United States Patent 9,205,144 (IDENTIFICATION OF CONSERVED PEPTIDE BLOCKS IN HOMOLOGOUS POLYPEPTIDES) - sequence listing, part 13

SEQ ID NO: 457771 - protein, 9 aa, Influenza virus
SYNAKLLVL

SEQ ID NO: 457772 - protein, 9 aa, Influenza virus
SYNAQLLVL

SEQ ID NO: 457773 - protein, 9 aa, Influenza virus
SYNAQLLVW

SEQ ID NO: 457774 - protein, 9 aa, Influenza virus
SYNARLLVL

SEQ ID NO: 457775 - protein, 9 aa, Influenza virus
SYNNTNGEQ

SEQ ID NO: 457776 - protein, 9 aa, Influenza virus
SYNNTSGEQ

SEQ ID NO: 457777 - protein, 9 aa, Influenza virus
SYNNTSGKQ

SEQ ID NO: 457778 - protein, 9 aa, Influenza virus
SYNYHQSFV

SEQ ID NO: 457779 - protein, 9 aa, Influenza virus
SYPNVRCVC

SEQ ID NO: 457780 - protein, 9 aa, Influenza virus
SYQVGYLCA

SEQ ID NO: 457781 - protein, 9 aa, Influenza virus
SYRRPIGIS

SEQ ID NO: 457782 - protein, 9 aa, Influenza virus
SYRRPVGIS

SEQ ID NO: 457783 - protein, 9 aa, Influenza virus
SYRSLIRFP

SEQ ID NO: 457784 - protein, 9 aa, Influenza virus
SYRTLLMNE

SEQ ID NO: 457785 - protein, 9 aa, Influenza virus
SYRTLLMSE

SEQ ID NO: 457786 - protein, 9 aa, Influenza virus
SYRVGYLCA

SEQ ID NO: 457787 - protein, 9 aa, Influenza virus
SYRYGNGVW

SEQ ID NO: 457788 - protein, 9 aa, Influenza virus
SYSAGALAS

SEQ ID NO: 457789 - protein, 9 aa, Influenza virus
SYSTGALAS

SEQ ID NO: 457790 - protein, 9 aa, Influenza virus
SYSVGYLCA

SEQ ID NO: 457791 - protein, 9 aa, Influenza virus
SYTVGYLCA

SEQ ID NO: 457792 - protein, 9 aa, Influenza virus
SYVCSGLVG

SEQ ID NO: 457793 - protein, 9 aa, Influenza virus
SYVRLYLWG

SEQ ID NO: 457794 - protein, 9 aa, Influenza virus
SYWWDGLQS

SEQ ID NO: 457795 - protein, 9 aa, Influenza virus
TAADLKSTQ

SEQ ID NO: 457796 - protein, 9 aa, Influenza virus
TAADYKSTP

SEQ ID NO: 457797 - protein, 9 aa, Influenza virus
TAADYKSTQ

SEQ ID NO: 457798 - protein, 9 aa, Influenza virus
TAAQKAMMD

SEQ ID NO: 457799 - protein, 9 aa, Influenza virus
TAAQRAMMD

SEQ ID NO: 457800 - protein, 9 aa, Influenza virus
TAAQRAMVD

SEQ ID NO: 457801 - protein, 9 aa, Influenza virus
TAASSLALA

SEQ ID NO: 457802 - protein, 9 aa, Influenza virus
TACFEIFHK

SEQ ID NO: 457803 - protein, 9 aa, Influenza virus
TACHDGKEW

SEQ ID NO: 457804 - protein, 9 aa, Influenza virus
TACHDGKGW

SEQ ID NO: 457805 - protein, 9 aa, Influenza virus
TACHDGKKW

SEQ ID NO: 457806 - protein, 9 aa, Influenza virus
TACHDGRKW

SEQ ID NO: 457807 - protein, 9 aa, Influenza virus
TACSDGPGW

SEQ ID NO: 457808 - protein, 9 aa, Influenza virus
TACSDGSGW

SEQ ID NO: 457809 - protein, 9 aa, Influenza virus
TADKDSNGV

SEQ ID NO: 457810 - protein, 9 aa, Influenza virus
TAEISHCRA

SEQ ID NO: 457811 - protein, 9 aa, Influenza virus
TAEVSHCRA

SEQ ID NO: 457812 - protein, 9 aa, Influenza virus
TAEVSYCRA

SEQ ID NO: 457813 - protein, 9 aa, Influenza virus
TAFRGLIST

SEQ ID NO: 457814 - protein, 9 aa, Influenza virus
TAFRGLMST

SEQ ID NO: 457815 - protein, 9 aa, Influenza virus
TAFSGMSAN

SEQ ID NO: 457816 - protein, 9 aa, Influenza virus
TAIDQINGK

SEQ ID NO: 457817 - protein, 9 aa, Influenza virus
TAIDQITGK

SEQ ID NO: 457818 - protein, 9 aa, Influenza virus
TAIFRKATR

SEQ ID NO: 457819 - protein, 9 aa, Influenza virus
TAIIRKATR

SEQ ID NO: 457820 - protein, 9 aa, Influenza virus
TAILKKATR

SEQ ID NO: 457821 - protein, 9 aa, Influenza virus
TAILRKATK

SEQ ID NO: 457822 - protein, 9 aa, Influenza virus
TAILRKATR

SEQ ID NO: 457823 - protein, 9 aa, Influenza virus
TAKAMEQMA

SEQ ID NO: 457824 - protein, 9 aa, Influenza virus
TAKAMEQVA

SEQ ID NO: 457825 - protein, 9 aa, Influenza virus
TAKHIEECS

SEQ ID NO: 457826 - protein, 9 aa, Influenza virus
TALANTIEI

SEQ ID NO: 457827 - protein, 9 aa, Influenza virus
TALANTIEV

SEQ ID NO: 457828 - protein, 9 aa, Influenza virus
TALLNASCA

SEQ ID NO: 457829 - protein, 9 aa, Influenza virus
TALSTIALL

SEQ ID NO: 457830 - protein, 9 aa, Influenza virus
TALYKNANT

SEQ ID NO: 457831 - protein, 9 aa, Influenza virus
TAMLCLGHH

SEQ ID NO: 457832 - protein, 9 aa, Influenza virus
TAMLNASCA

SEQ ID NO: 457833 - protein, 9 aa, Influenza virus
TANSIIVFC

SEQ ID NO: 457834 - protein, 9 aa, Influenza virus
TANTYRNTD

SEQ ID NO: 457835 - protein, 9 aa, Influenza virus
TAPHGLCYP

SEQ ID NO: 457836 - protein, 9 aa, Influenza virus
TAPILGNYK

SEQ ID NO: 457837 - protein, 9 aa, Influenza virus
TAPVLGNYK

SEQ ID NO: 457838 - protein, 9 aa, Influenza virus
TAPVLGNYR

SEQ ID NO: 457839 - protein, 9 aa, Influenza virus
TAQELVEAQ

SEQ ID NO: 457840 - protein, 9 aa, Influenza virus
TAQELVEPQ

SEQ ID NO: 457841 - protein, 9 aa, Influenza virus
TAQELVESK

SEQ ID NO: 457842 - protein, 9 aa, Influenza virus
TAQELVESQ

SEQ ID NO: 457843 - protein, 9 aa, Influenza virus
TAQHIEECS

SEQ ID NO: 457844 - protein, 9 aa, Influenza virus
TAQIIKLLP

SEQ ID NO: 457845 - protein, 9 aa, Influenza virus
TAQMALQLF

SEQ ID NO: 457846 - protein, 9 aa, Influenza virus
TASCLDKGA

SEQ ID NO: 457847 - protein, 9 aa, Influenza virus
TASCLDRGA

SEQ ID NO: 457848 - protein, 9 aa, Influenza virus
TASCLDRGT

SEQ ID NO: 457849 - protein, 9 aa, Influenza virus
TASCQNRGA

SEQ ID NO: 457850 - protein, 9 aa, Influenza virus
TASCRDNGA

SEQ ID NO: 457851 - protein, 9 aa, Influenza virus
TASLSPGMM

SEQ ID NO: 457852 - protein, 9 aa, Influenza virus
TASRAGYEM

SEQ ID NO: 457853 - protein, 9 aa, Influenza virus
TASRSGYEM

SEQ ID NO: 457854 - protein, 9 aa, Influenza virus
TASRSGYEV

SEQ ID NO: 457855 - protein, 9 aa, Influenza virus
TATKRIRMA

SEQ ID NO: 457856 - protein, 9 aa, Influenza virus
TATKRLRMA

SEQ ID NO: 457857 - protein, 9 aa, Influenza virus
TATLCLGHH

SEQ ID NO: 457858 - protein, 9 aa, Influenza virus
TATREGKHI

SEQ ID NO: 457859 - protein, 9 aa, Influenza virus
TATVYYDRR

SEQ ID NO: 457860 - protein, 9 aa, Influenza virus
TATVYYNGR

SEQ ID NO: 457861 - protein, 9 aa, Influenza virus
TATVYYNKR

SEQ ID NO: 457862 - protein, 9 aa, Influenza virus
TATVYYNRR

SEQ ID NO: 457863 - protein, 9 aa, Influenza virus
TAVAVIKYN

SEQ ID NO: 457864 - protein, 9 aa, Influenza virus
TAVAVLKYN

SEQ ID NO: 457865 - protein, 9 aa, Influenza virus
TAVDTCYPF

SEQ ID NO: 457866 - protein, 9 aa, Influenza virus
TAYELTDSS

SEQ ID NO: 457867 - protein, 9 aa, Influenza virus
TAYERMCNI

SEQ ID NO: 457868 - protein, 9 aa, Influenza virus
TAYSQITNG

SEQ ID NO: 457869 - protein, 9 aa, Influenza virus
TAYWWDGLQ

SEQ ID NO: 457870 - protein, 9 aa, Influenza virus
TCAVVMTDG

SEQ ID NO: 457871 - protein, 9 aa, Influenza virus
TCEQIADAQ

SEQ ID NO: 457872 - protein, 9 aa, Influenza virus
TCEQIADSH

SEQ ID NO: 457873 - protein, 9 aa, Influenza virus
TCEQIADSQ

SEQ ID NO: 457874 - protein, 9 aa, Influenza virus
TCGCRDNWQ

SEQ ID NO: 457875 - protein, 9 aa, Influenza virus
TCHDGIGRM

SEQ ID NO: 457876 - protein, 9 aa, Influenza virus
TCICRDNWQ

SEQ ID NO: 457877 - protein, 9 aa, Influenza virus
TCIVAVTDG

SEQ ID NO: 457878 - protein, 9 aa, Influenza virus
TCKLLGINM

SEQ ID NO: 457879 - protein, 9 aa, Influenza virus
TCKLVGINM

SEQ ID NO: 457880 - protein, 9 aa, Influenza virus
TCMETIRNG

SEQ ID NO: 457881 - protein, 9 aa, Influenza virus
TCNSGNCRF

SEQ ID NO: 457882 - protein, 9 aa, Influenza virus
TCRDNWKGS

SEQ ID NO: 457883 - protein, 9 aa, Influenza virus
TCRDNWQGS

SEQ ID NO: 457884 - protein, 9 aa, Influenza virus
TCSALFVYS

SEQ ID NO: 457885 - protein, 9 aa, Influenza virus
TCSNGSCRC

SEQ ID NO: 457886 - protein, 9 aa, Influenza virus
TCTCRDNWQ

SEQ ID NO: 457887 - protein, 9 aa, Influenza virus
TCTVIMTDG

SEQ ID NO: 457888 - protein, 9 aa, Influenza virus
TCTVVMTDG

SEQ ID NO: 457889 - protein, 9 aa, Influenza virus
TCVAVMTDG

SEQ ID NO: 457890 - protein, 9 aa, Influenza virus
TCVCRDNWH

SEQ ID NO: 457891 - protein, 9 aa, Influenza virus
TCVCRDNWK

SEQ ID NO: 457892 - protein, 9 aa, Influenza virus
TCVCRDNWQ

SEQ ID NO: 457893 - protein, 9 aa, Influenza virus
TCVCRDSWH

SEQ ID NO: 457894 - protein, 9 aa, Influenza virus
TCVVAVTDG

SEQ ID NO: 457895 - protein, 9 aa, Influenza virus
TCVVIMTDG

SEQ ID NO: 457896 - protein, 9 aa, Influenza virus
TCVVTVTDG

SEQ ID NO: 457897 - protein, 9 aa, Influenza virus
TCVVVMTDG

SEQ ID NO: 457898 - protein, 9 aa, Influenza virus
TCWEQLYTP

SEQ ID NO: 457899 - protein, 9 aa, Influenza virus
TCWEQMYTP

SEQ ID NO: 457900 - protein, 9 aa, Influenza virus
TCWSWPDGA

SEQ ID NO: 457901 - protein, 9 aa, Influenza virus
TCYPFDVPD

SEQ ID NO: 457902 - protein, 9 aa, Influenza virus
TCYPFDVPE

SEQ ID NO: 457903 - protein, 9 aa, Influenza virus
TCYPFDVPG

SEQ ID NO: 457904 - protein, 9 aa, Influenza virus
TCYPFDVPN

SEQ ID NO: 457905 - protein, 9 aa, Influenza virus
TDAEMNKLF

SEQ ID NO: 457906 - protein, 9 aa, Influenza virus
TDCVLEAMA

SEQ ID NO: 457907 - protein, 9 aa, Influenza virus
TDDPAANSA

SEQ ID NO: 457908 - protein, 9 aa, Influenza virus
TDELCPSPL

SEQ ID NO: 457909 - protein, 9 aa, Influenza virus
TDEYKNTGD

SEQ ID NO: 457910 - protein, 9 aa, Influenza virus
TDEYKNTRD

SEQ ID NO: 457911 - protein, 9 aa, Influenza virus
TDGATSACK

SEQ ID NO: 457912 - protein, 9 aa, Influenza virus
TDGNASGKA

SEQ ID NO: 457913 - protein, 9 aa, Influenza virus
TDGNASGRA

SEQ ID NO: 457914 - protein, 9 aa, Influenza virus
TDGPAANNA

SEQ ID NO: 457915 - protein, 9 aa, Influenza virus
TDGPAANSA

SEQ ID NO: 457916 - protein, 9 aa, Influenza virus
TDGPAASSA

SEQ ID NO: 457917 - protein, 9 aa, Influenza virus
TDGPADNKA

SEQ ID NO: 457918 - protein, 9 aa, Influenza virus
TDGPANDRA

SEQ ID NO: 457919 - protein, 9 aa, Influenza virus
TDGPANKQA

SEQ ID NO: 457920 - protein, 9 aa, Influenza virus
TDGPANNKA

SEQ ID NO: 457921 - protein, 9 aa, Influenza virus
TDGPANNQA

SEQ ID NO: 457922 - protein, 9 aa, Influenza virus
TDGPANNRA

SEQ ID NO: 457923 - protein, 9 aa, Influenza virus
TDGPANRQA

SEQ ID NO: 457924 - protein, 9 aa, Influenza virus
TDGPANSQA

SEQ ID NO: 457925 - protein, 9 aa, Influenza virus
TDGPANSRA

SEQ ID NO: 457926 - protein, 9 aa, Influenza virus
TDGPASNKA

SEQ ID NO: 457927 - protein, 9 aa, Influenza virus
TDGPASNQA

SEQ ID NO: 457928 - protein, 9 aa, Influenza virus
TDGPASSQA

SEQ ID NO: 457929 - protein, 9 aa, Influenza virus
TDGPSDAQA

SEQ ID NO: 457930 - protein, 9 aa, Influenza virus
TDGPSNAQA

SEQ ID NO: 457931 - protein, 9 aa, Influenza virus
TDGSANSQA

SEQ ID NO: 457932 - protein, 9 aa, Influenza virus
TDGSASGKA

SEQ ID NO: 457933 - protein, 9 aa, Influenza virus
TDGSASGQA

SEQ ID NO: 457934 - protein, 9 aa, Influenza virus
TDGSASGRA

SEQ ID NO: 457935 - protein, 9 aa, Influenza virus
TDGSASRKA

SEQ ID NO: 457936 - protein, 9 aa, Influenza virus
TDGSASSQA

SEQ ID NO: 457937 - protein, 9 aa, Influenza virus
TDGSASSRA

SEQ ID NO: 457938 - protein, 9 aa, Influenza virus
TDGSATGKA

SEQ ID NO: 457939 - protein, 9 aa, Influenza virus
TDGSATGPA

SEQ ID NO: 457940 - protein, 9 aa, Influenza virus
TDIWAYNAE

SEQ ID NO: 457941 - protein, 9 aa, Influenza virus
TDIWSYNAK

SEQ ID NO: 457942 - protein, 9 aa, Influenza virus
TDIWSYNAR

SEQ ID NO: 457943 - protein, 9 aa, Influenza virus
TDIWTYQAE

SEQ ID NO: 457944 - protein, 9 aa, Influenza virus
TDKDSNGVQ

SEQ ID NO: 457945 - protein, 9 aa, Influenza virus
TDKGSIQSD

SEQ ID NO: 457946 - protein, 9 aa, Influenza virus
TDKIDTLTE

SEQ ID NO: 457947 - protein, 9 aa, Influenza virus
TDKNSNGVQ

SEQ ID NO: 457948 - protein, 9 aa, Influenza virus
TDKVDTIIE

SEQ ID NO: 457949 - protein, 9 aa, Influenza virus
TDKVDTLTE

SEQ ID NO: 457950 - protein, 9 aa, Influenza virus
TDKVNTIIE

SEQ ID NO: 457951 - protein, 9 aa, Influenza virus
TDLEALMEW

SEQ ID NO: 457952 - protein, 9 aa, Influenza virus
TDLGAPLEL

SEQ ID NO: 457953 - protein, 9 aa, Influenza virus
TDLGQCGIL

SEQ ID NO: 457954 - protein, 9 aa, Influenza virus
TDLGQCGLL

SEQ ID NO: 457955 - protein, 9 aa, Influenza virus
TDLGSPLEL

SEQ ID NO: 457956 - protein, 9 aa, Influenza virus
TDLGTPLEL

SEQ ID NO: 457957 - protein, 9 aa, Influenza virus
TDLYKVATG

SEQ ID NO: 457958 - protein, 9 aa, Influenza virus
TDMGQCGLL

SEQ ID NO: 457959 - protein, 9 aa, Influenza virus
TDNHVEVVS

SEQ ID NO: 457960 - protein, 9 aa, Influenza virus
TDNPRPNDP

SEQ ID NO: 457961 - protein, 9 aa, Influenza virus
TDNYGVKGF

SEQ ID NO: 457962 - protein, 9 aa, Influenza virus
TDSEMDKLF

SEQ ID NO: 457963 - protein, 9 aa, Influenza virus
TDSEMLNLY

SEQ ID NO: 457964 - protein, 9 aa, Influenza virus
TDSEMNKLF

SEQ ID NO: 457965 - protein, 9 aa, Influenza virus
TDSEMNKLY

SEQ ID NO: 457966 - protein, 9 aa, Influenza virus
TDSEMNRLF

SEQ ID NO: 457967 - protein, 9 aa, Influenza virus
TDSEMSKLF

SEQ ID NO: 457968 - protein, 9 aa, Influenza virus
TDSEMSKLY

SEQ ID NO: 457969 - protein, 9 aa, Influenza virus
TDSIKSWRK

SEQ ID NO: 457970 - protein, 9 aa, Influenza virus
TDSIKSWRR

SEQ ID NO: 457971 - protein, 9 aa, Influenza virus
TDSQTATKR

SEQ ID NO: 457972 - protein, 9 aa, Influenza virus
TDTFKSWKG

SEQ ID NO: 457973 - protein, 9 aa, Influenza virus
TDTLKSWKG

SEQ ID NO: 457974 - protein, 9 aa, Influenza virus
TDTPRGEDS

SEQ ID NO: 457975 - protein, 9 aa, Influenza virus
TDTPRIQDS

SEQ ID NO: 457976 - protein, 9 aa, Influenza virus
TDTPRVQDD

SEQ ID NO: 457977 - protein, 9 aa, Influenza virus
TDTPRVQDG

SEQ ID NO: 457978 - protein, 9 aa, Influenza virus
TDTPRVQDN

SEQ ID NO: 457979 - protein, 9 aa, Influenza virus
TDTPRVQDS

SEQ ID NO: 457980 - protein, 9 aa, Influenza virus
TDTSKPSDK

SEQ ID NO: 457981 - protein, 9 aa, Influenza virus
TDTSRPGDK

SEQ ID NO: 457982 - protein, 9 aa, Influenza virus
TDTSRPGDR

SEQ ID NO: 457983 - protein, 9 aa, Influenza virus
TDTSRPKDK

SEQ ID NO: 457984 - protein, 9 aa, Influenza virus
TDTSRPNDP

SEQ ID NO: 457985 - protein, 9 aa, Influenza virus
TDTSRPSDK

SEQ ID NO: 457986 - protein, 9 aa, Influenza virus
TDTSRPSDP

SEQ ID NO: 457987 - protein, 9 aa, Influenza virus
TDTSRPSDR

SEQ ID NO: 457988 - protein, 9 aa, Influenza virus
TDTSRPTDP

SEQ ID NO: 457989 - protein, 9 aa, Influenza virus
TDTVDTILE

SEQ ID NO: 457990 - protein, 9 aa, Influenza virus
TDTVDTLIE

SEQ ID NO: 457991 - protein, 9 aa, Influenza virus
TDTVDTLLE

SEQ ID NO: 457992 - protein, 9 aa, Influenza virus
TDTVDTLTE

SEQ ID NO: 457993 - protein, 9 aa, Influenza virus
TDTVDTVLE

SEQ ID NO: 457994 - protein, 9 aa, Influenza virus
TDTVDTVRE

SEQ ID NO: 457995 - protein, 9 aa, Influenza virus
TDTVNTLIE

SEQ ID NO: 457996 - protein, 9 aa, Influenza virus
TDTVNTLME

SEQ ID NO: 457997 - protein, 9 aa, Influenza virus
TDTVNTLTE

SEQ ID NO: 457998 - protein, 9 aa, Influenza virus
TDVIRSWRK

SEQ ID NO: 457999 - protein, 9 aa, Influenza virus
TDVVNFLSM

SEQ ID NO: 458000 - protein, 9 aa, Influenza virus
TDVVNFVSM

SEQ ID NO: 458001 - protein, 9 aa, Influenza virus
TDVVNYVSM

SEQ ID NO: 458002 - protein, 9 aa, Influenza virus
TDVVRSWKK

SEQ ID NO: 458003 - protein, 9 aa, Influenza virus
TDVVRSWRK

SEQ ID NO: 458004 - protein, 9 aa, Influenza virus
TDVVRSWRR

SEQ ID NO: 458005 - protein, 9 aa, Influenza virus
TDVWSYNAK

SEQ ID NO: 458006 - protein, 9 aa, Influenza virus
TDVYCICRD

SEQ ID NO: 458007 - protein, 9 aa, Influenza virus
TDWSGYSGS

SEQ ID NO: 458008 - protein, 9 aa, Influenza virus
TECQLNEGI

SEQ ID NO: 458009 - protein, 9 aa, Influenza virus
TECQLNEGV

SEQ ID NO: 458010 - protein, 9 aa, Influenza virus
TECRTFFLT

SEQ ID NO: 458011 - protein, 9 aa, Influenza virus
TEDNIYKIL

SEQ ID NO: 458012 - protein, 9 aa, Influenza virus
TEDNVYKIL

SEQ ID NO: 458013 - protein, 9 aa, Influenza virus
TEDNVYKVL

SEQ ID NO: 458014 - protein, 9 aa, Influenza virus
TEEQAVDIC

SEQ ID NO: 458015 - protein, 9 aa, Influenza virus
TEEQAVGIC

SEQ ID NO: 458016 - protein, 9 aa, Influenza virus
TEEQAVNIC

SEQ ID NO: 458017 - protein, 9 aa, Influenza virus
TEFESIESE

SEQ ID NO: 458018 - protein, 9 aa, Influenza virus
TEFLGQWDW

SEQ ID NO: 458019 - protein, 9 aa, Influenza virus
TEFLGQWNW

SEQ ID NO: 458020 - protein, 9 aa, Influenza virus
TEGHIEECS

SEQ ID NO: 458021 - protein, 9 aa, Influenza virus
TEGRTSDMR

SEQ ID NO: 458022 - protein, 9 aa, Influenza virus
TEHQIGNVI

SEQ ID NO: 458023 - protein, 9 aa, Influenza virus
TEIASWAGN

SEQ ID NO: 458024 - protein, 9 aa, Influenza virus
TEIGAPQLN

SEQ ID NO: 458025 - protein, 9 aa, Influenza virus
TEIGVTRRE

SEQ ID NO: 458026 - protein, 9 aa, Influenza virus
TEIIIRMME

SEQ ID NO: 458027 - protein, 9 aa, Influenza virus
TEIMYLNNT

SEQ ID NO: 458028 - protein, 9 aa, Influenza virus
TEINTWARN

SEQ ID NO: 458029 - protein, 9 aa, Influenza virus
TEIPSWAGN

SEQ ID NO: 458030 - protein, 9 aa, Influenza virus
TEIPSWEGN

SEQ ID NO: 458031 - protein, 9 aa, Influenza virus
TEIRASVGK

SEQ ID NO: 458032 - protein, 9 aa, Influenza virus
TEIRASVGR

SEQ ID NO: 458033 - protein, 9 aa, Influenza virus
TEIRSSVGK

SEQ ID NO: 458034 - protein, 9 aa, Influenza virus
TEIRTSVGR

SEQ ID NO: 458035 - protein, 9 aa, Influenza virus
TEISFTITG

SEQ ID NO: 458036 - protein, 9 aa, Influenza virus
TEIVYLNDT

SEQ ID NO: 458037 - protein, 9 aa, Influenza virus
TEIVYLNHT

SEQ ID NO: 458038 - protein, 9 aa, Influenza virus
TEIVYLNNT

SEQ ID NO: 458039 - protein, 9 aa, Influenza virus
TEIVYLNST

SEQ ID NO: 458040 - protein, 9 aa, Influenza virus
TEIWSYNAE

SEQ ID NO: 458041 - protein, 9 aa, Influenza virus
TEIYNETVR

SEQ ID NO: 458042 - protein, 9 aa, Influenza virus
TEKGIEVVN

SEQ ID NO: 458043 - protein, 9 aa, Influenza virus
TEKGVEVVN

SEQ ID NO: 458044 - protein, 9 aa, Influenza virus
TEKVDTIIE

SEQ ID NO: 458045 - protein, 9 aa, Influenza virus
TEKVDTLLE

SEQ ID NO: 458046 - protein, 9 aa, Influenza virus
TELGAPLVL

SEQ ID NO: 458047 - protein, 9 aa, Influenza virus
TELGSPLVL

SEQ ID NO: 458048 - protein, 9 aa, Influenza virus
TELINPNKW

SEQ ID NO: 458049 - protein, 9 aa, Influenza virus
TELINPSKW

SEQ ID NO: 458050 - protein, 9 aa, Influenza virus
TELIPPSKW

SEQ ID NO: 458051 - protein, 9 aa, Influenza virus
TELISPNKW

SEQ ID NO: 458052 - protein, 9 aa, Influenza virus
TELISPSKW

SEQ ID NO: 458053 - protein, 9 aa, Influenza virus
TELLVLMEN

SEQ ID NO: 458054 - protein, 9 aa, Influenza virus
TELPFQNLS

SEQ ID NO: 458055 - protein, 9 aa, Influenza virus
TELSFTITG

SEQ ID NO: 458056 - protein, 9 aa, Influenza virus
TELSFTVTG

SEQ ID NO: 458057 - protein, 9 aa, Influenza virus
TELWSYNAE

SEQ ID NO: 458058 - protein, 9 aa, Influenza virus
TEMWSYNAE

SEQ ID NO: 458059 - protein, 9 aa, Influenza virus
TENGVPVTS

SEQ ID NO: 458060 - protein, 9 aa, Influenza virus
TENPVICLG

SEQ ID NO: 458061 - protein, 9 aa, Influenza virus
TENSFEQIT

SEQ ID NO: 458062 - protein, 9 aa, Influenza virus
TEPLCDVSG

SEQ ID NO: 458063 - protein, 9 aa, Influenza virus
TEPLCEVSG

SEQ ID NO: 458064 - protein, 9 aa, Influenza virus
TEPLCNVSG

SEQ ID NO: 458065 - protein, 9 aa, Influenza virus
TEQNVPVTQ

SEQ ID NO: 458066 - protein, 9 aa, Influenza virus
TEQTKLYGS

SEQ ID NO: 458067 - protein, 9 aa, Influenza virus
TEQTKLYKN

SEQ ID NO: 458068 - protein, 9 aa, Influenza virus
TEQVDTIME

SEQ ID NO: 458069 - protein, 9 aa, Influenza virus
TEREVEVVN

SEQ ID NO: 458070 - protein, 9 aa, Influenza virus
TERGIEVVN

SEQ ID NO: 458071 - protein, 9 aa, Influenza virus
TERGVEVVD

SEQ ID NO: 458072 - protein, 9 aa, Influenza virus
TERGVEVVN

SEQ ID NO: 458073 - protein, 9 aa, Influenza virus
TERQEIVDN

SEQ ID NO: 458074 - protein, 9 aa, Influenza virus
TERQEIVGN

SEQ ID NO: 458075 - protein, 9 aa, Influenza virus
TERVDTIIE

SEQ ID NO: 458076 - protein, 9 aa, Influenza virus
TERVDTIME

SEQ ID NO: 458077 - protein, 9 aa, Influenza virus
TESLQNRIQ

SEQ ID NO: 458078 - protein, 9 aa, Influenza virus
TESRGLFGA

SEQ ID NO: 458079 - protein, 9 aa, Influenza virus
TESSFEQIT

SEQ ID NO: 458080 - protein, 9 aa, Influenza virus
TETGALQLN

SEQ ID NO: 458081 - protein, 9 aa, Influenza virus
TETGAPQLN

SEQ ID NO: 458082 - protein, 9 aa, Influenza virus
TETGVPVTS

SEQ ID NO: 458083 - protein, 9 aa, Influenza virus
TETKAPQLN

SEQ ID NO: 458084 - protein, 9 aa, Influenza virus
TETLYLNHT

SEQ ID NO: 458085 - protein, 9 aa, Influenza virus
TETVEITGI

SEQ ID NO: 458086 - protein, 9 aa, Influenza virus
TETVNTLIE

SEQ ID NO: 458087 - protein, 9 aa, Influenza virus
TETVNTLSE

SEQ ID NO: 458088 - protein, 9 aa, Influenza virus
TETVNTLTE

SEQ ID NO: 458089 - protein, 9 aa, Influenza virus
TEVEGRIQD

SEQ ID NO: 458090 - protein, 9 aa, Influenza virus
TEVEKQIGN

SEQ ID NO: 458091 - protein, 9 aa, Influenza virus
TEVEQQIGN

SEQ ID NO: 458092 - protein, 9 aa, Influenza virus
TEVERQIGN

SEQ ID NO: 458093 - protein, 9 aa, Influenza virus
TEVETYVLS

SEQ ID NO: 458094 - protein, 9 aa, Influenza virus
TEVSHCRAT

SEQ ID NO: 458095 - protein, 9 aa, Influenza virus
TEVWSYNAD

SEQ ID NO: 458096 - protein, 9 aa, Influenza virus
TEVWSYNAE

SEQ ID NO: 458097 - protein, 9 aa, Influenza virus
TEVYNETVR

SEQ ID NO: 458098 - protein, 9 aa, Influenza virus
TEVYSETVR

SEQ ID NO: 458099 - protein, 9 aa, Influenza virus
TEWSGYSGS

SEQ ID NO: 458100 - protein, 9 aa, Influenza virus
TEYIIKGVY

SEQ ID NO: 458101 - protein, 9 aa, Influenza virus
TEYIMKGVY

SEQ ID NO: 458102 - protein, 9 aa, Influenza virus
TEYMMKGVY

SEQ ID NO: 458103 - protein, 9 aa, Influenza virus
TEYRQEALQ

SEQ ID NO: 458104 - protein, 9 aa, Influenza virus
TFCGLDNEP

SEQ ID NO: 458105 - protein, 9 aa, Influenza virus
TFCGLNNEP

SEQ ID NO: 458106 - protein, 9 aa, Influenza virus
TFDSLNITA

SEQ ID NO: 458107 - protein, 9 aa, Influenza virus
TFDTAQIIK

SEQ ID NO: 458108 - protein, 9 aa, Influenza virus
TFDTIQIIK

SEQ ID NO: 458109 - protein, 9 aa, Influenza virus
TFDTTQIIK

SEQ ID NO: 458110 - protein, 9 aa, Influenza virus
TFDTVQIIK

SEQ ID NO: 458111 - protein, 9 aa, Influenza virus
TFDTVQVIK

SEQ ID NO: 458112 - protein, 9 aa, Influenza virus
TFDWTLNRN

SEQ ID NO: 458113 - protein, 9 aa, Influenza virus
TFEFTSFFY

SEQ ID NO: 458114 - protein, 9 aa, Influenza virus
TFESDGAFL

SEQ ID NO: 458115 - protein, 9 aa, Influenza virus
TFESNGAFI

SEQ ID NO: 458116 - protein, 9 aa, Influenza virus
TFESNGAFL

SEQ ID NO: 458117 - protein, 9 aa, Influenza virus
TFESNGALL

SEQ ID NO: 458118 - protein, 9 aa, Influenza virus
TFESNGGFL

SEQ ID NO: 458119 - protein, 9 aa, Influenza virus
TFESNGGLI

SEQ ID NO: 458120 - protein, 9 aa, Influenza virus
TFESNGGLL

SEQ ID NO: 458121 - protein, 9 aa, Influenza virus
TFESNGVFL

SEQ ID NO: 458122 - protein, 9 aa, Influenza virus
TFESSGGLL

SEQ ID NO: 458123 - protein, 9 aa, Influenza virus
TFFLTHGAL

SEQ ID NO: 458124 - protein, 9 aa, Influenza virus
TFFLTHGSL

SEQ ID NO: 458125 - protein, 9 aa, Influenza virus
TFFLTQGAL

SEQ ID NO: 458126 - protein, 9 aa, Influenza virus
TFFLTQGSL

SEQ ID NO: 458127 - protein, 9 aa, Influenza virus
TFGDCPKYV

SEQ ID NO: 458128 - protein, 9 aa, Influenza virus
TFGPVHFQN

SEQ ID NO: 458129 - protein, 9 aa, Influenza virus
TFGPVHFRN

SEQ ID NO: 458130 - protein, 9 aa, Influenza virus
TFGPVHFRS

SEQ ID NO: 458131 - protein, 9 aa, Influenza virus
TFHGAKEIA

SEQ ID NO: 458132 - protein, 9 aa, Influenza virus
TFHGAKEIS

SEQ ID NO: 458133 - protein, 9 aa, Influenza virus
TFHGAKEVA

SEQ ID NO: 458134 - protein, 9 aa, Influenza virus
TFHGAKEVS

SEQ ID NO: 458135 - protein, 9 aa, Influenza virus
TFIFNGAFI

SEQ ID NO: 458136 - protein, 9 aa, Influenza virus
TFILWACQN

SEQ ID NO: 458137 - protein, 9 aa, Influenza virus
TFIQALQLL

SEQ ID NO: 458138 - protein, 9 aa, Influenza virus
TFKRTKGFS

SEQ ID NO: 458139 - protein, 9 aa, Influenza virus
TFKRTKGSS

SEQ ID NO: 458140 - protein, 9 aa, Influenza virus
TFKRTSGSS

SEQ ID NO: 458141 - protein, 9 aa, Influenza virus
TFKRTSGTS

SEQ ID NO: 458142 - protein, 9 aa, Influenza virus
TFKSWKGNI

SEQ ID NO: 458143 - protein, 9 aa, Influenza virus
TFKVIGGWS

SEQ ID NO: 458144 - protein, 9 aa, Influenza virus
TFKVIGGWT

SEQ ID NO: 458145 - protein, 9 aa, Influenza virus
TFLAMITYI

SEQ ID NO: 458146 - protein, 9 aa, Influenza virus
TFLARSALI

SEQ ID NO: 458147 - protein, 9 aa, Influenza virus
TFLHNGGLI

SEQ ID NO: 458148 - protein, 9 aa, Influenza virus
TFLQALQLL

SEQ ID NO: 458149 - protein, 9 aa, Influenza virus
TFLRSNAPS

SEQ ID NO: 458150 - protein, 9 aa, Influenza virus
TFMQALQLL

SEQ ID NO: 458151 - protein, 9 aa, Influenza virus
TFNFNGAFV

SEQ ID NO: 458152 - protein, 9 aa, Influenza virus
TFNGAFIAP

SEQ ID NO: 458153 - protein, 9 aa, Influenza virus
TFPYTGDPP

SEQ ID NO: 458154 - protein, 9 aa, Influenza virus
TFQNIDKNA

SEQ ID NO: 458155 - protein, 9 aa, Influenza virus
TFQNIDRNA

SEQ ID NO: 458156 - protein, 9 aa, Influenza virus
TFQNIEKNA

SEQ ID NO: 458157 - protein, 9 aa, Influenza virus
TFQNIERNA

SEQ ID NO: 458158 - protein, 9 aa, Influenza virus
TFQNISPVW

SEQ ID NO: 458159 - protein, 9 aa, Influenza virus
TFQNVSPIW

SEQ ID NO: 458160 - protein, 9 aa, Influenza virus
TFQNVSPLW

SEQ ID NO: 458161 - protein, 9 aa, Influenza virus
TFQNVSPVW

SEQ ID NO: 458162 - protein, 9 aa, Influenza virus
TFRGLLSTP

SEQ ID NO: 458163 - protein, 9 aa, Influenza virus
TFRVIDGWT

SEQ ID NO: 458164 - protein, 9 aa, Influenza virus
TFRVIGGWA

SEQ ID NO: 458165 - protein, 9 aa, Influenza virus
TFRVIGGWT

SEQ ID NO: 458166 - protein, 9 aa, Influenza virus
TFRVIGGWV

SEQ ID NO: 458167 - protein, 9 aa, Influenza virus
TFRVISGWT

SEQ ID NO: 458168 - protein, 9 aa, Influenza virus
TFSDNGGLI

SEQ ID NO: 458169 - protein, 9 aa, Influenza virus
TFSFNGAFI

SEQ ID NO: 458170 - protein, 9 aa, Influenza virus
TFSFNGAFV

SEQ ID NO: 458171 - protein, 9 aa, Influenza virus
TFSFQLILI

SEQ ID NO: 458172 - protein, 9 aa, Influenza virus
TFSFQLILL

SEQ ID NO: 458173 - protein, 9 aa, Influenza virus
TFSFQLINN

SEQ ID NO: 458174 - protein, 9 aa, Influenza virus
TFSHNGGLI

SEQ ID NO: 458175 - protein, 9 aa, Influenza virus
TFSHNGGRI

SEQ ID NO: 458176 - protein, 9 aa, Influenza virus
TFSPRSRSG

SEQ ID NO: 458177 - protein, 9 aa, Influenza virus
TFSVQRNLP

SEQ ID NO: 458178 - protein, 9 aa, Influenza virus
TFSVQRSLP

SEQ ID NO: 458179 - protein, 9 aa, Influenza virus
TFTFNGAFI

SEQ ID NO: 458180 - protein, 9 aa, Influenza virus
TFVNITNVQ

SEQ ID NO: 458181 - protein, 9 aa, Influenza virus
TFVNVTHVQ

SEQ ID NO: 458182 - protein, 9 aa, Influenza virus
TFVNVTNVQ

SEQ ID NO: 458183 - protein, 9 aa, Influenza virus
TGAINSSKP

SEQ ID NO: 458184 - protein, 9 aa, Influenza virus
TGAINSSRP

SEQ ID NO: 458185 - protein, 9 aa, Influenza virus
TGALASCMG

SEQ ID NO: 458186 - protein, 9 aa, Influenza virus
TGALQLNPI

SEQ ID NO: 458187 - protein, 9 aa, Influenza virus
TGAPQLNPI

SEQ ID NO: 458188 - protein, 9 aa, Influenza virus
TGAPQLNPV

SEQ ID NO: 458189 - protein, 9 aa, Influenza virus
TGAQSFYRS

SEQ ID NO: 458190 - protein, 9 aa, Influenza virus
TGARRIDFH

SEQ ID NO: 458191 - protein, 9 aa, Influenza virus
TGCFEIFHK

SEQ ID NO: 458192 - protein, 9 aa, Influenza virus
TGCFEIFHR

SEQ ID NO: 458193 - protein, 9 aa, Influenza virus
TGCKMYALH

SEQ ID NO: 458194 - protein, 9 aa, Influenza virus
TGCQLNEGV

SEQ ID NO: 458195 - protein, 9 aa, Influenza virus
TGDDGNATA

SEQ ID NO: 458196 - protein, 9 aa, Influenza virus
TGDDKNATA

SEQ ID NO: 458197 - protein, 9 aa, Influenza virus
TGDDRKATA

SEQ ID NO: 458198 - protein, 9 aa, Influenza virus
TGDDRNATA

SEQ ID NO: 458199 - protein, 9 aa, Influenza virus
TGDGCFEIL

SEQ ID NO: 458200 - protein, 9 aa, Influenza virus
TGDNTKWNE

SEQ ID NO: 458201 - protein, 9 aa, Influenza virus
TGDPPYSHG

SEQ ID NO: 458202 - protein, 9 aa, Influenza virus
TGFAPFSKD

SEQ ID NO: 458203 - protein, 9 aa, Influenza virus
TGFASFSKD

SEQ ID NO: 458204 - protein, 9 aa, Influenza virus
TGFHFEECS

SEQ ID NO: 458205 - protein, 9 aa, Influenza virus
TGFTYSGIR

SEQ ID NO: 458206 - protein, 9 aa, Influenza virus
TGGQAFYRS

SEQ ID NO: 458207 - protein, 9 aa, Influenza virus
TGGQSFYRS

SEQ ID NO: 458208 - protein, 9 aa, Influenza virus
TGIAADKAS

SEQ ID NO: 458209 - protein, 9 aa, Influenza virus
TGIAADKES

SEQ ID NO: 458210 - protein, 9 aa, Influenza virus
TGIAADKTS

SEQ ID NO: 458211 - protein, 9 aa, Influenza virus
TGIAADKVS

SEQ ID NO: 458212 - protein, 9 aa, Influenza virus
TGIAADRDS

SEQ ID NO: 458213 - protein, 9 aa, Influenza virus
TGIAADRES

SEQ ID NO: 458214 - protein, 9 aa, Influenza virus
TGIAADRGS

SEQ ID NO: 458215 - protein, 9 aa, Influenza virus
TGIAAEKES

SEQ ID NO: 458216 - protein, 9 aa, Influenza virus
TGIDKVCTK

SEQ ID NO: 458217 - protein, 9 aa, Influenza virus
TGILTDTSR

SEQ ID NO: 458218 - protein, 9 aa, Influenza virus
TGINKVCTK

SEQ ID NO: 458219 - protein, 9 aa, Influenza virus
TGIVADRDS

SEQ ID NO: 458220 - protein, 9 aa, Influenza virus
TGIWDTLIE

SEQ ID NO: 458221 - protein, 9 aa, Influenza virus
TGKDPKKTG

SEQ ID NO: 458222 - protein, 9 aa, Influenza virus
TGKGCFDIL

SEQ ID NO: 458223 - protein, 9 aa, Influenza virus
TGKLNRFIE

SEQ ID NO: 458224 - protein, 9 aa, Influenza virus
TGKLNRIIE

SEQ ID NO: 458225 - protein, 9 aa, Influenza virus
TGKLNRLID

SEQ ID NO: 458226 - protein, 9 aa, Influenza virus
TGKLNRLIE

SEQ ID NO: 458227 - protein, 9 aa, Influenza virus
TGKLNRLIG

SEQ ID NO: 458228 - protein, 9 aa, Influenza virus
TGKLNRLIS

SEQ ID NO: 458229 - protein, 9 aa, Influenza virus
TGKSHGRIL

SEQ ID NO: 458230 - protein, 9 aa, Influenza virus
TGKSHGRVL

SEQ ID NO: 458231 - protein, 9 aa, Influenza virus
TGLDCIRPC

SEQ ID NO: 458232 - protein, 9 aa, Influenza virus
TGLDCMRPC

SEQ ID NO: 458233 - protein, 9 aa, Influenza virus
TGLIDGWYG

SEQ ID NO: 458234 - protein, 9 aa, Influenza virus
TGLNCIRPC

SEQ ID NO: 458235 - protein, 9 aa, Influenza virus
TGLNCMRPC

SEQ ID NO: 458236 - protein, 9 aa, Influenza virus
TGLRNAHKM

SEQ ID NO: 458237 - protein, 9 aa, Influenza virus
TGLRNIPAI

SEQ ID NO: 458238 - protein, 9 aa, Influenza virus
TGLRNIPQI

SEQ ID NO: 458239 - protein, 9 aa, Influenza virus
TGLRNIPSI

SEQ ID NO: 458240 - protein, 9 aa, Influenza virus
TGLRNVPAI

SEQ ID NO: 458241 - protein, 9 aa, Influenza virus
TGLRNVPIP

SEQ ID NO: 458242 - protein, 9 aa, Influenza virus
TGLRNVPQI

SEQ ID NO: 458243 - protein, 9 aa, Influenza virus
TGLRNVPQM

SEQ ID NO: 458244 - protein, 9 aa, Influenza virus
TGLRNVPSI

SEQ ID NO: 458245 - protein, 9 aa, Influenza virus
TGLRNVPSV

SEQ ID NO: 458246 - protein, 9 aa, Influenza virus
TGMAADQKS

SEQ ID NO: 458247 - protein, 9 aa, Influenza virus
TGMAADRDS

SEQ ID NO: 458248 - protein, 9 aa, Influenza virus
TGMALSVVS

SEQ ID NO: 458249 - protein, 9 aa, Influenza virus
TGMDPRMCS

SEQ ID NO: 458250 - protein, 9 aa, Influenza virus
TGMIDGWYG

SEQ ID NO: 458251 - protein, 9 aa, Influenza virus
TGMILSVVS

SEQ ID NO: 458252 - protein, 9 aa, Influenza virus
TGMKNVPEI

SEQ ID NO: 458253 - protein, 9 aa, Influenza virus
TGMKNVPET

SEQ ID NO: 458254 - protein, 9 aa, Influenza virus
TGMRILVRG

SEQ ID NO: 458255 - protein, 9 aa, Influenza virus
TGMRNIPEK

SEQ ID NO: 458256 - protein, 9 aa, Influenza virus
TGMRNIPEN

SEQ ID NO: 458257 - protein, 9 aa, Influenza virus
TGMRNIPER

SEQ ID NO: 458258 - protein, 9 aa, Influenza virus
TGMRNIPGK

SEQ ID NO: 458259 - protein, 9 aa, Influenza virus
TGMRNVPEI

SEQ ID NO: 458260 - protein, 9 aa, Influenza virus
TGMRNVPEK

SEQ ID NO: 458261 - protein, 9 aa, Influenza virus
TGMRNVPEN

SEQ ID NO: 458262 - protein, 9 aa, Influenza virus
TGMRNVPER

SEQ ID NO: 458263 - protein, 9 aa, Influenza virus
TGMRNVPET

SEQ ID NO: 458264 - protein, 9 aa, Influenza virus
TGMRNVPEV

SEQ ID NO: 458265 - protein, 9 aa, Influenza virus
TGMTLSVVN

SEQ ID NO: 458266 - protein, 9 aa, Influenza virus
TGMTLSVVS

SEQ ID NO: 458267 - protein, 9 aa, Influenza virus
TGMVDGWYG

SEQ ID NO: 458268 - protein, 9 aa, Influenza virus
TGMVNGWYG

SEQ ID NO: 458269 - protein, 9 aa, Influenza virus
TGMWDTLIE

SEQ ID NO: 458270 - protein, 9 aa, Influenza virus
TGNDRNATA

SEQ ID NO: 458271 - protein, 9 aa, Influenza virus
TGNFIAPEY

SEQ ID NO: 458272 - protein, 9 aa, Influenza virus
TGNGCFDIL

SEQ ID NO: 458273 - protein, 9 aa, Influenza virus
TGNGCFEFY

SEQ ID NO: 458274 - protein, 9 aa, Influenza virus
TGNHGSLVL

SEQ ID NO: 458275 - protein, 9 aa, Influenza virus
TGNKLITVG

SEQ ID NO: 458276 - protein, 9 aa, Influenza virus
TGNLIAPEY

SEQ ID NO: 458277 - protein, 9 aa, Influenza virus
TGNLIAPRG

SEQ ID NO: 458278 - protein, 9 aa, Influenza virus
TGNLQALKI

SEQ ID NO: 458279 - protein, 9 aa, Influenza virus
TGNLQTLKI

SEQ ID NO: 458280 - protein, 9 aa, Influenza virus
TGNLQTLKL

SEQ ID NO: 458281 - protein, 9 aa, Influenza virus
TGNLQTLKV

SEQ ID NO: 458282 - protein, 9 aa, Influenza virus
TGNLQTLRI

SEQ ID NO: 458283 - protein, 9 aa, Influenza virus
TGNLVAPEY

SEQ ID NO: 458284 - protein, 9 aa, Influenza virus
TGNPIICLG

SEQ ID NO: 458285 - protein, 9 aa, Influenza virus
TGNPVICLG

SEQ ID NO: 458286 - protein, 9 aa, Influenza virus
TGNPVICMG

SEQ ID NO: 458287 - protein, 9 aa, Influenza virus
TGPADTRIY

SEQ ID NO: 458288 - protein, 9 aa, Influenza virus
TGPADTRVY

SEQ ID NO: 458289 - protein, 9 aa, Influenza virus
TGPAETRIY

SEQ ID NO: 458290 - protein, 9 aa, Influenza virus
TGPAETRVY

SEQ ID NO: 458291 - protein, 9 aa, Influenza virus
TGPDATAVA

SEQ ID NO: 458292 - protein, 9 aa, Influenza virus
TGPDSTAVA

SEQ ID NO: 458293 - protein, 9 aa, Influenza virus
TGPDTTAVA

SEQ ID NO: 458294 - protein, 9 aa, Influenza virus
TGPPQCDLF

SEQ ID NO: 458295 - protein, 9 aa, Influenza virus
TGPPQCDQF

SEQ ID NO: 458296 - protein, 9 aa, Influenza virus
TGPRNVPAI

SEQ ID NO: 458297 - protein, 9 aa, Influenza virus
TGPRNVPQI

SEQ ID NO: 458298 - protein, 9 aa, Influenza virus
TGQAADLKS

SEQ ID NO: 458299 - protein, 9 aa, Influenza virus
TGQAADYES

SEQ ID NO: 458300 - protein, 9 aa, Influenza virus
TGQAADYKS

SEQ ID NO: 458301 - protein, 9 aa, Influenza virus
TGRDVLVIW

SEQ ID NO: 458302 - protein, 9 aa, Influenza virus
TGRDVLVLW

SEQ ID NO: 458303 - protein, 9 aa, Influenza virus
TGRDVLVMW

SEQ ID NO: 458304 - protein, 9 aa, Influenza virus
TGRGIEVVN

SEQ ID NO: 458305 - protein, 9 aa, Influenza virus
TGRIDFHWL

SEQ ID NO: 458306 - protein, 9 aa, Influenza virus
TGRIFQSGI

SEQ ID NO: 458307 - protein, 9 aa, Influenza virus
TGRIFQSGV

SEQ ID NO: 458308 - protein, 9 aa, Influenza virus
TGRIFQSRI

SEQ ID NO: 458309 - protein, 9 aa, Influenza virus
TGRNCTIPC

SEQ ID NO: 458310 - protein, 9 aa, Influenza virus
TGRNCTVPC

SEQ ID NO: 458311 - protein, 9 aa, Influenza virus
TGRQEIVDN

SEQ ID NO: 458312 - protein, 9 aa, Influenza virus
TGRSSFFRN

SEQ ID NO: 458313 - protein, 9 aa, Influenza virus
TGRVTVSTR

SEQ ID NO: 458314 - protein, 9 aa, Influenza virus
TGSFCSIDG

SEQ ID NO: 458315 - protein, 9 aa, Influenza virus
TGSFCSING

SEQ ID NO: 458316 - protein, 9 aa, Influenza virus
TGSIYIEVL

SEQ ID NO: 458317 - protein, 9 aa, Influenza virus
TGSPGAPGV

SEQ ID NO: 458318 - protein, 9 aa, Influenza virus
TGSPSAPGV

SEQ ID NO: 458319 - protein, 9 aa, Influenza virus
TGSSFYAEM

SEQ ID NO: 458320 - protein, 9 aa, Influenza virus
TGSVYIEVL

SEQ ID NO: 458321 - protein, 9 aa, Influenza virus
TGSWADGAN

SEQ ID NO: 458322 - protein, 9 aa, Influenza virus
TGSWPDGAD

SEQ ID NO: 458323 - protein, 9 aa, Influenza virus
TGSWPDGAE

SEQ ID NO: 458324 - protein, 9 aa, Influenza virus
TGSWPDGAN

SEQ ID NO: 458325 - protein, 9 aa, Influenza virus
TGSYVRLYL

SEQ ID NO: 458326 - protein, 9 aa, Influenza virus
TGTAADLKS

SEQ ID NO: 458327 - protein, 9 aa, Influenza virus
TGTAKHIEE

SEQ ID NO: 458328 - protein, 9 aa, Influenza virus
TGTAKQNYL

SEQ ID NO: 458329 - protein, 9 aa, Influenza virus
TGTFCSING

SEQ ID NO: 458330 - protein, 9 aa, Influenza virus
TGTFEFTSF

SEQ ID NO: 458331 - protein, 9 aa, Influenza virus
TGTGYTMDT

SEQ ID NO: 458332 - protein, 9 aa, Influenza virus
TGTLNRLID

SEQ ID NO: 458333 - protein, 9 aa, Influenza virus
TGTNRPILV

SEQ ID NO: 458334 - protein, 9 aa, Influenza virus
TGTNRPVLI

SEQ ID NO: 458335 - protein, 9 aa, Influenza virus
TGTNRPVLV

SEQ ID NO: 458336 - protein, 9 aa, Influenza virus
TGTNRPVVV

SEQ ID NO: 458337 - protein, 9 aa, Influenza virus
TGTNSFYRN

SEQ ID NO: 458338 - protein, 9 aa, Influenza virus
TGTSSFYRN

SEQ ID NO: 458339 - protein, 9 aa, Influenza virus
TGTWDTLIE

SEQ ID NO: 458340 - protein, 9 aa, Influenza virus
TGTYCSLDG

SEQ ID NO: 458341 - protein, 9 aa, Influenza virus
TGTYCSLGG

SEQ ID NO: 458342 - protein, 9 aa, Influenza virus
TGTYCSLNG

SEQ ID NO: 458343 - protein, 9 aa, Influenza virus
TGTYCSLSG

SEQ ID NO: 458344 - protein, 9 aa, Influenza virus
TGVDCIRPC

SEQ ID NO: 458345 - protein, 9 aa, Influenza virus
TGVDEYSST

SEQ ID NO: 458346 - protein, 9 aa, Influenza virus
TGVESAVLR

SEQ ID NO: 458347 - protein, 9 aa, Influenza virus
TGVLTDTSR

SEQ ID NO: 458348 - protein, 9 aa, Influenza virus
TGVPVTSSV

SEQ ID NO: 458349 - protein, 9 aa, Influenza virus
TGVTLSVVS

SEQ ID NO: 458350 - protein, 9 aa, Influenza virus
TGWSWPDGA

SEQ ID NO: 458351 - protein, 9 aa, Influenza virus
TGYAQTDCV

SEQ ID NO: 458352 - protein, 9 aa, Influenza virus
TGYEKNATA

SEQ ID NO: 458353 - protein, 9 aa, Influenza virus
TGYHFEECS

SEQ ID NO: 458354 - protein, 9 aa, Influenza virus
TGYICSKFH

SEQ ID NO: 458355 - protein, 9 aa, Influenza virus
TGYTMDTVN

SEQ ID NO: 458356 - protein, 9 aa, Influenza virus
TGYTMDTVS

SEQ ID NO: 458357 - protein, 9 aa, Influenza virus
TGYVCSKFH

SEQ ID NO: 458358 - protein, 9 aa, Influenza virus
THAEDILEK

SEQ ID NO: 458359 - protein, 9 aa, Influenza virus
THAKDILEK

SEQ ID NO: 458360 - protein, 9 aa, Influenza virus
THAKNILEK

SEQ ID NO: 458361 - protein, 9 aa, Influenza virus
THALRELWQ

SEQ ID NO: 458362 - protein, 9 aa, Influenza virus
THAQDILEK

SEQ ID NO: 458363 - protein, 9 aa, Influenza virus
THAQDILER

SEQ ID NO: 458364 - protein, 9 aa, Influenza virus
THAQDLLEK

SEQ ID NO: 458365 - protein, 9 aa, Influenza virus
THAQNILEK

SEQ ID NO: 458366 - protein, 9 aa, Influenza virus
THDRTAFRG

SEQ ID NO: 458367 - protein, 9 aa, Influenza virus
THESECVCI

SEQ ID NO: 458368 - protein, 9 aa, Influenza virus
THFEKIKIL

SEQ ID NO: 458369 - protein, 9 aa, Influenza virus
THFEKVKIL

SEQ ID NO: 458370 - protein, 9 aa, Influenza virus
THFQRKRRI

SEQ ID NO: 458371 - protein, 9 aa, Influenza virus
THFQRKRRV

SEQ ID NO: 458372 - protein, 9 aa, Influenza virus
THGALLNDK

SEQ ID NO: 458373 - protein, 9 aa, Influenza virus
THGSLLNDK

SEQ ID NO: 458374 - protein, 9 aa, Influenza virus
THGTGSWPD

SEQ ID NO: 458375 - protein, 9 aa, Influenza virus
THHMRKKRG

SEQ ID NO: 458376 - protein, 9 aa, Influenza virus
THIHIFSFN

SEQ ID NO: 458377 - protein, 9 aa, Influenza virus
THIHIFSFT

SEQ ID NO: 458378 - protein, 9 aa, Influenza virus
THIMIWHSN

SEQ ID NO: 458379 - protein, 9 aa, Influenza virus
THISKYLCS

SEQ ID NO: 458380 - protein, 9 aa, Influenza virus
THISVGTST

SEQ ID NO: 458381 - protein, 9 aa, Influenza virus
THKQLTHHM

SEQ ID NO: 458382 - protein, 9 aa, Influenza virus
THLEICFMY

SEQ ID NO: 458383 - protein, 9 aa, Influenza virus
THLEVCFMY

SEQ ID NO: 458384 - protein, 9 aa, Influenza virus
THLMIWHSN

SEQ ID NO: 458385 - protein, 9 aa, Influenza virus
THMEVCFMY

SEQ ID NO: 458386 - protein, 9 aa, Influenza virus
THMMIWHSN

SEQ ID NO: 458387 - protein, 9 aa, Influenza virus
THMSKYLCS

SEQ ID NO: 458388 - protein, 9 aa, Influenza virus
THNGKLCKL

SEQ ID NO: 458389 - protein, 9 aa, Influenza virus
THNGKLCRL

SEQ ID NO: 458390 - protein, 9 aa, Influenza virus
THNGRLCKL

SEQ ID NO: 458391 - protein, 9 aa, Influenza virus
THQYSEKGK

SEQ ID NO: 458392 - protein, 9 aa, Influenza virus
THQYSEKGR

SEQ ID NO: 458393 - protein, 9 aa, Influenza virus
THQYSERGK

SEQ ID NO: 458394 - protein, 9 aa, Influenza virus
THQYSERGR

SEQ ID NO: 458395 - protein, 9 aa, Influenza virus
THSIELLEN

SEQ ID NO: 458396 - protein, 9 aa, Influenza virus
THSIELLES

SEQ ID NO: 458397 - protein, 9 aa, Influenza virus
THSSKYLCS

SEQ ID NO: 458398 - protein, 9 aa, Influenza virus
THSVELLED

SEQ ID NO: 458399 - protein, 9 aa, Influenza virus
THSVELLEN

SEQ ID NO: 458400 - protein, 9 aa, Influenza virus
THSVELLES

SEQ ID NO: 458401 - protein, 9 aa, Influenza virus
THSWIPKRN

SEQ ID NO: 458402 - protein, 9 aa, Influenza virus
THSWTPKRN

SEQ ID NO: 458403 - protein, 9 aa, Influenza virus
THSWVPILN

SEQ ID NO: 458404 - protein, 9 aa, Influenza virus
THSWVPKRN

SEQ ID NO: 458405 - protein, 9 aa, Influenza virus
THTGTSKAC

SEQ ID NO: 458406 - protein, 9 aa, Influenza virus
THTGTYCSL

SEQ ID NO: 458407 - protein, 9 aa, Influenza virus
THTSKYLCS

SEQ ID NO: 458408 - protein, 9 aa, Influenza virus
THTSQYICS

SEQ ID NO: 458409 - protein, 9 aa, Influenza virus
THTSRYLCS

SEQ ID NO: 458410 - protein, 9 aa, Influenza virus
THVQNNYTT

SEQ ID NO: 458411 - protein, 9 aa, Influenza virus
TIAGFIEGG

SEQ ID NO: 458412 - protein, 9 aa, Influenza virus
TIALFIGVG

SEQ ID NO: 458413 - protein, 9 aa, Influenza virus
TIALIIGVG

SEQ ID NO: 458414 - protein, 9 aa, Influenza virus
TIALLIGIG

SEQ ID NO: 458415 - protein, 9 aa, Influenza virus
TIALLIGVG

SEQ ID NO: 458416 - protein, 9 aa, Influenza virus
TIASDILKR

SEQ ID NO: 458417 - protein, 9 aa, Influenza virus
TIASDILTR

SEQ ID NO: 458418 - protein, 9 aa, Influenza virus
TIASSLPFQ

SEQ ID NO: 458419 - protein, 9 aa, Influenza virus
TICIGYHAN

SEQ ID NO: 458420 - protein, 9 aa, Influenza virus
TICIQGNND

SEQ ID NO: 458421 - protein, 9 aa, Influenza virus
TICVGYHAN

SEQ ID NO: 458422 - protein, 9 aa, Influenza virus
TICVQGNND

SEQ ID NO: 458423 - protein, 9 aa, Influenza virus
TICVQGNNK

SEQ ID NO: 458424 - protein, 9 aa, Influenza virus
TICVQGNNN

SEQ ID NO: 458425 - protein, 9 aa, Influenza virus
TIDEESRAR

SEQ ID NO: 458426 - protein, 9 aa, Influenza virus
TIDLADSEM

SEQ ID NO: 458427 - protein, 9 aa, Influenza virus
TIDLTDAEM

SEQ ID NO: 458428 - protein, 9 aa, Influenza virus
TIDLTDSEM

SEQ ID NO: 458429 - protein, 9 aa, Influenza virus
TIDLTNSEM

SEQ ID NO: 458430 - protein, 9 aa, Influenza virus
TIDMADSEM

SEQ ID NO: 458431 - protein, 9 aa, Influenza virus
TIDMTDSEM

SEQ ID NO: 458432 - protein, 9 aa, Influenza virus
TIDQITGKL

SEQ ID NO: 458433 - protein, 9 aa, Influenza virus
TIDQVTGKL

SEQ ID NO: 458434 - protein, 9 aa, Influenza virus
TIDSTDSEM

SEQ ID NO: 458435 - protein, 9 aa, Influenza virus
TIDVTDSEM

SEQ ID NO: 458436 - protein, 9 aa, Influenza virus
TIEKMVLSA

SEQ ID NO: 458437 - protein, 9 aa, Influenza virus
TIEMTDSEM

SEQ ID NO: 458438 - protein, 9 aa, Influenza virus
TIERMVLSA

SEQ ID NO: 458439 - protein, 9 aa, Influenza virus
TIGDCPKYM

SEQ ID NO: 458440 - protein, 9 aa, Influenza virus
TIGDCPKYV

SEQ ID NO: 458441 - protein, 9 aa, Influenza virus
TIGECPKYI

SEQ ID NO: 458442 - protein, 9 aa, Influenza virus
TIGECPKYV

SEQ ID NO: 458443 - protein, 9 aa, Influenza virus
TIGECPRYV

SEQ ID NO: 458444 - protein, 9 aa, Influenza virus
TIGISGPDD

SEQ ID NO: 458445 - protein, 9 aa, Influenza virus
TIGISGPDN

SEQ ID NO: 458446 - protein, 9 aa, Influenza virus
TIGISGPDS

SEQ ID NO: 458447 - protein, 9 aa, Influenza virus
TIGITGPDA

SEQ ID NO: 458448 - protein, 9 aa, Influenza virus
TIGKCPKYV

SEQ ID NO: 458449 - protein, 9 aa, Influenza virus
TIGKCSKYV

SEQ ID NO: 458450 - protein, 9 aa, Influenza virus
TIGLLLQII

SEQ ID NO: 458451 - protein, 9 aa, Influenza virus
TIGLLLQIT

SEQ ID NO: 458452 - protein, 9 aa, Influenza virus
TIGNLIAPR

SEQ ID NO: 458453 - protein, 9 aa, Influenza virus
TIGNLVAPR

SEQ ID NO: 458454 - protein, 9 aa, Influenza virus
TIGSASLGL

SEQ ID NO: 458455 - protein, 9 aa, Influenza virus
TIGSISLGL

SEQ ID NO: 458456 - protein, 9 aa, Influenza virus
TIGSMSLAL

SEQ ID NO: 458457 - protein, 9 aa, Influenza virus
TIGSVSLAL

SEQ ID NO: 458458 - protein, 9 aa, Influenza virus
TIGSVSLII

SEQ ID NO: 458459 - protein, 9 aa, Influenza virus
TIGSVSLTI

SEQ ID NO: 458460 - protein, 9 aa, Influenza virus
TIGSVSLTL

SEQ ID NO: 458461 - protein, 9 aa, Influenza virus
TIGVSGPDN

SEQ ID NO: 458462 - protein, 9 aa, Influenza virus
TIHDGTAFR

SEQ ID NO: 458463 - protein, 9 aa, Influenza virus
TIHDRAAFR

SEQ ID NO: 458464 - protein, 9 aa, Influenza virus
TIHDRIPHR

SEQ ID NO: 458465 - protein, 9 aa, Influenza virus
TIHDRSPFR

SEQ ID NO: 458466 - protein, 9 aa, Influenza virus
TIHDRSPHR

SEQ ID NO: 458467 - protein, 9 aa, Influenza virus
TIHDRSPYR

SEQ ID NO: 458468 - protein, 9 aa, Influenza virus
TIHDRSQFR

SEQ ID NO: 458469 - protein, 9 aa, Influenza virus
TIHDRSQYR

SEQ ID NO: 458470 - protein, 9 aa, Influenza virus
TIHDRTAFR

SEQ ID NO: 458471 - protein, 9 aa, Influenza virus
TIHDRTPHR

SEQ ID NO: 458472 - protein, 9 aa, Influenza virus
TIHDRTTFR

SEQ ID NO: 458473 - protein, 9 aa, Influenza virus
TIHLTDSEM

SEQ ID NO: 458474 - protein, 9 aa, Influenza virus
TIIENNVTV

SEQ ID NO: 458475 - protein, 9 aa, Influenza virus
TIIESNVTV

SEQ ID NO: 458476 - protein, 9 aa, Influenza virus
TIIETGYVC

SEQ ID NO: 458477 - protein, 9 aa, Influenza virus
TIIFEANGN

SEQ ID NO: 458478 - protein, 9 aa, Influenza virus
TIIFEASGN

SEQ ID NO: 458479 - protein, 9 aa, Influenza virus
TIIFEATGN

SEQ ID NO: 458480 - protein, 9 aa, Influenza virus
TIIGPPQCD

SEQ ID NO: 458481 - protein, 9 aa, Influenza virus
TIINNYHNE

SEQ ID NO: 458482 - protein, 9 aa, Influenza virus
TIINNYYND

SEQ ID NO: 458483 - protein, 9 aa, Influenza virus
TIINNYYNE

SEQ ID NO: 458484 - protein, 9 aa, Influenza virus
TIINNYYNK

SEQ ID NO: 458485 - protein, 9 aa, Influenza virus
TIISNLPFQ

SEQ ID NO: 458486 - protein, 9 aa, Influenza virus
TIISSLPFQ

SEQ ID NO: 458487 - protein, 9 aa, Influenza virus
TIIYSSSMM

SEQ ID NO: 458488 - protein, 9 aa, Influenza virus
TIKDRSPYR

SEQ ID NO: 458489 - protein, 9 aa, Influenza virus
TIKNGTYDH

SEQ ID NO: 458490 - protein, 9 aa, Influenza virus
TIKNGTYNH

SEQ ID NO: 458491 - protein, 9 aa, Influenza virus
TIKNGTYNR

SEQ ID NO: 458492 - protein, 9 aa, Influenza virus
TIKPWARNI

SEQ ID NO: 458493 - protein, 9 aa, Influenza virus
TIKQNGKSG

SEQ ID NO: 458494 - protein, 9 aa, Influenza virus
TIKTWAGKI

SEQ ID NO: 458495 - protein, 9 aa, Influenza virus
TIKTWAGNI

SEQ ID NO: 458496 - protein, 9 aa, Influenza virus
TIKTWAKNI

SEQ ID NO: 458497 - protein, 9 aa, Influenza virus
TIKTWARNI

SEQ ID NO: 458498 - protein, 9 aa, Influenza virus
TILEKNITV

SEQ ID NO: 458499 - protein, 9 aa, Influenza virus
TILEKNVTV

SEQ ID NO: 458500 - protein, 9 aa, Influenza virus
TILEQNVTV

SEQ ID NO: 458501 - protein, 9 aa, Influenza virus
TILERNVTV

SEQ ID NO: 458502 - protein, 9 aa, Influenza virus
TILETGYIC

SEQ ID NO: 458503 - protein, 9 aa, Influenza virus
TILETGYVC

SEQ ID NO: 458504 - protein, 9 aa, Influenza virus
TILETRYVC

SEQ ID NO: 458505 - protein, 9 aa, Influenza virus
TILRTQESE

SEQ ID NO: 458506 - protein, 9 aa, Influenza virus
TIMEKNVTV

SEQ ID NO: 458507 - protein, 9 aa, Influenza virus
TIMERNVTV

SEQ ID NO: 458508 - protein, 9 aa, Influenza virus
TINDRSPFR

SEQ ID NO: 458509 - protein, 9 aa, Influenza virus
TINEEALRQ

SEQ ID NO: 458510 - protein, 9 aa, Influenza virus
TINFESTGN

SEQ ID NO: 458511 - protein, 9 aa, Influenza virus
TINRIFQPN

SEQ ID NO: 458512 - protein, 9 aa, Influenza virus
TINRNFQPN

SEQ ID NO: 458513 - protein, 9 aa, Influenza virus
TINRSFQPN

SEQ ID NO: 458514 - protein, 9 aa, Influenza virus
TINRSFRPN

SEQ ID NO: 458515 - protein, 9 aa, Influenza virus
TINSKIDDQ

SEQ ID NO: 458516 - protein, 9 aa, Influenza virus
TINSPLPFQ

SEQ ID NO: 458517 - protein, 9 aa, Influenza virus
TINSWHIFG

SEQ ID NO: 458518 - protein, 9 aa, Influenza virus
TINSWHIYG

SEQ ID NO: 458519 - protein, 9 aa, Influenza virus
TINTASRSG

SEQ ID NO: 458520 - protein, 9 aa, Influenza virus
TINYYNETF

SEQ ID NO: 458521 - protein, 9 aa, Influenza virus
TIPCFWVEM

SEQ ID NO: 458522 - protein, 9 aa, Influenza virus
TIPINNTIY

SEQ ID NO: 458523 - protein, 9 aa, Influenza virus
TIPINNTVY

SEQ ID NO: 458524 - protein, 9 aa, Influenza virus
TIPVNNTIY

SEQ ID NO: 458525 - protein, 9 aa, Influenza virus
TIQIIKLLP

SEQ ID NO: 458526 - protein, 9 aa, Influenza virus
TIQNEDIPI

SEQ ID NO: 458527 - protein, 9 aa, Influenza virus
TIREKNVTV

SEQ ID NO: 458528 - protein, 9 aa, Influenza virus
TIRGKHSNG

SEQ ID NO: 458529 - protein, 9 aa, Influenza virus
TIRGRHSNG

SEQ ID NO: 458530 - protein, 9 aa, Influenza virus
TIRNGTYDH

SEQ ID NO: 458531 - protein, 9 aa, Influenza virus
TIRNGTYNH

SEQ ID NO: 458532 - protein, 9 aa, Influenza virus
TIRNKHSNG

SEQ ID NO: 458533 - protein, 9 aa, Influenza virus
TIRNKHSNS

SEQ ID NO: 458534 - protein, 9 aa, Influenza virus
TIRNRHSNG

SEQ ID NO: 458535 - protein, 9 aa, Influenza virus
TIRQELASR

SEQ ID NO: 458536 - protein, 9 aa, Influenza virus
TIRQEMAIR

SEQ ID NO: 458537 - protein, 9 aa, Influenza virus
TIRQEMANR

SEQ ID NO: 458538 - protein, 9 aa, Influenza virus
TIRQEMASK

SEQ ID NO: 458539 - protein, 9 aa, Influenza virus
TIRQEMASR

SEQ ID NO: 458540 - protein, 9 aa, Influenza virus
TIRTGTYNH

SEQ ID NO: 458541 - protein, 9 aa, Influenza virus
TIRTWAKNI

SEQ ID NO: 458542 - protein, 9 aa, Influenza virus
TISCDSPSN

SEQ ID NO: 458543 - protein, 9 aa, Influenza virus
TISFESTGN

SEQ ID NO: 458544 - protein, 9 aa, Influenza virus
TISIASRSG

SEQ ID NO: 458545 - protein, 9 aa, Influenza virus
TISKDLRSG

SEQ ID NO: 458546 - protein, 9 aa, Influenza virus
TISKDSRSG

SEQ ID NO: 458547 - protein, 9 aa, Influenza virus
TISKDTRSG

SEQ ID NO: 458548 - protein, 9 aa, Influenza virus
TISLVKTTL

SEQ ID NO: 458549 - protein, 9 aa, Influenza virus
TISMDSRSG

SEQ ID NO: 458550 - protein, 9 aa, Influenza virus
TISPHSRSG

SEQ ID NO: 458551 - protein, 9 aa, Influenza virus
TISPKLRSG

SEQ ID NO: 458552 - protein, 9 aa, Influenza virus
TISPRLRSG

SEQ ID NO: 458553 - protein, 9 aa, Influenza virus
TISPRSRNG

SEQ ID NO: 458554 - protein, 9 aa, Influenza virus
TISPRSRSG

SEQ ID NO: 458555 - protein, 9 aa, Influenza virus
TISRDSRSG

SEQ ID NO: 458556 - protein, 9 aa, Influenza virus
TISTASRAG

SEQ ID NO: 458557 - protein, 9 aa, Influenza virus
TISTASRSG

SEQ ID NO: 458558 - protein, 9 aa, Influenza virus
TISTASRYG

SEQ ID NO: 458559 - protein, 9 aa, Influenza virus
TITFEATGN

SEQ ID NO: 458560 - protein, 9 aa, Influenza virus
TITFSFNGA

SEQ ID NO: 458561 - protein, 9 aa, Influenza virus
TITGDNTKW

SEQ ID NO: 458562 - protein, 9 aa, Influenza virus
TITGPPQCD

SEQ ID NO: 458563 - protein, 9 aa, Influenza virus
TITIGSVSL

SEQ ID NO: 458564 - protein, 9 aa, Influenza virus
TITLHFKQN

SEQ ID NO: 458565 - protein, 9 aa, Influenza virus
TITNPLIRH

SEQ ID NO: 458566 - protein, 9 aa, Influenza virus
TITSNLPFQ

SEQ ID NO: 458567 - protein, 9 aa, Influenza virus
TITSPLPFQ

SEQ ID NO: 458568 - protein, 9 aa, Influenza virus
TITYSSPMM

SEQ ID NO: 458569 - protein, 9 aa, Influenza virus
TITYSSSLM

SEQ ID NO: 458570 - protein, 9 aa, Influenza virus
TITYSSSMM

SEQ ID NO: 458571 - protein, 9 aa, Influenza virus
TIVEKNVTV

SEQ ID NO: 458572 - protein, 9 aa, Influenza virus
TIVETGYVC

SEQ ID NO: 458573 - protein, 9 aa, Influenza virus
TIVKTLTNE

SEQ ID NO: 458574 - protein, 9 aa, Influenza virus
TIVKTLTSE

SEQ ID NO: 458575 - protein, 9 aa, Influenza virus
TIVLNTDWS

SEQ ID NO: 458576 - protein, 9 aa, Influenza virus
TIVLTTDWS

SEQ ID NO: 458577 - protein, 9 aa, Influenza virus
TIVSNTDWS

SEQ ID NO: 458578 - protein, 9 aa, Influenza virus
TIVSSLPFQ

SEQ ID NO: 458579 - protein, 9 aa, Influenza virus
TIWASGSSI

SEQ ID NO: 458580 - protein, 9 aa, Influenza virus
TIWTSASSI

SEQ ID NO: 458581 - protein, 9 aa, Influenza virus
TIWTSGSII

SEQ ID NO: 458582 - protein, 9 aa, Influenza virus
TIWTSGSSI

SEQ ID NO: 458583 - protein, 9 aa, Influenza virus
TIWTSSSSI

SEQ ID NO: 458584 - protein, 9 aa, Influenza virus
TIWTSSSSV

SEQ ID NO: 458585 - protein, 9 aa, Influenza virus
TIYSTAASS

SEQ ID NO: 458586 - protein, 9 aa, Influenza virus
TIYSTVASS

SEQ ID NO: 458587 - protein, 9 aa, Influenza virus
TIYWWDGLQ

SEQ ID NO: 458588 - protein, 9 aa, Influenza virus
TKAPQLNPI

SEQ ID NO: 458589 - protein, 9 aa, Influenza virus
TKATKMEAI

SEQ ID NO: 458590 - protein, 9 aa, Influenza virus
TKATKMKAI

SEQ ID NO: 458591 - protein, 9 aa, Influenza virus
TKATNGNYG

SEQ ID NO: 458592 - protein, 9 aa, Influenza virus
TKCQLNEGV

SEQ ID NO: 458593 - protein, 9 aa, Influenza virus
TKCQSPLGA

SEQ ID NO: 458594 - protein, 9 aa, Influenza virus
TKCQTPLGA

SEQ ID NO: 458595 - protein, 9 aa, Influenza virus
TKCQTSLGG

SEQ ID NO: 458596 - protein, 9 aa, Influenza virus
TKCQTSMGG

SEQ ID NO: 458597 - protein, 9 aa, Influenza virus
TKCQTSVGG

SEQ ID NO: 458598 - protein, 9 aa, Influenza virus
TKCQTYAGA

SEQ ID NO: 458599 - protein, 9 aa, Influenza virus
TKCQTYTGA

SEQ ID NO: 458600 - protein, 9 aa, Influenza virus
TKDAERGKL

SEQ ID NO: 458601 - protein, 9 aa, Influenza virus
TKDNSIRIG

SEQ ID NO: 458602 - protein, 9 aa, Influenza virus
TKDNSIRLS

SEQ ID NO: 458603 - protein, 9 aa, Influenza virus
TKDSITDIW

SEQ ID NO: 458604 - protein, 9 aa, Influenza virus
TKEAQDVIM

SEQ ID NO: 458605 - protein, 9 aa, Influenza virus
TKEGRRKTN

SEQ ID NO: 458606 - protein, 9 aa, Influenza virus
TKEGRRRTN

SEQ ID NO: 458607 - protein, 9 aa, Influenza virus
TKEKNDLYG

SEQ ID NO: 458608 - protein, 9 aa, Influenza virus
TKEKNELYG

SEQ ID NO: 458609 - protein, 9 aa, Influenza virus
TKEMEGICY

SEQ ID NO: 458610 - protein, 9 aa, Influenza virus
TKENTGSYV

SEQ ID NO: 458611 - protein, 9 aa, Influenza virus
TKEQTALYK

SEQ ID NO: 458612 - protein, 9 aa, Influenza virus
TKEQTTLYK

SEQ ID NO: 458613 - protein, 9 aa, Influenza virus
TKETNGNYG

SEQ ID NO: 458614 - protein, 9 aa, Influenza virus
TKEWSKRYE

SEQ ID NO: 458615 - protein, 9 aa, Influenza virus
TKEWSRRYE

SEQ ID NO: 458616 - protein, 9 aa, Influenza virus
TKGDKICLG

SEQ ID NO: 458617 - protein, 9 aa, Influenza virus
TKGEKANVL

SEQ ID NO: 458618 - protein, 9 aa, Influenza virus
TKGFGFLNE

SEQ ID NO: 458619 - protein, 9 aa, Influenza virus
TKGILGFVF

SEQ ID NO: 458620 - protein, 9 aa, Influenza virus
TKGKKAVDL

SEQ ID NO: 458621 - protein, 9 aa, Influenza virus
TKGLCIINS

SEQ ID NO: 458622 - protein, 9 aa, Influenza virus
TKGLCTINS

SEQ ID NO: 458623 - protein, 9 aa, Influenza virus
TKGLFGAIA

SEQ ID NO: 458624 - protein, 9 aa, Influenza virus
TKGMLGFVF

SEQ ID NO: 458625 - protein, 9 aa, Influenza virus
TKGVLGFVF

SEQ ID NO: 458626 - protein, 9 aa, Influenza virus
TKHDRIPHR

SEQ ID NO: 458627 - protein, 9 aa, Influenza virus
TKIDLWSYN

SEQ ID NO: 458628 - protein, 9 aa, Influenza virus
TKILFIEEG

SEQ ID NO: 458629 - protein, 9 aa, Influenza virus
TKILYFHKG

SEQ ID NO: 458630 - protein, 9 aa, Influenza virus
TKIMYFHKG

SEQ ID NO: 458631 - protein, 9 aa, Influenza virus
TKINNIIDK

SEQ ID NO: 458632 - protein, 9 aa, Influenza virus
TKINNIIEK

SEQ ID NO: 458633 - protein, 9 aa, Influenza virus
TKINTLTER

SEQ ID NO: 458634 - protein, 9 aa, Influenza virus
TKITVDHMA

SEQ ID NO: 458635 - protein, 9 aa, Influenza virus
TKIVYLNST

SEQ ID NO: 458636 - protein, 9 aa, Influenza virus
TKKEPDTYD

SEQ ID NO: 458637 - protein, 9 aa, Influenza virus
TKKKNPEAY

SEQ ID NO: 458638 - protein, 9 aa, Influenza virus
TKKKPDIYD

SEQ ID NO: 458639 - protein, 9 aa, Influenza virus
TKKKPDTYD

SEQ ID NO: 458640 - protein, 9 aa, Influenza virus
TKKMITQRT

SEQ ID NO: 458641 - protein, 9 aa, Influenza virus
TKKMTITFL

SEQ ID NO: 458642 - protein, 9 aa, Influenza virus
TKKMVTQRT

SEQ ID NO: 458643 - protein, 9 aa, Influenza virus
TKKQLRENA

SEQ ID NO: 458644 - protein, 9 aa, Influenza virus
TKLGSPLVL

SEQ ID NO: 458645 - protein, 9 aa, Influenza virus
TKLPFQNLS

SEQ ID NO: 458646 - protein, 9 aa, Influenza virus
TKLYGNGNK

SEQ ID NO: 458647 - protein, 9 aa, Influenza virus
TKLYGSGNK

SEQ ID NO: 458648 - protein, 9 aa, Influenza virus
TKLYGSGSK

SEQ ID NO: 458649 - protein, 9 aa, Influenza virus
TKLYKNTNT

SEQ ID NO: 458650 - protein, 9 aa, Influenza virus
TKLYVNKNP

SEQ ID NO: 458651 - protein, 9 aa, Influenza virus
TKMEAILVV

SEQ ID NO: 458652 - protein, 9 aa, Influenza virus
TKMKAIIVV

SEQ ID NO: 458653 - protein, 9 aa, Influenza virus
TKMKAILVV

SEQ ID NO: 458654 - protein, 9 aa, Influenza virus
TKNLESRSG

SEQ ID NO: 458655 - protein, 9 aa, Influenza virus
TKPRPRRGL

SEQ ID NO: 458656 - protein, 9 aa, Influenza virus
TKQLCIAWS

SEQ ID NO: 458657 - protein, 9 aa, Influenza virus
TKQVCAAWS

SEQ ID NO: 458658 - protein, 9 aa, Influenza virus
TKQVCIAWS

SEQ ID NO: 458659 - protein, 9 aa, Influenza virus
TKQVCMAWS

SEQ ID NO: 458660 - protein, 9 aa, Influenza virus
TKQVCVAWS

SEQ ID NO: 458661 - protein, 9 aa, Influenza virus
TKQVDTIME

SEQ ID NO: 458662 - protein, 9 aa, Influenza virus
TKRLAVLGK

SEQ ID NO: 458663 - protein, 9 aa, Influenza virus
TKRLCTINS

SEQ ID NO: 458664 - protein, 9 aa, Influenza virus
TKRLIQLIV

SEQ ID NO: 458665 - protein, 9 aa, Influenza virus
TKRLTIIGK

SEQ ID NO: 458666 - protein, 9 aa, Influenza virus
TKRLTILGK

SEQ ID NO: 458667 - protein, 9 aa, Influenza virus
TKRLTVLGK

SEQ ID NO: 458668 - protein, 9 aa, Influenza virus
TKRMVTQRT

SEQ ID NO: 458669 - protein, 9 aa, Influenza virus
TKRSHEQME

SEQ ID NO: 458670 - protein, 9 aa, Influenza virus
TKRSYEQME

SEQ ID NO: 458671 - protein, 9 aa, Influenza virus
TKSLESRSG

SEQ ID NO: 458672 - protein, 9 aa, Influenza virus
TKSTVLKSD

SEQ ID NO: 458673 - protein, 9 aa, Influenza virus
TKSYFANLK

SEQ ID NO: 458674 - protein, 9 aa, Influenza virus
TKTMTITFL

SEQ ID NO: 458675 - protein, 9 aa, Influenza virus
TKTTVDHMA

SEQ ID NO: 458676 - protein, 9 aa, Influenza virus
TKVDLWSYN

SEQ ID NO: 458677 - protein, 9 aa, Influenza virus
TKVDTLTEK

SEQ ID NO: 458678 - protein, 9 aa, Influenza virus
TKVLYFHKG

SEQ ID NO: 458679 - protein, 9 aa, Influenza virus
TKVMYFHKG

SEQ ID NO: 458680 - protein, 9 aa, Influenza virus
TKVNTLTEK

SEQ ID NO: 458681 - protein, 9 aa, Influenza virus
TKVNTLTER

SEQ ID NO: 458682 - protein, 9 aa, Influenza virus
TKVWWTSNS

SEQ ID NO: 458683 - protein, 9 aa, Influenza virus
TKVYNETVR

SEQ ID NO: 458684 - protein, 9 aa, Influenza virus
TKWNENQNP

SEQ ID NO: 458685 - protein, 9 aa, Influenza virus
TKWNVTHTG

SEQ ID NO: 458686 - protein, 9 aa, Influenza virus
TKWNVTYTG

SEQ ID NO: 458687 - protein, 9 aa, Influenza virus
TLCICYHAN

SEQ ID NO: 458688 - protein, 9 aa, Influenza virus
TLCIGYHAN

SEQ ID NO: 458689 - protein, 9 aa, Influenza virus
TLCLGHHAV

SEQ ID NO: 458690 - protein, 9 aa, Influenza virus
TLDEESRAR

SEQ ID NO: 458691 - protein, 9 aa, Influenza virus
TLDEHDANV

SEQ ID NO: 458692 - protein, 9 aa, Influenza virus
TLDEHDSNV

SEQ ID NO: 458693 - protein, 9 aa, Influenza virus
TLDFHDFNV

SEQ ID NO: 458694 - protein, 9 aa, Influenza virus
TLDFHDSNV

SEQ ID NO: 458695 - protein, 9 aa, Influenza virus
TLDFHDSSV

SEQ ID NO: 458696 - protein, 9 aa, Influenza virus
TLDKHDSNV

SEQ ID NO: 458697 - protein, 9 aa, Influenza virus
TLDLHDANV

SEQ ID NO: 458698 - protein, 9 aa, Influenza virus
TLDLHDSNV

SEQ ID NO: 458699 - protein, 9 aa, Influenza virus
TLDMHDANV

SEQ ID NO: 458700 - protein, 9 aa, Influenza virus
TLDNEHSNG

SEQ ID NO: 458701 - protein, 9 aa, Influenza virus
TLDNKHSND

SEQ ID NO: 458702 - protein, 9 aa, Influenza virus
TLDNKHSNG

SEQ ID NO: 458703 - protein, 9 aa, Influenza virus
TLDQHDANV

SEQ ID NO: 458704 - protein, 9 aa, Influenza virus
TLDYHDSNV

SEQ ID NO: 458705 - protein, 9 aa, Influenza virus
TLEFHDSNV

SEQ ID NO: 458706 - protein, 9 aa, Influenza virus
TLEHTSRYV

SEQ ID NO: 458707 - protein, 9 aa, Influenza virus
TLELRSGYW

SEQ ID NO: 458708 - protein, 9 aa, Influenza virus
TLELRSKYW

SEQ ID NO: 458709 - protein, 9 aa, Influenza virus
TLELRSRYW

SEQ ID NO: 458710 - protein, 9 aa, Influenza virus
TLENKHSNG

SEQ ID NO: 458711 - protein, 9 aa, Influenza virus
TLFEKFFPS

SEQ ID NO: 458712 - protein, 9 aa, Influenza virus
TLFQQMRDI

SEQ ID NO: 458713 - protein, 9 aa, Influenza virus
TLFQQMRDV

SEQ ID NO: 458714 - protein, 9 aa, Influenza virus
TLGENMAPE

SEQ ID NO: 458715 - protein, 9 aa, Influenza virus
TLGITGPDA

SEQ ID NO: 458716 - protein, 9 aa, Influenza virus
TLGITGPDS

SEQ ID NO: 458717 - protein, 9 aa, Influenza virus
TLGITGPDT

SEQ ID NO: 458718 - protein, 9 aa, Influenza virus
TLGLDIRTA

SEQ ID NO: 458719 - protein, 9 aa, Influenza virus
TLGLHDANV

SEQ ID NO: 458720 - protein, 9 aa, Influenza virus
TLHFKQHDC

SEQ ID NO: 458721 - protein, 9 aa, Influenza virus
TLHFKQHEC

SEQ ID NO: 458722 - protein, 9 aa, Influenza virus
TLHFKQHKC

SEQ ID NO: 458723 - protein, 9 aa, Influenza virus
TLHFKQNEC

SEQ ID NO: 458724 - protein, 9 aa, Influenza virus
TLIDALLGD

SEQ ID NO: 458725 - protein, 9 aa, Influenza virus
TLIDAMLGD

SEQ ID NO: 458726 - protein, 9 aa, Influenza virus
TLIENTYVN

SEQ ID NO: 458727 - protein, 9 aa, Influenza virus
TLIEQKVPV

SEQ ID NO: 458728 - protein, 9 aa, Influenza virus
TLIEQNIPV

SEQ ID NO: 458729 - protein, 9 aa, Influenza virus
TLIEQNVPV

SEQ ID NO: 458730 - protein, 9 aa, Influenza virus
TLIGPPQCD

SEQ ID NO: 458731 - protein, 9 aa, Influenza virus
TLITDGPSD

SEQ ID NO: 458732 - protein, 9 aa, Influenza virus
TLITDGPSN

SEQ ID NO: 458733 - protein, 9 aa, Influenza virus
TLKGRHANG

SEQ ID NO: 458734 - protein, 9 aa, Influenza virus
TLKIRTNGN

SEQ ID NO: 458735 - protein, 9 aa, Influenza virus
TLKLATGMR

SEQ ID NO: 458736 - protein, 9 aa, Influenza virus
TLKLGQFPV

SEQ ID NO: 458737 - protein, 9 aa, Influenza virus
TLKSEQFPV

SEQ ID NO: 458738 - protein, 9 aa, Influenza virus
TLKSGQFPV

SEQ ID NO: 458739 - protein, 9 aa, Influenza virus
TLKSWKGNI

SEQ ID NO: 458740 - protein, 9 aa, Influenza virus
TLKVESNGN

SEQ ID NO: 458741 - protein, 9 aa, Influenza virus
TLLAKSVFN

SEQ ID NO: 458742 - protein, 9 aa, Influenza virus
TLLEKNVTV

SEQ ID NO: 458743 - protein, 9 aa, Influenza virus
TLLENDVPV

SEQ ID NO: 458744 - protein, 9 aa, Influenza virus
TLLENGVPV

SEQ ID NO: 458745 - protein, 9 aa, Influenza virus
TLLENNVPV

SEQ ID NO: 458746 - protein, 9 aa, Influenza virus
TLLESDVPV

SEQ ID NO: 458747 - protein, 9 aa, Influenza virus
TLLMNELGI

SEQ ID NO: 458748 - protein, 9 aa, Influenza virus
TLLMNELGV

SEQ ID NO: 458749 - protein, 9 aa, Influenza virus
TLLMSELGV

SEQ ID NO: 458750 - protein, 9 aa, Influenza virus
TLMDALLGD

SEQ ID NO: 458751 - protein, 9 aa, Influenza virus
TLMEQNVPV

SEQ ID NO: 458752 - protein, 9 aa, Influenza virus
TLMSCPIGE

SEQ ID NO: 458753 - protein, 9 aa, Influenza virus
TLMSCPIGV

SEQ ID NO: 458754 - protein, 9 aa, Influenza virus
TLMSCPMGV

SEQ ID NO: 458755 - protein, 9 aa, Influenza virus
TLMSCPVGE

SEQ ID NO: 458756 - protein, 9 aa, Influenza virus
TLMSCPVGV

SEQ ID NO: 458757 - protein, 9 aa, Influenza virus
TLMSVEIGQ

SEQ ID NO: 458758 - protein, 9 aa, Influenza virus
TLMSVEVGQ

SEQ ID NO: 458759 - protein, 9 aa, Influenza virus
TLMSVGIGQ

SEQ ID NO: 458760 - protein, 9 aa, Influenza virus
TLMSVKIGQ

SEQ ID NO: 458761 - protein, 9 aa, Influenza virus
TLMSVKVGQ

SEQ ID NO: 458762 - protein, 9 aa, Influenza virus
TLMTDGPSD

SEQ ID NO: 458763 - protein, 9 aa, Influenza virus
TLNIESNGN

SEQ ID NO: 458764 - protein, 9 aa, Influenza virus
TLNMHDANV

SEQ ID NO: 458765 - protein, 9 aa, Influenza virus
TLNNKHSNG

SEQ ID NO: 458766 - protein, 9 aa, Influenza virus
TLNRNQPAA

SEQ ID NO: 458767 - protein, 9 aa, Influenza virus
TLNTMTKDA

SEQ ID NO: 458768 - protein, 9 aa, Influenza virus
TLNVESNGN

SEQ ID NO: 458769 - protein, 9 aa, Influenza virus
TLPFHNIHP

SEQ ID NO: 458770 - protein, 9 aa, Influenza virus
TLPFHNVHP

SEQ ID NO: 458771 - protein, 9 aa, Influenza virus
TLPRRSGAA

SEQ ID NO: 458772 - protein, 9 aa, Influenza virus
TLRGQHANG

SEQ ID NO: 458773 - protein, 9 aa, Influenza virus
TLRGRHANG

SEQ ID NO: 458774 - protein, 9 aa, Influenza virus
TLRIISNGN

SEQ ID NO: 458775 - protein, 9 aa, Influenza virus
TLRIRSNEN

SEQ ID NO: 458776 - protein, 9 aa, Influenza virus
TLRIRSNGN

SEQ ID NO: 458777 - protein, 9 aa, Influenza virus
TLRSLVASS

SEQ ID NO: 458778 - protein, 9 aa, Influenza virus
TLRTQESEC

SEQ ID NO: 458779 - protein, 9 aa, Influenza virus
TLRVKSNGN

SEQ ID NO: 458780 - protein, 9 aa, Influenza virus
TLRVRSDGN

SEQ ID NO: 458781 - protein, 9 aa, Influenza virus
TLRVRSNGN

SEQ ID NO: 458782 - protein, 9 aa, Influenza virus
TLSEQNVPV

SEQ ID NO: 458783 - protein, 9 aa, Influenza virus
TLSGVAIAL

SEQ ID NO: 458784 - protein, 9 aa, Influenza virus
TLSSGYKDI

SEQ ID NO: 458785 - protein, 9 aa, Influenza virus
TLSSVNTNT

SEQ ID NO: 458786 - protein, 9 aa, Influenza virus
TLSSVTTNT

SEQ ID NO: 458787 - protein, 9 aa, Influenza virus
TLSTIALFI

SEQ ID NO: 458788 - protein, 9 aa, Influenza virus
TLSTIALII

SEQ ID NO: 458789 - protein, 9 aa, Influenza virus
TLSTIALLI

SEQ ID NO: 458790 - protein, 9 aa, Influenza virus
TLTDNHVEV

SEQ ID NO: 458791 - protein, 9 aa, Influenza virus
TLTEKGIEV

SEQ ID NO: 458792 - protein, 9 aa, Influenza virus
TLTEKGVEV

SEQ ID NO: 458793 - protein, 9 aa, Influenza virus
TLTENGVPV

SEQ ID NO: 458794 - protein, 9 aa, Influenza virus
TLTEQNVPV

SEQ ID NO: 458795 - protein, 9 aa, Influenza virus
TLTEREVEV

SEQ ID NO: 458796 - protein, 9 aa, Influenza virus
TLTERGIEV

SEQ ID NO: 458797 - protein, 9 aa, Influenza virus
TLTERGVEV

SEQ ID NO: 458798 - protein, 9 aa, Influenza virus
TLTETGVPV

SEQ ID NO: 458799 - protein, 9 aa, Influenza virus
TLTGRGIEV

SEQ ID NO: 458800 - protein, 9 aa, Influenza virus
TLTMGYKDI

SEQ ID NO: 458801 - protein, 9 aa, Influenza virus
TLTNEHEEV

SEQ ID NO: 458802 - protein, 9 aa, Influenza virus
TLTNEKEEV

SEQ ID NO: 458803 - protein, 9 aa, Influenza virus
TLTNEQEEV

SEQ ID NO: 458804 - protein, 9 aa, Influenza virus
TLTNEREEV

SEQ ID NO: 458805 - protein, 9 aa, Influenza virus
TLTSEKEEV

SEQ ID NO: 458806 - protein, 9 aa, Influenza virus
TLTSVTTNT

SEQ ID NO: 458807 - protein, 9 aa, Influenza virus
TLTVPSERG

SEQ ID NO: 458808 - protein, 9 aa, Influenza virus
TLVANNDWS

SEQ ID NO: 458809 - protein, 9 aa, Influenza virus
TLVDALLGD

SEQ ID NO: 458810 - protein, 9 aa, Influenza virus
TLVLLVSLG

SEQ ID NO: 458811 - protein, 9 aa, Influenza virus
TLVNPGDSI

SEQ ID NO: 458812 - protein, 9 aa, Influenza virus
TLVSNNDWS

SEQ ID NO: 458813 - protein, 9 aa, Influenza virus
TLVSNSDWS

SEQ ID NO: 458814 - protein, 9 aa, Influenza virus
TLVSTGSWS

SEQ ID NO: 458815 - protein, 9 aa, Influenza virus
TLVSTKEWS

SEQ ID NO: 458816 - protein, 9 aa, Influenza virus
TLVSTKSWS

SEQ ID NO: 458817 - protein, 9 aa, Influenza virus
TLVSTRSWS

SEQ ID NO: 458818 - protein, 9 aa, Influenza virus
TLVSTSSWS

SEQ ID NO: 458819 - protein, 9 aa, Influenza virus
TLVTDGPSD

SEQ ID NO: 458820 - protein, 9 aa, Influenza virus
TLVTTSSWS

SEQ ID NO: 458821 - protein, 9 aa, Influenza virus
TLYFHDSNV

SEQ ID NO: 458822 - protein, 9 aa, Influenza virus
TLYKNANTL

SEQ ID NO: 458823 - protein, 9 aa, Influenza virus
TLYNKHSNG

SEQ ID NO: 458824 - protein, 9 aa, Influenza virus
TMDTVNRTH

SEQ ID NO: 458825 - protein, 9 aa, Influenza virus
TMDYYWGIL

SEQ ID NO: 458826 - protein, 9 aa, Influenza virus
TMELVEAEK

SEQ ID NO: 458827 - protein, 9 aa, Influenza virus
TMELVETEK

SEQ ID NO: 458828 - protein, 9 aa, Influenza virus
TMELVETKK

SEQ ID NO: 458829 - protein, 9 aa, Influenza virus
TMGYKDIIL

SEQ ID NO: 458830 - protein, 9 aa, Influenza virus
TMHDRSPFR

SEQ ID NO: 458831 - protein, 9 aa, Influenza virus
TMHQLLRHF

SEQ ID NO: 458832 - protein, 9 aa, Influenza virus
TMKDRSPYR

SEQ ID NO: 458833 - protein, 9 aa, Influenza virus
TMLNLYERV

SEQ ID NO: 458834 - protein, 9 aa, Influenza virus
TMSCDSPSN

SEQ ID NO: 458835 - protein, 9 aa, Influenza virus
TMTHTSQYI

SEQ ID NO: 458836 - protein, 9 aa, Influenza virus
TMTITFLIL

SEQ ID NO: 458837 - protein, 9 aa, Influenza virus
TMTKDAERG

SEQ ID NO: 458838 - protein, 9 aa, Influenza virus
TNADKICLG

SEQ ID NO: 458839 - protein, 9 aa, Influenza virus
TNAHDRICI

SEQ ID NO: 458840 - protein, 9 aa, Influenza virus
TNATELVQG

SEQ ID NO: 458841 - protein, 9 aa, Influenza virus
TNATELVQI

SEQ ID NO: 458842 - protein, 9 aa, Influenza virus
TNATELVQN

SEQ ID NO: 458843 - protein, 9 aa, Influenza virus
TNATELVQS

SEQ ID NO: 458844 - protein, 9 aa, Influenza virus
TNATETVEN

SEQ ID NO: 458845 - protein, 9 aa, Influenza virus
TNATETVES

SEQ ID NO: 458846 - protein, 9 aa, Influenza virus
TNAYDRICI

SEQ ID NO: 458847 - protein, 9 aa, Influenza virus
TNDKYHQIE

SEQ ID NO: 458848 - protein, 9 aa, Influenza virus
TNEEALRQI

SEQ ID NO: 458849 - protein, 9 aa, Influenza virus
TNEEPLRQI

SEQ ID NO: 458850 - protein, 9 aa, Influenza virus
TNEESLRQI

SEQ ID NO: 458851 - protein, 9 aa, Influenza virus
TNEKFHQIE

SEQ ID NO: 458852 - protein, 9 aa, Influenza virus
TNEKYHQIE

SEQ ID NO: 458853 - protein, 9 aa, Influenza virus
TNGEQILII

SEQ ID NO: 458854 - protein, 9 aa, Influenza virus
TNGNLIAPE

SEQ ID NO: 458855 - protein, 9 aa, Influenza virus
TNGNYGPIN

SEQ ID NO: 458856 - protein, 9 aa, Influenza virus
TNGTSKIKM

SEQ ID NO: 458857 - protein, 9 aa, Influenza virus
TNGTSKVKM

SEQ ID NO: 458858 - protein, 9 aa, Influenza virus
TNGTTGNPI

SEQ ID NO: 458859 - protein, 9 aa, Influenza virus
TNGVKGFSF

SEQ ID NO: 458860 - protein, 9 aa, Influenza virus
TNHQFELID

SEQ ID NO: 458861 - protein, 9 aa, Influenza virus
TNHTDELCP

SEQ ID NO: 458862 - protein, 9 aa, Influenza virus
TNHTGTYCS

SEQ ID NO: 458863 - protein, 9 aa, Influenza virus
TNINIREWS

SEQ ID NO: 458864 - protein, 9 aa, Influenza virus
TNKFAAICT

SEQ ID NO: 458865 - protein, 9 aa, Influenza virus
TNKFAAVCT

SEQ ID NO: 458866 - protein, 9 aa, Influenza virus
TNKFASICT

SEQ ID NO: 458867 - protein, 9 aa, Influenza virus
TNKINNIVD

SEQ ID NO: 458868 - protein, 9 aa, Influenza virus
TNKINSIID

SEQ ID NO: 458869 - protein, 9 aa, Influenza virus
TNKLAAICT

SEQ ID NO: 458870 - protein, 9 aa, Influenza virus
TNKQFELID

SEQ ID NO: 458871 - protein, 9 aa, Influenza virus
TNKTFQNAS

SEQ ID NO: 458872 - protein, 9 aa, Influenza virus
TNKTFQNID

SEQ ID NO: 458873 - protein, 9 aa, Influenza virus
TNKTFQNIE

SEQ ID NO: 458874 - protein, 9 aa, Influenza virus
TNKTFQNIS

SEQ ID NO: 458875 - protein, 9 aa, Influenza virus
TNKTFQNVS

SEQ ID NO: 458876 - protein, 9 aa, Influenza virus
TNKVNNIVD

SEQ ID NO: 458877 - protein, 9 aa, Influenza virus
TNKVNSIID

SEQ ID NO: 458878 - protein, 9 aa, Influenza virus
TNKVNSIIE

SEQ ID NO: 458879 - protein, 9 aa, Influenza virus
TNKVNSIIG

SEQ ID NO: 458880 - protein, 9 aa, Influenza virus
TNKVNSIIN

SEQ ID NO: 458881 - protein, 9 aa, Influenza virus
TNKVNSVIE

SEQ ID NO: 458882 - protein, 9 aa, Influenza virus
TNKVNSVVE

SEQ ID NO: 458883 - protein, 9 aa, Influenza virus
TNKVNTVIE

SEQ ID NO: 458884 - protein, 9 aa, Influenza virus
TNLGLNIGL

SEQ ID NO: 458885 - protein, 9 aa, Influenza virus
TNLYGFIIK

SEQ ID NO: 458886 - protein, 9 aa, Influenza virus
TNLYGFIVK

SEQ ID NO: 458887 - protein, 9 aa, Influenza virus
TNLYVNKNP

SEQ ID NO: 458888 - protein, 9 aa, Influenza virus
TNMINDKID

SEQ ID NO: 458889 - protein, 9 aa, Influenza virus
TNNSTDTVN

SEQ ID NO: 458890 - protein, 9 aa, Influenza virus
TNNSTETVN

SEQ ID NO: 458891 - protein, 9 aa, Influenza virus
TNNYGVKGF

SEQ ID NO: 458892 - protein, 9 aa, Influenza virus
TNPIVPSFD

SEQ ID NO: 458893 - protein, 9 aa, Influenza virus
TNPIVPSFE

SEQ ID NO: 458894 - protein, 9 aa, Influenza virus
TNPLIKHEN

SEQ ID NO: 458895 - protein, 9 aa, Influenza virus
TNPLIRHEN

SEQ ID NO: 458896 - protein, 9 aa, Influenza virus
TNPVVPSFD

SEQ ID NO: 458897 - protein, 9 aa, Influenza virus
TNQQFELID

SEQ ID NO: 458898 - protein, 9 aa, Influenza virus
TNQQFELIN

SEQ ID NO: 458899 - protein, 9 aa, Influenza virus
TNQQFEMID

SEQ ID NO: 458900 - protein, 9 aa, Influenza virus
TNQQFGLID

SEQ ID NO: 458901 - protein, 9 aa, Influenza virus
TNQQFKLID

SEQ ID NO: 458902 - protein, 9 aa, Influenza virus
TNRPILVIS

SEQ ID NO: 458903 - protein, 9 aa, Influenza virus
TNRPVLIIS

SEQ ID NO: 458904 - protein, 9 aa, Influenza virus
TNRPVLVIS

SEQ ID NO: 458905 - protein, 9 aa, Influenza virus
TNRPVLVVS

SEQ ID NO: 458906 - protein, 9 aa, Influenza virus
TNRTFQNID

SEQ ID NO: 458907 - protein, 9 aa, Influenza virus
TNRTFQNVS

SEQ ID NO: 458908 - protein, 9 aa, Influenza virus
TNRVNSIID

SEQ ID NO: 458909 - protein, 9 aa, Influenza virus
TNSIVVFCG

SEQ ID NO: 458910 - protein, 9 aa, Influenza virus
TNSQDTEIS

SEQ ID NO: 458911 - protein, 9 aa, Influenza virus
TNSQDTELS

SEQ ID NO: 458912 - protein, 9 aa, Influenza virus
TNSQDTEVS

SEQ ID NO: 458913 - protein, 9 aa, Influenza virus
TNSSDKVDT

SEQ ID NO: 458914 - protein, 9 aa, Influenza virus
TNSSEKVDT

SEQ ID NO: 458915 - protein, 9 aa, Influenza virus
TNSSEKVNT

SEQ ID NO: 458916 - protein, 9 aa, Influenza virus
TNSSERVDT

SEQ ID NO: 458917 - protein, 9 aa, Influenza virus
TNSTDTVDT

SEQ ID NO: 458918 - protein, 9 aa, Influenza virus
TNSTEAVDT

SEQ ID NO: 458919 - protein, 9 aa, Influenza virus
TNSTEKVDT

SEQ ID NO: 458920 - protein, 9 aa, Influenza virus
TNSTETVDT

SEQ ID NO: 458921 - protein, 9 aa, Influenza virus
TNSTETVGT

SEQ ID NO: 458922 - protein, 9 aa, Influenza virus
TNSTETVNT

SEQ ID NO: 458923 - protein, 9 aa, Influenza virus
TNSTETVYT

SEQ ID NO: 458924 - protein, 9 aa, Influenza virus
TNTEFESIE

SEQ ID NO: 458925 - protein, 9 aa, Influenza virus
TNTINRIFQ

SEQ ID NO: 458926 - protein, 9 aa, Influenza virus
TNTINRNFQ

SEQ ID NO: 458927 - protein, 9 aa, Influenza virus
TNTINRSFQ

SEQ ID NO: 458928 - protein, 9 aa, Influenza virus
TNTINRSFR

SEQ ID NO: 458929 - protein, 9 aa, Influenza virus
TNTLSSVTT

SEQ ID NO: 458930 - protein, 9 aa, Influenza virus
TNTQFELID

SEQ ID NO: 458931 - protein, 9 aa, Influenza virus
TNTTLIENT

SEQ ID NO: 458932 - protein, 9 aa, Influenza virus
TNTVNTLIE

SEQ ID NO: 458933 - protein, 9 aa, Influenza virus
TNTYRNTDP

SEQ ID NO: 458934 - protein, 9 aa, Influenza virus
TNTYRNTDS

SEQ ID NO: 458935 - protein, 9 aa, Influenza virus
TNTYRNTDT

SEQ ID NO: 458936 - protein, 9 aa, Influenza virus
TNVQNDYTT

SEQ ID NO: 458937 - protein, 9 aa, Influenza virus
TNVQNNYTT

SEQ ID NO: 458938 - protein, 9 aa, Influenza virus
TNWSGYSGS

SEQ ID NO: 458939 - protein, 9 aa, Influenza virus
TNYYNETFV

SEQ ID NO: 458940 - protein, 9 aa, Influenza virus
TPACDLHLT

SEQ ID NO: 458941 - protein, 9 aa, Influenza virus
TPACDLYLT

SEQ ID NO: 458942 - protein, 9 aa, Influenza virus
TPCVLLNDK

SEQ ID NO: 458943 - protein, 9 aa, Influenza virus
TPDPGVKGF

SEQ ID NO: 458944 - protein, 9 aa, Influenza virus
TPEWSYIVE

SEQ ID NO: 458945 - protein, 9 aa, Influenza virus
TPGGEVIND

SEQ ID NO: 458946 - protein, 9 aa, Influenza virus
TPGGEVKND

SEQ ID NO: 458947 - protein, 9 aa, Influenza virus
TPGGEVRND

SEQ ID NO: 458948 - protein, 9 aa, Influenza virus
TPGGGVRND

SEQ ID NO: 458949 - protein, 9 aa, Influenza virus
TPGGKVRND

SEQ ID NO: 458950 - protein, 9 aa, Influenza virus
TPGMQIRGF

SEQ ID NO: 458951 - protein, 9 aa, Influenza virus
TPHRTLLMN

SEQ ID NO: 458952 - protein, 9 aa, Influenza virus
TPIAFLTSS

SEQ ID NO: 458953 - protein, 9 aa, Influenza virus
TPIGAINSS

SEQ ID NO: 458954 - protein, 9 aa, Influenza virus
TPIVPSFDM

SEQ ID NO: 458955 - protein, 9 aa, Influenza virus
TPKRNRSIL

SEQ ID NO: 458956 - protein, 9 aa, Influenza virus
TPLELRDCK

SEQ ID NO: 458957 - protein, 9 aa, Influenza virus
TPLGAINSS

SEQ ID NO: 458958 - protein, 9 aa, Influenza virus
TPLGAINTT

SEQ ID NO: 458959 - protein, 9 aa, Influenza virus
TPLGALNTT

SEQ ID NO: 458960 - protein, 9 aa, Influenza virus
TPLGSPPIV

SEQ ID NO: 458961 - protein, 9 aa, Influenza virus
TPLGSPPMV

SEQ ID NO: 458962 - protein, 9 aa, Influenza virus
TPLGSPPVV

SEQ ID NO: 458963 - protein, 9 aa, Influenza virus
TPLGTPPTV

SEQ ID NO: 458964 - protein, 9 aa, Influenza virus
TPMGAINSS

SEQ ID NO: 458965 - protein, 9 aa, Influenza virus
TPMGAVNSS

SEQ ID NO: 458966 - protein, 9 aa, Influenza virus
TPNGSIPND

SEQ ID NO: 458967 - protein, 9 aa, Influenza virus
TPNGSIPNE

SEQ ID NO: 458968 - protein, 9 aa, Influenza virus
TPNGSIPNG

SEQ ID NO: 458969 - protein, 9 aa, Influenza virus
TPNGSIPNN

SEQ ID NO: 458970 - protein, 9 aa, Influenza virus
TPNGSISND

SEQ ID NO: 458971 - protein, 9 aa, Influenza virus
TPPTVSNSD

SEQ ID NO: 458972 - protein, 9 aa, Influenza virus
TPRGEDAQF

SEQ ID NO: 458973 - protein, 9 aa, Influenza virus
TPRGEDGQF

SEQ ID NO: 458974 - protein, 9 aa, Influenza virus
TPRGEDNQF

SEQ ID NO: 458975 - protein, 9 aa, Influenza virus
TPRGEDSQF

SEQ ID NO: 458976 - protein, 9 aa, Influenza virus
TPRNDDRFS

SEQ ID NO: 458977 - protein, 9 aa, Influenza virus
TPRNDDRSS

SEQ ID NO: 458978 - protein, 9 aa, Influenza virus
TPRNDDSSS

SEQ ID NO: 458979 - protein, 9 aa, Influenza virus
TPRNEDGSS

SEQ ID NO: 458980 - protein, 9 aa, Influenza virus
TPRNEDSSS

SEQ ID NO: 458981 - protein, 9 aa, Influenza virus
TPRNGDSSS

SEQ ID NO: 458982 - protein, 9 aa, Influenza virus
TPRSDDSSS

SEQ ID NO: 458983 - protein, 9 aa, Influenza virus
TPSAIDQIT

SEQ ID NO: 458984 - protein, 9 aa, Influenza virus
TPSIDPKGL

SEQ ID NO: 458985 - protein, 9 aa, Influenza virus
TPSIEPKGL

SEQ ID NO: 458986 - protein, 9 aa, Influenza virus
TPSIEPRGL

SEQ ID NO: 458987 - protein, 9 aa, Influenza virus
TPSVEPKGL

SEQ ID NO: 458988 - protein, 9 aa, Influenza virus
TPSVEPRGL

SEQ ID NO: 458989 - protein, 9 aa, Influenza virus
TPTKSYFAN

SEQ ID NO: 458990 - protein, 9 aa, Influenza virus
TPVCDPHLT

SEQ ID NO: 458991 - protein, 9 aa, Influenza virus
TPVGAINSS

SEQ ID NO: 458992 - protein, 9 aa, Influenza virus
TPYRSLIKF

SEQ ID NO: 458993 - protein, 9 aa, Influenza virus
TPYRSLIQF

SEQ ID NO: 458994 - protein, 9 aa, Influenza virus
TPYRSLIRF

SEQ ID NO: 458995 - protein, 9 aa, Influenza virus
TPYRTLLMN

SEQ ID NO: 458996 - protein, 9 aa, Influenza virus
TQAAIDKIN

SEQ ID NO: 458997 - protein, 9 aa, Influenza virus
TQAAIDQIN

SEQ ID NO: 458998 - protein, 9 aa, Influenza virus
TQAAIDQIT

SEQ ID NO: 458999 - protein, 9 aa, Influenza virus
TQAAIDQMT

SEQ ID NO: 459000 - protein, 9 aa, Influenza virus
TQAAIDQVN

SEQ ID NO: 459001 - protein, 9 aa, Influenza virus
TQAAVDQIT

SEQ ID NO: 459002 - protein, 9 aa, Influenza virus
TQAMELVEA

SEQ ID NO: 459003 - protein, 9 aa, Influenza virus
TQCQITGFA

SEQ ID NO: 459004 - protein, 9 aa, Influenza virus
TQCQTPLGA

SEQ ID NO: 459005 - protein, 9 aa, Influenza virus
TQDAMTEVW

SEQ ID NO: 459006 - protein, 9 aa, Influenza virus
TQDSECVSH

SEQ ID NO: 459007 - protein, 9 aa, Influenza virus
TQEAIDKIT

SEQ ID NO: 459008 - protein, 9 aa, Influenza virus
TQEAIEKIT

SEQ ID NO: 459009 - protein, 9 aa, Influenza virus
TQEAIGKIT

SEQ ID NO: 459010 - protein, 9 aa, Influenza virus
TQEAINKIT

SEQ ID NO: 459011 - protein, 9 aa, Influenza virus
TQEKNDLYG

SEQ ID NO: 459012 - protein, 9 aa, Influenza virus
TQERNDLYG

SEQ ID NO: 459013 - protein, 9 aa, Influenza virus
TQESDCVCI

SEQ ID NO: 459014 - protein, 9 aa, Influenza virus
TQESECACI

SEQ ID NO: 459015 - protein, 9 aa, Influenza virus
TQESECACV

SEQ ID NO: 459016 - protein, 9 aa, Influenza virus
TQESECICI

SEQ ID NO: 459017 - protein, 9 aa, Influenza virus
TQESECLCI

SEQ ID NO: 459018 - protein, 9 aa, Influenza virus
TQESECQCI

SEQ ID NO: 459019 - protein, 9 aa, Influenza virus
TQESECQCL

SEQ ID NO: 459020 - protein, 9 aa, Influenza virus
TQESECQRI

SEQ ID NO: 459021 - protein, 9 aa, Influenza virus
TQESECVCH

SEQ ID NO: 459022 - protein, 9 aa, Influenza virus
TQESECVCI

SEQ ID NO: 459023 - protein, 9 aa, Influenza virus
TQESECVCM

SEQ ID NO: 459024 - protein, 9 aa, Influenza virus
TQESECVCQ

SEQ ID NO: 459025 - protein, 9 aa, Influenza virus
TQESECVCV

SEQ ID NO: 459026 - protein, 9 aa, Influenza virus
TQESECVRH

SEQ ID NO: 459027 - protein, 9 aa, Influenza virus
TQESSCTCI

SEQ ID NO: 459028 - protein, 9 aa, Influenza virus
TQESSCVCI

SEQ ID NO: 459029 - protein, 9 aa, Influenza virus
TQESSCVCM

SEQ ID NO: 459030 - protein, 9 aa, Influenza virus
TQESSCVCV

SEQ ID NO: 459031 - protein, 9 aa, Influenza virus
TQEYECVCI

SEQ ID NO: 459032 - protein, 9 aa, Influenza virus
TQFEAIGRE

SEQ ID NO: 459033 - protein, 9 aa, Influenza virus
TQFEAVGKE

SEQ ID NO: 459034 - protein, 9 aa, Influenza virus
TQFEAVGRE

SEQ ID NO: 459035 - protein, 9 aa, Influenza virus
TQFELIDNE

SEQ ID NO: 459036 - protein, 9 aa, Influenza virus
TQFTAVGKE

SEQ ID NO: 459037 - protein, 9 aa, Influenza virus
TQFTSVGKE

SEQ ID NO: 459038 - protein, 9 aa, Influenza virus
TQFTVVGKE

SEQ ID NO: 459039 - protein, 9 aa, Influenza virus
TQGACWEQL

SEQ ID NO: 459040 - protein, 9 aa, Influenza virus
TQGALLNDK

SEQ ID NO: 459041 - protein, 9 aa, Influenza virus
TQGALLNDR

SEQ ID NO: 459042 - protein, 9 aa, Influenza virus
TQGEGTAAD

SEQ ID NO: 459043 - protein, 9 aa, Influenza virus
TQGRQTFDW

SEQ ID NO: 459044 - protein, 9 aa, Influenza virus
TQGRQTYDW

SEQ ID NO: 459045 - protein, 9 aa, Influenza virus
TQGSLLNDK

SEQ ID NO: 459046 - protein, 9 aa, Influenza virus
TQGSLLNDR

SEQ ID NO: 459047 - protein, 9 aa, Influenza virus
TQGTCWEQL

SEQ ID NO: 459048 - protein, 9 aa, Influenza virus
TQGTCWEQM

SEQ ID NO: 459049 - protein, 9 aa, Influenza virus
TQGVKGWAF

SEQ ID NO: 459050 - protein, 9 aa, Influenza virus
TQGYKDIIL

SEQ ID NO: 459051 - protein, 9 aa, Influenza virus
TQIIKLLPF

SEQ ID NO: 459052 - protein, 9 aa, Influenza virus
TQIIVILVL

SEQ ID NO: 459053 - protein, 9 aa, Influenza virus
TQKAIDEIT

SEQ ID NO: 459054 - protein, 9 aa, Influenza virus
TQKAIDGIT

SEQ ID NO: 459055 - protein, 9 aa, Influenza virus
TQKAIDGVT

SEQ ID NO: 459056 - protein, 9 aa, Influenza virus
TQKAIDIMQ

SEQ ID NO: 459057 - protein, 9 aa, Influenza virus
TQKAIDNMQ

SEQ ID NO: 459058 - protein, 9 aa, Influenza virus
TQKAIDQIT

SEQ ID NO: 459059 - protein, 9 aa, Influenza virus
TQKAIDRIT

SEQ ID NO: 459060 - protein, 9 aa, Influenza virus
TQKAINEIT

SEQ ID NO: 459061 - protein, 9 aa, Influenza virus
TQKAINGIT

SEQ ID NO: 459062 - protein, 9 aa, Influenza virus
TQKAINGVT

SEQ ID NO: 459063 - protein, 9 aa, Influenza virus
TQKALNEIT

SEQ ID NO: 459064 - protein, 9 aa, Influenza virus
TQKAVDGIT

SEQ ID NO: 459065 - protein, 9 aa, Influenza virus
TQKTIDQVT

SEQ ID NO: 459066 - protein, 9 aa, Influenza virus
TQMAIDNMQ

SEQ ID NO: 459067 - protein, 9 aa, Influenza virus
TQNNTTLIE

SEQ ID NO: 459068 - protein, 9 aa, Influenza virus
TQNNTTVVE

SEQ ID NO: 459069 - protein, 9 aa, Influenza virus
TQPLSISVG

SEQ ID NO: 459070 - protein, 9 aa, Influenza virus
TQPTFSVQR

SEQ ID NO: 459071 - protein, 9 aa, Influenza virus
TQQVCIAWS

SEQ ID NO: 459072 - protein, 9 aa, Influenza virus
TQRAIDGIT

SEQ ID NO: 459073 - protein, 9 aa, Influenza virus
TQRAIDGVT

SEQ ID NO: 459074 - protein, 9 aa, Influenza virus
TQRAIDNMQ

SEQ ID NO: 459075 - protein, 9 aa, Influenza virus
TQRTIGKKK

SEQ ID NO: 459076 - protein, 9 aa, Influenza virus
TQRTIGKRK

SEQ ID NO: 459077 - protein, 9 aa, Influenza virus
TQRTMGKKK

SEQ ID NO: 459078 - protein, 9 aa, Influenza virus
TQRTVGKKK

SEQ ID NO: 459079 - protein, 9 aa, Influenza virus
TQSAIDQIT

SEQ ID NO: 459080 - protein, 9 aa, Influenza virus
TQSAIDQVT

SEQ ID NO: 459081 - protein, 9 aa, Influenza virus
TQSAINQIT

SEQ ID NO: 459082 - protein, 9 aa, Influenza virus
TQSAVDQIT

SEQ ID NO: 459083 - protein, 9 aa, Influenza virus
TQSAVNQIT

SEQ ID NO: 459084 - protein, 9 aa, Influenza virus
TQSLSISIG

SEQ ID NO: 459085 - protein, 9 aa, Influenza virus
TQSLSISVE

SEQ ID NO: 459086 - protein, 9 aa, Influenza virus
TQSLSISVG

SEQ ID NO: 459087 - protein, 9 aa, Influenza virus
TQTAIDQIN

SEQ ID NO: 459088 - protein, 9 aa, Influenza virus
TQTAIDQIT

SEQ ID NO: 459089 - protein, 9 aa, Influenza virus
TQTLVANND

SEQ ID NO: 459090 - protein, 9 aa, Influenza virus
TQTLVSNND

SEQ ID NO: 459091 - protein, 9 aa, Influenza virus
TQTLVSNSD

SEQ ID NO: 459092 - protein, 9 aa, Influenza virus
TQTMELVEA

SEQ ID NO: 459093 - protein, 9 aa, Influenza virus
TQTMELVET

SEQ ID NO: 459094 - protein, 9 aa, Influenza virus
TQTRGIFGA

SEQ ID NO: 459095 - protein, 9 aa, Influenza virus
TQVEELVHG

SEQ ID NO: 459096 - protein, 9 aa, Influenza virus
TQVEELVHR

SEQ ID NO: 459097 - protein, 9 aa, Influenza virus
TQYREEALL

SEQ ID NO: 459098 - protein, 9 aa, Influenza virus
TQYREESLL

SEQ ID NO: 459099 - protein, 9 aa, Influenza virus
TRALVRSGM

SEQ ID NO: 459100 - protein, 9 aa, Influenza virus
TRALVRTGM

SEQ ID NO: 459101 - protein, 9 aa, Influenza virus
TRCQTPLGA

SEQ ID NO: 459102 - protein, 9 aa, Influenza virus
TRCQTSVGG

SEQ ID NO: 459103 - protein, 9 aa, Influenza virus
TRDAMTEIW

SEQ ID NO: 459104 - protein, 9 aa, Influenza virus
TRDAMTEVW

SEQ ID NO: 459105 - protein, 9 aa, Influenza virus
TRDSITELW

SEQ ID NO: 459106 - protein, 9 aa, Influenza virus
TRDSITEVW

SEQ ID NO: 459107 - protein, 9 aa, Influenza virus
TRDSLTEIW

SEQ ID NO: 459108 - protein, 9 aa, Influenza virus
TRDSMTEIW

SEQ ID NO: 459109 - protein, 9 aa, Influenza virus
TRDSMTEVW

SEQ ID NO: 459110 - protein, 9 aa, Influenza virus
TRDSVTELW

SEQ ID NO: 459111 - protein, 9 aa, Influenza virus
TREGKHIVE

SEQ ID NO: 459112 - protein, 9 aa, Influenza virus
TREGRRKTN

SEQ ID NO: 459113 - protein, 9 aa, Influenza virus
TREILTKIT

SEQ ID NO: 459114 - protein, 9 aa, Influenza virus
TREILTKTT

SEQ ID NO: 459115 - protein, 9 aa, Influenza virus
TREILTRTT

SEQ ID NO: 459116 - protein, 9 aa, Influenza virus
TRELCTINS

SEQ ID NO: 459117 - protein, 9 aa, Influenza virus
TRELYVSCD

SEQ ID NO: 459118 - protein, 9 aa, Influenza virus
TREPFISCS

SEQ ID NO: 459119 - protein, 9 aa, Influenza virus
TREPYISCD

SEQ ID NO: 459120 - protein, 9 aa, Influenza virus
TREPYLSCD

SEQ ID NO: 459121 - protein, 9 aa, Influenza virus
TREPYLSCG

SEQ ID NO: 459122 - protein, 9 aa, Influenza virus
TREPYVSCD

SEQ ID NO: 459123 - protein, 9 aa, Influenza virus
TREPYVSCE

SEQ ID NO: 459124 - protein, 9 aa, Influenza virus
TREPYVSCG

SEQ ID NO: 459125 - protein, 9 aa, Influenza virus
TREPYVSCK

SEQ ID NO: 459126 - protein, 9 aa, Influenza virus
TREPYVSCS

SEQ ID NO: 459127 - protein, 9 aa, Influenza virus
TREWSYLIE

SEQ ID NO: 459128 - protein, 9 aa, Influenza virus
TRFLPVAGG

SEQ ID NO: 459129 - protein, 9 aa, Influenza virus
TRFLPVSGG

SEQ ID NO: 459130 - protein, 9 aa, Influenza virus
TRFLPVTGG

SEQ ID NO: 459131 - protein, 9 aa, Influenza virus
TRFTYSGIR

SEQ ID NO: 459132 - protein, 9 aa, Influenza virus
TRGAYERMC

SEQ ID NO: 459133 - protein, 9 aa, Influenza virus
TRGIFGAIA

SEQ ID NO: 459134 - protein, 9 aa, Influenza virus
TRGILTKTT

SEQ ID NO: 459135 - protein, 9 aa, Influenza virus
TRGIQIASN

SEQ ID NO: 459136 - protein, 9 aa, Influenza virus
TRGLCTINS

SEQ ID NO: 459137 - protein, 9 aa, Influenza virus
TRGLFGAIA

SEQ ID NO: 459138 - protein, 9 aa, Influenza virus
TRGLFGAKA

SEQ ID NO: 459139 - protein, 9 aa, Influenza virus
TRGVQIASN

SEQ ID NO: 459140 - protein, 9 aa, Influenza virus
TRGVQVASN

SEQ ID NO: 459141 - protein, 9 aa, Influenza virus
TRIAYERMC

SEQ ID NO: 459142 - protein, 9 aa, Influenza virus
TRIGDGQRS

SEQ ID NO: 459143 - protein, 9 aa, Influenza virus
TRILFIEEG

SEQ ID NO: 459144 - protein, 9 aa, Influenza virus
TRILFIKEG

SEQ ID NO: 459145 - protein, 9 aa, Influenza virus
TRILFIREG

SEQ ID NO: 459146 - protein, 9 aa, Influenza virus
TRILFVKEG

SEQ ID NO: 459147 - protein, 9 aa, Influenza virus
TRINMINSK

SEQ ID NO: 459148 - protein, 9 aa, Influenza virus
TRIYYFKEG

SEQ ID NO: 459149 - protein, 9 aa, Influenza virus
TRKEPALIV

SEQ ID NO: 459150 - protein, 9 aa, Influenza virus
TRKLIQLIV

SEQ ID NO: 459151 - protein, 9 aa, Influenza virus
TRKMVTQRT

SEQ ID NO: 459152 - protein, 9 aa, Influenza virus
TRKQLRENA

SEQ ID NO: 459153 - protein, 9 aa, Influenza virus
TRLFTIRQE

SEQ ID NO: 459154 - protein, 9 aa, Influenza virus
TRLPFQNLS

SEQ ID NO: 459155 - protein, 9 aa, Influenza virus
TRLYIWGVH

SEQ ID NO: 459156 - protein, 9 aa, Influenza virus
TRLYVNKNP

SEQ ID NO: 459157 - protein, 9 aa, Influenza virus
TRPGYNGQK

SEQ ID NO: 459158 - protein, 9 aa, Influenza virus
TRPILSPLT

SEQ ID NO: 459159 - protein, 9 aa, Influenza virus
TRQASPSCL

SEQ ID NO: 459160 - protein, 9 aa, Influenza virus
TRQMVHAMR

SEQ ID NO: 459161 - protein, 9 aa, Influenza virus
TRQMVQAMR

SEQ ID NO: 459162 - protein, 9 aa, Influenza virus
TRQVCIAWS

SEQ ID NO: 459163 - protein, 9 aa, Influenza virus
TRQVCMAWS

SEQ ID NO: 459164 - protein, 9 aa, Influenza virus
TRQVCVAWS

SEQ ID NO: 459165 - protein, 9 aa, Influenza virus
TRREIHIYY

SEQ ID NO: 459166 - protein, 9 aa, Influenza virus
TRREVHIYY

SEQ ID NO: 459167 - protein, 9 aa, Influenza virus
TRREVHTYY

SEQ ID NO: 459168 - protein, 9 aa, Influenza virus
TRREVHVYY

SEQ ID NO: 459169 - protein, 9 aa, Influenza virus
TRRIDFHWL

SEQ ID NO: 459170 - protein, 9 aa, Influenza virus
TRRLIQLIV

SEQ ID NO: 459171 - protein, 9 aa, Influenza virus
TRRLTVLGK

SEQ ID NO: 459172 - protein, 9 aa, Influenza virus
TRRLVQLIV

SEQ ID NO: 459173 - protein, 9 aa, Influenza virus
TRRMIQLIV

SEQ ID NO: 459174 - protein, 9 aa, Influenza virus
TRRQKRGLF

SEQ ID NO: 459175 - protein, 9 aa, Influenza virus
TRRQLRENA

SEQ ID NO: 459176 - protein, 9 aa, Influenza virus
TRSAYERMC

SEQ ID NO: 459177 - protein, 9 aa, Influenza virus
TRSDQISIV

SEQ ID NO: 459178 - protein, 9 aa, Influenza virus
TRSGGNNNQ

SEQ ID NO: 459179 - protein, 9 aa, Influenza virus
TRSGGNTNH

SEQ ID NO: 459180 - protein, 9 aa, Influenza virus
TRSGGNTNQ

SEQ ID NO: 459181 - protein, 9 aa, Influenza virus
TRSGGNTSQ

SEQ ID NO: 459182 - protein, 9 aa, Influenza virus
TRSGQNHGI

SEQ ID NO: 459183 - protein, 9 aa, Influenza virus
TRSGTSKAC

SEQ ID NO: 459184 - protein, 9 aa, Influenza virus
TRSGYEMLK

SEQ ID NO: 459185 - protein, 9 aa, Influenza virus
TRSRSGFEM

SEQ ID NO: 459186 - protein, 9 aa, Influenza virus
TRTAYERMC

SEQ ID NO: 459187 - protein, 9 aa, Influenza virus
TRTTVDHMA

SEQ ID NO: 459188 - protein, 9 aa, Influenza virus
TRVAYERMC

SEQ ID NO: 459189 - protein, 9 aa, Influenza virus
TRVDKLTQG

SEQ ID NO: 459190 - protein, 9 aa, Influenza virus
TRVDRLTQG

SEQ ID NO: 459191 - protein, 9 aa, Influenza virus
TRVKRQLRE

SEQ ID NO: 459192 - protein, 9 aa, Influenza virus
TRVWWTSNS

SEQ ID NO: 459193 - protein, 9 aa, Influenza virus
TRVYYFKEG

SEQ ID NO: 459194 - protein, 9 aa, Influenza virus
TRVYYFKGG

SEQ ID NO: 459195 - protein, 9 aa, Influenza virus
TRVYYFKKG

SEQ ID NO: 459196 - protein, 9 aa, Influenza virus
TRVYYFREG

SEQ ID NO: 459197 - protein, 9 aa, Influenza virus
TRWMKIIRV

SEQ ID NO: 459198 - protein, 9 aa, Influenza virus
TRYVCSKFH

SEQ ID NO: 459199 - protein, 9 aa, Influenza virus
TSACKRTVS

SEQ ID NO: 459200 - protein, 9 aa, Influenza virus
TSARQEKNP

SEQ ID NO: 459201 - protein, 9 aa, Influenza virus
TSCFDGKEW

SEQ ID NO: 459202 - protein, 9 aa, Influenza virus
TSCHDGIGR

SEQ ID NO: 459203 - protein, 9 aa, Influenza virus
TSCHDGISR

SEQ ID NO: 459204 - protein, 9 aa, Influenza virus
TSCHDGKAR

SEQ ID NO: 459205 - protein, 9 aa, Influenza virus
TSCHDGKFR

SEQ ID NO: 459206 - protein, 9 aa, Influenza virus
TSCHDGKSR

SEQ ID NO: 459207 - protein, 9 aa, Influenza virus
TSCHDGKTR

SEQ ID NO: 459208 - protein, 9 aa, Influenza virus
TSCHDGMSR

SEQ ID NO: 459209 - protein, 9 aa, Influenza virus
TSCHDGRAR

SEQ ID NO: 459210 - protein, 9 aa, Influenza virus
TSCHDGRSR

SEQ ID NO: 459211 - protein, 9 aa, Influenza virus
TSCHDGVGR

SEQ ID NO: 459212 - protein, 9 aa, Influenza virus
TSCHDGVSR

SEQ ID NO: 459213 - protein, 9 aa, Influenza virus
TSDMRAEII

SEQ ID NO: 459214 - protein, 9 aa, Influenza virus
TSDMRTEII

SEQ ID NO: 459215 - protein, 9 aa, Influenza virus
TSDMRTEVI

SEQ ID NO: 459216 - protein, 9 aa, Influenza virus
TSFFYRYGF

SEQ ID NO: 459217 - protein, 9 aa, Influenza virus
TSFQVDCYL

SEQ ID NO: 459218 - protein, 9 aa, Influenza virus
TSGEQMLII

SEQ ID NO: 459219 - protein, 9 aa, Influenza virus
TSGEQMLVI

SEQ ID NO: 459220 - protein, 9 aa, Influenza virus
TSGEQVLVI

SEQ ID NO: 459221 - protein, 9 aa, Influenza virus
TSGNLIAPE

SEQ ID NO: 459222 - protein, 9 aa, Influenza virus
TSGRQEKNP

SEQ ID NO: 459223 - protein, 9 aa, Influenza virus
TSGSIISFC

SEQ ID NO: 459224 - protein, 9 aa, Influenza virus
TSGSSIAFC

SEQ ID NO: 459225 - protein, 9 aa, Influenza virus
TSGSSISFC

SEQ ID NO: 459226 - protein, 9 aa, Influenza virus
TSGTYGAGS

SEQ ID NO: 459227 - protein, 9 aa, Influenza virus
TSGTYGSGS

SEQ ID NO: 459228 - protein, 9 aa, Influenza virus
TSGTYGTGS

SEQ ID NO: 459229 - protein, 9 aa, Influenza virus
TSGTYGTGT

SEQ ID NO: 459230 - protein, 9 aa, Influenza virus
TSHRTLLMN

SEQ ID NO: 459231 - protein, 9 aa, Influenza virus
TSHTGTYCS

SEQ ID NO: 459232 - protein, 9 aa, Influenza virus
TSIRNNTYD

SEQ ID NO: 459233 - protein, 9 aa, Influenza virus
TSISCLYKL

SEQ ID NO: 459234 - protein, 9 aa, Influenza virus
TSIWTSSSS

SEQ ID NO: 459235 - protein, 9 aa, Influenza virus
TSKACNALT

SEQ ID NO: 459236 - protein, 9 aa, Influenza virus
TSKACNAST

SEQ ID NO: 459237 - protein, 9 aa, Influenza virus
TSKACSAST

SEQ ID NO: 459238 - protein, 9 aa, Influenza virus
TSKDSRSGY

SEQ ID NO: 459239 - protein, 9 aa, Influenza virus
TSKHYIGKC

SEQ ID NO: 459240 - protein, 9 aa, Influenza virus
TSKIKMKWG

SEQ ID NO: 459241 - protein, 9 aa, Influenza virus
TSKPFQNIC

SEQ ID NO: 459242 - protein, 9 aa, Influenza virus
TSKPFQNTS

SEQ ID NO: 459243 - protein, 9 aa, Influenza virus
TSKPLQNTS

SEQ ID NO: 459244 - protein, 9 aa, Influenza virus
TSKVKMKWG

SEQ ID NO: 459245 - protein, 9 aa, Influenza virus
TSLCSIWFS

SEQ ID NO: 459246 - protein, 9 aa, Influenza virus
TSLLLATGM

SEQ ID NO: 459247 - protein, 9 aa, Influenza virus
TSLTSLPFQ

SEQ ID NO: 459248 - protein, 9 aa, Influenza virus
TSNLPFQNV

SEQ ID NO: 459249 - protein, 9 aa, Influenza virus
TSNQDSFYR

SEQ ID NO: 459250 - protein, 9 aa, Influenza virus
TSNQGSFYR

SEQ ID NO: 459251 - protein, 9 aa, Influenza virus
TSNRGSFYR

SEQ ID NO: 459252 - protein, 9 aa, Influenza virus
TSNSIAVFC

SEQ ID NO: 459253 - protein, 9 aa, Influenza virus
TSNSIIAFC

SEQ ID NO: 459254 - protein, 9 aa, Influenza virus
TSNSIIVFC

SEQ ID NO: 459255 - protein, 9 aa, Influenza virus
TSNSIVAFC

SEQ ID NO: 459256 - protein, 9 aa, Influenza virus
TSNSIVALC

SEQ ID NO: 459257 - protein, 9 aa, Influenza virus
TSNSIVSMC

SEQ ID NO: 459258 - protein, 9 aa, Influenza virus
TSNSIVTFC

SEQ ID NO: 459259 - protein, 9 aa, Influenza virus
TSNSIVVFC

SEQ ID NO: 459260 - protein, 9 aa, Influenza virus
TSNSIVVFV

SEQ ID NO: 459261 - protein, 9 aa, Influenza virus
TSNSLIALC

SEQ ID NO: 459262 - protein, 9 aa, Influenza virus
TSNSLVALC

SEQ ID NO: 459263 - protein, 9 aa, Influenza virus
TSNSMVTFC

SEQ ID NO: 459264 - protein, 9 aa, Influenza virus
TSNSVVVFC

SEQ ID NO: 459265 - protein, 9 aa, Influenza virus
TSPCLTDKG

SEQ ID NO: 459266 - protein, 9 aa, Influenza virus
TSPIVPSFD

SEQ ID NO: 459267 - protein, 9 aa, Influenza virus
TSPLPFQNI

SEQ ID NO: 459268 - protein, 9 aa, Influenza virus
TSQRGILED

SEQ ID NO: 459269 - protein, 9 aa, Influenza virus
TSQRGVLED

SEQ ID NO: 459270 - protein, 9 aa, Influenza virus
TSQYICSPV

SEQ ID NO: 459271 - protein, 9 aa, Influenza virus
TSQYLCTGI

SEQ ID NO: 459272 - protein, 9 aa, Influenza virus
TSQYLCTGV

SEQ ID NO: 459273 - protein, 9 aa, Influenza virus
TSRHYIGKC

SEQ ID NO: 459274 - protein, 9 aa, Influenza virus
TSRHYMGEC

SEQ ID NO: 459275 - protein, 9 aa, Influenza virus
TSRYVCTGI

SEQ ID NO: 459276 - protein, 9 aa, Influenza virus
TSSGTSKAC

SEQ ID NO: 459277 - protein, 9 aa, Influenza virus
TSSIDLIET

SEQ ID NO: 459278 - protein, 9 aa, Influenza virus
TSSIDLVET

SEQ ID NO: 459279 - protein, 9 aa, Influenza virus
TSSIELVEN

SEQ ID NO: 459280 - protein, 9 aa, Influenza virus
TSSIYIEVL

SEQ ID NO: 459281 - protein, 9 aa, Influenza virus
TSSQDTEIS

SEQ ID NO: 459282 - protein, 9 aa, Influenza virus
TSSQDTELS

SEQ ID NO: 459283 - protein, 9 aa, Influenza virus
TSSSSIVMC

SEQ ID NO: 459284 - protein, 9 aa, Influenza virus
TSSSSTVFC

SEQ ID NO: 459285 - protein, 9 aa, Influenza virus
TSSSSVVMC

SEQ ID NO: 459286 - protein, 9 aa, Influenza virus
TSSVDLIET

SEQ ID NO: 459287 - protein, 9 aa, Influenza virus
TSSVDLVET

SEQ ID NO: 459288 - protein, 9 aa, Influenza virus
TSSVELVEN

SEQ ID NO: 459289 - protein, 9 aa, Influenza virus
TSSVELVET

SEQ ID NO: 459290 - protein, 9 aa, Influenza virus
TSSVYIEVL

SEQ ID NO: 459291 - protein, 9 aa, Influenza virus
TSSVYVEVL

SEQ ID NO: 459292 - protein, 9 aa, Influenza virus
TSTIDLIET

SEQ ID NO: 459293 - protein, 9 aa, Influenza virus
TSTQKAINE

SEQ ID NO: 459294 - protein, 9 aa, Influenza virus
TSVGGIDTN

SEQ ID NO: 459295 - protein, 9 aa, Influenza virus
TSVGGINTN

SEQ ID NO: 459296 - protein, 9 aa, Influenza virus
TSVKTLTDN

SEQ ID NO: 459297 - protein, 9 aa, Influenza virus
TSVTTNTIN

SEQ ID NO: 459298 - protein, 9 aa, Influenza virus
TSVWAGRTI

SEQ ID NO: 459299 - protein, 9 aa, Influenza virus
TSVWAGRTV

SEQ ID NO: 459300 - protein, 9 aa, Influenza virus
TSWSWPDGA

SEQ ID NO: 459301 - protein, 9 aa, Influenza virus
TSWSYIVEK

SEQ ID NO: 459302 - protein, 9 aa, Influenza virus
TSWSYIVER

SEQ ID NO: 459303 - protein, 9 aa, Influenza virus
TSYKILSIY

SEQ ID NO: 459304 - protein, 9 aa, Influenza virus
TSYRSLIRF

SEQ ID NO: 459305 - protein, 9 aa, Influenza virus
TSYWWDGLQ

SEQ ID NO: 459306 - protein, 9 aa, Influenza virus
TTAKAMEQM

SEQ ID NO: 459307 - protein, 9 aa, Influenza virus
TTAKAMEQV

SEQ ID NO: 459308 - protein, 9 aa, Influenza virus
TTASCQNRG

SEQ ID NO: 459309 - protein, 9 aa, Influenza virus
TTAVAVLKY

SEQ ID NO: 459310 - protein, 9 aa, Influenza virus
TTCHDGIGR

SEQ ID NO: 459311 - protein, 9 aa, Influenza virus
TTCWSWPDG

SEQ ID NO: 459312 - protein, 9 aa, Influenza virus
TTDWSGYSG

SEQ ID NO: 459313 - protein, 9 aa, Influenza virus
TTEINTWAR

SEQ ID NO: 459314 - protein, 9 aa, Influenza virus
TTEIRASVG

SEQ ID NO: 459315 - protein, 9 aa, Influenza virus
TTEIYNETV

SEQ ID NO: 459316 - protein, 9 aa, Influenza virus
TTEVSHCRA

SEQ ID NO: 459317 - protein, 9 aa, Influenza virus
TTEVYNETV

SEQ ID NO: 459318 - protein, 9 aa, Influenza virus
TTEVYSETV

SEQ ID NO: 459319 - protein, 9 aa, Influenza virus
TTFESNGGL

SEQ ID NO: 459320 - protein, 9 aa, Influenza virus
TTFPYTGDP

SEQ ID NO: 459321 - protein, 9 aa, Influenza virus
TTFRGLIST

SEQ ID NO: 459322 - protein, 9 aa, Influenza virus
TTFRGLLST

SEQ ID NO: 459323 - protein, 9 aa, Influenza virus
TTGKSHGRI

SEQ ID NO: 459324 - protein, 9 aa, Influenza virus
TTGMTLSVV

SEQ ID NO: 459325 - protein, 9 aa, Influenza virus
TTGNPIICL

SEQ ID NO: 459326 - protein, 9 aa, Influenza virus
TTGRDVLVI

SEQ ID NO: 459327 - protein, 9 aa, Influenza virus
TTGRDVLVL

SEQ ID NO: 459328 - protein, 9 aa, Influenza virus
TTGRDVLVM

SEQ ID NO: 459329 - protein, 9 aa, Influenza virus
TTGRNCTIP

SEQ ID NO: 459330 - protein, 9 aa, Influenza virus
TTGRNCTVP

SEQ ID NO: 459331 - protein, 9 aa, Influenza virus
TTGWSWPDG

SEQ ID NO: 459332 - protein, 9 aa, Influenza virus
TTHDRTAFR

SEQ ID NO: 459333 - protein, 9 aa, Influenza virus
TTHFQRKRR

SEQ ID NO: 459334 - protein, 9 aa, Influenza virus
TTHSWIPKR

SEQ ID NO: 459335 - protein, 9 aa, Influenza virus
TTHSWTPKR

SEQ ID NO: 459336 - protein, 9 aa, Influenza virus
TTHSWVPIL

SEQ ID NO: 459337 - protein, 9 aa, Influenza virus
TTHSWVPKR

SEQ ID NO: 459338 - protein, 9 aa, Influenza virus
TTHTGTYCS

SEQ ID NO: 459339 - protein, 9 aa, Influenza virus
TTIGLLLQI

SEQ ID NO: 459340 - protein, 9 aa, Influenza virus
TTIKPWARN

SEQ ID NO: 459341 - protein, 9 aa, Influenza virus
TTIKTWAGK

SEQ ID NO: 459342 - protein, 9 aa, Influenza virus
TTIKTWAGN

SEQ ID NO: 459343 - protein, 9 aa, Influenza virus
TTIKTWAKN

SEQ ID NO: 459344 - protein, 9 aa, Influenza virus
TTIKTWARN

SEQ ID NO: 459345 - protein, 9 aa, Influenza virus
TTINNITNV

SEQ ID NO: 459346 - protein, 9 aa, Influenza virus
TTIRGKHSN

SEQ ID NO: 459347 - protein, 9 aa, Influenza virus
TTIRGRHSN

SEQ ID NO: 459348 - protein, 9 aa, Influenza virus
TTIRNKHSN

SEQ ID NO: 459349 - protein, 9 aa, Influenza virus
TTIRNRHSN

SEQ ID NO: 459350 - protein, 9 aa, Influenza virus
TTIRTWAKN

SEQ ID NO: 459351 - protein, 9 aa, Influenza virus
TTITLHFKQ

SEQ ID NO: 459352 - protein, 9 aa, Influenza virus
TTIWTSGSS

SEQ ID NO: 459353 - protein, 9 aa, Influenza virus
TTKINNIID

SEQ ID NO: 459354 - protein, 9 aa, Influenza virus
TTKINNIIE

SEQ ID NO: 459355 - protein, 9 aa, Influenza virus
TTLDNEHSN

SEQ ID NO: 459356 - protein, 9 aa, Influenza virus
TTLDNKHSN

SEQ ID NO: 459357 - protein, 9 aa, Influenza virus
TTLENKHSN

SEQ ID NO: 459358 - protein, 9 aa, Influenza virus
TTLIENTYV

SEQ ID NO: 459359 - protein, 9 aa, Influenza virus
TTLKGRHAN

SEQ ID NO: 459360 - protein, 9 aa, Influenza virus
TTLNNKHSN

SEQ ID NO: 459361 - protein, 9 aa, Influenza virus
TTLPFHNIH

SEQ ID NO: 459362 - protein, 9 aa, Influenza virus
TTLPFHNVH

SEQ ID NO: 459363 - protein, 9 aa, Influenza virus
TTLRGQHAN

SEQ ID NO: 459364 - protein, 9 aa, Influenza virus
TTLRGRHAN

SEQ ID NO: 459365 - protein, 9 aa, Influenza virus
TTLSTIALF

SEQ ID NO: 459366 - protein, 9 aa, Influenza virus
TTLSTIALI

SEQ ID NO: 459367 - protein, 9 aa, Influenza virus
TTLSTIALL

SEQ ID NO: 459368 - protein, 9 aa, Influenza virus
TTLYKNANT

SEQ ID NO: 459369 - protein, 9 aa, Influenza virus
TTLYNKHSN

SEQ ID NO: 459370 - protein, 9 aa, Influenza virus
TTMEKNVTV

SEQ ID NO: 459371 - protein, 9 aa, Influenza virus
TTNPLIKHE

SEQ ID NO: 459372 - protein, 9 aa, Influenza virus
TTNPLIRHE

SEQ ID NO: 459373 - protein, 9 aa, Influenza virus
TTNSIVVFC

SEQ ID NO: 459374 - protein, 9 aa, Influenza virus
TTNTINRIF

SEQ ID NO: 459375 - protein, 9 aa, Influenza virus
TTNTINRNF

SEQ ID NO: 459376 - protein, 9 aa, Influenza virus
TTNTINRSF

SEQ ID NO: 459377 - protein, 9 aa, Influenza virus
TTNTYRNTD

SEQ ID NO: 459378 - protein, 9 aa, Influenza virus
TTNYYNETF

SEQ ID NO: 459379 - protein, 9 aa, Influenza virus
TTPTKSYFA

SEQ ID NO: 459380 - protein, 9 aa, Influenza virus
TTQIIKLLP

SEQ ID NO: 459381 - protein, 9 aa, Influenza virus
TTRQASPSC

SEQ ID NO: 459382 - protein, 9 aa, Influenza virus
TTSKDSRSG

SEQ ID NO: 459383 - protein, 9 aa, Influenza virus
TTSWSWPDG

SEQ ID NO: 459384 - protein, 9 aa, Influenza virus
TTTIKPWAR

SEQ ID NO: 459385 - protein, 9 aa, Influenza virus
TTTIKTWAG

SEQ ID NO: 459386 - protein, 9 aa, Influenza virus
TTTIKTWAK

SEQ ID NO: 459387 - protein, 9 aa, Influenza virus
TTTIKTWAR

SEQ ID NO: 459388 - protein, 9 aa, Influenza virus
TTTIRTWAK

SEQ ID NO: 459389 - protein, 9 aa, Influenza virus
TTTNPLIRH

SEQ ID NO: 459390 - protein, 9 aa, Influenza virus
TTTPTKSYF

SEQ ID NO: 459391 - protein, 9 aa, Influenza virus
TTTTIINNN

SEQ ID NO: 459392 - protein, 9 aa, Influenza virus
TTTVKTWAG

SEQ ID NO: 459393 - protein, 9 aa, Influenza virus
TTVDHMAII

SEQ ID NO: 459394 - protein, 9 aa, Influenza virus
TTVGLLLQI

SEQ ID NO: 459395 - protein, 9 aa, Influenza virus
TTVGLLLQV

SEQ ID NO: 459396 - protein, 9 aa, Influenza virus
TTVGWSWPD

SEQ ID NO: 459397 - protein, 9 aa, Influenza virus
TTVKTWAGN

SEQ ID NO: 459398 - protein, 9 aa, Influenza virus
TTVNEEALR

SEQ ID NO: 459399 - protein, 9 aa, Influenza virus
TTVTLHFKQ

SEQ ID NO: 459400 - protein, 9 aa, Influenza virus
TTVVENTYV

SEQ ID NO: 459401 - protein, 9 aa, Influenza virus
TTVWWTSNS

SEQ ID NO: 459402 - protein, 9 aa, Influenza virus
TTWDVFIER

SEQ ID NO: 459403 - protein, 9 aa, Influenza virus
TTYKILSIY

SEQ ID NO: 459404 - protein, 9 aa, Influenza virus
TTYQRTRAL

SEQ ID NO: 459405 - protein, 9 aa, Influenza virus
TTYRILSIY

SEQ ID NO: 459406 - protein, 9 aa, Influenza virus
TTYWWDGLQ

SEQ ID NO: 459407 - protein, 9 aa, Influenza virus
TVAASLCLA

SEQ ID NO: 459408 - protein, 9 aa, Influenza virus
TVAGSLSLA

SEQ ID NO: 459409 - protein, 9 aa, Influenza virus
TVASSLALA

SEQ ID NO: 459410 - protein, 9 aa, Influenza virus
TVASSLTLA

SEQ ID NO: 459411 - protein, 9 aa, Influenza virus
TVASSLVLA

SEQ ID NO: 459412 - protein, 9 aa, Influenza virus
TVDHMAIIK

SEQ ID NO: 459413 - protein, 9 aa, Influenza virus
TVDTILEKN

SEQ ID NO: 459414 - protein, 9 aa, Influenza virus
TVDTILERN

SEQ ID NO: 459415 - protein, 9 aa, Influenza virus
TVDTLIEQN

SEQ ID NO: 459416 - protein, 9 aa, Influenza virus
TVDTLLEKN

SEQ ID NO: 459417 - protein, 9 aa, Influenza virus
TVDTLTENG

SEQ ID NO: 459418 - protein, 9 aa, Influenza virus
TVDTVLEKN

SEQ ID NO: 459419 - protein, 9 aa, Influenza virus
TVDTVLERN

SEQ ID NO: 459420 - protein, 9 aa, Influenza virus
TVEITGIDK

SEQ ID NO: 459421 - protein, 9 aa, Influenza virus
TVEITGINK

SEQ ID NO: 459422 - protein, 9 aa, Influenza virus
TVERMVLSA

SEQ ID NO: 459423 - protein, 9 aa, Influenza virus
TVFCGVSGE

SEQ ID NO: 459424 - protein, 9 aa, Influenza virus
TVFCGVSSE

SEQ ID NO: 459425 - protein, 9 aa, Influenza virus
TVGKCPRYI

SEQ ID NO: 459426 - protein, 9 aa, Influenza virus
TVGKCPRYV

SEQ ID NO: 459427 - protein, 9 aa, Influenza virus
TVGLLLQII

SEQ ID NO: 459428 - protein, 9 aa, Influenza virus
TVGLLLQIT

SEQ ID NO: 459429 - protein, 9 aa, Influenza virus
TVGLLLQVT

SEQ ID NO: 459430 - protein, 9 aa, Influenza virus
TVGQCPKYV

SEQ ID NO: 459431 - protein, 9 aa, Influenza virus
TVGRCPRYV

SEQ ID NO: 459432 - protein, 9 aa, Influenza virus
TVGSSKYQQ

SEQ ID NO: 459433 - protein, 9 aa, Influenza virus
TVGSSKYRQ

SEQ ID NO: 459434 - protein, 9 aa, Influenza virus
TVGSSNYQQ

SEQ ID NO: 459435 - protein, 9 aa, Influenza virus
TVHDRIPHR

SEQ ID NO: 459436 - protein, 9 aa, Influenza virus
TVIKNNMIN

SEQ ID NO: 459437 - protein, 9 aa, Influenza virus
TVIKNNMVN

SEQ ID NO: 459438 - protein, 9 aa, Influenza virus
TVIMTDGSA

SEQ ID NO: 459439 - protein, 9 aa, Influenza virus
TVINNITTT

SEQ ID NO: 459440 - protein, 9 aa, Influenza virus
TVINNYYNE

SEQ ID NO: 459441 - protein, 9 aa, Influenza virus
TVIRNNMIN

SEQ ID NO: 459442 - protein, 9 aa, Influenza virus
TVKDRSPFR

SEQ ID NO: 459443 - protein, 9 aa, Influenza virus
TVKDRSPYR

SEQ ID NO: 459444 - protein, 9 aa, Influenza virus
TVKIKTNGN

SEQ ID NO: 459445 - protein, 9 aa, Influenza virus
TVKIQTNGN

SEQ ID NO: 459446 - protein, 9 aa, Influenza virus
TVKIQTSGN

SEQ ID NO: 459447 - protein, 9 aa, Influenza virus
TVKQDGKSS

SEQ ID NO: 459448 - protein, 9 aa, Influenza virus
TVKQNGKSG

SEQ ID NO: 459449 - protein, 9 aa, Influenza virus
TVKQNGKSS

SEQ ID NO: 459450 - protein, 9 aa, Influenza virus
TVKTWAGNI

SEQ ID NO: 459451 - protein, 9 aa, Influenza virus
TVLEKNVTV

SEQ ID NO: 459452 - protein, 9 aa, Influenza virus
TVLERNVTV

SEQ ID NO: 459453 - protein, 9 aa, Influenza virus
TVLGVSILN

SEQ ID NO: 459454 - protein, 9 aa, Influenza virus
TVLKSDKRI

SEQ ID NO: 459455 - protein, 9 aa, Influenza virus
TVLSIIALL

SEQ ID NO: 459456 - protein, 9 aa, Influenza virus
TVLVGLILA

SEQ ID NO: 459457 - protein, 9 aa, Influenza virus
TVMVGLILA

SEQ ID NO: 459458 - protein, 9 aa, Influenza virus
TVNEEALRQ

SEQ ID NO: 459459 - protein, 9 aa, Influenza virus
TVNEGALRQ

SEQ ID NO: 459460 - protein, 9 aa, Influenza virus
TVNFSFNGA

SEQ ID NO: 459461 - protein, 9 aa, Influenza virus
TVNRTHQYS

SEQ ID NO: 459462 - protein, 9 aa, Influenza virus
TVNTLIEQK

SEQ ID NO: 459463 - protein, 9 aa, Influenza virus
TVNTLIEQN

SEQ ID NO: 459464 - protein, 9 aa, Influenza virus
TVNTLMEQN

SEQ ID NO: 459465 - protein, 9 aa, Influenza virus
TVNTLSEQN

SEQ ID NO: 459466 - protein, 9 aa, Influenza virus
TVNTLTEQN

SEQ ID NO: 459467 - protein, 9 aa, Influenza virus
TVNVRGSGL

SEQ ID NO: 459468 - protein, 9 aa, Influenza virus
TVNVRGSGM

SEQ ID NO: 459469 - protein, 9 aa, Influenza virus
TVNVRGTGM

SEQ ID NO: 459470 - protein, 9 aa, Influenza virus
TVPCFWVEM

SEQ ID NO: 459471 - protein, 9 aa, Influenza virus
TVPSERGLQ

SEQ ID NO: 459472 - protein, 9 aa, Influenza virus
TVQIIKLLP

SEQ ID NO: 459473 - protein, 9 aa, Influenza virus
TVQVDTIME

SEQ ID NO: 459474 - protein, 9 aa, Influenza virus
TVQVIKLLP

SEQ ID NO: 459475 - protein, 9 aa, Influenza virus
TVSADPLAS

SEQ ID NO: 459476 - protein, 9 aa, Influenza virus
TVSADPLLS

SEQ ID NO: 459477 - protein, 9 aa, Influenza virus
TVSADPLVS

SEQ ID NO: 459478 - protein, 9 aa, Influenza virus
TVSCDSPSN

SEQ ID NO: 459479 - protein, 9 aa, Influenza virus
TVSIDRFLR

SEQ ID NO: 459480 - protein, 9 aa, Influenza virus
TVSLSPGMM

SEQ ID NO: 459481 - protein, 9 aa, Influenza virus
TVSSFERFE

SEQ ID NO: 459482 - protein, 9 aa, Influenza virus
TVSSFYSEM

SEQ ID NO: 459483 - protein, 9 aa, Influenza virus
TVSSGLVLV

SEQ ID NO: 459484 - protein, 9 aa, Influenza virus
TVSSSLVLA

SEQ ID NO: 459485 - protein, 9 aa, Influenza virus
TVSSSLVLV

SEQ ID NO: 459486 - protein, 9 aa, Influenza virus
TVSTRSDQI

SEQ ID NO: 459487 - protein, 9 aa, Influenza virus
TVSVRGSGM

SEQ ID NO: 459488 - protein, 9 aa, Influenza virus
TVTDGPAAN

SEQ ID NO: 459489 - protein, 9 aa, Influenza virus
TVTFIFNGA

SEQ ID NO: 459490 - protein, 9 aa, Influenza virus
TVTFNFNGA

SEQ ID NO: 459491 - protein, 9 aa, Influenza virus
TVTFSFNGA

SEQ ID NO: 459492 - protein, 9 aa, Influenza virus
TVTFTFNGA

SEQ ID NO: 459493 - protein, 9 aa, Influenza virus
TVTGPPQCD

SEQ ID NO: 459494 - protein, 9 aa, Influenza virus
TVTHAKDIL

SEQ ID NO: 459495 - protein, 9 aa, Influenza virus
TVTHAKNIL

SEQ ID NO: 459496 - protein, 9 aa, Influenza virus
TVTHAQDIL

SEQ ID NO: 459497 - protein, 9 aa, Influenza virus
TVTHAQDLL

SEQ ID NO: 459498 - protein, 9 aa, Influenza virus
TVTHAQNIL

SEQ ID NO: 459499 - protein, 9 aa, Influenza virus
TVTHSIELL

SEQ ID NO: 459500 - protein, 9 aa, Influenza virus
TVTHSINLL

SEQ ID NO: 459501 - protein, 9 aa, Influenza virus
TVTHSVDLL

SEQ ID NO: 459502 - protein, 9 aa, Influenza virus
TVTHSVELL

SEQ ID NO: 459503 - protein, 9 aa, Influenza virus
TVTHSVNIL

SEQ ID NO: 459504 - protein, 9 aa, Influenza virus
TVTHSVNLL

SEQ ID NO: 459505 - protein, 9 aa, Influenza virus
TVTLHFKQH

SEQ ID NO: 459506 - protein, 9 aa, Influenza virus
TVTLHFKQN

SEQ ID NO: 459507 - protein, 9 aa, Influenza virus
TVTSSIELV

SEQ ID NO: 459508 - protein, 9 aa, Influenza virus
TVTSSVELV

SEQ ID NO: 459509 - protein, 9 aa, Influenza virus
TVVENTYVN

SEQ ID NO: 459510 - protein, 9 aa, Influenza virus
TVVKTLTNE

SEQ ID NO: 459511 - protein, 9 aa, Influenza virus
TVVLNTDWS

SEQ ID NO: 459512 - protein, 9 aa, Influenza virus
TVVMTDGNA

SEQ ID NO: 459513 - protein, 9 aa, Influenza virus
TVVMTDGSA

SEQ ID NO: 459514 - protein, 9 aa, Influenza virus
TVVNNITTT

SEQ ID NO: 459515 - protein, 9 aa, Influenza virus
TVVSSLALA

SEQ ID NO: 459516 - protein, 9 aa, Influenza virus
TVWSSKYQQ

SEQ ID NO: 459517 - protein, 9 aa, Influenza virus
TVWSSKYQR

SEQ ID NO: 459518 - protein, 9 aa, Influenza virus
TVWSSKYRR

SEQ ID NO: 459519 - protein, 9 aa, Influenza virus
TVWTSGSII

SEQ ID NO: 459520 - protein, 9 aa, Influenza virus
TVWTSGSSI

SEQ ID NO: 459521 - protein, 9 aa, Influenza virus
TVWTSSSSI

SEQ ID NO: 459522 - protein, 9 aa, Influenza virus
TVYWWDGLQ

SEQ ID NO: 459523 - protein, 9 aa, Influenza virus
TVYYDRRLT

SEQ ID NO: 459524 - protein, 9 aa, Influenza virus
TVYYERRLT

SEQ ID NO: 459525 - protein, 9 aa, Influenza virus
TVYYNGRLT

SEQ ID NO: 459526 - protein, 9 aa, Influenza virus
TVYYNKRLT

SEQ ID NO: 459527 - protein, 9 aa, Influenza virus
TVYYNRRLT

SEQ ID NO: 459528 - protein, 9 aa, Influenza virus
TVYYNRRPT

SEQ ID NO: 459529 - protein, 9 aa, Influenza virus
TWAGKILRT

SEQ ID NO: 459530 - protein, 9 aa, Influenza virus
TWAGNILRT

SEQ ID NO: 459531 - protein, 9 aa, Influenza virus
TWAIHHPPT

SEQ ID NO: 459532 - protein, 9 aa, Influenza virus
TWAKNILRT

SEQ ID NO: 459533 - protein, 9 aa, Influenza virus
TWARNILRT

SEQ ID NO: 459534 - protein, 9 aa, Influenza virus
TWAVVMTDG

SEQ ID NO: 459535 - protein, 9 aa, Influenza virus
TWDTLIERD

SEQ ID NO: 459536 - protein, 9 aa, Influenza virus
TWDTLIERE

SEQ ID NO: 459537 - protein, 9 aa, Influenza virus
TWDTLIERG

SEQ ID NO: 459538 - protein, 9 aa, Influenza virus
TWDVFIERP

SEQ ID NO: 459539 - protein, 9 aa, Influenza virus
TWGIHHPSS

SEQ ID NO: 459540 - protein, 9 aa, Influenza virus
TWLGRTFSP

SEQ ID NO: 459541 - protein, 9 aa, Influenza virus
TWLGRTISI

SEQ ID NO: 459542 - protein, 9 aa, Influenza virus
TWLGRTISP

SEQ ID NO: 459543 - protein, 9 aa, Influenza virus
TWLGRTIST

SEQ ID NO: 459544 - protein, 9 aa, Influenza virus
TWLGRTLNT

SEQ ID NO: 459545 - protein, 9 aa, Influenza virus
TWLGRTTST

SEQ ID NO: 459546 - protein, 9 aa, Influenza virus
TWNGVKVDG

SEQ ID NO: 459547 - protein, 9 aa, Influenza virus
TYAGAINSS

SEQ ID NO: 459548 - protein, 9 aa, Influenza virus
TYAGAVNSS

SEQ ID NO: 459549 - protein, 9 aa, Influenza virus
TYCSLNGIS

SEQ ID NO: 459550 - protein, 9 aa, Influenza virus
TYCSLNGVS

SEQ ID NO: 459551 - protein, 9 aa, Influenza virus
TYDFNEGAY

SEQ ID NO: 459552 - protein, 9 aa, Influenza virus
TYDFNEGSY

SEQ ID NO: 459553 - protein, 9 aa, Influenza virus
TYDFNEGTY

SEQ ID NO: 459554 - protein, 9 aa, Influenza virus
TYDHAQYRE

SEQ ID NO: 459555 - protein, 9 aa, Influenza virus
TYDHKDFEE

SEQ ID NO: 459556 - protein, 9 aa, Influenza virus
TYDHKDYEE

SEQ ID NO: 459557 - protein, 9 aa, Influenza virus
TYDHKEFEE

SEQ ID NO: 459558 - protein, 9 aa, Influenza virus
TYDHKEFEK

SEQ ID NO: 459559 - protein, 9 aa, Influenza virus
TYDHKEYEE

SEQ ID NO: 459560 - protein, 9 aa, Influenza virus
TYDHNIYRD

SEQ ID NO: 459561 - protein, 9 aa, Influenza virus
TYDHSHYRE

SEQ ID NO: 459562 - protein, 9 aa, Influenza virus
TYDHSQYRE

SEQ ID NO: 459563 - protein, 9 aa, Influenza virus
TYDHTQYRE

SEQ ID NO: 459564 - protein, 9 aa, Influenza virus
TYDWTLNRN

SEQ ID NO: 459565 - protein, 9 aa, Influenza virus
TYDYPKYEE

SEQ ID NO: 459566 - protein, 9 aa, Influenza virus
TYDYPKYEK

SEQ ID NO: 459567 - protein, 9 aa, Influenza virus
TYDYPKYSE

SEQ ID NO: 459568 - protein, 9 aa, Influenza virus
TYDYPKYSK

SEQ ID NO: 459569 - protein, 9 aa, Influenza virus
TYDYSKYEE

SEQ ID NO: 459570 - protein, 9 aa, Influenza virus
TYGACPKYI

SEQ ID NO: 459571 - protein, 9 aa, Influenza virus
TYGACPKYV

SEQ ID NO: 459572 - protein, 9 aa, Influenza virus
TYGACPRYI

SEQ ID NO: 459573 - protein, 9 aa, Influenza virus
TYGACPRYV

SEQ ID NO: 459574 - protein, 9 aa, Influenza virus
TYGAGSWPD

SEQ ID NO: 459575 - protein, 9 aa, Influenza virus
TYGKGSWPD

SEQ ID NO: 459576 - protein, 9 aa, Influenza virus
TYGPCPRYV

SEQ ID NO: 459577 - protein, 9 aa, Influenza virus
TYGSGSWPD

SEQ ID NO: 459578 - protein, 9 aa, Influenza virus
TYGTGSWAD

SEQ ID NO: 459579 - protein, 9 aa, Influenza virus
TYGTGSWPD

SEQ ID NO: 459580 - protein, 9 aa, Influenza virus
TYGTGTWPD

SEQ ID NO: 459581 - protein, 9 aa, Influenza virus
TYHNSFVPV

SEQ ID NO: 459582 - protein, 9 aa, Influenza virus
TYINNATII

SEQ ID NO: 459583 - protein, 9 aa, Influenza virus
TYINNTTII

SEQ ID NO: 459584 - protein, 9 aa, Influenza virus
TYISIGTST

SEQ ID NO: 459585 - protein, 9 aa, Influenza virus
TYISVGTST

SEQ ID NO: 459586 - protein, 9 aa, Influenza virus
TYIWTYQAE

SEQ ID NO: 459587 - protein, 9 aa, Influenza virus
TYKILSIYS

SEQ ID NO: 459588 - protein, 9 aa, Influenza virus
TYKILTIYS

SEQ ID NO: 459589 - protein, 9 aa, Influenza virus
TYNAELFVL

SEQ ID NO: 459590 - protein, 9 aa, Influenza virus
TYNAELLIL

SEQ ID NO: 459591 - protein, 9 aa, Influenza virus
TYNAELLVA

SEQ ID NO: 459592 - protein, 9 aa, Influenza virus
TYNAELLVL

SEQ ID NO: 459593 - protein, 9 aa, Influenza virus
TYNAEVLVL

SEQ ID NO: 459594 - protein, 9 aa, Influenza virus
TYNGIRTNG

SEQ ID NO: 459595 - protein, 9 aa, Influenza virus
TYNHEDYKE

SEQ ID NO: 459596 - protein, 9 aa, Influenza virus
TYNHEDYRE

SEQ ID NO: 459597 - protein, 9 aa, Influenza virus
TYNHKDYEE

SEQ ID NO: 459598 - protein, 9 aa, Influenza virus
TYNHKEYEE

SEQ ID NO: 459599 - protein, 9 aa, Influenza virus
TYNHTEYRQ

SEQ ID NO: 459600 - protein, 9 aa, Influenza virus
TYNHTQYRE

SEQ ID NO: 459601 - protein, 9 aa, Influenza virus
TYNKTVINN

SEQ ID NO: 459602 - protein, 9 aa, Influenza virus
TYNNTTGRD

SEQ ID NO: 459603 - protein, 9 aa, Influenza virus
TYNNTVINN

SEQ ID NO: 459604 - protein, 9 aa, Influenza virus
TYNNTVVNN

SEQ ID NO: 459605 - protein, 9 aa, Influenza virus
TYNRKEYEE

SEQ ID NO: 459606 - protein, 9 aa, Influenza virus
TYNSTVVNN

SEQ ID NO: 459607 - protein, 9 aa, Influenza virus
TYNTELLVL

SEQ ID NO: 459608 - protein, 9 aa, Influenza virus
TYNVELLVL

SEQ ID NO: 459609 - protein, 9 aa, Influenza virus
TYNYPKYEE

SEQ ID NO: 459610 - protein, 9 aa, Influenza virus
TYNYPKYSE

SEQ ID NO: 459611 - protein, 9 aa, Influenza virus
TYQAELLIA

SEQ ID NO: 459612 - protein, 9 aa, Influenza virus
TYQAELLVA

SEQ ID NO: 459613 - protein, 9 aa, Influenza virus
TYQILSIYS

SEQ ID NO: 459614 - protein, 9 aa, Influenza virus
TYQILSVYS

SEQ ID NO: 459615 - protein, 9 aa, Influenza virus
TYQKRMGVQ

SEQ ID NO: 459616 - protein, 9 aa, Influenza virus
TYQNNFVPV

SEQ ID NO: 459617 - protein, 9 aa, Influenza virus
TYQNSFVPV

SEQ ID NO: 459618 - protein, 9 aa, Influenza virus
TYQRTRALV

SEQ ID NO: 459619 - protein, 9 aa, Influenza virus
TYQWIIKNW

SEQ ID NO: 459620 - protein, 9 aa, Influenza virus
TYQWIIRNW

SEQ ID NO: 459621 - protein, 9 aa, Influenza virus
TYQWVIRNW

SEQ ID NO: 459622 - protein, 9 aa, Influenza virus
TYRCHKGDT

SEQ ID NO: 459623 - protein, 9 aa, Influenza virus
TYRCHRGDM

SEQ ID NO: 459624 - protein, 9 aa, Influenza virus
TYRCHRGDT

SEQ ID NO: 459625 - protein, 9 aa, Influenza virus
TYREEAMQN

SEQ ID NO: 459626 - protein, 9 aa, Influenza virus
TYRILSIYS

SEQ ID NO: 459627 - protein, 9 aa, Influenza virus
TYRNNRKEP

SEQ ID NO: 459628 - protein, 9 aa, Influenza virus
TYRNTRKEP

SEQ ID NO: 459629 - protein, 9 aa, Influenza virus
TYSEIRTNG

SEQ ID NO: 459630 - protein, 9 aa, Influenza virus
TYSGIRTDG

SEQ ID NO: 459631 - protein, 9 aa, Influenza virus
TYSGIRTNG

SEQ ID NO: 459632 - protein, 9 aa, Influenza virus
TYSSPMMWE

SEQ ID NO: 459633 - protein, 9 aa, Influenza virus
TYSSSLMWE

SEQ ID NO: 459634 - protein, 9 aa, Influenza virus
TYSSSMMWE

SEQ ID NO: 459635 - protein, 9 aa, Influenza virus
TYTGAINSS

SEQ ID NO: 459636 - protein, 9 aa, Influenza virus
TYTGISKAC

SEQ ID NO: 459637 - protein, 9 aa, Influenza virus
TYTGTSKAC

SEQ ID NO: 459638 - protein, 9 aa, Influenza virus
TYTGTSRAC

SEQ ID NO: 459639 - protein, 9 aa, Influenza virus
TYTGVRTDG

SEQ ID NO: 459640 - protein, 9 aa, Influenza virus
TYTGVRTNG

SEQ ID NO: 459641 - protein, 9 aa, Influenza virus
TYVDGFEPN

SEQ ID NO: 459642 - protein, 9 aa, Influenza virus
TYVLSIIPS

SEQ ID NO: 459643 - protein, 9 aa, Influenza virus
TYVLSIVPS

SEQ ID NO: 459644 - protein, 9 aa, Influenza virus
TYVLSVIPS

SEQ ID NO: 459645 - protein, 9 aa, Influenza virus
TYVNNTTII

SEQ ID NO: 459646 - protein, 9 aa, Influenza virus
TYVNNTTVI

SEQ ID NO: 459647 - protein, 9 aa, Influenza virus
TYVSIGTST

SEQ ID NO: 459648 - protein, 9 aa, Influenza virus
TYVSVGTST

SEQ ID NO: 459649 - protein, 9 aa, Influenza virus
TYWWDGLQS

SEQ ID NO: 459650 - protein, 9 aa, Influenza virus
TYYYPKYEE

SEQ ID NO: 459651 - protein, 9 aa, Influenza virus
VAAQELVES

SEQ ID NO: 459652 - protein, 9 aa, Influenza virus
VAASLCLAI

SEQ ID NO: 459653 - protein, 9 aa, Influenza virus
VAASLCLAV

SEQ ID NO: 459654 - protein, 9 aa, Influenza virus
VACGPAECR

SEQ ID NO: 459655 - protein, 9 aa, Influenza virus
VACGPSECR

SEQ ID NO: 459656 - protein, 9 aa, Influenza virus
VACGPTECR

SEQ ID NO: 459657 - protein, 9 aa, Influenza virus
VACSPSECR

SEQ ID NO: 459658 - protein, 9 aa, Influenza virus
VADGGPNLY

SEQ ID NO: 459659 - protein, 9 aa, Influenza virus
VADRDSTQK

SEQ ID NO: 459660 - protein, 9 aa, Influenza virus
VADSEMNKL

SEQ ID NO: 459661 - protein, 9 aa, Influenza virus
VAEGWINSP

SEQ ID NO: 459662 - protein, 9 aa, Influenza virus
VAEINTWAR

SEQ ID NO: 459663 - protein, 9 aa, Influenza virus
VAFCGTSGT

SEQ ID NO: 459664 - protein, 9 aa, Influenza virus
VAGGLILGM

SEQ ID NO: 459665 - protein, 9 aa, Influenza virus
VAGLSFWMC

SEQ ID NO: 459666 - protein, 9 aa, Influenza virus
VAGLSLWMC

SEQ ID NO: 459667 - protein, 9 aa, Influenza virus
VAGSLSLAI

SEQ ID NO: 459668 - protein, 9 aa, Influenza virus
VAGSSEQAA

SEQ ID NO: 459669 - protein, 9 aa, Influenza virus
VAGWILGNP

SEQ ID NO: 459670 - protein, 9 aa, Influenza virus
VAGWLLGNP

SEQ ID NO: 459671 - protein, 9 aa, Influenza virus
VAGWYGFQH

SEQ ID NO: 459672 - protein, 9 aa, Influenza virus
VAHKSCLPA

SEQ ID NO: 459673 - protein, 9 aa, Influenza virus
VAIALSILN

SEQ ID NO: 459674 - protein, 9 aa, Influenza virus
VAIALSVLN

SEQ ID NO: 459675 - protein, 9 aa, Influenza virus
VAIENQHTI

SEQ ID NO: 459676 - protein, 9 aa, Influenza virus
VAKAGFIEN

SEQ ID NO: 459677 - protein, 9 aa, Influenza virus
VAKDNAIRF

SEQ ID NO: 459678 - protein, 9 aa, Influenza virus
VAKDNAVRF

SEQ ID NO: 459679 - protein, 9 aa, Influenza virus
VAKGSYNNT

SEQ ID NO: 459680 - protein, 9 aa, Influenza virus
VAKRSYNNT

SEQ ID NO: 459681 - protein, 9 aa, Influenza virus
VALALSHTA

SEQ ID NO: 459682 - protein, 9 aa, Influenza virus
VALCGSKEQ

SEQ ID NO: 459683 - protein, 9 aa, Influenza virus
VALCGSKER

SEQ ID NO: 459684 - protein, 9 aa, Influenza virus
VALCGSPIS

SEQ ID NO: 459685 - protein, 9 aa, Influenza virus
VALCGSPVP

SEQ ID NO: 459686 - protein, 9 aa, Influenza virus
VALCGSPVS

SEQ ID NO: 459687 - protein, 9 aa, Influenza virus
VALCGSRER

SEQ ID NO: 459688 - protein, 9 aa, Influenza virus
VALENQHTI

SEQ ID NO: 459689 - protein, 9 aa, Influenza virus
VALENQNTI

SEQ ID NO: 459690 - protein, 9 aa, Influenza virus
VALGYSTGA

SEQ ID NO: 459691 - protein, 9 aa, Influenza virus
VALILGFVL

SEQ ID NO: 459692 - protein, 9 aa, Influenza virus
VALSYSAGA

SEQ ID NO: 459693 - protein, 9 aa, Influenza virus
VALSYSTGA

SEQ ID NO: 459694 - protein, 9 aa, Influenza virus
VAMENQHTI

SEQ ID NO: 459695 - protein, 9 aa, Influenza virus
VAMVFSQED

SEQ ID NO: 459696 - protein, 9 aa, Influenza virus
VAMVFSQEE

SEQ ID NO: 459697 - protein, 9 aa, Influenza virus
VANFSMELP

SEQ ID NO: 459698 - protein, 9 aa, Influenza virus
VANGTIVKT

SEQ ID NO: 459699 - protein, 9 aa, Influenza virus
VANGTKVNT

SEQ ID NO: 459700 - protein, 9 aa, Influenza virus
VANGTMVKT

SEQ ID NO: 459701 - protein, 9 aa, Influenza virus
VANLGLNIG

SEQ ID NO: 459702 - protein, 9 aa, Influenza virus
VAPDRVSFF

SEQ ID NO: 459703 - protein, 9 aa, Influenza virus
VAPEYGFKI

SEQ ID NO: 459704 - protein, 9 aa, Influenza virus
VAPIMFSNK

SEQ ID NO: 459705 - protein, 9 aa, Influenza virus
VAPRGHYKL

SEQ ID NO: 459706 - protein, 9 aa, Influenza virus
VAPSPSNSR

SEQ ID NO: 459707 - protein, 9 aa, Influenza virus
VAPSPYNSR

SEQ ID NO: 459708 - protein, 9 aa, Influenza virus
VAPSRVSKL

SEQ ID NO: 459709 - protein, 9 aa, Influenza virus
VAPVLGNYK

SEQ ID NO: 459710 - protein, 9 aa, Influenza virus
VAQGSYNNT

SEQ ID NO: 459711 - protein, 9 aa, Influenza virus
VARCNTKCQ

SEQ ID NO: 459712 - protein, 9 aa, Influenza virus
VAREPYVSC

SEQ ID NO: 459713 - protein, 9 aa, Influenza virus
VARGSYNNT

SEQ ID NO: 459714 - protein, 9 aa, Influenza virus
VARLGKGYM

SEQ ID NO: 459715 - protein, 9 aa, Influenza virus
VASMRRNYF

SEQ ID NO: 459716 - protein, 9 aa, Influenza virus
VASSGNLEF

SEQ ID NO: 459717 - protein, 9 aa, Influenza virus
VASSGTLEF

SEQ ID NO: 459718 - protein, 9 aa, Influenza virus
VASSGTVEF

SEQ ID NO: 459719 - protein, 9 aa, Influenza virus
VASSLALAI

SEQ ID NO: 459720 - protein, 9 aa, Influenza virus
VASSLTLAI

SEQ ID NO: 459721 - protein, 9 aa, Influenza virus
VASSLVLAI

SEQ ID NO: 459722 - protein, 9 aa, Influenza virus
VASSLVLLF

SEQ ID NO: 459723 - protein, 9 aa, Influenza virus
VASSLVLLL

SEQ ID NO: 459724 - protein, 9 aa, Influenza virus
VATGRVTVS

SEQ ID NO: 459725 - protein, 9 aa, Influenza virus
VATTHSWIP

SEQ ID NO: 459726 - protein, 9 aa, Influenza virus
VATTHSWTP

SEQ ID NO: 459727 - protein, 9 aa, Influenza virus
VATTHSWVP

SEQ ID NO: 459728 - protein, 9 aa, Influenza virus
VAVAKDNAI

SEQ ID NO: 459729 - protein, 9 aa, Influenza virus
VAVENQHTI

SEQ ID NO: 459730 - protein, 9 aa, Influenza virus
VAVIKYNGI

SEQ ID NO: 459731 - protein, 9 aa, Influenza virus
VAVLKYKGI

SEQ ID NO: 459732 - protein, 9 aa, Influenza virus
VAVLKYNDI

SEQ ID NO: 459733 - protein, 9 aa, Influenza virus
VAVLKYNGI

SEQ ID NO: 459734 - protein, 9 aa, Influenza virus
VAVLKYNGV

SEQ ID NO: 459735 - protein, 9 aa, Influenza virus
VAVTDGPAA

SEQ ID NO: 459736 - protein, 9 aa, Influenza virus
VAWSASACH

SEQ ID NO: 459737 - protein, 9 aa, Influenza virus
VAWSATACH

SEQ ID NO: 459738 - protein, 9 aa, Influenza virus
VAWSATACS

SEQ ID NO: 459739 - protein, 9 aa, Influenza virus
VAWSSSSCF

SEQ ID NO: 459740 - protein, 9 aa, Influenza virus
VAWSSSSCH

SEQ ID NO: 459741 - protein, 9 aa, Influenza virus
VAWSSTSCF

SEQ ID NO: 459742 - protein, 9 aa, Influenza virus
VAYDKICIG

SEQ ID NO: 459743 - protein, 9 aa, Influenza virus
VAYERMCNI

SEQ ID NO: 459744 - protein, 9 aa, Influenza virus
VAYMLEREL

SEQ ID NO: 459745 - protein, 9 aa, Influenza virus
VCAAWSSSS

SEQ ID NO: 459746 - protein, 9 aa, Influenza virus
VCATCEQIA

SEQ ID NO: 459747 - protein, 9 aa, Influenza virus
VCFMYSDFH

SEQ ID NO: 459748 - protein, 9 aa, Influenza virus
VCHKGICPV

SEQ ID NO: 459749 - protein, 9 aa, Influenza virus
VCHKGVCPV

SEQ ID NO: 459750 - protein, 9 aa, Influenza virus
VCHNGICPV

SEQ ID NO: 459751 - protein, 9 aa, Influenza virus
VCHNGTCAV

SEQ ID NO: 459752 - protein, 9 aa, Influenza virus
VCHNGTCVV

SEQ ID NO: 459753 - protein, 9 aa, Influenza virus
VCHNGVCPV

SEQ ID NO: 459754 - protein, 9 aa, Influenza virus
VCHNSTCVV

SEQ ID NO: 459755 - protein, 9 aa, Influenza virus
VCHSGICPV

SEQ ID NO: 459756 - protein, 9 aa, Influenza virus
VCHSGVCPV

SEQ ID NO: 459757 - protein, 9 aa, Influenza virus
VCIAWSSAS

SEQ ID NO: 459758 - protein, 9 aa, Influenza virus
VCIAWSSSS

SEQ ID NO: 459759 - protein, 9 aa, Influenza virus
VCINGICTV

SEQ ID NO: 459760 - protein, 9 aa, Influenza virus
VCINGSCAV

SEQ ID NO: 459761 - protein, 9 aa, Influenza virus
VCINGSCIV

SEQ ID NO: 459762 - protein, 9 aa, Influenza virus
VCINGSCTV

SEQ ID NO: 459763 - protein, 9 aa, Influenza virus
VCINGTCAV

SEQ ID NO: 459764 - protein, 9 aa, Influenza virus
VCINGTCTV

SEQ ID NO: 459765 - protein, 9 aa, Influenza virus
VCISGPNNN

SEQ ID NO: 459766 - protein, 9 aa, Influenza virus
VCISGTCAV

SEQ ID NO: 459767 - protein, 9 aa, Influenza virus
VCITGDDRN

SEQ ID NO: 459768 - protein, 9 aa, Influenza virus
VCLKWDLMD

SEQ ID NO: 459769 - protein, 9 aa, Influenza virus
VCLKWELMD

SEQ ID NO: 459770 - protein, 9 aa, Influenza virus
VCMAWSSSS

SEQ ID NO: 459771 - protein, 9 aa, Influenza virus
VCMESVRNG

SEQ ID NO: 459772 - protein, 9 aa, Influenza virus
VCMSGPNNN

SEQ ID NO: 459773 - protein, 9 aa, Influenza virus
VCPVVFTDG

SEQ ID NO: 459774 - protein, 9 aa, Influenza virus
VCPVVMTDG

SEQ ID NO: 459775 - protein, 9 aa, Influenza virus
VCQDEFCYT

SEQ ID NO: 459776 - protein, 9 aa, Influenza virus
VCRALLAKS

SEQ ID NO: 459777 - protein, 9 aa, Influenza virus
VCRDNWHAS

SEQ ID NO: 459778 - protein, 9 aa, Influenza virus
VCRDNWHGS

SEQ ID NO: 459779 - protein, 9 aa, Influenza virus
VCRDNWKGA

SEQ ID NO: 459780 - protein, 9 aa, Influenza virus
VCRDNWKGS

SEQ ID NO: 459781 - protein, 9 aa, Influenza virus
VCRDNWMGS

SEQ ID NO: 459782 - protein, 9 aa, Influenza virus
VCRDNWNGM

SEQ ID NO: 459783 - protein, 9 aa, Influenza virus
VCRDNWQGA

SEQ ID NO: 459784 - protein, 9 aa, Influenza virus
VCRDNWRGS

SEQ ID NO: 459785 - protein, 9 aa, Influenza virus
VCRDNWTGT

SEQ ID NO: 459786 - protein, 9 aa, Influenza virus
VCRTLLAKS

SEQ ID NO: 459787 - protein, 9 aa, Influenza virus
VCSGIFGDN

SEQ ID NO: 459788 - protein, 9 aa, Influenza virus
VCSGLVGDT

SEQ ID NO: 459789 - protein, 9 aa, Influenza virus
VCSGVFGDN

SEQ ID NO: 459790 - protein, 9 aa, Influenza virus
VCSKFHSDT

SEQ ID NO: 459791 - protein, 9 aa, Influenza virus
VCSNGSCRC

SEQ ID NO: 459792 - protein, 9 aa, Influenza virus
VCTGILTDT

SEQ ID NO: 459793 - protein, 9 aa, Influenza virus
VCTGVLTDT

SEQ ID NO: 459794 - protein, 9 aa, Influenza virus
VCTKGKKAV

SEQ ID NO: 459795 - protein, 9 aa, Influenza virus
VCVAWSSSS

SEQ ID NO: 459796 - protein, 9 aa, Influenza virus
VCVCRDNWH

SEQ ID NO: 459797 - protein, 9 aa, Influenza virus
VCVSLLQSA

SEQ ID NO: 459798 - protein, 9 aa, Influenza virus
VCVTGDDGN

SEQ ID NO: 459799 - protein, 9 aa, Influenza virus
VCVTGDDKN

SEQ ID NO: 459800 - protein, 9 aa, Influenza virus
VCVTGDDRN

SEQ ID NO: 459801 - protein, 9 aa, Influenza virus
VCWDNWRGS

SEQ ID NO: 459802 - protein, 9 aa, Influenza virus
VCWSFALAQ

SEQ ID NO: 459803 - protein, 9 aa, Influenza virus
VCYNPCFYV

SEQ ID NO: 459804 - protein, 9 aa, Influenza virus
VCYPGKFAN

SEQ ID NO: 459805 - protein, 9 aa, Influenza virus
VCYPGKFSN

SEQ ID NO: 459806 - protein, 9 aa, Influenza virus
VCYPGKFTN

SEQ ID NO: 459807 - protein, 9 aa, Influenza virus
VCYPGKFVN

SEQ ID NO: 459808 - protein, 9 aa, Influenza virus
VCYPGSIEN

SEQ ID NO: 459809 - protein, 9 aa, Influenza virus
VCYPGSIKN

SEQ ID NO: 459810 - protein, 9 aa, Influenza virus
VDALLGDPH

SEQ ID NO: 459811 - protein, 9 aa, Influenza virus
VDATETVER

SEQ ID NO: 459812 - protein, 9 aa, Influenza virus
VDCFIWHIR

SEQ ID NO: 459813 - protein, 9 aa, Influenza virus
VDCFLWHIR

SEQ ID NO: 459814 - protein, 9 aa, Influenza virus
VDCFLWHVR

SEQ ID NO: 459815 - protein, 9 aa, Influenza virus
VDCFLWYVR

SEQ ID NO: 459816 - protein, 9 aa, Influenza virus
VDCYLWHIR

SEQ ID NO: 459817 - protein, 9 aa, Influenza virus
VDDAVTDIW

SEQ ID NO: 459818 - protein, 9 aa, Influenza virus
VDDAVTDVW

SEQ ID NO: 459819 - protein, 9 aa, Influenza virus
VDEGNGCFE

SEQ ID NO: 459820 - protein, 9 aa, Influenza virus
VDEYSNAEK

SEQ ID NO: 459821 - protein, 9 aa, Influenza virus
VDEYSNAER

SEQ ID NO: 459822 - protein, 9 aa, Influenza virus
VDEYSSAER

SEQ ID NO: 459823 - protein, 9 aa, Influenza virus
VDEYSSTEK

SEQ ID NO: 459824 - protein, 9 aa, Influenza virus
VDEYSSTER

SEQ ID NO: 459825 - protein, 9 aa, Influenza virus
VDGFEPNGC

SEQ ID NO: 459826 - protein, 9 aa, Influenza virus
VDGFEPNGY

SEQ ID NO: 459827 - protein, 9 aa, Influenza virus
VDGFKPNGC

SEQ ID NO: 459828 - protein, 9 aa, Influenza virus
VDGQDCDLI

SEQ ID NO: 459829 - protein, 9 aa, Influenza virus
VDGQSGRID

SEQ ID NO: 459830 - protein, 9 aa, Influenza virus
VDGSSSACL

SEQ ID NO: 459831 - protein, 9 aa, Influenza virus
VDGTIAGFI

SEQ ID NO: 459832 - protein, 9 aa, Influenza virus
VDGWYGFHH

SEQ ID NO: 459833 - protein, 9 aa, Influenza virus
VDGWYGFRH

SEQ ID NO: 459834 - protein, 9 aa, Influenza virus
VDGWYGFRY

SEQ ID NO: 459835 - protein, 9 aa, Influenza virus
VDGWYGYHH

SEQ ID NO: 459836 - protein, 9 aa, Influenza virus
VDHMAIIKK

SEQ ID NO: 459837 - protein, 9 aa, Influenza virus
VDICKAAIG

SEQ ID NO: 459838 - protein, 9 aa, Influenza virus
VDICKAALG

SEQ ID NO: 459839 - protein, 9 aa, Influenza virus
VDICKAAMG

SEQ ID NO: 459840 - protein, 9 aa, Influenza virus
VDINPGHAD

SEQ ID NO: 459841 - protein, 9 aa, Influenza virus
VDINPGHSD

SEQ ID NO: 459842 - protein, 9 aa, Influenza virus
VDKLTQGRQ

SEQ ID NO: 459843 - protein, 9 aa, Influenza virus
VDKMNREFE

SEQ ID NO: 459844 - protein, 9 aa, Influenza virus
VDKMNREFG

SEQ ID NO: 459845 - protein, 9 aa, Influenza virus
VDLGQCGLL

SEQ ID NO: 459846 - protein, 9 aa, Influenza virus
VDLGSCGIL

SEQ ID NO: 459847 - protein, 9 aa, Influenza virus
VDLVETNHT

SEQ ID NO: 459848 - protein, 9 aa, Influenza virus
VDLWSYNAE

SEQ ID NO: 459849 - protein, 9 aa, Influenza virus
VDMNPGHAD

SEQ ID NO: 459850 - protein, 9 aa, Influenza virus
VDNHSMSDI

SEQ ID NO: 459851 - protein, 9 aa, Influenza virus
VDNKNWSGY

SEQ ID NO: 459852 - protein, 9 aa, Influenza virus
VDNNGELRH

SEQ ID NO: 459853 - protein, 9 aa, Influenza virus
VDNNNWFGY

SEQ ID NO: 459854 - protein, 9 aa, Influenza virus
VDNNNWSGY

SEQ ID NO: 459855 - protein, 9 aa, Influenza virus
VDNNSWSGY

SEQ ID NO: 459856 - protein, 9 aa, Influenza virus
VDNSNWSGY

SEQ ID NO: 459857 - protein, 9 aa, Influenza virus
VDQITGKLN

SEQ ID NO: 459858 - protein, 9 aa, Influenza virus
VDQSLIIAA

SEQ ID NO: 459859 - protein, 9 aa, Influenza virus
VDQSLVIAA

SEQ ID NO: 459860 - protein, 9 aa, Influenza virus
VDQVRESRN

SEQ ID NO: 459861 - protein, 9 aa, Influenza virus
VDRFYRICK

SEQ ID NO: 459862 - protein, 9 aa, Influenza virus
VDRFYRTCK

SEQ ID NO: 459863 - protein, 9 aa, Influenza virus
VDRLTQGRQ

SEQ ID NO: 459864 - protein, 9 aa, Influenza virus
VDSIGSWSQ

SEQ ID NO: 459865 - protein, 9 aa, Influenza virus
VDSIVSWSQ

SEQ ID NO: 459866 - protein, 9 aa, Influenza virus
VDTCYPFDV

SEQ ID NO: 459867 - protein, 9 aa, Influenza virus
VDTGDGCFE

SEQ ID NO: 459868 - protein, 9 aa, Influenza virus
VDTGNGCFD

SEQ ID NO: 459869 - protein, 9 aa, Influenza virus
VDTIIENNV

SEQ ID NO: 459870 - protein, 9 aa, Influenza virus
VDTIIESNI

SEQ ID NO: 459871 - protein, 9 aa, Influenza virus
VDTIIESNV

SEQ ID NO: 459872 - protein, 9 aa, Influenza virus
VDTILEKNI

SEQ ID NO: 459873 - protein, 9 aa, Influenza virus
VDTILEKNV

SEQ ID NO: 459874 - protein, 9 aa, Influenza virus
VDTILERNV

SEQ ID NO: 459875 - protein, 9 aa, Influenza virus
VDTIMEKIV

SEQ ID NO: 459876 - protein, 9 aa, Influenza virus
VDTIMEKNV

SEQ ID NO: 459877 - protein, 9 aa, Influenza virus
VDTIMERNV

SEQ ID NO: 459878 - protein, 9 aa, Influenza virus
VDTIREKNV

SEQ ID NO: 459879 - protein, 9 aa, Influenza virus
VDTLLEKNV

SEQ ID NO: 459880 - protein, 9 aa, Influenza virus
VDTLLENDV

SEQ ID NO: 459881 - protein, 9 aa, Influenza virus
VDTLLENGV

SEQ ID NO: 459882 - protein, 9 aa, Influenza virus
VDTLLENNV

SEQ ID NO: 459883 - protein, 9 aa, Influenza virus
VDTLLESDV

SEQ ID NO: 459884 - protein, 9 aa, Influenza virus
VDTLTEKGI

SEQ ID NO: 459885 - protein, 9 aa, Influenza virus
VDTLTENGV

SEQ ID NO: 459886 - protein, 9 aa, Influenza virus
VDTLTETGV

SEQ ID NO: 459887 - protein, 9 aa, Influenza virus
VDTNLERNV

SEQ ID NO: 459888 - protein, 9 aa, Influenza virus
VDTNPGHAD

SEQ ID NO: 459889 - protein, 9 aa, Influenza virus
VDTVLEKNV

SEQ ID NO: 459890 - protein, 9 aa, Influenza virus
VDTVLERNV

SEQ ID NO: 459891 - protein, 9 aa, Influenza virus
VDTVREKNV

SEQ ID NO: 459892 - protein, 9 aa, Influenza virus
VDVNPGHAD

SEQ ID NO: 459893 - protein, 9 aa, Influenza virus
VDVYCICRD

SEQ ID NO: 459894 - protein, 9 aa, Influenza virus
VEAESSVKE

SEQ ID NO: 459895 - protein, 9 aa, Influenza virus
VEALARSIC

SEQ ID NO: 459896 - protein, 9 aa, Influenza virus
VEAMISRAR

SEQ ID NO: 459897 - protein, 9 aa, Influenza virus
VEAMMSRAR

SEQ ID NO: 459898 - protein, 9 aa, Influenza virus
VEAMVSRAR

SEQ ID NO: 459899 - protein, 9 aa, Influenza virus
VEAVIYGNP

SEQ ID NO: 459900 - protein, 9 aa, Influenza virus
VECICRDNW

SEQ ID NO: 459901 - protein, 9 aa, Influenza virus
VECIGWSST

SEQ ID NO: 459902 - protein, 9 aa, Influenza virus
VECVCRDNW

SEQ ID NO: 459903 - protein, 9 aa, Influenza virus
VECVGWSST

SEQ ID NO: 459904 - protein, 9 aa, Influenza virus
VEDGFLDVW

SEQ ID NO: 459905 - protein, 9 aa, Influenza virus
VEDGSIGKV

SEQ ID NO: 459906 - protein, 9 aa, Influenza virus
VEDTKIDLW

SEQ ID NO: 459907 - protein, 9 aa, Influenza virus
VEDTKVDLW

SEQ ID NO: 459908 - protein, 9 aa, Influenza virus
VEECLINDP

SEQ ID NO: 459909 - protein, 9 aa, Influenza virus
VEECSCYPQ

SEQ ID NO: 459910 - protein, 9 aa, Influenza virus
VEECSCYPR

SEQ ID NO: 459911 - protein, 9 aa, Influenza virus
VEECSCYPS

SEQ ID NO: 459912 - protein, 9 aa, Influenza virus
VEEGSIGKV

SEQ ID NO: 459913 - protein, 9 aa, Influenza virus
VEELVHGGI

SEQ ID NO: 459914 - protein, 9 aa, Influenza virus
VEELVHGGV

SEQ ID NO: 459915 - protein, 9 aa, Influenza virus
VEELVHGQV

SEQ ID NO: 459916 - protein, 9 aa, Influenza virus
VEELVHRGI

SEQ ID NO: 459917 - protein, 9 aa, Influenza virus
VEESSIGKV

SEQ ID NO: 459918 - protein, 9 aa, Influenza virus
VEFCGTSGT

SEQ ID NO: 459919 - protein, 9 aa, Influenza virus
VEFEPFQSL

SEQ ID NO: 459920 - protein, 9 aa, Influenza virus
VEGLIYGNP

SEQ ID NO: 459921 - protein, 9 aa, Influenza virus
VEGLVYGNP

SEQ ID NO: 459922 - protein, 9 aa, Influenza virus
VEGRIQDLE

SEQ ID NO: 459923 - protein, 9 aa, Influenza virus
VEGRIQYLE

SEQ ID NO: 459924 - protein, 9 aa, Influenza virus
VEGRTQDLE

SEQ ID NO: 459925 - protein, 9 aa, Influenza virus
VEGWVVIAK

SEQ ID NO: 459926 - protein, 9 aa, Influenza virus
VEGWVVIAQ

SEQ ID NO: 459927 - protein, 9 aa, Influenza virus
VEGWVVIEK

SEQ ID NO: 459928 - protein, 9 aa, Influenza virus
VEGWVVVAK

SEQ ID NO: 459929 - protein, 9 aa, Influenza virus
VEIGVTRRE

SEQ ID NO: 459930 - protein, 9 aa, Influenza virus
VEIRINMIN

SEQ ID NO: 459931 - protein, 9 aa, Influenza virus
VEITGIDKV

SEQ ID NO: 459932 - protein, 9 aa, Influenza virus
VEITGINKV

SEQ ID NO: 459933 - protein, 9 aa, Influenza virus
VEKEFSNLE

SEQ ID NO: 459934 - protein, 9 aa, Influenza virus
VEKQIGNVI

SEQ ID NO: 459935 - protein, 9 aa, Influenza virus
VEKQLGNVI

SEQ ID NO: 459936 - protein, 9 aa, Influenza virus
VEKRINMIA

SEQ ID NO: 459937 - protein, 9 aa, Influenza virus
VEKRINMLA

SEQ ID NO: 459938 - protein, 9 aa, Influenza virus
VEKTNEKFH

SEQ ID NO: 459939 - protein, 9 aa, Influenza virus
VELAEKAMK

SEQ ID NO: 459940 - protein, 9 aa, Influenza virus
VELAEKTMK

SEQ ID NO: 459941 - protein, 9 aa, Influenza virus
VELAERAMK

SEQ ID NO: 459942 - protein, 9 aa, Influenza virus
VELDEIGED

SEQ ID NO: 459943 - protein, 9 aa, Influenza virus
VELIRGMPK

SEQ ID NO: 459944 - protein, 9 aa, Influenza virus
VELIRGMPQ

SEQ ID NO: 459945 - protein, 9 aa, Influenza virus
VELIRGQPK

SEQ ID NO: 459946 - protein, 9 aa, Influenza virus
VELIRGRKQ

SEQ ID NO: 459947 - protein, 9 aa, Influenza virus
VELIRGRLN

SEQ ID NO: 459948 - protein, 9 aa, Influenza virus
VELIRGRPE

SEQ ID NO: 459949 - protein, 9 aa, Influenza virus
VELIRGRPG

SEQ ID NO: 459950 - protein, 9 aa, Influenza virus
VELIRGRPI

SEQ ID NO: 459951 - protein, 9 aa, Influenza virus
VELIRGRPK

SEQ ID NO: 459952 - protein, 9 aa, Influenza virus
VELIRGRPN

SEQ ID NO: 459953 - protein, 9 aa, Influenza virus
VELIRGRPQ

SEQ ID NO: 459954 - protein, 9 aa, Influenza virus
VELIRGRPR

SEQ ID NO: 459955 - protein, 9 aa, Influenza virus
VELIRGRQQ

SEQ ID NO: 459956 - protein, 9 aa, Influenza virus
VELIRGRRQ

SEQ ID NO: 459957 - protein, 9 aa, Influenza virus
VELIRGRSQ

SEQ ID NO: 459958 - protein, 9 aa, Influenza virus
VELLVLMEN

SEQ ID NO: 459959 - protein, 9 aa, Influenza virus
VELSSGYKD

SEQ ID NO: 459960 - protein, 9 aa, Influenza virus
VELSSMGVY

SEQ ID NO: 459961 - protein, 9 aa, Influenza virus
VELVRGRPK

SEQ ID NO: 459962 - protein, 9 aa, Influenza virus
VEMIRGEPE

SEQ ID NO: 459963 - protein, 9 aa, Influenza virus
VEMIRGKPE

SEQ ID NO: 459964 - protein, 9 aa, Influenza virus
VEMIRGQPK

SEQ ID NO: 459965 - protein, 9 aa, Influenza virus
VEMIRGRPE

SEQ ID NO: 459966 - protein, 9 aa, Influenza virus
VENEIRTFS

SEQ ID NO: 459967 - protein, 9 aa, Influenza virus
VENGTSVKT

SEQ ID NO: 459968 - protein, 9 aa, Influenza virus
VENLEELRF

SEQ ID NO: 459969 - protein, 9 aa, Influenza virus
VENLFDEVR

SEQ ID NO: 459970 - protein, 9 aa, Influenza virus
VENQEELRS

SEQ ID NO: 459971 - protein, 9 aa, Influenza virus
VENQHTIDL

SEQ ID NO: 459972 - protein, 9 aa, Influenza virus
VENRINMLA

SEQ ID NO: 459973 - protein, 9 aa, Influenza virus
VENTYVNNT

SEQ ID NO: 459974 - protein, 9 aa, Influenza virus
VEPKGLFGA

SEQ ID NO: 459975 - protein, 9 aa, Influenza virus
VEPRGLFGA

SEQ ID NO: 459976 - protein, 9 aa, Influenza virus
VEQEIRAFS

SEQ ID NO: 459977 - protein, 9 aa, Influenza virus
VEQEIRTFS

SEQ ID NO: 459978 - protein, 9 aa, Influenza virus
VEQEMRTFS

SEQ ID NO: 459979 - protein, 9 aa, Influenza virus
VEQQIGNVI

SEQ ID NO: 459980 - protein, 9 aa, Influenza virus
VEQRINMLA

SEQ ID NO: 459981 - protein, 9 aa, Influenza virus
VERGLFGAI

SEQ ID NO: 459982 - protein, 9 aa, Influenza virus
VERILEEES

SEQ ID NO: 459983 - protein, 9 aa, Influenza virus
VERMVLSAF

SEQ ID NO: 459984 - protein, 9 aa, Influenza virus
VERPKEIEG

SEQ ID NO: 459985 - protein, 9 aa, Influenza virus
VERPKEMEG

SEQ ID NO: 459986 - protein, 9 aa, Influenza virus
VERPSAPEG

SEQ ID NO: 459987 - protein, 9 aa, Influenza virus
VERQIGNVI

SEQ ID NO: 459988 - protein, 9 aa, Influenza virus
VERRINMLA

SEQ ID NO: 459989 - protein, 9 aa, Influenza virus
VERTKEMEG

SEQ ID NO: 459990 - protein, 9 aa, Influenza virus
VESAVLRGF

SEQ ID NO: 459991 - protein, 9 aa, Influenza virus
VESEIRTFS

SEQ ID NO: 459992 - protein, 9 aa, Influenza virus
VESMIEAES

SEQ ID NO: 459993 - protein, 9 aa, Influenza virus
VESNGNLIA

SEQ ID NO: 459994 - protein, 9 aa, Influenza virus
VESNGNLVA

SEQ ID NO: 459995 - protein, 9 aa, Influenza virus
VESRINMIN

SEQ ID NO: 459996 - protein, 9 aa, Influenza virus
VESRINTIN

SEQ ID NO: 459997 - protein, 9 aa, Influenza virus
VESSNYQQS

SEQ ID NO: 459998 - protein, 9 aa, Influenza virus
VESSTYQNN

SEQ ID NO: 459999 - protein, 9 aa, Influenza virus
VETGYVCSK

SEQ ID NO: 460000 - protein, 9 aa, Influenza virus
VETLARCIC

SEQ ID NO: 460001 - protein, 9 aa, Influenza virus
VETLARNIC

SEQ ID NO: 460002 - protein, 9 aa, Influenza virus
VETLARRIC

SEQ ID NO: 460003 - protein, 9 aa, Influenza virus
VETLARSIC

SEQ ID NO: 460004 - protein, 9 aa, Influenza virus
VETNHTDEL

SEQ ID NO: 460005 - protein, 9 aa, Influenza virus
VETNHTGTY

SEQ ID NO: 460006 - protein, 9 aa, Influenza virus
VETRINMIN

SEQ ID NO: 460007 - protein, 9 aa, Influenza virus
VETSHTGTY

SEQ ID NO: 460008 - protein, 9 aa, Influenza virus
VETYVLSII

SEQ ID NO: 460009 - protein, 9 aa, Influenza virus
VETYVLSIV

SEQ ID NO: 460010 - protein, 9 aa, Influenza virus
VETYVLSVI

SEQ ID NO: 460011 - protein, 9 aa, Influenza virus
VEVITAQEL

SEQ ID NO: 460012 - protein, 9 aa, Influenza virus
VEVLHLTQG

SEQ ID NO: 460013 - protein, 9 aa, Influenza virus
VEVTNATEL

SEQ ID NO: 460014 - protein, 9 aa, Influenza virus
VEVVAAQEL

SEQ ID NO: 460015 - protein, 9 aa, Influenza virus
VEVVDATET

SEQ ID NO: 460016 - protein, 9 aa, Influenza virus
VEVVNATET

SEQ ID NO: 460017 - protein, 9 aa, Influenza virus
VEVVSAKEL

SEQ ID NO: 460018 - protein, 9 aa, Influenza virus
VEVVTAQEL

SEQ ID NO: 460019 - protein, 9 aa, Influenza virus
VEWTSNSLI

SEQ ID NO: 460020 - protein, 9 aa, Influenza virus
VEYASKTRI

SEQ ID NO: 460021 - protein, 9 aa, Influenza virus
VEYDAVATT

SEQ ID NO: 460022 - protein, 9 aa, Influenza virus
VEYNGKSLG

SEQ ID NO: 460023 - protein, 9 aa, Influenza virus
VFAGKNADL

SEQ ID NO: 460024 - protein, 9 aa, Influenza virus
VFAGKNSDL

SEQ ID NO: 460025 - protein, 9 aa, Influenza virus
VFAGKNTDL

SEQ ID NO: 460026 - protein, 9 aa, Influenza virus
VFCGTPGTY

SEQ ID NO: 460027 - protein, 9 aa, Influenza virus
VFCGTSGNY

SEQ ID NO: 460028 - protein, 9 aa, Influenza virus
VFCGTSGTC

SEQ ID NO: 460029 - protein, 9 aa, Influenza virus
VFCGTSGTY

SEQ ID NO: 460030 - protein, 9 aa, Influenza virus
VFCGVSGEV

SEQ ID NO: 460031 - protein, 9 aa, Influenza virus
VFCGVSSEV

SEQ ID NO: 460032 - protein, 9 aa, Influenza virus
VFCSTSGTY

SEQ ID NO: 460033 - protein, 9 aa, Influenza virus
VFEFSDERA

SEQ ID NO: 460034 - protein, 9 aa, Influenza virus
VFELSDEKA

SEQ ID NO: 460035 - protein, 9 aa, Influenza virus
VFELSDERA

SEQ ID NO: 460036 - protein, 9 aa, Influenza virus
VFFCLKNGN

SEQ ID NO: 460037 - protein, 9 aa, Influenza virus
VFFCLRNGN

SEQ ID NO: 460038 - protein, 9 aa, Influenza virus
VFICIKNGN

SEQ ID NO: 460039 - protein, 9 aa, Influenza virus
VFICVKNGN

SEQ ID NO: 460040 - protein, 9 aa, Influenza virus
VFIERPTAV

SEQ ID NO: 460041 - protein, 9 aa, Influenza virus
VFIIREPFV

SEQ ID NO: 460042 - protein, 9 aa, Influenza virus
VFLAMITYI

SEQ ID NO: 460043 - protein, 9 aa, Influenza virus
VFLTMITYI

SEQ ID NO: 460044 - protein, 9 aa, Influenza virus
VFMCVKNGN

SEQ ID NO: 460045 - protein, 9 aa, Influenza virus
VFNCLYASP

SEQ ID NO: 460046 - protein, 9 aa, Influenza virus
VFNSIYASP

SEQ ID NO: 460047 - protein, 9 aa, Influenza virus
VFNSLYASP

SEQ ID NO: 460048 - protein, 9 aa, Influenza virus
VFNSLYASS

SEQ ID NO: 460049 - protein, 9 aa, Influenza virus
VFNSLYSSP

SEQ ID NO: 460050 - protein, 9 aa, Influenza virus
VFNTIGNLI

SEQ ID NO: 460051 - protein, 9 aa, Influenza virus
VFNTIGNLV

SEQ ID NO: 460052 - protein, 9 aa, Influenza virus
VFPNEVGAK

SEQ ID NO: 460053 - protein, 9 aa, Influenza virus
VFPNEVGAR

SEQ ID NO: 460054 - protein, 9 aa, Influenza virus
VFPQLNQTY

SEQ ID NO: 460055 - protein, 9 aa, Influenza virus
VFREQKQEF

SEQ ID NO: 460056 - protein, 9 aa, Influenza virus
VFSIAASYK

SEQ ID NO: 460057 - protein, 9 aa, Influenza virus
VFSNAASYK

SEQ ID NO: 460058 - protein, 9 aa, Influenza virus
VFSQEDCMI

SEQ ID NO: 460059 - protein, 9 aa, Influenza virus
VFSQEDCMM

SEQ ID NO: 460060 - protein, 9 aa, Influenza virus
VFSQEDCMV

SEQ ID NO: 460061 - protein, 9 aa, Influenza virus
VFSQEECMI

SEQ ID NO: 460062 - protein, 9 aa, Influenza virus
VFSSAASYK

SEQ ID NO: 460063 - protein, 9 aa, Influenza virus
VFTDGSATG

SEQ ID NO: 460064 - protein, 9 aa, Influenza virus
VFTLTVPSE

SEQ ID NO: 460065 - protein, 9 aa, Influenza virus
VFVALILGF

SEQ ID NO: 460066 - protein, 9 aa, Influenza virus
VFVIREPCI

SEQ ID NO: 460067 - protein, 9 aa, Influenza virus
VFVIREPFI

SEQ ID NO: 460068 - protein, 9 aa, Influenza virus
VFVIREPFV

SEQ ID NO: 460069 - protein, 9 aa, Influenza virus
VFWTSNSIV

SEQ ID NO: 460070 - protein, 9 aa, Influenza virus
VGAINSSMP

SEQ ID NO: 460071 - protein, 9 aa, Influenza virus
VGAKILTSE

SEQ ID NO: 460072 - protein, 9 aa, Influenza virus
VGARIITSE

SEQ ID NO: 460073 - protein, 9 aa, Influenza virus
VGARILASE

SEQ ID NO: 460074 - protein, 9 aa, Influenza virus
VGARILTSE

SEQ ID NO: 460075 - protein, 9 aa, Influenza virus
VGARPKVNG

SEQ ID NO: 460076 - protein, 9 aa, Influenza virus
VGARPQVNG

SEQ ID NO: 460077 - protein, 9 aa, Influenza virus
VGCVILLNP

SEQ ID NO: 460078 - protein, 9 aa, Influenza virus
VGDTPRNDD

SEQ ID NO: 460079 - protein, 9 aa, Influenza virus
VGDTPRNED

SEQ ID NO: 460080 - protein, 9 aa, Influenza virus
VGDTPRNGD

SEQ ID NO: 460081 - protein, 9 aa, Influenza virus
VGDTPRNND

SEQ ID NO: 460082 - protein, 9 aa, Influenza virus
VGEAPSPYN

SEQ ID NO: 460083 - protein, 9 aa, Influenza virus
VGECPRYVK

SEQ ID NO: 460084 - protein, 9 aa, Influenza virus
VGEVPSPYN

SEQ ID NO: 460085 - protein, 9 aa, Influenza virus
VGGIDTNKT

SEQ ID NO: 460086 - protein, 9 aa, Influenza virus
VGGINTNKT

SEQ ID NO: 460087 - protein, 9 aa, Influenza virus
VGGINTNRT

SEQ ID NO: 460088 - protein, 9 aa, Influenza virus
VGGNEKKAK

SEQ ID NO: 460089 - protein, 9 aa, Influenza virus
VGGSGTDNY

SEQ ID NO: 460090 - protein, 9 aa, Influenza virus
VGGSGTNNY

SEQ ID NO: 460091 - protein, 9 aa, Influenza virus
VGIAADKES

SEQ ID NO: 460092 - protein, 9 aa, Influenza virus
VGICKAAMG

SEQ ID NO: 460093 - protein, 9 aa, Influenza virus
VGIDPFKLL

SEQ ID NO: 460094 - protein, 9 aa, Influenza virus
VGIDPFRLL

SEQ ID NO: 460095 - protein, 9 aa, Influenza virus
VGINMSKKK

SEQ ID NO: 460096 - protein, 9 aa, Influenza virus
VGINMSKRK

SEQ ID NO: 460097 - protein, 9 aa, Influenza virus
VGISSMGEA

SEQ ID NO: 460098 - protein, 9 aa, Influenza virus
VGISSMMEA

SEQ ID NO: 460099 - protein, 9 aa, Influenza virus
VGISSMVEA

SEQ ID NO: 460100 - protein, 9 aa, Influenza virus
VGKCNDPYP

SEQ ID NO: 460101 - protein, 9 aa, Influenza virus
VGKCNEPYP

SEQ ID NO: 460102 - protein, 9 aa, Influenza virus
VGKCPKYVK

SEQ ID NO: 460103 - protein, 9 aa, Influenza virus
VGKCPRYIK

SEQ ID NO: 460104 - protein, 9 aa, Influenza virus
VGKCPRYVK

SEQ ID NO: 460105 - protein, 9 aa, Influenza virus
VGKCPRYVR

SEQ ID NO: 460106 - protein, 9 aa, Influenza virus
VGKEFGNLE

SEQ ID NO: 460107 - protein, 9 aa, Influenza virus
VGKEFNNLE

SEQ ID NO: 460108 - protein, 9 aa, Influenza virus
VGKEFNSLE

SEQ ID NO: 460109 - protein, 9 aa, Influenza virus
VGKEFSNLE

SEQ ID NO: 460110 - protein, 9 aa, Influenza virus
VGLILAFIL

SEQ ID NO: 460111 - protein, 9 aa, Influenza virus
VGLILAFIM

SEQ ID NO: 460112 - protein, 9 aa, Influenza virus
VGLILSFIM

SEQ ID NO: 460113 - protein, 9 aa, Influenza virus
VGLILTFIM

SEQ ID NO: 460114 - protein, 9 aa, Influenza virus
VGLLLQIIS

SEQ ID NO: 460115 - protein, 9 aa, Influenza virus
VGLLLQITS

SEQ ID NO: 460116 - protein, 9 aa, Influenza virus
VGLNISLHL

SEQ ID NO: 460117 - protein, 9 aa, Influenza virus
VGLNMSLHL

SEQ ID NO: 460118 - protein, 9 aa, Influenza virus
VGLNVSLHL

SEQ ID NO: 460119 - protein, 9 aa, Influenza virus
VGLRNTPSI

SEQ ID NO: 460120 - protein, 9 aa, Influenza virus
VGLRNTPSV

SEQ ID NO: 460121 - protein, 9 aa, Influenza virus
VGLVFFCLK

SEQ ID NO: 460122 - protein, 9 aa, Influenza virus
VGMAADKES

SEQ ID NO: 460123 - protein, 9 aa, Influenza virus
VGNDNWSGY

SEQ ID NO: 460124 - protein, 9 aa, Influenza virus
VGNGCFEFY

SEQ ID NO: 460125 - protein, 9 aa, Influenza virus
VGNLAFNTV

SEQ ID NO: 460126 - protein, 9 aa, Influenza virus
VGNLIFNTV

SEQ ID NO: 460127 - protein, 9 aa, Influenza virus
VGNLVFNTV

SEQ ID NO: 460128 - protein, 9 aa, Influenza virus
VGNPSCASN

SEQ ID NO: 460129 - protein, 9 aa, Influenza virus
VGNPSCATN

SEQ ID NO: 460130 - protein, 9 aa, Influenza virus
VGPGSFPDG

SEQ ID NO: 460131 - protein, 9 aa, Influenza virus
VGPILSFIM

SEQ ID NO: 460132 - protein, 9 aa, Influenza virus
VGQCPKYVK

SEQ ID NO: 460133 - protein, 9 aa, Influenza virus
VGQCPKYVN

SEQ ID NO: 460134 - protein, 9 aa, Influenza virus
VGQCPKYVS

SEQ ID NO: 460135 - protein, 9 aa, Influenza virus
VGQSPNVYQ

SEQ ID NO: 460136 - protein, 9 aa, Influenza virus
VGRCPRYVK

SEQ ID NO: 460137 - protein, 9 aa, Influenza virus
VGRMTICIQ

SEQ ID NO: 460138 - protein, 9 aa, Influenza virus
VGRMTICVQ

SEQ ID NO: 460139 - protein, 9 aa, Influenza virus
VGRSGTNNY

SEQ ID NO: 460140 - protein, 9 aa, Influenza virus
VGRTISIAS

SEQ ID NO: 460141 - protein, 9 aa, Influenza virus
VGSGSFPDG

SEQ ID NO: 460142 - protein, 9 aa, Influenza virus
VGSGSFPNG

SEQ ID NO: 460143 - protein, 9 aa, Influenza virus
VGSRGHVFV

SEQ ID NO: 460144 - protein, 9 aa, Influenza virus
VGSRINMIN

SEQ ID NO: 460145 - protein, 9 aa, Influenza virus
VGSSIYQNS

SEQ ID NO: 460146 - protein, 9 aa, Influenza virus
VGSSKYQQS

SEQ ID NO: 460147 - protein, 9 aa, Influenza virus
VGSSKYRQS

SEQ ID NO: 460148 - protein, 9 aa, Influenza virus
VGSSNYQQS

SEQ ID NO: 460149 - protein, 9 aa, Influenza virus
VGSSTYHNS

SEQ ID NO: 460150 - protein, 9 aa, Influenza virus
VGSSTYQNN

SEQ ID NO: 460151 - protein, 9 aa, Influenza virus
VGSSTYQNS

SEQ ID NO: 460152 - protein, 9 aa, Influenza virus
VGSWSQNIL

SEQ ID NO: 460153 - protein, 9 aa, Influenza virus
VGTAPVLGN

SEQ ID NO: 460154 - protein, 9 aa, Influenza virus
VGTKHSNGT

SEQ ID NO: 460155 - protein, 9 aa, Influenza virus
VGTRWMKII

SEQ ID NO: 460156 - protein, 9 aa, Influenza virus
VGTSTLNLR

SEQ ID NO: 460157 - protein, 9 aa, Influenza virus
VGTSTLNQR

SEQ ID NO: 460158 - protein, 9 aa, Influenza virus
VGVAPSPSN

SEQ ID NO: 460159 - protein, 9 aa, Influenza virus
VGVDEYSST

SEQ ID NO: 460160 - protein, 9 aa, Influenza virus
VGVDPFKLL

SEQ ID NO: 460161 - protein, 9 aa, Influenza virus
VGVDPFRLL

SEQ ID NO: 460162 - protein, 9 aa, Influenza virus
VGWSATACH

SEQ ID NO: 460163 - protein, 9 aa, Influenza virus
VGWSSTSCH

SEQ ID NO: 460164 - protein, 9 aa, Influenza virus
VGWSSTTCH

SEQ ID NO: 460165 - protein, 9 aa, Influenza virus
VGWTSNSIV

SEQ ID NO: 460166 - protein, 9 aa, Influenza virus
VGYHANNST

SEQ ID NO: 460167 - protein, 9 aa, Influenza virus
VGYHSNNST

SEQ ID NO: 460168 - protein, 9 aa, Influenza virus
VGYICSGVF

SEQ ID NO: 460169 - protein, 9 aa, Influenza virus
VGYLCAGIP

SEQ ID NO: 460170 - protein, 9 aa, Influenza virus
VGYLCAGLP

SEQ ID NO: 460171 - protein, 9 aa, Influenza virus
VGYLSTNSS

SEQ ID NO: 460172 - protein, 9 aa, Influenza virus
VGYLSTNST

SEQ ID NO: 460173 - protein, 9 aa, Influenza virus
VHAMRTIGT

SEQ ID NO: 460174 - protein, 9 aa, Influenza virus
VHDRIPHRT

SEQ ID NO: 460175 - protein, 9 aa, Influenza virus
VHFQNQVKI

SEQ ID NO: 460176 - protein, 9 aa, Influenza virus
VHFRNQIKI

SEQ ID NO: 460177 - protein, 9 aa, Influenza virus
VHFRNQVKI

SEQ ID NO: 460178 - protein, 9 aa, Influenza virus
VHFRSQVKI

SEQ ID NO: 460179 - protein, 9 aa, Influenza virus
VHFVEALAR

SEQ ID NO: 460180 - protein, 9 aa, Influenza virus
VHHPSSDNE

SEQ ID NO: 460181 - protein, 9 aa, Influenza virus
VHHPSTDAE

SEQ ID NO: 460182 - protein, 9 aa, Influenza virus
VHHPSTDKE

SEQ ID NO: 460183 - protein, 9 aa, Influenza virus
VHHPSTDTE

SEQ ID NO: 460184 - protein, 9 aa, Influenza virus
VHHSSSLDE

SEQ ID NO: 460185 - protein, 9 aa, Influenza virus
VHIGPLSGS

SEQ ID NO: 460186 - protein, 9 aa, Influenza virus
VHISPLAGS

SEQ ID NO: 460187 - protein, 9 aa, Influenza virus
VHISPLSGS

SEQ ID NO: 460188 - protein, 9 aa, Influenza virus
VHIYYLEKA

SEQ ID NO: 460189 - protein, 9 aa, Influenza virus
VHKSQLIWM

SEQ ID NO: 460190 - protein, 9 aa, Influenza virus
VHLGDCNFE

SEQ ID NO: 460191 - protein, 9 aa, Influenza virus
VHLGDCRFE

SEQ ID NO: 460192 - protein, 9 aa, Influenza virus
VHLGDCSFE

SEQ ID NO: 460193 - protein, 9 aa, Influenza virus
VHMYYLEKA

SEQ ID NO: 460194 - protein, 9 aa, Influenza virus
VHNGKLCRL

SEQ ID NO: 460195 - protein, 9 aa, Influenza virus
VHPLAIGEC

SEQ ID NO: 460196 - protein, 9 aa, Influenza virus
VHPLTIGEC

SEQ ID NO: 460197 - protein, 9 aa, Influenza virus
VHQILAIYS

SEQ ID NO: 460198 - protein, 9 aa, Influenza virus
VHQSTNSTE

SEQ ID NO: 460199 - protein, 9 aa, Influenza virus
VHRNAIGDC

SEQ ID NO: 460200 - protein, 9 aa, Influenza virus
VHRNTFGDC

SEQ ID NO: 460201 - protein, 9 aa, Influenza virus
VHRNTIGDC

SEQ ID NO: 460202 - protein, 9 aa, Influenza virus
VHRSTIGDC

SEQ ID NO: 460203 - protein, 9 aa, Influenza virus
VHTYYLEKA

SEQ ID NO: 460204 - protein, 9 aa, Influenza virus
VHVSPLSGS

SEQ ID NO: 460205 - protein, 9 aa, Influenza virus
VHVYYLEKA

SEQ ID NO: 460206 - protein, 9 aa, Influenza virus
VIAARNIVR

SEQ ID NO: 460207 - protein, 9 aa, Influenza virus
VIAKDNAIR

SEQ ID NO: 460208 - protein, 9 aa, Influenza virus
VIAKDNAVR

SEQ ID NO: 460209 - protein, 9 aa, Influenza virus
VIAQDNAIR

SEQ ID NO: 460210 - protein, 9 aa, Influenza virus
VIASTTAKA

SEQ ID NO: 460211 - protein, 9 aa, Influenza virus
VICLGHHAV

SEQ ID NO: 460212 - protein, 9 aa, Influenza virus
VICLGHHSV

SEQ ID NO: 460213 - protein, 9 aa, Influenza virus
VICMGHHAV

SEQ ID NO: 460214 - protein, 9 aa, Influenza virus
VIDGWTTAN

SEQ ID NO: 460215 - protein, 9 aa, Influenza virus
VIDKMNKQF

SEQ ID NO: 460216 - protein, 9 aa, Influenza virus
VIDKMNKQL

SEQ ID NO: 460217 - protein, 9 aa, Influenza virus
VIDKMNNQF

SEQ ID NO: 460218 - protein, 9 aa, Influenza virus
VIDKMYKQF

SEQ ID NO: 460219 - protein, 9 aa, Influenza virus
VIEGWINSP

SEQ ID NO: 460220 - protein, 9 aa, Influenza virus
VIEKDNAVR

SEQ ID NO: 460221 - protein, 9 aa, Influenza virus
VIEKMNIQF

SEQ ID NO: 460222 - protein, 9 aa, Influenza virus
VIEKMNTQF

SEQ ID NO: 460223 - protein, 9 aa, Influenza virus
VIGARPQVN

SEQ ID NO: 460224 - protein, 9 aa, Influenza virus
VIGGWATAN

SEQ ID NO: 460225 - protein, 9 aa, Influenza virus
VIGGWTIAN

SEQ ID NO: 460226 - protein, 9 aa, Influenza virus
VIGGWTTAN

SEQ ID NO: 460227 - protein, 9 aa, Influenza virus
VIHYGGIPT

SEQ ID NO: 460228 - protein, 9 aa, Influenza virus
VIHYGGMPT

SEQ ID NO: 460229 - protein, 9 aa, Influenza virus
VIHYGGVPT

SEQ ID NO: 460230 - protein, 9 aa, Influenza virus
VIITREPYV

SEQ ID NO: 460231 - protein, 9 aa, Influenza virus
VIKLLPFAA

SEQ ID NO: 460232 - protein, 9 aa, Influenza virus
VIKNNMINN

SEQ ID NO: 460233 - protein, 9 aa, Influenza virus
VIKNNMVNN

SEQ ID NO: 460234 - protein, 9 aa, Influenza virus
VIKYNGIIT

SEQ ID NO: 460235 - protein, 9 aa, Influenza virus
VILEENTTY

SEQ ID NO: 460236 - protein, 9 aa, Influenza virus
VILLNPFVS

SEQ ID NO: 460237 - protein, 9 aa, Influenza virus
VILVLGLSM

SEQ ID NO: 460238 - protein, 9 aa, Influenza virus
VILWFSFGA

SEQ ID NO: 460239 - protein, 9 aa, Influenza virus
VILWFSLGA

SEQ ID NO: 460240 - protein, 9 aa, Influenza virus
VIMEVVFPN

SEQ ID NO: 460241 - protein, 9 aa, Influenza virus
VIMTDGPAN

SEQ ID NO: 460242 - protein, 9 aa, Influenza virus
VIMTDGPAS

SEQ ID NO: 460243 - protein, 9 aa, Influenza virus
VIMTDGSAN

SEQ ID NO: 460244 - protein, 9 aa, Influenza virus
VIMTDGSAS

SEQ ID NO: 460245 - protein, 9 aa, Influenza virus
VINDKIDDQ

SEQ ID NO: 460246 - protein, 9 aa, Influenza virus
VINFESTGN

SEQ ID NO: 460247 - protein, 9 aa, Influenza virus
VINNITTTI

SEQ ID NO: 460248 - protein, 9 aa, Influenza virus
VINNMTTTI

SEQ ID NO: 460249 - protein, 9 aa, Influenza virus
VINNYYNET

SEQ ID NO: 460250 - protein, 9 aa, Influenza virus
VINTSKPFQ

SEQ ID NO: 460251 - protein, 9 aa, Influenza virus
VINWTKDSI

SEQ ID NO: 460252 - protein, 9 aa, Influenza virus
VINWTQDAM

SEQ ID NO: 460253 - protein, 9 aa, Influenza virus
VINWTRDAM

SEQ ID NO: 460254 - protein, 9 aa, Influenza virus
VINWTRDSI

SEQ ID NO: 460255 - protein, 9 aa, Influenza virus
VINWTRDSL

SEQ ID NO: 460256 - protein, 9 aa, Influenza virus
VINWTRDSM

SEQ ID NO: 460257 - protein, 9 aa, Influenza virus
VINWTRDSV

SEQ ID NO: 460258 - protein, 9 aa, Influenza virus
VIPLTTTPT

SEQ ID NO: 460259 - protein, 9 aa, Influenza virus
VIPVNNTIY

SEQ ID NO: 460260 - protein, 9 aa, Influenza virus
VIREPCISC

SEQ ID NO: 460261 - protein, 9 aa, Influenza virus
VIREPFISC

SEQ ID NO: 460262 - protein, 9 aa, Influenza virus
VIREPFVAC

SEQ ID NO: 460263 - protein, 9 aa, Influenza virus
VIREPFVSC

SEQ ID NO: 460264 - protein, 9 aa, Influenza virus
VIRNNMINN

SEQ ID NO: 460265 - protein, 9 aa, Influenza virus
VIRSWRKQI

SEQ ID NO: 460266 - protein, 9 aa, Influenza virus
VISFESTGN

SEQ ID NO: 460267 - protein, 9 aa, Influenza virus
VISGWTTAN

SEQ ID NO: 460268 - protein, 9 aa, Influenza virus
VITDTIKSW

SEQ ID NO: 460269 - protein, 9 aa, Influenza virus
VITDTLKSW

SEQ ID NO: 460270 - protein, 9 aa, Influenza virus
VIVTREPYI

SEQ ID NO: 460271 - protein, 9 aa, Influenza virus
VIVTREPYV

SEQ ID NO: 460272 - protein, 9 aa, Influenza virus
VIYGNPKCD

SEQ ID NO: 460273 - protein, 9 aa, Influenza virus
VKAVRGDLN

SEQ ID NO: 460274 - protein, 9 aa, Influenza virus
VKCICRDNW

SEQ ID NO: 460275 - protein, 9 aa, Influenza virus
VKCYQFALG

SEQ ID NO: 460276 - protein, 9 aa, Influenza virus
VKDRSPFRT

SEQ ID NO: 460277 - protein, 9 aa, Influenza virus
VKDRSPYRA

SEQ ID NO: 460278 - protein, 9 aa, Influenza virus
VKDRSPYRT

SEQ ID NO: 460279 - protein, 9 aa, Influenza virus
VKEAQDVIM

SEQ ID NO: 460280 - protein, 9 aa, Influenza virus
VKEKDLTKE

SEQ ID NO: 460281 - protein, 9 aa, Influenza virus
VKEKDMTKE

SEQ ID NO: 460282 - protein, 9 aa, Influenza virus
VKEKDMTRE

SEQ ID NO: 460283 - protein, 9 aa, Influenza virus
VKELGNGCF

SEQ ID NO: 460284 - protein, 9 aa, Influenza virus
VKGDKICLG

SEQ ID NO: 460285 - protein, 9 aa, Influenza virus
VKGDQICIG

SEQ ID NO: 460286 - protein, 9 aa, Influenza virus
VKGDRICIG

SEQ ID NO: 460287 - protein, 9 aa, Influenza virus
VKGDYNNTT

SEQ ID NO: 460288 - protein, 9 aa, Influenza virus
VKGEYNNTT

SEQ ID NO: 460289 - protein, 9 aa, Influenza virus
VKGFAFKYG

SEQ ID NO: 460290 - protein, 9 aa, Influenza virus
VKGFAFLDE

SEQ ID NO: 460291 - protein, 9 aa, Influenza virus
VKGFAFLDG

SEQ ID NO: 460292 - protein, 9 aa, Influenza virus
VKGFAFLDR

SEQ ID NO: 460293 - protein, 9 aa, Influenza virus
VKGFAFLNG

SEQ ID NO: 460294 - protein, 9 aa, Influenza virus
VKGFAYLDG

SEQ ID NO: 460295 - protein, 9 aa, Influenza virus
VKGFGFKAG

SEQ ID NO: 460296 - protein, 9 aa, Influenza virus
VKGFGFKKG

SEQ ID NO: 460297 - protein, 9 aa, Influenza virus
VKGFGFKSG

SEQ ID NO: 460298 - protein, 9 aa, Influenza virus
VKGFGFKTG

SEQ ID NO: 460299 - protein, 9 aa, Influenza virus
VKGFGFKVG

SEQ ID NO: 460300 - protein, 9 aa, Influenza virus
VKGFGFLDG

SEQ ID NO: 460301 - protein, 9 aa, Influenza virus
VKGFGFLDN

SEQ ID NO: 460302 - protein, 9 aa, Influenza virus
VKGFGFLDS

SEQ ID NO: 460303 - protein, 9 aa, Influenza virus
VKGFGFLNG

SEQ ID NO: 460304 - protein, 9 aa, Influenza virus
VKGFGFLSG

SEQ ID NO: 460305 - protein, 9 aa, Influenza virus
VKGFGFRQG

SEQ ID NO: 460306 - protein, 9 aa, Influenza virus
VKGFSFKYG

SEQ ID NO: 460307 - protein, 9 aa, Influenza virus
VKGFSFRYG

SEQ ID NO: 460308 - protein, 9 aa, Influenza virus
VKGFSYKYD

SEQ ID NO: 460309 - protein, 9 aa, Influenza virus
VKGFSYKYG

SEQ ID NO: 460310 - protein, 9 aa, Influenza virus
VKGFSYLDG

SEQ ID NO: 460311 - protein, 9 aa, Influenza virus
VKGFSYLNG

SEQ ID NO: 460312 - protein, 9 aa, Influenza virus
VKGFSYRYG

SEQ ID NO: 460313 - protein, 9 aa, Influenza virus
VKGRSHLRN

SEQ ID NO: 460314 - protein, 9 aa, Influenza virus
VKGWAFDDG

SEQ ID NO: 460315 - protein, 9 aa, Influenza virus
VKGWAFDNE

SEQ ID NO: 460316 - protein, 9 aa, Influenza virus
VKGWAFDNG

SEQ ID NO: 460317 - protein, 9 aa, Influenza virus
VKGWAFDSG

SEQ ID NO: 460318 - protein, 9 aa, Influenza virus
VKGWAFDYG

SEQ ID NO: 460319 - protein, 9 aa, Influenza virus
VKGWAPLSK

SEQ ID NO: 460320 - protein, 9 aa, Influenza virus
VKHFEKVKI

SEQ ID NO: 460321 - protein, 9 aa, Influenza virus
VKHFEKVRI

SEQ ID NO: 460322 - protein, 9 aa, Influenza virus
VKIDPVELS

SEQ ID NO: 460323 - protein, 9 aa, Influenza virus
VKIDPVKLS

SEQ ID NO: 460324 - protein, 9 aa, Influenza virus
VKIKTNGNL

SEQ ID NO: 460325 - protein, 9 aa, Influenza virus
VKIQTNGNL

SEQ ID NO: 460326 - protein, 9 aa, Influenza virus
VKIQTSGNL

SEQ ID NO: 460327 - protein, 9 aa, Influenza virus
VKIRRRVDI

SEQ ID NO: 460328 - protein, 9 aa, Influenza virus
VKIRRRVDM

SEQ ID NO: 460329 - protein, 9 aa, Influenza virus
VKIRRRVDT

SEQ ID NO: 460330 - protein, 9 aa, Influenza virus
VKIRRRVDV

SEQ ID NO: 460331 - protein, 9 aa, Influenza virus
VKKASLRLA

SEQ ID NO: 460332 - protein, 9 aa, Influenza virus
VKKESLRLA

SEQ ID NO: 460333 - protein, 9 aa, Influenza virus
VKKQLRENA

SEQ ID NO: 460334 - protein, 9 aa, Influenza virus
VKLAQGYKD

SEQ ID NO: 460335 - protein, 9 aa, Influenza virus
VKLEENSTY

SEQ ID NO: 460336 - protein, 9 aa, Influenza virus
VKLEENTSY

SEQ ID NO: 460337 - protein, 9 aa, Influenza virus
VKLEENTTY

SEQ ID NO: 460338 - protein, 9 aa, Influenza virus
VKLIQGYKD

SEQ ID NO: 460339 - protein, 9 aa, Influenza virus
VKLNSGYKD

SEQ ID NO: 460340 - protein, 9 aa, Influenza virus
VKLSGGYKD

SEQ ID NO: 460341 - protein, 9 aa, Influenza virus
VKLSNGYKD

SEQ ID NO: 460342 - protein, 9 aa, Influenza virus
VKLSNMGIY

SEQ ID NO: 460343 - protein, 9 aa, Influenza virus
VKLSNMGVY

SEQ ID NO: 460344 - protein, 9 aa, Influenza virus
VKLSSGYKD

SEQ ID NO: 460345 - protein, 9 aa, Influenza virus
VKLSSGYKE

SEQ ID NO: 460346 - protein, 9 aa, Influenza virus
VKLSSGYKN

SEQ ID NO: 460347 - protein, 9 aa, Influenza virus
VKLSSMGIY

SEQ ID NO: 460348 - protein, 9 aa, Influenza virus
VKLSSMGVY

SEQ ID NO: 460349 - protein, 9 aa, Influenza virus
VKLSSSYKD

SEQ ID NO: 460350 - protein, 9 aa, Influenza virus
VKLTQGYKD

SEQ ID NO: 460351 - protein, 9 aa, Influenza virus
VKLYKKLKR

SEQ ID NO: 460352 - protein, 9 aa, Influenza virus
VKLYRKLKR

SEQ ID NO: 460353 - protein, 9 aa, Influenza virus
VKMEKIVLL

SEQ ID NO: 460354 - protein, 9 aa, Influenza virus
VKMFDFIKW

SEQ ID NO: 460355 - protein, 9 aa, Influenza virus
VKMFDFSKW

SEQ ID NO: 460356 - protein, 9 aa, Influenza virus
VKMFDFTKW

SEQ ID NO: 460357 - protein, 9 aa, Influenza virus
VKMKWGMEM

SEQ ID NO: 460358 - protein, 9 aa, Influenza virus
VKMNPNQKI

SEQ ID NO: 460359 - protein, 9 aa, Influenza virus
VKNDDIDQS

SEQ ID NO: 460360 - protein, 9 aa, Influenza virus
VKNDDVDQS

SEQ ID NO: 460361 - protein, 9 aa, Influenza virus
VKNDEVDQS

SEQ ID NO: 460362 - protein, 9 aa, Influenza virus
VKNGNHAVH

SEQ ID NO: 460363 - protein, 9 aa, Influenza virus
VKNGNLRCT

SEQ ID NO: 460364 - protein, 9 aa, Influenza virus
VKNGNMQCT

SEQ ID NO: 460365 - protein, 9 aa, Influenza virus
VKNGNMRCT

SEQ ID NO: 460366 - protein, 9 aa, Influenza virus
VKNGTYDYP

SEQ ID NO: 460367 - protein, 9 aa, Influenza virus
VKNGTYNYP

SEQ ID NO: 460368 - protein, 9 aa, Influenza virus
VKNLFDEVK

SEQ ID NO: 460369 - protein, 9 aa, Influenza virus
VKNLFDEVR

SEQ ID NO: 460370 - protein, 9 aa, Influenza virus
VKNLHDQIK

SEQ ID NO: 460371 - protein, 9 aa, Influenza virus
VKNLHEQVK

SEQ ID NO: 460372 - protein, 9 aa, Influenza virus
VKNLHEQVR

SEQ ID NO: 460373 - protein, 9 aa, Influenza virus
VKNLYDKVR

SEQ ID NO: 460374 - protein, 9 aa, Influenza virus
VKNLYDRVR

SEQ ID NO: 460375 - protein, 9 aa, Influenza virus
VKNLYEKVR

SEQ ID NO: 460376 - protein, 9 aa, Influenza virus
VKNLYNKVR

SEQ ID NO: 460377 - protein, 9 aa, Influenza virus
VKPLILKDC

SEQ ID NO: 460378 - protein, 9 aa, Influenza virus
VKPLILRDC

SEQ ID NO: 460379 - protein, 9 aa, Influenza virus
VKPLILRNC

SEQ ID NO: 460380 - protein, 9 aa, Influenza virus
VKQDGKSSA

SEQ ID NO: 460381 - protein, 9 aa, Influenza virus
VKQESLLLA

SEQ ID NO: 460382 - protein, 9 aa, Influenza virus
VKQESLMLA

SEQ ID NO: 460383 - protein, 9 aa, Influenza virus
VKQGSLKLA

SEQ ID NO: 460384 - protein, 9 aa, Influenza virus
VKQGSLMLA

SEQ ID NO: 460385 - protein, 9 aa, Influenza virus
VKQGSLRLA

SEQ ID NO: 460386 - protein, 9 aa, Influenza virus
VKQKSILLA

SEQ ID NO: 460387 - protein, 9 aa, Influenza virus
VKQKSLLLA

SEQ ID NO: 460388 - protein, 9 aa, Influenza virus
VKQKTLKLA

SEQ ID NO: 460389 - protein, 9 aa, Influenza virus
VKQNGKSGA

SEQ ID NO: 460390 - protein, 9 aa, Influenza virus
VKQNGKSSA

SEQ ID NO: 460391 - protein, 9 aa, Influenza virus
VKQNTLKLA

SEQ ID NO: 460392 - protein, 9 aa, Influenza virus
VKQSSLPLA

SEQ ID NO: 460393 - protein, 9 aa, Influenza virus
VKQSTLKLA

SEQ ID NO: 460394 - protein, 9 aa, Influenza virus
VKQTSLLLA

SEQ ID NO: 460395 - protein, 9 aa, Influenza virus
VKRGINDRN

SEQ ID NO: 460396 - protein, 9 aa, Influenza virus
VKRLLRENA

SEQ ID NO: 460397 - protein, 9 aa, Influenza virus
VKRQLRENA

SEQ ID NO: 460398 - protein, 9 aa, Influenza virus
VKRRLSANA

SEQ ID NO: 460399 - protein, 9 aa, Influenza virus
VKRRLSTNA

SEQ ID NO: 460400 - protein, 9 aa, Influenza virus
VKRRPVAKA

SEQ ID NO: 460401 - protein, 9 aa, Influenza virus
VKSDKICLG

SEQ ID NO: 460402 - protein, 9 aa, Influenza virus
VKSDRLVLA

SEQ ID NO: 460403 - protein, 9 aa, Influenza virus
VKSEKLVLA

SEQ ID NO: 460404 - protein, 9 aa, Influenza virus
VKSERLVLA

SEQ ID NO: 460405 - protein, 9 aa, Influenza virus
VKSITQTLV

SEQ ID NO: 460406 - protein, 9 aa, Influenza virus
VKSLKLAIG

SEQ ID NO: 460407 - protein, 9 aa, Influenza virus
VKSLKLASG

SEQ ID NO: 460408 - protein, 9 aa, Influenza virus
VKSLKLATG

SEQ ID NO: 460409 - protein, 9 aa, Influenza virus
VKSLLRDNA

SEQ ID NO: 460410 - protein, 9 aa, Influenza virus
VKSLYDKVR

SEQ ID NO: 460411 - protein, 9 aa, Influenza virus
VKSNGNLIA

SEQ ID NO: 460412 - protein, 9 aa, Influenza virus
VKSQLKDNA

SEQ ID NO: 460413 - protein, 9 aa, Influenza virus
VKSQLRDNA

SEQ ID NO: 460414 - protein, 9 aa, Influenza virus
VKSVTQTLV

SEQ ID NO: 460415 - protein, 9 aa, Influenza virus
VKTLTDNHV

SEQ ID NO: 460416 - protein, 9 aa, Influenza virus
VKTLTNEHE

SEQ ID NO: 460417 - protein, 9 aa, Influenza virus
VKTLTNEKE

SEQ ID NO: 460418 - protein, 9 aa, Influenza virus
VKTLTNEQE

SEQ ID NO: 460419 - protein, 9 aa, Influenza virus
VKTLTSEKE

SEQ ID NO: 460420 - protein, 9 aa, Influenza virus
VKTWAGNIL

SEQ ID NO: 460421 - protein, 9 aa, Influenza virus
VKVDGSSSA

SEQ ID NO: 460422 - protein, 9 aa, Influenza virus
VKVTHRENL

SEQ ID NO: 460423 - protein, 9 aa, Influenza virus
VKYSRADKI

SEQ ID NO: 460424 - protein, 9 aa, Influenza virus
VKYVWWTSN

SEQ ID NO: 460425 - protein, 9 aa, Influenza virus
VLAIYSCIA

SEQ ID NO: 460426 - protein, 9 aa, Influenza virus
VLASTTAKA

SEQ ID NO: 460427 - protein, 9 aa, Influenza virus
VLATGLRNA

SEQ ID NO: 460428 - protein, 9 aa, Influenza virus
VLATGLRNI

SEQ ID NO: 460429 - protein, 9 aa, Influenza virus
VLATGLRNV

SEQ ID NO: 460430 - protein, 9 aa, Influenza virus
VLATGPRNV

SEQ ID NO: 460431 - protein, 9 aa, Influenza virus
VLDDCSLEG

SEQ ID NO: 460432 - protein, 9 aa, Influenza virus
VLDDCSLKG

SEQ ID NO: 460433 - protein, 9 aa, Influenza virus
VLDGVTASC

SEQ ID NO: 460434 - protein, 9 aa, Influenza virus
VLDNKNWSG

SEQ ID NO: 460435 - protein, 9 aa, Influenza virus
VLDTDWSGY

SEQ ID NO: 460436 - protein, 9 aa, Influenza virus
VLEAMAFLE

SEQ ID NO: 460437 - protein, 9 aa, Influenza virus
VLEAMALLE

SEQ ID NO: 460438 - protein, 9 aa, Influenza virus
VLEDEQMYQ

SEQ ID NO: 460439 - protein, 9 aa, Influenza virus
VLEKNVTVT

SEQ ID NO: 460440 - protein, 9 aa, Influenza virus
VLELIRMIK

SEQ ID NO: 460441 - protein, 9 aa, Influenza virus
VLERNVTVT

SEQ ID NO: 460442 - protein, 9 aa, Influenza virus
VLFQGGHIE

SEQ ID NO: 460443 - protein, 9 aa, Influenza virus
VLGDCSIAG

SEQ ID NO: 460444 - protein, 9 aa, Influenza virus
VLGENMAPE

SEQ ID NO: 460445 - protein, 9 aa, Influenza virus
VLGIINLLI

SEQ ID NO: 460446 - protein, 9 aa, Influenza virus
VLGLSMVKS

SEQ ID NO: 460447 - protein, 9 aa, Influenza virus
VLGLSMVRS

SEQ ID NO: 460448 - protein, 9 aa, Influenza virus
VLGNPKCDL

SEQ ID NO: 460449 - protein, 9 aa, Influenza virus
VLGNYKEIC

SEQ ID NO: 460450 - protein, 9 aa, Influenza virus
VLGNYKEIR

SEQ ID NO: 460451 - protein, 9 aa, Influenza virus
VLGNYREIC

SEQ ID NO: 460452 - protein, 9 aa, Influenza virus
VLGNYREVC

SEQ ID NO: 460453 - protein, 9 aa, Influenza virus
VLGVSILNL

SEQ ID NO: 460454 - protein, 9 aa, Influenza virus
VLGVSVLNL

SEQ ID NO: 460455 - protein, 9 aa, Influenza virus
VLHLTQGAC

SEQ ID NO: 460456 - protein, 9 aa, Influenza virus
VLHLTQGTC

SEQ ID NO: 460457 - protein, 9 aa, Influenza virus
VLIAGGLIL

SEQ ID NO: 460458 - protein, 9 aa, Influenza virus
VLIENDRTL

SEQ ID NO: 460459 - protein, 9 aa, Influenza virus
VLIENERTL

SEQ ID NO: 460460 - protein, 9 aa, Influenza virus
VLIENQKTL

SEQ ID NO: 460461 - protein, 9 aa, Influenza virus
VLIGQGDIV

SEQ ID NO: 460462 - protein, 9 aa, Influenza virus
VLIGQGDVV

SEQ ID NO: 460463 - protein, 9 aa, Influenza virus
VLINTYQWI

SEQ ID NO: 460464 - protein, 9 aa, Influenza virus
VLIVSLGAI

SEQ ID NO: 460465 - protein, 9 aa, Influenza virus
VLKPGETLK

SEQ ID NO: 460466 - protein, 9 aa, Influenza virus
VLKPGETLN

SEQ ID NO: 460467 - protein, 9 aa, Influenza virus
VLKPGQTLR

SEQ ID NO: 460468 - protein, 9 aa, Influenza virus
VLKPGQTVK

SEQ ID NO: 460469 - protein, 9 aa, Influenza virus
VLKSDKRIG

SEQ ID NO: 460470 - protein, 9 aa, Influenza virus
VLKYKGIIT

SEQ ID NO: 460471 - protein, 9 aa, Influenza virus
VLKYNGIIT

SEQ ID NO: 460472 - protein, 9 aa, Influenza virus
VLKYNGMIT

SEQ ID NO: 460473 - protein, 9 aa, Influenza virus
VLKYNGVIT

SEQ ID NO: 460474 - protein, 9 aa, Influenza virus
VLLEDERTL

SEQ ID NO: 460475 - protein, 9 aa, Influenza virus
VLLENDKTL

SEQ ID NO: 460476 - protein, 9 aa, Influenza virus
VLLENDRTL

SEQ ID NO: 460477 - protein, 9 aa, Influenza virus
VLLENEKTL

SEQ ID NO: 460478 - protein, 9 aa, Influenza virus
VLLENERTL

SEQ ID NO: 460479 - protein, 9 aa, Influenza virus
VLLENGRTL

SEQ ID NO: 460480 - protein, 9 aa, Influenza virus
VLLENQKIL

SEQ ID NO: 460481 - protein, 9 aa, Influenza virus
VLLENQKPL

SEQ ID NO: 460482 - protein, 9 aa, Influenza virus
VLLENQKTL

SEQ ID NO: 460483 - protein, 9 aa, Influenza virus
VLLFMIIGG

SEQ ID NO: 460484 - protein, 9 aa, Influenza virus
VLLGNQKTL

SEQ ID NO: 460485 - protein, 9 aa, Influenza virus
VLLGSSPNA

SEQ ID NO: 460486 - protein, 9 aa, Influenza virus
VLLGTKHSN

SEQ ID NO: 460487 - protein, 9 aa, Influenza virus
VLLKHRFEI

SEQ ID NO: 460488 - protein, 9 aa, Influenza virus
VLLLMIIGG

SEQ ID NO: 460489 - protein, 9 aa, Influenza virus
VLLNASWFN

SEQ ID NO: 460490 - protein, 9 aa, Influenza virus
VLLSPEEVS

SEQ ID NO: 460491 - protein, 9 aa, Influenza virus
VLLVSLGAI

SEQ ID NO: 460492 - protein, 9 aa, Influenza virus
VLLVSLGAV

SEQ ID NO: 460493 - protein, 9 aa, Influenza virus
VLMENEMTL

SEQ ID NO: 460494 - protein, 9 aa, Influenza virus
VLMENERTL

SEQ ID NO: 460495 - protein, 9 aa, Influenza virus
VLNKSLCKV

SEQ ID NO: 460496 - protein, 9 aa, Influenza virus
VLNLLIGIS

SEQ ID NO: 460497 - protein, 9 aa, Influenza virus
VLNLLIGVS

SEQ ID NO: 460498 - protein, 9 aa, Influenza virus
VLNNKHWSG

SEQ ID NO: 460499 - protein, 9 aa, Influenza virus
VLNNKNWSG

SEQ ID NO: 460500 - protein, 9 aa, Influenza virus
VLNNMNWSG

SEQ ID NO: 460501 - protein, 9 aa, Influenza virus
VLNTDWSGY

SEQ ID NO: 460502 - protein, 9 aa, Influenza virus
VLNVSLHLK

SEQ ID NO: 460503 - protein, 9 aa, Influenza virus
VLRGFLIIG

SEQ ID NO: 460504 - protein, 9 aa, Influenza virus
VLRGFLILG

SEQ ID NO: 460505 - protein, 9 aa, Influenza virus
VLRPGETLN

SEQ ID NO: 460506 - protein, 9 aa, Influenza virus
VLRPGQTLR

SEQ ID NO: 460507 - protein, 9 aa, Influenza virus
VLSAFDERR

SEQ ID NO: 460508 - protein, 9 aa, Influenza virus
VLSCIFCLA

SEQ ID NO: 460509 - protein, 9 aa, Influenza virus
VLSIAPIMF

SEQ ID NO: 460510 - protein, 9 aa, Influenza virus
VLSIIALLI

SEQ ID NO: 460511 - protein, 9 aa, Influenza virus
VLSIIPSGP

SEQ ID NO: 460512 - protein, 9 aa, Influenza virus
VLSIVPSGP

SEQ ID NO: 460513 - protein, 9 aa, Influenza virus
VLSIYSCIA

SEQ ID NO: 460514 - protein, 9 aa, Influenza virus
VLSVAPIMF

SEQ ID NO: 460515 - protein, 9 aa, Influenza virus
VLTDNPRPN

SEQ ID NO: 460516 - protein, 9 aa, Influenza virus
VLTDTSRPG

SEQ ID NO: 460517 - protein, 9 aa, Influenza virus
VLTDTSRPK

SEQ ID NO: 460518 - protein, 9 aa, Influenza virus
VLTDTSRPS

SEQ ID NO: 460519 - protein, 9 aa, Influenza virus
VLTGNLQAL

SEQ ID NO: 460520 - protein, 9 aa, Influenza virus
VLTGNLQTL

SEQ ID NO: 460521 - protein, 9 aa, Influenza virus
VLVALENQH

SEQ ID NO: 460522 - protein, 9 aa, Influenza virus
VLVGLILAF

SEQ ID NO: 460523 - protein, 9 aa, Influenza virus
VLVGLILSF

SEQ ID NO: 460524 - protein, 9 aa, Influenza virus
VLVGLILTF

SEQ ID NO: 460525 - protein, 9 aa, Influenza virus
VLVGPILSF

SEQ ID NO: 460526 - protein, 9 aa, Influenza virus
VLVIWGIHH

SEQ ID NO: 460527 - protein, 9 aa, Influenza virus
VLVIWGVHH

SEQ ID NO: 460528 - protein, 9 aa, Influenza virus
VLVLWAIHH

SEQ ID NO: 460529 - protein, 9 aa, Influenza virus
VLVLWGIHH

SEQ ID NO: 460530 - protein, 9 aa, Influenza virus
VLVLWGVHH

SEQ ID NO: 460531 - protein, 9 aa, Influenza virus
VLVMKRKRD

SEQ ID NO: 460532 - protein, 9 aa, Influenza virus
VLVMKRKRN

SEQ ID NO: 460533 - protein, 9 aa, Influenza virus
VLVMWGIHH

SEQ ID NO: 460534 - protein, 9 aa, Influenza virus
VLVMWGLHH

SEQ ID NO: 460535 - protein, 9 aa, Influenza virus
VLVNTYQWI

SEQ ID NO: 460536 - protein, 9 aa, Influenza virus
VLVNTYQWV

SEQ ID NO: 460537 - protein, 9 aa, Influenza virus
VLVTREPYI

SEQ ID NO: 460538 - protein, 9 aa, Influenza virus
VLVTREPYL

SEQ ID NO: 460539 - protein, 9 aa, Influenza virus
VLVTREPYV

SEQ ID NO: 460540 - protein, 9 aa, Influenza virus
VLVVSLGAI

SEQ ID NO: 460541 - protein, 9 aa, Influenza virus
VLWACQNGN

SEQ ID NO: 460542 - protein, 9 aa, Influenza virus
VLWGIHHPD

SEQ ID NO: 460543 - protein, 9 aa, Influenza virus
VLWISFAIS

SEQ ID NO: 460544 - protein, 9 aa, Influenza virus
VLWTSNSIV

SEQ ID NO: 460545 - protein, 9 aa, Influenza virus
VLWTSNSMV

SEQ ID NO: 460546 - protein, 9 aa, Influenza virus
VLWTSNSVV

SEQ ID NO: 460547 - protein, 9 aa, Influenza virus
VLYFWGIHH

SEQ ID NO: 460548 - protein, 9 aa, Influenza virus
VLYFWGVHH

SEQ ID NO: 460549 - protein, 9 aa, Influenza virus
VMCVCRDNW

SEQ ID NO: 460550 - protein, 9 aa, Influenza virus
VMEHTSQYL

SEQ ID NO: 460551 - protein, 9 aa, Influenza virus
VMELIRMIK

SEQ ID NO: 460552 - protein, 9 aa, Influenza virus
VMELIRMVK

SEQ ID NO: 460553 - protein, 9 aa, Influenza virus
VMELVRMIK

SEQ ID NO: 460554 - protein, 9 aa, Influenza virus
VMGARPQVN

SEQ ID NO: 460555 - protein, 9 aa, Influenza virus
VMGLVFFCL

SEQ ID NO: 460556 - protein, 9 aa, Influenza virus
VMGLVFICI

SEQ ID NO: 460557 - protein, 9 aa, Influenza virus
VMGQASYKI

SEQ ID NO: 460558 - protein, 9 aa, Influenza virus
VMGQQGRMD

SEQ ID NO: 460559 - protein, 9 aa, Influenza virus
VMKRKRDSS

SEQ ID NO: 460560 - protein, 9 aa, Influenza virus
VMKRKRNSS

SEQ ID NO: 460561 - protein, 9 aa, Influenza virus
VMLLAIAMG

SEQ ID NO: 460562 - protein, 9 aa, Influenza virus
VMNTSKPFQ

SEQ ID NO: 460563 - protein, 9 aa, Influenza virus
VMNTSKPLQ

SEQ ID NO: 460564 - protein, 9 aa, Influenza virus
VMREPFISC

SEQ ID NO: 460565 - protein, 9 aa, Influenza virus
VMTDGNASG

SEQ ID NO: 460566 - protein, 9 aa, Influenza virus
VMTDGPANK

SEQ ID NO: 460567 - protein, 9 aa, Influenza virus
VMTDGPANN

SEQ ID NO: 460568 - protein, 9 aa, Influenza virus
VMTDGPANR

SEQ ID NO: 460569 - protein, 9 aa, Influenza virus
VMTDGPANS

SEQ ID NO: 460570 - protein, 9 aa, Influenza virus
VMTDGPASN

SEQ ID NO: 460571 - protein, 9 aa, Influenza virus
VMTDGPASS

SEQ ID NO: 460572 - protein, 9 aa, Influenza virus
VMTDGSALG

SEQ ID NO: 460573 - protein, 9 aa, Influenza virus
VMTDGSASD

SEQ ID NO: 460574 - protein, 9 aa, Influenza virus
VMTDGSASE

SEQ ID NO: 460575 - protein, 9 aa, Influenza virus
VMTDGSASG

SEQ ID NO: 460576 - protein, 9 aa, Influenza virus
VMTDGSASR

SEQ ID NO: 460577 - protein, 9 aa, Influenza virus
VMTDGSASS

SEQ ID NO: 460578 - protein, 9 aa, Influenza virus
VMTDGSATG

SEQ ID NO: 460579 - protein, 9 aa, Influenza virus
VMTHTSQYI

SEQ ID NO: 460580 - protein, 9 aa, Influenza virus
VMVGLILAF

SEQ ID NO: 460581 - protein, 9 aa, Influenza virus
VNATETVEI

SEQ ID NO: 460582 - protein, 9 aa, Influenza virus
VNATETVEN

SEQ ID NO: 460583 - protein, 9 aa, Influenza virus
VNATETVEQ

SEQ ID NO: 460584 - protein, 9 aa, Influenza virus
VNATETVER

SEQ ID NO: 460585 - protein, 9 aa, Influenza virus
VNATETVET

SEQ ID NO: 460586 - protein, 9 aa, Influenza virus
VNDRNFWRG

SEQ ID NO: 460587 - protein, 9 aa, Influenza virus
VNEEALRQI

SEQ ID NO: 460588 - protein, 9 aa, Influenza virus
VNEEALRQK

SEQ ID NO: 460589 - protein, 9 aa, Influenza virus
VNEGALRQK

SEQ ID NO: 460590 - protein, 9 aa, Influenza virus
VNESADMSI

SEQ ID NO: 460591 - protein, 9 aa, Influenza virus
VNFLSMEFS

SEQ ID NO: 460592 - protein, 9 aa, Influenza virus
VNFSFNGAF

SEQ ID NO: 460593 - protein, 9 aa, Influenza virus
VNFVIEKMN

SEQ ID NO: 460594 - protein, 9 aa, Influenza virus
VNFVSMEFS

SEQ ID NO: 460595 - protein, 9 aa, Influenza virus
VNGALGSPG

SEQ ID NO: 460596 - protein, 9 aa, Influenza virus
VNGEALRQI

SEQ ID NO: 460597 - protein, 9 aa, Influenza virus
VNGPESVLV

SEQ ID NO: 460598 - protein, 9 aa, Influenza virus
VNGQAGRID

SEQ ID NO: 460599 - protein, 9 aa, Influenza virus
VNGQAGRMT

SEQ ID NO: 460600 - protein, 9 aa, Influenza virus
VNGQFGRID

SEQ ID NO: 460601 - protein, 9 aa, Influenza virus
VNGQFGRIN

SEQ ID NO: 460602 - protein, 9 aa, Influenza virus
VNGQRGRID

SEQ ID NO: 460603 - protein, 9 aa, Influenza virus
VNGQSGRID

SEQ ID NO: 460604 - protein, 9 aa, Influenza virus
VNGQSGRIE

SEQ ID NO: 460605 - protein, 9 aa, Influenza virus
VNGQSGRIN

SEQ ID NO: 460606 - protein, 9 aa, Influenza virus
VNGQSGRIV

SEQ ID NO: 460607 - protein, 9 aa, Influenza virus
VNGQTGRID

SEQ ID NO: 460608 - protein, 9 aa, Influenza virus
VNGVKLEEN

SEQ ID NO: 460609 - protein, 9 aa, Influenza virus
VNGWYGFRH

SEQ ID NO: 460610 - protein, 9 aa, Influenza virus
VNICKAAMG

SEQ ID NO: 460611 - protein, 9 aa, Influenza virus
VNIDRFLRV

SEQ ID NO: 460612 - protein, 9 aa, Influenza virus
VNIKSLKLA

SEQ ID NO: 460613 - protein, 9 aa, Influenza virus
VNKITYGAC

SEQ ID NO: 460614 - protein, 9 aa, Influenza virus
VNKNPYTLV

SEQ ID NO: 460615 - protein, 9 aa, Influenza virus
VNKTTVINK

SEQ ID NO: 460616 - protein, 9 aa, Influenza virus
VNLGLNIGL

SEQ ID NO: 460617 - protein, 9 aa, Influenza virus
VNMTNVQNN

SEQ ID NO: 460618 - protein, 9 aa, Influenza virus
VNNGKGRYG

SEQ ID NO: 460619 - protein, 9 aa, Influenza virus
VNNITTTII

SEQ ID NO: 460620 - protein, 9 aa, Influenza virus
VNNITTTIV

SEQ ID NO: 460621 - protein, 9 aa, Influenza virus
VNNIVDKMN

SEQ ID NO: 460622 - protein, 9 aa, Influenza virus
VNNPNWSGY

SEQ ID NO: 460623 - protein, 9 aa, Influenza virus
VNNQDWSGY

SEQ ID NO: 460624 - protein, 9 aa, Influenza virus
VNNQNWSGY

SEQ ID NO: 460625 - protein, 9 aa, Influenza virus
VNNTTIINK

SEQ ID NO: 460626 - protein, 9 aa, Influenza virus
VNNTTIISK

SEQ ID NO: 460627 - protein, 9 aa, Influenza virus
VNNTTIITK

SEQ ID NO: 460628 - protein, 9 aa, Influenza virus
VNNTTVINK

SEQ ID NO: 460629 - protein, 9 aa, Influenza virus
VNPGDSIIF

SEQ ID NO: 460630 - protein, 9 aa, Influenza virus
VNPTLLFLE

SEQ ID NO: 460631 - protein, 9 aa, Influenza virus
VNPTLLFLK

SEQ ID NO: 460632 - protein, 9 aa, Influenza virus
VNQITGKLN

SEQ ID NO: 460633 - protein, 9 aa, Influenza virus
VNRANQRLN

SEQ ID NO: 460634 - protein, 9 aa, Influenza virus
VNRCFYVEL

SEQ ID NO: 460635 - protein, 9 aa, Influenza virus
VNREPYVSC

SEQ ID NO: 460636 - protein, 9 aa, Influenza virus
VNRFYRTCK

SEQ ID NO: 460637 - protein, 9 aa, Influenza virus
VNRITYGAC

SEQ ID NO: 460638 - protein, 9 aa, Influenza virus
VNRITYGPC

SEQ ID NO: 460639 - protein, 9 aa, Influenza virus
VNRITYGVC

SEQ ID NO: 460640 - protein, 9 aa, Influenza virus
VNRTHQYSE

SEQ ID NO: 460641 - protein, 9 aa, Influenza virus
VNSALGSPG

SEQ ID NO: 460642 - protein, 9 aa, Influenza virus
VNSFSRTEL

SEQ ID NO: 460643 - protein, 9 aa, Influenza virus
VNSIIDKMN

SEQ ID NO: 460644 - protein, 9 aa, Influenza virus
VNSIIEKMN

SEQ ID NO: 460645 - protein, 9 aa, Influenza virus
VNSIIGKMN

SEQ ID NO: 460646 - protein, 9 aa, Influenza virus
VNSIINKMN

SEQ ID NO: 460647 - protein, 9 aa, Influenza virus
VNSSKPFQN

SEQ ID NO: 460648 - protein, 9 aa, Influenza virus
VNSSMPFHN

SEQ ID NO: 460649 - protein, 9 aa, Influenza virus
VNSVIEKIN

SEQ ID NO: 460650 - protein, 9 aa, Influenza virus
VNSVIEKMN

SEQ ID NO: 460651 - protein, 9 aa, Influenza virus
VNSVVEKMN

SEQ ID NO: 460652 - protein, 9 aa, Influenza virus
VNSWHIFSK

SEQ ID NO: 460653 - protein, 9 aa, Influenza virus
VNSWHILSK

SEQ ID NO: 460654 - protein, 9 aa, Influenza virus
VNTALLNAS

SEQ ID NO: 460655 - protein, 9 aa, Influenza virus
VNTIIENNV

SEQ ID NO: 460656 - protein, 9 aa, Influenza virus
VNTILEKNV

SEQ ID NO: 460657 - protein, 9 aa, Influenza virus
VNTILSTKA

SEQ ID NO: 460658 - protein, 9 aa, Influenza virus
VNTLAERGV

SEQ ID NO: 460659 - protein, 9 aa, Influenza virus
VNTLIEQNI

SEQ ID NO: 460660 - protein, 9 aa, Influenza virus
VNTLIEQNV

SEQ ID NO: 460661 - protein, 9 aa, Influenza virus
VNTLLENDV

SEQ ID NO: 460662 - protein, 9 aa, Influenza virus
VNTLSEQNV

SEQ ID NO: 460663 - protein, 9 aa, Influenza virus
VNTLTEKGI

SEQ ID NO: 460664 - protein, 9 aa, Influenza virus
VNTLTEKGV

SEQ ID NO: 460665 - protein, 9 aa, Influenza virus
VNTLTEQNV

SEQ ID NO: 460666 - protein, 9 aa, Influenza virus
VNTLTEREV

SEQ ID NO: 460667 - protein, 9 aa, Influenza virus
VNTLTERGI

SEQ ID NO: 460668 - protein, 9 aa, Influenza virus
VNTLTERGV

SEQ ID NO: 460669 - protein, 9 aa, Influenza virus
VNTNKTFQN

SEQ ID NO: 460670 - protein, 9 aa, Influenza virus
VNTNTINRS

SEQ ID NO: 460671 - protein, 9 aa, Influenza virus
VNTTLSTIA

SEQ ID NO: 460672 - protein, 9 aa, Influenza virus
VNTVLSIIA

SEQ ID NO: 460673 - protein, 9 aa, Influenza virus
VNTYQWIIK

SEQ ID NO: 460674 - protein, 9 aa, Influenza virus
VNTYQWIIR

SEQ ID NO: 460675 - protein, 9 aa, Influenza virus
VNTYQWVIR

SEQ ID NO: 460676 - protein, 9 aa, Influenza virus
VNVKSLKLA

SEQ ID NO: 460677 - protein, 9 aa, Influenza virus
VNVRGSGLR

SEQ ID NO: 460678 - protein, 9 aa, Influenza virus
VNVRGSGMR

SEQ ID NO: 460679 - protein, 9 aa, Influenza virus
VNVRGTGMR

SEQ ID NO: 460680 - protein, 9 aa, Influenza virus
VNVRSLKLA

SEQ ID NO: 460681 - protein, 9 aa, Influenza virus
VNVTHVQNN

SEQ ID NO: 460682 - protein, 9 aa, Influenza virus
VNVTNVQND

SEQ ID NO: 460683 - protein, 9 aa, Influenza virus
VNVTNVQNN

SEQ ID NO: 460684 - protein, 9 aa, Influenza virus
VNYVSMEFS

SEQ ID NO: 460685 - protein, 9 aa, Influenza virus
VPAQNAISI

SEQ ID NO: 460686 - protein, 9 aa, Influenza virus
VPAQNAIST

SEQ ID NO: 460687 - protein, 9 aa, Influenza virus
VPASRYLID

SEQ ID NO: 460688 - protein, 9 aa, Influenza virus
VPASRYLTD

SEQ ID NO: 460689 - protein, 9 aa, Influenza virus
VPCFWLEMI

SEQ ID NO: 460690 - protein, 9 aa, Influenza virus
VPCFWVEMI

SEQ ID NO: 460691 - protein, 9 aa, Influenza virus
VPDYQSIRS

SEQ ID NO: 460692 - protein, 9 aa, Influenza virus
VPDYQSLRS

SEQ ID NO: 460693 - protein, 9 aa, Influenza virus
VPEKIHTRG

SEQ ID NO: 460694 - protein, 9 aa, Influenza virus
VPEKIRTRG

SEQ ID NO: 460695 - protein, 9 aa, Influenza virus
VPEKIRVKR

SEQ ID NO: 460696 - protein, 9 aa, Influenza virus
VPERNEQGQ

SEQ ID NO: 460697 - protein, 9 aa, Influenza virus
VPESMREEY

SEQ ID NO: 460698 - protein, 9 aa, Influenza virus
VPEWSWDDG

SEQ ID NO: 460699 - protein, 9 aa, Influenza virus
VPEWSYIIE

SEQ ID NO: 460700 - protein, 9 aa, Influenza virus
VPEWSYIME

SEQ ID NO: 460701 - protein, 9 aa, Influenza virus
VPEWSYIVE

SEQ ID NO: 460702 - protein, 9 aa, Influenza virus
VPEYQSLRS

SEQ ID NO: 460703 - protein, 9 aa, Influenza virus
VPFHLATKQ

SEQ ID NO: 460704 - protein, 9 aa, Influenza virus
VPFHLGTKQ

SEQ ID NO: 460705 - protein, 9 aa, Influenza virus
VPFHLGTRQ

SEQ ID NO: 460706 - protein, 9 aa, Influenza virus
VPFSKDNSI

SEQ ID NO: 460707 - protein, 9 aa, Influenza virus
VPFYLGTKQ

SEQ ID NO: 460708 - protein, 9 aa, Influenza virus
VPGVKGFGF

SEQ ID NO: 460709 - protein, 9 aa, Influenza virus
VPGWSWDDG

SEQ ID NO: 460710 - protein, 9 aa, Influenza virus
VPGYQSLRS

SEQ ID NO: 460711 - protein, 9 aa, Influenza virus
VPILNTSQR

SEQ ID NO: 460712 - protein, 9 aa, Influenza virus
VPKRNRSIL

SEQ ID NO: 460713 - protein, 9 aa, Influenza virus
VPKSMREEY

SEQ ID NO: 460714 - protein, 9 aa, Influenza virus
VPLGSSPNA

SEQ ID NO: 460715 - protein, 9 aa, Influenza virus
VPLVPCEPI

SEQ ID NO: 460716 - protein, 9 aa, Influenza virus
VPMGSSPNA

SEQ ID NO: 460717 - protein, 9 aa, Influenza virus
VPNAGTDPN

SEQ ID NO: 460718 - protein, 9 aa, Influenza virus
VPNALTDDK

SEQ ID NO: 460719 - protein, 9 aa, Influenza virus
VPNALTDDR

SEQ ID NO: 460720 - protein, 9 aa, Influenza virus
VPNALTDER

SEQ ID NO: 460721 - protein, 9 aa, Influenza virus
VPNALTDNR

SEQ ID NO: 460722 - protein, 9 aa, Influenza virus
VPNGTIVKT

SEQ ID NO: 460723 - protein, 9 aa, Influenza virus
VPNGTIVRT

SEQ ID NO: 460724 - protein, 9 aa, Influenza virus
VPNGTKVNT

SEQ ID NO: 460725 - protein, 9 aa, Influenza virus
VPNGTLVKT

SEQ ID NO: 460726 - protein, 9 aa, Influenza virus
VPNGTMVKT

SEQ ID NO: 460727 - protein, 9 aa, Influenza virus
VPNGTVVKT

SEQ ID NO: 460728 - protein, 9 aa, Influenza virus
VPNIGSRPR

SEQ ID NO: 460729 - protein, 9 aa, Influenza virus
VPNYQSLRS

SEQ ID NO: 460730 - protein, 9 aa, Influenza virus
VPPLELGDC

SEQ ID NO: 460731 - protein, 9 aa, Influenza virus
VPPLGSAQA

SEQ ID NO: 460732 - protein, 9 aa, Influenza virus
VPQAQDRGL

SEQ ID NO: 460733 - protein, 9 aa, Influenza virus
VPQAQNRGL

SEQ ID NO: 460734 - protein, 9 aa, Influenza virus
VPQIEARGL

SEQ ID NO: 460735 - protein, 9 aa, Influenza virus
VPQIEPRGL

SEQ ID NO: 460736 - protein, 9 aa, Influenza virus
VPQIESRGL

SEQ ID NO: 460737 - protein, 9 aa, Influenza virus
VPQIQNRGL

SEQ ID NO: 460738 - protein, 9 aa, Influenza virus
VPQMESRGL

SEQ ID NO: 460739 - protein, 9 aa, Influenza virus
VPQVQDRGL

SEQ ID NO: 460740 - protein, 9 aa, Influenza virus
VPQVQNRGL

SEQ ID NO: 460741 - protein, 9 aa, Influenza virus
VPSERGLQR

SEQ ID NO: 460742 - protein, 9 aa, Influenza virus
VPSFDMNNE

SEQ ID NO: 460743 - protein, 9 aa, Influenza virus
VPSFDMSKE

SEQ ID NO: 460744 - protein, 9 aa, Influenza virus
VPSFDMSND

SEQ ID NO: 460745 - protein, 9 aa, Influenza virus
VPSFDMSNE

SEQ ID NO: 460746 - protein, 9 aa, Influenza virus
VPSFEMSNE

SEQ ID NO: 460747 - protein, 9 aa, Influenza virus
VPSGPLKAE

SEQ ID NO: 460748 - protein, 9 aa, Influenza virus
VPSIQSRGL

SEQ ID NO: 460749 - protein, 9 aa, Influenza virus
VPSPYNSRF

SEQ ID NO: 460750 - protein, 9 aa, Influenza virus
VPTDVIRSW

SEQ ID NO: 460751 - protein, 9 aa, Influenza virus
VPTDVMRSW

SEQ ID NO: 460752 - protein, 9 aa, Influenza virus
VPTDVVRSW

SEQ ID NO: 460753 - protein, 9 aa, Influenza virus
VPVGSGSFP

SEQ ID NO: 460754 - protein, 9 aa, Influenza virus
VPVIGARPQ

SEQ ID NO: 460755 - protein, 9 aa, Influenza virus
VPVMGARPQ

SEQ ID NO: 460756 - protein, 9 aa, Influenza virus
VPVQNAIST

SEQ ID NO: 460757 - protein, 9 aa, Influenza virus
VPVTQAMEL

SEQ ID NO: 460758 - protein, 9 aa, Influenza virus
VPVTQTMEL

SEQ ID NO: 460759 - protein, 9 aa, Influenza virus
VPVTQVEEL

SEQ ID NO: 460760 - protein, 9 aa, Influenza virus
VPVTSSIDL

SEQ ID NO: 460761 - protein, 9 aa, Influenza virus
VPVTSSVDL

SEQ ID NO: 460762 - protein, 9 aa, Influenza virus
VPVTSTIDL

SEQ ID NO: 460763 - protein, 9 aa, Influenza virus
VPVVGARPQ

SEQ ID NO: 460764 - protein, 9 aa, Influenza virus
VPVVGDRPL

SEQ ID NO: 460765 - protein, 9 aa, Influenza virus
VPVVRARPQ

SEQ ID NO: 460766 - protein, 9 aa, Influenza virus
VQAMRAIGT

SEQ ID NO: 460767 - protein, 9 aa, Influenza virus
VQAMRAVGT

SEQ ID NO: 460768 - protein, 9 aa, Influenza virus
VQAMRTIGT

SEQ ID NO: 460769 - protein, 9 aa, Influenza virus
VQAMRTVGT

SEQ ID NO: 460770 - protein, 9 aa, Influenza virus
VQDIIDNDN

SEQ ID NO: 460771 - protein, 9 aa, Influenza virus
VQDIIDNNN

SEQ ID NO: 460772 - protein, 9 aa, Influenza virus
VQDRGLFGA

SEQ ID NO: 460773 - protein, 9 aa, Influenza virus
VQGNNDNAT

SEQ ID NO: 460774 - protein, 9 aa, Influenza virus
VQGNNKNAT

SEQ ID NO: 460775 - protein, 9 aa, Influenza virus
VQGNNNNAT

SEQ ID NO: 460776 - protein, 9 aa, Influenza virus
VQHLEECSC

SEQ ID NO: 460777 - protein, 9 aa, Influenza virus
VQHPELTGL

SEQ ID NO: 460778 - protein, 9 aa, Influenza virus
VQHPELTGM

SEQ ID NO: 460779 - protein, 9 aa, Influenza virus
VQHPEMTGL

SEQ ID NO: 460780 - protein, 9 aa, Influenza virus
VQIIKLLPF

SEQ ID NO: 460781 - protein, 9 aa, Influenza virus
VQITGKLNR

SEQ ID NO: 460782 - protein, 9 aa, Influenza virus
VQMCTELKL

SEQ ID NO: 460783 - protein, 9 aa, Influenza virus
VQMQRFRRP

SEQ ID NO: 460784 - protein, 9 aa, Influenza virus
VQNAISTTF

SEQ ID NO: 460785 - protein, 9 aa, Influenza virus
VQNALNGNG

SEQ ID NO: 460786 - protein, 9 aa, Influenza virus
VQNALSGNG

SEQ ID NO: 460787 - protein, 9 aa, Influenza virus
VQNEFNKAC

SEQ ID NO: 460788 - protein, 9 aa, Influenza virus
VQNRGLFGA

SEQ ID NO: 460789 - protein, 9 aa, Influenza virus
VQPAFSVQR

SEQ ID NO: 460790 - protein, 9 aa, Influenza virus
VQPGDNITF

SEQ ID NO: 460791 - protein, 9 aa, Influenza virus
VQPTFSVQR

SEQ ID NO: 460792 - protein, 9 aa, Influenza virus
VQQTRVDKL

SEQ ID NO: 460793 - protein, 9 aa, Influenza virus
VQQTRVDRL

SEQ ID NO: 460794 - protein, 9 aa, Influenza virus
VQRNLPFDK

SEQ ID NO: 460795 - protein, 9 aa, Influenza virus
VQRNLPFEK

SEQ ID NO: 460796 - protein, 9 aa, Influenza virus
VQRNLPFER

SEQ ID NO: 460797 - protein, 9 aa, Influenza virus
VQRSLPFER

SEQ ID NO: 460798 - protein, 9 aa, Influenza virus
VQSEFNKAC

SEQ ID NO: 460799 - protein, 9 aa, Influenza virus
VQSKMQFSS

SEQ ID NO: 460800 - protein, 9 aa, Influenza virus
VQSRGLFGA

SEQ ID NO: 460801 - protein, 9 aa, Influenza virus
VQSRMQFSS

SEQ ID NO: 460802 - protein, 9 aa, Influenza virus
VQSYFQLFL

SEQ ID NO: 460803 - protein, 9 aa, Influenza virus
VQTDEYKNT

SEQ ID NO: 460804 - protein, 9 aa, Influenza virus
VQVDTIMEK

SEQ ID NO: 460805 - protein, 9 aa, Influenza virus
VQVIKLLPF

SEQ ID NO: 460806 - protein, 9 aa, Influenza virus
VRARPQVNG

SEQ ID NO: 460807 - protein, 9 aa, Influenza virus
VRCICKDNW

SEQ ID NO: 460808 - protein, 9 aa, Influenza virus
VRCICRDNW

SEQ ID NO: 460809 - protein, 9 aa, Influenza virus
VRCVCRDNW

SEQ ID NO: 460810 - protein, 9 aa, Influenza virus
VREGRNPGN

SEQ ID NO: 460811 - protein, 9 aa, Influenza virus
VREKDMTKE

SEQ ID NO: 460812 - protein, 9 aa, Influenza virus
VREPFISCS

SEQ ID NO: 460813 - protein, 9 aa, Influenza virus
VREQQGRMD

SEQ ID NO: 460814 - protein, 9 aa, Influenza virus
VRESRNPGN

SEQ ID NO: 460815 - protein, 9 aa, Influenza virus
VREWSYLIE

SEQ ID NO: 460816 - protein, 9 aa, Influenza virus
VRFGESEQI

SEQ ID NO: 460817 - protein, 9 aa, Influenza virus
VRFNSDLDY

SEQ ID NO: 460818 - protein, 9 aa, Influenza virus
VRFQLKDNA

SEQ ID NO: 460819 - protein, 9 aa, Influenza virus
VRGDLNFVN

SEQ ID NO: 460820 - protein, 9 aa, Influenza virus
VRGDQICIG

SEQ ID NO: 460821 - protein, 9 aa, Influenza virus
VRGDQICVG

SEQ ID NO: 460822 - protein, 9 aa, Influenza virus
VRGDQMAHC

SEQ ID NO: 460823 - protein, 9 aa, Influenza virus
VRGDYNNTT

SEQ ID NO: 460824 - protein, 9 aa, Influenza virus
VRGLSSRIS

SEQ ID NO: 460825 - protein, 9 aa, Influenza virus
VRGNSPAFN

SEQ ID NO: 460826 - protein, 9 aa, Influenza virus
VRGNSPVFN

SEQ ID NO: 460827 - protein, 9 aa, Influenza virus
VRGQQGRMD

SEQ ID NO: 460828 - protein, 9 aa, Influenza virus
VRGQQGTMD

SEQ ID NO: 460829 - protein, 9 aa, Influenza virus
VRGQQGWMD

SEQ ID NO: 460830 - protein, 9 aa, Influenza virus
VRGQSGRIS

SEQ ID NO: 460831 - protein, 9 aa, Influenza virus
VRGQSGRVS

SEQ ID NO: 460832 - protein, 9 aa, Influenza virus
VRGSGLRIL

SEQ ID NO: 460833 - protein, 9 aa, Influenza virus
VRGSGMRIL

SEQ ID NO: 460834 - protein, 9 aa, Influenza virus
VRGTGMRIL

SEQ ID NO: 460835 - protein, 9 aa, Influenza virus
VRHFEKVKI

SEQ ID NO: 460836 - protein, 9 aa, Influenza virus
VRHNGTCAV

SEQ ID NO: 460837 - protein, 9 aa, Influenza virus
VRHQLRDNA

SEQ ID NO: 460838 - protein, 9 aa, Influenza virus
VRHQLRENA

SEQ ID NO: 460839 - protein, 9 aa, Influenza virus
VRHRLKITE

SEQ ID NO: 460840 - protein, 9 aa, Influenza virus
VRIGSKGDV

SEQ ID NO: 460841 - protein, 9 aa, Influenza virus
VRINNETIL

SEQ ID NO: 460842 - protein, 9 aa, Influenza virus
VRKASLRLA

SEQ ID NO: 460843 - protein, 9 aa, Influenza virus
VRKMMTNSH

SEQ ID NO: 460844 - protein, 9 aa, Influenza virus
VRKMMTNSQ

SEQ ID NO: 460845 - protein, 9 aa, Influenza virus
VRKMMTSSQ

SEQ ID NO: 460846 - protein, 9 aa, Influenza virus
VRKQLRENA

SEQ ID NO: 460847 - protein, 9 aa, Influenza virus
VRKQLRQNA

SEQ ID NO: 460848 - protein, 9 aa, Influenza virus
VRKRFADQE

SEQ ID NO: 460849 - protein, 9 aa, Influenza virus
VRKTRFLPV

SEQ ID NO: 460850 - protein, 9 aa, Influenza virus
VRLEENTTY

SEQ ID NO: 460851 - protein, 9 aa, Influenza virus
VRLFDYSRW

SEQ ID NO: 460852 - protein, 9 aa, Influenza virus
VRLQLKDNA

SEQ ID NO: 460853 - protein, 9 aa, Influenza virus
VRLQLRDNA

SEQ ID NO: 460854 - protein, 9 aa, Influenza virus
VRLQLRNNA

SEQ ID NO: 460855 - protein, 9 aa, Influenza virus
VRLSAGGDI

SEQ ID NO: 460856 - protein, 9 aa, Influenza virus
VRLSASGDI

SEQ ID NO: 460857 - protein, 9 aa, Influenza virus
VRLSSGYKD

SEQ ID NO: 460858 - protein, 9 aa, Influenza virus
VRLTQGYKD

SEQ ID NO: 460859 - protein, 9 aa, Influenza virus
VRLYLWGVH

SEQ ID NO: 460860 - protein, 9 aa, Influenza virus
VRMIKRGIN

SEQ ID NO: 460861 - protein, 9 aa, Influenza virus
VRMNNETIL

SEQ ID NO: 460862 - protein, 9 aa, Influenza virus
VRMQLKDNA

SEQ ID NO: 460863 - protein, 9 aa, Influenza virus
VRMQLRDNA

SEQ ID NO: 460864 - protein, 9 aa, Influenza virus
VRMQLRDNV

SEQ ID NO: 460865 - protein, 9 aa, Influenza virus
VRNDDIDQS

SEQ ID NO: 460866 - protein, 9 aa, Influenza virus
VRNDDVDQS

SEQ ID NO: 460867 - protein, 9 aa, Influenza virus
VRNGTYDHK

SEQ ID NO: 460868 - protein, 9 aa, Influenza virus
VRNGTYDYP

SEQ ID NO: 460869 - protein, 9 aa, Influenza virus
VRNLHDQIK

SEQ ID NO: 460870 - protein, 9 aa, Influenza virus
VRNLHDQIR

SEQ ID NO: 460871 - protein, 9 aa, Influenza virus
VRNLHDQVK

SEQ ID NO: 460872 - protein, 9 aa, Influenza virus
VRNLHDQVR

SEQ ID NO: 460873 - protein, 9 aa, Influenza virus
VRNLHDRIR

SEQ ID NO: 460874 - protein, 9 aa, Influenza virus
VRNLHDRTR

SEQ ID NO: 460875 - protein, 9 aa, Influenza virus
VRNLHDRVK

SEQ ID NO: 460876 - protein, 9 aa, Influenza virus
VRNLHDRVR

SEQ ID NO: 460877 - protein, 9 aa, Influenza virus
VRNLHEQIK

SEQ ID NO: 460878 - protein, 9 aa, Influenza virus
VRNLHEQVR

SEQ ID NO: 460879 - protein, 9 aa, Influenza virus
VRNLHERIR

SEQ ID NO: 460880 - protein, 9 aa, Influenza virus
VRNLYDKVR

SEQ ID NO: 460881 - protein, 9 aa, Influenza virus
VRNQSGRIS

SEQ ID NO: 460882 - protein, 9 aa, Influenza virus
VRPGDNITF

SEQ ID NO: 460883 - protein, 9 aa, Influenza virus
VRPGYNGQK

SEQ ID NO: 460884 - protein, 9 aa, Influenza virus
VRPGYNGQR

SEQ ID NO: 460885 - protein, 9 aa, Influenza virus
VRPLILKDC

SEQ ID NO: 460886 - protein, 9 aa, Influenza virus
VRPLILRDC

SEQ ID NO: 460887 - protein, 9 aa, Influenza virus
VRPRYNGQR

SEQ ID NO: 460888 - protein, 9 aa, Influenza virus
VRQCFNPMI

SEQ ID NO: 460889 - protein, 9 aa, Influenza virus
VRQCFNPMT

SEQ ID NO: 460890 - protein, 9 aa, Influenza virus
VRQCFNPMV

SEQ ID NO: 460891 - protein, 9 aa, Influenza virus
VRRAAVSAD

SEQ ID NO: 460892 - protein, 9 aa, Influenza virus
VRRAIVSAD

SEQ ID NO: 460893 - protein, 9 aa, Influenza virus
VRRATVSAD

SEQ ID NO: 460894 - protein, 9 aa, Influenza virus
VRRDQMAHC

SEQ ID NO: 460895 - protein, 9 aa, Influenza virus
VRRIWRQAN

SEQ ID NO: 460896 - protein, 9 aa, Influenza virus
VRRQLRENA

SEQ ID NO: 460897 - protein, 9 aa, Influenza virus
VRRRLSANA

SEQ ID NO: 460898 - protein, 9 aa, Influenza virus
VRRRLSTNA

SEQ ID NO: 460899 - protein, 9 aa, Influenza virus
VRRRLSVNA

SEQ ID NO: 460900 - protein, 9 aa, Influenza virus
VRSDGNLIA

SEQ ID NO: 460901 - protein, 9 aa, Influenza virus
VRSDKICLG

SEQ ID NO: 460902 - protein, 9 aa, Influenza virus
VRSEKLVLA

SEQ ID NO: 460903 - protein, 9 aa, Influenza virus
VRSGMDPRM

SEQ ID NO: 460904 - protein, 9 aa, Influenza virus
VRSLKLATG

SEQ ID NO: 460905 - protein, 9 aa, Influenza virus
VRSNGNLIA

SEQ ID NO: 460906 - protein, 9 aa, Influenza virus
VRSQLRDNA

SEQ ID NO: 460907 - protein, 9 aa, Influenza virus
VRSQSGRIS

SEQ ID NO: 460908 - protein, 9 aa, Influenza virus
VRSWKKQIL

SEQ ID NO: 460909 - protein, 9 aa, Influenza virus
VRSWRKKIL

SEQ ID NO: 460910 - protein, 9 aa, Influenza virus
VRSWRKQIL

SEQ ID NO: 460911 - protein, 9 aa, Influenza virus
VRSWRRQIL

SEQ ID NO: 460912 - protein, 9 aa, Influenza virus
VRTGMDPRM

SEQ ID NO: 460913 - protein, 9 aa, Influenza virus
VRTLFQQMR

SEQ ID NO: 460914 - protein, 9 aa, Influenza virus
VRTNGTSKI

SEQ ID NO: 460915 - protein, 9 aa, Influenza virus
VRTNGTSKV

SEQ ID NO: 460916 - protein, 9 aa, Influenza virus
VSADPLASL

SEQ ID NO: 460917 - protein, 9 aa, Influenza virus
VSADPLLSL

SEQ ID NO: 460918 - protein, 9 aa, Influenza virus
VSAGGDIWV

SEQ ID NO: 460919 - protein, 9 aa, Influenza virus
VSAKELVET

SEQ ID NO: 460920 - protein, 9 aa, Influenza virus
VSCDPDECR

SEQ ID NO: 460921 - protein, 9 aa, Influenza virus
VSCDPDGCR

SEQ ID NO: 460922 - protein, 9 aa, Influenza virus
VSCDPLGCK

SEQ ID NO: 460923 - protein, 9 aa, Influenza virus
VSCDPLGCR

SEQ ID NO: 460924 - protein, 9 aa, Influenza virus
VSCDPNECR

SEQ ID NO: 460925 - protein, 9 aa, Influenza virus
VSCDPSGCK

SEQ ID NO: 460926 - protein, 9 aa, Influenza virus
VSCDPTGCK

SEQ ID NO: 460927 - protein, 9 aa, Influenza virus
VSCEPDECR

SEQ ID NO: 460928 - protein, 9 aa, Influenza virus
VSCGPSECR

SEQ ID NO: 460929 - protein, 9 aa, Influenza virus
VSCSHLECR

SEQ ID NO: 460930 - protein, 9 aa, Influenza virus
VSCVCRDNW

SEQ ID NO: 460931 - protein, 9 aa, Influenza virus
VSDGGPNLY

SEQ ID NO: 460932 - protein, 9 aa, Influenza virus
VSECRTFFL

SEQ ID NO: 460933 - protein, 9 aa, Influenza virus
VSEEALRQK

SEQ ID NO: 460934 - protein, 9 aa, Influenza virus
VSEWSYIVE

SEQ ID NO: 460935 - protein, 9 aa, Influenza virus
VSFESNGGL

SEQ ID NO: 460936 - protein, 9 aa, Influenza virus
VSFHLGTKQ

SEQ ID NO: 460937 - protein, 9 aa, Influenza virus
VSFQGGHIE

SEQ ID NO: 460938 - protein, 9 aa, Influenza virus
VSFQGRGVF

SEQ ID NO: 460939 - protein, 9 aa, Influenza virus
VSFRGRGVF

SEQ ID NO: 460940 - protein, 9 aa, Influenza virus
VSFSISCFL

SEQ ID NO: 460941 - protein, 9 aa, Influenza virus
VSFWMCSNG

SEQ ID NO: 460942 - protein, 9 aa, Influenza virus
VSFYWTIVE

SEQ ID NO: 460943 - protein, 9 aa, Influenza virus
VSGADDDAY

SEQ ID NO: 460944 - protein, 9 aa, Influenza virus
VSGADNDAY

SEQ ID NO: 460945 - protein, 9 aa, Influenza virus
VSGEVPGWS

SEQ ID NO: 460946 - protein, 9 aa, Influenza virus
VSGINESAD

SEQ ID NO: 460947 - protein, 9 aa, Influenza virus
VSGPDNGAV

SEQ ID NO: 460948 - protein, 9 aa, Influenza virus
VSGPNNNAS

SEQ ID NO: 460949 - protein, 9 aa, Influenza virus
VSGTDDDAY

SEQ ID NO: 460950 - protein, 9 aa, Influenza virus
VSGVNESAD

SEQ ID NO: 460951 - protein, 9 aa, Influenza virus
VSHCRATEY

SEQ ID NO: 460952 - protein, 9 aa, Influenza virus
VSHNGTWAV

SEQ ID NO: 460953 - protein, 9 aa, Influenza virus
VSIDRFLRV

SEQ ID NO: 460954 - protein, 9 aa, Influenza virus
VSIGTSTLN

SEQ ID NO: 460955 - protein, 9 aa, Influenza virus
VSILNLGQK

SEQ ID NO: 460956 - protein, 9 aa, Influenza virus
VSILNLGQR

SEQ ID NO: 460957 - protein, 9 aa, Influenza virus
VSKDNGIRI

SEQ ID NO: 460958 - protein, 9 aa, Influenza virus
VSKDNGIRV

SEQ ID NO: 460959 - protein, 9 aa, Influenza virus
VSKMGVDEY

SEQ ID NO: 460960 - protein, 9 aa, Influenza virus
VSKTGVDEY

SEQ ID NO: 460961 - protein, 9 aa, Influenza virus
VSKVGVDEY

SEQ ID NO: 460962 - protein, 9 aa, Influenza virus
VSLGAISFW

SEQ ID NO: 460963 - protein, 9 aa, Influenza virus
VSLGAVSFW

SEQ ID NO: 460964 - protein, 9 aa, Influenza virus
VSLLQSAIL

SEQ ID NO: 460965 - protein, 9 aa, Influenza virus
VSLSPGMMM

SEQ ID NO: 460966 - protein, 9 aa, Influenza virus
VSLSYSTGA

SEQ ID NO: 460967 - protein, 9 aa, Influenza virus
VSMCSSTEF

SEQ ID NO: 460968 - protein, 9 aa, Influenza virus
VSMEFSLTD

SEQ ID NO: 460969 - protein, 9 aa, Influenza virus
VSNDNWSGY

SEQ ID NO: 460970 - protein, 9 aa, Influenza virus
VSNGTKINT

SEQ ID NO: 460971 - protein, 9 aa, Influenza virus
VSNGTKVNT

SEQ ID NO: 460972 - protein, 9 aa, Influenza virus
VSNGTMVKT

SEQ ID NO: 460973 - protein, 9 aa, Influenza virus
VSNNDWSGY

SEQ ID NO: 460974 - protein, 9 aa, Influenza virus
VSNSDFICV

SEQ ID NO: 460975 - protein, 9 aa, Influenza virus
VSNSDFLCV

SEQ ID NO: 460976 - protein, 9 aa, Influenza virus
VSNSDFMCV

SEQ ID NO: 460977 - protein, 9 aa, Influenza virus
VSNSDWSGY

SEQ ID NO: 460978 - protein, 9 aa, Influenza virus
VSNSEFLCV

SEQ ID NO: 460979 - protein, 9 aa, Influenza virus
VSPIHLGDC

SEQ ID NO: 460980 - protein, 9 aa, Influenza virus
VSPLAVTWW

SEQ ID NO: 460981 - protein, 9 aa, Influenza virus
VSPLSGSAQ

SEQ ID NO: 460982 - protein, 9 aa, Influenza virus
VSPVHLGDC

SEQ ID NO: 460983 - protein, 9 aa, Influenza virus
VSRARIDAR

SEQ ID NO: 460984 - protein, 9 aa, Influenza virus
VSRIAIGNC

SEQ ID NO: 460985 - protein, 9 aa, Influenza virus
VSRMGVDEY

SEQ ID NO: 460986 - protein, 9 aa, Influenza virus
VSSEAPGWS

SEQ ID NO: 460987 - protein, 9 aa, Influenza virus
VSSEVPGCT

SEQ ID NO: 460988 - protein, 9 aa, Influenza virus
VSSEVPGWS

SEQ ID NO: 460989 - protein, 9 aa, Influenza virus
VSSFEKFEI

SEQ ID NO: 460990 - protein, 9 aa, Influenza virus
VSSFERFEI

SEQ ID NO: 460991 - protein, 9 aa, Influenza virus
VSSFERFEM

SEQ ID NO: 460992 - protein, 9 aa, Influenza virus
VSSFKRFEI

SEQ ID NO: 460993 - protein, 9 aa, Influenza virus
VSSFYSEMK

SEQ ID NO: 460994 - protein, 9 aa, Influenza virus
VSSGLVLVG

SEQ ID NO: 460995 - protein, 9 aa, Influenza virus
VSSLALAIM

SEQ ID NO: 460996 - protein, 9 aa, Influenza virus
VSSLPFQNI

SEQ ID NO: 460997 - protein, 9 aa, Influenza virus
VSSLPFQSI

SEQ ID NO: 460998 - protein, 9 aa, Influenza virus
VSSSGTSKA

SEQ ID NO: 460999 - protein, 9 aa, Influenza virus
VSSSLVLAG

SEQ ID NO: 461000 - protein, 9 aa, Influenza virus
VSSSLVLVG

SEQ ID NO: 461001 - protein, 9 aa, Influenza virus
VSSWHILSK

SEQ ID NO: 461002 - protein, 9 aa, Influenza virus
VSTDKDSNG

SEQ ID NO: 461003 - protein, 9 aa, Influenza virus
VSTDKNSNG

SEQ ID NO: 461004 - protein, 9 aa, Influenza virus
VSTDKSSNG

SEQ ID NO: 461005 - protein, 9 aa, Influenza virus
VSTKEWSKR

SEQ ID NO: 461006 - protein, 9 aa, Influenza virus
VSTKEWSRR

SEQ ID NO: 461007 - protein, 9 aa, Influenza virus
VSTNAYDRI

SEQ ID NO: 461008 - protein, 9 aa, Influenza virus
VSTQKAINE

SEQ ID NO: 461009 - protein, 9 aa, Influenza virus
VSTQKALNE

SEQ ID NO: 461010 - protein, 9 aa, Influenza virus
VSTRSDQIS

SEQ ID NO: 461011 - protein, 9 aa, Influenza virus
VSVGSGSFP

SEQ ID NO: 461012 - protein, 9 aa, Influenza virus
VSVGTSTLN

SEQ ID NO: 461013 - protein, 9 aa, Influenza virus
VSVLNLGQK

SEQ ID NO: 461014 - protein, 9 aa, Influenza virus
VSVTDGPAA

SEQ ID NO: 461015 - protein, 9 aa, Influenza virus
VSWASNSIV

SEQ ID NO: 461016 - protein, 9 aa, Influenza virus
VSWEMGQAP

SEQ ID NO: 461017 - protein, 9 aa, Influenza virus
VSWPLSSPP

SEQ ID NO: 461018 - protein, 9 aa, Influenza virus
VSWSQNILR

SEQ ID NO: 461019 - protein, 9 aa, Influenza virus
VSWTSNSII

SEQ ID NO: 461020 - protein, 9 aa, Influenza virus
VSWTSNSIV

SEQ ID NO: 461021 - protein, 9 aa, Influenza virus
VSWTSNSMV

SEQ ID NO: 461022 - protein, 9 aa, Influenza virus
VTAQELVEA

SEQ ID NO: 461023 - protein, 9 aa, Influenza virus
VTAQELVES

SEQ ID NO: 461024 - protein, 9 aa, Influenza virus
VTASCLDKG

SEQ ID NO: 461025 - protein, 9 aa, Influenza virus
VTASCLDRG

SEQ ID NO: 461026 - protein, 9 aa, Influenza virus
VTASCRDNG

SEQ ID NO: 461027 - protein, 9 aa, Influenza virus
VTCGCRDNW

SEQ ID NO: 461028 - protein, 9 aa, Influenza virus
VTCICRDNW

SEQ ID NO: 461029 - protein, 9 aa, Influenza virus
VTCTCRDNW

SEQ ID NO: 461030 - protein, 9 aa, Influenza virus
VTCVCRDNW

SEQ ID NO: 461031 - protein, 9 aa, Influenza virus
VTDGPAANN

SEQ ID NO: 461032 - protein, 9 aa, Influenza virus
VTDGPAANS

SEQ ID NO: 461033 - protein, 9 aa, Influenza virus
VTDGPSDAQ

SEQ ID NO: 461034 - protein, 9 aa, Influenza virus
VTDGWINSP

SEQ ID NO: 461035 - protein, 9 aa, Influenza virus
VTDIWAYNA

SEQ ID NO: 461036 - protein, 9 aa, Influenza virus
VTDIWSYNA

SEQ ID NO: 461037 - protein, 9 aa, Influenza virus
VTDSEMDKL

SEQ ID NO: 461038 - protein, 9 aa, Influenza virus
VTDSEMNKL

SEQ ID NO: 461039 - protein, 9 aa, Influenza virus
VTDSEMNRL

SEQ ID NO: 461040 - protein, 9 aa, Influenza virus
VTDSIKSWR

SEQ ID NO: 461041 - protein, 9 aa, Influenza virus
VTDVWSYNA

SEQ ID NO: 461042 - protein, 9 aa, Influenza virus
VTDWSGYSG

SEQ ID NO: 461043 - protein, 9 aa, Influenza virus
VTEGWIDSP

SEQ ID NO: 461044 - protein, 9 aa, Influenza virus
VTEGWINSP

SEQ ID NO: 461045 - protein, 9 aa, Influenza virus
VTEINTWAR

SEQ ID NO: 461046 - protein, 9 aa, Influenza virus
VTELWSYNA

SEQ ID NO: 461047 - protein, 9 aa, Influenza virus
VTETLYLNH

SEQ ID NO: 461048 - protein, 9 aa, Influenza virus
VTFCGLDNE

SEQ ID NO: 461049 - protein, 9 aa, Influenza virus
VTFCGLNNE

SEQ ID NO: 461050 - protein, 9 aa, Influenza virus
VTFHGAKEV

SEQ ID NO: 461051 - protein, 9 aa, Influenza virus
VTFIFNGAF

SEQ ID NO: 461052 - protein, 9 aa, Influenza virus
VTFNFNGAF

SEQ ID NO: 461053 - protein, 9 aa, Influenza virus
VTFSFNGAF

SEQ ID NO: 461054 - protein, 9 aa, Influenza virus
VTFTFNGAF

SEQ ID NO: 461055 - protein, 9 aa, Influenza virus
VTGDDKNAT

SEQ ID NO: 461056 - protein, 9 aa, Influenza virus
VTGDDRNAT

SEQ ID NO: 461057 - protein, 9 aa, Influenza virus
VTGFAPFSK

SEQ ID NO: 461058 - protein, 9 aa, Influenza virus
VTGKLNRLI

SEQ ID NO: 461059 - protein, 9 aa, Influenza virus
VTGKSHGRI

SEQ ID NO: 461060 - protein, 9 aa, Influenza virus
VTGLRNIPS

SEQ ID NO: 461061 - protein, 9 aa, Influenza virus
VTGLRNVPA

SEQ ID NO: 461062 - protein, 9 aa, Influenza virus
VTGYEKNAT

SEQ ID NO: 461063 - protein, 9 aa, Influenza virus
VTHAKDILE

SEQ ID NO: 461064 - protein, 9 aa, Influenza virus
VTHAKNILE

SEQ ID NO: 461065 - protein, 9 aa, Influenza virus
VTHAQDILE

SEQ ID NO: 461066 - protein, 9 aa, Influenza virus
VTHAQDLLE

SEQ ID NO: 461067 - protein, 9 aa, Influenza virus
VTHAQNILE

SEQ ID NO: 461068 - protein, 9 aa, Influenza virus
VTHFEKIKI

SEQ ID NO: 461069 - protein, 9 aa, Influenza virus
VTHFEKVKI

SEQ ID NO: 461070 - protein, 9 aa, Influenza virus
VTHFQRKRR

SEQ ID NO: 461071 - protein, 9 aa, Influenza virus
VTHSIELLE

SEQ ID NO: 461072 - protein, 9 aa, Influenza virus
VTHSINLLE

SEQ ID NO: 461073 - protein, 9 aa, Influenza virus
VTHSVELLE

SEQ ID NO: 461074 - protein, 9 aa, Influenza virus
VTHSVNILE

SEQ ID NO: 461075 - protein, 9 aa, Influenza virus
VTHSVNLLE

SEQ ID NO: 461076 - protein, 9 aa, Influenza virus
VTHTGTSKA

SEQ ID NO: 461077 - protein, 9 aa, Influenza virus
VTHVQNNYT

SEQ ID NO: 461078 - protein, 9 aa, Influenza virus
VTIGECPKY

SEQ ID NO: 461079 - protein, 9 aa, Influenza virus
VTIGKCPKY

SEQ ID NO: 461080 - protein, 9 aa, Influenza virus
VTKENTGSY

SEQ ID NO: 461081 - protein, 9 aa, Influenza virus
VTKVYNETV

SEQ ID NO: 461082 - protein, 9 aa, Influenza virus
VTLHFKQHD

SEQ ID NO: 461083 - protein, 9 aa, Influenza virus
VTLHFKQHE

SEQ ID NO: 461084 - protein, 9 aa, Influenza virus
VTLHFKQHK

SEQ ID NO: 461085 - protein, 9 aa, Influenza virus
VTLHFKQNE

SEQ ID NO: 461086 - protein, 9 aa, Influenza virus
VTLSSGYKD

SEQ ID NO: 461087 - protein, 9 aa, Influenza virus
VTLSVVSLL

SEQ ID NO: 461088 - protein, 9 aa, Influenza virus
VTLTMGYKD

SEQ ID NO: 461089 - protein, 9 aa, Influenza virus
VTNATELVQ

SEQ ID NO: 461090 - protein, 9 aa, Influenza virus
VTNATETVE

SEQ ID NO: 461091 - protein, 9 aa, Influenza virus
VTNGTMVKT

SEQ ID NO: 461092 - protein, 9 aa, Influenza virus
VTNKVNSII

SEQ ID NO: 461093 - protein, 9 aa, Influenza virus
VTNVQNDYT

SEQ ID NO: 461094 - protein, 9 aa, Influenza virus
VTNVQNNYT

SEQ ID NO: 461095 - protein, 9 aa, Influenza virus
VTQAMELVE

SEQ ID NO: 461096 - protein, 9 aa, Influenza virus
VTQINNTNI

SEQ ID NO: 461097 - protein, 9 aa, Influenza virus
VTQISNTNI

SEQ ID NO: 461098 - protein, 9 aa, Influenza virus
VTQRTIGKK

SEQ ID NO: 461099 - protein, 9 aa, Influenza virus
VTQRTIGKR

SEQ ID NO: 461100 - protein, 9 aa, Influenza virus
VTQRTVGKK

SEQ ID NO: 461101 - protein, 9 aa, Influenza virus
VTQTLVSNN

SEQ ID NO: 461102 - protein, 9 aa, Influenza virus
VTQTMELVE

SEQ ID NO: 461103 - protein, 9 aa, Influenza virus
VTQVEELVH

SEQ ID NO: 461104 - protein, 9 aa, Influenza virus
VTRELYVSC

SEQ ID NO: 461105 - protein, 9 aa, Influenza virus
VTREPYISC

SEQ ID NO: 461106 - protein, 9 aa, Influenza virus
VTREPYLSC

SEQ ID NO: 461107 - protein, 9 aa, Influenza virus
VTREPYVSC

SEQ ID NO: 461108 - protein, 9 aa, Influenza virus
VTRREIHIY

SEQ ID NO: 461109 - protein, 9 aa, Influenza virus
VTRREVHIY

SEQ ID NO: 461110 - protein, 9 aa, Influenza virus
VTRREVHMY

SEQ ID NO: 461111 - protein, 9 aa, Influenza virus
VTRREVHTY

SEQ ID NO: 461112 - protein, 9 aa, Influenza virus
VTRREVHVY

SEQ ID NO: 461113 - protein, 9 aa, Influenza virus
VTRSGTSKA

SEQ ID NO: 461114 - protein, 9 aa, Influenza virus
VTSSGTSKA

SEQ ID NO: 461115 - protein, 9 aa, Influenza virus
VTSSIDLIE

SEQ ID NO: 461116 - protein, 9 aa, Influenza virus
VTSSIDLVE

SEQ ID NO: 461117 - protein, 9 aa, Influenza virus
VTSSIELVE

SEQ ID NO: 461118 - protein, 9 aa, Influenza virus
VTSSVDLIE

SEQ ID NO: 461119 - protein, 9 aa, Influenza virus
VTSSVDLVE

SEQ ID NO: 461120 - protein, 9 aa, Influenza virus
VTSSVELVE

SEQ ID NO: 461121 - protein, 9 aa, Influenza virus
VTSTIDLIE

SEQ ID NO: 461122 - protein, 9 aa, Influenza virus
VTTHFQRKR

SEQ ID NO: 461123 - protein, 9 aa, Influenza virus
VTTNTINRI

SEQ ID NO: 461124 - protein, 9 aa, Influenza virus
VTTNTINRN

SEQ ID NO: 461125 - protein, 9 aa, Influenza virus
VTTNTINRS

SEQ ID NO: 461126 - protein, 9 aa, Influenza virus
VTTRQASPS

SEQ ID NO: 461127 - protein, 9 aa, Influenza virus
VTTVGWSWP

SEQ ID NO: 461128 - protein, 9 aa, Influenza virus
VTTVTLHFK

SEQ ID NO: 461129 - protein, 9 aa, Influenza virus
VTVIKNNMI

SEQ ID NO: 461130 - protein, 9 aa, Influenza virus
VTVIKNNMV

SEQ ID NO: 461131 - protein, 9 aa, Influenza virus
VTVIRNNMI

SEQ ID NO: 461132 - protein, 9 aa, Influenza virus
VTVSTRSDQ

SEQ ID NO: 461133 - protein, 9 aa, Influenza virus
VTVTDGPAA

SEQ ID NO: 461134 - protein, 9 aa, Influenza virus
VTVTHAEDI

SEQ ID NO: 461135 - protein, 9 aa, Influenza virus
VTVTHAKDI

SEQ ID NO: 461136 - protein, 9 aa, Influenza virus
VTVTHAKNI

SEQ ID NO: 461137 - protein, 9 aa, Influenza virus
VTVTHAQDI

SEQ ID NO: 461138 - protein, 9 aa, Influenza virus
VTVTHAQDL

SEQ ID NO: 461139 - protein, 9 aa, Influenza virus
VTVTHAQNI

SEQ ID NO: 461140 - protein, 9 aa, Influenza virus
VTVTHSIEL

SEQ ID NO: 461141 - protein, 9 aa, Influenza virus
VTVTHSINL

SEQ ID NO: 461142 - protein, 9 aa, Influenza virus
VTVTHSVDL

SEQ ID NO: 461143 - protein, 9 aa, Influenza virus
VTVTHSVEL

SEQ ID NO: 461144 - protein, 9 aa, Influenza virus
VTVTHSVNI

SEQ ID NO: 461145 - protein, 9 aa, Influenza virus
VTVTHSVNL

SEQ ID NO: 461146 - protein, 9 aa, Influenza virus
VTVTSSIEL

SEQ ID NO: 461147 - protein, 9 aa, Influenza virus
VTVTSSVEL

SEQ ID NO: 461148 - protein, 9 aa, Influenza virus
VTWWNRKGP

SEQ ID NO: 461149 - protein, 9 aa, Influenza virus
VTWWNRNGP

SEQ ID NO: 461150 - protein, 9 aa, Influenza virus
VTWWNRSGP

SEQ ID NO: 461151 - protein, 9 aa, Influenza virus
VTYNNTVIN

SEQ ID NO: 461152 - protein, 9 aa, Influenza virus
VTYQILSIY

SEQ ID NO: 461153 - protein, 9 aa, Influenza virus
VTYTGISKA

SEQ ID NO: 461154 - protein, 9 aa, Influenza virus
VTYTGTSKA

SEQ ID NO: 461155 - protein, 9 aa, Influenza virus
VTYTGTSRA

SEQ ID NO: 461156 - protein, 9 aa, Influenza virus
VVAAQELVE

SEQ ID NO: 461157 - protein, 9 aa, Influenza virus
VVAKDNAIR

SEQ ID NO: 461158 - protein, 9 aa, Influenza virus
VVAMVFSQE

SEQ ID NO: 461159 - protein, 9 aa, Influenza virus
VVAVTDGPA

SEQ ID NO: 461160 - protein, 9 aa, Influenza virus
VVCVCRDNW

SEQ ID NO: 461161 - protein, 9 aa, Influenza virus
VVDATETVE

SEQ ID NO: 461162 - protein, 9 aa, Influenza virus
VVENKYVNN

SEQ ID NO: 461163 - protein, 9 aa, Influenza virus
VVENTYVNN

SEQ ID NO: 461164 - protein, 9 aa, Influenza virus
VVFCGTSGI

SEQ ID NO: 461165 - protein, 9 aa, Influenza virus
VVFCGTSGN

SEQ ID NO: 461166 - protein, 9 aa, Influenza virus
VVFCGTSGT

SEQ ID NO: 461167 - protein, 9 aa, Influenza virus
VVFPNEVGA

SEQ ID NO: 461168 - protein, 9 aa, Influenza virus
VVFTDGSAT

SEQ ID NO: 461169 - protein, 9 aa, Influenza virus
VVGARPQVN

SEQ ID NO: 461170 - protein, 9 aa, Influenza virus
VVGDRPLVN

SEQ ID NO: 461171 - protein, 9 aa, Influenza virus
VVGWISGNP

SEQ ID NO: 461172 - protein, 9 aa, Influenza virus
VVHISPLSG

SEQ ID NO: 461173 - protein, 9 aa, Influenza virus
VVIAKDNAI

SEQ ID NO: 461174 - protein, 9 aa, Influenza virus
VVIAKDNAV

SEQ ID NO: 461175 - protein, 9 aa, Influenza virus
VVIAQDNAI

SEQ ID NO: 461176 - protein, 9 aa, Influenza virus
VVIEKDNAV

SEQ ID NO: 461177 - protein, 9 aa, Influenza virus
VVIMTDGPA

SEQ ID NO: 461178 - protein, 9 aa, Influenza virus
VVIMTDGSA

SEQ ID NO: 461179 - protein, 9 aa, Influenza virus
VVKTLTNEH

SEQ ID NO: 461180 - protein, 9 aa, Influenza virus
VVKYNGIIT

SEQ ID NO: 461181 - protein, 9 aa, Influenza virus
VVLNTDWSG

SEQ ID NO: 461182 - protein, 9 aa, Influenza virus
VVLNVSLHL

SEQ ID NO: 461183 - protein, 9 aa, Influenza virus
VVLVGLILA

SEQ ID NO: 461184 - protein, 9 aa, Influenza virus
VVLVMKRKR

SEQ ID NO: 461185 - protein, 9 aa, Influenza virus
VVMGLVFIC

SEQ ID NO: 461186 - protein, 9 aa, Influenza virus
VVMTDGNAS

SEQ ID NO: 461187 - protein, 9 aa, Influenza virus
VVMTDGPAD

SEQ ID NO: 461188 - protein, 9 aa, Influenza virus
VVMTDGPAN

SEQ ID NO: 461189 - protein, 9 aa, Influenza virus
VVMTDGPAS

SEQ ID NO: 461190 - protein, 9 aa, Influenza virus
VVMTDGSAS

SEQ ID NO: 461191 - protein, 9 aa, Influenza virus
VVMTDGSAT

SEQ ID NO: 461192 - protein, 9 aa, Influenza virus
VVMTDGSVS

SEQ ID NO: 461193 - protein, 9 aa, Influenza virus
VVNATETVE

SEQ ID NO: 461194 - protein, 9 aa, Influenza virus
VVNFLSMEF

SEQ ID NO: 461195 - protein, 9 aa, Influenza virus
VVNFVSMEF

SEQ ID NO: 461196 - protein, 9 aa, Influenza virus
VVNIDRFLR

SEQ ID NO: 461197 - protein, 9 aa, Influenza virus
VVNNITTTI

SEQ ID NO: 461198 - protein, 9 aa, Influenza virus
VVNTALSTI

SEQ ID NO: 461199 - protein, 9 aa, Influenza virus
VVNTTLSTI

SEQ ID NO: 461200 - protein, 9 aa, Influenza virus
VVNYVSMEF

SEQ ID NO: 461201 - protein, 9 aa, Influenza virus
VVPEYGFKI

SEQ ID NO: 461202 - protein, 9 aa, Influenza virus
VVPSFDMSN

SEQ ID NO: 461203 - protein, 9 aa, Influenza virus
VVRARPQVN

SEQ ID NO: 461204 - protein, 9 aa, Influenza virus
VVREPFISC

SEQ ID NO: 461205 - protein, 9 aa, Influenza virus
VVRKMMTNS

SEQ ID NO: 461206 - protein, 9 aa, Influenza virus
VVRKMMTSS

SEQ ID NO: 461207 - protein, 9 aa, Influenza virus
VVRSWKKQI

SEQ ID NO: 461208 - protein, 9 aa, Influenza virus
VVRSWRKKI

SEQ ID NO: 461209 - protein, 9 aa, Influenza virus
VVRSWRKQI

SEQ ID NO: 461210 - protein, 9 aa, Influenza virus
VVRSWRRQI

SEQ ID NO: 461211 - protein, 9 aa, Influenza virus
VVSAKELVE

SEQ ID NO: 461212 - protein, 9 aa, Influenza virus
VVSCDSPSN

SEQ ID NO: 461213 - protein, 9 aa, Influenza virus
VVSIDRFLR

SEQ ID NO: 461214 - protein, 9 aa, Influenza virus
VVSLGAISF

SEQ ID NO: 461215 - protein, 9 aa, Influenza virus
VVSSLALAI

SEQ ID NO: 461216 - protein, 9 aa, Influenza virus
VVSSLVLAI

SEQ ID NO: 461217 - protein, 9 aa, Influenza virus
VVTAQELVE

SEQ ID NO: 461218 - protein, 9 aa, Influenza virus
VVTFCGLDN

SEQ ID NO: 461219 - protein, 9 aa, Influenza virus
VVTREPYVS

SEQ ID NO: 461220 - protein, 9 aa, Influenza virus
VVTVTDGPA

SEQ ID NO: 461221 - protein, 9 aa, Influenza virus
VVVAKDNAI

SEQ ID NO: 461222 - protein, 9 aa, Influenza virus
VVVFCGTSG

SEQ ID NO: 461223 - protein, 9 aa, Influenza virus
VVVMTDGPA

SEQ ID NO: 461224 - protein, 9 aa, Influenza virus
VVVMTDGSA

SEQ ID NO: 461225 - protein, 9 aa, Influenza virus
VWACQRGNI

SEQ ID NO: 461226 - protein, 9 aa, Influenza virus
VWAYNAELL

SEQ ID NO: 461227 - protein, 9 aa, Influenza virus
VWDANGWVS

SEQ ID NO: 461228 - protein, 9 aa, Influenza virus
VWDANGWVT

SEQ ID NO: 461229 - protein, 9 aa, Influenza virus
VWGIHHPSS

SEQ ID NO: 461230 - protein, 9 aa, Influenza virus
VWGVHHSSS

SEQ ID NO: 461231 - protein, 9 aa, Influenza virus
VWIGRTKSA

SEQ ID NO: 461232 - protein, 9 aa, Influenza virus
VWIGRTKSI

SEQ ID NO: 461233 - protein, 9 aa, Influenza virus
VWIGRTKSL

SEQ ID NO: 461234 - protein, 9 aa, Influenza virus
VWIGRTKSN

SEQ ID NO: 461235 - protein, 9 aa, Influenza virus
VWIGRTKSP

SEQ ID NO: 461236 - protein, 9 aa, Influenza virus
VWIGRTKST

SEQ ID NO: 461237 - protein, 9 aa, Influenza virus
VWLENEKTL

SEQ ID NO: 461238 - protein, 9 aa, Influenza virus
VWLGRTVSI

SEQ ID NO: 461239 - protein, 9 aa, Influenza virus
VWLGRTVSN

SEQ ID NO: 461240 - protein, 9 aa, Influenza virus
VWLGRTVST

SEQ ID NO: 461241 - protein, 9 aa, Influenza virus
VWLWLVLRE

SEQ ID NO: 461242 - protein, 9 aa, Influenza virus
VWMACHSAA

SEQ ID NO: 461243 - protein, 9 aa, Influenza virus
VWMACNSAA

SEQ ID NO: 461244 - protein, 9 aa, Influenza virus
VWMGRTISK

SEQ ID NO: 461245 - protein, 9 aa, Influenza virus
VWMGRTISM

SEQ ID NO: 461246 - protein, 9 aa, Influenza virus
VWMGRTISR

SEQ ID NO: 461247 - protein, 9 aa, Influenza virus
VWMGRTKSN

SEQ ID NO: 461248 - protein, 9 aa, Influenza virus
VWRQANNGE

SEQ ID NO: 461249 - protein, 9 aa, Influenza virus
VWSSKYQQS

SEQ ID NO: 461250 - protein, 9 aa, Influenza virus
VWSSKYQRS

SEQ ID NO: 461251 - protein, 9 aa, Influenza virus
VWSYNADLL

SEQ ID NO: 461252 - protein, 9 aa, Influenza virus
VWSYNAEFL

SEQ ID NO: 461253 - protein, 9 aa, Influenza virus
VWSYNAELL

SEQ ID NO: 461254 - protein, 9 aa, Influenza virus
VWSYNAKLL

SEQ ID NO: 461255 - protein, 9 aa, Influenza virus
VWTSGSIIS

SEQ ID NO: 461256 - protein, 9 aa, Influenza virus
VWTSGSSIS

SEQ ID NO: 461257 - protein, 9 aa, Influenza virus
VWTYNAELF

SEQ ID NO: 461258 - protein, 9 aa, Influenza virus
VWTYNAELL

SEQ ID NO: 461259 - protein, 9 aa, Influenza virus
VWTYNAEVL

SEQ ID NO: 461260 - protein, 9 aa, Influenza virus
VWTYNTELL

SEQ ID NO: 461261 - protein, 9 aa, Influenza virus
VWTYNVELL

SEQ ID NO: 461262 - protein, 9 aa, Influenza virus
VWVTREPYV

SEQ ID NO: 461263 - protein, 9 aa, Influenza virus
VWWASNSLI

SEQ ID NO: 461264 - protein, 9 aa, Influenza virus
VWWTANSII

SEQ ID NO: 461265 - protein, 9 aa, Influenza virus
VWWTSNSIA

SEQ ID NO: 461266 - protein, 9 aa, Influenza virus
VWWTSNSII

SEQ ID NO: 461267 - protein, 9 aa, Influenza virus
VWWTSNSIV

SEQ ID NO: 461268 - protein, 9 aa, Influenza virus
VWWTSNSLI

SEQ ID NO: 461269 - protein, 9 aa, Influenza virus
VWWTSNSLV

SEQ ID NO: 461270 - protein, 9 aa, Influenza virus
VYCICRDNW

SEQ ID NO: 461271 - protein, 9 aa, Influenza virus
VYCVCRDNW

SEQ ID NO: 461272 - protein, 9 aa, Influenza virus
VYFVEALAR

SEQ ID NO: 461273 - protein, 9 aa, Influenza virus
VYFVEILAR

SEQ ID NO: 461274 - protein, 9 aa, Influenza virus
VYFVETLAK

SEQ ID NO: 461275 - protein, 9 aa, Influenza virus
VYFVETLAR

SEQ ID NO: 461276 - protein, 9 aa, Influenza virus
VYIEVLHLT

SEQ ID NO: 461277 - protein, 9 aa, Influenza virus
VYINTALLN

SEQ ID NO: 461278 - protein, 9 aa, Influenza virus
VYINTAMLN

SEQ ID NO: 461279 - protein, 9 aa, Influenza virus
VYKALSIYS

SEQ ID NO: 461280 - protein, 9 aa, Influenza virus
VYKILSIYS

SEQ ID NO: 461281 - protein, 9 aa, Influenza virus
VYKVLAIYS

SEQ ID NO: 461282 - protein, 9 aa, Influenza virus
VYKVLSIYS

SEQ ID NO: 461283 - protein, 9 aa, Influenza virus
VYMNTALLN

SEQ ID NO: 461284 - protein, 9 aa, Influenza virus
VYNETVRLE

SEQ ID NO: 461285 - protein, 9 aa, Influenza virus
VYNETVRVE

SEQ ID NO: 461286 - protein, 9 aa, Influenza virus
VYNETVRVK

SEQ ID NO: 461287 - protein, 9 aa, Influenza virus
VYNNTTGRD

SEQ ID NO: 461288 - protein, 9 aa, Influenza virus
VYQAKFEAV

SEQ ID NO: 461289 - protein, 9 aa, Influenza virus
VYQAKFESV

SEQ ID NO: 461290 - protein, 9 aa, Influenza virus
VYQARFEAV

SEQ ID NO: 461291 - protein, 9 aa, Influenza virus
VYQARFESV

SEQ ID NO: 461292 - protein, 9 aa, Influenza virus
VYQILAIYA

SEQ ID NO: 461293 - protein, 9 aa, Influenza virus
VYQILAIYS

SEQ ID NO: 461294 - protein, 9 aa, Influenza virus
VYQILSIYS

SEQ ID NO: 461295 - protein, 9 aa, Influenza virus
VYQILVIYA

SEQ ID NO: 461296 - protein, 9 aa, Influenza virus
VYQSRFEAV

SEQ ID NO: 461297 - protein, 9 aa, Influenza virus
VYRALSIYS

SEQ ID NO: 461298 - protein, 9 aa, Influenza virus
VYRDNWKGS

SEQ ID NO: 461299 - protein, 9 aa, Influenza virus
VYSETVRVE

SEQ ID NO: 461300 - protein, 9 aa, Influenza virus
VYSTVASSL

SEQ ID NO: 461301 - protein, 9 aa, Influenza virus
VYVDGFEPN

SEQ ID NO: 461302 - protein, 9 aa, Influenza virus
VYVEVLHLT

SEQ ID NO: 461303 - protein, 9 aa, Influenza virus
VYVNTALLN

SEQ ID NO: 461304 - protein, 9 aa, Influenza virus
VYWTIVKPG

SEQ ID NO: 461305 - protein, 9 aa, Influenza virus
VYWTVVKPG

SEQ ID NO: 461306 - protein, 9 aa, Influenza virus
VYWWDGLQS

SEQ ID NO: 461307 - protein, 9 aa, Influenza virus
VYYDRRLTT

SEQ ID NO: 461308 - protein, 9 aa, Influenza virus
VYYERRLTT

SEQ ID NO: 461309 - protein, 9 aa, Influenza virus
VYYNGRLTT

SEQ ID NO: 461310 - protein, 9 aa, Influenza virus
VYYNKRLTT

SEQ ID NO: 461311 - protein, 9 aa, Influenza virus
VYYNRRLTT

SEQ ID NO: 461312 - protein, 9 aa, Influenza virus
WACGNGSCR

SEQ ID NO: 461313 - protein, 9 aa, Influenza virus
WACNNGSCR

SEQ ID NO: 461314 - protein, 9 aa, Influenza virus
WACNSGNCR

SEQ ID NO: 461315 - protein, 9 aa, Influenza virus
WACQKGNIK

SEQ ID NO: 461316 - protein, 9 aa, Influenza virus
WACQKGNIR

SEQ ID NO: 461317 - protein, 9 aa, Influenza virus
WACQNGNIR

SEQ ID NO: 461318 - protein, 9 aa, Influenza virus
WACQNGNLR

SEQ ID NO: 461319 - protein, 9 aa, Influenza virus
WACQNGNVR

SEQ ID NO: 461320 - protein, 9 aa, Influenza virus
WACQRGNIR

SEQ ID NO: 461321 - protein, 9 aa, Influenza virus
WACSNGNCR

SEQ ID NO: 461322 - protein, 9 aa, Influenza virus
WACSNGSCR

SEQ ID NO: 461323 - protein, 9 aa, Influenza virus
WACSSGNCR

SEQ ID NO: 461324 - protein, 9 aa, Influenza virus
WAEGDCYRA

SEQ ID NO: 461325 - protein, 9 aa, Influenza virus
WAEGECYRA

SEQ ID NO: 461326 - protein, 9 aa, Influenza virus
WAGKILRTQ

SEQ ID NO: 461327 - protein, 9 aa, Influenza virus
WAGNILRTQ

SEQ ID NO: 461328 - protein, 9 aa, Influenza virus
WAIHHPPTS

SEQ ID NO: 461329 - protein, 9 aa, Influenza virus
WAIHHPPTT

SEQ ID NO: 461330 - protein, 9 aa, Influenza virus
WAIHTKDNS

SEQ ID NO: 461331 - protein, 9 aa, Influenza virus
WAILKPGQT

SEQ ID NO: 461332 - protein, 9 aa, Influenza virus
WAIRTRSGG

SEQ ID NO: 461333 - protein, 9 aa, Influenza virus
WAIYSKDNG

SEQ ID NO: 461334 - protein, 9 aa, Influenza virus
WAIYSKDNS

SEQ ID NO: 461335 - protein, 9 aa, Influenza virus
WAIYTKDNS

SEQ ID NO: 461336 - protein, 9 aa, Influenza virus
WAKEECYRA

SEQ ID NO: 461337 - protein, 9 aa, Influenza virus
WAKGDCYRA

SEQ ID NO: 461338 - protein, 9 aa, Influenza virus
WAKGECYRA

SEQ ID NO: 461339 - protein, 9 aa, Influenza virus
WAKNILRTQ

SEQ ID NO: 461340 - protein, 9 aa, Influenza virus
WALGENMAP

SEQ ID NO: 461341 - protein, 9 aa, Influenza virus
WAPLSKDNG

SEQ ID NO: 461342 - protein, 9 aa, Influenza virus
WARNILRTQ

SEQ ID NO: 461343 - protein, 9 aa, Influenza virus
WASGSSISF

SEQ ID NO: 461344 - protein, 9 aa, Influenza virus
WASNSIVTF

SEQ ID NO: 461345 - protein, 9 aa, Influenza virus
WASNSLIAL

SEQ ID NO: 461346 - protein, 9 aa, Influenza virus
WATANSKSQ

SEQ ID NO: 461347 - protein, 9 aa, Influenza virus
WAVGRCPRY

SEQ ID NO: 461348 - protein, 9 aa, Influenza virus
WAVLKPGQT

SEQ ID NO: 461349 - protein, 9 aa, Influenza virus
WAYNAELIV

SEQ ID NO: 461350 - protein, 9 aa, Influenza virus
WAYNAELLV

SEQ ID NO: 461351 - protein, 9 aa, Influenza virus
WCGMIDGWY

SEQ ID NO: 461352 - protein, 9 aa, Influenza virus
WCKIVTTVG

SEQ ID NO: 461353 - protein, 9 aa, Influenza virus
WDANGWVST

SEQ ID NO: 461354 - protein, 9 aa, Influenza virus
WDDGAILPF

SEQ ID NO: 461355 - protein, 9 aa, Influenza virus
WDDGAILPL

SEQ ID NO: 461356 - protein, 9 aa, Influenza virus
WDDNGWVST

SEQ ID NO: 461357 - protein, 9 aa, Influenza virus
WDGLQSSDD

SEQ ID NO: 461358 - protein, 9 aa, Influenza virus
WDILRTQES

SEQ ID NO: 461359 - protein, 9 aa, Influenza virus
WDSFRQSER

SEQ ID NO: 461360 - protein, 9 aa, Influenza virus
WDTINFEST

SEQ ID NO: 461361 - protein, 9 aa, Influenza virus
WDTISFEST

SEQ ID NO: 461362 - protein, 9 aa, Influenza virus
WDTLIERDN

SEQ ID NO: 461363 - protein, 9 aa, Influenza virus
WDTLIEREN

SEQ ID NO: 461364 - protein, 9 aa, Influenza virus
WDTLIERGS

SEQ ID NO: 461365 - protein, 9 aa, Influenza virus
WDVFIERPT

SEQ ID NO: 461366 - protein, 9 aa, Influenza virus
WDVINFEST

SEQ ID NO: 461367 - protein, 9 aa, Influenza virus
WDVISFEST

SEQ ID NO: 461368 - protein, 9 aa, Influenza virus
WDWPDGAKI

SEQ ID NO: 461369 - protein, 9 aa, Influenza virus
WEGLIDGWY

SEQ ID NO: 461370 - protein, 9 aa, Influenza virus
WEGLINGWY

SEQ ID NO: 461371 - protein, 9 aa, Influenza virus
WEGLVDGWY

SEQ ID NO: 461372 - protein, 9 aa, Influenza virus
WEGMIDGWY

SEQ ID NO: 461373 - protein, 9 aa, Influenza virus
WEGMMDGWY

SEQ ID NO: 461374 - protein, 9 aa, Influenza virus
WEGMVDGWY

SEQ ID NO: 461375 - protein, 9 aa, Influenza virus
WEGMVNGWY

SEQ ID NO: 461376 - protein, 9 aa, Influenza virus
WEGNILRTQ

SEQ ID NO: 461377 - protein, 9 aa, Influenza virus
WEINGPDSV

SEQ ID NO: 461378 - protein, 9 aa, Influenza virus
WEINGPESV

SEQ ID NO: 461379 - protein, 9 aa, Influenza virus
WEKNCTLID

SEQ ID NO: 461380 - protein, 9 aa, Influenza virus
WEMGLAPSP

SEQ ID NO: 461381 - protein, 9 aa, Influenza virus
WEMGQAPSP

SEQ ID NO: 461382 - protein, 9 aa, Influenza virus
WEQLYTPGG

SEQ ID NO: 461383 - protein, 9 aa, Influenza virus
WEQMYTPGG

SEQ ID NO: 461384 - protein, 9 aa, Influenza virus
WETTGRNCT

SEQ ID NO: 461385 - protein, 9 aa, Influenza virus
WEVNGPESV

SEQ ID NO: 461386 - protein, 9 aa, Influenza virus
WFGYFGIFF

SEQ ID NO: 461387 - protein, 9 aa, Influenza virus
WFRNILSIA

SEQ ID NO: 461388 - protein, 9 aa, Influenza virus
WFRNILSMA

SEQ ID NO: 461389 - protein, 9 aa, Influenza virus
WFRNVLSIA

SEQ ID NO: 461390 - protein, 9 aa, Influenza virus
WFRNVLSVA

SEQ ID NO: 461391 - protein, 9 aa, Influenza virus
WFSFGASCF

SEQ ID NO: 461392 - protein, 9 aa, Influenza virus
WFSFGASCV

SEQ ID NO: 461393 - protein, 9 aa, Influenza virus
WFSFGASSF

SEQ ID NO: 461394 - protein, 9 aa, Influenza virus
WFSHYNQMK

SEQ ID NO: 461395 - protein, 9 aa, Influenza virus
WFSHYNQMT

SEQ ID NO: 461396 - protein, 9 aa, Influenza virus
WFSHYNQVA

SEQ ID NO: 461397 - protein, 9 aa, Influenza virus
WFSHYNQVT

SEQ ID NO: 461398 - protein, 9 aa, Influenza virus
WFSLGASCF

SEQ ID NO: 461399 - protein, 9 aa, Influenza virus
WGDILDGVT

SEQ ID NO: 461400 - protein, 9 aa, Influenza virus
WGDILEGTT

SEQ ID NO: 461401 - protein, 9 aa, Influenza virus
WGDVLDGVT

SEQ ID NO: 461402 - protein, 9 aa, Influenza virus
WGIHHPDSE

SEQ ID NO: 461403 - protein, 9 aa, Influenza virus
WGIHHPDTE

SEQ ID NO: 461404 - protein, 9 aa, Influenza virus
WGIHHPNDD

SEQ ID NO: 461405 - protein, 9 aa, Influenza virus
WGIHHPNDE

SEQ ID NO: 461406 - protein, 9 aa, Influenza virus
WGIHHPPDA

SEQ ID NO: 461407 - protein, 9 aa, Influenza virus
WGIHHPPDE

SEQ ID NO: 461408 - protein, 9 aa, Influenza virus
WGIHHPPDT

SEQ ID NO: 461409 - protein, 9 aa, Influenza virus
WGIHHPPNT

SEQ ID NO: 461410 - protein, 9 aa, Influenza virus
WGIHHPSNT

SEQ ID NO: 461411 - protein, 9 aa, Influenza virus
WGIHHPSSA

SEQ ID NO: 461412 - protein, 9 aa, Influenza virus
WGIHHPSSI

SEQ ID NO: 461413 - protein, 9 aa, Influenza virus
WGIHHPSST

SEQ ID NO: 461414 - protein, 9 aa, Influenza virus
WGILKRGET

SEQ ID NO: 461415 - protein, 9 aa, Influenza virus
WGMELRRCL

SEQ ID NO: 461416 - protein, 9 aa, Influenza virus
WGMEMRRCL

SEQ ID NO: 461417 - protein, 9 aa, Influenza virus
WGMGQAPSP

SEQ ID NO: 461418 - protein, 9 aa, Influenza virus
WGNGCFEFY

SEQ ID NO: 461419 - protein, 9 aa, Influenza virus
WGNVLDGVT

SEQ ID NO: 461420 - protein, 9 aa, Influenza virus
WGVHHPIDE

SEQ ID NO: 461421 - protein, 9 aa, Influenza virus
WGVHHPKDE

SEQ ID NO: 461422 - protein, 9 aa, Influenza virus
WGVHHPNDE

SEQ ID NO: 461423 - protein, 9 aa, Influenza virus
WGVHHPSSD

SEQ ID NO: 461424 - protein, 9 aa, Influenza virus
WGVHHPSTD

SEQ ID NO: 461425 - protein, 9 aa, Influenza virus
WGVHHSSSL

SEQ ID NO: 461426 - protein, 9 aa, Influenza virus
WHASNRPWI

SEQ ID NO: 461427 - protein, 9 aa, Influenza virus
WHASNRPWV

SEQ ID NO: 461428 - protein, 9 aa, Influenza virus
WHDGAEIIY

SEQ ID NO: 461429 - protein, 9 aa, Influenza virus
WHDGAEITY

SEQ ID NO: 461430 - protein, 9 aa, Influenza virus
WHDGAILPF

SEQ ID NO: 461431 - protein, 9 aa, Influenza virus
WHDGAILPL

SEQ ID NO: 461432 - protein, 9 aa, Influenza virus
WHDGAVLPF

SEQ ID NO: 461433 - protein, 9 aa, Influenza virus
WHGSNRPWI

SEQ ID NO: 461434 - protein, 9 aa, Influenza virus
WHGSNRPWL

SEQ ID NO: 461435 - protein, 9 aa, Influenza virus
WHGSNRPWV

SEQ ID NO: 461436 - protein, 9 aa, Influenza virus
WHIFGKDNA

SEQ ID NO: 461437 - protein, 9 aa, Influenza virus
WHIFSKDNA

SEQ ID NO: 461438 - protein, 9 aa, Influenza virus
WHILSKDNA

SEQ ID NO: 461439 - protein, 9 aa, Influenza virus
WHIYGKDNA

SEQ ID NO: 461440 - protein, 9 aa, Influenza virus
WHLMHPGER

SEQ ID NO: 461441 - protein, 9 aa, Influenza virus
WHLMRPGER

SEQ ID NO: 461442 - protein, 9 aa, Influenza virus
WHLMSPGER

SEQ ID NO: 461443 - protein, 9 aa, Influenza virus
WHSNLNDAT

SEQ ID NO: 461444 - protein, 9 aa, Influenza virus
WHSNLNDTT

SEQ ID NO: 461445 - protein, 9 aa, Influenza virus
WHVRKRFAD

SEQ ID NO: 461446 - protein, 9 aa, Influenza virus
WICMGHHAV

SEQ ID NO: 461447 - protein, 9 aa, Influenza virus
WIDSPNHAK

SEQ ID NO: 461448 - protein, 9 aa, Influenza virus
WIELDEIGE

SEQ ID NO: 461449 - protein, 9 aa, Influenza virus
WIELIRGRP

SEQ ID NO: 461450 - protein, 9 aa, Influenza virus
WIGECPKYV

SEQ ID NO: 461451 - protein, 9 aa, Influenza virus
WIGGCPKYV

SEQ ID NO: 461452 - protein, 9 aa, Influenza virus
WIGKCPKYV

SEQ ID NO: 461453 - protein, 9 aa, Influenza virus
WIGRTKSLE

SEQ ID NO: 461454 - protein, 9 aa, Influenza virus
WIKTRPILS

SEQ ID NO: 461455 - protein, 9 aa, Influenza virus
WILGNPKCD

SEQ ID NO: 461456 - protein, 9 aa, Influenza virus
WILGNPMCD

SEQ ID NO: 461457 - protein, 9 aa, Influenza virus
WILGNPQCD

SEQ ID NO: 461458 - protein, 9 aa, Influenza virus
WILGNPRCD

SEQ ID NO: 461459 - protein, 9 aa, Influenza virus
WILGNPRCG

SEQ ID NO: 461460 - protein, 9 aa, Influenza virus
WILWISFAI

SEQ ID NO: 461461 - protein, 9 aa, Influenza virus
WILWISFAM

SEQ ID NO: 461462 - protein, 9 aa, Influenza virus
WILWISFAT

SEQ ID NO: 461463 - protein, 9 aa, Influenza virus
WINSPNHAK

SEQ ID NO: 461464 - protein, 9 aa, Influenza virus
WINSPNHVK

SEQ ID NO: 461465 - protein, 9 aa, Influenza virus
WINSPSQAK

SEQ ID NO: 461466 - protein, 9 aa, Influenza virus
WIPKRNRSI

SEQ ID NO: 461467 - protein, 9 aa, Influenza virus
WIQNEFNKA

SEQ ID NO: 461468 - protein, 9 aa, Influenza virus
WIQSEFNKA

SEQ ID NO: 461469 - protein, 9 aa, Influenza virus
WIRFNSDLD

SEQ ID NO: 461470 - protein, 9 aa, Influenza virus
WIRFNSDPD

SEQ ID NO: 461471 - protein, 9 aa, Influenza virus
WIRFNSNLD

SEQ ID NO: 461472 - protein, 9 aa, Influenza virus
WIRINNETI

SEQ ID NO: 461473 - protein, 9 aa, Influenza virus
WISFAISCF

SEQ ID NO: 461474 - protein, 9 aa, Influenza virus
WISFAMSCF

SEQ ID NO: 461475 - protein, 9 aa, Influenza virus
WISFATSCF

SEQ ID NO: 461476 - protein, 9 aa, Influenza virus
WISFSISCF

SEQ ID NO: 461477 - protein, 9 aa, Influenza virus
WISFSMSCF

SEQ ID NO: 461478 - protein, 9 aa, Influenza virus
WITIGISGP

SEQ ID NO: 461479 - protein, 9 aa, Influenza virus
WITREPYVS

SEQ ID NO: 461480 - protein, 9 aa, Influenza virus
WIVGNPSCA

SEQ ID NO: 461481 - protein, 9 aa, Influenza virus
WKGANRPII

SEQ ID NO: 461482 - protein, 9 aa, Influenza virus
WKGANRPVI

SEQ ID NO: 461483 - protein, 9 aa, Influenza virus
WKGGSIKTK

SEQ ID NO: 461484 - protein, 9 aa, Influenza virus
WKGGSINTK

SEQ ID NO: 461485 - protein, 9 aa, Influenza virus
WKGNIMRTQ

SEQ ID NO: 461486 - protein, 9 aa, Influenza virus
WKGSNRPII

SEQ ID NO: 461487 - protein, 9 aa, Influenza virus
WKGSNRPIV

SEQ ID NO: 461488 - protein, 9 aa, Influenza virus
WKGSNRPVI

SEQ ID NO: 461489 - protein, 9 aa, Influenza virus
WKGSNRPVV

SEQ ID NO: 461490 - protein, 9 aa, Influenza virus
WKGSNRPWI

SEQ ID NO: 461491 - protein, 9 aa, Influenza virus
WKGSNRPWM

SEQ ID NO: 461492 - protein, 9 aa, Influenza virus
WKGSNRPWV

SEQ ID NO: 461493 - protein, 9 aa, Influenza virus
WKHVTNTIL

SEQ ID NO: 461494 - protein, 9 aa, Influenza virus
WKKQILRTQ

SEQ ID NO: 461495 - protein, 9 aa, Influenza virus
WLELDEIGE

SEQ ID NO: 461496 - protein, 9 aa, Influenza virus
WLEMIRGKP

SEQ ID NO: 461497 - protein, 9 aa, Influenza virus
WLEMIRGRP

SEQ ID NO: 461498 - protein, 9 aa, Influenza virus
WLENEKTLD

SEQ ID NO: 461499 - protein, 9 aa, Influenza virus
WLGGTISPR

SEQ ID NO: 461500 - protein, 9 aa, Influenza virus
WLGRTFSPR

SEQ ID NO: 461501 - protein, 9 aa, Influenza virus
WLGRTISIA

SEQ ID NO: 461502 - protein, 9 aa, Influenza virus
WLGRTISKD

SEQ ID NO: 461503 - protein, 9 aa, Influenza virus
WLGRTISPK

SEQ ID NO: 461504 - protein, 9 aa, Influenza virus
WLGRTISPR

SEQ ID NO: 461505 - protein, 9 aa, Influenza virus
WLGRTISTA

SEQ ID NO: 461506 - protein, 9 aa, Influenza virus
WLGRTISTR

SEQ ID NO: 461507 - protein, 9 aa, Influenza virus
WLGRTLNTA

SEQ ID NO: 461508 - protein, 9 aa, Influenza virus
WLGRTTSKD

SEQ ID NO: 461509 - protein, 9 aa, Influenza virus
WLGRTTSTA

SEQ ID NO: 461510 - protein, 9 aa, Influenza virus
WLGRTVSIN

SEQ ID NO: 461511 - protein, 9 aa, Influenza virus
WLGRTVSIS

SEQ ID NO: 461512 - protein, 9 aa, Influenza virus
WLGRTVSNS

SEQ ID NO: 461513 - protein, 9 aa, Influenza virus
WLGRTVSTS

SEQ ID NO: 461514 - protein, 9 aa, Influenza virus
WLHICVTGD

SEQ ID NO: 461515 - protein, 9 aa, Influenza virus
WLHVCITGD

SEQ ID NO: 461516 - protein, 9 aa, Influenza virus
WLHVCVTGD

SEQ ID NO: 461517 - protein, 9 aa, Influenza virus
WLIDQSGTY

SEQ ID NO: 461518 - protein, 9 aa, Influenza virus
WLIHQSETY

SEQ ID NO: 461519 - protein, 9 aa, Influenza virus
WLIHQSGTY

SEQ ID NO: 461520 - protein, 9 aa, Influenza virus
WLILNPNDT

SEQ ID NO: 461521 - protein, 9 aa, Influenza virus
WLISKSKEQ

SEQ ID NO: 461522 - protein, 9 aa, Influenza virus
WLIYQSGTY

SEQ ID NO: 461523 - protein, 9 aa, Influenza virus
WLKPQCQIT

SEQ ID NO: 461524 - protein, 9 aa, Influenza virus
WLKTRPILS

SEQ ID NO: 461525 - protein, 9 aa, Influenza virus
WLLGNPECD

SEQ ID NO: 461526 - protein, 9 aa, Influenza virus
WLLGNPKCD

SEQ ID NO: 461527 - protein, 9 aa, Influenza virus
WLLGNPLCD

SEQ ID NO: 461528 - protein, 9 aa, Influenza virus
WLLGNPMCD

SEQ ID NO: 461529 - protein, 9 aa, Influenza virus
WLLLDPNDT

SEQ ID NO: 461530 - protein, 9 aa, Influenza virus
WLLSSKANQ

SEQ ID NO: 461531 - protein, 9 aa, Influenza virus
WLLSSKDNQ

SEQ ID NO: 461532 - protein, 9 aa, Influenza virus
WLMLNPNDT

SEQ ID NO: 461533 - protein, 9 aa, Influenza virus
WLMLNPNGT

SEQ ID NO: 461534 - protein, 9 aa, Influenza virus
WLMLNSNDT

SEQ ID NO: 461535 - protein, 9 aa, Influenza virus
WLSSSGNNQ

SEQ ID NO: 461536 - protein, 9 aa, Influenza virus
WLSSSMNNQ

SEQ ID NO: 461537 - protein, 9 aa, Influenza virus
WLTIGISGP

SEQ ID NO: 461538 - protein, 9 aa, Influenza virus
WLTIGITGP

SEQ ID NO: 461539 - protein, 9 aa, Influenza virus
WLTIGVSGP

SEQ ID NO: 461540 - protein, 9 aa, Influenza virus
WLTKATNGN

SEQ ID NO: 461541 - protein, 9 aa, Influenza virus
WLTKETNGN

SEQ ID NO: 461542 - protein, 9 aa, Influenza virus
WLTKKEPDT

SEQ ID NO: 461543 - protein, 9 aa, Influenza virus
WLTKKKNPE

SEQ ID NO: 461544 - protein, 9 aa, Influenza virus
WLTKKKPDI

SEQ ID NO: 461545 - protein, 9 aa, Influenza virus
WLTKKKPDT

SEQ ID NO: 461546 - protein, 9 aa, Influenza virus
WLTLGITGP

SEQ ID NO: 461547 - protein, 9 aa, Influenza virus
WLTLKLGQF

SEQ ID NO: 461548 - protein, 9 aa, Influenza virus
WLTLKSEQF

SEQ ID NO: 461549 - protein, 9 aa, Influenza virus
WLTLKSGQF

SEQ ID NO: 461550 - protein, 9 aa, Influenza virus
WLVHQSGTY

SEQ ID NO: 461551 - protein, 9 aa, Influenza virus
WLVLREKMP

SEQ ID NO: 461552 - protein, 9 aa, Influenza virus
WLVSKDKGR

SEQ ID NO: 461553 - protein, 9 aa, Influenza virus
WLVSKNKGQ

SEQ ID NO: 461554 - protein, 9 aa, Influenza virus
WLVSKSKGQ

SEQ ID NO: 461555 - protein, 9 aa, Influenza virus
WLVSKTKGQ

SEQ ID NO: 461556 - protein, 9 aa, Influenza virus
WLWLVLREK

SEQ ID NO: 461557 - protein, 9 aa, Influenza virus
WMACHSAAF

SEQ ID NO: 461558 - protein, 9 aa, Influenza virus
WMACNSAAF

SEQ ID NO: 461559 - protein, 9 aa, Influenza virus
WMCFNGSLQ

SEQ ID NO: 461560 - protein, 9 aa, Influenza virus
WMCLNGSMQ

SEQ ID NO: 461561 - protein, 9 aa, Influenza virus
WMCPNGSLQ

SEQ ID NO: 461562 - protein, 9 aa, Influenza virus
WMCSNGALQ

SEQ ID NO: 461563 - protein, 9 aa, Influenza virus
WMCSNGSLQ

SEQ ID NO: 461564 - protein, 9 aa, Influenza virus
WMCSNGSLR

SEQ ID NO: 461565 - protein, 9 aa, Influenza virus
WMCSNGSMP

SEQ ID NO: 461566 - protein, 9 aa, Influenza virus
WMCSNGSMQ

SEQ ID NO: 461567 - protein, 9 aa, Influenza virus
WMCSNGSYN

SEQ ID NO: 461568 - protein, 9 aa, Influenza virus
WMCSNSSMQ

SEQ ID NO: 461569 - protein, 9 aa, Influenza virus
WMDYYWGIL

SEQ ID NO: 461570 - protein, 9 aa, Influenza virus
WMELDEIGE

SEQ ID NO: 461571 - protein, 9 aa, Influenza virus
WMGRTISKD

SEQ ID NO: 461572 - protein, 9 aa, Influenza virus
WMGRTISMD

SEQ ID NO: 461573 - protein, 9 aa, Influenza virus
WMGRTISRD

SEQ ID NO: 461574 - protein, 9 aa, Influenza virus
WMKIIRVGC

SEQ ID NO: 461575 - protein, 9 aa, Influenza virus
WMKIYWHLM

SEQ ID NO: 461576 - protein, 9 aa, Influenza virus
WMKLYWHLM

SEQ ID NO: 461577 - protein, 9 aa, Influenza virus
WMLLDPGDT

SEQ ID NO: 461578 - protein, 9 aa, Influenza virus
WMMAMKYPI

SEQ ID NO: 461579 - protein, 9 aa, Influenza virus
WMMAMRYPI

SEQ ID NO: 461580 - protein, 9 aa, Influenza virus
WMRINNETI

SEQ ID NO: 461581 - protein, 9 aa, Influenza virus
WMRISNETI

SEQ ID NO: 461582 - protein, 9 aa, Influenza virus
WNENQNPRI

SEQ ID NO: 461583 - protein, 9 aa, Influenza virus
WNENQNPRM

SEQ ID NO: 461584 - protein, 9 aa, Influenza virus
WNENQNPRV

SEQ ID NO: 461585 - protein, 9 aa, Influenza virus
WNGECPKYV

SEQ ID NO: 461586 - protein, 9 aa, Influenza virus
WNGMNRPIL

SEQ ID NO: 461587 - protein, 9 aa, Influenza virus
WNGMNRPVL

SEQ ID NO: 461588 - protein, 9 aa, Influenza virus
WNGVKVDGS

SEQ ID NO: 461589 - protein, 9 aa, Influenza virus
WNLALDIVD

SEQ ID NO: 461590 - protein, 9 aa, Influenza virus
WNVSSSGTS

SEQ ID NO: 461591 - protein, 9 aa, Influenza virus
WNVTHTGTS

SEQ ID NO: 461592 - protein, 9 aa, Influenza virus
WNVTRSGTS

SEQ ID NO: 461593 - protein, 9 aa, Influenza virus
WNVTSSGTS

SEQ ID NO: 461594 - protein, 9 aa, Influenza virus
WNVTYTGIS

SEQ ID NO: 461595 - protein, 9 aa, Influenza virus
WNVTYTGTS

SEQ ID NO: 461596 - protein, 9 aa, Influenza virus
WNWPDGAEI

SEQ ID NO: 461597 - protein, 9 aa, Influenza virus
WNWPDGAKI

SEQ ID NO: 461598 - protein, 9 aa, Influenza virus
WPDDAELPF

SEQ ID NO: 461599 - protein, 9 aa, Influenza virus
WPDDAELPL

SEQ ID NO: 461600 - protein, 9 aa, Influenza virus
WPDGADINF

SEQ ID NO: 461601 - protein, 9 aa, Influenza virus
WPDGADLPF

SEQ ID NO: 461602 - protein, 9 aa, Influenza virus
WPDGAEIEY

SEQ ID NO: 461603 - protein, 9 aa, Influenza virus
WPDGAELPF

SEQ ID NO: 461604 - protein, 9 aa, Influenza virus
WPDGAELPS

SEQ ID NO: 461605 - protein, 9 aa, Influenza virus
WPDGAEVPF

SEQ ID NO: 461606 - protein, 9 aa, Influenza virus
WPDGAKIET

SEQ ID NO: 461607 - protein, 9 aa, Influenza virus
WPDGAKIEY

SEQ ID NO: 461608 - protein, 9 aa, Influenza virus
WPDGAKLPF

SEQ ID NO: 461609 - protein, 9 aa, Influenza virus
WPDGALLPF

SEQ ID NO: 461610 - protein, 9 aa, Influenza virus
WPDGALLPL

SEQ ID NO: 461611 - protein, 9 aa, Influenza virus
WPDGANIDF

SEQ ID NO: 461612 - protein, 9 aa, Influenza virus
WPDGANIGF

SEQ ID NO: 461613 - protein, 9 aa, Influenza virus
WPDGANINF

SEQ ID NO: 461614 - protein, 9 aa, Influenza virus
WPDGANINL

SEQ ID NO: 461615 - protein, 9 aa, Influenza virus
WPDGANISF

SEQ ID NO: 461616 - protein, 9 aa, Influenza virus
WPDGANTNF

SEQ ID NO: 461617 - protein, 9 aa, Influenza virus
WPDGSDIGF

SEQ ID NO: 461618 - protein, 9 aa, Influenza virus
WPDGSNIGF

SEQ ID NO: 461619 - protein, 9 aa, Influenza virus
WPDGYNIGF

SEQ ID NO: 461620 - protein, 9 aa, Influenza virus
WPDRAELPF

SEQ ID NO: 461621 - protein, 9 aa, Influenza virus
WPGLINGWY

SEQ ID NO: 461622 - protein, 9 aa, Influenza virus
WPGLVAGWY

SEQ ID NO: 461623 - protein, 9 aa, Influenza virus
WPIGESPEG

SEQ ID NO: 461624 - protein, 9 aa, Influenza virus
WPIGESPKG

SEQ ID NO: 461625 - protein, 9 aa, Influenza virus
WPIGESPKR

SEQ ID NO: 461626 - protein, 9 aa, Influenza virus
WPIGESPRG

SEQ ID NO: 461627 - protein, 9 aa, Influenza virus
WPLSSPPTV

SEQ ID NO: 461628 - protein, 9 aa, Influenza virus
WPQSSPPTV

SEQ ID NO: 461629 - protein, 9 aa, Influenza virus
WPVGESPKG

SEQ ID NO: 461630 - protein, 9 aa, Influenza virus
WPWPDGALL

SEQ ID NO: 461631 - protein, 9 aa, Influenza virus
WQGANRPII

SEQ ID NO: 461632 - protein, 9 aa, Influenza virus
WQGANRPVI

SEQ ID NO: 461633 - protein, 9 aa, Influenza virus
WQGLIDGWY

SEQ ID NO: 461634 - protein, 9 aa, Influenza virus
WQGLVDGWY

SEQ ID NO: 461635 - protein, 9 aa, Influenza virus
WQGMIDGWY

SEQ ID NO: 461636 - protein, 9 aa, Influenza virus
WQGMVDGWY

SEQ ID NO: 461637 - protein, 9 aa, Influenza virus
WQGSNRPVI

SEQ ID NO: 461638 - protein, 9 aa, Influenza virus
WREQLSQKF

SEQ ID NO: 461639 - protein, 9 aa, Influenza virus
WRGANRPVI

SEQ ID NO: 461640 - protein, 9 aa, Influenza virus
WRGDNGRRT

SEQ ID NO: 461641 - protein, 9 aa, Influenza virus
WRGENGRKT

SEQ ID NO: 461642 - protein, 9 aa, Influenza virus
WRGENGRRT

SEQ ID NO: 461643 - protein, 9 aa, Influenza virus
WRGGSINTK

SEQ ID NO: 461644 - protein, 9 aa, Influenza virus
WRGGSINTR

SEQ ID NO: 461645 - protein, 9 aa, Influenza virus
WRGSNRPIV

SEQ ID NO: 461646 - protein, 9 aa, Influenza virus
WRGSNRPWI

SEQ ID NO: 461647 - protein, 9 aa, Influenza virus
WRGSNRPWV

SEQ ID NO: 461648 - protein, 9 aa, Influenza virus
WRKDILRTQ

SEQ ID NO: 461649 - protein, 9 aa, Influenza virus
WRKKILRTQ

SEQ ID NO: 461650 - protein, 9 aa, Influenza virus
WRKQILRTQ

SEQ ID NO: 461651 - protein, 9 aa, Influenza virus
WRQANNGDD

SEQ ID NO: 461652 - protein, 9 aa, Influenza virus
WRQANNGED

SEQ ID NO: 461653 - protein, 9 aa, Influenza virus
WRQANNGEE

SEQ ID NO: 461654 - protein, 9 aa, Influenza virus
WRRDILRTQ

SEQ ID NO: 461655 - protein, 9 aa, Influenza virus
WRRQILRTQ

SEQ ID NO: 461656 - protein, 9 aa, Influenza virus
WSASACHDG

SEQ ID NO: 461657 - protein, 9 aa, Influenza virus
WSATACHDG

SEQ ID NO: 461658 - protein, 9 aa, Influenza virus
WSATACSDG

SEQ ID NO: 461659 - protein, 9 aa, Influenza virus
WSFALAQGA

SEQ ID NO: 461660 - protein, 9 aa, Influenza virus
WSFALAQGT

SEQ ID NO: 461661 - protein, 9 aa, Influenza virus
WSFALAQGV

SEQ ID NO: 461662 - protein, 9 aa, Influenza virus
WSFALSQGA

SEQ ID NO: 461663 - protein, 9 aa, Influenza virus
WSGLIAGWY

SEQ ID NO: 461664 - protein, 9 aa, Influenza virus
WSGLVAGWY

SEQ ID NO: 461665 - protein, 9 aa, Influenza virus
WSGMIDGWY

SEQ ID NO: 461666 - protein, 9 aa, Influenza virus
WSGYSGAFI

SEQ ID NO: 461667 - protein, 9 aa, Influenza virus
WSGYSGAFM

SEQ ID NO: 461668 - protein, 9 aa, Influenza virus
WSGYSGAFT

SEQ ID NO: 461669 - protein, 9 aa, Influenza virus
WSGYSGAFV

SEQ ID NO: 461670 - protein, 9 aa, Influenza virus
WSGYSGIFS

SEQ ID NO: 461671 - protein, 9 aa, Influenza virus
WSGYSGSFI

SEQ ID NO: 461672 - protein, 9 aa, Influenza virus
WSGYSGSFM

SEQ ID NO: 461673 - protein, 9 aa, Influenza virus
WSGYSGSFS

SEQ ID NO: 461674 - protein, 9 aa, Influenza virus
WSGYSGSFT

SEQ ID NO: 461675 - protein, 9 aa, Influenza virus
WSGYSGSFV

SEQ ID NO: 461676 - protein, 9 aa, Influenza virus
WSGYSGVFS

SEQ ID NO: 461677 - protein, 9 aa, Influenza virus
WSHNILRTQ

SEQ ID NO: 461678 - protein, 9 aa, Influenza virus
WSILKPGET

SEQ ID NO: 461679 - protein, 9 aa, Influenza virus
WSKNILRTQ

SEQ ID NO: 461680 - protein, 9 aa, Influenza virus
WSKPQCHIT

SEQ ID NO: 461681 - protein, 9 aa, Influenza virus
WSKPQCKIT

SEQ ID NO: 461682 - protein, 9 aa, Influenza virus
WSKPQCLIT

SEQ ID NO: 461683 - protein, 9 aa, Influenza virus
WSKPQCQIA

SEQ ID NO: 461684 - protein, 9 aa, Influenza virus
WSKPQCQII

SEQ ID NO: 461685 - protein, 9 aa, Influenza virus
WSKPQCQIR

SEQ ID NO: 461686 - protein, 9 aa, Influenza virus
WSKPQCQIS

SEQ ID NO: 461687 - protein, 9 aa, Influenza virus
WSKPQCQIT

SEQ ID NO: 461688 - protein, 9 aa, Influenza virus
WSKPQCRIT

SEQ ID NO: 461689 - protein, 9 aa, Influenza virus
WSKRYELEI

SEQ ID NO: 461690 - protein, 9 aa, Influenza virus
WSKTQCQIT

SEQ ID NO: 461691 - protein, 9 aa, Influenza virus
WSLQCRICI

SEQ ID NO: 461692 - protein, 9 aa, Influenza virus
WSMLKPGET

SEQ ID NO: 461693 - protein, 9 aa, Influenza virus
WSQNILRTQ

SEQ ID NO: 461694 - protein, 9 aa, Influenza virus
WSRRYELEI

SEQ ID NO: 461695 - protein, 9 aa, Influenza virus
WSSASCHDG

SEQ ID NO: 461696 - protein, 9 aa, Influenza virus
WSSSSCFDG

SEQ ID NO: 461697 - protein, 9 aa, Influenza virus
WSSSSCHDG

SEQ ID NO: 461698 - protein, 9 aa, Influenza virus
WSSSSCYDG

SEQ ID NO: 461699 - protein, 9 aa, Influenza virus
WSSTSCFDG

SEQ ID NO: 461700 - protein, 9 aa, Influenza virus
WSSTSCHDG

SEQ ID NO: 461701 - protein, 9 aa, Influenza virus
WSSTTCHDG

SEQ ID NO: 461702 - protein, 9 aa, Influenza virus
WSVLKPGET

SEQ ID NO: 461703 - protein, 9 aa, Influenza virus
WSVLQPGET

SEQ ID NO: 461704 - protein, 9 aa, Influenza virus
WSVLRPGET

SEQ ID NO: 461705 - protein, 9 aa, Influenza virus
WSWDDGAIL

SEQ ID NO: 461706 - protein, 9 aa, Influenza virus
WSWHDGAEI

SEQ ID NO: 461707 - protein, 9 aa, Influenza virus
WSWHDGAIL

SEQ ID NO: 461708 - protein, 9 aa, Influenza virus
WSWHDGAVL

SEQ ID NO: 461709 - protein, 9 aa, Influenza virus
WSWPDDAEL

SEQ ID NO: 461710 - protein, 9 aa, Influenza virus
WSWPDGADL

SEQ ID NO: 461711 - protein, 9 aa, Influenza virus
WSWPDGAEL

SEQ ID NO: 461712 - protein, 9 aa, Influenza virus
WSWPDGAEV

SEQ ID NO: 461713 - protein, 9 aa, Influenza virus
WSWPDGAKL

SEQ ID NO: 461714 - protein, 9 aa, Influenza virus
WSWPDGALL

SEQ ID NO: 461715 - protein, 9 aa, Influenza virus
WSYIIEKEN

SEQ ID NO: 461716 - protein, 9 aa, Influenza virus
WSYIMEKEN

SEQ ID NO: 461717 - protein, 9 aa, Influenza virus
WSYIVEKAN

SEQ ID NO: 461718 - protein, 9 aa, Influenza virus
WSYIVEKDK

SEQ ID NO: 461719 - protein, 9 aa, Influenza virus
WSYIVEKDN

SEQ ID NO: 461720 - protein, 9 aa, Influenza virus
WSYIVEKDS

SEQ ID NO: 461721 - protein, 9 aa, Influenza virus
WSYIVEKEN

SEQ ID NO: 461722 - protein, 9 aa, Influenza virus
WSYIVEKNN

SEQ ID NO: 461723 - protein, 9 aa, Influenza virus
WSYIVEKPN

SEQ ID NO: 461724 - protein, 9 aa, Influenza virus
WSYIVEKSN

SEQ ID NO: 461725 - protein, 9 aa, Influenza virus
WSYIVEKTN

SEQ ID NO: 461726 - protein, 9 aa, Influenza virus
WSYIVEREN

SEQ ID NO: 461727 - protein, 9 aa, Influenza virus
WSYIVERET

SEQ ID NO: 461728 - protein, 9 aa, Influenza virus
WSYIVERPK

SEQ ID NO: 461729 - protein, 9 aa, Influenza virus
WSYIVERPL

SEQ ID NO: 461730 - protein, 9 aa, Influenza virus
WSYIVERPN

SEQ ID NO: 461731 - protein, 9 aa, Influenza virus
WSYIVERPS

SEQ ID NO: 461732 - protein, 9 aa, Influenza virus
WSYIVERPT

SEQ ID NO: 461733 - protein, 9 aa, Influenza virus
WSYIVERSS

SEQ ID NO: 461734 - protein, 9 aa, Influenza virus
WSYIVERTK

SEQ ID NO: 461735 - protein, 9 aa, Influenza virus
WSYLIEDPA

SEQ ID NO: 461736 - protein, 9 aa, Influenza virus
WSYLIEDPG

SEQ ID NO: 461737 - protein, 9 aa, Influenza virus
WSYLIEDPN

SEQ ID NO: 461738 - protein, 9 aa, Influenza virus
WSYLIEDPS

SEQ ID NO: 461739 - protein, 9 aa, Influenza virus
WSYLIEDPT

SEQ ID NO: 461740 - protein, 9 aa, Influenza virus
WSYNADLLV

SEQ ID NO: 461741 - protein, 9 aa, Influenza virus
WSYNADVLV

SEQ ID NO: 461742 - protein, 9 aa, Influenza virus
WSYNAEFLV

SEQ ID NO: 461743 - protein, 9 aa, Influenza virus
WSYNAELLI

SEQ ID NO: 461744 - protein, 9 aa, Influenza virus
WSYNAELLV

SEQ ID NO: 461745 - protein, 9 aa, Influenza virus
WSYNAGLLV

SEQ ID NO: 461746 - protein, 9 aa, Influenza virus
WSYNAKLLV

SEQ ID NO: 461747 - protein, 9 aa, Influenza virus
WSYNAQLLV

SEQ ID NO: 461748 - protein, 9 aa, Influenza virus
WSYNARLLV

SEQ ID NO: 461749 - protein, 9 aa, Influenza virus
WTANSIIVF

SEQ ID NO: 461750 - protein, 9 aa, Influenza virus
WTCNSGNCR

SEQ ID NO: 461751 - protein, 9 aa, Influenza virus
WTCSNGSCR

SEQ ID NO: 461752 - protein, 9 aa, Influenza virus
WTGLIDGWY

SEQ ID NO: 461753 - protein, 9 aa, Influenza virus
WTGMIDGWY

SEQ ID NO: 461754 - protein, 9 aa, Influenza virus
WTGMVDGWY

SEQ ID NO: 461755 - protein, 9 aa, Influenza virus
WTGMVNGWY

SEQ ID NO: 461756 - protein, 9 aa, Influenza virus
WTGTNRPIL

SEQ ID NO: 461757 - protein, 9 aa, Influenza virus
WTGTNRPVL

SEQ ID NO: 461758 - protein, 9 aa, Influenza virus
WTIANSKSQ

SEQ ID NO: 461759 - protein, 9 aa, Influenza virus
WTKDSITDI

SEQ ID NO: 461760 - protein, 9 aa, Influenza virus
WTLGENMAP

SEQ ID NO: 461761 - protein, 9 aa, Influenza virus
WTLNRNQPA

SEQ ID NO: 461762 - protein, 9 aa, Influenza virus
WTLVNPGDS

SEQ ID NO: 461763 - protein, 9 aa, Influenza virus
WTPKRNRSI

SEQ ID NO: 461764 - protein, 9 aa, Influenza virus
WTQDAMTEV

SEQ ID NO: 461765 - protein, 9 aa, Influenza virus
WTRDAMTEI

SEQ ID NO: 461766 - protein, 9 aa, Influenza virus
WTRDAMTEV

SEQ ID NO: 461767 - protein, 9 aa, Influenza virus
WTRDSITEV

SEQ ID NO: 461768 - protein, 9 aa, Influenza virus
WTRDSLTEI

SEQ ID NO: 461769 - protein, 9 aa, Influenza virus
WTRDSMTEI

SEQ ID NO: 461770 - protein, 9 aa, Influenza virus
WTRDSMTEV

SEQ ID NO: 461771 - protein, 9 aa, Influenza virus
WTRDSVTEL

SEQ ID NO: 461772 - protein, 9 aa, Influenza virus
WTSGSIISF

SEQ ID NO: 461773 - protein, 9 aa, Influenza virus
WTSGSSIAF

SEQ ID NO: 461774 - protein, 9 aa, Influenza virus
WTSGSSISF

SEQ ID NO: 461775 - protein, 9 aa, Influenza virus
WTSNSIAVF

SEQ ID NO: 461776 - protein, 9 aa, Influenza virus
WTSNSIIAF

SEQ ID NO: 461777 - protein, 9 aa, Influenza virus
WTSNSIISM

SEQ ID NO: 461778 - protein, 9 aa, Influenza virus
WTSNSIIVF

SEQ ID NO: 461779 - protein, 9 aa, Influenza virus
WTSNSIVAF

SEQ ID NO: 461780 - protein, 9 aa, Influenza virus
WTSNSIVAL

SEQ ID NO: 461781 - protein, 9 aa, Influenza virus
WTSNSIVSM

SEQ ID NO: 461782 - protein, 9 aa, Influenza virus
WTSNSIVTF

SEQ ID NO: 461783 - protein, 9 aa, Influenza virus
WTSNSIVVF

SEQ ID NO: 461784 - protein, 9 aa, Influenza virus
WTSNSLIAL

SEQ ID NO: 461785 - protein, 9 aa, Influenza virus
WTSNSLVAL

SEQ ID NO: 461786 - protein, 9 aa, Influenza virus
WTSNSMVTF

SEQ ID NO: 461787 - protein, 9 aa, Influenza virus
WTSNSVVVF

SEQ ID NO: 461788 - protein, 9 aa, Influenza virus
WTSSSSIVM

SEQ ID NO: 461789 - protein, 9 aa, Influenza virus
WTSSSSTVF

SEQ ID NO: 461790 - protein, 9 aa, Influenza virus
WTSSSSVVM

SEQ ID NO: 461791 - protein, 9 aa, Influenza virus
WTTANSKSK

SEQ ID NO: 461792 - protein, 9 aa, Influenza virus
WTTANSKSQ

SEQ ID NO: 461793 - protein, 9 aa, Influenza virus
WTTNSIVVF

SEQ ID NO: 461794 - protein, 9 aa, Influenza virus
WTYNAELFV

SEQ ID NO: 461795 - protein, 9 aa, Influenza virus
WTYNAELLI

SEQ ID NO: 461796 - protein, 9 aa, Influenza virus
WTYNAELLV

SEQ ID NO: 461797 - protein, 9 aa, Influenza virus
WTYNAEVLV

SEQ ID NO: 461798 - protein, 9 aa, Influenza virus
WTYNTELLV

SEQ ID NO: 461799 - protein, 9 aa, Influenza virus
WTYNVELLV

SEQ ID NO: 461800 - protein, 9 aa, Influenza virus
WTYQAELLI

SEQ ID NO: 461801 - protein, 9 aa, Influenza virus
WTYQAELLV

SEQ ID NO: 461802 - protein, 9 aa, Influenza virus
WTYQEELLV

SEQ ID NO: 461803 - protein, 9 aa, Influenza virus
WVAVAKDNA

SEQ ID NO: 461804 - protein, 9 aa, Influenza virus
WVCSNGSCR

SEQ ID NO: 461805 - protein, 9 aa, Influenza virus
WVDDAVTDI

SEQ ID NO: 461806 - protein, 9 aa, Influenza virus
WVELDEIGE

SEQ ID NO: 461807 - protein, 9 aa, Influenza virus
WVELIRGQP

SEQ ID NO: 461808 - protein, 9 aa, Influenza virus
WVELIRGRP

SEQ ID NO: 461809 - protein, 9 aa, Influenza virus
WVELVRGLP

SEQ ID NO: 461810 - protein, 9 aa, Influenza virus
WVELVRGRP

SEQ ID NO: 461811 - protein, 9 aa, Influenza virus
WVEMIRGEP

SEQ ID NO: 461812 - protein, 9 aa, Influenza virus
WVEMIRGKP

SEQ ID NO: 461813 - protein, 9 aa, Influenza virus
WVEMIRGQP

SEQ ID NO: 461814 - protein, 9 aa, Influenza virus
WVEMIRGRP

SEQ ID NO: 461815 - protein, 9 aa, Influenza virus
WVGECPKYV

SEQ ID NO: 461816 - protein, 9 aa, Influenza virus
WVLGENMAP

SEQ ID NO: 461817 - protein, 9 aa, Influenza virus
WVLLNASWF

SEQ ID NO: 461818 - protein, 9 aa, Influenza virus
WVLWISFAI

SEQ ID NO: 461819 - protein, 9 aa, Influenza virus
WVMTDGPAN

SEQ ID NO: 461820 - protein, 9 aa, Influenza virus
WVMTDGPAS

SEQ ID NO: 461821 - protein, 9 aa, Influenza virus
WVPILNTSQ

SEQ ID NO: 461822 - protein, 9 aa, Influenza virus
WVPKRNRSI

SEQ ID NO: 461823 - protein, 9 aa, Influenza virus
WVQNEFNKA

SEQ ID NO: 461824 - protein, 9 aa, Influenza virus
WVQSEFNKA

SEQ ID NO: 461825 - protein, 9 aa, Influenza virus
WVRFNSDLD

SEQ ID NO: 461826 - protein, 9 aa, Influenza virus
WVRINNETI

SEQ ID NO: 461827 - protein, 9 aa, Influenza virus
WVRMNNETI

SEQ ID NO: 461828 - protein, 9 aa, Influenza virus
WVSFSISCF

SEQ ID NO: 461829 - protein, 9 aa, Influenza virus
WVSTDKDSN

SEQ ID NO: 461830 - protein, 9 aa, Influenza virus
WVSTDKNSN

SEQ ID NO: 461831 - protein, 9 aa, Influenza virus
WVSTDKSSN

SEQ ID NO: 461832 - protein, 9 aa, Influenza virus
WVTRELYVS

SEQ ID NO: 461833 - protein, 9 aa, Influenza virus
WVTREPYVS

SEQ ID NO: 461834 - protein, 9 aa, Influenza virus
WVVIAKDNA

SEQ ID NO: 461835 - protein, 9 aa, Influenza virus
WVVIAQDNA

SEQ ID NO: 461836 - protein, 9 aa, Influenza virus
WVVIEKDNA

SEQ ID NO: 461837 - protein, 9 aa, Influenza virus
WVVVAKDNA

SEQ ID NO: 461838 - protein, 9 aa, Influenza virus
WVWLWLVLR

SEQ ID NO: 461839 - protein, 9 aa, Influenza virus
WWASNSLIA

SEQ ID NO: 461840 - protein, 9 aa, Influenza virus
WWDGLQSSD

SEQ ID NO: 461841 - protein, 9 aa, Influenza virus
WWTSNSIAV

SEQ ID NO: 461842 - protein, 9 aa, Influenza virus
WWTSNSIIS

SEQ ID NO: 461843 - protein, 9 aa, Influenza virus
WWTSNSIIV

SEQ ID NO: 461844 - protein, 9 aa, Influenza virus
WWTSNSIVA

SEQ ID NO: 461845 - protein, 9 aa, Influenza virus
WWTSNSIVS

SEQ ID NO: 461846 - protein, 9 aa, Influenza virus
WWTSNSIVV

SEQ ID NO: 461847 - protein, 9 aa, Influenza virus
WWTSNSLIA

SEQ ID NO: 461848 - protein, 9 aa, Influenza virus
WWTSNSLVA

SEQ ID NO: 461849 - protein, 9 aa, Influenza virus
WWTSNSVVV

SEQ ID NO: 461850 - protein, 9 aa, Influenza virus
WWVWLWLVL

SEQ ID NO: 461851 - protein, 9 aa, Influenza virus
WYGFHHSNA

SEQ ID NO: 461852 - protein, 9 aa, Influenza virus
WYGFHHSNE

SEQ ID NO: 461853 - protein, 9 aa, Influenza virus
WYGFHHSNS

SEQ ID NO: 461854 - protein, 9 aa, Influenza virus
WYGFKHQNA

SEQ ID NO: 461855 - protein, 9 aa, Influenza virus
WYGFQHQNA

SEQ ID NO: 461856 - protein, 9 aa, Influenza virus
WYGFQHQNE

SEQ ID NO: 461857 - protein, 9 aa, Influenza virus
WYGFQHQNS

SEQ ID NO: 461858 - protein, 9 aa, Influenza virus
WYGFQHRND

SEQ ID NO: 461859 - protein, 9 aa, Influenza virus
WYGFQHRNE

SEQ ID NO: 461860 - protein, 9 aa, Influenza virus
WYGFQHSNA

SEQ ID NO: 461861 - protein, 9 aa, Influenza virus
WYGFQHSND

SEQ ID NO: 461862 - protein, 9 aa, Influenza virus
WYGFQHSNE

SEQ ID NO: 461863 - protein, 9 aa, Influenza virus
WYGFQHTND

SEQ ID NO: 461864 - protein, 9 aa, Influenza virus
WYGFRHHNS

SEQ ID NO: 461865 - protein, 9 aa, Influenza virus
WYGFRHLNS

SEQ ID NO: 461866 - protein, 9 aa, Influenza virus
WYGFRHQKA

SEQ ID NO: 461867 - protein, 9 aa, Influenza virus
WYGFRHQNA

SEQ ID NO: 461868 - protein, 9 aa, Influenza virus
WYGFRHQNS

SEQ ID NO: 461869 - protein, 9 aa, Influenza virus
WYGFRHQNT

SEQ ID NO: 461870 - protein, 9 aa, Influenza virus
WYGFRYQNS

SEQ ID NO: 461871 - protein, 9 aa, Influenza virus
WYGYHHENS

SEQ ID NO: 461872 - protein, 9 aa, Influenza virus
WYGYHHNNE

SEQ ID NO: 461873 - protein, 9 aa, Influenza virus
WYGYHHQNE

SEQ ID NO: 461874 - protein, 9 aa, Influenza virus
WYGYHHQNG

SEQ ID NO: 461875 - protein, 9 aa, Influenza virus
WYGYHHSKE

SEQ ID NO: 461876 - protein, 9 aa, Influenza virus
WYGYHHSND

SEQ ID NO: 461877 - protein, 9 aa, Influenza virus
WYGYHHSNE

SEQ ID NO: 461878 - protein, 9 aa, Influenza virus
WYGYHHSNG

SEQ ID NO: 461879 - protein, 9 aa, Influenza virus
WYGYKHQNA

SEQ ID NO: 461880 - protein, 9 aa, Influenza virus
WYGYRHQNA

SEQ ID NO: 461881 - protein, 9 aa, Influenza virus
YAADKASTQ

SEQ ID NO: 461882 - protein, 9 aa, Influenza virus
YAADKESTQ

SEQ ID NO: 461883 - protein, 9 aa, Influenza virus
YAADKKSTQ

SEQ ID NO: 461884 - protein, 9 aa, Influenza virus
YAADLKSTQ

SEQ ID NO: 461885 - protein, 9 aa, Influenza virus
YAADQESTQ

SEQ ID NO: 461886 - protein, 9 aa, Influenza virus
YAADQKSTQ

SEQ ID NO: 461887 - protein, 9 aa, Influenza virus
YAADRESTQ

SEQ ID NO: 461888 - protein, 9 aa, Influenza virus
YAADRKSTQ

SEQ ID NO: 461889 - protein, 9 aa, Influenza virus
YAEESKLKR

SEQ ID NO: 461890 - protein, 9 aa, Influenza virus
YAELKWLIS

SEQ ID NO: 461891 - protein, 9 aa, Influenza virus
YAELKWLVS

SEQ ID NO: 461892 - protein, 9 aa, Influenza virus
YAEMEWLLS

SEQ ID NO: 461893 - protein, 9 aa, Influenza virus
YAEMKWLLS

SEQ ID NO: 461894 - protein, 9 aa, Influenza virus
YAFGICPKY

SEQ ID NO: 461895 - protein, 9 aa, Influenza virus
YAFGNCPKY

SEQ ID NO: 461896 - protein, 9 aa, Influenza virus
YAFGNCPMY

SEQ ID NO: 461897 - protein, 9 aa, Influenza virus
YAFGNCSKY

SEQ ID NO: 461898 - protein, 9 aa, Influenza virus
YAFGTCPKY

SEQ ID NO: 461899 - protein, 9 aa, Influenza virus
YAGAINSSK

SEQ ID NO: 461900 - protein, 9 aa, Influenza virus
YAGAINSSR

SEQ ID NO: 461901 - protein, 9 aa, Influenza virus
YAGAVNSSK

SEQ ID NO: 461902 - protein, 9 aa, Influenza virus
YAKKASLRL

SEQ ID NO: 461903 - protein, 9 aa, Influenza virus
YALHQGTTI

SEQ ID NO: 461904 - protein, 9 aa, Influenza virus
YALSQGTTI

SEQ ID NO: 461905 - protein, 9 aa, Influenza virus
YAQTDCVLE

SEQ ID NO: 461906 - protein, 9 aa, Influenza virus
YARLYIWGV

SEQ ID NO: 461907 - protein, 9 aa, Influenza virus
YASKNPYTL

SEQ ID NO: 461908 - protein, 9 aa, Influenza virus
YASKTRISE

SEQ ID NO: 461909 - protein, 9 aa, Influenza virus
YASPQLEGF

SEQ ID NO: 461910 - protein, 9 aa, Influenza virus
YASSQLEGF

SEQ ID NO: 461911 - protein, 9 aa, Influenza virus
YATVAGSLS

SEQ ID NO: 461912 - protein, 9 aa, Influenza virus
YAVIHYGGI

SEQ ID NO: 461913 - protein, 9 aa, Influenza virus
YAVIHYGGM

SEQ ID NO: 461914 - protein, 9 aa, Influenza virus
YAVIHYGGV

SEQ ID NO: 461915 - protein, 9 aa, Influenza virus
YCFTVMTDG

SEQ ID NO: 461916 - protein, 9 aa, Influenza virus
YCICRDNWK

SEQ ID NO: 461917 - protein, 9 aa, Influenza virus
YCNTDLGAP

SEQ ID NO: 461918 - protein, 9 aa, Influenza virus
YCNTDLGSP

SEQ ID NO: 461919 - protein, 9 aa, Influenza virus
YCNTDLGTP

SEQ ID NO: 461920 - protein, 9 aa, Influenza virus
YCRATEYIM

SEQ ID NO: 461921 - protein, 9 aa, Influenza virus
YCSLNGISP

SEQ ID NO: 461922 - protein, 9 aa, Influenza virus
YCSLNGVSP

SEQ ID NO: 461923 - protein, 9 aa, Influenza virus
YCVCRDNWK

SEQ ID NO: 461924 - protein, 9 aa, Influenza virus
YCYPGATVN

SEQ ID NO: 461925 - protein, 9 aa, Influenza virus
YCYPGSTVN

SEQ ID NO: 461926 - protein, 9 aa, Influenza virus
YCYPGTTVN

SEQ ID NO: 461927 - protein, 9 aa, Influenza virus
YDAIEECLI

SEQ ID NO: 461928 - protein, 9 aa, Influenza virus
YDAVATTHS

SEQ ID NO: 461929 - protein, 9 aa, Influenza virus
YDFEKEGYS

SEQ ID NO: 461930 - protein, 9 aa, Influenza virus
YDFEREGYS

SEQ ID NO: 461931 - protein, 9 aa, Influenza virus
YDGIITDTI

SEQ ID NO: 461932 - protein, 9 aa, Influenza virus
YDGKAWLHI

SEQ ID NO: 461933 - protein, 9 aa, Influenza virus
YDGKAWLHV

SEQ ID NO: 461934 - protein, 9 aa, Influenza virus
YDGRLIQNS

SEQ ID NO: 461935 - protein, 9 aa, Influenza virus
YDHAQYREE

SEQ ID NO: 461936 - protein, 9 aa, Influenza virus
YDHKDYEEE

SEQ ID NO: 461937 - protein, 9 aa, Influenza virus
YDHKEFEEE

SEQ ID NO: 461938 - protein, 9 aa, Influenza virus
YDHKEFEKE

SEQ ID NO: 461939 - protein, 9 aa, Influenza virus
YDHKEFKEE

SEQ ID NO: 461940 - protein, 9 aa, Influenza virus
YDHKEYEEE

SEQ ID NO: 461941 - protein, 9 aa, Influenza virus
YDHNIYRDE

SEQ ID NO: 461942 - protein, 9 aa, Influenza virus
YDHSHYREE

SEQ ID NO: 461943 - protein, 9 aa, Influenza virus
YDHSQYREE

SEQ ID NO: 461944 - protein, 9 aa, Influenza virus
YDHTQYREE

SEQ ID NO: 461945 - protein, 9 aa, Influenza virus
YDKICIGYQ

SEQ ID NO: 461946 - protein, 9 aa, Influenza virus
YDKVRLQLK

SEQ ID NO: 461947 - protein, 9 aa, Influenza virus
YDKVRLQLR

SEQ ID NO: 461948 - protein, 9 aa, Influenza virus
YDKVRMQLK

SEQ ID NO: 461949 - protein, 9 aa, Influenza virus
YDKVRMQLR

SEQ ID NO: 461950 - protein, 9 aa, Influenza virus
YDNGVWIGR

SEQ ID NO: 461951 - protein, 9 aa, Influenza virus
YDRICIGYQ

SEQ ID NO: 461952 - protein, 9 aa, Influenza virus
YDRRLTTTI

SEQ ID NO: 461953 - protein, 9 aa, Influenza virus
YDRRLTTTV

SEQ ID NO: 461954 - protein, 9 aa, Influenza virus
YDRVRKQLR

SEQ ID NO: 461955 - protein, 9 aa, Influenza virus
YDRVRLQLR

SEQ ID NO: 461956 - protein, 9 aa, Influenza virus
YDRVRMQLR

SEQ ID NO: 461957 - protein, 9 aa, Influenza virus
YDSIRGEFN

SEQ ID NO: 461958 - protein, 9 aa, Influenza virus
YDSIRGEFS

SEQ ID NO: 461959 - protein, 9 aa, Influenza virus
YDVGYLCAG

SEQ ID NO: 461960 - protein, 9 aa, Influenza virus
YDWTLNRNQ

SEQ ID NO: 461961 - protein, 9 aa, Influenza virus
YDYPKYEEE

SEQ ID NO: 461962 - protein, 9 aa, Influenza virus
YDYPKYEKE

SEQ ID NO: 461963 - protein, 9 aa, Influenza virus
YDYPKYSEE

SEQ ID NO: 461964 - protein, 9 aa, Influenza virus
YDYPKYSKE

SEQ ID NO: 461965 - protein, 9 aa, Influenza virus
YDYSKYEEE

SEQ ID NO: 461966 - protein, 9 aa, Influenza virus
YEAIEECLI

SEQ ID NO: 461967 - protein, 9 aa, Influenza virus
YEDESRIER

SEQ ID NO: 461968 - protein, 9 aa, Influenza virus
YEECSCYPD

SEQ ID NO: 461969 - protein, 9 aa, Influenza virus
YEECSCYPE

SEQ ID NO: 461970 - protein, 9 aa, Influenza virus
YEECSCYPN

SEQ ID NO: 461971 - protein, 9 aa, Influenza virus
YEEEAKLEK

SEQ ID NO: 461972 - protein, 9 aa, Influenza virus
YEEEAKLER

SEQ ID NO: 461973 - protein, 9 aa, Influenza virus
YEEESKIER

SEQ ID NO: 461974 - protein, 9 aa, Influenza virus
YEEESKLER

SEQ ID NO: 461975 - protein, 9 aa, Influenza virus
YEEESKLKR

SEQ ID NO: 461976 - protein, 9 aa, Influenza virus
YEEESKLNK

SEQ ID NO: 461977 - protein, 9 aa, Influenza virus
YEEESKLNR

SEQ ID NO: 461978 - protein, 9 aa, Influenza virus
YEEESRIER

SEQ ID NO: 461979 - protein, 9 aa, Influenza virus
YEEESRLNR

SEQ ID NO: 461980 - protein, 9 aa, Influenza virus
YEELKEQLS

SEQ ID NO: 461981 - protein, 9 aa, Influenza virus
YEELKHLLN

SEQ ID NO: 461982 - protein, 9 aa, Influenza virus
YEELKHLLS

SEQ ID NO: 461983 - protein, 9 aa, Influenza virus
YEELKHLMS

SEQ ID NO: 461984 - protein, 9 aa, Influenza virus
YEELREHLS

SEQ ID NO: 461985 - protein, 9 aa, Influenza virus
YEELREQLN

SEQ ID NO: 461986 - protein, 9 aa, Influenza virus
YEELREQLS

SEQ ID NO: 461987 - protein, 9 aa, Influenza virus
YEELREQMS

SEQ ID NO: 461988 - protein, 9 aa, Influenza virus
YEGRLIQNS

SEQ ID NO: 461989 - protein, 9 aa, Influenza virus
YEILKVPNA

SEQ ID NO: 461990 - protein, 9 aa, Influenza virus
YEKVRLQLR

SEQ ID NO: 461991 - protein, 9 aa, Influenza virus
YEKVRMQLR

SEQ ID NO: 461992 - protein, 9 aa, Influenza virus
YEKVRRQLR

SEQ ID NO: 461993 - protein, 9 aa, Influenza virus
YELEIGARI

SEQ ID NO: 461994 - protein, 9 aa, Influenza virus
YELEIGTRI

SEQ ID NO: 461995 - protein, 9 aa, Influenza virus
YEMLKVPDA

SEQ ID NO: 461996 - protein, 9 aa, Influenza virus
YEMLKVPNA

SEQ ID NO: 461997 - protein, 9 aa, Influenza virus
YENNPGRVT

SEQ ID NO: 461998 - protein, 9 aa, Influenza virus
YENNTWVNQ

SEQ ID NO: 461999 - protein, 9 aa, Influenza virus
YENTTWVNQ

SEQ ID NO: 462000 - protein, 9 aa, Influenza virus
YEQMETDGD

SEQ ID NO: 462001 - protein, 9 aa, Influenza virus
YEQMETDGE

SEQ ID NO: 462002 - protein, 9 aa, Influenza virus
YEQMETGGE

SEQ ID NO: 462003 - protein, 9 aa, Influenza virus
YEQMETSGE

SEQ ID NO: 462004 - protein, 9 aa, Influenza virus
YERMCNILK

SEQ ID NO: 462005 - protein, 9 aa, Influenza virus
YERRLTTTI

SEQ ID NO: 462006 - protein, 9 aa, Influenza virus
YERVKKQLR

SEQ ID NO: 462007 - protein, 9 aa, Influenza virus
YERVKMFDF

SEQ ID NO: 462008 - protein, 9 aa, Influenza virus
YERVKRQLR

SEQ ID NO: 462009 - protein, 9 aa, Influenza virus
YERVRKQLR

SEQ ID NO: 462010 - protein, 9 aa, Influenza virus
YERVRRQLR

SEQ ID NO: 462011 - protein, 9 aa, Influenza virus
YESIEECLI

SEQ ID NO: 462012 - protein, 9 aa, Influenza virus
YESSINPAG

SEQ ID NO: 462013 - protein, 9 aa, Influenza virus
YESTQAAID

SEQ ID NO: 462014 - protein, 9 aa, Influenza virus
YETFKVIGG

SEQ ID NO: 462015 - protein, 9 aa, Influenza virus
YETFRVIDG

SEQ ID NO: 462016 - protein, 9 aa, Influenza virus
YETFRVIGG

SEQ ID NO: 462017 - protein, 9 aa, Influenza virus
YETFRVISG

SEQ ID NO: 462018 - protein, 9 aa, Influenza virus
YEVGYLCAG

SEQ ID NO: 462019 - protein, 9 aa, Influenza virus
YEVLKVPDA

SEQ ID NO: 462020 - protein, 9 aa, Influenza virus
YEVLKVPNA

SEQ ID NO: 462021 - protein, 9 aa, Influenza virus
YFFGDNAEE

SEQ ID NO: 462022 - protein, 9 aa, Influenza virus
YFFGDNAKE

SEQ ID NO: 462023 - protein, 9 aa, Influenza virus
YFFGDSAEE

SEQ ID NO: 462024 - protein, 9 aa, Influenza virus
YFFLKVPVQ

SEQ ID NO: 462025 - protein, 9 aa, Influenza virus
YFHDSNVKN

SEQ ID NO: 462026 - protein, 9 aa, Influenza virus
YFHKGIVIK

SEQ ID NO: 462027 - protein, 9 aa, Influenza virus
YFHKGLIIK

SEQ ID NO: 462028 - protein, 9 aa, Influenza virus
YFHKGLLIK

SEQ ID NO: 462029 - protein, 9 aa, Influenza virus
YFHKGLVIK

SEQ ID NO: 462030 - protein, 9 aa, Influenza virus
YFHKGLVVK

SEQ ID NO: 462031 - protein, 9 aa, Influenza virus
YFLDVFAGD

SEQ ID NO: 462032 - protein, 9 aa, Influenza virus
YFQLFLVCV

SEQ ID NO: 462033 - protein, 9 aa, Influenza virus
YFTAEISHC

SEQ ID NO: 462034 - protein, 9 aa, Influenza virus
YFTAEVSHC

SEQ ID NO: 462035 - protein, 9 aa, Influenza virus
YFTAEVSYC

SEQ ID NO: 462036 - protein, 9 aa, Influenza virus
YFTTEVSHC

SEQ ID NO: 462037 - protein, 9 aa, Influenza virus
YFVKEGKIV

SEQ ID NO: 462038 - protein, 9 aa, Influenza virus
YGAGNKLIT

SEQ ID NO: 462039 - protein, 9 aa, Influenza virus
YGAGSWPDG

SEQ ID NO: 462040 - protein, 9 aa, Influenza virus
YGAIEECLI

SEQ ID NO: 462041 - protein, 9 aa, Influenza virus
YGAQSLSIS

SEQ ID NO: 462042 - protein, 9 aa, Influenza virus
YGASINSAG

SEQ ID NO: 462043 - protein, 9 aa, Influenza virus
YGDGVWIGR

SEQ ID NO: 462044 - protein, 9 aa, Influenza virus
YGFHHSNAE

SEQ ID NO: 462045 - protein, 9 aa, Influenza virus
YGFHHSNSE

SEQ ID NO: 462046 - protein, 9 aa, Influenza virus
YGFIIKGRS

SEQ ID NO: 462047 - protein, 9 aa, Influenza virus
YGFIVKGRS

SEQ ID NO: 462048 - protein, 9 aa, Influenza virus
YGFKHQNAQ

SEQ ID NO: 462049 - protein, 9 aa, Influenza virus
YGFKISKRG

SEQ ID NO: 462050 - protein, 9 aa, Influenza virus
YGFQHQNAE

SEQ ID NO: 462051 - protein, 9 aa, Influenza virus
YGFQHQNEQ

SEQ ID NO: 462052 - protein, 9 aa, Influenza virus
YGFQHQNSE

SEQ ID NO: 462053 - protein, 9 aa, Influenza virus
YGFQHRNDE

SEQ ID NO: 462054 - protein, 9 aa, Influenza virus
YGFQHRNEE

SEQ ID NO: 462055 - protein, 9 aa, Influenza virus
YGFQHSNAQ

SEQ ID NO: 462056 - protein, 9 aa, Influenza virus
YGFQHSNDQ

SEQ ID NO: 462057 - protein, 9 aa, Influenza virus
YGFQHSNEQ

SEQ ID NO: 462058 - protein, 9 aa, Influenza virus
YGFQHTNDQ

SEQ ID NO: 462059 - protein, 9 aa, Influenza virus
YGFRHHNSE

SEQ ID NO: 462060 - protein, 9 aa, Influenza virus
YGFRHLNSE

SEQ ID NO: 462061 - protein, 9 aa, Influenza virus
YGFRHQKAQ

SEQ ID NO: 462062 - protein, 9 aa, Influenza virus
YGFRHQNAE

SEQ ID NO: 462063 - protein, 9 aa, Influenza virus
YGFRHQNAQ

SEQ ID NO: 462064 - protein, 9 aa, Influenza virus
YGFRHQNSE

SEQ ID NO: 462065 - protein, 9 aa, Influenza virus
YGFRHQNSQ

SEQ ID NO: 462066 - protein, 9 aa, Influenza virus
YGFRHQNTQ

SEQ ID NO: 462067 - protein, 9 aa, Influenza virus
YGFRISKRG

SEQ ID NO: 462068 - protein, 9 aa, Influenza virus
YGFRYQNSE

SEQ ID NO: 462069 - protein, 9 aa, Influenza virus
YGFVANFSM

SEQ ID NO: 462070 - protein, 9 aa, Influenza virus
YGGIPTDVI

SEQ ID NO: 462071 - protein, 9 aa, Influenza virus
YGGIPTDVV

SEQ ID NO: 462072 - protein, 9 aa, Influenza virus
YGGLNKSKP

SEQ ID NO: 462073 - protein, 9 aa, Influenza virus
YGGMPTDVV

SEQ ID NO: 462074 - protein, 9 aa, Influenza virus
YGGVPTDVI

SEQ ID NO: 462075 - protein, 9 aa, Influenza virus
YGGVPTDVV

SEQ ID NO: 462076 - protein, 9 aa, Influenza virus
YGHDSKVTC

SEQ ID NO: 462077 - protein, 9 aa, Influenza virus
YGHLITGKS

SEQ ID NO: 462078 - protein, 9 aa, Influenza virus
YGHLTTGKS

SEQ ID NO: 462079 - protein, 9 aa, Influenza virus
YGHLVTGKS

SEQ ID NO: 462080 - protein, 9 aa, Influenza virus
YGHNQKITC

SEQ ID NO: 462081 - protein, 9 aa, Influenza virus
YGHNSKVTC

SEQ ID NO: 462082 - protein, 9 aa, Influenza virus
YGHSQKATC

SEQ ID NO: 462083 - protein, 9 aa, Influenza virus
YGHSQKVTC

SEQ ID NO: 462084 - protein, 9 aa, Influenza virus
YGKDNAIRI

SEQ ID NO: 462085 - protein, 9 aa, Influenza virus
YGKDNAVRI

SEQ ID NO: 462086 - protein, 9 aa, Influenza virus
YGKGRIFQS

SEQ ID NO: 462087 - protein, 9 aa, Influenza virus
YGNCDAKCQ

SEQ ID NO: 462088 - protein, 9 aa, Influenza virus
YGNCDTKCQ

SEQ ID NO: 462089 - protein, 9 aa, Influenza virus
YGNCNAKCQ

SEQ ID NO: 462090 - protein, 9 aa, Influenza virus
YGNCNTKCQ

SEQ ID NO: 462091 - protein, 9 aa, Influenza virus
YGNDVWMGR

SEQ ID NO: 462092 - protein, 9 aa, Influenza virus
YGNGAWIGR

SEQ ID NO: 462093 - protein, 9 aa, Influenza virus
YGNGVWIGR

SEQ ID NO: 462094 - protein, 9 aa, Influenza virus
YGNGVWMGR

SEQ ID NO: 462095 - protein, 9 aa, Influenza virus
YGNPKCDIH

SEQ ID NO: 462096 - protein, 9 aa, Influenza virus
YGNPKCDTH

SEQ ID NO: 462097 - protein, 9 aa, Influenza virus
YGNPKCDVH

SEQ ID NO: 462098 - protein, 9 aa, Influenza virus
YGPALSINE

SEQ ID NO: 462099 - protein, 9 aa, Influenza virus
YGPALSISE

SEQ ID NO: 462100 - protein, 9 aa, Influenza virus
YGPINVTKE

SEQ ID NO: 462101 - protein, 9 aa, Influenza virus
YGRGRIFQS

SEQ ID NO: 462102 - protein, 9 aa, Influenza virus
YGRIIQNED

SEQ ID NO: 462103 - protein, 9 aa, Influenza virus
YGSDVWMGR

SEQ ID NO: 462104 - protein, 9 aa, Influenza virus
YGSENKLIT

SEQ ID NO: 462105 - protein, 9 aa, Influenza virus
YGSGAKLIT

SEQ ID NO: 462106 - protein, 9 aa, Influenza virus
YGSGNKLIT

SEQ ID NO: 462107 - protein, 9 aa, Influenza virus
YGSGNKLVT

SEQ ID NO: 462108 - protein, 9 aa, Influenza virus
YGSGRIFQS

SEQ ID NO: 462109 - protein, 9 aa, Influenza virus
YGSGSKLIT

SEQ ID NO: 462110 - protein, 9 aa, Influenza virus
YGSGSWPDG

SEQ ID NO: 462111 - protein, 9 aa, Influenza virus
YGSSINSAG

SEQ ID NO: 462112 - protein, 9 aa, Influenza virus
YGSSITSAG

SEQ ID NO: 462113 - protein, 9 aa, Influenza virus
YGTGNKLIT

SEQ ID NO: 462114 - protein, 9 aa, Influenza virus
YGTGRIFQS

SEQ ID NO: 462115 - protein, 9 aa, Influenza virus
YGTGSWPDG

SEQ ID NO: 462116 - protein, 9 aa, Influenza virus
YGTGSWPDV

SEQ ID NO: 462117 - protein, 9 aa, Influenza virus
YGTGTWPDG

SEQ ID NO: 462118 - protein, 9 aa, Influenza virus
YGTQPLSIS

SEQ ID NO: 462119 - protein, 9 aa, Influenza virus
YGTQSLSIS

SEQ ID NO: 462120 - protein, 9 aa, Influenza virus
YGVKGFGFR

SEQ ID NO: 462121 - protein, 9 aa, Influenza virus
YGVKGFSFR

SEQ ID NO: 462122 - protein, 9 aa, Influenza virus
YGYHHENSQ

SEQ ID NO: 462123 - protein, 9 aa, Influenza virus
YGYHHQNEQ

SEQ ID NO: 462124 - protein, 9 aa, Influenza virus
YGYHHQNGQ

SEQ ID NO: 462125 - protein, 9 aa, Influenza virus
YGYHHSNDQ

SEQ ID NO: 462126 - protein, 9 aa, Influenza virus
YGYIIEEYG

SEQ ID NO: 462127 - protein, 9 aa, Influenza virus
YGYIIEKYG

SEQ ID NO: 462128 - protein, 9 aa, Influenza virus
YGYKHQNAQ

SEQ ID NO: 462129 - protein, 9 aa, Influenza virus
YGYLITGKS

SEQ ID NO: 462130 - protein, 9 aa, Influenza virus
YGYRHQNAQ

SEQ ID NO: 462131 - protein, 9 aa, Influenza virus
YHANNSKKQ

SEQ ID NO: 462132 - protein, 9 aa, Influenza virus
YHANNSTDT

SEQ ID NO: 462133 - protein, 9 aa, Influenza virus
YHANNSTEH

SEQ ID NO: 462134 - protein, 9 aa, Influenza virus
YHANNSTEK

SEQ ID NO: 462135 - protein, 9 aa, Influenza virus
YHANNSTEQ

SEQ ID NO: 462136 - protein, 9 aa, Influenza virus
YHANNSTER

SEQ ID NO: 462137 - protein, 9 aa, Influenza virus
YHANNSTET

SEQ ID NO: 462138 - protein, 9 aa, Influenza virus
YHANNSTKQ

SEQ ID NO: 462139 - protein, 9 aa, Influenza virus
YHANNSTTK

SEQ ID NO: 462140 - protein, 9 aa, Influenza virus
YHANNSTTQ

SEQ ID NO: 462141 - protein, 9 aa, Influenza virus
YHANNSTVQ

SEQ ID NO: 462142 - protein, 9 aa, Influenza virus
YHDSNVKNL

SEQ ID NO: 462143 - protein, 9 aa, Influenza virus
YHFEECSCY

SEQ ID NO: 462144 - protein, 9 aa, Influenza virus
YHHENSQGS

SEQ ID NO: 462145 - protein, 9 aa, Influenza virus
YHHQNAQGS

SEQ ID NO: 462146 - protein, 9 aa, Influenza virus
YHHQNEQGS

SEQ ID NO: 462147 - protein, 9 aa, Influenza virus
YHHQNGQGS

SEQ ID NO: 462148 - protein, 9 aa, Influenza virus
YHHSNDQGA

SEQ ID NO: 462149 - protein, 9 aa, Influenza virus
YHHSNDQGS

SEQ ID NO: 462150 - protein, 9 aa, Influenza virus
YHKCDDECI

SEQ ID NO: 462151 - protein, 9 aa, Influenza virus
YHKCDDECM

SEQ ID NO: 462152 - protein, 9 aa, Influenza virus
YHKCDNECI

SEQ ID NO: 462153 - protein, 9 aa, Influenza virus
YHKCDNECM

SEQ ID NO: 462154 - protein, 9 aa, Influenza virus
YHKCDNGCI

SEQ ID NO: 462155 - protein, 9 aa, Influenza virus
YHKCDNKCI

SEQ ID NO: 462156 - protein, 9 aa, Influenza virus
YHKCNDECM

SEQ ID NO: 462157 - protein, 9 aa, Influenza virus
YHKCNNECI

SEQ ID NO: 462158 - protein, 9 aa, Influenza virus
YHQIEKEFE

SEQ ID NO: 462159 - protein, 9 aa, Influenza virus
YHQIEKEFG

SEQ ID NO: 462160 - protein, 9 aa, Influenza virus
YHQSFVPSP

SEQ ID NO: 462161 - protein, 9 aa, Influenza virus
YHSNNSTEK

SEQ ID NO: 462162 - protein, 9 aa, Influenza virus
YHSNNSTKK

SEQ ID NO: 462163 - protein, 9 aa, Influenza virus
YHTGRSSFF

SEQ ID NO: 462164 - protein, 9 aa, Influenza virus
YHWNLALDI

SEQ ID NO: 462165 - protein, 9 aa, Influenza virus
YHYEECSCY

SEQ ID NO: 462166 - protein, 9 aa, Influenza virus
YICSGFFGD

SEQ ID NO: 462167 - protein, 9 aa, Influenza virus
YICSGIFGD

SEQ ID NO: 462168 - protein, 9 aa, Influenza virus
YICSGLVGD

SEQ ID NO: 462169 - protein, 9 aa, Influenza virus
YICSGVFGD

SEQ ID NO: 462170 - protein, 9 aa, Influenza virus
YICSKFHSD

SEQ ID NO: 462171 - protein, 9 aa, Influenza virus
YICSPVLTD

SEQ ID NO: 462172 - protein, 9 aa, Influenza virus
YICTGILTD

SEQ ID NO: 462173 - protein, 9 aa, Influenza virus
YICTGVLTD

SEQ ID NO: 462174 - protein, 9 aa, Influenza virus
YICVKNGNM

SEQ ID NO: 462175 - protein, 9 aa, Influenza virus
YIEGKLSQM

SEQ ID NO: 462176 - protein, 9 aa, Influenza virus
YIELIRGKP

SEQ ID NO: 462177 - protein, 9 aa, Influenza virus
YIELIRGRP

SEQ ID NO: 462178 - protein, 9 aa, Influenza virus
YIEVLHLTQ

SEQ ID NO: 462179 - protein, 9 aa, Influenza virus
YIGKCPKYI

SEQ ID NO: 462180 - protein, 9 aa, Influenza virus
YIGKCPRYI

SEQ ID NO: 462181 - protein, 9 aa, Influenza virus
YIIEEYGKG

SEQ ID NO: 462182 - protein, 9 aa, Influenza virus
YIIEEYGRG

SEQ ID NO: 462183 - protein, 9 aa, Influenza virus
YIIEKYGSG

SEQ ID NO: 462184 - protein, 9 aa, Influenza virus
YIIEKYGTG

SEQ ID NO: 462185 - protein, 9 aa, Influenza virus
YIIRALTLN

SEQ ID NO: 462186 - protein, 9 aa, Influenza virus
YIKQGSLKL

SEQ ID NO: 462187 - protein, 9 aa, Influenza virus
YIKQNTLKL

SEQ ID NO: 462188 - protein, 9 aa, Influenza virus
YIKSDQLKL

SEQ ID NO: 462189 - protein, 9 aa, Influenza virus
YIKSGQLKL

SEQ ID NO: 462190 - protein, 9 aa, Influenza virus
YINKTGTFE

SEQ ID NO: 462191 - protein, 9 aa, Influenza virus
YINRTGTFE

SEQ ID NO: 462192 - protein, 9 aa, Influenza virus
YINTALLNA

SEQ ID NO: 462193 - protein, 9 aa, Influenza virus
YINTAMLNA

SEQ ID NO: 462194 - protein, 9 aa, Influenza virus
YIPSGSLKL

SEQ ID NO: 462195 - protein, 9 aa, Influenza virus
YIPSNSLKL

SEQ ID NO: 462196 - protein, 9 aa, Influenza virus
YIPSRSLKL

SEQ ID NO: 462197 - protein, 9 aa, Influenza virus
YIQMCTELK

SEQ ID NO: 462198 - protein, 9 aa, Influenza virus
YIQMCTELQ

SEQ ID NO: 462199 - protein, 9 aa, Influenza virus
YIRTNGTSK

SEQ ID NO: 462200 - protein, 9 aa, Influenza virus
YISIGTSTL

SEQ ID NO: 462201 - protein, 9 aa, Influenza virus
YISSGSLKL

SEQ ID NO: 462202 - protein, 9 aa, Influenza virus
YISVGTSTL

SEQ ID NO: 462203 - protein, 9 aa, Influenza virus
YIVERPKEI

SEQ ID NO: 462204 - protein, 9 aa, Influenza virus
YIVERPKEM

SEQ ID NO: 462205 - protein, 9 aa, Influenza virus
YIVERPSAP

SEQ ID NO: 462206 - protein, 9 aa, Influenza virus
YIVERTKEM

SEQ ID NO: 462207 - protein, 9 aa, Influenza virus
YIVKKGDSA

SEQ ID NO: 462208 - protein, 9 aa, Influenza virus
YIWGVHHPS

SEQ ID NO: 462209 - protein, 9 aa, Influenza virus
YIWTYQAEL

SEQ ID NO: 462210 - protein, 9 aa, Influenza virus
YKALSIYSC

SEQ ID NO: 462211 - protein, 9 aa, Influenza virus
YKDIILWFS

SEQ ID NO: 462212 - protein, 9 aa, Influenza virus
YKDIILWIS

SEQ ID NO: 462213 - protein, 9 aa, Influenza virus
YKDIILWVS

SEQ ID NO: 462214 - protein, 9 aa, Influenza virus
YKDLDNCHP

SEQ ID NO: 462215 - protein, 9 aa, Influenza virus
YKDLGNCHP

SEQ ID NO: 462216 - protein, 9 aa, Influenza virus
YKDLGSCHP

SEQ ID NO: 462217 - protein, 9 aa, Influenza virus
YKDVILWFS

SEQ ID NO: 462218 - protein, 9 aa, Influenza virus
YKDWILWIS

SEQ ID NO: 462219 - protein, 9 aa, Influenza virus
YKDWVLWIS

SEQ ID NO: 462220 - protein, 9 aa, Influenza virus
YKEESQLKR

SEQ ID NO: 462221 - protein, 9 aa, Influenza virus
YKEICIAWS

SEQ ID NO: 462222 - protein, 9 aa, Influenza virus
YKEICVAWS

SEQ ID NO: 462223 - protein, 9 aa, Influenza virus
YKEIILWFS

SEQ ID NO: 462224 - protein, 9 aa, Influenza virus
YKEIRIAWS

SEQ ID NO: 462225 - protein, 9 aa, Influenza virus
YKEVILWFS

SEQ ID NO: 462226 - protein, 9 aa, Influenza virus
YKGIITDTI

SEQ ID NO: 462227 - protein, 9 aa, Influenza virus
YKGRLCNPL

SEQ ID NO: 462228 - protein, 9 aa, Influenza virus
YKHQNAQGE

SEQ ID NO: 462229 - protein, 9 aa, Influenza virus
YKIGYICSG

SEQ ID NO: 462230 - protein, 9 aa, Influenza virus
YKIIKKGDS

SEQ ID NO: 462231 - protein, 9 aa, Influenza virus
YKILKIKKG

SEQ ID NO: 462232 - protein, 9 aa, Influenza virus
YKILKIRKG

SEQ ID NO: 462233 - protein, 9 aa, Influenza virus
YKILSIYSC

SEQ ID NO: 462234 - protein, 9 aa, Influenza virus
YKILSIYSS

SEQ ID NO: 462235 - protein, 9 aa, Influenza virus
YKILSIYST

SEQ ID NO: 462236 - protein, 9 aa, Influenza virus
YKILTIYST

SEQ ID NO: 462237 - protein, 9 aa, Influenza virus
YKISKSTKS

SEQ ID NO: 462238 - protein, 9 aa, Influenza virus
YKIVKEGDS

SEQ ID NO: 462239 - protein, 9 aa, Influenza virus
YKIVKKGDS

SEQ ID NO: 462240 - protein, 9 aa, Influenza virus
YKIVKTGDS

SEQ ID NO: 462241 - protein, 9 aa, Influenza virus
YKKLKREIT

SEQ ID NO: 462242 - protein, 9 aa, Influenza virus
YKKLKREMT

SEQ ID NO: 462243 - protein, 9 aa, Influenza virus
YKMNIQILI

SEQ ID NO: 462244 - protein, 9 aa, Influenza virus
YKMNNQILI

SEQ ID NO: 462245 - protein, 9 aa, Influenza virus
YKMNTKILV

SEQ ID NO: 462246 - protein, 9 aa, Influenza virus
YKMNTQILI

SEQ ID NO: 462247 - protein, 9 aa, Influenza virus
YKMNTQILV

SEQ ID NO: 462248 - protein, 9 aa, Influenza virus
YKMNTRILI

SEQ ID NO: 462249 - protein, 9 aa, Influenza virus
YKNANTLSS

SEQ ID NO: 462250 - protein, 9 aa, Influenza virus
YKNANTLTS

SEQ ID NO: 462251 - protein, 9 aa, Influenza virus
YKNNPGRVS

SEQ ID NO: 462252 - protein, 9 aa, Influenza virus
YKNNPGRVT

SEQ ID NO: 462253 - protein, 9 aa, Influenza virus
YKNNTWVNQ

SEQ ID NO: 462254 - protein, 9 aa, Influenza virus
YKNSPGRVT

SEQ ID NO: 462255 - protein, 9 aa, Influenza virus
YKNTGDSDI

SEQ ID NO: 462256 - protein, 9 aa, Influenza virus
YKNTNTLSS

SEQ ID NO: 462257 - protein, 9 aa, Influenza virus
YKNTRDSDI

SEQ ID NO: 462258 - protein, 9 aa, Influenza virus
YKNTRDSNI

SEQ ID NO: 462259 - protein, 9 aa, Influenza virus
YKNWILWIS

SEQ ID NO: 462260 - protein, 9 aa, Influenza virus
YKNWSKPQC

SEQ ID NO: 462261 - protein, 9 aa, Influenza virus
YKRIRLFDY

SEQ ID NO: 462262 - protein, 9 aa, Influenza virus
YKRVRLFDY

SEQ ID NO: 462263 - protein, 9 aa, Influenza virus
YKSNPGRVT

SEQ ID NO: 462264 - protein, 9 aa, Influenza virus
YKSTPSAID

SEQ ID NO: 462265 - protein, 9 aa, Influenza virus
YKSTQAAID

SEQ ID NO: 462266 - protein, 9 aa, Influenza virus
YKSTQAAVD

SEQ ID NO: 462267 - protein, 9 aa, Influenza virus
YKSTQKTID

SEQ ID NO: 462268 - protein, 9 aa, Influenza virus
YKSTQSAID

SEQ ID NO: 462269 - protein, 9 aa, Influenza virus
YKSTQSAIN

SEQ ID NO: 462270 - protein, 9 aa, Influenza virus
YKSTQSAVD

SEQ ID NO: 462271 - protein, 9 aa, Influenza virus
YKVATGRVT

SEQ ID NO: 462272 - protein, 9 aa, Influenza virus
YKVGYLCAG

SEQ ID NO: 462273 - protein, 9 aa, Influenza virus
YKVLAIYSC

SEQ ID NO: 462274 - protein, 9 aa, Influenza virus
YKVLSIYSC

SEQ ID NO: 462275 - protein, 9 aa, Influenza virus
YKYGNGVWI

SEQ ID NO: 462276 - protein, 9 aa, Influenza virus
YKYKIFKNG

SEQ ID NO: 462277 - protein, 9 aa, Influenza virus
YLCAGIPSD

SEQ ID NO: 462278 - protein, 9 aa, Influenza virus
YLCAGIPTD

SEQ ID NO: 462279 - protein, 9 aa, Influenza virus
YLCAGLPSD

SEQ ID NO: 462280 - protein, 9 aa, Influenza virus
YLCSGLVGD

SEQ ID NO: 462281 - protein, 9 aa, Influenza virus
YLCSKILTD

SEQ ID NO: 462282 - protein, 9 aa, Influenza virus
YLCSKTLTD

SEQ ID NO: 462283 - protein, 9 aa, Influenza virus
YLCSKVLTD

SEQ ID NO: 462284 - protein, 9 aa, Influenza virus
YLCSRILTD

SEQ ID NO: 462285 - protein, 9 aa, Influenza virus
YLCSRVLTD

SEQ ID NO: 462286 - protein, 9 aa, Influenza virus
YLCTGILTD

SEQ ID NO: 462287 - protein, 9 aa, Influenza virus
YLCTGVLTD

SEQ ID NO: 462288 - protein, 9 aa, Influenza virus
YLECRTFFL

SEQ ID NO: 462289 - protein, 9 aa, Influenza virus
YLEEHPNAG

SEQ ID NO: 462290 - protein, 9 aa, Influenza virus
YLEEHPSAG

SEQ ID NO: 462291 - protein, 9 aa, Influenza virus
YLEEHPSTG

SEQ ID NO: 462292 - protein, 9 aa, Influenza virus
YLEENPSAG

SEQ ID NO: 462293 - protein, 9 aa, Influenza virus
YLEKANKIK

SEQ ID NO: 462294 - protein, 9 aa, Influenza virus
YLEKASKIK

SEQ ID NO: 462295 - protein, 9 aa, Influenza virus
YLEKYVEDT

SEQ ID NO: 462296 - protein, 9 aa, Influenza virus
YLIEDPAAP

SEQ ID NO: 462297 - protein, 9 aa, Influenza virus
YLIEDPGAP

SEQ ID NO: 462298 - protein, 9 aa, Influenza virus
YLIEDPNAP

SEQ ID NO: 462299 - protein, 9 aa, Influenza virus
YLIEDPSAP

SEQ ID NO: 462300 - protein, 9 aa, Influenza virus
YLIEDPTAP

SEQ ID NO: 462301 - protein, 9 aa, Influenza virus
YLIGKTSWS

SEQ ID NO: 462302 - protein, 9 aa, Influenza virus
YLIRALTLN

SEQ ID NO: 462303 - protein, 9 aa, Influenza virus
YLIRTLTLN

SEQ ID NO: 462304 - protein, 9 aa, Influenza virus
YLITGKSHG

SEQ ID NO: 462305 - protein, 9 aa, Influenza virus
YLLFQDILM

SEQ ID NO: 462306 - protein, 9 aa, Influenza virus
YLLKGESHC

SEQ ID NO: 462307 - protein, 9 aa, Influenza virus
YLLKGESHG

SEQ ID NO: 462308 - protein, 9 aa, Influenza virus
YLLKGESYG

SEQ ID NO: 462309 - protein, 9 aa, Influenza virus
YLLLNKSLC

SEQ ID NO: 462310 - protein, 9 aa, Influenza virus
YLLRGESHG

SEQ ID NO: 462311 - protein, 9 aa, Influenza virus
YLMLNKSLC

SEQ ID NO: 462312 - protein, 9 aa, Influenza virus
YLMLSKSLC

SEQ ID NO: 462313 - protein, 9 aa, Influenza virus
YLNGREWSY

SEQ ID NO: 462314 - protein, 9 aa, Influenza virus
YLPDLYDYK

SEQ ID NO: 462315 - protein, 9 aa, Influenza virus
YLSGREWSY

SEQ ID NO: 462316 - protein, 9 aa, Influenza virus
YLSNNATDT

SEQ ID NO: 462317 - protein, 9 aa, Influenza virus
YLSNNSSDT

SEQ ID NO: 462318 - protein, 9 aa, Influenza virus
YLSNNSTDK

SEQ ID NO: 462319 - protein, 9 aa, Influenza virus
YLSNNSTDT

SEQ ID NO: 462320 - protein, 9 aa, Influenza virus
YLSNNSTEK

SEQ ID NO: 462321 - protein, 9 aa, Influenza virus
YLSNNSTER

SEQ ID NO: 462322 - protein, 9 aa, Influenza virus
YLSTNSSDK

SEQ ID NO: 462323 - protein, 9 aa, Influenza virus
YLSTNSSEK

SEQ ID NO: 462324 - protein, 9 aa, Influenza virus
YLSTNSSER

SEQ ID NO: 462325 - protein, 9 aa, Influenza virus
YLSTNSTEK

SEQ ID NO: 462326 - protein, 9 aa, Influenza virus
YLSTNSTET

SEQ ID NO: 462327 - protein, 9 aa, Influenza virus
YLTGTWDTL

SEQ ID NO: 462328 - protein, 9 aa, Influenza virus
YLVLNKSLC

SEQ ID NO: 462329 - protein, 9 aa, Influenza virus
YLWGVHHPS

SEQ ID NO: 462330 - protein, 9 aa, Influenza virus
YMCSGLVGD

SEQ ID NO: 462331 - protein, 9 aa, Influenza virus
YMGECPEYV

SEQ ID NO: 462332 - protein, 9 aa, Influenza virus
YMGECPKYA

SEQ ID NO: 462333 - protein, 9 aa, Influenza virus
YMGECPKYV

SEQ ID NO: 462334 - protein, 9 aa, Influenza virus
YMGECPNYV

SEQ ID NO: 462335 - protein, 9 aa, Influenza virus
YMLERELVR

SEQ ID NO: 462336 - protein, 9 aa, Influenza virus
YMNTALLNA

SEQ ID NO: 462337 - protein, 9 aa, Influenza virus
YMNVKSLKL

SEQ ID NO: 462338 - protein, 9 aa, Influenza virus
YMSNNSTEK

SEQ ID NO: 462339 - protein, 9 aa, Influenza virus
YNADLLVAM

SEQ ID NO: 462340 - protein, 9 aa, Influenza virus
YNADVLVAL

SEQ ID NO: 462341 - protein, 9 aa, Influenza virus
YNAEFLVAL

SEQ ID NO: 462342 - protein, 9 aa, Influenza virus
YNAEFLVAM

SEQ ID NO: 462343 - protein, 9 aa, Influenza virus
YNAEFLVAV

SEQ ID NO: 462344 - protein, 9 aa, Influenza virus
YNAEILVAL

SEQ ID NO: 462345 - protein, 9 aa, Influenza virus
YNAELFVLM

SEQ ID NO: 462346 - protein, 9 aa, Influenza virus
YNAELIVLL

SEQ ID NO: 462347 - protein, 9 aa, Influenza virus
YNAELLIAM

SEQ ID NO: 462348 - protein, 9 aa, Influenza virus
YNAELLILL

SEQ ID NO: 462349 - protein, 9 aa, Influenza virus
YNAELLVAL

SEQ ID NO: 462350 - protein, 9 aa, Influenza virus
YNAELLVAM

SEQ ID NO: 462351 - protein, 9 aa, Influenza virus
YNAELLVLI

SEQ ID NO: 462352 - protein, 9 aa, Influenza virus
YNAELLVLL

SEQ ID NO: 462353 - protein, 9 aa, Influenza virus
YNAELLVLM

SEQ ID NO: 462354 - protein, 9 aa, Influenza virus
YNAEVLVLM

SEQ ID NO: 462355 - protein, 9 aa, Influenza virus
YNAGLLVAL

SEQ ID NO: 462356 - protein, 9 aa, Influenza virus
YNAKLLVLI

SEQ ID NO: 462357 - protein, 9 aa, Influenza virus
YNAKLLVLL

SEQ ID NO: 462358 - protein, 9 aa, Influenza virus
YNAQLLVLL

SEQ ID NO: 462359 - protein, 9 aa, Influenza virus
YNAQLLVWL

SEQ ID NO: 462360 - protein, 9 aa, Influenza virus
YNARLLVLL

SEQ ID NO: 462361 - protein, 9 aa, Influenza virus
YNETFVNIT

SEQ ID NO: 462362 - protein, 9 aa, Influenza virus
YNETFVNVT

SEQ ID NO: 462363 - protein, 9 aa, Influenza virus
YNETVRLET

SEQ ID NO: 462364 - protein, 9 aa, Influenza virus
YNETVRVEI

SEQ ID NO: 462365 - protein, 9 aa, Influenza virus
YNETVRVET

SEQ ID NO: 462366 - protein, 9 aa, Influenza virus
YNETVRVKT

SEQ ID NO: 462367 - protein, 9 aa, Influenza virus
YNFEKEGYS

SEQ ID NO: 462368 - protein, 9 aa, Influenza virus
YNGIITDTF

SEQ ID NO: 462369 - protein, 9 aa, Influenza virus
YNGIITDTI

SEQ ID NO: 462370 - protein, 9 aa, Influenza virus
YNGIITDTL

SEQ ID NO: 462371 - protein, 9 aa, Influenza virus
YNGIRTNGA

SEQ ID NO: 462372 - protein, 9 aa, Influenza virus
YNGKSLGIQ

SEQ ID NO: 462373 - protein, 9 aa, Influenza virus
YNGLITDTI

SEQ ID NO: 462374 - protein, 9 aa, Influenza virus
YNGMITDTI

SEQ ID NO: 462375 - protein, 9 aa, Influenza virus
YNGQKSWMK

SEQ ID NO: 462376 - protein, 9 aa, Influenza virus
YNGQKSWTK

SEQ ID NO: 462377 - protein, 9 aa, Influenza virus
YNGQRSWMK

SEQ ID NO: 462378 - protein, 9 aa, Influenza virus
YNGRLTTTI

SEQ ID NO: 462379 - protein, 9 aa, Influenza virus
YNGVITDTL

SEQ ID NO: 462380 - protein, 9 aa, Influenza virus
YNHEDYKEE

SEQ ID NO: 462381 - protein, 9 aa, Influenza virus
YNHEDYREE

SEQ ID NO: 462382 - protein, 9 aa, Influenza virus
YNHKDYEEE

SEQ ID NO: 462383 - protein, 9 aa, Influenza virus
YNHKEYEEE

SEQ ID NO: 462384 - protein, 9 aa, Influenza virus
YNHTEYRQE

SEQ ID NO: 462385 - protein, 9 aa, Influenza virus
YNHTQYREE

SEQ ID NO: 462386 - protein, 9 aa, Influenza virus
YNIRNLHIP

SEQ ID NO: 462387 - protein, 9 aa, Influenza virus
YNKIEFEPF

SEQ ID NO: 462388 - protein, 9 aa, Influenza virus
YNKLEFEPF

SEQ ID NO: 462389 - protein, 9 aa, Influenza virus
YNKMEFEPF

SEQ ID NO: 462390 - protein, 9 aa, Influenza virus
YNKRLTTTI

SEQ ID NO: 462391 - protein, 9 aa, Influenza virus
YNKTVINNI

SEQ ID NO: 462392 - protein, 9 aa, Influenza virus
YNKVEFEPF

SEQ ID NO: 462393 - protein, 9 aa, Influenza virus
YNKVRMQLR

SEQ ID NO: 462394 - protein, 9 aa, Influenza virus
YNNTNGEQI

SEQ ID NO: 462395 - protein, 9 aa, Influenza virus
YNNTSGEQI

SEQ ID NO: 462396 - protein, 9 aa, Influenza virus
YNNTSGEQM

SEQ ID NO: 462397 - protein, 9 aa, Influenza virus
YNNTSGEQV

SEQ ID NO: 462398 - protein, 9 aa, Influenza virus
YNNTSGKQM

SEQ ID NO: 462399 - protein, 9 aa, Influenza virus
YNNTTGRDV

SEQ ID NO: 462400 - protein, 9 aa, Influenza virus
YNNTVINNI

SEQ ID NO: 462401 - protein, 9 aa, Influenza virus
YNNTVINNM

SEQ ID NO: 462402 - protein, 9 aa, Influenza virus
YNNTVVNNI

SEQ ID NO: 462403 - protein, 9 aa, Influenza virus
YNPCFYVEL

SEQ ID NO: 462404 - protein, 9 aa, Influenza virus
YNRKEYEEE

SEQ ID NO: 462405 - protein, 9 aa, Influenza virus
YNRRLTTTI

SEQ ID NO: 462406 - protein, 9 aa, Influenza virus
YNRRPTTTI

SEQ ID NO: 462407 - protein, 9 aa, Influenza virus
YNSKFESVA

SEQ ID NO: 462408 - protein, 9 aa, Influenza virus
YNSRFESVA

SEQ ID NO: 462409 - protein, 9 aa, Influenza virus
YNSTVVNNI

SEQ ID NO: 462410 - protein, 9 aa, Influenza virus
YNTELLVLM

SEQ ID NO: 462411 - protein, 9 aa, Influenza virus
YNVELLVLM

SEQ ID NO: 462412 - protein, 9 aa, Influenza virus
YNVGYLCAG

SEQ ID NO: 462413 - protein, 9 aa, Influenza virus
YNYHQSFVP

SEQ ID NO: 462414 - protein, 9 aa, Influenza virus
YNYPKYEEE

SEQ ID NO: 462415 - protein, 9 aa, Influenza virus
YNYPKYSEE

SEQ ID NO: 462416 - protein, 9 aa, Influenza virus
YNYSKYEEE

SEQ ID NO: 462417 - protein, 9 aa, Influenza virus
YPDVRCICR

SEQ ID NO: 462418 - protein, 9 aa, Influenza virus
YPDVRCTCR

SEQ ID NO: 462419 - protein, 9 aa, Influenza virus
YPDVRCVCR

SEQ ID NO: 462420 - protein, 9 aa, Influenza virus
YPFDVPDYQ

SEQ ID NO: 462421 - protein, 9 aa, Influenza virus
YPFDVPEYQ

SEQ ID NO: 462422 - protein, 9 aa, Influenza virus
YPFDVPGYQ

SEQ ID NO: 462423 - protein, 9 aa, Influenza virus
YPFDVPNYQ

SEQ ID NO: 462424 - protein, 9 aa, Influenza virus
YPGATINEE

SEQ ID NO: 462425 - protein, 9 aa, Influenza virus
YPGATVNEE

SEQ ID NO: 462426 - protein, 9 aa, Influenza virus
YPGATVNEG

SEQ ID NO: 462427 - protein, 9 aa, Influenza virus
YPGELDNNG

SEQ ID NO: 462428 - protein, 9 aa, Influenza virus
YPGELNNNG

SEQ ID NO: 462429 - protein, 9 aa, Influenza virus
YPGEVDNNG

SEQ ID NO: 462430 - protein, 9 aa, Influenza virus
YPGFVENLE

SEQ ID NO: 462431 - protein, 9 aa, Influenza virus
YPGKFANEE

SEQ ID NO: 462432 - protein, 9 aa, Influenza virus
YPGKFTNEE

SEQ ID NO: 462433 - protein, 9 aa, Influenza virus
YPGKFVNEE

SEQ ID NO: 462434 - protein, 9 aa, Influenza virus
YPGKFVNGE

SEQ ID NO: 462435 - protein, 9 aa, Influenza virus
YPGNFNDYE

SEQ ID NO: 462436 - protein, 9 aa, Influenza virus
YPGNNNGVK

SEQ ID NO: 462437 - protein, 9 aa, Influenza virus
YPGNNNKGV

SEQ ID NO: 462438 - protein, 9 aa, Influenza virus
YPGNNNNGV

SEQ ID NO: 462439 - protein, 9 aa, Influenza virus
YPGNSNNGV

SEQ ID NO: 462440 - protein, 9 aa, Influenza virus
YPGRFTNEE

SEQ ID NO: 462441 - protein, 9 aa, Influenza virus
YPGSFNDYE

SEQ ID NO: 462442 - protein, 9 aa, Influenza virus
YPGSFNNYE

SEQ ID NO: 462443 - protein, 9 aa, Influenza virus
YPGSIENLE

SEQ ID NO: 462444 - protein, 9 aa, Influenza virus
YPGSIENQE

SEQ ID NO: 462445 - protein, 9 aa, Influenza virus
YPGSIKNQE

SEQ ID NO: 462446 - protein, 9 aa, Influenza virus
YPGSLNDYE

SEQ ID NO: 462447 - protein, 9 aa, Influenza virus
YPGSTVNEE

SEQ ID NO: 462448 - protein, 9 aa, Influenza virus
YPGSVENLE

SEQ ID NO: 462449 - protein, 9 aa, Influenza virus
YPGSVENQE

SEQ ID NO: 462450 - protein, 9 aa, Influenza virus
YPGTTVNEE

SEQ ID NO: 462451 - protein, 9 aa, Influenza virus
YPGVRCICR

SEQ ID NO: 462452 - protein, 9 aa, Influenza virus
YPIQNLTKV

SEQ ID NO: 462453 - protein, 9 aa, Influenza virus
YPKIYKTYF

SEQ ID NO: 462454 - protein, 9 aa, Influenza virus
YPKVYKPYF

SEQ ID NO: 462455 - protein, 9 aa, Influenza virus
YPKVYKTYF

SEQ ID NO: 462456 - protein, 9 aa, Influenza virus
YPKVYRTYF

SEQ ID NO: 462457 - protein, 9 aa, Influenza virus
YPKYEEESK

SEQ ID NO: 462458 - protein, 9 aa, Influenza virus
YPKYEEESR

SEQ ID NO: 462459 - protein, 9 aa, Influenza virus
YPKYEKESK

SEQ ID NO: 462460 - protein, 9 aa, Influenza virus
YPKYSEEAK

SEQ ID NO: 462461 - protein, 9 aa, Influenza virus
YPKYSEESK

SEQ ID NO: 462462 - protein, 9 aa, Influenza virus
YPKYSEESR

SEQ ID NO: 462463 - protein, 9 aa, Influenza virus
YPKYSKESK

SEQ ID NO: 462464 - protein, 9 aa, Influenza virus
YPLQNLTKI

SEQ ID NO: 462465 - protein, 9 aa, Influenza virus
YPLQNLTKT

SEQ ID NO: 462466 - protein, 9 aa, Influenza virus
YPLQNLTKV

SEQ ID NO: 462467 - protein, 9 aa, Influenza virus
YPNDGKVEC

SEQ ID NO: 462468 - protein, 9 aa, Influenza virus
YPNEGKVEC

SEQ ID NO: 462469 - protein, 9 aa, Influenza virus
YPNLCQVEC

SEQ ID NO: 462470 - protein, 9 aa, Influenza virus
YPNLGKVEC

SEQ ID NO: 462471 - protein, 9 aa, Influenza virus
YPNLGQVEC

SEQ ID NO: 462472 - protein, 9 aa, Influenza virus
YPNMGKVEC

SEQ ID NO: 462473 - protein, 9 aa, Influenza virus
YPNNGKVEC

SEQ ID NO: 462474 - protein, 9 aa, Influenza virus
YPNSGKVEC

SEQ ID NO: 462475 - protein, 9 aa, Influenza virus
YPNVRCVCR

SEQ ID NO: 462476 - protein, 9 aa, Influenza virus
YPQYPDVRC

SEQ ID NO: 462477 - protein, 9 aa, Influenza virus
YPQYPNVRC

SEQ ID NO: 462478 - protein, 9 aa, Influenza virus
YPRYPDVRC

SEQ ID NO: 462479 - protein, 9 aa, Influenza virus
YPRYPGVRC

SEQ ID NO: 462480 - protein, 9 aa, Influenza virus
YPRYPNVRC

SEQ ID NO: 462481 - protein, 9 aa, Influenza virus
YQAELLVAM

SEQ ID NO: 462482 - protein, 9 aa, Influenza virus
YQAKFEAVA

SEQ ID NO: 462483 - protein, 9 aa, Influenza virus
YQAKFESVA

SEQ ID NO: 462484 - protein, 9 aa, Influenza virus
YQARFEAVA

SEQ ID NO: 462485 - protein, 9 aa, Influenza virus
YQARFESVA

SEQ ID NO: 462486 - protein, 9 aa, Influenza virus
YQEVGTYVS

SEQ ID NO: 462487 - protein, 9 aa, Influenza virus
YQFALGHGT

SEQ ID NO: 462488 - protein, 9 aa, Influenza virus
YQFALGQGA

SEQ ID NO: 462489 - protein, 9 aa, Influenza virus
YQFALGQGT

SEQ ID NO: 462490 - protein, 9 aa, Influenza virus
YQGRLCNPL

SEQ ID NO: 462491 - protein, 9 aa, Influenza virus
YQGRLCNPM

SEQ ID NO: 462492 - protein, 9 aa, Influenza virus
YQIGNVINW

SEQ ID NO: 462493 - protein, 9 aa, Influenza virus
YQIGYICSG

SEQ ID NO: 462494 - protein, 9 aa, Influenza virus
YQIGYVCSG

SEQ ID NO: 462495 - protein, 9 aa, Influenza virus
YQILAIYAT

SEQ ID NO: 462496 - protein, 9 aa, Influenza virus
YQILAIYST

SEQ ID NO: 462497 - protein, 9 aa, Influenza virus
YQILSIYST

SEQ ID NO: 462498 - protein, 9 aa, Influenza virus
YQILSVYST

SEQ ID NO: 462499 - protein, 9 aa, Influenza virus
YQKCCNLFE

SEQ ID NO: 462500 - protein, 9 aa, Influenza virus
YQKCCSLFE

SEQ ID NO: 462501 - protein, 9 aa, Influenza virus
YQKCCTLFE

SEQ ID NO: 462502 - protein, 9 aa, Influenza virus
YQKQMTRGL

SEQ ID NO: 462503 - protein, 9 aa, Influenza virus
YQKRMGLQM

SEQ ID NO: 462504 - protein, 9 aa, Influenza virus
YQKRMGVQI

SEQ ID NO: 462505 - protein, 9 aa, Influenza virus
YQKRMGVQL

SEQ ID NO: 462506 - protein, 9 aa, Influenza virus
YQKRMGVQM

SEQ ID NO: 462507 - protein, 9 aa, Influenza virus
YQKRMTRGL

SEQ ID NO: 462508 - protein, 9 aa, Influenza virus
YQKVGTYVS

SEQ ID NO: 462509 - protein, 9 aa, Influenza virus
YQMGYICSG

SEQ ID NO: 462510 - protein, 9 aa, Influenza virus
YQNNFVPVI

SEQ ID NO: 462511 - protein, 9 aa, Influenza virus
YQNNFVPVM

SEQ ID NO: 462512 - protein, 9 aa, Influenza virus
YQNNFVPVV

SEQ ID NO: 462513 - protein, 9 aa, Influenza virus
YQNSFVPVV

SEQ ID NO: 462514 - protein, 9 aa, Influenza virus
YQNVETYVS

SEQ ID NO: 462515 - protein, 9 aa, Influenza virus
YQNVGTYVS

SEQ ID NO: 462516 - protein, 9 aa, Influenza virus
YQQSFSPSP

SEQ ID NO: 462517 - protein, 9 aa, Influenza virus
YQQSFTPSP

SEQ ID NO: 462518 - protein, 9 aa, Influenza virus
YQQSFVPSP

SEQ ID NO: 462519 - protein, 9 aa, Influenza virus
YQRCCNLFE

SEQ ID NO: 462520 - protein, 9 aa, Influenza virus
YQRSKFLLM

SEQ ID NO: 462521 - protein, 9 aa, Influenza virus
YQRTRALVR

SEQ ID NO: 462522 - protein, 9 aa, Influenza virus
YQSGTYPVI

SEQ ID NO: 462523 - protein, 9 aa, Influenza virus
YQSIRSILA

SEQ ID NO: 462524 - protein, 9 aa, Influenza virus
YQSLRSILA

SEQ ID NO: 462525 - protein, 9 aa, Influenza virus
YQSNNSTDT

SEQ ID NO: 462526 - protein, 9 aa, Influenza virus
YQSNNSTNT

SEQ ID NO: 462527 - protein, 9 aa, Influenza virus
YQSRFEAVA

SEQ ID NO: 462528 - protein, 9 aa, Influenza virus
YQSTNSTEA

SEQ ID NO: 462529 - protein, 9 aa, Influenza virus
YQSTNSTEI

SEQ ID NO: 462530 - protein, 9 aa, Influenza virus
YQSTNSTET

SEQ ID NO: 462531 - protein, 9 aa, Influenza virus
YQTNNSTDT

SEQ ID NO: 462532 - protein, 9 aa, Influenza virus
YQTNNSTET

SEQ ID NO: 462533 - protein, 9 aa, Influenza virus
YQVGYICSG

SEQ ID NO: 462534 - protein, 9 aa, Influenza virus
YQVGYLCAG

SEQ ID NO: 462535 - protein, 9 aa, Influenza virus
YQVLAIYAT

SEQ ID NO: 462536 - protein, 9 aa, Influenza virus
YQWIIKNWE

SEQ ID NO: 462537 - protein, 9 aa, Influenza virus
YQWIIRNWE

SEQ ID NO: 462538 - protein, 9 aa, Influenza virus
YQWVIRNWE

SEQ ID NO: 462539 - protein, 9 aa, Influenza virus
YRACFYVEL

SEQ ID NO: 462540 - protein, 9 aa, Influenza virus
YRAESLQNR

SEQ ID NO: 462541 - protein, 9 aa, Influenza virus
YRALISWEM

SEQ ID NO: 462542 - protein, 9 aa, Influenza virus
YRALISWPL

SEQ ID NO: 462543 - protein, 9 aa, Influenza virus
YRALISWPQ

SEQ ID NO: 462544 - protein, 9 aa, Influenza virus
YRALMSVLL

SEQ ID NO: 462545 - protein, 9 aa, Influenza virus
YRALMSVPL

SEQ ID NO: 462546 - protein, 9 aa, Influenza virus
YRALSIYSC

SEQ ID NO: 462547 - protein, 9 aa, Influenza virus
YRALVSWPL

SEQ ID NO: 462548 - protein, 9 aa, Influenza virus
YRCHKGDTQ

SEQ ID NO: 462549 - protein, 9 aa, Influenza virus
YRCHRGDAQ

SEQ ID NO: 462550 - protein, 9 aa, Influenza virus
YRCHRGDMQ

SEQ ID NO: 462551 - protein, 9 aa, Influenza virus
YRCHRGDTH

SEQ ID NO: 462552 - protein, 9 aa, Influenza virus
YRCHRGDTQ

SEQ ID NO: 462553 - protein, 9 aa, Influenza virus
YRDEAINNR

SEQ ID NO: 462554 - protein, 9 aa, Influenza virus
YRDEAINSR

SEQ ID NO: 462555 - protein, 9 aa, Influenza virus
YRDEAISNR

SEQ ID NO: 462556 - protein, 9 aa, Influenza virus
YRDEALNNR

SEQ ID NO: 462557 - protein, 9 aa, Influenza virus
YRDEALSNR

SEQ ID NO: 462558 - protein, 9 aa, Influenza virus
YRDEAVNNR

SEQ ID NO: 462559 - protein, 9 aa, Influenza virus
YRDLGNCHP

SEQ ID NO: 462560 - protein, 9 aa, Influenza virus
YRDNWKGSN

SEQ ID NO: 462561 - protein, 9 aa, Influenza virus
YRDWSKPQC

SEQ ID NO: 462562 - protein, 9 aa, Influenza virus
YREEAIQNR

SEQ ID NO: 462563 - protein, 9 aa, Influenza virus
YREEALLNR

SEQ ID NO: 462564 - protein, 9 aa, Influenza virus
YREEAMQNR

SEQ ID NO: 462565 - protein, 9 aa, Influenza virus
YREESLLNR

SEQ ID NO: 462566 - protein, 9 aa, Influenza virus
YREESQLKK

SEQ ID NO: 462567 - protein, 9 aa, Influenza virus
YREESQLKR

SEQ ID NO: 462568 - protein, 9 aa, Influenza virus
YREICIAWS

SEQ ID NO: 462569 - protein, 9 aa, Influenza virus
YREVCIAWS

SEQ ID NO: 462570 - protein, 9 aa, Influenza virus
YRGRLCNPL

SEQ ID NO: 462571 - protein, 9 aa, Influenza virus
YRHQNAQGE

SEQ ID NO: 462572 - protein, 9 aa, Influenza virus
YRICKLVGI

SEQ ID NO: 462573 - protein, 9 aa, Influenza virus
YRIGYICSG

SEQ ID NO: 462574 - protein, 9 aa, Influenza virus
YRILSIYST

SEQ ID NO: 462575 - protein, 9 aa, Influenza virus
YRIWSKPQC

SEQ ID NO: 462576 - protein, 9 aa, Influenza virus
YRKEAIQNR

SEQ ID NO: 462577 - protein, 9 aa, Influenza virus
YRKLKREIT

SEQ ID NO: 462578 - protein, 9 aa, Influenza virus
YRKRMTRGL

SEQ ID NO: 462579 - protein, 9 aa, Influenza virus
YRKWSKPQC

SEQ ID NO: 462580 - protein, 9 aa, Influenza virus
YRNEAINNR

SEQ ID NO: 462581 - protein, 9 aa, Influenza virus
YRNEALNNR

SEQ ID NO: 462582 - protein, 9 aa, Influenza virus
YRNLIWLVK

SEQ ID NO: 462583 - protein, 9 aa, Influenza virus
YRNLIWLVN

SEQ ID NO: 462584 - protein, 9 aa, Influenza virus
YRNLIWLVQ

SEQ ID NO: 462585 - protein, 9 aa, Influenza virus
YRNLVWIVK

SEQ ID NO: 462586 - protein, 9 aa, Influenza virus
YRNLVWLVK

SEQ ID NO: 462587 - protein, 9 aa, Influenza virus
YRNMRWLTL

SEQ ID NO: 462588 - protein, 9 aa, Influenza virus
YRNNRKEPA

SEQ ID NO: 462589 - protein, 9 aa, Influenza virus
YRNTRKEPA

SEQ ID NO: 462590 - protein, 9 aa, Influenza virus
YRNVVWLIK

SEQ ID NO: 462591 - protein, 9 aa, Influenza virus
YRNWAKPQC

SEQ ID NO: 462592 - protein, 9 aa, Influenza virus
YRNWSKPQC

SEQ ID NO: 462593 - protein, 9 aa, Influenza virus
YRNWSMPQC

SEQ ID NO: 462594 - protein, 9 aa, Influenza virus
YRNWTKPQC

SEQ ID NO: 462595 - protein, 9 aa, Influenza virus
YRQEALQNR

SEQ ID NO: 462596 - protein, 9 aa, Influenza virus
YRQSFSPSP

SEQ ID NO: 462597 - protein, 9 aa, Influenza virus
YRRPIGISS

SEQ ID NO: 462598 - protein, 9 aa, Influenza virus
YRRPVGISS

SEQ ID NO: 462599 - protein, 9 aa, Influenza virus
YRSINWLTK

SEQ ID NO: 462600 - protein, 9 aa, Influenza virus
YRSIRWLTL

SEQ ID NO: 462601 - protein, 9 aa, Influenza virus
YRSLIKFPI

SEQ ID NO: 462602 - protein, 9 aa, Influenza virus
YRSLIQFPI

SEQ ID NO: 462603 - protein, 9 aa, Influenza virus
YRSLIQFPM

SEQ ID NO: 462604 - protein, 9 aa, Influenza virus
YRSLIRFPI

SEQ ID NO: 462605 - protein, 9 aa, Influenza virus
YRSLIRFPV

SEQ ID NO: 462606 - protein, 9 aa, Influenza virus
YRSLISWPL

SEQ ID NO: 462607 - protein, 9 aa, Influenza virus
YRSMKWLTL

SEQ ID NO: 462608 - protein, 9 aa, Influenza virus
YRSMRWLTL

SEQ ID NO: 462609 - protein, 9 aa, Influenza virus
YRSWSKPQC

SEQ ID NO: 462610 - protein, 9 aa, Influenza virus
YRTCKLLGI

SEQ ID NO: 462611 - protein, 9 aa, Influenza virus
YRTCKLVGI

SEQ ID NO: 462612 - protein, 9 aa, Influenza virus
YRTESLQNR

SEQ ID NO: 462613 - protein, 9 aa, Influenza virus
YRTLLMNEL

SEQ ID NO: 462614 - protein, 9 aa, Influenza virus
YRTLLMSEL

SEQ ID NO: 462615 - protein, 9 aa, Influenza virus
YRVGYLCAG

SEQ ID NO: 462616 - protein, 9 aa, Influenza virus
YRYGFVANF

SEQ ID NO: 462617 - protein, 9 aa, Influenza virus
YRYTYRCHK

SEQ ID NO: 462618 - protein, 9 aa, Influenza virus
YRYTYRCHR

SEQ ID NO: 462619 - protein, 9 aa, Influenza virus
YSAGALASC

SEQ ID NO: 462620 - protein, 9 aa, Influenza virus
YSCIASSIV

SEQ ID NO: 462621 - protein, 9 aa, Influenza virus
YSCIASSLI

SEQ ID NO: 462622 - protein, 9 aa, Influenza virus
YSCIASSLV

SEQ ID NO: 462623 - protein, 9 aa, Influenza virus
YSCIASSTV

SEQ ID NO: 462624 - protein, 9 aa, Influenza virus
YSCIASSVV

SEQ ID NO: 462625 - protein, 9 aa, Influenza virus
YSCVASSLV

SEQ ID NO: 462626 - protein, 9 aa, Influenza virus
YSDFHFIDE

SEQ ID NO: 462627 - protein, 9 aa, Influenza virus
YSDFHFINE

SEQ ID NO: 462628 - protein, 9 aa, Influenza virus
YSEMKWLLS

SEQ ID NO: 462629 - protein, 9 aa, Influenza virus
YSEMKWLSS

SEQ ID NO: 462630 - protein, 9 aa, Influenza virus
YSETVRVET

SEQ ID NO: 462631 - protein, 9 aa, Influenza virus
YSGAFIDYW

SEQ ID NO: 462632 - protein, 9 aa, Influenza virus
YSGAFMDYW

SEQ ID NO: 462633 - protein, 9 aa, Influenza virus
YSGAFTIPI

SEQ ID NO: 462634 - protein, 9 aa, Influenza virus
YSGAFTIPT

SEQ ID NO: 462635 - protein, 9 aa, Influenza virus
YSGAFTIPV

SEQ ID NO: 462636 - protein, 9 aa, Influenza virus
YSGAFTVPI

SEQ ID NO: 462637 - protein, 9 aa, Influenza virus
YSGAFVDYW

SEQ ID NO: 462638 - protein, 9 aa, Influenza virus
YSGFVRTLF

SEQ ID NO: 462639 - protein, 9 aa, Influenza virus
YSGGTINSP

SEQ ID NO: 462640 - protein, 9 aa, Influenza virus
YSGIFSVEG

SEQ ID NO: 462641 - protein, 9 aa, Influenza virus
YSGIFSVEH

SEQ ID NO: 462642 - protein, 9 aa, Influenza virus
YSGIFSVEN

SEQ ID NO: 462643 - protein, 9 aa, Influenza virus
YSGIFSVES

SEQ ID NO: 462644 - protein, 9 aa, Influenza virus
YSGIKTDGA

SEQ ID NO: 462645 - protein, 9 aa, Influenza virus
YSGIRTDGA

SEQ ID NO: 462646 - protein, 9 aa, Influenza virus
YSGIRTNGA

SEQ ID NO: 462647 - protein, 9 aa, Influenza virus
YSGIRTNGT

SEQ ID NO: 462648 - protein, 9 aa, Influenza virus
YSGIRTNGV

SEQ ID NO: 462649 - protein, 9 aa, Influenza virus
YSGSFIDYW

SEQ ID NO: 462650 - protein, 9 aa, Influenza virus
YSGSFIQHP

SEQ ID NO: 462651 - protein, 9 aa, Influenza virus
YSGSFMDYW

SEQ ID NO: 462652 - protein, 9 aa, Influenza virus
YSGSFSIRG

SEQ ID NO: 462653 - protein, 9 aa, Influenza virus
YSGSFSIRW

SEQ ID NO: 462654 - protein, 9 aa, Influenza virus
YSGSFTIPT

SEQ ID NO: 462655 - protein, 9 aa, Influenza virus
YSGSFTLPI

SEQ ID NO: 462656 - protein, 9 aa, Influenza virus
YSGSFTLPV

SEQ ID NO: 462657 - protein, 9 aa, Influenza virus
YSGSFVDYW

SEQ ID NO: 462658 - protein, 9 aa, Influenza virus
YSGSFVQHP

SEQ ID NO: 462659 - protein, 9 aa, Influenza virus
YSGVFSVEG

SEQ ID NO: 462660 - protein, 9 aa, Influenza virus
YSHGTGTGY

SEQ ID NO: 462661 - protein, 9 aa, Influenza virus
YSIADKICI

SEQ ID NO: 462662 - protein, 9 aa, Influenza virus
YSIDSGYVC

SEQ ID NO: 462663 - protein, 9 aa, Influenza virus
YSIDSNYVC

SEQ ID NO: 462664 - protein, 9 aa, Influenza virus
YSIDSSYIC

SEQ ID NO: 462665 - protein, 9 aa, Influenza virus
YSIDSSYVC

SEQ ID NO: 462666 - protein, 9 aa, Influenza virus
YSKADKICI

SEQ ID NO: 462667 - protein, 9 aa, Influenza virus
YSKDNGIRI

SEQ ID NO: 462668 - protein, 9 aa, Influenza virus
YSKDNSIRI

SEQ ID NO: 462669 - protein, 9 aa, Influenza virus
YSKDNSVRI

SEQ ID NO: 462670 - protein, 9 aa, Influenza virus
YSKVYKTYF

SEQ ID NO: 462671 - protein, 9 aa, Influenza virus
YSKYEEESK

SEQ ID NO: 462672 - protein, 9 aa, Influenza virus
YSLPPNFSS

SEQ ID NO: 462673 - protein, 9 aa, Influenza virus
YSLVGIDPF

SEQ ID NO: 462674 - protein, 9 aa, Influenza virus
YSLVGVDPF

SEQ ID NO: 462675 - protein, 9 aa, Influenza virus
YSQITNGTT

SEQ ID NO: 462676 - protein, 9 aa, Influenza virus
YSRADKICI

SEQ ID NO: 462677 - protein, 9 aa, Influenza virus
YSSPMMWEI

SEQ ID NO: 462678 - protein, 9 aa, Influenza virus
YSSPQLEGF

SEQ ID NO: 462679 - protein, 9 aa, Influenza virus
YSSSLMWEI

SEQ ID NO: 462680 - protein, 9 aa, Influenza virus
YSSSMMWEI

SEQ ID NO: 462681 - protein, 9 aa, Influenza virus
YSSSMMWEV

SEQ ID NO: 462682 - protein, 9 aa, Influenza virus
YSSVASSLV

SEQ ID NO: 462683 - protein, 9 aa, Influenza virus
YSTAASSLA

SEQ ID NO: 462684 - protein, 9 aa, Influenza virus
YSTAASSLV

SEQ ID NO: 462685 - protein, 9 aa, Influenza virus
YSTGALASC

SEQ ID NO: 462686 - protein, 9 aa, Influenza virus
YSTISSSLV

SEQ ID NO: 462687 - protein, 9 aa, Influenza virus
YSTVAASLC

SEQ ID NO: 462688 - protein, 9 aa, Influenza virus
YSTVASSLA

SEQ ID NO: 462689 - protein, 9 aa, Influenza virus
YSTVASSLT

SEQ ID NO: 462690 - protein, 9 aa, Influenza virus
YSTVASSLV

SEQ ID NO: 462691 - protein, 9 aa, Influenza virus
YSTVASSSV

SEQ ID NO: 462692 - protein, 9 aa, Influenza virus
YSTVSSSLV

SEQ ID NO: 462693 - protein, 9 aa, Influenza virus
YSTVVSSLA

SEQ ID NO: 462694 - protein, 9 aa, Influenza virus
YSVGYLCAG

SEQ ID NO: 462695 - protein, 9 aa, Influenza virus
YTENPVICL

SEQ ID NO: 462696 - protein, 9 aa, Influenza virus
YTGAINSSK

SEQ ID NO: 462697 - protein, 9 aa, Influenza virus
YTGAINSSR

SEQ ID NO: 462698 - protein, 9 aa, Influenza virus
YTGDPPYSH

SEQ ID NO: 462699 - protein, 9 aa, Influenza virus
YTGISKACN

SEQ ID NO: 462700 - protein, 9 aa, Influenza virus
YTGNLVICL

SEQ ID NO: 462701 - protein, 9 aa, Influenza virus
YTGNPVICL

SEQ ID NO: 462702 - protein, 9 aa, Influenza virus
YTGNPVICM

SEQ ID NO: 462703 - protein, 9 aa, Influenza virus
YTGSFCSID

SEQ ID NO: 462704 - protein, 9 aa, Influenza virus
YTGTSKACN

SEQ ID NO: 462705 - protein, 9 aa, Influenza virus
YTGTSRACN

SEQ ID NO: 462706 - protein, 9 aa, Influenza virus
YTIDEESRA

SEQ ID NO: 462707 - protein, 9 aa, Influenza virus
YTKCQTYAG

SEQ ID NO: 462708 - protein, 9 aa, Influenza virus
YTKDNSIRI

SEQ ID NO: 462709 - protein, 9 aa, Influenza virus
YTKIMYFHK

SEQ ID NO: 462710 - protein, 9 aa, Influenza virus
YTKVLYFHK

SEQ ID NO: 462711 - protein, 9 aa, Influenza virus
YTKVMYFHK

SEQ ID NO: 462712 - protein, 9 aa, Influenza virus
YTLDEESRA

SEQ ID NO: 462713 - protein, 9 aa, Influenza virus
YTLITDGPS

SEQ ID NO: 462714 - protein, 9 aa, Influenza virus
YTLMTDGPS

SEQ ID NO: 462715 - protein, 9 aa, Influenza virus
YTLVSTGSW

SEQ ID NO: 462716 - protein, 9 aa, Influenza virus
YTLVSTKEW

SEQ ID NO: 462717 - protein, 9 aa, Influenza virus
YTLVSTKSW

SEQ ID NO: 462718 - protein, 9 aa, Influenza virus
YTLVSTRSW

SEQ ID NO: 462719 - protein, 9 aa, Influenza virus
YTLVSTSSW

SEQ ID NO: 462720 - protein, 9 aa, Influenza virus
YTLVTDGPS

SEQ ID NO: 462721 - protein, 9 aa, Influenza virus
YTLVTTSSW

SEQ ID NO: 462722 - protein, 9 aa, Influenza virus
YTMDTVNRT

SEQ ID NO: 462723 - protein, 9 aa, Influenza virus
YTMDTVSRT

SEQ ID NO: 462724 - protein, 9 aa, Influenza virus
YTPGGEVIN

SEQ ID NO: 462725 - protein, 9 aa, Influenza virus
YTPGGEVKN

SEQ ID NO: 462726 - protein, 9 aa, Influenza virus
YTPGGEVRN

SEQ ID NO: 462727 - protein, 9 aa, Influenza virus
YTPGGGVRN

SEQ ID NO: 462728 - protein, 9 aa, Influenza virus
YTPGGKVRN

SEQ ID NO: 462729 - protein, 9 aa, Influenza virus
YTRLYIWGV

SEQ ID NO: 462730 - protein, 9 aa, Influenza virus
YTSARQEKN

SEQ ID NO: 462731 - protein, 9 aa, Influenza virus
YTSGRQEKN

SEQ ID NO: 462732 - protein, 9 aa, Influenza virus
YTVGYLCAG

SEQ ID NO: 462733 - protein, 9 aa, Influenza virus
YTYRCHKGD

SEQ ID NO: 462734 - protein, 9 aa, Influenza virus
YTYRCHRGD

SEQ ID NO: 462735 - protein, 9 aa, Influenza virus
YVCSGIFGD

SEQ ID NO: 462736 - protein, 9 aa, Influenza virus
YVCSGLVGD

SEQ ID NO: 462737 - protein, 9 aa, Influenza virus
YVCSGVFGD

SEQ ID NO: 462738 - protein, 9 aa, Influenza virus
YVCSKFHSD

SEQ ID NO: 462739 - protein, 9 aa, Influenza virus
YVCTGILTD

SEQ ID NO: 462740 - protein, 9 aa, Influenza virus
YVCTGVLTD

SEQ ID NO: 462741 - protein, 9 aa, Influenza virus
YVDGFEPNG

SEQ ID NO: 462742 - protein, 9 aa, Influenza virus
YVDGFKPNG

SEQ ID NO: 462743 - protein, 9 aa, Influenza virus
YVEDTKIDL

SEQ ID NO: 462744 - protein, 9 aa, Influenza virus
YVEDTKVDL

SEQ ID NO: 462745 - protein, 9 aa, Influenza virus
YVELIRGKP

SEQ ID NO: 462746 - protein, 9 aa, Influenza virus
YVELIRGMP

SEQ ID NO: 462747 - protein, 9 aa, Influenza virus
YVELIRGRE

SEQ ID NO: 462748 - protein, 9 aa, Influenza virus
YVELIRGRK

SEQ ID NO: 462749 - protein, 9 aa, Influenza virus
YVELIRGRL

SEQ ID NO: 462750 - protein, 9 aa, Influenza virus
YVELIRGRN

SEQ ID NO: 462751 - protein, 9 aa, Influenza virus
YVELIRGRP

SEQ ID NO: 462752 - protein, 9 aa, Influenza virus
YVELIRGRQ

SEQ ID NO: 462753 - protein, 9 aa, Influenza virus
YVELIRGRR

SEQ ID NO: 462754 - protein, 9 aa, Influenza virus
YVELIRGRS

SEQ ID NO: 462755 - protein, 9 aa, Influenza virus
YVELVRGRP

SEQ ID NO: 462756 - protein, 9 aa, Influenza virus
YVEMIRGRP

SEQ ID NO: 462757 - protein, 9 aa, Influenza virus
YVEVLHLTQ

SEQ ID NO: 462758 - protein, 9 aa, Influenza virus
YVEWTSNSL

SEQ ID NO: 462759 - protein, 9 aa, Influenza virus
YVKKASLRL

SEQ ID NO: 462760 - protein, 9 aa, Influenza virus
YVKKESLRL

SEQ ID NO: 462761 - protein, 9 aa, Influenza virus
YVKQGSLKL

SEQ ID NO: 462762 - protein, 9 aa, Influenza virus
YVKQGSLML

SEQ ID NO: 462763 - protein, 9 aa, Influenza virus
YVKQGSLRL

SEQ ID NO: 462764 - protein, 9 aa, Influenza virus
YVKQKTLKL

SEQ ID NO: 462765 - protein, 9 aa, Influenza virus
YVKQNTLKL

SEQ ID NO: 462766 - protein, 9 aa, Influenza virus
YVKQSSLPL

SEQ ID NO: 462767 - protein, 9 aa, Influenza virus
YVKQSTLKL

SEQ ID NO: 462768 - protein, 9 aa, Influenza virus
YVKSDRLVL

SEQ ID NO: 462769 - protein, 9 aa, Influenza virus
YVKSEKLVL

SEQ ID NO: 462770 - protein, 9 aa, Influenza virus
YVKSERLVL

SEQ ID NO: 462771 - protein, 9 aa, Influenza virus
YVLSIIPSG

SEQ ID NO: 462772 - protein, 9 aa, Influenza virus
YVLSIVPSG

SEQ ID NO: 462773 - protein, 9 aa, Influenza virus
YVLSVIPSG

SEQ ID NO: 462774 - protein, 9 aa, Influenza virus
YVNIKSLKL

SEQ ID NO: 462775 - protein, 9 aa, Influenza virus
YVNKNPYTL

SEQ ID NO: 462776 - protein, 9 aa, Influenza virus
YVNNTTIIN

SEQ ID NO: 462777 - protein, 9 aa, Influenza virus
YVNNTTIIS

SEQ ID NO: 462778 - protein, 9 aa, Influenza virus
YVNNTTIIT

SEQ ID NO: 462779 - protein, 9 aa, Influenza virus
YVNNTTVIN

SEQ ID NO: 462780 - protein, 9 aa, Influenza virus
YVNNTTVIS

SEQ ID NO: 462781 - protein, 9 aa, Influenza virus
YVNTALLNA

SEQ ID NO: 462782 - protein, 9 aa, Influenza virus
YVNVKSLKL

SEQ ID NO: 462783 - protein, 9 aa, Influenza virus
YVNVRSLKL

SEQ ID NO: 462784 - protein, 9 aa, Influenza virus
YVQMCTELK

SEQ ID NO: 462785 - protein, 9 aa, Influenza virus
YVRKASLRL

SEQ ID NO: 462786 - protein, 9 aa, Influenza virus
YVRLYLWGV

SEQ ID NO: 462787 - protein, 9 aa, Influenza virus
YVRQNTLKL

SEQ ID NO: 462788 - protein, 9 aa, Influenza virus
YVRSEKLVL

SEQ ID NO: 462789 - protein, 9 aa, Influenza virus
YVRTNGTSK

SEQ ID NO: 462790 - protein, 9 aa, Influenza virus
YVSCDPDEC

SEQ ID NO: 462791 - protein, 9 aa, Influenza virus
YVSCDPDGC

SEQ ID NO: 462792 - protein, 9 aa, Influenza virus
YVSCDPLGC

SEQ ID NO: 462793 - protein, 9 aa, Influenza virus
YVSCDPSGC

SEQ ID NO: 462794 - protein, 9 aa, Influenza virus
YVSCDPTGC

SEQ ID NO: 462795 - protein, 9 aa, Influenza virus
YVSCEPDEC

SEQ ID NO: 462796 - protein, 9 aa, Influenza virus
YVSIGTSTL

SEQ ID NO: 462797 - protein, 9 aa, Influenza virus
YVSMEFSLT

SEQ ID NO: 462798 - protein, 9 aa, Influenza virus
YVSVGTSTL

SEQ ID NO: 462799 - protein, 9 aa, Influenza virus
YVWWASNSL

SEQ ID NO: 462800 - protein, 9 aa, Influenza virus
YVWWTSNSL

SEQ ID NO: 462801 - protein, 9 aa, Influenza virus
YWAEGDCYR

SEQ ID NO: 462802 - protein, 9 aa, Influenza virus
YWAEGECYR

SEQ ID NO: 462803 - protein, 9 aa, Influenza virus
YWAILKPGQ

SEQ ID NO: 462804 - protein, 9 aa, Influenza virus
YWAIRTRSG

SEQ ID NO: 462805 - protein, 9 aa, Influenza virus
YWAKEECYR

SEQ ID NO: 462806 - protein, 9 aa, Influenza virus
YWAKGDCYR

SEQ ID NO: 462807 - protein, 9 aa, Influenza virus
YWAKGECYR

SEQ ID NO: 462808 - protein, 9 aa, Influenza virus
YWAVLKPGQ

SEQ ID NO: 462809 - protein, 9 aa, Influenza virus
YWGILKRGE

SEQ ID NO: 462810 - protein, 9 aa, Influenza virus
YWHLMHPGE

SEQ ID NO: 462811 - protein, 9 aa, Influenza virus
YWHLMRPGE

SEQ ID NO: 462812 - protein, 9 aa, Influenza virus
YWHLMSPGE

SEQ ID NO: 462813 - protein, 9 aa, Influenza virus
YWMCSNGSL

SEQ ID NO: 462814 - protein, 9 aa, Influenza virus
YWNWSKPQC

SEQ ID NO: 462815 - protein, 9 aa, Influenza virus
YWTIVDPGD

SEQ ID NO: 462816 - protein, 9 aa, Influenza virus
YWTIVEPED

SEQ ID NO: 462817 - protein, 9 aa, Influenza virus
YWTIVEPGD

SEQ ID NO: 462818 - protein, 9 aa, Influenza virus
YWTIVKPGD

SEQ ID NO: 462819 - protein, 9 aa, Influenza virus
YWTIVKSGD

SEQ ID NO: 462820 - protein, 9 aa, Influenza virus
YWTLVNPGD

SEQ ID NO: 462821 - protein, 9 aa, Influenza virus
YWTVVKPGD

SEQ ID NO: 462822 - protein, 9 aa, Influenza virus
YWVMTDGPA

SEQ ID NO: 462823 - protein, 9 aa, Influenza virus
YWWDGLQSS

SEQ ID NO: 462824 - protein, 9 aa, Influenza virus
YYDRRLTTT

SEQ ID NO: 462825 - protein, 9 aa, Influenza virus
YYEECSCYP

SEQ ID NO: 462826 - protein, 9 aa, Influenza virus
YYFVKEGKI

SEQ ID NO: 462827 - protein, 9 aa, Influenza virus
YYLEKANKI

SEQ ID NO: 462828 - protein, 9 aa, Influenza virus
YYLEKASKI

SEQ ID NO: 462829 - protein, 9 aa, Influenza virus
YYMGECPKY

SEQ ID NO: 462830 - protein, 9 aa, Influenza virus
YYNETFVNI

SEQ ID NO: 462831 - protein, 9 aa, Influenza virus
YYNETFVNV

SEQ ID NO: 462832 - protein, 9 aa, Influenza virus
YYNGRLTTT

SEQ ID NO: 462833 - protein, 9 aa, Influenza virus
YYNGRSSFF

SEQ ID NO: 462834 - protein, 9 aa, Influenza virus
YYNKRLTTT

SEQ ID NO: 462835 - protein, 9 aa, Influenza virus
YYNRRLTTT

SEQ ID NO: 462836 - protein, 9 aa, Influenza virus
YYNRRPTTT

SEQ ID NO: 462837 - protein, 9 aa, Influenza virus
YYPKYEEES

SEQ ID NO: 462838 - protein, 9 aa, Influenza virus
YYWAILKPG

SEQ ID NO: 462839 - protein, 9 aa, Influenza virus
YYWAVLKPG

SEQ ID NO: 462840 - protein, 9 aa, Influenza virus
YYWGILKRG

SEQ ID NO: 462841 - protein, 9 aa, Influenza virus
YYYEECSCY

SEQ ID NO: 462842 - protein, 9 aa, Influenza virus
YYYPKYEEE

SEQ ID NO: 462843 - protein, 9 aa, Influenza virus
AADKASTQK

SEQ ID NO: 462844 - protein, 9 aa, Influenza virus
AADKDSTQK

SEQ ID NO: 462845 - protein, 9 aa, Influenza virus
AADKESTQE

SEQ ID NO: 462846 - protein, 9 aa, Influenza virus
AADKESTQK

SEQ ID NO: 462847 - protein, 9 aa, Influenza virus
AADKESTQR

SEQ ID NO: 462848 - protein, 9 aa, Influenza virus
AADKESTQT

SEQ ID NO: 462849 - protein, 9 aa, Influenza virus
AADKKSTQK

SEQ ID NO: 462850 - protein, 9 aa, Influenza virus
AADKTSTQK

SEQ ID NO: 462851 - protein, 9 aa, Influenza virus
AADKVSTQK

SEQ ID NO: 462852 - protein, 9 aa, Influenza virus
AADLKSTQA

SEQ ID NO: 462853 - protein, 9 aa, Influenza virus
AADLKSTQT

SEQ ID NO: 462854 - protein, 9 aa, Influenza virus
AADQESTQK

SEQ ID NO: 462855 - protein, 9 aa, Influenza virus
AADQKSTQE

SEQ ID NO: 462856 - protein, 9 aa, Influenza virus
AADRDSTQK

SEQ ID NO: 462857 - protein, 9 aa, Influenza virus
AADRDSTQM

SEQ ID NO: 462858 - protein, 9 aa, Influenza virus
AADRDSTQR

SEQ ID NO: 462859 - protein, 9 aa, Influenza virus
AADRESTQK

SEQ ID NO: 462860 - protein, 9 aa, Influenza virus
AADRESTQR

SEQ ID NO: 462861 - protein, 9 aa, Influenza virus
AADRGSTQK

SEQ ID NO: 462862 - protein, 9 aa, Influenza virus
AADRKSTQK

SEQ ID NO: 462863 - protein, 9 aa, Influenza virus
AADYESTQA

SEQ ID NO: 462864 - protein, 9 aa, Influenza virus
AADYKSTPS

SEQ ID NO: 462865 - protein, 9 aa, Influenza virus
AADYKSTQA

SEQ ID NO: 462866 - protein, 9 aa, Influenza virus
AADYKSTQK

SEQ ID NO: 462867 - protein, 9 aa, Influenza virus
AADYKSTQS

SEQ ID NO: 462868 - protein, 9 aa, Influenza virus
AADYKSTQT

SEQ ID NO: 462869 - protein, 9 aa, Influenza virus
AAEKESTQK

SEQ ID NO: 462870 - protein, 9 aa, Influenza virus
AAFEDLRIS

SEQ ID NO: 462871 - protein, 9 aa, Influenza virus
AAFEDLRLL

SEQ ID NO: 462872 - protein, 9 aa, Influenza virus
AAFEDLRVL

SEQ ID NO: 462873 - protein, 9 aa, Influenza virus
AAFEDLRVS

SEQ ID NO: 462874 - protein, 9 aa, Influenza virus
AAFRGLIST

SEQ ID NO: 462875 - protein, 9 aa, Influenza virus
AAGAAIKGV

SEQ ID NO: 462876 - protein, 9 aa, Influenza virus
AAGAAVKGI

SEQ ID NO: 462877 - protein, 9 aa, Influenza virus
AAGAAVKGV

SEQ ID NO: 462878 - protein, 9 aa, Influenza virus
AAGFHFEEC

SEQ ID NO: 462879 - protein, 9 aa, Influenza virus
AAGGDIWVT

SEQ ID NO: 462880 - protein, 9 aa, Influenza virus
AAICTHLEI

SEQ ID NO: 462881 - protein, 9 aa, Influenza virus
AAICTHLEV

SEQ ID NO: 462882 - protein, 9 aa, Influenza virus
AAICTHMEV

SEQ ID NO: 462883 - protein, 9 aa, Influenza virus
AAIDQINGK

SEQ ID NO: 462884 - protein, 9 aa, Influenza virus
AAIDQISGK

SEQ ID NO: 462885 - protein, 9 aa, Influenza virus
AAIDQITGK

SEQ ID NO: 462886 - protein, 9 aa, Influenza virus
AAIDQMTGK

SEQ ID NO: 462887 - protein, 9 aa, Influenza virus
AAIGLRISS

SEQ ID NO: 462888 - protein, 9 aa, Influenza virus
AAIKGIGTM

SEQ ID NO: 462889 - protein, 9 aa, Influenza virus
AAIKGVGTM

SEQ ID NO: 462890 - protein, 9 aa, Influenza virus
AAINQINGK

SEQ ID NO: 462891 - protein, 9 aa, Influenza virus
AALGLRISS

SEQ ID NO: 462892 - protein, 9 aa, Influenza virus
AALGSPGCD

SEQ ID NO: 462893 - protein, 9 aa, Influenza virus
AAMDDFQLI

SEQ ID NO: 462894 - protein, 9 aa, Influenza virus
AAMDEFQLI

SEQ ID NO: 462895 - protein, 9 aa, Influenza virus
AAMEDFQLI

SEQ ID NO: 462896 - protein, 9 aa, Influenza virus
AAMGLKISS

SEQ ID NO: 462897 - protein, 9 aa, Influenza virus
AAMGLRISS

SEQ ID NO: 462898 - protein, 9 aa, Influenza virus
AAMGMRISS

SEQ ID NO: 462899 - protein, 9 aa, Influenza virus
AANNADHRI

SEQ ID NO: 462900 - protein, 9 aa, Influenza virus
AANNADHRV

SEQ ID NO: 462901 - protein, 9 aa, Influenza virus
AANPIVPSF

SEQ ID NO: 462902 - protein, 9 aa, Influenza virus
AANSADHRI

SEQ ID NO: 462903 - protein, 9 aa, Influenza virus
AANSADHRV

SEQ ID NO: 462904 - protein, 9 aa, Influenza virus
AANSAHHRV

SEQ ID NO: 462905 - protein, 9 aa, Influenza virus
AAPHGLCYP

SEQ ID NO: 462906 - protein, 9 aa, Influenza virus
AAPPEQSRM

SEQ ID NO: 462907 - protein, 9 aa, Influenza virus
AAPPKQSRM

SEQ ID NO: 462908 - protein, 9 aa, Influenza virus
AAPPVQSKM

SEQ ID NO: 462909 - protein, 9 aa, Influenza virus
AAPPVQSRM

SEQ ID NO: 462910 - protein, 9 aa, Influenza virus
AAQELVESQ

SEQ ID NO: 462911 - protein, 9 aa, Influenza virus
AAQKAMMDQ

SEQ ID NO: 462912 - protein, 9 aa, Influenza virus
AAQRAMMDQ

SEQ ID NO: 462913 - protein, 9 aa, Influenza virus
AAQRAMVDQ

SEQ ID NO: 462914 - protein, 9 aa, Influenza virus
AARNIVRRA

SEQ ID NO: 462915 - protein, 9 aa, Influenza virus
AARSIVRRA

SEQ ID NO: 462916 - protein, 9 aa, Influenza virus
AASLCLAIL

SEQ ID NO: 462917 - protein, 9 aa, Influenza virus
AASLCLAVL

SEQ ID NO: 462918 - protein, 9 aa, Influenza virus
AASLSPGMM

SEQ ID NO: 462919 - protein, 9 aa, Influenza virus
AASSLALAI

SEQ ID NO: 462920 - protein, 9 aa, Influenza virus
AASYKRIRL

SEQ ID NO: 462921 - protein, 9 aa, Influenza virus
AASYKRVRL

SEQ ID NO: 462922 - protein, 9 aa, Influenza virus
AATALANTI

SEQ ID NO: 462923 - protein, 9 aa, Influenza virus
AATLCLGHH

SEQ ID NO: 462924 - protein, 9 aa, Influenza virus
AATQTLVSN

SEQ ID NO: 462925 - protein, 9 aa, Influenza virus
AATVTLHFK

SEQ ID NO: 462926 - protein, 9 aa, Influenza virus
AAVDQITGK

SEQ ID NO: 462927 - protein, 9 aa, Influenza virus
AAVKGIGTM

SEQ ID NO: 462928 - protein, 9 aa, Influenza virus
AAVKGVGTI

SEQ ID NO: 462929 - protein, 9 aa, Influenza virus
AAVKGVGTM

SEQ ID NO: 462930 - protein, 9 aa, Influenza virus
AAVSADPLA

SEQ ID NO: 462931 - protein, 9 aa, Influenza virus
AAWSSSSCF

SEQ ID NO: 462932 - protein, 9 aa, Influenza virus
AAWSSSSCH

SEQ ID NO: 462933 - protein, 9 aa, Influenza virus
ACELTDSIW

SEQ ID NO: 462934 - protein, 9 aa, Influenza virus
ACELTDSSW

SEQ ID NO: 462935 - protein, 9 aa, Influenza virus
ACELTDSTW

SEQ ID NO: 462936 - protein, 9 aa, Influenza virus
ACELTDSVW

SEQ ID NO: 462937 - protein, 9 aa, Influenza virus
ACELTGSSW

SEQ ID NO: 462938 - protein, 9 aa, Influenza virus
ACFQPCFYV

SEQ ID NO: 462939 - protein, 9 aa, Influenza virus
ACFYVELIR

SEQ ID NO: 462940 - protein, 9 aa, Influenza virus
ACGNGSCRC

SEQ ID NO: 462941 - protein, 9 aa, Influenza virus
ACGPAECRT

SEQ ID NO: 462942 - protein, 9 aa, Influenza virus
ACGPSECRT

SEQ ID NO: 462943 - protein, 9 aa, Influenza virus
ACGPTECRT

SEQ ID NO: 462944 - protein, 9 aa, Influenza virus
ACHDGASWL

SEQ ID NO: 462945 - protein, 9 aa, Influenza virus
ACHDGISWL

SEQ ID NO: 462946 - protein, 9 aa, Influenza virus
ACHDGKEWL

SEQ ID NO: 462947 - protein, 9 aa, Influenza virus
ACHDGKEWM

SEQ ID NO: 462948 - protein, 9 aa, Influenza virus
ACHDGKGWL

SEQ ID NO: 462949 - protein, 9 aa, Influenza virus
ACHDGKKWL

SEQ ID NO: 462950 - protein, 9 aa, Influenza virus
ACHDGKKWM

SEQ ID NO: 462951 - protein, 9 aa, Influenza virus
ACHDGKKWT

SEQ ID NO: 462952 - protein, 9 aa, Influenza virus
ACHDGRKWM

SEQ ID NO: 462953 - protein, 9 aa, Influenza virus
ACHDGSSWL

SEQ ID NO: 462954 - protein, 9 aa, Influenza virus
ACHDGTNWL

SEQ ID NO: 462955 - protein, 9 aa, Influenza virus
ACHDGTSWL

SEQ ID NO: 462956 - protein, 9 aa, Influenza virus
ACHSAAFED

SEQ ID NO: 462957 - protein, 9 aa, Influenza virus
ACITPNGSI

SEQ ID NO: 462958 - protein, 9 aa, Influenza virus
ACKRTVSSF

SEQ ID NO: 462959 - protein, 9 aa, Influenza virus
ACLRGGRNS

SEQ ID NO: 462960 - protein, 9 aa, Influenza virus
ACNALTGGQ

SEQ ID NO: 462961 - protein, 9 aa, Influenza virus
ACNASTGAQ

SEQ ID NO: 462962 - protein, 9 aa, Influenza virus
ACNASTGGQ

SEQ ID NO: 462963 - protein, 9 aa, Influenza virus
ACNNGSCRC

SEQ ID NO: 462964 - protein, 9 aa, Influenza virus
ACNSAAFED

SEQ ID NO: 462965 - protein, 9 aa, Influenza virus
ACNSGNCRF

SEQ ID NO: 462966 - protein, 9 aa, Influenza virus
ACQKGNIKC

SEQ ID NO: 462967 - protein, 9 aa, Influenza virus
ACQKGNIRC

SEQ ID NO: 462968 - protein, 9 aa, Influenza virus
ACQNGNIRC

SEQ ID NO: 462969 - protein, 9 aa, Influenza virus
ACQNGNLRC

SEQ ID NO: 462970 - protein, 9 aa, Influenza virus
ACQNGNVRC

SEQ ID NO: 462971 - protein, 9 aa, Influenza virus
ACQRGNIRC

SEQ ID NO: 462972 - protein, 9 aa, Influenza virus
ACQTGNIRC

SEQ ID NO: 462973 - protein, 9 aa, Influenza virus
ACSASTGGQ

SEQ ID NO: 462974 - protein, 9 aa, Influenza virus
ACSDGPGWL

SEQ ID NO: 462975 - protein, 9 aa, Influenza virus
ACSDGSGWL

SEQ ID NO: 462976 - protein, 9 aa, Influenza virus
ACSNGNCRF

SEQ ID NO: 462977 - protein, 9 aa, Influenza virus
ACSNGSCRC

SEQ ID NO: 462978 - protein, 9 aa, Influenza virus
ACSNGSCRF

SEQ ID NO: 462979 - protein, 9 aa, Influenza virus
ACSPSECRT

SEQ ID NO: 462980 - protein, 9 aa, Influenza virus
ACSSGNCRF

SEQ ID NO: 462981 - protein, 9 aa, Influenza virus
ACWEQLYTP

SEQ ID NO: 462982 - protein, 9 aa, Influenza virus
ACYNPCFYV

SEQ ID NO: 462983 - protein, 9 aa, Influenza virus
ADAQHRSHR

SEQ ID NO: 462984 - protein, 9 aa, Influenza virus
ADDDAYAVI

SEQ ID NO: 462985 - protein, 9 aa, Influenza virus
ADDEAYAVI

SEQ ID NO: 462986 - protein, 9 aa, Influenza virus
ADEICIGHL

SEQ ID NO: 462987 - protein, 9 aa, Influenza virus
ADEICIGYL

SEQ ID NO: 462988 - protein, 9 aa, Influenza virus
ADEICIGYM

SEQ ID NO: 462989 - protein, 9 aa, Influenza virus
ADGDIWVTR

SEQ ID NO: 462990 - protein, 9 aa, Influenza virus
ADGGPNLYN

SEQ ID NO: 462991 - protein, 9 aa, Influenza virus
ADGVKGFSY

SEQ ID NO: 462992 - protein, 9 aa, Influenza virus
ADHPPKVAW

SEQ ID NO: 462993 - protein, 9 aa, Influenza virus
ADHRIYWIK

SEQ ID NO: 462994 - protein, 9 aa, Influenza virus
ADHRIYWIR

SEQ ID NO: 462995 - protein, 9 aa, Influenza virus
ADHRIYWVR

SEQ ID NO: 462996 - protein, 9 aa, Influenza virus
ADHRVYWIR

SEQ ID NO: 462997 - protein, 9 aa, Influenza virus
ADIKSHAYI

SEQ ID NO: 462998 - protein, 9 aa, Influenza virus
ADINLHAYI

SEQ ID NO: 462999 - protein, 9 aa, Influenza virus
ADINLMPIY

SEQ ID NO: 463000 - protein, 9 aa, Influenza virus
ADKASTQKA

SEQ ID NO: 463001 - protein, 9 aa, Influenza virus
ADKDSNGVQ

SEQ ID NO: 463002 - protein, 9 aa, Influenza virus
ADKDSTQKA

SEQ ID NO: 463003 - protein, 9 aa, Influenza virus
ADKESTQEA

SEQ ID NO: 463004 - protein, 9 aa, Influenza virus
ADKESTQKA

SEQ ID NO: 463005 - protein, 9 aa, Influenza virus
ADKESTQKT

SEQ ID NO: 463006 - protein, 9 aa, Influenza virus
ADKESTQRA

SEQ ID NO: 463007 - protein, 9 aa, Influenza virus
ADKESTQTA

SEQ ID NO: 463008 - protein, 9 aa, Influenza virus
ADKICIGYL

SEQ ID NO: 463009 - protein, 9 aa, Influenza virus
ADKICLGHH

SEQ ID NO: 463010 - protein, 9 aa, Influenza virus
ADKICLGRH

SEQ ID NO: 463011 - protein, 9 aa, Influenza virus
ADKICVGYL

SEQ ID NO: 463012 - protein, 9 aa, Influenza virus
ADKKSTQKA

SEQ ID NO: 463013 - protein, 9 aa, Influenza virus
ADKTSTQKA

SEQ ID NO: 463014 - protein, 9 aa, Influenza virus
ADKVSTQKA

SEQ ID NO: 463015 - protein, 9 aa, Influenza virus
ADLEALMEW

SEQ ID NO: 463016 - protein, 9 aa, Influenza virus
ADLIIERRE

SEQ ID NO: 463017 - protein, 9 aa, Influenza virus
ADLIIERRN

SEQ ID NO: 463018 - protein, 9 aa, Influenza virus
ADLKSTQAA

SEQ ID NO: 463019 - protein, 9 aa, Influenza virus
ADLKSTQTA

SEQ ID NO: 463020 - protein, 9 aa, Influenza virus
ADLLVAMEN

SEQ ID NO: 463021 - protein, 9 aa, Influenza virus
ADMSIGITV

SEQ ID NO: 463022 - protein, 9 aa, Influenza virus
ADMSIGVAV

SEQ ID NO: 463023 - protein, 9 aa, Influenza virus
ADMSIGVTV

SEQ ID NO: 463024 - protein, 9 aa, Influenza virus
ADNDAYAVI

SEQ ID NO: 463025 - protein, 9 aa, Influenza virus
ADPLASLLE

SEQ ID NO: 463026 - protein, 9 aa, Influenza virus
ADPLLSLLE

SEQ ID NO: 463027 - protein, 9 aa, Influenza virus
ADPLVSLLE

SEQ ID NO: 463028 - protein, 9 aa, Influenza virus
ADQELGDAP

SEQ ID NO: 463029 - protein, 9 aa, Influenza virus
ADQESTQKA

SEQ ID NO: 463030 - protein, 9 aa, Influenza virus
ADQKSTQEA

SEQ ID NO: 463031 - protein, 9 aa, Influenza virus
ADQSLPPNF

SEQ ID NO: 463032 - protein, 9 aa, Influenza virus
ADRDSTQKA

SEQ ID NO: 463033 - protein, 9 aa, Influenza virus
ADRDSTQMA

SEQ ID NO: 463034 - protein, 9 aa, Influenza virus
ADRDSTQRA

SEQ ID NO: 463035 - protein, 9 aa, Influenza virus
ADRESTQKA

SEQ ID NO: 463036 - protein, 9 aa, Influenza virus
ADRESTQRA

SEQ ID NO: 463037 - protein, 9 aa, Influenza virus
ADRGSTQKA

SEQ ID NO: 463038 - protein, 9 aa, Influenza virus
ADRICIGYL

SEQ ID NO: 463039 - protein, 9 aa, Influenza virus
ADRICVGYL

SEQ ID NO: 463040 - protein, 9 aa, Influenza virus
ADRIDDAVT

SEQ ID NO: 463041 - protein, 9 aa, Influenza virus
ADRKSTQKA

SEQ ID NO: 463042 - protein, 9 aa, Influenza virus
ADRVDDAVT

SEQ ID NO: 463043 - protein, 9 aa, Influenza virus
ADSEMDKLY

SEQ ID NO: 463044 - protein, 9 aa, Influenza virus
ADSEMKKLY

SEQ ID NO: 463045 - protein, 9 aa, Influenza virus
ADSEMLNLY

SEQ ID NO: 463046 - protein, 9 aa, Influenza virus
ADSEMNKLF

SEQ ID NO: 463047 - protein, 9 aa, Influenza virus
ADSEMNKLH

SEQ ID NO: 463048 - protein, 9 aa, Influenza virus
ADSEMNKLY

SEQ ID NO: 463049 - protein, 9 aa, Influenza virus
ADSEMSKLY

SEQ ID NO: 463050 - protein, 9 aa, Influenza virus
ADSHHRSHR

SEQ ID NO: 463051 - protein, 9 aa, Influenza virus
ADSQHKSHR

SEQ ID NO: 463052 - protein, 9 aa, Influenza virus
ADSQHRSHR

SEQ ID NO: 463053 - protein, 9 aa, Influenza virus
ADTICIGYH

SEQ ID NO: 463054 - protein, 9 aa, Influenza virus
ADTICVGYH

SEQ ID NO: 463055 - protein, 9 aa, Influenza virus
ADTKILFIE

SEQ ID NO: 463056 - protein, 9 aa, Influenza virus
ADTLCIGYH

SEQ ID NO: 463057 - protein, 9 aa, Influenza virus
ADTRILFIE

SEQ ID NO: 463058 - protein, 9 aa, Influenza virus
ADTRILFIK

SEQ ID NO: 463059 - protein, 9 aa, Influenza virus
ADTRILFIR

SEQ ID NO: 463060 - protein, 9 aa, Influenza virus
ADTRILFVK

SEQ ID NO: 463061 - protein, 9 aa, Influenza virus
ADVLVALEN

SEQ ID NO: 463062 - protein, 9 aa, Influenza virus
ADWSWHDGA

SEQ ID NO: 463063 - protein, 9 aa, Influenza virus
ADWSWQDGA

SEQ ID NO: 463064 - protein, 9 aa, Influenza virus
ADWVDDAVT

SEQ ID NO: 463065 - protein, 9 aa, Influenza virus
ADYESTQAA

SEQ ID NO: 463066 - protein, 9 aa, Influenza virus
ADYKSTPSA

SEQ ID NO: 463067 - protein, 9 aa, Influenza virus
ADYKSTQAA

SEQ ID NO: 463068 - protein, 9 aa, Influenza virus
ADYKSTQKT

SEQ ID NO: 463069 - protein, 9 aa, Influenza virus
ADYKSTQSA

SEQ ID NO: 463070 - protein, 9 aa, Influenza virus
ADYKSTQTA

SEQ ID NO: 463071 - protein, 9 aa, Influenza virus
ADYRVYWIR

SEQ ID NO: 463072 - protein, 9 aa, Influenza virus
AECRTFFLT

SEQ ID NO: 463073 - protein, 9 aa, Influenza virus
AEDIGNGCF

SEQ ID NO: 463074 - protein, 9 aa, Influenza virus
AEDKGNGCF

SEQ ID NO: 463075 - protein, 9 aa, Influenza virus
AEDMGDGCF

SEQ ID NO: 463076 - protein, 9 aa, Influenza virus
AEDMGGGCF

SEQ ID NO: 463077 - protein, 9 aa, Influenza virus
AEDMGNGCF

SEQ ID NO: 463078 - protein, 9 aa, Influenza virus
AEDMGNGCL

SEQ ID NO: 463079 - protein, 9 aa, Influenza virus
AEDQGNGCF

SEQ ID NO: 463080 - protein, 9 aa, Influenza virus
AEDRGNGCF

SEQ ID NO: 463081 - protein, 9 aa, Influenza virus
AEEDCTGCF

SEQ ID NO: 463082 - protein, 9 aa, Influenza virus
AEEDGKGCF

SEQ ID NO: 463083 - protein, 9 aa, Influenza virus
AEEDGNGCF

SEQ ID NO: 463084 - protein, 9 aa, Influenza virus
AEEDGRGCF

SEQ ID NO: 463085 - protein, 9 aa, Influenza virus
AEEDGTGCF

SEQ ID NO: 463086 - protein, 9 aa, Influenza virus
AEEMGNGCF

SEQ ID NO: 463087 - protein, 9 aa, Influenza virus
AEESKLKRQ

SEQ ID NO: 463088 - protein, 9 aa, Influenza virus
AEFLVALEN

SEQ ID NO: 463089 - protein, 9 aa, Influenza virus
AEFLVAVEN

SEQ ID NO: 463090 - protein, 9 aa, Influenza virus
AEFLVLMEN

SEQ ID NO: 463091 - protein, 9 aa, Influenza virus
AEGDCYRAC

SEQ ID NO: 463092 - protein, 9 aa, Influenza virus
AEGECYRAC

SEQ ID NO: 463093 - protein, 9 aa, Influenza virus
AEGIGIAAD

SEQ ID NO: 463094 - protein, 9 aa, Influenza virus
AEGRTSDMR

SEQ ID NO: 463095 - protein, 9 aa, Influenza virus
AEGTGIAAD

SEQ ID NO: 463096 - protein, 9 aa, Influenza virus
AEGTGMAAD

SEQ ID NO: 463097 - protein, 9 aa, Influenza virus
AEGTGTAAD

SEQ ID NO: 463098 - protein, 9 aa, Influenza virus
AEIAQKLED

SEQ ID NO: 463099 - protein, 9 aa, Influenza virus
AEIAQRLED

SEQ ID NO: 463100 - protein, 9 aa, Influenza virus
AEIAQRLEG

SEQ ID NO: 463101 - protein, 9 aa, Influenza virus
AEIAQRLEN

SEQ ID NO: 463102 - protein, 9 aa, Influenza virus
AEIAQRLES

SEQ ID NO: 463103 - protein, 9 aa, Influenza virus
AEIEDLIFL

SEQ ID NO: 463104 - protein, 9 aa, Influenza virus
AEIEDLIFM

SEQ ID NO: 463105 - protein, 9 aa, Influenza virus
AEIEDLIFS

SEQ ID NO: 463106 - protein, 9 aa, Influenza virus
AEIEDLTFL

SEQ ID NO: 463107 - protein, 9 aa, Influenza virus
AEILVALEN

SEQ ID NO: 463108 - protein, 9 aa, Influenza virus
AEILVLMEN

SEQ ID NO: 463109 - protein, 9 aa, Influenza virus
AEINTWARN

SEQ ID NO: 463110 - protein, 9 aa, Influenza virus
AEISHCRAT

SEQ ID NO: 463111 - protein, 9 aa, Influenza virus
AEKAMKEHG

SEQ ID NO: 463112 - protein, 9 aa, Influenza virus
AEKAMKEYG

SEQ ID NO: 463113 - protein, 9 aa, Influenza virus
AEKESTQKA

SEQ ID NO: 463114 - protein, 9 aa, Influenza virus
AEKTMKEYG

SEQ ID NO: 463115 - protein, 9 aa, Influenza virus
AELAEKAMK

SEQ ID NO: 463116 - protein, 9 aa, Influenza virus
AELFVLMEN

SEQ ID NO: 463117 - protein, 9 aa, Influenza virus
AELIVLLEN

SEQ ID NO: 463118 - protein, 9 aa, Influenza virus
AELKWLISK

SEQ ID NO: 463119 - protein, 9 aa, Influenza virus
AELKWLVSK

SEQ ID NO: 463120 - protein, 9 aa, Influenza virus
AELLIAMEN

SEQ ID NO: 463121 - protein, 9 aa, Influenza virus
AELLILLEN

SEQ ID NO: 463122 - protein, 9 aa, Influenza virus
AELLVAIEN

SEQ ID NO: 463123 - protein, 9 aa, Influenza virus
AELLVALEN

SEQ ID NO: 463124 - protein, 9 aa, Influenza virus
AELLVAMEN

SEQ ID NO: 463125 - protein, 9 aa, Influenza virus
AELLVLIEN

SEQ ID NO: 463126 - protein, 9 aa, Influenza virus
AELLVLLED

SEQ ID NO: 463127 - protein, 9 aa, Influenza virus
AELLVLLEN

SEQ ID NO: 463128 - protein, 9 aa, Influenza virus
AELLVLLGN

SEQ ID NO: 463129 - protein, 9 aa, Influenza virus
AELLVLMEN

SEQ ID NO: 463130 - protein, 9 aa, Influenza virus
AEMEWLLSN

SEQ ID NO: 463131 - protein, 9 aa, Influenza virus
AEMKWLLSD

SEQ ID NO: 463132 - protein, 9 aa, Influenza virus
AEMKWLLSN

SEQ ID NO: 463133 - protein, 9 aa, Influenza virus
AEMKWLLSS

SEQ ID NO: 463134 - protein, 9 aa, Influenza virus
AEQFTWNGV

SEQ ID NO: 463135 - protein, 9 aa, Influenza virus
AEQTKLYGS

SEQ ID NO: 463136 - protein, 9 aa, Influenza virus
AERGKLKRR

SEQ ID NO: 463137 - protein, 9 aa, Influenza virus
AERQEIVDN

SEQ ID NO: 463138 - protein, 9 aa, Influenza virus
AESEMNKLY

SEQ ID NO: 463139 - protein, 9 aa, Influenza virus
AESRKLLLI

SEQ ID NO: 463140 - protein, 9 aa, Influenza virus
AESRKLLLV

SEQ ID NO: 463141 - protein, 9 aa, Influenza virus
AESRKMLLI

SEQ ID NO: 463142 - protein, 9 aa, Influenza virus
AESSIKEKD

SEQ ID NO: 463143 - protein, 9 aa, Influenza virus
AESSVKEKD

SEQ ID NO: 463144 - protein, 9 aa, Influenza virus
AESSVREKD

SEQ ID NO: 463145 - protein, 9 aa, Influenza virus
AEVLVLMEN

SEQ ID NO: 463146 - protein, 9 aa, Influenza virus
AEVSHCRAT

SEQ ID NO: 463147 - protein, 9 aa, Influenza virus
AEVSYCRAT

SEQ ID NO: 463148 - protein, 9 aa, Influenza virus
AFCGTSGTY

SEQ ID NO: 463149 - protein, 9 aa, Influenza virus
AFCGVDSDT

SEQ ID NO: 463150 - protein, 9 aa, Influenza virus
AFCGVNFDL

SEQ ID NO: 463151 - protein, 9 aa, Influenza virus
AFCGVNSDT

SEQ ID NO: 463152 - protein, 9 aa, Influenza virus
AFDERRNKY

SEQ ID NO: 463153 - protein, 9 aa, Influenza virus
AFDERRNRY

SEQ ID NO: 463154 - protein, 9 aa, Influenza virus
AFFRNMVWL

SEQ ID NO: 463155 - protein, 9 aa, Influenza virus
AFGLICATC

SEQ ID NO: 463156 - protein, 9 aa, Influenza virus
AFGLVCATC

SEQ ID NO: 463157 - protein, 9 aa, Influenza virus
AFGPVHFRN

SEQ ID NO: 463158 - protein, 9 aa, Influenza virus
AFIAPDRAS

SEQ ID NO: 463159 - protein, 9 aa, Influenza virus
AFIAPDRAT

SEQ ID NO: 463160 - protein, 9 aa, Influenza virus
AFIAPDRVS

SEQ ID NO: 463161 - protein, 9 aa, Influenza virus
AFIAPNRAS

SEQ ID NO: 463162 - protein, 9 aa, Influenza virus
AFICIKNGN

SEQ ID NO: 463163 - protein, 9 aa, Influenza virus
AFILWACQN

SEQ ID NO: 463164 - protein, 9 aa, Influenza virus
AFILWACSS

SEQ ID NO: 463165 - protein, 9 aa, Influenza virus
AFIMWACSN

SEQ ID NO: 463166 - protein, 9 aa, Influenza virus
AFIMWACSS

SEQ ID NO: 463167 - protein, 9 aa, Influenza virus
AFKQGNSVW

SEQ ID NO: 463168 - protein, 9 aa, Influenza virus
AFLEDSHPG

SEQ ID NO: 463169 - protein, 9 aa, Influenza virus
AFLEESHPG

SEQ ID NO: 463170 - protein, 9 aa, Influenza virus
AFLEKSHPG

SEQ ID NO: 463171 - protein, 9 aa, Influenza virus
AFLENSHPG

SEQ ID NO: 463172 - protein, 9 aa, Influenza virus
AFLTSSIVC

SEQ ID NO: 463173 - protein, 9 aa, Influenza virus
AFMLWACQN

SEQ ID NO: 463174 - protein, 9 aa, Influenza virus
AFRDNLEPG

SEQ ID NO: 463175 - protein, 9 aa, Influenza virus
AFRGLISTH

SEQ ID NO: 463176 - protein, 9 aa, Influenza virus
AFRGLISTP

SEQ ID NO: 463177 - protein, 9 aa, Influenza virus
AFRGLISTQ

SEQ ID NO: 463178 - protein, 9 aa, Influenza virus
AFRGLMSTP

SEQ ID NO: 463179 - protein, 9 aa, Influenza virus
AFSGMSANG

SEQ ID NO: 463180 - protein, 9 aa, Influenza virus
AFSVQRNLP

SEQ ID NO: 463181 - protein, 9 aa, Influenza virus
AFVAPDRAS

SEQ ID NO: 463182 - protein, 9 aa, Influenza virus
AFVAPDRVS

SEQ ID NO: 463183 - protein, 9 aa, Influenza virus
AFVLWACQN

SEQ ID NO: 463184 - protein, 9 aa, Influenza virus
AFYKILKIK

SEQ ID NO: 463185 - protein, 9 aa, Influenza virus
AFYKILKIR

SEQ ID NO: 463186 - protein, 9 aa, Influenza virus
AFYRSINWL

SEQ ID NO: 463187 - protein, 9 aa, Influenza virus
AGAAIKGVG

SEQ ID NO: 463188 - protein, 9 aa, Influenza virus
AGAAVKGIG

SEQ ID NO: 463189 - protein, 9 aa, Influenza virus
AGAAVKGVG

SEQ ID NO: 463190 - protein, 9 aa, Influenza virus
AGAGALAED

SEQ ID NO: 463191 - protein, 9 aa, Influenza virus
AGAINSSKP

SEQ ID NO: 463192 - protein, 9 aa, Influenza virus
AGAINSSRP

SEQ ID NO: 463193 - protein, 9 aa, Influenza virus
AGALASCMG

SEQ ID NO: 463194 - protein, 9 aa, Influenza virus
AGAVNSSKP

SEQ ID NO: 463195 - protein, 9 aa, Influenza virus
AGDGCFEIL

SEQ ID NO: 463196 - protein, 9 aa, Influenza virus
AGFAPFSKD

SEQ ID NO: 463197 - protein, 9 aa, Influenza virus
AGFHFEECS

SEQ ID NO: 463198 - protein, 9 aa, Influenza virus
AGFIEGGWC

SEQ ID NO: 463199 - protein, 9 aa, Influenza virus
AGFIEGGWP

SEQ ID NO: 463200 - protein, 9 aa, Influenza virus
AGFIEGGWQ

SEQ ID NO: 463201 - protein, 9 aa, Influenza virus
AGFIEGGWS

SEQ ID NO: 463202 - protein, 9 aa, Influenza virus
AGFIEGGWT

SEQ ID NO: 463203 - protein, 9 aa, Influenza virus
AGFIEGRWP

SEQ ID NO: 463204 - protein, 9 aa, Influenza virus
AGFIENGWE

SEQ ID NO: 463205 - protein, 9 aa, Influenza virus
AGFIENGWQ

SEQ ID NO: 463206 - protein, 9 aa, Influenza virus
AGGAIWVTR

SEQ ID NO: 463207 - protein, 9 aa, Influenza virus
AGGDIWATR

SEQ ID NO: 463208 - protein, 9 aa, Influenza virus
AGGDIWITR

SEQ ID NO: 463209 - protein, 9 aa, Influenza virus
AGGDIWVTR

SEQ ID NO: 463210 - protein, 9 aa, Influenza virus
AGGHIWVTR

SEQ ID NO: 463211 - protein, 9 aa, Influenza virus
AGGLILGMQ

SEQ ID NO: 463212 - protein, 9 aa, Influenza virus
AGGNIWITR

SEQ ID NO: 463213 - protein, 9 aa, Influenza virus
AGIFFWMCS

SEQ ID NO: 463214 - protein, 9 aa, Influenza virus
AGIFLWMCS

SEQ ID NO: 463215 - protein, 9 aa, Influenza virus
AGIPSDTPR

SEQ ID NO: 463216 - protein, 9 aa, Influenza virus
AGIPTDTPR

SEQ ID NO: 463217 - protein, 9 aa, Influenza virus
AGISFWMCS

SEQ ID NO: 463218 - protein, 9 aa, Influenza virus
AGISIWMCS

SEQ ID NO: 463219 - protein, 9 aa, Influenza virus
AGISLWMCS

SEQ ID NO: 463220 - protein, 9 aa, Influenza virus
AGKDPKKTG

SEQ ID NO: 463221 - protein, 9 aa, Influenza virus
AGKILRTQE

SEQ ID NO: 463222 - protein, 9 aa, Influenza virus
AGKNADLEA

SEQ ID NO: 463223 - protein, 9 aa, Influenza virus
AGKNSDLEA

SEQ ID NO: 463224 - protein, 9 aa, Influenza virus
AGKNTDLEA

SEQ ID NO: 463225 - protein, 9 aa, Influenza virus
AGKNTDLEV

SEQ ID NO: 463226 - protein, 9 aa, Influenza virus
AGLFFWMCS

SEQ ID NO: 463227 - protein, 9 aa, Influenza virus
AGLFLWMCS

SEQ ID NO: 463228 - protein, 9 aa, Influenza virus
AGLLLWMCS

SEQ ID NO: 463229 - protein, 9 aa, Influenza virus
AGLLVALEN

SEQ ID NO: 463230 - protein, 9 aa, Influenza virus
AGLPSDTPR

SEQ ID NO: 463231 - protein, 9 aa, Influenza virus
AGLSFWMCS

SEQ ID NO: 463232 - protein, 9 aa, Influenza virus
AGLSLWMCF

SEQ ID NO: 463233 - protein, 9 aa, Influenza virus
AGLSLWMCS

SEQ ID NO: 463234 - protein, 9 aa, Influenza virus
AGLTHIMIW

SEQ ID NO: 463235 - protein, 9 aa, Influenza virus
AGLTHLMIW

SEQ ID NO: 463236 - protein, 9 aa, Influenza virus
AGLTHMMIW

SEQ ID NO: 463237 - protein, 9 aa, Influenza virus
AGLVLGNPM

SEQ ID NO: 463238 - protein, 9 aa, Influenza virus
AGNGCFDIL

SEQ ID NO: 463239 - protein, 9 aa, Influenza virus
AGNILRTQE

SEQ ID NO: 463240 - protein, 9 aa, Influenza virus
AGNKLITVG

SEQ ID NO: 463241 - protein, 9 aa, Influenza virus
AGRIDFHWM

SEQ ID NO: 463242 - protein, 9 aa, Influenza virus
AGRMTFYWA

SEQ ID NO: 463243 - protein, 9 aa, Influenza virus
AGRMTFYWI

SEQ ID NO: 463244 - protein, 9 aa, Influenza virus
AGRMTFYWK

SEQ ID NO: 463245 - protein, 9 aa, Influenza virus
AGRMTFYWT

SEQ ID NO: 463246 - protein, 9 aa, Influenza virus
AGSAQHVEE

SEQ ID NO: 463247 - protein, 9 aa, Influenza virus
AGSLSLAIM

SEQ ID NO: 463248 - protein, 9 aa, Influenza virus
AGSSEQAAE

SEQ ID NO: 463249 - protein, 9 aa, Influenza virus
AGSWPDGAN

SEQ ID NO: 463250 - protein, 9 aa, Influenza virus
AGTAKHIEE

SEQ ID NO: 463251 - protein, 9 aa, Influenza virus
AGVDRFYRI

SEQ ID NO: 463252 - protein, 9 aa, Influenza virus
AGVDRFYRT

SEQ ID NO: 463253 - protein, 9 aa, Influenza virus
AGVESAVLR

SEQ ID NO: 463254 - protein, 9 aa, Influenza virus
AGVETMVIL

SEQ ID NO: 463255 - protein, 9 aa, Influenza virus
AGVKMNPNQ

SEQ ID NO: 463256 - protein, 9 aa, Influenza virus
AGVNRFYRT

SEQ ID NO: 463257 - protein, 9 aa, Influenza virus
AGWILGNPE

SEQ ID NO: 463258 - protein, 9 aa, Influenza virus
AGWILGNPK

SEQ ID NO: 463259 - protein, 9 aa, Influenza virus
AGWILGNPM

SEQ ID NO: 463260 - protein, 9 aa, Influenza virus
AGWILGNPR

SEQ ID NO: 463261 - protein, 9 aa, Influenza virus
AGWLIGNPK

SEQ ID NO: 463262 - protein, 9 aa, Influenza virus
AGWLLGNPE

SEQ ID NO: 463263 - protein, 9 aa, Influenza virus
AGWLLGNPK

SEQ ID NO: 463264 - protein, 9 aa, Influenza virus
AGWLLGNPL

SEQ ID NO: 463265 - protein, 9 aa, Influenza virus
AGWLLGNPM

SEQ ID NO: 463266 - protein, 9 aa, Influenza virus
AGWYGFQHQ

SEQ ID NO: 463267 - protein, 9 aa, Influenza virus
AGWYGFQHS

SEQ ID NO: 463268 - protein, 9 aa, Influenza virus
AGWYGFQHT

SEQ ID NO: 463269 - protein, 9 aa, Influenza virus
AGYAADKES

SEQ ID NO: 463270 - protein, 9 aa, Influenza virus
AGYEMLKVP

SEQ ID NO: 463271 - protein, 9 aa, Influenza virus
AHALKLVVA

SEQ ID NO: 463272 - protein, 9 aa, Influenza virus
AHCYPGATI

SEQ ID NO: 463273 - protein, 9 aa, Influenza virus
AHDRICIGY

SEQ ID NO: 463274 - protein, 9 aa, Influenza virus
AHHRVYWIR

SEQ ID NO: 463275 - protein, 9 aa, Influenza virus
AHILVTREP

SEQ ID NO: 463276 - protein, 9 aa, Influenza virus
AHISPLSGS

SEQ ID NO: 463277 - protein, 9 aa, Influenza virus
AHKQLTHHM

SEQ ID NO: 463278 - protein, 9 aa, Influenza virus
AHKSCLPAC

SEQ ID NO: 463279 - protein, 9 aa, Influenza virus
AHKSQLIWM

SEQ ID NO: 463280 - protein, 9 aa, Influenza virus
AHKSQLVWM

SEQ ID NO: 463281 - protein, 9 aa, Influenza virus
AHNGKLCRL

SEQ ID NO: 463282 - protein, 9 aa, Influenza virus
AHTKVLYFH

SEQ ID NO: 463283 - protein, 9 aa, Influenza virus
AHVLVTREP

SEQ ID NO: 463284 - protein, 9 aa, Influenza virus
AIAGFIEGG

SEQ ID NO: 463285 - protein, 9 aa, Influenza virus
AIAGFIEGR

SEQ ID NO: 463286 - protein, 9 aa, Influenza virus
AIAGFIENG

SEQ ID NO: 463287 - protein, 9 aa, Influenza virus
AIALGIINL

SEQ ID NO: 463288 - protein, 9 aa, Influenza virus
AIALSILNL

SEQ ID NO: 463289 - protein, 9 aa, Influenza virus
AIALSVLNL

SEQ ID NO: 463290 - protein, 9 aa, Influenza virus
AIAMGFVFI

SEQ ID NO: 463291 - protein, 9 aa, Influenza virus
AIAMGLIFM

SEQ ID NO: 463292 - protein, 9 aa, Influenza virus
AIAMGLVFI

SEQ ID NO: 463293 - protein, 9 aa, Influenza virus
AIAMGLVFM

SEQ ID NO: 463294 - protein, 9 aa, Influenza virus
AIASKDNGI

SEQ ID NO: 463295 - protein, 9 aa, Influenza virus
AIATPGMQI

SEQ ID NO: 463296 - protein, 9 aa, Influenza virus
AICTHLEIC

SEQ ID NO: 463297 - protein, 9 aa, Influenza virus
AICTHLEVC

SEQ ID NO: 463298 - protein, 9 aa, Influenza virus
AICTHMEVC

SEQ ID NO: 463299 - protein, 9 aa, Influenza virus
AIDAGDGCF

SEQ ID NO: 463300 - protein, 9 aa, Influenza virus
AIDAGNGCF

SEQ ID NO: 463301 - protein, 9 aa, Influenza virus
AIDEGDGCF

SEQ ID NO: 463302 - protein, 9 aa, Influenza virus
AIDEGNGCF

SEQ ID NO: 463303 - protein, 9 aa, Influenza virus
AIDEITTKI

SEQ ID NO: 463304 - protein, 9 aa, Influenza virus
AIDGITNKI

SEQ ID NO: 463305 - protein, 9 aa, Influenza virus
AIDGITNKV

SEQ ID NO: 463306 - protein, 9 aa, Influenza virus
AIDGVTNKV

SEQ ID NO: 463307 - protein, 9 aa, Influenza virus
AIDIMQNKL

SEQ ID NO: 463308 - protein, 9 aa, Influenza virus
AIDKITNKI

SEQ ID NO: 463309 - protein, 9 aa, Influenza virus
AIDKITNKV

SEQ ID NO: 463310 - protein, 9 aa, Influenza virus
AIDNGDGCF

SEQ ID NO: 463311 - protein, 9 aa, Influenza virus
AIDNMQNKL

SEQ ID NO: 463312 - protein, 9 aa, Influenza virus
AIDNMQNRL

SEQ ID NO: 463313 - protein, 9 aa, Influenza virus
AIDQINGKL

SEQ ID NO: 463314 - protein, 9 aa, Influenza virus
AIDQITGKL

SEQ ID NO: 463315 - protein, 9 aa, Influenza virus
AIDQITGTL

SEQ ID NO: 463316 - protein, 9 aa, Influenza virus
AIDQITRKL

SEQ ID NO: 463317 - protein, 9 aa, Influenza virus
AIDQITTKI

SEQ ID NO: 463318 - protein, 9 aa, Influenza virus
AIDQVNGKL

SEQ ID NO: 463319 - protein, 9 aa, Influenza virus
AIDQVTGKL

SEQ ID NO: 463320 - protein, 9 aa, Influenza virus
AIDRITTKI

SEQ ID NO: 463321 - protein, 9 aa, Influenza virus
AIDTGDGCF

SEQ ID NO: 463322 - protein, 9 aa, Influenza virus
AIDTGKGCF

SEQ ID NO: 463323 - protein, 9 aa, Influenza virus
AIDTGNGCF

SEQ ID NO: 463324 - protein, 9 aa, Influenza virus
AIEECLIND

SEQ ID NO: 463325 - protein, 9 aa, Influenza virus
AIEKITNKV

SEQ ID NO: 463326 - protein, 9 aa, Influenza virus
AIENQHTID

SEQ ID NO: 463327 - protein, 9 aa, Influenza virus
AIFSKDNGI

SEQ ID NO: 463328 - protein, 9 aa, Influenza virus
AIGAIDSSM

SEQ ID NO: 463329 - protein, 9 aa, Influenza virus
AIGDCPKYI

SEQ ID NO: 463330 - protein, 9 aa, Influenza virus
AIGDCPKYV

SEQ ID NO: 463331 - protein, 9 aa, Influenza virus
AIGECPKYV

SEQ ID NO: 463332 - protein, 9 aa, Influenza virus
AIGGSGTDN

SEQ ID NO: 463333 - protein, 9 aa, Influenza virus
AIGGSGTNN

SEQ ID NO: 463334 - protein, 9 aa, Influenza virus
AIGKITNKV

SEQ ID NO: 463335 - protein, 9 aa, Influenza virus
AIGLRISSS

SEQ ID NO: 463336 - protein, 9 aa, Influenza virus
AIGLRNTPS

SEQ ID NO: 463337 - protein, 9 aa, Influenza virus
AIGLRNVPQ

SEQ ID NO: 463338 - protein, 9 aa, Influenza virus
AIGNCPKYV

SEQ ID NO: 463339 - protein, 9 aa, Influenza virus
AIGPRNVPQ

SEQ ID NO: 463340 - protein, 9 aa, Influenza virus
AIHHPPTSA

SEQ ID NO: 463341 - protein, 9 aa, Influenza virus
AIHHPPTSD

SEQ ID NO: 463342 - protein, 9 aa, Influenza virus
AIHHPPTSN

SEQ ID NO: 463343 - protein, 9 aa, Influenza virus
AIHHPPTTD

SEQ ID NO: 463344 - protein, 9 aa, Influenza virus
AIIIAGLSF

SEQ ID NO: 463345 - protein, 9 aa, Influenza virus
AIIKKYTSA

SEQ ID NO: 463346 - protein, 9 aa, Influenza virus
AIIKKYTSG

SEQ ID NO: 463347 - protein, 9 aa, Influenza virus
AIISKDNGI

SEQ ID NO: 463348 - protein, 9 aa, Influenza virus
AILAATVTL

SEQ ID NO: 463349 - protein, 9 aa, Influenza virus
AILATTITL

SEQ ID NO: 463350 - protein, 9 aa, Influenza virus
AILATTVTL

SEQ ID NO: 463351 - protein, 9 aa, Influenza virus
AILIAGGLI

SEQ ID NO: 463352 - protein, 9 aa, Influenza virus
AILKPGQTV

SEQ ID NO: 463353 - protein, 9 aa, Influenza virus
AILPFDIDK

SEQ ID NO: 463354 - protein, 9 aa, Influenza virus
AILPLTSIR

SEQ ID NO: 463355 - protein, 9 aa, Influenza virus
AILVAGGLI

SEQ ID NO: 463356 - protein, 9 aa, Influenza virus
AILVTTVTL

SEQ ID NO: 463357 - protein, 9 aa, Influenza virus
AIMIAGLFF

SEQ ID NO: 463358 - protein, 9 aa, Influenza virus
AIMIAGLSF

SEQ ID NO: 463359 - protein, 9 aa, Influenza virus
AIMMAGLSF

SEQ ID NO: 463360 - protein, 9 aa, Influenza virus
AIMVAGLSF

SEQ ID NO: 463361 - protein, 9 aa, Influenza virus
AINEGNGCF

SEQ ID NO: 463362 - protein, 9 aa, Influenza virus
AINEITTKI

SEQ ID NO: 463363 - protein, 9 aa, Influenza virus
AINGVTNKV

SEQ ID NO: 463364 - protein, 9 aa, Influenza virus
AINKITNKV

SEQ ID NO: 463365 - protein, 9 aa, Influenza virus
AINLYASKN

SEQ ID NO: 463366 - protein, 9 aa, Influenza virus
AINNRFQIQ

SEQ ID NO: 463367 - protein, 9 aa, Influenza virus
AINNRIKIN

SEQ ID NO: 463368 - protein, 9 aa, Influenza virus
AINQINGKL

SEQ ID NO: 463369 - protein, 9 aa, Influenza virus
AINQITGKL

SEQ ID NO: 463370 - protein, 9 aa, Influenza virus
AINSRFQIQ

SEQ ID NO: 463371 - protein, 9 aa, Influenza virus
AINSSKPFQ

SEQ ID NO: 463372 - protein, 9 aa, Influenza virus
AINSSKPLQ

SEQ ID NO: 463373 - protein, 9 aa, Influenza virus
AINSSMPFH

SEQ ID NO: 463374 - protein, 9 aa, Influenza virus
AINSSMPLH

SEQ ID NO: 463375 - protein, 9 aa, Influenza virus
AINSSRPFQ

SEQ ID NO: 463376 - protein, 9 aa, Influenza virus
AINTSMPFH

SEQ ID NO: 463377 - protein, 9 aa, Influenza virus
AINTTLPFH

SEQ ID NO: 463378 - protein, 9 aa, Influenza virus
AIRFGEGEQ

SEQ ID NO: 463379 - protein, 9 aa, Influenza virus
AIRFGESEQ

SEQ ID NO: 463380 - protein, 9 aa, Influenza virus
AIRIGEDAH

SEQ ID NO: 463381 - protein, 9 aa, Influenza virus
AIRIGEEAH

SEQ ID NO: 463382 - protein, 9 aa, Influenza virus
AIRIGEGAH

SEQ ID NO: 463383 - protein, 9 aa, Influenza virus
AIRIGENAH

SEQ ID NO: 463384 - protein, 9 aa, Influenza virus
AIRNGTYNH

SEQ ID NO: 463385 - protein, 9 aa, Influenza virus
AIRPKVNGQ

SEQ ID NO: 463386 - protein, 9 aa, Influenza virus
AIRTRSGGN

SEQ ID NO: 463387 - protein, 9 aa, Influenza virus
AISFWMCSG

SEQ ID NO: 463388 - protein, 9 aa, Influenza virus
AISFWMCSN

SEQ ID NO: 463389 - protein, 9 aa, Influenza virus
AISNRFQIQ

SEQ ID NO: 463390 - protein, 9 aa, Influenza virus
AISTTFPYT

SEQ ID NO: 463391 - protein, 9 aa, Influenza virus
AITRSGQNH

SEQ ID NO: 463392 - protein, 9 aa, Influenza virus
AIVFSQEDC

SEQ ID NO: 463393 - protein, 9 aa, Influenza virus
AIVLGIINL

SEQ ID NO: 463394 - protein, 9 aa, Influenza virus
AIVMGLVFI

SEQ ID NO: 463395 - protein, 9 aa, Influenza virus
AIVQITGKL

SEQ ID NO: 463396 - protein, 9 aa, Influenza virus
AIVSADPLA

SEQ ID NO: 463397 - protein, 9 aa, Influenza virus
AIVSKDNGI

SEQ ID NO: 463398 - protein, 9 aa, Influenza virus
AIWTSGSSI

SEQ ID NO: 463399 - protein, 9 aa, Influenza virus
AIWTSSSSI

SEQ ID NO: 463400 - protein, 9 aa, Influenza virus
AIWVTREPY

SEQ ID NO: 463401 - protein, 9 aa, Influenza virus
AIYATVAGS

SEQ ID NO: 463402 - protein, 9 aa, Influenza virus
AIYSCIASS

SEQ ID NO: 463403 - protein, 9 aa, Influenza virus
AIYSTAASS

SEQ ID NO: 463404 - protein, 9 aa, Influenza virus
AIYSTISSS

SEQ ID NO: 463405 - protein, 9 aa, Influenza virus
AIYSTVASS

SEQ ID NO: 463406 - protein, 9 aa, Influenza virus
AIYSTVSSS

SEQ ID NO: 463407 - protein, 9 aa, Influenza virus
AKAGFIEGG

SEQ ID NO: 463408 - protein, 9 aa, Influenza virus
AKAGFIENG

SEQ ID NO: 463409 - protein, 9 aa, Influenza virus
AKAGVKMNP

SEQ ID NO: 463410 - protein, 9 aa, Influenza virus
AKAMEQMAG

SEQ ID NO: 463411 - protein, 9 aa, Influenza virus
AKAMEQVAG

SEQ ID NO: 463412 - protein, 9 aa, Influenza virus
AKCNTKCQT

SEQ ID NO: 463413 - protein, 9 aa, Influenza virus
AKDEGNGCF

SEQ ID NO: 463414 - protein, 9 aa, Influenza virus
AKDILEKTH

SEQ ID NO: 463415 - protein, 9 aa, Influenza virus
AKDLGNGCF

SEQ ID NO: 463416 - protein, 9 aa, Influenza virus
AKDNAIRFG

SEQ ID NO: 463417 - protein, 9 aa, Influenza virus
AKDNAVRFG

SEQ ID NO: 463418 - protein, 9 aa, Influenza virus
AKDNSIRLS

SEQ ID NO: 463419 - protein, 9 aa, Influenza virus
AKEAQDVIM

SEQ ID NO: 463420 - protein, 9 aa, Influenza virus
AKEECYRAC

SEQ ID NO: 463421 - protein, 9 aa, Influenza virus
AKEIALSYS

SEQ ID NO: 463422 - protein, 9 aa, Influenza virus
AKEIGNGCF

SEQ ID NO: 463423 - protein, 9 aa, Influenza virus
AKELGNGCF

SEQ ID NO: 463424 - protein, 9 aa, Influenza virus
AKELVETNH

SEQ ID NO: 463425 - protein, 9 aa, Influenza virus
AKEMGNGCF

SEQ ID NO: 463426 - protein, 9 aa, Influenza virus
AKEQTALYK

SEQ ID NO: 463427 - protein, 9 aa, Influenza virus
AKEQTTLYK

SEQ ID NO: 463428 - protein, 9 aa, Influenza virus
AKETGNGCF

SEQ ID NO: 463429 - protein, 9 aa, Influenza virus
AKEVALGYS

SEQ ID NO: 463430 - protein, 9 aa, Influenza virus
AKEVALSYS

SEQ ID NO: 463431 - protein, 9 aa, Influenza virus
AKEVGNGCF

SEQ ID NO: 463432 - protein, 9 aa, Influenza virus
AKEVSLSYS

SEQ ID NO: 463433 - protein, 9 aa, Influenza virus
AKEWGNGCF

SEQ ID NO: 463434 - protein, 9 aa, Influenza virus
AKFEAVAWS

SEQ ID NO: 463435 - protein, 9 aa, Influenza virus
AKFESVAWS

SEQ ID NO: 463436 - protein, 9 aa, Influenza virus
AKGDCYRAC

SEQ ID NO: 463437 - protein, 9 aa, Influenza virus
AKGDKICLG

SEQ ID NO: 463438 - protein, 9 aa, Influenza virus
AKGECYRAC

SEQ ID NO: 463439 - protein, 9 aa, Influenza virus
AKGEKANVL

SEQ ID NO: 463440 - protein, 9 aa, Influenza virus
AKGLFGAIA

SEQ ID NO: 463441 - protein, 9 aa, Influenza virus
AKGSYNNTN

SEQ ID NO: 463442 - protein, 9 aa, Influenza virus
AKGSYNNTS

SEQ ID NO: 463443 - protein, 9 aa, Influenza virus
AKHIEECSC

SEQ ID NO: 463444 - protein, 9 aa, Influenza virus
AKHIEECSS

SEQ ID NO: 463445 - protein, 9 aa, Influenza virus
AKHVEECSC

SEQ ID NO: 463446 - protein, 9 aa, Influenza virus
AKILTSESQ

SEQ ID NO: 463447 - protein, 9 aa, Influenza virus
AKKASLRLA

SEQ ID NO: 463448 - protein, 9 aa, Influenza virus
AKLANVVRK

SEQ ID NO: 463449 - protein, 9 aa, Influenza virus
AKLEKSRIN

SEQ ID NO: 463450 - protein, 9 aa, Influenza virus
AKLERSKIN

SEQ ID NO: 463451 - protein, 9 aa, Influenza virus
AKLLVLIEN

SEQ ID NO: 463452 - protein, 9 aa, Influenza virus
AKLLVLLEN

SEQ ID NO: 463453 - protein, 9 aa, Influenza virus
AKNGICYPG

SEQ ID NO: 463454 - protein, 9 aa, Influenza virus
AKNILEKTH

SEQ ID NO: 463455 - protein, 9 aa, Influenza virus
AKNILRTQE

SEQ ID NO: 463456 - protein, 9 aa, Influenza virus
AKRSYNNTS

SEQ ID NO: 463457 - protein, 9 aa, Influenza virus
AKSITQTLV

SEQ ID NO: 463458 - protein, 9 aa, Influenza virus
AKSLTQTLV

SEQ ID NO: 463459 - protein, 9 aa, Influenza virus
AKSVFNCLY

SEQ ID NO: 463460 - protein, 9 aa, Influenza virus
AKSVFNNLY

SEQ ID NO: 463461 - protein, 9 aa, Influenza virus
AKSVFNSIY

SEQ ID NO: 463462 - protein, 9 aa, Influenza virus
AKSVFNSLY

SEQ ID NO: 463463 - protein, 9 aa, Influenza virus
AKSVTQTLV

SEQ ID NO: 463464 - protein, 9 aa, Influenza virus
AKVNTLTER

SEQ ID NO: 463465 - protein, 9 aa, Influenza virus
AKYVEWTSN

SEQ ID NO: 463466 - protein, 9 aa, Influenza virus
AKYVWWASN

SEQ ID NO: 463467 - protein, 9 aa, Influenza virus
AKYVWWTSN

SEQ ID NO: 463468 - protein, 9 aa, Influenza virus
ALALSHTAY

SEQ ID NO: 463469 - protein, 9 aa, Influenza virus
ALANTIEIF

SEQ ID NO: 463470 - protein, 9 aa, Influenza virus
ALANTIEVF

SEQ ID NO: 463471 - protein, 9 aa, Influenza virus
ALAQGALLG

SEQ ID NO: 463472 - protein, 9 aa, Influenza virus
ALAQGALVG

SEQ ID NO: 463473 - protein, 9 aa, Influenza virus
ALAQGTLLG

SEQ ID NO: 463474 - protein, 9 aa, Influenza virus
ALAQGVLLG

SEQ ID NO: 463475 - protein, 9 aa, Influenza virus
ALASCMGLI

SEQ ID NO: 463476 - protein, 9 aa, Influenza virus
ALCGSKEQL

SEQ ID NO: 463477 - protein, 9 aa, Influenza virus
ALCGSKERL

SEQ ID NO: 463478 - protein, 9 aa, Influenza virus
ALCGSPFPV

SEQ ID NO: 463479 - protein, 9 aa, Influenza virus
ALCGSPISV

SEQ ID NO: 463480 - protein, 9 aa, Influenza virus
ALCGSPVPV

SEQ ID NO: 463481 - protein, 9 aa, Influenza virus
ALCGSPVSV

SEQ ID NO: 463482 - protein, 9 aa, Influenza virus
ALCGSRERL

SEQ ID NO: 463483 - protein, 9 aa, Influenza virus
ALDTGDGCF

SEQ ID NO: 463484 - protein, 9 aa, Influenza virus
ALENQHTID

SEQ ID NO: 463485 - protein, 9 aa, Influenza virus
ALENQHTIH

SEQ ID NO: 463486 - protein, 9 aa, Influenza virus
ALENQNTID

SEQ ID NO: 463487 - protein, 9 aa, Influenza virus
ALFIGVGNL

SEQ ID NO: 463488 - protein, 9 aa, Influenza virus
ALFLAFILW

SEQ ID NO: 463489 - protein, 9 aa, Influenza virus
ALFVYSLRK

SEQ ID NO: 463490 - protein, 9 aa, Influenza virus
ALGDCPKYI

SEQ ID NO: 463491 - protein, 9 aa, Influenza virus
ALGECPKYI

SEQ ID NO: 463492 - protein, 9 aa, Influenza virus
ALGENMAPE

SEQ ID NO: 463493 - protein, 9 aa, Influenza virus
ALGIINLLI

SEQ ID NO: 463494 - protein, 9 aa, Influenza virus
ALGLRISSS

SEQ ID NO: 463495 - protein, 9 aa, Influenza virus
ALGLRNTPS

SEQ ID NO: 463496 - protein, 9 aa, Influenza virus
ALGLVCATC

SEQ ID NO: 463497 - protein, 9 aa, Influenza virus
ALGMKNVPE

SEQ ID NO: 463498 - protein, 9 aa, Influenza virus
ALGNCPKYI

SEQ ID NO: 463499 - protein, 9 aa, Influenza virus
ALGQGTTLD

SEQ ID NO: 463500 - protein, 9 aa, Influenza virus
ALGQGTTLE

SEQ ID NO: 463501 - protein, 9 aa, Influenza virus
ALGQGTTLK

SEQ ID NO: 463502 - protein, 9 aa, Influenza virus
ALGQGTTLN

SEQ ID NO: 463503 - protein, 9 aa, Influenza virus
ALGQGTTLS

SEQ ID NO: 463504 - protein, 9 aa, Influenza virus
ALGQGTTLY

SEQ ID NO: 463505 - protein, 9 aa, Influenza virus
ALGSPGCDH

SEQ ID NO: 463506 - protein, 9 aa, Influenza virus
ALGSPGCDR

SEQ ID NO: 463507 - protein, 9 aa, Influenza virus
ALGYSTGAL

SEQ ID NO: 463508 - protein, 9 aa, Influenza virus
ALHQGTTIR

SEQ ID NO: 463509 - protein, 9 aa, Influenza virus
ALIDDRSKP

SEQ ID NO: 463510 - protein, 9 aa, Influenza virus
ALIIGVGNL

SEQ ID NO: 463511 - protein, 9 aa, Influenza virus
ALIIWGIHH

SEQ ID NO: 463512 - protein, 9 aa, Influenza virus
ALIIWGVHH

SEQ ID NO: 463513 - protein, 9 aa, Influenza virus
ALILGFVLW

SEQ ID NO: 463514 - protein, 9 aa, Influenza virus
ALILRGAVA

SEQ ID NO: 463515 - protein, 9 aa, Influenza virus
ALILRGSIA

SEQ ID NO: 463516 - protein, 9 aa, Influenza virus
ALILRGSVA

SEQ ID NO: 463517 - protein, 9 aa, Influenza virus
ALILVALAL

SEQ ID NO: 463518 - protein, 9 aa, Influenza virus
ALISWEMGL

SEQ ID NO: 463519 - protein, 9 aa, Influenza virus
ALISWEMGQ

SEQ ID NO: 463520 - protein, 9 aa, Influenza virus
ALISWGMGQ

SEQ ID NO: 463521 - protein, 9 aa, Influenza virus
ALISWPLSS

SEQ ID NO: 463522 - protein, 9 aa, Influenza virus
ALISWPQSS

SEQ ID NO: 463523 - protein, 9 aa, Influenza virus
ALITWGIHH

SEQ ID NO: 463524 - protein, 9 aa, Influenza virus
ALIVWGIHH

SEQ ID NO: 463525 - protein, 9 aa, Influenza virus
ALIVWGVHH

SEQ ID NO: 463526 - protein, 9 aa, Influenza virus
ALKDNLEPG

SEQ ID NO: 463527 - protein, 9 aa, Influenza virus
ALKLSIEDP

SEQ ID NO: 463528 - protein, 9 aa, Influenza virus
ALKLVVAML

SEQ ID NO: 463529 - protein, 9 aa, Influenza virus
ALKMTIASD

SEQ ID NO: 463530 - protein, 9 aa, Influenza virus
ALLEESHPG

SEQ ID NO: 463531 - protein, 9 aa, Influenza virus
ALLGDPHCD

SEQ ID NO: 463532 - protein, 9 aa, Influenza virus
ALLGDPQCD

SEQ ID NO: 463533 - protein, 9 aa, Influenza virus
ALLGTKHSN

SEQ ID NO: 463534 - protein, 9 aa, Influenza virus
ALLGTNHSN

SEQ ID NO: 463535 - protein, 9 aa, Influenza virus
ALLGTRHSN

SEQ ID NO: 463536 - protein, 9 aa, Influenza virus
ALLIAFVLW

SEQ ID NO: 463537 - protein, 9 aa, Influenza virus
ALLIGIGNL

SEQ ID NO: 463538 - protein, 9 aa, Influenza virus
ALLIGVGNL

SEQ ID NO: 463539 - protein, 9 aa, Influenza virus
ALLKHRFEI

SEQ ID NO: 463540 - protein, 9 aa, Influenza virus
ALLLAFILW

SEQ ID NO: 463541 - protein, 9 aa, Influenza virus
ALLLAFMLW

SEQ ID NO: 463542 - protein, 9 aa, Influenza virus
ALLLAFVLW

SEQ ID NO: 463543 - protein, 9 aa, Influenza virus
ALLNASCAA

SEQ ID NO: 463544 - protein, 9 aa, Influenza virus
ALLNDKHSN

SEQ ID NO: 463545 - protein, 9 aa, Influenza virus
ALLNDRHSN

SEQ ID NO: 463546 - protein, 9 aa, Influenza virus
ALLNRLNIN

SEQ ID NO: 463547 - protein, 9 aa, Influenza virus
ALLNRLSIN

SEQ ID NO: 463548 - protein, 9 aa, Influenza virus
ALLPFDIDK

SEQ ID NO: 463549 - protein, 9 aa, Influenza virus
ALLPFDIDR

SEQ ID NO: 463550 - protein, 9 aa, Influenza virus
ALLSRLNIN

SEQ ID NO: 463551 - protein, 9 aa, Influenza virus
ALLVGIGNL

SEQ ID NO: 463552 - protein, 9 aa, Influenza virus
ALMEWIKTR

SEQ ID NO: 463553 - protein, 9 aa, Influenza virus
ALMEWLKTR

SEQ ID NO: 463554 - protein, 9 aa, Influenza virus
ALMSCPIGE

SEQ ID NO: 463555 - protein, 9 aa, Influenza virus
ALMSCPLGE

SEQ ID NO: 463556 - protein, 9 aa, Influenza virus
ALMSVPLGS

SEQ ID NO: 463557 - protein, 9 aa, Influenza virus
ALMSVPMGS

SEQ ID NO: 463558 - protein, 9 aa, Influenza virus
ALNEITTKI

SEQ ID NO: 463559 - protein, 9 aa, Influenza virus
ALNGNGDPN

SEQ ID NO: 463560 - protein, 9 aa, Influenza virus
ALNNRFQIK

SEQ ID NO: 463561 - protein, 9 aa, Influenza virus
ALNNRSQIK

SEQ ID NO: 463562 - protein, 9 aa, Influenza virus
ALNTTLPFH

SEQ ID NO: 463563 - protein, 9 aa, Influenza virus
ALQGTKRSY

SEQ ID NO: 463564 - protein, 9 aa, Influenza virus
ALQLFIKDY

SEQ ID NO: 463565 - protein, 9 aa, Influenza virus
ALQLLFEVE

SEQ ID NO: 463566 - protein, 9 aa, Influenza virus
ALQLLLEVE

SEQ ID NO: 463567 - protein, 9 aa, Influenza virus
ALQLNPIDG

SEQ ID NO: 463568 - protein, 9 aa, Influenza virus
ALQNRIMIN

SEQ ID NO: 463569 - protein, 9 aa, Influenza virus
ALRDNLEPG

SEQ ID NO: 463570 - protein, 9 aa, Influenza virus
ALRDSLEPG

SEQ ID NO: 463571 - protein, 9 aa, Influenza virus
ALRELWQCY

SEQ ID NO: 463572 - protein, 9 aa, Influenza virus
ALRMKWMMA

SEQ ID NO: 463573 - protein, 9 aa, Influenza virus
ALRQIIRES

SEQ ID NO: 463574 - protein, 9 aa, Influenza virus
ALRQKIMES

SEQ ID NO: 463575 - protein, 9 aa, Influenza virus
ALSGMAIAL

SEQ ID NO: 463576 - protein, 9 aa, Influenza virus
ALSGNGDPN

SEQ ID NO: 463577 - protein, 9 aa, Influenza virus
ALSGVAIAL

SEQ ID NO: 463578 - protein, 9 aa, Influenza virus
ALSGVAISL

SEQ ID NO: 463579 - protein, 9 aa, Influenza virus
ALSGVAVAL

SEQ ID NO: 463580 - protein, 9 aa, Influenza virus
ALSHTAYSQ

SEQ ID NO: 463581 - protein, 9 aa, Influenza virus
ALSIAPIMF

SEQ ID NO: 463582 - protein, 9 aa, Influenza virus
ALSILNLLI

SEQ ID NO: 463583 - protein, 9 aa, Influenza virus
ALSINELGN

SEQ ID NO: 463584 - protein, 9 aa, Influenza virus
ALSINELSK

SEQ ID NO: 463585 - protein, 9 aa, Influenza virus
ALSINELSN

SEQ ID NO: 463586 - protein, 9 aa, Influenza virus
ALSINELSS

SEQ ID NO: 463587 - protein, 9 aa, Influenza virus
ALSISELSN

SEQ ID NO: 463588 - protein, 9 aa, Influenza virus
ALSIYSCIA

SEQ ID NO: 463589 - protein, 9 aa, Influenza virus
ALSNRFQIK

SEQ ID NO: 463590 - protein, 9 aa, Influenza virus
ALSQGALLG

SEQ ID NO: 463591 - protein, 9 aa, Influenza virus
ALSQGTTIR

SEQ ID NO: 463592 - protein, 9 aa, Influenza virus
ALSQGTTLR

SEQ ID NO: 463593 - protein, 9 aa, Influenza virus
ALSVLNLLI

SEQ ID NO: 463594 - protein, 9 aa, Influenza virus
ALSYSAGAL

SEQ ID NO: 463595 - protein, 9 aa, Influenza virus
ALSYSTGAL

SEQ ID NO: 463596 - protein, 9 aa, Influenza virus
ALTDDKSKP

SEQ ID NO: 463597 - protein, 9 aa, Influenza virus
ALTDDRSKP

SEQ ID NO: 463598 - protein, 9 aa, Influenza virus
ALTDERSKP

SEQ ID NO: 463599 - protein, 9 aa, Influenza virus
ALTDNRSKP

SEQ ID NO: 463600 - protein, 9 aa, Influenza virus
ALTGGQSFY

SEQ ID NO: 463601 - protein, 9 aa, Influenza virus
ALTLNTMTK

SEQ ID NO: 463602 - protein, 9 aa, Influenza virus
ALVGTKHSN

SEQ ID NO: 463603 - protein, 9 aa, Influenza virus
ALVIWGVHH

SEQ ID NO: 463604 - protein, 9 aa, Influenza virus
ALVRGQQGR

SEQ ID NO: 463605 - protein, 9 aa, Influenza virus
ALVRSGMDP

SEQ ID NO: 463606 - protein, 9 aa, Influenza virus
ALVRTGMDP

SEQ ID NO: 463607 - protein, 9 aa, Influenza virus
ALVSWEMGQ

SEQ ID NO: 463608 - protein, 9 aa, Influenza virus
ALVSWPLSS

SEQ ID NO: 463609 - protein, 9 aa, Influenza virus
ALYGTQSLS

SEQ ID NO: 463610 - protein, 9 aa, Influenza virus
ALYKNANTL

SEQ ID NO: 463611 - protein, 9 aa, Influenza virus
AMAFLEDSH

SEQ ID NO: 463612 - protein, 9 aa, Influenza virus
AMAFLEESH

SEQ ID NO: 463613 - protein, 9 aa, Influenza virus
AMAFLEKSH

SEQ ID NO: 463614 - protein, 9 aa, Influenza virus
AMAFLENSH

SEQ ID NO: 463615 - protein, 9 aa, Influenza virus
AMALLEESH

SEQ ID NO: 463616 - protein, 9 aa, Influenza virus
AMASQGTKR

SEQ ID NO: 463617 - protein, 9 aa, Influenza virus
AMDAGNGCF

SEQ ID NO: 463618 - protein, 9 aa, Influenza virus
AMDDFQLIP

SEQ ID NO: 463619 - protein, 9 aa, Influenza virus
AMDEFQLIP

SEQ ID NO: 463620 - protein, 9 aa, Influenza virus
AMDHTSQYL

SEQ ID NO: 463621 - protein, 9 aa, Influenza virus
AMEDFQLIP

SEQ ID NO: 463622 - protein, 9 aa, Influenza virus
AMEHTSQYL

SEQ ID NO: 463623 - protein, 9 aa, Influenza virus
AMELIRMIK

SEQ ID NO: 463624 - protein, 9 aa, Influenza virus
AMELVEAEK

SEQ ID NO: 463625 - protein, 9 aa, Influenza virus
AMENQHTID

SEQ ID NO: 463626 - protein, 9 aa, Influenza virus
AMEQMAGSS

SEQ ID NO: 463627 - protein, 9 aa, Influenza virus
AMEQVAGSS

SEQ ID NO: 463628 - protein, 9 aa, Influenza virus
AMGLIFMCV

SEQ ID NO: 463629 - protein, 9 aa, Influenza virus
AMGLKISSS

SEQ ID NO: 463630 - protein, 9 aa, Influenza virus
AMGLRISSS

SEQ ID NO: 463631 - protein, 9 aa, Influenza virus
AMGLVFICI

SEQ ID NO: 463632 - protein, 9 aa, Influenza virus
AMGLVFICM

SEQ ID NO: 463633 - protein, 9 aa, Influenza virus
AMGLVFICV

SEQ ID NO: 463634 - protein, 9 aa, Influenza virus
AMGLVFMCV

SEQ ID NO: 463635 - protein, 9 aa, Influenza virus
AMGMRISSS

SEQ ID NO: 463636 - protein, 9 aa, Influenza virus
AMISRARID

SEQ ID NO: 463637 - protein, 9 aa, Influenza virus
AMKHTSQYI

SEQ ID NO: 463638 - protein, 9 aa, Influenza virus
AMKHTSQYL

SEQ ID NO: 463639 - protein, 9 aa, Influenza virus
AMKYPITAD

SEQ ID NO: 463640 - protein, 9 aa, Influenza virus
AMKYPITAE

SEQ ID NO: 463641 - protein, 9 aa, Influenza virus
AMKYPITAN

SEQ ID NO: 463642 - protein, 9 aa, Influenza virus
AMLGDPHCD

SEQ ID NO: 463643 - protein, 9 aa, Influenza virus
AMLNASCAA

SEQ ID NO: 463644 - protein, 9 aa, Influenza virus
AMMDQVREG

SEQ ID NO: 463645 - protein, 9 aa, Influenza virus
AMMDQVRES

SEQ ID NO: 463646 - protein, 9 aa, Influenza virus
AMMSRARID

SEQ ID NO: 463647 - protein, 9 aa, Influenza virus
AMQNRIQID

SEQ ID NO: 463648 - protein, 9 aa, Influenza virus
AMRAIGTHP

SEQ ID NO: 463649 - protein, 9 aa, Influenza virus
AMRAVGTHP

SEQ ID NO: 463650 - protein, 9 aa, Influenza virus
AMRTIGTHP

SEQ ID NO: 463651 - protein, 9 aa, Influenza virus
AMRTIGTQP

SEQ ID NO: 463652 - protein, 9 aa, Influenza virus
AMRTVGTHP

SEQ ID NO: 463653 - protein, 9 aa, Influenza virus
AMRYPITAD

SEQ ID NO: 463654 - protein, 9 aa, Influenza virus
AMTEIWSYN

SEQ ID NO: 463655 - protein, 9 aa, Influenza virus
AMTEVWSYN

SEQ ID NO: 463656 - protein, 9 aa, Influenza virus
AMTHTSQYI

SEQ ID NO: 463657 - protein, 9 aa, Influenza virus
AMVDQVRES

SEQ ID NO: 463658 - protein, 9 aa, Influenza virus
AMVFSQEDC

SEQ ID NO: 463659 - protein, 9 aa, Influenza virus
AMVFSQEEC

SEQ ID NO: 463660 - protein, 9 aa, Influenza virus
AMVSRARID

SEQ ID NO: 463661 - protein, 9 aa, Influenza virus
ANDLGNGCF

SEQ ID NO: 463662 - protein, 9 aa, Influenza virus
ANEESLRQI

SEQ ID NO: 463663 - protein, 9 aa, Influenza virus
ANEIRASVG

SEQ ID NO: 463664 - protein, 9 aa, Influenza virus
ANFSMELPS

SEQ ID NO: 463665 - protein, 9 aa, Influenza virus
ANGTIHDRS

SEQ ID NO: 463666 - protein, 9 aa, Influenza virus
ANGTINDRS

SEQ ID NO: 463667 - protein, 9 aa, Influenza virus
ANGTIVKTL

SEQ ID NO: 463668 - protein, 9 aa, Influenza virus
ANGTKVNTL

SEQ ID NO: 463669 - protein, 9 aa, Influenza virus
ANGTMHDRS

SEQ ID NO: 463670 - protein, 9 aa, Influenza virus
ANGTVVKTL

SEQ ID NO: 463671 - protein, 9 aa, Influenza virus
ANGVKGFSF

SEQ ID NO: 463672 - protein, 9 aa, Influenza virus
ANGVKGFSY

SEQ ID NO: 463673 - protein, 9 aa, Influenza virus
ANGWVSTDK

SEQ ID NO: 463674 - protein, 9 aa, Influenza virus
ANGWVTADK

SEQ ID NO: 463675 - protein, 9 aa, Influenza virus
ANINFMPYI

SEQ ID NO: 463676 - protein, 9 aa, Influenza virus
ANIRNNTYD

SEQ ID NO: 463677 - protein, 9 aa, Influenza virus
ANKLYVNKN

SEQ ID NO: 463678 - protein, 9 aa, Influenza virus
ANKQASYKI

SEQ ID NO: 463679 - protein, 9 aa, Influenza virus
ANLCRFLET

SEQ ID NO: 463680 - protein, 9 aa, Influenza virus
ANLGLNIGI

SEQ ID NO: 463681 - protein, 9 aa, Influenza virus
ANLGLNIGL

SEQ ID NO: 463682 - protein, 9 aa, Influenza virus
ANLGLNVGL

SEQ ID NO: 463683 - protein, 9 aa, Influenza virus
ANNADHRIY

SEQ ID NO: 463684 - protein, 9 aa, Influenza virus
ANNADHRVY

SEQ ID NO: 463685 - protein, 9 aa, Influenza virus
ANNGKFEFI

SEQ ID NO: 463686 - protein, 9 aa, Influenza virus
ANNGRFEFI

SEQ ID NO: 463687 - protein, 9 aa, Influenza virus
ANNQASYKI

SEQ ID NO: 463688 - protein, 9 aa, Influenza virus
ANNQASYRI

SEQ ID NO: 463689 - protein, 9 aa, Influenza virus
ANNSKKQID

SEQ ID NO: 463690 - protein, 9 aa, Influenza virus
ANNSTDTID

SEQ ID NO: 463691 - protein, 9 aa, Influenza virus
ANNSTDTVD

SEQ ID NO: 463692 - protein, 9 aa, Influenza virus
ANNSTEHVD

SEQ ID NO: 463693 - protein, 9 aa, Influenza virus
ANNSTEQVD

SEQ ID NO: 463694 - protein, 9 aa, Influenza virus
ANNSTERVD

SEQ ID NO: 463695 - protein, 9 aa, Influenza virus
ANNSTETVD

SEQ ID NO: 463696 - protein, 9 aa, Influenza virus
ANNSTKQID

SEQ ID NO: 463697 - protein, 9 aa, Influenza virus
ANNSTKQVD

SEQ ID NO: 463698 - protein, 9 aa, Influenza virus
ANNSTTKVD

SEQ ID NO: 463699 - protein, 9 aa, Influenza virus
ANNSTTQID

SEQ ID NO: 463700 - protein, 9 aa, Influenza virus
ANNSTTQVD

SEQ ID NO: 463701 - protein, 9 aa, Influenza virus
ANNSTTQVN

SEQ ID NO: 463702 - protein, 9 aa, Influenza virus
ANNSTVQVD

SEQ ID NO: 463703 - protein, 9 aa, Influenza virus
ANPIVPSFD

SEQ ID NO: 463704 - protein, 9 aa, Influenza virus
ANQRLNPMH

SEQ ID NO: 463705 - protein, 9 aa, Influenza virus
ANQRLNTMH

SEQ ID NO: 463706 - protein, 9 aa, Influenza virus
ANQSLPPNF

SEQ ID NO: 463707 - protein, 9 aa, Influenza virus
ANQVFPQLN

SEQ ID NO: 463708 - protein, 9 aa, Influenza virus
ANRPAIEID

SEQ ID NO: 463709 - protein, 9 aa, Influenza virus
ANRPIIEID

SEQ ID NO: 463710 - protein, 9 aa, Influenza virus
ANRPIITID

SEQ ID NO: 463711 - protein, 9 aa, Influenza virus
ANRPIITIN

SEQ ID NO: 463712 - protein, 9 aa, Influenza virus
ANRPVIEID

SEQ ID NO: 463713 - protein, 9 aa, Influenza virus
ANRPVIEIN

SEQ ID NO: 463714 - protein, 9 aa, Influenza virus
ANRPVIIID

SEQ ID NO: 463715 - protein, 9 aa, Influenza virus
ANRPVIKID

SEQ ID NO: 463716 - protein, 9 aa, Influenza virus
ANRPVITID

SEQ ID NO: 463717 - protein, 9 aa, Influenza virus
ANRPVITIN

SEQ ID NO: 463718 - protein, 9 aa, Influenza virus
ANRPWVSFN

SEQ ID NO: 463719 - protein, 9 aa, Influenza virus
ANSADHRIY

SEQ ID NO: 463720 - protein, 9 aa, Influenza virus
ANSADHRVY

SEQ ID NO: 463721 - protein, 9 aa, Influenza virus
ANSAHHRVY

SEQ ID NO: 463722 - protein, 9 aa, Influenza virus
ANSIIVFCG

SEQ ID NO: 463723 - protein, 9 aa, Influenza virus
ANSQASYKI

SEQ ID NO: 463724 - protein, 9 aa, Influenza virus
ANSQAYTKV

SEQ ID NO: 463725 - protein, 9 aa, Influenza virus
ANTIEIFRS

SEQ ID NO: 463726 - protein, 9 aa, Influenza virus
ANTIEVFKS

SEQ ID NO: 463727 - protein, 9 aa, Influenza virus
ANTIEVFRL

SEQ ID NO: 463728 - protein, 9 aa, Influenza virus
ANTIEVFRS

SEQ ID NO: 463729 - protein, 9 aa, Influenza virus
ANTLSSVNT

SEQ ID NO: 463730 - protein, 9 aa, Influenza virus
ANTLSSVTT

SEQ ID NO: 463731 - protein, 9 aa, Influenza virus
ANTLTSVTT

SEQ ID NO: 463732 - protein, 9 aa, Influenza virus
ANTYRNTDS

SEQ ID NO: 463733 - protein, 9 aa, Influenza virus
ANVKNLHDQ

SEQ ID NO: 463734 - protein, 9 aa, Influenza virus
ANVKNLHEQ

SEQ ID NO: 463735 - protein, 9 aa, Influenza virus
ANVLIGQGD

SEQ ID NO: 463736 - protein, 9 aa, Influenza virus
ANVRNLHDQ

SEQ ID NO: 463737 - protein, 9 aa, Influenza virus
ANVRNLHDR

SEQ ID NO: 463738 - protein, 9 aa, Influenza virus
ANVRNLHEQ

SEQ ID NO: 463739 - protein, 9 aa, Influenza virus
ANVRNLHER

SEQ ID NO: 463740 - protein, 9 aa, Influenza virus
ANVVRKMMT

SEQ ID NO: 463741 - protein, 9 aa, Influenza virus
ANWSWHDGA

SEQ ID NO: 463742 - protein, 9 aa, Influenza virus
ANYSLPPNF

SEQ ID NO: 463743 - protein, 9 aa, Influenza virus
APACDLHLT

SEQ ID NO: 463744 - protein, 9 aa, Influenza virus
APDRASFFK

SEQ ID NO: 463745 - protein, 9 aa, Influenza virus
APDRASFFR

SEQ ID NO: 463746 - protein, 9 aa, Influenza virus
APDRASFLR

SEQ ID NO: 463747 - protein, 9 aa, Influenza virus
APDRATFLR

SEQ ID NO: 463748 - protein, 9 aa, Influenza virus
APDYHYEEC

SEQ ID NO: 463749 - protein, 9 aa, Influenza virus
APEFGYLLK

SEQ ID NO: 463750 - protein, 9 aa, Influenza virus
APEFGYLLR

SEQ ID NO: 463751 - protein, 9 aa, Influenza virus
APEGMCYPG

SEQ ID NO: 463752 - protein, 9 aa, Influenza virus
APEWSYIVE

SEQ ID NO: 463753 - protein, 9 aa, Influenza virus
APEYGFKIS

SEQ ID NO: 463754 - protein, 9 aa, Influenza virus
APEYGFRIS

SEQ ID NO: 463755 - protein, 9 aa, Influenza virus
APEYGHLIT

SEQ ID NO: 463756 - protein, 9 aa, Influenza virus
APEYGHLTT

SEQ ID NO: 463757 - protein, 9 aa, Influenza virus
APEYGHLVT

SEQ ID NO: 463758 - protein, 9 aa, Influenza virus
APEYGYLIT

SEQ ID NO: 463759 - protein, 9 aa, Influenza virus
APFAKDNSI

SEQ ID NO: 463760 - protein, 9 aa, Influenza virus
APFDDRLRR

SEQ ID NO: 463761 - protein, 9 aa, Influenza virus
APFISCSYL

SEQ ID NO: 463762 - protein, 9 aa, Influenza virus
APFLDRIRR

SEQ ID NO: 463763 - protein, 9 aa, Influenza virus
APFLDRLRR

SEQ ID NO: 463764 - protein, 9 aa, Influenza virus
APFSKDNGI

SEQ ID NO: 463765 - protein, 9 aa, Influenza virus
APFSKDNSI

SEQ ID NO: 463766 - protein, 9 aa, Influenza virus
APFSKDNSV

SEQ ID NO: 463767 - protein, 9 aa, Influenza virus
APFTKDNSI

SEQ ID NO: 463768 - protein, 9 aa, Influenza virus
APGFHFEEC

SEQ ID NO: 463769 - protein, 9 aa, Influenza virus
APGIKGFGF

SEQ ID NO: 463770 - protein, 9 aa, Influenza virus
APGTKGFGF

SEQ ID NO: 463771 - protein, 9 aa, Influenza virus
APGVKGFGF

SEQ ID NO: 463772 - protein, 9 aa, Influenza virus
APGWSWDDG

SEQ ID NO: 463773 - protein, 9 aa, Influenza virus
APGYAFEIV

SEQ ID NO: 463774 - protein, 9 aa, Influenza virus
APHGLCYPG

SEQ ID NO: 463775 - protein, 9 aa, Influenza virus
APHKLCFPG

SEQ ID NO: 463776 - protein, 9 aa, Influenza virus
APHKLCYPG

SEQ ID NO: 463777 - protein, 9 aa, Influenza virus
APHRLCYPG

SEQ ID NO: 463778 - protein, 9 aa, Influenza virus
APIEHIASI

SEQ ID NO: 463779 - protein, 9 aa, Influenza virus
APIEHIASM

SEQ ID NO: 463780 - protein, 9 aa, Influenza virus
APIEHVASM

SEQ ID NO: 463781 - protein, 9 aa, Influenza virus
APIEYIASM

SEQ ID NO: 463782 - protein, 9 aa, Influenza virus
APIEYVASM

SEQ ID NO: 463783 - protein, 9 aa, Influenza virus
APILGNYKE

SEQ ID NO: 463784 - protein, 9 aa, Influenza virus
APIMFSNKM

SEQ ID NO: 463785 - protein, 9 aa, Influenza virus
APISLGDCS

SEQ ID NO: 463786 - protein, 9 aa, Influenza virus
APKYGYIIE

SEQ ID NO: 463787 - protein, 9 aa, Influenza virus
APLELRDCK

SEQ ID NO: 463788 - protein, 9 aa, Influenza virus
APLMMAYML

SEQ ID NO: 463789 - protein, 9 aa, Influenza virus
APLMVAYML

SEQ ID NO: 463790 - protein, 9 aa, Influenza virus
APLSKDNGI

SEQ ID NO: 463791 - protein, 9 aa, Influenza virus
APLSKDNSI

SEQ ID NO: 463792 - protein, 9 aa, Influenza virus
APLVLDDCS

SEQ ID NO: 463793 - protein, 9 aa, Influenza virus
APNFHYEEC

SEQ ID NO: 463794 - protein, 9 aa, Influenza virus
APNFYYEEC

SEQ ID NO: 463795 - protein, 9 aa, Influenza virus
APNKFCYPG

SEQ ID NO: 463796 - protein, 9 aa, Influenza virus
APNKLCFPG

SEQ ID NO: 463797 - protein, 9 aa, Influenza virus
APNKLCYPG

SEQ ID NO: 463798 - protein, 9 aa, Influenza virus
APNRASFFR

SEQ ID NO: 463799 - protein, 9 aa, Influenza virus
APNSHYEEC

SEQ ID NO: 463800 - protein, 9 aa, Influenza virus
APNYHYEEC

SEQ ID NO: 463801 - protein, 9 aa, Influenza virus
APNYYYEEC

SEQ ID NO: 463802 - protein, 9 aa, Influenza virus
APPEQSRMQ

SEQ ID NO: 463803 - protein, 9 aa, Influenza virus
APPKQSRMQ

SEQ ID NO: 463804 - protein, 9 aa, Influenza virus
APPVQSKMQ

SEQ ID NO: 463805 - protein, 9 aa, Influenza virus
APPVQSRMQ

SEQ ID NO: 463806 - protein, 9 aa, Influenza virus
APQLNPIDG

SEQ ID NO: 463807 - protein, 9 aa, Influenza virus
APRGHYKIS

SEQ ID NO: 463808 - protein, 9 aa, Influenza virus
APRYAFEIV

SEQ ID NO: 463809 - protein, 9 aa, Influenza virus
APRYAFELV

SEQ ID NO: 463810 - protein, 9 aa, Influenza virus
APRYGYIIE

SEQ ID NO: 463811 - protein, 9 aa, Influenza virus
APRYSFELV

SEQ ID NO: 463812 - protein, 9 aa, Influenza virus
APSCDLHLT

SEQ ID NO: 463813 - protein, 9 aa, Influenza virus
APSGIEYNG

SEQ ID NO: 463814 - protein, 9 aa, Influenza virus
APSGVEYNG

SEQ ID NO: 463815 - protein, 9 aa, Influenza virus
APSPSNSRF

SEQ ID NO: 463816 - protein, 9 aa, Influenza virus
APSPYNSKF

SEQ ID NO: 463817 - protein, 9 aa, Influenza virus
APSPYNSRF

SEQ ID NO: 463818 - protein, 9 aa, Influenza virus
APSRVSKLI

SEQ ID NO: 463819 - protein, 9 aa, Influenza virus
APSRVSKLK

SEQ ID NO: 463820 - protein, 9 aa, Influenza virus
APSRVSKLR

SEQ ID NO: 463821 - protein, 9 aa, Influenza virus
APSRVSKLT

SEQ ID NO: 463822 - protein, 9 aa, Influenza virus
APSRVTKLK

SEQ ID NO: 463823 - protein, 9 aa, Influenza virus
APVLGNCKE

SEQ ID NO: 463824 - protein, 9 aa, Influenza virus
APVLGNYKE

SEQ ID NO: 463825 - protein, 9 aa, Influenza virus
APVLGNYRE

SEQ ID NO: 463826 - protein, 9 aa, Influenza virus
APYRSLIRF

SEQ ID NO: 463827 - protein, 9 aa, Influenza virus
AQAFYKILK

SEQ ID NO: 463828 - protein, 9 aa, Influenza virus
AQDILEKTH

SEQ ID NO: 463829 - protein, 9 aa, Influenza virus
AQDILERTH

SEQ ID NO: 463830 - protein, 9 aa, Influenza virus
AQDNAIRFG

SEQ ID NO: 463831 - protein, 9 aa, Influenza virus
AQDRGLFGA

SEQ ID NO: 463832 - protein, 9 aa, Influenza virus
AQDVIMEVV

SEQ ID NO: 463833 - protein, 9 aa, Influenza virus
AQEKNDLYG

SEQ ID NO: 463834 - protein, 9 aa, Influenza virus
AQGALLGTK

SEQ ID NO: 463835 - protein, 9 aa, Influenza virus
AQGALLGTN

SEQ ID NO: 463836 - protein, 9 aa, Influenza virus
AQGALLGTR

SEQ ID NO: 463837 - protein, 9 aa, Influenza virus
AQGALVGTK

SEQ ID NO: 463838 - protein, 9 aa, Influenza virus
AQGEGIAAD

SEQ ID NO: 463839 - protein, 9 aa, Influenza virus
AQGEGTAAD

SEQ ID NO: 463840 - protein, 9 aa, Influenza virus
AQGIGQAAD

SEQ ID NO: 463841 - protein, 9 aa, Influenza virus
AQGQGTAAD

SEQ ID NO: 463842 - protein, 9 aa, Influenza virus
AQGSGYAAD

SEQ ID NO: 463843 - protein, 9 aa, Influenza virus
AQGSYNNTS

SEQ ID NO: 463844 - protein, 9 aa, Influenza virus
AQGTGQAAD

SEQ ID NO: 463845 - protein, 9 aa, Influenza virus
AQGVLLGTK

SEQ ID NO: 463846 - protein, 9 aa, Influenza virus
AQGYKDIIL

SEQ ID NO: 463847 - protein, 9 aa, Influenza virus
AQHGICYPG

SEQ ID NO: 463848 - protein, 9 aa, Influenza virus
AQHIEECSC

SEQ ID NO: 463849 - protein, 9 aa, Influenza virus
AQHRSHRQM

SEQ ID NO: 463850 - protein, 9 aa, Influenza virus
AQHVEECSC

SEQ ID NO: 463851 - protein, 9 aa, Influenza virus
AQIDESCEG

SEQ ID NO: 463852 - protein, 9 aa, Influenza virus
AQIIKLLPF

SEQ ID NO: 463853 - protein, 9 aa, Influenza virus
AQKAMMDQV

SEQ ID NO: 463854 - protein, 9 aa, Influenza virus
AQKLEDVFA

SEQ ID NO: 463855 - protein, 9 aa, Influenza virus
AQLLVLLEN

SEQ ID NO: 463856 - protein, 9 aa, Influenza virus
AQLLVWLEN

SEQ ID NO: 463857 - protein, 9 aa, Influenza virus
AQMALQLFI

SEQ ID NO: 463858 - protein, 9 aa, Influenza virus
AQNAISITF

SEQ ID NO: 463859 - protein, 9 aa, Influenza virus
AQNAISTTF

SEQ ID NO: 463860 - protein, 9 aa, Influenza virus
AQNGICYPG

SEQ ID NO: 463861 - protein, 9 aa, Influenza virus
AQNILEKTH

SEQ ID NO: 463862 - protein, 9 aa, Influenza virus
AQNRGLFGA

SEQ ID NO: 463863 - protein, 9 aa, Influenza virus
AQRAMMDQV

SEQ ID NO: 463864 - protein, 9 aa, Influenza virus
AQRAMVDQV

SEQ ID NO: 463865 - protein, 9 aa, Influenza virus
AQRLEDVFA

SEQ ID NO: 463866 - protein, 9 aa, Influenza virus
AQRLEGVFA

SEQ ID NO: 463867 - protein, 9 aa, Influenza virus
AQRLENVFA

SEQ ID NO: 463868 - protein, 9 aa, Influenza virus
AQRLESVFA

SEQ ID NO: 463869 - protein, 9 aa, Influenza virus
AQSFYRSIN

SEQ ID NO: 463870 - protein, 9 aa, Influenza virus
AQSLSISVG

SEQ ID NO: 463871 - protein, 9 aa, Influenza virus
AQTDCVLEA

SEQ ID NO: 463872 - protein, 9 aa, Influenza virus
AQYGICYPG

SEQ ID NO: 463873 - protein, 9 aa, Influenza virus
AQYREEALL

SEQ ID NO: 463874 - protein, 9 aa, Influenza virus
ARCICEKLE

SEQ ID NO: 463875 - protein, 9 aa, Influenza virus
ARCNTKCQT

SEQ ID NO: 463876 - protein, 9 aa, Influenza virus
ARELGNGCF

SEQ ID NO: 463877 - protein, 9 aa, Influenza virus
ARFEAVAWS

SEQ ID NO: 463878 - protein, 9 aa, Influenza virus
ARFESVAWS

SEQ ID NO: 463879 - protein, 9 aa, Influenza virus
ARGDKICLG

SEQ ID NO: 463880 - protein, 9 aa, Influenza virus
ARGEKANVL

SEQ ID NO: 463881 - protein, 9 aa, Influenza virus
ARGLFGAIA

SEQ ID NO: 463882 - protein, 9 aa, Influenza virus
ARGSYNNTS

SEQ ID NO: 463883 - protein, 9 aa, Influenza virus
ARHIEECPC

SEQ ID NO: 463884 - protein, 9 aa, Influenza virus
ARHIEECSC

SEQ ID NO: 463885 - protein, 9 aa, Influenza virus
ARHIEEWSC

SEQ ID NO: 463886 - protein, 9 aa, Influenza virus
ARIDARIDF

SEQ ID NO: 463887 - protein, 9 aa, Influenza virus
ARIDARVDF

SEQ ID NO: 463888 - protein, 9 aa, Influenza virus
ARIDARVDS

SEQ ID NO: 463889 - protein, 9 aa, Influenza virus
ARIDFESGR

SEQ ID NO: 463890 - protein, 9 aa, Influenza virus
ARIGEGQRS

SEQ ID NO: 463891 - protein, 9 aa, Influenza virus
ARIITSESQ

SEQ ID NO: 463892 - protein, 9 aa, Influenza virus
ARIKTRLFT

SEQ ID NO: 463893 - protein, 9 aa, Influenza virus
ARILASESQ

SEQ ID NO: 463894 - protein, 9 aa, Influenza virus
ARILTSESQ

SEQ ID NO: 463895 - protein, 9 aa, Influenza virus
ARLGKGYMF

SEQ ID NO: 463896 - protein, 9 aa, Influenza virus
ARLGRGYMF

SEQ ID NO: 463897 - protein, 9 aa, Influenza virus
ARLLVLLEN

SEQ ID NO: 463898 - protein, 9 aa, Influenza virus
ARLYIWGVH

SEQ ID NO: 463899 - protein, 9 aa, Influenza virus
ARMTICIQG

SEQ ID NO: 463900 - protein, 9 aa, Influenza virus
ARNGICYPG

SEQ ID NO: 463901 - protein, 9 aa, Influenza virus
ARNICEKLE

SEQ ID NO: 463902 - protein, 9 aa, Influenza virus
ARNILRTQD

SEQ ID NO: 463903 - protein, 9 aa, Influenza virus
ARNILRTQE

SEQ ID NO: 463904 - protein, 9 aa, Influenza virus
ARNIVRRAA

SEQ ID NO: 463905 - protein, 9 aa, Influenza virus
ARNIVRRAI

SEQ ID NO: 463906 - protein, 9 aa, Influenza virus
ARNIVRRAT

SEQ ID NO: 463907 - protein, 9 aa, Influenza virus
ARPKVNGQA

SEQ ID NO: 463908 - protein, 9 aa, Influenza virus
ARPLVNGQS

SEQ ID NO: 463909 - protein, 9 aa, Influenza virus
ARPQVNGQS

SEQ ID NO: 463910 - protein, 9 aa, Influenza virus
ARQEKNPAL

SEQ ID NO: 463911 - protein, 9 aa, Influenza virus
ARQMVHAMR

SEQ ID NO: 463912 - protein, 9 aa, Influenza virus
ARQMVQAMR

SEQ ID NO: 463913 - protein, 9 aa, Influenza virus
ARRICEKLE

SEQ ID NO: 463914 - protein, 9 aa, Influenza virus
ARRIDFHWL

SEQ ID NO: 463915 - protein, 9 aa, Influenza virus
ARRIDFNWL

SEQ ID NO: 463916 - protein, 9 aa, Influenza virus
ARRMVQAMR

SEQ ID NO: 463917 - protein, 9 aa, Influenza virus
ARSALILRG

SEQ ID NO: 463918 - protein, 9 aa, Influenza virus
ARSICEKLE

SEQ ID NO: 463919 - protein, 9 aa, Influenza virus
ARSIVRRAT

SEQ ID NO: 463920 - protein, 9 aa, Influenza virus
ARVDFESGR

SEQ ID NO: 463921 - protein, 9 aa, Influenza virus
ARVWWTSNS

SEQ ID NO: 463922 - protein, 9 aa, Influenza virus
ASACHDGAS

SEQ ID NO: 463923 - protein, 9 aa, Influenza virus
ASACHDGIS

SEQ ID NO: 463924 - protein, 9 aa, Influenza virus
ASACHDGSS

SEQ ID NO: 463925 - protein, 9 aa, Influenza virus
ASACHDGTN

SEQ ID NO: 463926 - protein, 9 aa, Influenza virus
ASACHDGTS

SEQ ID NO: 463927 - protein, 9 aa, Influenza virus
ASAGQISIQ

SEQ ID NO: 463928 - protein, 9 aa, Influenza virus
ASAGQISTQ

SEQ ID NO: 463929 - protein, 9 aa, Influenza virus
ASAGQISVQ

SEQ ID NO: 463930 - protein, 9 aa, Influenza virus
ASAGQTSVQ

SEQ ID NO: 463931 - protein, 9 aa, Influenza virus
ASAGQVSVQ

SEQ ID NO: 463932 - protein, 9 aa, Influenza virus
ASALILRGS

SEQ ID NO: 463933 - protein, 9 aa, Influenza virus
ASCAAMDDF

SEQ ID NO: 463934 - protein, 9 aa, Influenza virus
ASCAAMDEF

SEQ ID NO: 463935 - protein, 9 aa, Influenza virus
ASCAAMEDF

SEQ ID NO: 463936 - protein, 9 aa, Influenza virus
ASCFIFLAI

SEQ ID NO: 463937 - protein, 9 aa, Influenza virus
ASCFILLAI

SEQ ID NO: 463938 - protein, 9 aa, Influenza virus
ASCFILLAV

SEQ ID NO: 463939 - protein, 9 aa, Influenza virus
ASCFLFLAI

SEQ ID NO: 463940 - protein, 9 aa, Influenza virus
ASCFLLIAI

SEQ ID NO: 463941 - protein, 9 aa, Influenza virus
ASCFLLLAI

SEQ ID NO: 463942 - protein, 9 aa, Influenza virus
ASCFLLLAV

SEQ ID NO: 463943 - protein, 9 aa, Influenza virus
ASCFTLLAI

SEQ ID NO: 463944 - protein, 9 aa, Influenza virus
ASCFVLLAA

SEQ ID NO: 463945 - protein, 9 aa, Influenza virus
ASCFVLLAD

SEQ ID NO: 463946 - protein, 9 aa, Influenza virus
ASCFVLLAI

SEQ ID NO: 463947 - protein, 9 aa, Influenza virus
ASCFVLLAV

SEQ ID NO: 463948 - protein, 9 aa, Influenza virus
ASCHDGRAW

SEQ ID NO: 463949 - protein, 9 aa, Influenza virus
ASCMGLIYN

SEQ ID NO: 463950 - protein, 9 aa, Influenza virus
ASCVMLLAI

SEQ ID NO: 463951 - protein, 9 aa, Influenza virus
ASDILKRMS

SEQ ID NO: 463952 - protein, 9 aa, Influenza virus
ASDILTRMS

SEQ ID NO: 463953 - protein, 9 aa, Influenza virus
ASGDIWITR

SEQ ID NO: 463954 - protein, 9 aa, Influenza virus
ASGDIWVTR

SEQ ID NO: 463955 - protein, 9 aa, Influenza virus
ASGKADTRI

SEQ ID NO: 463956 - protein, 9 aa, Influenza virus
ASGKAETRI

SEQ ID NO: 463957 - protein, 9 aa, Influenza virus
ASGLRNVPA

SEQ ID NO: 463958 - protein, 9 aa, Influenza virus
ASGRADTKI

SEQ ID NO: 463959 - protein, 9 aa, Influenza virus
ASGRADTRI

SEQ ID NO: 463960 - protein, 9 aa, Influenza virus
ASGSSISFC

SEQ ID NO: 463961 - protein, 9 aa, Influenza virus
ASICTHLEV

SEQ ID NO: 463962 - protein, 9 aa, Influenza virus
ASIRNNSYD

SEQ ID NO: 463963 - protein, 9 aa, Influenza virus
ASIRNNTYD

SEQ ID NO: 463964 - protein, 9 aa, Influenza virus
ASIRNNTYN

SEQ ID NO: 463965 - protein, 9 aa, Influenza virus
ASIRNSTYD

SEQ ID NO: 463966 - protein, 9 aa, Influenza virus
ASIRRNYFT

SEQ ID NO: 463967 - protein, 9 aa, Influenza virus
ASKEPEVHE

SEQ ID NO: 463968 - protein, 9 aa, Influenza virus
ASKNPYTLV

SEQ ID NO: 463969 - protein, 9 aa, Influenza virus
ASLCLAILI

SEQ ID NO: 463970 - protein, 9 aa, Influenza virus
ASLCLAILV

SEQ ID NO: 463971 - protein, 9 aa, Influenza virus
ASLCLAVLI

SEQ ID NO: 463972 - protein, 9 aa, Influenza virus
ASLLEMCHG

SEQ ID NO: 463973 - protein, 9 aa, Influenza virus
ASLLEMCHS

SEQ ID NO: 463974 - protein, 9 aa, Influenza virus
ASLRLAVGL

SEQ ID NO: 463975 - protein, 9 aa, Influenza virus
ASLSPGMMM

SEQ ID NO: 463976 - protein, 9 aa, Influenza virus
ASMRRDYFT

SEQ ID NO: 463977 - protein, 9 aa, Influenza virus
ASMRRNYFT

SEQ ID NO: 463978 - protein, 9 aa, Influenza virus
ASMRRSYFT

SEQ ID NO: 463979 - protein, 9 aa, Influenza virus
ASNINIREW

SEQ ID NO: 463980 - protein, 9 aa, Influenza virus
ASNQASYKI

SEQ ID NO: 463981 - protein, 9 aa, Influenza virus
ASNRPWISF

SEQ ID NO: 463982 - protein, 9 aa, Influenza virus
ASNRPWVSF

SEQ ID NO: 463983 - protein, 9 aa, Influenza virus
ASNSIVTFC

SEQ ID NO: 463984 - protein, 9 aa, Influenza virus
ASNSLIALC

SEQ ID NO: 463985 - protein, 9 aa, Influenza virus
ASPQLEGFS

SEQ ID NO: 463986 - protein, 9 aa, Influenza virus
ASPSCLVVR

SEQ ID NO: 463987 - protein, 9 aa, Influenza virus
ASQGTKRPY

SEQ ID NO: 463988 - protein, 9 aa, Influenza virus
ASQGTKRSH

SEQ ID NO: 463989 - protein, 9 aa, Influenza virus
ASQGTKRSY

SEQ ID NO: 463990 - protein, 9 aa, Influenza virus
ASQYGPSHS

SEQ ID NO: 463991 - protein, 9 aa, Influenza virus
ASRHHMGEC

SEQ ID NO: 463992 - protein, 9 aa, Influenza virus
ASRHYMGEC

SEQ ID NO: 463993 - protein, 9 aa, Influenza virus
ASRKADTRI

SEQ ID NO: 463994 - protein, 9 aa, Influenza virus
ASRSGYEML

SEQ ID NO: 463995 - protein, 9 aa, Influenza virus
ASRSGYEVL

SEQ ID NO: 463996 - protein, 9 aa, Influenza virus
ASRYGYEML

SEQ ID NO: 463997 - protein, 9 aa, Influenza virus
ASRYYMGEC

SEQ ID NO: 463998 - protein, 9 aa, Influenza virus
ASSGIAIAL

SEQ ID NO: 463999 - protein, 9 aa, Influenza virus
ASSGIAIVL

SEQ ID NO: 464000 - protein, 9 aa, Influenza virus
ASSGSLEFI

SEQ ID NO: 464001 - protein, 9 aa, Influenza virus
ASSISFCGV

SEQ ID NO: 464002 - protein, 9 aa, Influenza virus
ASSIVLVGL

SEQ ID NO: 464003 - protein, 9 aa, Influenza virus
ASSIVMVGL

SEQ ID NO: 464004 - protein, 9 aa, Influenza virus
ASSKSRARI

SEQ ID NO: 464005 - protein, 9 aa, Influenza virus
ASSLALAII

SEQ ID NO: 464006 - protein, 9 aa, Influenza virus
ASSLALAIM

SEQ ID NO: 464007 - protein, 9 aa, Influenza virus
ASSLILAAI

SEQ ID NO: 464008 - protein, 9 aa, Influenza virus
ASSLPFQNI

SEQ ID NO: 464009 - protein, 9 aa, Influenza virus
ASSLTLAIM

SEQ ID NO: 464010 - protein, 9 aa, Influenza virus
ASSLVLAAI

SEQ ID NO: 464011 - protein, 9 aa, Influenza virus
ASSLVLAAL

SEQ ID NO: 464012 - protein, 9 aa, Influenza virus
ASSLVLAAS

SEQ ID NO: 464013 - protein, 9 aa, Influenza virus
ASSLVLAIM

SEQ ID NO: 464014 - protein, 9 aa, Influenza virus
ASSLVLIVS

SEQ ID NO: 464015 - protein, 9 aa, Influenza virus
ASSLVLLFM

SEQ ID NO: 464016 - protein, 9 aa, Influenza virus
ASSLVLLLM

SEQ ID NO: 464017 - protein, 9 aa, Influenza virus
ASSLVLLVS

SEQ ID NO: 464018 - protein, 9 aa, Influenza virus
ASSLVLVVS

SEQ ID NO: 464019 - protein, 9 aa, Influenza virus
ASSQAHTKI

SEQ ID NO: 464020 - protein, 9 aa, Influenza virus
ASSQAHTKV

SEQ ID NO: 464021 - protein, 9 aa, Influenza virus
ASSQAYTKI

SEQ ID NO: 464022 - protein, 9 aa, Influenza virus
ASSQAYTKV

SEQ ID NO: 464023 - protein, 9 aa, Influenza virus
ASSQLEGFS

SEQ ID NO: 464024 - protein, 9 aa, Influenza virus
ASSSVLLVS

SEQ ID NO: 464025 - protein, 9 aa, Influenza virus
ASSTVLVGL

SEQ ID NO: 464026 - protein, 9 aa, Influenza virus
ASSTVMVGL

SEQ ID NO: 464027 - protein, 9 aa, Influenza virus
ASSVVLVGL

SEQ ID NO: 464028 - protein, 9 aa, Influenza virus
ASSVVLVGP

SEQ ID NO: 464029 - protein, 9 aa, Influenza virus
ASTGAQSFY

SEQ ID NO: 464030 - protein, 9 aa, Influenza virus
ASTGGQAFY

SEQ ID NO: 464031 - protein, 9 aa, Influenza virus
ASTGGQSFY

SEQ ID NO: 464032 - protein, 9 aa, Influenza virus
ASTLVLLVS

SEQ ID NO: 464033 - protein, 9 aa, Influenza virus
ASTNAHDRI

SEQ ID NO: 464034 - protein, 9 aa, Influenza virus
ASTNAYDRI

SEQ ID NO: 464035 - protein, 9 aa, Influenza virus
ASTQKAIDE

SEQ ID NO: 464036 - protein, 9 aa, Influenza virus
ASTQKAINE

SEQ ID NO: 464037 - protein, 9 aa, Influenza virus
ASTTAKAME

SEQ ID NO: 464038 - protein, 9 aa, Influenza virus
ASVPASRYL

SEQ ID NO: 464039 - protein, 9 aa, Influenza virus
ASWAGNILR

SEQ ID NO: 464040 - protein, 9 aa, Influenza virus
ASWFNSFLA

SEQ ID NO: 464041 - protein, 9 aa, Influenza virus
ASWFNSFLI

SEQ ID NO: 464042 - protein, 9 aa, Influenza virus
ASWFNSFLK

SEQ ID NO: 464043 - protein, 9 aa, Influenza virus
ASWFNSFLT

SEQ ID NO: 464044 - protein, 9 aa, Influenza virus
ASWFNSFLV

SEQ ID NO: 464045 - protein, 9 aa, Influenza virus
ASWSWHDGA

SEQ ID NO: 464046 - protein, 9 aa, Influenza virus
ASYKIFKSH

SEQ ID NO: 464047 - protein, 9 aa, Influenza virus
ASYKIFKSQ

SEQ ID NO: 464048 - protein, 9 aa, Influenza virus
ASYKIFKSR

SEQ ID NO: 464049 - protein, 9 aa, Influenza virus
ASYKIFKSY

SEQ ID NO: 464050 - protein, 9 aa, Influenza virus
ASYKRIRLF

SEQ ID NO: 464051 - protein, 9 aa, Influenza virus
ASYKRVRLF

SEQ ID NO: 464052 - protein, 9 aa, Influenza virus
ASYRIFKSH

SEQ ID NO: 464053 - protein, 9 aa, Influenza virus
ATACHDGKE

SEQ ID NO: 464054 - protein, 9 aa, Influenza virus
ATACHDGKG

SEQ ID NO: 464055 - protein, 9 aa, Influenza virus
ATACHDGKK

SEQ ID NO: 464056 - protein, 9 aa, Influenza virus
ATACHDGRK

SEQ ID NO: 464057 - protein, 9 aa, Influenza virus
ATACSDGPG

SEQ ID NO: 464058 - protein, 9 aa, Influenza virus
ATACSDGSG

SEQ ID NO: 464059 - protein, 9 aa, Influenza virus
ATAIFRKAT

SEQ ID NO: 464060 - protein, 9 aa, Influenza virus
ATAIIRKAT

SEQ ID NO: 464061 - protein, 9 aa, Influenza virus
ATAILKKAT

SEQ ID NO: 464062 - protein, 9 aa, Influenza virus
ATAILRKAT

SEQ ID NO: 464063 - protein, 9 aa, Influenza virus
ATALANTIE

SEQ ID NO: 464064 - protein, 9 aa, Influenza virus
ATAQMALQL

SEQ ID NO: 464065 - protein, 9 aa, Influenza virus
ATASFIYDG

SEQ ID NO: 464066 - protein, 9 aa, Influenza virus
ATASFIYEG

SEQ ID NO: 464067 - protein, 9 aa, Influenza virus
ATASFIYGG

SEQ ID NO: 464068 - protein, 9 aa, Influenza virus
ATASFIYNG

SEQ ID NO: 464069 - protein, 9 aa, Influenza virus
ATASFVYDG

SEQ ID NO: 464070 - protein, 9 aa, Influenza virus
ATASLIYDG

SEQ ID NO: 464071 - protein, 9 aa, Influenza virus
ATASLIYNG

SEQ ID NO: 464072 - protein, 9 aa, Influenza virus
ATATVYYDR

SEQ ID NO: 464073 - protein, 9 aa, Influenza virus
ATATVYYER

SEQ ID NO: 464074 - protein, 9 aa, Influenza virus
ATATVYYNG

SEQ ID NO: 464075 - protein, 9 aa, Influenza virus
ATATVYYNK

SEQ ID NO: 464076 - protein, 9 aa, Influenza virus
ATATVYYNR

SEQ ID NO: 464077 - protein, 9 aa, Influenza virus
ATAVAVIKY

SEQ ID NO: 464078 - protein, 9 aa, Influenza virus
ATAVAVLKY

SEQ ID NO: 464079 - protein, 9 aa, Influenza virus
ATCEQIADA

SEQ ID NO: 464080 - protein, 9 aa, Influenza virus
ATCEQIADS

SEQ ID NO: 464081 - protein, 9 aa, Influenza virus
ATCVCRDNW

SEQ ID NO: 464082 - protein, 9 aa, Influenza virus
ATDTVDTLT

SEQ ID NO: 464083 - protein, 9 aa, Influenza virus
ATEIRASVG

SEQ ID NO: 464084 - protein, 9 aa, Influenza virus
ATEIRSSVG

SEQ ID NO: 464085 - protein, 9 aa, Influenza virus
ATEIRTSVG

SEQ ID NO: 464086 - protein, 9 aa, Influenza virus
ATETVEITG

SEQ ID NO: 464087 - protein, 9 aa, Influenza virus
ATEYIMKGV

SEQ ID NO: 464088 - protein, 9 aa, Influenza virus
ATEYMMKGV

SEQ ID NO: 464089 - protein, 9 aa, Influenza virus
ATFLRSNAP

SEQ ID NO: 464090 - protein, 9 aa, Influenza virus
ATGFHFEEC

SEQ ID NO: 464091 - protein, 9 aa, Influenza virus
ATGFHLEEC

SEQ ID NO: 464092 - protein, 9 aa, Influenza virus
ATGLKNVPA

SEQ ID NO: 464093 - protein, 9 aa, Influenza virus
ATGLRNAHK

SEQ ID NO: 464094 - protein, 9 aa, Influenza virus
ATGLRNIPA

SEQ ID NO: 464095 - protein, 9 aa, Influenza virus
ATGLRNIPQ

SEQ ID NO: 464096 - protein, 9 aa, Influenza virus
ATGLRNIPS

SEQ ID NO: 464097 - protein, 9 aa, Influenza virus
ATGLRNVPA

SEQ ID NO: 464098 - protein, 9 aa, Influenza virus
ATGLRNVPI

SEQ ID NO: 464099 - protein, 9 aa, Influenza virus
ATGLRNVPK

SEQ ID NO: 464100 - protein, 9 aa, Influenza virus
ATGLRNVPQ

SEQ ID NO: 464101 - protein, 9 aa, Influenza virus
ATGLRNVPS

SEQ ID NO: 464102 - protein, 9 aa, Influenza virus
ATGLRNVPT

SEQ ID NO: 464103 - protein, 9 aa, Influenza virus
ATGMALSVV

SEQ ID NO: 464104 - protein, 9 aa, Influenza virus
ATGMILSVV

SEQ ID NO: 464105 - protein, 9 aa, Influenza virus
ATGMKNVPE

SEQ ID NO: 464106 - protein, 9 aa, Influenza virus
ATGMRNIPE

SEQ ID NO: 464107 - protein, 9 aa, Influenza virus
ATGMRNIPG

SEQ ID NO: 464108 - protein, 9 aa, Influenza virus
ATGMRNVPE

SEQ ID NO: 464109 - protein, 9 aa, Influenza virus
ATGMTLSVV

SEQ ID NO: 464110 - protein, 9 aa, Influenza virus
ATGPADTRI

SEQ ID NO: 464111 - protein, 9 aa, Influenza virus
ATGPADTRV

SEQ ID NO: 464112 - protein, 9 aa, Influenza virus
ATGPAETRI

SEQ ID NO: 464113 - protein, 9 aa, Influenza virus
ATGPAETRV

SEQ ID NO: 464114 - protein, 9 aa, Influenza virus
ATGPRNVPA

SEQ ID NO: 464115 - protein, 9 aa, Influenza virus
ATGPRNVPQ

SEQ ID NO: 464116 - protein, 9 aa, Influenza virus
ATGRVTVST

SEQ ID NO: 464117 - protein, 9 aa, Influenza virus
ATGVTLSVV

SEQ ID NO: 464118 - protein, 9 aa, Influenza virus
ATGYHFEEC

SEQ ID NO: 464119 - protein, 9 aa, Influenza virus
ATIGECPKY

SEQ ID NO: 464120 - protein, 9 aa, Influenza virus
ATINEEALR

SEQ ID NO: 464121 - protein, 9 aa, Influenza virus
ATIWTSGSS

SEQ ID NO: 464122 - protein, 9 aa, Influenza virus
ATKLYVNKN

SEQ ID NO: 464123 - protein, 9 aa, Influenza virus
ATKMEAILV

SEQ ID NO: 464124 - protein, 9 aa, Influenza virus
ATKMKAIIV

SEQ ID NO: 464125 - protein, 9 aa, Influenza virus
ATKMKAILV

SEQ ID NO: 464126 - protein, 9 aa, Influenza virus
ATKRIRLAI

SEQ ID NO: 464127 - protein, 9 aa, Influenza virus
ATKRIRMAI

SEQ ID NO: 464128 - protein, 9 aa, Influenza virus
ATKRIRMAT

SEQ ID NO: 464129 - protein, 9 aa, Influenza virus
ATKRLRMAI

SEQ ID NO: 464130 - protein, 9 aa, Influenza virus
ATLCLGHHA

SEQ ID NO: 464131 - protein, 9 aa, Influenza virus
ATNGNYGPI

SEQ ID NO: 464132 - protein, 9 aa, Influenza virus
ATNINIREW

SEQ ID NO: 464133 - protein, 9 aa, Influenza virus
ATNLYVNKN

SEQ ID NO: 464134 - protein, 9 aa, Influenza virus
ATNPIVPSF

SEQ ID NO: 464135 - protein, 9 aa, Influenza virus
ATNPVVPSF

SEQ ID NO: 464136 - protein, 9 aa, Influenza virus
ATPGMQIRG

SEQ ID NO: 464137 - protein, 9 aa, Influenza virus
ATQTLVSNN

SEQ ID NO: 464138 - protein, 9 aa, Influenza virus
ATREGKHIV

SEQ ID NO: 464139 - protein, 9 aa, Influenza virus
ATRGVQIAS

SEQ ID NO: 464140 - protein, 9 aa, Influenza virus
ATRLYVNKN

SEQ ID NO: 464141 - protein, 9 aa, Influenza virus
ATRPKVNGQ

SEQ ID NO: 464142 - protein, 9 aa, Influenza virus
ATRPQVNGQ

SEQ ID NO: 464143 - protein, 9 aa, Influenza virus
ATRPRVNGQ

SEQ ID NO: 464144 - protein, 9 aa, Influenza virus
ATRSKVNGQ

SEQ ID NO: 464145 - protein, 9 aa, Influenza virus
ATSACKRTV

SEQ ID NO: 464146 - protein, 9 aa, Influenza virus
ATSPIVPSF

SEQ ID NO: 464147 - protein, 9 aa, Influenza virus
ATTHSWIPK

SEQ ID NO: 464148 - protein, 9 aa, Influenza virus
ATTHSWTPK

SEQ ID NO: 464149 - protein, 9 aa, Influenza virus
ATTHSWVPI

SEQ ID NO: 464150 - protein, 9 aa, Influenza virus
ATTHSWVPK

SEQ ID NO: 464151 - protein, 9 aa, Influenza virus
ATTITLHFK

SEQ ID NO: 464152 - protein, 9 aa, Influenza virus
ATTNPLIKH

SEQ ID NO: 464153 - protein, 9 aa, Influenza virus
ATTNPLIRH

SEQ ID NO: 464154 - protein, 9 aa, Influenza virus
ATTVTLHFK

SEQ ID NO: 464155 - protein, 9 aa, Influenza virus
ATVAGSLSL

SEQ ID NO: 464156 - protein, 9 aa, Influenza virus
ATVNEEALR

SEQ ID NO: 464157 - protein, 9 aa, Influenza virus
ATVNEGALR

SEQ ID NO: 464158 - protein, 9 aa, Influenza virus
ATVSADPLA

SEQ ID NO: 464159 - protein, 9 aa, Influenza virus
ATVSADPLL

SEQ ID NO: 464160 - protein, 9 aa, Influenza virus
ATVSADPLV

SEQ ID NO: 464161 - protein, 9 aa, Influenza virus
ATVTLHFKQ

SEQ ID NO: 464162 - protein, 9 aa, Influenza virus
ATVYYDRRL

SEQ ID NO: 464163 - protein, 9 aa, Influenza virus
ATVYYERRL

SEQ ID NO: 464164 - protein, 9 aa, Influenza virus
ATVYYNGRL

SEQ ID NO: 464165 - protein, 9 aa, Influenza virus
ATVYYNKRL

SEQ ID NO: 464166 - protein, 9 aa, Influenza virus
ATVYYNRRL

SEQ ID NO: 464167 - protein, 9 aa, Influenza virus
ATVYYNRRP

SEQ ID NO: 464168 - protein, 9 aa, Influenza virus
ATYQRTRAL

SEQ ID NO: 464169 - protein, 9 aa, Influenza virus
AVAKDNAIR

SEQ ID NO: 464170 - protein, 9 aa, Influenza virus
AVANGTKVN

SEQ ID NO: 464171 - protein, 9 aa, Influenza virus
AVATTHSWI

SEQ ID NO: 464172 - protein, 9 aa, Influenza virus
AVATTHSWT

SEQ ID NO: 464173 - protein, 9 aa, Influenza virus
AVATTHSWV

SEQ ID NO: 464174 - protein, 9 aa, Influenza virus
AVAVIKYNG

SEQ ID NO: 464175 - protein, 9 aa, Influenza virus
AVAVLKYDG

SEQ ID NO: 464176 - protein, 9 aa, Influenza virus
AVAVLKYKG

SEQ ID NO: 464177 - protein, 9 aa, Influenza virus
AVAVLKYNG

SEQ ID NO: 464178 - protein, 9 aa, Influenza virus
AVAVVKYNG

SEQ ID NO: 464179 - protein, 9 aa, Influenza virus
AVAWSATAC

SEQ ID NO: 464180 - protein, 9 aa, Influenza virus
AVDEGNGCF

SEQ ID NO: 464181 - protein, 9 aa, Influenza virus
AVDGTIAGF

SEQ ID NO: 464182 - protein, 9 aa, Influenza virus
AVDICKAAI

SEQ ID NO: 464183 - protein, 9 aa, Influenza virus
AVDICKAAL

SEQ ID NO: 464184 - protein, 9 aa, Influenza virus
AVDICKAAM

SEQ ID NO: 464185 - protein, 9 aa, Influenza virus
AVDLGSCGI

SEQ ID NO: 464186 - protein, 9 aa, Influenza virus
AVDQITGKL

SEQ ID NO: 464187 - protein, 9 aa, Influenza virus
AVDTCYPFD

SEQ ID NO: 464188 - protein, 9 aa, Influenza virus
AVDTGDGCF

SEQ ID NO: 464189 - protein, 9 aa, Influenza virus
AVDTGNGCF

SEQ ID NO: 464190 - protein, 9 aa, Influenza virus
AVEKEFSNL

SEQ ID NO: 464191 - protein, 9 aa, Influenza virus
AVENGTSVK

SEQ ID NO: 464192 - protein, 9 aa, Influenza virus
AVENQHTID

SEQ ID NO: 464193 - protein, 9 aa, Influenza virus
AVFCGTSGT

SEQ ID NO: 464194 - protein, 9 aa, Influenza virus
AVGGSGTDN

SEQ ID NO: 464195 - protein, 9 aa, Influenza virus
AVGGSGTNN

SEQ ID NO: 464196 - protein, 9 aa, Influenza virus
AVGICKAAM

SEQ ID NO: 464197 - protein, 9 aa, Influenza virus
AVGKCPKYV

SEQ ID NO: 464198 - protein, 9 aa, Influenza virus
AVGKCPRYV

SEQ ID NO: 464199 - protein, 9 aa, Influenza virus
AVGKEFGNL

SEQ ID NO: 464200 - protein, 9 aa, Influenza virus
AVGKEFNNL

SEQ ID NO: 464201 - protein, 9 aa, Influenza virus
AVGKEFSNL

SEQ ID NO: 464202 - protein, 9 aa, Influenza virus
AVGLRNTPS

SEQ ID NO: 464203 - protein, 9 aa, Influenza virus
AVGRCPRYV

SEQ ID NO: 464204 - protein, 9 aa, Influenza virus
AVIHYGGIP

SEQ ID NO: 464205 - protein, 9 aa, Influenza virus
AVIHYGGMP

SEQ ID NO: 464206 - protein, 9 aa, Influenza virus
AVIHYGGVP

SEQ ID NO: 464207 - protein, 9 aa, Influenza virus
AVIKYNGII

SEQ ID NO: 464208 - protein, 9 aa, Influenza virus
AVIYGNPKC

SEQ ID NO: 464209 - protein, 9 aa, Influenza virus
AVKLSSGYK

SEQ ID NO: 464210 - protein, 9 aa, Influenza virus
AVKLYKKLK

SEQ ID NO: 464211 - protein, 9 aa, Influenza virus
AVKLYRKLK

SEQ ID NO: 464212 - protein, 9 aa, Influenza virus
AVKQNGKSG

SEQ ID NO: 464213 - protein, 9 aa, Influenza virus
AVLIAGGLI

SEQ ID NO: 464214 - protein, 9 aa, Influenza virus
AVLKPGQTL

SEQ ID NO: 464215 - protein, 9 aa, Influenza virus
AVLKPGQTV

SEQ ID NO: 464216 - protein, 9 aa, Influenza virus
AVLKYKGII

SEQ ID NO: 464217 - protein, 9 aa, Influenza virus
AVLKYNGII

SEQ ID NO: 464218 - protein, 9 aa, Influenza virus
AVLKYNGMI

SEQ ID NO: 464219 - protein, 9 aa, Influenza virus
AVLKYNGVI

SEQ ID NO: 464220 - protein, 9 aa, Influenza virus
AVLRGFLII

SEQ ID NO: 464221 - protein, 9 aa, Influenza virus
AVLRGFLIL

SEQ ID NO: 464222 - protein, 9 aa, Influenza virus
AVNICKAAM

SEQ ID NO: 464223 - protein, 9 aa, Influenza virus
AVNNRFQIK

SEQ ID NO: 464224 - protein, 9 aa, Influenza virus
AVNSSKPFQ

SEQ ID NO: 464225 - protein, 9 aa, Influenza virus
AVNSSMPFH

SEQ ID NO: 464226 - protein, 9 aa, Influenza virus
AVNSWHILS

SEQ ID NO: 464227 - protein, 9 aa, Influenza virus
AVNTTLSTI

SEQ ID NO: 464228 - protein, 9 aa, Influenza virus
AVPNGTIVK

SEQ ID NO: 464229 - protein, 9 aa, Influenza virus
AVPNGTIVR

SEQ ID NO: 464230 - protein, 9 aa, Influenza virus
AVPNGTKVN

SEQ ID NO: 464231 - protein, 9 aa, Influenza virus
AVPNGTLVK

SEQ ID NO: 464232 - protein, 9 aa, Influenza virus
AVPNGTMVK

SEQ ID NO: 464233 - protein, 9 aa, Influenza virus
AVPNGTVVK

SEQ ID NO: 464234 - protein, 9 aa, Influenza virus
AVRFGESEQ

SEQ ID NO: 464235 - protein, 9 aa, Influenza virus
AVRGDLNFV

SEQ ID NO: 464236 - protein, 9 aa, Influenza virus
AVRIGEDAH

SEQ ID NO: 464237 - protein, 9 aa, Influenza virus
AVSADPLAS

SEQ ID NO: 464238 - protein, 9 aa, Influenza virus
AVSFWMCSN

SEQ ID NO: 464239 - protein, 9 aa, Influenza virus
AVSIDRFLR

SEQ ID NO: 464240 - protein, 9 aa, Influenza virus
AVSNGTKIN

SEQ ID NO: 464241 - protein, 9 aa, Influenza virus
AVSNGTKVN

SEQ ID NO: 464242 - protein, 9 aa, Influenza virus
AVTDGPAAN

SEQ ID NO: 464243 - protein, 9 aa, Influenza virus
AVTDGPADN

SEQ ID NO: 464244 - protein, 9 aa, Influenza virus
AVTDIWSYN

SEQ ID NO: 464245 - protein, 9 aa, Influenza virus
AVTDVWSYN

SEQ ID NO: 464246 - protein, 9 aa, Influenza virus
AVTWWNRKG

SEQ ID NO: 464247 - protein, 9 aa, Influenza virus
AVTWWNRNG

SEQ ID NO: 464248 - protein, 9 aa, Influenza virus
AVTWWNRSG

SEQ ID NO: 464249 - protein, 9 aa, Influenza virus
AVVKYNGII

SEQ ID NO: 464250 - protein, 9 aa, Influenza virus
AVVMGLVFI

SEQ ID NO: 464251 - protein, 9 aa, Influenza virus
AVVMTDGNA

SEQ ID NO: 464252 - protein, 9 aa, Influenza virus
AVVMTDGPA

SEQ ID NO: 464253 - protein, 9 aa, Influenza virus
AVVMTDGSA

SEQ ID NO: 464254 - protein, 9 aa, Influenza virus
AVVSKDNGI

SEQ ID NO: 464255 - protein, 9 aa, Influenza virus
AWIGRTKST

SEQ ID NO: 464256 - protein, 9 aa, Influenza virus
AWLHICVTG

SEQ ID NO: 464257 - protein, 9 aa, Influenza virus
AWLHVCITG

SEQ ID NO: 464258 - protein, 9 aa, Influenza virus
AWLHVCVTG

SEQ ID NO: 464259 - protein, 9 aa, Influenza virus
AWSASACHD

SEQ ID NO: 464260 - protein, 9 aa, Influenza virus
AWSATACHD

SEQ ID NO: 464261 - protein, 9 aa, Influenza virus
AWSATACSD

SEQ ID NO: 464262 - protein, 9 aa, Influenza virus
AWSRSSCHD

SEQ ID NO: 464263 - protein, 9 aa, Influenza virus
AWSSASCHD

SEQ ID NO: 464264 - protein, 9 aa, Influenza virus
AWSSSSCFD

SEQ ID NO: 464265 - protein, 9 aa, Influenza virus
AWSSSSCHD

SEQ ID NO: 464266 - protein, 9 aa, Influenza virus
AWSSSSCYD

SEQ ID NO: 464267 - protein, 9 aa, Influenza virus
AWSSTSCFD

SEQ ID NO: 464268 - protein, 9 aa, Influenza virus
AWSYIVERP

SEQ ID NO: 464269 - protein, 9 aa, Influenza virus
AWTAVNSIC

SEQ ID NO: 464270 - protein, 9 aa, Influenza virus
AWTMVNSIC

SEQ ID NO: 464271 - protein, 9 aa, Influenza virus
AWTVINSIC

SEQ ID NO: 464272 - protein, 9 aa, Influenza virus
AWTVVNSIC

SEQ ID NO: 464273 - protein, 9 aa, Influenza virus
AWTVVNSLC

SEQ ID NO: 464274 - protein, 9 aa, Influenza virus
AYAVIHYGG

SEQ ID NO: 464275 - protein, 9 aa, Influenza virus
AYCNTDLGA

SEQ ID NO: 464276 - protein, 9 aa, Influenza virus
AYCNTDLGS

SEQ ID NO: 464277 - protein, 9 aa, Influenza virus
AYCNTDLGT

SEQ ID NO: 464278 - protein, 9 aa, Influenza virus
AYCYPGATM

SEQ ID NO: 464279 - protein, 9 aa, Influenza virus
AYCYPGATV

SEQ ID NO: 464280 - protein, 9 aa, Influenza virus
AYCYPGSTV

SEQ ID NO: 464281 - protein, 9 aa, Influenza virus
AYCYPGTTV

SEQ ID NO: 464282 - protein, 9 aa, Influenza virus
AYDKICIGY

SEQ ID NO: 464283 - protein, 9 aa, Influenza virus
AYDRICIGY

SEQ ID NO: 464284 - protein, 9 aa, Influenza virus
AYERMCNIL

SEQ ID NO: 464285 - protein, 9 aa, Influenza virus
AYGVKGFSF

SEQ ID NO: 464286 - protein, 9 aa, Influenza virus
AYIVKKGDS

SEQ ID NO: 464287 - protein, 9 aa, Influenza virus
AYKIIKKGD

SEQ ID NO: 464288 - protein, 9 aa, Influenza virus
AYKILTIYS

SEQ ID NO: 464289 - protein, 9 aa, Influenza virus
AYKIVKEGD

SEQ ID NO: 464290 - protein, 9 aa, Influenza virus
AYKIVKKGD

SEQ ID NO: 464291 - protein, 9 aa, Influenza virus
AYKIVKTGD

SEQ ID NO: 464292 - protein, 9 aa, Influenza virus
AYMLERELV

SEQ ID NO: 464293 - protein, 9 aa, Influenza virus
AYNAELIVL

SEQ ID NO: 464294 - protein, 9 aa, Influenza virus
AYNAELLVL

SEQ ID NO: 464295 - protein, 9 aa, Influenza virus
AYNFNEGSY

SEQ ID NO: 464296 - protein, 9 aa, Influenza virus
AYNNTTGRD

SEQ ID NO: 464297 - protein, 9 aa, Influenza virus
AYPFQNLTK

SEQ ID NO: 464298 - protein, 9 aa, Influenza virus
AYPLQNLTK

SEQ ID NO: 464299 - protein, 9 aa, Influenza virus
AYQAKFESV

SEQ ID NO: 464300 - protein, 9 aa, Influenza virus
AYQAQFESV

SEQ ID NO: 464301 - protein, 9 aa, Influenza virus
AYQARFESV

SEQ ID NO: 464302 - protein, 9 aa, Influenza virus
AYQKQMTRG

SEQ ID NO: 464303 - protein, 9 aa, Influenza virus
AYQKRMGLQ

SEQ ID NO: 464304 - protein, 9 aa, Influenza virus
AYQKRMGVQ

SEQ ID NO: 464305 - protein, 9 aa, Influenza virus
AYQKRMTRG

SEQ ID NO: 464306 - protein, 9 aa, Influenza virus
AYRKRMTRG

SEQ ID NO: 464307 - protein, 9 aa, Influenza virus
AYSQITNGT

SEQ ID NO: 464308 - protein, 9 aa, Influenza virus
AYTKILYFH

SEQ ID NO: 464309 - protein, 9 aa, Influenza virus
AYTKIMYFH

SEQ ID NO: 464310 - protein, 9 aa, Influenza virus
AYTKVLYFH

SEQ ID NO: 464311 - protein, 9 aa, Influenza virus
AYTKVMYFH

SEQ ID NO: 464312 - protein, 9 aa, Influenza virus
AYVDGFEPN

SEQ ID NO: 464313 - protein, 9 aa, Influenza virus
AYVDGFKPN

SEQ ID NO: 464314 - protein, 9 aa, Influenza virus
AYWWDGLQS

SEQ ID NO: 464315 - protein, 9 aa, Influenza virus
CAAMDDFQL

SEQ ID NO: 464316 - protein, 9 aa, Influenza virus
CAAMDEFQL

SEQ ID NO: 464317 - protein, 9 aa, Influenza virus
CAAMEDFQL

SEQ ID NO: 464318 - protein, 9 aa, Influenza virus
CAAWSSSSC

SEQ ID NO: 464319 - protein, 9 aa, Influenza virus
CAGIPSDTP

SEQ ID NO: 464320 - protein, 9 aa, Influenza virus
CAGIPTDTP

SEQ ID NO: 464321 - protein, 9 aa, Influenza virus
CAGLPSDTP

SEQ ID NO: 464322 - protein, 9 aa, Influenza virus
CASNINIRE

SEQ ID NO: 464323 - protein, 9 aa, Influenza virus
CATCEQIAD

SEQ ID NO: 464324 - protein, 9 aa, Influenza virus
CATNINIRE

SEQ ID NO: 464325 - protein, 9 aa, Influenza virus
CAVATTHSW

SEQ ID NO: 464326 - protein, 9 aa, Influenza virus
CAVNSWHIL

SEQ ID NO: 464327 - protein, 9 aa, Influenza virus
CAVVMTDGN

SEQ ID NO: 464328 - protein, 9 aa, Influenza virus
CAVVMTDGS

SEQ ID NO: 464329 - protein, 9 aa, Influenza virus
CCNLFEKFF

SEQ ID NO: 464330 - protein, 9 aa, Influenza virus
CCSLFEKFF

SEQ ID NO: 464331 - protein, 9 aa, Influenza virus
CCTLFEKFF

SEQ ID NO: 464332 - protein, 9 aa, Influenza virus
CDAPFDDRL

SEQ ID NO: 464333 - protein, 9 aa, Influenza virus
CDDDCMASI

SEQ ID NO: 464334 - protein, 9 aa, Influenza virus
CDDHCMESI

SEQ ID NO: 464335 - protein, 9 aa, Influenza virus
CDDLIGKNS

SEQ ID NO: 464336 - protein, 9 aa, Influenza virus
CDDLIGKTS

SEQ ID NO: 464337 - protein, 9 aa, Influenza virus
CDDNCMESI

SEQ ID NO: 464338 - protein, 9 aa, Influenza virus
CDDPCMESI

SEQ ID NO: 464339 - protein, 9 aa, Influenza virus
CDDQCMESI

SEQ ID NO: 464340 - protein, 9 aa, Influenza virus
CDDSCMESI

SEQ ID NO: 464341 - protein, 9 aa, Influenza virus
CDELIGKTS

SEQ ID NO: 464342 - protein, 9 aa, Influenza virus
CDHSDNADK

SEQ ID NO: 464343 - protein, 9 aa, Influenza virus
CDIINGALG

SEQ ID NO: 464344 - protein, 9 aa, Influenza virus
CDIVNAALG

SEQ ID NO: 464345 - protein, 9 aa, Influenza virus
CDIVNGALG

SEQ ID NO: 464346 - protein, 9 aa, Influenza virus
CDIVNSALG

SEQ ID NO: 464347 - protein, 9 aa, Influenza virus
CDLHLEFKA

SEQ ID NO: 464348 - protein, 9 aa, Influenza virus
CDLHLTGIW

SEQ ID NO: 464349 - protein, 9 aa, Influenza virus
CDLHLTGKW

SEQ ID NO: 464350 - protein, 9 aa, Influenza virus
CDLHLTGTW

SEQ ID NO: 464351 - protein, 9 aa, Influenza virus
CDLINGALG

SEQ ID NO: 464352 - protein, 9 aa, Influenza virus
CDLYLNGRE

SEQ ID NO: 464353 - protein, 9 aa, Influenza virus
CDLYLSGRE

SEQ ID NO: 464354 - protein, 9 aa, Influenza virus
CDLYLTGTW

SEQ ID NO: 464355 - protein, 9 aa, Influenza virus
CDNECMETI

SEQ ID NO: 464356 - protein, 9 aa, Influenza virus
CDNKCIESI

SEQ ID NO: 464357 - protein, 9 aa, Influenza virus
CDNKCMETI

SEQ ID NO: 464358 - protein, 9 aa, Influenza virus
CDNLIGKTS

SEQ ID NO: 464359 - protein, 9 aa, Influenza virus
CDNNCIESI

SEQ ID NO: 464360 - protein, 9 aa, Influenza virus
CDNNCMESI

SEQ ID NO: 464361 - protein, 9 aa, Influenza virus
CDNQCMESI

SEQ ID NO: 464362 - protein, 9 aa, Influenza virus
CDNSCIESI

SEQ ID NO: 464363 - protein, 9 aa, Influenza virus
CDNTCIESI

SEQ ID NO: 464364 - protein, 9 aa, Influenza virus
CDPDECRFY

SEQ ID NO: 464365 - protein, 9 aa, Influenza virus
CDPDGCRFY

SEQ ID NO: 464366 - protein, 9 aa, Influenza virus
CDPHLTGTW

SEQ ID NO: 464367 - protein, 9 aa, Influenza virus
CDPIGCKMY

SEQ ID NO: 464368 - protein, 9 aa, Influenza virus
CDPLGCKMY

SEQ ID NO: 464369 - protein, 9 aa, Influenza virus
CDPLGCRMY

SEQ ID NO: 464370 - protein, 9 aa, Influenza virus
CDPNECRFY

SEQ ID NO: 464371 - protein, 9 aa, Influenza virus
CDPSGCKMY

SEQ ID NO: 464372 - protein, 9 aa, Influenza virus
CDPTGCKMY

SEQ ID NO: 464373 - protein, 9 aa, Influenza virus
CDPYLNGRE

SEQ ID NO: 464374 - protein, 9 aa, Influenza virus
CDRLQDTTW

SEQ ID NO: 464375 - protein, 9 aa, Influenza virus
CDSHLKFKA

SEQ ID NO: 464376 - protein, 9 aa, Influenza virus
CDSPSNING

SEQ ID NO: 464377 - protein, 9 aa, Influenza virus
CDSPSNVKG

SEQ ID NO: 464378 - protein, 9 aa, Influenza virus
CDSPSNVNG

SEQ ID NO: 464379 - protein, 9 aa, Influenza virus
CDTKCQTPL

SEQ ID NO: 464380 - protein, 9 aa, Influenza virus
CDYLIGKTS

SEQ ID NO: 464381 - protein, 9 aa, Influenza virus
CEGECFYSG

SEQ ID NO: 464382 - protein, 9 aa, Influenza virus
CEITGFAPF

SEQ ID NO: 464383 - protein, 9 aa, Influenza virus
CEKLEQSGL

SEQ ID NO: 464384 - protein, 9 aa, Influenza virus
CEPDECRFY

SEQ ID NO: 464385 - protein, 9 aa, Influenza virus
CEPIIIEKN

SEQ ID NO: 464386 - protein, 9 aa, Influenza virus
CEPIIIERN

SEQ ID NO: 464387 - protein, 9 aa, Influenza virus
CEPIIVERN

SEQ ID NO: 464388 - protein, 9 aa, Influenza virus
CEPTIIERN

SEQ ID NO: 464389 - protein, 9 aa, Influenza virus
CEQIADAQH

SEQ ID NO: 464390 - protein, 9 aa, Influenza virus
CEQIADSHH

SEQ ID NO: 464391 - protein, 9 aa, Influenza virus
CEQIADSQH

SEQ ID NO: 464392 - protein, 9 aa, Influenza virus
CESKCFWKG

SEQ ID NO: 464393 - protein, 9 aa, Influenza virus
CESKCFWRG

SEQ ID NO: 464394 - protein, 9 aa, Influenza virus
CETKCQSPL

SEQ ID NO: 464395 - protein, 9 aa, Influenza virus
CETKCQTPL

SEQ ID NO: 464396 - protein, 9 aa, Influenza virus
CETQCQTPL

SEQ ID NO: 464397 - protein, 9 aa, Influenza virus
CETRCQTPL

SEQ ID NO: 464398 - protein, 9 aa, Influenza virus
CEVNSWHIF

SEQ ID NO: 464399 - protein, 9 aa, Influenza virus
CEVNSWHIL

SEQ ID NO: 464400 - protein, 9 aa, Influenza virus
CEVSSWHIL

SEQ ID NO: 464401 - protein, 9 aa, Influenza virus
CFDGKEWLH

SEQ ID NO: 464402 - protein, 9 aa, Influenza virus
CFDGKEWMH

SEQ ID NO: 464403 - protein, 9 aa, Influenza virus
CFDGREWMH

SEQ ID NO: 464404 - protein, 9 aa, Influenza virus
CFDILHKCD

SEQ ID NO: 464405 - protein, 9 aa, Influenza virus
CFDILHKCN

SEQ ID NO: 464406 - protein, 9 aa, Influenza virus
CFDLYHKCD

SEQ ID NO: 464407 - protein, 9 aa, Influenza virus
CFEFWHKCD

SEQ ID NO: 464408 - protein, 9 aa, Influenza virus
CFEFWHKCN

SEQ ID NO: 464409 - protein, 9 aa, Influenza virus
CFEFYHKCD

SEQ ID NO: 464410 - protein, 9 aa, Influenza virus
CFEFYHKCN

SEQ ID NO: 464411 - protein, 9 aa, Influenza virus
CFEFYHRCD

SEQ ID NO: 464412 - protein, 9 aa, Influenza virus
CFEIFHKCD

SEQ ID NO: 464413 - protein, 9 aa, Influenza virus
CFEIFHQCD

SEQ ID NO: 464414 - protein, 9 aa, Influenza virus
CFEIFHRCD

SEQ ID NO: 464415 - protein, 9 aa, Influenza virus
CFEILHKCD

SEQ ID NO: 464416 - protein, 9 aa, Influenza virus
CFEILHKCN

SEQ ID NO: 464417 - protein, 9 aa, Influenza virus
CFEILHRCD

SEQ ID NO: 464418 - protein, 9 aa, Influenza virus
CFEILHRCN

SEQ ID NO: 464419 - protein, 9 aa, Influenza virus
CFEIYHACD

SEQ ID NO: 464420 - protein, 9 aa, Influenza virus
CFEIYHKCD

SEQ ID NO: 464421 - protein, 9 aa, Influenza virus
CFEIYHNCD

SEQ ID NO: 464422 - protein, 9 aa, Influenza virus
CFEIYHRCD

SEQ ID NO: 464423 - protein, 9 aa, Influenza virus
CFEIYHTCD

SEQ ID NO: 464424 - protein, 9 aa, Influenza virus
CFELLHKCN

SEQ ID NO: 464425 - protein, 9 aa, Influenza virus
CFELYHKCD

SEQ ID NO: 464426 - protein, 9 aa, Influenza virus
CFELYHKCN

SEQ ID NO: 464427 - protein, 9 aa, Influenza virus
CFELYHRCD

SEQ ID NO: 464428 - protein, 9 aa, Influenza virus
CFFMQIAIL

SEQ ID NO: 464429 - protein, 9 aa, Influenza virus
CFKIYHKCD

SEQ ID NO: 464430 - protein, 9 aa, Influenza virus
CFKIYHKCN

SEQ ID NO: 464431 - protein, 9 aa, Influenza virus
CFKIYHRCD

SEQ ID NO: 464432 - protein, 9 aa, Influenza virus
CFLLAALLL

SEQ ID NO: 464433 - protein, 9 aa, Influenza virus
CFLLIALLL

SEQ ID NO: 464434 - protein, 9 aa, Influenza virus
CFLLVALFL

SEQ ID NO: 464435 - protein, 9 aa, Influenza virus
CFLLVALLI

SEQ ID NO: 464436 - protein, 9 aa, Influenza virus
CFLLVALLL

SEQ ID NO: 464437 - protein, 9 aa, Influenza virus
CFLMQIAIL

SEQ ID NO: 464438 - protein, 9 aa, Influenza virus
CFLMQIATL

SEQ ID NO: 464439 - protein, 9 aa, Influenza virus
CFLMQIAVL

SEQ ID NO: 464440 - protein, 9 aa, Influenza virus
CFLMQITIL

SEQ ID NO: 464441 - protein, 9 aa, Influenza virus
CFLWHVRKR

SEQ ID NO: 464442 - protein, 9 aa, Influenza virus
CFMYSDFHF

SEQ ID NO: 464443 - protein, 9 aa, Influenza virus
CFNFFHKCN

SEQ ID NO: 464444 - protein, 9 aa, Influenza virus
CFNLLHKCN

SEQ ID NO: 464445 - protein, 9 aa, Influenza virus
CFNPCFYVE

SEQ ID NO: 464446 - protein, 9 aa, Influenza virus
CFNPITGSP

SEQ ID NO: 464447 - protein, 9 aa, Influenza virus
CFNPMIAEL

SEQ ID NO: 464448 - protein, 9 aa, Influenza virus
CFNPMIIEL

SEQ ID NO: 464449 - protein, 9 aa, Influenza virus
CFNPMIVEL

SEQ ID NO: 464450 - protein, 9 aa, Influenza virus
CFNPMTVEL

SEQ ID NO: 464451 - protein, 9 aa, Influenza virus
CFNPMVVEL

SEQ ID NO: 464452 - protein, 9 aa, Influenza virus
CFPFYHKCD

SEQ ID NO: 464453 - protein, 9 aa, Influenza virus
CFPGELDNN

SEQ ID NO: 464454 - protein, 9 aa, Influenza virus
CFPGEVDNN

SEQ ID NO: 464455 - protein, 9 aa, Influenza virus
CFQPCFYIE

SEQ ID NO: 464456 - protein, 9 aa, Influenza virus
CFQPCFYVE

SEQ ID NO: 464457 - protein, 9 aa, Influenza virus
CFQRSKFLL

SEQ ID NO: 464458 - protein, 9 aa, Influenza virus
CFRIYHKCD

SEQ ID NO: 464459 - protein, 9 aa, Influenza virus
CFSILHKCN

SEQ ID NO: 464460 - protein, 9 aa, Influenza virus
CFSLLHKCN

SEQ ID NO: 464461 - protein, 9 aa, Influenza virus
CFTFYHKCD

SEQ ID NO: 464462 - protein, 9 aa, Influenza virus
CFTFYHKCN

SEQ ID NO: 464463 - protein, 9 aa, Influenza virus
CFTIMTDGP

SEQ ID NO: 464464 - protein, 9 aa, Influenza virus
CFTIYHKCD

SEQ ID NO: 464465 - protein, 9 aa, Influenza virus
CFTVLTDGP

SEQ ID NO: 464466 - protein, 9 aa, Influenza virus
CFTVMTDGP

SEQ ID NO: 464467 - protein, 9 aa, Influenza virus
CFVFVALIL

SEQ ID NO: 464468 - protein, 9 aa, Influenza virus
CFWKGGSIK

SEQ ID NO: 464469 - protein, 9 aa, Influenza virus
CFWKGGSIN

SEQ ID NO: 464470 - protein, 9 aa, Influenza virus
CFWKGGTIN

SEQ ID NO: 464471 - protein, 9 aa, Influenza virus
CFWLEMIRG

SEQ ID NO: 464472 - protein, 9 aa, Influenza virus
CFWMCSNGS

SEQ ID NO: 464473 - protein, 9 aa, Influenza virus
CFWRGGSII

SEQ ID NO: 464474 - protein, 9 aa, Influenza virus
CFWRGGSIN

SEQ ID NO: 464475 - protein, 9 aa, Influenza virus
CFWVELIRG

SEQ ID NO: 464476 - protein, 9 aa, Influenza virus
CFWVELVRG

SEQ ID NO: 464477 - protein, 9 aa, Influenza virus
CFWVEMIRG

SEQ ID NO: 464478 - protein, 9 aa, Influenza virus
CFWVMTDGP

SEQ ID NO: 464479 - protein, 9 aa, Influenza virus
CFYIELIRG

SEQ ID NO: 464480 - protein, 9 aa, Influenza virus
CFYSGGTIN

SEQ ID NO: 464481 - protein, 9 aa, Influenza virus
CFYVELIRG

SEQ ID NO: 464482 - protein, 9 aa, Influenza virus
CFYVELTRG

SEQ ID NO: 464483 - protein, 9 aa, Influenza virus
CFYVELVRG

SEQ ID NO: 464484 - protein, 9 aa, Influenza virus
CGCRDNWQG

SEQ ID NO: 464485 - protein, 9 aa, Influenza virus
CGILGILTG

SEQ ID NO: 464486 - protein, 9 aa, Influenza virus
CGILGTIIG

SEQ ID NO: 464487 - protein, 9 aa, Influenza virus
CGLDNEPGS

SEQ ID NO: 464488 - protein, 9 aa, Influenza virus
CGLLGIITG

SEQ ID NO: 464489 - protein, 9 aa, Influenza virus
CGLLGILIG

SEQ ID NO: 464490 - protein, 9 aa, Influenza virus
CGLLGTITG

SEQ ID NO: 464491 - protein, 9 aa, Influenza virus
CGLLGTLIG

SEQ ID NO: 464492 - protein, 9 aa, Influenza virus
CGLLGTLTG

SEQ ID NO: 464493 - protein, 9 aa, Influenza virus
CGLLGTVTG

SEQ ID NO: 464494 - protein, 9 aa, Influenza virus
CGLNNEPGS

SEQ ID NO: 464495 - protein, 9 aa, Influenza virus
CGMIDGWYG

SEQ ID NO: 464496 - protein, 9 aa, Influenza virus
CGNGSCRCT

SEQ ID NO: 464497 - protein, 9 aa, Influenza virus
CGNNCIESI

SEQ ID NO: 464498 - protein, 9 aa, Influenza virus
CGPAECRTF

SEQ ID NO: 464499 - protein, 9 aa, Influenza virus
CGPSECRTF

SEQ ID NO: 464500 - protein, 9 aa, Influenza virus
CGPTECRTF

SEQ ID NO: 464501 - protein, 9 aa, Influenza virus
CGSKEQLGS

SEQ ID NO: 464502 - protein, 9 aa, Influenza virus
CGSKERLGS

SEQ ID NO: 464503 - protein, 9 aa, Influenza virus
CGSKKRLGS

SEQ ID NO: 464504 - protein, 9 aa, Influenza virus
CGSPFPVGS

SEQ ID NO: 464505 - protein, 9 aa, Influenza virus
CGSPISVGS

SEQ ID NO: 464506 - protein, 9 aa, Influenza virus
CGSPVPVGS

SEQ ID NO: 464507 - protein, 9 aa, Influenza virus
CGSPVSVGS

SEQ ID NO: 464508 - protein, 9 aa, Influenza virus
CGSRERLGS

SEQ ID NO: 464509 - protein, 9 aa, Influenza virus
CGTGSWPDG

SEQ ID NO: 464510 - protein, 9 aa, Influenza virus
CGTSGTYGA

SEQ ID NO: 464511 - protein, 9 aa, Influenza virus
CGTSGTYGS

SEQ ID NO: 464512 - protein, 9 aa, Influenza virus
CGTSGTYGT

SEQ ID NO: 464513 - protein, 9 aa, Influenza virus
CGVDSDTTG

SEQ ID NO: 464514 - protein, 9 aa, Influenza virus
CGVDSDTTS

SEQ ID NO: 464515 - protein, 9 aa, Influenza virus
CGVNSDTTG

SEQ ID NO: 464516 - protein, 9 aa, Influenza virus
CGVNSDTTS

SEQ ID NO: 464517 - protein, 9 aa, Influenza virus
CGVNSNTTG

SEQ ID NO: 464518 - protein, 9 aa, Influenza virus
CGVSGEVPG

SEQ ID NO: 464519 - protein, 9 aa, Influenza virus
CGVSSEVPE

SEQ ID NO: 464520 - protein, 9 aa, Influenza virus
CGVSSEVPG

SEQ ID NO: 464521 - protein, 9 aa, Influenza virus
CHDGASWLT

SEQ ID NO: 464522 - protein, 9 aa, Influenza virus
CHDGIARMT

SEQ ID NO: 464523 - protein, 9 aa, Influenza virus
CHDGIGRMT

SEQ ID NO: 464524 - protein, 9 aa, Influenza virus
CHDGISRMS

SEQ ID NO: 464525 - protein, 9 aa, Influenza virus
CHDGISWLT

SEQ ID NO: 464526 - protein, 9 aa, Influenza virus
CHDGKARMS

SEQ ID NO: 464527 - protein, 9 aa, Influenza virus
CHDGKAWLH

SEQ ID NO: 464528 - protein, 9 aa, Influenza virus
CHDGKEWLH

SEQ ID NO: 464529 - protein, 9 aa, Influenza virus
CHDGKFRMS

SEQ ID NO: 464530 - protein, 9 aa, Influenza virus
CHDGKKWMA

SEQ ID NO: 464531 - protein, 9 aa, Influenza virus
CHDGKKWMT

SEQ ID NO: 464532 - protein, 9 aa, Influenza virus
CHDGKSRMS

SEQ ID NO: 464533 - protein, 9 aa, Influenza virus
CHDGKSWLH

SEQ ID NO: 464534 - protein, 9 aa, Influenza virus
CHDGMSRMS

SEQ ID NO: 464535 - protein, 9 aa, Influenza virus
CHDGNAWLH

SEQ ID NO: 464536 - protein, 9 aa, Influenza virus
CHDGNKWMT

SEQ ID NO: 464537 - protein, 9 aa, Influenza virus
CHDGRARMS

SEQ ID NO: 464538 - protein, 9 aa, Influenza virus
CHDGRAWLH

SEQ ID NO: 464539 - protein, 9 aa, Influenza virus
CHDGRKWMT

SEQ ID NO: 464540 - protein, 9 aa, Influenza virus
CHDGRSRMS

SEQ ID NO: 464541 - protein, 9 aa, Influenza virus
CHDGSSWLT

SEQ ID NO: 464542 - protein, 9 aa, Influenza virus
CHDGTNWLT

SEQ ID NO: 464543 - protein, 9 aa, Influenza virus
CHDGTSWLT

SEQ ID NO: 464544 - protein, 9 aa, Influenza virus
CHDGVGRMT

SEQ ID NO: 464545 - protein, 9 aa, Influenza virus
CHDGVNRMT

SEQ ID NO: 464546 - protein, 9 aa, Influenza virus
CHDGVSRMS

SEQ ID NO: 464547 - protein, 9 aa, Influenza virus
CHDGVSRMT

SEQ ID NO: 464548 - protein, 9 aa, Influenza virus
CHIGVAPSP

SEQ ID NO: 464549 - protein, 9 aa, Influenza virus
CHITGFAPF

SEQ ID NO: 464550 - protein, 9 aa, Influenza virus
CHKGICPVV

SEQ ID NO: 464551 - protein, 9 aa, Influenza virus
CHKGVCPVV

SEQ ID NO: 464552 - protein, 9 aa, Influenza virus
CHNGICPVA

SEQ ID NO: 464553 - protein, 9 aa, Influenza virus
CHNGICPVV

SEQ ID NO: 464554 - protein, 9 aa, Influenza virus
CHNGTCAVV

SEQ ID NO: 464555 - protein, 9 aa, Influenza virus
CHNGTCPVV

SEQ ID NO: 464556 - protein, 9 aa, Influenza virus
CHNGTCVVI

SEQ ID NO: 464557 - protein, 9 aa, Influenza virus
CHNGTCVVV

SEQ ID NO: 464558 - protein, 9 aa, Influenza virus
CHNGVCPVV

SEQ ID NO: 464559 - protein, 9 aa, Influenza virus
CHPIGMIIG

SEQ ID NO: 464560 - protein, 9 aa, Influenza virus
CHPIGMLIG

SEQ ID NO: 464561 - protein, 9 aa, Influenza virus
CHPIGMVIG

SEQ ID NO: 464562 - protein, 9 aa, Influenza virus
CHPIGMVVG

SEQ ID NO: 464563 - protein, 9 aa, Influenza virus
CHPVGMLIG

SEQ ID NO: 464564 - protein, 9 aa, Influenza virus
CHQRSKFLL

SEQ ID NO: 464565 - protein, 9 aa, Influenza virus
CHSAAFEDL

SEQ ID NO: 464566 - protein, 9 aa, Influenza virus
CHSGICPVV

SEQ ID NO: 464567 - protein, 9 aa, Influenza virus
CHSGVCPVV

SEQ ID NO: 464568 - protein, 9 aa, Influenza virus
CHTKCQTYA

SEQ ID NO: 464569 - protein, 9 aa, Influenza virus
CHTKCQTYT

SEQ ID NO: 464570 - protein, 9 aa, Influenza virus
CIASSIVLV

SEQ ID NO: 464571 - protein, 9 aa, Influenza virus
CIASSIVMV

SEQ ID NO: 464572 - protein, 9 aa, Influenza virus
CIASSLILA

SEQ ID NO: 464573 - protein, 9 aa, Influenza virus
CIASSLVLA

SEQ ID NO: 464574 - protein, 9 aa, Influenza virus
CIASSTVLV

SEQ ID NO: 464575 - protein, 9 aa, Influenza virus
CIASSTVMV

SEQ ID NO: 464576 - protein, 9 aa, Influenza virus
CIASSVVLV

SEQ ID NO: 464577 - protein, 9 aa, Influenza virus
CIAWSSASC

SEQ ID NO: 464578 - protein, 9 aa, Influenza virus
CIAWSSSSC

SEQ ID NO: 464579 - protein, 9 aa, Influenza virus
CICEKLEQS

SEQ ID NO: 464580 - protein, 9 aa, Influenza virus
CICINGTCT

SEQ ID NO: 464581 - protein, 9 aa, Influenza virus
CICRDNWKG

SEQ ID NO: 464582 - protein, 9 aa, Influenza virus
CICRDNWQG

SEQ ID NO: 464583 - protein, 9 aa, Influenza virus
CICRDNWRG

SEQ ID NO: 464584 - protein, 9 aa, Influenza virus
CICRDNWTG

SEQ ID NO: 464585 - protein, 9 aa, Influenza virus
CIDFRDMRK

SEQ ID NO: 464586 - protein, 9 aa, Influenza virus
CIEGKLSQM

SEQ ID NO: 464587 - protein, 9 aa, Influenza virus
CIEKIRNGT

SEQ ID NO: 464588 - protein, 9 aa, Influenza virus
CIEKVRNGT

SEQ ID NO: 464589 - protein, 9 aa, Influenza virus
CIERVRNGT

SEQ ID NO: 464590 - protein, 9 aa, Influenza virus
CIESIRNGT

SEQ ID NO: 464591 - protein, 9 aa, Influenza virus
CIESKLSQM

SEQ ID NO: 464592 - protein, 9 aa, Influenza virus
CIESVRNGT

SEQ ID NO: 464593 - protein, 9 aa, Influenza virus
CIGHHANNS

SEQ ID NO: 464594 - protein, 9 aa, Influenza virus
CIGSIRNET

SEQ ID NO: 464595 - protein, 9 aa, Influenza virus
CIGSIRNGT

SEQ ID NO: 464596 - protein, 9 aa, Influenza virus
CIGWSSTSC

SEQ ID NO: 464597 - protein, 9 aa, Influenza virus
CIGYHANNS

SEQ ID NO: 464598 - protein, 9 aa, Influenza virus
CIGYHSNNS

SEQ ID NO: 464599 - protein, 9 aa, Influenza virus
CIGYLSNNA

SEQ ID NO: 464600 - protein, 9 aa, Influenza virus
CIGYLSNNS

SEQ ID NO: 464601 - protein, 9 aa, Influenza virus
CIGYLSTNS

SEQ ID NO: 464602 - protein, 9 aa, Influenza virus
CIGYMSNNS

SEQ ID NO: 464603 - protein, 9 aa, Influenza virus
CIGYQSNNS

SEQ ID NO: 464604 - protein, 9 aa, Influenza virus
CIGYQTNNS

SEQ ID NO: 464605 - protein, 9 aa, Influenza virus
CIINSWHIY

SEQ ID NO: 464606 - protein, 9 aa, Influenza virus
CIKNGNMQC

SEQ ID NO: 464607 - protein, 9 aa, Influenza virus
CIKNGNMRC

SEQ ID NO: 464608 - protein, 9 aa, Influenza virus
CIKPCFWVE

SEQ ID NO: 464609 - protein, 9 aa, Influenza virus
CIKTFFGWK

SEQ ID NO: 464610 - protein, 9 aa, Influenza virus
CILDQNFRN

SEQ ID NO: 464611 - protein, 9 aa, Influenza virus
CINGICTVV

SEQ ID NO: 464612 - protein, 9 aa, Influenza virus
CINGSCAVV

SEQ ID NO: 464613 - protein, 9 aa, Influenza virus
CINGSCIVV

SEQ ID NO: 464614 - protein, 9 aa, Influenza virus
CINGSCTVV

SEQ ID NO: 464615 - protein, 9 aa, Influenza virus
CINGTCAVV

SEQ ID NO: 464616 - protein, 9 aa, Influenza virus
CINGTCTVI

SEQ ID NO: 464617 - protein, 9 aa, Influenza virus
CINGTCTVV

SEQ ID NO: 464618 - protein, 9 aa, Influenza virus
CINRCFYVE

SEQ ID NO: 464619 - protein, 9 aa, Influenza virus
CIQGNNDNA

SEQ ID NO: 464620 - protein, 9 aa, Influenza virus
CIRPCFWVE

SEQ ID NO: 464621 - protein, 9 aa, Influenza virus
CIRTFFGWK

SEQ ID NO: 464622 - protein, 9 aa, Influenza virus
CISATGMAL

SEQ ID NO: 464623 - protein, 9 aa, Influenza virus
CISATGMIL

SEQ ID NO: 464624 - protein, 9 aa, Influenza virus
CISATGMTL

SEQ ID NO: 464625 - protein, 9 aa, Influenza virus
CISATGVTL

SEQ ID NO: 464626 - protein, 9 aa, Influenza virus
CISGPNNNA

SEQ ID NO: 464627 - protein, 9 aa, Influenza virus
CISGTCAVV

SEQ ID NO: 464628 - protein, 9 aa, Influenza virus
CISTTGMTL

SEQ ID NO: 464629 - protein, 9 aa, Influenza virus
CITGDDKNA

SEQ ID NO: 464630 - protein, 9 aa, Influenza virus
CITGDDRNA

SEQ ID NO: 464631 - protein, 9 aa, Influenza virus
CITPNGSIP

SEQ ID NO: 464632 - protein, 9 aa, Influenza virus
CITPNGSIS

SEQ ID NO: 464633 - protein, 9 aa, Influenza virus
CIVAVTDGP

SEQ ID NO: 464634 - protein, 9 aa, Influenza virus
CIVPCFWLE

SEQ ID NO: 464635 - protein, 9 aa, Influenza virus
CKAAIGLRI

SEQ ID NO: 464636 - protein, 9 aa, Influenza virus
CKAALGLRI

SEQ ID NO: 464637 - protein, 9 aa, Influenza virus
CKAAMGLKI

SEQ ID NO: 464638 - protein, 9 aa, Influenza virus
CKAAMGLRI

SEQ ID NO: 464639 - protein, 9 aa, Influenza virus
CKAAMGMRI

SEQ ID NO: 464640 - protein, 9 aa, Influenza virus
CKDPNNERG

SEQ ID NO: 464641 - protein, 9 aa, Influenza virus
CKIEAVIYG

SEQ ID NO: 464642 - protein, 9 aa, Influenza virus
CKIEGWVVV

SEQ ID NO: 464643 - protein, 9 aa, Influenza virus
CKITGFAPF

SEQ ID NO: 464644 - protein, 9 aa, Influenza virus
CKIVTTVGW

SEQ ID NO: 464645 - protein, 9 aa, Influenza virus
CKLLGINMS

SEQ ID NO: 464646 - protein, 9 aa, Influenza virus
CKLNGIPPL

SEQ ID NO: 464647 - protein, 9 aa, Influenza virus
CKLVGINMS

SEQ ID NO: 464648 - protein, 9 aa, Influenza virus
CKMYALHQG

SEQ ID NO: 464649 - protein, 9 aa, Influenza virus
CKPYIGKCP

SEQ ID NO: 464650 - protein, 9 aa, Influenza virus
CKRTVSSFY

SEQ ID NO: 464651 - protein, 9 aa, Influenza virus
CKSKCFWRG

SEQ ID NO: 464652 - protein, 9 aa, Influenza virus
CKTFFLTQG

SEQ ID NO: 464653 - protein, 9 aa, Influenza virus
CKTKCQTYA

SEQ ID NO: 464654 - protein, 9 aa, Influenza virus
CKVEAVIYG

SEQ ID NO: 464655 - protein, 9 aa, Influenza virus
CKVEGWVVV

SEQ ID NO: 464656 - protein, 9 aa, Influenza virus
CLAILIAGG

SEQ ID NO: 464657 - protein, 9 aa, Influenza virus
CLAILVAGG

SEQ ID NO: 464658 - protein, 9 aa, Influenza virus
CLAVLIAGG

SEQ ID NO: 464659 - protein, 9 aa, Influenza virus
CLGHHAIPN

SEQ ID NO: 464660 - protein, 9 aa, Influenza virus
CLGHHAVAN

SEQ ID NO: 464661 - protein, 9 aa, Influenza virus
CLGHHAVEN

SEQ ID NO: 464662 - protein, 9 aa, Influenza virus
CLGHHAVPN

SEQ ID NO: 464663 - protein, 9 aa, Influenza virus
CLGHHAVQN

SEQ ID NO: 464664 - protein, 9 aa, Influenza virus
CLGHHAVSN

SEQ ID NO: 464665 - protein, 9 aa, Influenza virus
CLGHHAVTN

SEQ ID NO: 464666 - protein, 9 aa, Influenza virus
CLINDPWVL

SEQ ID NO: 464667 - protein, 9 aa, Influenza virus
CLKIYHKCD

SEQ ID NO: 464668 - protein, 9 aa, Influenza virus
CLKNGNMRC

SEQ ID NO: 464669 - protein, 9 aa, Influenza virus
CLLQSLQQI

SEQ ID NO: 464670 - protein, 9 aa, Influenza virus
CLNGSMQCR

SEQ ID NO: 464671 - protein, 9 aa, Influenza virus
CLPACAYGP

SEQ ID NO: 464672 - protein, 9 aa, Influenza virus
CLPACIYGL

SEQ ID NO: 464673 - protein, 9 aa, Influenza virus
CLPACVYGL

SEQ ID NO: 464674 - protein, 9 aa, Influenza virus
CLPACVYGP

SEQ ID NO: 464675 - protein, 9 aa, Influenza virus
CLRGGRNSF

SEQ ID NO: 464676 - protein, 9 aa, Influenza virus
CLRNGNMRC

SEQ ID NO: 464677 - protein, 9 aa, Influenza virus
CLTDKGSIQ

SEQ ID NO: 464678 - protein, 9 aa, Influenza virus
CLVPCFWLE

SEQ ID NO: 464679 - protein, 9 aa, Influenza virus
CLVPCFWVE

SEQ ID NO: 464680 - protein, 9 aa, Influenza virus
CLYASPQLE

SEQ ID NO: 464681 - protein, 9 aa, Influenza virus
CMASIRNNS

SEQ ID NO: 464682 - protein, 9 aa, Influenza virus
CMASIRNNT

SEQ ID NO: 464683 - protein, 9 aa, Influenza virus
CMASIRNST

SEQ ID NO: 464684 - protein, 9 aa, Influenza virus
CMATIRNGT

SEQ ID NO: 464685 - protein, 9 aa, Influenza virus
CMAWSSSSC

SEQ ID NO: 464686 - protein, 9 aa, Influenza virus
CMDSVKNGT

SEQ ID NO: 464687 - protein, 9 aa, Influenza virus
CMDSVRNGT

SEQ ID NO: 464688 - protein, 9 aa, Influenza virus
CMDTIRNGT

SEQ ID NO: 464689 - protein, 9 aa, Influenza virus
CMEAIRNGT

SEQ ID NO: 464690 - protein, 9 aa, Influenza virus
CMERIRNNT

SEQ ID NO: 464691 - protein, 9 aa, Influenza virus
CMESIKNGT

SEQ ID NO: 464692 - protein, 9 aa, Influenza virus
CMESIRDNT

SEQ ID NO: 464693 - protein, 9 aa, Influenza virus
CMESIRNGT

SEQ ID NO: 464694 - protein, 9 aa, Influenza virus
CMESIRNNT

SEQ ID NO: 464695 - protein, 9 aa, Influenza virus
CMESVKNGT

SEQ ID NO: 464696 - protein, 9 aa, Influenza virus
CMESVRNGT

SEQ ID NO: 464697 - protein, 9 aa, Influenza virus
CMETIKNGT

SEQ ID NO: 464698 - protein, 9 aa, Influenza virus
CMETIRNGT

SEQ ID NO: 464699 - protein, 9 aa, Influenza virus
CMETTRNGT

SEQ ID NO: 464700 - protein, 9 aa, Influenza virus
CMGLIYNRM

SEQ ID NO: 464701 - protein, 9 aa, Influenza virus
CMGSIRNNT

SEQ ID NO: 464702 - protein, 9 aa, Influenza virus
CMGTIRNGT

SEQ ID NO: 464703 - protein, 9 aa, Influenza virus
CMIKAVRGD

SEQ ID NO: 464704 - protein, 9 aa, Influenza virus
CMKNGNMQC

SEQ ID NO: 464705 - protein, 9 aa, Influenza virus
CMKTFFGWK

SEQ ID NO: 464706 - protein, 9 aa, Influenza virus
CMKTFFGWR

SEQ ID NO: 464707 - protein, 9 aa, Influenza virus
CMMKAVRGD

SEQ ID NO: 464708 - protein, 9 aa, Influenza virus
CMNSVKNGT

SEQ ID NO: 464709 - protein, 9 aa, Influenza virus
CMNSVKTGT

SEQ ID NO: 464710 - protein, 9 aa, Influenza virus
CMNSVRNGT

SEQ ID NO: 464711 - protein, 9 aa, Influenza virus
CMRPCFWVE

SEQ ID NO: 464712 - protein, 9 aa, Influenza virus
CMRTFFGWK

SEQ ID NO: 464713 - protein, 9 aa, Influenza virus
CMSGPNDNA

SEQ ID NO: 464714 - protein, 9 aa, Influenza virus
CMSGPNNNA

SEQ ID NO: 464715 - protein, 9 aa, Influenza virus
CMSSVKNGT

SEQ ID NO: 464716 - protein, 9 aa, Influenza virus
CMTSIRNNT

SEQ ID NO: 464717 - protein, 9 aa, Influenza virus
CMVKAVRGD

SEQ ID NO: 464718 - protein, 9 aa, Influenza virus
CNALTGGQS

SEQ ID NO: 464719 - protein, 9 aa, Influenza virus
CNASTGAQS

SEQ ID NO: 464720 - protein, 9 aa, Influenza virus
CNASTGGQA

SEQ ID NO: 464721 - protein, 9 aa, Influenza virus
CNASTGGQS

SEQ ID NO: 464722 - protein, 9 aa, Influenza virus
CNDNCMESI

SEQ ID NO: 464723 - protein, 9 aa, Influenza virus
CNDPYPGNN

SEQ ID NO: 464724 - protein, 9 aa, Influenza virus
CNDSCMDTI

SEQ ID NO: 464725 - protein, 9 aa, Influenza virus
CNDSCMEAI

SEQ ID NO: 464726 - protein, 9 aa, Influenza virus
CNDSCMETI

SEQ ID NO: 464727 - protein, 9 aa, Influenza virus
CNEPYPGNN

SEQ ID NO: 464728 - protein, 9 aa, Influenza virus
CNFEGWIVG

SEQ ID NO: 464729 - protein, 9 aa, Influenza virus
CNILKGKFQ

SEQ ID NO: 464730 - protein, 9 aa, Influenza virus
CNLFEKFFP

SEQ ID NO: 464731 - protein, 9 aa, Influenza virus
CNNECMETI

SEQ ID NO: 464732 - protein, 9 aa, Influenza virus
CNNGSCRCT

SEQ ID NO: 464733 - protein, 9 aa, Influenza virus
CNNPITGSP

SEQ ID NO: 464734 - protein, 9 aa, Influenza virus
CNNSCMETI

SEQ ID NO: 464735 - protein, 9 aa, Influenza virus
CNNTCMETI

SEQ ID NO: 464736 - protein, 9 aa, Influenza virus
CNPLNPFVN

SEQ ID NO: 464737 - protein, 9 aa, Influenza virus
CNPLNPFVS

SEQ ID NO: 464738 - protein, 9 aa, Influenza virus
CNPLNPFVT

SEQ ID NO: 464739 - protein, 9 aa, Influenza virus
CNPMNPFVS

SEQ ID NO: 464740 - protein, 9 aa, Influenza virus
CNSAAFEDL

SEQ ID NO: 464741 - protein, 9 aa, Influenza virus
CNSGNCRFN

SEQ ID NO: 464742 - protein, 9 aa, Influenza virus
CNSNAITRS

SEQ ID NO: 464743 - protein, 9 aa, Influenza virus
CNTDLGAPL

SEQ ID NO: 464744 - protein, 9 aa, Influenza virus
CNTDLGSPL

SEQ ID NO: 464745 - protein, 9 aa, Influenza virus
CNTDLGTPL

SEQ ID NO: 464746 - protein, 9 aa, Influenza virus
CNTKCQTSL

SEQ ID NO: 464747 - protein, 9 aa, Influenza virus
CNTKCQTSM

SEQ ID NO: 464748 - protein, 9 aa, Influenza virus
CNTKCQTSV

SEQ ID NO: 464749 - protein, 9 aa, Influenza virus
CNTKCQTYA

SEQ ID NO: 464750 - protein, 9 aa, Influenza virus
CNTRCQTSV

SEQ ID NO: 464751 - protein, 9 aa, Influenza virus
CNVEGWVVI

SEQ ID NO: 464752 - protein, 9 aa, Influenza virus
CNVEGWVVV

SEQ ID NO: 464753 - protein, 9 aa, Influenza virus
CPFKGFFPF

SEQ ID NO: 464754 - protein, 9 aa, Influenza virus
CPFQGFFPF

SEQ ID NO: 464755 - protein, 9 aa, Influenza virus
CPFRGFFPF

SEQ ID NO: 464756 - protein, 9 aa, Influenza virus
CPIGEAPSP

SEQ ID NO: 464757 - protein, 9 aa, Influenza virus
CPIGEVPSP

SEQ ID NO: 464758 - protein, 9 aa, Influenza virus
CPIGVAPSP

SEQ ID NO: 464759 - protein, 9 aa, Influenza virus
CPIKGWAPL

SEQ ID NO: 464760 - protein, 9 aa, Influenza virus
CPIRGWAPL

SEQ ID NO: 464761 - protein, 9 aa, Influenza virus
CPKYIKQGS

SEQ ID NO: 464762 - protein, 9 aa, Influenza virus
CPKYIKSDQ

SEQ ID NO: 464763 - protein, 9 aa, Influenza virus
CPKYIKSGQ

SEQ ID NO: 464764 - protein, 9 aa, Influenza virus
CPKYIPSGS

SEQ ID NO: 464765 - protein, 9 aa, Influenza virus
CPKYIPSNS

SEQ ID NO: 464766 - protein, 9 aa, Influenza virus
CPKYIPSRS

SEQ ID NO: 464767 - protein, 9 aa, Influenza virus
CPKYISSGS

SEQ ID NO: 464768 - protein, 9 aa, Influenza virus
CPKYMNVKS

SEQ ID NO: 464769 - protein, 9 aa, Influenza virus
CPKYVKQES

SEQ ID NO: 464770 - protein, 9 aa, Influenza virus
CPKYVKQGS

SEQ ID NO: 464771 - protein, 9 aa, Influenza virus
CPKYVKSDR

SEQ ID NO: 464772 - protein, 9 aa, Influenza virus
CPKYVKSEK

SEQ ID NO: 464773 - protein, 9 aa, Influenza virus
CPKYVKSER

SEQ ID NO: 464774 - protein, 9 aa, Influenza virus
CPKYVKSKR

SEQ ID NO: 464775 - protein, 9 aa, Influenza virus
CPKYVNIKS

SEQ ID NO: 464776 - protein, 9 aa, Influenza virus
CPKYVNVKS

SEQ ID NO: 464777 - protein, 9 aa, Influenza virus
CPKYVNVRS

SEQ ID NO: 464778 - protein, 9 aa, Influenza virus
CPKYVRSEK

SEQ ID NO: 464779 - protein, 9 aa, Influenza virus
CPLGEAPSP

SEQ ID NO: 464780 - protein, 9 aa, Influenza virus
CPMGVAPSP

SEQ ID NO: 464781 - protein, 9 aa, Influenza virus
CPNGSLQCT

SEQ ID NO: 464782 - protein, 9 aa, Influenza virus
CPRYIKQKS

SEQ ID NO: 464783 - protein, 9 aa, Influenza virus
CPRYIPSGS

SEQ ID NO: 464784 - protein, 9 aa, Influenza virus
CPRYVKQES

SEQ ID NO: 464785 - protein, 9 aa, Influenza virus
CPRYVKQGS

SEQ ID NO: 464786 - protein, 9 aa, Influenza virus
CPRYVKQKS

SEQ ID NO: 464787 - protein, 9 aa, Influenza virus
CPRYVKQSS

SEQ ID NO: 464788 - protein, 9 aa, Influenza virus
CPRYVKQTS

SEQ ID NO: 464789 - protein, 9 aa, Influenza virus
CPSPLKLID

SEQ ID NO: 464790 - protein, 9 aa, Influenza virus
CPSPLKLVD

SEQ ID NO: 464791 - protein, 9 aa, Influenza virus
CPSPLRLID

SEQ ID NO: 464792 - protein, 9 aa, Influenza virus
CPSPLRLVD

SEQ ID NO: 464793 - protein, 9 aa, Influenza virus
CPVGEAPSP

SEQ ID NO: 464794 - protein, 9 aa, Influenza virus
CPVGVAPSP

SEQ ID NO: 464795 - protein, 9 aa, Influenza virus
CPVKGWAPL

SEQ ID NO: 464796 - protein, 9 aa, Influenza virus
CPVVFTDGS

SEQ ID NO: 464797 - protein, 9 aa, Influenza virus
CPVVMTDGP

SEQ ID NO: 464798 - protein, 9 aa, Influenza virus
CQDEFCYTL

SEQ ID NO: 464799 - protein, 9 aa, Influenza virus
CQIAGFAPF

SEQ ID NO: 464800 - protein, 9 aa, Influenza virus
CQITGFAPF

SEQ ID NO: 464801 - protein, 9 aa, Influenza virus
CQKGNIKCN

SEQ ID NO: 464802 - protein, 9 aa, Influenza virus
CQKGNIRCD

SEQ ID NO: 464803 - protein, 9 aa, Influenza virus
CQKGNIRCN

SEQ ID NO: 464804 - protein, 9 aa, Influenza virus
CQLNEGIMN

SEQ ID NO: 464805 - protein, 9 aa, Influenza virus
CQLNEGVIN

SEQ ID NO: 464806 - protein, 9 aa, Influenza virus
CQLNEGVMN

SEQ ID NO: 464807 - protein, 9 aa, Influenza virus
CQMEKIVLL

SEQ ID NO: 464808 - protein, 9 aa, Influenza virus
CQNGNIRCQ

SEQ ID NO: 464809 - protein, 9 aa, Influenza virus
CQNGNIRCT

SEQ ID NO: 464810 - protein, 9 aa, Influenza virus
CQNGNLRCQ

SEQ ID NO: 464811 - protein, 9 aa, Influenza virus
CQNGNVRCQ

SEQ ID NO: 464812 - protein, 9 aa, Influenza virus
CQNGNVRCT

SEQ ID NO: 464813 - protein, 9 aa, Influenza virus
CQRGNIRCN

SEQ ID NO: 464814 - protein, 9 aa, Influenza virus
CQSEIGGIN

SEQ ID NO: 464815 - protein, 9 aa, Influenza virus
CQSEIGGIS

SEQ ID NO: 464816 - protein, 9 aa, Influenza virus
CQSEIGWIN

SEQ ID NO: 464817 - protein, 9 aa, Influenza virus
CQSPLGAIN

SEQ ID NO: 464818 - protein, 9 aa, Influenza virus
CQTEIGGIN

SEQ ID NO: 464819 - protein, 9 aa, Influenza virus
CQTEVGGIN

SEQ ID NO: 464820 - protein, 9 aa, Influenza virus
CQTGNIRCQ

SEQ ID NO: 464821 - protein, 9 aa, Influenza virus
CQTPIGAIN

SEQ ID NO: 464822 - protein, 9 aa, Influenza virus
CQTPLGAIN

SEQ ID NO: 464823 - protein, 9 aa, Influenza virus
CQTPLGALN

SEQ ID NO: 464824 - protein, 9 aa, Influenza virus
CQTPMGAIN

SEQ ID NO: 464825 - protein, 9 aa, Influenza virus
CQTPMGAVN

SEQ ID NO: 464826 - protein, 9 aa, Influenza virus
CQTPVGAIN

SEQ ID NO: 464827 - protein, 9 aa, Influenza virus
CQTSVGGID

SEQ ID NO: 464828 - protein, 9 aa, Influenza virus
CQTSVGGIN

SEQ ID NO: 464829 - protein, 9 aa, Influenza virus
CQTYAGAIN

SEQ ID NO: 464830 - protein, 9 aa, Influenza virus
CQTYAGAVN

SEQ ID NO: 464831 - protein, 9 aa, Influenza virus
CQTYTGAIN

SEQ ID NO: 464832 - protein, 9 aa, Influenza virus
CQVTGFAPF

SEQ ID NO: 464833 - protein, 9 aa, Influenza virus
CRATEYIMK

SEQ ID NO: 464834 - protein, 9 aa, Influenza virus
CRATEYMMK

SEQ ID NO: 464835 - protein, 9 aa, Influenza virus
CRDNWHASN

SEQ ID NO: 464836 - protein, 9 aa, Influenza virus
CRDNWHGSN

SEQ ID NO: 464837 - protein, 9 aa, Influenza virus
CRDNWKGAN

SEQ ID NO: 464838 - protein, 9 aa, Influenza virus
CRDNWKGSN

SEQ ID NO: 464839 - protein, 9 aa, Influenza virus
CRDNWMGSN

SEQ ID NO: 464840 - protein, 9 aa, Influenza virus
CRDNWNGMN

SEQ ID NO: 464841 - protein, 9 aa, Influenza virus
CRDNWQGAN

SEQ ID NO: 464842 - protein, 9 aa, Influenza virus
CRDNWQGSN

SEQ ID NO: 464843 - protein, 9 aa, Influenza virus
CRDNWRGAN

SEQ ID NO: 464844 - protein, 9 aa, Influenza virus
CRDNWRGSN

SEQ ID NO: 464845 - protein, 9 aa, Influenza virus
CRDNWTGTN

SEQ ID NO: 464846 - protein, 9 aa, Influenza virus
CRDPNNERG

SEQ ID NO: 464847 - protein, 9 aa, Influenza virus
CRETRGLFG

SEQ ID NO: 464848 - protein, 9 aa, Influenza virus
CRFEGWIVG

SEQ ID NO: 464849 - protein, 9 aa, Influenza virus
CRFYALSQG

SEQ ID NO: 464850 - protein, 9 aa, Influenza virus
CRICIDFRD

SEQ ID NO: 464851 - protein, 9 aa, Influenza virus
CRICILDQN

SEQ ID NO: 464852 - protein, 9 aa, Influenza virus
CRICIRADG

SEQ ID NO: 464853 - protein, 9 aa, Influenza virus
CRIIQNEDI

SEQ ID NO: 464854 - protein, 9 aa, Influenza virus
CRKTRGLFG

SEQ ID NO: 464855 - protein, 9 aa, Influenza virus
CRLRGIPPL

SEQ ID NO: 464856 - protein, 9 aa, Influenza virus
CRLSGIPPL

SEQ ID NO: 464857 - protein, 9 aa, Influenza virus
CRMFALSQG

SEQ ID NO: 464858 - protein, 9 aa, Influenza virus
CRMYALHQG

SEQ ID NO: 464859 - protein, 9 aa, Influenza virus
CRNPNNEKG

SEQ ID NO: 464860 - protein, 9 aa, Influenza virus
CRNPNNERG

SEQ ID NO: 464861 - protein, 9 aa, Influenza virus
CRTFFLTHG

SEQ ID NO: 464862 - protein, 9 aa, Influenza virus
CRTFFLTQG

SEQ ID NO: 464863 - protein, 9 aa, Influenza virus
CRTKEGRRK

SEQ ID NO: 464864 - protein, 9 aa, Influenza virus
CRTKEGRRR

SEQ ID NO: 464865 - protein, 9 aa, Influenza virus
CRTLLAKSV

SEQ ID NO: 464866 - protein, 9 aa, Influenza virus
CRTREGRRK

SEQ ID NO: 464867 - protein, 9 aa, Influenza virus
CSALFVYSL

SEQ ID NO: 464868 - protein, 9 aa, Influenza virus
CSASTGGQS

SEQ ID NO: 464869 - protein, 9 aa, Influenza virus
CSCYGHDSK

SEQ ID NO: 464870 - protein, 9 aa, Influenza virus
CSCYGHNQK

SEQ ID NO: 464871 - protein, 9 aa, Influenza virus
CSCYGHNSK

SEQ ID NO: 464872 - protein, 9 aa, Influenza virus
CSCYGHSQK

SEQ ID NO: 464873 - protein, 9 aa, Influenza virus
CSCYMDIDV

SEQ ID NO: 464874 - protein, 9 aa, Influenza virus
CSCYPDAGE

SEQ ID NO: 464875 - protein, 9 aa, Influenza virus
CSCYPDAGK

SEQ ID NO: 464876 - protein, 9 aa, Influenza virus
CSCYPDASE

SEQ ID NO: 464877 - protein, 9 aa, Influenza virus
CSCYPDSGE

SEQ ID NO: 464878 - protein, 9 aa, Influenza virus
CSCYPNAGE

SEQ ID NO: 464879 - protein, 9 aa, Influenza virus
CSCYPNDGK

SEQ ID NO: 464880 - protein, 9 aa, Influenza virus
CSCYPNEGK

SEQ ID NO: 464881 - protein, 9 aa, Influenza virus
CSCYPNLCQ

SEQ ID NO: 464882 - protein, 9 aa, Influenza virus
CSCYPNLGK

SEQ ID NO: 464883 - protein, 9 aa, Influenza virus
CSCYPNLGQ

SEQ ID NO: 464884 - protein, 9 aa, Influenza virus
CSCYPNMGK

SEQ ID NO: 464885 - protein, 9 aa, Influenza virus
CSCYPNSGK

SEQ ID NO: 464886 - protein, 9 aa, Influenza virus
CSCYPQYPN

SEQ ID NO: 464887 - protein, 9 aa, Influenza virus
CSCYPRFPG

SEQ ID NO: 464888 - protein, 9 aa, Influenza virus
CSCYPRYPD

SEQ ID NO: 464889 - protein, 9 aa, Influenza virus
CSCYPRYPG

SEQ ID NO: 464890 - protein, 9 aa, Influenza virus
CSCYPRYPN

SEQ ID NO: 464891 - protein, 9 aa, Influenza virus
CSCYPRYSG

SEQ ID NO: 464892 - protein, 9 aa, Influenza virus
CSCYPSGED

SEQ ID NO: 464893 - protein, 9 aa, Influenza virus
CSCYPSGEN

SEQ ID NO: 464894 - protein, 9 aa, Influenza virus
CSCYPSGES

SEQ ID NO: 464895 - protein, 9 aa, Influenza virus
CSCYPSGTD

SEQ ID NO: 464896 - protein, 9 aa, Influenza virus
CSCYSRYPN

SEQ ID NO: 464897 - protein, 9 aa, Influenza virus
CSCYVDIDI

SEQ ID NO: 464898 - protein, 9 aa, Influenza virus
CSCYVDIDV

SEQ ID NO: 464899 - protein, 9 aa, Influenza virus
CSCYVDTDV

SEQ ID NO: 464900 - protein, 9 aa, Influenza virus
CSCYVDVDV

SEQ ID NO: 464901 - protein, 9 aa, Influenza virus
CSDGPGWLT

SEQ ID NO: 464902 - protein, 9 aa, Influenza virus
CSDGSGWLT

SEQ ID NO: 464903 - protein, 9 aa, Influenza virus
CSFAGWILG

SEQ ID NO: 464904 - protein, 9 aa, Influenza virus
CSFAGWLLG

SEQ ID NO: 464905 - protein, 9 aa, Influenza virus
CSFEGWIGG

SEQ ID NO: 464906 - protein, 9 aa, Influenza virus
CSFEGWIVG

SEQ ID NO: 464907 - protein, 9 aa, Influenza virus
CSGFFGDNP

SEQ ID NO: 464908 - protein, 9 aa, Influenza virus
CSGHSCRIC

SEQ ID NO: 464909 - protein, 9 aa, Influenza virus
CSGIFGDNP

SEQ ID NO: 464910 - protein, 9 aa, Influenza virus
CSGLVGDTP

SEQ ID NO: 464911 - protein, 9 aa, Influenza virus
CSGVFGDNP

SEQ ID NO: 464912 - protein, 9 aa, Influenza virus
CSGVFGDSP

SEQ ID NO: 464913 - protein, 9 aa, Influenza virus
CSGVFGDTP

SEQ ID NO: 464914 - protein, 9 aa, Influenza virus
CSGVLGDNP

SEQ ID NO: 464915 - protein, 9 aa, Influenza virus
CSHLECRTF

SEQ ID NO: 464916 - protein, 9 aa, Influenza virus
CSHMECRTF

SEQ ID NO: 464917 - protein, 9 aa, Influenza virus
CSHSECRTF

SEQ ID NO: 464918 - protein, 9 aa, Influenza virus
CSIAGWLLG

SEQ ID NO: 464919 - protein, 9 aa, Influenza virus
CSIDECRTF

SEQ ID NO: 464920 - protein, 9 aa, Influenza virus
CSIDGKAPI

SEQ ID NO: 464921 - protein, 9 aa, Influenza virus
CSIHECRTF

SEQ ID NO: 464922 - protein, 9 aa, Influenza virus
CSINECRTF

SEQ ID NO: 464923 - protein, 9 aa, Influenza virus
CSINGKAPI

SEQ ID NO: 464924 - protein, 9 aa, Influenza virus
CSINGKEPI

SEQ ID NO: 464925 - protein, 9 aa, Influenza virus
CSINGKQPI

SEQ ID NO: 464926 - protein, 9 aa, Influenza virus
CSINGRAPI

SEQ ID NO: 464927 - protein, 9 aa, Influenza virus
CSISECRTF

SEQ ID NO: 464928 - protein, 9 aa, Influenza virus
CSIWFSHYN

SEQ ID NO: 464929 - protein, 9 aa, Influenza virus
CSKFHSDTP

SEQ ID NO: 464930 - protein, 9 aa, Influenza virus
CSKILTDTS

SEQ ID NO: 464931 - protein, 9 aa, Influenza virus
CSKTLTDTS

SEQ ID NO: 464932 - protein, 9 aa, Influenza virus
CSKVLTDTS

SEQ ID NO: 464933 - protein, 9 aa, Influenza virus
CSKYHWNLA

SEQ ID NO: 464934 - protein, 9 aa, Influenza virus
CSLEGIILG

SEQ ID NO: 464935 - protein, 9 aa, Influenza virus
CSLEGLILG

SEQ ID NO: 464936 - protein, 9 aa, Influenza virus
CSLEGLILS

SEQ ID NO: 464937 - protein, 9 aa, Influenza virus
CSLEGLVLG

SEQ ID NO: 464938 - protein, 9 aa, Influenza virus
CSLFEKFFP

SEQ ID NO: 464939 - protein, 9 aa, Influenza virus
CSLKGLILG

SEQ ID NO: 464940 - protein, 9 aa, Influenza virus
CSLMQGSTL

SEQ ID NO: 464941 - protein, 9 aa, Influenza virus
CSLNGISPI

SEQ ID NO: 464942 - protein, 9 aa, Influenza virus
CSLNGISPV

SEQ ID NO: 464943 - protein, 9 aa, Influenza virus
CSLNGVSPI

SEQ ID NO: 464944 - protein, 9 aa, Influenza virus
CSLNGVSPV

SEQ ID NO: 464945 - protein, 9 aa, Influenza virus
CSNDTINYY

SEQ ID NO: 464946 - protein, 9 aa, Influenza virus
CSNGNCRFH

SEQ ID NO: 464947 - protein, 9 aa, Influenza virus
CSNGNCRFN

SEQ ID NO: 464948 - protein, 9 aa, Influenza virus
CSNGSCRCT

SEQ ID NO: 464949 - protein, 9 aa, Influenza virus
CSNGSCRFN

SEQ ID NO: 464950 - protein, 9 aa, Influenza virus
CSNGSLHGR

SEQ ID NO: 464951 - protein, 9 aa, Influenza virus
CSNGSLQCK

SEQ ID NO: 464952 - protein, 9 aa, Influenza virus
CSNGSLQCR

SEQ ID NO: 464953 - protein, 9 aa, Influenza virus
CSNGSLQFR

SEQ ID NO: 464954 - protein, 9 aa, Influenza virus
CSNGSLRCR

SEQ ID NO: 464955 - protein, 9 aa, Influenza virus
CSNGSMQCK

SEQ ID NO: 464956 - protein, 9 aa, Influenza virus
CSNGSMQCN

SEQ ID NO: 464957 - protein, 9 aa, Influenza virus
CSNGSMQCR

SEQ ID NO: 464958 - protein, 9 aa, Influenza virus
CSNNTTNYY

SEQ ID NO: 464959 - protein, 9 aa, Influenza virus
CSNPITGSP

SEQ ID NO: 464960 - protein, 9 aa, Influenza virus
CSNSSMQCR

SEQ ID NO: 464961 - protein, 9 aa, Influenza virus
CSPLSRCRE

SEQ ID NO: 464962 - protein, 9 aa, Influenza virus
CSPLSRCRK

SEQ ID NO: 464963 - protein, 9 aa, Influenza virus
CSPSECRTF

SEQ ID NO: 464964 - protein, 9 aa, Influenza virus
CSPVLTDNP

SEQ ID NO: 464965 - protein, 9 aa, Influenza virus
CSQNILRTQ

SEQ ID NO: 464966 - protein, 9 aa, Influenza virus
CSQRSKFLL

SEQ ID NO: 464967 - protein, 9 aa, Influenza virus
CSRILTDTS

SEQ ID NO: 464968 - protein, 9 aa, Influenza virus
CSRVLTDTS

SEQ ID NO: 464969 - protein, 9 aa, Influenza virus
CSSGNCRFN

SEQ ID NO: 464970 - protein, 9 aa, Influenza virus
CSSGNCRFS

SEQ ID NO: 464971 - protein, 9 aa, Influenza virus
CSSPLRLVD

SEQ ID NO: 464972 - protein, 9 aa, Influenza virus
CSSPSGIEG

SEQ ID NO: 464973 - protein, 9 aa, Influenza virus
CSSTEFLGQ

SEQ ID NO: 464974 - protein, 9 aa, Influenza virus
CSVAGWLLG

SEQ ID NO: 464975 - protein, 9 aa, Influenza virus
CSVEGWVVI

SEQ ID NO: 464976 - protein, 9 aa, Influenza virus
CSVEYASKT

SEQ ID NO: 464977 - protein, 9 aa, Influenza virus
CSVSECRTF

SEQ ID NO: 464978 - protein, 9 aa, Influenza virus
CSYLECRTF

SEQ ID NO: 464979 - protein, 9 aa, Influenza virus
CTCRDNWKG

SEQ ID NO: 464980 - protein, 9 aa, Influenza virus
CTCRDNWQG

SEQ ID NO: 464981 - protein, 9 aa, Influenza virus
CTGCFEIFH

SEQ ID NO: 464982 - protein, 9 aa, Influenza virus
CTGILTDTS

SEQ ID NO: 464983 - protein, 9 aa, Influenza virus
CTGNLIAPR

SEQ ID NO: 464984 - protein, 9 aa, Influenza virus
CTGVLTDTS

SEQ ID NO: 464985 - protein, 9 aa, Influenza virus
CTHLEICFM

SEQ ID NO: 464986 - protein, 9 aa, Influenza virus
CTHLEVCFM

SEQ ID NO: 464987 - protein, 9 aa, Influenza virus
CTHMEVCFM

SEQ ID NO: 464988 - protein, 9 aa, Influenza virus
CTINSWHIF

SEQ ID NO: 464989 - protein, 9 aa, Influenza virus
CTINSWHIY

SEQ ID NO: 464990 - protein, 9 aa, Influenza virus
CTIPCFWVE

SEQ ID NO: 464991 - protein, 9 aa, Influenza virus
CTISLVKTT

SEQ ID NO: 464992 - protein, 9 aa, Influenza virus
CTKGKKAVD

SEQ ID NO: 464993 - protein, 9 aa, Influenza virus
CTLFEKFFP

SEQ ID NO: 464994 - protein, 9 aa, Influenza virus
CTLIDALLG

SEQ ID NO: 464995 - protein, 9 aa, Influenza virus
CTLIDAMLG

SEQ ID NO: 464996 - protein, 9 aa, Influenza virus
CTLMDALLG

SEQ ID NO: 464997 - protein, 9 aa, Influenza virus
CTLVDALLG

SEQ ID NO: 464998 - protein, 9 aa, Influenza virus
CTSPCLTDK

SEQ ID NO: 464999 - protein, 9 aa, Influenza virus
CTVIMTDGS

SEQ ID NO: 465000 - protein, 9 aa, Influenza virus
CTVPCFWVE

SEQ ID NO: 465001 - protein, 9 aa, Influenza virus
CTVVMTDGN

SEQ ID NO: 465002 - protein, 9 aa, Influenza virus
CTVVMTDGS

SEQ ID NO: 465003 - protein, 9 aa, Influenza virus
CVAWSSSSC

SEQ ID NO: 465004 - protein, 9 aa, Influenza virus
CVAWSSTSC

SEQ ID NO: 465005 - protein, 9 aa, Influenza virus
CVCHKGICP

SEQ ID NO: 465006 - protein, 9 aa, Influenza virus
CVCHKGVCP

SEQ ID NO: 465007 - protein, 9 aa, Influenza virus
CVCHNGICP

SEQ ID NO: 465008 - protein, 9 aa, Influenza virus
CVCHNGTCA

SEQ ID NO: 465009 - protein, 9 aa, Influenza virus
CVCHNGTCV

SEQ ID NO: 465010 - protein, 9 aa, Influenza virus
CVCHNGVCP

SEQ ID NO: 465011 - protein, 9 aa, Influenza virus
CVCHNSTCV

SEQ ID NO: 465012 - protein, 9 aa, Influenza virus
CVCHSGICP

SEQ ID NO: 465013 - protein, 9 aa, Influenza virus
CVCHSGVCP

SEQ ID NO: 465014 - protein, 9 aa, Influenza virus
CVCINGICT

SEQ ID NO: 465015 - protein, 9 aa, Influenza virus
CVCINGSCA

SEQ ID NO: 465016 - protein, 9 aa, Influenza virus
CVCINGSCI

SEQ ID NO: 465017 - protein, 9 aa, Influenza virus
CVCINGSCT

SEQ ID NO: 465018 - protein, 9 aa, Influenza virus
CVCINGTCA

SEQ ID NO: 465019 - protein, 9 aa, Influenza virus
CVCINGTCT

SEQ ID NO: 465020 - protein, 9 aa, Influenza virus
CVCISGTCA

SEQ ID NO: 465021 - protein, 9 aa, Influenza virus
CVCQDEFCY

SEQ ID NO: 465022 - protein, 9 aa, Influenza virus
CVCRDNWHA

SEQ ID NO: 465023 - protein, 9 aa, Influenza virus
CVCRDNWHG

SEQ ID NO: 465024 - protein, 9 aa, Influenza virus
CVCRDNWKG

SEQ ID NO: 465025 - protein, 9 aa, Influenza virus
CVCRDNWMG

SEQ ID NO: 465026 - protein, 9 aa, Influenza virus
CVCRDNWNG

SEQ ID NO: 465027 - protein, 9 aa, Influenza virus
CVCRDNWQG

SEQ ID NO: 465028 - protein, 9 aa, Influenza virus
CVCRDNWRG

SEQ ID NO: 465029 - protein, 9 aa, Influenza virus
CVCRDNWTG

SEQ ID NO: 465030 - protein, 9 aa, Influenza virus
CVCWDNWRG

SEQ ID NO: 465031 - protein, 9 aa, Influenza virus
CVGWSSTSC

SEQ ID NO: 465032 - protein, 9 aa, Influenza virus
CVGWSSTTC

SEQ ID NO: 465033 - protein, 9 aa, Influenza virus
CVGYHANNS

SEQ ID NO: 465034 - protein, 9 aa, Influenza virus
CVGYHSNNS

SEQ ID NO: 465035 - protein, 9 aa, Influenza virus
CVGYLSTNS

SEQ ID NO: 465036 - protein, 9 aa, Influenza virus
CVILLNPFV

SEQ ID NO: 465037 - protein, 9 aa, Influenza virus
CVKNGNLRC

SEQ ID NO: 465038 - protein, 9 aa, Influenza virus
CVKNGNMQC

SEQ ID NO: 465039 - protein, 9 aa, Influenza virus
CVKNGNMRC

SEQ ID NO: 465040 - protein, 9 aa, Influenza virus
CVKNGNMRG

SEQ ID NO: 465041 - protein, 9 aa, Influenza virus
CVLEAMAFL

SEQ ID NO: 465042 - protein, 9 aa, Influenza virus
CVMLLAIAM

SEQ ID NO: 465043 - protein, 9 aa, Influenza virus
CVNRCFYVE

SEQ ID NO: 465044 - protein, 9 aa, Influenza virus
CVQGNNDNA

SEQ ID NO: 465045 - protein, 9 aa, Influenza virus
CVQGNNKNA

SEQ ID NO: 465046 - protein, 9 aa, Influenza virus
CVQGNNNNA

SEQ ID NO: 465047 - protein, 9 aa, Influenza virus
CVRHNGTCA

SEQ ID NO: 465048 - protein, 9 aa, Influenza virus
CVSGPNNNA

SEQ ID NO: 465049 - protein, 9 aa, Influenza virus
CVSHNGTWA

SEQ ID NO: 465050 - protein, 9 aa, Influenza virus
CVSLLQSAI

SEQ ID NO: 465051 - protein, 9 aa, Influenza virus
CVTGDDKNA

SEQ ID NO: 465052 - protein, 9 aa, Influenza virus
CVTGDDRNA

SEQ ID NO: 465053 - protein, 9 aa, Influenza virus
CVTGYEKNA

SEQ ID NO: 465054 - protein, 9 aa, Influenza virus
CVVAVTDGP

SEQ ID NO: 465055 - protein, 9 aa, Influenza virus
CVVIMTDGP

SEQ ID NO: 465056 - protein, 9 aa, Influenza virus
CVVIMTDGS

SEQ ID NO: 465057 - protein, 9 aa, Influenza virus
CVVTVTDGP

SEQ ID NO: 465058 - protein, 9 aa, Influenza virus
CVVVMTDGS

SEQ ID NO: 465059 - protein, 9 aa, Influenza virus
CVYRDNWKG

SEQ ID NO: 465060 - protein, 9 aa, Influenza virus
CWEQLYTPG

SEQ ID NO: 465061 - protein, 9 aa, Influenza virus
CWEQMYTPG

SEQ ID NO: 465062 - protein, 9 aa, Influenza virus
CWSFALAQG

SEQ ID NO: 465063 - protein, 9 aa, Influenza virus
CYDGKAWLH

SEQ ID NO: 465064 - protein, 9 aa, Influenza virus
CYGHDSKVT

SEQ ID NO: 465065 - protein, 9 aa, Influenza virus
CYGHNQKIT

SEQ ID NO: 465066 - protein, 9 aa, Influenza virus
CYGHNQKVT

SEQ ID NO: 465067 - protein, 9 aa, Influenza virus
CYGHNSKVT

SEQ ID NO: 465068 - protein, 9 aa, Influenza virus
CYGHSQKVT

SEQ ID NO: 465069 - protein, 9 aa, Influenza virus
CYMDIDVYC

SEQ ID NO: 465070 - protein, 9 aa, Influenza virus
CYNPCFYVE

SEQ ID NO: 465071 - protein, 9 aa, Influenza virus
CYPFDVPDY

SEQ ID NO: 465072 - protein, 9 aa, Influenza virus
CYPFDVPEY

SEQ ID NO: 465073 - protein, 9 aa, Influenza virus
CYPFDVPGY

SEQ ID NO: 465074 - protein, 9 aa, Influenza virus
CYPFDVPNY

SEQ ID NO: 465075 - protein, 9 aa, Influenza virus
CYPGATINE

SEQ ID NO: 465076 - protein, 9 aa, Influenza virus
CYPGATVNE

SEQ ID NO: 465077 - protein, 9 aa, Influenza virus
CYPGELDNN

SEQ ID NO: 465078 - protein, 9 aa, Influenza virus
CYPGELNNN

SEQ ID NO: 465079 - protein, 9 aa, Influenza virus
CYPGEVDNN

SEQ ID NO: 465080 - protein, 9 aa, Influenza virus
CYPGFVENL

SEQ ID NO: 465081 - protein, 9 aa, Influenza virus
CYPGGFTNE

SEQ ID NO: 465082 - protein, 9 aa, Influenza virus
CYPGKFTNE

SEQ ID NO: 465083 - protein, 9 aa, Influenza virus
CYPGKFVNE

SEQ ID NO: 465084 - protein, 9 aa, Influenza virus
CYPGKFVNG

SEQ ID NO: 465085 - protein, 9 aa, Influenza virus
CYPGNFNDY

SEQ ID NO: 465086 - protein, 9 aa, Influenza virus
CYPGRFTNE

SEQ ID NO: 465087 - protein, 9 aa, Influenza virus
CYPGSFNDY

SEQ ID NO: 465088 - protein, 9 aa, Influenza virus
CYPGSFNNY

SEQ ID NO: 465089 - protein, 9 aa, Influenza virus
CYPGSIENL

SEQ ID NO: 465090 - protein, 9 aa, Influenza virus
CYPGSIENQ

SEQ ID NO: 465091 - protein, 9 aa, Influenza virus
CYPGSIKNQ

SEQ ID NO: 465092 - protein, 9 aa, Influenza virus
CYPGSLNDY

SEQ ID NO: 465093 - protein, 9 aa, Influenza virus
CYPGSTVNE

SEQ ID NO: 465094 - protein, 9 aa, Influenza virus
CYPGSVENL

SEQ ID NO: 465095 - protein, 9 aa, Influenza virus
CYPGSVENQ

SEQ ID NO: 465096 - protein, 9 aa, Influenza virus
CYPGTTVNE

SEQ ID NO: 465097 - protein, 9 aa, Influenza virus
CYPNDGKVE

SEQ ID NO: 465098 - protein, 9 aa, Influenza virus
CYPNEGKVE

SEQ ID NO: 465099 - protein, 9 aa, Influenza virus
CYPNLCQVE

SEQ ID NO: 465100 - protein, 9 aa, Influenza virus
CYPNLGKVE

SEQ ID NO: 465101 - protein, 9 aa, Influenza virus
CYPNLGQVE

SEQ ID NO: 465102 - protein, 9 aa, Influenza virus
CYPNMGKVE

SEQ ID NO: 465103 - protein, 9 aa, Influenza virus
CYPNNGKVE

SEQ ID NO: 465104 - protein, 9 aa, Influenza virus
CYPNSGKVE

SEQ ID NO: 465105 - protein, 9 aa, Influenza virus
CYPQYPNVR

SEQ ID NO: 465106 - protein, 9 aa, Influenza virus
CYPRYPDVR

SEQ ID NO: 465107 - protein, 9 aa, Influenza virus
CYPRYPGVR

SEQ ID NO: 465108 - protein, 9 aa, Influenza virus
CYPRYPNVR

SEQ ID NO: 465109 - protein, 9 aa, Influenza virus
CYPYDVPDH

SEQ ID NO: 465110 - protein, 9 aa, Influenza virus
CYPYDVPDY

SEQ ID NO: 465111 - protein, 9 aa, Influenza virus
CYPYDVPEY

SEQ ID NO: 465112 - protein, 9 aa, Influenza virus
CYPYDVQDY

SEQ ID NO: 465113 - protein, 9 aa, Influenza virus
CYPYYVPDY

SEQ ID NO: 465114 - protein, 9 aa, Influenza virus
CYQFALGHG

SEQ ID NO: 465115 - protein, 9 aa, Influenza virus
CYQFALGQG

SEQ ID NO: 465116 - protein, 9 aa, Influenza virus
CYQRSKFLL

SEQ ID NO: 465117 - protein, 9 aa, Influenza virus
CYRACFYVE

SEQ ID NO: 465118 - protein, 9 aa, Influenza virus
CYSRYPNVR

SEQ ID NO: 465119 - protein, 9 aa, Influenza virus
CYTKCQTYA

SEQ ID NO: 465120 - protein, 9 aa, Influenza virus
CYTLITDGP

SEQ ID NO: 465121 - protein, 9 aa, Influenza virus
CYTLMTDGP

SEQ ID NO: 465122 - protein, 9 aa, Influenza virus
CYTLVTDGP

SEQ ID NO: 465123 - protein, 9 aa, Influenza virus
CYVDIDIYC

SEQ ID NO: 465124 - protein, 9 aa, Influenza virus
CYVDIDVYC

SEQ ID NO: 465125 - protein, 9 aa, Influenza virus
CYVDTDVYC

SEQ ID NO: 465126 - protein, 9 aa, Influenza virus
CYVDVDVYC

SEQ ID NO: 465127 - protein, 9 aa, Influenza virus
CYWVMTDGP

SEQ ID NO: 465128 - protein, 9 aa, Influenza virus
DAEMNKLFE

SEQ ID NO: 465129 - protein, 9 aa, Influenza virus
DAERGKLKR

SEQ ID NO: 465130 - protein, 9 aa, Influenza virus
DAGDGCFEI

SEQ ID NO: 465131 - protein, 9 aa, Influenza virus
DAGNGCFDI

SEQ ID NO: 465132 - protein, 9 aa, Influenza virus
DAHILVTRE

SEQ ID NO: 465133 - protein, 9 aa, Influenza virus
DAHVLVTRE

SEQ ID NO: 465134 - protein, 9 aa, Influenza virus
DAIEECLIN

SEQ ID NO: 465135 - protein, 9 aa, Influenza virus
DAINNRFQI

SEQ ID NO: 465136 - protein, 9 aa, Influenza virus
DALKLSIED

SEQ ID NO: 465137 - protein, 9 aa, Influenza virus
DALLGDPHC

SEQ ID NO: 465138 - protein, 9 aa, Influenza virus
DALLGDPQC

SEQ ID NO: 465139 - protein, 9 aa, Influenza virus
DAMLGDPHC

SEQ ID NO: 465140 - protein, 9 aa, Influenza virus
DAMTEIWSY

SEQ ID NO: 465141 - protein, 9 aa, Influenza virus
DAMTEVWSY

SEQ ID NO: 465142 - protein, 9 aa, Influenza virus
DANGWVSTD

SEQ ID NO: 465143 - protein, 9 aa, Influenza virus
DANGWVTAD

SEQ ID NO: 465144 - protein, 9 aa, Influenza virus
DANVKNLHD

SEQ ID NO: 465145 - protein, 9 aa, Influenza virus
DANVKNLHE

SEQ ID NO: 465146 - protein, 9 aa, Influenza virus
DANVRNLHD

SEQ ID NO: 465147 - protein, 9 aa, Influenza virus
DANVRNLHE

SEQ ID NO: 465148 - protein, 9 aa, Influenza virus
DAPFDDRLR

SEQ ID NO: 465149 - protein, 9 aa, Influenza virus
DAPFLDRIR

SEQ ID NO: 465150 - protein, 9 aa, Influenza virus
DAPFLDRLR

SEQ ID NO: 465151 - protein, 9 aa, Influenza virus
DAQAFYKIL

SEQ ID NO: 465152 - protein, 9 aa, Influenza virus
DAQAFYKLL

SEQ ID NO: 465153 - protein, 9 aa, Influenza virus
DAQHRSHRQ

SEQ ID NO: 465154 - protein, 9 aa, Influenza virus
DAQIDESCE

SEQ ID NO: 465155 - protein, 9 aa, Influenza virus
DARIDFESG

SEQ ID NO: 465156 - protein, 9 aa, Influenza virus
DARVDFESG

SEQ ID NO: 465157 - protein, 9 aa, Influenza virus
DATAVAVIK

SEQ ID NO: 465158 - protein, 9 aa, Influenza virus
DATAVAVLK

SEQ ID NO: 465159 - protein, 9 aa, Influenza virus
DATYQRTRA

SEQ ID NO: 465160 - protein, 9 aa, Influenza virus
DAVATTHSW

SEQ ID NO: 465161 - protein, 9 aa, Influenza virus
DAVKLSSGY

SEQ ID NO: 465162 - protein, 9 aa, Influenza virus
DAVTDIWSY

SEQ ID NO: 465163 - protein, 9 aa, Influenza virus
DAVTDVWSY

SEQ ID NO: 465164 - protein, 9 aa, Influenza virus
DAYAVIHYG

SEQ ID NO: 465165 - protein, 9 aa, Influenza virus
DCDLINGAL

SEQ ID NO: 465166 - protein, 9 aa, Influenza virus
DCETKCQTP

SEQ ID NO: 465167 - protein, 9 aa, Influenza virus
DCFLWHVRK

SEQ ID NO: 465168 - protein, 9 aa, Influenza virus
DCFQPCFYV

SEQ ID NO: 465169 - protein, 9 aa, Influenza virus
DCIKPCFWV

SEQ ID NO: 465170 - protein, 9 aa, Influenza virus
DCIRPCFWV

SEQ ID NO: 465171 - protein, 9 aa, Influenza virus
DCKIEAVIY

SEQ ID NO: 465172 - protein, 9 aa, Influenza virus
DCKVEAVIY

SEQ ID NO: 465173 - protein, 9 aa, Influenza virus
DCLVPCFWV

SEQ ID NO: 465174 - protein, 9 aa, Influenza virus
DCMASIRNN

SEQ ID NO: 465175 - protein, 9 aa, Influenza virus
DCMESIRNN

SEQ ID NO: 465176 - protein, 9 aa, Influenza virus
DCMIKAVRG

SEQ ID NO: 465177 - protein, 9 aa, Influenza virus
DCMMKAVRG

SEQ ID NO: 465178 - protein, 9 aa, Influenza virus
DCMRPCFWV

SEQ ID NO: 465179 - protein, 9 aa, Influenza virus
DCMVKAVRG

SEQ ID NO: 465180 - protein, 9 aa, Influenza virus
DCNFEGWIV

SEQ ID NO: 465181 - protein, 9 aa, Influenza virus
DCNNPITGS

SEQ ID NO: 465182 - protein, 9 aa, Influenza virus
DCPKYIKQG

SEQ ID NO: 465183 - protein, 9 aa, Influenza virus
DCPKYIKSG

SEQ ID NO: 465184 - protein, 9 aa, Influenza virus
DCPKYMNVK

SEQ ID NO: 465185 - protein, 9 aa, Influenza virus
DCPKYVKQG

SEQ ID NO: 465186 - protein, 9 aa, Influenza virus
DCPKYVNIK

SEQ ID NO: 465187 - protein, 9 aa, Influenza virus
DCPKYVNVK

SEQ ID NO: 465188 - protein, 9 aa, Influenza virus
DCPKYVNVR

SEQ ID NO: 465189 - protein, 9 aa, Influenza virus
DCPRYVKQG

SEQ ID NO: 465190 - protein, 9 aa, Influenza virus
DCRDNWKGS

SEQ ID NO: 465191 - protein, 9 aa, Influenza virus
DCRFEGWIV

SEQ ID NO: 465192 - protein, 9 aa, Influenza virus
DCRTFFLTQ

SEQ ID NO: 465193 - protein, 9 aa, Influenza virus
DCSFAGWIL

SEQ ID NO: 465194 - protein, 9 aa, Influenza virus
DCSFAGWLL

SEQ ID NO: 465195 - protein, 9 aa, Influenza virus
DCSFEGWIG

SEQ ID NO: 465196 - protein, 9 aa, Influenza virus
DCSFEGWIV

SEQ ID NO: 465197 - protein, 9 aa, Influenza virus
DCSIAGWLL

SEQ ID NO: 465198 - protein, 9 aa, Influenza virus
DCSITGWLL

SEQ ID NO: 465199 - protein, 9 aa, Influenza virus
DCSLEGIIL

SEQ ID NO: 465200 - protein, 9 aa, Influenza virus
DCSLEGLIL

SEQ ID NO: 465201 - protein, 9 aa, Influenza virus
DCSLEGLVL

SEQ ID NO: 465202 - protein, 9 aa, Influenza virus
DCSLKGLIL

SEQ ID NO: 465203 - protein, 9 aa, Influenza virus
DCSNPITGS

SEQ ID NO: 465204 - protein, 9 aa, Influenza virus
DCSVAGWLL

SEQ ID NO: 465205 - protein, 9 aa, Influenza virus
DCSVSGWLL

SEQ ID NO: 465206 - protein, 9 aa, Influenza virus
DCTGCFEIF

SEQ ID NO: 465207 - protein, 9 aa, Influenza virus
DCVLEAMAF

SEQ ID NO: 465208 - protein, 9 aa, Influenza virus
DCVLEAMAL

SEQ ID NO: 465209 - protein, 9 aa, Influenza virus
DCWSFALAQ

SEQ ID NO: 465210 - protein, 9 aa, Influenza virus
DCYRACFYV

SEQ ID NO: 465211 - protein, 9 aa, Influenza virus
DCYWVMTDG

SEQ ID NO: 465212 - protein, 9 aa, Influenza virus
DDAINNRFQ

SEQ ID NO: 465213 - protein, 9 aa, Influenza virus
DDAVTDIWS

SEQ ID NO: 465214 - protein, 9 aa, Influenza virus
DDAVTDVWS

SEQ ID NO: 465215 - protein, 9 aa, Influenza virus
DDAYAVIHY

SEQ ID NO: 465216 - protein, 9 aa, Influenza virus
DDCMASIRN

SEQ ID NO: 465217 - protein, 9 aa, Influenza virus
DDCSLEGII

SEQ ID NO: 465218 - protein, 9 aa, Influenza virus
DDCSLEGLI

SEQ ID NO: 465219 - protein, 9 aa, Influenza virus
DDCSLEGLV

SEQ ID NO: 465220 - protein, 9 aa, Influenza virus
DDCSLKGLI

SEQ ID NO: 465221 - protein, 9 aa, Influenza virus
DDDAYAVIH

SEQ ID NO: 465222 - protein, 9 aa, Influenza virus
DDDCMASIR

SEQ ID NO: 465223 - protein, 9 aa, Influenza virus
DDDVSWTSN

SEQ ID NO: 465224 - protein, 9 aa, Influenza virus
DDENATASF

SEQ ID NO: 465225 - protein, 9 aa, Influenza virus
DDFALILNA

SEQ ID NO: 465226 - protein, 9 aa, Influenza virus
DDFALIVNA

SEQ ID NO: 465227 - protein, 9 aa, Influenza virus
DDFFNRLNW

SEQ ID NO: 465228 - protein, 9 aa, Influenza virus
DDFQLIPMI

SEQ ID NO: 465229 - protein, 9 aa, Influenza virus
DDGAILPFD

SEQ ID NO: 465230 - protein, 9 aa, Influenza virus
DDGAILPFG

SEQ ID NO: 465231 - protein, 9 aa, Influenza virus
DDGAILPLT

SEQ ID NO: 465232 - protein, 9 aa, Influenza virus
DDGAVAVLK

SEQ ID NO: 465233 - protein, 9 aa, Influenza virus
DDGFIDIWT

SEQ ID NO: 465234 - protein, 9 aa, Influenza virus
DDGFIDVWT

SEQ ID NO: 465235 - protein, 9 aa, Influenza virus
DDGFLDIWT

SEQ ID NO: 465236 - protein, 9 aa, Influenza virus
DDGFLDVWT

SEQ ID NO: 465237 - protein, 9 aa, Influenza virus
DDGLLDVWT

SEQ ID NO: 465238 - protein, 9 aa, Influenza virus
DDHCMESIR

SEQ ID NO: 465239 - protein, 9 aa, Influenza virus
DDIDQSLII

SEQ ID NO: 465240 - protein, 9 aa, Influenza virus
DDKNATASF

SEQ ID NO: 465241 - protein, 9 aa, Influenza virus
DDLIEKTSW

SEQ ID NO: 465242 - protein, 9 aa, Influenza virus
DDLIGKTSW

SEQ ID NO: 465243 - protein, 9 aa, Influenza virus
DDNCMERIR

SEQ ID NO: 465244 - protein, 9 aa, Influenza virus
DDNCMESIR

SEQ ID NO: 465245 - protein, 9 aa, Influenza virus
DDNVYKALS

SEQ ID NO: 465246 - protein, 9 aa, Influenza virus
DDPNWSGYS

SEQ ID NO: 465247 - protein, 9 aa, Influenza virus
DDQCMESIR

SEQ ID NO: 465248 - protein, 9 aa, Influenza virus
DDQIEDLWA

SEQ ID NO: 465249 - protein, 9 aa, Influenza virus
DDQIEELWA

SEQ ID NO: 465250 - protein, 9 aa, Influenza virus
DDQIEGLWA

SEQ ID NO: 465251 - protein, 9 aa, Influenza virus
DDQIENLWA

SEQ ID NO: 465252 - protein, 9 aa, Influenza virus
DDQIIDIWA

SEQ ID NO: 465253 - protein, 9 aa, Influenza virus
DDQIQDIWA

SEQ ID NO: 465254 - protein, 9 aa, Influenza virus
DDQIQDLWA

SEQ ID NO: 465255 - protein, 9 aa, Influenza virus
DDQIQDVWA

SEQ ID NO: 465256 - protein, 9 aa, Influenza virus
DDQIQNIWA

SEQ ID NO: 465257 - protein, 9 aa, Influenza virus
DDQITDIWA

SEQ ID NO: 465258 - protein, 9 aa, Influenza virus
DDQVTDIWA

SEQ ID NO: 465259 - protein, 9 aa, Influenza virus
DDRNATASF

SEQ ID NO: 465260 - protein, 9 aa, Influenza virus
DDRNATASL

SEQ ID NO: 465261 - protein, 9 aa, Influenza virus
DDSCMESIR

SEQ ID NO: 465262 - protein, 9 aa, Influenza virus
DDSSSNSNC

SEQ ID NO: 465263 - protein, 9 aa, Influenza virus
DDSSSSSNC

SEQ ID NO: 465264 - protein, 9 aa, Influenza virus
DDSVYKALS

SEQ ID NO: 465265 - protein, 9 aa, Influenza virus
DDVDQSLII

SEQ ID NO: 465266 - protein, 9 aa, Influenza virus
DDVDQSLVI

SEQ ID NO: 465267 - protein, 9 aa, Influenza virus
DDVLMGRTI

SEQ ID NO: 465268 - protein, 9 aa, Influenza virus
DDVSWASNS

SEQ ID NO: 465269 - protein, 9 aa, Influenza virus
DDVSWTSNS

SEQ ID NO: 465270 - protein, 9 aa, Influenza virus
DDVWLGRTV

SEQ ID NO: 465271 - protein, 9 aa, Influenza virus
DDVWMGRTI

SEQ ID NO: 465272 - protein, 9 aa, Influenza virus
DEAINNRFQ

SEQ ID NO: 465273 - protein, 9 aa, Influenza virus
DEAINNRIK

SEQ ID NO: 465274 - protein, 9 aa, Influenza virus
DEAINSRFQ

SEQ ID NO: 465275 - protein, 9 aa, Influenza virus
DEAISNRFQ

SEQ ID NO: 465276 - protein, 9 aa, Influenza virus
DEALKMTIA

SEQ ID NO: 465277 - protein, 9 aa, Influenza virus
DEALNNRFQ

SEQ ID NO: 465278 - protein, 9 aa, Influenza virus
DEALNNRSQ

SEQ ID NO: 465279 - protein, 9 aa, Influenza virus
DEALSNRFQ

SEQ ID NO: 465280 - protein, 9 aa, Influenza virus
DEAVNNRFQ

SEQ ID NO: 465281 - protein, 9 aa, Influenza virus
DECIEKVRN

SEQ ID NO: 465282 - protein, 9 aa, Influenza virus
DECRFYALS

SEQ ID NO: 465283 - protein, 9 aa, Influenza virus
DECRTFFLT

SEQ ID NO: 465284 - protein, 9 aa, Influenza virus
DEEGTGIAA

SEQ ID NO: 465285 - protein, 9 aa, Influenza virus
DEESRARIK

SEQ ID NO: 465286 - protein, 9 aa, Influenza virus
DEFCYTLIT

SEQ ID NO: 465287 - protein, 9 aa, Influenza virus
DEFCYTLMT

SEQ ID NO: 465288 - protein, 9 aa, Influenza virus
DEFCYTLVT

SEQ ID NO: 465289 - protein, 9 aa, Influenza virus
DEFQLIPMI

SEQ ID NO: 465290 - protein, 9 aa, Influenza virus
DEGDGCFNF

SEQ ID NO: 465291 - protein, 9 aa, Influenza virus
DEGDGCFNL

SEQ ID NO: 465292 - protein, 9 aa, Influenza virus
DEGDGCFSI

SEQ ID NO: 465293 - protein, 9 aa, Influenza virus
DEGDGCFSL

SEQ ID NO: 465294 - protein, 9 aa, Influenza virus
DEGLPQSGR

SEQ ID NO: 465295 - protein, 9 aa, Influenza virus
DEGNGCFEL

SEQ ID NO: 465296 - protein, 9 aa, Influenza virus
DEGNGCFTF

SEQ ID NO: 465297 - protein, 9 aa, Influenza virus
DEHDANVRN

SEQ ID NO: 465298 - protein, 9 aa, Influenza virus
DEHDSNVEN

SEQ ID NO: 465299 - protein, 9 aa, Influenza virus
DEHDSNVKN

SEQ ID NO: 465300 - protein, 9 aa, Influenza virus
DEICIGHLS

SEQ ID NO: 465301 - protein, 9 aa, Influenza virus
DEICIGYLS

SEQ ID NO: 465302 - protein, 9 aa, Influenza virus
DEICIGYMS

SEQ ID NO: 465303 - protein, 9 aa, Influenza virus
DEIGEDIAP

SEQ ID NO: 465304 - protein, 9 aa, Influenza virus
DEIGEDLAP

SEQ ID NO: 465305 - protein, 9 aa, Influenza virus
DEIGEDVAP

SEQ ID NO: 465306 - protein, 9 aa, Influenza virus
DEITTKINN

SEQ ID NO: 465307 - protein, 9 aa, Influenza virus
DELCPSPLK

SEQ ID NO: 465308 - protein, 9 aa, Influenza virus
DELIGKTSW

SEQ ID NO: 465309 - protein, 9 aa, Influenza virus
DENATASFI

SEQ ID NO: 465310 - protein, 9 aa, Influenza virus
DEQMYQKCC

SEQ ID NO: 465311 - protein, 9 aa, Influenza virus
DEQMYQRCC

SEQ ID NO: 465312 - protein, 9 aa, Influenza virus
DEQNKLYGA

SEQ ID NO: 465313 - protein, 9 aa, Influenza virus
DEQNKLYGT

SEQ ID NO: 465314 - protein, 9 aa, Influenza virus
DEQTKLYGS

SEQ ID NO: 465315 - protein, 9 aa, Influenza virus
DERGLFGAI

SEQ ID NO: 465316 - protein, 9 aa, Influenza virus
DERGNPGVK

SEQ ID NO: 465317 - protein, 9 aa, Influenza virus
DERRNKYLE

SEQ ID NO: 465318 - protein, 9 aa, Influenza virus
DERRNRYLE

SEQ ID NO: 465319 - protein, 9 aa, Influenza virus
DESCEGECF

SEQ ID NO: 465320 - protein, 9 aa, Influenza virus
DESRIERQK

SEQ ID NO: 465321 - protein, 9 aa, Influenza virus
DEVDQSLII

SEQ ID NO: 465322 - protein, 9 aa, Influenza virus
DEVKRRLSA

SEQ ID NO: 465323 - protein, 9 aa, Influenza virus
DEVKRRLST

SEQ ID NO: 465324 - protein, 9 aa, Influenza virus
DEVRRRLSA

SEQ ID NO: 465325 - protein, 9 aa, Influenza virus
DEVRRRLST

SEQ ID NO: 465326 - protein, 9 aa, Influenza virus
DEVRRRLSV

SEQ ID NO: 465327 - protein, 9 aa, Influenza virus
DEVSWTSNS

SEQ ID NO: 465328 - protein, 9 aa, Influenza virus
DEVWWTSNS

SEQ ID NO: 465329 - protein, 9 aa, Influenza virus
DEYKNTGDS

SEQ ID NO: 465330 - protein, 9 aa, Influenza virus
DEYKNTRDS

SEQ ID NO: 465331 - protein, 9 aa, Influenza virus
DFALILNAP

SEQ ID NO: 465332 - protein, 9 aa, Influenza virus
DFALIVNAL

SEQ ID NO: 465333 - protein, 9 aa, Influenza virus
DFALIVNAP

SEQ ID NO: 465334 - protein, 9 aa, Influenza virus
DFALIVNAS

SEQ ID NO: 465335 - protein, 9 aa, Influenza virus
DFEKEGYSL

SEQ ID NO: 465336 - protein, 9 aa, Influenza virus
DFEREGYSL

SEQ ID NO: 465337 - protein, 9 aa, Influenza virus
DFFKRLNWL

SEQ ID NO: 465338 - protein, 9 aa, Influenza virus
DFFNRLNWL

SEQ ID NO: 465339 - protein, 9 aa, Influenza virus
DFFRRLNWL

SEQ ID NO: 465340 - protein, 9 aa, Influenza virus
DFHDSNVKN

SEQ ID NO: 465341 - protein, 9 aa, Influenza virus
DFHDSNVKS

SEQ ID NO: 465342 - protein, 9 aa, Influenza virus
DFHDSNVRN

SEQ ID NO: 465343 - protein, 9 aa, Influenza virus
DFHDSSVKN

SEQ ID NO: 465344 - protein, 9 aa, Influenza virus
DFHWMLLDP

SEQ ID NO: 465345 - protein, 9 aa, Influenza virus
DFICVGWSS

SEQ ID NO: 465346 - protein, 9 aa, Influenza virus
DFIKWNVTY

SEQ ID NO: 465347 - protein, 9 aa, Influenza virus
DFKSTQAAI

SEQ ID NO: 465348 - protein, 9 aa, Influenza virus
DFLCVGWSS

SEQ ID NO: 465349 - protein, 9 aa, Influenza virus
DFLDVWTYN

SEQ ID NO: 465350 - protein, 9 aa, Influenza virus
DFLNNTEPL

SEQ ID NO: 465351 - protein, 9 aa, Influenza virus
DFMCVGWSS

SEQ ID NO: 465352 - protein, 9 aa, Influenza virus
DFQLIPMIS

SEQ ID NO: 465353 - protein, 9 aa, Influenza virus
DFRDMRKNT

SEQ ID NO: 465354 - protein, 9 aa, Influenza virus
DFSKWNVTY

SEQ ID NO: 465355 - protein, 9 aa, Influenza virus
DFTKWNVTH

SEQ ID NO: 465356 - protein, 9 aa, Influenza virus
DFTKWNVTY

SEQ ID NO: 465357 - protein, 9 aa, Influenza virus
DFVRQCFNP

SEQ ID NO: 465358 - protein, 9 aa, Influenza virus
DGADINFMP

SEQ ID NO: 465359 - protein, 9 aa, Influenza virus
DGADLPFTI

SEQ ID NO: 465360 - protein, 9 aa, Influenza virus
DGAEIEYFL

SEQ ID NO: 465361 - protein, 9 aa, Influenza virus
DGAEIIYFE

SEQ ID NO: 465362 - protein, 9 aa, Influenza virus
DGAEIIYFK

SEQ ID NO: 465363 - protein, 9 aa, Influenza virus
DGAEITYFK

SEQ ID NO: 465364 - protein, 9 aa, Influenza virus
DGAELPFAI

SEQ ID NO: 465365 - protein, 9 aa, Influenza virus
DGAELPFII

SEQ ID NO: 465366 - protein, 9 aa, Influenza virus
DGAELPFTI

SEQ ID NO: 465367 - protein, 9 aa, Influenza virus
DGAFLAPRY

SEQ ID NO: 465368 - protein, 9 aa, Influenza virus
DGAILPFDF

SEQ ID NO: 465369 - protein, 9 aa, Influenza virus
DGAILPFDI

SEQ ID NO: 465370 - protein, 9 aa, Influenza virus
DGAILPFGI

SEQ ID NO: 465371 - protein, 9 aa, Influenza virus
DGAILPLTS

SEQ ID NO: 465372 - protein, 9 aa, Influenza virus
DGAKIEYFL

SEQ ID NO: 465373 - protein, 9 aa, Influenza virus
DGAKIKYFL

SEQ ID NO: 465374 - protein, 9 aa, Influenza virus
DGAKIQYFS

SEQ ID NO: 465375 - protein, 9 aa, Influenza virus
DGAKLPFTI

SEQ ID NO: 465376 - protein, 9 aa, Influenza virus
DGALLPFDI

SEQ ID NO: 465377 - protein, 9 aa, Influenza virus
DGANIDFMP

SEQ ID NO: 465378 - protein, 9 aa, Influenza virus
DGANIDFVP

SEQ ID NO: 465379 - protein, 9 aa, Influenza virus
DGANIGFMP

SEQ ID NO: 465380 - protein, 9 aa, Influenza virus
DGANINFMA

SEQ ID NO: 465381 - protein, 9 aa, Influenza virus
DGANINFMH

SEQ ID NO: 465382 - protein, 9 aa, Influenza virus
DGANINFMP

SEQ ID NO: 465383 - protein, 9 aa, Influenza virus
DGANINFMS

SEQ ID NO: 465384 - protein, 9 aa, Influenza virus
DGANINLMP

SEQ ID NO: 465385 - protein, 9 aa, Influenza virus
DGANISFMP

SEQ ID NO: 465386 - protein, 9 aa, Influenza virus
DGAQIKYFS

SEQ ID NO: 465387 - protein, 9 aa, Influenza virus
DGAQIQYFS

SEQ ID NO: 465388 - protein, 9 aa, Influenza virus
DGARIQYFS

SEQ ID NO: 465389 - protein, 9 aa, Influenza virus
DGATSACKR

SEQ ID NO: 465390 - protein, 9 aa, Influenza virus
DGAVAVLKY

SEQ ID NO: 465391 - protein, 9 aa, Influenza virus
DGAVLPFDI

SEQ ID NO: 465392 - protein, 9 aa, Influenza virus
DGCFEILHK

SEQ ID NO: 465393 - protein, 9 aa, Influenza virus
DGCFEILHR

SEQ ID NO: 465394 - protein, 9 aa, Influenza virus
DGCFNFFHK

SEQ ID NO: 465395 - protein, 9 aa, Influenza virus
DGCFNLLHK

SEQ ID NO: 465396 - protein, 9 aa, Influenza virus
DGCFSILHK

SEQ ID NO: 465397 - protein, 9 aa, Influenza virus
DGCFSLLHK

SEQ ID NO: 465398 - protein, 9 aa, Influenza virus
DGCRFYALS

SEQ ID NO: 465399 - protein, 9 aa, Influenza virus
DGDIIFLWG

SEQ ID NO: 465400 - protein, 9 aa, Influenza virus
DGFEPNGCI

SEQ ID NO: 465401 - protein, 9 aa, Influenza virus
DGFEPNGYI

SEQ ID NO: 465402 - protein, 9 aa, Influenza virus
DGFIDIWTY

SEQ ID NO: 465403 - protein, 9 aa, Influenza virus
DGFIDVWTY

SEQ ID NO: 465404 - protein, 9 aa, Influenza virus
DGFKPNGCI

SEQ ID NO: 465405 - protein, 9 aa, Influenza virus
DGFLDIWTY

SEQ ID NO: 465406 - protein, 9 aa, Influenza virus
DGFLDVWTY

SEQ ID NO: 465407 - protein, 9 aa, Influenza virus
DGFLGVWTY

SEQ ID NO: 465408 - protein, 9 aa, Influenza virus
DGFLNVWTY

SEQ ID NO: 465409 - protein, 9 aa, Influenza virus
DGFMDVWTY

SEQ ID NO: 465410 - protein, 9 aa, Influenza virus
DGGHIEECS

SEQ ID NO: 465411 - protein, 9 aa, Influenza virus
DGGPNLYNI

SEQ ID NO: 465412 - protein, 9 aa, Influenza virus
DGIARMTIC

SEQ ID NO: 465413 - protein, 9 aa, Influenza virus
DGIGRFYIQ

SEQ ID NO: 465414 - protein, 9 aa, Influenza virus
DGIGRMTIC

SEQ ID NO: 465415 - protein, 9 aa, Influenza virus
DGITNKINS

SEQ ID NO: 465416 - protein, 9 aa, Influenza virus
DGITNKVNS

SEQ ID NO: 465417 - protein, 9 aa, Influenza virus
DGKAPISLG

SEQ ID NO: 465418 - protein, 9 aa, Influenza virus
DGKAWLHIC

SEQ ID NO: 465419 - protein, 9 aa, Influenza virus
DGKAWLHVC

SEQ ID NO: 465420 - protein, 9 aa, Influenza virus
DGKEWLHVC

SEQ ID NO: 465421 - protein, 9 aa, Influenza virus
DGKEWMHIC

SEQ ID NO: 465422 - protein, 9 aa, Influenza virus
DGKEWMHVC

SEQ ID NO: 465423 - protein, 9 aa, Influenza virus
DGKEWMHVS

SEQ ID NO: 465424 - protein, 9 aa, Influenza virus
DGKGCFDLY

SEQ ID NO: 465425 - protein, 9 aa, Influenza virus
DGKGCFEIY

SEQ ID NO: 465426 - protein, 9 aa, Influenza virus
DGKGCFELY

SEQ ID NO: 465427 - protein, 9 aa, Influenza virus
DGKGCFETY

SEQ ID NO: 465428 - protein, 9 aa, Influenza virus
DGKGCSELY

SEQ ID NO: 465429 - protein, 9 aa, Influenza virus
DGKSSACKR

SEQ ID NO: 465430 - protein, 9 aa, Influenza virus
DGKSWLHVC

SEQ ID NO: 465431 - protein, 9 aa, Influenza virus
DGKVECVCR

SEQ ID NO: 465432 - protein, 9 aa, Influenza virus
DGLLDVWTY

SEQ ID NO: 465433 - protein, 9 aa, Influenza virus
DGLQSSDDF

SEQ ID NO: 465434 - protein, 9 aa, Influenza virus
DGNASGKAD

SEQ ID NO: 465435 - protein, 9 aa, Influenza virus
DGNAWLHVC

SEQ ID NO: 465436 - protein, 9 aa, Influenza virus
DGNGCFEIF

SEQ ID NO: 465437 - protein, 9 aa, Influenza virus
DGNGCFELY

SEQ ID NO: 465438 - protein, 9 aa, Influenza virus
DGNIIFLWG

SEQ ID NO: 465439 - protein, 9 aa, Influenza virus
DGNLIAPWY

SEQ ID NO: 465440 - protein, 9 aa, Influenza virus
DGPAANNAD

SEQ ID NO: 465441 - protein, 9 aa, Influenza virus
DGPAANSAD

SEQ ID NO: 465442 - protein, 9 aa, Influenza virus
DGPAANSAH

SEQ ID NO: 465443 - protein, 9 aa, Influenza virus
DGPANKQAS

SEQ ID NO: 465444 - protein, 9 aa, Influenza virus
DGPANNQAS

SEQ ID NO: 465445 - protein, 9 aa, Influenza virus
DGPANSQAS

SEQ ID NO: 465446 - protein, 9 aa, Influenza virus
DGPANSQAY

SEQ ID NO: 465447 - protein, 9 aa, Influenza virus
DGPASNQAS

SEQ ID NO: 465448 - protein, 9 aa, Influenza virus
DGPGWLTIG

SEQ ID NO: 465449 - protein, 9 aa, Influenza virus
DGPGWLTLG

SEQ ID NO: 465450 - protein, 9 aa, Influenza virus
DGPQIQYFS

SEQ ID NO: 465451 - protein, 9 aa, Influenza virus
DGPSDAQAF

SEQ ID NO: 465452 - protein, 9 aa, Influenza virus
DGPSNAQAF

SEQ ID NO: 465453 - protein, 9 aa, Influenza virus
DGQDCDLIN

SEQ ID NO: 465454 - protein, 9 aa, Influenza virus
DGQRSWMKI

SEQ ID NO: 465455 - protein, 9 aa, Influenza virus
DGQRSWMKL

SEQ ID NO: 465456 - protein, 9 aa, Influenza virus
DGQSGRIDF

SEQ ID NO: 465457 - protein, 9 aa, Influenza virus
DGRAWLHIC

SEQ ID NO: 465458 - protein, 9 aa, Influenza virus
DGRAWLHVC

SEQ ID NO: 465459 - protein, 9 aa, Influenza virus
DGREWMHVC

SEQ ID NO: 465460 - protein, 9 aa, Influenza virus
DGRGCFEIY

SEQ ID NO: 465461 - protein, 9 aa, Influenza virus
DGRLIQNSI

SEQ ID NO: 465462 - protein, 9 aa, Influenza virus
DGSANSQAY

SEQ ID NO: 465463 - protein, 9 aa, Influenza virus
DGSASGKAD

SEQ ID NO: 465464 - protein, 9 aa, Influenza virus
DGSASGKAE

SEQ ID NO: 465465 - protein, 9 aa, Influenza virus
DGSASGQAY

SEQ ID NO: 465466 - protein, 9 aa, Influenza virus
DGSASGRAD

SEQ ID NO: 465467 - protein, 9 aa, Influenza virus
DGSASRKAD

SEQ ID NO: 465468 - protein, 9 aa, Influenza virus
DGSASSQAH

SEQ ID NO: 465469 - protein, 9 aa, Influenza virus
DGSASSQAY

SEQ ID NO: 465470 - protein, 9 aa, Influenza virus
DGSATGPAD

SEQ ID NO: 465471 - protein, 9 aa, Influenza virus
DGSATGPAE

SEQ ID NO: 465472 - protein, 9 aa, Influenza virus
DGSDIGFMP

SEQ ID NO: 465473 - protein, 9 aa, Influenza virus
DGSGWLTLG

SEQ ID NO: 465474 - protein, 9 aa, Influenza virus
DGSIGKVCR

SEQ ID NO: 465475 - protein, 9 aa, Influenza virus
DGSKIGFMP

SEQ ID NO: 465476 - protein, 9 aa, Influenza virus
DGSNIGFMP

SEQ ID NO: 465477 - protein, 9 aa, Influenza virus
DGSNIKFMP

SEQ ID NO: 465478 - protein, 9 aa, Influenza virus
DGSSSACLR

SEQ ID NO: 465479 - protein, 9 aa, Influenza virus
DGTAFRGLI

SEQ ID NO: 465480 - protein, 9 aa, Influenza virus
DGTGCFEIF

SEQ ID NO: 465481 - protein, 9 aa, Influenza virus
DGTGCFELF

SEQ ID NO: 465482 - protein, 9 aa, Influenza virus
DGTIAGFIE

SEQ ID NO: 465483 - protein, 9 aa, Influenza virus
DGTYKILTI

SEQ ID NO: 465484 - protein, 9 aa, Influenza virus
DGVGRMTIC

SEQ ID NO: 465485 - protein, 9 aa, Influenza virus
DGVNRMTIC

SEQ ID NO: 465486 - protein, 9 aa, Influenza virus
DGVSRMTIC

SEQ ID NO: 465487 - protein, 9 aa, Influenza virus
DGVTASCLD

SEQ ID NO: 465488 - protein, 9 aa, Influenza virus
DGVTASCRD

SEQ ID NO: 465489 - protein, 9 aa, Influenza virus
DGVTNKVNS

SEQ ID NO: 465490 - protein, 9 aa, Influenza virus
DGVWIGRTK

SEQ ID NO: 465491 - protein, 9 aa, Influenza virus
DGVYKALSI

SEQ ID NO: 465492 - protein, 9 aa, Influenza virus
DGWILGNPQ

SEQ ID NO: 465493 - protein, 9 aa, Influenza virus
DGWINSPNH

SEQ ID NO: 465494 - protein, 9 aa, Influenza virus
DGWTTANSK

SEQ ID NO: 465495 - protein, 9 aa, Influenza virus
DGWYGFHHS

SEQ ID NO: 465496 - protein, 9 aa, Influenza virus
DGWYGFKHQ

SEQ ID NO: 465497 - protein, 9 aa, Influenza virus
DGWYGFRHH

SEQ ID NO: 465498 - protein, 9 aa, Influenza virus
DGWYGFRHQ

SEQ ID NO: 465499 - protein, 9 aa, Influenza virus
DGWYGFRYQ

SEQ ID NO: 465500 - protein, 9 aa, Influenza virus
DGWYGYHHE

SEQ ID NO: 465501 - protein, 9 aa, Influenza virus
DGWYGYHHI

SEQ ID NO: 465502 - protein, 9 aa, Influenza virus
DGWYGYHHN

SEQ ID NO: 465503 - protein, 9 aa, Influenza virus
DGWYGYHHQ

SEQ ID NO: 465504 - protein, 9 aa, Influenza virus
DGWYGYHHS

SEQ ID NO: 465505 - protein, 9 aa, Influenza virus
DGWYGYHHT

SEQ ID NO: 465506 - protein, 9 aa, Influenza virus
DGWYGYKHQ

SEQ ID NO: 465507 - protein, 9 aa, Influenza virus
DGWYGYRHQ

SEQ ID NO: 465508 - protein, 9 aa, Influenza virus
DHAQYREEA

SEQ ID NO: 465509 - protein, 9 aa, Influenza virus
DHCMESIRN

SEQ ID NO: 465510 - protein, 9 aa, Influenza virus
DHEGEGIPL

SEQ ID NO: 465511 - protein, 9 aa, Influenza virus
DHGVKGWAF

SEQ ID NO: 465512 - protein, 9 aa, Influenza virus
DHICIGYHA

SEQ ID NO: 465513 - protein, 9 aa, Influenza virus
DHIEVTNAT

SEQ ID NO: 465514 - protein, 9 aa, Influenza virus
DHITFSHNG

SEQ ID NO: 465515 - protein, 9 aa, Influenza virus
DHKDFEEES

SEQ ID NO: 465516 - protein, 9 aa, Influenza virus
DHKDYEEEA

SEQ ID NO: 465517 - protein, 9 aa, Influenza virus
DHKEFEEES

SEQ ID NO: 465518 - protein, 9 aa, Influenza virus
DHKEFEKES

SEQ ID NO: 465519 - protein, 9 aa, Influenza virus
DHKEYEEEA

SEQ ID NO: 465520 - protein, 9 aa, Influenza virus
DHMAIIKKY

SEQ ID NO: 465521 - protein, 9 aa, Influenza virus
DHNIYRDEA

SEQ ID NO: 465522 - protein, 9 aa, Influenza virus
DHRIYWIKE

SEQ ID NO: 465523 - protein, 9 aa, Influenza virus
DHRIYWIRE

SEQ ID NO: 465524 - protein, 9 aa, Influenza virus
DHRIYWIRK

SEQ ID NO: 465525 - protein, 9 aa, Influenza virus
DHRVYWIRE

SEQ ID NO: 465526 - protein, 9 aa, Influenza virus
DHSDNADKI

SEQ ID NO: 465527 - protein, 9 aa, Influenza virus
DHSQYREEA

SEQ ID NO: 465528 - protein, 9 aa, Influenza virus
DHTQYREEA

SEQ ID NO: 465529 - protein, 9 aa, Influenza virus
DHTSQYLCT

SEQ ID NO: 465530 - protein, 9 aa, Influenza virus
DICYPGKFT

SEQ ID NO: 465531 - protein, 9 aa, Influenza virus
DICYPGRFT

SEQ ID NO: 465532 - protein, 9 aa, Influenza virus
DIDIYCICR

SEQ ID NO: 465533 - protein, 9 aa, Influenza virus
DIDQSLIIA

SEQ ID NO: 465534 - protein, 9 aa, Influenza virus
DIDVYCICR

SEQ ID NO: 465535 - protein, 9 aa, Influenza virus
DIDVYCVCR

SEQ ID NO: 465536 - protein, 9 aa, Influenza virus
DIEAMASQG

SEQ ID NO: 465537 - protein, 9 aa, Influenza virus
DIEAMATQG

SEQ ID NO: 465538 - protein, 9 aa, Influenza virus
DIECVCRDN

SEQ ID NO: 465539 - protein, 9 aa, Influenza virus
DIEIMASQG

SEQ ID NO: 465540 - protein, 9 aa, Influenza virus
DIFVIREPF

SEQ ID NO: 465541 - protein, 9 aa, Influenza virus
DIFVMREPF

SEQ ID NO: 465542 - protein, 9 aa, Influenza virus
DIIDNDNWS

SEQ ID NO: 465543 - protein, 9 aa, Influenza virus
DIIDNNNWS

SEQ ID NO: 465544 - protein, 9 aa, Influenza virus
DIIFLWGIH

SEQ ID NO: 465545 - protein, 9 aa, Influenza virus
DIILWFSFG

SEQ ID NO: 465546 - protein, 9 aa, Influenza virus
DIILWISFS

SEQ ID NO: 465547 - protein, 9 aa, Influenza virus
DIILWVSFS

SEQ ID NO: 465548 - protein, 9 aa, Influenza virus
DIINGALGS

SEQ ID NO: 465549 - protein, 9 aa, Influenza virus
DIITDTIKS

SEQ ID NO: 465550 - protein, 9 aa, Influenza virus
DIIVFNTIG

SEQ ID NO: 465551 - protein, 9 aa, Influenza virus
DIKSHAYIS

SEQ ID NO: 465552 - protein, 9 aa, Influenza virus
DILDGVTAS

SEQ ID NO: 465553 - protein, 9 aa, Influenza virus
DILEGTTAS

SEQ ID NO: 465554 - protein, 9 aa, Influenza virus
DILEKAHNG

SEQ ID NO: 465555 - protein, 9 aa, Influenza virus
DILEKEHNG

SEQ ID NO: 465556 - protein, 9 aa, Influenza virus
DILEKKHNG

SEQ ID NO: 465557 - protein, 9 aa, Influenza virus
DILEKTHNG

SEQ ID NO: 465558 - protein, 9 aa, Influenza virus
DILEKVHNG

SEQ ID NO: 465559 - protein, 9 aa, Influenza virus
DILERTHNG

SEQ ID NO: 465560 - protein, 9 aa, Influenza virus
DILHKCDNE

SEQ ID NO: 465561 - protein, 9 aa, Influenza virus
DILHKCDNK

SEQ ID NO: 465562 - protein, 9 aa, Influenza virus
DILHKCNNE

SEQ ID NO: 465563 - protein, 9 aa, Influenza virus
DILKHNPTE

SEQ ID NO: 465564 - protein, 9 aa, Influenza virus
DILKQNPTE

SEQ ID NO: 465565 - protein, 9 aa, Influenza virus
DILRQNPSE

SEQ ID NO: 465566 - protein, 9 aa, Influenza virus
DILRQNPTE

SEQ ID NO: 465567 - protein, 9 aa, Influenza virus
DILRTQESE

SEQ ID NO: 465568 - protein, 9 aa, Influenza virus
DILRTQESS

SEQ ID NO: 465569 - protein, 9 aa, Influenza virus
DILVTREPY

SEQ ID NO: 465570 - protein, 9 aa, Influenza virus
DIMQNKLNN

SEQ ID NO: 465571 - protein, 9 aa, Influenza virus
DIMRTQESS

SEQ ID NO: 465572 - protein, 9 aa, Influenza virus
DINIAEYSI

SEQ ID NO: 465573 - protein, 9 aa, Influenza virus
DINIMASQG

SEQ ID NO: 465574 - protein, 9 aa, Influenza virus
DINLHAYIS

SEQ ID NO: 465575 - protein, 9 aa, Influenza virus
DINLMPIYS

SEQ ID NO: 465576 - protein, 9 aa, Influenza virus
DINMADYSI

SEQ ID NO: 465577 - protein, 9 aa, Influenza virus
DINMEDYSI

SEQ ID NO: 465578 - protein, 9 aa, Influenza virus
DIRTATREG

SEQ ID NO: 465579 - protein, 9 aa, Influenza virus
DISMEDYSI

SEQ ID NO: 465580 - protein, 9 aa, Influenza virus
DITIGSICM

SEQ ID NO: 465581 - protein, 9 aa, Influenza virus
DIVLVMKRK

SEQ ID NO: 465582 - protein, 9 aa, Influenza virus
DIVNAALGS

SEQ ID NO: 465583 - protein, 9 aa, Influenza virus
DIVNGALGS

SEQ ID NO: 465584 - protein, 9 aa, Influenza virus
DIVNSALGS

SEQ ID NO: 465585 - protein, 9 aa, Influenza virus
DIWAYNAEL

SEQ ID NO: 465586 - protein, 9 aa, Influenza virus
DIWITREPY

SEQ ID NO: 465587 - protein, 9 aa, Influenza virus
DIWMGRTIS

SEQ ID NO: 465588 - protein, 9 aa, Influenza virus
DIWSYNAKL

SEQ ID NO: 465589 - protein, 9 aa, Influenza virus
DIWSYNAQL

SEQ ID NO: 465590 - protein, 9 aa, Influenza virus
DIWSYNARL

SEQ ID NO: 465591 - protein, 9 aa, Influenza virus
DIWTYNAEL

SEQ ID NO: 465592 - protein, 9 aa, Influenza virus
DIWTYQAEL

SEQ ID NO: 465593 - protein, 9 aa, Influenza virus
DIWVTRELY

SEQ ID NO: 465594 - protein, 9 aa, Influenza virus
DIWVTREPY

SEQ ID NO: 465595 - protein, 9 aa, Influenza virus
DIWVTRKPY

SEQ ID NO: 465596 - protein, 9 aa, Influenza virus
DIWVTRVPY

SEQ ID NO: 465597 - protein, 9 aa, Influenza virus
DIYCICRDN

SEQ ID NO: 465598 - protein, 9 aa, Influenza virus
DIYCVCRDN

SEQ ID NO: 465599 - protein, 9 aa, Influenza virus
DIYDFNEGS

SEQ ID NO: 465600 - protein, 9 aa, Influenza virus
DKASTQKAI

SEQ ID NO: 465601 - protein, 9 aa, Influenza virus
DKAVKLYKK

SEQ ID NO: 465602 - protein, 9 aa, Influenza virus
DKAVKLYRK

SEQ ID NO: 465603 - protein, 9 aa, Influenza virus
DKCYQFALG

SEQ ID NO: 465604 - protein, 9 aa, Influenza virus
DKDSNGVQD

SEQ ID NO: 465605 - protein, 9 aa, Influenza virus
DKEPMGFRY

SEQ ID NO: 465606 - protein, 9 aa, Influenza virus
DKESMGFRY

SEQ ID NO: 465607 - protein, 9 aa, Influenza virus
DKESTQKAF

SEQ ID NO: 465608 - protein, 9 aa, Influenza virus
DKESTQKAI

SEQ ID NO: 465609 - protein, 9 aa, Influenza virus
DKESTQKAV

SEQ ID NO: 465610 - protein, 9 aa, Influenza virus
DKESTQRAF

SEQ ID NO: 465611 - protein, 9 aa, Influenza virus
DKGNGCFEI

SEQ ID NO: 465612 - protein, 9 aa, Influenza virus
DKGSIQSDK

SEQ ID NO: 465613 - protein, 9 aa, Influenza virus
DKHDSNVKN

SEQ ID NO: 465614 - protein, 9 aa, Influenza virus
DKHSNGTAK

SEQ ID NO: 465615 - protein, 9 aa, Influenza virus
DKHSNGTIK

SEQ ID NO: 465616 - protein, 9 aa, Influenza virus
DKHSNGTMK

SEQ ID NO: 465617 - protein, 9 aa, Influenza virus
DKHSNGTVK

SEQ ID NO: 465618 - protein, 9 aa, Influenza virus
DKHSNNTVK

SEQ ID NO: 465619 - protein, 9 aa, Influenza virus
DKHSNNTVR

SEQ ID NO: 465620 - protein, 9 aa, Influenza virus
DKICIGYHA

SEQ ID NO: 465621 - protein, 9 aa, Influenza virus
DKICIGYLS

SEQ ID NO: 465622 - protein, 9 aa, Influenza virus
DKICIGYQT

SEQ ID NO: 465623 - protein, 9 aa, Influenza virus
DKICLGHHA

SEQ ID NO: 465624 - protein, 9 aa, Influenza virus
DKICLGRHA

SEQ ID NO: 465625 - protein, 9 aa, Influenza virus
DKICVGYLS

SEQ ID NO: 465626 - protein, 9 aa, Influenza virus
DKIDDQIED

SEQ ID NO: 465627 - protein, 9 aa, Influenza virus
DKIDDQIEE

SEQ ID NO: 465628 - protein, 9 aa, Influenza virus
DKIDDQIEG

SEQ ID NO: 465629 - protein, 9 aa, Influenza virus
DKIDDQIEN

SEQ ID NO: 465630 - protein, 9 aa, Influenza virus
DKIDTLTET

SEQ ID NO: 465631 - protein, 9 aa, Influenza virus
DKINDQIED

SEQ ID NO: 465632 - protein, 9 aa, Influenza virus
DKITFEATG

SEQ ID NO: 465633 - protein, 9 aa, Influenza virus
DKITNKINN

SEQ ID NO: 465634 - protein, 9 aa, Influenza virus
DKITNKVNN

SEQ ID NO: 465635 - protein, 9 aa, Influenza virus
DKLTQGRQT

SEQ ID NO: 465636 - protein, 9 aa, Influenza virus
DKLYIWGIH

SEQ ID NO: 465637 - protein, 9 aa, Influenza virus
DKLYIWGVH

SEQ ID NO: 465638 - protein, 9 aa, Influenza virus
DKLYVWGIH

SEQ ID NO: 465639 - protein, 9 aa, Influenza virus
DKLYVWGVH

SEQ ID NO: 465640 - protein, 9 aa, Influenza virus
DKMNGNYDS

SEQ ID NO: 465641 - protein, 9 aa, Influenza virus
DKMNREFEV

SEQ ID NO: 465642 - protein, 9 aa, Influenza virus
DKMNREFGV

SEQ ID NO: 465643 - protein, 9 aa, Influenza virus
DKMNTQFEA

SEQ ID NO: 465644 - protein, 9 aa, Influenza virus
DKMNTQFET

SEQ ID NO: 465645 - protein, 9 aa, Influenza virus
DKMNTRFEA

SEQ ID NO: 465646 - protein, 9 aa, Influenza virus
DKNALGDCP

SEQ ID NO: 465647 - protein, 9 aa, Influenza virus
DKNALGECP

SEQ ID NO: 465648 - protein, 9 aa, Influenza virus
DKNATASFI

SEQ ID NO: 465649 - protein, 9 aa, Influenza virus
DKNSNGVQD

SEQ ID NO: 465650 - protein, 9 aa, Influenza virus
DKPFQNVNK

SEQ ID NO: 465651 - protein, 9 aa, Influenza virus
DKPFQNVNR

SEQ ID NO: 465652 - protein, 9 aa, Influenza virus
DKPFQNVSR

SEQ ID NO: 465653 - protein, 9 aa, Influenza virus
DKQTKTMTI

SEQ ID NO: 465654 - protein, 9 aa, Influenza virus
DKRIGSCTS

SEQ ID NO: 465655 - protein, 9 aa, Influenza virus
DKRYGPALS

SEQ ID NO: 465656 - protein, 9 aa, Influenza virus
DKTLDLHDA

SEQ ID NO: 465657 - protein, 9 aa, Influenza virus
DKTLDMHDA

SEQ ID NO: 465658 - protein, 9 aa, Influenza virus
DKTLNMHDA

SEQ ID NO: 465659 - protein, 9 aa, Influenza virus
DKTNQQFEL

SEQ ID NO: 465660 - protein, 9 aa, Influenza virus
DKTNQQFEM

SEQ ID NO: 465661 - protein, 9 aa, Influenza virus
DKTPYRSLI

SEQ ID NO: 465662 - protein, 9 aa, Influenza virus
DKTSTQKAI

SEQ ID NO: 465663 - protein, 9 aa, Influenza virus
DKVCTKGKK

SEQ ID NO: 465664 - protein, 9 aa, Influenza virus
DKVDTIIEN

SEQ ID NO: 465665 - protein, 9 aa, Influenza virus
DKVDTLLEN

SEQ ID NO: 465666 - protein, 9 aa, Influenza virus
DKVDTLTEN

SEQ ID NO: 465667 - protein, 9 aa, Influenza virus
DKVDTLTET

SEQ ID NO: 465668 - protein, 9 aa, Influenza virus
DKVNTIIEN

SEQ ID NO: 465669 - protein, 9 aa, Influenza virus
DKVRLQLKD

SEQ ID NO: 465670 - protein, 9 aa, Influenza virus
DKVRLQLRD

SEQ ID NO: 465671 - protein, 9 aa, Influenza virus
DKVRMQLKD

SEQ ID NO: 465672 - protein, 9 aa, Influenza virus
DKVRMQLRD

SEQ ID NO: 465673 - protein, 9 aa, Influenza virus
DKVSTQKAI

SEQ ID NO: 465674 - protein, 9 aa, Influenza virus
DKVSTQKAL

SEQ ID NO: 465675 - protein, 9 aa, Influenza virus
DKVWWTSNS

SEQ ID NO: 465676 - protein, 9 aa, Influenza virus
DKYHQIEKE

SEQ ID NO: 465677 - protein, 9 aa, Influenza virus
DLADSEMDK

SEQ ID NO: 465678 - protein, 9 aa, Influenza virus
DLADSEMKK

SEQ ID NO: 465679 - protein, 9 aa, Influenza virus
DLADSEMNK

SEQ ID NO: 465680 - protein, 9 aa, Influenza virus
DLADSEMSK

SEQ ID NO: 465681 - protein, 9 aa, Influenza virus
DLDNCHPIG

SEQ ID NO: 465682 - protein, 9 aa, Influenza virus
DLDYQIGYI

SEQ ID NO: 465683 - protein, 9 aa, Influenza virus
DLDYQIGYV

SEQ ID NO: 465684 - protein, 9 aa, Influenza virus
DLEALMEWI

SEQ ID NO: 465685 - protein, 9 aa, Influenza virus
DLEALMEWL

SEQ ID NO: 465686 - protein, 9 aa, Influenza virus
DLEKYVEDT

SEQ ID NO: 465687 - protein, 9 aa, Influenza virus
DLENYVEDT

SEQ ID NO: 465688 - protein, 9 aa, Influenza virus
DLERYVEDT

SEQ ID NO: 465689 - protein, 9 aa, Influenza virus
DLGAPLELR

SEQ ID NO: 465690 - protein, 9 aa, Influenza virus
DLGKCGLLG

SEQ ID NO: 465691 - protein, 9 aa, Influenza virus
DLGNCHPIG

SEQ ID NO: 465692 - protein, 9 aa, Influenza virus
DLGNCHPVG

SEQ ID NO: 465693 - protein, 9 aa, Influenza virus
DLGNGCFEF

SEQ ID NO: 465694 - protein, 9 aa, Influenza virus
DLGPATAQM

SEQ ID NO: 465695 - protein, 9 aa, Influenza virus
DLGQCGILG

SEQ ID NO: 465696 - protein, 9 aa, Influenza virus
DLGQCGLLG

SEQ ID NO: 465697 - protein, 9 aa, Influenza virus
DLGRCGLLG

SEQ ID NO: 465698 - protein, 9 aa, Influenza virus
DLGSCGILG

SEQ ID NO: 465699 - protein, 9 aa, Influenza virus
DLGSCHPIG

SEQ ID NO: 465700 - protein, 9 aa, Influenza virus
DLGSPLELR

SEQ ID NO: 465701 - protein, 9 aa, Influenza virus
DLGTPLELR

SEQ ID NO: 465702 - protein, 9 aa, Influenza virus
DLHDANVKN

SEQ ID NO: 465703 - protein, 9 aa, Influenza virus
DLHDANVRN

SEQ ID NO: 465704 - protein, 9 aa, Influenza virus
DLHDSNVKN

SEQ ID NO: 465705 - protein, 9 aa, Influenza virus
DLHDSNVRN

SEQ ID NO: 465706 - protein, 9 aa, Influenza virus
DLHDSNVRS

SEQ ID NO: 465707 - protein, 9 aa, Influenza virus
DLHLEFKAD

SEQ ID NO: 465708 - protein, 9 aa, Influenza virus
DLHLTGIWD

SEQ ID NO: 465709 - protein, 9 aa, Influenza virus
DLHLTGMWD

SEQ ID NO: 465710 - protein, 9 aa, Influenza virus
DLHLTGTWD

SEQ ID NO: 465711 - protein, 9 aa, Influenza virus
DLIENLQAY

SEQ ID NO: 465712 - protein, 9 aa, Influenza virus
DLIETNHTG

SEQ ID NO: 465713 - protein, 9 aa, Influenza virus
DLIETTHTG

SEQ ID NO: 465714 - protein, 9 aa, Influenza virus
DLIFLARSA

SEQ ID NO: 465715 - protein, 9 aa, Influenza virus
DLIFMARSA

SEQ ID NO: 465716 - protein, 9 aa, Influenza virus
DLIFSARSA

SEQ ID NO: 465717 - protein, 9 aa, Influenza virus
DLIGKNSWS

SEQ ID NO: 465718 - protein, 9 aa, Influenza virus
DLIGKTSWS

SEQ ID NO: 465719 - protein, 9 aa, Influenza virus
DLIIERKEG

SEQ ID NO: 465720 - protein, 9 aa, Influenza virus
DLIIERRDG

SEQ ID NO: 465721 - protein, 9 aa, Influenza virus
DLIIERREG

SEQ ID NO: 465722 - protein, 9 aa, Influenza virus
DLIIERRNS

SEQ ID NO: 465723 - protein, 9 aa, Influenza virus
DLILFNTIG

SEQ ID NO: 465724 - protein, 9 aa, Influenza virus
DLINGALGS

SEQ ID NO: 465725 - protein, 9 aa, Influenza virus
DLIVERQDG

SEQ ID NO: 465726 - protein, 9 aa, Influenza virus
DLIVERQEG

SEQ ID NO: 465727 - protein, 9 aa, Influenza virus
DLIVFNTIG

SEQ ID NO: 465728 - protein, 9 aa, Influenza virus
DLKSTQAAI

SEQ ID NO: 465729 - protein, 9 aa, Influenza virus
DLKSTQAAV

SEQ ID NO: 465730 - protein, 9 aa, Influenza virus
DLKSTQTAI

SEQ ID NO: 465731 - protein, 9 aa, Influenza virus
DLLDNLQAY

SEQ ID NO: 465732 - protein, 9 aa, Influenza virus
DLLENLQAY

SEQ ID NO: 465733 - protein, 9 aa, Influenza virus
DLLENLQTY

SEQ ID NO: 465734 - protein, 9 aa, Influenza virus
DLLVAMENQ

SEQ ID NO: 465735 - protein, 9 aa, Influenza virus
DLNFVNRAN

SEQ ID NO: 465736 - protein, 9 aa, Influenza virus
DLNMGQPFY

SEQ ID NO: 465737 - protein, 9 aa, Influenza virus
DLPFTQEQK

SEQ ID NO: 465738 - protein, 9 aa, Influenza virus
DLRSGYEML

SEQ ID NO: 465739 - protein, 9 aa, Influenza virus
DLRSGYETF

SEQ ID NO: 465740 - protein, 9 aa, Influenza virus
DLSFQGRGV

SEQ ID NO: 465741 - protein, 9 aa, Influenza virus
DLSQCGLLG

SEQ ID NO: 465742 - protein, 9 aa, Influenza virus
DLTDAEMNK

SEQ ID NO: 465743 - protein, 9 aa, Influenza virus
DLTDSEMNK

SEQ ID NO: 465744 - protein, 9 aa, Influenza virus
DLTDSEMSK

SEQ ID NO: 465745 - protein, 9 aa, Influenza virus
DLTFLARSA

SEQ ID NO: 465746 - protein, 9 aa, Influenza virus
DLTNSEMNK

SEQ ID NO: 465747 - protein, 9 aa, Influenza virus
DLVETNHTG

SEQ ID NO: 465748 - protein, 9 aa, Influenza virus
DLVETSHTG

SEQ ID NO: 465749 - protein, 9 aa, Influenza virus
DLWAYNAEL

SEQ ID NO: 465750 - protein, 9 aa, Influenza virus
DLWMGRTIS

SEQ ID NO: 465751 - protein, 9 aa, Influenza virus
DLWMGTTIS

SEQ ID NO: 465752 - protein, 9 aa, Influenza virus
DLWSYNAEL

SEQ ID NO: 465753 - protein, 9 aa, Influenza virus
DLWSYNAGL

SEQ ID NO: 465754 - protein, 9 aa, Influenza virus
DLWTYNAEL

SEQ ID NO: 465755 - protein, 9 aa, Influenza virus
DLYDYKEDR

SEQ ID NO: 465756 - protein, 9 aa, Influenza virus
DLYDYKENR

SEQ ID NO: 465757 - protein, 9 aa, Influenza virus
DLYDYKESR

SEQ ID NO: 465758 - protein, 9 aa, Influenza virus
DLYDYKKNR

SEQ ID NO: 465759 - protein, 9 aa, Influenza virus
DLYGTQPLS

SEQ ID NO: 465760 - protein, 9 aa, Influenza virus
DLYGTQSLS

SEQ ID NO: 465761 - protein, 9 aa, Influenza virus
DLYKVATGR

SEQ ID NO: 465762 - protein, 9 aa, Influenza virus
DLYLNGREW

SEQ ID NO: 465763 - protein, 9 aa, Influenza virus
DLYLSGREW

SEQ ID NO: 465764 - protein, 9 aa, Influenza virus
DLYLTGTWD

SEQ ID NO: 465765 - protein, 9 aa, Influenza virus
DMADSEMLN

SEQ ID NO: 465766 - protein, 9 aa, Influenza virus
DMADSTMLN

SEQ ID NO: 465767 - protein, 9 aa, Influenza virus
DMGDSEMLN

SEQ ID NO: 465768 - protein, 9 aa, Influenza virus
DMGNGCFKI

SEQ ID NO: 465769 - protein, 9 aa, Influenza virus
DMGNGCFRI

SEQ ID NO: 465770 - protein, 9 aa, Influenza virus
DMGNGCFTI

SEQ ID NO: 465771 - protein, 9 aa, Influenza virus
DMGNGCLKI

SEQ ID NO: 465772 - protein, 9 aa, Influenza virus
DMGQCGLLG

SEQ ID NO: 465773 - protein, 9 aa, Influenza virus
DMHDANVKN

SEQ ID NO: 465774 - protein, 9 aa, Influenza virus
DMHDANVRN

SEQ ID NO: 465775 - protein, 9 aa, Influenza virus
DMSIGITVI

SEQ ID NO: 465776 - protein, 9 aa, Influenza virus
DMSIGVAVI

SEQ ID NO: 465777 - protein, 9 aa, Influenza virus
DMSIGVTVI

SEQ ID NO: 465778 - protein, 9 aa, Influenza virus
DMTDSEMNK

SEQ ID NO: 465779 - protein, 9 aa, Influenza virus
DNADKICLG

SEQ ID NO: 465780 - protein, 9 aa, Influenza virus
DNAIDEGDG

SEQ ID NO: 465781 - protein, 9 aa, Influenza virus
DNAIRFGEG

SEQ ID NO: 465782 - protein, 9 aa, Influenza virus
DNAIRFGES

SEQ ID NO: 465783 - protein, 9 aa, Influenza virus
DNAIRIGED

SEQ ID NO: 465784 - protein, 9 aa, Influenza virus
DNAIRIGEE

SEQ ID NO: 465785 - protein, 9 aa, Influenza virus
DNAIRIGEN

SEQ ID NO: 465786 - protein, 9 aa, Influenza virus
DNAIRLGEN

SEQ ID NO: 465787 - protein, 9 aa, Influenza virus
DNAIRLGET

SEQ ID NO: 465788 - protein, 9 aa, Influenza virus
DNAIRPGEN

SEQ ID NO: 465789 - protein, 9 aa, Influenza virus
DNAKDEGNG

SEQ ID NO: 465790 - protein, 9 aa, Influenza virus
DNAKDLGNG

SEQ ID NO: 465791 - protein, 9 aa, Influenza virus
DNAKEIGNG

SEQ ID NO: 465792 - protein, 9 aa, Influenza virus
DNAKELGNG

SEQ ID NO: 465793 - protein, 9 aa, Influenza virus
DNAKEMGNG

SEQ ID NO: 465794 - protein, 9 aa, Influenza virus
DNAKETGNG

SEQ ID NO: 465795 - protein, 9 aa, Influenza virus
DNAKEVGNG

SEQ ID NO: 465796 - protein, 9 aa, Influenza virus
DNALRLAEN

SEQ ID NO: 465797 - protein, 9 aa, Influenza virus
DNANDLGNG

SEQ ID NO: 465798 - protein, 9 aa, Influenza virus
DNARELGNG

SEQ ID NO: 465799 - protein, 9 aa, Influenza virus
DNASAVVWY

SEQ ID NO: 465800 - protein, 9 aa, Influenza virus
DNATATVYY

SEQ ID NO: 465801 - protein, 9 aa, Influenza virus
DNAVRFGES

SEQ ID NO: 465802 - protein, 9 aa, Influenza virus
DNAVRIGED

SEQ ID NO: 465803 - protein, 9 aa, Influenza virus
DNAVRIGEN

SEQ ID NO: 465804 - protein, 9 aa, Influenza virus
DNAVRIGES

SEQ ID NO: 465805 - protein, 9 aa, Influenza virus
DNAVRLGEN

SEQ ID NO: 465806 - protein, 9 aa, Influenza virus
DNCMERIRN

SEQ ID NO: 465807 - protein, 9 aa, Influenza virus
DNCMESIRD

SEQ ID NO: 465808 - protein, 9 aa, Influenza virus
DNCMESIRN

SEQ ID NO: 465809 - protein, 9 aa, Influenza virus
DNDAYAVIH

SEQ ID NO: 465810 - protein, 9 aa, Influenza virus
DNDCESKCF

SEQ ID NO: 465811 - protein, 9 aa, Influenza virus
DNDNWSGYS

SEQ ID NO: 465812 - protein, 9 aa, Influenza virus
DNDPSGYAQ

SEQ ID NO: 465813 - protein, 9 aa, Influenza virus
DNEAVAVLK

SEQ ID NO: 465814 - protein, 9 aa, Influenza virus
DNECMETIK

SEQ ID NO: 465815 - protein, 9 aa, Influenza virus
DNEFTEVEQ

SEQ ID NO: 465816 - protein, 9 aa, Influenza virus
DNENATATV

SEQ ID NO: 465817 - protein, 9 aa, Influenza virus
DNEPGSGKL

SEQ ID NO: 465818 - protein, 9 aa, Influenza virus
DNEPGSGNW

SEQ ID NO: 465819 - protein, 9 aa, Influenza virus
DNEPNGYAQ

SEQ ID NO: 465820 - protein, 9 aa, Influenza virus
DNEPSGYAQ

SEQ ID NO: 465821 - protein, 9 aa, Influenza virus
DNEPTGYAQ

SEQ ID NO: 465822 - protein, 9 aa, Influenza virus
DNEQTDLYK

SEQ ID NO: 465823 - protein, 9 aa, Influenza virus
DNGAVAVLK

SEQ ID NO: 465824 - protein, 9 aa, Influenza virus
DNGAVAVVK

SEQ ID NO: 465825 - protein, 9 aa, Influenza virus
DNGDGCFEI

SEQ ID NO: 465826 - protein, 9 aa, Influenza virus
DNGGLIAPS

SEQ ID NO: 465827 - protein, 9 aa, Influenza virus
DNGIRIGSK

SEQ ID NO: 465828 - protein, 9 aa, Influenza virus
DNGIRIGSR

SEQ ID NO: 465829 - protein, 9 aa, Influenza virus
DNGIRVGSR

SEQ ID NO: 465830 - protein, 9 aa, Influenza virus
DNGVRIGSK

SEQ ID NO: 465831 - protein, 9 aa, Influenza virus
DNGVWIGRT

SEQ ID NO: 465832 - protein, 9 aa, Influenza virus
DNHSMSDIE

SEQ ID NO: 465833 - protein, 9 aa, Influenza virus
DNHVEVVSA

SEQ ID NO: 465834 - protein, 9 aa, Influenza virus
DNIEVTNAT

SEQ ID NO: 465835 - protein, 9 aa, Influenza virus
DNIIFSHNG

SEQ ID NO: 465836 - protein, 9 aa, Influenza virus
DNITFLHNG

SEQ ID NO: 465837 - protein, 9 aa, Influenza virus
DNITFSDNG

SEQ ID NO: 465838 - protein, 9 aa, Influenza virus
DNITFSHNG

SEQ ID NO: 465839 - protein, 9 aa, Influenza virus
DNIYKILSI

SEQ ID NO: 465840 - protein, 9 aa, Influenza virus
DNKCIESIR

SEQ ID NO: 465841 - protein, 9 aa, Influenza virus
DNKCMETIK

SEQ ID NO: 465842 - protein, 9 aa, Influenza virus
DNKHSNDTI

SEQ ID NO: 465843 - protein, 9 aa, Influenza virus
DNKHSNDTV

SEQ ID NO: 465844 - protein, 9 aa, Influenza virus
DNKHSNGTI

SEQ ID NO: 465845 - protein, 9 aa, Influenza virus
DNKNWSGYS

SEQ ID NO: 465846 - protein, 9 aa, Influenza virus
DNKTKKMTI

SEQ ID NO: 465847 - protein, 9 aa, Influenza virus
DNLEPGTFD

SEQ ID NO: 465848 - protein, 9 aa, Influenza virus
DNLIGKTSW

SEQ ID NO: 465849 - protein, 9 aa, Influenza virus
DNLNWSGYS

SEQ ID NO: 465850 - protein, 9 aa, Influenza virus
DNLQAYQKR

SEQ ID NO: 465851 - protein, 9 aa, Influenza virus
DNMQNKLNN

SEQ ID NO: 465852 - protein, 9 aa, Influenza virus
DNMQNRLNN

SEQ ID NO: 465853 - protein, 9 aa, Influenza virus
DNNCESKCF

SEQ ID NO: 465854 - protein, 9 aa, Influenza virus
DNNCIESIR

SEQ ID NO: 465855 - protein, 9 aa, Influenza virus
DNNCMESIR

SEQ ID NO: 465856 - protein, 9 aa, Influenza virus
DNNGELRHL

SEQ ID NO: 465857 - protein, 9 aa, Influenza virus
DNNIRIGSK

SEQ ID NO: 465858 - protein, 9 aa, Influenza virus
DNNKNATNP

SEQ ID NO: 465859 - protein, 9 aa, Influenza virus
DNNNRSGYS

SEQ ID NO: 465860 - protein, 9 aa, Influenza virus
DNNNWFGYF

SEQ ID NO: 465861 - protein, 9 aa, Influenza virus
DNNNWSGYS

SEQ ID NO: 465862 - protein, 9 aa, Influenza virus
DNNSWSGYS

SEQ ID NO: 465863 - protein, 9 aa, Influenza virus
DNPITGSPG

SEQ ID NO: 465864 - protein, 9 aa, Influenza virus
DNPNWSGYS

SEQ ID NO: 465865 - protein, 9 aa, Influenza virus
DNPRPNDPA

SEQ ID NO: 465866 - protein, 9 aa, Influenza virus
DNPRPNDPN

SEQ ID NO: 465867 - protein, 9 aa, Influenza virus
DNPRPNDPS

SEQ ID NO: 465868 - protein, 9 aa, Influenza virus
DNPRPNDPT

SEQ ID NO: 465869 - protein, 9 aa, Influenza virus
DNPRPNDPV

SEQ ID NO: 465870 - protein, 9 aa, Influenza virus
DNQCMESIR

SEQ ID NO: 465871 - protein, 9 aa, Influenza virus
DNQNWSGYS

SEQ ID NO: 465872 - protein, 9 aa, Influenza virus
DNQTKKMTI

SEQ ID NO: 465873 - protein, 9 aa, Influenza virus
DNQTKTMTI

SEQ ID NO: 465874 - protein, 9 aa, Influenza virus
DNQVFPQLN

SEQ ID NO: 465875 - protein, 9 aa, Influenza virus
DNRSGYSGI

SEQ ID NO: 465876 - protein, 9 aa, Influenza virus
DNSCESKCF

SEQ ID NO: 465877 - protein, 9 aa, Influenza virus
DNSCIESIR

SEQ ID NO: 465878 - protein, 9 aa, Influenza virus
DNSIQLSAG

SEQ ID NO: 465879 - protein, 9 aa, Influenza virus
DNSIRIGSK

SEQ ID NO: 465880 - protein, 9 aa, Influenza virus
DNSIRIGSR

SEQ ID NO: 465881 - protein, 9 aa, Influenza virus
DNSIRLAAG

SEQ ID NO: 465882 - protein, 9 aa, Influenza virus
DNSIRLSAD

SEQ ID NO: 465883 - protein, 9 aa, Influenza virus
DNSIRLSAG

SEQ ID NO: 465884 - protein, 9 aa, Influenza virus
DNSIRLSAS

SEQ ID NO: 465885 - protein, 9 aa, Influenza virus
DNSNWSGYS

SEQ ID NO: 465886 - protein, 9 aa, Influenza virus
DNSVRIGSK

SEQ ID NO: 465887 - protein, 9 aa, Influenza virus
DNSVRLSAG

SEQ ID NO: 465888 - protein, 9 aa, Influenza virus
DNSVRLSAS

SEQ ID NO: 465889 - protein, 9 aa, Influenza virus
DNTCIESIR

SEQ ID NO: 465890 - protein, 9 aa, Influenza virus
DNTKWNENQ

SEQ ID NO: 465891 - protein, 9 aa, Influenza virus
DNTWLGGTI

SEQ ID NO: 465892 - protein, 9 aa, Influenza virus
DNTWLGRTI

SEQ ID NO: 465893 - protein, 9 aa, Influenza virus
DNVKELGNG

SEQ ID NO: 465894 - protein, 9 aa, Influenza virus
DNVSWTSNS

SEQ ID NO: 465895 - protein, 9 aa, Influenza virus
DNVYKALSI

SEQ ID NO: 465896 - protein, 9 aa, Influenza virus
DNVYKILSI

SEQ ID NO: 465897 - protein, 9 aa, Influenza virus
DNVYKVLAI

SEQ ID NO: 465898 - protein, 9 aa, Influenza virus
DNVYKVLSI

SEQ ID NO: 465899 - protein, 9 aa, Influenza virus
DNVYRALSI

SEQ ID NO: 465900 - protein, 9 aa, Influenza virus
DNWHASNRP

SEQ ID NO: 465901 - protein, 9 aa, Influenza virus
DNWHGSNRP

SEQ ID NO: 465902 - protein, 9 aa, Influenza virus
DNWKGANRP

SEQ ID NO: 465903 - protein, 9 aa, Influenza virus
DNWKGSNRP

SEQ ID NO: 465904 - protein, 9 aa, Influenza virus
DNWMGSNRP

SEQ ID NO: 465905 - protein, 9 aa, Influenza virus
DNWNGMNRP

SEQ ID NO: 465906 - protein, 9 aa, Influenza virus
DNWQGANRP

SEQ ID NO: 465907 - protein, 9 aa, Influenza virus
DNWQGSNRP

SEQ ID NO: 465908 - protein, 9 aa, Influenza virus
DNWRGANRP

SEQ ID NO: 465909 - protein, 9 aa, Influenza virus
DNWRGSNRP

SEQ ID NO: 465910 - protein, 9 aa, Influenza virus
DNWSGYSGS

SEQ ID NO: 465911 - protein, 9 aa, Influenza virus
DNWTGTNRP

SEQ ID NO: 465912 - protein, 9 aa, Influenza virus
DNYGVKGFG

SEQ ID NO: 465913 - protein, 9 aa, Influenza virus
DPAAPHGLC

SEQ ID NO: 465914 - protein, 9 aa, Influenza virus
DPDECRFYA

SEQ ID NO: 465915 - protein, 9 aa, Influenza virus
DPDGCRFYA

SEQ ID NO: 465916 - protein, 9 aa, Influenza virus
DPDHEGEGI

SEQ ID NO: 465917 - protein, 9 aa, Influenza virus
DPDPFRLLQ

SEQ ID NO: 465918 - protein, 9 aa, Influenza virus
DPDYQIGYV

SEQ ID NO: 465919 - protein, 9 aa, Influenza virus
DPFKLLQNS

SEQ ID NO: 465920 - protein, 9 aa, Influenza virus
DPFKLLQTS

SEQ ID NO: 465921 - protein, 9 aa, Influenza virus
DPFRLLQNS

SEQ ID NO: 465922 - protein, 9 aa, Influenza virus
DPFRLLQSS

SEQ ID NO: 465923 - protein, 9 aa, Influenza virus
DPGAPHGLC

SEQ ID NO: 465924 - protein, 9 aa, Influenza virus
DPGDTVTFT

SEQ ID NO: 465925 - protein, 9 aa, Influenza virus
DPGVKGFAF

SEQ ID NO: 465926 - protein, 9 aa, Influenza virus
DPHLTGTWD

SEQ ID NO: 465927 - protein, 9 aa, Influenza virus
DPICIGYHA

SEQ ID NO: 465928 - protein, 9 aa, Influenza virus
DPIGCKMYA

SEQ ID NO: 465929 - protein, 9 aa, Influenza virus
DPKGLFGAI

SEQ ID NO: 465930 - protein, 9 aa, Influenza virus
DPKKTGGPI

SEQ ID NO: 465931 - protein, 9 aa, Influenza virus
DPLASLLEM

SEQ ID NO: 465932 - protein, 9 aa, Influenza virus
DPLGCKMYA

SEQ ID NO: 465933 - protein, 9 aa, Influenza virus
DPLGCRMYA

SEQ ID NO: 465934 - protein, 9 aa, Influenza virus
DPLLSLLEM

SEQ ID NO: 465935 - protein, 9 aa, Influenza virus
DPNALLKHR

SEQ ID NO: 465936 - protein, 9 aa, Influenza virus
DPNAPHKLC

SEQ ID NO: 465937 - protein, 9 aa, Influenza virus
DPNAPNKFC

SEQ ID NO: 465938 - protein, 9 aa, Influenza virus
DPNAPNKLC

SEQ ID NO: 465939 - protein, 9 aa, Influenza virus
DPNDERGNP

SEQ ID NO: 465940 - protein, 9 aa, Influenza virus
DPNECRFYA

SEQ ID NO: 465941 - protein, 9 aa, Influenza virus
DPNEERGNP

SEQ ID NO: 465942 - protein, 9 aa, Influenza virus
DPNEERGSP

SEQ ID NO: 465943 - protein, 9 aa, Influenza virus
DPNHEGEGI

SEQ ID NO: 465944 - protein, 9 aa, Influenza virus
DPNNEKGNP

SEQ ID NO: 465945 - protein, 9 aa, Influenza virus
DPNNERGNP

SEQ ID NO: 465946 - protein, 9 aa, Influenza virus
DPNNMDKAV

SEQ ID NO: 465947 - protein, 9 aa, Influenza virus
DPNNMDRAV

SEQ ID NO: 465948 - protein, 9 aa, Influenza virus
DPNTLLKHR

SEQ ID NO: 465949 - protein, 9 aa, Influenza virus
DPNVLLKHR

SEQ ID NO: 465950 - protein, 9 aa, Influenza virus
DPNWSGYSG

SEQ ID NO: 465951 - protein, 9 aa, Influenza virus
DPPYSHGTG

SEQ ID NO: 465952 - protein, 9 aa, Influenza virus
DPRMCSLMQ

SEQ ID NO: 465953 - protein, 9 aa, Influenza virus
DPSAPHGLC

SEQ ID NO: 465954 - protein, 9 aa, Influenza virus
DPSAPHRLC

SEQ ID NO: 465955 - protein, 9 aa, Influenza virus
DPSGCKMYA

SEQ ID NO: 465956 - protein, 9 aa, Influenza virus
DPSGYAQTD

SEQ ID NO: 465957 - protein, 9 aa, Influenza virus
DPSHEGEGI

SEQ ID NO: 465958 - protein, 9 aa, Influenza virus
DPSIMSCDS

SEQ ID NO: 465959 - protein, 9 aa, Influenza virus
DPSNMDRAV

SEQ ID NO: 465960 - protein, 9 aa, Influenza virus
DPSTISCDS

SEQ ID NO: 465961 - protein, 9 aa, Influenza virus
DPSTMSCDS

SEQ ID NO: 465962 - protein, 9 aa, Influenza virus
DPSTVSCDS

SEQ ID NO: 465963 - protein, 9 aa, Influenza virus
DPSVVSCDS

SEQ ID NO: 465964 - protein, 9 aa, Influenza virus
DPTAPHGLC

SEQ ID NO: 465965 - protein, 9 aa, Influenza virus
DPTGCKMYA

SEQ ID NO: 465966 - protein, 9 aa, Influenza virus
DPVELSSGY

SEQ ID NO: 465967 - protein, 9 aa, Influenza virus
DPVKLSGGY

SEQ ID NO: 465968 - protein, 9 aa, Influenza virus
DPVKLSNGY

SEQ ID NO: 465969 - protein, 9 aa, Influenza virus
DPVKLSSGY

SEQ ID NO: 465970 - protein, 9 aa, Influenza virus
DPWVLLNAS

SEQ ID NO: 465971 - protein, 9 aa, Influenza virus
DPYLNGREW

SEQ ID NO: 465972 - protein, 9 aa, Influenza virus
DPYPGNNBN

SEQ ID NO: 465973 - protein, 9 aa, Influenza virus
DPYPGNNNG

SEQ ID NO: 465974 - protein, 9 aa, Influenza virus
DPYPGNNNN

SEQ ID NO: 465975 - protein, 9 aa, Influenza virus
DPYPGSNNN

SEQ ID NO: 465976 - protein, 9 aa, Influenza virus
DQADSEMNK

SEQ ID NO: 465977 - protein, 9 aa, Influenza virus
DQAWSYIVE

SEQ ID NO: 465978 - protein, 9 aa, Influenza virus
DQCMESIRN

SEQ ID NO: 465979 - protein, 9 aa, Influenza virus
DQDWSYIVE

SEQ ID NO: 465980 - protein, 9 aa, Influenza virus
DQELGDAPF

SEQ ID NO: 465981 - protein, 9 aa, Influenza virus
DQGAGYAAD

SEQ ID NO: 465982 - protein, 9 aa, Influenza virus
DQGNGCFEI

SEQ ID NO: 465983 - protein, 9 aa, Influenza virus
DQGSGYAAD

SEQ ID NO: 465984 - protein, 9 aa, Influenza virus
DQGTGQAAD

SEQ ID NO: 465985 - protein, 9 aa, Influenza virus
DQGWSYIVE

SEQ ID NO: 465986 - protein, 9 aa, Influenza virus
DQICIGHHA

SEQ ID NO: 465987 - protein, 9 aa, Influenza virus
DQICIGYHA

SEQ ID NO: 465988 - protein, 9 aa, Influenza virus
DQICIGYHS

SEQ ID NO: 465989 - protein, 9 aa, Influenza virus
DQICVGYHA

SEQ ID NO: 465990 - protein, 9 aa, Influenza virus
DQICVGYHS

SEQ ID NO: 465991 - protein, 9 aa, Influenza virus
DQIEDLWAY

SEQ ID NO: 465992 - protein, 9 aa, Influenza virus
DQIEELWAY

SEQ ID NO: 465993 - protein, 9 aa, Influenza virus
DQIEGLWAY

SEQ ID NO: 465994 - protein, 9 aa, Influenza virus
DQIENLWAY

SEQ ID NO: 465995 - protein, 9 aa, Influenza virus
DQIEVTNAT

SEQ ID NO: 465996 - protein, 9 aa, Influenza virus
DQIIDIWAY

SEQ ID NO: 465997 - protein, 9 aa, Influenza virus
DQINGKLNR

SEQ ID NO: 465998 - protein, 9 aa, Influenza virus
DQIQDIWAY

SEQ ID NO: 465999 - protein, 9 aa, Influenza virus
DQIQDLWAY

SEQ ID NO: 466000 - protein, 9 aa, Influenza virus
DQIQDVWAY

SEQ ID NO: 466001 - protein, 9 aa, Influenza virus
DQIQNIWAY

SEQ ID NO: 466002 - protein, 9 aa, Influenza virus
DQISGKLNR

SEQ ID NO: 466003 - protein, 9 aa, Influenza virus
DQISIVPNI

SEQ ID NO: 466004 - protein, 9 aa, Influenza virus
DQITDIWAY

SEQ ID NO: 466005 - protein, 9 aa, Influenza virus
DQITGKLNH

SEQ ID NO: 466006 - protein, 9 aa, Influenza virus
DQITGKLNR

SEQ ID NO: 466007 - protein, 9 aa, Influenza virus
DQITGTLNR

SEQ ID NO: 466008 - protein, 9 aa, Influenza virus
DQITTKINN

SEQ ID NO: 466009 - protein, 9 aa, Influenza virus
DQKSLRGRG

SEQ ID NO: 466010 - protein, 9 aa, Influenza virus
DQKSTQEAI

SEQ ID NO: 466011 - protein, 9 aa, Influenza virus
DQLKLATGL

SEQ ID NO: 466012 - protein, 9 aa, Influenza virus
DQNFRNIRK

SEQ ID NO: 466013 - protein, 9 aa, Influenza virus
DQSLIIAAR

SEQ ID NO: 466014 - protein, 9 aa, Influenza virus
DQSLPPNFP

SEQ ID NO: 466015 - protein, 9 aa, Influenza virus
DQSLPPNFS

SEQ ID NO: 466016 - protein, 9 aa, Influenza virus
DQSLVIAAR

SEQ ID NO: 466017 - protein, 9 aa, Influenza virus
DQSWSYIVE

SEQ ID NO: 466018 - protein, 9 aa, Influenza virus
DQVEVTNAT

SEQ ID NO: 466019 - protein, 9 aa, Influenza virus
DQVKLSSGY

SEQ ID NO: 466020 - protein, 9 aa, Influenza virus
DQVREGRNP

SEQ ID NO: 466021 - protein, 9 aa, Influenza virus
DQVRESRNP

SEQ ID NO: 466022 - protein, 9 aa, Influenza virus
DQVTDIWAY

SEQ ID NO: 466023 - protein, 9 aa, Influenza virus
DQVTGKLNR

SEQ ID NO: 466024 - protein, 9 aa, Influenza virus
DRAAFRGLI

SEQ ID NO: 466025 - protein, 9 aa, Influenza virus
DRAPYRSLI

SEQ ID NO: 466026 - protein, 9 aa, Influenza virus
DRATFLRSN

SEQ ID NO: 466027 - protein, 9 aa, Influenza virus
DRAVKLYKK

SEQ ID NO: 466028 - protein, 9 aa, Influenza virus
DRAVKLYRK

SEQ ID NO: 466029 - protein, 9 aa, Influenza virus
DRDSTQKAI

SEQ ID NO: 466030 - protein, 9 aa, Influenza virus
DRDSTQMAI

SEQ ID NO: 466031 - protein, 9 aa, Influenza virus
DRDSTQRAI

SEQ ID NO: 466032 - protein, 9 aa, Influenza virus
DRFLRVKDQ

SEQ ID NO: 466033 - protein, 9 aa, Influenza virus
DRFLRVRDQ

SEQ ID NO: 466034 - protein, 9 aa, Influenza virus
DRFYRICKL

SEQ ID NO: 466035 - protein, 9 aa, Influenza virus
DRFYRTCKL

SEQ ID NO: 466036 - protein, 9 aa, Influenza virus
DRGLFGAIA

SEQ ID NO: 466037 - protein, 9 aa, Influenza virus
DRGLFGAKA

SEQ ID NO: 466038 - protein, 9 aa, Influenza virus
DRGNGCFEI

SEQ ID NO: 466039 - protein, 9 aa, Influenza virus
DRGSTQKAI

SEQ ID NO: 466040 - protein, 9 aa, Influenza virus
DRHSNGTIK

SEQ ID NO: 466041 - protein, 9 aa, Influenza virus
DRHSNGTVK

SEQ ID NO: 466042 - protein, 9 aa, Influenza virus
DRICIGYHA

SEQ ID NO: 466043 - protein, 9 aa, Influenza virus
DRICIGYLS

SEQ ID NO: 466044 - protein, 9 aa, Influenza virus
DRICIGYQS

SEQ ID NO: 466045 - protein, 9 aa, Influenza virus
DRICLGHHA

SEQ ID NO: 466046 - protein, 9 aa, Influenza virus
DRICVGYHA

SEQ ID NO: 466047 - protein, 9 aa, Influenza virus
DRICVGYLS

SEQ ID NO: 466048 - protein, 9 aa, Influenza virus
DRIDDAVTD

SEQ ID NO: 466049 - protein, 9 aa, Influenza virus
DRIEVTNAT

SEQ ID NO: 466050 - protein, 9 aa, Influenza virus
DRIPHRTLL

SEQ ID NO: 466051 - protein, 9 aa, Influenza virus
DRIQDIWAY

SEQ ID NO: 466052 - protein, 9 aa, Influenza virus
DRIRRDQKS

SEQ ID NO: 466053 - protein, 9 aa, Influenza virus
DRISHRTLL

SEQ ID NO: 466054 - protein, 9 aa, Influenza virus
DRITTKINN

SEQ ID NO: 466055 - protein, 9 aa, Influenza virus
DRLQDTTWD

SEQ ID NO: 466056 - protein, 9 aa, Influenza virus
DRLRRDQKA

SEQ ID NO: 466057 - protein, 9 aa, Influenza virus
DRLRRDQKS

SEQ ID NO: 466058 - protein, 9 aa, Influenza virus
DRLRRDQRA

SEQ ID NO: 466059 - protein, 9 aa, Influenza virus
DRLRRDQRS

SEQ ID NO: 466060 - protein, 9 aa, Influenza virus
DRLTQGRQT

SEQ ID NO: 466061 - protein, 9 aa, Influenza virus
DRLVLATGL

SEQ ID NO: 466062 - protein, 9 aa, Influenza virus
DRMIKAVRG

SEQ ID NO: 466063 - protein, 9 aa, Influenza virus
DRNAIGDCP

SEQ ID NO: 466064 - protein, 9 aa, Influenza virus
DRNALGDCP

SEQ ID NO: 466065 - protein, 9 aa, Influenza virus
DRNATASFI

SEQ ID NO: 466066 - protein, 9 aa, Influenza virus
DRNATASLI

SEQ ID NO: 466067 - protein, 9 aa, Influenza virus
DRNFWRGDN

SEQ ID NO: 466068 - protein, 9 aa, Influenza virus
DRNFWRGEN

SEQ ID NO: 466069 - protein, 9 aa, Influenza virus
DRPKVNGQA

SEQ ID NO: 466070 - protein, 9 aa, Influenza virus
DRPLVNGQR

SEQ ID NO: 466071 - protein, 9 aa, Influenza virus
DRRLTTTIK

SEQ ID NO: 466072 - protein, 9 aa, Influenza virus
DRRYGPALS

SEQ ID NO: 466073 - protein, 9 aa, Influenza virus
DRSFRPNIG

SEQ ID NO: 466074 - protein, 9 aa, Influenza virus
DRSPFRALI

SEQ ID NO: 466075 - protein, 9 aa, Influenza virus
DRSPFRALM

SEQ ID NO: 466076 - protein, 9 aa, Influenza virus
DRSPFRALV

SEQ ID NO: 466077 - protein, 9 aa, Influenza virus
DRSPFRTLM

SEQ ID NO: 466078 - protein, 9 aa, Influenza virus
DRSPHRALM

SEQ ID NO: 466079 - protein, 9 aa, Influenza virus
DRSPHRTLL

SEQ ID NO: 466080 - protein, 9 aa, Influenza virus
DRSPHRTLM

SEQ ID NO: 466081 - protein, 9 aa, Influenza virus
DRSPQRTLM

SEQ ID NO: 466082 - protein, 9 aa, Influenza virus
DRSPYRALI

SEQ ID NO: 466083 - protein, 9 aa, Influenza virus
DRSPYRALM

SEQ ID NO: 466084 - protein, 9 aa, Influenza virus
DRSPYRTLL

SEQ ID NO: 466085 - protein, 9 aa, Influenza virus
DRSPYRTLM

SEQ ID NO: 466086 - protein, 9 aa, Influenza virus
DRSQFRALI

SEQ ID NO: 466087 - protein, 9 aa, Influenza virus
DRSQYRALI

SEQ ID NO: 466088 - protein, 9 aa, Influenza virus
DRSQYRALV

SEQ ID NO: 466089 - protein, 9 aa, Influenza virus
DRSQYRSLI

SEQ ID NO: 466090 - protein, 9 aa, Influenza virus
DRTAFRGLI

SEQ ID NO: 466091 - protein, 9 aa, Influenza virus
DRTAFRGLM

SEQ ID NO: 466092 - protein, 9 aa, Influenza virus
DRTLDLHDA

SEQ ID NO: 466093 - protein, 9 aa, Influenza virus
DRTNHQFEL

SEQ ID NO: 466094 - protein, 9 aa, Influenza virus
DRTPHRTLL

SEQ ID NO: 466095 - protein, 9 aa, Influenza virus
DRTPYRSLI

SEQ ID NO: 466096 - protein, 9 aa, Influenza virus
DRTPYRTLL

SEQ ID NO: 466097 - protein, 9 aa, Influenza virus
DRTSHRTLL

SEQ ID NO: 466098 - protein, 9 aa, Influenza virus
DRTSYRSLI

SEQ ID NO: 466099 - protein, 9 aa, Influenza virus
DRTSYRTLL

SEQ ID NO: 466100 - protein, 9 aa, Influenza virus
DRTTFRGLI

SEQ ID NO: 466101 - protein, 9 aa, Influenza virus
DRTTFRGLL

SEQ ID NO: 466102 - protein, 9 aa, Influenza virus
DRVDDAVTD

SEQ ID NO: 466103 - protein, 9 aa, Influenza virus
DRVRKQLRQ

SEQ ID NO: 466104 - protein, 9 aa, Influenza virus
DRVRLQLRD

SEQ ID NO: 466105 - protein, 9 aa, Influenza virus
DRVRMQLRD

SEQ ID NO: 466106 - protein, 9 aa, Influenza virus
DRVWWTSNS

SEQ ID NO: 466107 - protein, 9 aa, Influenza virus
DSCMDTIRN

SEQ ID NO: 466108 - protein, 9 aa, Influenza virus
DSCMEAIRN

SEQ ID NO: 466109 - protein, 9 aa, Influenza virus
DSCMESIRN

SEQ ID NO: 466110 - protein, 9 aa, Influenza virus
DSCMETIRN

SEQ ID NO: 466111 - protein, 9 aa, Influenza virus
DSDILVTRE

SEQ ID NO: 466112 - protein, 9 aa, Influenza virus
DSDVLVTRE

SEQ ID NO: 466113 - protein, 9 aa, Influenza virus
DSECVSHNG

SEQ ID NO: 466114 - protein, 9 aa, Influenza virus
DSEIKKLYE

SEQ ID NO: 466115 - protein, 9 aa, Influenza virus
DSEMDKLFE

SEQ ID NO: 466116 - protein, 9 aa, Influenza virus
DSEMDKLYE

SEQ ID NO: 466117 - protein, 9 aa, Influenza virus
DSEMKKLYE

SEQ ID NO: 466118 - protein, 9 aa, Influenza virus
DSEMLNLYD

SEQ ID NO: 466119 - protein, 9 aa, Influenza virus
DSEMLNLYE

SEQ ID NO: 466120 - protein, 9 aa, Influenza virus
DSEMNKLFE

SEQ ID NO: 466121 - protein, 9 aa, Influenza virus
DSEMNKLYE

SEQ ID NO: 466122 - protein, 9 aa, Influenza virus
DSEMNNLYE

SEQ ID NO: 466123 - protein, 9 aa, Influenza virus
DSEMNRLFE

SEQ ID NO: 466124 - protein, 9 aa, Influenza virus
DSEMSKLFE

SEQ ID NO: 466125 - protein, 9 aa, Influenza virus
DSEMSKLYE

SEQ ID NO: 466126 - protein, 9 aa, Influenza virus
DSFRQSERG

SEQ ID NO: 466127 - protein, 9 aa, Influenza virus
DSFYAELKW

SEQ ID NO: 466128 - protein, 9 aa, Influenza virus
DSFYRNLIW

SEQ ID NO: 466129 - protein, 9 aa, Influenza virus
DSFYRSMKW

SEQ ID NO: 466130 - protein, 9 aa, Influenza virus
DSGAVAVLK

SEQ ID NO: 466131 - protein, 9 aa, Influenza virus
DSGYVCSGL

SEQ ID NO: 466132 - protein, 9 aa, Influenza virus
DSHHRSHRQ

SEQ ID NO: 466133 - protein, 9 aa, Influenza virus
DSHLKFKAD

SEQ ID NO: 466134 - protein, 9 aa, Influenza virus
DSIGSWSHN

SEQ ID NO: 466135 - protein, 9 aa, Influenza virus
DSIGSWSQN

SEQ ID NO: 466136 - protein, 9 aa, Influenza virus
DSIIFNSIG

SEQ ID NO: 466137 - protein, 9 aa, Influenza virus
DSIKSWRKD

SEQ ID NO: 466138 - protein, 9 aa, Influenza virus
DSIKSWRRD

SEQ ID NO: 466139 - protein, 9 aa, Influenza virus
DSIRGEFNQ

SEQ ID NO: 466140 - protein, 9 aa, Influenza virus
DSIRGEFSQ

SEQ ID NO: 466141 - protein, 9 aa, Influenza virus
DSITDIWTY

SEQ ID NO: 466142 - protein, 9 aa, Influenza virus
DSITEVWSY

SEQ ID NO: 466143 - protein, 9 aa, Influenza virus
DSITFSHNG

SEQ ID NO: 466144 - protein, 9 aa, Influenza virus
DSIVSWSQN

SEQ ID NO: 466145 - protein, 9 aa, Influenza virus
DSLEPGTFD

SEQ ID NO: 466146 - protein, 9 aa, Influenza virus
DSLKLSIED

SEQ ID NO: 466147 - protein, 9 aa, Influenza virus
DSLNITAAS

SEQ ID NO: 466148 - protein, 9 aa, Influenza virus
DSLTEIWSY

SEQ ID NO: 466149 - protein, 9 aa, Influenza virus
DSMTEIWSY

SEQ ID NO: 466150 - protein, 9 aa, Influenza virus
DSMTEVMVV

SEQ ID NO: 466151 - protein, 9 aa, Influenza virus
DSMTEVWSY

SEQ ID NO: 466152 - protein, 9 aa, Influenza virus
DSNALLKHR

SEQ ID NO: 466153 - protein, 9 aa, Influenza virus
DSNGNFIAP

SEQ ID NO: 466154 - protein, 9 aa, Influenza virus
DSNGVQDII

SEQ ID NO: 466155 - protein, 9 aa, Influenza virus
DSNVENLFD

SEQ ID NO: 466156 - protein, 9 aa, Influenza virus
DSNVKNLFD

SEQ ID NO: 466157 - protein, 9 aa, Influenza virus
DSNVKNLYD

SEQ ID NO: 466158 - protein, 9 aa, Influenza virus
DSNVKNLYE

SEQ ID NO: 466159 - protein, 9 aa, Influenza virus
DSNVKNLYN

SEQ ID NO: 466160 - protein, 9 aa, Influenza virus
DSNVKSLYD

SEQ ID NO: 466161 - protein, 9 aa, Influenza virus
DSNVRNLHE

SEQ ID NO: 466162 - protein, 9 aa, Influenza virus
DSNVRNLYD

SEQ ID NO: 466163 - protein, 9 aa, Influenza virus
DSNVRSLHE

SEQ ID NO: 466164 - protein, 9 aa, Influenza virus
DSNVTNLHE

SEQ ID NO: 466165 - protein, 9 aa, Influenza virus
DSNYVCSGL

SEQ ID NO: 466166 - protein, 9 aa, Influenza virus
DSPSNANGG

SEQ ID NO: 466167 - protein, 9 aa, Influenza virus
DSPSNINGE

SEQ ID NO: 466168 - protein, 9 aa, Influenza virus
DSPSNINGG

SEQ ID NO: 466169 - protein, 9 aa, Influenza virus
DSPSNVKGG

SEQ ID NO: 466170 - protein, 9 aa, Influenza virus
DSPSNVNGG

SEQ ID NO: 466171 - protein, 9 aa, Influenza virus
DSQHKSHRQ

SEQ ID NO: 466172 - protein, 9 aa, Influenza virus
DSQHRSHRQ

SEQ ID NO: 466173 - protein, 9 aa, Influenza virus
DSQTATKRI

SEQ ID NO: 466174 - protein, 9 aa, Influenza virus
DSQTATKRL

SEQ ID NO: 466175 - protein, 9 aa, Influenza virus
DSRAVGKCP

SEQ ID NO: 466176 - protein, 9 aa, Influenza virus
DSRSGYEIL

SEQ ID NO: 466177 - protein, 9 aa, Influenza virus
DSRSGYEML

SEQ ID NO: 466178 - protein, 9 aa, Influenza virus
DSRSGYETF

SEQ ID NO: 466179 - protein, 9 aa, Influenza virus
DSRSGYEVL

SEQ ID NO: 466180 - protein, 9 aa, Influenza virus
DSSFYAEMK

SEQ ID NO: 466181 - protein, 9 aa, Influenza virus
DSSILTDSQ

SEQ ID NO: 466182 - protein, 9 aa, Influenza virus
DSSYICSGL

SEQ ID NO: 466183 - protein, 9 aa, Influenza virus
DSSYLCSGL

SEQ ID NO: 466184 - protein, 9 aa, Influenza virus
DSSYVCSGL

SEQ ID NO: 466185 - protein, 9 aa, Influenza virus
DSTAVAVIK

SEQ ID NO: 466186 - protein, 9 aa, Influenza virus
DSTDSEMNK

SEQ ID NO: 466187 - protein, 9 aa, Influenza virus
DSTQKAIDI

SEQ ID NO: 466188 - protein, 9 aa, Influenza virus
DSTQKAIDN

SEQ ID NO: 466189 - protein, 9 aa, Influenza virus
DSTQMAIDN

SEQ ID NO: 466190 - protein, 9 aa, Influenza virus
DSTQRAIDN

SEQ ID NO: 466191 - protein, 9 aa, Influenza virus
DSTWLGRTI

SEQ ID NO: 466192 - protein, 9 aa, Influenza virus
DSVGSWSQN

SEQ ID NO: 466193 - protein, 9 aa, Influenza virus
DSVKLSSGY

SEQ ID NO: 466194 - protein, 9 aa, Influenza virus
DSVTELWSY

SEQ ID NO: 466195 - protein, 9 aa, Influenza virus
DSVYKALSI

SEQ ID NO: 466196 - protein, 9 aa, Influenza virus
DSWAVGRCP

SEQ ID NO: 466197 - protein, 9 aa, Influenza virus
DTCYPFDVP

SEQ ID NO: 466198 - protein, 9 aa, Influenza virus
DTDVVNFLS

SEQ ID NO: 466199 - protein, 9 aa, Influenza virus
DTDVVNFVS

SEQ ID NO: 466200 - protein, 9 aa, Influenza virus
DTDVVNYVS

SEQ ID NO: 466201 - protein, 9 aa, Influenza virus
DTDVYCICR

SEQ ID NO: 466202 - protein, 9 aa, Influenza virus
DTEISFTIT

SEQ ID NO: 466203 - protein, 9 aa, Influenza virus
DTELSFTIT

SEQ ID NO: 466204 - protein, 9 aa, Influenza virus
DTELSFTVT

SEQ ID NO: 466205 - protein, 9 aa, Influenza virus
DTFKSWKGN

SEQ ID NO: 466206 - protein, 9 aa, Influenza virus
DTGDGCFEI

SEQ ID NO: 466207 - protein, 9 aa, Influenza virus
DTGKGCFDI

SEQ ID NO: 466208 - protein, 9 aa, Influenza virus
DTGNGCFDI

SEQ ID NO: 466209 - protein, 9 aa, Influenza virus
DTHIHIFSF

SEQ ID NO: 466210 - protein, 9 aa, Influenza virus
DTICIGYHA

SEQ ID NO: 466211 - protein, 9 aa, Influenza virus
DTICVGYHA

SEQ ID NO: 466212 - protein, 9 aa, Influenza virus
DTIEERFEI

SEQ ID NO: 466213 - protein, 9 aa, Influenza virus
DTIIENNVT

SEQ ID NO: 466214 - protein, 9 aa, Influenza virus
DTIIESNVT

SEQ ID NO: 466215 - protein, 9 aa, Influenza virus
DTIIFEANG

SEQ ID NO: 466216 - protein, 9 aa, Influenza virus
DTIIFEASG

SEQ ID NO: 466217 - protein, 9 aa, Influenza virus
DTIIFEATG

SEQ ID NO: 466218 - protein, 9 aa, Influenza virus
DTILEKNIT

SEQ ID NO: 466219 - protein, 9 aa, Influenza virus
DTILEKNVT

SEQ ID NO: 466220 - protein, 9 aa, Influenza virus
DTILEQNVT

SEQ ID NO: 466221 - protein, 9 aa, Influenza virus
DTILERNVT

SEQ ID NO: 466222 - protein, 9 aa, Influenza virus
DTIMEKNVI

SEQ ID NO: 466223 - protein, 9 aa, Influenza virus
DTIMEKNVT

SEQ ID NO: 466224 - protein, 9 aa, Influenza virus
DTIMEKSVT

SEQ ID NO: 466225 - protein, 9 aa, Influenza virus
DTIMERNVT

SEQ ID NO: 466226 - protein, 9 aa, Influenza virus
DTINFESTG

SEQ ID NO: 466227 - protein, 9 aa, Influenza virus
DTINYYNET

SEQ ID NO: 466228 - protein, 9 aa, Influenza virus
DTIRNGTYN

SEQ ID NO: 466229 - protein, 9 aa, Influenza virus
DTISFESTG

SEQ ID NO: 466230 - protein, 9 aa, Influenza virus
DTITFEATG

SEQ ID NO: 466231 - protein, 9 aa, Influenza virus
DTITFSFNG

SEQ ID NO: 466232 - protein, 9 aa, Influenza virus
DTKCQTPLG

SEQ ID NO: 466233 - protein, 9 aa, Influenza virus
DTKIDLWSY

SEQ ID NO: 466234 - protein, 9 aa, Influenza virus
DTKILFIEE

SEQ ID NO: 466235 - protein, 9 aa, Influenza virus
DTKVDLWSY

SEQ ID NO: 466236 - protein, 9 aa, Influenza virus
DTLCIGYHA

SEQ ID NO: 466237 - protein, 9 aa, Influenza virus
DTLIERDNA

SEQ ID NO: 466238 - protein, 9 aa, Influenza virus
DTLIERDNS

SEQ ID NO: 466239 - protein, 9 aa, Influenza virus
DTLIERENA

SEQ ID NO: 466240 - protein, 9 aa, Influenza virus
DTLIERENS

SEQ ID NO: 466241 - protein, 9 aa, Influenza virus
DTLIERGSS

SEQ ID NO: 466242 - protein, 9 aa, Influenza virus
DTLKSWKGN

SEQ ID NO: 466243 - protein, 9 aa, Influenza virus
DTLLEKNVT

SEQ ID NO: 466244 - protein, 9 aa, Influenza virus
DTLLENDVP

SEQ ID NO: 466245 - protein, 9 aa, Influenza virus
DTLLENGVP

SEQ ID NO: 466246 - protein, 9 aa, Influenza virus
DTLLENNVP

SEQ ID NO: 466247 - protein, 9 aa, Influenza virus
DTLLESDVP

SEQ ID NO: 466248 - protein, 9 aa, Influenza virus
DTLTEKGIE

SEQ ID NO: 466249 - protein, 9 aa, Influenza virus
DTLTENGVP

SEQ ID NO: 466250 - protein, 9 aa, Influenza virus
DTLTETGVP

SEQ ID NO: 466251 - protein, 9 aa, Influenza virus
DTNKTFQNI

SEQ ID NO: 466252 - protein, 9 aa, Influenza virus
DTPRGEDAQ

SEQ ID NO: 466253 - protein, 9 aa, Influenza virus
DTPRGEDGQ

SEQ ID NO: 466254 - protein, 9 aa, Influenza virus
DTPRGEDNQ

SEQ ID NO: 466255 - protein, 9 aa, Influenza virus
DTPRGEDSQ

SEQ ID NO: 466256 - protein, 9 aa, Influenza virus
DTPRNDDRF

SEQ ID NO: 466257 - protein, 9 aa, Influenza virus
DTPRNDDRS

SEQ ID NO: 466258 - protein, 9 aa, Influenza virus
DTPRNDDSS

SEQ ID NO: 466259 - protein, 9 aa, Influenza virus
DTPRNEDGS

SEQ ID NO: 466260 - protein, 9 aa, Influenza virus
DTPRNEDSS

SEQ ID NO: 466261 - protein, 9 aa, Influenza virus
DTPRNGDSS

SEQ ID NO: 466262 - protein, 9 aa, Influenza virus
DTPRPADPS

SEQ ID NO: 466263 - protein, 9 aa, Influenza virus
DTPRPDDPS

SEQ ID NO: 466264 - protein, 9 aa, Influenza virus
DTPRPSDPS

SEQ ID NO: 466265 - protein, 9 aa, Influenza virus
DTPRPTDPS

SEQ ID NO: 466266 - protein, 9 aa, Influenza virus
DTPRPVDPS

SEQ ID NO: 466267 - protein, 9 aa, Influenza virus
DTPRSDDSS

SEQ ID NO: 466268 - protein, 9 aa, Influenza virus
DTRILFIEE

SEQ ID NO: 466269 - protein, 9 aa, Influenza virus
DTRILFIKE

SEQ ID NO: 466270 - protein, 9 aa, Influenza virus
DTRILFIRE

SEQ ID NO: 466271 - protein, 9 aa, Influenza virus
DTRILFVKE

SEQ ID NO: 466272 - protein, 9 aa, Influenza virus
DTRSGYEML

SEQ ID NO: 466273 - protein, 9 aa, Influenza virus
DTTAVAVLK

SEQ ID NO: 466274 - protein, 9 aa, Influenza virus
DTTCWSWPD

SEQ ID NO: 466275 - protein, 9 aa, Influenza virus
DTTGWSWPD

SEQ ID NO: 466276 - protein, 9 aa, Influenza virus
DTTMEKNVT

SEQ ID NO: 466277 - protein, 9 aa, Influenza virus
DTTSWSWPD

SEQ ID NO: 466278 - protein, 9 aa, Influenza virus
DTTWDVFIE

SEQ ID NO: 466279 - protein, 9 aa, Influenza virus
DTTYQRTRA

SEQ ID NO: 466280 - protein, 9 aa, Influenza virus
DTVDTILEK

SEQ ID NO: 466281 - protein, 9 aa, Influenza virus
DTVDTLIEQ

SEQ ID NO: 466282 - protein, 9 aa, Influenza virus
DTVDTLLEK

SEQ ID NO: 466283 - protein, 9 aa, Influenza virus
DTVDTLTEN

SEQ ID NO: 466284 - protein, 9 aa, Influenza virus
DTVDTVLEK

SEQ ID NO: 466285 - protein, 9 aa, Influenza virus
DTVDTVLER

SEQ ID NO: 466286 - protein, 9 aa, Influenza virus
DTVDTVREK

SEQ ID NO: 466287 - protein, 9 aa, Influenza virus
DTVIFSFNG

SEQ ID NO: 466288 - protein, 9 aa, Influenza virus
DTVLEKNVT

SEQ ID NO: 466289 - protein, 9 aa, Influenza virus
DTVLERNVT

SEQ ID NO: 466290 - protein, 9 aa, Influenza virus
DTVNFSFNG

SEQ ID NO: 466291 - protein, 9 aa, Influenza virus
DTVNRTHQY

SEQ ID NO: 466292 - protein, 9 aa, Influenza virus
DTVNTLIEQ

SEQ ID NO: 466293 - protein, 9 aa, Influenza virus
DTVNTLMEQ

SEQ ID NO: 466294 - protein, 9 aa, Influenza virus
DTVNTLTEQ

SEQ ID NO: 466295 - protein, 9 aa, Influenza virus
DTVREKNVT

SEQ ID NO: 466296 - protein, 9 aa, Influenza virus
DTVTFIFNG

SEQ ID NO: 466297 - protein, 9 aa, Influenza virus
DTVTFNFNG

SEQ ID NO: 466298 - protein, 9 aa, Influenza virus
DTVTFSFNG

SEQ ID NO: 466299 - protein, 9 aa, Influenza virus
DTVTFTFNG

SEQ ID NO: 466300 - protein, 9 aa, Influenza virus
DTYDFNEGA

SEQ ID NO: 466301 - protein, 9 aa, Influenza virus
DTYDFNEGS

SEQ ID NO: 466302 - protein, 9 aa, Influenza virus
DTYDFNEGT

SEQ ID NO: 466303 - protein, 9 aa, Influenza virus
DVADSEMNK

SEQ ID NO: 466304 - protein, 9 aa, Influenza virus
DVCYPGKFA

SEQ ID NO: 466305 - protein, 9 aa, Influenza virus
DVCYPGKFS

SEQ ID NO: 466306 - protein, 9 aa, Influenza virus
DVCYPGKFT

SEQ ID NO: 466307 - protein, 9 aa, Influenza virus
DVCYPGKFV

SEQ ID NO: 466308 - protein, 9 aa, Influenza virus
DVDQSLIIA

SEQ ID NO: 466309 - protein, 9 aa, Influenza virus
DVDQSLVIA

SEQ ID NO: 466310 - protein, 9 aa, Influenza virus
DVDVYCICR

SEQ ID NO: 466311 - protein, 9 aa, Influenza virus
DVECVCRDN

SEQ ID NO: 466312 - protein, 9 aa, Influenza virus
DVFAIREPF

SEQ ID NO: 466313 - protein, 9 aa, Influenza virus
DVFIERPTA

SEQ ID NO: 466314 - protein, 9 aa, Influenza virus
DVFIIREPF

SEQ ID NO: 466315 - protein, 9 aa, Influenza virus
DVFVIREPF

SEQ ID NO: 466316 - protein, 9 aa, Influenza virus
DVFVMREPF

SEQ ID NO: 466317 - protein, 9 aa, Influenza virus
DVFVTREPF

SEQ ID NO: 466318 - protein, 9 aa, Influenza virus
DVFVVREPF

SEQ ID NO: 466319 - protein, 9 aa, Influenza virus
DVGYLCAGI

SEQ ID NO: 466320 - protein, 9 aa, Influenza virus
DVIITREPY

SEQ ID NO: 466321 - protein, 9 aa, Influenza virus
DVILWFSFG

SEQ ID NO: 466322 - protein, 9 aa, Influenza virus
DVILWFSLG

SEQ ID NO: 466323 - protein, 9 aa, Influenza virus
DVILWISFS

SEQ ID NO: 466324 - protein, 9 aa, Influenza virus
DVIMEVVFP

SEQ ID NO: 466325 - protein, 9 aa, Influenza virus
DVINFESTG

SEQ ID NO: 466326 - protein, 9 aa, Influenza virus
DVIRSWRKQ

SEQ ID NO: 466327 - protein, 9 aa, Influenza virus
DVISFESTG

SEQ ID NO: 466328 - protein, 9 aa, Influenza virus
DVIVTREPY

SEQ ID NO: 466329 - protein, 9 aa, Influenza virus
DVLDGVTAS

SEQ ID NO: 466330 - protein, 9 aa, Influenza virus
DVLVALENQ

SEQ ID NO: 466331 - protein, 9 aa, Influenza virus
DVLVIWGIH

SEQ ID NO: 466332 - protein, 9 aa, Influenza virus
DVLVLWGIH

SEQ ID NO: 466333 - protein, 9 aa, Influenza virus
DVLVMWGIH

SEQ ID NO: 466334 - protein, 9 aa, Influenza virus
DVLVMWGLH

SEQ ID NO: 466335 - protein, 9 aa, Influenza virus
DVLVTREPY

SEQ ID NO: 466336 - protein, 9 aa, Influenza virus
DVLWTSNSI

SEQ ID NO: 466337 - protein, 9 aa, Influenza virus
DVNPTLLFL

SEQ ID NO: 466338 - protein, 9 aa, Influenza virus
DVPDYQSIR

SEQ ID NO: 466339 - protein, 9 aa, Influenza virus
DVPDYQSLR

SEQ ID NO: 466340 - protein, 9 aa, Influenza virus
DVPEWSYIV

SEQ ID NO: 466341 - protein, 9 aa, Influenza virus
DVPEYQSLR

SEQ ID NO: 466342 - protein, 9 aa, Influenza virus
DVPGYQSLR

SEQ ID NO: 466343 - protein, 9 aa, Influenza virus
DVPNYQSLR

SEQ ID NO: 466344 - protein, 9 aa, Influenza virus
DVRCICKDN

SEQ ID NO: 466345 - protein, 9 aa, Influenza virus
DVRCICRDN

SEQ ID NO: 466346 - protein, 9 aa, Influenza virus
DVRCVCRDN

SEQ ID NO: 466347 - protein, 9 aa, Influenza virus
DVSFQGRGV

SEQ ID NO: 466348 - protein, 9 aa, Influenza virus
DVSWASNSI

SEQ ID NO: 466349 - protein, 9 aa, Influenza virus
DVSWTSNSI

SEQ ID NO: 466350 - protein, 9 aa, Influenza virus
DVTDSEMDK

SEQ ID NO: 466351 - protein, 9 aa, Influenza virus
DVTDSEMNK

SEQ ID NO: 466352 - protein, 9 aa, Influenza virus
DVTDSEMNR

SEQ ID NO: 466353 - protein, 9 aa, Influenza virus
DVVLVMKRK

SEQ ID NO: 466354 - protein, 9 aa, Influenza virus
DVVNFLSME

SEQ ID NO: 466355 - protein, 9 aa, Influenza virus
DVVNFVSME

SEQ ID NO: 466356 - protein, 9 aa, Influenza virus
DVVNYVSME

SEQ ID NO: 466357 - protein, 9 aa, Influenza virus
DVVRSWKKQ

SEQ ID NO: 466358 - protein, 9 aa, Influenza virus
DVVRSWRKK

SEQ ID NO: 466359 - protein, 9 aa, Influenza virus
DVVRSWRKQ

SEQ ID NO: 466360 - protein, 9 aa, Influenza virus
DVVRSWRRQ

SEQ ID NO: 466361 - protein, 9 aa, Influenza virus
DVWAYNAEL

SEQ ID NO: 466362 - protein, 9 aa, Influenza virus
DVWLGRTIS

SEQ ID NO: 466363 - protein, 9 aa, Influenza virus
DVWLGRTMS

SEQ ID NO: 466364 - protein, 9 aa, Influenza virus
DVWLGRTVS

SEQ ID NO: 466365 - protein, 9 aa, Influenza virus
DVWMGRTIG

SEQ ID NO: 466366 - protein, 9 aa, Influenza virus
DVWMGRTIN

SEQ ID NO: 466367 - protein, 9 aa, Influenza virus
DVWMGRTIS

SEQ ID NO: 466368 - protein, 9 aa, Influenza virus
DVWMGRTVS

SEQ ID NO: 466369 - protein, 9 aa, Influenza virus
DVWSYNAKL

SEQ ID NO: 466370 - protein, 9 aa, Influenza virus
DVWTYNAEL

SEQ ID NO: 466371 - protein, 9 aa, Influenza virus
DVWTYNTEL

SEQ ID NO: 466372 - protein, 9 aa, Influenza virus
DVWTYNVEL

SEQ ID NO: 466373 - protein, 9 aa, Influenza virus
DVYCICRDN

SEQ ID NO: 466374 - protein, 9 aa, Influenza virus
DVYCVCRDN

SEQ ID NO: 466375 - protein, 9 aa, Influenza virus
DVYQILAIY

SEQ ID NO: 466376 - protein, 9 aa, Influenza virus
DWILWISFA

SEQ ID NO: 466377 - protein, 9 aa, Influenza virus
DWPDGAKIE

SEQ ID NO: 466378 - protein, 9 aa, Influenza virus
DWSGYSGAF

SEQ ID NO: 466379 - protein, 9 aa, Influenza virus
DWSGYSGSF

SEQ ID NO: 466380 - protein, 9 aa, Influenza virus
DWSKPQCQI

SEQ ID NO: 466381 - protein, 9 aa, Influenza virus
DWSWHDGAI

SEQ ID NO: 466382 - protein, 9 aa, Influenza virus
DWSWHDGAV

SEQ ID NO: 466383 - protein, 9 aa, Influenza virus
DWSWPDGAE

SEQ ID NO: 466384 - protein, 9 aa, Influenza virus
DWSYIVERP

SEQ ID NO: 466385 - protein, 9 aa, Influenza virus
DWTLNRNQP

SEQ ID NO: 466386 - protein, 9 aa, Influenza virus
DWVDDAVTD

SEQ ID NO: 466387 - protein, 9 aa, Influenza virus
DWVLWISFA

SEQ ID NO: 466388 - protein, 9 aa, Influenza virus
DYARLYIWG

SEQ ID NO: 466389 - protein, 9 aa, Influenza virus
DYEEEAKLE

SEQ ID NO: 466390 - protein, 9 aa, Influenza virus
DYEELKEQL

SEQ ID NO: 466391 - protein, 9 aa, Influenza virus
DYEELKHLL

SEQ ID NO: 466392 - protein, 9 aa, Influenza virus
DYEELKHLM

SEQ ID NO: 466393 - protein, 9 aa, Influenza virus
DYEELREQL

SEQ ID NO: 466394 - protein, 9 aa, Influenza virus
DYESTQAAI

SEQ ID NO: 466395 - protein, 9 aa, Influenza virus
DYHDSNVKN

SEQ ID NO: 466396 - protein, 9 aa, Influenza virus
DYHYEECSC

SEQ ID NO: 466397 - protein, 9 aa, Influenza virus
DYILDEESR

SEQ ID NO: 466398 - protein, 9 aa, Influenza virus
DYKEESQLK

SEQ ID NO: 466399 - protein, 9 aa, Influenza virus
DYKSTPSAI

SEQ ID NO: 466400 - protein, 9 aa, Influenza virus
DYKSTQAAI

SEQ ID NO: 466401 - protein, 9 aa, Influenza virus
DYKSTQAAV

SEQ ID NO: 466402 - protein, 9 aa, Influenza virus
DYKSTQKTI

SEQ ID NO: 466403 - protein, 9 aa, Influenza virus
DYKSTQSAI

SEQ ID NO: 466404 - protein, 9 aa, Influenza virus
DYKSTQSAV

SEQ ID NO: 466405 - protein, 9 aa, Influenza virus
DYKSTQTAI

SEQ ID NO: 466406 - protein, 9 aa, Influenza virus
DYLIGKTSW

SEQ ID NO: 466407 - protein, 9 aa, Influenza virus
DYNNTTGRD

SEQ ID NO: 466408 - protein, 9 aa, Influenza virus
DYPKYEEES

SEQ ID NO: 466409 - protein, 9 aa, Influenza virus
DYPKYEKES

SEQ ID NO: 466410 - protein, 9 aa, Influenza virus
DYPKYSEEA

SEQ ID NO: 466411 - protein, 9 aa, Influenza virus
DYPKYSEES

SEQ ID NO: 466412 - protein, 9 aa, Influenza virus
DYPKYSKES

SEQ ID NO: 466413 - protein, 9 aa, Influenza virus
DYQIGYICS

SEQ ID NO: 466414 - protein, 9 aa, Influenza virus
DYQIGYVCS

SEQ ID NO: 466415 - protein, 9 aa, Influenza virus
DYQSIRSIL

SEQ ID NO: 466416 - protein, 9 aa, Influenza virus
DYQSLRSIL

SEQ ID NO: 466417 - protein, 9 aa, Influenza virus
DYREESQLK

SEQ ID NO: 466418 - protein, 9 aa, Influenza virus
DYRYTYRCH

SEQ ID NO: 466419 - protein, 9 aa, Influenza virus
DYSIDSGYV

SEQ ID NO: 466420 - protein, 9 aa, Influenza virus
DYSIDSNYV

SEQ ID NO: 466421 - protein, 9 aa, Influenza virus
DYSIDSSYI

SEQ ID NO: 466422 - protein, 9 aa, Influenza virus
DYSIDSSYV

SEQ ID NO: 466423 - protein, 9 aa, Influenza virus
DYSKYEEES

SEQ ID NO: 466424 - protein, 9 aa, Influenza virus
DYTIDEESR

SEQ ID NO: 466425 - protein, 9 aa, Influenza virus
DYTLDEESR

SEQ ID NO: 466426 - protein, 9 aa, Influenza virus
DYTRLYIWG

SEQ ID NO: 466427 - protein, 9 aa, Influenza virus
DYWAEGDCY

SEQ ID NO: 466428 - protein, 9 aa, Influenza virus
DYWAEGECY

SEQ ID NO: 466429 - protein, 9 aa, Influenza virus
DYWAKEECY

SEQ ID NO: 466430 - protein, 9 aa, Influenza virus
DYWAKGDCY

SEQ ID NO: 466431 - protein, 9 aa, Influenza virus
DYWAKGECY

SEQ ID NO: 466432 - protein, 9 aa, Influenza virus
DYYWAILKP

SEQ ID NO: 466433 - protein, 9 aa, Influenza virus
DYYWAVLKP

SEQ ID NO: 466434 - protein, 9 aa, Influenza virus
DYYWGILKR

SEQ ID NO: 466435 - protein, 9 aa, Influenza virus
EAESSIKEK

SEQ ID NO: 466436 - protein, 9 aa, Influenza virus
EAESSVKEK

SEQ ID NO: 466437 - protein, 9 aa, Influenza virus
EAESSVREK

SEQ ID NO: 466438 - protein, 9 aa, Influenza virus
EAGLKWELM

SEQ ID NO: 466439 - protein, 9 aa, Influenza virus
EAHILVTRE

SEQ ID NO: 466440 - protein, 9 aa, Influenza virus
EAIDKITNK

SEQ ID NO: 466441 - protein, 9 aa, Influenza virus
EAIEECLIN

SEQ ID NO: 466442 - protein, 9 aa, Influenza virus
EAIEKITNK

SEQ ID NO: 466443 - protein, 9 aa, Influenza virus
EAIGKITNK

SEQ ID NO: 466444 - protein, 9 aa, Influenza virus
EAINKITNK

SEQ ID NO: 466445 - protein, 9 aa, Influenza virus
EAINNRFQI

SEQ ID NO: 466446 - protein, 9 aa, Influenza virus
EAINNRIKI

SEQ ID NO: 466447 - protein, 9 aa, Influenza virus
EAINSRFQI

SEQ ID NO: 466448 - protein, 9 aa, Influenza virus
EAIRNGTYN

SEQ ID NO: 466449 - protein, 9 aa, Influenza virus
EAISNRFQI

SEQ ID NO: 466450 - protein, 9 aa, Influenza virus
EAKLEKSRI

SEQ ID NO: 466451 - protein, 9 aa, Influenza virus
EAKLERSKI

SEQ ID NO: 466452 - protein, 9 aa, Influenza virus
EAKYVEWTS

SEQ ID NO: 466453 - protein, 9 aa, Influenza virus
EAKYVWWAS

SEQ ID NO: 466454 - protein, 9 aa, Influenza virus
EAKYVWWTS

SEQ ID NO: 466455 - protein, 9 aa, Influenza virus
EALKGSARH

SEQ ID NO: 466456 - protein, 9 aa, Influenza virus
EALKMTIAS

SEQ ID NO: 466457 - protein, 9 aa, Influenza virus
EALLNRLNI

SEQ ID NO: 466458 - protein, 9 aa, Influenza virus
EALLNRLSI

SEQ ID NO: 466459 - protein, 9 aa, Influenza virus
EALMEWIKT

SEQ ID NO: 466460 - protein, 9 aa, Influenza virus
EALMEWLKT

SEQ ID NO: 466461 - protein, 9 aa, Influenza virus
EALNNRFQI

SEQ ID NO: 466462 - protein, 9 aa, Influenza virus
EALNNRSQI

SEQ ID NO: 466463 - protein, 9 aa, Influenza virus
EALQGSARH

SEQ ID NO: 466464 - protein, 9 aa, Influenza virus
EALQNRIMI

SEQ ID NO: 466465 - protein, 9 aa, Influenza virus
EALRQIIRE

SEQ ID NO: 466466 - protein, 9 aa, Influenza virus
EALRQKIME

SEQ ID NO: 466467 - protein, 9 aa, Influenza virus
EALSNRFQI

SEQ ID NO: 466468 - protein, 9 aa, Influenza virus
EAMAFLEDS

SEQ ID NO: 466469 - protein, 9 aa, Influenza virus
EAMAFLEES

SEQ ID NO: 466470 - protein, 9 aa, Influenza virus
EAMAFLEKS

SEQ ID NO: 466471 - protein, 9 aa, Influenza virus
EAMAFLENS

SEQ ID NO: 466472 - protein, 9 aa, Influenza virus
EAMALLEES

SEQ ID NO: 466473 - protein, 9 aa, Influenza virus
EAMASQGTK

SEQ ID NO: 466474 - protein, 9 aa, Influenza virus
EAMATQGTK

SEQ ID NO: 466475 - protein, 9 aa, Influenza virus
EAMISRARI

SEQ ID NO: 466476 - protein, 9 aa, Influenza virus
EAMMSRARI

SEQ ID NO: 466477 - protein, 9 aa, Influenza virus
EAMQNRIQI

SEQ ID NO: 466478 - protein, 9 aa, Influenza virus
EAMQNRMQI

SEQ ID NO: 466479 - protein, 9 aa, Influenza virus
EAMQNRVKI

SEQ ID NO: 466480 - protein, 9 aa, Influenza virus
EAMVSRARI

SEQ ID NO: 466481 - protein, 9 aa, Influenza virus
EANGNLIAP

SEQ ID NO: 466482 - protein, 9 aa, Influenza virus
EAPGWSWDD

SEQ ID NO: 466483 - protein, 9 aa, Influenza virus
EAPLNRLNI

SEQ ID NO: 466484 - protein, 9 aa, Influenza virus
EAPSPYNSK

SEQ ID NO: 466485 - protein, 9 aa, Influenza virus
EAPSPYNSR

SEQ ID NO: 466486 - protein, 9 aa, Influenza virus
EAQDVIMEV

SEQ ID NO: 466487 - protein, 9 aa, Influenza virus
EARGLFGAI

SEQ ID NO: 466488 - protein, 9 aa, Influenza virus
EARVWWTSN

SEQ ID NO: 466489 - protein, 9 aa, Influenza virus
EATGNLIAP

SEQ ID NO: 466490 - protein, 9 aa, Influenza virus
EATGNLLVP

SEQ ID NO: 466491 - protein, 9 aa, Influenza virus
EATGNLVAP

SEQ ID NO: 466492 - protein, 9 aa, Influenza virus
EATGNLVVP

SEQ ID NO: 466493 - protein, 9 aa, Influenza virus
EAVAVLKYN

SEQ ID NO: 466494 - protein, 9 aa, Influenza virus
EAVAWSATA

SEQ ID NO: 466495 - protein, 9 aa, Influenza virus
EAVEECLIN

SEQ ID NO: 466496 - protein, 9 aa, Influenza virus
EAVIYGNPK

SEQ ID NO: 466497 - protein, 9 aa, Influenza virus
EAVNNRFQI

SEQ ID NO: 466498 - protein, 9 aa, Influenza virus
EAWPIGESP

SEQ ID NO: 466499 - protein, 9 aa, Influenza virus
EAYNFNEGS

SEQ ID NO: 466500 - protein, 9 aa, Influenza virus
ECACINGSC

SEQ ID NO: 466501 - protein, 9 aa, Influenza virus
ECACVNGSC

SEQ ID NO: 466502 - protein, 9 aa, Influenza virus
ECFNPCFYV

SEQ ID NO: 466503 - protein, 9 aa, Influenza virus
ECFNPITGS

SEQ ID NO: 466504 - protein, 9 aa, Influenza virus
ECFWVMTDG

SEQ ID NO: 466505 - protein, 9 aa, Influenza virus
ECFYSGGTI

SEQ ID NO: 466506 - protein, 9 aa, Influenza virus
ECICINGTC

SEQ ID NO: 466507 - protein, 9 aa, Influenza virus
ECICRDNWT

SEQ ID NO: 466508 - protein, 9 aa, Influenza virus
ECIEKIRNG

SEQ ID NO: 466509 - protein, 9 aa, Influenza virus
ECIEKVRNG

SEQ ID NO: 466510 - protein, 9 aa, Influenza virus
ECIERVRNG

SEQ ID NO: 466511 - protein, 9 aa, Influenza virus
ECIESVRNG

SEQ ID NO: 466512 - protein, 9 aa, Influenza virus
ECIGWSSTS

SEQ ID NO: 466513 - protein, 9 aa, Influenza virus
ECITPNGSI

SEQ ID NO: 466514 - protein, 9 aa, Influenza virus
ECKMFALSQ

SEQ ID NO: 466515 - protein, 9 aa, Influenza virus
ECKTFFLTQ

SEQ ID NO: 466516 - protein, 9 aa, Influenza virus
ECLINDPWV

SEQ ID NO: 466517 - protein, 9 aa, Influenza virus
ECLVPCFWV

SEQ ID NO: 466518 - protein, 9 aa, Influenza virus
ECMESVKNG

SEQ ID NO: 466519 - protein, 9 aa, Influenza virus
ECMESVRNG

SEQ ID NO: 466520 - protein, 9 aa, Influenza virus
ECMETIKNG

SEQ ID NO: 466521 - protein, 9 aa, Influenza virus
ECMIKAVRG

SEQ ID NO: 466522 - protein, 9 aa, Influenza virus
ECPKYIKSD

SEQ ID NO: 466523 - protein, 9 aa, Influenza virus
ECPKYVKQG

SEQ ID NO: 466524 - protein, 9 aa, Influenza virus
ECPKYVKSD

SEQ ID NO: 466525 - protein, 9 aa, Influenza virus
ECPKYVKSE

SEQ ID NO: 466526 - protein, 9 aa, Influenza virus
ECPKYVKSN

SEQ ID NO: 466527 - protein, 9 aa, Influenza virus
ECPKYVKSS

SEQ ID NO: 466528 - protein, 9 aa, Influenza virus
ECPKYVKST

SEQ ID NO: 466529 - protein, 9 aa, Influenza virus
ECPKYVRSA

SEQ ID NO: 466530 - protein, 9 aa, Influenza virus
ECPKYVRSE

SEQ ID NO: 466531 - protein, 9 aa, Influenza virus
ECPKYVRST

SEQ ID NO: 466532 - protein, 9 aa, Influenza virus
ECPRYVKSE

SEQ ID NO: 466533 - protein, 9 aa, Influenza virus
ECQLNEGIM

SEQ ID NO: 466534 - protein, 9 aa, Influenza virus
ECQLNEGVI

SEQ ID NO: 466535 - protein, 9 aa, Influenza virus
ECQLNEGVM

SEQ ID NO: 466536 - protein, 9 aa, Influenza virus
ECRFYALSQ

SEQ ID NO: 466537 - protein, 9 aa, Influenza virus
ECRMFALSQ

SEQ ID NO: 466538 - protein, 9 aa, Influenza virus
ECRTFFLTH

SEQ ID NO: 466539 - protein, 9 aa, Influenza virus
ECRTFFLTQ

SEQ ID NO: 466540 - protein, 9 aa, Influenza virus
ECSCYGHDS

SEQ ID NO: 466541 - protein, 9 aa, Influenza virus
ECSCYGHNQ

SEQ ID NO: 466542 - protein, 9 aa, Influenza virus
ECSCYGHNS

SEQ ID NO: 466543 - protein, 9 aa, Influenza virus
ECSCYGHSQ

SEQ ID NO: 466544 - protein, 9 aa, Influenza virus
ECSCYMDID

SEQ ID NO: 466545 - protein, 9 aa, Influenza virus
ECSCYPDAG

SEQ ID NO: 466546 - protein, 9 aa, Influenza virus
ECSCYPDAS

SEQ ID NO: 466547 - protein, 9 aa, Influenza virus
ECSCYPDSG

SEQ ID NO: 466548 - protein, 9 aa, Influenza virus
ECSCYPNAG

SEQ ID NO: 466549 - protein, 9 aa, Influenza virus
ECSCYPNDG

SEQ ID NO: 466550 - protein, 9 aa, Influenza virus
ECSCYPNEG

SEQ ID NO: 466551 - protein, 9 aa, Influenza virus
ECSCYPNLG

SEQ ID NO: 466552 - protein, 9 aa, Influenza virus
ECSCYPNMG

SEQ ID NO: 466553 - protein, 9 aa, Influenza virus
ECSCYPNSG

SEQ ID NO: 466554 - protein, 9 aa, Influenza virus
ECSCYPQYP

SEQ ID NO: 466555 - protein, 9 aa, Influenza virus
ECSCYPRFP

SEQ ID NO: 466556 - protein, 9 aa, Influenza virus
ECSCYPRSP

SEQ ID NO: 466557 - protein, 9 aa, Influenza virus
ECSCYPRYP

SEQ ID NO: 466558 - protein, 9 aa, Influenza virus
ECSCYPRYS

SEQ ID NO: 466559 - protein, 9 aa, Influenza virus
ECSCYPSGE

SEQ ID NO: 466560 - protein, 9 aa, Influenza virus
ECSCYPSGT

SEQ ID NO: 466561 - protein, 9 aa, Influenza virus
ECSCYVDID

SEQ ID NO: 466562 - protein, 9 aa, Influenza virus
ECSCYVDTD

SEQ ID NO: 466563 - protein, 9 aa, Influenza virus
ECSCYVDVD

SEQ ID NO: 466564 - protein, 9 aa, Influenza virus
ECVCHDGTC

SEQ ID NO: 466565 - protein, 9 aa, Influenza virus
ECVCHDGVC

SEQ ID NO: 466566 - protein, 9 aa, Influenza virus
ECVCHKGIC

SEQ ID NO: 466567 - protein, 9 aa, Influenza virus
ECVCHKGVC

SEQ ID NO: 466568 - protein, 9 aa, Influenza virus
ECVCHNGIC

SEQ ID NO: 466569 - protein, 9 aa, Influenza virus
ECVCHNGTC

SEQ ID NO: 466570 - protein, 9 aa, Influenza virus
ECVCHNGVC

SEQ ID NO: 466571 - protein, 9 aa, Influenza virus
ECVCHNSTC

SEQ ID NO: 466572 - protein, 9 aa, Influenza virus
ECVCHSGIC

SEQ ID NO: 466573 - protein, 9 aa, Influenza virus
ECVCINGIC

SEQ ID NO: 466574 - protein, 9 aa, Influenza virus
ECVCINGSC

SEQ ID NO: 466575 - protein, 9 aa, Influenza virus
ECVCINGTC

SEQ ID NO: 466576 - protein, 9 aa, Influenza virus
ECVCISGTC

SEQ ID NO: 466577 - protein, 9 aa, Influenza virus
ECVCMNGSC

SEQ ID NO: 466578 - protein, 9 aa, Influenza virus
ECVCQDEFC

SEQ ID NO: 466579 - protein, 9 aa, Influenza virus
ECVCRDNWN

SEQ ID NO: 466580 - protein, 9 aa, Influenza virus
ECVCRDNWR

SEQ ID NO: 466581 - protein, 9 aa, Influenza virus
ECVCRDNWT

SEQ ID NO: 466582 - protein, 9 aa, Influenza virus
ECVCVNGSC

SEQ ID NO: 466583 - protein, 9 aa, Influenza virus
ECVGWSSTS

SEQ ID NO: 466584 - protein, 9 aa, Influenza virus
ECVRHNGTC

SEQ ID NO: 466585 - protein, 9 aa, Influenza virus
ECVSHNGTW

SEQ ID NO: 466586 - protein, 9 aa, Influenza virus
ECYNPCFYV

SEQ ID NO: 466587 - protein, 9 aa, Influenza virus
ECYRACFYV

SEQ ID NO: 466588 - protein, 9 aa, Influenza virus
ECYWVMTDG

SEQ ID NO: 466589 - protein, 9 aa, Influenza virus
EDCMIKAVR

SEQ ID NO: 466590 - protein, 9 aa, Influenza virus
EDCMMKAVR

SEQ ID NO: 466591 - protein, 9 aa, Influenza virus
EDCMVKAVR

SEQ ID NO: 466592 - protein, 9 aa, Influenza virus
EDCTGCFEI

SEQ ID NO: 466593 - protein, 9 aa, Influenza virus
EDDVWMGRT

SEQ ID NO: 466594 - protein, 9 aa, Influenza virus
EDEQMYQKC

SEQ ID NO: 466595 - protein, 9 aa, Influenza virus
EDEQMYQRC

SEQ ID NO: 466596 - protein, 9 aa, Influenza virus
EDESRIERQ

SEQ ID NO: 466597 - protein, 9 aa, Influenza virus
EDEVWWTSN

SEQ ID NO: 466598 - protein, 9 aa, Influenza virus
EDFQLIPMI

SEQ ID NO: 466599 - protein, 9 aa, Influenza virus
EDFVRQCFN

SEQ ID NO: 466600 - protein, 9 aa, Influenza virus
EDGDIIFLW

SEQ ID NO: 466601 - protein, 9 aa, Influenza virus
EDGFIDVWT

SEQ ID NO: 466602 - protein, 9 aa, Influenza virus
EDGFLDVWT

SEQ ID NO: 466603 - protein, 9 aa, Influenza virus
EDGFLGVWT

SEQ ID NO: 466604 - protein, 9 aa, Influenza virus
EDGKGCFDL

SEQ ID NO: 466605 - protein, 9 aa, Influenza virus
EDGKGCFEI

SEQ ID NO: 466606 - protein, 9 aa, Influenza virus
EDGKGCFEL

SEQ ID NO: 466607 - protein, 9 aa, Influenza virus
EDGLLDVWT

SEQ ID NO: 466608 - protein, 9 aa, Influenza virus
EDGNGCFEI

SEQ ID NO: 466609 - protein, 9 aa, Influenza virus
EDGNGCFEL

SEQ ID NO: 466610 - protein, 9 aa, Influenza virus
EDGNIIFLW

SEQ ID NO: 466611 - protein, 9 aa, Influenza virus
EDGRGCFEI

SEQ ID NO: 466612 - protein, 9 aa, Influenza virus
EDGSIGKVC

SEQ ID NO: 466613 - protein, 9 aa, Influenza virus
EDGSSSSNC

SEQ ID NO: 466614 - protein, 9 aa, Influenza virus
EDGTGCFEI

SEQ ID NO: 466615 - protein, 9 aa, Influenza virus
EDGTGCFEL

SEQ ID NO: 466616 - protein, 9 aa, Influenza virus
EDGVYKALS

SEQ ID NO: 466617 - protein, 9 aa, Influenza virus
EDILRTQES

SEQ ID NO: 466618 - protein, 9 aa, Influenza virus
EDKGNGCFE

SEQ ID NO: 466619 - protein, 9 aa, Influenza virus
EDKRYGPAL

SEQ ID NO: 466620 - protein, 9 aa, Influenza virus
EDKVWWTSN

SEQ ID NO: 466621 - protein, 9 aa, Influenza virus
EDLGNGCFK

SEQ ID NO: 466622 - protein, 9 aa, Influenza virus
EDLIFLARS

SEQ ID NO: 466623 - protein, 9 aa, Influenza virus
EDLIFMARS

SEQ ID NO: 466624 - protein, 9 aa, Influenza virus
EDLIFSARS

SEQ ID NO: 466625 - protein, 9 aa, Influenza virus
EDLTFLARS

SEQ ID NO: 466626 - protein, 9 aa, Influenza virus
EDLWAYNAE

SEQ ID NO: 466627 - protein, 9 aa, Influenza virus
EDMGNGCFK

SEQ ID NO: 466628 - protein, 9 aa, Influenza virus
EDMGNGCFR

SEQ ID NO: 466629 - protein, 9 aa, Influenza virus
EDMGNGCFT

SEQ ID NO: 466630 - protein, 9 aa, Influenza virus
EDMGNGCLK

SEQ ID NO: 466631 - protein, 9 aa, Influenza virus
EDNIYKILS

SEQ ID NO: 466632 - protein, 9 aa, Influenza virus
EDNVYKALS

SEQ ID NO: 466633 - protein, 9 aa, Influenza virus
EDNVYKILS

SEQ ID NO: 466634 - protein, 9 aa, Influenza virus
EDNVYKVLA

SEQ ID NO: 466635 - protein, 9 aa, Influenza virus
EDNVYKVLS

SEQ ID NO: 466636 - protein, 9 aa, Influenza virus
EDNVYRALS

SEQ ID NO: 466637 - protein, 9 aa, Influenza virus
EDPAAPHGL

SEQ ID NO: 466638 - protein, 9 aa, Influenza virus
EDPDHEGEG

SEQ ID NO: 466639 - protein, 9 aa, Influenza virus
EDPGAPHGL

SEQ ID NO: 466640 - protein, 9 aa, Influenza virus
EDPNAPHKL

SEQ ID NO: 466641 - protein, 9 aa, Influenza virus
EDPNAPNKF

SEQ ID NO: 466642 - protein, 9 aa, Influenza virus
EDPNAPNKL

SEQ ID NO: 466643 - protein, 9 aa, Influenza virus
EDPNHEGEG

SEQ ID NO: 466644 - protein, 9 aa, Influenza virus
EDPSAPHGL

SEQ ID NO: 466645 - protein, 9 aa, Influenza virus
EDPSAPHRL

SEQ ID NO: 466646 - protein, 9 aa, Influenza virus
EDPSHEGEG

SEQ ID NO: 466647 - protein, 9 aa, Influenza virus
EDPTAPHGL

SEQ ID NO: 466648 - protein, 9 aa, Influenza virus
EDQGNGCFE

SEQ ID NO: 466649 - protein, 9 aa, Influenza virus
EDQIQDIWA

SEQ ID NO: 466650 - protein, 9 aa, Influenza virus
EDQITDIWA

SEQ ID NO: 466651 - protein, 9 aa, Influenza virus
EDRGNGCFE

SEQ ID NO: 466652 - protein, 9 aa, Influenza virus
EDRMIKAVR

SEQ ID NO: 466653 - protein, 9 aa, Influenza virus
EDRRYGPAL

SEQ ID NO: 466654 - protein, 9 aa, Influenza virus
EDRTPYRSL

SEQ ID NO: 466655 - protein, 9 aa, Influenza virus
EDRVWWTSN

SEQ ID NO: 466656 - protein, 9 aa, Influenza virus
EDSDILVTR

SEQ ID NO: 466657 - protein, 9 aa, Influenza virus
EDSDVLVTR

SEQ ID NO: 466658 - protein, 9 aa, Influenza virus
EDSRSGYET

SEQ ID NO: 466659 - protein, 9 aa, Influenza virus
EDSSSNSNC

SEQ ID NO: 466660 - protein, 9 aa, Influenza virus
EDSSSSSNC

SEQ ID NO: 466661 - protein, 9 aa, Influenza virus
EDTHIHIFS

SEQ ID NO: 466662 - protein, 9 aa, Influenza virus
EDTIEERFE

SEQ ID NO: 466663 - protein, 9 aa, Influenza virus
EDTKIDLWS

SEQ ID NO: 466664 - protein, 9 aa, Influenza virus
EDTKVDLWS

SEQ ID NO: 466665 - protein, 9 aa, Influenza virus
EDYKEESQL

SEQ ID NO: 466666 - protein, 9 aa, Influenza virus
EDYREESQL

SEQ ID NO: 466667 - protein, 9 aa, Influenza virus
EEAKLEKSR

SEQ ID NO: 466668 - protein, 9 aa, Influenza virus
EEAKLERSK

SEQ ID NO: 466669 - protein, 9 aa, Influenza virus
EEAKYVEWT

SEQ ID NO: 466670 - protein, 9 aa, Influenza virus
EEAKYVWWA

SEQ ID NO: 466671 - protein, 9 aa, Influenza virus
EEAKYVWWT

SEQ ID NO: 466672 - protein, 9 aa, Influenza virus
EEALKGSAR

SEQ ID NO: 466673 - protein, 9 aa, Influenza virus
EEALLNRLN

SEQ ID NO: 466674 - protein, 9 aa, Influenza virus
EEALLNRLS

SEQ ID NO: 466675 - protein, 9 aa, Influenza virus
EEALQGSAR

SEQ ID NO: 466676 - protein, 9 aa, Influenza virus
EEALRQIIR

SEQ ID NO: 466677 - protein, 9 aa, Influenza virus
EEALRQILR

SEQ ID NO: 466678 - protein, 9 aa, Influenza virus
EEALRQKIM

SEQ ID NO: 466679 - protein, 9 aa, Influenza virus
EEAMQNRIQ

SEQ ID NO: 466680 - protein, 9 aa, Influenza virus
EEAPLNRLN

SEQ ID NO: 466681 - protein, 9 aa, Influenza virus
EECLINDPW

SEQ ID NO: 466682 - protein, 9 aa, Influenza virus
EECMIKAVR

SEQ ID NO: 466683 - protein, 9 aa, Influenza virus
EECSCYGHD

SEQ ID NO: 466684 - protein, 9 aa, Influenza virus
EECSCYGHN

SEQ ID NO: 466685 - protein, 9 aa, Influenza virus
EECSCYGHS

SEQ ID NO: 466686 - protein, 9 aa, Influenza virus
EECSCYMDI

SEQ ID NO: 466687 - protein, 9 aa, Influenza virus
EECSCYPDA

SEQ ID NO: 466688 - protein, 9 aa, Influenza virus
EECSCYPDS

SEQ ID NO: 466689 - protein, 9 aa, Influenza virus
EECSCYPDT

SEQ ID NO: 466690 - protein, 9 aa, Influenza virus
EECSCYPES

SEQ ID NO: 466691 - protein, 9 aa, Influenza virus
EECSCYPNA

SEQ ID NO: 466692 - protein, 9 aa, Influenza virus
EECSCYPND

SEQ ID NO: 466693 - protein, 9 aa, Influenza virus
EECSCYPNE

SEQ ID NO: 466694 - protein, 9 aa, Influenza virus
EECSCYPNL

SEQ ID NO: 466695 - protein, 9 aa, Influenza virus
EECSCYPNM

SEQ ID NO: 466696 - protein, 9 aa, Influenza virus
EECSCYPNS

SEQ ID NO: 466697 - protein, 9 aa, Influenza virus
EECSCYPQH

SEQ ID NO: 466698 - protein, 9 aa, Influenza virus
EECSCYPQY

SEQ ID NO: 466699 - protein, 9 aa, Influenza virus
EECSCYPRF

SEQ ID NO: 466700 - protein, 9 aa, Influenza virus
EECSCYPRH

SEQ ID NO: 466701 - protein, 9 aa, Influenza virus
EECSCYPRS

SEQ ID NO: 466702 - protein, 9 aa, Influenza virus
EECSCYPRY

SEQ ID NO: 466703 - protein, 9 aa, Influenza virus
EECSCYPSG

SEQ ID NO: 466704 - protein, 9 aa, Influenza virus
EECSCYPSY

SEQ ID NO: 466705 - protein, 9 aa, Influenza virus
EECSCYSRY

SEQ ID NO: 466706 - protein, 9 aa, Influenza virus
EECSCYVDI

SEQ ID NO: 466707 - protein, 9 aa, Influenza virus
EECSCYVDT

SEQ ID NO: 466708 - protein, 9 aa, Influenza virus
EECSCYVDV

SEQ ID NO: 466709 - protein, 9 aa, Influenza virus
EECYRACFY

SEQ ID NO: 466710 - protein, 9 aa, Influenza virus
EEDCTGCFE

SEQ ID NO: 466711 - protein, 9 aa, Influenza virus
EEDGKGCFE

SEQ ID NO: 466712 - protein, 9 aa, Influenza virus
EEDGNGCFE

SEQ ID NO: 466713 - protein, 9 aa, Influenza virus
EEDGRGCFE

SEQ ID NO: 466714 - protein, 9 aa, Influenza virus
EEDGTGCFE

SEQ ID NO: 466715 - protein, 9 aa, Influenza virus
EEEAKLEKS

SEQ ID NO: 466716 - protein, 9 aa, Influenza virus
EEEAKLERS

SEQ ID NO: 466717 - protein, 9 aa, Influenza virus
EEELLTGNL

SEQ ID NO: 466718 - protein, 9 aa, Influenza virus
EEEMLTGNL

SEQ ID NO: 466719 - protein, 9 aa, Influenza virus
EEESDEALK

SEQ ID NO: 466720 - protein, 9 aa, Influenza virus
EEESKIERQ

SEQ ID NO: 466721 - protein, 9 aa, Influenza virus
EEESKLERQ

SEQ ID NO: 466722 - protein, 9 aa, Influenza virus
EEESKLKRN

SEQ ID NO: 466723 - protein, 9 aa, Influenza virus
EEESKLKRQ

SEQ ID NO: 466724 - protein, 9 aa, Influenza virus
EEESKLNRN

SEQ ID NO: 466725 - protein, 9 aa, Influenza virus
EEESKLNRS

SEQ ID NO: 466726 - protein, 9 aa, Influenza virus
EEESKLNRT

SEQ ID NO: 466727 - protein, 9 aa, Influenza virus
EEESRIERQ

SEQ ID NO: 466728 - protein, 9 aa, Influenza virus
EEESRLNRN

SEQ ID NO: 466729 - protein, 9 aa, Influenza virus
EEEVLTGNL

SEQ ID NO: 466730 - protein, 9 aa, Influenza virus
EEFVRQCFN

SEQ ID NO: 466731 - protein, 9 aa, Influenza virus
EEGDIIFLW

SEQ ID NO: 466732 - protein, 9 aa, Influenza virus
EEGSIGKVC

SEQ ID NO: 466733 - protein, 9 aa, Influenza virus
EEGTGIAAD

SEQ ID NO: 466734 - protein, 9 aa, Influenza virus
EEGTGVAAD

SEQ ID NO: 466735 - protein, 9 aa, Influenza virus
EEGTSIWTS

SEQ ID NO: 466736 - protein, 9 aa, Influenza virus
EEHPNAGKD

SEQ ID NO: 466737 - protein, 9 aa, Influenza virus
EEHPSAGKD

SEQ ID NO: 466738 - protein, 9 aa, Influenza virus
EEHPSAGRD

SEQ ID NO: 466739 - protein, 9 aa, Influenza virus
EEHPSTGKD

SEQ ID NO: 466740 - protein, 9 aa, Influenza virus
EEISETQGT

SEQ ID NO: 466741 - protein, 9 aa, Influenza virus
EEKTSIWTS

SEQ ID NO: 466742 - protein, 9 aa, Influenza virus
EEKVWWTSN

SEQ ID NO: 466743 - protein, 9 aa, Influenza virus
EELKEQLST

SEQ ID NO: 466744 - protein, 9 aa, Influenza virus
EELKHLLNR

SEQ ID NO: 466745 - protein, 9 aa, Influenza virus
EELKHLLSR

SEQ ID NO: 466746 - protein, 9 aa, Influenza virus
EELKHLLSS

SEQ ID NO: 466747 - protein, 9 aa, Influenza virus
EELKHLMSS

SEQ ID NO: 466748 - protein, 9 aa, Influenza virus
EELKSLFSS

SEQ ID NO: 466749 - protein, 9 aa, Influenza virus
EELLTGNLQ

SEQ ID NO: 466750 - protein, 9 aa, Influenza virus
EELREHLSS

SEQ ID NO: 466751 - protein, 9 aa, Influenza virus
EELREQLSS

SEQ ID NO: 466752 - protein, 9 aa, Influenza virus
EELREQLST

SEQ ID NO: 466753 - protein, 9 aa, Influenza virus
EELRFLFSS

SEQ ID NO: 466754 - protein, 9 aa, Influenza virus
EELRFVFSI

SEQ ID NO: 466755 - protein, 9 aa, Influenza virus
EELRFVFSN

SEQ ID NO: 466756 - protein, 9 aa, Influenza virus
EELRFVFSS

SEQ ID NO: 466757 - protein, 9 aa, Influenza virus
EELRRQKSL

SEQ ID NO: 466758 - protein, 9 aa, Influenza virus
EELRRQKWW

SEQ ID NO: 466759 - protein, 9 aa, Influenza virus
EELRSLFSS

SEQ ID NO: 466760 - protein, 9 aa, Influenza virus
EELVHGGID

SEQ ID NO: 466761 - protein, 9 aa, Influenza virus
EELVHGGIN

SEQ ID NO: 466762 - protein, 9 aa, Influenza virus
EELVHGGVD

SEQ ID NO: 466763 - protein, 9 aa, Influenza virus
EELVHGQVN

SEQ ID NO: 466764 - protein, 9 aa, Influenza virus
EELVHRGID

SEQ ID NO: 466765 - protein, 9 aa, Influenza virus
EELWAYNAE

SEQ ID NO: 466766 - protein, 9 aa, Influenza virus
EEMLTGNLQ

SEQ ID NO: 466767 - protein, 9 aa, Influenza virus
EENPSAGKD

SEQ ID NO: 466768 - protein, 9 aa, Influenza virus
EENSTYKIL

SEQ ID NO: 466769 - protein, 9 aa, Influenza virus
EENTSYKIL

SEQ ID NO: 466770 - protein, 9 aa, Influenza virus
EENTTYKIL

SEQ ID NO: 466771 - protein, 9 aa, Influenza virus
EENTTYRIL

SEQ ID NO: 466772 - protein, 9 aa, Influenza virus
EEPLKGSAK

SEQ ID NO: 466773 - protein, 9 aa, Influenza virus
EEPLRQILR

SEQ ID NO: 466774 - protein, 9 aa, Influenza virus
EEQAVDICK

SEQ ID NO: 466775 - protein, 9 aa, Influenza virus
EEQAVGICK

SEQ ID NO: 466776 - protein, 9 aa, Influenza virus
EEQAVNICK

SEQ ID NO: 466777 - protein, 9 aa, Influenza virus
EERGNPGVK

SEQ ID NO: 466778 - protein, 9 aa, Influenza virus
EERGSPGVK

SEQ ID NO: 466779 - protein, 9 aa, Influenza virus
EERNSIWTS

SEQ ID NO: 466780 - protein, 9 aa, Influenza virus
EERTSIWTS

SEQ ID NO: 466781 - protein, 9 aa, Influenza virus
EESDEALKM

SEQ ID NO: 466782 - protein, 9 aa, Influenza virus
EESECVCHN

SEQ ID NO: 466783 - protein, 9 aa, Influenza virus
EESHPGIFE

SEQ ID NO: 466784 - protein, 9 aa, Influenza virus
EESHPGIFG

SEQ ID NO: 466785 - protein, 9 aa, Influenza virus
EESHPGLFE

SEQ ID NO: 466786 - protein, 9 aa, Influenza virus
EESKIERQK

SEQ ID NO: 466787 - protein, 9 aa, Influenza virus
EESKINRQE

SEQ ID NO: 466788 - protein, 9 aa, Influenza virus
EESKLERQK

SEQ ID NO: 466789 - protein, 9 aa, Influenza virus
EESKLERQR

SEQ ID NO: 466790 - protein, 9 aa, Influenza virus
EESKLKRNE

SEQ ID NO: 466791 - protein, 9 aa, Influenza virus
EESKLKRQE

SEQ ID NO: 466792 - protein, 9 aa, Influenza virus
EESKLNKNE

SEQ ID NO: 466793 - protein, 9 aa, Influenza virus
EESKLNRNE

SEQ ID NO: 466794 - protein, 9 aa, Influenza virus
EESKLNRQE

SEQ ID NO: 466795 - protein, 9 aa, Influenza virus
EESKLNRSE

SEQ ID NO: 466796 - protein, 9 aa, Influenza virus
EESKLNRTE

SEQ ID NO: 466797 - protein, 9 aa, Influenza virus
EESLLNRLS

SEQ ID NO: 466798 - protein, 9 aa, Influenza virus
EESLRQILR

SEQ ID NO: 466799 - protein, 9 aa, Influenza virus
EESLRQVLR

SEQ ID NO: 466800 - protein, 9 aa, Influenza virus
EESQLKKQE

SEQ ID NO: 466801 - protein, 9 aa, Influenza virus
EESQLKRQE

SEQ ID NO: 466802 - protein, 9 aa, Influenza virus
EESRARIKT

SEQ ID NO: 466803 - protein, 9 aa, Influenza virus
EESRIERQK

SEQ ID NO: 466804 - protein, 9 aa, Influenza virus
EESRINRQE

SEQ ID NO: 466805 - protein, 9 aa, Influenza virus
EESRLNRNE

SEQ ID NO: 466806 - protein, 9 aa, Influenza virus
EESRLNRQE

SEQ ID NO: 466807 - protein, 9 aa, Influenza virus
EESSIGKVC

SEQ ID NO: 466808 - protein, 9 aa, Influenza virus
EETHIHIFS

SEQ ID NO: 466809 - protein, 9 aa, Influenza virus
EETIEEKFE

SEQ ID NO: 466810 - protein, 9 aa, Influenza virus
EETIEERFE

SEQ ID NO: 466811 - protein, 9 aa, Influenza virus
EETLKGSAR

SEQ ID NO: 466812 - protein, 9 aa, Influenza virus
EETLRKILR

SEQ ID NO: 466813 - protein, 9 aa, Influenza virus
EETLRQILR

SEQ ID NO: 466814 - protein, 9 aa, Influenza virus
EETVEERFE

SEQ ID NO: 466815 - protein, 9 aa, Influenza virus
EETYKILTI

SEQ ID NO: 466816 - protein, 9 aa, Influenza virus
EEVKYVWWT

SEQ ID NO: 466817 - protein, 9 aa, Influenza virus
EEVLKGSAR

SEQ ID NO: 466818 - protein, 9 aa, Influenza virus
EEVLTGNLQ

SEQ ID NO: 466819 - protein, 9 aa, Influenza virus
EEVSEAQGT

SEQ ID NO: 466820 - protein, 9 aa, Influenza virus
EEVSETQGI

SEQ ID NO: 466821 - protein, 9 aa, Influenza virus
EEVSETQGM

SEQ ID NO: 466822 - protein, 9 aa, Influenza virus
EEVSETQGT

SEQ ID NO: 466823 - protein, 9 aa, Influenza virus
EEVTNATET

SEQ ID NO: 466824 - protein, 9 aa, Influenza virus
EEWSCYGHS

SEQ ID NO: 466825 - protein, 9 aa, Influenza virus
EEYGKGRIF

SEQ ID NO: 466826 - protein, 9 aa, Influenza virus
EEYGRGRIF

SEQ ID NO: 466827 - protein, 9 aa, Influenza virus
EEYVEDTKI

SEQ ID NO: 466828 - protein, 9 aa, Influenza virus
EFCYTLITD

SEQ ID NO: 466829 - protein, 9 aa, Influenza virus
EFCYTLMTD

SEQ ID NO: 466830 - protein, 9 aa, Influenza virus
EFCYTLVTD

SEQ ID NO: 466831 - protein, 9 aa, Influenza virus
EFDEIGEDV

SEQ ID NO: 466832 - protein, 9 aa, Influenza virus
EFEPFQSLI

SEQ ID NO: 466833 - protein, 9 aa, Influenza virus
EFEPFQSLV

SEQ ID NO: 466834 - protein, 9 aa, Influenza virus
EFEQVEGRI

SEQ ID NO: 466835 - protein, 9 aa, Influenza virus
EFEQVEGRT

SEQ ID NO: 466836 - protein, 9 aa, Influenza virus
EFESIESEF

SEQ ID NO: 466837 - protein, 9 aa, Influenza virus
EFEVMNHEF

SEQ ID NO: 466838 - protein, 9 aa, Influenza virus
EFEVVDHEF

SEQ ID NO: 466839 - protein, 9 aa, Influenza virus
EFEVVNHEF

SEQ ID NO: 466840 - protein, 9 aa, Influenza virus
EFFNNTEPL

SEQ ID NO: 466841 - protein, 9 aa, Influenza virus
EFGNLERRL

SEQ ID NO: 466842 - protein, 9 aa, Influenza virus
EFGQVEGRI

SEQ ID NO: 466843 - protein, 9 aa, Influenza virus
EFGVVNHEF

SEQ ID NO: 466844 - protein, 9 aa, Influenza virus
EFGYLLKGE

SEQ ID NO: 466845 - protein, 9 aa, Influenza virus
EFGYLLRGE

SEQ ID NO: 466846 - protein, 9 aa, Influenza virus
EFHDSNVKN

SEQ ID NO: 466847 - protein, 9 aa, Influenza virus
EFIAEQFTW

SEQ ID NO: 466848 - protein, 9 aa, Influenza virus
EFICVGWSS

SEQ ID NO: 466849 - protein, 9 aa, Influenza virus
EFKADLIIE

SEQ ID NO: 466850 - protein, 9 aa, Influenza virus
EFKMNPNKK

SEQ ID NO: 466851 - protein, 9 aa, Influenza virus
EFKMNPNQK

SEQ ID NO: 466852 - protein, 9 aa, Influenza virus
EFLCVGWSS

SEQ ID NO: 466853 - protein, 9 aa, Influenza virus
EFLGQWDWP

SEQ ID NO: 466854 - protein, 9 aa, Influenza virus
EFLGQWNWP

SEQ ID NO: 466855 - protein, 9 aa, Influenza virus
EFLNNTEPL

SEQ ID NO: 466856 - protein, 9 aa, Influenza virus
EFLVALENQ

SEQ ID NO: 466857 - protein, 9 aa, Influenza virus
EFLVAMENQ

SEQ ID NO: 466858 - protein, 9 aa, Influenza virus
EFLVAVENQ

SEQ ID NO: 466859 - protein, 9 aa, Influenza virus
EFNEIEHQI

SEQ ID NO: 466860 - protein, 9 aa, Influenza virus
EFNEIEQQI

SEQ ID NO: 466861 - protein, 9 aa, Influenza virus
EFNEIEYQI

SEQ ID NO: 466862 - protein, 9 aa, Influenza virus
EFNEVEQQI

SEQ ID NO: 466863 - protein, 9 aa, Influenza virus
EFNKACELT

SEQ ID NO: 466864 - protein, 9 aa, Influenza virus
EFNNLEKRL

SEQ ID NO: 466865 - protein, 9 aa, Influenza virus
EFNNLERRL

SEQ ID NO: 466866 - protein, 9 aa, Influenza virus
EFNQVEKRI

SEQ ID NO: 466867 - protein, 9 aa, Influenza virus
EFNQVENRI

SEQ ID NO: 466868 - protein, 9 aa, Influenza virus
EFNQVEQRI

SEQ ID NO: 466869 - protein, 9 aa, Influenza virus
EFPSTGNHG

SEQ ID NO: 466870 - protein, 9 aa, Influenza virus
EFQLIPMIS

SEQ ID NO: 466871 - protein, 9 aa, Influenza virus
EFSEIEGRI

SEQ ID NO: 466872 - protein, 9 aa, Influenza virus
EFSEIEHQI

SEQ ID NO: 466873 - protein, 9 aa, Influenza virus
EFSEIEQQI

SEQ ID NO: 466874 - protein, 9 aa, Influenza virus
EFSETEHQI

SEQ ID NO: 466875 - protein, 9 aa, Influenza virus
EFSEVEGRI

SEQ ID NO: 466876 - protein, 9 aa, Influenza virus
EFSEVEIRI

SEQ ID NO: 466877 - protein, 9 aa, Influenza virus
EFSEVESRI

SEQ ID NO: 466878 - protein, 9 aa, Influenza virus
EFSEVETRI

SEQ ID NO: 466879 - protein, 9 aa, Influenza virus
EFSEVGSRI

SEQ ID NO: 466880 - protein, 9 aa, Influenza virus
EFSKVETRI

SEQ ID NO: 466881 - protein, 9 aa, Influenza virus
EFSLTDPKL

SEQ ID NO: 466882 - protein, 9 aa, Influenza virus
EFSLTDPRF

SEQ ID NO: 466883 - protein, 9 aa, Influenza virus
EFSLTDPRL

SEQ ID NO: 466884 - protein, 9 aa, Influenza virus
EFSNLEKRI

SEQ ID NO: 466885 - protein, 9 aa, Influenza virus
EFSNLEKRL

SEQ ID NO: 466886 - protein, 9 aa, Influenza virus
EFSNLERRI

SEQ ID NO: 466887 - protein, 9 aa, Influenza virus
EFSNLERRL

SEQ ID NO: 466888 - protein, 9 aa, Influenza virus
EFSQVEQRI

SEQ ID NO: 466889 - protein, 9 aa, Influenza virus
EFSQVERRI

SEQ ID NO: 466890 - protein, 9 aa, Influenza virus
EFSSLERRI

SEQ ID NO: 466891 - protein, 9 aa, Influenza virus
EFTEVEGRI

SEQ ID NO: 466892 - protein, 9 aa, Influenza virus
EFTEVEKQI

SEQ ID NO: 466893 - protein, 9 aa, Influenza virus
EFTEVEQQI

SEQ ID NO: 466894 - protein, 9 aa, Influenza virus
EFTSFFYRY

SEQ ID NO: 466895 - protein, 9 aa, Influenza virus
EFVRQCFNP

SEQ ID NO: 466896 - protein, 9 aa, Influenza virus
EFWHKCDDE

SEQ ID NO: 466897 - protein, 9 aa, Influenza virus
EFWHKCDND

SEQ ID NO: 466898 - protein, 9 aa, Influenza virus
EFWHKCDNE

SEQ ID NO: 466899 - protein, 9 aa, Influenza virus
EFWHKCNNE

SEQ ID NO: 466900 - protein, 9 aa, Influenza virus
EFYHKCDDE

SEQ ID NO: 466901 - protein, 9 aa, Influenza virus
EFYHKCDNE

SEQ ID NO: 466902 - protein, 9 aa, Influenza virus
EFYHKCNDE

SEQ ID NO: 466903 - protein, 9 aa, Influenza virus
EGADVCYPG

SEQ ID NO: 466904 - protein, 9 aa, Influenza virus
EGALRQKIM

SEQ ID NO: 466905 - protein, 9 aa, Influenza virus
EGAYKILTI

SEQ ID NO: 466906 - protein, 9 aa, Influenza virus
EGDCYRACF

SEQ ID NO: 466907 - protein, 9 aa, Influenza virus
EGDGCFNFF

SEQ ID NO: 466908 - protein, 9 aa, Influenza virus
EGDGCFNLL

SEQ ID NO: 466909 - protein, 9 aa, Influenza virus
EGDGCFSIL

SEQ ID NO: 466910 - protein, 9 aa, Influenza virus
EGDGCFSLL

SEQ ID NO: 466911 - protein, 9 aa, Influenza virus
EGDIIFLWG

SEQ ID NO: 466912 - protein, 9 aa, Influenza virus
EGECFYSGG

SEQ ID NO: 466913 - protein, 9 aa, Influenza virus
EGECYRACF

SEQ ID NO: 466914 - protein, 9 aa, Influenza virus
EGEGIPLHD

SEQ ID NO: 466915 - protein, 9 aa, Influenza virus
EGEGIPLYD

SEQ ID NO: 466916 - protein, 9 aa, Influenza virus
EGEQIIVTR

SEQ ID NO: 466917 - protein, 9 aa, Influenza virus
EGFAPFSKD

SEQ ID NO: 466918 - protein, 9 aa, Influenza virus
EGFEEFTMV

SEQ ID NO: 466919 - protein, 9 aa, Influenza virus
EGFSAESRK

SEQ ID NO: 466920 - protein, 9 aa, Influenza virus
EGFVRQCFN

SEQ ID NO: 466921 - protein, 9 aa, Influenza virus
EGGWCGMID

SEQ ID NO: 466922 - protein, 9 aa, Influenza virus
EGGWPGLIN

SEQ ID NO: 466923 - protein, 9 aa, Influenza virus
EGGWPGLVA

SEQ ID NO: 466924 - protein, 9 aa, Influenza virus
EGGWQGLVD

SEQ ID NO: 466925 - protein, 9 aa, Influenza virus
EGGWQGMID

SEQ ID NO: 466926 - protein, 9 aa, Influenza virus
EGGWQGMVD

SEQ ID NO: 466927 - protein, 9 aa, Influenza virus
EGGWSGLIA

SEQ ID NO: 466928 - protein, 9 aa, Influenza virus
EGGWSGLVA

SEQ ID NO: 466929 - protein, 9 aa, Influenza virus
EGGWSGMID

SEQ ID NO: 466930 - protein, 9 aa, Influenza virus
EGGWTGLID

SEQ ID NO: 466931 - protein, 9 aa, Influenza virus
EGGWTGMID

SEQ ID NO: 466932 - protein, 9 aa, Influenza virus
EGGWTGMVD

SEQ ID NO: 466933 - protein, 9 aa, Influenza virus
EGGWTGMVN

SEQ ID NO: 466934 - protein, 9 aa, Influenza virus
EGHIEECSC

SEQ ID NO: 466935 - protein, 9 aa, Influenza virus
EGIAADYKS

SEQ ID NO: 466936 - protein, 9 aa, Influenza virus
EGICYPGSI

SEQ ID NO: 466937 - protein, 9 aa, Influenza virus
EGICYPGSV

SEQ ID NO: 466938 - protein, 9 aa, Influenza virus
EGIGIAADR

SEQ ID NO: 466939 - protein, 9 aa, Influenza virus
EGIGQAADL

SEQ ID NO: 466940 - protein, 9 aa, Influenza virus
EGIILGNPK

SEQ ID NO: 466941 - protein, 9 aa, Influenza virus
EGIKLKSED

SEQ ID NO: 466942 - protein, 9 aa, Influenza virus
EGIKLKTED

SEQ ID NO: 466943 - protein, 9 aa, Influenza virus
EGIMNTSKP

SEQ ID NO: 466944 - protein, 9 aa, Influenza virus
EGIPLHDAI

SEQ ID NO: 466945 - protein, 9 aa, Influenza virus
EGIPLYDAI

SEQ ID NO: 466946 - protein, 9 aa, Influenza virus
EGIPLYDAV

SEQ ID NO: 466947 - protein, 9 aa, Influenza virus
EGIYKILTI

SEQ ID NO: 466948 - protein, 9 aa, Influenza virus
EGKHIVERI

SEQ ID NO: 466949 - protein, 9 aa, Influenza virus
EGKIAHISP

SEQ ID NO: 466950 - protein, 9 aa, Influenza virus
EGKIIHISP

SEQ ID NO: 466951 - protein, 9 aa, Influenza virus
EGKISHISP

SEQ ID NO: 466952 - protein, 9 aa, Influenza virus
EGKIVHIGP

SEQ ID NO: 466953 - protein, 9 aa, Influenza virus
EGKIVHISP

SEQ ID NO: 466954 - protein, 9 aa, Influenza virus
EGKIVHVSP

SEQ ID NO: 466955 - protein, 9 aa, Influenza virus
EGKLSQMSK

SEQ ID NO: 466956 - protein, 9 aa, Influenza virus
EGKLSQMSR

SEQ ID NO: 466957 - protein, 9 aa, Influenza virus
EGKVECICR

SEQ ID NO: 466958 - protein, 9 aa, Influenza virus
EGKVECVCR

SEQ ID NO: 466959 - protein, 9 aa, Influenza virus
EGKVVHISP

SEQ ID NO: 466960 - protein, 9 aa, Influenza virus
EGLIDGWYG

SEQ ID NO: 466961 - protein, 9 aa, Influenza virus
EGLILGNPK

SEQ ID NO: 466962 - protein, 9 aa, Influenza virus
EGLILSNPK

SEQ ID NO: 466963 - protein, 9 aa, Influenza virus
EGLINGWYG

SEQ ID NO: 466964 - protein, 9 aa, Influenza virus
EGLIYGNPS

SEQ ID NO: 466965 - protein, 9 aa, Influenza virus
EGLPQSGRI

SEQ ID NO: 466966 - protein, 9 aa, Influenza virus
EGLVDGWYG

SEQ ID NO: 466967 - protein, 9 aa, Influenza virus
EGLVLGNPK

SEQ ID NO: 466968 - protein, 9 aa, Influenza virus
EGLVYGNPA

SEQ ID NO: 466969 - protein, 9 aa, Influenza virus
EGLVYGNPS

SEQ ID NO: 466970 - protein, 9 aa, Influenza virus
EGLWAYNAE

SEQ ID NO: 466971 - protein, 9 aa, Influenza virus
EGMCYPGFV

SEQ ID NO: 466972 - protein, 9 aa, Influenza virus
EGMCYPGSI

SEQ ID NO: 466973 - protein, 9 aa, Influenza virus
EGMCYPGSV

SEQ ID NO: 466974 - protein, 9 aa, Influenza virus
EGMGQAADL

SEQ ID NO: 466975 - protein, 9 aa, Influenza virus
EGMIDGWYG

SEQ ID NO: 466976 - protein, 9 aa, Influenza virus
EGMMDGWYG

SEQ ID NO: 466977 - protein, 9 aa, Influenza virus
EGMVDGWYG

SEQ ID NO: 466978 - protein, 9 aa, Influenza virus
EGMVNGWYG

SEQ ID NO: 466979 - protein, 9 aa, Influenza virus
EGNDVCYPG

SEQ ID NO: 466980 - protein, 9 aa, Influenza virus
EGNGCFELL

SEQ ID NO: 466981 - protein, 9 aa, Influenza virus
EGNGCFTFY

SEQ ID NO: 466982 - protein, 9 aa, Influenza virus
EGNILRTQE

SEQ ID NO: 466983 - protein, 9 aa, Influenza virus
EGQRSWMKI

SEQ ID NO: 466984 - protein, 9 aa, Influenza virus
EGRGQAADL

SEQ ID NO: 466985 - protein, 9 aa, Influenza virus
EGRIQDLEK

SEQ ID NO: 466986 - protein, 9 aa, Influenza virus
EGRIQDLER

SEQ ID NO: 466987 - protein, 9 aa, Influenza virus
EGRLIQNSI

SEQ ID NO: 466988 - protein, 9 aa, Influenza virus
EGRLIQNSL

SEQ ID NO: 466989 - protein, 9 aa, Influenza virus
EGRLIQNSM

SEQ ID NO: 466990 - protein, 9 aa, Influenza virus
EGRNPGNAE

SEQ ID NO: 466991 - protein, 9 aa, Influenza virus
EGRRKTNLY

SEQ ID NO: 466992 - protein, 9 aa, Influenza virus
EGRRRTNLY

SEQ ID NO: 466993 - protein, 9 aa, Influenza virus
EGRTSDMRA

SEQ ID NO: 466994 - protein, 9 aa, Influenza virus
EGRTSDMRT

SEQ ID NO: 466995 - protein, 9 aa, Influenza virus
EGRWPGLVA

SEQ ID NO: 466996 - protein, 9 aa, Influenza virus
EGSDVCYPG

SEQ ID NO: 466997 - protein, 9 aa, Influenza virus
EGSIGKVCR

SEQ ID NO: 466998 - protein, 9 aa, Influenza virus
EGSINTRLP

SEQ ID NO: 466999 - protein, 9 aa, Influenza virus
EGSYFFGDN

SEQ ID NO: 467000 - protein, 9 aa, Influenza virus
EGTAADYKS

SEQ ID NO: 467001 - protein, 9 aa, Influenza virus
EGTDICYPG

SEQ ID NO: 467002 - protein, 9 aa, Influenza virus
EGTDVCYPG

SEQ ID NO: 467003 - protein, 9 aa, Influenza virus
EGTGIAADK

SEQ ID NO: 467004 - protein, 9 aa, Influenza virus
EGTGIAADR

SEQ ID NO: 467005 - protein, 9 aa, Influenza virus
EGTGIVADR

SEQ ID NO: 467006 - protein, 9 aa, Influenza virus
EGTGMAADQ

SEQ ID NO: 467007 - protein, 9 aa, Influenza virus
EGTGMAADR

SEQ ID NO: 467008 - protein, 9 aa, Influenza virus
EGTGQAADL

SEQ ID NO: 467009 - protein, 9 aa, Influenza virus
EGTGTAADL

SEQ ID NO: 467010 - protein, 9 aa, Influenza virus
EGTIVSSLP

SEQ ID NO: 467011 - protein, 9 aa, Influenza virus
EGTSIWTSS

SEQ ID NO: 467012 - protein, 9 aa, Influenza virus
EGTTASCQN

SEQ ID NO: 467013 - protein, 9 aa, Influenza virus
EGTYKILTI

SEQ ID NO: 467014 - protein, 9 aa, Influenza virus
EGVCYPGSI

SEQ ID NO: 467015 - protein, 9 aa, Influenza virus
EGVINTSKP

SEQ ID NO: 467016 - protein, 9 aa, Influenza virus
EGVMNTSKP

SEQ ID NO: 467017 - protein, 9 aa, Influenza virus
EGWIDSPNH

SEQ ID NO: 467018 - protein, 9 aa, Influenza virus
EGWIGGNPA

SEQ ID NO: 467019 - protein, 9 aa, Influenza virus
EGWILGNPK

SEQ ID NO: 467020 - protein, 9 aa, Influenza virus
EGWILGNPQ

SEQ ID NO: 467021 - protein, 9 aa, Influenza virus
EGWILGNPR

SEQ ID NO: 467022 - protein, 9 aa, Influenza virus
EGWINSPNH

SEQ ID NO: 467023 - protein, 9 aa, Influenza virus
EGWINSPSQ

SEQ ID NO: 467024 - protein, 9 aa, Influenza virus
EGWIVGNPA

SEQ ID NO: 467025 - protein, 9 aa, Influenza virus
EGWIVGNPS

SEQ ID NO: 467026 - protein, 9 aa, Influenza virus
EGWVVIAKD

SEQ ID NO: 467027 - protein, 9 aa, Influenza virus
EGWVVIAQD

SEQ ID NO: 467028 - protein, 9 aa, Influenza virus
EGWVVIEKD

SEQ ID NO: 467029 - protein, 9 aa, Influenza virus
EGWVVVAKD

SEQ ID NO: 467030 - protein, 9 aa, Influenza virus
EGYEEFTIV

SEQ ID NO: 467031 - protein, 9 aa, Influenza virus
EGYEEFTLV

SEQ ID NO: 467032 - protein, 9 aa, Influenza virus
EGYEEFTMI

SEQ ID NO: 467033 - protein, 9 aa, Influenza virus
EGYEEFTMV

SEQ ID NO: 467034 - protein, 9 aa, Influenza virus
EGYSLVGID

SEQ ID NO: 467035 - protein, 9 aa, Influenza virus
EGYSLVGVD

SEQ ID NO: 467036 - protein, 9 aa, Influenza virus
EHDANVRNL

SEQ ID NO: 467037 - protein, 9 aa, Influenza virus
EHDSNVENL

SEQ ID NO: 467038 - protein, 9 aa, Influenza virus
EHDSNVKNL

SEQ ID NO: 467039 - protein, 9 aa, Influenza virus
EHEEVTNAT

SEQ ID NO: 467040 - protein, 9 aa, Influenza virus
EHGSGYAAD

SEQ ID NO: 467041 - protein, 9 aa, Influenza virus
EHLIIWGIH

SEQ ID NO: 467042 - protein, 9 aa, Influenza virus
EHLIMWGIH

SEQ ID NO: 467043 - protein, 9 aa, Influenza virus
EHLITWGIH

SEQ ID NO: 467044 - protein, 9 aa, Influenza virus
EHLIVWGIH

SEQ ID NO: 467045 - protein, 9 aa, Influenza virus
EHLSSVSSF

SEQ ID NO: 467046 - protein, 9 aa, Influenza virus
EHLVMWGIH

SEQ ID NO: 467047 - protein, 9 aa, Influenza virus
EHNGILCAT

SEQ ID NO: 467048 - protein, 9 aa, Influenza virus
EHNGLLCAT

SEQ ID NO: 467049 - protein, 9 aa, Influenza virus
EHNGMLCAT

SEQ ID NO: 467050 - protein, 9 aa, Influenza virus
EHNGVLCAT

SEQ ID NO: 467051 - protein, 9 aa, Influenza virus
EHPNAGKDP

SEQ ID NO: 467052 - protein, 9 aa, Influenza virus
EHPSAGKDP

SEQ ID NO: 467053 - protein, 9 aa, Influenza virus
EHPSAGRDP

SEQ ID NO: 467054 - protein, 9 aa, Influenza virus
EHPSTGKDP

SEQ ID NO: 467055 - protein, 9 aa, Influenza virus
EHQIGNVIN

SEQ ID NO: 467056 - protein, 9 aa, Influenza virus
EHQISNVIN

SEQ ID NO: 467057 - protein, 9 aa, Influenza virus
EHSNGTIHD

SEQ ID NO: 467058 - protein, 9 aa, Influenza virus
EHSNGTTHD

SEQ ID NO: 467059 - protein, 9 aa, Influenza virus
EHTAYSQIT

SEQ ID NO: 467060 - protein, 9 aa, Influenza virus
EHTSKYVCT

SEQ ID NO: 467061 - protein, 9 aa, Influenza virus
EHTSQYLCT

SEQ ID NO: 467062 - protein, 9 aa, Influenza virus
EHTSRYICT

SEQ ID NO: 467063 - protein, 9 aa, Influenza virus
EHTSRYVCT

SEQ ID NO: 467064 - protein, 9 aa, Influenza virus
EIALSYSAG

SEQ ID NO: 467065 - protein, 9 aa, Influenza virus
EIAQKLEDV

SEQ ID NO: 467066 - protein, 9 aa, Influenza virus
EIAQRLEDV

SEQ ID NO: 467067 - protein, 9 aa, Influenza virus
EIAQRLEGV

SEQ ID NO: 467068 - protein, 9 aa, Influenza virus
EIAQRLENV

SEQ ID NO: 467069 - protein, 9 aa, Influenza virus
EIAQRLESV

SEQ ID NO: 467070 - protein, 9 aa, Influenza virus
EIASWAGNI

SEQ ID NO: 467071 - protein, 9 aa, Influenza virus
EICFMYSDF

SEQ ID NO: 467072 - protein, 9 aa, Influenza virus
EICIAWSSS

SEQ ID NO: 467073 - protein, 9 aa, Influenza virus
EICIGYLSN

SEQ ID NO: 467074 - protein, 9 aa, Influenza virus
EICIGYMSN

SEQ ID NO: 467075 - protein, 9 aa, Influenza virus
EICVAWSSS

SEQ ID NO: 467076 - protein, 9 aa, Influenza virus
EICVAWSST

SEQ ID NO: 467077 - protein, 9 aa, Influenza virus
EIDGIKLKS

SEQ ID NO: 467078 - protein, 9 aa, Influenza virus
EIDRSFRPN

SEQ ID NO: 467079 - protein, 9 aa, Influenza virus
EIEDLIFLA

SEQ ID NO: 467080 - protein, 9 aa, Influenza virus
EIEDLIFLT

SEQ ID NO: 467081 - protein, 9 aa, Influenza virus
EIEDLIFMA

SEQ ID NO: 467082 - protein, 9 aa, Influenza virus
EIEDLIFSA

SEQ ID NO: 467083 - protein, 9 aa, Influenza virus
EIEDLTFLA

SEQ ID NO: 467084 - protein, 9 aa, Influenza virus
EIEGICYPG

SEQ ID NO: 467085 - protein, 9 aa, Influenza virus
EIEGIKLES

SEQ ID NO: 467086 - protein, 9 aa, Influenza virus
EIEGIKLKS

SEQ ID NO: 467087 - protein, 9 aa, Influenza virus
EIEGIKLKT

SEQ ID NO: 467088 - protein, 9 aa, Influenza virus
EIEGIRLKS

SEQ ID NO: 467089 - protein, 9 aa, Influenza virus
EIEGRIQDL

SEQ ID NO: 467090 - protein, 9 aa, Influenza virus
EIEHQIGNV

SEQ ID NO: 467091 - protein, 9 aa, Influenza virus
EIEHQISNV

SEQ ID NO: 467092 - protein, 9 aa, Influenza virus
EIEKQIGNV

SEQ ID NO: 467093 - protein, 9 aa, Influenza virus
EIEQQIGNV

SEQ ID NO: 467094 - protein, 9 aa, Influenza virus
EIEYQIGNV

SEQ ID NO: 467095 - protein, 9 aa, Influenza virus
EIFHKCDDD

SEQ ID NO: 467096 - protein, 9 aa, Influenza virus
EIFHKCDDH

SEQ ID NO: 467097 - protein, 9 aa, Influenza virus
EIFHKCDDQ

SEQ ID NO: 467098 - protein, 9 aa, Influenza virus
EIFHKCDDR

SEQ ID NO: 467099 - protein, 9 aa, Influenza virus
EIFHKCDNQ

SEQ ID NO: 467100 - protein, 9 aa, Influenza virus
EIFHQCDND

SEQ ID NO: 467101 - protein, 9 aa, Influenza virus
EIFHQCDNN

SEQ ID NO: 467102 - protein, 9 aa, Influenza virus
EIFHRCDDQ

SEQ ID NO: 467103 - protein, 9 aa, Influenza virus
EIGAPQLNP

SEQ ID NO: 467104 - protein, 9 aa, Influenza virus
EIGARIGEG

SEQ ID NO: 467105 - protein, 9 aa, Influenza virus
EIGEDIAPI

SEQ ID NO: 467106 - protein, 9 aa, Influenza virus
EIGEDLAPI

SEQ ID NO: 467107 - protein, 9 aa, Influenza virus
EIGEDVAPI

SEQ ID NO: 467108 - protein, 9 aa, Influenza virus
EIGNGCFEF

SEQ ID NO: 467109 - protein, 9 aa, Influenza virus
EIGTRIGDG

SEQ ID NO: 467110 - protein, 9 aa, Influenza virus
EIGVTRREI

SEQ ID NO: 467111 - protein, 9 aa, Influenza virus
EIGVTRREV

SEQ ID NO: 467112 - protein, 9 aa, Influenza virus
EIHIYYLEK

SEQ ID NO: 467113 - protein, 9 aa, Influenza virus
EIIEGRDRA

SEQ ID NO: 467114 - protein, 9 aa, Influenza virus
EIIEGRDRI

SEQ ID NO: 467115 - protein, 9 aa, Influenza virus
EIIEGRDRN

SEQ ID NO: 467116 - protein, 9 aa, Influenza virus
EIIEGRDRT

SEQ ID NO: 467117 - protein, 9 aa, Influenza virus
EIIIRMMEN

SEQ ID NO: 467118 - protein, 9 aa, Influenza virus
EIILWFSFG

SEQ ID NO: 467119 - protein, 9 aa, Influenza virus
EIITHFQRK

SEQ ID NO: 467120 - protein, 9 aa, Influenza virus
EIITIGSIC

SEQ ID NO: 467121 - protein, 9 aa, Influenza virus
EIKCQTPLG

SEQ ID NO: 467122 - protein, 9 aa, Influenza virus
EIKGVELSS

SEQ ID NO: 467123 - protein, 9 aa, Influenza virus
EIKGVKLSN

SEQ ID NO: 467124 - protein, 9 aa, Influenza virus
EIKGVKLSS

SEQ ID NO: 467125 - protein, 9 aa, Influenza virus
EIKMNPNQK

SEQ ID NO: 467126 - protein, 9 aa, Influenza virus
EILKVPNAE

SEQ ID NO: 467127 - protein, 9 aa, Influenza virus
EILLIEDGW

SEQ ID NO: 467128 - protein, 9 aa, Influenza virus
EILLIEEGW

SEQ ID NO: 467129 - protein, 9 aa, Influenza virus
EILNNKNWS

SEQ ID NO: 467130 - protein, 9 aa, Influenza virus
EILRTQESE

SEQ ID NO: 467131 - protein, 9 aa, Influenza virus
EILTKITVD

SEQ ID NO: 467132 - protein, 9 aa, Influenza virus
EILTKTTVD

SEQ ID NO: 467133 - protein, 9 aa, Influenza virus
EILTRTTVD

SEQ ID NO: 467134 - protein, 9 aa, Influenza virus
EILVALENQ

SEQ ID NO: 467135 - protein, 9 aa, Influenza virus
EIMRIWRQA

SEQ ID NO: 467136 - protein, 9 aa, Influenza virus
EIMYLNNTT

SEQ ID NO: 467137 - protein, 9 aa, Influenza virus
EINGIKLKS

SEQ ID NO: 467138 - protein, 9 aa, Influenza virus
EINGPDSVL

SEQ ID NO: 467139 - protein, 9 aa, Influenza virus
EINGPESVL

SEQ ID NO: 467140 - protein, 9 aa, Influenza virus
EINRIFRPN

SEQ ID NO: 467141 - protein, 9 aa, Influenza virus
EINRNFKPN

SEQ ID NO: 467142 - protein, 9 aa, Influenza virus
EINRSFKPN

SEQ ID NO: 467143 - protein, 9 aa, Influenza virus
EINRSFRPN

SEQ ID NO: 467144 - protein, 9 aa, Influenza virus
EINTWARNI

SEQ ID NO: 467145 - protein, 9 aa, Influenza virus
EIPSWAGNI

SEQ ID NO: 467146 - protein, 9 aa, Influenza virus
EIPSWEGNI

SEQ ID NO: 467147 - protein, 9 aa, Influenza virus
EIPTWAGNI

SEQ ID NO: 467148 - protein, 9 aa, Influenza virus
EIRAFSFQL

SEQ ID NO: 467149 - protein, 9 aa, Influenza virus
EIRASVGKM

SEQ ID NO: 467150 - protein, 9 aa, Influenza virus
EIRASVGRM

SEQ ID NO: 467151 - protein, 9 aa, Influenza virus
EIRIAWSSS

SEQ ID NO: 467152 - protein, 9 aa, Influenza virus
EIRINMINS

SEQ ID NO: 467153 - protein, 9 aa, Influenza virus
EIRRIWRQA

SEQ ID NO: 467154 - protein, 9 aa, Influenza virus
EIRRVWRQA

SEQ ID NO: 467155 - protein, 9 aa, Influenza virus
EIRSSVGKM

SEQ ID NO: 467156 - protein, 9 aa, Influenza virus
EIRTFSFQF

SEQ ID NO: 467157 - protein, 9 aa, Influenza virus
EIRTFSFQL

SEQ ID NO: 467158 - protein, 9 aa, Influenza virus
EISETQGTE

SEQ ID NO: 467159 - protein, 9 aa, Influenza virus
EISFQGGHI

SEQ ID NO: 467160 - protein, 9 aa, Influenza virus
EISFTITGD

SEQ ID NO: 467161 - protein, 9 aa, Influenza virus
EISHCRATE

SEQ ID NO: 467162 - protein, 9 aa, Influenza virus
EITFHGAKE

SEQ ID NO: 467163 - protein, 9 aa, Influenza virus
EITFYGAKE

SEQ ID NO: 467164 - protein, 9 aa, Influenza virus
EITGIDKVC

SEQ ID NO: 467165 - protein, 9 aa, Influenza virus
EITGINKVC

SEQ ID NO: 467166 - protein, 9 aa, Influenza virus
EITTHFQRK

SEQ ID NO: 467167 - protein, 9 aa, Influenza virus
EITTKINNI

SEQ ID NO: 467168 - protein, 9 aa, Influenza virus
EIVDNKNWS

SEQ ID NO: 467169 - protein, 9 aa, Influenza virus
EIVDNNNWS

SEQ ID NO: 467170 - protein, 9 aa, Influenza virus
EIVDNSNWS

SEQ ID NO: 467171 - protein, 9 aa, Influenza virus
EIVGNDNWS

SEQ ID NO: 467172 - protein, 9 aa, Influenza virus
EIVSNDNWS

SEQ ID NO: 467173 - protein, 9 aa, Influenza virus
EIVTHFQRK

SEQ ID NO: 467174 - protein, 9 aa, Influenza virus
EIVYLNDTI

SEQ ID NO: 467175 - protein, 9 aa, Influenza virus
EIVYLNNTI

SEQ ID NO: 467176 - protein, 9 aa, Influenza virus
EIVYLNNTT

SEQ ID NO: 467177 - protein, 9 aa, Influenza virus
EIVYLNSTT

SEQ ID NO: 467178 - protein, 9 aa, Influenza virus
EIWSYNAEF

SEQ ID NO: 467179 - protein, 9 aa, Influenza virus
EIWSYNAEL

SEQ ID NO: 467180 - protein, 9 aa, Influenza virus
EIYNETVRL

SEQ ID NO: 467181 - protein, 9 aa, Influenza virus
EKAIWTSGS

SEQ ID NO: 467182 - protein, 9 aa, Influenza virus
EKAMKEHGE

SEQ ID NO: 467183 - protein, 9 aa, Influenza virus
EKAMKEYGE

SEQ ID NO: 467184 - protein, 9 aa, Influenza virus
EKANKIKAE

SEQ ID NO: 467185 - protein, 9 aa, Influenza virus
EKANKIKSE

SEQ ID NO: 467186 - protein, 9 aa, Influenza virus
EKANKIKTE

SEQ ID NO: 467187 - protein, 9 aa, Influenza virus
EKANVLIGQ

SEQ ID NO: 467188 - protein, 9 aa, Influenza virus
EKASKIKSE

SEQ ID NO: 467189 - protein, 9 aa, Influenza virus
EKDLTKEFF

SEQ ID NO: 467190 - protein, 9 aa, Influenza virus
EKDMTKEFF

SEQ ID NO: 467191 - protein, 9 aa, Influenza virus
EKDMTREFF

SEQ ID NO: 467192 - protein, 9 aa, Influenza virus
EKDNAVRFG

SEQ ID NO: 467193 - protein, 9 aa, Influenza virus
EKEEVINAT

SEQ ID NO: 467194 - protein, 9 aa, Influenza virus
EKEEVTNAT

SEQ ID NO: 467195 - protein, 9 aa, Influenza virus
EKEFEQVEG

SEQ ID NO: 467196 - protein, 9 aa, Influenza virus
EKEFGQVEG

SEQ ID NO: 467197 - protein, 9 aa, Influenza virus
EKEFSEIEG

SEQ ID NO: 467198 - protein, 9 aa, Influenza virus
EKEFSEVEG

SEQ ID NO: 467199 - protein, 9 aa, Influenza virus
EKEGYSLVG

SEQ ID NO: 467200 - protein, 9 aa, Influenza virus
EKEKEICSV

SEQ ID NO: 467201 - protein, 9 aa, Influenza virus
EKENSYPKI

SEQ ID NO: 467202 - protein, 9 aa, Influenza virus
EKENSYPMI

SEQ ID NO: 467203 - protein, 9 aa, Influenza virus
EKESKLNRN

SEQ ID NO: 467204 - protein, 9 aa, Influenza virus
EKESTQKAI

SEQ ID NO: 467205 - protein, 9 aa, Influenza virus
EKFFPSSSY

SEQ ID NO: 467206 - protein, 9 aa, Influenza virus
EKFHQIEKE

SEQ ID NO: 467207 - protein, 9 aa, Influenza virus
EKGAKQEEN

SEQ ID NO: 467208 - protein, 9 aa, Influenza virus
EKGIEVVNA

SEQ ID NO: 467209 - protein, 9 aa, Influenza virus
EKGKVVKSV

SEQ ID NO: 467210 - protein, 9 aa, Influenza virus
EKGNPGVKG

SEQ ID NO: 467211 - protein, 9 aa, Influenza virus
EKGNQGVKG

SEQ ID NO: 467212 - protein, 9 aa, Influenza virus
EKGPKQEEN

SEQ ID NO: 467213 - protein, 9 aa, Influenza virus
EKGTKQEEN

SEQ ID NO: 467214 - protein, 9 aa, Influenza virus
EKGVEVVNA

SEQ ID NO: 467215 - protein, 9 aa, Influenza virus
EKHLAYCNT

SEQ ID NO: 467216 - protein, 9 aa, Influenza virus
EKHPAYCNT

SEQ ID NO: 467217 - protein, 9 aa, Influenza virus
EKHSAYCNT

SEQ ID NO: 467218 - protein, 9 aa, Influenza virus
EKIEKIRPL

SEQ ID NO: 467219 - protein, 9 aa, Influenza virus
EKIHTRGLF

SEQ ID NO: 467220 - protein, 9 aa, Influenza virus
EKIKILPRD

SEQ ID NO: 467221 - protein, 9 aa, Influenza virus
EKIRNGTYD

SEQ ID NO: 467222 - protein, 9 aa, Influenza virus
EKIRTRGLF

SEQ ID NO: 467223 - protein, 9 aa, Influenza virus
EKIRVKRRP

SEQ ID NO: 467224 - protein, 9 aa, Influenza virus
EKITNKVNN

SEQ ID NO: 467225 - protein, 9 aa, Influenza virus
EKIVTVTHA

SEQ ID NO: 467226 - protein, 9 aa, Influenza virus
EKKAKLANV

SEQ ID NO: 467227 - protein, 9 aa, Influenza virus
EKKINMIND

SEQ ID NO: 467228 - protein, 9 aa, Influenza virus
EKLEQSGLP

SEQ ID NO: 467229 - protein, 9 aa, Influenza virus
EKLTIIYSS

SEQ ID NO: 467230 - protein, 9 aa, Influenza virus
EKLTITYSS

SEQ ID NO: 467231 - protein, 9 aa, Influenza virus
EKLVLATGL

SEQ ID NO: 467232 - protein, 9 aa, Influenza virus
EKLVLATGP

SEQ ID NO: 467233 - protein, 9 aa, Influenza virus
EKMNGNYDS

SEQ ID NO: 467234 - protein, 9 aa, Influenza virus
EKMNIQFTA

SEQ ID NO: 467235 - protein, 9 aa, Influenza virus
EKMNIQFTS

SEQ ID NO: 467236 - protein, 9 aa, Influenza virus
EKMNTQFTA

SEQ ID NO: 467237 - protein, 9 aa, Influenza virus
EKMNTQFTV

SEQ ID NO: 467238 - protein, 9 aa, Influenza virus
EKMVLSAFD

SEQ ID NO: 467239 - protein, 9 aa, Influenza virus
EKNALGDCP

SEQ ID NO: 467240 - protein, 9 aa, Influenza virus
EKNALYGTQ

SEQ ID NO: 467241 - protein, 9 aa, Influenza virus
EKNATASFI

SEQ ID NO: 467242 - protein, 9 aa, Influenza virus
EKNDLYGTQ

SEQ ID NO: 467243 - protein, 9 aa, Influenza virus
EKNELYGTQ

SEQ ID NO: 467244 - protein, 9 aa, Influenza virus
EKNITEIVY

SEQ ID NO: 467245 - protein, 9 aa, Influenza virus
EKNITKIVY

SEQ ID NO: 467246 - protein, 9 aa, Influenza virus
EKNITVTHA

SEQ ID NO: 467247 - protein, 9 aa, Influenza virus
EKNITVTHS

SEQ ID NO: 467248 - protein, 9 aa, Influenza virus
EKNPALRMK

SEQ ID NO: 467249 - protein, 9 aa, Influenza virus
EKNPAYCNT

SEQ ID NO: 467250 - protein, 9 aa, Influenza virus
EKNPSLRMK

SEQ ID NO: 467251 - protein, 9 aa, Influenza virus
EKNVTVTHA

SEQ ID NO: 467252 - protein, 9 aa, Influenza virus
EKNVTVTHS

SEQ ID NO: 467253 - protein, 9 aa, Influenza virus
EKNVTVTRA

SEQ ID NO: 467254 - protein, 9 aa, Influenza virus
EKPFQNVNK

SEQ ID NO: 467255 - protein, 9 aa, Influenza virus
EKQIGNVIN

SEQ ID NO: 467256 - protein, 9 aa, Influenza virus
EKQLGNVIN

SEQ ID NO: 467257 - protein, 9 aa, Influenza virus
EKQTRGIFG

SEQ ID NO: 467258 - protein, 9 aa, Influenza virus
EKQTRGLFG

SEQ ID NO: 467259 - protein, 9 aa, Influenza virus
EKRGLFGAI

SEQ ID NO: 467260 - protein, 9 aa, Influenza virus
EKRIENLNK

SEQ ID NO: 467261 - protein, 9 aa, Influenza virus
EKRINMIAD

SEQ ID NO: 467262 - protein, 9 aa, Influenza virus
EKRINMIND

SEQ ID NO: 467263 - protein, 9 aa, Influenza virus
EKRINMISD

SEQ ID NO: 467264 - protein, 9 aa, Influenza virus
EKRINMLAD

SEQ ID NO: 467265 - protein, 9 aa, Influenza virus
EKRINVIND

SEQ ID NO: 467266 - protein, 9 aa, Influenza virus
EKRLENLDK

SEQ ID NO: 467267 - protein, 9 aa, Influenza virus
EKRLENLNK

SEQ ID NO: 467268 - protein, 9 aa, Influenza virus
EKRLGNLNK

SEQ ID NO: 467269 - protein, 9 aa, Influenza virus
EKRRKKRGL

SEQ ID NO: 467270 - protein, 9 aa, Influenza virus
EKRTNMIND

SEQ ID NO: 467271 - protein, 9 aa, Influenza virus
EKSHPGIFE

SEQ ID NO: 467272 - protein, 9 aa, Influenza virus
EKSNKIKSE

SEQ ID NO: 467273 - protein, 9 aa, Influenza virus
EKSRINGVK

SEQ ID NO: 467274 - protein, 9 aa, Influenza virus
EKTHIHIFS

SEQ ID NO: 467275 - protein, 9 aa, Influenza virus
EKTHNGKLC

SEQ ID NO: 467276 - protein, 9 aa, Influenza virus
EKTHNGRLC

SEQ ID NO: 467277 - protein, 9 aa, Influenza virus
EKTIWTSGS

SEQ ID NO: 467278 - protein, 9 aa, Influenza virus
EKTLDLHDS

SEQ ID NO: 467279 - protein, 9 aa, Influenza virus
EKTMKEYGE

SEQ ID NO: 467280 - protein, 9 aa, Influenza virus
EKTNDKYHQ

SEQ ID NO: 467281 - protein, 9 aa, Influenza virus
EKTNEKFHQ

SEQ ID NO: 467282 - protein, 9 aa, Influenza virus
EKTNEKYHQ

SEQ ID NO: 467283 - protein, 9 aa, Influenza virus
EKTNKQFEL

SEQ ID NO: 467284 - protein, 9 aa, Influenza virus
EKTNQQFEL

SEQ ID NO: 467285 - protein, 9 aa, Influenza virus
EKTNQQFKL

SEQ ID NO: 467286 - protein, 9 aa, Influenza virus
EKTNTEFES

SEQ ID NO: 467287 - protein, 9 aa, Influenza virus
EKTNTQFEL

SEQ ID NO: 467288 - protein, 9 aa, Influenza virus
EKTSWSYIV

SEQ ID NO: 467289 - protein, 9 aa, Influenza virus
EKVDTIIEN

SEQ ID NO: 467290 - protein, 9 aa, Influenza virus
EKVDTIIES

SEQ ID NO: 467291 - protein, 9 aa, Influenza virus
EKVDTLLEN

SEQ ID NO: 467292 - protein, 9 aa, Influenza virus
EKVDTLLES

SEQ ID NO: 467293 - protein, 9 aa, Influenza virus
EKVEGRIQD

SEQ ID NO: 467294 - protein, 9 aa, Influenza virus
EKVHNGKLC

SEQ ID NO: 467295 - protein, 9 aa, Influenza virus
EKVKILARN

SEQ ID NO: 467296 - protein, 9 aa, Influenza virus
EKVKILPKD

SEQ ID NO: 467297 - protein, 9 aa, Influenza virus
EKVKILPRD

SEQ ID NO: 467298 - protein, 9 aa, Influenza virus
EKVNTLLEN

SEQ ID NO: 467299 - protein, 9 aa, Influenza virus
EKVRILPKD

SEQ ID NO: 467300 - protein, 9 aa, Influenza virus
EKVRLQLRD

SEQ ID NO: 467301 - protein, 9 aa, Influenza virus
EKVRMQLRD

SEQ ID NO: 467302 - protein, 9 aa, Influenza virus
EKVRNGTYD

SEQ ID NO: 467303 - protein, 9 aa, Influenza virus
EKVRRQLRE

SEQ ID NO: 467304 - protein, 9 aa, Influenza virus
EKVTNATET

SEQ ID NO: 467305 - protein, 9 aa, Influenza virus
EKVWWTSNS

SEQ ID NO: 467306 - protein, 9 aa, Influenza virus
EKWPIGESP

SEQ ID NO: 467307 - protein, 9 aa, Influenza virus
EKYGSGRIF

SEQ ID NO: 467308 - protein, 9 aa, Influenza virus
EKYGTGRIF

SEQ ID NO: 467309 - protein, 9 aa, Influenza virus
EKYHQIEKE

SEQ ID NO: 467310 - protein, 9 aa, Influenza virus
EKYVEDTKI

SEQ ID NO: 467311 - protein, 9 aa, Influenza virus
EKYVEDTKV

SEQ ID NO: 467312 - protein, 9 aa, Influenza virus
ELAEKAMKE

SEQ ID NO: 467313 - protein, 9 aa, Influenza virus
ELAEKTMKE

SEQ ID NO: 467314 - protein, 9 aa, Influenza virus
ELAERAMKE

SEQ ID NO: 467315 - protein, 9 aa, Influenza virus
ELCPKPLKL

SEQ ID NO: 467316 - protein, 9 aa, Influenza virus
ELCPSPLKL

SEQ ID NO: 467317 - protein, 9 aa, Influenza virus
ELCPSPLRL

SEQ ID NO: 467318 - protein, 9 aa, Influenza virus
ELCSSPLRL

SEQ ID NO: 467319 - protein, 9 aa, Influenza virus
ELCTINSWH

SEQ ID NO: 467320 - protein, 9 aa, Influenza virus
ELDEIGEDI

SEQ ID NO: 467321 - protein, 9 aa, Influenza virus
ELDEIGEDL

SEQ ID NO: 467322 - protein, 9 aa, Influenza virus
ELDEIGEDV

SEQ ID NO: 467323 - protein, 9 aa, Influenza virus
ELDNNGELR

SEQ ID NO: 467324 - protein, 9 aa, Influenza virus
ELEIGARIG

SEQ ID NO: 467325 - protein, 9 aa, Influenza virus
ELEIGTRIG

SEQ ID NO: 467326 - protein, 9 aa, Influenza virus
ELFHKCDDD

SEQ ID NO: 467327 - protein, 9 aa, Influenza virus
ELFVLMENE

SEQ ID NO: 467328 - protein, 9 aa, Influenza virus
ELGAPLVLD

SEQ ID NO: 467329 - protein, 9 aa, Influenza virus
ELGDAPFLD

SEQ ID NO: 467330 - protein, 9 aa, Influenza virus
ELGDCSIAG

SEQ ID NO: 467331 - protein, 9 aa, Influenza virus
ELGDCSITG

SEQ ID NO: 467332 - protein, 9 aa, Influenza virus
ELGIPFHLG

SEQ ID NO: 467333 - protein, 9 aa, Influenza virus
ELGNGCFEF

SEQ ID NO: 467334 - protein, 9 aa, Influenza virus
ELGSPLVLD

SEQ ID NO: 467335 - protein, 9 aa, Influenza virus
ELGVPFHLA

SEQ ID NO: 467336 - protein, 9 aa, Influenza virus
ELGVPFHLG

SEQ ID NO: 467337 - protein, 9 aa, Influenza virus
ELGVPFYLG

SEQ ID NO: 467338 - protein, 9 aa, Influenza virus
ELGVSFHLG

SEQ ID NO: 467339 - protein, 9 aa, Influenza virus
ELIDNEFNE

SEQ ID NO: 467340 - protein, 9 aa, Influenza virus
ELIDNEFSE

SEQ ID NO: 467341 - protein, 9 aa, Influenza virus
ELIDNEFTE

SEQ ID NO: 467342 - protein, 9 aa, Influenza virus
ELIDSEFNE

SEQ ID NO: 467343 - protein, 9 aa, Influenza virus
ELIGKTSWS

SEQ ID NO: 467344 - protein, 9 aa, Influenza virus
ELINNEFNE

SEQ ID NO: 467345 - protein, 9 aa, Influenza virus
ELINPNKWG

SEQ ID NO: 467346 - protein, 9 aa, Influenza virus
ELINPSKWG

SEQ ID NO: 467347 - protein, 9 aa, Influenza virus
ELIPPSKWG

SEQ ID NO: 467348 - protein, 9 aa, Influenza virus
ELIRGMPKE

SEQ ID NO: 467349 - protein, 9 aa, Influenza virus
ELIRGMPQE

SEQ ID NO: 467350 - protein, 9 aa, Influenza virus
ELIRGQPKE

SEQ ID NO: 467351 - protein, 9 aa, Influenza virus
ELIRGRKQE

SEQ ID NO: 467352 - protein, 9 aa, Influenza virus
ELIRGRPEE

SEQ ID NO: 467353 - protein, 9 aa, Influenza virus
ELIRGRPKE

SEQ ID NO: 467354 - protein, 9 aa, Influenza virus
ELIRGRPQE

SEQ ID NO: 467355 - protein, 9 aa, Influenza virus
ELIRGRPRE

SEQ ID NO: 467356 - protein, 9 aa, Influenza virus
ELIRGRQQE

SEQ ID NO: 467357 - protein, 9 aa, Influenza virus
ELIRGRSQE

SEQ ID NO: 467358 - protein, 9 aa, Influenza virus
ELIRMIKRG

SEQ ID NO: 467359 - protein, 9 aa, Influenza virus
ELIRMVKRG

SEQ ID NO: 467360 - protein, 9 aa, Influenza virus
ELISPNKWG

SEQ ID NO: 467361 - protein, 9 aa, Influenza virus
ELISPSKWG

SEQ ID NO: 467362 - protein, 9 aa, Influenza virus
ELIVLLENQ

SEQ ID NO: 467363 - protein, 9 aa, Influenza virus
ELKEQLSTV

SEQ ID NO: 467364 - protein, 9 aa, Influenza virus
ELKHLLNRI

SEQ ID NO: 467365 - protein, 9 aa, Influenza virus
ELKHLLSRI

SEQ ID NO: 467366 - protein, 9 aa, Influenza virus
ELKHLLSRT

SEQ ID NO: 467367 - protein, 9 aa, Influenza virus
ELKHLLSST

SEQ ID NO: 467368 - protein, 9 aa, Influenza virus
ELKHLMSST

SEQ ID NO: 467369 - protein, 9 aa, Influenza virus
ELKSLFSSI

SEQ ID NO: 467370 - protein, 9 aa, Influenza virus
ELKWLISKS

SEQ ID NO: 467371 - protein, 9 aa, Influenza virus
ELKWLVSKD

SEQ ID NO: 467372 - protein, 9 aa, Influenza virus
ELKWLVSKN

SEQ ID NO: 467373 - protein, 9 aa, Influenza virus
ELKWLVSKS

SEQ ID NO: 467374 - protein, 9 aa, Influenza virus
ELKWLVSKT

SEQ ID NO: 467375 - protein, 9 aa, Influenza virus
ELLHKCNDS

SEQ ID NO: 467376 - protein, 9 aa, Influenza virus
ELLHKCNNS

SEQ ID NO: 467377 - protein, 9 aa, Influenza virus
ELLHKCNNT

SEQ ID NO: 467378 - protein, 9 aa, Influenza virus
ELLIAMENQ

SEQ ID NO: 467379 - protein, 9 aa, Influenza virus
ELLILLENE

SEQ ID NO: 467380 - protein, 9 aa, Influenza virus
ELLVALENQ

SEQ ID NO: 467381 - protein, 9 aa, Influenza virus
ELLVAMENQ

SEQ ID NO: 467382 - protein, 9 aa, Influenza virus
ELLVLIENE

SEQ ID NO: 467383 - protein, 9 aa, Influenza virus
ELLVLIENQ

SEQ ID NO: 467384 - protein, 9 aa, Influenza virus
ELLVLLENE

SEQ ID NO: 467385 - protein, 9 aa, Influenza virus
ELLVLLENG

SEQ ID NO: 467386 - protein, 9 aa, Influenza virus
ELLVLLENQ

SEQ ID NO: 467387 - protein, 9 aa, Influenza virus
ELLVLLGNQ

SEQ ID NO: 467388 - protein, 9 aa, Influenza virus
ELLVLMENE

SEQ ID NO: 467389 - protein, 9 aa, Influenza virus
ELNNNGELR

SEQ ID NO: 467390 - protein, 9 aa, Influenza virus
ELPFQNLSP

SEQ ID NO: 467391 - protein, 9 aa, Influenza virus
ELPFTIDKS

SEQ ID NO: 467392 - protein, 9 aa, Influenza virus
ELPFTIDKY

SEQ ID NO: 467393 - protein, 9 aa, Influenza virus
ELPSFGVSG

SEQ ID NO: 467394 - protein, 9 aa, Influenza virus
ELRDCKIEA

SEQ ID NO: 467395 - protein, 9 aa, Influenza virus
ELRDCKVEA

SEQ ID NO: 467396 - protein, 9 aa, Influenza virus
ELRDCSIAG

SEQ ID NO: 467397 - protein, 9 aa, Influenza virus
ELREHLSSV

SEQ ID NO: 467398 - protein, 9 aa, Influenza virus
ELREQLSSV

SEQ ID NO: 467399 - protein, 9 aa, Influenza virus
ELREQLSTV

SEQ ID NO: 467400 - protein, 9 aa, Influenza virus
ELRFLFSSI

SEQ ID NO: 467401 - protein, 9 aa, Influenza virus
ELRFVFSIA

SEQ ID NO: 467402 - protein, 9 aa, Influenza virus
ELRFVFSNA

SEQ ID NO: 467403 - protein, 9 aa, Influenza virus
ELRFVFSSA

SEQ ID NO: 467404 - protein, 9 aa, Influenza virus
ELRHLFSGI

SEQ ID NO: 467405 - protein, 9 aa, Influenza virus
ELRHLFSGV

SEQ ID NO: 467406 - protein, 9 aa, Influenza virus
ELRRCLLQS

SEQ ID NO: 467407 - protein, 9 aa, Influenza virus
ELRRIWRQA

SEQ ID NO: 467408 - protein, 9 aa, Influenza virus
ELRRQKSLI

SEQ ID NO: 467409 - protein, 9 aa, Influenza virus
ELRRQKWWV

SEQ ID NO: 467410 - protein, 9 aa, Influenza virus
ELRSGYWAI

SEQ ID NO: 467411 - protein, 9 aa, Influenza virus
ELRSKYWAI

SEQ ID NO: 467412 - protein, 9 aa, Influenza virus
ELRSLFSSI

SEQ ID NO: 467413 - protein, 9 aa, Influenza virus
ELRSRYWAI

SEQ ID NO: 467414 - protein, 9 aa, Influenza virus
ELSFTITGD

SEQ ID NO: 467415 - protein, 9 aa, Influenza virus
ELSFTVTGD

SEQ ID NO: 467416 - protein, 9 aa, Influenza virus
ELSSGYKDV

SEQ ID NO: 467417 - protein, 9 aa, Influenza virus
ELSSMGVYQ

SEQ ID NO: 467418 - protein, 9 aa, Influenza virus
ELVETNHTD

SEQ ID NO: 467419 - protein, 9 aa, Influenza virus
ELVHGGIDP

SEQ ID NO: 467420 - protein, 9 aa, Influenza virus
ELVHGGINP

SEQ ID NO: 467421 - protein, 9 aa, Influenza virus
ELVHGGVDP

SEQ ID NO: 467422 - protein, 9 aa, Influenza virus
ELVHGQVNP

SEQ ID NO: 467423 - protein, 9 aa, Influenza virus
ELVHRGIDP

SEQ ID NO: 467424 - protein, 9 aa, Influenza virus
ELVRGRPKE

SEQ ID NO: 467425 - protein, 9 aa, Influenza virus
ELVRKTRFL

SEQ ID NO: 467426 - protein, 9 aa, Influenza virus
ELVRMIKRG

SEQ ID NO: 467427 - protein, 9 aa, Influenza virus
ELWAYNAEL

SEQ ID NO: 467428 - protein, 9 aa, Influenza virus
ELWQCYYLL

SEQ ID NO: 467429 - protein, 9 aa, Influenza virus
ELWSYNAEL

SEQ ID NO: 467430 - protein, 9 aa, Influenza virus
ELYGTQSLS

SEQ ID NO: 467431 - protein, 9 aa, Influenza virus
EMCAAWSSS

SEQ ID NO: 467432 - protein, 9 aa, Influenza virus
EMCHGTQIG

SEQ ID NO: 467433 - protein, 9 aa, Influenza virus
EMCHSTQIG

SEQ ID NO: 467434 - protein, 9 aa, Influenza virus
EMCHSTRIG

SEQ ID NO: 467435 - protein, 9 aa, Influenza virus
EMDKLFERV

SEQ ID NO: 467436 - protein, 9 aa, Influenza virus
EMDKLYERV

SEQ ID NO: 467437 - protein, 9 aa, Influenza virus
EMDKLYTRV

SEQ ID NO: 467438 - protein, 9 aa, Influenza virus
EMEGICYPG

SEQ ID NO: 467439 - protein, 9 aa, Influenza virus
EMEGVCYPG

SEQ ID NO: 467440 - protein, 9 aa, Influenza virus
EMGLAPSPY

SEQ ID NO: 467441 - protein, 9 aa, Influenza virus
EMGNGCFEF

SEQ ID NO: 467442 - protein, 9 aa, Influenza virus
EMGNGCFKI

SEQ ID NO: 467443 - protein, 9 aa, Influenza virus
EMGQAPSPY

SEQ ID NO: 467444 - protein, 9 aa, Influenza virus
EMIDNEFNE

SEQ ID NO: 467445 - protein, 9 aa, Influenza virus
EMIRGEPEE

SEQ ID NO: 467446 - protein, 9 aa, Influenza virus
EMIRGKPEE

SEQ ID NO: 467447 - protein, 9 aa, Influenza virus
EMIRGKPKE

SEQ ID NO: 467448 - protein, 9 aa, Influenza virus
EMIRGQPKE

SEQ ID NO: 467449 - protein, 9 aa, Influenza virus
EMIRGRPEE

SEQ ID NO: 467450 - protein, 9 aa, Influenza virus
EMIWDANGW

SEQ ID NO: 467451 - protein, 9 aa, Influenza virus
EMIWDPDGW

SEQ ID NO: 467452 - protein, 9 aa, Influenza virus
EMIWDPNGW

SEQ ID NO: 467453 - protein, 9 aa, Influenza virus
EMKKLYERV

SEQ ID NO: 467454 - protein, 9 aa, Influenza virus
EMKWLLSNA

SEQ ID NO: 467455 - protein, 9 aa, Influenza virus
EMKWLLSNN

SEQ ID NO: 467456 - protein, 9 aa, Influenza virus
EMKWLLSNS

SEQ ID NO: 467457 - protein, 9 aa, Influenza virus
EMKWLLSNT

SEQ ID NO: 467458 - protein, 9 aa, Influenza virus
EMKWLLSSK

SEQ ID NO: 467459 - protein, 9 aa, Influenza virus
EMKWLLSSS

SEQ ID NO: 467460 - protein, 9 aa, Influenza virus
EMKWLLSST

SEQ ID NO: 467461 - protein, 9 aa, Influenza virus
EMKWLSSSG

SEQ ID NO: 467462 - protein, 9 aa, Influenza virus
EMKWLSSSM

SEQ ID NO: 467463 - protein, 9 aa, Influenza virus
EMLKIHNAG

SEQ ID NO: 467464 - protein, 9 aa, Influenza virus
EMLKIPNAE

SEQ ID NO: 467465 - protein, 9 aa, Influenza virus
EMLKIPNAG

SEQ ID NO: 467466 - protein, 9 aa, Influenza virus
EMLKVPDAE

SEQ ID NO: 467467 - protein, 9 aa, Influenza virus
EMLKVPNAE

SEQ ID NO: 467468 - protein, 9 aa, Influenza virus
EMLKVPNAG

SEQ ID NO: 467469 - protein, 9 aa, Influenza virus
EMLKVPNAL

SEQ ID NO: 467470 - protein, 9 aa, Influenza virus
EMLNLYDRV

SEQ ID NO: 467471 - protein, 9 aa, Influenza virus
EMLNLYERV

SEQ ID NO: 467472 - protein, 9 aa, Influenza virus
EMLRIPNAG

SEQ ID NO: 467473 - protein, 9 aa, Influenza virus
EMLTGNLQT

SEQ ID NO: 467474 - protein, 9 aa, Influenza virus
EMNKLFEKT

SEQ ID NO: 467475 - protein, 9 aa, Influenza virus
EMNKLFERT

SEQ ID NO: 467476 - protein, 9 aa, Influenza virus
EMNKLFERV

SEQ ID NO: 467477 - protein, 9 aa, Influenza virus
EMNKLYEKV

SEQ ID NO: 467478 - protein, 9 aa, Influenza virus
EMNKLYERV

SEQ ID NO: 467479 - protein, 9 aa, Influenza virus
EMNRLFERV

SEQ ID NO: 467480 - protein, 9 aa, Influenza virus
EMRRCLLQS

SEQ ID NO: 467481 - protein, 9 aa, Influenza virus
EMRTFSFQL

SEQ ID NO: 467482 - protein, 9 aa, Influenza virus
EMSFQGRGV

SEQ ID NO: 467483 - protein, 9 aa, Influenza virus
EMSKLFEKT

SEQ ID NO: 467484 - protein, 9 aa, Influenza virus
EMSKLFERT

SEQ ID NO: 467485 - protein, 9 aa, Influenza virus
EMSKLFERV

SEQ ID NO: 467486 - protein, 9 aa, Influenza virus
EMSKLYERV

SEQ ID NO: 467487 - protein, 9 aa, Influenza virus
EMTDSEMLN

SEQ ID NO: 467488 - protein, 9 aa, Influenza virus
EMTFHGAKE

SEQ ID NO: 467489 - protein, 9 aa, Influenza virus
EMTLDFHDS

SEQ ID NO: 467490 - protein, 9 aa, Influenza virus
EMVWDANGW

SEQ ID NO: 467491 - protein, 9 aa, Influenza virus
EMVWDPNGW

SEQ ID NO: 467492 - protein, 9 aa, Influenza virus
EMWPIGESP

SEQ ID NO: 467493 - protein, 9 aa, Influenza virus
EMWSYNAEL

SEQ ID NO: 467494 - protein, 9 aa, Influenza virus
EMYNETVRV

SEQ ID NO: 467495 - protein, 9 aa, Influenza virus
ENAEDIGNG

SEQ ID NO: 467496 - protein, 9 aa, Influenza virus
ENAEDKGNG

SEQ ID NO: 467497 - protein, 9 aa, Influenza virus
ENAEDMGDG

SEQ ID NO: 467498 - protein, 9 aa, Influenza virus
ENAEDMGGG

SEQ ID NO: 467499 - protein, 9 aa, Influenza virus
ENAEDMGNG

SEQ ID NO: 467500 - protein, 9 aa, Influenza virus
ENAEDQGNG

SEQ ID NO: 467501 - protein, 9 aa, Influenza virus
ENAEDRGNG

SEQ ID NO: 467502 - protein, 9 aa, Influenza virus
ENAEEDCTG

SEQ ID NO: 467503 - protein, 9 aa, Influenza virus
ENAEEDGNG

SEQ ID NO: 467504 - protein, 9 aa, Influenza virus
ENAEEDGTG

SEQ ID NO: 467505 - protein, 9 aa, Influenza virus
ENAEEMGNG

SEQ ID NO: 467506 - protein, 9 aa, Influenza virus
ENAIDAGDG

SEQ ID NO: 467507 - protein, 9 aa, Influenza virus
ENAIDNGDG

SEQ ID NO: 467508 - protein, 9 aa, Influenza virus
ENAIDTGDG

SEQ ID NO: 467509 - protein, 9 aa, Influenza virus
ENALDTGDG

SEQ ID NO: 467510 - protein, 9 aa, Influenza virus
ENATASFIY

SEQ ID NO: 467511 - protein, 9 aa, Influenza virus
ENATATVYY

SEQ ID NO: 467512 - protein, 9 aa, Influenza virus
ENAVDTGDG

SEQ ID NO: 467513 - protein, 9 aa, Influenza virus
ENDKTLDLH

SEQ ID NO: 467514 - protein, 9 aa, Influenza virus
ENDKTLDMH

SEQ ID NO: 467515 - protein, 9 aa, Influenza virus
ENDKTLNMH

SEQ ID NO: 467516 - protein, 9 aa, Influenza virus
ENDRTLDLH

SEQ ID NO: 467517 - protein, 9 aa, Influenza virus
ENDVPVTSS

SEQ ID NO: 467518 - protein, 9 aa, Influenza virus
ENDVWMGRT

SEQ ID NO: 467519 - protein, 9 aa, Influenza virus
ENEKTLDLH

SEQ ID NO: 467520 - protein, 9 aa, Influenza virus
ENEMTLDFH

SEQ ID NO: 467521 - protein, 9 aa, Influenza virus
ENERTLDFH

SEQ ID NO: 467522 - protein, 9 aa, Influenza virus
ENERTLDLH

SEQ ID NO: 467523 - protein, 9 aa, Influenza virus
ENERTLDMH

SEQ ID NO: 467524 - protein, 9 aa, Influenza virus
ENERTLDQH

SEQ ID NO: 467525 - protein, 9 aa, Influenza virus
ENERTLDYH

SEQ ID NO: 467526 - protein, 9 aa, Influenza virus
ENERTLGFH

SEQ ID NO: 467527 - protein, 9 aa, Influenza virus
ENERTLYFH

SEQ ID NO: 467528 - protein, 9 aa, Influenza virus
ENFVRQCFN

SEQ ID NO: 467529 - protein, 9 aa, Influenza virus
ENGDIIFLW

SEQ ID NO: 467530 - protein, 9 aa, Influenza virus
ENGNGCFEL

SEQ ID NO: 467531 - protein, 9 aa, Influenza virus
ENGRTLDLH

SEQ ID NO: 467532 - protein, 9 aa, Influenza virus
ENGRTLDMH

SEQ ID NO: 467533 - protein, 9 aa, Influenza virus
ENGRTLGLH

SEQ ID NO: 467534 - protein, 9 aa, Influenza virus
ENGTSVKTL

SEQ ID NO: 467535 - protein, 9 aa, Influenza virus
ENGTYDYPK

SEQ ID NO: 467536 - protein, 9 aa, Influenza virus
ENGVPVTSS

SEQ ID NO: 467537 - protein, 9 aa, Influenza virus
ENGVPVTST

SEQ ID NO: 467538 - protein, 9 aa, Influenza virus
ENGWEGLID

SEQ ID NO: 467539 - protein, 9 aa, Influenza virus
ENGWEGLIN

SEQ ID NO: 467540 - protein, 9 aa, Influenza virus
ENGWEGLVD

SEQ ID NO: 467541 - protein, 9 aa, Influenza virus
ENGWEGMID

SEQ ID NO: 467542 - protein, 9 aa, Influenza virus
ENGWEGMMD

SEQ ID NO: 467543 - protein, 9 aa, Influenza virus
ENGWEGMVD

SEQ ID NO: 467544 - protein, 9 aa, Influenza virus
ENGWEGMVN

SEQ ID NO: 467545 - protein, 9 aa, Influenza virus
ENGWQGLID

SEQ ID NO: 467546 - protein, 9 aa, Influenza virus
ENIAPEKVD

SEQ ID NO: 467547 - protein, 9 aa, Influenza virus
ENKHSNGTK

SEQ ID NO: 467548 - protein, 9 aa, Influenza virus
ENKKYGPAL

SEQ ID NO: 467549 - protein, 9 aa, Influenza virus
ENKRYGPAL

SEQ ID NO: 467550 - protein, 9 aa, Influenza virus
ENKYVNNTT

SEQ ID NO: 467551 - protein, 9 aa, Influenza virus
ENLDKKMED

SEQ ID NO: 467552 - protein, 9 aa, Influenza virus
ENLEELRFV

SEQ ID NO: 467553 - protein, 9 aa, Influenza virus
ENLFDEVRR

SEQ ID NO: 467554 - protein, 9 aa, Influenza virus
ENLIAPWYG

SEQ ID NO: 467555 - protein, 9 aa, Influenza virus
ENLNKKIDD

SEQ ID NO: 467556 - protein, 9 aa, Influenza virus
ENLNKKMED

SEQ ID NO: 467557 - protein, 9 aa, Influenza virus
ENLNKKVDD

SEQ ID NO: 467558 - protein, 9 aa, Influenza virus
ENLNKKVED

SEQ ID NO: 467559 - protein, 9 aa, Influenza virus
ENLNKRMED

SEQ ID NO: 467560 - protein, 9 aa, Influenza virus
ENLNKRVDD

SEQ ID NO: 467561 - protein, 9 aa, Influenza virus
ENLNRKMED

SEQ ID NO: 467562 - protein, 9 aa, Influenza virus
ENLNRKVDD

SEQ ID NO: 467563 - protein, 9 aa, Influenza virus
ENLQAYQKR

SEQ ID NO: 467564 - protein, 9 aa, Influenza virus
ENLQTYQKR

SEQ ID NO: 467565 - protein, 9 aa, Influenza virus
ENLWAYNAE

SEQ ID NO: 467566 - protein, 9 aa, Influenza virus
ENMAPEKID

SEQ ID NO: 467567 - protein, 9 aa, Influenza virus
ENMAPEKMD

SEQ ID NO: 467568 - protein, 9 aa, Influenza virus
ENMAPEKVD

SEQ ID NO: 467569 - protein, 9 aa, Influenza virus
ENNTWGNQT

SEQ ID NO: 467570 - protein, 9 aa, Influenza virus
ENNTWVNQT

SEQ ID NO: 467571 - protein, 9 aa, Influenza virus
ENNVPVTSS

SEQ ID NO: 467572 - protein, 9 aa, Influenza virus
ENNVTVTSS

SEQ ID NO: 467573 - protein, 9 aa, Influenza virus
ENPAHKSQL

SEQ ID NO: 467574 - protein, 9 aa, Influenza virus
ENPSAGKDP

SEQ ID NO: 467575 - protein, 9 aa, Influenza virus
ENPSHEGEG

SEQ ID NO: 467576 - protein, 9 aa, Influenza virus
ENPVHKSQL

SEQ ID NO: 467577 - protein, 9 aa, Influenza virus
ENQEELKSL

SEQ ID NO: 467578 - protein, 9 aa, Influenza virus
ENQEELRFL

SEQ ID NO: 467579 - protein, 9 aa, Influenza virus
ENQEELRSL

SEQ ID NO: 467580 - protein, 9 aa, Influenza virus
ENQHIIDLA

SEQ ID NO: 467581 - protein, 9 aa, Influenza virus
ENQHTIDLA

SEQ ID NO: 467582 - protein, 9 aa, Influenza virus
ENQHTIDLT

SEQ ID NO: 467583 - protein, 9 aa, Influenza virus
ENQHTIDMA

SEQ ID NO: 467584 - protein, 9 aa, Influenza virus
ENQHTIDMT

SEQ ID NO: 467585 - protein, 9 aa, Influenza virus
ENQHTIDVT

SEQ ID NO: 467586 - protein, 9 aa, Influenza virus
ENQHTIHLT

SEQ ID NO: 467587 - protein, 9 aa, Influenza virus
ENQKILDEH

SEQ ID NO: 467588 - protein, 9 aa, Influenza virus
ENQKPLDEH

SEQ ID NO: 467589 - protein, 9 aa, Influenza virus
ENQKTLDEH

SEQ ID NO: 467590 - protein, 9 aa, Influenza virus
ENQKTLDKH

SEQ ID NO: 467591 - protein, 9 aa, Influenza virus
ENQNPRIFL

SEQ ID NO: 467592 - protein, 9 aa, Influenza virus
ENQNPRMFL

SEQ ID NO: 467593 - protein, 9 aa, Influenza virus
ENQNPRVFL

SEQ ID NO: 467594 - protein, 9 aa, Influenza virus
ENRINMLAD

SEQ ID NO: 467595 - protein, 9 aa, Influenza virus
ENRMVIAST

SEQ ID NO: 467596 - protein, 9 aa, Influenza virus
ENRMVLAST

SEQ ID NO: 467597 - protein, 9 aa, Influenza virus
ENRVWWTSN

SEQ ID NO: 467598 - protein, 9 aa, Influenza virus
ENSDVLVTR

SEQ ID NO: 467599 - protein, 9 aa, Influenza virus
ENSFEQITF

SEQ ID NO: 467600 - protein, 9 aa, Influenza virus
ENSHPGIFE

SEQ ID NO: 467601 - protein, 9 aa, Influenza virus
ENSQGSGYA

SEQ ID NO: 467602 - protein, 9 aa, Influenza virus
ENSTYKILS

SEQ ID NO: 467603 - protein, 9 aa, Influenza virus
ENSVIEKMN

SEQ ID NO: 467604 - protein, 9 aa, Influenza virus
ENSVLWTSN

SEQ ID NO: 467605 - protein, 9 aa, Influenza virus
ENTGSYVRL

SEQ ID NO: 467606 - protein, 9 aa, Influenza virus
ENTHIHIFS

SEQ ID NO: 467607 - protein, 9 aa, Influenza virus
ENTSYKILS

SEQ ID NO: 467608 - protein, 9 aa, Influenza virus
ENTTWVNQT

SEQ ID NO: 467609 - protein, 9 aa, Influenza virus
ENTTYKILS

SEQ ID NO: 467610 - protein, 9 aa, Influenza virus
ENTTYRILS

SEQ ID NO: 467611 - protein, 9 aa, Influenza virus
ENTYVNKTT

SEQ ID NO: 467612 - protein, 9 aa, Influenza virus
ENTYVNNTT

SEQ ID NO: 467613 - protein, 9 aa, Influenza virus
EPALIVWGV

SEQ ID NO: 467614 - protein, 9 aa, Influenza virus
EPDECRFYA

SEQ ID NO: 467615 - protein, 9 aa, Influenza virus
EPDTYDFNE

SEQ ID NO: 467616 - protein, 9 aa, Influenza virus
EPFISCSHF

SEQ ID NO: 467617 - protein, 9 aa, Influenza virus
EPFISCSHL

SEQ ID NO: 467618 - protein, 9 aa, Influenza virus
EPFISCSHM

SEQ ID NO: 467619 - protein, 9 aa, Influenza virus
EPFISCSHS

SEQ ID NO: 467620 - protein, 9 aa, Influenza virus
EPFISCSPL

SEQ ID NO: 467621 - protein, 9 aa, Influenza virus
EPFISCSQL

SEQ ID NO: 467622 - protein, 9 aa, Influenza virus
EPFQSLIPK

SEQ ID NO: 467623 - protein, 9 aa, Influenza virus
EPFQSLVPK

SEQ ID NO: 467624 - protein, 9 aa, Influenza virus
EPFQSLVPR

SEQ ID NO: 467625 - protein, 9 aa, Influenza virus
EPFVACGPA

SEQ ID NO: 467626 - protein, 9 aa, Influenza virus
EPFVACGPS

SEQ ID NO: 467627 - protein, 9 aa, Influenza virus
EPFVACGPT

SEQ ID NO: 467628 - protein, 9 aa, Influenza virus
EPFVACSPS

SEQ ID NO: 467629 - protein, 9 aa, Influenza virus
EPFVSCGPS

SEQ ID NO: 467630 - protein, 9 aa, Influenza virus
EPFVSCSHL

SEQ ID NO: 467631 - protein, 9 aa, Influenza virus
EPGSGDWPD

SEQ ID NO: 467632 - protein, 9 aa, Influenza virus
EPGSGNWPD

SEQ ID NO: 467633 - protein, 9 aa, Influenza virus
EPGTFDIEG

SEQ ID NO: 467634 - protein, 9 aa, Influenza virus
EPGTFDIGG

SEQ ID NO: 467635 - protein, 9 aa, Influenza virus
EPGTFDLEG

SEQ ID NO: 467636 - protein, 9 aa, Influenza virus
EPGTFDLGG

SEQ ID NO: 467637 - protein, 9 aa, Influenza virus
EPGVKGFGF

SEQ ID NO: 467638 - protein, 9 aa, Influenza virus
EPISLGDCS

SEQ ID NO: 467639 - protein, 9 aa, Influenza virus
EPKGLFGAI

SEQ ID NO: 467640 - protein, 9 aa, Influenza virus
EPLCDVSGF

SEQ ID NO: 467641 - protein, 9 aa, Influenza virus
EPLCEVSGF

SEQ ID NO: 467642 - protein, 9 aa, Influenza virus
EPLCNVSGF

SEQ ID NO: 467643 - protein, 9 aa, Influenza virus
EPLKGSAKH

SEQ ID NO: 467644 - protein, 9 aa, Influenza virus
EPMGFRYSG

SEQ ID NO: 467645 - protein, 9 aa, Influenza virus
EPNGCIEGK

SEQ ID NO: 467646 - protein, 9 aa, Influenza virus
EPNGCIESK

SEQ ID NO: 467647 - protein, 9 aa, Influenza virus
EPNGSIEGK

SEQ ID NO: 467648 - protein, 9 aa, Influenza virus
EPNGYIEGK

SEQ ID NO: 467649 - protein, 9 aa, Influenza virus
EPRGLFGAI

SEQ ID NO: 467650 - protein, 9 aa, Influenza virus
EPSGYAQTD

SEQ ID NO: 467651 - protein, 9 aa, Influenza virus
EPTGYAQTD

SEQ ID NO: 467652 - protein, 9 aa, Influenza virus
EPYPGNNNN

SEQ ID NO: 467653 - protein, 9 aa, Influenza virus
EPYVSCDPD

SEQ ID NO: 467654 - protein, 9 aa, Influenza virus
EPYVSCDPI

SEQ ID NO: 467655 - protein, 9 aa, Influenza virus
EPYVSCDPK

SEQ ID NO: 467656 - protein, 9 aa, Influenza virus
EPYVSCDPL

SEQ ID NO: 467657 - protein, 9 aa, Influenza virus
EPYVSCDPN

SEQ ID NO: 467658 - protein, 9 aa, Influenza virus
EPYVSCDPS

SEQ ID NO: 467659 - protein, 9 aa, Influenza virus
EPYVSCDPT

SEQ ID NO: 467660 - protein, 9 aa, Influenza virus
EPYVSCEPD

SEQ ID NO: 467661 - protein, 9 aa, Influenza virus
EQAAEAIEV

SEQ ID NO: 467662 - protein, 9 aa, Influenza virus
EQAAEAMDI

SEQ ID NO: 467663 - protein, 9 aa, Influenza virus
EQAAEAMEI

SEQ ID NO: 467664 - protein, 9 aa, Influenza virus
EQAAEAMEV

SEQ ID NO: 467665 - protein, 9 aa, Influenza virus
EQAKLYGSG

SEQ ID NO: 467666 - protein, 9 aa, Influenza virus
EQAVDICKA

SEQ ID NO: 467667 - protein, 9 aa, Influenza virus
EQAVGICKA

SEQ ID NO: 467668 - protein, 9 aa, Influenza virus
EQAVNICKA

SEQ ID NO: 467669 - protein, 9 aa, Influenza virus
EQEEVTNAT

SEQ ID NO: 467670 - protein, 9 aa, Influenza virus
EQFPVQTDE

SEQ ID NO: 467671 - protein, 9 aa, Influenza virus
EQFTWNGVK

SEQ ID NO: 467672 - protein, 9 aa, Influenza virus
EQGMGMAAD

SEQ ID NO: 467673 - protein, 9 aa, Influenza virus
EQGSGFAAD

SEQ ID NO: 467674 - protein, 9 aa, Influenza virus
EQGSGYAAD

SEQ ID NO: 467675 - protein, 9 aa, Influenza virus
EQGSGYAAN

SEQ ID NO: 467676 - protein, 9 aa, Influenza virus
EQGTGIAAD

SEQ ID NO: 467677 - protein, 9 aa, Influenza virus
EQGTGIAAE

SEQ ID NO: 467678 - protein, 9 aa, Influenza virus
EQGVGIAAD

SEQ ID NO: 467679 - protein, 9 aa, Influenza virus
EQGVGMAAD

SEQ ID NO: 467680 - protein, 9 aa, Influenza virus
EQGYGYAAD

SEQ ID NO: 467681 - protein, 9 aa, Influenza virus
EQIADAQHR

SEQ ID NO: 467682 - protein, 9 aa, Influenza virus
EQIADSHHR

SEQ ID NO: 467683 - protein, 9 aa, Influenza virus
EQIADSQHK

SEQ ID NO: 467684 - protein, 9 aa, Influenza virus
EQIADSQHR

SEQ ID NO: 467685 - protein, 9 aa, Influenza virus
EQIIVTREP

SEQ ID NO: 467686 - protein, 9 aa, Influenza virus
EQIKLYGSG

SEQ ID NO: 467687 - protein, 9 aa, Influenza virus
EQITFLQAL

SEQ ID NO: 467688 - protein, 9 aa, Influenza virus
EQITFMQAL

SEQ ID NO: 467689 - protein, 9 aa, Influenza virus
EQIVVTREP

SEQ ID NO: 467690 - protein, 9 aa, Influenza virus
EQKQEFKMN

SEQ ID NO: 467691 - protein, 9 aa, Influenza virus
EQKVPVTQT

SEQ ID NO: 467692 - protein, 9 aa, Influenza virus
EQLGSWSWH

SEQ ID NO: 467693 - protein, 9 aa, Influenza virus
EQLSQKFEE

SEQ ID NO: 467694 - protein, 9 aa, Influenza virus
EQLSSVSSF

SEQ ID NO: 467695 - protein, 9 aa, Influenza virus
EQLSTVSSF

SEQ ID NO: 467696 - protein, 9 aa, Influenza virus
EQLYTPGGE

SEQ ID NO: 467697 - protein, 9 aa, Influenza virus
EQMAGSSEQ

SEQ ID NO: 467698 - protein, 9 aa, Influenza virus
EQMETDGDR

SEQ ID NO: 467699 - protein, 9 aa, Influenza virus
EQMETDGER

SEQ ID NO: 467700 - protein, 9 aa, Influenza virus
EQMETGGER

SEQ ID NO: 467701 - protein, 9 aa, Influenza virus
EQMETSGER

SEQ ID NO: 467702 - protein, 9 aa, Influenza virus
EQMYQKCCN

SEQ ID NO: 467703 - protein, 9 aa, Influenza virus
EQMYQKCCS

SEQ ID NO: 467704 - protein, 9 aa, Influenza virus
EQMYQKCCT

SEQ ID NO: 467705 - protein, 9 aa, Influenza virus
EQMYQRCCN

SEQ ID NO: 467706 - protein, 9 aa, Influenza virus
EQMYTPGGE

SEQ ID NO: 467707 - protein, 9 aa, Influenza virus
EQMYTPGGG

SEQ ID NO: 467708 - protein, 9 aa, Influenza virus
EQMYTPGGK

SEQ ID NO: 467709 - protein, 9 aa, Influenza virus
EQNFPQTTN

SEQ ID NO: 467710 - protein, 9 aa, Influenza virus
EQNIPVTQT

SEQ ID NO: 467711 - protein, 9 aa, Influenza virus
EQNIPVTQV

SEQ ID NO: 467712 - protein, 9 aa, Influenza virus
EQNKLYGAG

SEQ ID NO: 467713 - protein, 9 aa, Influenza virus
EQNKLYGTG

SEQ ID NO: 467714 - protein, 9 aa, Influenza virus
EQNVPVTQA

SEQ ID NO: 467715 - protein, 9 aa, Influenza virus
EQNVPVTQT

SEQ ID NO: 467716 - protein, 9 aa, Influenza virus
EQNVPVTQV

SEQ ID NO: 467717 - protein, 9 aa, Influenza virus
EQNVTVTHA

SEQ ID NO: 467718 - protein, 9 aa, Influenza virus
EQQGRMDYY

SEQ ID NO: 467719 - protein, 9 aa, Influenza virus
EQQIGNVIN

SEQ ID NO: 467720 - protein, 9 aa, Influenza virus
EQRINMLAD

SEQ ID NO: 467721 - protein, 9 aa, Influenza virus
EQSGLPVGG

SEQ ID NO: 467722 - protein, 9 aa, Influenza virus
EQSKMQFSS

SEQ ID NO: 467723 - protein, 9 aa, Influenza virus
EQSRMQFSS

SEQ ID NO: 467724 - protein, 9 aa, Influenza virus
EQTALYKNA

SEQ ID NO: 467725 - protein, 9 aa, Influenza virus
EQTDLYKVA

SEQ ID NO: 467726 - protein, 9 aa, Influenza virus
EQTKLYGNG

SEQ ID NO: 467727 - protein, 9 aa, Influenza virus
EQTKLYGSG

SEQ ID NO: 467728 - protein, 9 aa, Influenza virus
EQTKLYKNT

SEQ ID NO: 467729 - protein, 9 aa, Influenza virus
EQTRLYGSG

SEQ ID NO: 467730 - protein, 9 aa, Influenza virus
EQTTLYKNA

SEQ ID NO: 467731 - protein, 9 aa, Influenza virus
EQVAGSSEQ

SEQ ID NO: 467732 - protein, 9 aa, Influenza virus
EQVDTIMEK

SEQ ID NO: 467733 - protein, 9 aa, Influenza virus
EQVDTIMER

SEQ ID NO: 467734 - protein, 9 aa, Influenza virus
EQVDTIREK

SEQ ID NO: 467735 - protein, 9 aa, Influenza virus
EQVEGRIQD

SEQ ID NO: 467736 - protein, 9 aa, Influenza virus
EQVEGRIQY

SEQ ID NO: 467737 - protein, 9 aa, Influenza virus
EQVEGRTQD

SEQ ID NO: 467738 - protein, 9 aa, Influenza virus
EQVIVTREP

SEQ ID NO: 467739 - protein, 9 aa, Influenza virus
EREAKLFVL

SEQ ID NO: 467740 - protein, 9 aa, Influenza virus
EREEVTNAT

SEQ ID NO: 467741 - protein, 9 aa, Influenza virus
EREGGRRRK

SEQ ID NO: 467742 - protein, 9 aa, Influenza virus
EREGYSLVG

SEQ ID NO: 467743 - protein, 9 aa, Influenza virus
ERELVRKTR

SEQ ID NO: 467744 - protein, 9 aa, Influenza virus
EREVEVVNA

SEQ ID NO: 467745 - protein, 9 aa, Influenza virus
ERGEDTIEE

SEQ ID NO: 467746 - protein, 9 aa, Influenza virus
ERGEETIEE

SEQ ID NO: 467747 - protein, 9 aa, Influenza virus
ERGEETVEE

SEQ ID NO: 467748 - protein, 9 aa, Influenza virus
ERGIEVVNA

SEQ ID NO: 467749 - protein, 9 aa, Influenza virus
ERGKLKRRA

SEQ ID NO: 467750 - protein, 9 aa, Influenza virus
ERGLFGAIA

SEQ ID NO: 467751 - protein, 9 aa, Influenza virus
ERGLQRRRF

SEQ ID NO: 467752 - protein, 9 aa, Influenza virus
ERGNHGVKG

SEQ ID NO: 467753 - protein, 9 aa, Influenza virus
ERGNPGVKG

SEQ ID NO: 467754 - protein, 9 aa, Influenza virus
ERGNQGVKG

SEQ ID NO: 467755 - protein, 9 aa, Influenza virus
ERGSPGVKG

SEQ ID NO: 467756 - protein, 9 aa, Influenza virus
ERGTKQEEN

SEQ ID NO: 467757 - protein, 9 aa, Influenza virus
ERGTQGVKG

SEQ ID NO: 467758 - protein, 9 aa, Influenza virus
ERGVEVVDA

SEQ ID NO: 467759 - protein, 9 aa, Influenza virus
ERGVEVVNA

SEQ ID NO: 467760 - protein, 9 aa, Influenza virus
ERILDFHDS

SEQ ID NO: 467761 - protein, 9 aa, Influenza virus
ERILEEESD

SEQ ID NO: 467762 - protein, 9 aa, Influenza virus
ERIMFESNG

SEQ ID NO: 467763 - protein, 9 aa, Influenza virus
ERIRNNTYD

SEQ ID NO: 467764 - protein, 9 aa, Influenza virus
ERITFESNG

SEQ ID NO: 467765 - protein, 9 aa, Influenza virus
ERITFESSG

SEQ ID NO: 467766 - protein, 9 aa, Influenza virus
ERLGSWSWH

SEQ ID NO: 467767 - protein, 9 aa, Influenza virus
ERLTITYSS

SEQ ID NO: 467768 - protein, 9 aa, Influenza virus
ERLVLATGL

SEQ ID NO: 467769 - protein, 9 aa, Influenza virus
ERMCNILKG

SEQ ID NO: 467770 - protein, 9 aa, Influenza virus
ERMVLSAFD

SEQ ID NO: 467771 - protein, 9 aa, Influenza virus
ERMYQKCCN

SEQ ID NO: 467772 - protein, 9 aa, Influenza virus
ERNALGDCP

SEQ ID NO: 467773 - protein, 9 aa, Influenza virus
ERNALGNCP

SEQ ID NO: 467774 - protein, 9 aa, Influenza virus
ERNDLYGTQ

SEQ ID NO: 467775 - protein, 9 aa, Influenza virus
ERNITEIVY

SEQ ID NO: 467776 - protein, 9 aa, Influenza virus
ERNSIWTSS

SEQ ID NO: 467777 - protein, 9 aa, Influenza virus
ERNVTETLY

SEQ ID NO: 467778 - protein, 9 aa, Influenza virus
ERNVTVTHA

SEQ ID NO: 467779 - protein, 9 aa, Influenza virus
ERNVTVTHS

SEQ ID NO: 467780 - protein, 9 aa, Influenza virus
ERPKEIEGI

SEQ ID NO: 467781 - protein, 9 aa, Influenza virus
ERPKEMEGI

SEQ ID NO: 467782 - protein, 9 aa, Influenza virus
ERPKEMEGV

SEQ ID NO: 467783 - protein, 9 aa, Influenza virus
ERPSAPEGM

SEQ ID NO: 467784 - protein, 9 aa, Influenza virus
ERPSIWTSS

SEQ ID NO: 467785 - protein, 9 aa, Influenza virus
ERPTAVDTC

SEQ ID NO: 467786 - protein, 9 aa, Influenza virus
ERQEIVDNN

SEQ ID NO: 467787 - protein, 9 aa, Influenza virus
ERQEIVDNR

SEQ ID NO: 467788 - protein, 9 aa, Influenza virus
ERQEIVDNS

SEQ ID NO: 467789 - protein, 9 aa, Influenza virus
ERQEIVGNN

SEQ ID NO: 467790 - protein, 9 aa, Influenza virus
ERQIGNVIN

SEQ ID NO: 467791 - protein, 9 aa, Influenza virus
ERQKINGVK

SEQ ID NO: 467792 - protein, 9 aa, Influenza virus
ERQKISGVK

SEQ ID NO: 467793 - protein, 9 aa, Influenza virus
ERQKVNGVK

SEQ ID NO: 467794 - protein, 9 aa, Influenza virus
ERQRINGVK

SEQ ID NO: 467795 - protein, 9 aa, Influenza virus
ERQTRGIFG

SEQ ID NO: 467796 - protein, 9 aa, Influenza virus
ERQTRGLFG

SEQ ID NO: 467797 - protein, 9 aa, Influenza virus
ERRIENLNK

SEQ ID NO: 467798 - protein, 9 aa, Influenza virus
ERRIENLNR

SEQ ID NO: 467799 - protein, 9 aa, Influenza virus
ERRIESLNK

SEQ ID NO: 467800 - protein, 9 aa, Influenza virus
ERRINMLAD

SEQ ID NO: 467801 - protein, 9 aa, Influenza virus
ERRLENLNK

SEQ ID NO: 467802 - protein, 9 aa, Influenza virus
ERRLTTTIK

SEQ ID NO: 467803 - protein, 9 aa, Influenza virus
ERRNKYLEE

SEQ ID NO: 467804 - protein, 9 aa, Influenza virus
ERRNRYLEE

SEQ ID NO: 467805 - protein, 9 aa, Influenza virus
ERRNSSDIC

SEQ ID NO: 467806 - protein, 9 aa, Influenza virus
ERRRKKRGL

SEQ ID NO: 467807 - protein, 9 aa, Influenza virus
ERSKINEVK

SEQ ID NO: 467808 - protein, 9 aa, Influenza virus
ERSKINGVI

SEQ ID NO: 467809 - protein, 9 aa, Influenza virus
ERSKINGVK

SEQ ID NO: 467810 - protein, 9 aa, Influenza virus
ERSKINGVR

SEQ ID NO: 467811 - protein, 9 aa, Influenza virus
ERTHIHIFS

SEQ ID NO: 467812 - protein, 9 aa, Influenza virus
ERTHNGKLC

SEQ ID NO: 467813 - protein, 9 aa, Influenza virus
ERTIWTSGS

SEQ ID NO: 467814 - protein, 9 aa, Influenza virus
ERTKEMEGI

SEQ ID NO: 467815 - protein, 9 aa, Influenza virus
ERTLDFHDF

SEQ ID NO: 467816 - protein, 9 aa, Influenza virus
ERTLDFHDL

SEQ ID NO: 467817 - protein, 9 aa, Influenza virus
ERTLDFHDS

SEQ ID NO: 467818 - protein, 9 aa, Influenza virus
ERTLDLHDA

SEQ ID NO: 467819 - protein, 9 aa, Influenza virus
ERTLDLHDS

SEQ ID NO: 467820 - protein, 9 aa, Influenza virus
ERTLDMHDA

SEQ ID NO: 467821 - protein, 9 aa, Influenza virus
ERTLDQHDA

SEQ ID NO: 467822 - protein, 9 aa, Influenza virus
ERTLDYHDF

SEQ ID NO: 467823 - protein, 9 aa, Influenza virus
ERTLDYHDS

SEQ ID NO: 467824 - protein, 9 aa, Influenza virus
ERTLYFHDS

SEQ ID NO: 467825 - protein, 9 aa, Influenza virus
ERTNEKFHQ

SEQ ID NO: 467826 - protein, 9 aa, Influenza virus
ERTNEKYHQ

SEQ ID NO: 467827 - protein, 9 aa, Influenza virus
ERTNQQFEL

SEQ ID NO: 467828 - protein, 9 aa, Influenza virus
ERTSIWTSS

SEQ ID NO: 467829 - protein, 9 aa, Influenza virus
ERTTFESNG

SEQ ID NO: 467830 - protein, 9 aa, Influenza virus
ERVDTIIES

SEQ ID NO: 467831 - protein, 9 aa, Influenza virus
ERVDTIMEK

SEQ ID NO: 467832 - protein, 9 aa, Influenza virus
ERVDTLLEN

SEQ ID NO: 467833 - protein, 9 aa, Influenza virus
ERVKKQLRE

SEQ ID NO: 467834 - protein, 9 aa, Influenza virus
ERVKMFDFI

SEQ ID NO: 467835 - protein, 9 aa, Influenza virus
ERVKMFDFS

SEQ ID NO: 467836 - protein, 9 aa, Influenza virus
ERVKMFDFT

SEQ ID NO: 467837 - protein, 9 aa, Influenza virus
ERVKRQLRE

SEQ ID NO: 467838 - protein, 9 aa, Influenza virus
ERVRHQLRE

SEQ ID NO: 467839 - protein, 9 aa, Influenza virus
ERVRKQLRE

SEQ ID NO: 467840 - protein, 9 aa, Influenza virus
ERVRKQLRQ

SEQ ID NO: 467841 - protein, 9 aa, Influenza virus
ERVRNGTYD

SEQ ID NO: 467842 - protein, 9 aa, Influenza virus
ERVRRQLRE

SEQ ID NO: 467843 - protein, 9 aa, Influenza virus
ERYVEDTKI

SEQ ID NO: 467844 - protein, 9 aa, Influenza virus
ESADMSIGI

SEQ ID NO: 467845 - protein, 9 aa, Influenza virus
ESADMSIGV

SEQ ID NO: 467846 - protein, 9 aa, Influenza virus
ESAVLRGFL

SEQ ID NO: 467847 - protein, 9 aa, Influenza virus
ESCEGECFY

SEQ ID NO: 467848 - protein, 9 aa, Influenza virus
ESDEALKMT

SEQ ID NO: 467849 - protein, 9 aa, Influenza virus
ESDGAFLAP

SEQ ID NO: 467850 - protein, 9 aa, Influenza virus
ESDVPVTSS

SEQ ID NO: 467851 - protein, 9 aa, Influenza virus
ESECACANG

SEQ ID NO: 467852 - protein, 9 aa, Influenza virus
ESECACING

SEQ ID NO: 467853 - protein, 9 aa, Influenza virus
ESECACVNG

SEQ ID NO: 467854 - protein, 9 aa, Influenza virus
ESECICING

SEQ ID NO: 467855 - protein, 9 aa, Influenza virus
ESECQCIDG

SEQ ID NO: 467856 - protein, 9 aa, Influenza virus
ESECQCIGG

SEQ ID NO: 467857 - protein, 9 aa, Influenza virus
ESECQCISG

SEQ ID NO: 467858 - protein, 9 aa, Influenza virus
ESECQCLYG

SEQ ID NO: 467859 - protein, 9 aa, Influenza virus
ESECQRIDG

SEQ ID NO: 467860 - protein, 9 aa, Influenza virus
ESECVCHKG

SEQ ID NO: 467861 - protein, 9 aa, Influenza virus
ESECVCHNG

SEQ ID NO: 467862 - protein, 9 aa, Influenza virus
ESECVCHNS

SEQ ID NO: 467863 - protein, 9 aa, Influenza virus
ESECVCHSG

SEQ ID NO: 467864 - protein, 9 aa, Influenza virus
ESECVCIDG

SEQ ID NO: 467865 - protein, 9 aa, Influenza virus
ESECVCINE

SEQ ID NO: 467866 - protein, 9 aa, Influenza virus
ESECVCING

SEQ ID NO: 467867 - protein, 9 aa, Influenza virus
ESECVCISG

SEQ ID NO: 467868 - protein, 9 aa, Influenza virus
ESECVCMNG

SEQ ID NO: 467869 - protein, 9 aa, Influenza virus
ESECVCQDE

SEQ ID NO: 467870 - protein, 9 aa, Influenza virus
ESECVCVNG

SEQ ID NO: 467871 - protein, 9 aa, Influenza virus
ESECVRHNG

SEQ ID NO: 467872 - protein, 9 aa, Influenza virus
ESEFNEIEH

SEQ ID NO: 467873 - protein, 9 aa, Influenza virus
ESEFNEIEY

SEQ ID NO: 467874 - protein, 9 aa, Influenza virus
ESEFSEIEH

SEQ ID NO: 467875 - protein, 9 aa, Influenza virus
ESEFSETEH

SEQ ID NO: 467876 - protein, 9 aa, Influenza virus
ESEMNKLYE

SEQ ID NO: 467877 - protein, 9 aa, Influenza virus
ESEQIIVTR

SEQ ID NO: 467878 - protein, 9 aa, Influenza virus
ESEQIVVTR

SEQ ID NO: 467879 - protein, 9 aa, Influenza virus
ESEQVIVTR

SEQ ID NO: 467880 - protein, 9 aa, Influenza virus
ESGGIDKEP

SEQ ID NO: 467881 - protein, 9 aa, Influenza virus
ESGGIDKES

SEQ ID NO: 467882 - protein, 9 aa, Influenza virus
ESGGIDKIG

SEQ ID NO: 467883 - protein, 9 aa, Influenza virus
ESGGIDKIS

SEQ ID NO: 467884 - protein, 9 aa, Influenza virus
ESGGIDKVS

SEQ ID NO: 467885 - protein, 9 aa, Influenza virus
ESGGISKIS

SEQ ID NO: 467886 - protein, 9 aa, Influenza virus
ESGGISKMS

SEQ ID NO: 467887 - protein, 9 aa, Influenza virus
ESGRLIDFL

SEQ ID NO: 467888 - protein, 9 aa, Influenza virus
ESGRLMDFL

SEQ ID NO: 467889 - protein, 9 aa, Influenza virus
ESGVLWTSN

SEQ ID NO: 467890 - protein, 9 aa, Influenza virus
ESHCRIIQN

SEQ ID NO: 467891 - protein, 9 aa, Influenza virus
ESHGKIIQN

SEQ ID NO: 467892 - protein, 9 aa, Influenza virus
ESHGRIIQN

SEQ ID NO: 467893 - protein, 9 aa, Influenza virus
ESHGRTIQN

SEQ ID NO: 467894 - protein, 9 aa, Influenza virus
ESIAWSATA

SEQ ID NO: 467895 - protein, 9 aa, Influenza virus
ESIEECLIN

SEQ ID NO: 467896 - protein, 9 aa, Influenza virus
ESIESEFNE

SEQ ID NO: 467897 - protein, 9 aa, Influenza virus
ESIESEFSE

SEQ ID NO: 467898 - protein, 9 aa, Influenza virus
ESIIEAESS

SEQ ID NO: 467899 - protein, 9 aa, Influenza virus
ESIKNGTYD

SEQ ID NO: 467900 - protein, 9 aa, Influenza virus
ESIRNGTYD

SEQ ID NO: 467901 - protein, 9 aa, Influenza virus
ESIRNGTYN

SEQ ID NO: 467902 - protein, 9 aa, Influenza virus
ESIRNNTYD

SEQ ID NO: 467903 - protein, 9 aa, Influenza virus
ESIRNNTYN

SEQ ID NO: 467904 - protein, 9 aa, Influenza virus
ESKCFWKGG

SEQ ID NO: 467905 - protein, 9 aa, Influenza virus
ESKCFWKSG

SEQ ID NO: 467906 - protein, 9 aa, Influenza virus
ESKCFWRGG

SEQ ID NO: 467907 - protein, 9 aa, Influenza virus
ESKIERQKI

SEQ ID NO: 467908 - protein, 9 aa, Influenza virus
ESKIERQKV

SEQ ID NO: 467909 - protein, 9 aa, Influenza virus
ESKINRQEI

SEQ ID NO: 467910 - protein, 9 aa, Influenza virus
ESKLERQKI

SEQ ID NO: 467911 - protein, 9 aa, Influenza virus
ESKLERQRI

SEQ ID NO: 467912 - protein, 9 aa, Influenza virus
ESKLKRNEI

SEQ ID NO: 467913 - protein, 9 aa, Influenza virus
ESKLKRQEI

SEQ ID NO: 467914 - protein, 9 aa, Influenza virus
ESKLNRNEI

SEQ ID NO: 467915 - protein, 9 aa, Influenza virus
ESKLNRQEI

SEQ ID NO: 467916 - protein, 9 aa, Influenza virus
ESKLNRSEI

SEQ ID NO: 467917 - protein, 9 aa, Influenza virus
ESKLNRTEI

SEQ ID NO: 467918 - protein, 9 aa, Influenza virus
ESKLSQMSK

SEQ ID NO: 467919 - protein, 9 aa, Influenza virus
ESLLLATGM

SEQ ID NO: 467920 - protein, 9 aa, Influenza virus
ESLLNRLSI

SEQ ID NO: 467921 - protein, 9 aa, Influenza virus
ESLMLATGM

SEQ ID NO: 467922 - protein, 9 aa, Influenza virus
ESLNKKMED

SEQ ID NO: 467923 - protein, 9 aa, Influenza virus
ESLNNKVDD

SEQ ID NO: 467924 - protein, 9 aa, Influenza virus
ESLQNRIQI

SEQ ID NO: 467925 - protein, 9 aa, Influenza virus
ESLQNRIRI

SEQ ID NO: 467926 - protein, 9 aa, Influenza virus
ESLRLAIGL

SEQ ID NO: 467927 - protein, 9 aa, Influenza virus
ESLRLALGL

SEQ ID NO: 467928 - protein, 9 aa, Influenza virus
ESLRLAVGL

SEQ ID NO: 467929 - protein, 9 aa, Influenza virus
ESMGFRYSG

SEQ ID NO: 467930 - protein, 9 aa, Influenza virus
ESMIEAESS

SEQ ID NO: 467931 - protein, 9 aa, Influenza virus
ESMVEAESS

SEQ ID NO: 467932 - protein, 9 aa, Influenza virus
ESNGAFIAP

SEQ ID NO: 467933 - protein, 9 aa, Influenza virus
ESNGAFLAP

SEQ ID NO: 467934 - protein, 9 aa, Influenza virus
ESNGGFLAP

SEQ ID NO: 467935 - protein, 9 aa, Influenza virus
ESNGGLIAP

SEQ ID NO: 467936 - protein, 9 aa, Influenza virus
ESNGGLLAP

SEQ ID NO: 467937 - protein, 9 aa, Influenza virus
ESNGNFIAP

SEQ ID NO: 467938 - protein, 9 aa, Influenza virus
ESNGNLIAP

SEQ ID NO: 467939 - protein, 9 aa, Influenza virus
ESNGNLVAP

SEQ ID NO: 467940 - protein, 9 aa, Influenza virus
ESNGVFLAP

SEQ ID NO: 467941 - protein, 9 aa, Influenza virus
ESNVLWTSN

SEQ ID NO: 467942 - protein, 9 aa, Influenza virus
ESNVTVTNS

SEQ ID NO: 467943 - protein, 9 aa, Influenza virus
ESNVTVTSS

SEQ ID NO: 467944 - protein, 9 aa, Influenza virus
ESQLKKQEI

SEQ ID NO: 467945 - protein, 9 aa, Influenza virus
ESQLKRQEI

SEQ ID NO: 467946 - protein, 9 aa, Influenza virus
ESRARIKTR

SEQ ID NO: 467947 - protein, 9 aa, Influenza virus
ESRGLFGAI

SEQ ID NO: 467948 - protein, 9 aa, Influenza virus
ESRIERQKI

SEQ ID NO: 467949 - protein, 9 aa, Influenza virus
ESRINMINS

SEQ ID NO: 467950 - protein, 9 aa, Influenza virus
ESRINRQEI

SEQ ID NO: 467951 - protein, 9 aa, Influenza virus
ESRINTINS

SEQ ID NO: 467952 - protein, 9 aa, Influenza virus
ESRKLLLIA

SEQ ID NO: 467953 - protein, 9 aa, Influenza virus
ESRKLLLIT

SEQ ID NO: 467954 - protein, 9 aa, Influenza virus
ESRKLLLIV

SEQ ID NO: 467955 - protein, 9 aa, Influenza virus
ESRKLLLVV

SEQ ID NO: 467956 - protein, 9 aa, Influenza virus
ESRKMLLIV

SEQ ID NO: 467957 - protein, 9 aa, Influenza virus
ESRLNRNEI

SEQ ID NO: 467958 - protein, 9 aa, Influenza virus
ESRLNRQEI

SEQ ID NO: 467959 - protein, 9 aa, Influenza virus
ESRNPGNAE

SEQ ID NO: 467960 - protein, 9 aa, Influenza virus
ESRSGFEMI

SEQ ID NO: 467961 - protein, 9 aa, Influenza virus
ESRSGFEMV

SEQ ID NO: 467962 - protein, 9 aa, Influenza virus
ESRSGYETF

SEQ ID NO: 467963 - protein, 9 aa, Influenza virus
ESRSNIFNM

SEQ ID NO: 467964 - protein, 9 aa, Influenza virus
ESSCTCIKG

SEQ ID NO: 467965 - protein, 9 aa, Influenza virus
ESSCTCILG

SEQ ID NO: 467966 - protein, 9 aa, Influenza virus
ESSCTCIQG

SEQ ID NO: 467967 - protein, 9 aa, Influenza virus
ESSCTCIRG

SEQ ID NO: 467968 - protein, 9 aa, Influenza virus
ESSCVCIKG

SEQ ID NO: 467969 - protein, 9 aa, Influenza virus
ESSCVCMKG

SEQ ID NO: 467970 - protein, 9 aa, Influenza virus
ESSCVCMNG

SEQ ID NO: 467971 - protein, 9 aa, Influenza virus
ESSCVCVKG

SEQ ID NO: 467972 - protein, 9 aa, Influenza virus
ESSDVLVTR

SEQ ID NO: 467973 - protein, 9 aa, Influenza virus
ESSFEQITF

SEQ ID NO: 467974 - protein, 9 aa, Influenza virus
ESSFYAEME

SEQ ID NO: 467975 - protein, 9 aa, Influenza virus
ESSFYAEMK

SEQ ID NO: 467976 - protein, 9 aa, Influenza virus
ESSGGLLAP

SEQ ID NO: 467977 - protein, 9 aa, Influenza virus
ESSIGKVCR

SEQ ID NO: 467978 - protein, 9 aa, Influenza virus
ESSIKEKDM

SEQ ID NO: 467979 - protein, 9 aa, Influenza virus
ESSTYQNNF

SEQ ID NO: 467980 - protein, 9 aa, Influenza virus
ESSVFWTSN

SEQ ID NO: 467981 - protein, 9 aa, Influenza virus
ESSVKEKDL

SEQ ID NO: 467982 - protein, 9 aa, Influenza virus
ESSVKEKDM

SEQ ID NO: 467983 - protein, 9 aa, Influenza virus
ESSVLWTSN

SEQ ID NO: 467984 - protein, 9 aa, Influenza virus
ESSVREKDM

SEQ ID NO: 467985 - protein, 9 aa, Influenza virus
ESTGNFIAP

SEQ ID NO: 467986 - protein, 9 aa, Influenza virus
ESTGNLIAP

SEQ ID NO: 467987 - protein, 9 aa, Influenza virus
ESTGNLVAP

SEQ ID NO: 467988 - protein, 9 aa, Influenza virus
ESTQAAIDQ

SEQ ID NO: 467989 - protein, 9 aa, Influenza virus
ESTQKAIDG

SEQ ID NO: 467990 - protein, 9 aa, Influenza virus
ESTQKAIDQ

SEQ ID NO: 467991 - protein, 9 aa, Influenza virus
ESTQKAIDR

SEQ ID NO: 467992 - protein, 9 aa, Influenza virus
ESTQKAING

SEQ ID NO: 467993 - protein, 9 aa, Influenza virus
ESTQKAMDG

SEQ ID NO: 467994 - protein, 9 aa, Influenza virus
ESTQKAVDG

SEQ ID NO: 467995 - protein, 9 aa, Influenza virus
ESTQRAIDG

SEQ ID NO: 467996 - protein, 9 aa, Influenza virus
ESVAWSASA

SEQ ID NO: 467997 - protein, 9 aa, Influenza virus
ESVAWSATA

SEQ ID NO: 467998 - protein, 9 aa, Influenza virus
ESVGWSATA

SEQ ID NO: 467999 - protein, 9 aa, Influenza virus
ESVKNGTYD

SEQ ID NO: 468000 - protein, 9 aa, Influenza virus
ESVKNGTYN

SEQ ID NO: 468001 - protein, 9 aa, Influenza virus
ESVLINTYQ

SEQ ID NO: 468002 - protein, 9 aa, Influenza virus
ESVLVNTYQ

SEQ ID NO: 468003 - protein, 9 aa, Influenza virus
ESVRNGTYD

SEQ ID NO: 468004 - protein, 9 aa, Influenza virus
ESVRNGTYK

SEQ ID NO: 468005 - protein, 9 aa, Influenza virus
ESVRNGTYN

SEQ ID NO: 468006 - protein, 9 aa, Influenza virus
ESYGRIIQN

SEQ ID NO: 468007 - protein, 9 aa, Influenza virus
ETEHQIGNV

SEQ ID NO: 468008 - protein, 9 aa, Influenza virus
ETEQTKLYK

SEQ ID NO: 468009 - protein, 9 aa, Influenza virus
ETFKVIGGW

SEQ ID NO: 468010 - protein, 9 aa, Influenza virus
ETFRVIDGW

SEQ ID NO: 468011 - protein, 9 aa, Influenza virus
ETFRVIGGW

SEQ ID NO: 468012 - protein, 9 aa, Influenza virus
ETFRVISGW

SEQ ID NO: 468013 - protein, 9 aa, Influenza virus
ETFVNITNV

SEQ ID NO: 468014 - protein, 9 aa, Influenza virus
ETFVNVTHV

SEQ ID NO: 468015 - protein, 9 aa, Influenza virus
ETFVNVTNV

SEQ ID NO: 468016 - protein, 9 aa, Influenza virus
ETGALQLNP

SEQ ID NO: 468017 - protein, 9 aa, Influenza virus
ETGAPQLNP

SEQ ID NO: 468018 - protein, 9 aa, Influenza virus
ETGNGCFEF

SEQ ID NO: 468019 - protein, 9 aa, Influenza virus
ETGVPVTSS

SEQ ID NO: 468020 - protein, 9 aa, Influenza virus
ETGVWWTSN

SEQ ID NO: 468021 - protein, 9 aa, Influenza virus
ETGYICSKF

SEQ ID NO: 468022 - protein, 9 aa, Influenza virus
ETGYVCGKF

SEQ ID NO: 468023 - protein, 9 aa, Influenza virus
ETGYVCSKF

SEQ ID NO: 468024 - protein, 9 aa, Influenza virus
ETHIHIFSF

SEQ ID NO: 468025 - protein, 9 aa, Influenza virus
ETIEEKFEI

SEQ ID NO: 468026 - protein, 9 aa, Influenza virus
ETIEERFEI

SEQ ID NO: 468027 - protein, 9 aa, Influenza virus
ETIIETGYV

SEQ ID NO: 468028 - protein, 9 aa, Influenza virus
ETIKNGTYD

SEQ ID NO: 468029 - protein, 9 aa, Influenza virus
ETIKNGTYN

SEQ ID NO: 468030 - protein, 9 aa, Influenza virus
ETILETGYI

SEQ ID NO: 468031 - protein, 9 aa, Influenza virus
ETILETGYV

SEQ ID NO: 468032 - protein, 9 aa, Influenza virus
ETILETRYV

SEQ ID NO: 468033 - protein, 9 aa, Influenza virus
ETIRNGTYD

SEQ ID NO: 468034 - protein, 9 aa, Influenza virus
ETIRNGTYN

SEQ ID NO: 468035 - protein, 9 aa, Influenza virus
ETIVETGYV

SEQ ID NO: 468036 - protein, 9 aa, Influenza virus
ETKAPQLNP

SEQ ID NO: 468037 - protein, 9 aa, Influenza virus
ETKCQSPLG

SEQ ID NO: 468038 - protein, 9 aa, Influenza virus
ETKCQTPLG

SEQ ID NO: 468039 - protein, 9 aa, Influenza virus
ETKGLFGAI

SEQ ID NO: 468040 - protein, 9 aa, Influenza virus
ETLKGSARH

SEQ ID NO: 468041 - protein, 9 aa, Influenza virus
ETLKIRTNG

SEQ ID NO: 468042 - protein, 9 aa, Influenza virus
ETLKVESNG

SEQ ID NO: 468043 - protein, 9 aa, Influenza virus
ETLNIESNG

SEQ ID NO: 468044 - protein, 9 aa, Influenza virus
ETLNVESNG

SEQ ID NO: 468045 - protein, 9 aa, Influenza virus
ETNGNYGPI

SEQ ID NO: 468046 - protein, 9 aa, Influenza virus
ETNHTDELC

SEQ ID NO: 468047 - protein, 9 aa, Influenza virus
ETNHTGTYC

SEQ ID NO: 468048 - protein, 9 aa, Influenza virus
ETNKFAAIC

SEQ ID NO: 468049 - protein, 9 aa, Influenza virus
ETNKFASIC

SEQ ID NO: 468050 - protein, 9 aa, Influenza virus
ETNKLAAIC

SEQ ID NO: 468051 - protein, 9 aa, Influenza virus
ETQCQTPLG

SEQ ID NO: 468052 - protein, 9 aa, Influenza virus
ETQTRGIFG

SEQ ID NO: 468053 - protein, 9 aa, Influenza virus
ETRCQTPLG

SEQ ID NO: 468054 - protein, 9 aa, Influenza virus
ETRGLFGAI

SEQ ID NO: 468055 - protein, 9 aa, Influenza virus
ETRINMINS

SEQ ID NO: 468056 - protein, 9 aa, Influenza virus
ETRVWWTSN

SEQ ID NO: 468057 - protein, 9 aa, Influenza virus
ETSHTGTYC

SEQ ID NO: 468058 - protein, 9 aa, Influenza virus
ETTGRNCTI

SEQ ID NO: 468059 - protein, 9 aa, Influenza virus
ETTGRNCTV

SEQ ID NO: 468060 - protein, 9 aa, Influenza virus
ETTHTGTYC

SEQ ID NO: 468061 - protein, 9 aa, Influenza virus
ETVEERFEI

SEQ ID NO: 468062 - protein, 9 aa, Influenza virus
ETVEITGID

SEQ ID NO: 468063 - protein, 9 aa, Influenza virus
ETVEITGIN

SEQ ID NO: 468064 - protein, 9 aa, Influenza virus
ETVNTLIEQ

SEQ ID NO: 468065 - protein, 9 aa, Influenza virus
ETVNTLSEQ

SEQ ID NO: 468066 - protein, 9 aa, Influenza virus
ETVNTLTEQ

SEQ ID NO: 468067 - protein, 9 aa, Influenza virus
ETWPIGESP

SEQ ID NO: 468068 - protein, 9 aa, Influenza virus
ETWPVGESP

SEQ ID NO: 468069 - protein, 9 aa, Influenza virus
ETYKILTIY

SEQ ID NO: 468070 - protein, 9 aa, Influenza virus
ETYVLSIIP

SEQ ID NO: 468071 - protein, 9 aa, Influenza virus
ETYVLSIVP

SEQ ID NO: 468072 - protein, 9 aa, Influenza virus
ETYVLSVIP

SEQ ID NO: 468073 - protein, 9 aa, Influenza virus
EVALGYSTG

SEQ ID NO: 468074 - protein, 9 aa, Influenza virus
EVALSYSAG

SEQ ID NO: 468075 - protein, 9 aa, Influenza virus
EVALSYSTG

SEQ ID NO: 468076 - protein, 9 aa, Influenza virus
EVCFMYSDF

SEQ ID NO: 468077 - protein, 9 aa, Influenza virus
EVCLKWDLM

SEQ ID NO: 468078 - protein, 9 aa, Influenza virus
EVCLKWELM

SEQ ID NO: 468079 - protein, 9 aa, Influenza virus
EVDNNGELR

SEQ ID NO: 468080 - protein, 9 aa, Influenza virus
EVEGRIQDL

SEQ ID NO: 468081 - protein, 9 aa, Influenza virus
EVEKQIGNV

SEQ ID NO: 468082 - protein, 9 aa, Influenza virus
EVEKQLGNV

SEQ ID NO: 468083 - protein, 9 aa, Influenza virus
EVENEIRTF

SEQ ID NO: 468084 - protein, 9 aa, Influenza virus
EVEQEIRAF

SEQ ID NO: 468085 - protein, 9 aa, Influenza virus
EVEQEIRTF

SEQ ID NO: 468086 - protein, 9 aa, Influenza virus
EVEQEMRTF

SEQ ID NO: 468087 - protein, 9 aa, Influenza virus
EVEQQIGNV

SEQ ID NO: 468088 - protein, 9 aa, Influenza virus
EVERQIGNV

SEQ ID NO: 468089 - protein, 9 aa, Influenza virus
EVESEIRTF

SEQ ID NO: 468090 - protein, 9 aa, Influenza virus
EVETYVLSI

SEQ ID NO: 468091 - protein, 9 aa, Influenza virus
EVEVVNATE

SEQ ID NO: 468092 - protein, 9 aa, Influenza virus
EVFVIREPC

SEQ ID NO: 468093 - protein, 9 aa, Influenza virus
EVFVIREPF

SEQ ID NO: 468094 - protein, 9 aa, Influenza virus
EVGAKILTS

SEQ ID NO: 468095 - protein, 9 aa, Influenza virus
EVGARIITS

SEQ ID NO: 468096 - protein, 9 aa, Influenza virus
EVGARILTS

SEQ ID NO: 468097 - protein, 9 aa, Influenza virus
EVGNGCFEF

SEQ ID NO: 468098 - protein, 9 aa, Influenza virus
EVGTRWMKI

SEQ ID NO: 468099 - protein, 9 aa, Influenza virus
EVGYLCAGI

SEQ ID NO: 468100 - protein, 9 aa, Influenza virus
EVHIYYLEK

SEQ ID NO: 468101 - protein, 9 aa, Influenza virus
EVHMYYLEK

SEQ ID NO: 468102 - protein, 9 aa, Influenza virus
EVHTYYLEK

SEQ ID NO: 468103 - protein, 9 aa, Influenza virus
EVHVYYLEK

SEQ ID NO: 468104 - protein, 9 aa, Influenza virus
EVILWFSFG

SEQ ID NO: 468105 - protein, 9 aa, Influenza virus
EVITAQELV

SEQ ID NO: 468106 - protein, 9 aa, Influenza virus
EVKLEENTT

SEQ ID NO: 468107 - protein, 9 aa, Influenza virus
EVKRRLSAN

SEQ ID NO: 468108 - protein, 9 aa, Influenza virus
EVKRRLSTN

SEQ ID NO: 468109 - protein, 9 aa, Influenza virus
EVKYVWWTS

SEQ ID NO: 468110 - protein, 9 aa, Influenza virus
EVLFIEDGW

SEQ ID NO: 468111 - protein, 9 aa, Influenza virus
EVLFQGGHI

SEQ ID NO: 468112 - protein, 9 aa, Influenza virus
EVLHLTQGA

SEQ ID NO: 468113 - protein, 9 aa, Influenza virus
EVLHLTQGT

SEQ ID NO: 468114 - protein, 9 aa, Influenza virus
EVLKGSARH

SEQ ID NO: 468115 - protein, 9 aa, Influenza virus
EVLKVPDAE

SEQ ID NO: 468116 - protein, 9 aa, Influenza virus
EVLKVPNAE

SEQ ID NO: 468117 - protein, 9 aa, Influenza virus
EVLLIEDGW

SEQ ID NO: 468118 - protein, 9 aa, Influenza virus
EVLNNKHWS

SEQ ID NO: 468119 - protein, 9 aa, Influenza virus
EVLNNKNWS

SEQ ID NO: 468120 - protein, 9 aa, Influenza virus
EVLNNMNWS

SEQ ID NO: 468121 - protein, 9 aa, Influenza virus
EVLNNRNWS

SEQ ID NO: 468122 - protein, 9 aa, Influenza virus
EVLTGNLQA

SEQ ID NO: 468123 - protein, 9 aa, Influenza virus
EVLTGNLQT

SEQ ID NO: 468124 - protein, 9 aa, Influenza virus
EVLWTSNSI

SEQ ID NO: 468125 - protein, 9 aa, Influenza virus
EVNGPESVL

SEQ ID NO: 468126 - protein, 9 aa, Influenza virus
EVNSWHIFS

SEQ ID NO: 468127 - protein, 9 aa, Influenza virus
EVNSWHILS

SEQ ID NO: 468128 - protein, 9 aa, Influenza virus
EVPAQNAIS

SEQ ID NO: 468129 - protein, 9 aa, Influenza virus
EVPGWSWDD

SEQ ID NO: 468130 - protein, 9 aa, Influenza virus
EVPGWSWGD

SEQ ID NO: 468131 - protein, 9 aa, Influenza virus
EVPSPYNSR

SEQ ID NO: 468132 - protein, 9 aa, Influenza virus
EVRRIWRQA

SEQ ID NO: 468133 - protein, 9 aa, Influenza virus
EVRRRLSAN

SEQ ID NO: 468134 - protein, 9 aa, Influenza virus
EVRRRLSTN

SEQ ID NO: 468135 - protein, 9 aa, Influenza virus
EVRRRLSVN

SEQ ID NO: 468136 - protein, 9 aa, Influenza virus
EVSEAQGTE

SEQ ID NO: 468137 - protein, 9 aa, Influenza virus
EVSETQGIE

SEQ ID NO: 468138 - protein, 9 aa, Influenza virus
EVSETQGME

SEQ ID NO: 468139 - protein, 9 aa, Influenza virus
EVSETQGTE

SEQ ID NO: 468140 - protein, 9 aa, Influenza virus
EVSFQGGHI

SEQ ID NO: 468141 - protein, 9 aa, Influenza virus
EVSFQGRGV

SEQ ID NO: 468142 - protein, 9 aa, Influenza virus
EVSFRGGHI

SEQ ID NO: 468143 - protein, 9 aa, Influenza virus
EVSFRGRGV

SEQ ID NO: 468144 - protein, 9 aa, Influenza virus
EVSHCRATE

SEQ ID NO: 468145 - protein, 9 aa, Influenza virus
EVSLSYSTG

SEQ ID NO: 468146 - protein, 9 aa, Influenza virus
EVSSWHILS

SEQ ID NO: 468147 - protein, 9 aa, Influenza virus
EVSWTSNSI

SEQ ID NO: 468148 - protein, 9 aa, Influenza virus
EVTNATELV

SEQ ID NO: 468149 - protein, 9 aa, Influenza virus
EVTNATETV

SEQ ID NO: 468150 - protein, 9 aa, Influenza virus
EVTTHFQRK

SEQ ID NO: 468151 - protein, 9 aa, Influenza virus
EVVAAQELV

SEQ ID NO: 468152 - protein, 9 aa, Influenza virus
EVVDATETV

SEQ ID NO: 468153 - protein, 9 aa, Influenza virus
EVVFPNEVG

SEQ ID NO: 468154 - protein, 9 aa, Influenza virus
EVVNATETV

SEQ ID NO: 468155 - protein, 9 aa, Influenza virus
EVVSAKELV

SEQ ID NO: 468156 - protein, 9 aa, Influenza virus
EVVTAQELV

SEQ ID NO: 468157 - protein, 9 aa, Influenza virus
EVWIGRTKS

SEQ ID NO: 468158 - protein, 9 aa, Influenza virus
EVWSYNADL

SEQ ID NO: 468159 - protein, 9 aa, Influenza virus
EVWSYNAEF

SEQ ID NO: 468160 - protein, 9 aa, Influenza virus
EVWSYNAEL

SEQ ID NO: 468161 - protein, 9 aa, Influenza virus
EVWWTSNSI

SEQ ID NO: 468162 - protein, 9 aa, Influenza virus
EVYNETVRL

SEQ ID NO: 468163 - protein, 9 aa, Influenza virus
EVYNETVRV

SEQ ID NO: 468164 - protein, 9 aa, Influenza virus
EVYSETVRV

SEQ ID NO: 468165 - protein, 9 aa, Influenza virus
EWDIFIERP

SEQ ID NO: 468166 - protein, 9 aa, Influenza virus
EWDVFIERP

SEQ ID NO: 468167 - protein, 9 aa, Influenza virus
EWDVFVERP

SEQ ID NO: 468168 - protein, 9 aa, Influenza virus
EWDVYIERP

SEQ ID NO: 468169 - protein, 9 aa, Influenza virus
EWGNGCFEF

SEQ ID NO: 468170 - protein, 9 aa, Influenza virus
EWIKTRPIL

SEQ ID NO: 468171 - protein, 9 aa, Influenza virus
EWLHVCITG

SEQ ID NO: 468172 - protein, 9 aa, Influenza virus
EWLKTRPIL

SEQ ID NO: 468173 - protein, 9 aa, Influenza virus
EWMHICMTG

SEQ ID NO: 468174 - protein, 9 aa, Influenza virus
EWMHVCITG

SEQ ID NO: 468175 - protein, 9 aa, Influenza virus
EWMHVCMAG

SEQ ID NO: 468176 - protein, 9 aa, Influenza virus
EWMHVCMTG

SEQ ID NO: 468177 - protein, 9 aa, Influenza virus
EWSGYSGSF

SEQ ID NO: 468178 - protein, 9 aa, Influenza virus
EWSKRYELE

SEQ ID NO: 468179 - protein, 9 aa, Influenza virus
EWSRRYELE

SEQ ID NO: 468180 - protein, 9 aa, Influenza virus
EWSWDDGAI

SEQ ID NO: 468181 - protein, 9 aa, Influenza virus
EWSYIIEKE

SEQ ID NO: 468182 - protein, 9 aa, Influenza virus
EWSYIMEKE

SEQ ID NO: 468183 - protein, 9 aa, Influenza virus
EWSYIMEKK

SEQ ID NO: 468184 - protein, 9 aa, Influenza virus
EWSYIVEKA

SEQ ID NO: 468185 - protein, 9 aa, Influenza virus
EWSYIVEKD

SEQ ID NO: 468186 - protein, 9 aa, Influenza virus
EWSYIVEKE

SEQ ID NO: 468187 - protein, 9 aa, Influenza virus
EWSYIVEKN

SEQ ID NO: 468188 - protein, 9 aa, Influenza virus
EWSYIVERE

SEQ ID NO: 468189 - protein, 9 aa, Influenza virus
EWSYIVERP

SEQ ID NO: 468190 - protein, 9 aa, Influenza virus
EWSYIVERT

SEQ ID NO: 468191 - protein, 9 aa, Influenza virus
EWSYLIEDP

SEQ ID NO: 468192 - protein, 9 aa, Influenza virus
EWTSNSLIA

SEQ ID NO: 468193 - protein, 9 aa, Influenza virus
EYAEESKLK

SEQ ID NO: 468194 - protein, 9 aa, Influenza virus
EYASKTRIS

SEQ ID NO: 468195 - protein, 9 aa, Influenza virus
EYDAVATTH

SEQ ID NO: 468196 - protein, 9 aa, Influenza virus
EYEEEAKLE

SEQ ID NO: 468197 - protein, 9 aa, Influenza virus
EYEEESKLK

SEQ ID NO: 468198 - protein, 9 aa, Influenza virus
EYGFKISKR

SEQ ID NO: 468199 - protein, 9 aa, Influenza virus
EYGFKISRR

SEQ ID NO: 468200 - protein, 9 aa, Influenza virus
EYGFRISKR

SEQ ID NO: 468201 - protein, 9 aa, Influenza virus
EYGHLITGK

SEQ ID NO: 468202 - protein, 9 aa, Influenza virus
EYGHLTTGK

SEQ ID NO: 468203 - protein, 9 aa, Influenza virus
EYGHLVTGK

SEQ ID NO: 468204 - protein, 9 aa, Influenza virus
EYGKGRIFQ

SEQ ID NO: 468205 - protein, 9 aa, Influenza virus
EYGRGRIFQ

SEQ ID NO: 468206 - protein, 9 aa, Influenza virus
EYGYLITGK

SEQ ID NO: 468207 - protein, 9 aa, Influenza virus
EYKDWILWI

SEQ ID NO: 468208 - protein, 9 aa, Influenza virus
EYKNTGDSD

SEQ ID NO: 468209 - protein, 9 aa, Influenza virus
EYKNTRDSD

SEQ ID NO: 468210 - protein, 9 aa, Influenza virus
EYKNTRDSN

SEQ ID NO: 468211 - protein, 9 aa, Influenza virus
EYNETIRIE

SEQ ID NO: 468212 - protein, 9 aa, Influenza virus
EYNETVKVE

SEQ ID NO: 468213 - protein, 9 aa, Influenza virus
EYNETVRIE

SEQ ID NO: 468214 - protein, 9 aa, Influenza virus
EYNETVRTE

SEQ ID NO: 468215 - protein, 9 aa, Influenza virus
EYNETVRVE

SEQ ID NO: 468216 - protein, 9 aa, Influenza virus
EYNGKSLGI

SEQ ID NO: 468217 - protein, 9 aa, Influenza virus
EYNNTTGRD

SEQ ID NO: 468218 - protein, 9 aa, Influenza virus
EYPLQNLTK

SEQ ID NO: 468219 - protein, 9 aa, Influenza virus
EYQIGNVIN

SEQ ID NO: 468220 - protein, 9 aa, Influenza virus
EYQSLRSIL

SEQ ID NO: 468221 - protein, 9 aa, Influenza virus
EYRQEALQN

SEQ ID NO: 468222 - protein, 9 aa, Influenza virus
EYSIDSSYV

SEQ ID NO: 468223 - protein, 9 aa, Influenza virus
EYTLDEESR

SEQ ID NO: 468224 - protein, 9 aa, Influenza virus
EYYFVKEGK

SEQ ID NO: 468225 - protein, 9 aa, Influenza virus
FAAAPPEQS

SEQ ID NO: 468226 - protein, 9 aa, Influenza virus
FAAAPPKQS

SEQ ID NO: 468227 - protein, 9 aa, Influenza virus
FAAAPPVQS

SEQ ID NO: 468228 - protein, 9 aa, Influenza virus
FAAICTHLE

SEQ ID NO: 468229 - protein, 9 aa, Influenza virus
FAAICTHME

SEQ ID NO: 468230 - protein, 9 aa, Influenza virus
FADQELGDA

SEQ ID NO: 468231 - protein, 9 aa, Influenza virus
FAFKQGNSV

SEQ ID NO: 468232 - protein, 9 aa, Influenza virus
FAGKNADLE

SEQ ID NO: 468233 - protein, 9 aa, Influenza virus
FAGKNSDLE

SEQ ID NO: 468234 - protein, 9 aa, Influenza virus
FAGKNTDLE

SEQ ID NO: 468235 - protein, 9 aa, Influenza virus
FAGWILGNP

SEQ ID NO: 468236 - protein, 9 aa, Influenza virus
FAGWLLGNP

SEQ ID NO: 468237 - protein, 9 aa, Influenza virus
FAIASKDNG

SEQ ID NO: 468238 - protein, 9 aa, Influenza virus
FAIFSKDNG

SEQ ID NO: 468239 - protein, 9 aa, Influenza virus
FAIISKDNG

SEQ ID NO: 468240 - protein, 9 aa, Influenza virus
FAISCFLIC

SEQ ID NO: 468241 - protein, 9 aa, Influenza virus
FAISCFLLC

SEQ ID NO: 468242 - protein, 9 aa, Influenza virus
FAISCLLLC

SEQ ID NO: 468243 - protein, 9 aa, Influenza virus
FAIVSKDNG

SEQ ID NO: 468244 - protein, 9 aa, Influenza virus
FAKDNSIRL

SEQ ID NO: 468245 - protein, 9 aa, Influenza virus
FALAQGALL

SEQ ID NO: 468246 - protein, 9 aa, Influenza virus
FALAQGALV

SEQ ID NO: 468247 - protein, 9 aa, Influenza virus
FALAQGTLL

SEQ ID NO: 468248 - protein, 9 aa, Influenza virus
FALAQGVLL

SEQ ID NO: 468249 - protein, 9 aa, Influenza virus
FALGHGTTL

SEQ ID NO: 468250 - protein, 9 aa, Influenza virus
FALGQGATL

SEQ ID NO: 468251 - protein, 9 aa, Influenza virus
FALGQGTTL

SEQ ID NO: 468252 - protein, 9 aa, Influenza virus
FALSGVAIA

SEQ ID NO: 468253 - protein, 9 aa, Influenza virus
FALSGVAIS

SEQ ID NO: 468254 - protein, 9 aa, Influenza virus
FALSGVAIT

SEQ ID NO: 468255 - protein, 9 aa, Influenza virus
FALSGVAVA

SEQ ID NO: 468256 - protein, 9 aa, Influenza virus
FALSQGALL

SEQ ID NO: 468257 - protein, 9 aa, Influenza virus
FALSQGTTL

SEQ ID NO: 468258 - protein, 9 aa, Influenza virus
FAMSCFLLC

SEQ ID NO: 468259 - protein, 9 aa, Influenza virus
FAPFAKDNS

SEQ ID NO: 468260 - protein, 9 aa, Influenza virus
FAPFSKDNG

SEQ ID NO: 468261 - protein, 9 aa, Influenza virus
FAPFSKDNS

SEQ ID NO: 468262 - protein, 9 aa, Influenza virus
FAPFTKDNS

SEQ ID NO: 468263 - protein, 9 aa, Influenza virus
FAPLSKDNS

SEQ ID NO: 468264 - protein, 9 aa, Influenza virus
FASAPPEQS

SEQ ID NO: 468265 - protein, 9 aa, Influenza virus
FASICTHLE

SEQ ID NO: 468266 - protein, 9 aa, Influenza virus
FASSGIAIA

SEQ ID NO: 468267 - protein, 9 aa, Influenza virus
FASSGIAIV

SEQ ID NO: 468268 - protein, 9 aa, Influenza virus
FATSCFLLC

SEQ ID NO: 468269 - protein, 9 aa, Influenza virus
FAYDKICIG

SEQ ID NO: 468270 - protein, 9 aa, Influenza virus
FAYGSSINS

SEQ ID NO: 468271 - protein, 9 aa, Influenza virus
FCFTVMTDG

SEQ ID NO: 468272 - protein, 9 aa, Influenza virus
FCGASGTYG

SEQ ID NO: 468273 - protein, 9 aa, Influenza virus
FCGLDNEPG

SEQ ID NO: 468274 - protein, 9 aa, Influenza virus
FCGLNNEPG

SEQ ID NO: 468275 - protein, 9 aa, Influenza virus
FCGTPGTYG

SEQ ID NO: 468276 - protein, 9 aa, Influenza virus
FCGTSGIYG

SEQ ID NO: 468277 - protein, 9 aa, Influenza virus
FCGTSGSYG

SEQ ID NO: 468278 - protein, 9 aa, Influenza virus
FCGTSGTCG

SEQ ID NO: 468279 - protein, 9 aa, Influenza virus
FCGTSGTYG

SEQ ID NO: 468280 - protein, 9 aa, Influenza virus
FCGTTGTYG

SEQ ID NO: 468281 - protein, 9 aa, Influenza virus
FCGVDSDTT

SEQ ID NO: 468282 - protein, 9 aa, Influenza virus
FCGVNSDTT

SEQ ID NO: 468283 - protein, 9 aa, Influenza virus
FCGVSGEVP

SEQ ID NO: 468284 - protein, 9 aa, Influenza virus
FCGVSSEVP

SEQ ID NO: 468285 - protein, 9 aa, Influenza virus
FCLKNGNMQ

SEQ ID NO: 468286 - protein, 9 aa, Influenza virus
FCLKNGNMR

SEQ ID NO: 468287 - protein, 9 aa, Influenza virus
FCLRNGNMR

SEQ ID NO: 468288 - protein, 9 aa, Influenza virus
FCSIDGKAP

SEQ ID NO: 468289 - protein, 9 aa, Influenza virus
FCSINGKAP

SEQ ID NO: 468290 - protein, 9 aa, Influenza virus
FCSINGKEP

SEQ ID NO: 468291 - protein, 9 aa, Influenza virus
FCSINGKQP

SEQ ID NO: 468292 - protein, 9 aa, Influenza virus
FCSLDGKAP

SEQ ID NO: 468293 - protein, 9 aa, Influenza virus
FCYPGELDN

SEQ ID NO: 468294 - protein, 9 aa, Influenza virus
FCYTLITDG

SEQ ID NO: 468295 - protein, 9 aa, Influenza virus
FCYTLMTDG

SEQ ID NO: 468296 - protein, 9 aa, Influenza virus
FCYTLVTDG

SEQ ID NO: 468297 - protein, 9 aa, Influenza virus
FDDRLRRDQ

SEQ ID NO: 468298 - protein, 9 aa, Influenza virus
FDERRNKYL

SEQ ID NO: 468299 - protein, 9 aa, Influenza virus
FDERRNRYL

SEQ ID NO: 468300 - protein, 9 aa, Influenza virus
FDEVKRRLS

SEQ ID NO: 468301 - protein, 9 aa, Influenza virus
FDEVRRRLS

SEQ ID NO: 468302 - protein, 9 aa, Influenza virus
FDFIKWNVT

SEQ ID NO: 468303 - protein, 9 aa, Influenza virus
FDFSKWNVT

SEQ ID NO: 468304 - protein, 9 aa, Influenza virus
FDFTKWNVT

SEQ ID NO: 468305 - protein, 9 aa, Influenza virus
FDGGHIEEC

SEQ ID NO: 468306 - protein, 9 aa, Influenza virus
FDGKEWLHV

SEQ ID NO: 468307 - protein, 9 aa, Influenza virus
FDGKEWMHI

SEQ ID NO: 468308 - protein, 9 aa, Influenza virus
FDGKEWMHV

SEQ ID NO: 468309 - protein, 9 aa, Influenza virus
FDGREWMHV

SEQ ID NO: 468310 - protein, 9 aa, Influenza virus
FDILHKCDN

SEQ ID NO: 468311 - protein, 9 aa, Influenza virus
FDILHKCNN

SEQ ID NO: 468312 - protein, 9 aa, Influenza virus
FDKLYIWGI

SEQ ID NO: 468313 - protein, 9 aa, Influenza virus
FDKLYIWGV

SEQ ID NO: 468314 - protein, 9 aa, Influenza virus
FDKLYVWGI

SEQ ID NO: 468315 - protein, 9 aa, Influenza virus
FDKLYVWGV

SEQ ID NO: 468316 - protein, 9 aa, Influenza virus
FDMNNEGSY

SEQ ID NO: 468317 - protein, 9 aa, Influenza virus
FDMSKEGSY

SEQ ID NO: 468318 - protein, 9 aa, Influenza virus
FDMSNDGSY

SEQ ID NO: 468319 - protein, 9 aa, Influenza virus
FDMSNEGSY

SEQ ID NO: 468320 - protein, 9 aa, Influenza virus
FDSLNITAA

SEQ ID NO: 468321 - protein, 9 aa, Influenza virus
FDSNGNFIA

SEQ ID NO: 468322 - protein, 9 aa, Influenza virus
FDVPDYQSL

SEQ ID NO: 468323 - protein, 9 aa, Influenza virus
FDVYQILAI

SEQ ID NO: 468324 - protein, 9 aa, Influenza virus
FDWTLNRNQ

SEQ ID NO: 468325 - protein, 9 aa, Influenza virus
FDYSGWNVT

SEQ ID NO: 468326 - protein, 9 aa, Influenza virus
FDYSKWNVS

SEQ ID NO: 468327 - protein, 9 aa, Influenza virus
FDYSKWNVT

SEQ ID NO: 468328 - protein, 9 aa, Influenza virus
FDYSRWNVT

SEQ ID NO: 468329 - protein, 9 aa, Influenza virus
FEAIGREFN

SEQ ID NO: 468330 - protein, 9 aa, Influenza virus
FEANGNLIA

SEQ ID NO: 468331 - protein, 9 aa, Influenza virus
FEATGNLIA

SEQ ID NO: 468332 - protein, 9 aa, Influenza virus
FEATGNLLV

SEQ ID NO: 468333 - protein, 9 aa, Influenza virus
FEATGNLVA

SEQ ID NO: 468334 - protein, 9 aa, Influenza virus
FEATGNLVV

SEQ ID NO: 468335 - protein, 9 aa, Influenza virus
FEAVAWSAT

SEQ ID NO: 468336 - protein, 9 aa, Influenza virus
FEAVGKEFN

SEQ ID NO: 468337 - protein, 9 aa, Influenza virus
FEAVGREFN

SEQ ID NO: 468338 - protein, 9 aa, Influenza virus
FEAVGREFS

SEQ ID NO: 468339 - protein, 9 aa, Influenza virus
FECITPNGS

SEQ ID NO: 468340 - protein, 9 aa, Influenza virus
FEECSCYPS

SEQ ID NO: 468341 - protein, 9 aa, Influenza virus
FEFSDERAA

SEQ ID NO: 468342 - protein, 9 aa, Influenza virus
FEFTSFFYR

SEQ ID NO: 468343 - protein, 9 aa, Influenza virus
FEFWHKCDD

SEQ ID NO: 468344 - protein, 9 aa, Influenza virus
FEFWHKCDN

SEQ ID NO: 468345 - protein, 9 aa, Influenza virus
FEFWHKCNN

SEQ ID NO: 468346 - protein, 9 aa, Influenza virus
FEFYHKCDD

SEQ ID NO: 468347 - protein, 9 aa, Influenza virus
FEFYHKCDN

SEQ ID NO: 468348 - protein, 9 aa, Influenza virus
FEFYHKCND

SEQ ID NO: 468349 - protein, 9 aa, Influenza virus
FEFYHKCNN

SEQ ID NO: 468350 - protein, 9 aa, Influenza virus
FEFYHRCDD

SEQ ID NO: 468351 - protein, 9 aa, Influenza virus
FEFYHRCDN

SEQ ID NO: 468352 - protein, 9 aa, Influenza virus
FEGWIGGNP

SEQ ID NO: 468353 - protein, 9 aa, Influenza virus
FEGWIVGNP

SEQ ID NO: 468354 - protein, 9 aa, Influenza virus
FEIFHKCDD

SEQ ID NO: 468355 - protein, 9 aa, Influenza virus
FEIFHKCDN

SEQ ID NO: 468356 - protein, 9 aa, Influenza virus
FEIFHQCDN

SEQ ID NO: 468357 - protein, 9 aa, Influenza virus
FEIFHQCNN

SEQ ID NO: 468358 - protein, 9 aa, Influenza virus
FEIFHRCDD

SEQ ID NO: 468359 - protein, 9 aa, Influenza virus
FEIFHRCDN

SEQ ID NO: 468360 - protein, 9 aa, Influenza virus
FEIIEGRDR

SEQ ID NO: 468361 - protein, 9 aa, Influenza virus
FEILHKCDD

SEQ ID NO: 468362 - protein, 9 aa, Influenza virus
FEILHKCDN

SEQ ID NO: 468363 - protein, 9 aa, Influenza virus
FEILHKCND

SEQ ID NO: 468364 - protein, 9 aa, Influenza virus
FEILHRCDD

SEQ ID NO: 468365 - protein, 9 aa, Influenza virus
FEILHRCND

SEQ ID NO: 468366 - protein, 9 aa, Influenza virus
FEILLIEDG

SEQ ID NO: 468367 - protein, 9 aa, Influenza virus
FEILLIEEG

SEQ ID NO: 468368 - protein, 9 aa, Influenza virus
FEKEGYSLV

SEQ ID NO: 468369 - protein, 9 aa, Influenza virus
FEKFEIFPK

SEQ ID NO: 468370 - protein, 9 aa, Influenza virus
FEKFFPSSS

SEQ ID NO: 468371 - protein, 9 aa, Influenza virus
FEKIKILPR

SEQ ID NO: 468372 - protein, 9 aa, Influenza virus
FEKVKILAR

SEQ ID NO: 468373 - protein, 9 aa, Influenza virus
FEKVKILPK

SEQ ID NO: 468374 - protein, 9 aa, Influenza virus
FEKVKILPR

SEQ ID NO: 468375 - protein, 9 aa, Influenza virus
FEKVRILPK

SEQ ID NO: 468376 - protein, 9 aa, Influenza virus
FELIDNEFN

SEQ ID NO: 468377 - protein, 9 aa, Influenza virus
FELIDNEFS

SEQ ID NO: 468378 - protein, 9 aa, Influenza virus
FELIDNEFT

SEQ ID NO: 468379 - protein, 9 aa, Influenza virus
FELIDNKFN

SEQ ID NO: 468380 - protein, 9 aa, Influenza virus
FELINNEFN

SEQ ID NO: 468381 - protein, 9 aa, Influenza virus
FELLHKCND

SEQ ID NO: 468382 - protein, 9 aa, Influenza virus
FELLHKCNN

SEQ ID NO: 468383 - protein, 9 aa, Influenza virus
FELSDEKAA

SEQ ID NO: 468384 - protein, 9 aa, Influenza virus
FELSDEKAT

SEQ ID NO: 468385 - protein, 9 aa, Influenza virus
FELSDERAA

SEQ ID NO: 468386 - protein, 9 aa, Influenza virus
FELSDERAT

SEQ ID NO: 468387 - protein, 9 aa, Influenza virus
FEMIDNEFN

SEQ ID NO: 468388 - protein, 9 aa, Influenza virus
FEMIWDANG

SEQ ID NO: 468389 - protein, 9 aa, Influenza virus
FEMIWDPDG

SEQ ID NO: 468390 - protein, 9 aa, Influenza virus
FEMIWDPNG

SEQ ID NO: 468391 - protein, 9 aa, Influenza virus
FEMLKIHNA

SEQ ID NO: 468392 - protein, 9 aa, Influenza virus
FEMLKIPNA

SEQ ID NO: 468393 - protein, 9 aa, Influenza virus
FEMLKVPNA

SEQ ID NO: 468394 - protein, 9 aa, Influenza virus
FEMLRIPNA

SEQ ID NO: 468395 - protein, 9 aa, Influenza virus
FEMSNEGSY

SEQ ID NO: 468396 - protein, 9 aa, Influenza virus
FEMVWDANG

SEQ ID NO: 468397 - protein, 9 aa, Influenza virus
FEMVWDPNG

SEQ ID NO: 468398 - protein, 9 aa, Influenza virus
FEPFQSLIP

SEQ ID NO: 468399 - protein, 9 aa, Influenza virus
FEPFQSLVP

SEQ ID NO: 468400 - protein, 9 aa, Influenza virus
FEPNGCIEG

SEQ ID NO: 468401 - protein, 9 aa, Influenza virus
FEPNGCIES

SEQ ID NO: 468402 - protein, 9 aa, Influenza virus
FEPNGSIEG

SEQ ID NO: 468403 - protein, 9 aa, Influenza virus
FEPNGYIEG

SEQ ID NO: 468404 - protein, 9 aa, Influenza virus
FEQITFIQA

SEQ ID NO: 468405 - protein, 9 aa, Influenza virus
FEQITFLQA

SEQ ID NO: 468406 - protein, 9 aa, Influenza virus
FEQITFMQA

SEQ ID NO: 468407 - protein, 9 aa, Influenza virus
FEQVEGRIQ

SEQ ID NO: 468408 - protein, 9 aa, Influenza virus
FEQVEGRTQ

SEQ ID NO: 468409 - protein, 9 aa, Influenza virus
FEREGYSLV

SEQ ID NO: 468410 - protein, 9 aa, Influenza virus
FERFEIFPK

SEQ ID NO: 468411 - protein, 9 aa, Influenza virus
FERFEIFPN

SEQ ID NO: 468412 - protein, 9 aa, Influenza virus
FERFEMFPK

SEQ ID NO: 468413 - protein, 9 aa, Influenza virus
FERVKRQLR

SEQ ID NO: 468414 - protein, 9 aa, Influenza virus
FERVRHQLR

SEQ ID NO: 468415 - protein, 9 aa, Influenza virus
FERVRRQLR

SEQ ID NO: 468416 - protein, 9 aa, Influenza virus
FESDGAFLA

SEQ ID NO: 468417 - protein, 9 aa, Influenza virus
FESIESEFN

SEQ ID NO: 468418 - protein, 9 aa, Influenza virus
FESIESEFS

SEQ ID NO: 468419 - protein, 9 aa, Influenza virus
FESNGAFIA

SEQ ID NO: 468420 - protein, 9 aa, Influenza virus
FESNGAFLA

SEQ ID NO: 468421 - protein, 9 aa, Influenza virus
FESNGALLA

SEQ ID NO: 468422 - protein, 9 aa, Influenza virus
FESNGGFLA

SEQ ID NO: 468423 - protein, 9 aa, Influenza virus
FESNGGLIA

SEQ ID NO: 468424 - protein, 9 aa, Influenza virus
FESNGGLLA

SEQ ID NO: 468425 - protein, 9 aa, Influenza virus
FESNGNFIA

SEQ ID NO: 468426 - protein, 9 aa, Influenza virus
FESNGNFIT

SEQ ID NO: 468427 - protein, 9 aa, Influenza virus
FESNGNLIA

SEQ ID NO: 468428 - protein, 9 aa, Influenza virus
FESSGGLLA

SEQ ID NO: 468429 - protein, 9 aa, Influenza virus
FESTGNFIA

SEQ ID NO: 468430 - protein, 9 aa, Influenza virus
FESTGNLIA

SEQ ID NO: 468431 - protein, 9 aa, Influenza virus
FESTGNLVA

SEQ ID NO: 468432 - protein, 9 aa, Influenza virus
FESVAWSAS

SEQ ID NO: 468433 - protein, 9 aa, Influenza virus
FESVAWSAT

SEQ ID NO: 468434 - protein, 9 aa, Influenza virus
FESVEWSAT

SEQ ID NO: 468435 - protein, 9 aa, Influenza virus
FESVGWSAT

SEQ ID NO: 468436 - protein, 9 aa, Influenza virus
FEVLFIEDG

SEQ ID NO: 468437 - protein, 9 aa, Influenza virus
FEVLLIEDG

SEQ ID NO: 468438 - protein, 9 aa, Influenza virus
FEVMNHEFS

SEQ ID NO: 468439 - protein, 9 aa, Influenza virus
FEVVDHEFS

SEQ ID NO: 468440 - protein, 9 aa, Influenza virus
FEVVNHEFS

SEQ ID NO: 468441 - protein, 9 aa, Influenza virus
FFARLNWLT

SEQ ID NO: 468442 - protein, 9 aa, Influenza virus
FFCLKDGNM

SEQ ID NO: 468443 - protein, 9 aa, Influenza virus
FFCLKNGNM

SEQ ID NO: 468444 - protein, 9 aa, Influenza virus
FFCLKNGNT

SEQ ID NO: 468445 - protein, 9 aa, Influenza virus
FFCLRNGNM

SEQ ID NO: 468446 - protein, 9 aa, Influenza virus
FFFCLKNGN

SEQ ID NO: 468447 - protein, 9 aa, Influenza virus
FFGAIAGFI

SEQ ID NO: 468448 - protein, 9 aa, Influenza virus
FFGDNAEEF

SEQ ID NO: 468449 - protein, 9 aa, Influenza virus
FFGDNAEEY

SEQ ID NO: 468450 - protein, 9 aa, Influenza virus
FFGDNAKEY

SEQ ID NO: 468451 - protein, 9 aa, Influenza virus
FFHKCNDSC

SEQ ID NO: 468452 - protein, 9 aa, Influenza virus
FFLTHGALL

SEQ ID NO: 468453 - protein, 9 aa, Influenza virus
FFLTHGSLL

SEQ ID NO: 468454 - protein, 9 aa, Influenza virus
FFLTQGALL

SEQ ID NO: 468455 - protein, 9 aa, Influenza virus
FFLTQGSLL

SEQ ID NO: 468456 - protein, 9 aa, Influenza virus
FFNNTEPLC

SEQ ID NO: 468457 - protein, 9 aa, Influenza virus
FFPDGPQIQ

SEQ ID NO: 468458 - protein, 9 aa, Influenza virus
FFPFHKDNA

SEQ ID NO: 468459 - protein, 9 aa, Influenza virus
FFPSSSYRR

SEQ ID NO: 468460 - protein, 9 aa, Influenza virus
FFRHMVWLI

SEQ ID NO: 468461 - protein, 9 aa, Influenza virus
FFRNIVWLI

SEQ ID NO: 468462 - protein, 9 aa, Influenza virus
FFRNMIWLI

SEQ ID NO: 468463 - protein, 9 aa, Influenza virus
FFRNMIWLT

SEQ ID NO: 468464 - protein, 9 aa, Influenza virus
FFRNMVWLI

SEQ ID NO: 468465 - protein, 9 aa, Influenza virus
FFRNMVWLT

SEQ ID NO: 468466 - protein, 9 aa, Influenza virus
FFRNMVWLV

SEQ ID NO: 468467 - protein, 9 aa, Influenza virus
FFRNVVWLI

SEQ ID NO: 468468 - protein, 9 aa, Influenza virus
FFRNVVWLT

SEQ ID NO: 468469 - protein, 9 aa, Influenza virus
FFRNVVWLV

SEQ ID NO: 468470 - protein, 9 aa, Influenza virus
FFRRLNWLT

SEQ ID NO: 468471 - protein, 9 aa, Influenza virus
FFSRLNWLH

SEQ ID NO: 468472 - protein, 9 aa, Influenza virus
FFSRLNWLT

SEQ ID NO: 468473 - protein, 9 aa, Influenza virus
FFSRLNWLY

SEQ ID NO: 468474 - protein, 9 aa, Influenza virus
FFWMCSNGS

SEQ ID NO: 468475 - protein, 9 aa, Influenza virus
FFYRYGFVA

SEQ ID NO: 468476 - protein, 9 aa, Influenza virus
FGAIAGFIE

SEQ ID NO: 468477 - protein, 9 aa, Influenza virus
FGAIAGFLE

SEQ ID NO: 468478 - protein, 9 aa, Influenza virus
FGAKAGFIE

SEQ ID NO: 468479 - protein, 9 aa, Influenza virus
FGASCFILL

SEQ ID NO: 468480 - protein, 9 aa, Influenza virus
FGASCFLFL

SEQ ID NO: 468481 - protein, 9 aa, Influenza virus
FGASCFLLI

SEQ ID NO: 468482 - protein, 9 aa, Influenza virus
FGASCFLLL

SEQ ID NO: 468483 - protein, 9 aa, Influenza virus
FGASCFVLL

SEQ ID NO: 468484 - protein, 9 aa, Influenza virus
FGASCLILL

SEQ ID NO: 468485 - protein, 9 aa, Influenza virus
FGASCVMLL

SEQ ID NO: 468486 - protein, 9 aa, Influenza virus
FGASSFVLL

SEQ ID NO: 468487 - protein, 9 aa, Influenza virus
FGCQNGNIR

SEQ ID NO: 468488 - protein, 9 aa, Influenza virus
FGCQNGNVR

SEQ ID NO: 468489 - protein, 9 aa, Influenza virus
FGDNPRPAD

SEQ ID NO: 468490 - protein, 9 aa, Influenza virus
FGDNPRPDD

SEQ ID NO: 468491 - protein, 9 aa, Influenza virus
FGDNPRPMD

SEQ ID NO: 468492 - protein, 9 aa, Influenza virus
FGDNPRPND

SEQ ID NO: 468493 - protein, 9 aa, Influenza virus
FGDNPRPSD

SEQ ID NO: 468494 - protein, 9 aa, Influenza virus
FGDNPRPVD

SEQ ID NO: 468495 - protein, 9 aa, Influenza virus
FGDNPRSVD

SEQ ID NO: 468496 - protein, 9 aa, Influenza virus
FGDSPRPND

SEQ ID NO: 468497 - protein, 9 aa, Influenza virus
FGDTPRPND

SEQ ID NO: 468498 - protein, 9 aa, Influenza virus
FGEGEQIIV

SEQ ID NO: 468499 - protein, 9 aa, Influenza virus
FGESEQIIV

SEQ ID NO: 468500 - protein, 9 aa, Influenza virus
FGESEQIVV

SEQ ID NO: 468501 - protein, 9 aa, Influenza virus
FGESEQVIV

SEQ ID NO: 468502 - protein, 9 aa, Influenza virus
FGFRQGDDV

SEQ ID NO: 468503 - protein, 9 aa, Influenza virus
FGFRQGNDV

SEQ ID NO: 468504 - protein, 9 aa, Influenza virus
FGFRQGNSV

SEQ ID NO: 468505 - protein, 9 aa, Influenza virus
FGFRQGSDV

SEQ ID NO: 468506 - protein, 9 aa, Influenza virus
FGFRQGTDV

SEQ ID NO: 468507 - protein, 9 aa, Influenza virus
FGFRQGTSV

SEQ ID NO: 468508 - protein, 9 aa, Influenza virus
FGGFTFKRT

SEQ ID NO: 468509 - protein, 9 aa, Influenza virus
FGKDNAIRI

SEQ ID NO: 468510 - protein, 9 aa, Influenza virus
FGKDNAVRI

SEQ ID NO: 468511 - protein, 9 aa, Influenza virus
FGLICATCE

SEQ ID NO: 468512 - protein, 9 aa, Influenza virus
FGLIDNEFN

SEQ ID NO: 468513 - protein, 9 aa, Influenza virus
FGLVCATCE

SEQ ID NO: 468514 - protein, 9 aa, Influenza virus
FGNLERRLE

SEQ ID NO: 468515 - protein, 9 aa, Influenza virus
FGPVHFQNQ

SEQ ID NO: 468516 - protein, 9 aa, Influenza virus
FGPVHFRNQ

SEQ ID NO: 468517 - protein, 9 aa, Influenza virus
FGPVHFRSQ

SEQ ID NO: 468518 - protein, 9 aa, Influenza virus
FGQVEGRIQ

SEQ ID NO: 468519 - protein, 9 aa, Influenza virus
FGRIDFHWL

SEQ ID NO: 468520 - protein, 9 aa, Influenza virus
FGRINFHWL

SEQ ID NO: 468521 - protein, 9 aa, Influenza virus
FGVSGINES

SEQ ID NO: 468522 - protein, 9 aa, Influenza virus
FGVSGVNES

SEQ ID NO: 468523 - protein, 9 aa, Influenza virus
FGVVNHEFS

SEQ ID NO: 468524 - protein, 9 aa, Influenza virus
FGVYQILAI

SEQ ID NO: 468525 - protein, 9 aa, Influenza virus
FGYFGIFFV

SEQ ID NO: 468526 - protein, 9 aa, Influenza virus
FGYLLKGES

SEQ ID NO: 468527 - protein, 9 aa, Influenza virus
FGYLLRGES

SEQ ID NO: 468528 - protein, 9 aa, Influenza virus
FHDSNVKNL

SEQ ID NO: 468529 - protein, 9 aa, Influenza virus
FHDSNVKSL

SEQ ID NO: 468530 - protein, 9 aa, Influenza virus
FHDSNVRNL

SEQ ID NO: 468531 - protein, 9 aa, Influenza virus
FHFEECSCY

SEQ ID NO: 468532 - protein, 9 aa, Influenza virus
FHGAKEIAL

SEQ ID NO: 468533 - protein, 9 aa, Influenza virus
FHGAKEISL

SEQ ID NO: 468534 - protein, 9 aa, Influenza virus
FHGAKEVAL

SEQ ID NO: 468535 - protein, 9 aa, Influenza virus
FHGAKEVSL

SEQ ID NO: 468536 - protein, 9 aa, Influenza virus
FHHSNAEGT

SEQ ID NO: 468537 - protein, 9 aa, Influenza virus
FHHSNSEGT

SEQ ID NO: 468538 - protein, 9 aa, Influenza virus
FHKCDDDCM

SEQ ID NO: 468539 - protein, 9 aa, Influenza virus
FHKCDDHCM

SEQ ID NO: 468540 - protein, 9 aa, Influenza virus
FHKCDDQCM

SEQ ID NO: 468541 - protein, 9 aa, Influenza virus
FHKCDDRCM

SEQ ID NO: 468542 - protein, 9 aa, Influenza virus
FHKCDNQCM

SEQ ID NO: 468543 - protein, 9 aa, Influenza virus
FHKCNDSCM

SEQ ID NO: 468544 - protein, 9 aa, Influenza virus
FHKDNAIRL

SEQ ID NO: 468545 - protein, 9 aa, Influenza virus
FHKDNAIRP

SEQ ID NO: 468546 - protein, 9 aa, Influenza virus
FHKDNALRL

SEQ ID NO: 468547 - protein, 9 aa, Influenza virus
FHKDNAVRL

SEQ ID NO: 468548 - protein, 9 aa, Influenza virus
FHKGIVIKE

SEQ ID NO: 468549 - protein, 9 aa, Influenza virus
FHKGLIIKE

SEQ ID NO: 468550 - protein, 9 aa, Influenza virus
FHKGLLIKE

SEQ ID NO: 468551 - protein, 9 aa, Influenza virus
FHKGLVIKE

SEQ ID NO: 468552 - protein, 9 aa, Influenza virus
FHKGLVVKE

SEQ ID NO: 468553 - protein, 9 aa, Influenza virus
FHLATKQVC

SEQ ID NO: 468554 - protein, 9 aa, Influenza virus
FHLGTKQVC

SEQ ID NO: 468555 - protein, 9 aa, Influenza virus
FHLGTRQVC

SEQ ID NO: 468556 - protein, 9 aa, Influenza virus
FHNIHPLAI

SEQ ID NO: 468557 - protein, 9 aa, Influenza virus
FHNIHPLTI

SEQ ID NO: 468558 - protein, 9 aa, Influenza virus
FHNISKYAF

SEQ ID NO: 468559 - protein, 9 aa, Influenza virus
FHNVHPFTI

SEQ ID NO: 468560 - protein, 9 aa, Influenza virus
FHNVHPLAI

SEQ ID NO: 468561 - protein, 9 aa, Influenza virus
FHNVHPLTI

SEQ ID NO: 468562 - protein, 9 aa, Influenza virus
FHNVSKYAF

SEQ ID NO: 468563 - protein, 9 aa, Influenza virus
FHQCDNDCM

SEQ ID NO: 468564 - protein, 9 aa, Influenza virus
FHQCDNNCI

SEQ ID NO: 468565 - protein, 9 aa, Influenza virus
FHQIEKEFS

SEQ ID NO: 468566 - protein, 9 aa, Influenza virus
FHRAKEVAL

SEQ ID NO: 468567 - protein, 9 aa, Influenza virus
FHRCDDQCM

SEQ ID NO: 468568 - protein, 9 aa, Influenza virus
FHRKRRVRD

SEQ ID NO: 468569 - protein, 9 aa, Influenza virus
FHSDTPRPA

SEQ ID NO: 468570 - protein, 9 aa, Influenza virus
FHSDTPRPD

SEQ ID NO: 468571 - protein, 9 aa, Influenza virus
FHSDTPRPS

SEQ ID NO: 468572 - protein, 9 aa, Influenza virus
FHSDTPRPT

SEQ ID NO: 468573 - protein, 9 aa, Influenza virus
FHSDTPRPV

SEQ ID NO: 468574 - protein, 9 aa, Influenza virus
FHWLILNPN

SEQ ID NO: 468575 - protein, 9 aa, Influenza virus
FHWLLLDPN

SEQ ID NO: 468576 - protein, 9 aa, Influenza virus
FHWLMLNPN

SEQ ID NO: 468577 - protein, 9 aa, Influenza virus
FHWLMLNSN

SEQ ID NO: 468578 - protein, 9 aa, Influenza virus
FHWMLLDPG

SEQ ID NO: 468579 - protein, 9 aa, Influenza virus
FHWMMLNPN

SEQ ID NO: 468580 - protein, 9 aa, Influenza virus
FHYEECSCY

SEQ ID NO: 468581 - protein, 9 aa, Influenza virus
FIAEQFTWN

SEQ ID NO: 468582 - protein, 9 aa, Influenza virus
FIAPDRASF

SEQ ID NO: 468583 - protein, 9 aa, Influenza virus
FIAPDRATF

SEQ ID NO: 468584 - protein, 9 aa, Influenza virus
FIAPDRVSF

SEQ ID NO: 468585 - protein, 9 aa, Influenza virus
FIAPENAYK

SEQ ID NO: 468586 - protein, 9 aa, Influenza virus
FIAPEYAFK

SEQ ID NO: 468587 - protein, 9 aa, Influenza virus
FIAPEYAYI

SEQ ID NO: 468588 - protein, 9 aa, Influenza virus
FIAPEYAYK

SEQ ID NO: 468589 - protein, 9 aa, Influenza virus
FIAPEYAYR

SEQ ID NO: 468590 - protein, 9 aa, Influenza virus
FIAPNRASF

SEQ ID NO: 468591 - protein, 9 aa, Influenza virus
FIAPRYAFE

SEQ ID NO: 468592 - protein, 9 aa, Influenza virus
FICIKNGNM

SEQ ID NO: 468593 - protein, 9 aa, Influenza virus
FICIKNGNV

SEQ ID NO: 468594 - protein, 9 aa, Influenza virus
FICVGWSST

SEQ ID NO: 468595 - protein, 9 aa, Influenza virus
FICVKNGNM

SEQ ID NO: 468596 - protein, 9 aa, Influenza virus
FICVRNGNM

SEQ ID NO: 468597 - protein, 9 aa, Influenza virus
FIDIWTYNA

SEQ ID NO: 468598 - protein, 9 aa, Influenza virus
FIDRLRRDQ

SEQ ID NO: 468599 - protein, 9 aa, Influenza virus
FIDVWTYNA

SEQ ID NO: 468600 - protein, 9 aa, Influenza virus
FIEGGWCGM

SEQ ID NO: 468601 - protein, 9 aa, Influenza virus
FIEGGWPGL

SEQ ID NO: 468602 - protein, 9 aa, Influenza virus
FIEGGWQGL

SEQ ID NO: 468603 - protein, 9 aa, Influenza virus
FIEGGWQGM

SEQ ID NO: 468604 - protein, 9 aa, Influenza virus
FIEGGWSGL

SEQ ID NO: 468605 - protein, 9 aa, Influenza virus
FIEGGWSGM

SEQ ID NO: 468606 - protein, 9 aa, Influenza virus
FIEGGWTGL

SEQ ID NO: 468607 - protein, 9 aa, Influenza virus
FIEGGWTGM

SEQ ID NO: 468608 - protein, 9 aa, Influenza virus
FIEGRWPGL

SEQ ID NO: 468609 - protein, 9 aa, Influenza virus
FIEIGVTRR

SEQ ID NO: 468610 - protein, 9 aa, Influenza virus
FIEKTNQQF

SEQ ID NO: 468611 - protein, 9 aa, Influenza virus
FIENGWEGL

SEQ ID NO: 468612 - protein, 9 aa, Influenza virus
FIENGWEGM

SEQ ID NO: 468613 - protein, 9 aa, Influenza virus
FIENGWQGL

SEQ ID NO: 468614 - protein, 9 aa, Influenza virus
FIERPTAVD

SEQ ID NO: 468615 - protein, 9 aa, Influenza virus
FIEVEKQIG

SEQ ID NO: 468616 - protein, 9 aa, Influenza virus
FIFGCQNGN

SEQ ID NO: 468617 - protein, 9 aa, Influenza virus
FIFILLTHW

SEQ ID NO: 468618 - protein, 9 aa, Influenza virus
FIFLLLTHW

SEQ ID NO: 468619 - protein, 9 aa, Influenza virus
FIFNGAFIA

SEQ ID NO: 468620 - protein, 9 aa, Influenza virus
FIGEEMATK

SEQ ID NO: 468621 - protein, 9 aa, Influenza virus
FIIKGRSHL

SEQ ID NO: 468622 - protein, 9 aa, Influenza virus
FIIREPFIS

SEQ ID NO: 468623 - protein, 9 aa, Influenza virus
FIIREPFVS

SEQ ID NO: 468624 - protein, 9 aa, Influenza virus
FIKDYRYTY

SEQ ID NO: 468625 - protein, 9 aa, Influenza virus
FIKWNVTYT

SEQ ID NO: 468626 - protein, 9 aa, Influenza virus
FILWACQNG

SEQ ID NO: 468627 - protein, 9 aa, Influenza virus
FILWACSSG

SEQ ID NO: 468628 - protein, 9 aa, Influenza virus
FIMWACNSG

SEQ ID NO: 468629 - protein, 9 aa, Influenza virus
FIMWACQKG

SEQ ID NO: 468630 - protein, 9 aa, Influenza virus
FIMWACQRG

SEQ ID NO: 468631 - protein, 9 aa, Influenza virus
FIMWACSNG

SEQ ID NO: 468632 - protein, 9 aa, Influenza virus
FIMWACSSG

SEQ ID NO: 468633 - protein, 9 aa, Influenza virus
FIMWTCNSG

SEQ ID NO: 468634 - protein, 9 aa, Influenza virus
FIMWTCQKG

SEQ ID NO: 468635 - protein, 9 aa, Influenza virus
FIQALQLLL

SEQ ID NO: 468636 - protein, 9 aa, Influenza virus
FIQHPELTG

SEQ ID NO: 468637 - protein, 9 aa, Influenza virus
FIQNALNGN

SEQ ID NO: 468638 - protein, 9 aa, Influenza virus
FISCSHFEC

SEQ ID NO: 468639 - protein, 9 aa, Influenza virus
FISCSHLEC

SEQ ID NO: 468640 - protein, 9 aa, Influenza virus
FISCSHMEC

SEQ ID NO: 468641 - protein, 9 aa, Influenza virus
FISCSHSEC

SEQ ID NO: 468642 - protein, 9 aa, Influenza virus
FISCSPLEC

SEQ ID NO: 468643 - protein, 9 aa, Influenza virus
FISCSQLEC

SEQ ID NO: 468644 - protein, 9 aa, Influenza virus
FISCSYLEC

SEQ ID NO: 468645 - protein, 9 aa, Influenza virus
FITPEYAYK

SEQ ID NO: 468646 - protein, 9 aa, Influenza virus
FITQGSLLN

SEQ ID NO: 468647 - protein, 9 aa, Influenza virus
FIVKGRSHL

SEQ ID NO: 468648 - protein, 9 aa, Influenza virus
FIVWACQRG

SEQ ID NO: 468649 - protein, 9 aa, Influenza virus
FIWAIHHPP

SEQ ID NO: 468650 - protein, 9 aa, Influenza virus
FIWGLSEWK

SEQ ID NO: 468651 - protein, 9 aa, Influenza virus
FIYGSSINS

SEQ ID NO: 468652 - protein, 9 aa, Influenza virus
FIYSGIRTN

SEQ ID NO: 468653 - protein, 9 aa, Influenza virus
FKADLIIER

SEQ ID NO: 468654 - protein, 9 aa, Influenza virus
FKFVSSDCS

SEQ ID NO: 468655 - protein, 9 aa, Influenza virus
FKFYHKCDN

SEQ ID NO: 468656 - protein, 9 aa, Influenza virus
FKGFFPFHK

SEQ ID NO: 468657 - protein, 9 aa, Influenza virus
FKHQNAQGE

SEQ ID NO: 468658 - protein, 9 aa, Influenza virus
FKISKRGGS

SEQ ID NO: 468659 - protein, 9 aa, Influenza virus
FKISKRGNS

SEQ ID NO: 468660 - protein, 9 aa, Influenza virus
FKISKRGSS

SEQ ID NO: 468661 - protein, 9 aa, Influenza virus
FKIYHKCDN

SEQ ID NO: 468662 - protein, 9 aa, Influenza virus
FKIYHKCNN

SEQ ID NO: 468663 - protein, 9 aa, Influenza virus
FKIYHRCDN

SEQ ID NO: 468664 - protein, 9 aa, Influenza virus
FKLLQNSQI

SEQ ID NO: 468665 - protein, 9 aa, Influenza virus
FKLLQNSQV

SEQ ID NO: 468666 - protein, 9 aa, Influenza virus
FKLLQTSQV

SEQ ID NO: 468667 - protein, 9 aa, Influenza virus
FKMNPNKKI

SEQ ID NO: 468668 - protein, 9 aa, Influenza virus
FKMNPNQKI

SEQ ID NO: 468669 - protein, 9 aa, Influenza virus
FKNTKGRDV

SEQ ID NO: 468670 - protein, 9 aa, Influenza virus
FKPNGCIEG

SEQ ID NO: 468671 - protein, 9 aa, Influenza virus
FKPNIGPRP

SEQ ID NO: 468672 - protein, 9 aa, Influenza virus
FKPPLPLCP

SEQ ID NO: 468673 - protein, 9 aa, Influenza virus
FKPSLPLCP

SEQ ID NO: 468674 - protein, 9 aa, Influenza virus
FKSPLPLCP

SEQ ID NO: 468675 - protein, 9 aa, Influenza virus
FKSSLPLCP

SEQ ID NO: 468676 - protein, 9 aa, Influenza virus
FKSTQAAIN

SEQ ID NO: 468677 - protein, 9 aa, Influenza virus
FKSWKGNIM

SEQ ID NO: 468678 - protein, 9 aa, Influenza virus
FKVIGGWST

SEQ ID NO: 468679 - protein, 9 aa, Influenza virus
FKVIGGWTT

SEQ ID NO: 468680 - protein, 9 aa, Influenza virus
FKYGDGVWI

SEQ ID NO: 468681 - protein, 9 aa, Influenza virus
FKYGNGAWI

SEQ ID NO: 468682 - protein, 9 aa, Influenza virus
FKYGNGVWI

SEQ ID NO: 468683 - protein, 9 aa, Influenza virus
FLAFILWAC

SEQ ID NO: 468684 - protein, 9 aa, Influenza virus
FLAHALKLV

SEQ ID NO: 468685 - protein, 9 aa, Influenza virus
FLAMITYIT

SEQ ID NO: 468686 - protein, 9 aa, Influenza virus
FLAPGYAFE

SEQ ID NO: 468687 - protein, 9 aa, Influenza virus
FLAPRYAFE

SEQ ID NO: 468688 - protein, 9 aa, Influenza virus
FLAPRYALE

SEQ ID NO: 468689 - protein, 9 aa, Influenza virus
FLAPRYGYI

SEQ ID NO: 468690 - protein, 9 aa, Influenza virus
FLAPRYSFE

SEQ ID NO: 468691 - protein, 9 aa, Influenza virus
FLARSALIL

SEQ ID NO: 468692 - protein, 9 aa, Influenza virus
FLCVGWSST

SEQ ID NO: 468693 - protein, 9 aa, Influenza virus
FLDIWTYNA

SEQ ID NO: 468694 - protein, 9 aa, Influenza virus
FLDRIRRDQ

SEQ ID NO: 468695 - protein, 9 aa, Influenza virus
FLDRLRRDQ

SEQ ID NO: 468696 - protein, 9 aa, Influenza virus
FLDVWTYNA

SEQ ID NO: 468697 - protein, 9 aa, Influenza virus
FLDVWTYNT

SEQ ID NO: 468698 - protein, 9 aa, Influenza virus
FLEIGVTRR

SEQ ID NO: 468699 - protein, 9 aa, Influenza virus
FLFSSIKKY

SEQ ID NO: 468700 - protein, 9 aa, Influenza virus
FLGQWDWPD

SEQ ID NO: 468701 - protein, 9 aa, Influenza virus
FLGQWNWPD

SEQ ID NO: 468702 - protein, 9 aa, Influenza virus
FLGVWTYNA

SEQ ID NO: 468703 - protein, 9 aa, Influenza virus
FLHNGGLIA

SEQ ID NO: 468704 - protein, 9 aa, Influenza virus
FLIIGKEDR

SEQ ID NO: 468705 - protein, 9 aa, Influenza virus
FLILGKEDK

SEQ ID NO: 468706 - protein, 9 aa, Influenza virus
FLILGKEDR

SEQ ID NO: 468707 - protein, 9 aa, Influenza virus
FLILGKENK

SEQ ID NO: 468708 - protein, 9 aa, Influenza virus
FLILGREDK

SEQ ID NO: 468709 - protein, 9 aa, Influenza virus
FLLMDALKL

SEQ ID NO: 468710 - protein, 9 aa, Influenza virus
FLLMDSLKL

SEQ ID NO: 468711 - protein, 9 aa, Influenza virus
FLNNTEPLC

SEQ ID NO: 468712 - protein, 9 aa, Influenza virus
FLNVWTYNA

SEQ ID NO: 468713 - protein, 9 aa, Influenza virus
FLPDLYDYK

SEQ ID NO: 468714 - protein, 9 aa, Influenza virus
FLPVAGGTG

SEQ ID NO: 468715 - protein, 9 aa, Influenza virus
FLPVAGGTS

SEQ ID NO: 468716 - protein, 9 aa, Influenza virus
FLPVSGGTS

SEQ ID NO: 468717 - protein, 9 aa, Influenza virus
FLPVTGGTS

SEQ ID NO: 468718 - protein, 9 aa, Influenza virus
FLQALQLLL

SEQ ID NO: 468719 - protein, 9 aa, Influenza virus
FLRSNAPSG

SEQ ID NO: 468720 - protein, 9 aa, Influenza virus
FLRVKDQQG

SEQ ID NO: 468721 - protein, 9 aa, Influenza virus
FLRVRDQLG

SEQ ID NO: 468722 - protein, 9 aa, Influenza virus
FLRVRDQMG

SEQ ID NO: 468723 - protein, 9 aa, Influenza virus
FLRVRDQQG

SEQ ID NO: 468724 - protein, 9 aa, Influenza virus
FLRVRDQRG

SEQ ID NO: 468725 - protein, 9 aa, Influenza virus
FLSMEFSLT

SEQ ID NO: 468726 - protein, 9 aa, Influenza virus
FLTHALRFL

SEQ ID NO: 468727 - protein, 9 aa, Influenza virus
FLTHGALLN

SEQ ID NO: 468728 - protein, 9 aa, Influenza virus
FLTHGSLLN

SEQ ID NO: 468729 - protein, 9 aa, Influenza virus
FLTMITYIT

SEQ ID NO: 468730 - protein, 9 aa, Influenza virus
FLTQGALLN

SEQ ID NO: 468731 - protein, 9 aa, Influenza virus
FLTQGSLLN

SEQ ID NO: 468732 - protein, 9 aa, Influenza virus
FLTSSIVCP

SEQ ID NO: 468733 - protein, 9 aa, Influenza virus
FLVALENQH

SEQ ID NO: 468734 - protein, 9 aa, Influenza virus
FLVAMENQH

SEQ ID NO: 468735 - protein, 9 aa, Influenza virus
FLVAVENQH

SEQ ID NO: 468736 - protein, 9 aa, Influenza virus
FLVCVSLLQ

SEQ ID NO: 468737 - protein, 9 aa, Influenza virus
FLWCKIVTT

SEQ ID NO: 468738 - protein, 9 aa, Influenza virus
FLWGIHHPP

SEQ ID NO: 468739 - protein, 9 aa, Influenza virus
FLWMCSNGS

SEQ ID NO: 468740 - protein, 9 aa, Influenza virus
FLYIRTNGT

SEQ ID NO: 468741 - protein, 9 aa, Influenza virus
FLYVRTNGT

SEQ ID NO: 468742 - protein, 9 aa, Influenza virus
FMARSALIL

SEQ ID NO: 468743 - protein, 9 aa, Influenza virus
FMCVGWSST

SEQ ID NO: 468744 - protein, 9 aa, Influenza virus
FMCVKNGNL

SEQ ID NO: 468745 - protein, 9 aa, Influenza virus
FMCVKNGNM

SEQ ID NO: 468746 - protein, 9 aa, Influenza virus
FMDVWTYNA

SEQ ID NO: 468747 - protein, 9 aa, Influenza virus
FMIIGGFIF

SEQ ID NO: 468748 - protein, 9 aa, Influenza virus
FMLWACQNG

SEQ ID NO: 468749 - protein, 9 aa, Influenza virus
FMQALQLLF

SEQ ID NO: 468750 - protein, 9 aa, Influenza virus
FMQALQLLL

SEQ ID NO: 468751 - protein, 9 aa, Influenza virus
FMWAIHHPP

SEQ ID NO: 468752 - protein, 9 aa, Influenza virus
FMYSDFHFI

SEQ ID NO: 468753 - protein, 9 aa, Influenza virus
FNCLYASPQ

SEQ ID NO: 468754 - protein, 9 aa, Influenza virus
FNDYEELKH

SEQ ID NO: 468755 - protein, 9 aa, Influenza virus
FNDYEELKL

SEQ ID NO: 468756 - protein, 9 aa, Influenza virus
FNDYEELKY

SEQ ID NO: 468757 - protein, 9 aa, Influenza virus
FNEGAYVNN

SEQ ID NO: 468758 - protein, 9 aa, Influenza virus
FNEGHIEEC

SEQ ID NO: 468759 - protein, 9 aa, Influenza virus
FNEGSYINN

SEQ ID NO: 468760 - protein, 9 aa, Influenza virus
FNEGSYVNN

SEQ ID NO: 468761 - protein, 9 aa, Influenza virus
FNEGTYINN

SEQ ID NO: 468762 - protein, 9 aa, Influenza virus
FNEGTYVNN

SEQ ID NO: 468763 - protein, 9 aa, Influenza virus
FNEIEHQIG

SEQ ID NO: 468764 - protein, 9 aa, Influenza virus
FNEIEQQIG

SEQ ID NO: 468765 - protein, 9 aa, Influenza virus
FNEIEYQIG

SEQ ID NO: 468766 - protein, 9 aa, Influenza virus
FNEVEKQIG

SEQ ID NO: 468767 - protein, 9 aa, Influenza virus
FNEVEQQIG

SEQ ID NO: 468768 - protein, 9 aa, Influenza virus
FNFFHKCND

SEQ ID NO: 468769 - protein, 9 aa, Influenza virus
FNFILLTHW

SEQ ID NO: 468770 - protein, 9 aa, Influenza virus
FNFNGAFVA

SEQ ID NO: 468771 - protein, 9 aa, Influenza virus
FNGAFIAPD

SEQ ID NO: 468772 - protein, 9 aa, Influenza virus
FNGAFIAPN

SEQ ID NO: 468773 - protein, 9 aa, Influenza virus
FNGAFVAPD

SEQ ID NO: 468774 - protein, 9 aa, Influenza virus
FNGEEMATK

SEQ ID NO: 468775 - protein, 9 aa, Influenza virus
FNGGHIEEC

SEQ ID NO: 468776 - protein, 9 aa, Influenza virus
FNKACELTD

SEQ ID NO: 468777 - protein, 9 aa, Influenza virus
FNLLHKCND

SEQ ID NO: 468778 - protein, 9 aa, Influenza virus
FNLLIGISN

SEQ ID NO: 468779 - protein, 9 aa, Influenza virus
FNMERIKEL

SEQ ID NO: 468780 - protein, 9 aa, Influenza virus
FNMLSTVLG

SEQ ID NO: 468781 - protein, 9 aa, Influenza virus
FNNIKGRDV

SEQ ID NO: 468782 - protein, 9 aa, Influenza virus
FNNLEKRLE

SEQ ID NO: 468783 - protein, 9 aa, Influenza virus
FNNLERRLE

SEQ ID NO: 468784 - protein, 9 aa, Influenza virus
FNNLTKGLC

SEQ ID NO: 468785 - protein, 9 aa, Influenza virus
FNNLTKRLC

SEQ ID NO: 468786 - protein, 9 aa, Influenza virus
FNNLTRELC

SEQ ID NO: 468787 - protein, 9 aa, Influenza virus
FNNLTRGLC

SEQ ID NO: 468788 - protein, 9 aa, Influenza virus
FNNTEPLCE

SEQ ID NO: 468789 - protein, 9 aa, Influenza virus
FNNTKERDV

SEQ ID NO: 468790 - protein, 9 aa, Influenza virus
FNNTKGRDV

SEQ ID NO: 468791 - protein, 9 aa, Influenza virus
FNNTKGRYV

SEQ ID NO: 468792 - protein, 9 aa, Influenza virus
FNNYEELKH

SEQ ID NO: 468793 - protein, 9 aa, Influenza virus
FNPCFYVEL

SEQ ID NO: 468794 - protein, 9 aa, Influenza virus
FNPITGSPG

SEQ ID NO: 468795 - protein, 9 aa, Influenza virus
FNPMIAELA

SEQ ID NO: 468796 - protein, 9 aa, Influenza virus
FNPMIIELA

SEQ ID NO: 468797 - protein, 9 aa, Influenza virus
FNPMIVELA

SEQ ID NO: 468798 - protein, 9 aa, Influenza virus
FNPMTVELA

SEQ ID NO: 468799 - protein, 9 aa, Influenza virus
FNPMVVELA

SEQ ID NO: 468800 - protein, 9 aa, Influenza virus
FNQVEKRIN

SEQ ID NO: 468801 - protein, 9 aa, Influenza virus
FNQVENRIN

SEQ ID NO: 468802 - protein, 9 aa, Influenza virus
FNQVEQRIN

SEQ ID NO: 468803 - protein, 9 aa, Influenza virus
FNSDLDYQI

SEQ ID NO: 468804 - protein, 9 aa, Influenza virus
FNSDLNYQI

SEQ ID NO: 468805 - protein, 9 aa, Influenza virus
FNSIGNLIA

SEQ ID NO: 468806 - protein, 9 aa, Influenza virus
FNSIYASPQ

SEQ ID NO: 468807 - protein, 9 aa, Influenza virus
FNSLYASPQ

SEQ ID NO: 468808 - protein, 9 aa, Influenza virus
FNSLYASSQ

SEQ ID NO: 468809 - protein, 9 aa, Influenza virus
FNSLYSSPQ

SEQ ID NO: 468810 - protein, 9 aa, Influenza virus
FNSNLDYQI

SEQ ID NO: 468811 - protein, 9 aa, Influenza virus
FNTIGNLIA

SEQ ID NO: 468812 - protein, 9 aa, Influenza virus
FNTIGNLVA

SEQ ID NO: 468813 - protein, 9 aa, Influenza virus
FPDGAKIQY

SEQ ID NO: 468814 - protein, 9 aa, Influenza virus
FPDGAQIKY

SEQ ID NO: 468815 - protein, 9 aa, Influenza virus
FPDGAQIQY

SEQ ID NO: 468816 - protein, 9 aa, Influenza virus
FPDGARIQY

SEQ ID NO: 468817 - protein, 9 aa, Influenza virus
FPDGPQIQY

SEQ ID NO: 468818 - protein, 9 aa, Influenza virus
FPFHKDNAI

SEQ ID NO: 468819 - protein, 9 aa, Influenza virus
FPFHKDNAL

SEQ ID NO: 468820 - protein, 9 aa, Influenza virus
FPFHKDNAV

SEQ ID NO: 468821 - protein, 9 aa, Influenza virus
FPGELDNNG

SEQ ID NO: 468822 - protein, 9 aa, Influenza virus
FPGEVDNNG

SEQ ID NO: 468823 - protein, 9 aa, Influenza virus
FPIGTAPIL

SEQ ID NO: 468824 - protein, 9 aa, Influenza virus
FPIGTAPVL

SEQ ID NO: 468825 - protein, 9 aa, Influenza virus
FPIGVAPVL

SEQ ID NO: 468826 - protein, 9 aa, Influenza virus
FPMGTAPVL

SEQ ID NO: 468827 - protein, 9 aa, Influenza virus
FPNEVGAKI

SEQ ID NO: 468828 - protein, 9 aa, Influenza virus
FPNEVGARI

SEQ ID NO: 468829 - protein, 9 aa, Influenza virus
FPQLNQTYR

SEQ ID NO: 468830 - protein, 9 aa, Influenza virus
FPQMTKSYK

SEQ ID NO: 468831 - protein, 9 aa, Influenza virus
FPQMTKSYR

SEQ ID NO: 468832 - protein, 9 aa, Influenza virus
FPQMTRSYK

SEQ ID NO: 468833 - protein, 9 aa, Influenza virus
FPQTANTYR

SEQ ID NO: 468834 - protein, 9 aa, Influenza virus
FPQTTKSYK

SEQ ID NO: 468835 - protein, 9 aa, Influenza virus
FPQTTNTYR

SEQ ID NO: 468836 - protein, 9 aa, Influenza virus
FPRTTNTYR

SEQ ID NO: 468837 - protein, 9 aa, Influenza virus
FPSSSYRRP

SEQ ID NO: 468838 - protein, 9 aa, Influenza virus
FPSTGNHGS

SEQ ID NO: 468839 - protein, 9 aa, Influenza virus
FPVGSGSFP

SEQ ID NO: 468840 - protein, 9 aa, Influenza virus
FPVGTAPVL

SEQ ID NO: 468841 - protein, 9 aa, Influenza virus
FPVQTDEYK

SEQ ID NO: 468842 - protein, 9 aa, Influenza virus
FPYTGDPPY

SEQ ID NO: 468843 - protein, 9 aa, Influenza virus
FQGFFPFHK

SEQ ID NO: 468844 - protein, 9 aa, Influenza virus
FQGGHIEEC

SEQ ID NO: 468845 - protein, 9 aa, Influenza virus
FQGRGVFEF

SEQ ID NO: 468846 - protein, 9 aa, Influenza virus
FQGRGVFEL

SEQ ID NO: 468847 - protein, 9 aa, Influenza virus
FQHQNAEGI

SEQ ID NO: 468848 - protein, 9 aa, Influenza virus
FQHQNAEGT

SEQ ID NO: 468849 - protein, 9 aa, Influenza virus
FQHQNEQGM

SEQ ID NO: 468850 - protein, 9 aa, Influenza virus
FQHQNEQGT

SEQ ID NO: 468851 - protein, 9 aa, Influenza virus
FQHQNEQGV

SEQ ID NO: 468852 - protein, 9 aa, Influenza virus
FQHQNSEGT

SEQ ID NO: 468853 - protein, 9 aa, Influenza virus
FQHRNDEGT

SEQ ID NO: 468854 - protein, 9 aa, Influenza virus
FQHRNEEGT

SEQ ID NO: 468855 - protein, 9 aa, Influenza virus
FQIQGIKLT

SEQ ID NO: 468856 - protein, 9 aa, Influenza virus
FQIQGVKLA

SEQ ID NO: 468857 - protein, 9 aa, Influenza virus
FQIQGVKLI

SEQ ID NO: 468858 - protein, 9 aa, Influenza virus
FQIQGVKLT

SEQ ID NO: 468859 - protein, 9 aa, Influenza virus
FQIQGVRLT

SEQ ID NO: 468860 - protein, 9 aa, Influenza virus
FQLFLVCVS

SEQ ID NO: 468861 - protein, 9 aa, Influenza virus
FQLINNKKP

SEQ ID NO: 468862 - protein, 9 aa, Influenza virus
FQLIPMISK

SEQ ID NO: 468863 - protein, 9 aa, Influenza virus
FQNASRHHM

SEQ ID NO: 468864 - protein, 9 aa, Influenza virus
FQNASRHYM

SEQ ID NO: 468865 - protein, 9 aa, Influenza virus
FQNASRYYM

SEQ ID NO: 468866 - protein, 9 aa, Influenza virus
FQNICKPYI

SEQ ID NO: 468867 - protein, 9 aa, Influenza virus
FQNIDKNAL

SEQ ID NO: 468868 - protein, 9 aa, Influenza virus
FQNIDRNAI

SEQ ID NO: 468869 - protein, 9 aa, Influenza virus
FQNIDRNAL

SEQ ID NO: 468870 - protein, 9 aa, Influenza virus
FQNIDSRAV

SEQ ID NO: 468871 - protein, 9 aa, Influenza virus
FQNIDSWAV

SEQ ID NO: 468872 - protein, 9 aa, Influenza virus
FQNIEKNAL

SEQ ID NO: 468873 - protein, 9 aa, Influenza virus
FQNIERNAL

SEQ ID NO: 468874 - protein, 9 aa, Influenza virus
FQNIHPATI

SEQ ID NO: 468875 - protein, 9 aa, Influenza virus
FQNIHPITI

SEQ ID NO: 468876 - protein, 9 aa, Influenza virus
FQNIHPVTI

SEQ ID NO: 468877 - protein, 9 aa, Influenza virus
FQNISKYAF

SEQ ID NO: 468878 - protein, 9 aa, Influenza virus
FQNISPVWI

SEQ ID NO: 468879 - protein, 9 aa, Influenza virus
FQNLSPRTV

SEQ ID NO: 468880 - protein, 9 aa, Influenza virus
FQNQVKIRR

SEQ ID NO: 468881 - protein, 9 aa, Influenza virus
FQNTSKHYI

SEQ ID NO: 468882 - protein, 9 aa, Influenza virus
FQNTSRHYI

SEQ ID NO: 468883 - protein, 9 aa, Influenza virus
FQNTSRHYM

SEQ ID NO: 468884 - protein, 9 aa, Influenza virus
FQNVHPITI

SEQ ID NO: 468885 - protein, 9 aa, Influenza virus
FQNVHPVTI

SEQ ID NO: 468886 - protein, 9 aa, Influenza virus
FQNVNKITY

SEQ ID NO: 468887 - protein, 9 aa, Influenza virus
FQNVNKVTY

SEQ ID NO: 468888 - protein, 9 aa, Influenza virus
FQNVNRITY

SEQ ID NO: 468889 - protein, 9 aa, Influenza virus
FQNVSKYAF

SEQ ID NO: 468890 - protein, 9 aa, Influenza virus
FQNVSPIWI

SEQ ID NO: 468891 - protein, 9 aa, Influenza virus
FQNVSPLWI

SEQ ID NO: 468892 - protein, 9 aa, Influenza virus
FQNVSPLWV

SEQ ID NO: 468893 - protein, 9 aa, Influenza virus
FQNVSPVWI

SEQ ID NO: 468894 - protein, 9 aa, Influenza virus
FQNVSRIAI

SEQ ID NO: 468895 - protein, 9 aa, Influenza virus
FQNVSRYAF

SEQ ID NO: 468896 - protein, 9 aa, Influenza virus
FQPCFYIEL

SEQ ID NO: 468897 - protein, 9 aa, Influenza virus
FQPCFYVEL

SEQ ID NO: 468898 - protein, 9 aa, Influenza virus
FQPNIGPRA

SEQ ID NO: 468899 - protein, 9 aa, Influenza virus
FQPNIGPRP

SEQ ID NO: 468900 - protein, 9 aa, Influenza virus
FQQMRDILG

SEQ ID NO: 468901 - protein, 9 aa, Influenza virus
FQQMRDVLG

SEQ ID NO: 468902 - protein, 9 aa, Influenza virus
FQRKRRIRD

SEQ ID NO: 468903 - protein, 9 aa, Influenza virus
FQRKRRVRD

SEQ ID NO: 468904 - protein, 9 aa, Influenza virus
FQRSKFLLM

SEQ ID NO: 468905 - protein, 9 aa, Influenza virus
FQTAAQKAM

SEQ ID NO: 468906 - protein, 9 aa, Influenza virus
FQTAAQRAM

SEQ ID NO: 468907 - protein, 9 aa, Influenza virus
FQVDCFIWH

SEQ ID NO: 468908 - protein, 9 aa, Influenza virus
FQVDCFLWH

SEQ ID NO: 468909 - protein, 9 aa, Influenza virus
FQVDCYLWH

SEQ ID NO: 468910 - protein, 9 aa, Influenza virus
FQYLLFQDI

SEQ ID NO: 468911 - protein, 9 aa, Influenza virus
FRALISWEM

SEQ ID NO: 468912 - protein, 9 aa, Influenza virus
FRALISWGM

SEQ ID NO: 468913 - protein, 9 aa, Influenza virus
FRALVSWEM

SEQ ID NO: 468914 - protein, 9 aa, Influenza virus
FRAYVDGFE

SEQ ID NO: 468915 - protein, 9 aa, Influenza virus
FRAYVDGFK

SEQ ID NO: 468916 - protein, 9 aa, Influenza virus
FRDMRKNTL

SEQ ID NO: 468917 - protein, 9 aa, Influenza virus
FRDNLEPGT

SEQ ID NO: 468918 - protein, 9 aa, Influenza virus
FRDYEELKH

SEQ ID NO: 468919 - protein, 9 aa, Influenza virus
FREQKQEFK

SEQ ID NO: 468920 - protein, 9 aa, Influenza virus
FRGFFPFHK

SEQ ID NO: 468921 - protein, 9 aa, Influenza virus
FRGGHIEEC

SEQ ID NO: 468922 - protein, 9 aa, Influenza virus
FRGLISTHL

SEQ ID NO: 468923 - protein, 9 aa, Influenza virus
FRGLISTPL

SEQ ID NO: 468924 - protein, 9 aa, Influenza virus
FRGLISTQL

SEQ ID NO: 468925 - protein, 9 aa, Influenza virus
FRGLLSTPL

SEQ ID NO: 468926 - protein, 9 aa, Influenza virus
FRGLMSTPL

SEQ ID NO: 468927 - protein, 9 aa, Influenza virus
FRGRGVFEL

SEQ ID NO: 468928 - protein, 9 aa, Influenza virus
FRHQNAEGT

SEQ ID NO: 468929 - protein, 9 aa, Influenza virus
FRHQNAQGE

SEQ ID NO: 468930 - protein, 9 aa, Influenza virus
FRHQNAQGI

SEQ ID NO: 468931 - protein, 9 aa, Influenza virus
FRHQNAQGQ

SEQ ID NO: 468932 - protein, 9 aa, Influenza virus
FRHQNAQGT

SEQ ID NO: 468933 - protein, 9 aa, Influenza virus
FRHQNSEGT

SEQ ID NO: 468934 - protein, 9 aa, Influenza virus
FRHQNSQGE

SEQ ID NO: 468935 - protein, 9 aa, Influenza virus
FRISKRGSS

SEQ ID NO: 468936 - protein, 9 aa, Influenza virus
FRIYHKCDN

SEQ ID NO: 468937 - protein, 9 aa, Influenza virus
FRLLQNSQV

SEQ ID NO: 468938 - protein, 9 aa, Influenza virus
FRLLQSSQV

SEQ ID NO: 468939 - protein, 9 aa, Influenza virus
FRNILSIAP

SEQ ID NO: 468940 - protein, 9 aa, Influenza virus
FRNILSMAP

SEQ ID NO: 468941 - protein, 9 aa, Influenza virus
FRNQIKIRR

SEQ ID NO: 468942 - protein, 9 aa, Influenza virus
FRNQVKIRR

SEQ ID NO: 468943 - protein, 9 aa, Influenza virus
FRNVLSIAP

SEQ ID NO: 468944 - protein, 9 aa, Influenza virus
FRNVLSVAP

SEQ ID NO: 468945 - protein, 9 aa, Influenza virus
FRNVVWLIK

SEQ ID NO: 468946 - protein, 9 aa, Influenza virus
FRNVVWLTK

SEQ ID NO: 468947 - protein, 9 aa, Influenza virus
FRNVVWLVK

SEQ ID NO: 468948 - protein, 9 aa, Influenza virus
FRPNIGPRP

SEQ ID NO: 468949 - protein, 9 aa, Influenza virus
FRQGNNVWA

SEQ ID NO: 468950 - protein, 9 aa, Influenza virus
FRQGNSVWA

SEQ ID NO: 468951 - protein, 9 aa, Influenza virus
FRQGTSVWA

SEQ ID NO: 468952 - protein, 9 aa, Influenza virus
FRQSERGED

SEQ ID NO: 468953 - protein, 9 aa, Influenza virus
FRQSERGEE

SEQ ID NO: 468954 - protein, 9 aa, Influenza virus
FRRPDSSWL

SEQ ID NO: 468955 - protein, 9 aa, Influenza virus
FRTLMSCPI

SEQ ID NO: 468956 - protein, 9 aa, Influenza virus
FRTLMSCPM

SEQ ID NO: 468957 - protein, 9 aa, Influenza virus
FRTLMSCPV

SEQ ID NO: 468958 - protein, 9 aa, Influenza virus
FRTYVDGFE

SEQ ID NO: 468959 - protein, 9 aa, Influenza virus
FRVIGGWAT

SEQ ID NO: 468960 - protein, 9 aa, Influenza virus
FRVIGGWTT

SEQ ID NO: 468961 - protein, 9 aa, Influenza virus
FRVIGGWVT

SEQ ID NO: 468962 - protein, 9 aa, Influenza virus
FRVYVDGFE

SEQ ID NO: 468963 - protein, 9 aa, Influenza virus
FRYGDGVWI

SEQ ID NO: 468964 - protein, 9 aa, Influenza virus
FRYGNGVWI

SEQ ID NO: 468965 - protein, 9 aa, Influenza virus
FRYSGIKTD

SEQ ID NO: 468966 - protein, 9 aa, Influenza virus
FRYSGIRTD

SEQ ID NO: 468967 - protein, 9 aa, Influenza virus
FSAESRKLL

SEQ ID NO: 468968 - protein, 9 aa, Influenza virus
FSAESRKML

SEQ ID NO: 468969 - protein, 9 aa, Influenza virus
FSARSALIL

SEQ ID NO: 468970 - protein, 9 aa, Influenza virus
FSDNGGLIA

SEQ ID NO: 468971 - protein, 9 aa, Influenza virus
FSDYEELKH

SEQ ID NO: 468972 - protein, 9 aa, Influenza virus
FSEIEGRIQ

SEQ ID NO: 468973 - protein, 9 aa, Influenza virus
FSEIEHQIG

SEQ ID NO: 468974 - protein, 9 aa, Influenza virus
FSEIEHQIS

SEQ ID NO: 468975 - protein, 9 aa, Influenza virus
FSEIEQQIG

SEQ ID NO: 468976 - protein, 9 aa, Influenza virus
FSETEHQIG

SEQ ID NO: 468977 - protein, 9 aa, Influenza virus
FSEVEGRIQ

SEQ ID NO: 468978 - protein, 9 aa, Influenza virus
FSEVEIRIN

SEQ ID NO: 468979 - protein, 9 aa, Influenza virus
FSEVESRIN

SEQ ID NO: 468980 - protein, 9 aa, Influenza virus
FSEVETRIN

SEQ ID NO: 468981 - protein, 9 aa, Influenza virus
FSEVGSRIN

SEQ ID NO: 468982 - protein, 9 aa, Influenza virus
FSFGASCFI

SEQ ID NO: 468983 - protein, 9 aa, Influenza virus
FSFGASCFL

SEQ ID NO: 468984 - protein, 9 aa, Influenza virus
FSFGASCFT

SEQ ID NO: 468985 - protein, 9 aa, Influenza virus
FSFGASCFV

SEQ ID NO: 468986 - protein, 9 aa, Influenza virus
FSFGASCLI

SEQ ID NO: 468987 - protein, 9 aa, Influenza virus
FSFGASCVM

SEQ ID NO: 468988 - protein, 9 aa, Influenza virus
FSFGASSFV

SEQ ID NO: 468989 - protein, 9 aa, Influenza virus
FSFGGFTFK

SEQ ID NO: 468990 - protein, 9 aa, Influenza virus
FSFKYGNGV

SEQ ID NO: 468991 - protein, 9 aa, Influenza virus
FSFNGAFIA

SEQ ID NO: 468992 - protein, 9 aa, Influenza virus
FSFNGAFVA

SEQ ID NO: 468993 - protein, 9 aa, Influenza virus
FSFNGEEMA

SEQ ID NO: 468994 - protein, 9 aa, Influenza virus
FSFQLINNK

SEQ ID NO: 468995 - protein, 9 aa, Influenza virus
FSFRYGDGV

SEQ ID NO: 468996 - protein, 9 aa, Influenza virus
FSFRYGNGV

SEQ ID NO: 468997 - protein, 9 aa, Influenza virus
FSFTGEEMA

SEQ ID NO: 468998 - protein, 9 aa, Influenza virus
FSGGHIEEC

SEQ ID NO: 468999 - protein, 9 aa, Influenza virus
FSGIKSFSR

SEQ ID NO: 469000 - protein, 9 aa, Influenza virus
FSGIRSFSR

SEQ ID NO: 469001 - protein, 9 aa, Influenza virus
FSGMSANGD

SEQ ID NO: 469002 - protein, 9 aa, Influenza virus
FSGSQKQEF

SEQ ID NO: 469003 - protein, 9 aa, Influenza virus
FSGVNSFSR

SEQ ID NO: 469004 - protein, 9 aa, Influenza virus
FSGYKDIIL

SEQ ID NO: 469005 - protein, 9 aa, Influenza virus
FSHNGGLIA

SEQ ID NO: 469006 - protein, 9 aa, Influenza virus
FSHNGGLVA

SEQ ID NO: 469007 - protein, 9 aa, Influenza virus
FSHNGGRIA

SEQ ID NO: 469008 - protein, 9 aa, Influenza virus
FSHYNQMKQ

SEQ ID NO: 469009 - protein, 9 aa, Influenza virus
FSHYNQMTQ

SEQ ID NO: 469010 - protein, 9 aa, Influenza virus
FSHYNQVAQ

SEQ ID NO: 469011 - protein, 9 aa, Influenza virus
FSHYNQVTQ

SEQ ID NO: 469012 - protein, 9 aa, Influenza virus
FSIAASYKR

SEQ ID NO: 469013 - protein, 9 aa, Influenza virus
FSILHKCND

SEQ ID NO: 469014 - protein, 9 aa, Influenza virus
FSIRGETTG

SEQ ID NO: 469015 - protein, 9 aa, Influenza virus
FSIRWETTG

SEQ ID NO: 469016 - protein, 9 aa, Influenza virus
FSISCFLLA

SEQ ID NO: 469017 - protein, 9 aa, Influenza virus
FSISCFLLI

SEQ ID NO: 469018 - protein, 9 aa, Influenza virus
FSISCFLLV

SEQ ID NO: 469019 - protein, 9 aa, Influenza virus
FSKDNAIRI

SEQ ID NO: 469020 - protein, 9 aa, Influenza virus
FSKDNGIRI

SEQ ID NO: 469021 - protein, 9 aa, Influenza virus
FSKDNSIQL

SEQ ID NO: 469022 - protein, 9 aa, Influenza virus
FSKDNSIRL

SEQ ID NO: 469023 - protein, 9 aa, Influenza virus
FSKDNSVRL

SEQ ID NO: 469024 - protein, 9 aa, Influenza virus
FSKVETRIN

SEQ ID NO: 469025 - protein, 9 aa, Influenza virus
FSKWNVTYT

SEQ ID NO: 469026 - protein, 9 aa, Influenza virus
FSLGASCFL

SEQ ID NO: 469027 - protein, 9 aa, Influenza virus
FSLLHKCND

SEQ ID NO: 469028 - protein, 9 aa, Influenza virus
FSLTDPKLE

SEQ ID NO: 469029 - protein, 9 aa, Influenza virus
FSLTDPRFE

SEQ ID NO: 469030 - protein, 9 aa, Influenza virus
FSLTDPRLE

SEQ ID NO: 469031 - protein, 9 aa, Influenza virus
FSLVDPRLE

SEQ ID NO: 469032 - protein, 9 aa, Influenza virus
FSMELPSFG

SEQ ID NO: 469033 - protein, 9 aa, Influenza virus
FSMSCFVFV

SEQ ID NO: 469034 - protein, 9 aa, Influenza virus
FSNAASYKR

SEQ ID NO: 469035 - protein, 9 aa, Influenza virus
FSNKMARLG

SEQ ID NO: 469036 - protein, 9 aa, Influenza virus
FSNKVARLG

SEQ ID NO: 469037 - protein, 9 aa, Influenza virus
FSNLEKRLE

SEQ ID NO: 469038 - protein, 9 aa, Influenza virus
FSNLERRLE

SEQ ID NO: 469039 - protein, 9 aa, Influenza virus
FSPRSRSGF

SEQ ID NO: 469040 - protein, 9 aa, Influenza virus
FSPSPGARP

SEQ ID NO: 469041 - protein, 9 aa, Influenza virus
FSPSPGDRP

SEQ ID NO: 469042 - protein, 9 aa, Influenza virus
FSQEDCMIK

SEQ ID NO: 469043 - protein, 9 aa, Influenza virus
FSQEDCMMK

SEQ ID NO: 469044 - protein, 9 aa, Influenza virus
FSQEDCMVK

SEQ ID NO: 469045 - protein, 9 aa, Influenza virus
FSQEDRMIK

SEQ ID NO: 469046 - protein, 9 aa, Influenza virus
FSQEECMIK

SEQ ID NO: 469047 - protein, 9 aa, Influenza virus
FSQVEQRIN

SEQ ID NO: 469048 - protein, 9 aa, Influenza virus
FSQVERRIN

SEQ ID NO: 469049 - protein, 9 aa, Influenza virus
FSRLNWLTK

SEQ ID NO: 469050 - protein, 9 aa, Influenza virus
FSRTELIAP

SEQ ID NO: 469051 - protein, 9 aa, Influenza virus
FSRTELINP

SEQ ID NO: 469052 - protein, 9 aa, Influenza virus
FSRTELIPP

SEQ ID NO: 469053 - protein, 9 aa, Influenza virus
FSRTELISP

SEQ ID NO: 469054 - protein, 9 aa, Influenza virus
FSRTQLIAP

SEQ ID NO: 469055 - protein, 9 aa, Influenza virus
FSSAASYKR

SEQ ID NO: 469056 - protein, 9 aa, Influenza virus
FSSIKKYER

SEQ ID NO: 469057 - protein, 9 aa, Influenza virus
FSSIKRYER

SEQ ID NO: 469058 - protein, 9 aa, Influenza virus
FSSLAVNVR

SEQ ID NO: 469059 - protein, 9 aa, Influenza virus
FSSLTVNVR

SEQ ID NO: 469060 - protein, 9 aa, Influenza virus
FSSLTVSVR

SEQ ID NO: 469061 - protein, 9 aa, Influenza virus
FSVQRNLPF

SEQ ID NO: 469062 - protein, 9 aa, Influenza virus
FSVQRSLPF

SEQ ID NO: 469063 - protein, 9 aa, Influenza virus
FSYKYDNGV

SEQ ID NO: 469064 - protein, 9 aa, Influenza virus
FSYKYGNGV

SEQ ID NO: 469065 - protein, 9 aa, Influenza virus
FSYRYGNGV

SEQ ID NO: 469066 - protein, 9 aa, Influenza virus
FTAEISHCR

SEQ ID NO: 469067 - protein, 9 aa, Influenza virus
FTAEVSHCR

SEQ ID NO: 469068 - protein, 9 aa, Influenza virus
FTAEVSYCR

SEQ ID NO: 469069 - protein, 9 aa, Influenza virus
FTAVGKEFN

SEQ ID NO: 469070 - protein, 9 aa, Influenza virus
FTAVGKEFS

SEQ ID NO: 469071 - protein, 9 aa, Influenza virus
FTDGSATGP

SEQ ID NO: 469072 - protein, 9 aa, Influenza virus
FTEGHIEEC

SEQ ID NO: 469073 - protein, 9 aa, Influenza virus
FTEIGVTRR

SEQ ID NO: 469074 - protein, 9 aa, Influenza virus
FTEVEGRIQ

SEQ ID NO: 469075 - protein, 9 aa, Influenza virus
FTEVEKQIG

SEQ ID NO: 469076 - protein, 9 aa, Influenza virus
FTEVEQQIG

SEQ ID NO: 469077 - protein, 9 aa, Influenza virus
FTFKRTKGF

SEQ ID NO: 469078 - protein, 9 aa, Influenza virus
FTFKRTKGS

SEQ ID NO: 469079 - protein, 9 aa, Influenza virus
FTFKRTSGS

SEQ ID NO: 469080 - protein, 9 aa, Influenza virus
FTFKRTSGT

SEQ ID NO: 469081 - protein, 9 aa, Influenza virus
FTFNGAFIA

SEQ ID NO: 469082 - protein, 9 aa, Influenza virus
FTFNGSFIA

SEQ ID NO: 469083 - protein, 9 aa, Influenza virus
FTFYHKCDD

SEQ ID NO: 469084 - protein, 9 aa, Influenza virus
FTFYHKCDN

SEQ ID NO: 469085 - protein, 9 aa, Influenza virus
FTFYHKCNN

SEQ ID NO: 469086 - protein, 9 aa, Influenza virus
FTFYHRCDN

SEQ ID NO: 469087 - protein, 9 aa, Influenza virus
FTGEEMASK

SEQ ID NO: 469088 - protein, 9 aa, Influenza virus
FTGEEMATK

SEQ ID NO: 469089 - protein, 9 aa, Influenza virus
FTGEEMATR

SEQ ID NO: 469090 - protein, 9 aa, Influenza virus
FTIGECPKY

SEQ ID NO: 469091 - protein, 9 aa, Influenza virus
FTIGECPRY

SEQ ID NO: 469092 - protein, 9 aa, Influenza virus
FTIMTDGPN

SEQ ID NO: 469093 - protein, 9 aa, Influenza virus
FTIMTDGPS

SEQ ID NO: 469094 - protein, 9 aa, Influenza virus
FTIRQELAS

SEQ ID NO: 469095 - protein, 9 aa, Influenza virus
FTIRQEMAG

SEQ ID NO: 469096 - protein, 9 aa, Influenza virus
FTIRQEMAI

SEQ ID NO: 469097 - protein, 9 aa, Influenza virus
FTIRQEMAN

SEQ ID NO: 469098 - protein, 9 aa, Influenza virus
FTIRQEMAS

SEQ ID NO: 469099 - protein, 9 aa, Influenza virus
FTITGDNTK

SEQ ID NO: 469100 - protein, 9 aa, Influenza virus
FTIYHKCDN

SEQ ID NO: 469101 - protein, 9 aa, Influenza virus
FTKDNSIRL

SEQ ID NO: 469102 - protein, 9 aa, Influenza virus
FTKWNVTHT

SEQ ID NO: 469103 - protein, 9 aa, Influenza virus
FTKWNVTYT

SEQ ID NO: 469104 - protein, 9 aa, Influenza virus
FTLSGVAIA

SEQ ID NO: 469105 - protein, 9 aa, Influenza virus
FTLTVPSER

SEQ ID NO: 469106 - protein, 9 aa, Influenza virus
FTNEEALRQ

SEQ ID NO: 469107 - protein, 9 aa, Influenza virus
FTNEEPLRQ

SEQ ID NO: 469108 - protein, 9 aa, Influenza virus
FTNEESLRQ

SEQ ID NO: 469109 - protein, 9 aa, Influenza virus
FTSFFYRYG

SEQ ID NO: 469110 - protein, 9 aa, Influenza virus
FTSVGKEFN

SEQ ID NO: 469111 - protein, 9 aa, Influenza virus
FTTEVSHCR

SEQ ID NO: 469112 - protein, 9 aa, Influenza virus
FTVLTDGPS

SEQ ID NO: 469113 - protein, 9 aa, Influenza virus
FTVMTDGPN

SEQ ID NO: 469114 - protein, 9 aa, Influenza virus
FTVMTDGPS

SEQ ID NO: 469115 - protein, 9 aa, Influenza virus
FTWAIHHPP

SEQ ID NO: 469116 - protein, 9 aa, Influenza virus
FTWNGVKVD

SEQ ID NO: 469117 - protein, 9 aa, Influenza virus
FTYESSINP

SEQ ID NO: 469118 - protein, 9 aa, Influenza virus
FTYGSSINS

SEQ ID NO: 469119 - protein, 9 aa, Influenza virus
FTYGSSITS

SEQ ID NO: 469120 - protein, 9 aa, Influenza virus
FTYNGIRTN

SEQ ID NO: 469121 - protein, 9 aa, Influenza virus
FTYSGIRTD

SEQ ID NO: 469122 - protein, 9 aa, Influenza virus
FTYSGIRTN

SEQ ID NO: 469123 - protein, 9 aa, Influenza virus
FTYTGVRTD

SEQ ID NO: 469124 - protein, 9 aa, Influenza virus
FTYTGVRTN

SEQ ID NO: 469125 - protein, 9 aa, Influenza virus
FVACGPAEC

SEQ ID NO: 469126 - protein, 9 aa, Influenza virus
FVACGPSEC

SEQ ID NO: 469127 - protein, 9 aa, Influenza virus
FVACGPTEC

SEQ ID NO: 469128 - protein, 9 aa, Influenza virus
FVACSPSEC

SEQ ID NO: 469129 - protein, 9 aa, Influenza virus
FVALILGFV

SEQ ID NO: 469130 - protein, 9 aa, Influenza virus
FVANFSMEL

SEQ ID NO: 469131 - protein, 9 aa, Influenza virus
FVAPDRASF

SEQ ID NO: 469132 - protein, 9 aa, Influenza virus
FVAPDRVSF

SEQ ID NO: 469133 - protein, 9 aa, Influenza virus
FVEIGVTRR

SEQ ID NO: 469134 - protein, 9 aa, Influenza virus
FVENLEELR

SEQ ID NO: 469135 - protein, 9 aa, Influenza virus
FVFSIAASY

SEQ ID NO: 469136 - protein, 9 aa, Influenza virus
FVFSNAASY

SEQ ID NO: 469137 - protein, 9 aa, Influenza virus
FVFSSAASY

SEQ ID NO: 469138 - protein, 9 aa, Influenza virus
FVFTLTVPS

SEQ ID NO: 469139 - protein, 9 aa, Influenza virus
FVFVALILG

SEQ ID NO: 469140 - protein, 9 aa, Influenza virus
FVHFVEALA

SEQ ID NO: 469141 - protein, 9 aa, Influenza virus
FVIEKMNTQ

SEQ ID NO: 469142 - protein, 9 aa, Influenza virus
FVIREPCIS

SEQ ID NO: 469143 - protein, 9 aa, Influenza virus
FVIREPFIS

SEQ ID NO: 469144 - protein, 9 aa, Influenza virus
FVIREPFVA

SEQ ID NO: 469145 - protein, 9 aa, Influenza virus
FVIREPFVS

SEQ ID NO: 469146 - protein, 9 aa, Influenza virus
FVIVSKDNG

SEQ ID NO: 469147 - protein, 9 aa, Influenza virus
FVLMENERT

SEQ ID NO: 469148 - protein, 9 aa, Influenza virus
FVLWACQNG

SEQ ID NO: 469149 - protein, 9 aa, Influenza virus
FVMREPFIS

SEQ ID NO: 469150 - protein, 9 aa, Influenza virus
FVMWACQKG

SEQ ID NO: 469151 - protein, 9 aa, Influenza virus
FVNEEALRQ

SEQ ID NO: 469152 - protein, 9 aa, Influenza virus
FVNGEALRQ

SEQ ID NO: 469153 - protein, 9 aa, Influenza virus
FVNMTNVQN

SEQ ID NO: 469154 - protein, 9 aa, Influenza virus
FVNRANQRL

SEQ ID NO: 469155 - protein, 9 aa, Influenza virus
FVNVTHVQN

SEQ ID NO: 469156 - protein, 9 aa, Influenza virus
FVNVTNVQN

SEQ ID NO: 469157 - protein, 9 aa, Influenza virus
FVPFSKDNS

SEQ ID NO: 469158 - protein, 9 aa, Influenza virus
FVPVIGARP

SEQ ID NO: 469159 - protein, 9 aa, Influenza virus
FVPVMGARP

SEQ ID NO: 469160 - protein, 9 aa, Influenza virus
FVPVVGARP

SEQ ID NO: 469161 - protein, 9 aa, Influenza virus
FVPVVRARP

SEQ ID NO: 469162 - protein, 9 aa, Influenza virus
FVQHPELTG

SEQ ID NO: 469163 - protein, 9 aa, Influenza virus
FVQHPEMTG

SEQ ID NO: 469164 - protein, 9 aa, Influenza virus
FVQNALNGN

SEQ ID NO: 469165 - protein, 9 aa, Influenza virus
FVQNALSGN

SEQ ID NO: 469166 - protein, 9 aa, Influenza virus
FVQSYFQLF

SEQ ID NO: 469167 - protein, 9 aa, Influenza virus
FVRGQQGRM

SEQ ID NO: 469168 - protein, 9 aa, Influenza virus
FVRQCFNPM

SEQ ID NO: 469169 - protein, 9 aa, Influenza virus
FVRTLFQQM

SEQ ID NO: 469170 - protein, 9 aa, Influenza virus
FVSCGPSEC

SEQ ID NO: 469171 - protein, 9 aa, Influenza virus
FVSCSHLEC

SEQ ID NO: 469172 - protein, 9 aa, Influenza virus
FVSMEFSLT

SEQ ID NO: 469173 - protein, 9 aa, Influenza virus
FVTREPFIS

SEQ ID NO: 469174 - protein, 9 aa, Influenza virus
FVVREPFIS

SEQ ID NO: 469175 - protein, 9 aa, Influenza virus
FVYFVEALA

SEQ ID NO: 469176 - protein, 9 aa, Influenza virus
FVYFVEILA

SEQ ID NO: 469177 - protein, 9 aa, Influenza virus
FVYFVETLA

SEQ ID NO: 469178 - protein, 9 aa, Influenza virus
FWHKCDDEC

SEQ ID NO: 469179 - protein, 9 aa, Influenza virus
FWHKCDNDC

SEQ ID NO: 469180 - protein, 9 aa, Influenza virus
FWHKCDNEC

SEQ ID NO: 469181 - protein, 9 aa, Influenza virus
FWHKCNNEC

SEQ ID NO: 469182 - protein, 9 aa, Influenza virus
FWIELIRGR

SEQ ID NO: 469183 - protein, 9 aa, Influenza virus
FWKGGSIKT

SEQ ID NO: 469184 - protein, 9 aa, Influenza virus
FWKGGSINT

SEQ ID NO: 469185 - protein, 9 aa, Influenza virus
FWKGGTINT

SEQ ID NO: 469186 - protein, 9 aa, Influenza virus
FWLEMIRGK

SEQ ID NO: 469187 - protein, 9 aa, Influenza virus
FWLEMIRGR

SEQ ID NO: 469188 - protein, 9 aa, Influenza virus
FWLKNGNMR

SEQ ID NO: 469189 - protein, 9 aa, Influenza virus
FWMCPNGSL

SEQ ID NO: 469190 - protein, 9 aa, Influenza virus
FWMCSGHSC

SEQ ID NO: 469191 - protein, 9 aa, Influenza virus
FWMCSNGSL

SEQ ID NO: 469192 - protein, 9 aa, Influenza virus
FWRGDNGRR

SEQ ID NO: 469193 - protein, 9 aa, Influenza virus
FWRGENGRK

SEQ ID NO: 469194 - protein, 9 aa, Influenza virus
FWRGENGRR

SEQ ID NO: 469195 - protein, 9 aa, Influenza virus
FWRGGSIIT

SEQ ID NO: 469196 - protein, 9 aa, Influenza virus
FWRGGSINT

SEQ ID NO: 469197 - protein, 9 aa, Influenza virus
FWTSNSIVA

SEQ ID NO: 469198 - protein, 9 aa, Influenza virus
FWTSNSIVT

SEQ ID NO: 469199 - protein, 9 aa, Influenza virus
FWVELIRGQ

SEQ ID NO: 469200 - protein, 9 aa, Influenza virus
FWVELIRGR

SEQ ID NO: 469201 - protein, 9 aa, Influenza virus
FWVELVRGL

SEQ ID NO: 469202 - protein, 9 aa, Influenza virus
FWVELVRGR

SEQ ID NO: 469203 - protein, 9 aa, Influenza virus
FWVEMIRGE

SEQ ID NO: 469204 - protein, 9 aa, Influenza virus
FWVEMIRGK

SEQ ID NO: 469205 - protein, 9 aa, Influenza virus
FWVEMIRGQ

SEQ ID NO: 469206 - protein, 9 aa, Influenza virus
FWVEMIRGR

SEQ ID NO: 469207 - protein, 9 aa, Influenza virus
FWVMTDGPA

SEQ ID NO: 469208 - protein, 9 aa, Influenza virus
FYAELKWLI

SEQ ID NO: 469209 - protein, 9 aa, Influenza virus
FYAELKWLV

SEQ ID NO: 469210 - protein, 9 aa, Influenza virus
FYAEMEWLL

SEQ ID NO: 469211 - protein, 9 aa, Influenza virus
FYAEMKWLL

SEQ ID NO: 469212 - protein, 9 aa, Influenza virus
FYALSQGTT

SEQ ID NO: 469213 - protein, 9 aa, Influenza virus
FYHKCDDEC

SEQ ID NO: 469214 - protein, 9 aa, Influenza virus
FYHKCDNEC

SEQ ID NO: 469215 - protein, 9 aa, Influenza virus
FYHKCDNKC

SEQ ID NO: 469216 - protein, 9 aa, Influenza virus
FYHKCNDEC

SEQ ID NO: 469217 - protein, 9 aa, Influenza virus
FYHKCNNEC

SEQ ID NO: 469218 - protein, 9 aa, Influenza virus
FYHRCDNEC

SEQ ID NO: 469219 - protein, 9 aa, Influenza virus
FYIELIRGK

SEQ ID NO: 469220 - protein, 9 aa, Influenza virus
FYIELIRGR

SEQ ID NO: 469221 - protein, 9 aa, Influenza virus
FYIQMCTEL

SEQ ID NO: 469222 - protein, 9 aa, Influenza virus
FYKILKIKK

SEQ ID NO: 469223 - protein, 9 aa, Influenza virus
FYKILKIRK

SEQ ID NO: 469224 - protein, 9 aa, Influenza virus
FYKSMRWLT

SEQ ID NO: 469225 - protein, 9 aa, Influenza virus
FYLGTKQVC

SEQ ID NO: 469226 - protein, 9 aa, Influenza virus
FYLGTRQVC

SEQ ID NO: 469227 - protein, 9 aa, Influenza virus
FYRGMRWLT

SEQ ID NO: 469228 - protein, 9 aa, Influenza virus
FYRICKLVG

SEQ ID NO: 469229 - protein, 9 aa, Influenza virus
FYRNLAWFV

SEQ ID NO: 469230 - protein, 9 aa, Influenza virus
FYRNLIWFV

SEQ ID NO: 469231 - protein, 9 aa, Influenza virus
FYRNLIWLV

SEQ ID NO: 469232 - protein, 9 aa, Influenza virus
FYRNLVWFI

SEQ ID NO: 469233 - protein, 9 aa, Influenza virus
FYRNLVWFV

SEQ ID NO: 469234 - protein, 9 aa, Influenza virus
FYRNLVWIV

SEQ ID NO: 469235 - protein, 9 aa, Influenza virus
FYRNLVWLV

SEQ ID NO: 469236 - protein, 9 aa, Influenza virus
FYRNMRWLT

SEQ ID NO: 469237 - protein, 9 aa, Influenza virus
FYRNVVWLI

SEQ ID NO: 469238 - protein, 9 aa, Influenza virus
FYRSINWLT

SEQ ID NO: 469239 - protein, 9 aa, Influenza virus
FYRSIRWLT

SEQ ID NO: 469240 - protein, 9 aa, Influenza virus
FYRSMKWLT

SEQ ID NO: 469241 - protein, 9 aa, Influenza virus
FYRSMRWLT

SEQ ID NO: 469242 - protein, 9 aa, Influenza virus
FYRSVRWLT

SEQ ID NO: 469243 - protein, 9 aa, Influenza virus
FYRTCKLLG

SEQ ID NO: 469244 - protein, 9 aa, Influenza virus
FYRTCKLVG

SEQ ID NO: 469245 - protein, 9 aa, Influenza virus
FYRYGFVAN

SEQ ID NO: 469246 - protein, 9 aa, Influenza virus
FYSEMKWLL

SEQ ID NO: 469247 - protein, 9 aa, Influenza virus
FYSEMKWLS

SEQ ID NO: 469248 - protein, 9 aa, Influenza virus
FYSGGTINS

SEQ ID NO: 469249 - protein, 9 aa, Influenza virus
FYVELIRGK

SEQ ID NO: 469250 - protein, 9 aa, Influenza virus
FYVELIRGM

SEQ ID NO: 469251 - protein, 9 aa, Influenza virus
FYVELIRGR

SEQ ID NO: 469252 - protein, 9 aa, Influenza virus
FYVELIRGS

SEQ ID NO: 469253 - protein, 9 aa, Influenza virus
FYVELTRGV

SEQ ID NO: 469254 - protein, 9 aa, Influenza virus
FYVELVRGR

SEQ ID NO: 469255 - protein, 9 aa, Influenza virus
FYVQMCTEL

SEQ ID NO: 469256 - protein, 9 aa, Influenza virus
FYWTIVDPG

SEQ ID NO: 469257 - protein, 9 aa, Influenza virus
FYWTIVEPE

SEQ ID NO: 469258 - protein, 9 aa, Influenza virus
FYWTIVEPG

SEQ ID NO: 469259 - protein, 9 aa, Influenza virus
FYYEECSCY

SEQ ID NO: 469260 - protein, 9 aa, Influenza virus
GAAGAAIKG

SEQ ID NO: 469261 - protein, 9 aa, Influenza virus
GAAGAAVKG

SEQ ID NO: 469262 - protein, 9 aa, Influenza virus
GAAIKGVGT

SEQ ID NO: 469263 - protein, 9 aa, Influenza virus
GAAPVLGNY

SEQ ID NO: 469264 - protein, 9 aa, Influenza virus
GAASLSPGM

SEQ ID NO: 469265 - protein, 9 aa, Influenza virus
GAAVKGIGT

SEQ ID NO: 469266 - protein, 9 aa, Influenza virus
GAAVKGVGT

SEQ ID NO: 469267 - protein, 9 aa, Influenza virus
GACWEQLYT

SEQ ID NO: 469268 - protein, 9 aa, Influenza virus
GADDDAYAV

SEQ ID NO: 469269 - protein, 9 aa, Influenza virus
GADDEAYAV

SEQ ID NO: 469270 - protein, 9 aa, Influenza virus
GADGVKGFS

SEQ ID NO: 469271 - protein, 9 aa, Influenza virus
GADINFMPI

SEQ ID NO: 469272 - protein, 9 aa, Influenza virus
GADNDAYAV

SEQ ID NO: 469273 - protein, 9 aa, Influenza virus
GADSFYRNL

SEQ ID NO: 469274 - protein, 9 aa, Influenza virus
GAFGPVHFR

SEQ ID NO: 469275 - protein, 9 aa, Influenza virus
GAFIAPDRA

SEQ ID NO: 469276 - protein, 9 aa, Influenza virus
GAFIAPDRV

SEQ ID NO: 469277 - protein, 9 aa, Influenza virus
GAFIAPNRA

SEQ ID NO: 469278 - protein, 9 aa, Influenza virus
GAFIAPRYA

SEQ ID NO: 469279 - protein, 9 aa, Influenza virus
GAFLAPRYA

SEQ ID NO: 469280 - protein, 9 aa, Influenza virus
GAFLAPRYS

SEQ ID NO: 469281 - protein, 9 aa, Influenza virus
GAFVAPDRV

SEQ ID NO: 469282 - protein, 9 aa, Influenza virus
GAGALAEDP

SEQ ID NO: 469283 - protein, 9 aa, Influenza virus
GAGNKLITV

SEQ ID NO: 469284 - protein, 9 aa, Influenza virus
GAGSWPDGA

SEQ ID NO: 469285 - protein, 9 aa, Influenza virus
GAGYAADKE

SEQ ID NO: 469286 - protein, 9 aa, Influenza virus
GAHILVTRE

SEQ ID NO: 469287 - protein, 9 aa, Influenza virus
GAIAGFIEG

SEQ ID NO: 469288 - protein, 9 aa, Influenza virus
GAIAGFIEN

SEQ ID NO: 469289 - protein, 9 aa, Influenza virus
GAIAGFLEN

SEQ ID NO: 469290 - protein, 9 aa, Influenza virus
GAIEECLIN

SEQ ID NO: 469291 - protein, 9 aa, Influenza virus
GAIGAIDSS

SEQ ID NO: 469292 - protein, 9 aa, Influenza virus
GAILPFDID

SEQ ID NO: 469293 - protein, 9 aa, Influenza virus
GAILPFGID

SEQ ID NO: 469294 - protein, 9 aa, Influenza virus
GAINSSKPF

SEQ ID NO: 469295 - protein, 9 aa, Influenza virus
GAINSSKPL

SEQ ID NO: 469296 - protein, 9 aa, Influenza virus
GAINSSMPF

SEQ ID NO: 469297 - protein, 9 aa, Influenza virus
GAINSSMPL

SEQ ID NO: 469298 - protein, 9 aa, Influenza virus
GAINSSRPF

SEQ ID NO: 469299 - protein, 9 aa, Influenza virus
GAINTTLPF

SEQ ID NO: 469300 - protein, 9 aa, Influenza virus
GAISFWMCS

SEQ ID NO: 469301 - protein, 9 aa, Influenza virus
GAIWVTREP

SEQ ID NO: 469302 - protein, 9 aa, Influenza virus
GAKAGFIEG

SEQ ID NO: 469303 - protein, 9 aa, Influenza virus
GAKAGFIEN

SEQ ID NO: 469304 - protein, 9 aa, Influenza virus
GAKEIALSY

SEQ ID NO: 469305 - protein, 9 aa, Influenza virus
GAKEISLSY

SEQ ID NO: 469306 - protein, 9 aa, Influenza virus
GAKEVALGY

SEQ ID NO: 469307 - protein, 9 aa, Influenza virus
GAKEVALSY

SEQ ID NO: 469308 - protein, 9 aa, Influenza virus
GAKEVSLSY

SEQ ID NO: 469309 - protein, 9 aa, Influenza virus
GAKILTSES

SEQ ID NO: 469310 - protein, 9 aa, Influenza virus
GAKSFYRNL

SEQ ID NO: 469311 - protein, 9 aa, Influenza virus
GAKVNTLTE

SEQ ID NO: 469312 - protein, 9 aa, Influenza virus
GALASCMGL

SEQ ID NO: 469313 - protein, 9 aa, Influenza virus
GALGSPGCD

SEQ ID NO: 469314 - protein, 9 aa, Influenza virus
GALLAPRYA

SEQ ID NO: 469315 - protein, 9 aa, Influenza virus
GALLGTKHS

SEQ ID NO: 469316 - protein, 9 aa, Influenza virus
GALLGTNHS

SEQ ID NO: 469317 - protein, 9 aa, Influenza virus
GALLGTRHS

SEQ ID NO: 469318 - protein, 9 aa, Influenza virus
GALLNDKHS

SEQ ID NO: 469319 - protein, 9 aa, Influenza virus
GALLNDRHS

SEQ ID NO: 469320 - protein, 9 aa, Influenza virus
GALLPFDID

SEQ ID NO: 469321 - protein, 9 aa, Influenza virus
GALNTTLPF

SEQ ID NO: 469322 - protein, 9 aa, Influenza virus
GALQLNPID

SEQ ID NO: 469323 - protein, 9 aa, Influenza virus
GALRQKIME

SEQ ID NO: 469324 - protein, 9 aa, Influenza virus
GALVGTKHS

SEQ ID NO: 469325 - protein, 9 aa, Influenza virus
GAMASQGTK

SEQ ID NO: 469326 - protein, 9 aa, Influenza virus
GANGVKGFS

SEQ ID NO: 469327 - protein, 9 aa, Influenza virus
GANIDFMPV

SEQ ID NO: 469328 - protein, 9 aa, Influenza virus
GANIGFMPK

SEQ ID NO: 469329 - protein, 9 aa, Influenza virus
GANINFMPI

SEQ ID NO: 469330 - protein, 9 aa, Influenza virus
GANINLMPI

SEQ ID NO: 469331 - protein, 9 aa, Influenza virus
GANISFMPI

SEQ ID NO: 469332 - protein, 9 aa, Influenza virus
GANRPIIEI

SEQ ID NO: 469333 - protein, 9 aa, Influenza virus
GANRPIITI

SEQ ID NO: 469334 - protein, 9 aa, Influenza virus
GANRPVIEI

SEQ ID NO: 469335 - protein, 9 aa, Influenza virus
GANRPVIII

SEQ ID NO: 469336 - protein, 9 aa, Influenza virus
GANRPVIKI

SEQ ID NO: 469337 - protein, 9 aa, Influenza virus
GANRPVITI

SEQ ID NO: 469338 - protein, 9 aa, Influenza virus
GANRPWVSF

SEQ ID NO: 469339 - protein, 9 aa, Influenza virus
GANSFYRNL

SEQ ID NO: 469340 - protein, 9 aa, Influenza virus
GAPACDLHL

SEQ ID NO: 469341 - protein, 9 aa, Influenza virus
GAPGVKGFG

SEQ ID NO: 469342 - protein, 9 aa, Influenza virus
GAPHGLCYP

SEQ ID NO: 469343 - protein, 9 aa, Influenza virus
GAPLELRDC

SEQ ID NO: 469344 - protein, 9 aa, Influenza virus
GAPLVLDDC

SEQ ID NO: 469345 - protein, 9 aa, Influenza virus
GAPQLNPID

SEQ ID NO: 469346 - protein, 9 aa, Influenza virus
GAPQLNPVD

SEQ ID NO: 469347 - protein, 9 aa, Influenza virus
GAPSCDLHL

SEQ ID NO: 469348 - protein, 9 aa, Influenza virus
GAQHIEECS

SEQ ID NO: 469349 - protein, 9 aa, Influenza virus
GAQHVEECS

SEQ ID NO: 469350 - protein, 9 aa, Influenza virus
GAQSFYRSI

SEQ ID NO: 469351 - protein, 9 aa, Influenza virus
GAQSLSISV

SEQ ID NO: 469352 - protein, 9 aa, Influenza virus
GARIGEGQR

SEQ ID NO: 469353 - protein, 9 aa, Influenza virus
GARIITSES

SEQ ID NO: 469354 - protein, 9 aa, Influenza virus
GARILASES

SEQ ID NO: 469355 - protein, 9 aa, Influenza virus
GARILTSES

SEQ ID NO: 469356 - protein, 9 aa, Influenza virus
GARPKVNGQ

SEQ ID NO: 469357 - protein, 9 aa, Influenza virus
GARPLVNGQ

SEQ ID NO: 469358 - protein, 9 aa, Influenza virus
GARPQVNGQ

SEQ ID NO: 469359 - protein, 9 aa, Influenza virus
GARRIDFHW

SEQ ID NO: 469360 - protein, 9 aa, Influenza virus
GARRIDFNW

SEQ ID NO: 469361 - protein, 9 aa, Influenza virus
GASCFILLA

SEQ ID NO: 469362 - protein, 9 aa, Influenza virus
GASCFLFLA

SEQ ID NO: 469363 - protein, 9 aa, Influenza virus
GASCFLLIA

SEQ ID NO: 469364 - protein, 9 aa, Influenza virus
GASCFLLLA

SEQ ID NO: 469365 - protein, 9 aa, Influenza virus
GASCFTLLA

SEQ ID NO: 469366 - protein, 9 aa, Influenza virus
GASCFVLLA

SEQ ID NO: 469367 - protein, 9 aa, Influenza virus
GASCLILLA

SEQ ID NO: 469368 - protein, 9 aa, Influenza virus
GASCVMLLA

SEQ ID NO: 469369 - protein, 9 aa, Influenza virus
GASSFVLLA

SEQ ID NO: 469370 - protein, 9 aa, Influenza virus
GASSFYRNL

SEQ ID NO: 469371 - protein, 9 aa, Influenza virus
GATINEEAL

SEQ ID NO: 469372 - protein, 9 aa, Influenza virus
GATSACKRT

SEQ ID NO: 469373 - protein, 9 aa, Influenza virus
GATVNEEAL

SEQ ID NO: 469374 - protein, 9 aa, Influenza virus
GATVNEGAL

SEQ ID NO: 469375 - protein, 9 aa, Influenza virus
GAVAVLKYD

SEQ ID NO: 469376 - protein, 9 aa, Influenza virus
GAVAVLKYK

SEQ ID NO: 469377 - protein, 9 aa, Influenza virus
GAVAVLKYN

SEQ ID NO: 469378 - protein, 9 aa, Influenza virus
GAVAVVKYN

SEQ ID NO: 469379 - protein, 9 aa, Influenza virus
GAVNSSKPF

SEQ ID NO: 469380 - protein, 9 aa, Influenza virus
GAVNSSMPF

SEQ ID NO: 469381 - protein, 9 aa, Influenza virus
GAVNTTLST

SEQ ID NO: 469382 - protein, 9 aa, Influenza virus
GAVWVTREP

SEQ ID NO: 469383 - protein, 9 aa, Influenza virus
GAYERMCNI

SEQ ID NO: 469384 - protein, 9 aa, Influenza virus
GAYGVKGFS

SEQ ID NO: 469385 - protein, 9 aa, Influenza virus
GAYKILTIY

SEQ ID NO: 469386 - protein, 9 aa, Influenza virus
GAYNNTTGR

SEQ ID NO: 469387 - protein, 9 aa, Influenza virus
GCDHSDNAD

SEQ ID NO: 469388 - protein, 9 aa, Influenza virus
GCDRLQDTT

SEQ ID NO: 469389 - protein, 9 aa, Influenza virus
GCFDILHKC

SEQ ID NO: 469390 - protein, 9 aa, Influenza virus
GCFDLYHKC

SEQ ID NO: 469391 - protein, 9 aa, Influenza virus
GCFEFWHKC

SEQ ID NO: 469392 - protein, 9 aa, Influenza virus
GCFEFYHKC

SEQ ID NO: 469393 - protein, 9 aa, Influenza virus
GCFEFYHRC

SEQ ID NO: 469394 - protein, 9 aa, Influenza virus
GCFEIFHKC

SEQ ID NO: 469395 - protein, 9 aa, Influenza virus
GCFEIFHQC

SEQ ID NO: 469396 - protein, 9 aa, Influenza virus
GCFEIFHRC

SEQ ID NO: 469397 - protein, 9 aa, Influenza virus
GCFEILHKC

SEQ ID NO: 469398 - protein, 9 aa, Influenza virus
GCFEILHRC

SEQ ID NO: 469399 - protein, 9 aa, Influenza virus
GCFEIYHAC

SEQ ID NO: 469400 - protein, 9 aa, Influenza virus
GCFEIYHKC

SEQ ID NO: 469401 - protein, 9 aa, Influenza virus
GCFEIYHNC

SEQ ID NO: 469402 - protein, 9 aa, Influenza virus
GCFEIYHTC

SEQ ID NO: 469403 - protein, 9 aa, Influenza virus
GCFEIYHVC

SEQ ID NO: 469404 - protein, 9 aa, Influenza virus
GCFELFHKC

SEQ ID NO: 469405 - protein, 9 aa, Influenza virus
GCFELLHKC

SEQ ID NO: 469406 - protein, 9 aa, Influenza virus
GCFELYHKC

SEQ ID NO: 469407 - protein, 9 aa, Influenza virus
GCFELYHRC

SEQ ID NO: 469408 - protein, 9 aa, Influenza virus
GCFKIYHKC

SEQ ID NO: 469409 - protein, 9 aa, Influenza virus
GCFKIYHRC

SEQ ID NO: 469410 - protein, 9 aa, Influenza virus
GCFNFFHKC

SEQ ID NO: 469411 - protein, 9 aa, Influenza virus
GCFNLLHKC

SEQ ID NO: 469412 - protein, 9 aa, Influenza virus
GCFQPCFYI

SEQ ID NO: 469413 - protein, 9 aa, Influenza virus
GCFQPCFYV

SEQ ID NO: 469414 - protein, 9 aa, Influenza virus
GCFSILHKC

SEQ ID NO: 469415 - protein, 9 aa, Influenza virus
GCFSLLHKC

SEQ ID NO: 469416 - protein, 9 aa, Influenza virus
GCFTFYHKC

SEQ ID NO: 469417 - protein, 9 aa, Influenza virus
GCFTFYHRC

SEQ ID NO: 469418 - protein, 9 aa, Influenza virus
GCFTIYHKC

SEQ ID NO: 469419 - protein, 9 aa, Influenza virus
GCIEGKLSQ

SEQ ID NO: 469420 - protein, 9 aa, Influenza virus
GCIESKLSQ

SEQ ID NO: 469421 - protein, 9 aa, Influenza virus
GCINRCFYV

SEQ ID NO: 469422 - protein, 9 aa, Influenza virus
GCITPNGSI

SEQ ID NO: 469423 - protein, 9 aa, Influenza virus
GCKMFALHQ

SEQ ID NO: 469424 - protein, 9 aa, Influenza virus
GCKMYALHQ

SEQ ID NO: 469425 - protein, 9 aa, Influenza virus
GCLKIYHKC

SEQ ID NO: 469426 - protein, 9 aa, Influenza virus
GCLVPCFWV

SEQ ID NO: 469427 - protein, 9 aa, Influenza virus
GCQLNEGVM

SEQ ID NO: 469428 - protein, 9 aa, Influenza virus
GCQNGNIRC

SEQ ID NO: 469429 - protein, 9 aa, Influenza virus
GCQNGNVRC

SEQ ID NO: 469430 - protein, 9 aa, Influenza virus
GCRDNWQGA

SEQ ID NO: 469431 - protein, 9 aa, Influenza virus
GCRFYALSQ

SEQ ID NO: 469432 - protein, 9 aa, Influenza virus
GCRMFALSQ

SEQ ID NO: 469433 - protein, 9 aa, Influenza virus
GCRMYALHQ

SEQ ID NO: 469434 - protein, 9 aa, Influenza virus
GCRTFFLTQ

SEQ ID NO: 469435 - protein, 9 aa, Influenza virus
GCSFAGWIL

SEQ ID NO: 469436 - protein, 9 aa, Influenza virus
GCVILLNPF

SEQ ID NO: 469437 - protein, 9 aa, Influenza virus
GCWSFALAQ

SEQ ID NO: 469438 - protein, 9 aa, Influenza virus
GDAPFIDRL

SEQ ID NO: 469439 - protein, 9 aa, Influenza virus
GDAPFLDRI

SEQ ID NO: 469440 - protein, 9 aa, Influenza virus
GDAPFLDRL

SEQ ID NO: 469441 - protein, 9 aa, Influenza virus
GDCNFEGWI

SEQ ID NO: 469442 - protein, 9 aa, Influenza virus
GDCNNPITG

SEQ ID NO: 469443 - protein, 9 aa, Influenza virus
GDCPKYIKQ

SEQ ID NO: 469444 - protein, 9 aa, Influenza virus
GDCPKYIKS

SEQ ID NO: 469445 - protein, 9 aa, Influenza virus
GDCPKYMNV

SEQ ID NO: 469446 - protein, 9 aa, Influenza virus
GDCPKYVKQ

SEQ ID NO: 469447 - protein, 9 aa, Influenza virus
GDCPKYVNI

SEQ ID NO: 469448 - protein, 9 aa, Influenza virus
GDCPKYVNV

SEQ ID NO: 469449 - protein, 9 aa, Influenza virus
GDCPRYVKQ

SEQ ID NO: 469450 - protein, 9 aa, Influenza virus
GDCRFEGWI

SEQ ID NO: 469451 - protein, 9 aa, Influenza virus
GDCSFAGWI

SEQ ID NO: 469452 - protein, 9 aa, Influenza virus
GDCSFAGWL

SEQ ID NO: 469453 - protein, 9 aa, Influenza virus
GDCSFEGWI

SEQ ID NO: 469454 - protein, 9 aa, Influenza virus
GDCSFTGWI

SEQ ID NO: 469455 - protein, 9 aa, Influenza virus
GDCSIAGWL

SEQ ID NO: 469456 - protein, 9 aa, Influenza virus
GDCSNPITG

SEQ ID NO: 469457 - protein, 9 aa, Influenza virus
GDCSVAGWL

SEQ ID NO: 469458 - protein, 9 aa, Influenza virus
GDCYRACFY

SEQ ID NO: 469459 - protein, 9 aa, Influenza virus
GDCYWVMTD

SEQ ID NO: 469460 - protein, 9 aa, Influenza virus
GDDGNATAS

SEQ ID NO: 469461 - protein, 9 aa, Influenza virus
GDDKNATAS

SEQ ID NO: 469462 - protein, 9 aa, Influenza virus
GDDRKATAS

SEQ ID NO: 469463 - protein, 9 aa, Influenza virus
GDDRNATAS

SEQ ID NO: 469464 - protein, 9 aa, Influenza virus
GDDVLMGRT

SEQ ID NO: 469465 - protein, 9 aa, Influenza virus
GDDVWLGRT

SEQ ID NO: 469466 - protein, 9 aa, Influenza virus
GDDVWMGRT

SEQ ID NO: 469467 - protein, 9 aa, Influenza virus
GDFVRQCFN

SEQ ID NO: 469468 - protein, 9 aa, Influenza virus
GDGCFEILH

SEQ ID NO: 469469 - protein, 9 aa, Influenza virus
GDGCFKIYH

SEQ ID NO: 469470 - protein, 9 aa, Influenza virus
GDGCFNFFH

SEQ ID NO: 469471 - protein, 9 aa, Influenza virus
GDGCFNLLH

SEQ ID NO: 469472 - protein, 9 aa, Influenza virus
GDGCFSILH

SEQ ID NO: 469473 - protein, 9 aa, Influenza virus
GDGCFSLLH

SEQ ID NO: 469474 - protein, 9 aa, Influenza virus
GDGQRSWMK

SEQ ID NO: 469475 - protein, 9 aa, Influenza virus
GDGVWIGRT

SEQ ID NO: 469476 - protein, 9 aa, Influenza virus
GDHGVKGWA

SEQ ID NO: 469477 - protein, 9 aa, Influenza virus
GDHITFSHN

SEQ ID NO: 469478 - protein, 9 aa, Influenza virus
GDIFVIREP

SEQ ID NO: 469479 - protein, 9 aa, Influenza virus
GDIFVMREP

SEQ ID NO: 469480 - protein, 9 aa, Influenza virus
GDIIFLWGI

SEQ ID NO: 469481 - protein, 9 aa, Influenza virus
GDIIVFNTI

SEQ ID NO: 469482 - protein, 9 aa, Influenza virus
GDILDGVTA

SEQ ID NO: 469483 - protein, 9 aa, Influenza virus
GDILEGTTA

SEQ ID NO: 469484 - protein, 9 aa, Influenza virus
GDILRTQES

SEQ ID NO: 469485 - protein, 9 aa, Influenza virus
GDIMRTQES

SEQ ID NO: 469486 - protein, 9 aa, Influenza virus
GDIVLVMKR

SEQ ID NO: 469487 - protein, 9 aa, Influenza virus
GDIWITREP

SEQ ID NO: 469488 - protein, 9 aa, Influenza virus
GDIWVTREL

SEQ ID NO: 469489 - protein, 9 aa, Influenza virus
GDIWVTREP

SEQ ID NO: 469490 - protein, 9 aa, Influenza virus
GDKICLGHH

SEQ ID NO: 469491 - protein, 9 aa, Influenza virus
GDLILFNTI

SEQ ID NO: 469492 - protein, 9 aa, Influenza virus
GDLIVFNTI

SEQ ID NO: 469493 - protein, 9 aa, Influenza virus
GDLNFVNRA

SEQ ID NO: 469494 - protein, 9 aa, Influenza virus
GDNENATAT

SEQ ID NO: 469495 - protein, 9 aa, Influenza virus
GDNIIFSHN

SEQ ID NO: 469496 - protein, 9 aa, Influenza virus
GDNITFLHN

SEQ ID NO: 469497 - protein, 9 aa, Influenza virus
GDNITFSDN

SEQ ID NO: 469498 - protein, 9 aa, Influenza virus
GDNITFSHN

SEQ ID NO: 469499 - protein, 9 aa, Influenza virus
GDNPRPADG

SEQ ID NO: 469500 - protein, 9 aa, Influenza virus
GDNPRPDDG

SEQ ID NO: 469501 - protein, 9 aa, Influenza virus
GDNPRPMDG

SEQ ID NO: 469502 - protein, 9 aa, Influenza virus
GDNPRPMDS

SEQ ID NO: 469503 - protein, 9 aa, Influenza virus
GDNPRPNDG

SEQ ID NO: 469504 - protein, 9 aa, Influenza virus
GDNPRPSDG

SEQ ID NO: 469505 - protein, 9 aa, Influenza virus
GDNPRPVDG

SEQ ID NO: 469506 - protein, 9 aa, Influenza virus
GDNPRSVDG

SEQ ID NO: 469507 - protein, 9 aa, Influenza virus
GDNTKWNEN

SEQ ID NO: 469508 - protein, 9 aa, Influenza virus
GDPNNMDKA

SEQ ID NO: 469509 - protein, 9 aa, Influenza virus
GDPNNMDRA

SEQ ID NO: 469510 - protein, 9 aa, Influenza virus
GDPPYSHGT

SEQ ID NO: 469511 - protein, 9 aa, Influenza virus
GDPSNMDRA

SEQ ID NO: 469512 - protein, 9 aa, Influenza virus
GDQICIGYH

SEQ ID NO: 469513 - protein, 9 aa, Influenza virus
GDQICVGYH

SEQ ID NO: 469514 - protein, 9 aa, Influenza virus
GDRICIGYH

SEQ ID NO: 469515 - protein, 9 aa, Influenza virus
GDRPKVNGQ

SEQ ID NO: 469516 - protein, 9 aa, Influenza virus
GDSFYAELK

SEQ ID NO: 469517 - protein, 9 aa, Influenza virus
GDSIIFNSI

SEQ ID NO: 469518 - protein, 9 aa, Influenza virus
GDSITFSHN

SEQ ID NO: 469519 - protein, 9 aa, Influenza virus
GDSPRPNDG

SEQ ID NO: 469520 - protein, 9 aa, Influenza virus
GDTPRNDDG

SEQ ID NO: 469521 - protein, 9 aa, Influenza virus
GDTPRNDDI

SEQ ID NO: 469522 - protein, 9 aa, Influenza virus
GDTPRNDDR

SEQ ID NO: 469523 - protein, 9 aa, Influenza virus
GDTPRNDDS

SEQ ID NO: 469524 - protein, 9 aa, Influenza virus
GDTPRNEDG

SEQ ID NO: 469525 - protein, 9 aa, Influenza virus
GDTPRNEDS

SEQ ID NO: 469526 - protein, 9 aa, Influenza virus
GDTPRNGDS

SEQ ID NO: 469527 - protein, 9 aa, Influenza virus
GDTPRNNDS

SEQ ID NO: 469528 - protein, 9 aa, Influenza virus
GDTPRPNDG

SEQ ID NO: 469529 - protein, 9 aa, Influenza virus
GDTPRSDDS

SEQ ID NO: 469530 - protein, 9 aa, Influenza virus
GDTVTFTFN

SEQ ID NO: 469531 - protein, 9 aa, Influenza virus
GDVFIIREP

SEQ ID NO: 469532 - protein, 9 aa, Influenza virus
GDVFVIREP

SEQ ID NO: 469533 - protein, 9 aa, Influenza virus
GDVFVMREP

SEQ ID NO: 469534 - protein, 9 aa, Influenza virus
GDVFVTREP

SEQ ID NO: 469535 - protein, 9 aa, Influenza virus
GDVFVVREP

SEQ ID NO: 469536 - protein, 9 aa, Influenza virus
GDVIVFNTI

SEQ ID NO: 469537 - protein, 9 aa, Influenza virus
GDVLDGVTA

SEQ ID NO: 469538 - protein, 9 aa, Influenza virus
GDVVLVMKR

SEQ ID NO: 469539 - protein, 9 aa, Influenza virus
GDVYKILSI

SEQ ID NO: 469540 - protein, 9 aa, Influenza virus
GDYARLYIW

SEQ ID NO: 469541 - protein, 9 aa, Influenza virus
GDYNNTTGR

SEQ ID NO: 469542 - protein, 9 aa, Influenza virus
GDYTRLYIW

SEQ ID NO: 469543 - protein, 9 aa, Influenza virus
GEALRQILR

SEQ ID NO: 469544 - protein, 9 aa, Influenza virus
GEAMVSRAR

SEQ ID NO: 469545 - protein, 9 aa, Influenza virus
GEAPSPYNS

SEQ ID NO: 469546 - protein, 9 aa, Influenza virus
GECFNPITG

SEQ ID NO: 469547 - protein, 9 aa, Influenza virus
GECFWVMTD

SEQ ID NO: 469548 - protein, 9 aa, Influenza virus
GECFYSGGT

SEQ ID NO: 469549 - protein, 9 aa, Influenza virus
GECPEYVKK

SEQ ID NO: 469550 - protein, 9 aa, Influenza virus
GECPKYAKK

SEQ ID NO: 469551 - protein, 9 aa, Influenza virus
GECPKYIKS

SEQ ID NO: 469552 - protein, 9 aa, Influenza virus
GECPKYVKK

SEQ ID NO: 469553 - protein, 9 aa, Influenza virus
GECPKYVKQ

SEQ ID NO: 469554 - protein, 9 aa, Influenza virus
GECPKYVKS

SEQ ID NO: 469555 - protein, 9 aa, Influenza virus
GECPKYVRK

SEQ ID NO: 469556 - protein, 9 aa, Influenza virus
GECPKYVRS

SEQ ID NO: 469557 - protein, 9 aa, Influenza virus
GECPNYVKK

SEQ ID NO: 469558 - protein, 9 aa, Influenza virus
GECPRYVKQ

SEQ ID NO: 469559 - protein, 9 aa, Influenza virus
GECPRYVKS

SEQ ID NO: 469560 - protein, 9 aa, Influenza virus
GECYRACFY

SEQ ID NO: 469561 - protein, 9 aa, Influenza virus
GECYWVMTD

SEQ ID NO: 469562 - protein, 9 aa, Influenza virus
GEDIAPIEH

SEQ ID NO: 469563 - protein, 9 aa, Influenza virus
GEDIAPIEY

SEQ ID NO: 469564 - protein, 9 aa, Influenza virus
GEDLAPIEY

SEQ ID NO: 469565 - protein, 9 aa, Influenza virus
GEDSDILVT

SEQ ID NO: 469566 - protein, 9 aa, Influenza virus
GEDSDVLVT

SEQ ID NO: 469567 - protein, 9 aa, Influenza virus
GEDTIEERF

SEQ ID NO: 469568 - protein, 9 aa, Influenza virus
GEDVAPIEH

SEQ ID NO: 469569 - protein, 9 aa, Influenza virus
GEDVAPIEY

SEQ ID NO: 469570 - protein, 9 aa, Influenza virus
GEETIEEKF

SEQ ID NO: 469571 - protein, 9 aa, Influenza virus
GEETIEERF

SEQ ID NO: 469572 - protein, 9 aa, Influenza virus
GEETVEERF

SEQ ID NO: 469573 - protein, 9 aa, Influenza virus
GEFNQVEKR

SEQ ID NO: 469574 - protein, 9 aa, Influenza virus
GEFNQVENR

SEQ ID NO: 469575 - protein, 9 aa, Influenza virus
GEFNQVEQR

SEQ ID NO: 469576 - protein, 9 aa, Influenza virus
GEFSQVEQR

SEQ ID NO: 469577 - protein, 9 aa, Influenza virus
GEFSQVERR

SEQ ID NO: 469578 - protein, 9 aa, Influenza virus
GEGEQIIVT

SEQ ID NO: 469579 - protein, 9 aa, Influenza virus
GEGIAADYK

SEQ ID NO: 469580 - protein, 9 aa, Influenza virus
GEGIPLHDA

SEQ ID NO: 469581 - protein, 9 aa, Influenza virus
GEGIPLYDA

SEQ ID NO: 469582 - protein, 9 aa, Influenza virus
GEGQRSWMK

SEQ ID NO: 469583 - protein, 9 aa, Influenza virus
GEGTAADYK

SEQ ID NO: 469584 - protein, 9 aa, Influenza virus
GEHAKAIGN

SEQ ID NO: 469585 - protein, 9 aa, Influenza virus
GEKANVLIG

SEQ ID NO: 469586 - protein, 9 aa, Influenza virus
GELDNNGEL

SEQ ID NO: 469587 - protein, 9 aa, Influenza virus
GELNNNGEL

SEQ ID NO: 469588 - protein, 9 aa, Influenza virus
GELRHLFSG

SEQ ID NO: 469589 - protein, 9 aa, Influenza virus
GENMAPEKI

SEQ ID NO: 469590 - protein, 9 aa, Influenza virus
GENMAPEKM

SEQ ID NO: 469591 - protein, 9 aa, Influenza virus
GENMAPEKV

SEQ ID NO: 469592 - protein, 9 aa, Influenza virus
GENSDVLVT

SEQ ID NO: 469593 - protein, 9 aa, Influenza virus
GENSGVLVT

SEQ ID NO: 469594 - protein, 9 aa, Influenza virus
GEPGVKGFG

SEQ ID NO: 469595 - protein, 9 aa, Influenza virus
GEQIIVTRE

SEQ ID NO: 469596 - protein, 9 aa, Influenza virus
GEQILIIWG

SEQ ID NO: 469597 - protein, 9 aa, Influenza virus
GEQMLIIWG

SEQ ID NO: 469598 - protein, 9 aa, Influenza virus
GEQMLVIWG

SEQ ID NO: 469599 - protein, 9 aa, Influenza virus
GEQVLVIWG

SEQ ID NO: 469600 - protein, 9 aa, Influenza virus
GERGLFGAI

SEQ ID NO: 469601 - protein, 9 aa, Influenza virus
GERIMFESN

SEQ ID NO: 469602 - protein, 9 aa, Influenza virus
GERITFESN

SEQ ID NO: 469603 - protein, 9 aa, Influenza virus
GERITFESS

SEQ ID NO: 469604 - protein, 9 aa, Influenza virus
GERTTFESN

SEQ ID NO: 469605 - protein, 9 aa, Influenza virus
GESEQIIVT

SEQ ID NO: 469606 - protein, 9 aa, Influenza virus
GESEQIVVT

SEQ ID NO: 469607 - protein, 9 aa, Influenza virus
GESEQVIVT

SEQ ID NO: 469608 - protein, 9 aa, Influenza virus
GESHCRIIQ

SEQ ID NO: 469609 - protein, 9 aa, Influenza virus
GESHGKIIQ

SEQ ID NO: 469610 - protein, 9 aa, Influenza virus
GESHGRIIQ

SEQ ID NO: 469611 - protein, 9 aa, Influenza virus
GESHGRTIQ

SEQ ID NO: 469612 - protein, 9 aa, Influenza virus
GESSDVLVT

SEQ ID NO: 469613 - protein, 9 aa, Influenza virus
GESYGRIIQ

SEQ ID NO: 469614 - protein, 9 aa, Influenza virus
GETLKIRTN

SEQ ID NO: 469615 - protein, 9 aa, Influenza virus
GETLKVESN

SEQ ID NO: 469616 - protein, 9 aa, Influenza virus
GETLNIESN

SEQ ID NO: 469617 - protein, 9 aa, Influenza virus
GETLNVESN

SEQ ID NO: 469618 - protein, 9 aa, Influenza virus
GETTGRNCT

SEQ ID NO: 469619 - protein, 9 aa, Influenza virus
GEVDNNGEL

SEQ ID NO: 469620 - protein, 9 aa, Influenza virus
GEVFVIREP

SEQ ID NO: 469621 - protein, 9 aa, Influenza virus
GEVPGWSWD

SEQ ID NO: 469622 - protein, 9 aa, Influenza virus
GEVPSPYNS

SEQ ID NO: 469623 - protein, 9 aa, Influenza virus
GEYNNTTGR

SEQ ID NO: 469624 - protein, 9 aa, Influenza virus
GFAFKQGNS

SEQ ID NO: 469625 - protein, 9 aa, Influenza virus
GFAFKYGNG

SEQ ID NO: 469626 - protein, 9 aa, Influenza virus
GFAIFSKDN

SEQ ID NO: 469627 - protein, 9 aa, Influenza virus
GFAIISKDN

SEQ ID NO: 469628 - protein, 9 aa, Influenza virus
GFAIVSKDN

SEQ ID NO: 469629 - protein, 9 aa, Influenza virus
GFAPFAKDN

SEQ ID NO: 469630 - protein, 9 aa, Influenza virus
GFAPFSKDN

SEQ ID NO: 469631 - protein, 9 aa, Influenza virus
GFAPFTKDN

SEQ ID NO: 469632 - protein, 9 aa, Influenza virus
GFAVVSKDN

SEQ ID NO: 469633 - protein, 9 aa, Influenza virus
GFCFTVMTD

SEQ ID NO: 469634 - protein, 9 aa, Influenza virus
GFEEFTMVG

SEQ ID NO: 469635 - protein, 9 aa, Influenza virus
GFEILLIED

SEQ ID NO: 469636 - protein, 9 aa, Influenza virus
GFEILLIEE

SEQ ID NO: 469637 - protein, 9 aa, Influenza virus
GFEMIWDAN

SEQ ID NO: 469638 - protein, 9 aa, Influenza virus
GFEMIWDPD

SEQ ID NO: 469639 - protein, 9 aa, Influenza virus
GFEMIWDPN

SEQ ID NO: 469640 - protein, 9 aa, Influenza virus
GFEMLKIHN

SEQ ID NO: 469641 - protein, 9 aa, Influenza virus
GFEMLKIPN

SEQ ID NO: 469642 - protein, 9 aa, Influenza virus
GFEMLKVPN

SEQ ID NO: 469643 - protein, 9 aa, Influenza virus
GFEMLRIPN

SEQ ID NO: 469644 - protein, 9 aa, Influenza virus
GFEMVWDAN

SEQ ID NO: 469645 - protein, 9 aa, Influenza virus
GFEMVWDPN

SEQ ID NO: 469646 - protein, 9 aa, Influenza virus
GFEPNGCIE

SEQ ID NO: 469647 - protein, 9 aa, Influenza virus
GFEPNGYIE

SEQ ID NO: 469648 - protein, 9 aa, Influenza virus
GFEVLFIED

SEQ ID NO: 469649 - protein, 9 aa, Influenza virus
GFEVLLIED

SEQ ID NO: 469650 - protein, 9 aa, Influenza virus
GFFGAIAGF

SEQ ID NO: 469651 - protein, 9 aa, Influenza virus
GFFGDNPRP

SEQ ID NO: 469652 - protein, 9 aa, Influenza virus
GFFPDGPQI

SEQ ID NO: 469653 - protein, 9 aa, Influenza virus
GFFPFHKDN

SEQ ID NO: 469654 - protein, 9 aa, Influenza virus
GFFRRLNWL

SEQ ID NO: 469655 - protein, 9 aa, Influenza virus
GFFSRLNWL

SEQ ID NO: 469656 - protein, 9 aa, Influenza virus
GFGFRQGDD

SEQ ID NO: 469657 - protein, 9 aa, Influenza virus
GFGFRQGND

SEQ ID NO: 469658 - protein, 9 aa, Influenza virus
GFGFRQGNS

SEQ ID NO: 469659 - protein, 9 aa, Influenza virus
GFGFRQGTD

SEQ ID NO: 469660 - protein, 9 aa, Influenza virus
GFGFRQGTS

SEQ ID NO: 469661 - protein, 9 aa, Influenza virus
GFHFEECSC

SEQ ID NO: 469662 - protein, 9 aa, Influenza virus
GFHHSNAEG

SEQ ID NO: 469663 - protein, 9 aa, Influenza virus
GFHHSNEQG

SEQ ID NO: 469664 - protein, 9 aa, Influenza virus
GFHHSNSEG

SEQ ID NO: 469665 - protein, 9 aa, Influenza virus
GFIDIWTYN

SEQ ID NO: 469666 - protein, 9 aa, Influenza virus
GFIDVWTYN

SEQ ID NO: 469667 - protein, 9 aa, Influenza virus
GFIEGGWCG

SEQ ID NO: 469668 - protein, 9 aa, Influenza virus
GFIEGGWPG

SEQ ID NO: 469669 - protein, 9 aa, Influenza virus
GFIEGGWQG

SEQ ID NO: 469670 - protein, 9 aa, Influenza virus
GFIEGGWSG

SEQ ID NO: 469671 - protein, 9 aa, Influenza virus
GFIEGGWTG

SEQ ID NO: 469672 - protein, 9 aa, Influenza virus
GFIEGRWPG

SEQ ID NO: 469673 - protein, 9 aa, Influenza virus
GFIENGWEG

SEQ ID NO: 469674 - protein, 9 aa, Influenza virus
GFIENGWQG

SEQ ID NO: 469675 - protein, 9 aa, Influenza virus
GFIFGCQNG

SEQ ID NO: 469676 - protein, 9 aa, Influenza virus
GFIIKGRSH

SEQ ID NO: 469677 - protein, 9 aa, Influenza virus
GFIMWACQK

SEQ ID NO: 469678 - protein, 9 aa, Influenza virus
GFIMWACQR

SEQ ID NO: 469679 - protein, 9 aa, Influenza virus
GFIMWTCQK

SEQ ID NO: 469680 - protein, 9 aa, Influenza virus
GFIVKGRSH

SEQ ID NO: 469681 - protein, 9 aa, Influenza virus
GFIVWACQR

SEQ ID NO: 469682 - protein, 9 aa, Influenza virus
GFIYSGIRT

SEQ ID NO: 469683 - protein, 9 aa, Influenza virus
GFKHQNAQG

SEQ ID NO: 469684 - protein, 9 aa, Influenza virus
GFKISKRGG

SEQ ID NO: 469685 - protein, 9 aa, Influenza virus
GFKISKRGN

SEQ ID NO: 469686 - protein, 9 aa, Influenza virus
GFKISKRGS

SEQ ID NO: 469687 - protein, 9 aa, Influenza virus
GFKPNGCIE

SEQ ID NO: 469688 - protein, 9 aa, Influenza virus
GFLAPRYGY

SEQ ID NO: 469689 - protein, 9 aa, Influenza virus
GFLDIWTYN

SEQ ID NO: 469690 - protein, 9 aa, Influenza virus
GFLDVWTYN

SEQ ID NO: 469691 - protein, 9 aa, Influenza virus
GFLGVWTYN

SEQ ID NO: 469692 - protein, 9 aa, Influenza virus
GFLIIGKED

SEQ ID NO: 469693 - protein, 9 aa, Influenza virus
GFLILGKED

SEQ ID NO: 469694 - protein, 9 aa, Influenza virus
GFLILGKEN

SEQ ID NO: 469695 - protein, 9 aa, Influenza virus
GFLILGRED

SEQ ID NO: 469696 - protein, 9 aa, Influenza virus
GFLNVWTYN

SEQ ID NO: 469697 - protein, 9 aa, Influenza virus
GFMDVWTYN

SEQ ID NO: 469698 - protein, 9 aa, Influenza virus
GFQHQNAEG

SEQ ID NO: 469699 - protein, 9 aa, Influenza virus
GFQHQNEQG

SEQ ID NO: 469700 - protein, 9 aa, Influenza virus
GFQHQNSEG

SEQ ID NO: 469701 - protein, 9 aa, Influenza virus
GFQHRDEEG

SEQ ID NO: 469702 - protein, 9 aa, Influenza virus
GFQHRNEEG

SEQ ID NO: 469703 - protein, 9 aa, Influenza virus
GFQHSNAQG

SEQ ID NO: 469704 - protein, 9 aa, Influenza virus
GFQHSNDQG

SEQ ID NO: 469705 - protein, 9 aa, Influenza virus
GFQHSNEQG

SEQ ID NO: 469706 - protein, 9 aa, Influenza virus
GFQHTNDQG

SEQ ID NO: 469707 - protein, 9 aa, Influenza virus
GFRDVWTYN

SEQ ID NO: 469708 - protein, 9 aa, Influenza virus
GFRHHNSEG

SEQ ID NO: 469709 - protein, 9 aa, Influenza virus
GFRHLNSEG

SEQ ID NO: 469710 - protein, 9 aa, Influenza virus
GFRHQNAEG

SEQ ID NO: 469711 - protein, 9 aa, Influenza virus
GFRHQNAQG

SEQ ID NO: 469712 - protein, 9 aa, Influenza virus
GFRHQNSEG

SEQ ID NO: 469713 - protein, 9 aa, Influenza virus
GFRHQNSQG

SEQ ID NO: 469714 - protein, 9 aa, Influenza virus
GFRHQNTQG

SEQ ID NO: 469715 - protein, 9 aa, Influenza virus
GFRISKRGS

SEQ ID NO: 469716 - protein, 9 aa, Influenza virus
GFRQGDDVW

SEQ ID NO: 469717 - protein, 9 aa, Influenza virus
GFRQGNDVW

SEQ ID NO: 469718 - protein, 9 aa, Influenza virus
GFRQGNSVW

SEQ ID NO: 469719 - protein, 9 aa, Influenza virus
GFRQGSDVW

SEQ ID NO: 469720 - protein, 9 aa, Influenza virus
GFRQGTDVW

SEQ ID NO: 469721 - protein, 9 aa, Influenza virus
GFRQGTSVW

SEQ ID NO: 469722 - protein, 9 aa, Influenza virus
GFRYQNSEG

SEQ ID NO: 469723 - protein, 9 aa, Influenza virus
GFRYSGIKT

SEQ ID NO: 469724 - protein, 9 aa, Influenza virus
GFRYSGIRT

SEQ ID NO: 469725 - protein, 9 aa, Influenza virus
GFSAESRKL

SEQ ID NO: 469726 - protein, 9 aa, Influenza virus
GFSAESRKM

SEQ ID NO: 469727 - protein, 9 aa, Influenza virus
GFSFKYGDG

SEQ ID NO: 469728 - protein, 9 aa, Influenza virus
GFSFKYGNG

SEQ ID NO: 469729 - protein, 9 aa, Influenza virus
GFSFRYGDG

SEQ ID NO: 469730 - protein, 9 aa, Influenza virus
GFSFRYGNG

SEQ ID NO: 469731 - protein, 9 aa, Influenza virus
GFSYKYDNG

SEQ ID NO: 469732 - protein, 9 aa, Influenza virus
GFSYKYGNG

SEQ ID NO: 469733 - protein, 9 aa, Influenza virus
GFSYRYGNG

SEQ ID NO: 469734 - protein, 9 aa, Influenza virus
GFTFKRTKG

SEQ ID NO: 469735 - protein, 9 aa, Influenza virus
GFTFKRTNG

SEQ ID NO: 469736 - protein, 9 aa, Influenza virus
GFTFKRTSG

SEQ ID NO: 469737 - protein, 9 aa, Influenza virus
GFTYNGIRT

SEQ ID NO: 469738 - protein, 9 aa, Influenza virus
GFTYSEIRT

SEQ ID NO: 469739 - protein, 9 aa, Influenza virus
GFTYSGIMT

SEQ ID NO: 469740 - protein, 9 aa, Influenza virus
GFTYSGIRT

SEQ ID NO: 469741 - protein, 9 aa, Influenza virus
GFTYSGMRT

SEQ ID NO: 469742 - protein, 9 aa, Influenza virus
GFTYSGVRT

SEQ ID NO: 469743 - protein, 9 aa, Influenza virus
GFTYTGVRT

SEQ ID NO: 469744 - protein, 9 aa, Influenza virus
GFVANFSME

SEQ ID NO: 469745 - protein, 9 aa, Influenza virus
GFVENLEEL

SEQ ID NO: 469746 - protein, 9 aa, Influenza virus
GFVFTLTVP

SEQ ID NO: 469747 - protein, 9 aa, Influenza virus
GFVHFVEAL

SEQ ID NO: 469748 - protein, 9 aa, Influenza virus
GFVIVSKDN

SEQ ID NO: 469749 - protein, 9 aa, Influenza virus
GFVLWACQN

SEQ ID NO: 469750 - protein, 9 aa, Influenza virus
GFVPFSKDN

SEQ ID NO: 469751 - protein, 9 aa, Influenza virus
GFVRQCFNP

SEQ ID NO: 469752 - protein, 9 aa, Influenza virus
GFVRTLFQQ

SEQ ID NO: 469753 - protein, 9 aa, Influenza virus
GFVYFVEAL

SEQ ID NO: 469754 - protein, 9 aa, Influenza virus
GFVYFVEIL

SEQ ID NO: 469755 - protein, 9 aa, Influenza virus
GFVYFVETL

SEQ ID NO: 469756 - protein, 9 aa, Influenza virus
GFWMCSNGS

SEQ ID NO: 469757 - protein, 9 aa, Influenza virus
GFYRNLVWF

SEQ ID NO: 469758 - protein, 9 aa, Influenza virus
GGAIWVTRE

SEQ ID NO: 469759 - protein, 9 aa, Influenza virus
GGAQHVEEC

SEQ ID NO: 469760 - protein, 9 aa, Influenza virus
GGCFQPCFY

SEQ ID NO: 469761 - protein, 9 aa, Influenza virus
GGCPKYVKS

SEQ ID NO: 469762 - protein, 9 aa, Influenza virus
GGDIWATRE

SEQ ID NO: 469763 - protein, 9 aa, Influenza virus
GGDIWITRE

SEQ ID NO: 469764 - protein, 9 aa, Influenza virus
GGDIWVMRE

SEQ ID NO: 469765 - protein, 9 aa, Influenza virus
GGDIWVTRE

SEQ ID NO: 469766 - protein, 9 aa, Influenza virus
GGDSFYAEL

SEQ ID NO: 469767 - protein, 9 aa, Influenza virus
GGFIFGCQN

SEQ ID NO: 469768 - protein, 9 aa, Influenza virus
GGFLAPRYG

SEQ ID NO: 469769 - protein, 9 aa, Influenza virus
GGFTFKRTK

SEQ ID NO: 469770 - protein, 9 aa, Influenza virus
GGFTFKRTN

SEQ ID NO: 469771 - protein, 9 aa, Influenza virus
GGFTFKRTS

SEQ ID NO: 469772 - protein, 9 aa, Influenza virus
GGGCFKIYH

SEQ ID NO: 469773 - protein, 9 aa, Influenza virus
GGGDIWVTR

SEQ ID NO: 469774 - protein, 9 aa, Influenza virus
GGGPDPGVK

SEQ ID NO: 469775 - protein, 9 aa, Influenza virus
GGGYAADKE

SEQ ID NO: 469776 - protein, 9 aa, Influenza virus
GGHGVKGWA

SEQ ID NO: 469777 - protein, 9 aa, Influenza virus
GGHIEECSC

SEQ ID NO: 469778 - protein, 9 aa, Influenza virus
GGHIWVTRE

SEQ ID NO: 469779 - protein, 9 aa, Influenza virus
GGIDKEPMG

SEQ ID NO: 469780 - protein, 9 aa, Influenza virus
GGIDKESMG

SEQ ID NO: 469781 - protein, 9 aa, Influenza virus
GGIDTNKTF

SEQ ID NO: 469782 - protein, 9 aa, Influenza virus
GGIGKFYIQ

SEQ ID NO: 469783 - protein, 9 aa, Influenza virus
GGIGRFYIQ

SEQ ID NO: 469784 - protein, 9 aa, Influenza virus
GGIGRFYVQ

SEQ ID NO: 469785 - protein, 9 aa, Influenza virus
GGINTNKTF

SEQ ID NO: 469786 - protein, 9 aa, Influenza virus
GGINTNRTF

SEQ ID NO: 469787 - protein, 9 aa, Influenza virus
GGIPTDVIR

SEQ ID NO: 469788 - protein, 9 aa, Influenza virus
GGIPTDVVR

SEQ ID NO: 469789 - protein, 9 aa, Influenza virus
GGLGVKGFG

SEQ ID NO: 469790 - protein, 9 aa, Influenza virus
GGLIAPDRV

SEQ ID NO: 469791 - protein, 9 aa, Influenza virus
GGLIAPNRV

SEQ ID NO: 469792 - protein, 9 aa, Influenza virus
GGLIAPRYG

SEQ ID NO: 469793 - protein, 9 aa, Influenza virus
GGLIAPSRV

SEQ ID NO: 469794 - protein, 9 aa, Influenza virus
GGLILGMQN

SEQ ID NO: 469795 - protein, 9 aa, Influenza virus
GGLLAPKYG

SEQ ID NO: 469796 - protein, 9 aa, Influenza virus
GGLLAPRYG

SEQ ID NO: 469797 - protein, 9 aa, Influenza virus
GGLVAPSRV

SEQ ID NO: 469798 - protein, 9 aa, Influenza virus
GGMPTDVVR

SEQ ID NO: 469799 - protein, 9 aa, Influenza virus
GGNEKKAKL

SEQ ID NO: 469800 - protein, 9 aa, Influenza virus
GGNIWITRE

SEQ ID NO: 469801 - protein, 9 aa, Influenza virus
GGNPDPGVK

SEQ ID NO: 469802 - protein, 9 aa, Influenza virus
GGNSFYAEL

SEQ ID NO: 469803 - protein, 9 aa, Influenza virus
GGPDPGVKG

SEQ ID NO: 469804 - protein, 9 aa, Influenza virus
GGPGVKGFG

SEQ ID NO: 469805 - protein, 9 aa, Influenza virus
GGPNLYNIR

SEQ ID NO: 469806 - protein, 9 aa, Influenza virus
GGQAFYRSI

SEQ ID NO: 469807 - protein, 9 aa, Influenza virus
GGQSFYRSI

SEQ ID NO: 469808 - protein, 9 aa, Influenza virus
GGRIAPSRV

SEQ ID NO: 469809 - protein, 9 aa, Influenza virus
GGRNSFFSR

SEQ ID NO: 469810 - protein, 9 aa, Influenza virus
GGSGIMKTE

SEQ ID NO: 469811 - protein, 9 aa, Influenza virus
GGSGTDNYG

SEQ ID NO: 469812 - protein, 9 aa, Influenza virus
GGSGTNNYG

SEQ ID NO: 469813 - protein, 9 aa, Influenza virus
GGSIITELP

SEQ ID NO: 469814 - protein, 9 aa, Influenza virus
GGSIKTKLP

SEQ ID NO: 469815 - protein, 9 aa, Influenza virus
GGSINTKLP

SEQ ID NO: 469816 - protein, 9 aa, Influenza virus
GGSINTRLP

SEQ ID NO: 469817 - protein, 9 aa, Influenza virus
GGSPDPGVK

SEQ ID NO: 469818 - protein, 9 aa, Influenza virus
GGTGSVYIE

SEQ ID NO: 469819 - protein, 9 aa, Influenza virus
GGTIASSLP

SEQ ID NO: 469820 - protein, 9 aa, Influenza virus
GGTIISNLP

SEQ ID NO: 469821 - protein, 9 aa, Influenza virus
GGTIISSLP

SEQ ID NO: 469822 - protein, 9 aa, Influenza virus
GGTINSPLP

SEQ ID NO: 469823 - protein, 9 aa, Influenza virus
GGTITSNLP

SEQ ID NO: 469824 - protein, 9 aa, Influenza virus
GGTITSPLP

SEQ ID NO: 469825 - protein, 9 aa, Influenza virus
GGTIVSSLP

SEQ ID NO: 469826 - protein, 9 aa, Influenza virus
GGTPDPGVK

SEQ ID NO: 469827 - protein, 9 aa, Influenza virus
GGTSSIYIE

SEQ ID NO: 469828 - protein, 9 aa, Influenza virus
GGTSSVYIE

SEQ ID NO: 469829 - protein, 9 aa, Influenza virus
GGTSSVYVE

SEQ ID NO: 469830 - protein, 9 aa, Influenza virus
GGVESAVLR

SEQ ID NO: 469831 - protein, 9 aa, Influenza virus
GGVNTNKTF

SEQ ID NO: 469832 - protein, 9 aa, Influenza virus
GGVPTDVIR

SEQ ID NO: 469833 - protein, 9 aa, Influenza virus
GGVPTDVVR

SEQ ID NO: 469834 - protein, 9 aa, Influenza virus
GGWATANSK

SEQ ID NO: 469835 - protein, 9 aa, Influenza virus
GGWCGMIDG

SEQ ID NO: 469836 - protein, 9 aa, Influenza virus
GGWPGLING

SEQ ID NO: 469837 - protein, 9 aa, Influenza virus
GGWPGLVAG

SEQ ID NO: 469838 - protein, 9 aa, Influenza virus
GGWQGLVDG

SEQ ID NO: 469839 - protein, 9 aa, Influenza virus
GGWQGMIDG

SEQ ID NO: 469840 - protein, 9 aa, Influenza virus
GGWQGMVDG

SEQ ID NO: 469841 - protein, 9 aa, Influenza virus
GGWSGLIAG

SEQ ID NO: 469842 - protein, 9 aa, Influenza virus
GGWSGLVAG

SEQ ID NO: 469843 - protein, 9 aa, Influenza virus
GGWSGMIDG

SEQ ID NO: 469844 - protein, 9 aa, Influenza virus
GGWTGLIDG

SEQ ID NO: 469845 - protein, 9 aa, Influenza virus
GGWTGMIDG

SEQ ID NO: 469846 - protein, 9 aa, Influenza virus
GGWTGMVDG

SEQ ID NO: 469847 - protein, 9 aa, Influenza virus
GGWTGMVNG

SEQ ID NO: 469848 - protein, 9 aa, Influenza virus
GGWTIANSK

SEQ ID NO: 469849 - protein, 9 aa, Influenza virus
GGWTTANSK

SEQ ID NO: 469850 - protein, 9 aa, Influenza virus
GGYAADKES

SEQ ID NO: 469851 - protein, 9 aa, Influenza virus
GGYDFEREG

SEQ ID NO: 469852 - protein, 9 aa, Influenza virus
GGYKDIILW

SEQ ID NO: 469853 - protein, 9 aa, Influenza virus
GGYKDVILW

SEQ ID NO: 469854 - protein, 9 aa, Influenza virus
GGYPVIKKT

SEQ ID NO: 469855 - protein, 9 aa, Influenza virus
GHDFEREGY

SEQ ID NO: 469856 - protein, 9 aa, Influenza virus
GHDKNATAS

SEQ ID NO: 469857 - protein, 9 aa, Influenza virus
GHGVKGWAF

SEQ ID NO: 469858 - protein, 9 aa, Influenza virus
GHHANNSTE

SEQ ID NO: 469859 - protein, 9 aa, Influenza virus
GHHAVANGT

SEQ ID NO: 469860 - protein, 9 aa, Influenza virus
GHHAVENGT

SEQ ID NO: 469861 - protein, 9 aa, Influenza virus
GHHAVPNGT

SEQ ID NO: 469862 - protein, 9 aa, Influenza virus
GHHAVQNGT

SEQ ID NO: 469863 - protein, 9 aa, Influenza virus
GHHAVSNGT

SEQ ID NO: 469864 - protein, 9 aa, Influenza virus
GHHAVTNGT

SEQ ID NO: 469865 - protein, 9 aa, Influenza virus
GHHSVPNGT

SEQ ID NO: 469866 - protein, 9 aa, Influenza virus
GHIEECSCY

SEQ ID NO: 469867 - protein, 9 aa, Influenza virus
GHIFVIREP

SEQ ID NO: 469868 - protein, 9 aa, Influenza virus
GHIWVTREP

SEQ ID NO: 469869 - protein, 9 aa, Influenza virus
GHLITGKSH

SEQ ID NO: 469870 - protein, 9 aa, Influenza virus
GHLTTGKSH

SEQ ID NO: 469871 - protein, 9 aa, Influenza virus
GHLVTGKSH

SEQ ID NO: 469872 - protein, 9 aa, Influenza virus
GHNGMLCAT

SEQ ID NO: 469873 - protein, 9 aa, Influenza virus
GHNITFSHN

SEQ ID NO: 469874 - protein, 9 aa, Influenza virus
GHNQEYTSG

SEQ ID NO: 469875 - protein, 9 aa, Influenza virus
GHPGVKGWA

SEQ ID NO: 469876 - protein, 9 aa, Influenza virus
GHQSTNSTD

SEQ ID NO: 469877 - protein, 9 aa, Influenza virus
GHQSTNSTE

SEQ ID NO: 469878 - protein, 9 aa, Influenza virus
GHVFVIREP

SEQ ID NO: 469879 - protein, 9 aa, Influenza virus
GHWPDGSNI

SEQ ID NO: 469880 - protein, 9 aa, Influenza virus
GHYKISKST

SEQ ID NO: 469881 - protein, 9 aa, Influenza virus
GIAADKAST

SEQ ID NO: 469882 - protein, 9 aa, Influenza virus
GIAADKEST

SEQ ID NO: 469883 - protein, 9 aa, Influenza virus
GIAADKTST

SEQ ID NO: 469884 - protein, 9 aa, Influenza virus
GIAADKVST

SEQ ID NO: 469885 - protein, 9 aa, Influenza virus
GIAADRDST

SEQ ID NO: 469886 - protein, 9 aa, Influenza virus
GIAADREST

SEQ ID NO: 469887 - protein, 9 aa, Influenza virus
GIAADRGST

SEQ ID NO: 469888 - protein, 9 aa, Influenza virus
GIAADYKST

SEQ ID NO: 469889 - protein, 9 aa, Influenza virus
GIAAEKEST

SEQ ID NO: 469890 - protein, 9 aa, Influenza virus
GIAIALGII

SEQ ID NO: 469891 - protein, 9 aa, Influenza virus
GIAIVLGII

SEQ ID NO: 469892 - protein, 9 aa, Influenza virus
GIANLGLNI

SEQ ID NO: 469893 - protein, 9 aa, Influenza virus
GICAVATTH

SEQ ID NO: 469894 - protein, 9 aa, Influenza virus
GICPVVFTD

SEQ ID NO: 469895 - protein, 9 aa, Influenza virus
GICPVVMTD

SEQ ID NO: 469896 - protein, 9 aa, Influenza virus
GICTVVMTD

SEQ ID NO: 469897 - protein, 9 aa, Influenza virus
GICVVAVTD

SEQ ID NO: 469898 - protein, 9 aa, Influenza virus
GICYPGILE

SEQ ID NO: 469899 - protein, 9 aa, Influenza virus
GICYPGSIE

SEQ ID NO: 469900 - protein, 9 aa, Influenza virus
GICYPGSLD

SEQ ID NO: 469901 - protein, 9 aa, Influenza virus
GICYPGSVE

SEQ ID NO: 469902 - protein, 9 aa, Influenza virus
GICYPGTLE

SEQ ID NO: 469903 - protein, 9 aa, Influenza virus
GICYPGTLG

SEQ ID NO: 469904 - protein, 9 aa, Influenza virus
GIDKEPMGF

SEQ ID NO: 469905 - protein, 9 aa, Influenza virus
GIDKESMGF

SEQ ID NO: 469906 - protein, 9 aa, Influenza virus
GIDKICLGH

SEQ ID NO: 469907 - protein, 9 aa, Influenza virus
GIDKVCTKG

SEQ ID NO: 469908 - protein, 9 aa, Influenza virus
GIDPFKLLQ

SEQ ID NO: 469909 - protein, 9 aa, Influenza virus
GIDPFRLLQ

SEQ ID NO: 469910 - protein, 9 aa, Influenza virus
GIDTNKTFQ

SEQ ID NO: 469911 - protein, 9 aa, Influenza virus
GIEVVNATE

SEQ ID NO: 469912 - protein, 9 aa, Influenza virus
GIEYNGKSL

SEQ ID NO: 469913 - protein, 9 aa, Influenza virus
GIFENSCIE

SEQ ID NO: 469914 - protein, 9 aa, Influenza virus
GIFENSCLE

SEQ ID NO: 469915 - protein, 9 aa, Influenza virus
GIFESSCLE

SEQ ID NO: 469916 - protein, 9 aa, Influenza virus
GIFFWMCSN

SEQ ID NO: 469917 - protein, 9 aa, Influenza virus
GIFGAIAGF

SEQ ID NO: 469918 - protein, 9 aa, Influenza virus
GIFGDNPRP

SEQ ID NO: 469919 - protein, 9 aa, Influenza virus
GIFGDSPRP

SEQ ID NO: 469920 - protein, 9 aa, Influenza virus
GIFGNSCLE

SEQ ID NO: 469921 - protein, 9 aa, Influenza virus
GIFGPVHFR

SEQ ID NO: 469922 - protein, 9 aa, Influenza virus
GIFLWMCSN

SEQ ID NO: 469923 - protein, 9 aa, Influenza virus
GIGIAADRD

SEQ ID NO: 469924 - protein, 9 aa, Influenza virus
GIGKFYIQM

SEQ ID NO: 469925 - protein, 9 aa, Influenza virus
GIGNLAFNA

SEQ ID NO: 469926 - protein, 9 aa, Influenza virus
GIGNLVFNT

SEQ ID NO: 469927 - protein, 9 aa, Influenza virus
GIGQAADLK

SEQ ID NO: 469928 - protein, 9 aa, Influenza virus
GIGQAADYK

SEQ ID NO: 469929 - protein, 9 aa, Influenza virus
GIGRFYIQM

SEQ ID NO: 469930 - protein, 9 aa, Influenza virus
GIGRFYVQM

SEQ ID NO: 469931 - protein, 9 aa, Influenza virus
GIGRMTICI

SEQ ID NO: 469932 - protein, 9 aa, Influenza virus
GIGRMTICV

SEQ ID NO: 469933 - protein, 9 aa, Influenza virus
GIHHPDSET

SEQ ID NO: 469934 - protein, 9 aa, Influenza virus
GIHHPDTEA

SEQ ID NO: 469935 - protein, 9 aa, Influenza virus
GIHHPDTEE

SEQ ID NO: 469936 - protein, 9 aa, Influenza virus
GIHHPDTET

SEQ ID NO: 469937 - protein, 9 aa, Influenza virus
GIHHPPDAK

SEQ ID NO: 469938 - protein, 9 aa, Influenza virus
GIHHPPDET

SEQ ID NO: 469939 - protein, 9 aa, Influenza virus
GIHHPPDTK

SEQ ID NO: 469940 - protein, 9 aa, Influenza virus
GIHHPPNTK

SEQ ID NO: 469941 - protein, 9 aa, Influenza virus
GIHHPSSAQ

SEQ ID NO: 469942 - protein, 9 aa, Influenza virus
GIHHPSSTK

SEQ ID NO: 469943 - protein, 9 aa, Influenza virus
GIHHPSSTQ

SEQ ID NO: 469944 - protein, 9 aa, Influenza virus
GIILGNPKC

SEQ ID NO: 469945 - protein, 9 aa, Influenza virus
GIINLLIGI

SEQ ID NO: 469946 - protein, 9 aa, Influenza virus
GIITDTFKS

SEQ ID NO: 469947 - protein, 9 aa, Influenza virus
GIITDTIKS

SEQ ID NO: 469948 - protein, 9 aa, Influenza virus
GIITDTIRS

SEQ ID NO: 469949 - protein, 9 aa, Influenza virus
GIITDTLKS

SEQ ID NO: 469950 - protein, 9 aa, Influenza virus
GIITETIKS

SEQ ID NO: 469951 - protein, 9 aa, Influenza virus
GIITGPPQC

SEQ ID NO: 469952 - protein, 9 aa, Influenza virus
GIITGTIKS

SEQ ID NO: 469953 - protein, 9 aa, Influenza virus
GIKGFAFLD

SEQ ID NO: 469954 - protein, 9 aa, Influenza virus
GIKGFGFLN

SEQ ID NO: 469955 - protein, 9 aa, Influenza virus
GIKGFSFKY

SEQ ID NO: 469956 - protein, 9 aa, Influenza virus
GIKGFSFRY

SEQ ID NO: 469957 - protein, 9 aa, Influenza virus
GIKLKSEDN

SEQ ID NO: 469958 - protein, 9 aa, Influenza virus
GIKLKTEDN

SEQ ID NO: 469959 - protein, 9 aa, Influenza virus
GIKSFSRTE

SEQ ID NO: 469960 - protein, 9 aa, Influenza virus
GIKSFSRTQ

SEQ ID NO: 469961 - protein, 9 aa, Influenza virus
GIKTDGATS

SEQ ID NO: 469962 - protein, 9 aa, Influenza virus
GIKVDTLTE

SEQ ID NO: 469963 - protein, 9 aa, Influenza virus
GILEDEQMY

SEQ ID NO: 469964 - protein, 9 aa, Influenza virus
GILGFVFTL

SEQ ID NO: 469965 - protein, 9 aa, Influenza virus
GILGILTGP

SEQ ID NO: 469966 - protein, 9 aa, Influenza virus
GILGTIIGP

SEQ ID NO: 469967 - protein, 9 aa, Influenza virus
GILHLILWI

SEQ ID NO: 469968 - protein, 9 aa, Influenza virus
GILHLVLWI

SEQ ID NO: 469969 - protein, 9 aa, Influenza virus
GILKRGETL

SEQ ID NO: 469970 - protein, 9 aa, Influenza virus
GILTDTSRP

SEQ ID NO: 469971 - protein, 9 aa, Influenza virus
GILTGPPQC

SEQ ID NO: 469972 - protein, 9 aa, Influenza virus
GIMKTEGTL

SEQ ID NO: 469973 - protein, 9 aa, Influenza virus
GIMKTEKTL

SEQ ID NO: 469974 - protein, 9 aa, Influenza virus
GIMKTERTL

SEQ ID NO: 469975 - protein, 9 aa, Influenza virus
GIMKTGGTL

SEQ ID NO: 469976 - protein, 9 aa, Influenza virus
GIMNTSKPF

SEQ ID NO: 469977 - protein, 9 aa, Influenza virus
GINDRNFWR

SEQ ID NO: 469978 - protein, 9 aa, Influenza virus
GINESADMS

SEQ ID NO: 469979 - protein, 9 aa, Influenza virus
GINKVCTKG

SEQ ID NO: 469980 - protein, 9 aa, Influenza virus
GINMSKKKS

SEQ ID NO: 469981 - protein, 9 aa, Influenza virus
GINTNKTFQ

SEQ ID NO: 469982 - protein, 9 aa, Influenza virus
GINTNRTFQ

SEQ ID NO: 469983 - protein, 9 aa, Influenza virus
GIPESMREE

SEQ ID NO: 469984 - protein, 9 aa, Influenza virus
GIPFHLGTK

SEQ ID NO: 469985 - protein, 9 aa, Influenza virus
GIPFHLGTR

SEQ ID NO: 469986 - protein, 9 aa, Influenza virus
GIPLHDAIK

SEQ ID NO: 469987 - protein, 9 aa, Influenza virus
GIPLYDAIK

SEQ ID NO: 469988 - protein, 9 aa, Influenza virus
GIPLYDAVK

SEQ ID NO: 469989 - protein, 9 aa, Influenza virus
GIPLYDAVR

SEQ ID NO: 469990 - protein, 9 aa, Influenza virus
GIPPLELGD

SEQ ID NO: 469991 - protein, 9 aa, Influenza virus
GIPPLELRD

SEQ ID NO: 469992 - protein, 9 aa, Influenza virus
GIPPLVLGD

SEQ ID NO: 469993 - protein, 9 aa, Influenza virus
GIPSDTPRG

SEQ ID NO: 469994 - protein, 9 aa, Influenza virus
GIPTDTPRG

SEQ ID NO: 469995 - protein, 9 aa, Influenza virus
GIPTDTPRI

SEQ ID NO: 469996 - protein, 9 aa, Influenza virus
GIPTDTPRV

SEQ ID NO: 469997 - protein, 9 aa, Influenza virus
GIPTDVVRS

SEQ ID NO: 469998 - protein, 9 aa, Influenza virus
GIQAGVDRF

SEQ ID NO: 469999 - protein, 9 aa, Influenza virus
GIQAGVNRF

SEQ ID NO: 470000 - protein, 9 aa, Influenza virus
GIQIASNEN

SEQ ID NO: 470001 - protein, 9 aa, Influenza virus
GIQSDAQID

SEQ ID NO: 470002 - protein, 9 aa, Influenza virus
GIREWSYLI

SEQ ID NO: 470003 - protein, 9 aa, Influenza virus
GIRIGSKGD

SEQ ID NO: 470004 - protein, 9 aa, Influenza virus
GIRIGSKGH

SEQ ID NO: 470005 - protein, 9 aa, Influenza virus
GIRIGSRGE

SEQ ID NO: 470006 - protein, 9 aa, Influenza virus
GIRIGSRGH

SEQ ID NO: 470007 - protein, 9 aa, Influenza virus
GIRPGYNGQ

SEQ ID NO: 470008 - protein, 9 aa, Influenza virus
GIRSFSRTE

SEQ ID NO: 470009 - protein, 9 aa, Influenza virus
GIRTDGATS

SEQ ID NO: 470010 - protein, 9 aa, Influenza virus
GIRVGSRGH

SEQ ID NO: 470011 - protein, 9 aa, Influenza virus
GISFWMCSN

SEQ ID NO: 470012 - protein, 9 aa, Influenza virus
GISGADDDA

SEQ ID NO: 470013 - protein, 9 aa, Influenza virus
GISGPDDGA

SEQ ID NO: 470014 - protein, 9 aa, Influenza virus
GISGPDNEA

SEQ ID NO: 470015 - protein, 9 aa, Influenza virus
GISGPDNGA

SEQ ID NO: 470016 - protein, 9 aa, Influenza virus
GISGPDSGA

SEQ ID NO: 470017 - protein, 9 aa, Influenza virus
GISIWMCSN

SEQ ID NO: 470018 - protein, 9 aa, Influenza virus
GISLWMCSN

SEQ ID NO: 470019 - protein, 9 aa, Influenza virus
GISNVGLKV

SEQ ID NO: 470020 - protein, 9 aa, Influenza virus
GISNVGLNV

SEQ ID NO: 470021 - protein, 9 aa, Influenza virus
GISPIHLGD

SEQ ID NO: 470022 - protein, 9 aa, Influenza virus
GISPLELGD

SEQ ID NO: 470023 - protein, 9 aa, Influenza virus
GISPVHLGD

SEQ ID NO: 470024 - protein, 9 aa, Influenza virus
GISSMGEAM

SEQ ID NO: 470025 - protein, 9 aa, Influenza virus
GISSMMEAM

SEQ ID NO: 470026 - protein, 9 aa, Influenza virus
GISSMVEAM

SEQ ID NO: 470027 - protein, 9 aa, Influenza virus
GITGPDATA

SEQ ID NO: 470028 - protein, 9 aa, Influenza virus
GITGPDSTA

SEQ ID NO: 470029 - protein, 9 aa, Influenza virus
GITGPDTTA

SEQ ID NO: 470030 - protein, 9 aa, Influenza virus
GITNKINSI

SEQ ID NO: 470031 - protein, 9 aa, Influenza virus
GITNKVNSI

SEQ ID NO: 470032 - protein, 9 aa, Influenza virus
GITTHFQRK

SEQ ID NO: 470033 - protein, 9 aa, Influenza virus
GITVIKNNM

SEQ ID NO: 470034 - protein, 9 aa, Influenza virus
GIVADRDST

SEQ ID NO: 470035 - protein, 9 aa, Influenza virus
GIVECVCRD

SEQ ID NO: 470036 - protein, 9 aa, Influenza virus
GIVHLILWI

SEQ ID NO: 470037 - protein, 9 aa, Influenza virus
GIVNTTLST

SEQ ID NO: 470038 - protein, 9 aa, Influenza virus
GIWDTLIER

SEQ ID NO: 470039 - protein, 9 aa, Influenza virus
GIYKILTIY

SEQ ID NO: 470040 - protein, 9 aa, Influenza virus
GIYQILAIY

SEQ ID NO: 470041 - protein, 9 aa, Influenza virus
GIYQILSIY

SEQ ID NO: 470042 - protein, 9 aa, Influenza virus
GKADTRILF

SEQ ID NO: 470043 - protein, 9 aa, Influenza virus
GKAPISLGD

SEQ ID NO: 470044 - protein, 9 aa, Influenza virus
GKAPISLGG

SEQ ID NO: 470045 - protein, 9 aa, Influenza virus
GKAQHIEEC

SEQ ID NO: 470046 - protein, 9 aa, Influenza virus
GKAWLHICV

SEQ ID NO: 470047 - protein, 9 aa, Influenza virus
GKAWLHVCI

SEQ ID NO: 470048 - protein, 9 aa, Influenza virus
GKAWLHVCV

SEQ ID NO: 470049 - protein, 9 aa, Influenza virus
GKCNDPYPG

SEQ ID NO: 470050 - protein, 9 aa, Influenza virus
GKCNEPYPG

SEQ ID NO: 470051 - protein, 9 aa, Influenza virus
GKCNTKCQT

SEQ ID NO: 470052 - protein, 9 aa, Influenza virus
GKCPKYIPS

SEQ ID NO: 470053 - protein, 9 aa, Influenza virus
GKCPKYISS

SEQ ID NO: 470054 - protein, 9 aa, Influenza virus
GKCPKYVKQ

SEQ ID NO: 470055 - protein, 9 aa, Influenza virus
GKCPKYVKS

SEQ ID NO: 470056 - protein, 9 aa, Influenza virus
GKCPRYIKQ

SEQ ID NO: 470057 - protein, 9 aa, Influenza virus
GKCPRYIPS

SEQ ID NO: 470058 - protein, 9 aa, Influenza virus
GKCPRYVKQ

SEQ ID NO: 470059 - protein, 9 aa, Influenza virus
GKCPRYVRQ

SEQ ID NO: 470060 - protein, 9 aa, Influenza virus
GKCYQFALG

SEQ ID NO: 470061 - protein, 9 aa, Influenza virus
GKDNAIRIG

SEQ ID NO: 470062 - protein, 9 aa, Influenza virus
GKDNAVRIG

SEQ ID NO: 470063 - protein, 9 aa, Influenza virus
GKDPKKTGG

SEQ ID NO: 470064 - protein, 9 aa, Influenza virus
GKEDKRYGP

SEQ ID NO: 470065 - protein, 9 aa, Influenza virus
GKEDRRYGP

SEQ ID NO: 470066 - protein, 9 aa, Influenza virus
GKENKKYGP

SEQ ID NO: 470067 - protein, 9 aa, Influenza virus
GKENKRYGP

SEQ ID NO: 470068 - protein, 9 aa, Influenza virus
GKEPISLGD

SEQ ID NO: 470069 - protein, 9 aa, Influenza virus
GKEWLHVCI

SEQ ID NO: 470070 - protein, 9 aa, Influenza virus
GKEWMHICM

SEQ ID NO: 470071 - protein, 9 aa, Influenza virus
GKEWMHVCI

SEQ ID NO: 470072 - protein, 9 aa, Influenza virus
GKEWMHVCM

SEQ ID NO: 470073 - protein, 9 aa, Influenza virus
GKFEFIAED

SEQ ID NO: 470074 - protein, 9 aa, Influenza virus
GKFEFIAEE

SEQ ID NO: 470075 - protein, 9 aa, Influenza virus
GKFEFIVEK

SEQ ID NO: 470076 - protein, 9 aa, Influenza virus
GKFQTAAQK

SEQ ID NO: 470077 - protein, 9 aa, Influenza virus
GKFQTAAQR

SEQ ID NO: 470078 - protein, 9 aa, Influenza virus
GKFTNEEAL

SEQ ID NO: 470079 - protein, 9 aa, Influenza virus
GKFYIQMCT

SEQ ID NO: 470080 - protein, 9 aa, Influenza virus
GKGCFDILH

SEQ ID NO: 470081 - protein, 9 aa, Influenza virus
GKGCFDLYH

SEQ ID NO: 470082 - protein, 9 aa, Influenza virus
GKGCFEIYH

SEQ ID NO: 470083 - protein, 9 aa, Influenza virus
GKGCFELYH

SEQ ID NO: 470084 - protein, 9 aa, Influenza virus
GKGLGIQSG

SEQ ID NO: 470085 - protein, 9 aa, Influenza virus
GKGRIFQSH

SEQ ID NO: 470086 - protein, 9 aa, Influenza virus
GKGRIFQSP

SEQ ID NO: 470087 - protein, 9 aa, Influenza virus
GKGRIFQSR

SEQ ID NO: 470088 - protein, 9 aa, Influenza virus
GKGRYGVKG

SEQ ID NO: 470089 - protein, 9 aa, Influenza virus
GKGSWPDGA

SEQ ID NO: 470090 - protein, 9 aa, Influenza virus
GKGYMFESK

SEQ ID NO: 470091 - protein, 9 aa, Influenza virus
GKHIVERIL

SEQ ID NO: 470092 - protein, 9 aa, Influenza virus
GKHSNGTIH

SEQ ID NO: 470093 - protein, 9 aa, Influenza virus
GKIAHISPL

SEQ ID NO: 470094 - protein, 9 aa, Influenza virus
GKIIHISPL

SEQ ID NO: 470095 - protein, 9 aa, Influenza virus
GKIIKWEPL

SEQ ID NO: 470096 - protein, 9 aa, Influenza virus
GKIIQNEDI

SEQ ID NO: 470097 - protein, 9 aa, Influenza virus
GKILKWEPL

SEQ ID NO: 470098 - protein, 9 aa, Influenza virus
GKILKWESL

SEQ ID NO: 470099 - protein, 9 aa, Influenza virus
GKILRTQES

SEQ ID NO: 470100 - protein, 9 aa, Influenza virus
GKISHISPL

SEQ ID NO: 470101 - protein, 9 aa, Influenza virus
GKITNKVNN

SEQ ID NO: 470102 - protein, 9 aa, Influenza virus
GKIVHIGPL

SEQ ID NO: 470103 - protein, 9 aa, Influenza virus
GKIVHISPL

SEQ ID NO: 470104 - protein, 9 aa, Influenza virus
GKIVHVSPL

SEQ ID NO: 470105 - protein, 9 aa, Influenza virus
GKKAVDLGS

SEQ ID NO: 470106 - protein, 9 aa, Influenza virus
GKKEEFSEI

SEQ ID NO: 470107 - protein, 9 aa, Influenza virus
GKKEFSEIM

SEQ ID NO: 470108 - protein, 9 aa, Influenza virus
GKKGKWLNQ

SEQ ID NO: 470109 - protein, 9 aa, Influenza virus
GKLCKLNGI

SEQ ID NO: 470110 - protein, 9 aa, Influenza virus
GKLCRLRGI

SEQ ID NO: 470111 - protein, 9 aa, Influenza virus
GKLCRLSGI

SEQ ID NO: 470112 - protein, 9 aa, Influenza virus
GKLEFIAEE

SEQ ID NO: 470113 - protein, 9 aa, Influenza virus
GKLKRRAIA

SEQ ID NO: 470114 - protein, 9 aa, Influenza virus
GKLNRFIEK

SEQ ID NO: 470115 - protein, 9 aa, Influenza virus
GKLNRIIEK

SEQ ID NO: 470116 - protein, 9 aa, Influenza virus
GKLNRLIDK

SEQ ID NO: 470117 - protein, 9 aa, Influenza virus
GKLNRLIDR

SEQ ID NO: 470118 - protein, 9 aa, Influenza virus
GKLNRLIEK

SEQ ID NO: 470119 - protein, 9 aa, Influenza virus
GKLNRLIER

SEQ ID NO: 470120 - protein, 9 aa, Influenza virus
GKLNRLIGK

SEQ ID NO: 470121 - protein, 9 aa, Influenza virus
GKLNRLISK

SEQ ID NO: 470122 - protein, 9 aa, Influenza virus
GKMNTQFEA

SEQ ID NO: 470123 - protein, 9 aa, Influenza virus
GKMRDSIKS

SEQ ID NO: 470124 - protein, 9 aa, Influenza virus
GKMTDSIKS

SEQ ID NO: 470125 - protein, 9 aa, Influenza virus
GKNADLEAL

SEQ ID NO: 470126 - protein, 9 aa, Influenza virus
GKNSDLEAL

SEQ ID NO: 470127 - protein, 9 aa, Influenza virus
GKNSFYAEL

SEQ ID NO: 470128 - protein, 9 aa, Influenza virus
GKNTDLEAL

SEQ ID NO: 470129 - protein, 9 aa, Influenza virus
GKNTDLEVL

SEQ ID NO: 470130 - protein, 9 aa, Influenza virus
GKPFQNVNR

SEQ ID NO: 470131 - protein, 9 aa, Influenza virus
GKQAKGLFG

SEQ ID NO: 470132 - protein, 9 aa, Influenza virus
GKQPISLGD

SEQ ID NO: 470133 - protein, 9 aa, Influenza virus
GKRGKWVKS

SEQ ID NO: 470134 - protein, 9 aa, Influenza virus
GKSDKICIG

SEQ ID NO: 470135 - protein, 9 aa, Influenza virus
GKSDRICIG

SEQ ID NO: 470136 - protein, 9 aa, Influenza virus
GKSGACKRA

SEQ ID NO: 470137 - protein, 9 aa, Influenza virus
GKSHGRILK

SEQ ID NO: 470138 - protein, 9 aa, Influenza virus
GKSHGRVLK

SEQ ID NO: 470139 - protein, 9 aa, Influenza virus
GKSLGIQSD

SEQ ID NO: 470140 - protein, 9 aa, Influenza virus
GKSSACKRA

SEQ ID NO: 470141 - protein, 9 aa, Influenza virus
GKTKATKME

SEQ ID NO: 470142 - protein, 9 aa, Influenza virus
GKTKATKMK

SEQ ID NO: 470143 - protein, 9 aa, Influenza virus
GKTLKWEPL

SEQ ID NO: 470144 - protein, 9 aa, Influenza virus
GKTNEKFHQ

SEQ ID NO: 470145 - protein, 9 aa, Influenza virus
GKTNQQFEL

SEQ ID NO: 470146 - protein, 9 aa, Influenza virus
GKTSWSYIV

SEQ ID NO: 470147 - protein, 9 aa, Influenza virus
GKVCRTLLA

SEQ ID NO: 470148 - protein, 9 aa, Influenza virus
GKVECICRD

SEQ ID NO: 470149 - protein, 9 aa, Influenza virus
GKVECVCRD

SEQ ID NO: 470150 - protein, 9 aa, Influenza virus
GKVVHISPL

SEQ ID NO: 470151 - protein, 9 aa, Influenza virus
GKWDTLIER

SEQ ID NO: 470152 - protein, 9 aa, Influenza virus
GKWREQLSQ

SEQ ID NO: 470153 - protein, 9 aa, Influenza virus
GLANLGLNI

SEQ ID NO: 470154 - protein, 9 aa, Influenza virus
GLANLGLNV

SEQ ID NO: 470155 - protein, 9 aa, Influenza virus
GLCTINSWH

SEQ ID NO: 470156 - protein, 9 aa, Influenza virus
GLCYPGELD

SEQ ID NO: 470157 - protein, 9 aa, Influenza virus
GLCYPGELN

SEQ ID NO: 470158 - protein, 9 aa, Influenza virus
GLCYPGSFN

SEQ ID NO: 470159 - protein, 9 aa, Influenza virus
GLDIRTATR

SEQ ID NO: 470160 - protein, 9 aa, Influenza virus
GLDKICLGH

SEQ ID NO: 470161 - protein, 9 aa, Influenza virus
GLDNEPGSE

SEQ ID NO: 470162 - protein, 9 aa, Influenza virus
GLDNEPGSG

SEQ ID NO: 470163 - protein, 9 aa, Influenza virus
GLDRICLGH

SEQ ID NO: 470164 - protein, 9 aa, Influenza virus
GLFENSCLE

SEQ ID NO: 470165 - protein, 9 aa, Influenza virus
GLFFFCLKN

SEQ ID NO: 470166 - protein, 9 aa, Influenza virus
GLFFWMCSN

SEQ ID NO: 470167 - protein, 9 aa, Influenza virus
GLFGAIAGF

SEQ ID NO: 470168 - protein, 9 aa, Influenza virus
GLFGAKAGF

SEQ ID NO: 470169 - protein, 9 aa, Influenza virus
GLFLWMCSN

SEQ ID NO: 470170 - protein, 9 aa, Influenza virus
GLGVKGFGF

SEQ ID NO: 470171 - protein, 9 aa, Influenza virus
GLHDANVRN

SEQ ID NO: 470172 - protein, 9 aa, Influenza virus
GLIAGWYGF

SEQ ID NO: 470173 - protein, 9 aa, Influenza virus
GLIAPDRVS

SEQ ID NO: 470174 - protein, 9 aa, Influenza virus
GLIAPRYGY

SEQ ID NO: 470175 - protein, 9 aa, Influenza virus
GLIAPSRVS

SEQ ID NO: 470176 - protein, 9 aa, Influenza virus
GLIAPSRVT

SEQ ID NO: 470177 - protein, 9 aa, Influenza virus
GLICATCEQ

SEQ ID NO: 470178 - protein, 9 aa, Influenza virus
GLIDGWYGF

SEQ ID NO: 470179 - protein, 9 aa, Influenza virus
GLIDGWYGY

SEQ ID NO: 470180 - protein, 9 aa, Influenza virus
GLIFMCVKN

SEQ ID NO: 470181 - protein, 9 aa, Influenza virus
GLILAFILW

SEQ ID NO: 470182 - protein, 9 aa, Influenza virus
GLILAFIMW

SEQ ID NO: 470183 - protein, 9 aa, Influenza virus
GLILGMQNG

SEQ ID NO: 470184 - protein, 9 aa, Influenza virus
GLILGNPKC

SEQ ID NO: 470185 - protein, 9 aa, Influenza virus
GLILSFIMW

SEQ ID NO: 470186 - protein, 9 aa, Influenza virus
GLILSNPKC

SEQ ID NO: 470187 - protein, 9 aa, Influenza virus
GLILTFIMW

SEQ ID NO: 470188 - protein, 9 aa, Influenza virus
GLINGWYGF

SEQ ID NO: 470189 - protein, 9 aa, Influenza virus
GLISTPLGS

SEQ ID NO: 470190 - protein, 9 aa, Influenza virus
GLISTPLGT

SEQ ID NO: 470191 - protein, 9 aa, Influenza virus
GLITDTIKS

SEQ ID NO: 470192 - protein, 9 aa, Influenza virus
GLIYGNPSC

SEQ ID NO: 470193 - protein, 9 aa, Influenza virus
GLIYNRMGA

SEQ ID NO: 470194 - protein, 9 aa, Influenza virus
GLIYNRMGT

SEQ ID NO: 470195 - protein, 9 aa, Influenza virus
GLKISSSFS

SEQ ID NO: 470196 - protein, 9 aa, Influenza virus
GLKVSLHLK

SEQ ID NO: 470197 - protein, 9 aa, Influenza virus
GLLAPKYGY

SEQ ID NO: 470198 - protein, 9 aa, Influenza virus
GLLAPRYGY

SEQ ID NO: 470199 - protein, 9 aa, Influenza virus
GLLDVWTYN

SEQ ID NO: 470200 - protein, 9 aa, Influenza virus
GLLEVGTRW

SEQ ID NO: 470201 - protein, 9 aa, Influenza virus
GLLGAIAGF

SEQ ID NO: 470202 - protein, 9 aa, Influenza virus
GLLGIITGP

SEQ ID NO: 470203 - protein, 9 aa, Influenza virus
GLLGILIGP

SEQ ID NO: 470204 - protein, 9 aa, Influenza virus
GLLGTITGP

SEQ ID NO: 470205 - protein, 9 aa, Influenza virus
GLLGTLIGP

SEQ ID NO: 470206 - protein, 9 aa, Influenza virus
GLLGTLTGP

SEQ ID NO: 470207 - protein, 9 aa, Influenza virus
GLLGTVTGP

SEQ ID NO: 470208 - protein, 9 aa, Influenza virus
GLLISDGGP

SEQ ID NO: 470209 - protein, 9 aa, Influenza virus
GLLLQIISL

SEQ ID NO: 470210 - protein, 9 aa, Influenza virus
GLLLQITSL

SEQ ID NO: 470211 - protein, 9 aa, Influenza virus
GLLLQVTSL

SEQ ID NO: 470212 - protein, 9 aa, Influenza virus
GLLLWMCSN

SEQ ID NO: 470213 - protein, 9 aa, Influenza virus
GLLVADGGP

SEQ ID NO: 470214 - protein, 9 aa, Influenza virus
GLLVALENQ

SEQ ID NO: 470215 - protein, 9 aa, Influenza virus
GLLVSDGGP

SEQ ID NO: 470216 - protein, 9 aa, Influenza virus
GLMGRTRIS

SEQ ID NO: 470217 - protein, 9 aa, Influenza virus
GLMSTPLGS

SEQ ID NO: 470218 - protein, 9 aa, Influenza virus
GLNIGLHLK

SEQ ID NO: 470219 - protein, 9 aa, Influenza virus
GLNIGLHLR

SEQ ID NO: 470220 - protein, 9 aa, Influenza virus
GLNISLHLK

SEQ ID NO: 470221 - protein, 9 aa, Influenza virus
GLNMSLHLK

SEQ ID NO: 470222 - protein, 9 aa, Influenza virus
GLNNEPGSG

SEQ ID NO: 470223 - protein, 9 aa, Influenza virus
GLNVGLHLK

SEQ ID NO: 470224 - protein, 9 aa, Influenza virus
GLNVSLHLK

SEQ ID NO: 470225 - protein, 9 aa, Influenza virus
GLNVSLHLR

SEQ ID NO: 470226 - protein, 9 aa, Influenza virus
GLPQSGRIV

SEQ ID NO: 470227 - protein, 9 aa, Influenza virus
GLPSDTPRG

SEQ ID NO: 470228 - protein, 9 aa, Influenza virus
GLPVGGNEK

SEQ ID NO: 470229 - protein, 9 aa, Influenza virus
GLQRRRFIQ

SEQ ID NO: 470230 - protein, 9 aa, Influenza virus
GLQRRRFVQ

SEQ ID NO: 470231 - protein, 9 aa, Influenza virus
GLQSSDDFA

SEQ ID NO: 470232 - protein, 9 aa, Influenza virus
GLREQKQEF

SEQ ID NO: 470233 - protein, 9 aa, Influenza virus
GLRILIRGN

SEQ ID NO: 470234 - protein, 9 aa, Influenza virus
GLRILVRGN

SEQ ID NO: 470235 - protein, 9 aa, Influenza virus
GLRISSSFS

SEQ ID NO: 470236 - protein, 9 aa, Influenza virus
GLRNIPAIA

SEQ ID NO: 470237 - protein, 9 aa, Influenza virus
GLRNIPQIE

SEQ ID NO: 470238 - protein, 9 aa, Influenza virus
GLRNIPSIQ

SEQ ID NO: 470239 - protein, 9 aa, Influenza virus
GLRNTPSID

SEQ ID NO: 470240 - protein, 9 aa, Influenza virus
GLRNTPSIE

SEQ ID NO: 470241 - protein, 9 aa, Influenza virus
GLRNTPSVE

SEQ ID NO: 470242 - protein, 9 aa, Influenza virus
GLRNVPAIA

SEQ ID NO: 470243 - protein, 9 aa, Influenza virus
GLRNVPAIS

SEQ ID NO: 470244 - protein, 9 aa, Influenza virus
GLRNVPAIT

SEQ ID NO: 470245 - protein, 9 aa, Influenza virus
GLRNVPQAQ

SEQ ID NO: 470246 - protein, 9 aa, Influenza virus
GLRNVPQIE

SEQ ID NO: 470247 - protein, 9 aa, Influenza virus
GLRNVPQIQ

SEQ ID NO: 470248 - protein, 9 aa, Influenza virus
GLRNVPQME

SEQ ID NO: 470249 - protein, 9 aa, Influenza virus
GLRNVPQVQ

SEQ ID NO: 470250 - protein, 9 aa, Influenza virus
GLRNVPSIQ

SEQ ID NO: 470251 - protein, 9 aa, Influenza virus
GLSFWMCSN

SEQ ID NO: 470252 - protein, 9 aa, Influenza virus
GLSLWMCFN

SEQ ID NO: 470253 - protein, 9 aa, Influenza virus
GLSLWMCSN

SEQ ID NO: 470254 - protein, 9 aa, Influenza virus
GLSMVKSDK

SEQ ID NO: 470255 - protein, 9 aa, Influenza virus
GLSMVRSDK

SEQ ID NO: 470256 - protein, 9 aa, Influenza virus
GLSPNVYQA

SEQ ID NO: 470257 - protein, 9 aa, Influenza virus
GLSSRISFY

SEQ ID NO: 470258 - protein, 9 aa, Influenza virus
GLTHIMIWH

SEQ ID NO: 470259 - protein, 9 aa, Influenza virus
GLTHLMIWH

SEQ ID NO: 470260 - protein, 9 aa, Influenza virus
GLTHMMIWH

SEQ ID NO: 470261 - protein, 9 aa, Influenza virus
GLVAGWYGF

SEQ ID NO: 470262 - protein, 9 aa, Influenza virus
GLVCATCEQ

SEQ ID NO: 470263 - protein, 9 aa, Influenza virus
GLVDGWYGF

SEQ ID NO: 470264 - protein, 9 aa, Influenza virus
GLVDGWYGY

SEQ ID NO: 470265 - protein, 9 aa, Influenza virus
GLVFFCLKN

SEQ ID NO: 470266 - protein, 9 aa, Influenza virus
GLVFFCLRN

SEQ ID NO: 470267 - protein, 9 aa, Influenza virus
GLVFICIKN

SEQ ID NO: 470268 - protein, 9 aa, Influenza virus
GLVFICVKN

SEQ ID NO: 470269 - protein, 9 aa, Influenza virus
GLVFMCVKN

SEQ ID NO: 470270 - protein, 9 aa, Influenza virus
GLVGDTPRD

SEQ ID NO: 470271 - protein, 9 aa, Influenza virus
GLVGDTPRE

SEQ ID NO: 470272 - protein, 9 aa, Influenza virus
GLVGDTPRK

SEQ ID NO: 470273 - protein, 9 aa, Influenza virus
GLVGDTPRN

SEQ ID NO: 470274 - protein, 9 aa, Influenza virus
GLVGDTPRS

SEQ ID NO: 470275 - protein, 9 aa, Influenza virus
GLVGDTPRT

SEQ ID NO: 470276 - protein, 9 aa, Influenza virus
GLVLGNPKC

SEQ ID NO: 470277 - protein, 9 aa, Influenza virus
GLVLGNPMC

SEQ ID NO: 470278 - protein, 9 aa, Influenza virus
GLVNLGLNI

SEQ ID NO: 470279 - protein, 9 aa, Influenza virus
GLVYGNPAC

SEQ ID NO: 470280 - protein, 9 aa, Influenza virus
GLVYGNPSC

SEQ ID NO: 470281 - protein, 9 aa, Influenza virus
GLWAYNAEL

SEQ ID NO: 470282 - protein, 9 aa, Influenza virus
GLWDPFRQS

SEQ ID NO: 470283 - protein, 9 aa, Influenza virus
GLWDSFRQS

SEQ ID NO: 470284 - protein, 9 aa, Influenza virus
GLYDAIEEC

SEQ ID NO: 470285 - protein, 9 aa, Influenza virus
GLYEAIEEC

SEQ ID NO: 470286 - protein, 9 aa, Influenza virus
GLYESIEEC

SEQ ID NO: 470287 - protein, 9 aa, Influenza virus
GLYGAIEEC

SEQ ID NO: 470288 - protein, 9 aa, Influenza virus
GMAADKEST

SEQ ID NO: 470289 - protein, 9 aa, Influenza virus
GMAADQKST

SEQ ID NO: 470290 - protein, 9 aa, Influenza virus
GMAADRDST

SEQ ID NO: 470291 - protein, 9 aa, Influenza virus
GMALSVVSL

SEQ ID NO: 470292 - protein, 9 aa, Influenza virus
GMCYPGFVE

SEQ ID NO: 470293 - protein, 9 aa, Influenza virus
GMCYPGSIE

SEQ ID NO: 470294 - protein, 9 aa, Influenza virus
GMCYPGSVE

SEQ ID NO: 470295 - protein, 9 aa, Influenza virus
GMDPRMCSL

SEQ ID NO: 470296 - protein, 9 aa, Influenza virus
GMEEGSIGK

SEQ ID NO: 470297 - protein, 9 aa, Influenza virus
GMELRRCLL

SEQ ID NO: 470298 - protein, 9 aa, Influenza virus
GMEMRRCLL

SEQ ID NO: 470299 - protein, 9 aa, Influenza virus
GMFNMLSTV

SEQ ID NO: 470300 - protein, 9 aa, Influenza virus
GMGMAADKE

SEQ ID NO: 470301 - protein, 9 aa, Influenza virus
GMGQAADLK

SEQ ID NO: 470302 - protein, 9 aa, Influenza virus
GMGQAPSPY

SEQ ID NO: 470303 - protein, 9 aa, Influenza virus
GMIDGWYGF

SEQ ID NO: 470304 - protein, 9 aa, Influenza virus
GMIDGWYGY

SEQ ID NO: 470305 - protein, 9 aa, Influenza virus
GMILSVVSL

SEQ ID NO: 470306 - protein, 9 aa, Influenza virus
GMITDTIKS

SEQ ID NO: 470307 - protein, 9 aa, Influenza virus
GMKNVPEIP

SEQ ID NO: 470308 - protein, 9 aa, Influenza virus
GMKNVPEKI

SEQ ID NO: 470309 - protein, 9 aa, Influenza virus
GMKNVPETP

SEQ ID NO: 470310 - protein, 9 aa, Influenza virus
GMLGFVFTL

SEQ ID NO: 470311 - protein, 9 aa, Influenza virus
GMMDGWYGF

SEQ ID NO: 470312 - protein, 9 aa, Influenza virus
GMMMGMFNM

SEQ ID NO: 470313 - protein, 9 aa, Influenza virus
GMPESMREE

SEQ ID NO: 470314 - protein, 9 aa, Influenza virus
GMPTDVVRS

SEQ ID NO: 470315 - protein, 9 aa, Influenza virus
GMQIRGFVH

SEQ ID NO: 470316 - protein, 9 aa, Influenza virus
GMQIRGFVY

SEQ ID NO: 470317 - protein, 9 aa, Influenza virus
GMQNGSCRC

SEQ ID NO: 470318 - protein, 9 aa, Influenza virus
GMQNGSYRC

SEQ ID NO: 470319 - protein, 9 aa, Influenza virus
GMRILIRGN

SEQ ID NO: 470320 - protein, 9 aa, Influenza virus
GMRILVRGN

SEQ ID NO: 470321 - protein, 9 aa, Influenza virus
GMRNIPEKP

SEQ ID NO: 470322 - protein, 9 aa, Influenza virus
GMRNIPEKQ

SEQ ID NO: 470323 - protein, 9 aa, Influenza virus
GMRNIPENP

SEQ ID NO: 470324 - protein, 9 aa, Influenza virus
GMRNIPERQ

SEQ ID NO: 470325 - protein, 9 aa, Influenza virus
GMRNIPGKQ

SEQ ID NO: 470326 - protein, 9 aa, Influenza virus
GMRNVPEKP

SEQ ID NO: 470327 - protein, 9 aa, Influenza virus
GMRNVPEKQ

SEQ ID NO: 470328 - protein, 9 aa, Influenza virus
GMRNVPENP

SEQ ID NO: 470329 - protein, 9 aa, Influenza virus
GMRNVPERQ

SEQ ID NO: 470330 - protein, 9 aa, Influenza virus
GMRNVPETQ

SEQ ID NO: 470331 - protein, 9 aa, Influenza virus
GMSANGDIL

SEQ ID NO: 470332 - protein, 9 aa, Influenza virus
GMTLSVVSL

SEQ ID NO: 470333 - protein, 9 aa, Influenza virus
GMVDGWYGF

SEQ ID NO: 470334 - protein, 9 aa, Influenza virus
GMVDGWYGY

SEQ ID NO: 470335 - protein, 9 aa, Influenza virus
GMVNGWYGF

SEQ ID NO: 470336 - protein, 9 aa, Influenza virus
GMVNGWYGY

SEQ ID NO: 470337 - protein, 9 aa, Influenza virus
GMWDTLIER

SEQ ID NO: 470338 - protein, 9 aa, Influenza virus
GNAEGRTSD

SEQ ID NO: 470339 - protein, 9 aa, Influenza virus
GNAEIEDLI

SEQ ID NO: 470340 - protein, 9 aa, Influenza virus
GNAEIEDLT

SEQ ID NO: 470341 - protein, 9 aa, Influenza virus
GNAKDEGNG

SEQ ID NO: 470342 - protein, 9 aa, Influenza virus
GNAQHIEEC

SEQ ID NO: 470343 - protein, 9 aa, Influenza virus
GNAQHVEEC

SEQ ID NO: 470344 - protein, 9 aa, Influenza virus
GNASGKADT

SEQ ID NO: 470345 - protein, 9 aa, Influenza virus
GNAWLHVCV

SEQ ID NO: 470346 - protein, 9 aa, Influenza virus
GNCDAKCQT

SEQ ID NO: 470347 - protein, 9 aa, Influenza virus
GNCDTKCQT

SEQ ID NO: 470348 - protein, 9 aa, Influenza virus
GNCNAKCQT

SEQ ID NO: 470349 - protein, 9 aa, Influenza virus
GNCNTKCQT

SEQ ID NO: 470350 - protein, 9 aa, Influenza virus
GNCPKYIKS

SEQ ID NO: 470351 - protein, 9 aa, Influenza virus
GNCPKYVKQ

SEQ ID NO: 470352 - protein, 9 aa, Influenza virus
GNCRFNVCI

SEQ ID NO: 470353 - protein, 9 aa, Influenza virus
GNCRFSVCI

SEQ ID NO: 470354 - protein, 9 aa, Influenza virus
GNCSIAGWL

SEQ ID NO: 470355 - protein, 9 aa, Influenza virus
GNCYWVMTD

SEQ ID NO: 470356 - protein, 9 aa, Influenza virus
GNDIWMGRT

SEQ ID NO: 470357 - protein, 9 aa, Influenza virus
GNDLWMGRT

SEQ ID NO: 470358 - protein, 9 aa, Influenza virus
GNDNWSGYS

SEQ ID NO: 470359 - protein, 9 aa, Influenza virus
GNDVWLGRT

SEQ ID NO: 470360 - protein, 9 aa, Influenza virus
GNDVWMGRT

SEQ ID NO: 470361 - protein, 9 aa, Influenza virus
GNEKKAKLA

SEQ ID NO: 470362 - protein, 9 aa, Influenza virus
GNFIAPENA

SEQ ID NO: 470363 - protein, 9 aa, Influenza virus
GNFIAPEYA

SEQ ID NO: 470364 - protein, 9 aa, Influenza virus
GNFNDYEEL

SEQ ID NO: 470365 - protein, 9 aa, Influenza virus
GNGAWIGRT

SEQ ID NO: 470366 - protein, 9 aa, Influenza virus
GNGCFDILH

SEQ ID NO: 470367 - protein, 9 aa, Influenza virus
GNGCFEFWH

SEQ ID NO: 470368 - protein, 9 aa, Influenza virus
GNGCFEFYH

SEQ ID NO: 470369 - protein, 9 aa, Influenza virus
GNGCFEIFH

SEQ ID NO: 470370 - protein, 9 aa, Influenza virus
GNGCFELLH

SEQ ID NO: 470371 - protein, 9 aa, Influenza virus
GNGCFELYH

SEQ ID NO: 470372 - protein, 9 aa, Influenza virus
GNGCFKIYH

SEQ ID NO: 470373 - protein, 9 aa, Influenza virus
GNGCFTFYH

SEQ ID NO: 470374 - protein, 9 aa, Influenza virus
GNGCFTIYH

SEQ ID NO: 470375 - protein, 9 aa, Influenza virus
GNGCLKIYH

SEQ ID NO: 470376 - protein, 9 aa, Influenza virus
GNGDPNNMD

SEQ ID NO: 470377 - protein, 9 aa, Influenza virus
GNGNKLITV

SEQ ID NO: 470378 - protein, 9 aa, Influenza virus
GNGSCRCTI

SEQ ID NO: 470379 - protein, 9 aa, Influenza virus
GNGVWIGRT

SEQ ID NO: 470380 - protein, 9 aa, Influenza virus
GNGVWMGRT

SEQ ID NO: 470381 - protein, 9 aa, Influenza virus
GNHGSLVLS

SEQ ID NO: 470382 - protein, 9 aa, Influenza virus
GNHGVKGWA

SEQ ID NO: 470383 - protein, 9 aa, Influenza virus
GNIIFLWGI

SEQ ID NO: 470384 - protein, 9 aa, Influenza virus
GNIKCNICI

SEQ ID NO: 470385 - protein, 9 aa, Influenza virus
GNILLSPEE

SEQ ID NO: 470386 - protein, 9 aa, Influenza virus
GNILRTQES

SEQ ID NO: 470387 - protein, 9 aa, Influenza virus
GNIMRTQES

SEQ ID NO: 470388 - protein, 9 aa, Influenza virus
GNIRCDICI

SEQ ID NO: 470389 - protein, 9 aa, Influenza virus
GNIRCNICI

SEQ ID NO: 470390 - protein, 9 aa, Influenza virus
GNIRCQICI

SEQ ID NO: 470391 - protein, 9 aa, Influenza virus
GNIRCTFCI

SEQ ID NO: 470392 - protein, 9 aa, Influenza virus
GNIWITREP

SEQ ID NO: 470393 - protein, 9 aa, Influenza virus
GNIYKILSI

SEQ ID NO: 470394 - protein, 9 aa, Influenza virus
GNKLITVGS

SEQ ID NO: 470395 - protein, 9 aa, Influenza virus
GNLAFNAVI

SEQ ID NO: 470396 - protein, 9 aa, Influenza virus
GNLAFNTVI

SEQ ID NO: 470397 - protein, 9 aa, Influenza virus
GNLERRLEN

SEQ ID NO: 470398 - protein, 9 aa, Influenza virus
GNLIAPEFG

SEQ ID NO: 470399 - protein, 9 aa, Influenza virus
GNLIAPEYG

SEQ ID NO: 470400 - protein, 9 aa, Influenza virus
GNLIAPLYG

SEQ ID NO: 470401 - protein, 9 aa, Influenza virus
GNLIAPRGH

SEQ ID NO: 470402 - protein, 9 aa, Influenza virus
GNLIAPRGY

SEQ ID NO: 470403 - protein, 9 aa, Influenza virus
GNLIAPWFG

SEQ ID NO: 470404 - protein, 9 aa, Influenza virus
GNLIAPWYA

SEQ ID NO: 470405 - protein, 9 aa, Influenza virus
GNLIAPWYG

SEQ ID NO: 470406 - protein, 9 aa, Influenza virus
GNLIFNAVI

SEQ ID NO: 470407 - protein, 9 aa, Influenza virus
GNLIFNTVI

SEQ ID NO: 470408 - protein, 9 aa, Influenza virus
GNLIVFNTI

SEQ ID NO: 470409 - protein, 9 aa, Influenza virus
GNLNKKMED

SEQ ID NO: 470410 - protein, 9 aa, Influenza virus
GNLRCQICI

SEQ ID NO: 470411 - protein, 9 aa, Influenza virus
GNLRCTICI

SEQ ID NO: 470412 - protein, 9 aa, Influenza virus
GNLVAPEYG

SEQ ID NO: 470413 - protein, 9 aa, Influenza virus
GNLVAPRGH

SEQ ID NO: 470414 - protein, 9 aa, Influenza virus
GNLVAPRGY

SEQ ID NO: 470415 - protein, 9 aa, Influenza virus
GNLVAPWYA

SEQ ID NO: 470416 - protein, 9 aa, Influenza virus
GNLVFNTVI

SEQ ID NO: 470417 - protein, 9 aa, Influenza virus
GNMQCTICI

SEQ ID NO: 470418 - protein, 9 aa, Influenza virus
GNMRCTICI

SEQ ID NO: 470419 - protein, 9 aa, Influenza virus
GNMRCTSCI

SEQ ID NO: 470420 - protein, 9 aa, Influenza virus
GNMRGTNWI

SEQ ID NO: 470421 - protein, 9 aa, Influenza virus
GNNBNGVKG

SEQ ID NO: 470422 - protein, 9 aa, Influenza virus
GNNCIESIR

SEQ ID NO: 470423 - protein, 9 aa, Influenza virus
GNNDNATAT

SEQ ID NO: 470424 - protein, 9 aa, Influenza virus
GNNEGRTSD

SEQ ID NO: 470425 - protein, 9 aa, Influenza virus
GNNENATAT

SEQ ID NO: 470426 - protein, 9 aa, Influenza virus
GNNKNATAT

SEQ ID NO: 470427 - protein, 9 aa, Influenza virus
GNNNGVKGF

SEQ ID NO: 470428 - protein, 9 aa, Influenza virus
GNNNNATAT

SEQ ID NO: 470429 - protein, 9 aa, Influenza virus
GNNNNGVKG

SEQ ID NO: 470430 - protein, 9 aa, Influenza virus
GNNQVFPQL

SEQ ID NO: 470431 - protein, 9 aa, Influenza virus
GNPDPGVKG

SEQ ID NO: 470432 - protein, 9 aa, Influenza virus
GNPECDILL

SEQ ID NO: 470433 - protein, 9 aa, Influenza virus
GNPECDLFL

SEQ ID NO: 470434 - protein, 9 aa, Influenza virus
GNPECDLLL

SEQ ID NO: 470435 - protein, 9 aa, Influenza virus
GNPECDRLL

SEQ ID NO: 470436 - protein, 9 aa, Influenza virus
GNPEGRTSD

SEQ ID NO: 470437 - protein, 9 aa, Influenza virus
GNPGVKGWA

SEQ ID NO: 470438 - protein, 9 aa, Influenza virus
GNPIICLGH

SEQ ID NO: 470439 - protein, 9 aa, Influenza virus
GNPKCDIHL

SEQ ID NO: 470440 - protein, 9 aa, Influenza virus
GNPKCDLYL

SEQ ID NO: 470441 - protein, 9 aa, Influenza virus
GNPKCDPYL

SEQ ID NO: 470442 - protein, 9 aa, Influenza virus
GNPKCDRLL

SEQ ID NO: 470443 - protein, 9 aa, Influenza virus
GNPKCDTHL

SEQ ID NO: 470444 - protein, 9 aa, Influenza virus
GNPKCDVHL

SEQ ID NO: 470445 - protein, 9 aa, Influenza virus
GNPMCDDLI

SEQ ID NO: 470446 - protein, 9 aa, Influenza virus
GNPMCDELI

SEQ ID NO: 470447 - protein, 9 aa, Influenza virus
GNPMCDNLI

SEQ ID NO: 470448 - protein, 9 aa, Influenza virus
GNPMCDYLI

SEQ ID NO: 470449 - protein, 9 aa, Influenza virus
GNPRCDDLI

SEQ ID NO: 470450 - protein, 9 aa, Influenza virus
GNPSCASNI

SEQ ID NO: 470451 - protein, 9 aa, Influenza virus
GNPSCATNI

SEQ ID NO: 470452 - protein, 9 aa, Influenza virus
GNPVICLGH

SEQ ID NO: 470453 - protein, 9 aa, Influenza virus
GNPVICMGH

SEQ ID NO: 470454 - protein, 9 aa, Influenza virus
GNQGVKGWA

SEQ ID NO: 470455 - protein, 9 aa, Influenza virus
GNQKTLDEH

SEQ ID NO: 470456 - protein, 9 aa, Influenza virus
GNSARLIHH

SEQ ID NO: 470457 - protein, 9 aa, Influenza virus
GNSDVLVTR

SEQ ID NO: 470458 - protein, 9 aa, Influenza virus
GNSEGRTSD

SEQ ID NO: 470459 - protein, 9 aa, Influenza virus
GNSFYAELK

SEQ ID NO: 470460 - protein, 9 aa, Influenza virus
GNSGVKGWA

SEQ ID NO: 470461 - protein, 9 aa, Influenza virus
GNSNNGVKG

SEQ ID NO: 470462 - protein, 9 aa, Influenza virus
GNSPAFNYN

SEQ ID NO: 470463 - protein, 9 aa, Influenza virus
GNSPIFNYN

SEQ ID NO: 470464 - protein, 9 aa, Influenza virus
GNSPVFNYN

SEQ ID NO: 470465 - protein, 9 aa, Influenza virus
GNSVWAGRT

SEQ ID NO: 470466 - protein, 9 aa, Influenza virus
GNTEGRTSD

SEQ ID NO: 470467 - protein, 9 aa, Influenza virus
GNTWLGRTI

SEQ ID NO: 470468 - protein, 9 aa, Influenza virus
GNTYVNNTT

SEQ ID NO: 470469 - protein, 9 aa, Influenza virus
GNVINWTKD

SEQ ID NO: 470470 - protein, 9 aa, Influenza virus
GNVINWTQD

SEQ ID NO: 470471 - protein, 9 aa, Influenza virus
GNVINWTRD

SEQ ID NO: 470472 - protein, 9 aa, Influenza virus
GNVLDGVTA

SEQ ID NO: 470473 - protein, 9 aa, Influenza virus
GNVLLSPEE

SEQ ID NO: 470474 - protein, 9 aa, Influenza virus
GNVRCQICI

SEQ ID NO: 470475 - protein, 9 aa, Influenza virus
GNVRCTFCI

SEQ ID NO: 470476 - protein, 9 aa, Influenza virus
GNVYKILSI

SEQ ID NO: 470477 - protein, 9 aa, Influenza virus
GNWPDGANI

SEQ ID NO: 470478 - protein, 9 aa, Influenza virus
GNWPDGSNI

SEQ ID NO: 470479 - protein, 9 aa, Influenza virus
GNYARLYIW

SEQ ID NO: 470480 - protein, 9 aa, Influenza virus
GNYDSIRGE

SEQ ID NO: 470481 - protein, 9 aa, Influenza virus
GNYGPINVT

SEQ ID NO: 470482 - protein, 9 aa, Influenza virus
GNYKEICIA

SEQ ID NO: 470483 - protein, 9 aa, Influenza virus
GNYKEICVA

SEQ ID NO: 470484 - protein, 9 aa, Influenza virus
GNYKEMCAA

SEQ ID NO: 470485 - protein, 9 aa, Influenza virus
GNYREICIA

SEQ ID NO: 470486 - protein, 9 aa, Influenza virus
GNYREVCIA

SEQ ID NO: 470487 - protein, 9 aa, Influenza virus
GPAANNADH

SEQ ID NO: 470488 - protein, 9 aa, Influenza virus
GPAANSADH

SEQ ID NO: 470489 - protein, 9 aa, Influenza virus
GPAANSAHH

SEQ ID NO: 470490 - protein, 9 aa, Influenza virus
GPADTRIYY

SEQ ID NO: 470491 - protein, 9 aa, Influenza virus
GPADTRVYY

SEQ ID NO: 470492 - protein, 9 aa, Influenza virus
GPAECRTFF

SEQ ID NO: 470493 - protein, 9 aa, Influenza virus
GPAETRIYY

SEQ ID NO: 470494 - protein, 9 aa, Influenza virus
GPAETRVYY

SEQ ID NO: 470495 - protein, 9 aa, Influenza virus
GPALSINEL

SEQ ID NO: 470496 - protein, 9 aa, Influenza virus
GPALSISEL

SEQ ID NO: 470497 - protein, 9 aa, Influenza virus
GPANKQASY

SEQ ID NO: 470498 - protein, 9 aa, Influenza virus
GPANNQASY

SEQ ID NO: 470499 - protein, 9 aa, Influenza virus
GPANSQASY

SEQ ID NO: 470500 - protein, 9 aa, Influenza virus
GPANSQAYT

SEQ ID NO: 470501 - protein, 9 aa, Influenza virus
GPASNQASY

SEQ ID NO: 470502 - protein, 9 aa, Influenza virus
GPATAQMAL

SEQ ID NO: 470503 - protein, 9 aa, Influenza virus
GPDATAVAV

SEQ ID NO: 470504 - protein, 9 aa, Influenza virus
GPDDGAVAV

SEQ ID NO: 470505 - protein, 9 aa, Influenza virus
GPDNEAVAV

SEQ ID NO: 470506 - protein, 9 aa, Influenza virus
GPDNGAVAV

SEQ ID NO: 470507 - protein, 9 aa, Influenza virus
GPDPGVKGF

SEQ ID NO: 470508 - protein, 9 aa, Influenza virus
GPDSGAVAV

SEQ ID NO: 470509 - protein, 9 aa, Influenza virus
GPDSTAVAV

SEQ ID NO: 470510 - protein, 9 aa, Influenza virus
GPDSVLVNT

SEQ ID NO: 470511 - protein, 9 aa, Influenza virus
GPDTTAVAV

SEQ ID NO: 470512 - protein, 9 aa, Influenza virus
GPESVLINT

SEQ ID NO: 470513 - protein, 9 aa, Influenza virus
GPESVLVNT

SEQ ID NO: 470514 - protein, 9 aa, Influenza virus
GPGSFPDGA

SEQ ID NO: 470515 - protein, 9 aa, Influenza virus
GPGVKGFGF

SEQ ID NO: 470516 - protein, 9 aa, Influenza virus
GPGWLTIGI

SEQ ID NO: 470517 - protein, 9 aa, Influenza virus
GPGWLTLGI

SEQ ID NO: 470518 - protein, 9 aa, Influenza virus
GPILSFIMW

SEQ ID NO: 470519 - protein, 9 aa, Influenza virus
GPINNGKGR

SEQ ID NO: 470520 - protein, 9 aa, Influenza virus
GPINVTKEN

SEQ ID NO: 470521 - protein, 9 aa, Influenza virus
GPLKAEIAQ

SEQ ID NO: 470522 - protein, 9 aa, Influenza virus
GPLSGSAQH

SEQ ID NO: 470523 - protein, 9 aa, Influenza virus
GPNDNASAV

SEQ ID NO: 470524 - protein, 9 aa, Influenza virus
GPNLYNIRN

SEQ ID NO: 470525 - protein, 9 aa, Influenza virus
GPNNNASAI

SEQ ID NO: 470526 - protein, 9 aa, Influenza virus
GPNNNASAV

SEQ ID NO: 470527 - protein, 9 aa, Influenza virus
GPPHCDQFL

SEQ ID NO: 470528 - protein, 9 aa, Influenza virus
GPPQCDKFL

SEQ ID NO: 470529 - protein, 9 aa, Influenza virus
GPPQCDLFL

SEQ ID NO: 470530 - protein, 9 aa, Influenza virus
GPPQCDLHL

SEQ ID NO: 470531 - protein, 9 aa, Influenza virus
GPPQCDQFL

SEQ ID NO: 470532 - protein, 9 aa, Influenza virus
GPPQCDRFL

SEQ ID NO: 470533 - protein, 9 aa, Influenza virus
GPPQCDSHL

SEQ ID NO: 470534 - protein, 9 aa, Influenza virus
GPRALVRGQ

SEQ ID NO: 470535 - protein, 9 aa, Influenza virus
GPRNVPAIA

SEQ ID NO: 470536 - protein, 9 aa, Influenza virus
GPRNVPQAQ

SEQ ID NO: 470537 - protein, 9 aa, Influenza virus
GPRNVPQIE

SEQ ID NO: 470538 - protein, 9 aa, Influenza virus
GPRNVPQVQ

SEQ ID NO: 470539 - protein, 9 aa, Influenza virus
GPRPFVRGQ

SEQ ID NO: 470540 - protein, 9 aa, Influenza virus
GPRPLIRGQ

SEQ ID NO: 470541 - protein, 9 aa, Influenza virus
GPRPLVMGQ

SEQ ID NO: 470542 - protein, 9 aa, Influenza virus
GPRPLVREQ

SEQ ID NO: 470543 - protein, 9 aa, Influenza virus
GPRPLVRGQ

SEQ ID NO: 470544 - protein, 9 aa, Influenza virus
GPSDAQAFY

SEQ ID NO: 470545 - protein, 9 aa, Influenza virus
GPSECRTFF

SEQ ID NO: 470546 - protein, 9 aa, Influenza virus
GPSFYAEMK

SEQ ID NO: 470547 - protein, 9 aa, Influenza virus
GPSHSIHTG

SEQ ID NO: 470548 - protein, 9 aa, Influenza virus
GPSNAQAFY

SEQ ID NO: 470549 - protein, 9 aa, Influenza virus
GPTECRTFF

SEQ ID NO: 470550 - protein, 9 aa, Influenza virus
GPVHFQNQV

SEQ ID NO: 470551 - protein, 9 aa, Influenza virus
GPVHFRNQI

SEQ ID NO: 470552 - protein, 9 aa, Influenza virus
GPVHFRNQV

SEQ ID NO: 470553 - protein, 9 aa, Influenza virus
GPVHFRSQV

SEQ ID NO: 470554 - protein, 9 aa, Influenza virus
GPWVRGQSG

SEQ ID NO: 470555 - protein, 9 aa, Influenza virus
GQAADLKST

SEQ ID NO: 470556 - protein, 9 aa, Influenza virus
GQAADYEST

SEQ ID NO: 470557 - protein, 9 aa, Influenza virus
GQAADYKST

SEQ ID NO: 470558 - protein, 9 aa, Influenza virus
GQAFYKILK

SEQ ID NO: 470559 - protein, 9 aa, Influenza virus
GQAFYRSIN

SEQ ID NO: 470560 - protein, 9 aa, Influenza virus
GQAGRIDFH

SEQ ID NO: 470561 - protein, 9 aa, Influenza virus
GQAGRMTFY

SEQ ID NO: 470562 - protein, 9 aa, Influenza virus
GQCGILGIL

SEQ ID NO: 470563 - protein, 9 aa, Influenza virus
GQCGLLGII

SEQ ID NO: 470564 - protein, 9 aa, Influenza virus
GQCGLLGTI

SEQ ID NO: 470565 - protein, 9 aa, Influenza virus
GQCGLLGTL

SEQ ID NO: 470566 - protein, 9 aa, Influenza virus
GQCGLLGTV

SEQ ID NO: 470567 - protein, 9 aa, Influenza virus
GQCPKYVKK

SEQ ID NO: 470568 - protein, 9 aa, Influenza virus
GQCPKYVNK

SEQ ID NO: 470569 - protein, 9 aa, Influenza virus
GQCPKYVNQ

SEQ ID NO: 470570 - protein, 9 aa, Influenza virus
GQCPKYVSK

SEQ ID NO: 470571 - protein, 9 aa, Influenza virus
GQCPKYVSQ

SEQ ID NO: 470572 - protein, 9 aa, Influenza virus
GQDCDLING

SEQ ID NO: 470573 - protein, 9 aa, Influenza virus
GQFGRIDFH

SEQ ID NO: 470574 - protein, 9 aa, Influenza virus
GQFGRINFH

SEQ ID NO: 470575 - protein, 9 aa, Influenza virus
GQFPVQTDE

SEQ ID NO: 470576 - protein, 9 aa, Influenza virus
GQGDIVLVM

SEQ ID NO: 470577 - protein, 9 aa, Influenza virus
GQGDVVLVM

SEQ ID NO: 470578 - protein, 9 aa, Influenza virus
GQGSGYAAD

SEQ ID NO: 470579 - protein, 9 aa, Influenza virus
GQGTAADYK

SEQ ID NO: 470580 - protein, 9 aa, Influenza virus
GQGTTLDNE

SEQ ID NO: 470581 - protein, 9 aa, Influenza virus
GQGTTLDNK

SEQ ID NO: 470582 - protein, 9 aa, Influenza virus
GQGTTLENK

SEQ ID NO: 470583 - protein, 9 aa, Influenza virus
GQGTTLNNK

SEQ ID NO: 470584 - protein, 9 aa, Influenza virus
GQGTTLYNK

SEQ ID NO: 470585 - protein, 9 aa, Influenza virus
GQHANGTIH

SEQ ID NO: 470586 - protein, 9 aa, Influenza virus
GQIIVLNTD

SEQ ID NO: 470587 - protein, 9 aa, Influenza virus
GQKSWMKIY

SEQ ID NO: 470588 - protein, 9 aa, Influenza virus
GQKSWTKIY

SEQ ID NO: 470589 - protein, 9 aa, Influenza virus
GQLKLATGL

SEQ ID NO: 470590 - protein, 9 aa, Influenza virus
GQNFPQTAN

SEQ ID NO: 470591 - protein, 9 aa, Influenza virus
GQNFPQTTN

SEQ ID NO: 470592 - protein, 9 aa, Influenza virus
GQNFPRTTN

SEQ ID NO: 470593 - protein, 9 aa, Influenza virus
GQNHGICAV

SEQ ID NO: 470594 - protein, 9 aa, Influenza virus
GQPKEKAIW

SEQ ID NO: 470595 - protein, 9 aa, Influenza virus
GQPKEKTIW

SEQ ID NO: 470596 - protein, 9 aa, Influenza virus
GQPNERTIW

SEQ ID NO: 470597 - protein, 9 aa, Influenza virus
GQQGRMDYY

SEQ ID NO: 470598 - protein, 9 aa, Influenza virus
GQQGTMDYY

SEQ ID NO: 470599 - protein, 9 aa, Influenza virus
GQQGWMDYY

SEQ ID NO: 470600 - protein, 9 aa, Influenza virus
GQRGRIDFH

SEQ ID NO: 470601 - protein, 9 aa, Influenza virus
GQRSWMKIY

SEQ ID NO: 470602 - protein, 9 aa, Influenza virus
GQRSWMKLY

SEQ ID NO: 470603 - protein, 9 aa, Influenza virus
GQSFPQTTN

SEQ ID NO: 470604 - protein, 9 aa, Influenza virus
GQSFYRSIN

SEQ ID NO: 470605 - protein, 9 aa, Influenza virus
GQSGRIDFH

SEQ ID NO: 470606 - protein, 9 aa, Influenza virus
GQSGRIDFY

SEQ ID NO: 470607 - protein, 9 aa, Influenza virus
GQSGRIEFH

SEQ ID NO: 470608 - protein, 9 aa, Influenza virus
GQSGRINFH

SEQ ID NO: 470609 - protein, 9 aa, Influenza virus
GQSGRISFY

SEQ ID NO: 470610 - protein, 9 aa, Influenza virus
GQSGRIVFH

SEQ ID NO: 470611 - protein, 9 aa, Influenza virus
GQSGRVSFY

SEQ ID NO: 470612 - protein, 9 aa, Influenza virus
GQSPNVYQA

SEQ ID NO: 470613 - protein, 9 aa, Influenza virus
GQSPNVYQS

SEQ ID NO: 470614 - protein, 9 aa, Influenza virus
GQTGRIDFH

SEQ ID NO: 470615 - protein, 9 aa, Influenza virus
GQTIVLNTD

SEQ ID NO: 470616 - protein, 9 aa, Influenza virus
GQTIVSNTD

SEQ ID NO: 470617 - protein, 9 aa, Influenza virus
GQTLRIISN

SEQ ID NO: 470618 - protein, 9 aa, Influenza virus
GQTLRIRSN

SEQ ID NO: 470619 - protein, 9 aa, Influenza virus
GQTLRVKSN

SEQ ID NO: 470620 - protein, 9 aa, Influenza virus
GQTLRVRSD

SEQ ID NO: 470621 - protein, 9 aa, Influenza virus
GQTLRVRSN

SEQ ID NO: 470622 - protein, 9 aa, Influenza virus
GQTVKIKTN

SEQ ID NO: 470623 - protein, 9 aa, Influenza virus
GQTVKIQTN

SEQ ID NO: 470624 - protein, 9 aa, Influenza virus
GQTVKIQTS

SEQ ID NO: 470625 - protein, 9 aa, Influenza virus
GQTVVLNTD

SEQ ID NO: 470626 - protein, 9 aa, Influenza virus
GQVECVCRD

SEQ ID NO: 470627 - protein, 9 aa, Influenza virus
GQVEGRIQD

SEQ ID NO: 470628 - protein, 9 aa, Influenza virus
GQWDWPDGA

SEQ ID NO: 470629 - protein, 9 aa, Influenza virus
GQWNWPDGA

SEQ ID NO: 470630 - protein, 9 aa, Influenza virus
GRADTKILF

SEQ ID NO: 470631 - protein, 9 aa, Influenza virus
GRADTRILF

SEQ ID NO: 470632 - protein, 9 aa, Influenza virus
GRAWLHVCV

SEQ ID NO: 470633 - protein, 9 aa, Influenza virus
GRCPRYVKQ

SEQ ID NO: 470634 - protein, 9 aa, Influenza virus
GRDLGIQSE

SEQ ID NO: 470635 - protein, 9 aa, Influenza virus
GRDVLVIWG

SEQ ID NO: 470636 - protein, 9 aa, Influenza virus
GRDVLVLWG

SEQ ID NO: 470637 - protein, 9 aa, Influenza virus
GRDVLVMWG

SEQ ID NO: 470638 - protein, 9 aa, Influenza virus
GREDKRYGP

SEQ ID NO: 470639 - protein, 9 aa, Influenza virus
GREWSYIVE

SEQ ID NO: 470640 - protein, 9 aa, Influenza virus
GRFEFIAEE

SEQ ID NO: 470641 - protein, 9 aa, Influenza virus
GRFTNEEAL

SEQ ID NO: 470642 - protein, 9 aa, Influenza virus
GRFYIQMCT

SEQ ID NO: 470643 - protein, 9 aa, Influenza virus
GRFYVQMCT

SEQ ID NO: 470644 - protein, 9 aa, Influenza virus
GRGCFEIYH

SEQ ID NO: 470645 - protein, 9 aa, Influenza virus
GRGIEVVNA

SEQ ID NO: 470646 - protein, 9 aa, Influenza virus
GRGLFGAIA

SEQ ID NO: 470647 - protein, 9 aa, Influenza virus
GRGLFGAKA

SEQ ID NO: 470648 - protein, 9 aa, Influenza virus
GRGLGIQSD

SEQ ID NO: 470649 - protein, 9 aa, Influenza virus
GRGLGIQSE

SEQ ID NO: 470650 - protein, 9 aa, Influenza virus
GRGLGIQSG

SEQ ID NO: 470651 - protein, 9 aa, Influenza virus
GRGQAADLK

SEQ ID NO: 470652 - protein, 9 aa, Influenza virus
GRGRIFQSR

SEQ ID NO: 470653 - protein, 9 aa, Influenza virus
GRGSTLGLD

SEQ ID NO: 470654 - protein, 9 aa, Influenza virus
GRGVFEFSD

SEQ ID NO: 470655 - protein, 9 aa, Influenza virus
GRGVFELSD

SEQ ID NO: 470656 - protein, 9 aa, Influenza virus
GRGYMFESK

SEQ ID NO: 470657 - protein, 9 aa, Influenza virus
GRHANGTIH

SEQ ID NO: 470658 - protein, 9 aa, Influenza virus
GRHANGTIN

SEQ ID NO: 470659 - protein, 9 aa, Influenza virus
GRHANGTMH

SEQ ID NO: 470660 - protein, 9 aa, Influenza virus
GRHSNGTIH

SEQ ID NO: 470661 - protein, 9 aa, Influenza virus
GRIDFHWLI

SEQ ID NO: 470662 - protein, 9 aa, Influenza virus
GRIDFHWLL

SEQ ID NO: 470663 - protein, 9 aa, Influenza virus
GRIDFHWLM

SEQ ID NO: 470664 - protein, 9 aa, Influenza virus
GRIDFHWLV

SEQ ID NO: 470665 - protein, 9 aa, Influenza virus
GRIDFHWML

SEQ ID NO: 470666 - protein, 9 aa, Influenza virus
GRIFQSGIR

SEQ ID NO: 470667 - protein, 9 aa, Influenza virus
GRIFQSGVR

SEQ ID NO: 470668 - protein, 9 aa, Influenza virus
GRIFQSHIR

SEQ ID NO: 470669 - protein, 9 aa, Influenza virus
GRIFQSPIR

SEQ ID NO: 470670 - protein, 9 aa, Influenza virus
GRIFQSRII

SEQ ID NO: 470671 - protein, 9 aa, Influenza virus
GRIFQSRIR

SEQ ID NO: 470672 - protein, 9 aa, Influenza virus
GRIIQNEDI

SEQ ID NO: 470673 - protein, 9 aa, Influenza virus
GRILKNDLP

SEQ ID NO: 470674 - protein, 9 aa, Influenza virus
GRILKNNLP

SEQ ID NO: 470675 - protein, 9 aa, Influenza virus
GRILKWEPL

SEQ ID NO: 470676 - protein, 9 aa, Influenza virus
GRINYYWTL

SEQ ID NO: 470677 - protein, 9 aa, Influenza virus
GRIQDLEKY

SEQ ID NO: 470678 - protein, 9 aa, Influenza virus
GRIQDLERY

SEQ ID NO: 470679 - protein, 9 aa, Influenza virus
GRISFYWTI

SEQ ID NO: 470680 - protein, 9 aa, Influenza virus
GRISIYWTL

SEQ ID NO: 470681 - protein, 9 aa, Influenza virus
GRLCNPLNP

SEQ ID NO: 470682 - protein, 9 aa, Influenza virus
GRLCNPMNP

SEQ ID NO: 470683 - protein, 9 aa, Influenza virus
GRLIDFLKD

SEQ ID NO: 470684 - protein, 9 aa, Influenza virus
GRLIQNSIT

SEQ ID NO: 470685 - protein, 9 aa, Influenza virus
GRLIQNSLT

SEQ ID NO: 470686 - protein, 9 aa, Influenza virus
GRLIQNSMT

SEQ ID NO: 470687 - protein, 9 aa, Influenza virus
GRLMDFLKD

SEQ ID NO: 470688 - protein, 9 aa, Influenza virus
GRLTTTIKT

SEQ ID NO: 470689 - protein, 9 aa, Influenza virus
GRLVRFRHQ

SEQ ID NO: 470690 - protein, 9 aa, Influenza virus
GRMDYYWAI

SEQ ID NO: 470691 - protein, 9 aa, Influenza virus
GRMDYYWAV

SEQ ID NO: 470692 - protein, 9 aa, Influenza virus
GRMDYYWGI

SEQ ID NO: 470693 - protein, 9 aa, Influenza virus
GRMDYYWTL

SEQ ID NO: 470694 - protein, 9 aa, Influenza virus
GRMNYHWTL

SEQ ID NO: 470695 - protein, 9 aa, Influenza virus
GRMNYYWTI

SEQ ID NO: 470696 - protein, 9 aa, Influenza virus
GRMNYYWTL

SEQ ID NO: 470697 - protein, 9 aa, Influenza virus
GRMSDSIKS

SEQ ID NO: 470698 - protein, 9 aa, Influenza virus
GRMTDSIKS

SEQ ID NO: 470699 - protein, 9 aa, Influenza virus
GRMTFYWAI

SEQ ID NO: 470700 - protein, 9 aa, Influenza virus
GRMTFYWKI

SEQ ID NO: 470701 - protein, 9 aa, Influenza virus
GRMTFYWTI

SEQ ID NO: 470702 - protein, 9 aa, Influenza virus
GRMTFYWTM

SEQ ID NO: 470703 - protein, 9 aa, Influenza virus
GRMTICIQG

SEQ ID NO: 470704 - protein, 9 aa, Influenza virus
GRMTICVQG

SEQ ID NO: 470705 - protein, 9 aa, Influenza virus
GRNCTIPCF

SEQ ID NO: 470706 - protein, 9 aa, Influenza virus
GRNCTVPCF

SEQ ID NO: 470707 - protein, 9 aa, Influenza virus
GRNPGNAEI

SEQ ID NO: 470708 - protein, 9 aa, Influenza virus
GRNSFFSRL

SEQ ID NO: 470709 - protein, 9 aa, Influenza virus
GRNSFYAEL

SEQ ID NO: 470710 - protein, 9 aa, Influenza virus
GRPEEAKYV

SEQ ID NO: 470711 - protein, 9 aa, Influenza virus
GRPEEVKYV

SEQ ID NO: 470712 - protein, 9 aa, Influenza virus
GRPITEINT

SEQ ID NO: 470713 - protein, 9 aa, Influenza virus
GRPKEDEVW

SEQ ID NO: 470714 - protein, 9 aa, Influenza virus
GRPKEDKVW

SEQ ID NO: 470715 - protein, 9 aa, Influenza virus
GRPKEDRVW

SEQ ID NO: 470716 - protein, 9 aa, Influenza virus
GRPKEEKVW

SEQ ID NO: 470717 - protein, 9 aa, Influenza virus
GRPTTEINT

SEQ ID NO: 470718 - protein, 9 aa, Influenza virus
GRQEIVDNN

SEQ ID NO: 470719 - protein, 9 aa, Influenza virus
GRQEKNPAL

SEQ ID NO: 470720 - protein, 9 aa, Influenza virus
GRQEKNPSL

SEQ ID NO: 470721 - protein, 9 aa, Influenza virus
GRQTFDWTL

SEQ ID NO: 470722 - protein, 9 aa, Influenza virus
GRQTYDWTL

SEQ ID NO: 470723 - protein, 9 aa, Influenza virus
GRRKTNLYG

SEQ ID NO: 470724 - protein, 9 aa, Influenza virus
GRSDKICIG

SEQ ID NO: 470725 - protein, 9 aa, Influenza virus
GRSHLRNDT

SEQ ID NO: 470726 - protein, 9 aa, Influenza virus
GRTFSPRSR

SEQ ID NO: 470727 - protein, 9 aa, Influenza virus
GRTINTASR

SEQ ID NO: 470728 - protein, 9 aa, Influenza virus
GRTIQNEDI

SEQ ID NO: 470729 - protein, 9 aa, Influenza virus
GRTISEDSR

SEQ ID NO: 470730 - protein, 9 aa, Influenza virus
GRTISIASR

SEQ ID NO: 470731 - protein, 9 aa, Influenza virus
GRTISKDLR

SEQ ID NO: 470732 - protein, 9 aa, Influenza virus
GRTISKDSR

SEQ ID NO: 470733 - protein, 9 aa, Influenza virus
GRTISKDTR

SEQ ID NO: 470734 - protein, 9 aa, Influenza virus
GRTISKNSR

SEQ ID NO: 470735 - protein, 9 aa, Influenza virus
GRTISMDSR

SEQ ID NO: 470736 - protein, 9 aa, Influenza virus
GRTISPHSR

SEQ ID NO: 470737 - protein, 9 aa, Influenza virus
GRTISPKLR

SEQ ID NO: 470738 - protein, 9 aa, Influenza virus
GRTISPRLR

SEQ ID NO: 470739 - protein, 9 aa, Influenza virus
GRTISPRSR

SEQ ID NO: 470740 - protein, 9 aa, Influenza virus
GRTISRDSR

SEQ ID NO: 470741 - protein, 9 aa, Influenza virus
GRTISTASR

SEQ ID NO: 470742 - protein, 9 aa, Influenza virus
GRTISTRSR

SEQ ID NO: 470743 - protein, 9 aa, Influenza virus
GRTKSLESR

SEQ ID NO: 470744 - protein, 9 aa, Influenza virus
GRTLDLHDA

SEQ ID NO: 470745 - protein, 9 aa, Influenza virus
GRTLDMHDA

SEQ ID NO: 470746 - protein, 9 aa, Influenza virus
GRTLGLHDA

SEQ ID NO: 470747 - protein, 9 aa, Influenza virus
GRTNQQFEL

SEQ ID NO: 470748 - protein, 9 aa, Influenza virus
GRTSDMRAE

SEQ ID NO: 470749 - protein, 9 aa, Influenza virus
GRTSDMRTE

SEQ ID NO: 470750 - protein, 9 aa, Influenza virus
GRTTSKDSR

SEQ ID NO: 470751 - protein, 9 aa, Influenza virus
GRTVSINGR

SEQ ID NO: 470752 - protein, 9 aa, Influenza virus
GRTVSISGR

SEQ ID NO: 470753 - protein, 9 aa, Influenza virus
GRTVSKDSR

SEQ ID NO: 470754 - protein, 9 aa, Influenza virus
GRTVSNSGR

SEQ ID NO: 470755 - protein, 9 aa, Influenza virus
GRTVSTSGR

SEQ ID NO: 470756 - protein, 9 aa, Influenza virus
GRVLKNNLP

SEQ ID NO: 470757 - protein, 9 aa, Influenza virus
GRVSFYWTI

SEQ ID NO: 470758 - protein, 9 aa, Influenza virus
GRVTDSIKS

SEQ ID NO: 470759 - protein, 9 aa, Influenza virus
GRVTVSTRS

SEQ ID NO: 470760 - protein, 9 aa, Influenza virus
GRWPGLVAG

SEQ ID NO: 470761 - protein, 9 aa, Influenza virus
GRYGVKGFS

SEQ ID NO: 470762 - protein, 9 aa, Influenza virus
GRYSIADKI

SEQ ID NO: 470763 - protein, 9 aa, Influenza virus
GRYSKADKI

SEQ ID NO: 470764 - protein, 9 aa, Influenza virus
GRYSRADKI

SEQ ID NO: 470765 - protein, 9 aa, Influenza virus
GSAEHIEEC

SEQ ID NO: 470766 - protein, 9 aa, Influenza virus
GSAKHIEEC

SEQ ID NO: 470767 - protein, 9 aa, Influenza virus
GSAKHVEEC

SEQ ID NO: 470768 - protein, 9 aa, Influenza virus
GSANSQAYT

SEQ ID NO: 470769 - protein, 9 aa, Influenza virus
GSAQATEEC

SEQ ID NO: 470770 - protein, 9 aa, Influenza virus
GSAQHIEEC

SEQ ID NO: 470771 - protein, 9 aa, Influenza virus
GSAQHVEEC

SEQ ID NO: 470772 - protein, 9 aa, Influenza virus
GSARHIEEC

SEQ ID NO: 470773 - protein, 9 aa, Influenza virus
GSARHIEEW

SEQ ID NO: 470774 - protein, 9 aa, Influenza virus
GSARHVEEC

SEQ ID NO: 470775 - protein, 9 aa, Influenza virus
GSASGKADT

SEQ ID NO: 470776 - protein, 9 aa, Influenza virus
GSASGKAET

SEQ ID NO: 470777 - protein, 9 aa, Influenza virus
GSASGQAYT

SEQ ID NO: 470778 - protein, 9 aa, Influenza virus
GSASGRADT

SEQ ID NO: 470779 - protein, 9 aa, Influenza virus
GSASRKADT

SEQ ID NO: 470780 - protein, 9 aa, Influenza virus
GSASSQAHT

SEQ ID NO: 470781 - protein, 9 aa, Influenza virus
GSASSQAYT

SEQ ID NO: 470782 - protein, 9 aa, Influenza virus
GSATGPADT

SEQ ID NO: 470783 - protein, 9 aa, Influenza virus
GSATGPAET

SEQ ID NO: 470784 - protein, 9 aa, Influenza virus
GSCASKCHT

SEQ ID NO: 470785 - protein, 9 aa, Influenza virus
GSCAVVMTD

SEQ ID NO: 470786 - protein, 9 aa, Influenza virus
GSCESKCHT

SEQ ID NO: 470787 - protein, 9 aa, Influenza virus
GSCFTIMTD

SEQ ID NO: 470788 - protein, 9 aa, Influenza virus
GSCFTLMTD

SEQ ID NO: 470789 - protein, 9 aa, Influenza virus
GSCFTVLTD

SEQ ID NO: 470790 - protein, 9 aa, Influenza virus
GSCFTVMTD

SEQ ID NO: 470791 - protein, 9 aa, Influenza virus
GSCGILGTI

SEQ ID NO: 470792 - protein, 9 aa, Influenza virus
GSCISKCHT

SEQ ID NO: 470793 - protein, 9 aa, Influenza virus
GSCRCMFCI

SEQ ID NO: 470794 - protein, 9 aa, Influenza virus
GSCRCTICI

SEQ ID NO: 470795 - protein, 9 aa, Influenza virus
GSCRFNVCI

SEQ ID NO: 470796 - protein, 9 aa, Influenza virus
GSCTSPCLT

SEQ ID NO: 470797 - protein, 9 aa, Influenza virus
GSCTVVMTD

SEQ ID NO: 470798 - protein, 9 aa, Influenza virus
GSCVSKCHT

SEQ ID NO: 470799 - protein, 9 aa, Influenza virus
GSCVSRCHT

SEQ ID NO: 470800 - protein, 9 aa, Influenza virus
GSDIGFMPK

SEQ ID NO: 470801 - protein, 9 aa, Influenza virus
GSDVWLGRT

SEQ ID NO: 470802 - protein, 9 aa, Influenza virus
GSDVWMGRT

SEQ ID NO: 470803 - protein, 9 aa, Influenza virus
GSECVCING

SEQ ID NO: 470804 - protein, 9 aa, Influenza virus
GSEHTAYSQ

SEQ ID NO: 470805 - protein, 9 aa, Influenza virus
GSFCSIDGK

SEQ ID NO: 470806 - protein, 9 aa, Influenza virus
GSFCSINGK

SEQ ID NO: 470807 - protein, 9 aa, Influenza virus
GSFCSINGR

SEQ ID NO: 470808 - protein, 9 aa, Influenza virus
GSFCSLDGK

SEQ ID NO: 470809 - protein, 9 aa, Influenza virus
GSFIDYWAE

SEQ ID NO: 470810 - protein, 9 aa, Influenza virus
GSFIDYWAK

SEQ ID NO: 470811 - protein, 9 aa, Influenza virus
GSFIDYWDD

SEQ ID NO: 470812 - protein, 9 aa, Influenza virus
GSFIDYWDE

SEQ ID NO: 470813 - protein, 9 aa, Influenza virus
GSFIDYWND

SEQ ID NO: 470814 - protein, 9 aa, Influenza virus
GSFIQHPEL

SEQ ID NO: 470815 - protein, 9 aa, Influenza virus
GSFMDYWAE

SEQ ID NO: 470816 - protein, 9 aa, Influenza virus
GSFNDYEEL

SEQ ID NO: 470817 - protein, 9 aa, Influenza virus
GSFNGAFIA

SEQ ID NO: 470818 - protein, 9 aa, Influenza virus
GSFNNYEEL

SEQ ID NO: 470819 - protein, 9 aa, Influenza virus
GSFPDGAKI

SEQ ID NO: 470820 - protein, 9 aa, Influenza virus
GSFPDGAQI

SEQ ID NO: 470821 - protein, 9 aa, Influenza virus
GSFPNGAQI

SEQ ID NO: 470822 - protein, 9 aa, Influenza virus
GSFSIRGET

SEQ ID NO: 470823 - protein, 9 aa, Influenza virus
GSFSIRWET

SEQ ID NO: 470824 - protein, 9 aa, Influenza virus
GSFTLPIEL

SEQ ID NO: 470825 - protein, 9 aa, Influenza virus
GSFTLPVEL

SEQ ID NO: 470826 - protein, 9 aa, Influenza virus
GSFTLPVEM

SEQ ID NO: 470827 - protein, 9 aa, Influenza virus
GSFTLPVGL

SEQ ID NO: 470828 - protein, 9 aa, Influenza virus
GSFVDYWAE

SEQ ID NO: 470829 - protein, 9 aa, Influenza virus
GSFVQHPEL

SEQ ID NO: 470830 - protein, 9 aa, Influenza virus
GSFVQHPEM

SEQ ID NO: 470831 - protein, 9 aa, Influenza virus
GSFYRNMRW

SEQ ID NO: 470832 - protein, 9 aa, Influenza virus
GSFYRSIRW

SEQ ID NO: 470833 - protein, 9 aa, Influenza virus
GSFYRSMRW

SEQ ID NO: 470834 - protein, 9 aa, Influenza virus
GSGAKLITV

SEQ ID NO: 470835 - protein, 9 aa, Influenza virus
GSGDWPDGS

SEQ ID NO: 470836 - protein, 9 aa, Influenza virus
GSGFFPDGP

SEQ ID NO: 470837 - protein, 9 aa, Influenza virus
GSGLRILIR

SEQ ID NO: 470838 - protein, 9 aa, Influenza virus
GSGLRILVR

SEQ ID NO: 470839 - protein, 9 aa, Influenza virus
GSGMRILIR

SEQ ID NO: 470840 - protein, 9 aa, Influenza virus
GSGMRILVR

SEQ ID NO: 470841 - protein, 9 aa, Influenza virus
GSGNKLITV

SEQ ID NO: 470842 - protein, 9 aa, Influenza virus
GSGNKLVTV

SEQ ID NO: 470843 - protein, 9 aa, Influenza virus
GSGNWPDGA

SEQ ID NO: 470844 - protein, 9 aa, Influenza virus
GSGNWPDGP

SEQ ID NO: 470845 - protein, 9 aa, Influenza virus
GSGNWPDGS

SEQ ID NO: 470846 - protein, 9 aa, Influenza virus
GSGRIFQSG

SEQ ID NO: 470847 - protein, 9 aa, Influenza virus
GSGSFPDGA

SEQ ID NO: 470848 - protein, 9 aa, Influenza virus
GSGSFPNGA

SEQ ID NO: 470849 - protein, 9 aa, Influenza virus
GSGSKLITV

SEQ ID NO: 470850 - protein, 9 aa, Influenza virus
GSGSWPDGA

SEQ ID NO: 470851 - protein, 9 aa, Influenza virus
GSGTDNYGV

SEQ ID NO: 470852 - protein, 9 aa, Influenza virus
GSGTNNYGV

SEQ ID NO: 470853 - protein, 9 aa, Influenza virus
GSGWLTLGI

SEQ ID NO: 470854 - protein, 9 aa, Influenza virus
GSGYAADKA

SEQ ID NO: 470855 - protein, 9 aa, Influenza virus
GSGYAADKE

SEQ ID NO: 470856 - protein, 9 aa, Influenza virus
GSGYAADKK

SEQ ID NO: 470857 - protein, 9 aa, Influenza virus
GSGYAADLK

SEQ ID NO: 470858 - protein, 9 aa, Influenza virus
GSGYAADQE

SEQ ID NO: 470859 - protein, 9 aa, Influenza virus
GSGYAADQK

SEQ ID NO: 470860 - protein, 9 aa, Influenza virus
GSGYAADRE

SEQ ID NO: 470861 - protein, 9 aa, Influenza virus
GSGYAADRK

SEQ ID NO: 470862 - protein, 9 aa, Influenza virus
GSGYAANKE

SEQ ID NO: 470863 - protein, 9 aa, Influenza virus
GSHGVKGWA

SEQ ID NO: 470864 - protein, 9 aa, Influenza virus
GSIAHKSCL

SEQ ID NO: 470865 - protein, 9 aa, Influenza virus
GSIENLEEL

SEQ ID NO: 470866 - protein, 9 aa, Influenza virus
GSIENQEEL

SEQ ID NO: 470867 - protein, 9 aa, Influenza virus
GSIGKVCRA

SEQ ID NO: 470868 - protein, 9 aa, Influenza virus
GSIGKVCRT

SEQ ID NO: 470869 - protein, 9 aa, Influenza virus
GSIISFCGV

SEQ ID NO: 470870 - protein, 9 aa, Influenza virus
GSIITELPF

SEQ ID NO: 470871 - protein, 9 aa, Influenza virus
GSIKNQEEL

SEQ ID NO: 470872 - protein, 9 aa, Influenza virus
GSIKTKLPF

SEQ ID NO: 470873 - protein, 9 aa, Influenza virus
GSINTKLPF

SEQ ID NO: 470874 - protein, 9 aa, Influenza virus
GSINTRLPF

SEQ ID NO: 470875 - protein, 9 aa, Influenza virus
GSIPNDKPF

SEQ ID NO: 470876 - protein, 9 aa, Influenza virus
GSIPNEKPF

SEQ ID NO: 470877 - protein, 9 aa, Influenza virus
GSIPNGKPF

SEQ ID NO: 470878 - protein, 9 aa, Influenza virus
GSIPNNKPF

SEQ ID NO: 470879 - protein, 9 aa, Influenza virus
GSIQSDKPF

SEQ ID NO: 470880 - protein, 9 aa, Influenza virus
GSIRNETYD

SEQ ID NO: 470881 - protein, 9 aa, Influenza virus
GSIRNGTYD

SEQ ID NO: 470882 - protein, 9 aa, Influenza virus
GSIRNGTYN

SEQ ID NO: 470883 - protein, 9 aa, Influenza virus
GSISLTIAA

SEQ ID NO: 470884 - protein, 9 aa, Influenza virus
GSISNDKPF

SEQ ID NO: 470885 - protein, 9 aa, Influenza virus
GSIYIEVLH

SEQ ID NO: 470886 - protein, 9 aa, Influenza virus
GSKEQLGSW

SEQ ID NO: 470887 - protein, 9 aa, Influenza virus
GSKERLGSW

SEQ ID NO: 470888 - protein, 9 aa, Influenza virus
GSKGDIFVI

SEQ ID NO: 470889 - protein, 9 aa, Influenza virus
GSKGDIFVM

SEQ ID NO: 470890 - protein, 9 aa, Influenza virus
GSKGDVFVI

SEQ ID NO: 470891 - protein, 9 aa, Influenza virus
GSKGDVFVM

SEQ ID NO: 470892 - protein, 9 aa, Influenza virus
GSKGHVFVI

SEQ ID NO: 470893 - protein, 9 aa, Influenza virus
GSKKRLGSW

SEQ ID NO: 470894 - protein, 9 aa, Influenza virus
GSLEFIAEQ

SEQ ID NO: 470895 - protein, 9 aa, Influenza virus
GSLHGRICI

SEQ ID NO: 470896 - protein, 9 aa, Influenza virus
GSLKLAIGL

SEQ ID NO: 470897 - protein, 9 aa, Influenza virus
GSLKLAIGP

SEQ ID NO: 470898 - protein, 9 aa, Influenza virus
GSLKLATGM

SEQ ID NO: 470899 - protein, 9 aa, Influenza virus
GSLLLATGM

SEQ ID NO: 470900 - protein, 9 aa, Influenza virus
GSLLNDKHF

SEQ ID NO: 470901 - protein, 9 aa, Influenza virus
GSLLNDKHS

SEQ ID NO: 470902 - protein, 9 aa, Influenza virus
GSLLNDRHS

SEQ ID NO: 470903 - protein, 9 aa, Influenza virus
GSLMLATGM

SEQ ID NO: 470904 - protein, 9 aa, Influenza virus
GSLNDYEEL

SEQ ID NO: 470905 - protein, 9 aa, Influenza virus
GSLNFVSME

SEQ ID NO: 470906 - protein, 9 aa, Influenza virus
GSLQCKICI

SEQ ID NO: 470907 - protein, 9 aa, Influenza virus
GSLQCRICI

SEQ ID NO: 470908 - protein, 9 aa, Influenza virus
GSLQCRICM

SEQ ID NO: 470909 - protein, 9 aa, Influenza virus
GSLQCRVCI

SEQ ID NO: 470910 - protein, 9 aa, Influenza virus
GSLQCTICI

SEQ ID NO: 470911 - protein, 9 aa, Influenza virus
GSLRCRICI

SEQ ID NO: 470912 - protein, 9 aa, Influenza virus
GSLRLATGM

SEQ ID NO: 470913 - protein, 9 aa, Influenza virus
GSLSLAIMI

SEQ ID NO: 470914 - protein, 9 aa, Influenza virus
GSLSLAIMM

SEQ ID NO: 470915 - protein, 9 aa, Influenza virus
GSLSLAIMV

SEQ ID NO: 470916 - protein, 9 aa, Influenza virus
GSMQCKICI

SEQ ID NO: 470917 - protein, 9 aa, Influenza virus
GSMQCNVCI

SEQ ID NO: 470918 - protein, 9 aa, Influenza virus
GSMQCRICI

SEQ ID NO: 470919 - protein, 9 aa, Influenza virus
GSMQCRVCI

SEQ ID NO: 470920 - protein, 9 aa, Influenza virus
GSNIGFMPK

SEQ ID NO: 470921 - protein, 9 aa, Influenza virus
GSNRPIIDI

SEQ ID NO: 470922 - protein, 9 aa, Influenza virus
GSNRPIVDI

SEQ ID NO: 470923 - protein, 9 aa, Influenza virus
GSNRPVIDI

SEQ ID NO: 470924 - protein, 9 aa, Influenza virus
GSNRPVIDV

SEQ ID NO: 470925 - protein, 9 aa, Influenza virus
GSNRPVIQI

SEQ ID NO: 470926 - protein, 9 aa, Influenza virus
GSNRPVIRI

SEQ ID NO: 470927 - protein, 9 aa, Influenza virus
GSNRPVLDI

SEQ ID NO: 470928 - protein, 9 aa, Influenza virus
GSNRPVVDI

SEQ ID NO: 470929 - protein, 9 aa, Influenza virus
GSNRPWIRF

SEQ ID NO: 470930 - protein, 9 aa, Influenza virus
GSNRPWIRI

SEQ ID NO: 470931 - protein, 9 aa, Influenza virus
GSNRPWISF

SEQ ID NO: 470932 - protein, 9 aa, Influenza virus
GSNRPWLSF

SEQ ID NO: 470933 - protein, 9 aa, Influenza virus
GSNRPWMRI

SEQ ID NO: 470934 - protein, 9 aa, Influenza virus
GSNRPWVRI

SEQ ID NO: 470935 - protein, 9 aa, Influenza virus
GSNRPWVRM

SEQ ID NO: 470936 - protein, 9 aa, Influenza virus
GSNRPWVSF

SEQ ID NO: 470937 - protein, 9 aa, Influenza virus
GSPDPGVKG

SEQ ID NO: 470938 - protein, 9 aa, Influenza virus
GSPFPVGSG

SEQ ID NO: 470939 - protein, 9 aa, Influenza virus
GSPGAPGVK

SEQ ID NO: 470940 - protein, 9 aa, Influenza virus
GSPGCDRLQ

SEQ ID NO: 470941 - protein, 9 aa, Influenza virus
GSPGVKGWA

SEQ ID NO: 470942 - protein, 9 aa, Influenza virus
GSPISVGSG

SEQ ID NO: 470943 - protein, 9 aa, Influenza virus
GSPLELRDC

SEQ ID NO: 470944 - protein, 9 aa, Influenza virus
GSPLVLDDC

SEQ ID NO: 470945 - protein, 9 aa, Influenza virus
GSPPIVSNS

SEQ ID NO: 470946 - protein, 9 aa, Influenza virus
GSPPMVSNS

SEQ ID NO: 470947 - protein, 9 aa, Influenza virus
GSPPVVSNS

SEQ ID NO: 470948 - protein, 9 aa, Influenza virus
GSPSAPGVK

SEQ ID NO: 470949 - protein, 9 aa, Influenza virus
GSPVPVGSG

SEQ ID NO: 470950 - protein, 9 aa, Influenza virus
GSPVSVGSG

SEQ ID NO: 470951 - protein, 9 aa, Influenza virus
GSQGVKGWA

SEQ ID NO: 470952 - protein, 9 aa, Influenza virus
GSQKQEFKM

SEQ ID NO: 470953 - protein, 9 aa, Influenza virus
GSRERLGSW

SEQ ID NO: 470954 - protein, 9 aa, Influenza virus
GSRGEVFVI

SEQ ID NO: 470955 - protein, 9 aa, Influenza virus
GSRGHIFVI

SEQ ID NO: 470956 - protein, 9 aa, Influenza virus
GSRGHVFVI

SEQ ID NO: 470957 - protein, 9 aa, Influenza virus
GSRINMINS

SEQ ID NO: 470958 - protein, 9 aa, Influenza virus
GSRPRVRNQ

SEQ ID NO: 470959 - protein, 9 aa, Influenza virus
GSSEQAAEA

SEQ ID NO: 470960 - protein, 9 aa, Influenza virus
GSSFYAELK

SEQ ID NO: 470961 - protein, 9 aa, Influenza virus
GSSFYAEMK

SEQ ID NO: 470962 - protein, 9 aa, Influenza virus
GSSGIMKTE

SEQ ID NO: 470963 - protein, 9 aa, Influenza virus
GSSGIMKTG

SEQ ID NO: 470964 - protein, 9 aa, Influenza virus
GSSGVMKTE

SEQ ID NO: 470965 - protein, 9 aa, Influenza virus
GSSIAFCGV

SEQ ID NO: 470966 - protein, 9 aa, Influenza virus
GSSISFCGV

SEQ ID NO: 470967 - protein, 9 aa, Influenza virus
GSSKYQQSF

SEQ ID NO: 470968 - protein, 9 aa, Influenza virus
GSSKYRQSF

SEQ ID NO: 470969 - protein, 9 aa, Influenza virus
GSSPNAYQA

SEQ ID NO: 470970 - protein, 9 aa, Influenza virus
GSSSACLRG

SEQ ID NO: 470971 - protein, 9 aa, Influenza virus
GSSSFYAEM

SEQ ID NO: 470972 - protein, 9 aa, Influenza virus
GSSTYHNSF

SEQ ID NO: 470973 - protein, 9 aa, Influenza virus
GSSTYQNNF

SEQ ID NO: 470974 - protein, 9 aa, Influenza virus
GSSTYQNSF

SEQ ID NO: 470975 - protein, 9 aa, Influenza virus
GSSTYQSNF

SEQ ID NO: 470976 - protein, 9 aa, Influenza virus
GSSYVCSGL

SEQ ID NO: 470977 - protein, 9 aa, Influenza virus
GSTLGLDIR

SEQ ID NO: 470978 - protein, 9 aa, Influenza virus
GSTLPRRSG

SEQ ID NO: 470979 - protein, 9 aa, Influenza virus
GSTQKAIDN

SEQ ID NO: 470980 - protein, 9 aa, Influenza virus
GSTVNEEAL

SEQ ID NO: 470981 - protein, 9 aa, Influenza virus
GSVAHKSCL

SEQ ID NO: 470982 - protein, 9 aa, Influenza virus
GSVENLEEL

SEQ ID NO: 470983 - protein, 9 aa, Influenza virus
GSVENQEEL

SEQ ID NO: 470984 - protein, 9 aa, Influenza virus
GSVNTVLSI

SEQ ID NO: 470985 - protein, 9 aa, Influenza virus
GSVSLIIAT

SEQ ID NO: 470986 - protein, 9 aa, Influenza virus
GSVSLTIAI

SEQ ID NO: 470987 - protein, 9 aa, Influenza virus
GSVSLTIAT

SEQ ID NO: 470988 - protein, 9 aa, Influenza virus
GSVSLTITT

SEQ ID NO: 470989 - protein, 9 aa, Influenza virus
GSVYIEVLH

SEQ ID NO: 470990 - protein, 9 aa, Influenza virus
GSWADGANI

SEQ ID NO: 470991 - protein, 9 aa, Influenza virus
GSWPDGADI

SEQ ID NO: 470992 - protein, 9 aa, Influenza virus
GSWPDGADL

SEQ ID NO: 470993 - protein, 9 aa, Influenza virus
GSWPDGAEI

SEQ ID NO: 470994 - protein, 9 aa, Influenza virus
GSWPDGANF

SEQ ID NO: 470995 - protein, 9 aa, Influenza virus
GSWPDGANI

SEQ ID NO: 470996 - protein, 9 aa, Influenza virus
GSWPDGANV

SEQ ID NO: 470997 - protein, 9 aa, Influenza virus
GSWPDGRTS

SEQ ID NO: 470998 - protein, 9 aa, Influenza virus
GSWSHNILR

SEQ ID NO: 470999 - protein, 9 aa, Influenza virus
GSWSQNILR

SEQ ID NO: 471000 - protein, 9 aa, Influenza virus
GSWSWHDGA

SEQ ID NO: 471001 - protein, 9 aa, Influenza virus
GSYFFGDNA

SEQ ID NO: 471002 - protein, 9 aa, Influenza virus
GSYGTGSWP

SEQ ID NO: 471003 - protein, 9 aa, Influenza virus
GSYNNTNGE

SEQ ID NO: 471004 - protein, 9 aa, Influenza virus
GSYNNTSGE

SEQ ID NO: 471005 - protein, 9 aa, Influenza virus
GSYRCMFCI

SEQ ID NO: 471006 - protein, 9 aa, Influenza virus
GSYVRLYLW

SEQ ID NO: 471007 - protein, 9 aa, Influenza virus
GTAADLKST

SEQ ID NO: 471008 - protein, 9 aa, Influenza virus
GTAADYKST

SEQ ID NO: 471009 - protein, 9 aa, Influenza virus
GTAALSPGM

SEQ ID NO: 471010 - protein, 9 aa, Influenza virus
GTACFEIFH

SEQ ID NO: 471011 - protein, 9 aa, Influenza virus
GTAKHIEEC

SEQ ID NO: 471012 - protein, 9 aa, Influenza virus
GTAPILGNY

SEQ ID NO: 471013 - protein, 9 aa, Influenza virus
GTAPVLGNY

SEQ ID NO: 471014 - protein, 9 aa, Influenza virus
GTASLSPGM

SEQ ID NO: 471015 - protein, 9 aa, Influenza virus
GTCAVVMTD

SEQ ID NO: 471016 - protein, 9 aa, Influenza virus
GTCGTGSWP

SEQ ID NO: 471017 - protein, 9 aa, Influenza virus
GTCIVAVTD

SEQ ID NO: 471018 - protein, 9 aa, Influenza virus
GTCTAVMTD

SEQ ID NO: 471019 - protein, 9 aa, Influenza virus
GTCTVVLTD

SEQ ID NO: 471020 - protein, 9 aa, Influenza virus
GTCTVVMTD

SEQ ID NO: 471021 - protein, 9 aa, Influenza virus
GTCVAVMTD

SEQ ID NO: 471022 - protein, 9 aa, Influenza virus
GTCVVAVTD

SEQ ID NO: 471023 - protein, 9 aa, Influenza virus
GTCVVIMTD

SEQ ID NO: 471024 - protein, 9 aa, Influenza virus
GTCVVTVTD

SEQ ID NO: 471025 - protein, 9 aa, Influenza virus
GTCVVVMTD

SEQ ID NO: 471026 - protein, 9 aa, Influenza virus
GTCWEQLYT

SEQ ID NO: 471027 - protein, 9 aa, Influenza virus
GTCWEQMYT

SEQ ID NO: 471028 - protein, 9 aa, Influenza virus
GTDNYGVKG

SEQ ID NO: 471029 - protein, 9 aa, Influenza virus
GTFDIEGLY

SEQ ID NO: 471030 - protein, 9 aa, Influenza virus
GTFDIGGLY

SEQ ID NO: 471031 - protein, 9 aa, Influenza virus
GTFDLEGLY

SEQ ID NO: 471032 - protein, 9 aa, Influenza virus
GTFDLGGLY

SEQ ID NO: 471033 - protein, 9 aa, Influenza virus
GTFDTAQII

SEQ ID NO: 471034 - protein, 9 aa, Influenza virus
GTFDTIQII

SEQ ID NO: 471035 - protein, 9 aa, Influenza virus
GTFDTTQII

SEQ ID NO: 471036 - protein, 9 aa, Influenza virus
GTFDTVQII

SEQ ID NO: 471037 - protein, 9 aa, Influenza virus
GTFDTVQVI

SEQ ID NO: 471038 - protein, 9 aa, Influenza virus
GTFEFTSFF

SEQ ID NO: 471039 - protein, 9 aa, Influenza virus
GTFGPVHFQ

SEQ ID NO: 471040 - protein, 9 aa, Influenza virus
GTFGPVHFR

SEQ ID NO: 471041 - protein, 9 aa, Influenza virus
GTGAWPDGA

SEQ ID NO: 471042 - protein, 9 aa, Influenza virus
GTGCFEIFH

SEQ ID NO: 471043 - protein, 9 aa, Influenza virus
GTGIAADKA

SEQ ID NO: 471044 - protein, 9 aa, Influenza virus
GTGIAADKE

SEQ ID NO: 471045 - protein, 9 aa, Influenza virus
GTGIAADKT

SEQ ID NO: 471046 - protein, 9 aa, Influenza virus
GTGIAADKV

SEQ ID NO: 471047 - protein, 9 aa, Influenza virus
GTGIAADRD

SEQ ID NO: 471048 - protein, 9 aa, Influenza virus
GTGIAADRE

SEQ ID NO: 471049 - protein, 9 aa, Influenza virus
GTGIAADRG

SEQ ID NO: 471050 - protein, 9 aa, Influenza virus
GTGIAAEKE

SEQ ID NO: 471051 - protein, 9 aa, Influenza virus
GTGIVADRD

SEQ ID NO: 471052 - protein, 9 aa, Influenza virus
GTGMAADQK

SEQ ID NO: 471053 - protein, 9 aa, Influenza virus
GTGMAADRD

SEQ ID NO: 471054 - protein, 9 aa, Influenza virus
GTGMRILVR

SEQ ID NO: 471055 - protein, 9 aa, Influenza virus
GTGNKLITV

SEQ ID NO: 471056 - protein, 9 aa, Influenza virus
GTGQAADLK

SEQ ID NO: 471057 - protein, 9 aa, Influenza virus
GTGQAADYE

SEQ ID NO: 471058 - protein, 9 aa, Influenza virus
GTGQAADYK

SEQ ID NO: 471059 - protein, 9 aa, Influenza virus
GTGRIFQSG

SEQ ID NO: 471060 - protein, 9 aa, Influenza virus
GTGRIFQSR

SEQ ID NO: 471061 - protein, 9 aa, Influenza virus
GTGSIYIEV

SEQ ID NO: 471062 - protein, 9 aa, Influenza virus
GTGSVYIEV

SEQ ID NO: 471063 - protein, 9 aa, Influenza virus
GTGSWPDGA

SEQ ID NO: 471064 - protein, 9 aa, Influenza virus
GTGTAADLK

SEQ ID NO: 471065 - protein, 9 aa, Influenza virus
GTGTGYTMD

SEQ ID NO: 471066 - protein, 9 aa, Influenza virus
GTGTWPDGA

SEQ ID NO: 471067 - protein, 9 aa, Influenza virus
GTGYTMDTV

SEQ ID NO: 471068 - protein, 9 aa, Influenza virus
GTHGTGSWP

SEQ ID NO: 471069 - protein, 9 aa, Influenza virus
GTIAGFIEG

SEQ ID NO: 471070 - protein, 9 aa, Influenza virus
GTIASSLPF

SEQ ID NO: 471071 - protein, 9 aa, Influenza virus
GTIHDRAAF

SEQ ID NO: 471072 - protein, 9 aa, Influenza virus
GTIHDRSPF

SEQ ID NO: 471073 - protein, 9 aa, Influenza virus
GTIHDRSPY

SEQ ID NO: 471074 - protein, 9 aa, Influenza virus
GTIHDRSQF

SEQ ID NO: 471075 - protein, 9 aa, Influenza virus
GTIHDRSQY

SEQ ID NO: 471076 - protein, 9 aa, Influenza virus
GTIHDRTAF

SEQ ID NO: 471077 - protein, 9 aa, Influenza virus
GTIHDRTTF

SEQ ID NO: 471078 - protein, 9 aa, Influenza virus
GTIIGPPQC

SEQ ID NO: 471079 - protein, 9 aa, Influenza virus
GTIIKTLTN

SEQ ID NO: 471080 - protein, 9 aa, Influenza virus
GTIISNLPF

SEQ ID NO: 471081 - protein, 9 aa, Influenza virus
GTIISSLPF

SEQ ID NO: 471082 - protein, 9 aa, Influenza virus
GTIKDRSPY

SEQ ID NO: 471083 - protein, 9 aa, Influenza virus
GTINDRSPF

SEQ ID NO: 471084 - protein, 9 aa, Influenza virus
GTINSPLPF

SEQ ID NO: 471085 - protein, 9 aa, Influenza virus
GTISPRSRS

SEQ ID NO: 471086 - protein, 9 aa, Influenza virus
GTITGPPQC

SEQ ID NO: 471087 - protein, 9 aa, Influenza virus
GTITSNLPF

SEQ ID NO: 471088 - protein, 9 aa, Influenza virus
GTITSPLPF

SEQ ID NO: 471089 - protein, 9 aa, Influenza virus
GTIVKTLTD

SEQ ID NO: 471090 - protein, 9 aa, Influenza virus
GTIVKTLTN

SEQ ID NO: 471091 - protein, 9 aa, Influenza virus
GTIVKTLTS

SEQ ID NO: 471092 - protein, 9 aa, Influenza virus
GTIVSSLPF

SEQ ID NO: 471093 - protein, 9 aa, Influenza virus
GTKGFGFLN

SEQ ID NO: 471094 - protein, 9 aa, Influenza virus
GTKINTLTE

SEQ ID NO: 471095 - protein, 9 aa, Influenza virus
GTKQVCAAW

SEQ ID NO: 471096 - protein, 9 aa, Influenza virus
GTKQVCIAW

SEQ ID NO: 471097 - protein, 9 aa, Influenza virus
GTKQVCMAW

SEQ ID NO: 471098 - protein, 9 aa, Influenza virus
GTKQVCVAW

SEQ ID NO: 471099 - protein, 9 aa, Influenza virus
GTKRSHEQM

SEQ ID NO: 471100 - protein, 9 aa, Influenza virus
GTKRSYEQM

SEQ ID NO: 471101 - protein, 9 aa, Influenza virus
GTKVDTLTE

SEQ ID NO: 471102 - protein, 9 aa, Influenza virus
GTKVNTLAE

SEQ ID NO: 471103 - protein, 9 aa, Influenza virus
GTKVNTLTE

SEQ ID NO: 471104 - protein, 9 aa, Influenza virus
GTLIGPPQC

SEQ ID NO: 471105 - protein, 9 aa, Influenza virus
GTLNRLIDK

SEQ ID NO: 471106 - protein, 9 aa, Influenza virus
GTMDYYWGI

SEQ ID NO: 471107 - protein, 9 aa, Influenza virus
GTMHDRSPF

SEQ ID NO: 471108 - protein, 9 aa, Influenza virus
GTMKDRSPY

SEQ ID NO: 471109 - protein, 9 aa, Influenza virus
GTMVKTLAD

SEQ ID NO: 471110 - protein, 9 aa, Influenza virus
GTMVKTLTD

SEQ ID NO: 471111 - protein, 9 aa, Influenza virus
GTMVKTLTG

SEQ ID NO: 471112 - protein, 9 aa, Influenza virus
GTNGVKGFS

SEQ ID NO: 471113 - protein, 9 aa, Influenza virus
GTNNYGVKG

SEQ ID NO: 471114 - protein, 9 aa, Influenza virus
GTNRPILVI

SEQ ID NO: 471115 - protein, 9 aa, Influenza virus
GTNRPVLII

SEQ ID NO: 471116 - protein, 9 aa, Influenza virus
GTNRPVLVI

SEQ ID NO: 471117 - protein, 9 aa, Influenza virus
GTNRPVLVV

SEQ ID NO: 471118 - protein, 9 aa, Influenza virus
GTPACDLHL

SEQ ID NO: 471119 - protein, 9 aa, Influenza virus
GTPACDLYL

SEQ ID NO: 471120 - protein, 9 aa, Influenza virus
GTPDPGVKG

SEQ ID NO: 471121 - protein, 9 aa, Influenza virus
GTPLELRDC

SEQ ID NO: 471122 - protein, 9 aa, Influenza virus
GTPPTVSNS

SEQ ID NO: 471123 - protein, 9 aa, Influenza virus
GTPTLNQRS

SEQ ID NO: 471124 - protein, 9 aa, Influenza virus
GTPVCDPHL

SEQ ID NO: 471125 - protein, 9 aa, Influenza virus
GTQGVKGWA

SEQ ID NO: 471126 - protein, 9 aa, Influenza virus
GTQPLSISV

SEQ ID NO: 471127 - protein, 9 aa, Influenza virus
GTQSLSISI

SEQ ID NO: 471128 - protein, 9 aa, Influenza virus
GTQSLSISV

SEQ ID NO: 471129 - protein, 9 aa, Influenza virus
GTREWSYLI

SEQ ID NO: 471130 - protein, 9 aa, Influenza virus
GTRIGDGQR

SEQ ID NO: 471131 - protein, 9 aa, Influenza virus
GTRPGYNGQ

SEQ ID NO: 471132 - protein, 9 aa, Influenza virus
GTRQVCIAW

SEQ ID NO: 471133 - protein, 9 aa, Influenza virus
GTRQVCMAW

SEQ ID NO: 471134 - protein, 9 aa, Influenza virus
GTRQVCVAW

SEQ ID NO: 471135 - protein, 9 aa, Influenza virus
GTRRIDFHW

SEQ ID NO: 471136 - protein, 9 aa, Influenza virus
GTRVNTLTE

SEQ ID NO: 471137 - protein, 9 aa, Influenza virus
GTRWMKIIR

SEQ ID NO: 471138 - protein, 9 aa, Influenza virus
GTSGTYGAG

SEQ ID NO: 471139 - protein, 9 aa, Influenza virus
GTSGTYGSG

SEQ ID NO: 471140 - protein, 9 aa, Influenza virus
GTSGTYGTG

SEQ ID NO: 471141 - protein, 9 aa, Influenza virus
GTSIWTSSS

SEQ ID NO: 471142 - protein, 9 aa, Influenza virus
GTSKACNAL

SEQ ID NO: 471143 - protein, 9 aa, Influenza virus
GTSKACNAS

SEQ ID NO: 471144 - protein, 9 aa, Influenza virus
GTSKACSAS

SEQ ID NO: 471145 - protein, 9 aa, Influenza virus
GTSKIKMKW

SEQ ID NO: 471146 - protein, 9 aa, Influenza virus
GTSKVKMKW

SEQ ID NO: 471147 - protein, 9 aa, Influenza virus
GTSSFYRNL

SEQ ID NO: 471148 - protein, 9 aa, Influenza virus
GTSSIYIEV

SEQ ID NO: 471149 - protein, 9 aa, Influenza virus
GTSSVYIEV

SEQ ID NO: 471150 - protein, 9 aa, Influenza virus
GTSSVYVEV

SEQ ID NO: 471151 - protein, 9 aa, Influenza virus
GTSTLNHRS

SEQ ID NO: 471152 - protein, 9 aa, Influenza virus
GTSTLNKRS

SEQ ID NO: 471153 - protein, 9 aa, Influenza virus
GTSTLNLRL

SEQ ID NO: 471154 - protein, 9 aa, Influenza virus
GTSTLNQKL

SEQ ID NO: 471155 - protein, 9 aa, Influenza virus
GTSTLNQRL

SEQ ID NO: 471156 - protein, 9 aa, Influenza virus
GTSTLNQRM

SEQ ID NO: 471157 - protein, 9 aa, Influenza virus
GTSTLNQRS

SEQ ID NO: 471158 - protein, 9 aa, Influenza virus
GTSVKTLTD

SEQ ID NO: 471159 - protein, 9 aa, Influenza virus
GTSVWAGRT

SEQ ID NO: 471160 - protein, 9 aa, Influenza virus
GTTASCQNR

SEQ ID NO: 471161 - protein, 9 aa, Influenza virus
GTTGNPIIC

SEQ ID NO: 471162 - protein, 9 aa, Influenza virus
GTTHDRTAF

SEQ ID NO: 471163 - protein, 9 aa, Influenza virus
GTTIRGKHS

SEQ ID NO: 471164 - protein, 9 aa, Influenza virus
GTTIRGRHS

SEQ ID NO: 471165 - protein, 9 aa, Influenza virus
GTTIRNKHS

SEQ ID NO: 471166 - protein, 9 aa, Influenza virus
GTTIRNRHS

SEQ ID NO: 471167 - protein, 9 aa, Influenza virus
GTTLDNEHS

SEQ ID NO: 471168 - protein, 9 aa, Influenza virus
GTTLDNKHS

SEQ ID NO: 471169 - protein, 9 aa, Influenza virus
GTTLENKHS

SEQ ID NO: 471170 - protein, 9 aa, Influenza virus
GTTLKGRHA

SEQ ID NO: 471171 - protein, 9 aa, Influenza virus
GTTLNNKHS

SEQ ID NO: 471172 - protein, 9 aa, Influenza virus
GTTLRGQHA

SEQ ID NO: 471173 - protein, 9 aa, Influenza virus
GTTLRGRHA

SEQ ID NO: 471174 - protein, 9 aa, Influenza virus
GTTLYNKHS

SEQ ID NO: 471175 - protein, 9 aa, Influenza virus
GTTVNEEAL

SEQ ID NO: 471176 - protein, 9 aa, Influenza virus
GTVKDRSPF

SEQ ID NO: 471177 - protein, 9 aa, Influenza virus
GTVKDRSPY

SEQ ID NO: 471178 - protein, 9 aa, Influenza virus
GTVSLSPGM

SEQ ID NO: 471179 - protein, 9 aa, Influenza virus
GTVTGPPQC

SEQ ID NO: 471180 - protein, 9 aa, Influenza virus
GTVVKTLTD

SEQ ID NO: 471181 - protein, 9 aa, Influenza virus
GTWAVVMTD

SEQ ID NO: 471182 - protein, 9 aa, Influenza virus
GTWDTIIER

SEQ ID NO: 471183 - protein, 9 aa, Influenza virus
GTWDTLIER

SEQ ID NO: 471184 - protein, 9 aa, Influenza virus
GTWNTLIER

SEQ ID NO: 471185 - protein, 9 aa, Influenza virus
GTWPDGADI

SEQ ID NO: 471186 - protein, 9 aa, Influenza virus
GTYCSLNGI

SEQ ID NO: 471187 - protein, 9 aa, Influenza virus
GTYCSLNGV

SEQ ID NO: 471188 - protein, 9 aa, Influenza virus
GTYDHKDYE

SEQ ID NO: 471189 - protein, 9 aa, Influenza virus
GTYDHKEFE

SEQ ID NO: 471190 - protein, 9 aa, Influenza virus
GTYDHKEFK

SEQ ID NO: 471191 - protein, 9 aa, Influenza virus
GTYDHKEYE

SEQ ID NO: 471192 - protein, 9 aa, Influenza virus
GTYDHNIYR

SEQ ID NO: 471193 - protein, 9 aa, Influenza virus
GTYDYPKYE

SEQ ID NO: 471194 - protein, 9 aa, Influenza virus
GTYDYPKYQ

SEQ ID NO: 471195 - protein, 9 aa, Influenza virus
GTYDYPKYS

SEQ ID NO: 471196 - protein, 9 aa, Influenza virus
GTYDYSKYE

SEQ ID NO: 471197 - protein, 9 aa, Influenza virus
GTYGAGSWP

SEQ ID NO: 471198 - protein, 9 aa, Influenza virus
GTYGSGSWP

SEQ ID NO: 471199 - protein, 9 aa, Influenza virus
GTYGTGAWP

SEQ ID NO: 471200 - protein, 9 aa, Influenza virus
GTYGTGSWP

SEQ ID NO: 471201 - protein, 9 aa, Influenza virus
GTYGTGTWP

SEQ ID NO: 471202 - protein, 9 aa, Influenza virus
GTYKILTIY

SEQ ID NO: 471203 - protein, 9 aa, Influenza virus
GTYNHEDYK

SEQ ID NO: 471204 - protein, 9 aa, Influenza virus
GTYNHEDYR

SEQ ID NO: 471205 - protein, 9 aa, Influenza virus
GTYNHKDYE

SEQ ID NO: 471206 - protein, 9 aa, Influenza virus
GTYNHKEYE

SEQ ID NO: 471207 - protein, 9 aa, Influenza virus
GTYNHQDYE

SEQ ID NO: 471208 - protein, 9 aa, Influenza virus
GTYNHQEYE

SEQ ID NO: 471209 - protein, 9 aa, Influenza virus
GTYNHREYE

SEQ ID NO: 471210 - protein, 9 aa, Influenza virus
GTYNNTTGR

SEQ ID NO: 471211 - protein, 9 aa, Influenza virus
GTYNRKEYE

SEQ ID NO: 471212 - protein, 9 aa, Influenza virus
GTYNYPKYE

SEQ ID NO: 471213 - protein, 9 aa, Influenza virus
GTYNYPKYH

SEQ ID NO: 471214 - protein, 9 aa, Influenza virus
GTYNYPKYQ

SEQ ID NO: 471215 - protein, 9 aa, Influenza virus
GTYNYPKYS

SEQ ID NO: 471216 - protein, 9 aa, Influenza virus
GTYQILSIY

SEQ ID NO: 471217 - protein, 9 aa, Influenza virus
GTYYYPKYE

SEQ ID NO: 471218 - protein, 9 aa, Influenza virus
GVAIALSIL

SEQ ID NO: 471219 - protein, 9 aa, Influenza virus
GVAIALSVL

SEQ ID NO: 471220 - protein, 9 aa, Influenza virus
GVANLGLNI

SEQ ID NO: 471221 - protein, 9 aa, Influenza virus
GVAPSPSNS

SEQ ID NO: 471222 - protein, 9 aa, Influenza virus
GVAPSPYNS

SEQ ID NO: 471223 - protein, 9 aa, Influenza virus
GVAPVLGNY

SEQ ID NO: 471224 - protein, 9 aa, Influenza virus
GVCPVVFTD

SEQ ID NO: 471225 - protein, 9 aa, Influenza virus
GVCPVVMTD

SEQ ID NO: 471226 - protein, 9 aa, Influenza virus
GVCYPGSIE

SEQ ID NO: 471227 - protein, 9 aa, Influenza virus
GVCYPGSIK

SEQ ID NO: 471228 - protein, 9 aa, Influenza virus
GVDEYSNAE

SEQ ID NO: 471229 - protein, 9 aa, Influenza virus
GVDEYSSAE

SEQ ID NO: 471230 - protein, 9 aa, Influenza virus
GVDEYSSTE

SEQ ID NO: 471231 - protein, 9 aa, Influenza virus
GVDPFKLLQ

SEQ ID NO: 471232 - protein, 9 aa, Influenza virus
GVDPFRLLQ

SEQ ID NO: 471233 - protein, 9 aa, Influenza virus
GVDRFYRIC

SEQ ID NO: 471234 - protein, 9 aa, Influenza virus
GVDRFYRTC

SEQ ID NO: 471235 - protein, 9 aa, Influenza virus
GVDSDTTGW

SEQ ID NO: 471236 - protein, 9 aa, Influenza virus
GVDSDTTSW

SEQ ID NO: 471237 - protein, 9 aa, Influenza virus
GVEDGSIGK

SEQ ID NO: 471238 - protein, 9 aa, Influenza virus
GVEEGSIGK

SEQ ID NO: 471239 - protein, 9 aa, Influenza virus
GVEESSIGK

SEQ ID NO: 471240 - protein, 9 aa, Influenza virus
GVELSSMGV

SEQ ID NO: 471241 - protein, 9 aa, Influenza virus
GVESAVLRG

SEQ ID NO: 471242 - protein, 9 aa, Influenza virus
GVETMVILS

SEQ ID NO: 471243 - protein, 9 aa, Influenza virus
GVEVVDATE

SEQ ID NO: 471244 - protein, 9 aa, Influenza virus
GVEVVNATE

SEQ ID NO: 471245 - protein, 9 aa, Influenza virus
GVEYNGKSL

SEQ ID NO: 471246 - protein, 9 aa, Influenza virus
GVFEFSDER

SEQ ID NO: 471247 - protein, 9 aa, Influenza virus
GVFELSDEK

SEQ ID NO: 471248 - protein, 9 aa, Influenza virus
GVFELSDER

SEQ ID NO: 471249 - protein, 9 aa, Influenza virus
GVFGDNPRP

SEQ ID NO: 471250 - protein, 9 aa, Influenza virus
GVFGDNPRS

SEQ ID NO: 471251 - protein, 9 aa, Influenza virus
GVFGDSPRP

SEQ ID NO: 471252 - protein, 9 aa, Influenza virus
GVFGDTPRP

SEQ ID NO: 471253 - protein, 9 aa, Influenza virus
GVFLAPRYA

SEQ ID NO: 471254 - protein, 9 aa, Influenza virus
GVGIAADKE

SEQ ID NO: 471255 - protein, 9 aa, Influenza virus
GVGMAADKE

SEQ ID NO: 471256 - protein, 9 aa, Influenza virus
GVGNLAFNT

SEQ ID NO: 471257 - protein, 9 aa, Influenza virus
GVGNLIFNT

SEQ ID NO: 471258 - protein, 9 aa, Influenza virus
GVGNLVFNT

SEQ ID NO: 471259 - protein, 9 aa, Influenza virus
GVGRMTICI

SEQ ID NO: 471260 - protein, 9 aa, Influenza virus
GVGRMTICV

SEQ ID NO: 471261 - protein, 9 aa, Influenza virus
GVHHPSSDN

SEQ ID NO: 471262 - protein, 9 aa, Influenza virus
GVHHPSTDA

SEQ ID NO: 471263 - protein, 9 aa, Influenza virus
GVHHPSTDK

SEQ ID NO: 471264 - protein, 9 aa, Influenza virus
GVHHPSTDT

SEQ ID NO: 471265 - protein, 9 aa, Influenza virus
GVHHSSSLD

SEQ ID NO: 471266 - protein, 9 aa, Influenza virus
GVILEENTT

SEQ ID NO: 471267 - protein, 9 aa, Influenza virus
GVINTSKPF

SEQ ID NO: 471268 - protein, 9 aa, Influenza virus
GVIPLTTTP

SEQ ID NO: 471269 - protein, 9 aa, Influenza virus
GVITDTIKS

SEQ ID NO: 471270 - protein, 9 aa, Influenza virus
GVITDTLKS

SEQ ID NO: 471271 - protein, 9 aa, Influenza virus
GVIVTREPY

SEQ ID NO: 471272 - protein, 9 aa, Influenza virus
GVKGFAFKY

SEQ ID NO: 471273 - protein, 9 aa, Influenza virus
GVKGFAFLD

SEQ ID NO: 471274 - protein, 9 aa, Influenza virus
GVKGFAFLN

SEQ ID NO: 471275 - protein, 9 aa, Influenza virus
GVKGFAYLD

SEQ ID NO: 471276 - protein, 9 aa, Influenza virus
GVKGFGFKA

SEQ ID NO: 471277 - protein, 9 aa, Influenza virus
GVKGFGFKK

SEQ ID NO: 471278 - protein, 9 aa, Influenza virus
GVKGFGFKS

SEQ ID NO: 471279 - protein, 9 aa, Influenza virus
GVKGFGFKT

SEQ ID NO: 471280 - protein, 9 aa, Influenza virus
GVKGFGFKV

SEQ ID NO: 471281 - protein, 9 aa, Influenza virus
GVKGFGFLD

SEQ ID NO: 471282 - protein, 9 aa, Influenza virus
GVKGFGFLN

SEQ ID NO: 471283 - protein, 9 aa, Influenza virus
GVKGFGFLS

SEQ ID NO: 471284 - protein, 9 aa, Influenza virus
GVKGFGFRQ

SEQ ID NO: 471285 - protein, 9 aa, Influenza virus
GVKGFSFKY

SEQ ID NO: 471286 - protein, 9 aa, Influenza virus
GVKGFSFRY

SEQ ID NO: 471287 - protein, 9 aa, Influenza virus
GVKGFSYKY

SEQ ID NO: 471288 - protein, 9 aa, Influenza virus
GVKGFSYLD

SEQ ID NO: 471289 - protein, 9 aa, Influenza virus
GVKGFSYLN

SEQ ID NO: 471290 - protein, 9 aa, Influenza virus
GVKGFSYRY

SEQ ID NO: 471291 - protein, 9 aa, Influenza virus
GVKGWAFDD

SEQ ID NO: 471292 - protein, 9 aa, Influenza virus
GVKGWAFDE

SEQ ID NO: 471293 - protein, 9 aa, Influenza virus
GVKGWAFDI

SEQ ID NO: 471294 - protein, 9 aa, Influenza virus
GVKGWAFDN

SEQ ID NO: 471295 - protein, 9 aa, Influenza virus
GVKGWAFDS

SEQ ID NO: 471296 - protein, 9 aa, Influenza virus
GVKGWAFDV

SEQ ID NO: 471297 - protein, 9 aa, Influenza virus
GVKGWAFDY

SEQ ID NO: 471298 - protein, 9 aa, Influenza virus
GVKLAQGYK

SEQ ID NO: 471299 - protein, 9 aa, Influenza virus
GVKLEENST

SEQ ID NO: 471300 - protein, 9 aa, Influenza virus
GVKLEENTS

SEQ ID NO: 471301 - protein, 9 aa, Influenza virus
GVKLEENTT

SEQ ID NO: 471302 - protein, 9 aa, Influenza virus
GVKLIQGYK

SEQ ID NO: 471303 - protein, 9 aa, Influenza virus
GVKLSNMGI

SEQ ID NO: 471304 - protein, 9 aa, Influenza virus
GVKLSNMGV

SEQ ID NO: 471305 - protein, 9 aa, Influenza virus
GVKLSSMGI

SEQ ID NO: 471306 - protein, 9 aa, Influenza virus
GVKLSSMGV

SEQ ID NO: 471307 - protein, 9 aa, Influenza virus
GVKLTQGYK

SEQ ID NO: 471308 - protein, 9 aa, Influenza virus
GVKMNPNQK

SEQ ID NO: 471309 - protein, 9 aa, Influenza virus
GVKPLILKD

SEQ ID NO: 471310 - protein, 9 aa, Influenza virus
GVKPLILRD

SEQ ID NO: 471311 - protein, 9 aa, Influenza virus
GVKPLILRN

SEQ ID NO: 471312 - protein, 9 aa, Influenza virus
GVKVDGSSS

SEQ ID NO: 471313 - protein, 9 aa, Influenza virus
GVLEDEQMY

SEQ ID NO: 471314 - protein, 9 aa, Influenza virus
GVLGDNPRP

SEQ ID NO: 471315 - protein, 9 aa, Influenza virus
GVLHLILWI

SEQ ID NO: 471316 - protein, 9 aa, Influenza virus
GVLLGTKHS

SEQ ID NO: 471317 - protein, 9 aa, Influenza virus
GVLTDTSRP

SEQ ID NO: 471318 - protein, 9 aa, Influenza virus
GVMKTEGTL

SEQ ID NO: 471319 - protein, 9 aa, Influenza virus
GVMNTSKPF

SEQ ID NO: 471320 - protein, 9 aa, Influenza virus
GVMNTSKPL

SEQ ID NO: 471321 - protein, 9 aa, Influenza virus
GVNDRNFWR

SEQ ID NO: 471322 - protein, 9 aa, Influenza virus
GVNESADMS

SEQ ID NO: 471323 - protein, 9 aa, Influenza virus
GVNRFYRTC

SEQ ID NO: 471324 - protein, 9 aa, Influenza virus
GVNSDTTGW

SEQ ID NO: 471325 - protein, 9 aa, Influenza virus
GVNSDTTSW

SEQ ID NO: 471326 - protein, 9 aa, Influenza virus
GVNSFSRTE

SEQ ID NO: 471327 - protein, 9 aa, Influenza virus
GVNSNTTGW

SEQ ID NO: 471328 - protein, 9 aa, Influenza virus
GVNTNKTFQ

SEQ ID NO: 471329 - protein, 9 aa, Influenza virus
GVPESMREE

SEQ ID NO: 471330 - protein, 9 aa, Influenza virus
GVPFHLATK

SEQ ID NO: 471331 - protein, 9 aa, Influenza virus
GVPFHLGTK

SEQ ID NO: 471332 - protein, 9 aa, Influenza virus
GVPFHLGTR

SEQ ID NO: 471333 - protein, 9 aa, Influenza virus
GVPFYLGTK

SEQ ID NO: 471334 - protein, 9 aa, Influenza virus
GVPFYLGTR

SEQ ID NO: 471335 - protein, 9 aa, Influenza virus
GVPKSMREE

SEQ ID NO: 471336 - protein, 9 aa, Influenza virus
GVPPLELGD

SEQ ID NO: 471337 - protein, 9 aa, Influenza virus
GVPTDVIRS

SEQ ID NO: 471338 - protein, 9 aa, Influenza virus
GVPTDVMRS

SEQ ID NO: 471339 - protein, 9 aa, Influenza virus
GVPTDVVRS

SEQ ID NO: 471340 - protein, 9 aa, Influenza virus
GVPVTSSID

SEQ ID NO: 471341 - protein, 9 aa, Influenza virus
GVPVTSSVD

SEQ ID NO: 471342 - protein, 9 aa, Influenza virus
GVQAGVDRF

SEQ ID NO: 471343 - protein, 9 aa, Influenza virus
GVQDIIDND

SEQ ID NO: 471344 - protein, 9 aa, Influenza virus
GVQDIIDNN

SEQ ID NO: 471345 - protein, 9 aa, Influenza virus
GVQIASNEN

SEQ ID NO: 471346 - protein, 9 aa, Influenza virus
GVQMQRFRR

SEQ ID NO: 471347 - protein, 9 aa, Influenza virus
GVQVASNEN

SEQ ID NO: 471348 - protein, 9 aa, Influenza virus
GVRCICRDN

SEQ ID NO: 471349 - protein, 9 aa, Influenza virus
GVREWSYLI

SEQ ID NO: 471350 - protein, 9 aa, Influenza virus
GVRLEENTT

SEQ ID NO: 471351 - protein, 9 aa, Influenza virus
GVRLTQGYK

SEQ ID NO: 471352 - protein, 9 aa, Influenza virus
GVRPGYNGQ

SEQ ID NO: 471353 - protein, 9 aa, Influenza virus
GVRPLILKD

SEQ ID NO: 471354 - protein, 9 aa, Influenza virus
GVRPLILRD

SEQ ID NO: 471355 - protein, 9 aa, Influenza virus
GVRPRYNGQ

SEQ ID NO: 471356 - protein, 9 aa, Influenza virus
GVSFHLGTK

SEQ ID NO: 471357 - protein, 9 aa, Influenza virus
GVSGADDDA

SEQ ID NO: 471358 - protein, 9 aa, Influenza virus
GVSGADNDA

SEQ ID NO: 471359 - protein, 9 aa, Influenza virus
GVSGEVPGW

SEQ ID NO: 471360 - protein, 9 aa, Influenza virus
GVSGINESA

SEQ ID NO: 471361 - protein, 9 aa, Influenza virus
GVSGPDNGA

SEQ ID NO: 471362 - protein, 9 aa, Influenza virus
GVSGTDDDA

SEQ ID NO: 471363 - protein, 9 aa, Influenza virus
GVSGVNESA

SEQ ID NO: 471364 - protein, 9 aa, Influenza virus
GVSILNLGQ

SEQ ID NO: 471365 - protein, 9 aa, Influenza virus
GVSPIHLGD

SEQ ID NO: 471366 - protein, 9 aa, Influenza virus
GVSPVHLGD

SEQ ID NO: 471367 - protein, 9 aa, Influenza virus
GVSSEVPEW

SEQ ID NO: 471368 - protein, 9 aa, Influenza virus
GVSSEVPGC

SEQ ID NO: 471369 - protein, 9 aa, Influenza virus
GVSSEVPGW

SEQ ID NO: 471370 - protein, 9 aa, Influenza virus
GVSVLNLGQ

SEQ ID NO: 471371 - protein, 9 aa, Influenza virus
GVTASCLDK

SEQ ID NO: 471372 - protein, 9 aa, Influenza virus
GVTASCLDR

SEQ ID NO: 471373 - protein, 9 aa, Influenza virus
GVTASCRDN

SEQ ID NO: 471374 - protein, 9 aa, Influenza virus
GVTLSVVSL

SEQ ID NO: 471375 - protein, 9 aa, Influenza virus
GVTNKVNSI

SEQ ID NO: 471376 - protein, 9 aa, Influenza virus
GVTRREIHI

SEQ ID NO: 471377 - protein, 9 aa, Influenza virus
GVTRREVHI

SEQ ID NO: 471378 - protein, 9 aa, Influenza virus
GVTRREVHM

SEQ ID NO: 471379 - protein, 9 aa, Influenza virus
GVTRREVHT

SEQ ID NO: 471380 - protein, 9 aa, Influenza virus
GVTRREVHV

SEQ ID NO: 471381 - protein, 9 aa, Influenza virus
GVTTHYVSQ

SEQ ID NO: 471382 - protein, 9 aa, Influenza virus
GVTVIKNNM

SEQ ID NO: 471383 - protein, 9 aa, Influenza virus
GVTVIRNNM

SEQ ID NO: 471384 - protein, 9 aa, Influenza virus
GVVNTALST

SEQ ID NO: 471385 - protein, 9 aa, Influenza virus
GVVNTTLST

SEQ ID NO: 471386 - protein, 9 aa, Influenza virus
GVWIGRTKN

SEQ ID NO: 471387 - protein, 9 aa, Influenza virus
GVWIGRTKS

SEQ ID NO: 471388 - protein, 9 aa, Influenza virus
GVWTYNAEL

SEQ ID NO: 471389 - protein, 9 aa, Influenza virus
GVWWTSNSI

SEQ ID NO: 471390 - protein, 9 aa, Influenza virus
GVYINTALL

SEQ ID NO: 471391 - protein, 9 aa, Influenza virus
GVYINTAML

SEQ ID NO: 471392 - protein, 9 aa, Influenza virus
GVYKALSIY

SEQ ID NO: 471393 - protein, 9 aa, Influenza virus
GVYMNTALL

SEQ ID NO: 471394 - protein, 9 aa, Influenza virus
GVYNNTTGR

SEQ ID NO: 471395 - protein, 9 aa, Influenza virus
GVYQILAIY

SEQ ID NO: 471396 - protein, 9 aa, Influenza virus
GVYQILSIY

SEQ ID NO: 471397 - protein, 9 aa, Influenza virus
GVYQVLAIY

SEQ ID NO: 471398 - protein, 9 aa, Influenza virus
GVYVNTALL

SEQ ID NO: 471399 - protein, 9 aa, Influenza virus
GWAFDNGDD

SEQ ID NO: 471400 - protein, 9 aa, Influenza virus
GWAFDNGND

SEQ ID NO: 471401 - protein, 9 aa, Influenza virus
GWAFDSGDD

SEQ ID NO: 471402 - protein, 9 aa, Influenza virus
GWAFDYGND

SEQ ID NO: 471403 - protein, 9 aa, Influenza virus
GWAFDYGSD

SEQ ID NO: 471404 - protein, 9 aa, Influenza virus
GWAIHSKDN

SEQ ID NO: 471405 - protein, 9 aa, Influenza virus
GWAIHTKDN

SEQ ID NO: 471406 - protein, 9 aa, Influenza virus
GWAIYSKDN

SEQ ID NO: 471407 - protein, 9 aa, Influenza virus
GWAIYTKDN

SEQ ID NO: 471408 - protein, 9 aa, Influenza virus
GWAPLSKDN

SEQ ID NO: 471409 - protein, 9 aa, Influenza virus
GWATANSKS

SEQ ID NO: 471410 - protein, 9 aa, Influenza virus
GWAVHSKDN

SEQ ID NO: 471411 - protein, 9 aa, Influenza virus
GWAVYSKDN

SEQ ID NO: 471412 - protein, 9 aa, Influenza virus
GWCGMIDGW

SEQ ID NO: 471413 - protein, 9 aa, Influenza virus
GWEGLIDGW

SEQ ID NO: 471414 - protein, 9 aa, Influenza virus
GWEGLINGW

SEQ ID NO: 471415 - protein, 9 aa, Influenza virus
GWEGLVDGW

SEQ ID NO: 471416 - protein, 9 aa, Influenza virus
GWEGMIDGW

SEQ ID NO: 471417 - protein, 9 aa, Influenza virus
GWEGMMDGW

SEQ ID NO: 471418 - protein, 9 aa, Influenza virus
GWEGMVDGW

SEQ ID NO: 471419 - protein, 9 aa, Influenza virus
GWEGMVNGW

SEQ ID NO: 471420 - protein, 9 aa, Influenza virus
GWIDSPNHA

SEQ ID NO: 471421 - protein, 9 aa, Influenza virus
GWIGGNPAC

SEQ ID NO: 471422 - protein, 9 aa, Influenza virus
GWILGNPEC

SEQ ID NO: 471423 - protein, 9 aa, Influenza virus
GWILGNPKC

SEQ ID NO: 471424 - protein, 9 aa, Influenza virus
GWILGNPMC

SEQ ID NO: 471425 - protein, 9 aa, Influenza virus
GWILGNPQC

SEQ ID NO: 471426 - protein, 9 aa, Influenza virus
GWILGNPRC

SEQ ID NO: 471427 - protein, 9 aa, Influenza virus
GWINSPNHA

SEQ ID NO: 471428 - protein, 9 aa, Influenza virus
GWINSPNHV

SEQ ID NO: 471429 - protein, 9 aa, Influenza virus
GWINSPSQA

SEQ ID NO: 471430 - protein, 9 aa, Influenza virus
GWITIGISG

SEQ ID NO: 471431 - protein, 9 aa, Influenza virus
GWIVGNPAC

SEQ ID NO: 471432 - protein, 9 aa, Influenza virus
GWIVGNPSC

SEQ ID NO: 471433 - protein, 9 aa, Influenza virus
GWLIGNPKC

SEQ ID NO: 471434 - protein, 9 aa, Influenza virus
GWLLGNPAC

SEQ ID NO: 471435 - protein, 9 aa, Influenza virus
GWLLGNPEC

SEQ ID NO: 471436 - protein, 9 aa, Influenza virus
GWLLGNPGC

SEQ ID NO: 471437 - protein, 9 aa, Influenza virus
GWLLGNPKC

SEQ ID NO: 471438 - protein, 9 aa, Influenza virus
GWLLGNPLC

SEQ ID NO: 471439 - protein, 9 aa, Influenza virus
GWLLGNPMC

SEQ ID NO: 471440 - protein, 9 aa, Influenza virus
GWLTIGISG

SEQ ID NO: 471441 - protein, 9 aa, Influenza virus
GWLTIGITG

SEQ ID NO: 471442 - protein, 9 aa, Influenza virus
GWLTLGITG

SEQ ID NO: 471443 - protein, 9 aa, Influenza virus
GWMDYYWGI

SEQ ID NO: 471444 - protein, 9 aa, Influenza virus
GWPGLINGW

SEQ ID NO: 471445 - protein, 9 aa, Influenza virus
GWPGLVAGW

SEQ ID NO: 471446 - protein, 9 aa, Influenza virus
GWPWPDGAL

SEQ ID NO: 471447 - protein, 9 aa, Influenza virus
GWQGLIDGW

SEQ ID NO: 471448 - protein, 9 aa, Influenza virus
GWQGLVDGW

SEQ ID NO: 471449 - protein, 9 aa, Influenza virus
GWQGMIDGW

SEQ ID NO: 471450 - protein, 9 aa, Influenza virus
GWQGMVDGW

SEQ ID NO: 471451 - protein, 9 aa, Influenza virus
GWSATACHD

SEQ ID NO: 471452 - protein, 9 aa, Influenza virus
GWSGLIAGW

SEQ ID NO: 471453 - protein, 9 aa, Influenza virus
GWSGLVAGW

SEQ ID NO: 471454 - protein, 9 aa, Influenza virus
GWSGMIDGW

SEQ ID NO: 471455 - protein, 9 aa, Influenza virus
GWSSTSCHD

SEQ ID NO: 471456 - protein, 9 aa, Influenza virus
GWSSTTCHD

SEQ ID NO: 471457 - protein, 9 aa, Influenza virus
GWSWDDGAI

SEQ ID NO: 471458 - protein, 9 aa, Influenza virus
GWSWPDDAE

SEQ ID NO: 471459 - protein, 9 aa, Influenza virus
GWSWPDGAE

SEQ ID NO: 471460 - protein, 9 aa, Influenza virus
GWSWPDGAK

SEQ ID NO: 471461 - protein, 9 aa, Influenza virus
GWSWPDGAL

SEQ ID NO: 471462 - protein, 9 aa, Influenza virus
GWSYIVERP

SEQ ID NO: 471463 - protein, 9 aa, Influenza virus
GWTGLIDGW

SEQ ID NO: 471464 - protein, 9 aa, Influenza virus
GWTGMIDGW

SEQ ID NO: 471465 - protein, 9 aa, Influenza virus
GWTGMVDGW

SEQ ID NO: 471466 - protein, 9 aa, Influenza virus
GWTGMVNGW

SEQ ID NO: 471467 - protein, 9 aa, Influenza virus
GWTIANSKS

SEQ ID NO: 471468 - protein, 9 aa, Influenza virus
GWTSNSIVV

SEQ ID NO: 471469 - protein, 9 aa, Influenza virus
GWTTANSKS

SEQ ID NO: 471470 - protein, 9 aa, Influenza virus
GWVAVAKDN

SEQ ID NO: 471471 - protein, 9 aa, Influenza virus
GWVSTDKDS

SEQ ID NO: 471472 - protein, 9 aa, Influenza virus
GWVSTDKNS

SEQ ID NO: 471473 - protein, 9 aa, Influenza virus
GWVTADKDS

SEQ ID NO: 471474 - protein, 9 aa, Influenza virus
GWVVIAKDN

SEQ ID NO: 471475 - protein, 9 aa, Influenza virus
GWVVIAQDN

SEQ ID NO: 471476 - protein, 9 aa, Influenza virus
GWVVIEKDN

SEQ ID NO: 471477 - protein, 9 aa, Influenza virus
GWVVVAKDN

SEQ ID NO: 471478 - protein, 9 aa, Influenza virus
GWYGFHHSN

SEQ ID NO: 471479 - protein, 9 aa, Influenza virus
GWYGFKHQN

SEQ ID NO: 471480 - protein, 9 aa, Influenza virus
GWYGFQHQN

SEQ ID NO: 471481 - protein, 9 aa, Influenza virus
GWYGFQHRN

SEQ ID NO: 471482 - protein, 9 aa, Influenza virus
GWYGFQHSN

SEQ ID NO: 471483 - protein, 9 aa, Influenza virus
GWYGFRHHN

SEQ ID NO: 471484 - protein, 9 aa, Influenza virus
GWYGFRHQK

SEQ ID NO: 471485 - protein, 9 aa, Influenza virus
GWYGFRHQN

SEQ ID NO: 471486 - protein, 9 aa, Influenza virus
GWYGFRYQN

SEQ ID NO: 471487 - protein, 9 aa, Influenza virus
GWYGYHHEN

SEQ ID NO: 471488 - protein, 9 aa, Influenza virus
GWYGYHHIN

SEQ ID NO: 471489 - protein, 9 aa, Influenza virus
GWYGYHHNN

SEQ ID NO: 471490 - protein, 9 aa, Influenza virus
GWYGYHHQN

SEQ ID NO: 471491 - protein, 9 aa, Influenza virus
GWYGYHHSN

SEQ ID NO: 471492 - protein, 9 aa, Influenza virus
GWYGYHHTN

SEQ ID NO: 471493 - protein, 9 aa, Influenza virus
GWYGYKHQN

SEQ ID NO: 471494 - protein, 9 aa, Influenza virus
GWYGYRHQN

SEQ ID NO: 471495 - protein, 9 aa, Influenza virus
GYAADKAST

SEQ ID NO: 471496 - protein, 9 aa, Influenza virus
GYAADKDST

SEQ ID NO: 471497 - protein, 9 aa, Influenza virus
GYAADKEST

SEQ ID NO: 471498 - protein, 9 aa, Influenza virus
GYAADKKST

SEQ ID NO: 471499 - protein, 9 aa, Influenza virus
GYAADLKST

SEQ ID NO: 471500 - protein, 9 aa, Influenza virus
GYAADQEST

SEQ ID NO: 471501 - protein, 9 aa, Influenza virus
GYAADQKST

SEQ ID NO: 471502 - protein, 9 aa, Influenza virus
GYAADREST

SEQ ID NO: 471503 - protein, 9 aa, Influenza virus
GYAADRKST

SEQ ID NO: 471504 - protein, 9 aa, Influenza virus
GYAQTDCVL

SEQ ID NO: 471505 - protein, 9 aa, Influenza virus
GYCFTVMTD

SEQ ID NO: 471506 - protein, 9 aa, Influenza virus
GYDFEKEGY

SEQ ID NO: 471507 - protein, 9 aa, Influenza virus
GYDFEREGY

SEQ ID NO: 471508 - protein, 9 aa, Influenza virus
GYEEFTIVG

SEQ ID NO: 471509 - protein, 9 aa, Influenza virus
GYEEFTLVG

SEQ ID NO: 471510 - protein, 9 aa, Influenza virus
GYEEFTMVG

SEQ ID NO: 471511 - protein, 9 aa, Influenza virus
GYEILKVPN

SEQ ID NO: 471512 - protein, 9 aa, Influenza virus
GYEKNATAS

SEQ ID NO: 471513 - protein, 9 aa, Influenza virus
GYEMLKVPD

SEQ ID NO: 471514 - protein, 9 aa, Influenza virus
GYEMLKVPN

SEQ ID NO: 471515 - protein, 9 aa, Influenza virus
GYETFKVIG

SEQ ID NO: 471516 - protein, 9 aa, Influenza virus
GYETFRVID

SEQ ID NO: 471517 - protein, 9 aa, Influenza virus
GYETFRVIG

SEQ ID NO: 471518 - protein, 9 aa, Influenza virus
GYETFRVIS

SEQ ID NO: 471519 - protein, 9 aa, Influenza virus
GYEVLKVPD

SEQ ID NO: 471520 - protein, 9 aa, Influenza virus
GYEVLKVPN

SEQ ID NO: 471521 - protein, 9 aa, Influenza virus
GYFGIFFVE

SEQ ID NO: 471522 - protein, 9 aa, Influenza virus
GYFGVFSVE

SEQ ID NO: 471523 - protein, 9 aa, Influenza virus
GYGVKGFGF

SEQ ID NO: 471524 - protein, 9 aa, Influenza virus
GYHANNSKK

SEQ ID NO: 471525 - protein, 9 aa, Influenza virus
GYHANNSTD

SEQ ID NO: 471526 - protein, 9 aa, Influenza virus
GYHANNSTE

SEQ ID NO: 471527 - protein, 9 aa, Influenza virus
GYHANNSTK

SEQ ID NO: 471528 - protein, 9 aa, Influenza virus
GYHANNSTT

SEQ ID NO: 471529 - protein, 9 aa, Influenza virus
GYHANNSTV

SEQ ID NO: 471530 - protein, 9 aa, Influenza virus
GYHFEECSC

SEQ ID NO: 471531 - protein, 9 aa, Influenza virus
GYHHENSQG

SEQ ID NO: 471532 - protein, 9 aa, Influenza virus
GYHHNNEQG

SEQ ID NO: 471533 - protein, 9 aa, Influenza virus
GYHHQNEQG

SEQ ID NO: 471534 - protein, 9 aa, Influenza virus
GYHHQNGQG

SEQ ID NO: 471535 - protein, 9 aa, Influenza virus
GYHHSKEQG

SEQ ID NO: 471536 - protein, 9 aa, Influenza virus
GYHHSNDQG

SEQ ID NO: 471537 - protein, 9 aa, Influenza virus
GYHHSNEQG

SEQ ID NO: 471538 - protein, 9 aa, Influenza virus
GYHHSNGQG

SEQ ID NO: 471539 - protein, 9 aa, Influenza virus
GYHSNNSTE

SEQ ID NO: 471540 - protein, 9 aa, Influenza virus
GYICSGFFG

SEQ ID NO: 471541 - protein, 9 aa, Influenza virus
GYICSGIFG

SEQ ID NO: 471542 - protein, 9 aa, Influenza virus
GYICSGVFG

SEQ ID NO: 471543 - protein, 9 aa, Influenza virus
GYICSKFHS

SEQ ID NO: 471544 - protein, 9 aa, Influenza virus
GYIEGKLSQ

SEQ ID NO: 471545 - protein, 9 aa, Influenza virus
GYIIEEYGK

SEQ ID NO: 471546 - protein, 9 aa, Influenza virus
GYIIEEYGR

SEQ ID NO: 471547 - protein, 9 aa, Influenza virus
GYIIEKYGS

SEQ ID NO: 471548 - protein, 9 aa, Influenza virus
GYIIEKYGT

SEQ ID NO: 471549 - protein, 9 aa, Influenza virus
GYKDIILWF

SEQ ID NO: 471550 - protein, 9 aa, Influenza virus
GYKDIILWI

SEQ ID NO: 471551 - protein, 9 aa, Influenza virus
GYKDIILWV

SEQ ID NO: 471552 - protein, 9 aa, Influenza virus
GYKDVILWF

SEQ ID NO: 471553 - protein, 9 aa, Influenza virus
GYKDWFLWI

SEQ ID NO: 471554 - protein, 9 aa, Influenza virus
GYKDWILWI

SEQ ID NO: 471555 - protein, 9 aa, Influenza virus
GYKDWVLWI

SEQ ID NO: 471556 - protein, 9 aa, Influenza virus
GYKEIILWF

SEQ ID NO: 471557 - protein, 9 aa, Influenza virus
GYKEVILWF

SEQ ID NO: 471558 - protein, 9 aa, Influenza virus
GYKHQNAQG

SEQ ID NO: 471559 - protein, 9 aa, Influenza virus
GYKMNIQIL

SEQ ID NO: 471560 - protein, 9 aa, Influenza virus
GYKMNNQIL

SEQ ID NO: 471561 - protein, 9 aa, Influenza virus
GYKMNTKIL

SEQ ID NO: 471562 - protein, 9 aa, Influenza virus
GYKMNTQIL

SEQ ID NO: 471563 - protein, 9 aa, Influenza virus
GYKMNTRIL

SEQ ID NO: 471564 - protein, 9 aa, Influenza virus
GYKNWILWI

SEQ ID NO: 471565 - protein, 9 aa, Influenza virus
GYLCAGIPS

SEQ ID NO: 471566 - protein, 9 aa, Influenza virus
GYLCAGIPT

SEQ ID NO: 471567 - protein, 9 aa, Influenza virus
GYLCAGLPS

SEQ ID NO: 471568 - protein, 9 aa, Influenza virus
GYLIRALTL

SEQ ID NO: 471569 - protein, 9 aa, Influenza virus
GYLITGKSH

SEQ ID NO: 471570 - protein, 9 aa, Influenza virus
GYLLKGESH

SEQ ID NO: 471571 - protein, 9 aa, Influenza virus
GYLLKGESY

SEQ ID NO: 471572 - protein, 9 aa, Influenza virus
GYLLLNKSL

SEQ ID NO: 471573 - protein, 9 aa, Influenza virus
GYLLRGESH

SEQ ID NO: 471574 - protein, 9 aa, Influenza virus
GYLSNNATD

SEQ ID NO: 471575 - protein, 9 aa, Influenza virus
GYLSNNSSD

SEQ ID NO: 471576 - protein, 9 aa, Influenza virus
GYLSNNSTD

SEQ ID NO: 471577 - protein, 9 aa, Influenza virus
GYLSNNSTE

SEQ ID NO: 471578 - protein, 9 aa, Influenza virus
GYLSTNSSD

SEQ ID NO: 471579 - protein, 9 aa, Influenza virus
GYLSTNSSE

SEQ ID NO: 471580 - protein, 9 aa, Influenza virus
GYLSTNSTE

SEQ ID NO: 471581 - protein, 9 aa, Influenza virus
GYMFESKKM

SEQ ID NO: 471582 - protein, 9 aa, Influenza virus
GYMFESKNM

SEQ ID NO: 471583 - protein, 9 aa, Influenza virus
GYMFESKRM

SEQ ID NO: 471584 - protein, 9 aa, Influenza virus
GYMFESKSM

SEQ ID NO: 471585 - protein, 9 aa, Influenza virus
GYMSNNSTE

SEQ ID NO: 471586 - protein, 9 aa, Influenza virus
GYNFEKEGY

SEQ ID NO: 471587 - protein, 9 aa, Influenza virus
GYNGQKSWM

SEQ ID NO: 471588 - protein, 9 aa, Influenza virus
GYNGQKSWT

SEQ ID NO: 471589 - protein, 9 aa, Influenza virus
GYNGQRSWM

SEQ ID NO: 471590 - protein, 9 aa, Influenza virus
GYPGVKGWA

SEQ ID NO: 471591 - protein, 9 aa, Influenza virus
GYQSLRSIL

SEQ ID NO: 471592 - protein, 9 aa, Influenza virus
GYQSNNSTD

SEQ ID NO: 471593 - protein, 9 aa, Influenza virus
GYQSNNSTN

SEQ ID NO: 471594 - protein, 9 aa, Influenza virus
GYQSTNSTE

SEQ ID NO: 471595 - protein, 9 aa, Influenza virus
GYQTNNSTD

SEQ ID NO: 471596 - protein, 9 aa, Influenza virus
GYQTNNSTE

SEQ ID NO: 471597 - protein, 9 aa, Influenza virus
GYRHQNAQG

SEQ ID NO: 471598 - protein, 9 aa, Influenza virus
GYSGAFIDY

SEQ ID NO: 471599 - protein, 9 aa, Influenza virus
GYSGAFMDY

SEQ ID NO: 471600 - protein, 9 aa, Influenza virus
GYSGAFTIP

SEQ ID NO: 471601 - protein, 9 aa, Influenza virus
GYSGAFTVP

SEQ ID NO: 471602 - protein, 9 aa, Influenza virus
GYSGAFVDY

SEQ ID NO: 471603 - protein, 9 aa, Influenza virus
GYSGIFSIE

SEQ ID NO: 471604 - protein, 9 aa, Influenza virus
GYSGIFSVE

SEQ ID NO: 471605 - protein, 9 aa, Influenza virus
GYSGSFIDY

SEQ ID NO: 471606 - protein, 9 aa, Influenza virus
GYSGSFIQH

SEQ ID NO: 471607 - protein, 9 aa, Influenza virus
GYSGSFMDY

SEQ ID NO: 471608 - protein, 9 aa, Influenza virus
GYSGSFSIR

SEQ ID NO: 471609 - protein, 9 aa, Influenza virus
GYSGSFTIP

SEQ ID NO: 471610 - protein, 9 aa, Influenza virus
GYSGSFTLP

SEQ ID NO: 471611 - protein, 9 aa, Influenza virus
GYSGSFVDY

SEQ ID NO: 471612 - protein, 9 aa, Influenza virus
GYSGSFVQH

SEQ ID NO: 471613 - protein, 9 aa, Influenza virus
GYSGVFSVE

SEQ ID NO: 471614 - protein, 9 aa, Influenza virus
GYSLVGIDP

SEQ ID NO: 471615 - protein, 9 aa, Influenza virus
GYSLVGVDP

SEQ ID NO: 471616 - protein, 9 aa, Influenza virus
GYSTGALAS

SEQ ID NO: 471617 - protein, 9 aa, Influenza virus
GYTMDTVNR

SEQ ID NO: 471618 - protein, 9 aa, Influenza virus
GYTMDTVSR

SEQ ID NO: 471619 - protein, 9 aa, Influenza virus
GYVCSGIFG

SEQ ID NO: 471620 - protein, 9 aa, Influenza virus
GYVCSGLVG

SEQ ID NO: 471621 - protein, 9 aa, Influenza virus
GYVCSGVFG

SEQ ID NO: 471622 - protein, 9 aa, Influenza virus
GYVCSKFHS

SEQ ID NO: 471623 - protein, 9 aa, Influenza virus
GYWAIRTRS

SEQ ID NO: 471624 - protein, 9 aa, Influenza virus
HAKDILEKA

SEQ ID NO: 471625 - protein, 9 aa, Influenza virus
HAKDILEKT

SEQ ID NO: 471626 - protein, 9 aa, Influenza virus
HAKNILEKT

SEQ ID NO: 471627 - protein, 9 aa, Influenza virus
HALKLVVAM

SEQ ID NO: 471628 - protein, 9 aa, Influenza virus
HALRELWQC

SEQ ID NO: 471629 - protein, 9 aa, Influenza virus
HANGTIHDR

SEQ ID NO: 471630 - protein, 9 aa, Influenza virus
HANGTINDR

SEQ ID NO: 471631 - protein, 9 aa, Influenza virus
HANGTMHDR

SEQ ID NO: 471632 - protein, 9 aa, Influenza virus
HANNSKKQI

SEQ ID NO: 471633 - protein, 9 aa, Influenza virus
HANNSTDTI

SEQ ID NO: 471634 - protein, 9 aa, Influenza virus
HANNSTDTV

SEQ ID NO: 471635 - protein, 9 aa, Influenza virus
HANNSTEHV

SEQ ID NO: 471636 - protein, 9 aa, Influenza virus
HANNSTEQV

SEQ ID NO: 471637 - protein, 9 aa, Influenza virus
HANNSTERV

SEQ ID NO: 471638 - protein, 9 aa, Influenza virus
HANNSTETV

SEQ ID NO: 471639 - protein, 9 aa, Influenza virus
HANNSTKQI

SEQ ID NO: 471640 - protein, 9 aa, Influenza virus
HANNSTKQV

SEQ ID NO: 471641 - protein, 9 aa, Influenza virus
HANNSTTKV

SEQ ID NO: 471642 - protein, 9 aa, Influenza virus
HANNSTTQI

SEQ ID NO: 471643 - protein, 9 aa, Influenza virus
HANNSTTQV

SEQ ID NO: 471644 - protein, 9 aa, Influenza virus
HANNSTVQV

SEQ ID NO: 471645 - protein, 9 aa, Influenza virus
HAQDILEKT

SEQ ID NO: 471646 - protein, 9 aa, Influenza virus
HAQNILEKT

SEQ ID NO: 471647 - protein, 9 aa, Influenza virus
HAQYREEAL

SEQ ID NO: 471648 - protein, 9 aa, Influenza virus
HASNRPWIS

SEQ ID NO: 471649 - protein, 9 aa, Influenza virus
HASNRPWVS

SEQ ID NO: 471650 - protein, 9 aa, Influenza virus
HAVANGTKV

SEQ ID NO: 471651 - protein, 9 aa, Influenza virus
HAVANGTRV

SEQ ID NO: 471652 - protein, 9 aa, Influenza virus
HAVENGTSV

SEQ ID NO: 471653 - protein, 9 aa, Influenza virus
HAVPNGTIV

SEQ ID NO: 471654 - protein, 9 aa, Influenza virus
HAVPNGTKV

SEQ ID NO: 471655 - protein, 9 aa, Influenza virus
HAVPNGTLV

SEQ ID NO: 471656 - protein, 9 aa, Influenza virus
HAVPNGTVV

SEQ ID NO: 471657 - protein, 9 aa, Influenza virus
HAVSNGTKV

SEQ ID NO: 471658 - protein, 9 aa, Influenza virus
HAVTNGTKV

SEQ ID NO: 471659 - protein, 9 aa, Influenza virus
HAYISFRNL

SEQ ID NO: 471660 - protein, 9 aa, Influenza virus
HCINRCFYV

SEQ ID NO: 471661 - protein, 9 aa, Influenza virus
HCMESIRNN

SEQ ID NO: 471662 - protein, 9 aa, Influenza virus
HCRATEYIM

SEQ ID NO: 471663 - protein, 9 aa, Influenza virus
HCRATEYMM

SEQ ID NO: 471664 - protein, 9 aa, Influenza virus
HCRIIQNED

SEQ ID NO: 471665 - protein, 9 aa, Influenza virus
HCSKYHWNL

SEQ ID NO: 471666 - protein, 9 aa, Influenza virus
HCWSFALAQ

SEQ ID NO: 471667 - protein, 9 aa, Influenza virus
HCYPGATIN

SEQ ID NO: 471668 - protein, 9 aa, Influenza virus
HDANVKNLH

SEQ ID NO: 471669 - protein, 9 aa, Influenza virus
HDANVRNLH

SEQ ID NO: 471670 - protein, 9 aa, Influenza virus
HDFEREGYS

SEQ ID NO: 471671 - protein, 9 aa, Influenza virus
HDGAEIIYF

SEQ ID NO: 471672 - protein, 9 aa, Influenza virus
HDGAEITYF

SEQ ID NO: 471673 - protein, 9 aa, Influenza virus
HDGASWLTI

SEQ ID NO: 471674 - protein, 9 aa, Influenza virus
HDGIARMTI

SEQ ID NO: 471675 - protein, 9 aa, Influenza virus
HDGIGRMTI

SEQ ID NO: 471676 - protein, 9 aa, Influenza virus
HDGISWLTI

SEQ ID NO: 471677 - protein, 9 aa, Influenza virus
HDGKAWLHI

SEQ ID NO: 471678 - protein, 9 aa, Influenza virus
HDGKAWLHV

SEQ ID NO: 471679 - protein, 9 aa, Influenza virus
HDGKSWLHV

SEQ ID NO: 471680 - protein, 9 aa, Influenza virus
HDGNAWLHV

SEQ ID NO: 471681 - protein, 9 aa, Influenza virus
HDGRAWLHI

SEQ ID NO: 471682 - protein, 9 aa, Influenza virus
HDGRAWLHV

SEQ ID NO: 471683 - protein, 9 aa, Influenza virus
HDGSSWLTI

SEQ ID NO: 471684 - protein, 9 aa, Influenza virus
HDGTNWLTI

SEQ ID NO: 471685 - protein, 9 aa, Influenza virus
HDGTSWLTI

SEQ ID NO: 471686 - protein, 9 aa, Influenza virus
HDGVGRMTI

SEQ ID NO: 471687 - protein, 9 aa, Influenza virus
HDGVNRMTI

SEQ ID NO: 471688 - protein, 9 aa, Influenza virus
HDGVSRMTI

SEQ ID NO: 471689 - protein, 9 aa, Influenza virus
HDIYRDEAI

SEQ ID NO: 471690 - protein, 9 aa, Influenza virus
HDIYRNEAI

SEQ ID NO: 471691 - protein, 9 aa, Influenza virus
HDRAAFRGL

SEQ ID NO: 471692 - protein, 9 aa, Influenza virus
HDRICIGYQ

SEQ ID NO: 471693 - protein, 9 aa, Influenza virus
HDRIPHRTL

SEQ ID NO: 471694 - protein, 9 aa, Influenza virus
HDRISHRTL

SEQ ID NO: 471695 - protein, 9 aa, Influenza virus
HDRNAFRGL

SEQ ID NO: 471696 - protein, 9 aa, Influenza virus
HDRSPFRAL

SEQ ID NO: 471697 - protein, 9 aa, Influenza virus
HDRSPHRTL

SEQ ID NO: 471698 - protein, 9 aa, Influenza virus
HDRSPYRAL

SEQ ID NO: 471699 - protein, 9 aa, Influenza virus
HDRSQFRAL

SEQ ID NO: 471700 - protein, 9 aa, Influenza virus
HDRSQYRAL

SEQ ID NO: 471701 - protein, 9 aa, Influenza virus
HDRSQYRSL

SEQ ID NO: 471702 - protein, 9 aa, Influenza virus
HDRTAFRGL

SEQ ID NO: 471703 - protein, 9 aa, Influenza virus
HDRTPHRTL

SEQ ID NO: 471704 - protein, 9 aa, Influenza virus
HDRTSHRTL

SEQ ID NO: 471705 - protein, 9 aa, Influenza virus
HDRTTFRGL

SEQ ID NO: 471706 - protein, 9 aa, Influenza virus
HDSNVENLF

SEQ ID NO: 471707 - protein, 9 aa, Influenza virus
HDSNVKNLF

SEQ ID NO: 471708 - protein, 9 aa, Influenza virus
HDSNVKNLH

SEQ ID NO: 471709 - protein, 9 aa, Influenza virus
HDSNVKNLY

SEQ ID NO: 471710 - protein, 9 aa, Influenza virus
HDSNVKSLY

SEQ ID NO: 471711 - protein, 9 aa, Influenza virus
HDSNVRNLH

SEQ ID NO: 471712 - protein, 9 aa, Influenza virus
HDSNVRNLY

SEQ ID NO: 471713 - protein, 9 aa, Influenza virus
HDSNVRSLH

SEQ ID NO: 471714 - protein, 9 aa, Influenza virus
HDVYRDEAI

SEQ ID NO: 471715 - protein, 9 aa, Influenza virus
HECRTFFLT

SEQ ID NO: 471716 - protein, 9 aa, Influenza virus
HEDYKEESQ

SEQ ID NO: 471717 - protein, 9 aa, Influenza virus
HEDYREESQ

SEQ ID NO: 471718 - protein, 9 aa, Influenza virus
HEEVTNATE

SEQ ID NO: 471719 - protein, 9 aa, Influenza virus
HEFSNLEKR

SEQ ID NO: 471720 - protein, 9 aa, Influenza virus
HEFSNLERR

SEQ ID NO: 471721 - protein, 9 aa, Influenza virus
HEFSSLERR

SEQ ID NO: 471722 - protein, 9 aa, Influenza virus
HEGEGIPLH

SEQ ID NO: 471723 - protein, 9 aa, Influenza virus
HEGEGIPLY

SEQ ID NO: 471724 - protein, 9 aa, Influenza virus
HEGRLIQNS

SEQ ID NO: 471725 - protein, 9 aa, Influenza virus
HENRMVIAS

SEQ ID NO: 471726 - protein, 9 aa, Influenza virus
HENRMVLAS

SEQ ID NO: 471727 - protein, 9 aa, Influenza virus
HENSQGSGY

SEQ ID NO: 471728 - protein, 9 aa, Influenza virus
HEQMETGGE

SEQ ID NO: 471729 - protein, 9 aa, Influenza virus
HERVRKQLR

SEQ ID NO: 471730 - protein, 9 aa, Influenza virus
HFEECSCYP

SEQ ID NO: 471731 - protein, 9 aa, Influenza virus
HFEKIKILP

SEQ ID NO: 471732 - protein, 9 aa, Influenza virus
HFEKVKILA

SEQ ID NO: 471733 - protein, 9 aa, Influenza virus
HFEKVKILP

SEQ ID NO: 471734 - protein, 9 aa, Influenza virus
HFEKVRILP

SEQ ID NO: 471735 - protein, 9 aa, Influenza virus
HFESNGNFI

SEQ ID NO: 471736 - protein, 9 aa, Influenza virus
HFQKDAKIL

SEQ ID NO: 471737 - protein, 9 aa, Influenza virus
HFQKDAKML

SEQ ID NO: 471738 - protein, 9 aa, Influenza virus
HFQKDAKVL

SEQ ID NO: 471739 - protein, 9 aa, Influenza virus
HFQKDARVL

SEQ ID NO: 471740 - protein, 9 aa, Influenza virus
HFQKNAKVL

SEQ ID NO: 471741 - protein, 9 aa, Influenza virus
HFQNQVKIR

SEQ ID NO: 471742 - protein, 9 aa, Influenza virus
HFQRKRRIR

SEQ ID NO: 471743 - protein, 9 aa, Influenza virus
HFQRKRRVR

SEQ ID NO: 471744 - protein, 9 aa, Influenza virus
HFRNQIKIR

SEQ ID NO: 471745 - protein, 9 aa, Influenza virus
HFRNQVKIR

SEQ ID NO: 471746 - protein, 9 aa, Influenza virus
HFRSQVKIR

SEQ ID NO: 471747 - protein, 9 aa, Influenza virus
HFVNIELED

SEQ ID NO: 471748 - protein, 9 aa, Influenza virus
HFVSIELEG

SEQ ID NO: 471749 - protein, 9 aa, Influenza virus
HGALLNDKH

SEQ ID NO: 471750 - protein, 9 aa, Influenza virus
HGANRPWVS

SEQ ID NO: 471751 - protein, 9 aa, Influenza virus
HGICAVATT

SEQ ID NO: 471752 - protein, 9 aa, Influenza virus
HGKIIQNED

SEQ ID NO: 471753 - protein, 9 aa, Influenza virus
HGLCYPGEL

SEQ ID NO: 471754 - protein, 9 aa, Influenza virus
HGRIIQNED

SEQ ID NO: 471755 - protein, 9 aa, Influenza virus
HGRILKNDL

SEQ ID NO: 471756 - protein, 9 aa, Influenza virus
HGRILKNNL

SEQ ID NO: 471757 - protein, 9 aa, Influenza virus
HGRTIQNED

SEQ ID NO: 471758 - protein, 9 aa, Influenza virus
HGRVLKNNL

SEQ ID NO: 471759 - protein, 9 aa, Influenza virus
HGSGYAADK

SEQ ID NO: 471760 - protein, 9 aa, Influenza virus
HGSLLNDKH

SEQ ID NO: 471761 - protein, 9 aa, Influenza virus
HGSLQCRIC

SEQ ID NO: 471762 - protein, 9 aa, Influenza virus
HGSLVLSLW

SEQ ID NO: 471763 - protein, 9 aa, Influenza virus
HGSNRPWIS

SEQ ID NO: 471764 - protein, 9 aa, Influenza virus
HGSNRPWLS

SEQ ID NO: 471765 - protein, 9 aa, Influenza virus
HGSNRPWVS

SEQ ID NO: 471766 - protein, 9 aa, Influenza virus
HGTGTGYTM

SEQ ID NO: 471767 - protein, 9 aa, Influenza virus
HGVKGWAFD

SEQ ID NO: 471768 - protein, 9 aa, Influenza virus
HHANNSTEQ

SEQ ID NO: 471769 - protein, 9 aa, Influenza virus
HHAVANGTI

SEQ ID NO: 471770 - protein, 9 aa, Influenza virus
HHAVANGTK

SEQ ID NO: 471771 - protein, 9 aa, Influenza virus
HHAVANGTR

SEQ ID NO: 471772 - protein, 9 aa, Influenza virus
HHAVANGTV

SEQ ID NO: 471773 - protein, 9 aa, Influenza virus
HHAVENGTS

SEQ ID NO: 471774 - protein, 9 aa, Influenza virus
HHAVPNGTI

SEQ ID NO: 471775 - protein, 9 aa, Influenza virus
HHAVPNGTK

SEQ ID NO: 471776 - protein, 9 aa, Influenza virus
HHAVPNGTL

SEQ ID NO: 471777 - protein, 9 aa, Influenza virus
HHAVPNGTV

SEQ ID NO: 471778 - protein, 9 aa, Influenza virus
HHAVSNGTI

SEQ ID NO: 471779 - protein, 9 aa, Influenza virus
HHAVSNGTK

SEQ ID NO: 471780 - protein, 9 aa, Influenza virus
HHAVTNGTI

SEQ ID NO: 471781 - protein, 9 aa, Influenza virus
HHAVTNGTK

SEQ ID NO: 471782 - protein, 9 aa, Influenza virus
HHENSQGSG

SEQ ID NO: 471783 - protein, 9 aa, Influenza virus
HHMGECPKY

SEQ ID NO: 471784 - protein, 9 aa, Influenza virus
HHMRKKRGL

SEQ ID NO: 471785 - protein, 9 aa, Influenza virus
HHNNEQGSG

SEQ ID NO: 471786 - protein, 9 aa, Influenza virus
HHNSEGTGQ

SEQ ID NO: 471787 - protein, 9 aa, Influenza virus
HHPDSETTA

SEQ ID NO: 471788 - protein, 9 aa, Influenza virus
HHPDTEATA

SEQ ID NO: 471789 - protein, 9 aa, Influenza virus
HHPDTEAVA

SEQ ID NO: 471790 - protein, 9 aa, Influenza virus
HHPDTEEVA

SEQ ID NO: 471791 - protein, 9 aa, Influenza virus
HHPDTETTA

SEQ ID NO: 471792 - protein, 9 aa, Influenza virus
HHPPDAKEQ

SEQ ID NO: 471793 - protein, 9 aa, Influenza virus
HHPPDETEQ

SEQ ID NO: 471794 - protein, 9 aa, Influenza virus
HHPPDTKEQ

SEQ ID NO: 471795 - protein, 9 aa, Influenza virus
HHPPNTKEQ

SEQ ID NO: 471796 - protein, 9 aa, Influenza virus
HHPPTSAEQ

SEQ ID NO: 471797 - protein, 9 aa, Influenza virus
HHPPTSDEQ

SEQ ID NO: 471798 - protein, 9 aa, Influenza virus
HHPPTSNEQ

SEQ ID NO: 471799 - protein, 9 aa, Influenza virus
HHPPTTDEQ

SEQ ID NO: 471800 - protein, 9 aa, Influenza virus
HHPSSAQEK

SEQ ID NO: 471801 - protein, 9 aa, Influenza virus
HHPSSDNEQ

SEQ ID NO: 471802 - protein, 9 aa, Influenza virus
HHPSSTKEK

SEQ ID NO: 471803 - protein, 9 aa, Influenza virus
HHPSSTQEK

SEQ ID NO: 471804 - protein, 9 aa, Influenza virus
HHPSTDAEQ

SEQ ID NO: 471805 - protein, 9 aa, Influenza virus
HHPSTDKEQ

SEQ ID NO: 471806 - protein, 9 aa, Influenza virus
HHPSTDTEQ

SEQ ID NO: 471807 - protein, 9 aa, Influenza virus
HHQNAQGSG

SEQ ID NO: 471808 - protein, 9 aa, Influenza virus
HHQNEQGSG

SEQ ID NO: 471809 - protein, 9 aa, Influenza virus
HHQNGQGSG

SEQ ID NO: 471810 - protein, 9 aa, Influenza virus
HHRSHRQMA

SEQ ID NO: 471811 - protein, 9 aa, Influenza virus
HHSKEQGSG

SEQ ID NO: 471812 - protein, 9 aa, Influenza virus
HHSNAEGTG

SEQ ID NO: 471813 - protein, 9 aa, Influenza virus
HHSNDQGAG

SEQ ID NO: 471814 - protein, 9 aa, Influenza virus
HHSNDQGSG

SEQ ID NO: 471815 - protein, 9 aa, Influenza virus
HHSNEQGSG

SEQ ID NO: 471816 - protein, 9 aa, Influenza virus
HHSNGQGSG

SEQ ID NO: 471817 - protein, 9 aa, Influenza virus
HHSNSEGTG

SEQ ID NO: 471818 - protein, 9 aa, Influenza virus
HHSSSLDEQ

SEQ ID NO: 471819 - protein, 9 aa, Influenza virus
HIAILVTTV

SEQ ID NO: 471820 - protein, 9 aa, Influenza virus
HICIGYHAN

SEQ ID NO: 471821 - protein, 9 aa, Influenza virus
HICVTGDDR

SEQ ID NO: 471822 - protein, 9 aa, Influenza virus
HIEECPCYG

SEQ ID NO: 471823 - protein, 9 aa, Influenza virus
HIEECSCYG

SEQ ID NO: 471824 - protein, 9 aa, Influenza virus
HIEECSCYP

SEQ ID NO: 471825 - protein, 9 aa, Influenza virus
HIEEWSCYG

SEQ ID NO: 471826 - protein, 9 aa, Influenza virus
HIEVTNATE

SEQ ID NO: 471827 - protein, 9 aa, Influenza virus
HIFGKDNAI

SEQ ID NO: 471828 - protein, 9 aa, Influenza virus
HIFGKDNAV

SEQ ID NO: 471829 - protein, 9 aa, Influenza virus
HIFSFNGEE

SEQ ID NO: 471830 - protein, 9 aa, Influenza virus
HIFSFTGEE

SEQ ID NO: 471831 - protein, 9 aa, Influenza virus
HIFSKDNAI

SEQ ID NO: 471832 - protein, 9 aa, Influenza virus
HIFVIREPF

SEQ ID NO: 471833 - protein, 9 aa, Influenza virus
HIGPLSGSA

SEQ ID NO: 471834 - protein, 9 aa, Influenza virus
HIHIFSFNG

SEQ ID NO: 471835 - protein, 9 aa, Influenza virus
HIHIFSFTG

SEQ ID NO: 471836 - protein, 9 aa, Influenza virus
HIIDLADSE

SEQ ID NO: 471837 - protein, 9 aa, Influenza virus
HIIDVTDSE

SEQ ID NO: 471838 - protein, 9 aa, Influenza virus
HIIMWGIHH

SEQ ID NO: 471839 - protein, 9 aa, Influenza virus
HILSKDNAI

SEQ ID NO: 471840 - protein, 9 aa, Influenza virus
HILSKDNAV

SEQ ID NO: 471841 - protein, 9 aa, Influenza virus
HILVTREPY

SEQ ID NO: 471842 - protein, 9 aa, Influenza virus
HIMIWHSNL

SEQ ID NO: 471843 - protein, 9 aa, Influenza virus
HIPEVCLKW

SEQ ID NO: 471844 - protein, 9 aa, Influenza virus
HIQTRRSFE

SEQ ID NO: 471845 - protein, 9 aa, Influenza virus
HISPLAGSA

SEQ ID NO: 471846 - protein, 9 aa, Influenza virus
HISPLSGSA

SEQ ID NO: 471847 - protein, 9 aa, Influenza virus
HISVGTSTL

SEQ ID NO: 471848 - protein, 9 aa, Influenza virus
HITFSHNGG

SEQ ID NO: 471849 - protein, 9 aa, Influenza virus
HITGFAPFS

SEQ ID NO: 471850 - protein, 9 aa, Influenza virus
HIVERILEE

SEQ ID NO: 471851 - protein, 9 aa, Influenza virus
HIWVTREPY

SEQ ID NO: 471852 - protein, 9 aa, Influenza virus
HIYGKDNAI

SEQ ID NO: 471853 - protein, 9 aa, Influenza virus
HIYGKDNAV

SEQ ID NO: 471854 - protein, 9 aa, Influenza virus
HKCDDDCMA

SEQ ID NO: 471855 - protein, 9 aa, Influenza virus
HKCDDECIE

SEQ ID NO: 471856 - protein, 9 aa, Influenza virus
HKCDDECMD

SEQ ID NO: 471857 - protein, 9 aa, Influenza virus
HKCDDECMN

SEQ ID NO: 471858 - protein, 9 aa, Influenza virus
HKCDDECMS

SEQ ID NO: 471859 - protein, 9 aa, Influenza virus
HKCDDHCME

SEQ ID NO: 471860 - protein, 9 aa, Influenza virus
HKCDDQCME

SEQ ID NO: 471861 - protein, 9 aa, Influenza virus
HKCDNECIE

SEQ ID NO: 471862 - protein, 9 aa, Influenza virus
HKCDNECMD

SEQ ID NO: 471863 - protein, 9 aa, Influenza virus
HKCDNECME

SEQ ID NO: 471864 - protein, 9 aa, Influenza virus
HKCDNKCIE

SEQ ID NO: 471865 - protein, 9 aa, Influenza virus
HKCDNKCME

SEQ ID NO: 471866 - protein, 9 aa, Influenza virus
HKCDNQCME

SEQ ID NO: 471867 - protein, 9 aa, Influenza virus
HKCNDECMN

SEQ ID NO: 471868 - protein, 9 aa, Influenza virus
HKCNDSCMD

SEQ ID NO: 471869 - protein, 9 aa, Influenza virus
HKCNDSCME

SEQ ID NO: 471870 - protein, 9 aa, Influenza virus
HKCNNECIE

SEQ ID NO: 471871 - protein, 9 aa, Influenza virus
HKCNNECME

SEQ ID NO: 471872 - protein, 9 aa, Influenza virus
HKCNNSCME

SEQ ID NO: 471873 - protein, 9 aa, Influenza virus
HKCNNTCME

SEQ ID NO: 471874 - protein, 9 aa, Influenza virus
HKDLGNCHP

SEQ ID NO: 471875 - protein, 9 aa, Influenza virus
HKDNAIRLG

SEQ ID NO: 471876 - protein, 9 aa, Influenza virus
HKDNAIRPG

SEQ ID NO: 471877 - protein, 9 aa, Influenza virus
HKDNALRLA

SEQ ID NO: 471878 - protein, 9 aa, Influenza virus
HKDNAVRLG

SEQ ID NO: 471879 - protein, 9 aa, Influenza virus
HKDYEEEAK

SEQ ID NO: 471880 - protein, 9 aa, Influenza virus
HKEFEEESK

SEQ ID NO: 471881 - protein, 9 aa, Influenza virus
HKEFEEESR

SEQ ID NO: 471882 - protein, 9 aa, Influenza virus
HKEFEKESK

SEQ ID NO: 471883 - protein, 9 aa, Influenza virus
HKEFEKESR

SEQ ID NO: 471884 - protein, 9 aa, Influenza virus
HKEFKEESK

SEQ ID NO: 471885 - protein, 9 aa, Influenza virus
HKEYEEEAK

SEQ ID NO: 471886 - protein, 9 aa, Influenza virus
HKGIVIKEE

SEQ ID NO: 471887 - protein, 9 aa, Influenza virus
HKGLIIKEE

SEQ ID NO: 471888 - protein, 9 aa, Influenza virus
HKGLLIKEE

SEQ ID NO: 471889 - protein, 9 aa, Influenza virus
HKGLVIKEE

SEQ ID NO: 471890 - protein, 9 aa, Influenza virus
HKGLVVKEE

SEQ ID NO: 471891 - protein, 9 aa, Influenza virus
HKGNSARLI

SEQ ID NO: 471892 - protein, 9 aa, Influenza virus
HKICIGYHA

SEQ ID NO: 471893 - protein, 9 aa, Influenza virus
HKMESRGLF

SEQ ID NO: 471894 - protein, 9 aa, Influenza virus
HKQLTHHMR

SEQ ID NO: 471895 - protein, 9 aa, Influenza virus
HKSCLPACA

SEQ ID NO: 471896 - protein, 9 aa, Influenza virus
HKSCLPACI

SEQ ID NO: 471897 - protein, 9 aa, Influenza virus
HKSCLPACV

SEQ ID NO: 471898 - protein, 9 aa, Influenza virus
HKSQLIWMA

SEQ ID NO: 471899 - protein, 9 aa, Influenza virus
HKSQLVWMA

SEQ ID NO: 471900 - protein, 9 aa, Influenza virus
HLAYCNTDL

SEQ ID NO: 471901 - protein, 9 aa, Influenza virus
HLECRTFFL

SEQ ID NO: 471902 - protein, 9 aa, Influenza virus
HLEECSCYM

SEQ ID NO: 471903 - protein, 9 aa, Influenza virus
HLEECSCYT

SEQ ID NO: 471904 - protein, 9 aa, Influenza virus
HLEECSCYV

SEQ ID NO: 471905 - protein, 9 aa, Influenza virus
HLEFKADLI

SEQ ID NO: 471906 - protein, 9 aa, Influenza virus
HLEICFMYS

SEQ ID NO: 471907 - protein, 9 aa, Influenza virus
HLEVCFMYS

SEQ ID NO: 471908 - protein, 9 aa, Influenza virus
HLFSGIKSF

SEQ ID NO: 471909 - protein, 9 aa, Influenza virus
HLFSGIRSF

SEQ ID NO: 471910 - protein, 9 aa, Influenza virus
HLFSGVNSF

SEQ ID NO: 471911 - protein, 9 aa, Influenza virus
HLGDCNFEG

SEQ ID NO: 471912 - protein, 9 aa, Influenza virus
HLGDCRFEG

SEQ ID NO: 471913 - protein, 9 aa, Influenza virus
HLGDCSFEG

SEQ ID NO: 471914 - protein, 9 aa, Influenza virus
HLGTKQVCA

SEQ ID NO: 471915 - protein, 9 aa, Influenza virus
HLGTKQVCI

SEQ ID NO: 471916 - protein, 9 aa, Influenza virus
HLGTKQVCM

SEQ ID NO: 471917 - protein, 9 aa, Influenza virus
HLGTKQVCV

SEQ ID NO: 471918 - protein, 9 aa, Influenza virus
HLGTRQVCI

SEQ ID NO: 471919 - protein, 9 aa, Influenza virus
HLGTRQVCM

SEQ ID NO: 471920 - protein, 9 aa, Influenza virus
HLGTRQVCV

SEQ ID NO: 471921 - protein, 9 aa, Influenza virus
HLIGKTNQQ

SEQ ID NO: 471922 - protein, 9 aa, Influenza virus
HLIIWGIHH

SEQ ID NO: 471923 - protein, 9 aa, Influenza virus
HLIMWGIHH

SEQ ID NO: 471924 - protein, 9 aa, Influenza virus
HLITGKSHG

SEQ ID NO: 471925 - protein, 9 aa, Influenza virus
HLITWGIHH

SEQ ID NO: 471926 - protein, 9 aa, Influenza virus
HLIVWGIHH

SEQ ID NO: 471927 - protein, 9 aa, Influenza virus
HLKDQAWSY

SEQ ID NO: 471928 - protein, 9 aa, Influenza virus
HLKDQDWSY

SEQ ID NO: 471929 - protein, 9 aa, Influenza virus
HLKDQGWSY

SEQ ID NO: 471930 - protein, 9 aa, Influenza virus
HLKDQSWSY

SEQ ID NO: 471931 - protein, 9 aa, Influenza virus
HLKFKADLI

SEQ ID NO: 471932 - protein, 9 aa, Influenza virus
HLMHPGERI

SEQ ID NO: 471933 - protein, 9 aa, Influenza virus
HLMIWHSNL

SEQ ID NO: 471934 - protein, 9 aa, Influenza virus
HLMRPGERI

SEQ ID NO: 471935 - protein, 9 aa, Influenza virus
HLMRPGERT

SEQ ID NO: 471936 - protein, 9 aa, Influenza virus
HLMSPGERI

SEQ ID NO: 471937 - protein, 9 aa, Influenza virus
HLRDQGWSY

SEQ ID NO: 471938 - protein, 9 aa, Influenza virus
HLRNDTDVV

SEQ ID NO: 471939 - protein, 9 aa, Influenza virus
HLSSVSSFE

SEQ ID NO: 471940 - protein, 9 aa, Influenza virus
HLTDSEMNK

SEQ ID NO: 471941 - protein, 9 aa, Influenza virus
HLTGIWDTL

SEQ ID NO: 471942 - protein, 9 aa, Influenza virus
HLTGKWDTL

SEQ ID NO: 471943 - protein, 9 aa, Influenza virus
HLTGTWDTL

SEQ ID NO: 471944 - protein, 9 aa, Influenza virus
HLTQGACWE

SEQ ID NO: 471945 - protein, 9 aa, Influenza virus
HLTQGTCWE

SEQ ID NO: 471946 - protein, 9 aa, Influenza virus
HLTTGKSHG

SEQ ID NO: 471947 - protein, 9 aa, Influenza virus
HLVTGKSHG

SEQ ID NO: 471948 - protein, 9 aa, Influenza virus
HMAIIKKYT

SEQ ID NO: 471949 - protein, 9 aa, Influenza virus
HMECRTFFL

SEQ ID NO: 471950 - protein, 9 aa, Influenza virus
HMEVCFMYS

SEQ ID NO: 471951 - protein, 9 aa, Influenza virus
HMGECPKYV

SEQ ID NO: 471952 - protein, 9 aa, Influenza virus
HMMIWHSNL

SEQ ID NO: 471953 - protein, 9 aa, Influenza virus
HMRKKRGLF

SEQ ID NO: 471954 - protein, 9 aa, Influenza virus
HNGGLIAPD

SEQ ID NO: 471955 - protein, 9 aa, Influenza virus
HNGGLIAPN

SEQ ID NO: 471956 - protein, 9 aa, Influenza virus
HNGGLIAPS

SEQ ID NO: 471957 - protein, 9 aa, Influenza virus
HNGGLVAPS

SEQ ID NO: 471958 - protein, 9 aa, Influenza virus
HNGGRIAPS

SEQ ID NO: 471959 - protein, 9 aa, Influenza virus
HNGICPVAF

SEQ ID NO: 471960 - protein, 9 aa, Influenza virus
HNGICPVVF

SEQ ID NO: 471961 - protein, 9 aa, Influenza virus
HNGKLCKLN

SEQ ID NO: 471962 - protein, 9 aa, Influenza virus
HNGKLCKLS

SEQ ID NO: 471963 - protein, 9 aa, Influenza virus
HNGKLCRLN

SEQ ID NO: 471964 - protein, 9 aa, Influenza virus
HNGKLCRLR

SEQ ID NO: 471965 - protein, 9 aa, Influenza virus
HNGKLCRLS

SEQ ID NO: 471966 - protein, 9 aa, Influenza virus
HNGTCAVVM

SEQ ID NO: 471967 - protein, 9 aa, Influenza virus
HNGTCVVIM

SEQ ID NO: 471968 - protein, 9 aa, Influenza virus
HNGTCVVVM

SEQ ID NO: 471969 - protein, 9 aa, Influenza virus
HNGTWAVVM

SEQ ID NO: 471970 - protein, 9 aa, Influenza virus
HNGVCPVVF

SEQ ID NO: 471971 - protein, 9 aa, Influenza virus
HNIHPLAIG

SEQ ID NO: 471972 - protein, 9 aa, Influenza virus
HNIHPLTIG

SEQ ID NO: 471973 - protein, 9 aa, Influenza virus
HNILRTQES

SEQ ID NO: 471974 - protein, 9 aa, Influenza virus
HNISKYAFG

SEQ ID NO: 471975 - protein, 9 aa, Influenza virus
HNIYRDEAI

SEQ ID NO: 471976 - protein, 9 aa, Influenza virus
HNNEQGSGY

SEQ ID NO: 471977 - protein, 9 aa, Influenza virus
HNQEYTSGR

SEQ ID NO: 471978 - protein, 9 aa, Influenza virus
HNSFVPVVG

SEQ ID NO: 471979 - protein, 9 aa, Influenza virus
HNSTCVVVM

SEQ ID NO: 471980 - protein, 9 aa, Influenza virus
HNVHPFTIG

SEQ ID NO: 471981 - protein, 9 aa, Influenza virus
HNVHPLAIG

SEQ ID NO: 471982 - protein, 9 aa, Influenza virus
HNVHPLTIG

SEQ ID NO: 471983 - protein, 9 aa, Influenza virus
HNVHRNAIG

SEQ ID NO: 471984 - protein, 9 aa, Influenza virus
HNVHRNTIG

SEQ ID NO: 471985 - protein, 9 aa, Influenza virus
HNVHRSTIG

SEQ ID NO: 471986 - protein, 9 aa, Influenza virus
HNVSKYAFG

SEQ ID NO: 471987 - protein, 9 aa, Influenza virus
HNVYRDEAI

SEQ ID NO: 471988 - protein, 9 aa, Influenza virus
HPATIGECP

SEQ ID NO: 471989 - protein, 9 aa, Influenza virus
HPAYCNTDL

SEQ ID NO: 471990 - protein, 9 aa, Influenza virus
HPELTGLDC

SEQ ID NO: 471991 - protein, 9 aa, Influenza virus
HPELTGLNC

SEQ ID NO: 471992 - protein, 9 aa, Influenza virus
HPELTGMDC

SEQ ID NO: 471993 - protein, 9 aa, Influenza virus
HPELTGMNC

SEQ ID NO: 471994 - protein, 9 aa, Influenza virus
HPELTGVDC

SEQ ID NO: 471995 - protein, 9 aa, Influenza virus
HPEMTGLDC

SEQ ID NO: 471996 - protein, 9 aa, Influenza virus
HPFTIGECP

SEQ ID NO: 471997 - protein, 9 aa, Influenza virus
HPGIFENSC

SEQ ID NO: 471998 - protein, 9 aa, Influenza virus
HPGIFGNSC

SEQ ID NO: 471999 - protein, 9 aa, Influenza virus
HPGLFENSC

SEQ ID NO: 472000 - protein, 9 aa, Influenza virus
HPITIGECP

SEQ ID NO: 472001 - protein, 9 aa, Influenza virus
HPLAIGECP

SEQ ID NO: 472002 - protein, 9 aa, Influenza virus
HPLTIGECP

SEQ ID NO: 472003 - protein, 9 aa, Influenza virus
HPLTIGKCP

SEQ ID NO: 472004 - protein, 9 aa, Influenza virus
HPLTMGECP

SEQ ID NO: 472005 - protein, 9 aa, Influenza virus
HPNAGKDPK

SEQ ID NO: 472006 - protein, 9 aa, Influenza virus
HPPDAKEQT

SEQ ID NO: 472007 - protein, 9 aa, Influenza virus
HPPDETEQT

SEQ ID NO: 472008 - protein, 9 aa, Influenza virus
HPPDTKEQT

SEQ ID NO: 472009 - protein, 9 aa, Influenza virus
HPPNTKEQT

SEQ ID NO: 472010 - protein, 9 aa, Influenza virus
HPPTSAEQV

SEQ ID NO: 472011 - protein, 9 aa, Influenza virus
HPPTSDEQI

SEQ ID NO: 472012 - protein, 9 aa, Influenza virus
HPPTSDEQV

SEQ ID NO: 472013 - protein, 9 aa, Influenza virus
HPPTSNEQV

SEQ ID NO: 472014 - protein, 9 aa, Influenza virus
HPPTTDEQM

SEQ ID NO: 472015 - protein, 9 aa, Influenza virus
HPRGLLEVG

SEQ ID NO: 472016 - protein, 9 aa, Influenza virus
HPSAGKDPK

SEQ ID NO: 472017 - protein, 9 aa, Influenza virus
HPSAGRDPK

SEQ ID NO: 472018 - protein, 9 aa, Influenza virus
HPSSAQEKN

SEQ ID NO: 472019 - protein, 9 aa, Influenza virus
HPSSDNEQT

SEQ ID NO: 472020 - protein, 9 aa, Influenza virus
HPSSTKEKN

SEQ ID NO: 472021 - protein, 9 aa, Influenza virus
HPSSTQEKN

SEQ ID NO: 472022 - protein, 9 aa, Influenza virus
HPSTGKDPK

SEQ ID NO: 472023 - protein, 9 aa, Influenza virus
HPTLLFLKV

SEQ ID NO: 472024 - protein, 9 aa, Influenza virus
HPVTIGECP

SEQ ID NO: 472025 - protein, 9 aa, Influenza virus
HPVTIGKCP

SEQ ID NO: 472026 - protein, 9 aa, Influenza virus
HQCDNNCIE

SEQ ID NO: 472027 - protein, 9 aa, Influenza virus
HQFELIDNE

SEQ ID NO: 472028 - protein, 9 aa, Influenza virus
HQGTTIRNK

SEQ ID NO: 472029 - protein, 9 aa, Influenza virus
HQGTTIRNR

SEQ ID NO: 472030 - protein, 9 aa, Influenza virus
HQIEKEFEQ

SEQ ID NO: 472031 - protein, 9 aa, Influenza virus
HQIEKEFGQ

SEQ ID NO: 472032 - protein, 9 aa, Influenza virus
HQIEKEFSE

SEQ ID NO: 472033 - protein, 9 aa, Influenza virus
HQIGNVINW

SEQ ID NO: 472034 - protein, 9 aa, Influenza virus
HQILAIYST

SEQ ID NO: 472035 - protein, 9 aa, Influenza virus
HQISNVINW

SEQ ID NO: 472036 - protein, 9 aa, Influenza virus
HQLLRHFQK

SEQ ID NO: 472037 - protein, 9 aa, Influenza virus
HQLRENAED

SEQ ID NO: 472038 - protein, 9 aa, Influenza virus
HQNAEGIGI

SEQ ID NO: 472039 - protein, 9 aa, Influenza virus
HQNAEGTGI

SEQ ID NO: 472040 - protein, 9 aa, Influenza virus
HQNAEGTGM

SEQ ID NO: 472041 - protein, 9 aa, Influenza virus
HQNAEGTGT

SEQ ID NO: 472042 - protein, 9 aa, Influenza virus
HQNAQGEGI

SEQ ID NO: 472043 - protein, 9 aa, Influenza virus
HQNAQGEGT

SEQ ID NO: 472044 - protein, 9 aa, Influenza virus
HQNAQGIGQ

SEQ ID NO: 472045 - protein, 9 aa, Influenza virus
HQNAQGQGT

SEQ ID NO: 472046 - protein, 9 aa, Influenza virus
HQNAQGSGY

SEQ ID NO: 472047 - protein, 9 aa, Influenza virus
HQNAQGTGQ

SEQ ID NO: 472048 - protein, 9 aa, Influenza virus
HQNEQGMGM

SEQ ID NO: 472049 - protein, 9 aa, Influenza virus
HQNEQGSGY

SEQ ID NO: 472050 - protein, 9 aa, Influenza virus
HQNEQGTGI

SEQ ID NO: 472051 - protein, 9 aa, Influenza virus
HQNEQGVGI

SEQ ID NO: 472052 - protein, 9 aa, Influenza virus
HQNEQGVGM

SEQ ID NO: 472053 - protein, 9 aa, Influenza virus
HQNGQGSGY

SEQ ID NO: 472054 - protein, 9 aa, Influenza virus
HQNSEGIGQ

SEQ ID NO: 472055 - protein, 9 aa, Influenza virus
HQNSEGMGQ

SEQ ID NO: 472056 - protein, 9 aa, Influenza virus
HQNSEGRGQ

SEQ ID NO: 472057 - protein, 9 aa, Influenza virus
HQNSEGTGI

SEQ ID NO: 472058 - protein, 9 aa, Influenza virus
HQNSEGTGQ

SEQ ID NO: 472059 - protein, 9 aa, Influenza virus
HQNSQGEGT

SEQ ID NO: 472060 - protein, 9 aa, Influenza virus
HQNTQGEGT

SEQ ID NO: 472061 - protein, 9 aa, Influenza virus
HQRSKFLLM

SEQ ID NO: 472062 - protein, 9 aa, Influenza virus
HQSETYPVI

SEQ ID NO: 472063 - protein, 9 aa, Influenza virus
HQSFVPSPG

SEQ ID NO: 472064 - protein, 9 aa, Influenza virus
HQSGTYPII

SEQ ID NO: 472065 - protein, 9 aa, Influenza virus
HQSGTYPVI

SEQ ID NO: 472066 - protein, 9 aa, Influenza virus
HQSGTYPVV

SEQ ID NO: 472067 - protein, 9 aa, Influenza virus
HQSTNSTET

SEQ ID NO: 472068 - protein, 9 aa, Influenza virus
HQYSEKGKW

SEQ ID NO: 472069 - protein, 9 aa, Influenza virus
HQYSEKGRW

SEQ ID NO: 472070 - protein, 9 aa, Influenza virus
HQYSERGKW

SEQ ID NO: 472071 - protein, 9 aa, Influenza virus
HQYSERGRW

SEQ ID NO: 472072 - protein, 9 aa, Influenza virus
HRCDDQCME

SEQ ID NO: 472073 - protein, 9 aa, Influenza virus
HRCDNECIE

SEQ ID NO: 472074 - protein, 9 aa, Influenza virus
HRDEEGTGI

SEQ ID NO: 472075 - protein, 9 aa, Influenza virus
HRFEIIEGR

SEQ ID NO: 472076 - protein, 9 aa, Influenza virus
HRIYWIREG

SEQ ID NO: 472077 - protein, 9 aa, Influenza virus
HRIYWIRKG

SEQ ID NO: 472078 - protein, 9 aa, Influenza virus
HRKRRVRDN

SEQ ID NO: 472079 - protein, 9 aa, Influenza virus
HRLCYPGEL

SEQ ID NO: 472080 - protein, 9 aa, Influenza virus
HRLKITENS

SEQ ID NO: 472081 - protein, 9 aa, Influenza virus
HRNDEGTGI

SEQ ID NO: 472082 - protein, 9 aa, Influenza virus
HRNEEGTGI

SEQ ID NO: 472083 - protein, 9 aa, Influenza virus
HRNTFGDCP

SEQ ID NO: 472084 - protein, 9 aa, Influenza virus
HRNTIGDCP

SEQ ID NO: 472085 - protein, 9 aa, Influenza virus
HRNTIGNCP

SEQ ID NO: 472086 - protein, 9 aa, Influenza virus
HRSTIGDCP

SEQ ID NO: 472087 - protein, 9 aa, Influenza virus
HRTLLMNEL

SEQ ID NO: 472088 - protein, 9 aa, Influenza virus
HRTLLMSEL

SEQ ID NO: 472089 - protein, 9 aa, Influenza virus
HRVYWIREG

SEQ ID NO: 472090 - protein, 9 aa, Influenza virus
HSAAFEDLR

SEQ ID NO: 472091 - protein, 9 aa, Influenza virus
HSAYCNTDL

SEQ ID NO: 472092 - protein, 9 aa, Influenza virus
HSDNADKIC

SEQ ID NO: 472093 - protein, 9 aa, Influenza virus
HSDTPRPAD

SEQ ID NO: 472094 - protein, 9 aa, Influenza virus
HSDTPRPDD

SEQ ID NO: 472095 - protein, 9 aa, Influenza virus
HSDTPRPSD

SEQ ID NO: 472096 - protein, 9 aa, Influenza virus
HSDTPRPTD

SEQ ID NO: 472097 - protein, 9 aa, Influenza virus
HSDTPRPVD

SEQ ID NO: 472098 - protein, 9 aa, Influenza virus
HSECRTFFL

SEQ ID NO: 472099 - protein, 9 aa, Influenza virus
HSGICPVVF

SEQ ID NO: 472100 - protein, 9 aa, Influenza virus
HSGVCPVVF

SEQ ID NO: 472101 - protein, 9 aa, Influenza virus
HSHYREEAL

SEQ ID NO: 472102 - protein, 9 aa, Influenza virus
HSKDNGIRI

SEQ ID NO: 472103 - protein, 9 aa, Influenza virus
HSKDNNIRI

SEQ ID NO: 472104 - protein, 9 aa, Influenza virus
HSKDNSIRI

SEQ ID NO: 472105 - protein, 9 aa, Influenza virus
HSKEQGSGY

SEQ ID NO: 472106 - protein, 9 aa, Influenza virus
HSKYREEAM

SEQ ID NO: 472107 - protein, 9 aa, Influenza virus
HSMSDIEAM

SEQ ID NO: 472108 - protein, 9 aa, Influenza virus
HSMSGFRSN

SEQ ID NO: 472109 - protein, 9 aa, Influenza virus
HSNAEGTGM

SEQ ID NO: 472110 - protein, 9 aa, Influenza virus
HSNDQGAGY

SEQ ID NO: 472111 - protein, 9 aa, Influenza virus
HSNDQGSGY

SEQ ID NO: 472112 - protein, 9 aa, Influenza virus
HSNDTIHDR

SEQ ID NO: 472113 - protein, 9 aa, Influenza virus
HSNDTVHDR

SEQ ID NO: 472114 - protein, 9 aa, Influenza virus
HSNEQGSGY

SEQ ID NO: 472115 - protein, 9 aa, Influenza virus
HSNETVKDR

SEQ ID NO: 472116 - protein, 9 aa, Influenza virus
HSNGQGSGY

SEQ ID NO: 472117 - protein, 9 aa, Influenza virus
HSNGTAKDR

SEQ ID NO: 472118 - protein, 9 aa, Influenza virus
HSNGTIEDR

SEQ ID NO: 472119 - protein, 9 aa, Influenza virus
HSNGTIHDR

SEQ ID NO: 472120 - protein, 9 aa, Influenza virus
HSNGTIKDK

SEQ ID NO: 472121 - protein, 9 aa, Influenza virus
HSNGTIKDR

SEQ ID NO: 472122 - protein, 9 aa, Influenza virus
HSNGTINDR

SEQ ID NO: 472123 - protein, 9 aa, Influenza virus
HSNGTKHDR

SEQ ID NO: 472124 - protein, 9 aa, Influenza virus
HSNGTMKDR

SEQ ID NO: 472125 - protein, 9 aa, Influenza virus
HSNGTNKDR

SEQ ID NO: 472126 - protein, 9 aa, Influenza virus
HSNGTTHDR

SEQ ID NO: 472127 - protein, 9 aa, Influenza virus
HSNGTVKBR

SEQ ID NO: 472128 - protein, 9 aa, Influenza virus
HSNGTVKDR

SEQ ID NO: 472129 - protein, 9 aa, Influenza virus
HSNGTVKNR

SEQ ID NO: 472130 - protein, 9 aa, Influenza virus
HSNGTVNDR

SEQ ID NO: 472131 - protein, 9 aa, Influenza virus
HSNLNDATY

SEQ ID NO: 472132 - protein, 9 aa, Influenza virus
HSNLNDTTY

SEQ ID NO: 472133 - protein, 9 aa, Influenza virus
HSNNTVKDR

SEQ ID NO: 472134 - protein, 9 aa, Influenza virus
HSNSEGTGM

SEQ ID NO: 472135 - protein, 9 aa, Influenza virus
HSNSTTHDR

SEQ ID NO: 472136 - protein, 9 aa, Influenza virus
HSQYREEAL

SEQ ID NO: 472137 - protein, 9 aa, Influenza virus
HSRGLFGAI

SEQ ID NO: 472138 - protein, 9 aa, Influenza virus
HSRYREEAM

SEQ ID NO: 472139 - protein, 9 aa, Influenza virus
HSSSLDEQN

SEQ ID NO: 472140 - protein, 9 aa, Influenza virus
HSVHRNTFG

SEQ ID NO: 472141 - protein, 9 aa, Influenza virus
HSVHRNTIG

SEQ ID NO: 472142 - protein, 9 aa, Influenza virus
HSWIPKRNR

SEQ ID NO: 472143 - protein, 9 aa, Influenza virus
HSWTPKRNR

SEQ ID NO: 472144 - protein, 9 aa, Influenza virus
HSWVPILNT

SEQ ID NO: 472145 - protein, 9 aa, Influenza virus
HSWVPKRNR

SEQ ID NO: 472146 - protein, 9 aa, Influenza virus
HTAYSQITN

SEQ ID NO: 472147 - protein, 9 aa, Influenza virus
HTDELCPSP

SEQ ID NO: 472148 - protein, 9 aa, Influenza virus
HTEYRQEAL

SEQ ID NO: 472149 - protein, 9 aa, Influenza virus
HTGNPVICL

SEQ ID NO: 472150 - protein, 9 aa, Influenza virus
HTGSFCSID

SEQ ID NO: 472151 - protein, 9 aa, Influenza virus
HTGSFCSIN

SEQ ID NO: 472152 - protein, 9 aa, Influenza virus
HTGTFCSIN

SEQ ID NO: 472153 - protein, 9 aa, Influenza virus
HTGTSKACN

SEQ ID NO: 472154 - protein, 9 aa, Influenza virus
HTGTYCSLD

SEQ ID NO: 472155 - protein, 9 aa, Influenza virus
HTGTYCSLG

SEQ ID NO: 472156 - protein, 9 aa, Influenza virus
HTGTYCSLN

SEQ ID NO: 472157 - protein, 9 aa, Influenza virus
HTGTYCSLS

SEQ ID NO: 472158 - protein, 9 aa, Influenza virus
HTIDLADSE

SEQ ID NO: 472159 - protein, 9 aa, Influenza virus
HTIDLAESE

SEQ ID NO: 472160 - protein, 9 aa, Influenza virus
HTIDLTDAE

SEQ ID NO: 472161 - protein, 9 aa, Influenza virus
HTIDLTDSE

SEQ ID NO: 472162 - protein, 9 aa, Influenza virus
HTIDLTNSE

SEQ ID NO: 472163 - protein, 9 aa, Influenza virus
HTIDMADSE

SEQ ID NO: 472164 - protein, 9 aa, Influenza virus
HTIDMGDSE

SEQ ID NO: 472165 - protein, 9 aa, Influenza virus
HTIDMTDSE

SEQ ID NO: 472166 - protein, 9 aa, Influenza virus
HTIDSTDSE

SEQ ID NO: 472167 - protein, 9 aa, Influenza virus
HTIDVTDSE

SEQ ID NO: 472168 - protein, 9 aa, Influenza virus
HTIHLTDSE

SEQ ID NO: 472169 - protein, 9 aa, Influenza virus
HTKCQTYAG

SEQ ID NO: 472170 - protein, 9 aa, Influenza virus
HTKCQTYTG

SEQ ID NO: 472171 - protein, 9 aa, Influenza virus
HTKDNSIRI

SEQ ID NO: 472172 - protein, 9 aa, Influenza virus
HTKILYFHK

SEQ ID NO: 472173 - protein, 9 aa, Influenza virus
HTKVLYFHK

SEQ ID NO: 472174 - protein, 9 aa, Influenza virus
HTKYRTESL

SEQ ID NO: 472175 - protein, 9 aa, Influenza virus
HTQYREEAL

SEQ ID NO: 472176 - protein, 9 aa, Influenza virus
HTQYREESL

SEQ ID NO: 472177 - protein, 9 aa, Influenza virus
HTQYRTESL

SEQ ID NO: 472178 - protein, 9 aa, Influenza virus
HTQYRTGSL

SEQ ID NO: 472179 - protein, 9 aa, Influenza virus
HTRGLFGAI

SEQ ID NO: 472180 - protein, 9 aa, Influenza virus
HTSKYVCTG

SEQ ID NO: 472181 - protein, 9 aa, Influenza virus
HTSQYICSP

SEQ ID NO: 472182 - protein, 9 aa, Influenza virus
HTSQYLCTG

SEQ ID NO: 472183 - protein, 9 aa, Influenza virus
HTSRYICTG

SEQ ID NO: 472184 - protein, 9 aa, Influenza virus
HTSRYMCTG

SEQ ID NO: 472185 - protein, 9 aa, Influenza virus
HTSRYVCTG

SEQ ID NO: 472186 - protein, 9 aa, Influenza virus
HVCITGDDR

SEQ ID NO: 472187 - protein, 9 aa, Influenza virus
HVCVTGDDG

SEQ ID NO: 472188 - protein, 9 aa, Influenza virus
HVCVTGDDK

SEQ ID NO: 472189 - protein, 9 aa, Influenza virus
HVCVTGDDR

SEQ ID NO: 472190 - protein, 9 aa, Influenza virus
HVDTIMEKN

SEQ ID NO: 472191 - protein, 9 aa, Influenza virus
HVEECSCYP

SEQ ID NO: 472192 - protein, 9 aa, Influenza virus
HVEVVSAKE

SEQ ID NO: 472193 - protein, 9 aa, Influenza virus
HVFVIREPF

SEQ ID NO: 472194 - protein, 9 aa, Influenza virus
HVLVTREPY

SEQ ID NO: 472195 - protein, 9 aa, Influenza virus
HVQNNYTTI

SEQ ID NO: 472196 - protein, 9 aa, Influenza virus
HVQNNYTTV

SEQ ID NO: 472197 - protein, 9 aa, Influenza virus
HVRKRFADQ

SEQ ID NO: 472198 - protein, 9 aa, Influenza virus
HVSPLSGSA

SEQ ID NO: 472199 - protein, 9 aa, Influenza virus
HWMLLDPGD

SEQ ID NO: 472200 - protein, 9 aa, Influenza virus
HWNLALDIV

SEQ ID NO: 472201 - protein, 9 aa, Influenza virus
HWPDGSNIG

SEQ ID NO: 472202 - protein, 9 aa, Influenza virus
HWTIVKPGD

SEQ ID NO: 472203 - protein, 9 aa, Influenza virus
HYEECSCYP

SEQ ID NO: 472204 - protein, 9 aa, Influenza virus
HYGGIPTDV

SEQ ID NO: 472205 - protein, 9 aa, Influenza virus
HYGGMPTDV

SEQ ID NO: 472206 - protein, 9 aa, Influenza virus
HYGGVPTDV

SEQ ID NO: 472207 - protein, 9 aa, Influenza virus
HYIGKCPKY

SEQ ID NO: 472208 - protein, 9 aa, Influenza virus
HYIGKCPRY

SEQ ID NO: 472209 - protein, 9 aa, Influenza virus
HYKISKSTK

SEQ ID NO: 472210 - protein, 9 aa, Influenza virus
HYMGECPEY

SEQ ID NO: 472211 - protein, 9 aa, Influenza virus
HYMGECPKY

SEQ ID NO: 472212 - protein, 9 aa, Influenza virus
HYMGECPNY

SEQ ID NO: 472213 - protein, 9 aa, Influenza virus
HYPKIYKTY

SEQ ID NO: 472214 - protein, 9 aa, Influenza virus
HYPKVYKPY

SEQ ID NO: 472215 - protein, 9 aa, Influenza virus
HYPKVYKTY

SEQ ID NO: 472216 - protein, 9 aa, Influenza virus
HYPKVYRTY

SEQ ID NO: 472217 - protein, 9 aa, Influenza virus
HYREEALLN

SEQ ID NO: 472218 - protein, 9 aa, Influenza virus
HYSKVYKTY

SEQ ID NO: 472219 - protein, 9 aa, Influenza virus
HYVCSGLVG

SEQ ID NO: 472220 - protein, 9 aa, Influenza virus
IAADKASTQ

SEQ ID NO: 472221 - protein, 9 aa, Influenza virus
IAADKESTQ

SEQ ID NO: 472222 - protein, 9 aa, Influenza virus
IAADKTSTQ

SEQ ID NO: 472223 - protein, 9 aa, Influenza virus
IAADKVSTQ

SEQ ID NO: 472224 - protein, 9 aa, Influenza virus
IAADRDSTQ

SEQ ID NO: 472225 - protein, 9 aa, Influenza virus
IAADRESTQ

SEQ ID NO: 472226 - protein, 9 aa, Influenza virus
IAADRGSTQ

SEQ ID NO: 472227 - protein, 9 aa, Influenza virus
IAADYKSTQ

SEQ ID NO: 472228 - protein, 9 aa, Influenza virus
IAAEKESTQ

SEQ ID NO: 472229 - protein, 9 aa, Influenza virus
IAARNIVRR

SEQ ID NO: 472230 - protein, 9 aa, Influenza virus
IAARSIVRR

SEQ ID NO: 472231 - protein, 9 aa, Influenza virus
IAASYKRIR

SEQ ID NO: 472232 - protein, 9 aa, Influenza virus
IADAQHRSH

SEQ ID NO: 472233 - protein, 9 aa, Influenza virus
IADKICIGY

SEQ ID NO: 472234 - protein, 9 aa, Influenza virus
IADRVDDAV

SEQ ID NO: 472235 - protein, 9 aa, Influenza virus
IADSHHRSH

SEQ ID NO: 472236 - protein, 9 aa, Influenza virus
IADSQHKSH

SEQ ID NO: 472237 - protein, 9 aa, Influenza virus
IADSQHRSH

SEQ ID NO: 472238 - protein, 9 aa, Influenza virus
IAEQFTWNG

SEQ ID NO: 472239 - protein, 9 aa, Influenza virus
IAFCGTSGT

SEQ ID NO: 472240 - protein, 9 aa, Influenza virus
IAFCGVDSD

SEQ ID NO: 472241 - protein, 9 aa, Influenza virus
IAFCGVNFD

SEQ ID NO: 472242 - protein, 9 aa, Influenza virus
IAFCGVNSD

SEQ ID NO: 472243 - protein, 9 aa, Influenza virus
IAFLTSSIV

SEQ ID NO: 472244 - protein, 9 aa, Influenza virus
IAFVLWACQ

SEQ ID NO: 472245 - protein, 9 aa, Influenza virus
IAGFAPFSK

SEQ ID NO: 472246 - protein, 9 aa, Influenza virus
IAGFIEGGW

SEQ ID NO: 472247 - protein, 9 aa, Influenza virus
IAGFIEGRW

SEQ ID NO: 472248 - protein, 9 aa, Influenza virus
IAGFIENGW

SEQ ID NO: 472249 - protein, 9 aa, Influenza virus
IAGGLILGM

SEQ ID NO: 472250 - protein, 9 aa, Influenza virus
IAGLFFWMC

SEQ ID NO: 472251 - protein, 9 aa, Influenza virus
IAGLSFWMC

SEQ ID NO: 472252 - protein, 9 aa, Influenza virus
IAGSSEQAA

SEQ ID NO: 472253 - protein, 9 aa, Influenza virus
IAGWILGNP

SEQ ID NO: 472254 - protein, 9 aa, Influenza virus
IAGWLLGNP

SEQ ID NO: 472255 - protein, 9 aa, Influenza virus
IAGWYGFQH

SEQ ID NO: 472256 - protein, 9 aa, Influenza virus
IAHCYPGAT

SEQ ID NO: 472257 - protein, 9 aa, Influenza virus
IAHISPLSG

SEQ ID NO: 472258 - protein, 9 aa, Influenza virus
IAHKSCLPA

SEQ ID NO: 472259 - protein, 9 aa, Influenza virus
IAIALGIIN

SEQ ID NO: 472260 - protein, 9 aa, Influenza virus
IAIGNCPKY

SEQ ID NO: 472261 - protein, 9 aa, Influenza virus
IAIGSVSRT

SEQ ID NO: 472262 - protein, 9 aa, Influenza virus
IAILAATVT

SEQ ID NO: 472263 - protein, 9 aa, Influenza virus
IAILATTIT

SEQ ID NO: 472264 - protein, 9 aa, Influenza virus
IAILATTVT

SEQ ID NO: 472265 - protein, 9 aa, Influenza virus
IAILVTTVT

SEQ ID NO: 472266 - protein, 9 aa, Influenza virus
IAIRPKVNG

SEQ ID NO: 472267 - protein, 9 aa, Influenza virus
IAIVLGIIN

SEQ ID NO: 472268 - protein, 9 aa, Influenza virus
IAKDNAIRF

SEQ ID NO: 472269 - protein, 9 aa, Influenza virus
IAKDNAVRF

SEQ ID NO: 472270 - protein, 9 aa, Influenza virus
IAKGEKANV

SEQ ID NO: 472271 - protein, 9 aa, Influenza virus
IAKRSYNNT

SEQ ID NO: 472272 - protein, 9 aa, Influenza virus
IALCGSPFP

SEQ ID NO: 472273 - protein, 9 aa, Influenza virus
IALCGSPFS

SEQ ID NO: 472274 - protein, 9 aa, Influenza virus
IALFIGVGN

SEQ ID NO: 472275 - protein, 9 aa, Influenza virus
IALGIINLL

SEQ ID NO: 472276 - protein, 9 aa, Influenza virus
IALIIGVGN

SEQ ID NO: 472277 - protein, 9 aa, Influenza virus
IALILVALA

SEQ ID NO: 472278 - protein, 9 aa, Influenza virus
IALLIGIGN

SEQ ID NO: 472279 - protein, 9 aa, Influenza virus
IALLIGVGN

SEQ ID NO: 472280 - protein, 9 aa, Influenza virus
IALSILNLL

SEQ ID NO: 472281 - protein, 9 aa, Influenza virus
IALSVLNLL

SEQ ID NO: 472282 - protein, 9 aa, Influenza virus
IALSYSAGA

SEQ ID NO: 472283 - protein, 9 aa, Influenza virus
IAMENQHTI

SEQ ID NO: 472284 - protein, 9 aa, Influenza virus
IAMGLIFMC

SEQ ID NO: 472285 - protein, 9 aa, Influenza virus
IAMGLVFIC

SEQ ID NO: 472286 - protein, 9 aa, Influenza virus
IAMGLVFMC

SEQ ID NO: 472287 - protein, 9 aa, Influenza virus
IANCYPGAT

SEQ ID NO: 472288 - protein, 9 aa, Influenza virus
IANLGLNIG

SEQ ID NO: 472289 - protein, 9 aa, Influenza virus
IAPDRASFF

SEQ ID NO: 472290 - protein, 9 aa, Influenza virus
IAPDRASFL

SEQ ID NO: 472291 - protein, 9 aa, Influenza virus
IAPDRATFL

SEQ ID NO: 472292 - protein, 9 aa, Influenza virus
IAPDRVSFL

SEQ ID NO: 472293 - protein, 9 aa, Influenza virus
IAPEFGYLL

SEQ ID NO: 472294 - protein, 9 aa, Influenza virus
IAPEKVDFE

SEQ ID NO: 472295 - protein, 9 aa, Influenza virus
IAPENAYKI

SEQ ID NO: 472296 - protein, 9 aa, Influenza virus
IAPEYAFKI

SEQ ID NO: 472297 - protein, 9 aa, Influenza virus
IAPEYAYIV

SEQ ID NO: 472298 - protein, 9 aa, Influenza virus
IAPEYAYKI

SEQ ID NO: 472299 - protein, 9 aa, Influenza virus
IAPEYAYKV

SEQ ID NO: 472300 - protein, 9 aa, Influenza virus
IAPEYAYRI

SEQ ID NO: 472301 - protein, 9 aa, Influenza virus
IAPEYGFKI

SEQ ID NO: 472302 - protein, 9 aa, Influenza virus
IAPEYGFRI

SEQ ID NO: 472303 - protein, 9 aa, Influenza virus
IAPEYGHLI

SEQ ID NO: 472304 - protein, 9 aa, Influenza virus
IAPEYGHLT

SEQ ID NO: 472305 - protein, 9 aa, Influenza virus
IAPEYGHLV

SEQ ID NO: 472306 - protein, 9 aa, Influenza virus
IAPEYGYLI

SEQ ID NO: 472307 - protein, 9 aa, Influenza virus
IAPIMFSNK

SEQ ID NO: 472308 - protein, 9 aa, Influenza virus
IAPLMMAYM

SEQ ID NO: 472309 - protein, 9 aa, Influenza virus
IAPLMVAYM

SEQ ID NO: 472310 - protein, 9 aa, Influenza virus
IAPNRASFF

SEQ ID NO: 472311 - protein, 9 aa, Influenza virus
IAPRGHYKI

SEQ ID NO: 472312 - protein, 9 aa, Influenza virus
IAPRGHYKL

SEQ ID NO: 472313 - protein, 9 aa, Influenza virus
IAPRGHYRL

SEQ ID NO: 472314 - protein, 9 aa, Influenza virus
IAPRGYFKI

SEQ ID NO: 472315 - protein, 9 aa, Influenza virus
IAPRGYFKM

SEQ ID NO: 472316 - protein, 9 aa, Influenza virus
IAPRGYFKV

SEQ ID NO: 472317 - protein, 9 aa, Influenza virus
IAPRGYYKM

SEQ ID NO: 472318 - protein, 9 aa, Influenza virus
IAPRYAFEL

SEQ ID NO: 472319 - protein, 9 aa, Influenza virus
IAPRYGYII

SEQ ID NO: 472320 - protein, 9 aa, Influenza virus
IAPSRVSKL

SEQ ID NO: 472321 - protein, 9 aa, Influenza virus
IAPSRVTKL

SEQ ID NO: 472322 - protein, 9 aa, Influenza virus
IAQDNAIRF

SEQ ID NO: 472323 - protein, 9 aa, Influenza virus
IAQKLEDVF

SEQ ID NO: 472324 - protein, 9 aa, Influenza virus
IAQRLEDVF

SEQ ID NO: 472325 - protein, 9 aa, Influenza virus
IAQRLEGVF

SEQ ID NO: 472326 - protein, 9 aa, Influenza virus
IAQRLENVF

SEQ ID NO: 472327 - protein, 9 aa, Influenza virus
IAQRLESVF

SEQ ID NO: 472328 - protein, 9 aa, Influenza virus
IASDILKRM

SEQ ID NO: 472329 - protein, 9 aa, Influenza virus
IASDILTRM

SEQ ID NO: 472330 - protein, 9 aa, Influenza virus
IASIRRNYF

SEQ ID NO: 472331 - protein, 9 aa, Influenza virus
IASKDNGIR

SEQ ID NO: 472332 - protein, 9 aa, Influenza virus
IASMRRDYF

SEQ ID NO: 472333 - protein, 9 aa, Influenza virus
IASMRRNYF

SEQ ID NO: 472334 - protein, 9 aa, Influenza virus
IASMRRSYF

SEQ ID NO: 472335 - protein, 9 aa, Influenza virus
IASRSGYEM

SEQ ID NO: 472336 - protein, 9 aa, Influenza virus
IASSGTLEF

SEQ ID NO: 472337 - protein, 9 aa, Influenza virus
IASSIVLVG

SEQ ID NO: 472338 - protein, 9 aa, Influenza virus
IASSIVMVG

SEQ ID NO: 472339 - protein, 9 aa, Influenza virus
IASSLILAA

SEQ ID NO: 472340 - protein, 9 aa, Influenza virus
IASSLPFQN

SEQ ID NO: 472341 - protein, 9 aa, Influenza virus
IASSLVLAA

SEQ ID NO: 472342 - protein, 9 aa, Influenza virus
IASSTVLVG

SEQ ID NO: 472343 - protein, 9 aa, Influenza virus
IASSTVMVG

SEQ ID NO: 472344 - protein, 9 aa, Influenza virus
IASSVVLVG

SEQ ID NO: 472345 - protein, 9 aa, Influenza virus
IASTTAKAM

SEQ ID NO: 472346 - protein, 9 aa, Influenza virus
IASVPASRY

SEQ ID NO: 472347 - protein, 9 aa, Influenza virus
IASWAGNIL

SEQ ID NO: 472348 - protein, 9 aa, Influenza virus
IATPGMQIR

SEQ ID NO: 472349 - protein, 9 aa, Influenza virus
IATREPYVS

SEQ ID NO: 472350 - protein, 9 aa, Influenza virus
IATRPKVNG

SEQ ID NO: 472351 - protein, 9 aa, Influenza virus
IATRPQVNG

SEQ ID NO: 472352 - protein, 9 aa, Influenza virus
IATRPRVNG

SEQ ID NO: 472353 - protein, 9 aa, Influenza virus
IATRSKVNG

SEQ ID NO: 472354 - protein, 9 aa, Influenza virus
IAVFCGTSG

SEQ ID NO: 472355 - protein, 9 aa, Influenza virus
IAWSATACH

SEQ ID NO: 472356 - protein, 9 aa, Influenza virus
IAWSRSSCH

SEQ ID NO: 472357 - protein, 9 aa, Influenza virus
IAWSSASCH

SEQ ID NO: 472358 - protein, 9 aa, Influenza virus
IAWSSSSCF

SEQ ID NO: 472359 - protein, 9 aa, Influenza virus
IAWSSSSCH

SEQ ID NO: 472360 - protein, 9 aa, Influenza virus
IAWSSSSCY

SEQ ID NO: 472361 - protein, 9 aa, Influenza virus
IAYCYPGAT

SEQ ID NO: 472362 - protein, 9 aa, Influenza virus
IAYCYPGST

SEQ ID NO: 472363 - protein, 9 aa, Influenza virus
IAYCYPGTT

SEQ ID NO: 472364 - protein, 9 aa, Influenza virus
IAYERMCNI

SEQ ID NO: 472365 - protein, 9 aa, Influenza virus
ICATCEQIA

SEQ ID NO: 472366 - protein, 9 aa, Influenza virus
ICAVATTHS

SEQ ID NO: 472367 - protein, 9 aa, Influenza virus
ICAVVMTDG

SEQ ID NO: 472368 - protein, 9 aa, Influenza virus
ICEKLEQSG

SEQ ID NO: 472369 - protein, 9 aa, Influenza virus
ICFMYSDFH

SEQ ID NO: 472370 - protein, 9 aa, Influenza virus
ICIAWSSSS

SEQ ID NO: 472371 - protein, 9 aa, Influenza virus
ICIDFRDMR

SEQ ID NO: 472372 - protein, 9 aa, Influenza virus
ICIGHHANN

SEQ ID NO: 472373 - protein, 9 aa, Influenza virus
ICIGYHANN

SEQ ID NO: 472374 - protein, 9 aa, Influenza virus
ICIGYHSNN

SEQ ID NO: 472375 - protein, 9 aa, Influenza virus
ICIGYLSNN

SEQ ID NO: 472376 - protein, 9 aa, Influenza virus
ICIGYLSTN

SEQ ID NO: 472377 - protein, 9 aa, Influenza virus
ICIGYMSNN

SEQ ID NO: 472378 - protein, 9 aa, Influenza virus
ICIGYQSNN

SEQ ID NO: 472379 - protein, 9 aa, Influenza virus
ICIGYQTNN

SEQ ID NO: 472380 - protein, 9 aa, Influenza virus
ICIKNGNMQ

SEQ ID NO: 472381 - protein, 9 aa, Influenza virus
ICIKNGNMR

SEQ ID NO: 472382 - protein, 9 aa, Influenza virus
ICILDQNFR

SEQ ID NO: 472383 - protein, 9 aa, Influenza virus
ICINGTCTV

SEQ ID NO: 472384 - protein, 9 aa, Influenza virus
ICIQGNNDN

SEQ ID NO: 472385 - protein, 9 aa, Influenza virus
ICISGPNNN

SEQ ID NO: 472386 - protein, 9 aa, Influenza virus
ICKAAIGLR

SEQ ID NO: 472387 - protein, 9 aa, Influenza virus
ICKAALGLR

SEQ ID NO: 472388 - protein, 9 aa, Influenza virus
ICKAAMGLK

SEQ ID NO: 472389 - protein, 9 aa, Influenza virus
ICKAAMGLR

SEQ ID NO: 472390 - protein, 9 aa, Influenza virus
ICKAAMGMR

SEQ ID NO: 472391 - protein, 9 aa, Influenza virus
ICKLVGINM

SEQ ID NO: 472392 - protein, 9 aa, Influenza virus
ICKPYIGKC

SEQ ID NO: 472393 - protein, 9 aa, Influenza virus
ICLGHHAIP

SEQ ID NO: 472394 - protein, 9 aa, Influenza virus
ICLGHHAVA

SEQ ID NO: 472395 - protein, 9 aa, Influenza virus
ICLGHHAVE

SEQ ID NO: 472396 - protein, 9 aa, Influenza virus
ICLGHHAVP

SEQ ID NO: 472397 - protein, 9 aa, Influenza virus
ICLGHHAVS

SEQ ID NO: 472398 - protein, 9 aa, Influenza virus
ICLGHHAVT

SEQ ID NO: 472399 - protein, 9 aa, Influenza virus
ICMKNGNMQ

SEQ ID NO: 472400 - protein, 9 aa, Influenza virus
ICMSGPNDN

SEQ ID NO: 472401 - protein, 9 aa, Influenza virus
ICMSGPNNN

SEQ ID NO: 472402 - protein, 9 aa, Influenza virus
ICNSNAITR

SEQ ID NO: 472403 - protein, 9 aa, Influenza virus
ICPVVFTDG

SEQ ID NO: 472404 - protein, 9 aa, Influenza virus
ICPVVMTDG

SEQ ID NO: 472405 - protein, 9 aa, Influenza virus
ICQMEKIVL

SEQ ID NO: 472406 - protein, 9 aa, Influenza virus
ICRDNWKGA

SEQ ID NO: 472407 - protein, 9 aa, Influenza virus
ICRDNWKGS

SEQ ID NO: 472408 - protein, 9 aa, Influenza virus
ICRDNWRGA

SEQ ID NO: 472409 - protein, 9 aa, Influenza virus
ICRDNWTGT

SEQ ID NO: 472410 - protein, 9 aa, Influenza virus
ICSCIASSL

SEQ ID NO: 472411 - protein, 9 aa, Influenza virus
ICSGFFGDN

SEQ ID NO: 472412 - protein, 9 aa, Influenza virus
ICSGIFGDN

SEQ ID NO: 472413 - protein, 9 aa, Influenza virus
ICSGLVGDT

SEQ ID NO: 472414 - protein, 9 aa, Influenza virus
ICSGVFGDN

SEQ ID NO: 472415 - protein, 9 aa, Influenza virus
ICSGVFGDS

SEQ ID NO: 472416 - protein, 9 aa, Influenza virus
ICSGVFGDT

SEQ ID NO: 472417 - protein, 9 aa, Influenza virus
ICSGVLGDN

SEQ ID NO: 472418 - protein, 9 aa, Influenza virus
ICSKFHSDT

SEQ ID NO: 472419 - protein, 9 aa, Influenza virus
ICSPVLTDN

SEQ ID NO: 472420 - protein, 9 aa, Influenza virus
ICTCRDNWQ

SEQ ID NO: 472421 - protein, 9 aa, Influenza virus
ICTGILTDT

SEQ ID NO: 472422 - protein, 9 aa, Influenza virus
ICTGVLTDT

SEQ ID NO: 472423 - protein, 9 aa, Influenza virus
ICTHLEICF

SEQ ID NO: 472424 - protein, 9 aa, Influenza virus
ICTHLEVCF

SEQ ID NO: 472425 - protein, 9 aa, Influenza virus
ICTHMEVCF

SEQ ID NO: 472426 - protein, 9 aa, Influenza virus
ICTVVMTDG

SEQ ID NO: 472427 - protein, 9 aa, Influenza virus
ICVAWSSSS

SEQ ID NO: 472428 - protein, 9 aa, Influenza virus
ICVAWSSTS

SEQ ID NO: 472429 - protein, 9 aa, Influenza virus
ICVCRDNWH

SEQ ID NO: 472430 - protein, 9 aa, Influenza virus
ICVGWSSTS

SEQ ID NO: 472431 - protein, 9 aa, Influenza virus
ICVGWSSTT

SEQ ID NO: 472432 - protein, 9 aa, Influenza virus
ICVGYHANN

SEQ ID NO: 472433 - protein, 9 aa, Influenza virus
ICVGYHSNN

SEQ ID NO: 472434 - protein, 9 aa, Influenza virus
ICVGYLSTN

SEQ ID NO: 472435 - protein, 9 aa, Influenza virus
ICVKNGNHA

SEQ ID NO: 472436 - protein, 9 aa, Influenza virus
ICVKNGNMQ

SEQ ID NO: 472437 - protein, 9 aa, Influenza virus
ICVKNGNMR

SEQ ID NO: 472438 - protein, 9 aa, Influenza virus
ICVQGNNDN

SEQ ID NO: 472439 - protein, 9 aa, Influenza virus
ICVQGNNKN

SEQ ID NO: 472440 - protein, 9 aa, Influenza virus
ICVQGNNNN

SEQ ID NO: 472441 - protein, 9 aa, Influenza virus
ICVSGPNNN

SEQ ID NO: 472442 - protein, 9 aa, Influenza virus
ICVTGDDRN

SEQ ID NO: 472443 - protein, 9 aa, Influenza virus
ICVVAVTDG

SEQ ID NO: 472444 - protein, 9 aa, Influenza virus
ICYPGKFTN

SEQ ID NO: 472445 - protein, 9 aa, Influenza virus
ICYPGRFTN

SEQ ID NO: 472446 - protein, 9 aa, Influenza virus
ICYPGSIEN

SEQ ID NO: 472447 - protein, 9 aa, Influenza virus
ICYPGSVEN

SEQ ID NO: 472448 - protein, 9 aa, Influenza virus
IDAGDGCFE

SEQ ID NO: 472449 - protein, 9 aa, Influenza virus
IDAGNGCFD

SEQ ID NO: 472450 - protein, 9 aa, Influenza virus
IDALLGDPH

SEQ ID NO: 472451 - protein, 9 aa, Influenza virus
IDALLGDPQ

SEQ ID NO: 472452 - protein, 9 aa, Influenza virus
IDARIDFES

SEQ ID NO: 472453 - protein, 9 aa, Influenza virus
IDARVDFES

SEQ ID NO: 472454 - protein, 9 aa, Influenza virus
IDAVKLSSG

SEQ ID NO: 472455 - protein, 9 aa, Influenza virus
IDDAVTDIW

SEQ ID NO: 472456 - protein, 9 aa, Influenza virus
IDDAVTDVW

SEQ ID NO: 472457 - protein, 9 aa, Influenza virus
IDDQIEDLW

SEQ ID NO: 472458 - protein, 9 aa, Influenza virus
IDDQIEELW

SEQ ID NO: 472459 - protein, 9 aa, Influenza virus
IDDQIEGLW

SEQ ID NO: 472460 - protein, 9 aa, Influenza virus
IDDQIENLW

SEQ ID NO: 472461 - protein, 9 aa, Influenza virus
IDDQIIDIW

SEQ ID NO: 472462 - protein, 9 aa, Influenza virus
IDDQITDIW

SEQ ID NO: 472463 - protein, 9 aa, Influenza virus
IDDQVTDIW

SEQ ID NO: 472464 - protein, 9 aa, Influenza virus
IDECRTFFL

SEQ ID NO: 472465 - protein, 9 aa, Influenza virus
IDEESRARI

SEQ ID NO: 472466 - protein, 9 aa, Influenza virus
IDEGDGCFN

SEQ ID NO: 472467 - protein, 9 aa, Influenza virus
IDEGDGCFS

SEQ ID NO: 472468 - protein, 9 aa, Influenza virus
IDEGNGCFE

SEQ ID NO: 472469 - protein, 9 aa, Influenza virus
IDEITTKIN

SEQ ID NO: 472470 - protein, 9 aa, Influenza virus
IDESCEGEC

SEQ ID NO: 472471 - protein, 9 aa, Influenza virus
IDFHWMLLD

SEQ ID NO: 472472 - protein, 9 aa, Influenza virus
IDFRDMRKN

SEQ ID NO: 472473 - protein, 9 aa, Influenza virus
IDGFEPNGC

SEQ ID NO: 472474 - protein, 9 aa, Influenza virus
IDGITNKIN

SEQ ID NO: 472475 - protein, 9 aa, Influenza virus
IDGITNKVN

SEQ ID NO: 472476 - protein, 9 aa, Influenza virus
IDGKAPISL

SEQ ID NO: 472477 - protein, 9 aa, Influenza virus
IDGTCTVVM

SEQ ID NO: 472478 - protein, 9 aa, Influenza virus
IDGVTNKVN

SEQ ID NO: 472479 - protein, 9 aa, Influenza virus
IDGWTTANS

SEQ ID NO: 472480 - protein, 9 aa, Influenza virus
IDGWYGFHH

SEQ ID NO: 472481 - protein, 9 aa, Influenza virus
IDGWYGFKH

SEQ ID NO: 472482 - protein, 9 aa, Influenza virus
IDGWYGFRH

SEQ ID NO: 472483 - protein, 9 aa, Influenza virus
IDGWYGYHH

SEQ ID NO: 472484 - protein, 9 aa, Influenza virus
IDGWYGYKH

SEQ ID NO: 472485 - protein, 9 aa, Influenza virus
IDGWYGYRH

SEQ ID NO: 472486 - protein, 9 aa, Influenza virus
IDIMQNKLN

SEQ ID NO: 472487 - protein, 9 aa, Influenza virus
IDIWAYNAE

SEQ ID NO: 472488 - protein, 9 aa, Influenza virus
IDIWTYNAE

SEQ ID NO: 472489 - protein, 9 aa, Influenza virus
IDIYCICRD

SEQ ID NO: 472490 - protein, 9 aa, Influenza virus
IDKEPMGFR

SEQ ID NO: 472491 - protein, 9 aa, Influenza virus
IDKESMGFR

SEQ ID NO: 472492 - protein, 9 aa, Influenza virus
IDKICLGHH

SEQ ID NO: 472493 - protein, 9 aa, Influenza virus
IDKINGKLN

SEQ ID NO: 472494 - protein, 9 aa, Influenza virus
IDKITNKIN

SEQ ID NO: 472495 - protein, 9 aa, Influenza virus
IDKITNKVN

SEQ ID NO: 472496 - protein, 9 aa, Influenza virus
IDKMNGNYD

SEQ ID NO: 472497 - protein, 9 aa, Influenza virus
IDKMNTQFE

SEQ ID NO: 472498 - protein, 9 aa, Influenza virus
IDKMNTRFE

SEQ ID NO: 472499 - protein, 9 aa, Influenza virus
IDKNALGDC

SEQ ID NO: 472500 - protein, 9 aa, Influenza virus
IDKNALGEC

SEQ ID NO: 472501 - protein, 9 aa, Influenza virus
IDKTNQQFE

SEQ ID NO: 472502 - protein, 9 aa, Influenza virus
IDKVCTKGK

SEQ ID NO: 472503 - protein, 9 aa, Influenza virus
IDLADSEMD

SEQ ID NO: 472504 - protein, 9 aa, Influenza virus
IDLADSEMK

SEQ ID NO: 472505 - protein, 9 aa, Influenza virus
IDLADSEML

SEQ ID NO: 472506 - protein, 9 aa, Influenza virus
IDLADSEMN

SEQ ID NO: 472507 - protein, 9 aa, Influenza virus
IDLADSEMS

SEQ ID NO: 472508 - protein, 9 aa, Influenza virus
IDLGQCGLL

SEQ ID NO: 472509 - protein, 9 aa, Influenza virus
IDLTDAEMN

SEQ ID NO: 472510 - protein, 9 aa, Influenza virus
IDLTDSEMN

SEQ ID NO: 472511 - protein, 9 aa, Influenza virus
IDLTDSEMS

SEQ ID NO: 472512 - protein, 9 aa, Influenza virus
IDLTNSEMN

SEQ ID NO: 472513 - protein, 9 aa, Influenza virus
IDLVETNHT

SEQ ID NO: 472514 - protein, 9 aa, Influenza virus
IDLWSYNAE

SEQ ID NO: 472515 - protein, 9 aa, Influenza virus
IDLWSYNAG

SEQ ID NO: 472516 - protein, 9 aa, Influenza virus
IDMADSEML

SEQ ID NO: 472517 - protein, 9 aa, Influenza virus
IDMADSTML

SEQ ID NO: 472518 - protein, 9 aa, Influenza virus
IDMTDSEMN

SEQ ID NO: 472519 - protein, 9 aa, Influenza virus
IDNDNWSGY

SEQ ID NO: 472520 - protein, 9 aa, Influenza virus
IDNEFIEVE

SEQ ID NO: 472521 - protein, 9 aa, Influenza virus
IDNEFNEIE

SEQ ID NO: 472522 - protein, 9 aa, Influenza virus
IDNEFNEVE

SEQ ID NO: 472523 - protein, 9 aa, Influenza virus
IDNEFSEIE

SEQ ID NO: 472524 - protein, 9 aa, Influenza virus
IDNEFSEVE

SEQ ID NO: 472525 - protein, 9 aa, Influenza virus
IDNEFTEIE

SEQ ID NO: 472526 - protein, 9 aa, Influenza virus
IDNEFTEVE

SEQ ID NO: 472527 - protein, 9 aa, Influenza virus
IDNGDGCFE

SEQ ID NO: 472528 - protein, 9 aa, Influenza virus
IDNMQNKLN

SEQ ID NO: 472529 - protein, 9 aa, Influenza virus
IDNMQNRLN

SEQ ID NO: 472530 - protein, 9 aa, Influenza virus
IDNNNWSGY

SEQ ID NO: 472531 - protein, 9 aa, Influenza virus
IDPKGLFGA

SEQ ID NO: 472532 - protein, 9 aa, Influenza virus
IDPVELSSG

SEQ ID NO: 472533 - protein, 9 aa, Influenza virus
IDPVKLSGG

SEQ ID NO: 472534 - protein, 9 aa, Influenza virus
IDPVKLSSG

SEQ ID NO: 472535 - protein, 9 aa, Influenza virus
IDQADSEMN

SEQ ID NO: 472536 - protein, 9 aa, Influenza virus
IDQINGKLN

SEQ ID NO: 472537 - protein, 9 aa, Influenza virus
IDQITGKLN

SEQ ID NO: 472538 - protein, 9 aa, Influenza virus
IDQITRKLN

SEQ ID NO: 472539 - protein, 9 aa, Influenza virus
IDQITTKIN

SEQ ID NO: 472540 - protein, 9 aa, Influenza virus
IDQSLIIAA

SEQ ID NO: 472541 - protein, 9 aa, Influenza virus
IDQVKLSSG

SEQ ID NO: 472542 - protein, 9 aa, Influenza virus
IDQVTGKLN

SEQ ID NO: 472543 - protein, 9 aa, Influenza virus
IDRFLRVKD

SEQ ID NO: 472544 - protein, 9 aa, Influenza virus
IDRFLRVRD

SEQ ID NO: 472545 - protein, 9 aa, Influenza virus
IDRITTKIN

SEQ ID NO: 472546 - protein, 9 aa, Influenza virus
IDRNAIGDC

SEQ ID NO: 472547 - protein, 9 aa, Influenza virus
IDRNALGDC

SEQ ID NO: 472548 - protein, 9 aa, Influenza virus
IDRSFRPNI

SEQ ID NO: 472549 - protein, 9 aa, Influenza virus
IDRTNHQFE

SEQ ID NO: 472550 - protein, 9 aa, Influenza virus
IDSGYVCSG

SEQ ID NO: 472551 - protein, 9 aa, Influenza virus
IDSIGSWSQ

SEQ ID NO: 472552 - protein, 9 aa, Influenza virus
IDSLLGDPH

SEQ ID NO: 472553 - protein, 9 aa, Influenza virus
IDSNYVCSG

SEQ ID NO: 472554 - protein, 9 aa, Influenza virus
IDSPNHAKS

SEQ ID NO: 472555 - protein, 9 aa, Influenza virus
IDSRAVGKC

SEQ ID NO: 472556 - protein, 9 aa, Influenza virus
IDSSYICSG

SEQ ID NO: 472557 - protein, 9 aa, Influenza virus
IDSSYLCSG

SEQ ID NO: 472558 - protein, 9 aa, Influenza virus
IDSSYMCSG

SEQ ID NO: 472559 - protein, 9 aa, Influenza virus
IDSSYVCSG

SEQ ID NO: 472560 - protein, 9 aa, Influenza virus
IDSTDSEMN

SEQ ID NO: 472561 - protein, 9 aa, Influenza virus
IDSVKLSSG

SEQ ID NO: 472562 - protein, 9 aa, Influenza virus
IDSWAVGRC

SEQ ID NO: 472563 - protein, 9 aa, Influenza virus
IDTGDGCFE

SEQ ID NO: 472564 - protein, 9 aa, Influenza virus
IDTGKGCFD

SEQ ID NO: 472565 - protein, 9 aa, Influenza virus
IDTGNGCFD

SEQ ID NO: 472566 - protein, 9 aa, Influenza virus
IDTILERNV

SEQ ID NO: 472567 - protein, 9 aa, Influenza virus
IDTIMEKNV

SEQ ID NO: 472568 - protein, 9 aa, Influenza virus
IDTLTETGV

SEQ ID NO: 472569 - protein, 9 aa, Influenza virus
IDTNKTFQN

SEQ ID NO: 472570 - protein, 9 aa, Influenza virus
IDVTDSEMD

SEQ ID NO: 472571 - protein, 9 aa, Influenza virus
IDVTDSEMN

SEQ ID NO: 472572 - protein, 9 aa, Influenza virus
IDVTDSEMS

SEQ ID NO: 472573 - protein, 9 aa, Influenza virus
IDVWTYNAE

SEQ ID NO: 472574 - protein, 9 aa, Influenza virus
IDVYCICRD

SEQ ID NO: 472575 - protein, 9 aa, Influenza virus
IDVYCVCRD

SEQ ID NO: 472576 - protein, 9 aa, Influenza virus
IEAESSIKE

SEQ ID NO: 472577 - protein, 9 aa, Influenza virus
IEAESSVKE

SEQ ID NO: 472578 - protein, 9 aa, Influenza virus
IEAESSVRE

SEQ ID NO: 472579 - protein, 9 aa, Influenza virus
IEAMASQGT

SEQ ID NO: 472580 - protein, 9 aa, Influenza virus
IEAMATQGT

SEQ ID NO: 472581 - protein, 9 aa, Influenza virus
IEARGLFGA

SEQ ID NO: 472582 - protein, 9 aa, Influenza virus
IEAVIYGNP

SEQ ID NO: 472583 - protein, 9 aa, Influenza virus
IECIGWSST

SEQ ID NO: 472584 - protein, 9 aa, Influenza virus
IECVCRDNW

SEQ ID NO: 472585 - protein, 9 aa, Influenza virus
IECVGWSST

SEQ ID NO: 472586 - protein, 9 aa, Influenza virus
IEDLIFLAR

SEQ ID NO: 472587 - protein, 9 aa, Influenza virus
IEDLIFLTR

SEQ ID NO: 472588 - protein, 9 aa, Influenza virus
IEDLIFMAR

SEQ ID NO: 472589 - protein, 9 aa, Influenza virus
IEDLIFSAR

SEQ ID NO: 472590 - protein, 9 aa, Influenza virus
IEDLTFLAR

SEQ ID NO: 472591 - protein, 9 aa, Influenza virus
IEDLWAYNA

SEQ ID NO: 472592 - protein, 9 aa, Influenza virus
IEDPAAPHG

SEQ ID NO: 472593 - protein, 9 aa, Influenza virus
IEDPDHEGE

SEQ ID NO: 472594 - protein, 9 aa, Influenza virus
IEDPGAPHG

SEQ ID NO: 472595 - protein, 9 aa, Influenza virus
IEDPNAPHK

SEQ ID NO: 472596 - protein, 9 aa, Influenza virus
IEDPNAPNK

SEQ ID NO: 472597 - protein, 9 aa, Influenza virus
IEDPNHEGE

SEQ ID NO: 472598 - protein, 9 aa, Influenza virus
IEDPSAPHG

SEQ ID NO: 472599 - protein, 9 aa, Influenza virus
IEDPSAPHR

SEQ ID NO: 472600 - protein, 9 aa, Influenza virus
IEDPSHEGE

SEQ ID NO: 472601 - protein, 9 aa, Influenza virus
IEDPTAPHG

SEQ ID NO: 472602 - protein, 9 aa, Influenza virus
IEDQITDIW

SEQ ID NO: 472603 - protein, 9 aa, Influenza virus
IEECLINDP

SEQ ID NO: 472604 - protein, 9 aa, Influenza virus
IEECPCYGH

SEQ ID NO: 472605 - protein, 9 aa, Influenza virus
IEECSCYGA

SEQ ID NO: 472606 - protein, 9 aa, Influenza virus
IEECSCYGE

SEQ ID NO: 472607 - protein, 9 aa, Influenza virus
IEECSCYGH

SEQ ID NO: 472608 - protein, 9 aa, Influenza virus
IEECSCYGK

SEQ ID NO: 472609 - protein, 9 aa, Influenza virus
IEECSCYGS

SEQ ID NO: 472610 - protein, 9 aa, Influenza virus
IEECSCYGV

SEQ ID NO: 472611 - protein, 9 aa, Influenza virus
IEECSCYPN

SEQ ID NO: 472612 - protein, 9 aa, Influenza virus
IEECSCYPQ

SEQ ID NO: 472613 - protein, 9 aa, Influenza virus
IEECSCYPR

SEQ ID NO: 472614 - protein, 9 aa, Influenza virus
IEEGINQLS

SEQ ID NO: 472615 - protein, 9 aa, Influenza virus
IEEGSIGKV

SEQ ID NO: 472616 - protein, 9 aa, Influenza virus
IEELWAYNA

SEQ ID NO: 472617 - protein, 9 aa, Influenza virus
IEERINHLS

SEQ ID NO: 472618 - protein, 9 aa, Influenza virus
IEERINQLS

SEQ ID NO: 472619 - protein, 9 aa, Influenza virus
IEEWSCYGH

SEQ ID NO: 472620 - protein, 9 aa, Influenza virus
IEEYGKGRI

SEQ ID NO: 472621 - protein, 9 aa, Influenza virus
IEEYGRGRI

SEQ ID NO: 472622 - protein, 9 aa, Influenza virus
IEFDEIGED

SEQ ID NO: 472623 - protein, 9 aa, Influenza virus
IEFEPFQSL

SEQ ID NO: 472624 - protein, 9 aa, Influenza virus
IEGGWCGMI

SEQ ID NO: 472625 - protein, 9 aa, Influenza virus
IEGGWPGLI

SEQ ID NO: 472626 - protein, 9 aa, Influenza virus
IEGGWPGLV

SEQ ID NO: 472627 - protein, 9 aa, Influenza virus
IEGGWQGLV

SEQ ID NO: 472628 - protein, 9 aa, Influenza virus
IEGGWQGMI

SEQ ID NO: 472629 - protein, 9 aa, Influenza virus
IEGGWQGMV

SEQ ID NO: 472630 - protein, 9 aa, Influenza virus
IEGGWSGLI

SEQ ID NO: 472631 - protein, 9 aa, Influenza virus
IEGGWSGLV

SEQ ID NO: 472632 - protein, 9 aa, Influenza virus
IEGGWSGMI

SEQ ID NO: 472633 - protein, 9 aa, Influenza virus
IEGGWTGLI

SEQ ID NO: 472634 - protein, 9 aa, Influenza virus
IEGGWTGMI

SEQ ID NO: 472635 - protein, 9 aa, Influenza virus
IEGGWTGMV

SEQ ID NO: 472636 - protein, 9 aa, Influenza virus
IEGICYPGS

SEQ ID NO: 472637 - protein, 9 aa, Influenza virus
IEGIKLKSE

SEQ ID NO: 472638 - protein, 9 aa, Influenza virus
IEGIKLKTE

SEQ ID NO: 472639 - protein, 9 aa, Influenza virus
IEGKLSQMS

SEQ ID NO: 472640 - protein, 9 aa, Influenza virus
IEGLIYGNP

SEQ ID NO: 472641 - protein, 9 aa, Influenza virus
IEGLVYGNP

SEQ ID NO: 472642 - protein, 9 aa, Influenza virus
IEGLWAYNA

SEQ ID NO: 472643 - protein, 9 aa, Influenza virus
IEGRIQDLE

SEQ ID NO: 472644 - protein, 9 aa, Influenza virus
IEGRVQDLE

SEQ ID NO: 472645 - protein, 9 aa, Influenza virus
IEGRWPGLV

SEQ ID NO: 472646 - protein, 9 aa, Influenza virus
IEGWVVVAK

SEQ ID NO: 472647 - protein, 9 aa, Influenza virus
IEHIASIRR

SEQ ID NO: 472648 - protein, 9 aa, Influenza virus
IEHIASMRR

SEQ ID NO: 472649 - protein, 9 aa, Influenza virus
IEHQIGNVI

SEQ ID NO: 472650 - protein, 9 aa, Influenza virus
IEHQISNVI

SEQ ID NO: 472651 - protein, 9 aa, Influenza virus
IEHVASMRR

SEQ ID NO: 472652 - protein, 9 aa, Influenza virus
IEIGVTRRE

SEQ ID NO: 472653 - protein, 9 aa, Influenza virus
IEIITIGSI

SEQ ID NO: 472654 - protein, 9 aa, Influenza virus
IEIMASQGT

SEQ ID NO: 472655 - protein, 9 aa, Influenza virus
IEIPSWAGN

SEQ ID NO: 472656 - protein, 9 aa, Influenza virus
IEIWSYNAE

SEQ ID NO: 472657 - protein, 9 aa, Influenza virus
IEKDNAVRF

SEQ ID NO: 472658 - protein, 9 aa, Influenza virus
IEKEFEQVE

SEQ ID NO: 472659 - protein, 9 aa, Influenza virus
IEKEFGQVE

SEQ ID NO: 472660 - protein, 9 aa, Influenza virus
IEKEFSEIE

SEQ ID NO: 472661 - protein, 9 aa, Influenza virus
IEKEFSEVE

SEQ ID NO: 472662 - protein, 9 aa, Influenza virus
IEKIEKIRP

SEQ ID NO: 472663 - protein, 9 aa, Influenza virus
IEKINTQFE

SEQ ID NO: 472664 - protein, 9 aa, Influenza virus
IEKIRNGTY

SEQ ID NO: 472665 - protein, 9 aa, Influenza virus
IEKITNKVN

SEQ ID NO: 472666 - protein, 9 aa, Influenza virus
IEKMNGNYD

SEQ ID NO: 472667 - protein, 9 aa, Influenza virus
IEKMNIQFE

SEQ ID NO: 472668 - protein, 9 aa, Influenza virus
IEKMNIQFT

SEQ ID NO: 472669 - protein, 9 aa, Influenza virus
IEKMNTQFE

SEQ ID NO: 472670 - protein, 9 aa, Influenza virus
IEKMNTQFG

SEQ ID NO: 472671 - protein, 9 aa, Influenza virus
IEKMNTQFT

SEQ ID NO: 472672 - protein, 9 aa, Influenza virus
IEKMNTQSE

SEQ ID NO: 472673 - protein, 9 aa, Influenza virus
IEKMVLSAF

SEQ ID NO: 472674 - protein, 9 aa, Influenza virus
IEKNALGDC

SEQ ID NO: 472675 - protein, 9 aa, Influenza virus
IEKQIGNVI

SEQ ID NO: 472676 - protein, 9 aa, Influenza virus
IEKRINQLS

SEQ ID NO: 472677 - protein, 9 aa, Influenza virus
IEKTNDKYH

SEQ ID NO: 472678 - protein, 9 aa, Influenza virus
IEKTNEKFH

SEQ ID NO: 472679 - protein, 9 aa, Influenza virus
IEKTNEKYH

SEQ ID NO: 472680 - protein, 9 aa, Influenza virus
IEKTNKQFE

SEQ ID NO: 472681 - protein, 9 aa, Influenza virus
IEKTNQQFE

SEQ ID NO: 472682 - protein, 9 aa, Influenza virus
IEKTNQQFK

SEQ ID NO: 472683 - protein, 9 aa, Influenza virus
IEKTNTEFE

SEQ ID NO: 472684 - protein, 9 aa, Influenza virus
IEKTNTQFE

SEQ ID NO: 472685 - protein, 9 aa, Influenza virus
IEKTSWSYI

SEQ ID NO: 472686 - protein, 9 aa, Influenza virus
IEKVRNGTY

SEQ ID NO: 472687 - protein, 9 aa, Influenza virus
IEKYGSGRI

SEQ ID NO: 472688 - protein, 9 aa, Influenza virus
IEKYGTGRI

SEQ ID NO: 472689 - protein, 9 aa, Influenza virus
IELAEKAMK

SEQ ID NO: 472690 - protein, 9 aa, Influenza virus
IELDEIGED

SEQ ID NO: 472691 - protein, 9 aa, Influenza virus
IELIRGKPN

SEQ ID NO: 472692 - protein, 9 aa, Influenza virus
IELIRGRPK

SEQ ID NO: 472693 - protein, 9 aa, Influenza virus
IELIRGRPN

SEQ ID NO: 472694 - protein, 9 aa, Influenza virus
IENDRTLDL

SEQ ID NO: 472695 - protein, 9 aa, Influenza virus
IENGWEGLI

SEQ ID NO: 472696 - protein, 9 aa, Influenza virus
IENGWEGLV

SEQ ID NO: 472697 - protein, 9 aa, Influenza virus
IENGWEGMI

SEQ ID NO: 472698 - protein, 9 aa, Influenza virus
IENGWEGMM

SEQ ID NO: 472699 - protein, 9 aa, Influenza virus
IENGWEGMV

SEQ ID NO: 472700 - protein, 9 aa, Influenza virus
IENGWQGLI

SEQ ID NO: 472701 - protein, 9 aa, Influenza virus
IENLEELRF

SEQ ID NO: 472702 - protein, 9 aa, Influenza virus
IENLNKKID

SEQ ID NO: 472703 - protein, 9 aa, Influenza virus
IENLNKKME

SEQ ID NO: 472704 - protein, 9 aa, Influenza virus
IENLNKKVD

SEQ ID NO: 472705 - protein, 9 aa, Influenza virus
IENLNRKME

SEQ ID NO: 472706 - protein, 9 aa, Influenza virus
IENLNRKVD

SEQ ID NO: 472707 - protein, 9 aa, Influenza virus
IENLQAYQK

SEQ ID NO: 472708 - protein, 9 aa, Influenza virus
IENLWAYNA

SEQ ID NO: 472709 - protein, 9 aa, Influenza virus
IENNVTVTS

SEQ ID NO: 472710 - protein, 9 aa, Influenza virus
IENPSHEGE

SEQ ID NO: 472711 - protein, 9 aa, Influenza virus
IENQEELKS

SEQ ID NO: 472712 - protein, 9 aa, Influenza virus
IENQEELRF

SEQ ID NO: 472713 - protein, 9 aa, Influenza virus
IENQEELRS

SEQ ID NO: 472714 - protein, 9 aa, Influenza virus
IENQHTIDL

SEQ ID NO: 472715 - protein, 9 aa, Influenza virus
IENQKTLDE

SEQ ID NO: 472716 - protein, 9 aa, Influenza virus
IENTYVNKT

SEQ ID NO: 472717 - protein, 9 aa, Influenza virus
IENTYVNNT

SEQ ID NO: 472718 - protein, 9 aa, Influenza virus
IEPKGLFGA

SEQ ID NO: 472719 - protein, 9 aa, Influenza virus
IEPRGLFGA

SEQ ID NO: 472720 - protein, 9 aa, Influenza virus
IEQKVPVTQ

SEQ ID NO: 472721 - protein, 9 aa, Influenza virus
IEQNIPVTQ

SEQ ID NO: 472722 - protein, 9 aa, Influenza virus
IEQNVPVTQ

SEQ ID NO: 472723 - protein, 9 aa, Influenza virus
IEQQIGNVI

SEQ ID NO: 472724 - protein, 9 aa, Influenza virus
IERMVLSAF

SEQ ID NO: 472725 - protein, 9 aa, Influenza virus
IERNALGDC

SEQ ID NO: 472726 - protein, 9 aa, Influenza virus
IERNALGNC

SEQ ID NO: 472727 - protein, 9 aa, Influenza virus
IERPTAVDT

SEQ ID NO: 472728 - protein, 9 aa, Influenza virus
IERQEIVDN

SEQ ID NO: 472729 - protein, 9 aa, Influenza virus
IERRNSSDI

SEQ ID NO: 472730 - protein, 9 aa, Influenza virus
IERTNEKFH

SEQ ID NO: 472731 - protein, 9 aa, Influenza virus
IERTNEKYH

SEQ ID NO: 472732 - protein, 9 aa, Influenza virus
IERTNQQFE

SEQ ID NO: 472733 - protein, 9 aa, Influenza virus
IERVRNGTY

SEQ ID NO: 472734 - protein, 9 aa, Influenza virus
IESEFNEIE

SEQ ID NO: 472735 - protein, 9 aa, Influenza virus
IESEFSEIE

SEQ ID NO: 472736 - protein, 9 aa, Influenza virus
IESEFSETE

SEQ ID NO: 472737 - protein, 9 aa, Influenza virus
IESIIEAES

SEQ ID NO: 472738 - protein, 9 aa, Influenza virus
IESIRNGTY

SEQ ID NO: 472739 - protein, 9 aa, Influenza virus
IESKLSQMS

SEQ ID NO: 472740 - protein, 9 aa, Influenza virus
IESLNKKME

SEQ ID NO: 472741 - protein, 9 aa, Influenza virus
IESMIEAES

SEQ ID NO: 472742 - protein, 9 aa, Influenza virus
IESMVEAES

SEQ ID NO: 472743 - protein, 9 aa, Influenza virus
IESNGNLIA

SEQ ID NO: 472744 - protein, 9 aa, Influenza virus
IESNITVTS

SEQ ID NO: 472745 - protein, 9 aa, Influenza virus
IESNVTVTS

SEQ ID NO: 472746 - protein, 9 aa, Influenza virus
IESRGLFGA

SEQ ID NO: 472747 - protein, 9 aa, Influenza virus
IESVRNGTY

SEQ ID NO: 472748 - protein, 9 aa, Influenza virus
IETGYVCSK

SEQ ID NO: 472749 - protein, 9 aa, Influenza virus
IETNHTGTY

SEQ ID NO: 472750 - protein, 9 aa, Influenza virus
IETTHTGTY

SEQ ID NO: 472751 - protein, 9 aa, Influenza virus
IEVEKQIGN

SEQ ID NO: 472752 - protein, 9 aa, Influenza virus
IEVLHLTQG

SEQ ID NO: 472753 - protein, 9 aa, Influenza virus
IEVTNATEL

SEQ ID NO: 472754 - protein, 9 aa, Influenza virus
IEVVAAQEL

SEQ ID NO: 472755 - protein, 9 aa, Influenza virus
IEVVNATET

SEQ ID NO: 472756 - protein, 9 aa, Influenza virus
IEVVTAQEL

SEQ ID NO: 472757 - protein, 9 aa, Influenza virus
IEVWSYNAE

SEQ ID NO: 472758 - protein, 9 aa, Influenza virus
IEYDAVATT

SEQ ID NO: 472759 - protein, 9 aa, Influenza virus
IEYIASMRR

SEQ ID NO: 472760 - protein, 9 aa, Influenza virus
IEYNGKSLG

SEQ ID NO: 472761 - protein, 9 aa, Influenza virus
IEYQIGNVI

SEQ ID NO: 472762 - protein, 9 aa, Influenza virus
IEYVASMRR

SEQ ID NO: 472763 - protein, 9 aa, Influenza virus
IFENSCIET

SEQ ID NO: 472764 - protein, 9 aa, Influenza virus
IFENSCLET

SEQ ID NO: 472765 - protein, 9 aa, Influenza virus
IFESSCLET

SEQ ID NO: 472766 - protein, 9 aa, Influenza virus
IFFWMCSNG

SEQ ID NO: 472767 - protein, 9 aa, Influenza virus
IFGAIAGFI

SEQ ID NO: 472768 - protein, 9 aa, Influenza virus
IFGCQNGNI

SEQ ID NO: 472769 - protein, 9 aa, Influenza virus
IFGCQNGNV

SEQ ID NO: 472770 - protein, 9 aa, Influenza virus
IFGKDNAIR

SEQ ID NO: 472771 - protein, 9 aa, Influenza virus
IFGKDNAVR

SEQ ID NO: 472772 - protein, 9 aa, Influenza virus
IFGNSCLET

SEQ ID NO: 472773 - protein, 9 aa, Influenza virus
IFGPVHFRN

SEQ ID NO: 472774 - protein, 9 aa, Influenza virus
IFHKCDDDC

SEQ ID NO: 472775 - protein, 9 aa, Influenza virus
IFHKCDDHC

SEQ ID NO: 472776 - protein, 9 aa, Influenza virus
IFHKCDDNC

SEQ ID NO: 472777 - protein, 9 aa, Influenza virus
IFHKCDDQC

SEQ ID NO: 472778 - protein, 9 aa, Influenza virus
IFHKCDNQC

SEQ ID NO: 472779 - protein, 9 aa, Influenza virus
IFHQCDNDC

SEQ ID NO: 472780 - protein, 9 aa, Influenza virus
IFHQCDNNC

SEQ ID NO: 472781 - protein, 9 aa, Influenza virus
IFHRCDDQC

SEQ ID NO: 472782 - protein, 9 aa, Influenza virus
IFIFILLTH

SEQ ID NO: 472783 - protein, 9 aa, Influenza virus
IFIFLLLTH

SEQ ID NO: 472784 - protein, 9 aa, Influenza virus
IFLAMITYI

SEQ ID NO: 472785 - protein, 9 aa, Influenza virus
IFLARSALI

SEQ ID NO: 472786 - protein, 9 aa, Influenza virus
IFLWCKIVT

SEQ ID NO: 472787 - protein, 9 aa, Influenza virus
IFLWGIHHP

SEQ ID NO: 472788 - protein, 9 aa, Influenza virus
IFLWMCSNG

SEQ ID NO: 472789 - protein, 9 aa, Influenza virus
IFLYVRTNG

SEQ ID NO: 472790 - protein, 9 aa, Influenza virus
IFMARSALI

SEQ ID NO: 472791 - protein, 9 aa, Influenza virus
IFMCVKNGN

SEQ ID NO: 472792 - protein, 9 aa, Influenza virus
IFNFILLTH

SEQ ID NO: 472793 - protein, 9 aa, Influenza virus
IFNGAFIAP

SEQ ID NO: 472794 - protein, 9 aa, Influenza virus
IFNMERIKE

SEQ ID NO: 472795 - protein, 9 aa, Influenza virus
IFNSIGNLI

SEQ ID NO: 472796 - protein, 9 aa, Influenza virus
IFQPNIGPR

SEQ ID NO: 472797 - protein, 9 aa, Influenza virus
IFQSGIRMA

SEQ ID NO: 472798 - protein, 9 aa, Influenza virus
IFQSGVRLA

SEQ ID NO: 472799 - protein, 9 aa, Influenza virus
IFQSGVRMA

SEQ ID NO: 472800 - protein, 9 aa, Influenza virus
IFQSGVRVA

SEQ ID NO: 472801 - protein, 9 aa, Influenza virus
IFQSRIRMG

SEQ ID NO: 472802 - protein, 9 aa, Influenza virus
IFRPNIGPR

SEQ ID NO: 472803 - protein, 9 aa, Influenza virus
IFSARSALI

SEQ ID NO: 472804 - protein, 9 aa, Influenza virus
IFSFNGEEM

SEQ ID NO: 472805 - protein, 9 aa, Influenza virus
IFSFTGEEM

SEQ ID NO: 472806 - protein, 9 aa, Influenza virus
IFSHNGGLI

SEQ ID NO: 472807 - protein, 9 aa, Influenza virus
IFSKDNAIR

SEQ ID NO: 472808 - protein, 9 aa, Influenza virus
IFSKDNGIR

SEQ ID NO: 472809 - protein, 9 aa, Influenza virus
IFVIREPFI

SEQ ID NO: 472810 - protein, 9 aa, Influenza virus
IFVIREPFV

SEQ ID NO: 472811 - protein, 9 aa, Influenza virus
IFVMREPFI

SEQ ID NO: 472812 - protein, 9 aa, Influenza virus
IGAIDSSMP

SEQ ID NO: 472813 - protein, 9 aa, Influenza virus
IGAINSSMP

SEQ ID NO: 472814 - protein, 9 aa, Influenza virus
IGAPQLNPI

SEQ ID NO: 472815 - protein, 9 aa, Influenza virus
IGARIGEGQ

SEQ ID NO: 472816 - protein, 9 aa, Influenza virus
IGARPQVNG

SEQ ID NO: 472817 - protein, 9 aa, Influenza virus
IGDCPKYIK

SEQ ID NO: 472818 - protein, 9 aa, Influenza virus
IGDCPKYMN

SEQ ID NO: 472819 - protein, 9 aa, Influenza virus
IGDCPKYVN

SEQ ID NO: 472820 - protein, 9 aa, Influenza virus
IGDGQRSWM

SEQ ID NO: 472821 - protein, 9 aa, Influenza virus
IGEAPSPYN

SEQ ID NO: 472822 - protein, 9 aa, Influenza virus
IGECPKYIK

SEQ ID NO: 472823 - protein, 9 aa, Influenza virus
IGECPKYVK

SEQ ID NO: 472824 - protein, 9 aa, Influenza virus
IGECPKYVR

SEQ ID NO: 472825 - protein, 9 aa, Influenza virus
IGECPRYVK

SEQ ID NO: 472826 - protein, 9 aa, Influenza virus
IGEDIAPIE

SEQ ID NO: 472827 - protein, 9 aa, Influenza virus
IGEDLAPIE

SEQ ID NO: 472828 - protein, 9 aa, Influenza virus
IGEDSDILV

SEQ ID NO: 472829 - protein, 9 aa, Influenza virus
IGEDSDVLV

SEQ ID NO: 472830 - protein, 9 aa, Influenza virus
IGEDVAPIE

SEQ ID NO: 472831 - protein, 9 aa, Influenza virus
IGEGQRSWM

SEQ ID NO: 472832 - protein, 9 aa, Influenza virus
IGENSDVLV

SEQ ID NO: 472833 - protein, 9 aa, Influenza virus
IGERINQLS

SEQ ID NO: 472834 - protein, 9 aa, Influenza virus
IGESSDVLV

SEQ ID NO: 472835 - protein, 9 aa, Influenza virus
IGEVPSPYN

SEQ ID NO: 472836 - protein, 9 aa, Influenza virus
IGEYPVVKG

SEQ ID NO: 472837 - protein, 9 aa, Influenza virus
IGFHFEECS

SEQ ID NO: 472838 - protein, 9 aa, Influenza virus
IGFWMCSNG

SEQ ID NO: 472839 - protein, 9 aa, Influenza virus
IGGFIFGCQ

SEQ ID NO: 472840 - protein, 9 aa, Influenza virus
IGGNSDVLV

SEQ ID NO: 472841 - protein, 9 aa, Influenza virus
IGGSGTNNY

SEQ ID NO: 472842 - protein, 9 aa, Influenza virus
IGGWATANS

SEQ ID NO: 472843 - protein, 9 aa, Influenza virus
IGGWTIANS

SEQ ID NO: 472844 - protein, 9 aa, Influenza virus
IGGWTTANS

SEQ ID NO: 472845 - protein, 9 aa, Influenza virus
IGHHANNST

SEQ ID NO: 472846 - protein, 9 aa, Influenza virus
IGIAADRDS

SEQ ID NO: 472847 - protein, 9 aa, Influenza virus
IGIGNLIFN

SEQ ID NO: 472848 - protein, 9 aa, Influenza virus
IGIGNLVFN

SEQ ID NO: 472849 - protein, 9 aa, Influenza virus
IGISGPDDG

SEQ ID NO: 472850 - protein, 9 aa, Influenza virus
IGISGPDNE

SEQ ID NO: 472851 - protein, 9 aa, Influenza virus
IGISGPDNG

SEQ ID NO: 472852 - protein, 9 aa, Influenza virus
IGISGPDSG

SEQ ID NO: 472853 - protein, 9 aa, Influenza virus
IGISNIGLN

SEQ ID NO: 472854 - protein, 9 aa, Influenza virus
IGISNMSLN

SEQ ID NO: 472855 - protein, 9 aa, Influenza virus
IGISNVGLN

SEQ ID NO: 472856 - protein, 9 aa, Influenza virus
IGISNVVLN

SEQ ID NO: 472857 - protein, 9 aa, Influenza virus
IGISSMVEA

SEQ ID NO: 472858 - protein, 9 aa, Influenza virus
IGITGPDAT

SEQ ID NO: 472859 - protein, 9 aa, Influenza virus
IGITVIKNN

SEQ ID NO: 472860 - protein, 9 aa, Influenza virus
IGKCNDPYP

SEQ ID NO: 472861 - protein, 9 aa, Influenza virus
IGKCPKYIP

SEQ ID NO: 472862 - protein, 9 aa, Influenza virus
IGKCPKYIS

SEQ ID NO: 472863 - protein, 9 aa, Influenza virus
IGKCPKYVK

SEQ ID NO: 472864 - protein, 9 aa, Influenza virus
IGKCPRYIP

SEQ ID NO: 472865 - protein, 9 aa, Influenza virus
IGKCPRYVK

SEQ ID NO: 472866 - protein, 9 aa, Influenza virus
IGKFYIQMC

SEQ ID NO: 472867 - protein, 9 aa, Influenza virus
IGKITNKVN

SEQ ID NO: 472868 - protein, 9 aa, Influenza virus
IGKMNTQFE

SEQ ID NO: 472869 - protein, 9 aa, Influenza virus
IGKTNEKFH

SEQ ID NO: 472870 - protein, 9 aa, Influenza virus
IGKTNQQFE

SEQ ID NO: 472871 - protein, 9 aa, Influenza virus
IGKTSWSYI

SEQ ID NO: 472872 - protein, 9 aa, Influenza virus
IGKVCRTLL

SEQ ID NO: 472873 - protein, 9 aa, Influenza virus
IGLLLQIIS

SEQ ID NO: 472874 - protein, 9 aa, Influenza virus
IGLLLQITS

SEQ ID NO: 472875 - protein, 9 aa, Influenza virus
IGLNVSLHL

SEQ ID NO: 472876 - protein, 9 aa, Influenza virus
IGLREQKQE

SEQ ID NO: 472877 - protein, 9 aa, Influenza virus
IGLRISSSF

SEQ ID NO: 472878 - protein, 9 aa, Influenza virus
IGLRNTPSI

SEQ ID NO: 472879 - protein, 9 aa, Influenza virus
IGLRNVPQA

SEQ ID NO: 472880 - protein, 9 aa, Influenza virus
IGLRNVPQI

SEQ ID NO: 472881 - protein, 9 aa, Influenza virus
IGLRNVPQV

SEQ ID NO: 472882 - protein, 9 aa, Influenza virus
IGLSPNVYQ

SEQ ID NO: 472883 - protein, 9 aa, Influenza virus
IGNCPKYVK

SEQ ID NO: 472884 - protein, 9 aa, Influenza virus
IGNCPKYVN

SEQ ID NO: 472885 - protein, 9 aa, Influenza virus
IGNGCFEFY

SEQ ID NO: 472886 - protein, 9 aa, Influenza virus
IGNLIAPRG

SEQ ID NO: 472887 - protein, 9 aa, Influenza virus
IGNLIFNTV

SEQ ID NO: 472888 - protein, 9 aa, Influenza virus
IGNLVAPRG

SEQ ID NO: 472889 - protein, 9 aa, Influenza virus
IGNLVFNTV

SEQ ID NO: 472890 - protein, 9 aa, Influenza virus
IGNVINWTK

SEQ ID NO: 472891 - protein, 9 aa, Influenza virus
IGNVINWTQ

SEQ ID NO: 472892 - protein, 9 aa, Influenza virus
IGNVINWTR

SEQ ID NO: 472893 - protein, 9 aa, Influenza virus
IGPLLQITS

SEQ ID NO: 472894 - protein, 9 aa, Influenza virus
IGPLSGSAQ

SEQ ID NO: 472895 - protein, 9 aa, Influenza virus
IGPPHCDQF

SEQ ID NO: 472896 - protein, 9 aa, Influenza virus
IGPPQCDKF

SEQ ID NO: 472897 - protein, 9 aa, Influenza virus
IGPPQCDLF

SEQ ID NO: 472898 - protein, 9 aa, Influenza virus
IGPPQCDLH

SEQ ID NO: 472899 - protein, 9 aa, Influenza virus
IGPPQCDQF

SEQ ID NO: 472900 - protein, 9 aa, Influenza virus
IGPPQCDRF

SEQ ID NO: 472901 - protein, 9 aa, Influenza virus
IGPPQCDSH

SEQ ID NO: 472902 - protein, 9 aa, Influenza virus
IGPRALVRG

SEQ ID NO: 472903 - protein, 9 aa, Influenza virus
IGPRNVPAI

SEQ ID NO: 472904 - protein, 9 aa, Influenza virus
IGPRNVPQA

SEQ ID NO: 472905 - protein, 9 aa, Influenza virus
IGPRNVPQV

SEQ ID NO: 472906 - protein, 9 aa, Influenza virus
IGPRPFVRG

SEQ ID NO: 472907 - protein, 9 aa, Influenza virus
IGPRPLIRG

SEQ ID NO: 472908 - protein, 9 aa, Influenza virus
IGPRPLVMG

SEQ ID NO: 472909 - protein, 9 aa, Influenza virus
IGPRPLVRE

SEQ ID NO: 472910 - protein, 9 aa, Influenza virus
IGPRPLVRG

SEQ ID NO: 472911 - protein, 9 aa, Influenza virus
IGQAADLKS

SEQ ID NO: 472912 - protein, 9 aa, Influenza virus
IGQAADYKS

SEQ ID NO: 472913 - protein, 9 aa, Influenza virus
IGQGDIVLV

SEQ ID NO: 472914 - protein, 9 aa, Influenza virus
IGQGDVVLV

SEQ ID NO: 472915 - protein, 9 aa, Influenza virus
IGQSANVYQ

SEQ ID NO: 472916 - protein, 9 aa, Influenza virus
IGQSPNVYQ

SEQ ID NO: 472917 - protein, 9 aa, Influenza virus
IGRFYIQMC

SEQ ID NO: 472918 - protein, 9 aa, Influenza virus
IGRFYVQMC

SEQ ID NO: 472919 - protein, 9 aa, Influenza virus
IGRMTICIQ

SEQ ID NO: 472920 - protein, 9 aa, Influenza virus
IGRMTICVQ

SEQ ID NO: 472921 - protein, 9 aa, Influenza virus
IGRTKSLES

SEQ ID NO: 472922 - protein, 9 aa, Influenza virus
IGRTNQQFE

SEQ ID NO: 472923 - protein, 9 aa, Influenza virus
IGSCASKCH

SEQ ID NO: 472924 - protein, 9 aa, Influenza virus
IGSCESKCH

SEQ ID NO: 472925 - protein, 9 aa, Influenza virus
IGSCISKCH

SEQ ID NO: 472926 - protein, 9 aa, Influenza virus
IGSCTSPCL

SEQ ID NO: 472927 - protein, 9 aa, Influenza virus
IGSCVSKCH

SEQ ID NO: 472928 - protein, 9 aa, Influenza virus
IGSCVSRCH

SEQ ID NO: 472929 - protein, 9 aa, Influenza virus
IGSGFFPDG

SEQ ID NO: 472930 - protein, 9 aa, Influenza virus
IGSIRNETY

SEQ ID NO: 472931 - protein, 9 aa, Influenza virus
IGSIRNGTY

SEQ ID NO: 472932 - protein, 9 aa, Influenza virus
IGSISLTIA

SEQ ID NO: 472933 - protein, 9 aa, Influenza virus
IGSKGDIFV

SEQ ID NO: 472934 - protein, 9 aa, Influenza virus
IGSKGDVFV

SEQ ID NO: 472935 - protein, 9 aa, Influenza virus
IGSKGHVFV

SEQ ID NO: 472936 - protein, 9 aa, Influenza virus
IGSRGDVFI

SEQ ID NO: 472937 - protein, 9 aa, Influenza virus
IGSRGDVFV

SEQ ID NO: 472938 - protein, 9 aa, Influenza virus
IGSRGEVFV

SEQ ID NO: 472939 - protein, 9 aa, Influenza virus
IGSRGHIFV

SEQ ID NO: 472940 - protein, 9 aa, Influenza virus
IGSRGHVFV

SEQ ID NO: 472941 - protein, 9 aa, Influenza virus
IGSRPRVRN

SEQ ID NO: 472942 - protein, 9 aa, Influenza virus
IGSSTYQNN

SEQ ID NO: 472943 - protein, 9 aa, Influenza virus
IGSVSLTIA

SEQ ID NO: 472944 - protein, 9 aa, Influenza virus
IGSVSLTIT

SEQ ID NO: 472945 - protein, 9 aa, Influenza virus
IGSWSHNIL

SEQ ID NO: 472946 - protein, 9 aa, Influenza virus
IGSWSQNIL

SEQ ID NO: 472947 - protein, 9 aa, Influenza virus
IGTAPILGN

SEQ ID NO: 472948 - protein, 9 aa, Influenza virus
IGTAPVLGN

SEQ ID NO: 472949 - protein, 9 aa, Influenza virus
IGTRIGDGQ

SEQ ID NO: 472950 - protein, 9 aa, Influenza virus
IGTSTLNQR

SEQ ID NO: 472951 - protein, 9 aa, Influenza virus
IGVAPSPSN

SEQ ID NO: 472952 - protein, 9 aa, Influenza virus
IGVAPVLGN

SEQ ID NO: 472953 - protein, 9 aa, Influenza virus
IGVAVIKNN

SEQ ID NO: 472954 - protein, 9 aa, Influenza virus
IGVGNLAFN

SEQ ID NO: 472955 - protein, 9 aa, Influenza virus
IGVGNLIFN

SEQ ID NO: 472956 - protein, 9 aa, Influenza virus
IGVGNLVFN

SEQ ID NO: 472957 - protein, 9 aa, Influenza virus
IGVSGPDNG

SEQ ID NO: 472958 - protein, 9 aa, Influenza virus
IGVSNVGLN

SEQ ID NO: 472959 - protein, 9 aa, Influenza virus
IGVTRREIH

SEQ ID NO: 472960 - protein, 9 aa, Influenza virus
IGVTRREVH

SEQ ID NO: 472961 - protein, 9 aa, Influenza virus
IGVTVIKNN

SEQ ID NO: 472962 - protein, 9 aa, Influenza virus
IGVTVIRNN

SEQ ID NO: 472963 - protein, 9 aa, Influenza virus
IGVYQILAI

SEQ ID NO: 472964 - protein, 9 aa, Influenza virus
IGWSSTSCH

SEQ ID NO: 472965 - protein, 9 aa, Influenza virus
IGYHANNSK

SEQ ID NO: 472966 - protein, 9 aa, Influenza virus
IGYHANNST

SEQ ID NO: 472967 - protein, 9 aa, Influenza virus
IGYHSNNST

SEQ ID NO: 472968 - protein, 9 aa, Influenza virus
IGYICSGFF

SEQ ID NO: 472969 - protein, 9 aa, Influenza virus
IGYICSGIF

SEQ ID NO: 472970 - protein, 9 aa, Influenza virus
IGYICSGVF

SEQ ID NO: 472971 - protein, 9 aa, Influenza virus
IGYICSGVL

SEQ ID NO: 472972 - protein, 9 aa, Influenza virus
IGYLSNNAT

SEQ ID NO: 472973 - protein, 9 aa, Influenza virus
IGYLSNNSS

SEQ ID NO: 472974 - protein, 9 aa, Influenza virus
IGYLSNNST

SEQ ID NO: 472975 - protein, 9 aa, Influenza virus
IGYLSTNSS

SEQ ID NO: 472976 - protein, 9 aa, Influenza virus
IGYMSNNST

SEQ ID NO: 472977 - protein, 9 aa, Influenza virus
IGYQSNNST

SEQ ID NO: 472978 - protein, 9 aa, Influenza virus
IGYQTNNST

SEQ ID NO: 472979 - protein, 9 aa, Influenza virus
IGYVCSGIF

SEQ ID NO: 472980 - protein, 9 aa, Influenza virus
IGYVCSGVF

SEQ ID NO: 472981 - protein, 9 aa, Influenza virus
IHDRAAFRG

SEQ ID NO: 472982 - protein, 9 aa, Influenza virus
IHDRIPHRT

SEQ ID NO: 472983 - protein, 9 aa, Influenza virus
IHDRSPFRA

SEQ ID NO: 472984 - protein, 9 aa, Influenza virus
IHDRSPHRT

SEQ ID NO: 472985 - protein, 9 aa, Influenza virus
IHDRSPYRA

SEQ ID NO: 472986 - protein, 9 aa, Influenza virus
IHDRSQFRA

SEQ ID NO: 472987 - protein, 9 aa, Influenza virus
IHDRSQYRA

SEQ ID NO: 472988 - protein, 9 aa, Influenza virus
IHDRSQYRS

SEQ ID NO: 472989 - protein, 9 aa, Influenza virus
IHDRTAFRG

SEQ ID NO: 472990 - protein, 9 aa, Influenza virus
IHDRTPHRT

SEQ ID NO: 472991 - protein, 9 aa, Influenza virus
IHDRTTFRG

SEQ ID NO: 472992 - protein, 9 aa, Influenza virus
IHECRTFFL

SEQ ID NO: 472993 - protein, 9 aa, Influenza virus
IHFESNGNF

SEQ ID NO: 472994 - protein, 9 aa, Influenza virus
IHHPDSETT

SEQ ID NO: 472995 - protein, 9 aa, Influenza virus
IHHPDTEAT

SEQ ID NO: 472996 - protein, 9 aa, Influenza virus
IHHPDTEAV

SEQ ID NO: 472997 - protein, 9 aa, Influenza virus
IHHPDTEEV

SEQ ID NO: 472998 - protein, 9 aa, Influenza virus
IHHPDTETT

SEQ ID NO: 472999 - protein, 9 aa, Influenza virus
IHHPPDAKE

SEQ ID NO: 473000 - protein, 9 aa, Influenza virus
IHHPPDETE

SEQ ID NO: 473001 - protein, 9 aa, Influenza virus
IHHPPDTKE

SEQ ID NO: 473002 - protein, 9 aa, Influenza virus
IHHPPNTKE

SEQ ID NO: 473003 - protein, 9 aa, Influenza virus
IHHPPTSAE

SEQ ID NO: 473004 - protein, 9 aa, Influenza virus
IHHPPTSDE

SEQ ID NO: 473005 - protein, 9 aa, Influenza virus
IHHPPTSNE

SEQ ID NO: 473006 - protein, 9 aa, Influenza virus
IHHPPTTDE

SEQ ID NO: 473007 - protein, 9 aa, Influenza virus
IHHPSSAQE

SEQ ID NO: 473008 - protein, 9 aa, Influenza virus
IHHPSSTKE

SEQ ID NO: 473009 - protein, 9 aa, Influenza virus
IHHPSSTQE

SEQ ID NO: 473010 - protein, 9 aa, Influenza virus
IHIFSFNGE

SEQ ID NO: 473011 - protein, 9 aa, Influenza virus
IHIFSFTGE

SEQ ID NO: 473012 - protein, 9 aa, Influenza virus
IHISPLSGS

SEQ ID NO: 473013 - protein, 9 aa, Influenza virus
IHIYYLEKA

SEQ ID NO: 473014 - protein, 9 aa, Influenza virus
IHKQLTHHM

SEQ ID NO: 473015 - protein, 9 aa, Influenza virus
IHLGDCSFE

SEQ ID NO: 473016 - protein, 9 aa, Influenza virus
IHLTDSEMN

SEQ ID NO: 473017 - protein, 9 aa, Influenza virus
IHPLAIGEC

SEQ ID NO: 473018 - protein, 9 aa, Influenza virus
IHPLTIGEC

SEQ ID NO: 473019 - protein, 9 aa, Influenza virus
IHPLTIGKC

SEQ ID NO: 473020 - protein, 9 aa, Influenza virus
IHQILAIYS

SEQ ID NO: 473021 - protein, 9 aa, Influenza virus
IHSRGLFGA

SEQ ID NO: 473022 - protein, 9 aa, Influenza virus
IHTRGLFGA

SEQ ID NO: 473023 - protein, 9 aa, Influenza virus
IHWTIVKPG

SEQ ID NO: 473024 - protein, 9 aa, Influenza virus
IHYGGIPTD

SEQ ID NO: 473025 - protein, 9 aa, Influenza virus
IHYGGMPTD

SEQ ID NO: 473026 - protein, 9 aa, Influenza virus
IHYGGVPTD

SEQ ID NO: 473027 - protein, 9 aa, Influenza virus
IIAARNIVR

SEQ ID NO: 473028 - protein, 9 aa, Influenza virus
IIAARSIVR

SEQ ID NO: 473029 - protein, 9 aa, Influenza virus
IIAFCGTSG

SEQ ID NO: 473030 - protein, 9 aa, Influenza virus
IIAIGSVSL

SEQ ID NO: 473031 - protein, 9 aa, Influenza virus
IIALLIGIG

SEQ ID NO: 473032 - protein, 9 aa, Influenza virus
IICIQGNND

SEQ ID NO: 473033 - protein, 9 aa, Influenza virus
IICLGHHAV

SEQ ID NO: 473034 - protein, 9 aa, Influenza virus
IICTCRDNW

SEQ ID NO: 473035 - protein, 9 aa, Influenza virus
IICVCRDNW

SEQ ID NO: 473036 - protein, 9 aa, Influenza virus
IIDIWAYNA

SEQ ID NO: 473037 - protein, 9 aa, Influenza virus
IIDKMNGNY

SEQ ID NO: 473038 - protein, 9 aa, Influenza virus
IIDKMNIQF

SEQ ID NO: 473039 - protein, 9 aa, Influenza virus
IIDKMNTQF

SEQ ID NO: 473040 - protein, 9 aa, Influenza virus
IIDKMNTRF

SEQ ID NO: 473041 - protein, 9 aa, Influenza virus
IIDKVNTQF

SEQ ID NO: 473042 - protein, 9 aa, Influenza virus
IIDLADSEM

SEQ ID NO: 473043 - protein, 9 aa, Influenza virus
IIDNDNWSG

SEQ ID NO: 473044 - protein, 9 aa, Influenza virus
IIDNNNWSG

SEQ ID NO: 473045 - protein, 9 aa, Influenza virus
IIDVTDSEM

SEQ ID NO: 473046 - protein, 9 aa, Influenza virus
IIEAESSVK

SEQ ID NO: 473047 - protein, 9 aa, Influenza virus
IIEEYGKGR

SEQ ID NO: 473048 - protein, 9 aa, Influenza virus
IIEEYGRGR

SEQ ID NO: 473049 - protein, 9 aa, Influenza virus
IIEKMNGNY

SEQ ID NO: 473050 - protein, 9 aa, Influenza virus
IIEKMNTQF

SEQ ID NO: 473051 - protein, 9 aa, Influenza virus
IIEKNVTVT

SEQ ID NO: 473052 - protein, 9 aa, Influenza virus
IIEKTNQQF

SEQ ID NO: 473053 - protein, 9 aa, Influenza virus
IIEKYGSGR

SEQ ID NO: 473054 - protein, 9 aa, Influenza virus
IIEKYGTGR

SEQ ID NO: 473055 - protein, 9 aa, Influenza virus
IIENNVTVT

SEQ ID NO: 473056 - protein, 9 aa, Influenza virus
IIERKEGTD

SEQ ID NO: 473057 - protein, 9 aa, Influenza virus
IIERREGAD

SEQ ID NO: 473058 - protein, 9 aa, Influenza virus
IIERREGND

SEQ ID NO: 473059 - protein, 9 aa, Influenza virus
IIERREGSD

SEQ ID NO: 473060 - protein, 9 aa, Influenza virus
IIERREGTD

SEQ ID NO: 473061 - protein, 9 aa, Influenza virus
IIERRNSSD

SEQ ID NO: 473062 - protein, 9 aa, Influenza virus
IIESNVTVT

SEQ ID NO: 473063 - protein, 9 aa, Influenza virus
IIETGYVCS

SEQ ID NO: 473064 - protein, 9 aa, Influenza virus
IIFEANGNL

SEQ ID NO: 473065 - protein, 9 aa, Influenza virus
IIFEATGNL

SEQ ID NO: 473066 - protein, 9 aa, Influenza virus
IIFLWGIHH

SEQ ID NO: 473067 - protein, 9 aa, Influenza virus
IIFNMERIK

SEQ ID NO: 473068 - protein, 9 aa, Influenza virus
IIFNSIGNL

SEQ ID NO: 473069 - protein, 9 aa, Influenza virus
IIFSHNGGL

SEQ ID NO: 473070 - protein, 9 aa, Influenza virus
IIGGFIFGC

SEQ ID NO: 473071 - protein, 9 aa, Influenza virus
IIGISGPDN

SEQ ID NO: 473072 - protein, 9 aa, Influenza virus
IIGISNVGL

SEQ ID NO: 473073 - protein, 9 aa, Influenza virus
IIGKMNTQF

SEQ ID NO: 473074 - protein, 9 aa, Influenza virus
IIGPPQCDL

SEQ ID NO: 473075 - protein, 9 aa, Influenza virus
IIGPPQCDS

SEQ ID NO: 473076 - protein, 9 aa, Influenza virus
IIHISPLSG

SEQ ID NO: 473077 - protein, 9 aa, Influenza virus
IIIAGLSFW

SEQ ID NO: 473078 - protein, 9 aa, Influenza virus
IIIAIGSVS

SEQ ID NO: 473079 - protein, 9 aa, Influenza virus
IIIRMMENA

SEQ ID NO: 473080 - protein, 9 aa, Influenza virus
IIIVVLLYT

SEQ ID NO: 473081 - protein, 9 aa, Influenza virus
IIKGRSHLR

SEQ ID NO: 473082 - protein, 9 aa, Influenza virus
IIKKYTSAR

SEQ ID NO: 473083 - protein, 9 aa, Influenza virus
IIKKYTSGR

SEQ ID NO: 473084 - protein, 9 aa, Influenza virus
IIKLLPFAA

SEQ ID NO: 473085 - protein, 9 aa, Influenza virus
IIKLLPFAS

SEQ ID NO: 473086 - protein, 9 aa, Influenza virus
IILGNPKCD

SEQ ID NO: 473087 - protein, 9 aa, Influenza virus
IILWFSFGA

SEQ ID NO: 473088 - protein, 9 aa, Influenza virus
IILWFSFSI

SEQ ID NO: 473089 - protein, 9 aa, Influenza virus
IILWISFSI

SEQ ID NO: 473090 - protein, 9 aa, Influenza virus
IILWISFSM

SEQ ID NO: 473091 - protein, 9 aa, Influenza virus
IILWVSFSI

SEQ ID NO: 473092 - protein, 9 aa, Influenza virus
IINGALGSP

SEQ ID NO: 473093 - protein, 9 aa, Influenza virus
IINKMNTQF

SEQ ID NO: 473094 - protein, 9 aa, Influenza virus
IINLLIGIS

SEQ ID NO: 473095 - protein, 9 aa, Influenza virus
IINNQNWSG

SEQ ID NO: 473096 - protein, 9 aa, Influenza virus
IINNYHNET

SEQ ID NO: 473097 - protein, 9 aa, Influenza virus
IINNYYNDT

SEQ ID NO: 473098 - protein, 9 aa, Influenza virus
IINNYYNET

SEQ ID NO: 473099 - protein, 9 aa, Influenza virus
IINNYYNKT

SEQ ID NO: 473100 - protein, 9 aa, Influenza virus
IIPSGPLKA

SEQ ID NO: 473101 - protein, 9 aa, Influenza virus
IIPVNNTIY

SEQ ID NO: 473102 - protein, 9 aa, Influenza virus
IIQNEDIPI

SEQ ID NO: 473103 - protein, 9 aa, Influenza virus
IIRALTLNT

SEQ ID NO: 473104 - protein, 9 aa, Influenza virus
IIREPFVSC

SEQ ID NO: 473105 - protein, 9 aa, Influenza virus
IIRESGGID

SEQ ID NO: 473106 - protein, 9 aa, Influenza virus
IIRVGCVIL

SEQ ID NO: 473107 - protein, 9 aa, Influenza virus
IISFCGVNS

SEQ ID NO: 473108 - protein, 9 aa, Influenza virus
IISKDNGIR

SEQ ID NO: 473109 - protein, 9 aa, Influenza virus
IISLCSIWF

SEQ ID NO: 473110 - protein, 9 aa, Influenza virus
IISMCSSTE

SEQ ID NO: 473111 - protein, 9 aa, Influenza virus
IISNLPFQN

SEQ ID NO: 473112 - protein, 9 aa, Influenza virus
IISSLPFQN

SEQ ID NO: 473113 - protein, 9 aa, Influenza virus
IITDTFKSW

SEQ ID NO: 473114 - protein, 9 aa, Influenza virus
IITDTIKSW

SEQ ID NO: 473115 - protein, 9 aa, Influenza virus
IITDTIRSW

SEQ ID NO: 473116 - protein, 9 aa, Influenza virus
IITDTLKSW

SEQ ID NO: 473117 - protein, 9 aa, Influenza virus
IITELPFQN

SEQ ID NO: 473118 - protein, 9 aa, Influenza virus
IITETIKSW

SEQ ID NO: 473119 - protein, 9 aa, Influenza virus
IITGPPQCD

SEQ ID NO: 473120 - protein, 9 aa, Influenza virus
IITGTIKSW

SEQ ID NO: 473121 - protein, 9 aa, Influenza virus
IITHFQRKR

SEQ ID NO: 473122 - protein, 9 aa, Influenza virus
IITIDSVSL

SEQ ID NO: 473123 - protein, 9 aa, Influenza virus
IITIGSASI

SEQ ID NO: 473124 - protein, 9 aa, Influenza virus
IITIGSASL

SEQ ID NO: 473125 - protein, 9 aa, Influenza virus
IITIGSICM

SEQ ID NO: 473126 - protein, 9 aa, Influenza virus
IITIGSISI

SEQ ID NO: 473127 - protein, 9 aa, Influenza virus
IITIGSISL

SEQ ID NO: 473128 - protein, 9 aa, Influenza virus
IITIGSISV

SEQ ID NO: 473129 - protein, 9 aa, Influenza virus
IITIGSVSI

SEQ ID NO: 473130 - protein, 9 aa, Influenza virus
IITIGSVSL

SEQ ID NO: 473131 - protein, 9 aa, Influenza virus
IITMGSVSL

SEQ ID NO: 473132 - protein, 9 aa, Influenza virus
IITREPYVS

SEQ ID NO: 473133 - protein, 9 aa, Influenza virus
IITVGSVSL

SEQ ID NO: 473134 - protein, 9 aa, Influenza virus
IIVFCGTSG

SEQ ID NO: 473135 - protein, 9 aa, Influenza virus
IIVFNTIGN

SEQ ID NO: 473136 - protein, 9 aa, Influenza virus
IIVILVLGL

SEQ ID NO: 473137 - protein, 9 aa, Influenza virus
IIVTREPYV

SEQ ID NO: 473138 - protein, 9 aa, Influenza virus
IIWGIHHPS

SEQ ID NO: 473139 - protein, 9 aa, Influenza virus
IIYSSSMMW

SEQ ID NO: 473140 - protein, 9 aa, Influenza virus
IKAVRGDLN

SEQ ID NO: 473141 - protein, 9 aa, Influenza virus
IKCICRDNW

SEQ ID NO: 473142 - protein, 9 aa, Influenza virus
IKCQTPLGA

SEQ ID NO: 473143 - protein, 9 aa, Influenza virus
IKCVCRDNW

SEQ ID NO: 473144 - protein, 9 aa, Influenza virus
IKDGNMRCT

SEQ ID NO: 473145 - protein, 9 aa, Influenza virus
IKDRSPYRT

SEQ ID NO: 473146 - protein, 9 aa, Influenza virus
IKDYRYTYR

SEQ ID NO: 473147 - protein, 9 aa, Influenza virus
IKEKDMTKE

SEQ ID NO: 473148 - protein, 9 aa, Influenza virus
IKFVSSDCS

SEQ ID NO: 473149 - protein, 9 aa, Influenza virus
IKGDYNNTT

SEQ ID NO: 473150 - protein, 9 aa, Influenza virus
IKGFAFLDG

SEQ ID NO: 473151 - protein, 9 aa, Influenza virus
IKGFAPFSK

SEQ ID NO: 473152 - protein, 9 aa, Influenza virus
IKGFGFLNE

SEQ ID NO: 473153 - protein, 9 aa, Influenza virus
IKGFSFKYG

SEQ ID NO: 473154 - protein, 9 aa, Influenza virus
IKGFSFRYG

SEQ ID NO: 473155 - protein, 9 aa, Influenza virus
IKGRSHLRN

SEQ ID NO: 473156 - protein, 9 aa, Influenza virus
IKGVELSSM

SEQ ID NO: 473157 - protein, 9 aa, Influenza virus
IKGVKLSNM

SEQ ID NO: 473158 - protein, 9 aa, Influenza virus
IKGVKLSSM

SEQ ID NO: 473159 - protein, 9 aa, Influenza virus
IKGVYINTA

SEQ ID NO: 473160 - protein, 9 aa, Influenza virus
IKGWAPLSK

SEQ ID NO: 473161 - protein, 9 aa, Influenza virus
IKHENRMVL

SEQ ID NO: 473162 - protein, 9 aa, Influenza virus
IKHLEECSC

SEQ ID NO: 473163 - protein, 9 aa, Influenza virus
IKICESRLR

SEQ ID NO: 473164 - protein, 9 aa, Influenza virus
IKINPVTLT

SEQ ID NO: 473165 - protein, 9 aa, Influenza virus
IKIRRRVDI

SEQ ID NO: 473166 - protein, 9 aa, Influenza virus
IKKTNEKFH

SEQ ID NO: 473167 - protein, 9 aa, Influenza virus
IKKYERVKM

SEQ ID NO: 473168 - protein, 9 aa, Influenza virus
IKKYTSARQ

SEQ ID NO: 473169 - protein, 9 aa, Influenza virus
IKKYTSGRQ

SEQ ID NO: 473170 - protein, 9 aa, Influenza virus
IKLKSEDNV

SEQ ID NO: 473171 - protein, 9 aa, Influenza virus
IKLKTEDNI

SEQ ID NO: 473172 - protein, 9 aa, Influenza virus
IKLKTEDNV

SEQ ID NO: 473173 - protein, 9 aa, Influenza virus
IKLLPFAAA

SEQ ID NO: 473174 - protein, 9 aa, Influenza virus
IKLLPFASA

SEQ ID NO: 473175 - protein, 9 aa, Influenza virus
IKMKWGMEL

SEQ ID NO: 473176 - protein, 9 aa, Influenza virus
IKMKWGMEM

SEQ ID NO: 473177 - protein, 9 aa, Influenza virus
IKMNPNQKI

SEQ ID NO: 473178 - protein, 9 aa, Influenza virus
IKNGNMQCT

SEQ ID NO: 473179 - protein, 9 aa, Influenza virus
IKNGNMRCT

SEQ ID NO: 473180 - protein, 9 aa, Influenza virus
IKNGTYDHK

SEQ ID NO: 473181 - protein, 9 aa, Influenza virus
IKNGTYNHK

SEQ ID NO: 473182 - protein, 9 aa, Influenza virus
IKNGTYNHQ

SEQ ID NO: 473183 - protein, 9 aa, Influenza virus
IKNGTYNRK

SEQ ID NO: 473184 - protein, 9 aa, Influenza virus
IKNNMINND

SEQ ID NO: 473185 - protein, 9 aa, Influenza virus
IKNQEELRS

SEQ ID NO: 473186 - protein, 9 aa, Influenza virus
IKPCFWVEL

SEQ ID NO: 473187 - protein, 9 aa, Influenza virus
IKPWARNIL

SEQ ID NO: 473188 - protein, 9 aa, Influenza virus
IKQGSLKLA

SEQ ID NO: 473189 - protein, 9 aa, Influenza virus
IKQNGKSGA

SEQ ID NO: 473190 - protein, 9 aa, Influenza virus
IKQNTLKLA

SEQ ID NO: 473191 - protein, 9 aa, Influenza virus
IKRGINDRN

SEQ ID NO: 473192 - protein, 9 aa, Influenza virus
IKRGVNDRN

SEQ ID NO: 473193 - protein, 9 aa, Influenza virus
IKRYERVKM

SEQ ID NO: 473194 - protein, 9 aa, Influenza virus
IKSDQLKLA

SEQ ID NO: 473195 - protein, 9 aa, Influenza virus
IKSFSRTEL

SEQ ID NO: 473196 - protein, 9 aa, Influenza virus
IKSFSRTQL

SEQ ID NO: 473197 - protein, 9 aa, Influenza virus
IKSGQLKLA

SEQ ID NO: 473198 - protein, 9 aa, Influenza virus
IKSHAYISF

SEQ ID NO: 473199 - protein, 9 aa, Influenza virus
IKSLKLATG

SEQ ID NO: 473200 - protein, 9 aa, Influenza virus
IKSWRKDIL

SEQ ID NO: 473201 - protein, 9 aa, Influenza virus
IKSWRRDIL

SEQ ID NO: 473202 - protein, 9 aa, Influenza virus
IKTDGATSA

SEQ ID NO: 473203 - protein, 9 aa, Influenza virus
IKTKLPFQN

SEQ ID NO: 473204 - protein, 9 aa, Influenza virus
IKTLTNEKE

SEQ ID NO: 473205 - protein, 9 aa, Influenza virus
IKTNGNLIA

SEQ ID NO: 473206 - protein, 9 aa, Influenza virus
IKTRLFTIR

SEQ ID NO: 473207 - protein, 9 aa, Influenza virus
IKTRPILSP

SEQ ID NO: 473208 - protein, 9 aa, Influenza virus
IKTWAGKIL

SEQ ID NO: 473209 - protein, 9 aa, Influenza virus
IKTWAGNIL

SEQ ID NO: 473210 - protein, 9 aa, Influenza virus
IKTWAKNIL

SEQ ID NO: 473211 - protein, 9 aa, Influenza virus
IKTWARNIL

SEQ ID NO: 473212 - protein, 9 aa, Influenza virus
IKVDTLTEK

SEQ ID NO: 473213 - protein, 9 aa, Influenza virus
IKWNVTYTG

SEQ ID NO: 473214 - protein, 9 aa, Influenza virus
IKYNGIITD

SEQ ID NO: 473215 - protein, 9 aa, Influenza virus
ILAATVTLH

SEQ ID NO: 473216 - protein, 9 aa, Influenza virus
ILAFILWAC

SEQ ID NO: 473217 - protein, 9 aa, Influenza virus
ILAFIMWAC

SEQ ID NO: 473218 - protein, 9 aa, Influenza virus
ILAFIMWTC

SEQ ID NO: 473219 - protein, 9 aa, Influenza virus
ILAIYATVA

SEQ ID NO: 473220 - protein, 9 aa, Influenza virus
ILAIYSTAA

SEQ ID NO: 473221 - protein, 9 aa, Influenza virus
ILAIYSTVA

SEQ ID NO: 473222 - protein, 9 aa, Influenza virus
ILAIYSTVS

SEQ ID NO: 473223 - protein, 9 aa, Influenza virus
ILANNGKFE

SEQ ID NO: 473224 - protein, 9 aa, Influenza virus
ILANNGRFE

SEQ ID NO: 473225 - protein, 9 aa, Influenza virus
ILASSGSLE

SEQ ID NO: 473226 - protein, 9 aa, Influenza virus
ILATTITLH

SEQ ID NO: 473227 - protein, 9 aa, Influenza virus
ILATTVTLH

SEQ ID NO: 473228 - protein, 9 aa, Influenza virus
ILCASATAI

SEQ ID NO: 473229 - protein, 9 aa, Influenza virus
ILCTSAIAI

SEQ ID NO: 473230 - protein, 9 aa, Influenza virus
ILCTSATAI

SEQ ID NO: 473231 - protein, 9 aa, Influenza virus
ILCTSATAL

SEQ ID NO: 473232 - protein, 9 aa, Influenza virus
ILDEHDSNV

SEQ ID NO: 473233 - protein, 9 aa, Influenza virus
ILDFHDSNV

SEQ ID NO: 473234 - protein, 9 aa, Influenza virus
ILDGVTASC

SEQ ID NO: 473235 - protein, 9 aa, Influenza virus
ILDQNFRNI

SEQ ID NO: 473236 - protein, 9 aa, Influenza virus
ILEDEQMYQ

SEQ ID NO: 473237 - protein, 9 aa, Influenza virus
ILEEESDEA

SEQ ID NO: 473238 - protein, 9 aa, Influenza virus
ILEENTTYK

SEQ ID NO: 473239 - protein, 9 aa, Influenza virus
ILEGTTASC

SEQ ID NO: 473240 - protein, 9 aa, Influenza virus
ILEKAHNGK

SEQ ID NO: 473241 - protein, 9 aa, Influenza virus
ILEKNITVT

SEQ ID NO: 473242 - protein, 9 aa, Influenza virus
ILEKNVTVT

SEQ ID NO: 473243 - protein, 9 aa, Influenza virus
ILEKTHNGK

SEQ ID NO: 473244 - protein, 9 aa, Influenza virus
ILEKTHNGR

SEQ ID NO: 473245 - protein, 9 aa, Influenza virus
ILEKVHNGK

SEQ ID NO: 473246 - protein, 9 aa, Influenza virus
ILEQNVTVT

SEQ ID NO: 473247 - protein, 9 aa, Influenza virus
ILERNVTVT

SEQ ID NO: 473248 - protein, 9 aa, Influenza virus
ILERTHNGK

SEQ ID NO: 473249 - protein, 9 aa, Influenza virus
ILETGYICS

SEQ ID NO: 473250 - protein, 9 aa, Influenza virus
ILETGYVCG

SEQ ID NO: 473251 - protein, 9 aa, Influenza virus
ILETGYVCS

SEQ ID NO: 473252 - protein, 9 aa, Influenza virus
ILETRYVCS

SEQ ID NO: 473253 - protein, 9 aa, Influenza virus
ILFASATAI

SEQ ID NO: 473254 - protein, 9 aa, Influenza virus
ILFIEEGKI

SEQ ID NO: 473255 - protein, 9 aa, Influenza virus
ILFIEEGKV

SEQ ID NO: 473256 - protein, 9 aa, Influenza virus
ILFIKEGKI

SEQ ID NO: 473257 - protein, 9 aa, Influenza virus
ILFIREGKI

SEQ ID NO: 473258 - protein, 9 aa, Influenza virus
ILFNTIGNL

SEQ ID NO: 473259 - protein, 9 aa, Influenza virus
ILFVKEGKI

SEQ ID NO: 473260 - protein, 9 aa, Influenza virus
ILGDCSVAG

SEQ ID NO: 473261 - protein, 9 aa, Influenza virus
ILGFVFTLT

SEQ ID NO: 473262 - protein, 9 aa, Influenza virus
ILGFVLWAC

SEQ ID NO: 473263 - protein, 9 aa, Influenza virus
ILGILTGPP

SEQ ID NO: 473264 - protein, 9 aa, Influenza virus
ILGMQNGSC

SEQ ID NO: 473265 - protein, 9 aa, Influenza virus
ILGMQNGSY

SEQ ID NO: 473266 - protein, 9 aa, Influenza virus
ILGNPKCDL

SEQ ID NO: 473267 - protein, 9 aa, Influenza virus
ILGNPKCDP

SEQ ID NO: 473268 - protein, 9 aa, Influenza virus
ILGNPMCDD

SEQ ID NO: 473269 - protein, 9 aa, Influenza virus
ILGNPMCDE

SEQ ID NO: 473270 - protein, 9 aa, Influenza virus
ILGNPMCDN

SEQ ID NO: 473271 - protein, 9 aa, Influenza virus
ILGNPMCDY

SEQ ID NO: 473272 - protein, 9 aa, Influenza virus
ILGNPRCDD

SEQ ID NO: 473273 - protein, 9 aa, Influenza virus
ILGNYKEIC

SEQ ID NO: 473274 - protein, 9 aa, Influenza virus
ILGTIIGPP

SEQ ID NO: 473275 - protein, 9 aa, Influenza virus
ILHKCDNEC

SEQ ID NO: 473276 - protein, 9 aa, Influenza virus
ILHKCDNKC

SEQ ID NO: 473277 - protein, 9 aa, Influenza virus
ILHKCNDSC

SEQ ID NO: 473278 - protein, 9 aa, Influenza virus
ILHKCNNEC

SEQ ID NO: 473279 - protein, 9 aa, Influenza virus
ILIAGGLIL

SEQ ID NO: 473280 - protein, 9 aa, Influenza virus
ILITQESEC

SEQ ID NO: 473281 - protein, 9 aa, Influenza virus
ILKDCSIAG

SEQ ID NO: 473282 - protein, 9 aa, Influenza virus
ILKDCSVAG

SEQ ID NO: 473283 - protein, 9 aa, Influenza virus
ILKDCSVSG

SEQ ID NO: 473284 - protein, 9 aa, Influenza virus
ILKGKFQTA

SEQ ID NO: 473285 - protein, 9 aa, Influenza virus
ILKHNPTEE

SEQ ID NO: 473286 - protein, 9 aa, Influenza virus
ILKIKKGKI

SEQ ID NO: 473287 - protein, 9 aa, Influenza virus
ILKIKKGKL

SEQ ID NO: 473288 - protein, 9 aa, Influenza virus
ILKIRKGKI

SEQ ID NO: 473289 - protein, 9 aa, Influenza virus
ILKPGETLN

SEQ ID NO: 473290 - protein, 9 aa, Influenza virus
ILKPGQTLR

SEQ ID NO: 473291 - protein, 9 aa, Influenza virus
ILKPGQTVK

SEQ ID NO: 473292 - protein, 9 aa, Influenza virus
ILKQNPTEE

SEQ ID NO: 473293 - protein, 9 aa, Influenza virus
ILKRGETLK

SEQ ID NO: 473294 - protein, 9 aa, Influenza virus
ILLENERTL

SEQ ID NO: 473295 - protein, 9 aa, Influenza virus
ILLNPFVSH

SEQ ID NO: 473296 - protein, 9 aa, Influenza virus
ILLSPEEVS

SEQ ID NO: 473297 - protein, 9 aa, Influenza virus
ILNLLIGIS

SEQ ID NO: 473298 - protein, 9 aa, Influenza virus
ILNNKNWSG

SEQ ID NO: 473299 - protein, 9 aa, Influenza virus
ILNPNDTVT

SEQ ID NO: 473300 - protein, 9 aa, Influenza virus
ILNTSQRGI

SEQ ID NO: 473301 - protein, 9 aa, Influenza virus
ILNTSQRGV

SEQ ID NO: 473302 - protein, 9 aa, Influenza virus
ILPFDIDKM

SEQ ID NO: 473303 - protein, 9 aa, Influenza virus
ILRDCSVAG

SEQ ID NO: 473304 - protein, 9 aa, Influenza virus
ILRGAVAHK

SEQ ID NO: 473305 - protein, 9 aa, Influenza virus
ILRGSIAHK

SEQ ID NO: 473306 - protein, 9 aa, Influenza virus
ILRGSVAHK

SEQ ID NO: 473307 - protein, 9 aa, Influenza virus
ILRQNPTEE

SEQ ID NO: 473308 - protein, 9 aa, Influenza virus
ILRTHESEC

SEQ ID NO: 473309 - protein, 9 aa, Influenza virus
ILRTQDSEC

SEQ ID NO: 473310 - protein, 9 aa, Influenza virus
ILRTQESEC

SEQ ID NO: 473311 - protein, 9 aa, Influenza virus
ILRTQESSC

SEQ ID NO: 473312 - protein, 9 aa, Influenza virus
ILSFIMWAC

SEQ ID NO: 473313 - protein, 9 aa, Influenza virus
ILSFIMWAG

SEQ ID NO: 473314 - protein, 9 aa, Influenza virus
ILSIAPIMF

SEQ ID NO: 473315 - protein, 9 aa, Influenza virus
ILSICSCIA

SEQ ID NO: 473316 - protein, 9 aa, Influenza virus
ILSIYSCIA

SEQ ID NO: 473317 - protein, 9 aa, Influenza virus
ILSIYSSVA

SEQ ID NO: 473318 - protein, 9 aa, Influenza virus
ILSIYSTAA

SEQ ID NO: 473319 - protein, 9 aa, Influenza virus
ILSIYSTVA

SEQ ID NO: 473320 - protein, 9 aa, Influenza virus
ILSIYSTVS

SEQ ID NO: 473321 - protein, 9 aa, Influenza virus
ILSIYSTVT

SEQ ID NO: 473322 - protein, 9 aa, Influenza virus
ILSIYSTVV

SEQ ID NO: 473323 - protein, 9 aa, Influenza virus
ILSKDNAIR

SEQ ID NO: 473324 - protein, 9 aa, Influenza virus
ILSMAPIMF

SEQ ID NO: 473325 - protein, 9 aa, Influenza virus
ILSNPKCDL

SEQ ID NO: 473326 - protein, 9 aa, Influenza virus
ILSPLTKGI

SEQ ID NO: 473327 - protein, 9 aa, Influenza virus
ILSPLTKGM

SEQ ID NO: 473328 - protein, 9 aa, Influenza virus
ILSTKALLI

SEQ ID NO: 473329 - protein, 9 aa, Influenza virus
ILSVYSTVA

SEQ ID NO: 473330 - protein, 9 aa, Influenza virus
ILTDSQTAT

SEQ ID NO: 473331 - protein, 9 aa, Influenza virus
ILTDTSRPG

SEQ ID NO: 473332 - protein, 9 aa, Influenza virus
ILTDTSRPS

SEQ ID NO: 473333 - protein, 9 aa, Influenza virus
ILTFIMWAC

SEQ ID NO: 473334 - protein, 9 aa, Influenza virus
ILTGPPQCD

SEQ ID NO: 473335 - protein, 9 aa, Influenza virus
ILTIYSTAA

SEQ ID NO: 473336 - protein, 9 aa, Influenza virus
ILTIYSTVA

SEQ ID NO: 473337 - protein, 9 aa, Influenza virus
ILTKITVDH

SEQ ID NO: 473338 - protein, 9 aa, Influenza virus
ILTKTTVDH

SEQ ID NO: 473339 - protein, 9 aa, Influenza virus
ILTRTTVDH

SEQ ID NO: 473340 - protein, 9 aa, Influenza virus
ILVAGGLIL

SEQ ID NO: 473341 - protein, 9 aa, Influenza virus
ILVALALSH

SEQ ID NO: 473342 - protein, 9 aa, Influenza virus
ILVALENQH

SEQ ID NO: 473343 - protein, 9 aa, Influenza virus
ILVIYATVA

SEQ ID NO: 473344 - protein, 9 aa, Influenza virus
ILVLGLSMV

SEQ ID NO: 473345 - protein, 9 aa, Influenza virus
ILVSTNAYD

SEQ ID NO: 473346 - protein, 9 aa, Influenza virus
ILVTREPYL

SEQ ID NO: 473347 - protein, 9 aa, Influenza virus
ILVTREPYV

SEQ ID NO: 473348 - protein, 9 aa, Influenza virus
ILVTTVTLH

SEQ ID NO: 473349 - protein, 9 aa, Influenza virus
ILWACQNGN

SEQ ID NO: 473350 - protein, 9 aa, Influenza virus
ILWACQTGN

SEQ ID NO: 473351 - protein, 9 aa, Influenza virus
ILWACSSGN

SEQ ID NO: 473352 - protein, 9 aa, Influenza virus
ILWFSFGAS

SEQ ID NO: 473353 - protein, 9 aa, Influenza virus
ILWFSLGAS

SEQ ID NO: 473354 - protein, 9 aa, Influenza virus
ILWISFAIS

SEQ ID NO: 473355 - protein, 9 aa, Influenza virus
ILWISFAMS

SEQ ID NO: 473356 - protein, 9 aa, Influenza virus
ILWISFATS

SEQ ID NO: 473357 - protein, 9 aa, Influenza virus
ILWISFSIS

SEQ ID NO: 473358 - protein, 9 aa, Influenza virus
ILWISFSMS

SEQ ID NO: 473359 - protein, 9 aa, Influenza virus
ILWVSFSIS

SEQ ID NO: 473360 - protein, 9 aa, Influenza virus
ILYFWGVHH

SEQ ID NO: 473361 - protein, 9 aa, Influenza virus
IMASQGTKR

SEQ ID NO: 473362 - protein, 9 aa, Influenza virus
IMEKIVTVT

SEQ ID NO: 473363 - protein, 9 aa, Influenza virus
IMEKNITVT

SEQ ID NO: 473364 - protein, 9 aa, Influenza virus
IMEKNVTVT

SEQ ID NO: 473365 - protein, 9 aa, Influenza virus
IMERNVTVT

SEQ ID NO: 473366 - protein, 9 aa, Influenza virus
IMESGGIDK

SEQ ID NO: 473367 - protein, 9 aa, Influenza virus
IMESGGISK

SEQ ID NO: 473368 - protein, 9 aa, Influenza virus
IMEVVFPNE

SEQ ID NO: 473369 - protein, 9 aa, Influenza virus
IMFESNGGL

SEQ ID NO: 473370 - protein, 9 aa, Influenza virus
IMFSNKMAR

SEQ ID NO: 473371 - protein, 9 aa, Influenza virus
IMFSNKVAR

SEQ ID NO: 473372 - protein, 9 aa, Influenza virus
IMGLFFFCL

SEQ ID NO: 473373 - protein, 9 aa, Influenza virus
IMGLVFFCL

SEQ ID NO: 473374 - protein, 9 aa, Influenza virus
IMHDRTKIR

SEQ ID NO: 473375 - protein, 9 aa, Influenza virus
IMIAGLFFW

SEQ ID NO: 473376 - protein, 9 aa, Influenza virus
IMIAGLSFW

SEQ ID NO: 473377 - protein, 9 aa, Influenza virus
IMIDGSASG

SEQ ID NO: 473378 - protein, 9 aa, Influenza virus
IMINPVKLS

SEQ ID NO: 473379 - protein, 9 aa, Influenza virus
IMIWHSNLN

SEQ ID NO: 473380 - protein, 9 aa, Influenza virus
IMMAGLSFW

SEQ ID NO: 473381 - protein, 9 aa, Influenza virus
IMNTSKPFQ

SEQ ID NO: 473382 - protein, 9 aa, Influenza virus
IMQNKLNNV

SEQ ID NO: 473383 - protein, 9 aa, Influenza virus
IMRIWRQAN

SEQ ID NO: 473384 - protein, 9 aa, Influenza virus
IMRTQESEC

SEQ ID NO: 473385 - protein, 9 aa, Influenza virus
IMRTQESSC

SEQ ID NO: 473386 - protein, 9 aa, Influenza virus
IMRTVIALS

SEQ ID NO: 473387 - protein, 9 aa, Influenza virus
IMSCDSPSN

SEQ ID NO: 473388 - protein, 9 aa, Influenza virus
IMTDGPASS

SEQ ID NO: 473389 - protein, 9 aa, Influenza virus
IMTDGSANS

SEQ ID NO: 473390 - protein, 9 aa, Influenza virus
IMTDGSASG

SEQ ID NO: 473391 - protein, 9 aa, Influenza virus
IMTDGSASS

SEQ ID NO: 473392 - protein, 9 aa, Influenza virus
IMTIGSVSL

SEQ ID NO: 473393 - protein, 9 aa, Influenza virus
IMVAGLSFW

SEQ ID NO: 473394 - protein, 9 aa, Influenza virus
IMWACNSGN

SEQ ID NO: 473395 - protein, 9 aa, Influenza virus
IMWACQKGN

SEQ ID NO: 473396 - protein, 9 aa, Influenza virus
IMWACQRGN

SEQ ID NO: 473397 - protein, 9 aa, Influenza virus
IMWACSNGN

SEQ ID NO: 473398 - protein, 9 aa, Influenza virus
IMWACSNGS

SEQ ID NO: 473399 - protein, 9 aa, Influenza virus
IMWACSSGN

SEQ ID NO: 473400 - protein, 9 aa, Influenza virus
IMWGIHHPS

SEQ ID NO: 473401 - protein, 9 aa, Influenza virus
IMWTCNSGN

SEQ ID NO: 473402 - protein, 9 aa, Influenza virus
IMWTCQKGN

SEQ ID NO: 473403 - protein, 9 aa, Influenza virus
INDKIDDQI

SEQ ID NO: 473404 - protein, 9 aa, Influenza virus
INDKINDQI

SEQ ID NO: 473405 - protein, 9 aa, Influenza virus
INDPWVLLN

SEQ ID NO: 473406 - protein, 9 aa, Influenza virus
INDQIEDLW

SEQ ID NO: 473407 - protein, 9 aa, Influenza virus
INDQITDIW

SEQ ID NO: 473408 - protein, 9 aa, Influenza virus
INDRNFWRG

SEQ ID NO: 473409 - protein, 9 aa, Influenza virus
INDRSPFRA

SEQ ID NO: 473410 - protein, 9 aa, Influenza virus
INDRTAFRG

SEQ ID NO: 473411 - protein, 9 aa, Influenza virus
INECRTFFL

SEQ ID NO: 473412 - protein, 9 aa, Influenza virus
INEEALRQK

SEQ ID NO: 473413 - protein, 9 aa, Influenza virus
INEGALRQK

SEQ ID NO: 473414 - protein, 9 aa, Influenza virus
INEGNGCFE

SEQ ID NO: 473415 - protein, 9 aa, Influenza virus
INEITTKIN

SEQ ID NO: 473416 - protein, 9 aa, Influenza virus
INESADMSI

SEQ ID NO: 473417 - protein, 9 aa, Influenza virus
INEVKLEEN

SEQ ID NO: 473418 - protein, 9 aa, Influenza virus
INFDSNGNF

SEQ ID NO: 473419 - protein, 9 aa, Influenza virus
INFESNGNF

SEQ ID NO: 473420 - protein, 9 aa, Influenza virus
INFESNGNL

SEQ ID NO: 473421 - protein, 9 aa, Influenza virus
INFESTGNL

SEQ ID NO: 473422 - protein, 9 aa, Influenza virus
INFMPYISF

SEQ ID NO: 473423 - protein, 9 aa, Influenza virus
INGALGSPG

SEQ ID NO: 473424 - protein, 9 aa, Influenza virus
INGFAPFSK

SEQ ID NO: 473425 - protein, 9 aa, Influenza virus
INGICTVVM

SEQ ID NO: 473426 - protein, 9 aa, Influenza virus
INGKAPISL

SEQ ID NO: 473427 - protein, 9 aa, Influenza virus
INGKEPISL

SEQ ID NO: 473428 - protein, 9 aa, Influenza virus
INGKLNRLI

SEQ ID NO: 473429 - protein, 9 aa, Influenza virus
INGKQPISL

SEQ ID NO: 473430 - protein, 9 aa, Influenza virus
INGPDSVLV

SEQ ID NO: 473431 - protein, 9 aa, Influenza virus
INGPESVLI

SEQ ID NO: 473432 - protein, 9 aa, Influenza virus
INGPESVLV

SEQ ID NO: 473433 - protein, 9 aa, Influenza virus
INGQAGRMT

SEQ ID NO: 473434 - protein, 9 aa, Influenza virus
INGQSGRID

SEQ ID NO: 473435 - protein, 9 aa, Influenza virus
INGRAPISL

SEQ ID NO: 473436 - protein, 9 aa, Influenza virus
INGSCAVVM

SEQ ID NO: 473437 - protein, 9 aa, Influenza virus
INGSCIVVM

SEQ ID NO: 473438 - protein, 9 aa, Influenza virus
INGSCTVVM

SEQ ID NO: 473439 - protein, 9 aa, Influenza virus
INGTCAVVM

SEQ ID NO: 473440 - protein, 9 aa, Influenza virus
INGTCTVIM

SEQ ID NO: 473441 - protein, 9 aa, Influenza virus
INGTCTVVM

SEQ ID NO: 473442 - protein, 9 aa, Influenza virus
INGVILEEN

SEQ ID NO: 473443 - protein, 9 aa, Influenza virus
INGVKLEEN

SEQ ID NO: 473444 - protein, 9 aa, Influenza virus
INGVRLEEN

SEQ ID NO: 473445 - protein, 9 aa, Influenza virus
INGVTNKVN

SEQ ID NO: 473446 - protein, 9 aa, Influenza virus
INGWYGFQH

SEQ ID NO: 473447 - protein, 9 aa, Influenza virus
INGWYGFRH

SEQ ID NO: 473448 - protein, 9 aa, Influenza virus
INIAEYSID

SEQ ID NO: 473449 - protein, 9 aa, Influenza virus
INIMASQGT

SEQ ID NO: 473450 - protein, 9 aa, Influenza virus
INIREWSYL

SEQ ID NO: 473451 - protein, 9 aa, Influenza virus
INKITNKVN

SEQ ID NO: 473452 - protein, 9 aa, Influenza virus
INKMNTQFE

SEQ ID NO: 473453 - protein, 9 aa, Influenza virus
INKTGTFEF

SEQ ID NO: 473454 - protein, 9 aa, Influenza virus
INKVCTKGK

SEQ ID NO: 473455 - protein, 9 aa, Influenza virus
INLHAYISF

SEQ ID NO: 473456 - protein, 9 aa, Influenza virus
INLLIGISN

SEQ ID NO: 473457 - protein, 9 aa, Influenza virus
INLYASKNP

SEQ ID NO: 473458 - protein, 9 aa, Influenza virus
INMADYSID

SEQ ID NO: 473459 - protein, 9 aa, Influenza virus
INMEDYSID

SEQ ID NO: 473460 - protein, 9 aa, Influenza virus
INMIADRVD

SEQ ID NO: 473461 - protein, 9 aa, Influenza virus
INMINDKID

SEQ ID NO: 473462 - protein, 9 aa, Influenza virus
INMINDKIN

SEQ ID NO: 473463 - protein, 9 aa, Influenza virus
INMINSKID

SEQ ID NO: 473464 - protein, 9 aa, Influenza virus
INMINSKIE

SEQ ID NO: 473465 - protein, 9 aa, Influenza virus
INMINSKIN

SEQ ID NO: 473466 - protein, 9 aa, Influenza virus
INMINSQID

SEQ ID NO: 473467 - protein, 9 aa, Influenza virus
INMISDKID

SEQ ID NO: 473468 - protein, 9 aa, Influenza virus
INMLADRID

SEQ ID NO: 473469 - protein, 9 aa, Influenza virus
INMLADRVD

SEQ ID NO: 473470 - protein, 9 aa, Influenza virus
INMLADWVD

SEQ ID NO: 473471 - protein, 9 aa, Influenza virus
INMSKKKSY

SEQ ID NO: 473472 - protein, 9 aa, Influenza virus
INNDLGPAT

SEQ ID NO: 473473 - protein, 9 aa, Influenza virus
INNETIIET

SEQ ID NO: 473474 - protein, 9 aa, Influenza virus
INNETILET

SEQ ID NO: 473475 - protein, 9 aa, Influenza virus
INNETIVET

SEQ ID NO: 473476 - protein, 9 aa, Influenza virus
INNGKGRYG

SEQ ID NO: 473477 - protein, 9 aa, Influenza virus
INNIIDKMN

SEQ ID NO: 473478 - protein, 9 aa, Influenza virus
INNIIEKMN

SEQ ID NO: 473479 - protein, 9 aa, Influenza virus
INNITNVVL

SEQ ID NO: 473480 - protein, 9 aa, Influenza virus
INNITTTII

SEQ ID NO: 473481 - protein, 9 aa, Influenza virus
INNITTTIT

SEQ ID NO: 473482 - protein, 9 aa, Influenza virus
INNIVDKMN

SEQ ID NO: 473483 - protein, 9 aa, Influenza virus
INNQNWSGY

SEQ ID NO: 473484 - protein, 9 aa, Influenza virus
INNRFQIQG

SEQ ID NO: 473485 - protein, 9 aa, Influenza virus
INNRIKINP

SEQ ID NO: 473486 - protein, 9 aa, Influenza virus
INNYHNETN

SEQ ID NO: 473487 - protein, 9 aa, Influenza virus
INNYYNDTN

SEQ ID NO: 473488 - protein, 9 aa, Influenza virus
INNYYNETN

SEQ ID NO: 473489 - protein, 9 aa, Influenza virus
INNYYNKTN

SEQ ID NO: 473490 - protein, 9 aa, Influenza virus
INPTLLFLK

SEQ ID NO: 473491 - protein, 9 aa, Influenza virus
INPVELSSG

SEQ ID NO: 473492 - protein, 9 aa, Influenza virus
INPVKLSGG

SEQ ID NO: 473493 - protein, 9 aa, Influenza virus
INPVKLSSG

SEQ ID NO: 473494 - protein, 9 aa, Influenza virus
INPVTLSSG

SEQ ID NO: 473495 - protein, 9 aa, Influenza virus
INPVTLTMG

SEQ ID NO: 473496 - protein, 9 aa, Influenza virus
INQINGKLN

SEQ ID NO: 473497 - protein, 9 aa, Influenza virus
INQITGKLN

SEQ ID NO: 473498 - protein, 9 aa, Influenza virus
INRCFYVEL

SEQ ID NO: 473499 - protein, 9 aa, Influenza virus
INRIFQPNI

SEQ ID NO: 473500 - protein, 9 aa, Influenza virus
INRIFRPNI

SEQ ID NO: 473501 - protein, 9 aa, Influenza virus
INRITYGAC

SEQ ID NO: 473502 - protein, 9 aa, Influenza virus
INRNFKPNI

SEQ ID NO: 473503 - protein, 9 aa, Influenza virus
INRNFQPNI

SEQ ID NO: 473504 - protein, 9 aa, Influenza virus
INRQEIEGV

SEQ ID NO: 473505 - protein, 9 aa, Influenza virus
INRQEVEGV

SEQ ID NO: 473506 - protein, 9 aa, Influenza virus
INRSFKPNI

SEQ ID NO: 473507 - protein, 9 aa, Influenza virus
INRSFQPNI

SEQ ID NO: 473508 - protein, 9 aa, Influenza virus
INRSFRPNI

SEQ ID NO: 473509 - protein, 9 aa, Influenza virus
INRTGTFEF

SEQ ID NO: 473510 - protein, 9 aa, Influenza virus
INSIIDKMN

SEQ ID NO: 473511 - protein, 9 aa, Influenza virus
INSKIDDQI

SEQ ID NO: 473512 - protein, 9 aa, Influenza virus
INSKIDDQV

SEQ ID NO: 473513 - protein, 9 aa, Influenza virus
INSKIEDQI

SEQ ID NO: 473514 - protein, 9 aa, Influenza virus
INSKINDQI

SEQ ID NO: 473515 - protein, 9 aa, Influenza virus
INSPLPFQN

SEQ ID NO: 473516 - protein, 9 aa, Influenza virus
INSPNHAKS

SEQ ID NO: 473517 - protein, 9 aa, Influenza virus
INSPNHVKS

SEQ ID NO: 473518 - protein, 9 aa, Influenza virus
INSPSQAKS

SEQ ID NO: 473519 - protein, 9 aa, Influenza virus
INSQIDDQI

SEQ ID NO: 473520 - protein, 9 aa, Influenza virus
INSRFQIQG

SEQ ID NO: 473521 - protein, 9 aa, Influenza virus
INSSKPFQN

SEQ ID NO: 473522 - protein, 9 aa, Influenza virus
INSSKPLQN

SEQ ID NO: 473523 - protein, 9 aa, Influenza virus
INSSMPFHN

SEQ ID NO: 473524 - protein, 9 aa, Influenza virus
INSSMPLHN

SEQ ID NO: 473525 - protein, 9 aa, Influenza virus
INSSRPFQN

SEQ ID NO: 473526 - protein, 9 aa, Influenza virus
INSSYVCSG

SEQ ID NO: 473527 - protein, 9 aa, Influenza virus
INSVKLFSG

SEQ ID NO: 473528 - protein, 9 aa, Influenza virus
INSVKLSSG

SEQ ID NO: 473529 - protein, 9 aa, Influenza virus
INSWHIFGK

SEQ ID NO: 473530 - protein, 9 aa, Influenza virus
INSWHIYGK

SEQ ID NO: 473531 - protein, 9 aa, Influenza virus
INTALLNAS

SEQ ID NO: 473532 - protein, 9 aa, Influenza virus
INTAMLNAS

SEQ ID NO: 473533 - protein, 9 aa, Influenza virus
INTINSKID

SEQ ID NO: 473534 - protein, 9 aa, Influenza virus
INTKLPFQN

SEQ ID NO: 473535 - protein, 9 aa, Influenza virus
INTLTERGV

SEQ ID NO: 473536 - protein, 9 aa, Influenza virus
INTNKTFQN

SEQ ID NO: 473537 - protein, 9 aa, Influenza virus
INTNRTFQN

SEQ ID NO: 473538 - protein, 9 aa, Influenza virus
INTRLPFQN

SEQ ID NO: 473539 - protein, 9 aa, Influenza virus
INTSKPFQN

SEQ ID NO: 473540 - protein, 9 aa, Influenza virus
INTTLPFHN

SEQ ID NO: 473541 - protein, 9 aa, Influenza virus
INTWARNIL

SEQ ID NO: 473542 - protein, 9 aa, Influenza virus
INTYQWIIR

SEQ ID NO: 473543 - protein, 9 aa, Influenza virus
INVINDKID

SEQ ID NO: 473544 - protein, 9 aa, Influenza virus
INVTKENTG

SEQ ID NO: 473545 - protein, 9 aa, Influenza virus
INWLTKKEP

SEQ ID NO: 473546 - protein, 9 aa, Influenza virus
INWLTKKKN

SEQ ID NO: 473547 - protein, 9 aa, Influenza virus
INWLTKKKP

SEQ ID NO: 473548 - protein, 9 aa, Influenza virus
INWTKDSIT

SEQ ID NO: 473549 - protein, 9 aa, Influenza virus
INWTQDAMT

SEQ ID NO: 473550 - protein, 9 aa, Influenza virus
INWTRDAMT

SEQ ID NO: 473551 - protein, 9 aa, Influenza virus
INWTRDSII

SEQ ID NO: 473552 - protein, 9 aa, Influenza virus
INWTRDSIT

SEQ ID NO: 473553 - protein, 9 aa, Influenza virus
INWTRDSLT

SEQ ID NO: 473554 - protein, 9 aa, Influenza virus
INWTRDSMT

SEQ ID NO: 473555 - protein, 9 aa, Influenza virus
INWTRDSVT

SEQ ID NO: 473556 - protein, 9 aa, Influenza virus
INYYNETFV

SEQ ID NO: 473557 - protein, 9 aa, Influenza virus
IPAQNAIST

SEQ ID NO: 473558 - protein, 9 aa, Influenza virus
IPCFWVEMI

SEQ ID NO: 473559 - protein, 9 aa, Influenza virus
IPEAGLKWE

SEQ ID NO: 473560 - protein, 9 aa, Influenza virus
IPERNEHGQ

SEQ ID NO: 473561 - protein, 9 aa, Influenza virus
IPERNEQGQ

SEQ ID NO: 473562 - protein, 9 aa, Influenza virus
IPESMREEY

SEQ ID NO: 473563 - protein, 9 aa, Influenza virus
IPEVCLKWD

SEQ ID NO: 473564 - protein, 9 aa, Influenza virus
IPEVCLKWE

SEQ ID NO: 473565 - protein, 9 aa, Influenza virus
IPFHLGTKQ

SEQ ID NO: 473566 - protein, 9 aa, Influenza virus
IPGKQAKGL

SEQ ID NO: 473567 - protein, 9 aa, Influenza virus
IPHRTLLMN

SEQ ID NO: 473568 - protein, 9 aa, Influenza virus
IPHRTLLMS

SEQ ID NO: 473569 - protein, 9 aa, Influenza virus
IPIGERGLF

SEQ ID NO: 473570 - protein, 9 aa, Influenza virus
IPKRNRSIL

SEQ ID NO: 473571 - protein, 9 aa, Influenza virus
IPLHDAIKC

SEQ ID NO: 473572 - protein, 9 aa, Influenza virus
IPLTTTPTK

SEQ ID NO: 473573 - protein, 9 aa, Influenza virus
IPLYDAIKC

SEQ ID NO: 473574 - protein, 9 aa, Influenza virus
IPLYDAVKC

SEQ ID NO: 473575 - protein, 9 aa, Influenza virus
IPLYDAVRC

SEQ ID NO: 473576 - protein, 9 aa, Influenza virus
IPMISKCKT

SEQ ID NO: 473577 - protein, 9 aa, Influenza virus
IPMISKCRT

SEQ ID NO: 473578 - protein, 9 aa, Influenza virus
IPMISKSRT

SEQ ID NO: 473579 - protein, 9 aa, Influenza virus
IPNAETDPN

SEQ ID NO: 473580 - protein, 9 aa, Influenza virus
IPNAETDPS

SEQ ID NO: 473581 - protein, 9 aa, Influenza virus
IPNAGIDPN

SEQ ID NO: 473582 - protein, 9 aa, Influenza virus
IPNAGTDPN

SEQ ID NO: 473583 - protein, 9 aa, Influenza virus
IPNDKPFQN

SEQ ID NO: 473584 - protein, 9 aa, Influenza virus
IPNEKPFQN

SEQ ID NO: 473585 - protein, 9 aa, Influenza virus
IPNGKPFQN

SEQ ID NO: 473586 - protein, 9 aa, Influenza virus
IPNNKPFQN

SEQ ID NO: 473587 - protein, 9 aa, Influenza virus
IPPLELGDC

SEQ ID NO: 473588 - protein, 9 aa, Influenza virus
IPPLELGNC

SEQ ID NO: 473589 - protein, 9 aa, Influenza virus
IPPLELRDC

SEQ ID NO: 473590 - protein, 9 aa, Influenza virus
IPPLVLGDC

SEQ ID NO: 473591 - protein, 9 aa, Influenza virus
IPQIESRGL

SEQ ID NO: 473592 - protein, 9 aa, Influenza virus
IPSDTPRGE

SEQ ID NO: 473593 - protein, 9 aa, Influenza virus
IPSGPLKAE

SEQ ID NO: 473594 - protein, 9 aa, Influenza virus
IPSGSLKLA

SEQ ID NO: 473595 - protein, 9 aa, Influenza virus
IPSIQSRGL

SEQ ID NO: 473596 - protein, 9 aa, Influenza virus
IPSNSLKLA

SEQ ID NO: 473597 - protein, 9 aa, Influenza virus
IPSRSLKLA

SEQ ID NO: 473598 - protein, 9 aa, Influenza virus
IPSVQSRGL

SEQ ID NO: 473599 - protein, 9 aa, Influenza virus
IPSWAGNIL

SEQ ID NO: 473600 - protein, 9 aa, Influenza virus
IPSWAGNVL

SEQ ID NO: 473601 - protein, 9 aa, Influenza virus
IPSWEGNIL

SEQ ID NO: 473602 - protein, 9 aa, Influenza virus
IPTDTPRGE

SEQ ID NO: 473603 - protein, 9 aa, Influenza virus
IPTDTPRIQ

SEQ ID NO: 473604 - protein, 9 aa, Influenza virus
IPTDTPRVQ

SEQ ID NO: 473605 - protein, 9 aa, Influenza virus
IPTDVVRSW

SEQ ID NO: 473606 - protein, 9 aa, Influenza virus
IPVQNAIST

SEQ ID NO: 473607 - protein, 9 aa, Influenza virus
IPVTQTMEL

SEQ ID NO: 473608 - protein, 9 aa, Influenza virus
IPVTQVEEL

SEQ ID NO: 473609 - protein, 9 aa, Influenza virus
IQAGVDRFY

SEQ ID NO: 473610 - protein, 9 aa, Influenza virus
IQAGVNRFY

SEQ ID NO: 473611 - protein, 9 aa, Influenza virus
IQALQLLLE

SEQ ID NO: 473612 - protein, 9 aa, Influenza virus
IQDIWAYNA

SEQ ID NO: 473613 - protein, 9 aa, Influenza virus
IQDLEKYVE

SEQ ID NO: 473614 - protein, 9 aa, Influenza virus
IQDLERYVE

SEQ ID NO: 473615 - protein, 9 aa, Influenza virus
IQDLWAYNA

SEQ ID NO: 473616 - protein, 9 aa, Influenza virus
IQDVWAYNA

SEQ ID NO: 473617 - protein, 9 aa, Influenza virus
IQFEAVGRE

SEQ ID NO: 473618 - protein, 9 aa, Influenza virus
IQFPIGTAP

SEQ ID NO: 473619 - protein, 9 aa, Influenza virus
IQFPMGTAP

SEQ ID NO: 473620 - protein, 9 aa, Influenza virus
IQFTAVGKE

SEQ ID NO: 473621 - protein, 9 aa, Influenza virus
IQFTSVGKE

SEQ ID NO: 473622 - protein, 9 aa, Influenza virus
IQGNNDNAT

SEQ ID NO: 473623 - protein, 9 aa, Influenza virus
IQGVKLAQG

SEQ ID NO: 473624 - protein, 9 aa, Influenza virus
IQGVKLIQG

SEQ ID NO: 473625 - protein, 9 aa, Influenza virus
IQGVKLTQG

SEQ ID NO: 473626 - protein, 9 aa, Influenza virus
IQGVRLTQG

SEQ ID NO: 473627 - protein, 9 aa, Influenza virus
IQGYKDIIL

SEQ ID NO: 473628 - protein, 9 aa, Influenza virus
IQHLEECSC

SEQ ID NO: 473629 - protein, 9 aa, Influenza virus
IQHPELTGL

SEQ ID NO: 473630 - protein, 9 aa, Influenza virus
IQIDAVKLS

SEQ ID NO: 473631 - protein, 9 aa, Influenza virus
IQIDPVKLS

SEQ ID NO: 473632 - protein, 9 aa, Influenza virus
IQIDQVKLS

SEQ ID NO: 473633 - protein, 9 aa, Influenza virus
IQIDSVKLS

SEQ ID NO: 473634 - protein, 9 aa, Influenza virus
IQIIKLLPF

SEQ ID NO: 473635 - protein, 9 aa, Influenza virus
IQINPVKLS

SEQ ID NO: 473636 - protein, 9 aa, Influenza virus
IQMCTELKL

SEQ ID NO: 473637 - protein, 9 aa, Influenza virus
IQMCTELQL

SEQ ID NO: 473638 - protein, 9 aa, Influenza virus
IQNALNGNG

SEQ ID NO: 473639 - protein, 9 aa, Influenza virus
IQNEDIPIE

SEQ ID NO: 473640 - protein, 9 aa, Influenza virus
IQNEDIPIG

SEQ ID NO: 473641 - protein, 9 aa, Influenza virus
IQNEFNKAC

SEQ ID NO: 473642 - protein, 9 aa, Influenza virus
IQNIWAYNA

SEQ ID NO: 473643 - protein, 9 aa, Influenza virus
IQNRGLFGA

SEQ ID NO: 473644 - protein, 9 aa, Influenza virus
IQPGDNITF

SEQ ID NO: 473645 - protein, 9 aa, Influenza virus
IQPTFSVQR

SEQ ID NO: 473646 - protein, 9 aa, Influenza virus
IQQTRVDKL

SEQ ID NO: 473647 - protein, 9 aa, Influenza virus
IQSDAQIDE

SEQ ID NO: 473648 - protein, 9 aa, Influenza virus
IQSDKPFQN

SEQ ID NO: 473649 - protein, 9 aa, Influenza virus
IQSEFNKAC

SEQ ID NO: 473650 - protein, 9 aa, Influenza virus
IQSKGLFGA

SEQ ID NO: 473651 - protein, 9 aa, Influenza virus
IQSRGLFGA

SEQ ID NO: 473652 - protein, 9 aa, Influenza virus
IQTKRSFEL

SEQ ID NO: 473653 - protein, 9 aa, Influenza virus
IQTLVSNND

SEQ ID NO: 473654 - protein, 9 aa, Influenza virus
IQTNGNLIA

SEQ ID NO: 473655 - protein, 9 aa, Influenza virus
IQTRGLFGA

SEQ ID NO: 473656 - protein, 9 aa, Influenza virus
IQTRRAFEL

SEQ ID NO: 473657 - protein, 9 aa, Influenza virus
IQTRRSFEI

SEQ ID NO: 473658 - protein, 9 aa, Influenza virus
IQTRRSFEL

SEQ ID NO: 473659 - protein, 9 aa, Influenza virus
IQTSGNLIA

SEQ ID NO: 473660 - protein, 9 aa, Influenza virus
IRAFSFQLI

SEQ ID NO: 473661 - protein, 9 aa, Influenza virus
IRALTLNTM

SEQ ID NO: 473662 - protein, 9 aa, Influenza virus
IRASVGKMI

SEQ ID NO: 473663 - protein, 9 aa, Influenza virus
IRASVGRMI

SEQ ID NO: 473664 - protein, 9 aa, Influenza virus
IRASVGRMV

SEQ ID NO: 473665 - protein, 9 aa, Influenza virus
IRCVCRDNW

SEQ ID NO: 473666 - protein, 9 aa, Influenza virus
IREGLILEY

SEQ ID NO: 473667 - protein, 9 aa, Influenza virus
IREKNVTVT

SEQ ID NO: 473668 - protein, 9 aa, Influenza virus
IREPFISCS

SEQ ID NO: 473669 - protein, 9 aa, Influenza virus
IREPFVACG

SEQ ID NO: 473670 - protein, 9 aa, Influenza virus
IREPFVACS

SEQ ID NO: 473671 - protein, 9 aa, Influenza virus
IREPFVSCG

SEQ ID NO: 473672 - protein, 9 aa, Influenza virus
IREPFVSCS

SEQ ID NO: 473673 - protein, 9 aa, Influenza virus
IRESGGIDK

SEQ ID NO: 473674 - protein, 9 aa, Influenza virus
IREWSYLIE

SEQ ID NO: 473675 - protein, 9 aa, Influenza virus
IRFGEGEQI

SEQ ID NO: 473676 - protein, 9 aa, Influenza virus
IRFGESEQI

SEQ ID NO: 473677 - protein, 9 aa, Influenza virus
IRFGESEQV

SEQ ID NO: 473678 - protein, 9 aa, Influenza virus
IRFNSDLDY

SEQ ID NO: 473679 - protein, 9 aa, Influenza virus
IRFNSDLNY

SEQ ID NO: 473680 - protein, 9 aa, Influenza virus
IRFNSNLDY

SEQ ID NO: 473681 - protein, 9 aa, Influenza virus
IRFPIGTAP

SEQ ID NO: 473682 - protein, 9 aa, Influenza virus
IRFPIGVAP

SEQ ID NO: 473683 - protein, 9 aa, Influenza virus
IRFPVGTAP

SEQ ID NO: 473684 - protein, 9 aa, Influenza virus
IRFVNSDCS

SEQ ID NO: 473685 - protein, 9 aa, Influenza virus
IRGEFNQVE

SEQ ID NO: 473686 - protein, 9 aa, Influenza virus
IRGEFSQVE

SEQ ID NO: 473687 - protein, 9 aa, Influenza virus
IRGETTGRN

SEQ ID NO: 473688 - protein, 9 aa, Influenza virus
IRGFVHFVE

SEQ ID NO: 473689 - protein, 9 aa, Influenza virus
IRGFVYFVE

SEQ ID NO: 473690 - protein, 9 aa, Influenza virus
IRGIFGAIA

SEQ ID NO: 473691 - protein, 9 aa, Influenza virus
IRGKHSNGT

SEQ ID NO: 473692 - protein, 9 aa, Influenza virus
IRGNSPIFN

SEQ ID NO: 473693 - protein, 9 aa, Influenza virus
IRGNSPVFN

SEQ ID NO: 473694 - protein, 9 aa, Influenza virus
IRGQPKEKA

SEQ ID NO: 473695 - protein, 9 aa, Influenza virus
IRGQPKEKT

SEQ ID NO: 473696 - protein, 9 aa, Influenza virus
IRGQPKERT

SEQ ID NO: 473697 - protein, 9 aa, Influenza virus
IRGQQGRMD

SEQ ID NO: 473698 - protein, 9 aa, Influenza virus
IRGRHSNGT

SEQ ID NO: 473699 - protein, 9 aa, Influenza virus
IRGRPEEAK

SEQ ID NO: 473700 - protein, 9 aa, Influenza virus
IRGRPEEVK

SEQ ID NO: 473701 - protein, 9 aa, Influenza virus
IRGRPKEDK

SEQ ID NO: 473702 - protein, 9 aa, Influenza virus
IRGRPKEDR

SEQ ID NO: 473703 - protein, 9 aa, Influenza virus
IRGRPKEEK

SEQ ID NO: 473704 - protein, 9 aa, Influenza virus
IRGWAPLSK

SEQ ID NO: 473705 - protein, 9 aa, Influenza virus
IRHENRMVI

SEQ ID NO: 473706 - protein, 9 aa, Influenza virus
IRHENRMVL

SEQ ID NO: 473707 - protein, 9 aa, Influenza virus
IRHLEECSC

SEQ ID NO: 473708 - protein, 9 aa, Influenza virus
IRIAWSSSS

SEQ ID NO: 473709 - protein, 9 aa, Influenza virus
IRIGSKGDI

SEQ ID NO: 473710 - protein, 9 aa, Influenza virus
IRIGSKGDV

SEQ ID NO: 473711 - protein, 9 aa, Influenza virus
IRIGSKGHV

SEQ ID NO: 473712 - protein, 9 aa, Influenza virus
IRIGSRGDV

SEQ ID NO: 473713 - protein, 9 aa, Influenza virus
IRIGSRGEV

SEQ ID NO: 473714 - protein, 9 aa, Influenza virus
IRIGSRGHI

SEQ ID NO: 473715 - protein, 9 aa, Influenza virus
IRIGSRGHV

SEQ ID NO: 473716 - protein, 9 aa, Influenza virus
IRINMINSK

SEQ ID NO: 473717 - protein, 9 aa, Influenza virus
IRINNETIL

SEQ ID NO: 473718 - protein, 9 aa, Influenza virus
IRKGLILEY

SEQ ID NO: 473719 - protein, 9 aa, Influenza virus
IRLAAGGDI

SEQ ID NO: 473720 - protein, 9 aa, Influenza virus
IRLFDYSGW

SEQ ID NO: 473721 - protein, 9 aa, Influenza virus
IRLFDYSKW

SEQ ID NO: 473722 - protein, 9 aa, Influenza virus
IRLFDYSRW

SEQ ID NO: 473723 - protein, 9 aa, Influenza virus
IRLSADGDI

SEQ ID NO: 473724 - protein, 9 aa, Influenza virus
IRLSAGGAI

SEQ ID NO: 473725 - protein, 9 aa, Influenza virus
IRLSAGGDI

SEQ ID NO: 473726 - protein, 9 aa, Influenza virus
IRLSAGGHI

SEQ ID NO: 473727 - protein, 9 aa, Influenza virus
IRLSAGGNI

SEQ ID NO: 473728 - protein, 9 aa, Influenza virus
IRLSASGDI

SEQ ID NO: 473729 - protein, 9 aa, Influenza virus
IRLSASGDV

SEQ ID NO: 473730 - protein, 9 aa, Influenza virus
IRMAINWGR

SEQ ID NO: 473731 - protein, 9 aa, Influenza virus
IRMATNECR

SEQ ID NO: 473732 - protein, 9 aa, Influenza virus
IRMIKRGIN

SEQ ID NO: 473733 - protein, 9 aa, Influenza virus
IRMIKRGVN

SEQ ID NO: 473734 - protein, 9 aa, Influenza virus
IRMVKRGIN

SEQ ID NO: 473735 - protein, 9 aa, Influenza virus
IRNETYDHD

SEQ ID NO: 473736 - protein, 9 aa, Influenza virus
IRNGTYDHD

SEQ ID NO: 473737 - protein, 9 aa, Influenza virus
IRNGTYDHK

SEQ ID NO: 473738 - protein, 9 aa, Influenza virus
IRNGTYDHN

SEQ ID NO: 473739 - protein, 9 aa, Influenza virus
IRNGTYDHT

SEQ ID NO: 473740 - protein, 9 aa, Influenza virus
IRNGTYNHA

SEQ ID NO: 473741 - protein, 9 aa, Influenza virus
IRNGTYNHD

SEQ ID NO: 473742 - protein, 9 aa, Influenza virus
IRNGTYNHE

SEQ ID NO: 473743 - protein, 9 aa, Influenza virus
IRNGTYNHI

SEQ ID NO: 473744 - protein, 9 aa, Influenza virus
IRNGTYNHK

SEQ ID NO: 473745 - protein, 9 aa, Influenza virus
IRNGTYNHN

SEQ ID NO: 473746 - protein, 9 aa, Influenza virus
IRNGTYNHQ

SEQ ID NO: 473747 - protein, 9 aa, Influenza virus
IRNGTYNHR

SEQ ID NO: 473748 - protein, 9 aa, Influenza virus
IRNGTYNHS

SEQ ID NO: 473749 - protein, 9 aa, Influenza virus
IRNGTYNHT

SEQ ID NO: 473750 - protein, 9 aa, Influenza virus
IRNKHSNGT

SEQ ID NO: 473751 - protein, 9 aa, Influenza virus
IRNKHSNST

SEQ ID NO: 473752 - protein, 9 aa, Influenza virus
IRNLHIPEA

SEQ ID NO: 473753 - protein, 9 aa, Influenza virus
IRNLHIPEV

SEQ ID NO: 473754 - protein, 9 aa, Influenza virus
IRNNMINND

SEQ ID NO: 473755 - protein, 9 aa, Influenza virus
IRNNSYDHS

SEQ ID NO: 473756 - protein, 9 aa, Influenza virus
IRNNTYDHA

SEQ ID NO: 473757 - protein, 9 aa, Influenza virus
IRNNTYDHK

SEQ ID NO: 473758 - protein, 9 aa, Influenza virus
IRNNTYDHN

SEQ ID NO: 473759 - protein, 9 aa, Influenza virus
IRNNTYDHS

SEQ ID NO: 473760 - protein, 9 aa, Influenza virus
IRNNTYDHT

SEQ ID NO: 473761 - protein, 9 aa, Influenza virus
IRNNTYNHT

SEQ ID NO: 473762 - protein, 9 aa, Influenza virus
IRNRHSNGT

SEQ ID NO: 473763 - protein, 9 aa, Influenza virus
IRNSTYDHS

SEQ ID NO: 473764 - protein, 9 aa, Influenza virus
IRPCFWVEL

SEQ ID NO: 473765 - protein, 9 aa, Influenza virus
IRPGYNGQK

SEQ ID NO: 473766 - protein, 9 aa, Influenza virus
IRRIWRQAN

SEQ ID NO: 473767 - protein, 9 aa, Influenza virus
IRRRVDINP

SEQ ID NO: 473768 - protein, 9 aa, Influenza virus
IRRRVDMNP

SEQ ID NO: 473769 - protein, 9 aa, Influenza virus
IRRRVDTNP

SEQ ID NO: 473770 - protein, 9 aa, Influenza virus
IRRRVDVNP

SEQ ID NO: 473771 - protein, 9 aa, Influenza virus
IRRVWRQAN

SEQ ID NO: 473772 - protein, 9 aa, Influenza virus
IRSFSRTEL

SEQ ID NO: 473773 - protein, 9 aa, Influenza virus
IRSNGNLIA

SEQ ID NO: 473774 - protein, 9 aa, Influenza virus
IRSNGNLVA

SEQ ID NO: 473775 - protein, 9 aa, Influenza virus
IRSSVGKMI

SEQ ID NO: 473776 - protein, 9 aa, Influenza virus
IRSWRKQIL

SEQ ID NO: 473777 - protein, 9 aa, Influenza virus
IRTATREGK

SEQ ID NO: 473778 - protein, 9 aa, Influenza virus
IRTDGATSA

SEQ ID NO: 473779 - protein, 9 aa, Influenza virus
IRTFSFQFI

SEQ ID NO: 473780 - protein, 9 aa, Influenza virus
IRTFSFQLI

SEQ ID NO: 473781 - protein, 9 aa, Influenza virus
IRTGTYNHR

SEQ ID NO: 473782 - protein, 9 aa, Influenza virus
IRTKSGGNT

SEQ ID NO: 473783 - protein, 9 aa, Influenza virus
IRTLTLNTM

SEQ ID NO: 473784 - protein, 9 aa, Influenza virus
IRTNGNLIA

SEQ ID NO: 473785 - protein, 9 aa, Influenza virus
IRTNGTSKI

SEQ ID NO: 473786 - protein, 9 aa, Influenza virus
IRTRGLFGA

SEQ ID NO: 473787 - protein, 9 aa, Influenza virus
IRTRSGGNT

SEQ ID NO: 473788 - protein, 9 aa, Influenza virus
IRTSVGRMV

SEQ ID NO: 473789 - protein, 9 aa, Influenza virus
IRTWAKNIL

SEQ ID NO: 473790 - protein, 9 aa, Influenza virus
IRVGCVILL

SEQ ID NO: 473791 - protein, 9 aa, Influenza virus
IRVGSRGHV

SEQ ID NO: 473792 - protein, 9 aa, Influenza virus
IRVKRRPVA

SEQ ID NO: 473793 - protein, 9 aa, Influenza virus
IRWETTGRN

SEQ ID NO: 473794 - protein, 9 aa, Influenza virus
IRWLTLKSG

SEQ ID NO: 473795 - protein, 9 aa, Influenza virus
ISATGMALS

SEQ ID NO: 473796 - protein, 9 aa, Influenza virus
ISATGMILS

SEQ ID NO: 473797 - protein, 9 aa, Influenza virus
ISATGMTLS

SEQ ID NO: 473798 - protein, 9 aa, Influenza virus
ISATGVTLS

SEQ ID NO: 473799 - protein, 9 aa, Influenza virus
ISCFLLAAL

SEQ ID NO: 473800 - protein, 9 aa, Influenza virus
ISCFLLIAL

SEQ ID NO: 473801 - protein, 9 aa, Influenza virus
ISCFLLVAL

SEQ ID NO: 473802 - protein, 9 aa, Influenza virus
ISCLYKLSQ

SEQ ID NO: 473803 - protein, 9 aa, Influenza virus
ISCSHFECR

SEQ ID NO: 473804 - protein, 9 aa, Influenza virus
ISCSHLECK

SEQ ID NO: 473805 - protein, 9 aa, Influenza virus
ISCSHLECR

SEQ ID NO: 473806 - protein, 9 aa, Influenza virus
ISCSHMECR

SEQ ID NO: 473807 - protein, 9 aa, Influenza virus
ISCSHSECR

SEQ ID NO: 473808 - protein, 9 aa, Influenza virus
ISCSIDECR

SEQ ID NO: 473809 - protein, 9 aa, Influenza virus
ISCSIHECR

SEQ ID NO: 473810 - protein, 9 aa, Influenza virus
ISCSINECR

SEQ ID NO: 473811 - protein, 9 aa, Influenza virus
ISCSISECR

SEQ ID NO: 473812 - protein, 9 aa, Influenza virus
ISCSPLECR

SEQ ID NO: 473813 - protein, 9 aa, Influenza virus
ISCSQLECR

SEQ ID NO: 473814 - protein, 9 aa, Influenza virus
ISCSVSECR

SEQ ID NO: 473815 - protein, 9 aa, Influenza virus
ISDGGPNLY

SEQ ID NO: 473816 - protein, 9 aa, Influenza virus
ISDKIDDQI

SEQ ID NO: 473817 - protein, 9 aa, Influenza virus
ISECRTFFL

SEQ ID NO: 473818 - protein, 9 aa, Influenza virus
ISFAISCFL

SEQ ID NO: 473819 - protein, 9 aa, Influenza virus
ISFAMSCFL

SEQ ID NO: 473820 - protein, 9 aa, Influenza virus
ISFATSCFL

SEQ ID NO: 473821 - protein, 9 aa, Influenza virus
ISFESNGGL

SEQ ID NO: 473822 - protein, 9 aa, Influenza virus
ISFESNGNF

SEQ ID NO: 473823 - protein, 9 aa, Influenza virus
ISFESTGNL

SEQ ID NO: 473824 - protein, 9 aa, Influenza virus
ISFQGGHIE

SEQ ID NO: 473825 - protein, 9 aa, Influenza virus
ISFQSGHIE

SEQ ID NO: 473826 - protein, 9 aa, Influenza virus
ISFSISCFL

SEQ ID NO: 473827 - protein, 9 aa, Influenza virus
ISFSMSCFV

SEQ ID NO: 473828 - protein, 9 aa, Influenza virus
ISFTITGDN

SEQ ID NO: 473829 - protein, 9 aa, Influenza virus
ISFWMCSGH

SEQ ID NO: 473830 - protein, 9 aa, Influenza virus
ISFWMCSNG

SEQ ID NO: 473831 - protein, 9 aa, Influenza virus
ISFYWTIVD

SEQ ID NO: 473832 - protein, 9 aa, Influenza virus
ISFYWTIVE

SEQ ID NO: 473833 - protein, 9 aa, Influenza virus
ISFYWTIVV

SEQ ID NO: 473834 - protein, 9 aa, Influenza virus
ISGADDDAY

SEQ ID NO: 473835 - protein, 9 aa, Influenza virus
ISGPDDGAV

SEQ ID NO: 473836 - protein, 9 aa, Influenza virus
ISGPDNEAV

SEQ ID NO: 473837 - protein, 9 aa, Influenza virus
ISGPDNGAV

SEQ ID NO: 473838 - protein, 9 aa, Influenza virus
ISGPDSGAV

SEQ ID NO: 473839 - protein, 9 aa, Influenza virus
ISGPNNNAS

SEQ ID NO: 473840 - protein, 9 aa, Influenza virus
ISGTCAVVM

SEQ ID NO: 473841 - protein, 9 aa, Influenza virus
ISGVKLEEN

SEQ ID NO: 473842 - protein, 9 aa, Influenza virus
ISGWTTANS

SEQ ID NO: 473843 - protein, 9 aa, Influenza virus
ISHCRATEY

SEQ ID NO: 473844 - protein, 9 aa, Influenza virus
ISHISPLSG

SEQ ID NO: 473845 - protein, 9 aa, Influenza virus
ISHRTLLMN

SEQ ID NO: 473846 - protein, 9 aa, Influenza virus
ISIASRSGY

SEQ ID NO: 473847 - protein, 9 aa, Influenza virus
ISIGSSTYQ

SEQ ID NO: 473848 - protein, 9 aa, Influenza virus
ISIGTSTLN

SEQ ID NO: 473849 - protein, 9 aa, Influenza virus
ISIVPNIGS

SEQ ID NO: 473850 - protein, 9 aa, Influenza virus
ISIWMCSNG

SEQ ID NO: 473851 - protein, 9 aa, Influenza virus
ISIYWTLVN

SEQ ID NO: 473852 - protein, 9 aa, Influenza virus
ISKCKTKEG

SEQ ID NO: 473853 - protein, 9 aa, Influenza virus
ISKCRTKEG

SEQ ID NO: 473854 - protein, 9 aa, Influenza virus
ISKCRTREG

SEQ ID NO: 473855 - protein, 9 aa, Influenza virus
ISKDLRSGY

SEQ ID NO: 473856 - protein, 9 aa, Influenza virus
ISKDNGIRI

SEQ ID NO: 473857 - protein, 9 aa, Influenza virus
ISKDSRSGY

SEQ ID NO: 473858 - protein, 9 aa, Influenza virus
ISKDTRSGY

SEQ ID NO: 473859 - protein, 9 aa, Influenza virus
ISKMGVDEY

SEQ ID NO: 473860 - protein, 9 aa, Influenza virus
ISKRGGSGI

SEQ ID NO: 473861 - protein, 9 aa, Influenza virus
ISKRGNSGI

SEQ ID NO: 473862 - protein, 9 aa, Influenza virus
ISKRGSSGI

SEQ ID NO: 473863 - protein, 9 aa, Influenza virus
ISKRGSSGV

SEQ ID NO: 473864 - protein, 9 aa, Influenza virus
ISKSRATEY

SEQ ID NO: 473865 - protein, 9 aa, Influenza virus
ISKSTKSTV

SEQ ID NO: 473866 - protein, 9 aa, Influenza virus
ISKTNQQFE

SEQ ID NO: 473867 - protein, 9 aa, Influenza virus
ISLCSIWFS

SEQ ID NO: 473868 - protein, 9 aa, Influenza virus
ISLGDCSFA

SEQ ID NO: 473869 - protein, 9 aa, Influenza virus
ISLGDCSFT

SEQ ID NO: 473870 - protein, 9 aa, Influenza virus
ISLVKTTLF

SEQ ID NO: 473871 - protein, 9 aa, Influenza virus
ISLWMCSNG

SEQ ID NO: 473872 - protein, 9 aa, Influenza virus
ISMCSSTEF

SEQ ID NO: 473873 - protein, 9 aa, Influenza virus
ISMDSRSGY

SEQ ID NO: 473874 - protein, 9 aa, Influenza virus
ISMEDYSID

SEQ ID NO: 473875 - protein, 9 aa, Influenza virus
ISMEDYSIG

SEQ ID NO: 473876 - protein, 9 aa, Influenza virus
ISNDKPFQN

SEQ ID NO: 473877 - protein, 9 aa, Influenza virus
ISNEGSYFF

SEQ ID NO: 473878 - protein, 9 aa, Influenza virus
ISNETILET

SEQ ID NO: 473879 - protein, 9 aa, Influenza virus
ISNKVNSVI

SEQ ID NO: 473880 - protein, 9 aa, Influenza virus
ISNLPFQNI

SEQ ID NO: 473881 - protein, 9 aa, Influenza virus
ISNQGSFYR

SEQ ID NO: 473882 - protein, 9 aa, Influenza virus
ISNRFQIQG

SEQ ID NO: 473883 - protein, 9 aa, Influenza virus
ISNVGLKVS

SEQ ID NO: 473884 - protein, 9 aa, Influenza virus
ISNVGLNVS

SEQ ID NO: 473885 - protein, 9 aa, Influenza virus
ISPIHLGDC

SEQ ID NO: 473886 - protein, 9 aa, Influenza virus
ISPKLRSGF

SEQ ID NO: 473887 - protein, 9 aa, Influenza virus
ISPLAGSAQ

SEQ ID NO: 473888 - protein, 9 aa, Influenza virus
ISPLAVTWW

SEQ ID NO: 473889 - protein, 9 aa, Influenza virus
ISPLMVAYM

SEQ ID NO: 473890 - protein, 9 aa, Influenza virus
ISPLSGSAQ

SEQ ID NO: 473891 - protein, 9 aa, Influenza virus
ISPRLRSGF

SEQ ID NO: 473892 - protein, 9 aa, Influenza virus
ISPRSRNGF

SEQ ID NO: 473893 - protein, 9 aa, Influenza virus
ISPRSRSGF

SEQ ID NO: 473894 - protein, 9 aa, Influenza virus
ISPVHLGDC

SEQ ID NO: 473895 - protein, 9 aa, Influenza virus
ISRARIDAR

SEQ ID NO: 473896 - protein, 9 aa, Influenza virus
ISRDSRSGY

SEQ ID NO: 473897 - protein, 9 aa, Influenza virus
ISSGSLKLA

SEQ ID NO: 473898 - protein, 9 aa, Influenza virus
ISSLPFQNI

SEQ ID NO: 473899 - protein, 9 aa, Influenza virus
ISSMGEAMV

SEQ ID NO: 473900 - protein, 9 aa, Influenza virus
ISSMMEAMV

SEQ ID NO: 473901 - protein, 9 aa, Influenza virus
ISSMVEAMI

SEQ ID NO: 473902 - protein, 9 aa, Influenza virus
ISSMVEAMM

SEQ ID NO: 473903 - protein, 9 aa, Influenza virus
ISSMVEAMV

SEQ ID NO: 473904 - protein, 9 aa, Influenza virus
ISSSFSFGG

SEQ ID NO: 473905 - protein, 9 aa, Influenza virus
ISTASRAGY

SEQ ID NO: 473906 - protein, 9 aa, Influenza virus
ISTASRSGY

SEQ ID NO: 473907 - protein, 9 aa, Influenza virus
ISTASRYGY

SEQ ID NO: 473908 - protein, 9 aa, Influenza virus
ISTPLGSPP

SEQ ID NO: 473909 - protein, 9 aa, Influenza virus
ISTPLGTPP

SEQ ID NO: 473910 - protein, 9 aa, Influenza virus
ISTRSRSGF

SEQ ID NO: 473911 - protein, 9 aa, Influenza virus
ISTTFPYTG

SEQ ID NO: 473912 - protein, 9 aa, Influenza virus
ISTTGMTLS

SEQ ID NO: 473913 - protein, 9 aa, Influenza virus
ISVESSTYQ

SEQ ID NO: 473914 - protein, 9 aa, Influenza virus
ISVGSGSFP

SEQ ID NO: 473915 - protein, 9 aa, Influenza virus
ISVGSSIYQ

SEQ ID NO: 473916 - protein, 9 aa, Influenza virus
ISVGSSTYQ

SEQ ID NO: 473917 - protein, 9 aa, Influenza virus
ISVGTSTLN

SEQ ID NO: 473918 - protein, 9 aa, Influenza virus
ISWEMGLAP

SEQ ID NO: 473919 - protein, 9 aa, Influenza virus
ISWEMGQAP

SEQ ID NO: 473920 - protein, 9 aa, Influenza virus
ISWGMGQAP

SEQ ID NO: 473921 - protein, 9 aa, Influenza virus
ISWPLSSPP

SEQ ID NO: 473922 - protein, 9 aa, Influenza virus
ISWPQSSPP

SEQ ID NO: 473923 - protein, 9 aa, Influenza virus
ITAASLNDD

SEQ ID NO: 473924 - protein, 9 aa, Influenza virus
ITAQELVES

SEQ ID NO: 473925 - protein, 9 aa, Influenza virus
ITCTCRDNW

SEQ ID NO: 473926 - protein, 9 aa, Influenza virus
ITCVCRDNW

SEQ ID NO: 473927 - protein, 9 aa, Influenza virus
ITDGPSDAQ

SEQ ID NO: 473928 - protein, 9 aa, Influenza virus
ITDGPSNAQ

SEQ ID NO: 473929 - protein, 9 aa, Influenza virus
ITDIWAYNA

SEQ ID NO: 473930 - protein, 9 aa, Influenza virus
ITDIWTYQA

SEQ ID NO: 473931 - protein, 9 aa, Influenza virus
ITDTFKSWK

SEQ ID NO: 473932 - protein, 9 aa, Influenza virus
ITDTIKSWG

SEQ ID NO: 473933 - protein, 9 aa, Influenza virus
ITDTIKSWK

SEQ ID NO: 473934 - protein, 9 aa, Influenza virus
ITDTIKSWR

SEQ ID NO: 473935 - protein, 9 aa, Influenza virus
ITDTIRSWR

SEQ ID NO: 473936 - protein, 9 aa, Influenza virus
ITDTLKSWK

SEQ ID NO: 473937 - protein, 9 aa, Influenza virus
ITDWSGYSG

SEQ ID NO: 473938 - protein, 9 aa, Influenza virus
ITEINTWAR

SEQ ID NO: 473939 - protein, 9 aa, Influenza virus
ITEIVYLNH

SEQ ID NO: 473940 - protein, 9 aa, Influenza virus
ITEIVYLNN

SEQ ID NO: 473941 - protein, 9 aa, Influenza virus
ITEIVYLNS

SEQ ID NO: 473942 - protein, 9 aa, Influenza virus
ITEIYNETV

SEQ ID NO: 473943 - protein, 9 aa, Influenza virus
ITELPFQNL

SEQ ID NO: 473944 - protein, 9 aa, Influenza virus
ITENSFEQI

SEQ ID NO: 473945 - protein, 9 aa, Influenza virus
ITEVWSYNA

SEQ ID NO: 473946 - protein, 9 aa, Influenza virus
ITEWSGYSG

SEQ ID NO: 473947 - protein, 9 aa, Influenza virus
ITFEATGNL

SEQ ID NO: 473948 - protein, 9 aa, Influenza virus
ITFESNGGF

SEQ ID NO: 473949 - protein, 9 aa, Influenza virus
ITFESNGGL

SEQ ID NO: 473950 - protein, 9 aa, Influenza virus
ITFESSGGL

SEQ ID NO: 473951 - protein, 9 aa, Influenza virus
ITFHGAKEI

SEQ ID NO: 473952 - protein, 9 aa, Influenza virus
ITFHGAKEV

SEQ ID NO: 473953 - protein, 9 aa, Influenza virus
ITFHRAKEV

SEQ ID NO: 473954 - protein, 9 aa, Influenza virus
ITFIQALQL

SEQ ID NO: 473955 - protein, 9 aa, Influenza virus
ITFLHNGGL

SEQ ID NO: 473956 - protein, 9 aa, Influenza virus
ITFLQALQL

SEQ ID NO: 473957 - protein, 9 aa, Influenza virus
ITFMQALQL

SEQ ID NO: 473958 - protein, 9 aa, Influenza virus
ITFSDNGGL

SEQ ID NO: 473959 - protein, 9 aa, Influenza virus
ITFSFNGAF

SEQ ID NO: 473960 - protein, 9 aa, Influenza virus
ITFSHNGGL

SEQ ID NO: 473961 - protein, 9 aa, Influenza virus
ITFSHNGGR

SEQ ID NO: 473962 - protein, 9 aa, Influenza virus
ITGDDKNAT

SEQ ID NO: 473963 - protein, 9 aa, Influenza virus
ITGDDRNAT

SEQ ID NO: 473964 - protein, 9 aa, Influenza virus
ITGDNTKWN

SEQ ID NO: 473965 - protein, 9 aa, Influenza virus
ITGFAPFSK

SEQ ID NO: 473966 - protein, 9 aa, Influenza virus
ITGFASFSK

SEQ ID NO: 473967 - protein, 9 aa, Influenza virus
ITGIDKVCT

SEQ ID NO: 473968 - protein, 9 aa, Influenza virus
ITGINKVCT

SEQ ID NO: 473969 - protein, 9 aa, Influenza virus
ITGKLNHLI

SEQ ID NO: 473970 - protein, 9 aa, Influenza virus
ITGKLNRII

SEQ ID NO: 473971 - protein, 9 aa, Influenza virus
ITGKLNRLI

SEQ ID NO: 473972 - protein, 9 aa, Influenza virus
ITGKSHGRI

SEQ ID NO: 473973 - protein, 9 aa, Influenza virus
ITGKSHGRV

SEQ ID NO: 473974 - protein, 9 aa, Influenza virus
ITGPDATAV

SEQ ID NO: 473975 - protein, 9 aa, Influenza virus
ITGPDSTAV

SEQ ID NO: 473976 - protein, 9 aa, Influenza virus
ITGPDTTAV

SEQ ID NO: 473977 - protein, 9 aa, Influenza virus
ITGSPCAPG

SEQ ID NO: 473978 - protein, 9 aa, Influenza virus
ITGSPEAPG

SEQ ID NO: 473979 - protein, 9 aa, Influenza virus
ITGSPGAPG

SEQ ID NO: 473980 - protein, 9 aa, Influenza virus
ITGSPGSPG

SEQ ID NO: 473981 - protein, 9 aa, Influenza virus
ITGSPGVPG

SEQ ID NO: 473982 - protein, 9 aa, Influenza virus
ITGSPSAPG

SEQ ID NO: 473983 - protein, 9 aa, Influenza virus
ITHFQRKRR

SEQ ID NO: 473984 - protein, 9 aa, Influenza virus
ITIDSVSLT

SEQ ID NO: 473985 - protein, 9 aa, Influenza virus
ITIGECPKY

SEQ ID NO: 473986 - protein, 9 aa, Influenza virus
ITIGFVSLI

SEQ ID NO: 473987 - protein, 9 aa, Influenza virus
ITIGISGPD

SEQ ID NO: 473988 - protein, 9 aa, Influenza virus
ITIGKCPKY

SEQ ID NO: 473989 - protein, 9 aa, Influenza virus
ITIGKCSKY

SEQ ID NO: 473990 - protein, 9 aa, Influenza virus
ITIGSASLT

SEQ ID NO: 473991 - protein, 9 aa, Influenza virus
ITIGSVSLI

SEQ ID NO: 473992 - protein, 9 aa, Influenza virus
ITIGSVSLT

SEQ ID NO: 473993 - protein, 9 aa, Influenza virus
ITKIVYLNS

SEQ ID NO: 473994 - protein, 9 aa, Influenza virus
ITLHFKQNE

SEQ ID NO: 473995 - protein, 9 aa, Influenza virus
ITLKFAFNM

SEQ ID NO: 473996 - protein, 9 aa, Influenza virus
ITNGTTGNP

SEQ ID NO: 473997 - protein, 9 aa, Influenza virus
ITNKANSII

SEQ ID NO: 473998 - protein, 9 aa, Influenza virus
ITNKINNIV

SEQ ID NO: 473999 - protein, 9 aa, Influenza virus
ITNKINSII

SEQ ID NO: 474000 - protein, 9 aa, Influenza virus
ITNKVNNIV

SEQ ID NO: 474001 - protein, 9 aa, Influenza virus
ITNKVNSII

SEQ ID NO: 474002 - protein, 9 aa, Influenza virus
ITNKVNSVI

SEQ ID NO: 474003 - protein, 9 aa, Influenza virus
ITNKVNSVV

SEQ ID NO: 474004 - protein, 9 aa, Influenza virus
ITNKVNTVI

SEQ ID NO: 474005 - protein, 9 aa, Influenza virus
ITNPLIRHE

SEQ ID NO: 474006 - protein, 9 aa, Influenza virus
ITNRVNSII

SEQ ID NO: 474007 - protein, 9 aa, Influenza virus
ITPEYAYKI

SEQ ID NO: 474008 - protein, 9 aa, Influenza virus
ITPNGSIPN

SEQ ID NO: 474009 - protein, 9 aa, Influenza virus
ITPNGSISN

SEQ ID NO: 474010 - protein, 9 aa, Influenza virus
ITQESECVC

SEQ ID NO: 474011 - protein, 9 aa, Influenza virus
ITQISNINI

SEQ ID NO: 474012 - protein, 9 aa, Influenza virus
ITQISNTNI

SEQ ID NO: 474013 - protein, 9 aa, Influenza virus
ITQRTIGKK

SEQ ID NO: 474014 - protein, 9 aa, Influenza virus
ITQTLVSNN

SEQ ID NO: 474015 - protein, 9 aa, Influenza virus
ITQTLVSNS

SEQ ID NO: 474016 - protein, 9 aa, Influenza virus
ITREPYVSC

SEQ ID NO: 474017 - protein, 9 aa, Influenza virus
ITRKLNRLI

SEQ ID NO: 474018 - protein, 9 aa, Influenza virus
ITRSGQNHG

SEQ ID NO: 474019 - protein, 9 aa, Influenza virus
ITSKVNSII

SEQ ID NO: 474020 - protein, 9 aa, Influenza virus
ITSLCSIWF

SEQ ID NO: 474021 - protein, 9 aa, Influenza virus
ITSNLPFQN

SEQ ID NO: 474022 - protein, 9 aa, Influenza virus
ITSPLPFQN

SEQ ID NO: 474023 - protein, 9 aa, Influenza virus
ITTHFQRKR

SEQ ID NO: 474024 - protein, 9 aa, Influenza virus
ITTKINNII

SEQ ID NO: 474025 - protein, 9 aa, Influenza virus
ITTKVNSII

SEQ ID NO: 474026 - protein, 9 aa, Influenza virus
ITVGSSKYQ

SEQ ID NO: 474027 - protein, 9 aa, Influenza virus
ITVGSSKYR

SEQ ID NO: 474028 - protein, 9 aa, Influenza virus
ITVIKNNMI

SEQ ID NO: 474029 - protein, 9 aa, Influenza virus
ITVTHAQDI

SEQ ID NO: 474030 - protein, 9 aa, Influenza virus
ITVTHSVEL

SEQ ID NO: 474031 - protein, 9 aa, Influenza virus
ITVTHSVNL

SEQ ID NO: 474032 - protein, 9 aa, Influenza virus
ITVTSSVEL

SEQ ID NO: 474033 - protein, 9 aa, Influenza virus
ITWGIHHPS

SEQ ID NO: 474034 - protein, 9 aa, Influenza virus
ITYGACPKY

SEQ ID NO: 474035 - protein, 9 aa, Influenza virus
ITYGACPRY

SEQ ID NO: 474036 - protein, 9 aa, Influenza virus
ITYGPCPRY

SEQ ID NO: 474037 - protein, 9 aa, Influenza virus
ITYGVCPRY

SEQ ID NO: 474038 - protein, 9 aa, Influenza virus
ITYIWTYQA

SEQ ID NO: 474039 - protein, 9 aa, Influenza virus
ITYNKTVIN

SEQ ID NO: 474040 - protein, 9 aa, Influenza virus
ITYNNTVIN

SEQ ID NO: 474041 - protein, 9 aa, Influenza virus
ITYNNTVVN

SEQ ID NO: 474042 - protein, 9 aa, Influenza virus
ITYNSTVVN

SEQ ID NO: 474043 - protein, 9 aa, Influenza virus
ITYSSPMMW

SEQ ID NO: 474044 - protein, 9 aa, Influenza virus
ITYSSSLMW

SEQ ID NO: 474045 - protein, 9 aa, Influenza virus
ITYSSSMMW

SEQ ID NO: 474046 - protein, 9 aa, Influenza virus
IVADRDSTQ

SEQ ID NO: 474047 - protein, 9 aa, Influenza virus
IVAFCGTSG

SEQ ID NO: 474048 - protein, 9 aa, Influenza virus
IVALCGSKE

SEQ ID NO: 474049 - protein, 9 aa, Influenza virus
IVALCGSKK

SEQ ID NO: 474050 - protein, 9 aa, Influenza virus
IVALCGSRE

SEQ ID NO: 474051 - protein, 9 aa, Influenza virus
IVAMVFSQE

SEQ ID NO: 474052 - protein, 9 aa, Influenza virus
IVASSGTLE

SEQ ID NO: 474053 - protein, 9 aa, Influenza virus
IVASSGTVE

SEQ ID NO: 474054 - protein, 9 aa, Influenza virus
IVAVTDGPA

SEQ ID NO: 474055 - protein, 9 aa, Influenza virus
IVDKMNREF

SEQ ID NO: 474056 - protein, 9 aa, Influenza virus
IVDNKNWSG

SEQ ID NO: 474057 - protein, 9 aa, Influenza virus
IVDNNNWFG

SEQ ID NO: 474058 - protein, 9 aa, Influenza virus
IVDNNNWSG

SEQ ID NO: 474059 - protein, 9 aa, Influenza virus
IVDNNSWSG

SEQ ID NO: 474060 - protein, 9 aa, Influenza virus
IVDNQNWSG

SEQ ID NO: 474061 - protein, 9 aa, Influenza virus
IVDNSNWSG

SEQ ID NO: 474062 - protein, 9 aa, Influenza virus
IVERILEEE

SEQ ID NO: 474063 - protein, 9 aa, Influenza virus
IVERPKEIE

SEQ ID NO: 474064 - protein, 9 aa, Influenza virus
IVERPKEME

SEQ ID NO: 474065 - protein, 9 aa, Influenza virus
IVERPSAPE

SEQ ID NO: 474066 - protein, 9 aa, Influenza virus
IVERTKEME

SEQ ID NO: 474067 - protein, 9 aa, Influenza virus
IVETGYVCS

SEQ ID NO: 474068 - protein, 9 aa, Influenza virus
IVFCGTSGT

SEQ ID NO: 474069 - protein, 9 aa, Influenza virus
IVFNTIGNL

SEQ ID NO: 474070 - protein, 9 aa, Influenza virus
IVGLVFFCL

SEQ ID NO: 474071 - protein, 9 aa, Influenza virus
IVGNDNWSG

SEQ ID NO: 474072 - protein, 9 aa, Influenza virus
IVGNNNWSG

SEQ ID NO: 474073 - protein, 9 aa, Influenza virus
IVGNPSCAS

SEQ ID NO: 474074 - protein, 9 aa, Influenza virus
IVGNPSCAT

SEQ ID NO: 474075 - protein, 9 aa, Influenza virus
IVHISPLSG

SEQ ID NO: 474076 - protein, 9 aa, Influenza virus
IVILVLGLS

SEQ ID NO: 474077 - protein, 9 aa, Influenza virus
IVKGRSHLR

SEQ ID NO: 474078 - protein, 9 aa, Influenza virus
IVKTLTNEK

SEQ ID NO: 474079 - protein, 9 aa, Influenza virus
IVKTLTNEQ

SEQ ID NO: 474080 - protein, 9 aa, Influenza virus
IVKTLTNER

SEQ ID NO: 474081 - protein, 9 aa, Influenza virus
IVKTLTSEK

SEQ ID NO: 474082 - protein, 9 aa, Influenza virus
IVLGIINLL

SEQ ID NO: 474083 - protein, 9 aa, Influenza virus
IVLLENQKT

SEQ ID NO: 474084 - protein, 9 aa, Influenza virus
IVLNTDWSG

SEQ ID NO: 474085 - protein, 9 aa, Influenza virus
IVLVGLILA

SEQ ID NO: 474086 - protein, 9 aa, Influenza virus
IVLVMKRKR

SEQ ID NO: 474087 - protein, 9 aa, Influenza virus
IVMGLVFIC

SEQ ID NO: 474088 - protein, 9 aa, Influenza virus
IVMVGLILA

SEQ ID NO: 474089 - protein, 9 aa, Influenza virus
IVNAALGSP

SEQ ID NO: 474090 - protein, 9 aa, Influenza virus
IVNGALGSP

SEQ ID NO: 474091 - protein, 9 aa, Influenza virus
IVNNQDWSG

SEQ ID NO: 474092 - protein, 9 aa, Influenza virus
IVNNQNWSG

SEQ ID NO: 474093 - protein, 9 aa, Influenza virus
IVNSALGSP

SEQ ID NO: 474094 - protein, 9 aa, Influenza virus
IVNTTLSTI

SEQ ID NO: 474095 - protein, 9 aa, Influenza virus
IVPCFWLEM

SEQ ID NO: 474096 - protein, 9 aa, Influenza virus
IVPNIGSRP

SEQ ID NO: 474097 - protein, 9 aa, Influenza virus
IVPSFDMNN

SEQ ID NO: 474098 - protein, 9 aa, Influenza virus
IVPSFDMSK

SEQ ID NO: 474099 - protein, 9 aa, Influenza virus
IVPSFDMSN

SEQ ID NO: 474100 - protein, 9 aa, Influenza virus
IVPSFEMSN

SEQ ID NO: 474101 - protein, 9 aa, Influenza virus
IVPSGPLKA

SEQ ID NO: 474102 - protein, 9 aa, Influenza virus
IVQITGKLN

SEQ ID NO: 474103 - protein, 9 aa, Influenza virus
IVRRAAVSA

SEQ ID NO: 474104 - protein, 9 aa, Influenza virus
IVRRAIVSA

SEQ ID NO: 474105 - protein, 9 aa, Influenza virus
IVRRATVSA

SEQ ID NO: 474106 - protein, 9 aa, Influenza virus
IVSADPLAS

SEQ ID NO: 474107 - protein, 9 aa, Influenza virus
IVSIDRFLR

SEQ ID NO: 474108 - protein, 9 aa, Influenza virus
IVSKDNGIR

SEQ ID NO: 474109 - protein, 9 aa, Influenza virus
IVSLGAISF

SEQ ID NO: 474110 - protein, 9 aa, Influenza virus
IVSMCSSTE

SEQ ID NO: 474111 - protein, 9 aa, Influenza virus
IVSNDNWSG

SEQ ID NO: 474112 - protein, 9 aa, Influenza virus
IVSNTDWSG

SEQ ID NO: 474113 - protein, 9 aa, Influenza virus
IVSPLAVTW

SEQ ID NO: 474114 - protein, 9 aa, Influenza virus
IVSSLPFQN

SEQ ID NO: 474115 - protein, 9 aa, Influenza virus
IVSSLPFQS

SEQ ID NO: 474116 - protein, 9 aa, Influenza virus
IVSWSQNIL

SEQ ID NO: 474117 - protein, 9 aa, Influenza virus
IVTFCGLDN

SEQ ID NO: 474118 - protein, 9 aa, Influenza virus
IVTFCGLNN

SEQ ID NO: 474119 - protein, 9 aa, Influenza virus
IVTHFQRKR

SEQ ID NO: 474120 - protein, 9 aa, Influenza virus
IVTIGSVSI

SEQ ID NO: 474121 - protein, 9 aa, Influenza virus
IVTREPYIS

SEQ ID NO: 474122 - protein, 9 aa, Influenza virus
IVTREPYVS

SEQ ID NO: 474123 - protein, 9 aa, Influenza virus
IVTTVGWSW

SEQ ID NO: 474124 - protein, 9 aa, Influenza virus
IVTVTHAQD

SEQ ID NO: 474125 - protein, 9 aa, Influenza virus
IVVFCGASG

SEQ ID NO: 474126 - protein, 9 aa, Influenza virus
IVVFCGTSA

SEQ ID NO: 474127 - protein, 9 aa, Influenza virus
IVVFCGTSG

SEQ ID NO: 474128 - protein, 9 aa, Influenza virus
IVVTREPYV

SEQ ID NO: 474129 - protein, 9 aa, Influenza virus
IVWACQRGN

SEQ ID NO: 474130 - protein, 9 aa, Influenza virus
IVWGIHHPS

SEQ ID NO: 474131 - protein, 9 aa, Influenza virus
IVWGVHHSS

SEQ ID NO: 474132 - protein, 9 aa, Influenza virus
IWAIHHPPT

SEQ ID NO: 474133 - protein, 9 aa, Influenza virus
IWASGSSIS

SEQ ID NO: 474134 - protein, 9 aa, Influenza virus
IWAYNAELI

SEQ ID NO: 474135 - protein, 9 aa, Influenza virus
IWAYNAELL

SEQ ID NO: 474136 - protein, 9 aa, Influenza virus
IWDANGWVS

SEQ ID NO: 474137 - protein, 9 aa, Influenza virus
IWDTLIERD

SEQ ID NO: 474138 - protein, 9 aa, Influenza virus
IWFSHYNQM

SEQ ID NO: 474139 - protein, 9 aa, Influenza virus
IWFSHYNQV

SEQ ID NO: 474140 - protein, 9 aa, Influenza virus
IWGIHHPND

SEQ ID NO: 474141 - protein, 9 aa, Influenza virus
IWGIHHPSS

SEQ ID NO: 474142 - protein, 9 aa, Influenza virus
IWGVHHPID

SEQ ID NO: 474143 - protein, 9 aa, Influenza virus
IWGVHHPKD

SEQ ID NO: 474144 - protein, 9 aa, Influenza virus
IWGVHHPND

SEQ ID NO: 474145 - protein, 9 aa, Influenza virus
IWGVHHPST

SEQ ID NO: 474146 - protein, 9 aa, Influenza virus
IWHSNLNDA

SEQ ID NO: 474147 - protein, 9 aa, Influenza virus
IWHSNLNDT

SEQ ID NO: 474148 - protein, 9 aa, Influenza virus
IWIGRTKST

SEQ ID NO: 474149 - protein, 9 aa, Influenza virus
IWITREPYV

SEQ ID NO: 474150 - protein, 9 aa, Influenza virus
IWLWLVLRE

SEQ ID NO: 474151 - protein, 9 aa, Influenza virus
IWMACHSAA

SEQ ID NO: 474152 - protein, 9 aa, Influenza virus
IWMCSNGSL

SEQ ID NO: 474153 - protein, 9 aa, Influenza virus
IWRQANNGD

SEQ ID NO: 474154 - protein, 9 aa, Influenza virus
IWRQANNGE

SEQ ID NO: 474155 - protein, 9 aa, Influenza virus
IWSKPQCQI

SEQ ID NO: 474156 - protein, 9 aa, Influenza virus
IWSYNAEFL

SEQ ID NO: 474157 - protein, 9 aa, Influenza virus
IWSYNAELL

SEQ ID NO: 474158 - protein, 9 aa, Influenza virus
IWSYNAKLL

SEQ ID NO: 474159 - protein, 9 aa, Influenza virus
IWSYNAQLL

SEQ ID NO: 474160 - protein, 9 aa, Influenza virus
IWSYNARLL

SEQ ID NO: 474161 - protein, 9 aa, Influenza virus
IWTSASSIS

SEQ ID NO: 474162 - protein, 9 aa, Influenza virus
IWTSGSIIS

SEQ ID NO: 474163 - protein, 9 aa, Influenza virus
IWTSGSSIA

SEQ ID NO: 474164 - protein, 9 aa, Influenza virus
IWTSGSSIS

SEQ ID NO: 474165 - protein, 9 aa, Influenza virus
IWTSSSSIV

SEQ ID NO: 474166 - protein, 9 aa, Influenza virus
IWTSSSSTV

SEQ ID NO: 474167 - protein, 9 aa, Influenza virus
IWTSSSSVV

SEQ ID NO: 474168 - protein, 9 aa, Influenza virus
IWTYNAELL

SEQ ID NO: 474169 - protein, 9 aa, Influenza virus
IWTYQAELL

SEQ ID NO: 474170 - protein, 9 aa, Influenza virus
IWVTRELYV

SEQ ID NO: 474171 - protein, 9 aa, Influenza virus
IWVTREPYV

SEQ ID NO: 474172 - protein, 9 aa, Influenza virus
IYATVAGSL

SEQ ID NO: 474173 - protein, 9 aa, Influenza virus
IYCICRDNW

SEQ ID NO: 474174 - protein, 9 aa, Influenza virus
IYCVCRDNW

SEQ ID NO: 474175 - protein, 9 aa, Influenza virus
IYDFNEGSY

SEQ ID NO: 474176 - protein, 9 aa, Influenza virus
IYGKDNAIR

SEQ ID NO: 474177 - protein, 9 aa, Influenza virus
IYGKDNAVR

SEQ ID NO: 474178 - protein, 9 aa, Influenza virus
IYGNPKCDI

SEQ ID NO: 474179 - protein, 9 aa, Influenza virus
IYGNPKCDT

SEQ ID NO: 474180 - protein, 9 aa, Influenza virus
IYGNPKCDV

SEQ ID NO: 474181 - protein, 9 aa, Influenza virus
IYHKCDNAC

SEQ ID NO: 474182 - protein, 9 aa, Influenza virus
IYHKCDNSC

SEQ ID NO: 474183 - protein, 9 aa, Influenza virus
IYHKCDNTC

SEQ ID NO: 474184 - protein, 9 aa, Influenza virus
IYHKCDNVC

SEQ ID NO: 474185 - protein, 9 aa, Influenza virus
IYHKCNNAC

SEQ ID NO: 474186 - protein, 9 aa, Influenza virus
IYIEVLHLT

SEQ ID NO: 474187 - protein, 9 aa, Influenza virus
IYKILSIYS

SEQ ID NO: 474188 - protein, 9 aa, Influenza virus
IYKILTIYS

SEQ ID NO: 474189 - protein, 9 aa, Influenza virus
IYNETVRLE

SEQ ID NO: 474190 - protein, 9 aa, Influenza virus
IYNRMGAVT

SEQ ID NO: 474191 - protein, 9 aa, Influenza virus
IYNRMGTIT

SEQ ID NO: 474192 - protein, 9 aa, Influenza virus
IYNRMGTVA

SEQ ID NO: 474193 - protein, 9 aa, Influenza virus
IYNRMGTVT

SEQ ID NO: 474194 - protein, 9 aa, Influenza virus
IYQILAIYA

SEQ ID NO: 474195 - protein, 9 aa, Influenza virus
IYQILAIYS

SEQ ID NO: 474196 - protein, 9 aa, Influenza virus
IYQILSIYS

SEQ ID NO: 474197 - protein, 9 aa, Influenza virus
IYRDEAINN

SEQ ID NO: 474198 - protein, 9 aa, Influenza virus
IYSCIASSI

SEQ ID NO: 474199 - protein, 9 aa, Influenza virus
IYSCIASSL

SEQ ID NO: 474200 - protein, 9 aa, Influenza virus
IYSCIASST

SEQ ID NO: 474201 - protein, 9 aa, Influenza virus
IYSCIASSV

SEQ ID NO: 474202 - protein, 9 aa, Influenza virus
IYSSSMMWE

SEQ ID NO: 474203 - protein, 9 aa, Influenza virus
IYSSVASSL

SEQ ID NO: 474204 - protein, 9 aa, Influenza virus
IYSTAASSL

SEQ ID NO: 474205 - protein, 9 aa, Influenza virus
IYSTISSSL

SEQ ID NO: 474206 - protein, 9 aa, Influenza virus
IYSTVAASL

SEQ ID NO: 474207 - protein, 9 aa, Influenza virus
IYSTVASSF

SEQ ID NO: 474208 - protein, 9 aa, Influenza virus
IYSTVASSI

SEQ ID NO: 474209 - protein, 9 aa, Influenza virus
IYSTVASSL

SEQ ID NO: 474210 - protein, 9 aa, Influenza virus
IYSTVASSS

SEQ ID NO: 474211 - protein, 9 aa, Influenza virus
IYSTVSSSL

SEQ ID NO: 474212 - protein, 9 aa, Influenza virus
IYSTVTSSL

SEQ ID NO: 474213 - protein, 9 aa, Influenza virus
IYSTVVSSL

SEQ ID NO: 474214 - protein, 9 aa, Influenza virus
IYWHLMHPG

SEQ ID NO: 474215 - protein, 9 aa, Influenza virus
IYWTIVKPG

SEQ ID NO: 474216 - protein, 9 aa, Influenza virus
IYWTLVNPG

SEQ ID NO: 474217 - protein, 9 aa, Influenza virus
IYWTVVKPG

SEQ ID NO: 474218 - protein, 9 aa, Influenza virus
IYWWDGLQS

SEQ ID NO: 474219 - protein, 9 aa, Influenza virus
KAAIGLRIS

SEQ ID NO: 474220 - protein, 9 aa, Influenza virus
KAALGLRIS

SEQ ID NO: 474221 - protein, 9 aa, Influenza virus
KAAMGLKIS

SEQ ID NO: 474222 - protein, 9 aa, Influenza virus
KAAMGLRIS

SEQ ID NO: 474223 - protein, 9 aa, Influenza virus
KAAMGMRIS

SEQ ID NO: 474224 - protein, 9 aa, Influenza virus
KACELTDSI

SEQ ID NO: 474225 - protein, 9 aa, Influenza virus
KACELTDSS

SEQ ID NO: 474226 - protein, 9 aa, Influenza virus
KACELTDST

SEQ ID NO: 474227 - protein, 9 aa, Influenza virus
KACELTDSV

SEQ ID NO: 474228 - protein, 9 aa, Influenza virus
KACELTGSS

SEQ ID NO: 474229 - protein, 9 aa, Influenza virus
KACNALTGG

SEQ ID NO: 474230 - protein, 9 aa, Influenza virus
KACNASTGA

SEQ ID NO: 474231 - protein, 9 aa, Influenza virus
KACNASTGG

SEQ ID NO: 474232 - protein, 9 aa, Influenza virus
KACSASTGG

SEQ ID NO: 474233 - protein, 9 aa, Influenza virus
KADEICIGY

SEQ ID NO: 474234 - protein, 9 aa, Influenza virus
KADHRIYWI

SEQ ID NO: 474235 - protein, 9 aa, Influenza virus
KADKICIGY

SEQ ID NO: 474236 - protein, 9 aa, Influenza virus
KADLIIERR

SEQ ID NO: 474237 - protein, 9 aa, Influenza virus
KADTILERN

SEQ ID NO: 474238 - protein, 9 aa, Influenza virus
KADTRILFI

SEQ ID NO: 474239 - protein, 9 aa, Influenza virus
KADTRILFV

SEQ ID NO: 474240 - protein, 9 aa, Influenza virus
KAEIAQKLE

SEQ ID NO: 474241 - protein, 9 aa, Influenza virus
KAEIAQRLE

SEQ ID NO: 474242 - protein, 9 aa, Influenza virus
KAGFIEGGW

SEQ ID NO: 474243 - protein, 9 aa, Influenza virus
KAGFIENGW

SEQ ID NO: 474244 - protein, 9 aa, Influenza virus
KAGVKMNPN

SEQ ID NO: 474245 - protein, 9 aa, Influenza virus
KAHNGKLCR

SEQ ID NO: 474246 - protein, 9 aa, Influenza virus
KAIDEITTK

SEQ ID NO: 474247 - protein, 9 aa, Influenza virus
KAIDGITNK

SEQ ID NO: 474248 - protein, 9 aa, Influenza virus
KAIDGVTNK

SEQ ID NO: 474249 - protein, 9 aa, Influenza virus
KAIDIMQNK

SEQ ID NO: 474250 - protein, 9 aa, Influenza virus
KAIDNMQNK

SEQ ID NO: 474251 - protein, 9 aa, Influenza virus
KAIDNMQNR

SEQ ID NO: 474252 - protein, 9 aa, Influenza virus
KAIDQITTK

SEQ ID NO: 474253 - protein, 9 aa, Influenza virus
KAIDRITTK

SEQ ID NO: 474254 - protein, 9 aa, Influenza virus
KAINEITTK

SEQ ID NO: 474255 - protein, 9 aa, Influenza virus
KAINGVTNK

SEQ ID NO: 474256 - protein, 9 aa, Influenza virus
KAIWTSGSS

SEQ ID NO: 474257 - protein, 9 aa, Influenza virus
KAKLANVVR

SEQ ID NO: 474258 - protein, 9 aa, Influenza virus
KALNEITTK

SEQ ID NO: 474259 - protein, 9 aa, Influenza virus
KALSIYSCI

SEQ ID NO: 474260 - protein, 9 aa, Influenza virus
KAMEQMAGS

SEQ ID NO: 474261 - protein, 9 aa, Influenza virus
KAMEQVAGS

SEQ ID NO: 474262 - protein, 9 aa, Influenza virus
KAMMDQVRE

SEQ ID NO: 474263 - protein, 9 aa, Influenza virus
KANQVFPQL

SEQ ID NO: 474264 - protein, 9 aa, Influenza virus
KANVLIGQG

SEQ ID NO: 474265 - protein, 9 aa, Influenza virus
KAPISLGDC

SEQ ID NO: 474266 - protein, 9 aa, Influenza virus
KAPQLNPID

SEQ ID NO: 474267 - protein, 9 aa, Influenza virus
KARIDYYWS

SEQ ID NO: 474268 - protein, 9 aa, Influenza virus
KASKEPEVH

SEQ ID NO: 474269 - protein, 9 aa, Influenza virus
KASLRLAVG

SEQ ID NO: 474270 - protein, 9 aa, Influenza virus
KASTQKAID

SEQ ID NO: 474271 - protein, 9 aa, Influenza virus
KASTQKAIN

SEQ ID NO: 474272 - protein, 9 aa, Influenza virus
KATAILRKA

SEQ ID NO: 474273 - protein, 9 aa, Influenza virus
KATCVCRDN

SEQ ID NO: 474274 - protein, 9 aa, Influenza virus
KATKMEAIL

SEQ ID NO: 474275 - protein, 9 aa, Influenza virus
KATKMKAII

SEQ ID NO: 474276 - protein, 9 aa, Influenza virus
KATKMKAIL

SEQ ID NO: 474277 - protein, 9 aa, Influenza virus
KATKRLIQL

SEQ ID NO: 474278 - protein, 9 aa, Influenza virus
KATNGNYGP

SEQ ID NO: 474279 - protein, 9 aa, Influenza virus
KATRKLIQL

SEQ ID NO: 474280 - protein, 9 aa, Influenza virus
KATRRLIQL

SEQ ID NO: 474281 - protein, 9 aa, Influenza virus
KATRRLVQL

SEQ ID NO: 474282 - protein, 9 aa, Influenza virus
KATRRMIQL

SEQ ID NO: 474283 - protein, 9 aa, Influenza virus
KAVDLGSCG

SEQ ID NO: 474284 - protein, 9 aa, Influenza virus
KAVKLYKKL

SEQ ID NO: 474285 - protein, 9 aa, Influenza virus
KAVKLYRKL

SEQ ID NO: 474286 - protein, 9 aa, Influenza virus
KAVRGDLNF

SEQ ID NO: 474287 - protein, 9 aa, Influenza virus
KAWLHICVT

SEQ ID NO: 474288 - protein, 9 aa, Influenza virus
KAWLHVCIT

SEQ ID NO: 474289 - protein, 9 aa, Influenza virus
KAWLHVCVT

SEQ ID NO: 474290 - protein, 9 aa, Influenza virus
KCCNLFEKF

SEQ ID NO: 474291 - protein, 9 aa, Influenza virus
KCCSLFEKF

SEQ ID NO: 474292 - protein, 9 aa, Influenza virus
KCCTLFEKF

SEQ ID NO: 474293 - protein, 9 aa, Influenza virus
KCDDDCMAS

SEQ ID NO: 474294 - protein, 9 aa, Influenza virus
KCDDECMDS

SEQ ID NO: 474295 - protein, 9 aa, Influenza virus
KCDDECMNS

SEQ ID NO: 474296 - protein, 9 aa, Influenza virus
KCDDECMSS

SEQ ID NO: 474297 - protein, 9 aa, Influenza virus
KCDDHCMES

SEQ ID NO: 474298 - protein, 9 aa, Influenza virus
KCDDQCMES

SEQ ID NO: 474299 - protein, 9 aa, Influenza virus
KCDIHLKDQ

SEQ ID NO: 474300 - protein, 9 aa, Influenza virus
KCDIHLRDQ

SEQ ID NO: 474301 - protein, 9 aa, Influenza virus
KCDLYLNGR

SEQ ID NO: 474302 - protein, 9 aa, Influenza virus
KCDLYLSGR

SEQ ID NO: 474303 - protein, 9 aa, Influenza virus
KCDNECMDS

SEQ ID NO: 474304 - protein, 9 aa, Influenza virus
KCDNECMET

SEQ ID NO: 474305 - protein, 9 aa, Influenza virus
KCDNKCMET

SEQ ID NO: 474306 - protein, 9 aa, Influenza virus
KCDNQCMES

SEQ ID NO: 474307 - protein, 9 aa, Influenza virus
KCDPYLNGR

SEQ ID NO: 474308 - protein, 9 aa, Influenza virus
KCDTHLKDQ

SEQ ID NO: 474309 - protein, 9 aa, Influenza virus
KCDVHLKDQ

SEQ ID NO: 474310 - protein, 9 aa, Influenza virus
KCFNPCFYV

SEQ ID NO: 474311 - protein, 9 aa, Influenza virus
KCFWKGGSI

SEQ ID NO: 474312 - protein, 9 aa, Influenza virus
KCFWKSGSI

SEQ ID NO: 474313 - protein, 9 aa, Influenza virus
KCFWRGGSI

SEQ ID NO: 474314 - protein, 9 aa, Influenza virus
KCICRDNWK

SEQ ID NO: 474315 - protein, 9 aa, Influenza virus
KCICRDNWR

SEQ ID NO: 474316 - protein, 9 aa, Influenza virus
KCIERVRNG

SEQ ID NO: 474317 - protein, 9 aa, Influenza virus
KCIESIRNG

SEQ ID NO: 474318 - protein, 9 aa, Influenza virus
KCIKTFFGW

SEQ ID NO: 474319 - protein, 9 aa, Influenza virus
KCIRTFFGW

SEQ ID NO: 474320 - protein, 9 aa, Influenza virus
KCKTKEGRR

SEQ ID NO: 474321 - protein, 9 aa, Influenza virus
KCMESVRNG

SEQ ID NO: 474322 - protein, 9 aa, Influenza virus
KCMETIKNG

SEQ ID NO: 474323 - protein, 9 aa, Influenza virus
KCMKTFFGW

SEQ ID NO: 474324 - protein, 9 aa, Influenza virus
KCMRTFFGW

SEQ ID NO: 474325 - protein, 9 aa, Influenza virus
KCNDECMNS

SEQ ID NO: 474326 - protein, 9 aa, Influenza virus
KCNDPYPGN

SEQ ID NO: 474327 - protein, 9 aa, Influenza virus
KCNDSCMDT

SEQ ID NO: 474328 - protein, 9 aa, Influenza virus
KCNDSCMEA

SEQ ID NO: 474329 - protein, 9 aa, Influenza virus
KCNDSCMET

SEQ ID NO: 474330 - protein, 9 aa, Influenza virus
KCNEPYPGN

SEQ ID NO: 474331 - protein, 9 aa, Influenza virus
KCNNECMET

SEQ ID NO: 474332 - protein, 9 aa, Influenza virus
KCNNSCMET

SEQ ID NO: 474333 - protein, 9 aa, Influenza virus
KCNNTCMET

SEQ ID NO: 474334 - protein, 9 aa, Influenza virus
KCNQFALGQ

SEQ ID NO: 474335 - protein, 9 aa, Influenza virus
KCNTKCQTS

SEQ ID NO: 474336 - protein, 9 aa, Influenza virus
KCPKYIPSG

SEQ ID NO: 474337 - protein, 9 aa, Influenza virus
KCPKYIPSN

SEQ ID NO: 474338 - protein, 9 aa, Influenza virus
KCPKYIPSR

SEQ ID NO: 474339 - protein, 9 aa, Influenza virus
KCPKYISSG

SEQ ID NO: 474340 - protein, 9 aa, Influenza virus
KCPKYVKST

SEQ ID NO: 474341 - protein, 9 aa, Influenza virus
KCPRYIPSG

SEQ ID NO: 474342 - protein, 9 aa, Influenza virus
KCPRYVKQS

SEQ ID NO: 474343 - protein, 9 aa, Influenza virus
KCQLNEGVM

SEQ ID NO: 474344 - protein, 9 aa, Influenza virus
KCQSEIGGI

SEQ ID NO: 474345 - protein, 9 aa, Influenza virus
KCQSEIGWI

SEQ ID NO: 474346 - protein, 9 aa, Influenza virus
KCQSPLGAI

SEQ ID NO: 474347 - protein, 9 aa, Influenza virus
KCQTEIGGI

SEQ ID NO: 474348 - protein, 9 aa, Influenza virus
KCQTEVGGI

SEQ ID NO: 474349 - protein, 9 aa, Influenza virus
KCQTPLGAI

SEQ ID NO: 474350 - protein, 9 aa, Influenza virus
KCQTPLGAL

SEQ ID NO: 474351 - protein, 9 aa, Influenza virus
KCQTSLGGI

SEQ ID NO: 474352 - protein, 9 aa, Influenza virus
KCQTSLGGV

SEQ ID NO: 474353 - protein, 9 aa, Influenza virus
KCQTSMGGI

SEQ ID NO: 474354 - protein, 9 aa, Influenza virus
KCQTSMGGV

SEQ ID NO: 474355 - protein, 9 aa, Influenza virus
KCQTSVGGI

SEQ ID NO: 474356 - protein, 9 aa, Influenza virus
KCQTYAGAI

SEQ ID NO: 474357 - protein, 9 aa, Influenza virus
KCQTYAGAV

SEQ ID NO: 474358 - protein, 9 aa, Influenza virus
KCQTYTGAI

SEQ ID NO: 474359 - protein, 9 aa, Influenza virus
KCRTKEGRR

SEQ ID NO: 474360 - protein, 9 aa, Influenza virus
KCRTREGRR

SEQ ID NO: 474361 - protein, 9 aa, Influenza virus
KCSKYVKST

SEQ ID NO: 474362 - protein, 9 aa, Influenza virus
KCVCRDNWK

SEQ ID NO: 474363 - protein, 9 aa, Influenza virus
KCYNPCFYV

SEQ ID NO: 474364 - protein, 9 aa, Influenza virus
KCYQFALGH

SEQ ID NO: 474365 - protein, 9 aa, Influenza virus
KCYQFALGQ

SEQ ID NO: 474366 - protein, 9 aa, Influenza virus
KDAERGKLK

SEQ ID NO: 474367 - protein, 9 aa, Influenza virus
KDCFQPCFY

SEQ ID NO: 474368 - protein, 9 aa, Influenza virus
KDCFQSCFY

SEQ ID NO: 474369 - protein, 9 aa, Influenza virus
KDCSIAGWL

SEQ ID NO: 474370 - protein, 9 aa, Influenza virus
KDCSVAGWL

SEQ ID NO: 474371 - protein, 9 aa, Influenza virus
KDCSVSGWL

SEQ ID NO: 474372 - protein, 9 aa, Influenza virus
KDEGNGCFT

SEQ ID NO: 474373 - protein, 9 aa, Influenza virus
KDGDIIFLW

SEQ ID NO: 474374 - protein, 9 aa, Influenza virus
KDIILWFSF

SEQ ID NO: 474375 - protein, 9 aa, Influenza virus
KDIILWISF

SEQ ID NO: 474376 - protein, 9 aa, Influenza virus
KDIILWVSF

SEQ ID NO: 474377 - protein, 9 aa, Influenza virus
KDILEKAHN

SEQ ID NO: 474378 - protein, 9 aa, Influenza virus
KDILEKTHN

SEQ ID NO: 474379 - protein, 9 aa, Influenza virus
KDILRTQES

SEQ ID NO: 474380 - protein, 9 aa, Influenza virus
KDLDNCHPI

SEQ ID NO: 474381 - protein, 9 aa, Influenza virus
KDLGNCHPI

SEQ ID NO: 474382 - protein, 9 aa, Influenza virus
KDLGNCHPV

SEQ ID NO: 474383 - protein, 9 aa, Influenza virus
KDLGNGCFE

SEQ ID NO: 474384 - protein, 9 aa, Influenza virus
KDLGSCHPI

SEQ ID NO: 474385 - protein, 9 aa, Influenza virus
KDLRSGYEM

SEQ ID NO: 474386 - protein, 9 aa, Influenza virus
KDLRSGYET

SEQ ID NO: 474387 - protein, 9 aa, Influenza virus
KDLTKEFFE

SEQ ID NO: 474388 - protein, 9 aa, Influenza virus
KDMTKDFFE

SEQ ID NO: 474389 - protein, 9 aa, Influenza virus
KDMTKEFFE

SEQ ID NO: 474390 - protein, 9 aa, Influenza virus
KDMTKEFFV

SEQ ID NO: 474391 - protein, 9 aa, Influenza virus
KDMTREFFE

SEQ ID NO: 474392 - protein, 9 aa, Influenza virus
KDNAIDEGD

SEQ ID NO: 474393 - protein, 9 aa, Influenza virus
KDNAIRFGE

SEQ ID NO: 474394 - protein, 9 aa, Influenza virus
KDNAIRIGE

SEQ ID NO: 474395 - protein, 9 aa, Influenza virus
KDNAIRLGE

SEQ ID NO: 474396 - protein, 9 aa, Influenza virus
KDNAIRPGE

SEQ ID NO: 474397 - protein, 9 aa, Influenza virus
KDNAKDEGN

SEQ ID NO: 474398 - protein, 9 aa, Influenza virus
KDNAKDLGN

SEQ ID NO: 474399 - protein, 9 aa, Influenza virus
KDNAKEIGN

SEQ ID NO: 474400 - protein, 9 aa, Influenza virus
KDNAKELGN

SEQ ID NO: 474401 - protein, 9 aa, Influenza virus
KDNALRLAE

SEQ ID NO: 474402 - protein, 9 aa, Influenza virus
KDNANDLGN

SEQ ID NO: 474403 - protein, 9 aa, Influenza virus
KDNARELGN

SEQ ID NO: 474404 - protein, 9 aa, Influenza virus
KDNAVRFGE

SEQ ID NO: 474405 - protein, 9 aa, Influenza virus
KDNAVRIGE

SEQ ID NO: 474406 - protein, 9 aa, Influenza virus
KDNAVRLGE

SEQ ID NO: 474407 - protein, 9 aa, Influenza virus
KDNGIRIGS

SEQ ID NO: 474408 - protein, 9 aa, Influenza virus
KDNGIRVGS

SEQ ID NO: 474409 - protein, 9 aa, Influenza virus
KDNLEPGTF

SEQ ID NO: 474410 - protein, 9 aa, Influenza virus
KDNNIRIGS

SEQ ID NO: 474411 - protein, 9 aa, Influenza virus
KDNQVFPQL

SEQ ID NO: 474412 - protein, 9 aa, Influenza virus
KDNSIQLSA

SEQ ID NO: 474413 - protein, 9 aa, Influenza virus
KDNSIRIGS

SEQ ID NO: 474414 - protein, 9 aa, Influenza virus
KDNSIRLAA

SEQ ID NO: 474415 - protein, 9 aa, Influenza virus
KDNSIRLSA

SEQ ID NO: 474416 - protein, 9 aa, Influenza virus
KDNSVRIGS

SEQ ID NO: 474417 - protein, 9 aa, Influenza virus
KDNSVRLSA

SEQ ID NO: 474418 - protein, 9 aa, Influenza virus
KDPKKTGGP

SEQ ID NO: 474419 - protein, 9 aa, Influenza virus
KDQAWSYIV

SEQ ID NO: 474420 - protein, 9 aa, Influenza virus
KDQDWSYIV

SEQ ID NO: 474421 - protein, 9 aa, Influenza virus
KDQGWSYIV

SEQ ID NO: 474422 - protein, 9 aa, Influenza virus
KDQSWSYIV

SEQ ID NO: 474423 - protein, 9 aa, Influenza virus
KDRAPYRSL

SEQ ID NO: 474424 - protein, 9 aa, Influenza virus
KDRSPFRAL

SEQ ID NO: 474425 - protein, 9 aa, Influenza virus
KDRSPFRTL

SEQ ID NO: 474426 - protein, 9 aa, Influenza virus
KDRSPHRAL

SEQ ID NO: 474427 - protein, 9 aa, Influenza virus
KDRSPHRTL

SEQ ID NO: 474428 - protein, 9 aa, Influenza virus
KDRSPQRTL

SEQ ID NO: 474429 - protein, 9 aa, Influenza virus
KDRSPYRAL

SEQ ID NO: 474430 - protein, 9 aa, Influenza virus
KDRSPYRTL

SEQ ID NO: 474431 - protein, 9 aa, Influenza virus
KDRTPYRSL

SEQ ID NO: 474432 - protein, 9 aa, Influenza virus
KDRTSYRSL

SEQ ID NO: 474433 - protein, 9 aa, Influenza virus
KDSITDIWT

SEQ ID NO: 474434 - protein, 9 aa, Influenza virus
KDSNGVQDI

SEQ ID NO: 474435 - protein, 9 aa, Influenza virus
KDSRSGYEI

SEQ ID NO: 474436 - protein, 9 aa, Influenza virus
KDSRSGYEM

SEQ ID NO: 474437 - protein, 9 aa, Influenza virus
KDSRSGYET

SEQ ID NO: 474438 - protein, 9 aa, Influenza virus
KDSRSGYEV

SEQ ID NO: 474439 - protein, 9 aa, Influenza virus
KDTRSGYEM

SEQ ID NO: 474440 - protein, 9 aa, Influenza virus
KDVIIWFSF

SEQ ID NO: 474441 - protein, 9 aa, Influenza virus
KDVILWFSF

SEQ ID NO: 474442 - protein, 9 aa, Influenza virus
KDVILWFSL

SEQ ID NO: 474443 - protein, 9 aa, Influenza virus
KDWILWISF

SEQ ID NO: 474444 - protein, 9 aa, Influenza virus
KDWVLWISF

SEQ ID NO: 474445 - protein, 9 aa, Influenza virus
KDYEEEAKL

SEQ ID NO: 474446 - protein, 9 aa, Influenza virus
KDYRYTYRC

SEQ ID NO: 474447 - protein, 9 aa, Influenza virus
KEAMQNRIQ

SEQ ID NO: 474448 - protein, 9 aa, Influenza virus
KEAQDVIME

SEQ ID NO: 474449 - protein, 9 aa, Influenza virus
KECFNPCFY

SEQ ID NO: 474450 - protein, 9 aa, Influenza virus
KEDEVWWTS

SEQ ID NO: 474451 - protein, 9 aa, Influenza virus
KEDKRYGPA

SEQ ID NO: 474452 - protein, 9 aa, Influenza virus
KEDKVWWTS

SEQ ID NO: 474453 - protein, 9 aa, Influenza virus
KEDRRYGPA

SEQ ID NO: 474454 - protein, 9 aa, Influenza virus
KEDRVWWTS

SEQ ID NO: 474455 - protein, 9 aa, Influenza virus
KEEALKGSA

SEQ ID NO: 474456 - protein, 9 aa, Influenza virus
KEEALQGSA

SEQ ID NO: 474457 - protein, 9 aa, Influenza virus
KEECYRACF

SEQ ID NO: 474458 - protein, 9 aa, Influenza virus
KEEKVWWTS

SEQ ID NO: 474459 - protein, 9 aa, Influenza virus
KEEPLKGSA

SEQ ID NO: 474460 - protein, 9 aa, Influenza virus
KEESQLKRQ

SEQ ID NO: 474461 - protein, 9 aa, Influenza virus
KEETLKGSA

SEQ ID NO: 474462 - protein, 9 aa, Influenza virus
KEEVINATE

SEQ ID NO: 474463 - protein, 9 aa, Influenza virus
KEEVLKGSA

SEQ ID NO: 474464 - protein, 9 aa, Influenza virus
KEEVTNATE

SEQ ID NO: 474465 - protein, 9 aa, Influenza virus
KEFEQVEGR

SEQ ID NO: 474466 - protein, 9 aa, Influenza virus
KEFGNLERR

SEQ ID NO: 474467 - protein, 9 aa, Influenza virus
KEFGQVEGR

SEQ ID NO: 474468 - protein, 9 aa, Influenza virus
KEFNNLEKR

SEQ ID NO: 474469 - protein, 9 aa, Influenza virus
KEFNNLERR

SEQ ID NO: 474470 - protein, 9 aa, Influenza virus
KEFSEIEGR

SEQ ID NO: 474471 - protein, 9 aa, Influenza virus
KEFSEVEGR

SEQ ID NO: 474472 - protein, 9 aa, Influenza virus
KEFSNLEKR

SEQ ID NO: 474473 - protein, 9 aa, Influenza virus
KEFSNLERR

SEQ ID NO: 474474 - protein, 9 aa, Influenza virus
KEFTEVEGR

SEQ ID NO: 474475 - protein, 9 aa, Influenza virus
KEGRRKTNL

SEQ ID NO: 474476 - protein, 9 aa, Influenza virus
KEGRRRTNL

SEQ ID NO: 474477 - protein, 9 aa, Influenza virus
KEGSYFFGD

SEQ ID NO: 474478 - protein, 9 aa, Influenza virus
KEGYSLVGI

SEQ ID NO: 474479 - protein, 9 aa, Influenza virus
KEGYSLVGV

SEQ ID NO: 474480 - protein, 9 aa, Influenza virus
KEICIAWSS

SEQ ID NO: 474481 - protein, 9 aa, Influenza virus
KEICVAWSS

SEQ ID NO: 474482 - protein, 9 aa, Influenza virus
KEIEGICYP

SEQ ID NO: 474483 - protein, 9 aa, Influenza virus
KEIGNGCFE

SEQ ID NO: 474484 - protein, 9 aa, Influenza virus
KEIVYLNNT

SEQ ID NO: 474485 - protein, 9 aa, Influenza virus
KEKAIWTSG

SEQ ID NO: 474486 - protein, 9 aa, Influenza virus
KEKDLTKEF

SEQ ID NO: 474487 - protein, 9 aa, Influenza virus
KEKDMTKEF

SEQ ID NO: 474488 - protein, 9 aa, Influenza virus
KEKDMTREF

SEQ ID NO: 474489 - protein, 9 aa, Influenza virus
KEKEICSVV

SEQ ID NO: 474490 - protein, 9 aa, Influenza virus
KEKENSYPK

SEQ ID NO: 474491 - protein, 9 aa, Influenza virus
KEKENSYPM

SEQ ID NO: 474492 - protein, 9 aa, Influenza virus
KEKNDLYGT

SEQ ID NO: 474493 - protein, 9 aa, Influenza virus
KEKNELYGT

SEQ ID NO: 474494 - protein, 9 aa, Influenza virus
KEKTIWTSG

SEQ ID NO: 474495 - protein, 9 aa, Influenza virus
KEKVTNATE

SEQ ID NO: 474496 - protein, 9 aa, Influenza virus
KELGNGCFE

SEQ ID NO: 474497 - protein, 9 aa, Influenza virus
KELVETNHT

SEQ ID NO: 474498 - protein, 9 aa, Influenza virus
KEMCAAWSS

SEQ ID NO: 474499 - protein, 9 aa, Influenza virus
KEMEGICYP

SEQ ID NO: 474500 - protein, 9 aa, Influenza virus
KEMEGVCYP

SEQ ID NO: 474501 - protein, 9 aa, Influenza virus
KEMGNGCFE

SEQ ID NO: 474502 - protein, 9 aa, Influenza virus
KENKKYGPA

SEQ ID NO: 474503 - protein, 9 aa, Influenza virus
KENKRYGPA

SEQ ID NO: 474504 - protein, 9 aa, Influenza virus
KENPAHKSQ

SEQ ID NO: 474505 - protein, 9 aa, Influenza virus
KENTGSYVR

SEQ ID NO: 474506 - protein, 9 aa, Influenza virus
KEPALIVWG

SEQ ID NO: 474507 - protein, 9 aa, Influenza virus
KEPDTYDFN

SEQ ID NO: 474508 - protein, 9 aa, Influenza virus
KEPISLGDC

SEQ ID NO: 474509 - protein, 9 aa, Influenza virus
KEPMGFRYS

SEQ ID NO: 474510 - protein, 9 aa, Influenza virus
KEQLGSWSW

SEQ ID NO: 474511 - protein, 9 aa, Influenza virus
KEQLSTVSS

SEQ ID NO: 474512 - protein, 9 aa, Influenza virus
KEQTALYKN

SEQ ID NO: 474513 - protein, 9 aa, Influenza virus
KEQTTLYKN

SEQ ID NO: 474514 - protein, 9 aa, Influenza virus
KERLGSWSW

SEQ ID NO: 474515 - protein, 9 aa, Influenza virus
KERTIWTSG

SEQ ID NO: 474516 - protein, 9 aa, Influenza virus
KERTSIWTS

SEQ ID NO: 474517 - protein, 9 aa, Influenza virus
KESLRLAIG

SEQ ID NO: 474518 - protein, 9 aa, Influenza virus
KESLRLALG

SEQ ID NO: 474519 - protein, 9 aa, Influenza virus
KESLRLAVG

SEQ ID NO: 474520 - protein, 9 aa, Influenza virus
KESMGFRYS

SEQ ID NO: 474521 - protein, 9 aa, Influenza virus
KESRLNRQE

SEQ ID NO: 474522 - protein, 9 aa, Influenza virus
KESRSGYET

SEQ ID NO: 474523 - protein, 9 aa, Influenza virus
KESTQKAID

SEQ ID NO: 474524 - protein, 9 aa, Influenza virus
KETGNGCFE

SEQ ID NO: 474525 - protein, 9 aa, Influenza virus
KETNGNYGP

SEQ ID NO: 474526 - protein, 9 aa, Influenza virus
KETRVWWTS

SEQ ID NO: 474527 - protein, 9 aa, Influenza virus
KEVGNGCFE

SEQ ID NO: 474528 - protein, 9 aa, Influenza virus
KEVILWFSF

SEQ ID NO: 474529 - protein, 9 aa, Influenza virus
KEWGNGCFE

SEQ ID NO: 474530 - protein, 9 aa, Influenza virus
KEWMHICMT

SEQ ID NO: 474531 - protein, 9 aa, Influenza virus
KEWMHVCIT

SEQ ID NO: 474532 - protein, 9 aa, Influenza virus
KEWMHVCMA

SEQ ID NO: 474533 - protein, 9 aa, Influenza virus
KEWMHVCMT

SEQ ID NO: 474534 - protein, 9 aa, Influenza virus
KEWMHVSMT

SEQ ID NO: 474535 - protein, 9 aa, Influenza virus
KEWSKRYEL

SEQ ID NO: 474536 - protein, 9 aa, Influenza virus
KEWSRRYEL

SEQ ID NO: 474537 - protein, 9 aa, Influenza virus
KEYEEEAKL

SEQ ID NO: 474538 - protein, 9 aa, Influenza virus
KFAAICTHL

SEQ ID NO: 474539 - protein, 9 aa, Influenza virus
KFAAICTHM

SEQ ID NO: 474540 - protein, 9 aa, Influenza virus
KFASICTHL

SEQ ID NO: 474541 - protein, 9 aa, Influenza virus
KFCYPGELD

SEQ ID NO: 474542 - protein, 9 aa, Influenza virus
KFEAVAWSA

SEQ ID NO: 474543 - protein, 9 aa, Influenza virus
KFEEIKWLI

SEQ ID NO: 474544 - protein, 9 aa, Influenza virus
KFEEIRWLI

SEQ ID NO: 474545 - protein, 9 aa, Influenza virus
KFEEIRWMI

SEQ ID NO: 474546 - protein, 9 aa, Influenza virus
KFEEMRWLI

SEQ ID NO: 474547 - protein, 9 aa, Influenza virus
KFEEVRWLI

SEQ ID NO: 474548 - protein, 9 aa, Influenza virus
KFEFIAEDF

SEQ ID NO: 474549 - protein, 9 aa, Influenza virus
KFEFIAEEF

SEQ ID NO: 474550 - protein, 9 aa, Influenza virus
KFEFIVEKF

SEQ ID NO: 474551 - protein, 9 aa, Influenza virus
KFESVAWSA

SEQ ID NO: 474552 - protein, 9 aa, Influenza virus
KFFPSSSYR

SEQ ID NO: 474553 - protein, 9 aa, Influenza virus
KFHQIEKEF

SEQ ID NO: 474554 - protein, 9 aa, Influenza virus
KFHSDTPRP

SEQ ID NO: 474555 - protein, 9 aa, Influenza virus
KFKADLIIE

SEQ ID NO: 474556 - protein, 9 aa, Influenza virus
KFLLMDALK

SEQ ID NO: 474557 - protein, 9 aa, Influenza virus
KFLLMDSLK

SEQ ID NO: 474558 - protein, 9 aa, Influenza virus
KFLNNTEPL

SEQ ID NO: 474559 - protein, 9 aa, Influenza virus
KFLPDLYDY

SEQ ID NO: 474560 - protein, 9 aa, Influenza virus
KFQTAAQKA

SEQ ID NO: 474561 - protein, 9 aa, Influenza virus
KFQTAAQRA

SEQ ID NO: 474562 - protein, 9 aa, Influenza virus
KFTNEEALR

SEQ ID NO: 474563 - protein, 9 aa, Influenza virus
KFYIQMCTE

SEQ ID NO: 474564 - protein, 9 aa, Influenza virus
KGANRPIIT

SEQ ID NO: 474565 - protein, 9 aa, Influenza virus
KGANRPVII

SEQ ID NO: 474566 - protein, 9 aa, Influenza virus
KGANRPVIT

SEQ ID NO: 474567 - protein, 9 aa, Influenza virus
KGCFDILHK

SEQ ID NO: 474568 - protein, 9 aa, Influenza virus
KGCFDLYHK

SEQ ID NO: 474569 - protein, 9 aa, Influenza virus
KGCFEIYHA

SEQ ID NO: 474570 - protein, 9 aa, Influenza virus
KGCFEIYHK

SEQ ID NO: 474571 - protein, 9 aa, Influenza virus
KGCFEIYHN

SEQ ID NO: 474572 - protein, 9 aa, Influenza virus
KGCFEIYHT

SEQ ID NO: 474573 - protein, 9 aa, Influenza virus
KGCFELYHK

SEQ ID NO: 474574 - protein, 9 aa, Influenza virus
KGCFELYHR

SEQ ID NO: 474575 - protein, 9 aa, Influenza virus
KGCFQPCFY

SEQ ID NO: 474576 - protein, 9 aa, Influenza virus
KGCINRCFY

SEQ ID NO: 474577 - protein, 9 aa, Influenza virus
KGDCYRACF

SEQ ID NO: 474578 - protein, 9 aa, Influenza virus
KGDIFVIRE

SEQ ID NO: 474579 - protein, 9 aa, Influenza virus
KGDIFVMRE

SEQ ID NO: 474580 - protein, 9 aa, Influenza virus
KGDKICLGH

SEQ ID NO: 474581 - protein, 9 aa, Influenza virus
KGDQICIGY

SEQ ID NO: 474582 - protein, 9 aa, Influenza virus
KGDRICIGY

SEQ ID NO: 474583 - protein, 9 aa, Influenza virus
KGDVFVIRE

SEQ ID NO: 474584 - protein, 9 aa, Influenza virus
KGDVFVMRE

SEQ ID NO: 474585 - protein, 9 aa, Influenza virus
KGDYNNTTG

SEQ ID NO: 474586 - protein, 9 aa, Influenza virus
KGECYRACF

SEQ ID NO: 474587 - protein, 9 aa, Influenza virus
KGEKANVLI

SEQ ID NO: 474588 - protein, 9 aa, Influenza virus
KGEYNNTTG

SEQ ID NO: 474589 - protein, 9 aa, Influenza virus
KGFAFKYGN

SEQ ID NO: 474590 - protein, 9 aa, Influenza virus
KGFAPFSKD

SEQ ID NO: 474591 - protein, 9 aa, Influenza virus
KGFFPFHKD

SEQ ID NO: 474592 - protein, 9 aa, Influenza virus
KGFGFRQGD

SEQ ID NO: 474593 - protein, 9 aa, Influenza virus
KGFGFRQGN

SEQ ID NO: 474594 - protein, 9 aa, Influenza virus
KGFGFRQGT

SEQ ID NO: 474595 - protein, 9 aa, Influenza virus
KGFNSFYRN

SEQ ID NO: 474596 - protein, 9 aa, Influenza virus
KGFSFKYGD

SEQ ID NO: 474597 - protein, 9 aa, Influenza virus
KGFSFKYGN

SEQ ID NO: 474598 - protein, 9 aa, Influenza virus
KGFSFRYGD

SEQ ID NO: 474599 - protein, 9 aa, Influenza virus
KGFSFRYGN

SEQ ID NO: 474600 - protein, 9 aa, Influenza virus
KGFSYKYDN

SEQ ID NO: 474601 - protein, 9 aa, Influenza virus
KGFSYKYGN

SEQ ID NO: 474602 - protein, 9 aa, Influenza virus
KGFSYRYGN

SEQ ID NO: 474603 - protein, 9 aa, Influenza virus
KGGPGVKGF

SEQ ID NO: 474604 - protein, 9 aa, Influenza virus
KGGSIKTKL

SEQ ID NO: 474605 - protein, 9 aa, Influenza virus
KGGSINTKL

SEQ ID NO: 474606 - protein, 9 aa, Influenza virus
KGHVFVIRE

SEQ ID NO: 474607 - protein, 9 aa, Influenza virus
KGIEVVNAT

SEQ ID NO: 474608 - protein, 9 aa, Influenza virus
KGILEDEQM

SEQ ID NO: 474609 - protein, 9 aa, Influenza virus
KGILGFVFT

SEQ ID NO: 474610 - protein, 9 aa, Influenza virus
KGKFQTAAQ

SEQ ID NO: 474611 - protein, 9 aa, Influenza virus
KGKKAVDLG

SEQ ID NO: 474612 - protein, 9 aa, Influenza virus
KGLCIINSW

SEQ ID NO: 474613 - protein, 9 aa, Influenza virus
KGLCTINSW

SEQ ID NO: 474614 - protein, 9 aa, Influenza virus
KGLFGAIAG

SEQ ID NO: 474615 - protein, 9 aa, Influenza virus
KGLILGNPK

SEQ ID NO: 474616 - protein, 9 aa, Influenza virus
KGLWDSFRQ

SEQ ID NO: 474617 - protein, 9 aa, Influenza virus
KGMLGFVFT

SEQ ID NO: 474618 - protein, 9 aa, Influenza virus
KGNAKDEGN

SEQ ID NO: 474619 - protein, 9 aa, Influenza virus
KGNGCFEIF

SEQ ID NO: 474620 - protein, 9 aa, Influenza virus
KGNIKCNIC

SEQ ID NO: 474621 - protein, 9 aa, Influenza virus
KGNIMRTQE

SEQ ID NO: 474622 - protein, 9 aa, Influenza virus
KGNIRCDIC

SEQ ID NO: 474623 - protein, 9 aa, Influenza virus
KGNIRCNIC

SEQ ID NO: 474624 - protein, 9 aa, Influenza virus
KGNPGVKGW

SEQ ID NO: 474625 - protein, 9 aa, Influenza virus
KGNQGVKGW

SEQ ID NO: 474626 - protein, 9 aa, Influenza virus
KGNSARLIH

SEQ ID NO: 474627 - protein, 9 aa, Influenza virus
KGRGLFGAI

SEQ ID NO: 474628 - protein, 9 aa, Influenza virus
KGRHANGTI

SEQ ID NO: 474629 - protein, 9 aa, Influenza virus
KGRIDYYWS

SEQ ID NO: 474630 - protein, 9 aa, Influenza virus
KGRIFQSHI

SEQ ID NO: 474631 - protein, 9 aa, Influenza virus
KGRIFQSPI

SEQ ID NO: 474632 - protein, 9 aa, Influenza virus
KGRIFQSRI

SEQ ID NO: 474633 - protein, 9 aa, Influenza virus
KGRLCNPLN

SEQ ID NO: 474634 - protein, 9 aa, Influenza virus
KGRSHLRND

SEQ ID NO: 474635 - protein, 9 aa, Influenza virus
KGRYGVKGF

SEQ ID NO: 474636 - protein, 9 aa, Influenza virus
KGSAKHIEE

SEQ ID NO: 474637 - protein, 9 aa, Influenza virus
KGSARHIEE

SEQ ID NO: 474638 - protein, 9 aa, Influenza virus
KGSIQSDKP

SEQ ID NO: 474639 - protein, 9 aa, Influenza virus
KGSNRPIID

SEQ ID NO: 474640 - protein, 9 aa, Influenza virus
KGSNRPIVD

SEQ ID NO: 474641 - protein, 9 aa, Influenza virus
KGSNRPVID

SEQ ID NO: 474642 - protein, 9 aa, Influenza virus
KGSNRPVVD

SEQ ID NO: 474643 - protein, 9 aa, Influenza virus
KGSNRPWIR

SEQ ID NO: 474644 - protein, 9 aa, Influenza virus
KGSNRPWMR

SEQ ID NO: 474645 - protein, 9 aa, Influenza virus
KGSNRPWVR

SEQ ID NO: 474646 - protein, 9 aa, Influenza virus
KGSYNNTNG

SEQ ID NO: 474647 - protein, 9 aa, Influenza virus
KGSYNNTSG

SEQ ID NO: 474648 - protein, 9 aa, Influenza virus
KGTNSFYRN

SEQ ID NO: 474649 - protein, 9 aa, Influenza virus
KGTYDYPKY

SEQ ID NO: 474650 - protein, 9 aa, Influenza virus
KGVELSSMG

SEQ ID NO: 474651 - protein, 9 aa, Influenza virus
KGVEVVNAT

SEQ ID NO: 474652 - protein, 9 aa, Influenza virus
KGVKLSNMG

SEQ ID NO: 474653 - protein, 9 aa, Influenza virus
KGVKLSSMG

SEQ ID NO: 474654 - protein, 9 aa, Influenza virus
KGVYINTAL

SEQ ID NO: 474655 - protein, 9 aa, Influenza virus
KGVYINTAM

SEQ ID NO: 474656 - protein, 9 aa, Influenza virus
KGVYMNTAL

SEQ ID NO: 474657 - protein, 9 aa, Influenza virus
KGVYVNTAL

SEQ ID NO: 474658 - protein, 9 aa, Influenza virus
KGWAFDNGD

SEQ ID NO: 474659 - protein, 9 aa, Influenza virus
KGWAFDNGN

SEQ ID NO: 474660 - protein, 9 aa, Influenza virus
KGWAFDSGD

SEQ ID NO: 474661 - protein, 9 aa, Influenza virus
KGWAFDYGN

SEQ ID NO: 474662 - protein, 9 aa, Influenza virus
KGWAFDYGS

SEQ ID NO: 474663 - protein, 9 aa, Influenza virus
KGWAPLSKD

SEQ ID NO: 474664 - protein, 9 aa, Influenza virus
KGWILGNPR

SEQ ID NO: 474665 - protein, 9 aa, Influenza virus
KGYGVKGFG

SEQ ID NO: 474666 - protein, 9 aa, Influenza virus
KHDRIPHRT

SEQ ID NO: 474667 - protein, 9 aa, Influenza virus
KHDSNVKNL

SEQ ID NO: 474668 - protein, 9 aa, Influenza virus
KHENRMVLA

SEQ ID NO: 474669 - protein, 9 aa, Influenza virus
KHFEKVKIL

SEQ ID NO: 474670 - protein, 9 aa, Influenza virus
KHFEKVRIL

SEQ ID NO: 474671 - protein, 9 aa, Influenza virus
KHIEECSCY

SEQ ID NO: 474672 - protein, 9 aa, Influenza virus
KHIVERILE

SEQ ID NO: 474673 - protein, 9 aa, Influenza virus
KHLAYCNTD

SEQ ID NO: 474674 - protein, 9 aa, Influenza virus
KHLEECSCY

SEQ ID NO: 474675 - protein, 9 aa, Influenza virus
KHPAYCNTD

SEQ ID NO: 474676 - protein, 9 aa, Influenza virus
KHQNAQGEG

SEQ ID NO: 474677 - protein, 9 aa, Influenza virus
KHRFEIIEG

SEQ ID NO: 474678 - protein, 9 aa, Influenza virus
KHSAYCNTD

SEQ ID NO: 474679 - protein, 9 aa, Influenza virus
KHSNDTIHD

SEQ ID NO: 474680 - protein, 9 aa, Influenza virus
KHSNDTVHD

SEQ ID NO: 474681 - protein, 9 aa, Influenza virus
KHSNETVKD

SEQ ID NO: 474682 - protein, 9 aa, Influenza virus
KHSNGTAKD

SEQ ID NO: 474683 - protein, 9 aa, Influenza virus
KHSNGTIHD

SEQ ID NO: 474684 - protein, 9 aa, Influenza virus
KHSNGTIKD

SEQ ID NO: 474685 - protein, 9 aa, Influenza virus
KHSNGTKHD

SEQ ID NO: 474686 - protein, 9 aa, Influenza virus
KHSNGTMKD

SEQ ID NO: 474687 - protein, 9 aa, Influenza virus
KHSNGTTHD

SEQ ID NO: 474688 - protein, 9 aa, Influenza virus
KHSNGTVKD

SEQ ID NO: 474689 - protein, 9 aa, Influenza virus
KHSNGTVND

SEQ ID NO: 474690 - protein, 9 aa, Influenza virus
KHSNNTVKD

SEQ ID NO: 474691 - protein, 9 aa, Influenza virus
KHSNNTVRD

SEQ ID NO: 474692 - protein, 9 aa, Influenza virus
KHSNSTTHD

SEQ ID NO: 474693 - protein, 9 aa, Influenza virus
KHTSQYICS

SEQ ID NO: 474694 - protein, 9 aa, Influenza virus
KHTSQYLCT

SEQ ID NO: 474695 - protein, 9 aa, Influenza virus
KHYIGKCPK

SEQ ID NO: 474696 - protein, 9 aa, Influenza virus
KHYIGKCPR

SEQ ID NO: 474697 - protein, 9 aa, Influenza virus
KIAHISPLS

SEQ ID NO: 474698 - protein, 9 aa, Influenza virus
KICIGYHAN

SEQ ID NO: 474699 - protein, 9 aa, Influenza virus
KICIGYLSN

SEQ ID NO: 474700 - protein, 9 aa, Influenza virus
KICIGYQTN

SEQ ID NO: 474701 - protein, 9 aa, Influenza virus
KICLGHHAE

SEQ ID NO: 474702 - protein, 9 aa, Influenza virus
KICLGHHAV

SEQ ID NO: 474703 - protein, 9 aa, Influenza virus
KICLGRHAV

SEQ ID NO: 474704 - protein, 9 aa, Influenza virus
KICVGYLST

SEQ ID NO: 474705 - protein, 9 aa, Influenza virus
KIDDQIEDL

SEQ ID NO: 474706 - protein, 9 aa, Influenza virus
KIDDQIEEL

SEQ ID NO: 474707 - protein, 9 aa, Influenza virus
KIDDQIEGL

SEQ ID NO: 474708 - protein, 9 aa, Influenza virus
KIDDQIENL

SEQ ID NO: 474709 - protein, 9 aa, Influenza virus
KIDLWSYNA

SEQ ID NO: 474710 - protein, 9 aa, Influenza virus
KIDTILERN

SEQ ID NO: 474711 - protein, 9 aa, Influenza virus
KIDTLTETG

SEQ ID NO: 474712 - protein, 9 aa, Influenza virus
KIEAVIYGN

SEQ ID NO: 474713 - protein, 9 aa, Influenza virus
KIEFEPFQS

SEQ ID NO: 474714 - protein, 9 aa, Influenza virus
KIEGRVQDL

SEQ ID NO: 474715 - protein, 9 aa, Influenza virus
KIEKIEKIR

SEQ ID NO: 474716 - protein, 9 aa, Influenza virus
KIHNAGTDP

SEQ ID NO: 474717 - protein, 9 aa, Influenza virus
KIHTRGLFG

SEQ ID NO: 474718 - protein, 9 aa, Influenza virus
KIIHISPLS

SEQ ID NO: 474719 - protein, 9 aa, Influenza virus
KIIQNEDIP

SEQ ID NO: 474720 - protein, 9 aa, Influenza virus
KIIRVGCVI

SEQ ID NO: 474721 - protein, 9 aa, Influenza virus
KIITIDSVS

SEQ ID NO: 474722 - protein, 9 aa, Influenza virus
KIITIGSAS

SEQ ID NO: 474723 - protein, 9 aa, Influenza virus
KIITIGSIS

SEQ ID NO: 474724 - protein, 9 aa, Influenza virus
KIITIGSVS

SEQ ID NO: 474725 - protein, 9 aa, Influenza virus
KIITMGSVS

SEQ ID NO: 474726 - protein, 9 aa, Influenza virus
KIKHLEECS

SEQ ID NO: 474727 - protein, 9 aa, Influenza virus
KIKMKWGME

SEQ ID NO: 474728 - protein, 9 aa, Influenza virus
KIKTNGNLI

SEQ ID NO: 474729 - protein, 9 aa, Influenza virus
KILCASATA

SEQ ID NO: 474730 - protein, 9 aa, Influenza virus
KILCTSAIA

SEQ ID NO: 474731 - protein, 9 aa, Influenza virus
KILCTSATA

SEQ ID NO: 474732 - protein, 9 aa, Influenza virus
KILDEHDSN

SEQ ID NO: 474733 - protein, 9 aa, Influenza virus
KILFASATA

SEQ ID NO: 474734 - protein, 9 aa, Influenza virus
KILFIEEGK

SEQ ID NO: 474735 - protein, 9 aa, Influenza virus
KILKIKKGK

SEQ ID NO: 474736 - protein, 9 aa, Influenza virus
KILKIRKGK

SEQ ID NO: 474737 - protein, 9 aa, Influenza virus
KILRTHESE

SEQ ID NO: 474738 - protein, 9 aa, Influenza virus
KILRTQESE

SEQ ID NO: 474739 - protein, 9 aa, Influenza virus
KILRTQESS

SEQ ID NO: 474740 - protein, 9 aa, Influenza virus
KILSIYSCI

SEQ ID NO: 474741 - protein, 9 aa, Influenza virus
KILSIYSCV

SEQ ID NO: 474742 - protein, 9 aa, Influenza virus
KILSIYSSV

SEQ ID NO: 474743 - protein, 9 aa, Influenza virus
KILSIYSTV

SEQ ID NO: 474744 - protein, 9 aa, Influenza virus
KILTDTSRP

SEQ ID NO: 474745 - protein, 9 aa, Influenza virus
KILTIYSTA

SEQ ID NO: 474746 - protein, 9 aa, Influenza virus
KILTIYSTV

SEQ ID NO: 474747 - protein, 9 aa, Influenza virus
KILTSESQL

SEQ ID NO: 474748 - protein, 9 aa, Influenza virus
KILYFHKGL

SEQ ID NO: 474749 - protein, 9 aa, Influenza virus
KIMESGGID

SEQ ID NO: 474750 - protein, 9 aa, Influenza virus
KIMESGGIS

SEQ ID NO: 474751 - protein, 9 aa, Influenza virus
KIMTIGSVS

SEQ ID NO: 474752 - protein, 9 aa, Influenza virus
KIMYFHKGL

SEQ ID NO: 474753 - protein, 9 aa, Influenza virus
KINDQIEDL

SEQ ID NO: 474754 - protein, 9 aa, Influenza virus
KINEVKLEE

SEQ ID NO: 474755 - protein, 9 aa, Influenza virus
KINGKLNRL

SEQ ID NO: 474756 - protein, 9 aa, Influenza virus
KINGVILEE

SEQ ID NO: 474757 - protein, 9 aa, Influenza virus
KINGVKLEE

SEQ ID NO: 474758 - protein, 9 aa, Influenza virus
KINGVRLEE

SEQ ID NO: 474759 - protein, 9 aa, Influenza virus
KINMINDKI

SEQ ID NO: 474760 - protein, 9 aa, Influenza virus
KINNIIDKM

SEQ ID NO: 474761 - protein, 9 aa, Influenza virus
KINNIIEKM

SEQ ID NO: 474762 - protein, 9 aa, Influenza virus
KINNIVDKM

SEQ ID NO: 474763 - protein, 9 aa, Influenza virus
KINPVTLTM

SEQ ID NO: 474764 - protein, 9 aa, Influenza virus
KINRQEIEG

SEQ ID NO: 474765 - protein, 9 aa, Influenza virus
KINSIIDKM

SEQ ID NO: 474766 - protein, 9 aa, Influenza virus
KINSWHIFG

SEQ ID NO: 474767 - protein, 9 aa, Influenza virus
KINTLTERG

SEQ ID NO: 474768 - protein, 9 aa, Influenza virus
KIPAQNAIS

SEQ ID NO: 474769 - protein, 9 aa, Influenza virus
KIPNAETDP

SEQ ID NO: 474770 - protein, 9 aa, Influenza virus
KIPNAGIDP

SEQ ID NO: 474771 - protein, 9 aa, Influenza virus
KIPNAGTDP

SEQ ID NO: 474772 - protein, 9 aa, Influenza virus
KIPVQNAIS

SEQ ID NO: 474773 - protein, 9 aa, Influenza virus
KIQHLEECS

SEQ ID NO: 474774 - protein, 9 aa, Influenza virus
KIQTNGNLI

SEQ ID NO: 474775 - protein, 9 aa, Influenza virus
KIQTSGNLI

SEQ ID NO: 474776 - protein, 9 aa, Influenza virus
KIQWSQDPT

SEQ ID NO: 474777 - protein, 9 aa, Influenza virus
KIQWSQEPT

SEQ ID NO: 474778 - protein, 9 aa, Influenza virus
KIQWSQNPA

SEQ ID NO: 474779 - protein, 9 aa, Influenza virus
KIQWSQNPS

SEQ ID NO: 474780 - protein, 9 aa, Influenza virus
KIQWSQNPT

SEQ ID NO: 474781 - protein, 9 aa, Influenza virus
KIRHLEECS

SEQ ID NO: 474782 - protein, 9 aa, Influenza virus
KIRNGTYDH

SEQ ID NO: 474783 - protein, 9 aa, Influenza virus
KIRRRVDIN

SEQ ID NO: 474784 - protein, 9 aa, Influenza virus
KIRRRVDMN

SEQ ID NO: 474785 - protein, 9 aa, Influenza virus
KIRRRVDTN

SEQ ID NO: 474786 - protein, 9 aa, Influenza virus
KIRRRVDVN

SEQ ID NO: 474787 - protein, 9 aa, Influenza virus
KIRTNGNLI

SEQ ID NO: 474788 - protein, 9 aa, Influenza virus
KIRTRGLFG

SEQ ID NO: 474789 - protein, 9 aa, Influenza virus
KIRVKRRPV

SEQ ID NO: 474790 - protein, 9 aa, Influenza virus
KISGVKLEE

SEQ ID NO: 474791 - protein, 9 aa, Influenza virus
KISHISPLS

SEQ ID NO: 474792 - protein, 9 aa, Influenza virus
KISKRGGSG

SEQ ID NO: 474793 - protein, 9 aa, Influenza virus
KISKRGNSG

SEQ ID NO: 474794 - protein, 9 aa, Influenza virus
KISKRGSSG

SEQ ID NO: 474795 - protein, 9 aa, Influenza virus
KISKSTKST

SEQ ID NO: 474796 - protein, 9 aa, Influenza virus
KISLGHHAV

SEQ ID NO: 474797 - protein, 9 aa, Influenza virus
KISRRGNSG

SEQ ID NO: 474798 - protein, 9 aa, Influenza virus
KISSSFSFG

SEQ ID NO: 474799 - protein, 9 aa, Influenza virus
KITCVCRDN

SEQ ID NO: 474800 - protein, 9 aa, Influenza virus
KITENSFEQ

SEQ ID NO: 474801 - protein, 9 aa, Influenza virus
KITFEATGN

SEQ ID NO: 474802 - protein, 9 aa, Influenza virus
KITGFAPFS

SEQ ID NO: 474803 - protein, 9 aa, Influenza virus
KITLKFAFN

SEQ ID NO: 474804 - protein, 9 aa, Influenza virus
KITNKINNI

SEQ ID NO: 474805 - protein, 9 aa, Influenza virus
KITNKVNNI

SEQ ID NO: 474806 - protein, 9 aa, Influenza virus
KITVDHMAI

SEQ ID NO: 474807 - protein, 9 aa, Influenza virus
KIVHISPLS

SEQ ID NO: 474808 - protein, 9 aa, Influenza virus
KIVTTVGWS

SEQ ID NO: 474809 - protein, 9 aa, Influenza virus
KIYWHLMHP

SEQ ID NO: 474810 - protein, 9 aa, Influenza virus
KKAKLANVV

SEQ ID NO: 474811 - protein, 9 aa, Influenza virus
KKASLRLAV

SEQ ID NO: 474812 - protein, 9 aa, Influenza virus
KKATRRLIQ

SEQ ID NO: 474813 - protein, 9 aa, Influenza virus
KKAVDLGSC

SEQ ID NO: 474814 - protein, 9 aa, Influenza virus
KKEPDTYDF

SEQ ID NO: 474815 - protein, 9 aa, Influenza virus
KKESLRLAI

SEQ ID NO: 474816 - protein, 9 aa, Influenza virus
KKESLRLAL

SEQ ID NO: 474817 - protein, 9 aa, Influenza virus
KKESLRLAV

SEQ ID NO: 474818 - protein, 9 aa, Influenza virus
KKGTYDYPK

SEQ ID NO: 474819 - protein, 9 aa, Influenza virus
KKHPAYCNT

SEQ ID NO: 474820 - protein, 9 aa, Influenza virus
KKIDDGFLD

SEQ ID NO: 474821 - protein, 9 aa, Influenza virus
KKILRTQES

SEQ ID NO: 474822 - protein, 9 aa, Influenza virus
KKINMINDK

SEQ ID NO: 474823 - protein, 9 aa, Influenza virus
KKKKKKRGL

SEQ ID NO: 474824 - protein, 9 aa, Influenza virus
KKKKKRGLF

SEQ ID NO: 474825 - protein, 9 aa, Influenza virus
KKKKRGLFG

SEQ ID NO: 474826 - protein, 9 aa, Influenza virus
KKKNPEAYN

SEQ ID NO: 474827 - protein, 9 aa, Influenza virus
KKKPDIYDF

SEQ ID NO: 474828 - protein, 9 aa, Influenza virus
KKKPDTYDF

SEQ ID NO: 474829 - protein, 9 aa, Influenza virus
KKKRGLFGA

SEQ ID NO: 474830 - protein, 9 aa, Influenza virus
KKKSYINKT

SEQ ID NO: 474831 - protein, 9 aa, Influenza virus
KKKSYINRT

SEQ ID NO: 474832 - protein, 9 aa, Influenza virus
KKLKREITF

SEQ ID NO: 474833 - protein, 9 aa, Influenza virus
KKLKREMTF

SEQ ID NO: 474834 - protein, 9 aa, Influenza virus
KKMEDGFLD

SEQ ID NO: 474835 - protein, 9 aa, Influenza virus
KKMTITFLI

SEQ ID NO: 474836 - protein, 9 aa, Influenza virus
KKNPEAYNF

SEQ ID NO: 474837 - protein, 9 aa, Influenza virus
KKPDIYDFN

SEQ ID NO: 474838 - protein, 9 aa, Influenza virus
KKPDTYDFN

SEQ ID NO: 474839 - protein, 9 aa, Influenza virus
KKQEIEGIK

SEQ ID NO: 474840 - protein, 9 aa, Influenza virus
KKQILRTQE

SEQ ID NO: 474841 - protein, 9 aa, Influenza virus
KKQLRENAE

SEQ ID NO: 474842 - protein, 9 aa, Influenza virus
KKREKRGLF

SEQ ID NO: 474843 - protein, 9 aa, Influenza virus
KKRGLFGAI

SEQ ID NO: 474844 - protein, 9 aa, Influenza virus
KKRKKRGLF

SEQ ID NO: 474845 - protein, 9 aa, Influenza virus
KKRLGSWSW

SEQ ID NO: 474846 - protein, 9 aa, Influenza virus
KKRRKRGLF

SEQ ID NO: 474847 - protein, 9 aa, Influenza virus
KKSYINKTG

SEQ ID NO: 474848 - protein, 9 aa, Influenza virus
KKSYINRTG

SEQ ID NO: 474849 - protein, 9 aa, Influenza virus
KKTGGPIYK

SEQ ID NO: 474850 - protein, 9 aa, Influenza virus
KKTGGPIYR

SEQ ID NO: 474851 - protein, 9 aa, Influenza virus
KKTNEKFHQ

SEQ ID NO: 474852 - protein, 9 aa, Influenza virus
KKVDDGFID

SEQ ID NO: 474853 - protein, 9 aa, Influenza virus
KKVDDGFLD

SEQ ID NO: 474854 - protein, 9 aa, Influenza virus
KKVDDGLLD

SEQ ID NO: 474855 - protein, 9 aa, Influenza virus
KKYERVKMF

SEQ ID NO: 474856 - protein, 9 aa, Influenza virus
KKYGPALSI

SEQ ID NO: 474857 - protein, 9 aa, Influenza virus
KKYTSARQE

SEQ ID NO: 474858 - protein, 9 aa, Influenza virus
KKYTSGRQE

SEQ ID NO: 474859 - protein, 9 aa, Influenza virus
KLAAICTHL

SEQ ID NO: 474860 - protein, 9 aa, Influenza virus
KLAIGLRNV

SEQ ID NO: 474861 - protein, 9 aa, Influenza virus
KLAIGPRNV

SEQ ID NO: 474862 - protein, 9 aa, Influenza virus
KLANVVRKM

SEQ ID NO: 474863 - protein, 9 aa, Influenza virus
KLAQGYKDI

SEQ ID NO: 474864 - protein, 9 aa, Influenza virus
KLASGLRNV

SEQ ID NO: 474865 - protein, 9 aa, Influenza virus
KLATGLKNV

SEQ ID NO: 474866 - protein, 9 aa, Influenza virus
KLATGLRNI

SEQ ID NO: 474867 - protein, 9 aa, Influenza virus
KLATGLRNV

SEQ ID NO: 474868 - protein, 9 aa, Influenza virus
KLATGMRNI

SEQ ID NO: 474869 - protein, 9 aa, Influenza virus
KLATGMRNV

SEQ ID NO: 474870 - protein, 9 aa, Influenza virus
KLATGPRNV

SEQ ID NO: 474871 - protein, 9 aa, Influenza virus
KLCFPGELD

SEQ ID NO: 474872 - protein, 9 aa, Influenza virus
KLCFPGEVD

SEQ ID NO: 474873 - protein, 9 aa, Influenza virus
KLCKLNGIP

SEQ ID NO: 474874 - protein, 9 aa, Influenza virus
KLCRLRGIP

SEQ ID NO: 474875 - protein, 9 aa, Influenza virus
KLCRLSGIP

SEQ ID NO: 474876 - protein, 9 aa, Influenza virus
KLCYPGELD

SEQ ID NO: 474877 - protein, 9 aa, Influenza virus
KLCYPGEVD

SEQ ID NO: 474878 - protein, 9 aa, Influenza virus
KLDINMADY

SEQ ID NO: 474879 - protein, 9 aa, Influenza virus
KLEDVFAGK

SEQ ID NO: 474880 - protein, 9 aa, Influenza virus
KLEENSTYK

SEQ ID NO: 474881 - protein, 9 aa, Influenza virus
KLEENTSYK

SEQ ID NO: 474882 - protein, 9 aa, Influenza virus
KLEENTTYK

SEQ ID NO: 474883 - protein, 9 aa, Influenza virus
KLEENTTYR

SEQ ID NO: 474884 - protein, 9 aa, Influenza virus
KLEFEPFQS

SEQ ID NO: 474885 - protein, 9 aa, Influenza virus
KLEFIAEEF

SEQ ID NO: 474886 - protein, 9 aa, Influenza virus
KLEKSRING

SEQ ID NO: 474887 - protein, 9 aa, Influenza virus
KLEQSGLPV

SEQ ID NO: 474888 - protein, 9 aa, Influenza virus
KLERSKINE

SEQ ID NO: 474889 - protein, 9 aa, Influenza virus
KLERSKING

SEQ ID NO: 474890 - protein, 9 aa, Influenza virus
KLFALSGVA

SEQ ID NO: 474891 - protein, 9 aa, Influenza virus
KLFASSGIA

SEQ ID NO: 474892 - protein, 9 aa, Influenza virus
KLFERVKRQ

SEQ ID NO: 474893 - protein, 9 aa, Influenza virus
KLFERVRHQ

SEQ ID NO: 474894 - protein, 9 aa, Influenza virus
KLFERVRRQ

SEQ ID NO: 474895 - protein, 9 aa, Influenza virus
KLFTLSGVA

SEQ ID NO: 474896 - protein, 9 aa, Influenza virus
KLGQFPVQT

SEQ ID NO: 474897 - protein, 9 aa, Influenza virus
KLGSPLVLD

SEQ ID NO: 474898 - protein, 9 aa, Influenza virus
KLIDNEFTE

SEQ ID NO: 474899 - protein, 9 aa, Influenza virus
KLILATGLR

SEQ ID NO: 474900 - protein, 9 aa, Influenza virus
KLIQGYKDI

SEQ ID NO: 474901 - protein, 9 aa, Influenza virus
KLIQLIVSG

SEQ ID NO: 474902 - protein, 9 aa, Influenza virus
KLITVGSSK

SEQ ID NO: 474903 - protein, 9 aa, Influenza virus
KLKREITFH

SEQ ID NO: 474904 - protein, 9 aa, Influenza virus
KLKREMTFH

SEQ ID NO: 474905 - protein, 9 aa, Influenza virus
KLKRNEIKG

SEQ ID NO: 474906 - protein, 9 aa, Influenza virus
KLKRQEIDG

SEQ ID NO: 474907 - protein, 9 aa, Influenza virus
KLKRQEIEG

SEQ ID NO: 474908 - protein, 9 aa, Influenza virus
KLKRQEING

SEQ ID NO: 474909 - protein, 9 aa, Influenza virus
KLKRRAIAT

SEQ ID NO: 474910 - protein, 9 aa, Influenza virus
KLKSEDNVY

SEQ ID NO: 474911 - protein, 9 aa, Influenza virus
KLKTEDNIY

SEQ ID NO: 474912 - protein, 9 aa, Influenza virus
KLKTEDNVY

SEQ ID NO: 474913 - protein, 9 aa, Influenza virus
KLLGINMSK

SEQ ID NO: 474914 - protein, 9 aa, Influenza virus
KLLKERGFF

SEQ ID NO: 474915 - protein, 9 aa, Influenza virus
KLLPFAAAP

SEQ ID NO: 474916 - protein, 9 aa, Influenza virus
KLLPFASAP

SEQ ID NO: 474917 - protein, 9 aa, Influenza virus
KLLVLIEND

SEQ ID NO: 474918 - protein, 9 aa, Influenza virus
KLLVLLEND

SEQ ID NO: 474919 - protein, 9 aa, Influenza virus
KLLVLLENE

SEQ ID NO: 474920 - protein, 9 aa, Influenza virus
KLLVLLENG

SEQ ID NO: 474921 - protein, 9 aa, Influenza virus
KLNGIPPLE

SEQ ID NO: 474922 - protein, 9 aa, Influenza virus
KLNNVIDKM

SEQ ID NO: 474923 - protein, 9 aa, Influenza virus
KLNRFIEKT

SEQ ID NO: 474924 - protein, 9 aa, Influenza virus
KLNRIIEKT

SEQ ID NO: 474925 - protein, 9 aa, Influenza virus
KLNRLIDKT

SEQ ID NO: 474926 - protein, 9 aa, Influenza virus
KLNRLIDRT

SEQ ID NO: 474927 - protein, 9 aa, Influenza virus
KLNRLIEKT

SEQ ID NO: 474928 - protein, 9 aa, Influenza virus
KLNRLIERT

SEQ ID NO: 474929 - protein, 9 aa, Influenza virus
KLNRLIGKT

SEQ ID NO: 474930 - protein, 9 aa, Influenza virus
KLNRLISKT

SEQ ID NO: 474931 - protein, 9 aa, Influenza virus
KLNRNEIKG

SEQ ID NO: 474932 - protein, 9 aa, Influenza virus
KLNRQEIEG

SEQ ID NO: 474933 - protein, 9 aa, Influenza virus
KLNRQEIGG

SEQ ID NO: 474934 - protein, 9 aa, Influenza virus
KLNRSEIKG

SEQ ID NO: 474935 - protein, 9 aa, Influenza virus
KLNRTEIKG

SEQ ID NO: 474936 - protein, 9 aa, Influenza virus
KLPFQNLSP

SEQ ID NO: 474937 - protein, 9 aa, Influenza virus
KLRLATGLR

SEQ ID NO: 474938 - protein, 9 aa, Influenza virus
KLRMATGLR

SEQ ID NO: 474939 - protein, 9 aa, Influenza virus
KLRMVTGLR

SEQ ID NO: 474940 - protein, 9 aa, Influenza virus
KLRSGFEML

SEQ ID NO: 474941 - protein, 9 aa, Influenza virus
KLSGGYKDI

SEQ ID NO: 474942 - protein, 9 aa, Influenza virus
KLSGGYKDV

SEQ ID NO: 474943 - protein, 9 aa, Influenza virus
KLSIEDPDH

SEQ ID NO: 474944 - protein, 9 aa, Influenza virus
KLSIEDPNH

SEQ ID NO: 474945 - protein, 9 aa, Influenza virus
KLSIEDPSH

SEQ ID NO: 474946 - protein, 9 aa, Influenza virus
KLSIENPSH

SEQ ID NO: 474947 - protein, 9 aa, Influenza virus
KLSNMGIYQ

SEQ ID NO: 474948 - protein, 9 aa, Influenza virus
KLSNMGVYQ

SEQ ID NO: 474949 - protein, 9 aa, Influenza virus
KLSQMPKEV

SEQ ID NO: 474950 - protein, 9 aa, Influenza virus
KLSQMSKEV

SEQ ID NO: 474951 - protein, 9 aa, Influenza virus
KLSQMSKKV

SEQ ID NO: 474952 - protein, 9 aa, Influenza virus
KLSQMSKNV

SEQ ID NO: 474953 - protein, 9 aa, Influenza virus
KLSQMSREV

SEQ ID NO: 474954 - protein, 9 aa, Influenza virus
KLSSGYKDI

SEQ ID NO: 474955 - protein, 9 aa, Influenza virus
KLSSGYKDV

SEQ ID NO: 474956 - protein, 9 aa, Influenza virus
KLSSGYKEV

SEQ ID NO: 474957 - protein, 9 aa, Influenza virus
KLSSMGIYQ

SEQ ID NO: 474958 - protein, 9 aa, Influenza virus
KLSSMGVYQ

SEQ ID NO: 474959 - protein, 9 aa, Influenza virus
KLTIIYSSS

SEQ ID NO: 474960 - protein, 9 aa, Influenza virus
KLTITYSSP

SEQ ID NO: 474961 - protein, 9 aa, Influenza virus
KLTITYSSS

SEQ ID NO: 474962 - protein, 9 aa, Influenza virus
KLTQGRQTF

SEQ ID NO: 474963 - protein, 9 aa, Influenza virus
KLTQGRQTY

SEQ ID NO: 474964 - protein, 9 aa, Influenza virus
KLTQGYKDI

SEQ ID NO: 474965 - protein, 9 aa, Influenza virus
KLTVTHSVN

SEQ ID NO: 474966 - protein, 9 aa, Influenza virus
KLVDGQDCD

SEQ ID NO: 474967 - protein, 9 aa, Influenza virus
KLVGINMSK

SEQ ID NO: 474968 - protein, 9 aa, Influenza virus
KLVLATGLR

SEQ ID NO: 474969 - protein, 9 aa, Influenza virus
KLVLATGPR

SEQ ID NO: 474970 - protein, 9 aa, Influenza virus
KLYDRVRLQ

SEQ ID NO: 474971 - protein, 9 aa, Influenza virus
KLYEKVRRQ

SEQ ID NO: 474972 - protein, 9 aa, Influenza virus
KLYERVKKQ

SEQ ID NO: 474973 - protein, 9 aa, Influenza virus
KLYERVKRQ

SEQ ID NO: 474974 - protein, 9 aa, Influenza virus
KLYERVRKQ

SEQ ID NO: 474975 - protein, 9 aa, Influenza virus
KLYERVRRQ

SEQ ID NO: 474976 - protein, 9 aa, Influenza virus
KLYGAGNKL

SEQ ID NO: 474977 - protein, 9 aa, Influenza virus
KLYGNGNKL

SEQ ID NO: 474978 - protein, 9 aa, Influenza virus
KLYGSGAKL

SEQ ID NO: 474979 - protein, 9 aa, Influenza virus
KLYGSGNKL

SEQ ID NO: 474980 - protein, 9 aa, Influenza virus
KLYGSGSKL

SEQ ID NO: 474981 - protein, 9 aa, Influenza virus
KLYGTGNKL

SEQ ID NO: 474982 - protein, 9 aa, Influenza virus
KLYIWGIHH

SEQ ID NO: 474983 - protein, 9 aa, Influenza virus
KLYIWGVHH

SEQ ID NO: 474984 - protein, 9 aa, Influenza virus
KLYKKLKRE

SEQ ID NO: 474985 - protein, 9 aa, Influenza virus
KLYKNTNTL

SEQ ID NO: 474986 - protein, 9 aa, Influenza virus
KLYRKLKRE

SEQ ID NO: 474987 - protein, 9 aa, Influenza virus
KLYVNKNPY

SEQ ID NO: 474988 - protein, 9 aa, Influenza virus
KLYVWGVHH

SEQ ID NO: 474989 - protein, 9 aa, Influenza virus
KLYWHLMHP

SEQ ID NO: 474990 - protein, 9 aa, Influenza virus
KLYWHLMRP

SEQ ID NO: 474991 - protein, 9 aa, Influenza virus
KLYWHLMSP

SEQ ID NO: 474992 - protein, 9 aa, Influenza virus
KMARLGKGY

SEQ ID NO: 474993 - protein, 9 aa, Influenza virus
KMARLGRGY

SEQ ID NO: 474994 - protein, 9 aa, Influenza virus
KMEAILVVL

SEQ ID NO: 474995 - protein, 9 aa, Influenza virus
KMEDGFLDV

SEQ ID NO: 474996 - protein, 9 aa, Influenza virus
KMEFEPFQS

SEQ ID NO: 474997 - protein, 9 aa, Influenza virus
KMEKIVLLL

SEQ ID NO: 474998 - protein, 9 aa, Influenza virus
KMFDFIKWN

SEQ ID NO: 474999 - protein, 9 aa, Influenza virus
KMFDFSKWN

SEQ ID NO: 475000 - protein, 9 aa, Influenza virus
KMFDFTKWN

SEQ ID NO: 475001 - protein, 9 aa, Influenza virus
KMGVDEYSN

SEQ ID NO: 475002 - protein, 9 aa, Influenza virus
KMGVDEYSS

SEQ ID NO: 475003 - protein, 9 aa, Influenza virus
KMITQRTIG

SEQ ID NO: 475004 - protein, 9 aa, Influenza virus
KMKAIIVVL

SEQ ID NO: 475005 - protein, 9 aa, Influenza virus
KMKAILVVL

SEQ ID NO: 475006 - protein, 9 aa, Influenza virus
KMKWGMELR

SEQ ID NO: 475007 - protein, 9 aa, Influenza virus
KMKWGMEMR

SEQ ID NO: 475008 - protein, 9 aa, Influenza virus
KMMTNSQDT

SEQ ID NO: 475009 - protein, 9 aa, Influenza virus
KMMTSSQDT

SEQ ID NO: 475010 - protein, 9 aa, Influenza virus
KMNGNYDSI

SEQ ID NO: 475011 - protein, 9 aa, Influenza virus
KMNIQFTAV

SEQ ID NO: 475012 - protein, 9 aa, Influenza virus
KMNIQFTSV

SEQ ID NO: 475013 - protein, 9 aa, Influenza virus
KMNIQILIL

SEQ ID NO: 475014 - protein, 9 aa, Influenza virus
KMNNQILIL

SEQ ID NO: 475015 - protein, 9 aa, Influenza virus
KMNPNKKII

SEQ ID NO: 475016 - protein, 9 aa, Influenza virus
KMNPNQKII

SEQ ID NO: 475017 - protein, 9 aa, Influenza virus
KMNPNQKIM

SEQ ID NO: 475018 - protein, 9 aa, Influenza virus
KMNREFEVM

SEQ ID NO: 475019 - protein, 9 aa, Influenza virus
KMNREFEVV

SEQ ID NO: 475020 - protein, 9 aa, Influenza virus
KMNREFGVV

SEQ ID NO: 475021 - protein, 9 aa, Influenza virus
KMNTKILVL

SEQ ID NO: 475022 - protein, 9 aa, Influenza virus
KMNTQFDAV

SEQ ID NO: 475023 - protein, 9 aa, Influenza virus
KMNTQFEAI

SEQ ID NO: 475024 - protein, 9 aa, Influenza virus
KMNTQFEAV

SEQ ID NO: 475025 - protein, 9 aa, Influenza virus
KMNTQFETV

SEQ ID NO: 475026 - protein, 9 aa, Influenza virus
KMNTQFTAV

SEQ ID NO: 475027 - protein, 9 aa, Influenza virus
KMNTQILIF

SEQ ID NO: 475028 - protein, 9 aa, Influenza virus
KMNTQILIL

SEQ ID NO: 475029 - protein, 9 aa, Influenza virus
KMNTQILVF

SEQ ID NO: 475030 - protein, 9 aa, Influenza virus
KMNTRILIL

SEQ ID NO: 475031 - protein, 9 aa, Influenza virus
KMPASRYLT

SEQ ID NO: 475032 - protein, 9 aa, Influenza virus
KMQFSSLTV

SEQ ID NO: 475033 - protein, 9 aa, Influenza virus
KMQLRDNAK

SEQ ID NO: 475034 - protein, 9 aa, Influenza virus
KMRDSIKSW

SEQ ID NO: 475035 - protein, 9 aa, Influenza virus
KMSLLTEVE

SEQ ID NO: 475036 - protein, 9 aa, Influenza virus
KMTDSIKSW

SEQ ID NO: 475037 - protein, 9 aa, Influenza virus
KMTIASDIL

SEQ ID NO: 475038 - protein, 9 aa, Influenza virus
KMTITFLIL

SEQ ID NO: 475039 - protein, 9 aa, Influenza virus
KMVLSAFDE

SEQ ID NO: 475040 - protein, 9 aa, Influenza virus
KMVTQRTIG

SEQ ID NO: 475041 - protein, 9 aa, Influenza virus
KMVTQRTVG

SEQ ID NO: 475042 - protein, 9 aa, Influenza virus
KMYALHQGT

SEQ ID NO: 475043 - protein, 9 aa, Influenza virus
KNADLEALM

SEQ ID NO: 475044 - protein, 9 aa, Influenza virus
KNALGDCPK

SEQ ID NO: 475045 - protein, 9 aa, Influenza virus
KNALGECPK

SEQ ID NO: 475046 - protein, 9 aa, Influenza virus
KNALYGTQS

SEQ ID NO: 475047 - protein, 9 aa, Influenza virus
KNANTLSSV

SEQ ID NO: 475048 - protein, 9 aa, Influenza virus
KNANTLTSV

SEQ ID NO: 475049 - protein, 9 aa, Influenza virus
KNATASFIY

SEQ ID NO: 475050 - protein, 9 aa, Influenza virus
KNATATVYY

SEQ ID NO: 475051 - protein, 9 aa, Influenza virus
KNCINRCFY

SEQ ID NO: 475052 - protein, 9 aa, Influenza virus
KNCTLIDAL

SEQ ID NO: 475053 - protein, 9 aa, Influenza virus
KNDDIDQSL

SEQ ID NO: 475054 - protein, 9 aa, Influenza virus
KNDDVDQSL

SEQ ID NO: 475055 - protein, 9 aa, Influenza virus
KNDEVDQSL

SEQ ID NO: 475056 - protein, 9 aa, Influenza virus
KNDLYGTQP

SEQ ID NO: 475057 - protein, 9 aa, Influenza virus
KNDLYGTQS

SEQ ID NO: 475058 - protein, 9 aa, Influenza virus
KNEIKGVKL

SEQ ID NO: 475059 - protein, 9 aa, Influenza virus
KNELYGTQS

SEQ ID NO: 475060 - protein, 9 aa, Influenza virus
KNGNHAVHY

SEQ ID NO: 475061 - protein, 9 aa, Influenza virus
KNGNLRCTI

SEQ ID NO: 475062 - protein, 9 aa, Influenza virus
KNGNMQCTI

SEQ ID NO: 475063 - protein, 9 aa, Influenza virus
KNGNMRCTI

SEQ ID NO: 475064 - protein, 9 aa, Influenza virus
KNGNMRGTN

SEQ ID NO: 475065 - protein, 9 aa, Influenza virus
KNGTYDHKD

SEQ ID NO: 475066 - protein, 9 aa, Influenza virus
KNGTYDHKE

SEQ ID NO: 475067 - protein, 9 aa, Influenza virus
KNGTYDYPK

SEQ ID NO: 475068 - protein, 9 aa, Influenza virus
KNGTYKYPK

SEQ ID NO: 475069 - protein, 9 aa, Influenza virus
KNGTYNHKD

SEQ ID NO: 475070 - protein, 9 aa, Influenza virus
KNGTYNHKE

SEQ ID NO: 475071 - protein, 9 aa, Influenza virus
KNGTYNRKE

SEQ ID NO: 475072 - protein, 9 aa, Influenza virus
KNGTYNYPK

SEQ ID NO: 475073 - protein, 9 aa, Influenza virus
KNGTYYYPK

SEQ ID NO: 475074 - protein, 9 aa, Influenza virus
KNILEKTHN

SEQ ID NO: 475075 - protein, 9 aa, Influenza virus
KNILRTQES

SEQ ID NO: 475076 - protein, 9 aa, Influenza virus
KNITEIVYL

SEQ ID NO: 475077 - protein, 9 aa, Influenza virus
KNITKIVYL

SEQ ID NO: 475078 - protein, 9 aa, Influenza virus
KNITVTHAQ

SEQ ID NO: 475079 - protein, 9 aa, Influenza virus
KNITVTHSV

SEQ ID NO: 475080 - protein, 9 aa, Influenza virus
KNLFDEVKR

SEQ ID NO: 475081 - protein, 9 aa, Influenza virus
KNLFDEVRR

SEQ ID NO: 475082 - protein, 9 aa, Influenza virus
KNLHDQIKR

SEQ ID NO: 475083 - protein, 9 aa, Influenza virus
KNLHEQVKR

SEQ ID NO: 475084 - protein, 9 aa, Influenza virus
KNLYDKVRL

SEQ ID NO: 475085 - protein, 9 aa, Influenza virus
KNLYDKVRM

SEQ ID NO: 475086 - protein, 9 aa, Influenza virus
KNLYDRVRL

SEQ ID NO: 475087 - protein, 9 aa, Influenza virus
KNLYEKVRL

SEQ ID NO: 475088 - protein, 9 aa, Influenza virus
KNLYEKVRM

SEQ ID NO: 475089 - protein, 9 aa, Influenza virus
KNLYNKVRM

SEQ ID NO: 475090 - protein, 9 aa, Influenza virus
KNNAIDEGD

SEQ ID NO: 475091 - protein, 9 aa, Influenza virus
KNNAKDEGN

SEQ ID NO: 475092 - protein, 9 aa, Influenza virus
KNNMINNDL

SEQ ID NO: 475093 - protein, 9 aa, Influenza virus
KNNQVILCE

SEQ ID NO: 475094 - protein, 9 aa, Influenza virus
KNNQVILCG

SEQ ID NO: 475095 - protein, 9 aa, Influenza virus
KNNWSGYSG

SEQ ID NO: 475096 - protein, 9 aa, Influenza virus
KNPALRMKW

SEQ ID NO: 475097 - protein, 9 aa, Influenza virus
KNPAYCNTD

SEQ ID NO: 475098 - protein, 9 aa, Influenza virus
KNPEAYNFN

SEQ ID NO: 475099 - protein, 9 aa, Influenza virus
KNPSLRMKW

SEQ ID NO: 475100 - protein, 9 aa, Influenza virus
KNPYTLVST

SEQ ID NO: 475101 - protein, 9 aa, Influenza virus
KNQEELRSL

SEQ ID NO: 475102 - protein, 9 aa, Influenza virus
KNRSPYRAL

SEQ ID NO: 475103 - protein, 9 aa, Influenza virus
KNSDLEALM

SEQ ID NO: 475104 - protein, 9 aa, Influenza virus
KNSFYAELK

SEQ ID NO: 475105 - protein, 9 aa, Influenza virus
KNSNGVQDI

SEQ ID NO: 475106 - protein, 9 aa, Influenza virus
KNSRSGYET

SEQ ID NO: 475107 - protein, 9 aa, Influenza virus
KNTDLEALM

SEQ ID NO: 475108 - protein, 9 aa, Influenza virus
KNTDLEVLM

SEQ ID NO: 475109 - protein, 9 aa, Influenza virus
KNTKGRDVL

SEQ ID NO: 475110 - protein, 9 aa, Influenza virus
KNTNTLSSV

SEQ ID NO: 475111 - protein, 9 aa, Influenza virus
KNTYVNNTT

SEQ ID NO: 475112 - protein, 9 aa, Influenza virus
KNVAVTHSV

SEQ ID NO: 475113 - protein, 9 aa, Influenza virus
KNVIFTHAQ

SEQ ID NO: 475114 - protein, 9 aa, Influenza virus
KNVPEKIHT

SEQ ID NO: 475115 - protein, 9 aa, Influenza virus
KNVPEKIRT

SEQ ID NO: 475116 - protein, 9 aa, Influenza virus
KNVPEKIRV

SEQ ID NO: 475117 - protein, 9 aa, Influenza virus
KNVTVTHAK

SEQ ID NO: 475118 - protein, 9 aa, Influenza virus
KNVTVTHAQ

SEQ ID NO: 475119 - protein, 9 aa, Influenza virus
KNVTVTHAV

SEQ ID NO: 475120 - protein, 9 aa, Influenza virus
KNVTVTHSI

SEQ ID NO: 475121 - protein, 9 aa, Influenza virus
KNVTVTHSV

SEQ ID NO: 475122 - protein, 9 aa, Influenza virus
KNVTVTHTQ

SEQ ID NO: 475123 - protein, 9 aa, Influenza virus
KNWILWISF

SEQ ID NO: 475124 - protein, 9 aa, Influenza virus
KNWSGYSGA

SEQ ID NO: 475125 - protein, 9 aa, Influenza virus
KNWSGYSGS

SEQ ID NO: 475126 - protein, 9 aa, Influenza virus
KPCFWVELI

SEQ ID NO: 475127 - protein, 9 aa, Influenza virus
KPDIYDFNE

SEQ ID NO: 475128 - protein, 9 aa, Influenza virus
KPDTYDFNE

SEQ ID NO: 475129 - protein, 9 aa, Influenza virus
KPFHNISRI

SEQ ID NO: 475130 - protein, 9 aa, Influenza virus
KPFQNASRH

SEQ ID NO: 475131 - protein, 9 aa, Influenza virus
KPFQNASRY

SEQ ID NO: 475132 - protein, 9 aa, Influenza virus
KPFQNICKP

SEQ ID NO: 475133 - protein, 9 aa, Influenza virus
KPFQNISRI

SEQ ID NO: 475134 - protein, 9 aa, Influenza virus
KPFQNISRV

SEQ ID NO: 475135 - protein, 9 aa, Influenza virus
KPFQNTSKH

SEQ ID NO: 475136 - protein, 9 aa, Influenza virus
KPFQNTSRH

SEQ ID NO: 475137 - protein, 9 aa, Influenza virus
KPFQNVNKI

SEQ ID NO: 475138 - protein, 9 aa, Influenza virus
KPFQNVNKV

SEQ ID NO: 475139 - protein, 9 aa, Influenza virus
KPFQNVNRI

SEQ ID NO: 475140 - protein, 9 aa, Influenza virus
KPFQNVSRI

SEQ ID NO: 475141 - protein, 9 aa, Influenza virus
KPFQNVSRT

SEQ ID NO: 475142 - protein, 9 aa, Influenza virus
KPGETLKVE

SEQ ID NO: 475143 - protein, 9 aa, Influenza virus
KPGETLNIE

SEQ ID NO: 475144 - protein, 9 aa, Influenza virus
KPGETLNVE

SEQ ID NO: 475145 - protein, 9 aa, Influenza virus
KPGQTLRIR

SEQ ID NO: 475146 - protein, 9 aa, Influenza virus
KPGQTLRVK

SEQ ID NO: 475147 - protein, 9 aa, Influenza virus
KPGQTLRVR

SEQ ID NO: 475148 - protein, 9 aa, Influenza virus
KPGQTVKIK

SEQ ID NO: 475149 - protein, 9 aa, Influenza virus
KPGQTVKIQ

SEQ ID NO: 475150 - protein, 9 aa, Influenza virus
KPKFLPDLY

SEQ ID NO: 475151 - protein, 9 aa, Influenza virus
KPKSLPDLY

SEQ ID NO: 475152 - protein, 9 aa, Influenza virus
KPKYLPDLY

SEQ ID NO: 475153 - protein, 9 aa, Influenza virus
KPLCAVNSW

SEQ ID NO: 475154 - protein, 9 aa, Influenza virus
KPLCEVNSW

SEQ ID NO: 475155 - protein, 9 aa, Influenza virus
KPLCEVSSW

SEQ ID NO: 475156 - protein, 9 aa, Influenza virus
KPLILGDCS

SEQ ID NO: 475157 - protein, 9 aa, Influenza virus
KPLILKDCS

SEQ ID NO: 475158 - protein, 9 aa, Influenza virus
KPLILRDCS

SEQ ID NO: 475159 - protein, 9 aa, Influenza virus
KPLKLVDGQ

SEQ ID NO: 475160 - protein, 9 aa, Influenza virus
KPLQNASRH

SEQ ID NO: 475161 - protein, 9 aa, Influenza virus
KPLQNTSKH

SEQ ID NO: 475162 - protein, 9 aa, Influenza virus
KPNGCIEGK

SEQ ID NO: 475163 - protein, 9 aa, Influenza virus
KPNIGPRPF

SEQ ID NO: 475164 - protein, 9 aa, Influenza virus
KPNIGPRPL

SEQ ID NO: 475165 - protein, 9 aa, Influenza virus
KPPLPLCPF

SEQ ID NO: 475166 - protein, 9 aa, Influenza virus
KPQCEITGF

SEQ ID NO: 475167 - protein, 9 aa, Influenza virus
KPQCHITGF

SEQ ID NO: 475168 - protein, 9 aa, Influenza virus
KPQCKITGF

SEQ ID NO: 475169 - protein, 9 aa, Influenza virus
KPQCLITGF

SEQ ID NO: 475170 - protein, 9 aa, Influenza virus
KPQCQIAGF

SEQ ID NO: 475171 - protein, 9 aa, Influenza virus
KPQCQITGF

SEQ ID NO: 475172 - protein, 9 aa, Influenza virus
KPQCQITGS

SEQ ID NO: 475173 - protein, 9 aa, Influenza virus
KPQCQVTGF

SEQ ID NO: 475174 - protein, 9 aa, Influenza virus
KPRFLPDLY

SEQ ID NO: 475175 - protein, 9 aa, Influenza virus
KPRGLFGAI

SEQ ID NO: 475176 - protein, 9 aa, Influenza virus
KPRPRRGLF

SEQ ID NO: 475177 - protein, 9 aa, Influenza virus
KPRYLPDLY

SEQ ID NO: 475178 - protein, 9 aa, Influenza virus
KPSLPLCPF

SEQ ID NO: 475179 - protein, 9 aa, Influenza virus
KPWARNILR

SEQ ID NO: 475180 - protein, 9 aa, Influenza virus
KPYIGKCPK

SEQ ID NO: 475181 - protein, 9 aa, Influenza virus
KQAKGLFGA

SEQ ID NO: 475182 - protein, 9 aa, Influenza virus
KQASYKIFK

SEQ ID NO: 475183 - protein, 9 aa, Influenza virus
KQDGKSSAC

SEQ ID NO: 475184 - protein, 9 aa, Influenza virus
KQEFKMNPN

SEQ ID NO: 475185 - protein, 9 aa, Influenza virus
KQEIEGIKL

SEQ ID NO: 475186 - protein, 9 aa, Influenza virus
KQEIKMNPN

SEQ ID NO: 475187 - protein, 9 aa, Influenza virus
KQESLLLAT

SEQ ID NO: 475188 - protein, 9 aa, Influenza virus
KQESLMLAT

SEQ ID NO: 475189 - protein, 9 aa, Influenza virus
KQETRVWWT

SEQ ID NO: 475190 - protein, 9 aa, Influenza virus
KQFELIDNE

SEQ ID NO: 475191 - protein, 9 aa, Influenza virus
KQGKTKATK

SEQ ID NO: 475192 - protein, 9 aa, Influenza virus
KQGNSVWAG

SEQ ID NO: 475193 - protein, 9 aa, Influenza virus
KQGSLKLAT

SEQ ID NO: 475194 - protein, 9 aa, Influenza virus
KQGSLMLAT

SEQ ID NO: 475195 - protein, 9 aa, Influenza virus
KQGSLRLAT

SEQ ID NO: 475196 - protein, 9 aa, Influenza virus
KQIDTIMEK

SEQ ID NO: 475197 - protein, 9 aa, Influenza virus
KQIGNVINW

SEQ ID NO: 475198 - protein, 9 aa, Influenza virus
KQILRTQES

SEQ ID NO: 475199 - protein, 9 aa, Influenza virus
KQKSLLLAT

SEQ ID NO: 475200 - protein, 9 aa, Influenza virus
KQKTLKLAT

SEQ ID NO: 475201 - protein, 9 aa, Influenza virus
KQLGNVINW

SEQ ID NO: 475202 - protein, 9 aa, Influenza virus
KQLRENAED

SEQ ID NO: 475203 - protein, 9 aa, Influenza virus
KQLRENAEE

SEQ ID NO: 475204 - protein, 9 aa, Influenza virus
KQLRQNAEE

SEQ ID NO: 475205 - protein, 9 aa, Influenza virus
KQLTHHMRK

SEQ ID NO: 475206 - protein, 9 aa, Influenza virus
KQMTRGLFG

SEQ ID NO: 475207 - protein, 9 aa, Influenza virus
KQNGKSGAC

SEQ ID NO: 475208 - protein, 9 aa, Influenza virus
KQNGKSSAC

SEQ ID NO: 475209 - protein, 9 aa, Influenza virus
KQNPTEEQA

SEQ ID NO: 475210 - protein, 9 aa, Influenza virus
KQNTLKLAT

SEQ ID NO: 475211 - protein, 9 aa, Influenza virus
KQPISLGDC

SEQ ID NO: 475212 - protein, 9 aa, Influenza virus
KQSRMQFSS

SEQ ID NO: 475213 - protein, 9 aa, Influenza virus
KQSSLPLAL

SEQ ID NO: 475214 - protein, 9 aa, Influenza virus
KQSTLKLAT

SEQ ID NO: 475215 - protein, 9 aa, Influenza virus
KQTKTMTIT

SEQ ID NO: 475216 - protein, 9 aa, Influenza virus
KQTRGIFGA

SEQ ID NO: 475217 - protein, 9 aa, Influenza virus
KQTRGLFGA

SEQ ID NO: 475218 - protein, 9 aa, Influenza virus
KQTSLLLAT

SEQ ID NO: 475219 - protein, 9 aa, Influenza virus
KQVCAAWSS

SEQ ID NO: 475220 - protein, 9 aa, Influenza virus
KQVCIAWSS

SEQ ID NO: 475221 - protein, 9 aa, Influenza virus
KQVCIAYSS

SEQ ID NO: 475222 - protein, 9 aa, Influenza virus
KQVCMAWSS

SEQ ID NO: 475223 - protein, 9 aa, Influenza virus
KQVCVAWSS

SEQ ID NO: 475224 - protein, 9 aa, Influenza virus
KQVDTIMEK

SEQ ID NO: 475225 - protein, 9 aa, Influenza virus
KRCINRCFY

SEQ ID NO: 475226 - protein, 9 aa, Influenza virus
KRDSSILTD

SEQ ID NO: 475227 - protein, 9 aa, Influenza virus
KREITFHGA

SEQ ID NO: 475228 - protein, 9 aa, Influenza virus
KREMTFHGA

SEQ ID NO: 475229 - protein, 9 aa, Influenza virus
KRFADQELG

SEQ ID NO: 475230 - protein, 9 aa, Influenza virus
KRGETLKIR

SEQ ID NO: 475231 - protein, 9 aa, Influenza virus
KRGGSGIMK

SEQ ID NO: 475232 - protein, 9 aa, Influenza virus
KRGINDRNF

SEQ ID NO: 475233 - protein, 9 aa, Influenza virus
KRGLFGAIA

SEQ ID NO: 475234 - protein, 9 aa, Influenza virus
KRGNSGIMK

SEQ ID NO: 475235 - protein, 9 aa, Influenza virus
KRGSSGIMK

SEQ ID NO: 475236 - protein, 9 aa, Influenza virus
KRGSSGIVK

SEQ ID NO: 475237 - protein, 9 aa, Influenza virus
KRGSSGVMK

SEQ ID NO: 475238 - protein, 9 aa, Influenza virus
KRGVNDRNF

SEQ ID NO: 475239 - protein, 9 aa, Influenza virus
KRIENLNKK

SEQ ID NO: 475240 - protein, 9 aa, Influenza virus
KRIGSCTSP

SEQ ID NO: 475241 - protein, 9 aa, Influenza virus
KRINMIADR

SEQ ID NO: 475242 - protein, 9 aa, Influenza virus
KRINMINDK

SEQ ID NO: 475243 - protein, 9 aa, Influenza virus
KRINMISDK

SEQ ID NO: 475244 - protein, 9 aa, Influenza virus
KRINMLADR

SEQ ID NO: 475245 - protein, 9 aa, Influenza virus
KRINMLADW

SEQ ID NO: 475246 - protein, 9 aa, Influenza virus
KRINVINDK

SEQ ID NO: 475247 - protein, 9 aa, Influenza virus
KRIRLFDYS

SEQ ID NO: 475248 - protein, 9 aa, Influenza virus
KRKKRGLFG

SEQ ID NO: 475249 - protein, 9 aa, Influenza virus
KRKRDSSIL

SEQ ID NO: 475250 - protein, 9 aa, Influenza virus
KRKRGLFGA

SEQ ID NO: 475251 - protein, 9 aa, Influenza virus
KRKRKTRGL

SEQ ID NO: 475252 - protein, 9 aa, Influenza virus
KRKRNSSIL

SEQ ID NO: 475253 - protein, 9 aa, Influenza virus
KRKTRGLFG

SEQ ID NO: 475254 - protein, 9 aa, Influenza virus
KRLAVLGKD

SEQ ID NO: 475255 - protein, 9 aa, Influenza virus
KRLCKVEGW

SEQ ID NO: 475256 - protein, 9 aa, Influenza virus
KRLCTINSW

SEQ ID NO: 475257 - protein, 9 aa, Influenza virus
KRLENLDKK

SEQ ID NO: 475258 - protein, 9 aa, Influenza virus
KRLENLNKK

SEQ ID NO: 475259 - protein, 9 aa, Influenza virus
KRLGNLNKK

SEQ ID NO: 475260 - protein, 9 aa, Influenza virus
KRLGSWSWH

SEQ ID NO: 475261 - protein, 9 aa, Influenza virus
KRLLRENAE

SEQ ID NO: 475262 - protein, 9 aa, Influenza virus
KRLTIIGKD

SEQ ID NO: 475263 - protein, 9 aa, Influenza virus
KRLTILGKD

SEQ ID NO: 475264 - protein, 9 aa, Influenza virus
KRLTTTIKT

SEQ ID NO: 475265 - protein, 9 aa, Influenza virus
KRLTVLGKD

SEQ ID NO: 475266 - protein, 9 aa, Influenza virus
KRLVLATGL

SEQ ID NO: 475267 - protein, 9 aa, Influenza virus
KRMGLQMQR

SEQ ID NO: 475268 - protein, 9 aa, Influenza virus
KRMGVQIQR

SEQ ID NO: 475269 - protein, 9 aa, Influenza virus
KRMGVQLQR

SEQ ID NO: 475270 - protein, 9 aa, Influenza virus
KRMGVQMHR

SEQ ID NO: 475271 - protein, 9 aa, Influenza virus
KRMGVQMQR

SEQ ID NO: 475272 - protein, 9 aa, Influenza virus
KRMTRGLFG

SEQ ID NO: 475273 - protein, 9 aa, Influenza virus
KRNEIKGVE

SEQ ID NO: 475274 - protein, 9 aa, Influenza virus
KRNEIKGVK

SEQ ID NO: 475275 - protein, 9 aa, Influenza virus
KRNITEIVY

SEQ ID NO: 475276 - protein, 9 aa, Influenza virus
KRNRSILNT

SEQ ID NO: 475277 - protein, 9 aa, Influenza virus
KRNSSILTD

SEQ ID NO: 475278 - protein, 9 aa, Influenza virus
KRPVTEINT

SEQ ID NO: 475279 - protein, 9 aa, Influenza virus
KRQEIDGIK

SEQ ID NO: 475280 - protein, 9 aa, Influenza virus
KRQEIEGIK

SEQ ID NO: 475281 - protein, 9 aa, Influenza virus
KRQEIEGIR

SEQ ID NO: 475282 - protein, 9 aa, Influenza virus
KRQEINGIK

SEQ ID NO: 475283 - protein, 9 aa, Influenza virus
KRQLRENAE

SEQ ID NO: 475284 - protein, 9 aa, Influenza virus
KRRAIATPG

SEQ ID NO: 475285 - protein, 9 aa, Influenza virus
KRRIRDNMT

SEQ ID NO: 475286 - protein, 9 aa, Influenza virus
KRRKKRGLF

SEQ ID NO: 475287 - protein, 9 aa, Influenza virus
KRRPVAKAG

SEQ ID NO: 475288 - protein, 9 aa, Influenza virus
KRRVRDNIT

SEQ ID NO: 475289 - protein, 9 aa, Influenza virus
KRRVRDNMT

SEQ ID NO: 475290 - protein, 9 aa, Influenza virus
KRRVRDNVT

SEQ ID NO: 475291 - protein, 9 aa, Influenza virus
KRRVRDSMT

SEQ ID NO: 475292 - protein, 9 aa, Influenza virus
KRSHEQMET

SEQ ID NO: 475293 - protein, 9 aa, Influenza virus
KRSYEQMET

SEQ ID NO: 475294 - protein, 9 aa, Influenza virus
KRSYNNTSG

SEQ ID NO: 475295 - protein, 9 aa, Influenza virus
KRTNMINDK

SEQ ID NO: 475296 - protein, 9 aa, Influenza virus
KRTVSSFYS

SEQ ID NO: 475297 - protein, 9 aa, Influenza virus
KRVRLFDYS

SEQ ID NO: 475298 - protein, 9 aa, Influenza virus
KRYELEIGA

SEQ ID NO: 475299 - protein, 9 aa, Influenza virus
KRYELEIGT

SEQ ID NO: 475300 - protein, 9 aa, Influenza virus
KRYERVKMF

SEQ ID NO: 475301 - protein, 9 aa, Influenza virus
KRYGPALSI

SEQ ID NO: 475302 - protein, 9 aa, Influenza virus
KSCINRCFY

SEQ ID NO: 475303 - protein, 9 aa, Influenza virus
KSCLPACAY

SEQ ID NO: 475304 - protein, 9 aa, Influenza virus
KSCLPACIY

SEQ ID NO: 475305 - protein, 9 aa, Influenza virus
KSCLPACVY

SEQ ID NO: 475306 - protein, 9 aa, Influenza virus
KSCVNRCFY

SEQ ID NO: 475307 - protein, 9 aa, Influenza virus
KSDKICIGY

SEQ ID NO: 475308 - protein, 9 aa, Influenza virus
KSDKICLGH

SEQ ID NO: 475309 - protein, 9 aa, Influenza virus
KSDKRIGSC

SEQ ID NO: 475310 - protein, 9 aa, Influenza virus
KSDQLKLAT

SEQ ID NO: 475311 - protein, 9 aa, Influenza virus
KSDRICIGY

SEQ ID NO: 475312 - protein, 9 aa, Influenza virus
KSDRLVLAT

SEQ ID NO: 475313 - protein, 9 aa, Influenza virus
KSDVLVTRE

SEQ ID NO: 475314 - protein, 9 aa, Influenza virus
KSEDNVYKV

SEQ ID NO: 475315 - protein, 9 aa, Influenza virus
KSEKLVLAT

SEQ ID NO: 475316 - protein, 9 aa, Influenza virus
KSEQFPVQT

SEQ ID NO: 475317 - protein, 9 aa, Influenza virus
KSERLVLAT

SEQ ID NO: 475318 - protein, 9 aa, Influenza virus
KSFSRTELI

SEQ ID NO: 475319 - protein, 9 aa, Influenza virus
KSFSRTQLI

SEQ ID NO: 475320 - protein, 9 aa, Influenza virus
KSFYRNLVW

SEQ ID NO: 475321 - protein, 9 aa, Influenza virus
KSGACKRAD

SEQ ID NO: 475322 - protein, 9 aa, Influenza virus
KSGACKRAN

SEQ ID NO: 475323 - protein, 9 aa, Influenza virus
KSGQFPVQT

SEQ ID NO: 475324 - protein, 9 aa, Influenza virus
KSGQLKLAT

SEQ ID NO: 475325 - protein, 9 aa, Influenza virus
KSHGRILKN

SEQ ID NO: 475326 - protein, 9 aa, Influenza virus
KSHGRVLKN

SEQ ID NO: 475327 - protein, 9 aa, Influenza virus
KSITQTLVS

SEQ ID NO: 475328 - protein, 9 aa, Influenza virus
KSKLFTLSG

SEQ ID NO: 475329 - protein, 9 aa, Influenza virus
KSKRLVLAT

SEQ ID NO: 475330 - protein, 9 aa, Influenza virus
KSLCEVNSW

SEQ ID NO: 475331 - protein, 9 aa, Influenza virus
KSLCKIEGW

SEQ ID NO: 475332 - protein, 9 aa, Influenza virus
KSLCKVEGW

SEQ ID NO: 475333 - protein, 9 aa, Influenza virus
KSLCNVEGW

SEQ ID NO: 475334 - protein, 9 aa, Influenza virus
KSLCSVEGW

SEQ ID NO: 475335 - protein, 9 aa, Influenza virus
KSLESRRGF

SEQ ID NO: 475336 - protein, 9 aa, Influenza virus
KSLESRSGF

SEQ ID NO: 475337 - protein, 9 aa, Influenza virus
KSLFSSIKK

SEQ ID NO: 475338 - protein, 9 aa, Influenza virus
KSLGIQSDA

SEQ ID NO: 475339 - protein, 9 aa, Influenza virus
KSLIWLWLV

SEQ ID NO: 475340 - protein, 9 aa, Influenza virus
KSLKLASGL

SEQ ID NO: 475341 - protein, 9 aa, Influenza virus
KSLKLATGL

SEQ ID NO: 475342 - protein, 9 aa, Influenza virus
KSLKLATGP

SEQ ID NO: 475343 - protein, 9 aa, Influenza virus
KSLKLVTGL

SEQ ID NO: 475344 - protein, 9 aa, Influenza virus
KSLLLATGM

SEQ ID NO: 475345 - protein, 9 aa, Influenza virus
KSLMLATGM

SEQ ID NO: 475346 - protein, 9 aa, Influenza virus
KSLPDLYDY

SEQ ID NO: 475347 - protein, 9 aa, Influenza virus
KSLRGRGST

SEQ ID NO: 475348 - protein, 9 aa, Influenza virus
KSLTQTLVS

SEQ ID NO: 475349 - protein, 9 aa, Influenza virus
KSLYDKVRM

SEQ ID NO: 475350 - protein, 9 aa, Influenza virus
KSNAIDEGD

SEQ ID NO: 475351 - protein, 9 aa, Influenza virus
KSNGNLIAP

SEQ ID NO: 475352 - protein, 9 aa, Influenza virus
KSPLPLCPF

SEQ ID NO: 475353 - protein, 9 aa, Influenza virus
KSQLIWMAC

SEQ ID NO: 475354 - protein, 9 aa, Influenza virus
KSQLVWMAC

SEQ ID NO: 475355 - protein, 9 aa, Influenza virus
KSRGYKMNI

SEQ ID NO: 475356 - protein, 9 aa, Influenza virus
KSRGYKMNN

SEQ ID NO: 475357 - protein, 9 aa, Influenza virus
KSRGYKMNT

SEQ ID NO: 475358 - protein, 9 aa, Influenza virus
KSRINGVKL

SEQ ID NO: 475359 - protein, 9 aa, Influenza virus
KSRSIIFNM

SEQ ID NO: 475360 - protein, 9 aa, Influenza virus
KSRSNIFNM

SEQ ID NO: 475361 - protein, 9 aa, Influenza virus
KSRVDNHSM

SEQ ID NO: 475362 - protein, 9 aa, Influenza virus
KSSACKRAN

SEQ ID NO: 475363 - protein, 9 aa, Influenza virus
KSSLPLCPF

SEQ ID NO: 475364 - protein, 9 aa, Influenza virus
KSTKSTVLK

SEQ ID NO: 475365 - protein, 9 aa, Influenza virus
KSTPSAIDQ

SEQ ID NO: 475366 - protein, 9 aa, Influenza virus
KSTQAAIDK

SEQ ID NO: 475367 - protein, 9 aa, Influenza virus
KSTQAAIDQ

SEQ ID NO: 475368 - protein, 9 aa, Influenza virus
KSTQAAINQ

SEQ ID NO: 475369 - protein, 9 aa, Influenza virus
KSTQAAVDQ

SEQ ID NO: 475370 - protein, 9 aa, Influenza virus
KSTQAAVNQ

SEQ ID NO: 475371 - protein, 9 aa, Influenza virus
KSTQEAIDK

SEQ ID NO: 475372 - protein, 9 aa, Influenza virus
KSTQEAIEK

SEQ ID NO: 475373 - protein, 9 aa, Influenza virus
KSTQEAIGK

SEQ ID NO: 475374 - protein, 9 aa, Influenza virus
KSTQEAINK

SEQ ID NO: 475375 - protein, 9 aa, Influenza virus
KSTQKAIDG

SEQ ID NO: 475376 - protein, 9 aa, Influenza virus
KSTQKTIDQ

SEQ ID NO: 475377 - protein, 9 aa, Influenza virus
KSTQSAIDQ

SEQ ID NO: 475378 - protein, 9 aa, Influenza virus
KSTQSAINQ

SEQ ID NO: 475379 - protein, 9 aa, Influenza virus
KSTQSAVDQ

SEQ ID NO: 475380 - protein, 9 aa, Influenza virus
KSTQSAVNQ

SEQ ID NO: 475381 - protein, 9 aa, Influenza virus
KSTQTAIDQ

SEQ ID NO: 475382 - protein, 9 aa, Influenza virus
KSTVLKSDK

SEQ ID NO: 475383 - protein, 9 aa, Influenza virus
KSVFNCLYA

SEQ ID NO: 475384 - protein, 9 aa, Influenza virus
KSVFNNLYA

SEQ ID NO: 475385 - protein, 9 aa, Influenza virus
KSVFNSIYA

SEQ ID NO: 475386 - protein, 9 aa, Influenza virus
KSVFNSLYA

SEQ ID NO: 475387 - protein, 9 aa, Influenza virus
KSVFNSLYS

SEQ ID NO: 475388 - protein, 9 aa, Influenza virus
KSVTQTLVS

SEQ ID NO: 475389 - protein, 9 aa, Influenza virus
KSVTVSHAQ

SEQ ID NO: 475390 - protein, 9 aa, Influenza virus
KSWKGNIMR

SEQ ID NO: 475391 - protein, 9 aa, Influenza virus
KSWRKDILR

SEQ ID NO: 475392 - protein, 9 aa, Influenza virus
KSWRRDILR

SEQ ID NO: 475393 - protein, 9 aa, Influenza virus
KSWSKPQCQ

SEQ ID NO: 475394 - protein, 9 aa, Influenza virus
KSYFANLKG

SEQ ID NO: 475395 - protein, 9 aa, Influenza virus
KSYINKTGT

SEQ ID NO: 475396 - protein, 9 aa, Influenza virus
KSYINRTGT

SEQ ID NO: 475397 - protein, 9 aa, Influenza virus
KTAYELTDS

SEQ ID NO: 475398 - protein, 9 aa, Influenza virus
KTDGATSAC

SEQ ID NO: 475399 - protein, 9 aa, Influenza virus
KTEDNIYKI

SEQ ID NO: 475400 - protein, 9 aa, Influenza virus
KTEDNVYKI

SEQ ID NO: 475401 - protein, 9 aa, Influenza virus
KTEDNVYKV

SEQ ID NO: 475402 - protein, 9 aa, Influenza virus
KTFFGWKEP

SEQ ID NO: 475403 - protein, 9 aa, Influenza virus
KTFFGWREP

SEQ ID NO: 475404 - protein, 9 aa, Influenza virus
KTFFLTQGA

SEQ ID NO: 475405 - protein, 9 aa, Influenza virus
KTFQNIDKN

SEQ ID NO: 475406 - protein, 9 aa, Influenza virus
KTFQNIDRN

SEQ ID NO: 475407 - protein, 9 aa, Influenza virus
KTFQNIEKN

SEQ ID NO: 475408 - protein, 9 aa, Influenza virus
KTFQNIERN

SEQ ID NO: 475409 - protein, 9 aa, Influenza virus
KTFQNISPV

SEQ ID NO: 475410 - protein, 9 aa, Influenza virus
KTFQNVSPI

SEQ ID NO: 475411 - protein, 9 aa, Influenza virus
KTFQNVSPL

SEQ ID NO: 475412 - protein, 9 aa, Influenza virus
KTFQNVSPV

SEQ ID NO: 475413 - protein, 9 aa, Influenza virus
KTGGPIYKK

SEQ ID NO: 475414 - protein, 9 aa, Influenza virus
KTGGPIYKR

SEQ ID NO: 475415 - protein, 9 aa, Influenza virus
KTGGPIYRR

SEQ ID NO: 475416 - protein, 9 aa, Influenza virus
KTGTFEFTS

SEQ ID NO: 475417 - protein, 9 aa, Influenza virus
KTGTYDYPK

SEQ ID NO: 475418 - protein, 9 aa, Influenza virus
KTGVDEYSS

SEQ ID NO: 475419 - protein, 9 aa, Influenza virus
KTHIHIFSF

SEQ ID NO: 475420 - protein, 9 aa, Influenza virus
KTHNGKLCK

SEQ ID NO: 475421 - protein, 9 aa, Influenza virus
KTHNGKLCR

SEQ ID NO: 475422 - protein, 9 aa, Influenza virus
KTHNGRLCK

SEQ ID NO: 475423 - protein, 9 aa, Influenza virus
KTIDQVTGK

SEQ ID NO: 475424 - protein, 9 aa, Influenza virus
KTITIGSVS

SEQ ID NO: 475425 - protein, 9 aa, Influenza virus
KTIWTSGSS

SEQ ID NO: 475426 - protein, 9 aa, Influenza virus
KTKATKMEA

SEQ ID NO: 475427 - protein, 9 aa, Influenza virus
KTKATKMKA

SEQ ID NO: 475428 - protein, 9 aa, Influenza virus
KTKCQTYAG

SEQ ID NO: 475429 - protein, 9 aa, Influenza virus
KTKKMTITF

SEQ ID NO: 475430 - protein, 9 aa, Influenza virus
KTKLPFQNL

SEQ ID NO: 475431 - protein, 9 aa, Influenza virus
KTLDEHDAN

SEQ ID NO: 475432 - protein, 9 aa, Influenza virus
KTLDEHDSN

SEQ ID NO: 475433 - protein, 9 aa, Influenza virus
KTLDEHDTN

SEQ ID NO: 475434 - protein, 9 aa, Influenza virus
KTLDEHEAN

SEQ ID NO: 475435 - protein, 9 aa, Influenza virus
KTLDEHVAN

SEQ ID NO: 475436 - protein, 9 aa, Influenza virus
KTLDKHDSN

SEQ ID NO: 475437 - protein, 9 aa, Influenza virus
KTLDLHDAN

SEQ ID NO: 475438 - protein, 9 aa, Influenza virus
KTLDLHDSN

SEQ ID NO: 475439 - protein, 9 aa, Influenza virus
KTLDMHDAN

SEQ ID NO: 475440 - protein, 9 aa, Influenza virus
KTLKLATGM

SEQ ID NO: 475441 - protein, 9 aa, Influenza virus
KTLNMHDAN

SEQ ID NO: 475442 - protein, 9 aa, Influenza virus
KTLTDNHVE

SEQ ID NO: 475443 - protein, 9 aa, Influenza virus
KTLTDTSRP

SEQ ID NO: 475444 - protein, 9 aa, Influenza virus
KTLTNEHEE

SEQ ID NO: 475445 - protein, 9 aa, Influenza virus
KTLTNEKEE

SEQ ID NO: 475446 - protein, 9 aa, Influenza virus
KTLTNEKEK

SEQ ID NO: 475447 - protein, 9 aa, Influenza virus
KTLTNEQEE

SEQ ID NO: 475448 - protein, 9 aa, Influenza virus
KTLTSEKEE

SEQ ID NO: 475449 - protein, 9 aa, Influenza virus
KTMTITFLI

SEQ ID NO: 475450 - protein, 9 aa, Influenza virus
KTNDKYHQI

SEQ ID NO: 475451 - protein, 9 aa, Influenza virus
KTNEKFHQI

SEQ ID NO: 475452 - protein, 9 aa, Influenza virus
KTNEKYHQI

SEQ ID NO: 475453 - protein, 9 aa, Influenza virus
KTNGNLIAP

SEQ ID NO: 475454 - protein, 9 aa, Influenza virus
KTNKQFELI

SEQ ID NO: 475455 - protein, 9 aa, Influenza virus
KTNLYGFII

SEQ ID NO: 475456 - protein, 9 aa, Influenza virus
KTNLYGFIV

SEQ ID NO: 475457 - protein, 9 aa, Influenza virus
KTNQQFELD

SEQ ID NO: 475458 - protein, 9 aa, Influenza virus
KTNQQFELI

SEQ ID NO: 475459 - protein, 9 aa, Influenza virus
KTNQQFEMI

SEQ ID NO: 475460 - protein, 9 aa, Influenza virus
KTNQQFKLI

SEQ ID NO: 475461 - protein, 9 aa, Influenza virus
KTNTEFESI

SEQ ID NO: 475462 - protein, 9 aa, Influenza virus
KTNTQFELI

SEQ ID NO: 475463 - protein, 9 aa, Influenza virus
KTPYRSLIR

SEQ ID NO: 475464 - protein, 9 aa, Influenza virus
KTRFLPVAG

SEQ ID NO: 475465 - protein, 9 aa, Influenza virus
KTRFLPVSG

SEQ ID NO: 475466 - protein, 9 aa, Influenza virus
KTRFLPVTG

SEQ ID NO: 475467 - protein, 9 aa, Influenza virus
KTRGLFGAI

SEQ ID NO: 475468 - protein, 9 aa, Influenza virus
KTRLFTIRQ

SEQ ID NO: 475469 - protein, 9 aa, Influenza virus
KTRPILSPL

SEQ ID NO: 475470 - protein, 9 aa, Influenza virus
KTSIWTSSS

SEQ ID NO: 475471 - protein, 9 aa, Influenza virus
KTSTQKAIN

SEQ ID NO: 475472 - protein, 9 aa, Influenza virus
KTSWSYIVE

SEQ ID NO: 475473 - protein, 9 aa, Influenza virus
KTTVDHMAI

SEQ ID NO: 475474 - protein, 9 aa, Influenza virus
KTVINNITT

SEQ ID NO: 475475 - protein, 9 aa, Influenza virus
KTVVHLNST

SEQ ID NO: 475476 - protein, 9 aa, Influenza virus
KTWAGKILR

SEQ ID NO: 475477 - protein, 9 aa, Influenza virus
KTWAGNILR

SEQ ID NO: 475478 - protein, 9 aa, Influenza virus
KTWAKNILR

SEQ ID NO: 475479 - protein, 9 aa, Influenza virus
KTWARNILR

SEQ ID NO: 475480 - protein, 9 aa, Influenza virus
KTYNNTTGR

SEQ ID NO: 475481 - protein, 9 aa, Influenza virus
KVARLGKGY

SEQ ID NO: 475482 - protein, 9 aa, Influenza virus
KVATGRVTV

SEQ ID NO: 475483 - protein, 9 aa, Influenza virus
KVCRALLAK

SEQ ID NO: 475484 - protein, 9 aa, Influenza virus
KVCRTLLAK

SEQ ID NO: 475485 - protein, 9 aa, Influenza virus
KVCTKGKKA

SEQ ID NO: 475486 - protein, 9 aa, Influenza virus
KVDGSSSAC

SEQ ID NO: 475487 - protein, 9 aa, Influenza virus
KVDLWSYNA

SEQ ID NO: 475488 - protein, 9 aa, Influenza virus
KVDTIIENN

SEQ ID NO: 475489 - protein, 9 aa, Influenza virus
KVDTIIESN

SEQ ID NO: 475490 - protein, 9 aa, Influenza virus
KVDTILERN

SEQ ID NO: 475491 - protein, 9 aa, Influenza virus
KVDTLTEKG

SEQ ID NO: 475492 - protein, 9 aa, Influenza virus
KVDTLTENG

SEQ ID NO: 475493 - protein, 9 aa, Influenza virus
KVDTLTETG

SEQ ID NO: 475494 - protein, 9 aa, Influenza virus
KVEAVIYGN

SEQ ID NO: 475495 - protein, 9 aa, Influenza virus
KVECICRDN

SEQ ID NO: 475496 - protein, 9 aa, Influenza virus
KVECIGWSS

SEQ ID NO: 475497 - protein, 9 aa, Influenza virus
KVECVCRDN

SEQ ID NO: 475498 - protein, 9 aa, Influenza virus
KVEFEPFQS

SEQ ID NO: 475499 - protein, 9 aa, Influenza virus
KVEGWVVVA

SEQ ID NO: 475500 - protein, 9 aa, Influenza virus
KVESNGNLI

SEQ ID NO: 475501 - protein, 9 aa, Influenza virus
KVGVDEYSS

SEQ ID NO: 475502 - protein, 9 aa, Influenza virus
KVGYLCAGI

SEQ ID NO: 475503 - protein, 9 aa, Influenza virus
KVKEIGNGC

SEQ ID NO: 475504 - protein, 9 aa, Influenza virus
KVKMKWGME

SEQ ID NO: 475505 - protein, 9 aa, Influenza virus
KVLAIYSCI

SEQ ID NO: 475506 - protein, 9 aa, Influenza virus
KVLSIYSCI

SEQ ID NO: 475507 - protein, 9 aa, Influenza virus
KVLTDTSRP

SEQ ID NO: 475508 - protein, 9 aa, Influenza virus
KVLYFHKGI

SEQ ID NO: 475509 - protein, 9 aa, Influenza virus
KVLYFHKGL

SEQ ID NO: 475510 - protein, 9 aa, Influenza virus
KVMYFHKGL

SEQ ID NO: 475511 - protein, 9 aa, Influenza virus
KVNGQAGRI

SEQ ID NO: 475512 - protein, 9 aa, Influenza virus
KVNGQSGRI

SEQ ID NO: 475513 - protein, 9 aa, Influenza virus
KVNGVKLEE

SEQ ID NO: 475514 - protein, 9 aa, Influenza virus
KVNNIVDKM

SEQ ID NO: 475515 - protein, 9 aa, Influenza virus
KVNSIIDKM

SEQ ID NO: 475516 - protein, 9 aa, Influenza virus
KVNSIIEKM

SEQ ID NO: 475517 - protein, 9 aa, Influenza virus
KVNSIIGKM

SEQ ID NO: 475518 - protein, 9 aa, Influenza virus
KVNSIINKM

SEQ ID NO: 475519 - protein, 9 aa, Influenza virus
KVNSVIEKM

SEQ ID NO: 475520 - protein, 9 aa, Influenza virus
KVNSVVEKM

SEQ ID NO: 475521 - protein, 9 aa, Influenza virus
KVNTIIENN

SEQ ID NO: 475522 - protein, 9 aa, Influenza virus
KVNTLTEKG

SEQ ID NO: 475523 - protein, 9 aa, Influenza virus
KVNTLTERE

SEQ ID NO: 475524 - protein, 9 aa, Influenza virus
KVNTLTERG

SEQ ID NO: 475525 - protein, 9 aa, Influenza virus
KVNTQFEAV

SEQ ID NO: 475526 - protein, 9 aa, Influenza virus
KVPAQNAIS

SEQ ID NO: 475527 - protein, 9 aa, Influenza virus
KVPEWSYIV

SEQ ID NO: 475528 - protein, 9 aa, Influenza virus
KVPNAEKDP

SEQ ID NO: 475529 - protein, 9 aa, Influenza virus
KVPNAGTDP

SEQ ID NO: 475530 - protein, 9 aa, Influenza virus
KVPNALIDD

SEQ ID NO: 475531 - protein, 9 aa, Influenza virus
KVPNALTDD

SEQ ID NO: 475532 - protein, 9 aa, Influenza virus
KVPNALTDE

SEQ ID NO: 475533 - protein, 9 aa, Influenza virus
KVPNALTDN

SEQ ID NO: 475534 - protein, 9 aa, Influenza virus
KVPVQNAIS

SEQ ID NO: 475535 - protein, 9 aa, Influenza virus
KVPVTQTME

SEQ ID NO: 475536 - protein, 9 aa, Influenza virus
KVQHLEECS

SEQ ID NO: 475537 - protein, 9 aa, Influenza virus
KVRHQLRDN

SEQ ID NO: 475538 - protein, 9 aa, Influenza virus
KVRLQLKDN

SEQ ID NO: 475539 - protein, 9 aa, Influenza virus
KVRLQLRDN

SEQ ID NO: 475540 - protein, 9 aa, Influenza virus
KVRMQLKDN

SEQ ID NO: 475541 - protein, 9 aa, Influenza virus
KVRMQLRDN

SEQ ID NO: 475542 - protein, 9 aa, Influenza virus
KVRNGTYDH

SEQ ID NO: 475543 - protein, 9 aa, Influenza virus
KVRRQLREN

SEQ ID NO: 475544 - protein, 9 aa, Influenza virus
KVSCVCRDN

SEQ ID NO: 475545 - protein, 9 aa, Influenza virus
KVSTQKAIN

SEQ ID NO: 475546 - protein, 9 aa, Influenza virus
KVSTQKALN

SEQ ID NO: 475547 - protein, 9 aa, Influenza virus
KVTCVCRDN

SEQ ID NO: 475548 - protein, 9 aa, Influenza virus
KVTHRENLL

SEQ ID NO: 475549 - protein, 9 aa, Influenza virus
KVTNATETV

SEQ ID NO: 475550 - protein, 9 aa, Influenza virus
KVVHISPLS

SEQ ID NO: 475551 - protein, 9 aa, Influenza virus
KVWWTSNSI

SEQ ID NO: 475552 - protein, 9 aa, Influenza virus
KWALGENMA

SEQ ID NO: 475553 - protein, 9 aa, Influenza virus
KWEKYCILE

SEQ ID NO: 475554 - protein, 9 aa, Influenza virus
KWEKYCVIE

SEQ ID NO: 475555 - protein, 9 aa, Influenza virus
KWEKYCVLE

SEQ ID NO: 475556 - protein, 9 aa, Influenza virus
KWEPLAGTA

SEQ ID NO: 475557 - protein, 9 aa, Influenza virus
KWEPLTGTA

SEQ ID NO: 475558 - protein, 9 aa, Influenza virus
KWERYCVLE

SEQ ID NO: 475559 - protein, 9 aa, Influenza virus
KWESLAGTA

SEQ ID NO: 475560 - protein, 9 aa, Influenza virus
KWESLNGTA

SEQ ID NO: 475561 - protein, 9 aa, Influenza virus
KWESLTGTA

SEQ ID NO: 475562 - protein, 9 aa, Influenza virus
KWGDILDGV

SEQ ID NO: 475563 - protein, 9 aa, Influenza virus
KWGDILEGT

SEQ ID NO: 475564 - protein, 9 aa, Influenza virus
KWGDVLDGV

SEQ ID NO: 475565 - protein, 9 aa, Influenza virus
KWGMELRRC

SEQ ID NO: 475566 - protein, 9 aa, Influenza virus
KWGMEMRRC

SEQ ID NO: 475567 - protein, 9 aa, Influenza virus
KWGNVLDGV

SEQ ID NO: 475568 - protein, 9 aa, Influenza virus
KWLISKSKE

SEQ ID NO: 475569 - protein, 9 aa, Influenza virus
KWLLSNADN

SEQ ID NO: 475570 - protein, 9 aa, Influenza virus
KWLLSNNDN

SEQ ID NO: 475571 - protein, 9 aa, Influenza virus
KWLLSNSDN

SEQ ID NO: 475572 - protein, 9 aa, Influenza virus
KWLLSNSNN

SEQ ID NO: 475573 - protein, 9 aa, Influenza virus
KWLLSNTDN

SEQ ID NO: 475574 - protein, 9 aa, Influenza virus
KWLLSSKAN

SEQ ID NO: 475575 - protein, 9 aa, Influenza virus
KWLLSSKDN

SEQ ID NO: 475576 - protein, 9 aa, Influenza virus
KWLLSSSDN

SEQ ID NO: 475577 - protein, 9 aa, Influenza virus
KWLLSSTDN

SEQ ID NO: 475578 - protein, 9 aa, Influenza virus
KWLSSSGNN

SEQ ID NO: 475579 - protein, 9 aa, Influenza virus
KWLSSSMNN

SEQ ID NO: 475580 - protein, 9 aa, Influenza virus
KWLTLKSGQ

SEQ ID NO: 475581 - protein, 9 aa, Influenza virus
KWLVSKDKG

SEQ ID NO: 475582 - protein, 9 aa, Influenza virus
KWLVSKNKG

SEQ ID NO: 475583 - protein, 9 aa, Influenza virus
KWLVSKSKG

SEQ ID NO: 475584 - protein, 9 aa, Influenza virus
KWLVSKTKG

SEQ ID NO: 475585 - protein, 9 aa, Influenza virus
KWMMAMKYP

SEQ ID NO: 475586 - protein, 9 aa, Influenza virus
KWMMAMRYP

SEQ ID NO: 475587 - protein, 9 aa, Influenza virus
KWNENQNPR

SEQ ID NO: 475588 - protein, 9 aa, Influenza virus
KWNVTHTGT

SEQ ID NO: 475589 - protein, 9 aa, Influenza virus
KWNVTYTGI

SEQ ID NO: 475590 - protein, 9 aa, Influenza virus
KWNVTYTGT

SEQ ID NO: 475591 - protein, 9 aa, Influenza virus
KWREQLSQK

SEQ ID NO: 475592 - protein, 9 aa, Influenza virus
KWSGYSGSF

SEQ ID NO: 475593 - protein, 9 aa, Influenza virus
KWTLGENMA

SEQ ID NO: 475594 - protein, 9 aa, Influenza virus
KWVLGENMA

SEQ ID NO: 475595 - protein, 9 aa, Influenza virus
KWWVWLWLV

SEQ ID NO: 475596 - protein, 9 aa, Influenza virus
KYDGIITDT

SEQ ID NO: 475597 - protein, 9 aa, Influenza virus
KYDNGVWIG

SEQ ID NO: 475598 - protein, 9 aa, Influenza virus
KYEEESKLK

SEQ ID NO: 475599 - protein, 9 aa, Influenza virus
KYEEESKLN

SEQ ID NO: 475600 - protein, 9 aa, Influenza virus
KYEEESRLN

SEQ ID NO: 475601 - protein, 9 aa, Influenza virus
KYERVKMFD

SEQ ID NO: 475602 - protein, 9 aa, Influenza virus
KYGDGVWIG

SEQ ID NO: 475603 - protein, 9 aa, Influenza virus
KYGNGAWIG

SEQ ID NO: 475604 - protein, 9 aa, Influenza virus
KYGNGVWIG

SEQ ID NO: 475605 - protein, 9 aa, Influenza virus
KYGNGVWMG

SEQ ID NO: 475606 - protein, 9 aa, Influenza virus
KYGPALSIN

SEQ ID NO: 475607 - protein, 9 aa, Influenza virus
KYGSGRIFQ

SEQ ID NO: 475608 - protein, 9 aa, Influenza virus
KYGTGRIFQ

SEQ ID NO: 475609 - protein, 9 aa, Influenza virus
KYGYIIEEY

SEQ ID NO: 475610 - protein, 9 aa, Influenza virus
KYHQIEKEF

SEQ ID NO: 475611 - protein, 9 aa, Influenza virus
KYHWNLALD

SEQ ID NO: 475612 - protein, 9 aa, Influenza virus
KYIKQGSLK

SEQ ID NO: 475613 - protein, 9 aa, Influenza virus
KYIKSDQLK

SEQ ID NO: 475614 - protein, 9 aa, Influenza virus
KYIKSGQLK

SEQ ID NO: 475615 - protein, 9 aa, Influenza virus
KYIPSGSLK

SEQ ID NO: 475616 - protein, 9 aa, Influenza virus
KYIPSNSLK

SEQ ID NO: 475617 - protein, 9 aa, Influenza virus
KYIPSRSLK

SEQ ID NO: 475618 - protein, 9 aa, Influenza virus
KYISSGSLK

SEQ ID NO: 475619 - protein, 9 aa, Influenza virus
KYKGIITDT

SEQ ID NO: 475620 - protein, 9 aa, Influenza virus
KYKGIITGT

SEQ ID NO: 475621 - protein, 9 aa, Influenza virus
KYKIFKNGK

SEQ ID NO: 475622 - protein, 9 aa, Influenza virus
KYLEEHPNA

SEQ ID NO: 475623 - protein, 9 aa, Influenza virus
KYLEEHPSA

SEQ ID NO: 475624 - protein, 9 aa, Influenza virus
KYLEEHPST

SEQ ID NO: 475625 - protein, 9 aa, Influenza virus
KYLPDLYDY

SEQ ID NO: 475626 - protein, 9 aa, Influenza virus
KYMNVKSLK

SEQ ID NO: 475627 - protein, 9 aa, Influenza virus
KYNDIITDT

SEQ ID NO: 475628 - protein, 9 aa, Influenza virus
KYNGIITDT

SEQ ID NO: 475629 - protein, 9 aa, Influenza virus
KYNGIITET

SEQ ID NO: 475630 - protein, 9 aa, Influenza virus
KYNGIITGT

SEQ ID NO: 475631 - protein, 9 aa, Influenza virus
KYNGLITDT

SEQ ID NO: 475632 - protein, 9 aa, Influenza virus
KYNGMITDT

SEQ ID NO: 475633 - protein, 9 aa, Influenza virus
KYNGVITDT

SEQ ID NO: 475634 - protein, 9 aa, Influenza virus
KYQQSFSPS

SEQ ID NO: 475635 - protein, 9 aa, Influenza virus
KYQQSFTPS

SEQ ID NO: 475636 - protein, 9 aa, Influenza virus
KYREEAMQN

SEQ ID NO: 475637 - protein, 9 aa, Influenza virus
KYRQSFSPS

SEQ ID NO: 475638 - protein, 9 aa, Influenza virus
KYRTESLQN

SEQ ID NO: 475639 - protein, 9 aa, Influenza virus
KYSRADKIC

SEQ ID NO: 475640 - protein, 9 aa, Influenza virus
KYTSARQEK

SEQ ID NO: 475641 - protein, 9 aa, Influenza virus
KYTSGRQEK

SEQ ID NO: 475642 - protein, 9 aa, Influenza virus
KYVEDTKID

SEQ ID NO: 475643 - protein, 9 aa, Influenza virus
KYVEDTKVD

SEQ ID NO: 475644 - protein, 9 aa, Influenza virus
KYVEWTSNS

SEQ ID NO: 475645 - protein, 9 aa, Influenza virus
KYVKQGSLK

SEQ ID NO: 475646 - protein, 9 aa, Influenza virus
KYVKQGSLM

SEQ ID NO: 475647 - protein, 9 aa, Influenza virus
KYVKQGSLR

SEQ ID NO: 475648 - protein, 9 aa, Influenza virus
KYVKSDRLV

SEQ ID NO: 475649 - protein, 9 aa, Influenza virus
KYVKSEKLV

SEQ ID NO: 475650 - protein, 9 aa, Influenza virus
KYVKSERLV

SEQ ID NO: 475651 - protein, 9 aa, Influenza virus
KYVKSKRLV

SEQ ID NO: 475652 - protein, 9 aa, Influenza virus
KYVNIKSLK

SEQ ID NO: 475653 - protein, 9 aa, Influenza virus
KYVNNTTII

SEQ ID NO: 475654 - protein, 9 aa, Influenza virus
KYVNVKSLK

SEQ ID NO: 475655 - protein, 9 aa, Influenza virus
KYVNVRSLK

SEQ ID NO: 475656 - protein, 9 aa, Influenza virus
KYVRSEKLV

SEQ ID NO: 475657 - protein, 9 aa, Influenza virus
KYVWWASNS

SEQ ID NO: 475658 - protein, 9 aa, Influenza virus
KYVWWTSNS

SEQ ID NO: 475659 - protein, 9 aa, Influenza virus
KYWAIRTRS

SEQ ID NO: 475660 - protein, 9 aa, Influenza virus
LAAGGDIWV

SEQ ID NO: 475661 - protein, 9 aa, Influenza virus
LAAICTHLE

SEQ ID NO: 475662 - protein, 9 aa, Influenza virus
LAATVTLHF

SEQ ID NO: 475663 - protein, 9 aa, Influenza virus
LADQSLPPN

SEQ ID NO: 475664 - protein, 9 aa, Influenza virus
LADRIDDAV

SEQ ID NO: 475665 - protein, 9 aa, Influenza virus
LADRVDDAV

SEQ ID NO: 475666 - protein, 9 aa, Influenza virus
LADSEMDKL

SEQ ID NO: 475667 - protein, 9 aa, Influenza virus
LADSEMKKL

SEQ ID NO: 475668 - protein, 9 aa, Influenza virus
LADSEMNKL

SEQ ID NO: 475669 - protein, 9 aa, Influenza virus
LADSEMSKL

SEQ ID NO: 475670 - protein, 9 aa, Influenza virus
LADWVDDAV

SEQ ID NO: 475671 - protein, 9 aa, Influenza virus
LAEKAMKEH

SEQ ID NO: 475672 - protein, 9 aa, Influenza virus
LAEKAMKEY

SEQ ID NO: 475673 - protein, 9 aa, Influenza virus
LAEKTMKEY

SEQ ID NO: 475674 - protein, 9 aa, Influenza virus
LAERAMKEY

SEQ ID NO: 475675 - protein, 9 aa, Influenza virus
LAFICIKNG

SEQ ID NO: 475676 - protein, 9 aa, Influenza virus
LAFILWACQ

SEQ ID NO: 475677 - protein, 9 aa, Influenza virus
LAFILWACS

SEQ ID NO: 475678 - protein, 9 aa, Influenza virus
LAFIMWACS

SEQ ID NO: 475679 - protein, 9 aa, Influenza virus
LAFMLWACQ

SEQ ID NO: 475680 - protein, 9 aa, Influenza virus
LAFNTVIHE

SEQ ID NO: 475681 - protein, 9 aa, Influenza virus
LAFVLWACQ

SEQ ID NO: 475682 - protein, 9 aa, Influenza virus
LAGSAQHVE

SEQ ID NO: 475683 - protein, 9 aa, Influenza virus
LAGTAKHIE

SEQ ID NO: 475684 - protein, 9 aa, Influenza virus
LAHALKLVV

SEQ ID NO: 475685 - protein, 9 aa, Influenza virus
LAIAMGLIF

SEQ ID NO: 475686 - protein, 9 aa, Influenza virus
LAIAMGLVF

SEQ ID NO: 475687 - protein, 9 aa, Influenza virus
LAIGECPKY

SEQ ID NO: 475688 - protein, 9 aa, Influenza virus
LAIGLRNTP

SEQ ID NO: 475689 - protein, 9 aa, Influenza virus
LAIGLRNVP

SEQ ID NO: 475690 - protein, 9 aa, Influenza virus
LAIGPRNVP

SEQ ID NO: 475691 - protein, 9 aa, Influenza virus
LAIIIAGLS

SEQ ID NO: 475692 - protein, 9 aa, Influenza virus
LAILIAGGL

SEQ ID NO: 475693 - protein, 9 aa, Influenza virus
LAILVAGGL

SEQ ID NO: 475694 - protein, 9 aa, Influenza virus
LAIMIAGIF

SEQ ID NO: 475695 - protein, 9 aa, Influenza virus
LAIMIAGIS

SEQ ID NO: 475696 - protein, 9 aa, Influenza virus
LAIMIAGLF

SEQ ID NO: 475697 - protein, 9 aa, Influenza virus
LAIMIAGLS

SEQ ID NO: 475698 - protein, 9 aa, Influenza virus
LAIMMAGIF

SEQ ID NO: 475699 - protein, 9 aa, Influenza virus
LAIMMAGIS

SEQ ID NO: 475700 - protein, 9 aa, Influenza virus
LAIMMAGLS

SEQ ID NO: 475701 - protein, 9 aa, Influenza virus
LAIMVAGIS

SEQ ID NO: 475702 - protein, 9 aa, Influenza virus
LAIMVAGLS

SEQ ID NO: 475703 - protein, 9 aa, Influenza virus
LAIVMGLVF

SEQ ID NO: 475704 - protein, 9 aa, Influenza virus
LAIYATVAG

SEQ ID NO: 475705 - protein, 9 aa, Influenza virus
LAIYSCIAS

SEQ ID NO: 475706 - protein, 9 aa, Influenza virus
LAIYSTAAS

SEQ ID NO: 475707 - protein, 9 aa, Influenza virus
LAIYSTISS

SEQ ID NO: 475708 - protein, 9 aa, Influenza virus
LAIYSTVAS

SEQ ID NO: 475709 - protein, 9 aa, Influenza virus
LAIYSTVSS

SEQ ID NO: 475710 - protein, 9 aa, Influenza virus
  MOD_RES (3)..(3): Ile or Leu
LAXVMGLVF

SEQ ID NO: 475711 - protein, 9 aa, Influenza virus
LAKCNTKCQ

SEQ ID NO: 475712 - protein, 9 aa, Influenza virus
LAKGEKANV

SEQ ID NO: 475713 - protein, 9 aa, Influenza virus
LAKSVFNCL

SEQ ID NO: 475714 - protein, 9 aa, Influenza virus
LAKSVFNNL

SEQ ID NO: 475715 - protein, 9 aa, Influenza virus
LAKSVFNSL

SEQ ID NO: 475716 - protein, 9 aa, Influenza virus
LALGLRNTP

SEQ ID NO: 475717 - protein, 9 aa, Influenza virus
LALGMKNVP

SEQ ID NO: 475718 - protein, 9 aa, Influenza virus
LALSHTAYS

SEQ ID NO: 475719 - protein, 9 aa, Influenza virus
LAMITYITK

SEQ ID NO: 475720 - protein, 9 aa, Influenza virus
LAMITYITR

SEQ ID NO: 475721 - protein, 9 aa, Influenza virus
LANLGLNIG

SEQ ID NO: 475722 - protein, 9 aa, Influenza virus
LANLGLNVG

SEQ ID NO: 475723 - protein, 9 aa, Influenza virus
LANNGKFEF

SEQ ID NO: 475724 - protein, 9 aa, Influenza virus
LANNGRFEF

SEQ ID NO: 475725 - protein, 9 aa, Influenza virus
LANQSLPPN

SEQ ID NO: 475726 - protein, 9 aa, Influenza virus
LANSEMNKL

SEQ ID NO: 475727 - protein, 9 aa, Influenza virus
LANTIEIFR

SEQ ID NO: 475728 - protein, 9 aa, Influenza virus
LANTIEVFR

SEQ ID NO: 475729 - protein, 9 aa, Influenza virus
LANVVRKMM

SEQ ID NO: 475730 - protein, 9 aa, Influenza virus
LANYSLPPN

SEQ ID NO: 475731 - protein, 9 aa, Influenza virus
LAPGYAFEI

SEQ ID NO: 475732 - protein, 9 aa, Influenza virus
LAPKYGYII

SEQ ID NO: 475733 - protein, 9 aa, Influenza virus
LAPRYAFEI

SEQ ID NO: 475734 - protein, 9 aa, Influenza virus
LAPRYAFEL

SEQ ID NO: 475735 - protein, 9 aa, Influenza virus
LAPRYALEL

SEQ ID NO: 475736 - protein, 9 aa, Influenza virus
LAPRYGYII

SEQ ID NO: 475737 - protein, 9 aa, Influenza virus
LAQGALLGT

SEQ ID NO: 475738 - protein, 9 aa, Influenza virus
LAQGALVGT

SEQ ID NO: 475739 - protein, 9 aa, Influenza virus
LAQGTLLGT

SEQ ID NO: 475740 - protein, 9 aa, Influenza virus
LAQGVLLGT

SEQ ID NO: 475741 - protein, 9 aa, Influenza virus
LAQGYKDII

SEQ ID NO: 475742 - protein, 9 aa, Influenza virus
LARCICEKL

SEQ ID NO: 475743 - protein, 9 aa, Influenza virus
LARGEKANV

SEQ ID NO: 475744 - protein, 9 aa, Influenza virus
LARNICEKL

SEQ ID NO: 475745 - protein, 9 aa, Influenza virus
LARRICEKL

SEQ ID NO: 475746 - protein, 9 aa, Influenza virus
LARSALILR

SEQ ID NO: 475747 - protein, 9 aa, Influenza virus
LARSICEKL

SEQ ID NO: 475748 - protein, 9 aa, Influenza virus
LASCMGLIY

SEQ ID NO: 475749 - protein, 9 aa, Influenza virus
LASGLRNVP

SEQ ID NO: 475750 - protein, 9 aa, Influenza virus
LASLLEMCH

SEQ ID NO: 475751 - protein, 9 aa, Influenza virus
LASSGSLEF

SEQ ID NO: 475752 - protein, 9 aa, Influenza virus
LASTNAHDR

SEQ ID NO: 475753 - protein, 9 aa, Influenza virus
LASTNAYDR

SEQ ID NO: 475754 - protein, 9 aa, Influenza virus
LASTTAKAM

SEQ ID NO: 475755 - protein, 9 aa, Influenza virus
LATGLKNVP

SEQ ID NO: 475756 - protein, 9 aa, Influenza virus
LATGLRNAH

SEQ ID NO: 475757 - protein, 9 aa, Influenza virus
LATGLRNIP

SEQ ID NO: 475758 - protein, 9 aa, Influenza virus
LATGLRNVP

SEQ ID NO: 475759 - protein, 9 aa, Influenza virus
LATGMKNVP

SEQ ID NO: 475760 - protein, 9 aa, Influenza virus
LATGMRNIP

SEQ ID NO: 475761 - protein, 9 aa, Influenza virus
LATGMRNVP

SEQ ID NO: 475762 - protein, 9 aa, Influenza virus
LATGPRNVP

SEQ ID NO: 475763 - protein, 9 aa, Influenza virus
LATRGVQIA

SEQ ID NO: 475764 - protein, 9 aa, Influenza virus
LATTITLHF

SEQ ID NO: 475765 - protein, 9 aa, Influenza virus
LATTVTLHF

SEQ ID NO: 475766 - protein, 9 aa, Influenza virus
LAVGLRNTP

SEQ ID NO: 475767 - protein, 9 aa, Influenza virus
LAVLIAGGL

SEQ ID NO: 475768 - protein, 9 aa, Influenza virus
LAVNVRGSG

SEQ ID NO: 475769 - protein, 9 aa, Influenza virus
LAVTWWNRK

SEQ ID NO: 475770 - protein, 9 aa, Influenza virus
LAVTWWNRN

SEQ ID NO: 475771 - protein, 9 aa, Influenza virus
LAVTWWNRS

SEQ ID NO: 475772 - protein, 9 aa, Influenza virus
LAVVMGLVF

SEQ ID NO: 475773 - protein, 9 aa, Influenza virus
LAYCNTDLG

SEQ ID NO: 475774 - protein, 9 aa, Influenza virus
LAYDKICIG

SEQ ID NO: 475775 - protein, 9 aa, Influenza virus
LCAGIPSDT

SEQ ID NO: 475776 - protein, 9 aa, Influenza virus
LCAGIPTDT

SEQ ID NO: 475777 - protein, 9 aa, Influenza virus
LCAGLPSDT

SEQ ID NO: 475778 - protein, 9 aa, Influenza virus
LCAVNSWHI

SEQ ID NO: 475779 - protein, 9 aa, Influenza virus
LCDVSGFAI

SEQ ID NO: 475780 - protein, 9 aa, Influenza virus
LCEISGFAI

SEQ ID NO: 475781 - protein, 9 aa, Influenza virus
LCEVNSWHI

SEQ ID NO: 475782 - protein, 9 aa, Influenza virus
LCEVSGFAI

SEQ ID NO: 475783 - protein, 9 aa, Influenza virus
LCEVSGFVI

SEQ ID NO: 475784 - protein, 9 aa, Influenza virus
LCEVSSWHI

SEQ ID NO: 475785 - protein, 9 aa, Influenza virus
LCFPGELDN

SEQ ID NO: 475786 - protein, 9 aa, Influenza virus
LCFPGEVDN

SEQ ID NO: 475787 - protein, 9 aa, Influenza virus
LCGSKEQLG

SEQ ID NO: 475788 - protein, 9 aa, Influenza virus
LCGSKERLG

SEQ ID NO: 475789 - protein, 9 aa, Influenza virus
LCGSKKRLG

SEQ ID NO: 475790 - protein, 9 aa, Influenza virus
LCGSPFPVG

SEQ ID NO: 475791 - protein, 9 aa, Influenza virus
LCGSPISVG

SEQ ID NO: 475792 - protein, 9 aa, Influenza virus
LCGSPVPVG

SEQ ID NO: 475793 - protein, 9 aa, Influenza virus
LCGSPVSVG

SEQ ID NO: 475794 - protein, 9 aa, Influenza virus
LCGSRERLG

SEQ ID NO: 475795 - protein, 9 aa, Influenza virus
LCIGYHANN

SEQ ID NO: 475796 - protein, 9 aa, Influenza virus
LCKIEGWVV

SEQ ID NO: 475797 - protein, 9 aa, Influenza virus
LCKLNGIPP

SEQ ID NO: 475798 - protein, 9 aa, Influenza virus
LCKVEGWVV

SEQ ID NO: 475799 - protein, 9 aa, Influenza virus
LCLAILIAG

SEQ ID NO: 475800 - protein, 9 aa, Influenza virus
LCLAILVAG

SEQ ID NO: 475801 - protein, 9 aa, Influenza virus
LCLAVLIAG

SEQ ID NO: 475802 - protein, 9 aa, Influenza virus
LCLGHHAVA

SEQ ID NO: 475803 - protein, 9 aa, Influenza virus
LCLGHHAVP

SEQ ID NO: 475804 - protein, 9 aa, Influenza virus
LCLGHHAVQ

SEQ ID NO: 475805 - protein, 9 aa, Influenza virus
LCLGHHAVS

SEQ ID NO: 475806 - protein, 9 aa, Influenza virus
LCLKNGNMR

SEQ ID NO: 475807 - protein, 9 aa, Influenza virus
LCMCSNGSL

SEQ ID NO: 475808 - protein, 9 aa, Influenza virus
LCNPLNPFV

SEQ ID NO: 475809 - protein, 9 aa, Influenza virus
LCNPMNPFV

SEQ ID NO: 475810 - protein, 9 aa, Influenza virus
LCNVEGWVV

SEQ ID NO: 475811 - protein, 9 aa, Influenza virus
LCNVSGFAI

SEQ ID NO: 475812 - protein, 9 aa, Influenza virus
LCPFKGFFP

SEQ ID NO: 475813 - protein, 9 aa, Influenza virus
LCPFQGFFP

SEQ ID NO: 475814 - protein, 9 aa, Influenza virus
LCPFRGFFP

SEQ ID NO: 475815 - protein, 9 aa, Influenza virus
LCPIKGWAP

SEQ ID NO: 475816 - protein, 9 aa, Influenza virus
LCPIRGWAP

SEQ ID NO: 475817 - protein, 9 aa, Influenza virus
LCPKPLKLV

SEQ ID NO: 475818 - protein, 9 aa, Influenza virus
LCPSPLKLI

SEQ ID NO: 475819 - protein, 9 aa, Influenza virus
LCPSPLKLV

SEQ ID NO: 475820 - protein, 9 aa, Influenza virus
LCPSPLRLI

SEQ ID NO: 475821 - protein, 9 aa, Influenza virus
LCPSPLRLV

SEQ ID NO: 475822 - protein, 9 aa, Influenza virus
LCPVKGWAP

SEQ ID NO: 475823 - protein, 9 aa, Influenza virus
LCRLRGIPP

SEQ ID NO: 475824 - protein, 9 aa, Influenza virus
LCRLSGIPP

SEQ ID NO: 475825 - protein, 9 aa, Influenza virus
LCSGLVGDT

SEQ ID NO: 475826 - protein, 9 aa, Influenza virus
LCSIWFSHY

SEQ ID NO: 475827 - protein, 9 aa, Influenza virus
LCSKILTDT

SEQ ID NO: 475828 - protein, 9 aa, Influenza virus
LCSKTLTDT

SEQ ID NO: 475829 - protein, 9 aa, Influenza virus
LCSKVLTDT

SEQ ID NO: 475830 - protein, 9 aa, Influenza virus
LCSRILTDT

SEQ ID NO: 475831 - protein, 9 aa, Influenza virus
LCSRVLTDT

SEQ ID NO: 475832 - protein, 9 aa, Influenza virus
LCSVEGWVV

SEQ ID NO: 475833 - protein, 9 aa, Influenza virus
LCSVEYASK

SEQ ID NO: 475834 - protein, 9 aa, Influenza virus
LCTGILTDT

SEQ ID NO: 475835 - protein, 9 aa, Influenza virus
LCTGVLTDT

SEQ ID NO: 475836 - protein, 9 aa, Influenza virus
LCTINSWHI

SEQ ID NO: 475837 - protein, 9 aa, Influenza virus
LCVGWSSTS

SEQ ID NO: 475838 - protein, 9 aa, Influenza virus
LCYPGELDN

SEQ ID NO: 475839 - protein, 9 aa, Influenza virus
LCYPGELNN

SEQ ID NO: 475840 - protein, 9 aa, Influenza virus
LCYPGEVDN

SEQ ID NO: 475841 - protein, 9 aa, Influenza virus
LCYPGNFND

SEQ ID NO: 475842 - protein, 9 aa, Influenza virus
LCYPGSFND

SEQ ID NO: 475843 - protein, 9 aa, Influenza virus
LCYPGSFNN

SEQ ID NO: 475844 - protein, 9 aa, Influenza virus
LCYPGSLND

SEQ ID NO: 475845 - protein, 9 aa, Influenza virus
LDDCSLEGI

SEQ ID NO: 475846 - protein, 9 aa, Influenza virus
LDDCSLEGL

SEQ ID NO: 475847 - protein, 9 aa, Influenza virus
LDDCSLKGL

SEQ ID NO: 475848 - protein, 9 aa, Influenza virus
LDEESRARI

SEQ ID NO: 475849 - protein, 9 aa, Influenza virus
LDEHDANAN

SEQ ID NO: 475850 - protein, 9 aa, Influenza virus
LDEHDANVH

SEQ ID NO: 475851 - protein, 9 aa, Influenza virus
LDEHDANVN

SEQ ID NO: 475852 - protein, 9 aa, Influenza virus
LDEHDANVR

SEQ ID NO: 475853 - protein, 9 aa, Influenza virus
LDEHDSNVE

SEQ ID NO: 475854 - protein, 9 aa, Influenza virus
LDEHDSNVK

SEQ ID NO: 475855 - protein, 9 aa, Influenza virus
LDEHDSNVN

SEQ ID NO: 475856 - protein, 9 aa, Influenza virus
LDEHVANVN

SEQ ID NO: 475857 - protein, 9 aa, Influenza virus
LDEIGEDIA

SEQ ID NO: 475858 - protein, 9 aa, Influenza virus
LDEIGEDLA

SEQ ID NO: 475859 - protein, 9 aa, Influenza virus
LDEIGEDVA

SEQ ID NO: 475860 - protein, 9 aa, Influenza virus
LDEQNKLYG

SEQ ID NO: 475861 - protein, 9 aa, Influenza virus
LDFHDSNVK

SEQ ID NO: 475862 - protein, 9 aa, Influenza virus
LDFHDSNVR

SEQ ID NO: 475863 - protein, 9 aa, Influenza virus
LDGVKPLIL

SEQ ID NO: 475864 - protein, 9 aa, Influenza virus
LDGVRPLIL

SEQ ID NO: 475865 - protein, 9 aa, Influenza virus
LDGVTASCL

SEQ ID NO: 475866 - protein, 9 aa, Influenza virus
LDGVTASCR

SEQ ID NO: 475867 - protein, 9 aa, Influenza virus
LDIRTATRE

SEQ ID NO: 475868 - protein, 9 aa, Influenza virus
LDIWTYNAE

SEQ ID NO: 475869 - protein, 9 aa, Influenza virus
LDKHDSNVK

SEQ ID NO: 475870 - protein, 9 aa, Influenza virus
LDKICLGHH

SEQ ID NO: 475871 - protein, 9 aa, Influenza virus
LDKKMEDGF

SEQ ID NO: 475872 - protein, 9 aa, Influenza virus
LDLHDANVK

SEQ ID NO: 475873 - protein, 9 aa, Influenza virus
LDLHDANVR

SEQ ID NO: 475874 - protein, 9 aa, Influenza virus
LDLHDSNVK

SEQ ID NO: 475875 - protein, 9 aa, Influenza virus
LDLHDSNVR

SEQ ID NO: 475876 - protein, 9 aa, Influenza virus
LDLNMGQPF

SEQ ID NO: 475877 - protein, 9 aa, Influenza virus
LDMHDANVK

SEQ ID NO: 475878 - protein, 9 aa, Influenza virus
LDMHDANVR

SEQ ID NO: 475879 - protein, 9 aa, Influenza virus
LDMHDVNVK

SEQ ID NO: 475880 - protein, 9 aa, Influenza virus
LDNCHPIGM

SEQ ID NO: 475881 - protein, 9 aa, Influenza virus
LDNEHSNGT

SEQ ID NO: 475882 - protein, 9 aa, Influenza virus
LDNEPGSGK

SEQ ID NO: 475883 - protein, 9 aa, Influenza virus
LDNEPGSGN

SEQ ID NO: 475884 - protein, 9 aa, Influenza virus
LDNKHSNDT

SEQ ID NO: 475885 - protein, 9 aa, Influenza virus
LDNKHSNGT

SEQ ID NO: 475886 - protein, 9 aa, Influenza virus
LDNKNWSGY

SEQ ID NO: 475887 - protein, 9 aa, Influenza virus
LDNLQAYQK

SEQ ID NO: 475888 - protein, 9 aa, Influenza virus
LDNNGELRH

SEQ ID NO: 475889 - protein, 9 aa, Influenza virus
LDPGDTVTF

SEQ ID NO: 475890 - protein, 9 aa, Influenza virus
LDPNDTVTF

SEQ ID NO: 475891 - protein, 9 aa, Influenza virus
LDQHDANVK

SEQ ID NO: 475892 - protein, 9 aa, Influenza virus
LDQNFRNIR

SEQ ID NO: 475893 - protein, 9 aa, Influenza virus
LDRICLGHH

SEQ ID NO: 475894 - protein, 9 aa, Influenza virus
LDRLRRDQK

SEQ ID NO: 475895 - protein, 9 aa, Influenza virus
LDTDWSGYS

SEQ ID NO: 475896 - protein, 9 aa, Influenza virus
LDTGDGCFE

SEQ ID NO: 475897 - protein, 9 aa, Influenza virus
LDTINFEST

SEQ ID NO: 475898 - protein, 9 aa, Influenza virus
LDVWTYNAE

SEQ ID NO: 475899 - protein, 9 aa, Influenza virus
LDVWTYNTE

SEQ ID NO: 475900 - protein, 9 aa, Influenza virus
LDYHDSNVK

SEQ ID NO: 475901 - protein, 9 aa, Influenza virus
LDYQIGYIC

SEQ ID NO: 475902 - protein, 9 aa, Influenza virus
LDYQIGYVC

SEQ ID NO: 475903 - protein, 9 aa, Influenza virus
LEALMEWIK

SEQ ID NO: 475904 - protein, 9 aa, Influenza virus
LEALMEWLK

SEQ ID NO: 475905 - protein, 9 aa, Influenza virus
LEAMAFLED

SEQ ID NO: 475906 - protein, 9 aa, Influenza virus
LEAMAFLEE

SEQ ID NO: 475907 - protein, 9 aa, Influenza virus
LEAMAFLEK

SEQ ID NO: 475908 - protein, 9 aa, Influenza virus
LEAMAFLEN

SEQ ID NO: 475909 - protein, 9 aa, Influenza virus
LEAMALLEE

SEQ ID NO: 475910 - protein, 9 aa, Influenza virus
LECKTFFLT

SEQ ID NO: 475911 - protein, 9 aa, Influenza virus
LECRTFFLT

SEQ ID NO: 475912 - protein, 9 aa, Influenza virus
LEDEQMYQK

SEQ ID NO: 475913 - protein, 9 aa, Influenza virus
LEDEQMYQR

SEQ ID NO: 475914 - protein, 9 aa, Influenza virus
LEDVFAGKN

SEQ ID NO: 475915 - protein, 9 aa, Influenza virus
LEDVFSGKN

SEQ ID NO: 475916 - protein, 9 aa, Influenza virus
LEECSCYMD

SEQ ID NO: 475917 - protein, 9 aa, Influenza virus
LEECSCYTD

SEQ ID NO: 475918 - protein, 9 aa, Influenza virus
LEECSCYVD

SEQ ID NO: 475919 - protein, 9 aa, Influenza virus
LEEESDEAL

SEQ ID NO: 475920 - protein, 9 aa, Influenza virus
LEEHPNAGK

SEQ ID NO: 475921 - protein, 9 aa, Influenza virus
LEEHPSAGK

SEQ ID NO: 475922 - protein, 9 aa, Influenza virus
LEEHPSAGR

SEQ ID NO: 475923 - protein, 9 aa, Influenza virus
LEEHPSTGK

SEQ ID NO: 475924 - protein, 9 aa, Influenza virus
LEELRFVFS

SEQ ID NO: 475925 - protein, 9 aa, Influenza virus
LEENPSAGK

SEQ ID NO: 475926 - protein, 9 aa, Influenza virus
LEENSTYKI

SEQ ID NO: 475927 - protein, 9 aa, Influenza virus
LEENTSYKI

SEQ ID NO: 475928 - protein, 9 aa, Influenza virus
LEENTTYKI

SEQ ID NO: 475929 - protein, 9 aa, Influenza virus
LEENTTYRI

SEQ ID NO: 475930 - protein, 9 aa, Influenza virus
LEESHPGIF

SEQ ID NO: 475931 - protein, 9 aa, Influenza virus
LEESHPGLF

SEQ ID NO: 475932 - protein, 9 aa, Influenza virus
LEFIAEQFT

SEQ ID NO: 475933 - protein, 9 aa, Influenza virus
LEFKADLII

SEQ ID NO: 475934 - protein, 9 aa, Influenza virus
LEGFSAESR

SEQ ID NO: 475935 - protein, 9 aa, Influenza virus
LEGIILGNP

SEQ ID NO: 475936 - protein, 9 aa, Influenza virus
LEGLILGNP

SEQ ID NO: 475937 - protein, 9 aa, Influenza virus
LEGLILSNP

SEQ ID NO: 475938 - protein, 9 aa, Influenza virus
LEGLVLGNP

SEQ ID NO: 475939 - protein, 9 aa, Influenza virus
LEGRIENLN

SEQ ID NO: 475940 - protein, 9 aa, Influenza virus
LEGTTASCQ

SEQ ID NO: 475941 - protein, 9 aa, Influenza virus
LEGVFAGKN

SEQ ID NO: 475942 - protein, 9 aa, Influenza virus
LEGVKPLIL

SEQ ID NO: 475943 - protein, 9 aa, Influenza virus
LEHTSKYVC

SEQ ID NO: 475944 - protein, 9 aa, Influenza virus
LEHTSRYIC

SEQ ID NO: 475945 - protein, 9 aa, Influenza virus
LEHTSRYVC

SEQ ID NO: 475946 - protein, 9 aa, Influenza virus
LEICFMYSD

SEQ ID NO: 475947 - protein, 9 aa, Influenza virus
LEIGARIGE

SEQ ID NO: 475948 - protein, 9 aa, Influenza virus
LEIGTRIGD

SEQ ID NO: 475949 - protein, 9 aa, Influenza virus
LEIGTRIGE

SEQ ID NO: 475950 - protein, 9 aa, Influenza virus
LEIGVTRRE

SEQ ID NO: 475951 - protein, 9 aa, Influenza virus
LEKAHNGKL

SEQ ID NO: 475952 - protein, 9 aa, Influenza virus
LEKANKIKS

SEQ ID NO: 475953 - protein, 9 aa, Influenza virus
LEKANKIKT

SEQ ID NO: 475954 - protein, 9 aa, Influenza virus
LEKASKIKS

SEQ ID NO: 475955 - protein, 9 aa, Influenza virus
LEKNITVTH

SEQ ID NO: 475956 - protein, 9 aa, Influenza virus
LEKNVTVTH

SEQ ID NO: 475957 - protein, 9 aa, Influenza virus
LEKRIENLN

SEQ ID NO: 475958 - protein, 9 aa, Influenza virus
LEKRLENLD

SEQ ID NO: 475959 - protein, 9 aa, Influenza virus
LEKRLENLN

SEQ ID NO: 475960 - protein, 9 aa, Influenza virus
LEKRLGNLN

SEQ ID NO: 475961 - protein, 9 aa, Influenza virus
LEKSHPGIF

SEQ ID NO: 475962 - protein, 9 aa, Influenza virus
LEKSRINGV

SEQ ID NO: 475963 - protein, 9 aa, Influenza virus
LEKTHNGKL

SEQ ID NO: 475964 - protein, 9 aa, Influenza virus
LEKVHNGKL

SEQ ID NO: 475965 - protein, 9 aa, Influenza virus
LEKYVEDTK

SEQ ID NO: 475966 - protein, 9 aa, Influenza virus
LELDEIGED

SEQ ID NO: 475967 - protein, 9 aa, Influenza virus
LELGDCSIA

SEQ ID NO: 475968 - protein, 9 aa, Influenza virus
LELGDCSIT

SEQ ID NO: 475969 - protein, 9 aa, Influenza virus
LELIRGRPQ

SEQ ID NO: 475970 - protein, 9 aa, Influenza virus
LELIRMIKR

SEQ ID NO: 475971 - protein, 9 aa, Influenza virus
LELRDCKIE

SEQ ID NO: 475972 - protein, 9 aa, Influenza virus
LELRDCKVE

SEQ ID NO: 475973 - protein, 9 aa, Influenza virus
LELRDCSIA

SEQ ID NO: 475974 - protein, 9 aa, Influenza virus
LELRSGYWA

SEQ ID NO: 475975 - protein, 9 aa, Influenza virus
LELRSKYWA

SEQ ID NO: 475976 - protein, 9 aa, Influenza virus
LELRSRYWA

SEQ ID NO: 475977 - protein, 9 aa, Influenza virus
LEMCHGTQI

SEQ ID NO: 475978 - protein, 9 aa, Influenza virus
LEMCHSTQI

SEQ ID NO: 475979 - protein, 9 aa, Influenza virus
LEMCHSTRI

SEQ ID NO: 475980 - protein, 9 aa, Influenza virus
LEMIRGKPE

SEQ ID NO: 475981 - protein, 9 aa, Influenza virus
LEMIRGKPK

SEQ ID NO: 475982 - protein, 9 aa, Influenza virus
LEMIRGRPE

SEQ ID NO: 475983 - protein, 9 aa, Influenza virus
LENDKTLDL

SEQ ID NO: 475984 - protein, 9 aa, Influenza virus
LENDKTLDM

SEQ ID NO: 475985 - protein, 9 aa, Influenza virus
LENDKTLNM

SEQ ID NO: 475986 - protein, 9 aa, Influenza virus
LENDRTLDL

SEQ ID NO: 475987 - protein, 9 aa, Influenza virus
LENDVPVTS

SEQ ID NO: 475988 - protein, 9 aa, Influenza virus
LENEKTLDL

SEQ ID NO: 475989 - protein, 9 aa, Influenza virus
LENERTLDF

SEQ ID NO: 475990 - protein, 9 aa, Influenza virus
LENERTLDL

SEQ ID NO: 475991 - protein, 9 aa, Influenza virus
LENERTLDY

SEQ ID NO: 475992 - protein, 9 aa, Influenza virus
LENGRTLDL

SEQ ID NO: 475993 - protein, 9 aa, Influenza virus
LENGRTLGL

SEQ ID NO: 475994 - protein, 9 aa, Influenza virus
LENGVPVTS

SEQ ID NO: 475995 - protein, 9 aa, Influenza virus
LENKHSNGT

SEQ ID NO: 475996 - protein, 9 aa, Influenza virus
LENLDKKME

SEQ ID NO: 475997 - protein, 9 aa, Influenza virus
LENLNKKME

SEQ ID NO: 475998 - protein, 9 aa, Influenza virus
LENLNKKVE

SEQ ID NO: 475999 - protein, 9 aa, Influenza virus
LENLQAYQK

SEQ ID NO: 476000 - protein, 9 aa, Influenza virus
LENLQTYQK

SEQ ID NO: 476001 - protein, 9 aa, Influenza virus
LENLSKRME

SEQ ID NO: 476002 - protein, 9 aa, Influenza virus
LENNVPVTS

SEQ ID NO: 476003 - protein, 9 aa, Influenza virus
LENQHTIDL

SEQ ID NO: 476004 - protein, 9 aa, Influenza virus
LENQHTIDM

SEQ ID NO: 476005 - protein, 9 aa, Influenza virus
LENQHTIDV

SEQ ID NO: 476006 - protein, 9 aa, Influenza virus
LENQHTIHL

SEQ ID NO: 476007 - protein, 9 aa, Influenza virus
LENQKILDE

SEQ ID NO: 476008 - protein, 9 aa, Influenza virus
LENQKPLDE

SEQ ID NO: 476009 - protein, 9 aa, Influenza virus
LENQKTLDE

SEQ ID NO: 476010 - protein, 9 aa, Influenza virus
LENQKTLDK

SEQ ID NO: 476011 - protein, 9 aa, Influenza virus
LENQNTIDL

SEQ ID NO: 476012 - protein, 9 aa, Influenza virus
LENSHPGIF

SEQ ID NO: 476013 - protein, 9 aa, Influenza virus
LENVFAGKN

SEQ ID NO: 476014 - protein, 9 aa, Influenza virus
LENYVEDTK

SEQ ID NO: 476015 - protein, 9 aa, Influenza virus
LEPGTFDIE

SEQ ID NO: 476016 - protein, 9 aa, Influenza virus
LEPGTFDIG

SEQ ID NO: 476017 - protein, 9 aa, Influenza virus
LEPGTFDLE

SEQ ID NO: 476018 - protein, 9 aa, Influenza virus
LEPGTFDLG

SEQ ID NO: 476019 - protein, 9 aa, Influenza virus
LEQNVTVTH

SEQ ID NO: 476020 - protein, 9 aa, Influenza virus
LEQSGLPVG

SEQ ID NO: 476021 - protein, 9 aa, Influenza virus
LERELVRKT

SEQ ID NO: 476022 - protein, 9 aa, Influenza virus
LERNVTVTH

SEQ ID NO: 476023 - protein, 9 aa, Influenza virus
LERRIENLN

SEQ ID NO: 476024 - protein, 9 aa, Influenza virus
LERRIESLN

SEQ ID NO: 476025 - protein, 9 aa, Influenza virus
LERRLENLN

SEQ ID NO: 476026 - protein, 9 aa, Influenza virus
LERRLENLS

SEQ ID NO: 476027 - protein, 9 aa, Influenza virus
LERSKINEV

SEQ ID NO: 476028 - protein, 9 aa, Influenza virus
LERSKINGV

SEQ ID NO: 476029 - protein, 9 aa, Influenza virus
LERTHNGKL

SEQ ID NO: 476030 - protein, 9 aa, Influenza virus
LERYVEDTK

SEQ ID NO: 476031 - protein, 9 aa, Influenza virus
LESDVPVTS

SEQ ID NO: 476032 - protein, 9 aa, Influenza virus
LESRSGFEM

SEQ ID NO: 476033 - protein, 9 aa, Influenza virus
LESVFAGKN

SEQ ID NO: 476034 - protein, 9 aa, Influenza virus
LETGYICSK

SEQ ID NO: 476035 - protein, 9 aa, Influenza virus
LETGYVCGK

SEQ ID NO: 476036 - protein, 9 aa, Influenza virus
LETGYVCSK

SEQ ID NO: 476037 - protein, 9 aa, Influenza virus
LEVCFMYSD

SEQ ID NO: 476038 - protein, 9 aa, Influenza virus
LEVGTRWMK

SEQ ID NO: 476039 - protein, 9 aa, Influenza virus
LFALSGVAI

SEQ ID NO: 476040 - protein, 9 aa, Influenza virus
LFALSGVAV

SEQ ID NO: 476041 - protein, 9 aa, Influenza virus
LFASSGIAI

SEQ ID NO: 476042 - protein, 9 aa, Influenza virus
LFDEVKRRL

SEQ ID NO: 476043 - protein, 9 aa, Influenza virus
LFDEVRRRL

SEQ ID NO: 476044 - protein, 9 aa, Influenza virus
LFDYSGWNV

SEQ ID NO: 476045 - protein, 9 aa, Influenza virus
LFDYSKWNV

SEQ ID NO: 476046 - protein, 9 aa, Influenza virus
LFDYSRWNV

SEQ ID NO: 476047 - protein, 9 aa, Influenza virus
LFEKFFPSS

SEQ ID NO: 476048 - protein, 9 aa, Influenza virus
LFENSCLET

SEQ ID NO: 476049 - protein, 9 aa, Influenza virus
LFERVKRQL

SEQ ID NO: 476050 - protein, 9 aa, Influenza virus
LFERVRHQL

SEQ ID NO: 476051 - protein, 9 aa, Influenza virus
LFERVRRQL

SEQ ID NO: 476052 - protein, 9 aa, Influenza virus
LFFFCLKNG

SEQ ID NO: 476053 - protein, 9 aa, Influenza virus
LFFWMCSNG

SEQ ID NO: 476054 - protein, 9 aa, Influenza virus
LFGAIAGFI

SEQ ID NO: 476055 - protein, 9 aa, Influenza virus
LFGAIAGFL

SEQ ID NO: 476056 - protein, 9 aa, Influenza virus
LFGAKAGFI

SEQ ID NO: 476057 - protein, 9 aa, Influenza virus
LFHKCDDDC

SEQ ID NO: 476058 - protein, 9 aa, Influenza virus
LFIKDYRYT

SEQ ID NO: 476059 - protein, 9 aa, Influenza virus
LFLAFILWA

SEQ ID NO: 476060 - protein, 9 aa, Influenza virus
LFLVCVSLL

SEQ ID NO: 476061 - protein, 9 aa, Influenza virus
LFLWMCSNG

SEQ ID NO: 476062 - protein, 9 aa, Influenza virus
LFLYVRTNG

SEQ ID NO: 476063 - protein, 9 aa, Influenza virus
LFMIIGGFI

SEQ ID NO: 476064 - protein, 9 aa, Influenza virus
LFNTIGNLI

SEQ ID NO: 476065 - protein, 9 aa, Influenza virus
LFQDILMRM

SEQ ID NO: 476066 - protein, 9 aa, Influenza virus
LFQGGHIEE

SEQ ID NO: 476067 - protein, 9 aa, Influenza virus
LFQQMRDIL

SEQ ID NO: 476068 - protein, 9 aa, Influenza virus
LFQQMRDVL

SEQ ID NO: 476069 - protein, 9 aa, Influenza virus
LFSGIKSFS

SEQ ID NO: 476070 - protein, 9 aa, Influenza virus
LFSGIRSFS

SEQ ID NO: 476071 - protein, 9 aa, Influenza virus
LFSGVNSFS

SEQ ID NO: 476072 - protein, 9 aa, Influenza virus
LFSGYKDII

SEQ ID NO: 476073 - protein, 9 aa, Influenza virus
LFSSIKKYE

SEQ ID NO: 476074 - protein, 9 aa, Influenza virus
LFSSIKRYE

SEQ ID NO: 476075 - protein, 9 aa, Influenza virus
LFTIRQELA

SEQ ID NO: 476076 - protein, 9 aa, Influenza virus
LFTIRQEMA

SEQ ID NO: 476077 - protein, 9 aa, Influenza virus
LFTLSGVAI

SEQ ID NO: 476078 - protein, 9 aa, Influenza virus
LFVLMENER

SEQ ID NO: 476079 - protein, 9 aa, Influenza virus
LFVQSYFQL

SEQ ID NO: 476080 - protein, 9 aa, Influenza virus
LGAIAGFIE

SEQ ID NO: 476081 - protein, 9 aa, Influenza virus
LGAINSSMP

SEQ ID NO: 476082 - protein, 9 aa, Influenza virus
LGAINTTLP

SEQ ID NO: 476083 - protein, 9 aa, Influenza virus
LGAISFWMC

SEQ ID NO: 476084 - protein, 9 aa, Influenza virus
LGALNTTLP

SEQ ID NO: 476085 - protein, 9 aa, Influenza virus
LGAPLELRD

SEQ ID NO: 476086 - protein, 9 aa, Influenza virus
LGAPLVLDD

SEQ ID NO: 476087 - protein, 9 aa, Influenza virus
LGCKMYALH

SEQ ID NO: 476088 - protein, 9 aa, Influenza virus
LGCKTYALH

SEQ ID NO: 476089 - protein, 9 aa, Influenza virus
LGCRMYALH

SEQ ID NO: 476090 - protein, 9 aa, Influenza virus
LGDAPFLDR

SEQ ID NO: 476091 - protein, 9 aa, Influenza virus
LGDCNFEGW

SEQ ID NO: 476092 - protein, 9 aa, Influenza virus
LGDCPKYIK

SEQ ID NO: 476093 - protein, 9 aa, Influenza virus
LGDCRFEGW

SEQ ID NO: 476094 - protein, 9 aa, Influenza virus
LGDCSFAGW

SEQ ID NO: 476095 - protein, 9 aa, Influenza virus
LGDCSFEGW

SEQ ID NO: 476096 - protein, 9 aa, Influenza virus
LGDCSIAGW

SEQ ID NO: 476097 - protein, 9 aa, Influenza virus
LGDCSITGW

SEQ ID NO: 476098 - protein, 9 aa, Influenza virus
LGDCSVAGW

SEQ ID NO: 476099 - protein, 9 aa, Influenza virus
LGEAPSPYN

SEQ ID NO: 476100 - protein, 9 aa, Influenza virus
LGECPKYIK

SEQ ID NO: 476101 - protein, 9 aa, Influenza virus
LGENMAPEK

SEQ ID NO: 476102 - protein, 9 aa, Influenza virus
LGFHDSNVK

SEQ ID NO: 476103 - protein, 9 aa, Influenza virus
LGFIMWACQ

SEQ ID NO: 476104 - protein, 9 aa, Influenza virus
LGFIMWTCQ

SEQ ID NO: 476105 - protein, 9 aa, Influenza virus
LGFIVWACQ

SEQ ID NO: 476106 - protein, 9 aa, Influenza virus
LGFVFTLTV

SEQ ID NO: 476107 - protein, 9 aa, Influenza virus
LGFVLWACQ

SEQ ID NO: 476108 - protein, 9 aa, Influenza virus
LGFVMWACQ

SEQ ID NO: 476109 - protein, 9 aa, Influenza virus
LGGCSFAGW

SEQ ID NO: 476110 - protein, 9 aa, Influenza virus
LGGTISPRS

SEQ ID NO: 476111 - protein, 9 aa, Influenza virus
LGHHAIPNG

SEQ ID NO: 476112 - protein, 9 aa, Influenza virus
LGHHAVANG

SEQ ID NO: 476113 - protein, 9 aa, Influenza virus
LGHHAVENG

SEQ ID NO: 476114 - protein, 9 aa, Influenza virus
LGHHAVPNG

SEQ ID NO: 476115 - protein, 9 aa, Influenza virus
LGHHAVQNG

SEQ ID NO: 476116 - protein, 9 aa, Influenza virus
LGHHAVSNG

SEQ ID NO: 476117 - protein, 9 aa, Influenza virus
LGHHAVTNG

SEQ ID NO: 476118 - protein, 9 aa, Influenza virus
LGIINLLIG

SEQ ID NO: 476119 - protein, 9 aa, Influenza virus
LGIITGPPQ

SEQ ID NO: 476120 - protein, 9 aa, Influenza virus
LGILTGPPQ

SEQ ID NO: 476121 - protein, 9 aa, Influenza virus
LGINMSKKK

SEQ ID NO: 476122 - protein, 9 aa, Influenza virus
LGIPFHLGT

SEQ ID NO: 476123 - protein, 9 aa, Influenza virus
LGIQSDAQI

SEQ ID NO: 476124 - protein, 9 aa, Influenza virus
LGITGPDAT

SEQ ID NO: 476125 - protein, 9 aa, Influenza virus
LGITGPDST

SEQ ID NO: 476126 - protein, 9 aa, Influenza virus
LGITGPDTT

SEQ ID NO: 476127 - protein, 9 aa, Influenza virus
LGIVECVCR

SEQ ID NO: 476128 - protein, 9 aa, Influenza virus
LGIYQILAI

SEQ ID NO: 476129 - protein, 9 aa, Influenza virus
LGKCPRYVK

SEQ ID NO: 476130 - protein, 9 aa, Influenza virus
LGKGYMFES

SEQ ID NO: 476131 - protein, 9 aa, Influenza virus
LGKVECVCR

SEQ ID NO: 476132 - protein, 9 aa, Influenza virus
LGLDIRTAT

SEQ ID NO: 476133 - protein, 9 aa, Influenza virus
LGLHDANVR

SEQ ID NO: 476134 - protein, 9 aa, Influenza virus
LGLNIGLHL

SEQ ID NO: 476135 - protein, 9 aa, Influenza virus
LGLNVGLHL

SEQ ID NO: 476136 - protein, 9 aa, Influenza virus
LGLRISSSF

SEQ ID NO: 476137 - protein, 9 aa, Influenza virus
LGLRNTPSI

SEQ ID NO: 476138 - protein, 9 aa, Influenza virus
LGLSMVKSD

SEQ ID NO: 476139 - protein, 9 aa, Influenza virus
LGLSMVRSD

SEQ ID NO: 476140 - protein, 9 aa, Influenza virus
LGLVCATCE

SEQ ID NO: 476141 - protein, 9 aa, Influenza virus
LGMKNVPEK

SEQ ID NO: 476142 - protein, 9 aa, Influenza virus
LGMQNGSCR

SEQ ID NO: 476143 - protein, 9 aa, Influenza virus
LGMQNGSYR

SEQ ID NO: 476144 - protein, 9 aa, Influenza virus
LGNCHPIGI

SEQ ID NO: 476145 - protein, 9 aa, Influenza virus
LGNCHPIGM

SEQ ID NO: 476146 - protein, 9 aa, Influenza virus
LGNCHPVGM

SEQ ID NO: 476147 - protein, 9 aa, Influenza virus
LGNCPKYIK

SEQ ID NO: 476148 - protein, 9 aa, Influenza virus
LGNGCFEFW

SEQ ID NO: 476149 - protein, 9 aa, Influenza virus
LGNGCFEFY

SEQ ID NO: 476150 - protein, 9 aa, Influenza virus
LGNILLSPE

SEQ ID NO: 476151 - protein, 9 aa, Influenza virus
LGNLNKKME

SEQ ID NO: 476152 - protein, 9 aa, Influenza virus
LGNPECDIL

SEQ ID NO: 476153 - protein, 9 aa, Influenza virus
LGNPECDLF

SEQ ID NO: 476154 - protein, 9 aa, Influenza virus
LGNPECDLL

SEQ ID NO: 476155 - protein, 9 aa, Influenza virus
LGNPECDRL

SEQ ID NO: 476156 - protein, 9 aa, Influenza virus
LGNPKCDLY

SEQ ID NO: 476157 - protein, 9 aa, Influenza virus
LGNPKCDPY

SEQ ID NO: 476158 - protein, 9 aa, Influenza virus
LGNPKCDRL

SEQ ID NO: 476159 - protein, 9 aa, Influenza virus
LGNPLCDEF

SEQ ID NO: 476160 - protein, 9 aa, Influenza virus
LGNPMCDDL

SEQ ID NO: 476161 - protein, 9 aa, Influenza virus
LGNPMCDEF

SEQ ID NO: 476162 - protein, 9 aa, Influenza virus
LGNPMCDEL

SEQ ID NO: 476163 - protein, 9 aa, Influenza virus
LGNPMCDKF

SEQ ID NO: 476164 - protein, 9 aa, Influenza virus
LGNPMCDNL

SEQ ID NO: 476165 - protein, 9 aa, Influenza virus
LGNPMCDYL

SEQ ID NO: 476166 - protein, 9 aa, Influenza virus
LGNPRCDDL

SEQ ID NO: 476167 - protein, 9 aa, Influenza virus
LGNPTCDEF

SEQ ID NO: 476168 - protein, 9 aa, Influenza virus
LGNQKTLDE

SEQ ID NO: 476169 - protein, 9 aa, Influenza virus
LGNVINWTR

SEQ ID NO: 476170 - protein, 9 aa, Influenza virus
LGNYKEICI

SEQ ID NO: 476171 - protein, 9 aa, Influenza virus
LGNYKEICV

SEQ ID NO: 476172 - protein, 9 aa, Influenza virus
LGNYKEMCA

SEQ ID NO: 476173 - protein, 9 aa, Influenza virus
LGNYREICI

SEQ ID NO: 476174 - protein, 9 aa, Influenza virus
LGNYREVCI

SEQ ID NO: 476175 - protein, 9 aa, Influenza virus
LGPATAQMA

SEQ ID NO: 476176 - protein, 9 aa, Influenza virus
LGQCGFLGT

SEQ ID NO: 476177 - protein, 9 aa, Influenza virus
LGQCGILGI

SEQ ID NO: 476178 - protein, 9 aa, Influenza virus
LGQCGLLGI

SEQ ID NO: 476179 - protein, 9 aa, Influenza virus
LGQCGLLGT

SEQ ID NO: 476180 - protein, 9 aa, Influenza virus
LGQFPVQTD

SEQ ID NO: 476181 - protein, 9 aa, Influenza virus
LGQGTPLNN

SEQ ID NO: 476182 - protein, 9 aa, Influenza virus
LGQGTTLDH

SEQ ID NO: 476183 - protein, 9 aa, Influenza virus
LGQGTTLDN

SEQ ID NO: 476184 - protein, 9 aa, Influenza virus
LGQGTTLDS

SEQ ID NO: 476185 - protein, 9 aa, Influenza virus
LGQGTTLEN

SEQ ID NO: 476186 - protein, 9 aa, Influenza virus
LGQGTTLKN

SEQ ID NO: 476187 - protein, 9 aa, Influenza virus
LGQGTTLNN

SEQ ID NO: 476188 - protein, 9 aa, Influenza virus
LGQGTTLSN

SEQ ID NO: 476189 - protein, 9 aa, Influenza virus
LGQGTTLYN

SEQ ID NO: 476190 - protein, 9 aa, Influenza virus
LGQVECVCR

SEQ ID NO: 476191 - protein, 9 aa, Influenza virus
LGQWDWPDG

SEQ ID NO: 476192 - protein, 9 aa, Influenza virus
LGQWNWPDG

SEQ ID NO: 476193 - protein, 9 aa, Influenza virus
LGRCGLLGT

SEQ ID NO: 476194 - protein, 9 aa, Influenza virus
LGRGYMFES

SEQ ID NO: 476195 - protein, 9 aa, Influenza virus
LGRTISIAS

SEQ ID NO: 476196 - protein, 9 aa, Influenza virus
LGRTISKDL

SEQ ID NO: 476197 - protein, 9 aa, Influenza virus
LGRTISKDS

SEQ ID NO: 476198 - protein, 9 aa, Influenza virus
LGRTISKDT

SEQ ID NO: 476199 - protein, 9 aa, Influenza virus
LGRTISPHS

SEQ ID NO: 476200 - protein, 9 aa, Influenza virus
LGRTISPKL

SEQ ID NO: 476201 - protein, 9 aa, Influenza virus
LGRTISPRL

SEQ ID NO: 476202 - protein, 9 aa, Influenza virus
LGRTISPRS

SEQ ID NO: 476203 - protein, 9 aa, Influenza virus
LGRTISTAS

SEQ ID NO: 476204 - protein, 9 aa, Influenza virus
LGRTTSKDS

SEQ ID NO: 476205 - protein, 9 aa, Influenza virus
LGRTTSTAS

SEQ ID NO: 476206 - protein, 9 aa, Influenza virus
LGRTVSING

SEQ ID NO: 476207 - protein, 9 aa, Influenza virus
LGRTVSISG

SEQ ID NO: 476208 - protein, 9 aa, Influenza virus
LGRTVSNSG

SEQ ID NO: 476209 - protein, 9 aa, Influenza virus
LGRTVSTSG

SEQ ID NO: 476210 - protein, 9 aa, Influenza virus
LGSAQHVEE

SEQ ID NO: 476211 - protein, 9 aa, Influenza virus
LGSCGILGT

SEQ ID NO: 476212 - protein, 9 aa, Influenza virus
LGSCHPIGM

SEQ ID NO: 476213 - protein, 9 aa, Influenza virus
LGSPGCDHL

SEQ ID NO: 476214 - protein, 9 aa, Influenza virus
LGSPGCDRL

SEQ ID NO: 476215 - protein, 9 aa, Influenza virus
LGSPLELRD

SEQ ID NO: 476216 - protein, 9 aa, Influenza virus
LGSPLVLDD

SEQ ID NO: 476217 - protein, 9 aa, Influenza virus
LGSPPIVSN

SEQ ID NO: 476218 - protein, 9 aa, Influenza virus
LGSPPMVSN

SEQ ID NO: 476219 - protein, 9 aa, Influenza virus
LGSPPVVSN

SEQ ID NO: 476220 - protein, 9 aa, Influenza virus
LGSSFYAEM

SEQ ID NO: 476221 - protein, 9 aa, Influenza virus
LGSSPNAYQ

SEQ ID NO: 476222 - protein, 9 aa, Influenza virus
LGSWSWHDG

SEQ ID NO: 476223 - protein, 9 aa, Influenza virus
LGTIIGPPQ

SEQ ID NO: 476224 - protein, 9 aa, Influenza virus
LGTITGPPQ

SEQ ID NO: 476225 - protein, 9 aa, Influenza virus
LGTKHSNGT

SEQ ID NO: 476226 - protein, 9 aa, Influenza virus
LGTKQVCAA

SEQ ID NO: 476227 - protein, 9 aa, Influenza virus
LGTKQVCIA

SEQ ID NO: 476228 - protein, 9 aa, Influenza virus
LGTKQVCMA

SEQ ID NO: 476229 - protein, 9 aa, Influenza virus
LGTKQVCVA

SEQ ID NO: 476230 - protein, 9 aa, Influenza virus
LGTLIGPPQ

SEQ ID NO: 476231 - protein, 9 aa, Influenza virus
LGTNHSNGT

SEQ ID NO: 476232 - protein, 9 aa, Influenza virus
LGTPLELRD

SEQ ID NO: 476233 - protein, 9 aa, Influenza virus
LGTPPTVSN

SEQ ID NO: 476234 - protein, 9 aa, Influenza virus
LGTRHSNGT

SEQ ID NO: 476235 - protein, 9 aa, Influenza virus
LGTRQVCIA

SEQ ID NO: 476236 - protein, 9 aa, Influenza virus
LGTRQVCMA

SEQ ID NO: 476237 - protein, 9 aa, Influenza virus
LGTRQVCVA

SEQ ID NO: 476238 - protein, 9 aa, Influenza virus
LGTVTGPPQ

SEQ ID NO: 476239 - protein, 9 aa, Influenza virus
LGVKGFGFK

SEQ ID NO: 476240 - protein, 9 aa, Influenza virus
LGVPFHLAT

SEQ ID NO: 476241 - protein, 9 aa, Influenza virus
LGVPFHLGT

SEQ ID NO: 476242 - protein, 9 aa, Influenza virus
LGVPFYLGT

SEQ ID NO: 476243 - protein, 9 aa, Influenza virus
LGVSFHLGT

SEQ ID NO: 476244 - protein, 9 aa, Influenza virus
LGVSILNLG

SEQ ID NO: 476245 - protein, 9 aa, Influenza virus
LGVSVLNLG

SEQ ID NO: 476246 - protein, 9 aa, Influenza virus
LGVWTYNAE

SEQ ID NO: 476247 - protein, 9 aa, Influenza virus
LGVYQILAI

SEQ ID NO: 476248 - protein, 9 aa, Influenza virus
LGYETFKVI

SEQ ID NO: 476249 - protein, 9 aa, Influenza virus
LGYETFKVV

SEQ ID NO: 476250 - protein, 9 aa, Influenza virus
LGYGVKGFG

SEQ ID NO: 476251 - protein, 9 aa, Influenza virus
LGYSTGALA

SEQ ID NO: 476252 - protein, 9 aa, Influenza virus
LHAYISFRN

SEQ ID NO: 476253 - protein, 9 aa, Influenza virus
LHDANVKNL

SEQ ID NO: 476254 - protein, 9 aa, Influenza virus
LHDANVRNL

SEQ ID NO: 476255 - protein, 9 aa, Influenza virus
LHDSNVKNL

SEQ ID NO: 476256 - protein, 9 aa, Influenza virus
LHDSNVRNL

SEQ ID NO: 476257 - protein, 9 aa, Influenza virus
LHDSNVRSL

SEQ ID NO: 476258 - protein, 9 aa, Influenza virus
LHEKIRRML

SEQ ID NO: 476259 - protein, 9 aa, Influenza virus
LHEKVRQML

SEQ ID NO: 476260 - protein, 9 aa, Influenza virus
LHEKVRRIL

SEQ ID NO: 476261 - protein, 9 aa, Influenza virus
LHEKVRRML

SEQ ID NO: 476262 - protein, 9 aa, Influenza virus
LHERVRRML

SEQ ID NO: 476263 - protein, 9 aa, Influenza virus
LHFKQHDCD

SEQ ID NO: 476264 - protein, 9 aa, Influenza virus
LHFKQHECD

SEQ ID NO: 476265 - protein, 9 aa, Influenza virus
LHFKQHECN

SEQ ID NO: 476266 - protein, 9 aa, Influenza virus
LHFKQHKCD

SEQ ID NO: 476267 - protein, 9 aa, Influenza virus
LHFKQNECS

SEQ ID NO: 476268 - protein, 9 aa, Influenza virus
LHICVTGDD

SEQ ID NO: 476269 - protein, 9 aa, Influenza virus
LHIPEAGLK

SEQ ID NO: 476270 - protein, 9 aa, Influenza virus
LHIPEVCLK

SEQ ID NO: 476271 - protein, 9 aa, Influenza virus
LHKCDNECM

SEQ ID NO: 476272 - protein, 9 aa, Influenza virus
LHKCDNKCM

SEQ ID NO: 476273 - protein, 9 aa, Influenza virus
LHKCNDSCM

SEQ ID NO: 476274 - protein, 9 aa, Influenza virus
LHKCNNECM

SEQ ID NO: 476275 - protein, 9 aa, Influenza virus
LHKCNNSCM

SEQ ID NO: 476276 - protein, 9 aa, Influenza virus
LHKCNNTCM

SEQ ID NO: 476277 - protein, 9 aa, Influenza virus
LHLEFKADL

SEQ ID NO: 476278 - protein, 9 aa, Influenza virus
LHLTGKWDT

SEQ ID NO: 476279 - protein, 9 aa, Influenza virus
LHLTGMWDT

SEQ ID NO: 476280 - protein, 9 aa, Influenza virus
LHLTGTWDT

SEQ ID NO: 476281 - protein, 9 aa, Influenza virus
LHLTQGACW

SEQ ID NO: 476282 - protein, 9 aa, Influenza virus
LHLTQGTCW

SEQ ID NO: 476283 - protein, 9 aa, Influenza virus
LHNGGLIAP

SEQ ID NO: 476284 - protein, 9 aa, Influenza virus
LHNIHPLTI

SEQ ID NO: 476285 - protein, 9 aa, Influenza virus
LHQGTTIRN

SEQ ID NO: 476286 - protein, 9 aa, Influenza virus
LHVCITGDD

SEQ ID NO: 476287 - protein, 9 aa, Influenza virus
LHVCVTGDD

SEQ ID NO: 476288 - protein, 9 aa, Influenza virus
LIAFVLWAC

SEQ ID NO: 476289 - protein, 9 aa, Influenza virus
LIAGGLILG

SEQ ID NO: 476290 - protein, 9 aa, Influenza virus
LIAGWYGFQ

SEQ ID NO: 476291 - protein, 9 aa, Influenza virus
LIALCGSPF

SEQ ID NO: 476292 - protein, 9 aa, Influenza virus
LIALCGSPI

SEQ ID NO: 476293 - protein, 9 aa, Influenza virus
LIALCGSPV

SEQ ID NO: 476294 - protein, 9 aa, Influenza virus
LIAMENQHT

SEQ ID NO: 476295 - protein, 9 aa, Influenza virus
LIAPEFGYL

SEQ ID NO: 476296 - protein, 9 aa, Influenza virus
LIAPEYGFK

SEQ ID NO: 476297 - protein, 9 aa, Influenza virus
LIAPEYGFR

SEQ ID NO: 476298 - protein, 9 aa, Influenza virus
LIAPEYGHL

SEQ ID NO: 476299 - protein, 9 aa, Influenza virus
LIAPEYGYL

SEQ ID NO: 476300 - protein, 9 aa, Influenza virus
LIAPRGHYK

SEQ ID NO: 476301 - protein, 9 aa, Influenza virus
LIAPRGHYR

SEQ ID NO: 476302 - protein, 9 aa, Influenza virus
LIAPRGYFK

SEQ ID NO: 476303 - protein, 9 aa, Influenza virus
LIAPRGYFR

SEQ ID NO: 476304 - protein, 9 aa, Influenza virus
LIAPRGYYK

SEQ ID NO: 476305 - protein, 9 aa, Influenza virus
LIAPRYGYI

SEQ ID NO: 476306 - protein, 9 aa, Influenza virus
LIAPSRVSK

SEQ ID NO: 476307 - protein, 9 aa, Influenza virus
LIAPSRVTK

SEQ ID NO: 476308 - protein, 9 aa, Influenza virus
LIAPWYAFR

SEQ ID NO: 476309 - protein, 9 aa, Influenza virus
LIAPWYAYK

SEQ ID NO: 476310 - protein, 9 aa, Influenza virus
LIAPWYAYR

SEQ ID NO: 476311 - protein, 9 aa, Influenza virus
LIASSGTLE

SEQ ID NO: 476312 - protein, 9 aa, Influenza virus
LICATCEQI

SEQ ID NO: 476313 - protein, 9 aa, Influenza virus
LIDALLGDP

SEQ ID NO: 476314 - protein, 9 aa, Influenza virus
LIDAMLGDP

SEQ ID NO: 476315 - protein, 9 aa, Influenza virus
LIDFLKDVI

SEQ ID NO: 476316 - protein, 9 aa, Influenza virus
LIDFLKDVM

SEQ ID NO: 476317 - protein, 9 aa, Influenza virus
LIDFLKDVT

SEQ ID NO: 476318 - protein, 9 aa, Influenza virus
LIDFLKDVV

SEQ ID NO: 476319 - protein, 9 aa, Influenza virus
LIDGWYGFK

SEQ ID NO: 476320 - protein, 9 aa, Influenza virus
LIDGWYGFR

SEQ ID NO: 476321 - protein, 9 aa, Influenza virus
LIDGWYGYH

SEQ ID NO: 476322 - protein, 9 aa, Influenza virus
LIDGWYGYK

SEQ ID NO: 476323 - protein, 9 aa, Influenza virus
LIDGWYGYR

SEQ ID NO: 476324 - protein, 9 aa, Influenza virus
LIDKTNQQF

SEQ ID NO: 476325 - protein, 9 aa, Influenza virus
LIDNEFTEV

SEQ ID NO: 476326 - protein, 9 aa, Influenza virus
LIDQSGTYP

SEQ ID NO: 476327 - protein, 9 aa, Influenza virus
LIDRTNHQF

SEQ ID NO: 476328 - protein, 9 aa, Influenza virus
LIDSIGSWS

SEQ ID NO: 476329 - protein, 9 aa, Influenza virus
LIEDPAAPH

SEQ ID NO: 476330 - protein, 9 aa, Influenza virus
LIEDPGAPH

SEQ ID NO: 476331 - protein, 9 aa, Influenza virus
LIEDPNAPH

SEQ ID NO: 476332 - protein, 9 aa, Influenza virus
LIEDPNAPN

SEQ ID NO: 476333 - protein, 9 aa, Influenza virus
LIEDPSAPH

SEQ ID NO: 476334 - protein, 9 aa, Influenza virus
LIEDPTAPH

SEQ ID NO: 476335 - protein, 9 aa, Influenza virus
LIEKTNDKY

SEQ ID NO: 476336 - protein, 9 aa, Influenza virus
LIEKTNEKY

SEQ ID NO: 476337 - protein, 9 aa, Influenza virus
LIEKTNKQF

SEQ ID NO: 476338 - protein, 9 aa, Influenza virus
LIEKTNQQF

SEQ ID NO: 476339 - protein, 9 aa, Influenza virus
LIEKTNTEF

SEQ ID NO: 476340 - protein, 9 aa, Influenza virus
LIEKTNTQF

SEQ ID NO: 476341 - protein, 9 aa, Influenza virus
LIEKTSWSY

SEQ ID NO: 476342 - protein, 9 aa, Influenza virus
LIENDRTLD

SEQ ID NO: 476343 - protein, 9 aa, Influenza virus
LIENERTLD

SEQ ID NO: 476344 - protein, 9 aa, Influenza virus
LIENLQAYQ

SEQ ID NO: 476345 - protein, 9 aa, Influenza virus
LIENQKTLD

SEQ ID NO: 476346 - protein, 9 aa, Influenza virus
LIENTYVNN

SEQ ID NO: 476347 - protein, 9 aa, Influenza virus
LIEQKVPVT

SEQ ID NO: 476348 - protein, 9 aa, Influenza virus
LIEQNIPVT

SEQ ID NO: 476349 - protein, 9 aa, Influenza virus
LIEQNVPVT

SEQ ID NO: 476350 - protein, 9 aa, Influenza virus
LIERTNEKY

SEQ ID NO: 476351 - protein, 9 aa, Influenza virus
LIERTNQQF

SEQ ID NO: 476352 - protein, 9 aa, Influenza virus
LIETNHTGT

SEQ ID NO: 476353 - protein, 9 aa, Influenza virus
LIETTHTGT

SEQ ID NO: 476354 - protein, 9 aa, Influenza virus
LIFLARSAL

SEQ ID NO: 476355 - protein, 9 aa, Influenza virus
LIFMARSAL

SEQ ID NO: 476356 - protein, 9 aa, Influenza virus
LIFMCVKNG

SEQ ID NO: 476357 - protein, 9 aa, Influenza virus
LIFNTVIHE

SEQ ID NO: 476358 - protein, 9 aa, Influenza virus
LIFNTVIHG

SEQ ID NO: 476359 - protein, 9 aa, Influenza virus
LIFSARSAL

SEQ ID NO: 476360 - protein, 9 aa, Influenza virus
LIGISNIGL

SEQ ID NO: 476361 - protein, 9 aa, Influenza virus
LIGISNMSL

SEQ ID NO: 476362 - protein, 9 aa, Influenza virus
LIGISNVGL

SEQ ID NO: 476363 - protein, 9 aa, Influenza virus
LIGISNVVL

SEQ ID NO: 476364 - protein, 9 aa, Influenza virus
LIGKTNQQF

SEQ ID NO: 476365 - protein, 9 aa, Influenza virus
LIGKTSWSY

SEQ ID NO: 476366 - protein, 9 aa, Influenza virus
LIGQGDIVL

SEQ ID NO: 476367 - protein, 9 aa, Influenza virus
LIGQGDVVL

SEQ ID NO: 476368 - protein, 9 aa, Influenza virus
LIGVSNVGL

SEQ ID NO: 476369 - protein, 9 aa, Influenza virus
LIHQSETYP

SEQ ID NO: 476370 - protein, 9 aa, Influenza virus
LIHQSGTYP

SEQ ID NO: 476371 - protein, 9 aa, Influenza virus
LIIAARNIV

SEQ ID NO: 476372 - protein, 9 aa, Influenza virus
LIIAARSIV

SEQ ID NO: 476373 - protein, 9 aa, Influenza virus
LIIERKEGT

SEQ ID NO: 476374 - protein, 9 aa, Influenza virus
LIIERREGA

SEQ ID NO: 476375 - protein, 9 aa, Influenza virus
LIIERREGN

SEQ ID NO: 476376 - protein, 9 aa, Influenza virus
LIIERREGS

SEQ ID NO: 476377 - protein, 9 aa, Influenza virus
LIIERREGT

SEQ ID NO: 476378 - protein, 9 aa, Influenza virus
LIIERRNSS

SEQ ID NO: 476379 - protein, 9 aa, Influenza virus
LIIGISNVG

SEQ ID NO: 476380 - protein, 9 aa, Influenza virus
LIISPDLSY

SEQ ID NO: 476381 - protein, 9 aa, Influenza virus
LIIWGIHHP

SEQ ID NO: 476382 - protein, 9 aa, Influenza virus
LIIWGIHHS

SEQ ID NO: 476383 - protein, 9 aa, Influenza virus
LIIWGVHHP

SEQ ID NO: 476384 - protein, 9 aa, Influenza virus
LIIWGVHHS

SEQ ID NO: 476385 - protein, 9 aa, Influenza virus
LIKHENRMV

SEQ ID NO: 476386 - protein, 9 aa, Influenza virus
LILAAIIMG

SEQ ID NO: 476387 - protein, 9 aa, Influenza virus
LILAFILWA

SEQ ID NO: 476388 - protein, 9 aa, Influenza virus
LILAFIMWA

SEQ ID NO: 476389 - protein, 9 aa, Influenza virus
LILAFIMWT

SEQ ID NO: 476390 - protein, 9 aa, Influenza virus
LILATGLRN

SEQ ID NO: 476391 - protein, 9 aa, Influenza virus
LILATGVRN

SEQ ID NO: 476392 - protein, 9 aa, Influenza virus
LILFNTIGN

SEQ ID NO: 476393 - protein, 9 aa, Influenza virus
LILGFVLWA

SEQ ID NO: 476394 - protein, 9 aa, Influenza virus
LILGMQNGS

SEQ ID NO: 476395 - protein, 9 aa, Influenza virus
LILGNPKCD

SEQ ID NO: 476396 - protein, 9 aa, Influenza virus
LILKDCSIA

SEQ ID NO: 476397 - protein, 9 aa, Influenza virus
LILKDCSVA

SEQ ID NO: 476398 - protein, 9 aa, Influenza virus
LILLENERT

SEQ ID NO: 476399 - protein, 9 aa, Influenza virus
LILRDCSVA

SEQ ID NO: 476400 - protein, 9 aa, Influenza virus
LILRGAVAH

SEQ ID NO: 476401 - protein, 9 aa, Influenza virus
LILRGSIAH

SEQ ID NO: 476402 - protein, 9 aa, Influenza virus
LILRGSVAH

SEQ ID NO: 476403 - protein, 9 aa, Influenza virus
LILSFIMWA

SEQ ID NO: 476404 - protein, 9 aa, Influenza virus
LILSNPKCD

SEQ ID NO: 476405 - protein, 9 aa, Influenza virus
LILTFIMWA

SEQ ID NO: 476406 - protein, 9 aa, Influenza virus
LILVALALS

SEQ ID NO: 476407 - protein, 9 aa, Influenza virus
LIMRTVIAL

SEQ ID NO: 476408 - protein, 9 aa, Influenza virus
LIMWGIHHP

SEQ ID NO: 476409 - protein, 9 aa, Influenza virus
LINDPWVLL

SEQ ID NO: 476410 - protein, 9 aa, Influenza virus
LINGALGSP

SEQ ID NO: 476411 - protein, 9 aa, Influenza virus
LINGWYGFQ

SEQ ID NO: 476412 - protein, 9 aa, Influenza virus
LINGWYGFR

SEQ ID NO: 476413 - protein, 9 aa, Influenza virus
LINTYQWII

SEQ ID NO: 476414 - protein, 9 aa, Influenza virus
LIPMISKCK

SEQ ID NO: 476415 - protein, 9 aa, Influenza virus
LIPMISKCR

SEQ ID NO: 476416 - protein, 9 aa, Influenza virus
LIQFPIGTA

SEQ ID NO: 476417 - protein, 9 aa, Influenza virus
LIQFPMGTA

SEQ ID NO: 476418 - protein, 9 aa, Influenza virus
LIQGYKDII

SEQ ID NO: 476419 - protein, 9 aa, Influenza virus
LIQLIVSGK

SEQ ID NO: 476420 - protein, 9 aa, Influenza virus
LIQLIVSGR

SEQ ID NO: 476421 - protein, 9 aa, Influenza virus
LIQNSITIE

SEQ ID NO: 476422 - protein, 9 aa, Influenza virus
LIQNSLTIE

SEQ ID NO: 476423 - protein, 9 aa, Influenza virus
LIQNSMTIE

SEQ ID NO: 476424 - protein, 9 aa, Influenza virus
LIRALTLNT

SEQ ID NO: 476425 - protein, 9 aa, Influenza virus
LIRFPIGTA

SEQ ID NO: 476426 - protein, 9 aa, Influenza virus
LIRFPIGVA

SEQ ID NO: 476427 - protein, 9 aa, Influenza virus
LIRFPVGTA

SEQ ID NO: 476428 - protein, 9 aa, Influenza virus
LIRGMPKES

SEQ ID NO: 476429 - protein, 9 aa, Influenza virus
LIRGMPQET

SEQ ID NO: 476430 - protein, 9 aa, Influenza virus
LIRGNSPIF

SEQ ID NO: 476431 - protein, 9 aa, Influenza virus
LIRGNSPVF

SEQ ID NO: 476432 - protein, 9 aa, Influenza virus
LIRGQQGRM

SEQ ID NO: 476433 - protein, 9 aa, Influenza virus
LIRGRPEEA

SEQ ID NO: 476434 - protein, 9 aa, Influenza virus
LIRGRPEEV

SEQ ID NO: 476435 - protein, 9 aa, Influenza virus
LIRGRPKED

SEQ ID NO: 476436 - protein, 9 aa, Influenza virus
LIRGRPKEE

SEQ ID NO: 476437 - protein, 9 aa, Influenza virus
LIRGRPKEN

SEQ ID NO: 476438 - protein, 9 aa, Influenza virus
LIRGRPKES

SEQ ID NO: 476439 - protein, 9 aa, Influenza virus
LIRGRPKET

SEQ ID NO: 476440 - protein, 9 aa, Influenza virus
LIRGRPQEN

SEQ ID NO: 476441 - protein, 9 aa, Influenza virus
LIRGRPQET

SEQ ID NO: 476442 - protein, 9 aa, Influenza virus
LIRGRPRES

SEQ ID NO: 476443 - protein, 9 aa, Influenza virus
LIRHENRMV

SEQ ID NO: 476444 - protein, 9 aa, Influenza virus
LIRMIKRGI

SEQ ID NO: 476445 - protein, 9 aa, Influenza virus
LIRMIKRGV

SEQ ID NO: 476446 - protein, 9 aa, Influenza virus
LIRMVKRGI

SEQ ID NO: 476447 - protein, 9 aa, Influenza virus
LIRTLTLNT

SEQ ID NO: 476448 - protein, 9 aa, Influenza virus
LISDGGPNL

SEQ ID NO: 476449 - protein, 9 aa, Influenza virus
LISKTNQQF

SEQ ID NO: 476450 - protein, 9 aa, Influenza virus
LISTPLGSP

SEQ ID NO: 476451 - protein, 9 aa, Influenza virus
LISTPLGTP

SEQ ID NO: 476452 - protein, 9 aa, Influenza virus
LISWEMGLA

SEQ ID NO: 476453 - protein, 9 aa, Influenza virus
LISWEMGQA

SEQ ID NO: 476454 - protein, 9 aa, Influenza virus
LISWGMGQA

SEQ ID NO: 476455 - protein, 9 aa, Influenza virus
LISWPLSSP

SEQ ID NO: 476456 - protein, 9 aa, Influenza virus
LISWPQSSP

SEQ ID NO: 476457 - protein, 9 aa, Influenza virus
LITDGPSDA

SEQ ID NO: 476458 - protein, 9 aa, Influenza virus
LITDGPSNA

SEQ ID NO: 476459 - protein, 9 aa, Influenza virus
LITDTIKSW

SEQ ID NO: 476460 - protein, 9 aa, Influenza virus
LITGKSHGR

SEQ ID NO: 476461 - protein, 9 aa, Influenza virus
LITQESECV

SEQ ID NO: 476462 - protein, 9 aa, Influenza virus
LITVGSSKY

SEQ ID NO: 476463 - protein, 9 aa, Influenza virus
LITWGIHHP

SEQ ID NO: 476464 - protein, 9 aa, Influenza virus
LIVFNTIGN

SEQ ID NO: 476465 - protein, 9 aa, Influenza virus
LIVLLENQK

SEQ ID NO: 476466 - protein, 9 aa, Influenza virus
LIVPEWSYI

SEQ ID NO: 476467 - protein, 9 aa, Influenza virus
LIVSLGAIS

SEQ ID NO: 476468 - protein, 9 aa, Influenza virus
LIVWGIHHP

SEQ ID NO: 476469 - protein, 9 aa, Influenza virus
LIVWGIHHS

SEQ ID NO: 476470 - protein, 9 aa, Influenza virus
LIVWGVHHS

SEQ ID NO: 476471 - protein, 9 aa, Influenza virus
LIWLWLVLR

SEQ ID NO: 476472 - protein, 9 aa, Influenza virus
LIWMACHSA

SEQ ID NO: 476473 - protein, 9 aa, Influenza virus
LIYGNPFCD

SEQ ID NO: 476474 - protein, 9 aa, Influenza virus
LIYGNPSCD

SEQ ID NO: 476475 - protein, 9 aa, Influenza virus
LIYGNPSCN

SEQ ID NO: 476476 - protein, 9 aa, Influenza virus
LIYNRMGAV

SEQ ID NO: 476477 - protein, 9 aa, Influenza virus
LIYNRMGTI

SEQ ID NO: 476478 - protein, 9 aa, Influenza virus
LIYNRMGTV

SEQ ID NO: 476479 - protein, 9 aa, Influenza virus
LKAEIAQKL

SEQ ID NO: 476480 - protein, 9 aa, Influenza virus
LKAEIAQRL

SEQ ID NO: 476481 - protein, 9 aa, Influenza virus
LKDCSIAGW

SEQ ID NO: 476482 - protein, 9 aa, Influenza virus
LKDCSVAGW

SEQ ID NO: 476483 - protein, 9 aa, Influenza virus
LKDCSVSGW

SEQ ID NO: 476484 - protein, 9 aa, Influenza virus
LKDEEKIPK

SEQ ID NO: 476485 - protein, 9 aa, Influenza virus
LKDNAIDEG

SEQ ID NO: 476486 - protein, 9 aa, Influenza virus
LKDNAKDEG

SEQ ID NO: 476487 - protein, 9 aa, Influenza virus
LKDNAKDLG

SEQ ID NO: 476488 - protein, 9 aa, Influenza virus
LKDNAKELG

SEQ ID NO: 476489 - protein, 9 aa, Influenza virus
LKDNAKEVG

SEQ ID NO: 476490 - protein, 9 aa, Influenza virus
LKDNANDLG

SEQ ID NO: 476491 - protein, 9 aa, Influenza virus
LKDNARELG

SEQ ID NO: 476492 - protein, 9 aa, Influenza virus
LKDNLEPGT

SEQ ID NO: 476493 - protein, 9 aa, Influenza virus
LKDQAWSYI

SEQ ID NO: 476494 - protein, 9 aa, Influenza virus
LKDQDWSYI

SEQ ID NO: 476495 - protein, 9 aa, Influenza virus
LKDQGWSYI

SEQ ID NO: 476496 - protein, 9 aa, Influenza virus
LKDQSWSYI

SEQ ID NO: 476497 - protein, 9 aa, Influenza virus
LKEQLSTVS

SEQ ID NO: 476498 - protein, 9 aa, Influenza virus
LKFKADLII

SEQ ID NO: 476499 - protein, 9 aa, Influenza virus
LKGKFQTAA

SEQ ID NO: 476500 - protein, 9 aa, Influenza virus
LKGLILGNP

SEQ ID NO: 476501 - protein, 9 aa, Influenza virus
LKGNAKDEG

SEQ ID NO: 476502 - protein, 9 aa, Influenza virus
LKGRHANGT

SEQ ID NO: 476503 - protein, 9 aa, Influenza virus
LKGSAKHIE

SEQ ID NO: 476504 - protein, 9 aa, Influenza virus
LKGSARHIE

SEQ ID NO: 476505 - protein, 9 aa, Influenza virus
LKGVRPLIL

SEQ ID NO: 476506 - protein, 9 aa, Influenza virus
LKHNPTEEQ

SEQ ID NO: 476507 - protein, 9 aa, Influenza virus
LKHRFEIIE

SEQ ID NO: 476508 - protein, 9 aa, Influenza virus
LKIHNAGTD

SEQ ID NO: 476509 - protein, 9 aa, Influenza virus
LKIKKGKIM

SEQ ID NO: 476510 - protein, 9 aa, Influenza virus
LKIKKGKIV

SEQ ID NO: 476511 - protein, 9 aa, Influenza virus
LKIPNAETD

SEQ ID NO: 476512 - protein, 9 aa, Influenza virus
LKIPNAGID

SEQ ID NO: 476513 - protein, 9 aa, Influenza virus
LKIPNAGTD

SEQ ID NO: 476514 - protein, 9 aa, Influenza virus
LKIRKGKIM

SEQ ID NO: 476515 - protein, 9 aa, Influenza virus
LKIRKGKIV

SEQ ID NO: 476516 - protein, 9 aa, Influenza virus
LKIRTNGNL

SEQ ID NO: 476517 - protein, 9 aa, Influenza virus
LKISSSFSF

SEQ ID NO: 476518 - protein, 9 aa, Influenza virus
LKITENSFE

SEQ ID NO: 476519 - protein, 9 aa, Influenza virus
LKIYHKCDN

SEQ ID NO: 476520 - protein, 9 aa, Influenza virus
LKKQEIEGI

SEQ ID NO: 476521 - protein, 9 aa, Influenza virus
LKLAIGLRN

SEQ ID NO: 476522 - protein, 9 aa, Influenza virus
LKLAIGPRN

SEQ ID NO: 476523 - protein, 9 aa, Influenza virus
LKLASGLRN

SEQ ID NO: 476524 - protein, 9 aa, Influenza virus
LKLATGLKN

SEQ ID NO: 476525 - protein, 9 aa, Influenza virus
LKLATGLRN

SEQ ID NO: 476526 - protein, 9 aa, Influenza virus
LKLATGMRN

SEQ ID NO: 476527 - protein, 9 aa, Influenza virus
LKLATGPRN

SEQ ID NO: 476528 - protein, 9 aa, Influenza virus
LKLAVGLKN

SEQ ID NO: 476529 - protein, 9 aa, Influenza virus
LKLAVGLRN

SEQ ID NO: 476530 - protein, 9 aa, Influenza virus
LKLAVGMRN

SEQ ID NO: 476531 - protein, 9 aa, Influenza virus
LKLAVGPRN

SEQ ID NO: 476532 - protein, 9 aa, Influenza virus
LKLGQFPVQ

SEQ ID NO: 476533 - protein, 9 aa, Influenza virus
LKLSIEDPD

SEQ ID NO: 476534 - protein, 9 aa, Influenza virus
LKLSIEDPN

SEQ ID NO: 476535 - protein, 9 aa, Influenza virus
LKLSIEDPS

SEQ ID NO: 476536 - protein, 9 aa, Influenza virus
LKLSIENPS

SEQ ID NO: 476537 - protein, 9 aa, Influenza virus
LKLVDGQDC

SEQ ID NO: 476538 - protein, 9 aa, Influenza virus
LKMATGLRN

SEQ ID NO: 476539 - protein, 9 aa, Influenza virus
LKMPASRYL

SEQ ID NO: 476540 - protein, 9 aa, Influenza virus
LKMSLLTEV

SEQ ID NO: 476541 - protein, 9 aa, Influenza virus
LKMTIASDI

SEQ ID NO: 476542 - protein, 9 aa, Influenza virus
LKNGNMRCT

SEQ ID NO: 476543 - protein, 9 aa, Influenza virus
LKNNAIDEG

SEQ ID NO: 476544 - protein, 9 aa, Influenza virus
LKNNAKDEG

SEQ ID NO: 476545 - protein, 9 aa, Influenza virus
LKPGETLKV

SEQ ID NO: 476546 - protein, 9 aa, Influenza virus
LKPGETLNI

SEQ ID NO: 476547 - protein, 9 aa, Influenza virus
LKPGETLNV

SEQ ID NO: 476548 - protein, 9 aa, Influenza virus
LKPGQTLRI

SEQ ID NO: 476549 - protein, 9 aa, Influenza virus
LKPGQTLRV

SEQ ID NO: 476550 - protein, 9 aa, Influenza virus
LKPGQTVKI

SEQ ID NO: 476551 - protein, 9 aa, Influenza virus
LKPQCQITG

SEQ ID NO: 476552 - protein, 9 aa, Influenza virus
LKQNPTEEQ

SEQ ID NO: 476553 - protein, 9 aa, Influenza virus
LKREITFHG

SEQ ID NO: 476554 - protein, 9 aa, Influenza virus
LKREMTFHG

SEQ ID NO: 476555 - protein, 9 aa, Influenza virus
LKRGETLKI

SEQ ID NO: 476556 - protein, 9 aa, Influenza virus
LKRNEIKGV

SEQ ID NO: 476557 - protein, 9 aa, Influenza virus
LKRQEIDGI

SEQ ID NO: 476558 - protein, 9 aa, Influenza virus
LKRQEIEGI

SEQ ID NO: 476559 - protein, 9 aa, Influenza virus
LKRQEINGI

SEQ ID NO: 476560 - protein, 9 aa, Influenza virus
LKRRAIATP

SEQ ID NO: 476561 - protein, 9 aa, Influenza virus
LKSDKRIGS

SEQ ID NO: 476562 - protein, 9 aa, Influenza virus
LKSEDNVYK

SEQ ID NO: 476563 - protein, 9 aa, Influenza virus
LKSEQFPVQ

SEQ ID NO: 476564 - protein, 9 aa, Influenza virus
LKSGQFPVQ

SEQ ID NO: 476565 - protein, 9 aa, Influenza virus
LKSLFSSIK

SEQ ID NO: 476566 - protein, 9 aa, Influenza virus
LKSNAIDEG

SEQ ID NO: 476567 - protein, 9 aa, Influenza virus
LKSTQAAID

SEQ ID NO: 476568 - protein, 9 aa, Influenza virus
LKSTQAAIN

SEQ ID NO: 476569 - protein, 9 aa, Influenza virus
LKSTQAAIT

SEQ ID NO: 476570 - protein, 9 aa, Influenza virus
LKSTQAAVN

SEQ ID NO: 476571 - protein, 9 aa, Influenza virus
LKSTQTAID

SEQ ID NO: 476572 - protein, 9 aa, Influenza virus
LKSWKGNIM

SEQ ID NO: 476573 - protein, 9 aa, Influenza virus
LKTEDNIYK

SEQ ID NO: 476574 - protein, 9 aa, Influenza virus
LKTEDNVYK

SEQ ID NO: 476575 - protein, 9 aa, Influenza virus
LKTRPILSP

SEQ ID NO: 476576 - protein, 9 aa, Influenza virus
LKVESNGNL

SEQ ID NO: 476577 - protein, 9 aa, Influenza virus
LKVPNAEKD

SEQ ID NO: 476578 - protein, 9 aa, Influenza virus
LKVPNAGTD

SEQ ID NO: 476579 - protein, 9 aa, Influenza virus
LKVPNALTD

SEQ ID NO: 476580 - protein, 9 aa, Influenza virus
LKWALGENM

SEQ ID NO: 476581 - protein, 9 aa, Influenza virus
LKWLISKSK

SEQ ID NO: 476582 - protein, 9 aa, Influenza virus
LKWLVSKDK

SEQ ID NO: 476583 - protein, 9 aa, Influenza virus
LKWLVSKNK

SEQ ID NO: 476584 - protein, 9 aa, Influenza virus
LKWLVSKSK

SEQ ID NO: 476585 - protein, 9 aa, Influenza virus
LKWLVSKTK

SEQ ID NO: 476586 - protein, 9 aa, Influenza virus
LKWTLGENM

SEQ ID NO: 476587 - protein, 9 aa, Influenza virus
LKWVLGENM

SEQ ID NO: 476588 - protein, 9 aa, Influenza virus
LKYKGIITG

SEQ ID NO: 476589 - protein, 9 aa, Influenza virus
LKYNDIITD

SEQ ID NO: 476590 - protein, 9 aa, Influenza virus
LKYNGIITD

SEQ ID NO: 476591 - protein, 9 aa, Influenza virus
LKYNGIITE

SEQ ID NO: 476592 - protein, 9 aa, Influenza virus
LKYNGIITG

SEQ ID NO: 476593 - protein, 9 aa, Influenza virus
LKYNGVITD

SEQ ID NO: 476594 - protein, 9 aa, Influenza virus
LLAFILWAC

SEQ ID NO: 476595 - protein, 9 aa, Influenza virus
LLAFMLWAC

SEQ ID NO: 476596 - protein, 9 aa, Influenza virus
LLAFVLWAC

SEQ ID NO: 476597 - protein, 9 aa, Influenza virus
LLAIAMGLG

SEQ ID NO: 476598 - protein, 9 aa, Influenza virus
LLAIAMGLI

SEQ ID NO: 476599 - protein, 9 aa, Influenza virus
LLAIAMGLV

SEQ ID NO: 476600 - protein, 9 aa, Influenza virus
LLAIVMGLV

SEQ ID NO: 476601 - protein, 9 aa, Influenza virus
  MOD_RES (4)..(4): Ile or Leu
LLAXVMGLV

SEQ ID NO: 476602 - protein, 9 aa, Influenza virus
LLAKSVFNC

SEQ ID NO: 476603 - protein, 9 aa, Influenza virus
LLAKSVFNN

SEQ ID NO: 476604 - protein, 9 aa, Influenza virus
LLAKSVFNS

SEQ ID NO: 476605 - protein, 9 aa, Influenza virus
LLAPKYGYI

SEQ ID NO: 476606 - protein, 9 aa, Influenza virus
LLAPRYGYI

SEQ ID NO: 476607 - protein, 9 aa, Influenza virus
LLASTNAHD

SEQ ID NO: 476608 - protein, 9 aa, Influenza virus
LLASTNAYD

SEQ ID NO: 476609 - protein, 9 aa, Influenza virus
LLATGMKNV

SEQ ID NO: 476610 - protein, 9 aa, Influenza virus
LLATGMRNI

SEQ ID NO: 476611 - protein, 9 aa, Influenza virus
LLATGMRNV

SEQ ID NO: 476612 - protein, 9 aa, Influenza virus
LLAVVMGLV

SEQ ID NO: 476613 - protein, 9 aa, Influenza virus
LLDNLQAYQ

SEQ ID NO: 476614 - protein, 9 aa, Influenza virus
LLDPGDTVT

SEQ ID NO: 476615 - protein, 9 aa, Influenza virus
LLDPNDTVT

SEQ ID NO: 476616 - protein, 9 aa, Influenza virus
LLDVWTYNA

SEQ ID NO: 476617 - protein, 9 aa, Influenza virus
LLEDERTLD

SEQ ID NO: 476618 - protein, 9 aa, Influenza virus
LLEKNVTVT

SEQ ID NO: 476619 - protein, 9 aa, Influenza virus
LLEMCHGTQ

SEQ ID NO: 476620 - protein, 9 aa, Influenza virus
LLEMCHSTQ

SEQ ID NO: 476621 - protein, 9 aa, Influenza virus
LLEMCHSTR

SEQ ID NO: 476622 - protein, 9 aa, Influenza virus
LLENDKTLD

SEQ ID NO: 476623 - protein, 9 aa, Influenza virus
LLENDKTLN

SEQ ID NO: 476624 - protein, 9 aa, Influenza virus
LLENDRTLD

SEQ ID NO: 476625 - protein, 9 aa, Influenza virus
LLENDVPVT

SEQ ID NO: 476626 - protein, 9 aa, Influenza virus
LLENEKTLD

SEQ ID NO: 476627 - protein, 9 aa, Influenza virus
LLENERTLD

SEQ ID NO: 476628 - protein, 9 aa, Influenza virus
LLENGRTLD

SEQ ID NO: 476629 - protein, 9 aa, Influenza virus
LLENGRTLG

SEQ ID NO: 476630 - protein, 9 aa, Influenza virus
LLENGVPVT

SEQ ID NO: 476631 - protein, 9 aa, Influenza virus
LLENLQAYQ

SEQ ID NO: 476632 - protein, 9 aa, Influenza virus
LLENLQTYQ

SEQ ID NO: 476633 - protein, 9 aa, Influenza virus
LLENNVPVT

SEQ ID NO: 476634 - protein, 9 aa, Influenza virus
LLENQKILD

SEQ ID NO: 476635 - protein, 9 aa, Influenza virus
LLENQKPLD

SEQ ID NO: 476636 - protein, 9 aa, Influenza virus
LLENQKTLD

SEQ ID NO: 476637 - protein, 9 aa, Influenza virus
LLESDVPVT

SEQ ID NO: 476638 - protein, 9 aa, Influenza virus
LLEVGTRWM

SEQ ID NO: 476639 - protein, 9 aa, Influenza virus
LLFLEVPAQ

SEQ ID NO: 476640 - protein, 9 aa, Influenza virus
LLFLKIPAQ

SEQ ID NO: 476641 - protein, 9 aa, Influenza virus
LLFLKIPVQ

SEQ ID NO: 476642 - protein, 9 aa, Influenza virus
LLFLKVPAQ

SEQ ID NO: 476643 - protein, 9 aa, Influenza virus
LLFLKVPVQ

SEQ ID NO: 476644 - protein, 9 aa, Influenza virus
LLFMIIGGF

SEQ ID NO: 476645 - protein, 9 aa, Influenza virus
LLFQDILMR

SEQ ID NO: 476646 - protein, 9 aa, Influenza virus
LLGAIAGFI

SEQ ID NO: 476647 - protein, 9 aa, Influenza virus
LLGIITGPP

SEQ ID NO: 476648 - protein, 9 aa, Influenza virus
LLGILIGPP

SEQ ID NO: 476649 - protein, 9 aa, Influenza virus
LLGINMSKK

SEQ ID NO: 476650 - protein, 9 aa, Influenza virus
LLGNPECDI

SEQ ID NO: 476651 - protein, 9 aa, Influenza virus
LLGNPECDL

SEQ ID NO: 476652 - protein, 9 aa, Influenza virus
LLGNPECDR

SEQ ID NO: 476653 - protein, 9 aa, Influenza virus
LLGNPKCDR

SEQ ID NO: 476654 - protein, 9 aa, Influenza virus
LLGNPLCDE

SEQ ID NO: 476655 - protein, 9 aa, Influenza virus
LLGNPMCDA

SEQ ID NO: 476656 - protein, 9 aa, Influenza virus
LLGNPMCDE

SEQ ID NO: 476657 - protein, 9 aa, Influenza virus
LLGNPMCDK

SEQ ID NO: 476658 - protein, 9 aa, Influenza virus
LLGNQKTLD

SEQ ID NO: 476659 - protein, 9 aa, Influenza virus
LLGSAQHVE

SEQ ID NO: 476660 - protein, 9 aa, Influenza virus
LLGTITGPP

SEQ ID NO: 476661 - protein, 9 aa, Influenza virus
LLGTKHSNG

SEQ ID NO: 476662 - protein, 9 aa, Influenza virus
LLGTLIGPP

SEQ ID NO: 476663 - protein, 9 aa, Influenza virus
LLGTLTGPP

SEQ ID NO: 476664 - protein, 9 aa, Influenza virus
LLGTNHSNG

SEQ ID NO: 476665 - protein, 9 aa, Influenza virus
LLGTRHSNG

SEQ ID NO: 476666 - protein, 9 aa, Influenza virus
LLGTVTGPP

SEQ ID NO: 476667 - protein, 9 aa, Influenza virus
LLHKCNDSC

SEQ ID NO: 476668 - protein, 9 aa, Influenza virus
LLHKCNNSC

SEQ ID NO: 476669 - protein, 9 aa, Influenza virus
LLHKCNNTC

SEQ ID NO: 476670 - protein, 9 aa, Influenza virus
LLIAFVLWA

SEQ ID NO: 476671 - protein, 9 aa, Influenza virus
LLIAMENQH

SEQ ID NO: 476672 - protein, 9 aa, Influenza virus
LLIAQALRD

SEQ ID NO: 476673 - protein, 9 aa, Influenza virus
LLIGISNIG

SEQ ID NO: 476674 - protein, 9 aa, Influenza virus
LLIGISNMS

SEQ ID NO: 476675 - protein, 9 aa, Influenza virus
LLIGISNVG

SEQ ID NO: 476676 - protein, 9 aa, Influenza virus
LLIGISNVV

SEQ ID NO: 476677 - protein, 9 aa, Influenza virus
LLIGVSNVG

SEQ ID NO: 476678 - protein, 9 aa, Influenza virus
LLIIWGIHH

SEQ ID NO: 476679 - protein, 9 aa, Influenza virus
LLILLENER

SEQ ID NO: 476680 - protein, 9 aa, Influenza virus
LLILWGIHH

SEQ ID NO: 476681 - protein, 9 aa, Influenza virus
LLISDGGPN

SEQ ID NO: 476682 - protein, 9 aa, Influenza virus
LLITQALRD

SEQ ID NO: 476683 - protein, 9 aa, Influenza virus
LLIVQAFRD

SEQ ID NO: 476684 - protein, 9 aa, Influenza virus
LLIVQALRD

SEQ ID NO: 476685 - protein, 9 aa, Influenza virus
LLKERGFFG

SEQ ID NO: 476686 - protein, 9 aa, Influenza virus
LLKGESHCR

SEQ ID NO: 476687 - protein, 9 aa, Influenza virus
LLKGESHGK

SEQ ID NO: 476688 - protein, 9 aa, Influenza virus
LLKGESHGR

SEQ ID NO: 476689 - protein, 9 aa, Influenza virus
LLKGESYGR

SEQ ID NO: 476690 - protein, 9 aa, Influenza virus
LLKHRFEII

SEQ ID NO: 476691 - protein, 9 aa, Influenza virus
LLKPGQTLR

SEQ ID NO: 476692 - protein, 9 aa, Influenza virus
LLLAFILWA

SEQ ID NO: 476693 - protein, 9 aa, Influenza virus
LLLAFMLWA

SEQ ID NO: 476694 - protein, 9 aa, Influenza virus
LLLAFVLWA

SEQ ID NO: 476695 - protein, 9 aa, Influenza virus
LLLATGMKN

SEQ ID NO: 476696 - protein, 9 aa, Influenza virus
LLLATGMRN

SEQ ID NO: 476697 - protein, 9 aa, Influenza virus
LLLLQANLC

SEQ ID NO: 476698 - protein, 9 aa, Influenza virus
LLLMIIGGF

SEQ ID NO: 476699 - protein, 9 aa, Influenza virus
LLLNKSLCN

SEQ ID NO: 476700 - protein, 9 aa, Influenza virus
LLLNKSLCS

SEQ ID NO: 476701 - protein, 9 aa, Influenza virus
LLLQANLCR

SEQ ID NO: 476702 - protein, 9 aa, Influenza virus
LLLQIISLC

SEQ ID NO: 476703 - protein, 9 aa, Influenza virus
LLLQITSLC

SEQ ID NO: 476704 - protein, 9 aa, Influenza virus
LLLQVTSLC

SEQ ID NO: 476705 - protein, 9 aa, Influenza virus
LLLWMCSNG

SEQ ID NO: 476706 - protein, 9 aa, Influenza virus
LLMDALKLS

SEQ ID NO: 476707 - protein, 9 aa, Influenza virus
LLMDSLKLS

SEQ ID NO: 476708 - protein, 9 aa, Influenza virus
LLMIIGGFI

SEQ ID NO: 476709 - protein, 9 aa, Influenza virus
LLMNELGIP

SEQ ID NO: 476710 - protein, 9 aa, Influenza virus
LLMNELGVP

SEQ ID NO: 476711 - protein, 9 aa, Influenza virus
LLMNELGVS

SEQ ID NO: 476712 - protein, 9 aa, Influenza virus
LLMSELGVP

SEQ ID NO: 476713 - protein, 9 aa, Influenza virus
LLMSTNAYD

SEQ ID NO: 476714 - protein, 9 aa, Influenza virus
LLNASCAAM

SEQ ID NO: 476715 - protein, 9 aa, Influenza virus
LLNASWFNS

SEQ ID NO: 476716 - protein, 9 aa, Influenza virus
LLNDKHFNG

SEQ ID NO: 476717 - protein, 9 aa, Influenza virus
LLNDKHSNE

SEQ ID NO: 476718 - protein, 9 aa, Influenza virus
LLNDKHSNG

SEQ ID NO: 476719 - protein, 9 aa, Influenza virus
LLNDKHSNN

SEQ ID NO: 476720 - protein, 9 aa, Influenza virus
LLNDKHSSG

SEQ ID NO: 476721 - protein, 9 aa, Influenza virus
LLNDRHSNG

SEQ ID NO: 476722 - protein, 9 aa, Influenza virus
LLNKSLCNV

SEQ ID NO: 476723 - protein, 9 aa, Influenza virus
LLNKSLCSV

SEQ ID NO: 476724 - protein, 9 aa, Influenza virus
LLNPFVSHK

SEQ ID NO: 476725 - protein, 9 aa, Influenza virus
LLNRININP

SEQ ID NO: 476726 - protein, 9 aa, Influenza virus
LLNRLNINP

SEQ ID NO: 476727 - protein, 9 aa, Influenza virus
LLNRLNINS

SEQ ID NO: 476728 - protein, 9 aa, Influenza virus
LLNRLSINP

SEQ ID NO: 476729 - protein, 9 aa, Influenza virus
LLPFAAAPP

SEQ ID NO: 476730 - protein, 9 aa, Influenza virus
LLPFASAPP

SEQ ID NO: 476731 - protein, 9 aa, Influenza virus
LLQANLCRF

SEQ ID NO: 476732 - protein, 9 aa, Influenza virus
LLQIISLCS

SEQ ID NO: 476733 - protein, 9 aa, Influenza virus
LLQITSLCS

SEQ ID NO: 476734 - protein, 9 aa, Influenza virus
LLQSAILSL

SEQ ID NO: 476735 - protein, 9 aa, Influenza virus
LLQSLQQIE

SEQ ID NO: 476736 - protein, 9 aa, Influenza virus
LLRENAEED

SEQ ID NO: 476737 - protein, 9 aa, Influenza virus
LLRGESHGR

SEQ ID NO: 476738 - protein, 9 aa, Influenza virus
LLRHFQKDA

SEQ ID NO: 476739 - protein, 9 aa, Influenza virus
LLRHFQKNA

SEQ ID NO: 476740 - protein, 9 aa, Influenza virus
LLSLLEMCH

SEQ ID NO: 476741 - protein, 9 aa, Influenza virus
LLSPEEVSE

SEQ ID NO: 476742 - protein, 9 aa, Influenza virus
LLSSKANQV

SEQ ID NO: 476743 - protein, 9 aa, Influenza virus
LLSSKDNQV

SEQ ID NO: 476744 - protein, 9 aa, Influenza virus
LLTEVETYV

SEQ ID NO: 476745 - protein, 9 aa, Influenza virus
LLVADGGPN

SEQ ID NO: 476746 - protein, 9 aa, Influenza virus
LLVALENQH

SEQ ID NO: 476747 - protein, 9 aa, Influenza virus
LLVALENQN

SEQ ID NO: 476748 - protein, 9 aa, Influenza virus
LLVAMENQH

SEQ ID NO: 476749 - protein, 9 aa, Influenza virus
LLVLIENDR

SEQ ID NO: 476750 - protein, 9 aa, Influenza virus
LLVLIENER

SEQ ID NO: 476751 - protein, 9 aa, Influenza virus
LLVLIENQK

SEQ ID NO: 476752 - protein, 9 aa, Influenza virus
LLVLLEDER

SEQ ID NO: 476753 - protein, 9 aa, Influenza virus
LLVLLENDK

SEQ ID NO: 476754 - protein, 9 aa, Influenza virus
LLVLLENDR

SEQ ID NO: 476755 - protein, 9 aa, Influenza virus
LLVLLENEK

SEQ ID NO: 476756 - protein, 9 aa, Influenza virus
LLVLLENER

SEQ ID NO: 476757 - protein, 9 aa, Influenza virus
LLVLLENGR

SEQ ID NO: 476758 - protein, 9 aa, Influenza virus
LLVLLENQK

SEQ ID NO: 476759 - protein, 9 aa, Influenza virus
LLVLLGNQK

SEQ ID NO: 476760 - protein, 9 aa, Influenza virus
LLVLMENEM

SEQ ID NO: 476761 - protein, 9 aa, Influenza virus
LLVLMENER

SEQ ID NO: 476762 - protein, 9 aa, Influenza virus
LLVLMETER

SEQ ID NO: 476763 - protein, 9 aa, Influenza virus
LLVLWGIHH

SEQ ID NO: 476764 - protein, 9 aa, Influenza virus
LLVLWGVHH

SEQ ID NO: 476765 - protein, 9 aa, Influenza virus
LLVMWGIHH

SEQ ID NO: 476766 - protein, 9 aa, Influenza virus
LLVSDGGPN

SEQ ID NO: 476767 - protein, 9 aa, Influenza virus
LLVSLGAIS

SEQ ID NO: 476768 - protein, 9 aa, Influenza virus
LLVSLGAVS

SEQ ID NO: 476769 - protein, 9 aa, Influenza virus
LLVSTNAYD

SEQ ID NO: 476770 - protein, 9 aa, Influenza virus
LLVVQALRD

SEQ ID NO: 476771 - protein, 9 aa, Influenza virus
LLVWLENEK

SEQ ID NO: 476772 - protein, 9 aa, Influenza virus
LLWMCSNGS

SEQ ID NO: 476773 - protein, 9 aa, Influenza virus
LMDALKLSI

SEQ ID NO: 476774 - protein, 9 aa, Influenza virus
LMDALLGDP

SEQ ID NO: 476775 - protein, 9 aa, Influenza virus
LMDFLKDVM

SEQ ID NO: 476776 - protein, 9 aa, Influenza virus
LMDSLKLSI

SEQ ID NO: 476777 - protein, 9 aa, Influenza virus
LMENEMTLD

SEQ ID NO: 476778 - protein, 9 aa, Influenza virus
LMENERILD

SEQ ID NO: 476779 - protein, 9 aa, Influenza virus
LMENERTLD

SEQ ID NO: 476780 - protein, 9 aa, Influenza virus
LMENERTLY

SEQ ID NO: 476781 - protein, 9 aa, Influenza virus
LMEQNVPVT

SEQ ID NO: 476782 - protein, 9 aa, Influenza virus
LMEWIKTRP

SEQ ID NO: 476783 - protein, 9 aa, Influenza virus
LMEWLKTRP

SEQ ID NO: 476784 - protein, 9 aa, Influenza virus
LMIIGGFIF

SEQ ID NO: 476785 - protein, 9 aa, Influenza virus
LMIWHSNLN

SEQ ID NO: 476786 - protein, 9 aa, Influenza virus
LMLATGMKN

SEQ ID NO: 476787 - protein, 9 aa, Influenza virus
LMLATGMRN

SEQ ID NO: 476788 - protein, 9 aa, Influenza virus
LMLNKSLCK

SEQ ID NO: 476789 - protein, 9 aa, Influenza virus
LMLQSRTRE

SEQ ID NO: 476790 - protein, 9 aa, Influenza virus
LMLSKSLCK

SEQ ID NO: 476791 - protein, 9 aa, Influenza virus
LMNELGIPF

SEQ ID NO: 476792 - protein, 9 aa, Influenza virus
LMNELGVPF

SEQ ID NO: 476793 - protein, 9 aa, Influenza virus
LMNELGVPL

SEQ ID NO: 476794 - protein, 9 aa, Influenza virus
LMNELGVSF

SEQ ID NO: 476795 - protein, 9 aa, Influenza virus
LMQGSTLPR

SEQ ID NO: 476796 - protein, 9 aa, Influenza virus
LMSCPIGEA

SEQ ID NO: 476797 - protein, 9 aa, Influenza virus
LMSCPIGEV

SEQ ID NO: 476798 - protein, 9 aa, Influenza virus
LMSCPIGVA

SEQ ID NO: 476799 - protein, 9 aa, Influenza virus
LMSCPIGVV

SEQ ID NO: 476800 - protein, 9 aa, Influenza virus
LMSCPLGEA

SEQ ID NO: 476801 - protein, 9 aa, Influenza virus
LMSCPMGVA

SEQ ID NO: 476802 - protein, 9 aa, Influenza virus
LMSCPVGEA

SEQ ID NO: 476803 - protein, 9 aa, Influenza virus
LMSCPVGVA

SEQ ID NO: 476804 - protein, 9 aa, Influenza virus
LMSELGVPF

SEQ ID NO: 476805 - protein, 9 aa, Influenza virus
LMSQSRTRE

SEQ ID NO: 476806 - protein, 9 aa, Influenza virus
LMSQSRTRG

SEQ ID NO: 476807 - protein, 9 aa, Influenza virus
LMSTNAYDR

SEQ ID NO: 476808 - protein, 9 aa, Influenza virus
LMSTPLGTP

SEQ ID NO: 476809 - protein, 9 aa, Influenza virus
LMSVLLGSS

SEQ ID NO: 476810 - protein, 9 aa, Influenza virus
LMSVPLGSS

SEQ ID NO: 476811 - protein, 9 aa, Influenza virus
LMTDGPSDA

SEQ ID NO: 476812 - protein, 9 aa, Influenza virus
LMVAYMLER

SEQ ID NO: 476813 - protein, 9 aa, Influenza virus
LMWALGENM

SEQ ID NO: 476814 - protein, 9 aa, Influenza virus
LMWEINGPE

SEQ ID NO: 476815 - protein, 9 aa, Influenza virus
LNASCAAMD

SEQ ID NO: 476816 - protein, 9 aa, Influenza virus
LNASCAAME

SEQ ID NO: 476817 - protein, 9 aa, Influenza virus
LNASWFNSF

SEQ ID NO: 476818 - protein, 9 aa, Influenza virus
LNDATYQRT

SEQ ID NO: 476819 - protein, 9 aa, Influenza virus
LNDKHFNGT

SEQ ID NO: 476820 - protein, 9 aa, Influenza virus
LNDKHSNET

SEQ ID NO: 476821 - protein, 9 aa, Influenza virus
LNDKHSNGT

SEQ ID NO: 476822 - protein, 9 aa, Influenza virus
LNDKHSNNT

SEQ ID NO: 476823 - protein, 9 aa, Influenza virus
LNDRHSNGT

SEQ ID NO: 476824 - protein, 9 aa, Influenza virus
LNDTTYQRT

SEQ ID NO: 476825 - protein, 9 aa, Influenza virus
LNDYEELKH

SEQ ID NO: 476826 - protein, 9 aa, Influenza virus
LNEGIMNTS

SEQ ID NO: 476827 - protein, 9 aa, Influenza virus
LNEGVINTS

SEQ ID NO: 476828 - protein, 9 aa, Influenza virus
LNEGVMNTS

SEQ ID NO: 476829 - protein, 9 aa, Influenza virus
LNEITTKIN

SEQ ID NO: 476830 - protein, 9 aa, Influenza virus
LNFVNRANQ

SEQ ID NO: 476831 - protein, 9 aa, Influenza virus
LNGIPPLEL

SEQ ID NO: 476832 - protein, 9 aa, Influenza virus
LNGISPIHL

SEQ ID NO: 476833 - protein, 9 aa, Influenza virus
LNGISPVHL

SEQ ID NO: 476834 - protein, 9 aa, Influenza virus
LNGNGDPNN

SEQ ID NO: 476835 - protein, 9 aa, Influenza virus
LNGREWSYI

SEQ ID NO: 476836 - protein, 9 aa, Influenza virus
LNGTAKHIE

SEQ ID NO: 476837 - protein, 9 aa, Influenza virus
LNGVKPLIL

SEQ ID NO: 476838 - protein, 9 aa, Influenza virus
LNGVPPLEL

SEQ ID NO: 476839 - protein, 9 aa, Influenza virus
LNGVSPIHL

SEQ ID NO: 476840 - protein, 9 aa, Influenza virus
LNGVSPVHL

SEQ ID NO: 476841 - protein, 9 aa, Influenza virus
LNIESNGNL

SEQ ID NO: 476842 - protein, 9 aa, Influenza virus
LNIGLHLKP

SEQ ID NO: 476843 - protein, 9 aa, Influenza virus
LNIGLHLRP

SEQ ID NO: 476844 - protein, 9 aa, Influenza virus
LNINPVKLS

SEQ ID NO: 476845 - protein, 9 aa, Influenza virus
LNINPVTLS

SEQ ID NO: 476846 - protein, 9 aa, Influenza virus
LNINSVKLS

SEQ ID NO: 476847 - protein, 9 aa, Influenza virus
LNITAASLN

SEQ ID NO: 476848 - protein, 9 aa, Influenza virus
LNKKIDDGF

SEQ ID NO: 476849 - protein, 9 aa, Influenza virus
LNKKMEDDF

SEQ ID NO: 476850 - protein, 9 aa, Influenza virus
LNKKMEDGF

SEQ ID NO: 476851 - protein, 9 aa, Influenza virus
LNKKMEEGF

SEQ ID NO: 476852 - protein, 9 aa, Influenza virus
LNKKVDDGF

SEQ ID NO: 476853 - protein, 9 aa, Influenza virus
LNKKVDDGL

SEQ ID NO: 476854 - protein, 9 aa, Influenza virus
LNKKVEDGF

SEQ ID NO: 476855 - protein, 9 aa, Influenza virus
LNKNEIKGV

SEQ ID NO: 476856 - protein, 9 aa, Influenza virus
LNKRMEDGF

SEQ ID NO: 476857 - protein, 9 aa, Influenza virus
LNKRMEDGL

SEQ ID NO: 476858 - protein, 9 aa, Influenza virus
LNKRMENGF

SEQ ID NO: 476859 - protein, 9 aa, Influenza virus
LNKRMQDGF

SEQ ID NO: 476860 - protein, 9 aa, Influenza virus
LNKSLCKIE

SEQ ID NO: 476861 - protein, 9 aa, Influenza virus
LNKSLCKVE

SEQ ID NO: 476862 - protein, 9 aa, Influenza virus
LNKSLCNVE

SEQ ID NO: 476863 - protein, 9 aa, Influenza virus
LNKSLCSVE

SEQ ID NO: 476864 - protein, 9 aa, Influenza virus
LNLGQKEYT

SEQ ID NO: 476865 - protein, 9 aa, Influenza virus
LNLGQKKYT

SEQ ID NO: 476866 - protein, 9 aa, Influenza virus
LNLGQKRHT

SEQ ID NO: 476867 - protein, 9 aa, Influenza virus
LNLGQKRYT

SEQ ID NO: 476868 - protein, 9 aa, Influenza virus
LNLGQRKYT

SEQ ID NO: 476869 - protein, 9 aa, Influenza virus
LNLIIGISN

SEQ ID NO: 476870 - protein, 9 aa, Influenza virus
LNLLIGISN

SEQ ID NO: 476871 - protein, 9 aa, Influenza virus
LNLLIGVSN

SEQ ID NO: 476872 - protein, 9 aa, Influenza virus
LNLYDRVRK

SEQ ID NO: 476873 - protein, 9 aa, Influenza virus
LNLYERVRK

SEQ ID NO: 476874 - protein, 9 aa, Influenza virus
LNMGQPFYS

SEQ ID NO: 476875 - protein, 9 aa, Influenza virus
LNMHDANVR

SEQ ID NO: 476876 - protein, 9 aa, Influenza virus
LNNEIRWPP

SEQ ID NO: 476877 - protein, 9 aa, Influenza virus
LNNEPGSGN

SEQ ID NO: 476878 - protein, 9 aa, Influenza virus
LNNKHSNGT

SEQ ID NO: 476879 - protein, 9 aa, Influenza virus
LNNKHWSGY

SEQ ID NO: 476880 - protein, 9 aa, Influenza virus
LNNKMEDGF

SEQ ID NO: 476881 - protein, 9 aa, Influenza virus
LNNKNWSGY

SEQ ID NO: 476882 - protein, 9 aa, Influenza virus
LNNKVDDGF

SEQ ID NO: 476883 - protein, 9 aa, Influenza virus
LNNMNWSGY

SEQ ID NO: 476884 - protein, 9 aa, Influenza virus
LNNNGELRH

SEQ ID NO: 476885 - protein, 9 aa, Influenza virus
LNNTEPLCD

SEQ ID NO: 476886 - protein, 9 aa, Influenza virus
LNNTEPLCE

SEQ ID NO: 476887 - protein, 9 aa, Influenza virus
LNNTEPLCN

SEQ ID NO: 476888 - protein, 9 aa, Influenza virus
LNNVIDKMN

SEQ ID NO: 476889 - protein, 9 aa, Influenza virus
LNNVIDKMY

SEQ ID NO: 476890 - protein, 9 aa, Influenza virus
LNPIDGPLP

SEQ ID NO: 476891 - protein, 9 aa, Influenza virus
LNPMHQLLR

SEQ ID NO: 476892 - protein, 9 aa, Influenza virus
LNPNDTITF

SEQ ID NO: 476893 - protein, 9 aa, Influenza virus
LNPNDTVIF

SEQ ID NO: 476894 - protein, 9 aa, Influenza virus
LNPNDTVTF

SEQ ID NO: 476895 - protein, 9 aa, Influenza virus
LNPNGTITF

SEQ ID NO: 476896 - protein, 9 aa, Influenza virus
LNQTYRNNR

SEQ ID NO: 476897 - protein, 9 aa, Influenza virus
LNQTYRNTR

SEQ ID NO: 476898 - protein, 9 aa, Influenza virus
LNRFIEKTN

SEQ ID NO: 476899 - protein, 9 aa, Influenza virus
LNRIIEKTN

SEQ ID NO: 476900 - protein, 9 aa, Influenza virus
LNRKMEDGF

SEQ ID NO: 476901 - protein, 9 aa, Influenza virus
LNRKVDDGF

SEQ ID NO: 476902 - protein, 9 aa, Influenza virus
LNRLIDKTN

SEQ ID NO: 476903 - protein, 9 aa, Influenza virus
LNRLIDRTN

SEQ ID NO: 476904 - protein, 9 aa, Influenza virus
LNRLIEKTN

SEQ ID NO: 476905 - protein, 9 aa, Influenza virus
LNRLIERTN

SEQ ID NO: 476906 - protein, 9 aa, Influenza virus
LNRLIGKTN

SEQ ID NO: 476907 - protein, 9 aa, Influenza virus
LNRLISKTN

SEQ ID NO: 476908 - protein, 9 aa, Influenza virus
LNRLNINPV

SEQ ID NO: 476909 - protein, 9 aa, Influenza virus
LNRLNINSV

SEQ ID NO: 476910 - protein, 9 aa, Influenza virus
LNRLSINPV

SEQ ID NO: 476911 - protein, 9 aa, Influenza virus
LNRNEIKGV

SEQ ID NO: 476912 - protein, 9 aa, Influenza virus
LNRNQPAAT

SEQ ID NO: 476913 - protein, 9 aa, Influenza virus
LNRQEIEGV

SEQ ID NO: 476914 - protein, 9 aa, Influenza virus
LNRQEIGGV

SEQ ID NO: 476915 - protein, 9 aa, Influenza virus
LNTASRSGY

SEQ ID NO: 476916 - protein, 9 aa, Influenza virus
LNTDWSGYS

SEQ ID NO: 476917 - protein, 9 aa, Influenza virus
LNTMHQLLR

SEQ ID NO: 476918 - protein, 9 aa, Influenza virus
LNTMTKDAE

SEQ ID NO: 476919 - protein, 9 aa, Influenza virus
LNTSQRGIL

SEQ ID NO: 476920 - protein, 9 aa, Influenza virus
LNTSQRGVL

SEQ ID NO: 476921 - protein, 9 aa, Influenza virus
LNTTLPFHN

SEQ ID NO: 476922 - protein, 9 aa, Influenza virus
LNVESNGNL

SEQ ID NO: 476923 - protein, 9 aa, Influenza virus
LNVGLHLKP

SEQ ID NO: 476924 - protein, 9 aa, Influenza virus
LNVPEWSYI

SEQ ID NO: 476925 - protein, 9 aa, Influenza virus
LNVWTYNAE

SEQ ID NO: 476926 - protein, 9 aa, Influenza virus
LNWLTKATN

SEQ ID NO: 476927 - protein, 9 aa, Influenza virus
LNWLTKETN

SEQ ID NO: 476928 - protein, 9 aa, Influenza virus
LNWSGYSGS

SEQ ID NO: 476929 - protein, 9 aa, Influenza virus
LPACAYGPA

SEQ ID NO: 476930 - protein, 9 aa, Influenza virus
LPACIYGLV

SEQ ID NO: 476931 - protein, 9 aa, Influenza virus
LPACVYGLA

SEQ ID NO: 476932 - protein, 9 aa, Influenza virus
LPACVYGLV

SEQ ID NO: 476933 - protein, 9 aa, Influenza virus
LPACVYGPA

SEQ ID NO: 476934 - protein, 9 aa, Influenza virus
LPDGAQIQY

SEQ ID NO: 476935 - protein, 9 aa, Influenza virus
LPDLYDYKE

SEQ ID NO: 476936 - protein, 9 aa, Influenza virus
LPFAAAPPE

SEQ ID NO: 476937 - protein, 9 aa, Influenza virus
LPFAAAPPK

SEQ ID NO: 476938 - protein, 9 aa, Influenza virus
LPFAAAPPV

SEQ ID NO: 476939 - protein, 9 aa, Influenza virus
LPFDFDKIS

SEQ ID NO: 476940 - protein, 9 aa, Influenza virus
LPFDIDKII

SEQ ID NO: 476941 - protein, 9 aa, Influenza virus
LPFHNIHPL

SEQ ID NO: 476942 - protein, 9 aa, Influenza virus
LPFHNISKY

SEQ ID NO: 476943 - protein, 9 aa, Influenza virus
LPFHNVHPF

SEQ ID NO: 476944 - protein, 9 aa, Influenza virus
LPFHNVHPL

SEQ ID NO: 476945 - protein, 9 aa, Influenza virus
LPFHNVSKY

SEQ ID NO: 476946 - protein, 9 aa, Influenza virus
LPFQNIDSR

SEQ ID NO: 476947 - protein, 9 aa, Influenza virus
LPFQNIDSW

SEQ ID NO: 476948 - protein, 9 aa, Influenza virus
LPFQNINPK

SEQ ID NO: 476949 - protein, 9 aa, Influenza virus
LPFQNINPR

SEQ ID NO: 476950 - protein, 9 aa, Influenza virus
LPFQNINSR

SEQ ID NO: 476951 - protein, 9 aa, Influenza virus
LPFQNISKY

SEQ ID NO: 476952 - protein, 9 aa, Influenza virus
LPFQNISPR

SEQ ID NO: 476953 - protein, 9 aa, Influenza virus
LPFQNLSPR

SEQ ID NO: 476954 - protein, 9 aa, Influenza virus
LPFQNVNSR

SEQ ID NO: 476955 - protein, 9 aa, Influenza virus
LPFQNVSKY

SEQ ID NO: 476956 - protein, 9 aa, Influenza virus
LPFQNVSRY

SEQ ID NO: 476957 - protein, 9 aa, Influenza virus
LPFQSINPR

SEQ ID NO: 476958 - protein, 9 aa, Influenza virus
LPLALGMKN

SEQ ID NO: 476959 - protein, 9 aa, Influenza virus
LPLCPFKGF

SEQ ID NO: 476960 - protein, 9 aa, Influenza virus
LPLCPFQGF

SEQ ID NO: 476961 - protein, 9 aa, Influenza virus
LPLCPFRGF

SEQ ID NO: 476962 - protein, 9 aa, Influenza virus
LPQSGRIVV

SEQ ID NO: 476963 - protein, 9 aa, Influenza virus
LPRRSGAAG

SEQ ID NO: 476964 - protein, 9 aa, Influenza virus
LPSDTPRGE

SEQ ID NO: 476965 - protein, 9 aa, Influenza virus
LPSFGVSGI

SEQ ID NO: 476966 - protein, 9 aa, Influenza virus
LPSFGVSGV

SEQ ID NO: 476967 - protein, 9 aa, Influenza virus
LPTFDSLNI

SEQ ID NO: 476968 - protein, 9 aa, Influenza virus
LPVAGGTGS

SEQ ID NO: 476969 - protein, 9 aa, Influenza virus
LPVAGGTSS

SEQ ID NO: 476970 - protein, 9 aa, Influenza virus
LPVGGNEKK

SEQ ID NO: 476971 - protein, 9 aa, Influenza virus
LPVSGGTSS

SEQ ID NO: 476972 - protein, 9 aa, Influenza virus
LPVTGGTSS

SEQ ID NO: 476973 - protein, 9 aa, Influenza virus
LQALQLLLE

SEQ ID NO: 476974 - protein, 9 aa, Influenza virus
LQANLCRFL

SEQ ID NO: 476975 - protein, 9 aa, Influenza virus
LQAYQKRMG

SEQ ID NO: 476976 - protein, 9 aa, Influenza virus
LQDNAKDEG

SEQ ID NO: 476977 - protein, 9 aa, Influenza virus
LQDTTWDVF

SEQ ID NO: 476978 - protein, 9 aa, Influenza virus
LQGSARHIE

SEQ ID NO: 476979 - protein, 9 aa, Influenza virus
LQGTKRSYE

SEQ ID NO: 476980 - protein, 9 aa, Influenza virus
LQIISLCSI

SEQ ID NO: 476981 - protein, 9 aa, Influenza virus
LQITSLCSI

SEQ ID NO: 476982 - protein, 9 aa, Influenza virus
LQLFIKDYR

SEQ ID NO: 476983 - protein, 9 aa, Influenza virus
LQLKDNAKE

SEQ ID NO: 476984 - protein, 9 aa, Influenza virus
LQLKDNARE

SEQ ID NO: 476985 - protein, 9 aa, Influenza virus
LQLLFEVEQ

SEQ ID NO: 476986 - protein, 9 aa, Influenza virus
LQLLLEVEN

SEQ ID NO: 476987 - protein, 9 aa, Influenza virus
LQLLLEVEQ

SEQ ID NO: 476988 - protein, 9 aa, Influenza virus
LQLLLEVES

SEQ ID NO: 476989 - protein, 9 aa, Influenza virus
LQLNPIDGP

SEQ ID NO: 476990 - protein, 9 aa, Influenza virus
LQLRDNAKE

SEQ ID NO: 476991 - protein, 9 aa, Influenza virus
LQLRDNARE

SEQ ID NO: 476992 - protein, 9 aa, Influenza virus
LQNASRHYM

SEQ ID NO: 476993 - protein, 9 aa, Influenza virus
LQNNAIDEG

SEQ ID NO: 476994 - protein, 9 aa, Influenza virus
LQNRIMINP

SEQ ID NO: 476995 - protein, 9 aa, Influenza virus
LQNRIQIDP

SEQ ID NO: 476996 - protein, 9 aa, Influenza virus
LQNRIQIDQ

SEQ ID NO: 476997 - protein, 9 aa, Influenza virus
LQNRIQIDS

SEQ ID NO: 476998 - protein, 9 aa, Influenza virus
LQNTSKHYI

SEQ ID NO: 476999 - protein, 9 aa, Influenza virus
LQQIESIIE

SEQ ID NO: 477000 - protein, 9 aa, Influenza virus
LQQIESMIE

SEQ ID NO: 477001 - protein, 9 aa, Influenza virus
LQQIESMVE

SEQ ID NO: 477002 - protein, 9 aa, Influenza virus
LQRRRFIQN

SEQ ID NO: 477003 - protein, 9 aa, Influenza virus
LQRRRFVQN

SEQ ID NO: 477004 - protein, 9 aa, Influenza virus
LQSFTPSPG

SEQ ID NO: 477005 - protein, 9 aa, Influenza virus
LQSLQQIES

SEQ ID NO: 477006 - protein, 9 aa, Influenza virus
LQSRTREIL

SEQ ID NO: 477007 - protein, 9 aa, Influenza virus
LQSSDDFAL

SEQ ID NO: 477008 - protein, 9 aa, Influenza virus
LQTYQKRMG

SEQ ID NO: 477009 - protein, 9 aa, Influenza virus
LRDCKIEAV

SEQ ID NO: 477010 - protein, 9 aa, Influenza virus
LRDCKVEAV

SEQ ID NO: 477011 - protein, 9 aa, Influenza virus
LRDCSIAGW

SEQ ID NO: 477012 - protein, 9 aa, Influenza virus
LRDCSVAGW

SEQ ID NO: 477013 - protein, 9 aa, Influenza virus
LRDNAKDEG

SEQ ID NO: 477014 - protein, 9 aa, Influenza virus
LRDNAKDLG

SEQ ID NO: 477015 - protein, 9 aa, Influenza virus
LRDNAKEIG

SEQ ID NO: 477016 - protein, 9 aa, Influenza virus
LRDNAKELG

SEQ ID NO: 477017 - protein, 9 aa, Influenza virus
LRDNAKETG

SEQ ID NO: 477018 - protein, 9 aa, Influenza virus
LRDNAMILG

SEQ ID NO: 477019 - protein, 9 aa, Influenza virus
LRDNANDLG

SEQ ID NO: 477020 - protein, 9 aa, Influenza virus
LRDNLEPGT

SEQ ID NO: 477021 - protein, 9 aa, Influenza virus
LRDNVKELG

SEQ ID NO: 477022 - protein, 9 aa, Influenza virus
LRDQGWSYI

SEQ ID NO: 477023 - protein, 9 aa, Influenza virus
LRDSLEPGT

SEQ ID NO: 477024 - protein, 9 aa, Influenza virus
LREHLSSVS

SEQ ID NO: 477025 - protein, 9 aa, Influenza virus
LRELWQCYY

SEQ ID NO: 477026 - protein, 9 aa, Influenza virus
LRENAEDIG

SEQ ID NO: 477027 - protein, 9 aa, Influenza virus
LRENAEDKG

SEQ ID NO: 477028 - protein, 9 aa, Influenza virus
LRENAEDLG

SEQ ID NO: 477029 - protein, 9 aa, Influenza virus
LRENAEDMG

SEQ ID NO: 477030 - protein, 9 aa, Influenza virus
LRENAEDQG

SEQ ID NO: 477031 - protein, 9 aa, Influenza virus
LRENAEDRG

SEQ ID NO: 477032 - protein, 9 aa, Influenza virus
LRENAEEDC

SEQ ID NO: 477033 - protein, 9 aa, Influenza virus
LRENAEEDG

SEQ ID NO: 477034 - protein, 9 aa, Influenza virus
LREQKQEFK

SEQ ID NO: 477035 - protein, 9 aa, Influenza virus
LREQLSSVS

SEQ ID NO: 477036 - protein, 9 aa, Influenza virus
LREQLSTVS

SEQ ID NO: 477037 - protein, 9 aa, Influenza virus
LRFLFSSIK

SEQ ID NO: 477038 - protein, 9 aa, Influenza virus
LRFVFSIAA

SEQ ID NO: 477039 - protein, 9 aa, Influenza virus
LRFVFSNAA

SEQ ID NO: 477040 - protein, 9 aa, Influenza virus
LRFVFSSAA

SEQ ID NO: 477041 - protein, 9 aa, Influenza virus
LRGFLIIGK

SEQ ID NO: 477042 - protein, 9 aa, Influenza virus
LRGFLILGK

SEQ ID NO: 477043 - protein, 9 aa, Influenza virus
LRGFLILGR

SEQ ID NO: 477044 - protein, 9 aa, Influenza virus
LRGGRNSFF

SEQ ID NO: 477045 - protein, 9 aa, Influenza virus
LRGIPPLEL

SEQ ID NO: 477046 - protein, 9 aa, Influenza virus
LRGQHANGT

SEQ ID NO: 477047 - protein, 9 aa, Influenza virus
LRGRGSTLG

SEQ ID NO: 477048 - protein, 9 aa, Influenza virus
LRGRHANGT

SEQ ID NO: 477049 - protein, 9 aa, Influenza virus
LRGSARHIE

SEQ ID NO: 477050 - protein, 9 aa, Influenza virus
LRGSIAHKS

SEQ ID NO: 477051 - protein, 9 aa, Influenza virus
LRGSVAHKS

SEQ ID NO: 477052 - protein, 9 aa, Influenza virus
LRHFQKDAK

SEQ ID NO: 477053 - protein, 9 aa, Influenza virus
LRHFQKDAR

SEQ ID NO: 477054 - protein, 9 aa, Influenza virus
LRHFQKNAK

SEQ ID NO: 477055 - protein, 9 aa, Influenza virus
LRHLFSGIK

SEQ ID NO: 477056 - protein, 9 aa, Influenza virus
LRHLFSGIR

SEQ ID NO: 477057 - protein, 9 aa, Influenza virus
LRHLFSGVN

SEQ ID NO: 477058 - protein, 9 aa, Influenza virus
LRIISNGNL

SEQ ID NO: 477059 - protein, 9 aa, Influenza virus
LRILIRGNS

SEQ ID NO: 477060 - protein, 9 aa, Influenza virus
LRILVRGNS

SEQ ID NO: 477061 - protein, 9 aa, Influenza virus
LRIPNAGID

SEQ ID NO: 477062 - protein, 9 aa, Influenza virus
LRIRSNENL

SEQ ID NO: 477063 - protein, 9 aa, Influenza virus
LRIRSNGNL

SEQ ID NO: 477064 - protein, 9 aa, Influenza virus
LRISSSFSF

SEQ ID NO: 477065 - protein, 9 aa, Influenza virus
LRKILRKSG

SEQ ID NO: 477066 - protein, 9 aa, Influenza virus
LRLAIGLRN

SEQ ID NO: 477067 - protein, 9 aa, Influenza virus
LRLALGLRN

SEQ ID NO: 477068 - protein, 9 aa, Influenza virus
LRLATGLRN

SEQ ID NO: 477069 - protein, 9 aa, Influenza virus
LRLAVGLRN

SEQ ID NO: 477070 - protein, 9 aa, Influenza virus
LRMARGLRN

SEQ ID NO: 477071 - protein, 9 aa, Influenza virus
LRMATGLRN

SEQ ID NO: 477072 - protein, 9 aa, Influenza virus
LRMKWMMAM

SEQ ID NO: 477073 - protein, 9 aa, Influenza virus
LRMVTGLRN

SEQ ID NO: 477074 - protein, 9 aa, Influenza virus
LRNDTDVVN

SEQ ID NO: 477075 - protein, 9 aa, Influenza virus
LRNGNMRCT

SEQ ID NO: 477076 - protein, 9 aa, Influenza virus
LRNIPSIQS

SEQ ID NO: 477077 - protein, 9 aa, Influenza virus
LRNIPSVQS

SEQ ID NO: 477078 - protein, 9 aa, Influenza virus
LRNTPSIDP

SEQ ID NO: 477079 - protein, 9 aa, Influenza virus
LRNTPSIEP

SEQ ID NO: 477080 - protein, 9 aa, Influenza virus
LRNTPSVEP

SEQ ID NO: 477081 - protein, 9 aa, Influenza virus
LRNVPSIQS

SEQ ID NO: 477082 - protein, 9 aa, Influenza virus
LRPGETLNV

SEQ ID NO: 477083 - protein, 9 aa, Influenza virus
LRPGQTLRV

SEQ ID NO: 477084 - protein, 9 aa, Influenza virus
LRQIIRESG

SEQ ID NO: 477085 - protein, 9 aa, Influenza virus
LRQILRESG

SEQ ID NO: 477086 - protein, 9 aa, Influenza virus
LRQILRGSG

SEQ ID NO: 477087 - protein, 9 aa, Influenza virus
LRQILRKSG

SEQ ID NO: 477088 - protein, 9 aa, Influenza virus
LRQILRRSG

SEQ ID NO: 477089 - protein, 9 aa, Influenza virus
LRQKIMESG

SEQ ID NO: 477090 - protein, 9 aa, Influenza virus
LRQNAEEDG

SEQ ID NO: 477091 - protein, 9 aa, Influenza virus
LRQNPTEEQ

SEQ ID NO: 477092 - protein, 9 aa, Influenza virus
LRQVLRESG

SEQ ID NO: 477093 - protein, 9 aa, Influenza virus
LRRCLLQSL

SEQ ID NO: 477094 - protein, 9 aa, Influenza virus
LRRDQKSLR

SEQ ID NO: 477095 - protein, 9 aa, Influenza virus
LRRIWRQAN

SEQ ID NO: 477096 - protein, 9 aa, Influenza virus
LRRQKSLIW

SEQ ID NO: 477097 - protein, 9 aa, Influenza virus
LRRQKWWVW

SEQ ID NO: 477098 - protein, 9 aa, Influenza virus
LRSGFEMLK

SEQ ID NO: 477099 - protein, 9 aa, Influenza virus
LRSGYEMLK

SEQ ID NO: 477100 - protein, 9 aa, Influenza virus
LRSGYETFK

SEQ ID NO: 477101 - protein, 9 aa, Influenza virus
LRSGYWAIR

SEQ ID NO: 477102 - protein, 9 aa, Influenza virus
LRSILANNG

SEQ ID NO: 477103 - protein, 9 aa, Influenza virus
LRSILASSG

SEQ ID NO: 477104 - protein, 9 aa, Influenza virus
LRSIVASSG

SEQ ID NO: 477105 - protein, 9 aa, Influenza virus
LRSKYWAIR

SEQ ID NO: 477106 - protein, 9 aa, Influenza virus
LRSLFSSIK

SEQ ID NO: 477107 - protein, 9 aa, Influenza virus
LRSLIASSG

SEQ ID NO: 477108 - protein, 9 aa, Influenza virus
LRSLVASSG

SEQ ID NO: 477109 - protein, 9 aa, Influenza virus
LRSNAPSGI

SEQ ID NO: 477110 - protein, 9 aa, Influenza virus
LRSNAPSGV

SEQ ID NO: 477111 - protein, 9 aa, Influenza virus
LRSRYWAIR

SEQ ID NO: 477112 - protein, 9 aa, Influenza virus
LRTHESECV

SEQ ID NO: 477113 - protein, 9 aa, Influenza virus
LRTQDSECV

SEQ ID NO: 477114 - protein, 9 aa, Influenza virus
LRTQESECA

SEQ ID NO: 477115 - protein, 9 aa, Influenza virus
LRTQESECI

SEQ ID NO: 477116 - protein, 9 aa, Influenza virus
LRTQESECQ

SEQ ID NO: 477117 - protein, 9 aa, Influenza virus
LRTQESECV

SEQ ID NO: 477118 - protein, 9 aa, Influenza virus
LRTQESSCT

SEQ ID NO: 477119 - protein, 9 aa, Influenza virus
LRTQESSCV

SEQ ID NO: 477120 - protein, 9 aa, Influenza virus
LRVKDQQGN

SEQ ID NO: 477121 - protein, 9 aa, Influenza virus
LRVKSNGNL

SEQ ID NO: 477122 - protein, 9 aa, Influenza virus
LRVPEWSYI

SEQ ID NO: 477123 - protein, 9 aa, Influenza virus
LRVPNALTD

SEQ ID NO: 477124 - protein, 9 aa, Influenza virus
LRVRDQLGN

SEQ ID NO: 477125 - protein, 9 aa, Influenza virus
LRVRDQMGN

SEQ ID NO: 477126 - protein, 9 aa, Influenza virus
LRVRDQQGN

SEQ ID NO: 477127 - protein, 9 aa, Influenza virus
LRVRDQRGN

SEQ ID NO: 477128 - protein, 9 aa, Influenza virus
LRVRSDGNL

SEQ ID NO: 477129 - protein, 9 aa, Influenza virus
LRVRSNGNL

SEQ ID NO: 477130 - protein, 9 aa, Influenza virus
LRWALGENM

SEQ ID NO: 477131 - protein, 9 aa, Influenza virus
LSAFDERRN

SEQ ID NO: 477132 - protein, 9 aa, Influenza virus
LSAGGAIWV

SEQ ID NO: 477133 - protein, 9 aa, Influenza virus
LSAGGAVWV

SEQ ID NO: 477134 - protein, 9 aa, Influenza virus
LSAGGDIWI

SEQ ID NO: 477135 - protein, 9 aa, Influenza virus
LSAGGDIWV

SEQ ID NO: 477136 - protein, 9 aa, Influenza virus
LSAGGHIWV

SEQ ID NO: 477137 - protein, 9 aa, Influenza virus
LSAGGNIWI

SEQ ID NO: 477138 - protein, 9 aa, Influenza virus
LSASGDIWI

SEQ ID NO: 477139 - protein, 9 aa, Influenza virus
LSASGDIWV

SEQ ID NO: 477140 - protein, 9 aa, Influenza virus
LSEQNVPVT

SEQ ID NO: 477141 - protein, 9 aa, Influenza virus
LSFQGRGVF

SEQ ID NO: 477142 - protein, 9 aa, Influenza virus
LSFQVDCFL

SEQ ID NO: 477143 - protein, 9 aa, Influenza virus
LSFTITGDN

SEQ ID NO: 477144 - protein, 9 aa, Influenza virus
LSFTVTGDN

SEQ ID NO: 477145 - protein, 9 aa, Influenza virus
LSFWMCSNG

SEQ ID NO: 477146 - protein, 9 aa, Influenza virus
LSGGAQHVE

SEQ ID NO: 477147 - protein, 9 aa, Influenza virus
LSGGGDIWV

SEQ ID NO: 477148 - protein, 9 aa, Influenza virus
LSGGYKDII

SEQ ID NO: 477149 - protein, 9 aa, Influenza virus
LSGGYKDVI

SEQ ID NO: 477150 - protein, 9 aa, Influenza virus
LSGIPPLEL

SEQ ID NO: 477151 - protein, 9 aa, Influenza virus
LSGIPPLVL

SEQ ID NO: 477152 - protein, 9 aa, Influenza virus
LSGMAIALS

SEQ ID NO: 477153 - protein, 9 aa, Influenza virus
LSGNAQHIE

SEQ ID NO: 477154 - protein, 9 aa, Influenza virus
LSGNAQHVE

SEQ ID NO: 477155 - protein, 9 aa, Influenza virus
LSGNGDPNN

SEQ ID NO: 477156 - protein, 9 aa, Influenza virus
LSGREWSYI

SEQ ID NO: 477157 - protein, 9 aa, Influenza virus
LSGSAQHIE

SEQ ID NO: 477158 - protein, 9 aa, Influenza virus
LSGSAQHVE

SEQ ID NO: 477159 - protein, 9 aa, Influenza virus
LSGVAIALN

SEQ ID NO: 477160 - protein, 9 aa, Influenza virus
LSGVAIALS

SEQ ID NO: 477161 - protein, 9 aa, Influenza virus
LSGVAISLS

SEQ ID NO: 477162 - protein, 9 aa, Influenza virus
LSGVAVALS

SEQ ID NO: 477163 - protein, 9 aa, Influenza virus
LSHTAYSQI

SEQ ID NO: 477164 - protein, 9 aa, Influenza virus
LSIAPIMFS

SEQ ID NO: 477165 - protein, 9 aa, Influenza virus
LSIEDPDHE

SEQ ID NO: 477166 - protein, 9 aa, Influenza virus
LSIEDPNHE

SEQ ID NO: 477167 - protein, 9 aa, Influenza virus
LSIEDPSHE

SEQ ID NO: 477168 - protein, 9 aa, Influenza virus
LSIEEPSHE

SEQ ID NO: 477169 - protein, 9 aa, Influenza virus
LSIENPSHE

SEQ ID NO: 477170 - protein, 9 aa, Influenza virus
LSIIPSGPL

SEQ ID NO: 477171 - protein, 9 aa, Influenza virus
LSILNLLIG

SEQ ID NO: 477172 - protein, 9 aa, Influenza virus
LSINPVKLS

SEQ ID NO: 477173 - protein, 9 aa, Influenza virus
LSISIGSST

SEQ ID NO: 477174 - protein, 9 aa, Influenza virus
LSISVESST

SEQ ID NO: 477175 - protein, 9 aa, Influenza virus
LSISVGSST

SEQ ID NO: 477176 - protein, 9 aa, Influenza virus
LSIVPSGPL

SEQ ID NO: 477177 - protein, 9 aa, Influenza virus
LSIYSCIAS

SEQ ID NO: 477178 - protein, 9 aa, Influenza virus
LSIYSCVAS

SEQ ID NO: 477179 - protein, 9 aa, Influenza virus
LSIYSSVAS

SEQ ID NO: 477180 - protein, 9 aa, Influenza virus
LSIYSTAAS

SEQ ID NO: 477181 - protein, 9 aa, Influenza virus
LSIYSTVAA

SEQ ID NO: 477182 - protein, 9 aa, Influenza virus
LSIYSTVAS

SEQ ID NO: 477183 - protein, 9 aa, Influenza virus
LSIYSTVTS

SEQ ID NO: 477184 - protein, 9 aa, Influenza virus
LSIYSTVVS

SEQ ID NO: 477185 - protein, 9 aa, Influenza virus
LSKDNAIRI

SEQ ID NO: 477186 - protein, 9 aa, Influenza virus
LSKDNGIRI

SEQ ID NO: 477187 - protein, 9 aa, Influenza virus
LSKDNSIRL

SEQ ID NO: 477188 - protein, 9 aa, Influenza virus
LSKRMEDGF

SEQ ID NO: 477189 - protein, 9 aa, Influenza virus
LSKSLCKVE

SEQ ID NO: 477190 - protein, 9 aa, Influenza virus
LSLAIMIAG

SEQ ID NO: 477191 - protein, 9 aa, Influenza virus
LSLAIMMAG

SEQ ID NO: 477192 - protein, 9 aa, Influenza virus
LSLAIMVAG

SEQ ID NO: 477193 - protein, 9 aa, Influenza virus
LSLIMRTVI

SEQ ID NO: 477194 - protein, 9 aa, Influenza virus
LSLLEMCHS

SEQ ID NO: 477195 - protein, 9 aa, Influenza virus
LSLWMCSNG

SEQ ID NO: 477196 - protein, 9 aa, Influenza virus
LSMAPIMFS

SEQ ID NO: 477197 - protein, 9 aa, Influenza virus
LSMEFSLTD

SEQ ID NO: 477198 - protein, 9 aa, Influenza virus
LSMVKSDKI

SEQ ID NO: 477199 - protein, 9 aa, Influenza virus
LSMVRSDKI

SEQ ID NO: 477200 - protein, 9 aa, Influenza virus
LSNMGIYQI

SEQ ID NO: 477201 - protein, 9 aa, Influenza virus
LSNMGVYQI

SEQ ID NO: 477202 - protein, 9 aa, Influenza virus
LSNNATDTV

SEQ ID NO: 477203 - protein, 9 aa, Influenza virus
LSNNSSDTV

SEQ ID NO: 477204 - protein, 9 aa, Influenza virus
LSNNSTDKI

SEQ ID NO: 477205 - protein, 9 aa, Influenza virus
LSNNSTDKV

SEQ ID NO: 477206 - protein, 9 aa, Influenza virus
LSNNSTDTV

SEQ ID NO: 477207 - protein, 9 aa, Influenza virus
LSNNSTEKV

SEQ ID NO: 477208 - protein, 9 aa, Influenza virus
LSNNSTERV

SEQ ID NO: 477209 - protein, 9 aa, Influenza virus
LSNPKCDLY

SEQ ID NO: 477210 - protein, 9 aa, Influenza virus
LSPEEVSET

SEQ ID NO: 477211 - protein, 9 aa, Influenza virus
LSPGMMMGM

SEQ ID NO: 477212 - protein, 9 aa, Influenza virus
LSPLTKGIL

SEQ ID NO: 477213 - protein, 9 aa, Influenza virus
LSPLTKGML

SEQ ID NO: 477214 - protein, 9 aa, Influenza virus
LSPNVYQAR

SEQ ID NO: 477215 - protein, 9 aa, Influenza virus
LSPRTVGQC

SEQ ID NO: 477216 - protein, 9 aa, Influenza virus
LSQCGLLGT

SEQ ID NO: 477217 - protein, 9 aa, Influenza virus
LSQGTTIRG

SEQ ID NO: 477218 - protein, 9 aa, Influenza virus
LSQGTTLKG

SEQ ID NO: 477219 - protein, 9 aa, Influenza virus
LSQGTTLRG

SEQ ID NO: 477220 - protein, 9 aa, Influenza virus
LSQKFEEIR

SEQ ID NO: 477221 - protein, 9 aa, Influenza virus
LSRCRETRG

SEQ ID NO: 477222 - protein, 9 aa, Influenza virus
LSRCRKTRG

SEQ ID NO: 477223 - protein, 9 aa, Influenza virus
LSSGYKDII

SEQ ID NO: 477224 - protein, 9 aa, Influenza virus
LSSGYKDVI

SEQ ID NO: 477225 - protein, 9 aa, Influenza virus
LSSGYKEVI

SEQ ID NO: 477226 - protein, 9 aa, Influenza virus
LSSKANQVF

SEQ ID NO: 477227 - protein, 9 aa, Influenza virus
LSSKDNQVF

SEQ ID NO: 477228 - protein, 9 aa, Influenza virus
LSSMGIYQI

SEQ ID NO: 477229 - protein, 9 aa, Influenza virus
LSSMGVYQI

SEQ ID NO: 477230 - protein, 9 aa, Influenza virus
LSSPPTVYN

SEQ ID NO: 477231 - protein, 9 aa, Influenza virus
LSSRISFYW

SEQ ID NO: 477232 - protein, 9 aa, Influenza virus
LSSSGNNQV

SEQ ID NO: 477233 - protein, 9 aa, Influenza virus
LSSSMNNQV

SEQ ID NO: 477234 - protein, 9 aa, Influenza virus
LSSVNTNTI

SEQ ID NO: 477235 - protein, 9 aa, Influenza virus
LSSVSSFEK

SEQ ID NO: 477236 - protein, 9 aa, Influenza virus
LSSVSSFER

SEQ ID NO: 477237 - protein, 9 aa, Influenza virus
LSSVSSFKR

SEQ ID NO: 477238 - protein, 9 aa, Influenza virus
LSSVTTNTI

SEQ ID NO: 477239 - protein, 9 aa, Influenza virus
LSTIALFIG

SEQ ID NO: 477240 - protein, 9 aa, Influenza virus
LSTIALIIG

SEQ ID NO: 477241 - protein, 9 aa, Influenza virus
LSTIALLIG

SEQ ID NO: 477242 - protein, 9 aa, Influenza virus
LSTKALLIG

SEQ ID NO: 477243 - protein, 9 aa, Influenza virus
LSTNSSDKV

SEQ ID NO: 477244 - protein, 9 aa, Influenza virus
LSTNSSEKV

SEQ ID NO: 477245 - protein, 9 aa, Influenza virus
LSTNSSERV

SEQ ID NO: 477246 - protein, 9 aa, Influenza virus
LSTNSTEKV

SEQ ID NO: 477247 - protein, 9 aa, Influenza virus
LSTNSTETV

SEQ ID NO: 477248 - protein, 9 aa, Influenza virus
LSTRGIQIA

SEQ ID NO: 477249 - protein, 9 aa, Influenza virus
LSTRGVQIA

SEQ ID NO: 477250 - protein, 9 aa, Influenza virus
LSTRGVQVA

SEQ ID NO: 477251 - protein, 9 aa, Influenza virus
LSTVLGVSI

SEQ ID NO: 477252 - protein, 9 aa, Influenza virus
LSTVSSFER

SEQ ID NO: 477253 - protein, 9 aa, Influenza virus
LSVAPIMFS

SEQ ID NO: 477254 - protein, 9 aa, Influenza virus
LSVIPSGPL

SEQ ID NO: 477255 - protein, 9 aa, Influenza virus
LSVLNLLIG

SEQ ID NO: 477256 - protein, 9 aa, Influenza virus
LSVPEWSYI

SEQ ID NO: 477257 - protein, 9 aa, Influenza virus
LSVVNLLIG

SEQ ID NO: 477258 - protein, 9 aa, Influenza virus
LSVVSLLIG

SEQ ID NO: 477259 - protein, 9 aa, Influenza virus
LSVVSLLVG

SEQ ID NO: 477260 - protein, 9 aa, Influenza virus
LSVYSTVAS

SEQ ID NO: 477261 - protein, 9 aa, Influenza virus
LSYKVGYLC

SEQ ID NO: 477262 - protein, 9 aa, Influenza virus
LSYQVGYLC

SEQ ID NO: 477263 - protein, 9 aa, Influenza virus
LSYRVGYLC

SEQ ID NO: 477264 - protein, 9 aa, Influenza virus
LSYSAGALA

SEQ ID NO: 477265 - protein, 9 aa, Influenza virus
LSYSTGALA

SEQ ID NO: 477266 - protein, 9 aa, Influenza virus
LSYSVGYLC

SEQ ID NO: 477267 - protein, 9 aa, Influenza virus
LSYTVGYLC

SEQ ID NO: 477268 - protein, 9 aa, Influenza virus
LTDAEMNKL

SEQ ID NO: 477269 - protein, 9 aa, Influenza virus
LTDKGSIQS

SEQ ID NO: 477270 - protein, 9 aa, Influenza virus
LTDNHVEVV

SEQ ID NO: 477271 - protein, 9 aa, Influenza virus
LTDNPRPND

SEQ ID NO: 477272 - protein, 9 aa, Influenza virus
LTDSEMNKL

SEQ ID NO: 477273 - protein, 9 aa, Influenza virus
LTDSEMSKL

SEQ ID NO: 477274 - protein, 9 aa, Influenza virus
LTDSQTATK

SEQ ID NO: 477275 - protein, 9 aa, Influenza virus
LTDTSRPGD

SEQ ID NO: 477276 - protein, 9 aa, Influenza virus
LTDTSRPKD

SEQ ID NO: 477277 - protein, 9 aa, Influenza virus
LTDTSRPND

SEQ ID NO: 477278 - protein, 9 aa, Influenza virus
LTDTSRPSD

SEQ ID NO: 477279 - protein, 9 aa, Influenza virus
LTDTSRPTD

SEQ ID NO: 477280 - protein, 9 aa, Influenza virus
LTDWSGYSG

SEQ ID NO: 477281 - protein, 9 aa, Influenza virus
LTEIWSYNA

SEQ ID NO: 477282 - protein, 9 aa, Influenza virus
LTEKGIEVV

SEQ ID NO: 477283 - protein, 9 aa, Influenza virus
LTEKGVEVV

SEQ ID NO: 477284 - protein, 9 aa, Influenza virus
LTENGVPVT

SEQ ID NO: 477285 - protein, 9 aa, Influenza virus
LTEQNVPVT

SEQ ID NO: 477286 - protein, 9 aa, Influenza virus
LTEREVEVV

SEQ ID NO: 477287 - protein, 9 aa, Influenza virus
LTERGIEVV

SEQ ID NO: 477288 - protein, 9 aa, Influenza virus
LTERGVEVV

SEQ ID NO: 477289 - protein, 9 aa, Influenza virus
LTETGVPVT

SEQ ID NO: 477290 - protein, 9 aa, Influenza virus
LTEVETYVL

SEQ ID NO: 477291 - protein, 9 aa, Influenza virus
LTFLARSAL

SEQ ID NO: 477292 - protein, 9 aa, Influenza virus
LTGGQSFYR

SEQ ID NO: 477293 - protein, 9 aa, Influenza virus
LTGIWDTLI

SEQ ID NO: 477294 - protein, 9 aa, Influenza virus
LTGMWDTLI

SEQ ID NO: 477295 - protein, 9 aa, Influenza virus
LTGNLQTLK

SEQ ID NO: 477296 - protein, 9 aa, Influenza virus
LTGNLQTLR

SEQ ID NO: 477297 - protein, 9 aa, Influenza virus
LTGRGIEVV

SEQ ID NO: 477298 - protein, 9 aa, Influenza virus
LTGSAQHIE

SEQ ID NO: 477299 - protein, 9 aa, Influenza virus
LTGTAKHIE

SEQ ID NO: 477300 - protein, 9 aa, Influenza virus
LTGTWDTLI

SEQ ID NO: 477301 - protein, 9 aa, Influenza virus
LTHALRELW

SEQ ID NO: 477302 - protein, 9 aa, Influenza virus
LTHGSLLND

SEQ ID NO: 477303 - protein, 9 aa, Influenza virus
LTHHMRKKR

SEQ ID NO: 477304 - protein, 9 aa, Influenza virus
LTHIMIWHS

SEQ ID NO: 477305 - protein, 9 aa, Influenza virus
LTHLMIWHS

SEQ ID NO: 477306 - protein, 9 aa, Influenza virus
LTHMMIWHS

SEQ ID NO: 477307 - protein, 9 aa, Influenza virus
LTHQSGTYP

SEQ ID NO: 477308 - protein, 9 aa, Influenza virus
LTIAMGLVF

SEQ ID NO: 477309 - protein, 9 aa, Influenza virus
LTIGECPKY

SEQ ID NO: 477310 - protein, 9 aa, Influenza virus
LTIGECPRY

SEQ ID NO: 477311 - protein, 9 aa, Influenza virus
LTIGISGPD

SEQ ID NO: 477312 - protein, 9 aa, Influenza virus
LTIGITGPD

SEQ ID NO: 477313 - protein, 9 aa, Influenza virus
LTIGKCPKY

SEQ ID NO: 477314 - protein, 9 aa, Influenza virus
LTIGVSGPD

SEQ ID NO: 477315 - protein, 9 aa, Influenza virus
LTIIYSSSM

SEQ ID NO: 477316 - protein, 9 aa, Influenza virus
LTILGKDAG

SEQ ID NO: 477317 - protein, 9 aa, Influenza virus
LTITYSSPM

SEQ ID NO: 477318 - protein, 9 aa, Influenza virus
LTITYSSSL

SEQ ID NO: 477319 - protein, 9 aa, Influenza virus
LTITYSSSM

SEQ ID NO: 477320 - protein, 9 aa, Influenza virus
LTIYSTAAS

SEQ ID NO: 477321 - protein, 9 aa, Influenza virus
LTIYSTVAS

SEQ ID NO: 477322 - protein, 9 aa, Influenza virus
LTKATNGNY

SEQ ID NO: 477323 - protein, 9 aa, Influenza virus
LTKELCTIN

SEQ ID NO: 477324 - protein, 9 aa, Influenza virus
LTKETNGNY

SEQ ID NO: 477325 - protein, 9 aa, Influenza virus
LTKGEKANV

SEQ ID NO: 477326 - protein, 9 aa, Influenza virus
LTKGILGFV

SEQ ID NO: 477327 - protein, 9 aa, Influenza virus
LTKGLCTIN

SEQ ID NO: 477328 - protein, 9 aa, Influenza virus
LTKGMLGFV

SEQ ID NO: 477329 - protein, 9 aa, Influenza virus
LTKGVLGFV

SEQ ID NO: 477330 - protein, 9 aa, Influenza virus
LTKINNGDY

SEQ ID NO: 477331 - protein, 9 aa, Influenza virus
LTKITVDHM

SEQ ID NO: 477332 - protein, 9 aa, Influenza virus
LTKKEPDTY

SEQ ID NO: 477333 - protein, 9 aa, Influenza virus
LTKKKNPEA

SEQ ID NO: 477334 - protein, 9 aa, Influenza virus
LTKKKPDIY

SEQ ID NO: 477335 - protein, 9 aa, Influenza virus
LTKKKPDTY

SEQ ID NO: 477336 - protein, 9 aa, Influenza virus
LTKRLCTIN

SEQ ID NO: 477337 - protein, 9 aa, Influenza virus
LTKTNNGDY

SEQ ID NO: 477338 - protein, 9 aa, Influenza virus
LTKTTVDHM

SEQ ID NO: 477339 - protein, 9 aa, Influenza virus
LTKVNNGDY

SEQ ID NO: 477340 - protein, 9 aa, Influenza virus
LTKVNNGNY

SEQ ID NO: 477341 - protein, 9 aa, Influenza virus
LTKVNSGDY

SEQ ID NO: 477342 - protein, 9 aa, Influenza virus
LTLGITGPD

SEQ ID NO: 477343 - protein, 9 aa, Influenza virus
LTLKLGQFP

SEQ ID NO: 477344 - protein, 9 aa, Influenza virus
LTLKSEQFP

SEQ ID NO: 477345 - protein, 9 aa, Influenza virus
LTLKSGQFP

SEQ ID NO: 477346 - protein, 9 aa, Influenza virus
LTLNTMTKD

SEQ ID NO: 477347 - protein, 9 aa, Influenza virus
LTMGECPKY

SEQ ID NO: 477348 - protein, 9 aa, Influenza virus
LTMGYKDII

SEQ ID NO: 477349 - protein, 9 aa, Influenza virus
LTMITYITR

SEQ ID NO: 477350 - protein, 9 aa, Influenza virus
LTNSEMNKL

SEQ ID NO: 477351 - protein, 9 aa, Influenza virus
LTQGACWEQ

SEQ ID NO: 477352 - protein, 9 aa, Influenza virus
LTQGALLND

SEQ ID NO: 477353 - protein, 9 aa, Influenza virus
LTQGRQTFD

SEQ ID NO: 477354 - protein, 9 aa, Influenza virus
LTQGRQTYD

SEQ ID NO: 477355 - protein, 9 aa, Influenza virus
LTQGSLLND

SEQ ID NO: 477356 - protein, 9 aa, Influenza virus
LTQGSLPND

SEQ ID NO: 477357 - protein, 9 aa, Influenza virus
LTQGTCWEQ

SEQ ID NO: 477358 - protein, 9 aa, Influenza virus
LTQGYKDII

SEQ ID NO: 477359 - protein, 9 aa, Influenza virus
LTQISNTNI

SEQ ID NO: 477360 - protein, 9 aa, Influenza virus
LTQTLVSNN

SEQ ID NO: 477361 - protein, 9 aa, Influenza virus
LTRELCTIN

SEQ ID NO: 477362 - protein, 9 aa, Influenza virus
LTREPYVSC

SEQ ID NO: 477363 - protein, 9 aa, Influenza virus
LTRGLCTIN

SEQ ID NO: 477364 - protein, 9 aa, Influenza virus
LTRTTVDHM

SEQ ID NO: 477365 - protein, 9 aa, Influenza virus
LTSLPFQNI

SEQ ID NO: 477366 - protein, 9 aa, Influenza virus
LTSVTTNTI

SEQ ID NO: 477367 - protein, 9 aa, Influenza virus
LTTGKSHGR

SEQ ID NO: 477368 - protein, 9 aa, Influenza virus
LTTIGLLLQ

SEQ ID NO: 477369 - protein, 9 aa, Influenza virus
LTTRGVQIA

SEQ ID NO: 477370 - protein, 9 aa, Influenza virus
LTTTIKPWA

SEQ ID NO: 477371 - protein, 9 aa, Influenza virus
LTTTIKTWA

SEQ ID NO: 477372 - protein, 9 aa, Influenza virus
LTTTIRTWA

SEQ ID NO: 477373 - protein, 9 aa, Influenza virus
LTTTPTKSY

SEQ ID NO: 477374 - protein, 9 aa, Influenza virus
LTTTVKTWA

SEQ ID NO: 477375 - protein, 9 aa, Influenza virus
LTTVGLLLQ

SEQ ID NO: 477376 - protein, 9 aa, Influenza virus
LTVEVPYVC

SEQ ID NO: 477377 - protein, 9 aa, Influenza virus
LTVLGKDAG

SEQ ID NO: 477378 - protein, 9 aa, Influenza virus
LTVNVRGSG

SEQ ID NO: 477379 - protein, 9 aa, Influenza virus
LTVNVRGTG

SEQ ID NO: 477380 - protein, 9 aa, Influenza virus
LTVPEWSYI

SEQ ID NO: 477381 - protein, 9 aa, Influenza virus
LTVPSERGL

SEQ ID NO: 477382 - protein, 9 aa, Influenza virus
LTVSVRGSG

SEQ ID NO: 477383 - protein, 9 aa, Influenza virus
LVADGGPNL

SEQ ID NO: 477384 - protein, 9 aa, Influenza virus
LVAGGLILG

SEQ ID NO: 477385 - protein, 9 aa, Influenza virus
LVAGWYGFQ

SEQ ID NO: 477386 - protein, 9 aa, Influenza virus
LVAIENQHT

SEQ ID NO: 477387 - protein, 9 aa, Influenza virus
LVALALSHT

SEQ ID NO: 477388 - protein, 9 aa, Influenza virus
LVALCGSPI

SEQ ID NO: 477389 - protein, 9 aa, Influenza virus
LVALCGSPV

SEQ ID NO: 477390 - protein, 9 aa, Influenza virus
LVALENQHT

SEQ ID NO: 477391 - protein, 9 aa, Influenza virus
LVALENQNT

SEQ ID NO: 477392 - protein, 9 aa, Influenza virus
LVAMENQHT

SEQ ID NO: 477393 - protein, 9 aa, Influenza virus
LVAPEYGFK

SEQ ID NO: 477394 - protein, 9 aa, Influenza virus
LVAPRGHYK

SEQ ID NO: 477395 - protein, 9 aa, Influenza virus
LVAPRGYFK

SEQ ID NO: 477396 - protein, 9 aa, Influenza virus
LVAPSRVSK

SEQ ID NO: 477397 - protein, 9 aa, Influenza virus
LVAPWYAYK

SEQ ID NO: 477398 - protein, 9 aa, Influenza virus
LVAPWYAYR

SEQ ID NO: 477399 - protein, 9 aa, Influenza virus
LVASSGNLE

SEQ ID NO: 477400 - protein, 9 aa, Influenza virus
LVASSGTLE

SEQ ID NO: 477401 - protein, 9 aa, Influenza virus
LVAVENQHT

SEQ ID NO: 477402 - protein, 9 aa, Influenza virus
LVCATCEQI

SEQ ID NO: 477403 - protein, 9 aa, Influenza virus
LVCVSLLQS

SEQ ID NO: 477404 - protein, 9 aa, Influenza virus
LVDALLGDP

SEQ ID NO: 477405 - protein, 9 aa, Influenza virus
LVDGQDCDL

SEQ ID NO: 477406 - protein, 9 aa, Influenza virus
LVDGWYGFR

SEQ ID NO: 477407 - protein, 9 aa, Influenza virus
LVDGWYGYH

SEQ ID NO: 477408 - protein, 9 aa, Influenza virus
LVDSIGSWS

SEQ ID NO: 477409 - protein, 9 aa, Influenza virus
LVDSIVSWS

SEQ ID NO: 477410 - protein, 9 aa, Influenza virus
LVETNHTDE

SEQ ID NO: 477411 - protein, 9 aa, Influenza virus
LVETNHTGT

SEQ ID NO: 477412 - protein, 9 aa, Influenza virus
LVETSHTGT

SEQ ID NO: 477413 - protein, 9 aa, Influenza virus
LVFFCLKNG

SEQ ID NO: 477414 - protein, 9 aa, Influenza virus
LVFFCLRNG

SEQ ID NO: 477415 - protein, 9 aa, Influenza virus
LVFICIKNG

SEQ ID NO: 477416 - protein, 9 aa, Influenza virus
LVFICMKNG

SEQ ID NO: 477417 - protein, 9 aa, Influenza virus
LVFICVKNG

SEQ ID NO: 477418 - protein, 9 aa, Influenza virus
LVFMCVKNG

SEQ ID NO: 477419 - protein, 9 aa, Influenza virus
LVFNTVIHE

SEQ ID NO: 477420 - protein, 9 aa, Influenza virus
LVFNTVIHG

SEQ ID NO: 477421 - protein, 9 aa, Influenza virus
LVFREQKQE

SEQ ID NO: 477422 - protein, 9 aa, Influenza virus
LVGDTPRND

SEQ ID NO: 477423 - protein, 9 aa, Influenza virus
LVGDTPRNE

SEQ ID NO: 477424 - protein, 9 aa, Influenza virus
LVGDTPRNG

SEQ ID NO: 477425 - protein, 9 aa, Influenza virus
LVGDTPRNN

SEQ ID NO: 477426 - protein, 9 aa, Influenza virus
LVGDTPRSD

SEQ ID NO: 477427 - protein, 9 aa, Influenza virus
LVGIDPFKL

SEQ ID NO: 477428 - protein, 9 aa, Influenza virus
LVGIDPFRL

SEQ ID NO: 477429 - protein, 9 aa, Influenza virus
LVGINMSKK

SEQ ID NO: 477430 - protein, 9 aa, Influenza virus
LVGINMSKR

SEQ ID NO: 477431 - protein, 9 aa, Influenza virus
LVGLILAFI

SEQ ID NO: 477432 - protein, 9 aa, Influenza virus
LVGLILSFI

SEQ ID NO: 477433 - protein, 9 aa, Influenza virus
LVGLILTFI

SEQ ID NO: 477434 - protein, 9 aa, Influenza virus
LVGPILSFI

SEQ ID NO: 477435 - protein, 9 aa, Influenza virus
LVGSSTYQN

SEQ ID NO: 477436 - protein, 9 aa, Influenza virus
LVGTKHSNG

SEQ ID NO: 477437 - protein, 9 aa, Influenza virus
LVGVDPFKL

SEQ ID NO: 477438 - protein, 9 aa, Influenza virus
LVGVDPFRL

SEQ ID NO: 477439 - protein, 9 aa, Influenza virus
LVHQSGTYP

SEQ ID NO: 477440 - protein, 9 aa, Influenza virus
LVIAARNIV

SEQ ID NO: 477441 - protein, 9 aa, Influenza virus
LVISPDLSY

SEQ ID NO: 477442 - protein, 9 aa, Influenza virus
LVISSDLSY

SEQ ID NO: 477443 - protein, 9 aa, Influenza virus
LVISTDLSY

SEQ ID NO: 477444 - protein, 9 aa, Influenza virus
LVIWGIHHP

SEQ ID NO: 477445 - protein, 9 aa, Influenza virus
LVIWGVHHP

SEQ ID NO: 477446 - protein, 9 aa, Influenza virus
LVIWGVHHS

SEQ ID NO: 477447 - protein, 9 aa, Influenza virus
LVLAAGLRN

SEQ ID NO: 477448 - protein, 9 aa, Influenza virus
LVLAAIIMG

SEQ ID NO: 477449 - protein, 9 aa, Influenza virus
LVLAALIMG

SEQ ID NO: 477450 - protein, 9 aa, Influenza virus
LVLAALNMG

SEQ ID NO: 477451 - protein, 9 aa, Influenza virus
LVLAASIMG

SEQ ID NO: 477452 - protein, 9 aa, Influenza virus
LVLATGLRN

SEQ ID NO: 477453 - protein, 9 aa, Influenza virus
LVLATGPRN

SEQ ID NO: 477454 - protein, 9 aa, Influenza virus
LVLDDCSLE

SEQ ID NO: 477455 - protein, 9 aa, Influenza virus
LVLDDCSLK

SEQ ID NO: 477456 - protein, 9 aa, Influenza virus
LVLGDCSIA

SEQ ID NO: 477457 - protein, 9 aa, Influenza virus
LVLGLSMVK

SEQ ID NO: 477458 - protein, 9 aa, Influenza virus
LVLGLSMVR

SEQ ID NO: 477459 - protein, 9 aa, Influenza virus
LVLGNPKCD

SEQ ID NO: 477460 - protein, 9 aa, Influenza virus
LVLIENDRT

SEQ ID NO: 477461 - protein, 9 aa, Influenza virus
LVLIENERT

SEQ ID NO: 477462 - protein, 9 aa, Influenza virus
LVLIENQKT

SEQ ID NO: 477463 - protein, 9 aa, Influenza virus
LVLIVSLGA

SEQ ID NO: 477464 - protein, 9 aa, Influenza virus
LVLLEDERT

SEQ ID NO: 477465 - protein, 9 aa, Influenza virus
LVLLENDKT

SEQ ID NO: 477466 - protein, 9 aa, Influenza virus
LVLLENDRT

SEQ ID NO: 477467 - protein, 9 aa, Influenza virus
LVLLENEKT

SEQ ID NO: 477468 - protein, 9 aa, Influenza virus
LVLLENERT

SEQ ID NO: 477469 - protein, 9 aa, Influenza virus
LVLLENGRT

SEQ ID NO: 477470 - protein, 9 aa, Influenza virus
LVLLENQKI

SEQ ID NO: 477471 - protein, 9 aa, Influenza virus
LVLLENQKP

SEQ ID NO: 477472 - protein, 9 aa, Influenza virus
LVLLENQKT

SEQ ID NO: 477473 - protein, 9 aa, Influenza virus
LVLLFMIIG

SEQ ID NO: 477474 - protein, 9 aa, Influenza virus
LVLLGNQKT

SEQ ID NO: 477475 - protein, 9 aa, Influenza virus
LVLLLMIIG

SEQ ID NO: 477476 - protein, 9 aa, Influenza virus
LVLLVSLGA

SEQ ID NO: 477477 - protein, 9 aa, Influenza virus
LVLMENEMT

SEQ ID NO: 477478 - protein, 9 aa, Influenza virus
LVLMENERT

SEQ ID NO: 477479 - protein, 9 aa, Influenza virus
LVLNKSLCK

SEQ ID NO: 477480 - protein, 9 aa, Influenza virus
LVLVVSLGA

SEQ ID NO: 477481 - protein, 9 aa, Influenza virus
LVLWAIHHP

SEQ ID NO: 477482 - protein, 9 aa, Influenza virus
LVLWGIHHP

SEQ ID NO: 477483 - protein, 9 aa, Influenza virus
LVLWGVHHP

SEQ ID NO: 477484 - protein, 9 aa, Influenza virus
LVMGQQGRM

SEQ ID NO: 477485 - protein, 9 aa, Influenza virus
LVMKRKRDS

SEQ ID NO: 477486 - protein, 9 aa, Influenza virus
LVMKRKRNS

SEQ ID NO: 477487 - protein, 9 aa, Influenza virus
LVMWGIHHP

SEQ ID NO: 477488 - protein, 9 aa, Influenza virus
LVMWGLHHP

SEQ ID NO: 477489 - protein, 9 aa, Influenza virus
LVNGQRGRI

SEQ ID NO: 477490 - protein, 9 aa, Influenza virus
LVNLGLNIG

SEQ ID NO: 477491 - protein, 9 aa, Influenza virus
LVNPGDSII

SEQ ID NO: 477492 - protein, 9 aa, Influenza virus
LVNTYQWII

SEQ ID NO: 477493 - protein, 9 aa, Influenza virus
LVNTYQWVI

SEQ ID NO: 477494 - protein, 9 aa, Influenza virus
LVPCEPIII

SEQ ID NO: 477495 - protein, 9 aa, Influenza virus
LVPCFWLEM

SEQ ID NO: 477496 - protein, 9 aa, Influenza virus
LVPCFWVEM

SEQ ID NO: 477497 - protein, 9 aa, Influenza virus
LVQLIVSGK

SEQ ID NO: 477498 - protein, 9 aa, Influenza virus
LVQLIVSGR

SEQ ID NO: 477499 - protein, 9 aa, Influenza virus
LVQNSITIE

SEQ ID NO: 477500 - protein, 9 aa, Influenza virus
LVREQQGRM

SEQ ID NO: 477501 - protein, 9 aa, Influenza virus
LVRGNSPAF

SEQ ID NO: 477502 - protein, 9 aa, Influenza virus
LVRGNSPVF

SEQ ID NO: 477503 - protein, 9 aa, Influenza virus
LVRGQQGRM

SEQ ID NO: 477504 - protein, 9 aa, Influenza virus
LVRGQQGTM

SEQ ID NO: 477505 - protein, 9 aa, Influenza virus
LVRGQQGWM

SEQ ID NO: 477506 - protein, 9 aa, Influenza virus
LVRGRPKES

SEQ ID NO: 477507 - protein, 9 aa, Influenza virus
LVRGRPQET

SEQ ID NO: 477508 - protein, 9 aa, Influenza virus
LVRKTRFLP

SEQ ID NO: 477509 - protein, 9 aa, Influenza virus
LVRMIKRGI

SEQ ID NO: 477510 - protein, 9 aa, Influenza virus
LVRSGMDPR

SEQ ID NO: 477511 - protein, 9 aa, Influenza virus
LVRTGMDPR

SEQ ID NO: 477512 - protein, 9 aa, Influenza virus
LVSDGGPNL

SEQ ID NO: 477513 - protein, 9 aa, Influenza virus
LVSLGAIGF

SEQ ID NO: 477514 - protein, 9 aa, Influenza virus
LVSLGAISF

SEQ ID NO: 477515 - protein, 9 aa, Influenza virus
LVSLGAVSF

SEQ ID NO: 477516 - protein, 9 aa, Influenza virus
LVSNNDWSG

SEQ ID NO: 477517 - protein, 9 aa, Influenza virus
LVSNSDWSG

SEQ ID NO: 477518 - protein, 9 aa, Influenza virus
LVSTKEWSK

SEQ ID NO: 477519 - protein, 9 aa, Influenza virus
LVSTKEWSR

SEQ ID NO: 477520 - protein, 9 aa, Influenza virus
LVSTNAYDR

SEQ ID NO: 477521 - protein, 9 aa, Influenza virus
LVSWEMGQA

SEQ ID NO: 477522 - protein, 9 aa, Influenza virus
LVSWPLSSP

SEQ ID NO: 477523 - protein, 9 aa, Influenza virus
LVTDGPSDA

SEQ ID NO: 477524 - protein, 9 aa, Influenza virus
LVTGKSHGR

SEQ ID NO: 477525 - protein, 9 aa, Influenza virus
LVTREPYIS

SEQ ID NO: 477526 - protein, 9 aa, Influenza virus
LVTREPYLS

SEQ ID NO: 477527 - protein, 9 aa, Influenza virus
LVTREPYVS

SEQ ID NO: 477528 - protein, 9 aa, Influenza virus
LVTTVTLHF

SEQ ID NO: 477529 - protein, 9 aa, Influenza virus
LVVPEYGFK

SEQ ID NO: 477530 - protein, 9 aa, Influenza virus
LVVSLGAIS

SEQ ID NO: 477531 - protein, 9 aa, Influenza virus
LVVSPDLSY

SEQ ID NO: 477532 - protein, 9 aa, Influenza virus
LVWLENEKT

SEQ ID NO: 477533 - protein, 9 aa, Influenza virus
LVWMACHSA

SEQ ID NO: 477534 - protein, 9 aa, Influenza virus
LVWMACNSA

SEQ ID NO: 477535 - protein, 9 aa, Influenza virus
LVYGNPACD

SEQ ID NO: 477536 - protein, 9 aa, Influenza virus
LVYGNPSCD

SEQ ID NO: 477537 - protein, 9 aa, Influenza virus
LWACQNGNI

SEQ ID NO: 477538 - protein, 9 aa, Influenza virus
LWACQNGNL

SEQ ID NO: 477539 - protein, 9 aa, Influenza virus
LWACQNGNV

SEQ ID NO: 477540 - protein, 9 aa, Influenza virus
LWACQTGNI

SEQ ID NO: 477541 - protein, 9 aa, Influenza virus
LWACSSGNC

SEQ ID NO: 477542 - protein, 9 aa, Influenza virus
LWAYNAELL

SEQ ID NO: 477543 - protein, 9 aa, Influenza virus
LWCKIVTTV

SEQ ID NO: 477544 - protein, 9 aa, Influenza virus
LWDSFRQSE

SEQ ID NO: 477545 - protein, 9 aa, Influenza virus
LWFSFGASC

SEQ ID NO: 477546 - protein, 9 aa, Influenza virus
LWFSFGASS

SEQ ID NO: 477547 - protein, 9 aa, Influenza virus
LWFSLGASC

SEQ ID NO: 477548 - protein, 9 aa, Influenza virus
LWGIHHPDS

SEQ ID NO: 477549 - protein, 9 aa, Influenza virus
LWGIHHPDT

SEQ ID NO: 477550 - protein, 9 aa, Influenza virus
LWGIHHPPD

SEQ ID NO: 477551 - protein, 9 aa, Influenza virus
LWGIHHPPN

SEQ ID NO: 477552 - protein, 9 aa, Influenza virus
LWGVHHPSS

SEQ ID NO: 477553 - protein, 9 aa, Influenza virus
LWHVRKRFA

SEQ ID NO: 477554 - protein, 9 aa, Influenza virus
LWISFAISC

SEQ ID NO: 477555 - protein, 9 aa, Influenza virus
LWISFAMSC

SEQ ID NO: 477556 - protein, 9 aa, Influenza virus
LWISFATSC

SEQ ID NO: 477557 - protein, 9 aa, Influenza virus
LWISFSISC

SEQ ID NO: 477558 - protein, 9 aa, Influenza virus
LWISFSMSC

SEQ ID NO: 477559 - protein, 9 aa, Influenza virus
LWLVLREKM

SEQ ID NO: 477560 - protein, 9 aa, Influenza virus
LWMCFNGSL

SEQ ID NO: 477561 - protein, 9 aa, Influenza virus
LWMCSNGSL

SEQ ID NO: 477562 - protein, 9 aa, Influenza virus
LWMCSNGSY

SEQ ID NO: 477563 - protein, 9 aa, Influenza virus
LWSYNAELL

SEQ ID NO: 477564 - protein, 9 aa, Influenza virus
LWSYNAGLL

SEQ ID NO: 477565 - protein, 9 aa, Influenza virus
LWSYNAQLL

SEQ ID NO: 477566 - protein, 9 aa, Influenza virus
LWTSNSIVA

SEQ ID NO: 477567 - protein, 9 aa, Influenza virus
LWTSNSIVV

SEQ ID NO: 477568 - protein, 9 aa, Influenza virus
LWTSNSMVA

SEQ ID NO: 477569 - protein, 9 aa, Influenza virus
LWTSNSVVA

SEQ ID NO: 477570 - protein, 9 aa, Influenza virus
LWTYNAELL

SEQ ID NO: 477571 - protein, 9 aa, Influenza virus
LWVSFSISC

SEQ ID NO: 477572 - protein, 9 aa, Influenza virus
LYASKNPYT

SEQ ID NO: 477573 - protein, 9 aa, Influenza virus
LYASPQLEG

SEQ ID NO: 477574 - protein, 9 aa, Influenza virus
LYASSQLEG

SEQ ID NO: 477575 - protein, 9 aa, Influenza virus
LYDAIEECL

SEQ ID NO: 477576 - protein, 9 aa, Influenza virus
LYDKVRFQL

SEQ ID NO: 477577 - protein, 9 aa, Influenza virus
LYDKVRHQL

SEQ ID NO: 477578 - protein, 9 aa, Influenza virus
LYDKVRLQL

SEQ ID NO: 477579 - protein, 9 aa, Influenza virus
LYDKVRMQL

SEQ ID NO: 477580 - protein, 9 aa, Influenza virus
LYDRVRKQL

SEQ ID NO: 477581 - protein, 9 aa, Influenza virus
LYDRVRLQL

SEQ ID NO: 477582 - protein, 9 aa, Influenza virus
LYDRVRMQL

SEQ ID NO: 477583 - protein, 9 aa, Influenza virus
LYDYKEDRF

SEQ ID NO: 477584 - protein, 9 aa, Influenza virus
LYDYKENRF

SEQ ID NO: 477585 - protein, 9 aa, Influenza virus
LYDYKESRF

SEQ ID NO: 477586 - protein, 9 aa, Influenza virus
LYDYKKNRF

SEQ ID NO: 477587 - protein, 9 aa, Influenza virus
LYEAIEECL

SEQ ID NO: 477588 - protein, 9 aa, Influenza virus
LYEKVRLQL

SEQ ID NO: 477589 - protein, 9 aa, Influenza virus
LYEKVRMQL

SEQ ID NO: 477590 - protein, 9 aa, Influenza virus
LYEKVRRQL

SEQ ID NO: 477591 - protein, 9 aa, Influenza virus
LYENNPGRV

SEQ ID NO: 477592 - protein, 9 aa, Influenza virus
LYERVKKQL

SEQ ID NO: 477593 - protein, 9 aa, Influenza virus
LYERVKRQL

SEQ ID NO: 477594 - protein, 9 aa, Influenza virus
LYERVRKQL

SEQ ID NO: 477595 - protein, 9 aa, Influenza virus
LYERVRRQL

SEQ ID NO: 477596 - protein, 9 aa, Influenza virus
LYESIEECL

SEQ ID NO: 477597 - protein, 9 aa, Influenza virus
LYFWGIHHP

SEQ ID NO: 477598 - protein, 9 aa, Influenza virus
LYFWGVHHP

SEQ ID NO: 477599 - protein, 9 aa, Influenza virus
LYGAGNKLI

SEQ ID NO: 477600 - protein, 9 aa, Influenza virus
LYGAIEECL

SEQ ID NO: 477601 - protein, 9 aa, Influenza virus
LYGAQSLSI

SEQ ID NO: 477602 - protein, 9 aa, Influenza virus
LYGFIIKGR

SEQ ID NO: 477603 - protein, 9 aa, Influenza virus
LYGFIVKGR

SEQ ID NO: 477604 - protein, 9 aa, Influenza virus
LYGNGAKLI

SEQ ID NO: 477605 - protein, 9 aa, Influenza virus
LYGNGNKLI

SEQ ID NO: 477606 - protein, 9 aa, Influenza virus
LYGNGNKLV

SEQ ID NO: 477607 - protein, 9 aa, Influenza virus
LYGSGAKLI

SEQ ID NO: 477608 - protein, 9 aa, Influenza virus
LYGSGNKLI

SEQ ID NO: 477609 - protein, 9 aa, Influenza virus
LYGSGNKLV

SEQ ID NO: 477610 - protein, 9 aa, Influenza virus
LYGSGSKLI

SEQ ID NO: 477611 - protein, 9 aa, Influenza virus
LYGTGNKLI

SEQ ID NO: 477612 - protein, 9 aa, Influenza virus
LYGTQPLSI

SEQ ID NO: 477613 - protein, 9 aa, Influenza virus
LYGTQSLSI

SEQ ID NO: 477614 - protein, 9 aa, Influenza virus
LYIRTNGTS

SEQ ID NO: 477615 - protein, 9 aa, Influenza virus
LYIWGIHHP

SEQ ID NO: 477616 - protein, 9 aa, Influenza virus
LYIWGVHHP

SEQ ID NO: 477617 - protein, 9 aa, Influenza virus
LYKKDISYV

SEQ ID NO: 477618 - protein, 9 aa, Influenza virus
LYKKDNSYV

SEQ ID NO: 477619 - protein, 9 aa, Influenza virus
LYKKDSSHV

SEQ ID NO: 477620 - protein, 9 aa, Influenza virus
LYKKDSSYI

SEQ ID NO: 477621 - protein, 9 aa, Influenza virus
LYKKDSSYV

SEQ ID NO: 477622 - protein, 9 aa, Influenza virus
LYKKLKREI

SEQ ID NO: 477623 - protein, 9 aa, Influenza virus
LYKKLKREM

SEQ ID NO: 477624 - protein, 9 aa, Influenza virus
LYKNANTLS

SEQ ID NO: 477625 - protein, 9 aa, Influenza virus
LYKNANTLT

SEQ ID NO: 477626 - protein, 9 aa, Influenza virus
LYKNNPGRV

SEQ ID NO: 477627 - protein, 9 aa, Influenza virus
LYKNSPGRV

SEQ ID NO: 477628 - protein, 9 aa, Influenza virus
LYKNTNTLS

SEQ ID NO: 477629 - protein, 9 aa, Influenza virus
LYKSNPGRV

SEQ ID NO: 477630 - protein, 9 aa, Influenza virus
LYKVATGRV

SEQ ID NO: 477631 - protein, 9 aa, Influenza virus
LYLNGREWS

SEQ ID NO: 477632 - protein, 9 aa, Influenza virus
LYLSGREWS

SEQ ID NO: 477633 - protein, 9 aa, Influenza virus
LYLTGTWDT

SEQ ID NO: 477634 - protein, 9 aa, Influenza virus
LYLWGVHHP

SEQ ID NO: 477635 - protein, 9 aa, Influenza virus
LYNIRNLHI

SEQ ID NO: 477636 - protein, 9 aa, Influenza virus
LYNKHSNGT

SEQ ID NO: 477637 - protein, 9 aa, Influenza virus
LYNKIEFEP

SEQ ID NO: 477638 - protein, 9 aa, Influenza virus
LYNKLEFEP

SEQ ID NO: 477639 - protein, 9 aa, Influenza virus
LYNKMEFEP

SEQ ID NO: 477640 - protein, 9 aa, Influenza virus
LYNKVEFEP

SEQ ID NO: 477641 - protein, 9 aa, Influenza virus
LYNKVRLQL

SEQ ID NO: 477642 - protein, 9 aa, Influenza virus
LYNKVRMQL

SEQ ID NO: 477643 - protein, 9 aa, Influenza virus
LYQEVGTYV

SEQ ID NO: 477644 - protein, 9 aa, Influenza virus
LYQKVGTYV

SEQ ID NO: 477645 - protein, 9 aa, Influenza virus
LYQNVETYV

SEQ ID NO: 477646 - protein, 9 aa, Influenza virus
LYQNVGTYV

SEQ ID NO: 477647 - protein, 9 aa, Influenza virus
LYRKLKREI

SEQ ID NO: 477648 - protein, 9 aa, Influenza virus
LYSGFVRTL

SEQ ID NO: 477649 - protein, 9 aa, Influenza virus
LYSSPQLEG

SEQ ID NO: 477650 - protein, 9 aa, Influenza virus
LYVNKNPYT

SEQ ID NO: 477651 - protein, 9 aa, Influenza virus
LYVRTNGTS

SEQ ID NO: 477652 - protein, 9 aa, Influenza virus
LYVWGVHHP

SEQ ID NO: 477653 - protein, 9 aa, Influenza virus
LYWHLMHPG

SEQ ID NO: 477654 - protein, 9 aa, Influenza virus
LYWHLMRPG

SEQ ID NO: 477655 - protein, 9 aa, Influenza virus
LYWHLMSPG

SEQ ID NO: 477656 - protein, 9 aa, Influenza virus
MAADKESTQ

SEQ ID NO: 477657 - protein, 9 aa, Influenza virus
MAADQKSTQ

SEQ ID NO: 477658 - protein, 9 aa, Influenza virus
MAADRDSTQ

SEQ ID NO: 477659 - protein, 9 aa, Influenza virus
MACHSAAFE

SEQ ID NO: 477660 - protein, 9 aa, Influenza virus
MACNSAAFE

SEQ ID NO: 477661 - protein, 9 aa, Influenza virus
MADSEMLNL

SEQ ID NO: 477662 - protein, 9 aa, Influenza virus
MADSIKSWR

SEQ ID NO: 477663 - protein, 9 aa, Influenza virus
MADSTMLNL

SEQ ID NO: 477664 - protein, 9 aa, Influenza virus
MAFLEDSHP

SEQ ID NO: 477665 - protein, 9 aa, Influenza virus
MAFLEESHP

SEQ ID NO: 477666 - protein, 9 aa, Influenza virus
MAFLEKSHP

SEQ ID NO: 477667 - protein, 9 aa, Influenza virus
MAFLENSHP

SEQ ID NO: 477668 - protein, 9 aa, Influenza virus
MAGLSFWMC

SEQ ID NO: 477669 - protein, 9 aa, Influenza virus
MAGSSEQAA

SEQ ID NO: 477670 - protein, 9 aa, Influenza virus
MAIDNMQNK

SEQ ID NO: 477671 - protein, 9 aa, Influenza virus
MAIIKKYTS

SEQ ID NO: 477672 - protein, 9 aa, Influenza virus
MAIIKRYTS

SEQ ID NO: 477673 - protein, 9 aa, Influenza virus
MAINWGRIV

SEQ ID NO: 477674 - protein, 9 aa, Influenza virus
MAKCNTKCQ

SEQ ID NO: 477675 - protein, 9 aa, Influenza virus
MALLEESHP

SEQ ID NO: 477676 - protein, 9 aa, Influenza virus
MALQGTKRS

SEQ ID NO: 477677 - protein, 9 aa, Influenza virus
MALQLFIKD

SEQ ID NO: 477678 - protein, 9 aa, Influenza virus
MALSVVSLL

SEQ ID NO: 477679 - protein, 9 aa, Influenza virus
MAMKYPITA

SEQ ID NO: 477680 - protein, 9 aa, Influenza virus
MAMRYPITA

SEQ ID NO: 477681 - protein, 9 aa, Influenza virus
MANIRNNTY

SEQ ID NO: 477682 - protein, 9 aa, Influenza virus
MAPEKIDFE

SEQ ID NO: 477683 - protein, 9 aa, Influenza virus
MAPEKMDFE

SEQ ID NO: 477684 - protein, 9 aa, Influenza virus
MAPEKVDFD

SEQ ID NO: 477685 - protein, 9 aa, Influenza virus
MAPEKVDFE

SEQ ID NO: 477686 - protein, 9 aa, Influenza virus
MAPIMFSNK

SEQ ID NO: 477687 - protein, 9 aa, Influenza virus
MARAVKLYK

SEQ ID NO: 477688 - protein, 9 aa, Influenza virus
MARCNTKCQ

SEQ ID NO: 477689 - protein, 9 aa, Influenza virus
MARLGKGYM

SEQ ID NO: 477690 - protein, 9 aa, Influenza virus
MARLGRGYM

SEQ ID NO: 477691 - protein, 9 aa, Influenza virus
MARSALILR

SEQ ID NO: 477692 - protein, 9 aa, Influenza virus
MASIRNNTY

SEQ ID NO: 477693 - protein, 9 aa, Influenza virus
MASIRNSTY

SEQ ID NO: 477694 - protein, 9 aa, Influenza virus
MASQGTKRP

SEQ ID NO: 477695 - protein, 9 aa, Influenza virus
MASQGTKRS

SEQ ID NO: 477696 - protein, 9 aa, Influenza virus
MATGLRNIP

SEQ ID NO: 477697 - protein, 9 aa, Influenza virus
MATGLRNVP

SEQ ID NO: 477698 - protein, 9 aa, Influenza virus
MATIRNGTY

SEQ ID NO: 477699 - protein, 9 aa, Influenza virus
MATLCLGHH

SEQ ID NO: 477700 - protein, 9 aa, Influenza virus
MATNECRII

SEQ ID NO: 477701 - protein, 9 aa, Influenza virus
MAWSSSSCH

SEQ ID NO: 477702 - protein, 9 aa, Influenza virus
MCFNGSLQC

SEQ ID NO: 477703 - protein, 9 aa, Influenza virus
MCHGTQIGG

SEQ ID NO: 477704 - protein, 9 aa, Influenza virus
MCHSTQIGG

SEQ ID NO: 477705 - protein, 9 aa, Influenza virus
MCHSTRIGG

SEQ ID NO: 477706 - protein, 9 aa, Influenza virus
MCLNGSMQC

SEQ ID NO: 477707 - protein, 9 aa, Influenza virus
MCNILKGKF

SEQ ID NO: 477708 - protein, 9 aa, Influenza virus
MCPNGSLQC

SEQ ID NO: 477709 - protein, 9 aa, Influenza virus
MCSGHSCRI

SEQ ID NO: 477710 - protein, 9 aa, Influenza virus
MCSGLVGDT

SEQ ID NO: 477711 - protein, 9 aa, Influenza virus
MCSLMQGST

SEQ ID NO: 477712 - protein, 9 aa, Influenza virus
MCSNGSLHG

SEQ ID NO: 477713 - protein, 9 aa, Influenza virus
MCSNGSLQC

SEQ ID NO: 477714 - protein, 9 aa, Influenza virus
MCSNGSLRC

SEQ ID NO: 477715 - protein, 9 aa, Influenza virus
MCSNGSMQC

SEQ ID NO: 477716 - protein, 9 aa, Influenza virus
MCSNSSMQC

SEQ ID NO: 477717 - protein, 9 aa, Influenza virus
MCSSTEFLG

SEQ ID NO: 477718 - protein, 9 aa, Influenza virus
MCTELKLND

SEQ ID NO: 477719 - protein, 9 aa, Influenza virus
MCTELKLSD

SEQ ID NO: 477720 - protein, 9 aa, Influenza virus
MCTELKLSE

SEQ ID NO: 477721 - protein, 9 aa, Influenza virus
MCTELQLSD

SEQ ID NO: 477722 - protein, 9 aa, Influenza virus
MCVCRDNWH

SEQ ID NO: 477723 - protein, 9 aa, Influenza virus
MCVGWSSTT

SEQ ID NO: 477724 - protein, 9 aa, Influenza virus
MCVKNGNLR

SEQ ID NO: 477725 - protein, 9 aa, Influenza virus
MCVKNGNMR

SEQ ID NO: 477726 - protein, 9 aa, Influenza virus
MCYPGFVEN

SEQ ID NO: 477727 - protein, 9 aa, Influenza virus
MCYPGSIEN

SEQ ID NO: 477728 - protein, 9 aa, Influenza virus
MCYPGSVEN

SEQ ID NO: 477729 - protein, 9 aa, Influenza virus
MDAGNGCFD

SEQ ID NO: 477730 - protein, 9 aa, Influenza virus
MDALKLSIE

SEQ ID NO: 477731 - protein, 9 aa, Influenza virus
MDALLGDPH

SEQ ID NO: 477732 - protein, 9 aa, Influenza virus
MDDFQLIPM

SEQ ID NO: 477733 - protein, 9 aa, Influenza virus
MDEFQLIPM

SEQ ID NO: 477734 - protein, 9 aa, Influenza virus
MDGVTNKVN

SEQ ID NO: 477735 - protein, 9 aa, Influenza virus
MDGWYGFRH

SEQ ID NO: 477736 - protein, 9 aa, Influenza virus
MDHTSQYLC

SEQ ID NO: 477737 - protein, 9 aa, Influenza virus
MDKAVKLYK

SEQ ID NO: 477738 - protein, 9 aa, Influenza virus
MDKAVKLYR

SEQ ID NO: 477739 - protein, 9 aa, Influenza virus
MDKLFERVR

SEQ ID NO: 477740 - protein, 9 aa, Influenza virus
MDKQTKTMT

SEQ ID NO: 477741 - protein, 9 aa, Influenza virus
MDNKTKKMT

SEQ ID NO: 477742 - protein, 9 aa, Influenza virus
MDNQTKKMT

SEQ ID NO: 477743 - protein, 9 aa, Influenza virus
MDNQTKTMT

SEQ ID NO: 477744 - protein, 9 aa, Influenza virus
MDPRMCSLM

SEQ ID NO: 477745 - protein, 9 aa, Influenza virus
MDQVREGRN

SEQ ID NO: 477746 - protein, 9 aa, Influenza virus
MDQVRESRN

SEQ ID NO: 477747 - protein, 9 aa, Influenza virus
MDRAVKLYK

SEQ ID NO: 477748 - protein, 9 aa, Influenza virus
MDRAVKLYR

SEQ ID NO: 477749 - protein, 9 aa, Influenza virus
MDSLKLSIE

SEQ ID NO: 477750 - protein, 9 aa, Influenza virus
MDSRSGYET

SEQ ID NO: 477751 - protein, 9 aa, Influenza virus
MDSVKNGTY

SEQ ID NO: 477752 - protein, 9 aa, Influenza virus
MDSVRNGTY

SEQ ID NO: 477753 - protein, 9 aa, Influenza virus
MDTIRNGTY

SEQ ID NO: 477754 - protein, 9 aa, Influenza virus
MDTVNRTHQ

SEQ ID NO: 477755 - protein, 9 aa, Influenza virus
MDTVSRTHQ

SEQ ID NO: 477756 - protein, 9 aa, Influenza virus
MDVNPTLLF

SEQ ID NO: 477757 - protein, 9 aa, Influenza virus
MDVWTYNAE

SEQ ID NO: 477758 - protein, 9 aa, Influenza virus
MDYYWAILK

SEQ ID NO: 477759 - protein, 9 aa, Influenza virus
MDYYWAVLK

SEQ ID NO: 477760 - protein, 9 aa, Influenza virus
MDYYWGILK

SEQ ID NO: 477761 - protein, 9 aa, Influenza virus
MEAIRNGTY

SEQ ID NO: 477762 - protein, 9 aa, Influenza virus
MEAMVSRAR

SEQ ID NO: 477763 - protein, 9 aa, Influenza virus
MECRTFFLT

SEQ ID NO: 477764 - protein, 9 aa, Influenza virus
MEDFVRQCF

SEQ ID NO: 477765 - protein, 9 aa, Influenza virus
MEDGFIDVW

SEQ ID NO: 477766 - protein, 9 aa, Influenza virus
MEDGFLDVW

SEQ ID NO: 477767 - protein, 9 aa, Influenza virus
MEDGFLGVW

SEQ ID NO: 477768 - protein, 9 aa, Influenza virus
MEDGFRDVW

SEQ ID NO: 477769 - protein, 9 aa, Influenza virus
MEEFVRQCF

SEQ ID NO: 477770 - protein, 9 aa, Influenza virus
MEEGSIGKV

SEQ ID NO: 477771 - protein, 9 aa, Influenza virus
MEEVTNATE

SEQ ID NO: 477772 - protein, 9 aa, Influenza virus
MEFEPFQSL

SEQ ID NO: 477773 - protein, 9 aa, Influenza virus
MEFSLTDPK

SEQ ID NO: 477774 - protein, 9 aa, Influenza virus
MEFSLTDPR

SEQ ID NO: 477775 - protein, 9 aa, Influenza virus
MEGFVRQCF

SEQ ID NO: 477776 - protein, 9 aa, Influenza virus
MEGICYPGS

SEQ ID NO: 477777 - protein, 9 aa, Influenza virus
MEGVCYPGS

SEQ ID NO: 477778 - protein, 9 aa, Influenza virus
MEHTSQYLC

SEQ ID NO: 477779 - protein, 9 aa, Influenza virus
MEKANKIKS

SEQ ID NO: 477780 - protein, 9 aa, Influenza virus
MEKFIILST

SEQ ID NO: 477781 - protein, 9 aa, Influenza virus
MEKFITLST

SEQ ID NO: 477782 - protein, 9 aa, Influenza virus
MEKFIVLSI

SEQ ID NO: 477783 - protein, 9 aa, Influenza virus
MEKFIVLSV

SEQ ID NO: 477784 - protein, 9 aa, Influenza virus
MEKNITVTH

SEQ ID NO: 477785 - protein, 9 aa, Influenza virus
MEKNVTVTH

SEQ ID NO: 477786 - protein, 9 aa, Influenza virus
MELDEIGED

SEQ ID NO: 477787 - protein, 9 aa, Influenza virus
MELIRMIKR

SEQ ID NO: 477788 - protein, 9 aa, Influenza virus
MELIRMVKR

SEQ ID NO: 477789 - protein, 9 aa, Influenza virus
MELPSFGVS

SEQ ID NO: 477790 - protein, 9 aa, Influenza virus
MELRRCLLQ

SEQ ID NO: 477791 - protein, 9 aa, Influenza virus
MELVEAEKH

SEQ ID NO: 477792 - protein, 9 aa, Influenza virus
MELVETEKH

SEQ ID NO: 477793 - protein, 9 aa, Influenza virus
MELVETEKN

SEQ ID NO: 477794 - protein, 9 aa, Influenza virus
MELVETKKH

SEQ ID NO: 477795 - protein, 9 aa, Influenza virus
MELVRMIKR

SEQ ID NO: 477796 - protein, 9 aa, Influenza virus
MEMRRCLLQ

SEQ ID NO: 477797 - protein, 9 aa, Influenza virus
MENEMTLDF

SEQ ID NO: 477798 - protein, 9 aa, Influenza virus
MENERILDF

SEQ ID NO: 477799 - protein, 9 aa, Influenza virus
MENERTLDF

SEQ ID NO: 477800 - protein, 9 aa, Influenza virus
MENERTLDL

SEQ ID NO: 477801 - protein, 9 aa, Influenza virus
MENERTLDY

SEQ ID NO: 477802 - protein, 9 aa, Influenza virus
MENERTLYF

SEQ ID NO: 477803 - protein, 9 aa, Influenza virus
MENFVRQCF

SEQ ID NO: 477804 - protein, 9 aa, Influenza virus
MENLNKKVD

SEQ ID NO: 477805 - protein, 9 aa, Influenza virus
MENQHIIDL

SEQ ID NO: 477806 - protein, 9 aa, Influenza virus
MENQHTIDL

SEQ ID NO: 477807 - protein, 9 aa, Influenza virus
MENQHTIDM

SEQ ID NO: 477808 - protein, 9 aa, Influenza virus
MEQMAGSSE

SEQ ID NO: 477809 - protein, 9 aa, Influenza virus
MEQNVPVTQ

SEQ ID NO: 477810 - protein, 9 aa, Influenza virus
MEQVAGSSE

SEQ ID NO: 477811 - protein, 9 aa, Influenza virus
MERIRNNTY

SEQ ID NO: 477812 - protein, 9 aa, Influenza virus
MERNVTVTH

SEQ ID NO: 477813 - protein, 9 aa, Influenza virus
MESGGIDKI

SEQ ID NO: 477814 - protein, 9 aa, Influenza virus
MESGGIDKV

SEQ ID NO: 477815 - protein, 9 aa, Influenza virus
MESGGISKI

SEQ ID NO: 477816 - protein, 9 aa, Influenza virus
MESGGISKM

SEQ ID NO: 477817 - protein, 9 aa, Influenza virus
MESIKNGTY

SEQ ID NO: 477818 - protein, 9 aa, Influenza virus
MESIRNGTY

SEQ ID NO: 477819 - protein, 9 aa, Influenza virus
MESIRNNTY

SEQ ID NO: 477820 - protein, 9 aa, Influenza virus
MESRGLFGA

SEQ ID NO: 477821 - protein, 9 aa, Influenza virus
MESVKNGTY

SEQ ID NO: 477822 - protein, 9 aa, Influenza virus
MESVRNGTY

SEQ ID NO: 477823 - protein, 9 aa, Influenza virus
METERTLDF

SEQ ID NO: 477824 - protein, 9 aa, Influenza virus
METIKNGTY

SEQ ID NO: 477825 - protein, 9 aa, Influenza virus
METIRNGTY

SEQ ID NO: 477826 - protein, 9 aa, Influenza virus
METTRNGTY

SEQ ID NO: 477827 - protein, 9 aa, Influenza virus
MEVCFMYSD

SEQ ID NO: 477828 - protein, 9 aa, Influenza virus
MEVVFPNEV

SEQ ID NO: 477829 - protein, 9 aa, Influenza virus
MEWIKTRPI

SEQ ID NO: 477830 - protein, 9 aa, Influenza virus
MEWLKTRPI

SEQ ID NO: 477831 - protein, 9 aa, Influenza virus
MEYDAVATT

SEQ ID NO: 477832 - protein, 9 aa, Influenza virus
MFALSQGTT

SEQ ID NO: 477833 - protein, 9 aa, Influenza virus
MFDFIKWNV

SEQ ID NO: 477834 - protein, 9 aa, Influenza virus
MFDFSKWNV

SEQ ID NO: 477835 - protein, 9 aa, Influenza virus
MFDFTKWNV

SEQ ID NO: 477836 - protein, 9 aa, Influenza virus
MFESNGGLI

SEQ ID NO: 477837 - protein, 9 aa, Influenza virus
MFESNGGLL

SEQ ID NO: 477838 - protein, 9 aa, Influenza virus
MFLAMITYI

SEQ ID NO: 477839 - protein, 9 aa, Influenza virus
MFLYIRTNG

SEQ ID NO: 477840 - protein, 9 aa, Influenza virus
MFLYVRTNG

SEQ ID NO: 477841 - protein, 9 aa, Influenza virus
MFNMLSTVL

SEQ ID NO: 477842 - protein, 9 aa, Influenza virus
MFSNKMARL

SEQ ID NO: 477843 - protein, 9 aa, Influenza virus
MFSNKVARL

SEQ ID NO: 477844 - protein, 9 aa, Influenza virus
MGAINSSMP

SEQ ID NO: 477845 - protein, 9 aa, Influenza virus
MGARPQVNG

SEQ ID NO: 477846 - protein, 9 aa, Influenza virus
MGAVNSSMP

SEQ ID NO: 477847 - protein, 9 aa, Influenza virus
MGEAMVSRA

SEQ ID NO: 477848 - protein, 9 aa, Influenza virus
MGECPEYVK

SEQ ID NO: 477849 - protein, 9 aa, Influenza virus
MGECPKYAK

SEQ ID NO: 477850 - protein, 9 aa, Influenza virus
MGECPKYVK

SEQ ID NO: 477851 - protein, 9 aa, Influenza virus
MGECPKYVR

SEQ ID NO: 477852 - protein, 9 aa, Influenza virus
MGECPNYVK

SEQ ID NO: 477853 - protein, 9 aa, Influenza virus
MGFRYSGIK

SEQ ID NO: 477854 - protein, 9 aa, Influenza virus
MGFRYSGIR

SEQ ID NO: 477855 - protein, 9 aa, Influenza virus
MGFTYSGIR

SEQ ID NO: 477856 - protein, 9 aa, Influenza virus
MGFTYTGVR

SEQ ID NO: 477857 - protein, 9 aa, Influenza virus
MGIYQILAI

SEQ ID NO: 477858 - protein, 9 aa, Influenza virus
MGKCNTKCQ

SEQ ID NO: 477859 - protein, 9 aa, Influenza virus
MGKVECVCR

SEQ ID NO: 477860 - protein, 9 aa, Influenza virus
MGLAPSPYN

SEQ ID NO: 477861 - protein, 9 aa, Influenza virus
MGLFFFCLK

SEQ ID NO: 477862 - protein, 9 aa, Influenza virus
MGLIFMCVK

SEQ ID NO: 477863 - protein, 9 aa, Influenza virus
MGLIYNRMG

SEQ ID NO: 477864 - protein, 9 aa, Influenza virus
MGLKISSSF

SEQ ID NO: 477865 - protein, 9 aa, Influenza virus
MGLQMQRFK

SEQ ID NO: 477866 - protein, 9 aa, Influenza virus
MGLRISSSF

SEQ ID NO: 477867 - protein, 9 aa, Influenza virus
MGLVFFCLK

SEQ ID NO: 477868 - protein, 9 aa, Influenza virus
MGLVFFCLR

SEQ ID NO: 477869 - protein, 9 aa, Influenza virus
MGLVFICIK

SEQ ID NO: 477870 - protein, 9 aa, Influenza virus
MGLVFICMK

SEQ ID NO: 477871 - protein, 9 aa, Influenza virus
MGLVFICVK

SEQ ID NO: 477872 - protein, 9 aa, Influenza virus
MGLVFMCVK

SEQ ID NO: 477873 - protein, 9 aa, Influenza virus
MGMAADKES

SEQ ID NO: 477874 - protein, 9 aa, Influenza virus
MGMFNMLST

SEQ ID NO: 477875 - protein, 9 aa, Influenza virus
MGNGCFEFY

SEQ ID NO: 477876 - protein, 9 aa, Influenza virus
MGNGCFKIY

SEQ ID NO: 477877 - protein, 9 aa, Influenza virus
MGNGCFRIY

SEQ ID NO: 477878 - protein, 9 aa, Influenza virus
MGNGCFTIY

SEQ ID NO: 477879 - protein, 9 aa, Influenza virus
MGNGCLKIY

SEQ ID NO: 477880 - protein, 9 aa, Influenza virus
MGQAADLKS

SEQ ID NO: 477881 - protein, 9 aa, Influenza virus
MGQAPSPYN

SEQ ID NO: 477882 - protein, 9 aa, Influenza virus
MGQAPSPYT

SEQ ID NO: 477883 - protein, 9 aa, Influenza virus
MGQCGLLGT

SEQ ID NO: 477884 - protein, 9 aa, Influenza virus
MGQQGRMDY

SEQ ID NO: 477885 - protein, 9 aa, Influenza virus
MGRTISKDS

SEQ ID NO: 477886 - protein, 9 aa, Influenza virus
MGRTISMDS

SEQ ID NO: 477887 - protein, 9 aa, Influenza virus
MGRTISRDS

SEQ ID NO: 477888 - protein, 9 aa, Influenza virus
MGSIRNNTY

SEQ ID NO: 477889 - protein, 9 aa, Influenza virus
MGSSPNAYQ

SEQ ID NO: 477890 - protein, 9 aa, Influenza virus
MGTAPVLGN

SEQ ID NO: 477891 - protein, 9 aa, Influenza virus
MGTIRNGTY

SEQ ID NO: 477892 - protein, 9 aa, Influenza virus
MGVAPSPSN

SEQ ID NO: 477893 - protein, 9 aa, Influenza virus
MGVDEYSNA

SEQ ID NO: 477894 - protein, 9 aa, Influenza virus
MGVDEYSSA

SEQ ID NO: 477895 - protein, 9 aa, Influenza virus
MGVDEYSST

SEQ ID NO: 477896 - protein, 9 aa, Influenza virus
MGVQIQRFK

SEQ ID NO: 477897 - protein, 9 aa, Influenza virus
MGVQLQRFK

SEQ ID NO: 477898 - protein, 9 aa, Influenza virus
MGVQMHRFK

SEQ ID NO: 477899 - protein, 9 aa, Influenza virus
MGVQMQRFK

SEQ ID NO: 477900 - protein, 9 aa, Influenza virus
MGVYQILAI

SEQ ID NO: 477901 - protein, 9 aa, Influenza virus
MGVYQILVI

SEQ ID NO: 477902 - protein, 9 aa, Influenza virus
MGYICSGIF

SEQ ID NO: 477903 - protein, 9 aa, Influenza virus
MGYICSGVF

SEQ ID NO: 477904 - protein, 9 aa, Influenza virus
MGYKDIILW

SEQ ID NO: 477905 - protein, 9 aa, Influenza virus
MHDANVKNL

SEQ ID NO: 477906 - protein, 9 aa, Influenza virus
MHDANVRNL

SEQ ID NO: 477907 - protein, 9 aa, Influenza virus
MHDRSPFRA

SEQ ID NO: 477908 - protein, 9 aa, Influenza virus
MHDRTKIRQ

SEQ ID NO: 477909 - protein, 9 aa, Influenza virus
MHQLLRHFQ

SEQ ID NO: 477910 - protein, 9 aa, Influenza virus
MIADRVDDA

SEQ ID NO: 477911 - protein, 9 aa, Influenza virus
MIALILVAL

SEQ ID NO: 477912 - protein, 9 aa, Influenza virus
MIDGWYGFH

SEQ ID NO: 477913 - protein, 9 aa, Influenza virus
MIDGWYGFR

SEQ ID NO: 477914 - protein, 9 aa, Influenza virus
MIDGWYGYH

SEQ ID NO: 477915 - protein, 9 aa, Influenza virus
MIEAESSIK

SEQ ID NO: 477916 - protein, 9 aa, Influenza virus
MIEAESSVK

SEQ ID NO: 477917 - protein, 9 aa, Influenza virus
MIEAESSVR

SEQ ID NO: 477918 - protein, 9 aa, Influenza virus
MIICIQGNN

SEQ ID NO: 477919 - protein, 9 aa, Influenza virus
MIIGGFIFG

SEQ ID NO: 477920 - protein, 9 aa, Influenza virus
MIKAVRGDL

SEQ ID NO: 477921 - protein, 9 aa, Influenza virus
MIKRGINDR

SEQ ID NO: 477922 - protein, 9 aa, Influenza virus
MIKRGVNDR

SEQ ID NO: 477923 - protein, 9 aa, Influenza virus
MILSVVSLL

SEQ ID NO: 477924 - protein, 9 aa, Influenza virus
MINDKIDDQ

SEQ ID NO: 477925 - protein, 9 aa, Influenza virus
MINDKINDQ

SEQ ID NO: 477926 - protein, 9 aa, Influenza virus
MINNDLGPA

SEQ ID NO: 477927 - protein, 9 aa, Influenza virus
MINPVKLSG

SEQ ID NO: 477928 - protein, 9 aa, Influenza virus
MINPVKLSS

SEQ ID NO: 477929 - protein, 9 aa, Influenza virus
MINSKIDDQ

SEQ ID NO: 477930 - protein, 9 aa, Influenza virus
MINSKIEDQ

SEQ ID NO: 477931 - protein, 9 aa, Influenza virus
MINSKINDQ

SEQ ID NO: 477932 - protein, 9 aa, Influenza virus
MINSQIDDQ

SEQ ID NO: 477933 - protein, 9 aa, Influenza virus
MIQLIVSGR

SEQ ID NO: 477934 - protein, 9 aa, Influenza virus
MIRGKPEEG

SEQ ID NO: 477935 - protein, 9 aa, Influenza virus
MIRGKPEER

SEQ ID NO: 477936 - protein, 9 aa, Influenza virus
MIRGKPKER

SEQ ID NO: 477937 - protein, 9 aa, Influenza virus
MIRGQPKEK

SEQ ID NO: 477938 - protein, 9 aa, Influenza virus
MIRGQPNER

SEQ ID NO: 477939 - protein, 9 aa, Influenza virus
MIRGRPEER

SEQ ID NO: 477940 - protein, 9 aa, Influenza virus
MISDKIDDQ

SEQ ID NO: 477941 - protein, 9 aa, Influenza virus
MISKCKTKE

SEQ ID NO: 477942 - protein, 9 aa, Influenza virus
MISKCRTKE

SEQ ID NO: 477943 - protein, 9 aa, Influenza virus
MISKCRTRE

SEQ ID NO: 477944 - protein, 9 aa, Influenza virus
MISKSRTKE

SEQ ID NO: 477945 - protein, 9 aa, Influenza virus
MISPLAVTW

SEQ ID NO: 477946 - protein, 9 aa, Influenza virus
MISRARIDA

SEQ ID NO: 477947 - protein, 9 aa, Influenza virus
MITDTIKSW

SEQ ID NO: 477948 - protein, 9 aa, Influenza virus
MITQRTIGK

SEQ ID NO: 477949 - protein, 9 aa, Influenza virus
MIWDANGWV

SEQ ID NO: 477950 - protein, 9 aa, Influenza virus
MIWDPDGWT

SEQ ID NO: 477951 - protein, 9 aa, Influenza virus
MIWDPNGWT

SEQ ID NO: 477952 - protein, 9 aa, Influenza virus
MIWHSNLND

SEQ ID NO: 477953 - protein, 9 aa, Influenza virus
MKDRSPYRT

SEQ ID NO: 477954 - protein, 9 aa, Influenza virus
MKGVYINTA

SEQ ID NO: 477955 - protein, 9 aa, Influenza virus
MKGVYMNTA

SEQ ID NO: 477956 - protein, 9 aa, Influenza virus
MKGVYVNTA

SEQ ID NO: 477957 - protein, 9 aa, Influenza virus
MKHTSQYIC

SEQ ID NO: 477958 - protein, 9 aa, Influenza virus
MKHTSQYLC

SEQ ID NO: 477959 - protein, 9 aa, Influenza virus
MKIIRVGCV

SEQ ID NO: 477960 - protein, 9 aa, Influenza virus
MKIYWHLMH

SEQ ID NO: 477961 - protein, 9 aa, Influenza virus
MKKFIILST

SEQ ID NO: 477962 - protein, 9 aa, Influenza virus
MKKLYERVR

SEQ ID NO: 477963 - protein, 9 aa, Influenza virus
MKLYWHLMH

SEQ ID NO: 477964 - protein, 9 aa, Influenza virus
MKLYWHLMR

SEQ ID NO: 477965 - protein, 9 aa, Influenza virus
MKLYWHLMS

SEQ ID NO: 477966 - protein, 9 aa, Influenza virus
MKNGNMQCT

SEQ ID NO: 477967 - protein, 9 aa, Influenza virus
MKNVPEIPK

SEQ ID NO: 477968 - protein, 9 aa, Influenza virus
MKNVPEIPR

SEQ ID NO: 477969 - protein, 9 aa, Influenza virus
MKNVPEKIH

SEQ ID NO: 477970 - protein, 9 aa, Influenza virus
MKNVPEKIR

SEQ ID NO: 477971 - protein, 9 aa, Influenza virus
MKNVPETPK

SEQ ID NO: 477972 - protein, 9 aa, Influenza virus
MKRKRDSSI

SEQ ID NO: 477973 - protein, 9 aa, Influenza virus
MKRKRNSSI

SEQ ID NO: 477974 - protein, 9 aa, Influenza virus
MKSRGYKMN

SEQ ID NO: 477975 - protein, 9 aa, Influenza virus
MKTIIIVLS

SEQ ID NO: 477976 - protein, 9 aa, Influenza virus
MKWGMELRR

SEQ ID NO: 477977 - protein, 9 aa, Influenza virus
MKWGMEMRR

SEQ ID NO: 477978 - protein, 9 aa, Influenza virus
MKWLLSNAD

SEQ ID NO: 477979 - protein, 9 aa, Influenza virus
MKWLLSNND

SEQ ID NO: 477980 - protein, 9 aa, Influenza virus
MKWLLSNSD

SEQ ID NO: 477981 - protein, 9 aa, Influenza virus
MKWLLSNTD

SEQ ID NO: 477982 - protein, 9 aa, Influenza virus
MKWLLSSKA

SEQ ID NO: 477983 - protein, 9 aa, Influenza virus
MKWLLSSKD

SEQ ID NO: 477984 - protein, 9 aa, Influenza virus
MKWLLSSSD

SEQ ID NO: 477985 - protein, 9 aa, Influenza virus
MKWLLSSTD

SEQ ID NO: 477986 - protein, 9 aa, Influenza virus
MKWLSSSGN

SEQ ID NO: 477987 - protein, 9 aa, Influenza virus
MKWLSSSMN

SEQ ID NO: 477988 - protein, 9 aa, Influenza virus
MKWLTLKSG

SEQ ID NO: 477989 - protein, 9 aa, Influenza virus
MKWMMAMKY

SEQ ID NO: 477990 - protein, 9 aa, Influenza virus
MKWMMAMRY

SEQ ID NO: 477991 - protein, 9 aa, Influenza virus
MLADRIDDA

SEQ ID NO: 477992 - protein, 9 aa, Influenza virus
MLADRVDDA

SEQ ID NO: 477993 - protein, 9 aa, Influenza virus
MLADWVDDA

SEQ ID NO: 477994 - protein, 9 aa, Influenza virus
MLATGMKNV

SEQ ID NO: 477995 - protein, 9 aa, Influenza virus
MLATGMRNI

SEQ ID NO: 477996 - protein, 9 aa, Influenza virus
MLATGMRNV

SEQ ID NO: 477997 - protein, 9 aa, Influenza virus
MLERELVRK

SEQ ID NO: 477998 - protein, 9 aa, Influenza virus
MLFVQSYFQ

SEQ ID NO: 477999 - protein, 9 aa, Influenza virus
MLGFVFTLT

SEQ ID NO: 478000 - protein, 9 aa, Influenza virus
MLKIHNAGT

SEQ ID NO: 478001 - protein, 9 aa, Influenza virus
MLKIPNAET

SEQ ID NO: 478002 - protein, 9 aa, Influenza virus
MLKIPNAGI

SEQ ID NO: 478003 - protein, 9 aa, Influenza virus
MLKIPNAGT

SEQ ID NO: 478004 - protein, 9 aa, Influenza virus
MLKMSLLTE

SEQ ID NO: 478005 - protein, 9 aa, Influenza virus
MLKPGETLN

SEQ ID NO: 478006 - protein, 9 aa, Influenza virus
MLKVPNAGT

SEQ ID NO: 478007 - protein, 9 aa, Influenza virus
MLKVPNALI

SEQ ID NO: 478008 - protein, 9 aa, Influenza virus
MLKVPNALT

SEQ ID NO: 478009 - protein, 9 aa, Influenza virus
MLLAIAMGL

SEQ ID NO: 478010 - protein, 9 aa, Influenza virus
MLLDPGDTV

SEQ ID NO: 478011 - protein, 9 aa, Influenza virus
MLNASCAAM

SEQ ID NO: 478012 - protein, 9 aa, Influenza virus
MLNKSLCKI

SEQ ID NO: 478013 - protein, 9 aa, Influenza virus
MLNKSLCKV

SEQ ID NO: 478014 - protein, 9 aa, Influenza virus
MLNLYDRVR

SEQ ID NO: 478015 - protein, 9 aa, Influenza virus
MLNLYERVR

SEQ ID NO: 478016 - protein, 9 aa, Influenza virus
MLNPNDTIT

SEQ ID NO: 478017 - protein, 9 aa, Influenza virus
MLNPNDTVI

SEQ ID NO: 478018 - protein, 9 aa, Influenza virus
MLNPNDTVT

SEQ ID NO: 478019 - protein, 9 aa, Influenza virus
MLQSRTREI

SEQ ID NO: 478020 - protein, 9 aa, Influenza virus
MLRIPNAGI

SEQ ID NO: 478021 - protein, 9 aa, Influenza virus
MLSKSLCKV

SEQ ID NO: 478022 - protein, 9 aa, Influenza virus
MLSLIMRTV

SEQ ID NO: 478023 - protein, 9 aa, Influenza virus
MLSTVLGVS

SEQ ID NO: 478024 - protein, 9 aa, Influenza virus
MLTGNLQTL

SEQ ID NO: 478025 - protein, 9 aa, Influenza virus
MLWACQNGN

SEQ ID NO: 478026 - protein, 9 aa, Influenza virus
MMAMKYPIT

SEQ ID NO: 478027 - protein, 9 aa, Influenza virus
MMAMRYPIT

SEQ ID NO: 478028 - protein, 9 aa, Influenza virus
MMDGWYGFR

SEQ ID NO: 478029 - protein, 9 aa, Influenza virus
MMDQVREGR

SEQ ID NO: 478030 - protein, 9 aa, Influenza virus
MMDQVRESR

SEQ ID NO: 478031 - protein, 9 aa, Influenza virus
MMEAMVSRA

SEQ ID NO: 478032 - protein, 9 aa, Influenza virus
MMGMFNMLS

SEQ ID NO: 478033 - protein, 9 aa, Influenza virus
MMIWHSNLN

SEQ ID NO: 478034 - protein, 9 aa, Influenza virus
MMKAVRGDL

SEQ ID NO: 478035 - protein, 9 aa, Influenza virus
MMMGMFNML

SEQ ID NO: 478036 - protein, 9 aa, Influenza virus
MMSRARIDA

SEQ ID NO: 478037 - protein, 9 aa, Influenza virus
MMTHTSQYI

SEQ ID NO: 478038 - protein, 9 aa, Influenza virus
MMTNSQDTE

SEQ ID NO: 478039 - protein, 9 aa, Influenza virus
MMTSSQDTE

SEQ ID NO: 478040 - protein, 9 aa, Influenza virus
MMWEINGPD

SEQ ID NO: 478041 - protein, 9 aa, Influenza virus
MMWEINGPE

SEQ ID NO: 478042 - protein, 9 aa, Influenza virus
MMWEVNGPE

SEQ ID NO: 478043 - protein, 9 aa, Influenza virus
MNELGIPFH

SEQ ID NO: 478044 - protein, 9 aa, Influenza virus
MNELGVPFH

SEQ ID NO: 478045 - protein, 9 aa, Influenza virus
MNELGVPFN

SEQ ID NO: 478046 - protein, 9 aa, Influenza virus
MNELGVPFY

SEQ ID NO: 478047 - protein, 9 aa, Influenza virus
MNELGVPLH

SEQ ID NO: 478048 - protein, 9 aa, Influenza virus
MNELGVSFH

SEQ ID NO: 478049 - protein, 9 aa, Influenza virus
MNGNYDSIR

SEQ ID NO: 478050 - protein, 9 aa, Influenza virus
MNGQSGRID

SEQ ID NO: 478051 - protein, 9 aa, Influenza virus
MNIQFTAVG

SEQ ID NO: 478052 - protein, 9 aa, Influenza virus
MNIQFTSVG

SEQ ID NO: 478053 - protein, 9 aa, Influenza virus
MNKLFERIR

SEQ ID NO: 478054 - protein, 9 aa, Influenza virus
MNKLFERVK

SEQ ID NO: 478055 - protein, 9 aa, Influenza virus
MNKLFERVR

SEQ ID NO: 478056 - protein, 9 aa, Influenza virus
MNKLYEKVR

SEQ ID NO: 478057 - protein, 9 aa, Influenza virus
MNKLYERVK

SEQ ID NO: 478058 - protein, 9 aa, Influenza virus
MNKLYERVR

SEQ ID NO: 478059 - protein, 9 aa, Influenza virus
MNKRMEDGF

SEQ ID NO: 478060 - protein, 9 aa, Influenza virus
MNLLIGISN

SEQ ID NO: 478061 - protein, 9 aa, Influenza virus
MNNEGSYFF

SEQ ID NO: 478062 - protein, 9 aa, Influenza virus
MNNETILET

SEQ ID NO: 478063 - protein, 9 aa, Influenza virus
MNNQVFPQL

SEQ ID NO: 478064 - protein, 9 aa, Influenza virus
MNPIKKIIT

SEQ ID NO: 478065 - protein, 9 aa, Influenza virus
MNPKSKLFT

SEQ ID NO: 478066 - protein, 9 aa, Influenza virus
MNPNKKIIT

SEQ ID NO: 478067 - protein, 9 aa, Influenza virus
MNPNQKIIA

SEQ ID NO: 478068 - protein, 9 aa, Influenza virus
MNPNQKIIC

SEQ ID NO: 478069 - protein, 9 aa, Influenza virus
MNPNQKIIT

SEQ ID NO: 478070 - protein, 9 aa, Influenza virus
MNPNQKILC

SEQ ID NO: 478071 - protein, 9 aa, Influenza virus
MNPNQKILF

SEQ ID NO: 478072 - protein, 9 aa, Influenza virus
MNPNQKIMC

SEQ ID NO: 478073 - protein, 9 aa, Influenza virus
MNPNQKIQC

SEQ ID NO: 478074 - protein, 9 aa, Influenza virus
MNPNQKITC

SEQ ID NO: 478075 - protein, 9 aa, Influenza virus
MNPNQKIVT

SEQ ID NO: 478076 - protein, 9 aa, Influenza virus
MNPNQKLFA

SEQ ID NO: 478077 - protein, 9 aa, Influenza virus
MNPNQKLFT

SEQ ID NO: 478078 - protein, 9 aa, Influenza virus
MNPNQKTIT

SEQ ID NO: 478079 - protein, 9 aa, Influenza virus
MNPNQRIIT

SEQ ID NO: 478080 - protein, 9 aa, Influenza virus
MNPNQSIIT

SEQ ID NO: 478081 - protein, 9 aa, Influenza virus
MNPSQKLFA

SEQ ID NO: 478082 - protein, 9 aa, Influenza virus
MNREFEVMN

SEQ ID NO: 478083 - protein, 9 aa, Influenza virus
MNREFEVVD

SEQ ID NO: 478084 - protein, 9 aa, Influenza virus
MNREFEVVN

SEQ ID NO: 478085 - protein, 9 aa, Influenza virus
MNREFGVVN

SEQ ID NO: 478086 - protein, 9 aa, Influenza virus
MNRLFERVR

SEQ ID NO: 478087 - protein, 9 aa, Influenza virus
MNSVKNGTY

SEQ ID NO: 478088 - protein, 9 aa, Influenza virus
MNSVKTGTY

SEQ ID NO: 478089 - protein, 9 aa, Influenza virus
MNSVRNGTY

SEQ ID NO: 478090 - protein, 9 aa, Influenza virus
MNTALLNAS

SEQ ID NO: 478091 - protein, 9 aa, Influenza virus
MNTQFEAIG

SEQ ID NO: 478092 - protein, 9 aa, Influenza virus
MNTQFEAVG

SEQ ID NO: 478093 - protein, 9 aa, Influenza virus
MNTQFTAVG

SEQ ID NO: 478094 - protein, 9 aa, Influenza virus
MNTQFTSVG

SEQ ID NO: 478095 - protein, 9 aa, Influenza virus
MNTQFTVVG

SEQ ID NO: 478096 - protein, 9 aa, Influenza virus
MNTQIIVIL

SEQ ID NO: 478097 - protein, 9 aa, Influenza virus
MNTRFEAVG

SEQ ID NO: 478098 - protein, 9 aa, Influenza virus
MNTSKPFQN

SEQ ID NO: 478099 - protein, 9 aa, Influenza virus
MNTSKPLQN

SEQ ID NO: 478100 - protein, 9 aa, Influenza virus
MNVKSLKLA

SEQ ID NO: 478101 - protein, 9 aa, Influenza virus
MNWSGYSGS

SEQ ID NO: 478102 - protein, 9 aa, Influenza virus
MPASRYLTD

SEQ ID NO: 478103 - protein, 9 aa, Influenza virus
MPESMREEY

SEQ ID NO: 478104 - protein, 9 aa, Influenza virus
MPFHNIHPL

SEQ ID NO: 478105 - protein, 9 aa, Influenza virus
MPFHNVHPF

SEQ ID NO: 478106 - protein, 9 aa, Influenza virus
MPFHNVHPL

SEQ ID NO: 478107 - protein, 9 aa, Influenza virus
MPLHNIHPL

SEQ ID NO: 478108 - protein, 9 aa, Influenza virus
MPTDVVRSW

SEQ ID NO: 478109 - protein, 9 aa, Influenza virus
MQALQLLFE

SEQ ID NO: 478110 - protein, 9 aa, Influenza virus
MQALQLLLE

SEQ ID NO: 478111 - protein, 9 aa, Influenza virus
MQCRICIGS

SEQ ID NO: 478112 - protein, 9 aa, Influenza virus
MQFSSLAVN

SEQ ID NO: 478113 - protein, 9 aa, Influenza virus
MQFSSLTVN

SEQ ID NO: 478114 - protein, 9 aa, Influenza virus
MQFSSLTVS

SEQ ID NO: 478115 - protein, 9 aa, Influenza virus
MQGSTLPRR

SEQ ID NO: 478116 - protein, 9 aa, Influenza virus
MQIRGFVHF

SEQ ID NO: 478117 - protein, 9 aa, Influenza virus
MQIRGFVYF

SEQ ID NO: 478118 - protein, 9 aa, Influenza virus
MQLKDNAKE

SEQ ID NO: 478119 - protein, 9 aa, Influenza virus
MQLRDNAKE

SEQ ID NO: 478120 - protein, 9 aa, Influenza virus
MQLRDNVKE

SEQ ID NO: 478121 - protein, 9 aa, Influenza virus
MQNGSCRCM

SEQ ID NO: 478122 - protein, 9 aa, Influenza virus
MQNGSYRCM

SEQ ID NO: 478123 - protein, 9 aa, Influenza virus
MQNKLNNVI

SEQ ID NO: 478124 - protein, 9 aa, Influenza virus
MQNRIQIDP

SEQ ID NO: 478125 - protein, 9 aa, Influenza virus
MQNRLNNVI

SEQ ID NO: 478126 - protein, 9 aa, Influenza virus
MQRFRRPDS

SEQ ID NO: 478127 - protein, 9 aa, Influenza virus
MRCTISLVK

SEQ ID NO: 478128 - protein, 9 aa, Influenza virus
MRDILGTFD

SEQ ID NO: 478129 - protein, 9 aa, Influenza virus
MRDVIGTFD

SEQ ID NO: 478130 - protein, 9 aa, Influenza virus
MRDVLGTFD

SEQ ID NO: 478131 - protein, 9 aa, Influenza virus
MREPFISCS

SEQ ID NO: 478132 - protein, 9 aa, Influenza virus
MRFTYSGIR

SEQ ID NO: 478133 - protein, 9 aa, Influenza virus
MRILIRGNS

SEQ ID NO: 478134 - protein, 9 aa, Influenza virus
MRILVRGNS

SEQ ID NO: 478135 - protein, 9 aa, Influenza virus
MRINNETIL

SEQ ID NO: 478136 - protein, 9 aa, Influenza virus
MRISNETIL

SEQ ID NO: 478137 - protein, 9 aa, Influenza virus
MRIWRQANN

SEQ ID NO: 478138 - protein, 9 aa, Influenza virus
MRKKRGLFG

SEQ ID NO: 478139 - protein, 9 aa, Influenza virus
MRNIPEKPK

SEQ ID NO: 478140 - protein, 9 aa, Influenza virus
MRNIPEKQT

SEQ ID NO: 478141 - protein, 9 aa, Influenza virus
MRNIPENPK

SEQ ID NO: 478142 - protein, 9 aa, Influenza virus
MRNIPERQT

SEQ ID NO: 478143 - protein, 9 aa, Influenza virus
MRNIPGKQA

SEQ ID NO: 478144 - protein, 9 aa, Influenza virus
MRNVPEKPK

SEQ ID NO: 478145 - protein, 9 aa, Influenza virus
MRNVPEKQT

SEQ ID NO: 478146 - protein, 9 aa, Influenza virus
MRNVPENPK

SEQ ID NO: 478147 - protein, 9 aa, Influenza virus
MRNVPERQT

SEQ ID NO: 478148 - protein, 9 aa, Influenza virus
MRNVPETQT

SEQ ID NO: 478149 - protein, 9 aa, Influenza virus
MRPCFWVEL

SEQ ID NO: 478150 - protein, 9 aa, Influenza virus
MRRCLLQSL

SEQ ID NO: 478151 - protein, 9 aa, Influenza virus
MRTFSFQLI

SEQ ID NO: 478152 - protein, 9 aa, Influenza virus
MRTPIAFLT

SEQ ID NO: 478153 - protein, 9 aa, Influenza virus
MRTQESECA

SEQ ID NO: 478154 - protein, 9 aa, Influenza virus
MRTQESECV

SEQ ID NO: 478155 - protein, 9 aa, Influenza virus
MRTQESSCT

SEQ ID NO: 478156 - protein, 9 aa, Influenza virus
MRWLTLKLG

SEQ ID NO: 478157 - protein, 9 aa, Influenza virus
MRWLTLKSE

SEQ ID NO: 478158 - protein, 9 aa, Influenza virus
MRWLTLKSG

SEQ ID NO: 478159 - protein, 9 aa, Influenza virus
MSCFVFVAL

SEQ ID NO: 478160 - protein, 9 aa, Influenza virus
MSCHIGVAP

SEQ ID NO: 478161 - protein, 9 aa, Influenza virus
MSCPIGEAP

SEQ ID NO: 478162 - protein, 9 aa, Influenza virus
MSCPIGEVP

SEQ ID NO: 478163 - protein, 9 aa, Influenza virus
MSCPIGVAP

SEQ ID NO: 478164 - protein, 9 aa, Influenza virus
MSCPLGEAP

SEQ ID NO: 478165 - protein, 9 aa, Influenza virus
MSCPMGVAP

SEQ ID NO: 478166 - protein, 9 aa, Influenza virus
MSCPVGEAP

SEQ ID NO: 478167 - protein, 9 aa, Influenza virus
MSCPVGVAP

SEQ ID NO: 478168 - protein, 9 aa, Influenza virus
MSDIEAMAS

SEQ ID NO: 478169 - protein, 9 aa, Influenza virus
MSDIEAMAT

SEQ ID NO: 478170 - protein, 9 aa, Influenza virus
MSDIGAMAS

SEQ ID NO: 478171 - protein, 9 aa, Influenza virus
MSDINIMAS

SEQ ID NO: 478172 - protein, 9 aa, Influenza virus
MSDSIKSWR

SEQ ID NO: 478173 - protein, 9 aa, Influenza virus
MSELGVPFH

SEQ ID NO: 478174 - protein, 9 aa, Influenza virus
MSELGVPFN

SEQ ID NO: 478175 - protein, 9 aa, Influenza virus
MSFQGRGVF

SEQ ID NO: 478176 - protein, 9 aa, Influenza virus
MSGPNDNAS

SEQ ID NO: 478177 - protein, 9 aa, Influenza virus
MSGPNNNAS

SEQ ID NO: 478178 - protein, 9 aa, Influenza virus
MSGYSGIFS

SEQ ID NO: 478179 - protein, 9 aa, Influenza virus
MSICISGPN

SEQ ID NO: 478180 - protein, 9 aa, Influenza virus
MSICMSGPN

SEQ ID NO: 478181 - protein, 9 aa, Influenza virus
MSICVSGPN

SEQ ID NO: 478182 - protein, 9 aa, Influenza virus
MSIGITVIK

SEQ ID NO: 478183 - protein, 9 aa, Influenza virus
MSIGVTVIK

SEQ ID NO: 478184 - protein, 9 aa, Influenza virus
MSIGVTVIR

SEQ ID NO: 478185 - protein, 9 aa, Influenza virus
MSKEGSYFF

SEQ ID NO: 478186 - protein, 9 aa, Influenza virus
MSKKKSYIN

SEQ ID NO: 478187 - protein, 9 aa, Influenza virus
MSKLYERVK

SEQ ID NO: 478188 - protein, 9 aa, Influenza virus
MSKLYERVR

SEQ ID NO: 478189 - protein, 9 aa, Influenza virus
MSKRKSYIN

SEQ ID NO: 478190 - protein, 9 aa, Influenza virus
MSLLTEVET

SEQ ID NO: 478191 - protein, 9 aa, Influenza virus
MSLNISLYS

SEQ ID NO: 478192 - protein, 9 aa, Influenza virus
MSNEGSYFF

SEQ ID NO: 478193 - protein, 9 aa, Influenza virus
MSNNSTEKV

SEQ ID NO: 478194 - protein, 9 aa, Influenza virus
MSQSRTREI

SEQ ID NO: 478195 - protein, 9 aa, Influenza virus
MSQSRTRGI

SEQ ID NO: 478196 - protein, 9 aa, Influenza virus
MSRARIDAR

SEQ ID NO: 478197 - protein, 9 aa, Influenza virus
MSSVKNGTY

SEQ ID NO: 478198 - protein, 9 aa, Influenza virus
MSTNAYDRI

SEQ ID NO: 478199 - protein, 9 aa, Influenza virus
MSTPLGTPP

SEQ ID NO: 478200 - protein, 9 aa, Influenza virus
MSVCISGPN

SEQ ID NO: 478201 - protein, 9 aa, Influenza virus
MSVCMSGPN

SEQ ID NO: 478202 - protein, 9 aa, Influenza virus
MSVLLGSSP

SEQ ID NO: 478203 - protein, 9 aa, Influenza virus
MSVPLGSSP

SEQ ID NO: 478204 - protein, 9 aa, Influenza virus
MSVPLGSSS

SEQ ID NO: 478205 - protein, 9 aa, Influenza virus
MTDGNASGK

SEQ ID NO: 478206 - protein, 9 aa, Influenza virus
MTDGPANKQ

SEQ ID NO: 478207 - protein, 9 aa, Influenza virus
MTDGPANNQ

SEQ ID NO: 478208 - protein, 9 aa, Influenza virus
MTDGPANRQ

SEQ ID NO: 478209 - protein, 9 aa, Influenza virus
MTDGPANSQ

SEQ ID NO: 478210 - protein, 9 aa, Influenza virus
MTDGPASNQ

SEQ ID NO: 478211 - protein, 9 aa, Influenza virus
MTDGPASSQ

SEQ ID NO: 478212 - protein, 9 aa, Influenza virus
MTDGPSDAQ

SEQ ID NO: 478213 - protein, 9 aa, Influenza virus
MTDGSANSQ

SEQ ID NO: 478214 - protein, 9 aa, Influenza virus
MTDGSASGK

SEQ ID NO: 478215 - protein, 9 aa, Influenza virus
MTDGSASGQ

SEQ ID NO: 478216 - protein, 9 aa, Influenza virus
MTDGSASGR

SEQ ID NO: 478217 - protein, 9 aa, Influenza virus
MTDGSASRK

SEQ ID NO: 478218 - protein, 9 aa, Influenza virus
MTDGSASSQ

SEQ ID NO: 478219 - protein, 9 aa, Influenza virus
MTDGSASSR

SEQ ID NO: 478220 - protein, 9 aa, Influenza virus
MTDSEMLNL

SEQ ID NO: 478221 - protein, 9 aa, Influenza virus
MTDSEMNKL

SEQ ID NO: 478222 - protein, 9 aa, Influenza virus
MTDSIKSWR

SEQ ID NO: 478223 - protein, 9 aa, Influenza virus
MTEIWSYNA

SEQ ID NO: 478224 - protein, 9 aa, Influenza virus
MTEVWSYNA

SEQ ID NO: 478225 - protein, 9 aa, Influenza virus
MTFHGAKEV

SEQ ID NO: 478226 - protein, 9 aa, Influenza virus
MTHISKYLC

SEQ ID NO: 478227 - protein, 9 aa, Influenza virus
MTHMSKYLC

SEQ ID NO: 478228 - protein, 9 aa, Influenza virus
MTHSSKYLC

SEQ ID NO: 478229 - protein, 9 aa, Influenza virus
MTHTSKYLC

SEQ ID NO: 478230 - protein, 9 aa, Influenza virus
MTHTSQYIC

SEQ ID NO: 478231 - protein, 9 aa, Influenza virus
MTHTSRYLC

SEQ ID NO: 478232 - protein, 9 aa, Influenza virus
MTIASDILK

SEQ ID NO: 478233 - protein, 9 aa, Influenza virus
MTIASDILT

SEQ ID NO: 478234 - protein, 9 aa, Influenza virus
MTICIQGNN

SEQ ID NO: 478235 - protein, 9 aa, Influenza virus
MTICVQGDN

SEQ ID NO: 478236 - protein, 9 aa, Influenza virus
MTICVQGNN

SEQ ID NO: 478237 - protein, 9 aa, Influenza virus
MTKDAERGK

SEQ ID NO: 478238 - protein, 9 aa, Influenza virus
MTLDFHDSN

SEQ ID NO: 478239 - protein, 9 aa, Influenza virus
MTLSVVSLL

SEQ ID NO: 478240 - protein, 9 aa, Influenza virus
MTNVQNNYT

SEQ ID NO: 478241 - protein, 9 aa, Influenza virus
MTRGLFGAI

SEQ ID NO: 478242 - protein, 9 aa, Influenza virus
MTSIRNNTY

SEQ ID NO: 478243 - protein, 9 aa, Influenza virus
MVAYMLERE

SEQ ID NO: 478244 - protein, 9 aa, Influenza virus
MVDGWYGFH

SEQ ID NO: 478245 - protein, 9 aa, Influenza virus
MVDGWYGFR

SEQ ID NO: 478246 - protein, 9 aa, Influenza virus
MVDGWYGYH

SEQ ID NO: 478247 - protein, 9 aa, Influenza virus
MVDQVRESR

SEQ ID NO: 478248 - protein, 9 aa, Influenza virus
MVDTILERN

SEQ ID NO: 478249 - protein, 9 aa, Influenza virus
MVEAESSVK

SEQ ID NO: 478250 - protein, 9 aa, Influenza virus
MVEAMISRA

SEQ ID NO: 478251 - protein, 9 aa, Influenza virus
MVEAMMSRA

SEQ ID NO: 478252 - protein, 9 aa, Influenza virus
MVEAMVSRA

SEQ ID NO: 478253 - protein, 9 aa, Influenza virus
MVFSQEDCM

SEQ ID NO: 478254 - protein, 9 aa, Influenza virus
MVFSQEDCV

SEQ ID NO: 478255 - protein, 9 aa, Influenza virus
MVFSQEECM

SEQ ID NO: 478256 - protein, 9 aa, Influenza virus
MVGLILAFI

SEQ ID NO: 478257 - protein, 9 aa, Influenza virus
MVHAMRTIG

SEQ ID NO: 478258 - protein, 9 aa, Influenza virus
MVIASTTAK

SEQ ID NO: 478259 - protein, 9 aa, Influenza virus
MVKAVRGDL

SEQ ID NO: 478260 - protein, 9 aa, Influenza virus
MVKRGINDR

SEQ ID NO: 478261 - protein, 9 aa, Influenza virus
MVKSDKICL

SEQ ID NO: 478262 - protein, 9 aa, Influenza virus
MVLASTTAK

SEQ ID NO: 478263 - protein, 9 aa, Influenza virus
MVLSAFDER

SEQ ID NO: 478264 - protein, 9 aa, Influenza virus
MVNERTLDF

SEQ ID NO: 478265 - protein, 9 aa, Influenza virus
MVNGWYGFR

SEQ ID NO: 478266 - protein, 9 aa, Influenza virus
MVQAMRAIG

SEQ ID NO: 478267 - protein, 9 aa, Influenza virus
MVQAMRAVG

SEQ ID NO: 478268 - protein, 9 aa, Influenza virus
MVQAMRTIG

SEQ ID NO: 478269 - protein, 9 aa, Influenza virus
MVQAMRTVG

SEQ ID NO: 478270 - protein, 9 aa, Influenza virus
MVRSDKICL

SEQ ID NO: 478271 - protein, 9 aa, Influenza virus
MVSPLAITW

SEQ ID NO: 478272 - protein, 9 aa, Influenza virus
MVSPLAVTW

SEQ ID NO: 478273 - protein, 9 aa, Influenza virus
MVSRARIDA

SEQ ID NO: 478274 - protein, 9 aa, Influenza virus
MVTFCGLDN

SEQ ID NO: 478275 - protein, 9 aa, Influenza virus
MVTGLRNIP

SEQ ID NO: 478276 - protein, 9 aa, Influenza virus
MVTQRTIGK

SEQ ID NO: 478277 - protein, 9 aa, Influenza virus
MVTQRTMGK

SEQ ID NO: 478278 - protein, 9 aa, Influenza virus
MVTQRTVGK

SEQ ID NO: 478279 - protein, 9 aa, Influenza virus
MVVYAELLV

SEQ ID NO: 478280 - protein, 9 aa, Influenza virus
MVWDANGWV

SEQ ID NO: 478281 - protein, 9 aa, Influenza virus
MVWDPNGWT

SEQ ID NO: 478282 - protein, 9 aa, Influenza virus
MWACNSGNC

SEQ ID NO: 478283 - protein, 9 aa, Influenza virus
MWACQKGNI

SEQ ID NO: 478284 - protein, 9 aa, Influenza virus
MWACQRGNI

SEQ ID NO: 478285 - protein, 9 aa, Influenza virus
MWACSNGNC

SEQ ID NO: 478286 - protein, 9 aa, Influenza virus
MWACSNGSC

SEQ ID NO: 478287 - protein, 9 aa, Influenza virus
MWACSSGNC

SEQ ID NO: 478288 - protein, 9 aa, Influenza virus
MWAIHHPPT

SEQ ID NO: 478289 - protein, 9 aa, Influenza virus
MWALGENMA

SEQ ID NO: 478290 - protein, 9 aa, Influenza virus
MWDTLIERD

SEQ ID NO: 478291 - protein, 9 aa, Influenza virus
MWEINGPDS

SEQ ID NO: 478292 - protein, 9 aa, Influenza virus
MWEINGPES

SEQ ID NO: 478293 - protein, 9 aa, Influenza virus
MWEVNGPES

SEQ ID NO: 478294 - protein, 9 aa, Influenza virus
MWGIHHPSS

SEQ ID NO: 478295 - protein, 9 aa, Influenza virus
MWSYNAELL

SEQ ID NO: 478296 - protein, 9 aa, Influenza virus
MWTCNSGNC

SEQ ID NO: 478297 - protein, 9 aa, Influenza virus
MWTCQKGNI

SEQ ID NO: 478298 - protein, 9 aa, Influenza virus
MYALHQGTT

SEQ ID NO: 478299 - protein, 9 aa, Influenza virus
MYQKCCNLF

SEQ ID NO: 478300 - protein, 9 aa, Influenza virus
MYQKCCSLF

SEQ ID NO: 478301 - protein, 9 aa, Influenza virus
MYQKCCTLF

SEQ ID NO: 478302 - protein, 9 aa, Influenza virus
MYQRCCNLF

SEQ ID NO: 478303 - protein, 9 aa, Influenza virus
MYSDFHFID

SEQ ID NO: 478304 - protein, 9 aa, Influenza virus
MYSDFHFIN

SEQ ID NO: 478305 - protein, 9 aa, Influenza virus
NAASYKRIR

SEQ ID NO: 478306 - protein, 9 aa, Influenza virus
NADHRIYWI

SEQ ID NO: 478307 - protein, 9 aa, Influenza virus
NADHRVYWI

SEQ ID NO: 478308 - protein, 9 aa, Influenza virus
NADKICLGH

SEQ ID NO: 478309 - protein, 9 aa, Influenza virus
NADLEALME

SEQ ID NO: 478310 - protein, 9 aa, Influenza virus
NADLLVAME

SEQ ID NO: 478311 - protein, 9 aa, Influenza virus
NADVLVALE

SEQ ID NO: 478312 - protein, 9 aa, Influenza virus
NAEDIGNGC

SEQ ID NO: 478313 - protein, 9 aa, Influenza virus
NAEDKGNGC

SEQ ID NO: 478314 - protein, 9 aa, Influenza virus
NAEDMGDGC

SEQ ID NO: 478315 - protein, 9 aa, Influenza virus
NAEDMGGGC

SEQ ID NO: 478316 - protein, 9 aa, Influenza virus
NAEDMGNGC

SEQ ID NO: 478317 - protein, 9 aa, Influenza virus
NAEDQGNGC

SEQ ID NO: 478318 - protein, 9 aa, Influenza virus
NAEDRGNGC

SEQ ID NO: 478319 - protein, 9 aa, Influenza virus
NAEEDCTGC

SEQ ID NO: 478320 - protein, 9 aa, Influenza virus
NAEEDGKGC

SEQ ID NO: 478321 - protein, 9 aa, Influenza virus
NAEEDGNGC

SEQ ID NO: 478322 - protein, 9 aa, Influenza virus
NAEEDGRGC

SEQ ID NO: 478323 - protein, 9 aa, Influenza virus
NAEEDGTGC

SEQ ID NO: 478324 - protein, 9 aa, Influenza virus
NAEEMGNGC

SEQ ID NO: 478325 - protein, 9 aa, Influenza virus
NAEEYRRLR

SEQ ID NO: 478326 - protein, 9 aa, Influenza virus
NAEFLVALE

SEQ ID NO: 478327 - protein, 9 aa, Influenza virus
NAEFLVAME

SEQ ID NO: 478328 - protein, 9 aa, Influenza virus
NAEFLVAVE

SEQ ID NO: 478329 - protein, 9 aa, Influenza virus
NAEGIGIAA

SEQ ID NO: 478330 - protein, 9 aa, Influenza virus
NAEGTGIAA

SEQ ID NO: 478331 - protein, 9 aa, Influenza virus
NAEGTGMAA

SEQ ID NO: 478332 - protein, 9 aa, Influenza virus
NAEGTGTAA

SEQ ID NO: 478333 - protein, 9 aa, Influenza virus
NAEIEDLIF

SEQ ID NO: 478334 - protein, 9 aa, Influenza virus
NAEIEDLTF

SEQ ID NO: 478335 - protein, 9 aa, Influenza virus
NAEILVALE

SEQ ID NO: 478336 - protein, 9 aa, Influenza virus
NAEILVLME

SEQ ID NO: 478337 - protein, 9 aa, Influenza virus
NAELFVLME

SEQ ID NO: 478338 - protein, 9 aa, Influenza virus
NAELIVLLE

SEQ ID NO: 478339 - protein, 9 aa, Influenza virus
NAELLIAME

SEQ ID NO: 478340 - protein, 9 aa, Influenza virus
NAELLILLE

SEQ ID NO: 478341 - protein, 9 aa, Influenza virus
NAELLVALE

SEQ ID NO: 478342 - protein, 9 aa, Influenza virus
NAELLVAME

SEQ ID NO: 478343 - protein, 9 aa, Influenza virus
NAELLVLIE

SEQ ID NO: 478344 - protein, 9 aa, Influenza virus
NAELLVLLE

SEQ ID NO: 478345 - protein, 9 aa, Influenza virus
NAELLVLLG

SEQ ID NO: 478346 - protein, 9 aa, Influenza virus
NAELLVLME

SEQ ID NO: 478347 - protein, 9 aa, Influenza virus
NAEVLVLME

SEQ ID NO: 478348 - protein, 9 aa, Influenza virus
NAFRGLIST

SEQ ID NO: 478349 - protein, 9 aa, Influenza virus
NAGKDPKKT

SEQ ID NO: 478350 - protein, 9 aa, Influenza virus
NAGLLVALE

SEQ ID NO: 478351 - protein, 9 aa, Influenza virus
NAHDRICIG

SEQ ID NO: 478352 - protein, 9 aa, Influenza virus
NAHILVTRE

SEQ ID NO: 478353 - protein, 9 aa, Influenza virus
NAIDAGDGC

SEQ ID NO: 478354 - protein, 9 aa, Influenza virus
NAIDAGNGC

SEQ ID NO: 478355 - protein, 9 aa, Influenza virus
NAIDEGDGC

SEQ ID NO: 478356 - protein, 9 aa, Influenza virus
NAIDEGNGC

SEQ ID NO: 478357 - protein, 9 aa, Influenza virus
NAIDNGDGC

SEQ ID NO: 478358 - protein, 9 aa, Influenza virus
NAIDTGDGC

SEQ ID NO: 478359 - protein, 9 aa, Influenza virus
NAIDTGKGC

SEQ ID NO: 478360 - protein, 9 aa, Influenza virus
NAIDTGNGC

SEQ ID NO: 478361 - protein, 9 aa, Influenza virus
NAIGDCPKY

SEQ ID NO: 478362 - protein, 9 aa, Influenza virus
NAINEGNGC

SEQ ID NO: 478363 - protein, 9 aa, Influenza virus
NAIRFGEGE

SEQ ID NO: 478364 - protein, 9 aa, Influenza virus
NAIRFGESE

SEQ ID NO: 478365 - protein, 9 aa, Influenza virus
NAIRIGEDA

SEQ ID NO: 478366 - protein, 9 aa, Influenza virus
NAIRIGEDS

SEQ ID NO: 478367 - protein, 9 aa, Influenza virus
NAIRIGEEA

SEQ ID NO: 478368 - protein, 9 aa, Influenza virus
NAIRIGEGA

SEQ ID NO: 478369 - protein, 9 aa, Influenza virus
NAIRIGENA

SEQ ID NO: 478370 - protein, 9 aa, Influenza virus
NAIRIGENS

SEQ ID NO: 478371 - protein, 9 aa, Influenza virus
NAIRIGGNS

SEQ ID NO: 478372 - protein, 9 aa, Influenza virus
NAIRLGENK

SEQ ID NO: 478373 - protein, 9 aa, Influenza virus
NAIRPGENK

SEQ ID NO: 478374 - protein, 9 aa, Influenza virus
NAISTTFPY

SEQ ID NO: 478375 - protein, 9 aa, Influenza virus
NAITRSGQN

SEQ ID NO: 478376 - protein, 9 aa, Influenza virus
NAKDEGNGC

SEQ ID NO: 478377 - protein, 9 aa, Influenza virus
NAKDLGNGC

SEQ ID NO: 478378 - protein, 9 aa, Influenza virus
NAKEIGNGC

SEQ ID NO: 478379 - protein, 9 aa, Influenza virus
NAKELGNGC

SEQ ID NO: 478380 - protein, 9 aa, Influenza virus
NAKEMGNGC

SEQ ID NO: 478381 - protein, 9 aa, Influenza virus
NAKETGNGC

SEQ ID NO: 478382 - protein, 9 aa, Influenza virus
NAKEVGNGC

SEQ ID NO: 478383 - protein, 9 aa, Influenza virus
NAKLLVLIE

SEQ ID NO: 478384 - protein, 9 aa, Influenza virus
NAKLLVLLE

SEQ ID NO: 478385 - protein, 9 aa, Influenza virus
NALDTGDGC

SEQ ID NO: 478386 - protein, 9 aa, Influenza virus
NALGDCPKY

SEQ ID NO: 478387 - protein, 9 aa, Influenza virus
NALGECPKY

SEQ ID NO: 478388 - protein, 9 aa, Influenza virus
NALGNCPKY

SEQ ID NO: 478389 - protein, 9 aa, Influenza virus
NALIDDRSK

SEQ ID NO: 478390 - protein, 9 aa, Influenza virus
NALLKHRFE

SEQ ID NO: 478391 - protein, 9 aa, Influenza virus
NALNGNGDP

SEQ ID NO: 478392 - protein, 9 aa, Influenza virus
NALRLAENK

SEQ ID NO: 478393 - protein, 9 aa, Influenza virus
NALSGNGDP

SEQ ID NO: 478394 - protein, 9 aa, Influenza virus
NALSIAPIM

SEQ ID NO: 478395 - protein, 9 aa, Influenza virus
NALTDDKSK

SEQ ID NO: 478396 - protein, 9 aa, Influenza virus
NALTDDRSK

SEQ ID NO: 478397 - protein, 9 aa, Influenza virus
NALTDNRSK

SEQ ID NO: 478398 - protein, 9 aa, Influenza virus
NALTGGQSF

SEQ ID NO: 478399 - protein, 9 aa, Influenza virus
NALTNDRSK

SEQ ID NO: 478400 - protein, 9 aa, Influenza virus
NALYGTQSL

SEQ ID NO: 478401 - protein, 9 aa, Influenza virus
NAMDAGNGC

SEQ ID NO: 478402 - protein, 9 aa, Influenza virus
NANDLGNGC

SEQ ID NO: 478403 - protein, 9 aa, Influenza virus
NANTLSSVN

SEQ ID NO: 478404 - protein, 9 aa, Influenza virus
NANTLSSVT

SEQ ID NO: 478405 - protein, 9 aa, Influenza virus
NANTLTSVT

SEQ ID NO: 478406 - protein, 9 aa, Influenza virus
NAPHKLCFP

SEQ ID NO: 478407 - protein, 9 aa, Influenza virus
NAPHKLCYP

SEQ ID NO: 478408 - protein, 9 aa, Influenza virus
NAPNKFCYP

SEQ ID NO: 478409 - protein, 9 aa, Influenza virus
NAPNKLCFP

SEQ ID NO: 478410 - protein, 9 aa, Influenza virus
NAPNKLCYP

SEQ ID NO: 478411 - protein, 9 aa, Influenza virus
NAPSGIEYN

SEQ ID NO: 478412 - protein, 9 aa, Influenza virus
NAPSGVEYN

SEQ ID NO: 478413 - protein, 9 aa, Influenza virus
NAQAFYKIL

SEQ ID NO: 478414 - protein, 9 aa, Influenza virus
NAQGEGIAA

SEQ ID NO: 478415 - protein, 9 aa, Influenza virus
NAQGEGTAA

SEQ ID NO: 478416 - protein, 9 aa, Influenza virus
NAQGIGQAA

SEQ ID NO: 478417 - protein, 9 aa, Influenza virus
NAQGQGTAA

SEQ ID NO: 478418 - protein, 9 aa, Influenza virus
NAQGSGYAA

SEQ ID NO: 478419 - protein, 9 aa, Influenza virus
NAQGTGLAA

SEQ ID NO: 478420 - protein, 9 aa, Influenza virus
NAQGTGQAA

SEQ ID NO: 478421 - protein, 9 aa, Influenza virus
NAQHIEECS

SEQ ID NO: 478422 - protein, 9 aa, Influenza virus
NAQHVEECS

SEQ ID NO: 478423 - protein, 9 aa, Influenza virus
NAQLLVLLE

SEQ ID NO: 478424 - protein, 9 aa, Influenza virus
NAQLLVWLE

SEQ ID NO: 478425 - protein, 9 aa, Influenza virus
NARELGNGC

SEQ ID NO: 478426 - protein, 9 aa, Influenza virus
NARLLVLLE

SEQ ID NO: 478427 - protein, 9 aa, Influenza virus
NASAIVWYN

SEQ ID NO: 478428 - protein, 9 aa, Influenza virus
NASAVIWYK

SEQ ID NO: 478429 - protein, 9 aa, Influenza virus
NASAVIWYN

SEQ ID NO: 478430 - protein, 9 aa, Influenza virus
NASAVVWYN

SEQ ID NO: 478431 - protein, 9 aa, Influenza virus
NASCAAMDD

SEQ ID NO: 478432 - protein, 9 aa, Influenza virus
NASCAAMDE

SEQ ID NO: 478433 - protein, 9 aa, Influenza virus
NASCAAMED

SEQ ID NO: 478434 - protein, 9 aa, Influenza virus
NASPVIWYN

SEQ ID NO: 478435 - protein, 9 aa, Influenza virus
NASRHHMGE

SEQ ID NO: 478436 - protein, 9 aa, Influenza virus
NASRHYMGE

SEQ ID NO: 478437 - protein, 9 aa, Influenza virus
NASRYYMGE

SEQ ID NO: 478438 - protein, 9 aa, Influenza virus
NASTGAQSF

SEQ ID NO: 478439 - protein, 9 aa, Influenza virus
NASTGGQAF

SEQ ID NO: 478440 - protein, 9 aa, Influenza virus
NASTGGQSF

SEQ ID NO: 478441 - protein, 9 aa, Influenza virus
NASWFNSFL

SEQ ID NO: 478442 - protein, 9 aa, Influenza virus
NATASFIYD

SEQ ID NO: 478443 - protein, 9 aa, Influenza virus
NATASFIYE

SEQ ID NO: 478444 - protein, 9 aa, Influenza virus
NATASFIYG

SEQ ID NO: 478445 - protein, 9 aa, Influenza virus
NATASFIYN

SEQ ID NO: 478446 - protein, 9 aa, Influenza virus
NATASFVYD

SEQ ID NO: 478447 - protein, 9 aa, Influenza virus
NATASLIYD

SEQ ID NO: 478448 - protein, 9 aa, Influenza virus
NATASLIYN

SEQ ID NO: 478449 - protein, 9 aa, Influenza virus
NATATVYYD

SEQ ID NO: 478450 - protein, 9 aa, Influenza virus
NATATVYYN

SEQ ID NO: 478451 - protein, 9 aa, Influenza virus
NATDTVDTL

SEQ ID NO: 478452 - protein, 9 aa, Influenza virus
NATETVEIT

SEQ ID NO: 478453 - protein, 9 aa, Influenza virus
NATETVENK

SEQ ID NO: 478454 - protein, 9 aa, Influenza virus
NATETVERT

SEQ ID NO: 478455 - protein, 9 aa, Influenza virus
NATETVESK

SEQ ID NO: 478456 - protein, 9 aa, Influenza virus
NATETVESR

SEQ ID NO: 478457 - protein, 9 aa, Influenza virus
NATETVEST

SEQ ID NO: 478458 - protein, 9 aa, Influenza virus
NATETVETA

SEQ ID NO: 478459 - protein, 9 aa, Influenza virus
NATETVETT

SEQ ID NO: 478460 - protein, 9 aa, Influenza virus
NATETVETV

SEQ ID NO: 478461 - protein, 9 aa, Influenza virus
NAVDEGNGC

SEQ ID NO: 478462 - protein, 9 aa, Influenza virus
NAVDTGDGC

SEQ ID NO: 478463 - protein, 9 aa, Influenza virus
NAVDTGNGC

SEQ ID NO: 478464 - protein, 9 aa, Influenza virus
NAVRFGESE

SEQ ID NO: 478465 - protein, 9 aa, Influenza virus
NAVRIGEDA

SEQ ID NO: 478466 - protein, 9 aa, Influenza virus
NAVRIGEDS

SEQ ID NO: 478467 - protein, 9 aa, Influenza virus
NAVRIGENS

SEQ ID NO: 478468 - protein, 9 aa, Influenza virus
NAYDRICIG

SEQ ID NO: 478469 - protein, 9 aa, Influenza virus
NAYQAKFES

SEQ ID NO: 478470 - protein, 9 aa, Influenza virus
NAYQARFES

SEQ ID NO: 478471 - protein, 9 aa, Influenza virus
NBNGVKGFS

SEQ ID NO: 478472 - protein, 9 aa, Influenza virus
NCDAKCQTP

SEQ ID NO: 478473 - protein, 9 aa, Influenza virus
NCDTKCQTP

SEQ ID NO: 478474 - protein, 9 aa, Influenza virus
NCETKCQSP

SEQ ID NO: 478475 - protein, 9 aa, Influenza virus
NCETKCQTP

SEQ ID NO: 478476 - protein, 9 aa, Influenza virus
NCETQCQTP

SEQ ID NO: 478477 - protein, 9 aa, Influenza virus
NCHTKCQTY

SEQ ID NO: 478478 - protein, 9 aa, Influenza virus
NCIESIRNG

SEQ ID NO: 478479 - protein, 9 aa, Influenza virus
NCIKPCFWV

SEQ ID NO: 478480 - protein, 9 aa, Influenza virus
NCINRCFYV

SEQ ID NO: 478481 - protein, 9 aa, Influenza virus
NCIRPCFWV

SEQ ID NO: 478482 - protein, 9 aa, Influenza virus
NCKDPNNER

SEQ ID NO: 478483 - protein, 9 aa, Influenza virus
NCKTKCQTY

SEQ ID NO: 478484 - protein, 9 aa, Influenza virus
NCLVPCFWV

SEQ ID NO: 478485 - protein, 9 aa, Influenza virus
NCLYASPQL

SEQ ID NO: 478486 - protein, 9 aa, Influenza virus
NCMERIRNN

SEQ ID NO: 478487 - protein, 9 aa, Influenza virus
NCMESIRDN

SEQ ID NO: 478488 - protein, 9 aa, Influenza virus
NCMESIRNN

SEQ ID NO: 478489 - protein, 9 aa, Influenza virus
NCMRPCFWV

SEQ ID NO: 478490 - protein, 9 aa, Influenza virus
NCNAKCQTP

SEQ ID NO: 478491 - protein, 9 aa, Influenza virus
NCNTKCQTP

SEQ ID NO: 478492 - protein, 9 aa, Influenza virus
NCNTKCQTY

SEQ ID NO: 478493 - protein, 9 aa, Influenza virus
NCPKYIKSG

SEQ ID NO: 478494 - protein, 9 aa, Influenza virus
NCPKYVKQG

SEQ ID NO: 478495 - protein, 9 aa, Influenza virus
NCRDPNNEK

SEQ ID NO: 478496 - protein, 9 aa, Influenza virus
NCRDPNNER

SEQ ID NO: 478497 - protein, 9 aa, Influenza virus
NCRDPNNES

SEQ ID NO: 478498 - protein, 9 aa, Influenza virus
NCRDSNNER

SEQ ID NO: 478499 - protein, 9 aa, Influenza virus
NCRNPNNEK

SEQ ID NO: 478500 - protein, 9 aa, Influenza virus
NCRNPNNER

SEQ ID NO: 478501 - protein, 9 aa, Influenza virus
NCTIPCFWV

SEQ ID NO: 478502 - protein, 9 aa, Influenza virus
NCTVPCFWV

SEQ ID NO: 478503 - protein, 9 aa, Influenza virus
NCWSFALAQ

SEQ ID NO: 478504 - protein, 9 aa, Influenza virus
NCYPGATVN

SEQ ID NO: 478505 - protein, 9 aa, Influenza virus
NCYQFALGQ

SEQ ID NO: 478506 - protein, 9 aa, Influenza virus
NCYTKCQTY

SEQ ID NO: 478507 - protein, 9 aa, Influenza virus
NCYWVMTDG

SEQ ID NO: 478508 - protein, 9 aa, Influenza virus
NDATYQRTR

SEQ ID NO: 478509 - protein, 9 aa, Influenza virus
NDAYAVIHY

SEQ ID NO: 478510 - protein, 9 aa, Influenza virus
NDCESKCFW

SEQ ID NO: 478511 - protein, 9 aa, Influenza virus
NDDIDQSLI

SEQ ID NO: 478512 - protein, 9 aa, Influenza virus
NDDSSSNSN

SEQ ID NO: 478513 - protein, 9 aa, Influenza virus
NDDSSSSSN

SEQ ID NO: 478514 - protein, 9 aa, Influenza virus
NDDVDQSLI

SEQ ID NO: 478515 - protein, 9 aa, Influenza virus
NDDVDQSLV

SEQ ID NO: 478516 - protein, 9 aa, Influenza virus
NDDVSWASN

SEQ ID NO: 478517 - protein, 9 aa, Influenza virus
NDDVSWTSN

SEQ ID NO: 478518 - protein, 9 aa, Influenza virus
NDEGTGIAA

SEQ ID NO: 478519 - protein, 9 aa, Influenza virus
NDERGNPGV

SEQ ID NO: 478520 - protein, 9 aa, Influenza virus
NDEVSWTSN

SEQ ID NO: 478521 - protein, 9 aa, Influenza virus
NDFFKRLNW

SEQ ID NO: 478522 - protein, 9 aa, Influenza virus
NDFFNRLNW

SEQ ID NO: 478523 - protein, 9 aa, Influenza virus
NDFFRRLNW

SEQ ID NO: 478524 - protein, 9 aa, Influenza virus
NDGKVECVC

SEQ ID NO: 478525 - protein, 9 aa, Influenza virus
NDIWMGRTI

SEQ ID NO: 478526 - protein, 9 aa, Influenza virus
NDKHSNETV

SEQ ID NO: 478527 - protein, 9 aa, Influenza virus
NDKHSNGTA

SEQ ID NO: 478528 - protein, 9 aa, Influenza virus
NDKHSNGTI

SEQ ID NO: 478529 - protein, 9 aa, Influenza virus
NDKHSNGTM

SEQ ID NO: 478530 - protein, 9 aa, Influenza virus
NDKHSNGTV

SEQ ID NO: 478531 - protein, 9 aa, Influenza virus
NDKHSNNTV

SEQ ID NO: 478532 - protein, 9 aa, Influenza virus
NDKIDDQIE

SEQ ID NO: 478533 - protein, 9 aa, Influenza virus
NDKINDQIE

SEQ ID NO: 478534 - protein, 9 aa, Influenza virus
NDKPFQNVN

SEQ ID NO: 478535 - protein, 9 aa, Influenza virus
NDKTLDLHD

SEQ ID NO: 478536 - protein, 9 aa, Influenza virus
NDKTLDMHD

SEQ ID NO: 478537 - protein, 9 aa, Influenza virus
NDKTLNMHD

SEQ ID NO: 478538 - protein, 9 aa, Influenza virus
NDKYHQIEK

SEQ ID NO: 478539 - protein, 9 aa, Influenza virus
NDLGNGCFE

SEQ ID NO: 478540 - protein, 9 aa, Influenza virus
NDLGPATAQ

SEQ ID NO: 478541 - protein, 9 aa, Influenza virus
NDLWMGRTI

SEQ ID NO: 478542 - protein, 9 aa, Influenza virus
NDLYGTQPL

SEQ ID NO: 478543 - protein, 9 aa, Influenza virus
NDLYGTQSL

SEQ ID NO: 478544 - protein, 9 aa, Influenza virus
NDNASAVVW

SEQ ID NO: 478545 - protein, 9 aa, Influenza virus
NDNATATVY

SEQ ID NO: 478546 - protein, 9 aa, Influenza virus
NDNCMESIR

SEQ ID NO: 478547 - protein, 9 aa, Influenza virus
NDNVSWTSN

SEQ ID NO: 478548 - protein, 9 aa, Influenza virus
NDNWSGYSG

SEQ ID NO: 478549 - protein, 9 aa, Influenza virus
NDPSGYAQT

SEQ ID NO: 478550 - protein, 9 aa, Influenza virus
NDPWVLLNA

SEQ ID NO: 478551 - protein, 9 aa, Influenza virus
NDPYPGNNN

SEQ ID NO: 478552 - protein, 9 aa, Influenza virus
NDPYPGNSN

SEQ ID NO: 478553 - protein, 9 aa, Influenza virus
NDQGAGYAA

SEQ ID NO: 478554 - protein, 9 aa, Influenza virus
NDQGSGYAA

SEQ ID NO: 478555 - protein, 9 aa, Influenza virus
NDQIEDLWA

SEQ ID NO: 478556 - protein, 9 aa, Influenza virus
NDQITDIWA

SEQ ID NO: 478557 - protein, 9 aa, Influenza virus
NDRHSNGTI

SEQ ID NO: 478558 - protein, 9 aa, Influenza virus
NDRHSNGTV

SEQ ID NO: 478559 - protein, 9 aa, Influenza virus
NDRNFWRGD

SEQ ID NO: 478560 - protein, 9 aa, Influenza virus
NDRNFWRGE

SEQ ID NO: 478561 - protein, 9 aa, Influenza virus
NDRSPFRAL

SEQ ID NO: 478562 - protein, 9 aa, Influenza virus
NDRSPHRTL

SEQ ID NO: 478563 - protein, 9 aa, Influenza virus
NDRTLDLHD

SEQ ID NO: 478564 - protein, 9 aa, Influenza virus
NDRTPYRSL

SEQ ID NO: 478565 - protein, 9 aa, Influenza virus
NDSCMDTIR

SEQ ID NO: 478566 - protein, 9 aa, Influenza virus
NDSCMEAIR

SEQ ID NO: 478567 - protein, 9 aa, Influenza virus
NDSCMETIR

SEQ ID NO: 478568 - protein, 9 aa, Influenza virus
NDTDVVNFL

SEQ ID NO: 478569 - protein, 9 aa, Influenza virus
NDTDVVNFV

SEQ ID NO: 478570 - protein, 9 aa, Influenza virus
NDTDVVNYV

SEQ ID NO: 478571 - protein, 9 aa, Influenza virus
NDTINYYNE

SEQ ID NO: 478572 - protein, 9 aa, Influenza virus
NDTITFSFN

SEQ ID NO: 478573 - protein, 9 aa, Influenza virus
NDTTYQRTR

SEQ ID NO: 478574 - protein, 9 aa, Influenza virus
NDTVIFSFN

SEQ ID NO: 478575 - protein, 9 aa, Influenza virus
NDTVNFSFN

SEQ ID NO: 478576 - protein, 9 aa, Influenza virus
NDTVTFIFN

SEQ ID NO: 478577 - protein, 9 aa, Influenza virus
NDTVTFNFN

SEQ ID NO: 478578 - protein, 9 aa, Influenza virus
NDTVTFSFN

SEQ ID NO: 478579 - protein, 9 aa, Influenza virus
NDTVTFTFN

SEQ ID NO: 478580 - protein, 9 aa, Influenza virus
NDVWLGRTI

SEQ ID NO: 478581 - protein, 9 aa, Influenza virus
NDVWLGRTV

SEQ ID NO: 478582 - protein, 9 aa, Influenza virus
NDVWMGRTI

SEQ ID NO: 478583 - protein, 9 aa, Influenza virus
NDWSGYSGS

SEQ ID NO: 478584 - protein, 9 aa, Influenza virus
NDYEELKHF

SEQ ID NO: 478585 - protein, 9 aa, Influenza virus
NDYEELKHL

SEQ ID NO: 478586 - protein, 9 aa, Influenza virus
NDYEELKLL

SEQ ID NO: 478587 - protein, 9 aa, Influenza virus
NDYEELKYL

SEQ ID NO: 478588 - protein, 9 aa, Influenza virus
NEAINNRFQ

SEQ ID NO: 478589 - protein, 9 aa, Influenza virus
NEALNNRFQ

SEQ ID NO: 478590 - protein, 9 aa, Influenza virus
NEAVAVLKY

SEQ ID NO: 478591 - protein, 9 aa, Influenza virus
NECIEKIRN

SEQ ID NO: 478592 - protein, 9 aa, Influenza virus
NECIEKVRN

SEQ ID NO: 478593 - protein, 9 aa, Influenza virus
NECIERVRN

SEQ ID NO: 478594 - protein, 9 aa, Influenza virus
NECMETIKN

SEQ ID NO: 478595 - protein, 9 aa, Influenza virus
NECRFYALS

SEQ ID NO: 478596 - protein, 9 aa, Influenza virus
NECRTFFLT

SEQ ID NO: 478597 - protein, 9 aa, Influenza virus
NECYNPCFY

SEQ ID NO: 478598 - protein, 9 aa, Influenza virus
NEDGDIIFL

SEQ ID NO: 478599 - protein, 9 aa, Influenza virus
NEDGNIIFL

SEQ ID NO: 478600 - protein, 9 aa, Influenza virus
NEDGSSSSN

SEQ ID NO: 478601 - protein, 9 aa, Influenza virus
NEDIPIENC

SEQ ID NO: 478602 - protein, 9 aa, Influenza virus
NEDIPIGNC

SEQ ID NO: 478603 - protein, 9 aa, Influenza virus
NEDIPIGSC

SEQ ID NO: 478604 - protein, 9 aa, Influenza virus
NEDSSSNSN

SEQ ID NO: 478605 - protein, 9 aa, Influenza virus
NEDSSSSSN

SEQ ID NO: 478606 - protein, 9 aa, Influenza virus
NEEALRQII

SEQ ID NO: 478607 - protein, 9 aa, Influenza virus
NEEALRQIL

SEQ ID NO: 478608 - protein, 9 aa, Influenza virus
NEEALRQKI

SEQ ID NO: 478609 - protein, 9 aa, Influenza virus
NEEGDIIFL

SEQ ID NO: 478610 - protein, 9 aa, Influenza virus
NEEGTGIAA

SEQ ID NO: 478611 - protein, 9 aa, Influenza virus
NEEPLRQIL

SEQ ID NO: 478612 - protein, 9 aa, Influenza virus
NEERGNPGV

SEQ ID NO: 478613 - protein, 9 aa, Influenza virus
NEERGSPGV

SEQ ID NO: 478614 - protein, 9 aa, Influenza virus
NEESLRQIL

SEQ ID NO: 478615 - protein, 9 aa, Influenza virus
NEESLRQVL

SEQ ID NO: 478616 - protein, 9 aa, Influenza virus
NEFNEIEQQ

SEQ ID NO: 478617 - protein, 9 aa, Influenza virus
NEFNEVEQQ

SEQ ID NO: 478618 - protein, 9 aa, Influenza virus
NEFNKACEL

SEQ ID NO: 478619 - protein, 9 aa, Influenza virus
NEFSEIEQQ

SEQ ID NO: 478620 - protein, 9 aa, Influenza virus
NEFTEIEQQ

SEQ ID NO: 478621 - protein, 9 aa, Influenza virus
NEFTEVEKQ

SEQ ID NO: 478622 - protein, 9 aa, Influenza virus
NEFTEVEQQ

SEQ ID NO: 478623 - protein, 9 aa, Influenza virus
NEGALRQKI

SEQ ID NO: 478624 - protein, 9 aa, Influenza virus
NEGHIEECS

SEQ ID NO: 478625 - protein, 9 aa, Influenza virus
NEGIMNTSK

SEQ ID NO: 478626 - protein, 9 aa, Influenza virus
NEGKVECIC

SEQ ID NO: 478627 - protein, 9 aa, Influenza virus
NEGKVECVC

SEQ ID NO: 478628 - protein, 9 aa, Influenza virus
NEGNGCFEL

SEQ ID NO: 478629 - protein, 9 aa, Influenza virus
NEGRLIQNS

SEQ ID NO: 478630 - protein, 9 aa, Influenza virus
NEGRTSDMR

SEQ ID NO: 478631 - protein, 9 aa, Influenza virus
NEGSYFFGD

SEQ ID NO: 478632 - protein, 9 aa, Influenza virus
NEGVINTSK

SEQ ID NO: 478633 - protein, 9 aa, Influenza virus
NEGVMNTSK

SEQ ID NO: 478634 - protein, 9 aa, Influenza virus
NEHSNGTIH

SEQ ID NO: 478635 - protein, 9 aa, Influenza virus
NEHSNGTTH

SEQ ID NO: 478636 - protein, 9 aa, Influenza virus
NEIEHQIGN

SEQ ID NO: 478637 - protein, 9 aa, Influenza virus
NEIEQQIGN

SEQ ID NO: 478638 - protein, 9 aa, Influenza virus
NEIEYQIGN

SEQ ID NO: 478639 - protein, 9 aa, Influenza virus
NEIGVPFHL

SEQ ID NO: 478640 - protein, 9 aa, Influenza virus
NEIKGVELS

SEQ ID NO: 478641 - protein, 9 aa, Influenza virus
NEIKGVKLS

SEQ ID NO: 478642 - protein, 9 aa, Influenza virus
NEIRASVGR

SEQ ID NO: 478643 - protein, 9 aa, Influenza virus
NEITTKINN

SEQ ID NO: 478644 - protein, 9 aa, Influenza virus
NEKFHQIEK

SEQ ID NO: 478645 - protein, 9 aa, Influenza virus
NEKGNPGVK

SEQ ID NO: 478646 - protein, 9 aa, Influenza virus
NEKGNQGVK

SEQ ID NO: 478647 - protein, 9 aa, Influenza virus
NEKKAKLAN

SEQ ID NO: 478648 - protein, 9 aa, Influenza virus
NEKPFQNVN

SEQ ID NO: 478649 - protein, 9 aa, Influenza virus
NEKTLDLHD

SEQ ID NO: 478650 - protein, 9 aa, Influenza virus
NEKYHQIEK

SEQ ID NO: 478651 - protein, 9 aa, Influenza virus
NELGIPFHL

SEQ ID NO: 478652 - protein, 9 aa, Influenza virus
NELGVPFHL

SEQ ID NO: 478653 - protein, 9 aa, Influenza virus
NELGVPFHM

SEQ ID NO: 478654 - protein, 9 aa, Influenza virus
NELGVPFNL

SEQ ID NO: 478655 - protein, 9 aa, Influenza virus
NELGVPFYL

SEQ ID NO: 478656 - protein, 9 aa, Influenza virus
NELGVPLHL

SEQ ID NO: 478657 - protein, 9 aa, Influenza virus
NELGVSFHL

SEQ ID NO: 478658 - protein, 9 aa, Influenza virus
NELYGTQSL

SEQ ID NO: 478659 - protein, 9 aa, Influenza virus
NEMTLDFHD

SEQ ID NO: 478660 - protein, 9 aa, Influenza virus
NENATATVY

SEQ ID NO: 478661 - protein, 9 aa, Influenza virus
NENGDIIFL

SEQ ID NO: 478662 - protein, 9 aa, Influenza virus
NENPAHKSQ

SEQ ID NO: 478663 - protein, 9 aa, Influenza virus
NENPVHKSQ

SEQ ID NO: 478664 - protein, 9 aa, Influenza virus
NENQNPRIF

SEQ ID NO: 478665 - protein, 9 aa, Influenza virus
NENQNPRMF

SEQ ID NO: 478666 - protein, 9 aa, Influenza virus
NENQNPRVF

SEQ ID NO: 478667 - protein, 9 aa, Influenza virus
NEPGSGDWP

SEQ ID NO: 478668 - protein, 9 aa, Influenza virus
NEPGSGNWP

SEQ ID NO: 478669 - protein, 9 aa, Influenza virus
NEPSGYAQT

SEQ ID NO: 478670 - protein, 9 aa, Influenza virus
NEPTGYAQT

SEQ ID NO: 478671 - protein, 9 aa, Influenza virus
NEPYPGNNN

SEQ ID NO: 478672 - protein, 9 aa, Influenza virus
NEQGGGYAA

SEQ ID NO: 478673 - protein, 9 aa, Influenza virus
NEQGMGMAA

SEQ ID NO: 478674 - protein, 9 aa, Influenza virus
NEQGSGFAA

SEQ ID NO: 478675 - protein, 9 aa, Influenza virus
NEQGSGYAA

SEQ ID NO: 478676 - protein, 9 aa, Influenza virus
NEQGTGIAA

SEQ ID NO: 478677 - protein, 9 aa, Influenza virus
NEQGVGIAA

SEQ ID NO: 478678 - protein, 9 aa, Influenza virus
NEQGVGMAA

SEQ ID NO: 478679 - protein, 9 aa, Influenza virus
NEQTDLYKV

SEQ ID NO: 478680 - protein, 9 aa, Influenza virus
NERGLFGAI

SEQ ID NO: 478681 - protein, 9 aa, Influenza virus
NERGNHGVK

SEQ ID NO: 478682 - protein, 9 aa, Influenza virus
NERGNPGVK

SEQ ID NO: 478683 - protein, 9 aa, Influenza virus
NERGNQGVK

SEQ ID NO: 478684 - protein, 9 aa, Influenza virus
NERGTQGVK

SEQ ID NO: 478685 - protein, 9 aa, Influenza virus
NERILDFHD

SEQ ID NO: 478686 - protein, 9 aa, Influenza virus
NERTLDFHD

SEQ ID NO: 478687 - protein, 9 aa, Influenza virus
NERTLDLHD

SEQ ID NO: 478688 - protein, 9 aa, Influenza virus
NERTLDMHD

SEQ ID NO: 478689 - protein, 9 aa, Influenza virus
NERTLDQHD

SEQ ID NO: 478690 - protein, 9 aa, Influenza virus
NERTLDYHD

SEQ ID NO: 478691 - protein, 9 aa, Influenza virus
NERTLYFHD

SEQ ID NO: 478692 - protein, 9 aa, Influenza virus
NESADMSIG

SEQ ID NO: 478693 - protein, 9 aa, Influenza virus
NESGRLIDF

SEQ ID NO: 478694 - protein, 9 aa, Influenza virus
NESGRLMDF

SEQ ID NO: 478695 - protein, 9 aa, Influenza virus
NETFVNMTN

SEQ ID NO: 478696 - protein, 9 aa, Influenza virus
NETFVNVTH

SEQ ID NO: 478697 - protein, 9 aa, Influenza virus
NETFVNVTN

SEQ ID NO: 478698 - protein, 9 aa, Influenza virus
NETIIETGY

SEQ ID NO: 478699 - protein, 9 aa, Influenza virus
NETILETGY

SEQ ID NO: 478700 - protein, 9 aa, Influenza virus
NETIVETGY

SEQ ID NO: 478701 - protein, 9 aa, Influenza virus
NETVKDRSP

SEQ ID NO: 478702 - protein, 9 aa, Influenza virus
NEVEQQIGN

SEQ ID NO: 478703 - protein, 9 aa, Influenza virus
NEVGAKILT

SEQ ID NO: 478704 - protein, 9 aa, Influenza virus
NEVGARIIT

SEQ ID NO: 478705 - protein, 9 aa, Influenza virus
NEVGARILT

SEQ ID NO: 478706 - protein, 9 aa, Influenza virus
NEVKLEENT

SEQ ID NO: 478707 - protein, 9 aa, Influenza virus
NEWSGYSGS

SEQ ID NO: 478708 - protein, 9 aa, Influenza virus
NFDSNGNFI

SEQ ID NO: 478709 - protein, 9 aa, Influenza virus
NFEGWIVGN

SEQ ID NO: 478710 - protein, 9 aa, Influenza virus
NFEKEGYSL

SEQ ID NO: 478711 - protein, 9 aa, Influenza virus
NFESNGNFI

SEQ ID NO: 478712 - protein, 9 aa, Influenza virus
NFESNGNLI

SEQ ID NO: 478713 - protein, 9 aa, Influenza virus
NFESTGNLI

SEQ ID NO: 478714 - protein, 9 aa, Influenza virus
NFESTGNLV

SEQ ID NO: 478715 - protein, 9 aa, Influenza virus
NFFHKCNDS

SEQ ID NO: 478716 - protein, 9 aa, Influenza virus
NFHYEECSC

SEQ ID NO: 478717 - protein, 9 aa, Influenza virus
NFIAPENAY

SEQ ID NO: 478718 - protein, 9 aa, Influenza virus
NFIAPEYAF

SEQ ID NO: 478719 - protein, 9 aa, Influenza virus
NFIAPEYAY

SEQ ID NO: 478720 - protein, 9 aa, Influenza virus
NFKPNIGPR

SEQ ID NO: 478721 - protein, 9 aa, Influenza virus
NFLSMEFSL

SEQ ID NO: 478722 - protein, 9 aa, Influenza virus
NFMPYISFA

SEQ ID NO: 478723 - protein, 9 aa, Influenza virus
NFNDYEELK

SEQ ID NO: 478724 - protein, 9 aa, Influenza virus
NFNGAFIAP

SEQ ID NO: 478725 - protein, 9 aa, Influenza virus
NFNGAFVAP

SEQ ID NO: 478726 - protein, 9 aa, Influenza virus
NFPQTANTY

SEQ ID NO: 478727 - protein, 9 aa, Influenza virus
NFPQTTNTY

SEQ ID NO: 478728 - protein, 9 aa, Influenza virus
NFPRTTNTY

SEQ ID NO: 478729 - protein, 9 aa, Influenza virus
NFQPNIGPR

SEQ ID NO: 478730 - protein, 9 aa, Influenza virus
NFRAYVDGF

SEQ ID NO: 478731 - protein, 9 aa, Influenza virus
NFRTYVDGF

SEQ ID NO: 478732 - protein, 9 aa, Influenza virus
NFRVYVDGF

SEQ ID NO: 478733 - protein, 9 aa, Influenza virus
NFSFNGAFI

SEQ ID NO: 478734 - protein, 9 aa, Influenza virus
NFSMELPSF

SEQ ID NO: 478735 - protein, 9 aa, Influenza virus
NFVIEKMNT

SEQ ID NO: 478736 - protein, 9 aa, Influenza virus
NFVNRANQR

SEQ ID NO: 478737 - protein, 9 aa, Influenza virus
NFVPVIGAR

SEQ ID NO: 478738 - protein, 9 aa, Influenza virus
NFVPVMGAR

SEQ ID NO: 478739 - protein, 9 aa, Influenza virus
NFVPVVGAR

SEQ ID NO: 478740 - protein, 9 aa, Influenza virus
NFVPVVRAR

SEQ ID NO: 478741 - protein, 9 aa, Influenza virus
NFVRQCFNP

SEQ ID NO: 478742 - protein, 9 aa, Influenza virus
NFVSMEFSL

SEQ ID NO: 478743 - protein, 9 aa, Influenza virus
NFWRGDNGR

SEQ ID NO: 478744 - protein, 9 aa, Influenza virus
NFWRGENGR

SEQ ID NO: 478745 - protein, 9 aa, Influenza virus
NFYYEECSC

SEQ ID NO: 478746 - protein, 9 aa, Influenza virus
NGAFIAPDR

SEQ ID NO: 478747 - protein, 9 aa, Influenza virus
NGAFIAPNR

SEQ ID NO: 478748 - protein, 9 aa, Influenza virus
NGAFIAPRY

SEQ ID NO: 478749 - protein, 9 aa, Influenza virus
NGAFLAPGY

SEQ ID NO: 478750 - protein, 9 aa, Influenza virus
NGAFLAPRY

SEQ ID NO: 478751 - protein, 9 aa, Influenza virus
NGAFVAPDR

SEQ ID NO: 478752 - protein, 9 aa, Influenza virus
NGAKVNTLT

SEQ ID NO: 478753 - protein, 9 aa, Influenza virus
NGALGSPGC

SEQ ID NO: 478754 - protein, 9 aa, Influenza virus
NGALLAPRY

SEQ ID NO: 478755 - protein, 9 aa, Influenza virus
NGAQIQYFS

SEQ ID NO: 478756 - protein, 9 aa, Influenza virus
NGAVAVLKY

SEQ ID NO: 478757 - protein, 9 aa, Influenza virus
NGAVAVVKY

SEQ ID NO: 478758 - protein, 9 aa, Influenza virus
NGAWIGRTK

SEQ ID NO: 478759 - protein, 9 aa, Influenza virus
NGCFDILHK

SEQ ID NO: 478760 - protein, 9 aa, Influenza virus
NGCFEFWHK

SEQ ID NO: 478761 - protein, 9 aa, Influenza virus
NGCFEFYHK

SEQ ID NO: 478762 - protein, 9 aa, Influenza virus
NGCFEFYHR

SEQ ID NO: 478763 - protein, 9 aa, Influenza virus
NGCFEIFHK

SEQ ID NO: 478764 - protein, 9 aa, Influenza virus
NGCFEIFHQ

SEQ ID NO: 478765 - protein, 9 aa, Influenza virus
NGCFEIFHR

SEQ ID NO: 478766 - protein, 9 aa, Influenza virus
NGCFELLHK

SEQ ID NO: 478767 - protein, 9 aa, Influenza virus
NGCFELYHK

SEQ ID NO: 478768 - protein, 9 aa, Influenza virus
NGCFKIYHK

SEQ ID NO: 478769 - protein, 9 aa, Influenza virus
NGCFPFYHK

SEQ ID NO: 478770 - protein, 9 aa, Influenza virus
NGCFQPCFY

SEQ ID NO: 478771 - protein, 9 aa, Influenza virus
NGCFTFYHK

SEQ ID NO: 478772 - protein, 9 aa, Influenza virus
NGCFTIYHK

SEQ ID NO: 478773 - protein, 9 aa, Influenza virus
NGCIEGKLS

SEQ ID NO: 478774 - protein, 9 aa, Influenza virus
NGCIESKLS

SEQ ID NO: 478775 - protein, 9 aa, Influenza virus
NGCLKIYHK

SEQ ID NO: 478776 - protein, 9 aa, Influenza virus
NGDDVWMGR

SEQ ID NO: 478777 - protein, 9 aa, Influenza virus
NGDGCFEIL

SEQ ID NO: 478778 - protein, 9 aa, Influenza virus
NGDIIFLWG

SEQ ID NO: 478779 - protein, 9 aa, Influenza virus
NGDPNNMDK

SEQ ID NO: 478780 - protein, 9 aa, Influenza virus
NGDPNNMDR

SEQ ID NO: 478781 - protein, 9 aa, Influenza virus
NGDYARLYI

SEQ ID NO: 478782 - protein, 9 aa, Influenza virus
NGDYTRLYI

SEQ ID NO: 478783 - protein, 9 aa, Influenza virus
NGEALRQIL

SEQ ID NO: 478784 - protein, 9 aa, Influenza virus
NGELRHLFS

SEQ ID NO: 478785 - protein, 9 aa, Influenza virus
NGEPGVKGF

SEQ ID NO: 478786 - protein, 9 aa, Influenza virus
NGEQILIIW

SEQ ID NO: 478787 - protein, 9 aa, Influenza virus
NGFAPFSKD

SEQ ID NO: 478788 - protein, 9 aa, Influenza virus
NGFCFTVMT

SEQ ID NO: 478789 - protein, 9 aa, Influenza virus
NGFEMLKIP

SEQ ID NO: 478790 - protein, 9 aa, Influenza virus
NGFLDVWTY

SEQ ID NO: 478791 - protein, 9 aa, Influenza virus
NGGFLAPRY

SEQ ID NO: 478792 - protein, 9 aa, Influenza virus
NGGHIEECS

SEQ ID NO: 478793 - protein, 9 aa, Influenza virus
NGGLGVKGF

SEQ ID NO: 478794 - protein, 9 aa, Influenza virus
NGGLIAPDR

SEQ ID NO: 478795 - protein, 9 aa, Influenza virus
NGGLIAPNR

SEQ ID NO: 478796 - protein, 9 aa, Influenza virus
NGGLIAPRY

SEQ ID NO: 478797 - protein, 9 aa, Influenza virus
NGGLIAPSR

SEQ ID NO: 478798 - protein, 9 aa, Influenza virus
NGGLLAPKY

SEQ ID NO: 478799 - protein, 9 aa, Influenza virus
NGGLLAPRY

SEQ ID NO: 478800 - protein, 9 aa, Influenza virus
NGGPGVKGF

SEQ ID NO: 478801 - protein, 9 aa, Influenza virus
NGGRIAPSR

SEQ ID NO: 478802 - protein, 9 aa, Influenza virus
NGICPVVFT

SEQ ID NO: 478803 - protein, 9 aa, Influenza virus
NGICTVVMT

SEQ ID NO: 478804 - protein, 9 aa, Influenza virus
NGICYPGIL

SEQ ID NO: 478805 - protein, 9 aa, Influenza virus
NGICYPGSL

SEQ ID NO: 478806 - protein, 9 aa, Influenza virus
NGICYPGTL

SEQ ID NO: 478807 - protein, 9 aa, Influenza virus
NGIITDTFK

SEQ ID NO: 478808 - protein, 9 aa, Influenza virus
NGIITDTLK

SEQ ID NO: 478809 - protein, 9 aa, Influenza virus
NGIKVDTLT

SEQ ID NO: 478810 - protein, 9 aa, Influenza virus
NGIPPLELG

SEQ ID NO: 478811 - protein, 9 aa, Influenza virus
NGIRIGSKG

SEQ ID NO: 478812 - protein, 9 aa, Influenza virus
NGIRIGSRG

SEQ ID NO: 478813 - protein, 9 aa, Influenza virus
NGIRVGSRG

SEQ ID NO: 478814 - protein, 9 aa, Influenza virus
NGISPIHLG

SEQ ID NO: 478815 - protein, 9 aa, Influenza virus
NGISPVHLG

SEQ ID NO: 478816 - protein, 9 aa, Influenza virus
NGITNKVNS

SEQ ID NO: 478817 - protein, 9 aa, Influenza virus
NGKAPISLG

SEQ ID NO: 478818 - protein, 9 aa, Influenza virus
NGKEPISLG

SEQ ID NO: 478819 - protein, 9 aa, Influenza virus
NGKFEFIAE

SEQ ID NO: 478820 - protein, 9 aa, Influenza virus
NGKFEFIVE

SEQ ID NO: 478821 - protein, 9 aa, Influenza virus
NGKGRYGVK

SEQ ID NO: 478822 - protein, 9 aa, Influenza virus
NGKLCKLNG

SEQ ID NO: 478823 - protein, 9 aa, Influenza virus
NGKLCKLSG

SEQ ID NO: 478824 - protein, 9 aa, Influenza virus
NGKLCRLNG

SEQ ID NO: 478825 - protein, 9 aa, Influenza virus
NGKLCRLRG

SEQ ID NO: 478826 - protein, 9 aa, Influenza virus
NGKLCRLSG

SEQ ID NO: 478827 - protein, 9 aa, Influenza virus
NGKLEFIAE

SEQ ID NO: 478828 - protein, 9 aa, Influenza virus
NGKLNRLIE

SEQ ID NO: 478829 - protein, 9 aa, Influenza virus
NGKPFQNVN

SEQ ID NO: 478830 - protein, 9 aa, Influenza virus
NGKQPISLG

SEQ ID NO: 478831 - protein, 9 aa, Influenza virus
NGKSGACKR

SEQ ID NO: 478832 - protein, 9 aa, Influenza virus
NGKSLGIQS

SEQ ID NO: 478833 - protein, 9 aa, Influenza virus
NGKSSACKR

SEQ ID NO: 478834 - protein, 9 aa, Influenza virus
NGKVECICR

SEQ ID NO: 478835 - protein, 9 aa, Influenza virus
NGKWREQLS

SEQ ID NO: 478836 - protein, 9 aa, Influenza virus
NGKYPVIKG

SEQ ID NO: 478837 - protein, 9 aa, Influenza virus
NGNCRFNVC

SEQ ID NO: 478838 - protein, 9 aa, Influenza virus
NGNDVWMGR

SEQ ID NO: 478839 - protein, 9 aa, Influenza virus
NGNFIAPEN

SEQ ID NO: 478840 - protein, 9 aa, Influenza virus
NGNFIAPEY

SEQ ID NO: 478841 - protein, 9 aa, Influenza virus
NGNFITPEY

SEQ ID NO: 478842 - protein, 9 aa, Influenza virus
NGNGCFELY

SEQ ID NO: 478843 - protein, 9 aa, Influenza virus
NGNGDPNNM

SEQ ID NO: 478844 - protein, 9 aa, Influenza virus
NGNHAVHYC

SEQ ID NO: 478845 - protein, 9 aa, Influenza virus
NGNIRCQIC

SEQ ID NO: 478846 - protein, 9 aa, Influenza virus
NGNIRCTFC

SEQ ID NO: 478847 - protein, 9 aa, Influenza virus
NGNLIAPEF

SEQ ID NO: 478848 - protein, 9 aa, Influenza virus
NGNLIAPEY

SEQ ID NO: 478849 - protein, 9 aa, Influenza virus
NGNLIAPLY

SEQ ID NO: 478850 - protein, 9 aa, Influenza virus
NGNLIAPRG

SEQ ID NO: 478851 - protein, 9 aa, Influenza virus
NGNLIAPWF

SEQ ID NO: 478852 - protein, 9 aa, Influenza virus
NGNLIAPWY

SEQ ID NO: 478853 - protein, 9 aa, Influenza virus
NGNLRCQIC

SEQ ID NO: 478854 - protein, 9 aa, Influenza virus
NGNLRCTIC

SEQ ID NO: 478855 - protein, 9 aa, Influenza virus
NGNLVAPRG

SEQ ID NO: 478856 - protein, 9 aa, Influenza virus
NGNLVAPWY

SEQ ID NO: 478857 - protein, 9 aa, Influenza virus
NGNMQCTIC

SEQ ID NO: 478858 - protein, 9 aa, Influenza virus
NGNMRCTIC

SEQ ID NO: 478859 - protein, 9 aa, Influenza virus
NGNMRCTIL

SEQ ID NO: 478860 - protein, 9 aa, Influenza virus
NGNMRCTSC

SEQ ID NO: 478861 - protein, 9 aa, Influenza virus
NGNVRCQIC

SEQ ID NO: 478862 - protein, 9 aa, Influenza virus
NGNVRCTFC

SEQ ID NO: 478863 - protein, 9 aa, Influenza virus
NGNYARLYI

SEQ ID NO: 478864 - protein, 9 aa, Influenza virus
NGNYDSIRG

SEQ ID NO: 478865 - protein, 9 aa, Influenza virus
NGNYGPINV

SEQ ID NO: 478866 - protein, 9 aa, Influenza virus
NGPDSVLVN

SEQ ID NO: 478867 - protein, 9 aa, Influenza virus
NGPESVLIN

SEQ ID NO: 478868 - protein, 9 aa, Influenza virus
NGPESVLVN

SEQ ID NO: 478869 - protein, 9 aa, Influenza virus
NGQAGRIDF

SEQ ID NO: 478870 - protein, 9 aa, Influenza virus
NGQAGRMTF

SEQ ID NO: 478871 - protein, 9 aa, Influenza virus
NGQFGRIDF

SEQ ID NO: 478872 - protein, 9 aa, Influenza virus
NGQFGRINF

SEQ ID NO: 478873 - protein, 9 aa, Influenza virus
NGQGSGYAA

SEQ ID NO: 478874 - protein, 9 aa, Influenza virus
NGQKSWMKI

SEQ ID NO: 478875 - protein, 9 aa, Influenza virus
NGQKSWTKI

SEQ ID NO: 478876 - protein, 9 aa, Influenza virus
NGQRGRIDF

SEQ ID NO: 478877 - protein, 9 aa, Influenza virus
NGQRSWMKI

SEQ ID NO: 478878 - protein, 9 aa, Influenza virus
NGQSGRIDF

SEQ ID NO: 478879 - protein, 9 aa, Influenza virus
NGQSGRIEF

SEQ ID NO: 478880 - protein, 9 aa, Influenza virus
NGQSGRINF

SEQ ID NO: 478881 - protein, 9 aa, Influenza virus
NGQSGRIVF

SEQ ID NO: 478882 - protein, 9 aa, Influenza virus
NGQTGRIDF

SEQ ID NO: 478883 - protein, 9 aa, Influenza virus
NGREWSYIV

SEQ ID NO: 478884 - protein, 9 aa, Influenza virus
NGRFEFIAE

SEQ ID NO: 478885 - protein, 9 aa, Influenza virus
NGRSGFEVI

SEQ ID NO: 478886 - protein, 9 aa, Influenza virus
NGRSSFFRN

SEQ ID NO: 478887 - protein, 9 aa, Influenza virus
NGRTLDLHD

SEQ ID NO: 478888 - protein, 9 aa, Influenza virus
NGRTLDMHD

SEQ ID NO: 478889 - protein, 9 aa, Influenza virus
NGRTLGLHD

SEQ ID NO: 478890 - protein, 9 aa, Influenza virus
NGSCAVVMT

SEQ ID NO: 478891 - protein, 9 aa, Influenza virus
NGSCFTIMT

SEQ ID NO: 478892 - protein, 9 aa, Influenza virus
NGSCFTVLT

SEQ ID NO: 478893 - protein, 9 aa, Influenza virus
NGSCFTVMT

SEQ ID NO: 478894 - protein, 9 aa, Influenza virus
NGSCRCMFC

SEQ ID NO: 478895 - protein, 9 aa, Influenza virus
NGSCRCTIC

SEQ ID NO: 478896 - protein, 9 aa, Influenza virus
NGSCRFNVC

SEQ ID NO: 478897 - protein, 9 aa, Influenza virus
NGSCTVVMT

SEQ ID NO: 478898 - protein, 9 aa, Influenza virus
NGSIPNDKP

SEQ ID NO: 478899 - protein, 9 aa, Influenza virus
NGSIPNEKP

SEQ ID NO: 478900 - protein, 9 aa, Influenza virus
NGSIPNGKP

SEQ ID NO: 478901 - protein, 9 aa, Influenza virus
NGSIPNNKP

SEQ ID NO: 478902 - protein, 9 aa, Influenza virus
NGSISNDKP

SEQ ID NO: 478903 - protein, 9 aa, Influenza virus
NGSLHGRIC

SEQ ID NO: 478904 - protein, 9 aa, Influenza virus
NGSLQCKIC

SEQ ID NO: 478905 - protein, 9 aa, Influenza virus
NGSLQCRIA

SEQ ID NO: 478906 - protein, 9 aa, Influenza virus
NGSLQCRIC

SEQ ID NO: 478907 - protein, 9 aa, Influenza virus
NGSLQCRVC

SEQ ID NO: 478908 - protein, 9 aa, Influenza virus
NGSLQCTIC

SEQ ID NO: 478909 - protein, 9 aa, Influenza virus
NGSLRCRIC

SEQ ID NO: 478910 - protein, 9 aa, Influenza virus
NGSYRCMFC

SEQ ID NO: 478911 - protein, 9 aa, Influenza virus
NGTAKDRSP

SEQ ID NO: 478912 - protein, 9 aa, Influenza virus
NGTAKHIEE

SEQ ID NO: 478913 - protein, 9 aa, Influenza virus
NGTCAVVMT

SEQ ID NO: 478914 - protein, 9 aa, Influenza virus
NGTCTVIMT

SEQ ID NO: 478915 - protein, 9 aa, Influenza virus
NGTCTVVMT

SEQ ID NO: 478916 - protein, 9 aa, Influenza virus
NGTCVVIMT

SEQ ID NO: 478917 - protein, 9 aa, Influenza virus
NGTCVVVMT

SEQ ID NO: 478918 - protein, 9 aa, Influenza virus
NGTIHDRAA

SEQ ID NO: 478919 - protein, 9 aa, Influenza virus
NGTIHDRSP

SEQ ID NO: 478920 - protein, 9 aa, Influenza virus
NGTIHDRSQ

SEQ ID NO: 478921 - protein, 9 aa, Influenza virus
NGTIHDRTA

SEQ ID NO: 478922 - protein, 9 aa, Influenza virus
NGTIHDRTT

SEQ ID NO: 478923 - protein, 9 aa, Influenza virus
NGTIKDRSP

SEQ ID NO: 478924 - protein, 9 aa, Influenza virus
NGTINDRSP

SEQ ID NO: 478925 - protein, 9 aa, Influenza virus
NGTIVKTIT

SEQ ID NO: 478926 - protein, 9 aa, Influenza virus
NGTIVKTLT

SEQ ID NO: 478927 - protein, 9 aa, Influenza virus
NGTIVRTIT

SEQ ID NO: 478928 - protein, 9 aa, Influenza virus
NGTIVTTLT

SEQ ID NO: 478929 - protein, 9 aa, Influenza virus
NGTKINTLT

SEQ ID NO: 478930 - protein, 9 aa, Influenza virus
NGTKVDTLT

SEQ ID NO: 478931 - protein, 9 aa, Influenza virus
NGTKVNTLT

SEQ ID NO: 478932 - protein, 9 aa, Influenza virus
NGTLVKTIT

SEQ ID NO: 478933 - protein, 9 aa, Influenza virus
NGTMHDRSP

SEQ ID NO: 478934 - protein, 9 aa, Influenza virus
NGTMKDRSP

SEQ ID NO: 478935 - protein, 9 aa, Influenza virus
NGTMVKTLA

SEQ ID NO: 478936 - protein, 9 aa, Influenza virus
NGTMVKTLT

SEQ ID NO: 478937 - protein, 9 aa, Influenza virus
NGTRVNTLT

SEQ ID NO: 478938 - protein, 9 aa, Influenza virus
NGTSKIKMK

SEQ ID NO: 478939 - protein, 9 aa, Influenza virus
NGTSKVKMK

SEQ ID NO: 478940 - protein, 9 aa, Influenza virus
NGTSVKTLT

SEQ ID NO: 478941 - protein, 9 aa, Influenza virus
NGTTGNPII

SEQ ID NO: 478942 - protein, 9 aa, Influenza virus
NGTTHDRTA

SEQ ID NO: 478943 - protein, 9 aa, Influenza virus
NGTTVKTLT

SEQ ID NO: 478944 - protein, 9 aa, Influenza virus
NGTVKDRSP

SEQ ID NO: 478945 - protein, 9 aa, Influenza virus
NGTVNDRSP

SEQ ID NO: 478946 - protein, 9 aa, Influenza virus
NGTVVKTIT

SEQ ID NO: 478947 - protein, 9 aa, Influenza virus
NGTVVKTLT

SEQ ID NO: 478948 - protein, 9 aa, Influenza virus
NGTWAVVMT

SEQ ID NO: 478949 - protein, 9 aa, Influenza virus
NGTYDHKDY

SEQ ID NO: 478950 - protein, 9 aa, Influenza virus
NGTYDHKEF

SEQ ID NO: 478951 - protein, 9 aa, Influenza virus
NGTYDHKEY

SEQ ID NO: 478952 - protein, 9 aa, Influenza virus
NGTYDHNIY

SEQ ID NO: 478953 - protein, 9 aa, Influenza virus
NGTYDYPHY

SEQ ID NO: 478954 - protein, 9 aa, Influenza virus
NGTYDYPKY

SEQ ID NO: 478955 - protein, 9 aa, Influenza virus
NGTYDYPQY

SEQ ID NO: 478956 - protein, 9 aa, Influenza virus
NGTYDYPRY

SEQ ID NO: 478957 - protein, 9 aa, Influenza virus
NGTYDYSKY

SEQ ID NO: 478958 - protein, 9 aa, Influenza virus
NGTYNHEDY

SEQ ID NO: 478959 - protein, 9 aa, Influenza virus
NGTYNHKDY

SEQ ID NO: 478960 - protein, 9 aa, Influenza virus
NGTYNHKEY

SEQ ID NO: 478961 - protein, 9 aa, Influenza virus
NGTYNRKEY

SEQ ID NO: 478962 - protein, 9 aa, Influenza virus
NGTYNYPKY

SEQ ID NO: 478963 - protein, 9 aa, Influenza virus
NGTYNYPQY

SEQ ID NO: 478964 - protein, 9 aa, Influenza virus
NGTYNYSKY

SEQ ID NO: 478965 - protein, 9 aa, Influenza virus
NGTYSYPQY

SEQ ID NO: 478966 - protein, 9 aa, Influenza virus
NGTYYYPKY

SEQ ID NO: 478967 - protein, 9 aa, Influenza virus
NGVCPVVFT

SEQ ID NO: 478968 - protein, 9 aa, Influenza virus
NGVILEENT

SEQ ID NO: 478969 - protein, 9 aa, Influenza virus
NGVITDTLK

SEQ ID NO: 478970 - protein, 9 aa, Influenza virus
NGVKGFAYL

SEQ ID NO: 478971 - protein, 9 aa, Influenza virus
NGVKGFSYL

SEQ ID NO: 478972 - protein, 9 aa, Influenza virus
NGVKLEENS

SEQ ID NO: 478973 - protein, 9 aa, Influenza virus
NGVKLEENT

SEQ ID NO: 478974 - protein, 9 aa, Influenza virus
NGVKVDGSS

SEQ ID NO: 478975 - protein, 9 aa, Influenza virus
NGVPVTSSI

SEQ ID NO: 478976 - protein, 9 aa, Influenza virus
NGVPVTSSV

SEQ ID NO: 478977 - protein, 9 aa, Influenza virus
NGVQDIIDN

SEQ ID NO: 478978 - protein, 9 aa, Influenza virus
NGVRLEENT

SEQ ID NO: 478979 - protein, 9 aa, Influenza virus
NGVSPIHLG

SEQ ID NO: 478980 - protein, 9 aa, Influenza virus
NGVSPVHLG

SEQ ID NO: 478981 - protein, 9 aa, Influenza virus
NGVTNKVNS

SEQ ID NO: 478982 - protein, 9 aa, Influenza virus
NGVWIGRTK

SEQ ID NO: 478983 - protein, 9 aa, Influenza virus
NGVWMGRTK

SEQ ID NO: 478984 - protein, 9 aa, Influenza virus
NGWEGLIDG

SEQ ID NO: 478985 - protein, 9 aa, Influenza virus
NGWEGLING

SEQ ID NO: 478986 - protein, 9 aa, Influenza virus
NGWEGLVDG

SEQ ID NO: 478987 - protein, 9 aa, Influenza virus
NGWEGMIDG

SEQ ID NO: 478988 - protein, 9 aa, Influenza virus
NGWEGMMDG

SEQ ID NO: 478989 - protein, 9 aa, Influenza virus
NGWEGMVDG

SEQ ID NO: 478990 - protein, 9 aa, Influenza virus
NGWEGMVNG

SEQ ID NO: 478991 - protein, 9 aa, Influenza virus
NGWQGLIDG

SEQ ID NO: 478992 - protein, 9 aa, Influenza virus
NGWVSTDKD

SEQ ID NO: 478993 - protein, 9 aa, Influenza virus
NGWVSTDKN

SEQ ID NO: 478994 - protein, 9 aa, Influenza virus
NGWVTADKD

SEQ ID NO: 478995 - protein, 9 aa, Influenza virus
NGWYGFQHQ

SEQ ID NO: 478996 - protein, 9 aa, Influenza virus
NGWYGFQHR

SEQ ID NO: 478997 - protein, 9 aa, Influenza virus
NGWYGFRHQ

SEQ ID NO: 478998 - protein, 9 aa, Influenza virus
NGYCFTVMT

SEQ ID NO: 478999 - protein, 9 aa, Influenza virus
NGYIEGKLS

SEQ ID NO: 479000 - protein, 9 aa, Influenza virus
NGYKDVILW

SEQ ID NO: 479001 - protein, 9 aa, Influenza virus
NHEDYKEES

SEQ ID NO: 479002 - protein, 9 aa, Influenza virus
NHEDYREES

SEQ ID NO: 479003 - protein, 9 aa, Influenza virus
NHEGEGIPL

SEQ ID NO: 479004 - protein, 9 aa, Influenza virus
NHGICAVAT

SEQ ID NO: 479005 - protein, 9 aa, Influenza virus
NHGSLVLSL

SEQ ID NO: 479006 - protein, 9 aa, Influenza virus
NHGVKGWAF

SEQ ID NO: 479007 - protein, 9 aa, Influenza virus
NHKDYEEEA

SEQ ID NO: 479008 - protein, 9 aa, Influenza virus
NHKEYEEEA

SEQ ID NO: 479009 - protein, 9 aa, Influenza virus
NHLIGKTNQ

SEQ ID NO: 479010 - protein, 9 aa, Influenza virus
NHQFELIDN

SEQ ID NO: 479011 - protein, 9 aa, Influenza virus
NHSMSDIEA

SEQ ID NO: 479012 - protein, 9 aa, Influenza virus
NHSNGTIHD

SEQ ID NO: 479013 - protein, 9 aa, Influenza virus
NHTDELCPS

SEQ ID NO: 479014 - protein, 9 aa, Influenza virus
NHTEYRQEA

SEQ ID NO: 479015 - protein, 9 aa, Influenza virus
NHTGTYCSL

SEQ ID NO: 479016 - protein, 9 aa, Influenza virus
NHTTINNIT

SEQ ID NO: 479017 - protein, 9 aa, Influenza virus
NHVEVVSAK

SEQ ID NO: 479018 - protein, 9 aa, Influenza virus
NIAEYSIDS

SEQ ID NO: 479019 - protein, 9 aa, Influenza virus
NIAPEKVDF

SEQ ID NO: 479020 - protein, 9 aa, Influenza virus
NICEKLEQS

SEQ ID NO: 479021 - protein, 9 aa, Influenza virus
NICKPYIGK

SEQ ID NO: 479022 - protein, 9 aa, Influenza virus
NIDKNALGD

SEQ ID NO: 479023 - protein, 9 aa, Influenza virus
NIDKNALGE

SEQ ID NO: 479024 - protein, 9 aa, Influenza virus
NIDRFLRVR

SEQ ID NO: 479025 - protein, 9 aa, Influenza virus
NIDRNAIGD

SEQ ID NO: 479026 - protein, 9 aa, Influenza virus
NIDRNALGD

SEQ ID NO: 479027 - protein, 9 aa, Influenza virus
NIDSRAVGK

SEQ ID NO: 479028 - protein, 9 aa, Influenza virus
NIDSWAVGR

SEQ ID NO: 479029 - protein, 9 aa, Influenza virus
NIECVCRDN

SEQ ID NO: 479030 - protein, 9 aa, Influenza virus
NIEKNALGD

SEQ ID NO: 479031 - protein, 9 aa, Influenza virus
NIERNALGD

SEQ ID NO: 479032 - protein, 9 aa, Influenza virus
NIERNALGN

SEQ ID NO: 479033 - protein, 9 aa, Influenza virus
NIESNGNLI

SEQ ID NO: 479034 - protein, 9 aa, Influenza virus
NIFNMERIK

SEQ ID NO: 479035 - protein, 9 aa, Influenza virus
NIGLNVSLH

SEQ ID NO: 479036 - protein, 9 aa, Influenza virus
NIGPRALVR

SEQ ID NO: 479037 - protein, 9 aa, Influenza virus
NIGPRPFVR

SEQ ID NO: 479038 - protein, 9 aa, Influenza virus
NIGPRPLIR

SEQ ID NO: 479039 - protein, 9 aa, Influenza virus
NIGPRPLVM

SEQ ID NO: 479040 - protein, 9 aa, Influenza virus
NIGPRPLVR

SEQ ID NO: 479041 - protein, 9 aa, Influenza virus
NIGSRPRVR

SEQ ID NO: 479042 - protein, 9 aa, Influenza virus
NIHPLAIGE

SEQ ID NO: 479043 - protein, 9 aa, Influenza virus
NIHPLTIGE

SEQ ID NO: 479044 - protein, 9 aa, Influenza virus
NIHPLTIGK

SEQ ID NO: 479045 - protein, 9 aa, Influenza virus
NIIDKMNGN

SEQ ID NO: 479046 - protein, 9 aa, Influenza virus
NIIEKMNGN

SEQ ID NO: 479047 - protein, 9 aa, Influenza virus
NIIFLWGIH

SEQ ID NO: 479048 - protein, 9 aa, Influenza virus
NIIFSHNGG

SEQ ID NO: 479049 - protein, 9 aa, Influenza virus
NIKSLKLAT

SEQ ID NO: 479050 - protein, 9 aa, Influenza virus
NILEKTHNG

SEQ ID NO: 479051 - protein, 9 aa, Influenza virus
NILITQESE

SEQ ID NO: 479052 - protein, 9 aa, Influenza virus
NILKGKFQT

SEQ ID NO: 479053 - protein, 9 aa, Influenza virus
NILKTQESE

SEQ ID NO: 479054 - protein, 9 aa, Influenza virus
NILLHIASI

SEQ ID NO: 479055 - protein, 9 aa, Influenza virus
NILLHIVSI

SEQ ID NO: 479056 - protein, 9 aa, Influenza virus
NILLHVASI

SEQ ID NO: 479057 - protein, 9 aa, Influenza virus
NILLSPEEV

SEQ ID NO: 479058 - protein, 9 aa, Influenza virus
NILRTQDSE

SEQ ID NO: 479059 - protein, 9 aa, Influenza virus
NILRTQESE

SEQ ID NO: 479060 - protein, 9 aa, Influenza virus
NILRTQESS

SEQ ID NO: 479061 - protein, 9 aa, Influenza virus
NILSIAPIM

SEQ ID NO: 479062 - protein, 9 aa, Influenza virus
NILSMAPIM

SEQ ID NO: 479063 - protein, 9 aa, Influenza virus
NIMASQGTK

SEQ ID NO: 479064 - protein, 9 aa, Influenza virus
NIMRTQESE

SEQ ID NO: 479065 - protein, 9 aa, Influenza virus
NINFMPYIS

SEQ ID NO: 479066 - protein, 9 aa, Influenza virus
NINIREWSY

SEQ ID NO: 479067 - protein, 9 aa, Influenza virus
NINPVKLSS

SEQ ID NO: 479068 - protein, 9 aa, Influenza virus
NINPVTLSS

SEQ ID NO: 479069 - protein, 9 aa, Influenza virus
NINRITYGA

SEQ ID NO: 479070 - protein, 9 aa, Influenza virus
NINSVKLSS

SEQ ID NO: 479071 - protein, 9 aa, Influenza virus
NIPEKQTRG

SEQ ID NO: 479072 - protein, 9 aa, Influenza virus
NIPERQTRG

SEQ ID NO: 479073 - protein, 9 aa, Influenza virus
NIPGKQAKG

SEQ ID NO: 479074 - protein, 9 aa, Influenza virus
NIPQIESRG

SEQ ID NO: 479075 - protein, 9 aa, Influenza virus
NIPSIQSRG

SEQ ID NO: 479076 - protein, 9 aa, Influenza virus
NIPSVQSRG

SEQ ID NO: 479077 - protein, 9 aa, Influenza virus
NIPVTQTME

SEQ ID NO: 479078 - protein, 9 aa, Influenza virus
NIPVTQVEE

SEQ ID NO: 479079 - protein, 9 aa, Influenza virus
NIQFEAVGR

SEQ ID NO: 479080 - protein, 9 aa, Influenza virus
NIQFTAVGK

SEQ ID NO: 479081 - protein, 9 aa, Influenza virus
NIQFTSVGK

SEQ ID NO: 479082 - protein, 9 aa, Influenza virus
NIREWSYLI

SEQ ID NO: 479083 - protein, 9 aa, Influenza virus
NIRIGSKGD

SEQ ID NO: 479084 - protein, 9 aa, Influenza virus
NIRNLHIPE

SEQ ID NO: 479085 - protein, 9 aa, Influenza virus
NISSRSGFE

SEQ ID NO: 479086 - protein, 9 aa, Influenza virus
NITAASLND

SEQ ID NO: 479087 - protein, 9 aa, Influenza virus
NITEIVYLN

SEQ ID NO: 479088 - protein, 9 aa, Influenza virus
NITFSDNGG

SEQ ID NO: 479089 - protein, 9 aa, Influenza virus
NITFSHNGG

SEQ ID NO: 479090 - protein, 9 aa, Influenza virus
NITKIVYLN

SEQ ID NO: 479091 - protein, 9 aa, Influenza virus
NITVTHAQD

SEQ ID NO: 479092 - protein, 9 aa, Influenza virus
NITVTHSVE

SEQ ID NO: 479093 - protein, 9 aa, Influenza virus
NITVTHSVN

SEQ ID NO: 479094 - protein, 9 aa, Influenza virus
NITVTSSVE

SEQ ID NO: 479095 - protein, 9 aa, Influenza virus
NIVDKMNRE

SEQ ID NO: 479096 - protein, 9 aa, Influenza virus
NIVRRAAVS

SEQ ID NO: 479097 - protein, 9 aa, Influenza virus
NIVRRAIVS

SEQ ID NO: 479098 - protein, 9 aa, Influenza virus
NIVRRATVS

SEQ ID NO: 479099 - protein, 9 aa, Influenza virus
NIWAYNAEL

SEQ ID NO: 479100 - protein, 9 aa, Influenza virus
NIWITREPY

SEQ ID NO: 479101 - protein, 9 aa, Influenza virus
NIWSYNAQL

SEQ ID NO: 479102 - protein, 9 aa, Influenza virus
NIYKILSIY

SEQ ID NO: 479103 - protein, 9 aa, Influenza virus
NIYRDEAIN

SEQ ID NO: 479104 - protein, 9 aa, Influenza virus
NKACELTDS

SEQ ID NO: 479105 - protein, 9 aa, Influenza virus
NKADHRIYW

SEQ ID NO: 479106 - protein, 9 aa, Influenza virus
NKCIERVRN

SEQ ID NO: 479107 - protein, 9 aa, Influenza virus
NKCIESIRN

SEQ ID NO: 479108 - protein, 9 aa, Influenza virus
NKCMETIKN

SEQ ID NO: 479109 - protein, 9 aa, Influenza virus
NKCYQFALG

SEQ ID NO: 479110 - protein, 9 aa, Influenza virus
NKDGDIIFL

SEQ ID NO: 479111 - protein, 9 aa, Influenza virus
NKFAAICTH

SEQ ID NO: 479112 - protein, 9 aa, Influenza virus
NKFASICTH

SEQ ID NO: 479113 - protein, 9 aa, Influenza virus
NKHSNDTIH

SEQ ID NO: 479114 - protein, 9 aa, Influenza virus
NKHSNDTVH

SEQ ID NO: 479115 - protein, 9 aa, Influenza virus
NKHSNGTIH

SEQ ID NO: 479116 - protein, 9 aa, Influenza virus
NKHSNGTKH

SEQ ID NO: 479117 - protein, 9 aa, Influenza virus
NKHSNGTTH

SEQ ID NO: 479118 - protein, 9 aa, Influenza virus
NKHSNSTTH

SEQ ID NO: 479119 - protein, 9 aa, Influenza virus
NKHWSGYSG

SEQ ID NO: 479120 - protein, 9 aa, Influenza virus
NKIEFEPFQ

SEQ ID NO: 479121 - protein, 9 aa, Influenza virus
NKINNIVDK

SEQ ID NO: 479122 - protein, 9 aa, Influenza virus
NKITNKVNN

SEQ ID NO: 479123 - protein, 9 aa, Influenza virus
NKITYGACP

SEQ ID NO: 479124 - protein, 9 aa, Influenza virus
NKKIDDGFL

SEQ ID NO: 479125 - protein, 9 aa, Influenza virus
NKKMEDGFL

SEQ ID NO: 479126 - protein, 9 aa, Influenza virus
NKKVDDGFI

SEQ ID NO: 479127 - protein, 9 aa, Influenza virus
NKKVDDGFL

SEQ ID NO: 479128 - protein, 9 aa, Influenza virus
NKKVDDGLL

SEQ ID NO: 479129 - protein, 9 aa, Influenza virus
NKKYGPALS

SEQ ID NO: 479130 - protein, 9 aa, Influenza virus
NKLAAICTH

SEQ ID NO: 479131 - protein, 9 aa, Influenza virus
NKLEFEPFQ

SEQ ID NO: 479132 - protein, 9 aa, Influenza virus
NKLFERVRR

SEQ ID NO: 479133 - protein, 9 aa, Influenza virus
NKLITVGSS

SEQ ID NO: 479134 - protein, 9 aa, Influenza virus
NKLNNVIDK

SEQ ID NO: 479135 - protein, 9 aa, Influenza virus
NKLYEKVRR

SEQ ID NO: 479136 - protein, 9 aa, Influenza virus
NKLYERVKR

SEQ ID NO: 479137 - protein, 9 aa, Influenza virus
NKLYERVRK

SEQ ID NO: 479138 - protein, 9 aa, Influenza virus
NKLYERVRR

SEQ ID NO: 479139 - protein, 9 aa, Influenza virus
NKLYGAGNK

SEQ ID NO: 479140 - protein, 9 aa, Influenza virus
NKLYGTGNK

SEQ ID NO: 479141 - protein, 9 aa, Influenza virus
NKLYVNKNP

SEQ ID NO: 479142 - protein, 9 aa, Influenza virus
NKMARLGKG

SEQ ID NO: 479143 - protein, 9 aa, Influenza virus
NKMARLGRG

SEQ ID NO: 479144 - protein, 9 aa, Influenza virus
NKMEFEPFQ

SEQ ID NO: 479145 - protein, 9 aa, Influenza virus
NKMNTQFEA

SEQ ID NO: 479146 - protein, 9 aa, Influenza virus
NKNATATVY

SEQ ID NO: 479147 - protein, 9 aa, Influenza virus
NKNEIKGVK

SEQ ID NO: 479148 - protein, 9 aa, Influenza virus
NKNPYTLVS

SEQ ID NO: 479149 - protein, 9 aa, Influenza virus
NKNWSGYSG

SEQ ID NO: 479150 - protein, 9 aa, Influenza virus
NKPFQNVNK

SEQ ID NO: 479151 - protein, 9 aa, Influenza virus
NKQASYKIF

SEQ ID NO: 479152 - protein, 9 aa, Influenza virus
NKQFELIDN

SEQ ID NO: 479153 - protein, 9 aa, Influenza virus
NKRLCKVEG

SEQ ID NO: 479154 - protein, 9 aa, Influenza virus
NKRMEDGFL

SEQ ID NO: 479155 - protein, 9 aa, Influenza virus
NKRMEDGLL

SEQ ID NO: 479156 - protein, 9 aa, Influenza virus
NKRMENGFL

SEQ ID NO: 479157 - protein, 9 aa, Influenza virus
NKRMQDGFL

SEQ ID NO: 479158 - protein, 9 aa, Influenza virus
NKRMQDGFM

SEQ ID NO: 479159 - protein, 9 aa, Influenza virus
NKRYGPALS

SEQ ID NO: 479160 - protein, 9 aa, Influenza virus
NKSLCKIEG

SEQ ID NO: 479161 - protein, 9 aa, Influenza virus
NKSLCKVEG

SEQ ID NO: 479162 - protein, 9 aa, Influenza virus
NKSLCNVEG

SEQ ID NO: 479163 - protein, 9 aa, Influenza virus
NKSLCSVEG

SEQ ID NO: 479164 - protein, 9 aa, Influenza virus
NKTFQNIDK

SEQ ID NO: 479165 - protein, 9 aa, Influenza virus
NKTFQNIDR

SEQ ID NO: 479166 - protein, 9 aa, Influenza virus
NKTFQNIEK

SEQ ID NO: 479167 - protein, 9 aa, Influenza virus
NKTFQNIER

SEQ ID NO: 479168 - protein, 9 aa, Influenza virus
NKTFQNISP

SEQ ID NO: 479169 - protein, 9 aa, Influenza virus
NKTFQNVSP

SEQ ID NO: 479170 - protein, 9 aa, Influenza virus
NKTGTFEFT

SEQ ID NO: 479171 - protein, 9 aa, Influenza virus
NKTKKMTIT

SEQ ID NO: 479172 - protein, 9 aa, Influenza virus
NKTVINNIT

SEQ ID NO: 479173 - protein, 9 aa, Influenza virus
NKVARLGKG

SEQ ID NO: 479174 - protein, 9 aa, Influenza virus
NKVCTKGKK

SEQ ID NO: 479175 - protein, 9 aa, Influenza virus
NKVEFEPFQ

SEQ ID NO: 479176 - protein, 9 aa, Influenza virus
NKVKEIGNG

SEQ ID NO: 479177 - protein, 9 aa, Influenza virus
NKVNNIVDK

SEQ ID NO: 479178 - protein, 9 aa, Influenza virus
NKVNSIIDK

SEQ ID NO: 479179 - protein, 9 aa, Influenza virus
NKVNSIIEK

SEQ ID NO: 479180 - protein, 9 aa, Influenza virus
NKVNSIIGK

SEQ ID NO: 479181 - protein, 9 aa, Influenza virus
NKVNSIINK

SEQ ID NO: 479182 - protein, 9 aa, Influenza virus
NKVNSVIEK

SEQ ID NO: 479183 - protein, 9 aa, Influenza virus
NKVNSVVEK

SEQ ID NO: 479184 - protein, 9 aa, Influenza virus
NKVRMQLRD

SEQ ID NO: 479185 - protein, 9 aa, Influenza virus
NKWGDILDG

SEQ ID NO: 479186 - protein, 9 aa, Influenza virus
NKWGNVLDG

SEQ ID NO: 479187 - protein, 9 aa, Influenza virus
NKYLEEHPN

SEQ ID NO: 479188 - protein, 9 aa, Influenza virus
NKYLEEHPS

SEQ ID NO: 479189 - protein, 9 aa, Influenza virus
NKYVNNTTI

SEQ ID NO: 479190 - protein, 9 aa, Influenza virus
NLAFNAVIH

SEQ ID NO: 479191 - protein, 9 aa, Influenza virus
NLALDIVDS

SEQ ID NO: 479192 - protein, 9 aa, Influenza virus
NLCQVECVC

SEQ ID NO: 479193 - protein, 9 aa, Influenza virus
NLCRFLETR

SEQ ID NO: 479194 - protein, 9 aa, Influenza virus
NLCYPGSLN

SEQ ID NO: 479195 - protein, 9 aa, Influenza virus
NLDLNMGQP

SEQ ID NO: 479196 - protein, 9 aa, Influenza virus
NLDYQIGYV

SEQ ID NO: 479197 - protein, 9 aa, Influenza virus
NLEELRFVF

SEQ ID NO: 479198 - protein, 9 aa, Influenza virus
NLEKRLENL

SEQ ID NO: 479199 - protein, 9 aa, Influenza virus
NLEPGTFDI

SEQ ID NO: 479200 - protein, 9 aa, Influenza virus
NLEPGTFDL

SEQ ID NO: 479201 - protein, 9 aa, Influenza virus
NLERRLENL

SEQ ID NO: 479202 - protein, 9 aa, Influenza virus
NLFDEVKRR

SEQ ID NO: 479203 - protein, 9 aa, Influenza virus
NLFDEVRRR

SEQ ID NO: 479204 - protein, 9 aa, Influenza virus
NLFEKFFPS

SEQ ID NO: 479205 - protein, 9 aa, Influenza virus
NLGKVECVC

SEQ ID NO: 479206 - protein, 9 aa, Influenza virus
NLGLNIGIH

SEQ ID NO: 479207 - protein, 9 aa, Influenza virus
NLGLNIGLH

SEQ ID NO: 479208 - protein, 9 aa, Influenza virus
NLGLNVGLH

SEQ ID NO: 479209 - protein, 9 aa, Influenza virus
NLGQVECVC

SEQ ID NO: 479210 - protein, 9 aa, Influenza virus
NLHAYISFR

SEQ ID NO: 479211 - protein, 9 aa, Influenza virus
NLHIPEAGL

SEQ ID NO: 479212 - protein, 9 aa, Influenza virus
NLHIPEVCL

SEQ ID NO: 479213 - protein, 9 aa, Influenza virus
NLIAPEFGY

SEQ ID NO: 479214 - protein, 9 aa, Influenza virus
NLIAPEYGF

SEQ ID NO: 479215 - protein, 9 aa, Influenza virus
NLIAPEYGH

SEQ ID NO: 479216 - protein, 9 aa, Influenza virus
NLIAPEYGY

SEQ ID NO: 479217 - protein, 9 aa, Influenza virus
NLIAPLYGH

SEQ ID NO: 479218 - protein, 9 aa, Influenza virus
NLIAPRGHY

SEQ ID NO: 479219 - protein, 9 aa, Influenza virus
NLIAPRGYF

SEQ ID NO: 479220 - protein, 9 aa, Influenza virus
NLIAPRGYY

SEQ ID NO: 479221 - protein, 9 aa, Influenza virus
NLIAPWFGH

SEQ ID NO: 479222 - protein, 9 aa, Influenza virus
NLIAPWYAF

SEQ ID NO: 479223 - protein, 9 aa, Influenza virus
NLIAPWYAY

SEQ ID NO: 479224 - protein, 9 aa, Influenza virus
NLIAPWYGH

SEQ ID NO: 479225 - protein, 9 aa, Influenza virus
NLIAPWYGY

SEQ ID NO: 479226 - protein, 9 aa, Influenza virus
NLIFNAVIH

SEQ ID NO: 479227 - protein, 9 aa, Influenza virus
NLIFNTVIH

SEQ ID NO: 479228 - protein, 9 aa, Influenza virus
NLIGKTSWS

SEQ ID NO: 479229 - protein, 9 aa, Influenza virus
NLIIERREG

SEQ ID NO: 479230 - protein, 9 aa, Influenza virus
NLIIERSEG

SEQ ID NO: 479231 - protein, 9 aa, Influenza virus
NLIIGISNV

SEQ ID NO: 479232 - protein, 9 aa, Influenza virus
NLIVERREG

SEQ ID NO: 479233 - protein, 9 aa, Influenza virus
NLIVFNTIG

SEQ ID NO: 479234 - protein, 9 aa, Influenza virus
NLKLATGLR

SEQ ID NO: 479235 - protein, 9 aa, Influenza virus
NLLENLQAY

SEQ ID NO: 479236 - protein, 9 aa, Influenza virus
NLLHKCNDS

SEQ ID NO: 479237 - protein, 9 aa, Influenza virus
NLLIGISNI

SEQ ID NO: 479238 - protein, 9 aa, Influenza virus
NLLIGISNM

SEQ ID NO: 479239 - protein, 9 aa, Influenza virus
NLLIGISNV

SEQ ID NO: 479240 - protein, 9 aa, Influenza virus
NLLIGVSNV

SEQ ID NO: 479241 - protein, 9 aa, Influenza virus
NLNDATYQR

SEQ ID NO: 479242 - protein, 9 aa, Influenza virus
NLNDTTYQR

SEQ ID NO: 479243 - protein, 9 aa, Influenza virus
NLNKKIDDG

SEQ ID NO: 479244 - protein, 9 aa, Influenza virus
NLNKKMEDG

SEQ ID NO: 479245 - protein, 9 aa, Influenza virus
NLNKKVDDG

SEQ ID NO: 479246 - protein, 9 aa, Influenza virus
NLNKKVEDG

SEQ ID NO: 479247 - protein, 9 aa, Influenza virus
NLNKRMEDG

SEQ ID NO: 479248 - protein, 9 aa, Influenza virus
NLNKRMENG

SEQ ID NO: 479249 - protein, 9 aa, Influenza virus
NLNKRMQDG

SEQ ID NO: 479250 - protein, 9 aa, Influenza virus
NLNKRVDDG

SEQ ID NO: 479251 - protein, 9 aa, Influenza virus
NLNRKMEDG

SEQ ID NO: 479252 - protein, 9 aa, Influenza virus
NLNRKVDDG

SEQ ID NO: 479253 - protein, 9 aa, Influenza virus
NLNWSGYSG

SEQ ID NO: 479254 - protein, 9 aa, Influenza virus
NLPFQNINS

SEQ ID NO: 479255 - protein, 9 aa, Influenza virus
NLPFQNVHP

SEQ ID NO: 479256 - protein, 9 aa, Influenza virus
NLPFQNVNS

SEQ ID NO: 479257 - protein, 9 aa, Influenza virus
NLQAYQKRM

SEQ ID NO: 479258 - protein, 9 aa, Influenza virus
NLQTYQKRM

SEQ ID NO: 479259 - protein, 9 aa, Influenza virus
NLSGYSGSF

SEQ ID NO: 479260 - protein, 9 aa, Influenza virus
NLSKRMEDG

SEQ ID NO: 479261 - protein, 9 aa, Influenza virus
NLSPRTVGQ

SEQ ID NO: 479262 - protein, 9 aa, Influenza virus
NLTKELCTI

SEQ ID NO: 479263 - protein, 9 aa, Influenza virus
NLTKGLCTI

SEQ ID NO: 479264 - protein, 9 aa, Influenza virus
NLTKINNGD

SEQ ID NO: 479265 - protein, 9 aa, Influenza virus
NLTKRLCTI

SEQ ID NO: 479266 - protein, 9 aa, Influenza virus
NLTKTNNGD

SEQ ID NO: 479267 - protein, 9 aa, Influenza virus
NLTKVNNGD

SEQ ID NO: 479268 - protein, 9 aa, Influenza virus
NLTKVNNGN

SEQ ID NO: 479269 - protein, 9 aa, Influenza virus
NLTKVNSGD

SEQ ID NO: 479270 - protein, 9 aa, Influenza virus
NLTRELCTI

SEQ ID NO: 479271 - protein, 9 aa, Influenza virus
NLTRGLCTI

SEQ ID NO: 479272 - protein, 9 aa, Influenza virus
NLVAPEYGF

SEQ ID NO: 479273 - protein, 9 aa, Influenza virus
NLVAPRGHY

SEQ ID NO: 479274 - protein, 9 aa, Influenza virus
NLVAPRGYF

SEQ ID NO: 479275 - protein, 9 aa, Influenza virus
NLVAPWYAY

SEQ ID NO: 479276 - protein, 9 aa, Influenza virus
NLVAPWYGH

SEQ ID NO: 479277 - protein, 9 aa, Influenza virus
NLVFNTVIH

SEQ ID NO: 479278 - protein, 9 aa, Influenza virus
NLWAYNAEL

SEQ ID NO: 479279 - protein, 9 aa, Influenza virus
NLYASKNPY

SEQ ID NO: 479280 - protein, 9 aa, Influenza virus
NLYDKVRFQ

SEQ ID NO: 479281 - protein, 9 aa, Influenza virus
NLYDKVRHQ

SEQ ID NO: 479282 - protein, 9 aa, Influenza virus
NLYDKVRLQ

SEQ ID NO: 479283 - protein, 9 aa, Influenza virus
NLYDKVRMQ

SEQ ID NO: 479284 - protein, 9 aa, Influenza virus
NLYDRVRKQ

SEQ ID NO: 479285 - protein, 9 aa, Influenza virus
NLYDRVRLQ

SEQ ID NO: 479286 - protein, 9 aa, Influenza virus
NLYDRVRMQ

SEQ ID NO: 479287 - protein, 9 aa, Influenza virus
NLYEKVRLQ

SEQ ID NO: 479288 - protein, 9 aa, Influenza virus
NLYEKVRMQ

SEQ ID NO: 479289 - protein, 9 aa, Influenza virus
NLYERVRKQ

SEQ ID NO: 479290 - protein, 9 aa, Influenza virus
NLYGFIIKG

SEQ ID NO: 479291 - protein, 9 aa, Influenza virus
NLYGFIVKG

SEQ ID NO: 479292 - protein, 9 aa, Influenza virus
NLYNIRNLH

SEQ ID NO: 479293 - protein, 9 aa, Influenza virus
NLYNKVRLQ

SEQ ID NO: 479294 - protein, 9 aa, Influenza virus
NLYNKVRMQ

SEQ ID NO: 479295 - protein, 9 aa, Influenza virus
NLYVNKNPY

SEQ ID NO: 479296 - protein, 9 aa, Influenza virus
NMADYSIDS

SEQ ID NO: 479297 - protein, 9 aa, Influenza virus
NMAPEKIDF

SEQ ID NO: 479298 - protein, 9 aa, Influenza virus
NMAPEKMDF

SEQ ID NO: 479299 - protein, 9 aa, Influenza virus
NMAPEKVDF

SEQ ID NO: 479300 - protein, 9 aa, Influenza virus
NMARAVKLY

SEQ ID NO: 479301 - protein, 9 aa, Influenza virus
NMDKAVKLY

SEQ ID NO: 479302 - protein, 9 aa, Influenza virus
NMDRAVKLY

SEQ ID NO: 479303 - protein, 9 aa, Influenza virus
NMEDYSIDS

SEQ ID NO: 479304 - protein, 9 aa, Influenza virus
NMERIKELR

SEQ ID NO: 479305 - protein, 9 aa, Influenza virus
NMGIYQILA

SEQ ID NO: 479306 - protein, 9 aa, Influenza virus
NMGKVECVC

SEQ ID NO: 479307 - protein, 9 aa, Influenza virus
NMGVYQILA

SEQ ID NO: 479308 - protein, 9 aa, Influenza virus
NMGVYQVLA

SEQ ID NO: 479309 - protein, 9 aa, Influenza virus
NMHDANVRN

SEQ ID NO: 479310 - protein, 9 aa, Influenza virus
NMIADRVDD

SEQ ID NO: 479311 - protein, 9 aa, Influenza virus
NMINDKIDD

SEQ ID NO: 479312 - protein, 9 aa, Influenza virus
NMINDKIND

SEQ ID NO: 479313 - protein, 9 aa, Influenza virus
NMINNDLGP

SEQ ID NO: 479314 - protein, 9 aa, Influenza virus
NMINSKIDD

SEQ ID NO: 479315 - protein, 9 aa, Influenza virus
NMINSKIED

SEQ ID NO: 479316 - protein, 9 aa, Influenza virus
NMINSKIND

SEQ ID NO: 479317 - protein, 9 aa, Influenza virus
NMINSQIDD

SEQ ID NO: 479318 - protein, 9 aa, Influenza virus
NMISDKIDD

SEQ ID NO: 479319 - protein, 9 aa, Influenza virus
NMLADRIDD

SEQ ID NO: 479320 - protein, 9 aa, Influenza virus
NMLADRVDD

SEQ ID NO: 479321 - protein, 9 aa, Influenza virus
NMLADWVDD

SEQ ID NO: 479322 - protein, 9 aa, Influenza virus
NMLSTVLGV

SEQ ID NO: 479323 - protein, 9 aa, Influenza virus
NMNKRMEDG

SEQ ID NO: 479324 - protein, 9 aa, Influenza virus
NMNWSGYSG

SEQ ID NO: 479325 - protein, 9 aa, Influenza virus
NMQNKLNNV

SEQ ID NO: 479326 - protein, 9 aa, Influenza virus
NMQNRLNNV

SEQ ID NO: 479327 - protein, 9 aa, Influenza virus
NMRCTISLV

SEQ ID NO: 479328 - protein, 9 aa, Influenza virus
NMRWLTLKS

SEQ ID NO: 479329 - protein, 9 aa, Influenza virus
NMSKKKSYI

SEQ ID NO: 479330 - protein, 9 aa, Influenza virus
NMSKRKSYI

SEQ ID NO: 479331 - protein, 9 aa, Influenza virus
NMSLNISLY

SEQ ID NO: 479332 - protein, 9 aa, Influenza virus
NMTNVQNNY

SEQ ID NO: 479333 - protein, 9 aa, Influenza virus
NMVDYSIDS

SEQ ID NO: 479334 - protein, 9 aa, Influenza virus
NNADHRIYW

SEQ ID NO: 479335 - protein, 9 aa, Influenza virus
NNADHRVYW

SEQ ID NO: 479336 - protein, 9 aa, Influenza virus
NNAIDEGDG

SEQ ID NO: 479337 - protein, 9 aa, Influenza virus
NNAKDEGNG

SEQ ID NO: 479338 - protein, 9 aa, Influenza virus
NNAKEIGNG

SEQ ID NO: 479339 - protein, 9 aa, Influenza virus
NNAKELGNG

SEQ ID NO: 479340 - protein, 9 aa, Influenza virus
NNAKEVGNG

SEQ ID NO: 479341 - protein, 9 aa, Influenza virus
NNAQEIGNG

SEQ ID NO: 479342 - protein, 9 aa, Influenza virus
NNARELGNG

SEQ ID NO: 479343 - protein, 9 aa, Influenza virus
NNASAIVWY

SEQ ID NO: 479344 - protein, 9 aa, Influenza virus
NNASAVIWY

SEQ ID NO: 479345 - protein, 9 aa, Influenza virus
NNASAVVWY

SEQ ID NO: 479346 - protein, 9 aa, Influenza virus
NNASTVIWY

SEQ ID NO: 479347 - protein, 9 aa, Influenza virus
NNATASFIY

SEQ ID NO: 479348 - protein, 9 aa, Influenza virus
NNATATVYY

SEQ ID NO: 479349 - protein, 9 aa, Influenza virus
NNATDTVDT

SEQ ID NO: 479350 - protein, 9 aa, Influenza virus
NNBNGVKGF

SEQ ID NO: 479351 - protein, 9 aa, Influenza virus
NNCESKCFW

SEQ ID NO: 479352 - protein, 9 aa, Influenza virus
NNCIESIRN

SEQ ID NO: 479353 - protein, 9 aa, Influenza virus
NNCMESIRN

SEQ ID NO: 479354 - protein, 9 aa, Influenza virus
NNDLGPATA

SEQ ID NO: 479355 - protein, 9 aa, Influenza virus
NNDNATATV

SEQ ID NO: 479356 - protein, 9 aa, Influenza virus
NNDWSGYSG

SEQ ID NO: 479357 - protein, 9 aa, Influenza virus
NNECMETIK

SEQ ID NO: 479358 - protein, 9 aa, Influenza virus
NNEDGDIIF

SEQ ID NO: 479359 - protein, 9 aa, Influenza virus
NNEDGNIIF

SEQ ID NO: 479360 - protein, 9 aa, Influenza virus
NNEEGDIIF

SEQ ID NO: 479361 - protein, 9 aa, Influenza virus
NNEGSYFFG

SEQ ID NO: 479362 - protein, 9 aa, Influenza virus
NNEKGNPGV

SEQ ID NO: 479363 - protein, 9 aa, Influenza virus
NNEKGNQGV

SEQ ID NO: 479364 - protein, 9 aa, Influenza virus
NNENATATV

SEQ ID NO: 479365 - protein, 9 aa, Influenza virus
NNENGDIIF

SEQ ID NO: 479366 - protein, 9 aa, Influenza virus
NNEPGSGNW

SEQ ID NO: 479367 - protein, 9 aa, Influenza virus
NNEPSGYAQ

SEQ ID NO: 479368 - protein, 9 aa, Influenza virus
NNEQGSGYA

SEQ ID NO: 479369 - protein, 9 aa, Influenza virus
NNERGNPGV

SEQ ID NO: 479370 - protein, 9 aa, Influenza virus
NNERGNQGV

SEQ ID NO: 479371 - protein, 9 aa, Influenza virus
NNERGTQGV

SEQ ID NO: 479372 - protein, 9 aa, Influenza virus
NNERGYPGV

SEQ ID NO: 479373 - protein, 9 aa, Influenza virus
NNETIIETG

SEQ ID NO: 479374 - protein, 9 aa, Influenza virus
NNETILETG

SEQ ID NO: 479375 - protein, 9 aa, Influenza virus
NNETIVETG

SEQ ID NO: 479376 - protein, 9 aa, Influenza virus
NNFVPVIGA

SEQ ID NO: 479377 - protein, 9 aa, Influenza virus
NNFVPVMGA

SEQ ID NO: 479378 - protein, 9 aa, Influenza virus
NNFVPVVGA

SEQ ID NO: 479379 - protein, 9 aa, Influenza virus
NNFVPVVRA

SEQ ID NO: 479380 - protein, 9 aa, Influenza virus
NNGDYARLY

SEQ ID NO: 479381 - protein, 9 aa, Influenza virus
NNGDYTRLY

SEQ ID NO: 479382 - protein, 9 aa, Influenza virus
NNGELRHLF

SEQ ID NO: 479383 - protein, 9 aa, Influenza virus
NNGKFEFIA

SEQ ID NO: 479384 - protein, 9 aa, Influenza virus
NNGKFEFIV

SEQ ID NO: 479385 - protein, 9 aa, Influenza virus
NNGKGRYGV

SEQ ID NO: 479386 - protein, 9 aa, Influenza virus
NNGKLEFIA

SEQ ID NO: 479387 - protein, 9 aa, Influenza virus
NNGNYARLY

SEQ ID NO: 479388 - protein, 9 aa, Influenza virus
NNGRFEFIA

SEQ ID NO: 479389 - protein, 9 aa, Influenza virus
NNGSCRCTI

SEQ ID NO: 479390 - protein, 9 aa, Influenza virus
NNGVKGFAY

SEQ ID NO: 479391 - protein, 9 aa, Influenza virus
NNGVKGFSY

SEQ ID NO: 479392 - protein, 9 aa, Influenza virus
NNIIDKMNG

SEQ ID NO: 479393 - protein, 9 aa, Influenza virus
NNIIEKMNG

SEQ ID NO: 479394 - protein, 9 aa, Influenza virus
NNIKGRDVL

SEQ ID NO: 479395 - protein, 9 aa, Influenza virus
NNILRTQES

SEQ ID NO: 479396 - protein, 9 aa, Influenza virus
NNIRIGSKG

SEQ ID NO: 479397 - protein, 9 aa, Influenza virus
NNITTTIIA

SEQ ID NO: 479398 - protein, 9 aa, Influenza virus
NNITTTIIT

SEQ ID NO: 479399 - protein, 9 aa, Influenza virus
NNITTTITT

SEQ ID NO: 479400 - protein, 9 aa, Influenza virus
NNITTTIVT

SEQ ID NO: 479401 - protein, 9 aa, Influenza virus
NNIVDKMNR

SEQ ID NO: 479402 - protein, 9 aa, Influenza virus
NNKDGDIIF

SEQ ID NO: 479403 - protein, 9 aa, Influenza virus
NNKHSNGTI

SEQ ID NO: 479404 - protein, 9 aa, Influenza virus
NNKHWSGYS

SEQ ID NO: 479405 - protein, 9 aa, Influenza virus
NNKNATATV

SEQ ID NO: 479406 - protein, 9 aa, Influenza virus
NNKNWSGYS

SEQ ID NO: 479407 - protein, 9 aa, Influenza virus
NNKPFQNVN

SEQ ID NO: 479408 - protein, 9 aa, Influenza virus
NNLEKRLEN

SEQ ID NO: 479409 - protein, 9 aa, Influenza virus
NNLERRLEN

SEQ ID NO: 479410 - protein, 9 aa, Influenza virus
NNLPFQNIN

SEQ ID NO: 479411 - protein, 9 aa, Influenza virus
NNLSGYSGS

SEQ ID NO: 479412 - protein, 9 aa, Influenza virus
NNLTKGLCT

SEQ ID NO: 479413 - protein, 9 aa, Influenza virus
NNLTKRLCT

SEQ ID NO: 479414 - protein, 9 aa, Influenza virus
NNLTRELCT

SEQ ID NO: 479415 - protein, 9 aa, Influenza virus
NNLTRGLCK

SEQ ID NO: 479416 - protein, 9 aa, Influenza virus
NNLTRGLCT

SEQ ID NO: 479417 - protein, 9 aa, Influenza virus
NNMARAVKL

SEQ ID NO: 479418 - protein, 9 aa, Influenza virus
NNMDKAVKL

SEQ ID NO: 479419 - protein, 9 aa, Influenza virus
NNMDRAVKL

SEQ ID NO: 479420 - protein, 9 aa, Influenza virus
NNMINNDLG

SEQ ID NO: 479421 - protein, 9 aa, Influenza virus
NNMTTTIIN

SEQ ID NO: 479422 - protein, 9 aa, Influenza virus
NNNASAIVW

SEQ ID NO: 479423 - protein, 9 aa, Influenza virus
NNNASAVIW

SEQ ID NO: 479424 - protein, 9 aa, Influenza virus
NNNASAVVW

SEQ ID NO: 479425 - protein, 9 aa, Influenza virus
NNNASPVIW

SEQ ID NO: 479426 - protein, 9 aa, Influenza virus
NNNATATVY

SEQ ID NO: 479427 - protein, 9 aa, Influenza virus
NNNGELRHL

SEQ ID NO: 479428 - protein, 9 aa, Influenza virus
NNNGVKGFA

SEQ ID NO: 479429 - protein, 9 aa, Influenza virus
NNNGVKGFS

SEQ ID NO: 479430 - protein, 9 aa, Influenza virus
NNNKGAVFK

SEQ ID NO: 479431 - protein, 9 aa, Influenza virus
NNNLSGYSG

SEQ ID NO: 479432 - protein, 9 aa, Influenza virus
NNNNATATV

SEQ ID NO: 479433 - protein, 9 aa, Influenza virus
NNNNGVKGF

SEQ ID NO: 479434 - protein, 9 aa, Influenza virus
NNNNNTATL

SEQ ID NO: 479435 - protein, 9 aa, Influenza virus
NNNWFGYFG

SEQ ID NO: 479436 - protein, 9 aa, Influenza virus
NNNWSGYSG

SEQ ID NO: 479437 - protein, 9 aa, Influenza virus
NNPGRVSVS

SEQ ID NO: 479438 - protein, 9 aa, Influenza virus
NNPGRVTVS

SEQ ID NO: 479439 - protein, 9 aa, Influenza virus
NNPITGSPG

SEQ ID NO: 479440 - protein, 9 aa, Influenza virus
NNQASYKIF

SEQ ID NO: 479441 - protein, 9 aa, Influenza virus
NNQASYRIF

SEQ ID NO: 479442 - protein, 9 aa, Influenza virus
NNQDWSGYS

SEQ ID NO: 479443 - protein, 9 aa, Influenza virus
NNQNWSGYS

SEQ ID NO: 479444 - protein, 9 aa, Influenza virus
NNQVFPQLN

SEQ ID NO: 479445 - protein, 9 aa, Influenza virus
NNRFQIQGI

SEQ ID NO: 479446 - protein, 9 aa, Influenza virus
NNRFQIQGV

SEQ ID NO: 479447 - protein, 9 aa, Influenza virus
NNRIKINPV

SEQ ID NO: 479448 - protein, 9 aa, Influenza virus
NNRKEPALI

SEQ ID NO: 479449 - protein, 9 aa, Influenza virus
NNRNWSGYS

SEQ ID NO: 479450 - protein, 9 aa, Influenza virus
NNRSGYSGI

SEQ ID NO: 479451 - protein, 9 aa, Influenza virus
NNSCMETIR

SEQ ID NO: 479452 - protein, 9 aa, Influenza virus
NNSKKQIDT

SEQ ID NO: 479453 - protein, 9 aa, Influenza virus
NNSSDTVDT

SEQ ID NO: 479454 - protein, 9 aa, Influenza virus
NNSTATLCL

SEQ ID NO: 479455 - protein, 9 aa, Influenza virus
NNSTDKIDT

SEQ ID NO: 479456 - protein, 9 aa, Influenza virus
NNSTDKVDT

SEQ ID NO: 479457 - protein, 9 aa, Influenza virus
NNSTDKVNT

SEQ ID NO: 479458 - protein, 9 aa, Influenza virus
NNSTDTIDT

SEQ ID NO: 479459 - protein, 9 aa, Influenza virus
NNSTDTVDT

SEQ ID NO: 479460 - protein, 9 aa, Influenza virus
NNSTDTVNT

SEQ ID NO: 479461 - protein, 9 aa, Influenza virus
NNSTEHVDT

SEQ ID NO: 479462 - protein, 9 aa, Influenza virus
NNSTEKIDT

SEQ ID NO: 479463 - protein, 9 aa, Influenza virus
NNSTEKVDT

SEQ ID NO: 479464 - protein, 9 aa, Influenza virus
NNSTEMVDT

SEQ ID NO: 479465 - protein, 9 aa, Influenza virus
NNSTEQVDT

SEQ ID NO: 479466 - protein, 9 aa, Influenza virus
NNSTERVDT

SEQ ID NO: 479467 - protein, 9 aa, Influenza virus
NNSTETVDT

SEQ ID NO: 479468 - protein, 9 aa, Influenza virus
NNSTETVNT

SEQ ID NO: 479469 - protein, 9 aa, Influenza virus
NNSTKKVDT

SEQ ID NO: 479470 - protein, 9 aa, Influenza virus
NNSTKQIDT

SEQ ID NO: 479471 - protein, 9 aa, Influenza virus
NNSTKQVDT

SEQ ID NO: 479472 - protein, 9 aa, Influenza virus
NNSTNTVNT

SEQ ID NO: 479473 - protein, 9 aa, Influenza virus
NNSTTKVDT

SEQ ID NO: 479474 - protein, 9 aa, Influenza virus
NNSTTQIDT

SEQ ID NO: 479475 - protein, 9 aa, Influenza virus
NNSTTQVDT

SEQ ID NO: 479476 - protein, 9 aa, Influenza virus
NNSTTQVNT

SEQ ID NO: 479477 - protein, 9 aa, Influenza virus
NNSTVQVDT

SEQ ID NO: 479478 - protein, 9 aa, Influenza virus
NNSYDHSKY

SEQ ID NO: 479479 - protein, 9 aa, Influenza virus
NNTCMETIR

SEQ ID NO: 479480 - protein, 9 aa, Influenza virus
NNTEPLCDV

SEQ ID NO: 479481 - protein, 9 aa, Influenza virus
NNTEPLCEV

SEQ ID NO: 479482 - protein, 9 aa, Influenza virus
NNTEPLCNV

SEQ ID NO: 479483 - protein, 9 aa, Influenza virus
NNTKGGDVL

SEQ ID NO: 479484 - protein, 9 aa, Influenza virus
NNTKGRDVL

SEQ ID NO: 479485 - protein, 9 aa, Influenza virus
NNTKGRYVL

SEQ ID NO: 479486 - protein, 9 aa, Influenza virus
NNTNGEQIL

SEQ ID NO: 479487 - protein, 9 aa, Influenza virus
NNTSGEQIL

SEQ ID NO: 479488 - protein, 9 aa, Influenza virus
NNTSGEQML

SEQ ID NO: 479489 - protein, 9 aa, Influenza virus
NNTSGEQVL

SEQ ID NO: 479490 - protein, 9 aa, Influenza virus
NNTSGKQML

SEQ ID NO: 479491 - protein, 9 aa, Influenza virus
NNTTGRDVL

SEQ ID NO: 479492 - protein, 9 aa, Influenza virus
NNTTLIENT

SEQ ID NO: 479493 - protein, 9 aa, Influenza virus
NNTTNYYNE

SEQ ID NO: 479494 - protein, 9 aa, Influenza virus
NNTTVVENT

SEQ ID NO: 479495 - protein, 9 aa, Influenza virus
NNTVINNIT

SEQ ID NO: 479496 - protein, 9 aa, Influenza virus
NNTVKDRSP

SEQ ID NO: 479497 - protein, 9 aa, Influenza virus
NNTVVNNIT

SEQ ID NO: 479498 - protein, 9 aa, Influenza virus
NNTWLGRTI

SEQ ID NO: 479499 - protein, 9 aa, Influenza virus
NNTWVNQTF

SEQ ID NO: 479500 - protein, 9 aa, Influenza virus
NNTWVNQTY

SEQ ID NO: 479501 - protein, 9 aa, Influenza virus
NNTYDHAQY

SEQ ID NO: 479502 - protein, 9 aa, Influenza virus
NNTYDHKKY

SEQ ID NO: 479503 - protein, 9 aa, Influenza virus
NNTYDHSHY

SEQ ID NO: 479504 - protein, 9 aa, Influenza virus
NNTYDHSKY

SEQ ID NO: 479505 - protein, 9 aa, Influenza virus
NNTYDHSQY

SEQ ID NO: 479506 - protein, 9 aa, Influenza virus
NNTYDHSRY

SEQ ID NO: 479507 - protein, 9 aa, Influenza virus
NNTYDHSTY

SEQ ID NO: 479508 - protein, 9 aa, Influenza virus
NNTYDHTKY

SEQ ID NO: 479509 - protein, 9 aa, Influenza virus
NNTYDHTQY

SEQ ID NO: 479510 - protein, 9 aa, Influenza virus
NNTYNHTEY

SEQ ID NO: 479511 - protein, 9 aa, Influenza virus
NNTYNHTQY

SEQ ID NO: 479512 - protein, 9 aa, Influenza virus
NNVIDKMNK

SEQ ID NO: 479513 - protein, 9 aa, Influenza virus
NNVIDKMNN

SEQ ID NO: 479514 - protein, 9 aa, Influenza virus
NNVIDKMYK

SEQ ID NO: 479515 - protein, 9 aa, Influenza virus
NNVTVTSSV

SEQ ID NO: 479516 - protein, 9 aa, Influenza virus
NNWFGYFGI

SEQ ID NO: 479517 - protein, 9 aa, Influenza virus
NNWSGYSGI

SEQ ID NO: 479518 - protein, 9 aa, Influenza virus
NNWSGYSGS

SEQ ID NO: 479519 - protein, 9 aa, Influenza virus
NNYEELKHL

SEQ ID NO: 479520 - protein, 9 aa, Influenza virus
NNYGVKGFG

SEQ ID NO: 479521 - protein, 9 aa, Influenza virus
NPAHKSQLI

SEQ ID NO: 479522 - protein, 9 aa, Influenza virus
NPAHKSQLV

SEQ ID NO: 479523 - protein, 9 aa, Influenza virus
NPALRMKWM

SEQ ID NO: 479524 - protein, 9 aa, Influenza virus
NPANGICYP

SEQ ID NO: 479525 - protein, 9 aa, Influenza virus
NPAYCNTDL

SEQ ID NO: 479526 - protein, 9 aa, Influenza virus
NPCFYVELI

SEQ ID NO: 479527 - protein, 9 aa, Influenza virus
NPDPGVKGF

SEQ ID NO: 479528 - protein, 9 aa, Influenza virus
NPEAYNFNE

SEQ ID NO: 479529 - protein, 9 aa, Influenza virus
NPECDRFLS

SEQ ID NO: 479530 - protein, 9 aa, Influenza virus
NPECDRLLN

SEQ ID NO: 479531 - protein, 9 aa, Influenza virus
NPECDRLLR

SEQ ID NO: 479532 - protein, 9 aa, Influenza virus
NPECDRLLS

SEQ ID NO: 479533 - protein, 9 aa, Influenza virus
NPECDRLLT

SEQ ID NO: 479534 - protein, 9 aa, Influenza virus
NPGDSIIFN

SEQ ID NO: 479535 - protein, 9 aa, Influenza virus
NPGNAEIED

SEQ ID NO: 479536 - protein, 9 aa, Influenza virus
NPGRVSVST

SEQ ID NO: 479537 - protein, 9 aa, Influenza virus
NPGRVTVST

SEQ ID NO: 479538 - protein, 9 aa, Influenza virus
NPGVKGWAF

SEQ ID NO: 479539 - protein, 9 aa, Influenza virus
NPIDGPLPD

SEQ ID NO: 479540 - protein, 9 aa, Influenza virus
NPIDGPLPE

SEQ ID NO: 479541 - protein, 9 aa, Influenza virus
NPIDGPLPK

SEQ ID NO: 479542 - protein, 9 aa, Influenza virus
NPIDGPLPV

SEQ ID NO: 479543 - protein, 9 aa, Influenza virus
NPIICLGHH

SEQ ID NO: 479544 - protein, 9 aa, Influenza virus
NPINGICYP

SEQ ID NO: 479545 - protein, 9 aa, Influenza virus
NPITGSPCA

SEQ ID NO: 479546 - protein, 9 aa, Influenza virus
NPITGSPEA

SEQ ID NO: 479547 - protein, 9 aa, Influenza virus
NPITGSPGA

SEQ ID NO: 479548 - protein, 9 aa, Influenza virus
NPITGSPGS

SEQ ID NO: 479549 - protein, 9 aa, Influenza virus
NPITGSPGV

SEQ ID NO: 479550 - protein, 9 aa, Influenza virus
NPITGSPSA

SEQ ID NO: 479551 - protein, 9 aa, Influenza virus
NPIVPSFDM

SEQ ID NO: 479552 - protein, 9 aa, Influenza virus
NPIVPSFEM

SEQ ID NO: 479553 - protein, 9 aa, Influenza virus
NPKCDIHLK

SEQ ID NO: 479554 - protein, 9 aa, Influenza virus
NPKCDIHLR

SEQ ID NO: 479555 - protein, 9 aa, Influenza virus
NPKCDLYLN

SEQ ID NO: 479556 - protein, 9 aa, Influenza virus
NPKCDLYLS

SEQ ID NO: 479557 - protein, 9 aa, Influenza virus
NPKCDPYLN

SEQ ID NO: 479558 - protein, 9 aa, Influenza virus
NPKCDTHLK

SEQ ID NO: 479559 - protein, 9 aa, Influenza virus
NPKCDVHLK

SEQ ID NO: 479560 - protein, 9 aa, Influenza virus
NPKSKLFTL

SEQ ID NO: 479561 - protein, 9 aa, Influenza virus
NPLIKHENR

SEQ ID NO: 479562 - protein, 9 aa, Influenza virus
NPLIRHENR

SEQ ID NO: 479563 - protein, 9 aa, Influenza virus
NPLNPFVGH

SEQ ID NO: 479564 - protein, 9 aa, Influenza virus
NPLNPFVNH

SEQ ID NO: 479565 - protein, 9 aa, Influenza virus
NPLNPFVSH

SEQ ID NO: 479566 - protein, 9 aa, Influenza virus
NPLNPFVTH

SEQ ID NO: 479567 - protein, 9 aa, Influenza virus
NPMCDDLIG

SEQ ID NO: 479568 - protein, 9 aa, Influenza virus
NPMCDELIG

SEQ ID NO: 479569 - protein, 9 aa, Influenza virus
NPMCDNLIG

SEQ ID NO: 479570 - protein, 9 aa, Influenza virus
NPMCDYLIG

SEQ ID NO: 479571 - protein, 9 aa, Influenza virus
NPMHQLLRH

SEQ ID NO: 479572 - protein, 9 aa, Influenza virus
NPMIAELAE

SEQ ID NO: 479573 - protein, 9 aa, Influenza virus
NPMIIELAE

SEQ ID NO: 479574 - protein, 9 aa, Influenza virus
NPMIVELAE

SEQ ID NO: 479575 - protein, 9 aa, Influenza virus
NPMNPFVSH

SEQ ID NO: 479576 - protein, 9 aa, Influenza virus
NPMTVELAE

SEQ ID NO: 479577 - protein, 9 aa, Influenza virus
NPMVVELAE

SEQ ID NO: 479578 - protein, 9 aa, Influenza virus
NPNQKIICI

SEQ ID NO: 479579 - protein, 9 aa, Influenza virus
NPNQKIITI

SEQ ID NO: 479580 - protein, 9 aa, Influenza virus
NPNQKILCA

SEQ ID NO: 479581 - protein, 9 aa, Influenza virus
NPNQKILCT

SEQ ID NO: 479582 - protein, 9 aa, Influenza virus
NPNQKILFA

SEQ ID NO: 479583 - protein, 9 aa, Influenza virus
NPNQKIMCI

SEQ ID NO: 479584 - protein, 9 aa, Influenza virus
NPNQKIQCT

SEQ ID NO: 479585 - protein, 9 aa, Influenza virus
NPNQKITCI

SEQ ID NO: 479586 - protein, 9 aa, Influenza virus
NPNQKIVTI

SEQ ID NO: 479587 - protein, 9 aa, Influenza virus
NPNQKLFAL

SEQ ID NO: 479588 - protein, 9 aa, Influenza virus
NPNQKLFAS

SEQ ID NO: 479589 - protein, 9 aa, Influenza virus
NPNQKLFTL

SEQ ID NO: 479590 - protein, 9 aa, Influenza virus
NPNQKTITI

SEQ ID NO: 479591 - protein, 9 aa, Influenza virus
NPNQMIITI

SEQ ID NO: 479592 - protein, 9 aa, Influenza virus
NPNWSGYSG

SEQ ID NO: 479593 - protein, 9 aa, Influenza virus
NPRCDDLIG

SEQ ID NO: 479594 - protein, 9 aa, Influenza virus
NPRIFLAMI

SEQ ID NO: 479595 - protein, 9 aa, Influenza virus
NPRMFLAMI

SEQ ID NO: 479596 - protein, 9 aa, Influenza virus
NPRVFLAMI

SEQ ID NO: 479597 - protein, 9 aa, Influenza virus
NPRVFLTMI

SEQ ID NO: 479598 - protein, 9 aa, Influenza virus
NPSAGKDPK

SEQ ID NO: 479599 - protein, 9 aa, Influenza virus
NPSCASNIN

SEQ ID NO: 479600 - protein, 9 aa, Influenza virus
NPSCATNIN

SEQ ID NO: 479601 - protein, 9 aa, Influenza virus
NPSHEGEGI

SEQ ID NO: 479602 - protein, 9 aa, Influenza virus
NPSLRMKWM

SEQ ID NO: 479603 - protein, 9 aa, Influenza virus
NPSQKLFAL

SEQ ID NO: 479604 - protein, 9 aa, Influenza virus
NPTEEQAVD

SEQ ID NO: 479605 - protein, 9 aa, Influenza virus
NPTEEQAVE

SEQ ID NO: 479606 - protein, 9 aa, Influenza virus
NPTEEQAVG

SEQ ID NO: 479607 - protein, 9 aa, Influenza virus
NPTEEQAVN

SEQ ID NO: 479608 - protein, 9 aa, Influenza virus
NPTLLFLEV

SEQ ID NO: 479609 - protein, 9 aa, Influenza virus
NPTLLFLKI

SEQ ID NO: 479610 - protein, 9 aa, Influenza virus
NPTLLFLKM

SEQ ID NO: 479611 - protein, 9 aa, Influenza virus
NPTLLFLKV

SEQ ID NO: 479612 - protein, 9 aa, Influenza virus
NPTNGICYP

SEQ ID NO: 479613 - protein, 9 aa, Influenza virus
NPVELSSGY

SEQ ID NO: 479614 - protein, 9 aa, Influenza virus
NPVHKSQLI

SEQ ID NO: 479615 - protein, 9 aa, Influenza virus
NPVICLGHH

SEQ ID NO: 479616 - protein, 9 aa, Influenza virus
NPVICMGHH

SEQ ID NO: 479617 - protein, 9 aa, Influenza virus
NPVKLNSGY

SEQ ID NO: 479618 - protein, 9 aa, Influenza virus
NPVKLSGGY

SEQ ID NO: 479619 - protein, 9 aa, Influenza virus
NPVKLSSGY

SEQ ID NO: 479620 - protein, 9 aa, Influenza virus
NPVKLSSSY

SEQ ID NO: 479621 - protein, 9 aa, Influenza virus
NPVNGICYP

SEQ ID NO: 479622 - protein, 9 aa, Influenza virus
NPVTLSSGY

SEQ ID NO: 479623 - protein, 9 aa, Influenza virus
NPVTLTMGY

SEQ ID NO: 479624 - protein, 9 aa, Influenza virus
NPVVPSFDM

SEQ ID NO: 479625 - protein, 9 aa, Influenza virus
NPYTLVSTK

SEQ ID NO: 479626 - protein, 9 aa, Influenza virus
NQASYKIFK

SEQ ID NO: 479627 - protein, 9 aa, Influenza virus
NQASYRIFK

SEQ ID NO: 479628 - protein, 9 aa, Influenza virus
NQCMESIRN

SEQ ID NO: 479629 - protein, 9 aa, Influenza virus
NQDSFYRSM

SEQ ID NO: 479630 - protein, 9 aa, Influenza virus
NQDWSGYSG

SEQ ID NO: 479631 - protein, 9 aa, Influenza virus
NQEELKSLF

SEQ ID NO: 479632 - protein, 9 aa, Influenza virus
NQEELRFLF

SEQ ID NO: 479633 - protein, 9 aa, Influenza virus
NQEELRSLF

SEQ ID NO: 479634 - protein, 9 aa, Influenza virus
NQEYTSGRQ

SEQ ID NO: 479635 - protein, 9 aa, Influenza virus
NQFALGQGT

SEQ ID NO: 479636 - protein, 9 aa, Influenza virus
NQGSFYRNM

SEQ ID NO: 479637 - protein, 9 aa, Influenza virus
NQGSFYRSI

SEQ ID NO: 479638 - protein, 9 aa, Influenza virus
NQGSFYRSM

SEQ ID NO: 479639 - protein, 9 aa, Influenza virus
NQGVKGWAF

SEQ ID NO: 479640 - protein, 9 aa, Influenza virus
NQHTIDLAD

SEQ ID NO: 479641 - protein, 9 aa, Influenza virus
NQHTIDLAE

SEQ ID NO: 479642 - protein, 9 aa, Influenza virus
NQHTIDLTD

SEQ ID NO: 479643 - protein, 9 aa, Influenza virus
NQHTIDLTN

SEQ ID NO: 479644 - protein, 9 aa, Influenza virus
NQHTIDMAD

SEQ ID NO: 479645 - protein, 9 aa, Influenza virus
NQHTIDMTD

SEQ ID NO: 479646 - protein, 9 aa, Influenza virus
NQHTIDSTD

SEQ ID NO: 479647 - protein, 9 aa, Influenza virus
NQHTIDVTD

SEQ ID NO: 479648 - protein, 9 aa, Influenza virus
NQHTIHLTD

SEQ ID NO: 479649 - protein, 9 aa, Influenza virus
NQIKIRRRV

SEQ ID NO: 479650 - protein, 9 aa, Influenza virus
NQINGKLNR

SEQ ID NO: 479651 - protein, 9 aa, Influenza virus
NQITGKLNR

SEQ ID NO: 479652 - protein, 9 aa, Influenza virus
NQKIICISA

SEQ ID NO: 479653 - protein, 9 aa, Influenza virus
NQKIICIST

SEQ ID NO: 479654 - protein, 9 aa, Influenza virus
NQKIITIDS

SEQ ID NO: 479655 - protein, 9 aa, Influenza virus
NQKIITIGS

SEQ ID NO: 479656 - protein, 9 aa, Influenza virus
NQKIITMGS

SEQ ID NO: 479657 - protein, 9 aa, Influenza virus
NQKILCASA

SEQ ID NO: 479658 - protein, 9 aa, Influenza virus
NQKILCTSA

SEQ ID NO: 479659 - protein, 9 aa, Influenza virus
NQKILDEHD

SEQ ID NO: 479660 - protein, 9 aa, Influenza virus
NQKILFASA

SEQ ID NO: 479661 - protein, 9 aa, Influenza virus
NQKIMCISA

SEQ ID NO: 479662 - protein, 9 aa, Influenza virus
NQKITCISA

SEQ ID NO: 479663 - protein, 9 aa, Influenza virus
NQKIVTIGS

SEQ ID NO: 479664 - protein, 9 aa, Influenza virus
NQKLFALSG

SEQ ID NO: 479665 - protein, 9 aa, Influenza virus
NQKLFASSG

SEQ ID NO: 479666 - protein, 9 aa, Influenza virus
NQKLFTLSG

SEQ ID NO: 479667 - protein, 9 aa, Influenza virus
NQKPLDEHD

SEQ ID NO: 479668 - protein, 9 aa, Influenza virus
NQKTITIGS

SEQ ID NO: 479669 - protein, 9 aa, Influenza virus
NQKTLDEHD

SEQ ID NO: 479670 - protein, 9 aa, Influenza virus
NQKTLDEHE

SEQ ID NO: 479671 - protein, 9 aa, Influenza virus
NQKTLDEHV

SEQ ID NO: 479672 - protein, 9 aa, Influenza virus
NQKTLDKHD

SEQ ID NO: 479673 - protein, 9 aa, Influenza virus
NQMIITIGS

SEQ ID NO: 479674 - protein, 9 aa, Influenza virus
NQNNTTVVE

SEQ ID NO: 479675 - protein, 9 aa, Influenza virus
NQNPRIFLA

SEQ ID NO: 479676 - protein, 9 aa, Influenza virus
NQNPRMFLA

SEQ ID NO: 479677 - protein, 9 aa, Influenza virus
NQNPRVFLA

SEQ ID NO: 479678 - protein, 9 aa, Influenza virus
NQNPRVFLT

SEQ ID NO: 479679 - protein, 9 aa, Influenza virus
NQNQNPRMF

SEQ ID NO: 479680 - protein, 9 aa, Influenza virus
NQNSTWVSQ

SEQ ID NO: 479681 - protein, 9 aa, Influenza virus
NQNWSGYSG

SEQ ID NO: 479682 - protein, 9 aa, Influenza virus
NQPAATALA

SEQ ID NO: 479683 - protein, 9 aa, Influenza virus
NQQFELIDH

SEQ ID NO: 479684 - protein, 9 aa, Influenza virus
NQQFELIDN

SEQ ID NO: 479685 - protein, 9 aa, Influenza virus
NQQFELINN

SEQ ID NO: 479686 - protein, 9 aa, Influenza virus
NQQFEMIDN

SEQ ID NO: 479687 - protein, 9 aa, Influenza virus
NQQFKLIDN

SEQ ID NO: 479688 - protein, 9 aa, Influenza virus
NQRLNPMHQ

SEQ ID NO: 479689 - protein, 9 aa, Influenza virus
NQRLNTMHQ

SEQ ID NO: 479690 - protein, 9 aa, Influenza virus
NQSGRISIY

SEQ ID NO: 479691 - protein, 9 aa, Influenza virus
NQSLPPNFS

SEQ ID NO: 479692 - protein, 9 aa, Influenza virus
NQTIINNYY

SEQ ID NO: 479693 - protein, 9 aa, Influenza virus
NQTKKMTIT

SEQ ID NO: 479694 - protein, 9 aa, Influenza virus
NQTKTMTIT

SEQ ID NO: 479695 - protein, 9 aa, Influenza virus
NQTLVSNND

SEQ ID NO: 479696 - protein, 9 aa, Influenza virus
NQTYRNNRK

SEQ ID NO: 479697 - protein, 9 aa, Influenza virus
NQTYRNTRK

SEQ ID NO: 479698 - protein, 9 aa, Influenza virus
NQVEKRINM

SEQ ID NO: 479699 - protein, 9 aa, Influenza virus
NQVENRINM

SEQ ID NO: 479700 - protein, 9 aa, Influenza virus
NQVEQRINM

SEQ ID NO: 479701 - protein, 9 aa, Influenza virus
NQVFPQLNQ

SEQ ID NO: 479702 - protein, 9 aa, Influenza virus
NQVKIRRRV

SEQ ID NO: 479703 - protein, 9 aa, Influenza virus
NRANQRLNP

SEQ ID NO: 479704 - protein, 9 aa, Influenza virus
NRANQRLNT

SEQ ID NO: 479705 - protein, 9 aa, Influenza virus
NRCFYVELI

SEQ ID NO: 479706 - protein, 9 aa, Influenza virus
NRCFYVELV

SEQ ID NO: 479707 - protein, 9 aa, Influenza virus
NRCYQFALG

SEQ ID NO: 479708 - protein, 9 aa, Influenza virus
NRDITIGSI

SEQ ID NO: 479709 - protein, 9 aa, Influenza virus
NREFEVMNH

SEQ ID NO: 479710 - protein, 9 aa, Influenza virus
NREFEVVDH

SEQ ID NO: 479711 - protein, 9 aa, Influenza virus
NREFEVVNH

SEQ ID NO: 479712 - protein, 9 aa, Influenza virus
NREFGVVNH

SEQ ID NO: 479713 - protein, 9 aa, Influenza virus
NRFIEKTNQ

SEQ ID NO: 479714 - protein, 9 aa, Influenza virus
NRFQIQGIK

SEQ ID NO: 479715 - protein, 9 aa, Influenza virus
NRFQIQGVK

SEQ ID NO: 479716 - protein, 9 aa, Influenza virus
NRFQIQGVR

SEQ ID NO: 479717 - protein, 9 aa, Influenza virus
NRFYRTCKL

SEQ ID NO: 479718 - protein, 9 aa, Influenza virus
NRGLFGAIA

SEQ ID NO: 479719 - protein, 9 aa, Influenza virus
NRGLFGAKA

SEQ ID NO: 479720 - protein, 9 aa, Influenza virus
NRGSFYRSM

SEQ ID NO: 479721 - protein, 9 aa, Influenza virus
NRHSNGTIH

SEQ ID NO: 479722 - protein, 9 aa, Influenza virus
NRIFQPNIG

SEQ ID NO: 479723 - protein, 9 aa, Influenza virus
NRIFRPNIG

SEQ ID NO: 479724 - protein, 9 aa, Influenza virus
NRIIEKTNQ

SEQ ID NO: 479725 - protein, 9 aa, Influenza virus
NRIKINPVT

SEQ ID NO: 479726 - protein, 9 aa, Influenza virus
NRIMINPVK

SEQ ID NO: 479727 - protein, 9 aa, Influenza virus
NRINMLADR

SEQ ID NO: 479728 - protein, 9 aa, Influenza virus
NRIQIDPVK

SEQ ID NO: 479729 - protein, 9 aa, Influenza virus
NRIQIDQVK

SEQ ID NO: 479730 - protein, 9 aa, Influenza virus
NRIQIDSVK

SEQ ID NO: 479731 - protein, 9 aa, Influenza virus
NRIQINPVK

SEQ ID NO: 479732 - protein, 9 aa, Influenza virus
NRIRIDPVK

SEQ ID NO: 479733 - protein, 9 aa, Influenza virus
NRITYGACP

SEQ ID NO: 479734 - protein, 9 aa, Influenza virus
NRITYGPCP

SEQ ID NO: 479735 - protein, 9 aa, Influenza virus
NRITYGVCP

SEQ ID NO: 479736 - protein, 9 aa, Influenza virus
NRKEPALIV

SEQ ID NO: 479737 - protein, 9 aa, Influenza virus
NRKEYEEEA

SEQ ID NO: 479738 - protein, 9 aa, Influenza virus
NRKMEDGFL

SEQ ID NO: 479739 - protein, 9 aa, Influenza virus
NRKVDDGFL

SEQ ID NO: 479740 - protein, 9 aa, Influenza virus
NRLIDKTNQ

SEQ ID NO: 479741 - protein, 9 aa, Influenza virus
NRLIDRTNH

SEQ ID NO: 479742 - protein, 9 aa, Influenza virus
NRLIEKTND

SEQ ID NO: 479743 - protein, 9 aa, Influenza virus
NRLIEKTNE

SEQ ID NO: 479744 - protein, 9 aa, Influenza virus
NRLIEKTNK

SEQ ID NO: 479745 - protein, 9 aa, Influenza virus
NRLIEKTNQ

SEQ ID NO: 479746 - protein, 9 aa, Influenza virus
NRLIEKTNT

SEQ ID NO: 479747 - protein, 9 aa, Influenza virus
NRLIERTNE

SEQ ID NO: 479748 - protein, 9 aa, Influenza virus
NRLIERTNQ

SEQ ID NO: 479749 - protein, 9 aa, Influenza virus
NRLIGKTNQ

SEQ ID NO: 479750 - protein, 9 aa, Influenza virus
NRLISKTNQ

SEQ ID NO: 479751 - protein, 9 aa, Influenza virus
NRLNINPVK

SEQ ID NO: 479752 - protein, 9 aa, Influenza virus
NRLNINPVR

SEQ ID NO: 479753 - protein, 9 aa, Influenza virus
NRLNINPVT

SEQ ID NO: 479754 - protein, 9 aa, Influenza virus
NRLNINSVK

SEQ ID NO: 479755 - protein, 9 aa, Influenza virus
NRLNNVIDK

SEQ ID NO: 479756 - protein, 9 aa, Influenza virus
NRLSINPVK

SEQ ID NO: 479757 - protein, 9 aa, Influenza virus
NRMQFSSLT

SEQ ID NO: 479758 - protein, 9 aa, Influenza virus
NRMQINPVK

SEQ ID NO: 479759 - protein, 9 aa, Influenza virus
NRMTICVQG

SEQ ID NO: 479760 - protein, 9 aa, Influenza virus
NRMVIASTT

SEQ ID NO: 479761 - protein, 9 aa, Influenza virus
NRMVLASTT

SEQ ID NO: 479762 - protein, 9 aa, Influenza virus
NRNEIKGVK

SEQ ID NO: 479763 - protein, 9 aa, Influenza virus
NRNFKPNIG

SEQ ID NO: 479764 - protein, 9 aa, Influenza virus
NRNFQPNIG

SEQ ID NO: 479765 - protein, 9 aa, Influenza virus
NRNQPAATA

SEQ ID NO: 479766 - protein, 9 aa, Influenza virus
NRNWSGYSG

SEQ ID NO: 479767 - protein, 9 aa, Influenza virus
NRPIIDINM

SEQ ID NO: 479768 - protein, 9 aa, Influenza virus
NRPIIEIDM

SEQ ID NO: 479769 - protein, 9 aa, Influenza virus
NRPIIEINM

SEQ ID NO: 479770 - protein, 9 aa, Influenza virus
NRPVIDINM

SEQ ID NO: 479771 - protein, 9 aa, Influenza virus
NRPVIDVNM

SEQ ID NO: 479772 - protein, 9 aa, Influenza virus
NRPVIEIDM

SEQ ID NO: 479773 - protein, 9 aa, Influenza virus
NRPVIEINM

SEQ ID NO: 479774 - protein, 9 aa, Influenza virus
NRPVIKIDM

SEQ ID NO: 479775 - protein, 9 aa, Influenza virus
NRPVIQIDP

SEQ ID NO: 479776 - protein, 9 aa, Influenza virus
NRPVIQINP

SEQ ID NO: 479777 - protein, 9 aa, Influenza virus
NRPVIRIDP

SEQ ID NO: 479778 - protein, 9 aa, Influenza virus
NRPWIRFNS

SEQ ID NO: 479779 - protein, 9 aa, Influenza virus
NRPWIRINN

SEQ ID NO: 479780 - protein, 9 aa, Influenza virus
NRPWISFDQ

SEQ ID NO: 479781 - protein, 9 aa, Influenza virus
NRPWISFNQ

SEQ ID NO: 479782 - protein, 9 aa, Influenza virus
NRPWLSFNQ

SEQ ID NO: 479783 - protein, 9 aa, Influenza virus
NRPWMRINN

SEQ ID NO: 479784 - protein, 9 aa, Influenza virus
NRPWMRISN

SEQ ID NO: 479785 - protein, 9 aa, Influenza virus
NRPWVRINN

SEQ ID NO: 479786 - protein, 9 aa, Influenza virus
NRPWVRMNN

SEQ ID NO: 479787 - protein, 9 aa, Influenza virus
NRPWVSFDQ

SEQ ID NO: 479788 - protein, 9 aa, Influenza virus
NRPWVSFNH

SEQ ID NO: 479789 - protein, 9 aa, Influenza virus
NRPWVSFNQ

SEQ ID NO: 479790 - protein, 9 aa, Influenza virus
NRPWVSFTQ

SEQ ID NO: 479791 - protein, 9 aa, Influenza virus
NRQEIEGAR

SEQ ID NO: 479792 - protein, 9 aa, Influenza virus
NRQEIEGVK

SEQ ID NO: 479793 - protein, 9 aa, Influenza virus
NRQEIEGVR

SEQ ID NO: 479794 - protein, 9 aa, Influenza virus
NRQEIGGVK

SEQ ID NO: 479795 - protein, 9 aa, Influenza virus
NRRLTTTIK

SEQ ID NO: 479796 - protein, 9 aa, Influenza virus
NRRPTTTIK

SEQ ID NO: 479797 - protein, 9 aa, Influenza virus
NRSFKPNIG

SEQ ID NO: 479798 - protein, 9 aa, Influenza virus
NRSFQPNIG

SEQ ID NO: 479799 - protein, 9 aa, Influenza virus
NRSFRPNIG

SEQ ID NO: 479800 - protein, 9 aa, Influenza virus
NRSGYSGIF

SEQ ID NO: 479801 - protein, 9 aa, Influenza virus
NRSGYSGSF

SEQ ID NO: 479802 - protein, 9 aa, Influenza virus
NRSILNTSQ

SEQ ID NO: 479803 - protein, 9 aa, Influenza virus
NRSPYRALM

SEQ ID NO: 479804 - protein, 9 aa, Influenza virus
NRTFQNIDK

SEQ ID NO: 479805 - protein, 9 aa, Influenza virus
NRTFQNIDR

SEQ ID NO: 479806 - protein, 9 aa, Influenza virus
NRTFQNVSP

SEQ ID NO: 479807 - protein, 9 aa, Influenza virus
NRTGTFEFT

SEQ ID NO: 479808 - protein, 9 aa, Influenza virus
NRTHQYSEK

SEQ ID NO: 479809 - protein, 9 aa, Influenza virus
NRTHQYSER

SEQ ID NO: 479810 - protein, 9 aa, Influenza virus
NRVKIDPVK

SEQ ID NO: 479811 - protein, 9 aa, Influenza virus
NRVWWTSNS

SEQ ID NO: 479812 - protein, 9 aa, Influenza virus
NRYLEEHPS

SEQ ID NO: 479813 - protein, 9 aa, Influenza virus
NRYLEENPS

SEQ ID NO: 479814 - protein, 9 aa, Influenza virus
NSAAFEDLR

SEQ ID NO: 479815 - protein, 9 aa, Influenza virus
NSADHRIYW

SEQ ID NO: 479816 - protein, 9 aa, Influenza virus
NSADHRVYW

SEQ ID NO: 479817 - protein, 9 aa, Influenza virus
NSALGSPGC

SEQ ID NO: 479818 - protein, 9 aa, Influenza virus
NSARLIHHT

SEQ ID NO: 479819 - protein, 9 aa, Influenza virus
NSCESKCFW

SEQ ID NO: 479820 - protein, 9 aa, Influenza virus
NSCIESIRN

SEQ ID NO: 479821 - protein, 9 aa, Influenza virus
NSCMETIRN

SEQ ID NO: 479822 - protein, 9 aa, Influenza virus
NSDFICVGW

SEQ ID NO: 479823 - protein, 9 aa, Influenza virus
NSDFLCVGW

SEQ ID NO: 479824 - protein, 9 aa, Influenza virus
NSDFMCVGW

SEQ ID NO: 479825 - protein, 9 aa, Influenza virus
NSDLDYQIG

SEQ ID NO: 479826 - protein, 9 aa, Influenza virus
NSDLEALME

SEQ ID NO: 479827 - protein, 9 aa, Influenza virus
NSDPDYQIG

SEQ ID NO: 479828 - protein, 9 aa, Influenza virus
NSDVLVTRE

SEQ ID NO: 479829 - protein, 9 aa, Influenza virus
NSDWSGYSG

SEQ ID NO: 479830 - protein, 9 aa, Influenza virus
NSEFICVGW

SEQ ID NO: 479831 - protein, 9 aa, Influenza virus
NSEFLCVGW

SEQ ID NO: 479832 - protein, 9 aa, Influenza virus
NSEGIGQAA

SEQ ID NO: 479833 - protein, 9 aa, Influenza virus
NSEGMGQAA

SEQ ID NO: 479834 - protein, 9 aa, Influenza virus
NSEGRGQAA

SEQ ID NO: 479835 - protein, 9 aa, Influenza virus
NSEGTGIAA

SEQ ID NO: 479836 - protein, 9 aa, Influenza virus
NSEGTGIVA

SEQ ID NO: 479837 - protein, 9 aa, Influenza virus
NSEGTGMAA

SEQ ID NO: 479838 - protein, 9 aa, Influenza virus
NSEGTGQAA

SEQ ID NO: 479839 - protein, 9 aa, Influenza virus
NSEMNKLYE

SEQ ID NO: 479840 - protein, 9 aa, Influenza virus
NSETGAPQL

SEQ ID NO: 479841 - protein, 9 aa, Influenza virus
NSFEQITFI

SEQ ID NO: 479842 - protein, 9 aa, Influenza virus
NSFEQITFL

SEQ ID NO: 479843 - protein, 9 aa, Influenza virus
NSFEQITFM

SEQ ID NO: 479844 - protein, 9 aa, Influenza virus
NSFFSRLNW

SEQ ID NO: 479845 - protein, 9 aa, Influenza virus
NSFSRTELI

SEQ ID NO: 479846 - protein, 9 aa, Influenza virus
NSFVPVVGA

SEQ ID NO: 479847 - protein, 9 aa, Influenza virus
NSFYAELKW

SEQ ID NO: 479848 - protein, 9 aa, Influenza virus
NSFYRNLIW

SEQ ID NO: 479849 - protein, 9 aa, Influenza virus
NSGDYARLY

SEQ ID NO: 479850 - protein, 9 aa, Influenza virus
NSGKVECVC

SEQ ID NO: 479851 - protein, 9 aa, Influenza virus
NSGVKGWAF

SEQ ID NO: 479852 - protein, 9 aa, Influenza virus
NSHYEECSC

SEQ ID NO: 479853 - protein, 9 aa, Influenza virus
NSIAVFCGT

SEQ ID NO: 479854 - protein, 9 aa, Influenza virus
NSIGNLIAP

SEQ ID NO: 479855 - protein, 9 aa, Influenza virus
NSIIAFCGT

SEQ ID NO: 479856 - protein, 9 aa, Influenza virus
NSIIDKMNI

SEQ ID NO: 479857 - protein, 9 aa, Influenza virus
NSIIDKMNT

SEQ ID NO: 479858 - protein, 9 aa, Influenza virus
NSIIDKVNT

SEQ ID NO: 479859 - protein, 9 aa, Influenza virus
NSIIEKMNT

SEQ ID NO: 479860 - protein, 9 aa, Influenza virus
NSIIGKMNT

SEQ ID NO: 479861 - protein, 9 aa, Influenza virus
NSIINKMNT

SEQ ID NO: 479862 - protein, 9 aa, Influenza virus
NSIIVFCGT

SEQ ID NO: 479863 - protein, 9 aa, Influenza virus
NSIQLSAGG

SEQ ID NO: 479864 - protein, 9 aa, Influenza virus
NSIRIGSKG

SEQ ID NO: 479865 - protein, 9 aa, Influenza virus
NSIRIGSRG

SEQ ID NO: 479866 - protein, 9 aa, Influenza virus
NSIRLAAGG

SEQ ID NO: 479867 - protein, 9 aa, Influenza virus
NSIRLSADG

SEQ ID NO: 479868 - protein, 9 aa, Influenza virus
NSIRLSAGG

SEQ ID NO: 479869 - protein, 9 aa, Influenza virus
NSIRLSASG

SEQ ID NO: 479870 - protein, 9 aa, Influenza virus
NSIVAFCGT

SEQ ID NO: 479871 - protein, 9 aa, Influenza virus
NSIVALCGS

SEQ ID NO: 479872 - protein, 9 aa, Influenza virus
NSIVEFCGT

SEQ ID NO: 479873 - protein, 9 aa, Influenza virus
NSIVSMCSS

SEQ ID NO: 479874 - protein, 9 aa, Influenza virus
NSIVTFCGL

SEQ ID NO: 479875 - protein, 9 aa, Influenza virus
NSIVVFCGT

SEQ ID NO: 479876 - protein, 9 aa, Influenza virus
NSIVVFCST

SEQ ID NO: 479877 - protein, 9 aa, Influenza virus
NSIVVFVAP

SEQ ID NO: 479878 - protein, 9 aa, Influenza virus
NSIWTSSSS

SEQ ID NO: 479879 - protein, 9 aa, Influenza virus
NSIYASPQL

SEQ ID NO: 479880 - protein, 9 aa, Influenza virus
NSKFESVAW

SEQ ID NO: 479881 - protein, 9 aa, Influenza virus
NSKKQIDTI

SEQ ID NO: 479882 - protein, 9 aa, Influenza virus
NSLIALCGS

SEQ ID NO: 479883 - protein, 9 aa, Influenza virus
NSLKLAIGL

SEQ ID NO: 479884 - protein, 9 aa, Influenza virus
NSLVALCGS

SEQ ID NO: 479885 - protein, 9 aa, Influenza virus
NSLYASPQL

SEQ ID NO: 479886 - protein, 9 aa, Influenza virus
NSLYASSQL

SEQ ID NO: 479887 - protein, 9 aa, Influenza virus
NSLYSSPQL

SEQ ID NO: 479888 - protein, 9 aa, Influenza virus
NSMVTFCGL

SEQ ID NO: 479889 - protein, 9 aa, Influenza virus
NSNAITRSG

SEQ ID NO: 479890 - protein, 9 aa, Influenza virus
NSNCKDPNN

SEQ ID NO: 479891 - protein, 9 aa, Influenza virus
NSNCRDPNN

SEQ ID NO: 479892 - protein, 9 aa, Influenza virus
NSNCRNPNN

SEQ ID NO: 479893 - protein, 9 aa, Influenza virus
NSNGVQDII

SEQ ID NO: 479894 - protein, 9 aa, Influenza virus
NSNLDYQIG

SEQ ID NO: 479895 - protein, 9 aa, Influenza virus
NSNNGVKGF

SEQ ID NO: 479896 - protein, 9 aa, Influenza virus
NSNWSGYSG

SEQ ID NO: 479897 - protein, 9 aa, Influenza virus
NSPAFNYNK

SEQ ID NO: 479898 - protein, 9 aa, Influenza virus
NSPGRVTVS

SEQ ID NO: 479899 - protein, 9 aa, Influenza virus
NSPIFNYNK

SEQ ID NO: 479900 - protein, 9 aa, Influenza virus
NSPLPFQNI

SEQ ID NO: 479901 - protein, 9 aa, Influenza virus
NSPVFNYNK

SEQ ID NO: 479902 - protein, 9 aa, Influenza virus
NSPVFNYNR

SEQ ID NO: 479903 - protein, 9 aa, Influenza virus
NSQASYKIF

SEQ ID NO: 479904 - protein, 9 aa, Influenza virus
NSQDTEISF

SEQ ID NO: 479905 - protein, 9 aa, Influenza virus
NSQDTELSF

SEQ ID NO: 479906 - protein, 9 aa, Influenza virus
NSQDTEVSF

SEQ ID NO: 479907 - protein, 9 aa, Influenza virus
NSQGEGTAA

SEQ ID NO: 479908 - protein, 9 aa, Influenza virus
NSQGSGYAA

SEQ ID NO: 479909 - protein, 9 aa, Influenza virus
NSRFESVAW

SEQ ID NO: 479910 - protein, 9 aa, Influenza virus
NSRFQIQGV

SEQ ID NO: 479911 - protein, 9 aa, Influenza virus
NSSCAAMDD

SEQ ID NO: 479912 - protein, 9 aa, Influenza virus
NSSDICYPG

SEQ ID NO: 479913 - protein, 9 aa, Influenza virus
NSSDKVDTL

SEQ ID NO: 479914 - protein, 9 aa, Influenza virus
NSSDTVDTL

SEQ ID NO: 479915 - protein, 9 aa, Influenza virus
NSSEKVDTL

SEQ ID NO: 479916 - protein, 9 aa, Influenza virus
NSSEKVNTL

SEQ ID NO: 479917 - protein, 9 aa, Influenza virus
NSSERVDTL

SEQ ID NO: 479918 - protein, 9 aa, Influenza virus
NSSILTDSQ

SEQ ID NO: 479919 - protein, 9 aa, Influenza virus
NSSKPFQNA

SEQ ID NO: 479920 - protein, 9 aa, Influenza virus
NSSKPFQNT

SEQ ID NO: 479921 - protein, 9 aa, Influenza virus
NSSKPLQNA

SEQ ID NO: 479922 - protein, 9 aa, Influenza virus
NSSMPFHNI

SEQ ID NO: 479923 - protein, 9 aa, Influenza virus
NSSMPFHNV

SEQ ID NO: 479924 - protein, 9 aa, Influenza virus
NSSMPLHNI

SEQ ID NO: 479925 - protein, 9 aa, Influenza virus
NSSRPFQNA

SEQ ID NO: 479926 - protein, 9 aa, Influenza virus
NSSVSRMST

SEQ ID NO: 479927 - protein, 9 aa, Influenza virus
NSSYVCSGL

SEQ ID NO: 479928 - protein, 9 aa, Influenza virus
NSTCVVVMT

SEQ ID NO: 479929 - protein, 9 aa, Influenza virus
NSTDKIDTL

SEQ ID NO: 479930 - protein, 9 aa, Influenza virus
NSTDKVDTI

SEQ ID NO: 479931 - protein, 9 aa, Influenza virus
NSTDKVDTL

SEQ ID NO: 479932 - protein, 9 aa, Influenza virus
NSTDKVNTI

SEQ ID NO: 479933 - protein, 9 aa, Influenza virus
NSTDTVDTI

SEQ ID NO: 479934 - protein, 9 aa, Influenza virus
NSTDTVDTL

SEQ ID NO: 479935 - protein, 9 aa, Influenza virus
NSTDTVDTV

SEQ ID NO: 479936 - protein, 9 aa, Influenza virus
NSTDTVNTL

SEQ ID NO: 479937 - protein, 9 aa, Influenza virus
NSTEHVDTI

SEQ ID NO: 479938 - protein, 9 aa, Influenza virus
NSTEKVDTI

SEQ ID NO: 479939 - protein, 9 aa, Influenza virus
NSTEKVDTL

SEQ ID NO: 479940 - protein, 9 aa, Influenza virus
NSTEQVDTI

SEQ ID NO: 479941 - protein, 9 aa, Influenza virus
NSTERVDTI

SEQ ID NO: 479942 - protein, 9 aa, Influenza virus
NSTETVNTL

SEQ ID NO: 479943 - protein, 9 aa, Influenza virus
NSTKQIDTI

SEQ ID NO: 479944 - protein, 9 aa, Influenza virus
NSTKQVDTI

SEQ ID NO: 479945 - protein, 9 aa, Influenza virus
NSTNTVNTL

SEQ ID NO: 479946 - protein, 9 aa, Influenza virus
NSTTHDRTA

SEQ ID NO: 479947 - protein, 9 aa, Influenza virus
NSTTKVDTI

SEQ ID NO: 479948 - protein, 9 aa, Influenza virus
NSTTQIDTI

SEQ ID NO: 479949 - protein, 9 aa, Influenza virus
NSTTQVDTI

SEQ ID NO: 479950 - protein, 9 aa, Influenza virus
NSTTQVDTL

SEQ ID NO: 479951 - protein, 9 aa, Influenza virus
NSTTQVNTI

SEQ ID NO: 479952 - protein, 9 aa, Influenza virus
NSTVQVDTI

SEQ ID NO: 479953 - protein, 9 aa, Influenza virus
NSTVVNNIT

SEQ ID NO: 479954 - protein, 9 aa, Influenza virus
NSTWVSQTY

SEQ ID NO: 479955 - protein, 9 aa, Influenza virus
NSTYKILSI

SEQ ID NO: 479956 - protein, 9 aa, Influenza virus
NSVIEKINT

SEQ ID NO: 479957 - protein, 9 aa, Influenza virus
NSVIEKMNI

SEQ ID NO: 479958 - protein, 9 aa, Influenza virus
NSVIEKMNT

SEQ ID NO: 479959 - protein, 9 aa, Influenza virus
NSVKLSSGY

SEQ ID NO: 479960 - protein, 9 aa, Influenza virus
NSVRIGSKG

SEQ ID NO: 479961 - protein, 9 aa, Influenza virus
NSVRLSAGG

SEQ ID NO: 479962 - protein, 9 aa, Influenza virus
NSVRLSASG

SEQ ID NO: 479963 - protein, 9 aa, Influenza virus
NSVVEKMNT

SEQ ID NO: 479964 - protein, 9 aa, Influenza virus
NSVVVFCGT

SEQ ID NO: 479965 - protein, 9 aa, Influenza virus
NSVWAGRTI

SEQ ID NO: 479966 - protein, 9 aa, Influenza virus
NSVWAGRTM

SEQ ID NO: 479967 - protein, 9 aa, Influenza virus
NSVWAGRTV

SEQ ID NO: 479968 - protein, 9 aa, Influenza virus
NSWHIFGKD

SEQ ID NO: 479969 - protein, 9 aa, Influenza virus
NSWHIFSKD

SEQ ID NO: 479970 - protein, 9 aa, Influenza virus
NSWHILSKD

SEQ ID NO: 479971 - protein, 9 aa, Influenza virus
NSWHIYGKD

SEQ ID NO: 479972 - protein, 9 aa, Influenza virus
NSWLGRTIS

SEQ ID NO: 479973 - protein, 9 aa, Influenza virus
NSWLGRTTS

SEQ ID NO: 479974 - protein, 9 aa, Influenza virus
NSWSGYSGI

SEQ ID NO: 479975 - protein, 9 aa, Influenza virus
NTALLNASC

SEQ ID NO: 479976 - protein, 9 aa, Influenza virus
NTALSTIAL

SEQ ID NO: 479977 - protein, 9 aa, Influenza virus
NTASRSGYE

SEQ ID NO: 479978 - protein, 9 aa, Influenza virus
NTCMETIRN

SEQ ID NO: 479979 - protein, 9 aa, Influenza virus
NTDLEALME

SEQ ID NO: 479980 - protein, 9 aa, Influenza virus
NTDLEVLME

SEQ ID NO: 479981 - protein, 9 aa, Influenza virus
NTDLGAPLE

SEQ ID NO: 479982 - protein, 9 aa, Influenza virus
NTDLGSPLE

SEQ ID NO: 479983 - protein, 9 aa, Influenza virus
NTDLGTPLE

SEQ ID NO: 479984 - protein, 9 aa, Influenza virus
NTDWSGYSG

SEQ ID NO: 479985 - protein, 9 aa, Influenza virus
NTEFESIES

SEQ ID NO: 479986 - protein, 9 aa, Influenza virus
NTEIGAPQL

SEQ ID NO: 479987 - protein, 9 aa, Influenza virus
NTELLVLME

SEQ ID NO: 479988 - protein, 9 aa, Influenza virus
NTEPLCDVS

SEQ ID NO: 479989 - protein, 9 aa, Influenza virus
NTEPLCEVS

SEQ ID NO: 479990 - protein, 9 aa, Influenza virus
NTEPLCNVS

SEQ ID NO: 479991 - protein, 9 aa, Influenza virus
NTETGALQL

SEQ ID NO: 479992 - protein, 9 aa, Influenza virus
NTETGAPQL

SEQ ID NO: 479993 - protein, 9 aa, Influenza virus
NTETKAPQL

SEQ ID NO: 479994 - protein, 9 aa, Influenza virus
NTFGDCPKY

SEQ ID NO: 479995 - protein, 9 aa, Influenza virus
NTGSYVRLY

SEQ ID NO: 479996 - protein, 9 aa, Influenza virus
NTHIHIFSF

SEQ ID NO: 479997 - protein, 9 aa, Influenza virus
NTIDLTDSE

SEQ ID NO: 479998 - protein, 9 aa, Influenza virus
NTIEIFRSN

SEQ ID NO: 479999 - protein, 9 aa, Influenza virus
NTIEVFKSN

SEQ ID NO: 480000 - protein, 9 aa, Influenza virus
NTIEVFRLN

SEQ ID NO: 480001 - protein, 9 aa, Influenza virus
NTIEVFRSN

SEQ ID NO: 480002 - protein, 9 aa, Influenza virus
NTIGDCPKY

SEQ ID NO: 480003 - protein, 9 aa, Influenza virus
NTIGNCPKY

SEQ ID NO: 480004 - protein, 9 aa, Influenza virus
NTIGNLIAP

SEQ ID NO: 480005 - protein, 9 aa, Influenza virus
NTIGNLVAP

SEQ ID NO: 480006 - protein, 9 aa, Influenza virus
NTIIENNVT

SEQ ID NO: 480007 - protein, 9 aa, Influenza virus
NTIIESNVT

SEQ ID NO: 480008 - protein, 9 aa, Influenza virus
NTILEKNVT

SEQ ID NO: 480009 - protein, 9 aa, Influenza virus
NTILSTKAL

SEQ ID NO: 480010 - protein, 9 aa, Influenza virus
NTINRIFQP

SEQ ID NO: 480011 - protein, 9 aa, Influenza virus
NTINRNFQP

SEQ ID NO: 480012 - protein, 9 aa, Influenza virus
NTINRSFQP

SEQ ID NO: 480013 - protein, 9 aa, Influenza virus
NTINRSFRP

SEQ ID NO: 480014 - protein, 9 aa, Influenza virus
NTINSKIDD

SEQ ID NO: 480015 - protein, 9 aa, Influenza virus
NTKCQTSLG

SEQ ID NO: 480016 - protein, 9 aa, Influenza virus
NTKCQTSMG

SEQ ID NO: 480017 - protein, 9 aa, Influenza virus
NTKCQTSVG

SEQ ID NO: 480018 - protein, 9 aa, Influenza virus
NTKCQTYAG

SEQ ID NO: 480019 - protein, 9 aa, Influenza virus
NTKLPFQNL

SEQ ID NO: 480020 - protein, 9 aa, Influenza virus
NTKWNENQN

SEQ ID NO: 480021 - protein, 9 aa, Influenza virus
NTLAERGVE

SEQ ID NO: 480022 - protein, 9 aa, Influenza virus
NTLIEQNIP

SEQ ID NO: 480023 - protein, 9 aa, Influenza virus
NTLIEQNVP

SEQ ID NO: 480024 - protein, 9 aa, Influenza virus
NTLKLATGM

SEQ ID NO: 480025 - protein, 9 aa, Influenza virus
NTLLENDVP

SEQ ID NO: 480026 - protein, 9 aa, Influenza virus
NTLRTQESE

SEQ ID NO: 480027 - protein, 9 aa, Influenza virus
NTLSEQNVP

SEQ ID NO: 480028 - protein, 9 aa, Influenza virus
NTLSSVNTN

SEQ ID NO: 480029 - protein, 9 aa, Influenza virus
NTLSSVTTN

SEQ ID NO: 480030 - protein, 9 aa, Influenza virus
NTLTEKGIE

SEQ ID NO: 480031 - protein, 9 aa, Influenza virus
NTLTEKGVE

SEQ ID NO: 480032 - protein, 9 aa, Influenza virus
NTLTEQNVP

SEQ ID NO: 480033 - protein, 9 aa, Influenza virus
NTLTEREVE

SEQ ID NO: 480034 - protein, 9 aa, Influenza virus
NTLTERGIE

SEQ ID NO: 480035 - protein, 9 aa, Influenza virus
NTLTERGVE

SEQ ID NO: 480036 - protein, 9 aa, Influenza virus
NTLTSVTTN

SEQ ID NO: 480037 - protein, 9 aa, Influenza virus
NTMHQLLRH

SEQ ID NO: 480038 - protein, 9 aa, Influenza virus
NTMTKDAER

SEQ ID NO: 480039 - protein, 9 aa, Influenza virus
NTNGEQILI

SEQ ID NO: 480040 - protein, 9 aa, Influenza virus
NTNKTFQNI

SEQ ID NO: 480041 - protein, 9 aa, Influenza virus
NTNRTFQNI

SEQ ID NO: 480042 - protein, 9 aa, Influenza virus
NTNTINRSF

SEQ ID NO: 480043 - protein, 9 aa, Influenza virus
NTNTLSSVT

SEQ ID NO: 480044 - protein, 9 aa, Influenza virus
NTPSIDPKG

SEQ ID NO: 480045 - protein, 9 aa, Influenza virus
NTPSIEPKG

SEQ ID NO: 480046 - protein, 9 aa, Influenza virus
NTPSIEPRG

SEQ ID NO: 480047 - protein, 9 aa, Influenza virus
NTPSVEPKG

SEQ ID NO: 480048 - protein, 9 aa, Influenza virus
NTPSVEPRG

SEQ ID NO: 480049 - protein, 9 aa, Influenza virus
NTQFEAIGR

SEQ ID NO: 480050 - protein, 9 aa, Influenza virus
NTQFEAVGK

SEQ ID NO: 480051 - protein, 9 aa, Influenza virus
NTQFEAVGR

SEQ ID NO: 480052 - protein, 9 aa, Influenza virus
NTQFELIDN

SEQ ID NO: 480053 - protein, 9 aa, Influenza virus
NTQFTAVGK

SEQ ID NO: 480054 - protein, 9 aa, Influenza virus
NTQFTSVGK

SEQ ID NO: 480055 - protein, 9 aa, Influenza virus
NTQGEGTAA

SEQ ID NO: 480056 - protein, 9 aa, Influenza virus
NTQIIVILV

SEQ ID NO: 480057 - protein, 9 aa, Influenza virus
NTRCQTSVG

SEQ ID NO: 480058 - protein, 9 aa, Influenza virus
NTRKEPALI

SEQ ID NO: 480059 - protein, 9 aa, Influenza virus
NTRLPFQNL

SEQ ID NO: 480060 - protein, 9 aa, Influenza virus
NTSGEQMLI

SEQ ID NO: 480061 - protein, 9 aa, Influenza virus
NTSGEQMLV

SEQ ID NO: 480062 - protein, 9 aa, Influenza virus
NTSGKQMLI

SEQ ID NO: 480063 - protein, 9 aa, Influenza virus
NTSKHYIGK

SEQ ID NO: 480064 - protein, 9 aa, Influenza virus
NTSKPFQNI

SEQ ID NO: 480065 - protein, 9 aa, Influenza virus
NTSKPFQNT

SEQ ID NO: 480066 - protein, 9 aa, Influenza virus
NTSKPLQNT

SEQ ID NO: 480067 - protein, 9 aa, Influenza virus
NTSQRGILE

SEQ ID NO: 480068 - protein, 9 aa, Influenza virus
NTSQRGVLE

SEQ ID NO: 480069 - protein, 9 aa, Influenza virus
NTSRHYIGK

SEQ ID NO: 480070 - protein, 9 aa, Influenza virus
NTSRHYMGE

SEQ ID NO: 480071 - protein, 9 aa, Influenza virus
NTSYKILSI

SEQ ID NO: 480072 - protein, 9 aa, Influenza virus
NTTGRDVLV

SEQ ID NO: 480073 - protein, 9 aa, Influenza virus
NTTGWSWPD

SEQ ID NO: 480074 - protein, 9 aa, Influenza virus
NTTLIENTY

SEQ ID NO: 480075 - protein, 9 aa, Influenza virus
NTTLPFHNI

SEQ ID NO: 480076 - protein, 9 aa, Influenza virus
NTTLPFHNV

SEQ ID NO: 480077 - protein, 9 aa, Influenza virus
NTTLSTIAL

SEQ ID NO: 480078 - protein, 9 aa, Influenza virus
NTTNYYNET

SEQ ID NO: 480079 - protein, 9 aa, Influenza virus
NTTVVENTY

SEQ ID NO: 480080 - protein, 9 aa, Influenza virus
NTTWVNQTY

SEQ ID NO: 480081 - protein, 9 aa, Influenza virus
NTTYKILSI

SEQ ID NO: 480082 - protein, 9 aa, Influenza virus
NTTYRILSI

SEQ ID NO: 480083 - protein, 9 aa, Influenza virus
NTVINNITT

SEQ ID NO: 480084 - protein, 9 aa, Influenza virus
NTVINNMTT

SEQ ID NO: 480085 - protein, 9 aa, Influenza virus
NTVKDRSPY

SEQ ID NO: 480086 - protein, 9 aa, Influenza virus
NTVNTLIEQ

SEQ ID NO: 480087 - protein, 9 aa, Influenza virus
NTVVNNITT

SEQ ID NO: 480088 - protein, 9 aa, Influenza virus
NTWARNILR

SEQ ID NO: 480089 - protein, 9 aa, Influenza virus
NTWLGGTIS

SEQ ID NO: 480090 - protein, 9 aa, Influenza virus
NTWLGRTIS

SEQ ID NO: 480091 - protein, 9 aa, Influenza virus
NTWLGRTTS

SEQ ID NO: 480092 - protein, 9 aa, Influenza virus
NTWVGRTIS

SEQ ID NO: 480093 - protein, 9 aa, Influenza virus
NTYDHAQYR

SEQ ID NO: 480094 - protein, 9 aa, Influenza virus
NTYDHKKYR

SEQ ID NO: 480095 - protein, 9 aa, Influenza virus
NTYDHRKYK

SEQ ID NO: 480096 - protein, 9 aa, Influenza virus
NTYDHSHYR

SEQ ID NO: 480097 - protein, 9 aa, Influenza virus
NTYDHSKYR

SEQ ID NO: 480098 - protein, 9 aa, Influenza virus
NTYDHSQYR

SEQ ID NO: 480099 - protein, 9 aa, Influenza virus
NTYDHSRYR

SEQ ID NO: 480100 - protein, 9 aa, Influenza virus
NTYDHSTYR

SEQ ID NO: 480101 - protein, 9 aa, Influenza virus
NTYDHTKYR

SEQ ID NO: 480102 - protein, 9 aa, Influenza virus
NTYDHTQYR

SEQ ID NO: 480103 - protein, 9 aa, Influenza virus
NTYINNATI

SEQ ID NO: 480104 - protein, 9 aa, Influenza virus
NTYINNTTI

SEQ ID NO: 480105 - protein, 9 aa, Influenza virus
NTYNHTEYR

SEQ ID NO: 480106 - protein, 9 aa, Influenza virus
NTYNHTQYR

SEQ ID NO: 480107 - protein, 9 aa, Influenza virus
NTYQWIIKN

SEQ ID NO: 480108 - protein, 9 aa, Influenza virus
NTYQWIIRN

SEQ ID NO: 480109 - protein, 9 aa, Influenza virus
NTYQWVIRN

SEQ ID NO: 480110 - protein, 9 aa, Influenza virus
NTYVNNTTI

SEQ ID NO: 480111 - protein, 9 aa, Influenza virus
NTYVNNTTV

SEQ ID NO: 480112 - protein, 9 aa, Influenza virus
NVECVCRDN

SEQ ID NO: 480113 - protein, 9 aa, Influenza virus
NVEGWVVIA

SEQ ID NO: 480114 - protein, 9 aa, Influenza virus
NVELLVLME

SEQ ID NO: 480115 - protein, 9 aa, Influenza virus
NVENLFDEV

SEQ ID NO: 480116 - protein, 9 aa, Influenza virus
NVESNGNLI

SEQ ID NO: 480117 - protein, 9 aa, Influenza virus
NVESNGNLV

SEQ ID NO: 480118 - protein, 9 aa, Influenza virus
NVGLKVSLH

SEQ ID NO: 480119 - protein, 9 aa, Influenza virus
NVGLNMSLH

SEQ ID NO: 480120 - protein, 9 aa, Influenza virus
NVGLNVSLH

SEQ ID NO: 480121 - protein, 9 aa, Influenza virus
NVGYLCAGI

SEQ ID NO: 480122 - protein, 9 aa, Influenza virus
NVHPLAIGE

SEQ ID NO: 480123 - protein, 9 aa, Influenza virus
NVHPLTIGE

SEQ ID NO: 480124 - protein, 9 aa, Influenza virus
NVHRNTIGD

SEQ ID NO: 480125 - protein, 9 aa, Influenza virus
NVHRNTIGN

SEQ ID NO: 480126 - protein, 9 aa, Influenza virus
NVHRSTIGD

SEQ ID NO: 480127 - protein, 9 aa, Influenza virus
NVIDKMNKQ

SEQ ID NO: 480128 - protein, 9 aa, Influenza virus
NVIDKMNNQ

SEQ ID NO: 480129 - protein, 9 aa, Influenza virus
NVIDKMYKQ

SEQ ID NO: 480130 - protein, 9 aa, Influenza virus
NVINDKIDD

SEQ ID NO: 480131 - protein, 9 aa, Influenza virus
NVINWTKDS

SEQ ID NO: 480132 - protein, 9 aa, Influenza virus
NVINWTQDA

SEQ ID NO: 480133 - protein, 9 aa, Influenza virus
NVINWTRDA

SEQ ID NO: 480134 - protein, 9 aa, Influenza virus
NVINWTRDS

SEQ ID NO: 480135 - protein, 9 aa, Influenza virus
NVIVTREPY

SEQ ID NO: 480136 - protein, 9 aa, Influenza virus
NVKELGNGC

SEQ ID NO: 480137 - protein, 9 aa, Influenza virus
NVKNLFDEV

SEQ ID NO: 480138 - protein, 9 aa, Influenza virus
NVKNLHDQI

SEQ ID NO: 480139 - protein, 9 aa, Influenza virus
NVKNLHEQV

SEQ ID NO: 480140 - protein, 9 aa, Influenza virus
NVKNLYDKV

SEQ ID NO: 480141 - protein, 9 aa, Influenza virus
NVKNLYDRV

SEQ ID NO: 480142 - protein, 9 aa, Influenza virus
NVKNLYEKV

SEQ ID NO: 480143 - protein, 9 aa, Influenza virus
NVKNLYNKV

SEQ ID NO: 480144 - protein, 9 aa, Influenza virus
NVKSLKLAS

SEQ ID NO: 480145 - protein, 9 aa, Influenza virus
NVKSLKLAT

SEQ ID NO: 480146 - protein, 9 aa, Influenza virus
NVKSLKLVT

SEQ ID NO: 480147 - protein, 9 aa, Influenza virus
NVLDGVTAS

SEQ ID NO: 480148 - protein, 9 aa, Influenza virus
NVLIGQGDI

SEQ ID NO: 480149 - protein, 9 aa, Influenza virus
NVLIGQGDV

SEQ ID NO: 480150 - protein, 9 aa, Influenza virus
NVLLKHRFE

SEQ ID NO: 480151 - protein, 9 aa, Influenza virus
NVLLSPEEV

SEQ ID NO: 480152 - protein, 9 aa, Influenza virus
NVLRTQESE

SEQ ID NO: 480153 - protein, 9 aa, Influenza virus
NVLSIAPIM

SEQ ID NO: 480154 - protein, 9 aa, Influenza virus
NVLSVAPIM

SEQ ID NO: 480155 - protein, 9 aa, Influenza virus
NVNKITYGA

SEQ ID NO: 480156 - protein, 9 aa, Influenza virus
NVNRITYGA

SEQ ID NO: 480157 - protein, 9 aa, Influenza virus
NVNRITYGP

SEQ ID NO: 480158 - protein, 9 aa, Influenza virus
NVNRITYGV

SEQ ID NO: 480159 - protein, 9 aa, Influenza virus
NVPEKIHTR

SEQ ID NO: 480160 - protein, 9 aa, Influenza virus
NVPEKIRTR

SEQ ID NO: 480161 - protein, 9 aa, Influenza virus
NVPEKIRVK

SEQ ID NO: 480162 - protein, 9 aa, Influenza virus
NVPEKQTRG

SEQ ID NO: 480163 - protein, 9 aa, Influenza virus
NVPERQTRG

SEQ ID NO: 480164 - protein, 9 aa, Influenza virus
NVPETQTRG

SEQ ID NO: 480165 - protein, 9 aa, Influenza virus
NVPEWSYIV

SEQ ID NO: 480166 - protein, 9 aa, Influenza virus
NVPQAQDRG

SEQ ID NO: 480167 - protein, 9 aa, Influenza virus
NVPQAQNRG

SEQ ID NO: 480168 - protein, 9 aa, Influenza virus
NVPQIEARG

SEQ ID NO: 480169 - protein, 9 aa, Influenza virus
NVPQIEPRG

SEQ ID NO: 480170 - protein, 9 aa, Influenza virus
NVPQIESRG

SEQ ID NO: 480171 - protein, 9 aa, Influenza virus
NVPQIQNRG

SEQ ID NO: 480172 - protein, 9 aa, Influenza virus
NVPQMESRG

SEQ ID NO: 480173 - protein, 9 aa, Influenza virus
NVPQVQDRG

SEQ ID NO: 480174 - protein, 9 aa, Influenza virus
NVPQVQNRG

SEQ ID NO: 480175 - protein, 9 aa, Influenza virus
NVPSIQSRG

SEQ ID NO: 480176 - protein, 9 aa, Influenza virus
NVPVTQAME

SEQ ID NO: 480177 - protein, 9 aa, Influenza virus
NVPVTQTME

SEQ ID NO: 480178 - protein, 9 aa, Influenza virus
NVPVTQVEE

SEQ ID NO: 480179 - protein, 9 aa, Influenza virus
NVQNDYTTV

SEQ ID NO: 480180 - protein, 9 aa, Influenza virus
NVQNNYTTI

SEQ ID NO: 480181 - protein, 9 aa, Influenza virus
NVQNNYTTV

SEQ ID NO: 480182 - protein, 9 aa, Influenza virus
NVRCVCRDN

SEQ ID NO: 480183 - protein, 9 aa, Influenza virus
NVRGSGLRI

SEQ ID NO: 480184 - protein, 9 aa, Influenza virus
NVRGSGMRI

SEQ ID NO: 480185 - protein, 9 aa, Influenza virus
NVRGTGMRI

SEQ ID NO: 480186 - protein, 9 aa, Influenza virus
NVRNLHDQI

SEQ ID NO: 480187 - protein, 9 aa, Influenza virus
NVRNLHDQV

SEQ ID NO: 480188 - protein, 9 aa, Influenza virus
NVRNLHDRI

SEQ ID NO: 480189 - protein, 9 aa, Influenza virus
NVRNLHDRT

SEQ ID NO: 480190 - protein, 9 aa, Influenza virus
NVRNLHDRV

SEQ ID NO: 480191 - protein, 9 aa, Influenza virus
NVRNLHEQI

SEQ ID NO: 480192 - protein, 9 aa, Influenza virus
NVRNLHEQV

SEQ ID NO: 480193 - protein, 9 aa, Influenza virus
NVRNLHERI

SEQ ID NO: 480194 - protein, 9 aa, Influenza virus
NVRNLYDKV

SEQ ID NO: 480195 - protein, 9 aa, Influenza virus
NVRSLKLAT

SEQ ID NO: 480196 - protein, 9 aa, Influenza virus
NVSEWSYIV

SEQ ID NO: 480197 - protein, 9 aa, Influenza virus
NVSRIAIGN

SEQ ID NO: 480198 - protein, 9 aa, Influenza virus
NVSSSGTSK

SEQ ID NO: 480199 - protein, 9 aa, Influenza virus
NVSWTSNSI

SEQ ID NO: 480200 - protein, 9 aa, Influenza virus
NVTETLYLN

SEQ ID NO: 480201 - protein, 9 aa, Influenza virus
NVTHTGTSK

SEQ ID NO: 480202 - protein, 9 aa, Influenza virus
NVTHVQNNY

SEQ ID NO: 480203 - protein, 9 aa, Influenza virus
NVTKENTGS

SEQ ID NO: 480204 - protein, 9 aa, Influenza virus
NVTNVQNDY

SEQ ID NO: 480205 - protein, 9 aa, Influenza virus
NVTNVQNNY

SEQ ID NO: 480206 - protein, 9 aa, Influenza virus
NVTRSGTSK

SEQ ID NO: 480207 - protein, 9 aa, Influenza virus
NVTSSGTSK

SEQ ID NO: 480208 - protein, 9 aa, Influenza virus
NVTVTHAKD

SEQ ID NO: 480209 - protein, 9 aa, Influenza virus
NVTVTHAKN

SEQ ID NO: 480210 - protein, 9 aa, Influenza virus
NVTVTHAQD

SEQ ID NO: 480211 - protein, 9 aa, Influenza virus
NVTVTHAQN

SEQ ID NO: 480212 - protein, 9 aa, Influenza virus
NVTVTHARD

SEQ ID NO: 480213 - protein, 9 aa, Influenza virus
NVTVTHSIE

SEQ ID NO: 480214 - protein, 9 aa, Influenza virus
NVTVTHSIN

SEQ ID NO: 480215 - protein, 9 aa, Influenza virus
NVTVTHSVD

SEQ ID NO: 480216 - protein, 9 aa, Influenza virus
NVTVTHSVE

SEQ ID NO: 480217 - protein, 9 aa, Influenza virus
NVTVTHSVN

SEQ ID NO: 480218 - protein, 9 aa, Influenza virus
NVTVTQAQD

SEQ ID NO: 480219 - protein, 9 aa, Influenza virus
NVTVTSSIE

SEQ ID NO: 480220 - protein, 9 aa, Influenza virus
NVTVTSSVE

SEQ ID NO: 480221 - protein, 9 aa, Influenza virus
NVTYTGISK

SEQ ID NO: 480222 - protein, 9 aa, Influenza virus
NVTYTGTSK

SEQ ID NO: 480223 - protein, 9 aa, Influenza virus
NVTYTGTSR

SEQ ID NO: 480224 - protein, 9 aa, Influenza virus
NVVLNVSLH

SEQ ID NO: 480225 - protein, 9 aa, Influenza virus
NVVRKMMTN

SEQ ID NO: 480226 - protein, 9 aa, Influenza virus
NVVRKMMTS

SEQ ID NO: 480227 - protein, 9 aa, Influenza virus
NVWAGRTVS

SEQ ID NO: 480228 - protein, 9 aa, Influenza virus
NVWTYNAEL

SEQ ID NO: 480229 - protein, 9 aa, Influenza virus
NVYKALSIY

SEQ ID NO: 480230 - protein, 9 aa, Influenza virus
NVYKILSIC

SEQ ID NO: 480231 - protein, 9 aa, Influenza virus
NVYKILSIY

SEQ ID NO: 480232 - protein, 9 aa, Influenza virus
NVYKVLAIY

SEQ ID NO: 480233 - protein, 9 aa, Influenza virus
NVYKVLSIY

SEQ ID NO: 480234 - protein, 9 aa, Influenza virus
NVYQAKFEA

SEQ ID NO: 480235 - protein, 9 aa, Influenza virus
NVYQAKFES

SEQ ID NO: 480236 - protein, 9 aa, Influenza virus
NVYQARFEA

SEQ ID NO: 480237 - protein, 9 aa, Influenza virus
NVYQARFES

SEQ ID NO: 480238 - protein, 9 aa, Influenza virus
NVYQSRFEA

SEQ ID NO: 480239 - protein, 9 aa, Influenza virus
NVYRALSIY

SEQ ID NO: 480240 - protein, 9 aa, Influenza virus
NWFGYFGIF

SEQ ID NO: 480241 - protein, 9 aa, Influenza virus
NWHASNRPW

SEQ ID NO: 480242 - protein, 9 aa, Influenza virus
NWHGSNRPW

SEQ ID NO: 480243 - protein, 9 aa, Influenza virus
NWILWISFA

SEQ ID NO: 480244 - protein, 9 aa, Influenza virus
NWKGANRPI

SEQ ID NO: 480245 - protein, 9 aa, Influenza virus
NWKGANRPV

SEQ ID NO: 480246 - protein, 9 aa, Influenza virus
NWKGSNRPI

SEQ ID NO: 480247 - protein, 9 aa, Influenza virus
NWKGSNRPV

SEQ ID NO: 480248 - protein, 9 aa, Influenza virus
NWKGSNRPW

SEQ ID NO: 480249 - protein, 9 aa, Influenza virus
NWKSSNRPV

SEQ ID NO: 480250 - protein, 9 aa, Influenza virus
NWLTIGISG

SEQ ID NO: 480251 - protein, 9 aa, Influenza virus
NWLTKATNG

SEQ ID NO: 480252 - protein, 9 aa, Influenza virus
NWLTKETNG

SEQ ID NO: 480253 - protein, 9 aa, Influenza virus
NWLTKKEPD

SEQ ID NO: 480254 - protein, 9 aa, Influenza virus
NWLTKKKNP

SEQ ID NO: 480255 - protein, 9 aa, Influenza virus
NWLTKKKPD

SEQ ID NO: 480256 - protein, 9 aa, Influenza virus
NWMGSNRPV

SEQ ID NO: 480257 - protein, 9 aa, Influenza virus
NWNGMNRPI

SEQ ID NO: 480258 - protein, 9 aa, Influenza virus
NWNGMNRPV

SEQ ID NO: 480259 - protein, 9 aa, Influenza virus
NWPDGAEIE

SEQ ID NO: 480260 - protein, 9 aa, Influenza virus
NWPDGAKIE

SEQ ID NO: 480261 - protein, 9 aa, Influenza virus
NWPDGANIG

SEQ ID NO: 480262 - protein, 9 aa, Influenza virus
NWPDGSNIG

SEQ ID NO: 480263 - protein, 9 aa, Influenza virus
NWPSSSGGL

SEQ ID NO: 480264 - protein, 9 aa, Influenza virus
NWQGANRPI

SEQ ID NO: 480265 - protein, 9 aa, Influenza virus
NWQGANRPV

SEQ ID NO: 480266 - protein, 9 aa, Influenza virus
NWQGSNRPV

SEQ ID NO: 480267 - protein, 9 aa, Influenza virus
NWRGANRPV

SEQ ID NO: 480268 - protein, 9 aa, Influenza virus
NWRGSNRPI

SEQ ID NO: 480269 - protein, 9 aa, Influenza virus
NWRGSNRPV

SEQ ID NO: 480270 - protein, 9 aa, Influenza virus
NWRGSNRPW

SEQ ID NO: 480271 - protein, 9 aa, Influenza virus
NWRQANNGE

SEQ ID NO: 480272 - protein, 9 aa, Influenza virus
NWSGYSGAF

SEQ ID NO: 480273 - protein, 9 aa, Influenza virus
NWSGYSGIF

SEQ ID NO: 480274 - protein, 9 aa, Influenza virus
NWSGYSGSF

SEQ ID NO: 480275 - protein, 9 aa, Influenza virus
NWSGYSGVF

SEQ ID NO: 480276 - protein, 9 aa, Influenza virus
NWSKPQCQI

SEQ ID NO: 480277 - protein, 9 aa, Influenza virus
NWSWHDGAI

SEQ ID NO: 480278 - protein, 9 aa, Influenza virus
NWSWPDGAE

SEQ ID NO: 480279 - protein, 9 aa, Influenza virus
NWTGTNRPI

SEQ ID NO: 480280 - protein, 9 aa, Influenza virus
NWTGTNRPV

SEQ ID NO: 480281 - protein, 9 aa, Influenza virus
NWTKDSITD

SEQ ID NO: 480282 - protein, 9 aa, Influenza virus
NWTQDAMTE

SEQ ID NO: 480283 - protein, 9 aa, Influenza virus
NWTRDAMTE

SEQ ID NO: 480284 - protein, 9 aa, Influenza virus
NWTRDSIIE

SEQ ID NO: 480285 - protein, 9 aa, Influenza virus
NWTRDSITE

SEQ ID NO: 480286 - protein, 9 aa, Influenza virus
NWTRDSLTE

SEQ ID NO: 480287 - protein, 9 aa, Influenza virus
NWTRDSMTE

SEQ ID NO: 480288 - protein, 9 aa, Influenza virus
NWTRDSVTE

SEQ ID NO: 480289 - protein, 9 aa, Influenza virus
NYARLYIWG

SEQ ID NO: 480290 - protein, 9 aa, Influenza virus
NYDSIRGEF

SEQ ID NO: 480291 - protein, 9 aa, Influenza virus
NYEELKHLL

SEQ ID NO: 480292 - protein, 9 aa, Influenza virus
NYEELREHL

SEQ ID NO: 480293 - protein, 9 aa, Influenza virus
NYEELREQL

SEQ ID NO: 480294 - protein, 9 aa, Influenza virus
NYGPINVTK

SEQ ID NO: 480295 - protein, 9 aa, Influenza virus
NYGVKGFGF

SEQ ID NO: 480296 - protein, 9 aa, Influenza virus
NYHQSFVPS

SEQ ID NO: 480297 - protein, 9 aa, Influenza virus
NYHYEECSC

SEQ ID NO: 480298 - protein, 9 aa, Influenza virus
NYKEICIAW

SEQ ID NO: 480299 - protein, 9 aa, Influenza virus
NYKEICVAW

SEQ ID NO: 480300 - protein, 9 aa, Influenza virus
NYKEIRIAW

SEQ ID NO: 480301 - protein, 9 aa, Influenza virus
NYLIRALTL

SEQ ID NO: 480302 - protein, 9 aa, Influenza virus
NYLLLNKSL

SEQ ID NO: 480303 - protein, 9 aa, Influenza virus
NYLMLNKSL

SEQ ID NO: 480304 - protein, 9 aa, Influenza virus
NYPKYEEES

SEQ ID NO: 480305 - protein, 9 aa, Influenza virus
NYPKYSEES

SEQ ID NO: 480306 - protein, 9 aa, Influenza virus
NYQQSFVPS

SEQ ID NO: 480307 - protein, 9 aa, Influenza virus
NYQSLRSIL

SEQ ID NO: 480308 - protein, 9 aa, Influenza virus
NYREICIAW

SEQ ID NO: 480309 - protein, 9 aa, Influenza virus
NYREVCIAW

SEQ ID NO: 480310 - protein, 9 aa, Influenza virus
NYSKYEEES

SEQ ID NO: 480311 - protein, 9 aa, Influenza virus
NYSLPPNFS

SEQ ID NO: 480312 - protein, 9 aa, Influenza virus
NYVCSGLVG

SEQ ID NO: 480313 - protein, 9 aa, Influenza virus
NYVSMEFSL

SEQ ID NO: 480314 - protein, 9 aa, Influenza virus
NYYNETFVN

SEQ ID NO: 480315 - protein, 9 aa, Influenza virus
NYYYEECSC

SEQ ID NO: 480316 - protein, 9 aa, Influenza virus
PAANNADHR

SEQ ID NO: 480317 - protein, 9 aa, Influenza virus
PAANSADHR

SEQ ID NO: 480318 - protein, 9 aa, Influenza virus
PAANSAHHR

SEQ ID NO: 480319 - protein, 9 aa, Influenza virus
PAAPHGLCY

SEQ ID NO: 480320 - protein, 9 aa, Influenza virus
PAATALANT

SEQ ID NO: 480321 - protein, 9 aa, Influenza virus
PACAYGPAV

SEQ ID NO: 480322 - protein, 9 aa, Influenza virus
PACDLHLTG

SEQ ID NO: 480323 - protein, 9 aa, Influenza virus
PACDLYLTG

SEQ ID NO: 480324 - protein, 9 aa, Influenza virus
PACIYGLVV

SEQ ID NO: 480325 - protein, 9 aa, Influenza virus
PACVYGLAV

SEQ ID NO: 480326 - protein, 9 aa, Influenza virus
PACVYGLVV

SEQ ID NO: 480327 - protein, 9 aa, Influenza virus
PACVYGPAV

SEQ ID NO: 480328 - protein, 9 aa, Influenza virus
PADTRIYYF

SEQ ID NO: 480329 - protein, 9 aa, Influenza virus
PADTRVYYF

SEQ ID NO: 480330 - protein, 9 aa, Influenza virus
PAECRTFFL

SEQ ID NO: 480331 - protein, 9 aa, Influenza virus
PAETRIYYF

SEQ ID NO: 480332 - protein, 9 aa, Influenza virus
PAETRVYYF

SEQ ID NO: 480333 - protein, 9 aa, Influenza virus
PAFSVQRNL

SEQ ID NO: 480334 - protein, 9 aa, Influenza virus
PAHKSQLIW

SEQ ID NO: 480335 - protein, 9 aa, Influenza virus
PAHKSQLVW

SEQ ID NO: 480336 - protein, 9 aa, Influenza virus
PAKLLKERG

SEQ ID NO: 480337 - protein, 9 aa, Influenza virus
PALIIWGIH

SEQ ID NO: 480338 - protein, 9 aa, Influenza virus
PALIIWGVH

SEQ ID NO: 480339 - protein, 9 aa, Influenza virus
PALITWGIH

SEQ ID NO: 480340 - protein, 9 aa, Influenza virus
PALIVWGIH

SEQ ID NO: 480341 - protein, 9 aa, Influenza virus
PALIVWGVH

SEQ ID NO: 480342 - protein, 9 aa, Influenza virus
PALRMKWMM

SEQ ID NO: 480343 - protein, 9 aa, Influenza virus
PALSINELG

SEQ ID NO: 480344 - protein, 9 aa, Influenza virus
PALSINELS

SEQ ID NO: 480345 - protein, 9 aa, Influenza virus
PALSISELS

SEQ ID NO: 480346 - protein, 9 aa, Influenza virus
PANGICYPG

SEQ ID NO: 480347 - protein, 9 aa, Influenza virus
PANKQASYK

SEQ ID NO: 480348 - protein, 9 aa, Influenza virus
PANNQASYK

SEQ ID NO: 480349 - protein, 9 aa, Influenza virus
PANNQASYR

SEQ ID NO: 480350 - protein, 9 aa, Influenza virus
PANSQASYK

SEQ ID NO: 480351 - protein, 9 aa, Influenza virus
PANSQAYTK

SEQ ID NO: 480352 - protein, 9 aa, Influenza virus
PAQNAISIT

SEQ ID NO: 480353 - protein, 9 aa, Influenza virus
PAQNAISTT

SEQ ID NO: 480354 - protein, 9 aa, Influenza virus
PASNQASYK

SEQ ID NO: 480355 - protein, 9 aa, Influenza virus
PASRYLIDM

SEQ ID NO: 480356 - protein, 9 aa, Influenza virus
PASRYLTDM

SEQ ID NO: 480357 - protein, 9 aa, Influenza virus
PASSQAYTK

SEQ ID NO: 480358 - protein, 9 aa, Influenza virus
PATAQMALQ

SEQ ID NO: 480359 - protein, 9 aa, Influenza virus
PATIGECPK

SEQ ID NO: 480360 - protein, 9 aa, Influenza virus
PAYCNTDLG

SEQ ID NO: 480361 - protein, 9 aa, Influenza virus
PCEPIIIEK

SEQ ID NO: 480362 - protein, 9 aa, Influenza virus
PCEPIIIER

SEQ ID NO: 480363 - protein, 9 aa, Influenza virus
PCEPIIVER

SEQ ID NO: 480364 - protein, 9 aa, Influenza virus
PCEPTIIER

SEQ ID NO: 480365 - protein, 9 aa, Influenza virus
PCFWLEMIR

SEQ ID NO: 480366 - protein, 9 aa, Influenza virus
PCFWVELIR

SEQ ID NO: 480367 - protein, 9 aa, Influenza virus
PCFWVELVR

SEQ ID NO: 480368 - protein, 9 aa, Influenza virus
PCFWVEMIR

SEQ ID NO: 480369 - protein, 9 aa, Influenza virus
PCFYIELIR

SEQ ID NO: 480370 - protein, 9 aa, Influenza virus
PCFYVELIR

SEQ ID NO: 480371 - protein, 9 aa, Influenza virus
PCFYVELTR

SEQ ID NO: 480372 - protein, 9 aa, Influenza virus
PCLTDKGSI

SEQ ID NO: 480373 - protein, 9 aa, Influenza virus
PDATAVAVL

SEQ ID NO: 480374 - protein, 9 aa, Influenza virus
PDATAVVVL

SEQ ID NO: 480375 - protein, 9 aa, Influenza virus
PDDGAVAVL

SEQ ID NO: 480376 - protein, 9 aa, Influenza virus
PDECRFYAL

SEQ ID NO: 480377 - protein, 9 aa, Influenza virus
PDGADINFM

SEQ ID NO: 480378 - protein, 9 aa, Influenza virus
PDGADLPFT

SEQ ID NO: 480379 - protein, 9 aa, Influenza virus
PDGAEIEYF

SEQ ID NO: 480380 - protein, 9 aa, Influenza virus
PDGAELPFA

SEQ ID NO: 480381 - protein, 9 aa, Influenza virus
PDGAELPFI

SEQ ID NO: 480382 - protein, 9 aa, Influenza virus
PDGAELPFT

SEQ ID NO: 480383 - protein, 9 aa, Influenza virus
PDGAKIEYF

SEQ ID NO: 480384 - protein, 9 aa, Influenza virus
PDGAKIEYS

SEQ ID NO: 480385 - protein, 9 aa, Influenza virus
PDGAKIKYF

SEQ ID NO: 480386 - protein, 9 aa, Influenza virus
PDGAKIQYF

SEQ ID NO: 480387 - protein, 9 aa, Influenza virus
PDGAKLPFT

SEQ ID NO: 480388 - protein, 9 aa, Influenza virus
PDGALLPFD

SEQ ID NO: 480389 - protein, 9 aa, Influenza virus
PDGALLPLT

SEQ ID NO: 480390 - protein, 9 aa, Influenza virus
PDGANIDFM

SEQ ID NO: 480391 - protein, 9 aa, Influenza virus
PDGANIDFV

SEQ ID NO: 480392 - protein, 9 aa, Influenza virus
PDGANIGFM

SEQ ID NO: 480393 - protein, 9 aa, Influenza virus
PDGANIGLC

SEQ ID NO: 480394 - protein, 9 aa, Influenza virus
PDGANINFM

SEQ ID NO: 480395 - protein, 9 aa, Influenza virus
PDGANINLM

SEQ ID NO: 480396 - protein, 9 aa, Influenza virus
PDGANISFM

SEQ ID NO: 480397 - protein, 9 aa, Influenza virus
PDGAQIKYF

SEQ ID NO: 480398 - protein, 9 aa, Influenza virus
PDGAQIQYF

SEQ ID NO: 480399 - protein, 9 aa, Influenza virus
PDGARIQYF

SEQ ID NO: 480400 - protein, 9 aa, Influenza virus
PDGCRFYAL

SEQ ID NO: 480401 - protein, 9 aa, Influenza virus
PDGPQIQYF

SEQ ID NO: 480402 - protein, 9 aa, Influenza virus
PDGSDIGFM

SEQ ID NO: 480403 - protein, 9 aa, Influenza virus
PDGSNIGFM

SEQ ID NO: 480404 - protein, 9 aa, Influenza virus
PDGSNIGFV

SEQ ID NO: 480405 - protein, 9 aa, Influenza virus
PDHEGEGIP

SEQ ID NO: 480406 - protein, 9 aa, Influenza virus
PDIYDFNEG

SEQ ID NO: 480407 - protein, 9 aa, Influenza virus
PDLYDYKED

SEQ ID NO: 480408 - protein, 9 aa, Influenza virus
PDLYDYKEN

SEQ ID NO: 480409 - protein, 9 aa, Influenza virus
PDLYDYKES

SEQ ID NO: 480410 - protein, 9 aa, Influenza virus
PDLYDYKKN

SEQ ID NO: 480411 - protein, 9 aa, Influenza virus
PDNEAVAVL

SEQ ID NO: 480412 - protein, 9 aa, Influenza virus
PDNGAVAVL

SEQ ID NO: 480413 - protein, 9 aa, Influenza virus
PDNGAVAVV

SEQ ID NO: 480414 - protein, 9 aa, Influenza virus
PDPFRLLQN

SEQ ID NO: 480415 - protein, 9 aa, Influenza virus
PDPGVKGFA

SEQ ID NO: 480416 - protein, 9 aa, Influenza virus
PDRASFFKG

SEQ ID NO: 480417 - protein, 9 aa, Influenza virus
PDRASFFRG

SEQ ID NO: 480418 - protein, 9 aa, Influenza virus
PDRASFLRG

SEQ ID NO: 480419 - protein, 9 aa, Influenza virus
PDRATFLRS

SEQ ID NO: 480420 - protein, 9 aa, Influenza virus
PDSGAVAVL

SEQ ID NO: 480421 - protein, 9 aa, Influenza virus
PDSSWLFGG

SEQ ID NO: 480422 - protein, 9 aa, Influenza virus
PDSTAVAVI

SEQ ID NO: 480423 - protein, 9 aa, Influenza virus
PDSVLVNTY

SEQ ID NO: 480424 - protein, 9 aa, Influenza virus
PDTTAVAVL

SEQ ID NO: 480425 - protein, 9 aa, Influenza virus
PDTYDFNEG

SEQ ID NO: 480426 - protein, 9 aa, Influenza virus
PDVRCICRD

SEQ ID NO: 480427 - protein, 9 aa, Influenza virus
PDVRCTCRD

SEQ ID NO: 480428 - protein, 9 aa, Influenza virus
PDVRCVCRD

SEQ ID NO: 480429 - protein, 9 aa, Influenza virus
PDWFRNVLS

SEQ ID NO: 480430 - protein, 9 aa, Influenza virus
PDYHYEECS

SEQ ID NO: 480431 - protein, 9 aa, Influenza virus
PDYQIGYVC

SEQ ID NO: 480432 - protein, 9 aa, Influenza virus
PDYQSIRSI

SEQ ID NO: 480433 - protein, 9 aa, Influenza virus
PDYQSLRSI

SEQ ID NO: 480434 - protein, 9 aa, Influenza virus
PEAGLKWEL

SEQ ID NO: 480435 - protein, 9 aa, Influenza virus
PEAYNFNEG

SEQ ID NO: 480436 - protein, 9 aa, Influenza virus
PEDLIVFNT

SEQ ID NO: 480437 - protein, 9 aa, Influenza virus
PEEAKYVEW

SEQ ID NO: 480438 - protein, 9 aa, Influenza virus
PEEAKYVWW

SEQ ID NO: 480439 - protein, 9 aa, Influenza virus
PEEGTSIWT

SEQ ID NO: 480440 - protein, 9 aa, Influenza virus
PEERNSIWT

SEQ ID NO: 480441 - protein, 9 aa, Influenza virus
PEERPSIWT

SEQ ID NO: 480442 - protein, 9 aa, Influenza virus
PEERTSIWT

SEQ ID NO: 480443 - protein, 9 aa, Influenza virus
PEEVKYVWW

SEQ ID NO: 480444 - protein, 9 aa, Influenza virus
PEEVSEAQG

SEQ ID NO: 480445 - protein, 9 aa, Influenza virus
PEEVSETQG

SEQ ID NO: 480446 - protein, 9 aa, Influenza virus
PEFGYLLKG

SEQ ID NO: 480447 - protein, 9 aa, Influenza virus
PEFGYLLRG

SEQ ID NO: 480448 - protein, 9 aa, Influenza virus
PEGMCYPGF

SEQ ID NO: 480449 - protein, 9 aa, Influenza virus
PEGMCYPGS

SEQ ID NO: 480450 - protein, 9 aa, Influenza virus
PEKIHTRGL

SEQ ID NO: 480451 - protein, 9 aa, Influenza virus
PEKIRTRGL

SEQ ID NO: 480452 - protein, 9 aa, Influenza virus
PEKIRVKRR

SEQ ID NO: 480453 - protein, 9 aa, Influenza virus
PEKQTRGIF

SEQ ID NO: 480454 - protein, 9 aa, Influenza virus
PEKQTRGLF

SEQ ID NO: 480455 - protein, 9 aa, Influenza virus
PELTGLDCI

SEQ ID NO: 480456 - protein, 9 aa, Influenza virus
PELTGLDCM

SEQ ID NO: 480457 - protein, 9 aa, Influenza virus
PELTGLNCI

SEQ ID NO: 480458 - protein, 9 aa, Influenza virus
PELTGMDCI

SEQ ID NO: 480459 - protein, 9 aa, Influenza virus
PELTGMNCI

SEQ ID NO: 480460 - protein, 9 aa, Influenza virus
PENAYKIVK

SEQ ID NO: 480461 - protein, 9 aa, Influenza virus
PEQSKMQFS

SEQ ID NO: 480462 - protein, 9 aa, Influenza virus
PEQSRMQFS

SEQ ID NO: 480463 - protein, 9 aa, Influenza virus
PERQTRGIF

SEQ ID NO: 480464 - protein, 9 aa, Influenza virus
PERQTRGLF

SEQ ID NO: 480465 - protein, 9 aa, Influenza virus
PESMREEYQ

SEQ ID NO: 480466 - protein, 9 aa, Influenza virus
PESMREEYR

SEQ ID NO: 480467 - protein, 9 aa, Influenza virus
PESVLINTY

SEQ ID NO: 480468 - protein, 9 aa, Influenza virus
PESVLVNTY

SEQ ID NO: 480469 - protein, 9 aa, Influenza virus
PETQTRGIF

SEQ ID NO: 480470 - protein, 9 aa, Influenza virus
PEVCLKWDL

SEQ ID NO: 480471 - protein, 9 aa, Influenza virus
PEVCLKWEL

SEQ ID NO: 480472 - protein, 9 aa, Influenza virus
PEWFRNILS

SEQ ID NO: 480473 - protein, 9 aa, Influenza virus
PEWFRNVLS

SEQ ID NO: 480474 - protein, 9 aa, Influenza virus
PEWSYIIEK

SEQ ID NO: 480475 - protein, 9 aa, Influenza virus
PEWSYIMEK

SEQ ID NO: 480476 - protein, 9 aa, Influenza virus
PEWSYIVEK

SEQ ID NO: 480477 - protein, 9 aa, Influenza virus
PEWSYIVER

SEQ ID NO: 480478 - protein, 9 aa, Influenza virus
PEYAFKIAK

SEQ ID NO: 480479 - protein, 9 aa, Influenza virus
PEYAYIVKK

SEQ ID NO: 480480 - protein, 9 aa, Influenza virus
PEYAYKIAK

SEQ ID NO: 480481 - protein, 9 aa, Influenza virus
PEYAYKIIK

SEQ ID NO: 480482 - protein, 9 aa, Influenza virus
PEYAYKIVK

SEQ ID NO: 480483 - protein, 9 aa, Influenza virus
PEYAYKVVK

SEQ ID NO: 480484 - protein, 9 aa, Influenza virus
PEYAYRIIK

SEQ ID NO: 480485 - protein, 9 aa, Influenza virus
PEYGFKISK

SEQ ID NO: 480486 - protein, 9 aa, Influenza virus
PEYGFKISR

SEQ ID NO: 480487 - protein, 9 aa, Influenza virus
PEYGFRISK

SEQ ID NO: 480488 - protein, 9 aa, Influenza virus
PEYGHLITG

SEQ ID NO: 480489 - protein, 9 aa, Influenza virus
PEYGHLTTG

SEQ ID NO: 480490 - protein, 9 aa, Influenza virus
PEYGHLVTG

SEQ ID NO: 480491 - protein, 9 aa, Influenza virus
PEYGYLITG

SEQ ID NO: 480492 - protein, 9 aa, Influenza virus
PEYQSLRSI

SEQ ID NO: 480493 - protein, 9 aa, Influenza virus
PFAAAPPEQ

SEQ ID NO: 480494 - protein, 9 aa, Influenza virus
PFAAAPPKQ

SEQ ID NO: 480495 - protein, 9 aa, Influenza virus
PFAAAPPVQ

SEQ ID NO: 480496 - protein, 9 aa, Influenza virus
PFAKDNSIR

SEQ ID NO: 480497 - protein, 9 aa, Influenza virus
PFDDRLRRD

SEQ ID NO: 480498 - protein, 9 aa, Influenza virus
PFDFDKISQ

SEQ ID NO: 480499 - protein, 9 aa, Influenza virus
PFDIDKIIT

SEQ ID NO: 480500 - protein, 9 aa, Influenza virus
PFDVPDYQS

SEQ ID NO: 480501 - protein, 9 aa, Influenza virus
PFDVPEYQS

SEQ ID NO: 480502 - protein, 9 aa, Influenza virus
PFDVPGYQS

SEQ ID NO: 480503 - protein, 9 aa, Influenza virus
PFDVPNYQS

SEQ ID NO: 480504 - protein, 9 aa, Influenza virus
PFHKDNAIR

SEQ ID NO: 480505 - protein, 9 aa, Influenza virus
PFHKDNALR

SEQ ID NO: 480506 - protein, 9 aa, Influenza virus
PFHKDNAVR

SEQ ID NO: 480507 - protein, 9 aa, Influenza virus
PFHKGNSAR

SEQ ID NO: 480508 - protein, 9 aa, Influenza virus
PFHLATKQV

SEQ ID NO: 480509 - protein, 9 aa, Influenza virus
PFHLGTKQV

SEQ ID NO: 480510 - protein, 9 aa, Influenza virus
PFHLGTRQV

SEQ ID NO: 480511 - protein, 9 aa, Influenza virus
PFHNIHPLA

SEQ ID NO: 480512 - protein, 9 aa, Influenza virus
PFHNIHPLT

SEQ ID NO: 480513 - protein, 9 aa, Influenza virus
PFHNVHPFT

SEQ ID NO: 480514 - protein, 9 aa, Influenza virus
PFHNVHPLT

SEQ ID NO: 480515 - protein, 9 aa, Influenza virus
PFILKDCSV

SEQ ID NO: 480516 - protein, 9 aa, Influenza virus
PFISCSHFE

SEQ ID NO: 480517 - protein, 9 aa, Influenza virus
PFISCSHLE

SEQ ID NO: 480518 - protein, 9 aa, Influenza virus
PFISCSHME

SEQ ID NO: 480519 - protein, 9 aa, Influenza virus
PFISCSHSE

SEQ ID NO: 480520 - protein, 9 aa, Influenza virus
PFISCSPLE

SEQ ID NO: 480521 - protein, 9 aa, Influenza virus
PFISCSQLE

SEQ ID NO: 480522 - protein, 9 aa, Influenza virus
PFISCSYLE

SEQ ID NO: 480523 - protein, 9 aa, Influenza virus
PFKGFFPFH

SEQ ID NO: 480524 - protein, 9 aa, Influenza virus
PFKLLQNSQ

SEQ ID NO: 480525 - protein, 9 aa, Influenza virus
PFKLLQTSQ

SEQ ID NO: 480526 - protein, 9 aa, Influenza virus
PFLDRIRRD

SEQ ID NO: 480527 - protein, 9 aa, Influenza virus
PFLDRLRRD

SEQ ID NO: 480528 - protein, 9 aa, Influenza virus
PFPVGSGSF

SEQ ID NO: 480529 - protein, 9 aa, Influenza virus
PFQGFFPFH

SEQ ID NO: 480530 - protein, 9 aa, Influenza virus
PFQNASRHH

SEQ ID NO: 480531 - protein, 9 aa, Influenza virus
PFQNASRHY

SEQ ID NO: 480532 - protein, 9 aa, Influenza virus
PFQNASRYY

SEQ ID NO: 480533 - protein, 9 aa, Influenza virus
PFQNICKPY

SEQ ID NO: 480534 - protein, 9 aa, Influenza virus
PFQNIDSRA

SEQ ID NO: 480535 - protein, 9 aa, Influenza virus
PFQNIDSWA

SEQ ID NO: 480536 - protein, 9 aa, Influenza virus
PFQNIHPAT

SEQ ID NO: 480537 - protein, 9 aa, Influenza virus
PFQNIHPIT

SEQ ID NO: 480538 - protein, 9 aa, Influenza virus
PFQNIHPVT

SEQ ID NO: 480539 - protein, 9 aa, Influenza virus
PFQNINPRT

SEQ ID NO: 480540 - protein, 9 aa, Influenza virus
PFQNINSRA

SEQ ID NO: 480541 - protein, 9 aa, Influenza virus
PFQNINSRT

SEQ ID NO: 480542 - protein, 9 aa, Influenza virus
PFQNINSRV

SEQ ID NO: 480543 - protein, 9 aa, Influenza virus
PFQNISRIA

SEQ ID NO: 480544 - protein, 9 aa, Influenza virus
PFQNISRIS

SEQ ID NO: 480545 - protein, 9 aa, Influenza virus
PFQNISRVS

SEQ ID NO: 480546 - protein, 9 aa, Influenza virus
PFQNLSPRT

SEQ ID NO: 480547 - protein, 9 aa, Influenza virus
PFQNTSKHY

SEQ ID NO: 480548 - protein, 9 aa, Influenza virus
PFQNTSRHY

SEQ ID NO: 480549 - protein, 9 aa, Influenza virus
PFQNVHPIT

SEQ ID NO: 480550 - protein, 9 aa, Influenza virus
PFQNVHPVT

SEQ ID NO: 480551 - protein, 9 aa, Influenza virus
PFQNVNKIT

SEQ ID NO: 480552 - protein, 9 aa, Influenza virus
PFQNVNKVT

SEQ ID NO: 480553 - protein, 9 aa, Influenza virus
PFQNVNRIT

SEQ ID NO: 480554 - protein, 9 aa, Influenza virus
PFQNVNSRA

SEQ ID NO: 480555 - protein, 9 aa, Influenza virus
PFQNVSRIA

SEQ ID NO: 480556 - protein, 9 aa, Influenza virus
PFQNVSRTA

SEQ ID NO: 480557 - protein, 9 aa, Influenza virus
PFQSLIPKA

SEQ ID NO: 480558 - protein, 9 aa, Influenza virus
PFQSLVPKA

SEQ ID NO: 480559 - protein, 9 aa, Influenza virus
PFQSLVPRA

SEQ ID NO: 480560 - protein, 9 aa, Influenza virus
PFRALISWE

SEQ ID NO: 480561 - protein, 9 aa, Influenza virus
PFRALISWG

SEQ ID NO: 480562 - protein, 9 aa, Influenza virus
PFRALVSWE

SEQ ID NO: 480563 - protein, 9 aa, Influenza virus
PFRGFFPFH

SEQ ID NO: 480564 - protein, 9 aa, Influenza virus
PFRLLQNSQ

SEQ ID NO: 480565 - protein, 9 aa, Influenza virus
PFRLLQSSQ

SEQ ID NO: 480566 - protein, 9 aa, Influenza virus
PFRTLMSCP

SEQ ID NO: 480567 - protein, 9 aa, Influenza virus
PFRTLMSVE

SEQ ID NO: 480568 - protein, 9 aa, Influenza virus
PFRTLMSVK

SEQ ID NO: 480569 - protein, 9 aa, Influenza virus
PFSKDNGIR

SEQ ID NO: 480570 - protein, 9 aa, Influenza virus
PFSKDNSIQ

SEQ ID NO: 480571 - protein, 9 aa, Influenza virus
PFSKDNSIR

SEQ ID NO: 480572 - protein, 9 aa, Influenza virus
PFSKDNSVR

SEQ ID NO: 480573 - protein, 9 aa, Influenza virus
PFTIGECPK

SEQ ID NO: 480574 - protein, 9 aa, Influenza virus
PFTIGECPR

SEQ ID NO: 480575 - protein, 9 aa, Influenza virus
PFTKDNSIR

SEQ ID NO: 480576 - protein, 9 aa, Influenza virus
PFVACGPAE

SEQ ID NO: 480577 - protein, 9 aa, Influenza virus
PFVACGPSE

SEQ ID NO: 480578 - protein, 9 aa, Influenza virus
PFVACGPTE

SEQ ID NO: 480579 - protein, 9 aa, Influenza virus
PFVACSPSE

SEQ ID NO: 480580 - protein, 9 aa, Influenza virus
PFVRGQQGR

SEQ ID NO: 480581 - protein, 9 aa, Influenza virus
PFVSCGPSE

SEQ ID NO: 480582 - protein, 9 aa, Influenza virus
PFVSCSHLE

SEQ ID NO: 480583 - protein, 9 aa, Influenza virus
PFYLGTKQV

SEQ ID NO: 480584 - protein, 9 aa, Influenza virus
PFYLGTRQV

SEQ ID NO: 480585 - protein, 9 aa, Influenza virus
PGAPGVKGF

SEQ ID NO: 480586 - protein, 9 aa, Influenza virus
PGAPHGLCY

SEQ ID NO: 480587 - protein, 9 aa, Influenza virus
PGARPKVNG

SEQ ID NO: 480588 - protein, 9 aa, Influenza virus
PGARPQVNG

SEQ ID NO: 480589 - protein, 9 aa, Influenza virus
PGARRIDFH

SEQ ID NO: 480590 - protein, 9 aa, Influenza virus
PGARRIDFN

SEQ ID NO: 480591 - protein, 9 aa, Influenza virus
PGATINEEA

SEQ ID NO: 480592 - protein, 9 aa, Influenza virus
PGATVNEEA

SEQ ID NO: 480593 - protein, 9 aa, Influenza virus
PGATVNEGA

SEQ ID NO: 480594 - protein, 9 aa, Influenza virus
PGCDRLQDT

SEQ ID NO: 480595 - protein, 9 aa, Influenza virus
PGDHITFSH

SEQ ID NO: 480596 - protein, 9 aa, Influenza virus
PGDIIVFNT

SEQ ID NO: 480597 - protein, 9 aa, Influenza virus
PGDLILFNT

SEQ ID NO: 480598 - protein, 9 aa, Influenza virus
PGDLIVFNT

SEQ ID NO: 480599 - protein, 9 aa, Influenza virus
PGDNIIFSH

SEQ ID NO: 480600 - protein, 9 aa, Influenza virus
PGDNITFSD

SEQ ID NO: 480601 - protein, 9 aa, Influenza virus
PGDNITFSH

SEQ ID NO: 480602 - protein, 9 aa, Influenza virus
PGDRPKVNG

SEQ ID NO: 480603 - protein, 9 aa, Influenza virus
PGDSIIFNS

SEQ ID NO: 480604 - protein, 9 aa, Influenza virus
PGDSITFSH

SEQ ID NO: 480605 - protein, 9 aa, Influenza virus
PGDTVTFTF

SEQ ID NO: 480606 - protein, 9 aa, Influenza virus
PGELDNNGE

SEQ ID NO: 480607 - protein, 9 aa, Influenza virus
PGELNNNGE

SEQ ID NO: 480608 - protein, 9 aa, Influenza virus
PGERIMFES

SEQ ID NO: 480609 - protein, 9 aa, Influenza virus
PGERITFES

SEQ ID NO: 480610 - protein, 9 aa, Influenza virus
PGERTTFES

SEQ ID NO: 480611 - protein, 9 aa, Influenza virus
PGETLKVES

SEQ ID NO: 480612 - protein, 9 aa, Influenza virus
PGETLNIES

SEQ ID NO: 480613 - protein, 9 aa, Influenza virus
PGETLNVES

SEQ ID NO: 480614 - protein, 9 aa, Influenza virus
PGEVDNNGE

SEQ ID NO: 480615 - protein, 9 aa, Influenza virus
PGFHFEECS

SEQ ID NO: 480616 - protein, 9 aa, Influenza virus
PGFVENLEE

SEQ ID NO: 480617 - protein, 9 aa, Influenza virus
PGIFENSCI

SEQ ID NO: 480618 - protein, 9 aa, Influenza virus
PGIFENSCL

SEQ ID NO: 480619 - protein, 9 aa, Influenza virus
PGIFESSCL

SEQ ID NO: 480620 - protein, 9 aa, Influenza virus
PGIFGNSCL

SEQ ID NO: 480621 - protein, 9 aa, Influenza virus
PGIKGFGFL

SEQ ID NO: 480622 - protein, 9 aa, Influenza virus
PGKFTNEEA

SEQ ID NO: 480623 - protein, 9 aa, Influenza virus
PGKQAKGLF

SEQ ID NO: 480624 - protein, 9 aa, Influenza virus
PGLFENSCL

SEQ ID NO: 480625 - protein, 9 aa, Influenza virus
PGLINGWYG

SEQ ID NO: 480626 - protein, 9 aa, Influenza virus
PGLVAGWYG

SEQ ID NO: 480627 - protein, 9 aa, Influenza virus
PGMMMGMFN

SEQ ID NO: 480628 - protein, 9 aa, Influenza virus
PGMQIRGFV

SEQ ID NO: 480629 - protein, 9 aa, Influenza virus
PGNAEIEDL

SEQ ID NO: 480630 - protein, 9 aa, Influenza virus
PGNFNDYEE

SEQ ID NO: 480631 - protein, 9 aa, Influenza virus
PGNNBNGVK

SEQ ID NO: 480632 - protein, 9 aa, Influenza virus
PGNNNGVKG

SEQ ID NO: 480633 - protein, 9 aa, Influenza virus
PGNNNNGVK

SEQ ID NO: 480634 - protein, 9 aa, Influenza virus
PGQTLRIRS

SEQ ID NO: 480635 - protein, 9 aa, Influenza virus
PGQTLRVKS

SEQ ID NO: 480636 - protein, 9 aa, Influenza virus
PGQTLRVRS

SEQ ID NO: 480637 - protein, 9 aa, Influenza virus
PGQTVKIKT

SEQ ID NO: 480638 - protein, 9 aa, Influenza virus
PGQTVKIQT

SEQ ID NO: 480639 - protein, 9 aa, Influenza virus
PGRFTNEEA

SEQ ID NO: 480640 - protein, 9 aa, Influenza virus
PGRVSVSTK

SEQ ID NO: 480641 - protein, 9 aa, Influenza virus
PGRVTVSTK

SEQ ID NO: 480642 - protein, 9 aa, Influenza virus
PGRVTVSTQ

SEQ ID NO: 480643 - protein, 9 aa, Influenza virus
PGRVTVSTR

SEQ ID NO: 480644 - protein, 9 aa, Influenza virus
PGSFNDYEE

SEQ ID NO: 480645 - protein, 9 aa, Influenza virus
PGSFNNYEE

SEQ ID NO: 480646 - protein, 9 aa, Influenza virus
PGSFPDGAQ

SEQ ID NO: 480647 - protein, 9 aa, Influenza virus
PGSGDWPDG

SEQ ID NO: 480648 - protein, 9 aa, Influenza virus
PGSGNWPDG

SEQ ID NO: 480649 - protein, 9 aa, Influenza virus
PGSIENLEE

SEQ ID NO: 480650 - protein, 9 aa, Influenza virus
PGSIENQEE

SEQ ID NO: 480651 - protein, 9 aa, Influenza virus
PGSIKNQEE

SEQ ID NO: 480652 - protein, 9 aa, Influenza virus
PGSLNDYEE

SEQ ID NO: 480653 - protein, 9 aa, Influenza virus
PGSNNNGVK

SEQ ID NO: 480654 - protein, 9 aa, Influenza virus
PGSTVNEEA

SEQ ID NO: 480655 - protein, 9 aa, Influenza virus
PGSVENLEE

SEQ ID NO: 480656 - protein, 9 aa, Influenza virus
PGSVENQEE

SEQ ID NO: 480657 - protein, 9 aa, Influenza virus
PGTFDIEGL

SEQ ID NO: 480658 - protein, 9 aa, Influenza virus
PGTFDIGGL

SEQ ID NO: 480659 - protein, 9 aa, Influenza virus
PGTFDLEGL

SEQ ID NO: 480660 - protein, 9 aa, Influenza virus
PGTFDLGGL

SEQ ID NO: 480661 - protein, 9 aa, Influenza virus
PGTKGFGFL

SEQ ID NO: 480662 - protein, 9 aa, Influenza virus
PGTRRIDFH

SEQ ID NO: 480663 - protein, 9 aa, Influenza virus
PGTTVNEEA

SEQ ID NO: 480664 - protein, 9 aa, Influenza virus
PGVKGFAFL

SEQ ID NO: 480665 - protein, 9 aa, Influenza virus
PGVKGFGFK

SEQ ID NO: 480666 - protein, 9 aa, Influenza virus
PGVKGFGFL

SEQ ID NO: 480667 - protein, 9 aa, Influenza virus
PGVKGFGFR

SEQ ID NO: 480668 - protein, 9 aa, Influenza virus
PGVKGWAFD

SEQ ID NO: 480669 - protein, 9 aa, Influenza virus
PGVKGWGFD

SEQ ID NO: 480670 - protein, 9 aa, Influenza virus
PGVRCICRD

SEQ ID NO: 480671 - protein, 9 aa, Influenza virus
PGWFRNVLS

SEQ ID NO: 480672 - protein, 9 aa, Influenza virus
PGWLTIGIT

SEQ ID NO: 480673 - protein, 9 aa, Influenza virus
PGWLTLGIT

SEQ ID NO: 480674 - protein, 9 aa, Influenza virus
PGWSWDDGA

SEQ ID NO: 480675 - protein, 9 aa, Influenza virus
PGWSWGDGA

SEQ ID NO: 480676 - protein, 9 aa, Influenza virus
PGYNGQKSW

SEQ ID NO: 480677 - protein, 9 aa, Influenza virus
PGYNGQRSW

SEQ ID NO: 480678 - protein, 9 aa, Influenza virus
PGYQSLRSI

SEQ ID NO: 480679 - protein, 9 aa, Influenza virus
PHGLCYPGE

SEQ ID NO: 480680 - protein, 9 aa, Influenza virus
PHKLCFPGE

SEQ ID NO: 480681 - protein, 9 aa, Influenza virus
PHKLCYPGE

SEQ ID NO: 480682 - protein, 9 aa, Influenza virus
PHLTGTWDT

SEQ ID NO: 480683 - protein, 9 aa, Influenza virus
PHRALMSCP

SEQ ID NO: 480684 - protein, 9 aa, Influenza virus
PHRLCYPGE

SEQ ID NO: 480685 - protein, 9 aa, Influenza virus
PHRSLMSCP

SEQ ID NO: 480686 - protein, 9 aa, Influenza virus
PHRTLLMNE

SEQ ID NO: 480687 - protein, 9 aa, Influenza virus
PHRTLLMSE

SEQ ID NO: 480688 - protein, 9 aa, Influenza virus
PHRTLMSCP

SEQ ID NO: 480689 - protein, 9 aa, Influenza virus
PIAFLTSSI

SEQ ID NO: 480690 - protein, 9 aa, Influenza virus
PIEHIASIR

SEQ ID NO: 480691 - protein, 9 aa, Influenza virus
PIEHIASMR

SEQ ID NO: 480692 - protein, 9 aa, Influenza virus
PIEHVASMR

SEQ ID NO: 480693 - protein, 9 aa, Influenza virus
PIEYIASMR

SEQ ID NO: 480694 - protein, 9 aa, Influenza virus
PIEYVASMR

SEQ ID NO: 480695 - protein, 9 aa, Influenza virus
PIFLYVRTN

SEQ ID NO: 480696 - protein, 9 aa, Influenza virus
PIGCKMYAL

SEQ ID NO: 480697 - protein, 9 aa, Influenza virus
PIGEAPSPY

SEQ ID NO: 480698 - protein, 9 aa, Influenza virus
PIGEVPSPY

SEQ ID NO: 480699 - protein, 9 aa, Influenza virus
PIGISSMVE

SEQ ID NO: 480700 - protein, 9 aa, Influenza virus
PIGSGFFPD

SEQ ID NO: 480701 - protein, 9 aa, Influenza virus
PIGTAPILG

SEQ ID NO: 480702 - protein, 9 aa, Influenza virus
PIGTAPVLG

SEQ ID NO: 480703 - protein, 9 aa, Influenza virus
PIGVAPSPS

SEQ ID NO: 480704 - protein, 9 aa, Influenza virus
PIGVAPVLG

SEQ ID NO: 480705 - protein, 9 aa, Influenza virus
PIGVVPSPS

SEQ ID NO: 480706 - protein, 9 aa, Influenza virus
PIHLGDCSF

SEQ ID NO: 480707 - protein, 9 aa, Influenza virus
PIICLGHHA

SEQ ID NO: 480708 - protein, 9 aa, Influenza virus
PIKGWAPLS

SEQ ID NO: 480709 - protein, 9 aa, Influenza virus
PILGNYKEI

SEQ ID NO: 480710 - protein, 9 aa, Influenza virus
PILNTSQRG

SEQ ID NO: 480711 - protein, 9 aa, Influenza virus
PILSFIMWA

SEQ ID NO: 480712 - protein, 9 aa, Influenza virus
PILSPLTKG

SEQ ID NO: 480713 - protein, 9 aa, Influenza virus
PILYFWGVH

SEQ ID NO: 480714 - protein, 9 aa, Influenza virus
PIMFSNKMA

SEQ ID NO: 480715 - protein, 9 aa, Influenza virus
PINGICYPG

SEQ ID NO: 480716 - protein, 9 aa, Influenza virus
PINNGKGRY

SEQ ID NO: 480717 - protein, 9 aa, Influenza virus
PINVTKENT

SEQ ID NO: 480718 - protein, 9 aa, Influenza virus
PIQNLTKVN

SEQ ID NO: 480719 - protein, 9 aa, Influenza virus
PIRGWAPLS

SEQ ID NO: 480720 - protein, 9 aa, Influenza virus
PISLGDCSF

SEQ ID NO: 480721 - protein, 9 aa, Influenza virus
PISVGSGSF

SEQ ID NO: 480722 - protein, 9 aa, Influenza virus
PITEINTWA

SEQ ID NO: 480723 - protein, 9 aa, Influenza virus
PITGSPCAP

SEQ ID NO: 480724 - protein, 9 aa, Influenza virus
PITGSPEAP

SEQ ID NO: 480725 - protein, 9 aa, Influenza virus
PITGSPGAP

SEQ ID NO: 480726 - protein, 9 aa, Influenza virus
PITGSPGSP

SEQ ID NO: 480727 - protein, 9 aa, Influenza virus
PITGSPGVP

SEQ ID NO: 480728 - protein, 9 aa, Influenza virus
PITGSPSAP

SEQ ID NO: 480729 - protein, 9 aa, Influenza virus
PITIGECPK

SEQ ID NO: 480730 - protein, 9 aa, Influenza virus
PITIGKCPK

SEQ ID NO: 480731 - protein, 9 aa, Influenza virus
PITIGKCSK

SEQ ID NO: 480732 - protein, 9 aa, Influenza virus
PIVPSFDMN

SEQ ID NO: 480733 - protein, 9 aa, Influenza virus
PIVPSFDMS

SEQ ID NO: 480734 - protein, 9 aa, Influenza virus
PIVPSFEMS

SEQ ID NO: 480735 - protein, 9 aa, Influenza virus
PKCDIHLKD

SEQ ID NO: 480736 - protein, 9 aa, Influenza virus
PKCDIHLRD

SEQ ID NO: 480737 - protein, 9 aa, Influenza virus
PKCDLYLNG

SEQ ID NO: 480738 - protein, 9 aa, Influenza virus
PKCDLYLSG

SEQ ID NO: 480739 - protein, 9 aa, Influenza virus
PKCDPYLNG

SEQ ID NO: 480740 - protein, 9 aa, Influenza virus
PKCDTHLKD

SEQ ID NO: 480741 - protein, 9 aa, Influenza virus
PKCDVHLKD

SEQ ID NO: 480742 - protein, 9 aa, Influenza virus
PKEDEVWWT

SEQ ID NO: 480743 - protein, 9 aa, Influenza virus
PKEDKVWWT

SEQ ID NO: 480744 - protein, 9 aa, Influenza virus
PKEDRVWWT

SEQ ID NO: 480745 - protein, 9 aa, Influenza virus
PKEEKVWWT

SEQ ID NO: 480746 - protein, 9 aa, Influenza virus
PKEIEGICY

SEQ ID NO: 480747 - protein, 9 aa, Influenza virus
PKEKAIWTS

SEQ ID NO: 480748 - protein, 9 aa, Influenza virus
PKEKTIWTS

SEQ ID NO: 480749 - protein, 9 aa, Influenza virus
PKEMEGICY

SEQ ID NO: 480750 - protein, 9 aa, Influenza virus
PKEMEGVCY

SEQ ID NO: 480751 - protein, 9 aa, Influenza virus
PKENPAHKS

SEQ ID NO: 480752 - protein, 9 aa, Influenza virus
PKERTIWTS

SEQ ID NO: 480753 - protein, 9 aa, Influenza virus
PKERTSIWT

SEQ ID NO: 480754 - protein, 9 aa, Influenza virus
PKETRVWWT

SEQ ID NO: 480755 - protein, 9 aa, Influenza virus
PKFLPDLYD

SEQ ID NO: 480756 - protein, 9 aa, Influenza virus
PKGLFGAIA

SEQ ID NO: 480757 - protein, 9 aa, Influenza virus
PKGRGLFGA

SEQ ID NO: 480758 - protein, 9 aa, Influenza virus
PKKRGLFGA

SEQ ID NO: 480759 - protein, 9 aa, Influenza virus
PKKTGGPIY

SEQ ID NO: 480760 - protein, 9 aa, Influenza virus
PKLRSGFEM

SEQ ID NO: 480761 - protein, 9 aa, Influenza virus
PKPRGLFGA

SEQ ID NO: 480762 - protein, 9 aa, Influenza virus
PKQSRMQFS

SEQ ID NO: 480763 - protein, 9 aa, Influenza virus
PKRNRSILN

SEQ ID NO: 480764 - protein, 9 aa, Influenza virus
PKSLPDLYD

SEQ ID NO: 480765 - protein, 9 aa, Influenza virus
PKSMREEYR

SEQ ID NO: 480766 - protein, 9 aa, Influenza virus
PKTRGLFGA

SEQ ID NO: 480767 - protein, 9 aa, Influenza virus
PKVNGQAGR

SEQ ID NO: 480768 - protein, 9 aa, Influenza virus
PKWFRNVLS

SEQ ID NO: 480769 - protein, 9 aa, Influenza virus
PKYEEESKL

SEQ ID NO: 480770 - protein, 9 aa, Influenza virus
PKYEEESRL

SEQ ID NO: 480771 - protein, 9 aa, Influenza virus
PKYGYIIEE

SEQ ID NO: 480772 - protein, 9 aa, Influenza virus
PKYIKQGSL

SEQ ID NO: 480773 - protein, 9 aa, Influenza virus
PKYIKSDQL

SEQ ID NO: 480774 - protein, 9 aa, Influenza virus
PKYIKSGQL

SEQ ID NO: 480775 - protein, 9 aa, Influenza virus
PKYIPSGSL

SEQ ID NO: 480776 - protein, 9 aa, Influenza virus
PKYIPSNSL

SEQ ID NO: 480777 - protein, 9 aa, Influenza virus
PKYIPSRSL

SEQ ID NO: 480778 - protein, 9 aa, Influenza virus
PKYISSGSL

SEQ ID NO: 480779 - protein, 9 aa, Influenza virus
PKYLPDLYD

SEQ ID NO: 480780 - protein, 9 aa, Influenza virus
PKYMNVKSL

SEQ ID NO: 480781 - protein, 9 aa, Influenza virus
PKYSEEAKL

SEQ ID NO: 480782 - protein, 9 aa, Influenza virus
PKYSEESKL

SEQ ID NO: 480783 - protein, 9 aa, Influenza virus
PKYSEESRL

SEQ ID NO: 480784 - protein, 9 aa, Influenza virus
PKYSKEAKL

SEQ ID NO: 480785 - protein, 9 aa, Influenza virus
PKYSKESKL

SEQ ID NO: 480786 - protein, 9 aa, Influenza virus
PKYVKQGSL

SEQ ID NO: 480787 - protein, 9 aa, Influenza virus
PKYVKSDRL

SEQ ID NO: 480788 - protein, 9 aa, Influenza virus
PKYVKSEKL

SEQ ID NO: 480789 - protein, 9 aa, Influenza virus
PKYVKSERL

SEQ ID NO: 480790 - protein, 9 aa, Influenza virus
PKYVNIKSL

SEQ ID NO: 480791 - protein, 9 aa, Influenza virus
PKYVNVKSL

SEQ ID NO: 480792 - protein, 9 aa, Influenza virus
PKYVNVRSL

SEQ ID NO: 480793 - protein, 9 aa, Influenza virus
PKYVRSEKL

SEQ ID NO: 480794 - protein, 9 aa, Influenza virus
PLAGSAQHV

SEQ ID NO: 480795 - protein, 9 aa, Influenza virus
PLAIGECPK

SEQ ID NO: 480796 - protein, 9 aa, Influenza virus
PLALGMKNV

SEQ ID NO: 480797 - protein, 9 aa, Influenza virus
PLASLLEMC

SEQ ID NO: 480798 - protein, 9 aa, Influenza virus
PLAVTWWNR

SEQ ID NO: 480799 - protein, 9 aa, Influenza virus
PLCAVNSWH

SEQ ID NO: 480800 - protein, 9 aa, Influenza virus
PLCDVSGFA

SEQ ID NO: 480801 - protein, 9 aa, Influenza virus
PLCEVNSWH

SEQ ID NO: 480802 - protein, 9 aa, Influenza virus
PLCEVSGFA

SEQ ID NO: 480803 - protein, 9 aa, Influenza virus
PLCEVSGFV

SEQ ID NO: 480804 - protein, 9 aa, Influenza virus
PLCEVSSWH

SEQ ID NO: 480805 - protein, 9 aa, Influenza virus
PLCNVSGFA

SEQ ID NO: 480806 - protein, 9 aa, Influenza virus
PLCPFKGFF

SEQ ID NO: 480807 - protein, 9 aa, Influenza virus
PLCPFQGFF

SEQ ID NO: 480808 - protein, 9 aa, Influenza virus
PLCPFRGFF

SEQ ID NO: 480809 - protein, 9 aa, Influenza virus
PLELGDCSI

SEQ ID NO: 480810 - protein, 9 aa, Influenza virus
PLELRDCKI

SEQ ID NO: 480811 - protein, 9 aa, Influenza virus
PLELRDCKV

SEQ ID NO: 480812 - protein, 9 aa, Influenza virus
PLELRDCSI

SEQ ID NO: 480813 - protein, 9 aa, Influenza virus
PLFLYVRTN

SEQ ID NO: 480814 - protein, 9 aa, Influenza virus
PLGAINTTL

SEQ ID NO: 480815 - protein, 9 aa, Influenza virus
PLGALNTTL

SEQ ID NO: 480816 - protein, 9 aa, Influenza virus
PLGCKMYAL

SEQ ID NO: 480817 - protein, 9 aa, Influenza virus
PLGCRMYAL

SEQ ID NO: 480818 - protein, 9 aa, Influenza virus
PLGEAPSPY

SEQ ID NO: 480819 - protein, 9 aa, Influenza virus
PLGSAQATE

SEQ ID NO: 480820 - protein, 9 aa, Influenza virus
PLGSPPIVS

SEQ ID NO: 480821 - protein, 9 aa, Influenza virus
PLGSPPMVS

SEQ ID NO: 480822 - protein, 9 aa, Influenza virus
PLGSPPVVS

SEQ ID NO: 480823 - protein, 9 aa, Influenza virus
PLGSSPNAY

SEQ ID NO: 480824 - protein, 9 aa, Influenza virus
PLGSSSNAY

SEQ ID NO: 480825 - protein, 9 aa, Influenza virus
PLGTPPTVS

SEQ ID NO: 480826 - protein, 9 aa, Influenza virus
PLHNIHPLT

SEQ ID NO: 480827 - protein, 9 aa, Influenza virus
PLIKHENRM

SEQ ID NO: 480828 - protein, 9 aa, Influenza virus
PLILGDCSV

SEQ ID NO: 480829 - protein, 9 aa, Influenza virus
PLILKDCSI

SEQ ID NO: 480830 - protein, 9 aa, Influenza virus
PLILKDCSV

SEQ ID NO: 480831 - protein, 9 aa, Influenza virus
PLILRDCSV

SEQ ID NO: 480832 - protein, 9 aa, Influenza virus
PLIRGQQGR

SEQ ID NO: 480833 - protein, 9 aa, Influenza virus
PLIRHENRM

SEQ ID NO: 480834 - protein, 9 aa, Influenza virus
PLKAEIAQK

SEQ ID NO: 480835 - protein, 9 aa, Influenza virus
PLKAEIAQR

SEQ ID NO: 480836 - protein, 9 aa, Influenza virus
PLKLVDGQD

SEQ ID NO: 480837 - protein, 9 aa, Influenza virus
PLLSLLEMC

SEQ ID NO: 480838 - protein, 9 aa, Influenza virus
PLMVAYMLE

SEQ ID NO: 480839 - protein, 9 aa, Influenza virus
PLPFQNIDS

SEQ ID NO: 480840 - protein, 9 aa, Influenza virus
PLPFQNINP

SEQ ID NO: 480841 - protein, 9 aa, Influenza virus
PLPLCPFKG

SEQ ID NO: 480842 - protein, 9 aa, Influenza virus
PLPLCPFRG

SEQ ID NO: 480843 - protein, 9 aa, Influenza virus
PLQNASRHY

SEQ ID NO: 480844 - protein, 9 aa, Influenza virus
PLQNLTKIN

SEQ ID NO: 480845 - protein, 9 aa, Influenza virus
PLQNLTKTN

SEQ ID NO: 480846 - protein, 9 aa, Influenza virus
PLQNLTKVN

SEQ ID NO: 480847 - protein, 9 aa, Influenza virus
PLQNTSKHY

SEQ ID NO: 480848 - protein, 9 aa, Influenza virus
PLSGSAQHI

SEQ ID NO: 480849 - protein, 9 aa, Influenza virus
PLSGSAQHV

SEQ ID NO: 480850 - protein, 9 aa, Influenza virus
PLSISVGSS

SEQ ID NO: 480851 - protein, 9 aa, Influenza virus
PLSKDNGIR

SEQ ID NO: 480852 - protein, 9 aa, Influenza virus
PLSKDNSIR

SEQ ID NO: 480853 - protein, 9 aa, Influenza virus
PLSSPPTVY

SEQ ID NO: 480854 - protein, 9 aa, Influenza virus
PLTGSAQHI

SEQ ID NO: 480855 - protein, 9 aa, Influenza virus
PLTIGECPK

SEQ ID NO: 480856 - protein, 9 aa, Influenza virus
PLTIGECPR

SEQ ID NO: 480857 - protein, 9 aa, Influenza virus
PLTIGKCPK

SEQ ID NO: 480858 - protein, 9 aa, Influenza virus
PLTKGILGF

SEQ ID NO: 480859 - protein, 9 aa, Influenza virus
PLTKGMLGF

SEQ ID NO: 480860 - protein, 9 aa, Influenza virus
PLTMGECPK

SEQ ID NO: 480861 - protein, 9 aa, Influenza virus
PLTTTPTKS

SEQ ID NO: 480862 - protein, 9 aa, Influenza virus
PLVLDDCSL

SEQ ID NO: 480863 - protein, 9 aa, Influenza virus
PLVLGDCSI

SEQ ID NO: 480864 - protein, 9 aa, Influenza virus
PLVMGQQGR

SEQ ID NO: 480865 - protein, 9 aa, Influenza virus
PLVNGQRGR

SEQ ID NO: 480866 - protein, 9 aa, Influenza virus
PLVPCEPII

SEQ ID NO: 480867 - protein, 9 aa, Influenza virus
PLVREQQGR

SEQ ID NO: 480868 - protein, 9 aa, Influenza virus
PLVRGQQGR

SEQ ID NO: 480869 - protein, 9 aa, Influenza virus
PLVRGQQGT

SEQ ID NO: 480870 - protein, 9 aa, Influenza virus
PLVRGQQGW

SEQ ID NO: 480871 - protein, 9 aa, Influenza virus
PLVRGQSGR

SEQ ID NO: 480872 - protein, 9 aa, Influenza virus
PLVRSQSGR

SEQ ID NO: 480873 - protein, 9 aa, Influenza virus
PMCDDLIGK

SEQ ID NO: 480874 - protein, 9 aa, Influenza virus
PMCDELIGK

SEQ ID NO: 480875 - protein, 9 aa, Influenza virus
PMCDNLIGK

SEQ ID NO: 480876 - protein, 9 aa, Influenza virus
PMCDYLIGK

SEQ ID NO: 480877 - protein, 9 aa, Influenza virus
PMFLYIRTN

SEQ ID NO: 480878 - protein, 9 aa, Influenza virus
PMFLYVRTN

SEQ ID NO: 480879 - protein, 9 aa, Influenza virus
PMGEAPSPY

SEQ ID NO: 480880 - protein, 9 aa, Influenza virus
PMGFRYSGI

SEQ ID NO: 480881 - protein, 9 aa, Influenza virus
PMGSSPNAY

SEQ ID NO: 480882 - protein, 9 aa, Influenza virus
PMGTAPVLG

SEQ ID NO: 480883 - protein, 9 aa, Influenza virus
PMGVAPSPS

SEQ ID NO: 480884 - protein, 9 aa, Influenza virus
PMHQLLRHF

SEQ ID NO: 480885 - protein, 9 aa, Influenza virus
PMIAELAEK

SEQ ID NO: 480886 - protein, 9 aa, Influenza virus
PMIIELAEK

SEQ ID NO: 480887 - protein, 9 aa, Influenza virus
PMISKCKTK

SEQ ID NO: 480888 - protein, 9 aa, Influenza virus
PMISKCRTK

SEQ ID NO: 480889 - protein, 9 aa, Influenza virus
PMISKCRTR

SEQ ID NO: 480890 - protein, 9 aa, Influenza virus
PMISKSRTK

SEQ ID NO: 480891 - protein, 9 aa, Influenza virus
PMIVELAEK

SEQ ID NO: 480892 - protein, 9 aa, Influenza virus
PMMWEINGP

SEQ ID NO: 480893 - protein, 9 aa, Influenza virus
PMRTPIAFL

SEQ ID NO: 480894 - protein, 9 aa, Influenza virus
PMTVELAEK

SEQ ID NO: 480895 - protein, 9 aa, Influenza virus
PMVVELAEK

SEQ ID NO: 480896 - protein, 9 aa, Influenza virus
PNAETDPNS

SEQ ID NO: 480897 - protein, 9 aa, Influenza virus
PNAETDPSS

SEQ ID NO: 480898 - protein, 9 aa, Influenza virus
PNAGIDPNS

SEQ ID NO: 480899 - protein, 9 aa, Influenza virus
PNAGKDPKK

SEQ ID NO: 480900 - protein, 9 aa, Influenza virus
PNAGTDPNS

SEQ ID NO: 480901 - protein, 9 aa, Influenza virus
PNALLKHRF

SEQ ID NO: 480902 - protein, 9 aa, Influenza virus
PNALTDDKS

SEQ ID NO: 480903 - protein, 9 aa, Influenza virus
PNALTDDRS

SEQ ID NO: 480904 - protein, 9 aa, Influenza virus
PNALTDERS

SEQ ID NO: 480905 - protein, 9 aa, Influenza virus
PNALTDNRS

SEQ ID NO: 480906 - protein, 9 aa, Influenza virus
PNAPHKLCF

SEQ ID NO: 480907 - protein, 9 aa, Influenza virus
PNAPHKLCY

SEQ ID NO: 480908 - protein, 9 aa, Influenza virus
PNAPNKFCY

SEQ ID NO: 480909 - protein, 9 aa, Influenza virus
PNAPNKLCF

SEQ ID NO: 480910 - protein, 9 aa, Influenza virus
PNAPNKLCY

SEQ ID NO: 480911 - protein, 9 aa, Influenza virus
PNAYQAKFE

SEQ ID NO: 480912 - protein, 9 aa, Influenza virus
PNAYQAQFE

SEQ ID NO: 480913 - protein, 9 aa, Influenza virus
PNAYQARFE

SEQ ID NO: 480914 - protein, 9 aa, Influenza virus
PNDERGNPG

SEQ ID NO: 480915 - protein, 9 aa, Influenza virus
PNDGKVECV

SEQ ID NO: 480916 - protein, 9 aa, Influenza virus
PNDGQVLYF

SEQ ID NO: 480917 - protein, 9 aa, Influenza virus
PNDKHSNGT

SEQ ID NO: 480918 - protein, 9 aa, Influenza virus
PNDKPFQNV

SEQ ID NO: 480919 - protein, 9 aa, Influenza virus
PNDNASAVV

SEQ ID NO: 480920 - protein, 9 aa, Influenza virus
PNECRFYAL

SEQ ID NO: 480921 - protein, 9 aa, Influenza virus
PNEERGNPG

SEQ ID NO: 480922 - protein, 9 aa, Influenza virus
PNEERGSPG

SEQ ID NO: 480923 - protein, 9 aa, Influenza virus
PNEGKVECI

SEQ ID NO: 480924 - protein, 9 aa, Influenza virus
PNEGKVECV

SEQ ID NO: 480925 - protein, 9 aa, Influenza virus
PNEKPFQNV

SEQ ID NO: 480926 - protein, 9 aa, Influenza virus
PNENPAHKS

SEQ ID NO: 480927 - protein, 9 aa, Influenza virus
PNENPVHKS

SEQ ID NO: 480928 - protein, 9 aa, Influenza virus
PNEVGAKIL

SEQ ID NO: 480929 - protein, 9 aa, Influenza virus
PNEVGARIL

SEQ ID NO: 480930 - protein, 9 aa, Influenza virus
PNFHYEECS

SEQ ID NO: 480931 - protein, 9 aa, Influenza virus
PNFYYEECS

SEQ ID NO: 480932 - protein, 9 aa, Influenza virus
PNGAQIQYF

SEQ ID NO: 480933 - protein, 9 aa, Influenza virus
PNGCIEGKL

SEQ ID NO: 480934 - protein, 9 aa, Influenza virus
PNGCIESKL

SEQ ID NO: 480935 - protein, 9 aa, Influenza virus
PNGKPFQNV

SEQ ID NO: 480936 - protein, 9 aa, Influenza virus
PNGSIPNDK

SEQ ID NO: 480937 - protein, 9 aa, Influenza virus
PNGSIPNEK

SEQ ID NO: 480938 - protein, 9 aa, Influenza virus
PNGSIPNGK

SEQ ID NO: 480939 - protein, 9 aa, Influenza virus
PNGSIPNNK

SEQ ID NO: 480940 - protein, 9 aa, Influenza virus
PNGSISNDK

SEQ ID NO: 480941 - protein, 9 aa, Influenza virus
PNGTIVKTI

SEQ ID NO: 480942 - protein, 9 aa, Influenza virus
PNGTIVKTL

SEQ ID NO: 480943 - protein, 9 aa, Influenza virus
PNGTIVRTI

SEQ ID NO: 480944 - protein, 9 aa, Influenza virus
PNGTKVNTL

SEQ ID NO: 480945 - protein, 9 aa, Influenza virus
PNGTLVKTI

SEQ ID NO: 480946 - protein, 9 aa, Influenza virus
PNGTMVKTI

SEQ ID NO: 480947 - protein, 9 aa, Influenza virus
PNGTVVKTI

SEQ ID NO: 480948 - protein, 9 aa, Influenza virus
PNGYIEGKL

SEQ ID NO: 480949 - protein, 9 aa, Influenza virus
PNHEGEGIP

SEQ ID NO: 480950 - protein, 9 aa, Influenza virus
PNIGPRALV

SEQ ID NO: 480951 - protein, 9 aa, Influenza virus
PNIGPRPFV

SEQ ID NO: 480952 - protein, 9 aa, Influenza virus
PNIGPRPLI

SEQ ID NO: 480953 - protein, 9 aa, Influenza virus
PNIGPRPLV

SEQ ID NO: 480954 - protein, 9 aa, Influenza virus
PNIGSRPRV

SEQ ID NO: 480955 - protein, 9 aa, Influenza virus
PNKFCYPGE

SEQ ID NO: 480956 - protein, 9 aa, Influenza virus
PNKLCFPGE

SEQ ID NO: 480957 - protein, 9 aa, Influenza virus
PNKLCYPGE

SEQ ID NO: 480958 - protein, 9 aa, Influenza virus
PNKWGDILD

SEQ ID NO: 480959 - protein, 9 aa, Influenza virus
PNKWGNVLD

SEQ ID NO: 480960 - protein, 9 aa, Influenza virus
PNLGIVECV

SEQ ID NO: 480961 - protein, 9 aa, Influenza virus
PNLGKVECV

SEQ ID NO: 480962 - protein, 9 aa, Influenza virus
PNLGQVECV

SEQ ID NO: 480963 - protein, 9 aa, Influenza virus
PNLYNIRNL

SEQ ID NO: 480964 - protein, 9 aa, Influenza virus
PNMGKVECV

SEQ ID NO: 480965 - protein, 9 aa, Influenza virus
PNNEKGNPG

SEQ ID NO: 480966 - protein, 9 aa, Influenza virus
PNNEKGNQG

SEQ ID NO: 480967 - protein, 9 aa, Influenza virus
PNNERGNPG

SEQ ID NO: 480968 - protein, 9 aa, Influenza virus
PNNERGNQG

SEQ ID NO: 480969 - protein, 9 aa, Influenza virus
PNNERGTQG

SEQ ID NO: 480970 - protein, 9 aa, Influenza virus
PNNERGYPG

SEQ ID NO: 480971 - protein, 9 aa, Influenza virus
PNNGKVECI

SEQ ID NO: 480972 - protein, 9 aa, Influenza virus
PNNKPFQNV

SEQ ID NO: 480973 - protein, 9 aa, Influenza virus
PNNMARAVK

SEQ ID NO: 480974 - protein, 9 aa, Influenza virus
PNNMDKAVK

SEQ ID NO: 480975 - protein, 9 aa, Influenza virus
PNNMDRAVK

SEQ ID NO: 480976 - protein, 9 aa, Influenza virus
PNNNASAII

SEQ ID NO: 480977 - protein, 9 aa, Influenza virus
PNNNASAIV

SEQ ID NO: 480978 - protein, 9 aa, Influenza virus
PNNNASAVI

SEQ ID NO: 480979 - protein, 9 aa, Influenza virus
PNNNASAVV

SEQ ID NO: 480980 - protein, 9 aa, Influenza virus
PNQKIICIS

SEQ ID NO: 480981 - protein, 9 aa, Influenza virus
PNQKIITIG

SEQ ID NO: 480982 - protein, 9 aa, Influenza virus
PNQKIITMG

SEQ ID NO: 480983 - protein, 9 aa, Influenza virus
PNQKILCAS

SEQ ID NO: 480984 - protein, 9 aa, Influenza virus
PNQKILCTS

SEQ ID NO: 480985 - protein, 9 aa, Influenza virus
PNQKILFAS

SEQ ID NO: 480986 - protein, 9 aa, Influenza virus
PNQKIMCIS

SEQ ID NO: 480987 - protein, 9 aa, Influenza virus
PNQKITCIS

SEQ ID NO: 480988 - protein, 9 aa, Influenza virus
PNQKLFALS

SEQ ID NO: 480989 - protein, 9 aa, Influenza virus
PNQKLFASS

SEQ ID NO: 480990 - protein, 9 aa, Influenza virus
PNQKLFTLS

SEQ ID NO: 480991 - protein, 9 aa, Influenza virus
PNQKTITIG

SEQ ID NO: 480992 - protein, 9 aa, Influenza virus
PNQMIITIG

SEQ ID NO: 480993 - protein, 9 aa, Influenza virus
PNQNLFTLS

SEQ ID NO: 480994 - protein, 9 aa, Influenza virus
PNQRILCTS

SEQ ID NO: 480995 - protein, 9 aa, Influenza virus
PNQSIITIG

SEQ ID NO: 480996 - protein, 9 aa, Influenza virus
PNRASFFRG

SEQ ID NO: 480997 - protein, 9 aa, Influenza virus
PNSGKVECV

SEQ ID NO: 480998 - protein, 9 aa, Influenza virus
PNSHYEECS

SEQ ID NO: 480999 - protein, 9 aa, Influenza virus
PNVLLKHRF

SEQ ID NO: 481000 - protein, 9 aa, Influenza virus
PNVRCVCRD

SEQ ID NO: 481001 - protein, 9 aa, Influenza virus
PNVYQAKFE

SEQ ID NO: 481002 - protein, 9 aa, Influenza virus
PNVYQARFE

SEQ ID NO: 481003 - protein, 9 aa, Influenza virus
PNVYQSRFE

SEQ ID NO: 481004 - protein, 9 aa, Influenza virus
PNWSGYSGS

SEQ ID NO: 481005 - protein, 9 aa, Influenza virus
PNYHYEECS

SEQ ID NO: 481006 - protein, 9 aa, Influenza virus
PNYQSLRSI

SEQ ID NO: 481007 - protein, 9 aa, Influenza virus
PNYYYEECS

SEQ ID NO: 481008 - protein, 9 aa, Influenza virus
PPEQSKMQF

SEQ ID NO: 481009 - protein, 9 aa, Influenza virus
PPEQSRMQF

SEQ ID NO: 481010 - protein, 9 aa, Influenza virus
PPHCDQFLE

SEQ ID NO: 481011 - protein, 9 aa, Influenza virus
PPIVSNSDF

SEQ ID NO: 481012 - protein, 9 aa, Influenza virus
PPIVSNSEF

SEQ ID NO: 481013 - protein, 9 aa, Influenza virus
PPKQSRMQF

SEQ ID NO: 481014 - protein, 9 aa, Influenza virus
PPLELGDCS

SEQ ID NO: 481015 - protein, 9 aa, Influenza virus
PPLELRDCS

SEQ ID NO: 481016 - protein, 9 aa, Influenza virus
PPLGSAQAT

SEQ ID NO: 481017 - protein, 9 aa, Influenza virus
PPLVLGDCS

SEQ ID NO: 481018 - protein, 9 aa, Influenza virus
PPMVSNSDF

SEQ ID NO: 481019 - protein, 9 aa, Influenza virus
PPQCDKFLE

SEQ ID NO: 481020 - protein, 9 aa, Influenza virus
PPQCDLFLE

SEQ ID NO: 481021 - protein, 9 aa, Influenza virus
PPQCDLHLE

SEQ ID NO: 481022 - protein, 9 aa, Influenza virus
PPQCDQFLE

SEQ ID NO: 481023 - protein, 9 aa, Influenza virus
PPQCDRFLE

SEQ ID NO: 481024 - protein, 9 aa, Influenza virus
PPQCDSHLK

SEQ ID NO: 481025 - protein, 9 aa, Influenza virus
PPTVSNSDF

SEQ ID NO: 481026 - protein, 9 aa, Influenza virus
PPVNGQSGR

SEQ ID NO: 481027 - protein, 9 aa, Influenza virus
PPVQSKMQF

SEQ ID NO: 481028 - protein, 9 aa, Influenza virus
PPVQSRMQF

SEQ ID NO: 481029 - protein, 9 aa, Influenza virus
PPVVSNSDF

SEQ ID NO: 481030 - protein, 9 aa, Influenza virus
PPYSHGTGT

SEQ ID NO: 481031 - protein, 9 aa, Influenza virus
PQAQDRGLF

SEQ ID NO: 481032 - protein, 9 aa, Influenza virus
PQAQNRGLF

SEQ ID NO: 481033 - protein, 9 aa, Influenza virus
PQCDKFLEF

SEQ ID NO: 481034 - protein, 9 aa, Influenza virus
PQCDLFLEF

SEQ ID NO: 481035 - protein, 9 aa, Influenza virus
PQCDLHLEF

SEQ ID NO: 481036 - protein, 9 aa, Influenza virus
PQCDQFLEF

SEQ ID NO: 481037 - protein, 9 aa, Influenza virus
PQCDRFLEF

SEQ ID NO: 481038 - protein, 9 aa, Influenza virus
PQCDSHLKF

SEQ ID NO: 481039 - protein, 9 aa, Influenza virus
PQCEITGFA

SEQ ID NO: 481040 - protein, 9 aa, Influenza virus
PQCHITGFA

SEQ ID NO: 481041 - protein, 9 aa, Influenza virus
PQCKITGFA

SEQ ID NO: 481042 - protein, 9 aa, Influenza virus
PQCLITGFA

SEQ ID NO: 481043 - protein, 9 aa, Influenza virus
PQCQIAGFA

SEQ ID NO: 481044 - protein, 9 aa, Influenza virus
PQCQITGFA

SEQ ID NO: 481045 - protein, 9 aa, Influenza virus
PQCQITGFV

SEQ ID NO: 481046 - protein, 9 aa, Influenza virus
PQCQITGSA

SEQ ID NO: 481047 - protein, 9 aa, Influenza virus
PQCQVTGFA

SEQ ID NO: 481048 - protein, 9 aa, Influenza virus
PQEARVWWT

SEQ ID NO: 481049 - protein, 9 aa, Influenza virus
PQEDRVWWT

SEQ ID NO: 481050 - protein, 9 aa, Influenza virus
PQENRVWWT

SEQ ID NO: 481051 - protein, 9 aa, Influenza virus
PQETRVWWT

SEQ ID NO: 481052 - protein, 9 aa, Influenza virus
PQIEARGLF

SEQ ID NO: 481053 - protein, 9 aa, Influenza virus
PQIEPRGLF

SEQ ID NO: 481054 - protein, 9 aa, Influenza virus
PQIESRGLF

SEQ ID NO: 481055 - protein, 9 aa, Influenza virus
PQINGQSGR

SEQ ID NO: 481056 - protein, 9 aa, Influenza virus
PQIQNRGLF

SEQ ID NO: 481057 - protein, 9 aa, Influenza virus
PQLEGFSAE

SEQ ID NO: 481058 - protein, 9 aa, Influenza virus
PQLNPIDGP

SEQ ID NO: 481059 - protein, 9 aa, Influenza virus
PQLNQTYRN

SEQ ID NO: 481060 - protein, 9 aa, Influenza virus
PQMESRGLF

SEQ ID NO: 481061 - protein, 9 aa, Influenza virus
PQMNGQSGR

SEQ ID NO: 481062 - protein, 9 aa, Influenza virus
PQMTKSYKN

SEQ ID NO: 481063 - protein, 9 aa, Influenza virus
PQMTKSYRN

SEQ ID NO: 481064 - protein, 9 aa, Influenza virus
PQMTRSYKN

SEQ ID NO: 481065 - protein, 9 aa, Influenza virus
PQRTLMSCP

SEQ ID NO: 481066 - protein, 9 aa, Influenza virus
PQSGRIVVD

SEQ ID NO: 481067 - protein, 9 aa, Influenza virus
PQSSPPTVY

SEQ ID NO: 481068 - protein, 9 aa, Influenza virus
PQTANTYRN

SEQ ID NO: 481069 - protein, 9 aa, Influenza virus
PQTESRGLF

SEQ ID NO: 481070 - protein, 9 aa, Influenza virus
PQTTKSYKN

SEQ ID NO: 481071 - protein, 9 aa, Influenza virus
PQTTNTYRN

SEQ ID NO: 481072 - protein, 9 aa, Influenza virus
PQVNGQFGR

SEQ ID NO: 481073 - protein, 9 aa, Influenza virus
PQVNGQRGR

SEQ ID NO: 481074 - protein, 9 aa, Influenza virus
PQVNGQSGR

SEQ ID NO: 481075 - protein, 9 aa, Influenza virus
PQVQDRGLF

SEQ ID NO: 481076 - protein, 9 aa, Influenza virus
PQVQNRGLF

SEQ ID NO: 481077 - protein, 9 aa, Influenza virus
PQYPNVRCV

SEQ ID NO: 481078 - protein, 9 aa, Influenza virus
PRALVRGQQ

SEQ ID NO: 481079 - protein, 9 aa, Influenza virus
PRCDDLIGK

SEQ ID NO: 481080 - protein, 9 aa, Influenza virus
PRFLPDLYD

SEQ ID NO: 481081 - protein, 9 aa, Influenza virus
PRGHYKISK

SEQ ID NO: 481082 - protein, 9 aa, Influenza virus
PRGKLSTRG

SEQ ID NO: 481083 - protein, 9 aa, Influenza virus
PRGLFGAIA

SEQ ID NO: 481084 - protein, 9 aa, Influenza virus
PRGLLEVGT

SEQ ID NO: 481085 - protein, 9 aa, Influenza virus
PRGQLATRG

SEQ ID NO: 481086 - protein, 9 aa, Influenza virus
PRGQLSTRG

SEQ ID NO: 481087 - protein, 9 aa, Influenza virus
PRGQLTTRG

SEQ ID NO: 481088 - protein, 9 aa, Influenza virus
PRGRLSTRG

SEQ ID NO: 481089 - protein, 9 aa, Influenza virus
PRIFLAMIT

SEQ ID NO: 481090 - protein, 9 aa, Influenza virus
PRLLQNSQV

SEQ ID NO: 481091 - protein, 9 aa, Influenza virus
PRLRSGFEM

SEQ ID NO: 481092 - protein, 9 aa, Influenza virus
PRMCSLMQG

SEQ ID NO: 481093 - protein, 9 aa, Influenza virus
PRMFLAMIT

SEQ ID NO: 481094 - protein, 9 aa, Influenza virus
PRNDDSSSN

SEQ ID NO: 481095 - protein, 9 aa, Influenza virus
PRNDDSSSS

SEQ ID NO: 481096 - protein, 9 aa, Influenza virus
PRNEDGSSS

SEQ ID NO: 481097 - protein, 9 aa, Influenza virus
PRNEDSSSN

SEQ ID NO: 481098 - protein, 9 aa, Influenza virus
PRNEDSSSS

SEQ ID NO: 481099 - protein, 9 aa, Influenza virus
PRPADGTGS

SEQ ID NO: 481100 - protein, 9 aa, Influenza virus
PRPFVRGQQ

SEQ ID NO: 481101 - protein, 9 aa, Influenza virus
PRPLIRGQQ

SEQ ID NO: 481102 - protein, 9 aa, Influenza virus
PRPLVMGQQ

SEQ ID NO: 481103 - protein, 9 aa, Influenza virus
PRPLVREQQ

SEQ ID NO: 481104 - protein, 9 aa, Influenza virus
PRPLVRGQQ

SEQ ID NO: 481105 - protein, 9 aa, Influenza virus
PRPMDGTGS

SEQ ID NO: 481106 - protein, 9 aa, Influenza virus
PRPMDSTGS

SEQ ID NO: 481107 - protein, 9 aa, Influenza virus
PRPRRGLFG

SEQ ID NO: 481108 - protein, 9 aa, Influenza virus
PRPVDGIGS

SEQ ID NO: 481109 - protein, 9 aa, Influenza virus
PRPVDGTGS

SEQ ID NO: 481110 - protein, 9 aa, Influenza virus
PRRGLFGAI

SEQ ID NO: 481111 - protein, 9 aa, Influenza virus
PRRSGAAGA

SEQ ID NO: 481112 - protein, 9 aa, Influenza virus
PRSRNGFEM

SEQ ID NO: 481113 - protein, 9 aa, Influenza virus
PRSRSGFEM

SEQ ID NO: 481114 - protein, 9 aa, Influenza virus
PRTTNTYRN

SEQ ID NO: 481115 - protein, 9 aa, Influenza virus
PRTVGQCPK

SEQ ID NO: 481116 - protein, 9 aa, Influenza virus
PRVFLAMIT

SEQ ID NO: 481117 - protein, 9 aa, Influenza virus
PRVFLTMIT

SEQ ID NO: 481118 - protein, 9 aa, Influenza virus
PRVRNQSGR

SEQ ID NO: 481119 - protein, 9 aa, Influenza virus
PRYAFEIVS

SEQ ID NO: 481120 - protein, 9 aa, Influenza virus
PRYAFELVF

SEQ ID NO: 481121 - protein, 9 aa, Influenza virus
PRYAFELVS

SEQ ID NO: 481122 - protein, 9 aa, Influenza virus
PRYALELVS

SEQ ID NO: 481123 - protein, 9 aa, Influenza virus
PRYGYIIEE

SEQ ID NO: 481124 - protein, 9 aa, Influenza virus
PRYGYIIEK

SEQ ID NO: 481125 - protein, 9 aa, Influenza virus
PRYIPSGSL

SEQ ID NO: 481126 - protein, 9 aa, Influenza virus
PRYLPDLYD

SEQ ID NO: 481127 - protein, 9 aa, Influenza virus
PRYNGQRSW

SEQ ID NO: 481128 - protein, 9 aa, Influenza virus
PRYPDVRCV

SEQ ID NO: 481129 - protein, 9 aa, Influenza virus
PRYPNVRCV

SEQ ID NO: 481130 - protein, 9 aa, Influenza virus
PRYSFELVS

SEQ ID NO: 481131 - protein, 9 aa, Influenza virus
PRYVKQGSL

SEQ ID NO: 481132 - protein, 9 aa, Influenza virus
PRYVKQSSL

SEQ ID NO: 481133 - protein, 9 aa, Influenza virus
PRYVKSEKL

SEQ ID NO: 481134 - protein, 9 aa, Influenza virus
PSAGKDPKK

SEQ ID NO: 481135 - protein, 9 aa, Influenza virus
PSAGRDPKK

SEQ ID NO: 481136 - protein, 9 aa, Influenza virus
PSAIDQITG

SEQ ID NO: 481137 - protein, 9 aa, Influenza virus
PSAPEGMCY

SEQ ID NO: 481138 - protein, 9 aa, Influenza virus
PSAPGVKGF

SEQ ID NO: 481139 - protein, 9 aa, Influenza virus
PSAPHGLCY

SEQ ID NO: 481140 - protein, 9 aa, Influenza virus
PSAPHRLCY

SEQ ID NO: 481141 - protein, 9 aa, Influenza virus
PSCASNINI

SEQ ID NO: 481142 - protein, 9 aa, Influenza virus
PSCATNINI

SEQ ID NO: 481143 - protein, 9 aa, Influenza virus
PSCDLHLTG

SEQ ID NO: 481144 - protein, 9 aa, Influenza virus
PSDAQAFYK

SEQ ID NO: 481145 - protein, 9 aa, Influenza virus
PSDTPRGED

SEQ ID NO: 481146 - protein, 9 aa, Influenza virus
PSECRTFFL

SEQ ID NO: 481147 - protein, 9 aa, Influenza virus
PSERGLQRR

SEQ ID NO: 481148 - protein, 9 aa, Influenza virus
PSFDMNNEG

SEQ ID NO: 481149 - protein, 9 aa, Influenza virus
PSFDMSKEG

SEQ ID NO: 481150 - protein, 9 aa, Influenza virus
PSFDMSNDG

SEQ ID NO: 481151 - protein, 9 aa, Influenza virus
PSFDMSNEG

SEQ ID NO: 481152 - protein, 9 aa, Influenza virus
PSFEMSNEG

SEQ ID NO: 481153 - protein, 9 aa, Influenza virus
PSFFRNMIW

SEQ ID NO: 481154 - protein, 9 aa, Influenza virus
PSFFRNMVW

SEQ ID NO: 481155 - protein, 9 aa, Influenza virus
PSFFRNVVW

SEQ ID NO: 481156 - protein, 9 aa, Influenza virus
PSFGVSGIN

SEQ ID NO: 481157 - protein, 9 aa, Influenza virus
PSFGVSGVN

SEQ ID NO: 481158 - protein, 9 aa, Influenza virus
PSFYAEMKW

SEQ ID NO: 481159 - protein, 9 aa, Influenza virus
PSFYRNLLW

SEQ ID NO: 481160 - protein, 9 aa, Influenza virus
PSGCKMYAL

SEQ ID NO: 481161 - protein, 9 aa, Influenza virus
PSGIEYNGK

SEQ ID NO: 481162 - protein, 9 aa, Influenza virus
PSGPLKAEI

SEQ ID NO: 481163 - protein, 9 aa, Influenza virus
PSGSLKLAI

SEQ ID NO: 481164 - protein, 9 aa, Influenza virus
PSGVEYNGK

SEQ ID NO: 481165 - protein, 9 aa, Influenza virus
PSGYAQTDC

SEQ ID NO: 481166 - protein, 9 aa, Influenza virus
PSHEGEGIP

SEQ ID NO: 481167 - protein, 9 aa, Influenza virus
PSIDPKGLF

SEQ ID NO: 481168 - protein, 9 aa, Influenza virus
PSIEPKGLF

SEQ ID NO: 481169 - protein, 9 aa, Influenza virus
PSIEPRGLF

SEQ ID NO: 481170 - protein, 9 aa, Influenza virus
PSIMSCDSP

SEQ ID NO: 481171 - protein, 9 aa, Influenza virus
PSIQSRGLF

SEQ ID NO: 481172 - protein, 9 aa, Influenza virus
PSKWGDILE

SEQ ID NO: 481173 - protein, 9 aa, Influenza virus
PSKWGDVLD

SEQ ID NO: 481174 - protein, 9 aa, Influenza virus
PSKWGNVLD

SEQ ID NO: 481175 - protein, 9 aa, Influenza virus
PSLRMKWMM

SEQ ID NO: 481176 - protein, 9 aa, Influenza virus
PSNAQAFYK

SEQ ID NO: 481177 - protein, 9 aa, Influenza virus
PSNMDRAVK

SEQ ID NO: 481178 - protein, 9 aa, Influenza virus
PSNSLKLAI

SEQ ID NO: 481179 - protein, 9 aa, Influenza virus
PSNSRFESV

SEQ ID NO: 481180 - protein, 9 aa, Influenza virus
PSPGARPKV

SEQ ID NO: 481181 - protein, 9 aa, Influenza virus
PSPGDRPKV

SEQ ID NO: 481182 - protein, 9 aa, Influenza virus
PSPLKLVDG

SEQ ID NO: 481183 - protein, 9 aa, Influenza virus
PSPSNSRFE

SEQ ID NO: 481184 - protein, 9 aa, Influenza virus
PSPYNSKFE

SEQ ID NO: 481185 - protein, 9 aa, Influenza virus
PSPYNSRFE

SEQ ID NO: 481186 - protein, 9 aa, Influenza virus
PSQKLFALS

SEQ ID NO: 481187 - protein, 9 aa, Influenza virus
PSRSLKLAI

SEQ ID NO: 481188 - protein, 9 aa, Influenza virus
PSRVSKLIG

SEQ ID NO: 481189 - protein, 9 aa, Influenza virus
PSRVSKLKG

SEQ ID NO: 481190 - protein, 9 aa, Influenza virus
PSRVSKLRG

SEQ ID NO: 481191 - protein, 9 aa, Influenza virus
PSRVSKLTG

SEQ ID NO: 481192 - protein, 9 aa, Influenza virus
PSRVTKLKG

SEQ ID NO: 481193 - protein, 9 aa, Influenza virus
PSSAQEKND

SEQ ID NO: 481194 - protein, 9 aa, Influenza virus
PSSDNEQTD

SEQ ID NO: 481195 - protein, 9 aa, Influenza virus
PSSSYRRPI

SEQ ID NO: 481196 - protein, 9 aa, Influenza virus
PSSSYRRPV

SEQ ID NO: 481197 - protein, 9 aa, Influenza virus
PSSTKEKND

SEQ ID NO: 481198 - protein, 9 aa, Influenza virus
PSSTKEKNE

SEQ ID NO: 481199 - protein, 9 aa, Influenza virus
PSSTQEKNA

SEQ ID NO: 481200 - protein, 9 aa, Influenza virus
PSSTQEKND

SEQ ID NO: 481201 - protein, 9 aa, Influenza virus
PSTGKDPKK

SEQ ID NO: 481202 - protein, 9 aa, Influenza virus
PSTGNHGSL

SEQ ID NO: 481203 - protein, 9 aa, Influenza virus
PSTISCDSP

SEQ ID NO: 481204 - protein, 9 aa, Influenza virus
PSTMSCDSP

SEQ ID NO: 481205 - protein, 9 aa, Influenza virus
PSTVSCDSP

SEQ ID NO: 481206 - protein, 9 aa, Influenza virus
PSVEPKGLF

SEQ ID NO: 481207 - protein, 9 aa, Influenza virus
PSVEPRGLF

SEQ ID NO: 481208 - protein, 9 aa, Influenza virus
PSVKLPMGA

SEQ ID NO: 481209 - protein, 9 aa, Influenza virus
PSVQSRGLF

SEQ ID NO: 481210 - protein, 9 aa, Influenza virus
PSVVSCDSP

SEQ ID NO: 481211 - protein, 9 aa, Influenza virus
PSWAGNILR

SEQ ID NO: 481212 - protein, 9 aa, Influenza virus
PSWAGNVLR

SEQ ID NO: 481213 - protein, 9 aa, Influenza virus
PSWEGNILR

SEQ ID NO: 481214 - protein, 9 aa, Influenza virus
PTAPHGLCY

SEQ ID NO: 481215 - protein, 9 aa, Influenza virus
PTAVDTCYP

SEQ ID NO: 481216 - protein, 9 aa, Influenza virus
PTDTPRGED

SEQ ID NO: 481217 - protein, 9 aa, Influenza virus
PTDTPRIQD

SEQ ID NO: 481218 - protein, 9 aa, Influenza virus
PTDTPRVQD

SEQ ID NO: 481219 - protein, 9 aa, Influenza virus
PTDVIRSWR

SEQ ID NO: 481220 - protein, 9 aa, Influenza virus
PTDVVRSWK

SEQ ID NO: 481221 - protein, 9 aa, Influenza virus
PTDVVRSWR

SEQ ID NO: 481222 - protein, 9 aa, Influenza virus
PTECRTFFL

SEQ ID NO: 481223 - protein, 9 aa, Influenza virus
PTEEQAVDI

SEQ ID NO: 481224 - protein, 9 aa, Influenza virus
PTEEQAVGI

SEQ ID NO: 481225 - protein, 9 aa, Influenza virus
PTEEQAVNI

SEQ ID NO: 481226 - protein, 9 aa, Influenza virus
PTFDSLNIT

SEQ ID NO: 481227 - protein, 9 aa, Influenza virus
PTFSVQRNL

SEQ ID NO: 481228 - protein, 9 aa, Influenza virus
PTFSVQRSL

SEQ ID NO: 481229 - protein, 9 aa, Influenza virus
PTGCKMYAL

SEQ ID NO: 481230 - protein, 9 aa, Influenza virus
PTGYAQTDC

SEQ ID NO: 481231 - protein, 9 aa, Influenza virus
PTKSYFANL

SEQ ID NO: 481232 - protein, 9 aa, Influenza virus
PTLLFLEVP

SEQ ID NO: 481233 - protein, 9 aa, Influenza virus
PTLLFLKIP

SEQ ID NO: 481234 - protein, 9 aa, Influenza virus
PTLLFLKMP

SEQ ID NO: 481235 - protein, 9 aa, Influenza virus
PTLLFLKVP

SEQ ID NO: 481236 - protein, 9 aa, Influenza virus
PTNGICYPG

SEQ ID NO: 481237 - protein, 9 aa, Influenza virus
PTTEINTWA

SEQ ID NO: 481238 - protein, 9 aa, Influenza virus
PVAEINTWA

SEQ ID NO: 481239 - protein, 9 aa, Influenza virus
PVAKAGFIE

SEQ ID NO: 481240 - protein, 9 aa, Influenza virus
PVCDPHLTG

SEQ ID NO: 481241 - protein, 9 aa, Influenza virus
PVELSSGYK

SEQ ID NO: 481242 - protein, 9 aa, Influenza virus
PVGEAPSPY

SEQ ID NO: 481243 - protein, 9 aa, Influenza virus
PVGEVPSPY

SEQ ID NO: 481244 - protein, 9 aa, Influenza virus
PVGGNEKKA

SEQ ID NO: 481245 - protein, 9 aa, Influenza virus
PVGISSMGE

SEQ ID NO: 481246 - protein, 9 aa, Influenza virus
PVGISSMME

SEQ ID NO: 481247 - protein, 9 aa, Influenza virus
PVGISSMVE

SEQ ID NO: 481248 - protein, 9 aa, Influenza virus
PVGPGSFPD

SEQ ID NO: 481249 - protein, 9 aa, Influenza virus
PVGSGSFPD

SEQ ID NO: 481250 - protein, 9 aa, Influenza virus
PVGTAPVLG

SEQ ID NO: 481251 - protein, 9 aa, Influenza virus
PVGVAPSPS

SEQ ID NO: 481252 - protein, 9 aa, Influenza virus
PVGVAPSPY

SEQ ID NO: 481253 - protein, 9 aa, Influenza virus
PVHFQNQVK

SEQ ID NO: 481254 - protein, 9 aa, Influenza virus
PVHFRNQIK

SEQ ID NO: 481255 - protein, 9 aa, Influenza virus
PVHFRNQVK

SEQ ID NO: 481256 - protein, 9 aa, Influenza virus
PVHFRSQVK

SEQ ID NO: 481257 - protein, 9 aa, Influenza virus
PVHKSQLIW

SEQ ID NO: 481258 - protein, 9 aa, Influenza virus
PVHLGDCNF

SEQ ID NO: 481259 - protein, 9 aa, Influenza virus
PVHLGDCRF

SEQ ID NO: 481260 - protein, 9 aa, Influenza virus
PVHLGDCSF

SEQ ID NO: 481261 - protein, 9 aa, Influenza virus
PVICLGHHA

SEQ ID NO: 481262 - protein, 9 aa, Influenza virus
PVICLGHHS

SEQ ID NO: 481263 - protein, 9 aa, Influenza virus
PVICMGHHA

SEQ ID NO: 481264 - protein, 9 aa, Influenza virus
PVIGARPQV

SEQ ID NO: 481265 - protein, 9 aa, Influenza virus
PVKGWAPLS

SEQ ID NO: 481266 - protein, 9 aa, Influenza virus
PVKLNSGYK

SEQ ID NO: 481267 - protein, 9 aa, Influenza virus
PVKLSGGYK

SEQ ID NO: 481268 - protein, 9 aa, Influenza virus
PVKLSNGYK

SEQ ID NO: 481269 - protein, 9 aa, Influenza virus
PVKLSSGYK

SEQ ID NO: 481270 - protein, 9 aa, Influenza virus
PVKLSSSYK

SEQ ID NO: 481271 - protein, 9 aa, Influenza virus
PVLGNYKEI

SEQ ID NO: 481272 - protein, 9 aa, Influenza virus
PVLGNYREI

SEQ ID NO: 481273 - protein, 9 aa, Influenza virus
PVLGNYREV

SEQ ID NO: 481274 - protein, 9 aa, Influenza virus
PVLKPGQTL

SEQ ID NO: 481275 - protein, 9 aa, Influenza virus
PVLTDNPRP

SEQ ID NO: 481276 - protein, 9 aa, Influenza virus
PVLYFWGVH

SEQ ID NO: 481277 - protein, 9 aa, Influenza virus
PVMGARPQV

SEQ ID NO: 481278 - protein, 9 aa, Influenza virus
PVNGICYPG

SEQ ID NO: 481279 - protein, 9 aa, Influenza virus
PVNGQSGRI

SEQ ID NO: 481280 - protein, 9 aa, Influenza virus
PVNNGKGRY

SEQ ID NO: 481281 - protein, 9 aa, Influenza virus
PVPVGSGSF

SEQ ID NO: 481282 - protein, 9 aa, Influenza virus
PVQNAISTT

SEQ ID NO: 481283 - protein, 9 aa, Influenza virus
PVQSKMQFS

SEQ ID NO: 481284 - protein, 9 aa, Influenza virus
PVQSRMQFS

SEQ ID NO: 481285 - protein, 9 aa, Influenza virus
PVQTDEYKN

SEQ ID NO: 481286 - protein, 9 aa, Influenza virus
PVSVGSGSF

SEQ ID NO: 481287 - protein, 9 aa, Influenza virus
PVTEINTWA

SEQ ID NO: 481288 - protein, 9 aa, Influenza virus
PVTIGECPK

SEQ ID NO: 481289 - protein, 9 aa, Influenza virus
PVTIGKCPK

SEQ ID NO: 481290 - protein, 9 aa, Influenza virus
PVTLSSGYK

SEQ ID NO: 481291 - protein, 9 aa, Influenza virus
PVTLTMGYK

SEQ ID NO: 481292 - protein, 9 aa, Influenza virus
PVTQAMELV

SEQ ID NO: 481293 - protein, 9 aa, Influenza virus
PVTQTMELV

SEQ ID NO: 481294 - protein, 9 aa, Influenza virus
PVTQVEELV

SEQ ID NO: 481295 - protein, 9 aa, Influenza virus
PVTSSIDLI

SEQ ID NO: 481296 - protein, 9 aa, Influenza virus
PVTSSIDLV

SEQ ID NO: 481297 - protein, 9 aa, Influenza virus
PVTSSVDLI

SEQ ID NO: 481298 - protein, 9 aa, Influenza virus
PVTSSVDLV

SEQ ID NO: 481299 - protein, 9 aa, Influenza virus
PVTSTIDLI

SEQ ID NO: 481300 - protein, 9 aa, Influenza virus
PVVFTDGSA

SEQ ID NO: 481301 - protein, 9 aa, Influenza virus
PVVGARPKV

SEQ ID NO: 481302 - protein, 9 aa, Influenza virus
PVVGARPQV

SEQ ID NO: 481303 - protein, 9 aa, Influenza virus
PVVMTDGPA

SEQ ID NO: 481304 - protein, 9 aa, Influenza virus
PVVPSFDMS

SEQ ID NO: 481305 - protein, 9 aa, Influenza virus
PVVRARPQV

SEQ ID NO: 481306 - protein, 9 aa, Influenza virus
PWARNILRT

SEQ ID NO: 481307 - protein, 9 aa, Influenza virus
PWIRFNSDL

SEQ ID NO: 481308 - protein, 9 aa, Influenza virus
PWIRFNSDP

SEQ ID NO: 481309 - protein, 9 aa, Influenza virus
PWIRFNSNL

SEQ ID NO: 481310 - protein, 9 aa, Influenza virus
PWIRINNET

SEQ ID NO: 481311 - protein, 9 aa, Influenza virus
PWISFDQNL

SEQ ID NO: 481312 - protein, 9 aa, Influenza virus
PWMRINNET

SEQ ID NO: 481313 - protein, 9 aa, Influenza virus
PWMRISNET

SEQ ID NO: 481314 - protein, 9 aa, Influenza virus
PWVLLNASW

SEQ ID NO: 481315 - protein, 9 aa, Influenza virus
PWVRGQSGR

SEQ ID NO: 481316 - protein, 9 aa, Influenza virus
PWVRINNET

SEQ ID NO: 481317 - protein, 9 aa, Influenza virus
PWVRMNNET

SEQ ID NO: 481318 - protein, 9 aa, Influenza virus
PWVSFDQNL

SEQ ID NO: 481319 - protein, 9 aa, Influenza virus
PWVSFNHNL

SEQ ID NO: 481320 - protein, 9 aa, Influenza virus
PWVSFNQDL

SEQ ID NO: 481321 - protein, 9 aa, Influenza virus
PWVSFNQNL

SEQ ID NO: 481322 - protein, 9 aa, Influenza virus
PYIGKCPKY

SEQ ID NO: 481323 - protein, 9 aa, Influenza virus
PYLNGREWS

SEQ ID NO: 481324 - protein, 9 aa, Influenza virus
PYNSKFESV

SEQ ID NO: 481325 - protein, 9 aa, Influenza virus
PYNSRFESV

SEQ ID NO: 481326 - protein, 9 aa, Influenza virus
PYPGNNBNG

SEQ ID NO: 481327 - protein, 9 aa, Influenza virus
PYPGNNNKG

SEQ ID NO: 481328 - protein, 9 aa, Influenza virus
PYPGNNNNG

SEQ ID NO: 481329 - protein, 9 aa, Influenza virus
PYPGNSNNG

SEQ ID NO: 481330 - protein, 9 aa, Influenza virus
PYRALISWE

SEQ ID NO: 481331 - protein, 9 aa, Influenza virus
PYRALMSCP

SEQ ID NO: 481332 - protein, 9 aa, Influenza virus
PYRALMSVP

SEQ ID NO: 481333 - protein, 9 aa, Influenza virus
PYRSLIKFP

SEQ ID NO: 481334 - protein, 9 aa, Influenza virus
PYRSLIQFP

SEQ ID NO: 481335 - protein, 9 aa, Influenza virus
PYRSLIRFP

SEQ ID NO: 481336 - protein, 9 aa, Influenza virus
PYRTLLMNE

SEQ ID NO: 481337 - protein, 9 aa, Influenza virus
PYRTLLMSE

SEQ ID NO: 481338 - protein, 9 aa, Influenza virus
PYRTLMSCP

SEQ ID NO: 481339 - protein, 9 aa, Influenza virus
PYRTLMSVE

SEQ ID NO: 481340 - protein, 9 aa, Influenza virus
PYRTLMSVK

SEQ ID NO: 481341 - protein, 9 aa, Influenza virus
PYSHGTGTG

SEQ ID NO: 481342 - protein, 9 aa, Influenza virus
PYTGDPPYS

SEQ ID NO: 481343 - protein, 9 aa, Influenza virus
PYTLVSTGS

SEQ ID NO: 481344 - protein, 9 aa, Influenza virus
PYTLVSTKE

SEQ ID NO: 481345 - protein, 9 aa, Influenza virus
PYTLVSTKS

SEQ ID NO: 481346 - protein, 9 aa, Influenza virus
PYTLVSTRS

SEQ ID NO: 481347 - protein, 9 aa, Influenza virus
PYTLVSTSS

SEQ ID NO: 481348 - protein, 9 aa, Influenza virus
PYTLVTTSS

SEQ ID NO: 481349 - protein, 9 aa, Influenza virus
PYVSCDPDE

SEQ ID NO: 481350 - protein, 9 aa, Influenza virus
PYVSCDPDG

SEQ ID NO: 481351 - protein, 9 aa, Influenza virus
PYVSCDPLG

SEQ ID NO: 481352 - protein, 9 aa, Influenza virus
PYVSCDPNE

SEQ ID NO: 481353 - protein, 9 aa, Influenza virus
PYVSCDPSG

SEQ ID NO: 481354 - protein, 9 aa, Influenza virus
PYVSCDPTG

SEQ ID NO: 481355 - protein, 9 aa, Influenza virus
PYVSCEPDE

SEQ ID NO: 481356 - protein, 9 aa, Influenza virus
QAADLKSTQ

SEQ ID NO: 481357 - protein, 9 aa, Influenza virus
QAADYESTQ

SEQ ID NO: 481358 - protein, 9 aa, Influenza virus
QAADYKSTQ

SEQ ID NO: 481359 - protein, 9 aa, Influenza virus
QAAEAIEVA

SEQ ID NO: 481360 - protein, 9 aa, Influenza virus
QAAEAMEIA

SEQ ID NO: 481361 - protein, 9 aa, Influenza virus
QAAEAMEVA

SEQ ID NO: 481362 - protein, 9 aa, Influenza virus
QAAIDKING

SEQ ID NO: 481363 - protein, 9 aa, Influenza virus
QAAIDQING

SEQ ID NO: 481364 - protein, 9 aa, Influenza virus
QAAIDQITG

SEQ ID NO: 481365 - protein, 9 aa, Influenza virus
QAAIDQVNG

SEQ ID NO: 481366 - protein, 9 aa, Influenza virus
QAAVDQITG

SEQ ID NO: 481367 - protein, 9 aa, Influenza virus
QADEICIGY

SEQ ID NO: 481368 - protein, 9 aa, Influenza virus
QADSEMNKL

SEQ ID NO: 481369 - protein, 9 aa, Influenza virus
QAELLVAME

SEQ ID NO: 481370 - protein, 9 aa, Influenza virus
QAFRDNLEP

SEQ ID NO: 481371 - protein, 9 aa, Influenza virus
QAFYKILKI

SEQ ID NO: 481372 - protein, 9 aa, Influenza virus
QAFYRSINW

SEQ ID NO: 481373 - protein, 9 aa, Influenza virus
QAGRIDFHW

SEQ ID NO: 481374 - protein, 9 aa, Influenza virus
QAGRMTFYW

SEQ ID NO: 481375 - protein, 9 aa, Influenza virus
QAGVDRFYR

SEQ ID NO: 481376 - protein, 9 aa, Influenza virus
QAGVNRFYR

SEQ ID NO: 481377 - protein, 9 aa, Influenza virus
QAHTKVLYF

SEQ ID NO: 481378 - protein, 9 aa, Influenza virus
QAKFEAVAW

SEQ ID NO: 481379 - protein, 9 aa, Influenza virus
QAKFESVAW

SEQ ID NO: 481380 - protein, 9 aa, Influenza virus
QAKGLFGAI

SEQ ID NO: 481381 - protein, 9 aa, Influenza virus
QALKDNLEP

SEQ ID NO: 481382 - protein, 9 aa, Influenza virus
QALQLLFEV

SEQ ID NO: 481383 - protein, 9 aa, Influenza virus
QALQLLLEV

SEQ ID NO: 481384 - protein, 9 aa, Influenza virus
QALRDNLEP

SEQ ID NO: 481385 - protein, 9 aa, Influenza virus
QALRDSLEP

SEQ ID NO: 481386 - protein, 9 aa, Influenza virus
QAMELVEAE

SEQ ID NO: 481387 - protein, 9 aa, Influenza virus
QANLCRFLE

SEQ ID NO: 481388 - protein, 9 aa, Influenza virus
QAQDRGLFG

SEQ ID NO: 481389 - protein, 9 aa, Influenza virus
QAQNRGLFG

SEQ ID NO: 481390 - protein, 9 aa, Influenza virus
QARFEAVAW

SEQ ID NO: 481391 - protein, 9 aa, Influenza virus
QARFESVAW

SEQ ID NO: 481392 - protein, 9 aa, Influenza virus
QASPSCLVV

SEQ ID NO: 481393 - protein, 9 aa, Influenza virus
QASYKIFKS

SEQ ID NO: 481394 - protein, 9 aa, Influenza virus
QASYRIFKS

SEQ ID NO: 481395 - protein, 9 aa, Influenza virus
QATIDQITG

SEQ ID NO: 481396 - protein, 9 aa, Influenza virus
QAVDICKAA

SEQ ID NO: 481397 - protein, 9 aa, Influenza virus
QAVGICKAA

SEQ ID NO: 481398 - protein, 9 aa, Influenza virus
QAVNICKAA

SEQ ID NO: 481399 - protein, 9 aa, Influenza virus
QAWSYIVER

SEQ ID NO: 481400 - protein, 9 aa, Influenza virus
QAYQKRMGL

SEQ ID NO: 481401 - protein, 9 aa, Influenza virus
QAYQKRMGV

SEQ ID NO: 481402 - protein, 9 aa, Influenza virus
QAYTKILYF

SEQ ID NO: 481403 - protein, 9 aa, Influenza virus
QAYTKIMYF

SEQ ID NO: 481404 - protein, 9 aa, Influenza virus
QAYTKVLYF

SEQ ID NO: 481405 - protein, 9 aa, Influenza virus
QAYTKVMYF

SEQ ID NO: 481406 - protein, 9 aa, Influenza virus
QCDLHLEFK

SEQ ID NO: 481407 - protein, 9 aa, Influenza virus
QCDNNCIES

SEQ ID NO: 481408 - protein, 9 aa, Influenza virus
QCDSHLKFK

SEQ ID NO: 481409 - protein, 9 aa, Influenza virus
QCEITGFAP

SEQ ID NO: 481410 - protein, 9 aa, Influenza virus
QCFNPMIAE

SEQ ID NO: 481411 - protein, 9 aa, Influenza virus
QCFNPMIIE

SEQ ID NO: 481412 - protein, 9 aa, Influenza virus
QCFNPMIVE

SEQ ID NO: 481413 - protein, 9 aa, Influenza virus
QCFNPMTVE

SEQ ID NO: 481414 - protein, 9 aa, Influenza virus
QCFNPMVVE

SEQ ID NO: 481415 - protein, 9 aa, Influenza virus
QCHITGFAP

SEQ ID NO: 481416 - protein, 9 aa, Influenza virus
QCKITGFAP

SEQ ID NO: 481417 - protein, 9 aa, Influenza virus
QCLITGFAP

SEQ ID NO: 481418 - protein, 9 aa, Influenza virus
QCMESIRNN

SEQ ID NO: 481419 - protein, 9 aa, Influenza virus
QCQIAGFAP

SEQ ID NO: 481420 - protein, 9 aa, Influenza virus
QCQIIGFAP

SEQ ID NO: 481421 - protein, 9 aa, Influenza virus
QCQIRGFAP

SEQ ID NO: 481422 - protein, 9 aa, Influenza virus
QCQISGFAP

SEQ ID NO: 481423 - protein, 9 aa, Influenza virus
QCQITGFAP

SEQ ID NO: 481424 - protein, 9 aa, Influenza virus
QCQITGFVP

SEQ ID NO: 481425 - protein, 9 aa, Influenza virus
QCQITGSAP

SEQ ID NO: 481426 - protein, 9 aa, Influenza virus
QCQTPLGAI

SEQ ID NO: 481427 - protein, 9 aa, Influenza virus
QCQVTGFAP

SEQ ID NO: 481428 - protein, 9 aa, Influenza virus
QCRICIDFR

SEQ ID NO: 481429 - protein, 9 aa, Influenza virus
QCRICILDQ

SEQ ID NO: 481430 - protein, 9 aa, Influenza virus
QCRICIRAD

SEQ ID NO: 481431 - protein, 9 aa, Influenza virus
QCRITGFAP

SEQ ID NO: 481432 - protein, 9 aa, Influenza virus
QDAMTEVWS

SEQ ID NO: 481433 - protein, 9 aa, Influenza virus
QDCDLINGA

SEQ ID NO: 481434 - protein, 9 aa, Influenza virus
QDEFCYTLI

SEQ ID NO: 481435 - protein, 9 aa, Influenza virus
QDEFCYTLM

SEQ ID NO: 481436 - protein, 9 aa, Influenza virus
QDEFCYTLV

SEQ ID NO: 481437 - protein, 9 aa, Influenza virus
QDGKSSACK

SEQ ID NO: 481438 - protein, 9 aa, Influenza virus
QDIIDNDNW

SEQ ID NO: 481439 - protein, 9 aa, Influenza virus
QDIIDNNNW

SEQ ID NO: 481440 - protein, 9 aa, Influenza virus
QDILEKTHN

SEQ ID NO: 481441 - protein, 9 aa, Influenza virus
QDIWAYNAE

SEQ ID NO: 481442 - protein, 9 aa, Influenza virus
QDLEKYVED

SEQ ID NO: 481443 - protein, 9 aa, Influenza virus
QDLENYVED

SEQ ID NO: 481444 - protein, 9 aa, Influenza virus
QDLERYVED

SEQ ID NO: 481445 - protein, 9 aa, Influenza virus
QDLWAYNAE

SEQ ID NO: 481446 - protein, 9 aa, Influenza virus
QDNAIRFGE

SEQ ID NO: 481447 - protein, 9 aa, Influenza virus
QDNAKDEGN

SEQ ID NO: 481448 - protein, 9 aa, Influenza virus
QDRGLFGAI

SEQ ID NO: 481449 - protein, 9 aa, Influenza virus
QDRGLFGAK

SEQ ID NO: 481450 - protein, 9 aa, Influenza virus
QDSECVSHN

SEQ ID NO: 481451 - protein, 9 aa, Influenza virus
QDSFYRSMK

SEQ ID NO: 481452 - protein, 9 aa, Influenza virus
QDTEISFTI

SEQ ID NO: 481453 - protein, 9 aa, Influenza virus
QDTELSFTI

SEQ ID NO: 481454 - protein, 9 aa, Influenza virus
QDTELSFTV

SEQ ID NO: 481455 - protein, 9 aa, Influenza virus
QDTEVSFTI

SEQ ID NO: 481456 - protein, 9 aa, Influenza virus
QDTTWDVFI

SEQ ID NO: 481457 - protein, 9 aa, Influenza virus
QDVIMEVVF

SEQ ID NO: 481458 - protein, 9 aa, Influenza virus
QDVWAYNAE

SEQ ID NO: 481459 - protein, 9 aa, Influenza virus
QDWSGYSGA

SEQ ID NO: 481460 - protein, 9 aa, Influenza virus
QDWSYIVER

SEQ ID NO: 481461 - protein, 9 aa, Influenza virus
QEAIDKITN

SEQ ID NO: 481462 - protein, 9 aa, Influenza virus
QEAIEKITN

SEQ ID NO: 481463 - protein, 9 aa, Influenza virus
QEAIGKITN

SEQ ID NO: 481464 - protein, 9 aa, Influenza virus
QEAINKITN

SEQ ID NO: 481465 - protein, 9 aa, Influenza virus
QEALQNRIM

SEQ ID NO: 481466 - protein, 9 aa, Influenza virus
QEARVWWTS

SEQ ID NO: 481467 - protein, 9 aa, Influenza virus
QEDCMIKAV

SEQ ID NO: 481468 - protein, 9 aa, Influenza virus
QEDCMMKAV

SEQ ID NO: 481469 - protein, 9 aa, Influenza virus
QEDCMVKAV

SEQ ID NO: 481470 - protein, 9 aa, Influenza virus
QEDRMIKAV

SEQ ID NO: 481471 - protein, 9 aa, Influenza virus
QEECMIKAV

SEQ ID NO: 481472 - protein, 9 aa, Influenza virus
QEELKSLFS

SEQ ID NO: 481473 - protein, 9 aa, Influenza virus
QEELRFLFS

SEQ ID NO: 481474 - protein, 9 aa, Influenza virus
QEELRSLFS

SEQ ID NO: 481475 - protein, 9 aa, Influenza virus
QEEVTNATE

SEQ ID NO: 481476 - protein, 9 aa, Influenza virus
QEFKMNPNK

SEQ ID NO: 481477 - protein, 9 aa, Influenza virus
QEFKMNPNQ

SEQ ID NO: 481478 - protein, 9 aa, Influenza virus
QEGRLIQNS

SEQ ID NO: 481479 - protein, 9 aa, Influenza virus
QEIDGIKLK

SEQ ID NO: 481480 - protein, 9 aa, Influenza virus
QEIEGARLD

SEQ ID NO: 481481 - protein, 9 aa, Influenza virus
QEIEGIKLE

SEQ ID NO: 481482 - protein, 9 aa, Influenza virus
QEIEGIKLK

SEQ ID NO: 481483 - protein, 9 aa, Influenza virus
QEIEGIRLK

SEQ ID NO: 481484 - protein, 9 aa, Influenza virus
QEIEGVKLD

SEQ ID NO: 481485 - protein, 9 aa, Influenza virus
QEIEGVKLN

SEQ ID NO: 481486 - protein, 9 aa, Influenza virus
QEIEGVRLD

SEQ ID NO: 481487 - protein, 9 aa, Influenza virus
QEIGGVKLD

SEQ ID NO: 481488 - protein, 9 aa, Influenza virus
QEIGNGCFE

SEQ ID NO: 481489 - protein, 9 aa, Influenza virus
QEIKMNPNQ

SEQ ID NO: 481490 - protein, 9 aa, Influenza virus
QEINGIKLK

SEQ ID NO: 481491 - protein, 9 aa, Influenza virus
QEIVDNKNW

SEQ ID NO: 481492 - protein, 9 aa, Influenza virus
QEIVDNNNW

SEQ ID NO: 481493 - protein, 9 aa, Influenza virus
QEIVDNSNW

SEQ ID NO: 481494 - protein, 9 aa, Influenza virus
QEIVGNDNW

SEQ ID NO: 481495 - protein, 9 aa, Influenza virus
QEIVSNDNW

SEQ ID NO: 481496 - protein, 9 aa, Influenza virus
QEKNDLYGA

SEQ ID NO: 481497 - protein, 9 aa, Influenza virus
QEKNDLYGT

SEQ ID NO: 481498 - protein, 9 aa, Influenza virus
QEKNPALRM

SEQ ID NO: 481499 - protein, 9 aa, Influenza virus
QEKNPSLRM

SEQ ID NO: 481500 - protein, 9 aa, Influenza virus
QELGDAPFL

SEQ ID NO: 481501 - protein, 9 aa, Influenza virus
QENRVWWTS

SEQ ID NO: 481502 - protein, 9 aa, Influenza virus
QERGLFGAI

SEQ ID NO: 481503 - protein, 9 aa, Influenza virus
QERNDLYGT

SEQ ID NO: 481504 - protein, 9 aa, Influenza virus
QESECACAN

SEQ ID NO: 481505 - protein, 9 aa, Influenza virus
QESECACIN

SEQ ID NO: 481506 - protein, 9 aa, Influenza virus
QESECACVN

SEQ ID NO: 481507 - protein, 9 aa, Influenza virus
QESECICIN

SEQ ID NO: 481508 - protein, 9 aa, Influenza virus
QESECQCID

SEQ ID NO: 481509 - protein, 9 aa, Influenza virus
QESECQCIG

SEQ ID NO: 481510 - protein, 9 aa, Influenza virus
QESECQCIS

SEQ ID NO: 481511 - protein, 9 aa, Influenza virus
QESECQCLY

SEQ ID NO: 481512 - protein, 9 aa, Influenza virus
QESECQRID

SEQ ID NO: 481513 - protein, 9 aa, Influenza virus
QESECVCHK

SEQ ID NO: 481514 - protein, 9 aa, Influenza virus
QESECVCHN

SEQ ID NO: 481515 - protein, 9 aa, Influenza virus
QESECVCHS

SEQ ID NO: 481516 - protein, 9 aa, Influenza virus
QESECVCID

SEQ ID NO: 481517 - protein, 9 aa, Influenza virus
QESECVCIN

SEQ ID NO: 481518 - protein, 9 aa, Influenza virus
QESECVCIS

SEQ ID NO: 481519 - protein, 9 aa, Influenza virus
QESECVCMN

SEQ ID NO: 481520 - protein, 9 aa, Influenza virus
QESECVCQD

SEQ ID NO: 481521 - protein, 9 aa, Influenza virus
QESECVCVN

SEQ ID NO: 481522 - protein, 9 aa, Influenza virus
QESECVRHN

SEQ ID NO: 481523 - protein, 9 aa, Influenza virus
QESLLLATG

SEQ ID NO: 481524 - protein, 9 aa, Influenza virus
QESLMLATG

SEQ ID NO: 481525 - protein, 9 aa, Influenza virus
QESSCTCIK

SEQ ID NO: 481526 - protein, 9 aa, Influenza virus
QESSCTCIL

SEQ ID NO: 481527 - protein, 9 aa, Influenza virus
QESSCTCIQ

SEQ ID NO: 481528 - protein, 9 aa, Influenza virus
QESSCTCIR

SEQ ID NO: 481529 - protein, 9 aa, Influenza virus
QESSCVCIK

SEQ ID NO: 481530 - protein, 9 aa, Influenza virus
QESSCVCMK

SEQ ID NO: 481531 - protein, 9 aa, Influenza virus
QESSCVCMN

SEQ ID NO: 481532 - protein, 9 aa, Influenza virus
QESSCVCVK

SEQ ID NO: 481533 - protein, 9 aa, Influenza virus
QETKVWWTS

SEQ ID NO: 481534 - protein, 9 aa, Influenza virus
QETRVWWTS

SEQ ID NO: 481535 - protein, 9 aa, Influenza virus
QFALGHGTT

SEQ ID NO: 481536 - protein, 9 aa, Influenza virus
QFALGQGAT

SEQ ID NO: 481537 - protein, 9 aa, Influenza virus
QFALGQGTT

SEQ ID NO: 481538 - protein, 9 aa, Influenza virus
QFEAIGREF

SEQ ID NO: 481539 - protein, 9 aa, Influenza virus
QFEAVGKEF

SEQ ID NO: 481540 - protein, 9 aa, Influenza virus
QFEAVGREF

SEQ ID NO: 481541 - protein, 9 aa, Influenza virus
QFELIDHEF

SEQ ID NO: 481542 - protein, 9 aa, Influenza virus
QFELIDNEF

SEQ ID NO: 481543 - protein, 9 aa, Influenza virus
QFELIDNKF

SEQ ID NO: 481544 - protein, 9 aa, Influenza virus
QFELINNEF

SEQ ID NO: 481545 - protein, 9 aa, Influenza virus
QFEMIDNEF

SEQ ID NO: 481546 - protein, 9 aa, Influenza virus
QFGLIDNEF

SEQ ID NO: 481547 - protein, 9 aa, Influenza virus
QFGRIDFHW

SEQ ID NO: 481548 - protein, 9 aa, Influenza virus
QFGRINFHW

SEQ ID NO: 481549 - protein, 9 aa, Influenza virus
QFKLIDNEF

SEQ ID NO: 481550 - protein, 9 aa, Influenza virus
QFPVQTDEY

SEQ ID NO: 481551 - protein, 9 aa, Influenza virus
QFRALISWE

SEQ ID NO: 481552 - protein, 9 aa, Influenza virus
QFSSLAVNV

SEQ ID NO: 481553 - protein, 9 aa, Influenza virus
QFSSLTVNV

SEQ ID NO: 481554 - protein, 9 aa, Influenza virus
QFSSLTVSV

SEQ ID NO: 481555 - protein, 9 aa, Influenza virus
QFTAVGKEF

SEQ ID NO: 481556 - protein, 9 aa, Influenza virus
QFTSVGKEF

SEQ ID NO: 481557 - protein, 9 aa, Influenza virus
QFTWNGVKV

SEQ ID NO: 481558 - protein, 9 aa, Influenza virus
QGACWEQLY

SEQ ID NO: 481559 - protein, 9 aa, Influenza virus
QGAGYAADK

SEQ ID NO: 481560 - protein, 9 aa, Influenza virus
QGALLGTKH

SEQ ID NO: 481561 - protein, 9 aa, Influenza virus
QGALLGTNH

SEQ ID NO: 481562 - protein, 9 aa, Influenza virus
QGALLGTRH

SEQ ID NO: 481563 - protein, 9 aa, Influenza virus
QGALLNDKH

SEQ ID NO: 481564 - protein, 9 aa, Influenza virus
QGALLNDRH

SEQ ID NO: 481565 - protein, 9 aa, Influenza virus
QGALVGTKH

SEQ ID NO: 481566 - protein, 9 aa, Influenza virus
QGANRPIIE

SEQ ID NO: 481567 - protein, 9 aa, Influenza virus
QGANRPVIE

SEQ ID NO: 481568 - protein, 9 aa, Influenza virus
QGANRPVIK

SEQ ID NO: 481569 - protein, 9 aa, Influenza virus
QGDIVLVMK

SEQ ID NO: 481570 - protein, 9 aa, Influenza virus
QGDNENATA

SEQ ID NO: 481571 - protein, 9 aa, Influenza virus
QGDVVLVMK

SEQ ID NO: 481572 - protein, 9 aa, Influenza virus
QGEGIAADY

SEQ ID NO: 481573 - protein, 9 aa, Influenza virus
QGEGTAADY

SEQ ID NO: 481574 - protein, 9 aa, Influenza virus
QGFAPFSKD

SEQ ID NO: 481575 - protein, 9 aa, Influenza virus
QGFFPFHKD

SEQ ID NO: 481576 - protein, 9 aa, Influenza virus
QGGHIEECS

SEQ ID NO: 481577 - protein, 9 aa, Influenza virus
QGIGQAADY

SEQ ID NO: 481578 - protein, 9 aa, Influenza virus
QGKTKATKM

SEQ ID NO: 481579 - protein, 9 aa, Influenza virus
QGLIDGWYG

SEQ ID NO: 481580 - protein, 9 aa, Influenza virus
QGLVDGWYG

SEQ ID NO: 481581 - protein, 9 aa, Influenza virus
QGMGMAADK

SEQ ID NO: 481582 - protein, 9 aa, Influenza virus
QGMIDGWYG

SEQ ID NO: 481583 - protein, 9 aa, Influenza virus
QGMVDGWYG

SEQ ID NO: 481584 - protein, 9 aa, Influenza virus
QGNGCFEIF

SEQ ID NO: 481585 - protein, 9 aa, Influenza virus
QGNILLSPE

SEQ ID NO: 481586 - protein, 9 aa, Influenza virus
QGNNDNATA

SEQ ID NO: 481587 - protein, 9 aa, Influenza virus
QGNNENATA

SEQ ID NO: 481588 - protein, 9 aa, Influenza virus
QGNNKNATA

SEQ ID NO: 481589 - protein, 9 aa, Influenza virus
QGNNNNATA

SEQ ID NO: 481590 - protein, 9 aa, Influenza virus
QGNSVWAGR

SEQ ID NO: 481591 - protein, 9 aa, Influenza virus
QGNVLLSPE

SEQ ID NO: 481592 - protein, 9 aa, Influenza virus
QGQGTAADY

SEQ ID NO: 481593 - protein, 9 aa, Influenza virus
QGQIIVLNT

SEQ ID NO: 481594 - protein, 9 aa, Influenza virus
QGQTIVLNT

SEQ ID NO: 481595 - protein, 9 aa, Influenza virus
QGQTIVSNT

SEQ ID NO: 481596 - protein, 9 aa, Influenza virus
QGQTVVLNT

SEQ ID NO: 481597 - protein, 9 aa, Influenza virus
QGRGLFGAI

SEQ ID NO: 481598 - protein, 9 aa, Influenza virus
QGRGLFGAK

SEQ ID NO: 481599 - protein, 9 aa, Influenza virus
QGRGVFEFS

SEQ ID NO: 481600 - protein, 9 aa, Influenza virus
QGRGVFELS

SEQ ID NO: 481601 - protein, 9 aa, Influenza virus
QGRLCNPLN

SEQ ID NO: 481602 - protein, 9 aa, Influenza virus
QGRLCNPMN

SEQ ID NO: 481603 - protein, 9 aa, Influenza virus
QGRMDYYWA

SEQ ID NO: 481604 - protein, 9 aa, Influenza virus
QGRMDYYWG

SEQ ID NO: 481605 - protein, 9 aa, Influenza virus
QGRQTFDWT

SEQ ID NO: 481606 - protein, 9 aa, Influenza virus
QGRQTYDWT

SEQ ID NO: 481607 - protein, 9 aa, Influenza virus
QGSARHIEE

SEQ ID NO: 481608 - protein, 9 aa, Influenza virus
QGSFYRNMR

SEQ ID NO: 481609 - protein, 9 aa, Influenza virus
QGSFYRSIR

SEQ ID NO: 481610 - protein, 9 aa, Influenza virus
QGSFYRSMR

SEQ ID NO: 481611 - protein, 9 aa, Influenza virus
QGSGYAADK

SEQ ID NO: 481612 - protein, 9 aa, Influenza virus
QGSGYAADL

SEQ ID NO: 481613 - protein, 9 aa, Influenza virus
QGSGYAADQ

SEQ ID NO: 481614 - protein, 9 aa, Influenza virus
QGSGYAADR

SEQ ID NO: 481615 - protein, 9 aa, Influenza virus
QGSLKLATG

SEQ ID NO: 481616 - protein, 9 aa, Influenza virus
QGSLLNDKH

SEQ ID NO: 481617 - protein, 9 aa, Influenza virus
QGSLLNDRH

SEQ ID NO: 481618 - protein, 9 aa, Influenza virus
QGSLMLATG

SEQ ID NO: 481619 - protein, 9 aa, Influenza virus
QGSLRLATG

SEQ ID NO: 481620 - protein, 9 aa, Influenza virus
QGSNRPVIQ

SEQ ID NO: 481621 - protein, 9 aa, Influenza virus
QGSNRPVIR

SEQ ID NO: 481622 - protein, 9 aa, Influenza virus
QGSNRPWIR

SEQ ID NO: 481623 - protein, 9 aa, Influenza virus
QGSTLPRRS

SEQ ID NO: 481624 - protein, 9 aa, Influenza virus
QGSYNNTSG

SEQ ID NO: 481625 - protein, 9 aa, Influenza virus
QGTAADYKS

SEQ ID NO: 481626 - protein, 9 aa, Influenza virus
QGTCWEQLY

SEQ ID NO: 481627 - protein, 9 aa, Influenza virus
QGTCWEQMY

SEQ ID NO: 481628 - protein, 9 aa, Influenza virus
QGTGIAADK

SEQ ID NO: 481629 - protein, 9 aa, Influenza virus
QGTGIAAEK

SEQ ID NO: 481630 - protein, 9 aa, Influenza virus
QGTGQAADY

SEQ ID NO: 481631 - protein, 9 aa, Influenza virus
QGTKRSHEQ

SEQ ID NO: 481632 - protein, 9 aa, Influenza virus
QGTKRSYEQ

SEQ ID NO: 481633 - protein, 9 aa, Influenza virus
QGTMDYYWG

SEQ ID NO: 481634 - protein, 9 aa, Influenza virus
QGTSVWAGR

SEQ ID NO: 481635 - protein, 9 aa, Influenza virus
QGTTIRGKH

SEQ ID NO: 481636 - protein, 9 aa, Influenza virus
QGTTIRGRH

SEQ ID NO: 481637 - protein, 9 aa, Influenza virus
QGTTIRNKH

SEQ ID NO: 481638 - protein, 9 aa, Influenza virus
QGTTIRNRH

SEQ ID NO: 481639 - protein, 9 aa, Influenza virus
QGTTLDNEH

SEQ ID NO: 481640 - protein, 9 aa, Influenza virus
QGTTLDNKH

SEQ ID NO: 481641 - protein, 9 aa, Influenza virus
QGTTLENKH

SEQ ID NO: 481642 - protein, 9 aa, Influenza virus
QGTTLKGRH

SEQ ID NO: 481643 - protein, 9 aa, Influenza virus
QGTTLNNKH

SEQ ID NO: 481644 - protein, 9 aa, Influenza virus
QGTTLRGQH

SEQ ID NO: 481645 - protein, 9 aa, Influenza virus
QGTTLRGRH

SEQ ID NO: 481646 - protein, 9 aa, Influenza virus
QGTTLYNKH

SEQ ID NO: 481647 - protein, 9 aa, Influenza virus
QGVGIAADK

SEQ ID NO: 481648 - protein, 9 aa, Influenza virus
QGVGMAADK

SEQ ID NO: 481649 - protein, 9 aa, Influenza virus
QGVKGWAFD

SEQ ID NO: 481650 - protein, 9 aa, Influenza virus
QGVKLAQGY

SEQ ID NO: 481651 - protein, 9 aa, Influenza virus
QGVKLIQGY

SEQ ID NO: 481652 - protein, 9 aa, Influenza virus
QGVKLTQGY

SEQ ID NO: 481653 - protein, 9 aa, Influenza virus
QGVLLGTKH

SEQ ID NO: 481654 - protein, 9 aa, Influenza virus
QGVRLTQGY

SEQ ID NO: 481655 - protein, 9 aa, Influenza virus
QGWMDYYWG

SEQ ID NO: 481656 - protein, 9 aa, Influenza virus
QGWSYIVER

SEQ ID NO: 481657 - protein, 9 aa, Influenza virus
QGYGVKGFG

SEQ ID NO: 481658 - protein, 9 aa, Influenza virus
QGYKDIILW

SEQ ID NO: 481659 - protein, 9 aa, Influenza virus
QHANGTIHD

SEQ ID NO: 481660 - protein, 9 aa, Influenza virus
QHIEECSCY

SEQ ID NO: 481661 - protein, 9 aa, Influenza virus
QHIIDLADS

SEQ ID NO: 481662 - protein, 9 aa, Influenza virus
QHIIDVTDS

SEQ ID NO: 481663 - protein, 9 aa, Influenza virus
QHKSHRQMV

SEQ ID NO: 481664 - protein, 9 aa, Influenza virus
QHLEECSCY

SEQ ID NO: 481665 - protein, 9 aa, Influenza virus
QHPELTGLD

SEQ ID NO: 481666 - protein, 9 aa, Influenza virus
QHPELTGLN

SEQ ID NO: 481667 - protein, 9 aa, Influenza virus
QHPELTGMD

SEQ ID NO: 481668 - protein, 9 aa, Influenza virus
QHPELTGMN

SEQ ID NO: 481669 - protein, 9 aa, Influenza virus
QHPELTGVD

SEQ ID NO: 481670 - protein, 9 aa, Influenza virus
QHPEMTGLD

SEQ ID NO: 481671 - protein, 9 aa, Influenza virus
QHQNAEGIG

SEQ ID NO: 481672 - protein, 9 aa, Influenza virus
QHQNAEGTG

SEQ ID NO: 481673 - protein, 9 aa, Influenza virus
QHQNEQGMG

SEQ ID NO: 481674 - protein, 9 aa, Influenza virus
QHQNEQGTG

SEQ ID NO: 481675 - protein, 9 aa, Influenza virus
QHQNEQGVG

SEQ ID NO: 481676 - protein, 9 aa, Influenza virus
QHQNSEGTG

SEQ ID NO: 481677 - protein, 9 aa, Influenza virus
QHRNDEGTG

SEQ ID NO: 481678 - protein, 9 aa, Influenza virus
QHRNEEGTG

SEQ ID NO: 481679 - protein, 9 aa, Influenza virus
QHRSHRQMA

SEQ ID NO: 481680 - protein, 9 aa, Influenza virus
QHRSHRQMV

SEQ ID NO: 481681 - protein, 9 aa, Influenza virus
QHTIDLADS

SEQ ID NO: 481682 - protein, 9 aa, Influenza virus
QHTIDLAES

SEQ ID NO: 481683 - protein, 9 aa, Influenza virus
QHTIDLTDA

SEQ ID NO: 481684 - protein, 9 aa, Influenza virus
QHTIDLTDS

SEQ ID NO: 481685 - protein, 9 aa, Influenza virus
QHTIDLTNS

SEQ ID NO: 481686 - protein, 9 aa, Influenza virus
QHTIDMADS

SEQ ID NO: 481687 - protein, 9 aa, Influenza virus
QHTIDMTDS

SEQ ID NO: 481688 - protein, 9 aa, Influenza virus
QHTIDSTDS

SEQ ID NO: 481689 - protein, 9 aa, Influenza virus
QHTIDVTDS

SEQ ID NO: 481690 - protein, 9 aa, Influenza virus
QHTIHLTDS

SEQ ID NO: 481691 - protein, 9 aa, Influenza virus
QHVEECSCY

SEQ ID NO: 481692 - protein, 9 aa, Influenza virus
QIADAQHRS

SEQ ID NO: 481693 - protein, 9 aa, Influenza virus
QIADSHHRS

SEQ ID NO: 481694 - protein, 9 aa, Influenza virus
QIADSQHKS

SEQ ID NO: 481695 - protein, 9 aa, Influenza virus
QIADSQHRS

SEQ ID NO: 481696 - protein, 9 aa, Influenza virus
QIAILAATV

SEQ ID NO: 481697 - protein, 9 aa, Influenza virus
QIAILATTI

SEQ ID NO: 481698 - protein, 9 aa, Influenza virus
QIAILATTV

SEQ ID NO: 481699 - protein, 9 aa, Influenza virus
QIAILVTTV

SEQ ID NO: 481700 - protein, 9 aa, Influenza virus
QICIGHHAN

SEQ ID NO: 481701 - protein, 9 aa, Influenza virus
QICIGYHAN

SEQ ID NO: 481702 - protein, 9 aa, Influenza virus
QICIGYHSN

SEQ ID NO: 481703 - protein, 9 aa, Influenza virus
QICVGYHAN

SEQ ID NO: 481704 - protein, 9 aa, Influenza virus
QICVGYHSN

SEQ ID NO: 481705 - protein, 9 aa, Influenza virus
QIDESCEGE

SEQ ID NO: 481706 - protein, 9 aa, Influenza virus
QIDPVKLSG

SEQ ID NO: 481707 - protein, 9 aa, Influenza virus
QIDPVKLSS

SEQ ID NO: 481708 - protein, 9 aa, Influenza virus
QIDQVKLSS

SEQ ID NO: 481709 - protein, 9 aa, Influenza virus
QIDSVKLSS

SEQ ID NO: 481710 - protein, 9 aa, Influenza virus
QIDTIMEKN

SEQ ID NO: 481711 - protein, 9 aa, Influenza virus
QIEARGLFG

SEQ ID NO: 481712 - protein, 9 aa, Influenza virus
QIEDLWAYN

SEQ ID NO: 481713 - protein, 9 aa, Influenza virus
QIEELWAYN

SEQ ID NO: 481714 - protein, 9 aa, Influenza virus
QIEGLWAYN

SEQ ID NO: 481715 - protein, 9 aa, Influenza virus
QIEKEFEQV

SEQ ID NO: 481716 - protein, 9 aa, Influenza virus
QIEKEFGQV

SEQ ID NO: 481717 - protein, 9 aa, Influenza virus
QIEKEFSEI

SEQ ID NO: 481718 - protein, 9 aa, Influenza virus
QIEKEFSEV

SEQ ID NO: 481719 - protein, 9 aa, Influenza virus
QIENLWAYN

SEQ ID NO: 481720 - protein, 9 aa, Influenza virus
QIEPRGLFG

SEQ ID NO: 481721 - protein, 9 aa, Influenza virus
QIESIIEAE

SEQ ID NO: 481722 - protein, 9 aa, Influenza virus
QIESMIEAE

SEQ ID NO: 481723 - protein, 9 aa, Influenza virus
QIESMVEAE

SEQ ID NO: 481724 - protein, 9 aa, Influenza virus
QIESRGLFG

SEQ ID NO: 481725 - protein, 9 aa, Influenza virus
QIEVTNATE

SEQ ID NO: 481726 - protein, 9 aa, Influenza virus
QIGNVINWT

SEQ ID NO: 481727 - protein, 9 aa, Influenza virus
QIGYICSGV

SEQ ID NO: 481728 - protein, 9 aa, Influenza virus
QIGYVCSGI

SEQ ID NO: 481729 - protein, 9 aa, Influenza virus
QIGYVCSGV

SEQ ID NO: 481730 - protein, 9 aa, Influenza virus
QIIDIWAYN

SEQ ID NO: 481731 - protein, 9 aa, Influenza virus
QIIKLLPFA

SEQ ID NO: 481732 - protein, 9 aa, Influenza virus
QIIRESGGI

SEQ ID NO: 481733 - protein, 9 aa, Influenza virus
QIIRRSGGI

SEQ ID NO: 481734 - protein, 9 aa, Influenza virus
QIISLCSIW

SEQ ID NO: 481735 - protein, 9 aa, Influenza virus
QIIVDNNNW

SEQ ID NO: 481736 - protein, 9 aa, Influenza virus
QIIVILVLG

SEQ ID NO: 481737 - protein, 9 aa, Influenza virus
QIIVLNTDW

SEQ ID NO: 481738 - protein, 9 aa, Influenza virus
QIIVTREPY

SEQ ID NO: 481739 - protein, 9 aa, Influenza virus
QIKIRRRVD

SEQ ID NO: 481740 - protein, 9 aa, Influenza virus
QILAIYATV

SEQ ID NO: 481741 - protein, 9 aa, Influenza virus
QILAIYSTA

SEQ ID NO: 481742 - protein, 9 aa, Influenza virus
QILAIYSTV

SEQ ID NO: 481743 - protein, 9 aa, Influenza virus
QILRESGGI

SEQ ID NO: 481744 - protein, 9 aa, Influenza virus
QILRGSGGI

SEQ ID NO: 481745 - protein, 9 aa, Influenza virus
QILRGSGGV

SEQ ID NO: 481746 - protein, 9 aa, Influenza virus
QILRKSGGI

SEQ ID NO: 481747 - protein, 9 aa, Influenza virus
QILRRSGGI

SEQ ID NO: 481748 - protein, 9 aa, Influenza virus
QILRTQESE

SEQ ID NO: 481749 - protein, 9 aa, Influenza virus
QILRTQESS

SEQ ID NO: 481750 - protein, 9 aa, Influenza virus
QILSIYSTA

SEQ ID NO: 481751 - protein, 9 aa, Influenza virus
QILSIYSTV

SEQ ID NO: 481752 - protein, 9 aa, Influenza virus
QILSLYSTV

SEQ ID NO: 481753 - protein, 9 aa, Influenza virus
QINGKLNRL

SEQ ID NO: 481754 - protein, 9 aa, Influenza virus
QINGQSGRI

SEQ ID NO: 481755 - protein, 9 aa, Influenza virus
QIQDIWAYN

SEQ ID NO: 481756 - protein, 9 aa, Influenza virus
QIQDLWAYN

SEQ ID NO: 481757 - protein, 9 aa, Influenza virus
QIQDVWAYN

SEQ ID NO: 481758 - protein, 9 aa, Influenza virus
QIQGIKLTQ

SEQ ID NO: 481759 - protein, 9 aa, Influenza virus
QIQGVKLAQ

SEQ ID NO: 481760 - protein, 9 aa, Influenza virus
QIQGVKLIQ

SEQ ID NO: 481761 - protein, 9 aa, Influenza virus
QIQGVKLTQ

SEQ ID NO: 481762 - protein, 9 aa, Influenza virus
QIQGVRLTQ

SEQ ID NO: 481763 - protein, 9 aa, Influenza virus
QIQNIWAYN

SEQ ID NO: 481764 - protein, 9 aa, Influenza virus
QIQNRGLFG

SEQ ID NO: 481765 - protein, 9 aa, Influenza virus
QIQTKRSFE

SEQ ID NO: 481766 - protein, 9 aa, Influenza virus
QIQTRRAFE

SEQ ID NO: 481767 - protein, 9 aa, Influenza virus
QIQTRRSFE

SEQ ID NO: 481768 - protein, 9 aa, Influenza virus
QIRGFVHFV

SEQ ID NO: 481769 - protein, 9 aa, Influenza virus
QIRGFVYFV

SEQ ID NO: 481770 - protein, 9 aa, Influenza virus
QISIVPNIG

SEQ ID NO: 481771 - protein, 9 aa, Influenza virus
QITDIWAYN

SEQ ID NO: 481772 - protein, 9 aa, Influenza virus
QITFLQALQ

SEQ ID NO: 481773 - protein, 9 aa, Influenza virus
QITFMQALQ

SEQ ID NO: 481774 - protein, 9 aa, Influenza virus
QITGFAPFS

SEQ ID NO: 481775 - protein, 9 aa, Influenza virus
QITGKLNHL

SEQ ID NO: 481776 - protein, 9 aa, Influenza virus
QITGKLNRI

SEQ ID NO: 481777 - protein, 9 aa, Influenza virus
QITGKLNRL

SEQ ID NO: 481778 - protein, 9 aa, Influenza virus
QITNGTTGN

SEQ ID NO: 481779 - protein, 9 aa, Influenza virus
QITRKLNRL

SEQ ID NO: 481780 - protein, 9 aa, Influenza virus
QITSLCSIW

SEQ ID NO: 481781 - protein, 9 aa, Influenza virus
QITTKINNI

SEQ ID NO: 481782 - protein, 9 aa, Influenza virus
QIVVTREPY

SEQ ID NO: 481783 - protein, 9 aa, Influenza virus
QKAIDEITT

SEQ ID NO: 481784 - protein, 9 aa, Influenza virus
QKAIDGITN

SEQ ID NO: 481785 - protein, 9 aa, Influenza virus
QKAIDGVTN

SEQ ID NO: 481786 - protein, 9 aa, Influenza virus
QKAIDIMQN

SEQ ID NO: 481787 - protein, 9 aa, Influenza virus
QKAIDNMQN

SEQ ID NO: 481788 - protein, 9 aa, Influenza virus
QKAIDQITT

SEQ ID NO: 481789 - protein, 9 aa, Influenza virus
QKAIDRITT

SEQ ID NO: 481790 - protein, 9 aa, Influenza virus
QKAINEITT

SEQ ID NO: 481791 - protein, 9 aa, Influenza virus
QKAINGVTN

SEQ ID NO: 481792 - protein, 9 aa, Influenza virus
QKALNEITT

SEQ ID NO: 481793 - protein, 9 aa, Influenza virus
QKAMMDQVR

SEQ ID NO: 481794 - protein, 9 aa, Influenza virus
QKAQGEGTA

SEQ ID NO: 481795 - protein, 9 aa, Influenza virus
QKCCNLFEK

SEQ ID NO: 481796 - protein, 9 aa, Influenza virus
QKCCSLFEK

SEQ ID NO: 481797 - protein, 9 aa, Influenza virus
QKCCTLFEK

SEQ ID NO: 481798 - protein, 9 aa, Influenza virus
QKFEEIKWL

SEQ ID NO: 481799 - protein, 9 aa, Influenza virus
QKFEEIRWL

SEQ ID NO: 481800 - protein, 9 aa, Influenza virus
QKFEEIRWM

SEQ ID NO: 481801 - protein, 9 aa, Influenza virus
QKFEEMRWL

SEQ ID NO: 481802 - protein, 9 aa, Influenza virus
QKFEEVRWL

SEQ ID NO: 481803 - protein, 9 aa, Influenza virus
QKGNIKCNI

SEQ ID NO: 481804 - protein, 9 aa, Influenza virus
QKGNIRCDI

SEQ ID NO: 481805 - protein, 9 aa, Influenza virus
QKGNIRCNI

SEQ ID NO: 481806 - protein, 9 aa, Influenza virus
QKIITIDSV

SEQ ID NO: 481807 - protein, 9 aa, Influenza virus
QKIITIGSA

SEQ ID NO: 481808 - protein, 9 aa, Influenza virus
QKIITIGSI

SEQ ID NO: 481809 - protein, 9 aa, Influenza virus
QKIITIGSM

SEQ ID NO: 481810 - protein, 9 aa, Influenza virus
QKIITIGSV

SEQ ID NO: 481811 - protein, 9 aa, Influenza virus
QKIITMGSV

SEQ ID NO: 481812 - protein, 9 aa, Influenza virus
QKILCASAT

SEQ ID NO: 481813 - protein, 9 aa, Influenza virus
QKILCTSAI

SEQ ID NO: 481814 - protein, 9 aa, Influenza virus
QKILCTSAT

SEQ ID NO: 481815 - protein, 9 aa, Influenza virus
QKILDEHDS

SEQ ID NO: 481816 - protein, 9 aa, Influenza virus
QKILFASAT

SEQ ID NO: 481817 - protein, 9 aa, Influenza virus
QKIMESGEI

SEQ ID NO: 481818 - protein, 9 aa, Influenza virus
QKIMESGGI

SEQ ID NO: 481819 - protein, 9 aa, Influenza virus
QKIMESGGV

SEQ ID NO: 481820 - protein, 9 aa, Influenza virus
QKINGVKLE

SEQ ID NO: 481821 - protein, 9 aa, Influenza virus
QKISGVKLE

SEQ ID NO: 481822 - protein, 9 aa, Influenza virus
QKITCVCRD

SEQ ID NO: 481823 - protein, 9 aa, Influenza virus
QKKDKRYGP

SEQ ID NO: 481824 - protein, 9 aa, Influenza virus
QKLEDVFAG

SEQ ID NO: 481825 - protein, 9 aa, Influenza virus
QKLFALSGV

SEQ ID NO: 481826 - protein, 9 aa, Influenza virus
QKLFASSGI

SEQ ID NO: 481827 - protein, 9 aa, Influenza virus
QKLFTLSGV

SEQ ID NO: 481828 - protein, 9 aa, Influenza virus
QKQEFKMNP

SEQ ID NO: 481829 - protein, 9 aa, Influenza virus
QKQEIKMNP

SEQ ID NO: 481830 - protein, 9 aa, Influenza virus
QKQMTRGLF

SEQ ID NO: 481831 - protein, 9 aa, Influenza virus
QKRGLFGAI

SEQ ID NO: 481832 - protein, 9 aa, Influenza virus
QKRMGLQMQ

SEQ ID NO: 481833 - protein, 9 aa, Influenza virus
QKRMGVQIQ

SEQ ID NO: 481834 - protein, 9 aa, Influenza virus
QKRMGVQLQ

SEQ ID NO: 481835 - protein, 9 aa, Influenza virus
QKRMGVQMH

SEQ ID NO: 481836 - protein, 9 aa, Influenza virus
QKRMGVQMQ

SEQ ID NO: 481837 - protein, 9 aa, Influenza virus
QKRMTRGLF

SEQ ID NO: 481838 - protein, 9 aa, Influenza virus
QKSLIWLWL

SEQ ID NO: 481839 - protein, 9 aa, Influenza virus
QKSLLLATG

SEQ ID NO: 481840 - protein, 9 aa, Influenza virus
QKSLRGRGS

SEQ ID NO: 481841 - protein, 9 aa, Influenza virus
QKSTQEAID

SEQ ID NO: 481842 - protein, 9 aa, Influenza virus
QKSTQEAIE

SEQ ID NO: 481843 - protein, 9 aa, Influenza virus
QKSTQEAIG

SEQ ID NO: 481844 - protein, 9 aa, Influenza virus
QKSTQEAIN

SEQ ID NO: 481845 - protein, 9 aa, Influenza virus
QKSWMKIYW

SEQ ID NO: 481846 - protein, 9 aa, Influenza virus
QKSWTKIYW

SEQ ID NO: 481847 - protein, 9 aa, Influenza virus
QKTIDQVTG

SEQ ID NO: 481848 - protein, 9 aa, Influenza virus
QKTITIGSV

SEQ ID NO: 481849 - protein, 9 aa, Influenza virus
QKTLDEHDA

SEQ ID NO: 481850 - protein, 9 aa, Influenza virus
QKTLDEHDS

SEQ ID NO: 481851 - protein, 9 aa, Influenza virus
QKTLDEHDT

SEQ ID NO: 481852 - protein, 9 aa, Influenza virus
QKTLDEHEA

SEQ ID NO: 481853 - protein, 9 aa, Influenza virus
QKTLDEHVA

SEQ ID NO: 481854 - protein, 9 aa, Influenza virus
QKTLDKHDS

SEQ ID NO: 481855 - protein, 9 aa, Influenza virus
QKTLKLATG

SEQ ID NO: 481856 - protein, 9 aa, Influenza virus
QKVNGVKLE

SEQ ID NO: 481857 - protein, 9 aa, Influenza virus
QKVPVTQTM

SEQ ID NO: 481858 - protein, 9 aa, Influenza virus
QKVTCVCRD

SEQ ID NO: 481859 - protein, 9 aa, Influenza virus
QKWSGYSGA

SEQ ID NO: 481860 - protein, 9 aa, Influenza virus
QKWWVWLWL

SEQ ID NO: 481861 - protein, 9 aa, Influenza virus
QLEGFSAES

SEQ ID NO: 481862 - protein, 9 aa, Influenza virus
QLFIKDYRY

SEQ ID NO: 481863 - protein, 9 aa, Influenza virus
QLFLVCVSL

SEQ ID NO: 481864 - protein, 9 aa, Influenza virus
QLGNVINWT

SEQ ID NO: 481865 - protein, 9 aa, Influenza virus
QLGSWSWHD

SEQ ID NO: 481866 - protein, 9 aa, Influenza virus
QLIPMISKC

SEQ ID NO: 481867 - protein, 9 aa, Influenza virus
QLIWMACHS

SEQ ID NO: 481868 - protein, 9 aa, Influenza virus
QLKDNAKEL

SEQ ID NO: 481869 - protein, 9 aa, Influenza virus
QLKDNAKEV

SEQ ID NO: 481870 - protein, 9 aa, Influenza virus
QLKDNAREL

SEQ ID NO: 481871 - protein, 9 aa, Influenza virus
QLKKQEIEG

SEQ ID NO: 481872 - protein, 9 aa, Influenza virus
QLKLATGLK

SEQ ID NO: 481873 - protein, 9 aa, Influenza virus
QLKLATGLR

SEQ ID NO: 481874 - protein, 9 aa, Influenza virus
QLKRQEIEG

SEQ ID NO: 481875 - protein, 9 aa, Influenza virus
QLLFEVEQE

SEQ ID NO: 481876 - protein, 9 aa, Influenza virus
QLLLEVENE

SEQ ID NO: 481877 - protein, 9 aa, Influenza virus
QLLLEVEQE

SEQ ID NO: 481878 - protein, 9 aa, Influenza virus
QLLLEVESE

SEQ ID NO: 481879 - protein, 9 aa, Influenza virus
QLLRHFQKD

SEQ ID NO: 481880 - protein, 9 aa, Influenza virus
QLLVLLENE

SEQ ID NO: 481881 - protein, 9 aa, Influenza virus
QLLVWLENE

SEQ ID NO: 481882 - protein, 9 aa, Influenza virus
QLNEGIMNT

SEQ ID NO: 481883 - protein, 9 aa, Influenza virus
QLNEGVINT

SEQ ID NO: 481884 - protein, 9 aa, Influenza virus
QLNEGVMNT

SEQ ID NO: 481885 - protein, 9 aa, Influenza virus
QLNPIDGPL

SEQ ID NO: 481886 - protein, 9 aa, Influenza virus
QLNQTYRNN

SEQ ID NO: 481887 - protein, 9 aa, Influenza virus
QLNQTYRNT

SEQ ID NO: 481888 - protein, 9 aa, Influenza virus
QLRDNAKEI

SEQ ID NO: 481889 - protein, 9 aa, Influenza virus
QLRDNAKEL

SEQ ID NO: 481890 - protein, 9 aa, Influenza virus
QLRDNAKET

SEQ ID NO: 481891 - protein, 9 aa, Influenza virus
QLRDNVKEL

SEQ ID NO: 481892 - protein, 9 aa, Influenza virus
QLRENAEDI

SEQ ID NO: 481893 - protein, 9 aa, Influenza virus
QLRENAEDK

SEQ ID NO: 481894 - protein, 9 aa, Influenza virus
QLRENAEDM

SEQ ID NO: 481895 - protein, 9 aa, Influenza virus
QLRENAEDQ

SEQ ID NO: 481896 - protein, 9 aa, Influenza virus
QLRENAEDR

SEQ ID NO: 481897 - protein, 9 aa, Influenza virus
QLRENAEED

SEQ ID NO: 481898 - protein, 9 aa, Influenza virus
QLRENAEEM

SEQ ID NO: 481899 - protein, 9 aa, Influenza virus
QLRMATGLR

SEQ ID NO: 481900 - protein, 9 aa, Influenza virus
QLRQNAEED

SEQ ID NO: 481901 - protein, 9 aa, Influenza virus
QLSAGGDIW

SEQ ID NO: 481902 - protein, 9 aa, Influenza virus
QLSQKFEEI

SEQ ID NO: 481903 - protein, 9 aa, Influenza virus
QLSSVSSFE

SEQ ID NO: 481904 - protein, 9 aa, Influenza virus
QLSSVSSFK

SEQ ID NO: 481905 - protein, 9 aa, Influenza virus
QLSTVSSFE

SEQ ID NO: 481906 - protein, 9 aa, Influenza virus
QLTHHMRKK

SEQ ID NO: 481907 - protein, 9 aa, Influenza virus
QLVWMACHS

SEQ ID NO: 481908 - protein, 9 aa, Influenza virus
QLVWMACNS

SEQ ID NO: 481909 - protein, 9 aa, Influenza virus
QLYTPGGEV

SEQ ID NO: 481910 - protein, 9 aa, Influenza virus
QMAGSSEQA

SEQ ID NO: 481911 - protein, 9 aa, Influenza virus
QMAIDNMQN

SEQ ID NO: 481912 - protein, 9 aa, Influenza virus
QMALQLFIK

SEQ ID NO: 481913 - protein, 9 aa, Influenza virus
QMCTELKLN

SEQ ID NO: 481914 - protein, 9 aa, Influenza virus
QMCTELKLS

SEQ ID NO: 481915 - protein, 9 aa, Influenza virus
QMCTELQLS

SEQ ID NO: 481916 - protein, 9 aa, Influenza virus
QMEKIVLLF

SEQ ID NO: 481917 - protein, 9 aa, Influenza virus
QMESRGLFG

SEQ ID NO: 481918 - protein, 9 aa, Influenza virus
QMETDGDRQ

SEQ ID NO: 481919 - protein, 9 aa, Influenza virus
QMETDGERQ

SEQ ID NO: 481920 - protein, 9 aa, Influenza virus
QMETGERQN

SEQ ID NO: 481921 - protein, 9 aa, Influenza virus
QMETGGERQ

SEQ ID NO: 481922 - protein, 9 aa, Influenza virus
QMETSGERQ

SEQ ID NO: 481923 - protein, 9 aa, Influenza virus
QMNGQSGRI

SEQ ID NO: 481924 - protein, 9 aa, Influenza virus
QMQRFRRPD

SEQ ID NO: 481925 - protein, 9 aa, Influenza virus
QMRDILGTF

SEQ ID NO: 481926 - protein, 9 aa, Influenza virus
QMRDVLGTF

SEQ ID NO: 481927 - protein, 9 aa, Influenza virus
QMTRGLFGA

SEQ ID NO: 481928 - protein, 9 aa, Influenza virus
QMYQKCCNL

SEQ ID NO: 481929 - protein, 9 aa, Influenza virus
QMYQKCCSL

SEQ ID NO: 481930 - protein, 9 aa, Influenza virus
QMYQKCCTL

SEQ ID NO: 481931 - protein, 9 aa, Influenza virus
QMYQRCCNL

SEQ ID NO: 481932 - protein, 9 aa, Influenza virus
QMYTPGGEV

SEQ ID NO: 481933 - protein, 9 aa, Influenza virus
QMYTPGGGV

SEQ ID NO: 481934 - protein, 9 aa, Influenza virus
QMYTPGGKV

SEQ ID NO: 481935 - protein, 9 aa, Influenza virus
QNAEEDGKG

SEQ ID NO: 481936 - protein, 9 aa, Influenza virus
QNAEEDGRG

SEQ ID NO: 481937 - protein, 9 aa, Influenza virus
QNAEGIGIA

SEQ ID NO: 481938 - protein, 9 aa, Influenza virus
QNAEGTGIA

SEQ ID NO: 481939 - protein, 9 aa, Influenza virus
QNAEGTGMA

SEQ ID NO: 481940 - protein, 9 aa, Influenza virus
QNAEGTGTA

SEQ ID NO: 481941 - protein, 9 aa, Influenza virus
QNAISTTFP

SEQ ID NO: 481942 - protein, 9 aa, Influenza virus
QNALNGNGD

SEQ ID NO: 481943 - protein, 9 aa, Influenza virus
QNALSGNGD

SEQ ID NO: 481944 - protein, 9 aa, Influenza virus
QNAQGEGIA

SEQ ID NO: 481945 - protein, 9 aa, Influenza virus
QNAQGEGTA

SEQ ID NO: 481946 - protein, 9 aa, Influenza virus
QNAQGIGQA

SEQ ID NO: 481947 - protein, 9 aa, Influenza virus
QNAQGQGTA

SEQ ID NO: 481948 - protein, 9 aa, Influenza virus
QNAQGSGYA

SEQ ID NO: 481949 - protein, 9 aa, Influenza virus
QNAQGTGLA

SEQ ID NO: 481950 - protein, 9 aa, Influenza virus
QNAQGTGQA

SEQ ID NO: 481951 - protein, 9 aa, Influenza virus
QNASRHHMG

SEQ ID NO: 481952 - protein, 9 aa, Influenza virus
QNASRHYMG

SEQ ID NO: 481953 - protein, 9 aa, Influenza virus
QNASRYYMG

SEQ ID NO: 481954 - protein, 9 aa, Influenza virus
QNDVWLGRT

SEQ ID NO: 481955 - protein, 9 aa, Influenza virus
QNEDIPIEN

SEQ ID NO: 481956 - protein, 9 aa, Influenza virus
QNEDIPIGN

SEQ ID NO: 481957 - protein, 9 aa, Influenza virus
QNEDIPIGS

SEQ ID NO: 481958 - protein, 9 aa, Influenza virus
QNEFNKACE

SEQ ID NO: 481959 - protein, 9 aa, Influenza virus
QNEQGMGMA

SEQ ID NO: 481960 - protein, 9 aa, Influenza virus
QNEQGSGYA

SEQ ID NO: 481961 - protein, 9 aa, Influenza virus
QNEQGTGIA

SEQ ID NO: 481962 - protein, 9 aa, Influenza virus
QNEQGVGIA

SEQ ID NO: 481963 - protein, 9 aa, Influenza virus
QNEQGVGMA

SEQ ID NO: 481964 - protein, 9 aa, Influenza virus
QNFPQTANT

SEQ ID NO: 481965 - protein, 9 aa, Influenza virus
QNFPQTTNT

SEQ ID NO: 481966 - protein, 9 aa, Influenza virus
QNFPRTTNT

SEQ ID NO: 481967 - protein, 9 aa, Influenza virus
QNGKSGACK

SEQ ID NO: 481968 - protein, 9 aa, Influenza virus
QNGKSSACK

SEQ ID NO: 481969 - protein, 9 aa, Influenza virus
QNGNIRCQI

SEQ ID NO: 481970 - protein, 9 aa, Influenza virus
QNGNIRCTF

SEQ ID NO: 481971 - protein, 9 aa, Influenza virus
QNGNIRWPD

SEQ ID NO: 481972 - protein, 9 aa, Influenza virus
QNGNLRCQI

SEQ ID NO: 481973 - protein, 9 aa, Influenza virus
QNGNVRCQI

SEQ ID NO: 481974 - protein, 9 aa, Influenza virus
QNGNVRCTF

SEQ ID NO: 481975 - protein, 9 aa, Influenza virus
QNGQGSGYA

SEQ ID NO: 481976 - protein, 9 aa, Influenza virus
QNGSCRCMF

SEQ ID NO: 481977 - protein, 9 aa, Influenza virus
QNGSYRCMF

SEQ ID NO: 481978 - protein, 9 aa, Influenza virus
QNHGICAVA

SEQ ID NO: 481979 - protein, 9 aa, Influenza virus
QNICKPYIG

SEQ ID NO: 481980 - protein, 9 aa, Influenza virus
QNIDKNALG

SEQ ID NO: 481981 - protein, 9 aa, Influenza virus
QNIDRNAIG

SEQ ID NO: 481982 - protein, 9 aa, Influenza virus
QNIDRNALG

SEQ ID NO: 481983 - protein, 9 aa, Influenza virus
QNIDSRAVG

SEQ ID NO: 481984 - protein, 9 aa, Influenza virus
QNIDSWAVG

SEQ ID NO: 481985 - protein, 9 aa, Influenza virus
QNIEKNALG

SEQ ID NO: 481986 - protein, 9 aa, Influenza virus
QNIERNALG

SEQ ID NO: 481987 - protein, 9 aa, Influenza virus
QNIHPATIG

SEQ ID NO: 481988 - protein, 9 aa, Influenza virus
QNIHPITIG

SEQ ID NO: 481989 - protein, 9 aa, Influenza virus
QNIHPVTIG

SEQ ID NO: 481990 - protein, 9 aa, Influenza virus
QNIIQIDPV

SEQ ID NO: 481991 - protein, 9 aa, Influenza virus
QNILEKTHN

SEQ ID NO: 481992 - protein, 9 aa, Influenza virus
QNILRTQES

SEQ ID NO: 481993 - protein, 9 aa, Influenza virus
QNIPVTQTM

SEQ ID NO: 481994 - protein, 9 aa, Influenza virus
QNIPVTQVE

SEQ ID NO: 481995 - protein, 9 aa, Influenza virus
QNISKYAFG

SEQ ID NO: 481996 - protein, 9 aa, Influenza virus
QNISPVWIG

SEQ ID NO: 481997 - protein, 9 aa, Influenza virus
QNIWAYNAE

SEQ ID NO: 481998 - protein, 9 aa, Influenza virus
QNKLNNVID

SEQ ID NO: 481999 - protein, 9 aa, Influenza virus
QNKLYGAGN

SEQ ID NO: 482000 - protein, 9 aa, Influenza virus
QNKLYGTGN

SEQ ID NO: 482001 - protein, 9 aa, Influenza virus
QNLFTLSGV

SEQ ID NO: 482002 - protein, 9 aa, Influenza virus
QNLSPRTVG

SEQ ID NO: 482003 - protein, 9 aa, Influenza virus
QNLTKINNG

SEQ ID NO: 482004 - protein, 9 aa, Influenza virus
QNLTKTNNG

SEQ ID NO: 482005 - protein, 9 aa, Influenza virus
QNLTKVNNG

SEQ ID NO: 482006 - protein, 9 aa, Influenza virus
QNLTKVNSG

SEQ ID NO: 482007 - protein, 9 aa, Influenza virus
QNNAIDEGD

SEQ ID NO: 482008 - protein, 9 aa, Influenza virus
QNNFVPVIG

SEQ ID NO: 482009 - protein, 9 aa, Influenza virus
QNNFVPVMG

SEQ ID NO: 482010 - protein, 9 aa, Influenza virus
QNNFVPVVG

SEQ ID NO: 482011 - protein, 9 aa, Influenza virus
QNNFVPVVR

SEQ ID NO: 482012 - protein, 9 aa, Influenza virus
QNNTTLIEN

SEQ ID NO: 482013 - protein, 9 aa, Influenza virus
QNNTTVVEN

SEQ ID NO: 482014 - protein, 9 aa, Influenza virus
QNPRIFLAM

SEQ ID NO: 482015 - protein, 9 aa, Influenza virus
QNPRMFLAM

SEQ ID NO: 482016 - protein, 9 aa, Influenza virus
QNPRVFLAM

SEQ ID NO: 482017 - protein, 9 aa, Influenza virus
QNPRVFLTM

SEQ ID NO: 482018 - protein, 9 aa, Influenza virus
QNPTEEQAV

SEQ ID NO: 482019 - protein, 9 aa, Influenza virus
QNQNPRMFL

SEQ ID NO: 482020 - protein, 9 aa, Influenza virus
QNQVKIRRR

SEQ ID NO: 482021 - protein, 9 aa, Influenza virus
QNRGLFGAI

SEQ ID NO: 482022 - protein, 9 aa, Influenza virus
QNRGLFGAK

SEQ ID NO: 482023 - protein, 9 aa, Influenza virus
QNRIMINPV

SEQ ID NO: 482024 - protein, 9 aa, Influenza virus
QNRIQIDAV

SEQ ID NO: 482025 - protein, 9 aa, Influenza virus
QNRIQIDPV

SEQ ID NO: 482026 - protein, 9 aa, Influenza virus
QNRIQIDQV

SEQ ID NO: 482027 - protein, 9 aa, Influenza virus
QNRIQIDSV

SEQ ID NO: 482028 - protein, 9 aa, Influenza virus
QNRIQINPV

SEQ ID NO: 482029 - protein, 9 aa, Influenza virus
QNRIRIDPV

SEQ ID NO: 482030 - protein, 9 aa, Influenza virus
QNRLNNVID

SEQ ID NO: 482031 - protein, 9 aa, Influenza virus
QNRMQFSSL

SEQ ID NO: 482032 - protein, 9 aa, Influenza virus
QNRMQINPV

SEQ ID NO: 482033 - protein, 9 aa, Influenza virus
QNRVKIDPV

SEQ ID NO: 482034 - protein, 9 aa, Influenza virus
QNSEGTGIA

SEQ ID NO: 482035 - protein, 9 aa, Influenza virus
QNSEGTGIV

SEQ ID NO: 482036 - protein, 9 aa, Influenza virus
QNSEGTGTA

SEQ ID NO: 482037 - protein, 9 aa, Influenza virus
QNSFVPVVG

SEQ ID NO: 482038 - protein, 9 aa, Influenza virus
QNSITIERM

SEQ ID NO: 482039 - protein, 9 aa, Influenza virus
QNSLTIEKM

SEQ ID NO: 482040 - protein, 9 aa, Influenza virus
QNSLTIERM

SEQ ID NO: 482041 - protein, 9 aa, Influenza virus
QNSMTIERM

SEQ ID NO: 482042 - protein, 9 aa, Influenza virus
QNSQGEGTA

SEQ ID NO: 482043 - protein, 9 aa, Influenza virus
QNSTWVSQT

SEQ ID NO: 482044 - protein, 9 aa, Influenza virus
QNTIDLTDS

SEQ ID NO: 482045 - protein, 9 aa, Influenza virus
QNTLKLATG

SEQ ID NO: 482046 - protein, 9 aa, Influenza virus
QNTQGEGTA

SEQ ID NO: 482047 - protein, 9 aa, Influenza virus
QNTSKHYIG

SEQ ID NO: 482048 - protein, 9 aa, Influenza virus
QNTSRHYIG

SEQ ID NO: 482049 - protein, 9 aa, Influenza virus
QNTSRHYMG

SEQ ID NO: 482050 - protein, 9 aa, Influenza virus
QNVHPITIG

SEQ ID NO: 482051 - protein, 9 aa, Influenza virus
QNVHPVTIG

SEQ ID NO: 482052 - protein, 9 aa, Influenza virus
QNVNKITYG

SEQ ID NO: 482053 - protein, 9 aa, Influenza virus
QNVNKVTYG

SEQ ID NO: 482054 - protein, 9 aa, Influenza virus
QNVNRITYG

SEQ ID NO: 482055 - protein, 9 aa, Influenza virus
QNVPVTQAM

SEQ ID NO: 482056 - protein, 9 aa, Influenza virus
QNVPVTQTM

SEQ ID NO: 482057 - protein, 9 aa, Influenza virus
QNVPVTQVE

SEQ ID NO: 482058 - protein, 9 aa, Influenza virus
QNVSKYAFG

SEQ ID NO: 482059 - protein, 9 aa, Influenza virus
QNVSPIWIG

SEQ ID NO: 482060 - protein, 9 aa, Influenza virus
QNVSPLWIG

SEQ ID NO: 482061 - protein, 9 aa, Influenza virus
QNVSPLWVG

SEQ ID NO: 482062 - protein, 9 aa, Influenza virus
QNVSPVWIG

SEQ ID NO: 482063 - protein, 9 aa, Influenza virus
QNVSRIAIG

SEQ ID NO: 482064 - protein, 9 aa, Influenza virus
QNVSRYAFG

SEQ ID NO: 482065 - protein, 9 aa, Influenza virus
QNVTVTHAK

SEQ ID NO: 482066 - protein, 9 aa, Influenza virus
QNWSGYSGA

SEQ ID NO: 482067 - protein, 9 aa, Influenza virus
QNWSGYSGS

SEQ ID NO: 482068 - protein, 9 aa, Influenza virus
QPAATALAN

SEQ ID NO: 482069 - protein, 9 aa, Influenza virus
QPAFSVQRN

SEQ ID NO: 482070 - protein, 9 aa, Influenza virus
QPCFYIELI

SEQ ID NO: 482071 - protein, 9 aa, Influenza virus
QPCFYVELI

SEQ ID NO: 482072 - protein, 9 aa, Influenza virus
QPCFYVELT

SEQ ID NO: 482073 - protein, 9 aa, Influenza virus
QPEWFRNIL

SEQ ID NO: 482074 - protein, 9 aa, Influenza virus
QPEWFRNVL

SEQ ID NO: 482075 - protein, 9 aa, Influenza virus
QPGDNIIFS

SEQ ID NO: 482076 - protein, 9 aa, Influenza virus
QPGDNITFS

SEQ ID NO: 482077 - protein, 9 aa, Influenza virus
QPGWFRNVL

SEQ ID NO: 482078 - protein, 9 aa, Influenza virus
QPISLGDCS

SEQ ID NO: 482079 - protein, 9 aa, Influenza virus
QPKEKAIWT

SEQ ID NO: 482080 - protein, 9 aa, Influenza virus
QPKEKTIWT

SEQ ID NO: 482081 - protein, 9 aa, Influenza virus
QPKWFRNVL

SEQ ID NO: 482082 - protein, 9 aa, Influenza virus
QPLSISVGS

SEQ ID NO: 482083 - protein, 9 aa, Influenza virus
QPNDGQVLY

SEQ ID NO: 482084 - protein, 9 aa, Influenza virus
QPNERTIWT

SEQ ID NO: 482085 - protein, 9 aa, Influenza virus
QPNIGPRAL

SEQ ID NO: 482086 - protein, 9 aa, Influenza virus
QPNIGPRPL

SEQ ID NO: 482087 - protein, 9 aa, Influenza virus
QPTFSVQRN

SEQ ID NO: 482088 - protein, 9 aa, Influenza virus
QPTFSVQRS

SEQ ID NO: 482089 - protein, 9 aa, Influenza virus
QQETRVWWT

SEQ ID NO: 482090 - protein, 9 aa, Influenza virus
QQFELIDNE

SEQ ID NO: 482091 - protein, 9 aa, Influenza virus
QQFELIDNK

SEQ ID NO: 482092 - protein, 9 aa, Influenza virus
QQFELIDSE

SEQ ID NO: 482093 - protein, 9 aa, Influenza virus
QQFELINNE

SEQ ID NO: 482094 - protein, 9 aa, Influenza virus
QQFEMIDNE

SEQ ID NO: 482095 - protein, 9 aa, Influenza virus
QQFKLIDNE

SEQ ID NO: 482096 - protein, 9 aa, Influenza virus
QQGRMDYYW

SEQ ID NO: 482097 - protein, 9 aa, Influenza virus
QQGTMDYYW

SEQ ID NO: 482098 - protein, 9 aa, Influenza virus
QQGWMDYYW

SEQ ID NO: 482099 - protein, 9 aa, Influenza virus
QQIESIIEA

SEQ ID NO: 482100 - protein, 9 aa, Influenza virus
QQIESMIEA

SEQ ID NO: 482101 - protein, 9 aa, Influenza virus
QQIESMVEA

SEQ ID NO: 482102 - protein, 9 aa, Influenza virus
QQIGNVINC

SEQ ID NO: 482103 - protein, 9 aa, Influenza virus
QQIGNVINW

SEQ ID NO: 482104 - protein, 9 aa, Influenza virus
QQMRDILGT

SEQ ID NO: 482105 - protein, 9 aa, Influenza virus
QQMRDVLGT

SEQ ID NO: 482106 - protein, 9 aa, Influenza virus
QQSFSPSPG

SEQ ID NO: 482107 - protein, 9 aa, Influenza virus
QQSFTPSPG

SEQ ID NO: 482108 - protein, 9 aa, Influenza virus
QQSFVPSPG

SEQ ID NO: 482109 - protein, 9 aa, Influenza virus
QQTRVDKLT

SEQ ID NO: 482110 - protein, 9 aa, Influenza virus
QQTRVDRLT

SEQ ID NO: 482111 - protein, 9 aa, Influenza virus
QQVCIAWSS

SEQ ID NO: 482112 - protein, 9 aa, Influenza virus
QRAIDGVTN

SEQ ID NO: 482113 - protein, 9 aa, Influenza virus
QRAIDNMQN

SEQ ID NO: 482114 - protein, 9 aa, Influenza virus
QRAMMDQVR

SEQ ID NO: 482115 - protein, 9 aa, Influenza virus
QRAMVDQVR

SEQ ID NO: 482116 - protein, 9 aa, Influenza virus
QRCCNLFEK

SEQ ID NO: 482117 - protein, 9 aa, Influenza virus
QRFRRPDSS

SEQ ID NO: 482118 - protein, 9 aa, Influenza virus
QRGILEDEQ

SEQ ID NO: 482119 - protein, 9 aa, Influenza virus
QRGNIRCNI

SEQ ID NO: 482120 - protein, 9 aa, Influenza virus
QRGRIDFHW

SEQ ID NO: 482121 - protein, 9 aa, Influenza virus
QRGVLEDEQ

SEQ ID NO: 482122 - protein, 9 aa, Influenza virus
QRINGVKLE

SEQ ID NO: 482123 - protein, 9 aa, Influenza virus
QRINMLADR

SEQ ID NO: 482124 - protein, 9 aa, Influenza virus
QRKRRIRDN

SEQ ID NO: 482125 - protein, 9 aa, Influenza virus
QRKRRVRDN

SEQ ID NO: 482126 - protein, 9 aa, Influenza virus
QRLEDVFAG

SEQ ID NO: 482127 - protein, 9 aa, Influenza virus
QRLEGVFAG

SEQ ID NO: 482128 - protein, 9 aa, Influenza virus
QRLENVFAG

SEQ ID NO: 482129 - protein, 9 aa, Influenza virus
QRLESVFAG

SEQ ID NO: 482130 - protein, 9 aa, Influenza virus
QRLNPMHQL

SEQ ID NO: 482131 - protein, 9 aa, Influenza virus
QRLNTMHQL

SEQ ID NO: 482132 - protein, 9 aa, Influenza virus
QRRRFIQNA

SEQ ID NO: 482133 - protein, 9 aa, Influenza virus
QRRRFVQNA

SEQ ID NO: 482134 - protein, 9 aa, Influenza virus
QRSKFLLMD

SEQ ID NO: 482135 - protein, 9 aa, Influenza virus
QRSWMKIYW

SEQ ID NO: 482136 - protein, 9 aa, Influenza virus
QRSWMKLYW

SEQ ID NO: 482137 - protein, 9 aa, Influenza virus
QRTIGKKKH

SEQ ID NO: 482138 - protein, 9 aa, Influenza virus
QRTIGKKKQ

SEQ ID NO: 482139 - protein, 9 aa, Influenza virus
QRTIGKRKQ

SEQ ID NO: 482140 - protein, 9 aa, Influenza virus
QRTMGKKKQ

SEQ ID NO: 482141 - protein, 9 aa, Influenza virus
QRTRALVRS

SEQ ID NO: 482142 - protein, 9 aa, Influenza virus
QRTRALVRT

SEQ ID NO: 482143 - protein, 9 aa, Influenza virus
QRTVGKKKQ

SEQ ID NO: 482144 - protein, 9 aa, Influenza virus
QRWSYIVER

SEQ ID NO: 482145 - protein, 9 aa, Influenza virus
QSAIDQITG

SEQ ID NO: 482146 - protein, 9 aa, Influenza virus
QSAIDQITR

SEQ ID NO: 482147 - protein, 9 aa, Influenza virus
QSAIDQVTG

SEQ ID NO: 482148 - protein, 9 aa, Influenza virus
QSAINQITG

SEQ ID NO: 482149 - protein, 9 aa, Influenza virus
QSAVDQITG

SEQ ID NO: 482150 - protein, 9 aa, Influenza virus
QSCFYVELI

SEQ ID NO: 482151 - protein, 9 aa, Influenza virus
QSDAQIDES

SEQ ID NO: 482152 - protein, 9 aa, Influenza virus
QSDKPFQNV

SEQ ID NO: 482153 - protein, 9 aa, Influenza virus
QSEFNKACE

SEQ ID NO: 482154 - protein, 9 aa, Influenza virus
QSEIGGINT

SEQ ID NO: 482155 - protein, 9 aa, Influenza virus
QSEIGGIST

SEQ ID NO: 482156 - protein, 9 aa, Influenza virus
QSEIGWINT

SEQ ID NO: 482157 - protein, 9 aa, Influenza virus
QSERGEDTI

SEQ ID NO: 482158 - protein, 9 aa, Influenza virus
QSERGEETI

SEQ ID NO: 482159 - protein, 9 aa, Influenza virus
QSERGEETV

SEQ ID NO: 482160 - protein, 9 aa, Influenza virus
QSFPQTTNT

SEQ ID NO: 482161 - protein, 9 aa, Influenza virus
QSFSPSPGA

SEQ ID NO: 482162 - protein, 9 aa, Influenza virus
QSFSPSPGD

SEQ ID NO: 482163 - protein, 9 aa, Influenza virus
QSFTPSPGA

SEQ ID NO: 482164 - protein, 9 aa, Influenza virus
QSFTPSPGT

SEQ ID NO: 482165 - protein, 9 aa, Influenza virus
QSFVPSPGA

SEQ ID NO: 482166 - protein, 9 aa, Influenza virus
QSFVPSPGS

SEQ ID NO: 482167 - protein, 9 aa, Influenza virus
QSFVPSPGV

SEQ ID NO: 482168 - protein, 9 aa, Influenza virus
QSFYRSINW

SEQ ID NO: 482169 - protein, 9 aa, Influenza virus
QSGHIEECS

SEQ ID NO: 482170 - protein, 9 aa, Influenza virus
QSGLPVGGN

SEQ ID NO: 482171 - protein, 9 aa, Influenza virus
QSGRIDFHW

SEQ ID NO: 482172 - protein, 9 aa, Influenza virus
QSGRIDFYW

SEQ ID NO: 482173 - protein, 9 aa, Influenza virus
QSGRIEFHW

SEQ ID NO: 482174 - protein, 9 aa, Influenza virus
QSGRINFHW

SEQ ID NO: 482175 - protein, 9 aa, Influenza virus
QSGRISFYW

SEQ ID NO: 482176 - protein, 9 aa, Influenza virus
QSGRISIYW

SEQ ID NO: 482177 - protein, 9 aa, Influenza virus
QSGRIVFHW

SEQ ID NO: 482178 - protein, 9 aa, Influenza virus
QSGRVSFYW

SEQ ID NO: 482179 - protein, 9 aa, Influenza virus
QSKGLFGAI

SEQ ID NO: 482180 - protein, 9 aa, Influenza virus
QSKMQFSSL

SEQ ID NO: 482181 - protein, 9 aa, Influenza virus
QSLIIAARN

SEQ ID NO: 482182 - protein, 9 aa, Influenza virus
QSLIIAARS

SEQ ID NO: 482183 - protein, 9 aa, Influenza virus
QSLPPNFPS

SEQ ID NO: 482184 - protein, 9 aa, Influenza virus
QSLPPNFSC

SEQ ID NO: 482185 - protein, 9 aa, Influenza virus
QSLPPNFSS

SEQ ID NO: 482186 - protein, 9 aa, Influenza virus
QSLQQIESI

SEQ ID NO: 482187 - protein, 9 aa, Influenza virus
QSLQQIESM

SEQ ID NO: 482188 - protein, 9 aa, Influenza virus
QSLRSILAN

SEQ ID NO: 482189 - protein, 9 aa, Influenza virus
QSLRSILAS

SEQ ID NO: 482190 - protein, 9 aa, Influenza virus
QSLSISIGS

SEQ ID NO: 482191 - protein, 9 aa, Influenza virus
QSLSISVES

SEQ ID NO: 482192 - protein, 9 aa, Influenza virus
QSLSISVGS

SEQ ID NO: 482193 - protein, 9 aa, Influenza virus
QSLVIAARN

SEQ ID NO: 482194 - protein, 9 aa, Influenza virus
QSNNSTDTV

SEQ ID NO: 482195 - protein, 9 aa, Influenza virus
QSNNSTNTV

SEQ ID NO: 482196 - protein, 9 aa, Influenza virus
QSPLGAINT

SEQ ID NO: 482197 - protein, 9 aa, Influenza virus
QSPNVYQAK

SEQ ID NO: 482198 - protein, 9 aa, Influenza virus
QSPNVYQAR

SEQ ID NO: 482199 - protein, 9 aa, Influenza virus
QSPNVYQSR

SEQ ID NO: 482200 - protein, 9 aa, Influenza virus
QSPRMFLAM

SEQ ID NO: 482201 - protein, 9 aa, Influenza virus
QSRFEAVAW

SEQ ID NO: 482202 - protein, 9 aa, Influenza virus
QSRGLFGAI

SEQ ID NO: 482203 - protein, 9 aa, Influenza virus
QSRMQFSSL

SEQ ID NO: 482204 - protein, 9 aa, Influenza virus
QSRTREILT

SEQ ID NO: 482205 - protein, 9 aa, Influenza virus
QSRTRGILT

SEQ ID NO: 482206 - protein, 9 aa, Influenza virus
QSSDDFALI

SEQ ID NO: 482207 - protein, 9 aa, Influenza virus
QSSLPLALG

SEQ ID NO: 482208 - protein, 9 aa, Influenza virus
QSSPPTVYN

SEQ ID NO: 482209 - protein, 9 aa, Influenza virus
QSTLKLATG

SEQ ID NO: 482210 - protein, 9 aa, Influenza virus
QSTNSTEAV

SEQ ID NO: 482211 - protein, 9 aa, Influenza virus
QSTNSTETV

SEQ ID NO: 482212 - protein, 9 aa, Influenza virus
QSWSCIVER

SEQ ID NO: 482213 - protein, 9 aa, Influenza virus
QSWSYIVER

SEQ ID NO: 482214 - protein, 9 aa, Influenza virus
QSWSYVVER

SEQ ID NO: 482215 - protein, 9 aa, Influenza virus
QSYFQLFLV

SEQ ID NO: 482216 - protein, 9 aa, Influenza virus
QTAAQKAMM

SEQ ID NO: 482217 - protein, 9 aa, Influenza virus
QTAAQRAMM

SEQ ID NO: 482218 - protein, 9 aa, Influenza virus
QTAAQRAMV

SEQ ID NO: 482219 - protein, 9 aa, Influenza virus
QTAIDQING

SEQ ID NO: 482220 - protein, 9 aa, Influenza virus
QTAIDQITG

SEQ ID NO: 482221 - protein, 9 aa, Influenza virus
QTALYKNAN

SEQ ID NO: 482222 - protein, 9 aa, Influenza virus
QTANTYRNT

SEQ ID NO: 482223 - protein, 9 aa, Influenza virus
QTATKRIRM

SEQ ID NO: 482224 - protein, 9 aa, Influenza virus
QTATKRLRM

SEQ ID NO: 482225 - protein, 9 aa, Influenza virus
QTDCVLEAM

SEQ ID NO: 482226 - protein, 9 aa, Influenza virus
QTDEYKNTG

SEQ ID NO: 482227 - protein, 9 aa, Influenza virus
QTDEYKNTR

SEQ ID NO: 482228 - protein, 9 aa, Influenza virus
QTDLYKVAT

SEQ ID NO: 482229 - protein, 9 aa, Influenza virus
QTEIGGINT

SEQ ID NO: 482230 - protein, 9 aa, Influenza virus
QTESRGLFG

SEQ ID NO: 482231 - protein, 9 aa, Influenza virus
QTEVGGINT

SEQ ID NO: 482232 - protein, 9 aa, Influenza virus
QTFDWTLNR

SEQ ID NO: 482233 - protein, 9 aa, Influenza virus
QTGRIDFHW

SEQ ID NO: 482234 - protein, 9 aa, Influenza virus
QTIINNYHN

SEQ ID NO: 482235 - protein, 9 aa, Influenza virus
QTIINNYYN

SEQ ID NO: 482236 - protein, 9 aa, Influenza virus
QTIVLNTDW

SEQ ID NO: 482237 - protein, 9 aa, Influenza virus
QTIVSNTDW

SEQ ID NO: 482238 - protein, 9 aa, Influenza virus
QTKKMTITF

SEQ ID NO: 482239 - protein, 9 aa, Influenza virus
QTKLYGNGN

SEQ ID NO: 482240 - protein, 9 aa, Influenza virus
QTKLYGSGN

SEQ ID NO: 482241 - protein, 9 aa, Influenza virus
QTKLYGSGS

SEQ ID NO: 482242 - protein, 9 aa, Influenza virus
QTKLYKNTN

SEQ ID NO: 482243 - protein, 9 aa, Influenza virus
QTKRSFELK

SEQ ID NO: 482244 - protein, 9 aa, Influenza virus
QTKTMTITF

SEQ ID NO: 482245 - protein, 9 aa, Influenza virus
QTLRIRSNE

SEQ ID NO: 482246 - protein, 9 aa, Influenza virus
QTLRIRSNG

SEQ ID NO: 482247 - protein, 9 aa, Influenza virus
QTLRVKSNG

SEQ ID NO: 482248 - protein, 9 aa, Influenza virus
QTLRVRSDG

SEQ ID NO: 482249 - protein, 9 aa, Influenza virus
QTLRVRSNG

SEQ ID NO: 482250 - protein, 9 aa, Influenza virus
QTLVANNDW

SEQ ID NO: 482251 - protein, 9 aa, Influenza virus
QTLVSNDDW

SEQ ID NO: 482252 - protein, 9 aa, Influenza virus
QTLVSNNDW

SEQ ID NO: 482253 - protein, 9 aa, Influenza virus
QTLVSNSDW

SEQ ID NO: 482254 - protein, 9 aa, Influenza virus
QTMELVEAE

SEQ ID NO: 482255 - protein, 9 aa, Influenza virus
QTMELVETE

SEQ ID NO: 482256 - protein, 9 aa, Influenza virus
QTMELVETK

SEQ ID NO: 482257 - protein, 9 aa, Influenza virus
QTNGNLIAP

SEQ ID NO: 482258 - protein, 9 aa, Influenza virus
QTNNSTDTV

SEQ ID NO: 482259 - protein, 9 aa, Influenza virus
QTNNSTETV

SEQ ID NO: 482260 - protein, 9 aa, Influenza virus
QTPIGAINS

SEQ ID NO: 482261 - protein, 9 aa, Influenza virus
QTPLGAINS

SEQ ID NO: 482262 - protein, 9 aa, Influenza virus
QTPLGAINT

SEQ ID NO: 482263 - protein, 9 aa, Influenza virus
QTPLGALNT

SEQ ID NO: 482264 - protein, 9 aa, Influenza virus
QTPMGAINS

SEQ ID NO: 482265 - protein, 9 aa, Influenza virus
QTPMGAVNS

SEQ ID NO: 482266 - protein, 9 aa, Influenza virus
QTPVGAINS

SEQ ID NO: 482267 - protein, 9 aa, Influenza virus
QTRGIFGAI

SEQ ID NO: 482268 - protein, 9 aa, Influenza virus
QTRGLFGAI

SEQ ID NO: 482269 - protein, 9 aa, Influenza virus
QTRRAFELK

SEQ ID NO: 482270 - protein, 9 aa, Influenza virus
QTRRSFEIK

SEQ ID NO: 482271 - protein, 9 aa, Influenza virus
QTRRSFELK

SEQ ID NO: 482272 - protein, 9 aa, Influenza virus
QTRRSFELR

SEQ ID NO: 482273 - protein, 9 aa, Influenza virus
QTRVDKLTQ

SEQ ID NO: 482274 - protein, 9 aa, Influenza virus
QTRVDRLTQ

SEQ ID NO: 482275 - protein, 9 aa, Influenza virus
QTSGNLIAP

SEQ ID NO: 482276 - protein, 9 aa, Influenza virus
QTSIVPNIG

SEQ ID NO: 482277 - protein, 9 aa, Influenza virus
QTSLLLATG

SEQ ID NO: 482278 - protein, 9 aa, Influenza virus
QTSVGGIDT

SEQ ID NO: 482279 - protein, 9 aa, Influenza virus
QTSVGGINT

SEQ ID NO: 482280 - protein, 9 aa, Influenza virus
QTSVIPNIG

SEQ ID NO: 482281 - protein, 9 aa, Influenza virus
QTSVVPDIG

SEQ ID NO: 482282 - protein, 9 aa, Influenza virus
QTSVVPNID

SEQ ID NO: 482283 - protein, 9 aa, Influenza virus
QTSVVPNIG

SEQ ID NO: 482284 - protein, 9 aa, Influenza virus
QTTLYKNAN

SEQ ID NO: 482285 - protein, 9 aa, Influenza virus
QTTNTYRNT

SEQ ID NO: 482286 - protein, 9 aa, Influenza virus
QTVINNYYN

SEQ ID NO: 482287 - protein, 9 aa, Influenza virus
QTVKIKTNG

SEQ ID NO: 482288 - protein, 9 aa, Influenza virus
QTVKIQTNG

SEQ ID NO: 482289 - protein, 9 aa, Influenza virus
QTVKIQTSG

SEQ ID NO: 482290 - protein, 9 aa, Influenza virus
QTVVLNTDW

SEQ ID NO: 482291 - protein, 9 aa, Influenza virus
QTYAGAINS

SEQ ID NO: 482292 - protein, 9 aa, Influenza virus
QTYAGAVNS

SEQ ID NO: 482293 - protein, 9 aa, Influenza virus
QTYDWTLNR

SEQ ID NO: 482294 - protein, 9 aa, Influenza virus
QTYQKRMGV

SEQ ID NO: 482295 - protein, 9 aa, Influenza virus
QTYRNNRKE

SEQ ID NO: 482296 - protein, 9 aa, Influenza virus
QTYRNTRKE

SEQ ID NO: 482297 - protein, 9 aa, Influenza virus
QTYTGAINS

SEQ ID NO: 482298 - protein, 9 aa, Influenza virus
QVAGSSEQA

SEQ ID NO: 482299 - protein, 9 aa, Influenza virus
QVCAAWSSS

SEQ ID NO: 482300 - protein, 9 aa, Influenza virus
QVCIAWSSA

SEQ ID NO: 482301 - protein, 9 aa, Influenza virus
QVCIAWSSS

SEQ ID NO: 482302 - protein, 9 aa, Influenza virus
QVCMAWSSS

SEQ ID NO: 482303 - protein, 9 aa, Influenza virus
QVCVAWSSS

SEQ ID NO: 482304 - protein, 9 aa, Influenza virus
QVDCFIWHI

SEQ ID NO: 482305 - protein, 9 aa, Influenza virus
QVDCFLWHI

SEQ ID NO: 482306 - protein, 9 aa, Influenza virus
QVDCFLWHV

SEQ ID NO: 482307 - protein, 9 aa, Influenza virus
QVDCFLWYV

SEQ ID NO: 482308 - protein, 9 aa, Influenza virus
QVDCYLWHI

SEQ ID NO: 482309 - protein, 9 aa, Influenza virus
QVDGQSGRI

SEQ ID NO: 482310 - protein, 9 aa, Influenza virus
QVDTIMEKI

SEQ ID NO: 482311 - protein, 9 aa, Influenza virus
QVDTIMEKN

SEQ ID NO: 482312 - protein, 9 aa, Influenza virus
QVDTIMERN

SEQ ID NO: 482313 - protein, 9 aa, Influenza virus
QVDTIVEKN

SEQ ID NO: 482314 - protein, 9 aa, Influenza virus
QVECVCRDN

SEQ ID NO: 482315 - protein, 9 aa, Influenza virus
QVEELVHGG

SEQ ID NO: 482316 - protein, 9 aa, Influenza virus
QVEELVHGQ

SEQ ID NO: 482317 - protein, 9 aa, Influenza virus
QVEELVHRG

SEQ ID NO: 482318 - protein, 9 aa, Influenza virus
QVEGRIQDL

SEQ ID NO: 482319 - protein, 9 aa, Influenza virus
QVEGRIQYL

SEQ ID NO: 482320 - protein, 9 aa, Influenza virus
QVEGRTQDL

SEQ ID NO: 482321 - protein, 9 aa, Influenza virus
QVEKRINMI

SEQ ID NO: 482322 - protein, 9 aa, Influenza virus
QVEKRINML

SEQ ID NO: 482323 - protein, 9 aa, Influenza virus
QVENRINML

SEQ ID NO: 482324 - protein, 9 aa, Influenza virus
QVEQRINML

SEQ ID NO: 482325 - protein, 9 aa, Influenza virus
QVERRINML

SEQ ID NO: 482326 - protein, 9 aa, Influenza virus
QVESMIEAE

SEQ ID NO: 482327 - protein, 9 aa, Influenza virus
QVEVTNATE

SEQ ID NO: 482328 - protein, 9 aa, Influenza virus
QVFPQLNQT

SEQ ID NO: 482329 - protein, 9 aa, Influenza virus
QVIKLLPFA

SEQ ID NO: 482330 - protein, 9 aa, Influenza virus
QVIVDNNNW

SEQ ID NO: 482331 - protein, 9 aa, Influenza virus
QVIVDNNSW

SEQ ID NO: 482332 - protein, 9 aa, Influenza virus
QVIVDNSNW

SEQ ID NO: 482333 - protein, 9 aa, Influenza virus
QVIVTREPY

SEQ ID NO: 482334 - protein, 9 aa, Influenza virus
QVKIRRRVD

SEQ ID NO: 482335 - protein, 9 aa, Influenza virus
QVKLSSGYK

SEQ ID NO: 482336 - protein, 9 aa, Influenza virus
QVLAIYATV

SEQ ID NO: 482337 - protein, 9 aa, Influenza virus
QVLRESGGI

SEQ ID NO: 482338 - protein, 9 aa, Influenza virus
QVMVDNNNW

SEQ ID NO: 482339 - protein, 9 aa, Influenza virus
QVNGQFGRI

SEQ ID NO: 482340 - protein, 9 aa, Influenza virus
QVNGQSGRI

SEQ ID NO: 482341 - protein, 9 aa, Influenza virus
QVNGQSGRV

SEQ ID NO: 482342 - protein, 9 aa, Influenza virus
QVNGQTGRI

SEQ ID NO: 482343 - protein, 9 aa, Influenza virus
QVQDRGLFG

SEQ ID NO: 482344 - protein, 9 aa, Influenza virus
QVQNRGLFG

SEQ ID NO: 482345 - protein, 9 aa, Influenza virus
QVREGRNPG

SEQ ID NO: 482346 - protein, 9 aa, Influenza virus
QVRESRNPG

SEQ ID NO: 482347 - protein, 9 aa, Influenza virus
QVTDIWAYN

SEQ ID NO: 482348 - protein, 9 aa, Influenza virus
QVTGKLNRL

SEQ ID NO: 482349 - protein, 9 aa, Influenza virus
QWDWPDGAK

SEQ ID NO: 482350 - protein, 9 aa, Influenza virus
QWNWPDGAE

SEQ ID NO: 482351 - protein, 9 aa, Influenza virus
QWNWPDGAK

SEQ ID NO: 482352 - protein, 9 aa, Influenza virus
QYICSPVLT

SEQ ID NO: 482353 - protein, 9 aa, Influenza virus
QYLCTGILT

SEQ ID NO: 482354 - protein, 9 aa, Influenza virus
QYLCTGVLT

SEQ ID NO: 482355 - protein, 9 aa, Influenza virus
QYLEKYVED

SEQ ID NO: 482356 - protein, 9 aa, Influenza virus
QYLLFQDIL

SEQ ID NO: 482357 - protein, 9 aa, Influenza virus
QYPNVRCVC

SEQ ID NO: 482358 - protein, 9 aa, Influenza virus
QYRAESLQN

SEQ ID NO: 482359 - protein, 9 aa, Influenza virus
QYRALISWP

SEQ ID NO: 482360 - protein, 9 aa, Influenza virus
QYRALVSWP

SEQ ID NO: 482361 - protein, 9 aa, Influenza virus
QYREEALLN

SEQ ID NO: 482362 - protein, 9 aa, Influenza virus
QYREESLLN

SEQ ID NO: 482363 - protein, 9 aa, Influenza virus
QYRSLISWP

SEQ ID NO: 482364 - protein, 9 aa, Influenza virus
QYRTESLQN

SEQ ID NO: 482365 - protein, 9 aa, Influenza virus
QYRTGSLQN

SEQ ID NO: 482366 - protein, 9 aa, Influenza virus
QYSGFVRTL

SEQ ID NO: 482367 - protein, 9 aa, Influenza virus
RAAFRGLIS

SEQ ID NO: 482368 - protein, 9 aa, Influenza virus
RAAVSADPL

SEQ ID NO: 482369 - protein, 9 aa, Influenza virus
RACFYVELI

SEQ ID NO: 482370 - protein, 9 aa, Influenza virus
RADEICIGY

SEQ ID NO: 482371 - protein, 9 aa, Influenza virus
RADKICIGY

SEQ ID NO: 482372 - protein, 9 aa, Influenza virus
RADTKILFI

SEQ ID NO: 482373 - protein, 9 aa, Influenza virus
RADTRILFI

SEQ ID NO: 482374 - protein, 9 aa, Influenza virus
RAESLQNRI

SEQ ID NO: 482375 - protein, 9 aa, Influenza virus
RAGYEMLKV

SEQ ID NO: 482376 - protein, 9 aa, Influenza virus
RAGYETFKV

SEQ ID NO: 482377 - protein, 9 aa, Influenza virus
RAGYETFRV

SEQ ID NO: 482378 - protein, 9 aa, Influenza virus
RAIATPGMQ

SEQ ID NO: 482379 - protein, 9 aa, Influenza virus
RAIDGVTNK

SEQ ID NO: 482380 - protein, 9 aa, Influenza virus
RAIDNMQNK

SEQ ID NO: 482381 - protein, 9 aa, Influenza virus
RAIVSADPL

SEQ ID NO: 482382 - protein, 9 aa, Influenza virus
RALISWEMG

SEQ ID NO: 482383 - protein, 9 aa, Influenza virus
RALISWGMG

SEQ ID NO: 482384 - protein, 9 aa, Influenza virus
RALISWPLS

SEQ ID NO: 482385 - protein, 9 aa, Influenza virus
RALISWPQS

SEQ ID NO: 482386 - protein, 9 aa, Influenza virus
RALMSCPIG

SEQ ID NO: 482387 - protein, 9 aa, Influenza virus
RALMSCPLG

SEQ ID NO: 482388 - protein, 9 aa, Influenza virus
RALMSCPVG

SEQ ID NO: 482389 - protein, 9 aa, Influenza virus
RALMSVPLG

SEQ ID NO: 482390 - protein, 9 aa, Influenza virus
RALMSVPMG

SEQ ID NO: 482391 - protein, 9 aa, Influenza virus
RALSIYSCI

SEQ ID NO: 482392 - protein, 9 aa, Influenza virus
RALTLNTMT

SEQ ID NO: 482393 - protein, 9 aa, Influenza virus
RALVRGQQG

SEQ ID NO: 482394 - protein, 9 aa, Influenza virus
RALVRSGMD

SEQ ID NO: 482395 - protein, 9 aa, Influenza virus
RALVRTGMD

SEQ ID NO: 482396 - protein, 9 aa, Influenza virus
RALVSWEMG

SEQ ID NO: 482397 - protein, 9 aa, Influenza virus
RALVSWPLS

SEQ ID NO: 482398 - protein, 9 aa, Influenza virus
RAMMDQVRE

SEQ ID NO: 482399 - protein, 9 aa, Influenza virus
RAMVDQVRE

SEQ ID NO: 482400 - protein, 9 aa, Influenza virus
RANQRLNPM

SEQ ID NO: 482401 - protein, 9 aa, Influenza virus
RANQRLNTM

SEQ ID NO: 482402 - protein, 9 aa, Influenza virus
RAPISLGDC

SEQ ID NO: 482403 - protein, 9 aa, Influenza virus
RAPYRSLIR

SEQ ID NO: 482404 - protein, 9 aa, Influenza virus
RARIDARID

SEQ ID NO: 482405 - protein, 9 aa, Influenza virus
RARIDARVD

SEQ ID NO: 482406 - protein, 9 aa, Influenza virus
RARIKTRLF

SEQ ID NO: 482407 - protein, 9 aa, Influenza virus
RARPQVNGQ

SEQ ID NO: 482408 - protein, 9 aa, Influenza virus
RATAIFRKA

SEQ ID NO: 482409 - protein, 9 aa, Influenza virus
RATAIIRKA

SEQ ID NO: 482410 - protein, 9 aa, Influenza virus
RATAILKKA

SEQ ID NO: 482411 - protein, 9 aa, Influenza virus
RATAILRKA

SEQ ID NO: 482412 - protein, 9 aa, Influenza virus
RATEYIMKG

SEQ ID NO: 482413 - protein, 9 aa, Influenza virus
RATEYMMKG

SEQ ID NO: 482414 - protein, 9 aa, Influenza virus
RATFLRSNA

SEQ ID NO: 482415 - protein, 9 aa, Influenza virus
RATVSADPL

SEQ ID NO: 482416 - protein, 9 aa, Influenza virus
RAVDGTIAG

SEQ ID NO: 482417 - protein, 9 aa, Influenza virus
RAVGKCPRY

SEQ ID NO: 482418 - protein, 9 aa, Influenza virus
RAVKLYKKL

SEQ ID NO: 482419 - protein, 9 aa, Influenza virus
RAVKLYRKL

SEQ ID NO: 482420 - protein, 9 aa, Influenza virus
RAWLHVCVT

SEQ ID NO: 482421 - protein, 9 aa, Influenza virus
RAYVDGFEP

SEQ ID NO: 482422 - protein, 9 aa, Influenza virus
RAYVDGFKP

SEQ ID NO: 482423 - protein, 9 aa, Influenza virus
RCCNLFEKF

SEQ ID NO: 482424 - protein, 9 aa, Influenza virus
RCDDQCMES

SEQ ID NO: 482425 - protein, 9 aa, Influenza virus
RCFYVELIR

SEQ ID NO: 482426 - protein, 9 aa, Influenza virus
RCFYVELVR

SEQ ID NO: 482427 - protein, 9 aa, Influenza virus
RCHKGDTQI

SEQ ID NO: 482428 - protein, 9 aa, Influenza virus
RCHRGDAQI

SEQ ID NO: 482429 - protein, 9 aa, Influenza virus
RCHRGDMQI

SEQ ID NO: 482430 - protein, 9 aa, Influenza virus
RCHRGDTHI

SEQ ID NO: 482431 - protein, 9 aa, Influenza virus
RCHRGDTQI

SEQ ID NO: 482432 - protein, 9 aa, Influenza virus
RCICEKLEQ

SEQ ID NO: 482433 - protein, 9 aa, Influenza virus
RCICRDNWK

SEQ ID NO: 482434 - protein, 9 aa, Influenza virus
RCINRCFYV

SEQ ID NO: 482435 - protein, 9 aa, Influenza virus
RCLLQSLQQ

SEQ ID NO: 482436 - protein, 9 aa, Influenza virus
RCMKTFFGW

SEQ ID NO: 482437 - protein, 9 aa, Influenza virus
RCNTKCQTS

SEQ ID NO: 482438 - protein, 9 aa, Influenza virus
RCNTRCQTS

SEQ ID NO: 482439 - protein, 9 aa, Influenza virus
RCPRYVKQS

SEQ ID NO: 482440 - protein, 9 aa, Influenza virus
RCQSEIGGI

SEQ ID NO: 482441 - protein, 9 aa, Influenza virus
RCQTPLGAI

SEQ ID NO: 482442 - protein, 9 aa, Influenza virus
RCQTSVGGI

SEQ ID NO: 482443 - protein, 9 aa, Influenza virus
RCQYSGFVR

SEQ ID NO: 482444 - protein, 9 aa, Influenza virus
RCRETRGLF

SEQ ID NO: 482445 - protein, 9 aa, Influenza virus
RCRKTRGLF

SEQ ID NO: 482446 - protein, 9 aa, Influenza virus
RCTCRDNWK

SEQ ID NO: 482447 - protein, 9 aa, Influenza virus
RCTISLVKT

SEQ ID NO: 482448 - protein, 9 aa, Influenza virus
RCVCRDNWK

SEQ ID NO: 482449 - protein, 9 aa, Influenza virus
RCVCRDNWM

SEQ ID NO: 482450 - protein, 9 aa, Influenza virus
RCVCRDNWR

SEQ ID NO: 482451 - protein, 9 aa, Influenza virus
RCYQFALGQ

SEQ ID NO: 482452 - protein, 9 aa, Influenza virus
RDAMTEIWS

SEQ ID NO: 482453 - protein, 9 aa, Influenza virus
RDAMTEVWS

SEQ ID NO: 482454 - protein, 9 aa, Influenza virus
RDCKIEAVI

SEQ ID NO: 482455 - protein, 9 aa, Influenza virus
RDCKVEAVI

SEQ ID NO: 482456 - protein, 9 aa, Influenza virus
RDCSIAGWL

SEQ ID NO: 482457 - protein, 9 aa, Influenza virus
RDCSVAGWL

SEQ ID NO: 482458 - protein, 9 aa, Influenza virus
RDEAINNRF

SEQ ID NO: 482459 - protein, 9 aa, Influenza virus
RDEAINNRI

SEQ ID NO: 482460 - protein, 9 aa, Influenza virus
RDEAINSRF

SEQ ID NO: 482461 - protein, 9 aa, Influenza virus
RDEAISNRF

SEQ ID NO: 482462 - protein, 9 aa, Influenza virus
RDEALNNRF

SEQ ID NO: 482463 - protein, 9 aa, Influenza virus
RDEALNNRS

SEQ ID NO: 482464 - protein, 9 aa, Influenza virus
RDEAVNNRF

SEQ ID NO: 482465 - protein, 9 aa, Influenza virus
RDEEGTGIA

SEQ ID NO: 482466 - protein, 9 aa, Influenza virus
RDEGNGCFT

SEQ ID NO: 482467 - protein, 9 aa, Influenza virus
RDILGTFDT

SEQ ID NO: 482468 - protein, 9 aa, Influenza virus
RDILRTQES

SEQ ID NO: 482469 - protein, 9 aa, Influenza virus
RDITIGSIC

SEQ ID NO: 482470 - protein, 9 aa, Influenza virus
RDLGNCHPI

SEQ ID NO: 482471 - protein, 9 aa, Influenza virus
RDNAKDEGN

SEQ ID NO: 482472 - protein, 9 aa, Influenza virus
RDNAKDLGN

SEQ ID NO: 482473 - protein, 9 aa, Influenza virus
RDNAKEIGN

SEQ ID NO: 482474 - protein, 9 aa, Influenza virus
RDNAKELGN

SEQ ID NO: 482475 - protein, 9 aa, Influenza virus
RDNAMILGN

SEQ ID NO: 482476 - protein, 9 aa, Influenza virus
RDNANDLGN

SEQ ID NO: 482477 - protein, 9 aa, Influenza virus
RDNLEPGTF

SEQ ID NO: 482478 - protein, 9 aa, Influenza virus
RDNVKELGN

SEQ ID NO: 482479 - protein, 9 aa, Influenza virus
RDNWHASNR

SEQ ID NO: 482480 - protein, 9 aa, Influenza virus
RDNWHGSNR

SEQ ID NO: 482481 - protein, 9 aa, Influenza virus
RDNWKGANR

SEQ ID NO: 482482 - protein, 9 aa, Influenza virus
RDNWKGSNR

SEQ ID NO: 482483 - protein, 9 aa, Influenza virus
RDNWMGSNR

SEQ ID NO: 482484 - protein, 9 aa, Influenza virus
RDNWNGMNR

SEQ ID NO: 482485 - protein, 9 aa, Influenza virus
RDNWQGANR

SEQ ID NO: 482486 - protein, 9 aa, Influenza virus
RDNWQGSNR

SEQ ID NO: 482487 - protein, 9 aa, Influenza virus
RDNWRGANR

SEQ ID NO: 482488 - protein, 9 aa, Influenza virus
RDNWRGSNR

SEQ ID NO: 482489 - protein, 9 aa, Influenza virus
RDNWTGTNR

SEQ ID NO: 482490 - protein, 9 aa, Influenza virus
RDQGWSYIV

SEQ ID NO: 482491 - protein, 9 aa, Influenza virus
RDQKALKGR

SEQ ID NO: 482492 - protein, 9 aa, Influenza virus
RDQKSLKGR

SEQ ID NO: 482493 - protein, 9 aa, Influenza virus
RDQKSLRGR

SEQ ID NO: 482494 - protein, 9 aa, Influenza virus
RDQMAHCRM

SEQ ID NO: 482495 - protein, 9 aa, Influenza virus
RDQRALKGR

SEQ ID NO: 482496 - protein, 9 aa, Influenza virus
RDQRSLRGR

SEQ ID NO: 482497 - protein, 9 aa, Influenza virus
RDRTPYRSL

SEQ ID NO: 482498 - protein, 9 aa, Influenza virus
RDSIKSWRN

SEQ ID NO: 482499 - protein, 9 aa, Influenza virus
RDSITEVWS

SEQ ID NO: 482500 - protein, 9 aa, Influenza virus
RDSLEPGTF

SEQ ID NO: 482501 - protein, 9 aa, Influenza virus
RDSLTEIWS

SEQ ID NO: 482502 - protein, 9 aa, Influenza virus
RDSMTEIWS

SEQ ID NO: 482503 - protein, 9 aa, Influenza virus
RDSMTEVMV

SEQ ID NO: 482504 - protein, 9 aa, Influenza virus
RDSMTEVWS

SEQ ID NO: 482505 - protein, 9 aa, Influenza virus
RDSRSGYET

SEQ ID NO: 482506 - protein, 9 aa, Influenza virus
RDSSILTDS

SEQ ID NO: 482507 - protein, 9 aa, Influenza virus
RDSTQKAID

SEQ ID NO: 482508 - protein, 9 aa, Influenza virus
RDSTQMAID

SEQ ID NO: 482509 - protein, 9 aa, Influenza virus
RDSTQRAID

SEQ ID NO: 482510 - protein, 9 aa, Influenza virus
RDSVTELWS

SEQ ID NO: 482511 - protein, 9 aa, Influenza virus
RDVIGTFDT

SEQ ID NO: 482512 - protein, 9 aa, Influenza virus
RDVLGTFDT

SEQ ID NO: 482513 - protein, 9 aa, Influenza virus
RDVLVIWGI

SEQ ID NO: 482514 - protein, 9 aa, Influenza virus
RDVLVLWGI

SEQ ID NO: 482515 - protein, 9 aa, Influenza virus
RDVLVMWGI

SEQ ID NO: 482516 - protein, 9 aa, Influenza virus
RDVLVMWGL

SEQ ID NO: 482517 - protein, 9 aa, Influenza virus
RDVWTYNAE

SEQ ID NO: 482518 - protein, 9 aa, Influenza virus
RDWSKPQCQ

SEQ ID NO: 482519 - protein, 9 aa, Influenza virus
RDYFTAEVS

SEQ ID NO: 482520 - protein, 9 aa, Influenza virus
RECFNPCFY

SEQ ID NO: 482521 - protein, 9 aa, Influenza virus
REDKRYGPA

SEQ ID NO: 482522 - protein, 9 aa, Influenza virus
REEALLNRI

SEQ ID NO: 482523 - protein, 9 aa, Influenza virus
REEALLNRL

SEQ ID NO: 482524 - protein, 9 aa, Influenza virus
REEAMQNRI

SEQ ID NO: 482525 - protein, 9 aa, Influenza virus
REEAMQNRM

SEQ ID NO: 482526 - protein, 9 aa, Influenza virus
REEAMQNRV

SEQ ID NO: 482527 - protein, 9 aa, Influenza virus
REESLLNRL

SEQ ID NO: 482528 - protein, 9 aa, Influenza virus
REESQLKKQ

SEQ ID NO: 482529 - protein, 9 aa, Influenza virus
REESQLKRQ

SEQ ID NO: 482530 - protein, 9 aa, Influenza virus
REEVTNATE

SEQ ID NO: 482531 - protein, 9 aa, Influenza virus
REFEVMNHE

SEQ ID NO: 482532 - protein, 9 aa, Influenza virus
REFEVVDHE

SEQ ID NO: 482533 - protein, 9 aa, Influenza virus
REFEVVNHE

SEQ ID NO: 482534 - protein, 9 aa, Influenza virus
REFGVVNHE

SEQ ID NO: 482535 - protein, 9 aa, Influenza virus
REGKHIVER

SEQ ID NO: 482536 - protein, 9 aa, Influenza virus
REGLILEYY

SEQ ID NO: 482537 - protein, 9 aa, Influenza virus
REGRNPGNA

SEQ ID NO: 482538 - protein, 9 aa, Influenza virus
REGRRKTNL

SEQ ID NO: 482539 - protein, 9 aa, Influenza virus
REGYSLVGI

SEQ ID NO: 482540 - protein, 9 aa, Influenza virus
REHLSSVSS

SEQ ID NO: 482541 - protein, 9 aa, Influenza virus
REICIAWSS

SEQ ID NO: 482542 - protein, 9 aa, Influenza virus
REIHIYYLE

SEQ ID NO: 482543 - protein, 9 aa, Influenza virus
REILTKITV

SEQ ID NO: 482544 - protein, 9 aa, Influenza virus
REILTKTTV

SEQ ID NO: 482545 - protein, 9 aa, Influenza virus
REILTRTTV

SEQ ID NO: 482546 - protein, 9 aa, Influenza virus
REITFHGAK

SEQ ID NO: 482547 - protein, 9 aa, Influenza virus
REKDMTKEF

SEQ ID NO: 482548 - protein, 9 aa, Influenza virus
RELCTINSW

SEQ ID NO: 482549 - protein, 9 aa, Influenza virus
RELGNGCFE

SEQ ID NO: 482550 - protein, 9 aa, Influenza virus
RELVRKTRF

SEQ ID NO: 482551 - protein, 9 aa, Influenza virus
RELWQCYYL

SEQ ID NO: 482552 - protein, 9 aa, Influenza virus
REMTFHGAK

SEQ ID NO: 482553 - protein, 9 aa, Influenza virus
RENAEDIGN

SEQ ID NO: 482554 - protein, 9 aa, Influenza virus
RENAEDKGN

SEQ ID NO: 482555 - protein, 9 aa, Influenza virus
RENAEDLGN

SEQ ID NO: 482556 - protein, 9 aa, Influenza virus
RENAEDMGD

SEQ ID NO: 482557 - protein, 9 aa, Influenza virus
RENAEDMGG

SEQ ID NO: 482558 - protein, 9 aa, Influenza virus
RENAEDMGN

SEQ ID NO: 482559 - protein, 9 aa, Influenza virus
RENAEDQGN

SEQ ID NO: 482560 - protein, 9 aa, Influenza virus
RENAEDRGN

SEQ ID NO: 482561 - protein, 9 aa, Influenza virus
RENAEEDCT

SEQ ID NO: 482562 - protein, 9 aa, Influenza virus
RENAEEDGN

SEQ ID NO: 482563 - protein, 9 aa, Influenza virus
RENAEEDGT

SEQ ID NO: 482564 - protein, 9 aa, Influenza virus
REPFISCSH

SEQ ID NO: 482565 - protein, 9 aa, Influenza virus
REPFISCSI

SEQ ID NO: 482566 - protein, 9 aa, Influenza virus
REPFISCSP

SEQ ID NO: 482567 - protein, 9 aa, Influenza virus
REPFISCSQ

SEQ ID NO: 482568 - protein, 9 aa, Influenza virus
REPFISCSV

SEQ ID NO: 482569 - protein, 9 aa, Influenza virus
REPFVACGP

SEQ ID NO: 482570 - protein, 9 aa, Influenza virus
REPFVACSP

SEQ ID NO: 482571 - protein, 9 aa, Influenza virus
REPFVSCGP

SEQ ID NO: 482572 - protein, 9 aa, Influenza virus
REPFVSCSH

SEQ ID NO: 482573 - protein, 9 aa, Influenza virus
REPFVSCSI

SEQ ID NO: 482574 - protein, 9 aa, Influenza virus
REPFVSCSP

SEQ ID NO: 482575 - protein, 9 aa, Influenza virus
REPYISCDN

SEQ ID NO: 482576 - protein, 9 aa, Influenza virus
REPYLSCDP

SEQ ID NO: 482577 - protein, 9 aa, Influenza virus
REPYLSCGP

SEQ ID NO: 482578 - protein, 9 aa, Influenza virus
REPYVSCDN

SEQ ID NO: 482579 - protein, 9 aa, Influenza virus
REPYVSCDP

SEQ ID NO: 482580 - protein, 9 aa, Influenza virus
REPYVSCDS

SEQ ID NO: 482581 - protein, 9 aa, Influenza virus
REPYVSCDT

SEQ ID NO: 482582 - protein, 9 aa, Influenza virus
REPYVSCDY

SEQ ID NO: 482583 - protein, 9 aa, Influenza virus
REPYVSCEP

SEQ ID NO: 482584 - protein, 9 aa, Influenza virus
REPYVSCGP

SEQ ID NO: 482585 - protein, 9 aa, Influenza virus
REPYVSCNP

SEQ ID NO: 482586 - protein, 9 aa, Influenza virus
REPYVSCSL

SEQ ID NO: 482587 - protein, 9 aa, Influenza virus
REPYVSCSP

SEQ ID NO: 482588 - protein, 9 aa, Influenza virus
REQKQEFKM

SEQ ID NO: 482589 - protein, 9 aa, Influenza virus
REQLSQKFE

SEQ ID NO: 482590 - protein, 9 aa, Influenza virus
REQLSSVSS

SEQ ID NO: 482591 - protein, 9 aa, Influenza virus
REQLSTVSS

SEQ ID NO: 482592 - protein, 9 aa, Influenza virus
REQQGRMDY

SEQ ID NO: 482593 - protein, 9 aa, Influenza virus
REREGGRRR

SEQ ID NO: 482594 - protein, 9 aa, Influenza virus
RERLGSWSW

SEQ ID NO: 482595 - protein, 9 aa, Influenza virus
RESGGIDKE

SEQ ID NO: 482596 - protein, 9 aa, Influenza virus
RESRNPGNA

SEQ ID NO: 482597 - protein, 9 aa, Influenza virus
RETRGLFGA

SEQ ID NO: 482598 - protein, 9 aa, Influenza virus
REVCIAWSS

SEQ ID NO: 482599 - protein, 9 aa, Influenza virus
REVEVVNAT

SEQ ID NO: 482600 - protein, 9 aa, Influenza virus
REVHIYYLE

SEQ ID NO: 482601 - protein, 9 aa, Influenza virus
REVHMYYLE

SEQ ID NO: 482602 - protein, 9 aa, Influenza virus
REVHTYYLE

SEQ ID NO: 482603 - protein, 9 aa, Influenza virus
REVHVYYLE

SEQ ID NO: 482604 - protein, 9 aa, Influenza virus
REWSYIVER

SEQ ID NO: 482605 - protein, 9 aa, Influenza virus
REWSYLIED

SEQ ID NO: 482606 - protein, 9 aa, Influenza virus
RFADQELGD

SEQ ID NO: 482607 - protein, 9 aa, Influenza virus
RFEAVAWSA

SEQ ID NO: 482608 - protein, 9 aa, Influenza virus
RFEFIAEEF

SEQ ID NO: 482609 - protein, 9 aa, Influenza virus
RFEGWIVGN

SEQ ID NO: 482610 - protein, 9 aa, Influenza virus
RFEIIEGRD

SEQ ID NO: 482611 - protein, 9 aa, Influenza virus
RFESVAWSA

SEQ ID NO: 482612 - protein, 9 aa, Influenza virus
RFGEGEQII

SEQ ID NO: 482613 - protein, 9 aa, Influenza virus
RFGESEQII

SEQ ID NO: 482614 - protein, 9 aa, Influenza virus
RFGESEQIV

SEQ ID NO: 482615 - protein, 9 aa, Influenza virus
RFGESEQVI

SEQ ID NO: 482616 - protein, 9 aa, Influenza virus
RFIEIGVTR

SEQ ID NO: 482617 - protein, 9 aa, Influenza virus
RFIEKTNQQ

SEQ ID NO: 482618 - protein, 9 aa, Influenza virus
RFIQNALNG

SEQ ID NO: 482619 - protein, 9 aa, Influenza virus
RFLEIGVTR

SEQ ID NO: 482620 - protein, 9 aa, Influenza virus
RFLFSSIKK

SEQ ID NO: 482621 - protein, 9 aa, Influenza virus
RFLPDLYDY

SEQ ID NO: 482622 - protein, 9 aa, Influenza virus
RFLPVAGGT

SEQ ID NO: 482623 - protein, 9 aa, Influenza virus
RFLPVSGGT

SEQ ID NO: 482624 - protein, 9 aa, Influenza virus
RFLPVTGGT

SEQ ID NO: 482625 - protein, 9 aa, Influenza virus
RFLRVKDQQ

SEQ ID NO: 482626 - protein, 9 aa, Influenza virus
RFLRVRDQL

SEQ ID NO: 482627 - protein, 9 aa, Influenza virus
RFLRVRDQM

SEQ ID NO: 482628 - protein, 9 aa, Influenza virus
RFLRVRDQQ

SEQ ID NO: 482629 - protein, 9 aa, Influenza virus
RFLRVRDQR

SEQ ID NO: 482630 - protein, 9 aa, Influenza virus
RFNSDLDYQ

SEQ ID NO: 482631 - protein, 9 aa, Influenza virus
RFNSDPDYQ

SEQ ID NO: 482632 - protein, 9 aa, Influenza virus
RFNSNLDYQ

SEQ ID NO: 482633 - protein, 9 aa, Influenza virus
RFQIQGIKL

SEQ ID NO: 482634 - protein, 9 aa, Influenza virus
RFQIQGVKL

SEQ ID NO: 482635 - protein, 9 aa, Influenza virus
RFQIQGVRL

SEQ ID NO: 482636 - protein, 9 aa, Influenza virus
RFRRPDSSW

SEQ ID NO: 482637 - protein, 9 aa, Influenza virus
RFSYVFCLA

SEQ ID NO: 482638 - protein, 9 aa, Influenza virus
RFTEIGVTR

SEQ ID NO: 482639 - protein, 9 aa, Influenza virus
RFTNEEALR

SEQ ID NO: 482640 - protein, 9 aa, Influenza virus
RFTYSGIRT

SEQ ID NO: 482641 - protein, 9 aa, Influenza virus
RFVEIGVTR

SEQ ID NO: 482642 - protein, 9 aa, Influenza virus
RFVFSIAAS

SEQ ID NO: 482643 - protein, 9 aa, Influenza virus
RFVFSNAAS

SEQ ID NO: 482644 - protein, 9 aa, Influenza virus
RFVFSSAAS

SEQ ID NO: 482645 - protein, 9 aa, Influenza virus
RFVNSDCSK

SEQ ID NO: 482646 - protein, 9 aa, Influenza virus
RFVQNALNG

SEQ ID NO: 482647 - protein, 9 aa, Influenza virus
RFVQNALSG

SEQ ID NO: 482648 - protein, 9 aa, Influenza virus
RFYALSQGT

SEQ ID NO: 482649 - protein, 9 aa, Influenza virus
RFYIQMCTE

SEQ ID NO: 482650 - protein, 9 aa, Influenza virus
RFYRICKLV

SEQ ID NO: 482651 - protein, 9 aa, Influenza virus
RFYRTCKLL

SEQ ID NO: 482652 - protein, 9 aa, Influenza virus
RFYRTCKLV

SEQ ID NO: 482653 - protein, 9 aa, Influenza virus
RFYVQMCTE

SEQ ID NO: 482654 - protein, 9 aa, Influenza virus
RGANRPVIT

SEQ ID NO: 482655 - protein, 9 aa, Influenza virus
RGAYERMCN

SEQ ID NO: 482656 - protein, 9 aa, Influenza virus
RGCFEIYHK

SEQ ID NO: 482657 - protein, 9 aa, Influenza virus
RGDKICLGH

SEQ ID NO: 482658 - protein, 9 aa, Influenza virus
RGDLNFVNR

SEQ ID NO: 482659 - protein, 9 aa, Influenza virus
RGDNGRRTR

SEQ ID NO: 482660 - protein, 9 aa, Influenza virus
RGDQICIGY

SEQ ID NO: 482661 - protein, 9 aa, Influenza virus
RGDQICVGY

SEQ ID NO: 482662 - protein, 9 aa, Influenza virus
RGDYNNTTG

SEQ ID NO: 482663 - protein, 9 aa, Influenza virus
RGEDTIEER

SEQ ID NO: 482664 - protein, 9 aa, Influenza virus
RGEETIEEK

SEQ ID NO: 482665 - protein, 9 aa, Influenza virus
RGEETIEER

SEQ ID NO: 482666 - protein, 9 aa, Influenza virus
RGEETVEER

SEQ ID NO: 482667 - protein, 9 aa, Influenza virus
RGEFNQVEK

SEQ ID NO: 482668 - protein, 9 aa, Influenza virus
RGEFNQVEN

SEQ ID NO: 482669 - protein, 9 aa, Influenza virus
RGEFNQVEQ

SEQ ID NO: 482670 - protein, 9 aa, Influenza virus
RGEFSQVEQ

SEQ ID NO: 482671 - protein, 9 aa, Influenza virus
RGEFSQVER

SEQ ID NO: 482672 - protein, 9 aa, Influenza virus
RGENGRKTR

SEQ ID NO: 482673 - protein, 9 aa, Influenza virus
RGENGRRTR

SEQ ID NO: 482674 - protein, 9 aa, Influenza virus
RGETLKIRT

SEQ ID NO: 482675 - protein, 9 aa, Influenza virus
RGETTGRNC

SEQ ID NO: 482676 - protein, 9 aa, Influenza virus
RGEVFVIRE

SEQ ID NO: 482677 - protein, 9 aa, Influenza virus
RGFAPFSKD

SEQ ID NO: 482678 - protein, 9 aa, Influenza virus
RGFEMVWDA

SEQ ID NO: 482679 - protein, 9 aa, Influenza virus
RGFFGAIAG

SEQ ID NO: 482680 - protein, 9 aa, Influenza virus
RGFFPFHKD

SEQ ID NO: 482681 - protein, 9 aa, Influenza virus
RGFLIIGKE

SEQ ID NO: 482682 - protein, 9 aa, Influenza virus
RGFLILGKE

SEQ ID NO: 482683 - protein, 9 aa, Influenza virus
RGFLILGRE

SEQ ID NO: 482684 - protein, 9 aa, Influenza virus
RGFVHFVEA

SEQ ID NO: 482685 - protein, 9 aa, Influenza virus
RGFVYFVEA

SEQ ID NO: 482686 - protein, 9 aa, Influenza virus
RGFVYFVEI

SEQ ID NO: 482687 - protein, 9 aa, Influenza virus
RGFVYFVET

SEQ ID NO: 482688 - protein, 9 aa, Influenza virus
RGGRNSFFS

SEQ ID NO: 482689 - protein, 9 aa, Influenza virus
RGGSGIMKT

SEQ ID NO: 482690 - protein, 9 aa, Influenza virus
RGGSINTKL

SEQ ID NO: 482691 - protein, 9 aa, Influenza virus
RGGSINTRL

SEQ ID NO: 482692 - protein, 9 aa, Influenza virus
RGHIFVIRE

SEQ ID NO: 482693 - protein, 9 aa, Influenza virus
RGHVFVIRE

SEQ ID NO: 482694 - protein, 9 aa, Influenza virus
RGHYKISKS

SEQ ID NO: 482695 - protein, 9 aa, Influenza virus
RGIEVVNAT

SEQ ID NO: 482696 - protein, 9 aa, Influenza virus
RGIFGAIAG

SEQ ID NO: 482697 - protein, 9 aa, Influenza virus
RGILEDEQM

SEQ ID NO: 482698 - protein, 9 aa, Influenza virus
RGINDRNFW

SEQ ID NO: 482699 - protein, 9 aa, Influenza virus
RGIPPLELG

SEQ ID NO: 482700 - protein, 9 aa, Influenza virus
RGIQIASNE

SEQ ID NO: 482701 - protein, 9 aa, Influenza virus
RGKHSNGTI

SEQ ID NO: 482702 - protein, 9 aa, Influenza virus
RGKLKRRAI

SEQ ID NO: 482703 - protein, 9 aa, Influenza virus
RGLCTINSW

SEQ ID NO: 482704 - protein, 9 aa, Influenza virus
RGLFGAIAG

SEQ ID NO: 482705 - protein, 9 aa, Influenza virus
RGLFGAKAG

SEQ ID NO: 482706 - protein, 9 aa, Influenza virus
RGLISTHLG

SEQ ID NO: 482707 - protein, 9 aa, Influenza virus
RGLISTPLG

SEQ ID NO: 482708 - protein, 9 aa, Influenza virus
RGLISTQLG

SEQ ID NO: 482709 - protein, 9 aa, Influenza virus
RGLLEVGTR

SEQ ID NO: 482710 - protein, 9 aa, Influenza virus
RGLLGAIAG

SEQ ID NO: 482711 - protein, 9 aa, Influenza virus
RGLLSTPLG

SEQ ID NO: 482712 - protein, 9 aa, Influenza virus
RGLMSTPLG

SEQ ID NO: 482713 - protein, 9 aa, Influenza virus
RGLQRRRFI

SEQ ID NO: 482714 - protein, 9 aa, Influenza virus
RGLQRRRFV

SEQ ID NO: 482715 - protein, 9 aa, Influenza virus
RGLSSRISF

SEQ ID NO: 482716 - protein, 9 aa, Influenza virus
RGLWDPFRQ

SEQ ID NO: 482717 - protein, 9 aa, Influenza virus
RGLWDSFRQ

SEQ ID NO: 482718 - protein, 9 aa, Influenza virus
RGNGCFEIF

SEQ ID NO: 482719 - protein, 9 aa, Influenza virus
RGNILLSPE

SEQ ID NO: 482720 - protein, 9 aa, Influenza virus
RGNIRCNIC

SEQ ID NO: 482721 - protein, 9 aa, Influenza virus
RGNPGVKGW

SEQ ID NO: 482722 - protein, 9 aa, Influenza virus
RGNQGVKGW

SEQ ID NO: 482723 - protein, 9 aa, Influenza virus
RGNSGIMKT

SEQ ID NO: 482724 - protein, 9 aa, Influenza virus
RGNSPAFNY

SEQ ID NO: 482725 - protein, 9 aa, Influenza virus
RGNSPIFNY

SEQ ID NO: 482726 - protein, 9 aa, Influenza virus
RGNSPVFNY

SEQ ID NO: 482727 - protein, 9 aa, Influenza virus
RGNVLLSPE

SEQ ID NO: 482728 - protein, 9 aa, Influenza virus
RGQAADLKS

SEQ ID NO: 482729 - protein, 9 aa, Influenza virus
RGQHANGTI

SEQ ID NO: 482730 - protein, 9 aa, Influenza virus
RGQPKEKAI

SEQ ID NO: 482731 - protein, 9 aa, Influenza virus
RGQPKEKTI

SEQ ID NO: 482732 - protein, 9 aa, Influenza virus
RGQPKERTI

SEQ ID NO: 482733 - protein, 9 aa, Influenza virus
RGQQGRMDY

SEQ ID NO: 482734 - protein, 9 aa, Influenza virus
RGQQGTMDY

SEQ ID NO: 482735 - protein, 9 aa, Influenza virus
RGQQGWMDY

SEQ ID NO: 482736 - protein, 9 aa, Influenza virus
RGQSGRISF

SEQ ID NO: 482737 - protein, 9 aa, Influenza virus
RGQSGRVSF

SEQ ID NO: 482738 - protein, 9 aa, Influenza virus
RGQYSGFVR

SEQ ID NO: 482739 - protein, 9 aa, Influenza virus
RGRGSTLGL

SEQ ID NO: 482740 - protein, 9 aa, Influenza virus
RGRGVFELS

SEQ ID NO: 482741 - protein, 9 aa, Influenza virus
RGRHANGTI

SEQ ID NO: 482742 - protein, 9 aa, Influenza virus
RGRHANGTM

SEQ ID NO: 482743 - protein, 9 aa, Influenza virus
RGRHSNGTI

SEQ ID NO: 482744 - protein, 9 aa, Influenza virus
RGRIDYFWS

SEQ ID NO: 482745 - protein, 9 aa, Influenza virus
RGRIDYYWS

SEQ ID NO: 482746 - protein, 9 aa, Influenza virus
RGRIFQSRI

SEQ ID NO: 482747 - protein, 9 aa, Influenza virus
RGRLCNPLN

SEQ ID NO: 482748 - protein, 9 aa, Influenza virus
RGRPEEAKY

SEQ ID NO: 482749 - protein, 9 aa, Influenza virus
RGRPEEVKY

SEQ ID NO: 482750 - protein, 9 aa, Influenza virus
RGRPKEDEV

SEQ ID NO: 482751 - protein, 9 aa, Influenza virus
RGRPKEDKV

SEQ ID NO: 482752 - protein, 9 aa, Influenza virus
RGRPKEDRV

SEQ ID NO: 482753 - protein, 9 aa, Influenza virus
RGRPKEEKV

SEQ ID NO: 482754 - protein, 9 aa, Influenza virus
RGSARHIEE

SEQ ID NO: 482755 - protein, 9 aa, Influenza virus
RGSFYRSMR

SEQ ID NO: 482756 - protein, 9 aa, Influenza virus
RGSGGIDKE

SEQ ID NO: 482757 - protein, 9 aa, Influenza virus
RGSGLRILI

SEQ ID NO: 482758 - protein, 9 aa, Influenza virus
RGSGLRILV

SEQ ID NO: 482759 - protein, 9 aa, Influenza virus
RGSGMRILI

SEQ ID NO: 482760 - protein, 9 aa, Influenza virus
RGSGMRILV

SEQ ID NO: 482761 - protein, 9 aa, Influenza virus
RGSIAHKSC

SEQ ID NO: 482762 - protein, 9 aa, Influenza virus
RGSNRPIVD

SEQ ID NO: 482763 - protein, 9 aa, Influenza virus
RGSNRPWIR

SEQ ID NO: 482764 - protein, 9 aa, Influenza virus
RGSPGVKGW

SEQ ID NO: 482765 - protein, 9 aa, Influenza virus
RGSSGIMKT

SEQ ID NO: 482766 - protein, 9 aa, Influenza virus
RGSSGIVKT

SEQ ID NO: 482767 - protein, 9 aa, Influenza virus
RGSSGVMKT

SEQ ID NO: 482768 - protein, 9 aa, Influenza virus
RGSTLGLDI

SEQ ID NO: 482769 - protein, 9 aa, Influenza virus
RGSTQKAID

SEQ ID NO: 482770 - protein, 9 aa, Influenza virus
RGSVAHKSC

SEQ ID NO: 482771 - protein, 9 aa, Influenza virus
RGSYNNTSG

SEQ ID NO: 482772 - protein, 9 aa, Influenza virus
RGTGMRILV

SEQ ID NO: 482773 - protein, 9 aa, Influenza virus
RGTNSFYRN

SEQ ID NO: 482774 - protein, 9 aa, Influenza virus
RGTQGVKGW

SEQ ID NO: 482775 - protein, 9 aa, Influenza virus
RGVEVVDAT

SEQ ID NO: 482776 - protein, 9 aa, Influenza virus
RGVEVVNAT

SEQ ID NO: 482777 - protein, 9 aa, Influenza virus
RGVFEFSDE

SEQ ID NO: 482778 - protein, 9 aa, Influenza virus
RGVFELSDE

SEQ ID NO: 482779 - protein, 9 aa, Influenza virus
RGVKGFGFK

SEQ ID NO: 482780 - protein, 9 aa, Influenza virus
RGVLEDEQM

SEQ ID NO: 482781 - protein, 9 aa, Influenza virus
RGVNDRNFW

SEQ ID NO: 482782 - protein, 9 aa, Influenza virus
RGVQIASNE

SEQ ID NO: 482783 - protein, 9 aa, Influenza virus
RGVQVASNE

SEQ ID NO: 482784 - protein, 9 aa, Influenza virus
RGWAPLSKD

SEQ ID NO: 482785 - protein, 9 aa, Influenza virus
RGYKMNIQI

SEQ ID NO: 482786 - protein, 9 aa, Influenza virus
RGYKMNNQI

SEQ ID NO: 482787 - protein, 9 aa, Influenza virus
RGYKMNTKI

SEQ ID NO: 482788 - protein, 9 aa, Influenza virus
RGYKMNTQI

SEQ ID NO: 482789 - protein, 9 aa, Influenza virus
RGYKMNTRI

SEQ ID NO: 482790 - protein, 9 aa, Influenza virus
RGYPGVKGW

SEQ ID NO: 482791 - protein, 9 aa, Influenza virus
RHANGTIHD

SEQ ID NO: 482792 - protein, 9 aa, Influenza virus
RHANGTIND

SEQ ID NO: 482793 - protein, 9 aa, Influenza virus
RHANGTMHD

SEQ ID NO: 482794 - protein, 9 aa, Influenza virus
RHCSKYHWN

SEQ ID NO: 482795 - protein, 9 aa, Influenza virus
RHENRMVIA

SEQ ID NO: 482796 - protein, 9 aa, Influenza virus
RHENRMVLA

SEQ ID NO: 482797 - protein, 9 aa, Influenza virus
RHFEKVKIL

SEQ ID NO: 482798 - protein, 9 aa, Influenza virus
RHFQKDAKI

SEQ ID NO: 482799 - protein, 9 aa, Influenza virus
RHFQKDAKM

SEQ ID NO: 482800 - protein, 9 aa, Influenza virus
RHFQKDAKV

SEQ ID NO: 482801 - protein, 9 aa, Influenza virus
RHFQKDARV

SEQ ID NO: 482802 - protein, 9 aa, Influenza virus
RHFQKNAKV

SEQ ID NO: 482803 - protein, 9 aa, Influenza virus
RHHMGECPK

SEQ ID NO: 482804 - protein, 9 aa, Influenza virus
RHHNSEGTG

SEQ ID NO: 482805 - protein, 9 aa, Influenza virus
RHIEECPCY

SEQ ID NO: 482806 - protein, 9 aa, Influenza virus
RHIEECSCY

SEQ ID NO: 482807 - protein, 9 aa, Influenza virus
RHIEEWSCY

SEQ ID NO: 482808 - protein, 9 aa, Influenza virus
RHLEECSCY

SEQ ID NO: 482809 - protein, 9 aa, Influenza virus
RHLFSGIKS

SEQ ID NO: 482810 - protein, 9 aa, Influenza virus
RHLFSGIRS

SEQ ID NO: 482811 - protein, 9 aa, Influenza virus
RHLFSGVNS

SEQ ID NO: 482812 - protein, 9 aa, Influenza virus
RHQLRENAE

SEQ ID NO: 482813 - protein, 9 aa, Influenza virus
RHQNAEGTG

SEQ ID NO: 482814 - protein, 9 aa, Influenza virus
RHQNAQGEG

SEQ ID NO: 482815 - protein, 9 aa, Influenza virus
RHQNAQGIG

SEQ ID NO: 482816 - protein, 9 aa, Influenza virus
RHQNAQGQG

SEQ ID NO: 482817 - protein, 9 aa, Influenza virus
RHQNAQGTG

SEQ ID NO: 482818 - protein, 9 aa, Influenza virus
RHQNSEGIG

SEQ ID NO: 482819 - protein, 9 aa, Influenza virus
RHQNSEGMG

SEQ ID NO: 482820 - protein, 9 aa, Influenza virus
RHQNSEGRG

SEQ ID NO: 482821 - protein, 9 aa, Influenza virus
RHQNSEGTG

SEQ ID NO: 482822 - protein, 9 aa, Influenza virus
RHQNSQGEG

SEQ ID NO: 482823 - protein, 9 aa, Influenza virus
RHRLKITEN

SEQ ID NO: 482824 - protein, 9 aa, Influenza virus
RHSNEQGSG

SEQ ID NO: 482825 - protein, 9 aa, Influenza virus
RHSNGTIHD

SEQ ID NO: 482826 - protein, 9 aa, Influenza virus
RHSNGTVKD

SEQ ID NO: 482827 - protein, 9 aa, Influenza virus
RHYIGKCPK

SEQ ID NO: 482828 - protein, 9 aa, Influenza virus
RHYMGECPE

SEQ ID NO: 482829 - protein, 9 aa, Influenza virus
RHYMGECPK

SEQ ID NO: 482830 - protein, 9 aa, Influenza virus
RHYMGECPN

SEQ ID NO: 482831 - protein, 9 aa, Influenza virus
RIAIGNCPK

SEQ ID NO: 482832 - protein, 9 aa, Influenza virus
RIAWSSSSC

SEQ ID NO: 482833 - protein, 9 aa, Influenza virus
RIAYERMCN

SEQ ID NO: 482834 - protein, 9 aa, Influenza virus
RICEKLEQS

SEQ ID NO: 482835 - protein, 9 aa, Influenza virus
RICIDFRDM

SEQ ID NO: 482836 - protein, 9 aa, Influenza virus
RICIGYHAN

SEQ ID NO: 482837 - protein, 9 aa, Influenza virus
RICIGYLST

SEQ ID NO: 482838 - protein, 9 aa, Influenza virus
RICIGYQSN

SEQ ID NO: 482839 - protein, 9 aa, Influenza virus
RICILDQNF

SEQ ID NO: 482840 - protein, 9 aa, Influenza virus
RICKLVGIN

SEQ ID NO: 482841 - protein, 9 aa, Influenza virus
RICLGHHAV

SEQ ID NO: 482842 - protein, 9 aa, Influenza virus
RICVGYHAN

SEQ ID NO: 482843 - protein, 9 aa, Influenza virus
RICVGYLST

SEQ ID NO: 482844 - protein, 9 aa, Influenza virus
RIDARIDFE

SEQ ID NO: 482845 - protein, 9 aa, Influenza virus
RIDARVDFE

SEQ ID NO: 482846 - protein, 9 aa, Influenza virus
RIDDAVTDI

SEQ ID NO: 482847 - protein, 9 aa, Influenza virus
RIDDAVTDV

SEQ ID NO: 482848 - protein, 9 aa, Influenza virus
RIDFESGRI

SEQ ID NO: 482849 - protein, 9 aa, Influenza virus
RIDFESGRM

SEQ ID NO: 482850 - protein, 9 aa, Influenza virus
RIDFESGRV

SEQ ID NO: 482851 - protein, 9 aa, Influenza virus
RIDFHWLFL

SEQ ID NO: 482852 - protein, 9 aa, Influenza virus
RIDFHWLIL

SEQ ID NO: 482853 - protein, 9 aa, Influenza virus
RIDFHWLLL

SEQ ID NO: 482854 - protein, 9 aa, Influenza virus
RIDFHWLML

SEQ ID NO: 482855 - protein, 9 aa, Influenza virus
RIDFHWMLL

SEQ ID NO: 482856 - protein, 9 aa, Influenza virus
RIDFNWLLL

SEQ ID NO: 482857 - protein, 9 aa, Influenza virus
RIDYFWSIL

SEQ ID NO: 482858 - protein, 9 aa, Influenza virus
RIDYYWSFL

SEQ ID NO: 482859 - protein, 9 aa, Influenza virus
RIDYYWSIL

SEQ ID NO: 482860 - protein, 9 aa, Influenza virus
RIDYYWSML

SEQ ID NO: 482861 - protein, 9 aa, Influenza virus
RIDYYWSVL

SEQ ID NO: 482862 - protein, 9 aa, Influenza virus
RIECIGWSS

SEQ ID NO: 482863 - protein, 9 aa, Influenza virus
RIENLNKKI

SEQ ID NO: 482864 - protein, 9 aa, Influenza virus
RIENLNKKM

SEQ ID NO: 482865 - protein, 9 aa, Influenza virus
RIENLNKKV

SEQ ID NO: 482866 - protein, 9 aa, Influenza virus
RIENLNRKM

SEQ ID NO: 482867 - protein, 9 aa, Influenza virus
RIENLNRKV

SEQ ID NO: 482868 - protein, 9 aa, Influenza virus
RIESLNKKM

SEQ ID NO: 482869 - protein, 9 aa, Influenza virus
RIFLAMITY

SEQ ID NO: 482870 - protein, 9 aa, Influenza virus
RIFQPNIGP

SEQ ID NO: 482871 - protein, 9 aa, Influenza virus
RIFQSGIRM

SEQ ID NO: 482872 - protein, 9 aa, Influenza virus
RIFQSGVRL

SEQ ID NO: 482873 - protein, 9 aa, Influenza virus
RIFQSGVRM

SEQ ID NO: 482874 - protein, 9 aa, Influenza virus
RIFQSGVRV

SEQ ID NO: 482875 - protein, 9 aa, Influenza virus
RIFQSRIRM

SEQ ID NO: 482876 - protein, 9 aa, Influenza virus
RIFRPNIGP

SEQ ID NO: 482877 - protein, 9 aa, Influenza virus
RIGDGQRSW

SEQ ID NO: 482878 - protein, 9 aa, Influenza virus
RIGEDAHIL

SEQ ID NO: 482879 - protein, 9 aa, Influenza virus
RIGEDAHVL

SEQ ID NO: 482880 - protein, 9 aa, Influenza virus
RIGEDSDIL

SEQ ID NO: 482881 - protein, 9 aa, Influenza virus
RIGEDSDVL

SEQ ID NO: 482882 - protein, 9 aa, Influenza virus
RIGEEAHIL

SEQ ID NO: 482883 - protein, 9 aa, Influenza virus
RIGEGAHIL

SEQ ID NO: 482884 - protein, 9 aa, Influenza virus
RIGEGQRSW

SEQ ID NO: 482885 - protein, 9 aa, Influenza virus
RIGENAHIL

SEQ ID NO: 482886 - protein, 9 aa, Influenza virus
RIGENSDVL

SEQ ID NO: 482887 - protein, 9 aa, Influenza virus
RIGENSGVL

SEQ ID NO: 482888 - protein, 9 aa, Influenza virus
RIGGNSDVL

SEQ ID NO: 482889 - protein, 9 aa, Influenza virus
RIGSCTSPC

SEQ ID NO: 482890 - protein, 9 aa, Influenza virus
RIGSKGDIF

SEQ ID NO: 482891 - protein, 9 aa, Influenza virus
RIGSKGDVF

SEQ ID NO: 482892 - protein, 9 aa, Influenza virus
RIGSKGHVF

SEQ ID NO: 482893 - protein, 9 aa, Influenza virus
RIGSRGDVF

SEQ ID NO: 482894 - protein, 9 aa, Influenza virus
RIGSRGEVF

SEQ ID NO: 482895 - protein, 9 aa, Influenza virus
RIGSRGHIF

SEQ ID NO: 482896 - protein, 9 aa, Influenza virus
RIGSRGHVF

SEQ ID NO: 482897 - protein, 9 aa, Influenza virus
RIIEKTNQQ

SEQ ID NO: 482898 - protein, 9 aa, Influenza virus
RIIQNEDIP

SEQ ID NO: 482899 - protein, 9 aa, Influenza virus
RIITSESQL

SEQ ID NO: 482900 - protein, 9 aa, Influenza virus
RIKINPVTL

SEQ ID NO: 482901 - protein, 9 aa, Influenza virus
RIKTRLFTI

SEQ ID NO: 482902 - protein, 9 aa, Influenza virus
RILASESQL

SEQ ID NO: 482903 - protein, 9 aa, Influenza virus
RILCTSATA

SEQ ID NO: 482904 - protein, 9 aa, Influenza virus
RILEEESDE

SEQ ID NO: 482905 - protein, 9 aa, Influenza virus
RILFIEEGK

SEQ ID NO: 482906 - protein, 9 aa, Influenza virus
RILFIKEGK

SEQ ID NO: 482907 - protein, 9 aa, Influenza virus
RILFIREGK

SEQ ID NO: 482908 - protein, 9 aa, Influenza virus
RILFVKEGK

SEQ ID NO: 482909 - protein, 9 aa, Influenza virus
RILIRGNSP

SEQ ID NO: 482910 - protein, 9 aa, Influenza virus
RILKENAID

SEQ ID NO: 482911 - protein, 9 aa, Influenza virus
RILKENALD

SEQ ID NO: 482912 - protein, 9 aa, Influenza virus
RILRTQESE

SEQ ID NO: 482913 - protein, 9 aa, Influenza virus
RILSIYSTV

SEQ ID NO: 482914 - protein, 9 aa, Influenza virus
RILTDTSRP

SEQ ID NO: 482915 - protein, 9 aa, Influenza virus
RILTSESQL

SEQ ID NO: 482916 - protein, 9 aa, Influenza virus
RILTSESQM

SEQ ID NO: 482917 - protein, 9 aa, Influenza virus
RILVRGNSP

SEQ ID NO: 482918 - protein, 9 aa, Influenza virus
RIMFESNGG

SEQ ID NO: 482919 - protein, 9 aa, Influenza virus
RIMINPVKL

SEQ ID NO: 482920 - protein, 9 aa, Influenza virus
RINGVKLEE

SEQ ID NO: 482921 - protein, 9 aa, Influenza virus
RINMIADRV

SEQ ID NO: 482922 - protein, 9 aa, Influenza virus
RINMINDKI

SEQ ID NO: 482923 - protein, 9 aa, Influenza virus
RINMINSKI

SEQ ID NO: 482924 - protein, 9 aa, Influenza virus
RINMINSQI

SEQ ID NO: 482925 - protein, 9 aa, Influenza virus
RINMISDKI

SEQ ID NO: 482926 - protein, 9 aa, Influenza virus
RINMLADRI

SEQ ID NO: 482927 - protein, 9 aa, Influenza virus
RINMLADRV

SEQ ID NO: 482928 - protein, 9 aa, Influenza virus
RINMLADWV

SEQ ID NO: 482929 - protein, 9 aa, Influenza virus
RINNETILE

SEQ ID NO: 482930 - protein, 9 aa, Influenza virus
RINNETIVE

SEQ ID NO: 482931 - protein, 9 aa, Influenza virus
RINRQEIEG

SEQ ID NO: 482932 - protein, 9 aa, Influenza virus
RINTINSKI

SEQ ID NO: 482933 - protein, 9 aa, Influenza virus
RINVINDKI

SEQ ID NO: 482934 - protein, 9 aa, Influenza virus
RIPHRTLLM

SEQ ID NO: 482935 - protein, 9 aa, Influenza virus
RIPNAGIDP

SEQ ID NO: 482936 - protein, 9 aa, Influenza virus
RIQDIWAYN

SEQ ID NO: 482937 - protein, 9 aa, Influenza virus
RIQDLEKYV

SEQ ID NO: 482938 - protein, 9 aa, Influenza virus
RIQDLERYV

SEQ ID NO: 482939 - protein, 9 aa, Influenza virus
RIQHLEECS

SEQ ID NO: 482940 - protein, 9 aa, Influenza virus
RIQIDPVKL

SEQ ID NO: 482941 - protein, 9 aa, Influenza virus
RIQIDQVKL

SEQ ID NO: 482942 - protein, 9 aa, Influenza virus
RIQIDSVKL

SEQ ID NO: 482943 - protein, 9 aa, Influenza virus
RIQINPVKL

SEQ ID NO: 482944 - protein, 9 aa, Influenza virus
RIRIDPVKL

SEQ ID NO: 482945 - protein, 9 aa, Influenza virus
RIRLFDYSG

SEQ ID NO: 482946 - protein, 9 aa, Influenza virus
RIRLFDYSK

SEQ ID NO: 482947 - protein, 9 aa, Influenza virus
RIRLFDYSR

SEQ ID NO: 482948 - protein, 9 aa, Influenza virus
RIRMAINLV

SEQ ID NO: 482949 - protein, 9 aa, Influenza virus
RIRMAINQC

SEQ ID NO: 482950 - protein, 9 aa, Influenza virus
RIRMAINWG

SEQ ID NO: 482951 - protein, 9 aa, Influenza virus
RIRMAINYS

SEQ ID NO: 482952 - protein, 9 aa, Influenza virus
RIRMATNEC

SEQ ID NO: 482953 - protein, 9 aa, Influenza virus
RIRNNTYDH

SEQ ID NO: 482954 - protein, 9 aa, Influenza virus
RIRRDQKSL

SEQ ID NO: 482955 - protein, 9 aa, Influenza virus
RISFYWTIV

SEQ ID NO: 482956 - protein, 9 aa, Influenza virus
RISHRTLLM

SEQ ID NO: 482957 - protein, 9 aa, Influenza virus
RISIYWTLV

SEQ ID NO: 482958 - protein, 9 aa, Influenza virus
RISKMGVDE

SEQ ID NO: 482959 - protein, 9 aa, Influenza virus
RISKRGSSG

SEQ ID NO: 482960 - protein, 9 aa, Influenza virus
RISNETILE

SEQ ID NO: 482961 - protein, 9 aa, Influenza virus
RISSSFSFG

SEQ ID NO: 482962 - protein, 9 aa, Influenza virus
RITFESNGG

SEQ ID NO: 482963 - protein, 9 aa, Influenza virus
RITFESSGG

SEQ ID NO: 482964 - protein, 9 aa, Influenza virus
RITTKINNI

SEQ ID NO: 482965 - protein, 9 aa, Influenza virus
RIWRQANNG

SEQ ID NO: 482966 - protein, 9 aa, Influenza virus
RIWSKPQCQ

SEQ ID NO: 482967 - protein, 9 aa, Influenza virus
RIYWIREGK

SEQ ID NO: 482968 - protein, 9 aa, Influenza virus
RIYWIREGR

SEQ ID NO: 482969 - protein, 9 aa, Influenza virus
RIYWIRKGR

SEQ ID NO: 482970 - protein, 9 aa, Influenza virus
RKASLRLAV

SEQ ID NO: 482971 - protein, 9 aa, Influenza virus
RKATKRLIQ

SEQ ID NO: 482972 - protein, 9 aa, Influenza virus
RKATRRLIQ

SEQ ID NO: 482973 - protein, 9 aa, Influenza virus
RKATRRLVQ

SEQ ID NO: 482974 - protein, 9 aa, Influenza virus
RKATRRMIQ

SEQ ID NO: 482975 - protein, 9 aa, Influenza virus
RKDILRTQE

SEQ ID NO: 482976 - protein, 9 aa, Influenza virus
RKEAMQNRI

SEQ ID NO: 482977 - protein, 9 aa, Influenza virus
RKEPALIVW

SEQ ID NO: 482978 - protein, 9 aa, Influenza virus
RKEYEEEAK

SEQ ID NO: 482979 - protein, 9 aa, Influenza virus
RKGLILEYY

SEQ ID NO: 482980 - protein, 9 aa, Influenza virus
RKILRKSGG

SEQ ID NO: 482981 - protein, 9 aa, Influenza virus
RKKILRTQE

SEQ ID NO: 482982 - protein, 9 aa, Influenza virus
RKKRGLFGA

SEQ ID NO: 482983 - protein, 9 aa, Influenza virus
RKLKREITF

SEQ ID NO: 482984 - protein, 9 aa, Influenza virus
RKLLLIAQA

SEQ ID NO: 482985 - protein, 9 aa, Influenza virus
RKLLLITQA

SEQ ID NO: 482986 - protein, 9 aa, Influenza virus
RKLLLIVQA

SEQ ID NO: 482987 - protein, 9 aa, Influenza virus
RKLLLVVQA

SEQ ID NO: 482988 - protein, 9 aa, Influenza virus
RKMEDGFLD

SEQ ID NO: 482989 - protein, 9 aa, Influenza virus
RKMLLIVQA

SEQ ID NO: 482990 - protein, 9 aa, Influenza virus
RKMMTNSQD

SEQ ID NO: 482991 - protein, 9 aa, Influenza virus
RKMMTSSQD

SEQ ID NO: 482992 - protein, 9 aa, Influenza virus
RKQILRTQE

SEQ ID NO: 482993 - protein, 9 aa, Influenza virus
RKQLRENAE

SEQ ID NO: 482994 - protein, 9 aa, Influenza virus
RKQLRQNAE

SEQ ID NO: 482995 - protein, 9 aa, Influenza virus
RKRDSSILT

SEQ ID NO: 482996 - protein, 9 aa, Influenza virus
RKRFADQEL

SEQ ID NO: 482997 - protein, 9 aa, Influenza virus
RKRGLFGAI

SEQ ID NO: 482998 - protein, 9 aa, Influenza virus
RKRKRKTRG

SEQ ID NO: 482999 - protein, 9 aa, Influenza virus
RKRKTRGLF

SEQ ID NO: 483000 - protein, 9 aa, Influenza virus
RKRMTRGLF

SEQ ID NO: 483001 - protein, 9 aa, Influenza virus
RKRNSSILT

SEQ ID NO: 483002 - protein, 9 aa, Influenza virus
RKRRIRDNM

SEQ ID NO: 483003 - protein, 9 aa, Influenza virus
RKRRVRDNI

SEQ ID NO: 483004 - protein, 9 aa, Influenza virus
RKRRVRDNM

SEQ ID NO: 483005 - protein, 9 aa, Influenza virus
RKRRVRDNV

SEQ ID NO: 483006 - protein, 9 aa, Influenza virus
RKRRVRDSM

SEQ ID NO: 483007 - protein, 9 aa, Influenza virus
RKSGGIGKE

SEQ ID NO: 483008 - protein, 9 aa, Influenza virus
RKTNLYGFI

SEQ ID NO: 483009 - protein, 9 aa, Influenza virus
RKTRFLPVA

SEQ ID NO: 483010 - protein, 9 aa, Influenza virus
RKTRFLPVS

SEQ ID NO: 483011 - protein, 9 aa, Influenza virus
RKTRFLPVT

SEQ ID NO: 483012 - protein, 9 aa, Influenza virus
RKTRGLFGA

SEQ ID NO: 483013 - protein, 9 aa, Influenza virus
RKVDDGFLD

SEQ ID NO: 483014 - protein, 9 aa, Influenza virus
RLAAAGDIW

SEQ ID NO: 483015 - protein, 9 aa, Influenza virus
RLAAGGDIW

SEQ ID NO: 483016 - protein, 9 aa, Influenza virus
RLAIGLRNT

SEQ ID NO: 483017 - protein, 9 aa, Influenza virus
RLAKCNTKC

SEQ ID NO: 483018 - protein, 9 aa, Influenza virus
RLALGLRNT

SEQ ID NO: 483019 - protein, 9 aa, Influenza virus
RLATGLRNI

SEQ ID NO: 483020 - protein, 9 aa, Influenza virus
RLATGLRNV

SEQ ID NO: 483021 - protein, 9 aa, Influenza virus
RLATGMRNI

SEQ ID NO: 483022 - protein, 9 aa, Influenza virus
RLAVGLRNT

SEQ ID NO: 483023 - protein, 9 aa, Influenza virus
RLCNPLNPF

SEQ ID NO: 483024 - protein, 9 aa, Influenza virus
RLCTINSWH

SEQ ID NO: 483025 - protein, 9 aa, Influenza virus
RLCYPGELD

SEQ ID NO: 483026 - protein, 9 aa, Influenza virus
RLEDVFAGK

SEQ ID NO: 483027 - protein, 9 aa, Influenza virus
RLEENTTYK

SEQ ID NO: 483028 - protein, 9 aa, Influenza virus
RLEGVFAGK

SEQ ID NO: 483029 - protein, 9 aa, Influenza virus
RLENLDKKM

SEQ ID NO: 483030 - protein, 9 aa, Influenza virus
RLENLNKKM

SEQ ID NO: 483031 - protein, 9 aa, Influenza virus
RLENLNKKV

SEQ ID NO: 483032 - protein, 9 aa, Influenza virus
RLENLNKRM

SEQ ID NO: 483033 - protein, 9 aa, Influenza virus
RLENVFAGK

SEQ ID NO: 483034 - protein, 9 aa, Influenza virus
RLESVFAGK

SEQ ID NO: 483035 - protein, 9 aa, Influenza virus
RLFDYSGWN

SEQ ID NO: 483036 - protein, 9 aa, Influenza virus
RLFDYSKWN

SEQ ID NO: 483037 - protein, 9 aa, Influenza virus
RLFDYSRWN

SEQ ID NO: 483038 - protein, 9 aa, Influenza virus
RLFERVRRQ

SEQ ID NO: 483039 - protein, 9 aa, Influenza virus
RLFTIRQEL

SEQ ID NO: 483040 - protein, 9 aa, Influenza virus
RLFTIRQEM

SEQ ID NO: 483041 - protein, 9 aa, Influenza virus
RLGKGYMFE

SEQ ID NO: 483042 - protein, 9 aa, Influenza virus
RLGNLNKKM

SEQ ID NO: 483043 - protein, 9 aa, Influenza virus
RLGRGYMFE

SEQ ID NO: 483044 - protein, 9 aa, Influenza virus
RLGSSFYAE

SEQ ID NO: 483045 - protein, 9 aa, Influenza virus
RLGSWSWHD

SEQ ID NO: 483046 - protein, 9 aa, Influenza virus
RLGYETFKV

SEQ ID NO: 483047 - protein, 9 aa, Influenza virus
RLIDFLKDV

SEQ ID NO: 483048 - protein, 9 aa, Influenza virus
RLIDKTNQQ

SEQ ID NO: 483049 - protein, 9 aa, Influenza virus
RLIDRTNHQ

SEQ ID NO: 483050 - protein, 9 aa, Influenza virus
RLIEKTNDK

SEQ ID NO: 483051 - protein, 9 aa, Influenza virus
RLIEKTNEK

SEQ ID NO: 483052 - protein, 9 aa, Influenza virus
RLIEKTNKQ

SEQ ID NO: 483053 - protein, 9 aa, Influenza virus
RLIEKTNQQ

SEQ ID NO: 483054 - protein, 9 aa, Influenza virus
RLIEKTNTE

SEQ ID NO: 483055 - protein, 9 aa, Influenza virus
RLIEKTNTQ

SEQ ID NO: 483056 - protein, 9 aa, Influenza virus
RLIERTNEK

SEQ ID NO: 483057 - protein, 9 aa, Influenza virus
RLIERTNQQ

SEQ ID NO: 483058 - protein, 9 aa, Influenza virus
RLIGKTNQQ

SEQ ID NO: 483059 - protein, 9 aa, Influenza virus
RLILATGLR

SEQ ID NO: 483060 - protein, 9 aa, Influenza virus
RLIQLIVSG

SEQ ID NO: 483061 - protein, 9 aa, Influenza virus
RLIQNSITI

SEQ ID NO: 483062 - protein, 9 aa, Influenza virus
RLIQNSLTI

SEQ ID NO: 483063 - protein, 9 aa, Influenza virus
RLIQNSMTI

SEQ ID NO: 483064 - protein, 9 aa, Influenza virus
RLISKTNQQ

SEQ ID NO: 483065 - protein, 9 aa, Influenza virus
RLKITENSF

SEQ ID NO: 483066 - protein, 9 aa, Influenza virus
RLKVNGQSG

SEQ ID NO: 483067 - protein, 9 aa, Influenza virus
RLLRENAEE

SEQ ID NO: 483068 - protein, 9 aa, Influenza virus
RLLVLLEND

SEQ ID NO: 483069 - protein, 9 aa, Influenza virus
RLMDFLKDV

SEQ ID NO: 483070 - protein, 9 aa, Influenza virus
RLNINPVKL

SEQ ID NO: 483071 - protein, 9 aa, Influenza virus
RLNINPVTL

SEQ ID NO: 483072 - protein, 9 aa, Influenza virus
RLNINSVKL

SEQ ID NO: 483073 - protein, 9 aa, Influenza virus
RLNNVIDKM

SEQ ID NO: 483074 - protein, 9 aa, Influenza virus
RLNPMHQLL

SEQ ID NO: 483075 - protein, 9 aa, Influenza virus
RLNRNEIKG

SEQ ID NO: 483076 - protein, 9 aa, Influenza virus
RLNRQEIEG

SEQ ID NO: 483077 - protein, 9 aa, Influenza virus
RLNTMHQLL

SEQ ID NO: 483078 - protein, 9 aa, Influenza virus
RLNWLTKAT

SEQ ID NO: 483079 - protein, 9 aa, Influenza virus
RLNWLTKET

SEQ ID NO: 483080 - protein, 9 aa, Influenza virus
RLPFQNLSP

SEQ ID NO: 483081 - protein, 9 aa, Influenza virus
RLPLPLCPF

SEQ ID NO: 483082 - protein, 9 aa, Influenza virus
RLQDTTWDV

SEQ ID NO: 483083 - protein, 9 aa, Influenza virus
RLQLKDNAK

SEQ ID NO: 483084 - protein, 9 aa, Influenza virus
RLQLKDNAR

SEQ ID NO: 483085 - protein, 9 aa, Influenza virus
RLQLRDNAK

SEQ ID NO: 483086 - protein, 9 aa, Influenza virus
RLQLRDNAR

SEQ ID NO: 483087 - protein, 9 aa, Influenza virus
RLRGIPPLE

SEQ ID NO: 483088 - protein, 9 aa, Influenza virus
RLRMATGLR

SEQ ID NO: 483089 - protein, 9 aa, Influenza virus
RLRRDQKAL

SEQ ID NO: 483090 - protein, 9 aa, Influenza virus
RLRRDQKSL

SEQ ID NO: 483091 - protein, 9 aa, Influenza virus
RLRRDQRAL

SEQ ID NO: 483092 - protein, 9 aa, Influenza virus
RLRRDQRSL

SEQ ID NO: 483093 - protein, 9 aa, Influenza virus
RLRSGFEML

SEQ ID NO: 483094 - protein, 9 aa, Influenza virus
RLSADGDIW

SEQ ID NO: 483095 - protein, 9 aa, Influenza virus
RLSAGGAIW

SEQ ID NO: 483096 - protein, 9 aa, Influenza virus
RLSAGGDIW

SEQ ID NO: 483097 - protein, 9 aa, Influenza virus
RLSAGGGIW

SEQ ID NO: 483098 - protein, 9 aa, Influenza virus
RLSAGGHIW

SEQ ID NO: 483099 - protein, 9 aa, Influenza virus
RLSAGGNIW

SEQ ID NO: 483100 - protein, 9 aa, Influenza virus
RLSAGGSIW

SEQ ID NO: 483101 - protein, 9 aa, Influenza virus
RLSASGDIW

SEQ ID NO: 483102 - protein, 9 aa, Influenza virus
RLSGGGDIW

SEQ ID NO: 483103 - protein, 9 aa, Influenza virus
RLSGIPPLE

SEQ ID NO: 483104 - protein, 9 aa, Influenza virus
RLSINPVKL

SEQ ID NO: 483105 - protein, 9 aa, Influenza virus
RLSSGYKDI

SEQ ID NO: 483106 - protein, 9 aa, Influenza virus
RLTIIGKDA

SEQ ID NO: 483107 - protein, 9 aa, Influenza virus
RLTILGKDA

SEQ ID NO: 483108 - protein, 9 aa, Influenza virus
RLTITYSSS

SEQ ID NO: 483109 - protein, 9 aa, Influenza virus
RLTQGRQTY

SEQ ID NO: 483110 - protein, 9 aa, Influenza virus
RLTQGYKDI

SEQ ID NO: 483111 - protein, 9 aa, Influenza virus
RLTTTIKPW

SEQ ID NO: 483112 - protein, 9 aa, Influenza virus
RLTTTIKTW

SEQ ID NO: 483113 - protein, 9 aa, Influenza virus
RLTTTIRTW

SEQ ID NO: 483114 - protein, 9 aa, Influenza virus
RLTTTVKTW

SEQ ID NO: 483115 - protein, 9 aa, Influenza virus
RLTVLGKDA

SEQ ID NO: 483116 - protein, 9 aa, Influenza virus
RLVLATGLR

SEQ ID NO: 483117 - protein, 9 aa, Influenza virus
RLVQLIVSG

SEQ ID NO: 483118 - protein, 9 aa, Influenza virus
RLVQNSITI

SEQ ID NO: 483119 - protein, 9 aa, Influenza virus
RLVRFRHQN

SEQ ID NO: 483120 - protein, 9 aa, Influenza virus
RLYGSENKL

SEQ ID NO: 483121 - protein, 9 aa, Influenza virus
RLYGSGNKL

SEQ ID NO: 483122 - protein, 9 aa, Influenza virus
RLYIWGVHH

SEQ ID NO: 483123 - protein, 9 aa, Influenza virus
RLYLWGVHH

SEQ ID NO: 483124 - protein, 9 aa, Influenza virus
RLYVNKNPY

SEQ ID NO: 483125 - protein, 9 aa, Influenza virus
RMADSIKSW

SEQ ID NO: 483126 - protein, 9 aa, Influenza virus
RMAINWGRI

SEQ ID NO: 483127 - protein, 9 aa, Influenza virus
RMAKCNTKC

SEQ ID NO: 483128 - protein, 9 aa, Influenza virus
RMARCNTKC

SEQ ID NO: 483129 - protein, 9 aa, Influenza virus
RMATGLRNI

SEQ ID NO: 483130 - protein, 9 aa, Influenza virus
RMATGLRNV

SEQ ID NO: 483131 - protein, 9 aa, Influenza virus
RMATNECRI

SEQ ID NO: 483132 - protein, 9 aa, Influenza virus
RMCNILKGK

SEQ ID NO: 483133 - protein, 9 aa, Influenza virus
RMCSLMQGS

SEQ ID NO: 483134 - protein, 9 aa, Influenza virus
RMDYYWAIL

SEQ ID NO: 483135 - protein, 9 aa, Influenza virus
RMDYYWAVL

SEQ ID NO: 483136 - protein, 9 aa, Influenza virus
RMDYYWGIL

SEQ ID NO: 483137 - protein, 9 aa, Influenza virus
RMEFFWTLL

SEQ ID NO: 483138 - protein, 9 aa, Influenza virus
RMEFSWILL

SEQ ID NO: 483139 - protein, 9 aa, Influenza virus
RMEFSWTIL

SEQ ID NO: 483140 - protein, 9 aa, Influenza virus
RMEFSWTLL

SEQ ID NO: 483141 - protein, 9 aa, Influenza virus
RMENLNKKV

SEQ ID NO: 483142 - protein, 9 aa, Influenza virus
RMFALSQGT

SEQ ID NO: 483143 - protein, 9 aa, Influenza virus
RMFLAMITY

SEQ ID NO: 483144 - protein, 9 aa, Influenza virus
RMGKCNTKC

SEQ ID NO: 483145 - protein, 9 aa, Influenza virus
RMGLQMQRF

SEQ ID NO: 483146 - protein, 9 aa, Influenza virus
RMGVDEYSS

SEQ ID NO: 483147 - protein, 9 aa, Influenza virus
RMGVQIQRF

SEQ ID NO: 483148 - protein, 9 aa, Influenza virus
RMGVQLQRF

SEQ ID NO: 483149 - protein, 9 aa, Influenza virus
RMGVQMQRF

SEQ ID NO: 483150 - protein, 9 aa, Influenza virus
RMIKAVRGD

SEQ ID NO: 483151 - protein, 9 aa, Influenza virus
RMIKRGIND

SEQ ID NO: 483152 - protein, 9 aa, Influenza virus
RMIKRGVND

SEQ ID NO: 483153 - protein, 9 aa, Influenza virus
RMIQLIVSG

SEQ ID NO: 483154 - protein, 9 aa, Influenza virus
RMITQRTIG

SEQ ID NO: 483155 - protein, 9 aa, Influenza virus
RMKWMMAMK

SEQ ID NO: 483156 - protein, 9 aa, Influenza virus
RMKWMMAMR

SEQ ID NO: 483157 - protein, 9 aa, Influenza virus
RMQFSSLAV

SEQ ID NO: 483158 - protein, 9 aa, Influenza virus
RMQFSSLTV

SEQ ID NO: 483159 - protein, 9 aa, Influenza virus
RMQINPVKL

SEQ ID NO: 483160 - protein, 9 aa, Influenza virus
RMQLKDNAK

SEQ ID NO: 483161 - protein, 9 aa, Influenza virus
RMQLRDNAK

SEQ ID NO: 483162 - protein, 9 aa, Influenza virus
RMQLRDNVK

SEQ ID NO: 483163 - protein, 9 aa, Influenza virus
RMSDSIKSW

SEQ ID NO: 483164 - protein, 9 aa, Influenza virus
RMSICISGP

SEQ ID NO: 483165 - protein, 9 aa, Influenza virus
RMSICMSGP

SEQ ID NO: 483166 - protein, 9 aa, Influenza virus
RMSICVSGP

SEQ ID NO: 483167 - protein, 9 aa, Influenza virus
RMSVCISGP

SEQ ID NO: 483168 - protein, 9 aa, Influenza virus
RMSVCMSGP

SEQ ID NO: 483169 - protein, 9 aa, Influenza virus
RMTDSIKSW

SEQ ID NO: 483170 - protein, 9 aa, Influenza virus
RMTFYWAIV

SEQ ID NO: 483171 - protein, 9 aa, Influenza virus
RMTFYWKIV

SEQ ID NO: 483172 - protein, 9 aa, Influenza virus
RMTFYWTII

SEQ ID NO: 483173 - protein, 9 aa, Influenza virus
RMTFYWTIV

SEQ ID NO: 483174 - protein, 9 aa, Influenza virus
RMTFYWTMV

SEQ ID NO: 483175 - protein, 9 aa, Influenza virus
RMTICIQGN

SEQ ID NO: 483176 - protein, 9 aa, Influenza virus
RMTICVQGD

SEQ ID NO: 483177 - protein, 9 aa, Influenza virus
RMTICVQGK

SEQ ID NO: 483178 - protein, 9 aa, Influenza virus
RMTICVQGN

SEQ ID NO: 483179 - protein, 9 aa, Influenza virus
RMTRGLFGA

SEQ ID NO: 483180 - protein, 9 aa, Influenza virus
RMVIASTTA

SEQ ID NO: 483181 - protein, 9 aa, Influenza virus
RMVKRGIND

SEQ ID NO: 483182 - protein, 9 aa, Influenza virus
RMVLASTTA

SEQ ID NO: 483183 - protein, 9 aa, Influenza virus
RMVLSAFDE

SEQ ID NO: 483184 - protein, 9 aa, Influenza virus
RMVTGLRNI

SEQ ID NO: 483185 - protein, 9 aa, Influenza virus
RMVTQRTIG

SEQ ID NO: 483186 - protein, 9 aa, Influenza virus
RMYALHQGT

SEQ ID NO: 483187 - protein, 9 aa, Influenza virus
RMYQKCCNL

SEQ ID NO: 483188 - protein, 9 aa, Influenza virus
RNAFRGLIS

SEQ ID NO: 483189 - protein, 9 aa, Influenza virus
RNAHKMESR

SEQ ID NO: 483190 - protein, 9 aa, Influenza virus
RNAIGDCPK

SEQ ID NO: 483191 - protein, 9 aa, Influenza virus
RNALGDCPK

SEQ ID NO: 483192 - protein, 9 aa, Influenza virus
RNALGNCPK

SEQ ID NO: 483193 - protein, 9 aa, Influenza virus
RNALSIAPI

SEQ ID NO: 483194 - protein, 9 aa, Influenza virus
RNATASFIY

SEQ ID NO: 483195 - protein, 9 aa, Influenza virus
RNATASFVY

SEQ ID NO: 483196 - protein, 9 aa, Influenza virus
RNATASLIY

SEQ ID NO: 483197 - protein, 9 aa, Influenza virus
RNCTIPCFW

SEQ ID NO: 483198 - protein, 9 aa, Influenza virus
RNCTVPCFW

SEQ ID NO: 483199 - protein, 9 aa, Influenza virus
RNDDIDQSL

SEQ ID NO: 483200 - protein, 9 aa, Influenza virus
RNDDSSSNS

SEQ ID NO: 483201 - protein, 9 aa, Influenza virus
RNDDSSSSS

SEQ ID NO: 483202 - protein, 9 aa, Influenza virus
RNDDVDQSL

SEQ ID NO: 483203 - protein, 9 aa, Influenza virus
RNDEGTGIA

SEQ ID NO: 483204 - protein, 9 aa, Influenza virus
RNDLYGTQS

SEQ ID NO: 483205 - protein, 9 aa, Influenza virus
RNDTDVVNF

SEQ ID NO: 483206 - protein, 9 aa, Influenza virus
RNDTDVVNY

SEQ ID NO: 483207 - protein, 9 aa, Influenza virus
RNEAINNRF

SEQ ID NO: 483208 - protein, 9 aa, Influenza virus
RNEALNNRF

SEQ ID NO: 483209 - protein, 9 aa, Influenza virus
RNEDGSSSS

SEQ ID NO: 483210 - protein, 9 aa, Influenza virus
RNEDSSSNS

SEQ ID NO: 483211 - protein, 9 aa, Influenza virus
RNEDSSSSS

SEQ ID NO: 483212 - protein, 9 aa, Influenza virus
RNEEGTGIA

SEQ ID NO: 483213 - protein, 9 aa, Influenza virus
RNEHGQTLW

SEQ ID NO: 483214 - protein, 9 aa, Influenza virus
RNEIKGVEL

SEQ ID NO: 483215 - protein, 9 aa, Influenza virus
RNEIKGVKL

SEQ ID NO: 483216 - protein, 9 aa, Influenza virus
RNEQGQALW

SEQ ID NO: 483217 - protein, 9 aa, Influenza virus
RNEQGQILW

SEQ ID NO: 483218 - protein, 9 aa, Influenza virus
RNEQGQMLW

SEQ ID NO: 483219 - protein, 9 aa, Influenza virus
RNEQGQTLW

SEQ ID NO: 483220 - protein, 9 aa, Influenza virus
RNFKPNIGP

SEQ ID NO: 483221 - protein, 9 aa, Influenza virus
RNFPQTTNT

SEQ ID NO: 483222 - protein, 9 aa, Influenza virus
RNFQPNIGP

SEQ ID NO: 483223 - protein, 9 aa, Influenza virus
RNFWRGDNG

SEQ ID NO: 483224 - protein, 9 aa, Influenza virus
RNFWRGENG

SEQ ID NO: 483225 - protein, 9 aa, Influenza virus
RNGFEMLKI

SEQ ID NO: 483226 - protein, 9 aa, Influenza virus
RNGKWREQL

SEQ ID NO: 483227 - protein, 9 aa, Influenza virus
RNGNMRCTI

SEQ ID NO: 483228 - protein, 9 aa, Influenza virus
RNGTYDHKE

SEQ ID NO: 483229 - protein, 9 aa, Influenza virus
RNGTYDHNI

SEQ ID NO: 483230 - protein, 9 aa, Influenza virus
RNGTYDYPK

SEQ ID NO: 483231 - protein, 9 aa, Influenza virus
RNGTYNHED

SEQ ID NO: 483232 - protein, 9 aa, Influenza virus
RNGTYNYPK

SEQ ID NO: 483233 - protein, 9 aa, Influenza virus
RNICEKLEQ

SEQ ID NO: 483234 - protein, 9 aa, Influenza virus
RNILRTQDS

SEQ ID NO: 483235 - protein, 9 aa, Influenza virus
RNILRTQES

SEQ ID NO: 483236 - protein, 9 aa, Influenza virus
RNILSIAPI

SEQ ID NO: 483237 - protein, 9 aa, Influenza virus
RNILSMAPI

SEQ ID NO: 483238 - protein, 9 aa, Influenza virus
RNIPEKQTR

SEQ ID NO: 483239 - protein, 9 aa, Influenza virus
RNIPERQTR

SEQ ID NO: 483240 - protein, 9 aa, Influenza virus
RNIPGKQAK

SEQ ID NO: 483241 - protein, 9 aa, Influenza virus
RNIPQIESR

SEQ ID NO: 483242 - protein, 9 aa, Influenza virus
RNIPSIQSR

SEQ ID NO: 483243 - protein, 9 aa, Influenza virus
RNIPSVQSR

SEQ ID NO: 483244 - protein, 9 aa, Influenza virus
RNITEIVYL

SEQ ID NO: 483245 - protein, 9 aa, Influenza virus
RNIVRRAAV

SEQ ID NO: 483246 - protein, 9 aa, Influenza virus
RNIVRRAIV

SEQ ID NO: 483247 - protein, 9 aa, Influenza virus
RNIVRRATV

SEQ ID NO: 483248 - protein, 9 aa, Influenza virus
RNKHSNGTI

SEQ ID NO: 483249 - protein, 9 aa, Influenza virus
RNKHSNGTT

SEQ ID NO: 483250 - protein, 9 aa, Influenza virus
RNKHSNSTT

SEQ ID NO: 483251 - protein, 9 aa, Influenza virus
RNKYLEEHP

SEQ ID NO: 483252 - protein, 9 aa, Influenza virus
RNLHDQIKR

SEQ ID NO: 483253 - protein, 9 aa, Influenza virus
RNLHDQVKR

SEQ ID NO: 483254 - protein, 9 aa, Influenza virus
RNLHDRIRR

SEQ ID NO: 483255 - protein, 9 aa, Influenza virus
RNLHDRTRR

SEQ ID NO: 483256 - protein, 9 aa, Influenza virus
RNLHDRVKR

SEQ ID NO: 483257 - protein, 9 aa, Influenza virus
RNLHDRVRR

SEQ ID NO: 483258 - protein, 9 aa, Influenza virus
RNLHEQIKR

SEQ ID NO: 483259 - protein, 9 aa, Influenza virus
RNLHERIRR

SEQ ID NO: 483260 - protein, 9 aa, Influenza virus
RNLHIPEVC

SEQ ID NO: 483261 - protein, 9 aa, Influenza virus
RNLYDKVRL

SEQ ID NO: 483262 - protein, 9 aa, Influenza virus
RNLYDKVRM

SEQ ID NO: 483263 - protein, 9 aa, Influenza virus
RNMRWLTLK

SEQ ID NO: 483264 - protein, 9 aa, Influenza virus
RNNMINNDL

SEQ ID NO: 483265 - protein, 9 aa, Influenza virus
RNNRKEPAL

SEQ ID NO: 483266 - protein, 9 aa, Influenza virus
RNNSYDHSK

SEQ ID NO: 483267 - protein, 9 aa, Influenza virus
RNNTYDHAQ

SEQ ID NO: 483268 - protein, 9 aa, Influenza virus
RNNTYDHKK

SEQ ID NO: 483269 - protein, 9 aa, Influenza virus
RNNTYDHSH

SEQ ID NO: 483270 - protein, 9 aa, Influenza virus
RNNTYDHSK

SEQ ID NO: 483271 - protein, 9 aa, Influenza virus
RNNTYDHSQ

SEQ ID NO: 483272 - protein, 9 aa, Influenza virus
RNNTYDHSR

SEQ ID NO: 483273 - protein, 9 aa, Influenza virus
RNNTYDHST

SEQ ID NO: 483274 - protein, 9 aa, Influenza virus
RNNTYDHTK

SEQ ID NO: 483275 - protein, 9 aa, Influenza virus
RNNTYDHTQ

SEQ ID NO: 483276 - protein, 9 aa, Influenza virus
RNNTYNHTE

SEQ ID NO: 483277 - protein, 9 aa, Influenza virus
RNNTYNHTQ

SEQ ID NO: 483278 - protein, 9 aa, Influenza virus
RNPGNAEIE

SEQ ID NO: 483279 - protein, 9 aa, Influenza virus
RNQIKIRRR

SEQ ID NO: 483280 - protein, 9 aa, Influenza virus
RNQPAATAL

SEQ ID NO: 483281 - protein, 9 aa, Influenza virus
RNQSGRISI

SEQ ID NO: 483282 - protein, 9 aa, Influenza virus
RNQVKIRRR

SEQ ID NO: 483283 - protein, 9 aa, Influenza virus
RNRHSNGTI

SEQ ID NO: 483284 - protein, 9 aa, Influenza virus
RNRSILNTS

SEQ ID NO: 483285 - protein, 9 aa, Influenza virus
RNRYLEEHP

SEQ ID NO: 483286 - protein, 9 aa, Influenza virus
RNSFFSRLN

SEQ ID NO: 483287 - protein, 9 aa, Influenza virus
RNSFYAELK

SEQ ID NO: 483288 - protein, 9 aa, Influenza virus
RNSIWTSSS

SEQ ID NO: 483289 - protein, 9 aa, Influenza virus
RNSSDICYP

SEQ ID NO: 483290 - protein, 9 aa, Influenza virus
RNSSILTDS

SEQ ID NO: 483291 - protein, 9 aa, Influenza virus
RNTFGDCPK

SEQ ID NO: 483292 - protein, 9 aa, Influenza virus
RNTIGDCPK

SEQ ID NO: 483293 - protein, 9 aa, Influenza virus
RNTIGNCPK

SEQ ID NO: 483294 - protein, 9 aa, Influenza virus
RNTPSIDPK

SEQ ID NO: 483295 - protein, 9 aa, Influenza virus
RNTPSIEPK

SEQ ID NO: 483296 - protein, 9 aa, Influenza virus
RNTPSIEPR

SEQ ID NO: 483297 - protein, 9 aa, Influenza virus
RNTPSVEPK

SEQ ID NO: 483298 - protein, 9 aa, Influenza virus
RNTPSVEPR

SEQ ID NO: 483299 - protein, 9 aa, Influenza virus
RNTRKEPAL

SEQ ID NO: 483300 - protein, 9 aa, Influenza virus
RNVLSIAPI

SEQ ID NO: 483301 - protein, 9 aa, Influenza virus
RNVLSVAPI

SEQ ID NO: 483302 - protein, 9 aa, Influenza virus
RNVPEKQTR

SEQ ID NO: 483303 - protein, 9 aa, Influenza virus
RNVPERQTR

SEQ ID NO: 483304 - protein, 9 aa, Influenza virus
RNVPETQTR

SEQ ID NO: 483305 - protein, 9 aa, Influenza virus
RNVPQAQDR

SEQ ID NO: 483306 - protein, 9 aa, Influenza virus
RNVPQAQNR

SEQ ID NO: 483307 - protein, 9 aa, Influenza virus
RNVPQIEAR

SEQ ID NO: 483308 - protein, 9 aa, Influenza virus
RNVPQIESR

SEQ ID NO: 483309 - protein, 9 aa, Influenza virus
RNVPQIQNR

SEQ ID NO: 483310 - protein, 9 aa, Influenza virus
RNVPQMESR

SEQ ID NO: 483311 - protein, 9 aa, Influenza virus
RNVPQVQDR

SEQ ID NO: 483312 - protein, 9 aa, Influenza virus
RNVPQVQNR

SEQ ID NO: 483313 - protein, 9 aa, Influenza virus
RNVPSIQSR

SEQ ID NO: 483314 - protein, 9 aa, Influenza virus
RNVTETLYL

SEQ ID NO: 483315 - protein, 9 aa, Influenza virus
RNVTVTHAK

SEQ ID NO: 483316 - protein, 9 aa, Influenza virus
RNVTVTHAQ

SEQ ID NO: 483317 - protein, 9 aa, Influenza virus
RNVTVTHSV

SEQ ID NO: 483318 - protein, 9 aa, Influenza virus
RNVVWLIKK

SEQ ID NO: 483319 - protein, 9 aa, Influenza virus
RNVVWLTKK

SEQ ID NO: 483320 - protein, 9 aa, Influenza virus
RNVVWLVKK

SEQ ID NO: 483321 - protein, 9 aa, Influenza virus
RNWRQANNG

SEQ ID NO: 483322 - protein, 9 aa, Influenza virus
RNWSGYSGS

SEQ ID NO: 483323 - protein, 9 aa, Influenza virus
RNWSKPQCQ

SEQ ID NO: 483324 - protein, 9 aa, Influenza virus
RNYFTAEIS

SEQ ID NO: 483325 - protein, 9 aa, Influenza virus
RNYFTAEVS

SEQ ID NO: 483326 - protein, 9 aa, Influenza virus
RNYFTTEVS

SEQ ID NO: 483327 - protein, 9 aa, Influenza virus
RPADGTGSC

SEQ ID NO: 483328 - protein, 9 aa, Influenza virus
RPCFWVELI

SEQ ID NO: 483329 - protein, 9 aa, Influenza virus
RPCFWVELV

SEQ ID NO: 483330 - protein, 9 aa, Influenza virus
RPDSSWLFG

SEQ ID NO: 483331 - protein, 9 aa, Influenza virus
RPEEAKYVE

SEQ ID NO: 483332 - protein, 9 aa, Influenza virus
RPEEAKYVW

SEQ ID NO: 483333 - protein, 9 aa, Influenza virus
RPEEVKYVW

SEQ ID NO: 483334 - protein, 9 aa, Influenza virus
RPFQNASRH

SEQ ID NO: 483335 - protein, 9 aa, Influenza virus
RPFVRGQQG

SEQ ID NO: 483336 - protein, 9 aa, Influenza virus
RPGDNITFS

SEQ ID NO: 483337 - protein, 9 aa, Influenza virus
RPGETLNVE

SEQ ID NO: 483338 - protein, 9 aa, Influenza virus
RPGQTLRVR

SEQ ID NO: 483339 - protein, 9 aa, Influenza virus
RPGVKGFGF

SEQ ID NO: 483340 - protein, 9 aa, Influenza virus
RPGYNGQKS

SEQ ID NO: 483341 - protein, 9 aa, Influenza virus
RPGYNGQRS

SEQ ID NO: 483342 - protein, 9 aa, Influenza virus
RPHPEDLNG

SEQ ID NO: 483343 - protein, 9 aa, Influenza virus
RPIGISSMV

SEQ ID NO: 483344 - protein, 9 aa, Influenza virus
RPIIEIDMN

SEQ ID NO: 483345 - protein, 9 aa, Influenza virus
RPIIEIDMS

SEQ ID NO: 483346 - protein, 9 aa, Influenza virus
RPIIEIDMT

SEQ ID NO: 483347 - protein, 9 aa, Influenza virus
RPILSPLTK

SEQ ID NO: 483348 - protein, 9 aa, Influenza virus
RPITEINTW

SEQ ID NO: 483349 - protein, 9 aa, Influenza virus
RPKEDEVWW

SEQ ID NO: 483350 - protein, 9 aa, Influenza virus
RPKEDKVWW

SEQ ID NO: 483351 - protein, 9 aa, Influenza virus
RPKEDRVWW

SEQ ID NO: 483352 - protein, 9 aa, Influenza virus
RPKEEKVWW

SEQ ID NO: 483353 - protein, 9 aa, Influenza virus
RPKEIEGIC

SEQ ID NO: 483354 - protein, 9 aa, Influenza virus
RPKEMEGIC

SEQ ID NO: 483355 - protein, 9 aa, Influenza virus
RPKEMEGVC

SEQ ID NO: 483356 - protein, 9 aa, Influenza virus
RPKENPAHK

SEQ ID NO: 483357 - protein, 9 aa, Influenza virus
RPKVNGQAG

SEQ ID NO: 483358 - protein, 9 aa, Influenza virus
RPKVNGQSG

SEQ ID NO: 483359 - protein, 9 aa, Influenza virus
RPLILKDCS

SEQ ID NO: 483360 - protein, 9 aa, Influenza virus
RPLILRDCS

SEQ ID NO: 483361 - protein, 9 aa, Influenza virus
RPLIRGQQG

SEQ ID NO: 483362 - protein, 9 aa, Influenza virus
RPLVMGQQG

SEQ ID NO: 483363 - protein, 9 aa, Influenza virus
RPLVNGQRG

SEQ ID NO: 483364 - protein, 9 aa, Influenza virus
RPLVNGQSG

SEQ ID NO: 483365 - protein, 9 aa, Influenza virus
RPLVREQQG

SEQ ID NO: 483366 - protein, 9 aa, Influenza virus
RPLVRGQQG

SEQ ID NO: 483367 - protein, 9 aa, Influenza virus
RPLVRGQSG

SEQ ID NO: 483368 - protein, 9 aa, Influenza virus
RPLVRSQSG

SEQ ID NO: 483369 - protein, 9 aa, Influenza virus
RPMDGTGSC

SEQ ID NO: 483370 - protein, 9 aa, Influenza virus
RPMDSTGSC

SEQ ID NO: 483371 - protein, 9 aa, Influenza virus
RPNENPAHK

SEQ ID NO: 483372 - protein, 9 aa, Influenza virus
RPNENPVHK

SEQ ID NO: 483373 - protein, 9 aa, Influenza virus
RPNIGPRPL

SEQ ID NO: 483374 - protein, 9 aa, Influenza virus
RPPVNGQSG

SEQ ID NO: 483375 - protein, 9 aa, Influenza virus
RPQINGQSG

SEQ ID NO: 483376 - protein, 9 aa, Influenza virus
RPQMNGQSG

SEQ ID NO: 483377 - protein, 9 aa, Influenza virus
RPQVNGQRG

SEQ ID NO: 483378 - protein, 9 aa, Influenza virus
RPQVNGQSG

SEQ ID NO: 483379 - protein, 9 aa, Influenza virus
RPRRGLFGA

SEQ ID NO: 483380 - protein, 9 aa, Influenza virus
RPRVNGQSG

SEQ ID NO: 483381 - protein, 9 aa, Influenza virus
RPRVRNQSG

SEQ ID NO: 483382 - protein, 9 aa, Influenza virus
RPRYNGQRS

SEQ ID NO: 483383 - protein, 9 aa, Influenza virus
RPSAPEGMC

SEQ ID NO: 483384 - protein, 9 aa, Influenza virus
RPTAVDTCY

SEQ ID NO: 483385 - protein, 9 aa, Influenza virus
RPTRNGWGC

SEQ ID NO: 483386 - protein, 9 aa, Influenza virus
RPTTEINTW

SEQ ID NO: 483387 - protein, 9 aa, Influenza virus
RPTTTIKTW

SEQ ID NO: 483388 - protein, 9 aa, Influenza virus
RPVAEINTW

SEQ ID NO: 483389 - protein, 9 aa, Influenza virus
RPVAKAGFI

SEQ ID NO: 483390 - protein, 9 aa, Influenza virus
RPVDGIGSC

SEQ ID NO: 483391 - protein, 9 aa, Influenza virus
RPVDGTGSC

SEQ ID NO: 483392 - protein, 9 aa, Influenza virus
RPVGISSMG

SEQ ID NO: 483393 - protein, 9 aa, Influenza virus
RPVGISSMM

SEQ ID NO: 483394 - protein, 9 aa, Influenza virus
RPVGISSMV

SEQ ID NO: 483395 - protein, 9 aa, Influenza virus
RPVIEIDMN

SEQ ID NO: 483396 - protein, 9 aa, Influenza virus
RPVIEIDMS

SEQ ID NO: 483397 - protein, 9 aa, Influenza virus
RPVTEINTW

SEQ ID NO: 483398 - protein, 9 aa, Influenza virus
RPWIRFNSD

SEQ ID NO: 483399 - protein, 9 aa, Influenza virus
RPWIRFNSN

SEQ ID NO: 483400 - protein, 9 aa, Influenza virus
RPWIRINNE

SEQ ID NO: 483401 - protein, 9 aa, Influenza virus
RPWISFDQN

SEQ ID NO: 483402 - protein, 9 aa, Influenza virus
RPWMRINNE

SEQ ID NO: 483403 - protein, 9 aa, Influenza virus
RPWMRISNE

SEQ ID NO: 483404 - protein, 9 aa, Influenza virus
RPWVRGLSS

SEQ ID NO: 483405 - protein, 9 aa, Influenza virus
RPWVRGQSG

SEQ ID NO: 483406 - protein, 9 aa, Influenza virus
RPWVRINNE

SEQ ID NO: 483407 - protein, 9 aa, Influenza virus
RPWVRMNNE

SEQ ID NO: 483408 - protein, 9 aa, Influenza virus
RPWVSFDQN

SEQ ID NO: 483409 - protein, 9 aa, Influenza virus
RPWVSFNHN

SEQ ID NO: 483410 - protein, 9 aa, Influenza virus
RPWVSFNQD

SEQ ID NO: 483411 - protein, 9 aa, Influenza virus
RPWVSFNQN

SEQ ID NO: 483412 - protein, 9 aa, Influenza virus
RQANNGDDA

SEQ ID NO: 483413 - protein, 9 aa, Influenza virus
RQANNGEDA

SEQ ID NO: 483414 - protein, 9 aa, Influenza virus
RQANNGEDS

SEQ ID NO: 483415 - protein, 9 aa, Influenza virus
RQANNGEEA

SEQ ID NO: 483416 - protein, 9 aa, Influenza virus
RQANSGEDA

SEQ ID NO: 483417 - protein, 9 aa, Influenza virus
RQASPSCLV

SEQ ID NO: 483418 - protein, 9 aa, Influenza virus
RQCFNPMII

SEQ ID NO: 483419 - protein, 9 aa, Influenza virus
RQCFNPMIV

SEQ ID NO: 483420 - protein, 9 aa, Influenza virus
RQCFNPMTV

SEQ ID NO: 483421 - protein, 9 aa, Influenza virus
RQCFNPMVV

SEQ ID NO: 483422 - protein, 9 aa, Influenza virus
RQEALQNRI

SEQ ID NO: 483423 - protein, 9 aa, Influenza virus
RQEIDGIKL

SEQ ID NO: 483424 - protein, 9 aa, Influenza virus
RQEIEGARL

SEQ ID NO: 483425 - protein, 9 aa, Influenza virus
RQEIEGIKL

SEQ ID NO: 483426 - protein, 9 aa, Influenza virus
RQEIEGIRL

SEQ ID NO: 483427 - protein, 9 aa, Influenza virus
RQEIEGVKL

SEQ ID NO: 483428 - protein, 9 aa, Influenza virus
RQEIEGVRL

SEQ ID NO: 483429 - protein, 9 aa, Influenza virus
RQEIGGVKL

SEQ ID NO: 483430 - protein, 9 aa, Influenza virus
RQEINGIKL

SEQ ID NO: 483431 - protein, 9 aa, Influenza virus
RQEIVDNKN

SEQ ID NO: 483432 - protein, 9 aa, Influenza virus
RQEIVDNNN

SEQ ID NO: 483433 - protein, 9 aa, Influenza virus
RQEIVDNSN

SEQ ID NO: 483434 - protein, 9 aa, Influenza virus
RQEIVGNDN

SEQ ID NO: 483435 - protein, 9 aa, Influenza virus
RQEIVSNDN

SEQ ID NO: 483436 - protein, 9 aa, Influenza virus
RQEKNPALR

SEQ ID NO: 483437 - protein, 9 aa, Influenza virus
RQEKNPSLR

SEQ ID NO: 483438 - protein, 9 aa, Influenza virus
RQGNSVWAG

SEQ ID NO: 483439 - protein, 9 aa, Influenza virus
RQGTSVWAG

SEQ ID NO: 483440 - protein, 9 aa, Influenza virus
RQIGNVINW

SEQ ID NO: 483441 - protein, 9 aa, Influenza virus
RQIIRESGG

SEQ ID NO: 483442 - protein, 9 aa, Influenza virus
RQIIVDNNN

SEQ ID NO: 483443 - protein, 9 aa, Influenza virus
RQILRESGG

SEQ ID NO: 483444 - protein, 9 aa, Influenza virus
RQILRGSGG

SEQ ID NO: 483445 - protein, 9 aa, Influenza virus
RQILRKSGG

SEQ ID NO: 483446 - protein, 9 aa, Influenza virus
RQILRRSGG

SEQ ID NO: 483447 - protein, 9 aa, Influenza virus
RQILRTQES

SEQ ID NO: 483448 - protein, 9 aa, Influenza virus
RQKIMESGG

SEQ ID NO: 483449 - protein, 9 aa, Influenza virus
RQKINGVKL

SEQ ID NO: 483450 - protein, 9 aa, Influenza virus
RQKISGVKL

SEQ ID NO: 483451 - protein, 9 aa, Influenza virus
RQKRGLFGA

SEQ ID NO: 483452 - protein, 9 aa, Influenza virus
RQKSLIWLW

SEQ ID NO: 483453 - protein, 9 aa, Influenza virus
RQKVMESGG

SEQ ID NO: 483454 - protein, 9 aa, Influenza virus
RQKVNGVKL

SEQ ID NO: 483455 - protein, 9 aa, Influenza virus
RQKWWVWLW

SEQ ID NO: 483456 - protein, 9 aa, Influenza virus
RQLRENAED

SEQ ID NO: 483457 - protein, 9 aa, Influenza virus
RQLRENAEE

SEQ ID NO: 483458 - protein, 9 aa, Influenza virus
RQMVHAMRT

SEQ ID NO: 483459 - protein, 9 aa, Influenza virus
RQMVQAMRA

SEQ ID NO: 483460 - protein, 9 aa, Influenza virus
RQMVQAMRT

SEQ ID NO: 483461 - protein, 9 aa, Influenza virus
RQNAEEDGK

SEQ ID NO: 483462 - protein, 9 aa, Influenza virus
RQNAEEDGR

SEQ ID NO: 483463 - protein, 9 aa, Influenza virus
RQNPTEEQA

SEQ ID NO: 483464 - protein, 9 aa, Influenza virus
RQRINGVKL

SEQ ID NO: 483465 - protein, 9 aa, Influenza virus
RQSERGEDT

SEQ ID NO: 483466 - protein, 9 aa, Influenza virus
RQSERGEET

SEQ ID NO: 483467 - protein, 9 aa, Influenza virus
RQSFSPSPG

SEQ ID NO: 483468 - protein, 9 aa, Influenza virus
RQTFDWTLN

SEQ ID NO: 483469 - protein, 9 aa, Influenza virus
RQTRGIFGA

SEQ ID NO: 483470 - protein, 9 aa, Influenza virus
RQTRGLFGA

SEQ ID NO: 483471 - protein, 9 aa, Influenza virus
RQTYDWTLN

SEQ ID NO: 483472 - protein, 9 aa, Influenza virus
RQVCIAWSS

SEQ ID NO: 483473 - protein, 9 aa, Influenza virus
RQVCMAWSS

SEQ ID NO: 483474 - protein, 9 aa, Influenza virus
RQVCVAWSS

SEQ ID NO: 483475 - protein, 9 aa, Influenza virus
RQVIVDNNN

SEQ ID NO: 483476 - protein, 9 aa, Influenza virus
RQVIVDNNS

SEQ ID NO: 483477 - protein, 9 aa, Influenza virus
RQVIVDNSN

SEQ ID NO: 483478 - protein, 9 aa, Influenza virus
RQVLRESGG

SEQ ID NO: 483479 - protein, 9 aa, Influenza virus
RRAAVSADP

SEQ ID NO: 483480 - protein, 9 aa, Influenza virus
RRAEIIKME

SEQ ID NO: 483481 - protein, 9 aa, Influenza virus
RRAIATPGM

SEQ ID NO: 483482 - protein, 9 aa, Influenza virus
RRAIVSADP

SEQ ID NO: 483483 - protein, 9 aa, Influenza virus
RRATVSADP

SEQ ID NO: 483484 - protein, 9 aa, Influenza virus
RRCLLQSLQ

SEQ ID NO: 483485 - protein, 9 aa, Influenza virus
RRDILRTQE

SEQ ID NO: 483486 - protein, 9 aa, Influenza virus
RRDQKALKG

SEQ ID NO: 483487 - protein, 9 aa, Influenza virus
RRDQKSLKG

SEQ ID NO: 483488 - protein, 9 aa, Influenza virus
RRDQKSLRG

SEQ ID NO: 483489 - protein, 9 aa, Influenza virus
RRDQMAHCR

SEQ ID NO: 483490 - protein, 9 aa, Influenza virus
RRDQRALKG

SEQ ID NO: 483491 - protein, 9 aa, Influenza virus
RRDQRSLRG

SEQ ID NO: 483492 - protein, 9 aa, Influenza virus
RRDYFTAEV

SEQ ID NO: 483493 - protein, 9 aa, Influenza virus
RREIHIYYL

SEQ ID NO: 483494 - protein, 9 aa, Influenza virus
RREVHIYYL

SEQ ID NO: 483495 - protein, 9 aa, Influenza virus
RREVHMYYL

SEQ ID NO: 483496 - protein, 9 aa, Influenza virus
RREVHTYYL

SEQ ID NO: 483497 - protein, 9 aa, Influenza virus
RREVHVYYL

SEQ ID NO: 483498 - protein, 9 aa, Influenza virus
RRFIQNALN

SEQ ID NO: 483499 - protein, 9 aa, Influenza virus
RRFVQNALN

SEQ ID NO: 483500 - protein, 9 aa, Influenza virus
RRFVQNALS

SEQ ID NO: 483501 - protein, 9 aa, Influenza virus
RRGLFGAIA

SEQ ID NO: 483502 - protein, 9 aa, Influenza virus
RRGQGHLDE

SEQ ID NO: 483503 - protein, 9 aa, Influenza virus
RRGVKGFGF

SEQ ID NO: 483504 - protein, 9 aa, Influenza virus
RRICEKLEQ

SEQ ID NO: 483505 - protein, 9 aa, Influenza virus
RRIDFHWLF

SEQ ID NO: 483506 - protein, 9 aa, Influenza virus
RRIDFHWLL

SEQ ID NO: 483507 - protein, 9 aa, Influenza virus
RRIDFNWLL

SEQ ID NO: 483508 - protein, 9 aa, Influenza virus
RRIENLNKK

SEQ ID NO: 483509 - protein, 9 aa, Influenza virus
RRIENLNRK

SEQ ID NO: 483510 - protein, 9 aa, Influenza virus
RRIESLNKK

SEQ ID NO: 483511 - protein, 9 aa, Influenza virus
RRINMLADR

SEQ ID NO: 483512 - protein, 9 aa, Influenza virus
RRIWRQANN

SEQ ID NO: 483513 - protein, 9 aa, Influenza virus
RRKKRGLFG

SEQ ID NO: 483514 - protein, 9 aa, Influenza virus
RRKRGLFGA

SEQ ID NO: 483515 - protein, 9 aa, Influenza virus
RRKRRGLFG

SEQ ID NO: 483516 - protein, 9 aa, Influenza virus
RRKTNLYGF

SEQ ID NO: 483517 - protein, 9 aa, Influenza virus
RRLENLNKK

SEQ ID NO: 483518 - protein, 9 aa, Influenza virus
RRLENLNKR

SEQ ID NO: 483519 - protein, 9 aa, Influenza virus
RRLENLSKR

SEQ ID NO: 483520 - protein, 9 aa, Influenza virus
RRLSANAID

SEQ ID NO: 483521 - protein, 9 aa, Influenza virus
RRLSANAVD

SEQ ID NO: 483522 - protein, 9 aa, Influenza virus
RRLSTNAID

SEQ ID NO: 483523 - protein, 9 aa, Influenza virus
RRLSTNAMD

SEQ ID NO: 483524 - protein, 9 aa, Influenza virus
RRLSVNAID

SEQ ID NO: 483525 - protein, 9 aa, Influenza virus
RRLTTTIKP

SEQ ID NO: 483526 - protein, 9 aa, Influenza virus
RRLTTTIKT

SEQ ID NO: 483527 - protein, 9 aa, Influenza virus
RRLTTTIRT

SEQ ID NO: 483528 - protein, 9 aa, Influenza virus
RRLTTTVKT

SEQ ID NO: 483529 - protein, 9 aa, Influenza virus
RRLTVLGKD

SEQ ID NO: 483530 - protein, 9 aa, Influenza virus
RRMVQAMRA

SEQ ID NO: 483531 - protein, 9 aa, Influenza virus
RRNKYLEEH

SEQ ID NO: 483532 - protein, 9 aa, Influenza virus
RRNRYLEEH

SEQ ID NO: 483533 - protein, 9 aa, Influenza virus
RRNSSDICY

SEQ ID NO: 483534 - protein, 9 aa, Influenza virus
RRNWRQANN

SEQ ID NO: 483535 - protein, 9 aa, Influenza virus
RRNYFTAEI

SEQ ID NO: 483536 - protein, 9 aa, Influenza virus
RRNYFTAEV

SEQ ID NO: 483537 - protein, 9 aa, Influenza virus
RRNYFTTEV

SEQ ID NO: 483538 - protein, 9 aa, Influenza virus
RRPDSSWLF

SEQ ID NO: 483539 - protein, 9 aa, Influenza virus
RRPIGISSM

SEQ ID NO: 483540 - protein, 9 aa, Influenza virus
RRPVAEINT

SEQ ID NO: 483541 - protein, 9 aa, Influenza virus
RRPVAKAGF

SEQ ID NO: 483542 - protein, 9 aa, Influenza virus
RRPVGISSM

SEQ ID NO: 483543 - protein, 9 aa, Influenza virus
RRPVTEINT

SEQ ID NO: 483544 - protein, 9 aa, Influenza virus
RRQILRTQE

SEQ ID NO: 483545 - protein, 9 aa, Influenza virus
RRQKRGLFG

SEQ ID NO: 483546 - protein, 9 aa, Influenza virus
RRQKSLIWL

SEQ ID NO: 483547 - protein, 9 aa, Influenza virus
RRQKWWVWL

SEQ ID NO: 483548 - protein, 9 aa, Influenza virus
RRQLRENAE

SEQ ID NO: 483549 - protein, 9 aa, Influenza virus
RRRFIQNAL

SEQ ID NO: 483550 - protein, 9 aa, Influenza virus
RRRFVQNAL

SEQ ID NO: 483551 - protein, 9 aa, Influenza virus
RRRGLFGAI

SEQ ID NO: 483552 - protein, 9 aa, Influenza virus
RRRKKRGLF

SEQ ID NO: 483553 - protein, 9 aa, Influenza virus
RRRKRGLFG

SEQ ID NO: 483554 - protein, 9 aa, Influenza virus
RRRTNLYGF

SEQ ID NO: 483555 - protein, 9 aa, Influenza virus
RRRVDINPG

SEQ ID NO: 483556 - protein, 9 aa, Influenza virus
RRRVDMNPG

SEQ ID NO: 483557 - protein, 9 aa, Influenza virus
RRRVDTNPG

SEQ ID NO: 483558 - protein, 9 aa, Influenza virus
RRRVDVNPG

SEQ ID NO: 483559 - protein, 9 aa, Influenza virus
RRSGAAGAA

SEQ ID NO: 483560 - protein, 9 aa, Influenza virus
RRSGGIGKE

SEQ ID NO: 483561 - protein, 9 aa, Influenza virus
RRSGGISKE

SEQ ID NO: 483562 - protein, 9 aa, Influenza virus
RRSYFTAEV

SEQ ID NO: 483563 - protein, 9 aa, Influenza virus
RRTNLYGFI

SEQ ID NO: 483564 - protein, 9 aa, Influenza virus
RRVDINPGH

SEQ ID NO: 483565 - protein, 9 aa, Influenza virus
RRVDMNPGH

SEQ ID NO: 483566 - protein, 9 aa, Influenza virus
RRVDTNPGH

SEQ ID NO: 483567 - protein, 9 aa, Influenza virus
RRVDVNPGH

SEQ ID NO: 483568 - protein, 9 aa, Influenza virus
RRVWRQANN

SEQ ID NO: 483569 - protein, 9 aa, Influenza virus
RRYELEIGT

SEQ ID NO: 483570 - protein, 9 aa, Influenza virus
RRYGPALSI

SEQ ID NO: 483571 - protein, 9 aa, Influenza virus
RSALILRGA

SEQ ID NO: 483572 - protein, 9 aa, Influenza virus
RSALILRGS

SEQ ID NO: 483573 - protein, 9 aa, Influenza virus
RSAYERMCN

SEQ ID NO: 483574 - protein, 9 aa, Influenza virus
RSDGNLIAP

SEQ ID NO: 483575 - protein, 9 aa, Influenza virus
RSDKICIGY

SEQ ID NO: 483576 - protein, 9 aa, Influenza virus
RSDKICLGH

SEQ ID NO: 483577 - protein, 9 aa, Influenza virus
RSDQISIVP

SEQ ID NO: 483578 - protein, 9 aa, Influenza virus
RSEKLVLAT

SEQ ID NO: 483579 - protein, 9 aa, Influenza virus
RSESSFYAE

SEQ ID NO: 483580 - protein, 9 aa, Influenza virus
RSFKPNIGP

SEQ ID NO: 483581 - protein, 9 aa, Influenza virus
RSFQPNIGP

SEQ ID NO: 483582 - protein, 9 aa, Influenza virus
RSFRPNIGP

SEQ ID NO: 483583 - protein, 9 aa, Influenza virus
RSFSRTELI

SEQ ID NO: 483584 - protein, 9 aa, Influenza virus
RSGAAGAAI

SEQ ID NO: 483585 - protein, 9 aa, Influenza virus
RSGAAGAAV

SEQ ID NO: 483586 - protein, 9 aa, Influenza virus
RSGFEIIKV

SEQ ID NO: 483587 - protein, 9 aa, Influenza virus
RSGFEIIRV

SEQ ID NO: 483588 - protein, 9 aa, Influenza virus
RSGFEIIWD

SEQ ID NO: 483589 - protein, 9 aa, Influenza virus
RSGFEILLI

SEQ ID NO: 483590 - protein, 9 aa, Influenza virus
RSGFEMIWD

SEQ ID NO: 483591 - protein, 9 aa, Influenza virus
RSGFEMLKI

SEQ ID NO: 483592 - protein, 9 aa, Influenza virus
RSGFEMLKV

SEQ ID NO: 483593 - protein, 9 aa, Influenza virus
RSGFEMLRI

SEQ ID NO: 483594 - protein, 9 aa, Influenza virus
RSGFEMVWD

SEQ ID NO: 483595 - protein, 9 aa, Influenza virus
RSGFEVIKV

SEQ ID NO: 483596 - protein, 9 aa, Influenza virus
RSGFEVIRV

SEQ ID NO: 483597 - protein, 9 aa, Influenza virus
RSGFEVLFI

SEQ ID NO: 483598 - protein, 9 aa, Influenza virus
RSGFEVLKV

SEQ ID NO: 483599 - protein, 9 aa, Influenza virus
RSGFEVLLI

SEQ ID NO: 483600 - protein, 9 aa, Influenza virus
RSGMDPRMC

SEQ ID NO: 483601 - protein, 9 aa, Influenza virus
RSGPSFYAE

SEQ ID NO: 483602 - protein, 9 aa, Influenza virus
RSGQNHGIC

SEQ ID NO: 483603 - protein, 9 aa, Influenza virus
RSGSSFYAE

SEQ ID NO: 483604 - protein, 9 aa, Influenza virus
RSGTSKACN

SEQ ID NO: 483605 - protein, 9 aa, Influenza virus
RSGYEILKV

SEQ ID NO: 483606 - protein, 9 aa, Influenza virus
RSGYEMLKV

SEQ ID NO: 483607 - protein, 9 aa, Influenza virus
RSGYETFKV

SEQ ID NO: 483608 - protein, 9 aa, Influenza virus
RSGYETFRV

SEQ ID NO: 483609 - protein, 9 aa, Influenza virus
RSGYEVLKV

SEQ ID NO: 483610 - protein, 9 aa, Influenza virus
RSGYSGIFS

SEQ ID NO: 483611 - protein, 9 aa, Influenza virus
RSGYSGSFI

SEQ ID NO: 483612 - protein, 9 aa, Influenza virus
RSGYSGVFS

SEQ ID NO: 483613 - protein, 9 aa, Influenza virus
RSGYWAIRT

SEQ ID NO: 483614 - protein, 9 aa, Influenza virus
RSHEQMETG

SEQ ID NO: 483615 - protein, 9 aa, Influenza virus
RSHKICIGY

SEQ ID NO: 483616 - protein, 9 aa, Influenza virus
RSHLRNDTD

SEQ ID NO: 483617 - protein, 9 aa, Influenza virus
RSICEKLEQ

SEQ ID NO: 483618 - protein, 9 aa, Influenza virus
RSIEEKFEI

SEQ ID NO: 483619 - protein, 9 aa, Influenza virus
RSIIFNMER

SEQ ID NO: 483620 - protein, 9 aa, Influenza virus
RSILANNGK

SEQ ID NO: 483621 - protein, 9 aa, Influenza virus
RSILANNGR

SEQ ID NO: 483622 - protein, 9 aa, Influenza virus
RSILASSGS

SEQ ID NO: 483623 - protein, 9 aa, Influenza virus
RSILNTSQR

SEQ ID NO: 483624 - protein, 9 aa, Influenza virus
RSINWLTKK

SEQ ID NO: 483625 - protein, 9 aa, Influenza virus
RSIRWLTLK

SEQ ID NO: 483626 - protein, 9 aa, Influenza virus
RSIVASSGT

SEQ ID NO: 483627 - protein, 9 aa, Influenza virus
RSIVRRATV

SEQ ID NO: 483628 - protein, 9 aa, Influenza virus
RSKFLLMDA

SEQ ID NO: 483629 - protein, 9 aa, Influenza virus
RSKFLLMDS

SEQ ID NO: 483630 - protein, 9 aa, Influenza virus
RSKIITIGS

SEQ ID NO: 483631 - protein, 9 aa, Influenza virus
RSKINEVKL

SEQ ID NO: 483632 - protein, 9 aa, Influenza virus
RSKINGVIL

SEQ ID NO: 483633 - protein, 9 aa, Influenza virus
RSKINGVKL

SEQ ID NO: 483634 - protein, 9 aa, Influenza virus
RSKINGVRL

SEQ ID NO: 483635 - protein, 9 aa, Influenza virus
RSKVNGQSG

SEQ ID NO: 483636 - protein, 9 aa, Influenza virus
RSKYWAIRT

SEQ ID NO: 483637 - protein, 9 aa, Influenza virus
RSLFSSIKK

SEQ ID NO: 483638 - protein, 9 aa, Influenza virus
RSLFSSIKR

SEQ ID NO: 483639 - protein, 9 aa, Influenza virus
RSLIASSGT

SEQ ID NO: 483640 - protein, 9 aa, Influenza virus
RSLIQFPIG

SEQ ID NO: 483641 - protein, 9 aa, Influenza virus
RSLIQFPMG

SEQ ID NO: 483642 - protein, 9 aa, Influenza virus
RSLIRFPIG

SEQ ID NO: 483643 - protein, 9 aa, Influenza virus
RSLIRFPVG

SEQ ID NO: 483644 - protein, 9 aa, Influenza virus
RSLISWPLS

SEQ ID NO: 483645 - protein, 9 aa, Influenza virus
RSLKLAIGL

SEQ ID NO: 483646 - protein, 9 aa, Influenza virus
RSLKLATGL

SEQ ID NO: 483647 - protein, 9 aa, Influenza virus
RSLLLATGM

SEQ ID NO: 483648 - protein, 9 aa, Influenza virus
RSLMLATGM

SEQ ID NO: 483649 - protein, 9 aa, Influenza virus
RSLMSCPVG

SEQ ID NO: 483650 - protein, 9 aa, Influenza virus
RSLVASSGN

SEQ ID NO: 483651 - protein, 9 aa, Influenza virus
RSLVASSGT

SEQ ID NO: 483652 - protein, 9 aa, Influenza virus
RSLWDSFRQ

SEQ ID NO: 483653 - protein, 9 aa, Influenza virus
RSLYSGFVR

SEQ ID NO: 483654 - protein, 9 aa, Influenza virus
RSMKWLTLK

SEQ ID NO: 483655 - protein, 9 aa, Influenza virus
RSMRWLTLK

SEQ ID NO: 483656 - protein, 9 aa, Influenza virus
RSNAPSGIE

SEQ ID NO: 483657 - protein, 9 aa, Influenza virus
RSNAPSGVE

SEQ ID NO: 483658 - protein, 9 aa, Influenza virus
RSNENLIAP

SEQ ID NO: 483659 - protein, 9 aa, Influenza virus
RSNENPAHK

SEQ ID NO: 483660 - protein, 9 aa, Influenza virus
RSNGNLIAP

SEQ ID NO: 483661 - protein, 9 aa, Influenza virus
RSNGNLVAP

SEQ ID NO: 483662 - protein, 9 aa, Influenza virus
RSNIFNMER

SEQ ID NO: 483663 - protein, 9 aa, Influenza virus
RSPFRALIS

SEQ ID NO: 483664 - protein, 9 aa, Influenza virus
RSPFRALVS

SEQ ID NO: 483665 - protein, 9 aa, Influenza virus
RSPFRTLMS

SEQ ID NO: 483666 - protein, 9 aa, Influenza virus
RSPGNAEIE

SEQ ID NO: 483667 - protein, 9 aa, Influenza virus
RSPHRALMS

SEQ ID NO: 483668 - protein, 9 aa, Influenza virus
RSPHRTLLM

SEQ ID NO: 483669 - protein, 9 aa, Influenza virus
RSPHRTLMS

SEQ ID NO: 483670 - protein, 9 aa, Influenza virus
RSPQRTLMS

SEQ ID NO: 483671 - protein, 9 aa, Influenza virus
RSPYRALIS

SEQ ID NO: 483672 - protein, 9 aa, Influenza virus
RSPYRALMS

SEQ ID NO: 483673 - protein, 9 aa, Influenza virus
RSPYRTLLM

SEQ ID NO: 483674 - protein, 9 aa, Influenza virus
RSPYRTLMS

SEQ ID NO: 483675 - protein, 9 aa, Influenza virus
RSQFRALIS

SEQ ID NO: 483676 - protein, 9 aa, Influenza virus
RSQSGRISF

SEQ ID NO: 483677 - protein, 9 aa, Influenza virus
RSQYRALIS

SEQ ID NO: 483678 - protein, 9 aa, Influenza virus
RSQYRALVS

SEQ ID NO: 483679 - protein, 9 aa, Influenza virus
RSQYRSLIS

SEQ ID NO: 483680 - protein, 9 aa, Influenza virus
RSQYSGFVR

SEQ ID NO: 483681 - protein, 9 aa, Influenza virus
RSRIDYYWS

SEQ ID NO: 483682 - protein, 9 aa, Influenza virus
RSRNGFEML

SEQ ID NO: 483683 - protein, 9 aa, Influenza virus
RSRSGFEML

SEQ ID NO: 483684 - protein, 9 aa, Influenza virus
RSRSGFEVL

SEQ ID NO: 483685 - protein, 9 aa, Influenza virus
RSRSSFYAE

SEQ ID NO: 483686 - protein, 9 aa, Influenza virus
RSRYSGFVR

SEQ ID NO: 483687 - protein, 9 aa, Influenza virus
RSRYWAIRT

SEQ ID NO: 483688 - protein, 9 aa, Influenza virus
RSSCHDGKA

SEQ ID NO: 483689 - protein, 9 aa, Influenza virus
RSSFEIIKV

SEQ ID NO: 483690 - protein, 9 aa, Influenza virus
RSSFYAEMK

SEQ ID NO: 483691 - protein, 9 aa, Influenza virus
RSSSSFYAE

SEQ ID NO: 483692 - protein, 9 aa, Influenza virus
RSTIGDCPK

SEQ ID NO: 483693 - protein, 9 aa, Influenza virus
RSWKKQILR

SEQ ID NO: 483694 - protein, 9 aa, Influenza virus
RSWMKIYWH

SEQ ID NO: 483695 - protein, 9 aa, Influenza virus
RSWMKLYWH

SEQ ID NO: 483696 - protein, 9 aa, Influenza virus
RSWRKKILR

SEQ ID NO: 483697 - protein, 9 aa, Influenza virus
RSWRKQILR

SEQ ID NO: 483698 - protein, 9 aa, Influenza virus
RSWRRQILR

SEQ ID NO: 483699 - protein, 9 aa, Influenza virus
RSWSKPQCQ

SEQ ID NO: 483700 - protein, 9 aa, Influenza virus
RSWSYIVER

SEQ ID NO: 483701 - protein, 9 aa, Influenza virus
RSYEQMETD

SEQ ID NO: 483702 - protein, 9 aa, Influenza virus
RSYEQMETG

SEQ ID NO: 483703 - protein, 9 aa, Influenza virus
RSYEQMETS

SEQ ID NO: 483704 - protein, 9 aa, Influenza virus
RSYFTAEVS

SEQ ID NO: 483705 - protein, 9 aa, Influenza virus
RSYNNTSGE

SEQ ID NO: 483706 - protein, 9 aa, Influenza virus
RSYNNTSGG

SEQ ID NO: 483707 - protein, 9 aa, Influenza virus
RSYNNTSGK

SEQ ID NO: 483708 - protein, 9 aa, Influenza virus
RTAFRGLIS

SEQ ID NO: 483709 - protein, 9 aa, Influenza virus
RTAFRGLMS

SEQ ID NO: 483710 - protein, 9 aa, Influenza virus
RTATREGKH

SEQ ID NO: 483711 - protein, 9 aa, Influenza virus
RTAYERMCN

SEQ ID NO: 483712 - protein, 9 aa, Influenza virus
RTCKLLGIN

SEQ ID NO: 483713 - protein, 9 aa, Influenza virus
RTCKLVGIN

SEQ ID NO: 483714 - protein, 9 aa, Influenza virus
RTDGATSAC

SEQ ID NO: 483715 - protein, 9 aa, Influenza virus
RTELINPNK

SEQ ID NO: 483716 - protein, 9 aa, Influenza virus
RTELINPSK

SEQ ID NO: 483717 - protein, 9 aa, Influenza virus
RTELIPPSK

SEQ ID NO: 483718 - protein, 9 aa, Influenza virus
RTELISPNK

SEQ ID NO: 483719 - protein, 9 aa, Influenza virus
RTELISPSK

SEQ ID NO: 483720 - protein, 9 aa, Influenza virus
RTESLQNRI

SEQ ID NO: 483721 - protein, 9 aa, Influenza virus
RTFFGWKEP

SEQ ID NO: 483722 - protein, 9 aa, Influenza virus
RTFFLTHGA

SEQ ID NO: 483723 - protein, 9 aa, Influenza virus
RTFFLTHGS

SEQ ID NO: 483724 - protein, 9 aa, Influenza virus
RTFFLTQGA

SEQ ID NO: 483725 - protein, 9 aa, Influenza virus
RTFFLTQGS

SEQ ID NO: 483726 - protein, 9 aa, Influenza virus
RTFQNIDKN

SEQ ID NO: 483727 - protein, 9 aa, Influenza virus
RTFQNIDRN

SEQ ID NO: 483728 - protein, 9 aa, Influenza virus
RTFQNVSPL

SEQ ID NO: 483729 - protein, 9 aa, Influenza virus
RTFSFQLIL

SEQ ID NO: 483730 - protein, 9 aa, Influenza virus
RTFSFQLIN

SEQ ID NO: 483731 - protein, 9 aa, Influenza virus
RTFSPRSRS

SEQ ID NO: 483732 - protein, 9 aa, Influenza virus
RTGMDPRMC

SEQ ID NO: 483733 - protein, 9 aa, Influenza virus
RTGTFEFTS

SEQ ID NO: 483734 - protein, 9 aa, Influenza virus
RTHESECVC

SEQ ID NO: 483735 - protein, 9 aa, Influenza virus
RTHIHIFSF

SEQ ID NO: 483736 - protein, 9 aa, Influenza virus
RTHQYSEKG

SEQ ID NO: 483737 - protein, 9 aa, Influenza virus
RTHQYSERG

SEQ ID NO: 483738 - protein, 9 aa, Influenza virus
RTINTASRS

SEQ ID NO: 483739 - protein, 9 aa, Influenza virus
RTIQNEDIP

SEQ ID NO: 483740 - protein, 9 aa, Influenza virus
RTISIASRS

SEQ ID NO: 483741 - protein, 9 aa, Influenza virus
RTISKDLRS

SEQ ID NO: 483742 - protein, 9 aa, Influenza virus
RTISKDSRS

SEQ ID NO: 483743 - protein, 9 aa, Influenza virus
RTISKDTRS

SEQ ID NO: 483744 - protein, 9 aa, Influenza virus
RTISMDSRS

SEQ ID NO: 483745 - protein, 9 aa, Influenza virus
RTISPKLRS

SEQ ID NO: 483746 - protein, 9 aa, Influenza virus
RTISPRLRS

SEQ ID NO: 483747 - protein, 9 aa, Influenza virus
RTISPRSRN

SEQ ID NO: 483748 - protein, 9 aa, Influenza virus
RTISPRSRS

SEQ ID NO: 483749 - protein, 9 aa, Influenza virus
RTISRDSRS

SEQ ID NO: 483750 - protein, 9 aa, Influenza virus
RTISTASRS

SEQ ID NO: 483751 - protein, 9 aa, Influenza virus
RTISYSSRS

SEQ ID NO: 483752 - protein, 9 aa, Influenza virus
RTIWTSGSS

SEQ ID NO: 483753 - protein, 9 aa, Influenza virus
RTKEGRRKT

SEQ ID NO: 483754 - protein, 9 aa, Influenza virus
RTKEGRRRT

SEQ ID NO: 483755 - protein, 9 aa, Influenza virus
RTKEMEGIC

SEQ ID NO: 483756 - protein, 9 aa, Influenza virus
RTKNLESRS

SEQ ID NO: 483757 - protein, 9 aa, Influenza virus
RTKSGGNTN

SEQ ID NO: 483758 - protein, 9 aa, Influenza virus
RTKSLESRS

SEQ ID NO: 483759 - protein, 9 aa, Influenza virus
RTLDFHDFN

SEQ ID NO: 483760 - protein, 9 aa, Influenza virus
RTLDFHDSN

SEQ ID NO: 483761 - protein, 9 aa, Influenza virus
RTLDFHDSS

SEQ ID NO: 483762 - protein, 9 aa, Influenza virus
RTLDLHDAN

SEQ ID NO: 483763 - protein, 9 aa, Influenza virus
RTLDLHDSN

SEQ ID NO: 483764 - protein, 9 aa, Influenza virus
RTLDMHDAN

SEQ ID NO: 483765 - protein, 9 aa, Influenza virus
RTLDQHDAN

SEQ ID NO: 483766 - protein, 9 aa, Influenza virus
RTLDYHDSH

SEQ ID NO: 483767 - protein, 9 aa, Influenza virus
RTLDYHDSN

SEQ ID NO: 483768 - protein, 9 aa, Influenza virus
RTLFQQMRD

SEQ ID NO: 483769 - protein, 9 aa, Influenza virus
RTLGFHDSN

SEQ ID NO: 483770 - protein, 9 aa, Influenza virus
RTLGLHDAN

SEQ ID NO: 483771 - protein, 9 aa, Influenza virus
RTLLAKSVF

SEQ ID NO: 483772 - protein, 9 aa, Influenza virus
RTLLMNELG

SEQ ID NO: 483773 - protein, 9 aa, Influenza virus
RTLLMSELG

SEQ ID NO: 483774 - protein, 9 aa, Influenza virus
RTLMSCPIG

SEQ ID NO: 483775 - protein, 9 aa, Influenza virus
RTLMSCPMG

SEQ ID NO: 483776 - protein, 9 aa, Influenza virus
RTLMSCPVG

SEQ ID NO: 483777 - protein, 9 aa, Influenza virus
RTLMSVEIG

SEQ ID NO: 483778 - protein, 9 aa, Influenza virus
RTLMSVEVG

SEQ ID NO: 483779 - protein, 9 aa, Influenza virus
RTLMSVKIG

SEQ ID NO: 483780 - protein, 9 aa, Influenza virus
RTLMSVKVG

SEQ ID NO: 483781 - protein, 9 aa, Influenza virus
RTLNTASRS

SEQ ID NO: 483782 - protein, 9 aa, Influenza virus
RTLTLNTMT

SEQ ID NO: 483783 - protein, 9 aa, Influenza virus
RTLYFHDSN

SEQ ID NO: 483784 - protein, 9 aa, Influenza virus
RTNEKFHQI

SEQ ID NO: 483785 - protein, 9 aa, Influenza virus
RTNEKYHQI

SEQ ID NO: 483786 - protein, 9 aa, Influenza virus
RTNGNLIAP

SEQ ID NO: 483787 - protein, 9 aa, Influenza virus
RTNGTSKIK

SEQ ID NO: 483788 - protein, 9 aa, Influenza virus
RTNGTSKVK

SEQ ID NO: 483789 - protein, 9 aa, Influenza virus
RTNLYGFII

SEQ ID NO: 483790 - protein, 9 aa, Influenza virus
RTNMINDKI

SEQ ID NO: 483791 - protein, 9 aa, Influenza virus
RTNQQFELI

SEQ ID NO: 483792 - protein, 9 aa, Influenza virus
RTPHRTLLM

SEQ ID NO: 483793 - protein, 9 aa, Influenza virus
RTPIAFLTS

SEQ ID NO: 483794 - protein, 9 aa, Influenza virus
RTPYRSLIK

SEQ ID NO: 483795 - protein, 9 aa, Influenza virus
RTPYRSLIQ

SEQ ID NO: 483796 - protein, 9 aa, Influenza virus
RTPYRSLIR

SEQ ID NO: 483797 - protein, 9 aa, Influenza virus
RTPYRTLLM

SEQ ID NO: 483798 - protein, 9 aa, Influenza virus
RTQDSECVS

SEQ ID NO: 483799 - protein, 9 aa, Influenza virus
RTQESECAC

SEQ ID NO: 483800 - protein, 9 aa, Influenza virus
RTQESECIC

SEQ ID NO: 483801 - protein, 9 aa, Influenza virus
RTQESECQC

SEQ ID NO: 483802 - protein, 9 aa, Influenza virus
RTQESECQR

SEQ ID NO: 483803 - protein, 9 aa, Influenza virus
RTQESECVC

SEQ ID NO: 483804 - protein, 9 aa, Influenza virus
RTQESECVR

SEQ ID NO: 483805 - protein, 9 aa, Influenza virus
RTQESGCVC

SEQ ID NO: 483806 - protein, 9 aa, Influenza virus
RTQESSCTC

SEQ ID NO: 483807 - protein, 9 aa, Influenza virus
RTQESSCVC

SEQ ID NO: 483808 - protein, 9 aa, Influenza virus
RTRALVRSG

SEQ ID NO: 483809 - protein, 9 aa, Influenza virus
RTRALVRTG

SEQ ID NO: 483810 - protein, 9 aa, Influenza virus
RTREGRRKT

SEQ ID NO: 483811 - protein, 9 aa, Influenza virus
RTREILTKI

SEQ ID NO: 483812 - protein, 9 aa, Influenza virus
RTREILTKT

SEQ ID NO: 483813 - protein, 9 aa, Influenza virus
RTREILTRT

SEQ ID NO: 483814 - protein, 9 aa, Influenza virus
RTRGILTKT

SEQ ID NO: 483815 - protein, 9 aa, Influenza virus
RTRGLFGAI

SEQ ID NO: 483816 - protein, 9 aa, Influenza virus
RTRSGGNNN

SEQ ID NO: 483817 - protein, 9 aa, Influenza virus
RTRSGGNTN

SEQ ID NO: 483818 - protein, 9 aa, Influenza virus
RTRSGGNTS

SEQ ID NO: 483819 - protein, 9 aa, Influenza virus
RTSDMRAEI

SEQ ID NO: 483820 - protein, 9 aa, Influenza virus
RTSDMRTEI

SEQ ID NO: 483821 - protein, 9 aa, Influenza virus
RTSDMRTEV

SEQ ID NO: 483822 - protein, 9 aa, Influenza virus
RTSHRTLLM

SEQ ID NO: 483823 - protein, 9 aa, Influenza virus
RTSISCLYK

SEQ ID NO: 483824 - protein, 9 aa, Influenza virus
RTSIWTSSS

SEQ ID NO: 483825 - protein, 9 aa, Influenza virus
RTSYRSLIR

SEQ ID NO: 483826 - protein, 9 aa, Influenza virus
RTSYRTLLM

SEQ ID NO: 483827 - protein, 9 aa, Influenza virus
RTTFESNGG

SEQ ID NO: 483828 - protein, 9 aa, Influenza virus
RTTFRGLIS

SEQ ID NO: 483829 - protein, 9 aa, Influenza virus
RTTFRGLLS

SEQ ID NO: 483830 - protein, 9 aa, Influenza virus
RTTNTYRNT

SEQ ID NO: 483831 - protein, 9 aa, Influenza virus
RTTSKDSRS

SEQ ID NO: 483832 - protein, 9 aa, Influenza virus
RTTSTASRS

SEQ ID NO: 483833 - protein, 9 aa, Influenza virus
RTTVDHMAI

SEQ ID NO: 483834 - protein, 9 aa, Influenza virus
RTVGQCPKY

SEQ ID NO: 483835 - protein, 9 aa, Influenza virus
RTVSINGRS

SEQ ID NO: 483836 - protein, 9 aa, Influenza virus
RTVSISGRS

SEQ ID NO: 483837 - protein, 9 aa, Influenza virus
RTVSNSGRS

SEQ ID NO: 483838 - protein, 9 aa, Influenza virus
RTVSSFYSE

SEQ ID NO: 483839 - protein, 9 aa, Influenza virus
RTVSTSGRS

SEQ ID NO: 483840 - protein, 9 aa, Influenza virus
RTWAKNILR

SEQ ID NO: 483841 - protein, 9 aa, Influenza virus
RTYNNTTGR

SEQ ID NO: 483842 - protein, 9 aa, Influenza virus
RTYVDGFEP

SEQ ID NO: 483843 - protein, 9 aa, Influenza virus
RTYVDGFKP

SEQ ID NO: 483844 - protein, 9 aa, Influenza virus
RVARCNTKC

SEQ ID NO: 483845 - protein, 9 aa, Influenza virus
RVAYERMCN

SEQ ID NO: 483846 - protein, 9 aa, Influenza virus
RVDDAVTDI

SEQ ID NO: 483847 - protein, 9 aa, Influenza virus
RVDDAVTDV

SEQ ID NO: 483848 - protein, 9 aa, Influenza virus
RVDFESGRI

SEQ ID NO: 483849 - protein, 9 aa, Influenza virus
RVDINPGHA

SEQ ID NO: 483850 - protein, 9 aa, Influenza virus
RVDINPGHS

SEQ ID NO: 483851 - protein, 9 aa, Influenza virus
RVDKLTQGR

SEQ ID NO: 483852 - protein, 9 aa, Influenza virus
RVDMNPGHA

SEQ ID NO: 483853 - protein, 9 aa, Influenza virus
RVDNHSMSD

SEQ ID NO: 483854 - protein, 9 aa, Influenza virus
RVDRLTQGR

SEQ ID NO: 483855 - protein, 9 aa, Influenza virus
RVDSESGRI

SEQ ID NO: 483856 - protein, 9 aa, Influenza virus
RVDTIIESN

SEQ ID NO: 483857 - protein, 9 aa, Influenza virus
RVDTIMEKN

SEQ ID NO: 483858 - protein, 9 aa, Influenza virus
RVDTNPGHA

SEQ ID NO: 483859 - protein, 9 aa, Influenza virus
RVDVNPGHA

SEQ ID NO: 483860 - protein, 9 aa, Influenza virus
RVECIGWSS

SEQ ID NO: 483861 - protein, 9 aa, Influenza virus
RVEEGSIGK

SEQ ID NO: 483862 - protein, 9 aa, Influenza virus
RVFLAMITY

SEQ ID NO: 483863 - protein, 9 aa, Influenza virus
RVFLTMITY

SEQ ID NO: 483864 - protein, 9 aa, Influenza virus
RVGCVILLN

SEQ ID NO: 483865 - protein, 9 aa, Influenza virus
RVGSRGHVF

SEQ ID NO: 483866 - protein, 9 aa, Influenza virus
RVKIDPVKL

SEQ ID NO: 483867 - protein, 9 aa, Influenza virus
RVKKQLREN

SEQ ID NO: 483868 - protein, 9 aa, Influenza virus
RVKMFDFIK

SEQ ID NO: 483869 - protein, 9 aa, Influenza virus
RVKMFDFSK

SEQ ID NO: 483870 - protein, 9 aa, Influenza virus
RVKMFDFTK

SEQ ID NO: 483871 - protein, 9 aa, Influenza virus
RVKRQLREN

SEQ ID NO: 483872 - protein, 9 aa, Influenza virus
RVKRRPVAK

SEQ ID NO: 483873 - protein, 9 aa, Influenza virus
RVLIRGNSP

SEQ ID NO: 483874 - protein, 9 aa, Influenza virus
RVLKENAID

SEQ ID NO: 483875 - protein, 9 aa, Influenza virus
RVLRENAID

SEQ ID NO: 483876 - protein, 9 aa, Influenza virus
RVLRENAVD

SEQ ID NO: 483877 - protein, 9 aa, Influenza virus
RVLTDTSRP

SEQ ID NO: 483878 - protein, 9 aa, Influenza virus
RVNSIIDKM

SEQ ID NO: 483879 - protein, 9 aa, Influenza virus
RVRHQLREN

SEQ ID NO: 483880 - protein, 9 aa, Influenza virus
RVRKQLREN

SEQ ID NO: 483881 - protein, 9 aa, Influenza virus
RVRKQLRQN

SEQ ID NO: 483882 - protein, 9 aa, Influenza virus
RVRLFDYSR

SEQ ID NO: 483883 - protein, 9 aa, Influenza virus
RVRLQLRDN

SEQ ID NO: 483884 - protein, 9 aa, Influenza virus
RVRMQLRDN

SEQ ID NO: 483885 - protein, 9 aa, Influenza virus
RVRNGTYDH

SEQ ID NO: 483886 - protein, 9 aa, Influenza virus
RVRNQSGRI

SEQ ID NO: 483887 - protein, 9 aa, Influenza virus
RVRRQLREN

SEQ ID NO: 483888 - protein, 9 aa, Influenza virus
RVSAGGDIW

SEQ ID NO: 483889 - protein, 9 aa, Influenza virus
RVSFYWTIV

SEQ ID NO: 483890 - protein, 9 aa, Influenza virus
RVSKMGVDE

SEQ ID NO: 483891 - protein, 9 aa, Influenza virus
RVSKTGVDE

SEQ ID NO: 483892 - protein, 9 aa, Influenza virus
RVSKVGVDE

SEQ ID NO: 483893 - protein, 9 aa, Influenza virus
RVSRMGVDE

SEQ ID NO: 483894 - protein, 9 aa, Influenza virus
RVTCVCRDN

SEQ ID NO: 483895 - protein, 9 aa, Influenza virus
RVTVSTRSD

SEQ ID NO: 483896 - protein, 9 aa, Influenza virus
RVWRQANNG

SEQ ID NO: 483897 - protein, 9 aa, Influenza virus
RVWWTSNSI

SEQ ID NO: 483898 - protein, 9 aa, Influenza virus
RVWWTTNSI

SEQ ID NO: 483899 - protein, 9 aa, Influenza virus
RVYVDGFEP

SEQ ID NO: 483900 - protein, 9 aa, Influenza virus
RVYWIREGK

SEQ ID NO: 483901 - protein, 9 aa, Influenza virus
RVYWIREGR

SEQ ID NO: 483902 - protein, 9 aa, Influenza virus
RWALGENMA

SEQ ID NO: 483903 - protein, 9 aa, Influenza virus
RWETTGRNC

SEQ ID NO: 483904 - protein, 9 aa, Influenza virus
RWKHVTNTI

SEQ ID NO: 483905 - protein, 9 aa, Influenza virus
RWLTLKLGQ

SEQ ID NO: 483906 - protein, 9 aa, Influenza virus
RWLTLKSEQ

SEQ ID NO: 483907 - protein, 9 aa, Influenza virus
RWLTLKSGQ

SEQ ID NO: 483908 - protein, 9 aa, Influenza virus
RWMKIIRVG

SEQ ID NO: 483909 - protein, 9 aa, Influenza virus
RWPGLVAGW

SEQ ID NO: 483910 - protein, 9 aa, Influenza virus
RWSYIVERP

SEQ ID NO: 483911 - protein, 9 aa, Influenza virus
RYELEIGAR

SEQ ID NO: 483912 - protein, 9 aa, Influenza virus
RYELEIGTR

SEQ ID NO: 483913 - protein, 9 aa, Influenza virus
RYERVKMFD

SEQ ID NO: 483914 - protein, 9 aa, Influenza virus
RYGDGVWIG

SEQ ID NO: 483915 - protein, 9 aa, Influenza virus
RYGFVANFS

SEQ ID NO: 483916 - protein, 9 aa, Influenza virus
RYGNGVWIG

SEQ ID NO: 483917 - protein, 9 aa, Influenza virus
RYGPALSIN

SEQ ID NO: 483918 - protein, 9 aa, Influenza virus
RYGPALSIS

SEQ ID NO: 483919 - protein, 9 aa, Influenza virus
RYGVKGFSF

SEQ ID NO: 483920 - protein, 9 aa, Influenza virus
RYGYIIEEY

SEQ ID NO: 483921 - protein, 9 aa, Influenza virus
RYGYIIEKY

SEQ ID NO: 483922 - protein, 9 aa, Influenza virus
RYICSGLVG

SEQ ID NO: 483923 - protein, 9 aa, Influenza virus
RYIPSGSLK

SEQ ID NO: 483924 - protein, 9 aa, Influenza virus
RYLEEHPSA

SEQ ID NO: 483925 - protein, 9 aa, Influenza virus
RYLEENPSA

SEQ ID NO: 483926 - protein, 9 aa, Influenza virus
RYLPDLYDY

SEQ ID NO: 483927 - protein, 9 aa, Influenza virus
RYNGQRSWM

SEQ ID NO: 483928 - protein, 9 aa, Influenza virus
RYPDVRCIC

SEQ ID NO: 483929 - protein, 9 aa, Influenza virus
RYPDVRCTC

SEQ ID NO: 483930 - protein, 9 aa, Influenza virus
RYPDVRCVC

SEQ ID NO: 483931 - protein, 9 aa, Influenza virus
RYPGVRCIC

SEQ ID NO: 483932 - protein, 9 aa, Influenza virus
RYPNVRCVC

SEQ ID NO: 483933 - protein, 9 aa, Influenza virus
RYREEAMQN

SEQ ID NO: 483934 - protein, 9 aa, Influenza virus
RYSGFVRTL

SEQ ID NO: 483935 - protein, 9 aa, Influenza virus
RYSGIKTDG

SEQ ID NO: 483936 - protein, 9 aa, Influenza virus
RYSGIRTDG

SEQ ID NO: 483937 - protein, 9 aa, Influenza virus
RYSIADKIC

SEQ ID NO: 483938 - protein, 9 aa, Influenza virus
RYSKADKIC

SEQ ID NO: 483939 - protein, 9 aa, Influenza virus
RYSRADKIC

SEQ ID NO: 483940 - protein, 9 aa, Influenza virus
RYTYRCHKG

SEQ ID NO: 483941 - protein, 9 aa, Influenza virus
RYTYRCHRG

SEQ ID NO: 483942 - protein, 9 aa, Influenza virus
RYVCSGLVG

SEQ ID NO: 483943 - protein, 9 aa, Influenza virus
RYVCSKFHS

SEQ ID NO: 483944 - protein, 9 aa, Influenza virus
RYVCTGILT

SEQ ID NO: 483945 - protein, 9 aa, Influenza virus
RYVEDTKID

SEQ ID NO: 483946 - protein, 9 aa, Influenza virus
RYVKQGSLK

SEQ ID NO: 483947 - protein, 9 aa, Influenza virus
RYVKQSSLP

SEQ ID NO: 483948 - protein, 9 aa, Influenza virus
RYWAIRTRS

SEQ ID NO: 483949 - protein, 9 aa, Influenza virus
RYYMGECPK

SEQ ID NO: 483950 - protein, 9 aa, Influenza virus
SAAFEDLRI

SEQ ID NO: 483951 - protein, 9 aa, Influenza virus
SAAFEDLRL

SEQ ID NO: 483952 - protein, 9 aa, Influenza virus
SAAFEDLRV

SEQ ID NO: 483953 - protein, 9 aa, Influenza virus
SAASYKRIR

SEQ ID NO: 483954 - protein, 9 aa, Influenza virus
SAASYKRVR

SEQ ID NO: 483955 - protein, 9 aa, Influenza virus
SACHDGASW

SEQ ID NO: 483956 - protein, 9 aa, Influenza virus
SACHDGISW

SEQ ID NO: 483957 - protein, 9 aa, Influenza virus
SACHDGSSW

SEQ ID NO: 483958 - protein, 9 aa, Influenza virus
SACHDGTNW

SEQ ID NO: 483959 - protein, 9 aa, Influenza virus
SACHDGTSW

SEQ ID NO: 483960 - protein, 9 aa, Influenza virus
SACITPNGS

SEQ ID NO: 483961 - protein, 9 aa, Influenza virus
SACKRTVSS

SEQ ID NO: 483962 - protein, 9 aa, Influenza virus
SACLRGGRN

SEQ ID NO: 483963 - protein, 9 aa, Influenza virus
SACYNPCFY

SEQ ID NO: 483964 - protein, 9 aa, Influenza virus
SADGDIWVT

SEQ ID NO: 483965 - protein, 9 aa, Influenza virus
SADHRIYWI

SEQ ID NO: 483966 - protein, 9 aa, Influenza virus
SADHRVYWI

SEQ ID NO: 483967 - protein, 9 aa, Influenza virus
SADMSIGIT

SEQ ID NO: 483968 - protein, 9 aa, Influenza virus
SADMSIGVT

SEQ ID NO: 483969 - protein, 9 aa, Influenza virus
SADPLASLL

SEQ ID NO: 483970 - protein, 9 aa, Influenza virus
SADPLLSLL

SEQ ID NO: 483971 - protein, 9 aa, Influenza virus
SAEHIEECS

SEQ ID NO: 483972 - protein, 9 aa, Influenza virus
SAESRKLLL

SEQ ID NO: 483973 - protein, 9 aa, Influenza virus
SAESRKMLL

SEQ ID NO: 483974 - protein, 9 aa, Influenza virus
SAFDERRNK

SEQ ID NO: 483975 - protein, 9 aa, Influenza virus
SAFDERRNR

SEQ ID NO: 483976 - protein, 9 aa, Influenza virus
SAGALASCM

SEQ ID NO: 483977 - protein, 9 aa, Influenza virus
SAGGAIWVT

SEQ ID NO: 483978 - protein, 9 aa, Influenza virus
SAGGDIWIT

SEQ ID NO: 483979 - protein, 9 aa, Influenza virus
SAGGDIWVT

SEQ ID NO: 483980 - protein, 9 aa, Influenza virus
SAGGHIWVT

SEQ ID NO: 483981 - protein, 9 aa, Influenza virus
SAGGNIWIT

SEQ ID NO: 483982 - protein, 9 aa, Influenza virus
SAGKDPKKT

SEQ ID NO: 483983 - protein, 9 aa, Influenza virus
SAGQISIQP

SEQ ID NO: 483984 - protein, 9 aa, Influenza virus
SAGQISTQP

SEQ ID NO: 483985 - protein, 9 aa, Influenza virus
SAGQISVQP

SEQ ID NO: 483986 - protein, 9 aa, Influenza virus
SAGQTSVQP

SEQ ID NO: 483987 - protein, 9 aa, Influenza virus
SAGQVSVQP

SEQ ID NO: 483988 - protein, 9 aa, Influenza virus
SAGRDPKKT

SEQ ID NO: 483989 - protein, 9 aa, Influenza virus
SAIDQITGK

SEQ ID NO: 483990 - protein, 9 aa, Influenza virus
SAIDQITGT

SEQ ID NO: 483991 - protein, 9 aa, Influenza virus
SAIDQITRK

SEQ ID NO: 483992 - protein, 9 aa, Influenza virus
SAIDQVTGK

SEQ ID NO: 483993 - protein, 9 aa, Influenza virus
SAINQITGK

SEQ ID NO: 483994 - protein, 9 aa, Influenza virus
SAKELVETN

SEQ ID NO: 483995 - protein, 9 aa, Influenza virus
SAKHIEECS

SEQ ID NO: 483996 - protein, 9 aa, Influenza virus
SAKHVEECS

SEQ ID NO: 483997 - protein, 9 aa, Influenza virus
SALFVYSLR

SEQ ID NO: 483998 - protein, 9 aa, Influenza virus
SALGSPGCD

SEQ ID NO: 483999 - protein, 9 aa, Influenza virus
SALILRGAV

SEQ ID NO: 484000 - protein, 9 aa, Influenza virus
SALILRGSI

SEQ ID NO: 484001 - protein, 9 aa, Influenza virus
SALILRGSV

SEQ ID NO: 484002 - protein, 9 aa, Influenza virus
SAMHIEECS

SEQ ID NO: 484003 - protein, 9 aa, Influenza virus
SAPEGMCYP

SEQ ID NO: 484004 - protein, 9 aa, Influenza virus
SAPGVKGFG

SEQ ID NO: 484005 - protein, 9 aa, Influenza virus
SAPHGLCYP

SEQ ID NO: 484006 - protein, 9 aa, Influenza virus
SAPHRLCYP

SEQ ID NO: 484007 - protein, 9 aa, Influenza virus
SAPPEQSRM

SEQ ID NO: 484008 - protein, 9 aa, Influenza virus
SAQEKNDLY

SEQ ID NO: 484009 - protein, 9 aa, Influenza virus
SAQHIEECS

SEQ ID NO: 484010 - protein, 9 aa, Influenza virus
SAQHVEECS

SEQ ID NO: 484011 - protein, 9 aa, Influenza virus
SARHIEECP

SEQ ID NO: 484012 - protein, 9 aa, Influenza virus
SARHIEECS

SEQ ID NO: 484013 - protein, 9 aa, Influenza virus
SARHIEEWS

SEQ ID NO: 484014 - protein, 9 aa, Influenza virus
SARHVEECS

SEQ ID NO: 484015 - protein, 9 aa, Influenza virus
SARQEKNPA

SEQ ID NO: 484016 - protein, 9 aa, Influenza virus
SARSALILR

SEQ ID NO: 484017 - protein, 9 aa, Influenza virus
SASACHDGI

SEQ ID NO: 484018 - protein, 9 aa, Influenza virus
SASACHDGL

SEQ ID NO: 484019 - protein, 9 aa, Influenza virus
SASACHDGM

SEQ ID NO: 484020 - protein, 9 aa, Influenza virus
SASACHDGS

SEQ ID NO: 484021 - protein, 9 aa, Influenza virus
SASACHDGT

SEQ ID NO: 484022 - protein, 9 aa, Influenza virus
SASACHDGV

SEQ ID NO: 484023 - protein, 9 aa, Influenza virus
SASALILRG

SEQ ID NO: 484024 - protein, 9 aa, Influenza virus
SASCHDGRA

SEQ ID NO: 484025 - protein, 9 aa, Influenza virus
SASGDIWIT

SEQ ID NO: 484026 - protein, 9 aa, Influenza virus
SASGDIWVT

SEQ ID NO: 484027 - protein, 9 aa, Influenza virus
SASGKADTR

SEQ ID NO: 484028 - protein, 9 aa, Influenza virus
SASGQAYTK

SEQ ID NO: 484029 - protein, 9 aa, Influenza virus
SASGRADTK

SEQ ID NO: 484030 - protein, 9 aa, Influenza virus
SASGRADTR

SEQ ID NO: 484031 - protein, 9 aa, Influenza virus
SASSISFCG

SEQ ID NO: 484032 - protein, 9 aa, Influenza virus
SASSQAHTK

SEQ ID NO: 484033 - protein, 9 aa, Influenza virus
SASSQAYTK

SEQ ID NO: 484034 - protein, 9 aa, Influenza virus
SASTGGQSF

SEQ ID NO: 484035 - protein, 9 aa, Influenza virus
SATACHDGK

SEQ ID NO: 484036 - protein, 9 aa, Influenza virus
SATACHDGR

SEQ ID NO: 484037 - protein, 9 aa, Influenza virus
SATACSDGP

SEQ ID NO: 484038 - protein, 9 aa, Influenza virus
SATACSDGS

SEQ ID NO: 484039 - protein, 9 aa, Influenza virus
SATGMALSV

SEQ ID NO: 484040 - protein, 9 aa, Influenza virus
SATGMILSV

SEQ ID NO: 484041 - protein, 9 aa, Influenza virus
SATGMTLSV

SEQ ID NO: 484042 - protein, 9 aa, Influenza virus
SATGPADTR

SEQ ID NO: 484043 - protein, 9 aa, Influenza virus
SATGPAETR

SEQ ID NO: 484044 - protein, 9 aa, Influenza virus
SATGVTLSV

SEQ ID NO: 484045 - protein, 9 aa, Influenza virus
SAVDQITGK

SEQ ID NO: 484046 - protein, 9 aa, Influenza virus
SAVLRGFLI

SEQ ID NO: 484047 - protein, 9 aa, Influenza virus
SAVNQITGK

SEQ ID NO: 484048 - protein, 9 aa, Influenza virus
SAYCNTDLG

SEQ ID NO: 484049 - protein, 9 aa, Influenza virus
SAYERMCNI

SEQ ID NO: 484050 - protein, 9 aa, Influenza virus
SCAAMDDFQ

SEQ ID NO: 484051 - protein, 9 aa, Influenza virus
SCAAMDEFQ

SEQ ID NO: 484052 - protein, 9 aa, Influenza virus
SCAAMEDFQ

SEQ ID NO: 484053 - protein, 9 aa, Influenza virus
SCASNINIR

SEQ ID NO: 484054 - protein, 9 aa, Influenza virus
SCATNINIR

SEQ ID NO: 484055 - protein, 9 aa, Influenza virus
SCAVVMTDG

SEQ ID NO: 484056 - protein, 9 aa, Influenza virus
SCDPDECRF

SEQ ID NO: 484057 - protein, 9 aa, Influenza virus
SCDPDGCRF

SEQ ID NO: 484058 - protein, 9 aa, Influenza virus
SCDPIGCKM

SEQ ID NO: 484059 - protein, 9 aa, Influenza virus
SCDPLGCKM

SEQ ID NO: 484060 - protein, 9 aa, Influenza virus
SCDPLGCRM

SEQ ID NO: 484061 - protein, 9 aa, Influenza virus
SCDPNECRF

SEQ ID NO: 484062 - protein, 9 aa, Influenza virus
SCDPSGCKM

SEQ ID NO: 484063 - protein, 9 aa, Influenza virus
SCDPTGCKM

SEQ ID NO: 484064 - protein, 9 aa, Influenza virus
SCDSPSNIN

SEQ ID NO: 484065 - protein, 9 aa, Influenza virus
SCDSPSNVK

SEQ ID NO: 484066 - protein, 9 aa, Influenza virus
SCDSPSNVN

SEQ ID NO: 484067 - protein, 9 aa, Influenza virus
SCEGECFYS

SEQ ID NO: 484068 - protein, 9 aa, Influenza virus
SCEPDECRF

SEQ ID NO: 484069 - protein, 9 aa, Influenza virus
SCFDGKEWL

SEQ ID NO: 484070 - protein, 9 aa, Influenza virus
SCFDGKEWM

SEQ ID NO: 484071 - protein, 9 aa, Influenza virus
SCFDGREWM

SEQ ID NO: 484072 - protein, 9 aa, Influenza virus
SCFILLAIA

SEQ ID NO: 484073 - protein, 9 aa, Influenza virus
SCFILLAIV

SEQ ID NO: 484074 - protein, 9 aa, Influenza virus
SCFILLAVI

SEQ ID NO: 484075 - protein, 9 aa, Influenza virus
SCFLLAALL

SEQ ID NO: 484076 - protein, 9 aa, Influenza virus
SCFLLIALL

SEQ ID NO: 484077 - protein, 9 aa, Influenza virus
SCFLLLAIA

SEQ ID NO: 484078 - protein, 9 aa, Influenza virus
SCFLLLAIV

SEQ ID NO: 484079 - protein, 9 aa, Influenza virus
SCFLLLAVV

SEQ ID NO: 484080 - protein, 9 aa, Influenza virus
SCFLLVALF

SEQ ID NO: 484081 - protein, 9 aa, Influenza virus
SCFLLVALL

SEQ ID NO: 484082 - protein, 9 aa, Influenza virus
SCFTIMTDG

SEQ ID NO: 484083 - protein, 9 aa, Influenza virus
SCFTLMTDG

SEQ ID NO: 484084 - protein, 9 aa, Influenza virus
SCFTVLTDG

SEQ ID NO: 484085 - protein, 9 aa, Influenza virus
SCFTVMTDG

SEQ ID NO: 484086 - protein, 9 aa, Influenza virus
SCFVFVALI

SEQ ID NO: 484087 - protein, 9 aa, Influenza virus
SCFVLLAAI

SEQ ID NO: 484088 - protein, 9 aa, Influenza virus
SCFVLLAIV

SEQ ID NO: 484089 - protein, 9 aa, Influenza virus
SCFVLLAVI

SEQ ID NO: 484090 - protein, 9 aa, Influenza virus
SCFVLLAVV

SEQ ID NO: 484091 - protein, 9 aa, Influenza virus
SCGILGTII

SEQ ID NO: 484092 - protein, 9 aa, Influenza virus
SCGPSECRT

SEQ ID NO: 484093 - protein, 9 aa, Influenza virus
SCHDGIGRM

SEQ ID NO: 484094 - protein, 9 aa, Influenza virus
SCHDGISRM

SEQ ID NO: 484095 - protein, 9 aa, Influenza virus
SCHDGKARM

SEQ ID NO: 484096 - protein, 9 aa, Influenza virus
SCHDGKAWL

SEQ ID NO: 484097 - protein, 9 aa, Influenza virus
SCHDGKEWL

SEQ ID NO: 484098 - protein, 9 aa, Influenza virus
SCHDGKFRM

SEQ ID NO: 484099 - protein, 9 aa, Influenza virus
SCHDGKSRM

SEQ ID NO: 484100 - protein, 9 aa, Influenza virus
SCHDGKSWL

SEQ ID NO: 484101 - protein, 9 aa, Influenza virus
SCHDGMSRM

SEQ ID NO: 484102 - protein, 9 aa, Influenza virus
SCHDGNAWL

SEQ ID NO: 484103 - protein, 9 aa, Influenza virus
SCHDGRARM

SEQ ID NO: 484104 - protein, 9 aa, Influenza virus
SCHDGRAWL

SEQ ID NO: 484105 - protein, 9 aa, Influenza virus
SCHDGRSRM

SEQ ID NO: 484106 - protein, 9 aa, Influenza virus
SCHDGVGRM

SEQ ID NO: 484107 - protein, 9 aa, Influenza virus
SCHDGVSRM

SEQ ID NO: 484108 - protein, 9 aa, Influenza virus
SCHIGVAPS

SEQ ID NO: 484109 - protein, 9 aa, Influenza virus
SCHTKCQTY

SEQ ID NO: 484110 - protein, 9 aa, Influenza virus
SCIASSIVL

SEQ ID NO: 484111 - protein, 9 aa, Influenza virus
SCIASSIVM

SEQ ID NO: 484112 - protein, 9 aa, Influenza virus
SCIASSLIL

SEQ ID NO: 484113 - protein, 9 aa, Influenza virus
SCIASSLVL

SEQ ID NO: 484114 - protein, 9 aa, Influenza virus
SCIASSTVL

SEQ ID NO: 484115 - protein, 9 aa, Influenza virus
SCIASSTVM

SEQ ID NO: 484116 - protein, 9 aa, Influenza virus
SCIASSVVL

SEQ ID NO: 484117 - protein, 9 aa, Influenza virus
SCIESIRNG

SEQ ID NO: 484118 - protein, 9 aa, Influenza virus
SCINRCFYV

SEQ ID NO: 484119 - protein, 9 aa, Influenza virus
SCKMYALHQ

SEQ ID NO: 484120 - protein, 9 aa, Influenza virus
SCLPACAYG

SEQ ID NO: 484121 - protein, 9 aa, Influenza virus
SCLPACIYG

SEQ ID NO: 484122 - protein, 9 aa, Influenza virus
SCLPACVYG

SEQ ID NO: 484123 - protein, 9 aa, Influenza virus
SCLVPCFWV

SEQ ID NO: 484124 - protein, 9 aa, Influenza virus
SCLYKLSQF

SEQ ID NO: 484125 - protein, 9 aa, Influenza virus
SCMDTIRNG

SEQ ID NO: 484126 - protein, 9 aa, Influenza virus
SCMEAIRNG

SEQ ID NO: 484127 - protein, 9 aa, Influenza virus
SCMERIRNN

SEQ ID NO: 484128 - protein, 9 aa, Influenza virus
SCMESIRNN

SEQ ID NO: 484129 - protein, 9 aa, Influenza virus
SCMETIRNG

SEQ ID NO: 484130 - protein, 9 aa, Influenza virus
SCMGLIYNR

SEQ ID NO: 484131 - protein, 9 aa, Influenza virus
SCPIGEAPS

SEQ ID NO: 484132 - protein, 9 aa, Influenza virus
SCPIGEVPS

SEQ ID NO: 484133 - protein, 9 aa, Influenza virus
SCPIGVAPS

SEQ ID NO: 484134 - protein, 9 aa, Influenza virus
SCPLGEAPS

SEQ ID NO: 484135 - protein, 9 aa, Influenza virus
SCPMGVAPS

SEQ ID NO: 484136 - protein, 9 aa, Influenza virus
SCPVGEAPS

SEQ ID NO: 484137 - protein, 9 aa, Influenza virus
SCPVGVAPS

SEQ ID NO: 484138 - protein, 9 aa, Influenza virus
SCSHLECRT

SEQ ID NO: 484139 - protein, 9 aa, Influenza virus
SCSHMECRT

SEQ ID NO: 484140 - protein, 9 aa, Influenza virus
SCSHSECRT

SEQ ID NO: 484141 - protein, 9 aa, Influenza virus
SCSIDECRT

SEQ ID NO: 484142 - protein, 9 aa, Influenza virus
SCSIHECRT

SEQ ID NO: 484143 - protein, 9 aa, Influenza virus
SCSINECRT

SEQ ID NO: 484144 - protein, 9 aa, Influenza virus
SCSISECRT

SEQ ID NO: 484145 - protein, 9 aa, Influenza virus
SCSQNILRT

SEQ ID NO: 484146 - protein, 9 aa, Influenza virus
SCSSPSGIE

SEQ ID NO: 484147 - protein, 9 aa, Influenza virus
SCSVSECRT

SEQ ID NO: 484148 - protein, 9 aa, Influenza virus
SCSYLECRT

SEQ ID NO: 484149 - protein, 9 aa, Influenza virus
SCTSPCLTD

SEQ ID NO: 484150 - protein, 9 aa, Influenza virus
SCTVVMTDG

SEQ ID NO: 484151 - protein, 9 aa, Influenza virus
SCVCRDNWQ

SEQ ID NO: 484152 - protein, 9 aa, Influenza virus
SCVMLLAIA

SEQ ID NO: 484153 - protein, 9 aa, Influenza virus
SCVNRCFYV

SEQ ID NO: 484154 - protein, 9 aa, Influenza virus
SCYDGKAWL

SEQ ID NO: 484155 - protein, 9 aa, Influenza virus
SCYMDIDVY

SEQ ID NO: 484156 - protein, 9 aa, Influenza virus
SCYPNDGKV

SEQ ID NO: 484157 - protein, 9 aa, Influenza virus
SCYPNEGKV

SEQ ID NO: 484158 - protein, 9 aa, Influenza virus
SCYPNLGIV

SEQ ID NO: 484159 - protein, 9 aa, Influenza virus
SCYPNLGKV

SEQ ID NO: 484160 - protein, 9 aa, Influenza virus
SCYPNLGQV

SEQ ID NO: 484161 - protein, 9 aa, Influenza virus
SCYPNMGKV

SEQ ID NO: 484162 - protein, 9 aa, Influenza virus
SCYPNNGKV

SEQ ID NO: 484163 - protein, 9 aa, Influenza virus
SCYPNSGKV

SEQ ID NO: 484164 - protein, 9 aa, Influenza virus
SCYPQYPDV

SEQ ID NO: 484165 - protein, 9 aa, Influenza virus
SCYPQYPNV

SEQ ID NO: 484166 - protein, 9 aa, Influenza virus
SCYPRYPDV

SEQ ID NO: 484167 - protein, 9 aa, Influenza virus
SCYPRYPGV

SEQ ID NO: 484168 - protein, 9 aa, Influenza virus
SCYPRYPNV

SEQ ID NO: 484169 - protein, 9 aa, Influenza virus
SCYVDIDIY

SEQ ID NO: 484170 - protein, 9 aa, Influenza virus
SCYVDIDVY

SEQ ID NO: 484171 - protein, 9 aa, Influenza virus
SCYVDTDVY

SEQ ID NO: 484172 - protein, 9 aa, Influenza virus
SCYVDVDVY

SEQ ID NO: 484173 - protein, 9 aa, Influenza virus
SDAPFLDRL

SEQ ID NO: 484174 - protein, 9 aa, Influenza virus
SDAQAFYKI

SEQ ID NO: 484175 - protein, 9 aa, Influenza virus
SDAQAFYKL

SEQ ID NO: 484176 - protein, 9 aa, Influenza virus
SDAQIDESC

SEQ ID NO: 484177 - protein, 9 aa, Influenza virus
SDDFALILN

SEQ ID NO: 484178 - protein, 9 aa, Influenza virus
SDDFALIVN

SEQ ID NO: 484179 - protein, 9 aa, Influenza virus
SDDNVYKAL

SEQ ID NO: 484180 - protein, 9 aa, Influenza virus
SDDSVYKAL

SEQ ID NO: 484181 - protein, 9 aa, Influenza virus
SDEALKMTI

SEQ ID NO: 484182 - protein, 9 aa, Influenza virus
SDFHFIDEQ

SEQ ID NO: 484183 - protein, 9 aa, Influenza virus
SDFHFIDER

SEQ ID NO: 484184 - protein, 9 aa, Influenza virus
SDFHFINEL

SEQ ID NO: 484185 - protein, 9 aa, Influenza virus
SDFHFINEQ

SEQ ID NO: 484186 - protein, 9 aa, Influenza virus
SDFHFINER

SEQ ID NO: 484187 - protein, 9 aa, Influenza virus
SDFICVGWS

SEQ ID NO: 484188 - protein, 9 aa, Influenza virus
SDFLCVGWS

SEQ ID NO: 484189 - protein, 9 aa, Influenza virus
SDFMCVGWS

SEQ ID NO: 484190 - protein, 9 aa, Influenza virus
SDGAFLAPR

SEQ ID NO: 484191 - protein, 9 aa, Influenza virus
SDGGPNLYN

SEQ ID NO: 484192 - protein, 9 aa, Influenza virus
SDGNLIAPW

SEQ ID NO: 484193 - protein, 9 aa, Influenza virus
SDGPGWLTI

SEQ ID NO: 484194 - protein, 9 aa, Influenza virus
SDGPGWLTL

SEQ ID NO: 484195 - protein, 9 aa, Influenza virus
SDGSGWLTL

SEQ ID NO: 484196 - protein, 9 aa, Influenza virus
SDHICIGYH

SEQ ID NO: 484197 - protein, 9 aa, Influenza virus
SDICYPGKF

SEQ ID NO: 484198 - protein, 9 aa, Influenza virus
SDICYPGRF

SEQ ID NO: 484199 - protein, 9 aa, Influenza virus
SDIEAMASQ

SEQ ID NO: 484200 - protein, 9 aa, Influenza virus
SDIEAMATQ

SEQ ID NO: 484201 - protein, 9 aa, Influenza virus
SDIGAMASQ

SEQ ID NO: 484202 - protein, 9 aa, Influenza virus
SDILVTREP

SEQ ID NO: 484203 - protein, 9 aa, Influenza virus
SDINIMASQ

SEQ ID NO: 484204 - protein, 9 aa, Influenza virus
SDKICIGYH

SEQ ID NO: 484205 - protein, 9 aa, Influenza virus
SDKICLGHH

SEQ ID NO: 484206 - protein, 9 aa, Influenza virus
SDKIDDQIE

SEQ ID NO: 484207 - protein, 9 aa, Influenza virus
SDKLYIWGV

SEQ ID NO: 484208 - protein, 9 aa, Influenza virus
SDKPFQNVS

SEQ ID NO: 484209 - protein, 9 aa, Influenza virus
SDKRIGSCT

SEQ ID NO: 484210 - protein, 9 aa, Influenza virus
SDKVDTLLE

SEQ ID NO: 484211 - protein, 9 aa, Influenza virus
SDLDYQIGY

SEQ ID NO: 484212 - protein, 9 aa, Influenza virus
SDLEALMEW

SEQ ID NO: 484213 - protein, 9 aa, Influenza virus
SDLIIERKE

SEQ ID NO: 484214 - protein, 9 aa, Influenza virus
SDLIIERRE

SEQ ID NO: 484215 - protein, 9 aa, Influenza virus
SDLNYQIGY

SEQ ID NO: 484216 - protein, 9 aa, Influenza virus
SDMRAEIIK

SEQ ID NO: 484217 - protein, 9 aa, Influenza virus
SDMRAEIIR

SEQ ID NO: 484218 - protein, 9 aa, Influenza virus
SDMRTEIIK

SEQ ID NO: 484219 - protein, 9 aa, Influenza virus
SDMRTEIIR

SEQ ID NO: 484220 - protein, 9 aa, Influenza virus
SDMRTEVIR

SEQ ID NO: 484221 - protein, 9 aa, Influenza virus
SDNADKICL

SEQ ID NO: 484222 - protein, 9 aa, Influenza virus
SDNEQTDLY

SEQ ID NO: 484223 - protein, 9 aa, Influenza virus
SDNGGLIAP

SEQ ID NO: 484224 - protein, 9 aa, Influenza virus
SDNRSGYSG

SEQ ID NO: 484225 - protein, 9 aa, Influenza virus
SDQICIGHH

SEQ ID NO: 484226 - protein, 9 aa, Influenza virus
SDQICIGYH

SEQ ID NO: 484227 - protein, 9 aa, Influenza virus
SDQICVGYH

SEQ ID NO: 484228 - protein, 9 aa, Influenza virus
SDQISIVPN

SEQ ID NO: 484229 - protein, 9 aa, Influenza virus
SDQLKLATG

SEQ ID NO: 484230 - protein, 9 aa, Influenza virus
SDRICIGYH

SEQ ID NO: 484231 - protein, 9 aa, Influenza virus
SDRLVLAIG

SEQ ID NO: 484232 - protein, 9 aa, Influenza virus
SDRLVLATG

SEQ ID NO: 484233 - protein, 9 aa, Influenza virus
SDSIKSWRK

SEQ ID NO: 484234 - protein, 9 aa, Influenza virus
SDTPRGEDA

SEQ ID NO: 484235 - protein, 9 aa, Influenza virus
SDTPRGEDG

SEQ ID NO: 484236 - protein, 9 aa, Influenza virus
SDTPRGEDN

SEQ ID NO: 484237 - protein, 9 aa, Influenza virus
SDTPRGEDS

SEQ ID NO: 484238 - protein, 9 aa, Influenza virus
SDTPRPADP

SEQ ID NO: 484239 - protein, 9 aa, Influenza virus
SDTPRPDDP

SEQ ID NO: 484240 - protein, 9 aa, Influenza virus
SDTPRPSDP

SEQ ID NO: 484241 - protein, 9 aa, Influenza virus
SDTPRPTDP

SEQ ID NO: 484242 - protein, 9 aa, Influenza virus
SDTPRPVDP

SEQ ID NO: 484243 - protein, 9 aa, Influenza virus
SDTTCWSWP

SEQ ID NO: 484244 - protein, 9 aa, Influenza virus
SDTTGWPWP

SEQ ID NO: 484245 - protein, 9 aa, Influenza virus
SDTTGWSWP

SEQ ID NO: 484246 - protein, 9 aa, Influenza virus
SDTTSWSWP

SEQ ID NO: 484247 - protein, 9 aa, Influenza virus
SDTVDTLTE

SEQ ID NO: 484248 - protein, 9 aa, Influenza virus
SDVLVTREP

SEQ ID NO: 484249 - protein, 9 aa, Influenza virus
SDVWLGRTV

SEQ ID NO: 484250 - protein, 9 aa, Influenza virus
SDVWMGRTI

SEQ ID NO: 484251 - protein, 9 aa, Influenza virus
SDWSGYSGS

SEQ ID NO: 484252 - protein, 9 aa, Influenza virus
SDYEELKHL

SEQ ID NO: 484253 - protein, 9 aa, Influenza virus
SEAPGWSWD

SEQ ID NO: 484254 - protein, 9 aa, Influenza virus
SECACINGS

SEQ ID NO: 484255 - protein, 9 aa, Influenza virus
SECACVNGS

SEQ ID NO: 484256 - protein, 9 aa, Influenza virus
SECICINGT

SEQ ID NO: 484257 - protein, 9 aa, Influenza virus
SECITPNGS

SEQ ID NO: 484258 - protein, 9 aa, Influenza virus
SECRTFFLT

SEQ ID NO: 484259 - protein, 9 aa, Influenza virus
SECVCHDGT

SEQ ID NO: 484260 - protein, 9 aa, Influenza virus
SECVCHKGI

SEQ ID NO: 484261 - protein, 9 aa, Influenza virus
SECVCHKGV

SEQ ID NO: 484262 - protein, 9 aa, Influenza virus
SECVCHNGI

SEQ ID NO: 484263 - protein, 9 aa, Influenza virus
SECVCHNGT

SEQ ID NO: 484264 - protein, 9 aa, Influenza virus
SECVCHNGV

SEQ ID NO: 484265 - protein, 9 aa, Influenza virus
SECVCHNST

SEQ ID NO: 484266 - protein, 9 aa, Influenza virus
SECVCHSGI

SEQ ID NO: 484267 - protein, 9 aa, Influenza virus
SECVCINGI

SEQ ID NO: 484268 - protein, 9 aa, Influenza virus
SECVCINGS

SEQ ID NO: 484269 - protein, 9 aa, Influenza virus
SECVCINGT

SEQ ID NO: 484270 - protein, 9 aa, Influenza virus
SECVCISGT

SEQ ID NO: 484271 - protein, 9 aa, Influenza virus
SECVCMNGS

SEQ ID NO: 484272 - protein, 9 aa, Influenza virus
SECVCQDEF

SEQ ID NO: 484273 - protein, 9 aa, Influenza virus
SECVCQNGV

SEQ ID NO: 484274 - protein, 9 aa, Influenza virus
SECVCVNGS

SEQ ID NO: 484275 - protein, 9 aa, Influenza virus
SECVRHNGT

SEQ ID NO: 484276 - protein, 9 aa, Influenza virus
SECVSHNGT

SEQ ID NO: 484277 - protein, 9 aa, Influenza virus
SECYNPCFY

SEQ ID NO: 484278 - protein, 9 aa, Influenza virus
SEDGVYKAL

SEQ ID NO: 484279 - protein, 9 aa, Influenza virus
SEDNVYKAL

SEQ ID NO: 484280 - protein, 9 aa, Influenza virus
SEDNVYKVL

SEQ ID NO: 484281 - protein, 9 aa, Influenza virus
SEDNVYRAL

SEQ ID NO: 484282 - protein, 9 aa, Influenza virus
SEDSRSGYE

SEQ ID NO: 484283 - protein, 9 aa, Influenza virus
SEEALRQKI

SEQ ID NO: 484284 - protein, 9 aa, Influenza virus
SEFICVGWS

SEQ ID NO: 484285 - protein, 9 aa, Influenza virus
SEFLCVGWS

SEQ ID NO: 484286 - protein, 9 aa, Influenza virus
SEFNEIEHQ

SEQ ID NO: 484287 - protein, 9 aa, Influenza virus
SEFNEIEYQ

SEQ ID NO: 484288 - protein, 9 aa, Influenza virus
SEFNKACEL

SEQ ID NO: 484289 - protein, 9 aa, Influenza virus
SEFSEIEHQ

SEQ ID NO: 484290 - protein, 9 aa, Influenza virus
SEFSETEHQ

SEQ ID NO: 484291 - protein, 9 aa, Influenza virus
SEGIGQAAD

SEQ ID NO: 484292 - protein, 9 aa, Influenza virus
SEGMGQAAD

SEQ ID NO: 484293 - protein, 9 aa, Influenza virus
SEGRGQAAD

SEQ ID NO: 484294 - protein, 9 aa, Influenza virus
SEGRTSDMR

SEQ ID NO: 484295 - protein, 9 aa, Influenza virus
SEGTGIAAD

SEQ ID NO: 484296 - protein, 9 aa, Influenza virus
SEGTGIVAD

SEQ ID NO: 484297 - protein, 9 aa, Influenza virus
SEGTGMAAD

SEQ ID NO: 484298 - protein, 9 aa, Influenza virus
SEGTGQAAD

SEQ ID NO: 484299 - protein, 9 aa, Influenza virus
SEGTGTAAD

SEQ ID NO: 484300 - protein, 9 aa, Influenza virus
SEHTAYSQI

SEQ ID NO: 484301 - protein, 9 aa, Influenza virus
SEIEGRIQD

SEQ ID NO: 484302 - protein, 9 aa, Influenza virus
SEIEHQIGN

SEQ ID NO: 484303 - protein, 9 aa, Influenza virus
SEIEHQISN

SEQ ID NO: 484304 - protein, 9 aa, Influenza virus
SEIEQQIGN

SEQ ID NO: 484305 - protein, 9 aa, Influenza virus
SEKLVLATG

SEQ ID NO: 484306 - protein, 9 aa, Influenza virus
SEKVDTLLE

SEQ ID NO: 484307 - protein, 9 aa, Influenza virus
SEKVNTLLE

SEQ ID NO: 484308 - protein, 9 aa, Influenza virus
SELGVPFHL

SEQ ID NO: 484309 - protein, 9 aa, Influenza virus
SEMDKLFER

SEQ ID NO: 484310 - protein, 9 aa, Influenza virus
SEMDKLYER

SEQ ID NO: 484311 - protein, 9 aa, Influenza virus
SEMDKLYTR

SEQ ID NO: 484312 - protein, 9 aa, Influenza virus
SEMKKLYER

SEQ ID NO: 484313 - protein, 9 aa, Influenza virus
SEMKWLLSS

SEQ ID NO: 484314 - protein, 9 aa, Influenza virus
SEMKWLSSS

SEQ ID NO: 484315 - protein, 9 aa, Influenza virus
SEMLNLYDR

SEQ ID NO: 484316 - protein, 9 aa, Influenza virus
SEMLNLYER

SEQ ID NO: 484317 - protein, 9 aa, Influenza virus
SEMNKLFEK

SEQ ID NO: 484318 - protein, 9 aa, Influenza virus
SEMNKLFER

SEQ ID NO: 484319 - protein, 9 aa, Influenza virus
SEMNKLHER

SEQ ID NO: 484320 - protein, 9 aa, Influenza virus
SEMNKLYEK

SEQ ID NO: 484321 - protein, 9 aa, Influenza virus
SEMNKLYER

SEQ ID NO: 484322 - protein, 9 aa, Influenza virus
SEMNRLFER

SEQ ID NO: 484323 - protein, 9 aa, Influenza virus
SEMSKLFEK

SEQ ID NO: 484324 - protein, 9 aa, Influenza virus
SEMSKLFER

SEQ ID NO: 484325 - protein, 9 aa, Influenza virus
SEMSKLYER

SEQ ID NO: 484326 - protein, 9 aa, Influenza virus
SEQAAEAIE

SEQ ID NO: 484327 - protein, 9 aa, Influenza virus
SEQAAEAMD

SEQ ID NO: 484328 - protein, 9 aa, Influenza virus
SEQAAEAME

SEQ ID NO: 484329 - protein, 9 aa, Influenza virus
SEQFPVQTD

SEQ ID NO: 484330 - protein, 9 aa, Influenza virus
SEQIIVTRE

SEQ ID NO: 484331 - protein, 9 aa, Influenza virus
SEQIVVTRE

SEQ ID NO: 484332 - protein, 9 aa, Influenza virus
SEQMETGGE

SEQ ID NO: 484333 - protein, 9 aa, Influenza virus
SEQNVPVTQ

SEQ ID NO: 484334 - protein, 9 aa, Influenza virus
SEQTKLYGN

SEQ ID NO: 484335 - protein, 9 aa, Influenza virus
SEQTKLYGS

SEQ ID NO: 484336 - protein, 9 aa, Influenza virus
SEQVIVTRE

SEQ ID NO: 484337 - protein, 9 aa, Influenza virus
SERGEDTIE

SEQ ID NO: 484338 - protein, 9 aa, Influenza virus
SERGEETIE

SEQ ID NO: 484339 - protein, 9 aa, Influenza virus
SERGEETVE

SEQ ID NO: 484340 - protein, 9 aa, Influenza virus
SERGLFGAI

SEQ ID NO: 484341 - protein, 9 aa, Influenza virus
SERGLQRRR

SEQ ID NO: 484342 - protein, 9 aa, Influenza virus
SERLVLATG

SEQ ID NO: 484343 - protein, 9 aa, Influenza virus
SERVDTLLE

SEQ ID NO: 484344 - protein, 9 aa, Influenza virus
SESGRLIDF

SEQ ID NO: 484345 - protein, 9 aa, Influenza virus
SESRSNIFN

SEQ ID NO: 484346 - protein, 9 aa, Influenza virus
SESSFYAEM

SEQ ID NO: 484347 - protein, 9 aa, Influenza virus
SETEHQIGN

SEQ ID NO: 484348 - protein, 9 aa, Influenza virus
SETGAPQLN

SEQ ID NO: 484349 - protein, 9 aa, Influenza virus
SEVEGRIQD

SEQ ID NO: 484350 - protein, 9 aa, Influenza virus
SEVPEWSWD

SEQ ID NO: 484351 - protein, 9 aa, Influenza virus
SEVPGWSWD

SEQ ID NO: 484352 - protein, 9 aa, Influenza virus
SEVPGWSWG

SEQ ID NO: 484353 - protein, 9 aa, Influenza virus
SEWSYIVEK

SEQ ID NO: 484354 - protein, 9 aa, Influenza virus
SFAGWILGN

SEQ ID NO: 484355 - protein, 9 aa, Influenza virus
SFAISCFLI

SEQ ID NO: 484356 - protein, 9 aa, Influenza virus
SFAISCFLL

SEQ ID NO: 484357 - protein, 9 aa, Influenza virus
SFAISCLLL

SEQ ID NO: 484358 - protein, 9 aa, Influenza virus
SFALAQGAL

SEQ ID NO: 484359 - protein, 9 aa, Influenza virus
SFALAQGTL

SEQ ID NO: 484360 - protein, 9 aa, Influenza virus
SFALAQGVL

SEQ ID NO: 484361 - protein, 9 aa, Influenza virus
SFAMSCFLL

SEQ ID NO: 484362 - protein, 9 aa, Influenza virus
SFATSCFLL

SEQ ID NO: 484363 - protein, 9 aa, Influenza virus
SFCLKNGNM

SEQ ID NO: 484364 - protein, 9 aa, Influenza virus
SFEGWIGGN

SEQ ID NO: 484365 - protein, 9 aa, Influenza virus
SFEGWIVGN

SEQ ID NO: 484366 - protein, 9 aa, Influenza virus
SFEKFEIFP

SEQ ID NO: 484367 - protein, 9 aa, Influenza virus
SFEQITFIQ

SEQ ID NO: 484368 - protein, 9 aa, Influenza virus
SFEQITFLQ

SEQ ID NO: 484369 - protein, 9 aa, Influenza virus
SFEQITFMQ

SEQ ID NO: 484370 - protein, 9 aa, Influenza virus
SFERFEIFP

SEQ ID NO: 484371 - protein, 9 aa, Influenza virus
SFERFEMFP

SEQ ID NO: 484372 - protein, 9 aa, Influenza virus
SFESNGGLL

SEQ ID NO: 484373 - protein, 9 aa, Influenza virus
SFESNGNFI

SEQ ID NO: 484374 - protein, 9 aa, Influenza virus
SFESTGNLI

SEQ ID NO: 484375 - protein, 9 aa, Influenza virus
SFESTGNLV

SEQ ID NO: 484376 - protein, 9 aa, Influenza virus
SFFRHMVWL

SEQ ID NO: 484377 - protein, 9 aa, Influenza virus
SFFRNIVWL

SEQ ID NO: 484378 - protein, 9 aa, Influenza virus
SFFRNMIWL

SEQ ID NO: 484379 - protein, 9 aa, Influenza virus
SFFRNMVWL

SEQ ID NO: 484380 - protein, 9 aa, Influenza virus
SFFRNVIWL

SEQ ID NO: 484381 - protein, 9 aa, Influenza virus
SFFRNVVWI

SEQ ID NO: 484382 - protein, 9 aa, Influenza virus
SFFRNVVWL

SEQ ID NO: 484383 - protein, 9 aa, Influenza virus
SFFSKLNWL

SEQ ID NO: 484384 - protein, 9 aa, Influenza virus
SFFSRLNWL

SEQ ID NO: 484385 - protein, 9 aa, Influenza virus
SFFYRYGFV

SEQ ID NO: 484386 - protein, 9 aa, Influenza virus
SFGASCFIL

SEQ ID NO: 484387 - protein, 9 aa, Influenza virus
SFGASCFLF

SEQ ID NO: 484388 - protein, 9 aa, Influenza virus
SFGASCFLL

SEQ ID NO: 484389 - protein, 9 aa, Influenza virus
SFGASCFTL

SEQ ID NO: 484390 - protein, 9 aa, Influenza virus
SFGASCFVL

SEQ ID NO: 484391 - protein, 9 aa, Influenza virus
SFGASCLIL

SEQ ID NO: 484392 - protein, 9 aa, Influenza virus
SFGASCVML

SEQ ID NO: 484393 - protein, 9 aa, Influenza virus
SFGASSFVL

SEQ ID NO: 484394 - protein, 9 aa, Influenza virus
SFGGFTFKR

SEQ ID NO: 484395 - protein, 9 aa, Influenza virus
SFGVSGINE

SEQ ID NO: 484396 - protein, 9 aa, Influenza virus
SFGVSGVNE

SEQ ID NO: 484397 - protein, 9 aa, Influenza virus
SFHLGTKQV

SEQ ID NO: 484398 - protein, 9 aa, Influenza virus
SFIDYWAEG

SEQ ID NO: 484399 - protein, 9 aa, Influenza virus
SFIDYWAKE

SEQ ID NO: 484400 - protein, 9 aa, Influenza virus
SFIDYWAKG

SEQ ID NO: 484401 - protein, 9 aa, Influenza virus
SFIGEEMAT

SEQ ID NO: 484402 - protein, 9 aa, Influenza virus
SFIQHPELT

SEQ ID NO: 484403 - protein, 9 aa, Influenza virus
SFKPNIGPR

SEQ ID NO: 484404 - protein, 9 aa, Influenza virus
SFKYGNGVW

SEQ ID NO: 484405 - protein, 9 aa, Influenza virus
SFLAHALKL

SEQ ID NO: 484406 - protein, 9 aa, Influenza virus
SFLTHALRF

SEQ ID NO: 484407 - protein, 9 aa, Influenza virus
SFLVHALKS

SEQ ID NO: 484408 - protein, 9 aa, Influenza virus
SFMDYWAEG

SEQ ID NO: 484409 - protein, 9 aa, Influenza virus
SFNDYEELK

SEQ ID NO: 484410 - protein, 9 aa, Influenza virus
SFNGAFIAP

SEQ ID NO: 484411 - protein, 9 aa, Influenza virus
SFNGAFVAP

SEQ ID NO: 484412 - protein, 9 aa, Influenza virus
SFNGEEMAT

SEQ ID NO: 484413 - protein, 9 aa, Influenza virus
SFNNYEELK

SEQ ID NO: 484414 - protein, 9 aa, Influenza virus
SFPDGAKIQ

SEQ ID NO: 484415 - protein, 9 aa, Influenza virus
SFPDGAQIK

SEQ ID NO: 484416 - protein, 9 aa, Influenza virus
SFPDGAQIQ

SEQ ID NO: 484417 - protein, 9 aa, Influenza virus
SFPDGARIQ

SEQ ID NO: 484418 - protein, 9 aa, Influenza virus
SFPQTTNTY

SEQ ID NO: 484419 - protein, 9 aa, Influenza virus
SFQGGHIEE

SEQ ID NO: 484420 - protein, 9 aa, Influenza virus
SFQGRGVFE

SEQ ID NO: 484421 - protein, 9 aa, Influenza virus
SFQLINNKK

SEQ ID NO: 484422 - protein, 9 aa, Influenza virus
SFQPNIGPR

SEQ ID NO: 484423 - protein, 9 aa, Influenza virus
SFQSGHIEE

SEQ ID NO: 484424 - protein, 9 aa, Influenza virus
SFQVDCFLW

SEQ ID NO: 484425 - protein, 9 aa, Influenza virus
SFQVDCYLW

SEQ ID NO: 484426 - protein, 9 aa, Influenza virus
SFRAYVDGF

SEQ ID NO: 484427 - protein, 9 aa, Influenza virus
SFRGRGVFE

SEQ ID NO: 484428 - protein, 9 aa, Influenza virus
SFRPNIGPR

SEQ ID NO: 484429 - protein, 9 aa, Influenza virus
SFRQSERGE

SEQ ID NO: 484430 - protein, 9 aa, Influenza virus
SFRYGDGVW

SEQ ID NO: 484431 - protein, 9 aa, Influenza virus
SFRYGNGVW

SEQ ID NO: 484432 - protein, 9 aa, Influenza virus
SFSFGGFTF

SEQ ID NO: 484433 - protein, 9 aa, Influenza virus
SFSIRGETT

SEQ ID NO: 484434 - protein, 9 aa, Influenza virus
SFSIRWETT

SEQ ID NO: 484435 - protein, 9 aa, Influenza virus
SFSISCFLL

SEQ ID NO: 484436 - protein, 9 aa, Influenza virus
SFSMSCFVF

SEQ ID NO: 484437 - protein, 9 aa, Influenza virus
SFSPSPGAR

SEQ ID NO: 484438 - protein, 9 aa, Influenza virus
SFSPSPGDR

SEQ ID NO: 484439 - protein, 9 aa, Influenza virus
SFSRTELIA

SEQ ID NO: 484440 - protein, 9 aa, Influenza virus
SFSRTELIN

SEQ ID NO: 484441 - protein, 9 aa, Influenza virus
SFSRTELIP

SEQ ID NO: 484442 - protein, 9 aa, Influenza virus
SFSRTELIS

SEQ ID NO: 484443 - protein, 9 aa, Influenza virus
SFSRTQLIA

SEQ ID NO: 484444 - protein, 9 aa, Influenza virus
SFTGEEMAS

SEQ ID NO: 484445 - protein, 9 aa, Influenza virus
SFTGEEMAT

SEQ ID NO: 484446 - protein, 9 aa, Influenza virus
SFTGWILGN

SEQ ID NO: 484447 - protein, 9 aa, Influenza virus
SFTITGDNT

SEQ ID NO: 484448 - protein, 9 aa, Influenza virus
SFTPSPGAR

SEQ ID NO: 484449 - protein, 9 aa, Influenza virus
SFTPSPGTR

SEQ ID NO: 484450 - protein, 9 aa, Influenza virus
SFVDYWAEG

SEQ ID NO: 484451 - protein, 9 aa, Influenza virus
SFVPSPGAR

SEQ ID NO: 484452 - protein, 9 aa, Influenza virus
SFVPSPGSR

SEQ ID NO: 484453 - protein, 9 aa, Influenza virus
SFVPSPGVR

SEQ ID NO: 484454 - protein, 9 aa, Influenza virus
SFVPVVGAR

SEQ ID NO: 484455 - protein, 9 aa, Influenza virus
SFVQHPELT

SEQ ID NO: 484456 - protein, 9 aa, Influenza virus
SFVQHPEMT

SEQ ID NO: 484457 - protein, 9 aa, Influenza virus
SFWMCPNGS

SEQ ID NO: 484458 - protein, 9 aa, Influenza virus
SFWMCSGHS

SEQ ID NO: 484459 - protein, 9 aa, Influenza virus
SFWMCSNGS

SEQ ID NO: 484460 - protein, 9 aa, Influenza virus
SFYAELKWL

SEQ ID NO: 484461 - protein, 9 aa, Influenza virus
SFYAELRWL

SEQ ID NO: 484462 - protein, 9 aa, Influenza virus
SFYAEMEWL

SEQ ID NO: 484463 - protein, 9 aa, Influenza virus
SFYAEMKWL

SEQ ID NO: 484464 - protein, 9 aa, Influenza virus
SFYAEVKWL

SEQ ID NO: 484465 - protein, 9 aa, Influenza virus
SFYGELKWL

SEQ ID NO: 484466 - protein, 9 aa, Influenza virus
SFYRNLAWF

SEQ ID NO: 484467 - protein, 9 aa, Influenza virus
SFYRNLIWF

SEQ ID NO: 484468 - protein, 9 aa, Influenza virus
SFYRNLIWL

SEQ ID NO: 484469 - protein, 9 aa, Influenza virus
SFYRNLLWI

SEQ ID NO: 484470 - protein, 9 aa, Influenza virus
SFYRNLLWM

SEQ ID NO: 484471 - protein, 9 aa, Influenza virus
SFYRNLVWF

SEQ ID NO: 484472 - protein, 9 aa, Influenza virus
SFYRNLVWI

SEQ ID NO: 484473 - protein, 9 aa, Influenza virus
SFYRNLVWL

SEQ ID NO: 484474 - protein, 9 aa, Influenza virus
SFYRNMRWL

SEQ ID NO: 484475 - protein, 9 aa, Influenza virus
SFYRNVVWL

SEQ ID NO: 484476 - protein, 9 aa, Influenza virus
SFYRSINWL

SEQ ID NO: 484477 - protein, 9 aa, Influenza virus
SFYRSIRWL

SEQ ID NO: 484478 - protein, 9 aa, Influenza virus
SFYRSMKWL

SEQ ID NO: 484479 - protein, 9 aa, Influenza virus
SFYRSMRWL

SEQ ID NO: 484480 - protein, 9 aa, Influenza virus
SFYSEMKWL

SEQ ID NO: 484481 - protein, 9 aa, Influenza virus
SFYTELKWL

SEQ ID NO: 484482 - protein, 9 aa, Influenza virus
SFYWTIVDP

SEQ ID NO: 484483 - protein, 9 aa, Influenza virus
SFYWTIVEP

SEQ ID NO: 484484 - protein, 9 aa, Influenza virus
SGAAGAAIK

SEQ ID NO: 484485 - protein, 9 aa, Influenza virus
SGAAGAAVK

SEQ ID NO: 484486 - protein, 9 aa, Influenza virus
SGADDDAYA

SEQ ID NO: 484487 - protein, 9 aa, Influenza virus
SGADDEAYA

SEQ ID NO: 484488 - protein, 9 aa, Influenza virus
SGADNDAYA

SEQ ID NO: 484489 - protein, 9 aa, Influenza virus
SGAVAVLKY

SEQ ID NO: 484490 - protein, 9 aa, Influenza virus
SGCITPNGS

SEQ ID NO: 484491 - protein, 9 aa, Influenza virus
SGCKMYALH

SEQ ID NO: 484492 - protein, 9 aa, Influenza virus
SGDDVWMGR

SEQ ID NO: 484493 - protein, 9 aa, Influenza virus
SGDIWITRE

SEQ ID NO: 484494 - protein, 9 aa, Influenza virus
SGDIWVTRE

SEQ ID NO: 484495 - protein, 9 aa, Influenza virus
SGDVWVTRE

SEQ ID NO: 484496 - protein, 9 aa, Influenza virus
SGDYARLYI

SEQ ID NO: 484497 - protein, 9 aa, Influenza virus
SGEQMLIIW

SEQ ID NO: 484498 - protein, 9 aa, Influenza virus
SGEQMLVIW

SEQ ID NO: 484499 - protein, 9 aa, Influenza virus
SGEVPGWSW

SEQ ID NO: 484500 - protein, 9 aa, Influenza virus
SGFAIASKD

SEQ ID NO: 484501 - protein, 9 aa, Influenza virus
SGFAIFSKD

SEQ ID NO: 484502 - protein, 9 aa, Influenza virus
SGFAIISKD

SEQ ID NO: 484503 - protein, 9 aa, Influenza virus
SGFAIVSKD

SEQ ID NO: 484504 - protein, 9 aa, Influenza virus
SGFAVVSKD

SEQ ID NO: 484505 - protein, 9 aa, Influenza virus
SGFEIIWDP

SEQ ID NO: 484506 - protein, 9 aa, Influenza virus
SGFEILLIE

SEQ ID NO: 484507 - protein, 9 aa, Influenza virus
SGFEMIWDA

SEQ ID NO: 484508 - protein, 9 aa, Influenza virus
SGFEMIWDP

SEQ ID NO: 484509 - protein, 9 aa, Influenza virus
SGFEMLKIH

SEQ ID NO: 484510 - protein, 9 aa, Influenza virus
SGFEMLKIP

SEQ ID NO: 484511 - protein, 9 aa, Influenza virus
SGFEMLKVP

SEQ ID NO: 484512 - protein, 9 aa, Influenza virus
SGFEMLRIP

SEQ ID NO: 484513 - protein, 9 aa, Influenza virus
SGFEMVWDA

SEQ ID NO: 484514 - protein, 9 aa, Influenza virus
SGFEMVWDP

SEQ ID NO: 484515 - protein, 9 aa, Influenza virus
SGFEVLFIE

SEQ ID NO: 484516 - protein, 9 aa, Influenza virus
SGFEVLKVP

SEQ ID NO: 484517 - protein, 9 aa, Influenza virus
SGFEVLLIE

SEQ ID NO: 484518 - protein, 9 aa, Influenza virus
SGFFGDNPR

SEQ ID NO: 484519 - protein, 9 aa, Influenza virus
SGFFPDGPQ

SEQ ID NO: 484520 - protein, 9 aa, Influenza virus
SGFVRTLFQ

SEQ ID NO: 484521 - protein, 9 aa, Influenza virus
SGGGDIWVT

SEQ ID NO: 484522 - protein, 9 aa, Influenza virus
SGGHIEECS

SEQ ID NO: 484523 - protein, 9 aa, Influenza virus
SGGIDKEPM

SEQ ID NO: 484524 - protein, 9 aa, Influenza virus
SGGIDKESM

SEQ ID NO: 484525 - protein, 9 aa, Influenza virus
SGGIDKIGT

SEQ ID NO: 484526 - protein, 9 aa, Influenza virus
SGGIDKIST

SEQ ID NO: 484527 - protein, 9 aa, Influenza virus
SGGIDKVST

SEQ ID NO: 484528 - protein, 9 aa, Influenza virus
SGGISKIST

SEQ ID NO: 484529 - protein, 9 aa, Influenza virus
SGGISKMST

SEQ ID NO: 484530 - protein, 9 aa, Influenza virus
SGGLLAPRY

SEQ ID NO: 484531 - protein, 9 aa, Influenza virus
SGGTINSPL

SEQ ID NO: 484532 - protein, 9 aa, Influenza virus
SGGYKDIIL

SEQ ID NO: 484533 - protein, 9 aa, Influenza virus
SGGYKDVIL

SEQ ID NO: 484534 - protein, 9 aa, Influenza virus
SGHDFEREG

SEQ ID NO: 484535 - protein, 9 aa, Influenza virus
SGHSCRICI

SEQ ID NO: 484536 - protein, 9 aa, Influenza virus
SGHWPDGSN

SEQ ID NO: 484537 - protein, 9 aa, Influenza virus
SGIAIALGI

SEQ ID NO: 484538 - protein, 9 aa, Influenza virus
SGIAIVLGI

SEQ ID NO: 484539 - protein, 9 aa, Influenza virus
SGICPVVFT

SEQ ID NO: 484540 - protein, 9 aa, Influenza virus
SGIEYNGKS

SEQ ID NO: 484541 - protein, 9 aa, Influenza virus
SGIFGDNPR

SEQ ID NO: 484542 - protein, 9 aa, Influenza virus
SGIFSVEGK

SEQ ID NO: 484543 - protein, 9 aa, Influenza virus
SGIFSVEHK

SEQ ID NO: 484544 - protein, 9 aa, Influenza virus
SGIFSVENK

SEQ ID NO: 484545 - protein, 9 aa, Influenza virus
SGIFSVESK

SEQ ID NO: 484546 - protein, 9 aa, Influenza virus
SGIGRFYIQ

SEQ ID NO: 484547 - protein, 9 aa, Influenza virus
SGIKSFSRT

SEQ ID NO: 484548 - protein, 9 aa, Influenza virus
SGIKTDGAT

SEQ ID NO: 484549 - protein, 9 aa, Influenza virus
SGIMKTEGT

SEQ ID NO: 484550 - protein, 9 aa, Influenza virus
SGIMKTEKT

SEQ ID NO: 484551 - protein, 9 aa, Influenza virus
SGIMKTGGT

SEQ ID NO: 484552 - protein, 9 aa, Influenza virus
SGINESADM

SEQ ID NO: 484553 - protein, 9 aa, Influenza virus
SGIPPLELG

SEQ ID NO: 484554 - protein, 9 aa, Influenza virus
SGIRSFSRT

SEQ ID NO: 484555 - protein, 9 aa, Influenza virus
SGIRTDGAT

SEQ ID NO: 484556 - protein, 9 aa, Influenza virus
SGKADTRIL

SEQ ID NO: 484557 - protein, 9 aa, Influenza virus
SGKQMLIIW

SEQ ID NO: 484558 - protein, 9 aa, Influenza virus
SGKVECVCR

SEQ ID NO: 484559 - protein, 9 aa, Influenza virus
SGLIAGWYG

SEQ ID NO: 484560 - protein, 9 aa, Influenza virus
SGLPVGGNE

SEQ ID NO: 484561 - protein, 9 aa, Influenza virus
SGLRILIRG

SEQ ID NO: 484562 - protein, 9 aa, Influenza virus
SGLRILVRG

SEQ ID NO: 484563 - protein, 9 aa, Influenza virus
SGLRNVPAI

SEQ ID NO: 484564 - protein, 9 aa, Influenza virus
SGLTHIMIW

SEQ ID NO: 484565 - protein, 9 aa, Influenza virus
SGLVAGWYG

SEQ ID NO: 484566 - protein, 9 aa, Influenza virus
SGLVGDTPR

SEQ ID NO: 484567 - protein, 9 aa, Influenza virus
SGMDPRMCS

SEQ ID NO: 484568 - protein, 9 aa, Influenza virus
SGMIDGWYG

SEQ ID NO: 484569 - protein, 9 aa, Influenza virus
SGMRILIRG

SEQ ID NO: 484570 - protein, 9 aa, Influenza virus
SGMRILVRG

SEQ ID NO: 484571 - protein, 9 aa, Influenza virus
SGMSANGDI

SEQ ID NO: 484572 - protein, 9 aa, Influenza virus
SGNAQHVEE

SEQ ID NO: 484573 - protein, 9 aa, Influenza virus
SGNCRFNVC

SEQ ID NO: 484574 - protein, 9 aa, Influenza virus
SGNCRFSVC

SEQ ID NO: 484575 - protein, 9 aa, Influenza virus
SGNGDPNNM

SEQ ID NO: 484576 - protein, 9 aa, Influenza virus
SGNLIAPEY

SEQ ID NO: 484577 - protein, 9 aa, Influenza virus
SGNNQVFPQ

SEQ ID NO: 484578 - protein, 9 aa, Influenza virus
SGNWPDGSD

SEQ ID NO: 484579 - protein, 9 aa, Influenza virus
SGNWPDGSN

SEQ ID NO: 484580 - protein, 9 aa, Influenza virus
SGPDDGAVA

SEQ ID NO: 484581 - protein, 9 aa, Influenza virus
SGPDNEAVA

SEQ ID NO: 484582 - protein, 9 aa, Influenza virus
SGPDNGAVA

SEQ ID NO: 484583 - protein, 9 aa, Influenza virus
SGPDSGAVA

SEQ ID NO: 484584 - protein, 9 aa, Influenza virus
SGPLKAEIA

SEQ ID NO: 484585 - protein, 9 aa, Influenza virus
SGPNDNASA

SEQ ID NO: 484586 - protein, 9 aa, Influenza virus
SGPNNNASA

SEQ ID NO: 484587 - protein, 9 aa, Influenza virus
SGPSFYAEM

SEQ ID NO: 484588 - protein, 9 aa, Influenza virus
SGQFPVQTD

SEQ ID NO: 484589 - protein, 9 aa, Influenza virus
SGQLKLATG

SEQ ID NO: 484590 - protein, 9 aa, Influenza virus
SGQNHGICA

SEQ ID NO: 484591 - protein, 9 aa, Influenza virus
SGRADTKIL

SEQ ID NO: 484592 - protein, 9 aa, Influenza virus
SGRADTRIL

SEQ ID NO: 484593 - protein, 9 aa, Influenza virus
SGREWSYIV

SEQ ID NO: 484594 - protein, 9 aa, Influenza virus
SGRIDFHWA

SEQ ID NO: 484595 - protein, 9 aa, Influenza virus
SGRIDFHWL

SEQ ID NO: 484596 - protein, 9 aa, Influenza virus
SGRIDFHWM

SEQ ID NO: 484597 - protein, 9 aa, Influenza virus
SGRIDFHWT

SEQ ID NO: 484598 - protein, 9 aa, Influenza virus
SGRIDFYWL

SEQ ID NO: 484599 - protein, 9 aa, Influenza virus
SGRIFQSGV

SEQ ID NO: 484600 - protein, 9 aa, Influenza virus
SGRINFHWL

SEQ ID NO: 484601 - protein, 9 aa, Influenza virus
SGRINFHWT

SEQ ID NO: 484602 - protein, 9 aa, Influenza virus
SGRISFYWT

SEQ ID NO: 484603 - protein, 9 aa, Influenza virus
SGRISIYWT

SEQ ID NO: 484604 - protein, 9 aa, Influenza virus
SGRLGFEII

SEQ ID NO: 484605 - protein, 9 aa, Influenza virus
SGRLIDFLK

SEQ ID NO: 484606 - protein, 9 aa, Influenza virus
SGRLMDFLK

SEQ ID NO: 484607 - protein, 9 aa, Influenza virus
SGRQEKNPA

SEQ ID NO: 484608 - protein, 9 aa, Influenza virus
SGRQEKNPS

SEQ ID NO: 484609 - protein, 9 aa, Influenza virus
SGRSGFEII

SEQ ID NO: 484610 - protein, 9 aa, Influenza virus
SGRSGFEVI

SEQ ID NO: 484611 - protein, 9 aa, Influenza virus
SGRSSFEII

SEQ ID NO: 484612 - protein, 9 aa, Influenza virus
SGRSSFFRN

SEQ ID NO: 484613 - protein, 9 aa, Influenza virus
SGRVSFYWT

SEQ ID NO: 484614 - protein, 9 aa, Influenza virus
SGSAQHIEE

SEQ ID NO: 484615 - protein, 9 aa, Influenza virus
SGSAQHVEE

SEQ ID NO: 484616 - protein, 9 aa, Influenza virus
SGSFIDYWA

SEQ ID NO: 484617 - protein, 9 aa, Influenza virus
SGSFIDYWD

SEQ ID NO: 484618 - protein, 9 aa, Influenza virus
SGSFIDYWN

SEQ ID NO: 484619 - protein, 9 aa, Influenza virus
SGSFIQHPE

SEQ ID NO: 484620 - protein, 9 aa, Influenza virus
SGSFMDYWA

SEQ ID NO: 484621 - protein, 9 aa, Influenza virus
SGSFPDGAK

SEQ ID NO: 484622 - protein, 9 aa, Influenza virus
SGSFPDGAQ

SEQ ID NO: 484623 - protein, 9 aa, Influenza virus
SGSFPNGAQ

SEQ ID NO: 484624 - protein, 9 aa, Influenza virus
SGSFSIRGE

SEQ ID NO: 484625 - protein, 9 aa, Influenza virus
SGSFSIRWE

SEQ ID NO: 484626 - protein, 9 aa, Influenza virus
SGSFTLPIE

SEQ ID NO: 484627 - protein, 9 aa, Influenza virus
SGSFTLPVE

SEQ ID NO: 484628 - protein, 9 aa, Influenza virus
SGSFTLPVG

SEQ ID NO: 484629 - protein, 9 aa, Influenza virus
SGSFVDYWA

SEQ ID NO: 484630 - protein, 9 aa, Influenza virus
SGSFVQHPE

SEQ ID NO: 484631 - protein, 9 aa, Influenza virus
SGSIISFCG

SEQ ID NO: 484632 - protein, 9 aa, Influenza virus
SGSLEFIAE

SEQ ID NO: 484633 - protein, 9 aa, Influenza virus
SGSLKLAIG

SEQ ID NO: 484634 - protein, 9 aa, Influenza virus
SGSLPDGAQ

SEQ ID NO: 484635 - protein, 9 aa, Influenza virus
SGSQKQEFK

SEQ ID NO: 484636 - protein, 9 aa, Influenza virus
SGSSFYAEL

SEQ ID NO: 484637 - protein, 9 aa, Influenza virus
SGSSFYAEM

SEQ ID NO: 484638 - protein, 9 aa, Influenza virus
SGSSIAFCG

SEQ ID NO: 484639 - protein, 9 aa, Influenza virus
SGSSISFCG

SEQ ID NO: 484640 - protein, 9 aa, Influenza virus
SGSWPDGAD

SEQ ID NO: 484641 - protein, 9 aa, Influenza virus
SGTCAVVMT

SEQ ID NO: 484642 - protein, 9 aa, Influenza virus
SGTDNYGVK

SEQ ID NO: 484643 - protein, 9 aa, Influenza virus
SGTNNYGVK

SEQ ID NO: 484644 - protein, 9 aa, Influenza virus
SGTSKACNA

SEQ ID NO: 484645 - protein, 9 aa, Influenza virus
SGTSKACSA

SEQ ID NO: 484646 - protein, 9 aa, Influenza virus
SGTYGAGSW

SEQ ID NO: 484647 - protein, 9 aa, Influenza virus
SGTYGSGSW

SEQ ID NO: 484648 - protein, 9 aa, Influenza virus
SGTYGTGSW

SEQ ID NO: 484649 - protein, 9 aa, Influenza virus
SGTYGTGTW

SEQ ID NO: 484650 - protein, 9 aa, Influenza virus
SGVAIALSI

SEQ ID NO: 484651 - protein, 9 aa, Influenza virus
SGVAIALSV

SEQ ID NO: 484652 - protein, 9 aa, Influenza virus
SGVCPVVFT

SEQ ID NO: 484653 - protein, 9 aa, Influenza virus
SGVESAVLR

SEQ ID NO: 484654 - protein, 9 aa, Influenza virus
SGVEYNGKS

SEQ ID NO: 484655 - protein, 9 aa, Influenza virus
SGVFGDNPR

SEQ ID NO: 484656 - protein, 9 aa, Influenza virus
SGVFGDSPR

SEQ ID NO: 484657 - protein, 9 aa, Influenza virus
SGVFGDTPR

SEQ ID NO: 484658 - protein, 9 aa, Influenza virus
SGVFSVEGK

SEQ ID NO: 484659 - protein, 9 aa, Influenza virus
SGVKGWAFD

SEQ ID NO: 484660 - protein, 9 aa, Influenza virus
SGVKLEENS

SEQ ID NO: 484661 - protein, 9 aa, Influenza virus
SGVLGDNPR

SEQ ID NO: 484662 - protein, 9 aa, Influenza virus
SGVMKTEGT

SEQ ID NO: 484663 - protein, 9 aa, Influenza virus
SGVNESADM

SEQ ID NO: 484664 - protein, 9 aa, Influenza virus
SGVNSFSRT

SEQ ID NO: 484665 - protein, 9 aa, Influenza virus
SGWLLGNPM

SEQ ID NO: 484666 - protein, 9 aa, Influenza virus
SGWLTLGIT

SEQ ID NO: 484667 - protein, 9 aa, Influenza virus
SGWTTANSK

SEQ ID NO: 484668 - protein, 9 aa, Influenza virus
SGYAADKAS

SEQ ID NO: 484669 - protein, 9 aa, Influenza virus
SGYAADKES

SEQ ID NO: 484670 - protein, 9 aa, Influenza virus
SGYAADKKS

SEQ ID NO: 484671 - protein, 9 aa, Influenza virus
SGYAADLKS

SEQ ID NO: 484672 - protein, 9 aa, Influenza virus
SGYAADQES

SEQ ID NO: 484673 - protein, 9 aa, Influenza virus
SGYAADQKS

SEQ ID NO: 484674 - protein, 9 aa, Influenza virus
SGYAADRES

SEQ ID NO: 484675 - protein, 9 aa, Influenza virus
SGYAADRKS

SEQ ID NO: 484676 - protein, 9 aa, Influenza virus
SGYAQTDCV

SEQ ID NO: 484677 - protein, 9 aa, Influenza virus
SGYDFEKEG

SEQ ID NO: 484678 - protein, 9 aa, Influenza virus
SGYDFEREG

SEQ ID NO: 484679 - protein, 9 aa, Influenza virus
SGYEILKVP

SEQ ID NO: 484680 - protein, 9 aa, Influenza virus
SGYEMLKVP

SEQ ID NO: 484681 - protein, 9 aa, Influenza virus
SGYETFKVI

SEQ ID NO: 484682 - protein, 9 aa, Influenza virus
SGYETFRII

SEQ ID NO: 484683 - protein, 9 aa, Influenza virus
SGYETFRVI

SEQ ID NO: 484684 - protein, 9 aa, Influenza virus
SGYETFRVL

SEQ ID NO: 484685 - protein, 9 aa, Influenza virus
SGYETFRVT

SEQ ID NO: 484686 - protein, 9 aa, Influenza virus
SGYEVLKVP

SEQ ID NO: 484687 - protein, 9 aa, Influenza virus
SGYEVLRVP

SEQ ID NO: 484688 - protein, 9 aa, Influenza virus
SGYFGVFSV

SEQ ID NO: 484689 - protein, 9 aa, Influenza virus
SGYGEDNES

SEQ ID NO: 484690 - protein, 9 aa, Influenza virus
SGYKDIILW

SEQ ID NO: 484691 - protein, 9 aa, Influenza virus
SGYKDVILW

SEQ ID NO: 484692 - protein, 9 aa, Influenza virus
SGYKEIILW

SEQ ID NO: 484693 - protein, 9 aa, Influenza virus
SGYKEVILW

SEQ ID NO: 484694 - protein, 9 aa, Influenza virus
SGYNFEKEG

SEQ ID NO: 484695 - protein, 9 aa, Influenza virus
SGYSGAFID

SEQ ID NO: 484696 - protein, 9 aa, Influenza virus
SGYSGAFMD

SEQ ID NO: 484697 - protein, 9 aa, Influenza virus
SGYSGAFTI

SEQ ID NO: 484698 - protein, 9 aa, Influenza virus
SGYSGAFTV

SEQ ID NO: 484699 - protein, 9 aa, Influenza virus
SGYSGAFVD

SEQ ID NO: 484700 - protein, 9 aa, Influenza virus
SGYSGIFSI

SEQ ID NO: 484701 - protein, 9 aa, Influenza virus
SGYSGIFSV

SEQ ID NO: 484702 - protein, 9 aa, Influenza virus
SGYSGSFID

SEQ ID NO: 484703 - protein, 9 aa, Influenza virus
SGYSGSFII

SEQ ID NO: 484704 - protein, 9 aa, Influenza virus
SGYSGSFIQ

SEQ ID NO: 484705 - protein, 9 aa, Influenza virus
SGYSGSFIV

SEQ ID NO: 484706 - protein, 9 aa, Influenza virus
SGYSGSFMD

SEQ ID NO: 484707 - protein, 9 aa, Influenza virus
SGYSGSFSI

SEQ ID NO: 484708 - protein, 9 aa, Influenza virus
SGYSGSFSV

SEQ ID NO: 484709 - protein, 9 aa, Influenza virus
SGYSGSFTI

SEQ ID NO: 484710 - protein, 9 aa, Influenza virus
SGYSGSFTL

SEQ ID NO: 484711 - protein, 9 aa, Influenza virus
SGYSGSFVD

SEQ ID NO: 484712 - protein, 9 aa, Influenza virus
SGYSGSFVI

SEQ ID NO: 484713 - protein, 9 aa, Influenza virus
SGYSGSFVM

SEQ ID NO: 484714 - protein, 9 aa, Influenza virus
SGYSGSFVQ

SEQ ID NO: 484715 - protein, 9 aa, Influenza virus
SGYSGVFSV

SEQ ID NO: 484716 - protein, 9 aa, Influenza virus
SGYVCSGLV

SEQ ID NO: 484717 - protein, 9 aa, Influenza virus
SGYWAIRTR

SEQ ID NO: 484718 - protein, 9 aa, Influenza virus
SHCRATEYI

SEQ ID NO: 484719 - protein, 9 aa, Influenza virus
SHCRIIQNE

SEQ ID NO: 484720 - protein, 9 aa, Influenza virus
SHEGEGIPL

SEQ ID NO: 484721 - protein, 9 aa, Influenza virus
SHEQMETGG

SEQ ID NO: 484722 - protein, 9 aa, Influenza virus
SHGKIIQNE

SEQ ID NO: 484723 - protein, 9 aa, Influenza virus
SHGRIIQNE

SEQ ID NO: 484724 - protein, 9 aa, Influenza virus
SHGRILKND

SEQ ID NO: 484725 - protein, 9 aa, Influenza virus
SHGRILKNN

SEQ ID NO: 484726 - protein, 9 aa, Influenza virus
SHGRTIQNE

SEQ ID NO: 484727 - protein, 9 aa, Influenza virus
SHGRVLKNN

SEQ ID NO: 484728 - protein, 9 aa, Influenza virus
SHGSLQCRI

SEQ ID NO: 484729 - protein, 9 aa, Influenza virus
SHGTGTGYT

SEQ ID NO: 484730 - protein, 9 aa, Influenza virus
SHGVKGWAF

SEQ ID NO: 484731 - protein, 9 aa, Influenza virus
SHHRSHRQM

SEQ ID NO: 484732 - protein, 9 aa, Influenza virus
SHISPLSGS

SEQ ID NO: 484733 - protein, 9 aa, Influenza virus
SHKICIGYH

SEQ ID NO: 484734 - protein, 9 aa, Influenza virus
SHLECRTFF

SEQ ID NO: 484735 - protein, 9 aa, Influenza virus
SHLKFKADL

SEQ ID NO: 484736 - protein, 9 aa, Influenza virus
SHLRNDTDV

SEQ ID NO: 484737 - protein, 9 aa, Influenza virus
SHMECRTFF

SEQ ID NO: 484738 - protein, 9 aa, Influenza virus
SHNGGLIAP

SEQ ID NO: 484739 - protein, 9 aa, Influenza virus
SHNGGLVAP

SEQ ID NO: 484740 - protein, 9 aa, Influenza virus
SHNGGRIAP

SEQ ID NO: 484741 - protein, 9 aa, Influenza virus
SHPGIFENS

SEQ ID NO: 484742 - protein, 9 aa, Influenza virus
SHPGIFESS

SEQ ID NO: 484743 - protein, 9 aa, Influenza virus
SHPGIFGNS

SEQ ID NO: 484744 - protein, 9 aa, Influenza virus
SHPGLFENS

SEQ ID NO: 484745 - protein, 9 aa, Influenza virus
SHRTLLMNE

SEQ ID NO: 484746 - protein, 9 aa, Influenza virus
SHSECRTFF

SEQ ID NO: 484747 - protein, 9 aa, Influenza virus
SHTAYSQIT

SEQ ID NO: 484748 - protein, 9 aa, Influenza virus
SHTGTYCSL

SEQ ID NO: 484749 - protein, 9 aa, Influenza virus
SHYEECSCY

SEQ ID NO: 484750 - protein, 9 aa, Influenza virus
SHYNQITQT

SEQ ID NO: 484751 - protein, 9 aa, Influenza virus
SHYNQMKQA

SEQ ID NO: 484752 - protein, 9 aa, Influenza virus
SHYNQMTQA

SEQ ID NO: 484753 - protein, 9 aa, Influenza virus
SHYNQVTQP

SEQ ID NO: 484754 - protein, 9 aa, Influenza virus
SHYNQVTQT

SEQ ID NO: 484755 - protein, 9 aa, Influenza virus
SHYREEALL

SEQ ID NO: 484756 - protein, 9 aa, Influenza virus
SHYVCSGLV

SEQ ID NO: 484757 - protein, 9 aa, Influenza virus
SIAASYKRI

SEQ ID NO: 484758 - protein, 9 aa, Influenza virus
SIADKICIG

SEQ ID NO: 484759 - protein, 9 aa, Influenza virus
SIAFCGVDS

SEQ ID NO: 484760 - protein, 9 aa, Influenza virus
SIAFCGVNS

SEQ ID NO: 484761 - protein, 9 aa, Influenza virus
SIAGWLLGN

SEQ ID NO: 484762 - protein, 9 aa, Influenza virus
SIAHKSCLP

SEQ ID NO: 484763 - protein, 9 aa, Influenza virus
SIAPIMFSN

SEQ ID NO: 484764 - protein, 9 aa, Influenza virus
SIASRSGYE

SEQ ID NO: 484765 - protein, 9 aa, Influenza virus
SIAVFCGTS

SEQ ID NO: 484766 - protein, 9 aa, Influenza virus
SIAWSATAC

SEQ ID NO: 484767 - protein, 9 aa, Influenza virus
SICEKLEQS

SEQ ID NO: 484768 - protein, 9 aa, Influenza virus
SICISGPNN

SEQ ID NO: 484769 - protein, 9 aa, Influenza virus
SICMSGPND

SEQ ID NO: 484770 - protein, 9 aa, Influenza virus
SICMSGPNN

SEQ ID NO: 484771 - protein, 9 aa, Influenza virus
SICTHLEVC

SEQ ID NO: 484772 - protein, 9 aa, Influenza virus
SICVSGPNN

SEQ ID NO: 484773 - protein, 9 aa, Influenza virus
SIDECRTFF

SEQ ID NO: 484774 - protein, 9 aa, Influenza virus
SIDGKAPIS

SEQ ID NO: 484775 - protein, 9 aa, Influenza virus
SIDLVETNH

SEQ ID NO: 484776 - protein, 9 aa, Influenza virus
SIDPKGLFG

SEQ ID NO: 484777 - protein, 9 aa, Influenza virus
SIDRFLRVK

SEQ ID NO: 484778 - protein, 9 aa, Influenza virus
SIDRFLRVR

SEQ ID NO: 484779 - protein, 9 aa, Influenza virus
SIDSGYVCS

SEQ ID NO: 484780 - protein, 9 aa, Influenza virus
SIDSNYVCS

SEQ ID NO: 484781 - protein, 9 aa, Influenza virus
SIDSSYICS

SEQ ID NO: 484782 - protein, 9 aa, Influenza virus
SIDSSYVCS

SEQ ID NO: 484783 - protein, 9 aa, Influenza virus
SIECVCRDN

SEQ ID NO: 484784 - protein, 9 aa, Influenza virus
SIEDPDHEG

SEQ ID NO: 484785 - protein, 9 aa, Influenza virus
SIEDPNHEG

SEQ ID NO: 484786 - protein, 9 aa, Influenza virus
SIEDPSHEG

SEQ ID NO: 484787 - protein, 9 aa, Influenza virus
SIEECLIND

SEQ ID NO: 484788 - protein, 9 aa, Influenza virus
SIEEPSHEG

SEQ ID NO: 484789 - protein, 9 aa, Influenza virus
SIENLEELR

SEQ ID NO: 484790 - protein, 9 aa, Influenza virus
SIENPSHEG

SEQ ID NO: 484791 - protein, 9 aa, Influenza virus
SIENQEELK

SEQ ID NO: 484792 - protein, 9 aa, Influenza virus
SIENQEELR

SEQ ID NO: 484793 - protein, 9 aa, Influenza virus
SIEPKGLFG

SEQ ID NO: 484794 - protein, 9 aa, Influenza virus
SIEPRGLFG

SEQ ID NO: 484795 - protein, 9 aa, Influenza virus
SIESEFNEI

SEQ ID NO: 484796 - protein, 9 aa, Influenza virus
SIESEFSEI

SEQ ID NO: 484797 - protein, 9 aa, Influenza virus
SIESEFSET

SEQ ID NO: 484798 - protein, 9 aa, Influenza virus
SIGITVIKN

SEQ ID NO: 484799 - protein, 9 aa, Influenza virus
SIGKVCRTL

SEQ ID NO: 484800 - protein, 9 aa, Influenza virus
SIGNLIAPR

SEQ ID NO: 484801 - protein, 9 aa, Influenza virus
SIGSSTYQN

SEQ ID NO: 484802 - protein, 9 aa, Influenza virus
SIGSWSHNI

SEQ ID NO: 484803 - protein, 9 aa, Influenza virus
SIGSWSQNI

SEQ ID NO: 484804 - protein, 9 aa, Influenza virus
SIGTSTLNQ

SEQ ID NO: 484805 - protein, 9 aa, Influenza virus
SIGVTVIKN

SEQ ID NO: 484806 - protein, 9 aa, Influenza virus
SIGVTVIRN

SEQ ID NO: 484807 - protein, 9 aa, Influenza virus
SIHECRTFF

SEQ ID NO: 484808 - protein, 9 aa, Influenza virus
SIHSRGLFG

SEQ ID NO: 484809 - protein, 9 aa, Influenza virus
SIHWTIVKP

SEQ ID NO: 484810 - protein, 9 aa, Influenza virus
SIIAFCGTS

SEQ ID NO: 484811 - protein, 9 aa, Influenza virus
SIIDKMNTQ

SEQ ID NO: 484812 - protein, 9 aa, Influenza virus
SIIEAESSV

SEQ ID NO: 484813 - protein, 9 aa, Influenza virus
SIIEKMNTQ

SEQ ID NO: 484814 - protein, 9 aa, Influenza virus
SIIFNMERI

SEQ ID NO: 484815 - protein, 9 aa, Influenza virus
SIIFNSIGN

SEQ ID NO: 484816 - protein, 9 aa, Influenza virus
SIIGKMNTQ

SEQ ID NO: 484817 - protein, 9 aa, Influenza virus
SIINKMNTQ

SEQ ID NO: 484818 - protein, 9 aa, Influenza virus
SIIPSGPLK

SEQ ID NO: 484819 - protein, 9 aa, Influenza virus
SIISFCGVN

SEQ ID NO: 484820 - protein, 9 aa, Influenza virus
SIISMCSST

SEQ ID NO: 484821 - protein, 9 aa, Influenza virus
SIITELPFQ

SEQ ID NO: 484822 - protein, 9 aa, Influenza virus
SIIVFCGTS

SEQ ID NO: 484823 - protein, 9 aa, Influenza virus
SIKEKDMTK

SEQ ID NO: 484824 - protein, 9 aa, Influenza virus
SIKKYERVK

SEQ ID NO: 484825 - protein, 9 aa, Influenza virus
SIKNGTYDY

SEQ ID NO: 484826 - protein, 9 aa, Influenza virus
SIKNQEELR

SEQ ID NO: 484827 - protein, 9 aa, Influenza virus
SIKRYERVK

SEQ ID NO: 484828 - protein, 9 aa, Influenza virus
SIKSWRKDI

SEQ ID NO: 484829 - protein, 9 aa, Influenza virus
SIKSWRRDI

SEQ ID NO: 484830 - protein, 9 aa, Influenza virus
SIKTKLPFQ

SEQ ID NO: 484831 - protein, 9 aa, Influenza virus
SILANNGKF

SEQ ID NO: 484832 - protein, 9 aa, Influenza virus
SILANNGRF

SEQ ID NO: 484833 - protein, 9 aa, Influenza virus
SILASSGSL

SEQ ID NO: 484834 - protein, 9 aa, Influenza virus
SILHKCNDS

SEQ ID NO: 484835 - protein, 9 aa, Influenza virus
SILKPGETL

SEQ ID NO: 484836 - protein, 9 aa, Influenza virus
SILKPGQTL

SEQ ID NO: 484837 - protein, 9 aa, Influenza virus
SILNLLIGI

SEQ ID NO: 484838 - protein, 9 aa, Influenza virus
SILNTSQRG

SEQ ID NO: 484839 - protein, 9 aa, Influenza virus
SILRTQESE

SEQ ID NO: 484840 - protein, 9 aa, Influenza virus
SILTDSQTA

SEQ ID NO: 484841 - protein, 9 aa, Influenza virus
SILYFWGVH

SEQ ID NO: 484842 - protein, 9 aa, Influenza virus
SIMSCDSPS

SEQ ID NO: 484843 - protein, 9 aa, Influenza virus
SINECRTFF

SEQ ID NO: 484844 - protein, 9 aa, Influenza virus
SINGKAPIS

SEQ ID NO: 484845 - protein, 9 aa, Influenza virus
SINGKEPIS

SEQ ID NO: 484846 - protein, 9 aa, Influenza virus
SINGKQPIS

SEQ ID NO: 484847 - protein, 9 aa, Influenza virus
SINGRAPIS

SEQ ID NO: 484848 - protein, 9 aa, Influenza virus
SINPVKLSS

SEQ ID NO: 484849 - protein, 9 aa, Influenza virus
SINTKLPFQ

SEQ ID NO: 484850 - protein, 9 aa, Influenza virus
SINTRLPFQ

SEQ ID NO: 484851 - protein, 9 aa, Influenza virus
SINWLTKKE

SEQ ID NO: 484852 - protein, 9 aa, Influenza virus
SINWLTKKK

SEQ ID NO: 484853 - protein, 9 aa, Influenza virus
SIPNDKPFQ

SEQ ID NO: 484854 - protein, 9 aa, Influenza virus
SIPNEKPFQ

SEQ ID NO: 484855 - protein, 9 aa, Influenza virus
SIPNGKPFQ

SEQ ID NO: 484856 - protein, 9 aa, Influenza virus
SIPNNKPFQ

SEQ ID NO: 484857 - protein, 9 aa, Influenza virus
SIQPTFSVQ

SEQ ID NO: 484858 - protein, 9 aa, Influenza virus
SIQSDKPFQ

SEQ ID NO: 484859 - protein, 9 aa, Influenza virus
SIQSKGLFG

SEQ ID NO: 484860 - protein, 9 aa, Influenza virus
SIQSRGLFG

SEQ ID NO: 484861 - protein, 9 aa, Influenza virus
SIQTRGLFG

SEQ ID NO: 484862 - protein, 9 aa, Influenza virus
SIRDNTYDH

SEQ ID NO: 484863 - protein, 9 aa, Influenza virus
SIRGEFNQV

SEQ ID NO: 484864 - protein, 9 aa, Influenza virus
SIRGEFSQV

SEQ ID NO: 484865 - protein, 9 aa, Influenza virus
SIRGETTGR

SEQ ID NO: 484866 - protein, 9 aa, Influenza virus
SIRIGSKGD

SEQ ID NO: 484867 - protein, 9 aa, Influenza virus
SIRIGSRGD

SEQ ID NO: 484868 - protein, 9 aa, Influenza virus
SIRLAAGGD

SEQ ID NO: 484869 - protein, 9 aa, Influenza virus
SIRLSADGD

SEQ ID NO: 484870 - protein, 9 aa, Influenza virus
SIRLSAGGA

SEQ ID NO: 484871 - protein, 9 aa, Influenza virus
SIRLSAGGD

SEQ ID NO: 484872 - protein, 9 aa, Influenza virus
SIRLSAGGH

SEQ ID NO: 484873 - protein, 9 aa, Influenza virus
SIRLSAGGN

SEQ ID NO: 484874 - protein, 9 aa, Influenza virus
SIRLSASGD

SEQ ID NO: 484875 - protein, 9 aa, Influenza virus
SIRNETYDH

SEQ ID NO: 484876 - protein, 9 aa, Influenza virus
SIRNGTYDH

SEQ ID NO: 484877 - protein, 9 aa, Influenza virus
SIRNGTYDY

SEQ ID NO: 484878 - protein, 9 aa, Influenza virus
SIRNGTYNH

SEQ ID NO: 484879 - protein, 9 aa, Influenza virus
SIRNGTYNY

SEQ ID NO: 484880 - protein, 9 aa, Influenza virus
SIRNGTYSY

SEQ ID NO: 484881 - protein, 9 aa, Influenza virus
SIRNNSYDH

SEQ ID NO: 484882 - protein, 9 aa, Influenza virus
SIRNNTYDH

SEQ ID NO: 484883 - protein, 9 aa, Influenza virus
SIRNNTYNH

SEQ ID NO: 484884 - protein, 9 aa, Influenza virus
SIRNSTYDH

SEQ ID NO: 484885 - protein, 9 aa, Influenza virus
SIRTGTYDH

SEQ ID NO: 484886 - protein, 9 aa, Influenza virus
SIRWETTGR

SEQ ID NO: 484887 - protein, 9 aa, Influenza virus
SIRWLTLKS

SEQ ID NO: 484888 - protein, 9 aa, Influenza virus
SISCFLLAA

SEQ ID NO: 484889 - protein, 9 aa, Influenza virus
SISCFLLIA

SEQ ID NO: 484890 - protein, 9 aa, Influenza virus
SISCFLLVA

SEQ ID NO: 484891 - protein, 9 aa, Influenza virus
SISCLYKLS

SEQ ID NO: 484892 - protein, 9 aa, Influenza virus
SISECRTFF

SEQ ID NO: 484893 - protein, 9 aa, Influenza virus
SISFCGVDS

SEQ ID NO: 484894 - protein, 9 aa, Influenza virus
SISFCGVNG

SEQ ID NO: 484895 - protein, 9 aa, Influenza virus
SISFCGVNS

SEQ ID NO: 484896 - protein, 9 aa, Influenza virus
SISFCGVSS

SEQ ID NO: 484897 - protein, 9 aa, Influenza virus
SISIGSSTY

SEQ ID NO: 484898 - protein, 9 aa, Influenza virus
SISNDKPFQ

SEQ ID NO: 484899 - protein, 9 aa, Influenza virus
SISSRNGFE

SEQ ID NO: 484900 - protein, 9 aa, Influenza virus
SISSRSGFE

SEQ ID NO: 484901 - protein, 9 aa, Influenza virus
SISVESSTY

SEQ ID NO: 484902 - protein, 9 aa, Influenza virus
SISVGSSTY

SEQ ID NO: 484903 - protein, 9 aa, Influenza virus
SITDIWTYQ

SEQ ID NO: 484904 - protein, 9 aa, Influenza virus
SITEVWSYN

SEQ ID NO: 484905 - protein, 9 aa, Influenza virus
SITFSHNGG

SEQ ID NO: 484906 - protein, 9 aa, Influenza virus
SITIGKCPK

SEQ ID NO: 484907 - protein, 9 aa, Influenza virus
SITQTLVSN

SEQ ID NO: 484908 - protein, 9 aa, Influenza virus
SITYIWTYQ

SEQ ID NO: 484909 - protein, 9 aa, Influenza virus
SIVAFCGTS

SEQ ID NO: 484910 - protein, 9 aa, Influenza virus
SIVALCGSK

SEQ ID NO: 484911 - protein, 9 aa, Influenza virus
SIVALCGSR

SEQ ID NO: 484912 - protein, 9 aa, Influenza virus
SIVASSGTL

SEQ ID NO: 484913 - protein, 9 aa, Influenza virus
SIVASSGTV

SEQ ID NO: 484914 - protein, 9 aa, Influenza virus
SIVLVGLIL

SEQ ID NO: 484915 - protein, 9 aa, Influenza virus
SIVMCGVDH

SEQ ID NO: 484916 - protein, 9 aa, Influenza virus
SIVMCGVDY

SEQ ID NO: 484917 - protein, 9 aa, Influenza virus
SIVMCGVEH

SEQ ID NO: 484918 - protein, 9 aa, Influenza virus
SIVMCGVNY

SEQ ID NO: 484919 - protein, 9 aa, Influenza virus
SIVMVGLIL

SEQ ID NO: 484920 - protein, 9 aa, Influenza virus
SIVPNIGSR

SEQ ID NO: 484921 - protein, 9 aa, Influenza virus
SIVPSGPLK

SEQ ID NO: 484922 - protein, 9 aa, Influenza virus
SIVRRATVS

SEQ ID NO: 484923 - protein, 9 aa, Influenza virus
SIVSMCSST

SEQ ID NO: 484924 - protein, 9 aa, Influenza virus
SIVSWSQNI

SEQ ID NO: 484925 - protein, 9 aa, Influenza virus
SIVTFCGLD

SEQ ID NO: 484926 - protein, 9 aa, Influenza virus
SIVTFCGLN

SEQ ID NO: 484927 - protein, 9 aa, Influenza virus
SIVVFCGTP

SEQ ID NO: 484928 - protein, 9 aa, Influenza virus
SIVVFCGTS

SEQ ID NO: 484929 - protein, 9 aa, Influenza virus
SIWFSHYNQ

SEQ ID NO: 484930 - protein, 9 aa, Influenza virus
SIWMCSNGS

SEQ ID NO: 484931 - protein, 9 aa, Influenza virus
SIWTSSSST

SEQ ID NO: 484932 - protein, 9 aa, Influenza virus
SIYASPQLE

SEQ ID NO: 484933 - protein, 9 aa, Influenza virus
SIYIEVLHL

SEQ ID NO: 484934 - protein, 9 aa, Influenza virus
SIYQNSFVP

SEQ ID NO: 484935 - protein, 9 aa, Influenza virus
SIYSCIASS

SEQ ID NO: 484936 - protein, 9 aa, Influenza virus
SIYSCVASS

SEQ ID NO: 484937 - protein, 9 aa, Influenza virus
SIYSSVASS

SEQ ID NO: 484938 - protein, 9 aa, Influenza virus
SIYSTAASS

SEQ ID NO: 484939 - protein, 9 aa, Influenza virus
SIYSTVAAS

SEQ ID NO: 484940 - protein, 9 aa, Influenza virus
SIYSTVASS

SEQ ID NO: 484941 - protein, 9 aa, Influenza virus
SIYSTVSSS

SEQ ID NO: 484942 - protein, 9 aa, Influenza virus
SIYSTVTSS

SEQ ID NO: 484943 - protein, 9 aa, Influenza virus
SIYSTVVSS

SEQ ID NO: 484944 - protein, 9 aa, Influenza virus
SIYWTIVKP

SEQ ID NO: 484945 - protein, 9 aa, Influenza virus
SIYWTLVNP

SEQ ID NO: 484946 - protein, 9 aa, Influenza virus
SIYWTVVKP

SEQ ID NO: 484947 - protein, 9 aa, Influenza virus
SKACNALTG

SEQ ID NO: 484948 - protein, 9 aa, Influenza virus
SKACNASTG

SEQ ID NO: 484949 - protein, 9 aa, Influenza virus
SKACNDISN

SEQ ID NO: 484950 - protein, 9 aa, Influenza virus
SKACNDTSN

SEQ ID NO: 484951 - protein, 9 aa, Influenza virus
SKACNNTSN

SEQ ID NO: 484952 - protein, 9 aa, Influenza virus
SKACNSISN

SEQ ID NO: 484953 - protein, 9 aa, Influenza virus
SKACSASTG

SEQ ID NO: 484954 - protein, 9 aa, Influenza virus
SKADKICIG

SEQ ID NO: 484955 - protein, 9 aa, Influenza virus
SKANQVFPQ

SEQ ID NO: 484956 - protein, 9 aa, Influenza virus
SKCFWKGGS

SEQ ID NO: 484957 - protein, 9 aa, Influenza virus
SKCFWKGGT

SEQ ID NO: 484958 - protein, 9 aa, Influenza virus
SKCFWRGGS

SEQ ID NO: 484959 - protein, 9 aa, Influenza virus
SKCHTDKGS

SEQ ID NO: 484960 - protein, 9 aa, Influenza virus
SKCHTDRGS

SEQ ID NO: 484961 - protein, 9 aa, Influenza virus
SKCHTEKGS

SEQ ID NO: 484962 - protein, 9 aa, Influenza virus
SKCHTNRGS

SEQ ID NO: 484963 - protein, 9 aa, Influenza virus
SKCKTKEGR

SEQ ID NO: 484964 - protein, 9 aa, Influenza virus
SKCQQSFTP

SEQ ID NO: 484965 - protein, 9 aa, Influenza virus
SKCRTKEGR

SEQ ID NO: 484966 - protein, 9 aa, Influenza virus
SKCRTREGR

SEQ ID NO: 484967 - protein, 9 aa, Influenza virus
SKCYNPCFY

SEQ ID NO: 484968 - protein, 9 aa, Influenza virus
SKCYQFALG

SEQ ID NO: 484969 - protein, 9 aa, Influenza virus
SKDLRSGYE

SEQ ID NO: 484970 - protein, 9 aa, Influenza virus
SKDNAIRIG

SEQ ID NO: 484971 - protein, 9 aa, Influenza virus
SKDNGIRIG

SEQ ID NO: 484972 - protein, 9 aa, Influenza virus
SKDNGIRVG

SEQ ID NO: 484973 - protein, 9 aa, Influenza virus
SKDNNIRIG

SEQ ID NO: 484974 - protein, 9 aa, Influenza virus
SKDNQVFPQ

SEQ ID NO: 484975 - protein, 9 aa, Influenza virus
SKDNSIQLS

SEQ ID NO: 484976 - protein, 9 aa, Influenza virus
SKDNSIRIG

SEQ ID NO: 484977 - protein, 9 aa, Influenza virus
SKDNSIRLA

SEQ ID NO: 484978 - protein, 9 aa, Influenza virus
SKDNSIRLS

SEQ ID NO: 484979 - protein, 9 aa, Influenza virus
SKDNSVRIG

SEQ ID NO: 484980 - protein, 9 aa, Influenza virus
SKDNSVRLS

SEQ ID NO: 484981 - protein, 9 aa, Influenza virus
SKDSRSGYE

SEQ ID NO: 484982 - protein, 9 aa, Influenza virus
SKDTRSGYE

SEQ ID NO: 484983 - protein, 9 aa, Influenza virus
SKEAQDVIM

SEQ ID NO: 484984 - protein, 9 aa, Influenza virus
SKEGSYFFG

SEQ ID NO: 484985 - protein, 9 aa, Influenza virus
SKEQGSGYA

SEQ ID NO: 484986 - protein, 9 aa, Influenza virus
SKEQLGSWS

SEQ ID NO: 484987 - protein, 9 aa, Influenza virus
SKERLGSWS

SEQ ID NO: 484988 - protein, 9 aa, Influenza virus
SKFESVAWS

SEQ ID NO: 484989 - protein, 9 aa, Influenza virus
SKFHSDTPR

SEQ ID NO: 484990 - protein, 9 aa, Influenza virus
SKFLLMDAL

SEQ ID NO: 484991 - protein, 9 aa, Influenza virus
SKFLLMDSL

SEQ ID NO: 484992 - protein, 9 aa, Influenza virus
SKGDIFVIR

SEQ ID NO: 484993 - protein, 9 aa, Influenza virus
SKGDIFVMR

SEQ ID NO: 484994 - protein, 9 aa, Influenza virus
SKGDVFVIR

SEQ ID NO: 484995 - protein, 9 aa, Influenza virus
SKGDVFVMR

SEQ ID NO: 484996 - protein, 9 aa, Influenza virus
SKGHVFVIR

SEQ ID NO: 484997 - protein, 9 aa, Influenza virus
SKGLFGAIA

SEQ ID NO: 484998 - protein, 9 aa, Influenza virus
SKGSSKQQH

SEQ ID NO: 484999 - protein, 9 aa, Influenza virus
SKHYIGKCP

SEQ ID NO: 485000 - protein, 9 aa, Influenza virus
SKIKMKWGM

SEQ ID NO: 485001 - protein, 9 aa, Influenza virus
SKILTDTSR

SEQ ID NO: 485002 - protein, 9 aa, Influenza virus
SKINEVKLE

SEQ ID NO: 485003 - protein, 9 aa, Influenza virus
SKINGVILE

SEQ ID NO: 485004 - protein, 9 aa, Influenza virus
SKINGVKLE

SEQ ID NO: 485005 - protein, 9 aa, Influenza virus
SKINGVRLE

SEQ ID NO: 485006 - protein, 9 aa, Influenza virus
SKINRQEIE

SEQ ID NO: 485007 - protein, 9 aa, Influenza virus
SKITLKFAF

SEQ ID NO: 485008 - protein, 9 aa, Influenza virus
SKKKSYINK

SEQ ID NO: 485009 - protein, 9 aa, Influenza virus
SKKKSYINR

SEQ ID NO: 485010 - protein, 9 aa, Influenza virus
SKKRLGSWS

SEQ ID NO: 485011 - protein, 9 aa, Influenza virus
SKLKRNEIK

SEQ ID NO: 485012 - protein, 9 aa, Influenza virus
SKLKRQEID

SEQ ID NO: 485013 - protein, 9 aa, Influenza virus
SKLKRQEIE

SEQ ID NO: 485014 - protein, 9 aa, Influenza virus
SKLKRQEIN

SEQ ID NO: 485015 - protein, 9 aa, Influenza virus
SKLNRNEIK

SEQ ID NO: 485016 - protein, 9 aa, Influenza virus
SKLNRQEIE

SEQ ID NO: 485017 - protein, 9 aa, Influenza virus
SKLNRQEIG

SEQ ID NO: 485018 - protein, 9 aa, Influenza virus
SKLNRSEIK

SEQ ID NO: 485019 - protein, 9 aa, Influenza virus
SKLNRTEIK

SEQ ID NO: 485020 - protein, 9 aa, Influenza virus
SKLPFQNIN

SEQ ID NO: 485021 - protein, 9 aa, Influenza virus
SKMGVDEYS

SEQ ID NO: 485022 - protein, 9 aa, Influenza virus
SKMQFSSLT

SEQ ID NO: 485023 - protein, 9 aa, Influenza virus
SKNILRTQE

SEQ ID NO: 485024 - protein, 9 aa, Influenza virus
SKNPYTLVS

SEQ ID NO: 485025 - protein, 9 aa, Influenza virus
SKNSRSGYE

SEQ ID NO: 485026 - protein, 9 aa, Influenza virus
SKPFQNASR

SEQ ID NO: 485027 - protein, 9 aa, Influenza virus
SKPFQNICK

SEQ ID NO: 485028 - protein, 9 aa, Influenza virus
SKPFQNTSK

SEQ ID NO: 485029 - protein, 9 aa, Influenza virus
SKPFQNTSR

SEQ ID NO: 485030 - protein, 9 aa, Influenza virus
SKPLQNASR

SEQ ID NO: 485031 - protein, 9 aa, Influenza virus
SKPLQNTSK

SEQ ID NO: 485032 - protein, 9 aa, Influenza virus
SKPQCHITG

SEQ ID NO: 485033 - protein, 9 aa, Influenza virus
SKPQCKITG

SEQ ID NO: 485034 - protein, 9 aa, Influenza virus
SKPQCLITG

SEQ ID NO: 485035 - protein, 9 aa, Influenza virus
SKPQCQIAG

SEQ ID NO: 485036 - protein, 9 aa, Influenza virus
SKPQCQIIG

SEQ ID NO: 485037 - protein, 9 aa, Influenza virus
SKPQCQIRG

SEQ ID NO: 485038 - protein, 9 aa, Influenza virus
SKPQCQISG

SEQ ID NO: 485039 - protein, 9 aa, Influenza virus
SKPQCQITG

SEQ ID NO: 485040 - protein, 9 aa, Influenza virus
SKRGGSGIM

SEQ ID NO: 485041 - protein, 9 aa, Influenza virus
SKRGNSGIM

SEQ ID NO: 485042 - protein, 9 aa, Influenza virus
SKRGSSGIM

SEQ ID NO: 485043 - protein, 9 aa, Influenza virus
SKRGSSGIV

SEQ ID NO: 485044 - protein, 9 aa, Influenza virus
SKRGSSGVM

SEQ ID NO: 485045 - protein, 9 aa, Influenza virus
SKRYELEIG

SEQ ID NO: 485046 - protein, 9 aa, Influenza virus
SKSDKICIG

SEQ ID NO: 485047 - protein, 9 aa, Influenza virus
SKSDRICIG

SEQ ID NO: 485048 - protein, 9 aa, Influenza virus
SKSLCKVEG

SEQ ID NO: 485049 - protein, 9 aa, Influenza virus
SKSRGYKMN

SEQ ID NO: 485050 - protein, 9 aa, Influenza virus
SKSRSIIFN

SEQ ID NO: 485051 - protein, 9 aa, Influenza virus
SKSRSNIFN

SEQ ID NO: 485052 - protein, 9 aa, Influenza virus
SKSRVDNHS

SEQ ID NO: 485053 - protein, 9 aa, Influenza virus
SKSTKSTVL

SEQ ID NO: 485054 - protein, 9 aa, Influenza virus
SKTGVDEYS

SEQ ID NO: 485055 - protein, 9 aa, Influenza virus
SKTLTDTSR

SEQ ID NO: 485056 - protein, 9 aa, Influenza virus
SKTNQQFEL

SEQ ID NO: 485057 - protein, 9 aa, Influenza virus
SKTQCQITG

SEQ ID NO: 485058 - protein, 9 aa, Influenza virus
SKVGVDEYS

SEQ ID NO: 485059 - protein, 9 aa, Influenza virus
SKVKMKWGM

SEQ ID NO: 485060 - protein, 9 aa, Influenza virus
SKVLTDTSR

SEQ ID NO: 485061 - protein, 9 aa, Influenza virus
SKVTCICRD

SEQ ID NO: 485062 - protein, 9 aa, Influenza virus
SKVTCVCRD

SEQ ID NO: 485063 - protein, 9 aa, Influenza virus
SKWGDILEG

SEQ ID NO: 485064 - protein, 9 aa, Influenza virus
SKWGDVLDG

SEQ ID NO: 485065 - protein, 9 aa, Influenza virus
SKWGNVLDG

SEQ ID NO: 485066 - protein, 9 aa, Influenza virus
SKWNVTYTG

SEQ ID NO: 485067 - protein, 9 aa, Influenza virus
SKYEEESKL

SEQ ID NO: 485068 - protein, 9 aa, Influenza virus
SKYHWNLAL

SEQ ID NO: 485069 - protein, 9 aa, Influenza virus
SKYQQSFSP

SEQ ID NO: 485070 - protein, 9 aa, Influenza virus
SKYQQSFTP

SEQ ID NO: 485071 - protein, 9 aa, Influenza virus
SKYRQSFSP

SEQ ID NO: 485072 - protein, 9 aa, Influenza virus
SKYWAIRTR

SEQ ID NO: 485073 - protein, 9 aa, Influenza virus
SLAIMIAGI

SEQ ID NO: 485074 - protein, 9 aa, Influenza virus
SLAIMMAGI

SEQ ID NO: 485075 - protein, 9 aa, Influenza virus
SLAIMVAGI

SEQ ID NO: 485076 - protein, 9 aa, Influenza virus
SLAVNVRGS

SEQ ID NO: 485077 - protein, 9 aa, Influenza virus
SLCEVNSWH

SEQ ID NO: 485078 - protein, 9 aa, Influenza virus
SLCKIEGWV

SEQ ID NO: 485079 - protein, 9 aa, Influenza virus
SLCKVEEWV

SEQ ID NO: 485080 - protein, 9 aa, Influenza virus
SLCKVEGWV

SEQ ID NO: 485081 - protein, 9 aa, Influenza virus
SLCLAILIA

SEQ ID NO: 485082 - protein, 9 aa, Influenza virus
SLCLAILVA

SEQ ID NO: 485083 - protein, 9 aa, Influenza virus
SLCLAVLIA

SEQ ID NO: 485084 - protein, 9 aa, Influenza virus
SLCMCSNGS

SEQ ID NO: 485085 - protein, 9 aa, Influenza virus
SLCNVEGWV

SEQ ID NO: 485086 - protein, 9 aa, Influenza virus
SLCSIWFSH

SEQ ID NO: 485087 - protein, 9 aa, Influenza virus
SLCSVEGWV

SEQ ID NO: 485088 - protein, 9 aa, Influenza virus
SLCYPGNFN

SEQ ID NO: 485089 - protein, 9 aa, Influenza virus
SLCYPGSFN

SEQ ID NO: 485090 - protein, 9 aa, Influenza virus
SLCYPGSLN

SEQ ID NO: 485091 - protein, 9 aa, Influenza virus
SLDEQNKLY

SEQ ID NO: 485092 - protein, 9 aa, Influenza virus
SLDKICLGH

SEQ ID NO: 485093 - protein, 9 aa, Influenza virus
SLEFIAEQF

SEQ ID NO: 485094 - protein, 9 aa, Influenza virus
SLEGIILGN

SEQ ID NO: 485095 - protein, 9 aa, Influenza virus
SLEGLILGN

SEQ ID NO: 485096 - protein, 9 aa, Influenza virus
SLEGLILSN

SEQ ID NO: 485097 - protein, 9 aa, Influenza virus
SLEGLVLGN

SEQ ID NO: 485098 - protein, 9 aa, Influenza virus
SLEPGTFDL

SEQ ID NO: 485099 - protein, 9 aa, Influenza virus
SLERRLENL

SEQ ID NO: 485100 - protein, 9 aa, Influenza virus
SLESRRGFE

SEQ ID NO: 485101 - protein, 9 aa, Influenza virus
SLESRSGFE

SEQ ID NO: 485102 - protein, 9 aa, Influenza virus
SLFEKFFPS

SEQ ID NO: 485103 - protein, 9 aa, Influenza virus
SLFSSIKKY

SEQ ID NO: 485104 - protein, 9 aa, Influenza virus
SLFSSIKRY

SEQ ID NO: 485105 - protein, 9 aa, Influenza virus
SLGAISFWM

SEQ ID NO: 485106 - protein, 9 aa, Influenza virus
SLGASCFLL

SEQ ID NO: 485107 - protein, 9 aa, Influenza virus
SLGAVSFWM

SEQ ID NO: 485108 - protein, 9 aa, Influenza virus
SLGDCSFAG

SEQ ID NO: 485109 - protein, 9 aa, Influenza virus
SLGGCSFAG

SEQ ID NO: 485110 - protein, 9 aa, Influenza virus
SLGIQSDAQ

SEQ ID NO: 485111 - protein, 9 aa, Influenza virus
SLIALCGSP

SEQ ID NO: 485112 - protein, 9 aa, Influenza virus
SLIASSGTL

SEQ ID NO: 485113 - protein, 9 aa, Influenza virus
SLIIAARNI

SEQ ID NO: 485114 - protein, 9 aa, Influenza virus
SLIIAARSI

SEQ ID NO: 485115 - protein, 9 aa, Influenza virus
SLILAAIIM

SEQ ID NO: 485116 - protein, 9 aa, Influenza virus
SLILAALIM

SEQ ID NO: 485117 - protein, 9 aa, Influenza virus
SLIMRTVIA

SEQ ID NO: 485118 - protein, 9 aa, Influenza virus
SLIQFPIGT

SEQ ID NO: 485119 - protein, 9 aa, Influenza virus
SLIQFPMGT

SEQ ID NO: 485120 - protein, 9 aa, Influenza virus
SLIRFPIGT

SEQ ID NO: 485121 - protein, 9 aa, Influenza virus
SLIRFPIGV

SEQ ID NO: 485122 - protein, 9 aa, Influenza virus
SLIRFPVGT

SEQ ID NO: 485123 - protein, 9 aa, Influenza virus
SLIRPKENP

SEQ ID NO: 485124 - protein, 9 aa, Influenza virus
SLIRPNENP

SEQ ID NO: 485125 - protein, 9 aa, Influenza virus
SLIRSNENP

SEQ ID NO: 485126 - protein, 9 aa, Influenza virus
SLISWPLSS

SEQ ID NO: 485127 - protein, 9 aa, Influenza virus
SLIWLWLVL

SEQ ID NO: 485128 - protein, 9 aa, Influenza virus
SLKGLILGN

SEQ ID NO: 485129 - protein, 9 aa, Influenza virus
SLKLAIGLR

SEQ ID NO: 485130 - protein, 9 aa, Influenza virus
SLKLAIGPR

SEQ ID NO: 485131 - protein, 9 aa, Influenza virus
SLKLASGLR

SEQ ID NO: 485132 - protein, 9 aa, Influenza virus
SLKLATGLR

SEQ ID NO: 485133 - protein, 9 aa, Influenza virus
SLKLATGMR

SEQ ID NO: 485134 - protein, 9 aa, Influenza virus
SLKLATGPR

SEQ ID NO: 485135 - protein, 9 aa, Influenza virus
SLKLAVGLK

SEQ ID NO: 485136 - protein, 9 aa, Influenza virus
SLKLAVGLR

SEQ ID NO: 485137 - protein, 9 aa, Influenza virus
SLKLAVGMR

SEQ ID NO: 485138 - protein, 9 aa, Influenza virus
SLKLAVGPR

SEQ ID NO: 485139 - protein, 9 aa, Influenza virus
SLKLSIEDP

SEQ ID NO: 485140 - protein, 9 aa, Influenza virus
SLKLVTGLR

SEQ ID NO: 485141 - protein, 9 aa, Influenza virus
SLLEMCHST

SEQ ID NO: 485142 - protein, 9 aa, Influenza virus
SLLGDPHCD

SEQ ID NO: 485143 - protein, 9 aa, Influenza virus
SLLHKCNDS

SEQ ID NO: 485144 - protein, 9 aa, Influenza virus
SLLLATGMK

SEQ ID NO: 485145 - protein, 9 aa, Influenza virus
SLLLATGMR

SEQ ID NO: 485146 - protein, 9 aa, Influenza virus
SLLLLQANL

SEQ ID NO: 485147 - protein, 9 aa, Influenza virus
SLLLQANLC

SEQ ID NO: 485148 - protein, 9 aa, Influenza virus
SLLNDKHSN

SEQ ID NO: 485149 - protein, 9 aa, Influenza virus
SLLNDKHSS

SEQ ID NO: 485150 - protein, 9 aa, Influenza virus
SLLNDRHSN

SEQ ID NO: 485151 - protein, 9 aa, Influenza virus
SLLNRLSIN

SEQ ID NO: 485152 - protein, 9 aa, Influenza virus
SLLQSAILS

SEQ ID NO: 485153 - protein, 9 aa, Influenza virus
SLLRDNAKD

SEQ ID NO: 485154 - protein, 9 aa, Influenza virus
SLLTEVETH

SEQ ID NO: 485155 - protein, 9 aa, Influenza virus
SLLTEVETL

SEQ ID NO: 485156 - protein, 9 aa, Influenza virus
SLLTEVETP

SEQ ID NO: 485157 - protein, 9 aa, Influenza virus
SLLTEVETY

SEQ ID NO: 485158 - protein, 9 aa, Influenza virus
SLMLATGMK

SEQ ID NO: 485159 - protein, 9 aa, Influenza virus
SLMLATGMR

SEQ ID NO: 485160 - protein, 9 aa, Influenza virus
SLMQGSTLP

SEQ ID NO: 485161 - protein, 9 aa, Influenza virus
SLMRPNENP

SEQ ID NO: 485162 - protein, 9 aa, Influenza virus
SLMWEINGP

SEQ ID NO: 485163 - protein, 9 aa, Influenza virus
SLNDYEELK

SEQ ID NO: 485164 - protein, 9 aa, Influenza virus
SLNGISPIH

SEQ ID NO: 485165 - protein, 9 aa, Influenza virus
SLNGISPVH

SEQ ID NO: 485166 - protein, 9 aa, Influenza virus
SLNGVSPIH

SEQ ID NO: 485167 - protein, 9 aa, Influenza virus
SLNGVSPVH

SEQ ID NO: 485168 - protein, 9 aa, Influenza virus
SLNISLYSK

SEQ ID NO: 485169 - protein, 9 aa, Influenza virus
SLNITAASL

SEQ ID NO: 485170 - protein, 9 aa, Influenza virus
SLNKKMEDG

SEQ ID NO: 485171 - protein, 9 aa, Influenza virus
SLNKRMEDG

SEQ ID NO: 485172 - protein, 9 aa, Influenza virus
SLNNKVDDG

SEQ ID NO: 485173 - protein, 9 aa, Influenza virus
SLPDGAQIQ

SEQ ID NO: 485174 - protein, 9 aa, Influenza virus
SLPDLYDYK

SEQ ID NO: 485175 - protein, 9 aa, Influenza virus
SLPFHNIHP

SEQ ID NO: 485176 - protein, 9 aa, Influenza virus
SLPFHNVHP

SEQ ID NO: 485177 - protein, 9 aa, Influenza virus
SLPFQNIHP

SEQ ID NO: 485178 - protein, 9 aa, Influenza virus
SLPFQNIHS

SEQ ID NO: 485179 - protein, 9 aa, Influenza virus
SLPFQNINP

SEQ ID NO: 485180 - protein, 9 aa, Influenza virus
SLPFQNINS

SEQ ID NO: 485181 - protein, 9 aa, Influenza virus
SLPFQNISP

SEQ ID NO: 485182 - protein, 9 aa, Influenza virus
SLPFQNVHP

SEQ ID NO: 485183 - protein, 9 aa, Influenza virus
SLPLALGMK

SEQ ID NO: 485184 - protein, 9 aa, Influenza virus
SLPLCPFKG

SEQ ID NO: 485185 - protein, 9 aa, Influenza virus
SLPLCPFQG

SEQ ID NO: 485186 - protein, 9 aa, Influenza virus
SLPLCPFRG

SEQ ID NO: 485187 - protein, 9 aa, Influenza virus
SLPNDKHSN

SEQ ID NO: 485188 - protein, 9 aa, Influenza virus
SLQNRIQID

SEQ ID NO: 485189 - protein, 9 aa, Influenza virus
SLQQIESII

SEQ ID NO: 485190 - protein, 9 aa, Influenza virus
SLQQIESMI

SEQ ID NO: 485191 - protein, 9 aa, Influenza virus
SLQQIESMV

SEQ ID NO: 485192 - protein, 9 aa, Influenza virus
SLRGRGSTL

SEQ ID NO: 485193 - protein, 9 aa, Influenza virus
SLRLAIGLR

SEQ ID NO: 485194 - protein, 9 aa, Influenza virus
SLRLALGLR

SEQ ID NO: 485195 - protein, 9 aa, Influenza virus
SLRLATGLR

SEQ ID NO: 485196 - protein, 9 aa, Influenza virus
SLRLAVGLR

SEQ ID NO: 485197 - protein, 9 aa, Influenza virus
SLRMKWMMA

SEQ ID NO: 485198 - protein, 9 aa, Influenza virus
SLRSILANN

SEQ ID NO: 485199 - protein, 9 aa, Influenza virus
SLRSILASS

SEQ ID NO: 485200 - protein, 9 aa, Influenza virus
SLRSIVASS

SEQ ID NO: 485201 - protein, 9 aa, Influenza virus
SLRSLIASS

SEQ ID NO: 485202 - protein, 9 aa, Influenza virus
SLRSLVASS

SEQ ID NO: 485203 - protein, 9 aa, Influenza virus
SLSGSAQHI

SEQ ID NO: 485204 - protein, 9 aa, Influenza virus
SLSISIGSS

SEQ ID NO: 485205 - protein, 9 aa, Influenza virus
SLSISVESS

SEQ ID NO: 485206 - protein, 9 aa, Influenza virus
SLSISVGSS

SEQ ID NO: 485207 - protein, 9 aa, Influenza virus
SLSLAIMIA

SEQ ID NO: 485208 - protein, 9 aa, Influenza virus
SLSLAIMMA

SEQ ID NO: 485209 - protein, 9 aa, Influenza virus
SLSLAIMVA

SEQ ID NO: 485210 - protein, 9 aa, Influenza virus
SLSPGMMMG

SEQ ID NO: 485211 - protein, 9 aa, Influenza virus
SLSYSTGAL

SEQ ID NO: 485212 - protein, 9 aa, Influenza virus
SLTEIWSYN

SEQ ID NO: 485213 - protein, 9 aa, Influenza virus
SLTHALREL

SEQ ID NO: 485214 - protein, 9 aa, Influenza virus
SLTSLPFQN

SEQ ID NO: 485215 - protein, 9 aa, Influenza virus
SLTVNVRGS

SEQ ID NO: 485216 - protein, 9 aa, Influenza virus
SLTVNVRGT

SEQ ID NO: 485217 - protein, 9 aa, Influenza virus
SLTVSVRGS

SEQ ID NO: 485218 - protein, 9 aa, Influenza virus
SLVALCGSP

SEQ ID NO: 485219 - protein, 9 aa, Influenza virus
SLVASSGNL

SEQ ID NO: 485220 - protein, 9 aa, Influenza virus
SLVASSGTL

SEQ ID NO: 485221 - protein, 9 aa, Influenza virus
SLVGIDPFK

SEQ ID NO: 485222 - protein, 9 aa, Influenza virus
SLVGIDPFR

SEQ ID NO: 485223 - protein, 9 aa, Influenza virus
SLVGVDPFK

SEQ ID NO: 485224 - protein, 9 aa, Influenza virus
SLVIAARNI

SEQ ID NO: 485225 - protein, 9 aa, Influenza virus
SLVKTTLFL

SEQ ID NO: 485226 - protein, 9 aa, Influenza virus
SLVLAAIIM

SEQ ID NO: 485227 - protein, 9 aa, Influenza virus
SLVLAALIM

SEQ ID NO: 485228 - protein, 9 aa, Influenza virus
SLVLAASIM

SEQ ID NO: 485229 - protein, 9 aa, Influenza virus
SLVLIVSLG

SEQ ID NO: 485230 - protein, 9 aa, Influenza virus
SLVLLFMII

SEQ ID NO: 485231 - protein, 9 aa, Influenza virus
SLVLLLMII

SEQ ID NO: 485232 - protein, 9 aa, Influenza virus
SLVLLVSLG

SEQ ID NO: 485233 - protein, 9 aa, Influenza virus
SLVLVVSLG

SEQ ID NO: 485234 - protein, 9 aa, Influenza virus
SLWDSFRQS

SEQ ID NO: 485235 - protein, 9 aa, Influenza virus
SLWMCSNGS

SEQ ID NO: 485236 - protein, 9 aa, Influenza virus
SLYASPQLE

SEQ ID NO: 485237 - protein, 9 aa, Influenza virus
SLYASSQLE

SEQ ID NO: 485238 - protein, 9 aa, Influenza virus
SLYDKVRMQ

SEQ ID NO: 485239 - protein, 9 aa, Influenza virus
SLYSSPQLE

SEQ ID NO: 485240 - protein, 9 aa, Influenza virus
SLYWTIVEP

SEQ ID NO: 485241 - protein, 9 aa, Influenza virus
SMAPIMFSN

SEQ ID NO: 485242 - protein, 9 aa, Influenza virus
SMCSSTEFL

SEQ ID NO: 485243 - protein, 9 aa, Influenza virus
SMDSRSGYE

SEQ ID NO: 485244 - protein, 9 aa, Influenza virus
SMEDYSIDS

SEQ ID NO: 485245 - protein, 9 aa, Influenza virus
SMEFSLTDP

SEQ ID NO: 485246 - protein, 9 aa, Influenza virus
SMELPSFGV

SEQ ID NO: 485247 - protein, 9 aa, Influenza virus
SMFLYVRTN

SEQ ID NO: 485248 - protein, 9 aa, Influenza virus
SMGEAMVSR

SEQ ID NO: 485249 - protein, 9 aa, Influenza virus
SMGFRYSGI

SEQ ID NO: 485250 - protein, 9 aa, Influenza virus
SMGIYQILA

SEQ ID NO: 485251 - protein, 9 aa, Influenza virus
SMGVYQILA

SEQ ID NO: 485252 - protein, 9 aa, Influenza virus
SMIEAESSI

SEQ ID NO: 485253 - protein, 9 aa, Influenza virus
SMIEAESSV

SEQ ID NO: 485254 - protein, 9 aa, Influenza virus
SMKWLTLKS

SEQ ID NO: 485255 - protein, 9 aa, Influenza virus
SMLKPGETL

SEQ ID NO: 485256 - protein, 9 aa, Influenza virus
SMMEAMVSR

SEQ ID NO: 485257 - protein, 9 aa, Influenza virus
SMMWEINGP

SEQ ID NO: 485258 - protein, 9 aa, Influenza virus
SMMWEVNGP

SEQ ID NO: 485259 - protein, 9 aa, Influenza virus
SMNNQVFPQ

SEQ ID NO: 485260 - protein, 9 aa, Influenza virus
SMPFHNIHP

SEQ ID NO: 485261 - protein, 9 aa, Influenza virus
SMPFHNVHP

SEQ ID NO: 485262 - protein, 9 aa, Influenza virus
SMPLHNIHP

SEQ ID NO: 485263 - protein, 9 aa, Influenza virus
SMQCRICIG

SEQ ID NO: 485264 - protein, 9 aa, Influenza virus
SMREEYQQE

SEQ ID NO: 485265 - protein, 9 aa, Influenza virus
SMREEYREE

SEQ ID NO: 485266 - protein, 9 aa, Influenza virus
SMREEYRKE

SEQ ID NO: 485267 - protein, 9 aa, Influenza virus
SMREEYRQE

SEQ ID NO: 485268 - protein, 9 aa, Influenza virus
SMREEYRQK

SEQ ID NO: 485269 - protein, 9 aa, Influenza virus
SMRWLTLKL

SEQ ID NO: 485270 - protein, 9 aa, Influenza virus
SMRWLTLKS

SEQ ID NO: 485271 - protein, 9 aa, Influenza virus
SMSCFVFVA

SEQ ID NO: 485272 - protein, 9 aa, Influenza virus
SMSDIEAMA

SEQ ID NO: 485273 - protein, 9 aa, Influenza virus
SMSGFRSNL

SEQ ID NO: 485274 - protein, 9 aa, Influenza virus
SMTEIWSYN

SEQ ID NO: 485275 - protein, 9 aa, Influenza virus
SMTEVWSYN

SEQ ID NO: 485276 - protein, 9 aa, Influenza virus
SMVEAESSV

SEQ ID NO: 485277 - protein, 9 aa, Influenza virus
SMVEAMISR

SEQ ID NO: 485278 - protein, 9 aa, Influenza virus
SMVEAMMSR

SEQ ID NO: 485279 - protein, 9 aa, Influenza virus
SMVEAMVSR

SEQ ID NO: 485280 - protein, 9 aa, Influenza virus
SMVKSDKIC

SEQ ID NO: 485281 - protein, 9 aa, Influenza virus
SMVRSDKIC

SEQ ID NO: 485282 - protein, 9 aa, Influenza virus
SMVTFCGLD

SEQ ID NO: 485283 - protein, 9 aa, Influenza virus
SNAASYKRI

SEQ ID NO: 485284 - protein, 9 aa, Influenza virus
SNAEGTGMA

SEQ ID NO: 485285 - protein, 9 aa, Influenza virus
SNAIDEGDG

SEQ ID NO: 485286 - protein, 9 aa, Influenza virus
SNAITRSGQ

SEQ ID NO: 485287 - protein, 9 aa, Influenza virus
SNALLKHRF

SEQ ID NO: 485288 - protein, 9 aa, Influenza virus
SNAPSGIEY

SEQ ID NO: 485289 - protein, 9 aa, Influenza virus
SNAPSGVEY

SEQ ID NO: 485290 - protein, 9 aa, Influenza virus
SNAQAFYKI

SEQ ID NO: 485291 - protein, 9 aa, Influenza virus
SNCKDPNEE

SEQ ID NO: 485292 - protein, 9 aa, Influenza virus
SNCKDPNNE

SEQ ID NO: 485293 - protein, 9 aa, Influenza virus
SNCRDPNDE

SEQ ID NO: 485294 - protein, 9 aa, Influenza virus
SNCRDPNEE

SEQ ID NO: 485295 - protein, 9 aa, Influenza virus
SNCRDPNNE

SEQ ID NO: 485296 - protein, 9 aa, Influenza virus
SNCRDSNNE

SEQ ID NO: 485297 - protein, 9 aa, Influenza virus
SNCRNPNNE

SEQ ID NO: 485298 - protein, 9 aa, Influenza virus
SNDDWSGYS

SEQ ID NO: 485299 - protein, 9 aa, Influenza virus
SNDKPFQNV

SEQ ID NO: 485300 - protein, 9 aa, Influenza virus
SNDNWSGYS

SEQ ID NO: 485301 - protein, 9 aa, Influenza virus
SNDQGAGYA

SEQ ID NO: 485302 - protein, 9 aa, Influenza virus
SNDQGSGYA

SEQ ID NO: 485303 - protein, 9 aa, Influenza virus
SNDTIHDRT

SEQ ID NO: 485304 - protein, 9 aa, Influenza virus
SNDTINYYN

SEQ ID NO: 485305 - protein, 9 aa, Influenza virus
SNDVWLGRT

SEQ ID NO: 485306 - protein, 9 aa, Influenza virus
SNEGSYFFG

SEQ ID NO: 485307 - protein, 9 aa, Influenza virus
SNENLIAPW

SEQ ID NO: 485308 - protein, 9 aa, Influenza virus
SNENPAHKS

SEQ ID NO: 485309 - protein, 9 aa, Influenza virus
SNEQGSGYA

SEQ ID NO: 485310 - protein, 9 aa, Influenza virus
SNETILETG

SEQ ID NO: 485311 - protein, 9 aa, Influenza virus
SNETVKDRS

SEQ ID NO: 485312 - protein, 9 aa, Influenza virus
SNGAFIAPR

SEQ ID NO: 485313 - protein, 9 aa, Influenza virus
SNGAFLAPG

SEQ ID NO: 485314 - protein, 9 aa, Influenza virus
SNGAFLAPR

SEQ ID NO: 485315 - protein, 9 aa, Influenza virus
SNGALLAPR

SEQ ID NO: 485316 - protein, 9 aa, Influenza virus
SNGGFLAPR

SEQ ID NO: 485317 - protein, 9 aa, Influenza virus
SNGGLIAPR

SEQ ID NO: 485318 - protein, 9 aa, Influenza virus
SNGGLLAPK

SEQ ID NO: 485319 - protein, 9 aa, Influenza virus
SNGGLLAPR

SEQ ID NO: 485320 - protein, 9 aa, Influenza virus
SNGNCRFNV

SEQ ID NO: 485321 - protein, 9 aa, Influenza virus
SNGNFIAPE

SEQ ID NO: 485322 - protein, 9 aa, Influenza virus
SNGNFITPE

SEQ ID NO: 485323 - protein, 9 aa, Influenza virus
SNGNLIAPE

SEQ ID NO: 485324 - protein, 9 aa, Influenza virus
SNGNLIAPL

SEQ ID NO: 485325 - protein, 9 aa, Influenza virus
SNGNLIAPR

SEQ ID NO: 485326 - protein, 9 aa, Influenza virus
SNGNLIAPW

SEQ ID NO: 485327 - protein, 9 aa, Influenza virus
SNGNLVAPR

SEQ ID NO: 485328 - protein, 9 aa, Influenza virus
SNGNLVAPW

SEQ ID NO: 485329 - protein, 9 aa, Influenza virus
SNGQGSGYA

SEQ ID NO: 485330 - protein, 9 aa, Influenza virus
SNGSCRCTI

SEQ ID NO: 485331 - protein, 9 aa, Influenza virus
SNGSCRFNV

SEQ ID NO: 485332 - protein, 9 aa, Influenza virus
SNGSLHGRI

SEQ ID NO: 485333 - protein, 9 aa, Influenza virus
SNGSLQCKI

SEQ ID NO: 485334 - protein, 9 aa, Influenza virus
SNGSLQCRI

SEQ ID NO: 485335 - protein, 9 aa, Influenza virus
SNGSLQCRV

SEQ ID NO: 485336 - protein, 9 aa, Influenza virus
SNGSLQCTI

SEQ ID NO: 485337 - protein, 9 aa, Influenza virus
SNGSLQFRI

SEQ ID NO: 485338 - protein, 9 aa, Influenza virus
SNGSLRCRI

SEQ ID NO: 485339 - protein, 9 aa, Influenza virus
SNGTAKDRS

SEQ ID NO: 485340 - protein, 9 aa, Influenza virus
SNGTIEDRT

SEQ ID NO: 485341 - protein, 9 aa, Influenza virus
SNGTIHDGT

SEQ ID NO: 485342 - protein, 9 aa, Influenza virus
SNGTIHDRA

SEQ ID NO: 485343 - protein, 9 aa, Influenza virus
SNGTIHDRI

SEQ ID NO: 485344 - protein, 9 aa, Influenza virus
SNGTIHDRN

SEQ ID NO: 485345 - protein, 9 aa, Influenza virus
SNGTIHDRS

SEQ ID NO: 485346 - protein, 9 aa, Influenza virus
SNGTIHDRT

SEQ ID NO: 485347 - protein, 9 aa, Influenza virus
SNGTIIKTL

SEQ ID NO: 485348 - protein, 9 aa, Influenza virus
SNGTIKDRS

SEQ ID NO: 485349 - protein, 9 aa, Influenza virus
SNGTIKDRT

SEQ ID NO: 485350 - protein, 9 aa, Influenza virus
SNGTIRDRT

SEQ ID NO: 485351 - protein, 9 aa, Influenza virus
SNGTIVKTL

SEQ ID NO: 485352 - protein, 9 aa, Influenza virus
SNGTKINTL

SEQ ID NO: 485353 - protein, 9 aa, Influenza virus
SNGTKVNTL

SEQ ID NO: 485354 - protein, 9 aa, Influenza virus
SNGTMKDRS

SEQ ID NO: 485355 - protein, 9 aa, Influenza virus
SNGTNKDRT

SEQ ID NO: 485356 - protein, 9 aa, Influenza virus
SNGTTHDRI

SEQ ID NO: 485357 - protein, 9 aa, Influenza virus
SNGTTHDRT

SEQ ID NO: 485358 - protein, 9 aa, Influenza virus
SNGTVKBRS

SEQ ID NO: 485359 - protein, 9 aa, Influenza virus
SNGTVKDRS

SEQ ID NO: 485360 - protein, 9 aa, Influenza virus
SNGTVKDRT

SEQ ID NO: 485361 - protein, 9 aa, Influenza virus
SNGTVKNRS

SEQ ID NO: 485362 - protein, 9 aa, Influenza virus
SNGTVNDRS

SEQ ID NO: 485363 - protein, 9 aa, Influenza virus
SNGVQDIID

SEQ ID NO: 485364 - protein, 9 aa, Influenza virus
SNGYKDVIL

SEQ ID NO: 485365 - protein, 9 aa, Influenza virus
SNIFNMERI

SEQ ID NO: 485366 - protein, 9 aa, Influenza virus
SNIGLNVSL

SEQ ID NO: 485367 - protein, 9 aa, Influenza virus
SNINIREWS

SEQ ID NO: 485368 - protein, 9 aa, Influenza virus
SNITVTSSV

SEQ ID NO: 485369 - protein, 9 aa, Influenza virus
SNKMARLGK

SEQ ID NO: 485370 - protein, 9 aa, Influenza virus
SNKMARLGR

SEQ ID NO: 485371 - protein, 9 aa, Influenza virus
SNKVARLGK

SEQ ID NO: 485372 - protein, 9 aa, Influenza virus
SNKVNSVIE

SEQ ID NO: 485373 - protein, 9 aa, Influenza virus
SNLDYQIGY

SEQ ID NO: 485374 - protein, 9 aa, Influenza virus
SNLEKRLEN

SEQ ID NO: 485375 - protein, 9 aa, Influenza virus
SNLERRLEN

SEQ ID NO: 485376 - protein, 9 aa, Influenza virus
SNLNDATYQ

SEQ ID NO: 485377 - protein, 9 aa, Influenza virus
SNLNDTTYQ

SEQ ID NO: 485378 - protein, 9 aa, Influenza virus
SNLPFQNIN

SEQ ID NO: 485379 - protein, 9 aa, Influenza virus
SNLPFQNVN

SEQ ID NO: 485380 - protein, 9 aa, Influenza virus
SNMDRAVKL

SEQ ID NO: 485381 - protein, 9 aa, Influenza virus
SNMGIYQIL

SEQ ID NO: 485382 - protein, 9 aa, Influenza virus
SNMGVYQIL

SEQ ID NO: 485383 - protein, 9 aa, Influenza virus
SNMSLNISL

SEQ ID NO: 485384 - protein, 9 aa, Influenza virus
SNNATDTVD

SEQ ID NO: 485385 - protein, 9 aa, Influenza virus
SNNDWSGYS

SEQ ID NO: 485386 - protein, 9 aa, Influenza virus
SNNRSGYSG

SEQ ID NO: 485387 - protein, 9 aa, Influenza virus
SNNSSDTVD

SEQ ID NO: 485388 - protein, 9 aa, Influenza virus
SNNSTDKID

SEQ ID NO: 485389 - protein, 9 aa, Influenza virus
SNNSTDKVD

SEQ ID NO: 485390 - protein, 9 aa, Influenza virus
SNNSTDKVN

SEQ ID NO: 485391 - protein, 9 aa, Influenza virus
SNNSTDTVD

SEQ ID NO: 485392 - protein, 9 aa, Influenza virus
SNNSTDTVN

SEQ ID NO: 485393 - protein, 9 aa, Influenza virus
SNNSTEKVD

SEQ ID NO: 485394 - protein, 9 aa, Influenza virus
SNNSTERVD

SEQ ID NO: 485395 - protein, 9 aa, Influenza virus
SNNSTNTVN

SEQ ID NO: 485396 - protein, 9 aa, Influenza virus
SNNTTNYYN

SEQ ID NO: 485397 - protein, 9 aa, Influenza virus
SNNTVKDRS

SEQ ID NO: 485398 - protein, 9 aa, Influenza virus
SNNWSGYSG

SEQ ID NO: 485399 - protein, 9 aa, Influenza virus
SNPGRVTVS

SEQ ID NO: 485400 - protein, 9 aa, Influenza virus
SNPITGSPC

SEQ ID NO: 485401 - protein, 9 aa, Influenza virus
SNPITGSPG

SEQ ID NO: 485402 - protein, 9 aa, Influenza virus
SNPITGSPS

SEQ ID NO: 485403 - protein, 9 aa, Influenza virus
SNPKCDLYL

SEQ ID NO: 485404 - protein, 9 aa, Influenza virus
SNQASYKIF

SEQ ID NO: 485405 - protein, 9 aa, Influenza virus
SNQDSFYRS

SEQ ID NO: 485406 - protein, 9 aa, Influenza virus
SNQGSFYRN

SEQ ID NO: 485407 - protein, 9 aa, Influenza virus
SNQGSFYRS

SEQ ID NO: 485408 - protein, 9 aa, Influenza virus
SNQKIITIG

SEQ ID NO: 485409 - protein, 9 aa, Influenza virus
SNRFQIQGV

SEQ ID NO: 485410 - protein, 9 aa, Influenza virus
SNRGSFYRS

SEQ ID NO: 485411 - protein, 9 aa, Influenza virus
SNRPIIDIN

SEQ ID NO: 485412 - protein, 9 aa, Influenza virus
SNRPIVDIN

SEQ ID NO: 485413 - protein, 9 aa, Influenza virus
SNRPVIDIN

SEQ ID NO: 485414 - protein, 9 aa, Influenza virus
SNRPVIDVN

SEQ ID NO: 485415 - protein, 9 aa, Influenza virus
SNRPVIQID

SEQ ID NO: 485416 - protein, 9 aa, Influenza virus
SNRPVIQIN

SEQ ID NO: 485417 - protein, 9 aa, Influenza virus
SNRPVIRID

SEQ ID NO: 485418 - protein, 9 aa, Influenza virus
SNRPVLDIS

SEQ ID NO: 485419 - protein, 9 aa, Influenza virus
SNRPVVDIN

SEQ ID NO: 485420 - protein, 9 aa, Influenza virus
SNRPVVDIR

SEQ ID NO: 485421 - protein, 9 aa, Influenza virus
SNRPWIRFN

SEQ ID NO: 485422 - protein, 9 aa, Influenza virus
SNRPWIRIN

SEQ ID NO: 485423 - protein, 9 aa, Influenza virus
SNRPWISFD

SEQ ID NO: 485424 - protein, 9 aa, Influenza virus
SNRPWISFN

SEQ ID NO: 485425 - protein, 9 aa, Influenza virus
SNRPWLSFN

SEQ ID NO: 485426 - protein, 9 aa, Influenza virus
SNRPWMRIN

SEQ ID NO: 485427 - protein, 9 aa, Influenza virus
SNRPWMRIS

SEQ ID NO: 485428 - protein, 9 aa, Influenza virus
SNRPWVRIN

SEQ ID NO: 485429 - protein, 9 aa, Influenza virus
SNRPWVRMN

SEQ ID NO: 485430 - protein, 9 aa, Influenza virus
SNRPWVSFD

SEQ ID NO: 485431 - protein, 9 aa, Influenza virus
SNRPWVSFN

SEQ ID NO: 485432 - protein, 9 aa, Influenza virus
SNRSGYSGS

SEQ ID NO: 485433 - protein, 9 aa, Influenza virus
SNSDFICVG

SEQ ID NO: 485434 - protein, 9 aa, Influenza virus
SNSDFLCVG

SEQ ID NO: 485435 - protein, 9 aa, Influenza virus
SNSDFMCVG

SEQ ID NO: 485436 - protein, 9 aa, Influenza virus
SNSDWSGYS

SEQ ID NO: 485437 - protein, 9 aa, Influenza virus
SNSEFICVG

SEQ ID NO: 485438 - protein, 9 aa, Influenza virus
SNSEFLCVG

SEQ ID NO: 485439 - protein, 9 aa, Influenza virus
SNSEGTGMA

SEQ ID NO: 485440 - protein, 9 aa, Influenza virus
SNSIAVFCG

SEQ ID NO: 485441 - protein, 9 aa, Influenza virus
SNSIIAFCG

SEQ ID NO: 485442 - protein, 9 aa, Influenza virus
SNSIIVFCG

SEQ ID NO: 485443 - protein, 9 aa, Influenza virus
SNSIVAFCG

SEQ ID NO: 485444 - protein, 9 aa, Influenza virus
SNSIVALCG

SEQ ID NO: 485445 - protein, 9 aa, Influenza virus
SNSIVSMCS

SEQ ID NO: 485446 - protein, 9 aa, Influenza virus
SNSIVTFCG

SEQ ID NO: 485447 - protein, 9 aa, Influenza virus
SNSIVVFCG

SEQ ID NO: 485448 - protein, 9 aa, Influenza virus
SNSLIALCG

SEQ ID NO: 485449 - protein, 9 aa, Influenza virus
SNSLKLAIG

SEQ ID NO: 485450 - protein, 9 aa, Influenza virus
SNSLVALCG

SEQ ID NO: 485451 - protein, 9 aa, Influenza virus
SNSMVTFCG

SEQ ID NO: 485452 - protein, 9 aa, Influenza virus
SNSNCKDPN

SEQ ID NO: 485453 - protein, 9 aa, Influenza virus
SNSNCRDPN

SEQ ID NO: 485454 - protein, 9 aa, Influenza virus
SNSNCRNPN

SEQ ID NO: 485455 - protein, 9 aa, Influenza virus
SNSRFESVA

SEQ ID NO: 485456 - protein, 9 aa, Influenza virus
SNSTTHDRT

SEQ ID NO: 485457 - protein, 9 aa, Influenza virus
SNTWLGRTI

SEQ ID NO: 485458 - protein, 9 aa, Influenza virus
SNVENLFDE

SEQ ID NO: 485459 - protein, 9 aa, Influenza virus
SNVGLKVSL

SEQ ID NO: 485460 - protein, 9 aa, Influenza virus
SNVGLNMSL

SEQ ID NO: 485461 - protein, 9 aa, Influenza virus
SNVGLNVSL

SEQ ID NO: 485462 - protein, 9 aa, Influenza virus
SNVKNLFDE

SEQ ID NO: 485463 - protein, 9 aa, Influenza virus
SNVKNLHEK

SEQ ID NO: 485464 - protein, 9 aa, Influenza virus
SNVKNLYDK

SEQ ID NO: 485465 - protein, 9 aa, Influenza virus
SNVKNLYDR

SEQ ID NO: 485466 - protein, 9 aa, Influenza virus
SNVKNLYEK

SEQ ID NO: 485467 - protein, 9 aa, Influenza virus
SNVKNLYNK

SEQ ID NO: 485468 - protein, 9 aa, Influenza virus
SNVRNLHEK

SEQ ID NO: 485469 - protein, 9 aa, Influenza virus
SNVRNLHER

SEQ ID NO: 485470 - protein, 9 aa, Influenza virus
SNVRNLYDK

SEQ ID NO: 485471 - protein, 9 aa, Influenza virus
SNVRSLHEK

SEQ ID NO: 485472 - protein, 9 aa, Influenza virus
SNVTVTSSI

SEQ ID NO: 485473 - protein, 9 aa, Influenza virus
SNVTVTSSV

SEQ ID NO: 485474 - protein, 9 aa, Influenza virus
SNVVLNVSL

SEQ ID NO: 485475 - protein, 9 aa, Influenza virus
SNWSGYSGI

SEQ ID NO: 485476 - protein, 9 aa, Influenza virus
SNWSGYSGS

SEQ ID NO: 485477 - protein, 9 aa, Influenza virus
SNYHQSFVP

SEQ ID NO: 485478 - protein, 9 aa, Influenza virus
SNYQQSFVP

SEQ ID NO: 485479 - protein, 9 aa, Influenza virus
SNYVCSGLV

SEQ ID NO: 485480 - protein, 9 aa, Influenza virus
SPCLTDKGS

SEQ ID NO: 485481 - protein, 9 aa, Influenza virus
SPDPGVKGF

SEQ ID NO: 485482 - protein, 9 aa, Influenza virus
SPEEVSEAQ

SEQ ID NO: 485483 - protein, 9 aa, Influenza virus
SPEEVSETQ

SEQ ID NO: 485484 - protein, 9 aa, Influenza virus
SPFPVGSGS

SEQ ID NO: 485485 - protein, 9 aa, Influenza virus
SPFRALISW

SEQ ID NO: 485486 - protein, 9 aa, Influenza virus
SPFRALVSW

SEQ ID NO: 485487 - protein, 9 aa, Influenza virus
SPFRTLMSC

SEQ ID NO: 485488 - protein, 9 aa, Influenza virus
SPFRTLMSV

SEQ ID NO: 485489 - protein, 9 aa, Influenza virus
SPGAPGVKG

SEQ ID NO: 485490 - protein, 9 aa, Influenza virus
SPGARPKVN

SEQ ID NO: 485491 - protein, 9 aa, Influenza virus
SPGCDRLQD

SEQ ID NO: 485492 - protein, 9 aa, Influenza virus
SPGDRPKVN

SEQ ID NO: 485493 - protein, 9 aa, Influenza virus
SPGMMMGMF

SEQ ID NO: 485494 - protein, 9 aa, Influenza virus
SPGNAEIED

SEQ ID NO: 485495 - protein, 9 aa, Influenza virus
SPGRVTVST

SEQ ID NO: 485496 - protein, 9 aa, Influenza virus
SPGVKGFGF

SEQ ID NO: 485497 - protein, 9 aa, Influenza virus
SPGVKGWAF

SEQ ID NO: 485498 - protein, 9 aa, Influenza virus
SPHRALMSC

SEQ ID NO: 485499 - protein, 9 aa, Influenza virus
SPHRSLMSC

SEQ ID NO: 485500 - protein, 9 aa, Influenza virus
SPHRTLLMN

SEQ ID NO: 485501 - protein, 9 aa, Influenza virus
SPHRTLMSC

SEQ ID NO: 485502 - protein, 9 aa, Influenza virus
SPIHLGDCS

SEQ ID NO: 485503 - protein, 9 aa, Influenza virus
SPINNGKGR

SEQ ID NO: 485504 - protein, 9 aa, Influenza virus
SPISVGSGS

SEQ ID NO: 485505 - protein, 9 aa, Influenza virus
SPIVPSFDM

SEQ ID NO: 485506 - protein, 9 aa, Influenza virus
SPKLRSGFE

SEQ ID NO: 485507 - protein, 9 aa, Influenza virus
SPLAGSAQH

SEQ ID NO: 485508 - protein, 9 aa, Influenza virus
SPLAVTWWN

SEQ ID NO: 485509 - protein, 9 aa, Influenza virus
SPLELRDCK

SEQ ID NO: 485510 - protein, 9 aa, Influenza virus
SPLGAINTT

SEQ ID NO: 485511 - protein, 9 aa, Influenza virus
SPLKLIDGQ

SEQ ID NO: 485512 - protein, 9 aa, Influenza virus
SPLKLVDGQ

SEQ ID NO: 485513 - protein, 9 aa, Influenza virus
SPLMVAYML

SEQ ID NO: 485514 - protein, 9 aa, Influenza virus
SPLPFQNID

SEQ ID NO: 485515 - protein, 9 aa, Influenza virus
SPLPFQNIN

SEQ ID NO: 485516 - protein, 9 aa, Influenza virus
SPLRLIDGQ

SEQ ID NO: 485517 - protein, 9 aa, Influenza virus
SPLRLVDGQ

SEQ ID NO: 485518 - protein, 9 aa, Influenza virus
SPLSGNAQH

SEQ ID NO: 485519 - protein, 9 aa, Influenza virus
SPLSGSAQH

SEQ ID NO: 485520 - protein, 9 aa, Influenza virus
SPLSRCRET

SEQ ID NO: 485521 - protein, 9 aa, Influenza virus
SPLSRCRKT

SEQ ID NO: 485522 - protein, 9 aa, Influenza virus
SPLTGSAQH

SEQ ID NO: 485523 - protein, 9 aa, Influenza virus
SPLTKGILG

SEQ ID NO: 485524 - protein, 9 aa, Influenza virus
SPLTKGMLG

SEQ ID NO: 485525 - protein, 9 aa, Influenza virus
SPLVLDDCS

SEQ ID NO: 485526 - protein, 9 aa, Influenza virus
SPMMWEING

SEQ ID NO: 485527 - protein, 9 aa, Influenza virus
SPNAYQAKF

SEQ ID NO: 485528 - protein, 9 aa, Influenza virus
SPNAYQAQF

SEQ ID NO: 485529 - protein, 9 aa, Influenza virus
SPNAYQARF

SEQ ID NO: 485530 - protein, 9 aa, Influenza virus
SPNVYQAKF

SEQ ID NO: 485531 - protein, 9 aa, Influenza virus
SPNVYQARF

SEQ ID NO: 485532 - protein, 9 aa, Influenza virus
SPNVYQSRF

SEQ ID NO: 485533 - protein, 9 aa, Influenza virus
SPPIVSNSD

SEQ ID NO: 485534 - protein, 9 aa, Influenza virus
SPPIVSNSE

SEQ ID NO: 485535 - protein, 9 aa, Influenza virus
SPPMVSNSD

SEQ ID NO: 485536 - protein, 9 aa, Influenza virus
SPPTVYNNR

SEQ ID NO: 485537 - protein, 9 aa, Influenza virus
SPPTVYNSK

SEQ ID NO: 485538 - protein, 9 aa, Influenza virus
SPPTVYNSR

SEQ ID NO: 485539 - protein, 9 aa, Influenza virus
SPPTVYNTR

SEQ ID NO: 485540 - protein, 9 aa, Influenza virus
SPPTVYSSR

SEQ ID NO: 485541 - protein, 9 aa, Influenza virus
SPPVVSNSD

SEQ ID NO: 485542 - protein, 9 aa, Influenza virus
SPQLEGFSA

SEQ ID NO: 485543 - protein, 9 aa, Influenza virus
SPQRTLMSC

SEQ ID NO: 485544 - protein, 9 aa, Influenza virus
SPRLRSGFE

SEQ ID NO: 485545 - protein, 9 aa, Influenza virus
SPRMFLAMI

SEQ ID NO: 485546 - protein, 9 aa, Influenza virus
SPRSRNGFE

SEQ ID NO: 485547 - protein, 9 aa, Influenza virus
SPRSRSGFE

SEQ ID NO: 485548 - protein, 9 aa, Influenza virus
SPRTVGQCP

SEQ ID NO: 485549 - protein, 9 aa, Influenza virus
SPSAPGVKG

SEQ ID NO: 485550 - protein, 9 aa, Influenza virus
SPSECRTFF

SEQ ID NO: 485551 - protein, 9 aa, Influenza virus
SPSNSRFES

SEQ ID NO: 485552 - protein, 9 aa, Influenza virus
SPSPGARPK

SEQ ID NO: 485553 - protein, 9 aa, Influenza virus
SPSPGDRPK

SEQ ID NO: 485554 - protein, 9 aa, Influenza virus
SPVHLGDCN

SEQ ID NO: 485555 - protein, 9 aa, Influenza virus
SPVHLGDCR

SEQ ID NO: 485556 - protein, 9 aa, Influenza virus
SPVHLGDCS

SEQ ID NO: 485557 - protein, 9 aa, Influenza virus
SPVLTDNPR

SEQ ID NO: 485558 - protein, 9 aa, Influenza virus
SPVNNGKGR

SEQ ID NO: 485559 - protein, 9 aa, Influenza virus
SPVPVGSGS

SEQ ID NO: 485560 - protein, 9 aa, Influenza virus
SPVSVGSGS

SEQ ID NO: 485561 - protein, 9 aa, Influenza virus
SPYNSKFES

SEQ ID NO: 485562 - protein, 9 aa, Influenza virus
SPYNSRFES

SEQ ID NO: 485563 - protein, 9 aa, Influenza virus
SPYRALISW

SEQ ID NO: 485564 - protein, 9 aa, Influenza virus
SPYRALMSC

SEQ ID NO: 485565 - protein, 9 aa, Influenza virus
SPYRALMSV

SEQ ID NO: 485566 - protein, 9 aa, Influenza virus
SPYRTLMSC

SEQ ID NO: 485567 - protein, 9 aa, Influenza virus
SPYRTLMSV

SEQ ID NO: 485568 - protein, 9 aa, Influenza virus
SQASYKIFK

SEQ ID NO: 485569 - protein, 9 aa, Influenza virus
SQDTEISFT

SEQ ID NO: 485570 - protein, 9 aa, Influenza virus
SQDTELSFT

SEQ ID NO: 485571 - protein, 9 aa, Influenza virus
SQEDCMIKA

SEQ ID NO: 485572 - protein, 9 aa, Influenza virus
SQEDCMMKA

SEQ ID NO: 485573 - protein, 9 aa, Influenza virus
SQEDCMVKA

SEQ ID NO: 485574 - protein, 9 aa, Influenza virus
SQEDRMIKA

SEQ ID NO: 485575 - protein, 9 aa, Influenza virus
SQEECMIKA

SEQ ID NO: 485576 - protein, 9 aa, Influenza virus
SQETRVWWT

SEQ ID NO: 485577 - protein, 9 aa, Influenza virus
SQFRALISW

SEQ ID NO: 485578 - protein, 9 aa, Influenza virus
SQGEGTAAD

SEQ ID NO: 485579 - protein, 9 aa, Influenza virus
SQGSGYAAD

SEQ ID NO: 485580 - protein, 9 aa, Influenza virus
SQGTKRPYE

SEQ ID NO: 485581 - protein, 9 aa, Influenza virus
SQGTKRSHE

SEQ ID NO: 485582 - protein, 9 aa, Influenza virus
SQGTKRSYE

SEQ ID NO: 485583 - protein, 9 aa, Influenza virus
SQGTTIRGK

SEQ ID NO: 485584 - protein, 9 aa, Influenza virus
SQGTTIRGR

SEQ ID NO: 485585 - protein, 9 aa, Influenza virus
SQGTTLKGR

SEQ ID NO: 485586 - protein, 9 aa, Influenza virus
SQGTTLRGQ

SEQ ID NO: 485587 - protein, 9 aa, Influenza virus
SQGTTLRGR

SEQ ID NO: 485588 - protein, 9 aa, Influenza virus
SQGVKGWAF

SEQ ID NO: 485589 - protein, 9 aa, Influenza virus
SQHKSHRQM

SEQ ID NO: 485590 - protein, 9 aa, Influenza virus
SQHRSHRQM

SEQ ID NO: 485591 - protein, 9 aa, Influenza virus
SQITNGTTG

SEQ ID NO: 485592 - protein, 9 aa, Influenza virus
SQKILCTSA

SEQ ID NO: 485593 - protein, 9 aa, Influenza virus
SQKLFALSG

SEQ ID NO: 485594 - protein, 9 aa, Influenza virus
SQKQEFKMN

SEQ ID NO: 485595 - protein, 9 aa, Influenza virus
SQLEGFSAE

SEQ ID NO: 485596 - protein, 9 aa, Influenza virus
SQLIWMACH

SEQ ID NO: 485597 - protein, 9 aa, Influenza virus
SQLKDNAKD

SEQ ID NO: 485598 - protein, 9 aa, Influenza virus
SQLKDNAND

SEQ ID NO: 485599 - protein, 9 aa, Influenza virus
SQLKKQEIE

SEQ ID NO: 485600 - protein, 9 aa, Influenza virus
SQLKRQEIE

SEQ ID NO: 485601 - protein, 9 aa, Influenza virus
SQLRDNAKD

SEQ ID NO: 485602 - protein, 9 aa, Influenza virus
SQLRDNAND

SEQ ID NO: 485603 - protein, 9 aa, Influenza virus
SQLTEVETP

SEQ ID NO: 485604 - protein, 9 aa, Influenza virus
SQLVWMACH

SEQ ID NO: 485605 - protein, 9 aa, Influenza virus
SQLVWMACN

SEQ ID NO: 485606 - protein, 9 aa, Influenza virus
SQNILRTHE

SEQ ID NO: 485607 - protein, 9 aa, Influenza virus
SQNILRTQE

SEQ ID NO: 485608 - protein, 9 aa, Influenza virus
SQRGILEDE

SEQ ID NO: 485609 - protein, 9 aa, Influenza virus
SQRGVLEDE

SEQ ID NO: 485610 - protein, 9 aa, Influenza virus
SQRSKFLLM

SEQ ID NO: 485611 - protein, 9 aa, Influenza virus
SQSGRISFY

SEQ ID NO: 485612 - protein, 9 aa, Influenza virus
SQSRTREIL

SEQ ID NO: 485613 - protein, 9 aa, Influenza virus
SQSRTRGIL

SEQ ID NO: 485614 - protein, 9 aa, Influenza virus
SQTATKRIR

SEQ ID NO: 485615 - protein, 9 aa, Influenza virus
SQTATKRLR

SEQ ID NO: 485616 - protein, 9 aa, Influenza virus
SQTIINNYH

SEQ ID NO: 485617 - protein, 9 aa, Influenza virus
SQTIINNYY

SEQ ID NO: 485618 - protein, 9 aa, Influenza virus
SQTVINNYY

SEQ ID NO: 485619 - protein, 9 aa, Influenza virus
SQVEQRINM

SEQ ID NO: 485620 - protein, 9 aa, Influenza virus
SQVERRINM

SEQ ID NO: 485621 - protein, 9 aa, Influenza virus
SQYICSPVL

SEQ ID NO: 485622 - protein, 9 aa, Influenza virus
SQYLCTGIL

SEQ ID NO: 485623 - protein, 9 aa, Influenza virus
SQYLCTGVL

SEQ ID NO: 485624 - protein, 9 aa, Influenza virus
SQYRALISW

SEQ ID NO: 485625 - protein, 9 aa, Influenza virus
SQYRALVSW

SEQ ID NO: 485626 - protein, 9 aa, Influenza virus
SQYREEALL

SEQ ID NO: 485627 - protein, 9 aa, Influenza virus
SQYRSLISW

SEQ ID NO: 485628 - protein, 9 aa, Influenza virus
SRACNNTSN

SEQ ID NO: 485629 - protein, 9 aa, Influenza virus
SRADKICIG

SEQ ID NO: 485630 - protein, 9 aa, Influenza virus
SRAGDILRT

SEQ ID NO: 485631 - protein, 9 aa, Influenza virus
SRAGYEMLK

SEQ ID NO: 485632 - protein, 9 aa, Influenza virus
SRARIDARI

SEQ ID NO: 485633 - protein, 9 aa, Influenza virus
SRARIDARV

SEQ ID NO: 485634 - protein, 9 aa, Influenza virus
SRARIKTRL

SEQ ID NO: 485635 - protein, 9 aa, Influenza virus
SRAVGKCPR

SEQ ID NO: 485636 - protein, 9 aa, Influenza virus
SRCHTDKGS

SEQ ID NO: 485637 - protein, 9 aa, Influenza virus
SRCRETRGL

SEQ ID NO: 485638 - protein, 9 aa, Influenza virus
SRCRKTRGL

SEQ ID NO: 485639 - protein, 9 aa, Influenza virus
SRDSRSGYE

SEQ ID NO: 485640 - protein, 9 aa, Influenza virus
SRERLGSWS

SEQ ID NO: 485641 - protein, 9 aa, Influenza virus
SRFEAVAWS

SEQ ID NO: 485642 - protein, 9 aa, Influenza virus
SRFESVAWS

SEQ ID NO: 485643 - protein, 9 aa, Influenza virus
SRFQIQGVK

SEQ ID NO: 485644 - protein, 9 aa, Influenza virus
SRGEVFVIR

SEQ ID NO: 485645 - protein, 9 aa, Influenza virus
SRGHIFVIR

SEQ ID NO: 485646 - protein, 9 aa, Influenza virus
SRGHVFVIR

SEQ ID NO: 485647 - protein, 9 aa, Influenza virus
SRGLFGAIA

SEQ ID NO: 485648 - protein, 9 aa, Influenza virus
SRGLFGAKA

SEQ ID NO: 485649 - protein, 9 aa, Influenza virus
SRGYKMNIQ

SEQ ID NO: 485650 - protein, 9 aa, Influenza virus
SRGYKMNNQ

SEQ ID NO: 485651 - protein, 9 aa, Influenza virus
SRGYKMNTK

SEQ ID NO: 485652 - protein, 9 aa, Influenza virus
SRGYKMNTQ

SEQ ID NO: 485653 - protein, 9 aa, Influenza virus
SRGYKMNTR

SEQ ID NO: 485654 - protein, 9 aa, Influenza virus
SRHCSKYHW

SEQ ID NO: 485655 - protein, 9 aa, Influenza virus
SRHHMGECP

SEQ ID NO: 485656 - protein, 9 aa, Influenza virus
SRHYIGKCP

SEQ ID NO: 485657 - protein, 9 aa, Influenza virus
SRHYMGECP

SEQ ID NO: 485658 - protein, 9 aa, Influenza virus
SRIAIGNCP

SEQ ID NO: 485659 - protein, 9 aa, Influenza virus
SRILTDTSR

SEQ ID NO: 485660 - protein, 9 aa, Influenza virus
SRINGVKLE

SEQ ID NO: 485661 - protein, 9 aa, Influenza virus
SRINMINSK

SEQ ID NO: 485662 - protein, 9 aa, Influenza virus
SRINMINSQ

SEQ ID NO: 485663 - protein, 9 aa, Influenza virus
SRINRQEIE

SEQ ID NO: 485664 - protein, 9 aa, Influenza virus
SRINTINSK

SEQ ID NO: 485665 - protein, 9 aa, Influenza virus
SRISFYWTI

SEQ ID NO: 485666 - protein, 9 aa, Influenza virus
SRKLLLIAQ

SEQ ID NO: 485667 - protein, 9 aa, Influenza virus
SRKLLLITQ

SEQ ID NO: 485668 - protein, 9 aa, Influenza virus
SRKLLLIVQ

SEQ ID NO: 485669 - protein, 9 aa, Influenza virus
SRKLLLVVQ

SEQ ID NO: 485670 - protein, 9 aa, Influenza virus
SRKMLLIVQ

SEQ ID NO: 485671 - protein, 9 aa, Influenza virus
SRLNRNEIK

SEQ ID NO: 485672 - protein, 9 aa, Influenza virus
SRLNRQEIE

SEQ ID NO: 485673 - protein, 9 aa, Influenza virus
SRLNWLTKA

SEQ ID NO: 485674 - protein, 9 aa, Influenza virus
SRLNWLTKE

SEQ ID NO: 485675 - protein, 9 aa, Influenza virus
SRMGVDEYS

SEQ ID NO: 485676 - protein, 9 aa, Influenza virus
SRMQFSSLA

SEQ ID NO: 485677 - protein, 9 aa, Influenza virus
SRMQFSSLT

SEQ ID NO: 485678 - protein, 9 aa, Influenza virus
SRMSICISG

SEQ ID NO: 485679 - protein, 9 aa, Influenza virus
SRMSICMSG

SEQ ID NO: 485680 - protein, 9 aa, Influenza virus
SRMSVCMSG

SEQ ID NO: 485681 - protein, 9 aa, Influenza virus
SRMTICVQG

SEQ ID NO: 485682 - protein, 9 aa, Influenza virus
SRNGFEMLK

SEQ ID NO: 485683 - protein, 9 aa, Influenza virus
SRNGKWREQ

SEQ ID NO: 485684 - protein, 9 aa, Influenza virus
SRNPGNAEI

SEQ ID NO: 485685 - protein, 9 aa, Influenza virus
SRPFQNASR

SEQ ID NO: 485686 - protein, 9 aa, Influenza virus
SRPRVRNQS

SEQ ID NO: 485687 - protein, 9 aa, Influenza virus
SRRYELEIG

SEQ ID NO: 485688 - protein, 9 aa, Influenza virus
SRSGFEIIW

SEQ ID NO: 485689 - protein, 9 aa, Influenza virus
SRSGFEILL

SEQ ID NO: 485690 - protein, 9 aa, Influenza virus
SRSGFEMIW

SEQ ID NO: 485691 - protein, 9 aa, Influenza virus
SRSGFEMLK

SEQ ID NO: 485692 - protein, 9 aa, Influenza virus
SRSGFEMLR

SEQ ID NO: 485693 - protein, 9 aa, Influenza virus
SRSGFEMVW

SEQ ID NO: 485694 - protein, 9 aa, Influenza virus
SRSGFEVLF

SEQ ID NO: 485695 - protein, 9 aa, Influenza virus
SRSGFEVLL

SEQ ID NO: 485696 - protein, 9 aa, Influenza virus
SRSGYEILK

SEQ ID NO: 485697 - protein, 9 aa, Influenza virus
SRSGYEMLK

SEQ ID NO: 485698 - protein, 9 aa, Influenza virus
SRSGYETFK

SEQ ID NO: 485699 - protein, 9 aa, Influenza virus
SRSGYETFR

SEQ ID NO: 485700 - protein, 9 aa, Influenza virus
SRSGYEVLK

SEQ ID NO: 485701 - protein, 9 aa, Influenza virus
SRSIIFNME

SEQ ID NO: 485702 - protein, 9 aa, Influenza virus
SRSLKLAIG

SEQ ID NO: 485703 - protein, 9 aa, Influenza virus
SRSNIFNME

SEQ ID NO: 485704 - protein, 9 aa, Influenza virus
SRSPGNAEI

SEQ ID NO: 485705 - protein, 9 aa, Influenza virus
SRSSCHDGK

SEQ ID NO: 485706 - protein, 9 aa, Influenza virus
SRSSFYAEM

SEQ ID NO: 485707 - protein, 9 aa, Influenza virus
SRTELINPN

SEQ ID NO: 485708 - protein, 9 aa, Influenza virus
SRTELINPS

SEQ ID NO: 485709 - protein, 9 aa, Influenza virus
SRTELIPPS

SEQ ID NO: 485710 - protein, 9 aa, Influenza virus
SRTELISPN

SEQ ID NO: 485711 - protein, 9 aa, Influenza virus
SRTELISPS

SEQ ID NO: 485712 - protein, 9 aa, Influenza virus
SRTHQYSEK

SEQ ID NO: 485713 - protein, 9 aa, Influenza virus
SRTREILTK

SEQ ID NO: 485714 - protein, 9 aa, Influenza virus
SRTREILTR

SEQ ID NO: 485715 - protein, 9 aa, Influenza virus
SRTRGILTK

SEQ ID NO: 485716 - protein, 9 aa, Influenza virus
SRVDNHSMS

SEQ ID NO: 485717 - protein, 9 aa, Influenza virus
SRVLTDTSR

SEQ ID NO: 485718 - protein, 9 aa, Influenza virus
SRYGYEMLK

SEQ ID NO: 485719 - protein, 9 aa, Influenza virus
SRYICSGLV

SEQ ID NO: 485720 - protein, 9 aa, Influenza virus
SRYSKADKI

SEQ ID NO: 485721 - protein, 9 aa, Influenza virus
SRYVCSGLV

SEQ ID NO: 485722 - protein, 9 aa, Influenza virus
SRYVCTGIL

SEQ ID NO: 485723 - protein, 9 aa, Influenza virus
SRYWAIRTR

SEQ ID NO: 485724 - protein, 9 aa, Influenza virus
SRYYMGECP

SEQ ID NO: 485725 - protein, 9 aa, Influenza virus
SSAASYKRI

SEQ ID NO: 485726 - protein, 9 aa, Influenza virus
SSAASYKRV

SEQ ID NO: 485727 - protein, 9 aa, Influenza virus
SSACLRGGR

SEQ ID NO: 485728 - protein, 9 aa, Influenza virus
SSAQEKNDL

SEQ ID NO: 485729 - protein, 9 aa, Influenza virus
SSASCHDGR

SEQ ID NO: 485730 - protein, 9 aa, Influenza virus
SSCAAMDDF

SEQ ID NO: 485731 - protein, 9 aa, Influenza virus
SSCFDGKEW

SEQ ID NO: 485732 - protein, 9 aa, Influenza virus
SSCFDGREW

SEQ ID NO: 485733 - protein, 9 aa, Influenza virus
SSCHDGKAW

SEQ ID NO: 485734 - protein, 9 aa, Influenza virus
SSCHDGKSW

SEQ ID NO: 485735 - protein, 9 aa, Influenza virus
SSCHDGNAW

SEQ ID NO: 485736 - protein, 9 aa, Influenza virus
SSCHDGRAW

SEQ ID NO: 485737 - protein, 9 aa, Influenza virus
SSCYDGKAW

SEQ ID NO: 485738 - protein, 9 aa, Influenza virus
SSDDFALIL

SEQ ID NO: 485739 - protein, 9 aa, Influenza virus
SSDDFALIV

SEQ ID NO: 485740 - protein, 9 aa, Influenza virus
SSDICYPGK

SEQ ID NO: 485741 - protein, 9 aa, Influenza virus
SSDICYPGR

SEQ ID NO: 485742 - protein, 9 aa, Influenza virus
SSDKVDTLL

SEQ ID NO: 485743 - protein, 9 aa, Influenza virus
SSDNEQTDL

SEQ ID NO: 485744 - protein, 9 aa, Influenza virus
SSDTVDTLT

SEQ ID NO: 485745 - protein, 9 aa, Influenza virus
SSEAPGWSW

SEQ ID NO: 485746 - protein, 9 aa, Influenza virus
SSEKVDTLL

SEQ ID NO: 485747 - protein, 9 aa, Influenza virus
SSEKVNTLL

SEQ ID NO: 485748 - protein, 9 aa, Influenza virus
SSEQAAEAI

SEQ ID NO: 485749 - protein, 9 aa, Influenza virus
SSEQAAEAM

SEQ ID NO: 485750 - protein, 9 aa, Influenza virus
SSERVDTLL

SEQ ID NO: 485751 - protein, 9 aa, Influenza virus
SSEVPEWSW

SEQ ID NO: 485752 - protein, 9 aa, Influenza virus
SSEVPGWSW

SEQ ID NO: 485753 - protein, 9 aa, Influenza virus
SSFEKFEIF

SEQ ID NO: 485754 - protein, 9 aa, Influenza virus
SSFEQITFM

SEQ ID NO: 485755 - protein, 9 aa, Influenza virus
SSFERFEIF

SEQ ID NO: 485756 - protein, 9 aa, Influenza virus
SSFERFEMF

SEQ ID NO: 485757 - protein, 9 aa, Influenza virus
SSFFRNIVW

SEQ ID NO: 485758 - protein, 9 aa, Influenza virus
SSFFRNMVW

SEQ ID NO: 485759 - protein, 9 aa, Influenza virus
SSFFRNVVW

SEQ ID NO: 485760 - protein, 9 aa, Influenza virus
SSFQVDCFI

SEQ ID NO: 485761 - protein, 9 aa, Influenza virus
SSFQVDCFL

SEQ ID NO: 485762 - protein, 9 aa, Influenza virus
SSFSFGGFT

SEQ ID NO: 485763 - protein, 9 aa, Influenza virus
SSFYAEMEW

SEQ ID NO: 485764 - protein, 9 aa, Influenza virus
SSFYAEMKW

SEQ ID NO: 485765 - protein, 9 aa, Influenza virus
SSFYRNLIW

SEQ ID NO: 485766 - protein, 9 aa, Influenza virus
SSFYRNLLW

SEQ ID NO: 485767 - protein, 9 aa, Influenza virus
SSFYRNLVW

SEQ ID NO: 485768 - protein, 9 aa, Influenza virus
SSFYRNVVW

SEQ ID NO: 485769 - protein, 9 aa, Influenza virus
SSFYSEMKW

SEQ ID NO: 485770 - protein, 9 aa, Influenza virus
SSGGLLAPR

SEQ ID NO: 485771 - protein, 9 aa, Influenza virus
SSGIAIALG

SEQ ID NO: 485772 - protein, 9 aa, Influenza virus
SSGIAIVLG

SEQ ID NO: 485773 - protein, 9 aa, Influenza virus
SSGNCRFNV

SEQ ID NO: 485774 - protein, 9 aa, Influenza virus
SSGNCRFSV

SEQ ID NO: 485775 - protein, 9 aa, Influenza virus
SSGNNQVFP

SEQ ID NO: 485776 - protein, 9 aa, Influenza virus
SSGSLEFIA

SEQ ID NO: 485777 - protein, 9 aa, Influenza virus
SSGSLKLAI

SEQ ID NO: 485778 - protein, 9 aa, Influenza virus
SSGTSKACN

SEQ ID NO: 485779 - protein, 9 aa, Influenza virus
SSGTSKACS

SEQ ID NO: 485780 - protein, 9 aa, Influenza virus
SSGTVKDRS

SEQ ID NO: 485781 - protein, 9 aa, Influenza virus
SSGYKDIIL

SEQ ID NO: 485782 - protein, 9 aa, Influenza virus
SSGYKDVII

SEQ ID NO: 485783 - protein, 9 aa, Influenza virus
SSGYKDVIL

SEQ ID NO: 485784 - protein, 9 aa, Influenza virus
SSGYKEVIL

SEQ ID NO: 485785 - protein, 9 aa, Influenza virus
SSIAFCGVD

SEQ ID NO: 485786 - protein, 9 aa, Influenza virus
SSIAFCGVN

SEQ ID NO: 485787 - protein, 9 aa, Influenza virus
SSIDLVETN

SEQ ID NO: 485788 - protein, 9 aa, Influenza virus
SSIGKVCRT

SEQ ID NO: 485789 - protein, 9 aa, Influenza virus
SSIKEKDMT

SEQ ID NO: 485790 - protein, 9 aa, Influenza virus
SSIKKYERV

SEQ ID NO: 485791 - protein, 9 aa, Influenza virus
SSIKRYERV

SEQ ID NO: 485792 - protein, 9 aa, Influenza virus
SSILTDSQT

SEQ ID NO: 485793 - protein, 9 aa, Influenza virus
SSISFCGVD

SEQ ID NO: 485794 - protein, 9 aa, Influenza virus
SSISFCGVN

SEQ ID NO: 485795 - protein, 9 aa, Influenza virus
SSISFCGVS

SEQ ID NO: 485796 - protein, 9 aa, Influenza virus
SSIVLVGLI

SEQ ID NO: 485797 - protein, 9 aa, Influenza virus
SSIVMCGVD

SEQ ID NO: 485798 - protein, 9 aa, Influenza virus
SSIVMCGVN

SEQ ID NO: 485799 - protein, 9 aa, Influenza virus
SSIVMVGLI

SEQ ID NO: 485800 - protein, 9 aa, Influenza virus
SSIYIEVLH

SEQ ID NO: 485801 - protein, 9 aa, Influenza virus
SSIYQNSFV

SEQ ID NO: 485802 - protein, 9 aa, Influenza virus
SSKANQVFP

SEQ ID NO: 485803 - protein, 9 aa, Influenza virus
SSKCQQSFT

SEQ ID NO: 485804 - protein, 9 aa, Influenza virus
SSKDNQVFP

SEQ ID NO: 485805 - protein, 9 aa, Influenza virus
SSKPFHNIH

SEQ ID NO: 485806 - protein, 9 aa, Influenza virus
SSKPFQNAS

SEQ ID NO: 485807 - protein, 9 aa, Influenza virus
SSKPFQNTS

SEQ ID NO: 485808 - protein, 9 aa, Influenza virus
SSKPLQNAS

SEQ ID NO: 485809 - protein, 9 aa, Influenza virus
SSKYQQSFS

SEQ ID NO: 485810 - protein, 9 aa, Influenza virus
SSKYQQSFT

SEQ ID NO: 485811 - protein, 9 aa, Influenza virus
SSKYRQSFS

SEQ ID NO: 485812 - protein, 9 aa, Influenza virus
SSLAVNVRG

SEQ ID NO: 485813 - protein, 9 aa, Influenza virus
SSLDEQNKL

SEQ ID NO: 485814 - protein, 9 aa, Influenza virus
SSLILAAII

SEQ ID NO: 485815 - protein, 9 aa, Influenza virus
SSLILAALI

SEQ ID NO: 485816 - protein, 9 aa, Influenza virus
SSLLLQANL

SEQ ID NO: 485817 - protein, 9 aa, Influenza virus
SSLMWEING

SEQ ID NO: 485818 - protein, 9 aa, Influenza virus
SSLPFHNVH

SEQ ID NO: 485819 - protein, 9 aa, Influenza virus
SSLPFQNIN

SEQ ID NO: 485820 - protein, 9 aa, Influenza virus
SSLPFQNIS

SEQ ID NO: 485821 - protein, 9 aa, Influenza virus
SSLPLALGM

SEQ ID NO: 485822 - protein, 9 aa, Influenza virus
SSLSGSAQH

SEQ ID NO: 485823 - protein, 9 aa, Influenza virus
SSLTHALRE

SEQ ID NO: 485824 - protein, 9 aa, Influenza virus
SSLTVNVRG

SEQ ID NO: 485825 - protein, 9 aa, Influenza virus
SSLTVSVRG

SEQ ID NO: 485826 - protein, 9 aa, Influenza virus
SSLVLAAII

SEQ ID NO: 485827 - protein, 9 aa, Influenza virus
SSLVLAALI

SEQ ID NO: 485828 - protein, 9 aa, Influenza virus
SSLVLAALN

SEQ ID NO: 485829 - protein, 9 aa, Influenza virus
SSLVLIVSL

SEQ ID NO: 485830 - protein, 9 aa, Influenza virus
SSLVLLFMI

SEQ ID NO: 485831 - protein, 9 aa, Influenza virus
SSLVLLLMI

SEQ ID NO: 485832 - protein, 9 aa, Influenza virus
SSLVLLVSL

SEQ ID NO: 485833 - protein, 9 aa, Influenza virus
SSLVLMGLI

SEQ ID NO: 485834 - protein, 9 aa, Influenza virus
SSLVLVGLI

SEQ ID NO: 485835 - protein, 9 aa, Influenza virus
SSLVLVGLV

SEQ ID NO: 485836 - protein, 9 aa, Influenza virus
SSLVLVVSL

SEQ ID NO: 485837 - protein, 9 aa, Influenza virus
SSMGEAMVS

SEQ ID NO: 485838 - protein, 9 aa, Influenza virus
SSMGIYQIL

SEQ ID NO: 485839 - protein, 9 aa, Influenza virus
SSMGVYQIL

SEQ ID NO: 485840 - protein, 9 aa, Influenza virus
SSMMEAMVS

SEQ ID NO: 485841 - protein, 9 aa, Influenza virus
SSMMWEING

SEQ ID NO: 485842 - protein, 9 aa, Influenza virus
SSMMWEVNG

SEQ ID NO: 485843 - protein, 9 aa, Influenza virus
SSMNNQVFP

SEQ ID NO: 485844 - protein, 9 aa, Influenza virus
SSMPFHNIH

SEQ ID NO: 485845 - protein, 9 aa, Influenza virus
SSMPFHNVH

SEQ ID NO: 485846 - protein, 9 aa, Influenza virus
SSMPLHNIH

SEQ ID NO: 485847 - protein, 9 aa, Influenza virus
SSMQCRICI

SEQ ID NO: 485848 - protein, 9 aa, Influenza virus
SSMVEAMIS

SEQ ID NO: 485849 - protein, 9 aa, Influenza virus
SSMVEAMMS

SEQ ID NO: 485850 - protein, 9 aa, Influenza virus
SSMVEAMVS

SEQ ID NO: 485851 - protein, 9 aa, Influenza virus
SSNCKDPNN

SEQ ID NO: 485852 - protein, 9 aa, Influenza virus
SSNCRDPNN

SEQ ID NO: 485853 - protein, 9 aa, Influenza virus
SSNCRDSNN

SEQ ID NO: 485854 - protein, 9 aa, Influenza virus
SSNCRNPNN

SEQ ID NO: 485855 - protein, 9 aa, Influenza virus
SSNYHQSFV

SEQ ID NO: 485856 - protein, 9 aa, Influenza virus
SSNYQQSFV

SEQ ID NO: 485857 - protein, 9 aa, Influenza virus
SSPMMWEIN

SEQ ID NO: 485858 - protein, 9 aa, Influenza virus
SSPNAYQAK

SEQ ID NO: 485859 - protein, 9 aa, Influenza virus
SSPNAYQAR

SEQ ID NO: 485860 - protein, 9 aa, Influenza virus
SSPPTVYNN

SEQ ID NO: 485861 - protein, 9 aa, Influenza virus
SSPPTVYNS

SEQ ID NO: 485862 - protein, 9 aa, Influenza virus
SSPPTVYNT

SEQ ID NO: 485863 - protein, 9 aa, Influenza virus
SSQDTELSF

SEQ ID NO: 485864 - protein, 9 aa, Influenza virus
SSQLEGFSA

SEQ ID NO: 485865 - protein, 9 aa, Influenza virus
SSRHCSKYH

SEQ ID NO: 485866 - protein, 9 aa, Influenza virus
SSRISFYWT

SEQ ID NO: 485867 - protein, 9 aa, Influenza virus
SSRNGFEIL

SEQ ID NO: 485868 - protein, 9 aa, Influenza virus
SSRPFQNAS

SEQ ID NO: 485869 - protein, 9 aa, Influenza virus
SSRSGFEIL

SEQ ID NO: 485870 - protein, 9 aa, Influenza virus
SSRSGFEVL

SEQ ID NO: 485871 - protein, 9 aa, Influenza virus
SSSACLRGG

SEQ ID NO: 485872 - protein, 9 aa, Influenza virus
SSSCFDGKE

SEQ ID NO: 485873 - protein, 9 aa, Influenza virus
SSSCFDGRE

SEQ ID NO: 485874 - protein, 9 aa, Influenza virus
SSSCHDGKA

SEQ ID NO: 485875 - protein, 9 aa, Influenza virus
SSSCHDGKS

SEQ ID NO: 485876 - protein, 9 aa, Influenza virus
SSSCHDGNA

SEQ ID NO: 485877 - protein, 9 aa, Influenza virus
SSSCHDGRA

SEQ ID NO: 485878 - protein, 9 aa, Influenza virus
SSSCYDGKA

SEQ ID NO: 485879 - protein, 9 aa, Influenza virus
SSSFSFGGF

SEQ ID NO: 485880 - protein, 9 aa, Influenza virus
SSSFYAEMK

SEQ ID NO: 485881 - protein, 9 aa, Influenza virus
SSSGNNQVF

SEQ ID NO: 485882 - protein, 9 aa, Influenza virus
SSSGTSKAC

SEQ ID NO: 485883 - protein, 9 aa, Influenza virus
SSSIVMCGV

SEQ ID NO: 485884 - protein, 9 aa, Influenza virus
SSSIVVFCG

SEQ ID NO: 485885 - protein, 9 aa, Influenza virus
SSSLDEQNK

SEQ ID NO: 485886 - protein, 9 aa, Influenza virus
SSSLMWEIN

SEQ ID NO: 485887 - protein, 9 aa, Influenza virus
SSSLVLAGL

SEQ ID NO: 485888 - protein, 9 aa, Influenza virus
SSSLVLMGL

SEQ ID NO: 485889 - protein, 9 aa, Influenza virus
SSSLVLVGL

SEQ ID NO: 485890 - protein, 9 aa, Influenza virus
SSSMMWEIN

SEQ ID NO: 485891 - protein, 9 aa, Influenza virus
SSSMMWEVN

SEQ ID NO: 485892 - protein, 9 aa, Influenza virus
SSSMNNQVF

SEQ ID NO: 485893 - protein, 9 aa, Influenza virus
SSSNAYQAK

SEQ ID NO: 485894 - protein, 9 aa, Influenza virus
SSSNCKDPN

SEQ ID NO: 485895 - protein, 9 aa, Influenza virus
SSSNCRDPN

SEQ ID NO: 485896 - protein, 9 aa, Influenza virus
SSSNCRDSN

SEQ ID NO: 485897 - protein, 9 aa, Influenza virus
SSSNCRNPN

SEQ ID NO: 485898 - protein, 9 aa, Influenza virus
SSSSCFDGK

SEQ ID NO: 485899 - protein, 9 aa, Influenza virus
SSSSCFDGR

SEQ ID NO: 485900 - protein, 9 aa, Influenza virus
SSSSCHDGK

SEQ ID NO: 485901 - protein, 9 aa, Influenza virus
SSSSCHDGN

SEQ ID NO: 485902 - protein, 9 aa, Influenza virus
SSSSCHDGR

SEQ ID NO: 485903 - protein, 9 aa, Influenza virus
SSSSCYDGK

SEQ ID NO: 485904 - protein, 9 aa, Influenza virus
SSSSFYAEM

SEQ ID NO: 485905 - protein, 9 aa, Influenza virus
SSSSIVMCG

SEQ ID NO: 485906 - protein, 9 aa, Influenza virus
SSSSTVFCG

SEQ ID NO: 485907 - protein, 9 aa, Influenza virus
SSSSVVMCG

SEQ ID NO: 485908 - protein, 9 aa, Influenza virus
SSSTVFCGV

SEQ ID NO: 485909 - protein, 9 aa, Influenza virus
SSSVLLVSL

SEQ ID NO: 485910 - protein, 9 aa, Influenza virus
SSSVVMCGV

SEQ ID NO: 485911 - protein, 9 aa, Influenza virus
SSSYRRPIG

SEQ ID NO: 485912 - protein, 9 aa, Influenza virus
SSSYRRPVG

SEQ ID NO: 485913 - protein, 9 aa, Influenza virus
SSTEFLGQW

SEQ ID NO: 485914 - protein, 9 aa, Influenza virus
SSTKEKNDL

SEQ ID NO: 485915 - protein, 9 aa, Influenza virus
SSTKEKNEL

SEQ ID NO: 485916 - protein, 9 aa, Influenza virus
SSTQEKNDL

SEQ ID NO: 485917 - protein, 9 aa, Influenza virus
SSTQERNDL

SEQ ID NO: 485918 - protein, 9 aa, Influenza virus
SSTSCFDGK

SEQ ID NO: 485919 - protein, 9 aa, Influenza virus
SSTSCHDGI

SEQ ID NO: 485920 - protein, 9 aa, Influenza virus
SSTSCHDGK

SEQ ID NO: 485921 - protein, 9 aa, Influenza virus
SSTSCHDGM

SEQ ID NO: 485922 - protein, 9 aa, Influenza virus
SSTSCHDGR

SEQ ID NO: 485923 - protein, 9 aa, Influenza virus
SSTSCHDGV

SEQ ID NO: 485924 - protein, 9 aa, Influenza virus
SSTTCHDGI

SEQ ID NO: 485925 - protein, 9 aa, Influenza virus
SSTTCHDGV

SEQ ID NO: 485926 - protein, 9 aa, Influenza virus
SSTVFCGVS

SEQ ID NO: 485927 - protein, 9 aa, Influenza virus
SSTVLVGLI

SEQ ID NO: 485928 - protein, 9 aa, Influenza virus
SSTVMVGLI

SEQ ID NO: 485929 - protein, 9 aa, Influenza virus
SSTYHNSFV

SEQ ID NO: 485930 - protein, 9 aa, Influenza virus
SSTYQNNFV

SEQ ID NO: 485931 - protein, 9 aa, Influenza virus
SSTYQNSFV

SEQ ID NO: 485932 - protein, 9 aa, Influenza virus
SSVASSLVL

SEQ ID NO: 485933 - protein, 9 aa, Influenza virus
SSVDLVETN

SEQ ID NO: 485934 - protein, 9 aa, Influenza virus
SSVKEKDLT

SEQ ID NO: 485935 - protein, 9 aa, Influenza virus
SSVKEKDMT

SEQ ID NO: 485936 - protein, 9 aa, Influenza virus
SSVLLVSLG

SEQ ID NO: 485937 - protein, 9 aa, Influenza virus
SSVNTNTIN

SEQ ID NO: 485938 - protein, 9 aa, Influenza virus
SSVREKDMT

SEQ ID NO: 485939 - protein, 9 aa, Influenza virus
SSVSSFEKF

SEQ ID NO: 485940 - protein, 9 aa, Influenza virus
SSVSSFERF

SEQ ID NO: 485941 - protein, 9 aa, Influenza virus
SSVSSFKRF

SEQ ID NO: 485942 - protein, 9 aa, Influenza virus
SSVTTNTIN

SEQ ID NO: 485943 - protein, 9 aa, Influenza virus
SSVVLVGLI

SEQ ID NO: 485944 - protein, 9 aa, Influenza virus
SSVVLVGPI

SEQ ID NO: 485945 - protein, 9 aa, Influenza virus
SSVVMCGVD

SEQ ID NO: 485946 - protein, 9 aa, Influenza virus
SSVYIEVLH

SEQ ID NO: 485947 - protein, 9 aa, Influenza virus
SSVYVEVLH

SEQ ID NO: 485948 - protein, 9 aa, Influenza virus
SSWHILSKD

SEQ ID NO: 485949 - protein, 9 aa, Influenza virus
SSYICSGLV

SEQ ID NO: 485950 - protein, 9 aa, Influenza virus
SSYLCSGLV

SEQ ID NO: 485951 - protein, 9 aa, Influenza virus
SSYMCSGLV

SEQ ID NO: 485952 - protein, 9 aa, Influenza virus
SSYRRPIGI

SEQ ID NO: 485953 - protein, 9 aa, Influenza virus
SSYRRPVGI

SEQ ID NO: 485954 - protein, 9 aa, Influenza virus
SSYVCSGLV

SEQ ID NO: 485955 - protein, 9 aa, Influenza virus
STAASSLAL

SEQ ID NO: 485956 - protein, 9 aa, Influenza virus
STAASSLVL

SEQ ID NO: 485957 - protein, 9 aa, Influenza virus
STASRSGYE

SEQ ID NO: 485958 - protein, 9 aa, Influenza virus
STAVAVIKY

SEQ ID NO: 485959 - protein, 9 aa, Influenza virus
STCVVVMTD

SEQ ID NO: 485960 - protein, 9 aa, Influenza virus
STDKDSNGV

SEQ ID NO: 485961 - protein, 9 aa, Influenza virus
STDKIDTLT

SEQ ID NO: 485962 - protein, 9 aa, Influenza virus
STDKNSNGV

SEQ ID NO: 485963 - protein, 9 aa, Influenza virus
STDKVDTII

SEQ ID NO: 485964 - protein, 9 aa, Influenza virus
STDKVDTLT

SEQ ID NO: 485965 - protein, 9 aa, Influenza virus
STDKVNTII

SEQ ID NO: 485966 - protein, 9 aa, Influenza virus
STDSEMNKL

SEQ ID NO: 485967 - protein, 9 aa, Influenza virus
STDTVDTIL

SEQ ID NO: 485968 - protein, 9 aa, Influenza virus
STDTVDTLI

SEQ ID NO: 485969 - protein, 9 aa, Influenza virus
STDTVDTLL

SEQ ID NO: 485970 - protein, 9 aa, Influenza virus
STDTVDTLT

SEQ ID NO: 485971 - protein, 9 aa, Influenza virus
STDTVDTVL

SEQ ID NO: 485972 - protein, 9 aa, Influenza virus
STDTVNTLI

SEQ ID NO: 485973 - protein, 9 aa, Influenza virus
STDTVNTLM

SEQ ID NO: 485974 - protein, 9 aa, Influenza virus
STDTVNTLT

SEQ ID NO: 485975 - protein, 9 aa, Influenza virus
STEFLGQWD

SEQ ID NO: 485976 - protein, 9 aa, Influenza virus
STEFLGQWN

SEQ ID NO: 485977 - protein, 9 aa, Influenza virus
STEKVDTII

SEQ ID NO: 485978 - protein, 9 aa, Influenza virus
STEKVDTLL

SEQ ID NO: 485979 - protein, 9 aa, Influenza virus
STEQVDTIM

SEQ ID NO: 485980 - protein, 9 aa, Influenza virus
STERVDTII

SEQ ID NO: 485981 - protein, 9 aa, Influenza virus
STERVDTIM

SEQ ID NO: 485982 - protein, 9 aa, Influenza virus
STETVNTLI

SEQ ID NO: 485983 - protein, 9 aa, Influenza virus
STETVNTLS

SEQ ID NO: 485984 - protein, 9 aa, Influenza virus
STETVNTLT

SEQ ID NO: 485985 - protein, 9 aa, Influenza virus
STGALASCM

SEQ ID NO: 485986 - protein, 9 aa, Influenza virus
STGAQSFYR

SEQ ID NO: 485987 - protein, 9 aa, Influenza virus
STGGQAFYR

SEQ ID NO: 485988 - protein, 9 aa, Influenza virus
STGGQSFYR

SEQ ID NO: 485989 - protein, 9 aa, Influenza virus
STGKDPKKT

SEQ ID NO: 485990 - protein, 9 aa, Influenza virus
STGNFIAPE

SEQ ID NO: 485991 - protein, 9 aa, Influenza virus
STGNHGSLV

SEQ ID NO: 485992 - protein, 9 aa, Influenza virus
STGNLIAPE

SEQ ID NO: 485993 - protein, 9 aa, Influenza virus
STGNLIAPR

SEQ ID NO: 485994 - protein, 9 aa, Influenza virus
STGNLVAPE

SEQ ID NO: 485995 - protein, 9 aa, Influenza virus
STIALFIGV

SEQ ID NO: 485996 - protein, 9 aa, Influenza virus
STIALIIGV

SEQ ID NO: 485997 - protein, 9 aa, Influenza virus
STIALLIGI

SEQ ID NO: 485998 - protein, 9 aa, Influenza virus
STIALLIGV

SEQ ID NO: 485999 - protein, 9 aa, Influenza virus
STIGDCPKY

SEQ ID NO: 486000 - protein, 9 aa, Influenza virus
STISCDSPS

SEQ ID NO: 486001 - protein, 9 aa, Influenza virus
STKALLIGI

SEQ ID NO: 486002 - protein, 9 aa, Influenza virus
STKEKNDLY

SEQ ID NO: 486003 - protein, 9 aa, Influenza virus
STKEKNELY

SEQ ID NO: 486004 - protein, 9 aa, Influenza virus
STKEWSKRY

SEQ ID NO: 486005 - protein, 9 aa, Influenza virus
STKEWSRRY

SEQ ID NO: 486006 - protein, 9 aa, Influenza virus
STKQVDTIM

SEQ ID NO: 486007 - protein, 9 aa, Influenza virus
STKSTVLKS

SEQ ID NO: 486008 - protein, 9 aa, Influenza virus
STLGLDIRT

SEQ ID NO: 486009 - protein, 9 aa, Influenza virus
STLKLATGM

SEQ ID NO: 486010 - protein, 9 aa, Influenza virus
STLPRRSGA

SEQ ID NO: 486011 - protein, 9 aa, Influenza virus
STLVLLVSL

SEQ ID NO: 486012 - protein, 9 aa, Influenza virus
STMLNLYER

SEQ ID NO: 486013 - protein, 9 aa, Influenza virus
STMSCDSPS

SEQ ID NO: 486014 - protein, 9 aa, Influenza virus
STNAHDRIC

SEQ ID NO: 486015 - protein, 9 aa, Influenza virus
STNAYDRIC

SEQ ID NO: 486016 - protein, 9 aa, Influenza virus
STNSSDKVD

SEQ ID NO: 486017 - protein, 9 aa, Influenza virus
STNSSEKVD

SEQ ID NO: 486018 - protein, 9 aa, Influenza virus
STNSSEKVN

SEQ ID NO: 486019 - protein, 9 aa, Influenza virus
STNSSERVD

SEQ ID NO: 486020 - protein, 9 aa, Influenza virus
STNSTEKVD

SEQ ID NO: 486021 - protein, 9 aa, Influenza virus
STNTVNTLI

SEQ ID NO: 486022 - protein, 9 aa, Influenza virus
STPLGSPPI

SEQ ID NO: 486023 - protein, 9 aa, Influenza virus
STPLGSPPM

SEQ ID NO: 486024 - protein, 9 aa, Influenza virus
STPLGSPPV

SEQ ID NO: 486025 - protein, 9 aa, Influenza virus
STPLGTPPT

SEQ ID NO: 486026 - protein, 9 aa, Influenza virus
STPSAIDQI

SEQ ID NO: 486027 - protein, 9 aa, Influenza virus
STQAAIDKI

SEQ ID NO: 486028 - protein, 9 aa, Influenza virus
STQAAIDQI

SEQ ID NO: 486029 - protein, 9 aa, Influenza virus
STQAAIDQV

SEQ ID NO: 486030 - protein, 9 aa, Influenza virus
STQAAINQI

SEQ ID NO: 486031 - protein, 9 aa, Influenza virus
STQAAVDQI

SEQ ID NO: 486032 - protein, 9 aa, Influenza virus
STQAAVNQI

SEQ ID NO: 486033 - protein, 9 aa, Influenza virus
STQATIDQI

SEQ ID NO: 486034 - protein, 9 aa, Influenza virus
STQEAIDKI

SEQ ID NO: 486035 - protein, 9 aa, Influenza virus
STQEAIEKI

SEQ ID NO: 486036 - protein, 9 aa, Influenza virus
STQEAIGKI

SEQ ID NO: 486037 - protein, 9 aa, Influenza virus
STQEAINKI

SEQ ID NO: 486038 - protein, 9 aa, Influenza virus
STQEKNDLY

SEQ ID NO: 486039 - protein, 9 aa, Influenza virus
STQERNDLY

SEQ ID NO: 486040 - protein, 9 aa, Influenza virus
STQKAIDEI

SEQ ID NO: 486041 - protein, 9 aa, Influenza virus
STQKAIDGI

SEQ ID NO: 486042 - protein, 9 aa, Influenza virus
STQKAIDGV

SEQ ID NO: 486043 - protein, 9 aa, Influenza virus
STQKAIDIM

SEQ ID NO: 486044 - protein, 9 aa, Influenza virus
STQKAIDNM

SEQ ID NO: 486045 - protein, 9 aa, Influenza virus
STQKAIDQI

SEQ ID NO: 486046 - protein, 9 aa, Influenza virus
STQKAIDRI

SEQ ID NO: 486047 - protein, 9 aa, Influenza virus
STQKAINEI

SEQ ID NO: 486048 - protein, 9 aa, Influenza virus
STQKAINGI

SEQ ID NO: 486049 - protein, 9 aa, Influenza virus
STQKAINGV

SEQ ID NO: 486050 - protein, 9 aa, Influenza virus
STQKALNEI

SEQ ID NO: 486051 - protein, 9 aa, Influenza virus
STQKAVDGI

SEQ ID NO: 486052 - protein, 9 aa, Influenza virus
STQKTIDQV

SEQ ID NO: 486053 - protein, 9 aa, Influenza virus
STQMAIDNM

SEQ ID NO: 486054 - protein, 9 aa, Influenza virus
STQPTFSVQ

SEQ ID NO: 486055 - protein, 9 aa, Influenza virus
STQRAIDGI

SEQ ID NO: 486056 - protein, 9 aa, Influenza virus
STQRAIDGV

SEQ ID NO: 486057 - protein, 9 aa, Influenza virus
STQRAIDNM

SEQ ID NO: 486058 - protein, 9 aa, Influenza virus
STQSAIDQI

SEQ ID NO: 486059 - protein, 9 aa, Influenza virus
STQSAIDQV

SEQ ID NO: 486060 - protein, 9 aa, Influenza virus
STQSAINQI

SEQ ID NO: 486061 - protein, 9 aa, Influenza virus
STQSAVDQI

SEQ ID NO: 486062 - protein, 9 aa, Influenza virus
STQSAVNQI

SEQ ID NO: 486063 - protein, 9 aa, Influenza virus
STQTAIDQI

SEQ ID NO: 486064 - protein, 9 aa, Influenza virus
STRGIQIAS

SEQ ID NO: 486065 - protein, 9 aa, Influenza virus
STRGVQIAS

SEQ ID NO: 486066 - protein, 9 aa, Influenza virus
STRGVQVAS

SEQ ID NO: 486067 - protein, 9 aa, Influenza virus
STRSDQISI

SEQ ID NO: 486068 - protein, 9 aa, Influenza virus
STRSRSGFE

SEQ ID NO: 486069 - protein, 9 aa, Influenza virus
STSCFDGKE

SEQ ID NO: 486070 - protein, 9 aa, Influenza virus
STSCHDGIG

SEQ ID NO: 486071 - protein, 9 aa, Influenza virus
STSCHDGIS

SEQ ID NO: 486072 - protein, 9 aa, Influenza virus
STSCHDGKA

SEQ ID NO: 486073 - protein, 9 aa, Influenza virus
STSCHDGKF

SEQ ID NO: 486074 - protein, 9 aa, Influenza virus
STSCHDGKS

SEQ ID NO: 486075 - protein, 9 aa, Influenza virus
STSCHDGKT

SEQ ID NO: 486076 - protein, 9 aa, Influenza virus
STSCHDGMS

SEQ ID NO: 486077 - protein, 9 aa, Influenza virus
STSCHDGRA

SEQ ID NO: 486078 - protein, 9 aa, Influenza virus
STSCHDGRS

SEQ ID NO: 486079 - protein, 9 aa, Influenza virus
STSCHDGVG

SEQ ID NO: 486080 - protein, 9 aa, Influenza virus
STSCHDGVS

SEQ ID NO: 486081 - protein, 9 aa, Influenza virus
STSIVVFCG

SEQ ID NO: 486082 - protein, 9 aa, Influenza virus
STSSRSGFE

SEQ ID NO: 486083 - protein, 9 aa, Influenza virus
STTAKAMEQ

SEQ ID NO: 486084 - protein, 9 aa, Influenza virus
STTCHDGIG

SEQ ID NO: 486085 - protein, 9 aa, Influenza virus
STTFPYTGD

SEQ ID NO: 486086 - protein, 9 aa, Influenza virus
STTGMTLSV

SEQ ID NO: 486087 - protein, 9 aa, Influenza virus
STTHDRTAF

SEQ ID NO: 486088 - protein, 9 aa, Influenza virus
STVAASLCL

SEQ ID NO: 486089 - protein, 9 aa, Influenza virus
STVASSLAL

SEQ ID NO: 486090 - protein, 9 aa, Influenza virus
STVASSLIL

SEQ ID NO: 486091 - protein, 9 aa, Influenza virus
STVASSLTL

SEQ ID NO: 486092 - protein, 9 aa, Influenza virus
STVASSLVL

SEQ ID NO: 486093 - protein, 9 aa, Influenza virus
STVASSSVL

SEQ ID NO: 486094 - protein, 9 aa, Influenza virus
STVFCGVSG

SEQ ID NO: 486095 - protein, 9 aa, Influenza virus
STVFCGVSS

SEQ ID NO: 486096 - protein, 9 aa, Influenza virus
STVLGVSIL

SEQ ID NO: 486097 - protein, 9 aa, Influenza virus
STVLKSDKR

SEQ ID NO: 486098 - protein, 9 aa, Influenza virus
STVLVGLIL

SEQ ID NO: 486099 - protein, 9 aa, Influenza virus
STVMVGLIL

SEQ ID NO: 486100 - protein, 9 aa, Influenza virus
STVNEEALR

SEQ ID NO: 486101 - protein, 9 aa, Influenza virus
STVQVDTIM

SEQ ID NO: 486102 - protein, 9 aa, Influenza virus
STVSCDSPS

SEQ ID NO: 486103 - protein, 9 aa, Influenza virus
STVSSFERF

SEQ ID NO: 486104 - protein, 9 aa, Influenza virus
STVSSSLVL

SEQ ID NO: 486105 - protein, 9 aa, Influenza virus
STVVNNITT

SEQ ID NO: 486106 - protein, 9 aa, Influenza virus
STVVSSLAL

SEQ ID NO: 486107 - protein, 9 aa, Influenza virus
STWLGRTIS

SEQ ID NO: 486108 - protein, 9 aa, Influenza virus
STYKILSIY

SEQ ID NO: 486109 - protein, 9 aa, Influenza virus
STYQNNFVP

SEQ ID NO: 486110 - protein, 9 aa, Influenza virus
STYQNSFVP

SEQ ID NO: 486111 - protein, 9 aa, Influenza virus
SVAGWLLGN

SEQ ID NO: 486112 - protein, 9 aa, Influenza virus
SVAHKSCLP

SEQ ID NO: 486113 - protein, 9 aa, Influenza virus
SVAPIMFSN

SEQ ID NO: 486114 - protein, 9 aa, Influenza virus
SVASSLVLL

SEQ ID NO: 486115 - protein, 9 aa, Influenza virus
SVAWSASAC

SEQ ID NO: 486116 - protein, 9 aa, Influenza virus
SVAWSATAC

SEQ ID NO: 486117 - protein, 9 aa, Influenza virus
SVCISGPNN

SEQ ID NO: 486118 - protein, 9 aa, Influenza virus
SVCMSGPNN

SEQ ID NO: 486119 - protein, 9 aa, Influenza virus
SVCYNPCFY

SEQ ID NO: 486120 - protein, 9 aa, Influenza virus
SVDLVETNH

SEQ ID NO: 486121 - protein, 9 aa, Influenza virus
SVEGWVVIA

SEQ ID NO: 486122 - protein, 9 aa, Influenza virus
SVENGTYDY

SEQ ID NO: 486123 - protein, 9 aa, Influenza virus
SVENLEELR

SEQ ID NO: 486124 - protein, 9 aa, Influenza virus
SVENQEELR

SEQ ID NO: 486125 - protein, 9 aa, Influenza virus
SVEPKGLFG

SEQ ID NO: 486126 - protein, 9 aa, Influenza virus
SVEPRGLFG

SEQ ID NO: 486127 - protein, 9 aa, Influenza virus
SVESSTYQN

SEQ ID NO: 486128 - protein, 9 aa, Influenza virus
SVEYASKTR

SEQ ID NO: 486129 - protein, 9 aa, Influenza virus
SVFNCLYAS

SEQ ID NO: 486130 - protein, 9 aa, Influenza virus
SVFNNLYAS

SEQ ID NO: 486131 - protein, 9 aa, Influenza virus
SVFNSLYAS

SEQ ID NO: 486132 - protein, 9 aa, Influenza virus
SVFNSLYSS

SEQ ID NO: 486133 - protein, 9 aa, Influenza virus
SVGGIDTNK

SEQ ID NO: 486134 - protein, 9 aa, Influenza virus
SVGGINTNK

SEQ ID NO: 486135 - protein, 9 aa, Influenza virus
SVGGINTNR

SEQ ID NO: 486136 - protein, 9 aa, Influenza virus
SVGKEFSNL

SEQ ID NO: 486137 - protein, 9 aa, Influenza virus
SVGSGSFPD

SEQ ID NO: 486138 - protein, 9 aa, Influenza virus
SVGSSIYQN

SEQ ID NO: 486139 - protein, 9 aa, Influenza virus
SVGSSTYHN

SEQ ID NO: 486140 - protein, 9 aa, Influenza virus
SVGSSTYQN

SEQ ID NO: 486141 - protein, 9 aa, Influenza virus
SVGSWSQNI

SEQ ID NO: 486142 - protein, 9 aa, Influenza virus
SVGTSTLNL

SEQ ID NO: 486143 - protein, 9 aa, Influenza virus
SVGTSTLNQ

SEQ ID NO: 486144 - protein, 9 aa, Influenza virus
SVGWSATAC

SEQ ID NO: 486145 - protein, 9 aa, Influenza virus
SVHRNTFGD

SEQ ID NO: 486146 - protein, 9 aa, Influenza virus
SVHRNTIGD

SEQ ID NO: 486147 - protein, 9 aa, Influenza virus
SVIEKINTQ

SEQ ID NO: 486148 - protein, 9 aa, Influenza virus
SVIEKMNIQ

SEQ ID NO: 486149 - protein, 9 aa, Influenza virus
SVIEKMNTQ

SEQ ID NO: 486150 - protein, 9 aa, Influenza virus
SVKEKDLTK

SEQ ID NO: 486151 - protein, 9 aa, Influenza virus
SVKEKDMTK

SEQ ID NO: 486152 - protein, 9 aa, Influenza virus
SVKEKDMTR

SEQ ID NO: 486153 - protein, 9 aa, Influenza virus
SVKKGTYDY

SEQ ID NO: 486154 - protein, 9 aa, Influenza virus
SVKLSSGYK

SEQ ID NO: 486155 - protein, 9 aa, Influenza virus
SVKMEKIVL

SEQ ID NO: 486156 - protein, 9 aa, Influenza virus
SVKNGTYDY

SEQ ID NO: 486157 - protein, 9 aa, Influenza virus
SVKNGTYEY

SEQ ID NO: 486158 - protein, 9 aa, Influenza virus
SVKNGTYNY

SEQ ID NO: 486159 - protein, 9 aa, Influenza virus
SVKNGTYYY

SEQ ID NO: 486160 - protein, 9 aa, Influenza virus
SVKTGTYDY

SEQ ID NO: 486161 - protein, 9 aa, Influenza virus
SVKTLTDNH

SEQ ID NO: 486162 - protein, 9 aa, Influenza virus
SVLINTYQW

SEQ ID NO: 486163 - protein, 9 aa, Influenza virus
SVLKPGETL

SEQ ID NO: 486164 - protein, 9 aa, Influenza virus
SVLKPGQTL

SEQ ID NO: 486165 - protein, 9 aa, Influenza virus
SVLLGSSPN

SEQ ID NO: 486166 - protein, 9 aa, Influenza virus
SVLLVSLGA

SEQ ID NO: 486167 - protein, 9 aa, Influenza virus
SVLNLLIGI

SEQ ID NO: 486168 - protein, 9 aa, Influenza virus
SVLNLLIGV

SEQ ID NO: 486169 - protein, 9 aa, Influenza virus
SVLQPGETL

SEQ ID NO: 486170 - protein, 9 aa, Influenza virus
SVLRPGETL

SEQ ID NO: 486171 - protein, 9 aa, Influenza virus
SVLRPGQTL

SEQ ID NO: 486172 - protein, 9 aa, Influenza virus
SVLVNTYQW

SEQ ID NO: 486173 - protein, 9 aa, Influenza virus
SVLYFWGIH

SEQ ID NO: 486174 - protein, 9 aa, Influenza virus
SVLYFWGVH

SEQ ID NO: 486175 - protein, 9 aa, Influenza virus
SVNTNTINR

SEQ ID NO: 486176 - protein, 9 aa, Influenza virus
SVNTVLSII

SEQ ID NO: 486177 - protein, 9 aa, Influenza virus
SVPASRYLI

SEQ ID NO: 486178 - protein, 9 aa, Influenza virus
SVPASRYLT

SEQ ID NO: 486179 - protein, 9 aa, Influenza virus
SVPLGSSPN

SEQ ID NO: 486180 - protein, 9 aa, Influenza virus
SVPMGSSPN

SEQ ID NO: 486181 - protein, 9 aa, Influenza virus
SVQPAFSVQ

SEQ ID NO: 486182 - protein, 9 aa, Influenza virus
SVQPTFSVQ

SEQ ID NO: 486183 - protein, 9 aa, Influenza virus
SVQRNLPFD

SEQ ID NO: 486184 - protein, 9 aa, Influenza virus
SVQRNLPFE

SEQ ID NO: 486185 - protein, 9 aa, Influenza virus
SVQRSLPFE

SEQ ID NO: 486186 - protein, 9 aa, Influenza virus
SVQSRGLFG

SEQ ID NO: 486187 - protein, 9 aa, Influenza virus
SVREKDMTK

SEQ ID NO: 486188 - protein, 9 aa, Influenza virus
SVRGSGMRI

SEQ ID NO: 486189 - protein, 9 aa, Influenza virus
SVRIGSKGD

SEQ ID NO: 486190 - protein, 9 aa, Influenza virus
SVRLSASGD

SEQ ID NO: 486191 - protein, 9 aa, Influenza virus
SVRNGTYDY

SEQ ID NO: 486192 - protein, 9 aa, Influenza virus
SVRNGTYKY

SEQ ID NO: 486193 - protein, 9 aa, Influenza virus
SVRNGTYNY

SEQ ID NO: 486194 - protein, 9 aa, Influenza virus
SVSECRTFF

SEQ ID NO: 486195 - protein, 9 aa, Influenza virus
SVSSFEKFE

SEQ ID NO: 486196 - protein, 9 aa, Influenza virus
SVSSFERFE

SEQ ID NO: 486197 - protein, 9 aa, Influenza virus
SVSSFKRFE

SEQ ID NO: 486198 - protein, 9 aa, Influenza virus
SVSSRSGFE

SEQ ID NO: 486199 - protein, 9 aa, Influenza virus
SVTELWSYN

SEQ ID NO: 486200 - protein, 9 aa, Influenza virus
SVTQTLVSN

SEQ ID NO: 486201 - protein, 9 aa, Influenza virus
SVTTNTINR

SEQ ID NO: 486202 - protein, 9 aa, Influenza virus
SVVEKMNTQ

SEQ ID NO: 486203 - protein, 9 aa, Influenza virus
SVVLVGLIL

SEQ ID NO: 486204 - protein, 9 aa, Influenza virus
SVVLVGPIL

SEQ ID NO: 486205 - protein, 9 aa, Influenza virus
SVVMCGVDH

SEQ ID NO: 486206 - protein, 9 aa, Influenza virus
SVVSCDSPS

SEQ ID NO: 486207 - protein, 9 aa, Influenza virus
SVVVFCGTS

SEQ ID NO: 486208 - protein, 9 aa, Influenza virus
SVWAGRTIS

SEQ ID NO: 486209 - protein, 9 aa, Influenza virus
SVWAGRTMS

SEQ ID NO: 486210 - protein, 9 aa, Influenza virus
SVWAGRTVS

SEQ ID NO: 486211 - protein, 9 aa, Influenza virus
SVYIEVLHL

SEQ ID NO: 486212 - protein, 9 aa, Influenza virus
SVYKALSIY

SEQ ID NO: 486213 - protein, 9 aa, Influenza virus
SVYSTVASS

SEQ ID NO: 486214 - protein, 9 aa, Influenza virus
SVYVEVLHL

SEQ ID NO: 486215 - protein, 9 aa, Influenza virus
SVYWTIVKP

SEQ ID NO: 486216 - protein, 9 aa, Influenza virus
SVYWTVVKP

SEQ ID NO: 486217 - protein, 9 aa, Influenza virus
SWAGDILRT

SEQ ID NO: 486218 - protein, 9 aa, Influenza virus
SWAGDIMRT

SEQ ID NO: 486219 - protein, 9 aa, Influenza virus
SWAGNILRT

SEQ ID NO: 486220 - protein, 9 aa, Influenza virus
SWASNSIVT

SEQ ID NO: 486221 - protein, 9 aa, Influenza virus
SWAVGRCPR

SEQ ID NO: 486222 - protein, 9 aa, Influenza virus
SWDDGAILP

SEQ ID NO: 486223 - protein, 9 aa, Influenza virus
SWEGDILRT

SEQ ID NO: 486224 - protein, 9 aa, Influenza virus
SWEGNILRT

SEQ ID NO: 486225 - protein, 9 aa, Influenza virus
SWEMGLAPS

SEQ ID NO: 486226 - protein, 9 aa, Influenza virus
SWEMGQAPS

SEQ ID NO: 486227 - protein, 9 aa, Influenza virus
SWFNSFLAH

SEQ ID NO: 486228 - protein, 9 aa, Influenza virus
SWFNSFLIH

SEQ ID NO: 486229 - protein, 9 aa, Influenza virus
SWFNSFLKH

SEQ ID NO: 486230 - protein, 9 aa, Influenza virus
SWFNSFLTH

SEQ ID NO: 486231 - protein, 9 aa, Influenza virus
SWFNSFLVH

SEQ ID NO: 486232 - protein, 9 aa, Influenza virus
SWGMGQAPS

SEQ ID NO: 486233 - protein, 9 aa, Influenza virus
SWHDGAEII

SEQ ID NO: 486234 - protein, 9 aa, Influenza virus
SWHDGAEIT

SEQ ID NO: 486235 - protein, 9 aa, Influenza virus
SWHDGAILP

SEQ ID NO: 486236 - protein, 9 aa, Influenza virus
SWHDGAVLP

SEQ ID NO: 486237 - protein, 9 aa, Influenza virus
SWHIFGKDN

SEQ ID NO: 486238 - protein, 9 aa, Influenza virus
SWHIFSKDN

SEQ ID NO: 486239 - protein, 9 aa, Influenza virus
SWHILSKDN

SEQ ID NO: 486240 - protein, 9 aa, Influenza virus
SWHIYGKDN

SEQ ID NO: 486241 - protein, 9 aa, Influenza virus
SWIPKRNRS

SEQ ID NO: 486242 - protein, 9 aa, Influenza virus
SWKGNIMRT

SEQ ID NO: 486243 - protein, 9 aa, Influenza virus
SWKKQILRT

SEQ ID NO: 486244 - protein, 9 aa, Influenza virus
SWLGRTISK

SEQ ID NO: 486245 - protein, 9 aa, Influenza virus
SWLGRTTSK

SEQ ID NO: 486246 - protein, 9 aa, Influenza virus
SWLHVCVTG

SEQ ID NO: 486247 - protein, 9 aa, Influenza virus
SWLTIGISG

SEQ ID NO: 486248 - protein, 9 aa, Influenza virus
SWLTIGVSG

SEQ ID NO: 486249 - protein, 9 aa, Influenza virus
SWMKIYWDL

SEQ ID NO: 486250 - protein, 9 aa, Influenza virus
SWMKIYWHL

SEQ ID NO: 486251 - protein, 9 aa, Influenza virus
SWMKIYWSL

SEQ ID NO: 486252 - protein, 9 aa, Influenza virus
SWMKIYWVL

SEQ ID NO: 486253 - protein, 9 aa, Influenza virus
SWMKIYWYL

SEQ ID NO: 486254 - protein, 9 aa, Influenza virus
SWMKLYWHL

SEQ ID NO: 486255 - protein, 9 aa, Influenza virus
SWPDDAELP

SEQ ID NO: 486256 - protein, 9 aa, Influenza virus
SWPDGADIN

SEQ ID NO: 486257 - protein, 9 aa, Influenza virus
SWPDGADLP

SEQ ID NO: 486258 - protein, 9 aa, Influenza virus
SWPDGAELP

SEQ ID NO: 486259 - protein, 9 aa, Influenza virus
SWPDGAEVP

SEQ ID NO: 486260 - protein, 9 aa, Influenza virus
SWPDGAKLP

SEQ ID NO: 486261 - protein, 9 aa, Influenza virus
SWPDGALFP

SEQ ID NO: 486262 - protein, 9 aa, Influenza virus
SWPDGALLP

SEQ ID NO: 486263 - protein, 9 aa, Influenza virus
SWPDGANID

SEQ ID NO: 486264 - protein, 9 aa, Influenza virus
SWPDGANIN

SEQ ID NO: 486265 - protein, 9 aa, Influenza virus
SWPDGANIS

SEQ ID NO: 486266 - protein, 9 aa, Influenza virus
SWPLSSPPT

SEQ ID NO: 486267 - protein, 9 aa, Influenza virus
SWPQSSPPT

SEQ ID NO: 486268 - protein, 9 aa, Influenza virus
SWRKDILRT

SEQ ID NO: 486269 - protein, 9 aa, Influenza virus
SWRKKILRT

SEQ ID NO: 486270 - protein, 9 aa, Influenza virus
SWRKQILRT

SEQ ID NO: 486271 - protein, 9 aa, Influenza virus
SWRRDILRT

SEQ ID NO: 486272 - protein, 9 aa, Influenza virus
SWRRQILRT

SEQ ID NO: 486273 - protein, 9 aa, Influenza virus
SWSCIVERP

SEQ ID NO: 486274 - protein, 9 aa, Influenza virus
SWSGYSGIF

SEQ ID NO: 486275 - protein, 9 aa, Influenza virus
SWSKNILRT

SEQ ID NO: 486276 - protein, 9 aa, Influenza virus
SWSKPQCQI

SEQ ID NO: 486277 - protein, 9 aa, Influenza virus
SWSLQCRIC

SEQ ID NO: 486278 - protein, 9 aa, Influenza virus
SWSQNILKK

SEQ ID NO: 486279 - protein, 9 aa, Influenza virus
SWSQNILRT

SEQ ID NO: 486280 - protein, 9 aa, Influenza virus
SWSWHDGAE

SEQ ID NO: 486281 - protein, 9 aa, Influenza virus
SWSWHDGAI

SEQ ID NO: 486282 - protein, 9 aa, Influenza virus
SWSWHDGAV

SEQ ID NO: 486283 - protein, 9 aa, Influenza virus
SWSWPDDAE

SEQ ID NO: 486284 - protein, 9 aa, Influenza virus
SWSWPDGAD

SEQ ID NO: 486285 - protein, 9 aa, Influenza virus
SWSWPDGAE

SEQ ID NO: 486286 - protein, 9 aa, Influenza virus
SWSWPDGAL

SEQ ID NO: 486287 - protein, 9 aa, Influenza virus
SWSYIVEKL

SEQ ID NO: 486288 - protein, 9 aa, Influenza virus
SWSYIVEKP

SEQ ID NO: 486289 - protein, 9 aa, Influenza virus
SWSYIVEKS

SEQ ID NO: 486290 - protein, 9 aa, Influenza virus
SWSYIVEKT

SEQ ID NO: 486291 - protein, 9 aa, Influenza virus
SWSYIVERL

SEQ ID NO: 486292 - protein, 9 aa, Influenza virus
SWSYIVERP

SEQ ID NO: 486293 - protein, 9 aa, Influenza virus
SWSYVVERP

SEQ ID NO: 486294 - protein, 9 aa, Influenza virus
SWTKIYWYL

SEQ ID NO: 486295 - protein, 9 aa, Influenza virus
SWTPKRNRS

SEQ ID NO: 486296 - protein, 9 aa, Influenza virus
SWTSNSIVT

SEQ ID NO: 486297 - protein, 9 aa, Influenza virus
SWTSNSMVT

SEQ ID NO: 486298 - protein, 9 aa, Influenza virus
SWVPILNTS

SEQ ID NO: 486299 - protein, 9 aa, Influenza virus
SWVPKRNRS

SEQ ID NO: 486300 - protein, 9 aa, Influenza virus
SYCRATEYI

SEQ ID NO: 486301 - protein, 9 aa, Influenza virus
SYEQMETDG

SEQ ID NO: 486302 - protein, 9 aa, Influenza virus
SYEQMETGE

SEQ ID NO: 486303 - protein, 9 aa, Influenza virus
SYEQMETGG

SEQ ID NO: 486304 - protein, 9 aa, Influenza virus
SYEQMETSG

SEQ ID NO: 486305 - protein, 9 aa, Influenza virus
SYFANLKGT

SEQ ID NO: 486306 - protein, 9 aa, Influenza virus
SYFFGDNAE

SEQ ID NO: 486307 - protein, 9 aa, Influenza virus
SYFFGDNAK

SEQ ID NO: 486308 - protein, 9 aa, Influenza virus
SYFQLFLVC

SEQ ID NO: 486309 - protein, 9 aa, Influenza virus
SYGRIIQNE

SEQ ID NO: 486310 - protein, 9 aa, Influenza virus
SYGTGSWPD

SEQ ID NO: 486311 - protein, 9 aa, Influenza virus
SYICSGLVG

SEQ ID NO: 486312 - protein, 9 aa, Influenza virus
SYIIEKENP

SEQ ID NO: 486313 - protein, 9 aa, Influenza virus
SYIIERPSA

SEQ ID NO: 486314 - protein, 9 aa, Influenza virus
SYIIRALTL

SEQ ID NO: 486315 - protein, 9 aa, Influenza virus
SYIMEKENP

SEQ ID NO: 486316 - protein, 9 aa, Influenza virus
SYINKTGTF

SEQ ID NO: 486317 - protein, 9 aa, Influenza virus
SYINRTGTF

SEQ ID NO: 486318 - protein, 9 aa, Influenza virus
SYIVEKANP

SEQ ID NO: 486319 - protein, 9 aa, Influenza virus
SYIVEKDKP

SEQ ID NO: 486320 - protein, 9 aa, Influenza virus
SYIVEKDNP

SEQ ID NO: 486321 - protein, 9 aa, Influenza virus
SYIVEKDSP

SEQ ID NO: 486322 - protein, 9 aa, Influenza virus
SYIVEKENP

SEQ ID NO: 486323 - protein, 9 aa, Influenza virus
SYIVEKNNP

SEQ ID NO: 486324 - protein, 9 aa, Influenza virus
SYIVEKPNP

SEQ ID NO: 486325 - protein, 9 aa, Influenza virus
SYIVEKSNP

SEQ ID NO: 486326 - protein, 9 aa, Influenza virus
SYIVEKTNP

SEQ ID NO: 486327 - protein, 9 aa, Influenza virus
SYIVERENP

SEQ ID NO: 486328 - protein, 9 aa, Influenza virus
SYIVERETP

SEQ ID NO: 486329 - protein, 9 aa, Influenza virus
SYIVERPKE

SEQ ID NO: 486330 - protein, 9 aa, Influenza virus
SYIVERPNP

SEQ ID NO: 486331 - protein, 9 aa, Influenza virus
SYIVERPSA

SEQ ID NO: 486332 - protein, 9 aa, Influenza virus
SYIVERPTA

SEQ ID NO: 486333 - protein, 9 aa, Influenza virus
SYIVERQSA

SEQ ID NO: 486334 - protein, 9 aa, Influenza virus
SYIVERSSA

SEQ ID NO: 486335 - protein, 9 aa, Influenza virus
SYIVERSSP

SEQ ID NO: 486336 - protein, 9 aa, Influenza virus
SYIVERTKE

SEQ ID NO: 486337 - protein, 9 aa, Influenza virus
SYKILSIYS

SEQ ID NO: 486338 - protein, 9 aa, Influenza virus
SYKRIRLFD

SEQ ID NO: 486339 - protein, 9 aa, Influenza virus
SYKRVRLFD

SEQ ID NO: 486340 - protein, 9 aa, Influenza virus
SYKVGYLCA

SEQ ID NO: 486341 - protein, 9 aa, Influenza virus
SYKYDNGVW

SEQ ID NO: 486342 - protein, 9 aa, Influenza virus
SYKYGNGVW

SEQ ID NO: 486343 - protein, 9 aa, Influenza virus
SYLCSGLVG

SEQ ID NO: 486344 - protein, 9 aa, Influenza virus
SYLECRTFF

SEQ ID NO: 486345 - protein, 9 aa, Influenza virus
SYLIEDPAA

SEQ ID NO: 486346 - protein, 9 aa, Influenza virus
SYLIEDPGA

SEQ ID NO: 486347 - protein, 9 aa, Influenza virus
SYLIEDPNA

SEQ ID NO: 486348 - protein, 9 aa, Influenza virus
SYLIEDPSA

SEQ ID NO: 486349 - protein, 9 aa, Influenza virus
SYLIEDPTA

SEQ ID NO: 486350 - protein, 9 aa, Influenza virus
SYLIRALTL

SEQ ID NO: 486351 - protein, 9 aa, Influenza virus
SYLIRTLTL

SEQ ID NO: 486352 - protein, 9 aa, Influenza virus
SYLLLNKSL

SEQ ID NO: 486353 - protein, 9 aa, Influenza virus
SYLNVRCVC

SEQ ID NO: 486354 - protein, 9 aa, Influenza virus
SYMCSGLVG

SEQ ID NO: 486355 - protein, 9 aa, Influenza virus
SYNADLLVA

SEQ ID NO: 486356 - protein, 9 aa, Influenza virus
SYNADVLVA

SEQ ID NO: 486357 - protein, 9 aa, Influenza virus
SYNAEFLVA

SEQ ID NO: 486358 - protein, 9 aa, Influenza virus
SYNAELLIA

SEQ ID NO: 486359 - protein, 9 aa, Influenza virus
SYNAELLVA

SEQ ID NO: 486360 - protein, 9 aa, Influenza virus
SYNAGLLVA

SEQ ID NO: 486361 - protein, 9 aa, Influenza virus
SYNAKLLVL

SEQ ID NO: 486362 - protein, 9 aa, Influenza virus
SYNAQLLVL

SEQ ID NO: 486363 - protein, 9 aa, Influenza virus
SYNAQLLVW

SEQ ID NO: 486364 - protein, 9 aa, Influenza virus
SYNARLLVL

SEQ ID NO: 486365 - protein, 9 aa, Influenza virus
SYNNTNGEQ

SEQ ID NO: 486366 - protein, 9 aa, Influenza virus
SYNNTSGEQ

SEQ ID NO: 486367 - protein, 9 aa, Influenza virus
SYNNTSGKQ

SEQ ID NO: 486368 - protein, 9 aa, Influenza virus
SYNYHQSFV

SEQ ID NO: 486369 - protein, 9 aa, Influenza virus
SYPNVRCVC

SEQ ID NO: 486370 - protein, 9 aa, Influenza virus
SYQVGYLCA

SEQ ID NO: 486371 - protein, 9 aa, Influenza virus
SYRRPIGIS

SEQ ID NO: 486372 - protein, 9 aa, Influenza virus
SYRRPVGIS

SEQ ID NO: 486373 - protein, 9 aa, Influenza virus
SYRSLIRFP

SEQ ID NO: 486374 - protein, 9 aa, Influenza virus
SYRTLLMNE

SEQ ID NO: 486375 - protein, 9 aa, Influenza virus
SYRTLLMSE

SEQ ID NO: 486376 - protein, 9 aa, Influenza virus
SYRVGYLCA

SEQ ID NO: 486377 - protein, 9 aa, Influenza virus
SYRYGNGVW

SEQ ID NO: 486378 - protein, 9 aa, Influenza virus
SYSAGALAS

SEQ ID NO: 486379 - protein, 9 aa, Influenza virus
SYSTGALAS

SEQ ID NO: 486380 - protein, 9 aa, Influenza virus
SYSVGYLCA

SEQ ID NO: 486381 - protein, 9 aa, Influenza virus
SYTVGYLCA

SEQ ID NO: 486382 - protein, 9 aa, Influenza virus
SYVCSGLVG

SEQ ID NO: 486383 - protein, 9 aa, Influenza virus
SYVRLYLWG

SEQ ID NO: 486384 - protein, 9 aa, Influenza virus
SYWWDGLQS

SEQ ID NO: 486385 - protein, 9 aa, Influenza virus
TAADLKSTQ

SEQ ID NO: 486386 - protein, 9 aa, Influenza virus
TAADYKSTP

SEQ ID NO: 486387 - protein, 9 aa, Influenza virus
TAADYKSTQ

SEQ ID NO: 486388 - protein, 9 aa, Influenza virus
TAAQKAMMD

SEQ ID NO: 486389 - protein, 9 aa, Influenza virus
TAAQRAMMD

SEQ ID NO: 486390 - protein, 9 aa, Influenza virus
TAAQRAMVD

SEQ ID NO: 486391 - protein, 9 aa, Influenza virus
TAASSLALA

SEQ ID NO: 486392 - protein, 9 aa, Influenza virus
TACFEIFHK

SEQ ID NO: 486393 - protein, 9 aa, Influenza virus
TACHDGKEW

SEQ ID NO: 486394 - protein, 9 aa, Influenza virus
TACHDGKGW

SEQ ID NO: 486395 - protein, 9 aa, Influenza virus
TACHDGKKW

SEQ ID NO: 486396 - protein, 9 aa, Influenza virus
TACHDGRKW

SEQ ID NO: 486397 - protein, 9 aa, Influenza virus
TACSDGPGW

SEQ ID NO: 486398 - protein, 9 aa, Influenza virus
TACSDGSGW

SEQ ID NO: 486399 - protein, 9 aa, Influenza virus
TADKDSNGV

SEQ ID NO: 486400 - protein, 9 aa, Influenza virus
TAEISHCRA

SEQ ID NO: 486401 - protein, 9 aa, Influenza virus
TAEVSHCRA

SEQ ID NO: 486402 - protein, 9 aa, Influenza virus
TAEVSYCRA

SEQ ID NO: 486403 - protein, 9 aa, Influenza virus
TAFRGLIST

SEQ ID NO: 486404 - protein, 9 aa, Influenza virus
TAFRGLMST

SEQ ID NO: 486405 - protein, 9 aa, Influenza virus
TAFSGMSAN

SEQ ID NO: 486406 - protein, 9 aa, Influenza virus
TAIDQINGK

SEQ ID NO: 486407 - protein, 9 aa, Influenza virus
TAIDQITGK

SEQ ID NO: 486408 - protein, 9 aa, Influenza virus
TAIFRKATR

SEQ ID NO: 486409 - protein, 9 aa, Influenza virus
TAIIRKATR

SEQ ID NO: 486410 - protein, 9 aa, Influenza virus
TAILKKATR

SEQ ID NO: 486411 - protein, 9 aa, Influenza virus
TAILRKATK

SEQ ID NO: 486412 - protein, 9 aa, Influenza virus
TAILRKATR

SEQ ID NO: 486413 - protein, 9 aa, Influenza virus
TAKAMEQMA

SEQ ID NO: 486414 - protein, 9 aa, Influenza virus
TAKAMEQVA

SEQ ID NO: 486415 - protein, 9 aa, Influenza virus
TAKHIEECS

SEQ ID NO: 486416 - protein, 9 aa, Influenza virus
TALANTIEI

SEQ ID NO: 486417 - protein, 9 aa, Influenza virus
TALANTIEV

SEQ ID NO: 486418 - protein, 9 aa, Influenza virus
TALLNASCA

SEQ ID NO: 486419 - protein, 9 aa, Influenza virus
TALSTIALL

SEQ ID NO: 486420 - protein, 9 aa, Influenza virus
TALYKNANT

SEQ ID NO: 486421 - protein, 9 aa, Influenza virus
TAMLCLGHH

SEQ ID NO: 486422 - protein, 9 aa, Influenza virus
TAMLNASCA

SEQ ID NO: 486423 - protein, 9 aa, Influenza virus
TANSIIVFC

SEQ ID NO: 486424 - protein, 9 aa, Influenza virus
TANTYRNTD

SEQ ID NO: 486425 - protein, 9 aa, Influenza virus
TAPHGLCYP

SEQ ID NO: 486426 - protein, 9 aa, Influenza virus
TAPILGNYK

SEQ ID NO: 486427 - protein, 9 aa, Influenza virus
TAPVLGNYK

SEQ ID NO: 486428 - protein, 9 aa, Influenza virus
TAPVLGNYR

SEQ ID NO: 486429 - protein, 9 aa, Influenza virus
TAQELVEAQ

SEQ ID NO: 486430 - protein, 9 aa, Influenza virus
TAQELVEPQ

SEQ ID NO: 486431 - protein, 9 aa, Influenza virus
TAQELVESK

SEQ ID NO: 486432 - protein, 9 aa, Influenza virus
TAQELVESQ

SEQ ID NO: 486433 - protein, 9 aa, Influenza virus
TAQHIEECS

SEQ ID NO: 486434 - protein, 9 aa, Influenza virus
TAQIIKLLP

SEQ ID NO: 486435 - protein, 9 aa, Influenza virus
TAQMALQLF

SEQ ID NO: 486436 - protein, 9 aa, Influenza virus
TASCLDKGA

SEQ ID NO: 486437 - protein, 9 aa, Influenza virus
TASCLDRGA

SEQ ID NO: 486438 - protein, 9 aa, Influenza virus
TASCLDRGT

SEQ ID NO: 486439 - protein, 9 aa, Influenza virus
TASCQNRGA

SEQ ID NO: 486440 - protein, 9 aa, Influenza virus
TASCRDNGA

SEQ ID NO: 486441 - protein, 9 aa, Influenza virus
TASLSPGMM

SEQ ID NO: 486442 - protein, 9 aa, Influenza virus
TASRAGYEM

SEQ ID NO: 486443 - protein, 9 aa, Influenza virus
TASRSGYEM

SEQ ID NO: 486444 - protein, 9 aa, Influenza virus
TASRSGYEV

SEQ ID NO: 486445 - protein, 9 aa, Influenza virus
TATKRIRMA

SEQ ID NO: 486446 - protein, 9 aa, Influenza virus
TATKRLRMA

SEQ ID NO: 486447 - protein, 9 aa, Influenza virus
TATLCLGHH

SEQ ID NO: 486448 - protein, 9 aa, Influenza virus
TATREGKHI

SEQ ID NO: 486449 - protein, 9 aa, Influenza virus
TATVYYDRR

SEQ ID NO: 486450 - protein, 9 aa, Influenza virus
TATVYYNGR

SEQ ID NO: 486451 - protein, 9 aa, Influenza virus
TATVYYNKR

SEQ ID NO: 486452 - protein, 9 aa, Influenza virus
TATVYYNRR

SEQ ID NO: 486453 - protein, 9 aa, Influenza virus
TAVAVIKYN

SEQ ID NO: 486454 - protein, 9 aa, Influenza virus
TAVAVLKYN

SEQ ID NO: 486455 - protein, 9 aa, Influenza virus
TAVDTCYPF

SEQ ID NO: 486456 - protein, 9 aa, Influenza virus
TAYELTDSS

SEQ ID NO: 486457 - protein, 9 aa, Influenza virus
TAYERMCNI

SEQ ID NO: 486458 - protein, 9 aa, Influenza virus
TAYSQITNG

SEQ ID NO: 486459 - protein, 9 aa, Influenza virus
TAYWWDGLQ

SEQ ID NO: 486460 - protein, 9 aa, Influenza virus
TCAVVMTDG

SEQ ID NO: 486461 - protein, 9 aa, Influenza virus
TCEQIADAQ

SEQ ID NO: 486462 - protein, 9 aa, Influenza virus
TCEQIADSH

SEQ ID NO: 486463 - protein, 9 aa, Influenza virus
TCEQIADSQ

SEQ ID NO: 486464 - protein, 9 aa, Influenza virus
TCGCRDNWQ

SEQ ID NO: 486465 - protein, 9 aa, Influenza virus
TCHDGIGRM

SEQ ID NO: 486466 - protein, 9 aa, Influenza virus
TCICRDNWQ

SEQ ID NO: 486467 - protein, 9 aa, Influenza virus
TCIVAVTDG

SEQ ID NO: 486468 - protein, 9 aa, Influenza virus
TCKLLGINM

SEQ ID NO: 486469 - protein, 9 aa, Influenza virus
TCKLVGINM

SEQ ID NO: 486470 - protein, 9 aa, Influenza virus
TCMETIRNG

SEQ ID NO: 486471 - protein, 9 aa, Influenza virus
TCNSGNCRF

SEQ ID NO: 486472 - protein, 9 aa, Influenza virus
TCRDNWKGS

SEQ ID NO: 486473 - protein, 9 aa, Influenza virus
TCRDNWQGS

SEQ ID NO: 486474 - protein, 9 aa, Influenza virus
TCSALFVYS

SEQ ID NO: 486475 - protein, 9 aa, Influenza virus
TCSNGSCRC

SEQ ID NO: 486476 - protein, 9 aa, Influenza virus
TCTCRDNWQ

SEQ ID NO: 486477 - protein, 9 aa, Influenza virus
TCTVIMTDG

SEQ ID NO: 486478 - protein, 9 aa, Influenza virus
TCTVVMTDG

SEQ ID NO: 486479 - protein, 9 aa, Influenza virus
TCVAVMTDG

SEQ ID NO: 486480 - protein, 9 aa, Influenza virus
TCVCRDNWH

SEQ ID NO: 486481 - protein, 9 aa, Influenza virus
TCVCRDNWK

SEQ ID NO: 486482 - protein, 9 aa, Influenza virus
TCVCRDNWQ

SEQ ID NO: 486483 - protein, 9 aa, Influenza virus
TCVCRDSWH

SEQ ID NO: 486484 - protein, 9 aa, Influenza virus
TCVVAVTDG

SEQ ID NO: 486485 - protein, 9 aa, Influenza virus
TCVVIMTDG

SEQ ID NO: 486486 - protein, 9 aa, Influenza virus
TCVVTVTDG

SEQ ID NO: 486487 - protein, 9 aa, Influenza virus
TCVVVMTDG

SEQ ID NO: 486488 - protein, 9 aa, Influenza virus
TCWEQLYTP

SEQ ID NO: 486489 - protein, 9 aa, Influenza virus
TCWEQMYTP

SEQ ID NO: 486490 - protein, 9 aa, Influenza virus
TCWSWPDGA

SEQ ID NO: 486491 - protein, 9 aa, Influenza virus
TCYPFDVPD

SEQ ID NO: 486492 - protein, 9 aa, Influenza virus
TCYPFDVPE

SEQ ID NO: 486493 - protein, 9 aa, Influenza virus
TCYPFDVPG

SEQ ID NO: 486494 - protein, 9 aa, Influenza virus
TCYPFDVPN

SEQ ID NO: 486495 - protein, 9 aa, Influenza virus
TDAEMNKLF

SEQ ID NO: 486496 - protein, 9 aa, Influenza virus
TDCVLEAMA

SEQ ID NO: 486497 - protein, 9 aa, Influenza virus
TDDPAANSA

SEQ ID NO: 486498 - protein, 9 aa, Influenza virus
TDELCPSPL

SEQ ID NO: 486499 - protein, 9 aa, Influenza virus
TDEYKNTGD

SEQ ID NO: 486500 - protein, 9 aa, Influenza virus
TDEYKNTRD

SEQ ID NO: 486501 - protein, 9 aa, Influenza virus
TDGATSACK

SEQ ID NO: 486502 - protein, 9 aa, Influenza virus
TDGNASGKA

SEQ ID NO: 486503 - protein, 9 aa, Influenza virus
TDGNASGRA

SEQ ID NO: 486504 - protein, 9 aa, Influenza virus
TDGPAANNA

SEQ ID NO: 486505 - protein, 9 aa, Influenza virus
TDGPAANSA

SEQ ID NO: 486506 - protein, 9 aa, Influenza virus
TDGPAASSA

SEQ ID NO: 486507 - protein, 9 aa, Influenza virus
TDGPADNKA

SEQ ID NO: 486508 - protein, 9 aa, Influenza virus
TDGPANDRA

SEQ ID NO: 486509 - protein, 9 aa, Influenza virus
TDGPANKQA

SEQ ID NO: 486510 - protein, 9 aa, Influenza virus
TDGPANNKA

SEQ ID NO: 486511 - protein, 9 aa, Influenza virus
TDGPANNQA

SEQ ID NO: 486512 - protein, 9 aa, Influenza virus
TDGPANNRA

SEQ ID NO: 486513 - protein, 9 aa, Influenza virus
TDGPANRQA

SEQ ID NO: 486514 - protein, 9 aa, Influenza virus
TDGPANSQA

SEQ ID NO: 486515 - protein, 9 aa, Influenza virus
TDGPANSRA

SEQ ID NO: 486516 - protein, 9 aa, Influenza virus
TDGPASNKA

SEQ ID NO: 486517 - protein, 9 aa, Influenza virus
TDGPASNQA

SEQ ID NO: 486518 - protein, 9 aa, Influenza virus
TDGPASSQA

SEQ ID NO: 486519 - protein, 9 aa, Influenza virus
TDGPSDAQA

SEQ ID NO: 486520 - protein, 9 aa, Influenza virus
TDGPSNAQA

SEQ ID NO: 486521 - protein, 9 aa, Influenza virus
TDGSANSQA

SEQ ID NO: 486522 - protein, 9 aa, Influenza virus
TDGSASGKA

SEQ ID NO: 486523 - protein, 9 aa, Influenza virus
TDGSASGQA

SEQ ID NO: 486524 - protein, 9 aa, Influenza virus
TDGSASGRA

SEQ ID NO: 486525 - protein, 9 aa, Influenza virus
TDGSASRKA

SEQ ID NO: 486526 - protein, 9 aa, Influenza virus
TDGSASSQA

SEQ ID NO: 486527 - protein, 9 aa, Influenza virus
TDGSASSRA

SEQ ID NO: 486528 - protein, 9 aa, Influenza virus
TDGSATGKA

SEQ ID NO: 486529 - protein, 9 aa, Influenza virus
TDGSATGPA

SEQ ID NO: 486530 - protein, 9 aa, Influenza virus
TDIWAYNAE

SEQ ID NO: 486531 - protein, 9 aa, Influenza virus
TDIWSYNAK

SEQ ID NO: 486532 - protein, 9 aa, Influenza virus
TDIWSYNAR

SEQ ID NO: 486533 - protein, 9 aa, Influenza virus
TDIWTYQAE

SEQ ID NO: 486534 - protein, 9 aa, Influenza virus
TDKDSNGVQ

SEQ ID NO: 486535 - protein, 9 aa, Influenza virus
TDKGSIQSD

SEQ ID NO: 486536 - protein, 9 aa, Influenza virus
TDKIDTLTE

SEQ ID NO: 486537 - protein, 9 aa, Influenza virus
TDKNSNGVQ

SEQ ID NO: 486538 - protein, 9 aa, Influenza virus
TDKVDTIIE

SEQ ID NO: 486539 - protein, 9 aa, Influenza virus
TDKVDTLTE

SEQ ID NO: 486540 - protein, 9 aa, Influenza virus
TDKVNTIIE

SEQ ID NO: 486541 - protein, 9 aa, Influenza virus
TDLEALMEW

SEQ ID NO: 486542 - protein, 9 aa, Influenza virus
TDLGAPLEL

SEQ ID NO: 486543 - protein, 9 aa, Influenza virus
TDLGQCGIL

SEQ ID NO: 486544 - protein, 9 aa, Influenza virus
TDLGQCGLL

SEQ ID NO: 486545 - protein, 9 aa, Influenza virus
TDLGSPLEL

SEQ ID NO: 486546 - protein, 9 aa, Influenza virus
TDLGTPLEL

SEQ ID NO: 486547 - protein, 9 aa, Influenza virus
TDLYKVATG

SEQ ID NO: 486548 - protein, 9 aa, Influenza virus
TDMGQCGLL

SEQ ID NO: 486549 - protein, 9 aa, Influenza virus
TDNHVEVVS

SEQ ID NO: 486550 - protein, 9 aa, Influenza virus
TDNPRPNDP

SEQ ID NO: 486551 - protein, 9 aa, Influenza virus
TDNYGVKGF

SEQ ID NO: 486552 - protein, 9 aa, Influenza virus
TDSEMDKLF

SEQ ID NO: 486553 - protein, 9 aa, Influenza virus
TDSEMLNLY

SEQ ID NO: 486554 - protein, 9 aa, Influenza virus
TDSEMNKLF

SEQ ID NO: 486555 - protein, 9 aa, Influenza virus
TDSEMNKLY

SEQ ID NO: 486556 - protein, 9 aa, Influenza virus
TDSEMNRLF

SEQ ID NO: 486557 - protein, 9 aa, Influenza virus
TDSEMSKLF

SEQ ID NO: 486558 - protein, 9 aa, Influenza virus
TDSEMSKLY

SEQ ID NO: 486559 - protein, 9 aa, Influenza virus
TDSIKSWRK

SEQ ID NO: 486560 - protein, 9 aa, Influenza virus
TDSIKSWRR

SEQ ID NO: 486561 - protein, 9 aa, Influenza virus
TDSQTATKR

SEQ ID NO: 486562 - protein, 9 aa, Influenza virus
TDTFKSWKG

SEQ ID NO: 486563 - protein, 9 aa, Influenza virus
TDTLKSWKG

SEQ ID NO: 486564 - protein, 9 aa, Influenza virus
TDTPRGEDS

SEQ ID NO: 486565 - protein, 9 aa, Influenza virus
TDTPRIQDS

SEQ ID NO: 486566 - protein, 9 aa, Influenza virus
TDTPRVQDD

SEQ ID NO: 486567 - protein, 9 aa, Influenza virus
TDTPRVQDG

SEQ ID NO: 486568 - protein, 9 aa, Influenza virus
TDTPRVQDN

SEQ ID NO: 486569 - protein, 9 aa, Influenza virus
TDTPRVQDS

SEQ ID NO: 486570 - protein, 9 aa, Influenza virus
TDTSKPSDK

SEQ ID NO: 486571 - protein, 9 aa, Influenza virus
TDTSRPGDK

SEQ ID NO: 486572 - protein, 9 aa, Influenza virus
TDTSRPGDR

SEQ ID NO: 486573 - protein, 9 aa, Influenza virus
TDTSRPKDK

SEQ ID NO: 486574 - protein, 9 aa, Influenza virus
TDTSRPNDP

SEQ ID NO: 486575 - protein, 9 aa, Influenza virus
TDTSRPSDK

SEQ ID NO: 486576 - protein, 9 aa, Influenza virus
TDTSRPSDP

SEQ ID NO: 486577 - protein, 9 aa, Influenza virus
TDTSRPSDR

SEQ ID NO: 486578 - protein, 9 aa, Influenza virus
TDTSRPTDP

SEQ ID NO: 486579 - protein, 9 aa, Influenza virus
TDTVDTILE

SEQ ID NO: 486580 - protein, 9 aa, Influenza virus
TDTVDTLIE

SEQ ID NO: 486581 - protein, 9 aa, Influenza virus
TDTVDTLLE

SEQ ID NO: 486582 - protein, 9 aa, Influenza virus
TDTVDTLTE

SEQ ID NO: 486583 - protein, 9 aa, Influenza virus
TDTVDTVLE

SEQ ID NO: 486584 - protein, 9 aa, Influenza virus
TDTVDTVRE

SEQ ID NO: 486585 - protein, 9 aa, Influenza virus
TDTVNTLIE

SEQ ID NO: 486586 - protein, 9 aa, Influenza virus
TDTVNTLME

SEQ ID NO: 486587 - protein, 9 aa, Influenza virus
TDTVNTLTE

SEQ ID NO: 486588 - protein, 9 aa, Influenza virus
TDVIRSWRK

SEQ ID NO: 486589 - protein, 9 aa, Influenza virus
TDVVNFLSM

SEQ ID NO: 486590 - protein, 9 aa, Influenza virus
TDVVNFVSM

SEQ ID NO: 486591 - protein, 9 aa, Influenza virus
TDVVNYVSM

SEQ ID NO: 486592 - protein, 9 aa, Influenza virus
TDVVRSWKK

SEQ ID NO: 486593 - protein, 9 aa, Influenza virus
TDVVRSWRK

SEQ ID NO: 486594 - protein, 9 aa, Influenza virus
TDVVRSWRR

SEQ ID NO: 486595 - protein, 9 aa, Influenza virus
TDVWSYNAK

SEQ ID NO: 486596 - protein, 9 aa, Influenza virus
TDVYCICRD

SEQ ID NO: 486597 - protein, 9 aa, Influenza virus
TDWSGYSGS

SEQ ID NO: 486598 - protein, 9 aa, Influenza virus
TECQLNEGI

SEQ ID NO: 486599 - protein, 9 aa, Influenza virus
TECQLNEGV

SEQ ID NO: 486600 - protein, 9 aa, Influenza virus
TECRTFFLT

SEQ ID NO: 486601 - protein, 9 aa, Influenza virus
TEDNIYKIL

SEQ ID NO: 486602 - protein, 9 aa, Influenza virus
TEDNVYKIL

SEQ ID NO: 486603 - protein, 9 aa, Influenza virus
TEDNVYKVL

SEQ ID NO: 486604 - protein, 9 aa, Influenza virus
TEEQAVDIC

SEQ ID NO: 486605 - protein, 9 aa, Influenza virus
TEEQAVGIC

SEQ ID NO: 486606 - protein, 9 aa, Influenza virus
TEEQAVNIC

SEQ ID NO: 486607 - protein, 9 aa, Influenza virus
TEFESIESE

SEQ ID NO: 486608 - protein, 9 aa, Influenza virus
TEFLGQWDW

SEQ ID NO: 486609 - protein, 9 aa, Influenza virus
TEFLGQWNW

SEQ ID NO: 486610 - protein, 9 aa, Influenza virus
TEGHIEECS

SEQ ID NO: 486611 - protein, 9 aa, Influenza virus
TEGRTSDMR

SEQ ID NO: 486612 - protein, 9 aa, Influenza virus
TEHQIGNVI

SEQ ID NO: 486613 - protein, 9 aa, Influenza virus
TEIASWAGN

SEQ ID NO: 486614 - protein, 9 aa, Influenza virus
TEIGAPQLN

SEQ ID NO: 486615 - protein, 9 aa, Influenza virus
TEIGVTRRE

SEQ ID NO: 486616 - protein, 9 aa, Influenza virus
TEIIIRMME

SEQ ID NO: 486617 - protein, 9 aa, Influenza virus
TEIMYLNNT

SEQ ID NO: 486618 - protein, 9 aa, Influenza virus
TEINTWARN

SEQ ID NO: 486619 - protein, 9 aa, Influenza virus
TEIPSWAGN

SEQ ID NO: 486620 - protein, 9 aa, Influenza virus
TEIPSWEGN

SEQ ID NO: 486621 - protein, 9 aa, Influenza virus
TEIRASVGK

SEQ ID NO: 486622 - protein, 9 aa, Influenza virus
TEIRASVGR

SEQ ID NO: 486623 - protein, 9 aa, Influenza virus
TEIRSSVGK

SEQ ID NO: 486624 - protein, 9 aa, Influenza virus
TEIRTSVGR

SEQ ID NO: 486625 - protein, 9 aa, Influenza virus
TEISFTITG

SEQ ID NO: 486626 - protein, 9 aa, Influenza virus
TEIVYLNDT

SEQ ID NO: 486627 - protein, 9 aa, Influenza virus
TEIVYLNHT

SEQ ID NO: 486628 - protein, 9 aa, Influenza virus
TEIVYLNNT

SEQ ID NO: 486629 - protein, 9 aa, Influenza virus
TEIVYLNST

SEQ ID NO: 486630 - protein, 9 aa, Influenza virus
TEIWSYNAE

SEQ ID NO: 486631 - protein, 9 aa, Influenza virus
TEIYNETVR

SEQ ID NO: 486632 - protein, 9 aa, Influenza virus
TEKGIEVVN

SEQ ID NO: 486633 - protein, 9 aa, Influenza virus
TEKGVEVVN

SEQ ID NO: 486634 - protein, 9 aa, Influenza virus
TEKVDTIIE

SEQ ID NO: 486635 - protein, 9 aa, Influenza virus
TEKVDTLLE

SEQ ID NO: 486636 - protein, 9 aa, Influenza virus
TELGAPLVL

SEQ ID NO: 486637 - protein, 9 aa, Influenza virus
TELGSPLVL

SEQ ID NO: 486638 - protein, 9 aa, Influenza virus
TELINPNKW

SEQ ID NO: 486639 - protein, 9 aa, Influenza virus
TELINPSKW

SEQ ID NO: 486640 - protein, 9 aa, Influenza virus
TELIPPSKW

SEQ ID NO: 486641 - protein, 9 aa, Influenza virus
TELISPNKW

SEQ ID NO: 486642 - protein, 9 aa, Influenza virus
TELISPSKW

SEQ ID NO: 486643 - protein, 9 aa, Influenza virus
TELLVLMEN

SEQ ID NO: 486644 - protein, 9 aa, Influenza virus
TELPFQNLS

SEQ ID NO: 486645 - protein, 9 aa, Influenza virus
TELSFTITG

SEQ ID NO: 486646 - protein, 9 aa, Influenza virus
TELSFTVTG

SEQ ID NO: 486647 - protein, 9 aa, Influenza virus
TELWSYNAE

SEQ ID NO: 486648 - protein, 9 aa, Influenza virus
TEMWSYNAE

SEQ ID NO: 486649 - protein, 9 aa, Influenza virus
TENGVPVTS

SEQ ID NO: 486650 - protein, 9 aa, Influenza virus
TENPVICLG

SEQ ID NO: 486651 - protein, 9 aa, Influenza virus
TENSFEQIT

SEQ ID NO: 486652 - protein, 9 aa, Influenza virus
TEPLCDVSG

SEQ ID NO: 486653 - protein, 9 aa, Influenza virus
TEPLCEVSG

SEQ ID NO: 486654 - protein, 9 aa, Influenza virus
TEPLCNVSG

SEQ ID NO: 486655 - protein, 9 aa, Influenza virus
TEQNVPVTQ

SEQ ID NO: 486656 - protein, 9 aa, Influenza virus
TEQTKLYGS

SEQ ID NO: 486657 - protein, 9 aa, Influenza virus
TEQTKLYKN

SEQ ID NO: 486658 - protein, 9 aa, Influenza virus
TEQVDTIME

SEQ ID NO: 486659 - protein, 9 aa, Influenza virus
TEREVEVVN

SEQ ID NO: 486660 - protein, 9 aa, Influenza virus
TERGIEVVN

SEQ ID NO: 486661 - protein, 9 aa, Influenza virus
TERGVEVVD

SEQ ID NO: 486662 - protein, 9 aa, Influenza virus
TERGVEVVN

SEQ ID NO: 486663 - protein, 9 aa, Influenza virus
TERQEIVDN

SEQ ID NO: 486664 - protein, 9 aa, Influenza virus
TERQEIVGN

SEQ ID NO: 486665 - protein, 9 aa, Influenza virus
TERVDTIIE

SEQ ID NO: 486666 - protein, 9 aa, Influenza virus
TERVDTIME

SEQ ID NO: 486667 - protein, 9 aa, Influenza virus
TESLQNRIQ

SEQ ID NO: 486668 - protein, 9 aa, Influenza virus
TESRGLFGA

SEQ ID NO: 486669 - protein, 9 aa, Influenza virus
TESSFEQIT

SEQ ID NO: 486670 - protein, 9 aa, Influenza virus
TETGALQLN

SEQ ID NO: 486671 - protein, 9 aa, Influenza virus
TETGAPQLN

SEQ ID NO: 486672 - protein, 9 aa, Influenza virus
TETGVPVTS

SEQ ID NO: 486673 - protein, 9 aa, Influenza virus
TETKAPQLN

SEQ ID NO: 486674 - protein, 9 aa, Influenza virus
TETLYLNHT

SEQ ID NO: 486675 - protein, 9 aa, Influenza virus
TETVEITGI

SEQ ID NO: 486676 - protein, 9 aa, Influenza virus
TETVNTLIE

SEQ ID NO: 486677 - protein, 9 aa, Influenza virus
TETVNTLSE

SEQ ID NO: 486678 - protein, 9 aa, Influenza virus
TETVNTLTE

SEQ ID NO: 486679 - protein, 9 aa, Influenza virus
TEVEGRIQD

SEQ ID NO: 486680 - protein, 9 aa, Influenza virus
TEVEKQIGN

SEQ ID NO: 486681 - protein, 9 aa, Influenza virus
TEVEQQIGN

SEQ ID NO: 486682 - protein, 9 aa, Influenza virus
TEVERQIGN

SEQ ID NO: 486683 - protein, 9 aa, Influenza virus
TEVETYVLS

SEQ ID NO: 486684 - protein, 9 aa, Influenza virus
TEVSHCRAT

SEQ ID NO: 486685 - protein, 9 aa, Influenza virus
TEVWSYNAD

SEQ ID NO: 486686 - protein, 9 aa, Influenza virus
TEVWSYNAE

SEQ ID NO: 486687 - protein, 9 aa, Influenza virus
TEVYNETVR

SEQ ID NO: 486688 - protein, 9 aa, Influenza virus
TEVYSETVR

SEQ ID NO: 486689 - protein, 9 aa, Influenza virus
TEWSGYSGS

SEQ ID NO: 486690 - protein, 9 aa, Influenza virus
TEYIIKGVY

SEQ ID NO: 486691 - protein, 9 aa, Influenza virus
TEYIMKGVY

SEQ ID NO: 486692 - protein, 9 aa, Influenza virus
TEYMMKGVY

SEQ ID NO: 486693 - protein, 9 aa, Influenza virus
TEYRQEALQ

SEQ ID NO: 486694 - protein, 9 aa, Influenza virus
TFCGLDNEP

SEQ ID NO: 486695 - protein, 9 aa, Influenza virus
TFCGLNNEP

SEQ ID NO: 486696 - protein, 9 aa, Influenza virus
TFDSLNITA

SEQ ID NO: 486697 - protein, 9 aa, Influenza virus
TFDTAQIIK

SEQ ID NO: 486698 - protein, 9 aa, Influenza virus
TFDTIQIIK

SEQ ID NO: 486699 - protein, 9 aa, Influenza virus
TFDTTQIIK

SEQ ID NO: 486700 - protein, 9 aa, Influenza virus
TFDTVQIIK

SEQ ID NO: 486701 - protein, 9 aa, Influenza virus
TFDTVQVIK

SEQ ID NO: 486702 - protein, 9 aa, Influenza virus
TFDWTLNRN

SEQ ID NO: 486703 - protein, 9 aa, Influenza virus
TFEFTSFFY

SEQ ID NO: 486704 - protein, 9 aa, Influenza virus
TFESDGAFL

SEQ ID NO: 486705 - protein, 9 aa, Influenza virus
TFESNGAFI

SEQ ID NO: 486706 - protein, 9 aa, Influenza virus
TFESNGAFL

SEQ ID NO: 486707 - protein, 9 aa, Influenza virus
TFESNGALL

SEQ ID NO: 486708 - protein, 9 aa, Influenza virus
TFESNGGFL

SEQ ID NO: 486709 - protein, 9 aa, Influenza virus
TFESNGGLI

SEQ ID NO: 486710 - protein, 9 aa, Influenza virus
TFESNGGLL

SEQ ID NO: 486711 - protein, 9 aa, Influenza virus
TFESNGVFL

SEQ ID NO: 486712 - protein, 9 aa, Influenza virus
TFESSGGLL

SEQ ID NO: 486713 - protein, 9 aa, Influenza virus
TFFLTHGAL

SEQ ID NO: 486714 - protein, 9 aa, Influenza virus
TFFLTHGSL

SEQ ID NO: 486715 - protein, 9 aa, Influenza virus
TFFLTQGAL

SEQ ID NO: 486716 - protein, 9 aa, Influenza virus
TFFLTQGSL

SEQ ID NO: 486717 - protein, 9 aa, Influenza virus
TFGDCPKYV

SEQ ID NO: 486718 - protein, 9 aa, Influenza virus
TFGPVHFQN

SEQ ID NO: 486719 - protein, 9 aa, Influenza virus
TFGPVHFRN

SEQ ID NO: 486720 - protein, 9 aa, Influenza virus
TFGPVHFRS

SEQ ID NO: 486721 - protein, 9 aa, Influenza virus
TFHGAKEIA

SEQ ID NO: 486722 - protein, 9 aa, Influenza virus
TFHGAKEIS

SEQ ID NO: 486723 - protein, 9 aa, Influenza virus
TFHGAKEVA

SEQ ID NO: 486724 - protein, 9 aa, Influenza virus
TFHGAKEVS

SEQ ID NO: 486725 - protein, 9 aa, Influenza virus
TFIFNGAFI

SEQ ID NO: 486726 - protein, 9 aa, Influenza virus
TFILWACQN

SEQ ID NO: 486727 - protein, 9 aa, Influenza virus
TFIQALQLL

SEQ ID NO: 486728 - protein, 9 aa, Influenza virus
TFKRTKGFS

SEQ ID NO: 486729 - protein, 9 aa, Influenza virus
TFKRTKGSS

SEQ ID NO: 486730 - protein, 9 aa, Influenza virus
TFKRTSGSS

SEQ ID NO: 486731 - protein, 9 aa, Influenza virus
TFKRTSGTS

SEQ ID NO: 486732 - protein, 9 aa, Influenza virus
TFKSWKGNI

SEQ ID NO: 486733 - protein, 9 aa, Influenza virus
TFKVIGGWS

SEQ ID NO: 486734 - protein, 9 aa, Influenza virus
TFKVIGGWT

SEQ ID NO: 486735 - protein, 9 aa, Influenza virus
TFLAMITYI

SEQ ID NO: 486736 - protein, 9 aa, Influenza virus
TFLARSALI

SEQ ID NO: 486737 - protein, 9 aa, Influenza virus
TFLHNGGLI

SEQ ID NO: 486738 - protein, 9 aa, Influenza virus
TFLQALQLL

SEQ ID NO: 486739 - protein, 9 aa, Influenza virus
TFLRSNAPS

SEQ ID NO: 486740 - protein, 9 aa, Influenza virus
TFMQALQLL

SEQ ID NO: 486741 - protein, 9 aa, Influenza virus
TFNFNGAFV

SEQ ID NO: 486742 - protein, 9 aa, Influenza virus
TFNGAFIAP

SEQ ID NO: 486743 - protein, 9 aa, Influenza virus
TFPYTGDPP

SEQ ID NO: 486744 - protein, 9 aa, Influenza virus
TFQNIDKNA

SEQ ID NO: 486745 - protein, 9 aa, Influenza virus
TFQNIDRNA

SEQ ID NO: 486746 - protein, 9 aa, Influenza virus
TFQNIEKNA

SEQ ID NO: 486747 - protein, 9 aa, Influenza virus
TFQNIERNA

SEQ ID NO: 486748 - protein, 9 aa, Influenza virus
TFQNISPVW

SEQ ID NO: 486749 - protein, 9 aa, Influenza virus
TFQNVSPIW

SEQ ID NO: 486750 - protein, 9 aa, Influenza virus
TFQNVSPLW

SEQ ID NO: 486751 - protein, 9 aa, Influenza virus
TFQNVSPVW

SEQ ID NO: 486752 - protein, 9 aa, Influenza virus
TFRGLLSTP

SEQ ID NO: 486753 - protein, 9 aa, Influenza virus
TFRVIDGWT

SEQ ID NO: 486754 - protein, 9 aa, Influenza virus
TFRVIGGWA

SEQ ID NO: 486755 - protein, 9 aa, Influenza virus
TFRVIGGWT

SEQ ID NO: 486756 - protein, 9 aa, Influenza virus
TFRVIGGWV

SEQ ID NO: 486757 - protein, 9 aa, Influenza virus
TFRVISGWT

SEQ ID NO: 486758 - protein, 9 aa, Influenza virus
TFSDNGGLI

SEQ ID NO: 486759 - protein, 9 aa, Influenza virus
TFSFNGAFI

SEQ ID NO: 486760 - protein, 9 aa, Influenza virus
TFSFNGAFV

SEQ ID NO: 486761 - protein, 9 aa, Influenza virus
TFSFQLILI

SEQ ID NO: 486762 - protein, 9 aa, Influenza virus
TFSFQLILL

SEQ ID NO: 486763 - protein, 9 aa, Influenza virus
TFSFQLINN

SEQ ID NO: 486764 - protein, 9 aa, Influenza virus
TFSHNGGLI

SEQ ID NO: 486765 - protein, 9 aa, Influenza virus
TFSHNGGRI

SEQ ID NO: 486766 - protein, 9 aa, Influenza virus
TFSPRSRSG

SEQ ID NO: 486767 - protein, 9 aa, Influenza virus
TFSVQRNLP

SEQ ID NO: 486768 - protein, 9 aa, Influenza virus
TFSVQRSLP

SEQ ID NO: 486769 - protein, 9 aa, Influenza virus
TFTFNGAFI

SEQ ID NO: 486770 - protein, 9 aa, Influenza virus
TFVNITNVQ

SEQ ID NO: 486771 - protein, 9 aa, Influenza virus
TFVNVTHVQ

SEQ ID NO: 486772 - protein, 9 aa, Influenza virus
TFVNVTNVQ

SEQ ID NO: 486773 - protein, 9 aa, Influenza virus
TGAINSSKP

SEQ ID NO: 486774 - protein, 9 aa, Influenza virus
TGAINSSRP

SEQ ID NO: 486775 - protein, 9 aa, Influenza virus
TGALASCMG

SEQ ID NO: 486776 - protein, 9 aa, Influenza virus
TGALQLNPI

SEQ ID NO: 486777 - protein, 9 aa, Influenza virus
TGAPQLNPI

SEQ ID NO: 486778 - protein, 9 aa, Influenza virus
TGAPQLNPV

SEQ ID NO: 486779 - protein, 9 aa, Influenza virus
TGAQSFYRS

SEQ ID NO: 486780 - protein, 9 aa, Influenza virus
TGARRIDFH

SEQ ID NO: 486781 - protein, 9 aa, Influenza virus
TGCFEIFHK

SEQ ID NO: 486782 - protein, 9 aa, Influenza virus
TGCFEIFHR

SEQ ID NO: 486783 - protein, 9 aa, Influenza virus
TGCKMYALH

SEQ ID NO: 486784 - protein, 9 aa, Influenza virus
TGCQLNEGV

SEQ ID NO: 486785 - protein, 9 aa, Influenza virus
TGDDGNATA

SEQ ID NO: 486786 - protein, 9 aa, Influenza virus
TGDDKNATA

SEQ ID NO: 486787 - protein, 9 aa, Influenza virus
TGDDRKATA

SEQ ID NO: 486788 - protein, 9 aa, Influenza virus
TGDDRNATA

SEQ ID NO: 486789 - protein, 9 aa, Influenza virus
TGDGCFEIL

SEQ ID NO: 486790 - protein, 9 aa, Influenza virus
TGDNTKWNE

SEQ ID NO: 486791 - protein, 9 aa, Influenza virus
TGDPPYSHG

SEQ ID NO: 486792 - protein, 9 aa, Influenza virus
TGFAPFSKD

SEQ ID NO: 486793 - protein, 9 aa, Influenza virus
TGFASFSKD

SEQ ID NO: 486794 - protein, 9 aa, Influenza virus
TGFHFEECS

SEQ ID NO: 486795 - protein, 9 aa, Influenza virus
TGFTYSGIR

SEQ ID NO: 486796 - protein, 9 aa, Influenza virus
TGGQAFYRS

SEQ ID NO: 486797 - protein, 9 aa, Influenza virus
TGGQSFYRS

SEQ ID NO: 486798 - protein, 9 aa, Influenza virus
TGIAADKAS

SEQ ID NO: 486799 - protein, 9 aa, Influenza virus
TGIAADKES

SEQ ID NO: 486800 - protein, 9 aa, Influenza virus
TGIAADKTS

SEQ ID NO: 486801 - protein, 9 aa, Influenza virus
TGIAADKVS

SEQ ID NO: 486802 - protein, 9 aa, Influenza virus
TGIAADRDS

SEQ ID NO: 486803 - protein, 9 aa, Influenza virus
TGIAADRES

SEQ ID NO: 486804 - protein, 9 aa, Influenza virus
TGIAADRGS

SEQ ID NO: 486805 - protein, 9 aa, Influenza virus
TGIAAEKES

SEQ ID NO: 486806 - protein, 9 aa, Influenza virus
TGIDKVCTK

SEQ ID NO: 486807 - protein, 9 aa, Influenza virus
TGILTDTSR

SEQ ID NO: 486808 - protein, 9 aa, Influenza virus
TGINKVCTK

SEQ ID NO: 486809 - protein, 9 aa, Influenza virus
TGIVADRDS

SEQ ID NO: 486810 - protein, 9 aa, Influenza virus
TGIWDTLIE

SEQ ID NO: 486811 - protein, 9 aa, Influenza virus
TGKDPKKTG

SEQ ID NO: 486812 - protein, 9 aa, Influenza virus
TGKGCFDIL

SEQ ID NO: 486813 - protein, 9 aa, Influenza virus
TGKLNRFIE

SEQ ID NO: 486814 - protein, 9 aa, Influenza virus
TGKLNRIIE

SEQ ID NO: 486815 - protein, 9 aa, Influenza virus
TGKLNRLID

SEQ ID NO: 486816 - protein, 9 aa, Influenza virus
TGKLNRLIE

SEQ ID NO: 486817 - protein, 9 aa, Influenza virus
TGKLNRLIG

SEQ ID NO: 486818 - protein, 9 aa, Influenza virus
TGKLNRLIS

SEQ ID NO: 486819 - protein, 9 aa, Influenza virus
TGKSHGRIL

SEQ ID NO: 486820 - protein, 9 aa, Influenza virus
TGKSHGRVL

SEQ ID NO: 486821 - protein, 9 aa, Influenza virus
TGLDCIRPC

SEQ ID NO: 486822 - protein, 9 aa, Influenza virus
TGLDCMRPC

SEQ ID NO: 486823 - protein, 9 aa, Influenza virus
TGLIDGWYG

SEQ ID NO: 486824 - protein, 9 aa, Influenza virus
TGLNCIRPC

SEQ ID NO: 486825 - protein, 9 aa, Influenza virus
TGLNCMRPC

SEQ ID NO: 486826 - protein, 9 aa, Influenza virus
TGLRNAHKM

SEQ ID NO: 486827 - protein, 9 aa, Influenza virus
TGLRNIPAI

SEQ ID NO: 486828 - protein, 9 aa, Influenza virus
TGLRNIPQI

SEQ ID NO: 486829 - protein, 9 aa, Influenza virus
TGLRNIPSI

SEQ ID NO: 486830 - protein, 9 aa, Influenza virus
TGLRNVPAI

SEQ ID NO: 486831 - protein, 9 aa, Influenza virus
TGLRNVPIP

SEQ ID NO: 486832 - protein, 9 aa, Influenza virus
TGLRNVPQI

SEQ ID NO: 486833 - protein, 9 aa, Influenza virus
TGLRNVPQM

SEQ ID NO: 486834 - protein, 9 aa, Influenza virus
TGLRNVPSI

SEQ ID NO: 486835 - protein, 9 aa, Influenza virus
TGLRNVPSV

SEQ ID NO: 486836 - protein, 9 aa, Influenza virus
TGMAADQKS

SEQ ID NO: 486837 - protein, 9 aa, Influenza virus
TGMAADRDS

SEQ ID NO: 486838 - protein, 9 aa, Influenza virus
TGMALSVVS

SEQ ID NO: 486839 - protein, 9 aa, Influenza virus
TGMDPRMCS

SEQ ID NO: 486840 - protein, 9 aa, Influenza virus
TGMIDGWYG

SEQ ID NO: 486841 - protein, 9 aa, Influenza virus
TGMILSVVS

SEQ ID NO: 486842 - protein, 9 aa, Influenza virus
TGMKNVPEI

SEQ ID NO: 486843 - protein, 9 aa, Influenza virus
TGMKNVPET

SEQ ID NO: 486844 - protein, 9 aa, Influenza virus
TGMRILVRG

SEQ ID NO: 486845 - protein, 9 aa, Influenza virus
TGMRNIPEK

SEQ ID NO: 486846 - protein, 9 aa, Influenza virus
TGMRNIPEN

SEQ ID NO: 486847 - protein, 9 aa, Influenza virus
TGMRNIPER

SEQ ID NO: 486848 - protein, 9 aa, Influenza virus
TGMRNIPGK

SEQ ID NO: 486849 - protein, 9 aa, Influenza virus
TGMRNVPEI

SEQ ID NO: 486850 - protein, 9 aa, Influenza virus
TGMRNVPEK

SEQ ID NO: 486851 - protein, 9 aa, Influenza virus
TGMRNVPEN

SEQ ID NO: 486852 - protein, 9 aa, Influenza virus
TGMRNVPER

SEQ ID NO: 486853 - protein, 9 aa, Influenza virus
TGMRNVPET

SEQ ID NO: 486854 - protein, 9 aa, Influenza virus
TGMRNVPEV

SEQ ID NO: 486855 - protein, 9 aa, Influenza virus
TGMTLSVVN

SEQ ID NO: 486856 - protein, 9 aa, Influenza virus
TGMTLSVVS

SEQ ID NO: 486857 - protein, 9 aa, Influenza virus
TGMVDGWYG

SEQ ID NO: 486858 - protein, 9 aa, Influenza virus
TGMVNGWYG

SEQ ID NO: 486859 - protein, 9 aa, Influenza virus
TGMWDTLIE

SEQ ID NO: 486860 - protein, 9 aa, Influenza virus
TGNDRNATA

SEQ ID NO: 486861 - protein, 9 aa, Influenza virus
TGNFIAPEY

SEQ ID NO: 486862 - protein, 9 aa, Influenza virus
TGNGCFDIL

SEQ ID NO: 486863 - protein, 9 aa, Influenza virus
TGNGCFEFY

SEQ ID NO: 486864 - protein, 9 aa, Influenza virus
TGNHGSLVL

SEQ ID NO: 486865 - protein, 9 aa, Influenza virus
TGNKLITVG

SEQ ID NO: 486866 - protein, 9 aa, Influenza virus
TGNLIAPEY

SEQ ID NO: 486867 - protein, 9 aa, Influenza virus
TGNLIAPRG

SEQ ID NO: 486868 - protein, 9 aa, Influenza virus
TGNLQALKI

SEQ ID NO: 486869 - protein, 9 aa, Influenza virus
TGNLQTLKI

SEQ ID NO: 486870 - protein, 9 aa, Influenza virus
TGNLQTLKL

SEQ ID NO: 486871 - protein, 9 aa, Influenza virus
TGNLQTLKV

SEQ ID NO: 486872 - protein, 9 aa, Influenza virus
TGNLQTLRI

SEQ ID NO: 486873 - protein, 9 aa, Influenza virus
TGNLVAPEY

SEQ ID NO: 486874 - protein, 9 aa, Influenza virus
TGNPIICLG

SEQ ID NO: 486875 - protein, 9 aa, Influenza virus
TGNPVICLG

SEQ ID NO: 486876 - protein, 9 aa, Influenza virus
TGNPVICMG

SEQ ID NO: 486877 - protein, 9 aa, Influenza virus
TGPADTRIY

SEQ ID NO: 486878 - protein, 9 aa, Influenza virus
TGPADTRVY

SEQ ID NO: 486879 - protein, 9 aa, Influenza virus
TGPAETRIY

SEQ ID NO: 486880 - protein, 9 aa, Influenza virus
TGPAETRVY

SEQ ID NO: 486881 - protein, 9 aa, Influenza virus
TGPDATAVA

SEQ ID NO: 486882 - protein, 9 aa, Influenza virus
TGPDSTAVA

SEQ ID NO: 486883 - protein, 9 aa, Influenza virus
TGPDTTAVA

SEQ ID NO: 486884 - protein, 9 aa, Influenza virus
TGPPQCDLF

SEQ ID NO: 486885 - protein, 9 aa, Influenza virus
TGPPQCDQF

SEQ ID NO: 486886 - protein, 9 aa, Influenza virus
TGPRNVPAI

SEQ ID NO: 486887 - protein, 9 aa, Influenza virus
TGPRNVPQI

SEQ ID NO: 486888 - protein, 9 aa, Influenza virus
TGQAADLKS

SEQ ID NO: 486889 - protein, 9 aa, Influenza virus
TGQAADYES

SEQ ID NO: 486890 - protein, 9 aa, Influenza virus
TGQAADYKS

SEQ ID NO: 486891 - protein, 9 aa, Influenza virus
TGRDVLVIW

SEQ ID NO: 486892 - protein, 9 aa, Influenza virus
TGRDVLVLW

SEQ ID NO: 486893 - protein, 9 aa, Influenza virus
TGRDVLVMW

SEQ ID NO: 486894 - protein, 9 aa, Influenza virus
TGRGIEVVN

SEQ ID NO: 486895 - protein, 9 aa, Influenza virus
TGRIDFHWL

SEQ ID NO: 486896 - protein, 9 aa, Influenza virus
TGRIFQSGI

SEQ ID NO: 486897 - protein, 9 aa, Influenza virus
TGRIFQSGV

SEQ ID NO: 486898 - protein, 9 aa, Influenza virus
TGRIFQSRI

SEQ ID NO: 486899 - protein, 9 aa, Influenza virus
TGRNCTIPC

SEQ ID NO: 486900 - protein, 9 aa, Influenza virus
TGRNCTVPC

SEQ ID NO: 486901 - protein, 9 aa, Influenza virus
TGRQEIVDN

SEQ ID NO: 486902 - protein, 9 aa, Influenza virus
TGRSSFFRN

SEQ ID NO: 486903 - protein, 9 aa, Influenza virus
TGRVTVSTR

SEQ ID NO: 486904 - protein, 9 aa, Influenza virus
TGSFCSIDG

SEQ ID NO: 486905 - protein, 9 aa, Influenza virus
TGSFCSING

SEQ ID NO: 486906 - protein, 9 aa, Influenza virus
TGSIYIEVL

SEQ ID NO: 486907 - protein, 9 aa, Influenza virus
TGSPGAPGV

SEQ ID NO: 486908 - protein, 9 aa, Influenza virus
TGSPSAPGV

SEQ ID NO: 486909 - protein, 9 aa, Influenza virus
TGSSFYAEM

SEQ ID NO: 486910 - protein, 9 aa, Influenza virus
TGSVYIEVL

SEQ ID NO: 486911 - protein, 9 aa, Influenza virus
TGSWADGAN

SEQ ID NO: 486912 - protein, 9 aa, Influenza virus
TGSWPDGAD

SEQ ID NO: 486913 - protein, 9 aa, Influenza virus
TGSWPDGAE

SEQ ID NO: 486914 - protein, 9 aa, Influenza virus
TGSWPDGAN

SEQ ID NO: 486915 - protein, 9 aa, Influenza virus
TGSYVRLYL

SEQ ID NO: 486916 - protein, 9 aa, Influenza virus
TGTAADLKS

SEQ ID NO: 486917 - protein, 9 aa, Influenza virus
TGTAKHIEE

SEQ ID NO: 486918 - protein, 9 aa, Influenza virus
TGTAKQNYL

SEQ ID NO: 486919 - protein, 9 aa, Influenza virus
TGTFCSING

SEQ ID NO: 486920 - protein, 9 aa, Influenza virus
TGTFEFTSF

SEQ ID NO: 486921 - protein, 9 aa, Influenza virus
TGTGYTMDT

SEQ ID NO: 486922 - protein, 9 aa, Influenza virus
TGTLNRLID

SEQ ID NO: 486923 - protein, 9 aa, Influenza virus
TGTNRPILV

SEQ ID NO: 486924 - protein, 9 aa, Influenza virus
TGTNRPVLI

SEQ ID NO: 486925 - protein, 9 aa, Influenza virus
TGTNRPVLV

SEQ ID NO: 486926 - protein, 9 aa, Influenza virus
TGTNRPVVV

SEQ ID NO: 486927 - protein, 9 aa, Influenza virus
TGTNSFYRN

SEQ ID NO: 486928 - protein, 9 aa, Influenza virus
TGTSSFYRN

SEQ ID NO: 486929 - protein, 9 aa, Influenza virus
TGTWDTLIE

SEQ ID NO: 486930 - protein, 9 aa, Influenza virus
TGTYCSLDG

SEQ ID NO: 486931 - protein, 9 aa, Influenza virus
TGTYCSLGG

SEQ ID NO: 486932 - protein, 9 aa, Influenza virus
TGTYCSLNG

SEQ ID NO: 486933 - protein, 9 aa, Influenza virus
TGTYCSLSG

SEQ ID NO: 486934 - protein, 9 aa, Influenza virus
TGVDCIRPC

SEQ ID NO: 486935 - protein, 9 aa, Influenza virus
TGVDEYSST

SEQ ID NO: 486936 - protein, 9 aa, Influenza virus
TGVESAVLR

SEQ ID NO: 486937 - protein, 9 aa, Influenza virus
TGVLTDTSR

SEQ ID NO: 486938 - protein, 9 aa, Influenza virus
TGVPVTSSV

SEQ ID NO: 486939 - protein, 9 aa, Influenza virus
TGVTLSVVS

SEQ ID NO: 486940 - protein, 9 aa, Influenza virus
TGWSWPDGA

SEQ ID NO: 486941 - protein, 9 aa, Influenza virus
TGYAQTDCV

SEQ ID NO: 486942 - protein, 9 aa, Influenza virus
TGYEKNATA

SEQ ID NO: 486943 - protein, 9 aa, Influenza virus
TGYHFEECS

SEQ ID NO: 486944 - protein, 9 aa, Influenza virus
TGYICSKFH

SEQ ID NO: 486945 - protein, 9 aa, Influenza virus
TGYTMDTVN

SEQ ID NO: 486946 - protein, 9 aa, Influenza virus
TGYTMDTVS

SEQ ID NO: 486947 - protein, 9 aa, Influenza virus
TGYVCSKFH

SEQ ID NO: 486948 - protein, 9 aa, Influenza virus
THAEDILEK

SEQ ID NO: 486949 - protein, 9 aa, Influenza virus
THAKDILEK

SEQ ID NO: 486950 - protein, 9 aa, Influenza virus
THAKNILEK

SEQ ID NO: 486951 - protein, 9 aa, Influenza virus
THALRELWQ

SEQ ID NO: 486952 - protein, 9 aa, Influenza virus
THAQDILEK

SEQ ID NO: 486953 - protein, 9 aa, Influenza virus
THAQDILER

SEQ ID NO: 486954 - protein, 9 aa, Influenza virus
THAQDLLEK

SEQ ID NO: 486955 - protein, 9 aa, Influenza virus
THAQNILEK

SEQ ID NO: 486956 - protein, 9 aa, Influenza virus
THDRTAFRG

SEQ ID NO: 486957 - protein, 9 aa, Influenza virus
THESECVCI

SEQ ID NO: 486958 - protein, 9 aa, Influenza virus
THFEKIKIL

SEQ ID NO: 486959 - protein, 9 aa, Influenza virus
THFEKVKIL

SEQ ID NO: 486960 - protein, 9 aa, Influenza virus
THFQRKRRI

SEQ ID NO: 486961 - protein, 9 aa, Influenza virus
THFQRKRRV

SEQ ID NO: 486962 - protein, 9 aa, Influenza virus
THGALLNDK

SEQ ID NO: 486963 - protein, 9 aa, Influenza virus
THGSLLNDK

SEQ ID NO: 486964 - protein, 9 aa, Influenza virus
THGTGSWPD

SEQ ID NO: 486965 - protein, 9 aa, Influenza virus
THHMRKKRG

SEQ ID NO: 486966 - protein, 9 aa, Influenza virus
THIHIFSFN

SEQ ID NO: 486967 - protein, 9 aa, Influenza virus
THIHIFSFT

SEQ ID NO: 486968 - protein, 9 aa, Influenza virus
THIMIWHSN

SEQ ID NO: 486969 - protein, 9 aa, Influenza virus
THISKYLCS

SEQ ID NO: 486970 - protein, 9 aa, Influenza virus
THISVGTST

SEQ ID NO: 486971 - protein, 9 aa, Influenza virus
THKQLTHHM

SEQ ID NO: 486972 - protein, 9 aa, Influenza virus
THLEICFMY

SEQ ID NO: 486973 - protein, 9 aa, Influenza virus
THLEVCFMY

SEQ ID NO: 486974 - protein, 9 aa, Influenza virus
THLMIWHSN

SEQ ID NO: 486975 - protein, 9 aa, Influenza virus
THMEVCFMY

SEQ ID NO: 486976 - protein, 9 aa, Influenza virus
THMMIWHSN

SEQ ID NO: 486977 - protein, 9 aa, Influenza virus
THMSKYLCS

SEQ ID NO: 486978 - protein, 9 aa, Influenza virus
THNGKLCKL

SEQ ID NO: 486979 - protein, 9 aa, Influenza virus
THNGKLCRL

SEQ ID NO: 486980 - protein, 9 aa, Influenza virus
THNGRLCKL

SEQ ID NO: 486981 - protein, 9 aa, Influenza virus
THQYSEKGK

SEQ ID NO: 486982 - protein, 9 aa, Influenza virus
THQYSEKGR

SEQ ID NO: 486983 - protein, 9 aa, Influenza virus
THQYSERGK

SEQ ID NO: 486984 - protein, 9 aa, Influenza virus
THQYSERGR

SEQ ID NO: 486985 - protein, 9 aa, Influenza virus
THSIELLEN

SEQ ID NO: 486986 - protein, 9 aa, Influenza virus
THSIELLES

SEQ ID NO: 486987 - protein, 9 aa, Influenza virus
THSSKYLCS

SEQ ID NO: 486988 - protein, 9 aa, Influenza virus
THSVELLED

SEQ ID NO: 486989 - protein, 9 aa, Influenza virus
THSVELLEN

SEQ ID NO: 486990 - protein, 9 aa, Influenza virus
THSVELLES

SEQ ID NO: 486991 - protein, 9 aa, Influenza virus
THSWIPKRN

SEQ ID NO: 486992 - protein, 9 aa, Influenza virus
THSWTPKRN

SEQ ID NO: 486993 - protein, 9 aa, Influenza virus
THSWVPILN

SEQ ID NO: 486994 - protein, 9 aa, Influenza virus
THSWVPKRN

SEQ ID NO: 486995 - protein, 9 aa, Influenza virus
THTGTSKAC

SEQ ID NO: 486996 - protein, 9 aa, Influenza virus
THTGTYCSL

SEQ ID NO: 486997 - protein, 9 aa, Influenza virus
THTSKYLCS

SEQ ID NO: 486998 - protein, 9 aa, Influenza virus
THTSQYICS

SEQ ID NO: 486999 - protein, 9 aa, Influenza virus
THTSRYLCS

SEQ ID NO: 487000 - protein, 9 aa, Influenza virus
THVQNNYTT

SEQ ID NO: 487001 - protein, 9 aa, Influenza virus
TIAGFIEGG

SEQ ID NO: 487002 - protein, 9 aa, Influenza virus
TIALFIGVG

SEQ ID NO: 487003 - protein, 9 aa, Influenza virus
TIALIIGVG

SEQ ID NO: 487004 - protein, 9 aa, Influenza virus
TIALLIGIG

SEQ ID NO: 487005 - protein, 9 aa, Influenza virus
TIALLIGVG

SEQ ID NO: 487006 - protein, 9 aa, Influenza virus
TIASDILKR

SEQ ID NO: 487007 - protein, 9 aa, Influenza virus
TIASDILTR

SEQ ID NO: 487008 - protein, 9 aa, Influenza virus
TIASSLPFQ

SEQ ID NO: 487009 - protein, 9 aa, Influenza virus
TICIGYHAN

SEQ ID NO: 487010 - protein, 9 aa, Influenza virus
TICIQGNND

SEQ ID NO: 487011 - protein, 9 aa, Influenza virus
TICVGYHAN

SEQ ID NO: 487012 - protein, 9 aa, Influenza virus
TICVQGNND

SEQ ID NO: 487013 - protein, 9 aa, Influenza virus
TICVQGNNK

SEQ ID NO: 487014 - protein, 9 aa, Influenza virus
TICVQGNNN

SEQ ID NO: 487015 - protein, 9 aa, Influenza virus
TIDEESRAR

SEQ ID NO: 487016 - protein, 9 aa, Influenza virus
TIDLADSEM

SEQ ID NO: 487017 - protein, 9 aa, Influenza virus
TIDLTDAEM

SEQ ID NO: 487018 - protein, 9 aa, Influenza virus
TIDLTDSEM

SEQ ID NO: 487019 - protein, 9 aa, Influenza virus
TIDLTNSEM

SEQ ID NO: 487020 - protein, 9 aa, Influenza virus
TIDMADSEM

SEQ ID NO: 487021 - protein, 9 aa, Influenza virus
TIDMTDSEM

SEQ ID NO: 487022 - protein, 9 aa, Influenza virus
TIDQITGKL

SEQ ID NO: 487023 - protein, 9 aa, Influenza virus
TIDQVTGKL

SEQ ID NO: 487024 - protein, 9 aa, Influenza virus
TIDSTDSEM

SEQ ID NO: 487025 - protein, 9 aa, Influenza virus
TIDVTDSEM

SEQ ID NO: 487026 - protein, 9 aa, Influenza virus
TIEKMVLSA

SEQ ID NO: 487027 - protein, 9 aa, Influenza virus
TIEMTDSEM

SEQ ID NO: 487028 - protein, 9 aa, Influenza virus
TIERMVLSA

SEQ ID NO: 487029 - protein, 9 aa, Influenza virus
TIGDCPKYM

SEQ ID NO: 487030 - protein, 9 aa, Influenza virus
TIGDCPKYV

SEQ ID NO: 487031 - protein, 9 aa, Influenza virus
TIGECPKYI

SEQ ID NO: 487032 - protein, 9 aa, Influenza virus
TIGECPKYV

SEQ ID NO: 487033 - protein, 9 aa, Influenza virus
TIGECPRYV

SEQ ID NO: 487034 - protein, 9 aa, Influenza virus
TIGISGPDD

SEQ ID NO: 487035 - protein, 9 aa, Influenza virus
TIGISGPDN

SEQ ID NO: 487036 - protein, 9 aa, Influenza virus
TIGISGPDS

SEQ ID NO: 487037 - protein, 9 aa, Influenza virus
TIGITGPDA

SEQ ID NO: 487038 - protein, 9 aa, Influenza virus
TIGKCPKYV

SEQ ID NO: 487039 - protein, 9 aa, Influenza virus
TIGKCSKYV

SEQ ID NO: 487040 - protein, 9 aa, Influenza virus
TIGLLLQII

SEQ ID NO: 487041 - protein, 9 aa, Influenza virus
TIGLLLQIT

SEQ ID NO: 487042 - protein, 9 aa, Influenza virus
TIGNLIAPR

SEQ ID NO: 487043 - protein, 9 aa, Influenza virus
TIGNLVAPR

SEQ ID NO: 487044 - protein, 9 aa, Influenza virus
TIGSASLGL

SEQ ID NO: 487045 - protein, 9 aa, Influenza virus
TIGSISLGL

SEQ ID NO: 487046 - protein, 9 aa, Influenza virus
TIGSMSLAL

SEQ ID NO: 487047 - protein, 9 aa, Influenza virus
TIGSVSLAL

SEQ ID NO: 487048 - protein, 9 aa, Influenza virus
TIGSVSLII

SEQ ID NO: 487049 - protein, 9 aa, Influenza virus
TIGSVSLTI

SEQ ID NO: 487050 - protein, 9 aa, Influenza virus
TIGSVSLTL

SEQ ID NO: 487051 - protein, 9 aa, Influenza virus
TIGVSGPDN

SEQ ID NO: 487052 - protein, 9 aa, Influenza virus
TIHDGTAFR

SEQ ID NO: 487053 - protein, 9 aa, Influenza virus
TIHDRAAFR

SEQ ID NO: 487054 - protein, 9 aa, Influenza virus
TIHDRIPHR

SEQ ID NO: 487055 - protein, 9 aa, Influenza virus
TIHDRSPFR

SEQ ID NO: 487056 - protein, 9 aa, Influenza virus
TIHDRSPHR

SEQ ID NO: 487057 - protein, 9 aa, Influenza virus
TIHDRSPYR

SEQ ID NO: 487058 - protein, 9 aa, Influenza virus
TIHDRSQFR

SEQ ID NO: 487059 - protein, 9 aa, Influenza virus
TIHDRSQYR

SEQ ID NO: 487060 - protein, 9 aa, Influenza virus
TIHDRTAFR

SEQ ID NO: 487061 - protein, 9 aa, Influenza virus
TIHDRTPHR

SEQ ID NO: 487062 - protein, 9 aa, Influenza virus
TIHDRTTFR

SEQ ID NO: 487063 - protein, 9 aa, Influenza virus
TIHLTDSEM

SEQ ID NO: 487064 - protein, 9 aa, Influenza virus
TIIENNVTV

SEQ ID NO: 487065 - protein, 9 aa, Influenza virus
TIIESNVTV

SEQ ID NO: 487066 - protein, 9 aa, Influenza virus
TIIETGYVC

SEQ ID NO: 487067 - protein, 9 aa, Influenza virus
TIIFEANGN

SEQ ID NO: 487068 - protein, 9 aa, Influenza virus
TIIFEASGN

SEQ ID NO: 487069 - protein, 9 aa, Influenza virus
TIIFEATGN

SEQ ID NO: 487070 - protein, 9 aa, Influenza virus
TIIGPPQCD

SEQ ID NO: 487071 - protein, 9 aa, Influenza virus
TIINNYHNE

SEQ ID NO: 487072 - protein, 9 aa, Influenza virus
TIINNYYND

SEQ ID NO: 487073 - protein, 9 aa, Influenza virus
TIINNYYNE

SEQ ID NO: 487074 - protein, 9 aa, Influenza virus
TIINNYYNK

SEQ ID NO: 487075 - protein, 9 aa, Influenza virus
TIISNLPFQ

SEQ ID NO: 487076 - protein, 9 aa, Influenza virus
TIISSLPFQ

SEQ ID NO: 487077 - protein, 9 aa, Influenza virus
TIIYSSSMM

SEQ ID NO: 487078 - protein, 9 aa, Influenza virus
TIKDRSPYR

SEQ ID NO: 487079 - protein, 9 aa, Influenza virus
TIKNGTYDH

SEQ ID NO: 487080 - protein, 9 aa, Influenza virus
TIKNGTYNH

SEQ ID NO: 487081 - protein, 9 aa, Influenza virus
TIKNGTYNR

SEQ ID NO: 487082 - protein, 9 aa, Influenza virus
TIKPWARNI

SEQ ID NO: 487083 - protein, 9 aa, Influenza virus
TIKQNGKSG

SEQ ID NO: 487084 - protein, 9 aa, Influenza virus
TIKTWAGKI

SEQ ID NO: 487085 - protein, 9 aa, Influenza virus
TIKTWAGNI

SEQ ID NO: 487086 - protein, 9 aa, Influenza virus
TIKTWAKNI

SEQ ID NO: 487087 - protein, 9 aa, Influenza virus
TIKTWARNI

SEQ ID NO: 487088 - protein, 9 aa, Influenza virus
TILEKNITV

SEQ ID NO: 487089 - protein, 9 aa, Influenza virus
TILEKNVTV

SEQ ID NO: 487090 - protein, 9 aa, Influenza virus
TILEQNVTV

SEQ ID NO: 487091 - protein, 9 aa, Influenza virus
TILERNVTV

SEQ ID NO: 487092 - protein, 9 aa, Influenza virus
TILETGYIC

SEQ ID NO: 487093 - protein, 9 aa, Influenza virus
TILETGYVC

SEQ ID NO: 487094 - protein, 9 aa, Influenza virus
TILETRYVC

SEQ ID NO: 487095 - protein, 9 aa, Influenza virus
TILRTQESE

SEQ ID NO: 487096 - protein, 9 aa, Influenza virus
TIMEKNVTV

SEQ ID NO: 487097 - protein, 9 aa, Influenza virus
TIMERNVTV

SEQ ID NO: 487098 - protein, 9 aa, Influenza virus
TINDRSPFR

SEQ ID NO: 487099 - protein, 9 aa, Influenza virus
TINEEALRQ

SEQ ID NO: 487100 - protein, 9 aa, Influenza virus
TINFESTGN

SEQ ID NO: 487101 - protein, 9 aa, Influenza virus
TINRIFQPN

SEQ ID NO: 487102 - protein, 9 aa, Influenza virus
TINRNFQPN

SEQ ID NO: 487103 - protein, 9 aa, Influenza virus
TINRSFQPN

SEQ ID NO: 487104 - protein, 9 aa, Influenza virus
TINRSFRPN

SEQ ID NO: 487105 - protein, 9 aa, Influenza virus
TINSKIDDQ

SEQ ID NO: 487106 - protein, 9 aa, Influenza virus
TINSPLPFQ

SEQ ID NO: 487107 - protein, 9 aa, Influenza virus
TINSWHIFG

SEQ ID NO: 487108 - protein, 9 aa, Influenza virus
TINSWHIYG

SEQ ID NO: 487109 - protein, 9 aa, Influenza virus
TINTASRSG

SEQ ID NO: 487110 - protein, 9 aa, Influenza virus
TINYYNETF

SEQ ID NO: 487111 - protein, 9 aa, Influenza virus
TIPCFWVEM

SEQ ID NO: 487112 - protein, 9 aa, Influenza virus
TIPINNTIY

SEQ ID NO: 487113 - protein, 9 aa, Influenza virus
TIPINNTVY

SEQ ID NO: 487114 - protein, 9 aa, Influenza virus
TIPVNNTIY

SEQ ID NO: 487115 - protein, 9 aa, Influenza virus
TIQIIKLLP

SEQ ID NO: 487116 - protein, 9 aa, Influenza virus
TIQNEDIPI

SEQ ID NO: 487117 - protein, 9 aa, Influenza virus
TIREKNVTV

SEQ ID NO: 487118 - protein, 9 aa, Influenza virus
TIRGKHSNG

SEQ ID NO: 487119 - protein, 9 aa, Influenza virus
TIRGRHSNG

SEQ ID NO: 487120 - protein, 9 aa, Influenza virus
TIRNGTYDH

SEQ ID NO: 487121 - protein, 9 aa, Influenza virus
TIRNGTYNH

SEQ ID NO: 487122 - protein, 9 aa, Influenza virus
TIRNKHSNG

SEQ ID NO: 487123 - protein, 9 aa, Influenza virus
TIRNKHSNS

SEQ ID NO: 487124 - protein, 9 aa, Influenza virus
TIRNRHSNG

SEQ ID NO: 487125 - protein, 9 aa, Influenza virus
TIRQELASR

SEQ ID NO: 487126 - protein, 9 aa, Influenza virus
TIRQEMAIR

SEQ ID NO: 487127 - protein, 9 aa, Influenza virus
TIRQEMANR

SEQ ID NO: 487128 - protein, 9 aa, Influenza virus
TIRQEMASK

SEQ ID NO: 487129 - protein, 9 aa, Influenza virus
TIRQEMASR

SEQ ID NO: 487130 - protein, 9 aa, Influenza virus
TIRTGTYNH

SEQ ID NO: 487131 - protein, 9 aa, Influenza virus
TIRTWAKNI

SEQ ID NO: 487132 - protein, 9 aa, Influenza virus
TISCDSPSN

SEQ ID NO: 487133 - protein, 9 aa, Influenza virus
TISFESTGN

SEQ ID NO: 487134 - protein, 9 aa, Influenza virus
TISIASRSG

SEQ ID NO: 487135 - protein, 9 aa, Influenza virus
TISKDLRSG

SEQ ID NO: 487136 - protein, 9 aa, Influenza virus
TISKDSRSG

SEQ ID NO: 487137 - protein, 9 aa, Influenza virus
TISKDTRSG

SEQ ID NO: 487138 - protein, 9 aa, Influenza virus
TISLVKTTL

SEQ ID NO: 487139 - protein, 9 aa, Influenza virus
TISMDSRSG

SEQ ID NO: 487140 - protein, 9 aa, Influenza virus
TISPHSRSG

SEQ ID NO: 487141 - protein, 9 aa, Influenza virus
TISPKLRSG

SEQ ID NO: 487142 - protein, 9 aa, Influenza virus
TISPRLRSG

SEQ ID NO: 487143 - protein, 9 aa, Influenza virus
TISPRSRNG

SEQ ID NO: 487144 - protein, 9 aa, Influenza virus
TISPRSRSG

SEQ ID NO: 487145 - protein, 9 aa, Influenza virus
TISRDSRSG

SEQ ID NO: 487146 - protein, 9 aa, Influenza virus
TISTASRAG

SEQ ID NO: 487147 - protein, 9 aa, Influenza virus
TISTASRSG

SEQ ID NO: 487148 - protein, 9 aa, Influenza virus
TISTASRYG

SEQ ID NO: 487149 - protein, 9 aa, Influenza virus
TITFEATGN

SEQ ID NO: 487150 - protein, 9 aa, Influenza virus
TITFSFNGA

SEQ ID NO: 487151 - protein, 9 aa, Influenza virus
TITGDNTKW

SEQ ID NO: 487152 - protein, 9 aa, Influenza virus
TITGPPQCD

SEQ ID NO: 487153 - protein, 9 aa, Influenza virus
TITIGSVSL

SEQ ID NO: 487154 - protein, 9 aa, Influenza virus
TITLHFKQN

SEQ ID NO: 487155 - protein, 9 aa, Influenza virus
TITNPLIRH

SEQ ID NO: 487156 - protein, 9 aa, Influenza virus
TITSNLPFQ

SEQ ID NO: 487157 - protein, 9 aa, Influenza virus
TITSPLPFQ

SEQ ID NO: 487158 - protein, 9 aa, Influenza virus
TITYSSPMM

SEQ ID NO: 487159 - protein, 9 aa, Influenza virus
TITYSSSLM

SEQ ID NO: 487160 - protein, 9 aa, Influenza virus
TITYSSSMM

SEQ ID NO: 487161 - protein, 9 aa, Influenza virus
TIVEKNVTV

SEQ ID NO: 487162 - protein, 9 aa, Influenza virus
TIVETGYVC

SEQ ID NO: 487163 - protein, 9 aa, Influenza virus
TIVKTLTNE

SEQ ID NO: 487164 - protein, 9 aa, Influenza virus
TIVKTLTSE

SEQ ID NO: 487165 - protein, 9 aa, Influenza virus
TIVLNTDWS

SEQ ID NO: 487166 - protein, 9 aa, Influenza virus
TIVLTTDWS

SEQ ID NO: 487167 - protein, 9 aa, Influenza virus
TIVSNTDWS

SEQ ID NO: 487168 - protein, 9 aa, Influenza virus
TIVSSLPFQ

SEQ ID NO: 487169 - protein, 9 aa, Influenza virus
TIWASGSSI

SEQ ID NO: 487170 - protein, 9 aa, Influenza virus
TIWTSASSI

SEQ ID NO: 487171 - protein, 9 aa, Influenza virus
TIWTSGSII

SEQ ID NO: 487172 - protein, 9 aa, Influenza virus
TIWTSGSSI

SEQ ID NO: 487173 - protein, 9 aa, Influenza virus
TIWTSSSSI

SEQ ID NO: 487174 - protein, 9 aa, Influenza virus
TIWTSSSSV

SEQ ID NO: 487175 - protein, 9 aa, Influenza virus
TIYSTAASS

SEQ ID NO: 487176 - protein, 9 aa, Influenza virus
TIYSTVASS

SEQ ID NO: 487177 - protein, 9 aa, Influenza virus
TIYWWDGLQ

SEQ ID NO: 487178 - protein, 9 aa, Influenza virus
TKAPQLNPI

SEQ ID NO: 487179 - protein, 9 aa, Influenza virus
TKATKMEAI

SEQ ID NO: 487180 - protein, 9 aa, Influenza virus
TKATKMKAI

SEQ ID NO: 487181 - protein, 9 aa, Influenza virus
TKATNGNYG

SEQ ID NO: 487182 - protein, 9 aa, Influenza virus
TKCQLNEGV

SEQ ID NO: 487183 - protein, 9 aa, Influenza virus
TKCQSPLGA

SEQ ID NO: 487184 - protein, 9 aa, Influenza virus
TKCQTPLGA

SEQ ID NO: 487185 - protein, 9 aa, Influenza virus
TKCQTSLGG

SEQ ID NO: 487186 - protein, 9 aa, Influenza virus
TKCQTSMGG

SEQ ID NO: 487187 - protein, 9 aa, Influenza virus
TKCQTSVGG

SEQ ID NO: 487188 - protein, 9 aa, Influenza virus
TKCQTYAGA

SEQ ID NO: 487189 - protein, 9 aa, Influenza virus
TKCQTYTGA

SEQ ID NO: 487190 - protein, 9 aa, Influenza virus
TKDAERGKL

SEQ ID NO: 487191 - protein, 9 aa, Influenza virus
TKDNSIRIG

SEQ ID NO: 487192 - protein, 9 aa, Influenza virus
TKDNSIRLS

SEQ ID NO: 487193 - protein, 9 aa, Influenza virus
TKDSITDIW

SEQ ID NO: 487194 - protein, 9 aa, Influenza virus
TKEAQDVIM

SEQ ID NO: 487195 - protein, 9 aa, Influenza virus
TKEGRRKTN

SEQ ID NO: 487196 - protein, 9 aa, Influenza virus
TKEGRRRTN

SEQ ID NO: 487197 - protein, 9 aa, Influenza virus
TKEKNDLYG

SEQ ID NO: 487198 - protein, 9 aa, Influenza virus
TKEKNELYG

SEQ ID NO: 487199 - protein, 9 aa, Influenza virus
TKEMEGICY

SEQ ID NO: 487200 - protein, 9 aa, Influenza virus
TKENTGSYV

SEQ ID NO: 487201 - protein, 9 aa, Influenza virus
TKEQTALYK

SEQ ID NO: 487202 - protein, 9 aa, Influenza virus
TKEQTTLYK

SEQ ID NO: 487203 - protein, 9 aa, Influenza virus
TKETNGNYG

SEQ ID NO: 487204 - protein, 9 aa, Influenza virus
TKEWSKRYE

SEQ ID NO: 487205 - protein, 9 aa, Influenza virus
TKEWSRRYE

SEQ ID NO: 487206 - protein, 9 aa, Influenza virus
TKGDKICLG

SEQ ID NO: 487207 - protein, 9 aa, Influenza virus
TKGEKANVL

SEQ ID NO: 487208 - protein, 9 aa, Influenza virus
TKGFGFLNE

SEQ ID NO: 487209 - protein, 9 aa, Influenza virus
TKGILGFVF

SEQ ID NO: 487210 - protein, 9 aa, Influenza virus
TKGKKAVDL

SEQ ID NO: 487211 - protein, 9 aa, Influenza virus
TKGLCIINS

SEQ ID NO: 487212 - protein, 9 aa, Influenza virus
TKGLCTINS

SEQ ID NO: 487213 - protein, 9 aa, Influenza virus
TKGLFGAIA

SEQ ID NO: 487214 - protein, 9 aa, Influenza virus
TKGMLGFVF

SEQ ID NO: 487215 - protein, 9 aa, Influenza virus
TKGVLGFVF

SEQ ID NO: 487216 - protein, 9 aa, Influenza virus
TKHDRIPHR

SEQ ID NO: 487217 - protein, 9 aa, Influenza virus
TKIDLWSYN

SEQ ID NO: 487218 - protein, 9 aa, Influenza virus
TKILFIEEG

SEQ ID NO: 487219 - protein, 9 aa, Influenza virus
TKILYFHKG

SEQ ID NO: 487220 - protein, 9 aa, Influenza virus
TKIMYFHKG

SEQ ID NO: 487221 - protein, 9 aa, Influenza virus
TKINNIIDK

SEQ ID NO: 487222 - protein, 9 aa, Influenza virus
TKINNIIEK

SEQ ID NO: 487223 - protein, 9 aa, Influenza virus
TKINTLTER

SEQ ID NO: 487224 - protein, 9 aa, Influenza virus
TKITVDHMA

SEQ ID NO: 487225 - protein, 9 aa, Influenza virus
TKIVYLNST

SEQ ID NO: 487226 - protein, 9 aa, Influenza virus
TKKEPDTYD

SEQ ID NO: 487227 - protein, 9 aa, Influenza virus
TKKKNPEAY

SEQ ID NO: 487228 - protein, 9 aa, Influenza virus
TKKKPDIYD

SEQ ID NO: 487229 - protein, 9 aa, Influenza virus
TKKKPDTYD

SEQ ID NO: 487230 - protein, 9 aa, Influenza virus
TKKMITQRT

SEQ ID NO: 487231 - protein, 9 aa, Influenza virus
TKKMTITFL

SEQ ID NO: 487232 - protein, 9 aa, Influenza virus
TKKMVTQRT

SEQ ID NO: 487233 - protein, 9 aa, Influenza virus
TKKQLRENA

SEQ ID NO: 487234 - protein, 9 aa, Influenza virus
TKLGSPLVL

SEQ ID NO: 487235 - protein, 9 aa, Influenza virus
TKLPFQNLS

SEQ ID NO: 487236 - protein, 9 aa, Influenza virus
TKLYGNGNK

SEQ ID NO: 487237 - protein, 9 aa, Influenza virus
TKLYGSGNK

SEQ ID NO: 487238 - protein, 9 aa, Influenza virus
TKLYGSGSK

SEQ ID NO: 487239 - protein, 9 aa, Influenza virus
TKLYKNTNT

SEQ ID NO: 487240 - protein, 9 aa, Influenza virus
TKLYVNKNP

SEQ ID NO: 487241 - protein, 9 aa, Influenza virus
TKMEAILVV

SEQ ID NO: 487242 - protein, 9 aa, Influenza virus
TKMKAIIVV

SEQ ID NO: 487243 - protein, 9 aa, Influenza virus
TKMKAILVV

SEQ ID NO: 487244 - protein, 9 aa, Influenza virus
TKNLESRSG

SEQ ID NO: 487245 - protein, 9 aa, Influenza virus
TKPRPRRGL

SEQ ID NO: 487246 - protein, 9 aa, Influenza virus
TKQLCIAWS

SEQ ID NO: 487247 - protein, 9 aa, Influenza virus
TKQVCAAWS

SEQ ID NO: 487248 - protein, 9 aa, Influenza virus
TKQVCIAWS

SEQ ID NO: 487249 - protein, 9 aa, Influenza virus
TKQVCMAWS

SEQ ID NO: 487250 - protein, 9 aa, Influenza virus
TKQVCVAWS

SEQ ID NO: 487251 - protein, 9 aa, Influenza virus
TKQVDTIME

SEQ ID NO: 487252 - protein, 9 aa, Influenza virus
TKRLAVLGK

SEQ ID NO: 487253 - protein, 9 aa, Influenza virus
TKRLCTINS

SEQ ID NO: 487254 - protein, 9 aa, Influenza virus
TKRLIQLIV

SEQ ID NO: 487255 - protein, 9 aa, Influenza virus
TKRLTIIGK

SEQ ID NO: 487256 - protein, 9 aa, Influenza virus
TKRLTILGK

SEQ ID NO: 487257 - protein, 9 aa, Influenza virus
TKRLTVLGK

SEQ ID NO: 487258 - protein, 9 aa, Influenza virus
TKRMVTQRT

SEQ ID NO: 487259 - protein, 9 aa, Influenza virus
TKRSHEQME

SEQ ID NO: 487260 - protein, 9 aa, Influenza virus
TKRSYEQME

SEQ ID NO: 487261 - protein, 9 aa, Influenza virus
TKSLESRSG

SEQ ID NO: 487262 - protein, 9 aa, Influenza virus
TKSTVLKSD

SEQ ID NO: 487263 - protein, 9 aa, Influenza virus
TKSYFANLK

SEQ ID NO: 487264 - protein, 9 aa, Influenza virus
TKTMTITFL

SEQ ID NO: 487265 - protein, 9 aa, Influenza virus
TKTTVDHMA

SEQ ID NO: 487266 - protein, 9 aa, Influenza virus
TKVDLWSYN

SEQ ID NO: 487267 - protein, 9 aa, Influenza virus
TKVDTLTEK

SEQ ID NO: 487268 - protein, 9 aa, Influenza virus
TKVLYFHKG

SEQ ID NO: 487269 - protein, 9 aa, Influenza virus
TKVMYFHKG

SEQ ID NO: 487270 - protein, 9 aa, Influenza virus
TKVNTLTEK

SEQ ID NO: 487271 - protein, 9 aa, Influenza virus
TKVNTLTER

SEQ ID NO: 487272 - protein, 9 aa, Influenza virus
TKVWWTSNS

SEQ ID NO: 487273 - protein, 9 aa, Influenza virus
TKVYNETVR

SEQ ID NO: 487274 - protein, 9 aa, Influenza virus
TKWNENQNP

SEQ ID NO: 487275 - protein, 9 aa, Influenza virus
TKWNVTHTG

SEQ ID NO: 487276 - protein, 9 aa, Influenza virus
TKWNVTYTG

SEQ ID NO: 487277 - protein, 9 aa, Influenza virus
TLCICYHAN

SEQ ID NO: 487278 - protein, 9 aa, Influenza virus
TLCIGYHAN

SEQ ID NO: 487279 - protein, 9 aa, Influenza virus
TLCLGHHAV

SEQ ID NO: 487280 - protein, 9 aa, Influenza virus
TLDEESRAR

SEQ ID NO: 487281 - protein, 9 aa, Influenza virus
TLDEHDANV

SEQ ID NO: 487282 - protein, 9 aa, Influenza virus
TLDEHDSNV

SEQ ID NO: 487283 - protein, 9 aa, Influenza virus
TLDFHDFNV

SEQ ID NO: 487284 - protein, 9 aa, Influenza virus
TLDFHDSNV

SEQ ID NO: 487285 - protein, 9 aa, Influenza virus
TLDFHDSSV

SEQ ID NO: 487286 - protein, 9 aa, Influenza virus
TLDKHDSNV

SEQ ID NO: 487287 - protein, 9 aa, Influenza virus
TLDLHDANV

SEQ ID NO: 487288 - protein, 9 aa, Influenza virus
TLDLHDSNV

SEQ ID NO: 487289 - protein, 9 aa, Influenza virus
TLDMHDANV

SEQ ID NO: 487290 - protein, 9 aa, Influenza virus
TLDNEHSNG

SEQ ID NO: 487291 - protein, 9 aa, Influenza virus
TLDNKHSND

SEQ ID NO: 487292 - protein, 9 aa, Influenza virus
TLDNKHSNG

SEQ ID NO: 487293 - protein, 9 aa, Influenza virus
TLDQHDANV

SEQ ID NO: 487294 - protein, 9 aa, Influenza virus
TLDYHDSNV

SEQ ID NO: 487295 - protein, 9 aa, Influenza virus
TLEFHDSNV

SEQ ID NO: 487296 - protein, 9 aa, Influenza virus
TLEHTSRYV

SEQ ID NO: 487297 - protein, 9 aa, Influenza virus
TLELRSGYW

SEQ ID NO: 487298 - protein, 9 aa, Influenza virus
TLELRSKYW

SEQ ID NO: 487299 - protein, 9 aa, Influenza virus
TLELRSRYW

SEQ ID NO: 487300 - protein, 9 aa, Influenza virus
TLENKHSNG

SEQ ID NO: 487301 - protein, 9 aa, Influenza virus
TLFEKFFPS

SEQ ID NO: 487302 - protein, 9 aa, Influenza virus
TLFQQMRDI

SEQ ID NO: 487303 - protein, 9 aa, Influenza virus
TLFQQMRDV

SEQ ID NO: 487304 - protein, 9 aa, Influenza virus
TLGENMAPE

SEQ ID NO: 487305 - protein, 9 aa, Influenza virus
TLGITGPDA

SEQ ID NO: 487306 - protein, 9 aa, Influenza virus
TLGITGPDS

SEQ ID NO: 487307 - protein, 9 aa, Influenza virus
TLGITGPDT

SEQ ID NO: 487308 - protein, 9 aa, Influenza virus
TLGLDIRTA

SEQ ID NO: 487309 - protein, 9 aa, Influenza virus
TLGLHDANV

SEQ ID NO: 487310 - protein, 9 aa, Influenza virus
TLHFKQHDC

SEQ ID NO: 487311 - protein, 9 aa, Influenza virus
TLHFKQHEC

SEQ ID NO: 487312 - protein, 9 aa, Influenza virus
TLHFKQHKC

SEQ ID NO: 487313 - protein, 9 aa, Influenza virus
TLHFKQNEC

SEQ ID NO: 487314 - protein, 9 aa, Influenza virus
TLIDALLGD

SEQ ID NO: 487315 - protein, 9 aa, Influenza virus
TLIDAMLGD

SEQ ID NO: 487316 - protein, 9 aa, Influenza virus
TLIENTYVN

SEQ ID NO: 487317 - protein, 9 aa, Influenza virus
TLIEQKVPV

SEQ ID NO: 487318 - protein, 9 aa, Influenza virus
TLIEQNIPV

SEQ ID NO: 487319 - protein, 9 aa, Influenza virus
TLIEQNVPV

SEQ ID NO: 487320 - protein, 9 aa, Influenza virus
TLIGPPQCD

SEQ ID NO: 487321 - protein, 9 aa, Influenza virus
TLITDGPSD

SEQ ID NO: 487322 - protein, 9 aa, Influenza virus
TLITDGPSN

SEQ ID NO: 487323 - protein, 9 aa, Influenza virus
TLKGRHANG

SEQ ID NO: 487324 - protein, 9 aa, Influenza virus
TLKIRTNGN

SEQ ID NO: 487325 - protein, 9 aa, Influenza virus
TLKLATGMR

SEQ ID NO: 487326 - protein, 9 aa, Influenza virus
TLKLGQFPV

SEQ ID NO: 487327 - protein, 9 aa, Influenza virus
TLKSEQFPV

SEQ ID NO: 487328 - protein, 9 aa, Influenza virus
TLKSGQFPV

SEQ ID NO: 487329 - protein, 9 aa, Influenza virus
TLKSWKGNI

SEQ ID NO: 487330 - protein, 9 aa, Influenza virus
TLKVESNGN

SEQ ID NO: 487331 - protein, 9 aa, Influenza virus
TLLAKSVFN

SEQ ID NO: 487332 - protein, 9 aa, Influenza virus
TLLEKNVTV

SEQ ID NO: 487333 - protein, 9 aa, Influenza virus
TLLENDVPV

SEQ ID NO: 487334 - protein, 9 aa, Influenza virus
TLLENGVPV

SEQ ID NO: 487335 - protein, 9 aa, Influenza virus
TLLENNVPV

SEQ ID NO: 487336 - protein, 9 aa, Influenza virus
TLLESDVPV

SEQ ID NO: 487337 - protein, 9 aa, Influenza virus
TLLMNELGI

SEQ ID NO: 487338 - protein, 9 aa, Influenza virus
TLLMNELGV

SEQ ID NO: 487339 - protein, 9 aa, Influenza virus
TLLMSELGV

SEQ ID NO: 487340 - protein, 9 aa, Influenza virus
TLMDALLGD

SEQ ID NO: 487341 - protein, 9 aa, Influenza virus
TLMEQNVPV

SEQ ID NO: 487342 - protein, 9 aa, Influenza virus
TLMSCPIGE

SEQ ID NO: 487343 - protein, 9 aa, Influenza virus
TLMSCPIGV

SEQ ID NO: 487344 - protein, 9 aa, Influenza virus
TLMSCPMGV

SEQ ID NO: 487345 - protein, 9 aa, Influenza virus
TLMSCPVGE

SEQ ID NO: 487346 - protein, 9 aa, Influenza virus
TLMSCPVGV

SEQ ID NO: 487347 - protein, 9 aa, Influenza virus
TLMSVEIGQ

SEQ ID NO: 487348 - protein, 9 aa, Influenza virus
TLMSVEVGQ

SEQ ID NO: 487349 - protein, 9 aa, Influenza virus
TLMSVGIGQ

SEQ ID NO: 487350 - protein, 9 aa, Influenza virus
TLMSVKIGQ

SEQ ID NO: 487351 - protein, 9 aa, Influenza virus
TLMSVKVGQ

SEQ ID NO: 487352 - protein, 9 aa, Influenza virus
TLMTDGPSD

SEQ ID NO: 487353 - protein, 9 aa, Influenza virus
TLNIESNGN

SEQ ID NO: 487354 - protein, 9 aa, Influenza virus
TLNMHDANV

SEQ ID NO: 487355 - protein, 9 aa, Influenza virus
TLNNKHSNG

SEQ ID NO: 487356 - protein, 9 aa, Influenza virus
TLNRNQPAA

SEQ ID NO: 487357 - protein, 9 aa, Influenza virus
TLNTMTKDA

SEQ ID NO: 487358 - protein, 9 aa, Influenza virus
TLNVESNGN

SEQ ID NO: 487359 - protein, 9 aa, Influenza virus
TLPFHNIHP

SEQ ID NO: 487360 - protein, 9 aa, Influenza virus
TLPFHNVHP

SEQ ID NO: 487361 - protein, 9 aa, Influenza virus
TLPRRSGAA

SEQ ID NO: 487362 - protein, 9 aa, Influenza virus
TLRGQHANG

SEQ ID NO: 487363 - protein, 9 aa, Influenza virus
TLRGRHANG

SEQ ID NO: 487364 - protein, 9 aa, Influenza virus
TLRIISNGN

SEQ ID NO: 487365 - protein, 9 aa, Influenza virus
TLRIRSNEN

SEQ ID NO: 487366 - protein, 9 aa, Influenza virus
TLRIRSNGN

SEQ ID NO: 487367 - protein, 9 aa, Influenza virus
TLRSLVASS

SEQ ID NO: 487368 - protein, 9 aa, Influenza virus
TLRTQESEC

SEQ ID NO: 487369 - protein, 9 aa, Influenza virus
TLRVKSNGN

SEQ ID NO: 487370 - protein, 9 aa, Influenza virus
TLRVRSDGN

SEQ ID NO: 487371 - protein, 9 aa, Influenza virus
TLRVRSNGN

SEQ ID NO: 487372 - protein, 9 aa, Influenza virus
TLSEQNVPV

SEQ ID NO: 487373 - protein, 9 aa, Influenza virus
TLSGVAIAL

SEQ ID NO: 487374 - protein, 9 aa, Influenza virus
TLSSGYKDI

SEQ ID NO: 487375 - protein, 9 aa, Influenza virus
TLSSVNTNT

SEQ ID NO: 487376 - protein, 9 aa, Influenza virus
TLSSVTTNT

SEQ ID NO: 487377 - protein, 9 aa, Influenza virus
TLSTIALFI

SEQ ID NO: 487378 - protein, 9 aa, Influenza virus
TLSTIALII

SEQ ID NO: 487379 - protein, 9 aa, Influenza virus
TLSTIALLI

SEQ ID NO: 487380 - protein, 9 aa, Influenza virus
TLTDNHVEV

SEQ ID NO: 487381 - protein, 9 aa, Influenza virus
TLTEKGIEV

SEQ ID NO: 487382 - protein, 9 aa, Influenza virus
TLTEKGVEV

SEQ ID NO: 487383 - protein, 9 aa, Influenza virus
TLTENGVPV

SEQ ID NO: 487384 - protein, 9 aa, Influenza virus
TLTEQNVPV

SEQ ID NO: 487385 - protein, 9 aa, Influenza virus
TLTEREVEV

SEQ ID NO: 487386 - protein, 9 aa, Influenza virus
TLTERGIEV

SEQ ID NO: 487387 - protein, 9 aa, Influenza virus
TLTERGVEV

SEQ ID NO: 487388 - protein, 9 aa, Influenza virus
TLTETGVPV

SEQ ID NO: 487389 - protein, 9 aa, Influenza virus
TLTGRGIEV

SEQ ID NO: 487390 - protein, 9 aa, Influenza virus
TLTMGYKDI

SEQ ID NO: 487391 - protein, 9 aa, Influenza virus
TLTNEHEEV

SEQ ID NO: 487392 - protein, 9 aa, Influenza virus
TLTNEKEEV

SEQ ID NO: 487393 - protein, 9 aa, Influenza virus
TLTNEQEEV

SEQ ID NO: 487394 - protein, 9 aa, Influenza virus
TLTNEREEV

SEQ ID NO: 487395 - protein, 9 aa, Influenza virus
TLTSEKEEV

SEQ ID NO: 487396 - protein, 9 aa, Influenza virus
TLTSVTTNT

SEQ ID NO: 487397 - protein, 9 aa, Influenza virus
TLTVPSERG

SEQ ID NO: 487398 - protein, 9 aa, Influenza virus
TLVANNDWS

SEQ ID NO: 487399 - protein, 9 aa, Influenza virus
TLVDALLGD

SEQ ID NO: 487400 - protein, 9 aa, Influenza virus
TLVLLVSLG

SEQ ID NO: 487401 - protein, 9 aa, Influenza virus
TLVNPGDSI

SEQ ID NO: 487402 - protein, 9 aa, Influenza virus
TLVSNNDWS

SEQ ID NO: 487403 - protein, 9 aa, Influenza virus
TLVSNSDWS

SEQ ID NO: 487404 - protein, 9 aa, Influenza virus
TLVSTGSWS

SEQ ID NO: 487405 - protein, 9 aa, Influenza virus
TLVSTKEWS

SEQ ID NO: 487406 - protein, 9 aa, Influenza virus
TLVSTKSWS

SEQ ID NO: 487407 - protein, 9 aa, Influenza virus
TLVSTRSWS

SEQ ID NO: 487408 - protein, 9 aa, Influenza virus
TLVSTSSWS

SEQ ID NO: 487409 - protein, 9 aa, Influenza virus
TLVTDGPSD

SEQ ID NO: 487410 - protein, 9 aa, Influenza virus
TLVTTSSWS

SEQ ID NO: 487411 - protein, 9 aa, Influenza virus
TLYFHDSNV

SEQ ID NO: 487412 - protein, 9 aa, Influenza virus
TLYKNANTL

SEQ ID NO: 487413 - protein, 9 aa, Influenza virus
TLYNKHSNG

SEQ ID NO: 487414 - protein, 9 aa, Influenza virus
TMDTVNRTH

SEQ ID NO: 487415 - protein, 9 aa, Influenza virus
TMDYYWGIL

SEQ ID NO: 487416 - protein, 9 aa, Influenza virus
TMELVEAEK

SEQ ID NO: 487417 - protein, 9 aa, Influenza virus
TMELVETEK

SEQ ID NO: 487418 - protein, 9 aa, Influenza virus
TMELVETKK

SEQ ID NO: 487419 - protein, 9 aa, Influenza virus
TMGYKDIIL

SEQ ID NO: 487420 - protein, 9 aa, Influenza virus
TMHDRSPFR

SEQ ID NO: 487421 - protein, 9 aa, Influenza virus
TMHQLLRHF

SEQ ID NO: 487422 - protein, 9 aa, Influenza virus
TMKDRSPYR

SEQ ID NO: 487423 - protein, 9 aa, Influenza virus
TMLNLYERV

SEQ ID NO: 487424 - protein, 9 aa, Influenza virus
TMSCDSPSN

SEQ ID NO: 487425 - protein, 9 aa, Influenza virus
TMTHTSQYI

SEQ ID NO: 487426 - protein, 9 aa, Influenza virus
TMTITFLIL

SEQ ID NO: 487427 - protein, 9 aa, Influenza virus
TMTKDAERG

SEQ ID NO: 487428 - protein, 9 aa, Influenza virus
TNADKICLG

SEQ ID NO: 487429 - protein, 9 aa, Influenza virus
TNAHDRICI

SEQ ID NO: 487430 - protein, 9 aa, Influenza virus
TNATELVQG

SEQ ID NO: 487431 - protein, 9 aa, Influenza virus
TNATELVQI

SEQ ID NO: 487432 - protein, 9 aa, Influenza virus
TNATELVQN

SEQ ID NO: 487433 - protein, 9 aa, Influenza virus
TNATELVQS

SEQ ID NO: 487434 - protein, 9 aa, Influenza virus
TNATETVEN

SEQ ID NO: 487435 - protein, 9 aa, Influenza virus
TNATETVES

SEQ ID NO: 487436 - protein, 9 aa, Influenza virus
TNAYDRICI

SEQ ID NO: 487437 - protein, 9 aa, Influenza virus
TNDKYHQIE

SEQ ID NO: 487438 - protein, 9 aa, Influenza virus
TNEEALRQI

SEQ ID NO: 487439 - protein, 9 aa, Influenza virus
TNEEPLRQI

SEQ ID NO: 487440 - protein, 9 aa, Influenza virus
TNEESLRQI

SEQ ID NO: 487441 - protein, 9 aa, Influenza virus
TNEKFHQIE

SEQ ID NO: 487442 - protein, 9 aa, Influenza virus
TNEKYHQIE

SEQ ID NO: 487443 - protein, 9 aa, Influenza virus
TNGEQILII

SEQ ID NO: 487444 - protein, 9 aa, Influenza virus
TNGNLIAPE

SEQ ID NO: 487445 - protein, 9 aa, Influenza virus
TNGNYGPIN

SEQ ID NO: 487446 - protein, 9 aa, Influenza virus
TNGTSKIKM

SEQ ID NO: 487447 - protein, 9 aa, Influenza virus
TNGTSKVKM

SEQ ID NO: 487448 - protein, 9 aa, Influenza virus
TNGTTGNPI

SEQ ID NO: 487449 - protein, 9 aa, Influenza virus
TNGVKGFSF

SEQ ID NO: 487450 - protein, 9 aa, Influenza virus
TNHQFELID

SEQ ID NO: 487451 - protein, 9 aa, Influenza virus
TNHTDELCP

SEQ ID NO: 487452 - protein, 9 aa, Influenza virus
TNHTGTYCS

SEQ ID NO: 487453 - protein, 9 aa, Influenza virus
TNINIREWS

SEQ ID NO: 487454 - protein, 9 aa, Influenza virus
TNKFAAICT

SEQ ID NO: 487455 - protein, 9 aa, Influenza virus
TNKFAAVCT

SEQ ID NO: 487456 - protein, 9 aa, Influenza virus
TNKFASICT

SEQ ID NO: 487457 - protein, 9 aa, Influenza virus
TNKINNIVD

SEQ ID NO: 487458 - protein, 9 aa, Influenza virus
TNKINSIID

SEQ ID NO: 487459 - protein, 9 aa, Influenza virus
TNKLAAICT

SEQ ID NO: 487460 - protein, 9 aa, Influenza virus
TNKQFELID

SEQ ID NO: 487461 - protein, 9 aa, Influenza virus
TNKTFQNAS

SEQ ID NO: 487462 - protein, 9 aa, Influenza virus
TNKTFQNID

SEQ ID NO: 487463 - protein, 9 aa, Influenza virus
TNKTFQNIE

SEQ ID NO: 487464 - protein, 9 aa, Influenza virus
TNKTFQNIS

SEQ ID NO: 487465 - protein, 9 aa, Influenza virus
TNKTFQNVS

SEQ ID NO: 487466 - protein, 9 aa, Influenza virus
TNKVNNIVD

SEQ ID NO: 487467 - protein, 9 aa, Influenza virus
TNKVNSIID

SEQ ID NO: 487468 - protein, 9 aa, Influenza virus
TNKVNSIIE

SEQ ID NO: 487469 - protein, 9 aa, Influenza virus
TNKVNSIIG

SEQ ID NO: 487470 - protein, 9 aa, Influenza virus
TNKVNSIIN

SEQ ID NO: 487471 - protein, 9 aa, Influenza virus
TNKVNSVIE

SEQ ID NO: 487472 - protein, 9 aa, Influenza virus
TNKVNSVVE

SEQ ID NO: 487473 - protein, 9 aa, Influenza virus
TNKVNTVIE

SEQ ID NO: 487474 - protein, 9 aa, Influenza virus
TNLGLNIGL

SEQ ID NO: 487475 - protein, 9 aa, Influenza virus
TNLYGFIIK

SEQ ID NO: 487476 - protein, 9 aa, Influenza virus
TNLYGFIVK

SEQ ID NO: 487477 - protein, 9 aa, Influenza virus
TNLYVNKNP

SEQ ID NO: 487478 - protein, 9 aa, Influenza virus
TNMINDKID

SEQ ID NO: 487479 - protein, 9 aa, Influenza virus
TNNSTDTVN

SEQ ID NO: 487480 - protein, 9 aa, Influenza virus
TNNSTETVN

SEQ ID NO: 487481 - protein, 9 aa, Influenza virus
TNNYGVKGF

SEQ ID NO: 487482 - protein, 9 aa, Influenza virus
TNPIVPSFD

SEQ ID NO: 487483 - protein, 9 aa, Influenza virus
TNPIVPSFE

SEQ ID NO: 487484 - protein, 9 aa, Influenza virus
TNPLIKHEN

SEQ ID NO: 487485 - protein, 9 aa, Influenza virus
TNPLIRHEN

SEQ ID NO: 487486 - protein, 9 aa, Influenza virus
TNPVVPSFD

SEQ ID NO: 487487 - protein, 9 aa, Influenza virus
TNQQFELID

SEQ ID NO: 487488 - protein, 9 aa, Influenza virus
TNQQFELIN

SEQ ID NO: 487489 - protein, 9 aa, Influenza virus
TNQQFEMID

SEQ ID NO: 487490 - protein, 9 aa, Influenza virus
TNQQFGLID

SEQ ID NO: 487491 - protein, 9 aa, Influenza virus
TNQQFKLID

SEQ ID NO: 487492 - protein, 9 aa, Influenza virus
TNRPILVIS

SEQ ID NO: 487493 - protein, 9 aa, Influenza virus
TNRPVLIIS

SEQ ID NO: 487494 - protein, 9 aa, Influenza virus
TNRPVLVIS

SEQ ID NO: 487495 - protein, 9 aa, Influenza virus
TNRPVLVVS

SEQ ID NO: 487496 - protein, 9 aa, Influenza virus
TNRTFQNID

SEQ ID NO: 487497 - protein, 9 aa, Influenza virus
TNRTFQNVS

SEQ ID NO: 487498 - protein, 9 aa, Influenza virus
TNRVNSIID

SEQ ID NO: 487499 - protein, 9 aa, Influenza virus
TNSIVVFCG

SEQ ID NO: 487500 - protein, 9 aa, Influenza virus
TNSQDTEIS

SEQ ID NO: 487501 - protein, 9 aa, Influenza virus
TNSQDTELS

SEQ ID NO: 487502 - protein, 9 aa, Influenza virus
TNSQDTEVS

SEQ ID NO: 487503 - protein, 9 aa, Influenza virus
TNSSDKVDT

SEQ ID NO: 487504 - protein, 9 aa, Influenza virus
TNSSEKVDT

SEQ ID NO: 487505 - protein, 9 aa, Influenza virus
TNSSEKVNT

SEQ ID NO: 487506 - protein, 9 aa, Influenza virus
TNSSERVDT

SEQ ID NO: 487507 - protein, 9 aa, Influenza virus
TNSTDTVDT

SEQ ID NO: 487508 - protein, 9 aa, Influenza virus
TNSTEAVDT

SEQ ID NO: 487509 - protein, 9 aa, Influenza virus
TNSTEKVDT

SEQ ID NO: 487510 - protein, 9 aa, Influenza virus
TNSTETVDT

SEQ ID NO: 487511 - protein, 9 aa, Influenza virus
TNSTETVGT

SEQ ID NO: 487512 - protein, 9 aa, Influenza virus
TNSTETVNT

SEQ ID NO: 487513 - protein, 9 aa, Influenza virus
TNSTETVYT

SEQ ID NO: 487514 - protein, 9 aa, Influenza virus
TNTEFESIE

SEQ ID NO: 487515 - protein, 9 aa, Influenza virus
TNTINRIFQ

SEQ ID NO: 487516 - protein, 9 aa, Influenza virus
TNTINRNFQ

SEQ ID NO: 487517 - protein, 9 aa, Influenza virus
TNTINRSFQ

SEQ ID NO: 487518 - protein, 9 aa, Influenza virus
TNTINRSFR

SEQ ID NO: 487519 - protein, 9 aa, Influenza virus
TNTLSSVTT

SEQ ID NO: 487520 - protein, 9 aa, Influenza virus
TNTQFELID

SEQ ID NO: 487521 - protein, 9 aa, Influenza virus
TNTTLIENT

SEQ ID NO: 487522 - protein, 9 aa, Influenza virus
TNTVNTLIE

SEQ ID NO: 487523 - protein, 9 aa, Influenza virus
TNTYRNTDP

SEQ ID NO: 487524 - protein, 9 aa, Influenza virus
TNTYRNTDS

SEQ ID NO: 487525 - protein, 9 aa, Influenza virus
TNTYRNTDT

SEQ ID NO: 487526 - protein, 9 aa, Influenza virus
TNVQNDYTT

SEQ ID NO: 487527 - protein, 9 aa, Influenza virus
TNVQNNYTT

SEQ ID NO: 487528 - protein, 9 aa, Influenza virus
TNWSGYSGS

SEQ ID NO: 487529 - protein, 9 aa, Influenza virus
TNYYNETFV

SEQ ID NO: 487530 - protein, 9 aa, Influenza virus
TPACDLHLT

SEQ ID NO: 487531 - protein, 9 aa, Influenza virus
TPACDLYLT

SEQ ID NO: 487532 - protein, 9 aa, Influenza virus
TPCVLLNDK

SEQ ID NO: 487533 - protein, 9 aa, Influenza virus
TPDPGVKGF

SEQ ID NO: 487534 - protein, 9 aa, Influenza virus
TPEWSYIVE

SEQ ID NO: 487535 - protein, 9 aa, Influenza virus
TPGGEVIND

SEQ ID NO: 487536 - protein, 9 aa, Influenza virus
TPGGEVKND

SEQ ID NO: 487537 - protein, 9 aa, Influenza virus
TPGGEVRND

SEQ ID NO: 487538 - protein, 9 aa, Influenza virus
TPGGGVRND

SEQ ID NO: 487539 - protein, 9 aa, Influenza virus
TPGGKVRND

SEQ ID NO: 487540 - protein, 9 aa, Influenza virus
TPGMQIRGF

SEQ ID NO: 487541 - protein, 9 aa, Influenza virus
TPHRTLLMN

SEQ ID NO: 487542 - protein, 9 aa, Influenza virus
TPIAFLTSS

SEQ ID NO: 487543 - protein, 9 aa, Influenza virus
TPIGAINSS

SEQ ID NO: 487544 - protein, 9 aa, Influenza virus
TPIVPSFDM

SEQ ID NO: 487545 - protein, 9 aa, Influenza virus
TPKRNRSIL

SEQ ID NO: 487546 - protein, 9 aa, Influenza virus
TPLELRDCK

SEQ ID NO: 487547 - protein, 9 aa, Influenza virus
TPLGAINSS

SEQ ID NO: 487548 - protein, 9 aa, Influenza virus
TPLGAINTT

SEQ ID NO: 487549 - protein, 9 aa, Influenza virus
TPLGALNTT

SEQ ID NO: 487550 - protein, 9 aa, Influenza virus
TPLGSPPIV

SEQ ID NO: 487551 - protein, 9 aa, Influenza virus
TPLGSPPMV

SEQ ID NO: 487552 - protein, 9 aa, Influenza virus
TPLGSPPVV

SEQ ID NO: 487553 - protein, 9 aa, Influenza virus
TPLGTPPTV

SEQ ID NO: 487554 - protein, 9 aa, Influenza virus
TPMGAINSS

SEQ ID NO: 487555 - protein, 9 aa, Influenza virus
TPMGAVNSS

SEQ ID NO: 487556 - protein, 9 aa, Influenza virus
TPNGSIPND

SEQ ID NO: 487557 - protein, 9 aa, Influenza virus
TPNGSIPNE

SEQ ID NO: 487558 - protein, 9 aa, Influenza virus
TPNGSIPNG

SEQ ID NO: 487559 - protein, 9 aa, Influenza virus
TPNGSIPNN

SEQ ID NO: 487560 - protein, 9 aa, Influenza virus
TPNGSISND

SEQ ID NO: 487561 - protein, 9 aa, Influenza virus
TPPTVSNSD

SEQ ID NO: 487562 - protein, 9 aa, Influenza virus
TPRGEDAQF

SEQ ID NO: 487563 - protein, 9 aa, Influenza virus
TPRGEDGQF

SEQ ID NO: 487564 - protein, 9 aa, Influenza virus
TPRGEDNQF

SEQ ID NO: 487565 - protein, 9 aa, Influenza virus
TPRGEDSQF

SEQ ID NO: 487566 - protein, 9 aa, Influenza virus
TPRNDDRFS

SEQ ID NO: 487567 - protein, 9 aa, Influenza virus
TPRNDDRSS

SEQ ID NO: 487568 - protein, 9 aa, Influenza virus
TPRNDDSSS

SEQ ID NO: 487569 - protein, 9 aa, Influenza virus
TPRNEDGSS

SEQ ID NO: 487570 - protein, 9 aa, Influenza virus
TPRNEDSSS

SEQ ID NO: 487571 - protein, 9 aa, Influenza virus
TPRNGDSSS

SEQ ID NO: 487572 - protein, 9 aa, Influenza virus
TPRSDDSSS

SEQ ID NO: 487573 - protein, 9 aa, Influenza virus
TPSAIDQIT

SEQ ID NO: 487574 - protein, 9 aa, Influenza virus
TPSIDPKGL

SEQ ID NO: 487575 - protein, 9 aa, Influenza virus
TPSIEPKGL

SEQ ID NO: 487576 - protein, 9 aa, Influenza virus
TPSIEPRGL

SEQ ID NO: 487577 - protein, 9 aa, Influenza virus
TPSVEPKGL

SEQ ID NO: 487578 - protein, 9 aa, Influenza virus
TPSVEPRGL

SEQ ID NO: 487579 - protein, 9 aa, Influenza virus
TPTKSYFAN

SEQ ID NO: 487580 - protein, 9 aa, Influenza virus
TPVCDPHLT

SEQ ID NO: 487581 - protein, 9 aa, Influenza virus
TPVGAINSS

SEQ ID NO: 487582 - protein, 9 aa, Influenza virus
TPYRSLIKF

SEQ ID NO: 487583 - protein, 9 aa, Influenza virus
TPYRSLIQF

SEQ ID NO: 487584 - protein, 9 aa, Influenza virus
TPYRSLIRF

SEQ ID NO: 487585 - protein, 9 aa, Influenza virus
TPYRTLLMN

SEQ ID NO: 487586 - protein, 9 aa, Influenza virus
TQAAIDKIN

SEQ ID NO: 487587 - protein, 9 aa, Influenza virus
TQAAIDQIN

SEQ ID NO: 487588 - protein, 9 aa, Influenza virus
TQAAIDQIT

SEQ ID NO: 487589 - protein, 9 aa, Influenza virus
TQAAIDQMT

SEQ ID NO: 487590 - protein, 9 aa, Influenza virus
TQAAIDQVN

SEQ ID NO: 487591 - protein, 9 aa, Influenza virus
TQAAVDQIT

SEQ ID NO: 487592 - protein, 9 aa, Influenza virus
TQAMELVEA

SEQ ID NO: 487593 - protein, 9 aa, Influenza virus
TQCQITGFA

SEQ ID NO: 487594 - protein, 9 aa, Influenza virus
TQCQTPLGA

SEQ ID NO: 487595 - protein, 9 aa, Influenza virus
TQDAMTEVW

SEQ ID NO: 487596 - protein, 9 aa, Influenza virus
TQDSECVSH

SEQ ID NO: 487597 - protein, 9 aa, Influenza virus
TQEAIDKIT

SEQ ID NO: 487598 - protein, 9 aa, Influenza virus
TQEAIEKIT

SEQ ID NO: 487599 - protein, 9 aa, Influenza virus
TQEAIGKIT

SEQ ID NO: 487600 - protein, 9 aa, Influenza virus
TQEAINKIT

SEQ ID NO: 487601 - protein, 9 aa, Influenza virus
TQEKNDLYG

SEQ ID NO: 487602 - protein, 9 aa, Influenza virus
TQERNDLYG

SEQ ID NO: 487603 - protein, 9 aa, Influenza virus
TQESDCVCI

SEQ ID NO: 487604 - protein, 9 aa, Influenza virus
TQESECACI

SEQ ID NO: 487605 - protein, 9 aa, Influenza virus
TQESECACV

SEQ ID NO: 487606 - protein, 9 aa, Influenza virus
TQESECICI

SEQ ID NO: 487607 - protein, 9 aa, Influenza virus
TQESECLCI

SEQ ID NO: 487608 - protein, 9 aa, Influenza virus
TQESECQCI

SEQ ID NO: 487609 - protein, 9 aa, Influenza virus
TQESECQCL

SEQ ID NO: 487610 - protein, 9 aa, Influenza virus
TQESECQRI

SEQ ID NO: 487611 - protein, 9 aa, Influenza virus
TQESECVCH

SEQ ID NO: 487612 - protein, 9 aa, Influenza virus
TQESECVCI

SEQ ID NO: 487613 - protein, 9 aa, Influenza virus
TQESECVCM

SEQ ID NO: 487614 - protein, 9 aa, Influenza virus
TQESECVCQ

SEQ ID NO: 487615 - protein, 9 aa, Influenza virus
TQESECVCV

SEQ ID NO: 487616 - protein, 9 aa, Influenza virus
TQESECVRH

SEQ ID NO: 487617 - protein, 9 aa, Influenza virus
TQESSCTCI

SEQ ID NO: 487618 - protein, 9 aa, Influenza virus
TQESSCVCI

SEQ ID NO: 487619 - protein, 9 aa, Influenza virus
TQESSCVCM

SEQ ID NO: 487620 - protein, 9 aa, Influenza virus
TQESSCVCV

SEQ ID NO: 487621 - protein, 9 aa, Influenza virus
TQEYECVCI

SEQ ID NO: 487622 - protein, 9 aa, Influenza virus
TQFEAIGRE

SEQ ID NO: 487623 - protein, 9 aa, Influenza virus
TQFEAVGKE

SEQ ID NO: 487624 - protein, 9 aa, Influenza virus
TQFEAVGRE

SEQ ID NO: 487625 - protein, 9 aa, Influenza virus
TQFELIDNE

SEQ ID NO: 487626 - protein, 9 aa, Influenza virus
TQFTAVGKE

SEQ ID NO: 487627 - protein, 9 aa, Influenza virus
TQFTSVGKE

SEQ ID NO: 487628 - protein, 9 aa, Influenza virus
TQFTVVGKE

SEQ ID NO: 487629 - protein, 9 aa, Influenza virus
TQGACWEQL

SEQ ID NO: 487630 - protein, 9 aa, Influenza virus
TQGALLNDK

SEQ ID NO: 487631 - protein, 9 aa, Influenza virus
TQGALLNDR

SEQ ID NO: 487632 - protein, 9 aa, Influenza virus
TQGEGTAAD

SEQ ID NO: 487633 - protein, 9 aa, Influenza virus
TQGRQTFDW

SEQ ID NO: 487634 - protein, 9 aa, Influenza virus
TQGRQTYDW

SEQ ID NO: 487635 - protein, 9 aa, Influenza virus
TQGSLLNDK

SEQ ID NO: 487636 - protein, 9 aa, Influenza virus
TQGSLLNDR

SEQ ID NO: 487637 - protein, 9 aa, Influenza virus
TQGTCWEQL

SEQ ID NO: 487638 - protein, 9 aa, Influenza virus
TQGTCWEQM

SEQ ID NO: 487639 - protein, 9 aa, Influenza virus
TQGVKGWAF

SEQ ID NO: 487640 - protein, 9 aa, Influenza virus
TQGYKDIIL

SEQ ID NO: 487641 - protein, 9 aa, Influenza virus
TQIIKLLPF

SEQ ID NO: 487642 - protein, 9 aa, Influenza virus
TQIIVILVL

SEQ ID NO: 487643 - protein, 9 aa, Influenza virus
TQKAIDEIT

SEQ ID NO: 487644 - protein, 9 aa, Influenza virus
TQKAIDGIT

SEQ ID NO: 487645 - protein, 9 aa, Influenza virus
TQKAIDGVT

SEQ ID NO: 487646 - protein, 9 aa, Influenza virus
TQKAIDIMQ

SEQ ID NO: 487647 - protein, 9 aa, Influenza virus
TQKAIDNMQ

SEQ ID NO: 487648 - protein, 9 aa, Influenza virus
TQKAIDQIT

SEQ ID NO: 487649 - protein, 9 aa, Influenza virus
TQKAIDRIT

SEQ ID NO: 487650 - protein, 9 aa, Influenza virus
TQKAINEIT

SEQ ID NO: 487651 - protein, 9 aa, Influenza virus
TQKAINGIT

SEQ ID NO: 487652 - protein, 9 aa, Influenza virus
TQKAINGVT

SEQ ID NO: 487653 - protein, 9 aa, Influenza virus
TQKALNEIT

SEQ ID NO: 487654 - protein, 9 aa, Influenza virus
TQKAVDGIT

SEQ ID NO: 487655 - protein, 9 aa, Influenza virus
TQKTIDQVT

SEQ ID NO: 487656 - protein, 9 aa, Influenza virus
TQMAIDNMQ

SEQ ID NO: 487657 - protein, 9 aa, Influenza virus
TQNNTTLIE

SEQ ID NO: 487658 - protein, 9 aa, Influenza virus
TQNNTTVVE

SEQ ID NO: 487659 - protein, 9 aa, Influenza virus
TQPLSISVG

SEQ ID NO: 487660 - protein, 9 aa, Influenza virus
TQPTFSVQR

SEQ ID NO: 487661 - protein, 9 aa, Influenza virus
TQQVCIAWS

SEQ ID NO: 487662 - protein, 9 aa, Influenza virus
TQRAIDGIT

SEQ ID NO: 487663 - protein, 9 aa, Influenza virus
TQRAIDGVT

SEQ ID NO: 487664 - protein, 9 aa, Influenza virus
TQRAIDNMQ

SEQ ID NO: 487665 - protein, 9 aa, Influenza virus
TQRTIGKKK

SEQ ID NO: 487666 - protein, 9 aa, Influenza virus
TQRTIGKRK

SEQ ID NO: 487667 - protein, 9 aa, Influenza virus
TQRTMGKKK

SEQ ID NO: 487668 - protein, 9 aa, Influenza virus
TQRTVGKKK

SEQ ID NO: 487669 - protein, 9 aa, Influenza virus
TQSAIDQIT

SEQ ID NO: 487670 - protein, 9 aa, Influenza virus
TQSAIDQVT

SEQ ID NO: 487671 - protein, 9 aa, Influenza virus
TQSAINQIT

SEQ ID NO: 487672 - protein, 9 aa, Influenza virus
TQSAVDQIT

SEQ ID NO: 487673 - protein, 9 aa, Influenza virus
TQSAVNQIT

SEQ ID NO: 487674 - protein, 9 aa, Influenza virus
TQSLSISIG

SEQ ID NO: 487675 - protein, 9 aa, Influenza virus
TQSLSISVE

SEQ ID NO: 487676 - protein, 9 aa, Influenza virus
TQSLSISVG

SEQ ID NO: 487677 - protein, 9 aa, Influenza virus
TQTAIDQIN

SEQ ID NO: 487678 - protein, 9 aa, Influenza virus
TQTAIDQIT

SEQ ID NO: 487679 - protein, 9 aa, Influenza virus
TQTLVANND

SEQ ID NO: 487680 - protein, 9 aa, Influenza virus
TQTLVSNND

SEQ ID NO: 487681 - protein, 9 aa, Influenza virus
TQTLVSNSD

SEQ ID NO: 487682 - protein, 9 aa, Influenza virus
TQTMELVEA

SEQ ID NO: 487683 - protein, 9 aa, Influenza virus
TQTMELVET

SEQ ID NO: 487684 - protein, 9 aa, Influenza virus
TQTRGIFGA

SEQ ID NO: 487685 - protein, 9 aa, Influenza virus
TQVEELVHG

SEQ ID NO: 487686 - protein, 9 aa, Influenza virus
TQVEELVHR

SEQ ID NO: 487687 - protein, 9 aa, Influenza virus
TQYREEALL

SEQ ID NO: 487688 - protein, 9 aa, Influenza virus
TQYREESLL

SEQ ID NO: 487689 - protein, 9 aa, Influenza virus
TRALVRSGM

SEQ ID NO: 487690 - protein, 9 aa, Influenza virus
TRALVRTGM

SEQ ID NO: 487691 - protein, 9 aa, Influenza virus
TRCQTPLGA

SEQ ID NO: 487692 - protein, 9 aa, Influenza virus
TRCQTSVGG

SEQ ID NO: 487693 - protein, 9 aa, Influenza virus
TRDAMTEIW

SEQ ID NO: 487694 - protein, 9 aa, Influenza virus
TRDAMTEVW

SEQ ID NO: 487695 - protein, 9 aa, Influenza virus
TRDSITELW

SEQ ID NO: 487696 - protein, 9 aa, Influenza virus
TRDSITEVW

SEQ ID NO: 487697 - protein, 9 aa, Influenza virus
TRDSLTEIW

SEQ ID NO: 487698 - protein, 9 aa, Influenza virus
TRDSMTEIW

SEQ ID NO: 487699 - protein, 9 aa, Influenza virus
TRDSMTEVW

SEQ ID NO: 487700 - protein, 9 aa, Influenza virus
TRDSVTELW

SEQ ID NO: 487701 - protein, 9 aa, Influenza virus
TREGKHIVE

SEQ ID NO: 487702 - protein, 9 aa, Influenza virus
TREGRRKTN

SEQ ID NO: 487703 - protein, 9 aa, Influenza virus
TREILTKIT

SEQ ID NO: 487704 - protein, 9 aa, Influenza virus
TREILTKTT

SEQ ID NO: 487705 - protein, 9 aa, Influenza virus
TREILTRTT

SEQ ID NO: 487706 - protein, 9 aa, Influenza virus
TRELCTINS

SEQ ID NO: 487707 - protein, 9 aa, Influenza virus
TRELYVSCD

SEQ ID NO: 487708 - protein, 9 aa, Influenza virus
TREPFISCS

SEQ ID NO: 487709 - protein, 9 aa, Influenza virus
TREPYISCD

SEQ ID NO: 487710 - protein, 9 aa, Influenza virus
TREPYLSCD

SEQ ID NO: 487711 - protein, 9 aa, Influenza virus
TREPYLSCG

SEQ ID NO: 487712 - protein, 9 aa, Influenza virus
TREPYVSCD

SEQ ID NO: 487713 - protein, 9 aa, Influenza virus
TREPYVSCE

SEQ ID NO: 487714 - protein, 9 aa, Influenza virus
TREPYVSCG

SEQ ID NO: 487715 - protein, 9 aa, Influenza virus
TREPYVSCK

SEQ ID NO: 487716 - protein, 9 aa, Influenza virus
TREPYVSCS

SEQ ID NO: 487717 - protein, 9 aa, Influenza virus
TREWSYLIE

SEQ ID NO: 487718 - protein, 9 aa, Influenza virus
TRFLPVAGG

SEQ ID NO: 487719 - protein, 9 aa, Influenza virus
TRFLPVSGG

SEQ ID NO: 487720 - protein, 9 aa, Influenza virus
TRFLPVTGG

SEQ ID NO: 487721 - protein, 9 aa, Influenza virus
TRFTYSGIR

SEQ ID NO: 487722 - protein, 9 aa, Influenza virus
TRGAYERMC

SEQ ID NO: 487723 - protein, 9 aa, Influenza virus
TRGIFGAIA

SEQ ID NO: 487724 - protein, 9 aa, Influenza virus
TRGILTKTT

SEQ ID NO: 487725 - protein, 9 aa, Influenza virus
TRGIQIASN

SEQ ID NO: 487726 - protein, 9 aa, Influenza virus
TRGLCTINS

SEQ ID NO: 487727 - protein, 9 aa, Influenza virus
TRGLFGAIA

SEQ ID NO: 487728 - protein, 9 aa, Influenza virus
TRGLFGAKA

SEQ ID NO: 487729 - protein, 9 aa, Influenza virus
TRGVQIASN

SEQ ID NO: 487730 - protein, 9 aa, Influenza virus
TRGVQVASN

SEQ ID NO: 487731 - protein, 9 aa, Influenza virus
TRIAYERMC

SEQ ID NO: 487732 - protein, 9 aa, Influenza virus
TRIGDGQRS

SEQ ID NO: 487733 - protein, 9 aa, Influenza virus
TRILFIEEG

SEQ ID NO: 487734 - protein, 9 aa, Influenza virus
TRILFIKEG

SEQ ID NO: 487735 - protein, 9 aa, Influenza virus
TRILFIREG

SEQ ID NO: 487736 - protein, 9 aa, Influenza virus
TRILFVKEG

SEQ ID NO: 487737 - protein, 9 aa, Influenza virus
TRINMINSK

SEQ ID NO: 487738 - protein, 9 aa, Influenza virus
TRIYYFKEG

SEQ ID NO: 487739 - protein, 9 aa, Influenza virus
TRKEPALIV

SEQ ID NO: 487740 - protein, 9 aa, Influenza virus
TRKLIQLIV

SEQ ID NO: 487741 - protein, 9 aa, Influenza virus
TRKMVTQRT

SEQ ID NO: 487742 - protein, 9 aa, Influenza virus
TRKQLRENA

SEQ ID NO: 487743 - protein, 9 aa, Influenza virus
TRLFTIRQE

SEQ ID NO: 487744 - protein, 9 aa, Influenza virus
TRLPFQNLS

SEQ ID NO: 487745 - protein, 9 aa, Influenza virus
TRLYIWGVH

SEQ ID NO: 487746 - protein, 9 aa, Influenza virus
TRLYVNKNP

SEQ ID NO: 487747 - protein, 9 aa, Influenza virus
TRPGYNGQK

SEQ ID NO: 487748 - protein, 9 aa, Influenza virus
TRPILSPLT

SEQ ID NO: 487749 - protein, 9 aa, Influenza virus
TRQASPSCL

SEQ ID NO: 487750 - protein, 9 aa, Influenza virus
TRQMVHAMR

SEQ ID NO: 487751 - protein, 9 aa, Influenza virus
TRQMVQAMR

SEQ ID NO: 487752 - protein, 9 aa, Influenza virus
TRQVCIAWS

SEQ ID NO: 487753 - protein, 9 aa, Influenza virus
TRQVCMAWS

SEQ ID NO: 487754 - protein, 9 aa, Influenza virus
TRQVCVAWS

SEQ ID NO: 487755 - protein, 9 aa, Influenza virus
TRREIHIYY

SEQ ID NO: 487756 - protein, 9 aa, Influenza virus
TRREVHIYY

SEQ ID NO: 487757 - protein, 9 aa, Influenza virus
TRREVHTYY

SEQ ID NO: 487758 - protein, 9 aa, Influenza virus
TRREVHVYY

SEQ ID NO: 487759 - protein, 9 aa, Influenza virus
TRRIDFHWL

SEQ ID NO: 487760 - protein, 9 aa, Influenza virus
TRRLIQLIV

SEQ ID NO: 487761 - protein, 9 aa, Influenza virus
TRRLTVLGK

SEQ ID NO: 487762 - protein, 9 aa, Influenza virus
TRRLVQLIV

SEQ ID NO: 487763 - protein, 9 aa, Influenza virus
TRRMIQLIV

SEQ ID NO: 487764 - protein, 9 aa, Influenza virus
TRRQKRGLF

SEQ ID NO: 487765 - protein, 9 aa, Influenza virus
TRRQLRENA

SEQ ID NO: 487766 - protein, 9 aa, Influenza virus
TRSAYERMC

SEQ ID NO: 487767 - protein, 9 aa, Influenza virus
TRSDQISIV

SEQ ID NO: 487768 - protein, 9 aa, Influenza virus
TRSGGNNNQ

SEQ ID NO: 487769 - protein, 9 aa, Influenza virus
TRSGGNTNH

SEQ ID NO: 487770 - protein, 9 aa, Influenza virus
TRSGGNTNQ

SEQ ID NO: 487771 - protein, 9 aa, Influenza virus
TRSGGNTSQ

SEQ ID NO: 487772 - protein, 9 aa, Influenza virus
TRSGQNHGI

SEQ ID NO: 487773 - protein, 9 aa, Influenza virus
TRSGTSKAC

SEQ ID NO: 487774 - protein, 9 aa, Influenza virus
TRSGYEMLK

SEQ ID NO: 487775 - protein, 9 aa, Influenza virus
TRSRSGFEM

SEQ ID NO: 487776 - protein, 9 aa, Influenza virus
TRTAYERMC

SEQ ID NO: 487777 - protein, 9 aa, Influenza virus
TRTTVDHMA

SEQ ID NO: 487778 - protein, 9 aa, Influenza virus
TRVAYERMC

SEQ ID NO: 487779 - protein, 9 aa, Influenza virus
TRVDKLTQG

SEQ ID NO: 487780 - protein, 9 aa, Influenza virus
TRVDRLTQG

SEQ ID NO: 487781 - protein, 9 aa, Influenza virus
TRVKRQLRE

SEQ ID NO: 487782 - protein, 9 aa, Influenza virus
TRVWWTSNS

SEQ ID NO: 487783 - protein, 9 aa, Influenza virus
TRVYYFKEG

SEQ ID NO: 487784 - protein, 9 aa, Influenza virus
TRVYYFKGG

SEQ ID NO: 487785 - protein, 9 aa, Influenza virus
TRVYYFKKG

SEQ ID NO: 487786 - protein, 9 aa, Influenza virus
TRVYYFREG

SEQ ID NO: 487787 - protein, 9 aa, Influenza virus
TRWMKIIRV

SEQ ID NO: 487788 - protein, 9 aa, Influenza virus
TRYVCSKFH

SEQ ID NO: 487789 - protein, 9 aa, Influenza virus
TSACKRTVS

SEQ ID NO: 487790 - protein, 9 aa, Influenza virus
TSARQEKNP

SEQ ID NO: 487791 - protein, 9 aa, Influenza virus
TSCFDGKEW

SEQ ID NO: 487792 - protein, 9 aa, Influenza virus
TSCHDGIGR

SEQ ID NO: 487793 - protein, 9 aa, Influenza virus
TSCHDGISR

SEQ ID NO: 487794 - protein, 9 aa, Influenza virus
TSCHDGKAR

SEQ ID NO: 487795 - protein, 9 aa, Influenza virus
TSCHDGKFR

SEQ ID NO: 487796 - protein, 9 aa, Influenza virus
TSCHDGKSR

SEQ ID NO: 487797 - protein, 9 aa, Influenza virus
TSCHDGKTR

SEQ ID NO: 487798 - protein, 9 aa, Influenza virus
TSCHDGMSR

SEQ ID NO: 487799 - protein, 9 aa, Influenza virus
TSCHDGRAR

SEQ ID NO: 487800 - protein, 9 aa, Influenza virus
TSCHDGRSR

SEQ ID NO: 487801 - protein, 9 aa, Influenza virus
TSCHDGVGR

SEQ ID NO: 487802 - protein, 9 aa, Influenza virus
TSCHDGVSR

SEQ ID NO: 487803 - protein, 9 aa, Influenza virus
TSDMRAEII

SEQ ID NO: 487804 - protein, 9 aa, Influenza virus
TSDMRTEII

SEQ ID NO: 487805 - protein, 9 aa, Influenza virus
TSDMRTEVI

SEQ ID NO: 487806 - protein, 9 aa, Influenza virus
TSFFYRYGF

SEQ ID NO: 487807 - protein, 9 aa, Influenza virus
TSFQVDCYL

SEQ ID NO: 487808 - protein, 9 aa, Influenza virus
TSGEQMLII

SEQ ID NO: 487809 - protein, 9 aa, Influenza virus
TSGEQMLVI

SEQ ID NO: 487810 - protein, 9 aa, Influenza virus
TSGEQVLVI

SEQ ID NO: 487811 - protein, 9 aa, Influenza virus
TSGNLIAPE

SEQ ID NO: 487812 - protein, 9 aa, Influenza virus
TSGRQEKNP

SEQ ID NO: 487813 - protein, 9 aa, Influenza virus
TSGSIISFC

SEQ ID NO: 487814 - protein, 9 aa, Influenza virus
TSGSSIAFC

SEQ ID NO: 487815 - protein, 9 aa, Influenza virus
TSGSSISFC

SEQ ID NO: 487816 - protein, 9 aa, Influenza virus
TSGTYGAGS

SEQ ID NO: 487817 - protein, 9 aa, Influenza virus
TSGTYGSGS

SEQ ID NO: 487818 - protein, 9 aa, Influenza virus
TSGTYGTGS

SEQ ID NO: 487819 - protein, 9 aa, Influenza virus
TSGTYGTGT

SEQ ID NO: 487820 - protein, 9 aa, Influenza virus
TSHRTLLMN

SEQ ID NO: 487821 - protein, 9 aa, Influenza virus
TSHTGTYCS

SEQ ID NO: 487822 - protein, 9 aa, Influenza virus
TSIRNNTYD

SEQ ID NO: 487823 - protein, 9 aa, Influenza virus
TSISCLYKL

SEQ ID NO: 487824 - protein, 9 aa, Influenza virus
TSIWTSSSS

SEQ ID NO: 487825 - protein, 9 aa, Influenza virus
TSKACNALT

SEQ ID NO: 487826 - protein, 9 aa, Influenza virus
TSKACNAST

SEQ ID NO: 487827 - protein, 9 aa, Influenza virus
TSKACSAST

SEQ ID NO: 487828 - protein, 9 aa, Influenza virus
TSKDSRSGY

SEQ ID NO: 487829 - protein, 9 aa, Influenza virus
TSKHYIGKC

SEQ ID NO: 487830 - protein, 9 aa, Influenza virus
TSKIKMKWG

SEQ ID NO: 487831 - protein, 9 aa, Influenza virus
TSKPFQNIC

SEQ ID NO: 487832 - protein, 9 aa, Influenza virus
TSKPFQNTS

SEQ ID NO: 487833 - protein, 9 aa, Influenza virus
TSKPLQNTS

SEQ ID NO: 487834 - protein, 9 aa, Influenza virus
TSKVKMKWG

SEQ ID NO: 487835 - protein, 9 aa, Influenza virus
TSLCSIWFS

SEQ ID NO: 487836 - protein, 9 aa, Influenza virus
TSLLLATGM

SEQ ID NO: 487837 - protein, 9 aa, Influenza virus
TSLTSLPFQ

SEQ ID NO: 487838 - protein, 9 aa, Influenza virus
TSNLPFQNV

SEQ ID NO: 487839 - protein, 9 aa, Influenza virus
TSNQDSFYR

SEQ ID NO: 487840 - protein, 9 aa, Influenza virus
TSNQGSFYR

SEQ ID NO: 487841 - protein, 9 aa, Influenza virus
TSNRGSFYR

SEQ ID NO: 487842 - protein, 9 aa, Influenza virus
TSNSIAVFC

SEQ ID NO: 487843 - protein, 9 aa, Influenza virus
TSNSIIAFC

SEQ ID NO: 487844 - protein, 9 aa, Influenza virus
TSNSIIVFC

SEQ ID NO: 487845 - protein, 9 aa, Influenza virus
TSNSIVAFC

SEQ ID NO: 487846 - protein, 9 aa, Influenza virus
TSNSIVALC

SEQ ID NO: 487847 - protein, 9 aa, Influenza virus
TSNSIVSMC

SEQ ID NO: 487848 - protein, 9 aa, Influenza virus
TSNSIVTFC

SEQ ID NO: 487849 - protein, 9 aa, Influenza virus
TSNSIVVFC

SEQ ID NO: 487850 - protein, 9 aa, Influenza virus
TSNSIVVFV

SEQ ID NO: 487851 - protein, 9 aa, Influenza virus
TSNSLIALC

SEQ ID NO: 487852 - protein, 9 aa, Influenza virus
TSNSLVALC

SEQ ID NO: 487853 - protein, 9 aa, Influenza virus
TSNSMVTFC

SEQ ID NO: 487854 - protein, 9 aa, Influenza virus
TSNSVVVFC

SEQ ID NO: 487855 - protein, 9 aa, Influenza virus
TSPCLTDKG

SEQ ID NO: 487856 - protein, 9 aa, Influenza virus
TSPIVPSFD

SEQ ID NO: 487857 - protein, 9 aa, Influenza virus
TSPLPFQNI

SEQ ID NO: 487858 - protein, 9 aa, Influenza virus
TSQRGILED

SEQ ID NO: 487859 - protein, 9 aa, Influenza virus
TSQRGVLED

SEQ ID NO: 487860 - protein, 9 aa, Influenza virus
TSQYICSPV

SEQ ID NO: 487861 - protein, 9 aa, Influenza virus
TSQYLCTGI

SEQ ID NO: 487862 - protein, 9 aa, Influenza virus
TSQYLCTGV

SEQ ID NO: 487863 - protein, 9 aa, Influenza virus
TSRHYIGKC

SEQ ID NO: 487864 - protein, 9 aa, Influenza virus
TSRHYMGEC

SEQ ID NO: 487865 - protein, 9 aa, Influenza virus
TSRYVCTGI

SEQ ID NO: 487866 - protein, 9 aa, Influenza virus
TSSGTSKAC

SEQ ID NO: 487867 - protein, 9 aa, Influenza virus
TSSIDLIET

SEQ ID NO: 487868 - protein, 9 aa, Influenza virus
TSSIDLVET

SEQ ID NO: 487869 - protein, 9 aa, Influenza virus
TSSIELVEN

SEQ ID NO: 487870 - protein, 9 aa, Influenza virus
TSSIYIEVL

SEQ ID NO: 487871 - protein, 9 aa, Influenza virus
TSSQDTEIS

SEQ ID NO: 487872 - protein, 9 aa, Influenza virus
TSSQDTELS

SEQ ID NO: 487873 - protein, 9 aa, Influenza virus
TSSSSIVMC

SEQ ID NO: 487874 - protein, 9 aa, Influenza virus
TSSSSTVFC

SEQ ID NO: 487875 - protein, 9 aa, Influenza virus
TSSSSVVMC

SEQ ID NO: 487876 - protein, 9 aa, Influenza virus
TSSVDLIET

SEQ ID NO: 487877 - protein, 9 aa, Influenza virus
TSSVDLVET

SEQ ID NO: 487878 - protein, 9 aa, Influenza virus
TSSVELVEN

SEQ ID NO: 487879 - protein, 9 aa, Influenza virus
TSSVELVET

SEQ ID NO: 487880 - protein, 9 aa, Influenza virus
TSSVYIEVL

SEQ ID NO: 487881 - protein, 9 aa, Influenza virus
TSSVYVEVL

SEQ ID NO: 487882 - protein, 9 aa, Influenza virus
TSTIDLIET

SEQ ID NO: 487883 - protein, 9 aa, Influenza virus
TSTQKAINE

SEQ ID NO: 487884 - protein, 9 aa, Influenza virus
TSVGGIDTN

SEQ ID NO: 487885 - protein, 9 aa, Influenza virus
TSVGGINTN

SEQ ID NO: 487886 - protein, 9 aa, Influenza virus
TSVKTLTDN

SEQ ID NO: 487887 - protein, 9 aa, Influenza virus
TSVTTNTIN

SEQ ID NO: 487888 - protein, 9 aa, Influenza virus
TSVWAGRTI

SEQ ID NO: 487889 - protein, 9 aa, Influenza virus
TSVWAGRTV

SEQ ID NO: 487890 - protein, 9 aa, Influenza virus
TSWSWPDGA

SEQ ID NO: 487891 - protein, 9 aa, Influenza virus
TSWSYIVEK

SEQ ID NO: 487892 - protein, 9 aa, Influenza virus
TSWSYIVER

SEQ ID NO: 487893 - protein, 9 aa, Influenza virus
TSYKILSIY

SEQ ID NO: 487894 - protein, 9 aa, Influenza virus
TSYRSLIRF

SEQ ID NO: 487895 - protein, 9 aa, Influenza virus
TSYWWDGLQ

SEQ ID NO: 487896 - protein, 9 aa, Influenza virus
TTAKAMEQM

SEQ ID NO: 487897 - protein, 9 aa, Influenza virus
TTAKAMEQV

SEQ ID NO: 487898 - protein, 9 aa, Influenza virus
TTASCQNRG

SEQ ID NO: 487899 - protein, 9 aa, Influenza virus
TTAVAVLKY

SEQ ID NO: 487900 - protein, 9 aa, Influenza virus
TTCHDGIGR

SEQ ID NO: 487901 - protein, 9 aa, Influenza virus
TTCWSWPDG

SEQ ID NO: 487902 - protein, 9 aa, Influenza virus
TTDWSGYSG

SEQ ID NO: 487903 - protein, 9 aa, Influenza virus
TTEINTWAR

SEQ ID NO: 487904 - protein, 9 aa, Influenza virus
TTEIRASVG

SEQ ID NO: 487905 - protein, 9 aa, Influenza virus
TTEIYNETV

SEQ ID NO: 487906 - protein, 9 aa, Influenza virus
TTEVSHCRA

SEQ ID NO: 487907 - protein, 9 aa, Influenza virus
TTEVYNETV

SEQ ID NO: 487908 - protein, 9 aa, Influenza virus
TTEVYSETV

SEQ ID NO: 487909 - protein, 9 aa, Influenza virus
TTFESNGGL

SEQ ID NO: 487910 - protein, 9 aa, Influenza virus
TTFPYTGDP

SEQ ID NO: 487911 - protein, 9 aa, Influenza virus
TTFRGLIST

SEQ ID NO: 487912 - protein, 9 aa, Influenza virus
TTFRGLLST

SEQ ID NO: 487913 - protein, 9 aa, Influenza virus
TTGKSHGRI

SEQ ID NO: 487914 - protein, 9 aa, Influenza virus
TTGMTLSVV

SEQ ID NO: 487915 - protein, 9 aa, Influenza virus
TTGNPIICL

SEQ ID NO: 487916 - protein, 9 aa, Influenza virus
TTGRDVLVI

SEQ ID NO: 487917 - protein, 9 aa, Influenza virus
TTGRDVLVL

SEQ ID NO: 487918 - protein, 9 aa, Influenza virus
TTGRDVLVM

SEQ ID NO: 487919 - protein, 9 aa, Influenza virus
TTGRNCTIP

SEQ ID NO: 487920 - protein, 9 aa, Influenza virus
TTGRNCTVP

SEQ ID NO: 487921 - protein, 9 aa, Influenza virus
TTGWSWPDG

SEQ ID NO: 487922 - protein, 9 aa, Influenza virus
TTHDRTAFR

SEQ ID NO: 487923 - protein, 9 aa, Influenza virus
TTHFQRKRR

SEQ ID NO: 487924 - protein, 9 aa, Influenza virus
TTHSWIPKR

SEQ ID NO: 487925 - protein, 9 aa, Influenza virus
TTHSWTPKR

SEQ ID NO: 487926 - protein, 9 aa, Influenza virus
TTHSWVPIL

SEQ ID NO: 487927 - protein, 9 aa, Influenza virus
TTHSWVPKR

SEQ ID NO: 487928 - protein, 9 aa, Influenza virus
TTHTGTYCS

SEQ ID NO: 487929 - protein, 9 aa, Influenza virus
TTIGLLLQI

SEQ ID NO: 487930 - protein, 9 aa, Influenza virus
TTIKPWARN

SEQ ID NO: 487931 - protein, 9 aa, Influenza virus
TTIKTWAGK

SEQ ID NO: 487932 - protein, 9 aa, Influenza virus
TTIKTWAGN

SEQ ID NO: 487933 - protein, 9 aa, Influenza virus
TTIKTWAKN

SEQ ID NO: 487934 - protein, 9 aa, Influenza virus
TTIKTWARN

SEQ ID NO: 487935 - protein, 9 aa, Influenza virus
TTINNITNV

SEQ ID NO: 487936 - protein, 9 aa, Influenza virus
TTIRGKHSN

SEQ ID NO: 487937 - protein, 9 aa, Influenza virus
TTIRGRHSN

SEQ ID NO: 487938 - protein, 9 aa, Influenza virus
TTIRNKHSN

SEQ ID NO: 487939 - protein, 9 aa, Influenza virus
TTIRNRHSN

SEQ ID NO: 487940 - protein, 9 aa, Influenza virus
TTIRTWAKN

SEQ ID NO: 487941 - protein, 9 aa, Influenza virus
TTITLHFKQ

SEQ ID NO: 487942 - protein, 9 aa, Influenza virus
TTIWTSGSS

SEQ ID NO: 487943 - protein, 9 aa, Influenza virus
TTKINNIID

SEQ ID NO: 487944 - protein, 9 aa, Influenza virus
TTKINNIIE

SEQ ID NO: 487945 - protein, 9 aa, Influenza virus
TTLDNEHSN

SEQ ID NO: 487946 - protein, 9 aa, Influenza virus
TTLDNKHSN

SEQ ID NO: 487947 - protein, 9 aa, Influenza virus
TTLENKHSN

SEQ ID NO: 487948 - protein, 9 aa, Influenza virus
TTLIENTYV

SEQ ID NO: 487949 - protein, 9 aa, Influenza virus
TTLKGRHAN

SEQ ID NO: 487950 - protein, 9 aa, Influenza virus
TTLNNKHSN

SEQ ID NO: 487951 - protein, 9 aa, Influenza virus
TTLPFHNIH

SEQ ID NO: 487952 - protein, 9 aa, Influenza virus
TTLPFHNVH

SEQ ID NO: 487953 - protein, 9 aa, Influenza virus
TTLRGQHAN

SEQ ID NO: 487954 - protein, 9 aa, Influenza virus
TTLRGRHAN

SEQ ID NO: 487955 - protein, 9 aa, Influenza virus
TTLSTIALF

SEQ ID NO: 487956 - protein, 9 aa, Influenza virus
TTLSTIALI

SEQ ID NO: 487957 - protein, 9 aa, Influenza virus
TTLSTIALL

SEQ ID NO: 487958 - protein, 9 aa, Influenza virus
TTLYKNANT

SEQ ID NO: 487959 - protein, 9 aa, Influenza virus
TTLYNKHSN

SEQ ID NO: 487960 - protein, 9 aa, Influenza virus
TTMEKNVTV

SEQ ID NO: 487961 - protein, 9 aa, Influenza virus
TTNPLIKHE

SEQ ID NO: 487962 - protein, 9 aa, Influenza virus
TTNPLIRHE

SEQ ID NO: 487963 - protein, 9 aa, Influenza virus
TTNSIVVFC

SEQ ID NO: 487964 - protein, 9 aa, Influenza virus
TTNTINRIF

SEQ ID NO: 487965 - protein, 9 aa, Influenza virus
TTNTINRNF

SEQ ID NO: 487966 - protein, 9 aa, Influenza virus
TTNTINRSF

SEQ ID NO: 487967 - protein, 9 aa, Influenza virus
TTNTYRNTD

SEQ ID NO: 487968 - protein, 9 aa, Influenza virus
TTNYYNETF

SEQ ID NO: 487969 - protein, 9 aa, Influenza virus
TTPTKSYFA

SEQ ID NO: 487970 - protein, 9 aa, Influenza virus
TTQIIKLLP

SEQ ID NO: 487971 - protein, 9 aa, Influenza virus
TTRQASPSC

SEQ ID NO: 487972 - protein, 9 aa, Influenza virus
TTSKDSRSG

SEQ ID NO: 487973 - protein, 9 aa, Influenza virus
TTSWSWPDG

SEQ ID NO: 487974 - protein, 9 aa, Influenza virus
TTTIKPWAR

SEQ ID NO: 487975 - protein, 9 aa, Influenza virus
TTTIKTWAG

SEQ ID NO: 487976 - protein, 9 aa, Influenza virus
TTTIKTWAK

SEQ ID NO: 487977 - protein, 9 aa, Influenza virus
TTTIKTWAR

SEQ ID NO: 487978 - protein, 9 aa, Influenza virus
TTTIRTWAK

SEQ ID NO: 487979 - protein, 9 aa, Influenza virus
TTTNPLIRH

SEQ ID NO: 487980 - protein, 9 aa, Influenza virus
TTTPTKSYF

SEQ ID NO: 487981 - protein, 9 aa, Influenza virus
TTTTIINNN

SEQ ID NO: 487982 - protein, 9 aa, Influenza virus
TTTVKTWAG

SEQ ID NO: 487983 - protein, 9 aa, Influenza virus
TTVDHMAII

SEQ ID NO: 487984 - protein, 9 aa, Influenza virus
TTVGLLLQI

SEQ ID NO: 487985 - protein, 9 aa, Influenza virus
TTVGLLLQV

SEQ ID NO: 487986 - protein, 9 aa, Influenza virus
TTVGWSWPD

SEQ ID NO: 487987 - protein, 9 aa, Influenza virus
TTVKTWAGN

SEQ ID NO: 487988 - protein, 9 aa, Influenza virus
TTVNEEALR

SEQ ID NO: 487989 - protein, 9 aa, Influenza virus
TTVTLHFKQ

SEQ ID NO: 487990 - protein, 9 aa, Influenza virus
TTVVENTYV

SEQ ID NO: 487991 - protein, 9 aa, Influenza virus
TTVWWTSNS

SEQ ID NO: 487992 - protein, 9 aa, Influenza virus
TTWDVFIER

SEQ ID NO: 487993 - protein, 9 aa, Influenza virus
TTYKILSIY

SEQ ID NO: 487994 - protein, 9 aa, Influenza virus
TTYQRTRAL

SEQ ID NO: 487995 - protein, 9 aa, Influenza virus
TTYRILSIY

SEQ ID NO: 487996 - protein, 9 aa, Influenza virus
TTYWWDGLQ

SEQ ID NO: 487997 - protein, 9 aa, Influenza virus
TVAASLCLA

SEQ ID NO: 487998 - protein, 9 aa, Influenza virus
TVAGSLSLA

SEQ ID NO: 487999 - protein, 9 aa, Influenza virus
TVASSLALA

SEQ ID NO: 488000 - protein, 9 aa, Influenza virus
TVASSLTLA

SEQ ID NO: 488001 - protein, 9 aa, Influenza virus
TVASSLVLA

SEQ ID NO: 488002 - protein, 9 aa, Influenza virus
TVDHMAIIK

SEQ ID NO: 488003 - protein, 9 aa, Influenza virus
TVDTILEKN

SEQ ID NO: 488004 - protein, 9 aa, Influenza virus
TVDTILERN

SEQ ID NO: 488005 - protein, 9 aa, Influenza virus
TVDTLIEQN

SEQ ID NO: 488006 - protein, 9 aa, Influenza virus
TVDTLLEKN

SEQ ID NO: 488007 - protein, 9 aa, Influenza virus
TVDTLTENG

SEQ ID NO: 488008 - protein, 9 aa, Influenza virus
TVDTVLEKN

SEQ ID NO: 488009 - protein, 9 aa, Influenza virus
TVDTVLERN

SEQ ID NO: 488010 - protein, 9 aa, Influenza virus
TVEITGIDK

SEQ ID NO: 488011 - protein, 9 aa, Influenza virus
TVEITGINK

SEQ ID NO: 488012 - protein, 9 aa, Influenza virus
TVERMVLSA

SEQ ID NO: 488013 - protein, 9 aa, Influenza virus
TVFCGVSGE

SEQ ID NO: 488014 - protein, 9 aa, Influenza virus
TVFCGVSSE

SEQ ID NO: 488015 - protein, 9 aa, Influenza virus
TVGKCPRYI

SEQ ID NO: 488016 - protein, 9 aa, Influenza virus
TVGKCPRYV

SEQ ID NO: 488017 - protein, 9 aa, Influenza virus
TVGLLLQII

SEQ ID NO: 488018 - protein, 9 aa, Influenza virus
TVGLLLQIT

SEQ ID NO: 488019 - protein, 9 aa, Influenza virus
TVGLLLQVT

SEQ ID NO: 488020 - protein, 9 aa, Influenza virus
TVGQCPKYV

SEQ ID NO: 488021 - protein, 9 aa, Influenza virus
TVGRCPRYV

SEQ ID NO: 488022 - protein, 9 aa, Influenza virus
TVGSSKYQQ

SEQ ID NO: 488023 - protein, 9 aa, Influenza virus
TVGSSKYRQ

SEQ ID NO: 488024 - protein, 9 aa, Influenza virus
TVGSSNYQQ

SEQ ID NO: 488025 - protein, 9 aa, Influenza virus
TVHDRIPHR

SEQ ID NO: 488026 - protein, 9 aa, Influenza virus
TVIKNNMIN

SEQ ID NO: 488027 - protein, 9 aa, Influenza virus
TVIKNNMVN

SEQ ID NO: 488028 - protein, 9 aa, Influenza virus
TVIMTDGSA

SEQ ID NO: 488029 - protein, 9 aa, Influenza virus
TVINNITTT

SEQ ID NO: 488030 - protein, 9 aa, Influenza virus
TVINNYYNE

SEQ ID NO: 488031 - protein, 9 aa, Influenza virus
TVIRNNMIN

SEQ ID NO: 488032 - protein, 9 aa, Influenza virus
TVKDRSPFR

SEQ ID NO: 488033 - protein, 9 aa, Influenza virus
TVKDRSPYR

SEQ ID NO: 488034 - protein, 9 aa, Influenza virus
TVKIKTNGN

SEQ ID NO: 488035 - protein, 9 aa, Influenza virus
TVKIQTNGN

SEQ ID NO: 488036 - protein, 9 aa, Influenza virus
TVKIQTSGN

SEQ ID NO: 488037 - protein, 9 aa, Influenza virus
TVKQDGKSS

SEQ ID NO: 488038 - protein, 9 aa, Influenza virus
TVKQNGKSG

SEQ ID NO: 488039 - protein, 9 aa, Influenza virus
TVKQNGKSS

SEQ ID NO: 488040 - protein, 9 aa, Influenza virus
TVKTWAGNI

SEQ ID NO: 488041 - protein, 9 aa, Influenza virus
TVLEKNVTV

SEQ ID NO: 488042 - protein, 9 aa, Influenza virus
TVLERNVTV

SEQ ID NO: 488043 - protein, 9 aa, Influenza virus
TVLGVSILN

SEQ ID NO: 488044 - protein, 9 aa, Influenza virus
TVLKSDKRI

SEQ ID NO: 488045 - protein, 9 aa, Influenza virus
TVLSIIALL

SEQ ID NO: 488046 - protein, 9 aa, Influenza virus
TVLVGLILA

SEQ ID NO: 488047 - protein, 9 aa, Influenza virus
TVMVGLILA

SEQ ID NO: 488048 - protein, 9 aa, Influenza virus
TVNEEALRQ

SEQ ID NO: 488049 - protein, 9 aa, Influenza virus
TVNEGALRQ

SEQ ID NO: 488050 - protein, 9 aa, Influenza virus
TVNFSFNGA

SEQ ID NO: 488051 - protein, 9 aa, Influenza virus
TVNRTHQYS

SEQ ID NO: 488052 - protein, 9 aa, Influenza virus
TVNTLIEQK

SEQ ID NO: 488053 - protein, 9 aa, Influenza virus
TVNTLIEQN

SEQ ID NO: 488054 - protein, 9 aa, Influenza virus
TVNTLMEQN

SEQ ID NO: 488055 - protein, 9 aa, Influenza virus
TVNTLSEQN

SEQ ID NO: 488056 - protein, 9 aa, Influenza virus
TVNTLTEQN

SEQ ID NO: 488057 - protein, 9 aa, Influenza virus
TVNVRGSGL

SEQ ID NO: 488058 - protein, 9 aa, Influenza virus
TVNVRGSGM

SEQ ID NO: 488059 - protein, 9 aa, Influenza virus
TVNVRGTGM

SEQ ID NO: 488060 - protein, 9 aa, Influenza virus
TVPCFWVEM

SEQ ID NO: 488061 - protein, 9 aa, Influenza virus
TVPSERGLQ

SEQ ID NO: 488062 - protein, 9 aa, Influenza virus
TVQIIKLLP

SEQ ID NO: 488063 - protein, 9 aa, Influenza virus
TVQVDTIME

SEQ ID NO: 488064 - protein, 9 aa, Influenza virus
TVQVIKLLP

SEQ ID NO: 488065 - protein, 9 aa, Influenza virus
TVSADPLAS

SEQ ID NO: 488066 - protein, 9 aa, Influenza virus
TVSADPLLS

SEQ ID NO: 488067 - protein, 9 aa, Influenza virus
TVSADPLVS

SEQ ID NO: 488068 - protein, 9 aa, Influenza virus
TVSCDSPSN

SEQ ID NO: 488069 - protein, 9 aa, Influenza virus
TVSIDRFLR

SEQ ID NO: 488070 - protein, 9 aa, Influenza virus
TVSLSPGMM

SEQ ID NO: 488071 - protein, 9 aa, Influenza virus
TVSSFERFE

SEQ ID NO: 488072 - protein, 9 aa, Influenza virus
TVSSFYSEM

SEQ ID NO: 488073 - protein, 9 aa, Influenza virus
TVSSGLVLV

SEQ ID NO: 488074 - protein, 9 aa, Influenza virus
TVSSSLVLA

SEQ ID NO: 488075 - protein, 9 aa, Influenza virus
TVSSSLVLV

SEQ ID NO: 488076 - protein, 9 aa, Influenza virus
TVSTRSDQI

SEQ ID NO: 488077 - protein, 9 aa, Influenza virus
TVSVRGSGM

SEQ ID NO: 488078 - protein, 9 aa, Influenza virus
TVTDGPAAN

SEQ ID NO: 488079 - protein, 9 aa, Influenza virus
TVTFIFNGA

SEQ ID NO: 488080 - protein, 9 aa, Influenza virus
TVTFNFNGA

SEQ ID NO: 488081 - protein, 9 aa, Influenza virus
TVTFSFNGA

SEQ ID NO: 488082 - protein, 9 aa, Influenza virus
TVTFTFNGA

SEQ ID NO: 488083 - protein, 9 aa, Influenza virus
TVTGPPQCD

SEQ ID NO: 488084 - protein, 9 aa, Influenza virus
TVTHAKDIL

SEQ ID NO: 488085 - protein, 9 aa, Influenza virus
TVTHAKNIL

SEQ ID NO: 488086 - protein, 9 aa, Influenza virus
TVTHAQDIL

SEQ ID NO: 488087 - protein, 9 aa, Influenza virus
TVTHAQDLL

SEQ ID NO: 488088 - protein, 9 aa, Influenza virus
TVTHAQNIL

SEQ ID NO: 488089 - protein, 9 aa, Influenza virus
TVTHSIELL

SEQ ID NO: 488090 - protein, 9 aa, Influenza virus
TVTHSINLL

SEQ ID NO: 488091 - protein, 9 aa, Influenza virus
TVTHSVDLL

SEQ ID NO: 488092 - protein, 9 aa, Influenza virus
TVTHSVELL

SEQ ID NO: 488093 - protein, 9 aa, Influenza virus
TVTHSVNIL

SEQ ID NO: 488094 - protein, 9 aa, Influenza virus
TVTHSVNLL

SEQ ID NO: 488095 - protein, 9 aa, Influenza virus
TVTLHFKQH

SEQ ID NO: 488096 - protein, 9 aa, Influenza virus
TVTLHFKQN

SEQ ID NO: 488097 - protein, 9 aa, Influenza virus
TVTSSIELV

SEQ ID NO: 488098 - protein, 9 aa, Influenza virus
TVTSSVELV

SEQ ID NO: 488099 - protein, 9 aa, Influenza virus
TVVENTYVN

SEQ ID NO: 488100 - protein, 9 aa, Influenza virus
TVVKTLTNE

SEQ ID NO: 488101 - protein, 9 aa, Influenza virus
TVVLNTDWS

SEQ ID NO: 488102 - protein, 9 aa, Influenza virus
TVVMTDGNA

SEQ ID NO: 488103 - protein, 9 aa, Influenza virus
TVVMTDGSA

SEQ ID NO: 488104 - protein, 9 aa, Influenza virus
TVVNNITTT

SEQ ID NO: 488105 - protein, 9 aa, Influenza virus
TVVSSLALA

SEQ ID NO: 488106 - protein, 9 aa, Influenza virus
TVWSSKYQQ

SEQ ID NO: 488107 - protein, 9 aa, Influenza virus
TVWSSKYQR

SEQ ID NO: 488108 - protein, 9 aa, Influenza virus
TVWSSKYRR

SEQ ID NO: 488109 - protein, 9 aa, Influenza virus
TVWTSGSII

SEQ ID NO: 488110 - protein, 9 aa, Influenza virus
TVWTSGSSI

SEQ ID NO: 488111 - protein, 9 aa, Influenza virus
TVWTSSSSI

SEQ ID NO: 488112 - protein, 9 aa, Influenza virus
TVYWWDGLQ

SEQ ID NO: 488113 - protein, 9 aa, Influenza virus
TVYYDRRLT

SEQ ID NO: 488114 - protein, 9 aa, Influenza virus
TVYYERRLT

SEQ ID NO: 488115 - protein, 9 aa, Influenza virus
TVYYNGRLT

SEQ ID NO: 488116 - protein, 9 aa, Influenza virus
TVYYNKRLT

SEQ ID NO: 488117 - protein, 9 aa, Influenza virus
TVYYNRRLT

SEQ ID NO: 488118 - protein, 9 aa, Influenza virus
TVYYNRRPT

SEQ ID NO: 488119 - protein, 9 aa, Influenza virus
TWAGKILRT

SEQ ID NO: 488120 - protein, 9 aa, Influenza virus
TWAGNILRT

SEQ ID NO: 488121 - protein, 9 aa, Influenza virus
TWAIHHPPT

SEQ ID NO: 488122 - protein, 9 aa, Influenza virus
TWAKNILRT

SEQ ID NO: 488123 - protein, 9 aa, Influenza virus
TWARNILRT

SEQ ID NO: 488124 - protein, 9 aa, Influenza virus
TWAVVMTDG

SEQ ID NO: 488125 - protein, 9 aa, Influenza virus
TWDTLIERD

SEQ ID NO: 488126 - protein, 9 aa, Influenza virus
TWDTLIERE

SEQ ID NO: 488127 - protein, 9 aa, Influenza virus
TWDTLIERG

SEQ ID NO: 488128 - protein, 9 aa, Influenza virus
TWDVFIERP

SEQ ID NO: 488129 - protein, 9 aa, Influenza virus
TWGIHHPSS

SEQ ID NO: 488130 - protein, 9 aa, Influenza virus
TWLGRTFSP

SEQ ID NO: 488131 - protein, 9 aa, Influenza virus
TWLGRTISI

SEQ ID NO: 488132 - protein, 9 aa, Influenza virus
TWLGRTISP

SEQ ID NO: 488133 - protein, 9 aa, Influenza virus
TWLGRTIST

SEQ ID NO: 488134 - protein, 9 aa, Influenza virus
TWLGRTLNT

SEQ ID NO: 488135 - protein, 9 aa, Influenza virus
TWLGRTTST

SEQ ID NO: 488136 - protein, 9 aa, Influenza virus
TWNGVKVDG

SEQ ID NO: 488137 - protein, 9 aa, Influenza virus
TYAGAINSS

SEQ ID NO: 488138 - protein, 9 aa, Influenza virus
TYAGAVNSS

SEQ ID NO: 488139 - protein, 9 aa, Influenza virus
TYCSLNGIS

SEQ ID NO: 488140 - protein, 9 aa, Influenza virus
TYCSLNGVS

SEQ ID NO: 488141 - protein, 9 aa, Influenza virus
TYDFNEGAY

SEQ ID NO: 488142 - protein, 9 aa, Influenza virus
TYDFNEGSY

SEQ ID NO: 488143 - protein, 9 aa, Influenza virus
TYDFNEGTY

SEQ ID NO: 488144 - protein, 9 aa, Influenza virus
TYDHAQYRE

SEQ ID NO: 488145 - protein, 9 aa, Influenza virus
TYDHKDFEE

SEQ ID NO: 488146 - protein, 9 aa, Influenza virus
TYDHKDYEE

SEQ ID NO: 488147 - protein, 9 aa, Influenza virus
TYDHKEFEE

SEQ ID NO: 488148 - protein, 9 aa, Influenza virus
TYDHKEFEK

SEQ ID NO: 488149 - protein, 9 aa, Influenza virus
TYDHKEYEE

SEQ ID NO: 488150 - protein, 9 aa, Influenza virus
TYDHNIYRD

SEQ ID NO: 488151 - protein, 9 aa, Influenza virus
TYDHSHYRE

SEQ ID NO: 488152 - protein, 9 aa, Influenza virus
TYDHSQYRE

SEQ ID NO: 488153 - protein, 9 aa, Influenza virus
TYDHTQYRE

SEQ ID NO: 488154 - protein, 9 aa, Influenza virus
TYDWTLNRN

SEQ ID NO: 488155 - protein, 9 aa, Influenza virus
TYDYPKYEE

SEQ ID NO: 488156 - protein, 9 aa, Influenza virus
TYDYPKYEK

SEQ ID NO: 488157 - protein, 9 aa, Influenza virus
TYDYPKYSE

SEQ ID NO: 488158 - protein, 9 aa, Influenza virus
TYDYPKYSK

SEQ ID NO: 488159 - protein, 9 aa, Influenza virus
TYDYSKYEE

SEQ ID NO: 488160 - protein, 9 aa, Influenza virus
TYGACPKYI

SEQ ID NO: 488161 - protein, 9 aa, Influenza virus
TYGACPKYV

SEQ ID NO: 488162 - protein, 9 aa, Influenza virus
TYGACPRYI

SEQ ID NO: 488163 - protein, 9 aa, Influenza virus
TYGACPRYV

SEQ ID NO: 488164 - protein, 9 aa, Influenza virus
TYGAGSWPD

SEQ ID NO: 488165 - protein, 9 aa, Influenza virus
TYGKGSWPD

SEQ ID NO: 488166 - protein, 9 aa, Influenza virus
TYGPCPRYV

SEQ ID NO: 488167 - protein, 9 aa, Influenza virus
TYGSGSWPD

SEQ ID NO: 488168 - protein, 9 aa, Influenza virus
TYGTGSWAD

SEQ ID NO: 488169 - protein, 9 aa, Influenza virus
TYGTGSWPD

SEQ ID NO: 488170 - protein, 9 aa, Influenza virus
TYGTGTWPD

SEQ ID NO: 488171 - protein, 9 aa, Influenza virus
TYHNSFVPV

SEQ ID NO: 488172 - protein, 9 aa, Influenza virus
TYINNATII

SEQ ID NO: 488173 - protein, 9 aa, Influenza virus
TYINNTTII

SEQ ID NO: 488174 - protein, 9 aa, Influenza virus
TYISIGTST

SEQ ID NO: 488175 - protein, 9 aa, Influenza virus
TYISVGTST

SEQ ID NO: 488176 - protein, 9 aa, Influenza virus
TYIWTYQAE

SEQ ID NO: 488177 - protein, 9 aa, Influenza virus
TYKILSIYS

SEQ ID NO: 488178 - protein, 9 aa, Influenza virus
TYKILTIYS

SEQ ID NO: 488179 - protein, 9 aa, Influenza virus
TYNAELFVL

SEQ ID NO: 488180 - protein, 9 aa, Influenza virus
TYNAELLIL

SEQ ID NO: 488181 - protein, 9 aa, Influenza virus
TYNAELLVA

SEQ ID NO: 488182 - protein, 9 aa, Influenza virus
TYNAELLVL

SEQ ID NO: 488183 - protein, 9 aa, Influenza virus
TYNAEVLVL

SEQ ID NO: 488184 - protein, 9 aa, Influenza virus
TYNGIRTNG

SEQ ID NO: 488185 - protein, 9 aa, Influenza virus
TYNHEDYKE

SEQ ID NO: 488186 - protein, 9 aa, Influenza virus
TYNHEDYRE

SEQ ID NO: 488187 - protein, 9 aa, Influenza virus
TYNHKDYEE

SEQ ID NO: 488188 - protein, 9 aa, Influenza virus
TYNHKEYEE

SEQ ID NO: 488189 - protein, 9 aa, Influenza virus
TYNHTEYRQ

SEQ ID NO: 488190 - protein, 9 aa, Influenza virus
TYNHTQYRE

SEQ ID NO: 488191 - protein, 9 aa, Influenza virus
TYNKTVINN

SEQ ID NO: 488192 - protein, 9 aa, Influenza virus
TYNNTTGRD

SEQ ID NO: 488193 - protein, 9 aa, Influenza virus
TYNNTVINN

SEQ ID NO: 488194 - protein, 9 aa, Influenza virus
TYNNTVVNN

SEQ ID NO: 488195 - protein, 9 aa, Influenza virus
TYNRKEYEE

SEQ ID NO: 488196 - protein, 9 aa, Influenza virus
TYNSTVVNN

SEQ ID NO: 488197 - protein, 9 aa, Influenza virus
TYNTELLVL

SEQ ID NO: 488198 - protein, 9 aa, Influenza virus
TYNVELLVL

SEQ ID NO: 488199 - protein, 9 aa, Influenza virus
TYNYPKYEE

SEQ ID NO: 488200 - protein, 9 aa, Influenza virus
TYNYPKYSE

SEQ ID NO: 488201 - protein, 9 aa, Influenza virus
TYQAELLIA

SEQ ID NO: 488202 - protein, 9 aa, Influenza virus
TYQAELLVA

SEQ ID NO: 488203 - protein, 9 aa, Influenza virus
TYQILSIYS

SEQ ID NO: 488204 - protein, 9 aa, Influenza virus
TYQILSVYS

SEQ ID NO: 488205 - protein, 9 aa, Influenza virus
TYQKRMGVQ

SEQ ID NO: 488206 - protein, 9 aa, Influenza virus
TYQNNFVPV

SEQ ID NO: 488207 - protein, 9 aa, Influenza virus
TYQNSFVPV

SEQ ID NO: 488208 - protein, 9 aa, Influenza virus
TYQRTRALV

SEQ ID NO: 488209 - protein, 9 aa, Influenza virus
TYQWIIKNW

SEQ ID NO: 488210 - protein, 9 aa, Influenza virus
TYQWIIRNW

SEQ ID NO: 488211 - protein, 9 aa, Influenza virus
TYQWVIRNW

SEQ ID NO: 488212 - protein, 9 aa, Influenza virus
TYRCHKGDT

SEQ ID NO: 488213 - protein, 9 aa, Influenza virus
TYRCHRGDM

SEQ ID NO: 488214 - protein, 9 aa, Influenza virus
TYRCHRGDT

SEQ ID NO: 488215 - protein, 9 aa, Influenza virus
TYREEAMQN

SEQ ID NO: 488216 - protein, 9 aa, Influenza virus
TYRILSIYS

SEQ ID NO: 488217 - protein, 9 aa, Influenza virus
TYRNNRKEP

SEQ ID NO: 488218 - protein, 9 aa, Influenza virus
TYRNTRKEP

SEQ ID NO: 488219 - protein, 9 aa, Influenza virus
TYSEIRTNG

SEQ ID NO: 488220 - protein, 9 aa, Influenza virus
TYSGIRTDG

SEQ ID NO: 488221 - protein, 9 aa, Influenza virus
TYSGIRTNG

SEQ ID NO: 488222 - protein, 9 aa, Influenza virus
TYSSPMMWE

SEQ ID NO: 488223 - protein, 9 aa, Influenza virus
TYSSSLMWE

SEQ ID NO: 488224 - protein, 9 aa, Influenza virus
TYSSSMMWE

SEQ ID NO: 488225 - protein, 9 aa, Influenza virus
TYTGAINSS

SEQ ID NO: 488226 - protein, 9 aa, Influenza virus
TYTGISKAC

SEQ ID NO: 488227 - protein, 9 aa, Influenza virus
TYTGTSKAC

SEQ ID NO: 488228 - protein, 9 aa, Influenza virus
TYTGTSRAC

SEQ ID NO: 488229 - protein, 9 aa, Influenza virus
TYTGVRTDG

SEQ ID NO: 488230 - protein, 9 aa, Influenza virus
TYTGVRTNG

SEQ ID NO: 488231 - protein, 9 aa, Influenza virus
TYVDGFEPN

SEQ ID NO: 488232 - protein, 9 aa, Influenza virus
TYVLSIIPS

SEQ ID NO: 488233 - protein, 9 aa, Influenza virus
TYVLSIVPS

SEQ ID NO: 488234 - protein, 9 aa, Influenza virus
TYVLSVIPS

SEQ ID NO: 488235 - protein, 9 aa, Influenza virus
TYVNNTTII

SEQ ID NO: 488236 - protein, 9 aa, Influenza virus
TYVNNTTVI

SEQ ID NO: 488237 - protein, 9 aa, Influenza virus
TYVSIGTST

SEQ ID NO: 488238 - protein, 9 aa, Influenza virus
TYVSVGTST

SEQ ID NO: 488239 - protein, 9 aa, Influenza virus
TYWWDGLQS

SEQ ID NO: 488240 - protein, 9 aa, Influenza virus
TYYYPKYEE

SEQ ID NO: 488241 - protein, 9 aa, Influenza virus
VAAQELVES

SEQ ID NO: 488242 - protein, 9 aa, Influenza virus
VAASLCLAI

SEQ ID NO: 488243 - protein, 9 aa, Influenza virus
VAASLCLAV

SEQ ID NO: 488244 - protein, 9 aa, Influenza virus
VACGPAECR

SEQ ID NO: 488245 - protein, 9 aa, Influenza virus
VACGPSECR

SEQ ID NO: 488246 - protein, 9 aa, Influenza virus
VACGPTECR

SEQ ID NO: 488247 - protein, 9 aa, Influenza virus
VACSPSECR

SEQ ID NO: 488248 - protein, 9 aa, Influenza virus
VADGGPNLY

SEQ ID NO: 488249 - protein, 9 aa, Influenza virus
VADRDSTQK

SEQ ID NO: 488250 - protein, 9 aa, Influenza virus
VADSEMNKL

SEQ ID NO: 488251 - protein, 9 aa, Influenza virus
VAEGWINSP

SEQ ID NO: 488252 - protein, 9 aa, Influenza virus
VAEINTWAR

SEQ ID NO: 488253 - protein, 9 aa, Influenza virus
VAFCGTSGT

SEQ ID NO: 488254 - protein, 9 aa, Influenza virus
VAGGLILGM

SEQ ID NO: 488255 - protein, 9 aa, Influenza virus
VAGLSFWMC

SEQ ID NO: 488256 - protein, 9 aa, Influenza virus
VAGLSLWMC

SEQ ID NO: 488257 - protein, 9 aa, Influenza virus
VAGSLSLAI

SEQ ID NO: 488258 - protein, 9 aa, Influenza virus
VAGSSEQAA

SEQ ID NO: 488259 - protein, 9 aa, Influenza virus
VAGWILGNP

SEQ ID NO: 488260 - protein, 9 aa, Influenza virus
VAGWLLGNP

SEQ ID NO: 488261 - protein, 9 aa, Influenza virus
VAGWYGFQH

SEQ ID NO: 488262 - protein, 9 aa, Influenza virus
VAHKSCLPA

SEQ ID NO: 488263 - protein, 9 aa, Influenza virus
VAIALSILN

SEQ ID NO: 488264 - protein, 9 aa, Influenza virus
VAIALSVLN

SEQ ID NO: 488265 - protein, 9 aa, Influenza virus
VAIENQHTI

SEQ ID NO: 488266 - protein, 9 aa, Influenza virus
VAKAGFIEN

SEQ ID NO: 488267 - protein, 9 aa, Influenza virus
VAKDNAIRF

SEQ ID NO: 488268 - protein, 9 aa, Influenza virus
VAKDNAVRF

SEQ ID NO: 488269 - protein, 9 aa, Influenza virus
VAKGSYNNT

SEQ ID NO: 488270 - protein, 9 aa, Influenza virus
VAKRSYNNT

SEQ ID NO: 488271 - protein, 9 aa, Influenza virus
VALALSHTA

SEQ ID NO: 488272 - protein, 9 aa, Influenza virus
VALCGSKEQ

SEQ ID NO: 488273 - protein, 9 aa, Influenza virus
VALCGSKER

SEQ ID NO: 488274 - protein, 9 aa, Influenza virus
VALCGSPIS

SEQ ID NO: 488275 - protein, 9 aa, Influenza virus
VALCGSPVP

SEQ ID NO: 488276 - protein, 9 aa, Influenza virus
VALCGSPVS

SEQ ID NO: 488277 - protein, 9 aa, Influenza virus
VALCGSRER

SEQ ID NO: 488278 - protein, 9 aa, Influenza virus
VALENQHTI

SEQ ID NO: 488279 - protein, 9 aa, Influenza virus
VALENQNTI

SEQ ID NO: 488280 - protein, 9 aa, Influenza virus
VALGYSTGA

SEQ ID NO: 488281 - protein, 9 aa, Influenza virus
VALILGFVL

SEQ ID NO: 488282 - protein, 9 aa, Influenza virus
VALSYSAGA

SEQ ID NO: 488283 - protein, 9 aa, Influenza virus
VALSYSTGA

SEQ ID NO: 488284 - protein, 9 aa, Influenza virus
VAMENQHTI

SEQ ID NO: 488285 - protein, 9 aa, Influenza virus
VAMVFSQED

SEQ ID NO: 488286 - protein, 9 aa, Influenza virus
VAMVFSQEE

SEQ ID NO: 488287 - protein, 9 aa, Influenza virus
VANFSMELP

SEQ ID NO: 488288 - protein, 9 aa, Influenza virus
VANGTIVKT

SEQ ID NO: 488289 - protein, 9 aa, Influenza virus
VANGTKVNT

SEQ ID NO: 488290 - protein, 9 aa, Influenza virus
VANGTMVKT

SEQ ID NO: 488291 - protein, 9 aa, Influenza virus
VANLGLNIG

SEQ ID NO: 488292 - protein, 9 aa, Influenza virus
VAPDRVSFF

SEQ ID NO: 488293 - protein, 9 aa, Influenza virus
VAPEYGFKI

SEQ ID NO: 488294 - protein, 9 aa, Influenza virus
VAPIMFSNK

SEQ ID NO: 488295 - protein, 9 aa, Influenza virus
VAPRGHYKL

SEQ ID NO: 488296 - protein, 9 aa, Influenza virus
VAPSPSNSR

SEQ ID NO: 488297 - protein, 9 aa, Influenza virus
VAPSPYNSR

SEQ ID NO: 488298 - protein, 9 aa, Influenza virus
VAPSRVSKL

SEQ ID NO: 488299 - protein, 9 aa, Influenza virus
VAPVLGNYK

SEQ ID NO: 488300 - protein, 9 aa, Influenza virus
VAQGSYNNT

SEQ ID NO: 488301 - protein, 9 aa, Influenza virus
VARCNTKCQ

SEQ ID NO: 488302 - protein, 9 aa, Influenza virus
VAREPYVSC

SEQ ID NO: 488303 - protein, 9 aa, Influenza virus
VARGSYNNT

SEQ ID NO: 488304 - protein, 9 aa, Influenza virus
VARLGKGYM

SEQ ID NO: 488305 - protein, 9 aa, Influenza virus
VASMRRNYF

SEQ ID NO: 488306 - protein, 9 aa, Influenza virus
VASSGNLEF

SEQ ID NO: 488307 - protein, 9 aa, Influenza virus
VASSGTLEF

SEQ ID NO: 488308 - protein, 9 aa, Influenza virus
VASSGTVEF

SEQ ID NO: 488309 - protein, 9 aa, Influenza virus
VASSLALAI

SEQ ID NO: 488310 - protein, 9 aa, Influenza virus
VASSLTLAI

SEQ ID NO: 488311 - protein, 9 aa, Influenza virus
VASSLVLAI

SEQ ID NO: 488312 - protein, 9 aa, Influenza virus
VASSLVLLF

SEQ ID NO: 488313 - protein, 9 aa, Influenza virus
VASSLVLLL

SEQ ID NO: 488314 - protein, 9 aa, Influenza virus
VATGRVTVS

SEQ ID NO: 488315 - protein, 9 aa, Influenza virus
VATTHSWIP

SEQ ID NO: 488316 - protein, 9 aa, Influenza virus
VATTHSWTP

SEQ ID NO: 488317 - protein, 9 aa, Influenza virus
VATTHSWVP

SEQ ID NO: 488318 - protein, 9 aa, Influenza virus
VAVAKDNAI

SEQ ID NO: 488319 - protein, 9 aa, Influenza virus
VAVENQHTI

SEQ ID NO: 488320 - protein, 9 aa, Influenza virus
VAVIKYNGI

SEQ ID NO: 488321 - protein, 9 aa, Influenza virus
VAVLKYKGI

SEQ ID NO: 488322 - protein, 9 aa, Influenza virus
VAVLKYNDI

SEQ ID NO: 488323 - protein, 9 aa, Influenza virus
VAVLKYNGI

SEQ ID NO: 488324 - protein, 9 aa, Influenza virus
VAVLKYNGV

SEQ ID NO: 488325 - protein, 9 aa, Influenza virus
VAVTDGPAA

SEQ ID NO: 488326 - protein, 9 aa, Influenza virus
VAWSASACH

SEQ ID NO: 488327 - protein, 9 aa, Influenza virus
VAWSATACH

SEQ ID NO: 488328 - protein, 9 aa, Influenza virus
VAWSATACS

SEQ ID NO: 488329 - protein, 9 aa, Influenza virus
VAWSSSSCF

SEQ ID NO: 488330 - protein, 9 aa, Influenza virus
VAWSSSSCH

SEQ ID NO: 488331 - protein, 9 aa, Influenza virus
VAWSSTSCF

SEQ ID NO: 488332 - protein, 9 aa, Influenza virus
VAYDKICIG

SEQ ID NO: 488333 - protein, 9 aa, Influenza virus
VAYERMCNI

SEQ ID NO: 488334 - protein, 9 aa, Influenza virus
VAYMLEREL

SEQ ID NO: 488335 - protein, 9 aa, Influenza virus
VCAAWSSSS

SEQ ID NO: 488336 - protein, 9 aa, Influenza virus
VCATCEQIA

SEQ ID NO: 488337 - protein, 9 aa, Influenza virus
VCFMYSDFH

SEQ ID NO: 488338 - protein, 9 aa, Influenza virus
VCHKGICPV

SEQ ID NO: 488339 - protein, 9 aa, Influenza virus
VCHKGVCPV

SEQ ID NO: 488340 - protein, 9 aa, Influenza virus
VCHNGICPV

SEQ ID NO: 488341 - protein, 9 aa, Influenza virus
VCHNGTCAV

SEQ ID NO: 488342 - protein, 9 aa, Influenza virus
VCHNGTCVV

SEQ ID NO: 488343 - protein, 9 aa, Influenza virus
VCHNGVCPV

SEQ ID NO: 488344 - protein, 9 aa, Influenza virus
VCHNSTCVV

SEQ ID NO: 488345 - protein, 9 aa, Influenza virus
VCHSGICPV

SEQ ID NO: 488346 - protein, 9 aa, Influenza virus
VCHSGVCPV

SEQ ID NO: 488347 - protein, 9 aa, Influenza virus
VCIAWSSAS

SEQ ID NO: 488348 - protein, 9 aa, Influenza virus
VCIAWSSSS

SEQ ID NO: 488349 - protein, 9 aa, Influenza virus
VCINGICTV

SEQ ID NO: 488350 - protein, 9 aa, Influenza virus
VCINGSCAV

SEQ ID NO: 488351 - protein, 9 aa, Influenza virus
VCINGSCIV

SEQ ID NO: 488352 - protein, 9 aa, Influenza virus
VCINGSCTV

SEQ ID NO: 488353 - protein, 9 aa, Influenza virus
VCINGTCAV

SEQ ID NO: 488354 - protein, 9 aa, Influenza virus
VCINGTCTV

SEQ ID NO: 488355 - protein, 9 aa, Influenza virus
VCISGPNNN

SEQ ID NO: 488356 - protein, 9 aa, Influenza virus
VCISGTCAV

SEQ ID NO: 488357 - protein, 9 aa, Influenza virus
VCITGDDRN

SEQ ID NO: 488358 - protein, 9 aa, Influenza virus
VCLKWDLMD

SEQ ID NO: 488359 - protein, 9 aa, Influenza virus
VCLKWELMD

SEQ ID NO: 488360 - protein, 9 aa, Influenza virus
VCMAWSSSS

SEQ ID NO: 488361 - protein, 9 aa, Influenza virus
VCMESVRNG

SEQ ID NO: 488362 - protein, 9 aa, Influenza virus
VCMSGPNNN

SEQ ID NO: 488363 - protein, 9 aa, Influenza virus
VCPVVFTDG

SEQ ID NO: 488364 - protein, 9 aa, Influenza virus
VCPVVMTDG

SEQ ID NO: 488365 - protein, 9 aa, Influenza virus
VCQDEFCYT

SEQ ID NO: 488366 - protein, 9 aa, Influenza virus
VCRALLAKS

SEQ ID NO: 488367 - protein, 9 aa, Influenza virus
VCRDNWHAS

SEQ ID NO: 488368 - protein, 9 aa, Influenza virus
VCRDNWHGS

SEQ ID NO: 488369 - protein, 9 aa, Influenza virus
VCRDNWKGA

SEQ ID NO: 488370 - protein, 9 aa, Influenza virus
VCRDNWKGS

SEQ ID NO: 488371 - protein, 9 aa, Influenza virus
VCRDNWMGS

SEQ ID NO: 488372 - protein, 9 aa, Influenza virus
VCRDNWNGM

SEQ ID NO: 488373 - protein, 9 aa, Influenza virus
VCRDNWQGA

SEQ ID NO: 488374 - protein, 9 aa, Influenza virus
VCRDNWRGS

SEQ ID NO: 488375 - protein, 9 aa, Influenza virus
VCRDNWTGT

SEQ ID NO: 488376 - protein, 9 aa, Influenza virus
VCRTLLAKS

SEQ ID NO: 488377 - protein, 9 aa, Influenza virus
VCSGIFGDN

SEQ ID NO: 488378 - protein, 9 aa, Influenza virus
VCSGLVGDT

SEQ ID NO: 488379 - protein, 9 aa, Influenza virus
VCSGVFGDN

SEQ ID NO: 488380 - protein, 9 aa, Influenza virus
VCSKFHSDT

SEQ ID NO: 488381 - protein, 9 aa, Influenza virus
VCSNGSCRC

SEQ ID NO: 488382 - protein, 9 aa, Influenza virus
VCTGILTDT

SEQ ID NO: 488383 - protein, 9 aa, Influenza virus
VCTGVLTDT

SEQ ID NO: 488384 - protein, 9 aa, Influenza virus
VCTKGKKAV

SEQ ID NO: 488385 - protein, 9 aa, Influenza virus
VCVAWSSSS

SEQ ID NO: 488386 - protein, 9 aa, Influenza virus
VCVCRDNWH

SEQ ID NO: 488387 - protein, 9 aa, Influenza virus
VCVSLLQSA

SEQ ID NO: 488388 - protein, 9 aa, Influenza virus
VCVTGDDGN

SEQ ID NO: 488389 - protein, 9 aa, Influenza virus
VCVTGDDKN

SEQ ID NO: 488390 - protein, 9 aa, Influenza virus
VCVTGDDRN

SEQ ID NO: 488391 - protein, 9 aa, Influenza virus
VCWDNWRGS

SEQ ID NO: 488392 - protein, 9 aa, Influenza virus
VCWSFALAQ

SEQ ID NO: 488393 - protein, 9 aa, Influenza virus
VCYNPCFYV

SEQ ID NO: 488394 - protein, 9 aa, Influenza virus
VCYPGKFAN

SEQ ID NO: 488395 - protein, 9 aa, Influenza virus
VCYPGKFSN

SEQ ID NO: 488396 - protein, 9 aa, Influenza virus
VCYPGKFTN

SEQ ID NO: 488397 - protein, 9 aa, Influenza virus
VCYPGKFVN

SEQ ID NO: 488398 - protein, 9 aa, Influenza virus
VCYPGSIEN

SEQ ID NO: 488399 - protein, 9 aa, Influenza virus
VCYPGSIKN

SEQ ID NO: 488400 - protein, 9 aa, Influenza virus
VDALLGDPH

SEQ ID NO: 488401 - protein, 9 aa, Influenza virus
VDATETVER

SEQ ID NO: 488402 - protein, 9 aa, Influenza virus
VDCFIWHIR

SEQ ID NO: 488403 - protein, 9 aa, Influenza virus
VDCFLWHIR

SEQ ID NO: 488404 - protein, 9 aa, Influenza virus
VDCFLWHVR

SEQ ID NO: 488405 - protein, 9 aa, Influenza virus
VDCFLWYVR

SEQ ID NO: 488406 - protein, 9 aa, Influenza virus
VDCYLWHIR

SEQ ID NO: 488407 - protein, 9 aa, Influenza virus
VDDAVTDIW

SEQ ID NO: 488408 - protein, 9 aa, Influenza virus
VDDAVTDVW

SEQ ID NO: 488409 - protein, 9 aa, Influenza virus
VDEGNGCFE

SEQ ID NO: 488410 - protein, 9 aa, Influenza virus
VDEYSNAEK

SEQ ID NO: 488411 - protein, 9 aa, Influenza virus
VDEYSNAER

SEQ ID NO: 488412 - protein, 9 aa, Influenza virus
VDEYSSAER

SEQ ID NO: 488413 - protein, 9 aa, Influenza virus
VDEYSSTEK

SEQ ID NO: 488414 - protein, 9 aa, Influenza virus
VDEYSSTER

SEQ ID NO: 488415 - protein, 9 aa, Influenza virus
VDGFEPNGC

SEQ ID NO: 488416 - protein, 9 aa, Influenza virus
VDGFEPNGY

SEQ ID NO: 488417 - protein, 9 aa, Influenza virus
VDGFKPNGC

SEQ ID NO: 488418 - protein, 9 aa, Influenza virus
VDGQDCDLI

SEQ ID NO: 488419 - protein, 9 aa, Influenza virus
VDGQSGRID

SEQ ID NO: 488420 - protein, 9 aa, Influenza virus
VDGSSSACL

SEQ ID NO: 488421 - protein, 9 aa, Influenza virus
VDGTIAGFI

SEQ ID NO: 488422 - protein, 9 aa, Influenza virus
VDGWYGFHH

SEQ ID NO: 488423 - protein, 9 aa, Influenza virus
VDGWYGFRH

SEQ ID NO: 488424 - protein, 9 aa, Influenza virus
VDGWYGFRY

SEQ ID NO: 488425 - protein, 9 aa, Influenza virus
VDGWYGYHH

SEQ ID NO: 488426 - protein, 9 aa, Influenza virus
VDHMAIIKK

SEQ ID NO: 488427 - protein, 9 aa, Influenza virus
VDICKAAIG

SEQ ID NO: 488428 - protein, 9 aa, Influenza virus
VDICKAALG

SEQ ID NO: 488429 - protein, 9 aa, Influenza virus
VDICKAAMG

SEQ ID NO: 488430 - protein, 9 aa, Influenza virus
VDINPGHAD

SEQ ID NO: 488431 - protein, 9 aa, Influenza virus
VDINPGHSD

SEQ ID NO: 488432 - protein, 9 aa, Influenza virus
VDKLTQGRQ

SEQ ID NO: 488433 - protein, 9 aa, Influenza virus
VDKMNREFE

SEQ ID NO: 488434 - protein, 9 aa, Influenza virus
VDKMNREFG

SEQ ID NO: 488435 - protein, 9 aa, Influenza virus
VDLGQCGLL

SEQ ID NO: 488436 - protein, 9 aa, Influenza virus
VDLGSCGIL

SEQ ID NO: 488437 - protein, 9 aa, Influenza virus
VDLVETNHT

SEQ ID NO: 488438 - protein, 9 aa, Influenza virus
VDLWSYNAE

SEQ ID NO: 488439 - protein, 9 aa, Influenza virus
VDMNPGHAD

SEQ ID NO: 488440 - protein, 9 aa, Influenza virus
VDNHSMSDI

SEQ ID NO: 488441 - protein, 9 aa, Influenza virus
VDNKNWSGY

SEQ ID NO: 488442 - protein, 9 aa, Influenza virus
VDNNGELRH

SEQ ID NO: 488443 - protein, 9 aa, Influenza virus
VDNNNWFGY

SEQ ID NO: 488444 - protein, 9 aa, Influenza virus
VDNNNWSGY

SEQ ID NO: 488445 - protein, 9 aa, Influenza virus
VDNNSWSGY

SEQ ID NO: 488446 - protein, 9 aa, Influenza virus
VDNSNWSGY

SEQ ID NO: 488447 - protein, 9 aa, Influenza virus
VDQITGKLN

SEQ ID NO: 488448 - protein, 9 aa, Influenza virus
VDQSLIIAA

SEQ ID NO: 488449 - protein, 9 aa, Influenza virus
VDQSLVIAA

SEQ ID NO: 488450 - protein, 9 aa, Influenza virus
VDQVRESRN

SEQ ID NO: 488451 - protein, 9 aa, Influenza virus
VDRFYRICK

SEQ ID NO: 488452 - protein, 9 aa, Influenza virus
VDRFYRTCK

SEQ ID NO: 488453 - protein, 9 aa, Influenza virus
VDRLTQGRQ

SEQ ID NO: 488454 - protein, 9 aa, Influenza virus
VDSIGSWSQ

SEQ ID NO: 488455 - protein, 9 aa, Influenza virus
VDSIVSWSQ

SEQ ID NO: 488456 - protein, 9 aa, Influenza virus
VDTCYPFDV

SEQ ID NO: 488457 - protein, 9 aa, Influenza virus
VDTGDGCFE

SEQ ID NO: 488458 - protein, 9 aa, Influenza virus
VDTGNGCFD

SEQ ID NO: 488459 - protein, 9 aa, Influenza virus
VDTIIENNV

SEQ ID NO: 488460 - protein, 9 aa, Influenza virus
VDTIIESNI

SEQ ID NO: 488461 - protein, 9 aa, Influenza virus
VDTIIESNV

SEQ ID NO: 488462 - protein, 9 aa, Influenza virus
VDTILEKNI

SEQ ID NO: 488463 - protein, 9 aa, Influenza virus
VDTILEKNV

SEQ ID NO: 488464 - protein, 9 aa, Influenza virus
VDTILERNV

SEQ ID NO: 488465 - protein, 9 aa, Influenza virus
VDTIMEKIV

SEQ ID NO: 488466 - protein, 9 aa, Influenza virus
VDTIMEKNV

SEQ ID NO: 488467 - protein, 9 aa, Influenza virus
VDTIMERNV

SEQ ID NO: 488468 - protein, 9 aa, Influenza virus
VDTIREKNV

SEQ ID NO: 488469 - protein, 9 aa, Influenza virus
VDTLLEKNV

SEQ ID NO: 488470 - protein, 9 aa, Influenza virus
VDTLLENDV

SEQ ID NO: 488471 - protein, 9 aa, Influenza virus
VDTLLENGV

SEQ ID NO: 488472 - protein, 9 aa, Influenza virus
VDTLLENNV

SEQ ID NO: 488473 - protein, 9 aa, Influenza virus
VDTLLESDV

SEQ ID NO: 488474 - protein, 9 aa, Influenza virus
VDTLTEKGI

SEQ ID NO: 488475 - protein, 9 aa, Influenza virus
VDTLTENGV

SEQ ID NO: 488476 - protein, 9 aa, Influenza virus
VDTLTETGV

SEQ ID NO: 488477 - protein, 9 aa, Influenza virus
VDTNLERNV

SEQ ID NO: 488478 - protein, 9 aa, Influenza virus
VDTNPGHAD

SEQ ID NO: 488479 - protein, 9 aa, Influenza virus
VDTVLEKNV

SEQ ID NO: 488480 - protein, 9 aa, Influenza virus
VDTVLERNV

SEQ ID NO: 488481 - protein, 9 aa, Influenza virus
VDTVREKNV

SEQ ID NO: 488482 - protein, 9 aa, Influenza virus
VDVNPGHAD

SEQ ID NO: 488483 - protein, 9 aa, Influenza virus
VDVYCICRD

SEQ ID NO: 488484 - protein, 9 aa, Influenza virus
VEAESSVKE

SEQ ID NO: 488485 - protein, 9 aa, Influenza virus
VEALARSIC

SEQ ID NO: 488486 - protein, 9 aa, Influenza virus
VEAMISRAR

SEQ ID NO: 488487 - protein, 9 aa, Influenza virus
VEAMMSRAR

SEQ ID NO: 488488 - protein, 9 aa, Influenza virus
VEAMVSRAR

SEQ ID NO: 488489 - protein, 9 aa, Influenza virus
VEAVIYGNP

SEQ ID NO: 488490 - protein, 9 aa, Influenza virus
VECICRDNW

SEQ ID NO: 488491 - protein, 9 aa, Influenza virus
VECIGWSST

SEQ ID NO: 488492 - protein, 9 aa, Influenza virus
VECVCRDNW

SEQ ID NO: 488493 - protein, 9 aa, Influenza virus
VECVGWSST

SEQ ID NO: 488494 - protein, 9 aa, Influenza virus
VEDGFLDVW

SEQ ID NO: 488495 - protein, 9 aa, Influenza virus
VEDGSIGKV

SEQ ID NO: 488496 - protein, 9 aa, Influenza virus
VEDTKIDLW

SEQ ID NO: 488497 - protein, 9 aa, Influenza virus
VEDTKVDLW

SEQ ID NO: 488498 - protein, 9 aa, Influenza virus
VEECLINDP

SEQ ID NO: 488499 - protein, 9 aa, Influenza virus
VEECSCYPQ

SEQ ID NO: 488500 - protein, 9 aa, Influenza virus
VEECSCYPR

SEQ ID NO: 488501 - protein, 9 aa, Influenza virus
VEECSCYPS

SEQ ID NO: 488502 - protein, 9 aa, Influenza virus
VEEGSIGKV

SEQ ID NO: 488503 - protein, 9 aa, Influenza virus
VEELVHGGI

SEQ ID NO: 488504 - protein, 9 aa, Influenza virus
VEELVHGGV

SEQ ID NO: 488505 - protein, 9 aa, Influenza virus
VEELVHGQV

SEQ ID NO: 488506 - protein, 9 aa, Influenza virus
VEELVHRGI

SEQ ID NO: 488507 - protein, 9 aa, Influenza virus
VEESSIGKV

SEQ ID NO: 488508 - protein, 9 aa, Influenza virus
VEFCGTSGT

SEQ ID NO: 488509 - protein, 9 aa, Influenza virus
VEFEPFQSL

SEQ ID NO: 488510 - protein, 9 aa, Influenza virus
VEGLIYGNP

SEQ ID NO: 488511 - protein, 9 aa, Influenza virus
VEGLVYGNP

SEQ ID NO: 488512 - protein, 9 aa, Influenza virus
VEGRIQDLE

SEQ ID NO: 488513 - protein, 9 aa, Influenza virus
VEGRIQYLE

SEQ ID NO: 488514 - protein, 9 aa, Influenza virus
VEGRTQDLE

SEQ ID NO: 488515 - protein, 9 aa, Influenza virus
VEGWVVIAK

SEQ ID NO: 488516 - protein, 9 aa, Influenza virus
VEGWVVIAQ

SEQ ID NO: 488517 - protein, 9 aa, Influenza virus
VEGWVVIEK

SEQ ID NO: 488518 - protein, 9 aa, Influenza virus
VEGWVVVAK

SEQ ID NO: 488519 - protein, 9 aa, Influenza virus
VEIGVTRRE

SEQ ID NO: 488520 - protein, 9 aa, Influenza virus
VEIRINMIN

SEQ ID NO: 488521 - protein, 9 aa, Influenza virus
VEITGIDKV

SEQ ID NO: 488522 - protein, 9 aa, Influenza virus
VEITGINKV

SEQ ID NO: 488523 - protein, 9 aa, Influenza virus
VEKEFSNLE

SEQ ID NO: 488524 - protein, 9 aa, Influenza virus
VEKQIGNVI

SEQ ID NO: 488525 - protein, 9 aa, Influenza virus
VEKQLGNVI

SEQ ID NO: 488526 - protein, 9 aa, Influenza virus
VEKRINMIA

SEQ ID NO: 488527 - protein, 9 aa, Influenza virus
VEKRINMLA

SEQ ID NO: 488528 - protein, 9 aa, Influenza virus
VEKTNEKFH

SEQ ID NO: 488529 - protein, 9 aa, Influenza virus
VELAEKAMK

SEQ ID NO: 488530 - protein, 9 aa, Influenza virus
VELAEKTMK

SEQ ID NO: 488531 - protein, 9 aa, Influenza virus
VELAERAMK

SEQ ID NO: 488532 - protein, 9 aa, Influenza virus
VELDEIGED

SEQ ID NO: 488533 - protein, 9 aa, Influenza virus
VELIRGMPK

SEQ ID NO: 488534 - protein, 9 aa, Influenza virus
VELIRGMPQ

SEQ ID NO: 488535 - protein, 9 aa, Influenza virus
VELIRGQPK

SEQ ID NO: 488536 - protein, 9 aa, Influenza virus
VELIRGRKQ

SEQ ID NO: 488537 - protein, 9 aa, Influenza virus
VELIRGRLN

SEQ ID NO: 488538 - protein, 9 aa, Influenza virus
VELIRGRPE

SEQ ID NO: 488539 - protein, 9 aa, Influenza virus
VELIRGRPG

SEQ ID NO: 488540 - protein, 9 aa, Influenza virus
VELIRGRPI

SEQ ID NO: 488541 - protein, 9 aa, Influenza virus
VELIRGRPK

SEQ ID NO: 488542 - protein, 9 aa, Influenza virus
VELIRGRPN

SEQ ID NO: 488543 - protein, 9 aa, Influenza virus
VELIRGRPQ

SEQ ID NO: 488544 - protein, 9 aa, Influenza virus
VELIRGRPR

SEQ ID NO: 488545 - protein, 9 aa, Influenza virus
VELIRGRQQ

SEQ ID NO: 488546 - protein, 9 aa, Influenza virus
VELIRGRRQ

SEQ ID NO: 488547 - protein, 9 aa, Influenza virus
VELIRGRSQ

SEQ ID NO: 488548 - protein, 9 aa, Influenza virus
VELLVLMEN

SEQ ID NO: 488549 - protein, 9 aa, Influenza virus
VELSSGYKD

SEQ ID NO: 488550 - protein, 9 aa, Influenza virus
VELSSMGVY

SEQ ID NO: 488551 - protein, 9 aa, Influenza virus
VELVRGRPK

SEQ ID NO: 488552 - protein, 9 aa, Influenza virus
VEMIRGEPE

SEQ ID NO: 488553 - protein, 9 aa, Influenza virus
VEMIRGKPE

SEQ ID NO: 488554 - protein, 9 aa, Influenza virus
VEMIRGQPK

SEQ ID NO: 488555 - protein, 9 aa, Influenza virus
VEMIRGRPE

SEQ ID NO: 488556 - protein, 9 aa, Influenza virus
VENEIRTFS

SEQ ID NO: 488557 - protein, 9 aa, Influenza virus
VENGTSVKT

SEQ ID NO: 488558 - protein, 9 aa, Influenza virus
VENLEELRF

SEQ ID NO: 488559 - protein, 9 aa, Influenza virus
VENLFDEVR

SEQ ID NO: 488560 - protein, 9 aa, Influenza virus
VENQEELRS

SEQ ID NO: 488561 - protein, 9 aa, Influenza virus
VENQHTIDL

SEQ ID NO: 488562 - protein, 9 aa, Influenza virus
VENRINMLA

SEQ ID NO: 488563 - protein, 9 aa, Influenza virus
VENTYVNNT

SEQ ID NO: 488564 - protein, 9 aa, Influenza virus
VEPKGLFGA

SEQ ID NO: 488565 - protein, 9 aa, Influenza virus
VEPRGLFGA

SEQ ID NO: 488566 - protein, 9 aa, Influenza virus
VEQEIRAFS

SEQ ID NO: 488567 - protein, 9 aa, Influenza virus
VEQEIRTFS

SEQ ID NO: 488568 - protein, 9 aa, Influenza virus
VEQEMRTFS

SEQ ID NO: 488569 - protein, 9 aa, Influenza virus
VEQQIGNVI

SEQ ID NO: 488570 - protein, 9 aa, Influenza virus
VEQRINMLA

SEQ ID NO: 488571 - protein, 9 aa, Influenza virus
VERGLFGAI

SEQ ID NO: 488572 - protein, 9 aa, Influenza virus
VERILEEES

SEQ ID NO: 488573 - protein, 9 aa, Influenza virus
VERMVLSAF

SEQ ID NO: 488574 - protein, 9 aa, Influenza virus
VERPKEIEG

SEQ ID NO: 488575 - protein, 9 aa, Influenza virus
VERPKEMEG

SEQ ID NO: 488576 - protein, 9 aa, Influenza virus
VERPSAPEG

SEQ ID NO: 488577 - protein, 9 aa, Influenza virus
VERQIGNVI

SEQ ID NO: 488578 - protein, 9 aa, Influenza virus
VERRINMLA

SEQ ID NO: 488579 - protein, 9 aa, Influenza virus
VERTKEMEG

SEQ ID NO: 488580 - protein, 9 aa, Influenza virus
VESAVLRGF

SEQ ID NO: 488581 - protein, 9 aa, Influenza virus
VESEIRTFS

SEQ ID NO: 488582 - protein, 9 aa, Influenza virus
VESMIEAES

SEQ ID NO: 488583 - protein, 9 aa, Influenza virus
VESNGNLIA

SEQ ID NO: 488584 - protein, 9 aa, Influenza virus
VESNGNLVA

SEQ ID NO: 488585 - protein, 9 aa, Influenza virus
VESRINMIN

SEQ ID NO: 488586 - protein, 9 aa, Influenza virus
VESRINTIN

SEQ ID NO: 488587 - protein, 9 aa, Influenza virus
VESSNYQQS

SEQ ID NO: 488588 - protein, 9 aa, Influenza virus
VESSTYQNN

SEQ ID NO: 488589 - protein, 9 aa, Influenza virus
VETGYVCSK

SEQ ID NO: 488590 - protein, 9 aa, Influenza virus
VETLARCIC

SEQ ID NO: 488591 - protein, 9 aa, Influenza virus
VETLARNIC

SEQ ID NO: 488592 - protein, 9 aa, Influenza virus
VETLARRIC

SEQ ID NO: 488593 - protein, 9 aa, Influenza virus
VETLARSIC

SEQ ID NO: 488594 - protein, 9 aa, Influenza virus
VETNHTDEL

SEQ ID NO: 488595 - protein, 9 aa, Influenza virus
VETNHTGTY

SEQ ID NO: 488596 - protein, 9 aa, Influenza virus
VETRINMIN

SEQ ID NO: 488597 - protein, 9 aa, Influenza virus
VETSHTGTY

SEQ ID NO: 488598 - protein, 9 aa, Influenza virus
VETYVLSII

SEQ ID NO: 488599 - protein, 9 aa, Influenza virus
VETYVLSIV

SEQ ID NO: 488600 - protein, 9 aa, Influenza virus
VETYVLSVI

SEQ ID NO: 488601 - protein, 9 aa, Influenza virus
VEVITAQEL

SEQ ID NO: 488602 - protein, 9 aa, Influenza virus
VEVLHLTQG

SEQ ID NO: 488603 - protein, 9 aa, Influenza virus
VEVTNATEL

SEQ ID NO: 488604 - protein, 9 aa, Influenza virus
VEVVAAQEL

SEQ ID NO: 488605 - protein, 9 aa, Influenza virus
VEVVDATET

SEQ ID NO: 488606 - protein, 9 aa, Influenza virus
VEVVNATET

SEQ ID NO: 488607 - protein, 9 aa, Influenza virus
VEVVSAKEL

SEQ ID NO: 488608 - protein, 9 aa, Influenza virus
VEVVTAQEL

SEQ ID NO: 488609 - protein, 9 aa, Influenza virus
VEWTSNSLI

SEQ ID NO: 488610 - protein, 9 aa, Influenza virus
VEYASKTRI

SEQ ID NO: 488611 - protein, 9 aa, Influenza virus
VEYDAVATT

SEQ ID NO: 488612 - protein, 9 aa, Influenza virus
VEYNGKSLG

SEQ ID NO: 488613 - protein, 9 aa, Influenza virus
VFAGKNADL

SEQ ID NO: 488614 - protein, 9 aa, Influenza virus
VFAGKNSDL

SEQ ID NO: 488615 - protein, 9 aa, Influenza virus
VFAGKNTDL

SEQ ID NO: 488616 - protein, 9 aa, Influenza virus
VFCGTPGTY

SEQ ID NO: 488617 - protein, 9 aa, Influenza virus
VFCGTSGNY

SEQ ID NO: 488618 - protein, 9 aa, Influenza virus
VFCGTSGTC

SEQ ID NO: 488619 - protein, 9 aa, Influenza virus
VFCGTSGTY

SEQ ID NO: 488620 - protein, 9 aa, Influenza virus
VFCGVSGEV

SEQ ID NO: 488621 - protein, 9 aa, Influenza virus
VFCGVSSEV

SEQ ID NO: 488622 - protein, 9 aa, Influenza virus
VFCSTSGTY

SEQ ID NO: 488623 - protein, 9 aa, Influenza virus
VFEFSDERA

SEQ ID NO: 488624 - protein, 9 aa, Influenza virus
VFELSDEKA

SEQ ID NO: 488625 - protein, 9 aa, Influenza virus
VFELSDERA

SEQ ID NO: 488626 - protein, 9 aa, Influenza virus
VFFCLKNGN

SEQ ID NO: 488627 - protein, 9 aa, Influenza virus
VFFCLRNGN

SEQ ID NO: 488628 - protein, 9 aa, Influenza virus
VFICIKNGN

SEQ ID NO: 488629 - protein, 9 aa, Influenza virus
VFICVKNGN

SEQ ID NO: 488630 - protein, 9 aa, Influenza virus
VFIERPTAV

SEQ ID NO: 488631 - protein, 9 aa, Influenza virus
VFIIREPFV

SEQ ID NO: 488632 - protein, 9 aa, Influenza virus
VFLAMITYI

SEQ ID NO: 488633 - protein, 9 aa, Influenza virus
VFLTMITYI

SEQ ID NO: 488634 - protein, 9 aa, Influenza virus
VFMCVKNGN

SEQ ID NO: 488635 - protein, 9 aa, Influenza virus
VFNCLYASP

SEQ ID NO: 488636 - protein, 9 aa, Influenza virus
VFNSIYASP

SEQ ID NO: 488637 - protein, 9 aa, Influenza virus
VFNSLYASP

SEQ ID NO: 488638 - protein, 9 aa, Influenza virus
VFNSLYASS

SEQ ID NO: 488639 - protein, 9 aa, Influenza virus
VFNSLYSSP

SEQ ID NO: 488640 - protein, 9 aa, Influenza virus
VFNTIGNLI

SEQ ID NO: 488641 - protein, 9 aa, Influenza virus
VFNTIGNLV

SEQ ID NO: 488642 - protein, 9 aa, Influenza virus
VFPNEVGAK

SEQ ID NO: 488643 - protein, 9 aa, Influenza virus
VFPNEVGAR

SEQ ID NO: 488644 - protein, 9 aa, Influenza virus
VFPQLNQTY

SEQ ID NO: 488645 - protein, 9 aa, Influenza virus
VFREQKQEF

SEQ ID NO: 488646 - protein, 9 aa, Influenza virus
VFSIAASYK

SEQ ID NO: 488647 - protein, 9 aa, Influenza virus
VFSNAASYK

SEQ ID NO: 488648 - protein, 9 aa, Influenza virus
VFSQEDCMI

SEQ ID NO: 488649 - protein, 9 aa, Influenza virus
VFSQEDCMM

SEQ ID NO: 488650 - protein, 9 aa, Influenza virus
VFSQEDCMV

SEQ ID NO: 488651 - protein, 9 aa, Influenza virus
VFSQEECMI

SEQ ID NO: 488652 - protein, 9 aa, Influenza virus
VFSSAASYK

SEQ ID NO: 488653 - protein, 9 aa, Influenza virus
VFTDGSATG

SEQ ID NO: 488654 - protein, 9 aa, Influenza virus
VFTLTVPSE

SEQ ID NO: 488655 - protein, 9 aa, Influenza virus
VFVALILGF

SEQ ID NO: 488656 - protein, 9 aa, Influenza virus
VFVIREPCI

SEQ ID NO: 488657 - protein, 9 aa, Influenza virus
VFVIREPFI

SEQ ID NO: 488658 - protein, 9 aa, Influenza virus
VFVIREPFV

SEQ ID NO: 488659 - protein, 9 aa, Influenza virus
VFWTSNSIV

SEQ ID NO: 488660 - protein, 9 aa, Influenza virus
VGAINSSMP

SEQ ID NO: 488661 - protein, 9 aa, Influenza virus
VGAKILTSE

SEQ ID NO: 488662 - protein, 9 aa, Influenza virus
VGARIITSE

SEQ ID NO: 488663 - protein, 9 aa, Influenza virus
VGARILASE

SEQ ID NO: 488664 - protein, 9 aa, Influenza virus
VGARILTSE

SEQ ID NO: 488665 - protein, 9 aa, Influenza virus
VGARPKVNG

SEQ ID NO: 488666 - protein, 9 aa, Influenza virus
VGARPQVNG

SEQ ID NO: 488667 - protein, 9 aa, Influenza virus
VGCVILLNP

SEQ ID NO: 488668 - protein, 9 aa, Influenza virus
VGDTPRNDD

SEQ ID NO: 488669 - protein, 9 aa, Influenza virus
VGDTPRNED

SEQ ID NO: 488670 - protein, 9 aa, Influenza virus
VGDTPRNGD

SEQ ID NO: 488671 - protein, 9 aa, Influenza virus
VGDTPRNND

SEQ ID NO: 488672 - protein, 9 aa, Influenza virus
VGEAPSPYN

SEQ ID NO: 488673 - protein, 9 aa, Influenza virus
VGECPRYVK

SEQ ID NO: 488674 - protein, 9 aa, Influenza virus
VGEVPSPYN

SEQ ID NO: 488675 - protein, 9 aa, Influenza virus
VGGIDTNKT

SEQ ID NO: 488676 - protein, 9 aa, Influenza virus
VGGINTNKT

SEQ ID NO: 488677 - protein, 9 aa, Influenza virus
VGGINTNRT

SEQ ID NO: 488678 - protein, 9 aa, Influenza virus
VGGNEKKAK

SEQ ID NO: 488679 - protein, 9 aa, Influenza virus
VGGSGTDNY

SEQ ID NO: 488680 - protein, 9 aa, Influenza virus
VGGSGTNNY

SEQ ID NO: 488681 - protein, 9 aa, Influenza virus
VGIAADKES

SEQ ID NO: 488682 - protein, 9 aa, Influenza virus
VGICKAAMG

SEQ ID NO: 488683 - protein, 9 aa, Influenza virus
VGIDPFKLL

SEQ ID NO: 488684 - protein, 9 aa, Influenza virus
VGIDPFRLL

SEQ ID NO: 488685 - protein, 9 aa, Influenza virus
VGINMSKKK

SEQ ID NO: 488686 - protein, 9 aa, Influenza virus
VGINMSKRK

SEQ ID NO: 488687 - protein, 9 aa, Influenza virus
VGISSMGEA

SEQ ID NO: 488688 - protein, 9 aa, Influenza virus
VGISSMMEA

SEQ ID NO: 488689 - protein, 9 aa, Influenza virus
VGISSMVEA

SEQ ID NO: 488690 - protein, 9 aa, Influenza virus
VGKCNDPYP

SEQ ID NO: 488691 - protein, 9 aa, Influenza virus
VGKCNEPYP

SEQ ID NO: 488692 - protein, 9 aa, Influenza virus
VGKCPKYVK

SEQ ID NO: 488693 - protein, 9 aa, Influenza virus
VGKCPRYIK

SEQ ID NO: 488694 - protein, 9 aa, Influenza virus
VGKCPRYVK

SEQ ID NO: 488695 - protein, 9 aa, Influenza virus
VGKCPRYVR

SEQ ID NO: 488696 - protein, 9 aa, Influenza virus
VGKEFGNLE

SEQ ID NO: 488697 - protein, 9 aa, Influenza virus
VGKEFNNLE

SEQ ID NO: 488698 - protein, 9 aa, Influenza virus
VGKEFNSLE

SEQ ID NO: 488699 - protein, 9 aa, Influenza virus
VGKEFSNLE

SEQ ID NO: 488700 - protein, 9 aa, Influenza virus
VGLILAFIL

SEQ ID NO: 488701 - protein, 9 aa, Influenza virus
VGLILAFIM

SEQ ID NO: 488702 - protein, 9 aa, Influenza virus
VGLILSFIM

SEQ ID NO: 488703 - protein, 9 aa, Influenza virus
VGLILTFIM

SEQ ID NO: 488704 - protein, 9 aa, Influenza virus
VGLLLQIIS

SEQ ID NO: 488705 - protein, 9 aa, Influenza virus
VGLLLQITS

SEQ ID NO: 488706 - protein, 9 aa, Influenza virus
VGLNISLHL

SEQ ID NO: 488707 - protein, 9 aa, Influenza virus
VGLNMSLHL

SEQ ID NO: 488708 - protein, 9 aa, Influenza virus
VGLNVSLHL

SEQ ID NO: 488709 - protein, 9 aa, Influenza virus
VGLRNTPSI

SEQ ID NO: 488710 - protein, 9 aa, Influenza virus
VGLRNTPSV

SEQ ID NO: 488711 - protein, 9 aa, Influenza virus
VGLVFFCLK

SEQ ID NO: 488712 - protein, 9 aa, Influenza virus
VGMAADKES

SEQ ID NO: 488713 - protein, 9 aa, Influenza virus
VGNDNWSGY

SEQ ID NO: 488714 - protein, 9 aa, Influenza virus
VGNGCFEFY

SEQ ID NO: 488715 - protein, 9 aa, Influenza virus
VGNLAFNTV

SEQ ID NO: 488716 - protein, 9 aa, Influenza virus
VGNLIFNTV

SEQ ID NO: 488717 - protein, 9 aa, Influenza virus
VGNLVFNTV

SEQ ID NO: 488718 - protein, 9 aa, Influenza virus
VGNPSCASN

SEQ ID NO: 488719 - protein, 9 aa, Influenza virus
VGNPSCATN

SEQ ID NO: 488720 - protein, 9 aa, Influenza virus
VGPGSFPDG

SEQ ID NO: 488721 - protein, 9 aa, Influenza virus
VGPILSFIM

SEQ ID NO: 488722 - protein, 9 aa, Influenza virus
VGQCPKYVK

SEQ ID NO: 488723 - protein, 9 aa, Influenza virus
VGQCPKYVN

SEQ ID NO: 488724 - protein, 9 aa, Influenza virus
VGQCPKYVS

SEQ ID NO: 488725 - protein, 9 aa, Influenza virus
VGQSPNVYQ

SEQ ID NO: 488726 - protein, 9 aa, Influenza virus
VGRCPRYVK

SEQ ID NO: 488727 - protein, 9 aa, Influenza virus
VGRMTICIQ

SEQ ID NO: 488728 - protein, 9 aa, Influenza virus
VGRMTICVQ

SEQ ID NO: 488729 - protein, 9 aa, Influenza virus
VGRSGTNNY

SEQ ID NO: 488730 - protein, 9 aa, Influenza virus
VGRTISIAS

SEQ ID NO: 488731 - protein, 9 aa, Influenza virus
VGSGSFPDG

SEQ ID NO: 488732 - protein, 9 aa, Influenza virus
VGSGSFPNG

SEQ ID NO: 488733 - protein, 9 aa, Influenza virus
VGSRGHVFV

SEQ ID NO: 488734 - protein, 9 aa, Influenza virus
VGSRINMIN

SEQ ID NO: 488735 - protein, 9 aa, Influenza virus
VGSSIYQNS

SEQ ID NO: 488736 - protein, 9 aa, Influenza virus
VGSSKYQQS

SEQ ID NO: 488737 - protein, 9 aa, Influenza virus
VGSSKYRQS

SEQ ID NO: 488738 - protein, 9 aa, Influenza virus
VGSSNYQQS

SEQ ID NO: 488739 - protein, 9 aa, Influenza virus
VGSSTYHNS

SEQ ID NO: 488740 - protein, 9 aa, Influenza virus
VGSSTYQNN

SEQ ID NO: 488741 - protein, 9 aa, Influenza virus
VGSSTYQNS

SEQ ID NO: 488742 - protein, 9 aa, Influenza virus
VGSWSQNIL

SEQ ID NO: 488743 - protein, 9 aa, Influenza virus
VGTAPVLGN

SEQ ID NO: 488744 - protein, 9 aa, Influenza virus
VGTKHSNGT

SEQ ID NO: 488745 - protein, 9 aa, Influenza virus
VGTRWMKII

SEQ ID NO: 488746 - protein, 9 aa, Influenza virus
VGTSTLNLR

SEQ ID NO: 488747 - protein, 9 aa, Influenza virus
VGTSTLNQR

SEQ ID NO: 488748 - protein, 9 aa, Influenza virus
VGVAPSPSN

SEQ ID NO: 488749 - protein, 9 aa, Influenza virus
VGVDEYSST

SEQ ID NO: 488750 - protein, 9 aa, Influenza virus
VGVDPFKLL

SEQ ID NO: 488751 - protein, 9 aa, Influenza virus
VGVDPFRLL

SEQ ID NO: 488752 - protein, 9 aa, Influenza virus
VGWSATACH

SEQ ID NO: 488753 - protein, 9 aa, Influenza virus
VGWSSTSCH

SEQ ID NO: 488754 - protein, 9 aa, Influenza virus
VGWSSTTCH

SEQ ID NO: 488755 - protein, 9 aa, Influenza virus
VGWTSNSIV

SEQ ID NO: 488756 - protein, 9 aa, Influenza virus
VGYHANNST

SEQ ID NO: 488757 - protein, 9 aa, Influenza virus
VGYHSNNST

SEQ ID NO: 488758 - protein, 9 aa, Influenza virus
VGYICSGVF

SEQ ID NO: 488759 - protein, 9 aa, Influenza virus
VGYLCAGIP

SEQ ID NO: 488760 - protein, 9 aa, Influenza virus
VGYLCAGLP

SEQ ID NO: 488761 - protein, 9 aa, Influenza virus
VGYLSTNSS

SEQ ID NO: 488762 - protein, 9 aa, Influenza virus
VGYLSTNST

SEQ ID NO: 488763 - protein, 9 aa, Influenza virus
VHAMRTIGT

SEQ ID NO: 488764 - protein, 9 aa, Influenza virus
VHDRIPHRT

SEQ ID NO: 488765 - protein, 9 aa, Influenza virus
VHFQNQVKI

SEQ ID NO: 488766 - protein, 9 aa, Influenza virus
VHFRNQIKI

SEQ ID NO: 488767 - protein, 9 aa, Influenza virus
VHFRNQVKI

SEQ ID NO: 488768 - protein, 9 aa, Influenza virus
VHFRSQVKI

SEQ ID NO: 488769 - protein, 9 aa, Influenza virus
VHFVEALAR

SEQ ID NO: 488770 - protein, 9 aa, Influenza virus
VHHPSSDNE

SEQ ID NO: 488771 - protein, 9 aa, Influenza virus
VHHPSTDAE

SEQ ID NO: 488772 - protein, 9 aa, Influenza virus
VHHPSTDKE

SEQ ID NO: 488773 - protein, 9 aa, Influenza virus
VHHPSTDTE

SEQ ID NO: 488774 - protein, 9 aa, Influenza virus
VHHSSSLDE

SEQ ID NO: 488775 - protein, 9 aa, Influenza virus
VHIGPLSGS

SEQ ID NO: 488776 - protein, 9 aa, Influenza virus
VHISPLAGS

SEQ ID NO: 488777 - protein, 9 aa, Influenza virus
VHISPLSGS

SEQ ID NO: 488778 - protein, 9 aa, Influenza virus
VHIYYLEKA

SEQ ID NO: 488779 - protein, 9 aa, Influenza virus
VHKSQLIWM

SEQ ID NO: 488780 - protein, 9 aa, Influenza virus
VHLGDCNFE

SEQ ID NO: 488781 - protein, 9 aa, Influenza virus
VHLGDCRFE

SEQ ID NO: 488782 - protein, 9 aa, Influenza virus
VHLGDCSFE

SEQ ID NO: 488783 - protein, 9 aa, Influenza virus
VHMYYLEKA

SEQ ID NO: 488784 - protein, 9 aa, Influenza virus
VHNGKLCRL

SEQ ID NO: 488785 - protein, 9 aa, Influenza virus
VHPLAIGEC

SEQ ID NO: 488786 - protein, 9 aa, Influenza virus
VHPLTIGEC

SEQ ID NO: 488787 - protein, 9 aa, Influenza virus
VHQILAIYS

SEQ ID NO: 488788 - protein, 9 aa, Influenza virus
VHQSTNSTE

SEQ ID NO: 488789 - protein, 9 aa, Influenza virus
VHRNAIGDC

SEQ ID NO: 488790 - protein, 9 aa, Influenza virus
VHRNTFGDC

SEQ ID NO: 488791 - protein, 9 aa, Influenza virus
VHRNTIGDC

SEQ ID NO: 488792 - protein, 9 aa, Influenza virus
VHRSTIGDC

SEQ ID NO: 488793 - protein, 9 aa, Influenza virus
VHTYYLEKA

SEQ ID NO: 488794 - protein, 9 aa, Influenza virus
VHVSPLSGS

SEQ ID NO: 488795 - protein, 9 aa, Influenza virus
VHVYYLEKA

SEQ ID NO: 488796 - protein, 9 aa, Influenza virus
VIAARNIVR

SEQ ID NO: 488797 - protein, 9 aa, Influenza virus
VIAKDNAIR

SEQ ID NO: 488798 - protein, 9 aa, Influenza virus
VIAKDNAVR

SEQ ID NO: 488799 - protein, 9 aa, Influenza virus
VIAQDNAIR

SEQ ID NO: 488800 - protein, 9 aa, Influenza virus
VIASTTAKA

SEQ ID NO: 488801 - protein, 9 aa, Influenza virus
VICLGHHAV

SEQ ID NO: 488802 - protein, 9 aa, Influenza virus
VICLGHHSV

SEQ ID NO: 488803 - protein, 9 aa, Influenza virus
VICMGHHAV

SEQ ID NO: 488804 - protein, 9 aa, Influenza virus
VIDGWTTAN

SEQ ID NO: 488805 - protein, 9 aa, Influenza virus
VIDKMNKQF

SEQ ID NO: 488806 - protein, 9 aa, Influenza virus
VIDKMNKQL

SEQ ID NO: 488807 - protein, 9 aa, Influenza virus
VIDKMNNQF

SEQ ID NO: 488808 - protein, 9 aa, Influenza virus
VIDKMYKQF

SEQ ID NO: 488809 - protein, 9 aa, Influenza virus
VIEGWINSP

SEQ ID NO: 488810 - protein, 9 aa, Influenza virus
VIEKDNAVR

SEQ ID NO: 488811 - protein, 9 aa, Influenza virus
VIEKMNIQF

SEQ ID NO: 488812 - protein, 9 aa, Influenza virus
VIEKMNTQF

SEQ ID NO: 488813 - protein, 9 aa, Influenza virus
VIGARPQVN

SEQ ID NO: 488814 - protein, 9 aa, Influenza virus
VIGGWATAN

SEQ ID NO: 488815 - protein, 9 aa, Influenza virus
VIGGWTIAN

SEQ ID NO: 488816 - protein, 9 aa, Influenza virus
VIGGWTTAN

SEQ ID NO: 488817 - protein, 9 aa, Influenza virus
VIHYGGIPT

SEQ ID NO: 488818 - protein, 9 aa, Influenza virus
VIHYGGMPT

SEQ ID NO: 488819 - protein, 9 aa, Influenza virus
VIHYGGVPT

SEQ ID NO: 488820 - protein, 9 aa, Influenza virus
VIITREPYV

SEQ ID NO: 488821 - protein, 9 aa, Influenza virus
VIKLLPFAA

SEQ ID NO: 488822 - protein, 9 aa, Influenza virus
VIKNNMINN

SEQ ID NO: 488823 - protein, 9 aa, Influenza virus
VIKNNMVNN

SEQ ID NO: 488824 - protein, 9 aa, Influenza virus
VIKYNGIIT

SEQ ID NO: 488825 - protein, 9 aa, Influenza virus
VILEENTTY

SEQ ID NO: 488826 - protein, 9 aa, Influenza virus
VILLNPFVS

SEQ ID NO: 488827 - protein, 9 aa, Influenza virus
VILVLGLSM

SEQ ID NO: 488828 - protein, 9 aa, Influenza virus
VILWFSFGA

SEQ ID NO: 488829 - protein, 9 aa, Influenza virus
VILWFSLGA

SEQ ID NO: 488830 - protein, 9 aa, Influenza virus
VIMEVVFPN

SEQ ID NO: 488831 - protein, 9 aa, Influenza virus
VIMTDGPAN

SEQ ID NO: 488832 - protein, 9 aa, Influenza virus
VIMTDGPAS

SEQ ID NO: 488833 - protein, 9 aa, Influenza virus
VIMTDGSAN

SEQ ID NO: 488834 - protein, 9 aa, Influenza virus
VIMTDGSAS

SEQ ID NO: 488835 - protein, 9 aa, Influenza virus
VINDKIDDQ

SEQ ID NO: 488836 - protein, 9 aa, Influenza virus
VINFESTGN

SEQ ID NO: 488837 - protein, 9 aa, Influenza virus
VINNITTTI

SEQ ID NO: 488838 - protein, 9 aa, Influenza virus
VINNMTTTI

SEQ ID NO: 488839 - protein, 9 aa, Influenza virus
VINNYYNET

SEQ ID NO: 488840 - protein, 9 aa, Influenza virus
VINTSKPFQ

SEQ ID NO: 488841 - protein, 9 aa, Influenza virus
VINWTKDSI

SEQ ID NO: 488842 - protein, 9 aa, Influenza virus
VINWTQDAM

SEQ ID NO: 488843 - protein, 9 aa, Influenza virus
VINWTRDAM

SEQ ID NO: 488844 - protein, 9 aa, Influenza virus
VINWTRDSI

SEQ ID NO: 488845 - protein, 9 aa, Influenza virus
VINWTRDSL

SEQ ID NO: 488846 - protein, 9 aa, Influenza virus
VINWTRDSM

SEQ ID NO: 488847 - protein, 9 aa, Influenza virus
VINWTRDSV

SEQ ID NO: 488848 - protein, 9 aa, Influenza virus
VIPLTTTPT

SEQ ID NO: 488849 - protein, 9 aa, Influenza virus
VIPVNNTIY

SEQ ID NO: 488850 - protein, 9 aa, Influenza virus
VIREPCISC

SEQ ID NO: 488851 - protein, 9 aa, Influenza virus
VIREPFISC

SEQ ID NO: 488852 - protein, 9 aa, Influenza virus
VIREPFVAC

SEQ ID NO: 488853 - protein, 9 aa, Influenza virus
VIREPFVSC

SEQ ID NO: 488854 - protein, 9 aa, Influenza virus
VIRNNMINN

SEQ ID NO: 488855 - protein, 9 aa, Influenza virus
VIRSWRKQI

SEQ ID NO: 488856 - protein, 9 aa, Influenza virus
VISFESTGN

SEQ ID NO: 488857 - protein, 9 aa, Influenza virus
VISGWTTAN

SEQ ID NO: 488858 - protein, 9 aa, Influenza virus
VITDTIKSW

SEQ ID NO: 488859 - protein, 9 aa, Influenza virus
VITDTLKSW

SEQ ID NO: 488860 - protein, 9 aa, Influenza virus
VIVTREPYI

SEQ ID NO: 488861 - protein, 9 aa, Influenza virus
VIVTREPYV

SEQ ID NO: 488862 - protein, 9 aa, Influenza virus
VIYGNPKCD

SEQ ID NO: 488863 - protein, 9 aa, Influenza virus
VKAVRGDLN

SEQ ID NO: 488864 - protein, 9 aa, Influenza virus
VKCICRDNW

SEQ ID NO: 488865 - protein, 9 aa, Influenza virus
VKCYQFALG

SEQ ID NO: 488866 - protein, 9 aa, Influenza virus
VKDRSPFRT

SEQ ID NO: 488867 - protein, 9 aa, Influenza virus
VKDRSPYRA

SEQ ID NO: 488868 - protein, 9 aa, Influenza virus
VKDRSPYRT

SEQ ID NO: 488869 - protein, 9 aa, Influenza virus
VKEAQDVIM

SEQ ID NO: 488870 - protein, 9 aa, Influenza virus
VKEKDLTKE

SEQ ID NO: 488871 - protein, 9 aa, Influenza virus
VKEKDMTKE

SEQ ID NO: 488872 - protein, 9 aa, Influenza virus
VKEKDMTRE

SEQ ID NO: 488873 - protein, 9 aa, Influenza virus
VKELGNGCF

SEQ ID NO: 488874 - protein, 9 aa, Influenza virus
VKGDKICLG

SEQ ID NO: 488875 - protein, 9 aa, Influenza virus
VKGDQICIG

SEQ ID NO: 488876 - protein, 9 aa, Influenza virus
VKGDRICIG

SEQ ID NO: 488877 - protein, 9 aa, Influenza virus
VKGDYNNTT

SEQ ID NO: 488878 - protein, 9 aa, Influenza virus
VKGEYNNTT

SEQ ID NO: 488879 - protein, 9 aa, Influenza virus
VKGFAFKYG

SEQ ID NO: 488880 - protein, 9 aa, Influenza virus
VKGFAFLDE

SEQ ID NO: 488881 - protein, 9 aa, Influenza virus
VKGFAFLDG

SEQ ID NO: 488882 - protein, 9 aa, Influenza virus
VKGFAFLDR

SEQ ID NO: 488883 - protein, 9 aa, Influenza virus
VKGFAFLNG

SEQ ID NO: 488884 - protein, 9 aa, Influenza virus
VKGFAYLDG

SEQ ID NO: 488885 - protein, 9 aa, Influenza virus
VKGFGFKAG

SEQ ID NO: 488886 - protein, 9 aa, Influenza virus
VKGFGFKKG

SEQ ID NO: 488887 - protein, 9 aa, Influenza virus
VKGFGFKSG

SEQ ID NO: 488888 - protein, 9 aa, Influenza virus
VKGFGFKTG

SEQ ID NO: 488889 - protein, 9 aa, Influenza virus
VKGFGFKVG

SEQ ID NO: 488890 - protein, 9 aa, Influenza virus
VKGFGFLDG

SEQ ID NO: 488891 - protein, 9 aa, Influenza virus
VKGFGFLDN

SEQ ID NO: 488892 - protein, 9 aa, Influenza virus
VKGFGFLDS

SEQ ID NO: 488893 - protein, 9 aa, Influenza virus
VKGFGFLNG

SEQ ID NO: 488894 - protein, 9 aa, Influenza virus
VKGFGFLSG

SEQ ID NO: 488895 - protein, 9 aa, Influenza virus
VKGFGFRQG

SEQ ID NO: 488896 - protein, 9 aa, Influenza virus
VKGFSFKYG

SEQ ID NO: 488897 - protein, 9 aa, Influenza virus
VKGFSFRYG

SEQ ID NO: 488898 - protein, 9 aa, Influenza virus
VKGFSYKYD

SEQ ID NO: 488899 - protein, 9 aa, Influenza virus
VKGFSYKYG

SEQ ID NO: 488900 - protein, 9 aa, Influenza virus
VKGFSYLDG

SEQ ID NO: 488901 - protein, 9 aa, Influenza virus
VKGFSYLNG

SEQ ID NO: 488902 - protein, 9 aa, Influenza virus
VKGFSYRYG

SEQ ID NO: 488903 - protein, 9 aa, Influenza virus
VKGRSHLRN

SEQ ID NO: 488904 - protein, 9 aa, Influenza virus
VKGWAFDDG

SEQ ID NO: 488905 - protein, 9 aa, Influenza virus
VKGWAFDNE

SEQ ID NO: 488906 - protein, 9 aa, Influenza virus
VKGWAFDNG

SEQ ID NO: 488907 - protein, 9 aa, Influenza virus
VKGWAFDSG

SEQ ID NO: 488908 - protein, 9 aa, Influenza virus
VKGWAFDYG

SEQ ID NO: 488909 - protein, 9 aa, Influenza virus
VKGWAPLSK

SEQ ID NO: 488910 - protein, 9 aa, Influenza virus
VKHFEKVKI

SEQ ID NO: 488911 - protein, 9 aa, Influenza virus
VKHFEKVRI

SEQ ID NO: 488912 - protein, 9 aa, Influenza virus
VKIDPVELS

SEQ ID NO: 488913 - protein, 9 aa, Influenza virus
VKIDPVKLS

SEQ ID NO: 488914 - protein, 9 aa, Influenza virus
VKIKTNGNL

SEQ ID NO: 488915 - protein, 9 aa, Influenza virus
VKIQTNGNL

SEQ ID NO: 488916 - protein, 9 aa, Influenza virus
VKIQTSGNL

SEQ ID NO: 488917 - protein, 9 aa, Influenza virus
VKIRRRVDI

SEQ ID NO: 488918 - protein, 9 aa, Influenza virus
VKIRRRVDM

SEQ ID NO: 488919 - protein, 9 aa, Influenza virus
VKIRRRVDT

SEQ ID NO: 488920 - protein, 9 aa, Influenza virus
VKIRRRVDV

SEQ ID NO: 488921 - protein, 9 aa, Influenza virus
VKKASLRLA

SEQ ID NO: 488922 - protein, 9 aa, Influenza virus
VKKESLRLA

SEQ ID NO: 488923 - protein, 9 aa, Influenza virus
VKKQLRENA

SEQ ID NO: 488924 - protein, 9 aa, Influenza virus
VKLAQGYKD

SEQ ID NO: 488925 - protein, 9 aa, Influenza virus
VKLEENSTY

SEQ ID NO: 488926 - protein, 9 aa, Influenza virus
VKLEENTSY

SEQ ID NO: 488927 - protein, 9 aa, Influenza virus
VKLEENTTY

SEQ ID NO: 488928 - protein, 9 aa, Influenza virus
VKLIQGYKD

SEQ ID NO: 488929 - protein, 9 aa, Influenza virus
VKLNSGYKD

SEQ ID NO: 488930 - protein, 9 aa, Influenza virus
VKLSGGYKD

SEQ ID NO: 488931 - protein, 9 aa, Influenza virus
VKLSNGYKD

SEQ ID NO: 488932 - protein, 9 aa, Influenza virus
VKLSNMGIY

SEQ ID NO: 488933 - protein, 9 aa, Influenza virus
VKLSNMGVY

SEQ ID NO: 488934 - protein, 9 aa, Influenza virus
VKLSSGYKD

SEQ ID NO: 488935 - protein, 9 aa, Influenza virus
VKLSSGYKE

SEQ ID NO: 488936 - protein, 9 aa, Influenza virus
VKLSSGYKN

SEQ ID NO: 488937 - protein, 9 aa, Influenza virus
VKLSSMGIY

SEQ ID NO: 488938 - protein, 9 aa, Influenza virus
VKLSSMGVY

SEQ ID NO: 488939 - protein, 9 aa, Influenza virus
VKLSSSYKD

SEQ ID NO: 488940 - protein, 9 aa, Influenza virus
VKLTQGYKD

SEQ ID NO: 488941 - protein, 9 aa, Influenza virus
VKLYKKLKR

SEQ ID NO: 488942 - protein, 9 aa, Influenza virus
VKLYRKLKR

SEQ ID NO: 488943 - protein, 9 aa, Influenza virus
VKMEKIVLL

SEQ ID NO: 488944 - protein, 9 aa, Influenza virus
VKMFDFIKW

SEQ ID NO: 488945 - protein, 9 aa, Influenza virus
VKMFDFSKW

SEQ ID NO: 488946 - protein, 9 aa, Influenza virus
VKMFDFTKW

SEQ ID NO: 488947 - protein, 9 aa, Influenza virus
VKMKWGMEM

SEQ ID NO: 488948 - protein, 9 aa, Influenza virus
VKMNPNQKI

SEQ ID NO: 488949 - protein, 9 aa, Influenza virus
VKNDDIDQS

SEQ ID NO: 488950 - protein, 9 aa, Influenza virus
VKNDDVDQS

SEQ ID NO: 488951 - protein, 9 aa, Influenza virus
VKNDEVDQS

SEQ ID NO: 488952 - protein, 9 aa, Influenza virus
VKNGNHAVH

SEQ ID NO: 488953 - protein, 9 aa, Influenza virus
VKNGNLRCT

SEQ ID NO: 488954 - protein, 9 aa, Influenza virus
VKNGNMQCT

SEQ ID NO: 488955 - protein, 9 aa, Influenza virus
VKNGNMRCT

SEQ ID NO: 488956 - protein, 9 aa, Influenza virus
VKNGTYDYP

SEQ ID NO: 488957 - protein, 9 aa, Influenza virus
VKNGTYNYP

SEQ ID NO: 488958 - protein, 9 aa, Influenza virus
VKNLFDEVK

SEQ ID NO: 488959 - protein, 9 aa, Influenza virus
VKNLFDEVR

SEQ ID NO: 488960 - protein, 9 aa, Influenza virus
VKNLHDQIK

SEQ ID NO: 488961 - protein, 9 aa, Influenza virus
VKNLHEQVK

SEQ ID NO: 488962 - protein, 9 aa, Influenza virus
VKNLHEQVR

SEQ ID NO: 488963 - protein, 9 aa, Influenza virus
VKNLYDKVR

SEQ ID NO: 488964 - protein, 9 aa, Influenza virus
VKNLYDRVR

SEQ ID NO: 488965 - protein, 9 aa, Influenza virus
VKNLYEKVR

SEQ ID NO: 488966 - protein, 9 aa, Influenza virus
VKNLYNKVR

SEQ ID NO: 488967 - protein, 9 aa, Influenza virus
VKPLILKDC

SEQ ID NO: 488968 - protein, 9 aa, Influenza virus
VKPLILRDC

SEQ ID NO: 488969 - protein, 9 aa, Influenza virus
VKPLILRNC

SEQ ID NO: 488970 - protein, 9 aa, Influenza virus
VKQDGKSSA

SEQ ID NO: 488971 - protein, 9 aa, Influenza virus
VKQESLLLA

SEQ ID NO: 488972 - protein, 9 aa, Influenza virus
VKQESLMLA

SEQ ID NO: 488973 - protein, 9 aa, Influenza virus
VKQGSLKLA

SEQ ID NO: 488974 - protein, 9 aa, Influenza virus
VKQGSLMLA

SEQ ID NO: 488975 - protein, 9 aa, Influenza virus
VKQGSLRLA

SEQ ID NO: 488976 - protein, 9 aa, Influenza virus
VKQKSILLA

SEQ ID NO: 488977 - protein, 9 aa, Influenza virus
VKQKSLLLA

SEQ ID NO: 488978 - protein, 9 aa, Influenza virus
VKQKTLKLA

SEQ ID NO: 488979 - protein, 9 aa, Influenza virus
VKQNGKSGA

SEQ ID NO: 488980 - protein, 9 aa, Influenza virus
VKQNGKSSA

SEQ ID NO: 488981 - protein, 9 aa, Influenza virus
VKQNTLKLA

SEQ ID NO: 488982 - protein, 9 aa, Influenza virus
VKQSSLPLA

SEQ ID NO: 488983 - protein, 9 aa, Influenza virus
VKQSTLKLA

SEQ ID NO: 488984 - protein, 9 aa, Influenza virus
VKQTSLLLA

SEQ ID NO: 488985 - protein, 9 aa, Influenza virus
VKRGINDRN

SEQ ID NO: 488986 - protein, 9 aa, Influenza virus
VKRLLRENA

SEQ ID NO: 488987 - protein, 9 aa, Influenza virus
VKRQLRENA

SEQ ID NO: 488988 - protein, 9 aa, Influenza virus
VKRRLSANA

SEQ ID NO: 488989 - protein, 9 aa, Influenza virus
VKRRLSTNA

SEQ ID NO: 488990 - protein, 9 aa, Influenza virus
VKRRPVAKA

SEQ ID NO: 488991 - protein, 9 aa, Influenza virus
VKSDKICLG

SEQ ID NO: 488992 - protein, 9 aa, Influenza virus
VKSDRLVLA

SEQ ID NO: 488993 - protein, 9 aa, Influenza virus
VKSEKLVLA

SEQ ID NO: 488994 - protein, 9 aa, Influenza virus
VKSERLVLA

SEQ ID NO: 488995 - protein, 9 aa, Influenza virus
VKSITQTLV

SEQ ID NO: 488996 - protein, 9 aa, Influenza virus
VKSLKLAIG

SEQ ID NO: 488997 - protein, 9 aa, Influenza virus
VKSLKLASG

SEQ ID NO: 488998 - protein, 9 aa, Influenza virus
VKSLKLATG

SEQ ID NO: 488999 - protein, 9 aa, Influenza virus
VKSLLRDNA

SEQ ID NO: 489000 - protein, 9 aa, Influenza virus
VKSLYDKVR

SEQ ID NO: 489001 - protein, 9 aa, Influenza virus
VKSNGNLIA

SEQ ID NO: 489002 - protein, 9 aa, Influenza virus
VKSQLKDNA

SEQ ID NO: 489003 - protein, 9 aa, Influenza virus
VKSQLRDNA

SEQ ID NO: 489004 - protein, 9 aa, Influenza virus
VKSVTQTLV

SEQ ID NO: 489005 - protein, 9 aa, Influenza virus
VKTLTDNHV

SEQ ID NO: 489006 - protein, 9 aa, Influenza virus
VKTLTNEHE

SEQ ID NO: 489007 - protein, 9 aa, Influenza virus
VKTLTNEKE

SEQ ID NO: 489008 - protein, 9 aa, Influenza virus
VKTLTNEQE

SEQ ID NO: 489009 - protein, 9 aa, Influenza virus
VKTLTSEKE

SEQ ID NO: 489010 - protein, 9 aa, Influenza virus
VKTWAGNIL

SEQ ID NO: 489011 - protein, 9 aa, Influenza virus
VKVDGSSSA

SEQ ID NO: 489012 - protein, 9 aa, Influenza virus
VKVTHRENL

SEQ ID NO: 489013 - protein, 9 aa, Influenza virus
VKYSRADKI

SEQ ID NO: 489014 - protein, 9 aa, Influenza virus
VKYVWWTSN

SEQ ID NO: 489015 - protein, 9 aa, Influenza virus
VLAIYSCIA

SEQ ID NO: 489016 - protein, 9 aa, Influenza virus
VLASTTAKA

SEQ ID NO: 489017 - protein, 9 aa, Influenza virus
VLATGLRNA

SEQ ID NO: 489018 - protein, 9 aa, Influenza virus
VLATGLRNI

SEQ ID NO: 489019 - protein, 9 aa, Influenza virus
VLATGLRNV

SEQ ID NO: 489020 - protein, 9 aa, Influenza virus
VLATGPRNV

SEQ ID NO: 489021 - protein, 9 aa, Influenza virus
VLDDCSLEG

SEQ ID NO: 489022 - protein, 9 aa, Influenza virus
VLDDCSLKG

SEQ ID NO: 489023 - protein, 9 aa, Influenza virus
VLDGVTASC

SEQ ID NO: 489024 - protein, 9 aa, Influenza virus
VLDNKNWSG

SEQ ID NO: 489025 - protein, 9 aa, Influenza virus
VLDTDWSGY

SEQ ID NO: 489026 - protein, 9 aa, Influenza virus
VLEAMAFLE

SEQ ID NO: 489027 - protein, 9 aa, Influenza virus
VLEAMALLE

SEQ ID NO: 489028 - protein, 9 aa, Influenza virus
VLEDEQMYQ

SEQ ID NO: 489029 - protein, 9 aa, Influenza virus
VLEKNVTVT

SEQ ID NO: 489030 - protein, 9 aa, Influenza virus
VLELIRMIK

SEQ ID NO: 489031 - protein, 9 aa, Influenza virus
VLERNVTVT

SEQ ID NO: 489032 - protein, 9 aa, Influenza virus
VLFQGGHIE

SEQ ID NO: 489033 - protein, 9 aa, Influenza virus
VLGDCSIAG

SEQ ID NO: 489034 - protein, 9 aa, Influenza virus
VLGENMAPE

SEQ ID NO: 489035 - protein, 9 aa, Influenza virus
VLGIINLLI

SEQ ID NO: 489036 - protein, 9 aa, Influenza virus
VLGLSMVKS

SEQ ID NO: 489037 - protein, 9 aa, Influenza virus
VLGLSMVRS

SEQ ID NO: 489038 - protein, 9 aa, Influenza virus
VLGNPKCDL

SEQ ID NO: 489039 - protein, 9 aa, Influenza virus
VLGNYKEIC

SEQ ID NO: 489040 - protein, 9 aa, Influenza virus
VLGNYKEIR

SEQ ID NO: 489041 - protein, 9 aa, Influenza virus
VLGNYREIC

SEQ ID NO: 489042 - protein, 9 aa, Influenza virus
VLGNYREVC

SEQ ID NO: 489043 - protein, 9 aa, Influenza virus
VLGVSILNL

SEQ ID NO: 489044 - protein, 9 aa, Influenza virus
VLGVSVLNL

SEQ ID NO: 489045 - protein, 9 aa, Influenza virus
VLHLTQGAC

SEQ ID NO: 489046 - protein, 9 aa, Influenza virus
VLHLTQGTC

SEQ ID NO: 489047 - protein, 9 aa, Influenza virus
VLIAGGLIL

SEQ ID NO: 489048 - protein, 9 aa, Influenza virus
VLIENDRTL

SEQ ID NO: 489049 - protein, 9 aa, Influenza virus
VLIENERTL

SEQ ID NO: 489050 - protein, 9 aa, Influenza virus
VLIENQKTL

SEQ ID NO: 489051 - protein, 9 aa, Influenza virus
VLIGQGDIV

SEQ ID NO: 489052 - protein, 9 aa, Influenza virus
VLIGQGDVV

SEQ ID NO: 489053 - protein, 9 aa, Influenza virus
VLINTYQWI

SEQ ID NO: 489054 - protein, 9 aa, Influenza virus
VLIVSLGAI

SEQ ID NO: 489055 - protein, 9 aa, Influenza virus
VLKPGETLK

SEQ ID NO: 489056 - protein, 9 aa, Influenza virus
VLKPGETLN

SEQ ID NO: 489057 - protein, 9 aa, Influenza virus
VLKPGQTLR

SEQ ID NO: 489058 - protein, 9 aa, Influenza virus
VLKPGQTVK

SEQ ID NO: 489059 - protein, 9 aa, Influenza virus
VLKSDKRIG

SEQ ID NO: 489060 - protein, 9 aa, Influenza virus
VLKYKGIIT

SEQ ID NO: 489061 - protein, 9 aa, Influenza virus
VLKYNGIIT

SEQ ID NO: 489062 - protein, 9 aa, Influenza virus
VLKYNGMIT

SEQ ID NO: 489063 - protein, 9 aa, Influenza virus
VLKYNGVIT

SEQ ID NO: 489064 - protein, 9 aa, Influenza virus
VLLEDERTL

SEQ ID NO: 489065 - protein, 9 aa, Influenza virus
VLLENDKTL

SEQ ID NO: 489066 - protein, 9 aa, Influenza virus
VLLENDRTL

SEQ ID NO: 489067 - protein, 9 aa, Influenza virus
VLLENEKTL

SEQ ID NO: 489068 - protein, 9 aa, Influenza virus
VLLENERTL

SEQ ID NO: 489069 - protein, 9 aa, Influenza virus
VLLENGRTL

SEQ ID NO: 489070 - protein, 9 aa, Influenza virus
VLLENQKIL

SEQ ID NO: 489071 - protein, 9 aa, Influenza virus
VLLENQKPL

SEQ ID NO: 489072 - protein, 9 aa, Influenza virus
VLLENQKTL

SEQ ID NO: 489073 - protein, 9 aa, Influenza virus
VLLFMIIGG

SEQ ID NO: 489074 - protein, 9 aa, Influenza virus
VLLGNQKTL

SEQ ID NO: 489075 - protein, 9 aa, Influenza virus
VLLGSSPNA

SEQ ID NO: 489076 - protein, 9 aa, Influenza virus
VLLGTKHSN

SEQ ID NO: 489077 - protein, 9 aa, Influenza virus
VLLKHRFEI

SEQ ID NO: 489078 - protein, 9 aa, Influenza virus
VLLLMIIGG

SEQ ID NO: 489079 - protein, 9 aa, Influenza virus
VLLNASWFN

SEQ ID NO: 489080 - protein, 9 aa, Influenza virus
VLLSPEEVS

SEQ ID NO: 489081 - protein, 9 aa, Influenza virus
VLLVSLGAI

SEQ ID NO: 489082 - protein, 9 aa, Influenza virus
VLLVSLGAV

SEQ ID NO: 489083 - protein, 9 aa, Influenza virus
VLMENEMTL

SEQ ID NO: 489084 - protein, 9 aa, Influenza virus
VLMENERTL

SEQ ID NO: 489085 - protein, 9 aa, Influenza virus
VLNKSLCKV

SEQ ID NO: 489086 - protein, 9 aa, Influenza virus
VLNLLIGIS

SEQ ID NO: 489087 - protein, 9 aa, Influenza virus
VLNLLIGVS

SEQ ID NO: 489088 - protein, 9 aa, Influenza virus
VLNNKHWSG

SEQ ID NO: 489089 - protein, 9 aa, Influenza virus
VLNNKNWSG

SEQ ID NO: 489090 - protein, 9 aa, Influenza virus
VLNNMNWSG

SEQ ID NO: 489091 - protein, 9 aa, Influenza virus
VLNTDWSGY

SEQ ID NO: 489092 - protein, 9 aa, Influenza virus
VLNVSLHLK

SEQ ID NO: 489093 - protein, 9 aa, Influenza virus
VLRGFLIIG

SEQ ID NO: 489094 - protein, 9 aa, Influenza virus
VLRGFLILG

SEQ ID NO: 489095 - protein, 9 aa, Influenza virus
VLRPGETLN

SEQ ID NO: 489096 - protein, 9 aa, Influenza virus
VLRPGQTLR

SEQ ID NO: 489097 - protein, 9 aa, Influenza virus
VLSAFDERR

SEQ ID NO: 489098 - protein, 9 aa, Influenza virus
VLSCIFCLA

SEQ ID NO: 489099 - protein, 9 aa, Influenza virus
VLSIAPIMF

SEQ ID NO: 489100 - protein, 9 aa, Influenza virus
VLSIIALLI

SEQ ID NO: 489101 - protein, 9 aa, Influenza virus
VLSIIPSGP

SEQ ID NO: 489102 - protein, 9 aa, Influenza virus
VLSIVPSGP

SEQ ID NO: 489103 - protein, 9 aa, Influenza virus
VLSIYSCIA

SEQ ID NO: 489104 - protein, 9 aa, Influenza virus
VLSVAPIMF

SEQ ID NO: 489105 - protein, 9 aa, Influenza virus
VLTDNPRPN

SEQ ID NO: 489106 - protein, 9 aa, Influenza virus
VLTDTSRPG

SEQ ID NO: 489107 - protein, 9 aa, Influenza virus
VLTDTSRPK

SEQ ID NO: 489108 - protein, 9 aa, Influenza virus
VLTDTSRPS

SEQ ID NO: 489109 - protein, 9 aa, Influenza virus
VLTGNLQAL

SEQ ID NO: 489110 - protein, 9 aa, Influenza virus
VLTGNLQTL

SEQ ID NO: 489111 - protein, 9 aa, Influenza virus
VLVALENQH

SEQ ID NO: 489112 - protein, 9 aa, Influenza virus
VLVGLILAF

SEQ ID NO: 489113 - protein, 9 aa, Influenza virus
VLVGLILSF

SEQ ID NO: 489114 - protein, 9 aa, Influenza virus
VLVGLILTF

SEQ ID NO: 489115 - protein, 9 aa, Influenza virus
VLVGPILSF

SEQ ID NO: 489116 - protein, 9 aa, Influenza virus
VLVIWGIHH

SEQ ID NO: 489117 - protein, 9 aa, Influenza virus
VLVIWGVHH

SEQ ID NO: 489118 - protein, 9 aa, Influenza virus
VLVLWAIHH

SEQ ID NO: 489119 - protein, 9 aa, Influenza virus
VLVLWGIHH

SEQ ID NO: 489120 - protein, 9 aa, Influenza virus
VLVLWGVHH

SEQ ID NO: 489121 - protein, 9 aa, Influenza virus
VLVMKRKRD

SEQ ID NO: 489122 - protein, 9 aa, Influenza virus
VLVMKRKRN

SEQ ID NO: 489123 - protein, 9 aa, Influenza virus
VLVMWGIHH

SEQ ID NO: 489124 - protein, 9 aa, Influenza virus
VLVMWGLHH

SEQ ID NO: 489125 - protein, 9 aa, Influenza virus
VLVNTYQWI

SEQ ID NO: 489126 - protein, 9 aa, Influenza virus
VLVNTYQWV

SEQ ID NO: 489127 - protein, 9 aa, Influenza virus
VLVTREPYI

SEQ ID NO: 489128 - protein, 9 aa, Influenza virus
VLVTREPYL

SEQ ID NO: 489129 - protein, 9 aa, Influenza virus
VLVTREPYV

SEQ ID NO: 489130 - protein, 9 aa, Influenza virus
VLVVSLGAI

SEQ ID NO: 489131 - protein, 9 aa, Influenza virus
VLWACQNGN

SEQ ID NO: 489132 - protein, 9 aa, Influenza virus
VLWGIHHPD

SEQ ID NO: 489133 - protein, 9 aa, Influenza virus
VLWISFAIS

SEQ ID NO: 489134 - protein, 9 aa, Influenza virus
VLWTSNSIV

SEQ ID NO: 489135 - protein, 9 aa, Influenza virus
VLWTSNSMV

SEQ ID NO: 489136 - protein, 9 aa, Influenza virus
VLWTSNSVV

SEQ ID NO: 489137 - protein, 9 aa, Influenza virus
VLYFWGIHH

SEQ ID NO: 489138 - protein, 9 aa, Influenza virus
VLYFWGVHH

SEQ ID NO: 489139 - protein, 9 aa, Influenza virus
VMCVCRDNW

SEQ ID NO: 489140 - protein, 9 aa, Influenza virus
VMEHTSQYL

SEQ ID NO: 489141 - protein, 9 aa, Influenza virus
VMELIRMIK

SEQ ID NO: 489142 - protein, 9 aa, Influenza virus
VMELIRMVK

SEQ ID NO: 489143 - protein, 9 aa, Influenza virus
VMELVRMIK

SEQ ID NO: 489144 - protein, 9 aa, Influenza virus
VMGARPQVN

SEQ ID NO: 489145 - protein, 9 aa, Influenza virus
VMGLVFFCL

SEQ ID NO: 489146 - protein, 9 aa, Influenza virus
VMGLVFICI

SEQ ID NO: 489147 - protein, 9 aa, Influenza virus
VMGQASYKI

SEQ ID NO: 489148 - protein, 9 aa, Influenza virus
VMGQQGRMD

SEQ ID NO: 489149 - protein, 9 aa, Influenza virus
VMKRKRDSS

SEQ ID NO: 489150 - protein, 9 aa, Influenza virus
VMKRKRNSS

SEQ ID NO: 489151 - protein, 9 aa, Influenza virus
VMLLAIAMG

SEQ ID NO: 489152 - protein, 9 aa, Influenza virus
VMNTSKPFQ

SEQ ID NO: 489153 - protein, 9 aa, Influenza virus
VMNTSKPLQ

SEQ ID NO: 489154 - protein, 9 aa, Influenza virus
VMREPFISC

SEQ ID NO: 489155 - protein, 9 aa, Influenza virus
VMTDGNASG

SEQ ID NO: 489156 - protein, 9 aa, Influenza virus
VMTDGPANK

SEQ ID NO: 489157 - protein, 9 aa, Influenza virus
VMTDGPANN

SEQ ID NO: 489158 - protein, 9 aa, Influenza virus
VMTDGPANR

SEQ ID NO: 489159 - protein, 9 aa, Influenza virus
VMTDGPANS

SEQ ID NO: 489160 - protein, 9 aa, Influenza virus
VMTDGPASN

SEQ ID NO: 489161 - protein, 9 aa, Influenza virus
VMTDGPASS

SEQ ID NO: 489162 - protein, 9 aa, Influenza virus
VMTDGSALG

SEQ ID NO: 489163 - protein, 9 aa, Influenza virus
VMTDGSASD

SEQ ID NO: 489164 - protein, 9 aa, Influenza virus
VMTDGSASE

SEQ ID NO: 489165 - protein, 9 aa, Influenza virus
VMTDGSASG

SEQ ID NO: 489166 - protein, 9 aa, Influenza virus
VMTDGSASR

SEQ ID NO: 489167 - protein, 9 aa, Influenza virus
VMTDGSASS

SEQ ID NO: 489168 - protein, 9 aa, Influenza virus
VMTDGSATG

SEQ ID NO: 489169 - protein, 9 aa, Influenza virus
VMTHTSQYI

SEQ ID NO: 489170 - protein, 9 aa, Influenza virus
VMVGLILAF

SEQ ID NO: 489171 - protein, 9 aa, Influenza virus
VNATETVEI

SEQ ID NO: 489172 - protein, 9 aa, Influenza virus
VNATETVEN

SEQ ID NO: 489173 - protein, 9 aa, Influenza virus
VNATETVEQ

SEQ ID NO: 489174 - protein, 9 aa, Influenza virus
VNATETVER

SEQ ID NO: 489175 - protein, 9 aa, Influenza virus
VNATETVET

SEQ ID NO: 489176 - protein, 9 aa, Influenza virus
VNDRNFWRG

SEQ ID NO: 489177 - protein, 9 aa, Influenza virus
VNEEALRQI

SEQ ID NO: 489178 - protein, 9 aa, Influenza virus
VNEEALRQK

SEQ ID NO: 489179 - protein, 9 aa, Influenza virus
VNEGALRQK

SEQ ID NO: 489180 - protein, 9 aa, Influenza virus
VNESADMSI

SEQ ID NO: 489181 - protein, 9 aa, Influenza virus
VNFLSMEFS

SEQ ID NO: 489182 - protein, 9 aa, Influenza virus
VNFSFNGAF

SEQ ID NO: 489183 - protein, 9 aa, Influenza virus
VNFVIEKMN

SEQ ID NO: 489184 - protein, 9 aa, Influenza virus
VNFVSMEFS

SEQ ID NO: 489185 - protein, 9 aa, Influenza virus
VNGALGSPG

SEQ ID NO: 489186 - protein, 9 aa, Influenza virus
VNGEALRQI

SEQ ID NO: 489187 - protein, 9 aa, Influenza virus
VNGPESVLV

SEQ ID NO: 489188 - protein, 9 aa, Influenza virus
VNGQAGRID

SEQ ID NO: 489189 - protein, 9 aa, Influenza virus
VNGQAGRMT

SEQ ID NO: 489190 - protein, 9 aa, Influenza virus
VNGQFGRID

SEQ ID NO: 489191 - protein, 9 aa, Influenza virus
VNGQFGRIN

SEQ ID NO: 489192 - protein, 9 aa, Influenza virus
VNGQRGRID

SEQ ID NO: 489193 - protein, 9 aa, Influenza virus
VNGQSGRID

SEQ ID NO: 489194 - protein, 9 aa, Influenza virus
VNGQSGRIE

SEQ ID NO: 489195 - protein, 9 aa, Influenza virus
VNGQSGRIN

SEQ ID NO: 489196 - protein, 9 aa, Influenza virus
VNGQSGRIV

SEQ ID NO: 489197 - protein, 9 aa, Influenza virus
VNGQTGRID

SEQ ID NO: 489198 - protein, 9 aa, Influenza virus
VNGVKLEEN

SEQ ID NO: 489199 - protein, 9 aa, Influenza virus
VNGWYGFRH

SEQ ID NO: 489200 - protein, 9 aa, Influenza virus
VNICKAAMG

SEQ ID NO: 489201 - protein, 9 aa, Influenza virus
VNIDRFLRV

SEQ ID NO: 489202 - protein, 9 aa, Influenza virus
VNIKSLKLA

SEQ ID NO: 489203 - protein, 9 aa, Influenza virus
VNKITYGAC

SEQ ID NO: 489204 - protein, 9 aa, Influenza virus
VNKNPYTLV

SEQ ID NO: 489205 - protein, 9 aa, Influenza virus
VNKTTVINK

SEQ ID NO: 489206 - protein, 9 aa, Influenza virus
VNLGLNIGL

SEQ ID NO: 489207 - protein, 9 aa, Influenza virus
VNMTNVQNN

SEQ ID NO: 489208 - protein, 9 aa, Influenza virus
VNNGKGRYG

SEQ ID NO: 489209 - protein, 9 aa, Influenza virus
VNNITTTII

SEQ ID NO: 489210 - protein, 9 aa, Influenza virus
VNNITTTIV

SEQ ID NO: 489211 - protein, 9 aa, Influenza virus
VNNIVDKMN

SEQ ID NO: 489212 - protein, 9 aa, Influenza virus
VNNPNWSGY

SEQ ID NO: 489213 - protein, 9 aa, Influenza virus
VNNQDWSGY

SEQ ID NO: 489214 - protein, 9 aa, Influenza virus
VNNQNWSGY

SEQ ID NO: 489215 - protein, 9 aa, Influenza virus
VNNTTIINK

SEQ ID NO: 489216 - protein, 9 aa, Influenza virus
VNNTTIISK

SEQ ID NO: 489217 - protein, 9 aa, Influenza virus
VNNTTIITK

SEQ ID NO: 489218 - protein, 9 aa, Influenza virus
VNNTTVINK

SEQ ID NO: 489219 - protein, 9 aa, Influenza virus
VNPGDSIIF

SEQ ID NO: 489220 - protein, 9 aa, Influenza virus
VNPTLLFLE

SEQ ID NO: 489221 - protein, 9 aa, Influenza virus
VNPTLLFLK

SEQ ID NO: 489222 - protein, 9 aa, Influenza virus
VNQITGKLN

SEQ ID NO: 489223 - protein, 9 aa, Influenza virus
VNRANQRLN

SEQ ID NO: 489224 - protein, 9 aa, Influenza virus
VNRCFYVEL

SEQ ID NO: 489225 - protein, 9 aa, Influenza virus
VNREPYVSC

SEQ ID NO: 489226 - protein, 9 aa, Influenza virus
VNRFYRTCK

SEQ ID NO: 489227 - protein, 9 aa, Influenza virus
VNRITYGAC

SEQ ID NO: 489228 - protein, 9 aa, Influenza virus
VNRITYGPC

SEQ ID NO: 489229 - protein, 9 aa, Influenza virus
VNRITYGVC

SEQ ID NO: 489230 - protein, 9 aa, Influenza virus
VNRTHQYSE

SEQ ID NO: 489231 - protein, 9 aa, Influenza virus
VNSALGSPG

SEQ ID NO: 489232 - protein, 9 aa, Influenza virus
VNSFSRTEL

SEQ ID NO: 489233 - protein, 9 aa, Influenza virus
VNSIIDKMN

SEQ ID NO: 489234 - protein, 9 aa, Influenza virus
VNSIIEKMN

SEQ ID NO: 489235 - protein, 9 aa, Influenza virus
VNSIIGKMN

SEQ ID NO: 489236 - protein, 9 aa, Influenza virus
VNSIINKMN

SEQ ID NO: 489237 - protein, 9 aa, Influenza virus
VNSSKPFQN

SEQ ID NO: 489238 - protein, 9 aa, Influenza virus
VNSSMPFHN

SEQ ID NO: 489239 - protein, 9 aa, Influenza virus
VNSVIEKIN

SEQ ID NO: 489240 - protein, 9 aa, Influenza virus
VNSVIEKMN

SEQ ID NO: 489241 - protein, 9 aa, Influenza virus
VNSVVEKMN

SEQ ID NO: 489242 - protein, 9 aa, Influenza virus
VNSWHIFSK

SEQ ID NO: 489243 - protein, 9 aa, Influenza virus
VNSWHILSK

SEQ ID NO: 489244 - protein, 9 aa, Influenza virus
VNTALLNAS

SEQ ID NO: 489245 - protein, 9 aa, Influenza virus
VNTIIENNV

SEQ ID NO: 489246 - protein, 9 aa, Influenza virus
VNTILEKNV

SEQ ID NO: 489247 - protein, 9 aa, Influenza virus
VNTILSTKA

SEQ ID NO: 489248 - protein, 9 aa, Influenza virus
VNTLAERGV

SEQ ID NO: 489249 - protein, 9 aa, Influenza virus
VNTLIEQNI

SEQ ID NO: 489250 - protein, 9 aa, Influenza virus
VNTLIEQNV

SEQ ID NO: 489251 - protein, 9 aa, Influenza virus
VNTLLENDV

SEQ ID NO: 489252 - protein, 9 aa, Influenza virus
VNTLSEQNV

SEQ ID NO: 489253 - protein, 9 aa, Influenza virus
VNTLTEKGI

SEQ ID NO: 489254 - protein, 9 aa, Influenza virus
VNTLTEKGV

SEQ ID NO: 489255 - protein, 9 aa, Influenza virus
VNTLTEQNV

SEQ ID NO: 489256 - protein, 9 aa, Influenza virus
VNTLTEREV

SEQ ID NO: 489257 - protein, 9 aa, Influenza virus
VNTLTERGI

SEQ ID NO: 489258 - protein, 9 aa, Influenza virus
VNTLTERGV

SEQ ID NO: 489259 - protein, 9 aa, Influenza virus
VNTNKTFQN

SEQ ID NO: 489260 - protein, 9 aa, Influenza virus
VNTNTINRS

SEQ ID NO: 489261 - protein, 9 aa, Influenza virus
VNTTLSTIA

SEQ ID NO: 489262 - protein, 9 aa, Influenza virus
VNTVLSIIA

SEQ ID NO: 489263 - protein, 9 aa, Influenza virus
VNTYQWIIK

SEQ ID NO: 489264 - protein, 9 aa, Influenza virus
VNTYQWIIR

SEQ ID NO: 489265 - protein, 9 aa, Influenza virus
VNTYQWVIR

SEQ ID NO: 489266 - protein, 9 aa, Influenza virus
VNVKSLKLA

SEQ ID NO: 489267 - protein, 9 aa, Influenza virus
VNVRGSGLR

SEQ ID NO: 489268 - protein, 9 aa, Influenza virus
VNVRGSGMR

SEQ ID NO: 489269 - protein, 9 aa, Influenza virus
VNVRGTGMR

SEQ ID NO: 489270 - protein, 9 aa, Influenza virus
VNVRSLKLA

SEQ ID NO: 489271 - protein, 9 aa, Influenza virus
VNVTHVQNN

SEQ ID NO: 489272 - protein, 9 aa, Influenza virus
VNVTNVQND

SEQ ID NO: 489273 - protein, 9 aa, Influenza virus
VNVTNVQNN

SEQ ID NO: 489274 - protein, 9 aa, Influenza virus
VNYVSMEFS

SEQ ID NO: 489275 - protein, 9 aa, Influenza virus
VPAQNAISI

SEQ ID NO: 489276 - protein, 9 aa, Influenza virus
VPAQNAIST

SEQ ID NO: 489277 - protein, 9 aa, Influenza virus
VPASRYLID

SEQ ID NO: 489278 - protein, 9 aa, Influenza virus
VPASRYLTD

SEQ ID NO: 489279 - protein, 9 aa, Influenza virus
VPCFWLEMI

SEQ ID NO: 489280 - protein, 9 aa, Influenza virus
VPCFWVEMI

SEQ ID NO: 489281 - protein, 9 aa, Influenza virus
VPDYQSIRS

SEQ ID NO: 489282 - protein, 9 aa, Influenza virus
VPDYQSLRS

SEQ ID NO: 489283 - protein, 9 aa, Influenza virus
VPEKIHTRG

SEQ ID NO: 489284 - protein, 9 aa, Influenza virus
VPEKIRTRG

SEQ ID NO: 489285 - protein, 9 aa, Influenza virus
VPEKIRVKR

SEQ ID NO: 489286 - protein, 9 aa, Influenza virus
VPERNEQGQ

SEQ ID NO: 489287 - protein, 9 aa, Influenza virus
VPESMREEY

SEQ ID NO: 489288 - protein, 9 aa, Influenza virus
VPEWSWDDG

SEQ ID NO: 489289 - protein, 9 aa, Influenza virus
VPEWSYIIE

SEQ ID NO: 489290 - protein, 9 aa, Influenza virus
VPEWSYIME

SEQ ID NO: 489291 - protein, 9 aa, Influenza virus
VPEWSYIVE

SEQ ID NO: 489292 - protein, 9 aa, Influenza virus
VPEYQSLRS

SEQ ID NO: 489293 - protein, 9 aa, Influenza virus
VPFHLATKQ

SEQ ID NO: 489294 - protein, 9 aa, Influenza virus
VPFHLGTKQ

SEQ ID NO: 489295 - protein, 9 aa, Influenza virus
VPFHLGTRQ

SEQ ID NO: 489296 - protein, 9 aa, Influenza virus
VPFSKDNSI

SEQ ID NO: 489297 - protein, 9 aa, Influenza virus
VPFYLGTKQ

SEQ ID NO: 489298 - protein, 9 aa, Influenza virus
VPGVKGFGF

SEQ ID NO: 489299 - protein, 9 aa, Influenza virus
VPGWSWDDG

SEQ ID NO: 489300 - protein, 9 aa, Influenza virus
VPGYQSLRS

SEQ ID NO: 489301 - protein, 9 aa, Influenza virus
VPILNTSQR

SEQ ID NO: 489302 - protein, 9 aa, Influenza virus
VPKRNRSIL

SEQ ID NO: 489303 - protein, 9 aa, Influenza virus
VPKSMREEY

SEQ ID NO: 489304 - protein, 9 aa, Influenza virus
VPLGSSPNA

SEQ ID NO: 489305 - protein, 9 aa, Influenza virus
VPLVPCEPI

SEQ ID NO: 489306 - protein, 9 aa, Influenza virus
VPMGSSPNA

SEQ ID NO: 489307 - protein, 9 aa, Influenza virus
VPNAGTDPN

SEQ ID NO: 489308 - protein, 9 aa, Influenza virus
VPNALTDDK

SEQ ID NO: 489309 - protein, 9 aa, Influenza virus
VPNALTDDR

SEQ ID NO: 489310 - protein, 9 aa, Influenza virus
VPNALTDER

SEQ ID NO: 489311 - protein, 9 aa, Influenza virus
VPNALTDNR

SEQ ID NO: 489312 - protein, 9 aa, Influenza virus
VPNGTIVKT

SEQ ID NO: 489313 - protein, 9 aa, Influenza virus
VPNGTIVRT

SEQ ID NO: 489314 - protein, 9 aa, Influenza virus
VPNGTKVNT

SEQ ID NO: 489315 - protein, 9 aa, Influenza virus
VPNGTLVKT

SEQ ID NO: 489316 - protein, 9 aa, Influenza virus
VPNGTMVKT

SEQ ID NO: 489317 - protein, 9 aa, Influenza virus
VPNGTVVKT

SEQ ID NO: 489318 - protein, 9 aa, Influenza virus
VPNIGSRPR

SEQ ID NO: 489319 - protein, 9 aa, Influenza virus
VPNYQSLRS

SEQ ID NO: 489320 - protein, 9 aa, Influenza virus
VPPLELGDC

SEQ ID NO: 489321 - protein, 9 aa, Influenza virus
VPPLGSAQA

SEQ ID NO: 489322 - protein, 9 aa, Influenza virus
VPQAQDRGL

SEQ ID NO: 489323 - protein, 9 aa, Influenza virus
VPQAQNRGL

SEQ ID NO: 489324 - protein, 9 aa, Influenza virus
VPQIEARGL

SEQ ID NO: 489325 - protein, 9 aa, Influenza virus
VPQIEPRGL

SEQ ID NO: 489326 - protein, 9 aa, Influenza virus
VPQIESRGL

SEQ ID NO: 489327 - protein, 9 aa, Influenza virus
VPQIQNRGL

SEQ ID NO: 489328 - protein, 9 aa, Influenza virus
VPQMESRGL

SEQ ID NO: 489329 - protein, 9 aa, Influenza virus
VPQVQDRGL

SEQ ID NO: 489330 - protein, 9 aa, Influenza virus
VPQVQNRGL

SEQ ID NO: 489331 - protein, 9 aa, Influenza virus
VPSERGLQR

SEQ ID NO: 489332 - protein, 9 aa, Influenza virus
VPSFDMNNE

SEQ ID NO: 489333 - protein, 9 aa, Influenza virus
VPSFDMSKE

SEQ ID NO: 489334 - protein, 9 aa, Influenza virus
VPSFDMSND

SEQ ID NO: 489335 - protein, 9 aa, Influenza virus
VPSFDMSNE

SEQ ID NO: 489336 - protein, 9 aa, Influenza virus
VPSFEMSNE

SEQ ID NO: 489337 - protein, 9 aa, Influenza virus
VPSGPLKAE

SEQ ID NO: 489338 - protein, 9 aa, Influenza virus
VPSIQSRGL

SEQ ID NO: 489339 - protein, 9 aa, Influenza virus
VPSPYNSRF

SEQ ID NO: 489340 - protein, 9 aa, Influenza virus
VPTDVIRSW

SEQ ID NO: 489341 - protein, 9 aa, Influenza virus
VPTDVMRSW

SEQ ID NO: 489342 - protein, 9 aa, Influenza virus
VPTDVVRSW

SEQ ID NO: 489343 - protein, 9 aa, Influenza virus
VPVGSGSFP

SEQ ID NO: 489344 - protein, 9 aa, Influenza virus
VPVIGARPQ

SEQ ID NO: 489345 - protein, 9 aa, Influenza virus
VPVMGARPQ

SEQ ID NO: 489346 - protein, 9 aa, Influenza virus
VPVQNAIST

SEQ ID NO: 489347 - protein, 9 aa, Influenza virus
VPVTQAMEL

SEQ ID NO: 489348 - protein, 9 aa, Influenza virus
VPVTQTMEL

SEQ ID NO: 489349 - protein, 9 aa, Influenza virus
VPVTQVEEL

SEQ ID NO: 489350 - protein, 9 aa, Influenza virus
VPVTSSIDL

SEQ ID NO: 489351 - protein, 9 aa, Influenza virus
VPVTSSVDL

SEQ ID NO: 489352 - protein, 9 aa, Influenza virus
VPVTSTIDL

SEQ ID NO: 489353 - protein, 9 aa, Influenza virus
VPVVGARPQ

SEQ ID NO: 489354 - protein, 9 aa, Influenza virus
VPVVGDRPL

SEQ ID NO: 489355 - protein, 9 aa, Influenza virus
VPVVRARPQ

SEQ ID NO: 489356 - protein, 9 aa, Influenza virus
VQAMRAIGT

SEQ ID NO: 489357 - protein, 9 aa, Influenza virus
VQAMRAVGT

SEQ ID NO: 489358 - protein, 9 aa, Influenza virus
VQAMRTIGT

SEQ ID NO: 489359 - protein, 9 aa, Influenza virus
VQAMRTVGT

SEQ ID NO: 489360 - protein, 9 aa, Influenza virus
VQDIIDNDN

SEQ ID NO: 489361 - protein, 9 aa, Influenza virus
VQDIIDNNN

SEQ ID NO: 489362 - protein, 9 aa, Influenza virus
VQDRGLFGA

SEQ ID NO: 489363 - protein, 9 aa, Influenza virus
VQGNNDNAT

SEQ ID NO: 489364 - protein, 9 aa, Influenza virus
VQGNNKNAT

SEQ ID NO: 489365 - protein, 9 aa, Influenza virus
VQGNNNNAT

SEQ ID NO: 489366 - protein, 9 aa, Influenza virus
VQHLEECSC

SEQ ID NO: 489367 - protein, 9 aa, Influenza virus
VQHPELTGL

SEQ ID NO: 489368 - protein, 9 aa, Influenza virus
VQHPELTGM

SEQ ID NO: 489369 - protein, 9 aa, Influenza virus
VQHPEMTGL

SEQ ID NO: 489370 - protein, 9 aa, Influenza virus
VQIIKLLPF

SEQ ID NO: 489371 - protein, 9 aa, Influenza virus
VQITGKLNR

SEQ ID NO: 489372 - protein, 9 aa, Influenza virus
VQMCTELKL

SEQ ID NO: 489373 - protein, 9 aa, Influenza virus
VQMQRFRRP

SEQ ID NO: 489374 - protein, 9 aa, Influenza virus
VQNAISTTF

SEQ ID NO: 489375 - protein, 9 aa, Influenza virus
VQNALNGNG

SEQ ID NO: 489376 - protein, 9 aa, Influenza virus
VQNALSGNG

SEQ ID NO: 489377 - protein, 9 aa, Influenza virus
VQNEFNKAC

SEQ ID NO: 489378 - protein, 9 aa, Influenza virus
VQNRGLFGA

SEQ ID NO: 489379 - protein, 9 aa, Influenza virus
VQPAFSVQR

SEQ ID NO: 489380 - protein, 9 aa, Influenza virus
VQPGDNITF

SEQ ID NO: 489381 - protein, 9 aa, Influenza virus
VQPTFSVQR

SEQ ID NO: 489382 - protein, 9 aa, Influenza virus
VQQTRVDKL

SEQ ID NO: 489383 - protein, 9 aa, Influenza virus
VQQTRVDRL

SEQ ID NO: 489384 - protein, 9 aa, Influenza virus
VQRNLPFDK

SEQ ID NO: 489385 - protein, 9 aa, Influenza virus
VQRNLPFEK

SEQ ID NO: 489386 - protein, 9 aa, Influenza virus
VQRNLPFER

SEQ ID NO: 489387 - protein, 9 aa, Influenza virus
VQRSLPFER

SEQ ID NO: 489388 - protein, 9 aa, Influenza virus
VQSEFNKAC

SEQ ID NO: 489389 - protein, 9 aa, Influenza virus
VQSKMQFSS

SEQ ID NO: 489390 - protein, 9 aa, Influenza virus
VQSRGLFGA

SEQ ID NO: 489391 - protein, 9 aa, Influenza virus
VQSRMQFSS

SEQ ID NO: 489392 - protein, 9 aa, Influenza virus
VQSYFQLFL

SEQ ID NO: 489393 - protein, 9 aa, Influenza virus
VQTDEYKNT

SEQ ID NO: 489394 - protein, 9 aa, Influenza virus
VQVDTIMEK

SEQ ID NO: 489395 - protein, 9 aa, Influenza virus
VQVIKLLPF

SEQ ID NO: 489396 - protein, 9 aa, Influenza virus
VRARPQVNG

SEQ ID NO: 489397 - protein, 9 aa, Influenza virus
VRCICKDNW

SEQ ID NO: 489398 - protein, 9 aa, Influenza virus
VRCICRDNW

SEQ ID NO: 489399 - protein, 9 aa, Influenza virus
VRCVCRDNW

SEQ ID NO: 489400 - protein, 9 aa, Influenza virus
VREGRNPGN

SEQ ID NO: 489401 - protein, 9 aa, Influenza virus
VREKDMTKE

SEQ ID NO: 489402 - protein, 9 aa, Influenza virus
VREPFISCS

SEQ ID NO: 489403 - protein, 9 aa, Influenza virus
VREQQGRMD

SEQ ID NO: 489404 - protein, 9 aa, Influenza virus
VRESRNPGN

SEQ ID NO: 489405 - protein, 9 aa, Influenza virus
VREWSYLIE

SEQ ID NO: 489406 - protein, 9 aa, Influenza virus
VRFGESEQI

SEQ ID NO: 489407 - protein, 9 aa, Influenza virus
VRFNSDLDY

SEQ ID NO: 489408 - protein, 9 aa, Influenza virus
VRFQLKDNA

SEQ ID NO: 489409 - protein, 9 aa, Influenza virus
VRGDLNFVN

SEQ ID NO: 489410 - protein, 9 aa, Influenza virus
VRGDQICIG

SEQ ID NO: 489411 - protein, 9 aa, Influenza virus
VRGDQICVG

SEQ ID NO: 489412 - protein, 9 aa, Influenza virus
VRGDQMAHC

SEQ ID NO: 489413 - protein, 9 aa, Influenza virus
VRGDYNNTT

SEQ ID NO: 489414 - protein, 9 aa, Influenza virus
VRGLSSRIS

SEQ ID NO: 489415 - protein, 9 aa, Influenza virus
VRGNSPAFN

SEQ ID NO: 489416 - protein, 9 aa, Influenza virus
VRGNSPVFN

SEQ ID NO: 489417 - protein, 9 aa, Influenza virus
VRGQQGRMD

SEQ ID NO: 489418 - protein, 9 aa, Influenza virus
VRGQQGTMD

SEQ ID NO: 489419 - protein, 9 aa, Influenza virus
VRGQQGWMD

SEQ ID NO: 489420 - protein, 9 aa, Influenza virus
VRGQSGRIS

SEQ ID NO: 489421 - protein, 9 aa, Influenza virus
VRGQSGRVS

SEQ ID NO: 489422 - protein, 9 aa, Influenza virus
VRGSGLRIL

SEQ ID NO: 489423 - protein, 9 aa, Influenza virus
VRGSGMRIL

SEQ ID NO: 489424 - protein, 9 aa, Influenza virus
VRGTGMRIL

SEQ ID NO: 489425 - protein, 9 aa, Influenza virus
VRHFEKVKI

SEQ ID NO: 489426 - protein, 9 aa, Influenza virus
VRHNGTCAV

SEQ ID NO: 489427 - protein, 9 aa, Influenza virus
VRHQLRDNA

SEQ ID NO: 489428 - protein, 9 aa, Influenza virus
VRHQLRENA

SEQ ID NO: 489429 - protein, 9 aa, Influenza virus
VRHRLKITE

SEQ ID NO: 489430 - protein, 9 aa, Influenza virus
VRIGSKGDV

SEQ ID NO: 489431 - protein, 9 aa, Influenza virus
VRINNETIL

SEQ ID NO: 489432 - protein, 9 aa, Influenza virus
VRKASLRLA

SEQ ID NO: 489433 - protein, 9 aa, Influenza virus
VRKMMTNSH

SEQ ID NO: 489434 - protein, 9 aa, Influenza virus
VRKMMTNSQ

SEQ ID NO: 489435 - protein, 9 aa, Influenza virus
VRKMMTSSQ

SEQ ID NO: 489436 - protein, 9 aa, Influenza virus
VRKQLRENA

SEQ ID NO: 489437 - protein, 9 aa, Influenza virus
VRKQLRQNA

SEQ ID NO: 489438 - protein, 9 aa, Influenza virus
VRKRFADQE

SEQ ID NO: 489439 - protein, 9 aa, Influenza virus
VRKTRFLPV

SEQ ID NO: 489440 - protein, 9 aa, Influenza virus
VRLEENTTY

SEQ ID NO: 489441 - protein, 9 aa, Influenza virus
VRLFDYSRW

SEQ ID NO: 489442 - protein, 9 aa, Influenza virus
VRLQLKDNA

SEQ ID NO: 489443 - protein, 9 aa, Influenza virus
VRLQLRDNA

SEQ ID NO: 489444 - protein, 9 aa, Influenza virus
VRLQLRNNA

SEQ ID NO: 489445 - protein, 9 aa, Influenza virus
VRLSAGGDI

SEQ ID NO: 489446 - protein, 9 aa, Influenza virus
VRLSASGDI

SEQ ID NO: 489447 - protein, 9 aa, Influenza virus
VRLSSGYKD

SEQ ID NO: 489448 - protein, 9 aa, Influenza virus
VRLTQGYKD

SEQ ID NO: 489449 - protein, 9 aa, Influenza virus
VRLYLWGVH

SEQ ID NO: 489450 - protein, 9 aa, Influenza virus
VRMIKRGIN

SEQ ID NO: 489451 - protein, 9 aa, Influenza virus
VRMNNETIL

SEQ ID NO: 489452 - protein, 9 aa, Influenza virus
VRMQLKDNA

SEQ ID NO: 489453 - protein, 9 aa, Influenza virus
VRMQLRDNA

SEQ ID NO: 489454 - protein, 9 aa, Influenza virus
VRMQLRDNV

SEQ ID NO: 489455 - protein, 9 aa, Influenza virus
VRNDDIDQS

SEQ ID NO: 489456 - protein, 9 aa, Influenza virus
VRNDDVDQS

SEQ ID NO: 489457 - protein, 9 aa, Influenza virus
VRNGTYDHK

SEQ ID NO: 489458 - protein, 9 aa, Influenza virus
VRNGTYDYP

SEQ ID NO: 489459 - protein, 9 aa, Influenza virus
VRNLHDQIK

SEQ ID NO: 489460 - protein, 9 aa, Influenza virus
VRNLHDQIR

SEQ ID NO: 489461 - protein, 9 aa, Influenza virus
VRNLHDQVK

SEQ ID NO: 489462 - protein, 9 aa, Influenza virus
VRNLHDQVR

SEQ ID NO: 489463 - protein, 9 aa, Influenza virus
VRNLHDRIR

SEQ ID NO: 489464 - protein, 9 aa, Influenza virus
VRNLHDRTR

SEQ ID NO: 489465 - protein, 9 aa, Influenza virus
VRNLHDRVK

SEQ ID NO: 489466 - protein, 9 aa, Influenza virus
VRNLHDRVR

SEQ ID NO: 489467 - protein, 9 aa, Influenza virus
VRNLHEQIK

SEQ ID NO: 489468 - protein, 9 aa, Influenza virus
VRNLHEQVR

SEQ ID NO: 489469 - protein, 9 aa, Influenza virus
VRNLHERIR

SEQ ID NO: 489470 - protein, 9 aa, Influenza virus
VRNLYDKVR

SEQ ID NO: 489471 - protein, 9 aa, Influenza virus
VRNQSGRIS

SEQ ID NO: 489472 - protein, 9 aa, Influenza virus
VRPGDNITF

SEQ ID NO: 489473 - protein, 9 aa, Influenza virus
VRPGYNGQK

SEQ ID NO: 489474 - protein, 9 aa, Influenza virus
VRPGYNGQR

SEQ ID NO: 489475 - protein, 9 aa, Influenza virus
VRPLILKDC

SEQ ID NO: 489476 - protein, 9 aa, Influenza virus
VRPLILRDC

SEQ ID NO: 489477 - protein, 9 aa, Influenza virus
VRPRYNGQR

SEQ ID NO: 489478 - protein, 9 aa, Influenza virus
VRQCFNPMI

SEQ ID NO: 489479 - protein, 9 aa, Influenza virus
VRQCFNPMT

SEQ ID NO: 489480 - protein, 9 aa, Influenza virus
VRQCFNPMV

SEQ ID NO: 489481 - protein, 9 aa, Influenza virus
VRRAAVSAD

SEQ ID NO: 489482 - protein, 9 aa, Influenza virus
VRRAIVSAD

SEQ ID NO: 489483 - protein, 9 aa, Influenza virus
VRRATVSAD

SEQ ID NO: 489484 - protein, 9 aa, Influenza virus
VRRDQMAHC

SEQ ID NO: 489485 - protein, 9 aa, Influenza virus
VRRIWRQAN

SEQ ID NO: 489486 - protein, 9 aa, Influenza virus
VRRQLRENA

SEQ ID NO: 489487 - protein, 9 aa, Influenza virus
VRRRLSANA

SEQ ID NO: 489488 - protein, 9 aa, Influenza virus
VRRRLSTNA

SEQ ID NO: 489489 - protein, 9 aa, Influenza virus
VRRRLSVNA

SEQ ID NO: 489490 - protein, 9 aa, Influenza virus
VRSDGNLIA

SEQ ID NO: 489491 - protein, 9 aa, Influenza virus
VRSDKICLG

SEQ ID NO: 489492 - protein, 9 aa, Influenza virus
VRSEKLVLA

SEQ ID NO: 489493 - protein, 9 aa, Influenza virus
VRSGMDPRM

SEQ ID NO: 489494 - protein, 9 aa, Influenza virus
VRSLKLATG

SEQ ID NO: 489495 - protein, 9 aa, Influenza virus
VRSNGNLIA

SEQ ID NO: 489496 - protein, 9 aa, Influenza virus
VRSQLRDNA

SEQ ID NO: 489497 - protein, 9 aa, Influenza virus
VRSQSGRIS

SEQ ID NO: 489498 - protein, 9 aa, Influenza virus
VRSWKKQIL

SEQ ID NO: 489499 - protein, 9 aa, Influenza virus
VRSWRKKIL

SEQ ID NO: 489500 - protein, 9 aa, Influenza virus
VRSWRKQIL

SEQ ID NO: 489501 - protein, 9 aa, Influenza virus
VRSWRRQIL

SEQ ID NO: 489502 - protein, 9 aa, Influenza virus
VRTGMDPRM

SEQ ID NO: 489503 - protein, 9 aa, Influenza virus
VRTLFQQMR

SEQ ID NO: 489504 - protein, 9 aa, Influenza virus
VRTNGTSKI

SEQ ID NO: 489505 - protein, 9 aa, Influenza virus
VRTNGTSKV

SEQ ID NO: 489506 - protein, 9 aa, Influenza virus
VSADPLASL

SEQ ID NO: 489507 - protein, 9 aa, Influenza virus
VSADPLLSL

SEQ ID NO: 489508 - protein, 9 aa, Influenza virus
VSAGGDIWV

SEQ ID NO: 489509 - protein, 9 aa, Influenza virus
VSAKELVET

SEQ ID NO: 489510 - protein, 9 aa, Influenza virus
VSCDPDECR

SEQ ID NO: 489511 - protein, 9 aa, Influenza virus
VSCDPDGCR

SEQ ID NO: 489512 - protein, 9 aa, Influenza virus
VSCDPLGCK

SEQ ID NO: 489513 - protein, 9 aa, Influenza virus
VSCDPLGCR

SEQ ID NO: 489514 - protein, 9 aa, Influenza virus
VSCDPNECR

SEQ ID NO: 489515 - protein, 9 aa, Influenza virus
VSCDPSGCK

SEQ ID NO: 489516 - protein, 9 aa, Influenza virus
VSCDPTGCK

SEQ ID NO: 489517 - protein, 9 aa, Influenza virus
VSCEPDECR

SEQ ID NO: 489518 - protein, 9 aa, Influenza virus
VSCGPSECR

SEQ ID NO: 489519 - protein, 9 aa, Influenza virus
VSCSHLECR

SEQ ID NO: 489520 - protein, 9 aa, Influenza virus
VSCVCRDNW

SEQ ID NO: 489521 - protein, 9 aa, Influenza virus
VSDGGPNLY

SEQ ID NO: 489522 - protein, 9 aa, Influenza virus
VSECRTFFL

SEQ ID NO: 489523 - protein, 9 aa, Influenza virus
VSEEALRQK

SEQ ID NO: 489524 - protein, 9 aa, Influenza virus
VSEWSYIVE

SEQ ID NO: 489525 - protein, 9 aa, Influenza virus
VSFESNGGL

SEQ ID NO: 489526 - protein, 9 aa, Influenza virus
VSFHLGTKQ

SEQ ID NO: 489527 - protein, 9 aa, Influenza virus
VSFQGGHIE

SEQ ID NO: 489528 - protein, 9 aa, Influenza virus
VSFQGRGVF

SEQ ID NO: 489529 - protein, 9 aa, Influenza virus
VSFRGRGVF

SEQ ID NO: 489530 - protein, 9 aa, Influenza virus
VSFSISCFL

SEQ ID NO: 489531 - protein, 9 aa, Influenza virus
VSFWMCSNG

SEQ ID NO: 489532 - protein, 9 aa, Influenza virus
VSFYWTIVE

SEQ ID NO: 489533 - protein, 9 aa, Influenza virus
VSGADDDAY

SEQ ID NO: 489534 - protein, 9 aa, Influenza virus
VSGADNDAY

SEQ ID NO: 489535 - protein, 9 aa, Influenza virus
VSGEVPGWS

SEQ ID NO: 489536 - protein, 9 aa, Influenza virus
VSGINESAD

SEQ ID NO: 489537 - protein, 9 aa, Influenza virus
VSGPDNGAV

SEQ ID NO: 489538 - protein, 9 aa, Influenza virus
VSGPNNNAS

SEQ ID NO: 489539 - protein, 9 aa, Influenza virus
VSGTDDDAY

SEQ ID NO: 489540 - protein, 9 aa, Influenza virus
VSGVNESAD

SEQ ID NO: 489541 - protein, 9 aa, Influenza virus
VSHCRATEY

SEQ ID NO: 489542 - protein, 9 aa, Influenza virus
VSHNGTWAV

SEQ ID NO: 489543 - protein, 9 aa, Influenza virus
VSIDRFLRV

SEQ ID NO: 489544 - protein, 9 aa, Influenza virus
VSIGTSTLN

SEQ ID NO: 489545 - protein, 9 aa, Influenza virus
VSILNLGQK

SEQ ID NO: 489546 - protein, 9 aa, Influenza virus
VSILNLGQR

SEQ ID NO: 489547 - protein, 9 aa, Influenza virus
VSKDNGIRI

SEQ ID NO: 489548 - protein, 9 aa, Influenza virus
VSKDNGIRV

SEQ ID NO: 489549 - protein, 9 aa, Influenza virus
VSKMGVDEY

SEQ ID NO: 489550 - protein, 9 aa, Influenza virus
VSKTGVDEY

SEQ ID NO: 489551 - protein, 9 aa, Influenza virus
VSKVGVDEY

SEQ ID NO: 489552 - protein, 9 aa, Influenza virus
VSLGAISFW

SEQ ID NO: 489553 - protein, 9 aa, Influenza virus
VSLGAVSFW

SEQ ID NO: 489554 - protein, 9 aa, Influenza virus
VSLLQSAIL

SEQ ID NO: 489555 - protein, 9 aa, Influenza virus
VSLSPGMMM

SEQ ID NO: 489556 - protein, 9 aa, Influenza virus
VSLSYSTGA

SEQ ID NO: 489557 - protein, 9 aa, Influenza virus
VSMCSSTEF

SEQ ID NO: 489558 - protein, 9 aa, Influenza virus
VSMEFSLTD

SEQ ID NO: 489559 - protein, 9 aa, Influenza virus
VSNDNWSGY

SEQ ID NO: 489560 - protein, 9 aa, Influenza virus
VSNGTKINT

SEQ ID NO: 489561 - protein, 9 aa, Influenza virus
VSNGTKVNT

SEQ ID NO: 489562 - protein, 9 aa, Influenza virus
VSNGTMVKT

SEQ ID NO: 489563 - protein, 9 aa, Influenza virus
VSNNDWSGY

SEQ ID NO: 489564 - protein, 9 aa, Influenza virus
VSNSDFICV

SEQ ID NO: 489565 - protein, 9 aa, Influenza virus
VSNSDFLCV

SEQ ID NO: 489566 - protein, 9 aa, Influenza virus
VSNSDFMCV

SEQ ID NO: 489567 - protein, 9 aa, Influenza virus
VSNSDWSGY

SEQ ID NO: 489568 - protein, 9 aa, Influenza virus
VSNSEFLCV

SEQ ID NO: 489569 - protein, 9 aa, Influenza virus
VSPIHLGDC

SEQ ID NO: 489570 - protein, 9 aa, Influenza virus
VSPLAVTWW

SEQ ID NO: 489571 - protein, 9 aa, Influenza virus
VSPLSGSAQ

SEQ ID NO: 489572 - protein, 9 aa, Influenza virus
VSPVHLGDC

SEQ ID NO: 489573 - protein, 9 aa, Influenza virus
VSRARIDAR

SEQ ID NO: 489574 - protein, 9 aa, Influenza virus
VSRIAIGNC

SEQ ID NO: 489575 - protein, 9 aa, Influenza virus
VSRMGVDEY

SEQ ID NO: 489576 - protein, 9 aa, Influenza virus
VSSEAPGWS

SEQ ID NO: 489577 - protein, 9 aa, Influenza virus
VSSEVPGCT

SEQ ID NO: 489578 - protein, 9 aa, Influenza virus
VSSEVPGWS

SEQ ID NO: 489579 - protein, 9 aa, Influenza virus
VSSFEKFEI

SEQ ID NO: 489580 - protein, 9 aa, Influenza virus
VSSFERFEI

SEQ ID NO: 489581 - protein, 9 aa, Influenza virus
VSSFERFEM

SEQ ID NO: 489582 - protein, 9 aa, Influenza virus
VSSFKRFEI

SEQ ID NO: 489583 - protein, 9 aa, Influenza virus
VSSFYSEMK

SEQ ID NO: 489584 - protein, 9 aa, Influenza virus
VSSGLVLVG

SEQ ID NO: 489585 - protein, 9 aa, Influenza virus
VSSLALAIM

SEQ ID NO: 489586 - protein, 9 aa, Influenza virus
VSSLPFQNI

SEQ ID NO: 489587 - protein, 9 aa, Influenza virus
VSSLPFQSI

SEQ ID NO: 489588 - protein, 9 aa, Influenza virus
VSSSGTSKA

SEQ ID NO: 489589 - protein, 9 aa, Influenza virus
VSSSLVLAG

SEQ ID NO: 489590 - protein, 9 aa, Influenza virus
VSSSLVLVG

SEQ ID NO: 489591 - protein, 9 aa, Influenza virus
VSSWHILSK

SEQ ID NO: 489592 - protein, 9 aa, Influenza virus
VSTDKDSNG

SEQ ID NO: 489593 - protein, 9 aa, Influenza virus
VSTDKNSNG

SEQ ID NO: 489594 - protein, 9 aa, Influenza virus
VSTDKSSNG

SEQ ID NO: 489595 - protein, 9 aa, Influenza virus
VSTKEWSKR

SEQ ID NO: 489596 - protein, 9 aa, Influenza virus
VSTKEWSRR

SEQ ID NO: 489597 - protein, 9 aa, Influenza virus
VSTNAYDRI

SEQ ID NO: 489598 - protein, 9 aa, Influenza virus
VSTQKAINE

SEQ ID NO: 489599 - protein, 9 aa, Influenza virus
VSTQKALNE

SEQ ID NO: 489600 - protein, 9 aa, Influenza virus
VSTRSDQIS

SEQ ID NO: 489601 - protein, 9 aa, Influenza virus
VSVGSGSFP

SEQ ID NO: 489602 - protein, 9 aa, Influenza virus
VSVGTSTLN

SEQ ID NO: 489603 - protein, 9 aa, Influenza virus
VSVLNLGQK

SEQ ID NO: 489604 - protein, 9 aa, Influenza virus
VSVTDGPAA

SEQ ID NO: 489605 - protein, 9 aa, Influenza virus
VSWASNSIV

SEQ ID NO: 489606 - protein, 9 aa, Influenza virus
VSWEMGQAP

SEQ ID NO: 489607 - protein, 9 aa, Influenza virus
VSWPLSSPP

SEQ ID NO: 489608 - protein, 9 aa, Influenza virus
VSWSQNILR

SEQ ID NO: 489609 - protein, 9 aa, Influenza virus
VSWTSNSII

SEQ ID NO: 489610 - protein, 9 aa, Influenza virus
VSWTSNSIV

SEQ ID NO: 489611 - protein, 9 aa, Influenza virus
VSWTSNSMV

SEQ ID NO: 489612 - protein, 9 aa, Influenza virus
VTAQELVEA

SEQ ID NO: 489613 - protein, 9 aa, Influenza virus
VTAQELVES

SEQ ID NO: 489614 - protein, 9 aa, Influenza virus
VTASCLDKG

SEQ ID NO: 489615 - protein, 9 aa, Influenza virus
VTASCLDRG

SEQ ID NO: 489616 - protein, 9 aa, Influenza virus
VTASCRDNG

SEQ ID NO: 489617 - protein, 9 aa, Influenza virus
VTCGCRDNW

SEQ ID NO: 489618 - protein, 9 aa, Influenza virus
VTCICRDNW

SEQ ID NO: 489619 - protein, 9 aa, Influenza virus
VTCTCRDNW

SEQ ID NO: 489620 - protein, 9 aa, Influenza virus
VTCVCRDNW

SEQ ID NO: 489621 - protein, 9 aa, Influenza virus
VTDGPAANN

SEQ ID NO: 489622 - protein, 9 aa, Influenza virus
VTDGPAANS

SEQ ID NO: 489623 - protein, 9 aa, Influenza virus
VTDGPSDAQ

SEQ ID NO: 489624 - protein, 9 aa, Influenza virus
VTDGWINSP

SEQ ID NO: 489625 - protein, 9 aa, Influenza virus
VTDIWAYNA

SEQ ID NO: 489626 - protein, 9 aa, Influenza virus
VTDIWSYNA

SEQ ID NO: 489627 - protein, 9 aa, Influenza virus
VTDSEMDKL

SEQ ID NO: 489628 - protein, 9 aa, Influenza virus
VTDSEMNKL

SEQ ID NO: 489629 - protein, 9 aa, Influenza virus
VTDSEMNRL

SEQ ID NO: 489630 - protein, 9 aa, Influenza virus
VTDSIKSWR

SEQ ID NO: 489631 - protein, 9 aa, Influenza virus
VTDVWSYNA

SEQ ID NO: 489632 - protein, 9 aa, Influenza virus
VTDWSGYSG

SEQ ID NO: 489633 - protein, 9 aa, Influenza virus
VTEGWIDSP

SEQ ID NO: 489634 - protein, 9 aa, Influenza virus
VTEGWINSP

SEQ ID NO: 489635 - protein, 9 aa, Influenza virus
VTEINTWAR

SEQ ID NO: 489636 - protein, 9 aa, Influenza virus
VTELWSYNA

SEQ ID NO: 489637 - protein, 9 aa, Influenza virus
VTETLYLNH

SEQ ID NO: 489638 - protein, 9 aa, Influenza virus
VTFCGLDNE

SEQ ID NO: 489639 - protein, 9 aa, Influenza virus
VTFCGLNNE

SEQ ID NO: 489640 - protein, 9 aa, Influenza virus
VTFHGAKEV

SEQ ID NO: 489641 - protein, 9 aa, Influenza virus
VTFIFNGAF

SEQ ID NO: 489642 - protein, 9 aa, Influenza virus
VTFNFNGAF

SEQ ID NO: 489643 - protein, 9 aa, Influenza virus
VTFSFNGAF

SEQ ID NO: 489644 - protein, 9 aa, Influenza virus
VTFTFNGAF

SEQ ID NO: 489645 - protein, 9 aa, Influenza virus
VTGDDKNAT

SEQ ID NO: 489646 - protein, 9 aa, Influenza virus
VTGDDRNAT

SEQ ID NO: 489647 - protein, 9 aa, Influenza virus
VTGFAPFSK

SEQ ID NO: 489648 - protein, 9 aa, Influenza virus
VTGKLNRLI

SEQ ID NO: 489649 - protein, 9 aa, Influenza virus
VTGKSHGRI

SEQ ID NO: 489650 - protein, 9 aa, Influenza virus
VTGLRNIPS

SEQ ID NO: 489651 - protein, 9 aa, Influenza virus
VTGLRNVPA

SEQ ID NO: 489652 - protein, 9 aa, Influenza virus
VTGYEKNAT

SEQ ID NO: 489653 - protein, 9 aa, Influenza virus
VTHAKDILE

SEQ ID NO: 489654 - protein, 9 aa, Influenza virus
VTHAKNILE

SEQ ID NO: 489655 - protein, 9 aa, Influenza virus
VTHAQDILE

SEQ ID NO: 489656 - protein, 9 aa, Influenza virus
VTHAQDLLE

SEQ ID NO: 489657 - protein, 9 aa, Influenza virus
VTHAQNILE

SEQ ID NO: 489658 - protein, 9 aa, Influenza virus
VTHFEKIKI

SEQ ID NO: 489659 - protein, 9 aa, Influenza virus
VTHFEKVKI

SEQ ID NO: 489660 - protein, 9 aa, Influenza virus
VTHFQRKRR

SEQ ID NO: 489661 - protein, 9 aa, Influenza virus
VTHSIELLE

SEQ ID NO: 489662 - protein, 9 aa, Influenza virus
VTHSINLLE

SEQ ID NO: 489663 - protein, 9 aa, Influenza virus
VTHSVELLE

SEQ ID NO: 489664 - protein, 9 aa, Influenza virus
VTHSVNILE

SEQ ID NO: 489665 - protein, 9 aa, Influenza virus
VTHSVNLLE

SEQ ID NO: 489666 - protein, 9 aa, Influenza virus
VTHTGTSKA

SEQ ID NO: 489667 - protein, 9 aa, Influenza virus
VTHVQNNYT

SEQ ID NO: 489668 - protein, 9 aa, Influenza virus
VTIGECPKY

SEQ ID NO: 489669 - protein, 9 aa, Influenza virus
VTIGKCPKY

SEQ ID NO: 489670 - protein, 9 aa, Influenza virus
VTKENTGSY

SEQ ID NO: 489671 - protein, 9 aa, Influenza virus
VTKVYNETV

SEQ ID NO: 489672 - protein, 9 aa, Influenza virus
VTLHFKQHD

SEQ ID NO: 489673 - protein, 9 aa, Influenza virus
VTLHFKQHE

SEQ ID NO: 489674 - protein, 9 aa, Influenza virus
VTLHFKQHK

SEQ ID NO: 489675 - protein, 9 aa, Influenza virus
VTLHFKQNE

SEQ ID NO: 489676 - protein, 9 aa, Influenza virus
VTLSSGYKD

SEQ ID NO: 489677 - protein, 9 aa, Influenza virus
VTLSVVSLL

SEQ ID NO: 489678 - protein, 9 aa, Influenza virus
VTLTMGYKD

SEQ ID NO: 489679 - protein, 9 aa, Influenza virus
VTNATELVQ

SEQ ID NO: 489680 - protein, 9 aa, Influenza virus
VTNATETVE

SEQ ID NO: 489681 - protein, 9 aa, Influenza virus
VTNGTMVKT

SEQ ID NO: 489682 - protein, 9 aa, Influenza virus
VTNKVNSII

SEQ ID NO: 489683 - protein, 9 aa, Influenza virus
VTNVQNDYT

SEQ ID NO: 489684 - protein, 9 aa, Influenza virus
VTNVQNNYT

SEQ ID NO: 489685 - protein, 9 aa, Influenza virus
VTQAMELVE

SEQ ID NO: 489686 - protein, 9 aa, Influenza virus
VTQINNTNI

SEQ ID NO: 489687 - protein, 9 aa, Influenza virus
VTQISNTNI

SEQ ID NO: 489688 - protein, 9 aa, Influenza virus
VTQRTIGKK

SEQ ID NO: 489689 - protein, 9 aa, Influenza virus
VTQRTIGKR

SEQ ID NO: 489690 - protein, 9 aa, Influenza virus
VTQRTVGKK

SEQ ID NO: 489691 - protein, 9 aa, Influenza virus
VTQTLVSNN

SEQ ID NO: 489692 - protein, 9 aa, Influenza virus
VTQTMELVE

SEQ ID NO: 489693 - protein, 9 aa, Influenza virus
VTQVEELVH

SEQ ID NO: 489694 - protein, 9 aa, Influenza virus
VTRELYVSC

SEQ ID NO: 489695 - protein, 9 aa, Influenza virus
VTREPYISC

SEQ ID NO: 489696 - protein, 9 aa, Influenza virus
VTREPYLSC

SEQ ID NO: 489697 - protein, 9 aa, Influenza virus
VTREPYVSC

SEQ ID NO: 489698 - protein, 9 aa, Influenza virus
VTRREIHIY

SEQ ID NO: 489699 - protein, 9 aa, Influenza virus
VTRREVHIY

SEQ ID NO: 489700 - protein, 9 aa, Influenza virus
VTRREVHMY

SEQ ID NO: 489701 - protein, 9 aa, Influenza virus
VTRREVHTY

SEQ ID NO: 489702 - protein, 9 aa, Influenza virus
VTRREVHVY

SEQ ID NO: 489703 - protein, 9 aa, Influenza virus
VTRSGTSKA

SEQ ID NO: 489704 - protein, 9 aa, Influenza virus
VTSSGTSKA

SEQ ID NO: 489705 - protein, 9 aa, Influenza virus
VTSSIDLIE

SEQ ID NO: 489706 - protein, 9 aa, Influenza virus
VTSSIDLVE

SEQ ID NO: 489707 - protein, 9 aa, Influenza virus
VTSSIELVE

SEQ ID NO: 489708 - protein, 9 aa, Influenza virus
VTSSVDLIE

SEQ ID NO: 489709 - protein, 9 aa, Influenza virus
VTSSVDLVE

SEQ ID NO: 489710 - protein, 9 aa, Influenza virus
VTSSVELVE

SEQ ID NO: 489711 - protein, 9 aa, Influenza virus
VTSTIDLIE

SEQ ID NO: 489712 - protein, 9 aa, Influenza virus
VTTHFQRKR

SEQ ID NO: 489713 - protein, 9 aa, Influenza virus
VTTNTINRI

SEQ ID NO: 489714 - protein, 9 aa, Influenza virus
VTTNTINRN

SEQ ID NO: 489715 - protein, 9 aa, Influenza virus
VTTNTINRS

SEQ ID NO: 489716 - protein, 9 aa, Influenza virus
VTTRQASPS

SEQ ID NO: 489717 - protein, 9 aa, Influenza virus
VTTVGWSWP

SEQ ID NO: 489718 - protein, 9 aa, Influenza virus
VTTVTLHFK

SEQ ID NO: 489719 - protein, 9 aa, Influenza virus
VTVIKNNMI

SEQ ID NO: 489720 - protein, 9 aa, Influenza virus
VTVIKNNMV

SEQ ID NO: 489721 - protein, 9 aa, Influenza virus
VTVIRNNMI

SEQ ID NO: 489722 - protein, 9 aa, Influenza virus
VTVSTRSDQ

SEQ ID NO: 489723 - protein, 9 aa, Influenza virus
VTVTDGPAA

SEQ ID NO: 489724 - protein, 9 aa, Influenza virus
VTVTHAEDI

SEQ ID NO: 489725 - protein, 9 aa, Influenza virus
VTVTHAKDI

SEQ ID NO: 489726 - protein, 9 aa, Influenza virus
VTVTHAKNI

SEQ ID NO: 489727 - protein, 9 aa, Influenza virus
VTVTHAQDI

SEQ ID NO: 489728 - protein, 9 aa, Influenza virus
VTVTHAQDL

SEQ ID NO: 489729 - protein, 9 aa, Influenza virus
VTVTHAQNI

SEQ ID NO: 489730 - protein, 9 aa, Influenza virus
VTVTHSIEL

SEQ ID NO: 489731 - protein, 9 aa, Influenza virus
VTVTHSINL

SEQ ID NO: 489732 - protein, 9 aa, Influenza virus
VTVTHSVDL

SEQ ID NO: 489733 - protein, 9 aa, Influenza virus
VTVTHSVEL

SEQ ID NO: 489734 - protein, 9 aa, Influenza virus
VTVTHSVNI

SEQ ID NO: 489735 - protein, 9 aa, Influenza virus
VTVTHSVNL

SEQ ID NO: 489736 - protein, 9 aa, Influenza virus
VTVTSSIEL

SEQ ID NO: 489737 - protein, 9 aa, Influenza virus
VTVTSSVEL

SEQ ID NO: 489738 - protein, 9 aa, Influenza virus
VTWWNRKGP

SEQ ID NO: 489739 - protein, 9 aa, Influenza virus
VTWWNRNGP

SEQ ID NO: 489740 - protein, 9 aa, Influenza virus
VTWWNRSGP

SEQ ID NO: 489741 - protein, 9 aa, Influenza virus
VTYNNTVIN

SEQ ID NO: 489742 - protein, 9 aa, Influenza virus
VTYQILSIY

SEQ ID NO: 489743 - protein, 9 aa, Influenza virus
VTYTGISKA

SEQ ID NO: 489744 - protein, 9 aa, Influenza virus
VTYTGTSKA

SEQ ID NO: 489745 - protein, 9 aa, Influenza virus
VTYTGTSRA

SEQ ID NO: 489746 - protein, 9 aa, Influenza virus
VVAAQELVE

SEQ ID NO: 489747 - protein, 9 aa, Influenza virus
VVAKDNAIR

SEQ ID NO: 489748 - protein, 9 aa, Influenza virus
VVAMVFSQE

SEQ ID NO: 489749 - protein, 9 aa, Influenza virus
VVAVTDGPA

SEQ ID NO: 489750 - protein, 9 aa, Influenza virus
VVCVCRDNW

SEQ ID NO: 489751 - protein, 9 aa, Influenza virus
VVDATETVE

SEQ ID NO: 489752 - protein, 9 aa, Influenza virus
VVENKYVNN

SEQ ID NO: 489753 - protein, 9 aa, Influenza virus
VVENTYVNN

SEQ ID NO: 489754 - protein, 9 aa, Influenza virus
VVFCGTSGI

SEQ ID NO: 489755 - protein, 9 aa, Influenza virus
VVFCGTSGN

SEQ ID NO: 489756 - protein, 9 aa, Influenza virus
VVFCGTSGT

SEQ ID NO: 489757 - protein, 9 aa, Influenza virus
VVFPNEVGA

SEQ ID NO: 489758 - protein, 9 aa, Influenza virus
VVFTDGSAT

SEQ ID NO: 489759 - protein, 9 aa, Influenza virus
VVGARPQVN

SEQ ID NO: 489760 - protein, 9 aa, Influenza virus
VVGDRPLVN

SEQ ID NO: 489761 - protein, 9 aa, Influenza virus
VVGWISGNP

SEQ ID NO: 489762 - protein, 9 aa, Influenza virus
VVHISPLSG

SEQ ID NO: 489763 - protein, 9 aa, Influenza virus
VVIAKDNAI

SEQ ID NO: 489764 - protein, 9 aa, Influenza virus
VVIAKDNAV

SEQ ID NO: 489765 - protein, 9 aa, Influenza virus
VVIAQDNAI

SEQ ID NO: 489766 - protein, 9 aa, Influenza virus
VVIEKDNAV

SEQ ID NO: 489767 - protein, 9 aa, Influenza virus
VVIMTDGPA

SEQ ID NO: 489768 - protein, 9 aa, Influenza virus
VVIMTDGSA

SEQ ID NO: 489769 - protein, 9 aa, Influenza virus
VVKTLTNEH

SEQ ID NO: 489770 - protein, 9 aa, Influenza virus
VVKYNGIIT

SEQ ID NO: 489771 - protein, 9 aa, Influenza virus
VVLNTDWSG

SEQ ID NO: 489772 - protein, 9 aa, Influenza virus
VVLNVSLHL

SEQ ID NO: 489773 - protein, 9 aa, Influenza virus
VVLVGLILA

SEQ ID NO: 489774 - protein, 9 aa, Influenza virus
VVLVMKRKR

SEQ ID NO: 489775 - protein, 9 aa, Influenza virus
VVMGLVFIC

SEQ ID NO: 489776 - protein, 9 aa, Influenza virus
VVMTDGNAS

SEQ ID NO: 489777 - protein, 9 aa, Influenza virus
VVMTDGPAD

SEQ ID NO: 489778 - protein, 9 aa, Influenza virus
VVMTDGPAN

SEQ ID NO: 489779 - protein, 9 aa, Influenza virus
VVMTDGPAS

SEQ ID NO: 489780 - protein, 9 aa, Influenza virus
VVMTDGSAS

SEQ ID NO: 489781 - protein, 9 aa, Influenza virus
VVMTDGSAT

SEQ ID NO: 489782 - protein, 9 aa, Influenza virus
VVMTDGSVS

SEQ ID NO: 489783 - protein, 9 aa, Influenza virus
VVNATETVE

SEQ ID NO: 489784 - protein, 9 aa, Influenza virus
VVNFLSMEF

SEQ ID NO: 489785 - protein, 9 aa, Influenza virus
VVNFVSMEF

SEQ ID NO: 489786 - protein, 9 aa, Influenza virus
VVNIDRFLR

SEQ ID NO: 489787 - protein, 9 aa, Influenza virus
VVNNITTTI

SEQ ID NO: 489788 - protein, 9 aa, Influenza virus
VVNTALSTI

SEQ ID NO: 489789 - protein, 9 aa, Influenza virus
VVNTTLSTI

SEQ ID NO: 489790 - protein, 9 aa, Influenza virus
VVNYVSMEF

SEQ ID NO: 489791 - protein, 9 aa, Influenza virus
VVPEYGFKI

SEQ ID NO: 489792 - protein, 9 aa, Influenza virus
VVPSFDMSN

SEQ ID NO: 489793 - protein, 9 aa, Influenza virus
VVRARPQVN

SEQ ID NO: 489794 - protein, 9 aa, Influenza virus
VVREPFISC

SEQ ID NO: 489795 - protein, 9 aa, Influenza virus
VVRKMMTNS

SEQ ID NO: 489796 - protein, 9 aa, Influenza virus
VVRKMMTSS

SEQ ID NO: 489797 - protein, 9 aa, Influenza virus
VVRSWKKQI

SEQ ID NO: 489798 - protein, 9 aa, Influenza virus
VVRSWRKKI

SEQ ID NO: 489799 - protein, 9 aa, Influenza virus
VVRSWRKQI

SEQ ID NO: 489800 - protein, 9 aa, Influenza virus
VVRSWRRQI

SEQ ID NO: 489801 - protein, 9 aa, Influenza virus
VVSAKELVE

SEQ ID NO: 489802 - protein, 9 aa, Influenza virus
VVSCDSPSN

SEQ ID NO: 489803 - protein, 9 aa, Influenza virus
VVSIDRFLR

SEQ ID NO: 489804 - protein, 9 aa, Influenza virus
VVSLGAISF

SEQ ID NO: 489805 - protein, 9 aa, Influenza virus
VVSSLALAI

SEQ ID NO: 489806 - protein, 9 aa, Influenza virus
VVSSLVLAI

SEQ ID NO: 489807 - protein, 9 aa, Influenza virus
VVTAQELVE

SEQ ID NO: 489808 - protein, 9 aa, Influenza virus
VVTFCGLDN

SEQ ID NO: 489809 - protein, 9 aa, Influenza virus
VVTREPYVS

SEQ ID NO: 489810 - protein, 9 aa, Influenza virus
VVTVTDGPA

SEQ ID NO: 489811 - protein, 9 aa, Influenza virus
VVVAKDNAI

SEQ ID NO: 489812 - protein, 9 aa, Influenza virus
VVVFCGTSG

SEQ ID NO: 489813 - protein, 9 aa, Influenza virus
VVVMTDGPA

SEQ ID NO: 489814 - protein, 9 aa, Influenza virus
VVVMTDGSA

SEQ ID NO: 489815 - protein, 9 aa, Influenza virus
VWACQRGNI

SEQ ID NO: 489816 - protein, 9 aa, Influenza virus
VWAYNAELL

SEQ ID NO: 489817 - protein, 9 aa, Influenza virus
VWDANGWVS

SEQ ID NO: 489818 - protein, 9 aa, Influenza virus
VWDANGWVT

SEQ ID NO: 489819 - protein, 9 aa, Influenza virus
VWGIHHPSS

SEQ ID NO: 489820 - protein, 9 aa, Influenza virus
VWGVHHSSS

SEQ ID NO: 489821 - protein, 9 aa, Influenza virus
VWIGRTKSA

SEQ ID NO: 489822 - protein, 9 aa, Influenza virus
VWIGRTKSI

SEQ ID NO: 489823 - protein, 9 aa, Influenza virus
VWIGRTKSL

SEQ ID NO: 489824 - protein, 9 aa, Influenza virus
VWIGRTKSN

SEQ ID NO: 489825 - protein, 9 aa, Influenza virus
VWIGRTKSP

SEQ ID NO: 489826 - protein, 9 aa, Influenza virus
VWIGRTKST

SEQ ID NO: 489827 - protein, 9 aa, Influenza virus
VWLENEKTL

SEQ ID NO: 489828 - protein, 9 aa, Influenza virus
VWLGRTVSI

SEQ ID NO: 489829 - protein, 9 aa, Influenza virus
VWLGRTVSN

SEQ ID NO: 489830 - protein, 9 aa, Influenza virus
VWLGRTVST

SEQ ID NO: 489831 - protein, 9 aa, Influenza virus
VWLWLVLRE

SEQ ID NO: 489832 - protein, 9 aa, Influenza virus
VWMACHSAA

SEQ ID NO: 489833 - protein, 9 aa, Influenza virus
VWMACNSAA

SEQ ID NO: 489834 - protein, 9 aa, Influenza virus
VWMGRTISK

SEQ ID NO: 489835 - protein, 9 aa, Influenza virus
VWMGRTISM

SEQ ID NO: 489836 - protein, 9 aa, Influenza virus
VWMGRTISR

SEQ ID NO: 489837 - protein, 9 aa, Influenza virus
VWMGRTKSN

SEQ ID NO: 489838 - protein, 9 aa, Influenza virus
VWRQANNGE

SEQ ID NO: 489839 - protein, 9 aa, Influenza virus
VWSSKYQQS

SEQ ID NO: 489840 - protein, 9 aa, Influenza virus
VWSSKYQRS

SEQ ID NO: 489841 - protein, 9 aa, Influenza virus
VWSYNADLL

SEQ ID NO: 489842 - protein, 9 aa, Influenza virus
VWSYNAEFL

SEQ ID NO: 489843 - protein, 9 aa, Influenza virus
VWSYNAELL

SEQ ID NO: 489844 - protein, 9 aa, Influenza virus
VWSYNAKLL

SEQ ID NO: 489845 - protein, 9 aa, Influenza virus
VWTSGSIIS

SEQ ID NO: 489846 - protein, 9 aa, Influenza virus
VWTSGSSIS

SEQ ID NO: 489847 - protein, 9 aa, Influenza virus
VWTYNAELF

SEQ ID NO: 489848 - protein, 9 aa, Influenza virus
VWTYNAELL

SEQ ID NO: 489849 - protein, 9 aa, Influenza virus
VWTYNAEVL

SEQ ID NO: 489850 - protein, 9 aa, Influenza virus
VWTYNTELL

SEQ ID NO: 489851 - protein, 9 aa, Influenza virus
VWTYNVELL

SEQ ID NO: 489852 - protein, 9 aa, Influenza virus
VWVTREPYV

SEQ ID NO: 489853 - protein, 9 aa, Influenza virus
VWWASNSLI

SEQ ID NO: 489854 - protein, 9 aa, Influenza virus
VWWTANSII

SEQ ID NO: 489855 - protein, 9 aa, Influenza virus
VWWTSNSIA

SEQ ID NO: 489856 - protein, 9 aa, Influenza virus
VWWTSNSII

SEQ ID NO: 489857 - protein, 9 aa, Influenza virus
VWWTSNSIV

SEQ ID NO: 489858 - protein, 9 aa, Influenza virus
VWWTSNSLI

SEQ ID NO: 489859 - protein, 9 aa, Influenza virus
VWWTSNSLV

SEQ ID NO: 489860 - protein, 9 aa, Influenza virus
VYCICRDNW

SEQ ID NO: 489861 - protein, 9 aa, Influenza virus
VYCVCRDNW

SEQ ID NO: 489862 - protein, 9 aa, Influenza virus
VYFVEALAR

SEQ ID NO: 489863 - protein, 9 aa, Influenza virus
VYFVEILAR

SEQ ID NO: 489864 - protein, 9 aa, Influenza virus
VYFVETLAK

SEQ ID NO: 489865 - protein, 9 aa, Influenza virus
VYFVETLAR

SEQ ID NO: 489866 - protein, 9 aa, Influenza virus
VYIEVLHLT

SEQ ID NO: 489867 - protein, 9 aa, Influenza virus
VYINTALLN

SEQ ID NO: 489868 - protein, 9 aa, Influenza virus
VYINTAMLN

SEQ ID NO: 489869 - protein, 9 aa, Influenza virus
VYKALSIYS

SEQ ID NO: 489870 - protein, 9 aa, Influenza virus
VYKILSIYS

SEQ ID NO: 489871 - protein, 9 aa, Influenza virus
VYKVLAIYS

SEQ ID NO: 489872 - protein, 9 aa, Influenza virus
VYKVLSIYS

SEQ ID NO: 489873 - protein, 9 aa, Influenza virus
VYMNTALLN

SEQ ID NO: 489874 - protein, 9 aa, Influenza virus
VYNETVRLE

SEQ ID NO: 489875 - protein, 9 aa, Influenza virus
VYNETVRVE

SEQ ID NO: 489876 - protein, 9 aa, Influenza virus
VYNETVRVK

SEQ ID NO: 489877 - protein, 9 aa, Influenza virus
VYNNTTGRD

SEQ ID NO: 489878 - protein, 9 aa, Influenza virus
VYQAKFEAV

SEQ ID NO: 489879 - protein, 9 aa, Influenza virus
VYQAKFESV

SEQ ID NO: 489880 - protein, 9 aa, Influenza virus
VYQARFEAV

SEQ ID NO: 489881 - protein, 9 aa, Influenza virus
VYQARFESV

SEQ ID NO: 489882 - protein, 9 aa, Influenza virus
VYQILAIYA

SEQ ID NO: 489883 - protein, 9 aa, Influenza virus
VYQILAIYS

SEQ ID NO: 489884 - protein, 9 aa, Influenza virus
VYQILSIYS

SEQ ID NO: 489885 - protein, 9 aa, Influenza virus
VYQILVIYA

SEQ ID NO: 489886 - protein, 9 aa, Influenza virus
VYQSRFEAV

SEQ ID NO: 489887 - protein, 9 aa, Influenza virus
VYRALSIYS

SEQ ID NO: 489888 - protein, 9 aa, Influenza virus
VYRDNWKGS

SEQ ID NO: 489889 - protein, 9 aa, Influenza virus
VYSETVRVE

SEQ ID NO: 489890 - protein, 9 aa, Influenza virus
VYSTVASSL

SEQ ID NO: 489891 - protein, 9 aa, Influenza virus
VYVDGFEPN

SEQ ID NO: 489892 - protein, 9 aa, Influenza virus
VYVEVLHLT

SEQ ID NO: 489893 - protein, 9 aa, Influenza virus
VYVNTALLN

SEQ ID NO: 489894 - protein, 9 aa, Influenza virus
VYWTIVKPG

SEQ ID NO: 489895 - protein, 9 aa, Influenza virus
VYWTVVKPG

SEQ ID NO: 489896 - protein, 9 aa, Influenza virus
VYWWDGLQS

SEQ ID NO: 489897 - protein, 9 aa, Influenza virus
VYYDRRLTT

SEQ ID NO: 489898 - protein, 9 aa, Influenza virus
VYYERRLTT

SEQ ID NO: 489899 - protein, 9 aa, Influenza virus
VYYNGRLTT

SEQ ID NO: 489900 - protein, 9 aa, Influenza virus
VYYNKRLTT

SEQ ID NO: 489901 - protein, 9 aa, Influenza virus
VYYNRRLTT

SEQ ID NO: 489902 - protein, 9 aa, Influenza virus
WACGNGSCR

SEQ ID NO: 489903 - protein, 9 aa, Influenza virus
WACNNGSCR

SEQ ID NO: 489904 - protein, 9 aa, Influenza virus
WACNSGNCR

SEQ ID NO: 489905 - protein, 9 aa, Influenza virus
WACQKGNIK

SEQ ID NO: 489906 - protein, 9 aa, Influenza virus
WACQKGNIR

SEQ ID NO: 489907 - protein, 9 aa, Influenza virus
WACQNGNIR

SEQ ID NO: 489908 - protein, 9 aa, Influenza virus
WACQNGNLR

SEQ ID NO: 489909 - protein, 9 aa, Influenza virus
WACQNGNVR

SEQ ID NO: 489910 - protein, 9 aa, Influenza virus
WACQRGNIR

SEQ ID NO: 489911 - protein, 9 aa, Influenza virus
WACSNGNCR

SEQ ID NO: 489912 - protein, 9 aa, Influenza virus
WACSNGSCR

SEQ ID NO: 489913 - protein, 9 aa, Influenza virus
WACSSGNCR

SEQ ID NO: 489914 - protein, 9 aa, Influenza virus
WAEGDCYRA

SEQ ID NO: 489915 - protein, 9 aa, Influenza virus
WAEGECYRA

SEQ ID NO: 489916 - protein, 9 aa, Influenza virus
WAGKILRTQ

SEQ ID NO: 489917 - protein, 9 aa, Influenza virus
WAGNILRTQ

SEQ ID NO: 489918 - protein, 9 aa, Influenza virus
WAIHHPPTS

SEQ ID NO: 489919 - protein, 9 aa, Influenza virus
WAIHHPPTT

SEQ ID NO: 489920 - protein, 9 aa, Influenza virus
WAIHTKDNS

SEQ ID NO: 489921 - protein, 9 aa, Influenza virus
WAILKPGQT

SEQ ID NO: 489922 - protein, 9 aa, Influenza virus
WAIRTRSGG

SEQ ID NO: 489923 - protein, 9 aa, Influenza virus
WAIYSKDNG

SEQ ID NO: 489924 - protein, 9 aa, Influenza virus
WAIYSKDNS

SEQ ID NO: 489925 - protein, 9 aa, Influenza virus
WAIYTKDNS

SEQ ID NO: 489926 - protein, 9 aa, Influenza virus
WAKEECYRA

SEQ ID NO: 489927 - protein, 9 aa, Influenza virus
WAKGDCYRA

SEQ ID NO: 489928 - protein, 9 aa, Influenza virus
WAKGECYRA

SEQ ID NO: 489929 - protein, 9 aa, Influenza virus
WAKNILRTQ

SEQ ID NO: 489930 - protein, 9 aa, Influenza virus
WALGENMAP

SEQ ID NO: 489931 - protein, 9 aa, Influenza virus
WAPLSKDNG

SEQ ID NO: 489932 - protein, 9 aa, Influenza virus
WARNILRTQ

SEQ ID NO: 489933 - protein, 9 aa, Influenza virus
WASGSSISF

SEQ ID NO: 489934 - protein, 9 aa, Influenza virus
WASNSIVTF

SEQ ID NO: 489935 - protein, 9 aa, Influenza virus
WASNSLIAL

SEQ ID NO: 489936 - protein, 9 aa, Influenza virus
WATANSKSQ

SEQ ID NO: 489937 - protein, 9 aa, Influenza virus
WAVGRCPRY

SEQ ID NO: 489938 - protein, 9 aa, Influenza virus
WAVLKPGQT

SEQ ID NO: 489939 - protein, 9 aa, Influenza virus
WAYNAELIV

SEQ ID NO: 489940 - protein, 9 aa, Influenza virus
WAYNAELLV

SEQ ID NO: 489941 - protein, 9 aa, Influenza virus
WCGMIDGWY

SEQ ID NO: 489942 - protein, 9 aa, Influenza virus
WCKIVTTVG

SEQ ID NO: 489943 - protein, 9 aa, Influenza virus
WDANGWVST

SEQ ID NO: 489944 - protein, 9 aa, Influenza virus
WDDGAILPF

SEQ ID NO: 489945 - protein, 9 aa, Influenza virus
WDDGAILPL

SEQ ID NO: 489946 - protein, 9 aa, Influenza virus
WDDNGWVST

SEQ ID NO: 489947 - protein, 9 aa, Influenza virus
WDGLQSSDD

SEQ ID NO: 489948 - protein, 9 aa, Influenza virus
WDILRTQES

SEQ ID NO: 489949 - protein, 9 aa, Influenza virus
WDSFRQSER

SEQ ID NO: 489950 - protein, 9 aa, Influenza virus
WDTINFEST

SEQ ID NO: 489951 - protein, 9 aa, Influenza virus
WDTISFEST

SEQ ID NO: 489952 - protein, 9 aa, Influenza virus
WDTLIERDN

SEQ ID NO: 489953 - protein, 9 aa, Influenza virus
WDTLIEREN

SEQ ID NO: 489954 - protein, 9 aa, Influenza virus
WDTLIERGS

SEQ ID NO: 489955 - protein, 9 aa, Influenza virus
WDVFIERPT

SEQ ID NO: 489956 - protein, 9 aa, Influenza virus
WDVINFEST

SEQ ID NO: 489957 - protein, 9 aa, Influenza virus
WDVISFEST

SEQ ID NO: 489958 - protein, 9 aa, Influenza virus
WDWPDGAKI

SEQ ID NO: 489959 - protein, 9 aa, Influenza virus
WEGLIDGWY

SEQ ID NO: 489960 - protein, 9 aa, Influenza virus
WEGLINGWY

SEQ ID NO: 489961 - protein, 9 aa, Influenza virus
WEGLVDGWY

SEQ ID NO: 489962 - protein, 9 aa, Influenza virus
WEGMIDGWY

SEQ ID NO: 489963 - protein, 9 aa, Influenza virus
WEGMMDGWY

SEQ ID NO: 489964 - protein, 9 aa, Influenza virus
WEGMVDGWY

SEQ ID NO: 489965 - protein, 9 aa, Influenza virus
WEGMVNGWY

SEQ ID NO: 489966 - protein, 9 aa, Influenza virus
WEGNILRTQ

SEQ ID NO: 489967 - protein, 9 aa, Influenza virus
WEINGPDSV

SEQ ID NO: 489968 - protein, 9 aa, Influenza virus
WEINGPESV

SEQ ID NO: 489969 - protein, 9 aa, Influenza virus
WEKNCTLID

SEQ ID NO: 489970 - protein, 9 aa, Influenza virus
WEMGLAPSP

SEQ ID NO: 489971 - protein, 9 aa, Influenza virus
WEMGQAPSP

SEQ ID NO: 489972 - protein, 9 aa, Influenza virus
WEQLYTPGG

SEQ ID NO: 489973 - protein, 9 aa, Influenza virus
WEQMYTPGG

SEQ ID NO: 489974 - protein, 9 aa, Influenza virus
WETTGRNCT

SEQ ID NO: 489975 - protein, 9 aa, Influenza virus
WEVNGPESV

SEQ ID NO: 489976 - protein, 9 aa, Influenza virus
WFGYFGIFF

SEQ ID NO: 489977 - protein, 9 aa, Influenza virus
WFRNILSIA

SEQ ID NO: 489978 - protein, 9 aa, Influenza virus
WFRNILSMA

SEQ ID NO: 489979 - protein, 9 aa, Influenza virus
WFRNVLSIA

SEQ ID NO: 489980 - protein, 9 aa, Influenza virus
WFRNVLSVA

SEQ ID NO: 489981 - protein, 9 aa, Influenza virus
WFSFGASCF

SEQ ID NO: 489982 - protein, 9 aa, Influenza virus
WFSFGASCV

SEQ ID NO: 489983 - protein, 9 aa, Influenza virus
WFSFGASSF

SEQ ID NO: 489984 - protein, 9 aa, Influenza virus
WFSHYNQMK

SEQ ID NO: 489985 - protein, 9 aa, Influenza virus
WFSHYNQMT

SEQ ID NO: 489986 - protein, 9 aa, Influenza virus
WFSHYNQVA

SEQ ID NO: 489987 - protein, 9 aa, Influenza virus
WFSHYNQVT

SEQ ID NO: 489988 - protein, 9 aa, Influenza virus
WFSLGASCF

SEQ ID NO: 489989 - protein, 9 aa, Influenza virus
WGDILDGVT

SEQ ID NO: 489990 - protein, 9 aa, Influenza virus
WGDILEGTT

SEQ ID NO: 489991 - protein, 9 aa, Influenza virus
WGDVLDGVT

SEQ ID NO: 489992 - protein, 9 aa, Influenza virus
WGIHHPDSE

SEQ ID NO: 489993 - protein, 9 aa, Influenza virus
WGIHHPDTE

SEQ ID NO: 489994 - protein, 9 aa, Influenza virus
WGIHHPNDD

SEQ ID NO: 489995 - protein, 9 aa, Influenza virus
WGIHHPNDE

SEQ ID NO: 489996 - protein, 9 aa, Influenza virus
WGIHHPPDA

SEQ ID NO: 489997 - protein, 9 aa, Influenza virus
WGIHHPPDE

SEQ ID NO: 489998 - protein, 9 aa, Influenza virus
WGIHHPPDT

SEQ ID NO: 489999 - protein, 9 aa, Influenza virus
WGIHHPPNT

SEQ ID NO: 490000 - protein, 9 aa, Influenza virus
WGIHHPSNT

SEQ ID NO: 490001 - protein, 9 aa, Influenza virus
WGIHHPSSA

SEQ ID NO: 490002 - protein, 9 aa, Influenza virus
WGIHHPSSI

SEQ ID NO: 490003 - protein, 9 aa, Influenza virus
WGIHHPSST

SEQ ID NO: 490004 - protein, 9 aa, Influenza virus
WGILKRGET

SEQ ID NO: 490005 - protein, 9 aa, Influenza virus
WGMELRRCL

SEQ ID NO: 490006 - protein, 9 aa, Influenza virus
WGMEMRRCL

SEQ ID NO: 490007 - protein, 9 aa, Influenza virus
WGMGQAPSP

SEQ ID NO: 490008 - protein, 9 aa, Influenza virus
WGNGCFEFY

SEQ ID NO: 490009 - protein, 9 aa, Influenza virus
WGNVLDGVT

SEQ ID NO: 490010 - protein, 9 aa, Influenza virus
WGVHHPIDE

SEQ ID NO: 490011 - protein, 9 aa, Influenza virus
WGVHHPKDE

SEQ ID NO: 490012 - protein, 9 aa, Influenza virus
WGVHHPNDE

SEQ ID NO: 490013 - protein, 9 aa, Influenza virus
WGVHHPSSD

SEQ ID NO: 490014 - protein, 9 aa, Influenza virus
WGVHHPSTD

SEQ ID NO: 490015 - protein, 9 aa, Influenza virus
WGVHHSSSL

SEQ ID NO: 490016 - protein, 9 aa, Influenza virus
WHASNRPWI

SEQ ID NO: 490017 - protein, 9 aa, Influenza virus
WHASNRPWV

SEQ ID NO: 490018 - protein, 9 aa, Influenza virus
WHDGAEIIY

SEQ ID NO: 490019 - protein, 9 aa, Influenza virus
WHDGAEITY

SEQ ID NO: 490020 - protein, 9 aa, Influenza virus
WHDGAILPF

SEQ ID NO: 490021 - protein, 9 aa, Influenza virus
WHDGAILPL

SEQ ID NO: 490022 - protein, 9 aa, Influenza virus
WHDGAVLPF

SEQ ID NO: 490023 - protein, 9 aa, Influenza virus
WHGSNRPWI

SEQ ID NO: 490024 - protein, 9 aa, Influenza virus
WHGSNRPWL

SEQ ID NO: 490025 - protein, 9 aa, Influenza virus
WHGSNRPWV

SEQ ID NO: 490026 - protein, 9 aa, Influenza virus
WHIFGKDNA

SEQ ID NO: 490027 - protein, 9 aa, Influenza virus
WHIFSKDNA

SEQ ID NO: 490028 - protein, 9 aa, Influenza virus
WHILSKDNA

SEQ ID NO: 490029 - protein, 9 aa, Influenza virus
WHIYGKDNA

SEQ ID NO: 490030 - protein, 9 aa, Influenza virus
WHLMHPGER

SEQ ID NO: 490031 - protein, 9 aa, Influenza virus
WHLMRPGER

SEQ ID NO: 490032 - protein, 9 aa, Influenza virus
WHLMSPGER

SEQ ID NO: 490033 - protein, 9 aa, Influenza virus
WHSNLNDAT

SEQ ID NO: 490034 - protein, 9 aa, Influenza virus
WHSNLNDTT

SEQ ID NO: 490035 - protein, 9 aa, Influenza virus
WHVRKRFAD

SEQ ID NO: 490036 - protein, 9 aa, Influenza virus
WICMGHHAV

SEQ ID NO: 490037 - protein, 9 aa, Influenza virus
WIDSPNHAK

SEQ ID NO: 490038 - protein, 9 aa, Influenza virus
WIELDEIGE

SEQ ID NO: 490039 - protein, 9 aa, Influenza virus
WIELIRGRP

SEQ ID NO: 490040 - protein, 9 aa, Influenza virus
WIGECPKYV

SEQ ID NO: 490041 - protein, 9 aa, Influenza virus
WIGGCPKYV

SEQ ID NO: 490042 - protein, 9 aa, Influenza virus
WIGKCPKYV

SEQ ID NO: 490043 - protein, 9 aa, Influenza virus
WIGRTKSLE

SEQ ID NO: 490044 - protein, 9 aa, Influenza virus
WIKTRPILS

SEQ ID NO: 490045 - protein, 9 aa, Influenza virus
WILGNPKCD

SEQ ID NO: 490046 - protein, 9 aa, Influenza virus
WILGNPMCD

SEQ ID NO: 490047 - protein, 9 aa, Influenza virus
WILGNPQCD

SEQ ID NO: 490048 - protein, 9 aa, Influenza virus
WILGNPRCD

SEQ ID NO: 490049 - protein, 9 aa, Influenza virus
WILGNPRCG

SEQ ID NO: 490050 - protein, 9 aa, Influenza virus
WILWISFAI

SEQ ID NO: 490051 - protein, 9 aa, Influenza virus
WILWISFAM

SEQ ID NO: 490052 - protein, 9 aa, Influenza virus
WILWISFAT

SEQ ID NO: 490053 - protein, 9 aa, Influenza virus
WINSPNHAK

SEQ ID NO: 490054 - protein, 9 aa, Influenza virus
WINSPNHVK

SEQ ID NO: 490055 - protein, 9 aa, Influenza virus
WINSPSQAK

SEQ ID NO: 490056 - protein, 9 aa, Influenza virus
WIPKRNRSI

SEQ ID NO: 490057 - protein, 9 aa, Influenza virus
WIQNEFNKA

SEQ ID NO: 490058 - protein, 9 aa, Influenza virus
WIQSEFNKA

SEQ ID NO: 490059 - protein, 9 aa, Influenza virus
WIRFNSDLD

SEQ ID NO: 490060 - protein, 9 aa, Influenza virus
WIRFNSDPD

SEQ ID NO: 490061 - protein, 9 aa, Influenza virus
WIRFNSNLD

SEQ ID NO: 490062 - protein, 9 aa, Influenza virus
WIRINNETI

SEQ ID NO: 490063 - protein, 9 aa, Influenza virus
WISFAISCF

SEQ ID NO: 490064 - protein, 9 aa, Influenza virus
WISFAMSCF

SEQ ID NO: 490065 - protein, 9 aa, Influenza virus
WISFATSCF

SEQ ID NO: 490066 - protein, 9 aa, Influenza virus
WISFSISCF

SEQ ID NO: 490067 - protein, 9 aa, Influenza virus
WISFSMSCF

SEQ ID NO: 490068 - protein, 9 aa, Influenza virus
WITIGISGP

SEQ ID NO: 490069 - protein, 9 aa, Influenza virus
WITREPYVS

SEQ ID NO: 490070 - protein, 9 aa, Influenza virus
WIVGNPSCA

SEQ ID NO: 490071 - protein, 9 aa, Influenza virus
WKGANRPII

SEQ ID NO: 490072 - protein, 9 aa, Influenza virus
WKGANRPVI

SEQ ID NO: 490073 - protein, 9 aa, Influenza virus
WKGGSIKTK

SEQ ID NO: 490074 - protein, 9 aa, Influenza virus
WKGGSINTK

SEQ ID NO: 490075 - protein, 9 aa, Influenza virus
WKGNIMRTQ

SEQ ID NO: 490076 - protein, 9 aa, Influenza virus
WKGSNRPII

SEQ ID NO: 490077 - protein, 9 aa, Influenza virus
WKGSNRPIV

SEQ ID NO: 490078 - protein, 9 aa, Influenza virus
WKGSNRPVI

SEQ ID NO: 490079 - protein, 9 aa, Influenza virus
WKGSNRPVV

SEQ ID NO: 490080 - protein, 9 aa, Influenza virus
WKGSNRPWI

SEQ ID NO: 490081 - protein, 9 aa, Influenza virus
WKGSNRPWM

SEQ ID NO: 490082 - protein, 9 aa, Influenza virus
WKGSNRPWV

SEQ ID NO: 490083 - protein, 9 aa, Influenza virus
WKHVTNTIL

SEQ ID NO: 490084 - protein, 9 aa, Influenza virus
WKKQILRTQ

SEQ ID NO: 490085 - protein, 9 aa, Influenza virus
WLELDEIGE

SEQ ID NO: 490086 - protein, 9 aa, Influenza virus
WLEMIRGKP

SEQ ID NO: 490087 - protein, 9 aa, Influenza virus
WLEMIRGRP

SEQ ID NO: 490088 - protein, 9 aa, Influenza virus
WLENEKTLD

SEQ ID NO: 490089 - protein, 9 aa, Influenza virus
WLGGTISPR

SEQ ID NO: 490090 - protein, 9 aa, Influenza virus
WLGRTFSPR

SEQ ID NO: 490091 - protein, 9 aa, Influenza virus
WLGRTISIA

SEQ ID NO: 490092 - protein, 9 aa, Influenza virus
WLGRTISKD

SEQ ID NO: 490093 - protein, 9 aa, Influenza virus
WLGRTISPK

SEQ ID NO: 490094 - protein, 9 aa, Influenza virus
WLGRTISPR

SEQ ID NO: 490095 - protein, 9 aa, Influenza virus
WLGRTISTA

SEQ ID NO: 490096 - protein, 9 aa, Influenza virus
WLGRTISTR

SEQ ID NO: 490097 - protein, 9 aa, Influenza virus
WLGRTLNTA

SEQ ID NO: 490098 - protein, 9 aa, Influenza virus
WLGRTTSKD

SEQ ID NO: 490099 - protein, 9 aa, Influenza virus
WLGRTTSTA

SEQ ID NO: 490100 - protein, 9 aa, Influenza virus
WLGRTVSIN

SEQ ID NO: 490101 - protein, 9 aa, Influenza virus
WLGRTVSIS

SEQ ID NO: 490102 - protein, 9 aa, Influenza virus
WLGRTVSNS

SEQ ID NO: 490103 - protein, 9 aa, Influenza virus
WLGRTVSTS

SEQ ID NO: 490104 - protein, 9 aa, Influenza virus
WLHICVTGD

SEQ ID NO: 490105 - protein, 9 aa, Influenza virus
WLHVCITGD

SEQ ID NO: 490106 - protein, 9 aa, Influenza virus
WLHVCVTGD

SEQ ID NO: 490107 - protein, 9 aa, Influenza virus
WLIDQSGTY

SEQ ID NO: 490108 - protein, 9 aa, Influenza virus
WLIHQSETY

SEQ ID NO: 490109 - protein, 9 aa, Influenza virus
WLIHQSGTY

SEQ ID NO: 490110 - protein, 9 aa, Influenza virus
WLILNPNDT

SEQ ID NO: 490111 - protein, 9 aa, Influenza virus
WLISKSKEQ

SEQ ID NO: 490112 - protein, 9 aa, Influenza virus
WLIYQSGTY

SEQ ID NO: 490113 - protein, 9 aa, Influenza virus
WLKPQCQIT

SEQ ID NO: 490114 - protein, 9 aa, Influenza virus
WLKTRPILS

SEQ ID NO: 490115 - protein, 9 aa, Influenza virus
WLLGNPECD

SEQ ID NO: 490116 - protein, 9 aa, Influenza virus
WLLGNPKCD

SEQ ID NO: 490117 - protein, 9 aa, Influenza virus
WLLGNPLCD

SEQ ID NO: 490118 - protein, 9 aa, Influenza virus
WLLGNPMCD

SEQ ID NO: 490119 - protein, 9 aa, Influenza virus
WLLLDPNDT

SEQ ID NO: 490120 - protein, 9 aa, Influenza virus
WLLSSKANQ

SEQ ID NO: 490121 - protein, 9 aa, Influenza virus
WLLSSKDNQ

SEQ ID NO: 490122 - protein, 9 aa, Influenza virus
WLMLNPNDT

SEQ ID NO: 490123 - protein, 9 aa, Influenza virus
WLMLNPNGT

SEQ ID NO: 490124 - protein, 9 aa, Influenza virus
WLMLNSNDT

SEQ ID NO: 490125 - protein, 9 aa, Influenza virus
WLSSSGNNQ

SEQ ID NO: 490126 - protein, 9 aa, Influenza virus
WLSSSMNNQ

SEQ ID NO: 490127 - protein, 9 aa, Influenza virus
WLTIGISGP

SEQ ID NO: 490128 - protein, 9 aa, Influenza virus
WLTIGITGP

SEQ ID NO: 490129 - protein, 9 aa, Influenza virus
WLTIGVSGP

SEQ ID NO: 490130 - protein, 9 aa, Influenza virus
WLTKATNGN

SEQ ID NO: 490131 - protein, 9 aa, Influenza virus
WLTKETNGN

SEQ ID NO: 490132 - protein, 9 aa, Influenza virus
WLTKKEPDT

SEQ ID NO: 490133 - protein, 9 aa, Influenza virus
WLTKKKNPE

SEQ ID NO: 490134 - protein, 9 aa, Influenza virus
WLTKKKPDI

SEQ ID NO: 490135 - protein, 9 aa, Influenza virus
WLTKKKPDT

SEQ ID NO: 490136 - protein, 9 aa, Influenza virus
WLTLGITGP

SEQ ID NO: 490137 - protein, 9 aa, Influenza virus
WLTLKLGQF

SEQ ID NO: 490138 - protein, 9 aa, Influenza virus
WLTLKSEQF

SEQ ID NO: 490139 - protein, 9 aa, Influenza virus
WLTLKSGQF

SEQ ID NO: 490140 - protein, 9 aa, Influenza virus
WLVHQSGTY

SEQ ID NO: 490141 - protein, 9 aa, Influenza virus
WLVLREKMP

SEQ ID NO: 490142 - protein, 9 aa, Influenza virus
WLVSKDKGR

SEQ ID NO: 490143 - protein, 9 aa, Influenza virus
WLVSKNKGQ

SEQ ID NO: 490144 - protein, 9 aa, Influenza virus
WLVSKSKGQ

SEQ ID NO: 490145 - protein, 9 aa, Influenza virus
WLVSKTKGQ

SEQ ID NO: 490146 - protein, 9 aa, Influenza virus
WLWLVLREK

SEQ ID NO: 490147 - protein, 9 aa, Influenza virus
WMACHSAAF

SEQ ID NO: 490148 - protein, 9 aa, Influenza virus
WMACNSAAF

SEQ ID NO: 490149 - protein, 9 aa, Influenza virus
WMCFNGSLQ

SEQ ID NO: 490150 - protein, 9 aa, Influenza virus
WMCLNGSMQ

SEQ ID NO: 490151 - protein, 9 aa, Influenza virus
WMCPNGSLQ

SEQ ID NO: 490152 - protein, 9 aa, Influenza virus
WMCSNGALQ

SEQ ID NO: 490153 - protein, 9 aa, Influenza virus
WMCSNGSLQ

SEQ ID NO: 490154 - protein, 9 aa, Influenza virus
WMCSNGSLR

SEQ ID NO: 490155 - protein, 9 aa, Influenza virus
WMCSNGSMP

SEQ ID NO: 490156 - protein, 9 aa, Influenza virus
WMCSNGSMQ

SEQ ID NO: 490157 - protein, 9 aa, Influenza virus
WMCSNGSYN

SEQ ID NO: 490158 - protein, 9 aa, Influenza virus
WMCSNSSMQ

SEQ ID NO: 490159 - protein, 9 aa, Influenza virus
WMDYYWGIL

SEQ ID NO: 490160 - protein, 9 aa, Influenza virus
WMELDEIGE

SEQ ID NO: 490161 - protein, 9 aa, Influenza virus
WMGRTISKD

SEQ ID NO: 490162 - protein, 9 aa, Influenza virus
WMGRTISMD

SEQ ID NO: 490163 - protein, 9 aa, Influenza virus
WMGRTISRD

SEQ ID NO: 490164 - protein, 9 aa, Influenza virus
WMKIIRVGC

SEQ ID NO: 490165 - protein, 9 aa, Influenza virus
WMKIYWHLM

SEQ ID NO: 490166 - protein, 9 aa, Influenza virus
WMKLYWHLM

SEQ ID NO: 490167 - protein, 9 aa, Influenza virus
WMLLDPGDT

SEQ ID NO: 490168 - protein, 9 aa, Influenza virus
WMMAMKYPI

SEQ ID NO: 490169 - protein, 9 aa, Influenza virus
WMMAMRYPI

SEQ ID NO: 490170 - protein, 9 aa, Influenza virus
WMRINNETI

SEQ ID NO: 490171 - protein, 9 aa, Influenza virus
WMRISNETI

SEQ ID NO: 490172 - protein, 9 aa, Influenza virus
WNENQNPRI

SEQ ID NO: 490173 - protein, 9 aa, Influenza virus
WNENQNPRM

SEQ ID NO: 490174 - protein, 9 aa, Influenza virus
WNENQNPRV

SEQ ID NO: 490175 - protein, 9 aa, Influenza virus
WNGECPKYV

SEQ ID NO: 490176 - protein, 9 aa, Influenza virus
WNGMNRPIL

SEQ ID NO: 490177 - protein, 9 aa, Influenza virus
WNGMNRPVL

SEQ ID NO: 490178 - protein, 9 aa, Influenza virus
WNGVKVDGS

SEQ ID NO: 490179 - protein, 9 aa, Influenza virus
WNLALDIVD

SEQ ID NO: 490180 - protein, 9 aa, Influenza virus
WNVSSSGTS

SEQ ID NO: 490181 - protein, 9 aa, Influenza virus
WNVTHTGTS

SEQ ID NO: 490182 - protein, 9 aa, Influenza virus
WNVTRSGTS

SEQ ID NO: 490183 - protein, 9 aa, Influenza virus
WNVTSSGTS

SEQ ID NO: 490184 - protein, 9 aa, Influenza virus
WNVTYTGIS

SEQ ID NO: 490185 - protein, 9 aa, Influenza virus
WNVTYTGTS

SEQ ID NO: 490186 - protein, 9 aa, Influenza virus
WNWPDGAEI

SEQ ID NO: 490187 - protein, 9 aa, Influenza virus
WNWPDGAKI

SEQ ID NO: 490188 - protein, 9 aa, Influenza virus
WPDDAELPF

SEQ ID NO: 490189 - protein, 9 aa, Influenza virus
WPDDAELPL

SEQ ID NO: 490190 - protein, 9 aa, Influenza virus
WPDGADINF

SEQ ID NO: 490191 - protein, 9 aa, Influenza virus
WPDGADLPF

SEQ ID NO: 490192 - protein, 9 aa, Influenza virus
WPDGAEIEY

SEQ ID NO: 490193 - protein, 9 aa, Influenza virus
WPDGAELPF

SEQ ID NO: 490194 - protein, 9 aa, Influenza virus
WPDGAELPS

SEQ ID NO: 490195 - protein, 9 aa, Influenza virus
WPDGAEVPF

SEQ ID NO: 490196 - protein, 9 aa, Influenza virus
WPDGAKIET

SEQ ID NO: 490197 - protein, 9 aa, Influenza virus
WPDGAKIEY

SEQ ID NO: 490198 - protein, 9 aa, Influenza virus
WPDGAKLPF

SEQ ID NO: 490199 - protein, 9 aa, Influenza virus
WPDGALLPF

SEQ ID NO: 490200 - protein, 9 aa, Influenza virus
WPDGALLPL

SEQ ID NO: 490201 - protein, 9 aa, Influenza virus
WPDGANIDF

SEQ ID NO: 490202 - protein, 9 aa, Influenza virus
WPDGANIGF

SEQ ID NO: 490203 - protein, 9 aa, Influenza virus
WPDGANINF

SEQ ID NO: 490204 - protein, 9 aa, Influenza virus
WPDGANINL

SEQ ID NO: 490205 - protein, 9 aa, Influenza virus
WPDGANISF

SEQ ID NO: 490206 - protein, 9 aa, Influenza virus
WPDGANTNF

SEQ ID NO: 490207 - protein, 9 aa, Influenza virus
WPDGSDIGF

SEQ ID NO: 490208 - protein, 9 aa, Influenza virus
WPDGSNIGF

SEQ ID NO: 490209 - protein, 9 aa, Influenza virus
WPDGYNIGF

SEQ ID NO: 490210 - protein, 9 aa, Influenza virus
WPDRAELPF

SEQ ID NO: 490211 - protein, 9 aa, Influenza virus
WPGLINGWY

SEQ ID NO: 490212 - protein, 9 aa, Influenza virus
WPGLVAGWY

SEQ ID NO: 490213 - protein, 9 aa, Influenza virus
WPIGESPEG

SEQ ID NO: 490214 - protein, 9 aa, Influenza virus
WPIGESPKG

SEQ ID NO: 490215 - protein, 9 aa, Influenza virus
WPIGESPKR

SEQ ID NO: 490216 - protein, 9 aa, Influenza virus
WPIGESPRG

SEQ ID NO: 490217 - protein, 9 aa, Influenza virus
WPLSSPPTV

SEQ ID NO: 490218 - protein, 9 aa, Influenza virus
WPQSSPPTV

SEQ ID NO: 490219 - protein, 9 aa, Influenza virus
WPVGESPKG

SEQ ID NO: 490220 - protein, 9 aa, Influenza virus
WPWPDGALL

SEQ ID NO: 490221 - protein, 9 aa, Influenza virus
WQGANRPII

SEQ ID NO: 490222 - protein, 9 aa, Influenza virus
WQGANRPVI

SEQ ID NO: 490223 - protein, 9 aa, Influenza virus
WQGLIDGWY

SEQ ID NO: 490224 - protein, 9 aa, Influenza virus
WQGLVDGWY

SEQ ID NO: 490225 - protein, 9 aa, Influenza virus
WQGMIDGWY

SEQ ID NO: 490226 - protein, 9 aa, Influenza virus
WQGMVDGWY

SEQ ID NO: 490227 - protein, 9 aa, Influenza virus
WQGSNRPVI

SEQ ID NO: 490228 - protein, 9 aa, Influenza virus
WREQLSQKF

SEQ ID NO: 490229 - protein, 9 aa, Influenza virus
WRGANRPVI

SEQ ID NO: 490230 - protein, 9 aa, Influenza virus
WRGDNGRRT

SEQ ID NO: 490231 - protein, 9 aa, Influenza virus
WRGENGRKT

SEQ ID NO: 490232 - protein, 9 aa, Influenza virus
WRGENGRRT

SEQ ID NO: 490233 - protein, 9 aa, Influenza virus
WRGGSINTK

SEQ ID NO: 490234 - protein, 9 aa, Influenza virus
WRGGSINTR

SEQ ID NO: 490235 - protein, 9 aa, Influenza virus
WRGSNRPIV

SEQ ID NO: 490236 - protein, 9 aa, Influenza virus
WRGSNRPWI

SEQ ID NO: 490237 - protein, 9 aa, Influenza virus
WRGSNRPWV

SEQ ID NO: 490238 - protein, 9 aa, Influenza virus
WRKDILRTQ

SEQ ID NO: 490239 - protein, 9 aa, Influenza virus
WRKKILRTQ

SEQ ID NO: 490240 - protein, 9 aa, Influenza virus
WRKQILRTQ

SEQ ID NO: 490241 - protein, 9 aa, Influenza virus
WRQANNGDD

SEQ ID NO: 490242 - protein, 9 aa, Influenza virus
WRQANNGED

SEQ ID NO: 490243 - protein, 9 aa, Influenza virus
WRQANNGEE

SEQ ID NO: 490244 - protein, 9 aa, Influenza virus
WRRDILRTQ

SEQ ID NO: 490245 - protein, 9 aa, Influenza virus
WRRQILRTQ

SEQ ID NO: 490246 - protein, 9 aa, Influenza virus
WSASACHDG

SEQ ID NO: 490247 - protein, 9 aa, Influenza virus
WSATACHDG

SEQ ID NO: 490248 - protein, 9 aa, Influenza virus
WSATACSDG

SEQ ID NO: 490249 - protein, 9 aa, Influenza virus
WSFALAQGA

SEQ ID NO: 490250 - protein, 9 aa, Influenza virus
WSFALAQGT

SEQ ID NO: 490251 - protein, 9 aa, Influenza virus
WSFALAQGV

SEQ ID NO: 490252 - protein, 9 aa, Influenza virus
WSFALSQGA

SEQ ID NO: 490253 - protein, 9 aa, Influenza virus
WSGLIAGWY

SEQ ID NO: 490254 - protein, 9 aa, Influenza virus
WSGLVAGWY

SEQ ID NO: 490255 - protein, 9 aa, Influenza virus
WSGMIDGWY

SEQ ID NO: 490256 - protein, 9 aa, Influenza virus
WSGYSGAFI

SEQ ID NO: 490257 - protein, 9 aa, Influenza virus
WSGYSGAFM

SEQ ID NO: 490258 - protein, 9 aa, Influenza virus
WSGYSGAFT

SEQ ID NO: 490259 - protein, 9 aa, Influenza virus
WSGYSGAFV

SEQ ID NO: 490260 - protein, 9 aa, Influenza virus
WSGYSGIFS

SEQ ID NO: 490261 - protein, 9 aa, Influenza virus
WSGYSGSFI

SEQ ID NO: 490262 - protein, 9 aa, Influenza virus
WSGYSGSFM

SEQ ID NO: 490263 - protein, 9 aa, Influenza virus
WSGYSGSFS

SEQ ID NO: 490264 - protein, 9 aa, Influenza virus
WSGYSGSFT

SEQ ID NO: 490265 - protein, 9 aa, Influenza virus
WSGYSGSFV

SEQ ID NO: 490266 - protein, 9 aa, Influenza virus
WSGYSGVFS

SEQ ID NO: 490267 - protein, 9 aa, Influenza virus
WSHNILRTQ

SEQ ID NO: 490268 - protein, 9 aa, Influenza virus
WSILKPGET

SEQ ID NO: 490269 - protein, 9 aa, Influenza virus
WSKNILRTQ

SEQ ID NO: 490270 - protein, 9 aa, Influenza virus
WSKPQCHIT

SEQ ID NO: 490271 - protein, 9 aa, Influenza virus
WSKPQCKIT

SEQ ID NO: 490272 - protein, 9 aa, Influenza virus
WSKPQCLIT

SEQ ID NO: 490273 - protein, 9 aa, Influenza virus
WSKPQCQIA

SEQ ID NO: 490274 - protein, 9 aa, Influenza virus
WSKPQCQII

SEQ ID NO: 490275 - protein, 9 aa, Influenza virus
WSKPQCQIR

SEQ ID NO: 490276 - protein, 9 aa, Influenza virus
WSKPQCQIS

SEQ ID NO: 490277 - protein, 9 aa, Influenza virus
WSKPQCQIT

SEQ ID NO: 490278 - protein, 9 aa, Influenza virus
WSKPQCRIT

SEQ ID NO: 490279 - protein, 9 aa, Influenza virus
WSKRYELEI

SEQ ID NO: 490280 - protein, 9 aa, Influenza virus
WSKTQCQIT

SEQ ID NO: 490281 - protein, 9 aa, Influenza virus
WSLQCRICI

SEQ ID NO: 490282 - protein, 9 aa, Influenza virus
WSMLKPGET

SEQ ID NO: 490283 - protein, 9 aa, Influenza virus
WSQNILRTQ

SEQ ID NO: 490284 - protein, 9 aa, Influenza virus
WSRRYELEI

SEQ ID NO: 490285 - protein, 9 aa, Influenza virus
WSSASCHDG

SEQ ID NO: 490286 - protein, 9 aa, Influenza virus
WSSSSCFDG

SEQ ID NO: 490287 - protein, 9 aa, Influenza virus
WSSSSCHDG

SEQ ID NO: 490288 - protein, 9 aa, Influenza virus
WSSSSCYDG

SEQ ID NO: 490289 - protein, 9 aa, Influenza virus
WSSTSCFDG

SEQ ID NO: 490290 - protein, 9 aa, Influenza virus
WSSTSCHDG

SEQ ID NO: 490291 - protein, 9 aa, Influenza virus
WSSTTCHDG

SEQ ID NO: 490292 - protein, 9 aa, Influenza virus
WSVLKPGET

SEQ ID NO: 490293 - protein, 9 aa, Influenza virus
WSVLQPGET

SEQ ID NO: 490294 - protein, 9 aa, Influenza virus
WSVLRPGET

SEQ ID NO: 490295 - protein, 9 aa, Influenza virus
WSWDDGAIL

SEQ ID NO: 490296 - protein, 9 aa, Influenza virus
WSWHDGAEI

SEQ ID NO: 490297 - protein, 9 aa, Influenza virus
WSWHDGAIL

SEQ ID NO: 490298 - protein, 9 aa, Influenza virus
WSWHDGAVL

SEQ ID NO: 490299 - protein, 9 aa, Influenza virus
WSWPDDAEL

SEQ ID NO: 490300 - protein, 9 aa, Influenza virus
WSWPDGADL

SEQ ID NO: 490301 - protein, 9 aa, Influenza virus
WSWPDGAEL

SEQ ID NO: 490302 - protein, 9 aa, Influenza virus
WSWPDGAEV

SEQ ID NO: 490303 - protein, 9 aa, Influenza virus
WSWPDGAKL

SEQ ID NO: 490304 - protein, 9 aa, Influenza virus
WSWPDGALL

SEQ ID NO: 490305 - protein, 9 aa, Influenza virus
WSYIIEKEN

SEQ ID NO: 490306 - protein, 9 aa, Influenza virus
WSYIMEKEN

SEQ ID NO: 490307 - protein, 9 aa, Influenza virus
WSYIVEKAN

SEQ ID NO: 490308 - protein, 9 aa, Influenza virus
WSYIVEKDK

SEQ ID NO: 490309 - protein, 9 aa, Influenza virus
WSYIVEKDN

SEQ ID NO: 490310 - protein, 9 aa, Influenza virus
WSYIVEKDS

SEQ ID NO: 490311 - protein, 9 aa, Influenza virus
WSYIVEKEN

SEQ ID NO: 490312 - protein, 9 aa, Influenza virus
WSYIVEKNN

SEQ ID NO: 490313 - protein, 9 aa, Influenza virus
WSYIVEKPN

SEQ ID NO: 490314 - protein, 9 aa, Influenza virus
WSYIVEKSN

SEQ ID NO: 490315 - protein, 9 aa, Influenza virus
WSYIVEKTN

SEQ ID NO: 490316 - protein, 9 aa, Influenza virus
WSYIVEREN

SEQ ID NO: 490317 - protein, 9 aa, Influenza virus
WSYIVERET

SEQ ID NO: 490318 - protein, 9 aa, Influenza virus
WSYIVERPK

SEQ ID NO: 490319 - protein, 9 aa, Influenza virus
WSYIVERPL

SEQ ID NO: 490320 - protein, 9 aa, Influenza virus
WSYIVERPN

SEQ ID NO: 490321 - protein, 9 aa, Influenza virus
WSYIVERPS

SEQ ID NO: 490322 - protein, 9 aa, Influenza virus
WSYIVERPT

SEQ ID NO: 490323 - protein, 9 aa, Influenza virus
WSYIVERSS

SEQ ID NO: 490324 - protein, 9 aa, Influenza virus
WSYIVERTK

SEQ ID NO: 490325 - protein, 9 aa, Influenza virus
WSYLIEDPA

SEQ ID NO: 490326 - protein, 9 aa, Influenza virus
WSYLIEDPG

SEQ ID NO: 490327 - protein, 9 aa, Influenza virus
WSYLIEDPN

SEQ ID NO: 490328 - protein, 9 aa, Influenza virus
WSYLIEDPS

SEQ ID NO: 490329 - protein, 9 aa, Influenza virus
WSYLIEDPT

SEQ ID NO: 490330 - protein, 9 aa, Influenza virus
WSYNADLLV

SEQ ID NO: 490331 - protein, 9 aa, Influenza virus
WSYNADVLV

SEQ ID NO: 490332 - protein, 9 aa, Influenza virus
WSYNAEFLV

SEQ ID NO: 490333 - protein, 9 aa, Influenza virus
WSYNAELLI

SEQ ID NO: 490334 - protein, 9 aa, Influenza virus
WSYNAELLV

SEQ ID NO: 490335 - protein, 9 aa, Influenza virus
WSYNAGLLV

SEQ ID NO: 490336 - protein, 9 aa, Influenza virus
WSYNAKLLV

SEQ ID NO: 490337 - protein, 9 aa, Influenza virus
WSYNAQLLV

SEQ ID NO: 490338 - protein, 9 aa, Influenza virus
WSYNARLLV

SEQ ID NO: 490339 - protein, 9 aa, Influenza virus
WTANSIIVF

SEQ ID NO: 490340 - protein, 9 aa, Influenza virus
WTCNSGNCR

SEQ ID NO: 490341 - protein, 9 aa, Influenza virus
WTCSNGSCR

SEQ ID NO: 490342 - protein, 9 aa, Influenza virus
WTGLIDGWY

SEQ ID NO: 490343 - protein, 9 aa, Influenza virus
WTGMIDGWY

SEQ ID NO: 490344 - protein, 9 aa, Influenza virus
WTGMVDGWY

SEQ ID NO: 490345 - protein, 9 aa, Influenza virus
WTGMVNGWY

SEQ ID NO: 490346 - protein, 9 aa, Influenza virus
WTGTNRPIL

SEQ ID NO: 490347 - protein, 9 aa, Influenza virus
WTGTNRPVL

SEQ ID NO: 490348 - protein, 9 aa, Influenza virus
WTIANSKSQ

SEQ ID NO: 490349 - protein, 9 aa, Influenza virus
WTKDSITDI

SEQ ID NO: 490350 - protein, 9 aa, Influenza virus
WTLGENMAP

SEQ ID NO: 490351 - protein, 9 aa, Influenza virus
WTLNRNQPA

SEQ ID NO: 490352 - protein, 9 aa, Influenza virus
WTLVNPGDS

SEQ ID NO: 490353 - protein, 9 aa, Influenza virus
WTPKRNRSI

SEQ ID NO: 490354 - protein, 9 aa, Influenza virus
WTQDAMTEV

SEQ ID NO: 490355 - protein, 9 aa, Influenza virus
WTRDAMTEI

SEQ ID NO: 490356 - protein, 9 aa, Influenza virus
WTRDAMTEV

SEQ ID NO: 490357 - protein, 9 aa, Influenza virus
WTRDSITEV

SEQ ID NO: 490358 - protein, 9 aa, Influenza virus
WTRDSLTEI

SEQ ID NO: 490359 - protein, 9 aa, Influenza virus
WTRDSMTEI

SEQ ID NO: 490360 - protein, 9 aa, Influenza virus
WTRDSMTEV

SEQ ID NO: 490361 - protein, 9 aa, Influenza virus
WTRDSVTEL

SEQ ID NO: 490362 - protein, 9 aa, Influenza virus
WTSGSIISF

SEQ ID NO: 490363 - protein, 9 aa, Influenza virus
WTSGSSIAF

SEQ ID NO: 490364 - protein, 9 aa, Influenza virus
WTSGSSISF

SEQ ID NO: 490365 - protein, 9 aa, Influenza virus
WTSNSIAVF

SEQ ID NO: 490366 - protein, 9 aa, Influenza virus
WTSNSIIAF

SEQ ID NO: 490367 - protein, 9 aa, Influenza virus
WTSNSIISM

SEQ ID NO: 490368 - protein, 9 aa, Influenza virus
WTSNSIIVF

SEQ ID NO: 490369 - protein, 9 aa, Influenza virus
WTSNSIVAF

SEQ ID NO: 490370 - protein, 9 aa, Influenza virus
WTSNSIVAL

SEQ ID NO: 490371 - protein, 9 aa, Influenza virus
WTSNSIVSM

SEQ ID NO: 490372 - protein, 9 aa, Influenza virus
WTSNSIVTF

SEQ ID NO: 490373 - protein, 9 aa, Influenza virus
WTSNSIVVF

SEQ ID NO: 490374 - protein, 9 aa, Influenza virus
WTSNSLIAL

SEQ ID NO: 490375 - protein, 9 aa, Influenza virus
WTSNSLVAL

SEQ ID NO: 490376 - protein, 9 aa, Influenza virus
WTSNSMVTF

SEQ ID NO: 490377 - protein, 9 aa, Influenza virus
WTSNSVVVF

SEQ ID NO: 490378 - protein, 9 aa, Influenza virus
WTSSSSIVM

SEQ ID NO: 490379 - protein, 9 aa, Influenza virus
WTSSSSTVF

SEQ ID NO: 490380 - protein, 9 aa, Influenza virus
WTSSSSVVM

SEQ ID NO: 490381 - protein, 9 aa, Influenza virus
WTTANSKSK

SEQ ID NO: 490382 - protein, 9 aa, Influenza virus
WTTANSKSQ

SEQ ID NO: 490383 - protein, 9 aa, Influenza virus
WTTNSIVVF

SEQ ID NO: 490384 - protein, 9 aa, Influenza virus
WTYNAELFV

SEQ ID NO: 490385 - protein, 9 aa, Influenza virus
WTYNAELLI

SEQ ID NO: 490386 - protein, 9 aa, Influenza virus
WTYNAELLV

SEQ ID NO: 490387 - protein, 9 aa, Influenza virus
WTYNAEVLV

SEQ ID NO: 490388 - protein, 9 aa, Influenza virus
WTYNTELLV

SEQ ID NO: 490389 - protein, 9 aa, Influenza virus
WTYNVELLV

SEQ ID NO: 490390 - protein, 9 aa, Influenza virus
WTYQAELLI

SEQ ID NO: 490391 - protein, 9 aa, Influenza virus
WTYQAELLV

SEQ ID NO: 490392 - protein, 9 aa, Influenza virus
WTYQEELLV

SEQ ID NO: 490393 - protein, 9 aa, Influenza virus
WVAVAKDNA

SEQ ID NO: 490394 - protein, 9 aa, Influenza virus
WVCSNGSCR

SEQ ID NO: 490395 - protein, 9 aa, Influenza virus
WVDDAVTDI

SEQ ID NO: 490396 - protein, 9 aa, Influenza virus
WVELDEIGE

SEQ ID NO: 490397 - protein, 9 aa, Influenza virus
WVELIRGQP

SEQ ID NO: 490398 - protein, 9 aa, Influenza virus
WVELIRGRP

SEQ ID NO: 490399 - protein, 9 aa, Influenza virus
WVELVRGLP

SEQ ID NO: 490400 - protein, 9 aa, Influenza virus
WVELVRGRP

SEQ ID NO: 490401 - protein, 9 aa, Influenza virus
WVEMIRGEP

SEQ ID NO: 490402 - protein, 9 aa, Influenza virus
WVEMIRGKP

SEQ ID NO: 490403 - protein, 9 aa, Influenza virus
WVEMIRGQP

SEQ ID NO: 490404 - protein, 9 aa, Influenza virus
WVEMIRGRP

SEQ ID NO: 490405 - protein, 9 aa, Influenza virus
WVGECPKYV

SEQ ID NO: 490406 - protein, 9 aa, Influenza virus
WVLGENMAP

SEQ ID NO: 490407 - protein, 9 aa, Influenza virus
WVLLNASWF

SEQ ID NO: 490408 - protein, 9 aa, Influenza virus
WVLWISFAI

SEQ ID NO: 490409 - protein, 9 aa, Influenza virus
WVMTDGPAN

SEQ ID NO: 490410 - protein, 9 aa, Influenza virus
WVMTDGPAS

SEQ ID NO: 490411 - protein, 9 aa, Influenza virus
WVPILNTSQ

SEQ ID NO: 490412 - protein, 9 aa, Influenza virus
WVPKRNRSI

SEQ ID NO: 490413 - protein, 9 aa, Influenza virus
WVQNEFNKA

SEQ ID NO: 490414 - protein, 9 aa, Influenza virus
WVQSEFNKA

SEQ ID NO: 490415 - protein, 9 aa, Influenza virus
WVRFNSDLD

SEQ ID NO: 490416 - protein, 9 aa, Influenza virus
WVRINNETI

SEQ ID NO: 490417 - protein, 9 aa, Influenza virus
WVRMNNETI

SEQ ID NO: 490418 - protein, 9 aa, Influenza virus
WVSFSISCF

SEQ ID NO: 490419 - protein, 9 aa, Influenza virus
WVSTDKDSN

SEQ ID NO: 490420 - protein, 9 aa, Influenza virus
WVSTDKNSN

SEQ ID NO: 490421 - protein, 9 aa, Influenza virus
WVSTDKSSN

SEQ ID NO: 490422 - protein, 9 aa, Influenza virus
WVTRELYVS

SEQ ID NO: 490423 - protein, 9 aa, Influenza virus
WVTREPYVS

SEQ ID NO: 490424 - protein, 9 aa, Influenza virus
WVVIAKDNA

SEQ ID NO: 490425 - protein, 9 aa, Influenza virus
WVVIAQDNA

SEQ ID NO: 490426 - protein, 9 aa, Influenza virus
WVVIEKDNA

SEQ ID NO: 490427 - protein, 9 aa, Influenza virus
WVVVAKDNA

SEQ ID NO: 490428 - protein, 9 aa, Influenza virus
WVWLWLVLR

SEQ ID NO: 490429 - protein, 9 aa, Influenza virus
WWASNSLIA

SEQ ID NO: 490430 - protein, 9 aa, Influenza virus
WWDGLQSSD

SEQ ID NO: 490431 - protein, 9 aa, Influenza virus
WWTSNSIAV

SEQ ID NO: 490432 - protein, 9 aa, Influenza virus
WWTSNSIIS

SEQ ID NO: 490433 - protein, 9 aa, Influenza virus
WWTSNSIIV

SEQ ID NO: 490434 - protein, 9 aa, Influenza virus
WWTSNSIVA

SEQ ID NO: 490435 - protein, 9 aa, Influenza virus
WWTSNSIVS

SEQ ID NO: 490436 - protein, 9 aa, Influenza virus
WWTSNSIVV

SEQ ID NO: 490437 - protein, 9 aa, Influenza virus
WWTSNSLIA

SEQ ID NO: 490438 - protein, 9 aa, Influenza virus
WWTSNSLVA

SEQ ID NO: 490439 - protein, 9 aa, Influenza virus
WWTSNSVVV

SEQ ID NO: 490440 - protein, 9 aa, Influenza virus
WWVWLWLVL

SEQ ID NO: 490441 - protein, 9 aa, Influenza virus
WYGFHHSNA

SEQ ID NO: 490442 - protein, 9 aa, Influenza virus
WYGFHHSNE

SEQ ID NO: 490443 - protein, 9 aa, Influenza virus
WYGFHHSNS

SEQ ID NO: 490444 - protein, 9 aa, Influenza virus
WYGFKHQNA

SEQ ID NO: 490445 - protein, 9 aa, Influenza virus
WYGFQHQNA

SEQ ID NO: 490446 - protein, 9 aa, Influenza virus
WYGFQHQNE

SEQ ID NO: 490447 - protein, 9 aa, Influenza virus
WYGFQHQNS

SEQ ID NO: 490448 - protein, 9 aa, Influenza virus
WYGFQHRND

SEQ ID NO: 490449 - protein, 9 aa, Influenza virus
WYGFQHRNE

SEQ ID NO: 490450 - protein, 9 aa, Influenza virus
WYGFQHSNA

SEQ ID NO: 490451 - protein, 9 aa, Influenza virus
WYGFQHSND

SEQ ID NO: 490452 - protein, 9 aa, Influenza virus
WYGFQHSNE

SEQ ID NO: 490453 - protein, 9 aa, Influenza virus
WYGFQHTND

SEQ ID NO: 490454 - protein, 9 aa, Influenza virus
WYGFRHHNS

SEQ ID NO: 490455 - protein, 9 aa, Influenza virus
WYGFRHLNS

SEQ ID NO: 490456 - protein, 9 aa, Influenza virus
WYGFRHQKA

SEQ ID NO: 490457 - protein, 9 aa, Influenza virus
WYGFRHQNA

SEQ ID NO: 490458 - protein, 9 aa, Influenza virus
WYGFRHQNS

SEQ ID NO: 490459 - protein, 9 aa, Influenza virus
WYGFRHQNT

SEQ ID NO: 490460 - protein, 9 aa, Influenza virus
WYGFRYQNS

SEQ ID NO: 490461 - protein, 9 aa, Influenza virus
WYGYHHENS

SEQ ID NO: 490462 - protein, 9 aa, Influenza virus
WYGYHHNNE

SEQ ID NO: 490463 - protein, 9 aa, Influenza virus
WYGYHHQNE

SEQ ID NO: 490464 - protein, 9 aa, Influenza virus
WYGYHHQNG

SEQ ID NO: 490465 - protein, 9 aa, Influenza virus
WYGYHHSKE

SEQ ID NO: 490466 - protein, 9 aa, Influenza virus
WYGYHHSND

SEQ ID NO: 490467 - protein, 9 aa, Influenza virus
WYGYHHSNE

SEQ ID NO: 490468 - protein, 9 aa, Influenza virus
WYGYHHSNG

SEQ ID NO: 490469 - protein, 9 aa, Influenza virus
WYGYKHQNA

SEQ ID NO: 490470 - protein, 9 aa, Influenza virus
WYGYRHQNA

SEQ ID NO: 490471 - protein, 9 aa, Influenza virus
YAADKASTQ

SEQ ID NO: 490472 - protein, 9 aa, Influenza virus
YAADKESTQ

SEQ ID NO: 490473 - protein, 9 aa, Influenza virus
YAADKKSTQ

SEQ ID NO: 490474 - protein, 9 aa, Influenza virus
YAADLKSTQ

SEQ ID NO: 490475 - protein, 9 aa, Influenza virus
YAADQESTQ

SEQ ID NO: 490476 - protein, 9 aa, Influenza virus
YAADQKSTQ

SEQ ID NO: 490477 - protein, 9 aa, Influenza virus
YAADRESTQ

SEQ ID NO: 490478 - protein, 9 aa, Influenza virus
YAADRKSTQ

SEQ ID NO: 490479 - protein, 9 aa, Influenza virus
YAEESKLKR

SEQ ID NO: 490480 - protein, 9 aa, Influenza virus
YAELKWLIS

SEQ ID NO: 490481 - protein, 9 aa, Influenza virus
YAELKWLVS

SEQ ID NO: 490482 - protein, 9 aa, Influenza virus
YAEMEWLLS

SEQ ID NO: 490483 - protein, 9 aa, Influenza virus
YAEMKWLLS

SEQ ID NO: 490484 - protein, 9 aa, Influenza virus
YAFGICPKY

SEQ ID NO: 490485 - protein, 9 aa, Influenza virus
YAFGNCPKY

SEQ ID NO: 490486 - protein, 9 aa, Influenza virus
YAFGNCPMY

SEQ ID NO: 490487 - protein, 9 aa, Influenza virus
YAFGNCSKY

SEQ ID NO: 490488 - protein, 9 aa, Influenza virus
YAFGTCPKY

SEQ ID NO: 490489 - protein, 9 aa, Influenza virus
YAGAINSSK

SEQ ID NO: 490490 - protein, 9 aa, Influenza virus
YAGAINSSR

SEQ ID NO: 490491 - protein, 9 aa, Influenza virus
YAGAVNSSK

SEQ ID NO: 490492 - protein, 9 aa, Influenza virus
YAKKASLRL

SEQ ID NO: 490493 - protein, 9 aa, Influenza virus
YALHQGTTI

SEQ ID NO: 490494 - protein, 9 aa, Influenza virus
YALSQGTTI

SEQ ID NO: 490495 - protein, 9 aa, Influenza virus
YAQTDCVLE

SEQ ID NO: 490496 - protein, 9 aa, Influenza virus
YARLYIWGV

SEQ ID NO: 490497 - protein, 9 aa, Influenza virus
YASKNPYTL

SEQ ID NO: 490498 - protein, 9 aa, Influenza virus
YASKTRISE

SEQ ID NO: 490499 - protein, 9 aa, Influenza virus
YASPQLEGF

SEQ ID NO: 490500 - protein, 9 aa, Influenza virus
YASSQLEGF

SEQ ID NO: 490501 - protein, 9 aa, Influenza virus
YATVAGSLS

SEQ ID NO: 490502 - protein, 9 aa, Influenza virus
YAVIHYGGI

SEQ ID NO: 490503 - protein, 9 aa, Influenza virus
YAVIHYGGM

SEQ ID NO: 490504 - protein, 9 aa, Influenza virus
YAVIHYGGV

SEQ ID NO: 490505 - protein, 9 aa, Influenza virus
YCFTVMTDG

SEQ ID NO: 490506 - protein, 9 aa, Influenza virus
YCICRDNWK

SEQ ID NO: 490507 - protein, 9 aa, Influenza virus
YCNTDLGAP

SEQ ID NO: 490508 - protein, 9 aa, Influenza virus
YCNTDLGSP

SEQ ID NO: 490509 - protein, 9 aa, Influenza virus
YCNTDLGTP

SEQ ID NO: 490510 - protein, 9 aa, Influenza virus
YCRATEYIM

SEQ ID NO: 490511 - protein, 9 aa, Influenza virus
YCSLNGISP

SEQ ID NO: 490512 - protein, 9 aa, Influenza virus
YCSLNGVSP

SEQ ID NO: 490513 - protein, 9 aa, Influenza virus
YCVCRDNWK

SEQ ID NO: 490514 - protein, 9 aa, Influenza virus
YCYPGATVN

SEQ ID NO: 490515 - protein, 9 aa, Influenza virus
YCYPGSTVN

SEQ ID NO: 490516 - protein, 9 aa, Influenza virus
YCYPGTTVN

SEQ ID NO: 490517 - protein, 9 aa, Influenza virus
YDAIEECLI

SEQ ID NO: 490518 - protein, 9 aa, Influenza virus
YDAVATTHS

SEQ ID NO: 490519 - protein, 9 aa, Influenza virus
YDFEKEGYS

SEQ ID NO: 490520 - protein, 9 aa, Influenza virus
YDFEREGYS

SEQ ID NO: 490521 - protein, 9 aa, Influenza virus
YDGIITDTI

SEQ ID NO: 490522 - protein, 9 aa, Influenza virus
YDGKAWLHI

SEQ ID NO: 490523 - protein, 9 aa, Influenza virus
YDGKAWLHV

SEQ ID NO: 490524 - protein, 9 aa, Influenza virus
YDGRLIQNS

SEQ ID NO: 490525 - protein, 9 aa, Influenza virus
YDHAQYREE

SEQ ID NO: 490526 - protein, 9 aa, Influenza virus
YDHKDYEEE

SEQ ID NO: 490527 - protein, 9 aa, Influenza virus
YDHKEFEEE

SEQ ID NO: 490528 - protein, 9 aa, Influenza virus
YDHKEFEKE

SEQ ID NO: 490529 - protein, 9 aa, Influenza virus
YDHKEFKEE

SEQ ID NO: 490530 - protein, 9 aa, Influenza virus
YDHKEYEEE

SEQ ID NO: 490531 - protein, 9 aa, Influenza virus
YDHNIYRDE

SEQ ID NO: 490532 - protein, 9 aa, Influenza virus
YDHSHYREE

SEQ ID NO: 490533 - protein, 9 aa, Influenza virus
YDHSQYREE

SEQ ID NO: 490534 - protein, 9 aa, Influenza virus
YDHTQYREE

SEQ ID NO: 490535 - protein, 9 aa, Influenza virus
YDKICIGYQ

SEQ ID NO: 490536 - protein, 9 aa, Influenza virus
YDKVRLQLK

SEQ ID NO: 490537 - protein, 9 aa, Influenza virus
YDKVRLQLR

SEQ ID NO: 490538 - protein, 9 aa, Influenza virus
YDKVRMQLK

SEQ ID NO: 490539 - protein, 9 aa, Influenza virus
YDKVRMQLR

SEQ ID NO: 490540 - protein, 9 aa, Influenza virus
YDNGVWIGR

SEQ ID NO: 490541 - protein, 9 aa, Influenza virus
YDRICIGYQ

SEQ ID NO: 490542 - protein, 9 aa, Influenza virus
YDRRLTTTI

SEQ ID NO: 490543 - protein, 9 aa, Influenza virus
YDRRLTTTV

SEQ ID NO: 490544 - protein, 9 aa, Influenza virus
YDRVRKQLR

SEQ ID NO: 490545 - protein, 9 aa, Influenza virus
YDRVRLQLR

SEQ ID NO: 490546 - protein, 9 aa, Influenza virus
YDRVRMQLR

SEQ ID NO: 490547 - protein, 9 aa, Influenza virus
YDSIRGEFN

SEQ ID NO: 490548 - protein, 9 aa, Influenza virus
YDSIRGEFS

SEQ ID NO: 490549 - protein, 9 aa, Influenza virus
YDVGYLCAG

SEQ ID NO: 490550 - protein, 9 aa, Influenza virus
YDWTLNRNQ

SEQ ID NO: 490551 - protein, 9 aa, Influenza virus
YDYPKYEEE

SEQ ID NO: 490552 - protein, 9 aa, Influenza virus
YDYPKYEKE

SEQ ID NO: 490553 - protein, 9 aa, Influenza virus
YDYPKYSEE

SEQ ID NO: 490554 - protein, 9 aa, Influenza virus
YDYPKYSKE

SEQ ID NO: 490555 - protein, 9 aa, Influenza virus
YDYSKYEEE

SEQ ID NO: 490556 - protein, 9 aa, Influenza virus
YEAIEECLI

SEQ ID NO: 490557 - protein, 9 aa, Influenza virus
YEDESRIER

SEQ ID NO: 490558 - protein, 9 aa, Influenza virus
YEECSCYPD

SEQ ID NO: 490559 - protein, 9 aa, Influenza virus
YEECSCYPE

SEQ ID NO: 490560 - protein, 9 aa, Influenza virus
YEECSCYPN

SEQ ID NO: 490561 - protein, 9 aa, Influenza virus
YEEEAKLEK

SEQ ID NO: 490562 - protein, 9 aa, Influenza virus
YEEEAKLER

SEQ ID NO: 490563 - protein, 9 aa, Influenza virus
YEEESKIER

SEQ ID NO: 490564 - protein, 9 aa, Influenza virus
YEEESKLER

SEQ ID NO: 490565 - protein, 9 aa, Influenza virus
YEEESKLKR

SEQ ID NO: 490566 - protein, 9 aa, Influenza virus
YEEESKLNK

SEQ ID NO: 490567 - protein, 9 aa, Influenza virus
YEEESKLNR

SEQ ID NO: 490568 - protein, 9 aa, Influenza virus
YEEESRIER

SEQ ID NO: 490569 - protein, 9 aa, Influenza virus
YEEESRLNR

SEQ ID NO: 490570 - protein, 9 aa, Influenza virus
YEELKEQLS

SEQ ID NO: 490571 - protein, 9 aa, Influenza virus
YEELKHLLN

SEQ ID NO: 490572 - protein, 9 aa, Influenza virus
YEELKHLLS

SEQ ID NO: 490573 - protein, 9 aa, Influenza virus
YEELKHLMS

SEQ ID NO: 490574 - protein, 9 aa, Influenza virus
YEELREHLS

SEQ ID NO: 490575 - protein, 9 aa, Influenza virus
YEELREQLN

SEQ ID NO: 490576 - protein, 9 aa, Influenza virus
YEELREQLS

SEQ ID NO: 490577 - protein, 9 aa, Influenza virus
YEELREQMS

SEQ ID NO: 490578 - protein, 9 aa, Influenza virus
YEGRLIQNS

SEQ ID NO: 490579 - protein, 9 aa, Influenza virus
YEILKVPNA

SEQ ID NO: 490580 - protein, 9 aa, Influenza virus
YEKVRLQLR

SEQ ID NO: 490581 - protein, 9 aa, Influenza virus
YEKVRMQLR

SEQ ID NO: 490582 - protein, 9 aa, Influenza virus
YEKVRRQLR

SEQ ID NO: 490583 - protein, 9 aa, Influenza virus
YELEIGARI

SEQ ID NO: 490584 - protein, 9 aa, Influenza virus
YELEIGTRI

SEQ ID NO: 490585 - protein, 9 aa, Influenza virus
YEMLKVPDA

SEQ ID NO: 490586 - protein, 9 aa, Influenza virus
YEMLKVPNA

SEQ ID NO: 490587 - protein, 9 aa, Influenza virus
YENNPGRVT

SEQ ID NO: 490588 - protein, 9 aa, Influenza virus
YENNTWVNQ

SEQ ID NO: 490589 - protein, 9 aa, Influenza virus
YENTTWVNQ

SEQ ID NO: 490590 - protein, 9 aa, Influenza virus
YEQMETDGD

SEQ ID NO: 490591 - protein, 9 aa, Influenza virus
YEQMETDGE

SEQ ID NO: 490592 - protein, 9 aa, Influenza virus
YEQMETGGE

SEQ ID NO: 490593 - protein, 9 aa, Influenza virus
YEQMETSGE

SEQ ID NO: 490594 - protein, 9 aa, Influenza virus
YERMCNILK

SEQ ID NO: 490595 - protein, 9 aa, Influenza virus
YERRLTTTI

SEQ ID NO: 490596 - protein, 9 aa, Influenza virus
YERVKKQLR

SEQ ID NO: 490597 - protein, 9 aa, Influenza virus
YERVKMFDF

SEQ ID NO: 490598 - protein, 9 aa, Influenza virus
YERVKRQLR

SEQ ID NO: 490599 - protein, 9 aa, Influenza virus
YERVRKQLR

SEQ ID NO: 490600 - protein, 9 aa, Influenza virus
YERVRRQLR

SEQ ID NO: 490601 - protein, 9 aa, Influenza virus
YESIEECLI

SEQ ID NO: 490602 - protein, 9 aa, Influenza virus
YESSINPAG

SEQ ID NO: 490603 - protein, 9 aa, Influenza virus
YESTQAAID

SEQ ID NO: 490604 - protein, 9 aa, Influenza virus
YETFKVIGG

SEQ ID NO: 490605 - protein, 9 aa, Influenza virus
YETFRVIDG

SEQ ID NO: 490606 - protein, 9 aa, Influenza virus
YETFRVIGG

SEQ ID NO: 490607 - protein, 9 aa, Influenza virus
YETFRVISG

SEQ ID NO: 490608 - protein, 9 aa, Influenza virus
YEVGYLCAG

SEQ ID NO: 490609 - protein, 9 aa, Influenza virus
YEVLKVPDA

SEQ ID NO: 490610 - protein, 9 aa, Influenza virus
YEVLKVPNA

SEQ ID NO: 490611 - protein, 9 aa, Influenza virus
YFFGDNAEE

SEQ ID NO: 490612 - protein, 9 aa, Influenza virus
YFFGDNAKE

SEQ ID NO: 490613 - protein, 9 aa, Influenza virus
YFFGDSAEE

SEQ ID NO: 490614 - protein, 9 aa, Influenza virus
YFFLKVPVQ

SEQ ID NO: 490615 - protein, 9 aa, Influenza virus
YFHDSNVKN

SEQ ID NO: 490616 - protein, 9 aa, Influenza virus
YFHKGIVIK

SEQ ID NO: 490617 - protein, 9 aa, Influenza virus
YFHKGLIIK

SEQ ID NO: 490618 - protein, 9 aa, Influenza virus
YFHKGLLIK

SEQ ID NO: 490619 - protein, 9 aa, Influenza virus
YFHKGLVIK

SEQ ID NO: 490620 - protein, 9 aa, Influenza virus
YFHKGLVVK

SEQ ID NO: 490621 - protein, 9 aa, Influenza virus
YFLDVFAGD

SEQ ID NO: 490622 - protein, 9 aa, Influenza virus
YFQLFLVCV

SEQ ID NO: 490623 - protein, 9 aa, Influenza virus
YFTAEISHC

SEQ ID NO: 490624 - protein, 9 aa, Influenza virus
YFTAEVSHC

SEQ ID NO: 490625 - protein, 9 aa, Influenza virus
YFTAEVSYC

SEQ ID NO: 490626 - protein, 9 aa, Influenza virus
YFTTEVSHC

SEQ ID NO: 490627 - protein, 9 aa, Influenza virus
YFVKEGKIV

SEQ ID NO: 490628 - protein, 9 aa, Influenza virus
YGAGNKLIT

SEQ ID NO: 490629 - protein, 9 aa, Influenza virus
YGAGSWPDG

SEQ ID NO: 490630 - protein, 9 aa, Influenza virus
YGAIEECLI

SEQ ID NO: 490631 - protein, 9 aa, Influenza virus
YGAQSLSIS

SEQ ID NO: 490632 - protein, 9 aa, Influenza virus
YGASINSAG

SEQ ID NO: 490633 - protein, 9 aa, Influenza virus
YGDGVWIGR

SEQ ID NO: 490634 - protein, 9 aa, Influenza virus
YGFHHSNAE

SEQ ID NO: 490635 - protein, 9 aa, Influenza virus
YGFHHSNSE

SEQ ID NO: 490636 - protein, 9 aa, Influenza virus
YGFIIKGRS

SEQ ID NO: 490637 - protein, 9 aa, Influenza virus
YGFIVKGRS

SEQ ID NO: 490638 - protein, 9 aa, Influenza virus
YGFKHQNAQ

SEQ ID NO: 490639 - protein, 9 aa, Influenza virus
YGFKISKRG

SEQ ID NO: 490640 - protein, 9 aa, Influenza virus
YGFQHQNAE

SEQ ID NO: 490641 - protein, 9 aa, Influenza virus
YGFQHQNEQ

SEQ ID NO: 490642 - protein, 9 aa, Influenza virus
YGFQHQNSE

SEQ ID NO: 490643 - protein, 9 aa, Influenza virus
YGFQHRNDE

SEQ ID NO: 490644 - protein, 9 aa, Influenza virus
YGFQHRNEE

SEQ ID NO: 490645 - protein, 9 aa, Influenza virus
YGFQHSNAQ

SEQ ID NO: 490646 - protein, 9 aa, Influenza virus
YGFQHSNDQ

SEQ ID NO: 490647 - protein, 9 aa, Influenza virus
YGFQHSNEQ

SEQ ID NO: 490648 - protein, 9 aa, Influenza virus
YGFQHTNDQ

SEQ ID NO: 490649 - protein, 9 aa, Influenza virus
YGFRHHNSE

SEQ ID NO: 490650 - protein, 9 aa, Influenza virus
YGFRHLNSE

SEQ ID NO: 490651 - protein, 9 aa, Influenza virus
YGFRHQKAQ

SEQ ID NO: 490652 - protein, 9 aa, Influenza virus
YGFRHQNAE

SEQ ID NO: 490653 - protein, 9 aa, Influenza virus
YGFRHQNAQ

SEQ ID NO: 490654 - protein, 9 aa, Influenza virus
YGFRHQNSE

SEQ ID NO: 490655 - protein, 9 aa, Influenza virus
YGFRHQNSQ

SEQ ID NO: 490656 - protein, 9 aa, Influenza virus
YGFRHQNTQ

SEQ ID NO: 490657 - protein, 9 aa, Influenza virus
YGFRISKRG

SEQ ID NO: 490658 - protein, 9 aa, Influenza virus
YGFRYQNSE

SEQ ID NO: 490659 - protein, 9 aa, Influenza virus
YGFVANFSM

SEQ ID NO: 490660 - protein, 9 aa, Influenza virus
YGGIPTDVI

SEQ ID NO: 490661 - protein, 9 aa, Influenza virus
YGGIPTDVV

SEQ ID NO: 490662 - protein, 9 aa, Influenza virus
YGGLNKSKP

SEQ ID NO: 490663 - protein, 9 aa, Influenza virus
YGGMPTDVV

SEQ ID NO: 490664 - protein, 9 aa, Influenza virus
YGGVPTDVI

SEQ ID NO: 490665 - protein, 9 aa, Influenza virus
YGGVPTDVV

SEQ ID NO: 490666 - protein, 9 aa, Influenza virus
YGHDSKVTC

SEQ ID NO: 490667 - protein, 9 aa, Influenza virus
YGHLITGKS

SEQ ID NO: 490668 - protein, 9 aa, Influenza virus
YGHLTTGKS

SEQ ID NO: 490669 - protein, 9 aa, Influenza virus
YGHLVTGKS

SEQ ID NO: 490670 - protein, 9 aa, Influenza virus
YGHNQKITC

SEQ ID NO: 490671 - protein, 9 aa, Influenza virus
YGHNSKVTC

SEQ ID NO: 490672 - protein, 9 aa, Influenza virus
YGHSQKATC

SEQ ID NO: 490673 - protein, 9 aa, Influenza virus
YGHSQKVTC

SEQ ID NO: 490674 - protein, 9 aa, Influenza virus
YGKDNAIRI

SEQ ID NO: 490675 - protein, 9 aa, Influenza virus
YGKDNAVRI

SEQ ID NO: 490676 - protein, 9 aa, Influenza virus
YGKGRIFQS

SEQ ID NO: 490677 - protein, 9 aa, Influenza virus
YGNCDAKCQ

SEQ ID NO: 490678 - protein, 9 aa, Influenza virus
YGNCDTKCQ

SEQ ID NO: 490679 - protein, 9 aa, Influenza virus
YGNCNAKCQ

SEQ ID NO: 490680 - protein, 9 aa, Influenza virus
YGNCNTKCQ

SEQ ID NO: 490681 - protein, 9 aa, Influenza virus
YGNDVWMGR

SEQ ID NO: 490682 - protein, 9 aa, Influenza virus
YGNGAWIGR

SEQ ID NO: 490683 - protein, 9 aa, Influenza virus
YGNGVWIGR

SEQ ID NO: 490684 - protein, 9 aa, Influenza virus
YGNGVWMGR

SEQ ID NO: 490685 - protein, 9 aa, Influenza virus
YGNPKCDIH

SEQ ID NO: 490686 - protein, 9 aa, Influenza virus
YGNPKCDTH

SEQ ID NO: 490687 - protein, 9 aa, Influenza virus
YGNPKCDVH

SEQ ID NO: 490688 - protein, 9 aa, Influenza virus
YGPALSINE

SEQ ID NO: 490689 - protein, 9 aa, Influenza virus
YGPALSISE

SEQ ID NO: 490690 - protein, 9 aa, Influenza virus
YGPINVTKE

SEQ ID NO: 490691 - protein, 9 aa, Influenza virus
YGRGRIFQS

SEQ ID NO: 490692 - protein, 9 aa, Influenza virus
YGRIIQNED

SEQ ID NO: 490693 - protein, 9 aa, Influenza virus
YGSDVWMGR

SEQ ID NO: 490694 - protein, 9 aa, Influenza virus
YGSENKLIT

SEQ ID NO: 490695 - protein, 9 aa, Influenza virus
YGSGAKLIT

SEQ ID NO: 490696 - protein, 9 aa, Influenza virus
YGSGNKLIT

SEQ ID NO: 490697 - protein, 9 aa, Influenza virus
YGSGNKLVT

SEQ ID NO: 490698 - protein, 9 aa, Influenza virus
YGSGRIFQS

SEQ ID NO: 490699 - protein, 9 aa, Influenza virus
YGSGSKLIT

SEQ ID NO: 490700 - protein, 9 aa, Influenza virus
YGSGSWPDG

SEQ ID NO: 490701 - protein, 9 aa, Influenza virus
YGSSINSAG

SEQ ID NO: 490702 - protein, 9 aa, Influenza virus
YGSSITSAG

SEQ ID NO: 490703 - protein, 9 aa, Influenza virus
YGTGNKLIT

SEQ ID NO: 490704 - protein, 9 aa, Influenza virus
YGTGRIFQS

SEQ ID NO: 490705 - protein, 9 aa, Influenza virus
YGTGSWPDG

SEQ ID NO: 490706 - protein, 9 aa, Influenza virus
YGTGSWPDV

SEQ ID NO: 490707 - protein, 9 aa, Influenza virus
YGTGTWPDG

SEQ ID NO: 490708 - protein, 9 aa, Influenza virus
YGTQPLSIS

SEQ ID NO: 490709 - protein, 9 aa, Influenza virus
YGTQSLSIS

SEQ ID NO: 490710 - protein, 9 aa, Influenza virus
YGVKGFGFR

SEQ ID NO: 490711 - protein, 9 aa, Influenza virus
YGVKGFSFR

SEQ ID NO: 490712 - protein, 9 aa, Influenza virus
YGYHHENSQ

SEQ ID NO: 490713 - protein, 9 aa, Influenza virus
YGYHHQNEQ

SEQ ID NO: 490714 - protein, 9 aa, Influenza virus
YGYHHQNGQ

SEQ ID NO: 490715 - protein, 9 aa, Influenza virus
YGYHHSNDQ

SEQ ID NO: 490716 - protein, 9 aa, Influenza virus
YGYIIEEYG

SEQ ID NO: 490717 - protein, 9 aa, Influenza virus
YGYIIEKYG

SEQ ID NO: 490718 - protein, 9 aa, Influenza virus
YGYKHQNAQ

SEQ ID NO: 490719 - protein, 9 aa, Influenza virus
YGYLITGKS

SEQ ID NO: 490720 - protein, 9 aa, Influenza virus
YGYRHQNAQ

SEQ ID NO: 490721 - protein, 9 aa, Influenza virus
YHANNSKKQ

SEQ ID NO: 490722 - protein, 9 aa, Influenza virus
YHANNSTDT

SEQ ID NO: 490723 - protein, 9 aa, Influenza virus
YHANNSTEH

SEQ ID NO: 490724 - protein, 9 aa, Influenza virus
YHANNSTEK

SEQ ID NO: 490725 - protein, 9 aa, Influenza virus
YHANNSTEQ

SEQ ID NO: 490726 - protein, 9 aa, Influenza virus
YHANNSTER

SEQ ID NO: 490727 - protein, 9 aa, Influenza virus
YHANNSTET

SEQ ID NO: 490728 - protein, 9 aa, Influenza virus
YHANNSTKQ

SEQ ID NO: 490729 - protein, 9 aa, Influenza virus
YHANNSTTK

SEQ ID NO: 490730 - protein, 9 aa, Influenza virus
YHANNSTTQ

SEQ ID NO: 490731 - protein, 9 aa, Influenza virus
YHANNSTVQ

SEQ ID NO: 490732 - protein, 9 aa, Influenza virus
YHDSNVKNL

SEQ ID NO: 490733 - protein, 9 aa, Influenza virus
YHFEECSCY

SEQ ID NO: 490734 - protein, 9 aa, Influenza virus
YHHENSQGS

SEQ ID NO: 490735 - protein, 9 aa, Influenza virus
YHHQNAQGS

SEQ ID NO: 490736 - protein, 9 aa, Influenza virus
YHHQNEQGS

SEQ ID NO: 490737 - protein, 9 aa, Influenza virus
YHHQNGQGS

SEQ ID NO: 490738 - protein, 9 aa, Influenza virus
YHHSNDQGA

SEQ ID NO: 490739 - protein, 9 aa, Influenza virus
YHHSNDQGS

SEQ ID NO: 490740 - protein, 9 aa, Influenza virus
YHKCDDECI

SEQ ID NO: 490741 - protein, 9 aa, Influenza virus
YHKCDDECM

SEQ ID NO: 490742 - protein, 9 aa, Influenza virus
YHKCDNECI

SEQ ID NO: 490743 - protein, 9 aa, Influenza virus
YHKCDNECM

SEQ ID NO: 490744 - protein, 9 aa, Influenza virus
YHKCDNGCI

SEQ ID NO: 490745 - protein, 9 aa, Influenza virus
YHKCDNKCI

SEQ ID NO: 490746 - protein, 9 aa, Influenza virus
YHKCNDECM

SEQ ID NO: 490747 - protein, 9 aa, Influenza virus
YHKCNNECI

SEQ ID NO: 490748 - protein, 9 aa, Influenza virus
YHQIEKEFE

SEQ ID NO: 490749 - protein, 9 aa, Influenza virus
YHQIEKEFG

SEQ ID NO: 490750 - protein, 9 aa, Influenza virus
YHQSFVPSP

SEQ ID NO: 490751 - protein, 9 aa, Influenza virus
YHSNNSTEK

SEQ ID NO: 490752 - protein, 9 aa, Influenza virus
YHSNNSTKK

SEQ ID NO: 490753 - protein, 9 aa, Influenza virus
YHTGRSSFF

SEQ ID NO: 490754 - protein, 9 aa, Influenza virus
YHWNLALDI

SEQ ID NO: 490755 - protein, 9 aa, Influenza virus
YHYEECSCY

SEQ ID NO: 490756 - protein, 9 aa, Influenza virus
YICSGFFGD

SEQ ID NO: 490757 - protein, 9 aa, Influenza virus
YICSGIFGD

SEQ ID NO: 490758 - protein, 9 aa, Influenza virus
YICSGLVGD

SEQ ID NO: 490759 - protein, 9 aa, Influenza virus
YICSGVFGD

SEQ ID NO: 490760 - protein, 9 aa, Influenza virus
YICSKFHSD

SEQ ID NO: 490761 - protein, 9 aa, Influenza virus
YICSPVLTD

SEQ ID NO: 490762 - protein, 9 aa, Influenza virus
YICTGILTD

SEQ ID NO: 490763 - protein, 9 aa, Influenza virus
YICTGVLTD

SEQ ID NO: 490764 - protein, 9 aa, Influenza virus
YICVKNGNM

SEQ ID NO: 490765 - protein, 9 aa, Influenza virus
YIEGKLSQM

SEQ ID NO: 490766 - protein, 9 aa, Influenza virus
YIELIRGKP

SEQ ID NO: 490767 - protein, 9 aa, Influenza virus
YIELIRGRP

SEQ ID NO: 490768 - protein, 9 aa, Influenza virus
YIEVLHLTQ

SEQ ID NO: 490769 - protein, 9 aa, Influenza virus
YIGKCPKYI

SEQ ID NO: 490770 - protein, 9 aa, Influenza virus
YIGKCPRYI

SEQ ID NO: 490771 - protein, 9 aa, Influenza virus
YIIEEYGKG

SEQ ID NO: 490772 - protein, 9 aa, Influenza virus
YIIEEYGRG

SEQ ID NO: 490773 - protein, 9 aa, Influenza virus
YIIEKYGSG

SEQ ID NO: 490774 - protein, 9 aa, Influenza virus
YIIEKYGTG

SEQ ID NO: 490775 - protein, 9 aa, Influenza virus
YIIRALTLN

SEQ ID NO: 490776 - protein, 9 aa, Influenza virus
YIKQGSLKL

SEQ ID NO: 490777 - protein, 9 aa, Influenza virus
YIKQNTLKL

SEQ ID NO: 490778 - protein, 9 aa, Influenza virus
YIKSDQLKL

SEQ ID NO: 490779 - protein, 9 aa, Influenza virus
YIKSGQLKL

SEQ ID NO: 490780 - protein, 9 aa, Influenza virus
YINKTGTFE

SEQ ID NO: 490781 - protein, 9 aa, Influenza virus
YINRTGTFE

SEQ ID NO: 490782 - protein, 9 aa, Influenza virus
YINTALLNA

SEQ ID NO: 490783 - protein, 9 aa, Influenza virus
YINTAMLNA

SEQ ID NO: 490784 - protein, 9 aa, Influenza virus
YIPSGSLKL

SEQ ID NO: 490785 - protein, 9 aa, Influenza virus
YIPSNSLKL

SEQ ID NO: 490786 - protein, 9 aa, Influenza virus
YIPSRSLKL

SEQ ID NO: 490787 - protein, 9 aa, Influenza virus
YIQMCTELK

SEQ ID NO: 490788 - protein, 9 aa, Influenza virus
YIQMCTELQ

SEQ ID NO: 490789 - protein, 9 aa, Influenza virus
YIRTNGTSK

SEQ ID NO: 490790 - protein, 9 aa, Influenza virus
YISIGTSTL

SEQ ID NO: 490791 - protein, 9 aa, Influenza virus
YISSGSLKL

SEQ ID NO: 490792 - protein, 9 aa, Influenza virus
YISVGTSTL

SEQ ID NO: 490793 - protein, 9 aa, Influenza virus
YIVERPKEI

SEQ ID NO: 490794 - protein, 9 aa, Influenza virus
YIVERPKEM

SEQ ID NO: 490795 - protein, 9 aa, Influenza virus
YIVERPSAP

SEQ ID NO: 490796 - protein, 9 aa, Influenza virus
YIVERTKEM

SEQ ID NO: 490797 - protein, 9 aa, Influenza virus
YIVKKGDSA

SEQ ID NO: 490798 - protein, 9 aa, Influenza virus
YIWGVHHPS

SEQ ID NO: 490799 - protein, 9 aa, Influenza virus
YIWTYQAEL

SEQ ID NO: 490800 - protein, 9 aa, Influenza virus
YKALSIYSC

SEQ ID NO: 490801 - protein, 9 aa, Influenza virus
YKDIILWFS

SEQ ID NO: 490802 - protein, 9 aa, Influenza virus
YKDIILWIS

SEQ ID NO: 490803 - protein, 9 aa, Influenza virus
YKDIILWVS

SEQ ID NO: 490804 - protein, 9 aa, Influenza virus
YKDLDNCHP

SEQ ID NO: 490805 - protein, 9 aa, Influenza virus
YKDLGNCHP

SEQ ID NO: 490806 - protein, 9 aa, Influenza virus
YKDLGSCHP

SEQ ID NO: 490807 - protein, 9 aa, Influenza virus
YKDVILWFS

SEQ ID NO: 490808 - protein, 9 aa, Influenza virus
YKDWILWIS

SEQ ID NO: 490809 - protein, 9 aa, Influenza virus
YKDWVLWIS

SEQ ID NO: 490810 - protein, 9 aa, Influenza virus
YKEESQLKR

SEQ ID NO: 490811 - protein, 9 aa, Influenza virus
YKEICIAWS

SEQ ID NO: 490812 - protein, 9 aa, Influenza virus
YKEICVAWS

SEQ ID NO: 490813 - protein, 9 aa, Influenza virus
YKEIILWFS

SEQ ID NO: 490814 - protein, 9 aa, Influenza virus
YKEIRIAWS

SEQ ID NO: 490815 - protein, 9 aa, Influenza virus
YKEVILWFS

SEQ ID NO: 490816 - protein, 9 aa, Influenza virus
YKGIITDTI

SEQ ID NO: 490817 - protein, 9 aa, Influenza virus
YKGRLCNPL

SEQ ID NO: 490818 - protein, 9 aa, Influenza virus
YKHQNAQGE

SEQ ID NO: 490819 - protein, 9 aa, Influenza virus
YKIGYICSG

SEQ ID NO: 490820 - protein, 9 aa, Influenza virus
YKIIKKGDS

SEQ ID NO: 490821 - protein, 9 aa, Influenza virus
YKILKIKKG

SEQ ID NO: 490822 - protein, 9 aa, Influenza virus
YKILKIRKG

SEQ ID NO: 490823 - protein, 9 aa, Influenza virus
YKILSIYSC

SEQ ID NO: 490824 - protein, 9 aa, Influenza virus
YKILSIYSS

SEQ ID NO: 490825 - protein, 9 aa, Influenza virus
YKILSIYST

SEQ ID NO: 490826 - protein, 9 aa, Influenza virus
YKILTIYST

SEQ ID NO: 490827 - protein, 9 aa, Influenza virus
YKISKSTKS

SEQ ID NO: 490828 - protein, 9 aa, Influenza virus
YKIVKEGDS

SEQ ID NO: 490829 - protein, 9 aa, Influenza virus
YKIVKKGDS

SEQ ID NO: 490830 - protein, 9 aa, Influenza virus
YKIVKTGDS

SEQ ID NO: 490831 - protein, 9 aa, Influenza virus
YKKLKREIT

SEQ ID NO: 490832 - protein, 9 aa, Influenza virus
YKKLKREMT

SEQ ID NO: 490833 - protein, 9 aa, Influenza virus
YKMNIQILI

SEQ ID NO: 490834 - protein, 9 aa, Influenza virus
YKMNNQILI

SEQ ID NO: 490835 - protein, 9 aa, Influenza virus
YKMNTKILV

SEQ ID NO: 490836 - protein, 9 aa, Influenza virus
YKMNTQILI

SEQ ID NO: 490837 - protein, 9 aa, Influenza virus
YKMNTQILV

SEQ ID NO: 490838 - protein, 9 aa, Influenza virus
YKMNTRILI

SEQ ID NO: 490839 - protein, 9 aa, Influenza virus
YKNANTLSS

SEQ ID NO: 490840 - protein, 9 aa, Influenza virus
YKNANTLTS

SEQ ID NO: 490841 - protein, 9 aa, Influenza virus
YKNNPGRVS

SEQ ID NO: 490842 - protein, 9 aa, Influenza virus
YKNNPGRVT

SEQ ID NO: 490843 - protein, 9 aa, Influenza virus
YKNNTWVNQ

SEQ ID NO: 490844 - protein, 9 aa, Influenza virus
YKNSPGRVT

SEQ ID NO: 490845 - protein, 9 aa, Influenza virus
YKNTGDSDI

SEQ ID NO: 490846 - protein, 9 aa, Influenza virus
YKNTNTLSS

SEQ ID NO: 490847 - protein, 9 aa, Influenza virus
YKNTRDSDI

SEQ ID NO: 490848 - protein, 9 aa, Influenza virus
YKNTRDSNI

SEQ ID NO: 490849 - protein, 9 aa, Influenza virus
YKNWILWIS

SEQ ID NO: 490850 - protein, 9 aa, Influenza virus
YKNWSKPQC

SEQ ID NO: 490851 - protein, 9 aa, Influenza virus
YKRIRLFDY

SEQ ID NO: 490852 - protein, 9 aa, Influenza virus
YKRVRLFDY

SEQ ID NO: 490853 - protein, 9 aa, Influenza virus
YKSNPGRVT

SEQ ID NO: 490854 - protein, 9 aa, Influenza virus
YKSTPSAID

SEQ ID NO: 490855 - protein, 9 aa, Influenza virus
YKSTQAAID

SEQ ID NO: 490856 - protein, 9 aa, Influenza virus
YKSTQAAVD

SEQ ID NO: 490857 - protein, 9 aa, Influenza virus
YKSTQKTID

SEQ ID NO: 490858 - protein, 9 aa, Influenza virus
YKSTQSAID

SEQ ID NO: 490859 - protein, 9 aa, Influenza virus
YKSTQSAIN

SEQ ID NO: 490860 - protein, 9 aa, Influenza virus
YKSTQSAVD

SEQ ID NO: 490861 - protein, 9 aa, Influenza virus
YKVATGRVT

SEQ ID NO: 490862 - protein, 9 aa, Influenza virus
YKVGYLCAG

SEQ ID NO: 490863 - protein, 9 aa, Influenza virus
YKVLAIYSC

SEQ ID NO: 490864 - protein, 9 aa, Influenza virus
YKVLSIYSC

SEQ ID NO: 490865 - protein, 9 aa, Influenza virus
YKYGNGVWI

SEQ ID NO: 490866 - protein, 9 aa, Influenza virus
YKYKIFKNG

SEQ ID NO: 490867 - protein, 9 aa, Influenza virus
YLCAGIPSD

SEQ ID NO: 490868 - protein, 9 aa, Influenza virus
YLCAGIPTD

SEQ ID NO: 490869 - protein, 9 aa, Influenza virus
YLCAGLPSD

SEQ ID NO: 490870 - protein, 9 aa, Influenza virus
YLCSGLVGD

SEQ ID NO: 490871 - protein, 9 aa, Influenza virus
YLCSKILTD

SEQ ID NO: 490872 - protein, 9 aa, Influenza virus
YLCSKTLTD

SEQ ID NO: 490873 - protein, 9 aa, Influenza virus
YLCSKVLTD

SEQ ID NO: 490874 - protein, 9 aa, Influenza virus
YLCSRILTD

SEQ ID NO: 490875 - protein, 9 aa, Influenza virus
YLCSRVLTD

SEQ ID NO: 490876 - protein, 9 aa, Influenza virus
YLCTGILTD

SEQ ID NO: 490877 - protein, 9 aa, Influenza virus
YLCTGVLTD

SEQ ID NO: 490878 - protein, 9 aa, Influenza virus
YLECRTFFL

SEQ ID NO: 490879 - protein, 9 aa, Influenza virus
YLEEHPNAG

SEQ ID NO: 490880 - protein, 9 aa, Influenza virus
YLEEHPSAG

SEQ ID NO: 490881 - protein, 9 aa, Influenza virus
YLEEHPSTG

SEQ ID NO: 490882 - protein, 9 aa, Influenza virus
YLEENPSAG

SEQ ID NO: 490883 - protein, 9 aa, Influenza virus
YLEKANKIK

SEQ ID NO: 490884 - protein, 9 aa, Influenza virus
YLEKASKIK

SEQ ID NO: 490885 - protein, 9 aa, Influenza virus
YLEKYVEDT

SEQ ID NO: 490886 - protein, 9 aa, Influenza virus
YLIEDPAAP

SEQ ID NO: 490887 - protein, 9 aa, Influenza virus
YLIEDPGAP

SEQ ID NO: 490888 - protein, 9 aa, Influenza virus
YLIEDPNAP

SEQ ID NO: 490889 - protein, 9 aa, Influenza virus
YLIEDPSAP

SEQ ID NO: 490890 - protein, 9 aa, Influenza virus
YLIEDPTAP

SEQ ID NO: 490891 - protein, 9 aa, Influenza virus
YLIGKTSWS

SEQ ID NO: 490892 - protein, 9 aa, Influenza virus
YLIRALTLN

SEQ ID NO: 490893 - protein, 9 aa, Influenza virus
YLIRTLTLN

SEQ ID NO: 490894 - protein, 9 aa, Influenza virus
YLITGKSHG

SEQ ID NO: 490895 - protein, 9 aa, Influenza virus
YLLFQDILM

SEQ ID NO: 490896 - protein, 9 aa, Influenza virus
YLLKGESHC

SEQ ID NO: 490897 - protein, 9 aa, Influenza virus
YLLKGESHG

SEQ ID NO: 490898 - protein, 9 aa, Influenza virus
YLLKGESYG

SEQ ID NO: 490899 - protein, 9 aa, Influenza virus
YLLLNKSLC

SEQ ID NO: 490900 - protein, 9 aa, Influenza virus
YLLRGESHG

SEQ ID NO: 490901 - protein, 9 aa, Influenza virus
YLMLNKSLC

SEQ ID NO: 490902 - protein, 9 aa, Influenza virus
YLMLSKSLC

SEQ ID NO: 490903 - protein, 9 aa, Influenza virus
YLNGREWSY

SEQ ID NO: 490904 - protein, 9 aa, Influenza virus
YLPDLYDYK

SEQ ID NO: 490905 - protein, 9 aa, Influenza virus
YLSGREWSY

SEQ ID NO: 490906 - protein, 9 aa, Influenza virus
YLSNNATDT

SEQ ID NO: 490907 - protein, 9 aa, Influenza virus
YLSNNSSDT

SEQ ID NO: 490908 - protein, 9 aa, Influenza virus
YLSNNSTDK

SEQ ID NO: 490909 - protein, 9 aa, Influenza virus
YLSNNSTDT

SEQ ID NO: 490910 - protein, 9 aa, Influenza virus
YLSNNSTEK

SEQ ID NO: 490911 - protein, 9 aa, Influenza virus
YLSNNSTER

SEQ ID NO: 490912 - protein, 9 aa, Influenza virus
YLSTNSSDK

SEQ ID NO: 490913 - protein, 9 aa, Influenza virus
YLSTNSSEK

SEQ ID NO: 490914 - protein, 9 aa, Influenza virus
YLSTNSSER

SEQ ID NO: 490915 - protein, 9 aa, Influenza virus
YLSTNSTEK

SEQ ID NO: 490916 - protein, 9 aa, Influenza virus
YLSTNSTET

SEQ ID NO: 490917 - protein, 9 aa, Influenza virus
YLTGTWDTL

SEQ ID NO: 490918 - protein, 9 aa, Influenza virus
YLVLNKSLC

SEQ ID NO: 490919 - protein, 9 aa, Influenza virus
YLWGVHHPS

SEQ ID NO: 490920 - protein, 9 aa, Influenza virus
YMCSGLVGD

SEQ ID NO: 490921 - protein, 9 aa, Influenza virus
YMGECPEYV

SEQ ID NO: 490922 - protein, 9 aa, Influenza virus
YMGECPKYA

SEQ ID NO: 490923 - protein, 9 aa, Influenza virus
YMGECPKYV

SEQ ID NO: 490924 - protein, 9 aa, Influenza virus
YMGECPNYV

SEQ ID NO: 490925 - protein, 9 aa, Influenza virus
YMLERELVR

SEQ ID NO: 490926 - protein, 9 aa, Influenza virus
YMNTALLNA

SEQ ID NO: 490927 - protein, 9 aa, Influenza virus
YMNVKSLKL

SEQ ID NO: 490928 - protein, 9 aa, Influenza virus
YMSNNSTEK

SEQ ID NO: 490929 - protein, 9 aa, Influenza virus
YNADLLVAM

SEQ ID NO: 490930 - protein, 9 aa, Influenza virus
YNADVLVAL

SEQ ID NO: 490931 - protein, 9 aa, Influenza virus
YNAEFLVAL

SEQ ID NO: 490932 - protein, 9 aa, Influenza virus
YNAEFLVAM

SEQ ID NO: 490933 - protein, 9 aa, Influenza virus
YNAEFLVAV

SEQ ID NO: 490934 - protein, 9 aa, Influenza virus
YNAEILVAL

SEQ ID NO: 490935 - protein, 9 aa, Influenza virus
YNAELFVLM

SEQ ID NO: 490936 - protein, 9 aa, Influenza virus
YNAELIVLL

SEQ ID NO: 490937 - protein, 9 aa, Influenza virus
YNAELLIAM

SEQ ID NO: 490938 - protein, 9 aa, Influenza virus
YNAELLILL

SEQ ID NO: 490939 - protein, 9 aa, Influenza virus
YNAELLVAL

SEQ ID NO: 490940 - protein, 9 aa, Influenza virus
YNAELLVAM

SEQ ID NO: 490941 - protein, 9 aa, Influenza virus
YNAELLVLI

SEQ ID NO: 490942 - protein, 9 aa, Influenza virus
YNAELLVLL

SEQ ID NO: 490943 - protein, 9 aa, Influenza virus
YNAELLVLM

SEQ ID NO: 490944 - protein, 9 aa, Influenza virus
YNAEVLVLM

SEQ ID NO: 490945 - protein, 9 aa, Influenza virus
YNAGLLVAL

SEQ ID NO: 490946 - protein, 9 aa, Influenza virus
YNAKLLVLI

SEQ ID NO: 490947 - protein, 9 aa, Influenza virus
YNAKLLVLL

SEQ ID NO: 490948 - protein, 9 aa, Influenza virus
YNAQLLVLL

SEQ ID NO: 490949 - protein, 9 aa, Influenza virus
YNAQLLVWL

SEQ ID NO: 490950 - protein, 9 aa, Influenza virus
YNARLLVLL

SEQ ID NO: 490951 - protein, 9 aa, Influenza virus
YNETFVNIT

SEQ ID NO: 490952 - protein, 9 aa, Influenza virus
YNETFVNVT

SEQ ID NO: 490953 - protein, 9 aa, Influenza virus
YNETVRLET

SEQ ID NO: 490954 - protein, 9 aa, Influenza virus
YNETVRVEI

SEQ ID NO: 490955 - protein, 9 aa, Influenza virus
YNETVRVET

SEQ ID NO: 490956 - protein, 9 aa, Influenza virus
YNETVRVKT

SEQ ID NO: 490957 - protein, 9 aa, Influenza virus
YNFEKEGYS

SEQ ID NO: 490958 - protein, 9 aa, Influenza virus
YNGIITDTF

SEQ ID NO: 490959 - protein, 9 aa, Influenza virus
YNGIITDTI

SEQ ID NO: 490960 - protein, 9 aa, Influenza virus
YNGIITDTL

SEQ ID NO: 490961 - protein, 9 aa, Influenza virus
YNGIRTNGA

SEQ ID NO: 490962 - protein, 9 aa, Influenza virus
YNGKSLGIQ

SEQ ID NO: 490963 - protein, 9 aa, Influenza virus
YNGLITDTI

SEQ ID NO: 490964 - protein, 9 aa, Influenza virus
YNGMITDTI

SEQ ID NO: 490965 - protein, 9 aa, Influenza virus
YNGQKSWMK

SEQ ID NO: 490966 - protein, 9 aa, Influenza virus
YNGQKSWTK

SEQ ID NO: 490967 - protein, 9 aa, Influenza virus
YNGQRSWMK

SEQ ID NO: 490968 - protein, 9 aa, Influenza virus
YNGRLTTTI

SEQ ID NO: 490969 - protein, 9 aa, Influenza virus
YNGVITDTL

SEQ ID NO: 490970 - protein, 9 aa, Influenza virus
YNHEDYKEE

SEQ ID NO: 490971 - protein, 9 aa, Influenza virus
YNHEDYREE

SEQ ID NO: 490972 - protein, 9 aa, Influenza virus
YNHKDYEEE

SEQ ID NO: 490973 - protein, 9 aa, Influenza virus
YNHKEYEEE

SEQ ID NO: 490974 - protein, 9 aa, Influenza virus
YNHTEYRQE

SEQ ID NO: 490975 - protein, 9 aa, Influenza virus
YNHTQYREE

SEQ ID NO: 490976 - protein, 9 aa, Influenza virus
YNIRNLHIP

SEQ ID NO: 490977 - protein, 9 aa, Influenza virus
YNKIEFEPF

SEQ ID NO: 490978 - protein, 9 aa, Influenza virus
YNKLEFEPF

SEQ ID NO: 490979 - protein, 9 aa, Influenza virus
YNKMEFEPF

SEQ ID NO: 490980 - protein, 9 aa, Influenza virus
YNKRLTTTI

SEQ ID NO: 490981 - protein, 9 aa, Influenza virus
YNKTVINNI

SEQ ID NO: 490982 - protein, 9 aa, Influenza virus
YNKVEFEPF

SEQ ID NO: 490983 - protein, 9 aa, Influenza virus
YNKVRMQLR

SEQ ID NO: 490984 - protein, 9 aa, Influenza virus
YNNTNGEQI

SEQ ID NO: 490985 - protein, 9 aa, Influenza virus
YNNTSGEQI

SEQ ID NO: 490986 - protein, 9 aa, Influenza virus
YNNTSGEQM

SEQ ID NO: 490987 - protein, 9 aa, Influenza virus
YNNTSGEQV

SEQ ID NO: 490988 - protein, 9 aa, Influenza virus
YNNTSGKQM

SEQ ID NO: 490989 - protein, 9 aa, Influenza virus
YNNTTGRDV

SEQ ID NO: 490990 - protein, 9 aa, Influenza virus
YNNTVINNI

SEQ ID NO: 490991 - protein, 9 aa, Influenza virus
YNNTVINNM

SEQ ID NO: 490992 - protein, 9 aa, Influenza virus
YNNTVVNNI

SEQ ID NO: 490993 - protein, 9 aa, Influenza virus
YNPCFYVEL

SEQ ID NO: 490994 - protein, 9 aa, Influenza virus
YNRKEYEEE

SEQ ID NO: 490995 - protein, 9 aa, Influenza virus
YNRRLTTTI

SEQ ID NO: 490996 - protein, 9 aa, Influenza virus
YNRRPTTTI

SEQ ID NO: 490997 - protein, 9 aa, Influenza virus
YNSKFESVA

SEQ ID NO: 490998 - protein, 9 aa, Influenza virus
YNSRFESVA

SEQ ID NO: 490999 - protein, 9 aa, Influenza virus
YNSTVVNNI

SEQ ID NO: 491000 - protein, 9 aa, Influenza virus
YNTELLVLM

SEQ ID NO: 491001 - protein, 9 aa, Influenza virus
YNVELLVLM

SEQ ID NO: 491002 - protein, 9 aa, Influenza virus
YNVGYLCAG

SEQ ID NO: 491003 - protein, 9 aa, Influenza virus
YNYHQSFVP

SEQ ID NO: 491004 - protein, 9 aa, Influenza virus
YNYPKYEEE

SEQ ID NO: 491005 - protein, 9 aa, Influenza virus
YNYPKYSEE

SEQ ID NO: 491006 - protein, 9 aa, Influenza virus
YNYSKYEEE

SEQ ID NO: 491007 - protein, 9 aa, Influenza virus
YPDVRCICR

SEQ ID NO: 491008 - protein, 9 aa, Influenza virus
YPDVRCTCR

SEQ ID NO: 491009 - protein, 9 aa, Influenza virus
YPDVRCVCR

SEQ ID NO: 491010 - protein, 9 aa, Influenza virus
YPFDVPDYQ

SEQ ID NO: 491011 - protein, 9 aa, Influenza virus
YPFDVPEYQ

SEQ ID NO: 491012 - protein, 9 aa, Influenza virus
YPFDVPGYQ

SEQ ID NO: 491013 - protein, 9 aa, Influenza virus
YPFDVPNYQ

SEQ ID NO: 491014 - protein, 9 aa, Influenza virus
YPGATINEE

SEQ ID NO: 491015 - protein, 9 aa, Influenza virus
YPGATVNEE

SEQ ID NO: 491016 - protein, 9 aa, Influenza virus
YPGATVNEG

SEQ ID NO: 491017 - protein, 9 aa, Influenza virus
YPGELDNNG

SEQ ID NO: 491018 - protein, 9 aa, Influenza virus
YPGELNNNG

SEQ ID NO: 491019 - protein, 9 aa, Influenza virus
YPGEVDNNG

SEQ ID NO: 491020 - protein, 9 aa, Influenza virus
YPGFVENLE

SEQ ID NO: 491021 - protein, 9 aa, Influenza virus
YPGKFANEE

SEQ ID NO: 491022 - protein, 9 aa, Influenza virus
YPGKFTNEE

SEQ ID NO: 491023 - protein, 9 aa, Influenza virus
YPGKFVNEE

SEQ ID NO: 491024 - protein, 9 aa, Influenza virus
YPGKFVNGE

SEQ ID NO: 491025 - protein, 9 aa, Influenza virus
YPGNFNDYE

SEQ ID NO: 491026 - protein, 9 aa, Influenza virus
YPGNNNGVK

SEQ ID NO: 491027 - protein, 9 aa, Influenza virus
YPGNNNKGV

SEQ ID NO: 491028 - protein, 9 aa, Influenza virus
YPGNNNNGV

SEQ ID NO: 491029 - protein, 9 aa, Influenza virus
YPGNSNNGV

SEQ ID NO: 491030 - protein, 9 aa, Influenza virus
YPGRFTNEE

SEQ ID NO: 491031 - protein, 9 aa, Influenza virus
YPGSFNDYE

SEQ ID NO: 491032 - protein, 9 aa, Influenza virus
YPGSFNNYE

SEQ ID NO: 491033 - protein, 9 aa, Influenza virus
YPGSIENLE

SEQ ID NO: 491034 - protein, 9 aa, Influenza virus
YPGSIENQE

SEQ ID NO: 491035 - protein, 9 aa, Influenza virus
YPGSIKNQE

SEQ ID NO: 491036 - protein, 9 aa, Influenza virus
YPGSLNDYE

SEQ ID NO: 491037 - protein, 9 aa, Influenza virus
YPGSTVNEE

SEQ ID NO: 491038 - protein, 9 aa, Influenza virus
YPGSVENLE

SEQ ID NO: 491039 - protein, 9 aa, Influenza virus
YPGSVENQE

SEQ ID NO: 491040 - protein, 9 aa, Influenza virus
YPGTTVNEE

SEQ ID NO: 491041 - protein, 9 aa, Influenza virus
YPGVRCICR

SEQ ID NO: 491042 - protein, 9 aa, Influenza virus
YPIQNLTKV

SEQ ID NO: 491043 - protein, 9 aa, Influenza virus
YPKIYKTYF

SEQ ID NO: 491044 - protein, 9 aa, Influenza virus
YPKVYKPYF

SEQ ID NO: 491045 - protein, 9 aa, Influenza virus
YPKVYKTYF

SEQ ID NO: 491046 - protein, 9 aa, Influenza virus
YPKVYRTYF

SEQ ID NO: 491047 - protein, 9 aa, Influenza virus
YPKYEEESK

SEQ ID NO: 491048 - protein, 9 aa, Influenza virus
YPKYEEESR

SEQ ID NO: 491049 - protein, 9 aa, Influenza virus
YPKYEKESK

SEQ ID NO: 491050 - protein, 9 aa, Influenza virus
YPKYSEEAK

SEQ ID NO: 491051 - protein, 9 aa, Influenza virus
YPKYSEESK

SEQ ID NO: 491052 - protein, 9 aa, Influenza virus
YPKYSEESR

SEQ ID NO: 491053 - protein, 9 aa, Influenza virus
YPKYSKESK

SEQ ID NO: 491054 - protein, 9 aa, Influenza virus
YPLQNLTKI

SEQ ID NO: 491055 - protein, 9 aa, Influenza virus
YPLQNLTKT

SEQ ID NO: 491056 - protein, 9 aa, Influenza virus
YPLQNLTKV

SEQ ID NO: 491057 - protein, 9 aa, Influenza virus
YPNDGKVEC

SEQ ID NO: 491058 - protein, 9 aa, Influenza virus
YPNEGKVEC

SEQ ID NO: 491059 - protein, 9 aa, Influenza virus
YPNLCQVEC

SEQ ID NO: 491060 - protein, 9 aa, Influenza virus
YPNLGKVEC

SEQ ID NO: 491061 - protein, 9 aa, Influenza virus
YPNLGQVEC

SEQ ID NO: 491062 - protein, 9 aa, Influenza virus
YPNMGKVEC

SEQ ID NO: 491063 - protein, 9 aa, Influenza virus
YPNNGKVEC

SEQ ID NO: 491064 - protein, 9 aa, Influenza virus
YPNSGKVEC

SEQ ID NO: 491065 - protein, 9 aa, Influenza virus
YPNVRCVCR

SEQ ID NO: 491066 - protein, 9 aa, Influenza virus
YPQYPDVRC

SEQ ID NO: 491067 - protein, 9 aa, Influenza virus
YPQYPNVRC

SEQ ID NO: 491068 - protein, 9 aa, Influenza virus
YPRYPDVRC

SEQ ID NO: 491069 - protein, 9 aa, Influenza virus
YPRYPGVRC

SEQ ID NO: 491070 - protein, 9 aa, Influenza virus
YPRYPNVRC

SEQ ID NO: 491071 - protein, 9 aa, Influenza virus
YQAELLVAM

SEQ ID NO: 491072 - protein, 9 aa, Influenza virus
YQAKFEAVA

SEQ ID NO: 491073 - protein, 9 aa, Influenza virus
YQAKFESVA

SEQ ID NO: 491074 - protein, 9 aa, Influenza virus
YQARFEAVA

SEQ ID NO: 491075 - protein, 9 aa, Influenza virus
YQARFESVA

SEQ ID NO: 491076 - protein, 9 aa, Influenza virus
YQEVGTYVS

SEQ ID NO: 491077 - protein, 9 aa, Influenza virus
YQFALGHGT

SEQ ID NO: 491078 - protein, 9 aa, Influenza virus
YQFALGQGA

SEQ ID NO: 491079 - protein, 9 aa, Influenza virus
YQFALGQGT

SEQ ID NO: 491080 - protein, 9 aa, Influenza virus
YQGRLCNPL

SEQ ID NO: 491081 - protein, 9 aa, Influenza virus
YQGRLCNPM

SEQ ID NO: 491082 - protein, 9 aa, Influenza virus
YQIGNVINW

SEQ ID NO: 491083 - protein, 9 aa, Influenza virus
YQIGYICSG

SEQ ID NO: 491084 - protein, 9 aa, Influenza virus
YQIGYVCSG

SEQ ID NO: 491085 - protein, 9 aa, Influenza virus
YQILAIYAT

SEQ ID NO: 491086 - protein, 9 aa, Influenza virus
YQILAIYST

SEQ ID NO: 491087 - protein, 9 aa, Influenza virus
YQILSIYST

SEQ ID NO: 491088 - protein, 9 aa, Influenza virus
YQILSVYST

SEQ ID NO: 491089 - protein, 9 aa, Influenza virus
YQKCCNLFE

SEQ ID NO: 491090 - protein, 9 aa, Influenza virus
YQKCCSLFE

SEQ ID NO: 491091 - protein, 9 aa, Influenza virus
YQKCCTLFE

SEQ ID NO: 491092 - protein, 9 aa, Influenza virus
YQKQMTRGL

SEQ ID NO: 491093 - protein, 9 aa, Influenza virus
YQKRMGLQM

SEQ ID NO: 491094 - protein, 9 aa, Influenza virus
YQKRMGVQI

SEQ ID NO: 491095 - protein, 9 aa, Influenza virus
YQKRMGVQL

SEQ ID NO: 491096 - protein, 9 aa, Influenza virus
YQKRMGVQM

SEQ ID NO: 491097 - protein, 9 aa, Influenza virus
YQKRMTRGL

SEQ ID NO: 491098 - protein, 9 aa, Influenza virus
YQKVGTYVS

SEQ ID NO: 491099 - protein, 9 aa, Influenza virus
YQMGYICSG

SEQ ID NO: 491100 - protein, 9 aa, Influenza virus
YQNNFVPVI

SEQ ID NO: 491101 - protein, 9 aa, Influenza virus
YQNNFVPVM

SEQ ID NO: 491102 - protein, 9 aa, Influenza virus
YQNNFVPVV

SEQ ID NO: 491103 - protein, 9 aa, Influenza virus
YQNSFVPVV

SEQ ID NO: 491104 - protein, 9 aa, Influenza virus
YQNVETYVS

SEQ ID NO: 491105 - protein, 9 aa, Influenza virus
YQNVGTYVS

SEQ ID NO: 491106 - protein, 9 aa, Influenza virus
YQQSFSPSP

SEQ ID NO: 491107 - protein, 9 aa, Influenza virus
YQQSFTPSP

SEQ ID NO: 491108 - protein, 9 aa, Influenza virus
YQQSFVPSP

SEQ ID NO: 491109 - protein, 9 aa, Influenza virus
YQRCCNLFE

SEQ ID NO: 491110 - protein, 9 aa, Influenza virus
YQRSKFLLM

SEQ ID NO: 491111 - protein, 9 aa, Influenza virus
YQRTRALVR

SEQ ID NO: 491112 - protein, 9 aa, Influenza virus
YQSGTYPVI

SEQ ID NO: 491113 - protein, 9 aa, Influenza virus
YQSIRSILA

SEQ ID NO: 491114 - protein, 9 aa, Influenza virus
YQSLRSILA

SEQ ID NO: 491115 - protein, 9 aa, Influenza virus
YQSNNSTDT

SEQ ID NO: 491116 - protein, 9 aa, Influenza virus
YQSNNSTNT

SEQ ID NO: 491117 - protein, 9 aa, Influenza virus
YQSRFEAVA

SEQ ID NO: 491118 - protein, 9 aa, Influenza virus
YQSTNSTEA

SEQ ID NO: 491119 - protein, 9 aa, Influenza virus
YQSTNSTEI

SEQ ID NO: 491120 - protein, 9 aa, Influenza virus
YQSTNSTET

SEQ ID NO: 491121 - protein, 9 aa, Influenza virus
YQTNNSTDT

SEQ ID NO: 491122 - protein, 9 aa, Influenza virus
YQTNNSTET

SEQ ID NO: 491123 - protein, 9 aa, Influenza virus
YQVGYICSG

SEQ ID NO: 491124 - protein, 9 aa, Influenza virus
YQVGYLCAG

SEQ ID NO: 491125 - protein, 9 aa, Influenza virus
YQVLAIYAT

SEQ ID NO: 491126 - protein, 9 aa, Influenza virus
YQWIIKNWE

SEQ ID NO: 491127 - protein, 9 aa, Influenza virus
YQWIIRNWE

SEQ ID NO: 491128 - protein, 9 aa, Influenza virus
YQWVIRNWE

SEQ ID NO: 491129 - protein, 9 aa, Influenza virus
YRACFYVEL

SEQ ID NO: 491130 - protein, 9 aa, Influenza virus
YRAESLQNR

SEQ ID NO: 491131 - protein, 9 aa, Influenza virus
YRALISWEM

SEQ ID NO: 491132 - protein, 9 aa, Influenza virus
YRALISWPL

SEQ ID NO: 491133 - protein, 9 aa, Influenza virus
YRALISWPQ

SEQ ID NO: 491134 - protein, 9 aa, Influenza virus
YRALMSVLL

SEQ ID NO: 491135 - protein, 9 aa, Influenza virus
YRALMSVPL

SEQ ID NO: 491136 - protein, 9 aa, Influenza virus
YRALSIYSC

SEQ ID NO: 491137 - protein, 9 aa, Influenza virus
YRALVSWPL

SEQ ID NO: 491138 - protein, 9 aa, Influenza virus
YRCHKGDTQ

SEQ ID NO: 491139 - protein, 9 aa, Influenza virus
YRCHRGDAQ

SEQ ID NO: 491140 - protein, 9 aa, Influenza virus
YRCHRGDMQ

SEQ ID NO: 491141 - protein, 9 aa, Influenza virus
YRCHRGDTH

SEQ ID NO: 491142 - protein, 9 aa, Influenza virus
YRCHRGDTQ

SEQ ID NO: 491143 - protein, 9 aa, Influenza virus
YRDEAINNR

SEQ ID NO: 491144 - protein, 9 aa, Influenza virus
YRDEAINSR

SEQ ID NO: 491145 - protein, 9 aa, Influenza virus
YRDEAISNR

SEQ ID NO: 491146 - protein, 9 aa, Influenza virus
YRDEALNNR

SEQ ID NO: 491147 - protein, 9 aa, Influenza virus
YRDEALSNR

SEQ ID NO: 491148 - protein, 9 aa, Influenza virus
YRDEAVNNR

SEQ ID NO: 491149 - protein, 9 aa, Influenza virus
YRDLGNCHP

SEQ ID NO: 491150 - protein, 9 aa, Influenza virus
YRDNWKGSN

SEQ ID NO: 491151 - protein, 9 aa, Influenza virus
YRDWSKPQC

SEQ ID NO: 491152 - protein, 9 aa, Influenza virus
YREEAIQNR

SEQ ID NO: 491153 - protein, 9 aa, Influenza virus
YREEALLNR

SEQ ID NO: 491154 - protein, 9 aa, Influenza virus
YREEAMQNR

SEQ ID NO: 491155 - protein, 9 aa, Influenza virus
YREESLLNR

SEQ ID NO: 491156 - protein, 9 aa, Influenza virus
YREESQLKK

SEQ ID NO: 491157 - protein, 9 aa, Influenza virus
YREESQLKR

SEQ ID NO: 491158 - protein, 9 aa, Influenza virus
YREICIAWS

SEQ ID NO: 491159 - protein, 9 aa, Influenza virus
YREVCIAWS

SEQ ID NO: 491160 - protein, 9 aa, Influenza virus
YRGRLCNPL

SEQ ID NO: 491161 - protein, 9 aa, Influenza virus
YRHQNAQGE

SEQ ID NO: 491162 - protein, 9 aa, Influenza virus
YRICKLVGI

SEQ ID NO: 491163 - protein, 9 aa, Influenza virus
YRIGYICSG

SEQ ID NO: 491164 - protein, 9 aa, Influenza virus
YRILSIYST

SEQ ID NO: 491165 - protein, 9 aa, Influenza virus
YRIWSKPQC

SEQ ID NO: 491166 - protein, 9 aa, Influenza virus
YRKEAIQNR

SEQ ID NO: 491167 - protein, 9 aa, Influenza virus
YRKLKREIT

SEQ ID NO: 491168 - protein, 9 aa, Influenza virus
YRKRMTRGL

SEQ ID NO: 491169 - protein, 9 aa, Influenza virus
YRKWSKPQC

SEQ ID NO: 491170 - protein, 9 aa, Influenza virus
YRNEAINNR

SEQ ID NO: 491171 - protein, 9 aa, Influenza virus
YRNEALNNR

SEQ ID NO: 491172 - protein, 9 aa, Influenza virus
YRNLIWLVK

SEQ ID NO: 491173 - protein, 9 aa, Influenza virus
YRNLIWLVN

SEQ ID NO: 491174 - protein, 9 aa, Influenza virus
YRNLIWLVQ

SEQ ID NO: 491175 - protein, 9 aa, Influenza virus
YRNLVWIVK

SEQ ID NO: 491176 - protein, 9 aa, Influenza virus
YRNLVWLVK

SEQ ID NO: 491177 - protein, 9 aa, Influenza virus
YRNMRWLTL

SEQ ID NO: 491178 - protein, 9 aa, Influenza virus
YRNNRKEPA

SEQ ID NO: 491179 - protein, 9 aa, Influenza virus
YRNTRKEPA

SEQ ID NO: 491180 - protein, 9 aa, Influenza virus
YRNVVWLIK

SEQ ID NO: 491181 - protein, 9 aa, Influenza virus
YRNWAKPQC

SEQ ID NO: 491182 - protein, 9 aa, Influenza virus
YRNWSKPQC

SEQ ID NO: 491183 - protein, 9 aa, Influenza virus
YRNWSMPQC

SEQ ID NO: 491184 - protein, 9 aa, Influenza virus
YRNWTKPQC

SEQ ID NO: 491185 - protein, 9 aa, Influenza virus
YRQEALQNR

SEQ ID NO: 491186 - protein, 9 aa, Influenza virus
YRQSFSPSP

SEQ ID NO: 491187 - protein, 9 aa, Influenza virus
YRRPIGISS

SEQ ID NO: 491188 - protein, 9 aa, Influenza virus
YRRPVGISS

SEQ ID NO: 491189 - protein, 9 aa, Influenza virus
YRSINWLTK

SEQ ID NO: 491190 - protein, 9 aa, Influenza virus
YRSIRWLTL

SEQ ID NO: 491191 - protein, 9 aa, Influenza virus
YRSLIKFPI

SEQ ID NO: 491192 - protein, 9 aa, Influenza virus
YRSLIQFPI

SEQ ID NO: 491193 - protein, 9 aa, Influenza virus
YRSLIQFPM

SEQ ID NO: 491194 - protein, 9 aa, Influenza virus
YRSLIRFPI

SEQ ID NO: 491195 - protein, 9 aa, Influenza virus
YRSLIRFPV

SEQ ID NO: 491196 - protein, 9 aa, Influenza virus
YRSLISWPL

SEQ ID NO: 491197 - protein, 9 aa, Influenza virus
YRSMKWLTL

SEQ ID NO: 491198 - protein, 9 aa, Influenza virus
YRSMRWLTL

SEQ ID NO: 491199 - protein, 9 aa, Influenza virus
YRSWSKPQC

SEQ ID NO: 491200 - protein, 9 aa, Influenza virus
YRTCKLLGI

SEQ ID NO: 491201 - protein, 9 aa, Influenza virus
YRTCKLVGI

SEQ ID NO: 491202 - protein, 9 aa, Influenza virus
YRTESLQNR

SEQ ID NO: 491203 - protein, 9 aa, Influenza virus
YRTLLMNEL

SEQ ID NO: 491204 - protein, 9 aa, Influenza virus
YRTLLMSEL

SEQ ID NO: 491205 - protein, 9 aa, Influenza virus
YRVGYLCAG

SEQ ID NO: 491206 - protein, 9 aa, Influenza virus
YRYGFVANF

SEQ ID NO: 491207 - protein, 9 aa, Influenza virus
YRYTYRCHK

SEQ ID NO: 491208 - protein, 9 aa, Influenza virus
YRYTYRCHR

SEQ ID NO: 491209 - protein, 9 aa, Influenza virus
YSAGALASC

SEQ ID NO: 491210 - protein, 9 aa, Influenza virus
YSCIASSIV

SEQ ID NO: 491211 - protein, 9 aa, Influenza virus
YSCIASSLI

SEQ ID NO: 491212 - protein, 9 aa, Influenza virus
YSCIASSLV

SEQ ID NO: 491213 - protein, 9 aa, Influenza virus
YSCIASSTV

SEQ ID NO: 491214 - protein, 9 aa, Influenza virus
YSCIASSVV

SEQ ID NO: 491215 - protein, 9 aa, Influenza virus
YSCVASSLV

SEQ ID NO: 491216 - protein, 9 aa, Influenza virus
YSDFHFIDE

SEQ ID NO: 491217 - protein, 9 aa, Influenza virus
YSDFHFINE

SEQ ID NO: 491218 - protein, 9 aa, Influenza virus
YSEMKWLLS

SEQ ID NO: 491219 - protein, 9 aa, Influenza virus
YSEMKWLSS

SEQ ID NO: 491220 - protein, 9 aa, Influenza virus
YSETVRVET

SEQ ID NO: 491221 - protein, 9 aa, Influenza virus
YSGAFIDYW

SEQ ID NO: 491222 - protein, 9 aa, Influenza virus
YSGAFMDYW

SEQ ID NO: 491223 - protein, 9 aa, Influenza virus
YSGAFTIPI

SEQ ID NO: 491224 - protein, 9 aa, Influenza virus
YSGAFTIPT

SEQ ID NO: 491225 - protein, 9 aa, Influenza virus
YSGAFTIPV

SEQ ID NO: 491226 - protein, 9 aa, Influenza virus
YSGAFTVPI

SEQ ID NO: 491227 - protein, 9 aa, Influenza virus
YSGAFVDYW

SEQ ID NO: 491228 - protein, 9 aa, Influenza virus
YSGFVRTLF

SEQ ID NO: 491229 - protein, 9 aa, Influenza virus
YSGGTINSP

SEQ ID NO: 491230 - protein, 9 aa, Influenza virus
YSGIFSVEG

SEQ ID NO: 491231 - protein, 9 aa, Influenza virus
YSGIFSVEH

SEQ ID NO: 491232 - protein, 9 aa, Influenza virus
YSGIFSVEN

SEQ ID NO: 491233 - protein, 9 aa, Influenza virus
YSGIFSVES

SEQ ID NO: 491234 - protein, 9 aa, Influenza virus
YSGIKTDGA

SEQ ID NO: 491235 - protein, 9 aa, Influenza virus
YSGIRTDGA

SEQ ID NO: 491236 - protein, 9 aa, Influenza virus
YSGIRTNGA

SEQ ID NO: 491237 - protein, 9 aa, Influenza virus
YSGIRTNGT

SEQ ID NO: 491238 - protein, 9 aa, Influenza virus
YSGIRTNGV

SEQ ID NO: 491239 - protein, 9 aa, Influenza virus
YSGSFIDYW

SEQ ID NO: 491240 - protein, 9 aa, Influenza virus
YSGSFIQHP

SEQ ID NO: 491241 - protein, 9 aa, Influenza virus
YSGSFMDYW

SEQ ID NO: 491242 - protein, 9 aa, Influenza virus
YSGSFSIRG

SEQ ID NO: 491243 - protein, 9 aa, Influenza virus
YSGSFSIRW

SEQ ID NO: 491244 - protein, 9 aa, Influenza virus
YSGSFTIPT

SEQ ID NO: 491245 - protein, 9 aa, Influenza virus
YSGSFTLPI

SEQ ID NO: 491246 - protein, 9 aa, Influenza virus
YSGSFTLPV

SEQ ID NO: 491247 - protein, 9 aa, Influenza virus
YSGSFVDYW

SEQ ID NO: 491248 - protein, 9 aa, Influenza virus
YSGSFVQHP

SEQ ID NO: 491249 - protein, 9 aa, Influenza virus
YSGVFSVEG

SEQ ID NO: 491250 - protein, 9 aa, Influenza virus
YSHGTGTGY

SEQ ID NO: 491251 - protein, 9 aa, Influenza virus
YSIADKICI

SEQ ID NO: 491252 - protein, 9 aa, Influenza virus
YSIDSGYVC

SEQ ID NO: 491253 - protein, 9 aa, Influenza virus
YSIDSNYVC

SEQ ID NO: 491254 - protein, 9 aa, Influenza virus
YSIDSSYIC

SEQ ID NO: 491255 - protein, 9 aa, Influenza virus
YSIDSSYVC

SEQ ID NO: 491256 - protein, 9 aa, Influenza virus
YSKADKICI

SEQ ID NO: 491257 - protein, 9 aa, Influenza virus
YSKDNGIRI

SEQ ID NO: 491258 - protein, 9 aa, Influenza virus
YSKDNSIRI

SEQ ID NO: 491259 - protein, 9 aa, Influenza virus
YSKDNSVRI

SEQ ID NO: 491260 - protein, 9 aa, Influenza virus
YSKVYKTYF

SEQ ID NO: 491261 - protein, 9 aa, Influenza virus
YSKYEEESK

SEQ ID NO: 491262 - protein, 9 aa, Influenza virus
YSLPPNFSS

SEQ ID NO: 491263 - protein, 9 aa, Influenza virus
YSLVGIDPF

SEQ ID NO: 491264 - protein, 9 aa, Influenza virus
YSLVGVDPF

SEQ ID NO: 491265 - protein, 9 aa, Influenza virus
YSQITNGTT

SEQ ID NO: 491266 - protein, 9 aa, Influenza virus
YSRADKICI

SEQ ID NO: 491267 - protein, 9 aa, Influenza virus
YSSPMMWEI

SEQ ID NO: 491268 - protein, 9 aa, Influenza virus
YSSPQLEGF

SEQ ID NO: 491269 - protein, 9 aa, Influenza virus
YSSSLMWEI

SEQ ID NO: 491270 - protein, 9 aa, Influenza virus
YSSSMMWEI

SEQ ID NO: 491271 - protein, 9 aa, Influenza virus
YSSSMMWEV

SEQ ID NO: 491272 - protein, 9 aa, Influenza virus
YSSVASSLV

SEQ ID NO: 491273 - protein, 9 aa, Influenza virus
YSTAASSLA

SEQ ID NO: 491274 - protein, 9 aa, Influenza virus
YSTAASSLV

SEQ ID NO: 491275 - protein, 9 aa, Influenza virus
YSTGALASC

SEQ ID NO: 491276 - protein, 9 aa, Influenza virus
YSTISSSLV

SEQ ID NO: 491277 - protein, 9 aa, Influenza virus
YSTVAASLC

SEQ ID NO: 491278 - protein, 9 aa, Influenza virus
YSTVASSLA

SEQ ID NO: 491279 - protein, 9 aa, Influenza virus
YSTVASSLT

SEQ ID NO: 491280 - protein, 9 aa, Influenza virus
YSTVASSLV

SEQ ID NO: 491281 - protein, 9 aa, Influenza virus
YSTVASSSV

SEQ ID NO: 491282 - protein, 9 aa, Influenza virus
YSTVSSSLV

SEQ ID NO: 491283 - protein, 9 aa, Influenza virus
YSTVVSSLA

SEQ ID NO: 491284 - protein, 9 aa, Influenza virus
YSVGYLCAG

SEQ ID NO: 491285 - protein, 9 aa, Influenza virus
YTENPVICL

SEQ ID NO: 491286 - protein, 9 aa, Influenza virus
YTGAINSSK

SEQ ID NO: 491287 - protein, 9 aa, Influenza virus
YTGAINSSR

SEQ ID NO: 491288 - protein, 9 aa, Influenza virus
YTGDPPYSH

SEQ ID NO: 491289 - protein, 9 aa, Influenza virus
YTGISKACN

SEQ ID NO: 491290 - protein, 9 aa, Influenza virus
YTGNLVICL

SEQ ID NO: 491291 - protein, 9 aa, Influenza virus
YTGNPVICL

SEQ ID NO: 491292 - protein, 9 aa, Influenza virus
YTGNPVICM

SEQ ID NO: 491293 - protein, 9 aa, Influenza virus
YTGSFCSID

SEQ ID NO: 491294 - protein, 9 aa, Influenza virus
YTGTSKACN

SEQ ID NO: 491295 - protein, 9 aa, Influenza virus
YTGTSRACN

SEQ ID NO: 491296 - protein, 9 aa, Influenza virus
YTIDEESRA

SEQ ID NO: 491297 - protein, 9 aa, Influenza virus
YTKCQTYAG

SEQ ID NO: 491298 - protein, 9 aa, Influenza virus
YTKDNSIRI

SEQ ID NO: 491299 - protein, 9 aa, Influenza virus
YTKIMYFHK

SEQ ID NO: 491300 - protein, 9 aa, Influenza virus
YTKVLYFHK

SEQ ID NO: 491301 - protein, 9 aa, Influenza virus
YTKVMYFHK

SEQ ID NO: 491302 - protein, 9 aa, Influenza virus
YTLDEESRA

SEQ ID NO: 491303 - protein, 9 aa, Influenza virus
YTLITDGPS

SEQ ID NO: 491304 - protein, 9 aa, Influenza virus
YTLMTDGPS

SEQ ID NO: 491305 - protein, 9 aa, Influenza virus
YTLVSTGSW

SEQ ID NO: 491306 - protein, 9 aa, Influenza virus
YTLVSTKEW

SEQ ID NO: 491307 - protein, 9 aa, Influenza virus
YTLVSTKSW

SEQ ID NO: 491308 - protein, 9 aa, Influenza virus
YTLVSTRSW

SEQ ID NO: 491309 - protein, 9 aa, Influenza virus
YTLVSTSSW

SEQ ID NO: 491310 - protein, 9 aa, Influenza virus
YTLVTDGPS

SEQ ID NO: 491311 - protein, 9 aa, Influenza virus
YTLVTTSSW

SEQ ID NO: 491312 - protein, 9 aa, Influenza virus
YTMDTVNRT

SEQ ID NO: 491313 - protein, 9 aa, Influenza virus
YTMDTVSRT

SEQ ID NO: 491314 - protein, 9 aa, Influenza virus
YTPGGEVIN

SEQ ID NO: 491315 - protein, 9 aa, Influenza virus
YTPGGEVKN

SEQ ID NO: 491316 - protein, 9 aa, Influenza virus
YTPGGEVRN

SEQ ID NO: 491317 - protein, 9 aa, Influenza virus
YTPGGGVRN

SEQ ID NO: 491318 - protein, 9 aa, Influenza virus
YTPGGKVRN

SEQ ID NO: 491319 - protein, 9 aa, Influenza virus
YTRLYIWGV

SEQ ID NO: 491320 - protein, 9 aa, Influenza virus
YTSARQEKN

SEQ ID NO: 491321 - protein, 9 aa, Influenza virus
YTSGRQEKN

SEQ ID NO: 491322 - protein, 9 aa, Influenza virus
YTVGYLCAG

SEQ ID NO: 491323 - protein, 9 aa, Influenza virus
YTYRCHKGD

SEQ ID NO: 491324 - protein, 9 aa, Influenza virus
YTYRCHRGD

SEQ ID NO: 491325 - protein, 9 aa, Influenza virus
YVCSGIFGD

SEQ ID NO: 491326 - protein, 9 aa, Influenza virus
YVCSGLVGD

SEQ ID NO: 491327 - protein, 9 aa, Influenza virus
YVCSGVFGD

SEQ ID NO: 491328 - protein, 9 aa, Influenza virus
YVCSKFHSD

SEQ ID NO: 491329 - protein, 9 aa, Influenza virus
YVCTGILTD

SEQ ID NO: 491330 - protein, 9 aa, Influenza virus
YVCTGVLTD

SEQ ID NO: 491331 - protein, 9 aa, Influenza virus
YVDGFEPNG

SEQ ID NO: 491332 - protein, 9 aa, Influenza virus
YVDGFKPNG

SEQ ID NO: 491333 - protein, 9 aa, Influenza virus
YVEDTKIDL

SEQ ID NO: 491334 - protein, 9 aa, Influenza virus
YVEDTKVDL

SEQ ID NO: 491335 - protein, 9 aa, Influenza virus
YVELIRGKP

SEQ ID NO: 491336 - protein, 9 aa, Influenza virus
YVELIRGMP

SEQ ID NO: 491337 - protein, 9 aa, Influenza virus
YVELIRGRE

SEQ ID NO: 491338 - protein, 9 aa, Influenza virus
YVELIRGRK

SEQ ID NO: 491339 - protein, 9 aa, Influenza virus
YVELIRGRL

SEQ ID NO: 491340 - protein, 9 aa, Influenza virus
YVELIRGRN

SEQ ID NO: 491341 - protein, 9 aa, Influenza virus
YVELIRGRP

SEQ ID NO: 491342 - protein, 9 aa, Influenza virus
YVELIRGRQ

SEQ ID NO: 491343 - protein, 9 aa, Influenza virus
YVELIRGRR

SEQ ID NO: 491344 - protein, 9 aa, Influenza virus
YVELIRGRS

SEQ ID NO: 491345 - protein, 9 aa, Influenza virus
YVELVRGRP

SEQ ID NO: 491346 - protein, 9 aa, Influenza virus
YVEMIRGRP

SEQ ID NO: 491347 - protein, 9 aa, Influenza virus
YVEVLHLTQ

SEQ ID NO: 491348 - protein, 9 aa, Influenza virus
YVEWTSNSL

SEQ ID NO: 491349 - protein, 9 aa, Influenza virus
YVKKASLRL

SEQ ID NO: 491350 - protein, 9 aa, Influenza virus
YVKKESLRL

SEQ ID NO: 491351 - protein, 9 aa, Influenza virus
YVKQGSLKL

SEQ ID NO: 491352 - protein, 9 aa, Influenza virus
YVKQGSLML

SEQ ID NO: 491353 - protein, 9 aa, Influenza virus
YVKQGSLRL

SEQ ID NO: 491354 - protein, 9 aa, Influenza virus
YVKQKTLKL

SEQ ID NO: 491355 - protein, 9 aa, Influenza virus
YVKQNTLKL

SEQ ID NO: 491356 - protein, 9 aa, Influenza virus
YVKQSSLPL

SEQ ID NO: 491357 - protein, 9 aa, Influenza virus
YVKQSTLKL

SEQ ID NO: 491358 - protein, 9 aa, Influenza virus
YVKSDRLVL

SEQ ID NO: 491359 - protein, 9 aa, Influenza virus
YVKSEKLVL

SEQ ID NO: 491360 - protein, 9 aa, Influenza virus
YVKSERLVL

SEQ ID NO: 491361 - protein, 9 aa, Influenza virus
YVLSIIPSG

SEQ ID NO: 491362 - protein, 9 aa, Influenza virus
YVLSIVPSG

SEQ ID NO: 491363 - protein, 9 aa, Influenza virus
YVLSVIPSG

SEQ ID NO: 491364 - protein, 9 aa, Influenza virus
YVNIKSLKL

SEQ ID NO: 491365 - protein, 9 aa, Influenza virus
YVNKNPYTL

SEQ ID NO: 491366 - protein, 9 aa, Influenza virus
YVNNTTIIN

SEQ ID NO: 491367 - protein, 9 aa, Influenza virus
YVNNTTIIS

SEQ ID NO: 491368 - protein, 9 aa, Influenza virus
YVNNTTIIT

SEQ ID NO: 491369 - protein, 9 aa, Influenza virus
YVNNTTVIN

SEQ ID NO: 491370 - protein, 9 aa, Influenza virus
YVNNTTVIS

SEQ ID NO: 491371 - protein, 9 aa, Influenza virus
YVNTALLNA

SEQ ID NO: 491372 - protein, 9 aa, Influenza virus
YVNVKSLKL

SEQ ID NO: 491373 - protein, 9 aa, Influenza virus
YVNVRSLKL

SEQ ID NO: 491374 - protein, 9 aa, Influenza virus
YVQMCTELK

SEQ ID NO: 491375 - protein, 9 aa, Influenza virus
YVRKASLRL

SEQ ID NO: 491376 - protein, 9 aa, Influenza virus
YVRLYLWGV

SEQ ID NO: 491377 - protein, 9 aa, Influenza virus
YVRQNTLKL

SEQ ID NO: 491378 - protein, 9 aa, Influenza virus
YVRSEKLVL

SEQ ID NO: 491379 - protein, 9 aa, Influenza virus
YVRTNGTSK

SEQ ID NO: 491380 - protein, 9 aa, Influenza virus
YVSCDPDEC

SEQ ID NO: 491381 - protein, 9 aa, Influenza virus
YVSCDPDGC

SEQ ID NO: 491382 - protein, 9 aa, Influenza virus
YVSCDPLGC

SEQ ID NO: 491383 - protein, 9 aa, Influenza virus
YVSCDPSGC

SEQ ID NO: 491384 - protein, 9 aa, Influenza virus
YVSCDPTGC

SEQ ID NO: 491385 - protein, 9 aa, Influenza virus
YVSCEPDEC

SEQ ID NO: 491386 - protein, 9 aa, Influenza virus
YVSIGTSTL

SEQ ID NO: 491387 - protein, 9 aa, Influenza virus
YVSMEFSLT

SEQ ID NO: 491388 - protein, 9 aa, Influenza virus
YVSVGTSTL

SEQ ID NO: 491389 - protein, 9 aa, Influenza virus
YVWWASNSL

SEQ ID NO: 491390 - protein, 9 aa, Influenza virus
YVWWTSNSL

SEQ ID NO: 491391 - protein, 9 aa, Influenza virus
YWAEGDCYR

SEQ ID NO: 491392 - protein, 9 aa, Influenza virus
YWAEGECYR

SEQ ID NO: 491393 - protein, 9 aa, Influenza virus
YWAILKPGQ

SEQ ID NO: 491394 - protein, 9 aa, Influenza virus
YWAIRTRSG

SEQ ID NO: 491395 - protein, 9 aa, Influenza virus
YWAKEECYR

SEQ ID NO: 491396 - protein, 9 aa, Influenza virus
YWAKGDCYR

SEQ ID NO: 491397 - protein, 9 aa, Influenza virus
YWAKGECYR

SEQ ID NO: 491398 - protein, 9 aa, Influenza virus
YWAVLKPGQ

SEQ ID NO: 491399 - protein, 9 aa, Influenza virus
YWGILKRGE

SEQ ID NO: 491400 - protein, 9 aa, Influenza virus
YWHLMHPGE

SEQ ID NO: 491401 - protein, 9 aa, Influenza virus
YWHLMRPGE

SEQ ID NO: 491402 - protein, 9 aa, Influenza virus
YWHLMSPGE

SEQ ID NO: 491403 - protein, 9 aa, Influenza virus
YWMCSNGSL

SEQ ID NO: 491404 - protein, 9 aa, Influenza virus
YWNWSKPQC

SEQ ID NO: 491405 - protein, 9 aa, Influenza virus
YWTIVDPGD

SEQ ID NO: 491406 - protein, 9 aa, Influenza virus
YWTIVEPED

SEQ ID NO: 491407 - protein, 9 aa, Influenza virus
YWTIVEPGD

SEQ ID NO: 491408 - protein, 9 aa, Influenza virus
YWTIVKPGD

SEQ ID NO: 491409 - protein, 9 aa, Influenza virus
YWTIVKSGD

SEQ ID NO: 491410 - protein, 9 aa, Influenza virus
YWTLVNPGD

SEQ ID NO: 491411 - protein, 9 aa, Influenza virus
YWTVVKPGD

SEQ ID NO: 491412 - protein, 9 aa, Influenza virus
YWVMTDGPA

SEQ ID NO: 491413 - protein, 9 aa, Influenza virus
YWWDGLQSS

SEQ ID NO: 491414 - protein, 9 aa, Influenza virus
YYDRRLTTT

SEQ ID NO: 491415 - protein, 9 aa, Influenza virus
YYEECSCYP

SEQ ID NO: 491416 - protein, 9 aa, Influenza virus
YYFVKEGKI

SEQ ID NO: 491417 - protein, 9 aa, Influenza virus
YYLEKANKI

SEQ ID NO: 491418 - protein, 9 aa, Influenza virus
YYLEKASKI

SEQ ID NO: 491419 - protein, 9 aa, Influenza virus
YYMGECPKY

SEQ ID NO: 491420 - protein, 9 aa, Influenza virus
YYNETFVNI

SEQ ID NO: 491421 - protein, 9 aa, Influenza virus
YYNETFVNV

SEQ ID NO: 491422 - protein, 9 aa, Influenza virus
YYNGRLTTT

SEQ ID NO: 491423 - protein, 9 aa, Influenza virus
YYNGRSSFF

SEQ ID NO: 491424 - protein, 9 aa, Influenza virus
YYNKRLTTT

SEQ ID NO: 491425 - protein, 9 aa, Influenza virus
YYNRRLTTT

SEQ ID NO: 491426 - protein, 9 aa, Influenza virus
YYNRRPTTT

SEQ ID NO: 491427 - protein, 9 aa, Influenza virus
YYPKYEEES

SEQ ID NO: 491428 - protein, 9 aa, Influenza virus
YYWAILKPG

SEQ ID NO: 491429 - protein, 9 aa, Influenza virus
YYWAVLKPG

SEQ ID NO: 491430 - protein, 9 aa, Influenza virus
YYWGILKRG

SEQ ID NO: 491431 - protein, 9 aa, Influenza virus
YYYEECSCY

SEQ ID NO: 491432 - protein, 9 aa, Influenza virus
YYYPKYEEE

SEQ ID NO: 491433 - protein, 10 aa, Influenza virus
AADKASTQKA

SEQ ID NO: 491434 - protein, 10 aa, Influenza virus
AADKDSTQKA

SEQ ID NO: 491435 - protein, 10 aa, Influenza virus
AADKESTQEA

SEQ ID NO: 491436 - protein, 10 aa, Influenza virus
AADKESTQKA

SEQ ID NO: 491437 - protein, 10 aa, Influenza virus
AADKESTQKT

SEQ ID NO: 491438 - protein, 10 aa, Influenza virus
AADKESTQRA

SEQ ID NO: 491439 - protein, 10 aa, Influenza virus
AADKESTQTA

SEQ ID NO: 491440 - protein, 10 aa, Influenza virus
AADKKSTQKA

SEQ ID NO: 491441 - protein, 10 aa, Influenza virus
AADKTSTQKA

SEQ ID NO: 491442 - protein, 10 aa, Influenza virus
AADKVSTQKA

SEQ ID NO: 491443 - protein, 10 aa, Influenza virus
AADLKSTQAA

SEQ ID NO: 491444 - protein, 10 aa, Influenza virus
AADLKSTQTA

SEQ ID NO: 491445 - protein, 10 aa, Influenza virus
AADQESTQKA

SEQ ID NO: 491446 - protein, 10 aa, Influenza virus
AADQKSTQEA

SEQ ID NO: 491447 - protein, 10 aa, Influenza virus
AADRDSTQKA

SEQ ID NO: 491448 - protein, 10 aa, Influenza virus
AADRDSTQMA

SEQ ID NO: 491449 - protein, 10 aa, Influenza virus
AADRDSTQRA

SEQ ID NO: 491450 - protein, 10 aa, Influenza virus
AADRESTQKA

SEQ ID NO: 491451 - protein, 10 aa, Influenza virus
AADRESTQRA

SEQ ID NO: 491452 - protein, 10 aa, Influenza virus
AADRGSTQKA

SEQ ID NO: 491453 - protein, 10 aa, Influenza virus
AADRKSTQKA

SEQ ID NO: 491454 - protein, 10 aa, Influenza virus
AADYESTQAA

SEQ ID NO: 491455 - protein, 10 aa, Influenza virus
AADYKSTPSA

SEQ ID NO: 491456 - protein, 10 aa, Influenza virus
AADYKSTQAA

SEQ ID NO: 491457 - protein, 10 aa, Influenza virus
AADYKSTQKT

SEQ ID NO: 491458 - protein, 10 aa, Influenza virus
AADYKSTQSA

SEQ ID NO: 491459 - protein, 10 aa, Influenza virus
AADYKSTQTA

SEQ ID NO: 491460 - protein, 10 aa, Influenza virus
AAEKESTQKA

SEQ ID NO: 491461 - protein, 10 aa, Influenza virus
AAGAAIKGVG

SEQ ID NO: 491462 - protein, 10 aa, Influenza virus
AAGAAVKGIG

SEQ ID NO: 491463 - protein, 10 aa, Influenza virus
AAGAAVKGVG

SEQ ID NO: 491464 - protein, 10 aa, Influenza virus
AAGFHFEECS

SEQ ID NO: 491465 - protein, 10 aa, Influenza virus
AAGGDIWVTR

SEQ ID NO: 491466 - protein, 10 aa, Influenza virus
AAICTHLEIC

SEQ ID NO: 491467 - protein, 10 aa, Influenza virus
AAICTHLEVC

SEQ ID NO: 491468 - protein, 10 aa, Influenza virus
AAICTHMEVC

SEQ ID NO: 491469 - protein, 10 aa, Influenza virus
AAIDQINGKL

SEQ ID NO: 491470 - protein, 10 aa, Influenza virus
AAIDQISGKL

SEQ ID NO: 491471 - protein, 10 aa, Influenza virus
AAIDQITGKL

SEQ ID NO: 491472 - protein, 10 aa, Influenza virus
AAIDQVNGKL

SEQ ID NO: 491473 - protein, 10 aa, Influenza virus
AAIGLRISSS

SEQ ID NO: 491474 - protein, 10 aa, Influenza virus
AALGLRISSS

SEQ ID NO: 491475 - protein, 10 aa, Influenza virus
AALGSPGCDH

SEQ ID NO: 491476 - protein, 10 aa, Influenza virus
AAMDDFQLIP

SEQ ID NO: 491477 - protein, 10 aa, Influenza virus
AAMDEFQLIP

SEQ ID NO: 491478 - protein, 10 aa, Influenza virus
AAMEDFQLIP

SEQ ID NO: 491479 - protein, 10 aa, Influenza virus
AAMGLKISSS

SEQ ID NO: 491480 - protein, 10 aa, Influenza virus
AAMGLRISSS

SEQ ID NO: 491481 - protein, 10 aa, Influenza virus
AAMGMRISSS

SEQ ID NO: 491482 - protein, 10 aa, Influenza virus
AANNADHRIY

SEQ ID NO: 491483 - protein, 10 aa, Influenza virus
AANPIVPSFD

SEQ ID NO: 491484 - protein, 10 aa, Influenza virus
AANSADHRIY

SEQ ID NO: 491485 - protein, 10 aa, Influenza virus
AANSADHRVY

SEQ ID NO: 491486 - protein, 10 aa, Influenza virus
AANSAHHRVY

SEQ ID NO: 491487 - protein, 10 aa, Influenza virus
AAPHGLCYPG

SEQ ID NO: 491488 - protein, 10 aa, Influenza virus
AAQKAMMDQV

SEQ ID NO: 491489 - protein, 10 aa, Influenza virus
AAQRAMMDQV

SEQ ID NO: 491490 - protein, 10 aa, Influenza virus
AAQRAMVDQV

SEQ ID NO: 491491 - protein, 10 aa, Influenza virus
AARNIVRRAA

SEQ ID NO: 491492 - protein, 10 aa, Influenza virus
AARNIVRRAI

SEQ ID NO: 491493 - protein, 10 aa, Influenza virus
AARNIVRRAT

SEQ ID NO: 491494 - protein, 10 aa, Influenza virus
AARSIVRRAT

SEQ ID NO: 491495 - protein, 10 aa, Influenza virus
AASLCLAILI

SEQ ID NO: 491496 - protein, 10 aa, Influenza virus
AASLCLAILV

SEQ ID NO: 491497 - protein, 10 aa, Influenza virus
AASLCLAVLI

SEQ ID NO: 491498 - protein, 10 aa, Influenza virus
AASLSPGMMM

SEQ ID NO: 491499 - protein, 10 aa, Influenza virus
AASYKRIRLF

SEQ ID NO: 491500 - protein, 10 aa, Influenza virus
AASYKRVRLF

SEQ ID NO: 491501 - protein, 10 aa, Influenza virus
AATALANTIE

SEQ ID NO: 491502 - protein, 10 aa, Influenza virus
AATLCLGHHA

SEQ ID NO: 491503 - protein, 10 aa, Influenza virus
AATQTLVSNN

SEQ ID NO: 491504 - protein, 10 aa, Influenza virus
AATVTLHFKQ

SEQ ID NO: 491505 - protein, 10 aa, Influenza virus
AAVDQITGKL

SEQ ID NO: 491506 - protein, 10 aa, Influenza virus
AAVSADPLAS

SEQ ID NO: 491507 - protein, 10 aa, Influenza virus
AAWSSSSCFD

SEQ ID NO: 491508 - protein, 10 aa, Influenza virus
AAWSSSSCHD

SEQ ID NO: 491509 - protein, 10 aa, Influenza virus
ACFQPCFYVE

SEQ ID NO: 491510 - protein, 10 aa, Influenza virus
ACFYVELIRG

SEQ ID NO: 491511 - protein, 10 aa, Influenza virus
ACGNGSCRCT

SEQ ID NO: 491512 - protein, 10 aa, Influenza virus
ACGPAECRTF

SEQ ID NO: 491513 - protein, 10 aa, Influenza virus
ACGPSECRTF

SEQ ID NO: 491514 - protein, 10 aa, Influenza virus
ACGPTECRTF

SEQ ID NO: 491515 - protein, 10 aa, Influenza virus
ACHDGKKWMA

SEQ ID NO: 491516 - protein, 10 aa, Influenza virus
ACHDGKKWMT

SEQ ID NO: 491517 - protein, 10 aa, Influenza virus
ACHDGKKWTT

SEQ ID NO: 491518 - protein, 10 aa, Influenza virus
ACHDGNKWMT

SEQ ID NO: 491519 - protein, 10 aa, Influenza virus
ACHDGRKWMT

SEQ ID NO: 491520 - protein, 10 aa, Influenza virus
ACHSAAFEDL

SEQ ID NO: 491521 - protein, 10 aa, Influenza virus
ACITPNGSIP

SEQ ID NO: 491522 - protein, 10 aa, Influenza virus
ACKRTVSSFY

SEQ ID NO: 491523 - protein, 10 aa, Influenza virus
ACLRGGRNSF

SEQ ID NO: 491524 - protein, 10 aa, Influenza virus
ACNALTGGQS

SEQ ID NO: 491525 - protein, 10 aa, Influenza virus
ACNASTGAQS

SEQ ID NO: 491526 - protein, 10 aa, Influenza virus
ACNASTGGQA

SEQ ID NO: 491527 - protein, 10 aa, Influenza virus
ACNASTGGQS

SEQ ID NO: 491528 - protein, 10 aa, Influenza virus
ACNNGSCRCT

SEQ ID NO: 491529 - protein, 10 aa, Influenza virus
ACNSAAFEDL

SEQ ID NO: 491530 - protein, 10 aa, Influenza virus
ACQKGNIKCN

SEQ ID NO: 491531 - protein, 10 aa, Influenza virus
ACQKGNIRCD

SEQ ID NO: 491532 - protein, 10 aa, Influenza virus
ACQKGNIRCN

SEQ ID NO: 491533 - protein, 10 aa, Influenza virus
ACQNGNIRCQ

SEQ ID NO: 491534 - protein, 10 aa, Influenza virus
ACQNGNLRCQ

SEQ ID NO: 491535 - protein, 10 aa, Influenza virus
ACQNGNVRCQ

SEQ ID NO: 491536 - protein, 10 aa, Influenza virus
ACQRGNIRCN

SEQ ID NO: 491537 - protein, 10 aa, Influenza virus
ACQTGNIRCQ

SEQ ID NO: 491538 - protein, 10 aa, Influenza virus
ACSASTGGQS

SEQ ID NO: 491539 - protein, 10 aa, Influenza virus
ACSDGPGWLT

SEQ ID NO: 491540 - protein, 10 aa, Influenza virus
ACSDGSGWLT

SEQ ID NO: 491541 - protein, 10 aa, Influenza virus
ACSNGNCRFN

SEQ ID NO: 491542 - protein, 10 aa, Influenza virus
ACSNGSCRCT

SEQ ID NO: 491543 - protein, 10 aa, Influenza virus
ACSNGSCRFN

SEQ ID NO: 491544 - protein, 10 aa, Influenza virus
ACSPSECRTF

SEQ ID NO: 491545 - protein, 10 aa, Influenza virus
ACSSGNCRFN

SEQ ID NO: 491546 - protein, 10 aa, Influenza virus
ACSSGNCRFS

SEQ ID NO: 491547 - protein, 10 aa, Influenza virus
ACWEQLYTPG

SEQ ID NO: 491548 - protein, 10 aa, Influenza virus
ACYNPCFYVE

SEQ ID NO: 491549 - protein, 10 aa, Influenza virus
ADAQHRSHRQ

SEQ ID NO: 491550 - protein, 10 aa, Influenza virus
ADDDAYAVIH

SEQ ID NO: 491551 - protein, 10 aa, Influenza virus
ADDEAYAVIH

SEQ ID NO: 491552 - protein, 10 aa, Influenza virus
ADEICIGHLS

SEQ ID NO: 491553 - protein, 10 aa, Influenza virus
ADEICIGYLS

SEQ ID NO: 491554 - protein, 10 aa, Influenza virus
ADEICIGYMS

SEQ ID NO: 491555 - protein, 10 aa, Influenza virus
ADFKSTQAAI

SEQ ID NO: 491556 - protein, 10 aa, Influenza virus
ADGDIWVTRE

SEQ ID NO: 491557 - protein, 10 aa, Influenza virus
ADGGPNLYNI

SEQ ID NO: 491558 - protein, 10 aa, Influenza virus
ADHPPKVAWS

SEQ ID NO: 491559 - protein, 10 aa, Influenza virus
ADHRIYWIRE

SEQ ID NO: 491560 - protein, 10 aa, Influenza virus
ADHRIYWIRK

SEQ ID NO: 491561 - protein, 10 aa, Influenza virus
ADHRVYWIRE

SEQ ID NO: 491562 - protein, 10 aa, Influenza virus
ADIKSHAYIS

SEQ ID NO: 491563 - protein, 10 aa, Influenza virus
ADINLHAYIS

SEQ ID NO: 491564 - protein, 10 aa, Influenza virus
ADINLMPIYS

SEQ ID NO: 491565 - protein, 10 aa, Influenza virus
ADKASTQKAI

SEQ ID NO: 491566 - protein, 10 aa, Influenza virus
ADKESTQKAF

SEQ ID NO: 491567 - protein, 10 aa, Influenza virus
ADKESTQKAI

SEQ ID NO: 491568 - protein, 10 aa, Influenza virus
ADKESTQKAV

SEQ ID NO: 491569 - protein, 10 aa, Influenza virus
ADKESTQRAF

SEQ ID NO: 491570 - protein, 10 aa, Influenza virus
ADKICIGYLS

SEQ ID NO: 491571 - protein, 10 aa, Influenza virus
ADKICLGHHA

SEQ ID NO: 491572 - protein, 10 aa, Influenza virus
ADKICLGRHA

SEQ ID NO: 491573 - protein, 10 aa, Influenza virus
ADKICVGYLS

SEQ ID NO: 491574 - protein, 10 aa, Influenza virus
ADKTSTQKAI

SEQ ID NO: 491575 - protein, 10 aa, Influenza virus
ADKVSTQKAI

SEQ ID NO: 491576 - protein, 10 aa, Influenza virus
ADKVSTQKAL

SEQ ID NO: 491577 - protein, 10 aa, Influenza virus
ADLEALMEWL

SEQ ID NO: 491578 - protein, 10 aa, Influenza virus
ADLIIERREG

SEQ ID NO: 491579 - protein, 10 aa, Influenza virus
ADLIIERRNS

SEQ ID NO: 491580 - protein, 10 aa, Influenza virus
ADLKSTQAAI

SEQ ID NO: 491581 - protein, 10 aa, Influenza virus
ADLKSTQAAV

SEQ ID NO: 491582 - protein, 10 aa, Influenza virus
ADLKSTQTAI

SEQ ID NO: 491583 - protein, 10 aa, Influenza virus
ADLLVAMENQ

SEQ ID NO: 491584 - protein, 10 aa, Influenza virus
ADLPFTQEQK

SEQ ID NO: 491585 - protein, 10 aa, Influenza virus
ADMSIGITVI

SEQ ID NO: 491586 - protein, 10 aa, Influenza virus
ADMSIGVAVI

SEQ ID NO: 491587 - protein, 10 aa, Influenza virus
ADMSIGVTVI

SEQ ID NO: 491588 - protein, 10 aa, Influenza virus
ADNDAYAVIH

SEQ ID NO: 491589 - protein, 10 aa, Influenza virus
ADNKADHRIY

SEQ ID NO: 491590 - protein, 10 aa, Influenza virus
ADPLASLLEM

SEQ ID NO: 491591 - protein, 10 aa, Influenza virus
ADPLLSLLEM

SEQ ID NO: 491592 - protein, 10 aa, Influenza virus
ADPLVSLLEM

SEQ ID NO: 491593 - protein, 10 aa, Influenza virus
ADQELGDAPF

SEQ ID NO: 491594 - protein, 10 aa, Influenza virus
ADQKSTQEAI

SEQ ID NO: 491595 - protein, 10 aa, Influenza virus
ADQSLPPNFP

SEQ ID NO: 491596 - protein, 10 aa, Influenza virus
ADQSLPPNFS

SEQ ID NO: 491597 - protein, 10 aa, Influenza virus
ADRDSTQKAI

SEQ ID NO: 491598 - protein, 10 aa, Influenza virus
ADRDSTQMAI

SEQ ID NO: 491599 - protein, 10 aa, Influenza virus
ADRDSTQRAI

SEQ ID NO: 491600 - protein, 10 aa, Influenza virus
ADRGSTQKAI

SEQ ID NO: 491601 - protein, 10 aa, Influenza virus
ADRICIGYLS

SEQ ID NO: 491602 - protein, 10 aa, Influenza virus
ADRICVGYLS

SEQ ID NO: 491603 - protein, 10 aa, Influenza virus
ADRIDDAVTD

SEQ ID NO: 491604 - protein, 10 aa, Influenza virus
ADRVDDAVTD

SEQ ID NO: 491605 - protein, 10 aa, Influenza virus
ADSEMDKLYE

SEQ ID NO: 491606 - protein, 10 aa, Influenza virus
ADSEMDKLYT

SEQ ID NO: 491607 - protein, 10 aa, Influenza virus
ADSEMLNLYD

SEQ ID NO: 491608 - protein, 10 aa, Influenza virus
ADSEMLNLYE

SEQ ID NO: 491609 - protein, 10 aa, Influenza virus
ADSEMNKLFE

SEQ ID NO: 491610 - protein, 10 aa, Influenza virus
ADSEMNKLYE

SEQ ID NO: 491611 - protein, 10 aa, Influenza virus
ADSEMNNLYE

SEQ ID NO: 491612 - protein, 10 aa, Influenza virus
ADSHHRSHRQ

SEQ ID NO: 491613 - protein, 10 aa, Influenza virus
ADSQHKSHRQ

SEQ ID NO: 491614 - protein, 10 aa, Influenza virus
ADSQHRSHRQ

SEQ ID NO: 491615 - protein, 10 aa, Influenza virus
ADTICIGYHA

SEQ ID NO: 491616 - protein, 10 aa, Influenza virus
ADTICVGYHA

SEQ ID NO: 491617 - protein, 10 aa, Influenza virus
ADTILERNVT

SEQ ID NO: 491618 - protein, 10 aa, Influenza virus
ADTKILFIEE

SEQ ID NO: 491619 - protein, 10 aa, Influenza virus
ADTLCIGYHA

SEQ ID NO: 491620 - protein, 10 aa, Influenza virus
ADTRILFIEE

SEQ ID NO: 491621 - protein, 10 aa, Influenza virus
ADTRILFIKE

SEQ ID NO: 491622 - protein, 10 aa, Influenza virus
ADTRILFIRE

SEQ ID NO: 491623 - protein, 10 aa, Influenza virus
ADTRILFVKE

SEQ ID NO: 491624 - protein, 10 aa, Influenza virus
ADVLVALENQ

SEQ ID NO: 491625 - protein, 10 aa, Influenza virus
ADWSWHDGAI

SEQ ID NO: 491626 - protein, 10 aa, Influenza virus
ADWSWHDGAV

SEQ ID NO: 491627 - protein, 10 aa, Influenza virus
ADWVDDAVTD

SEQ ID NO: 491628 - protein, 10 aa, Influenza virus
ADYESTQAAI

SEQ ID NO: 491629 - protein, 10 aa, Influenza virus
ADYKSTPSAI

SEQ ID NO: 491630 - protein, 10 aa, Influenza virus
ADYKSTQAAI

SEQ ID NO: 491631 - protein, 10 aa, Influenza virus
ADYKSTQAAV

SEQ ID NO: 491632 - protein, 10 aa, Influenza virus
ADYKSTQKTI

SEQ ID NO: 491633 - protein, 10 aa, Influenza virus
ADYKSTQSAI

SEQ ID NO: 491634 - protein, 10 aa, Influenza virus
ADYKSTQSAV

SEQ ID NO: 491635 - protein, 10 aa, Influenza virus
ADYKSTQTAI

SEQ ID NO: 491636 - protein, 10 aa, Influenza virus
AECRTFFLTQ

SEQ ID NO: 491637 - protein, 10 aa, Influenza virus
AEDKGNGCFE

SEQ ID NO: 491638 - protein, 10 aa, Influenza virus
AEDMGNGCFK

SEQ ID NO: 491639 - protein, 10 aa, Influenza virus
AEDMGNGCFR

SEQ ID NO: 491640 - protein, 10 aa, Influenza virus
AEDMGNGCFT

SEQ ID NO: 491641 - protein, 10 aa, Influenza virus
AEDMGNGCLK

SEQ ID NO: 491642 - protein, 10 aa, Influenza virus
AEDQGNGCFE

SEQ ID NO: 491643 - protein, 10 aa, Influenza virus
AEDRGNGCFE

SEQ ID NO: 491644 - protein, 10 aa, Influenza virus
AEEDCTGCFE

SEQ ID NO: 491645 - protein, 10 aa, Influenza virus
AEEDGKGCFE

SEQ ID NO: 491646 - protein, 10 aa, Influenza virus
AEEDGNGCFE

SEQ ID NO: 491647 - protein, 10 aa, Influenza virus
AEEDGRGCFE

SEQ ID NO: 491648 - protein, 10 aa, Influenza virus
AEEDGTGCFE

SEQ ID NO: 491649 - protein, 10 aa, Influenza virus
AEEMGNGCFK

SEQ ID NO: 491650 - protein, 10 aa, Influenza virus
AEESKLKRQE

SEQ ID NO: 491651 - protein, 10 aa, Influenza virus
AEFLVALENQ

SEQ ID NO: 491652 - protein, 10 aa, Influenza virus
AEFLVAMENQ

SEQ ID NO: 491653 - protein, 10 aa, Influenza virus
AEFLVAVENQ

SEQ ID NO: 491654 - protein, 10 aa, Influenza virus
AEGDCYRACF

SEQ ID NO: 491655 - protein, 10 aa, Influenza virus
AEGECYRACF

SEQ ID NO: 491656 - protein, 10 aa, Influenza virus
AEGIGIAADR

SEQ ID NO: 491657 - protein, 10 aa, Influenza virus
AEGTGIAADR

SEQ ID NO: 491658 - protein, 10 aa, Influenza virus
AEGTGMAADQ

SEQ ID NO: 491659 - protein, 10 aa, Influenza virus
AEGTGMAADR

SEQ ID NO: 491660 - protein, 10 aa, Influenza virus
AEGTGTAADL

SEQ ID NO: 491661 - protein, 10 aa, Influenza virus
AEIAQKLEDV

SEQ ID NO: 491662 - protein, 10 aa, Influenza virus
AEIAQRLEDV

SEQ ID NO: 491663 - protein, 10 aa, Influenza virus
AEIAQRLEGV

SEQ ID NO: 491664 - protein, 10 aa, Influenza virus
AEIAQRLENV

SEQ ID NO: 491665 - protein, 10 aa, Influenza virus
AEIAQRLESV

SEQ ID NO: 491666 - protein, 10 aa, Influenza virus
AEIEDLIFLA

SEQ ID NO: 491667 - protein, 10 aa, Influenza virus
AEIEDLIFLT

SEQ ID NO: 491668 - protein, 10 aa, Influenza virus
AEIEDLIFMA

SEQ ID NO: 491669 - protein, 10 aa, Influenza virus
AEIEDLIFSA

SEQ ID NO: 491670 - protein, 10 aa, Influenza virus
AEIEDLTFLA

SEQ ID NO: 491671 - protein, 10 aa, Influenza virus
AEILVALENQ

SEQ ID NO: 491672 - protein, 10 aa, Influenza virus
AEILVLMENE

SEQ ID NO: 491673 - protein, 10 aa, Influenza virus
AEINTWARNI

SEQ ID NO: 491674 - protein, 10 aa, Influenza virus
AEISHCRATE

SEQ ID NO: 491675 - protein, 10 aa, Influenza virus
AEKAMKEHGE

SEQ ID NO: 491676 - protein, 10 aa, Influenza virus
AEKAMKEYGE

SEQ ID NO: 491677 - protein, 10 aa, Influenza virus
AEKESTQKAI

SEQ ID NO: 491678 - protein, 10 aa, Influenza virus
AEKTMKEYGE

SEQ ID NO: 491679 - protein, 10 aa, Influenza virus
AELAEKAMKE

SEQ ID NO: 491680 - protein, 10 aa, Influenza virus
AELFVLMENE

SEQ ID NO: 491681 - protein, 10 aa, Influenza virus
AELIRGRPKE

SEQ ID NO: 491682 - protein, 10 aa, Influenza virus
AELIVLLENQ

SEQ ID NO: 491683 - protein, 10 aa, Influenza virus
AELKWLISKS

SEQ ID NO: 491684 - protein, 10 aa, Influenza virus
AELKWLVSKD

SEQ ID NO: 491685 - protein, 10 aa, Influenza virus
AELKWLVSKN

SEQ ID NO: 491686 - protein, 10 aa, Influenza virus
AELKWLVSKS

SEQ ID NO: 491687 - protein, 10 aa, Influenza virus
AELKWLVSKT

SEQ ID NO: 491688 - protein, 10 aa, Influenza virus
AELLIAMENQ

SEQ ID NO: 491689 - protein, 10 aa, Influenza virus
AELLILLENE

SEQ ID NO: 491690 - protein, 10 aa, Influenza virus
AELLVALENQ

SEQ ID NO: 491691 - protein, 10 aa, Influenza virus
AELLVAMENQ

SEQ ID NO: 491692 - protein, 10 aa, Influenza virus
AELLVLIENE

SEQ ID NO: 491693 - protein, 10 aa, Influenza virus
AELLVLIENQ

SEQ ID NO: 491694 - protein, 10 aa, Influenza virus
AELLVLLEDE

SEQ ID NO: 491695 - protein, 10 aa, Influenza virus
AELLVLLENE

SEQ ID NO: 491696 - protein, 10 aa, Influenza virus
AELLVLLENG

SEQ ID NO: 491697 - protein, 10 aa, Influenza virus
AELLVLLENQ

SEQ ID NO: 491698 - protein, 10 aa, Influenza virus
AELLVLLGNQ

SEQ ID NO: 491699 - protein, 10 aa, Influenza virus
AELLVLMENE

SEQ ID NO: 491700 - protein, 10 aa, Influenza virus
AELLVLMETE

SEQ ID NO: 491701 - protein, 10 aa, Influenza virus
AELPFTIDKS

SEQ ID NO: 491702 - protein, 10 aa, Influenza virus
AELPFTIDKY

SEQ ID NO: 491703 - protein, 10 aa, Influenza virus
AEMKWLLSNA

SEQ ID NO: 491704 - protein, 10 aa, Influenza virus
AEMKWLLSNN

SEQ ID NO: 491705 - protein, 10 aa, Influenza virus
AEMKWLLSNS

SEQ ID NO: 491706 - protein, 10 aa, Influenza virus
AEMKWLLSNT

SEQ ID NO: 491707 - protein, 10 aa, Influenza virus
AEMKWLLSSS

SEQ ID NO: 491708 - protein, 10 aa, Influenza virus
AEMKWLLSST

SEQ ID NO: 491709 - protein, 10 aa, Influenza virus
AEQFTWNGVK

SEQ ID NO: 491710 - protein, 10 aa, Influenza virus
AERAMKEYGE

SEQ ID NO: 491711 - protein, 10 aa, Influenza virus
AERGKLKRRA

SEQ ID NO: 491712 - protein, 10 aa, Influenza virus
AESRKLLLIA

SEQ ID NO: 491713 - protein, 10 aa, Influenza virus
AESRKLLLIT

SEQ ID NO: 491714 - protein, 10 aa, Influenza virus
AESRKLLLIV

SEQ ID NO: 491715 - protein, 10 aa, Influenza virus
AESRKLLLVV

SEQ ID NO: 491716 - protein, 10 aa, Influenza virus
AESRKMLLIV

SEQ ID NO: 491717 - protein, 10 aa, Influenza virus
AESSIKEKDM

SEQ ID NO: 491718 - protein, 10 aa, Influenza virus
AESSVKEKDL

SEQ ID NO: 491719 - protein, 10 aa, Influenza virus
AESSVKEKDM

SEQ ID NO: 491720 - protein, 10 aa, Influenza virus
AESSVREKDM

SEQ ID NO: 491721 - protein, 10 aa, Influenza virus
AEVLVLMENE

SEQ ID NO: 491722 - protein, 10 aa, Influenza virus
AEVSHCRATE

SEQ ID NO: 491723 - protein, 10 aa, Influenza virus
AEVSYCRATE

SEQ ID NO: 491724 - protein, 10 aa, Influenza virus
AFCGTSGTYG

SEQ ID NO: 491725 - protein, 10 aa, Influenza virus
AFCGVDSDTT

SEQ ID NO: 491726 - protein, 10 aa, Influenza virus
AFCGVNSDTT

SEQ ID NO: 491727 - protein, 10 aa, Influenza virus
AFDERRNKYL

SEQ ID NO: 491728 - protein, 10 aa, Influenza virus
AFDERRNRYL

SEQ ID NO: 491729 - protein, 10 aa, Influenza virus
AFFRNMVWLI

SEQ ID NO: 491730 - protein, 10 aa, Influenza virus
AFGLICATCE

SEQ ID NO: 491731 - protein, 10 aa, Influenza virus
AFGLVCATCE

SEQ ID NO: 491732 - protein, 10 aa, Influenza virus
AFGPVHFRNQ

SEQ ID NO: 491733 - protein, 10 aa, Influenza virus
AFIAPDRAGF

SEQ ID NO: 491734 - protein, 10 aa, Influenza virus
AFIAPDRASF

SEQ ID NO: 491735 - protein, 10 aa, Influenza virus
AFIAPDRATF

SEQ ID NO: 491736 - protein, 10 aa, Influenza virus
AFIAPDRVSF

SEQ ID NO: 491737 - protein, 10 aa, Influenza virus
AFIAPNRASF

SEQ ID NO: 491738 - protein, 10 aa, Influenza virus
AFICIKNGNM

SEQ ID NO: 491739 - protein, 10 aa, Influenza virus
AFILWACQNG

SEQ ID NO: 491740 - protein, 10 aa, Influenza virus
AFILWACQTG

SEQ ID NO: 491741 - protein, 10 aa, Influenza virus
AFILWACSSG

SEQ ID NO: 491742 - protein, 10 aa, Influenza virus
AFIMWACSNG

SEQ ID NO: 491743 - protein, 10 aa, Influenza virus
AFIMWACSSG

SEQ ID NO: 491744 - protein, 10 aa, Influenza virus
AFKFVSSDCS

SEQ ID NO: 491745 - protein, 10 aa, Influenza virus
AFKQGNSVWA

SEQ ID NO: 491746 - protein, 10 aa, Influenza virus
AFLTSSIVCP

SEQ ID NO: 491747 - protein, 10 aa, Influenza virus
AFMLWACQNG

SEQ ID NO: 491748 - protein, 10 aa, Influenza virus
AFRDNLEPGT

SEQ ID NO: 491749 - protein, 10 aa, Influenza virus
AFRGLISTHL

SEQ ID NO: 491750 - protein, 10 aa, Influenza virus
AFRGLISTPL

SEQ ID NO: 491751 - protein, 10 aa, Influenza virus
AFRGLISTQL

SEQ ID NO: 491752 - protein, 10 aa, Influenza virus
AFRGLMSTPL

SEQ ID NO: 491753 - protein, 10 aa, Influenza virus
AFSGMSANGD

SEQ ID NO: 491754 - protein, 10 aa, Influenza virus
AFSVQRNLPF

SEQ ID NO: 491755 - protein, 10 aa, Influenza virus
AFVAPDRVSF

SEQ ID NO: 491756 - protein, 10 aa, Influenza virus
AFVLWACQNG

SEQ ID NO: 491757 - protein, 10 aa, Influenza virus
AFYKILKIKK

SEQ ID NO: 491758 - protein, 10 aa, Influenza virus
AFYKILKIRK

SEQ ID NO: 491759 - protein, 10 aa, Influenza virus
AFYRSINWLT

SEQ ID NO: 491760 - protein, 10 aa, Influenza virus
AGAAIKGVGT

SEQ ID NO: 491761 - protein, 10 aa, Influenza virus
AGAAVKGIGT

SEQ ID NO: 491762 - protein, 10 aa, Influenza virus
AGAAVKGVGT

SEQ ID NO: 491763 - protein, 10 aa, Influenza virus
AGAGALAEDP

SEQ ID NO: 491764 - protein, 10 aa, Influenza virus
AGALASCMGL

SEQ ID NO: 491765 - protein, 10 aa, Influenza virus
AGDGCFEILH

SEQ ID NO: 491766 - protein, 10 aa, Influenza virus
AGFAPFSKDN

SEQ ID NO: 491767 - protein, 10 aa, Influenza virus
AGFHFEECSC

SEQ ID NO: 491768 - protein, 10 aa, Influenza virus
AGFIEGGWCG

SEQ ID NO: 491769 - protein, 10 aa, Influenza virus
AGFIEGGWPG

SEQ ID NO: 491770 - protein, 10 aa, Influenza virus
AGFIEGGWQG

SEQ ID NO: 491771 - protein, 10 aa, Influenza virus
AGFIEGGWSG

SEQ ID NO: 491772 - protein, 10 aa, Influenza virus
AGFIEGGWTG

SEQ ID NO: 491773 - protein, 10 aa, Influenza virus
AGFIEGRWPG

SEQ ID NO: 491774 - protein, 10 aa, Influenza virus
AGFIENGWEG

SEQ ID NO: 491775 - protein, 10 aa, Influenza virus
AGFIENGWQG

SEQ ID NO: 491776 - protein, 10 aa, Influenza virus
AGGAIWVTRE

SEQ ID NO: 491777 - protein, 10 aa, Influenza virus
AGGDIWATRE

SEQ ID NO: 491778 - protein, 10 aa, Influenza virus
AGGDIWITRE

SEQ ID NO: 491779 - protein, 10 aa, Influenza virus
AGGDIWVTRE

SEQ ID NO: 491780 - protein, 10 aa, Influenza virus
AGGDIWVTRV

SEQ ID NO: 491781 - protein, 10 aa, Influenza virus
AGGHIWVTRE

SEQ ID NO: 491782 - protein, 10 aa, Influenza virus
AGGLILGMQN

SEQ ID NO: 491783 - protein, 10 aa, Influenza virus
AGGNIWITRE

SEQ ID NO: 491784 - protein, 10 aa, Influenza virus
AGIFFWMCSN

SEQ ID NO: 491785 - protein, 10 aa, Influenza virus
AGIFLWMCSN

SEQ ID NO: 491786 - protein, 10 aa, Influenza virus
AGIPSDTPRG

SEQ ID NO: 491787 - protein, 10 aa, Influenza virus
AGIPTDTPRG

SEQ ID NO: 491788 - protein, 10 aa, Influenza virus
AGIPTDTPRI

SEQ ID NO: 491789 - protein, 10 aa, Influenza virus
AGIPTDTPRV

SEQ ID NO: 491790 - protein, 10 aa, Influenza virus
AGISFWMCSN

SEQ ID NO: 491791 - protein, 10 aa, Influenza virus
AGISIWMCSN

SEQ ID NO: 491792 - protein, 10 aa, Influenza virus
AGISLWMCSN

SEQ ID NO: 491793 - protein, 10 aa, Influenza virus
AGKDPKKTGG

SEQ ID NO: 491794 - protein, 10 aa, Influenza virus
AGKILRTQES

SEQ ID NO: 491795 - protein, 10 aa, Influenza virus
AGKNADLEAL

SEQ ID NO: 491796 - protein, 10 aa, Influenza virus
AGKNSDLEAL

SEQ ID NO: 491797 - protein, 10 aa, Influenza virus
AGKNTDLEAL

SEQ ID NO: 491798 - protein, 10 aa, Influenza virus
AGKNTDLEVL

SEQ ID NO: 491799 - protein, 10 aa, Influenza virus
AGLFFWMCSN

SEQ ID NO: 491800 - protein, 10 aa, Influenza virus
AGLFLWMCSN

SEQ ID NO: 491801 - protein, 10 aa, Influenza virus
AGLLLWMCSN

SEQ ID NO: 491802 - protein, 10 aa, Influenza virus
AGLLVALENQ

SEQ ID NO: 491803 - protein, 10 aa, Influenza virus
AGLPSDTPRG

SEQ ID NO: 491804 - protein, 10 aa, Influenza virus
AGLSFWMCSN

SEQ ID NO: 491805 - protein, 10 aa, Influenza virus
AGLSLWMCFN

SEQ ID NO: 491806 - protein, 10 aa, Influenza virus
AGLSLWMCSN

SEQ ID NO: 491807 - protein, 10 aa, Influenza virus
AGLTHIMIWH

SEQ ID NO: 491808 - protein, 10 aa, Influenza virus
AGLTHLMIWH

SEQ ID NO: 491809 - protein, 10 aa, Influenza virus
AGLTHMMIWH

SEQ ID NO: 491810 - protein, 10 aa, Influenza virus
AGLVLGNPMC

SEQ ID NO: 491811 - protein, 10 aa, Influenza virus
AGNGCFDILH

SEQ ID NO: 491812 - protein, 10 aa, Influenza virus
AGNILRTQES

SEQ ID NO: 491813 - protein, 10 aa, Influenza virus
AGNKLITVGS

SEQ ID NO: 491814 - protein, 10 aa, Influenza virus
AGRIDFHWML

SEQ ID NO: 491815 - protein, 10 aa, Influenza virus
AGRMTFYWAI

SEQ ID NO: 491816 - protein, 10 aa, Influenza virus
AGRMTFYWII

SEQ ID NO: 491817 - protein, 10 aa, Influenza virus
AGRMTFYWKI

SEQ ID NO: 491818 - protein, 10 aa, Influenza virus
AGRMTFYWTI

SEQ ID NO: 491819 - protein, 10 aa, Influenza virus
AGRMTFYWTM

SEQ ID NO: 491820 - protein, 10 aa, Influenza virus
AGSAQHVEEC

SEQ ID NO: 491821 - protein, 10 aa, Influenza virus
AGSLSLAIMI

SEQ ID NO: 491822 - protein, 10 aa, Influenza virus
AGSLSLAIMM

SEQ ID NO: 491823 - protein, 10 aa, Influenza virus
AGSLSLAIMV

SEQ ID NO: 491824 - protein, 10 aa, Influenza virus
AGSNEQAAEA

SEQ ID NO: 491825 - protein, 10 aa, Influenza virus
AGSSEQAAEA

SEQ ID NO: 491826 - protein, 10 aa, Influenza virus
AGTAKHIEEC

SEQ ID NO: 491827 - protein, 10 aa, Influenza virus
AGVDRFYRIC

SEQ ID NO: 491828 - protein, 10 aa, Influenza virus
AGVDRFYRTC

SEQ ID NO: 491829 - protein, 10 aa, Influenza virus
AGVESAVLRG

SEQ ID NO: 491830 - protein, 10 aa, Influenza virus
AGVETMVILS

SEQ ID NO: 491831 - protein, 10 aa, Influenza virus
AGVKMNPNQK

SEQ ID NO: 491832 - protein, 10 aa, Influenza virus
AGVNRFYRTC

SEQ ID NO: 491833 - protein, 10 aa, Influenza virus
AGWILGNPEC

SEQ ID NO: 491834 - protein, 10 aa, Influenza virus
AGWILGNPKC

SEQ ID NO: 491835 - protein, 10 aa, Influenza virus
AGWILGNPMC

SEQ ID NO: 491836 - protein, 10 aa, Influenza virus
AGWILGNPRC

SEQ ID NO: 491837 - protein, 10 aa, Influenza virus
AGWLIGNPKC

SEQ ID NO: 491838 - protein, 10 aa, Influenza virus
AGWLLGNPEC

SEQ ID NO: 491839 - protein, 10 aa, Influenza virus
AGWLLGNPKC

SEQ ID NO: 491840 - protein, 10 aa, Influenza virus
AGWLLGNPLC

SEQ ID NO: 491841 - protein, 10 aa, Influenza virus
AGWLLGNPMC

SEQ ID NO: 491842 - protein, 10 aa, Influenza virus
AGWYGFQHQN

SEQ ID NO: 491843 - protein, 10 aa, Influenza virus
AGWYGFQHSN

SEQ ID NO: 491844 - protein, 10 aa, Influenza virus
AGWYGFQHTN

SEQ ID NO: 491845 - protein, 10 aa, Influenza virus
AGYAADKEST

SEQ ID NO: 491846 - protein, 10 aa, Influenza virus
AGYEMLKVPN

SEQ ID NO: 491847 - protein, 10 aa, Influenza virus
AHALKLVVAM

SEQ ID NO: 491848 - protein, 10 aa, Influenza virus
AHCYPGATIN

SEQ ID NO: 491849 - protein, 10 aa, Influenza virus
AHDRICIGYQ

SEQ ID NO: 491850 - protein, 10 aa, Influenza virus
AHHRVYWIRE

SEQ ID NO: 491851 - protein, 10 aa, Influenza virus
AHILVTREPY

SEQ ID NO: 491852 - protein, 10 aa, Influenza virus
AHISPLSGSA

SEQ ID NO: 491853 - protein, 10 aa, Influenza virus
AHKMESRGLF

SEQ ID NO: 491854 - protein, 10 aa, Influenza virus
AHKQLTHHMR

SEQ ID NO: 491855 - protein, 10 aa, Influenza virus
AHKSCLPACA

SEQ ID NO: 491856 - protein, 10 aa, Influenza virus
AHKSCLPACI

SEQ ID NO: 491857 - protein, 10 aa, Influenza virus
AHKSCLPACV

SEQ ID NO: 491858 - protein, 10 aa, Influenza virus
AHKSQLIWMA

SEQ ID NO: 491859 - protein, 10 aa, Influenza virus
AHKSQLVWMA

SEQ ID NO: 491860 - protein, 10 aa, Influenza virus
AHNGKLCRLS

SEQ ID NO: 491861 - protein, 10 aa, Influenza virus
AHTKILYFHK

SEQ ID NO: 491862 - protein, 10 aa, Influenza virus
AHTKVLYFHK

SEQ ID NO: 491863 - protein, 10 aa, Influenza virus
AHVLVTREPY

SEQ ID NO: 491864 - protein, 10 aa, Influenza virus
AIAGFIEGGW

SEQ ID NO: 491865 - protein, 10 aa, Influenza virus
AIAGFIEGRW

SEQ ID NO: 491866 - protein, 10 aa, Influenza virus
AIAGFIENGW

SEQ ID NO: 491867 - protein, 10 aa, Influenza virus
AIAGFLENGW

SEQ ID NO: 491868 - protein, 10 aa, Influenza virus
AIALGIINLL

SEQ ID NO: 491869 - protein, 10 aa, Influenza virus
AIALSILNLL

SEQ ID NO: 491870 - protein, 10 aa, Influenza virus
AIALSVLNLL

SEQ ID NO: 491871 - protein, 10 aa, Influenza virus
AIAMGLIFMC

SEQ ID NO: 491872 - protein, 10 aa, Influenza virus
AIAMGLVFIC

SEQ ID NO: 491873 - protein, 10 aa, Influenza virus
AIAMGLVFMC

SEQ ID NO: 491874 - protein, 10 aa, Influenza virus
AIASKDNGIR

SEQ ID NO: 491875 - protein, 10 aa, Influenza virus
AIATPGMQIR

SEQ ID NO: 491876 - protein, 10 aa, Influenza virus
AICTHLEICF

SEQ ID NO: 491877 - protein, 10 aa, Influenza virus
AICTHLEVCF

SEQ ID NO: 491878 - protein, 10 aa, Influenza virus
AICTHMEVCF

SEQ ID NO: 491879 - protein, 10 aa, Influenza virus
AIDAGDGCFE

SEQ ID NO: 491880 - protein, 10 aa, Influenza virus
AIDAGNGCFD

SEQ ID NO: 491881 - protein, 10 aa, Influenza virus
AIDEGDGCFN

SEQ ID NO: 491882 - protein, 10 aa, Influenza virus
AIDEGDGCFS

SEQ ID NO: 491883 - protein, 10 aa, Influenza virus
AIDEGNGCFE

SEQ ID NO: 491884 - protein, 10 aa, Influenza virus
AIDEITTKIN

SEQ ID NO: 491885 - protein, 10 aa, Influenza virus
AIDGITNKIN

SEQ ID NO: 491886 - protein, 10 aa, Influenza virus
AIDGITNKVN

SEQ ID NO: 491887 - protein, 10 aa, Influenza virus
AIDGVTNKVN

SEQ ID NO: 491888 - protein, 10 aa, Influenza virus
AIDIMQNKLN

SEQ ID NO: 491889 - protein, 10 aa, Influenza virus
AIDKINGKLN

SEQ ID NO: 491890 - protein, 10 aa, Influenza virus
AIDKITNKIN

SEQ ID NO: 491891 - protein, 10 aa, Influenza virus
AIDKITNKVN

SEQ ID NO: 491892 - protein, 10 aa, Influenza virus
AIDNGDGCFE

SEQ ID NO: 491893 - protein, 10 aa, Influenza virus
AIDNMQNKLN

SEQ ID NO: 491894 - protein, 10 aa, Influenza virus
AIDNMQNRLN

SEQ ID NO: 491895 - protein, 10 aa, Influenza virus
AIDQINGKLN

SEQ ID NO: 491896 - protein, 10 aa, Influenza virus
AIDQITGKLN

SEQ ID NO: 491897 - protein, 10 aa, Influenza virus
AIDQITRKLN

SEQ ID NO: 491898 - protein, 10 aa, Influenza virus
AIDQITTKIN

SEQ ID NO: 491899 - protein, 10 aa, Influenza virus
AIDQMTGKLN

SEQ ID NO: 491900 - protein, 10 aa, Influenza virus
AIDQVNGKLN

SEQ ID NO: 491901 - protein, 10 aa, Influenza virus
AIDQVTGKLN

SEQ ID NO: 491902 - protein, 10 aa, Influenza virus
AIDRITTKIN

SEQ ID NO: 491903 - protein, 10 aa, Influenza virus
AIDTGDGCFE

SEQ ID NO: 491904 - protein, 10 aa, Influenza virus
AIDTGKGCFD

SEQ ID NO: 491905 - protein, 10 aa, Influenza virus
AIDTGNGCFD

SEQ ID NO: 491906 - protein, 10 aa, Influenza virus
AIEECLINDP

SEQ ID NO: 491907 - protein, 10 aa, Influenza virus
AIEKITNKVN

SEQ ID NO: 491908 - protein, 10 aa, Influenza virus
AIENQHTIDL

SEQ ID NO: 491909 - protein, 10 aa, Influenza virus
AIFSKDNGIR

SEQ ID NO: 491910 - protein, 10 aa, Influenza virus
AIGAIDSSMP

SEQ ID NO: 491911 - protein, 10 aa, Influenza virus
AIGDCPKYIK

SEQ ID NO: 491912 - protein, 10 aa, Influenza virus
AIGDCPKYVN

SEQ ID NO: 491913 - protein, 10 aa, Influenza virus
AIGECPKYVK

SEQ ID NO: 491914 - protein, 10 aa, Influenza virus
AIGFWMCSNG

SEQ ID NO: 491915 - protein, 10 aa, Influenza virus
AIGGSGTDNY

SEQ ID NO: 491916 - protein, 10 aa, Influenza virus
AIGGSGTNNY

SEQ ID NO: 491917 - protein, 10 aa, Influenza virus
AIGKITNKVN

SEQ ID NO: 491918 - protein, 10 aa, Influenza virus
AIGLRISSSF

SEQ ID NO: 491919 - protein, 10 aa, Influenza virus
AIGLRNTPSI

SEQ ID NO: 491920 - protein, 10 aa, Influenza virus
AIGLRNVPQA

SEQ ID NO: 491921 - protein, 10 aa, Influenza virus
AIGLRNVPQI

SEQ ID NO: 491922 - protein, 10 aa, Influenza virus
AIGLRNVPQV

SEQ ID NO: 491923 - protein, 10 aa, Influenza virus
AIGNCPKYVK

SEQ ID NO: 491924 - protein, 10 aa, Influenza virus
AIGPRNVPQA

SEQ ID NO: 491925 - protein, 10 aa, Influenza virus
AIGPRNVPQV

SEQ ID NO: 491926 - protein, 10 aa, Influenza virus
AIHHPPTSAE

SEQ ID NO: 491927 - protein, 10 aa, Influenza virus
AIHHPPTSDE

SEQ ID NO: 491928 - protein, 10 aa, Influenza virus
AIHHPPTSNE

SEQ ID NO: 491929 - protein, 10 aa, Influenza virus
AIHHPPTTDE

SEQ ID NO: 491930 - protein, 10 aa, Influenza virus
AIIIAGLSFW

SEQ ID NO: 491931 - protein, 10 aa, Influenza virus
AIIKKYTSAR

SEQ ID NO: 491932 - protein, 10 aa, Influenza virus
AIIKKYTSGR

SEQ ID NO: 491933 - protein, 10 aa, Influenza virus
AIISKDNGIR

SEQ ID NO: 491934 - protein, 10 aa, Influenza virus
AILAATVTLH

SEQ ID NO: 491935 - protein, 10 aa, Influenza virus
AILATTITLH

SEQ ID NO: 491936 - protein, 10 aa, Influenza virus
AILATTVTLH

SEQ ID NO: 491937 - protein, 10 aa, Influenza virus
AILIAGGLIL

SEQ ID NO: 491938 - protein, 10 aa, Influenza virus
AILKPGQTVK

SEQ ID NO: 491939 - protein, 10 aa, Influenza virus
AILPFDIDKM

SEQ ID NO: 491940 - protein, 10 aa, Influenza virus
AILVAGGLIL

SEQ ID NO: 491941 - protein, 10 aa, Influenza virus
AILVTTVTLH

SEQ ID NO: 491942 - protein, 10 aa, Influenza virus
AIMIAGLFFW

SEQ ID NO: 491943 - protein, 10 aa, Influenza virus
AIMIAGLSFW

SEQ ID NO: 491944 - protein, 10 aa, Influenza virus
AIMMAGLSFW

SEQ ID NO: 491945 - protein, 10 aa, Influenza virus
AIMVAGLSFW

SEQ ID NO: 491946 - protein, 10 aa, Influenza virus
AINEGNGCFE

SEQ ID NO: 491947 - protein, 10 aa, Influenza virus
AINEITTKIN

SEQ ID NO: 491948 - protein, 10 aa, Influenza virus
AINGVTNKVN

SEQ ID NO: 491949 - protein, 10 aa, Influenza virus
AINKITNKVN

SEQ ID NO: 491950 - protein, 10 aa, Influenza virus
AINLYASKNP

SEQ ID NO: 491951 - protein, 10 aa, Influenza virus
AINNRFQIQG

SEQ ID NO: 491952 - protein, 10 aa, Influenza virus
AINNRIKINP

SEQ ID NO: 491953 - protein, 10 aa, Influenza virus
AINQITGKLN

SEQ ID NO: 491954 - protein, 10 aa, Influenza virus
AINSRFQIQG

SEQ ID NO: 491955 - protein, 10 aa, Influenza virus
AINSSKPFQN

SEQ ID NO: 491956 - protein, 10 aa, Influenza virus
AINSSKPLQN

SEQ ID NO: 491957 - protein, 10 aa, Influenza virus
AINSSMPFHN

SEQ ID NO: 491958 - protein, 10 aa, Influenza virus
AINSSMPLHN

SEQ ID NO: 491959 - protein, 10 aa, Influenza virus
AINSSRPFQN

SEQ ID NO: 491960 - protein, 10 aa, Influenza virus
AINTTLPFHN

SEQ ID NO: 491961 - protein, 10 aa, Influenza virus
AIRFGEGEQI

SEQ ID NO: 491962 - protein, 10 aa, Influenza virus
AIRFGESEQI

SEQ ID NO: 491963 - protein, 10 aa, Influenza virus
AIRFGESEQV

SEQ ID NO: 491964 - protein, 10 aa, Influenza virus
AIRNGTYNHE

SEQ ID NO: 491965 - protein, 10 aa, Influenza virus
AIRTKSGGNT

SEQ ID NO: 491966 - protein, 10 aa, Influenza virus
AIRTRSGGNT

SEQ ID NO: 491967 - protein, 10 aa, Influenza virus
AISFWMCSGH

SEQ ID NO: 491968 - protein, 10 aa, Influenza virus
AISFWMCSNG

SEQ ID NO: 491969 - protein, 10 aa, Influenza virus
AISNRFQIQG

SEQ ID NO: 491970 - protein, 10 aa, Influenza virus
AISSSMPFHN

SEQ ID NO: 491971 - protein, 10 aa, Influenza virus
AISTTFPYTG

SEQ ID NO: 491972 - protein, 10 aa, Influenza virus
AITRSGQNHG

SEQ ID NO: 491973 - protein, 10 aa, Influenza virus
AIVFSQEDCM

SEQ ID NO: 491974 - protein, 10 aa, Influenza virus
AIVLGIINLL

SEQ ID NO: 491975 - protein, 10 aa, Influenza virus
AIVMGLVFIC

SEQ ID NO: 491976 - protein, 10 aa, Influenza virus
AIVQITGKLN

SEQ ID NO: 491977 - protein, 10 aa, Influenza virus
AIVSADPLAS

SEQ ID NO: 491978 - protein, 10 aa, Influenza virus
AIVSKDNGIR

SEQ ID NO: 491979 - protein, 10 aa, Influenza virus
AIWTSGSSIA

SEQ ID NO: 491980 - protein, 10 aa, Influenza virus
AIWTSSSSIV

SEQ ID NO: 491981 - protein, 10 aa, Influenza virus
AIWVTREPYV

SEQ ID NO: 491982 - protein, 10 aa, Influenza virus
AIYATVAGSL

SEQ ID NO: 491983 - protein, 10 aa, Influenza virus
AIYSCIASSI

SEQ ID NO: 491984 - protein, 10 aa, Influenza virus
AIYSTAASSL

SEQ ID NO: 491985 - protein, 10 aa, Influenza virus
AIYSTISSSL

SEQ ID NO: 491986 - protein, 10 aa, Influenza virus
AIYSTVASSL

SEQ ID NO: 491987 - protein, 10 aa, Influenza virus
AIYSTVASSS

SEQ ID NO: 491988 - protein, 10 aa, Influenza virus
AIYSTVSSSL

SEQ ID NO: 491989 - protein, 10 aa, Influenza virus
  MOD_RES (2)..(2): Ile or Leu
AXVMGLVFIC

SEQ ID NO: 491990 - protein, 10 aa, Influenza virus
AKAGFIEGGW

SEQ ID NO: 491991 - protein, 10 aa, Influenza virus
AKAGFIENGW

SEQ ID NO: 491992 - protein, 10 aa, Influenza virus
AKAGVKMNPN

SEQ ID NO: 491993 - protein, 10 aa, Influenza virus
AKAMEQMAGS

SEQ ID NO: 491994 - protein, 10 aa, Influenza virus
AKAMEQVAGS

SEQ ID NO: 491995 - protein, 10 aa, Influenza virus
AKCNTKCQTS

SEQ ID NO: 491996 - protein, 10 aa, Influenza virus
AKDEGNGCFT

SEQ ID NO: 491997 - protein, 10 aa, Influenza virus
AKDILEKTHN

SEQ ID NO: 491998 - protein, 10 aa, Influenza virus
AKDLGNGCFE

SEQ ID NO: 491999 - protein, 10 aa, Influenza virus
AKDNAIRFGE

SEQ ID NO: 492000 - protein, 10 aa, Influenza virus
AKDNAVRFGE

SEQ ID NO: 492001 - protein, 10 aa, Influenza virus
AKDNSIRLSA

SEQ ID NO: 492002 - protein, 10 aa, Influenza virus
AKEAQDVIME

SEQ ID NO: 492003 - protein, 10 aa, Influenza virus
AKEECYRACF

SEQ ID NO: 492004 - protein, 10 aa, Influenza virus
AKEIGNGCFE

SEQ ID NO: 492005 - protein, 10 aa, Influenza virus
AKEIGNGCFK

SEQ ID NO: 492006 - protein, 10 aa, Influenza virus
AKELGNGCFE

SEQ ID NO: 492007 - protein, 10 aa, Influenza virus
AKELVETNHT

SEQ ID NO: 492008 - protein, 10 aa, Influenza virus
AKEMGNGCFE

SEQ ID NO: 492009 - protein, 10 aa, Influenza virus
AKEQTALYKN

SEQ ID NO: 492010 - protein, 10 aa, Influenza virus
AKEQTTLYKN

SEQ ID NO: 492011 - protein, 10 aa, Influenza virus
AKETGNGCFE

SEQ ID NO: 492012 - protein, 10 aa, Influenza virus
AKEVGNGCFE

SEQ ID NO: 492013 - protein, 10 aa, Influenza virus
AKEWGNGCFE

SEQ ID NO: 492014 - protein, 10 aa, Influenza virus
AKFEAVAWSA

SEQ ID NO: 492015 - protein, 10 aa, Influenza virus
AKFESVAWSA

SEQ ID NO: 492016 - protein, 10 aa, Influenza virus
AKGDCYRACF

SEQ ID NO: 492017 - protein, 10 aa, Influenza virus
AKGDKICLGH

SEQ ID NO: 492018 - protein, 10 aa, Influenza virus
AKGECYRACF

SEQ ID NO: 492019 - protein, 10 aa, Influenza virus
AKGEKANVLI

SEQ ID NO: 492020 - protein, 10 aa, Influenza virus
AKGLFGAIAG

SEQ ID NO: 492021 - protein, 10 aa, Influenza virus
AKGSYNNTNG

SEQ ID NO: 492022 - protein, 10 aa, Influenza virus
AKGSYNNTSG

SEQ ID NO: 492023 - protein, 10 aa, Influenza virus
AKHIEECSCY

SEQ ID NO: 492024 - protein, 10 aa, Influenza virus
AKHIEECSSY

SEQ ID NO: 492025 - protein, 10 aa, Influenza virus
AKHVEECSCY

SEQ ID NO: 492026 - protein, 10 aa, Influenza virus
AKILTSESQL

SEQ ID NO: 492027 - protein, 10 aa, Influenza virus
AKLANVVRKM

SEQ ID NO: 492028 - protein, 10 aa, Influenza virus
AKLEKSRING

SEQ ID NO: 492029 - protein, 10 aa, Influenza virus
AKLERSKINE

SEQ ID NO: 492030 - protein, 10 aa, Influenza virus
AKLERSKING

SEQ ID NO: 492031 - protein, 10 aa, Influenza virus
AKLLVLIEND

SEQ ID NO: 492032 - protein, 10 aa, Influenza virus
AKLLVLLEND

SEQ ID NO: 492033 - protein, 10 aa, Influenza virus
AKLLVLLENE

SEQ ID NO: 492034 - protein, 10 aa, Influenza virus
AKLLVLLENG

SEQ ID NO: 492035 - protein, 10 aa, Influenza virus
AKNILEKTHN

SEQ ID NO: 492036 - protein, 10 aa, Influenza virus
AKNILRTQES

SEQ ID NO: 492037 - protein, 10 aa, Influenza virus
AKRSYNNTSG

SEQ ID NO: 492038 - protein, 10 aa, Influenza virus
AKSITQTLVS

SEQ ID NO: 492039 - protein, 10 aa, Influenza virus
AKSLTQTLVS

SEQ ID NO: 492040 - protein, 10 aa, Influenza virus
AKSVFNCLYA

SEQ ID NO: 492041 - protein, 10 aa, Influenza virus
AKSVFNNLYA

SEQ ID NO: 492042 - protein, 10 aa, Influenza virus
AKSVFNSIYA

SEQ ID NO: 492043 - protein, 10 aa, Influenza virus
AKSVFNSLYA

SEQ ID NO: 492044 - protein, 10 aa, Influenza virus
AKSVFNSLYS

SEQ ID NO: 492045 - protein, 10 aa, Influenza virus
AKSVTQTLVS

SEQ ID NO: 492046 - protein, 10 aa, Influenza virus
AKYVEWTSNS

SEQ ID NO: 492047 - protein, 10 aa, Influenza virus
AKYVWWASNS

SEQ ID NO: 492048 - protein, 10 aa, Influenza virus
AKYVWWTSNS

SEQ ID NO: 492049 - protein, 10 aa, Influenza virus
ALALSHTAYS

SEQ ID NO: 492050 - protein, 10 aa, Influenza virus
ALANTIEIFR

SEQ ID NO: 492051 - protein, 10 aa, Influenza virus
ALANTIEVFR

SEQ ID NO: 492052 - protein, 10 aa, Influenza virus
ALAQGALLGT

SEQ ID NO: 492053 - protein, 10 aa, Influenza virus
ALAQGALVGT

SEQ ID NO: 492054 - protein, 10 aa, Influenza virus
ALAQGTLLGT

SEQ ID NO: 492055 - protein, 10 aa, Influenza virus
ALAQGVLLGT

SEQ ID NO: 492056 - protein, 10 aa, Influenza virus
ALASCMGLIY

SEQ ID NO: 492057 - protein, 10 aa, Influenza virus
ALCGSKEQLG

SEQ ID NO: 492058 - protein, 10 aa, Influenza virus
ALCGSKERLG

SEQ ID NO: 492059 - protein, 10 aa, Influenza virus
ALCGSKKRLG

SEQ ID NO: 492060 - protein, 10 aa, Influenza virus
ALCGSPFPVG

SEQ ID NO: 492061 - protein, 10 aa, Influenza virus
ALCGSPISVG

SEQ ID NO: 492062 - protein, 10 aa, Influenza virus
ALCGSPVPVG

SEQ ID NO: 492063 - protein, 10 aa, Influenza virus
ALCGSPVSVG

SEQ ID NO: 492064 - protein, 10 aa, Influenza virus
ALCGSRERLG

SEQ ID NO: 492065 - protein, 10 aa, Influenza virus
ALDTGDGCFE

SEQ ID NO: 492066 - protein, 10 aa, Influenza virus
ALENQHTIDL

SEQ ID NO: 492067 - protein, 10 aa, Influenza virus
ALENQHTIDM

SEQ ID NO: 492068 - protein, 10 aa, Influenza virus
ALENQHTIDV

SEQ ID NO: 492069 - protein, 10 aa, Influenza virus
ALENQHTIHL

SEQ ID NO: 492070 - protein, 10 aa, Influenza virus
ALENQNTIDL

SEQ ID NO: 492071 - protein, 10 aa, Influenza virus
ALFLAFILWA

SEQ ID NO: 492072 - protein, 10 aa, Influenza virus
ALGDCPKYIK

SEQ ID NO: 492073 - protein, 10 aa, Influenza virus
ALGECPKYIK

SEQ ID NO: 492074 - protein, 10 aa, Influenza virus
ALGENMAPEK

SEQ ID NO: 492075 - protein, 10 aa, Influenza virus
ALGIINLLIG

SEQ ID NO: 492076 - protein, 10 aa, Influenza virus
ALGLRISSSF

SEQ ID NO: 492077 - protein, 10 aa, Influenza virus
ALGLRNTPSI

SEQ ID NO: 492078 - protein, 10 aa, Influenza virus
ALGLVCATCE

SEQ ID NO: 492079 - protein, 10 aa, Influenza virus
ALGMKNVPEK

SEQ ID NO: 492080 - protein, 10 aa, Influenza virus
ALGNCPKYIK

SEQ ID NO: 492081 - protein, 10 aa, Influenza virus
ALGQGTTLDN

SEQ ID NO: 492082 - protein, 10 aa, Influenza virus
ALGQGTTLEN

SEQ ID NO: 492083 - protein, 10 aa, Influenza virus
ALGQGTTLKN

SEQ ID NO: 492084 - protein, 10 aa, Influenza virus
ALGQGTTLNN

SEQ ID NO: 492085 - protein, 10 aa, Influenza virus
ALGQGTTLSN

SEQ ID NO: 492086 - protein, 10 aa, Influenza virus
ALGQGTTLYN

SEQ ID NO: 492087 - protein, 10 aa, Influenza virus
ALGSPGCDHL

SEQ ID NO: 492088 - protein, 10 aa, Influenza virus
ALGSPGCDRL

SEQ ID NO: 492089 - protein, 10 aa, Influenza virus
ALGYSTGALA

SEQ ID NO: 492090 - protein, 10 aa, Influenza virus
ALHQGTTIRN

SEQ ID NO: 492091 - protein, 10 aa, Influenza virus
ALIIWGIHHS

SEQ ID NO: 492092 - protein, 10 aa, Influenza virus
ALIIWGVHHS

SEQ ID NO: 492093 - protein, 10 aa, Influenza virus
ALILGFVLWA

SEQ ID NO: 492094 - protein, 10 aa, Influenza virus
ALILRGAVAH

SEQ ID NO: 492095 - protein, 10 aa, Influenza virus
ALILRGSIAH

SEQ ID NO: 492096 - protein, 10 aa, Influenza virus
ALILRGSVAH

SEQ ID NO: 492097 - protein, 10 aa, Influenza virus
ALILVALALS

SEQ ID NO: 492098 - protein, 10 aa, Influenza virus
ALISWEMGLA

SEQ ID NO: 492099 - protein, 10 aa, Influenza virus
ALISWEMGQA

SEQ ID NO: 492100 - protein, 10 aa, Influenza virus
ALISWGMGQA

SEQ ID NO: 492101 - protein, 10 aa, Influenza virus
ALISWPLSSP

SEQ ID NO: 492102 - protein, 10 aa, Influenza virus
ALISWPQSSP

SEQ ID NO: 492103 - protein, 10 aa, Influenza virus
ALIVWGIHHS

SEQ ID NO: 492104 - protein, 10 aa, Influenza virus
ALIVWGVHHS

SEQ ID NO: 492105 - protein, 10 aa, Influenza virus
ALKDNLEPGT

SEQ ID NO: 492106 - protein, 10 aa, Influenza virus
ALKMTIASDI

SEQ ID NO: 492107 - protein, 10 aa, Influenza virus
ALLGTKHSNG

SEQ ID NO: 492108 - protein, 10 aa, Influenza virus
ALLGTNHSNG

SEQ ID NO: 492109 - protein, 10 aa, Influenza virus
ALLGTRHSNG

SEQ ID NO: 492110 - protein, 10 aa, Influenza virus
ALLIAFVLWA

SEQ ID NO: 492111 - protein, 10 aa, Influenza virus
ALLKHRFEII

SEQ ID NO: 492112 - protein, 10 aa, Influenza virus
ALLLAFILWA

SEQ ID NO: 492113 - protein, 10 aa, Influenza virus
ALLLAFMLWA

SEQ ID NO: 492114 - protein, 10 aa, Influenza virus
ALLLAFVLWA

SEQ ID NO: 492115 - protein, 10 aa, Influenza virus
ALLNASCAAM

SEQ ID NO: 492116 - protein, 10 aa, Influenza virus
ALLNDKHSNE

SEQ ID NO: 492117 - protein, 10 aa, Influenza virus
ALLNDKHSNG

SEQ ID NO: 492118 - protein, 10 aa, Influenza virus
ALLNDKHSNN

SEQ ID NO: 492119 - protein, 10 aa, Influenza virus
ALLNDRHSNG

SEQ ID NO: 492120 - protein, 10 aa, Influenza virus
ALLNRININP

SEQ ID NO: 492121 - protein, 10 aa, Influenza virus
ALLNRLNINP

SEQ ID NO: 492122 - protein, 10 aa, Influenza virus
ALLNRLNINS

SEQ ID NO: 492123 - protein, 10 aa, Influenza virus
ALLNRLSINP

SEQ ID NO: 492124 - protein, 10 aa, Influenza virus
ALMEWIKTRP

SEQ ID NO: 492125 - protein, 10 aa, Influenza virus
ALMEWLKTRP

SEQ ID NO: 492126 - protein, 10 aa, Influenza virus
ALMSVLLGSS

SEQ ID NO: 492127 - protein, 10 aa, Influenza virus
ALMSVPLGSS

SEQ ID NO: 492128 - protein, 10 aa, Influenza virus
ALNEITTKIN

SEQ ID NO: 492129 - protein, 10 aa, Influenza virus
ALNGNGDPNN

SEQ ID NO: 492130 - protein, 10 aa, Influenza virus
ALNTTLPFHN

SEQ ID NO: 492131 - protein, 10 aa, Influenza virus
ALQGTKRSYE

SEQ ID NO: 492132 - protein, 10 aa, Influenza virus
ALQLFIKDYR

SEQ ID NO: 492133 - protein, 10 aa, Influenza virus
ALQLLFEVEQ

SEQ ID NO: 492134 - protein, 10 aa, Influenza virus
ALQLLLEVEN

SEQ ID NO: 492135 - protein, 10 aa, Influenza virus
ALQLLLEVEQ

SEQ ID NO: 492136 - protein, 10 aa, Influenza virus
ALQLLLEVES

SEQ ID NO: 492137 - protein, 10 aa, Influenza virus
ALQLNPIDGP

SEQ ID NO: 492138 - protein, 10 aa, Influenza virus
ALQNRIMINP

SEQ ID NO: 492139 - protein, 10 aa, Influenza virus
ALRDNLEPGT

SEQ ID NO: 492140 - protein, 10 aa, Influenza virus
ALRDSLEPGT

SEQ ID NO: 492141 - protein, 10 aa, Influenza virus
ALRELWQCYY

SEQ ID NO: 492142 - protein, 10 aa, Influenza virus
ALRMKWMMAM

SEQ ID NO: 492143 - protein, 10 aa, Influenza virus
ALRQIIRESG

SEQ ID NO: 492144 - protein, 10 aa, Influenza virus
ALRQKIMESG

SEQ ID NO: 492145 - protein, 10 aa, Influenza virus
ALSGNGDPNN

SEQ ID NO: 492146 - protein, 10 aa, Influenza virus
ALSGVAIALS

SEQ ID NO: 492147 - protein, 10 aa, Influenza virus
ALSHTAYSQI

SEQ ID NO: 492148 - protein, 10 aa, Influenza virus
ALSIAPIMFS

SEQ ID NO: 492149 - protein, 10 aa, Influenza virus
ALSILNLLIG

SEQ ID NO: 492150 - protein, 10 aa, Influenza virus
ALSIYSCIAS

SEQ ID NO: 492151 - protein, 10 aa, Influenza virus
ALSQGALLGT

SEQ ID NO: 492152 - protein, 10 aa, Influenza virus
ALSQGTTIRG

SEQ ID NO: 492153 - protein, 10 aa, Influenza virus
ALSQGTTLKG

SEQ ID NO: 492154 - protein, 10 aa, Influenza virus
ALSQGTTLRG

SEQ ID NO: 492155 - protein, 10 aa, Influenza virus
ALSVLNLLIG

SEQ ID NO: 492156 - protein, 10 aa, Influenza virus
ALSYSAGALA

SEQ ID NO: 492157 - protein, 10 aa, Influenza virus
ALSYSTGALA

SEQ ID NO: 492158 - protein, 10 aa, Influenza virus
ALTGGQSFYR

SEQ ID NO: 492159 - protein, 10 aa, Influenza virus
ALTLNTMTKD

SEQ ID NO: 492160 - protein, 10 aa, Influenza virus
ALVGTKHSNG

SEQ ID NO: 492161 - protein, 10 aa, Influenza virus
ALVIWGVHHS

SEQ ID NO: 492162 - protein, 10 aa, Influenza virus
ALVRGQQGRM

SEQ ID NO: 492163 - protein, 10 aa, Influenza virus
ALVRSGMDPR

SEQ ID NO: 492164 - protein, 10 aa, Influenza virus
ALVRTGMDPR

SEQ ID NO: 492165 - protein, 10 aa, Influenza virus
ALVSWEMGQA

SEQ ID NO: 492166 - protein, 10 aa, Influenza virus
ALVSWPLSSP

SEQ ID NO: 492167 - protein, 10 aa, Influenza virus
ALYGTQSLSI

SEQ ID NO: 492168 - protein, 10 aa, Influenza virus
ALYKNANTLS

SEQ ID NO: 492169 - protein, 10 aa, Influenza virus
AMAFLEDSHP

SEQ ID NO: 492170 - protein, 10 aa, Influenza virus
AMAFLEESHP

SEQ ID NO: 492171 - protein, 10 aa, Influenza virus
AMAFLEKSHP

SEQ ID NO: 492172 - protein, 10 aa, Influenza virus
AMAFLENSHP

SEQ ID NO: 492173 - protein, 10 aa, Influenza virus
AMALLEESHP

SEQ ID NO: 492174 - protein, 10 aa, Influenza virus
AMASQGTKRS

SEQ ID NO: 492175 - protein, 10 aa, Influenza virus
AMDAGNGCFD

SEQ ID NO: 492176 - protein, 10 aa, Influenza virus
AMDDFQLIPM

SEQ ID NO: 492177 - protein, 10 aa, Influenza virus
AMDEFQLIPM

SEQ ID NO: 492178 - protein, 10 aa, Influenza virus
AMDGVTNKVN

SEQ ID NO: 492179 - protein, 10 aa, Influenza virus
AMDHTSQYLC

SEQ ID NO: 492180 - protein, 10 aa, Influenza virus
AMEDFQLIPM

SEQ ID NO: 492181 - protein, 10 aa, Influenza virus
AMEHTSQYLC

SEQ ID NO: 492182 - protein, 10 aa, Influenza virus
AMELIRMIKR

SEQ ID NO: 492183 - protein, 10 aa, Influenza virus
AMELVEAEKH

SEQ ID NO: 492184 - protein, 10 aa, Influenza virus
AMENQHIIDL

SEQ ID NO: 492185 - protein, 10 aa, Influenza virus
AMENQHTIDL

SEQ ID NO: 492186 - protein, 10 aa, Influenza virus
AMENQHTIDM

SEQ ID NO: 492187 - protein, 10 aa, Influenza virus
AMEQMAGSSE

SEQ ID NO: 492188 - protein, 10 aa, Influenza virus
AMEQVAGSSE

SEQ ID NO: 492189 - protein, 10 aa, Influenza virus
AMGLIFMCVK

SEQ ID NO: 492190 - protein, 10 aa, Influenza virus
AMGLKISSSF

SEQ ID NO: 492191 - protein, 10 aa, Influenza virus
AMGLRISSSF

SEQ ID NO: 492192 - protein, 10 aa, Influenza virus
AMGLVFICIK

SEQ ID NO: 492193 - protein, 10 aa, Influenza virus
AMGLVFICMK

SEQ ID NO: 492194 - protein, 10 aa, Influenza virus
AMGLVFICVK

SEQ ID NO: 492195 - protein, 10 aa, Influenza virus
AMGLVFMCVK

SEQ ID NO: 492196 - protein, 10 aa, Influenza virus
AMGMRISSSF

SEQ ID NO: 492197 - protein, 10 aa, Influenza virus
AMISRARIDA

SEQ ID NO: 492198 - protein, 10 aa, Influenza virus
AMKHTSQYIC

SEQ ID NO: 492199 - protein, 10 aa, Influenza virus
AMKHTSQYLC

SEQ ID NO: 492200 - protein, 10 aa, Influenza virus
AMLNASCAAM

SEQ ID NO: 492201 - protein, 10 aa, Influenza virus
AMMDQVREGR

SEQ ID NO: 492202 - protein, 10 aa, Influenza virus
AMMDQVRESR

SEQ ID NO: 492203 - protein, 10 aa, Influenza virus
AMMSRARIDA

SEQ ID NO: 492204 - protein, 10 aa, Influenza virus
AMQNRIQIDP

SEQ ID NO: 492205 - protein, 10 aa, Influenza virus
AMTEIWSYNA

SEQ ID NO: 492206 - protein, 10 aa, Influenza virus
AMTEVWSYNA

SEQ ID NO: 492207 - protein, 10 aa, Influenza virus
AMTHTSQYIC

SEQ ID NO: 492208 - protein, 10 aa, Influenza virus
AMVDQVRESR

SEQ ID NO: 492209 - protein, 10 aa, Influenza virus
AMVFSQEDCM

SEQ ID NO: 492210 - protein, 10 aa, Influenza virus
AMVFSQEDCV

SEQ ID NO: 492211 - protein, 10 aa, Influenza virus
AMVFSQEECM

SEQ ID NO: 492212 - protein, 10 aa, Influenza virus
AMVSRARIDA

SEQ ID NO: 492213 - protein, 10 aa, Influenza virus
ANCYPGATVN

SEQ ID NO: 492214 - protein, 10 aa, Influenza virus
ANDLGNGCFE

SEQ ID NO: 492215 - protein, 10 aa, Influenza virus
ANFSMELPSF

SEQ ID NO: 492216 - protein, 10 aa, Influenza virus
ANGTIHDRSP

SEQ ID NO: 492217 - protein, 10 aa, Influenza virus
ANGTIHDRSQ

SEQ ID NO: 492218 - protein, 10 aa, Influenza virus
ANGTINDRSP

SEQ ID NO: 492219 - protein, 10 aa, Influenza virus
ANGTIVKTLT

SEQ ID NO: 492220 - protein, 10 aa, Influenza virus
ANGTKVNTLT

SEQ ID NO: 492221 - protein, 10 aa, Influenza virus
ANGTMHDRSP

SEQ ID NO: 492222 - protein, 10 aa, Influenza virus
ANGWVSTDKD

SEQ ID NO: 492223 - protein, 10 aa, Influenza virus
ANGWVSTDKN

SEQ ID NO: 492224 - protein, 10 aa, Influenza virus
ANGWVSTDKS

SEQ ID NO: 492225 - protein, 10 aa, Influenza virus
ANINFMPYIS

SEQ ID NO: 492226 - protein, 10 aa, Influenza virus
ANIRNNTYDH

SEQ ID NO: 492227 - protein, 10 aa, Influenza virus
ANKLYVNKNP

SEQ ID NO: 492228 - protein, 10 aa, Influenza virus
ANKQASYKIF

SEQ ID NO: 492229 - protein, 10 aa, Influenza virus
ANLCRFLETR

SEQ ID NO: 492230 - protein, 10 aa, Influenza virus
ANLGLNIGIH

SEQ ID NO: 492231 - protein, 10 aa, Influenza virus
ANLGLNIGLH

SEQ ID NO: 492232 - protein, 10 aa, Influenza virus
ANLGLNVGLH

SEQ ID NO: 492233 - protein, 10 aa, Influenza virus
ANNADHRIYW

SEQ ID NO: 492234 - protein, 10 aa, Influenza virus
ANNADHRVYW

SEQ ID NO: 492235 - protein, 10 aa, Influenza virus
ANNGKFEFIA

SEQ ID NO: 492236 - protein, 10 aa, Influenza virus
ANNGKFEFIV

SEQ ID NO: 492237 - protein, 10 aa, Influenza virus
ANNGKLEFIA

SEQ ID NO: 492238 - protein, 10 aa, Influenza virus
ANNGRFEFIA

SEQ ID NO: 492239 - protein, 10 aa, Influenza virus
ANNQASYKIF

SEQ ID NO: 492240 - protein, 10 aa, Influenza virus
ANNQASYRIF

SEQ ID NO: 492241 - protein, 10 aa, Influenza virus
ANNSKKQIDT

SEQ ID NO: 492242 - protein, 10 aa, Influenza virus
ANNSTDTIDT

SEQ ID NO: 492243 - protein, 10 aa, Influenza virus
ANNSTDTVDT

SEQ ID NO: 492244 - protein, 10 aa, Influenza virus
ANNSTEHVDT

SEQ ID NO: 492245 - protein, 10 aa, Influenza virus
ANNSTEQVDT

SEQ ID NO: 492246 - protein, 10 aa, Influenza virus
ANNSTERVDT

SEQ ID NO: 492247 - protein, 10 aa, Influenza virus
ANNSTETVDT

SEQ ID NO: 492248 - protein, 10 aa, Influenza virus
ANNSTKQIDT

SEQ ID NO: 492249 - protein, 10 aa, Influenza virus
ANNSTKQVDT

SEQ ID NO: 492250 - protein, 10 aa, Influenza virus
ANNSTTKVDT

SEQ ID NO: 492251 - protein, 10 aa, Influenza virus
ANNSTTQIDT

SEQ ID NO: 492252 - protein, 10 aa, Influenza virus
ANNSTTQVDT

SEQ ID NO: 492253 - protein, 10 aa, Influenza virus
ANNSTTQVNT

SEQ ID NO: 492254 - protein, 10 aa, Influenza virus
ANNSTVQVDT

SEQ ID NO: 492255 - protein, 10 aa, Influenza virus
ANQRLNPMHQ

SEQ ID NO: 492256 - protein, 10 aa, Influenza virus
ANQRLNTMHQ

SEQ ID NO: 492257 - protein, 10 aa, Influenza virus
ANQSLPPNFS

SEQ ID NO: 492258 - protein, 10 aa, Influenza virus
ANQVFPQLNQ

SEQ ID NO: 492259 - protein, 10 aa, Influenza virus
ANRPIIEIDM

SEQ ID NO: 492260 - protein, 10 aa, Influenza virus
ANRPIIEINM

SEQ ID NO: 492261 - protein, 10 aa, Influenza virus
ANRPVIEIDM

SEQ ID NO: 492262 - protein, 10 aa, Influenza virus
ANRPVIEINM

SEQ ID NO: 492263 - protein, 10 aa, Influenza virus
ANRPVIKIDM

SEQ ID NO: 492264 - protein, 10 aa, Influenza virus
ANRPWVSFNQ

SEQ ID NO: 492265 - protein, 10 aa, Influenza virus
ANSADHRIYW

SEQ ID NO: 492266 - protein, 10 aa, Influenza virus
ANSADHRVYW

SEQ ID NO: 492267 - protein, 10 aa, Influenza virus
ANSAHHRVYW

SEQ ID NO: 492268 - protein, 10 aa, Influenza virus
ANSEMNKLYE

SEQ ID NO: 492269 - protein, 10 aa, Influenza virus
ANSIIVFCGT

SEQ ID NO: 492270 - protein, 10 aa, Influenza virus
ANSQASYKIF

SEQ ID NO: 492271 - protein, 10 aa, Influenza virus
ANTIEIFRSN

SEQ ID NO: 492272 - protein, 10 aa, Influenza virus
ANTIEVFKSN

SEQ ID NO: 492273 - protein, 10 aa, Influenza virus
ANTIEVFRLN

SEQ ID NO: 492274 - protein, 10 aa, Influenza virus
ANTIEVFRSN

SEQ ID NO: 492275 - protein, 10 aa, Influenza virus
ANTLSSVNTN

SEQ ID NO: 492276 - protein, 10 aa, Influenza virus
ANTLSSVTTN

SEQ ID NO: 492277 - protein, 10 aa, Influenza virus
ANTLTSVTTN

SEQ ID NO: 492278 - protein, 10 aa, Influenza virus
ANVKNLHDQI

SEQ ID NO: 492279 - protein, 10 aa, Influenza virus
ANVKNLHEQV

SEQ ID NO: 492280 - protein, 10 aa, Influenza virus
ANVLIGQGDI

SEQ ID NO: 492281 - protein, 10 aa, Influenza virus
ANVLIGQGDV

SEQ ID NO: 492282 - protein, 10 aa, Influenza virus
ANVRNLHDQI

SEQ ID NO: 492283 - protein, 10 aa, Influenza virus
ANVRNLHDQV

SEQ ID NO: 492284 - protein, 10 aa, Influenza virus
ANVRNLHDRI

SEQ ID NO: 492285 - protein, 10 aa, Influenza virus
ANVRNLHDRT

SEQ ID NO: 492286 - protein, 10 aa, Influenza virus
ANVRNLHDRV

SEQ ID NO: 492287 - protein, 10 aa, Influenza virus
ANVRNLHEQI

SEQ ID NO: 492288 - protein, 10 aa, Influenza virus
ANVRNLHEQV

SEQ ID NO: 492289 - protein, 10 aa, Influenza virus
ANVRNLHERI

SEQ ID NO: 492290 - protein, 10 aa, Influenza virus
ANVVRKMMTN

SEQ ID NO: 492291 - protein, 10 aa, Influenza virus
ANVVRKMMTS

SEQ ID NO: 492292 - protein, 10 aa, Influenza virus
ANWSWHDGAI

SEQ ID NO: 492293 - protein, 10 aa, Influenza virus
ANYSLPPNFS

SEQ ID NO: 492294 - protein, 10 aa, Influenza virus
APACDLHLTG

SEQ ID NO: 492295 - protein, 10 aa, Influenza virus
APDRASFFKG

SEQ ID NO: 492296 - protein, 10 aa, Influenza virus
APDRASFFRG

SEQ ID NO: 492297 - protein, 10 aa, Influenza virus
APDRASFLRG

SEQ ID NO: 492298 - protein, 10 aa, Influenza virus
APDRATFLRS

SEQ ID NO: 492299 - protein, 10 aa, Influenza virus
APDYHYEECS

SEQ ID NO: 492300 - protein, 10 aa, Influenza virus
APEFGYLLKG

SEQ ID NO: 492301 - protein, 10 aa, Influenza virus
APEFGYLLRG

SEQ ID NO: 492302 - protein, 10 aa, Influenza virus
APEGMCYPGF

SEQ ID NO: 492303 - protein, 10 aa, Influenza virus
APEGMCYPGS

SEQ ID NO: 492304 - protein, 10 aa, Influenza virus
APEWSYIVEK

SEQ ID NO: 492305 - protein, 10 aa, Influenza virus
APEYGFKISK

SEQ ID NO: 492306 - protein, 10 aa, Influenza virus
APEYGFRISK

SEQ ID NO: 492307 - protein, 10 aa, Influenza virus
APEYGHLITG

SEQ ID NO: 492308 - protein, 10 aa, Influenza virus
APEYGHLTTG

SEQ ID NO: 492309 - protein, 10 aa, Influenza virus
APEYGHLVTG

SEQ ID NO: 492310 - protein, 10 aa, Influenza virus
APEYGYLITG

SEQ ID NO: 492311 - protein, 10 aa, Influenza virus
APFAKDNSIR

SEQ ID NO: 492312 - protein, 10 aa, Influenza virus
APFDDRLRRD

SEQ ID NO: 492313 - protein, 10 aa, Influenza virus
APFIDRLRRD

SEQ ID NO: 492314 - protein, 10 aa, Influenza virus
APFISCSYLE

SEQ ID NO: 492315 - protein, 10 aa, Influenza virus
APFLDRIRRD

SEQ ID NO: 492316 - protein, 10 aa, Influenza virus
APFLDRLRRD

SEQ ID NO: 492317 - protein, 10 aa, Influenza virus
APFSKDNGIR

SEQ ID NO: 492318 - protein, 10 aa, Influenza virus
APFSKDNSIQ

SEQ ID NO: 492319 - protein, 10 aa, Influenza virus
APFSKDNSIR

SEQ ID NO: 492320 - protein, 10 aa, Influenza virus
APFSKDNSVR

SEQ ID NO: 492321 - protein, 10 aa, Influenza virus
APGFHFEECS

SEQ ID NO: 492322 - protein, 10 aa, Influenza virus
APGIKGFGFL

SEQ ID NO: 492323 - protein, 10 aa, Influenza virus
APGTKGFGFL

SEQ ID NO: 492324 - protein, 10 aa, Influenza virus
APGVKGFGFL

SEQ ID NO: 492325 - protein, 10 aa, Influenza virus
APGWSWDDGA

SEQ ID NO: 492326 - protein, 10 aa, Influenza virus
APGYAFEIVS

SEQ ID NO: 492327 - protein, 10 aa, Influenza virus
APHGLCYPGE

SEQ ID NO: 492328 - protein, 10 aa, Influenza virus
APHKLCFPGE

SEQ ID NO: 492329 - protein, 10 aa, Influenza virus
APHKLCYPGE

SEQ ID NO: 492330 - protein, 10 aa, Influenza virus
APHRLCYPGE

SEQ ID NO: 492331 - protein, 10 aa, Influenza virus
APIEHIASIR

SEQ ID NO: 492332 - protein, 10 aa, Influenza virus
APIEHIASMR

SEQ ID NO: 492333 - protein, 10 aa, Influenza virus
APIEHVASMR

SEQ ID NO: 492334 - protein, 10 aa, Influenza virus
APIEYIASMR

SEQ ID NO: 492335 - protein, 10 aa, Influenza virus
APIEYVASMR

SEQ ID NO: 492336 - protein, 10 aa, Influenza virus
APILGNYKEI

SEQ ID NO: 492337 - protein, 10 aa, Influenza virus
APIMFSNKMA

SEQ ID NO: 492338 - protein, 10 aa, Influenza virus
APISLGDCSF

SEQ ID NO: 492339 - protein, 10 aa, Influenza virus
APKYGYIIEE

SEQ ID NO: 492340 - protein, 10 aa, Influenza virus
APLELRDCKI

SEQ ID NO: 492341 - protein, 10 aa, Influenza virus
APLELRDCKV

SEQ ID NO: 492342 - protein, 10 aa, Influenza virus
APLMMAYMLE

SEQ ID NO: 492343 - protein, 10 aa, Influenza virus
APLMVAYMLE

SEQ ID NO: 492344 - protein, 10 aa, Influenza virus
APLSKDNGIR

SEQ ID NO: 492345 - protein, 10 aa, Influenza virus
APLVLDDCSL

SEQ ID NO: 492346 - protein, 10 aa, Influenza virus
APNFHYEECS

SEQ ID NO: 492347 - protein, 10 aa, Influenza virus
APNFYYEECS

SEQ ID NO: 492348 - protein, 10 aa, Influenza virus
APNKFCYPGE

SEQ ID NO: 492349 - protein, 10 aa, Influenza virus
APNKLCFPGE

SEQ ID NO: 492350 - protein, 10 aa, Influenza virus
APNKLCYPGE

SEQ ID NO: 492351 - protein, 10 aa, Influenza virus
APNRASFFRG

SEQ ID NO: 492352 - protein, 10 aa, Influenza virus
APNSHYEECS

SEQ ID NO: 492353 - protein, 10 aa, Influenza virus
APNYHYEECS

SEQ ID NO: 492354 - protein, 10 aa, Influenza virus
APNYYYEECS

SEQ ID NO: 492355 - protein, 10 aa, Influenza virus
APPEQSKMQF

SEQ ID NO: 492356 - protein, 10 aa, Influenza virus
APPEQSRMQF

SEQ ID NO: 492357 - protein, 10 aa, Influenza virus
APPKQSRMQF

SEQ ID NO: 492358 - protein, 10 aa, Influenza virus
APPVQSKMQF

SEQ ID NO: 492359 - protein, 10 aa, Influenza virus
APPVQSRMQF

SEQ ID NO: 492360 - protein, 10 aa, Influenza virus
APQLNPIDGP

SEQ ID NO: 492361 - protein, 10 aa, Influenza virus
APRGHYKISK

SEQ ID NO: 492362 - protein, 10 aa, Influenza virus
APRYAFEIVS

SEQ ID NO: 492363 - protein, 10 aa, Influenza virus
APRYAFELVF

SEQ ID NO: 492364 - protein, 10 aa, Influenza virus
APRYAFELVS

SEQ ID NO: 492365 - protein, 10 aa, Influenza virus
APRYGYIIEE

SEQ ID NO: 492366 - protein, 10 aa, Influenza virus
APRYGYIIEK

SEQ ID NO: 492367 - protein, 10 aa, Influenza virus
APRYSFELVS

SEQ ID NO: 492368 - protein, 10 aa, Influenza virus
APSCDLHLTG

SEQ ID NO: 492369 - protein, 10 aa, Influenza virus
APSGIEYNGK

SEQ ID NO: 492370 - protein, 10 aa, Influenza virus
APSGVEYNGK

SEQ ID NO: 492371 - protein, 10 aa, Influenza virus
APSPSNSRFE

SEQ ID NO: 492372 - protein, 10 aa, Influenza virus
APSPYNSKFE

SEQ ID NO: 492373 - protein, 10 aa, Influenza virus
APSPYNSRFE

SEQ ID NO: 492374 - protein, 10 aa, Influenza virus
APSRVSKLIG

SEQ ID NO: 492375 - protein, 10 aa, Influenza virus
APSRVSKLKG

SEQ ID NO: 492376 - protein, 10 aa, Influenza virus
APSRVSKLRG

SEQ ID NO: 492377 - protein, 10 aa, Influenza virus
APSRVSKLTG

SEQ ID NO: 492378 - protein, 10 aa, Influenza virus
APSRVTKLKG

SEQ ID NO: 492379 - protein, 10 aa, Influenza virus
APVLGNYKEI

SEQ ID NO: 492380 - protein, 10 aa, Influenza virus
APVLGNYREI

SEQ ID NO: 492381 - protein, 10 aa, Influenza virus
APVLGNYREV

SEQ ID NO: 492382 - protein, 10 aa, Influenza virus
APYRSLIRFP

SEQ ID NO: 492383 - protein, 10 aa, Influenza virus
AQAFYKILKI

SEQ ID NO: 492384 - protein, 10 aa, Influenza virus
AQDILEKTHN

SEQ ID NO: 492385 - protein, 10 aa, Influenza virus
AQDILERTHN

SEQ ID NO: 492386 - protein, 10 aa, Influenza virus
AQDNAIRFGE

SEQ ID NO: 492387 - protein, 10 aa, Influenza virus
AQDVIMEVVF

SEQ ID NO: 492388 - protein, 10 aa, Influenza virus
AQGALLGTKH

SEQ ID NO: 492389 - protein, 10 aa, Influenza virus
AQGALLGTNH

SEQ ID NO: 492390 - protein, 10 aa, Influenza virus
AQGALLGTRH

SEQ ID NO: 492391 - protein, 10 aa, Influenza virus
AQGALVGTKH

SEQ ID NO: 492392 - protein, 10 aa, Influenza virus
AQGEGIAADY

SEQ ID NO: 492393 - protein, 10 aa, Influenza virus
AQGEGTAADY

SEQ ID NO: 492394 - protein, 10 aa, Influenza virus
AQGIGQAADY

SEQ ID NO: 492395 - protein, 10 aa, Influenza virus
AQGQGTAADY

SEQ ID NO: 492396 - protein, 10 aa, Influenza virus
AQGSGYAADL

SEQ ID NO: 492397 - protein, 10 aa, Influenza virus
AQGSYNNTSG

SEQ ID NO: 492398 - protein, 10 aa, Influenza virus
AQGTGLAADY

SEQ ID NO: 492399 - protein, 10 aa, Influenza virus
AQGTGQAADY

SEQ ID NO: 492400 - protein, 10 aa, Influenza virus
AQGVLLGTKH

SEQ ID NO: 492401 - protein, 10 aa, Influenza virus
AQGYKDIILW

SEQ ID NO: 492402 - protein, 10 aa, Influenza virus
AQHIEECSCY

SEQ ID NO: 492403 - protein, 10 aa, Influenza virus
AQHVEECSCY

SEQ ID NO: 492404 - protein, 10 aa, Influenza virus
AQIDESCEGE

SEQ ID NO: 492405 - protein, 10 aa, Influenza virus
AQIIKLLPFA

SEQ ID NO: 492406 - protein, 10 aa, Influenza virus
AQKAMMDQVR

SEQ ID NO: 492407 - protein, 10 aa, Influenza virus
AQKLEDVFAG

SEQ ID NO: 492408 - protein, 10 aa, Influenza virus
AQLLVLLENE

SEQ ID NO: 492409 - protein, 10 aa, Influenza virus
AQLLVWLENE

SEQ ID NO: 492410 - protein, 10 aa, Influenza virus
AQMALQLFIK

SEQ ID NO: 492411 - protein, 10 aa, Influenza virus
AQNAISITFP

SEQ ID NO: 492412 - protein, 10 aa, Influenza virus
AQNAISTTFP

SEQ ID NO: 492413 - protein, 10 aa, Influenza virus
AQNILEKTHN

SEQ ID NO: 492414 - protein, 10 aa, Influenza virus
AQRAMMDQVR

SEQ ID NO: 492415 - protein, 10 aa, Influenza virus
AQRAMVDQVR

SEQ ID NO: 492416 - protein, 10 aa, Influenza virus
AQRLEDVFAG

SEQ ID NO: 492417 - protein, 10 aa, Influenza virus
AQRLEGVFAG

SEQ ID NO: 492418 - protein, 10 aa, Influenza virus
AQRLENVFAG

SEQ ID NO: 492419 - protein, 10 aa, Influenza virus
AQRLESVFAG

SEQ ID NO: 492420 - protein, 10 aa, Influenza virus
AQSFYRSINW

SEQ ID NO: 492421 - protein, 10 aa, Influenza virus
AQSLSISVGS

SEQ ID NO: 492422 - protein, 10 aa, Influenza virus
AQTDCVLEAM

SEQ ID NO: 492423 - protein, 10 aa, Influenza virus
AQYREEALLN

SEQ ID NO: 492424 - protein, 10 aa, Influenza virus
ARCICEKLEQ

SEQ ID NO: 492425 - protein, 10 aa, Influenza virus
ARCNTKCQTS

SEQ ID NO: 492426 - protein, 10 aa, Influenza virus
ARDEGNGCFT

SEQ ID NO: 492427 - protein, 10 aa, Influenza virus
AREIGNGCFE

SEQ ID NO: 492428 - protein, 10 aa, Influenza virus
ARELGNGCFE

SEQ ID NO: 492429 - protein, 10 aa, Influenza virus
ARFEAVAWSA

SEQ ID NO: 492430 - protein, 10 aa, Influenza virus
ARFESVAWSA

SEQ ID NO: 492431 - protein, 10 aa, Influenza virus
ARGDKICLGH

SEQ ID NO: 492432 - protein, 10 aa, Influenza virus
ARGEKANVLI

SEQ ID NO: 492433 - protein, 10 aa, Influenza virus
ARGLFGAIAG

SEQ ID NO: 492434 - protein, 10 aa, Influenza virus
ARGSYNNTSG

SEQ ID NO: 492435 - protein, 10 aa, Influenza virus
ARHIEECSCY

SEQ ID NO: 492436 - protein, 10 aa, Influenza virus
ARHIEEWSCY

SEQ ID NO: 492437 - protein, 10 aa, Influenza virus
ARHVEECSCY

SEQ ID NO: 492438 - protein, 10 aa, Influenza virus
ARIDARIDFE

SEQ ID NO: 492439 - protein, 10 aa, Influenza virus
ARIDARVDFE

SEQ ID NO: 492440 - protein, 10 aa, Influenza virus
ARIDARVDSE

SEQ ID NO: 492441 - protein, 10 aa, Influenza virus
ARIDFESGRI

SEQ ID NO: 492442 - protein, 10 aa, Influenza virus
ARIDFESGRM

SEQ ID NO: 492443 - protein, 10 aa, Influenza virus
ARIDFESGRV

SEQ ID NO: 492444 - protein, 10 aa, Influenza virus
ARIGEGQRSW

SEQ ID NO: 492445 - protein, 10 aa, Influenza virus
ARIITSESQL

SEQ ID NO: 492446 - protein, 10 aa, Influenza virus
ARIKTRLFTI

SEQ ID NO: 492447 - protein, 10 aa, Influenza virus
ARILASESQL

SEQ ID NO: 492448 - protein, 10 aa, Influenza virus
ARILTSESQL

SEQ ID NO: 492449 - protein, 10 aa, Influenza virus
ARILTSESQM

SEQ ID NO: 492450 - protein, 10 aa, Influenza virus
ARLGKGYMFE

SEQ ID NO: 492451 - protein, 10 aa, Influenza virus
ARLGRGYMFE

SEQ ID NO: 492452 - protein, 10 aa, Influenza virus
ARLLVLLEND

SEQ ID NO: 492453 - protein, 10 aa, Influenza virus
ARLYIWGVHH

SEQ ID NO: 492454 - protein, 10 aa, Influenza virus
ARNICEKLEQ

SEQ ID NO: 492455 - protein, 10 aa, Influenza virus
ARNILRTQDS

SEQ ID NO: 492456 - protein, 10 aa, Influenza virus
ARNILRTQES

SEQ ID NO: 492457 - protein, 10 aa, Influenza virus
ARNIVRRAAV

SEQ ID NO: 492458 - protein, 10 aa, Influenza virus
ARNIVRRAIV

SEQ ID NO: 492459 - protein, 10 aa, Influenza virus
ARNIVRRATV

SEQ ID NO: 492460 - protein, 10 aa, Influenza virus
ARPKVNGQAG

SEQ ID NO: 492461 - protein, 10 aa, Influenza virus
ARPKVNGQSG

SEQ ID NO: 492462 - protein, 10 aa, Influenza virus
ARPQVNGQRG

SEQ ID NO: 492463 - protein, 10 aa, Influenza virus
ARPQVNGQSG

SEQ ID NO: 492464 - protein, 10 aa, Influenza virus
ARQEKNPALR

SEQ ID NO: 492465 - protein, 10 aa, Influenza virus
ARRICEKLEQ

SEQ ID NO: 492466 - protein, 10 aa, Influenza virus
ARRIDFHWLF

SEQ ID NO: 492467 - protein, 10 aa, Influenza virus
ARRIDFHWLL

SEQ ID NO: 492468 - protein, 10 aa, Influenza virus
ARRIDFNWLL

SEQ ID NO: 492469 - protein, 10 aa, Influenza virus
ARSALILRGA

SEQ ID NO: 492470 - protein, 10 aa, Influenza virus
ARSALILRGS

SEQ ID NO: 492471 - protein, 10 aa, Influenza virus
ARSICEKLEQ

SEQ ID NO: 492472 - protein, 10 aa, Influenza virus
ARSIVRRATV

SEQ ID NO: 492473 - protein, 10 aa, Influenza virus
ARVDFESGRI

SEQ ID NO: 492474 - protein, 10 aa, Influenza virus
ARVDSESGRI

SEQ ID NO: 492475 - protein, 10 aa, Influenza virus
ARVWWTSNSI

SEQ ID NO: 492476 - protein, 10 aa, Influenza virus
ASACHDGASW

SEQ ID NO: 492477 - protein, 10 aa, Influenza virus
ASACHDGISW

SEQ ID NO: 492478 - protein, 10 aa, Influenza virus
ASACHDGSSW

SEQ ID NO: 492479 - protein, 10 aa, Influenza virus
ASACHDGTNW

SEQ ID NO: 492480 - protein, 10 aa, Influenza virus
ASACHDGTSW

SEQ ID NO: 492481 - protein, 10 aa, Influenza virus
ASAGQISIQP

SEQ ID NO: 492482 - protein, 10 aa, Influenza virus
ASAGQISTQP

SEQ ID NO: 492483 - protein, 10 aa, Influenza virus
ASAGQISVQP

SEQ ID NO: 492484 - protein, 10 aa, Influenza virus
ASAGQTSVQP

SEQ ID NO: 492485 - protein, 10 aa, Influenza virus
ASAGQVSVQP

SEQ ID NO: 492486 - protein, 10 aa, Influenza virus
ASALILRGSV

SEQ ID NO: 492487 - protein, 10 aa, Influenza virus
ASCAAMDDFQ

SEQ ID NO: 492488 - protein, 10 aa, Influenza virus
ASCAAMDEFQ

SEQ ID NO: 492489 - protein, 10 aa, Influenza virus
ASCAAMEDFQ

SEQ ID NO: 492490 - protein, 10 aa, Influenza virus
ASCFILLAIA

SEQ ID NO: 492491 - protein, 10 aa, Influenza virus
ASCFILLAIV

SEQ ID NO: 492492 - protein, 10 aa, Influenza virus
ASCFLLLAIA

SEQ ID NO: 492493 - protein, 10 aa, Influenza virus
ASCFLLLAIV

SEQ ID NO: 492494 - protein, 10 aa, Influenza virus
ASCFLLLAVV

SEQ ID NO: 492495 - protein, 10 aa, Influenza virus
ASCHDGRAWL

SEQ ID NO: 492496 - protein, 10 aa, Influenza virus
ASCMGLIYNR

SEQ ID NO: 492497 - protein, 10 aa, Influenza virus
ASCVMLLAIA

SEQ ID NO: 492498 - protein, 10 aa, Influenza virus
ASDILKRMSK

SEQ ID NO: 492499 - protein, 10 aa, Influenza virus
ASDILTRMSK

SEQ ID NO: 492500 - protein, 10 aa, Influenza virus
ASGDIWITRE

SEQ ID NO: 492501 - protein, 10 aa, Influenza virus
ASGDIWVTRE

SEQ ID NO: 492502 - protein, 10 aa, Influenza virus
ASGKADTRIL

SEQ ID NO: 492503 - protein, 10 aa, Influenza virus
ASGRADTKIL

SEQ ID NO: 492504 - protein, 10 aa, Influenza virus
ASGRADTRIL

SEQ ID NO: 492505 - protein, 10 aa, Influenza virus
ASGSSISFCG

SEQ ID NO: 492506 - protein, 10 aa, Influenza virus
ASICTHLEVC

SEQ ID NO: 492507 - protein, 10 aa, Influenza virus
ASIRNNTYDH

SEQ ID NO: 492508 - protein, 10 aa, Influenza virus
ASIRNNTYNH

SEQ ID NO: 492509 - protein, 10 aa, Influenza virus
ASIRNSTYDH

SEQ ID NO: 492510 - protein, 10 aa, Influenza virus
ASKEPEVHEG

SEQ ID NO: 492511 - protein, 10 aa, Influenza virus
ASKNPYTLVS

SEQ ID NO: 492512 - protein, 10 aa, Influenza virus
ASLCLAILIA

SEQ ID NO: 492513 - protein, 10 aa, Influenza virus
ASLCLAILVA

SEQ ID NO: 492514 - protein, 10 aa, Influenza virus
ASLCLAVLIA

SEQ ID NO: 492515 - protein, 10 aa, Influenza virus
ASLLEMCHGT

SEQ ID NO: 492516 - protein, 10 aa, Influenza virus
ASLLEMCHST

SEQ ID NO: 492517 - protein, 10 aa, Influenza virus
ASLRLAVGLR

SEQ ID NO: 492518 - protein, 10 aa, Influenza virus
ASLSPGMMMG

SEQ ID NO: 492519 - protein, 10 aa, Influenza virus
ASNINIREWS

SEQ ID NO: 492520 - protein, 10 aa, Influenza virus
ASNQASYKIF

SEQ ID NO: 492521 - protein, 10 aa, Influenza virus
ASNRPWISFD

SEQ ID NO: 492522 - protein, 10 aa, Influenza virus
ASNRPWVSFD

SEQ ID NO: 492523 - protein, 10 aa, Influenza virus
ASNRPWVSFN

SEQ ID NO: 492524 - protein, 10 aa, Influenza virus
ASNSIVTFCG

SEQ ID NO: 492525 - protein, 10 aa, Influenza virus
ASNSLIALCG

SEQ ID NO: 492526 - protein, 10 aa, Influenza virus
ASPQLEGFSA

SEQ ID NO: 492527 - protein, 10 aa, Influenza virus
ASPSCLVVRK

SEQ ID NO: 492528 - protein, 10 aa, Influenza virus
ASQGTKRPYE

SEQ ID NO: 492529 - protein, 10 aa, Influenza virus
ASQGTKRSHE

SEQ ID NO: 492530 - protein, 10 aa, Influenza virus
ASQGTKRSYE

SEQ ID NO: 492531 - protein, 10 aa, Influenza virus
ASQYGPSHSI

SEQ ID NO: 492532 - protein, 10 aa, Influenza virus
ASRAGYEMLK

SEQ ID NO: 492533 - protein, 10 aa, Influenza virus
ASRHHMGECP

SEQ ID NO: 492534 - protein, 10 aa, Influenza virus
ASRHYMGECP

SEQ ID NO: 492535 - protein, 10 aa, Influenza virus
ASRSGYEMLK

SEQ ID NO: 492536 - protein, 10 aa, Influenza virus
ASRYGYEMLK

SEQ ID NO: 492537 - protein, 10 aa, Influenza virus
ASRYYMGECP

SEQ ID NO: 492538 - protein, 10 aa, Influenza virus
ASSGIAIALG

SEQ ID NO: 492539 - protein, 10 aa, Influenza virus
ASSGIAIVLG

SEQ ID NO: 492540 - protein, 10 aa, Influenza virus
ASSGSLEFIA

SEQ ID NO: 492541 - protein, 10 aa, Influenza virus
ASSISFCGVN

SEQ ID NO: 492542 - protein, 10 aa, Influenza virus
ASSIVLVGLI

SEQ ID NO: 492543 - protein, 10 aa, Influenza virus
ASSIVMVGLI

SEQ ID NO: 492544 - protein, 10 aa, Influenza virus
ASSKSRARIK

SEQ ID NO: 492545 - protein, 10 aa, Influenza virus
ASSLILAAII

SEQ ID NO: 492546 - protein, 10 aa, Influenza virus
ASSLILAALI

SEQ ID NO: 492547 - protein, 10 aa, Influenza virus
ASSLPFQNIN

SEQ ID NO: 492548 - protein, 10 aa, Influenza virus
ASSLVLAAII

SEQ ID NO: 492549 - protein, 10 aa, Influenza virus
ASSLVLAALI

SEQ ID NO: 492550 - protein, 10 aa, Influenza virus
ASSLVLAALN

SEQ ID NO: 492551 - protein, 10 aa, Influenza virus
ASSLVLIVSL

SEQ ID NO: 492552 - protein, 10 aa, Influenza virus
ASSLVLLFMI

SEQ ID NO: 492553 - protein, 10 aa, Influenza virus
ASSLVLLLMI

SEQ ID NO: 492554 - protein, 10 aa, Influenza virus
ASSLVLLVSL

SEQ ID NO: 492555 - protein, 10 aa, Influenza virus
ASSLVLVVSL

SEQ ID NO: 492556 - protein, 10 aa, Influenza virus
ASSQLEGFSA

SEQ ID NO: 492557 - protein, 10 aa, Influenza virus
ASSSVLLVSL

SEQ ID NO: 492558 - protein, 10 aa, Influenza virus
ASSTVLVGLI

SEQ ID NO: 492559 - protein, 10 aa, Influenza virus
ASSTVMVGLI

SEQ ID NO: 492560 - protein, 10 aa, Influenza virus
ASSVVLVGLI

SEQ ID NO: 492561 - protein, 10 aa, Influenza virus
ASSVVLVGPI

SEQ ID NO: 492562 - protein, 10 aa, Influenza virus
ASTGAQSFYR

SEQ ID NO: 492563 - protein, 10 aa, Influenza virus
ASTGGQAFYR

SEQ ID NO: 492564 - protein, 10 aa, Influenza virus
ASTGGQSFYR

SEQ ID NO: 492565 - protein, 10 aa, Influenza virus
ASTLVLLVSL

SEQ ID NO: 492566 - protein, 10 aa, Influenza virus
ASTNAHDRIC

SEQ ID NO: 492567 - protein, 10 aa, Influenza virus
ASTNAYDRIC

SEQ ID NO: 492568 - protein, 10 aa, Influenza virus
ASTQKAIDEI

SEQ ID NO: 492569 - protein, 10 aa, Influenza virus
ASTQKAINEI

SEQ ID NO: 492570 - protein, 10 aa, Influenza virus
ASTTAKAMEQ

SEQ ID NO: 492571 - protein, 10 aa, Influenza virus
ASVPASRYLI

SEQ ID NO: 492572 - protein, 10 aa, Influenza virus
ASVPASRYLT

SEQ ID NO: 492573 - protein, 10 aa, Influenza virus
ASWAGNILRT

SEQ ID NO: 492574 - protein, 10 aa, Influenza virus
ASWFNSFLAH

SEQ ID NO: 492575 - protein, 10 aa, Influenza virus
ASWFNSFLIH

SEQ ID NO: 492576 - protein, 10 aa, Influenza virus
ASWFNSFLKH

SEQ ID NO: 492577 - protein, 10 aa, Influenza virus
ASWFNSFLTH

SEQ ID NO: 492578 - protein, 10 aa, Influenza virus
ASWFNSFLVH

SEQ ID NO: 492579 - protein, 10 aa, Influenza virus
ASWSWHDGAI

SEQ ID NO: 492580 - protein, 10 aa, Influenza virus
ASWSWHDGAV

SEQ ID NO: 492581 - protein, 10 aa, Influenza virus
ASYKRIRLFD

SEQ ID NO: 492582 - protein, 10 aa, Influenza virus
ASYKRVRLFD

SEQ ID NO: 492583 - protein, 10 aa, Influenza virus
ATACHDGKEW

SEQ ID NO: 492584 - protein, 10 aa, Influenza virus
ATACHDGKGW

SEQ ID NO: 492585 - protein, 10 aa, Influenza virus
ATACHDGKKW

SEQ ID NO: 492586 - protein, 10 aa, Influenza virus
ATACHDGRKW

SEQ ID NO: 492587 - protein, 10 aa, Influenza virus
ATACSDGPGW

SEQ ID NO: 492588 - protein, 10 aa, Influenza virus
ATACSDGSGW

SEQ ID NO: 492589 - protein, 10 aa, Influenza virus
ATAIFRKATR

SEQ ID NO: 492590 - protein, 10 aa, Influenza virus
ATAIIRKATR

SEQ ID NO: 492591 - protein, 10 aa, Influenza virus
ATAILKKATR

SEQ ID NO: 492592 - protein, 10 aa, Influenza virus
ATAILRKATK

SEQ ID NO: 492593 - protein, 10 aa, Influenza virus
ATAILRKATR

SEQ ID NO: 492594 - protein, 10 aa, Influenza virus
ATALANTIEI

SEQ ID NO: 492595 - protein, 10 aa, Influenza virus
ATALANTIEV

SEQ ID NO: 492596 - protein, 10 aa, Influenza virus
ATAQMALQLF

SEQ ID NO: 492597 - protein, 10 aa, Influenza virus
ATATVYYDRR

SEQ ID NO: 492598 - protein, 10 aa, Influenza virus
ATATVYYNGR

SEQ ID NO: 492599 - protein, 10 aa, Influenza virus
ATATVYYNKR

SEQ ID NO: 492600 - protein, 10 aa, Influenza virus
ATATVYYNRR

SEQ ID NO: 492601 - protein, 10 aa, Influenza virus
ATAVAVIKYN

SEQ ID NO: 492602 - protein, 10 aa, Influenza virus
ATAVAVLKYN

SEQ ID NO: 492603 - protein, 10 aa, Influenza virus
ATCEQIADAQ

SEQ ID NO: 492604 - protein, 10 aa, Influenza virus
ATCEQIADSH

SEQ ID NO: 492605 - protein, 10 aa, Influenza virus
ATCEQIADSQ

SEQ ID NO: 492606 - protein, 10 aa, Influenza virus
ATCVCRDNWQ

SEQ ID NO: 492607 - protein, 10 aa, Influenza virus
ATDTVDTLTE

SEQ ID NO: 492608 - protein, 10 aa, Influenza virus
ATETVEITGI

SEQ ID NO: 492609 - protein, 10 aa, Influenza virus
ATEYIIKGVY

SEQ ID NO: 492610 - protein, 10 aa, Influenza virus
ATEYIMKGVY

SEQ ID NO: 492611 - protein, 10 aa, Influenza virus
ATEYMMKGVY

SEQ ID NO: 492612 - protein, 10 aa, Influenza virus
ATFLRSNAPS

SEQ ID NO: 492613 - protein, 10 aa, Influenza virus
ATGFHFEECS

SEQ ID NO: 492614 - protein, 10 aa, Influenza virus
ATGFHLEECS

SEQ ID NO: 492615 - protein, 10 aa, Influenza virus
ATGLRNAHKM

SEQ ID NO: 492616 - protein, 10 aa, Influenza virus
ATGLRNIPQI

SEQ ID NO: 492617 - protein, 10 aa, Influenza virus
ATGLRNIPSI

SEQ ID NO: 492618 - protein, 10 aa, Influenza virus
ATGLRNVPIP

SEQ ID NO: 492619 - protein, 10 aa, Influenza virus
ATGLRNVPQI

SEQ ID NO: 492620 - protein, 10 aa, Influenza virus
ATGLRNVPQM

SEQ ID NO: 492621 - protein, 10 aa, Influenza virus
ATGLRNVPSI

SEQ ID NO: 492622 - protein, 10 aa, Influenza virus
ATGLRNVPSV

SEQ ID NO: 492623 - protein, 10 aa, Influenza virus
ATGMKNVPEI

SEQ ID NO: 492624 - protein, 10 aa, Influenza virus
ATGMKNVPET

SEQ ID NO: 492625 - protein, 10 aa, Influenza virus
ATGMRNIPEK

SEQ ID NO: 492626 - protein, 10 aa, Influenza virus
ATGMRNIPEN

SEQ ID NO: 492627 - protein, 10 aa, Influenza virus
ATGMRNIPER

SEQ ID NO: 492628 - protein, 10 aa, Influenza virus
ATGMRNIPGK

SEQ ID NO: 492629 - protein, 10 aa, Influenza virus
ATGMRNVPEI

SEQ ID NO: 492630 - protein, 10 aa, Influenza virus
ATGMRNVPEK

SEQ ID NO: 492631 - protein, 10 aa, Influenza virus
ATGMRNVPEN

SEQ ID NO: 492632 - protein, 10 aa, Influenza virus
ATGMRNVPER

SEQ ID NO: 492633 - protein, 10 aa, Influenza virus
ATGMRNVPET

SEQ ID NO: 492634 - protein, 10 aa, Influenza virus
ATGMRNVPEV

SEQ ID NO: 492635 - protein, 10 aa, Influenza virus
ATGPADTRIY

SEQ ID NO: 492636 - protein, 10 aa, Influenza virus
ATGPADTRVY

SEQ ID NO: 492637 - protein, 10 aa, Influenza virus
ATGPAETRIY

SEQ ID NO: 492638 - protein, 10 aa, Influenza virus
ATGPAETRVY

SEQ ID NO: 492639 - protein, 10 aa, Influenza virus
ATGPRNVPQI

SEQ ID NO: 492640 - protein, 10 aa, Influenza virus
ATGRVTVSTR

SEQ ID NO: 492641 - protein, 10 aa, Influenza virus
ATGYHFEECS

SEQ ID NO: 492642 - protein, 10 aa, Influenza virus
ATIDQITGKL

SEQ ID NO: 492643 - protein, 10 aa, Influenza virus
ATIGECPKYV

SEQ ID NO: 492644 - protein, 10 aa, Influenza virus
ATINEEALRQ

SEQ ID NO: 492645 - protein, 10 aa, Influenza virus
ATIWTSGSSI

SEQ ID NO: 492646 - protein, 10 aa, Influenza virus
ATKLYVNKNP

SEQ ID NO: 492647 - protein, 10 aa, Influenza virus
ATKMEAILVV

SEQ ID NO: 492648 - protein, 10 aa, Influenza virus
ATKMKAIIVV

SEQ ID NO: 492649 - protein, 10 aa, Influenza virus
ATKMKAILVV

SEQ ID NO: 492650 - protein, 10 aa, Influenza virus
ATLCLGHHAV

SEQ ID NO: 492651 - protein, 10 aa, Influenza virus
ATNGNYGPIN

SEQ ID NO: 492652 - protein, 10 aa, Influenza virus
ATNINIREWS

SEQ ID NO: 492653 - protein, 10 aa, Influenza virus
ATNLYVNKNP

SEQ ID NO: 492654 - protein, 10 aa, Influenza virus
ATNPIVPSFD

SEQ ID NO: 492655 - protein, 10 aa, Influenza virus
ATNPIVPSFE

SEQ ID NO: 492656 - protein, 10 aa, Influenza virus
ATNPVVPSFD

SEQ ID NO: 492657 - protein, 10 aa, Influenza virus
ATPGMQIRGF

SEQ ID NO: 492658 - protein, 10 aa, Influenza virus
ATQTLVSNND

SEQ ID NO: 492659 - protein, 10 aa, Influenza virus
ATREGKHIVE

SEQ ID NO: 492660 - protein, 10 aa, Influenza virus
ATRGVQIASN

SEQ ID NO: 492661 - protein, 10 aa, Influenza virus
ATRLYVNKNP

SEQ ID NO: 492662 - protein, 10 aa, Influenza virus
ATSACKRTVS

SEQ ID NO: 492663 - protein, 10 aa, Influenza virus
ATSPIVPSFD

SEQ ID NO: 492664 - protein, 10 aa, Influenza virus
ATTHSWIPKR

SEQ ID NO: 492665 - protein, 10 aa, Influenza virus
ATTHSWTPKR

SEQ ID NO: 492666 - protein, 10 aa, Influenza virus
ATTHSWVPIL

SEQ ID NO: 492667 - protein, 10 aa, Influenza virus
ATTHSWVPKR

SEQ ID NO: 492668 - protein, 10 aa, Influenza virus
ATTITLHFKQ

SEQ ID NO: 492669 - protein, 10 aa, Influenza virus
ATTNPLIKHE

SEQ ID NO: 492670 - protein, 10 aa, Influenza virus
ATTNPLIRHE

SEQ ID NO: 492671 - protein, 10 aa, Influenza virus
ATTVTLHFKQ

SEQ ID NO: 492672 - protein, 10 aa, Influenza virus
ATVAGSLSLA

SEQ ID NO: 492673 - protein, 10 aa, Influenza virus
ATVNEEALRQ

SEQ ID NO: 492674 - protein, 10 aa, Influenza virus
ATVNEGALRQ

SEQ ID NO: 492675 - protein, 10 aa, Influenza virus
ATVSADPLAS

SEQ ID NO: 492676 - protein, 10 aa, Influenza virus
ATVSADPLLS

SEQ ID NO: 492677 - protein, 10 aa, Influenza virus
ATVSADPLVS

SEQ ID NO: 492678 - protein, 10 aa, Influenza virus
ATVTLHFKQH

SEQ ID NO: 492679 - protein, 10 aa, Influenza virus
ATVYYDRRLT

SEQ ID NO: 492680 - protein, 10 aa, Influenza virus
ATVYYNGRLT

SEQ ID NO: 492681 - protein, 10 aa, Influenza virus
ATVYYNKRLT

SEQ ID NO: 492682 - protein, 10 aa, Influenza virus
ATVYYNRRLT

SEQ ID NO: 492683 - protein, 10 aa, Influenza virus
ATVYYNRRPT

SEQ ID NO: 492684 - protein, 10 aa, Influenza virus
ATYQRTRALV

SEQ ID NO: 492685 - protein, 10 aa, Influenza virus
AVAKDNAIRF

SEQ ID NO: 492686 - protein, 10 aa, Influenza virus
AVANGTKVNT

SEQ ID NO: 492687 - protein, 10 aa, Influenza virus
AVATTHSWIP

SEQ ID NO: 492688 - protein, 10 aa, Influenza virus
AVATTHSWTP

SEQ ID NO: 492689 - protein, 10 aa, Influenza virus
AVATTHSWVP

SEQ ID NO: 492690 - protein, 10 aa, Influenza virus
AVAVIKYNGI

SEQ ID NO: 492691 - protein, 10 aa, Influenza virus
AVAVLKYKGI

SEQ ID NO: 492692 - protein, 10 aa, Influenza virus
AVAVLKYNDI

SEQ ID NO: 492693 - protein, 10 aa, Influenza virus
AVAVLKYNGI

SEQ ID NO: 492694 - protein, 10 aa, Influenza virus
AVAVLKYNGV

SEQ ID NO: 492695 - protein, 10 aa, Influenza virus
AVAWSATACH

SEQ ID NO: 492696 - protein, 10 aa, Influenza virus
AVDEGNGCFE

SEQ ID NO: 492697 - protein, 10 aa, Influenza virus
AVDGTIAGFI

SEQ ID NO: 492698 - protein, 10 aa, Influenza virus
AVDICKAAIG

SEQ ID NO: 492699 - protein, 10 aa, Influenza virus
AVDICKAALG

SEQ ID NO: 492700 - protein, 10 aa, Influenza virus
AVDICKAAMG

SEQ ID NO: 492701 - protein, 10 aa, Influenza virus
AVDLGSCGIL

SEQ ID NO: 492702 - protein, 10 aa, Influenza virus
AVDQITGKLN

SEQ ID NO: 492703 - protein, 10 aa, Influenza virus
AVDTCYPFDV

SEQ ID NO: 492704 - protein, 10 aa, Influenza virus
AVDTGDGCFE

SEQ ID NO: 492705 - protein, 10 aa, Influenza virus
AVDTGNGCFD

SEQ ID NO: 492706 - protein, 10 aa, Influenza virus
AVEECLINDP

SEQ ID NO: 492707 - protein, 10 aa, Influenza virus
AVEKEFSNLE

SEQ ID NO: 492708 - protein, 10 aa, Influenza virus
AVENGTSVKT

SEQ ID NO: 492709 - protein, 10 aa, Influenza virus
AVENQHTIDL

SEQ ID NO: 492710 - protein, 10 aa, Influenza virus
AVFCGTSGTY

SEQ ID NO: 492711 - protein, 10 aa, Influenza virus
AVGGSGTDNY

SEQ ID NO: 492712 - protein, 10 aa, Influenza virus
AVGGSGTNNY

SEQ ID NO: 492713 - protein, 10 aa, Influenza virus
AVGICKAAMG

SEQ ID NO: 492714 - protein, 10 aa, Influenza virus
AVGKCPKYVK

SEQ ID NO: 492715 - protein, 10 aa, Influenza virus
AVGKCPRYVK

SEQ ID NO: 492716 - protein, 10 aa, Influenza virus
AVGKEFGNLE

SEQ ID NO: 492717 - protein, 10 aa, Influenza virus
AVGKEFNNLE

SEQ ID NO: 492718 - protein, 10 aa, Influenza virus
AVGKEFSNLE

SEQ ID NO: 492719 - protein, 10 aa, Influenza virus
AVGLRNTPSI

SEQ ID NO: 492720 - protein, 10 aa, Influenza virus
AVGLRNTPSV

SEQ ID NO: 492721 - protein, 10 aa, Influenza virus
AVGRCPRYVK

SEQ ID NO: 492722 - protein, 10 aa, Influenza virus
AVIHYGGIPT

SEQ ID NO: 492723 - protein, 10 aa, Influenza virus
AVIHYGGMPT

SEQ ID NO: 492724 - protein, 10 aa, Influenza virus
AVIHYGGVPT

SEQ ID NO: 492725 - protein, 10 aa, Influenza virus
AVIKYNGIIT

SEQ ID NO: 492726 - protein, 10 aa, Influenza virus
AVIYGNPKCD

SEQ ID NO: 492727 - protein, 10 aa, Influenza virus
AVKLSSGYKD

SEQ ID NO: 492728 - protein, 10 aa, Influenza virus
AVKLYKKLKR

SEQ ID NO: 492729 - protein, 10 aa, Influenza virus
AVKLYRKLKR

SEQ ID NO: 492730 - protein, 10 aa, Influenza virus
AVKQNGKSGA

SEQ ID NO: 492731 - protein, 10 aa, Influenza virus
AVLIAGGLIL

SEQ ID NO: 492732 - protein, 10 aa, Influenza virus
AVLKPGQTVK

SEQ ID NO: 492733 - protein, 10 aa, Influenza virus
AVLKYKGIIT

SEQ ID NO: 492734 - protein, 10 aa, Influenza virus
AVLKYNDIIT

SEQ ID NO: 492735 - protein, 10 aa, Influenza virus
AVLKYNGIIT

SEQ ID NO: 492736 - protein, 10 aa, Influenza virus
AVLKYNGMIT

SEQ ID NO: 492737 - protein, 10 aa, Influenza virus
AVLKYNGVIT

SEQ ID NO: 492738 - protein, 10 aa, Influenza virus
AVLRGFLIIG

SEQ ID NO: 492739 - protein, 10 aa, Influenza virus
AVLRGFLILG

SEQ ID NO: 492740 - protein, 10 aa, Influenza virus
AVNICKAAMG

SEQ ID NO: 492741 - protein, 10 aa, Influenza virus
AVNQITGKLN

SEQ ID NO: 492742 - protein, 10 aa, Influenza virus
AVNSSKPFQN

SEQ ID NO: 492743 - protein, 10 aa, Influenza virus
AVNSSMPFHN

SEQ ID NO: 492744 - protein, 10 aa, Influenza virus
AVNSWHILSK

SEQ ID NO: 492745 - protein, 10 aa, Influenza virus
AVNTTLSTIA

SEQ ID NO: 492746 - protein, 10 aa, Influenza virus
AVPNGTIVKT

SEQ ID NO: 492747 - protein, 10 aa, Influenza virus
AVPNGTIVRT

SEQ ID NO: 492748 - protein, 10 aa, Influenza virus
AVPNGTKVNT

SEQ ID NO: 492749 - protein, 10 aa, Influenza virus
AVPNGTLVKT

SEQ ID NO: 492750 - protein, 10 aa, Influenza virus
AVPNGTMVKT

SEQ ID NO: 492751 - protein, 10 aa, Influenza virus
AVPNGTVVKT

SEQ ID NO: 492752 - protein, 10 aa, Influenza virus
AVRFGESEQI

SEQ ID NO: 492753 - protein, 10 aa, Influenza virus
AVRGDLNFVN

SEQ ID NO: 492754 - protein, 10 aa, Influenza virus
AVSADPLASL

SEQ ID NO: 492755 - protein, 10 aa, Influenza virus
AVSFWMCSNG

SEQ ID NO: 492756 - protein, 10 aa, Influenza virus
AVSIDRFLRV

SEQ ID NO: 492757 - protein, 10 aa, Influenza virus
AVSNGTKINT

SEQ ID NO: 492758 - protein, 10 aa, Influenza virus
AVSNGTKVNT

SEQ ID NO: 492759 - protein, 10 aa, Influenza virus
AVTDGPAANN

SEQ ID NO: 492760 - protein, 10 aa, Influenza virus
AVTDGPAANS

SEQ ID NO: 492761 - protein, 10 aa, Influenza virus
AVTDIWSYNA

SEQ ID NO: 492762 - protein, 10 aa, Influenza virus
AVTDVWSYNA

SEQ ID NO: 492763 - protein, 10 aa, Influenza virus
AVTWWNRKGP

SEQ ID NO: 492764 - protein, 10 aa, Influenza virus
AVTWWNRNGP

SEQ ID NO: 492765 - protein, 10 aa, Influenza virus
AVTWWNRSGP

SEQ ID NO: 492766 - protein, 10 aa, Influenza virus
AVVKYNGIIT

SEQ ID NO: 492767 - protein, 10 aa, Influenza virus
AVVMGLVFIC

SEQ ID NO: 492768 - protein, 10 aa, Influenza virus
AVVMTDGNAS

SEQ ID NO: 492769 - protein, 10 aa, Influenza virus
AVVMTDGPAS

SEQ ID NO: 492770 - protein, 10 aa, Influenza virus
AVVMTDGSAS

SEQ ID NO: 492771 - protein, 10 aa, Influenza virus
AWLHICVTGD

SEQ ID NO: 492772 - protein, 10 aa, Influenza virus
AWLHVCITGD

SEQ ID NO: 492773 - protein, 10 aa, Influenza virus
AWLHVCVTGD

SEQ ID NO: 492774 - protein, 10 aa, Influenza virus
AWLHVCVTGH

SEQ ID NO: 492775 - protein, 10 aa, Influenza virus
AWSASACHDG

SEQ ID NO: 492776 - protein, 10 aa, Influenza virus
AWSATACHDG

SEQ ID NO: 492777 - protein, 10 aa, Influenza virus
AWSATACSDG

SEQ ID NO: 492778 - protein, 10 aa, Influenza virus
AWSRSSCHDG

SEQ ID NO: 492779 - protein, 10 aa, Influenza virus
AWSSASCHDG

SEQ ID NO: 492780 - protein, 10 aa, Influenza virus
AWSSSSCFDG

SEQ ID NO: 492781 - protein, 10 aa, Influenza virus
AWSSSSCHDG

SEQ ID NO: 492782 - protein, 10 aa, Influenza virus
AWSSSSCYDG

SEQ ID NO: 492783 - protein, 10 aa, Influenza virus
AWSSTSCFDG

SEQ ID NO: 492784 - protein, 10 aa, Influenza virus
AWSYIVERPS

SEQ ID NO: 492785 - protein, 10 aa, Influenza virus
AYAVIHYGGI

SEQ ID NO: 492786 - protein, 10 aa, Influenza virus
AYAVIHYGGM

SEQ ID NO: 492787 - protein, 10 aa, Influenza virus
AYAVIHYGGV

SEQ ID NO: 492788 - protein, 10 aa, Influenza virus
AYCNTDLGAP

SEQ ID NO: 492789 - protein, 10 aa, Influenza virus
AYCNTDLGSP

SEQ ID NO: 492790 - protein, 10 aa, Influenza virus
AYCNTDLGTP

SEQ ID NO: 492791 - protein, 10 aa, Influenza virus
AYCYPGATVN

SEQ ID NO: 492792 - protein, 10 aa, Influenza virus
AYCYPGSTVN

SEQ ID NO: 492793 - protein, 10 aa, Influenza virus
AYCYPGTTVN

SEQ ID NO: 492794 - protein, 10 aa, Influenza virus
AYDKICIGYQ

SEQ ID NO: 492795 - protein, 10 aa, Influenza virus
AYDRICIGYQ

SEQ ID NO: 492796 - protein, 10 aa, Influenza virus
AYERMCNILK

SEQ ID NO: 492797 - protein, 10 aa, Influenza virus
AYIVKKGDSA

SEQ ID NO: 492798 - protein, 10 aa, Influenza virus
AYKIIKKGDS

SEQ ID NO: 492799 - protein, 10 aa, Influenza virus
AYKILTIYST

SEQ ID NO: 492800 - protein, 10 aa, Influenza virus
AYKIVKEGDS

SEQ ID NO: 492801 - protein, 10 aa, Influenza virus
AYKIVKKGDS

SEQ ID NO: 492802 - protein, 10 aa, Influenza virus
AYKIVKTGDS

SEQ ID NO: 492803 - protein, 10 aa, Influenza virus
AYMLERELVR

SEQ ID NO: 492804 - protein, 10 aa, Influenza virus
AYNAELIVLL

SEQ ID NO: 492805 - protein, 10 aa, Influenza virus
AYNAELLVLI

SEQ ID NO: 492806 - protein, 10 aa, Influenza virus
AYNAELLVLL

SEQ ID NO: 492807 - protein, 10 aa, Influenza virus
AYNNTTGRDV

SEQ ID NO: 492808 - protein, 10 aa, Influenza virus
AYQKQMTRGL

SEQ ID NO: 492809 - protein, 10 aa, Influenza virus
AYQKRMGLQM

SEQ ID NO: 492810 - protein, 10 aa, Influenza virus
AYQKRMGVQI

SEQ ID NO: 492811 - protein, 10 aa, Influenza virus
AYQKRMGVQL

SEQ ID NO: 492812 - protein, 10 aa, Influenza virus
AYQKRMGVQM

SEQ ID NO: 492813 - protein, 10 aa, Influenza virus
AYQKRMTRGL

SEQ ID NO: 492814 - protein, 10 aa, Influenza virus
AYRKRMTRGL

SEQ ID NO: 492815 - protein, 10 aa, Influenza virus
AYSQITNGTT

SEQ ID NO: 492816 - protein, 10 aa, Influenza virus
AYTKIMYFHK

SEQ ID NO: 492817 - protein, 10 aa, Influenza virus
AYTKVLYFHK

SEQ ID NO: 492818 - protein, 10 aa, Influenza virus
AYTKVMYFHK

SEQ ID NO: 492819 - protein, 10 aa, Influenza virus
AYVDGFEPNG

SEQ ID NO: 492820 - protein, 10 aa, Influenza virus
AYVDGFKPNG

SEQ ID NO: 492821 - protein, 10 aa, Influenza virus
AYWWDGLQSS

SEQ ID NO: 492822 - protein, 10 aa, Influenza virus
CAAMDDFQLI

SEQ ID NO: 492823 - protein, 10 aa, Influenza virus
CAAMDEFQLI

SEQ ID NO: 492824 - protein, 10 aa, Influenza virus
CAAMEDFQLI

SEQ ID NO: 492825 - protein, 10 aa, Influenza virus
CAAWSSSSCF

SEQ ID NO: 492826 - protein, 10 aa, Influenza virus
CAAWSSSSCH

SEQ ID NO: 492827 - protein, 10 aa, Influenza virus
CAGIPSDTPR

SEQ ID NO: 492828 - protein, 10 aa, Influenza virus
CAGIPTDTPR

SEQ ID NO: 492829 - protein, 10 aa, Influenza virus
CAGLPSDTPR

SEQ ID NO: 492830 - protein, 10 aa, Influenza virus
CASNINIREW

SEQ ID NO: 492831 - protein, 10 aa, Influenza virus
CATCEQIADA

SEQ ID NO: 492832 - protein, 10 aa, Influenza virus
CATCEQIADS

SEQ ID NO: 492833 - protein, 10 aa, Influenza virus
CATNINIREW

SEQ ID NO: 492834 - protein, 10 aa, Influenza virus
CAVATTHSWV

SEQ ID NO: 492835 - protein, 10 aa, Influenza virus
CAVNSWHILS

SEQ ID NO: 492836 - protein, 10 aa, Influenza virus
CAVVMTDGNA

SEQ ID NO: 492837 - protein, 10 aa, Influenza virus
CAVVMTDGSA

SEQ ID NO: 492838 - protein, 10 aa, Influenza virus
CCNLFEKFFP

SEQ ID NO: 492839 - protein, 10 aa, Influenza virus
CCSLFEKFFP

SEQ ID NO: 492840 - protein, 10 aa, Influenza virus
CCTLFEKFFP

SEQ ID NO: 492841 - protein, 10 aa, Influenza virus
CDAPFDDRLR

SEQ ID NO: 492842 - protein, 10 aa, Influenza virus
CDDDCMASIR

SEQ ID NO: 492843 - protein, 10 aa, Influenza virus
CDDHCMESIR

SEQ ID NO: 492844 - protein, 10 aa, Influenza virus
CDDLIGKNSW

SEQ ID NO: 492845 - protein, 10 aa, Influenza virus
CDDLIGKTSW

SEQ ID NO: 492846 - protein, 10 aa, Influenza virus
CDDNCMERIR

SEQ ID NO: 492847 - protein, 10 aa, Influenza virus
CDDNCMESIR

SEQ ID NO: 492848 - protein, 10 aa, Influenza virus
CDDQCMESIR

SEQ ID NO: 492849 - protein, 10 aa, Influenza virus
CDDSCMESIR

SEQ ID NO: 492850 - protein, 10 aa, Influenza virus
CDELIGKTSW

SEQ ID NO: 492851 - protein, 10 aa, Influenza virus
CDHSDNADKI

SEQ ID NO: 492852 - protein, 10 aa, Influenza virus
CDIINGALGS

SEQ ID NO: 492853 - protein, 10 aa, Influenza virus
CDIVNAALGS

SEQ ID NO: 492854 - protein, 10 aa, Influenza virus
CDIVNGALGS

SEQ ID NO: 492855 - protein, 10 aa, Influenza virus
CDIVNSALGS

SEQ ID NO: 492856 - protein, 10 aa, Influenza virus
CDLHLEFKAD

SEQ ID NO: 492857 - protein, 10 aa, Influenza virus
CDLHLTGKWD

SEQ ID NO: 492858 - protein, 10 aa, Influenza virus
CDLHLTGMWD

SEQ ID NO: 492859 - protein, 10 aa, Influenza virus
CDLHLTGTWD

SEQ ID NO: 492860 - protein, 10 aa, Influenza virus
CDLINGALGS

SEQ ID NO: 492861 - protein, 10 aa, Influenza virus
CDLYLNGREW

SEQ ID NO: 492862 - protein, 10 aa, Influenza virus
CDLYLSGREW

SEQ ID NO: 492863 - protein, 10 aa, Influenza virus
CDLYLTGTWD

SEQ ID NO: 492864 - protein, 10 aa, Influenza virus
CDNECMETIK

SEQ ID NO: 492865 - protein, 10 aa, Influenza virus
CDNKCIESIR

SEQ ID NO: 492866 - protein, 10 aa, Influenza virus
CDNKCMETIK

SEQ ID NO: 492867 - protein, 10 aa, Influenza virus
CDNLIGKTSW

SEQ ID NO: 492868 - protein, 10 aa, Influenza virus
CDNNCIESIR

SEQ ID NO: 492869 - protein, 10 aa, Influenza virus
CDNNCMESIR

SEQ ID NO: 492870 - protein, 10 aa, Influenza virus
CDNQCMESIR

SEQ ID NO: 492871 - protein, 10 aa, Influenza virus
CDNSCIESIR

SEQ ID NO: 492872 - protein, 10 aa, Influenza virus
CDPDECRFYA

SEQ ID NO: 492873 - protein, 10 aa, Influenza virus
CDPDGCRFYA

SEQ ID NO: 492874 - protein, 10 aa, Influenza virus
CDPHLTGTWD

SEQ ID NO: 492875 - protein, 10 aa, Influenza virus
CDPLGCKMYA

SEQ ID NO: 492876 - protein, 10 aa, Influenza virus
CDPLGCKTYA

SEQ ID NO: 492877 - protein, 10 aa, Influenza virus
CDPLGCRMYA

SEQ ID NO: 492878 - protein, 10 aa, Influenza virus
CDPNECRFYA

SEQ ID NO: 492879 - protein, 10 aa, Influenza virus
CDPSGCKMYA

SEQ ID NO: 492880 - protein, 10 aa, Influenza virus
CDPTGCKMYA

SEQ ID NO: 492881 - protein, 10 aa, Influenza virus
CDPYLNGREW

SEQ ID NO: 492882 - protein, 10 aa, Influenza virus
CDRLQDTTWD

SEQ ID NO: 492883 - protein, 10 aa, Influenza virus
CDSHLKFKAD

SEQ ID NO: 492884 - protein, 10 aa, Influenza virus
CDSPSNINGE

SEQ ID NO: 492885 - protein, 10 aa, Influenza virus
CDSPSNINGG

SEQ ID NO: 492886 - protein, 10 aa, Influenza virus
CDSPSNVKGG

SEQ ID NO: 492887 - protein, 10 aa, Influenza virus
CDSPSNVNGG

SEQ ID NO: 492888 - protein, 10 aa, Influenza virus
CDTKCQTPLG

SEQ ID NO: 492889 - protein, 10 aa, Influenza virus
CDYLIGKTSW

SEQ ID NO: 492890 - protein, 10 aa, Influenza virus
CEGECFYSGG

SEQ ID NO: 492891 - protein, 10 aa, Influenza virus
CEKLEQSGLP

SEQ ID NO: 492892 - protein, 10 aa, Influenza virus
CEPDECRFYA

SEQ ID NO: 492893 - protein, 10 aa, Influenza virus
CEQIADAQHR

SEQ ID NO: 492894 - protein, 10 aa, Influenza virus
CEQIADSHHR

SEQ ID NO: 492895 - protein, 10 aa, Influenza virus
CEQIADSQHK

SEQ ID NO: 492896 - protein, 10 aa, Influenza virus
CEQIADSQHR

SEQ ID NO: 492897 - protein, 10 aa, Influenza virus
CESKCFWKGG

SEQ ID NO: 492898 - protein, 10 aa, Influenza virus
CESKCFWKSG

SEQ ID NO: 492899 - protein, 10 aa, Influenza virus
CESKCFWRGG

SEQ ID NO: 492900 - protein, 10 aa, Influenza virus
CETKCQSPLG

SEQ ID NO: 492901 - protein, 10 aa, Influenza virus
CETKCQTPLG

SEQ ID NO: 492902 - protein, 10 aa, Influenza virus
CETQCQTPLG

SEQ ID NO: 492903 - protein, 10 aa, Influenza virus
CETRCQTPLG

SEQ ID NO: 492904 - protein, 10 aa, Influenza virus
CEVNSWHIFS

SEQ ID NO: 492905 - protein, 10 aa, Influenza virus
CEVNSWHILS

SEQ ID NO: 492906 - protein, 10 aa, Influenza virus
CEVSSWHILS

SEQ ID NO: 492907 - protein, 10 aa, Influenza virus
CFDGKEWLHV

SEQ ID NO: 492908 - protein, 10 aa, Influenza virus
CFDGKEWMHI

SEQ ID NO: 492909 - protein, 10 aa, Influenza virus
CFDGKEWMHV

SEQ ID NO: 492910 - protein, 10 aa, Influenza virus
CFDGREWMHV

SEQ ID NO: 492911 - protein, 10 aa, Influenza virus
CFDILHKCDN

SEQ ID NO: 492912 - protein, 10 aa, Influenza virus
CFDILHKCNN

SEQ ID NO: 492913 - protein, 10 aa, Influenza virus
CFEFWHKCDD

SEQ ID NO: 492914 - protein, 10 aa, Influenza virus
CFEFWHKCDN

SEQ ID NO: 492915 - protein, 10 aa, Influenza virus
CFEFWHKCNN

SEQ ID NO: 492916 - protein, 10 aa, Influenza virus
CFEFYHKCDD

SEQ ID NO: 492917 - protein, 10 aa, Influenza virus
CFEFYHKCDN

SEQ ID NO: 492918 - protein, 10 aa, Influenza virus
CFEFYHKCND

SEQ ID NO: 492919 - protein, 10 aa, Influenza virus
CFEFYHKCNN

SEQ ID NO: 492920 - protein, 10 aa, Influenza virus
CFEFYHRCDD

SEQ ID NO: 492921 - protein, 10 aa, Influenza virus
CFEFYHRCDN

SEQ ID NO: 492922 - protein, 10 aa, Influenza virus
CFEIFHKCDD

SEQ ID NO: 492923 - protein, 10 aa, Influenza virus
CFEIFHKCDN

SEQ ID NO: 492924 - protein, 10 aa, Influenza virus
CFEIFHQCDN

SEQ ID NO: 492925 - protein, 10 aa, Influenza virus
CFEIFHQCNN

SEQ ID NO: 492926 - protein, 10 aa, Influenza virus
CFEIFHRCDD

SEQ ID NO: 492927 - protein, 10 aa, Influenza virus
CFEIFHRCDN

SEQ ID NO: 492928 - protein, 10 aa, Influenza virus
CFEILHKCDD

SEQ ID NO: 492929 - protein, 10 aa, Influenza virus
CFEILHKCDN

SEQ ID NO: 492930 - protein, 10 aa, Influenza virus
CFEILHKCND

SEQ ID NO: 492931 - protein, 10 aa, Influenza virus
CFEILHRCDD

SEQ ID NO: 492932 - protein, 10 aa, Influenza virus
CFEILHRCND

SEQ ID NO: 492933 - protein, 10 aa, Influenza virus
CFELLHKCND

SEQ ID NO: 492934 - protein, 10 aa, Influenza virus
CFELLHKCNN

SEQ ID NO: 492935 - protein, 10 aa, Influenza virus
CFKIYHKCDN

SEQ ID NO: 492936 - protein, 10 aa, Influenza virus
CFKIYHKCNN

SEQ ID NO: 492937 - protein, 10 aa, Influenza virus
CFKIYHRCDN

SEQ ID NO: 492938 - protein, 10 aa, Influenza virus
CFLWHVRKRF

SEQ ID NO: 492939 - protein, 10 aa, Influenza virus
CFMYSDFHFI

SEQ ID NO: 492940 - protein, 10 aa, Influenza virus
CFNFFHKCND

SEQ ID NO: 492941 - protein, 10 aa, Influenza virus
CFNGSLQCRI

SEQ ID NO: 492942 - protein, 10 aa, Influenza virus
CFNLLHKCND

SEQ ID NO: 492943 - protein, 10 aa, Influenza virus
CFNPCFYVEL

SEQ ID NO: 492944 - protein, 10 aa, Influenza virus
CFNPITGSPG

SEQ ID NO: 492945 - protein, 10 aa, Influenza virus
CFNPMIAELA

SEQ ID NO: 492946 - protein, 10 aa, Influenza virus
CFNPMIIELA

SEQ ID NO: 492947 - protein, 10 aa, Influenza virus
CFNPMIVELA

SEQ ID NO: 492948 - protein, 10 aa, Influenza virus
CFNPMTVELA

SEQ ID NO: 492949 - protein, 10 aa, Influenza virus
CFNPMVVELA

SEQ ID NO: 492950 - protein, 10 aa, Influenza virus
CFPFYHKCDN

SEQ ID NO: 492951 - protein, 10 aa, Influenza virus
CFPGELDNNG

SEQ ID NO: 492952 - protein, 10 aa, Influenza virus
CFPGEVDNNG

SEQ ID NO: 492953 - protein, 10 aa, Influenza virus
CFQPCFYIEL

SEQ ID NO: 492954 - protein, 10 aa, Influenza virus
CFQPCFYVEL

SEQ ID NO: 492955 - protein, 10 aa, Influenza virus
CFQRSKFLLM

SEQ ID NO: 492956 - protein, 10 aa, Influenza virus
CFRIYHKCDN

SEQ ID NO: 492957 - protein, 10 aa, Influenza virus
CFSILHKCND

SEQ ID NO: 492958 - protein, 10 aa, Influenza virus
CFSLLHKCND

SEQ ID NO: 492959 - protein, 10 aa, Influenza virus
CFTFYHKCDD

SEQ ID NO: 492960 - protein, 10 aa, Influenza virus
CFTFYHKCDN

SEQ ID NO: 492961 - protein, 10 aa, Influenza virus
CFTFYHKCNN

SEQ ID NO: 492962 - protein, 10 aa, Influenza virus
CFTIMTDGPN

SEQ ID NO: 492963 - protein, 10 aa, Influenza virus
CFTIMTDGPS

SEQ ID NO: 492964 - protein, 10 aa, Influenza virus
CFTIYHKCDN

SEQ ID NO: 492965 - protein, 10 aa, Influenza virus
CFTVLTDGPS

SEQ ID NO: 492966 - protein, 10 aa, Influenza virus
CFTVMTDGPN

SEQ ID NO: 492967 - protein, 10 aa, Influenza virus
CFTVMTDGPS

SEQ ID NO: 492968 - protein, 10 aa, Influenza virus
CFVFVALILG

SEQ ID NO: 492969 - protein, 10 aa, Influenza virus
CFWIELIRGR

SEQ ID NO: 492970 - protein, 10 aa, Influenza virus
CFWKGGSIKT

SEQ ID NO: 492971 - protein, 10 aa, Influenza virus
CFWKGGSINT

SEQ ID NO: 492972 - protein, 10 aa, Influenza virus
CFWKSGSINT

SEQ ID NO: 492973 - protein, 10 aa, Influenza virus
CFWLEMIRGK

SEQ ID NO: 492974 - protein, 10 aa, Influenza virus
CFWLEMIRGR

SEQ ID NO: 492975 - protein, 10 aa, Influenza virus
CFWMCSNGSL

SEQ ID NO: 492976 - protein, 10 aa, Influenza virus
CFWRGGSIIT

SEQ ID NO: 492977 - protein, 10 aa, Influenza virus
CFWRGGSINT

SEQ ID NO: 492978 - protein, 10 aa, Influenza virus
CFWVELIRGQ

SEQ ID NO: 492979 - protein, 10 aa, Influenza virus
CFWVELIRGR

SEQ ID NO: 492980 - protein, 10 aa, Influenza virus
CFWVELVRGL

SEQ ID NO: 492981 - protein, 10 aa, Influenza virus
CFWVELVRGR

SEQ ID NO: 492982 - protein, 10 aa, Influenza virus
CFWVEMIRGE

SEQ ID NO: 492983 - protein, 10 aa, Influenza virus
CFWVEMIRGK

SEQ ID NO: 492984 - protein, 10 aa, Influenza virus
CFWVEMIRGQ

SEQ ID NO: 492985 - protein, 10 aa, Influenza virus
CFWVEMIRGR

SEQ ID NO: 492986 - protein, 10 aa, Influenza virus
CFWVMTDGPA

SEQ ID NO: 492987 - protein, 10 aa, Influenza virus
CFYIELIRGK

SEQ ID NO: 492988 - protein, 10 aa, Influenza virus
CFYIELIRGR

SEQ ID NO: 492989 - protein, 10 aa, Influenza virus
CFYSGGTINS

SEQ ID NO: 492990 - protein, 10 aa, Influenza virus
CFYVELIRGK

SEQ ID NO: 492991 - protein, 10 aa, Influenza virus
CFYVELIRGM

SEQ ID NO: 492992 - protein, 10 aa, Influenza virus
CFYVELIRGR

SEQ ID NO: 492993 - protein, 10 aa, Influenza virus
CFYVELIRGS

SEQ ID NO: 492994 - protein, 10 aa, Influenza virus
CFYVELTRGR

SEQ ID NO: 492995 - protein, 10 aa, Influenza virus
CFYVELTRGV

SEQ ID NO: 492996 - protein, 10 aa, Influenza virus
CFYVELVRGR

SEQ ID NO: 492997 - protein, 10 aa, Influenza virus
CGCRDNWQGA

SEQ ID NO: 492998 - protein, 10 aa, Influenza virus
CGILGILTGP

SEQ ID NO: 492999 - protein, 10 aa, Influenza virus
CGILGTIIGP

SEQ ID NO: 493000 - protein, 10 aa, Influenza virus
CGLDNEPGSE

SEQ ID NO: 493001 - protein, 10 aa, Influenza virus
CGLDNEPGSG

SEQ ID NO: 493002 - protein, 10 aa, Influenza virus
CGLLGIITGP

SEQ ID NO: 493003 - protein, 10 aa, Influenza virus
CGLLGILIGP

SEQ ID NO: 493004 - protein, 10 aa, Influenza virus
CGLLGTITGP

SEQ ID NO: 493005 - protein, 10 aa, Influenza virus
CGLLGTLIGP

SEQ ID NO: 493006 - protein, 10 aa, Influenza virus
CGLLGTLTGP

SEQ ID NO: 493007 - protein, 10 aa, Influenza virus
CGLLGTVTGP

SEQ ID NO: 493008 - protein, 10 aa, Influenza virus
CGLNNEPGSG

SEQ ID NO: 493009 - protein, 10 aa, Influenza virus
CGMIDGWYGF

SEQ ID NO: 493010 - protein, 10 aa, Influenza virus
CGNGSCRCTI

SEQ ID NO: 493011 - protein, 10 aa, Influenza virus
CGNNCIESIR

SEQ ID NO: 493012 - protein, 10 aa, Influenza virus
CGPAECRTFF

SEQ ID NO: 493013 - protein, 10 aa, Influenza virus
CGPSECRTFF

SEQ ID NO: 493014 - protein, 10 aa, Influenza virus
CGPTECRTFF

SEQ ID NO: 493015 - protein, 10 aa, Influenza virus
CGSKEQLGSW

SEQ ID NO: 493016 - protein, 10 aa, Influenza virus
CGSKERLGSW

SEQ ID NO: 493017 - protein, 10 aa, Influenza virus
CGSKKRLGSW

SEQ ID NO: 493018 - protein, 10 aa, Influenza virus
CGSPFPVGSG

SEQ ID NO: 493019 - protein, 10 aa, Influenza virus
CGSPISVGSG

SEQ ID NO: 493020 - protein, 10 aa, Influenza virus
CGSPVPVGSG

SEQ ID NO: 493021 - protein, 10 aa, Influenza virus
CGSPVSVGSG

SEQ ID NO: 493022 - protein, 10 aa, Influenza virus
CGSRERLGSW

SEQ ID NO: 493023 - protein, 10 aa, Influenza virus
CGTSGTYGAG

SEQ ID NO: 493024 - protein, 10 aa, Influenza virus
CGTSGTYGSG

SEQ ID NO: 493025 - protein, 10 aa, Influenza virus
CGTSGTYGTG

SEQ ID NO: 493026 - protein, 10 aa, Influenza virus
CGVDSDTTGW

SEQ ID NO: 493027 - protein, 10 aa, Influenza virus
CGVDSDTTSW

SEQ ID NO: 493028 - protein, 10 aa, Influenza virus
CGVNSDTTCW

SEQ ID NO: 493029 - protein, 10 aa, Influenza virus
CGVNSDTTGW

SEQ ID NO: 493030 - protein, 10 aa, Influenza virus
CGVNSDTTSW

SEQ ID NO: 493031 - protein, 10 aa, Influenza virus
CGVSGEVPGW

SEQ ID NO: 493032 - protein, 10 aa, Influenza virus
CGVSSEAPGW

SEQ ID NO: 493033 - protein, 10 aa, Influenza virus
CGVSSEVPGC

SEQ ID NO: 493034 - protein, 10 aa, Influenza virus
CGVSSEVPGW

SEQ ID NO: 493035 - protein, 10 aa, Influenza virus
CHDGASWLTI

SEQ ID NO: 493036 - protein, 10 aa, Influenza virus
CHDGIARMTI

SEQ ID NO: 493037 - protein, 10 aa, Influenza virus
CHDGIGRMTI

SEQ ID NO: 493038 - protein, 10 aa, Influenza virus
CHDGISWLTI

SEQ ID NO: 493039 - protein, 10 aa, Influenza virus
CHDGKAWLHI

SEQ ID NO: 493040 - protein, 10 aa, Influenza virus
CHDGKAWLHV

SEQ ID NO: 493041 - protein, 10 aa, Influenza virus
CHDGKSWLHV

SEQ ID NO: 493042 - protein, 10 aa, Influenza virus
CHDGNAWLHV

SEQ ID NO: 493043 - protein, 10 aa, Influenza virus
CHDGRAWLHI

SEQ ID NO: 493044 - protein, 10 aa, Influenza virus
CHDGRAWLHV

SEQ ID NO: 493045 - protein, 10 aa, Influenza virus
CHDGSSWLTI

SEQ ID NO: 493046 - protein, 10 aa, Influenza virus
CHDGTNWLTI

SEQ ID NO: 493047 - protein, 10 aa, Influenza virus
CHDGTSWLTI

SEQ ID NO: 493048 - protein, 10 aa, Influenza virus
CHDGVCPVVF

SEQ ID NO: 493049 - protein, 10 aa, Influenza virus
CHDGVGRMTI

SEQ ID NO: 493050 - protein, 10 aa, Influenza virus
CHDGVNRMTI

SEQ ID NO: 493051 - protein, 10 aa, Influenza virus
CHDGVSRMTI

SEQ ID NO: 493052 - protein, 10 aa, Influenza virus
CHIGVAPSPS

SEQ ID NO: 493053 - protein, 10 aa, Influenza virus
CHNGICPVVF

SEQ ID NO: 493054 - protein, 10 aa, Influenza virus
CHNGTCAVVM

SEQ ID NO: 493055 - protein, 10 aa, Influenza virus
CHNGTCVVIM

SEQ ID NO: 493056 - protein, 10 aa, Influenza virus
CHNGTCVVVM

SEQ ID NO: 493057 - protein, 10 aa, Influenza virus
CHNGVCPVVF

SEQ ID NO: 493058 - protein, 10 aa, Influenza virus
CHQRSKFLLM

SEQ ID NO: 493059 - protein, 10 aa, Influenza virus
CHSAAFEDLR

SEQ ID NO: 493060 - protein, 10 aa, Influenza virus
CHSGICPVVF

SEQ ID NO: 493061 - protein, 10 aa, Influenza virus
CHSGVCPVVF

SEQ ID NO: 493062 - protein, 10 aa, Influenza virus
CHTKCQTYAG

SEQ ID NO: 493063 - protein, 10 aa, Influenza virus
CHTKCQTYTG

SEQ ID NO: 493064 - protein, 10 aa, Influenza virus
CIASSIVLVG

SEQ ID NO: 493065 - protein, 10 aa, Influenza virus
CIASSIVMVG

SEQ ID NO: 493066 - protein, 10 aa, Influenza virus
CIASSLILAA

SEQ ID NO: 493067 - protein, 10 aa, Influenza virus
CIASSLVLAA

SEQ ID NO: 493068 - protein, 10 aa, Influenza virus
CIASSTVLVG

SEQ ID NO: 493069 - protein, 10 aa, Influenza virus
CIASSTVMVG

SEQ ID NO: 493070 - protein, 10 aa, Influenza virus
CIASSVVLVG

SEQ ID NO: 493071 - protein, 10 aa, Influenza virus
CIAWSSASCH

SEQ ID NO: 493072 - protein, 10 aa, Influenza virus
CIAWSSSSCF

SEQ ID NO: 493073 - protein, 10 aa, Influenza virus
CIAWSSSSCH

SEQ ID NO: 493074 - protein, 10 aa, Influenza virus
CIAWSSSSCY

SEQ ID NO: 493075 - protein, 10 aa, Influenza virus
CICEKLEQSG

SEQ ID NO: 493076 - protein, 10 aa, Influenza virus
CICINGTCTV

SEQ ID NO: 493077 - protein, 10 aa, Influenza virus
CICRDNWKGA

SEQ ID NO: 493078 - protein, 10 aa, Influenza virus
CICRDNWKGS

SEQ ID NO: 493079 - protein, 10 aa, Influenza virus
CICRDNWRGA

SEQ ID NO: 493080 - protein, 10 aa, Influenza virus
CICRDNWTGT

SEQ ID NO: 493081 - protein, 10 aa, Influenza virus
CIDFRDMRKN

SEQ ID NO: 493082 - protein, 10 aa, Influenza virus
CIEGKLSQMP

SEQ ID NO: 493083 - protein, 10 aa, Influenza virus
CIEGKLSQMS

SEQ ID NO: 493084 - protein, 10 aa, Influenza virus
CIEKIRNGTY

SEQ ID NO: 493085 - protein, 10 aa, Influenza virus
CIEKVRNGTY

SEQ ID NO: 493086 - protein, 10 aa, Influenza virus
CIERVRNGTY

SEQ ID NO: 493087 - protein, 10 aa, Influenza virus
CIESIRNGTY

SEQ ID NO: 493088 - protein, 10 aa, Influenza virus
CIESKLSQMS

SEQ ID NO: 493089 - protein, 10 aa, Influenza virus
CIESVRNGTY

SEQ ID NO: 493090 - protein, 10 aa, Influenza virus
CIGHHANNST

SEQ ID NO: 493091 - protein, 10 aa, Influenza virus
CIGSIRNETY

SEQ ID NO: 493092 - protein, 10 aa, Influenza virus
CIGSIRNGTY

SEQ ID NO: 493093 - protein, 10 aa, Influenza virus
CIGWSSTSCH

SEQ ID NO: 493094 - protein, 10 aa, Influenza virus
CIGYHANNSK

SEQ ID NO: 493095 - protein, 10 aa, Influenza virus
CIGYHANNST

SEQ ID NO: 493096 - protein, 10 aa, Influenza virus
CIGYHSNNST

SEQ ID NO: 493097 - protein, 10 aa, Influenza virus
CIGYLSNNAT

SEQ ID NO: 493098 - protein, 10 aa, Influenza virus
CIGYLSNNSS

SEQ ID NO: 493099 - protein, 10 aa, Influenza virus
CIGYLSNNST

SEQ ID NO: 493100 - protein, 10 aa, Influenza virus
CIGYLSTNSS

SEQ ID NO: 493101 - protein, 10 aa, Influenza virus
CIGYMSNNST

SEQ ID NO: 493102 - protein, 10 aa, Influenza virus
CIGYQSNNST

SEQ ID NO: 493103 - protein, 10 aa, Influenza virus
CIGYQTNNST

SEQ ID NO: 493104 - protein, 10 aa, Influenza virus
CIINSWHIYG

SEQ ID NO: 493105 - protein, 10 aa, Influenza virus
CIKDGNMRCT

SEQ ID NO: 493106 - protein, 10 aa, Influenza virus
CIKFVSSDCS

SEQ ID NO: 493107 - protein, 10 aa, Influenza virus
CIKICESRLR

SEQ ID NO: 493108 - protein, 10 aa, Influenza virus
CIKNGNMQCT

SEQ ID NO: 493109 - protein, 10 aa, Influenza virus
CIKNGNMRCT

SEQ ID NO: 493110 - protein, 10 aa, Influenza virus
CIKNGNVRCT

SEQ ID NO: 493111 - protein, 10 aa, Influenza virus
CIKPCFWVEL

SEQ ID NO: 493112 - protein, 10 aa, Influenza virus
CILDQNFRNI

SEQ ID NO: 493113 - protein, 10 aa, Influenza virus
CINGICTVVM

SEQ ID NO: 493114 - protein, 10 aa, Influenza virus
CINGSCAVVM

SEQ ID NO: 493115 - protein, 10 aa, Influenza virus
CINGSCIVVM

SEQ ID NO: 493116 - protein, 10 aa, Influenza virus
CINGSCTVVM

SEQ ID NO: 493117 - protein, 10 aa, Influenza virus
CINGTCAVVM

SEQ ID NO: 493118 - protein, 10 aa, Influenza virus
CINGTCTVIM

SEQ ID NO: 493119 - protein, 10 aa, Influenza virus
CINGTCTVVM

SEQ ID NO: 493120 - protein, 10 aa, Influenza virus
CINRCFYVEL

SEQ ID NO: 493121 - protein, 10 aa, Influenza virus
CIQGNNDNAT

SEQ ID NO: 493122 - protein, 10 aa, Influenza virus
CIRFVNSDCS

SEQ ID NO: 493123 - protein, 10 aa, Influenza virus
CIRPCFWVEL

SEQ ID NO: 493124 - protein, 10 aa, Influenza virus
CISATGMALS

SEQ ID NO: 493125 - protein, 10 aa, Influenza virus
CISATGMILS

SEQ ID NO: 493126 - protein, 10 aa, Influenza virus
CISATGMTLS

SEQ ID NO: 493127 - protein, 10 aa, Influenza virus
CISATGVTLS

SEQ ID NO: 493128 - protein, 10 aa, Influenza virus
CISGPNNNAS

SEQ ID NO: 493129 - protein, 10 aa, Influenza virus
CISGTCAVVM

SEQ ID NO: 493130 - protein, 10 aa, Influenza virus
CISTTGMTLS

SEQ ID NO: 493131 - protein, 10 aa, Influenza virus
CITGDDKNAT

SEQ ID NO: 493132 - protein, 10 aa, Influenza virus
CITGDDRNAT

SEQ ID NO: 493133 - protein, 10 aa, Influenza virus
CITPNGSIPN

SEQ ID NO: 493134 - protein, 10 aa, Influenza virus
CITPNGSISN

SEQ ID NO: 493135 - protein, 10 aa, Influenza virus
CIVAVTDGPA

SEQ ID NO: 493136 - protein, 10 aa, Influenza virus
CIVPCFWLEM

SEQ ID NO: 493137 - protein, 10 aa, Influenza virus
CKAAIGLRIS

SEQ ID NO: 493138 - protein, 10 aa, Influenza virus
CKAALGLRIS

SEQ ID NO: 493139 - protein, 10 aa, Influenza virus
CKAAMGLKIS

SEQ ID NO: 493140 - protein, 10 aa, Influenza virus
CKAAMGLRIS

SEQ ID NO: 493141 - protein, 10 aa, Influenza virus
CKAAMGMRIS

SEQ ID NO: 493142 - protein, 10 aa, Influenza virus
CKIEAVIYGN

SEQ ID NO: 493143 - protein, 10 aa, Influenza virus
CKITGFAPFS

SEQ ID NO: 493144 - protein, 10 aa, Influenza virus
CKIVTTVGWS

SEQ ID NO: 493145 - protein, 10 aa, Influenza virus
CKLLGINMSK

SEQ ID NO: 493146 - protein, 10 aa, Influenza virus
CKLNGIPPLE

SEQ ID NO: 493147 - protein, 10 aa, Influenza virus
CKLVGINMSK

SEQ ID NO: 493148 - protein, 10 aa, Influenza virus
CKMYALHQGT

SEQ ID NO: 493149 - protein, 10 aa, Influenza virus
CKPYIGKCPK

SEQ ID NO: 493150 - protein, 10 aa, Influenza virus
CKRTVSSFYS

SEQ ID NO: 493151 - protein, 10 aa, Influenza virus
CKTFFLTQGA

SEQ ID NO: 493152 - protein, 10 aa, Influenza virus
CKTKCQTYAG

SEQ ID NO: 493153 - protein, 10 aa, Influenza virus
CKTKEGRRKT

SEQ ID NO: 493154 - protein, 10 aa, Influenza virus
CKVEAVIYGN

SEQ ID NO: 493155 - protein, 10 aa, Influenza virus
CKVEGWVVVA

SEQ ID NO: 493156 - protein, 10 aa, Influenza virus
CLAILIAGGL

SEQ ID NO: 493157 - protein, 10 aa, Influenza virus
CLAILVAGGL

SEQ ID NO: 493158 - protein, 10 aa, Influenza virus
CLAVLIAGGL

SEQ ID NO: 493159 - protein, 10 aa, Influenza virus
CLGHHAIPNG

SEQ ID NO: 493160 - protein, 10 aa, Influenza virus
CLGHHAVANG

SEQ ID NO: 493161 - protein, 10 aa, Influenza virus
CLGHHAVENG

SEQ ID NO: 493162 - protein, 10 aa, Influenza virus
CLGHHAVPNG

SEQ ID NO: 493163 - protein, 10 aa, Influenza virus
CLGHHAVQNG

SEQ ID NO: 493164 - protein, 10 aa, Influenza virus
CLGHHAVSNG

SEQ ID NO: 493165 - protein, 10 aa, Influenza virus
CLGHHAVTNG

SEQ ID NO: 493166 - protein, 10 aa, Influenza virus
CLINDPWVLL

SEQ ID NO: 493167 - protein, 10 aa, Influenza virus
CLKIYHKCDN

SEQ ID NO: 493168 - protein, 10 aa, Influenza virus
CLKNGNMRCT

SEQ ID NO: 493169 - protein, 10 aa, Influenza virus
CLLQSLQQIE

SEQ ID NO: 493170 - protein, 10 aa, Influenza virus
CLPACAYGPA

SEQ ID NO: 493171 - protein, 10 aa, Influenza virus
CLPACIYGLV

SEQ ID NO: 493172 - protein, 10 aa, Influenza virus
CLPACVYGLA

SEQ ID NO: 493173 - protein, 10 aa, Influenza virus
CLPACVYGLV

SEQ ID NO: 493174 - protein, 10 aa, Influenza virus
CLPACVYGPA

SEQ ID NO: 493175 - protein, 10 aa, Influenza virus
CLRGGRNSFF

SEQ ID NO: 493176 - protein, 10 aa, Influenza virus
CLRNGNMRCT

SEQ ID NO: 493177 - protein, 10 aa, Influenza virus
CLTDKGSIQS

SEQ ID NO: 493178 - protein, 10 aa, Influenza virus
CLVPCFWLEM

SEQ ID NO: 493179 - protein, 10 aa, Influenza virus
CLVPCFWVEM

SEQ ID NO: 493180 - protein, 10 aa, Influenza virus
CLYASPQLEG

SEQ ID NO: 493181 - protein, 10 aa, Influenza virus
CMASIRNNSY

SEQ ID NO: 493182 - protein, 10 aa, Influenza virus
CMASIRNNTY

SEQ ID NO: 493183 - protein, 10 aa, Influenza virus
CMASIRNSTY

SEQ ID NO: 493184 - protein, 10 aa, Influenza virus
CMATIRNGTY

SEQ ID NO: 493185 - protein, 10 aa, Influenza virus
CMAWSSSSCH

SEQ ID NO: 493186 - protein, 10 aa, Influenza virus
CMDSVKNGTY

SEQ ID NO: 493187 - protein, 10 aa, Influenza virus
CMDSVRNGTY

SEQ ID NO: 493188 - protein, 10 aa, Influenza virus
CMDTIRNGTY

SEQ ID NO: 493189 - protein, 10 aa, Influenza virus
CMEAIRNGTY

SEQ ID NO: 493190 - protein, 10 aa, Influenza virus
CMERIRNNTY

SEQ ID NO: 493191 - protein, 10 aa, Influenza virus
CMESIKNGTY

SEQ ID NO: 493192 - protein, 10 aa, Influenza virus
CMESIRNGTY

SEQ ID NO: 493193 - protein, 10 aa, Influenza virus
CMESIRNNTY

SEQ ID NO: 493194 - protein, 10 aa, Influenza virus
CMESVKNGTY

SEQ ID NO: 493195 - protein, 10 aa, Influenza virus
CMESVRNGTY

SEQ ID NO: 493196 - protein, 10 aa, Influenza virus
CMETIKNGTY

SEQ ID NO: 493197 - protein, 10 aa, Influenza virus
CMETIRNGTY

SEQ ID NO: 493198 - protein, 10 aa, Influenza virus
CMETTRNGTY

SEQ ID NO: 493199 - protein, 10 aa, Influenza virus
CMGLIYNRMG

SEQ ID NO: 493200 - protein, 10 aa, Influenza virus
CMGSIRNNTY

SEQ ID NO: 493201 - protein, 10 aa, Influenza virus
CMGTIRNGTY

SEQ ID NO: 493202 - protein, 10 aa, Influenza virus
CMIKAVRGDL

SEQ ID NO: 493203 - protein, 10 aa, Influenza virus
CMMKAVRGDL

SEQ ID NO: 493204 - protein, 10 aa, Influenza virus
CMNSVKNGTY

SEQ ID NO: 493205 - protein, 10 aa, Influenza virus
CMNSVKTGTY

SEQ ID NO: 493206 - protein, 10 aa, Influenza virus
CMNSVRNGTY

SEQ ID NO: 493207 - protein, 10 aa, Influenza virus
CMRPCFWVEL

SEQ ID NO: 493208 - protein, 10 aa, Influenza virus
CMSGPNDNAS

SEQ ID NO: 493209 - protein, 10 aa, Influenza virus
CMSGPNNNAS

SEQ ID NO: 493210 - protein, 10 aa, Influenza virus
CMSSVKNGTY

SEQ ID NO: 493211 - protein, 10 aa, Influenza virus
CMTSIRNNTY

SEQ ID NO: 493212 - protein, 10 aa, Influenza virus
CMVKAVRGDL

SEQ ID NO: 493213 - protein, 10 aa, Influenza virus
CNALTGGQSF

SEQ ID NO: 493214 - protein, 10 aa, Influenza virus
CNASTGAQSF

SEQ ID NO: 493215 - protein, 10 aa, Influenza virus
CNASTGGQAF

SEQ ID NO: 493216 - protein, 10 aa, Influenza virus
CNASTGGQSF

SEQ ID NO: 493217 - protein, 10 aa, Influenza virus
CNDNCMESIR

SEQ ID NO: 493218 - protein, 10 aa, Influenza virus
CNDPYPGNNB

SEQ ID NO: 493219 - protein, 10 aa, Influenza virus
CNDPYPGNNN

SEQ ID NO: 493220 - protein, 10 aa, Influenza virus
CNDSCMDTIR

SEQ ID NO: 493221 - protein, 10 aa, Influenza virus
CNDSCMEAIR

SEQ ID NO: 493222 - protein, 10 aa, Influenza virus
CNDSCMETIR

SEQ ID NO: 493223 - protein, 10 aa, Influenza virus
CNEPYPGNNN

SEQ ID NO: 493224 - protein, 10 aa, Influenza virus
CNFEGWIVGN

SEQ ID NO: 493225 - protein, 10 aa, Influenza virus
CNILKGKFQT

SEQ ID NO: 493226 - protein, 10 aa, Influenza virus
CNLFEKFFPS

SEQ ID NO: 493227 - protein, 10 aa, Influenza virus
CNNECMETIK

SEQ ID NO: 493228 - protein, 10 aa, Influenza virus
CNNGSCRCTI

SEQ ID NO: 493229 - protein, 10 aa, Influenza virus
CNNNCIESIR

SEQ ID NO: 493230 - protein, 10 aa, Influenza virus
CNNPITGSPE

SEQ ID NO: 493231 - protein, 10 aa, Influenza virus
CNNPITGSPG

SEQ ID NO: 493232 - protein, 10 aa, Influenza virus
CNNSCMETIR

SEQ ID NO: 493233 - protein, 10 aa, Influenza virus
CNNTCMETIR

SEQ ID NO: 493234 - protein, 10 aa, Influenza virus
CNPLNPFVGH

SEQ ID NO: 493235 - protein, 10 aa, Influenza virus
CNPLNPFVNH

SEQ ID NO: 493236 - protein, 10 aa, Influenza virus
CNPLNPFVSH

SEQ ID NO: 493237 - protein, 10 aa, Influenza virus
CNPLNPFVTH

SEQ ID NO: 493238 - protein, 10 aa, Influenza virus
CNPMNPFVSH

SEQ ID NO: 493239 - protein, 10 aa, Influenza virus
CNQFALGQGT

SEQ ID NO: 493240 - protein, 10 aa, Influenza virus
CNSAAFEDLR

SEQ ID NO: 493241 - protein, 10 aa, Influenza virus
CNSNAITRSG

SEQ ID NO: 493242 - protein, 10 aa, Influenza virus
CNTDLGAPLE

SEQ ID NO: 493243 - protein, 10 aa, Influenza virus
CNTDLGSPLE

SEQ ID NO: 493244 - protein, 10 aa, Influenza virus
CNTDLGTPLE

SEQ ID NO: 493245 - protein, 10 aa, Influenza virus
CNTKCQTSLG

SEQ ID NO: 493246 - protein, 10 aa, Influenza virus
CNTKCQTSMG

SEQ ID NO: 493247 - protein, 10 aa, Influenza virus
CNTKCQTSVG

SEQ ID NO: 493248 - protein, 10 aa, Influenza virus
CNTKCQTYAG

SEQ ID NO: 493249 - protein, 10 aa, Influenza virus
CNTRCQTSVG

SEQ ID NO: 493250 - protein, 10 aa, Influenza virus
CNVEGWVVIA

SEQ ID NO: 493251 - protein, 10 aa, Influenza virus
CPFKGFFPFH

SEQ ID NO: 493252 - protein, 10 aa, Influenza virus
CPFQGFFPFH

SEQ ID NO: 493253 - protein, 10 aa, Influenza virus
CPFRGFFPFH

SEQ ID NO: 493254 - protein, 10 aa, Influenza virus
CPIGEAPSPY

SEQ ID NO: 493255 - protein, 10 aa, Influenza virus
CPIGEVPSPY

SEQ ID NO: 493256 - protein, 10 aa, Influenza virus
CPIGVAPSPS

SEQ ID NO: 493257 - protein, 10 aa, Influenza virus
CPIKGWAPLS

SEQ ID NO: 493258 - protein, 10 aa, Influenza virus
CPIRGWAPLS

SEQ ID NO: 493259 - protein, 10 aa, Influenza virus
CPKYIKQGSL

SEQ ID NO: 493260 - protein, 10 aa, Influenza virus
CPKYIKSDQL

SEQ ID NO: 493261 - protein, 10 aa, Influenza virus
CPKYIKSGQL

SEQ ID NO: 493262 - protein, 10 aa, Influenza virus
CPKYIPSGSL

SEQ ID NO: 493263 - protein, 10 aa, Influenza virus
CPKYIPSNSL

SEQ ID NO: 493264 - protein, 10 aa, Influenza virus
CPKYIPSRSL

SEQ ID NO: 493265 - protein, 10 aa, Influenza virus
CPKYISSGSL

SEQ ID NO: 493266 - protein, 10 aa, Influenza virus
CPKYMNVKSL

SEQ ID NO: 493267 - protein, 10 aa, Influenza virus
CPKYVKQGSL

SEQ ID NO: 493268 - protein, 10 aa, Influenza virus
CPKYVKSDRL

SEQ ID NO: 493269 - protein, 10 aa, Influenza virus
CPKYVKSEKL

SEQ ID NO: 493270 - protein, 10 aa, Influenza virus
CPKYVKSERL

SEQ ID NO: 493271 - protein, 10 aa, Influenza virus
CPKYVNIKSL

SEQ ID NO: 493272 - protein, 10 aa, Influenza virus
CPKYVNVKSL

SEQ ID NO: 493273 - protein, 10 aa, Influenza virus
CPKYVNVRSL

SEQ ID NO: 493274 - protein, 10 aa, Influenza virus
CPKYVRSEKL

SEQ ID NO: 493275 - protein, 10 aa, Influenza virus
CPLGEAPSPY

SEQ ID NO: 493276 - protein, 10 aa, Influenza virus
CPMGVAPSPS

SEQ ID NO: 493277 - protein, 10 aa, Influenza virus
CPNGSLQCTI

SEQ ID NO: 493278 - protein, 10 aa, Influenza virus
CPRYIPSGSL

SEQ ID NO: 493279 - protein, 10 aa, Influenza virus
CPRYVKQGSL

SEQ ID NO: 493280 - protein, 10 aa, Influenza virus
CPRYVKQSSL

SEQ ID NO: 493281 - protein, 10 aa, Influenza virus
CPRYVKSEKL

SEQ ID NO: 493282 - protein, 10 aa, Influenza virus
CPSPLKLVDG

SEQ ID NO: 493283 - protein, 10 aa, Influenza virus
CPVGEAPSPY

SEQ ID NO: 493284 - protein, 10 aa, Influenza virus
CPVGVAPSPS

SEQ ID NO: 493285 - protein, 10 aa, Influenza virus
CPVKGWAPLS

SEQ ID NO: 493286 - protein, 10 aa, Influenza virus
CPVVFTDGSA

SEQ ID NO: 493287 - protein, 10 aa, Influenza virus
CPVVMTDGPA

SEQ ID NO: 493288 - protein, 10 aa, Influenza virus
CQDEFCYTLI

SEQ ID NO: 493289 - protein, 10 aa, Influenza virus
CQDEFCYTLM

SEQ ID NO: 493290 - protein, 10 aa, Influenza virus
CQDEFCYTLV

SEQ ID NO: 493291 - protein, 10 aa, Influenza virus
CQIAGFAPFS

SEQ ID NO: 493292 - protein, 10 aa, Influenza virus
CQITGFAPFS

SEQ ID NO: 493293 - protein, 10 aa, Influenza virus
CQKGNIKCNI

SEQ ID NO: 493294 - protein, 10 aa, Influenza virus
CQKGNIRCDI

SEQ ID NO: 493295 - protein, 10 aa, Influenza virus
CQKGNIRCNI

SEQ ID NO: 493296 - protein, 10 aa, Influenza virus
CQLNEGIMNT

SEQ ID NO: 493297 - protein, 10 aa, Influenza virus
CQLNEGVINT

SEQ ID NO: 493298 - protein, 10 aa, Influenza virus
CQLNEGVMNT

SEQ ID NO: 493299 - protein, 10 aa, Influenza virus
CQMEKIVLLF

SEQ ID NO: 493300 - protein, 10 aa, Influenza virus
CQNGNIRCQI

SEQ ID NO: 493301 - protein, 10 aa, Influenza virus
CQNGNIRCTF

SEQ ID NO: 493302 - protein, 10 aa, Influenza virus
CQNGNLRCQI

SEQ ID NO: 493303 - protein, 10 aa, Influenza virus
CQNGNVRCQI

SEQ ID NO: 493304 - protein, 10 aa, Influenza virus
CQNGNVRCTF

SEQ ID NO: 493305 - protein, 10 aa, Influenza virus
CQRGNIRCNI

SEQ ID NO: 493306 - protein, 10 aa, Influenza virus
CQSEIGGINT

SEQ ID NO: 493307 - protein, 10 aa, Influenza virus
CQSEIGGIST

SEQ ID NO: 493308 - protein, 10 aa, Influenza virus
CQSEIGWINT

SEQ ID NO: 493309 - protein, 10 aa, Influenza virus
CQSPLGAINT

SEQ ID NO: 493310 - protein, 10 aa, Influenza virus
CQTEIGGINT

SEQ ID NO: 493311 - protein, 10 aa, Influenza virus
CQTEVGGINT

SEQ ID NO: 493312 - protein, 10 aa, Influenza virus
CQTPIGAINS

SEQ ID NO: 493313 - protein, 10 aa, Influenza virus
CQTPLGAINS

SEQ ID NO: 493314 - protein, 10 aa, Influenza virus
CQTPLGAINT

SEQ ID NO: 493315 - protein, 10 aa, Influenza virus
CQTPLGALNT

SEQ ID NO: 493316 - protein, 10 aa, Influenza virus
CQTPMGAINS

SEQ ID NO: 493317 - protein, 10 aa, Influenza virus
CQTPMGAVNS

SEQ ID NO: 493318 - protein, 10 aa, Influenza virus
CQTPVGAINS

SEQ ID NO: 493319 - protein, 10 aa, Influenza virus
CQTSVGGIDT

SEQ ID NO: 493320 - protein, 10 aa, Influenza virus
CQTSVGGINT

SEQ ID NO: 493321 - protein, 10 aa, Influenza virus
CQTYAGAINS

SEQ ID NO: 493322 - protein, 10 aa, Influenza virus
CQTYAGAVNS

SEQ ID NO: 493323 - protein, 10 aa, Influenza virus
CQTYTGAINS

SEQ ID NO: 493324 - protein, 10 aa, Influenza virus
CQVECVCRDN

SEQ ID NO: 493325 - protein, 10 aa, Influenza virus
CRATEYIMKG

SEQ ID NO: 493326 - protein, 10 aa, Influenza virus
CRATEYMMKG

SEQ ID NO: 493327 - protein, 10 aa, Influenza virus
CRDNWHASNR

SEQ ID NO: 493328 - protein, 10 aa, Influenza virus
CRDNWHGSNR

SEQ ID NO: 493329 - protein, 10 aa, Influenza virus
CRDNWKGANR

SEQ ID NO: 493330 - protein, 10 aa, Influenza virus
CRDNWKGSNR

SEQ ID NO: 493331 - protein, 10 aa, Influenza virus
CRDNWMGSNR

SEQ ID NO: 493332 - protein, 10 aa, Influenza virus
CRDNWNGMNR

SEQ ID NO: 493333 - protein, 10 aa, Influenza virus
CRDNWQGANR

SEQ ID NO: 493334 - protein, 10 aa, Influenza virus
CRDNWQGSNR

SEQ ID NO: 493335 - protein, 10 aa, Influenza virus
CRDNWRGANR

SEQ ID NO: 493336 - protein, 10 aa, Influenza virus
CRDNWRGSNR

SEQ ID NO: 493337 - protein, 10 aa, Influenza virus
CRDNWTGTNR

SEQ ID NO: 493338 - protein, 10 aa, Influenza virus
CRETRGLFGA

SEQ ID NO: 493339 - protein, 10 aa, Influenza virus
CRFEGWIVGN

SEQ ID NO: 493340 - protein, 10 aa, Influenza virus
CRFYALSQGT

SEQ ID NO: 493341 - protein, 10 aa, Influenza virus
CRICIDFRDM

SEQ ID NO: 493342 - protein, 10 aa, Influenza virus
CRICILDQNF

SEQ ID NO: 493343 - protein, 10 aa, Influenza virus
CRIIQNEDIP

SEQ ID NO: 493344 - protein, 10 aa, Influenza virus
CRKTRGLFGA

SEQ ID NO: 493345 - protein, 10 aa, Influenza virus
CRLRGIPPLE

SEQ ID NO: 493346 - protein, 10 aa, Influenza virus
CRLSGIPPLE

SEQ ID NO: 493347 - protein, 10 aa, Influenza virus
CRMFALSQGT

SEQ ID NO: 493348 - protein, 10 aa, Influenza virus
CRMYALHQGT

SEQ ID NO: 493349 - protein, 10 aa, Influenza virus
CRTFFLTHGA

SEQ ID NO: 493350 - protein, 10 aa, Influenza virus
CRTFFLTHGS

SEQ ID NO: 493351 - protein, 10 aa, Influenza virus
CRTFFLTQGA

SEQ ID NO: 493352 - protein, 10 aa, Influenza virus
CRTFFLTQGS

SEQ ID NO: 493353 - protein, 10 aa, Influenza virus
CRTKEGRRKT

SEQ ID NO: 493354 - protein, 10 aa, Influenza virus
CRTKEGRRRT

SEQ ID NO: 493355 - protein, 10 aa, Influenza virus
CRTLLAKSVF

SEQ ID NO: 493356 - protein, 10 aa, Influenza virus
CRTREGRRKT

SEQ ID NO: 493357 - protein, 10 aa, Influenza virus
CSALFVYSLR

SEQ ID NO: 493358 - protein, 10 aa, Influenza virus
CSASTGGQSF

SEQ ID NO: 493359 - protein, 10 aa, Influenza virus
CSCIASSLVL

SEQ ID NO: 493360 - protein, 10 aa, Influenza virus
CSCYMDIDVY

SEQ ID NO: 493361 - protein, 10 aa, Influenza virus
CSCYPNDGKV

SEQ ID NO: 493362 - protein, 10 aa, Influenza virus
CSCYPNEGKV

SEQ ID NO: 493363 - protein, 10 aa, Influenza virus
CSCYPNLGIV

SEQ ID NO: 493364 - protein, 10 aa, Influenza virus
CSCYPNLGKV

SEQ ID NO: 493365 - protein, 10 aa, Influenza virus
CSCYPNLGQV

SEQ ID NO: 493366 - protein, 10 aa, Influenza virus
CSCYPNMGKV

SEQ ID NO: 493367 - protein, 10 aa, Influenza virus
CSCYPNNGKV

SEQ ID NO: 493368 - protein, 10 aa, Influenza virus
CSCYPNSGKV

SEQ ID NO: 493369 - protein, 10 aa, Influenza virus
CSCYPQYPNV

SEQ ID NO: 493370 - protein, 10 aa, Influenza virus
CSCYPRYPDV

SEQ ID NO: 493371 - protein, 10 aa, Influenza virus
CSCYPRYPGV

SEQ ID NO: 493372 - protein, 10 aa, Influenza virus
CSCYPRYPNV

SEQ ID NO: 493373 - protein, 10 aa, Influenza virus
CSCYSRYPNV

SEQ ID NO: 493374 - protein, 10 aa, Influenza virus
CSCYVDIDIY

SEQ ID NO: 493375 - protein, 10 aa, Influenza virus
CSCYVDIDVY

SEQ ID NO: 493376 - protein, 10 aa, Influenza virus
CSCYVDTDVY

SEQ ID NO: 493377 - protein, 10 aa, Influenza virus
CSCYVDVDVY

SEQ ID NO: 493378 - protein, 10 aa, Influenza virus
CSDGPGWLTI

SEQ ID NO: 493379 - protein, 10 aa, Influenza virus
CSDGPGWLTL

SEQ ID NO: 493380 - protein, 10 aa, Influenza virus
CSDGSGWLTL

SEQ ID NO: 493381 - protein, 10 aa, Influenza virus
CSFAGWILGN

SEQ ID NO: 493382 - protein, 10 aa, Influenza virus
CSFAGWLLGN

SEQ ID NO: 493383 - protein, 10 aa, Influenza virus
CSFEGWIGGN

SEQ ID NO: 493384 - protein, 10 aa, Influenza virus
CSFEGWIVGN

SEQ ID NO: 493385 - protein, 10 aa, Influenza virus
CSGFFGDNPR

SEQ ID NO: 493386 - protein, 10 aa, Influenza virus
CSGHSCRICI

SEQ ID NO: 493387 - protein, 10 aa, Influenza virus
CSGIFGDNPR

SEQ ID NO: 493388 - protein, 10 aa, Influenza virus
CSGLVGDTPR

SEQ ID NO: 493389 - protein, 10 aa, Influenza virus
CSGVFGDNPR

SEQ ID NO: 493390 - protein, 10 aa, Influenza virus
CSGVFGDSPR

SEQ ID NO: 493391 - protein, 10 aa, Influenza virus
CSGVFGDTPR

SEQ ID NO: 493392 - protein, 10 aa, Influenza virus
CSGVLGDNPR

SEQ ID NO: 493393 - protein, 10 aa, Influenza virus
CSHLECRTFF

SEQ ID NO: 493394 - protein, 10 aa, Influenza virus
CSHMECRTFF

SEQ ID NO: 493395 - protein, 10 aa, Influenza virus
CSHSECRTFF

SEQ ID NO: 493396 - protein, 10 aa, Influenza virus
CSIAGWLLGN

SEQ ID NO: 493397 - protein, 10 aa, Influenza virus
CSIDECRTFF

SEQ ID NO: 493398 - protein, 10 aa, Influenza virus
CSIDGKAPIS

SEQ ID NO: 493399 - protein, 10 aa, Influenza virus
CSIHECRTFF

SEQ ID NO: 493400 - protein, 10 aa, Influenza virus
CSINECRTFF

SEQ ID NO: 493401 - protein, 10 aa, Influenza virus
CSINGKAPIS

SEQ ID NO: 493402 - protein, 10 aa, Influenza virus
CSINGKQPIS

SEQ ID NO: 493403 - protein, 10 aa, Influenza virus
CSINGRAPIS

SEQ ID NO: 493404 - protein, 10 aa, Influenza virus
CSISECRTFF

SEQ ID NO: 493405 - protein, 10 aa, Influenza virus
CSIWFSHYNQ

SEQ ID NO: 493406 - protein, 10 aa, Influenza virus
CSKFHSDTPR

SEQ ID NO: 493407 - protein, 10 aa, Influenza virus
CSKILTDTSR

SEQ ID NO: 493408 - protein, 10 aa, Influenza virus
CSKTLTDTSR

SEQ ID NO: 493409 - protein, 10 aa, Influenza virus
CSKVLTDTSR

SEQ ID NO: 493410 - protein, 10 aa, Influenza virus
CSKYHWNLAL

SEQ ID NO: 493411 - protein, 10 aa, Influenza virus
CSLDGKAPIS

SEQ ID NO: 493412 - protein, 10 aa, Influenza virus
CSLEGIILGN

SEQ ID NO: 493413 - protein, 10 aa, Influenza virus
CSLEGLILGN

SEQ ID NO: 493414 - protein, 10 aa, Influenza virus
CSLEGLILSN

SEQ ID NO: 493415 - protein, 10 aa, Influenza virus
CSLEGLVLGN

SEQ ID NO: 493416 - protein, 10 aa, Influenza virus
CSLFEKFFPS

SEQ ID NO: 493417 - protein, 10 aa, Influenza virus
CSLKGLILGN

SEQ ID NO: 493418 - protein, 10 aa, Influenza virus
CSLMQGSTLP

SEQ ID NO: 493419 - protein, 10 aa, Influenza virus
CSLNGISPIH

SEQ ID NO: 493420 - protein, 10 aa, Influenza virus
CSLNGISPVH

SEQ ID NO: 493421 - protein, 10 aa, Influenza virus
CSLNGVSPIH

SEQ ID NO: 493422 - protein, 10 aa, Influenza virus
CSLNGVSPVH

SEQ ID NO: 493423 - protein, 10 aa, Influenza virus
CSNDTINYYN

SEQ ID NO: 493424 - protein, 10 aa, Influenza virus
CSNGNCRFNV

SEQ ID NO: 493425 - protein, 10 aa, Influenza virus
CSNGSCRCTI

SEQ ID NO: 493426 - protein, 10 aa, Influenza virus
CSNGSCRFNV

SEQ ID NO: 493427 - protein, 10 aa, Influenza virus
CSNGSLHGRI

SEQ ID NO: 493428 - protein, 10 aa, Influenza virus
CSNGSLQCKI

SEQ ID NO: 493429 - protein, 10 aa, Influenza virus
CSNGSLQCRI

SEQ ID NO: 493430 - protein, 10 aa, Influenza virus
CSNGSLQCRV

SEQ ID NO: 493431 - protein, 10 aa, Influenza virus
CSNGSLQCTI

SEQ ID NO: 493432 - protein, 10 aa, Influenza virus
CSNGSLRCRI

SEQ ID NO: 493433 - protein, 10 aa, Influenza virus
CSNNTTNYYN

SEQ ID NO: 493434 - protein, 10 aa, Influenza virus
CSNPITGSPC

SEQ ID NO: 493435 - protein, 10 aa, Influenza virus
CSNPITGSPG

SEQ ID NO: 493436 - protein, 10 aa, Influenza virus
CSNPITGSPS

SEQ ID NO: 493437 - protein, 10 aa, Influenza virus
CSPLSRCRET

SEQ ID NO: 493438 - protein, 10 aa, Influenza virus
CSPLSRCRKT

SEQ ID NO: 493439 - protein, 10 aa, Influenza virus
CSPSECRTFF

SEQ ID NO: 493440 - protein, 10 aa, Influenza virus
CSPVLTDNPR

SEQ ID NO: 493441 - protein, 10 aa, Influenza virus
CSQMECRTFF

SEQ ID NO: 493442 - protein, 10 aa, Influenza virus
CSQRSKFLLM

SEQ ID NO: 493443 - protein, 10 aa, Influenza virus
CSRILTDTSR

SEQ ID NO: 493444 - protein, 10 aa, Influenza virus
CSRVLTDTSR

SEQ ID NO: 493445 - protein, 10 aa, Influenza virus
CSSGNCRFNV

SEQ ID NO: 493446 - protein, 10 aa, Influenza virus
CSSGNCRFSV

SEQ ID NO: 493447 - protein, 10 aa, Influenza virus
CSSPSGIEGR

SEQ ID NO: 493448 - protein, 10 aa, Influenza virus
CSSTEFLGQW

SEQ ID NO: 493449 - protein, 10 aa, Influenza virus
CSVAGWLLGN

SEQ ID NO: 493450 - protein, 10 aa, Influenza virus
CSVEGWVVIA

SEQ ID NO: 493451 - protein, 10 aa, Influenza virus
CSVEYASKTR

SEQ ID NO: 493452 - protein, 10 aa, Influenza virus
CSVSECRTFF

SEQ ID NO: 493453 - protein, 10 aa, Influenza virus
CSWSLQCRIC

SEQ ID NO: 493454 - protein, 10 aa, Influenza virus
CSYLECRTFF

SEQ ID NO: 493455 - protein, 10 aa, Influenza virus
CTAMDDFQLI

SEQ ID NO: 493456 - protein, 10 aa, Influenza virus
CTCRDNWKGS

SEQ ID NO: 493457 - protein, 10 aa, Influenza virus
CTCRDNWQGS

SEQ ID NO: 493458 - protein, 10 aa, Influenza virus
CTGCFEIFHK

SEQ ID NO: 493459 - protein, 10 aa, Influenza virus
CTGILTDTSR

SEQ ID NO: 493460 - protein, 10 aa, Influenza virus
CTGNLIAPRG

SEQ ID NO: 493461 - protein, 10 aa, Influenza virus
CTGVLTDTSR

SEQ ID NO: 493462 - protein, 10 aa, Influenza virus
CTHLEICFMY

SEQ ID NO: 493463 - protein, 10 aa, Influenza virus
CTHLEVCFMY

SEQ ID NO: 493464 - protein, 10 aa, Influenza virus
CTHMEVCFMY

SEQ ID NO: 493465 - protein, 10 aa, Influenza virus
CTINSWHIFG

SEQ ID NO: 493466 - protein, 10 aa, Influenza virus
CTINSWHIYG

SEQ ID NO: 493467 - protein, 10 aa, Influenza virus
CTIPCFWVEM

SEQ ID NO: 493468 - protein, 10 aa, Influenza virus
CTISLVKTTL

SEQ ID NO: 493469 - protein, 10 aa, Influenza virus
CTKGKKAVDL

SEQ ID NO: 493470 - protein, 10 aa, Influenza virus
CTLFEKFFPS

SEQ ID NO: 493471 - protein, 10 aa, Influenza virus
CTLIDALLGD

SEQ ID NO: 493472 - protein, 10 aa, Influenza virus
CTLIDAMLGD

SEQ ID NO: 493473 - protein, 10 aa, Influenza virus
CTLMDALLGD

SEQ ID NO: 493474 - protein, 10 aa, Influenza virus
CTLVDALLGD

SEQ ID NO: 493475 - protein, 10 aa, Influenza virus
CTSPCLTDKG

SEQ ID NO: 493476 - protein, 10 aa, Influenza virus
CTVIMTDGSA

SEQ ID NO: 493477 - protein, 10 aa, Influenza virus
CTVPCFWVEM

SEQ ID NO: 493478 - protein, 10 aa, Influenza virus
CTVVMTDGNA

SEQ ID NO: 493479 - protein, 10 aa, Influenza virus
CTVVMTDGSA

SEQ ID NO: 493480 - protein, 10 aa, Influenza virus
CVAWSSSSCF

SEQ ID NO: 493481 - protein, 10 aa, Influenza virus
CVAWSSSSCH

SEQ ID NO: 493482 - protein, 10 aa, Influenza virus
CVAWSSTSCF

SEQ ID NO: 493483 - protein, 10 aa, Influenza virus
CVCHDGVCPV

SEQ ID NO: 493484 - protein, 10 aa, Influenza virus
CVCHKGICPV

SEQ ID NO: 493485 - protein, 10 aa, Influenza virus
CVCHKGVCPV

SEQ ID NO: 493486 - protein, 10 aa, Influenza virus
CVCHNGICPV

SEQ ID NO: 493487 - protein, 10 aa, Influenza virus
CVCHNGTCAV

SEQ ID NO: 493488 - protein, 10 aa, Influenza virus
CVCHNGTCVV

SEQ ID NO: 493489 - protein, 10 aa, Influenza virus
CVCHNGVCPV

SEQ ID NO: 493490 - protein, 10 aa, Influenza virus
CVCHNSTCVV

SEQ ID NO: 493491 - protein, 10 aa, Influenza virus
CVCHSGICPV

SEQ ID NO: 493492 - protein, 10 aa, Influenza virus
CVCINGICTV

SEQ ID NO: 493493 - protein, 10 aa, Influenza virus
CVCINGSCAV

SEQ ID NO: 493494 - protein, 10 aa, Influenza virus
CVCINGSCIV

SEQ ID NO: 493495 - protein, 10 aa, Influenza virus
CVCINGSCTV

SEQ ID NO: 493496 - protein, 10 aa, Influenza virus
CVCINGTCAV

SEQ ID NO: 493497 - protein, 10 aa, Influenza virus
CVCINGTCTV

SEQ ID NO: 493498 - protein, 10 aa, Influenza virus
CVCISGTCAV

SEQ ID NO: 493499 - protein, 10 aa, Influenza virus
CVCQDEFCYT

SEQ ID NO: 493500 - protein, 10 aa, Influenza virus
CVCRDNWHAS

SEQ ID NO: 493501 - protein, 10 aa, Influenza virus
CVCRDNWHGS

SEQ ID NO: 493502 - protein, 10 aa, Influenza virus
CVCRDNWKGA

SEQ ID NO: 493503 - protein, 10 aa, Influenza virus
CVCRDNWKGS

SEQ ID NO: 493504 - protein, 10 aa, Influenza virus
CVCRDNWMGS

SEQ ID NO: 493505 - protein, 10 aa, Influenza virus
CVCRDNWNGM

SEQ ID NO: 493506 - protein, 10 aa, Influenza virus
CVCRDNWQGA

SEQ ID NO: 493507 - protein, 10 aa, Influenza virus
CVCRDNWRGS

SEQ ID NO: 493508 - protein, 10 aa, Influenza virus
CVCRDNWTGT

SEQ ID NO: 493509 - protein, 10 aa, Influenza virus
CVGWSSTSCH

SEQ ID NO: 493510 - protein, 10 aa, Influenza virus
CVGWSSTTCH

SEQ ID NO: 493511 - protein, 10 aa, Influenza virus
CVGYHANNST

SEQ ID NO: 493512 - protein, 10 aa, Influenza virus
CVGYHSNNST

SEQ ID NO: 493513 - protein, 10 aa, Influenza virus
CVGYLSTNSS

SEQ ID NO: 493514 - protein, 10 aa, Influenza virus
CVGYLSTNST

SEQ ID NO: 493515 - protein, 10 aa, Influenza virus
CVILLNPFVS

SEQ ID NO: 493516 - protein, 10 aa, Influenza virus
CVKNGNHAVH

SEQ ID NO: 493517 - protein, 10 aa, Influenza virus
CVKNGNLRCT

SEQ ID NO: 493518 - protein, 10 aa, Influenza virus
CVKNGNMQCT

SEQ ID NO: 493519 - protein, 10 aa, Influenza virus
CVKNGNMRCT

SEQ ID NO: 493520 - protein, 10 aa, Influenza virus
CVLEAMAFLE

SEQ ID NO: 493521 - protein, 10 aa, Influenza virus
CVLEAMALLE

SEQ ID NO: 493522 - protein, 10 aa, Influenza virus
CVMLLAIAMG

SEQ ID NO: 493523 - protein, 10 aa, Influenza virus
CVNRCFYVEL

SEQ ID NO: 493524 - protein, 10 aa, Influenza virus
CVQGNNDNAT

SEQ ID NO: 493525 - protein, 10 aa, Influenza virus
CVQGNNKNAT

SEQ ID NO: 493526 - protein, 10 aa, Influenza virus
CVQGNNNNAT

SEQ ID NO: 493527 - protein, 10 aa, Influenza virus
CVRHNGTCAV

SEQ ID NO: 493528 - protein, 10 aa, Influenza virus
CVSGPNNNAS

SEQ ID NO: 493529 - protein, 10 aa, Influenza virus
CVSHNGTWAV

SEQ ID NO: 493530 - protein, 10 aa, Influenza virus
CVSLLQSAIL

SEQ ID NO: 493531 - protein, 10 aa, Influenza virus
CVTGDDENAT

SEQ ID NO: 493532 - protein, 10 aa, Influenza virus
CVTGDDKNAT

SEQ ID NO: 493533 - protein, 10 aa, Influenza virus
CVTGDDRNAT

SEQ ID NO: 493534 - protein, 10 aa, Influenza virus
CVVAVTDGPA

SEQ ID NO: 493535 - protein, 10 aa, Influenza virus
CVVIMTDGPA

SEQ ID NO: 493536 - protein, 10 aa, Influenza virus
CVVIMTDGSA

SEQ ID NO: 493537 - protein, 10 aa, Influenza virus
CVVTVTDGPA

SEQ ID NO: 493538 - protein, 10 aa, Influenza virus
CVVVMTDGSA

SEQ ID NO: 493539 - protein, 10 aa, Influenza virus
CWEQLYTPGG

SEQ ID NO: 493540 - protein, 10 aa, Influenza virus
CWEQMYTPGG

SEQ ID NO: 493541 - protein, 10 aa, Influenza virus
CWSFALAQGA

SEQ ID NO: 493542 - protein, 10 aa, Influenza virus
CWSFALAQGT

SEQ ID NO: 493543 - protein, 10 aa, Influenza virus
CWSFALAQGV

SEQ ID NO: 493544 - protein, 10 aa, Influenza virus
CWSWPDGALL

SEQ ID NO: 493545 - protein, 10 aa, Influenza virus
CYDGKAWLHI

SEQ ID NO: 493546 - protein, 10 aa, Influenza virus
CYDGKAWLHV

SEQ ID NO: 493547 - protein, 10 aa, Influenza virus
CYGHDSKVTC

SEQ ID NO: 493548 - protein, 10 aa, Influenza virus
CYGHNQKITC

SEQ ID NO: 493549 - protein, 10 aa, Influenza virus
CYGHNSKVTC

SEQ ID NO: 493550 - protein, 10 aa, Influenza virus
CYGHSQKATC

SEQ ID NO: 493551 - protein, 10 aa, Influenza virus
CYGHSQKVTC

SEQ ID NO: 493552 - protein, 10 aa, Influenza virus
CYNPCFYVEL

SEQ ID NO: 493553 - protein, 10 aa, Influenza virus
CYPFDVPDYQ

SEQ ID NO: 493554 - protein, 10 aa, Influenza virus
CYPFDVPEYQ

SEQ ID NO: 493555 - protein, 10 aa, Influenza virus
CYPFDVPGYQ

SEQ ID NO: 493556 - protein, 10 aa, Influenza virus
CYPFDVPNYQ

SEQ ID NO: 493557 - protein, 10 aa, Influenza virus
CYPGATINEE

SEQ ID NO: 493558 - protein, 10 aa, Influenza virus
CYPGATVNEE

SEQ ID NO: 493559 - protein, 10 aa, Influenza virus
CYPGATVNEG

SEQ ID NO: 493560 - protein, 10 aa, Influenza virus
CYPGELDNNG

SEQ ID NO: 493561 - protein, 10 aa, Influenza virus
CYPGELNNNG

SEQ ID NO: 493562 - protein, 10 aa, Influenza virus
CYPGEVDNNG

SEQ ID NO: 493563 - protein, 10 aa, Influenza virus
CYPGFVENLE

SEQ ID NO: 493564 - protein, 10 aa, Influenza virus
CYPGGFTNEE

SEQ ID NO: 493565 - protein, 10 aa, Influenza virus
CYPGKFTNEE

SEQ ID NO: 493566 - protein, 10 aa, Influenza virus
CYPGKFVNEE

SEQ ID NO: 493567 - protein, 10 aa, Influenza virus
CYPGKFVNGE

SEQ ID NO: 493568 - protein, 10 aa, Influenza virus
CYPGNFNDYE

SEQ ID NO: 493569 - protein, 10 aa, Influenza virus
CYPGRFTNEE

SEQ ID NO: 493570 - protein, 10 aa, Influenza virus
CYPGSFNDYE

SEQ ID NO: 493571 - protein, 10 aa, Influenza virus
CYPGSFNNYE

SEQ ID NO: 493572 - protein, 10 aa, Influenza virus
CYPGSIENLE

SEQ ID NO: 493573 - protein, 10 aa, Influenza virus
CYPGSIENQE

SEQ ID NO: 493574 - protein, 10 aa, Influenza virus
CYPGSIKNQE

SEQ ID NO: 493575 - protein, 10 aa, Influenza virus
CYPGSLNDYE

SEQ ID NO: 493576 - protein, 10 aa, Influenza virus
CYPGSTVNEE

SEQ ID NO: 493577 - protein, 10 aa, Influenza virus
CYPGSVENLE

SEQ ID NO: 493578 - protein, 10 aa, Influenza virus
CYPGSVENQE

SEQ ID NO: 493579 - protein, 10 aa, Influenza virus
CYPGTTVNEE

SEQ ID NO: 493580 - protein, 10 aa, Influenza virus
CYPNDGKVEC

SEQ ID NO: 493581 - protein, 10 aa, Influenza virus
CYPNEGKVEC

SEQ ID NO: 493582 - protein, 10 aa, Influenza virus
CYPNLGIVEC

SEQ ID NO: 493583 - protein, 10 aa, Influenza virus
CYPNLGKVEC

SEQ ID NO: 493584 - protein, 10 aa, Influenza virus
CYPNLGQVEC

SEQ ID NO: 493585 - protein, 10 aa, Influenza virus
CYPNMGKVEC

SEQ ID NO: 493586 - protein, 10 aa, Influenza virus
CYPNNGKVEC

SEQ ID NO: 493587 - protein, 10 aa, Influenza virus
CYPNSGKVEC

SEQ ID NO: 493588 - protein, 10 aa, Influenza virus
CYPQYPNVRC

SEQ ID NO: 493589 - protein, 10 aa, Influenza virus
CYPRYPDVRC

SEQ ID NO: 493590 - protein, 10 aa, Influenza virus
CYPRYPGVRC

SEQ ID NO: 493591 - protein, 10 aa, Influenza virus
CYPRYPNVRC

SEQ ID NO: 493592 - protein, 10 aa, Influenza virus
CYQFALGHGT

SEQ ID NO: 493593 - protein, 10 aa, Influenza virus
CYQFALGQGA

SEQ ID NO: 493594 - protein, 10 aa, Influenza virus
CYQFALGQGT

SEQ ID NO: 493595 - protein, 10 aa, Influenza virus
CYQRSKFLLM

SEQ ID NO: 493596 - protein, 10 aa, Influenza virus
CYRACFYVEL

SEQ ID NO: 493597 - protein, 10 aa, Influenza virus
CYSRYPNVRC

SEQ ID NO: 493598 - protein, 10 aa, Influenza virus
CYTKCQTYAG

SEQ ID NO: 493599 - protein, 10 aa, Influenza virus
CYTLITDGPS

SEQ ID NO: 493600 - protein, 10 aa, Influenza virus
CYTLMTDGPS

SEQ ID NO: 493601 - protein, 10 aa, Influenza virus
CYTLVTDGPS

SEQ ID NO: 493602 - protein, 10 aa, Influenza virus
CYWVMTDGPA

SEQ ID NO: 493603 - protein, 10 aa, Influenza virus
DAERGKLKRR

SEQ ID NO: 493604 - protein, 10 aa, Influenza virus
DAGDGCFEIL

SEQ ID NO: 493605 - protein, 10 aa, Influenza virus
DAGNGCFDIL

SEQ ID NO: 493606 - protein, 10 aa, Influenza virus
DAHILVTREP

SEQ ID NO: 493607 - protein, 10 aa, Influenza virus
DAHVLVTREP

SEQ ID NO: 493608 - protein, 10 aa, Influenza virus
DAIEECLIND

SEQ ID NO: 493609 - protein, 10 aa, Influenza virus
DAINNRFQIQ

SEQ ID NO: 493610 - protein, 10 aa, Influenza virus
DALKLSIEDP

SEQ ID NO: 493611 - protein, 10 aa, Influenza virus
DALLGDPHCD

SEQ ID NO: 493612 - protein, 10 aa, Influenza virus
DALLGDPQCD

SEQ ID NO: 493613 - protein, 10 aa, Influenza virus
DAMLGDPHCD

SEQ ID NO: 493614 - protein, 10 aa, Influenza virus
DAMTEIWSYN

SEQ ID NO: 493615 - protein, 10 aa, Influenza virus
DAMTEVWSYN

SEQ ID NO: 493616 - protein, 10 aa, Influenza virus
DANGWVSTDK

SEQ ID NO: 493617 - protein, 10 aa, Influenza virus
DANVKNLHDQ

SEQ ID NO: 493618 - protein, 10 aa, Influenza virus
DANVKNLHEQ

SEQ ID NO: 493619 - protein, 10 aa, Influenza virus
DANVRNLHDQ

SEQ ID NO: 493620 - protein, 10 aa, Influenza virus
DANVRNLHDR

SEQ ID NO: 493621 - protein, 10 aa, Influenza virus
DANVRNLHEQ

SEQ ID NO: 493622 - protein, 10 aa, Influenza virus
DANVRNLHER

SEQ ID NO: 493623 - protein, 10 aa, Influenza virus
DAPFDDRLRR

SEQ ID NO: 493624 - protein, 10 aa, Influenza virus
DAPFIDRLRR

SEQ ID NO: 493625 - protein, 10 aa, Influenza virus
DAPFLDRIRR

SEQ ID NO: 493626 - protein, 10 aa, Influenza virus
DAPFLDRLRR

SEQ ID NO: 493627 - protein, 10 aa, Influenza virus
DAQAFYKILK

SEQ ID NO: 493628 - protein, 10 aa, Influenza virus
DAQHRSHRQM

SEQ ID NO: 493629 - protein, 10 aa, Influenza virus
DAQIDESCEG

SEQ ID NO: 493630 - protein, 10 aa, Influenza virus
DARIDFESGR

SEQ ID NO: 493631 - protein, 10 aa, Influenza virus
DARVDFESGR

SEQ ID NO: 493632 - protein, 10 aa, Influenza virus
DATAVAVIKY

SEQ ID NO: 493633 - protein, 10 aa, Influenza virus
DATAVAVLKY

SEQ ID NO: 493634 - protein, 10 aa, Influenza virus
DATYQRTRAL

SEQ ID NO: 493635 - protein, 10 aa, Influenza virus
DAVATTHSWI

SEQ ID NO: 493636 - protein, 10 aa, Influenza virus
DAVATTHSWT

SEQ ID NO: 493637 - protein, 10 aa, Influenza virus
DAVATTHSWV

SEQ ID NO: 493638 - protein, 10 aa, Influenza virus
DAVKLSSGYK

SEQ ID NO: 493639 - protein, 10 aa, Influenza virus
DAVTDIWSYN

SEQ ID NO: 493640 - protein, 10 aa, Influenza virus
DAVTDVWSYN

SEQ ID NO: 493641 - protein, 10 aa, Influenza virus
DAYAVIHYGG

SEQ ID NO: 493642 - protein, 10 aa, Influenza virus
DCDLINGALG

SEQ ID NO: 493643 - protein, 10 aa, Influenza virus
DCETKCQTPL

SEQ ID NO: 493644 - protein, 10 aa, Influenza virus
DCFLWHVRKR

SEQ ID NO: 493645 - protein, 10 aa, Influenza virus
DCFQPCFYVE

SEQ ID NO: 493646 - protein, 10 aa, Influenza virus
DCIRPCFWIE

SEQ ID NO: 493647 - protein, 10 aa, Influenza virus
DCIRPCFWVE

SEQ ID NO: 493648 - protein, 10 aa, Influenza virus
DCKIEAVIYG

SEQ ID NO: 493649 - protein, 10 aa, Influenza virus
DCKVEAVIYG

SEQ ID NO: 493650 - protein, 10 aa, Influenza virus
DCLVPCFWVE

SEQ ID NO: 493651 - protein, 10 aa, Influenza virus
DCMASIRNNT

SEQ ID NO: 493652 - protein, 10 aa, Influenza virus
DCMIKAVRGD

SEQ ID NO: 493653 - protein, 10 aa, Influenza virus
DCMMKAVRGD

SEQ ID NO: 493654 - protein, 10 aa, Influenza virus
DCMRPCFWVE

SEQ ID NO: 493655 - protein, 10 aa, Influenza virus
DCMVKAVRGD

SEQ ID NO: 493656 - protein, 10 aa, Influenza virus
DCNFEGWIVG

SEQ ID NO: 493657 - protein, 10 aa, Influenza virus
DCNNPITGSP

SEQ ID NO: 493658 - protein, 10 aa, Influenza virus
DCPKYIKQGS

SEQ ID NO: 493659 - protein, 10 aa, Influenza virus
DCPKYIKSGQ

SEQ ID NO: 493660 - protein, 10 aa, Influenza virus
DCPKYMNVKS

SEQ ID NO: 493661 - protein, 10 aa, Influenza virus
DCPKYVKQGS

SEQ ID NO: 493662 - protein, 10 aa, Influenza virus
DCPKYVNIKS

SEQ ID NO: 493663 - protein, 10 aa, Influenza virus
DCPKYVNVKS

SEQ ID NO: 493664 - protein, 10 aa, Influenza virus
DCPKYVNVRS

SEQ ID NO: 493665 - protein, 10 aa, Influenza virus
DCPRYVKQGS

SEQ ID NO: 493666 - protein, 10 aa, Influenza virus
DCRFEGWIVG

SEQ ID NO: 493667 - protein, 10 aa, Influenza virus
DCRTFFLTQG

SEQ ID NO: 493668 - protein, 10 aa, Influenza virus
DCSFAGWILG

SEQ ID NO: 493669 - protein, 10 aa, Influenza virus
DCSFAGWLLG

SEQ ID NO: 493670 - protein, 10 aa, Influenza virus
DCSFEGWIGG

SEQ ID NO: 493671 - protein, 10 aa, Influenza virus
DCSFEGWIVG

SEQ ID NO: 493672 - protein, 10 aa, Influenza virus
DCSIAGWLLG

SEQ ID NO: 493673 - protein, 10 aa, Influenza virus
DCSLEGIILG

SEQ ID NO: 493674 - protein, 10 aa, Influenza virus
DCSLEGLILG

SEQ ID NO: 493675 - protein, 10 aa, Influenza virus
DCSLEGLILS

SEQ ID NO: 493676 - protein, 10 aa, Influenza virus
DCSLEGLVLG

SEQ ID NO: 493677 - protein, 10 aa, Influenza virus
DCSLKGLILG

SEQ ID NO: 493678 - protein, 10 aa, Influenza virus
DCSNPITGSP

SEQ ID NO: 493679 - protein, 10 aa, Influenza virus
DCSVAGWLLG

SEQ ID NO: 493680 - protein, 10 aa, Influenza virus
DCSVSGWLLG

SEQ ID NO: 493681 - protein, 10 aa, Influenza virus
DCTGCFEIFH

SEQ ID NO: 493682 - protein, 10 aa, Influenza virus
DCVLEAMAFL

SEQ ID NO: 493683 - protein, 10 aa, Influenza virus
DCVLEAMALL

SEQ ID NO: 493684 - protein, 10 aa, Influenza virus
DCWSFALAQG

SEQ ID NO: 493685 - protein, 10 aa, Influenza virus
DCYRACFYVE

SEQ ID NO: 493686 - protein, 10 aa, Influenza virus
DCYWVMTDGP

SEQ ID NO: 493687 - protein, 10 aa, Influenza virus
DDAINNRFQI

SEQ ID NO: 493688 - protein, 10 aa, Influenza virus
DDAVTDIWSY

SEQ ID NO: 493689 - protein, 10 aa, Influenza virus
DDAVTDVWSY

SEQ ID NO: 493690 - protein, 10 aa, Influenza virus
DDAYAVIHYG

SEQ ID NO: 493691 - protein, 10 aa, Influenza virus
DDCMASIRNN

SEQ ID NO: 493692 - protein, 10 aa, Influenza virus
DDCSLEGIIL

SEQ ID NO: 493693 - protein, 10 aa, Influenza virus
DDCSLEGLIL

SEQ ID NO: 493694 - protein, 10 aa, Influenza virus
DDCSLEGLVL

SEQ ID NO: 493695 - protein, 10 aa, Influenza virus
DDCSLKGLIL

SEQ ID NO: 493696 - protein, 10 aa, Influenza virus
DDDAYAVIHY

SEQ ID NO: 493697 - protein, 10 aa, Influenza virus
DDDCMASIRN

SEQ ID NO: 493698 - protein, 10 aa, Influenza virus
DDDVSWTSNS

SEQ ID NO: 493699 - protein, 10 aa, Influenza virus
DDENATASFI

SEQ ID NO: 493700 - protein, 10 aa, Influenza virus
DDFALILNAP

SEQ ID NO: 493701 - protein, 10 aa, Influenza virus
DDFALIVNAL

SEQ ID NO: 493702 - protein, 10 aa, Influenza virus
DDFALIVNAP

SEQ ID NO: 493703 - protein, 10 aa, Influenza virus
DDFALIVNAS

SEQ ID NO: 493704 - protein, 10 aa, Influenza virus
DDFFNRLNWL

SEQ ID NO: 493705 - protein, 10 aa, Influenza virus
DDFQLIPMIS

SEQ ID NO: 493706 - protein, 10 aa, Influenza virus
DDGAILPFDI

SEQ ID NO: 493707 - protein, 10 aa, Influenza virus
DDGAILPFGI

SEQ ID NO: 493708 - protein, 10 aa, Influenza virus
DDGAILPLTS

SEQ ID NO: 493709 - protein, 10 aa, Influenza virus
DDGAVAVLKY

SEQ ID NO: 493710 - protein, 10 aa, Influenza virus
DDGFIDIWTY

SEQ ID NO: 493711 - protein, 10 aa, Influenza virus
DDGFIDVWTY

SEQ ID NO: 493712 - protein, 10 aa, Influenza virus
DDGFLDIWTY

SEQ ID NO: 493713 - protein, 10 aa, Influenza virus
DDGFLDVWTY

SEQ ID NO: 493714 - protein, 10 aa, Influenza virus
DDGLLDVWTY

SEQ ID NO: 493715 - protein, 10 aa, Influenza virus
DDHCMESIRN

SEQ ID NO: 493716 - protein, 10 aa, Influenza virus
DDIDQSLIIA

SEQ ID NO: 493717 - protein, 10 aa, Influenza virus
DDKNATASFI

SEQ ID NO: 493718 - protein, 10 aa, Influenza virus
DDLIEKTSWS

SEQ ID NO: 493719 - protein, 10 aa, Influenza virus
DDLIGKTSWS

SEQ ID NO: 493720 - protein, 10 aa, Influenza virus
DDNGWVSTDK

SEQ ID NO: 493721 - protein, 10 aa, Influenza virus
DDNVYKALSI

SEQ ID NO: 493722 - protein, 10 aa, Influenza virus
DDPNWSGYSG

SEQ ID NO: 493723 - protein, 10 aa, Influenza virus
DDQCMESIRN

SEQ ID NO: 493724 - protein, 10 aa, Influenza virus
DDQIEDLWAY

SEQ ID NO: 493725 - protein, 10 aa, Influenza virus
DDQIEELWAY

SEQ ID NO: 493726 - protein, 10 aa, Influenza virus
DDQIEGLWAY

SEQ ID NO: 493727 - protein, 10 aa, Influenza virus
DDQIENLWAY

SEQ ID NO: 493728 - protein, 10 aa, Influenza virus
DDQIIDIWAY

SEQ ID NO: 493729 - protein, 10 aa, Influenza virus
DDQIQDIWAY

SEQ ID NO: 493730 - protein, 10 aa, Influenza virus
DDQIQDLWAY

SEQ ID NO: 493731 - protein, 10 aa, Influenza virus
DDQIQDVWAY

SEQ ID NO: 493732 - protein, 10 aa, Influenza virus
DDQIQNIWAY

SEQ ID NO: 493733 - protein, 10 aa, Influenza virus
DDQITDIWAY

SEQ ID NO: 493734 - protein, 10 aa, Influenza virus
DDQVTDIWAY

SEQ ID NO: 493735 - protein, 10 aa, Influenza virus
DDRIQDIWAY

SEQ ID NO: 493736 - protein, 10 aa, Influenza virus
DDRNATASFI

SEQ ID NO: 493737 - protein, 10 aa, Influenza virus
DDRNATASLI

SEQ ID NO: 493738 - protein, 10 aa, Influenza virus
DDSVYKALSI

SEQ ID NO: 493739 - protein, 10 aa, Influenza virus
DDVDQSLIIA

SEQ ID NO: 493740 - protein, 10 aa, Influenza virus
DDVDQSLVIA

SEQ ID NO: 493741 - protein, 10 aa, Influenza virus
DDVSWASNSI

SEQ ID NO: 493742 - protein, 10 aa, Influenza virus
DDVSWTSNSI

SEQ ID NO: 493743 - protein, 10 aa, Influenza virus
DDVWLGRTVS

SEQ ID NO: 493744 - protein, 10 aa, Influenza virus
DDVWMGRTIS

SEQ ID NO: 493745 - protein, 10 aa, Influenza virus
DDWSGYSGSF

SEQ ID NO: 493746 - protein, 10 aa, Influenza virus
DEAINNRFQI

SEQ ID NO: 493747 - protein, 10 aa, Influenza virus
DEAINNRIKI

SEQ ID NO: 493748 - protein, 10 aa, Influenza virus
DEAINSRFQI

SEQ ID NO: 493749 - protein, 10 aa, Influenza virus
DEAISNRFQI

SEQ ID NO: 493750 - protein, 10 aa, Influenza virus
DEALKMTIAS

SEQ ID NO: 493751 - protein, 10 aa, Influenza virus
DECIEKVRNG

SEQ ID NO: 493752 - protein, 10 aa, Influenza virus
DECRFYALSQ

SEQ ID NO: 493753 - protein, 10 aa, Influenza virus
DECRTFFLTQ

SEQ ID NO: 493754 - protein, 10 aa, Influenza virus
DEESRARIKT

SEQ ID NO: 493755 - protein, 10 aa, Influenza virus
DEFCYTLITD

SEQ ID NO: 493756 - protein, 10 aa, Influenza virus
DEFCYTLMTD

SEQ ID NO: 493757 - protein, 10 aa, Influenza virus
DEFCYTLVTD

SEQ ID NO: 493758 - protein, 10 aa, Influenza virus
DEFQLIPMIS

SEQ ID NO: 493759 - protein, 10 aa, Influenza virus
DEGDGCFNFF

SEQ ID NO: 493760 - protein, 10 aa, Influenza virus
DEGDGCFNLL

SEQ ID NO: 493761 - protein, 10 aa, Influenza virus
DEGDGCFSIL

SEQ ID NO: 493762 - protein, 10 aa, Influenza virus
DEGDGCFSLL

SEQ ID NO: 493763 - protein, 10 aa, Influenza virus
DEGLPQSGRI

SEQ ID NO: 493764 - protein, 10 aa, Influenza virus
DEGNGCFELL

SEQ ID NO: 493765 - protein, 10 aa, Influenza virus
DEGNGCFTFY

SEQ ID NO: 493766 - protein, 10 aa, Influenza virus
DEGTGIAADK

SEQ ID NO: 493767 - protein, 10 aa, Influenza virus
DEHDANVRNL

SEQ ID NO: 493768 - protein, 10 aa, Influenza virus
DEHDSNVENL

SEQ ID NO: 493769 - protein, 10 aa, Influenza virus
DEHDSNVKNL

SEQ ID NO: 493770 - protein, 10 aa, Influenza virus
DEICIGYLSN

SEQ ID NO: 493771 - protein, 10 aa, Influenza virus
DEICIGYMSN

SEQ ID NO: 493772 - protein, 10 aa, Influenza virus
DEIGEDIAPI

SEQ ID NO: 493773 - protein, 10 aa, Influenza virus
DEIGEDLAPI

SEQ ID NO: 493774 - protein, 10 aa, Influenza virus
DEIGEDVAPI

SEQ ID NO: 493775 - protein, 10 aa, Influenza virus
DEITTKINNI

SEQ ID NO: 493776 - protein, 10 aa, Influenza virus
DELCPSPLKL

SEQ ID NO: 493777 - protein, 10 aa, Influenza virus
DELIGKTSWS

SEQ ID NO: 493778 - protein, 10 aa, Influenza virus
DENATASFIY

SEQ ID NO: 493779 - protein, 10 aa, Influenza virus
DEQMYQKCCN

SEQ ID NO: 493780 - protein, 10 aa, Influenza virus
DEQMYQKCCS

SEQ ID NO: 493781 - protein, 10 aa, Influenza virus
DEQMYQKCCT

SEQ ID NO: 493782 - protein, 10 aa, Influenza virus
DEQMYQRCCN

SEQ ID NO: 493783 - protein, 10 aa, Influenza virus
DEQNKLYGAG

SEQ ID NO: 493784 - protein, 10 aa, Influenza virus
DEQNKLYGTG

SEQ ID NO: 493785 - protein, 10 aa, Influenza virus
DERGLFGAIA

SEQ ID NO: 493786 - protein, 10 aa, Influenza virus
DERGNPGVKG

SEQ ID NO: 493787 - protein, 10 aa, Influenza virus
DERMYQKCCN

SEQ ID NO: 493788 - protein, 10 aa, Influenza virus
DERRNKYLEE

SEQ ID NO: 493789 - protein, 10 aa, Influenza virus
DERRNRYLEE

SEQ ID NO: 493790 - protein, 10 aa, Influenza virus
DESCEGECFY

SEQ ID NO: 493791 - protein, 10 aa, Influenza virus
DEVDQSLIIA

SEQ ID NO: 493792 - protein, 10 aa, Influenza virus
DEVKRRLSAN

SEQ ID NO: 493793 - protein, 10 aa, Influenza virus
DEVKRRLSTN

SEQ ID NO: 493794 - protein, 10 aa, Influenza virus
DEVRRRLSAN

SEQ ID NO: 493795 - protein, 10 aa, Influenza virus
DEVRRRLSTN

SEQ ID NO: 493796 - protein, 10 aa, Influenza virus
DEVRRRLSVN

SEQ ID NO: 493797 - protein, 10 aa, Influenza virus
DEVSWTSNSI

SEQ ID NO: 493798 - protein, 10 aa, Influenza virus
DEVWWTSNSI

SEQ ID NO: 493799 - protein, 10 aa, Influenza virus
DEYKNTGDSD

SEQ ID NO: 493800 - protein, 10 aa, Influenza virus
DEYKNTRDSD

SEQ ID NO: 493801 - protein, 10 aa, Influenza virus
DEYKNTRDSN

SEQ ID NO: 493802 - protein, 10 aa, Influenza virus
DFEKEGYSLV

SEQ ID NO: 493803 - protein, 10 aa, Influenza virus
DFEREGYSLV

SEQ ID NO: 493804 - protein, 10 aa, Influenza virus
DFHDSNVKNL

SEQ ID NO: 493805 - protein, 10 aa, Influenza virus
DFHDSNVKSL

SEQ ID NO: 493806 - protein, 10 aa, Influenza virus
DFHDSNVRNL

SEQ ID NO: 493807 - protein, 10 aa, Influenza virus
DFHWMLLDPG

SEQ ID NO: 493808 - protein, 10 aa, Influenza virus
DFICVGWSST

SEQ ID NO: 493809 - protein, 10 aa, Influenza virus
DFIKWNVTYT

SEQ ID NO: 493810 - protein, 10 aa, Influenza virus
DFKSTQAAIN

SEQ ID NO: 493811 - protein, 10 aa, Influenza virus
DFLCVGWSST

SEQ ID NO: 493812 - protein, 10 aa, Influenza virus
DFLNNTEPLC

SEQ ID NO: 493813 - protein, 10 aa, Influenza virus
DFMCVGWSST

SEQ ID NO: 493814 - protein, 10 aa, Influenza virus
DFQLIPMISK

SEQ ID NO: 493815 - protein, 10 aa, Influenza virus
DFRDMRKNTL

SEQ ID NO: 493816 - protein, 10 aa, Influenza virus
DFSKWNVTYT

SEQ ID NO: 493817 - protein, 10 aa, Influenza virus
DFTKWNVTHT

SEQ ID NO: 493818 - protein, 10 aa, Influenza virus
DFTKWNVTYT

SEQ ID NO: 493819 - protein, 10 aa, Influenza virus
DFVRQCFNPM

SEQ ID NO: 493820 - protein, 10 aa, Influenza virus
DFVRQCFSPM

SEQ ID NO: 493821 - protein, 10 aa, Influenza virus
DGADINFMPI

SEQ ID NO: 493822 - protein, 10 aa, Influenza virus
DGAILPFDID

SEQ ID NO: 493823 - protein, 10 aa, Influenza virus
DGAILPFGID

SEQ ID NO: 493824 - protein, 10 aa, Influenza virus
DGALLPFDID

SEQ ID NO: 493825 - protein, 10 aa, Influenza virus
DGANIDFMPV

SEQ ID NO: 493826 - protein, 10 aa, Influenza virus
DGANIGFMPK

SEQ ID NO: 493827 - protein, 10 aa, Influenza virus
DGANINFMPI

SEQ ID NO: 493828 - protein, 10 aa, Influenza virus
DGANINLMPI

SEQ ID NO: 493829 - protein, 10 aa, Influenza virus
DGANISFMPI

SEQ ID NO: 493830 - protein, 10 aa, Influenza virus
DGATSACKRT

SEQ ID NO: 493831 - protein, 10 aa, Influenza virus
DGAVAVLKYN

SEQ ID NO: 493832 - protein, 10 aa, Influenza virus
DGCFEILHKC

SEQ ID NO: 493833 - protein, 10 aa, Influenza virus
DGCFEILHRC

SEQ ID NO: 493834 - protein, 10 aa, Influenza virus
DGCFNFFHKC

SEQ ID NO: 493835 - protein, 10 aa, Influenza virus
DGCFNLLHKC

SEQ ID NO: 493836 - protein, 10 aa, Influenza virus
DGCFSILHKC

SEQ ID NO: 493837 - protein, 10 aa, Influenza virus
DGCFSLLHKC

SEQ ID NO: 493838 - protein, 10 aa, Influenza virus
DGCRFYALSQ

SEQ ID NO: 493839 - protein, 10 aa, Influenza virus
DGDIIFLWGI

SEQ ID NO: 493840 - protein, 10 aa, Influenza virus
DGFEPNGCIE

SEQ ID NO: 493841 - protein, 10 aa, Influenza virus
DGFEPNGSIE

SEQ ID NO: 493842 - protein, 10 aa, Influenza virus
DGFEPNGYIE

SEQ ID NO: 493843 - protein, 10 aa, Influenza virus
DGFIDIWTYN

SEQ ID NO: 493844 - protein, 10 aa, Influenza virus
DGFIDVWTYN

SEQ ID NO: 493845 - protein, 10 aa, Influenza virus
DGFKPNGCIE

SEQ ID NO: 493846 - protein, 10 aa, Influenza virus
DGFLDIWTYN

SEQ ID NO: 493847 - protein, 10 aa, Influenza virus
DGFLDVWTYN

SEQ ID NO: 493848 - protein, 10 aa, Influenza virus
DGFLGVWTYN

SEQ ID NO: 493849 - protein, 10 aa, Influenza virus
DGFLNVWTYN

SEQ ID NO: 493850 - protein, 10 aa, Influenza virus
DGFMDVWTYN

SEQ ID NO: 493851 - protein, 10 aa, Influenza virus
DGFRDVWTYN

SEQ ID NO: 493852 - protein, 10 aa, Influenza virus
DGGHIEECSC

SEQ ID NO: 493853 - protein, 10 aa, Influenza virus
DGGPNLYNIR

SEQ ID NO: 493854 - protein, 10 aa, Influenza virus
DGIGRFYIQM

SEQ ID NO: 493855 - protein, 10 aa, Influenza virus
DGIGRMTICI

SEQ ID NO: 493856 - protein, 10 aa, Influenza virus
DGIGRMTICV

SEQ ID NO: 493857 - protein, 10 aa, Influenza virus
DGITNKVNSI

SEQ ID NO: 493858 - protein, 10 aa, Influenza virus
DGKAPISLGD

SEQ ID NO: 493859 - protein, 10 aa, Influenza virus
DGKAPISLGG

SEQ ID NO: 493860 - protein, 10 aa, Influenza virus
DGKAWLHICV

SEQ ID NO: 493861 - protein, 10 aa, Influenza virus
DGKAWLHVCI

SEQ ID NO: 493862 - protein, 10 aa, Influenza virus
DGKAWLHVCV

SEQ ID NO: 493863 - protein, 10 aa, Influenza virus
DGKEWMHICM

SEQ ID NO: 493864 - protein, 10 aa, Influenza virus
DGKEWMHVCI

SEQ ID NO: 493865 - protein, 10 aa, Influenza virus
DGKEWMHVCM

SEQ ID NO: 493866 - protein, 10 aa, Influenza virus
DGKEWMHVSM

SEQ ID NO: 493867 - protein, 10 aa, Influenza virus
DGKGCFDLYH

SEQ ID NO: 493868 - protein, 10 aa, Influenza virus
DGKGCFEIYH

SEQ ID NO: 493869 - protein, 10 aa, Influenza virus
DGKGCFELHH

SEQ ID NO: 493870 - protein, 10 aa, Influenza virus
DGKGCFELYH

SEQ ID NO: 493871 - protein, 10 aa, Influenza virus
DGKSSACKRA

SEQ ID NO: 493872 - protein, 10 aa, Influenza virus
DGKVECVCRD

SEQ ID NO: 493873 - protein, 10 aa, Influenza virus
DGLLDVWTYN

SEQ ID NO: 493874 - protein, 10 aa, Influenza virus
DGLQSSDDFA

SEQ ID NO: 493875 - protein, 10 aa, Influenza virus
DGNASGKADT

SEQ ID NO: 493876 - protein, 10 aa, Influenza virus
DGNGCFEIFH

SEQ ID NO: 493877 - protein, 10 aa, Influenza virus
DGNGCFELYH

SEQ ID NO: 493878 - protein, 10 aa, Influenza virus
DGNIIFLWGI

SEQ ID NO: 493879 - protein, 10 aa, Influenza virus
DGNMRCTICI

SEQ ID NO: 493880 - protein, 10 aa, Influenza virus
DGPAANNADH

SEQ ID NO: 493881 - protein, 10 aa, Influenza virus
DGPAANSADH

SEQ ID NO: 493882 - protein, 10 aa, Influenza virus
DGPAANSAHH

SEQ ID NO: 493883 - protein, 10 aa, Influenza virus
DGPANKQASY

SEQ ID NO: 493884 - protein, 10 aa, Influenza virus
DGPANNQASY

SEQ ID NO: 493885 - protein, 10 aa, Influenza virus
DGPANSQASY

SEQ ID NO: 493886 - protein, 10 aa, Influenza virus
DGPANSQAYT

SEQ ID NO: 493887 - protein, 10 aa, Influenza virus
DGPASNQASY

SEQ ID NO: 493888 - protein, 10 aa, Influenza virus
DGPASSQAYT

SEQ ID NO: 493889 - protein, 10 aa, Influenza virus
DGPGWLTIGI

SEQ ID NO: 493890 - protein, 10 aa, Influenza virus
DGPGWLTLGI

SEQ ID NO: 493891 - protein, 10 aa, Influenza virus
DGPSDAQAFY

SEQ ID NO: 493892 - protein, 10 aa, Influenza virus
DGPSNAQAFY

SEQ ID NO: 493893 - protein, 10 aa, Influenza virus
DGQAFYKILK

SEQ ID NO: 493894 - protein, 10 aa, Influenza virus
DGQDCDLING

SEQ ID NO: 493895 - protein, 10 aa, Influenza virus
DGQRSWMKIY

SEQ ID NO: 493896 - protein, 10 aa, Influenza virus
DGQRSWMKLY

SEQ ID NO: 493897 - protein, 10 aa, Influenza virus
DGQSGRIDFH

SEQ ID NO: 493898 - protein, 10 aa, Influenza virus
DGRAWLHVCV

SEQ ID NO: 493899 - protein, 10 aa, Influenza virus
DGRGCFEIYH

SEQ ID NO: 493900 - protein, 10 aa, Influenza virus
DGRLIQNSIT

SEQ ID NO: 493901 - protein, 10 aa, Influenza virus
DGSASGKADT

SEQ ID NO: 493902 - protein, 10 aa, Influenza virus
DGSASGKAET

SEQ ID NO: 493903 - protein, 10 aa, Influenza virus
DGSASGQAYT

SEQ ID NO: 493904 - protein, 10 aa, Influenza virus
DGSASGRADT

SEQ ID NO: 493905 - protein, 10 aa, Influenza virus
DGSASRKADT

SEQ ID NO: 493906 - protein, 10 aa, Influenza virus
DGSASSQAHT

SEQ ID NO: 493907 - protein, 10 aa, Influenza virus
DGSASSQAYT

SEQ ID NO: 493908 - protein, 10 aa, Influenza virus
DGSATGPADT

SEQ ID NO: 493909 - protein, 10 aa, Influenza virus
DGSATGPAET

SEQ ID NO: 493910 - protein, 10 aa, Influenza virus
DGSDIGFMPK

SEQ ID NO: 493911 - protein, 10 aa, Influenza virus
DGSGWLTLGI

SEQ ID NO: 493912 - protein, 10 aa, Influenza virus
DGSIGKVCRT

SEQ ID NO: 493913 - protein, 10 aa, Influenza virus
DGSNIGFMPK

SEQ ID NO: 493914 - protein, 10 aa, Influenza virus
DGSSSACLRG

SEQ ID NO: 493915 - protein, 10 aa, Influenza virus
DGTACFEIFH

SEQ ID NO: 493916 - protein, 10 aa, Influenza virus
DGTAFRGLIS

SEQ ID NO: 493917 - protein, 10 aa, Influenza virus
DGTGCFEIFH

SEQ ID NO: 493918 - protein, 10 aa, Influenza virus
DGTIAGFIEG

SEQ ID NO: 493919 - protein, 10 aa, Influenza virus
DGTYKILTIY

SEQ ID NO: 493920 - protein, 10 aa, Influenza virus
DGVGRMTICI

SEQ ID NO: 493921 - protein, 10 aa, Influenza virus
DGVGRMTICV

SEQ ID NO: 493922 - protein, 10 aa, Influenza virus
DGVTASCLDK

SEQ ID NO: 493923 - protein, 10 aa, Influenza virus
DGVTASCLDR

SEQ ID NO: 493924 - protein, 10 aa, Influenza virus
DGVTASCRDN

SEQ ID NO: 493925 - protein, 10 aa, Influenza virus
DGVTNKVNSI

SEQ ID NO: 493926 - protein, 10 aa, Influenza virus
DGVWIGRTKN

SEQ ID NO: 493927 - protein, 10 aa, Influenza virus
DGVWIGRTKS

SEQ ID NO: 493928 - protein, 10 aa, Influenza virus
DGVYKALSIY

SEQ ID NO: 493929 - protein, 10 aa, Influenza virus
DGWILGNPQC

SEQ ID NO: 493930 - protein, 10 aa, Influenza virus
DGWINSPNHA

SEQ ID NO: 493931 - protein, 10 aa, Influenza virus
DGWTTANSKS

SEQ ID NO: 493932 - protein, 10 aa, Influenza virus
DGWYGFHHSN

SEQ ID NO: 493933 - protein, 10 aa, Influenza virus
DGWYGFKHQN

SEQ ID NO: 493934 - protein, 10 aa, Influenza virus
DGWYGFRHHN

SEQ ID NO: 493935 - protein, 10 aa, Influenza virus
DGWYGFRHQN

SEQ ID NO: 493936 - protein, 10 aa, Influenza virus
DGWYGFRYQN

SEQ ID NO: 493937 - protein, 10 aa, Influenza virus
DGWYGYHHEN

SEQ ID NO: 493938 - protein, 10 aa, Influenza virus
DGWYGYHHIN

SEQ ID NO: 493939 - protein, 10 aa, Influenza virus
DGWYGYHHNN

SEQ ID NO: 493940 - protein, 10 aa, Influenza virus
DGWYGYHHQN

SEQ ID NO: 493941 - protein, 10 aa, Influenza virus
DGWYGYHHSK

SEQ ID NO: 493942 - protein, 10 aa, Influenza virus
DGWYGYHHSN

SEQ ID NO: 493943 - protein, 10 aa, Influenza virus
DGWYGYHHTN

SEQ ID NO: 493944 - protein, 10 aa, Influenza virus
DGWYGYKHQN

SEQ ID NO: 493945 - protein, 10 aa, Influenza virus
DGWYGYRHQN

SEQ ID NO: 493946 - protein, 10 aa, Influenza virus
DHAQYREEAL

SEQ ID NO: 493947 - protein, 10 aa, Influenza virus
DHCMESIRNN

SEQ ID NO: 493948 - protein, 10 aa, Influenza virus
DHEGEGIPLY

SEQ ID NO: 493949 - protein, 10 aa, Influenza virus
DHFVSIELEG

SEQ ID NO: 493950 - protein, 10 aa, Influenza virus
DHGVKGWAFD

SEQ ID NO: 493951 - protein, 10 aa, Influenza virus
DHICIGYHAN

SEQ ID NO: 493952 - protein, 10 aa, Influenza virus
DHIEVTNATE

SEQ ID NO: 493953 - protein, 10 aa, Influenza virus
DHITFSHNGG

SEQ ID NO: 493954 - protein, 10 aa, Influenza virus
DHKDFEEESK

SEQ ID NO: 493955 - protein, 10 aa, Influenza virus
DHKDYEEEAK

SEQ ID NO: 493956 - protein, 10 aa, Influenza virus
DHKEFEEESK

SEQ ID NO: 493957 - protein, 10 aa, Influenza virus
DHKEFEEESR

SEQ ID NO: 493958 - protein, 10 aa, Influenza virus
DHKEFEKESK

SEQ ID NO: 493959 - protein, 10 aa, Influenza virus
DHKEFEKESR

SEQ ID NO: 493960 - protein, 10 aa, Influenza virus
DHKEYEEEAK

SEQ ID NO: 493961 - protein, 10 aa, Influenza virus
DHMAIIKKYT

SEQ ID NO: 493962 - protein, 10 aa, Influenza virus
DHNIYRDEAI

SEQ ID NO: 493963 - protein, 10 aa, Influenza virus
DHRIYWIREG

SEQ ID NO: 493964 - protein, 10 aa, Influenza virus
DHRIYWIRKG

SEQ ID NO: 493965 - protein, 10 aa, Influenza virus
DHRVYWIREG

SEQ ID NO: 493966 - protein, 10 aa, Influenza virus
DHSDNADKIC

SEQ ID NO: 493967 - protein, 10 aa, Influenza virus
DHSQYREEAL

SEQ ID NO: 493968 - protein, 10 aa, Influenza virus
DHTQYREEAL

SEQ ID NO: 493969 - protein, 10 aa, Influenza virus
DHTSQYLCTG

SEQ ID NO: 493970 - protein, 10 aa, Influenza virus
DICYPGKFTN

SEQ ID NO: 493971 - protein, 10 aa, Influenza virus
DICYPGRFTN

SEQ ID NO: 493972 - protein, 10 aa, Influenza virus
DIDIYCICRD

SEQ ID NO: 493973 - protein, 10 aa, Influenza virus
DIDQSLIIAA

SEQ ID NO: 493974 - protein, 10 aa, Influenza virus
DIDVYCICRD

SEQ ID NO: 493975 - protein, 10 aa, Influenza virus
DIDVYCVCRD

SEQ ID NO: 493976 - protein, 10 aa, Influenza virus
DIEAMASQGT

SEQ ID NO: 493977 - protein, 10 aa, Influenza virus
DIEAMATQGT

SEQ ID NO: 493978 - protein, 10 aa, Influenza virus
DIECVCRDNW

SEQ ID NO: 493979 - protein, 10 aa, Influenza virus
DIFVIREPFI

SEQ ID NO: 493980 - protein, 10 aa, Influenza virus
DIFVMREPFI

SEQ ID NO: 493981 - protein, 10 aa, Influenza virus
DIGAMASQGT

SEQ ID NO: 493982 - protein, 10 aa, Influenza virus
DIIDNDNWSG

SEQ ID NO: 493983 - protein, 10 aa, Influenza virus
DIIDNNNWSG

SEQ ID NO: 493984 - protein, 10 aa, Influenza virus
DIIFLWGIHH

SEQ ID NO: 493985 - protein, 10 aa, Influenza virus
DIILWFSFGA

SEQ ID NO: 493986 - protein, 10 aa, Influenza virus
DIILWISFSI

SEQ ID NO: 493987 - protein, 10 aa, Influenza virus
DIILWISFSM

SEQ ID NO: 493988 - protein, 10 aa, Influenza virus
DIILWVSFSI

SEQ ID NO: 493989 - protein, 10 aa, Influenza virus
DIINGALGSP

SEQ ID NO: 493990 - protein, 10 aa, Influenza virus
DIITDTIKSW

SEQ ID NO: 493991 - protein, 10 aa, Influenza virus
DIIVFNTIGN

SEQ ID NO: 493992 - protein, 10 aa, Influenza virus
DIKSHAYISF

SEQ ID NO: 493993 - protein, 10 aa, Influenza virus
DILDGVTASC

SEQ ID NO: 493994 - protein, 10 aa, Influenza virus
DILEGTTASC

SEQ ID NO: 493995 - protein, 10 aa, Influenza virus
DILEKAHNGK

SEQ ID NO: 493996 - protein, 10 aa, Influenza virus
DILEKTHNGK

SEQ ID NO: 493997 - protein, 10 aa, Influenza virus
DILEKVHNGK

SEQ ID NO: 493998 - protein, 10 aa, Influenza virus
DILERTHNGK

SEQ ID NO: 493999 - protein, 10 aa, Influenza virus
DILHKCDNEC

SEQ ID NO: 494000 - protein, 10 aa, Influenza virus
DILHKCDNKC

SEQ ID NO: 494001 - protein, 10 aa, Influenza virus
DILHKCNNEC

SEQ ID NO: 494002 - protein, 10 aa, Influenza virus
DILKHNPTEE

SEQ ID NO: 494003 - protein, 10 aa, Influenza virus
DILKQNPTEE

SEQ ID NO: 494004 - protein, 10 aa, Influenza virus
DILRQNPSEE

SEQ ID NO: 494005 - protein, 10 aa, Influenza virus
DILRQNPTEE

SEQ ID NO: 494006 - protein, 10 aa, Influenza virus
DILRTQESEC

SEQ ID NO: 494007 - protein, 10 aa, Influenza virus
DILRTQESSC

SEQ ID NO: 494008 - protein, 10 aa, Influenza virus
DILVTREPYV

SEQ ID NO: 494009 - protein, 10 aa, Influenza virus
DIMQNKLNNV

SEQ ID NO: 494010 - protein, 10 aa, Influenza virus
DIMRTQESSC

SEQ ID NO: 494011 - protein, 10 aa, Influenza virus
DINIAEYSID

SEQ ID NO: 494012 - protein, 10 aa, Influenza virus
DINIMASQGT

SEQ ID NO: 494013 - protein, 10 aa, Influenza virus
DINLHAYISF

SEQ ID NO: 494014 - protein, 10 aa, Influenza virus
DINMADYSID

SEQ ID NO: 494015 - protein, 10 aa, Influenza virus
DINMEDYSID

SEQ ID NO: 494016 - protein, 10 aa, Influenza virus
DIRTATREGK

SEQ ID NO: 494017 - protein, 10 aa, Influenza virus
DISMEDYSID

SEQ ID NO: 494018 - protein, 10 aa, Influenza virus
DISMEDYSIG

SEQ ID NO: 494019 - protein, 10 aa, Influenza virus
DITIGSICMV

SEQ ID NO: 494020 - protein, 10 aa, Influenza virus
DIVLVMKRKR

SEQ ID NO: 494021 - protein, 10 aa, Influenza virus
DIVNAALGSP

SEQ ID NO: 494022 - protein, 10 aa, Influenza virus
DIVNGALGSP

SEQ ID NO: 494023 - protein, 10 aa, Influenza virus
DIVNSALGSP

SEQ ID NO: 494024 - protein, 10 aa, Influenza virus
DIWATREPYV

SEQ ID NO: 494025 - protein, 10 aa, Influenza virus
DIWAYNAELI

SEQ ID NO: 494026 - protein, 10 aa, Influenza virus
DIWAYNAELL

SEQ ID NO: 494027 - protein, 10 aa, Influenza virus
DIWITREPYV

SEQ ID NO: 494028 - protein, 10 aa, Influenza virus
DIWSYNAKLL

SEQ ID NO: 494029 - protein, 10 aa, Influenza virus
DIWSYNAQLL

SEQ ID NO: 494030 - protein, 10 aa, Influenza virus
DIWSYNARLL

SEQ ID NO: 494031 - protein, 10 aa, Influenza virus
DIWTYNAELL

SEQ ID NO: 494032 - protein, 10 aa, Influenza virus
DIWTYNAEML

SEQ ID NO: 494033 - protein, 10 aa, Influenza virus
DIWTYQAELL

SEQ ID NO: 494034 - protein, 10 aa, Influenza virus
DIWVTRELYV

SEQ ID NO: 494035 - protein, 10 aa, Influenza virus
DIWVTREPYA

SEQ ID NO: 494036 - protein, 10 aa, Influenza virus
DIWVTREPYV

SEQ ID NO: 494037 - protein, 10 aa, Influenza virus
DIWVTRVPYV

SEQ ID NO: 494038 - protein, 10 aa, Influenza virus
DIYCICRDNW

SEQ ID NO: 494039 - protein, 10 aa, Influenza virus
DIYCVCRDNW

SEQ ID NO: 494040 - protein, 10 aa, Influenza virus
DIYDFNEGSY

SEQ ID NO: 494041 - protein, 10 aa, Influenza virus
DKASTQKAID

SEQ ID NO: 494042 - protein, 10 aa, Influenza virus
DKASTQKAIN

SEQ ID NO: 494043 - protein, 10 aa, Influenza virus
DKAVKLYKKL

SEQ ID NO: 494044 - protein, 10 aa, Influenza virus
DKAVKLYRKL

SEQ ID NO: 494045 - protein, 10 aa, Influenza virus
DKCYQFALGQ

SEQ ID NO: 494046 - protein, 10 aa, Influenza virus
DKDSNGVQDI

SEQ ID NO: 494047 - protein, 10 aa, Influenza virus
DKEPMGFRYS

SEQ ID NO: 494048 - protein, 10 aa, Influenza virus
DKESMGFRYS

SEQ ID NO: 494049 - protein, 10 aa, Influenza virus
DKESTQKAID

SEQ ID NO: 494050 - protein, 10 aa, Influenza virus
DKGNGCFEIF

SEQ ID NO: 494051 - protein, 10 aa, Influenza virus
DKGSIQSDKP

SEQ ID NO: 494052 - protein, 10 aa, Influenza virus
DKHDSNVKNL

SEQ ID NO: 494053 - protein, 10 aa, Influenza virus
DKHSNGTIKD

SEQ ID NO: 494054 - protein, 10 aa, Influenza virus
DKHSNGTMKD

SEQ ID NO: 494055 - protein, 10 aa, Influenza virus
DKHSNGTVKD

SEQ ID NO: 494056 - protein, 10 aa, Influenza virus
DKHSNNTVKD

SEQ ID NO: 494057 - protein, 10 aa, Influenza virus
DKICIGYHAN

SEQ ID NO: 494058 - protein, 10 aa, Influenza virus
DKICIGYLSN

SEQ ID NO: 494059 - protein, 10 aa, Influenza virus
DKICIGYQTN

SEQ ID NO: 494060 - protein, 10 aa, Influenza virus
DKICLGHHAA

SEQ ID NO: 494061 - protein, 10 aa, Influenza virus
DKICLGHHAV

SEQ ID NO: 494062 - protein, 10 aa, Influenza virus
DKICLGRHAV

SEQ ID NO: 494063 - protein, 10 aa, Influenza virus
DKICVGYLST

SEQ ID NO: 494064 - protein, 10 aa, Influenza virus
DKIDDQIEDL

SEQ ID NO: 494065 - protein, 10 aa, Influenza virus
DKIDDQIEEL

SEQ ID NO: 494066 - protein, 10 aa, Influenza virus
DKIDDQIEGL

SEQ ID NO: 494067 - protein, 10 aa, Influenza virus
DKIDDQIENL

SEQ ID NO: 494068 - protein, 10 aa, Influenza virus
DKIDTLTETG

SEQ ID NO: 494069 - protein, 10 aa, Influenza virus
DKINDQIEDL

SEQ ID NO: 494070 - protein, 10 aa, Influenza virus
DKINGKLNRL

SEQ ID NO: 494071 - protein, 10 aa, Influenza virus
DKISLGHHAV

SEQ ID NO: 494072 - protein, 10 aa, Influenza virus
DKITFEATGN

SEQ ID NO: 494073 - protein, 10 aa, Influenza virus
DKITNKINNI

SEQ ID NO: 494074 - protein, 10 aa, Influenza virus
DKITNKVNNI

SEQ ID NO: 494075 - protein, 10 aa, Influenza virus
DKLTQGRQTF

SEQ ID NO: 494076 - protein, 10 aa, Influenza virus
DKLTQGRQTY

SEQ ID NO: 494077 - protein, 10 aa, Influenza virus
DKLYIWGIHH

SEQ ID NO: 494078 - protein, 10 aa, Influenza virus
DKLYIWGVHH

SEQ ID NO: 494079 - protein, 10 aa, Influenza virus
DKLYVWGIHH

SEQ ID NO: 494080 - protein, 10 aa, Influenza virus
DKLYVWGVHH

SEQ ID NO: 494081 - protein, 10 aa, Influenza virus
DKMNGNYDSI

SEQ ID NO: 494082 - protein, 10 aa, Influenza virus
DKMNREFEVM

SEQ ID NO: 494083 - protein, 10 aa, Influenza virus
DKMNREFEVV

SEQ ID NO: 494084 - protein, 10 aa, Influenza virus
DKMNREFGVV

SEQ ID NO: 494085 - protein, 10 aa, Influenza virus
DKNALGDCPK

SEQ ID NO: 494086 - protein, 10 aa, Influenza virus
DKNALGECPK

SEQ ID NO: 494087 - protein, 10 aa, Influenza virus
DKNATASFIY

SEQ ID NO: 494088 - protein, 10 aa, Influenza virus
DKNSNGVQDI

SEQ ID NO: 494089 - protein, 10 aa, Influenza virus
DKPFQNVSRI

SEQ ID NO: 494090 - protein, 10 aa, Influenza virus
DKQTKTMTIT

SEQ ID NO: 494091 - protein, 10 aa, Influenza virus
DKRIGSCTSP

SEQ ID NO: 494092 - protein, 10 aa, Influenza virus
DKRYGPALSI

SEQ ID NO: 494093 - protein, 10 aa, Influenza virus
DKTLDLHDAN

SEQ ID NO: 494094 - protein, 10 aa, Influenza virus
DKTLDMHDAN

SEQ ID NO: 494095 - protein, 10 aa, Influenza virus
DKTLNMHDAN

SEQ ID NO: 494096 - protein, 10 aa, Influenza virus
DKTNQQFELI

SEQ ID NO: 494097 - protein, 10 aa, Influenza virus
DKTNQQFEMI

SEQ ID NO: 494098 - protein, 10 aa, Influenza virus
DKTPYRSLIR

SEQ ID NO: 494099 - protein, 10 aa, Influenza virus
DKTSTQKAIN

SEQ ID NO: 494100 - protein, 10 aa, Influenza virus
DKVCTKGKKA

SEQ ID NO: 494101 - protein, 10 aa, Influenza virus
DKVDTIIENN

SEQ ID NO: 494102 - protein, 10 aa, Influenza virus
DKVDTLTENG

SEQ ID NO: 494103 - protein, 10 aa, Influenza virus
DKVDTLTETG

SEQ ID NO: 494104 - protein, 10 aa, Influenza virus
DKVNTIIENN

SEQ ID NO: 494105 - protein, 10 aa, Influenza virus
DKVRLQLKDN

SEQ ID NO: 494106 - protein, 10 aa, Influenza virus
DKVRLQLRDN

SEQ ID NO: 494107 - protein, 10 aa, Influenza virus
DKVRMQLKDN

SEQ ID NO: 494108 - protein, 10 aa, Influenza virus
DKVRMQLRDN

SEQ ID NO: 494109 - protein, 10 aa, Influenza virus
DKVSTQKAIN

SEQ ID NO: 494110 - protein, 10 aa, Influenza virus
DKVSTQKALN

SEQ ID NO: 494111 - protein, 10 aa, Influenza virus
DKVWWTSNSI

SEQ ID NO: 494112 - protein, 10 aa, Influenza virus
DKYHQIEKEF

SEQ ID NO: 494113 - protein, 10 aa, Influenza virus
DLADSEMDKL

SEQ ID NO: 494114 - protein, 10 aa, Influenza virus
DLADSEMKKL

SEQ ID NO: 494115 - protein, 10 aa, Influenza virus
DLADSEMLNL

SEQ ID NO: 494116 - protein, 10 aa, Influenza virus
DLADSEMNKL

SEQ ID NO: 494117 - protein, 10 aa, Influenza virus
DLADSEMNNL

SEQ ID NO: 494118 - protein, 10 aa, Influenza virus
DLADSEMSKL

SEQ ID NO: 494119 - protein, 10 aa, Influenza virus
DLAESEMNKL

SEQ ID NO: 494120 - protein, 10 aa, Influenza virus
DLDNCHPIGM

SEQ ID NO: 494121 - protein, 10 aa, Influenza virus
DLDYQIGYIC

SEQ ID NO: 494122 - protein, 10 aa, Influenza virus
DLDYQIGYVC

SEQ ID NO: 494123 - protein, 10 aa, Influenza virus
DLEALMEWIK

SEQ ID NO: 494124 - protein, 10 aa, Influenza virus
DLEALMEWLK

SEQ ID NO: 494125 - protein, 10 aa, Influenza virus
DLEEYVEDTK

SEQ ID NO: 494126 - protein, 10 aa, Influenza virus
DLEKYIEDTK

SEQ ID NO: 494127 - protein, 10 aa, Influenza virus
DLEKYVEDTK

SEQ ID NO: 494128 - protein, 10 aa, Influenza virus
DLENYVEDTK

SEQ ID NO: 494129 - protein, 10 aa, Influenza virus
DLERYVEDTK

SEQ ID NO: 494130 - protein, 10 aa, Influenza virus
DLGAPLELRD

SEQ ID NO: 494131 - protein, 10 aa, Influenza virus
DLGKCGLLGT

SEQ ID NO: 494132 - protein, 10 aa, Influenza virus
DLGNCHPIGI

SEQ ID NO: 494133 - protein, 10 aa, Influenza virus
DLGNCHPIGM

SEQ ID NO: 494134 - protein, 10 aa, Influenza virus
DLGNCHPVGM

SEQ ID NO: 494135 - protein, 10 aa, Influenza virus
DLGNGCFEFW

SEQ ID NO: 494136 - protein, 10 aa, Influenza virus
DLGNGCFKIY

SEQ ID NO: 494137 - protein, 10 aa, Influenza virus
DLGPATAQMA

SEQ ID NO: 494138 - protein, 10 aa, Influenza virus
DLGQCGILGI

SEQ ID NO: 494139 - protein, 10 aa, Influenza virus
DLGQCGLLGI

SEQ ID NO: 494140 - protein, 10 aa, Influenza virus
DLGQCGLLGT

SEQ ID NO: 494141 - protein, 10 aa, Influenza virus
DLGRCGLLGT

SEQ ID NO: 494142 - protein, 10 aa, Influenza virus
DLGSCGILGT

SEQ ID NO: 494143 - protein, 10 aa, Influenza virus
DLGSCHPIGM

SEQ ID NO: 494144 - protein, 10 aa, Influenza virus
DLGSPLELRD

SEQ ID NO: 494145 - protein, 10 aa, Influenza virus
DLGTPLELRD

SEQ ID NO: 494146 - protein, 10 aa, Influenza virus
DLHDANVKNL

SEQ ID NO: 494147 - protein, 10 aa, Influenza virus
DLHDANVRNL

SEQ ID NO: 494148 - protein, 10 aa, Influenza virus
DLHDSNVKNL

SEQ ID NO: 494149 - protein, 10 aa, Influenza virus
DLHDSNVRNL

SEQ ID NO: 494150 - protein, 10 aa, Influenza virus
DLHDSNVRSL

SEQ ID NO: 494151 - protein, 10 aa, Influenza virus
DLHLEFKADL

SEQ ID NO: 494152 - protein, 10 aa, Influenza virus
DLHLTGIWDT

SEQ ID NO: 494153 - protein, 10 aa, Influenza virus
DLHLTGMWDT

SEQ ID NO: 494154 - protein, 10 aa, Influenza virus
DLHLTGTWDT

SEQ ID NO: 494155 - protein, 10 aa, Influenza virus
DLIENLQAYQ

SEQ ID NO: 494156 - protein, 10 aa, Influenza virus
DLIETNHTGT

SEQ ID NO: 494157 - protein, 10 aa, Influenza virus
DLIETTHTGT

SEQ ID NO: 494158 - protein, 10 aa, Influenza virus
DLIFLARSAL

SEQ ID NO: 494159 - protein, 10 aa, Influenza virus
DLIFMARSAL

SEQ ID NO: 494160 - protein, 10 aa, Influenza virus
DLIFSARSAL

SEQ ID NO: 494161 - protein, 10 aa, Influenza virus
DLIGKNSWSY

SEQ ID NO: 494162 - protein, 10 aa, Influenza virus
DLIGKTSWSY

SEQ ID NO: 494163 - protein, 10 aa, Influenza virus
DLIIERKEGT

SEQ ID NO: 494164 - protein, 10 aa, Influenza virus
DLIIERREGA

SEQ ID NO: 494165 - protein, 10 aa, Influenza virus
DLIIERREGN

SEQ ID NO: 494166 - protein, 10 aa, Influenza virus
DLIIERREGS

SEQ ID NO: 494167 - protein, 10 aa, Influenza virus
DLIIERREGT

SEQ ID NO: 494168 - protein, 10 aa, Influenza virus
DLIIERRNSS

SEQ ID NO: 494169 - protein, 10 aa, Influenza virus
DLILFNTIGN

SEQ ID NO: 494170 - protein, 10 aa, Influenza virus
DLINGALGSP

SEQ ID NO: 494171 - protein, 10 aa, Influenza virus
DLIVFNTIGN

SEQ ID NO: 494172 - protein, 10 aa, Influenza virus
DLKSTQAAID

SEQ ID NO: 494173 - protein, 10 aa, Influenza virus
DLKSTQAAIN

SEQ ID NO: 494174 - protein, 10 aa, Influenza virus
DLKSTQAAIT

SEQ ID NO: 494175 - protein, 10 aa, Influenza virus
DLKSTQAAVN

SEQ ID NO: 494176 - protein, 10 aa, Influenza virus
DLKSTQTAID

SEQ ID NO: 494177 - protein, 10 aa, Influenza virus
DLLDNLQAYQ

SEQ ID NO: 494178 - protein, 10 aa, Influenza virus
DLLENLQAYQ

SEQ ID NO: 494179 - protein, 10 aa, Influenza virus
DLLENLQTYQ

SEQ ID NO: 494180 - protein, 10 aa, Influenza virus
DLLVAMENQH

SEQ ID NO: 494181 - protein, 10 aa, Influenza virus
DLNFVNRANQ

SEQ ID NO: 494182 - protein, 10 aa, Influenza virus
DLNMGQPFYS

SEQ ID NO: 494183 - protein, 10 aa, Influenza virus
DLNYQIGYIC

SEQ ID NO: 494184 - protein, 10 aa, Influenza virus
DLRSGYEMLK

SEQ ID NO: 494185 - protein, 10 aa, Influenza virus
DLRSGYETFK

SEQ ID NO: 494186 - protein, 10 aa, Influenza virus
DLSFQGRGVF

SEQ ID NO: 494187 - protein, 10 aa, Influenza virus
DLSQCGLLGT

SEQ ID NO: 494188 - protein, 10 aa, Influenza virus
DLTDSEMNKL

SEQ ID NO: 494189 - protein, 10 aa, Influenza virus
DLTDSEMSKL

SEQ ID NO: 494190 - protein, 10 aa, Influenza virus
DLTFLARSAL

SEQ ID NO: 494191 - protein, 10 aa, Influenza virus
DLVETNHTGT

SEQ ID NO: 494192 - protein, 10 aa, Influenza virus
DLVETSHTGT

SEQ ID NO: 494193 - protein, 10 aa, Influenza virus
DLWAYNAELL

SEQ ID NO: 494194 - protein, 10 aa, Influenza virus
DLWSYNAELL

SEQ ID NO: 494195 - protein, 10 aa, Influenza virus
DLWSYNAGLL

SEQ ID NO: 494196 - protein, 10 aa, Influenza virus
DLWTYNAELL

SEQ ID NO: 494197 - protein, 10 aa, Influenza virus
DLYDYKEDRF

SEQ ID NO: 494198 - protein, 10 aa, Influenza virus
DLYDYKENRF

SEQ ID NO: 494199 - protein, 10 aa, Influenza virus
DLYDYKESRF

SEQ ID NO: 494200 - protein, 10 aa, Influenza virus
DLYDYKKNRF

SEQ ID NO: 494201 - protein, 10 aa, Influenza virus
DLYGTQPLSI

SEQ ID NO: 494202 - protein, 10 aa, Influenza virus
DLYGTQSLSI

SEQ ID NO: 494203 - protein, 10 aa, Influenza virus
DLYKVATGRV

SEQ ID NO: 494204 - protein, 10 aa, Influenza virus
DLYLNGREWS

SEQ ID NO: 494205 - protein, 10 aa, Influenza virus
DLYLSGREWS

SEQ ID NO: 494206 - protein, 10 aa, Influenza virus
DLYLTGTWDT

SEQ ID NO: 494207 - protein, 10 aa, Influenza virus
DMADSEMLNL

SEQ ID NO: 494208 - protein, 10 aa, Influenza virus
DMGDSEMLNL

SEQ ID NO: 494209 - protein, 10 aa, Influenza virus
DMGNGCFKIY

SEQ ID NO: 494210 - protein, 10 aa, Influenza virus
DMGNGCFRIY

SEQ ID NO: 494211 - protein, 10 aa, Influenza virus
DMGNGCFTIY

SEQ ID NO: 494212 - protein, 10 aa, Influenza virus
DMGNGCLKIY

SEQ ID NO: 494213 - protein, 10 aa, Influenza virus
DMGQCGLLGT

SEQ ID NO: 494214 - protein, 10 aa, Influenza virus
DMHDANVKNL

SEQ ID NO: 494215 - protein, 10 aa, Influenza virus
DMHDANVRNL

SEQ ID NO: 494216 - protein, 10 aa, Influenza virus
DMSIGITVIK

SEQ ID NO: 494217 - protein, 10 aa, Influenza virus
DMSIGVAVIK

SEQ ID NO: 494218 - protein, 10 aa, Influenza virus
DMSIGVTVIK

SEQ ID NO: 494219 - protein, 10 aa, Influenza virus
DMSIGVTVIR

SEQ ID NO: 494220 - protein, 10 aa, Influenza virus
DMTDSEMNKL

SEQ ID NO: 494221 - protein, 10 aa, Influenza virus
DNADKICLGH

SEQ ID NO: 494222 - protein, 10 aa, Influenza virus
DNAEEYRRLR

SEQ ID NO: 494223 - protein, 10 aa, Influenza virus
DNAIDEGDGC

SEQ ID NO: 494224 - protein, 10 aa, Influenza virus
DNAIRFGEGE

SEQ ID NO: 494225 - protein, 10 aa, Influenza virus
DNAIRFGESE

SEQ ID NO: 494226 - protein, 10 aa, Influenza virus
DNAIRIGEDA

SEQ ID NO: 494227 - protein, 10 aa, Influenza virus
DNAIRIGEDS

SEQ ID NO: 494228 - protein, 10 aa, Influenza virus
DNAIRIGEEA

SEQ ID NO: 494229 - protein, 10 aa, Influenza virus
DNAIRIGEGA

SEQ ID NO: 494230 - protein, 10 aa, Influenza virus
DNAIRIGENA

SEQ ID NO: 494231 - protein, 10 aa, Influenza virus
DNAIRIGENS

SEQ ID NO: 494232 - protein, 10 aa, Influenza virus
DNAIRLGENK

SEQ ID NO: 494233 - protein, 10 aa, Influenza virus
DNAIRPGENK

SEQ ID NO: 494234 - protein, 10 aa, Influenza virus
DNAKDEGNGC

SEQ ID NO: 494235 - protein, 10 aa, Influenza virus
DNAKDLGNGC

SEQ ID NO: 494236 - protein, 10 aa, Influenza virus
DNAKEIGNGC

SEQ ID NO: 494237 - protein, 10 aa, Influenza virus
DNAKELGNGC

SEQ ID NO: 494238 - protein, 10 aa, Influenza virus
DNAKEMGNGC

SEQ ID NO: 494239 - protein, 10 aa, Influenza virus
DNAKETGNGC

SEQ ID NO: 494240 - protein, 10 aa, Influenza virus
DNAKEVGNGC

SEQ ID NO: 494241 - protein, 10 aa, Influenza virus
DNALRLAENK

SEQ ID NO: 494242 - protein, 10 aa, Influenza virus
DNANDLGNGC

SEQ ID NO: 494243 - protein, 10 aa, Influenza virus
DNARELGNGC

SEQ ID NO: 494244 - protein, 10 aa, Influenza virus
DNATATVYYD

SEQ ID NO: 494245 - protein, 10 aa, Influenza virus
DNATATVYYN

SEQ ID NO: 494246 - protein, 10 aa, Influenza virus
DNAVRFGESE

SEQ ID NO: 494247 - protein, 10 aa, Influenza virus
DNAVRIGEDA

SEQ ID NO: 494248 - protein, 10 aa, Influenza virus
DNAVRIGEDS

SEQ ID NO: 494249 - protein, 10 aa, Influenza virus
DNAVRIGENS

SEQ ID NO: 494250 - protein, 10 aa, Influenza virus
DNAVRIGESS

SEQ ID NO: 494251 - protein, 10 aa, Influenza virus
DNCMERIRNN

SEQ ID NO: 494252 - protein, 10 aa, Influenza virus
DNCMESIRDN

SEQ ID NO: 494253 - protein, 10 aa, Influenza virus
DNCMESIRNN

SEQ ID NO: 494254 - protein, 10 aa, Influenza virus
DNDAYAVIHY

SEQ ID NO: 494255 - protein, 10 aa, Influenza virus
DNDCESKCFW

SEQ ID NO: 494256 - protein, 10 aa, Influenza virus
DNDNWSGYSG

SEQ ID NO: 494257 - protein, 10 aa, Influenza virus
DNDPSGYAQT

SEQ ID NO: 494258 - protein, 10 aa, Influenza virus
DNEAVAVLKY

SEQ ID NO: 494259 - protein, 10 aa, Influenza virus
DNECMETIKN

SEQ ID NO: 494260 - protein, 10 aa, Influenza virus
DNEFTEVEQQ

SEQ ID NO: 494261 - protein, 10 aa, Influenza virus
DNENATATVY

SEQ ID NO: 494262 - protein, 10 aa, Influenza virus
DNEPGSGDWP

SEQ ID NO: 494263 - protein, 10 aa, Influenza virus
DNEPGSGNWP

SEQ ID NO: 494264 - protein, 10 aa, Influenza virus
DNEPGSGSWP

SEQ ID NO: 494265 - protein, 10 aa, Influenza virus
DNEPNGYAQT

SEQ ID NO: 494266 - protein, 10 aa, Influenza virus
DNEPSGYAQT

SEQ ID NO: 494267 - protein, 10 aa, Influenza virus
DNEPTGYAQT

SEQ ID NO: 494268 - protein, 10 aa, Influenza virus
DNEQTDLYKV

SEQ ID NO: 494269 - protein, 10 aa, Influenza virus
DNGAVAVLKY

SEQ ID NO: 494270 - protein, 10 aa, Influenza virus
DNGAVAVVKY

SEQ ID NO: 494271 - protein, 10 aa, Influenza virus
DNGDGCFEIL

SEQ ID NO: 494272 - protein, 10 aa, Influenza virus
DNGGLIAPSR

SEQ ID NO: 494273 - protein, 10 aa, Influenza virus
DNGIRIGSKG

SEQ ID NO: 494274 - protein, 10 aa, Influenza virus
DNGIRIGSRG

SEQ ID NO: 494275 - protein, 10 aa, Influenza virus
DNGIRVGSRG

SEQ ID NO: 494276 - protein, 10 aa, Influenza virus
DNGVRIGSKG

SEQ ID NO: 494277 - protein, 10 aa, Influenza virus
DNGVWIGRTK

SEQ ID NO: 494278 - protein, 10 aa, Influenza virus
DNGWVSTDKD

SEQ ID NO: 494279 - protein, 10 aa, Influenza virus
DNHSMSDIEA

SEQ ID NO: 494280 - protein, 10 aa, Influenza virus
DNHVEVVSAK

SEQ ID NO: 494281 - protein, 10 aa, Influenza virus
DNIEVTNATE

SEQ ID NO: 494282 - protein, 10 aa, Influenza virus
DNIIFSHNGG

SEQ ID NO: 494283 - protein, 10 aa, Influenza virus
DNITFSDNGG

SEQ ID NO: 494284 - protein, 10 aa, Influenza virus
DNITFSHNGG

SEQ ID NO: 494285 - protein, 10 aa, Influenza virus
DNIYKILSIY

SEQ ID NO: 494286 - protein, 10 aa, Influenza virus
DNKCIESIRN

SEQ ID NO: 494287 - protein, 10 aa, Influenza virus
DNKCMETIKN

SEQ ID NO: 494288 - protein, 10 aa, Influenza virus
DNKHSNDTIH

SEQ ID NO: 494289 - protein, 10 aa, Influenza virus
DNKHSNDTVH

SEQ ID NO: 494290 - protein, 10 aa, Influenza virus
DNKHSNGTIH

SEQ ID NO: 494291 - protein, 10 aa, Influenza virus
DNKNWSGYSG

SEQ ID NO: 494292 - protein, 10 aa, Influenza virus
DNKTKKMTIT

SEQ ID NO: 494293 - protein, 10 aa, Influenza virus
DNLEPGTFDI

SEQ ID NO: 494294 - protein, 10 aa, Influenza virus
DNLEPGTFDL

SEQ ID NO: 494295 - protein, 10 aa, Influenza virus
DNLIGKTSWS

SEQ ID NO: 494296 - protein, 10 aa, Influenza virus
DNLNWSGYSG

SEQ ID NO: 494297 - protein, 10 aa, Influenza virus
DNLQAYQKRM

SEQ ID NO: 494298 - protein, 10 aa, Influenza virus
DNMQNKLNNV

SEQ ID NO: 494299 - protein, 10 aa, Influenza virus
DNMQNRLNNV

SEQ ID NO: 494300 - protein, 10 aa, Influenza virus
DNNCESKCFW

SEQ ID NO: 494301 - protein, 10 aa, Influenza virus
DNNCIESIRN

SEQ ID NO: 494302 - protein, 10 aa, Influenza virus
DNNGELRHLF

SEQ ID NO: 494303 - protein, 10 aa, Influenza virus
DNNIRIGSKG

SEQ ID NO: 494304 - protein, 10 aa, Influenza virus
DNNKNATNPL

SEQ ID NO: 494305 - protein, 10 aa, Influenza virus
DNNNRSGYSG

SEQ ID NO: 494306 - protein, 10 aa, Influenza virus
DNNNWFGYFG

SEQ ID NO: 494307 - protein, 10 aa, Influenza virus
DNNNWSGYSG

SEQ ID NO: 494308 - protein, 10 aa, Influenza virus
DNNSWSGYSG

SEQ ID NO: 494309 - protein, 10 aa, Influenza virus
DNPIRLSGGG

SEQ ID NO: 494310 - protein, 10 aa, Influenza virus
DNPITGSPGA

SEQ ID NO: 494311 - protein, 10 aa, Influenza virus
DNPNWSGYSG

SEQ ID NO: 494312 - protein, 10 aa, Influenza virus
DNQCMESIRN

SEQ ID NO: 494313 - protein, 10 aa, Influenza virus
DNQNWSGYSG

SEQ ID NO: 494314 - protein, 10 aa, Influenza virus
DNQTKKMTIT

SEQ ID NO: 494315 - protein, 10 aa, Influenza virus
DNQTKTMTIT

SEQ ID NO: 494316 - protein, 10 aa, Influenza virus
DNQVFPQLNQ

SEQ ID NO: 494317 - protein, 10 aa, Influenza virus
DNRSGYSGIF

SEQ ID NO: 494318 - protein, 10 aa, Influenza virus
DNSCESKCFW

SEQ ID NO: 494319 - protein, 10 aa, Influenza virus
DNSCIESIRN

SEQ ID NO: 494320 - protein, 10 aa, Influenza virus
DNSIQLSAGG

SEQ ID NO: 494321 - protein, 10 aa, Influenza virus
DNSIRIGSKG

SEQ ID NO: 494322 - protein, 10 aa, Influenza virus
DNSIRIGSRG

SEQ ID NO: 494323 - protein, 10 aa, Influenza virus
DNSIRLAAGG

SEQ ID NO: 494324 - protein, 10 aa, Influenza virus
DNSIRLSADG

SEQ ID NO: 494325 - protein, 10 aa, Influenza virus
DNSIRLSAGG

SEQ ID NO: 494326 - protein, 10 aa, Influenza virus
DNSIRLSASG

SEQ ID NO: 494327 - protein, 10 aa, Influenza virus
DNSNWSGYSG

SEQ ID NO: 494328 - protein, 10 aa, Influenza virus
DNSVRIGSKG

SEQ ID NO: 494329 - protein, 10 aa, Influenza virus
DNSVRLSAGG

SEQ ID NO: 494330 - protein, 10 aa, Influenza virus
DNTCIESIRN

SEQ ID NO: 494331 - protein, 10 aa, Influenza virus
DNTKWNENQN

SEQ ID NO: 494332 - protein, 10 aa, Influenza virus
DNTWLGGTIS

SEQ ID NO: 494333 - protein, 10 aa, Influenza virus
DNTWLGRTIS

SEQ ID NO: 494334 - protein, 10 aa, Influenza virus
DNVKELGNGC

SEQ ID NO: 494335 - protein, 10 aa, Influenza virus
DNVSWTSNSI

SEQ ID NO: 494336 - protein, 10 aa, Influenza virus
DNVYKALSIY

SEQ ID NO: 494337 - protein, 10 aa, Influenza virus
DNVYKILSIY

SEQ ID NO: 494338 - protein, 10 aa, Influenza virus
DNVYKVLAIY

SEQ ID NO: 494339 - protein, 10 aa, Influenza virus
DNVYKVLSIY

SEQ ID NO: 494340 - protein, 10 aa, Influenza virus
DNVYRALSIY

SEQ ID NO: 494341 - protein, 10 aa, Influenza virus
DNWHASNRPW

SEQ ID NO: 494342 - protein, 10 aa, Influenza virus
DNWHGSNRPW

SEQ ID NO: 494343 - protein, 10 aa, Influenza virus
DNWKGANRPI

SEQ ID NO: 494344 - protein, 10 aa, Influenza virus
DNWKGANRPV

SEQ ID NO: 494345 - protein, 10 aa, Influenza virus
DNWKGCNRPV

SEQ ID NO: 494346 - protein, 10 aa, Influenza virus
DNWKGSNRPD

SEQ ID NO: 494347 - protein, 10 aa, Influenza virus
DNWKGSNRPI

SEQ ID NO: 494348 - protein, 10 aa, Influenza virus
DNWKGSNRPV

SEQ ID NO: 494349 - protein, 10 aa, Influenza virus
DNWKGSNRPW

SEQ ID NO: 494350 - protein, 10 aa, Influenza virus
DNWKSSNRPV

SEQ ID NO: 494351 - protein, 10 aa, Influenza virus
DNWMGSNRPV

SEQ ID NO: 494352 - protein, 10 aa, Influenza virus
DNWNGMNRPI

SEQ ID NO: 494353 - protein, 10 aa, Influenza virus
DNWNGMNRPV

SEQ ID NO: 494354 - protein, 10 aa, Influenza virus
DNWQGANRPI

SEQ ID NO: 494355 - protein, 10 aa, Influenza virus
DNWQGANRPV

SEQ ID NO: 494356 - protein, 10 aa, Influenza virus
DNWQGSNRPV

SEQ ID NO: 494357 - protein, 10 aa, Influenza virus
DNWRGANRPV

SEQ ID NO: 494358 - protein, 10 aa, Influenza virus
DNWRGSNRPI

SEQ ID NO: 494359 - protein, 10 aa, Influenza virus
DNWRGSNRPV

SEQ ID NO: 494360 - protein, 10 aa, Influenza virus
DNWRGSNRPW

SEQ ID NO: 494361 - protein, 10 aa, Influenza virus
DNWSGYSGSF

SEQ ID NO: 494362 - protein, 10 aa, Influenza virus
DNWTGTNRPI

SEQ ID NO: 494363 - protein, 10 aa, Influenza virus
DNWTGTNRPV

SEQ ID NO: 494364 - protein, 10 aa, Influenza virus
DNYGVKGFGF

SEQ ID NO: 494365 - protein, 10 aa, Influenza virus
DPAAPHGLCY

SEQ ID NO: 494366 - protein, 10 aa, Influenza virus
DPDECRFYAL

SEQ ID NO: 494367 - protein, 10 aa, Influenza virus
DPDGCRFYAL

SEQ ID NO: 494368 - protein, 10 aa, Influenza virus
DPDHEGEGIP

SEQ ID NO: 494369 - protein, 10 aa, Influenza virus
DPDPFRLLQN

SEQ ID NO: 494370 - protein, 10 aa, Influenza virus
DPFKLLQNSQ

SEQ ID NO: 494371 - protein, 10 aa, Influenza virus
DPFKLLQTSQ

SEQ ID NO: 494372 - protein, 10 aa, Influenza virus
DPFRLLQNSQ

SEQ ID NO: 494373 - protein, 10 aa, Influenza virus
DPFRLLQSSQ

SEQ ID NO: 494374 - protein, 10 aa, Influenza virus
DPGAPHGLCY

SEQ ID NO: 494375 - protein, 10 aa, Influenza virus
DPGDTVTFTF

SEQ ID NO: 494376 - protein, 10 aa, Influenza virus
DPGVKGFAFL

SEQ ID NO: 494377 - protein, 10 aa, Influenza virus
DPHLTGTWDT

SEQ ID NO: 494378 - protein, 10 aa, Influenza virus
DPICIGYHAN

SEQ ID NO: 494379 - protein, 10 aa, Influenza virus
DPKGLFGAIA

SEQ ID NO: 494380 - protein, 10 aa, Influenza virus
DPKKTGGPIY

SEQ ID NO: 494381 - protein, 10 aa, Influenza virus
DPLASLLEMC

SEQ ID NO: 494382 - protein, 10 aa, Influenza virus
DPLGCKMYAL

SEQ ID NO: 494383 - protein, 10 aa, Influenza virus
DPLGCKTYAL

SEQ ID NO: 494384 - protein, 10 aa, Influenza virus
DPLGCRMYAL

SEQ ID NO: 494385 - protein, 10 aa, Influenza virus
DPLLSLLEMC

SEQ ID NO: 494386 - protein, 10 aa, Influenza virus
DPNALLKHRF

SEQ ID NO: 494387 - protein, 10 aa, Influenza virus
DPNAPHKLCF

SEQ ID NO: 494388 - protein, 10 aa, Influenza virus
DPNAPHKLCY

SEQ ID NO: 494389 - protein, 10 aa, Influenza virus
DPNAPNKFCY

SEQ ID NO: 494390 - protein, 10 aa, Influenza virus
DPNAPNKLCF

SEQ ID NO: 494391 - protein, 10 aa, Influenza virus
DPNAPNKLCY

SEQ ID NO: 494392 - protein, 10 aa, Influenza virus
DPNDERGNPG

SEQ ID NO: 494393 - protein, 10 aa, Influenza virus
DPNECRFYAL

SEQ ID NO: 494394 - protein, 10 aa, Influenza virus
DPNEERGNPG

SEQ ID NO: 494395 - protein, 10 aa, Influenza virus
DPNEERGSPG

SEQ ID NO: 494396 - protein, 10 aa, Influenza virus
DPNHEGEGIP

SEQ ID NO: 494397 - protein, 10 aa, Influenza virus
DPNNEKGNPG

SEQ ID NO: 494398 - protein, 10 aa, Influenza virus
DPNNERGNPG

SEQ ID NO: 494399 - protein, 10 aa, Influenza virus
DPNNMARAVK

SEQ ID NO: 494400 - protein, 10 aa, Influenza virus
DPNNMDKAVK

SEQ ID NO: 494401 - protein, 10 aa, Influenza virus
DPNNMDRAVK

SEQ ID NO: 494402 - protein, 10 aa, Influenza virus
DPNTLLKHRF

SEQ ID NO: 494403 - protein, 10 aa, Influenza virus
DPNVLLKHRF

SEQ ID NO: 494404 - protein, 10 aa, Influenza virus
DPNWSGYSGS

SEQ ID NO: 494405 - protein, 10 aa, Influenza virus
DPPYSHGTGT

SEQ ID NO: 494406 - protein, 10 aa, Influenza virus
DPRMCSLMQG

SEQ ID NO: 494407 - protein, 10 aa, Influenza virus
DPSAPHGLCY

SEQ ID NO: 494408 - protein, 10 aa, Influenza virus
DPSAPHRLCY

SEQ ID NO: 494409 - protein, 10 aa, Influenza virus
DPSGCKMYAL

SEQ ID NO: 494410 - protein, 10 aa, Influenza virus
DPSGYAQTDC

SEQ ID NO: 494411 - protein, 10 aa, Influenza virus
DPSHEGEGIP

SEQ ID NO: 494412 - protein, 10 aa, Influenza virus
DPSIMSCDSP

SEQ ID NO: 494413 - protein, 10 aa, Influenza virus
DPSNMDRAVK

SEQ ID NO: 494414 - protein, 10 aa, Influenza virus
DPSTISCDSP

SEQ ID NO: 494415 - protein, 10 aa, Influenza virus
DPSTMSCDSP

SEQ ID NO: 494416 - protein, 10 aa, Influenza virus
DPSTVSCDSP

SEQ ID NO: 494417 - protein, 10 aa, Influenza virus
DPSVVSCDSP

SEQ ID NO: 494418 - protein, 10 aa, Influenza virus
DPTAPHGLCY

SEQ ID NO: 494419 - protein, 10 aa, Influenza virus
DPTGCKMYAL

SEQ ID NO: 494420 - protein, 10 aa, Influenza virus
DPVELSSGYK

SEQ ID NO: 494421 - protein, 10 aa, Influenza virus
DPVKLSGGYK

SEQ ID NO: 494422 - protein, 10 aa, Influenza virus
DPVKLSNGYK

SEQ ID NO: 494423 - protein, 10 aa, Influenza virus
DPVKLSSGYK

SEQ ID NO: 494424 - protein, 10 aa, Influenza virus
DPWVLLNASW

SEQ ID NO: 494425 - protein, 10 aa, Influenza virus
DPYLNGREWS

SEQ ID NO: 494426 - protein, 10 aa, Influenza virus
DPYPGNNNGV

SEQ ID NO: 494427 - protein, 10 aa, Influenza virus
DPYPGNNNKG

SEQ ID NO: 494428 - protein, 10 aa, Influenza virus
DPYPGNNNNG

SEQ ID NO: 494429 - protein, 10 aa, Influenza virus
DPYPGNSNNG

SEQ ID NO: 494430 - protein, 10 aa, Influenza virus
DQAWSYIVER

SEQ ID NO: 494431 - protein, 10 aa, Influenza virus
DQCMESIRNN

SEQ ID NO: 494432 - protein, 10 aa, Influenza virus
DQDWSYIVER

SEQ ID NO: 494433 - protein, 10 aa, Influenza virus
DQELGDAPFL

SEQ ID NO: 494434 - protein, 10 aa, Influenza virus
DQGAGYAADK

SEQ ID NO: 494435 - protein, 10 aa, Influenza virus
DQGNGCFEIF

SEQ ID NO: 494436 - protein, 10 aa, Influenza virus
DQGSGYAADK

SEQ ID NO: 494437 - protein, 10 aa, Influenza virus
DQGWSYIVER

SEQ ID NO: 494438 - protein, 10 aa, Influenza virus
DQICIGHHAN

SEQ ID NO: 494439 - protein, 10 aa, Influenza virus
DQICIGYHAN

SEQ ID NO: 494440 - protein, 10 aa, Influenza virus
DQICIGYHSN

SEQ ID NO: 494441 - protein, 10 aa, Influenza virus
DQICVGYHAN

SEQ ID NO: 494442 - protein, 10 aa, Influenza virus
DQICVGYHSN

SEQ ID NO: 494443 - protein, 10 aa, Influenza virus
DQIEDLWAYN

SEQ ID NO: 494444 - protein, 10 aa, Influenza virus
DQIEELWAYN

SEQ ID NO: 494445 - protein, 10 aa, Influenza virus
DQIEGLWAYN

SEQ ID NO: 494446 - protein, 10 aa, Influenza virus
DQIENLWAYN

SEQ ID NO: 494447 - protein, 10 aa, Influenza virus
DQIEVTNATE

SEQ ID NO: 494448 - protein, 10 aa, Influenza virus
DQIIDIWAYN

SEQ ID NO: 494449 - protein, 10 aa, Influenza virus
DQINGKLNRL

SEQ ID NO: 494450 - protein, 10 aa, Influenza virus
DQIQDIWAYN

SEQ ID NO: 494451 - protein, 10 aa, Influenza virus
DQIQDLWAYN

SEQ ID NO: 494452 - protein, 10 aa, Influenza virus
DQIQDVWAYN

SEQ ID NO: 494453 - protein, 10 aa, Influenza virus
DQIQNIWAYN

SEQ ID NO: 494454 - protein, 10 aa, Influenza virus
DQISIVPNIG

SEQ ID NO: 494455 - protein, 10 aa, Influenza virus
DQITDIWAYN

SEQ ID NO: 494456 - protein, 10 aa, Influenza virus
DQITGKLNHL

SEQ ID NO: 494457 - protein, 10 aa, Influenza virus
DQITGKLNRL

SEQ ID NO: 494458 - protein, 10 aa, Influenza virus
DQITRKLNRL

SEQ ID NO: 494459 - protein, 10 aa, Influenza virus
DQITTKINNI

SEQ ID NO: 494460 - protein, 10 aa, Influenza virus
DQKSLRGRGS

SEQ ID NO: 494461 - protein, 10 aa, Influenza virus
DQKSTQEAID

SEQ ID NO: 494462 - protein, 10 aa, Influenza virus
DQKSTQEAIE

SEQ ID NO: 494463 - protein, 10 aa, Influenza virus
DQKSTQEAIG

SEQ ID NO: 494464 - protein, 10 aa, Influenza virus
DQKSTQEAIN

SEQ ID NO: 494465 - protein, 10 aa, Influenza virus
DQLKLATGLR

SEQ ID NO: 494466 - protein, 10 aa, Influenza virus
DQSLIIAARN

SEQ ID NO: 494467 - protein, 10 aa, Influenza virus
DQSLIIAARS

SEQ ID NO: 494468 - protein, 10 aa, Influenza virus
DQSLVIAARN

SEQ ID NO: 494469 - protein, 10 aa, Influenza virus
DQSWSYIVER

SEQ ID NO: 494470 - protein, 10 aa, Influenza virus
DQVEVTNATE

SEQ ID NO: 494471 - protein, 10 aa, Influenza virus
DQVKLSSGYK

SEQ ID NO: 494472 - protein, 10 aa, Influenza virus
DQVNGKLNRL

SEQ ID NO: 494473 - protein, 10 aa, Influenza virus
DQVREGRNPG

SEQ ID NO: 494474 - protein, 10 aa, Influenza virus
DQVRESRNPG

SEQ ID NO: 494475 - protein, 10 aa, Influenza virus
DQVTDIWAYN

SEQ ID NO: 494476 - protein, 10 aa, Influenza virus
DQVTGKLNRL

SEQ ID NO: 494477 - protein, 10 aa, Influenza virus
DRAAFRGLIS

SEQ ID NO: 494478 - protein, 10 aa, Influenza virus
DRAPYRSLIR

SEQ ID NO: 494479 - protein, 10 aa, Influenza virus
DRATFLRSNA

SEQ ID NO: 494480 - protein, 10 aa, Influenza virus
DRAVKLYKKL

SEQ ID NO: 494481 - protein, 10 aa, Influenza virus
DRAVKLYRKL

SEQ ID NO: 494482 - protein, 10 aa, Influenza virus
DRCYQFALGQ

SEQ ID NO: 494483 - protein, 10 aa, Influenza virus
DRDSTQKAID

SEQ ID NO: 494484 - protein, 10 aa, Influenza virus
DRDSTQMAID

SEQ ID NO: 494485 - protein, 10 aa, Influenza virus
DRDSTQRAID

SEQ ID NO: 494486 - protein, 10 aa, Influenza virus
DRFLRVKDQQ

SEQ ID NO: 494487 - protein, 10 aa, Influenza virus
DRFLRVRDQL

SEQ ID NO: 494488 - protein, 10 aa, Influenza virus
DRFLRVRDQM

SEQ ID NO: 494489 - protein, 10 aa, Influenza virus
DRFLRVRDQQ

SEQ ID NO: 494490 - protein, 10 aa, Influenza virus
DRFLRVRDQR

SEQ ID NO: 494491 - protein, 10 aa, Influenza virus
DRFYRICKLV

SEQ ID NO: 494492 - protein, 10 aa, Influenza virus
DRFYRTCKLL

SEQ ID NO: 494493 - protein, 10 aa, Influenza virus
DRFYRTCKLV

SEQ ID NO: 494494 - protein, 10 aa, Influenza virus
DRGLFGAIAG

SEQ ID NO: 494495 - protein, 10 aa, Influenza virus
DRGLFGAKAG

SEQ ID NO: 494496 - protein, 10 aa, Influenza virus
DRGNGCFEIF

SEQ ID NO: 494497 - protein, 10 aa, Influenza virus
DRGSTQKAID

SEQ ID NO: 494498 - protein, 10 aa, Influenza virus
DRHSNGTVKD

SEQ ID NO: 494499 - protein, 10 aa, Influenza virus
DRHSNNTVKD

SEQ ID NO: 494500 - protein, 10 aa, Influenza virus
DRICIGYHAN

SEQ ID NO: 494501 - protein, 10 aa, Influenza virus
DRICIGYLST

SEQ ID NO: 494502 - protein, 10 aa, Influenza virus
DRICIGYQSN

SEQ ID NO: 494503 - protein, 10 aa, Influenza virus
DRICLGHHAV

SEQ ID NO: 494504 - protein, 10 aa, Influenza virus
DRICVGYHAN

SEQ ID NO: 494505 - protein, 10 aa, Influenza virus
DRICVGYLST

SEQ ID NO: 494506 - protein, 10 aa, Influenza virus
DRIDDAVTDI

SEQ ID NO: 494507 - protein, 10 aa, Influenza virus
DRIDDAVTDV

SEQ ID NO: 494508 - protein, 10 aa, Influenza virus
DRIEVTNATE

SEQ ID NO: 494509 - protein, 10 aa, Influenza virus
DRIPHRTLLM

SEQ ID NO: 494510 - protein, 10 aa, Influenza virus
DRIQDIWAYN

SEQ ID NO: 494511 - protein, 10 aa, Influenza virus
DRIRRDQKSL

SEQ ID NO: 494512 - protein, 10 aa, Influenza virus
DRISHRTLLM

SEQ ID NO: 494513 - protein, 10 aa, Influenza virus
DRITTKINNI

SEQ ID NO: 494514 - protein, 10 aa, Influenza virus
DRLQDTTWDV

SEQ ID NO: 494515 - protein, 10 aa, Influenza virus
DRLRRDQKAL

SEQ ID NO: 494516 - protein, 10 aa, Influenza virus
DRLRRDQKSL

SEQ ID NO: 494517 - protein, 10 aa, Influenza virus
DRLRRDQRAL

SEQ ID NO: 494518 - protein, 10 aa, Influenza virus
DRLRRDQRSL

SEQ ID NO: 494519 - protein, 10 aa, Influenza virus
DRLTQGRQTY

SEQ ID NO: 494520 - protein, 10 aa, Influenza virus
DRLVLATGLR

SEQ ID NO: 494521 - protein, 10 aa, Influenza virus
DRMIKAVRGD

SEQ ID NO: 494522 - protein, 10 aa, Influenza virus
DRNAFRGLIS

SEQ ID NO: 494523 - protein, 10 aa, Influenza virus
DRNAIGDCPK

SEQ ID NO: 494524 - protein, 10 aa, Influenza virus
DRNALGDCPK

SEQ ID NO: 494525 - protein, 10 aa, Influenza virus
DRNATASFIY

SEQ ID NO: 494526 - protein, 10 aa, Influenza virus
DRNATASLIY

SEQ ID NO: 494527 - protein, 10 aa, Influenza virus
DRNFWRGDNG

SEQ ID NO: 494528 - protein, 10 aa, Influenza virus
DRNFWRGENG

SEQ ID NO: 494529 - protein, 10 aa, Influenza virus
DRPKVNGQAG

SEQ ID NO: 494530 - protein, 10 aa, Influenza virus
DRRLTTTIKT

SEQ ID NO: 494531 - protein, 10 aa, Influenza virus
DRRYGPALSI

SEQ ID NO: 494532 - protein, 10 aa, Influenza virus
DRSFRPNIGP

SEQ ID NO: 494533 - protein, 10 aa, Influenza virus
DRSPFRALIS

SEQ ID NO: 494534 - protein, 10 aa, Influenza virus
DRSPFRALMS

SEQ ID NO: 494535 - protein, 10 aa, Influenza virus
DRSPFRALVS

SEQ ID NO: 494536 - protein, 10 aa, Influenza virus
DRSPFRTLMS

SEQ ID NO: 494537 - protein, 10 aa, Influenza virus
DRSPHRALMS

SEQ ID NO: 494538 - protein, 10 aa, Influenza virus
DRSPHRTLLM

SEQ ID NO: 494539 - protein, 10 aa, Influenza virus
DRSPHRTLMS

SEQ ID NO: 494540 - protein, 10 aa, Influenza virus
DRSPQRTLMS

SEQ ID NO: 494541 - protein, 10 aa, Influenza virus
DRSPYRALIS

SEQ ID NO: 494542 - protein, 10 aa, Influenza virus
DRSPYRALMS

SEQ ID NO: 494543 - protein, 10 aa, Influenza virus
DRSPYRTLLM

SEQ ID NO: 494544 - protein, 10 aa, Influenza virus
DRSPYRTLMS

SEQ ID NO: 494545 - protein, 10 aa, Influenza virus
DRSQFRALIS

SEQ ID NO: 494546 - protein, 10 aa, Influenza virus
DRSQYRALIS

SEQ ID NO: 494547 - protein, 10 aa, Influenza virus
DRSQYRALVS

SEQ ID NO: 494548 - protein, 10 aa, Influenza virus
DRSQYRSLIS

SEQ ID NO: 494549 - protein, 10 aa, Influenza virus
DRTAFRGLIS

SEQ ID NO: 494550 - protein, 10 aa, Influenza virus
DRTAFRGLMS

SEQ ID NO: 494551 - protein, 10 aa, Influenza virus
DRTLDLHDAN

SEQ ID NO: 494552 - protein, 10 aa, Influenza virus
DRTNHQFELI

SEQ ID NO: 494553 - protein, 10 aa, Influenza virus
DRTPHRTLLM

SEQ ID NO: 494554 - protein, 10 aa, Influenza virus
DRTPYRSLIK

SEQ ID NO: 494555 - protein, 10 aa, Influenza virus
DRTPYRSLIQ

SEQ ID NO: 494556 - protein, 10 aa, Influenza virus
DRTPYRSLIR

SEQ ID NO: 494557 - protein, 10 aa, Influenza virus
DRTPYRTLLM

SEQ ID NO: 494558 - protein, 10 aa, Influenza virus
DRTSHRTLLM

SEQ ID NO: 494559 - protein, 10 aa, Influenza virus
DRTSYRSLIR

SEQ ID NO: 494560 - protein, 10 aa, Influenza virus
DRTSYRTLLM

SEQ ID NO: 494561 - protein, 10 aa, Influenza virus
DRTTFRGLIS

SEQ ID NO: 494562 - protein, 10 aa, Influenza virus
DRTTFRGLLS

SEQ ID NO: 494563 - protein, 10 aa, Influenza virus
DRVDDAVTDI

SEQ ID NO: 494564 - protein, 10 aa, Influenza virus
DRVDDAVTDV

SEQ ID NO: 494565 - protein, 10 aa, Influenza virus
DRVRKQLRQN

SEQ ID NO: 494566 - protein, 10 aa, Influenza virus
DRVRLQLRDN

SEQ ID NO: 494567 - protein, 10 aa, Influenza virus
DRVRMQLRDN

SEQ ID NO: 494568 - protein, 10 aa, Influenza virus
DRVWWTSNSI

SEQ ID NO: 494569 - protein, 10 aa, Influenza virus
DSCMDTIRNG

SEQ ID NO: 494570 - protein, 10 aa, Influenza virus
DSCMEAIRNG

SEQ ID NO: 494571 - protein, 10 aa, Influenza virus
DSCMESIRNN

SEQ ID NO: 494572 - protein, 10 aa, Influenza virus
DSCMETIRNG

SEQ ID NO: 494573 - protein, 10 aa, Influenza virus
DSDILVTREP

SEQ ID NO: 494574 - protein, 10 aa, Influenza virus
DSDVLVTREP

SEQ ID NO: 494575 - protein, 10 aa, Influenza virus
DSECVSHNGT

SEQ ID NO: 494576 - protein, 10 aa, Influenza virus
DSEMDKLFER

SEQ ID NO: 494577 - protein, 10 aa, Influenza virus
DSEMDKLYER

SEQ ID NO: 494578 - protein, 10 aa, Influenza virus
DSEMDKLYTR

SEQ ID NO: 494579 - protein, 10 aa, Influenza virus
DSEMKKLYER

SEQ ID NO: 494580 - protein, 10 aa, Influenza virus
DSEMLNLYDR

SEQ ID NO: 494581 - protein, 10 aa, Influenza virus
DSEMLNLYEG

SEQ ID NO: 494582 - protein, 10 aa, Influenza virus
DSEMLNLYER

SEQ ID NO: 494583 - protein, 10 aa, Influenza virus
DSEMNKLFEK

SEQ ID NO: 494584 - protein, 10 aa, Influenza virus
DSEMNKLFER

SEQ ID NO: 494585 - protein, 10 aa, Influenza virus
DSEMNKLYEK

SEQ ID NO: 494586 - protein, 10 aa, Influenza virus
DSEMNKLYER

SEQ ID NO: 494587 - protein, 10 aa, Influenza virus
DSEMNNLYER

SEQ ID NO: 494588 - protein, 10 aa, Influenza virus
DSEMNRLFER

SEQ ID NO: 494589 - protein, 10 aa, Influenza virus
DSEMSKLFEK

SEQ ID NO: 494590 - protein, 10 aa, Influenza virus
DSEMSKLFER

SEQ ID NO: 494591 - protein, 10 aa, Influenza virus
DSEMSKLYER

SEQ ID NO: 494592 - protein, 10 aa, Influenza virus
DSFRQSERGE

SEQ ID NO: 494593 - protein, 10 aa, Influenza virus
DSFYAELKWL

SEQ ID NO: 494594 - protein, 10 aa, Influenza virus
DSFYRSMKWL

SEQ ID NO: 494595 - protein, 10 aa, Influenza virus
DSGAVAVLKY

SEQ ID NO: 494596 - protein, 10 aa, Influenza virus
DSGYVCSGLV

SEQ ID NO: 494597 - protein, 10 aa, Influenza virus
DSHHRSHRQM

SEQ ID NO: 494598 - protein, 10 aa, Influenza virus
DSHLKFKADL

SEQ ID NO: 494599 - protein, 10 aa, Influenza virus
DSIGSWSHNI

SEQ ID NO: 494600 - protein, 10 aa, Influenza virus
DSIGSWSQNI

SEQ ID NO: 494601 - protein, 10 aa, Influenza virus
DSIIFNSIGN

SEQ ID NO: 494602 - protein, 10 aa, Influenza virus
DSIKSWRKDI

SEQ ID NO: 494603 - protein, 10 aa, Influenza virus
DSIKSWRRDI

SEQ ID NO: 494604 - protein, 10 aa, Influenza virus
DSIRGEFNQV

SEQ ID NO: 494605 - protein, 10 aa, Influenza virus
DSIRGEFSQV

SEQ ID NO: 494606 - protein, 10 aa, Influenza virus
DSISSWSQNI

SEQ ID NO: 494607 - protein, 10 aa, Influenza virus
DSITDIWTYQ

SEQ ID NO: 494608 - protein, 10 aa, Influenza virus
DSITEVWSYN

SEQ ID NO: 494609 - protein, 10 aa, Influenza virus
DSITFSHNGG

SEQ ID NO: 494610 - protein, 10 aa, Influenza virus
DSITYIWTYQ

SEQ ID NO: 494611 - protein, 10 aa, Influenza virus
DSIVSWSQNI

SEQ ID NO: 494612 - protein, 10 aa, Influenza virus
DSLEPGTFDL

SEQ ID NO: 494613 - protein, 10 aa, Influenza virus
DSLKLSIEDP

SEQ ID NO: 494614 - protein, 10 aa, Influenza virus
DSLLGDPHCD

SEQ ID NO: 494615 - protein, 10 aa, Influenza virus
DSLNITAASL

SEQ ID NO: 494616 - protein, 10 aa, Influenza virus
DSLTEIWSYN

SEQ ID NO: 494617 - protein, 10 aa, Influenza virus
DSMTEIWSYN

SEQ ID NO: 494618 - protein, 10 aa, Influenza virus
DSMTEVWSYN

SEQ ID NO: 494619 - protein, 10 aa, Influenza virus
DSNALLKHRF

SEQ ID NO: 494620 - protein, 10 aa, Influenza virus
DSNGNFIAPE

SEQ ID NO: 494621 - protein, 10 aa, Influenza virus
DSNGVQDIID

SEQ ID NO: 494622 - protein, 10 aa, Influenza virus
DSNVENLFDE

SEQ ID NO: 494623 - protein, 10 aa, Influenza virus
DSNVKNLFDE

SEQ ID NO: 494624 - protein, 10 aa, Influenza virus
DSNVKNLHEK

SEQ ID NO: 494625 - protein, 10 aa, Influenza virus
DSNVKNLYDK

SEQ ID NO: 494626 - protein, 10 aa, Influenza virus
DSNVKNLYDR

SEQ ID NO: 494627 - protein, 10 aa, Influenza virus
DSNVKNLYEK

SEQ ID NO: 494628 - protein, 10 aa, Influenza virus
DSNVKNLYNK

SEQ ID NO: 494629 - protein, 10 aa, Influenza virus
DSNVRNLHEK

SEQ ID NO: 494630 - protein, 10 aa, Influenza virus
DSNVRNLHER

SEQ ID NO: 494631 - protein, 10 aa, Influenza virus
DSNVRNLYDK

SEQ ID NO: 494632 - protein, 10 aa, Influenza virus
DSNVRSLHEK

SEQ ID NO: 494633 - protein, 10 aa, Influenza virus
DSNYVCSGLV

SEQ ID NO: 494634 - protein, 10 aa, Influenza virus
DSQHKSHRQM

SEQ ID NO: 494635 - protein, 10 aa, Influenza virus
DSQHRSHRQM

SEQ ID NO: 494636 - protein, 10 aa, Influenza virus
DSQTATKRIR

SEQ ID NO: 494637 - protein, 10 aa, Influenza virus
DSQTATKRLR

SEQ ID NO: 494638 - protein, 10 aa, Influenza virus
DSRAVGKCPR

SEQ ID NO: 494639 - protein, 10 aa, Influenza virus
DSRSGYEILK

SEQ ID NO: 494640 - protein, 10 aa, Influenza virus
DSRSGYEMLK

SEQ ID NO: 494641 - protein, 10 aa, Influenza virus
DSRSGYETFK

SEQ ID NO: 494642 - protein, 10 aa, Influenza virus
DSRSGYETFR

SEQ ID NO: 494643 - protein, 10 aa, Influenza virus
DSRSGYEVLK

SEQ ID NO: 494644 - protein, 10 aa, Influenza virus
DSSFYAEMKW

SEQ ID NO: 494645 - protein, 10 aa, Influenza virus
DSSILTDSQT

SEQ ID NO: 494646 - protein, 10 aa, Influenza virus
DSSYICSGLV

SEQ ID NO: 494647 - protein, 10 aa, Influenza virus
DSSYLCSGLV

SEQ ID NO: 494648 - protein, 10 aa, Influenza virus
DSSYVCSGLV

SEQ ID NO: 494649 - protein, 10 aa, Influenza virus
DSTAVAVIKY

SEQ ID NO: 494650 - protein, 10 aa, Influenza virus
DSTDSEMNKL

SEQ ID NO: 494651 - protein, 10 aa, Influenza virus
DSTQKAIDIM

SEQ ID NO: 494652 - protein, 10 aa, Influenza virus
DSTQKAIDNM

SEQ ID NO: 494653 - protein, 10 aa, Influenza virus
DSTQMAIDNM

SEQ ID NO: 494654 - protein, 10 aa, Influenza virus
DSTQRAIDNM

SEQ ID NO: 494655 - protein, 10 aa, Influenza virus
DSTWLGRTIS

SEQ ID NO: 494656 - protein, 10 aa, Influenza virus
DSVKLSSGYK

SEQ ID NO: 494657 - protein, 10 aa, Influenza virus
DSVTELWSYN

SEQ ID NO: 494658 - protein, 10 aa, Influenza virus
DSVYKALSIY

SEQ ID NO: 494659 - protein, 10 aa, Influenza virus
DSWAVGRCPR

SEQ ID NO: 494660 - protein, 10 aa, Influenza virus
DTCYPFDVPD

SEQ ID NO: 494661 - protein, 10 aa, Influenza virus
DTCYPFDVPE

SEQ ID NO: 494662 - protein, 10 aa, Influenza virus
DTCYPFDVPG

SEQ ID NO: 494663 - protein, 10 aa, Influenza virus
DTCYPFDVPN

SEQ ID NO: 494664 - protein, 10 aa, Influenza virus
DTDVVNFLSM

SEQ ID NO: 494665 - protein, 10 aa, Influenza virus
DTDVVNFVSM

SEQ ID NO: 494666 - protein, 10 aa, Influenza virus
DTDVVNYVSM

SEQ ID NO: 494667 - protein, 10 aa, Influenza virus
DTDVYCICRD

SEQ ID NO: 494668 - protein, 10 aa, Influenza virus
DTEISFTITG

SEQ ID NO: 494669 - protein, 10 aa, Influenza virus
DTELSFTITG

SEQ ID NO: 494670 - protein, 10 aa, Influenza virus
DTELSFTVTG

SEQ ID NO: 494671 - protein, 10 aa, Influenza virus
DTFKSWKGNI

SEQ ID NO: 494672 - protein, 10 aa, Influenza virus
DTGDGCFEIL

SEQ ID NO: 494673 - protein, 10 aa, Influenza virus
DTGKGCFDIL

SEQ ID NO: 494674 - protein, 10 aa, Influenza virus
DTGNGCFDIL

SEQ ID NO: 494675 - protein, 10 aa, Influenza virus
DTICIGYHAN

SEQ ID NO: 494676 - protein, 10 aa, Influenza virus
DTICVGYHAN

SEQ ID NO: 494677 - protein, 10 aa, Influenza virus
DTIIENNVTV

SEQ ID NO: 494678 - protein, 10 aa, Influenza virus
DTIIESNVTV

SEQ ID NO: 494679 - protein, 10 aa, Influenza virus
DTIIFEANGN

SEQ ID NO: 494680 - protein, 10 aa, Influenza virus
DTIIFEASGN

SEQ ID NO: 494681 - protein, 10 aa, Influenza virus
DTIIFEATGN

SEQ ID NO: 494682 - protein, 10 aa, Influenza virus
DTILEKNITV

SEQ ID NO: 494683 - protein, 10 aa, Influenza virus
DTILEKNVTV

SEQ ID NO: 494684 - protein, 10 aa, Influenza virus
DTILEQNVTV

SEQ ID NO: 494685 - protein, 10 aa, Influenza virus
DTILERNVTV

SEQ ID NO: 494686 - protein, 10 aa, Influenza virus
DTIMEKIVTV

SEQ ID NO: 494687 - protein, 10 aa, Influenza virus
DTIMEKNVIF

SEQ ID NO: 494688 - protein, 10 aa, Influenza virus
DTIMEKNVTV

SEQ ID NO: 494689 - protein, 10 aa, Influenza virus
DTIMERNVTV

SEQ ID NO: 494690 - protein, 10 aa, Influenza virus
DTINFESTGN

SEQ ID NO: 494691 - protein, 10 aa, Influenza virus
DTINYYNETF

SEQ ID NO: 494692 - protein, 10 aa, Influenza virus
DTIRNGTYNH

SEQ ID NO: 494693 - protein, 10 aa, Influenza virus
DTISFESTGN

SEQ ID NO: 494694 - protein, 10 aa, Influenza virus
DTITFEATGN

SEQ ID NO: 494695 - protein, 10 aa, Influenza virus
DTITFSFNGA

SEQ ID NO: 494696 - protein, 10 aa, Influenza virus
DTKCQTPLGA

SEQ ID NO: 494697 - protein, 10 aa, Influenza virus
DTKIDLWSYN

SEQ ID NO: 494698 - protein, 10 aa, Influenza virus
DTKILFIEEG

SEQ ID NO: 494699 - protein, 10 aa, Influenza virus
DTKVDLWSYN

SEQ ID NO: 494700 - protein, 10 aa, Influenza virus
DTLCIGYHAN

SEQ ID NO: 494701 - protein, 10 aa, Influenza virus
DTLKSWKGNI

SEQ ID NO: 494702 - protein, 10 aa, Influenza virus
DTLLEKNVTV

SEQ ID NO: 494703 - protein, 10 aa, Influenza virus
DTLLENDVPV

SEQ ID NO: 494704 - protein, 10 aa, Influenza virus
DTLLENGVPV

SEQ ID NO: 494705 - protein, 10 aa, Influenza virus
DTLLENNVPV

SEQ ID NO: 494706 - protein, 10 aa, Influenza virus
DTLLESDVPV

SEQ ID NO: 494707 - protein, 10 aa, Influenza virus
DTLTEKGIEV

SEQ ID NO: 494708 - protein, 10 aa, Influenza virus
DTLTENGVPV

SEQ ID NO: 494709 - protein, 10 aa, Influenza virus
DTLTETGVPV

SEQ ID NO: 494710 - protein, 10 aa, Influenza virus
DTNKTFQNID

SEQ ID NO: 494711 - protein, 10 aa, Influenza virus
DTPRGEDAQF

SEQ ID NO: 494712 - protein, 10 aa, Influenza virus
DTPRGEDGQF

SEQ ID NO: 494713 - protein, 10 aa, Influenza virus
DTPRGEDNQF

SEQ ID NO: 494714 - protein, 10 aa, Influenza virus
DTPRGEDSQF

SEQ ID NO: 494715 - protein, 10 aa, Influenza virus
DTPRNDDRFS

SEQ ID NO: 494716 - protein, 10 aa, Influenza virus
DTPRNDDRSS

SEQ ID NO: 494717 - protein, 10 aa, Influenza virus
DTPRNDDSSS

SEQ ID NO: 494718 - protein, 10 aa, Influenza virus
DTPRNEDGSS

SEQ ID NO: 494719 - protein, 10 aa, Influenza virus
DTPRNEDSSS

SEQ ID NO: 494720 - protein, 10 aa, Influenza virus
DTPRNGDSSS

SEQ ID NO: 494721 - protein, 10 aa, Influenza virus
DTPRSDDSSS

SEQ ID NO: 494722 - protein, 10 aa, Influenza virus
DTRILFIEEG

SEQ ID NO: 494723 - protein, 10 aa, Influenza virus
DTRILFIKEG

SEQ ID NO: 494724 - protein, 10 aa, Influenza virus
DTRILFIREG

SEQ ID NO: 494725 - protein, 10 aa, Influenza virus
DTRILFVKEG

SEQ ID NO: 494726 - protein, 10 aa, Influenza virus
DTRSGYEMLK

SEQ ID NO: 494727 - protein, 10 aa, Influenza virus
DTTAVAVLKY

SEQ ID NO: 494728 - protein, 10 aa, Influenza virus
DTTCWSWPDG

SEQ ID NO: 494729 - protein, 10 aa, Influenza virus
DTTGWPWPDG

SEQ ID NO: 494730 - protein, 10 aa, Influenza virus
DTTGWSWPDG

SEQ ID NO: 494731 - protein, 10 aa, Influenza virus
DTTMEKNVTV

SEQ ID NO: 494732 - protein, 10 aa, Influenza virus
DTTSWSWPDG

SEQ ID NO: 494733 - protein, 10 aa, Influenza virus
DTTWDVFIER

SEQ ID NO: 494734 - protein, 10 aa, Influenza virus
DTTYQRTRAL

SEQ ID NO: 494735 - protein, 10 aa, Influenza virus
DTVDTILEKN

SEQ ID NO: 494736 - protein, 10 aa, Influenza virus
DTVDTLLEKN

SEQ ID NO: 494737 - protein, 10 aa, Influenza virus
DTVDTLTENG

SEQ ID NO: 494738 - protein, 10 aa, Influenza virus
DTVDTVLEKN

SEQ ID NO: 494739 - protein, 10 aa, Influenza virus
DTVDTVLERN

SEQ ID NO: 494740 - protein, 10 aa, Influenza virus
DTVDTVREKN

SEQ ID NO: 494741 - protein, 10 aa, Influenza virus
DTVLEKNVTV

SEQ ID NO: 494742 - protein, 10 aa, Influenza virus
DTVLERNVTV

SEQ ID NO: 494743 - protein, 10 aa, Influenza virus
DTVNFSFNGA

SEQ ID NO: 494744 - protein, 10 aa, Influenza virus
DTVNRTHQYS

SEQ ID NO: 494745 - protein, 10 aa, Influenza virus
DTVNTLIEQN

SEQ ID NO: 494746 - protein, 10 aa, Influenza virus
DTVNTLTEQN

SEQ ID NO: 494747 - protein, 10 aa, Influenza virus
DTVREKNVTV

SEQ ID NO: 494748 - protein, 10 aa, Influenza virus
DTVTFIFNGA

SEQ ID NO: 494749 - protein, 10 aa, Influenza virus
DTVTFNFNGA

SEQ ID NO: 494750 - protein, 10 aa, Influenza virus
DTVTFSFNGA

SEQ ID NO: 494751 - protein, 10 aa, Influenza virus
DTVTFTFNGA

SEQ ID NO: 494752 - protein, 10 aa, Influenza virus
DTYDFNEGAY

SEQ ID NO: 494753 - protein, 10 aa, Influenza virus
DTYDFNEGSY

SEQ ID NO: 494754 - protein, 10 aa, Influenza virus
DTYDFNEGTY

SEQ ID NO: 494755 - protein, 10 aa, Influenza virus
DVCYPGKFAN

SEQ ID NO: 494756 - protein, 10 aa, Influenza virus
DVCYPGKFSN

SEQ ID NO: 494757 - protein, 10 aa, Influenza virus
DVCYPGKFTN

SEQ ID NO: 494758 - protein, 10 aa, Influenza virus
DVCYPGKFVN

SEQ ID NO: 494759 - protein, 10 aa, Influenza virus
DVDQSLIIAA

SEQ ID NO: 494760 - protein, 10 aa, Influenza virus
DVDQSLVIAA

SEQ ID NO: 494761 - protein, 10 aa, Influenza virus
DVDVYCICRD

SEQ ID NO: 494762 - protein, 10 aa, Influenza virus
DVECVCRDNW

SEQ ID NO: 494763 - protein, 10 aa, Influenza virus
DVFIERPTAV

SEQ ID NO: 494764 - protein, 10 aa, Influenza virus
DVFVIREPFI

SEQ ID NO: 494765 - protein, 10 aa, Influenza virus
DVGYLCAGIP

SEQ ID NO: 494766 - protein, 10 aa, Influenza virus
DVILWFSFGA

SEQ ID NO: 494767 - protein, 10 aa, Influenza virus
DVILWFSLGA

SEQ ID NO: 494768 - protein, 10 aa, Influenza virus
DVILWISFSI

SEQ ID NO: 494769 - protein, 10 aa, Influenza virus
DVIMEVVFPN

SEQ ID NO: 494770 - protein, 10 aa, Influenza virus
DVINFESTGN

SEQ ID NO: 494771 - protein, 10 aa, Influenza virus
DVIRSWRKQI

SEQ ID NO: 494772 - protein, 10 aa, Influenza virus
DVISFESTGN

SEQ ID NO: 494773 - protein, 10 aa, Influenza virus
DVIVFNTIGN

SEQ ID NO: 494774 - protein, 10 aa, Influenza virus
DVLDGVTASC

SEQ ID NO: 494775 - protein, 10 aa, Influenza virus
DVLVALENQH

SEQ ID NO: 494776 - protein, 10 aa, Influenza virus
DVLVIWGIHH

SEQ ID NO: 494777 - protein, 10 aa, Influenza virus
DVLVLWGIHH

SEQ ID NO: 494778 - protein, 10 aa, Influenza virus
DVLVMWGIHH

SEQ ID NO: 494779 - protein, 10 aa, Influenza virus
DVLVMWGLHH

SEQ ID NO: 494780 - protein, 10 aa, Influenza virus
DVLVTREPYV

SEQ ID NO: 494781 - protein, 10 aa, Influenza virus
DVLWTSNSIV

SEQ ID NO: 494782 - protein, 10 aa, Influenza virus
DVNPTLLFLE

SEQ ID NO: 494783 - protein, 10 aa, Influenza virus
DVNPTLLFLK

SEQ ID NO: 494784 - protein, 10 aa, Influenza virus
DVNPTLLFLR

SEQ ID NO: 494785 - protein, 10 aa, Influenza virus
DVPDYQSIRS

SEQ ID NO: 494786 - protein, 10 aa, Influenza virus
DVPDYQSLRS

SEQ ID NO: 494787 - protein, 10 aa, Influenza virus
DVPEWSYIVE

SEQ ID NO: 494788 - protein, 10 aa, Influenza virus
DVPEYQSLRS

SEQ ID NO: 494789 - protein, 10 aa, Influenza virus
DVPGYQSLRS

SEQ ID NO: 494790 - protein, 10 aa, Influenza virus
DVPNYQSLRS

SEQ ID NO: 494791 - protein, 10 aa, Influenza virus
DVRCICRDNW

SEQ ID NO: 494792 - protein, 10 aa, Influenza virus
DVRCTCRDNW

SEQ ID NO: 494793 - protein, 10 aa, Influenza virus
DVRCVCRDNW

SEQ ID NO: 494794 - protein, 10 aa, Influenza virus
DVSFQGRGVF

SEQ ID NO: 494795 - protein, 10 aa, Influenza virus
DVSWASNSIV

SEQ ID NO: 494796 - protein, 10 aa, Influenza virus
DVSWTSNSIV

SEQ ID NO: 494797 - protein, 10 aa, Influenza virus
DVTDSEMNKL

SEQ ID NO: 494798 - protein, 10 aa, Influenza virus
DVVLVMKRKR

SEQ ID NO: 494799 - protein, 10 aa, Influenza virus
DVVNFLSMEF

SEQ ID NO: 494800 - protein, 10 aa, Influenza virus
DVVNFVSMEF

SEQ ID NO: 494801 - protein, 10 aa, Influenza virus
DVVNYVSMEF

SEQ ID NO: 494802 - protein, 10 aa, Influenza virus
DVVRSWKKQI

SEQ ID NO: 494803 - protein, 10 aa, Influenza virus
DVVRSWRKKI

SEQ ID NO: 494804 - protein, 10 aa, Influenza virus
DVVRSWRKQI

SEQ ID NO: 494805 - protein, 10 aa, Influenza virus
DVVRSWRRQI

SEQ ID NO: 494806 - protein, 10 aa, Influenza virus
DVWAYNAELL

SEQ ID NO: 494807 - protein, 10 aa, Influenza virus
DVWLGRTVSI

SEQ ID NO: 494808 - protein, 10 aa, Influenza virus
DVWLGRTVSN

SEQ ID NO: 494809 - protein, 10 aa, Influenza virus
DVWLGRTVST

SEQ ID NO: 494810 - protein, 10 aa, Influenza virus
DVWMGRTISK

SEQ ID NO: 494811 - protein, 10 aa, Influenza virus
DVWMGRTISM

SEQ ID NO: 494812 - protein, 10 aa, Influenza virus
DVWMGRTISR

SEQ ID NO: 494813 - protein, 10 aa, Influenza virus
DVWSYNAKLL

SEQ ID NO: 494814 - protein, 10 aa, Influenza virus
DVWTYNAELL

SEQ ID NO: 494815 - protein, 10 aa, Influenza virus
DVWTYNTELL

SEQ ID NO: 494816 - protein, 10 aa, Influenza virus
DVYCICRDNW

SEQ ID NO: 494817 - protein, 10 aa, Influenza virus
DVYCVCRDNW

SEQ ID NO: 494818 - protein, 10 aa, Influenza virus
DVYKILSIYS

SEQ ID NO: 494819 - protein, 10 aa, Influenza virus
DVYQILAIYS

SEQ ID NO: 494820 - protein, 10 aa, Influenza virus
DWILWISFAI

SEQ ID NO: 494821 - protein, 10 aa, Influenza virus
DWILWISFAM

SEQ ID NO: 494822 - protein, 10 aa, Influenza virus
DWILWISFAT

SEQ ID NO: 494823 - protein, 10 aa, Influenza virus
DWPDGAKIEY

SEQ ID NO: 494824 - protein, 10 aa, Influenza virus
DWPDGAKIKY

SEQ ID NO: 494825 - protein, 10 aa, Influenza virus
DWSGYSGAFI

SEQ ID NO: 494826 - protein, 10 aa, Influenza virus
DWSGYSGSFI

SEQ ID NO: 494827 - protein, 10 aa, Influenza virus
DWSGYSGSFM

SEQ ID NO: 494828 - protein, 10 aa, Influenza virus
DWSGYSGSFS

SEQ ID NO: 494829 - protein, 10 aa, Influenza virus
DWSGYSGSFV

SEQ ID NO: 494830 - protein, 10 aa, Influenza virus
DWSWHDGAIL

SEQ ID NO: 494831 - protein, 10 aa, Influenza virus
DWSWHDGAVL

SEQ ID NO: 494832 - protein, 10 aa, Influenza virus
DWSYIVERPS

SEQ ID NO: 494833 - protein, 10 aa, Influenza virus
DWTLNRNQPA

SEQ ID NO: 494834 - protein, 10 aa, Influenza virus
DWVDDAVTDI

SEQ ID NO: 494835 - protein, 10 aa, Influenza virus
DWVLWISFAI

SEQ ID NO: 494836 - protein, 10 aa, Influenza virus
DYARLYIWGV

SEQ ID NO: 494837 - protein, 10 aa, Influenza virus
DYEEEAKLER

SEQ ID NO: 494838 - protein, 10 aa, Influenza virus
DYEELKEQLS

SEQ ID NO: 494839 - protein, 10 aa, Influenza virus
DYEELKHLLN

SEQ ID NO: 494840 - protein, 10 aa, Influenza virus
DYEELKHLLS

SEQ ID NO: 494841 - protein, 10 aa, Influenza virus
DYEELKHLMS

SEQ ID NO: 494842 - protein, 10 aa, Influenza virus
DYEELREQLS

SEQ ID NO: 494843 - protein, 10 aa, Influenza virus
DYESTQAAID

SEQ ID NO: 494844 - protein, 10 aa, Influenza virus
DYHDSNVKNL

SEQ ID NO: 494845 - protein, 10 aa, Influenza virus
DYHYEECSCY

SEQ ID NO: 494846 - protein, 10 aa, Influenza virus
DYILDEESRA

SEQ ID NO: 494847 - protein, 10 aa, Influenza virus
DYKEESQLKR

SEQ ID NO: 494848 - protein, 10 aa, Influenza virus
DYKSTPSAID

SEQ ID NO: 494849 - protein, 10 aa, Influenza virus
DYKSTQAAID

SEQ ID NO: 494850 - protein, 10 aa, Influenza virus
DYKSTQAAVD

SEQ ID NO: 494851 - protein, 10 aa, Influenza virus
DYKSTQKTID

SEQ ID NO: 494852 - protein, 10 aa, Influenza virus
DYKSTQSAID

SEQ ID NO: 494853 - protein, 10 aa, Influenza virus
DYKSTQSAIN

SEQ ID NO: 494854 - protein, 10 aa, Influenza virus
DYKSTQSAVD

SEQ ID NO: 494855 - protein, 10 aa, Influenza virus
DYKSTQSAVN

SEQ ID NO: 494856 - protein, 10 aa, Influenza virus
DYLIGKTSWS

SEQ ID NO: 494857 - protein, 10 aa, Influenza virus
DYNNTTGRDV

SEQ ID NO: 494858 - protein, 10 aa, Influenza virus
DYPKYEEESK

SEQ ID NO: 494859 - protein, 10 aa, Influenza virus
DYPKYEEESR

SEQ ID NO: 494860 - protein, 10 aa, Influenza virus
DYPKYEKESK

SEQ ID NO: 494861 - protein, 10 aa, Influenza virus
DYQIGYICSG

SEQ ID NO: 494862 - protein, 10 aa, Influenza virus
DYQIGYVCSG

SEQ ID NO: 494863 - protein, 10 aa, Influenza virus
DYQLIPMISK

SEQ ID NO: 494864 - protein, 10 aa, Influenza virus
DYQSIRSILA

SEQ ID NO: 494865 - protein, 10 aa, Influenza virus
DYQSLRSILA

SEQ ID NO: 494866 - protein, 10 aa, Influenza virus
DYREESQLKK

SEQ ID NO: 494867 - protein, 10 aa, Influenza virus
DYREESQLKR

SEQ ID NO: 494868 - protein, 10 aa, Influenza virus
DYRYTYRCHK

SEQ ID NO: 494869 - protein, 10 aa, Influenza virus
DYRYTYRCHR

SEQ ID NO: 494870 - protein, 10 aa, Influenza virus
DYSIDSGYVC

SEQ ID NO: 494871 - protein, 10 aa, Influenza virus
DYSIDSNYVC

SEQ ID NO: 494872 - protein, 10 aa, Influenza virus
DYSIDSSYIC

SEQ ID NO: 494873 - protein, 10 aa, Influenza virus
DYSIDSSYVC

SEQ ID NO: 494874 - protein, 10 aa, Influenza virus
DYTIDEESRA

SEQ ID NO: 494875 - protein, 10 aa, Influenza virus
DYTLDEESRA

SEQ ID NO: 494876 - protein, 10 aa, Influenza virus
DYTRLYIWGV

SEQ ID NO: 494877 - protein, 10 aa, Influenza virus
DYWAEGDCYR

SEQ ID NO: 494878 - protein, 10 aa, Influenza virus
DYWAEGECYR

SEQ ID NO: 494879 - protein, 10 aa, Influenza virus
DYWAKEECYR

SEQ ID NO: 494880 - protein, 10 aa, Influenza virus
DYWAKGDCYR

SEQ ID NO: 494881 - protein, 10 aa, Influenza virus
DYWAKGECYR

SEQ ID NO: 494882 - protein, 10 aa, Influenza virus
DYYWAILKPG

SEQ ID NO: 494883 - protein, 10 aa, Influenza virus
DYYWAVLKPG

SEQ ID NO: 494884 - protein, 10 aa, Influenza virus
DYYWGILKRG

SEQ ID NO: 494885 - protein, 10 aa, Influenza virus
EAESSIKEKD

SEQ ID NO: 494886 - protein, 10 aa, Influenza virus
EAESSVKEKD

SEQ ID NO: 494887 - protein, 10 aa, Influenza virus
EAESSVREKD

SEQ ID NO: 494888 - protein, 10 aa, Influenza virus
EAGLKWELMD

SEQ ID NO: 494889 - protein, 10 aa, Influenza virus
EAHILVTREP

SEQ ID NO: 494890 - protein, 10 aa, Influenza virus
EAIDKITNKI

SEQ ID NO: 494891 - protein, 10 aa, Influenza virus
EAIDKITNKV

SEQ ID NO: 494892 - protein, 10 aa, Influenza virus
EAIEECLIND

SEQ ID NO: 494893 - protein, 10 aa, Influenza virus
EAIEKITNKV

SEQ ID NO: 494894 - protein, 10 aa, Influenza virus
EAIGKITNKV

SEQ ID NO: 494895 - protein, 10 aa, Influenza virus
EAINKITNKV

SEQ ID NO: 494896 - protein, 10 aa, Influenza virus
EAINNRFQIQ

SEQ ID NO: 494897 - protein, 10 aa, Influenza virus
EAINNRIKIN

SEQ ID NO: 494898 - protein, 10 aa, Influenza virus
EAINSRFQIQ

SEQ ID NO: 494899 - protein, 10 aa, Influenza virus
EAIRNGTYNH

SEQ ID NO: 494900 - protein, 10 aa, Influenza virus
EAISNRFQIQ

SEQ ID NO: 494901 - protein, 10 aa, Influenza virus
EAKLEKSRIN

SEQ ID NO: 494902 - protein, 10 aa, Influenza virus
EAKLERSKIN

SEQ ID NO: 494903 - protein, 10 aa, Influenza virus
EAKYVEWTSN

SEQ ID NO: 494904 - protein, 10 aa, Influenza virus
EAKYVWWASN

SEQ ID NO: 494905 - protein, 10 aa, Influenza virus
EAKYVWWTSN

SEQ ID NO: 494906 - protein, 10 aa, Influenza virus
EALKMTIASD

SEQ ID NO: 494907 - protein, 10 aa, Influenza virus
EALLNRLNIN

SEQ ID NO: 494908 - protein, 10 aa, Influenza virus
EALLNRLSIN

SEQ ID NO: 494909 - protein, 10 aa, Influenza virus
EALLSRLNIN

SEQ ID NO: 494910 - protein, 10 aa, Influenza virus
EALMEWIKTR

SEQ ID NO: 494911 - protein, 10 aa, Influenza virus
EALMEWLKTR

SEQ ID NO: 494912 - protein, 10 aa, Influenza virus
EALNNRFQIK

SEQ ID NO: 494913 - protein, 10 aa, Influenza virus
EALNNRSQIK

SEQ ID NO: 494914 - protein, 10 aa, Influenza virus
EALQNRIMIN

SEQ ID NO: 494915 - protein, 10 aa, Influenza virus
EALRQIIRES

SEQ ID NO: 494916 - protein, 10 aa, Influenza virus
EALRQKIMES

SEQ ID NO: 494917 - protein, 10 aa, Influenza virus
EALSNRFQIK

SEQ ID NO: 494918 - protein, 10 aa, Influenza virus
EAMAFLEDSH

SEQ ID NO: 494919 - protein, 10 aa, Influenza virus
EAMAFLEESH

SEQ ID NO: 494920 - protein, 10 aa, Influenza virus
EAMAFLEKSH

SEQ ID NO: 494921 - protein, 10 aa, Influenza virus
EAMAFLENSH

SEQ ID NO: 494922 - protein, 10 aa, Influenza virus
EAMALLEESH

SEQ ID NO: 494923 - protein, 10 aa, Influenza virus
EAMASQGTKR

SEQ ID NO: 494924 - protein, 10 aa, Influenza virus
EAMATQGTKR

SEQ ID NO: 494925 - protein, 10 aa, Influenza virus
EAMISRARID

SEQ ID NO: 494926 - protein, 10 aa, Influenza virus
EAMMSRARID

SEQ ID NO: 494927 - protein, 10 aa, Influenza virus
EAMQNRIQID

SEQ ID NO: 494928 - protein, 10 aa, Influenza virus
EAMQNRLKID

SEQ ID NO: 494929 - protein, 10 aa, Influenza virus
EAMVSRARID

SEQ ID NO: 494930 - protein, 10 aa, Influenza virus
EAPGWSWDDG

SEQ ID NO: 494931 - protein, 10 aa, Influenza virus
EAPSPYNSKF

SEQ ID NO: 494932 - protein, 10 aa, Influenza virus
EAPSPYNSRF

SEQ ID NO: 494933 - protein, 10 aa, Influenza virus
EAQDVIMEVV

SEQ ID NO: 494934 - protein, 10 aa, Influenza virus
EARGLFGAIA

SEQ ID NO: 494935 - protein, 10 aa, Influenza virus
EARVWWTSNS

SEQ ID NO: 494936 - protein, 10 aa, Influenza virus
EAVAVLKYNG

SEQ ID NO: 494937 - protein, 10 aa, Influenza virus
EAVAWSATAC

SEQ ID NO: 494938 - protein, 10 aa, Influenza virus
EAVEECLIND

SEQ ID NO: 494939 - protein, 10 aa, Influenza virus
EAVIYGNPKC

SEQ ID NO: 494940 - protein, 10 aa, Influenza virus
EAVNNRFQIK

SEQ ID NO: 494941 - protein, 10 aa, Influenza virus
EAYNFNEGSY

SEQ ID NO: 494942 - protein, 10 aa, Influenza virus
ECFNPCFYVE

SEQ ID NO: 494943 - protein, 10 aa, Influenza virus
ECFNPITGSP

SEQ ID NO: 494944 - protein, 10 aa, Influenza virus
ECFWVMTDGP

SEQ ID NO: 494945 - protein, 10 aa, Influenza virus
ECFYSGGTIN

SEQ ID NO: 494946 - protein, 10 aa, Influenza virus
ECICINGTCT

SEQ ID NO: 494947 - protein, 10 aa, Influenza virus
ECICRDNWTG

SEQ ID NO: 494948 - protein, 10 aa, Influenza virus
ECIEKIRNGT

SEQ ID NO: 494949 - protein, 10 aa, Influenza virus
ECIEKVRNGT

SEQ ID NO: 494950 - protein, 10 aa, Influenza virus
ECIERVRNGT

SEQ ID NO: 494951 - protein, 10 aa, Influenza virus
ECIESVRNGT

SEQ ID NO: 494952 - protein, 10 aa, Influenza virus
ECIGWSSTSC

SEQ ID NO: 494953 - protein, 10 aa, Influenza virus
ECITPNGSIP

SEQ ID NO: 494954 - protein, 10 aa, Influenza virus
ECITPNGSIS

SEQ ID NO: 494955 - protein, 10 aa, Influenza virus
ECKMYALHQG

SEQ ID NO: 494956 - protein, 10 aa, Influenza virus
ECKTFFLTQG

SEQ ID NO: 494957 - protein, 10 aa, Influenza virus
ECLINDPWVL

SEQ ID NO: 494958 - protein, 10 aa, Influenza virus
ECLVPCFWVE

SEQ ID NO: 494959 - protein, 10 aa, Influenza virus
ECMESVKNGT

SEQ ID NO: 494960 - protein, 10 aa, Influenza virus
ECMESVRNGT

SEQ ID NO: 494961 - protein, 10 aa, Influenza virus
ECMETIKNGT

SEQ ID NO: 494962 - protein, 10 aa, Influenza virus
ECMIKAVRGD

SEQ ID NO: 494963 - protein, 10 aa, Influenza virus
ECPKYIKSDQ

SEQ ID NO: 494964 - protein, 10 aa, Influenza virus
ECPKYVKQGS

SEQ ID NO: 494965 - protein, 10 aa, Influenza virus
ECPKYVKSDR

SEQ ID NO: 494966 - protein, 10 aa, Influenza virus
ECPKYVKSEK

SEQ ID NO: 494967 - protein, 10 aa, Influenza virus
ECPKYVKSER

SEQ ID NO: 494968 - protein, 10 aa, Influenza virus
ECPKYVKSKR

SEQ ID NO: 494969 - protein, 10 aa, Influenza virus
ECPKYVRSEK

SEQ ID NO: 494970 - protein, 10 aa, Influenza virus
ECQLNEGIMN

SEQ ID NO: 494971 - protein, 10 aa, Influenza virus
ECQLNEGVIN

SEQ ID NO: 494972 - protein, 10 aa, Influenza virus
ECQLNEGVMN

SEQ ID NO: 494973 - protein, 10 aa, Influenza virus
ECRFYALSQG

SEQ ID NO: 494974 - protein, 10 aa, Influenza virus
ECRIFALSQG

SEQ ID NO: 494975 - protein, 10 aa, Influenza virus
ECRMFALSQG

SEQ ID NO: 494976 - protein, 10 aa, Influenza virus
ECRTFFLTHG

SEQ ID NO: 494977 - protein, 10 aa, Influenza virus
ECRTFFLTQG

SEQ ID NO: 494978 - protein, 10 aa, Influenza virus
ECSCYGHDSK

SEQ ID NO: 494979 - protein, 10 aa, Influenza virus
ECSCYGHNQK

SEQ ID NO: 494980 - protein, 10 aa, Influenza virus
ECSCYGHNSK

SEQ ID NO: 494981 - protein, 10 aa, Influenza virus
ECSCYGHSQK

SEQ ID NO: 494982 - protein, 10 aa, Influenza virus
ECSCYMDIDV

SEQ ID NO: 494983 - protein, 10 aa, Influenza virus
ECSCYPDAGE

SEQ ID NO: 494984 - protein, 10 aa, Influenza virus
ECSCYPDAGK

SEQ ID NO: 494985 - protein, 10 aa, Influenza virus
ECSCYPDASE

SEQ ID NO: 494986 - protein, 10 aa, Influenza virus
ECSCYPDSGE

SEQ ID NO: 494987 - protein, 10 aa, Influenza virus
ECSCYPNAGE

SEQ ID NO: 494988 - protein, 10 aa, Influenza virus
ECSCYPNDGK

SEQ ID NO: 494989 - protein, 10 aa, Influenza virus
ECSCYPNEGK

SEQ ID NO: 494990 - protein, 10 aa, Influenza virus
ECSCYPNLGI

SEQ ID NO: 494991 - protein, 10 aa, Influenza virus
ECSCYPNLGK

SEQ ID NO: 494992 - protein, 10 aa, Influenza virus
ECSCYPNLGQ

SEQ ID NO: 494993 - protein, 10 aa, Influenza virus
ECSCYPNMGK

SEQ ID NO: 494994 - protein, 10 aa, Influenza virus
ECSCYPNSGK

SEQ ID NO: 494995 - protein, 10 aa, Influenza virus
ECSCYPQYPD

SEQ ID NO: 494996 - protein, 10 aa, Influenza virus
ECSCYPQYPN

SEQ ID NO: 494997 - protein, 10 aa, Influenza virus
ECSCYPRFPG

SEQ ID NO: 494998 - protein, 10 aa, Influenza virus
ECSCYPRYPD

SEQ ID NO: 494999 - protein, 10 aa, Influenza virus
ECSCYPRYPG

SEQ ID NO: 495000 - protein, 10 aa, Influenza virus
ECSCYPRYPN

SEQ ID NO: 495001 - protein, 10 aa, Influenza virus
ECSCYPRYSG

SEQ ID NO: 495002 - protein, 10 aa, Influenza virus
ECSCYPSGEN

SEQ ID NO: 495003 - protein, 10 aa, Influenza virus
ECSCYPSGES

SEQ ID NO: 495004 - protein, 10 aa, Influenza virus
ECSCYPSGTD

SEQ ID NO: 495005 - protein, 10 aa, Influenza virus
ECSCYPSREN

SEQ ID NO: 495006 - protein, 10 aa, Influenza virus
ECSCYVDIDI

SEQ ID NO: 495007 - protein, 10 aa, Influenza virus
ECSCYVDIDV

SEQ ID NO: 495008 - protein, 10 aa, Influenza virus
ECSCYVDTDV

SEQ ID NO: 495009 - protein, 10 aa, Influenza virus
ECSCYVDVDV

SEQ ID NO: 495010 - protein, 10 aa, Influenza virus
ECVCHDGTCV

SEQ ID NO: 495011 - protein, 10 aa, Influenza virus
ECVCHKGICP

SEQ ID NO: 495012 - protein, 10 aa, Influenza virus
ECVCHKGVCP

SEQ ID NO: 495013 - protein, 10 aa, Influenza virus
ECVCHNGICP

SEQ ID NO: 495014 - protein, 10 aa, Influenza virus
ECVCHNGTCA

SEQ ID NO: 495015 - protein, 10 aa, Influenza virus
ECVCHNGTCV

SEQ ID NO: 495016 - protein, 10 aa, Influenza virus
ECVCHNGVCP

SEQ ID NO: 495017 - protein, 10 aa, Influenza virus
ECVCHNSTCV

SEQ ID NO: 495018 - protein, 10 aa, Influenza virus
ECVCHSGICP

SEQ ID NO: 495019 - protein, 10 aa, Influenza virus
ECVCINGICT

SEQ ID NO: 495020 - protein, 10 aa, Influenza virus
ECVCINGSCA

SEQ ID NO: 495021 - protein, 10 aa, Influenza virus
ECVCINGSCI

SEQ ID NO: 495022 - protein, 10 aa, Influenza virus
ECVCINGSCT

SEQ ID NO: 495023 - protein, 10 aa, Influenza virus
ECVCINGTCA

SEQ ID NO: 495024 - protein, 10 aa, Influenza virus
ECVCINGTCT

SEQ ID NO: 495025 - protein, 10 aa, Influenza virus
ECVCISGTCA

SEQ ID NO: 495026 - protein, 10 aa, Influenza virus
ECVCQDEFCY

SEQ ID NO: 495027 - protein, 10 aa, Influenza virus
ECVCQNGVCP

SEQ ID NO: 495028 - protein, 10 aa, Influenza virus
ECVCRDNWNG

SEQ ID NO: 495029 - protein, 10 aa, Influenza virus
ECVCRDNWRG

SEQ ID NO: 495030 - protein, 10 aa, Influenza virus
ECVCRDNWTG

SEQ ID NO: 495031 - protein, 10 aa, Influenza virus
ECVGWSSTSC

SEQ ID NO: 495032 - protein, 10 aa, Influenza virus
ECVRHNGTCA

SEQ ID NO: 495033 - protein, 10 aa, Influenza virus
ECVSHNGTWA

SEQ ID NO: 495034 - protein, 10 aa, Influenza virus
ECYNPCFYVE

SEQ ID NO: 495035 - protein, 10 aa, Influenza virus
ECYRACFYVE

SEQ ID NO: 495036 - protein, 10 aa, Influenza virus
ECYWVMTDGP

SEQ ID NO: 495037 - protein, 10 aa, Influenza virus
EDCTGCFEIF

SEQ ID NO: 495038 - protein, 10 aa, Influenza virus
EDEQMYQKCC

SEQ ID NO: 495039 - protein, 10 aa, Influenza virus
EDEQMYQRCC

SEQ ID NO: 495040 - protein, 10 aa, Influenza virus
EDESRIERQK

SEQ ID NO: 495041 - protein, 10 aa, Influenza virus
EDEVWWTSNS

SEQ ID NO: 495042 - protein, 10 aa, Influenza virus
EDFQLIPMIS

SEQ ID NO: 495043 - protein, 10 aa, Influenza virus
EDGDIIFLWG

SEQ ID NO: 495044 - protein, 10 aa, Influenza virus
EDGFIDVWTY

SEQ ID NO: 495045 - protein, 10 aa, Influenza virus
EDGFLDVWTY

SEQ ID NO: 495046 - protein, 10 aa, Influenza virus
EDGFLGVWTY

SEQ ID NO: 495047 - protein, 10 aa, Influenza virus
EDGFRDVWTY

SEQ ID NO: 495048 - protein, 10 aa, Influenza virus
EDGKGCFDLY

SEQ ID NO: 495049 - protein, 10 aa, Influenza virus
EDGKGCFEIY

SEQ ID NO: 495050 - protein, 10 aa, Influenza virus
EDGKGCFELY

SEQ ID NO: 495051 - protein, 10 aa, Influenza virus
EDGKGCSELY

SEQ ID NO: 495052 - protein, 10 aa, Influenza virus
EDGNGCFEIF

SEQ ID NO: 495053 - protein, 10 aa, Influenza virus
EDGNGCFELY

SEQ ID NO: 495054 - protein, 10 aa, Influenza virus
EDGNIIFLWG

SEQ ID NO: 495055 - protein, 10 aa, Influenza virus
EDGRGCFEIY

SEQ ID NO: 495056 - protein, 10 aa, Influenza virus
EDGSIGKVCR

SEQ ID NO: 495057 - protein, 10 aa, Influenza virus
EDGTGCFEIF

SEQ ID NO: 495058 - protein, 10 aa, Influenza virus
EDGTGCFEIL

SEQ ID NO: 495059 - protein, 10 aa, Influenza virus
EDGTGCFELF

SEQ ID NO: 495060 - protein, 10 aa, Influenza virus
EDGVYKALSI

SEQ ID NO: 495061 - protein, 10 aa, Influenza virus
EDKGNGCFEI

SEQ ID NO: 495062 - protein, 10 aa, Influenza virus
EDKRYGPALS

SEQ ID NO: 495063 - protein, 10 aa, Influenza virus
EDKVWWTSNS

SEQ ID NO: 495064 - protein, 10 aa, Influenza virus
EDLIFLARSA

SEQ ID NO: 495065 - protein, 10 aa, Influenza virus
EDLIFMARSA

SEQ ID NO: 495066 - protein, 10 aa, Influenza virus
EDLIFSARSA

SEQ ID NO: 495067 - protein, 10 aa, Influenza virus
EDLIVFNTIG

SEQ ID NO: 495068 - protein, 10 aa, Influenza virus
EDLTFLARSA

SEQ ID NO: 495069 - protein, 10 aa, Influenza virus
EDLWAYNAEL

SEQ ID NO: 495070 - protein, 10 aa, Influenza virus
EDMGNGCFKI

SEQ ID NO: 495071 - protein, 10 aa, Influenza virus
EDMGNGCFRI

SEQ ID NO: 495072 - protein, 10 aa, Influenza virus
EDMGNGCFTI

SEQ ID NO: 495073 - protein, 10 aa, Influenza virus
EDMGNGCLKI

SEQ ID NO: 495074 - protein, 10 aa, Influenza virus
EDNIYKILSI

SEQ ID NO: 495075 - protein, 10 aa, Influenza virus
EDNVYKALSI

SEQ ID NO: 495076 - protein, 10 aa, Influenza virus
EDNVYKILSI

SEQ ID NO: 495077 - protein, 10 aa, Influenza virus
EDNVYKVLAI

SEQ ID NO: 495078 - protein, 10 aa, Influenza virus
EDNVYKVLSI

SEQ ID NO: 495079 - protein, 10 aa, Influenza virus
EDNVYRALSI

SEQ ID NO: 495080 - protein, 10 aa, Influenza virus
EDPAAPHGLC

SEQ ID NO: 495081 - protein, 10 aa, Influenza virus
EDPDHEGEGI

SEQ ID NO: 495082 - protein, 10 aa, Influenza virus
EDPGAPHGLC

SEQ ID NO: 495083 - protein, 10 aa, Influenza virus
EDPNAPHKLC

SEQ ID NO: 495084 - protein, 10 aa, Influenza virus
EDPNAPNKFC

SEQ ID NO: 495085 - protein, 10 aa, Influenza virus
EDPNAPNKLC

SEQ ID NO: 495086 - protein, 10 aa, Influenza virus
EDPNHEGEGI

SEQ ID NO: 495087 - protein, 10 aa, Influenza virus
EDPSAPHGLC

SEQ ID NO: 495088 - protein, 10 aa, Influenza virus
EDPSAPHRLC

SEQ ID NO: 495089 - protein, 10 aa, Influenza virus
EDPSHEGEGI

SEQ ID NO: 495090 - protein, 10 aa, Influenza virus
EDPTAPHGLC

SEQ ID NO: 495091 - protein, 10 aa, Influenza virus
EDQGNGCFEI

SEQ ID NO: 495092 - protein, 10 aa, Influenza virus
EDQITDIWAY

SEQ ID NO: 495093 - protein, 10 aa, Influenza virus
EDRGNGCFEI

SEQ ID NO: 495094 - protein, 10 aa, Influenza virus
EDRRYGPALS

SEQ ID NO: 495095 - protein, 10 aa, Influenza virus
EDRTPYRSLI

SEQ ID NO: 495096 - protein, 10 aa, Influenza virus
EDRVWWTSNS

SEQ ID NO: 495097 - protein, 10 aa, Influenza virus
EDSDILVTRE

SEQ ID NO: 495098 - protein, 10 aa, Influenza virus
EDSDVLVTRE

SEQ ID NO: 495099 - protein, 10 aa, Influenza virus
EDTHIHIFSF

SEQ ID NO: 495100 - protein, 10 aa, Influenza virus
EDTIEERFEI

SEQ ID NO: 495101 - protein, 10 aa, Influenza virus
EDTKIDLWSY

SEQ ID NO: 495102 - protein, 10 aa, Influenza virus
EDTKVDLWSY

SEQ ID NO: 495103 - protein, 10 aa, Influenza virus
EDVSWTSNSI

SEQ ID NO: 495104 - protein, 10 aa, Influenza virus
EDYKEESQLK

SEQ ID NO: 495105 - protein, 10 aa, Influenza virus
EDYREESQLK

SEQ ID NO: 495106 - protein, 10 aa, Influenza virus
EEAKLEKSRI

SEQ ID NO: 495107 - protein, 10 aa, Influenza virus
EEAKLERSKI

SEQ ID NO: 495108 - protein, 10 aa, Influenza virus
EEAKYVEWTS

SEQ ID NO: 495109 - protein, 10 aa, Influenza virus
EEAKYVWWAS

SEQ ID NO: 495110 - protein, 10 aa, Influenza virus
EEAKYVWWTS

SEQ ID NO: 495111 - protein, 10 aa, Influenza virus
EEALKGSARH

SEQ ID NO: 495112 - protein, 10 aa, Influenza virus
EEALLNRINI

SEQ ID NO: 495113 - protein, 10 aa, Influenza virus
EEALLNRLNI

SEQ ID NO: 495114 - protein, 10 aa, Influenza virus
EEALLNRLSI

SEQ ID NO: 495115 - protein, 10 aa, Influenza virus
EEALQGSARH

SEQ ID NO: 495116 - protein, 10 aa, Influenza virus
EEALRQIIRE

SEQ ID NO: 495117 - protein, 10 aa, Influenza virus
EEALRQKIME

SEQ ID NO: 495118 - protein, 10 aa, Influenza virus
EEAMQNRIQI

SEQ ID NO: 495119 - protein, 10 aa, Influenza virus
EECLINDPWV

SEQ ID NO: 495120 - protein, 10 aa, Influenza virus
EECSCYGHDS

SEQ ID NO: 495121 - protein, 10 aa, Influenza virus
EECSCYGHNQ

SEQ ID NO: 495122 - protein, 10 aa, Influenza virus
EECSCYGHNS

SEQ ID NO: 495123 - protein, 10 aa, Influenza virus
EECSCYGHSQ

SEQ ID NO: 495124 - protein, 10 aa, Influenza virus
EECSCYMDID

SEQ ID NO: 495125 - protein, 10 aa, Influenza virus
EECSCYPDAG

SEQ ID NO: 495126 - protein, 10 aa, Influenza virus
EECSCYPDAS

SEQ ID NO: 495127 - protein, 10 aa, Influenza virus
EECSCYPDSG

SEQ ID NO: 495128 - protein, 10 aa, Influenza virus
EECSCYPNAG

SEQ ID NO: 495129 - protein, 10 aa, Influenza virus
EECSCYPNDG

SEQ ID NO: 495130 - protein, 10 aa, Influenza virus
EECSCYPNEG

SEQ ID NO: 495131 - protein, 10 aa, Influenza virus
EECSCYPNLG

SEQ ID NO: 495132 - protein, 10 aa, Influenza virus
EECSCYPNMG

SEQ ID NO: 495133 - protein, 10 aa, Influenza virus
EECSCYPNSG

SEQ ID NO: 495134 - protein, 10 aa, Influenza virus
EECSCYPQYP

SEQ ID NO: 495135 - protein, 10 aa, Influenza virus
EECSCYPRFP

SEQ ID NO: 495136 - protein, 10 aa, Influenza virus
EECSCYPRSP

SEQ ID NO: 495137 - protein, 10 aa, Influenza virus
EECSCYPRYP

SEQ ID NO: 495138 - protein, 10 aa, Influenza virus
EECSCYPRYS

SEQ ID NO: 495139 - protein, 10 aa, Influenza virus
EECSCYPSGE

SEQ ID NO: 495140 - protein, 10 aa, Influenza virus
EECSCYPSGT

SEQ ID NO: 495141 - protein, 10 aa, Influenza virus
EECSCYVDID

SEQ ID NO: 495142 - protein, 10 aa, Influenza virus
EECSCYVDTD

SEQ ID NO: 495143 - protein, 10 aa, Influenza virus
EECSCYVDVD

SEQ ID NO: 495144 - protein, 10 aa, Influenza virus
EECYRACFYV

SEQ ID NO: 495145 - protein, 10 aa, Influenza virus
EEDCTGCFEI

SEQ ID NO: 495146 - protein, 10 aa, Influenza virus
EEDGKGCFEI

SEQ ID NO: 495147 - protein, 10 aa, Influenza virus
EEDGNGCFEI

SEQ ID NO: 495148 - protein, 10 aa, Influenza virus
EEDGRGCFEI

SEQ ID NO: 495149 - protein, 10 aa, Influenza virus
EEDGTGCFEI

SEQ ID NO: 495150 - protein, 10 aa, Influenza virus
EEDGTGCFEL

SEQ ID NO: 495151 - protein, 10 aa, Influenza virus
EEEAKLEKSR

SEQ ID NO: 495152 - protein, 10 aa, Influenza virus
EEEAKLERSK

SEQ ID NO: 495153 - protein, 10 aa, Influenza virus
EEELLTGNLQ

SEQ ID NO: 495154 - protein, 10 aa, Influenza virus
EEEMLTGNLQ

SEQ ID NO: 495155 - protein, 10 aa, Influenza virus
EEESDEALKM

SEQ ID NO: 495156 - protein, 10 aa, Influenza virus
EEESKIERQK

SEQ ID NO: 495157 - protein, 10 aa, Influenza virus
EEESKLERQK

SEQ ID NO: 495158 - protein, 10 aa, Influenza virus
EEESKLERQR

SEQ ID NO: 495159 - protein, 10 aa, Influenza virus
EEESKLKRNE

SEQ ID NO: 495160 - protein, 10 aa, Influenza virus
EEESKLKRQE

SEQ ID NO: 495161 - protein, 10 aa, Influenza virus
EEESKLNKNE

SEQ ID NO: 495162 - protein, 10 aa, Influenza virus
EEESKLNRNE

SEQ ID NO: 495163 - protein, 10 aa, Influenza virus
EEESKLNRSE

SEQ ID NO: 495164 - protein, 10 aa, Influenza virus
EEESKLNRTE

SEQ ID NO: 495165 - protein, 10 aa, Influenza virus
EEESRIERQK

SEQ ID NO: 495166 - protein, 10 aa, Influenza virus
EEESRLNRNE

SEQ ID NO: 495167 - protein, 10 aa, Influenza virus
EEEVLTGNLQ

SEQ ID NO: 495168 - protein, 10 aa, Influenza virus
EEGDIIFLWG

SEQ ID NO: 495169 - protein, 10 aa, Influenza virus
EEGSIGKVCR

SEQ ID NO: 495170 - protein, 10 aa, Influenza virus
EEGSVYPRFL

SEQ ID NO: 495171 - protein, 10 aa, Influenza virus
EEGTGIAADK

SEQ ID NO: 495172 - protein, 10 aa, Influenza virus
EEGTGIAADR

SEQ ID NO: 495173 - protein, 10 aa, Influenza virus
EEGTSIWTSS

SEQ ID NO: 495174 - protein, 10 aa, Influenza virus
EEHPNAGKDP

SEQ ID NO: 495175 - protein, 10 aa, Influenza virus
EEHPSAGKDP

SEQ ID NO: 495176 - protein, 10 aa, Influenza virus
EEHPSAGRDP

SEQ ID NO: 495177 - protein, 10 aa, Influenza virus
EEHPSTGKDP

SEQ ID NO: 495178 - protein, 10 aa, Influenza virus
EEISETQGTE

SEQ ID NO: 495179 - protein, 10 aa, Influenza virus
EEKTSIWTSS

SEQ ID NO: 495180 - protein, 10 aa, Influenza virus
EEKVWWTSNS

SEQ ID NO: 495181 - protein, 10 aa, Influenza virus
EELKEQLSTV

SEQ ID NO: 495182 - protein, 10 aa, Influenza virus
EELKHLLNRI

SEQ ID NO: 495183 - protein, 10 aa, Influenza virus
EELKHLLSRI

SEQ ID NO: 495184 - protein, 10 aa, Influenza virus
EELKHLLSRT

SEQ ID NO: 495185 - protein, 10 aa, Influenza virus
EELKHLLSST

SEQ ID NO: 495186 - protein, 10 aa, Influenza virus
EELKHLMSST

SEQ ID NO: 495187 - protein, 10 aa, Influenza virus
EELKSLFSSI

SEQ ID NO: 495188 - protein, 10 aa, Influenza virus
EELLTGNLQT

SEQ ID NO: 495189 - protein, 10 aa, Influenza virus
EELREHLSSV

SEQ ID NO: 495190 - protein, 10 aa, Influenza virus
EELREQLSSV

SEQ ID NO: 495191 - protein, 10 aa, Influenza virus
EELREQLSTV

SEQ ID NO: 495192 - protein, 10 aa, Influenza virus
EELRFLFSSI

SEQ ID NO: 495193 - protein, 10 aa, Influenza virus
EELRFVFSIA

SEQ ID NO: 495194 - protein, 10 aa, Influenza virus
EELRFVFSNA

SEQ ID NO: 495195 - protein, 10 aa, Influenza virus
EELRFVFSSA

SEQ ID NO: 495196 - protein, 10 aa, Influenza virus
EELRRQKSLI

SEQ ID NO: 495197 - protein, 10 aa, Influenza virus
EELRRQKWWV

SEQ ID NO: 495198 - protein, 10 aa, Influenza virus
EELRSLFSSI

SEQ ID NO: 495199 - protein, 10 aa, Influenza virus
EELVHGGIDP

SEQ ID NO: 495200 - protein, 10 aa, Influenza virus
EELVHGGINP

SEQ ID NO: 495201 - protein, 10 aa, Influenza virus
EELVHGGVDP

SEQ ID NO: 495202 - protein, 10 aa, Influenza virus
EELVHGQVNP

SEQ ID NO: 495203 - protein, 10 aa, Influenza virus
EELVHRGIDP

SEQ ID NO: 495204 - protein, 10 aa, Influenza virus
EELWAYNAEL

SEQ ID NO: 495205 - protein, 10 aa, Influenza virus
EEMGNGCFKI

SEQ ID NO: 495206 - protein, 10 aa, Influenza virus
EEMLTGNLQT

SEQ ID NO: 495207 - protein, 10 aa, Influenza virus
EENPSAGKDP

SEQ ID NO: 495208 - protein, 10 aa, Influenza virus
EENSTYKILS

SEQ ID NO: 495209 - protein, 10 aa, Influenza virus
EENTSYKILS

SEQ ID NO: 495210 - protein, 10 aa, Influenza virus
EENTTYKILS

SEQ ID NO: 495211 - protein, 10 aa, Influenza virus
EENTTYRILS

SEQ ID NO: 495212 - protein, 10 aa, Influenza virus
EEPLKGSAKH

SEQ ID NO: 495213 - protein, 10 aa, Influenza virus
EEQAVDICKA

SEQ ID NO: 495214 - protein, 10 aa, Influenza virus
EEQAVGICKA

SEQ ID NO: 495215 - protein, 10 aa, Influenza virus
EEQAVNICKA

SEQ ID NO: 495216 - protein, 10 aa, Influenza virus
EERGNPGVKG

SEQ ID NO: 495217 - protein, 10 aa, Influenza virus
EERGSPGVKG

SEQ ID NO: 495218 - protein, 10 aa, Influenza virus
EERNSIWTSS

SEQ ID NO: 495219 - protein, 10 aa, Influenza virus
EERTSIWTSS

SEQ ID NO: 495220 - protein, 10 aa, Influenza virus
EESDEALKMT

SEQ ID NO: 495221 - protein, 10 aa, Influenza virus
EESKLKRNEI

SEQ ID NO: 495222 - protein, 10 aa, Influenza virus
EESKLKRQEI

SEQ ID NO: 495223 - protein, 10 aa, Influenza virus
EESKLNRNEI

SEQ ID NO: 495224 - protein, 10 aa, Influenza virus
EESKLNRSEI

SEQ ID NO: 495225 - protein, 10 aa, Influenza virus
EESKLNRTEI

SEQ ID NO: 495226 - protein, 10 aa, Influenza virus
EESLLNRLSI

SEQ ID NO: 495227 - protein, 10 aa, Influenza virus
EESQLKKQEI

SEQ ID NO: 495228 - protein, 10 aa, Influenza virus
EESQLKRQEI

SEQ ID NO: 495229 - protein, 10 aa, Influenza virus
EESRARIKTR

SEQ ID NO: 495230 - protein, 10 aa, Influenza virus
EESRLNRNEI

SEQ ID NO: 495231 - protein, 10 aa, Influenza virus
EESSIGKVCR

SEQ ID NO: 495232 - protein, 10 aa, Influenza virus
EETHIHIFSF

SEQ ID NO: 495233 - protein, 10 aa, Influenza virus
EETIEEKFEI

SEQ ID NO: 495234 - protein, 10 aa, Influenza virus
EETIEERFEI

SEQ ID NO: 495235 - protein, 10 aa, Influenza virus
EETLKGSARH

SEQ ID NO: 495236 - protein, 10 aa, Influenza virus
EETVEERFEI

SEQ ID NO: 495237 - protein, 10 aa, Influenza virus
EETYKILTIY

SEQ ID NO: 495238 - protein, 10 aa, Influenza virus
EEVKYVWWTS

SEQ ID NO: 495239 - protein, 10 aa, Influenza virus
EEVLKGSARH

SEQ ID NO: 495240 - protein, 10 aa, Influenza virus
EEVLTGNLQA

SEQ ID NO: 495241 - protein, 10 aa, Influenza virus
EEVLTGNLQT

SEQ ID NO: 495242 - protein, 10 aa, Influenza virus
EEVSEAQGTE

SEQ ID NO: 495243 - protein, 10 aa, Influenza virus
EEVSETQGIE

SEQ ID NO: 495244 - protein, 10 aa, Influenza virus
EEVSETQGME

SEQ ID NO: 495245 - protein, 10 aa, Influenza virus
EEVSETQGTE

SEQ ID NO: 495246 - protein, 10 aa, Influenza virus
EEVTNATETV

SEQ ID NO: 495247 - protein, 10 aa, Influenza virus
EEYGKGRIFQ

SEQ ID NO: 495248 - protein, 10 aa, Influenza virus
EEYGRGRIFQ

SEQ ID NO: 495249 - protein, 10 aa, Influenza virus
EEYVEDTKID

SEQ ID NO: 495250 - protein, 10 aa, Influenza virus
EFCGTSGTYG

SEQ ID NO: 495251 - protein, 10 aa, Influenza virus
EFCYTLITDG

SEQ ID NO: 495252 - protein, 10 aa, Influenza virus
EFCYTLMTDG

SEQ ID NO: 495253 - protein, 10 aa, Influenza virus
EFCYTLVTDG

SEQ ID NO: 495254 - protein, 10 aa, Influenza virus
EFDEIGEDVA

SEQ ID NO: 495255 - protein, 10 aa, Influenza virus
EFEPFQSLIP

SEQ ID NO: 495256 - protein, 10 aa, Influenza virus
EFEPFQSLVP

SEQ ID NO: 495257 - protein, 10 aa, Influenza virus
EFEQVEGRIQ

SEQ ID NO: 495258 - protein, 10 aa, Influenza virus
EFEQVEGRTQ

SEQ ID NO: 495259 - protein, 10 aa, Influenza virus
EFESIESEFN

SEQ ID NO: 495260 - protein, 10 aa, Influenza virus
EFESIESEFS

SEQ ID NO: 495261 - protein, 10 aa, Influenza virus
EFEVMNHEFS

SEQ ID NO: 495262 - protein, 10 aa, Influenza virus
EFEVVDHEFS

SEQ ID NO: 495263 - protein, 10 aa, Influenza virus
EFEVVNHEFS

SEQ ID NO: 495264 - protein, 10 aa, Influenza virus
EFFNNTEPLC

SEQ ID NO: 495265 - protein, 10 aa, Influenza virus
EFGNLERRLE

SEQ ID NO: 495266 - protein, 10 aa, Influenza virus
EFGQVEGRIQ

SEQ ID NO: 495267 - protein, 10 aa, Influenza virus
EFGVVNHEFS

SEQ ID NO: 495268 - protein, 10 aa, Influenza virus
EFGYLLKGES

SEQ ID NO: 495269 - protein, 10 aa, Influenza virus
EFGYLLRGES

SEQ ID NO: 495270 - protein, 10 aa, Influenza virus
EFIAEQFTWN

SEQ ID NO: 495271 - protein, 10 aa, Influenza virus
EFICVGWSST

SEQ ID NO: 495272 - protein, 10 aa, Influenza virus
EFKADLIIER

SEQ ID NO: 495273 - protein, 10 aa, Influenza virus
EFKMNPNKKI

SEQ ID NO: 495274 - protein, 10 aa, Influenza virus
EFKMNPNQKI

SEQ ID NO: 495275 - protein, 10 aa, Influenza virus
EFLCVGWSST

SEQ ID NO: 495276 - protein, 10 aa, Influenza virus
EFLGQWDWPD

SEQ ID NO: 495277 - protein, 10 aa, Influenza virus
EFLGQWNWPD

SEQ ID NO: 495278 - protein, 10 aa, Influenza virus
EFLNNTEPLC

SEQ ID NO: 495279 - protein, 10 aa, Influenza virus
EFLVALENQH

SEQ ID NO: 495280 - protein, 10 aa, Influenza virus
EFLVAMENQH

SEQ ID NO: 495281 - protein, 10 aa, Influenza virus
EFLVAVENQH

SEQ ID NO: 495282 - protein, 10 aa, Influenza virus
EFNEIEHQIG

SEQ ID NO: 495283 - protein, 10 aa, Influenza virus
EFNEIEQQIG

SEQ ID NO: 495284 - protein, 10 aa, Influenza virus
EFNEIEYQIG

SEQ ID NO: 495285 - protein, 10 aa, Influenza virus
EFNEVEQQIG

SEQ ID NO: 495286 - protein, 10 aa, Influenza virus
EFNKACELTD

SEQ ID NO: 495287 - protein, 10 aa, Influenza virus
EFNNLEKRLE

SEQ ID NO: 495288 - protein, 10 aa, Influenza virus
EFNNLERRLE

SEQ ID NO: 495289 - protein, 10 aa, Influenza virus
EFNQVEKRIN

SEQ ID NO: 495290 - protein, 10 aa, Influenza virus
EFNQVENRIN

SEQ ID NO: 495291 - protein, 10 aa, Influenza virus
EFNQVEQRIN

SEQ ID NO: 495292 - protein, 10 aa, Influenza virus
EFPSTGNHGS

SEQ ID NO: 495293 - protein, 10 aa, Influenza virus
EFQLIPMISK

SEQ ID NO: 495294 - protein, 10 aa, Influenza virus
EFSEIEGRIQ

SEQ ID NO: 495295 - protein, 10 aa, Influenza virus
EFSEIEHQIG

SEQ ID NO: 495296 - protein, 10 aa, Influenza virus
EFSEIEHQIS

SEQ ID NO: 495297 - protein, 10 aa, Influenza virus
EFSEIEQQIG

SEQ ID NO: 495298 - protein, 10 aa, Influenza virus
EFSETEHQIG

SEQ ID NO: 495299 - protein, 10 aa, Influenza virus
EFSEVEGRIQ

SEQ ID NO: 495300 - protein, 10 aa, Influenza virus
EFSEVEIRIN

SEQ ID NO: 495301 - protein, 10 aa, Influenza virus
EFSEVESRIN

SEQ ID NO: 495302 - protein, 10 aa, Influenza virus
EFSEVETRIN

SEQ ID NO: 495303 - protein, 10 aa, Influenza virus
EFSEVGSRIN

SEQ ID NO: 495304 - protein, 10 aa, Influenza virus
EFSKVETRIN

SEQ ID NO: 495305 - protein, 10 aa, Influenza virus
EFSLTDPKLE

SEQ ID NO: 495306 - protein, 10 aa, Influenza virus
EFSLTDPRFE

SEQ ID NO: 495307 - protein, 10 aa, Influenza virus
EFSLTDPRLE

SEQ ID NO: 495308 - protein, 10 aa, Influenza virus
EFSLVDPRLE

SEQ ID NO: 495309 - protein, 10 aa, Influenza virus
EFSNLEKRLE

SEQ ID NO: 495310 - protein, 10 aa, Influenza virus
EFSNLERRLE

SEQ ID NO: 495311 - protein, 10 aa, Influenza virus
EFSQVEQRIN

SEQ ID NO: 495312 - protein, 10 aa, Influenza virus
EFSQVERRIN

SEQ ID NO: 495313 - protein, 10 aa, Influenza virus
EFTEVEGRIQ

SEQ ID NO: 495314 - protein, 10 aa, Influenza virus
EFTEVEKQIG

SEQ ID NO: 495315 - protein, 10 aa, Influenza virus
EFTEVEQQIG

SEQ ID NO: 495316 - protein, 10 aa, Influenza virus
EFTSFFYRYG

SEQ ID NO: 495317 - protein, 10 aa, Influenza virus
EFVRQCFNPM

SEQ ID NO: 495318 - protein, 10 aa, Influenza virus
EFWHKCDDEC

SEQ ID NO: 495319 - protein, 10 aa, Influenza virus
EFWHKCDNDC

SEQ ID NO: 495320 - protein, 10 aa, Influenza virus
EFWHKCDNEC

SEQ ID NO: 495321 - protein, 10 aa, Influenza virus
EFWHKCNNEC

SEQ ID NO: 495322 - protein, 10 aa, Influenza virus
EFYHKCDDEC

SEQ ID NO: 495323 - protein, 10 aa, Influenza virus
EFYHKCDNEC

SEQ ID NO: 495324 - protein, 10 aa, Influenza virus
EFYHKCNDEC

SEQ ID NO: 495325 - protein, 10 aa, Influenza virus
EGALRQKIME

SEQ ID NO: 495326 - protein, 10 aa, Influenza virus
EGAYKILTIY

SEQ ID NO: 495327 - protein, 10 aa, Influenza virus
EGDCYRACFY

SEQ ID NO: 495328 - protein, 10 aa, Influenza virus
EGDGCFNFFH

SEQ ID NO: 495329 - protein, 10 aa, Influenza virus
EGDGCFNLLH

SEQ ID NO: 495330 - protein, 10 aa, Influenza virus
EGDGCFSILH

SEQ ID NO: 495331 - protein, 10 aa, Influenza virus
EGDGCFSLLH

SEQ ID NO: 495332 - protein, 10 aa, Influenza virus
EGDIIFLWGI

SEQ ID NO: 495333 - protein, 10 aa, Influenza virus
EGECFYSGGT

SEQ ID NO: 495334 - protein, 10 aa, Influenza virus
EGECYRACFY

SEQ ID NO: 495335 - protein, 10 aa, Influenza virus
EGEGIPLHDA

SEQ ID NO: 495336 - protein, 10 aa, Influenza virus
EGEGIPLYDA

SEQ ID NO: 495337 - protein, 10 aa, Influenza virus
EGEQIIVTRE

SEQ ID NO: 495338 - protein, 10 aa, Influenza virus
EGFAPFSKDN

SEQ ID NO: 495339 - protein, 10 aa, Influenza virus
EGFEEFTMVG

SEQ ID NO: 495340 - protein, 10 aa, Influenza virus
EGFSAESRKL

SEQ ID NO: 495341 - protein, 10 aa, Influenza virus
EGFSAESRKM

SEQ ID NO: 495342 - protein, 10 aa, Influenza virus
EGGWCGMIDG

SEQ ID NO: 495343 - protein, 10 aa, Influenza virus
EGGWPGLING

SEQ ID NO: 495344 - protein, 10 aa, Influenza virus
EGGWPGLVAG

SEQ ID NO: 495345 - protein, 10 aa, Influenza virus
EGGWQGLVDG

SEQ ID NO: 495346 - protein, 10 aa, Influenza virus
EGGWQGMIDG

SEQ ID NO: 495347 - protein, 10 aa, Influenza virus
EGGWQGMVDG

SEQ ID NO: 495348 - protein, 10 aa, Influenza virus
EGGWSGLIAG

SEQ ID NO: 495349 - protein, 10 aa, Influenza virus
EGGWSGLVAG

SEQ ID NO: 495350 - protein, 10 aa, Influenza virus
EGGWSGMIDG

SEQ ID NO: 495351 - protein, 10 aa, Influenza virus
EGGWTGLIDG

SEQ ID NO: 495352 - protein, 10 aa, Influenza virus
EGGWTGMIDG

SEQ ID NO: 495353 - protein, 10 aa, Influenza virus
EGGWTGMVDG

SEQ ID NO: 495354 - protein, 10 aa, Influenza virus
EGGWTGMVNG

SEQ ID NO: 495355 - protein, 10 aa, Influenza virus
EGHIEECSCY

SEQ ID NO: 495356 - protein, 10 aa, Influenza virus
EGIAADYKST

SEQ ID NO: 495357 - protein, 10 aa, Influenza virus
EGICYPGSIE

SEQ ID NO: 495358 - protein, 10 aa, Influenza virus
EGICYPGSVE

SEQ ID NO: 495359 - protein, 10 aa, Influenza virus
EGIGIAADRD

SEQ ID NO: 495360 - protein, 10 aa, Influenza virus
EGIGQAADLK

SEQ ID NO: 495361 - protein, 10 aa, Influenza virus
EGIILGNPKC

SEQ ID NO: 495362 - protein, 10 aa, Influenza virus
EGIKLKSEDN

SEQ ID NO: 495363 - protein, 10 aa, Influenza virus
EGIKLKTEDN

SEQ ID NO: 495364 - protein, 10 aa, Influenza virus
EGIMNTSKPF

SEQ ID NO: 495365 - protein, 10 aa, Influenza virus
EGIPLHDAIK

SEQ ID NO: 495366 - protein, 10 aa, Influenza virus
EGIPLYDAIK

SEQ ID NO: 495367 - protein, 10 aa, Influenza virus
EGIPLYDAVK

SEQ ID NO: 495368 - protein, 10 aa, Influenza virus
EGIPLYDAVR

SEQ ID NO: 495369 - protein, 10 aa, Influenza virus
EGIYKILTIY

SEQ ID NO: 495370 - protein, 10 aa, Influenza virus
EGKHIVERIL

SEQ ID NO: 495371 - protein, 10 aa, Influenza virus
EGKIAHISPL

SEQ ID NO: 495372 - protein, 10 aa, Influenza virus
EGKIIHISPL

SEQ ID NO: 495373 - protein, 10 aa, Influenza virus
EGKISHISPL

SEQ ID NO: 495374 - protein, 10 aa, Influenza virus
EGKIVHIGPL

SEQ ID NO: 495375 - protein, 10 aa, Influenza virus
EGKIVHISPL

SEQ ID NO: 495376 - protein, 10 aa, Influenza virus
EGKIVHVSPL

SEQ ID NO: 495377 - protein, 10 aa, Influenza virus
EGKVECICRD

SEQ ID NO: 495378 - protein, 10 aa, Influenza virus
EGKVECVCRD

SEQ ID NO: 495379 - protein, 10 aa, Influenza virus
EGKVVHISPL

SEQ ID NO: 495380 - protein, 10 aa, Influenza virus
EGLIDGWYGF

SEQ ID NO: 495381 - protein, 10 aa, Influenza virus
EGLIDGWYGY

SEQ ID NO: 495382 - protein, 10 aa, Influenza virus
EGLILGNPKC

SEQ ID NO: 495383 - protein, 10 aa, Influenza virus
EGLILSNPKC

SEQ ID NO: 495384 - protein, 10 aa, Influenza virus
EGLINGWYGF

SEQ ID NO: 495385 - protein, 10 aa, Influenza virus
EGLIYGNPSC

SEQ ID NO: 495386 - protein, 10 aa, Influenza virus
EGLPQSGRIV

SEQ ID NO: 495387 - protein, 10 aa, Influenza virus
EGLVDGWYGF

SEQ ID NO: 495388 - protein, 10 aa, Influenza virus
EGLVLGNPKC

SEQ ID NO: 495389 - protein, 10 aa, Influenza virus
EGLVYGNPAC

SEQ ID NO: 495390 - protein, 10 aa, Influenza virus
EGLVYGNPSC

SEQ ID NO: 495391 - protein, 10 aa, Influenza virus
EGLWAYNAEL

SEQ ID NO: 495392 - protein, 10 aa, Influenza virus
EGMCYPGFVE

SEQ ID NO: 495393 - protein, 10 aa, Influenza virus
EGMCYPGSIE

SEQ ID NO: 495394 - protein, 10 aa, Influenza virus
EGMCYPGSVE

SEQ ID NO: 495395 - protein, 10 aa, Influenza virus
EGMGQAADLK

SEQ ID NO: 495396 - protein, 10 aa, Influenza virus
EGMIDGWYGF

SEQ ID NO: 495397 - protein, 10 aa, Influenza virus
EGMMDGWYGF

SEQ ID NO: 495398 - protein, 10 aa, Influenza virus
EGMVDGWYGF

SEQ ID NO: 495399 - protein, 10 aa, Influenza virus
EGMVNGWYGF

SEQ ID NO: 495400 - protein, 10 aa, Influenza virus
EGNGCFELLH

SEQ ID NO: 495401 - protein, 10 aa, Influenza virus
EGNGCFTFYH

SEQ ID NO: 495402 - protein, 10 aa, Influenza virus
EGNILRTQES

SEQ ID NO: 495403 - protein, 10 aa, Influenza virus
EGQRSWMKIY

SEQ ID NO: 495404 - protein, 10 aa, Influenza virus
EGRGQAADLK

SEQ ID NO: 495405 - protein, 10 aa, Influenza virus
EGRIQDLEKY

SEQ ID NO: 495406 - protein, 10 aa, Influenza virus
EGRIQDLERY

SEQ ID NO: 495407 - protein, 10 aa, Influenza virus
EGRLIQNSIT

SEQ ID NO: 495408 - protein, 10 aa, Influenza virus
EGRLIQNSLT

SEQ ID NO: 495409 - protein, 10 aa, Influenza virus
EGRLIQNSMT

SEQ ID NO: 495410 - protein, 10 aa, Influenza virus
EGRNPGNAEI

SEQ ID NO: 495411 - protein, 10 aa, Influenza virus
EGRRKTNLYG

SEQ ID NO: 495412 - protein, 10 aa, Influenza virus
EGRRRTNLYG

SEQ ID NO: 495413 - protein, 10 aa, Influenza virus
EGRTSDMRAE

SEQ ID NO: 495414 - protein, 10 aa, Influenza virus
EGRTSDMRTE

SEQ ID NO: 495415 - protein, 10 aa, Influenza virus
EGRWPGLVAG

SEQ ID NO: 495416 - protein, 10 aa, Influenza virus
EGSIGKVCRA

SEQ ID NO: 495417 - protein, 10 aa, Influenza virus
EGSIGKVCRT

SEQ ID NO: 495418 - protein, 10 aa, Influenza virus
EGSYFFGDNA

SEQ ID NO: 495419 - protein, 10 aa, Influenza virus
EGTAADYKST

SEQ ID NO: 495420 - protein, 10 aa, Influenza virus
EGTGIAADKE

SEQ ID NO: 495421 - protein, 10 aa, Influenza virus
EGTGIAADRD

SEQ ID NO: 495422 - protein, 10 aa, Influenza virus
EGTGIAADRE

SEQ ID NO: 495423 - protein, 10 aa, Influenza virus
EGTGIAADRG

SEQ ID NO: 495424 - protein, 10 aa, Influenza virus
EGTGIVADRD

SEQ ID NO: 495425 - protein, 10 aa, Influenza virus
EGTGMAADQK

SEQ ID NO: 495426 - protein, 10 aa, Influenza virus
EGTGMAADRD

SEQ ID NO: 495427 - protein, 10 aa, Influenza virus
EGTGQAADLK

SEQ ID NO: 495428 - protein, 10 aa, Influenza virus
EGTGTAADLK

SEQ ID NO: 495429 - protein, 10 aa, Influenza virus
EGTSIWTSSS

SEQ ID NO: 495430 - protein, 10 aa, Influenza virus
EGTTASCQNR

SEQ ID NO: 495431 - protein, 10 aa, Influenza virus
EGTYKILTIY

SEQ ID NO: 495432 - protein, 10 aa, Influenza virus
EGVCYPGSIE

SEQ ID NO: 495433 - protein, 10 aa, Influenza virus
EGVCYPGSIK

SEQ ID NO: 495434 - protein, 10 aa, Influenza virus
EGVINTSKPF

SEQ ID NO: 495435 - protein, 10 aa, Influenza virus
EGVMNTSKPF

SEQ ID NO: 495436 - protein, 10 aa, Influenza virus
EGVMNTSKPL

SEQ ID NO: 495437 - protein, 10 aa, Influenza virus
EGWIDSPNHA

SEQ ID NO: 495438 - protein, 10 aa, Influenza virus
EGWIGGNPAC

SEQ ID NO: 495439 - protein, 10 aa, Influenza virus
EGWILGNPKC

SEQ ID NO: 495440 - protein, 10 aa, Influenza virus
EGWILGNPQC

SEQ ID NO: 495441 - protein, 10 aa, Influenza virus
EGWILGNPRC

SEQ ID NO: 495442 - protein, 10 aa, Influenza virus
EGWINSPNHA

SEQ ID NO: 495443 - protein, 10 aa, Influenza virus
EGWINSPNHV

SEQ ID NO: 495444 - protein, 10 aa, Influenza virus
EGWINSPSQA

SEQ ID NO: 495445 - protein, 10 aa, Influenza virus
EGWIVGNPAC

SEQ ID NO: 495446 - protein, 10 aa, Influenza virus
EGWIVGNPSC

SEQ ID NO: 495447 - protein, 10 aa, Influenza virus
EGWVVIAKDN

SEQ ID NO: 495448 - protein, 10 aa, Influenza virus
EGWVVIAQDN

SEQ ID NO: 495449 - protein, 10 aa, Influenza virus
EGWVVIEKDN

SEQ ID NO: 495450 - protein, 10 aa, Influenza virus
EGWVVVAKDN

SEQ ID NO: 495451 - protein, 10 aa, Influenza virus
EGYEEFTIVG

SEQ ID NO: 495452 - protein, 10 aa, Influenza virus
EGYEEFTLVG

SEQ ID NO: 495453 - protein, 10 aa, Influenza virus
EGYEEFTMIG

SEQ ID NO: 495454 - protein, 10 aa, Influenza virus
EGYEEFTMVG

SEQ ID NO: 495455 - protein, 10 aa, Influenza virus
EGYSLVGIDP

SEQ ID NO: 495456 - protein, 10 aa, Influenza virus
EGYSLVGVDP

SEQ ID NO: 495457 - protein, 10 aa, Influenza virus
EHDANVRNLH

SEQ ID NO: 495458 - protein, 10 aa, Influenza virus
EHDSNVENLF

SEQ ID NO: 495459 - protein, 10 aa, Influenza virus
EHDSNVKNLF

SEQ ID NO: 495460 - protein, 10 aa, Influenza virus
EHEEVTNATE

SEQ ID NO: 495461 - protein, 10 aa, Influenza virus
EHLIIWGIHH

SEQ ID NO: 495462 - protein, 10 aa, Influenza virus
EHLIMWGIHH

SEQ ID NO: 495463 - protein, 10 aa, Influenza virus
EHLITWGIHH

SEQ ID NO: 495464 - protein, 10 aa, Influenza virus
EHLIVWGIHH

SEQ ID NO: 495465 - protein, 10 aa, Influenza virus
EHLSSVSSFE

SEQ ID NO: 495466 - protein, 10 aa, Influenza virus
EHLVMWGIHH

SEQ ID NO: 495467 - protein, 10 aa, Influenza virus
EHPNAGKDPK

SEQ ID NO: 495468 - protein, 10 aa, Influenza virus
EHPSAGKDPK

SEQ ID NO: 495469 - protein, 10 aa, Influenza virus
EHPSAGRDPK

SEQ ID NO: 495470 - protein, 10 aa, Influenza virus
EHPSTGKDPK

SEQ ID NO: 495471 - protein, 10 aa, Influenza virus
EHQIGNVINW

SEQ ID NO: 495472 - protein, 10 aa, Influenza virus
EHSNGTIHDR

SEQ ID NO: 495473 - protein, 10 aa, Influenza virus
EHSNGTTHDR

SEQ ID NO: 495474 - protein, 10 aa, Influenza virus
EHTAYSQITN

SEQ ID NO: 495475 - protein, 10 aa, Influenza virus
EHTSKYVCTG

SEQ ID NO: 495476 - protein, 10 aa, Influenza virus
EHTSQYICTG

SEQ ID NO: 495477 - protein, 10 aa, Influenza virus
EHTSQYLCTG

SEQ ID NO: 495478 - protein, 10 aa, Influenza virus
EHTSRYICTG

SEQ ID NO: 495479 - protein, 10 aa, Influenza virus
EHTSRYVCTG

SEQ ID NO: 495480 - protein, 10 aa, Influenza virus
EIAQKLEDVF

SEQ ID NO: 495481 - protein, 10 aa, Influenza virus
EIAQRLEDVF

SEQ ID NO: 495482 - protein, 10 aa, Influenza virus
EIAQRLEGVF

SEQ ID NO: 495483 - protein, 10 aa, Influenza virus
EIAQRLENVF

SEQ ID NO: 495484 - protein, 10 aa, Influenza virus
EIAQRLESVF

SEQ ID NO: 495485 - protein, 10 aa, Influenza virus
EIASWAGNIL

SEQ ID NO: 495486 - protein, 10 aa, Influenza virus
EICFMYSDFH

SEQ ID NO: 495487 - protein, 10 aa, Influenza virus
EICIAWSSSS

SEQ ID NO: 495488 - protein, 10 aa, Influenza virus
EICIGYLSNN

SEQ ID NO: 495489 - protein, 10 aa, Influenza virus
EICIGYMSNN

SEQ ID NO: 495490 - protein, 10 aa, Influenza virus
EICVAWSSSS

SEQ ID NO: 495491 - protein, 10 aa, Influenza virus
EICVAWSSTS

SEQ ID NO: 495492 - protein, 10 aa, Influenza virus
EIDRSFRPNI

SEQ ID NO: 495493 - protein, 10 aa, Influenza virus
EIEDLIFLAR

SEQ ID NO: 495494 - protein, 10 aa, Influenza virus
EIEDLIFLTR

SEQ ID NO: 495495 - protein, 10 aa, Influenza virus
EIEDLIFMAR

SEQ ID NO: 495496 - protein, 10 aa, Influenza virus
EIEDLIFSAR

SEQ ID NO: 495497 - protein, 10 aa, Influenza virus
EIEDLTFLAR

SEQ ID NO: 495498 - protein, 10 aa, Influenza virus
EIEGICYPGS

SEQ ID NO: 495499 - protein, 10 aa, Influenza virus
EIEGIKLKSE

SEQ ID NO: 495500 - protein, 10 aa, Influenza virus
EIEGIKLKTE

SEQ ID NO: 495501 - protein, 10 aa, Influenza virus
EIEGRIQDLE

SEQ ID NO: 495502 - protein, 10 aa, Influenza virus
EIEHQIGNVI

SEQ ID NO: 495503 - protein, 10 aa, Influenza virus
EIEHQISNVI

SEQ ID NO: 495504 - protein, 10 aa, Influenza virus
EIEKQIGNVI

SEQ ID NO: 495505 - protein, 10 aa, Influenza virus
EIEQQIGNVI

SEQ ID NO: 495506 - protein, 10 aa, Influenza virus
EIEYQIGNVI

SEQ ID NO: 495507 - protein, 10 aa, Influenza virus
EIFHKCDDDC

SEQ ID NO: 495508 - protein, 10 aa, Influenza virus
EIFHKCDDHC

SEQ ID NO: 495509 - protein, 10 aa, Influenza virus
EIFHKCDDQC

SEQ ID NO: 495510 - protein, 10 aa, Influenza virus
EIFHKCDDRC

SEQ ID NO: 495511 - protein, 10 aa, Influenza virus
EIFHKCDNQC

SEQ ID NO: 495512 - protein, 10 aa, Influenza virus
EIFHQCDNDC

SEQ ID NO: 495513 - protein, 10 aa, Influenza virus
EIFHQCDNNC

SEQ ID NO: 495514 - protein, 10 aa, Influenza virus
EIFHRCDDQC

SEQ ID NO: 495515 - protein, 10 aa, Influenza virus
EIGAPQLNPI

SEQ ID NO: 495516 - protein, 10 aa, Influenza virus
EIGARIGEGQ

SEQ ID NO: 495517 - protein, 10 aa, Influenza virus
EIGEDIAPIE

SEQ ID NO: 495518 - protein, 10 aa, Influenza virus
EIGEDLAPIE

SEQ ID NO: 495519 - protein, 10 aa, Influenza virus
EIGEDVAPIE

SEQ ID NO: 495520 - protein, 10 aa, Influenza virus
EIGNGCFEFY

SEQ ID NO: 495521 - protein, 10 aa, Influenza virus
EIGTRIGDGQ

SEQ ID NO: 495522 - protein, 10 aa, Influenza virus
EIGVTRREIH

SEQ ID NO: 495523 - protein, 10 aa, Influenza virus
EIGVTRREVH

SEQ ID NO: 495524 - protein, 10 aa, Influenza virus
EIIIRMMENA

SEQ ID NO: 495525 - protein, 10 aa, Influenza virus
EIILWFSFGA

SEQ ID NO: 495526 - protein, 10 aa, Influenza virus
EIITIGSICM

SEQ ID NO: 495527 - protein, 10 aa, Influenza virus
EIKGVELSSM

SEQ ID NO: 495528 - protein, 10 aa, Influenza virus
EIKGVKLSNM

SEQ ID NO: 495529 - protein, 10 aa, Influenza virus
EIKGVKLSSM

SEQ ID NO: 495530 - protein, 10 aa, Influenza virus
EIKMNPNQKI

SEQ ID NO: 495531 - protein, 10 aa, Influenza virus
EILKVPNALT

SEQ ID NO: 495532 - protein, 10 aa, Influenza virus
EILNNKNWSG

SEQ ID NO: 495533 - protein, 10 aa, Influenza virus
EILRTQESEC

SEQ ID NO: 495534 - protein, 10 aa, Influenza virus
EILTKITVDH

SEQ ID NO: 495535 - protein, 10 aa, Influenza virus
EILTKTTVDH

SEQ ID NO: 495536 - protein, 10 aa, Influenza virus
EILTRTTVDH

SEQ ID NO: 495537 - protein, 10 aa, Influenza virus
EIMASQGTKR

SEQ ID NO: 495538 - protein, 10 aa, Influenza virus
EIMRIWRQAN

SEQ ID NO: 495539 - protein, 10 aa, Influenza virus
EINGPDSVLV

SEQ ID NO: 495540 - protein, 10 aa, Influenza virus
EINGPESVLI

SEQ ID NO: 495541 - protein, 10 aa, Influenza virus
EINGPESVLV

SEQ ID NO: 495542 - protein, 10 aa, Influenza virus
EINRIFRPNI

SEQ ID NO: 495543 - protein, 10 aa, Influenza virus
EINRNFKPNI

SEQ ID NO: 495544 - protein, 10 aa, Influenza virus
EINRSFKPNI

SEQ ID NO: 495545 - protein, 10 aa, Influenza virus
EINRSFRPNI

SEQ ID NO: 495546 - protein, 10 aa, Influenza virus
EINTWARNIL

SEQ ID NO: 495547 - protein, 10 aa, Influenza virus
EIPSWAGNIL

SEQ ID NO: 495548 - protein, 10 aa, Influenza virus
EIPSWAGNVL

SEQ ID NO: 495549 - protein, 10 aa, Influenza virus
EIPSWEGNIL

SEQ ID NO: 495550 - protein, 10 aa, Influenza virus
EIRAFSFQLI

SEQ ID NO: 495551 - protein, 10 aa, Influenza virus
EIRASVGKMI

SEQ ID NO: 495552 - protein, 10 aa, Influenza virus
EIRASVGRMI

SEQ ID NO: 495553 - protein, 10 aa, Influenza virus
EIRASVGRMV

SEQ ID NO: 495554 - protein, 10 aa, Influenza virus
EIRIAWSSSS

SEQ ID NO: 495555 - protein, 10 aa, Influenza virus
EIRRIWRQAN

SEQ ID NO: 495556 - protein, 10 aa, Influenza virus
EIRRVWRQAN

SEQ ID NO: 495557 - protein, 10 aa, Influenza virus
EIRSSVGKMI

SEQ ID NO: 495558 - protein, 10 aa, Influenza virus
EIRTFSFQFI

SEQ ID NO: 495559 - protein, 10 aa, Influenza virus
EIRTFSFQLI

SEQ ID NO: 495560 - protein, 10 aa, Influenza virus
EIRTSVGRMV

SEQ ID NO: 495561 - protein, 10 aa, Influenza virus
EISFQGGHIE

SEQ ID NO: 495562 - protein, 10 aa, Influenza virus
EISFQSGHIE

SEQ ID NO: 495563 - protein, 10 aa, Influenza virus
EISFTITGDN

SEQ ID NO: 495564 - protein, 10 aa, Influenza virus
EISHCRATEY

SEQ ID NO: 495565 - protein, 10 aa, Influenza virus
EITFHGAKEI

SEQ ID NO: 495566 - protein, 10 aa, Influenza virus
EITFHGAKEV

SEQ ID NO: 495567 - protein, 10 aa, Influenza virus
EITFHGSKEV

SEQ ID NO: 495568 - protein, 10 aa, Influenza virus
EITFHRAKEV

SEQ ID NO: 495569 - protein, 10 aa, Influenza virus
EITGIDKVCT

SEQ ID NO: 495570 - protein, 10 aa, Influenza virus
EITGINKVCT

SEQ ID NO: 495571 - protein, 10 aa, Influenza virus
EITTKINNII

SEQ ID NO: 495572 - protein, 10 aa, Influenza virus
EIVDNKNWSG

SEQ ID NO: 495573 - protein, 10 aa, Influenza virus
EIVDNNNWSG

SEQ ID NO: 495574 - protein, 10 aa, Influenza virus
EIVDNSNWSG

SEQ ID NO: 495575 - protein, 10 aa, Influenza virus
EIVGNDNWSG

SEQ ID NO: 495576 - protein, 10 aa, Influenza virus
EIVSNDNWSG

SEQ ID NO: 495577 - protein, 10 aa, Influenza virus
EIWSYNAEFL

SEQ ID NO: 495578 - protein, 10 aa, Influenza virus
EIWSYNAELL

SEQ ID NO: 495579 - protein, 10 aa, Influenza virus
EKAHNGKLCR

SEQ ID NO: 495580 - protein, 10 aa, Influenza virus
EKAIWTSGSS

SEQ ID NO: 495581 - protein, 10 aa, Influenza virus
EKANVLIGQG

SEQ ID NO: 495582 - protein, 10 aa, Influenza virus
EKDLTKEFFE

SEQ ID NO: 495583 - protein, 10 aa, Influenza virus
EKDMTKDFFE

SEQ ID NO: 495584 - protein, 10 aa, Influenza virus
EKDMTKEFFE

SEQ ID NO: 495585 - protein, 10 aa, Influenza virus
EKDMTKEFFV

SEQ ID NO: 495586 - protein, 10 aa, Influenza virus
EKDMTREFFE

SEQ ID NO: 495587 - protein, 10 aa, Influenza virus
EKDNAVRFGE

SEQ ID NO: 495588 - protein, 10 aa, Influenza virus
EKEEVINATE

SEQ ID NO: 495589 - protein, 10 aa, Influenza virus
EKEEVTNATE

SEQ ID NO: 495590 - protein, 10 aa, Influenza virus
EKEFEQVEGR

SEQ ID NO: 495591 - protein, 10 aa, Influenza virus
EKEFGQVEGR

SEQ ID NO: 495592 - protein, 10 aa, Influenza virus
EKEFSEIEGR

SEQ ID NO: 495593 - protein, 10 aa, Influenza virus
EKEFSEVEGR

SEQ ID NO: 495594 - protein, 10 aa, Influenza virus
EKEFTEVEGR

SEQ ID NO: 495595 - protein, 10 aa, Influenza virus
EKEGYSLVGI

SEQ ID NO: 495596 - protein, 10 aa, Influenza virus
EKEGYSLVGV

SEQ ID NO: 495597 - protein, 10 aa, Influenza virus
EKEKEICSVV

SEQ ID NO: 495598 - protein, 10 aa, Influenza virus
EKEKVTNATE

SEQ ID NO: 495599 - protein, 10 aa, Influenza virus
EKENSYPKIN

SEQ ID NO: 495600 - protein, 10 aa, Influenza virus
EKENSYPMIN

SEQ ID NO: 495601 - protein, 10 aa, Influenza virus
EKESTQKAID

SEQ ID NO: 495602 - protein, 10 aa, Influenza virus
EKFFPSSSYR

SEQ ID NO: 495603 - protein, 10 aa, Influenza virus
EKFHQIEKEF

SEQ ID NO: 495604 - protein, 10 aa, Influenza virus
EKGAKQEENL

SEQ ID NO: 495605 - protein, 10 aa, Influenza virus
EKGIEVVNAT

SEQ ID NO: 495606 - protein, 10 aa, Influenza virus
EKGKVVKSVE

SEQ ID NO: 495607 - protein, 10 aa, Influenza virus
EKGNPGVKGW

SEQ ID NO: 495608 - protein, 10 aa, Influenza virus
EKGNQGVKGW

SEQ ID NO: 495609 - protein, 10 aa, Influenza virus
EKGPKQEENL

SEQ ID NO: 495610 - protein, 10 aa, Influenza virus
EKGPKQEENS

SEQ ID NO: 495611 - protein, 10 aa, Influenza virus
EKGTKQEENL

SEQ ID NO: 495612 - protein, 10 aa, Influenza virus
EKGVEVVNAT

SEQ ID NO: 495613 - protein, 10 aa, Influenza virus
EKHLAYCNTD

SEQ ID NO: 495614 - protein, 10 aa, Influenza virus
EKHPAYCNTD

SEQ ID NO: 495615 - protein, 10 aa, Influenza virus
EKHSAYCNTD

SEQ ID NO: 495616 - protein, 10 aa, Influenza virus
EKIEKIRPLL

SEQ ID NO: 495617 - protein, 10 aa, Influenza virus
EKIHTRGLFG

SEQ ID NO: 495618 - protein, 10 aa, Influenza virus
EKIRNGTYDH

SEQ ID NO: 495619 - protein, 10 aa, Influenza virus
EKIRTRGLFG

SEQ ID NO: 495620 - protein, 10 aa, Influenza virus
EKIRVKRRPV

SEQ ID NO: 495621 - protein, 10 aa, Influenza virus
EKITNKVNNI

SEQ ID NO: 495622 - protein, 10 aa, Influenza virus
EKIVTVTHAQ

SEQ ID NO: 495623 - protein, 10 aa, Influenza virus
EKKAKLANVV

SEQ ID NO: 495624 - protein, 10 aa, Influenza virus
EKKINMINDK

SEQ ID NO: 495625 - protein, 10 aa, Influenza virus
EKLEQSGLPV

SEQ ID NO: 495626 - protein, 10 aa, Influenza virus
EKLTIIYSSS

SEQ ID NO: 495627 - protein, 10 aa, Influenza virus
EKLTITYSSP

SEQ ID NO: 495628 - protein, 10 aa, Influenza virus
EKLTITYSSS

SEQ ID NO: 495629 - protein, 10 aa, Influenza virus
EKLVLATGLR

SEQ ID NO: 495630 - protein, 10 aa, Influenza virus
EKLVLATGPR

SEQ ID NO: 495631 - protein, 10 aa, Influenza virus
EKMNGNYDSI

SEQ ID NO: 495632 - protein, 10 aa, Influenza virus
EKMNIQFTAV

SEQ ID NO: 495633 - protein, 10 aa, Influenza virus
EKMNIQFTSV

SEQ ID NO: 495634 - protein, 10 aa, Influenza virus
EKMNTQFTAV

SEQ ID NO: 495635 - protein, 10 aa, Influenza virus
EKMNTQFTSV

SEQ ID NO: 495636 - protein, 10 aa, Influenza virus
EKMVLSAFDE

SEQ ID NO: 495637 - protein, 10 aa, Influenza virus
EKNALGDCPK

SEQ ID NO: 495638 - protein, 10 aa, Influenza virus
EKNALYGTQS

SEQ ID NO: 495639 - protein, 10 aa, Influenza virus
EKNATASFIY

SEQ ID NO: 495640 - protein, 10 aa, Influenza virus
EKNDLYGTQP

SEQ ID NO: 495641 - protein, 10 aa, Influenza virus
EKNDLYGTQS

SEQ ID NO: 495642 - protein, 10 aa, Influenza virus
EKNELYGTQS

SEQ ID NO: 495643 - protein, 10 aa, Influenza virus
EKNITEIVYL

SEQ ID NO: 495644 - protein, 10 aa, Influenza virus
EKNITKIVYL

SEQ ID NO: 495645 - protein, 10 aa, Influenza virus
EKNITVTHAQ

SEQ ID NO: 495646 - protein, 10 aa, Influenza virus
EKNITVTHSV

SEQ ID NO: 495647 - protein, 10 aa, Influenza virus
EKNPALRMKW

SEQ ID NO: 495648 - protein, 10 aa, Influenza virus
EKNPAYCNTD

SEQ ID NO: 495649 - protein, 10 aa, Influenza virus
EKNPSLRMKW

SEQ ID NO: 495650 - protein, 10 aa, Influenza virus
EKNVTVTHAK

SEQ ID NO: 495651 - protein, 10 aa, Influenza virus
EKNVTVTHAQ

SEQ ID NO: 495652 - protein, 10 aa, Influenza virus
EKNVTVTHAR

SEQ ID NO: 495653 - protein, 10 aa, Influenza virus
EKNVTVTHSI

SEQ ID NO: 495654 - protein, 10 aa, Influenza virus
EKNVTVTHSV

SEQ ID NO: 495655 - protein, 10 aa, Influenza virus
EKNVTVTHTQ

SEQ ID NO: 495656 - protein, 10 aa, Influenza virus
EKQIGNLINW

SEQ ID NO: 495657 - protein, 10 aa, Influenza virus
EKQIGNVINW

SEQ ID NO: 495658 - protein, 10 aa, Influenza virus
EKQLGNVINW

SEQ ID NO: 495659 - protein, 10 aa, Influenza virus
EKQTRGIFGA

SEQ ID NO: 495660 - protein, 10 aa, Influenza virus
EKQTRGLFGA

SEQ ID NO: 495661 - protein, 10 aa, Influenza virus
EKRGLFGAIA

SEQ ID NO: 495662 - protein, 10 aa, Influenza virus
EKRIENLNKK

SEQ ID NO: 495663 - protein, 10 aa, Influenza virus
EKRINMIADR

SEQ ID NO: 495664 - protein, 10 aa, Influenza virus
EKRINMINDK

SEQ ID NO: 495665 - protein, 10 aa, Influenza virus
EKRINMISDK

SEQ ID NO: 495666 - protein, 10 aa, Influenza virus
EKRINMLADR

SEQ ID NO: 495667 - protein, 10 aa, Influenza virus
EKRINMLADW

SEQ ID NO: 495668 - protein, 10 aa, Influenza virus
EKRINVINDK

SEQ ID NO: 495669 - protein, 10 aa, Influenza virus
EKRLENLNKK

SEQ ID NO: 495670 - protein, 10 aa, Influenza virus
EKRLGNLNKK

SEQ ID NO: 495671 - protein, 10 aa, Influenza virus
EKRRKKRGLF

SEQ ID NO: 495672 - protein, 10 aa, Influenza virus
EKRTNMINDK

SEQ ID NO: 495673 - protein, 10 aa, Influenza virus
EKSDVLVTRE

SEQ ID NO: 495674 - protein, 10 aa, Influenza virus
EKSRINGVKL

SEQ ID NO: 495675 - protein, 10 aa, Influenza virus
EKTHIHIFSF

SEQ ID NO: 495676 - protein, 10 aa, Influenza virus
EKTHNGKLCK

SEQ ID NO: 495677 - protein, 10 aa, Influenza virus
EKTHNGKLCR

SEQ ID NO: 495678 - protein, 10 aa, Influenza virus
EKTIWTSGSS

SEQ ID NO: 495679 - protein, 10 aa, Influenza virus
EKTLDLHDSN

SEQ ID NO: 495680 - protein, 10 aa, Influenza virus
EKTNDKYHQI

SEQ ID NO: 495681 - protein, 10 aa, Influenza virus
EKTNEKFHQI

SEQ ID NO: 495682 - protein, 10 aa, Influenza virus
EKTNEKYHQI

SEQ ID NO: 495683 - protein, 10 aa, Influenza virus
EKTNKQFELI

SEQ ID NO: 495684 - protein, 10 aa, Influenza virus
EKTNQQFELI

SEQ ID NO: 495685 - protein, 10 aa, Influenza virus
EKTNQQFKLI

SEQ ID NO: 495686 - protein, 10 aa, Influenza virus
EKTNTEFESI

SEQ ID NO: 495687 - protein, 10 aa, Influenza virus
EKTNTQFELI

SEQ ID NO: 495688 - protein, 10 aa, Influenza virus
EKTSIWTSSS

SEQ ID NO: 495689 - protein, 10 aa, Influenza virus
EKVDTIIESN

SEQ ID NO: 495690 - protein, 10 aa, Influenza virus
EKVNTIIESN

SEQ ID NO: 495691 - protein, 10 aa, Influenza virus
EKVRLQLRDN

SEQ ID NO: 495692 - protein, 10 aa, Influenza virus
EKVRMQLRDN

SEQ ID NO: 495693 - protein, 10 aa, Influenza virus
EKVRNGTYDH

SEQ ID NO: 495694 - protein, 10 aa, Influenza virus
EKVRRQLREN

SEQ ID NO: 495695 - protein, 10 aa, Influenza virus
EKVTNATETV

SEQ ID NO: 495696 - protein, 10 aa, Influenza virus
EKVWWTSNSI

SEQ ID NO: 495697 - protein, 10 aa, Influenza virus
EKYGSGRIFQ

SEQ ID NO: 495698 - protein, 10 aa, Influenza virus
EKYGTGRIFQ

SEQ ID NO: 495699 - protein, 10 aa, Influenza virus
EKYHQIEKEF

SEQ ID NO: 495700 - protein, 10 aa, Influenza virus
EKYVEDTKID

SEQ ID NO: 495701 - protein, 10 aa, Influenza virus
EKYVEDTKVD

SEQ ID NO: 495702 - protein, 10 aa, Influenza virus
ELAEKAMKEH

SEQ ID NO: 495703 - protein, 10 aa, Influenza virus
ELAEKAMKEY

SEQ ID NO: 495704 - protein, 10 aa, Influenza virus
ELAEKTMKEY

SEQ ID NO: 495705 - protein, 10 aa, Influenza virus
ELAERAMKEY

SEQ ID NO: 495706 - protein, 10 aa, Influenza virus
ELCPSPLKLV

SEQ ID NO: 495707 - protein, 10 aa, Influenza virus
ELCTINSWHI

SEQ ID NO: 495708 - protein, 10 aa, Influenza virus
ELDEIGEDIA

SEQ ID NO: 495709 - protein, 10 aa, Influenza virus
ELDEIGEDLA

SEQ ID NO: 495710 - protein, 10 aa, Influenza virus
ELDEIGEDVA

SEQ ID NO: 495711 - protein, 10 aa, Influenza virus
ELDNNGELRH

SEQ ID NO: 495712 - protein, 10 aa, Influenza virus
ELEIGARIGE

SEQ ID NO: 495713 - protein, 10 aa, Influenza virus
ELEIGTRIGD

SEQ ID NO: 495714 - protein, 10 aa, Influenza virus
ELEIGTRIGE

SEQ ID NO: 495715 - protein, 10 aa, Influenza virus
ELFHKCDDDC

SEQ ID NO: 495716 - protein, 10 aa, Influenza virus
ELFVLMENER

SEQ ID NO: 495717 - protein, 10 aa, Influenza virus
ELGAPLVLDD

SEQ ID NO: 495718 - protein, 10 aa, Influenza virus
ELGDAPFLDR

SEQ ID NO: 495719 - protein, 10 aa, Influenza virus
ELGDCSIAGW

SEQ ID NO: 495720 - protein, 10 aa, Influenza virus
ELGIPFHLGT

SEQ ID NO: 495721 - protein, 10 aa, Influenza virus
ELGNCSIAGW

SEQ ID NO: 495722 - protein, 10 aa, Influenza virus
ELGNGCFEFY

SEQ ID NO: 495723 - protein, 10 aa, Influenza virus
ELGSPLVLDD

SEQ ID NO: 495724 - protein, 10 aa, Influenza virus
ELGVPFHLAT

SEQ ID NO: 495725 - protein, 10 aa, Influenza virus
ELGVPFHLGT

SEQ ID NO: 495726 - protein, 10 aa, Influenza virus
ELGVPFYLGT

SEQ ID NO: 495727 - protein, 10 aa, Influenza virus
ELGVSFHLGT

SEQ ID NO: 495728 - protein, 10 aa, Influenza virus
ELIDNEFTEV

SEQ ID NO: 495729 - protein, 10 aa, Influenza virus
ELIGKTSWSY

SEQ ID NO: 495730 - protein, 10 aa, Influenza virus
ELIRGMPKES

SEQ ID NO: 495731 - protein, 10 aa, Influenza virus
ELIRGRPEEA

SEQ ID NO: 495732 - protein, 10 aa, Influenza virus
ELIRGRPEEV

SEQ ID NO: 495733 - protein, 10 aa, Influenza virus
ELIRGRPKED

SEQ ID NO: 495734 - protein, 10 aa, Influenza virus
ELIRGRPKEE

SEQ ID NO: 495735 - protein, 10 aa, Influenza virus
ELIRGRPKEN

SEQ ID NO: 495736 - protein, 10 aa, Influenza virus
ELIRGRPKES

SEQ ID NO: 495737 - protein, 10 aa, Influenza virus
ELIRGRPRES

SEQ ID NO: 495738 - protein, 10 aa, Influenza virus
ELIRMIKRGI

SEQ ID NO: 495739 - protein, 10 aa, Influenza virus
ELIRMIKRGV

SEQ ID NO: 495740 - protein, 10 aa, Influenza virus
ELIRMVKRGI

SEQ ID NO: 495741 - protein, 10 aa, Influenza virus
ELIVLLENQK

SEQ ID NO: 495742 - protein, 10 aa, Influenza virus
ELKEQLSTVS

SEQ ID NO: 495743 - protein, 10 aa, Influenza virus
ELKSLFSSIK

SEQ ID NO: 495744 - protein, 10 aa, Influenza virus
ELKWLISKSK

SEQ ID NO: 495745 - protein, 10 aa, Influenza virus
ELKWLVSKDK

SEQ ID NO: 495746 - protein, 10 aa, Influenza virus
ELKWLVSKNK

SEQ ID NO: 495747 - protein, 10 aa, Influenza virus
ELKWLVSKSK

SEQ ID NO: 495748 - protein, 10 aa, Influenza virus
ELKWLVSKTK

SEQ ID NO: 495749 - protein, 10 aa, Influenza virus
ELLHKCNDSC

SEQ ID NO: 495750 - protein, 10 aa, Influenza virus
ELLHKCNNSC

SEQ ID NO: 495751 - protein, 10 aa, Influenza virus
ELLHKCNNTC

SEQ ID NO: 495752 - protein, 10 aa, Influenza virus
ELLIAMENQH

SEQ ID NO: 495753 - protein, 10 aa, Influenza virus
ELLILLENER

SEQ ID NO: 495754 - protein, 10 aa, Influenza virus
ELLTGNLQTL

SEQ ID NO: 495755 - protein, 10 aa, Influenza virus
ELLVALENQH

SEQ ID NO: 495756 - protein, 10 aa, Influenza virus
ELLVALENQN

SEQ ID NO: 495757 - protein, 10 aa, Influenza virus
ELLVAMENQH

SEQ ID NO: 495758 - protein, 10 aa, Influenza virus
ELLVLIENER

SEQ ID NO: 495759 - protein, 10 aa, Influenza virus
ELLVLIENQK

SEQ ID NO: 495760 - protein, 10 aa, Influenza virus
ELLVLLEDER

SEQ ID NO: 495761 - protein, 10 aa, Influenza virus
ELLVLLENER

SEQ ID NO: 495762 - protein, 10 aa, Influenza virus
ELLVLLENGR

SEQ ID NO: 495763 - protein, 10 aa, Influenza virus
ELLVLLENQK

SEQ ID NO: 495764 - protein, 10 aa, Influenza virus
ELLVLLGNQK

SEQ ID NO: 495765 - protein, 10 aa, Influenza virus
ELLVLMENEM

SEQ ID NO: 495766 - protein, 10 aa, Influenza virus
ELLVLMENER

SEQ ID NO: 495767 - protein, 10 aa, Influenza virus
ELLVLMVNER

SEQ ID NO: 495768 - protein, 10 aa, Influenza virus
ELNNNGELRH

SEQ ID NO: 495769 - protein, 10 aa, Influenza virus
ELPFQNLSPR

SEQ ID NO: 495770 - protein, 10 aa, Influenza virus
ELPSFGVSGI

SEQ ID NO: 495771 - protein, 10 aa, Influenza virus
ELPSFGVSGV

SEQ ID NO: 495772 - protein, 10 aa, Influenza virus
ELRDCKIEAV

SEQ ID NO: 495773 - protein, 10 aa, Influenza virus
ELRDCKVEAV

SEQ ID NO: 495774 - protein, 10 aa, Influenza virus
ELRDCSIAGW

SEQ ID NO: 495775 - protein, 10 aa, Influenza virus
ELREHLSSVS

SEQ ID NO: 495776 - protein, 10 aa, Influenza virus
ELREQLSSVS

SEQ ID NO: 495777 - protein, 10 aa, Influenza virus
ELREQLSTVS

SEQ ID NO: 495778 - protein, 10 aa, Influenza virus
ELRFLFSSIK

SEQ ID NO: 495779 - protein, 10 aa, Influenza virus
ELRFVFSIAA

SEQ ID NO: 495780 - protein, 10 aa, Influenza virus
ELRFVFSNAA

SEQ ID NO: 495781 - protein, 10 aa, Influenza virus
ELRFVFSSAA

SEQ ID NO: 495782 - protein, 10 aa, Influenza virus
ELRHLFSGIK

SEQ ID NO: 495783 - protein, 10 aa, Influenza virus
ELRHLFSGIR

SEQ ID NO: 495784 - protein, 10 aa, Influenza virus
ELRHLFSGVN

SEQ ID NO: 495785 - protein, 10 aa, Influenza virus
ELRRCLLQSL

SEQ ID NO: 495786 - protein, 10 aa, Influenza virus
ELRRIWRQAN

SEQ ID NO: 495787 - protein, 10 aa, Influenza virus
ELRRQKSLIW

SEQ ID NO: 495788 - protein, 10 aa, Influenza virus
ELRRQKWWVW

SEQ ID NO: 495789 - protein, 10 aa, Influenza virus
ELRSGYWAIR

SEQ ID NO: 495790 - protein, 10 aa, Influenza virus
ELRSKYWAIR

SEQ ID NO: 495791 - protein, 10 aa, Influenza virus
ELRSLFSSIK

SEQ ID NO: 495792 - protein, 10 aa, Influenza virus
ELRSRYWAIR

SEQ ID NO: 495793 - protein, 10 aa, Influenza virus
ELSFTITGDN

SEQ ID NO: 495794 - protein, 10 aa, Influenza virus
ELSFTVTGDN

SEQ ID NO: 495795 - protein, 10 aa, Influenza virus
ELSSGYKDVI

SEQ ID NO: 495796 - protein, 10 aa, Influenza virus
ELSSMGVYQI

SEQ ID NO: 495797 - protein, 10 aa, Influenza virus
ELVETNHTDE

SEQ ID NO: 495798 - protein, 10 aa, Influenza virus
ELVRGRPKES

SEQ ID NO: 495799 - protein, 10 aa, Influenza virus
ELVRKTRFLP

SEQ ID NO: 495800 - protein, 10 aa, Influenza virus
ELVRMIKRGI

SEQ ID NO: 495801 - protein, 10 aa, Influenza virus
ELWAYNAELL

SEQ ID NO: 495802 - protein, 10 aa, Influenza virus
ELWSYNAELL

SEQ ID NO: 495803 - protein, 10 aa, Influenza virus
ELYGTQSLSI

SEQ ID NO: 495804 - protein, 10 aa, Influenza virus
EMCAAWSSSS

SEQ ID NO: 495805 - protein, 10 aa, Influenza virus
EMCHGTQIGG

SEQ ID NO: 495806 - protein, 10 aa, Influenza virus
EMCHSTQIGG

SEQ ID NO: 495807 - protein, 10 aa, Influenza virus
EMCHSTRIGG

SEQ ID NO: 495808 - protein, 10 aa, Influenza virus
EMDKLFERVR

SEQ ID NO: 495809 - protein, 10 aa, Influenza virus
EMEGICYPGS

SEQ ID NO: 495810 - protein, 10 aa, Influenza virus
EMEGVCYPGS

SEQ ID NO: 495811 - protein, 10 aa, Influenza virus
EMGHAPSPYN

SEQ ID NO: 495812 - protein, 10 aa, Influenza virus
EMGLAPSPYN

SEQ ID NO: 495813 - protein, 10 aa, Influenza virus
EMGNGCFEFY

SEQ ID NO: 495814 - protein, 10 aa, Influenza virus
EMGQAPSPYN

SEQ ID NO: 495815 - protein, 10 aa, Influenza virus
EMGQAPSPYT

SEQ ID NO: 495816 - protein, 10 aa, Influenza virus
EMIRGKPEEG

SEQ ID NO: 495817 - protein, 10 aa, Influenza virus
EMIRGKPEER

SEQ ID NO: 495818 - protein, 10 aa, Influenza virus
EMIRGKPKER

SEQ ID NO: 495819 - protein, 10 aa, Influenza virus
EMIRGQPKEK

SEQ ID NO: 495820 - protein, 10 aa, Influenza virus
EMIRGQPKER

SEQ ID NO: 495821 - protein, 10 aa, Influenza virus
EMIRGRPEER

SEQ ID NO: 495822 - protein, 10 aa, Influenza virus
EMIWDANGWV

SEQ ID NO: 495823 - protein, 10 aa, Influenza virus
EMIWDPDGWT

SEQ ID NO: 495824 - protein, 10 aa, Influenza virus
EMIWDPNGWT

SEQ ID NO: 495825 - protein, 10 aa, Influenza virus
EMKKLYERVR

SEQ ID NO: 495826 - protein, 10 aa, Influenza virus
EMKWLLSNAD

SEQ ID NO: 495827 - protein, 10 aa, Influenza virus
EMKWLLSNND

SEQ ID NO: 495828 - protein, 10 aa, Influenza virus
EMKWLLSNSD

SEQ ID NO: 495829 - protein, 10 aa, Influenza virus
EMKWLLSNTD

SEQ ID NO: 495830 - protein, 10 aa, Influenza virus
EMKWLLSSKA

SEQ ID NO: 495831 - protein, 10 aa, Influenza virus
EMKWLLSSKD

SEQ ID NO: 495832 - protein, 10 aa, Influenza virus
EMKWLLSSSD

SEQ ID NO: 495833 - protein, 10 aa, Influenza virus
EMKWLLSSTD

SEQ ID NO: 495834 - protein, 10 aa, Influenza virus
EMKWLSSSGN

SEQ ID NO: 495835 - protein, 10 aa, Influenza virus
EMKWLSSSMN

SEQ ID NO: 495836 - protein, 10 aa, Influenza virus
EMLKIHNAGT

SEQ ID NO: 495837 - protein, 10 aa, Influenza virus
EMLKIPNAET

SEQ ID NO: 495838 - protein, 10 aa, Influenza virus
EMLKIPNAGI

SEQ ID NO: 495839 - protein, 10 aa, Influenza virus
EMLKIPNAGT

SEQ ID NO: 495840 - protein, 10 aa, Influenza virus
EMLKVPNAGT

SEQ ID NO: 495841 - protein, 10 aa, Influenza virus
EMLKVPNALT

SEQ ID NO: 495842 - protein, 10 aa, Influenza virus
EMLNLYDRVR

SEQ ID NO: 495843 - protein, 10 aa, Influenza virus
EMLNLYEGVR

SEQ ID NO: 495844 - protein, 10 aa, Influenza virus
EMLNLYERVR

SEQ ID NO: 495845 - protein, 10 aa, Influenza virus
EMLRIPNAGI

SEQ ID NO: 495846 - protein, 10 aa, Influenza virus
EMLTGNLQTL

SEQ ID NO: 495847 - protein, 10 aa, Influenza virus
EMNKLFERVK

SEQ ID NO: 495848 - protein, 10 aa, Influenza virus
EMNKLFERVR

SEQ ID NO: 495849 - protein, 10 aa, Influenza virus
EMNKLYEKVR

SEQ ID NO: 495850 - protein, 10 aa, Influenza virus
EMNKLYERVK

SEQ ID NO: 495851 - protein, 10 aa, Influenza virus
EMNKLYERVR

SEQ ID NO: 495852 - protein, 10 aa, Influenza virus
EMNRLFERVR

SEQ ID NO: 495853 - protein, 10 aa, Influenza virus
EMRRCLLQSL

SEQ ID NO: 495854 - protein, 10 aa, Influenza virus
EMRTFSFQLI

SEQ ID NO: 495855 - protein, 10 aa, Influenza virus
EMSFQGRGVF

SEQ ID NO: 495856 - protein, 10 aa, Influenza virus
EMSKLFERVR

SEQ ID NO: 495857 - protein, 10 aa, Influenza virus
EMSKLYERVK

SEQ ID NO: 495858 - protein, 10 aa, Influenza virus
EMSKLYERVR

SEQ ID NO: 495859 - protein, 10 aa, Influenza virus
EMTFHGAKEV

SEQ ID NO: 495860 - protein, 10 aa, Influenza virus
EMTLDFHDSN

SEQ ID NO: 495861 - protein, 10 aa, Influenza virus
EMVWDANGWV

SEQ ID NO: 495862 - protein, 10 aa, Influenza virus
EMVWDPNGWT

SEQ ID NO: 495863 - protein, 10 aa, Influenza virus
EMWSYNAELL

SEQ ID NO: 495864 - protein, 10 aa, Influenza virus
ENAEDIGNGC

SEQ ID NO: 495865 - protein, 10 aa, Influenza virus
ENAEDKGNGC

SEQ ID NO: 495866 - protein, 10 aa, Influenza virus
ENAEDMGDGC

SEQ ID NO: 495867 - protein, 10 aa, Influenza virus
ENAEDMGGGC

SEQ ID NO: 495868 - protein, 10 aa, Influenza virus
ENAEDMGNGC

SEQ ID NO: 495869 - protein, 10 aa, Influenza virus
ENAEDQGNGC

SEQ ID NO: 495870 - protein, 10 aa, Influenza virus
ENAEDRGNGC

SEQ ID NO: 495871 - protein, 10 aa, Influenza virus
ENAEEDCTGC

SEQ ID NO: 495872 - protein, 10 aa, Influenza virus
ENAEEDGNGC

SEQ ID NO: 495873 - protein, 10 aa, Influenza virus
ENAEEDGTGC

SEQ ID NO: 495874 - protein, 10 aa, Influenza virus
ENAEEMGNGC

SEQ ID NO: 495875 - protein, 10 aa, Influenza virus
ENAIDAGDGC

SEQ ID NO: 495876 - protein, 10 aa, Influenza virus
ENAIDNGDGC

SEQ ID NO: 495877 - protein, 10 aa, Influenza virus
ENAIDTGDGC

SEQ ID NO: 495878 - protein, 10 aa, Influenza virus
ENALDTGDGC

SEQ ID NO: 495879 - protein, 10 aa, Influenza virus
ENATATVYYN

SEQ ID NO: 495880 - protein, 10 aa, Influenza virus
ENAVDTGDGC

SEQ ID NO: 495881 - protein, 10 aa, Influenza virus
ENDKTLDLHD

SEQ ID NO: 495882 - protein, 10 aa, Influenza virus
ENDKTLDMHD

SEQ ID NO: 495883 - protein, 10 aa, Influenza virus
ENDKTLNMHD

SEQ ID NO: 495884 - protein, 10 aa, Influenza virus
ENDRTLDLHD

SEQ ID NO: 495885 - protein, 10 aa, Influenza virus
ENDVWMGRTI

SEQ ID NO: 495886 - protein, 10 aa, Influenza virus
ENEKTLDLHD

SEQ ID NO: 495887 - protein, 10 aa, Influenza virus
ENEMTLDFHD

SEQ ID NO: 495888 - protein, 10 aa, Influenza virus
ENERILDFHD

SEQ ID NO: 495889 - protein, 10 aa, Influenza virus
ENERTLDFHD

SEQ ID NO: 495890 - protein, 10 aa, Influenza virus
ENERTLDLHD

SEQ ID NO: 495891 - protein, 10 aa, Influenza virus
ENERTLDMHD

SEQ ID NO: 495892 - protein, 10 aa, Influenza virus
ENERTLDQHD

SEQ ID NO: 495893 - protein, 10 aa, Influenza virus
ENERTLDYHD

SEQ ID NO: 495894 - protein, 10 aa, Influenza virus
ENERTLEFHD

SEQ ID NO: 495895 - protein, 10 aa, Influenza virus
ENERTLYFHD

SEQ ID NO: 495896 - protein, 10 aa, Influenza virus
ENGDIIFLWG

SEQ ID NO: 495897 - protein, 10 aa, Influenza virus
ENGNGCFELY

SEQ ID NO: 495898 - protein, 10 aa, Influenza virus
ENGRTLDLHD

SEQ ID NO: 495899 - protein, 10 aa, Influenza virus
ENGRTLDMHD

SEQ ID NO: 495900 - protein, 10 aa, Influenza virus
ENGRTLGLHD

SEQ ID NO: 495901 - protein, 10 aa, Influenza virus
ENGTSVKTLT

SEQ ID NO: 495902 - protein, 10 aa, Influenza virus
ENGTYDYPKY

SEQ ID NO: 495903 - protein, 10 aa, Influenza virus
ENGVPVTSSI

SEQ ID NO: 495904 - protein, 10 aa, Influenza virus
ENGVPVTSSV

SEQ ID NO: 495905 - protein, 10 aa, Influenza virus
ENGWEGLIDG

SEQ ID NO: 495906 - protein, 10 aa, Influenza virus
ENGWEGLING

SEQ ID NO: 495907 - protein, 10 aa, Influenza virus
ENGWEGLVDG

SEQ ID NO: 495908 - protein, 10 aa, Influenza virus
ENGWEGMIDG

SEQ ID NO: 495909 - protein, 10 aa, Influenza virus
ENGWEGMMDG

SEQ ID NO: 495910 - protein, 10 aa, Influenza virus
ENGWEGMVDG

SEQ ID NO: 495911 - protein, 10 aa, Influenza virus
ENGWEGMVNG

SEQ ID NO: 495912 - protein, 10 aa, Influenza virus
ENGWQGLIDG

SEQ ID NO: 495913 - protein, 10 aa, Influenza virus
ENIAPEKVDF

SEQ ID NO: 495914 - protein, 10 aa, Influenza virus
ENKHSNGTKH

SEQ ID NO: 495915 - protein, 10 aa, Influenza virus
ENKKYGPALS

SEQ ID NO: 495916 - protein, 10 aa, Influenza virus
ENKRYGPALS

SEQ ID NO: 495917 - protein, 10 aa, Influenza virus
ENKYVNNTTI

SEQ ID NO: 495918 - protein, 10 aa, Influenza virus
ENLDKKMEDG

SEQ ID NO: 495919 - protein, 10 aa, Influenza virus
ENLEELRFVF

SEQ ID NO: 495920 - protein, 10 aa, Influenza virus
ENLFDEVRRR

SEQ ID NO: 495921 - protein, 10 aa, Influenza virus
ENLNKKIDDG

SEQ ID NO: 495922 - protein, 10 aa, Influenza virus
ENLNKKMEDG

SEQ ID NO: 495923 - protein, 10 aa, Influenza virus
ENLNKKVDDG

SEQ ID NO: 495924 - protein, 10 aa, Influenza virus
ENLNKKVEDG

SEQ ID NO: 495925 - protein, 10 aa, Influenza virus
ENLNKRVDDG

SEQ ID NO: 495926 - protein, 10 aa, Influenza virus
ENLNRKMEDG

SEQ ID NO: 495927 - protein, 10 aa, Influenza virus
ENLNRKVDDG

SEQ ID NO: 495928 - protein, 10 aa, Influenza virus
ENLQAYQKRM

SEQ ID NO: 495929 - protein, 10 aa, Influenza virus
ENLQAYQNRM

SEQ ID NO: 495930 - protein, 10 aa, Influenza virus
ENLQTYQKRM

SEQ ID NO: 495931 - protein, 10 aa, Influenza virus
ENLSKRMEDG

SEQ ID NO: 495932 - protein, 10 aa, Influenza virus
ENLWAYNAEL

SEQ ID NO: 495933 - protein, 10 aa, Influenza virus
ENMAPEKIDF

SEQ ID NO: 495934 - protein, 10 aa, Influenza virus
ENMAPEKMDF

SEQ ID NO: 495935 - protein, 10 aa, Influenza virus
ENMAPEKVDF

SEQ ID NO: 495936 - protein, 10 aa, Influenza virus
ENNTWGNQTY

SEQ ID NO: 495937 - protein, 10 aa, Influenza virus
ENNTWVNQTF

SEQ ID NO: 495938 - protein, 10 aa, Influenza virus
ENNTWVNQTY

SEQ ID NO: 495939 - protein, 10 aa, Influenza virus
ENNVTVTSSV

SEQ ID NO: 495940 - protein, 10 aa, Influenza virus
ENPAHKSQLI

SEQ ID NO: 495941 - protein, 10 aa, Influenza virus
ENPAHKSQLV

SEQ ID NO: 495942 - protein, 10 aa, Influenza virus
ENPSAGKDPK

SEQ ID NO: 495943 - protein, 10 aa, Influenza virus
ENPSHEGEGI

SEQ ID NO: 495944 - protein, 10 aa, Influenza virus
ENPVHKSQLI

SEQ ID NO: 495945 - protein, 10 aa, Influenza virus
ENPVICLGHH

SEQ ID NO: 495946 - protein, 10 aa, Influenza virus
ENQEELKSLF

SEQ ID NO: 495947 - protein, 10 aa, Influenza virus
ENQEELRFLF

SEQ ID NO: 495948 - protein, 10 aa, Influenza virus
ENQEELRSLF

SEQ ID NO: 495949 - protein, 10 aa, Influenza virus
ENQHIIDLAD

SEQ ID NO: 495950 - protein, 10 aa, Influenza virus
ENQHTIDLAD

SEQ ID NO: 495951 - protein, 10 aa, Influenza virus
ENQHTIDLAE

SEQ ID NO: 495952 - protein, 10 aa, Influenza virus
ENQHTIDLTD

SEQ ID NO: 495953 - protein, 10 aa, Influenza virus
ENQHTIDLTN

SEQ ID NO: 495954 - protein, 10 aa, Influenza virus
ENQHTIDMAD

SEQ ID NO: 495955 - protein, 10 aa, Influenza virus
ENQHTIDMTD

SEQ ID NO: 495956 - protein, 10 aa, Influenza virus
ENQHTIDSTD

SEQ ID NO: 495957 - protein, 10 aa, Influenza virus
ENQHTIDVTD

SEQ ID NO: 495958 - protein, 10 aa, Influenza virus
ENQHTIEMTD

SEQ ID NO: 495959 - protein, 10 aa, Influenza virus
ENQHTIHLTD

SEQ ID NO: 495960 - protein, 10 aa, Influenza virus
ENQKILDEHD

SEQ ID NO: 495961 - protein, 10 aa, Influenza virus
ENQKPLDEHD

SEQ ID NO: 495962 - protein, 10 aa, Influenza virus
ENQKTLDEHD

SEQ ID NO: 495963 - protein, 10 aa, Influenza virus
ENQKTLDEHE

SEQ ID NO: 495964 - protein, 10 aa, Influenza virus
ENQKTLDEHV

SEQ ID NO: 495965 - protein, 10 aa, Influenza virus
ENQKTLDKHD

SEQ ID NO: 495966 - protein, 10 aa, Influenza virus
ENQNPRIFLA

SEQ ID NO: 495967 - protein, 10 aa, Influenza virus
ENQNPRMFLA

SEQ ID NO: 495968 - protein, 10 aa, Influenza virus
ENQNPRVFLA

SEQ ID NO: 495969 - protein, 10 aa, Influenza virus
ENQNPRVFLT

SEQ ID NO: 495970 - protein, 10 aa, Influenza virus
ENQSPRMFLA

SEQ ID NO: 495971 - protein, 10 aa, Influenza virus
ENRINMLADR

SEQ ID NO: 495972 - protein, 10 aa, Influenza virus
ENRMVIASTT

SEQ ID NO: 495973 - protein, 10 aa, Influenza virus
ENRMVLASTT

SEQ ID NO: 495974 - protein, 10 aa, Influenza virus
ENRVWWTSNS

SEQ ID NO: 495975 - protein, 10 aa, Influenza virus
ENSDVLVTRE

SEQ ID NO: 495976 - protein, 10 aa, Influenza virus
ENSFEQITFI

SEQ ID NO: 495977 - protein, 10 aa, Influenza virus
ENSFEQITFL

SEQ ID NO: 495978 - protein, 10 aa, Influenza virus
ENSFEQITFM

SEQ ID NO: 495979 - protein, 10 aa, Influenza virus
ENSQGSGYAA

SEQ ID NO: 495980 - protein, 10 aa, Influenza virus
ENSTYKILSI

SEQ ID NO: 495981 - protein, 10 aa, Influenza virus
ENTGSYVRLY

SEQ ID NO: 495982 - protein, 10 aa, Influenza virus
ENTHIHIFSF

SEQ ID NO: 495983 - protein, 10 aa, Influenza virus
ENTSYKILSI

SEQ ID NO: 495984 - protein, 10 aa, Influenza virus
ENTTWVNQTY

SEQ ID NO: 495985 - protein, 10 aa, Influenza virus
ENTTYKILSI

SEQ ID NO: 495986 - protein, 10 aa, Influenza virus
ENTTYRILSI

SEQ ID NO: 495987 - protein, 10 aa, Influenza virus
ENTYVNKTTV

SEQ ID NO: 495988 - protein, 10 aa, Influenza virus
ENTYVNNTTI

SEQ ID NO: 495989 - protein, 10 aa, Influenza virus
ENTYVNNTTV

SEQ ID NO: 495990 - protein, 10 aa, Influenza virus
EPALIVWGVH

SEQ ID NO: 495991 - protein, 10 aa, Influenza virus
EPDECRFYAL

SEQ ID NO: 495992 - protein, 10 aa, Influenza virus
EPDTYDFNEG

SEQ ID NO: 495993 - protein, 10 aa, Influenza virus
EPFISCSHFE

SEQ ID NO: 495994 - protein, 10 aa, Influenza virus
EPFISCSHLE

SEQ ID NO: 495995 - protein, 10 aa, Influenza virus
EPFISCSHME

SEQ ID NO: 495996 - protein, 10 aa, Influenza virus
EPFISCSHSE

SEQ ID NO: 495997 - protein, 10 aa, Influenza virus
EPFISCSPLE

SEQ ID NO: 495998 - protein, 10 aa, Influenza virus
EPFISCSQLE

SEQ ID NO: 495999 - protein, 10 aa, Influenza virus
EPFQSLIPKA

SEQ ID NO: 496000 - protein, 10 aa, Influenza virus
EPFQSLVPKA

SEQ ID NO: 496001 - protein, 10 aa, Influenza virus
EPFQSLVPRA

SEQ ID NO: 496002 - protein, 10 aa, Influenza virus
EPFVACGPAE

SEQ ID NO: 496003 - protein, 10 aa, Influenza virus
EPFVACGPSE

SEQ ID NO: 496004 - protein, 10 aa, Influenza virus
EPFVACGPTE

SEQ ID NO: 496005 - protein, 10 aa, Influenza virus
EPFVACSPSE

SEQ ID NO: 496006 - protein, 10 aa, Influenza virus
EPFVSCGPSE

SEQ ID NO: 496007 - protein, 10 aa, Influenza virus
EPFVSCSHLE

SEQ ID NO: 496008 - protein, 10 aa, Influenza virus
EPGSGDWPDG

SEQ ID NO: 496009 - protein, 10 aa, Influenza virus
EPGSGNWPDG

SEQ ID NO: 496010 - protein, 10 aa, Influenza virus
EPGTFDIEGL

SEQ ID NO: 496011 - protein, 10 aa, Influenza virus
EPGTFDIGGL

SEQ ID NO: 496012 - protein, 10 aa, Influenza virus
EPGTFDLEGL

SEQ ID NO: 496013 - protein, 10 aa, Influenza virus
EPGTFDLGGL

SEQ ID NO: 496014 - protein, 10 aa, Influenza virus
EPGVKGFGFK

SEQ ID NO: 496015 - protein, 10 aa, Influenza virus
EPISLGDCSF

SEQ ID NO: 496016 - protein, 10 aa, Influenza virus
EPKGLFGAIA

SEQ ID NO: 496017 - protein, 10 aa, Influenza virus
EPLCDVSGFA

SEQ ID NO: 496018 - protein, 10 aa, Influenza virus
EPLCEVSGFA

SEQ ID NO: 496019 - protein, 10 aa, Influenza virus
EPLCEVSGFV

SEQ ID NO: 496020 - protein, 10 aa, Influenza virus
EPLCNVSGFA

SEQ ID NO: 496021 - protein, 10 aa, Influenza virus
EPMGFRYSGI

SEQ ID NO: 496022 - protein, 10 aa, Influenza virus
EPNGCIEGKL

SEQ ID NO: 496023 - protein, 10 aa, Influenza virus
EPNGCIESKL

SEQ ID NO: 496024 - protein, 10 aa, Influenza virus
EPNGSIEGKL

SEQ ID NO: 496025 - protein, 10 aa, Influenza virus
EPNGYIEGKL

SEQ ID NO: 496026 - protein, 10 aa, Influenza virus
EPRGLFGAIA

SEQ ID NO: 496027 - protein, 10 aa, Influenza virus
EPSGYAQTDC

SEQ ID NO: 496028 - protein, 10 aa, Influenza virus
EPTGYAQTDC

SEQ ID NO: 496029 - protein, 10 aa, Influenza virus
EPYPGNNNNG

SEQ ID NO: 496030 - protein, 10 aa, Influenza virus
EPYVSCDPDE

SEQ ID NO: 496031 - protein, 10 aa, Influenza virus
EPYVSCDPDG

SEQ ID NO: 496032 - protein, 10 aa, Influenza virus
EPYVSCDPLG

SEQ ID NO: 496033 - protein, 10 aa, Influenza virus
EPYVSCDPNE

SEQ ID NO: 496034 - protein, 10 aa, Influenza virus
EPYVSCDPSG

SEQ ID NO: 496035 - protein, 10 aa, Influenza virus
EPYVSCDPTG

SEQ ID NO: 496036 - protein, 10 aa, Influenza virus
EPYVSCEPDE

SEQ ID NO: 496037 - protein, 10 aa, Influenza virus
EQAAEAIEVA

SEQ ID NO: 496038 - protein, 10 aa, Influenza virus
EQAAEAMDIA

SEQ ID NO: 496039 - protein, 10 aa, Influenza virus
EQAAEAMEIA

SEQ ID NO: 496040 - protein, 10 aa, Influenza virus
EQAAEAMEVA

SEQ ID NO: 496041 - protein, 10 aa, Influenza virus
EQAVDICKAA

SEQ ID NO: 496042 - protein, 10 aa, Influenza virus
EQAVGICKAA

SEQ ID NO: 496043 - protein, 10 aa, Influenza virus
EQAVNICKAA

SEQ ID NO: 496044 - protein, 10 aa, Influenza virus
EQEEVTNATE

SEQ ID NO: 496045 - protein, 10 aa, Influenza virus
EQFPVQTDEY

SEQ ID NO: 496046 - protein, 10 aa, Influenza virus
EQFTWNGVKV

SEQ ID NO: 496047 - protein, 10 aa, Influenza virus
EQGMGMAADK

SEQ ID NO: 496048 - protein, 10 aa, Influenza virus
EQGSGYAADK

SEQ ID NO: 496049 - protein, 10 aa, Influenza virus
EQGSGYAADL

SEQ ID NO: 496050 - protein, 10 aa, Influenza virus
EQGSGYAADQ

SEQ ID NO: 496051 - protein, 10 aa, Influenza virus
EQGSGYAADR

SEQ ID NO: 496052 - protein, 10 aa, Influenza virus
EQGTGIAADK

SEQ ID NO: 496053 - protein, 10 aa, Influenza virus
EQGTGIAAEK

SEQ ID NO: 496054 - protein, 10 aa, Influenza virus
EQGVGIAADK

SEQ ID NO: 496055 - protein, 10 aa, Influenza virus
EQGVGMAADK

SEQ ID NO: 496056 - protein, 10 aa, Influenza virus
EQIADAQHRS

SEQ ID NO: 496057 - protein, 10 aa, Influenza virus
EQIADSHHRS

SEQ ID NO: 496058 - protein, 10 aa, Influenza virus
EQIADSQHKS

SEQ ID NO: 496059 - protein, 10 aa, Influenza virus
EQIADSQHRS

SEQ ID NO: 496060 - protein, 10 aa, Influenza virus
EQIIVTREPY

SEQ ID NO: 496061 - protein, 10 aa, Influenza virus
EQITFIQALQ

SEQ ID NO: 496062 - protein, 10 aa, Influenza virus
EQITFLQALQ

SEQ ID NO: 496063 - protein, 10 aa, Influenza virus
EQITFMQALQ

SEQ ID NO: 496064 - protein, 10 aa, Influenza virus
EQIVVTREPY

SEQ ID NO: 496065 - protein, 10 aa, Influenza virus
EQKQEFKMNP

SEQ ID NO: 496066 - protein, 10 aa, Influenza virus
EQKVPVTQTM

SEQ ID NO: 496067 - protein, 10 aa, Influenza virus
EQLGSWSWHD

SEQ ID NO: 496068 - protein, 10 aa, Influenza virus
EQLSQKFEEI

SEQ ID NO: 496069 - protein, 10 aa, Influenza virus
EQLSSVSSFE

SEQ ID NO: 496070 - protein, 10 aa, Influenza virus
EQLSSVSSFK

SEQ ID NO: 496071 - protein, 10 aa, Influenza virus
EQLSTVSSFE

SEQ ID NO: 496072 - protein, 10 aa, Influenza virus
EQLYTPGGEV

SEQ ID NO: 496073 - protein, 10 aa, Influenza virus
EQMAGSSEQA

SEQ ID NO: 496074 - protein, 10 aa, Influenza virus
EQMETDGDRQ

SEQ ID NO: 496075 - protein, 10 aa, Influenza virus
EQMETDGERQ

SEQ ID NO: 496076 - protein, 10 aa, Influenza virus
EQMETGGERQ

SEQ ID NO: 496077 - protein, 10 aa, Influenza virus
EQMETSGERQ

SEQ ID NO: 496078 - protein, 10 aa, Influenza virus
EQMYQKCCNL

SEQ ID NO: 496079 - protein, 10 aa, Influenza virus
EQMYQKCCSL

SEQ ID NO: 496080 - protein, 10 aa, Influenza virus
EQMYQKCCTL

SEQ ID NO: 496081 - protein, 10 aa, Influenza virus
EQMYQRCCNL

SEQ ID NO: 496082 - protein, 10 aa, Influenza virus
EQMYTPGGEV

SEQ ID NO: 496083 - protein, 10 aa, Influenza virus
EQMYTPGGGV

SEQ ID NO: 496084 - protein, 10 aa, Influenza virus
EQMYTPGGKV

SEQ ID NO: 496085 - protein, 10 aa, Influenza virus
EQNIPVTQTM

SEQ ID NO: 496086 - protein, 10 aa, Influenza virus
EQNIPVTQVE

SEQ ID NO: 496087 - protein, 10 aa, Influenza virus
EQNKLYGAGN

SEQ ID NO: 496088 - protein, 10 aa, Influenza virus
EQNKLYGTGN

SEQ ID NO: 496089 - protein, 10 aa, Influenza virus
EQNVPVTQAM

SEQ ID NO: 496090 - protein, 10 aa, Influenza virus
EQNVPVTQTM

SEQ ID NO: 496091 - protein, 10 aa, Influenza virus
EQNVPVTQVE

SEQ ID NO: 496092 - protein, 10 aa, Influenza virus
EQNVTVTHAK

SEQ ID NO: 496093 - protein, 10 aa, Influenza virus
EQQGRMDYYW

SEQ ID NO: 496094 - protein, 10 aa, Influenza virus
EQQIGNVINW

SEQ ID NO: 496095 - protein, 10 aa, Influenza virus
EQRINMLADR

SEQ ID NO: 496096 - protein, 10 aa, Influenza virus
EQSGLPVGGN

SEQ ID NO: 496097 - protein, 10 aa, Influenza virus
EQTALYKNAN

SEQ ID NO: 496098 - protein, 10 aa, Influenza virus
EQTDLYKVAT

SEQ ID NO: 496099 - protein, 10 aa, Influenza virus
EQTKLYGNGN

SEQ ID NO: 496100 - protein, 10 aa, Influenza virus
EQTKLYGSGN

SEQ ID NO: 496101 - protein, 10 aa, Influenza virus
EQTKLYGSGS

SEQ ID NO: 496102 - protein, 10 aa, Influenza virus
EQTKLYKNTN

SEQ ID NO: 496103 - protein, 10 aa, Influenza virus
EQTTLYKNAN

SEQ ID NO: 496104 - protein, 10 aa, Influenza virus
EQVAGSSEQA

SEQ ID NO: 496105 - protein, 10 aa, Influenza virus
EQVDTIMEKN

SEQ ID NO: 496106 - protein, 10 aa, Influenza virus
EQVDTIMERN

SEQ ID NO: 496107 - protein, 10 aa, Influenza virus
EQVEGRIQDL

SEQ ID NO: 496108 - protein, 10 aa, Influenza virus
EQVEGRIQYL

SEQ ID NO: 496109 - protein, 10 aa, Influenza virus
EQVEGRTQDL

SEQ ID NO: 496110 - protein, 10 aa, Influenza virus
EQVIVTREPY

SEQ ID NO: 496111 - protein, 10 aa, Influenza virus
EREAKLFVLF

SEQ ID NO: 496112 - protein, 10 aa, Influenza virus
EREGGRRRKR

SEQ ID NO: 496113 - protein, 10 aa, Influenza virus
EREGYSLVGI

SEQ ID NO: 496114 - protein, 10 aa, Influenza virus
EREGYSLVGV

SEQ ID NO: 496115 - protein, 10 aa, Influenza virus
ERELVRKTRF

SEQ ID NO: 496116 - protein, 10 aa, Influenza virus
EREVEVVNAT

SEQ ID NO: 496117 - protein, 10 aa, Influenza virus
ERGEDTIEER

SEQ ID NO: 496118 - protein, 10 aa, Influenza virus
ERGEETIEEK

SEQ ID NO: 496119 - protein, 10 aa, Influenza virus
ERGEETIEER

SEQ ID NO: 496120 - protein, 10 aa, Influenza virus
ERGEETVEER

SEQ ID NO: 496121 - protein, 10 aa, Influenza virus
ERGIEVVNAT

SEQ ID NO: 496122 - protein, 10 aa, Influenza virus
ERGKLKRRAI

SEQ ID NO: 496123 - protein, 10 aa, Influenza virus
ERGLFGAIAG

SEQ ID NO: 496124 - protein, 10 aa, Influenza virus
ERGLQRRRFI

SEQ ID NO: 496125 - protein, 10 aa, Influenza virus
ERGLQRRRFV

SEQ ID NO: 496126 - protein, 10 aa, Influenza virus
ERGNHGVKGW

SEQ ID NO: 496127 - protein, 10 aa, Influenza virus
ERGNPGVKGW

SEQ ID NO: 496128 - protein, 10 aa, Influenza virus
ERGNQGVKGW

SEQ ID NO: 496129 - protein, 10 aa, Influenza virus
ERGSPGVKGW

SEQ ID NO: 496130 - protein, 10 aa, Influenza virus
ERGTKQEENL

SEQ ID NO: 496131 - protein, 10 aa, Influenza virus
ERGTQGVKGW

SEQ ID NO: 496132 - protein, 10 aa, Influenza virus
ERGVEVVDAT

SEQ ID NO: 496133 - protein, 10 aa, Influenza virus
ERGVEVVNAT

SEQ ID NO: 496134 - protein, 10 aa, Influenza virus
ERILDFHDSN

SEQ ID NO: 496135 - protein, 10 aa, Influenza virus
ERILEEESDE

SEQ ID NO: 496136 - protein, 10 aa, Influenza virus
ERIMFESNGG

SEQ ID NO: 496137 - protein, 10 aa, Influenza virus
ERIRNNTYDH

SEQ ID NO: 496138 - protein, 10 aa, Influenza virus
ERITFESNGG

SEQ ID NO: 496139 - protein, 10 aa, Influenza virus
ERITFESSGG

SEQ ID NO: 496140 - protein, 10 aa, Influenza virus
ERLGSWSWHD

SEQ ID NO: 496141 - protein, 10 aa, Influenza virus
ERLTITYSSS

SEQ ID NO: 496142 - protein, 10 aa, Influenza virus
ERLVLATGLR

SEQ ID NO: 496143 - protein, 10 aa, Influenza virus
ERMCNILKGK

SEQ ID NO: 496144 - protein, 10 aa, Influenza virus
ERMVLSAFDE

SEQ ID NO: 496145 - protein, 10 aa, Influenza virus
ERMYQKCCNL

SEQ ID NO: 496146 - protein, 10 aa, Influenza virus
ERNALGDCPK

SEQ ID NO: 496147 - protein, 10 aa, Influenza virus
ERNALGNCPK

SEQ ID NO: 496148 - protein, 10 aa, Influenza virus
ERNDLYGTQS

SEQ ID NO: 496149 - protein, 10 aa, Influenza virus
ERNITEIVYL

SEQ ID NO: 496150 - protein, 10 aa, Influenza virus
ERNVTETLYL

SEQ ID NO: 496151 - protein, 10 aa, Influenza virus
ERNVTVTHAK

SEQ ID NO: 496152 - protein, 10 aa, Influenza virus
ERNVTVTHAQ

SEQ ID NO: 496153 - protein, 10 aa, Influenza virus
ERNVTVTHSV

SEQ ID NO: 496154 - protein, 10 aa, Influenza virus
ERPKEIEGIC

SEQ ID NO: 496155 - protein, 10 aa, Influenza virus
ERPKEMEGIC

SEQ ID NO: 496156 - protein, 10 aa, Influenza virus
ERPKEMEGVC

SEQ ID NO: 496157 - protein, 10 aa, Influenza virus
ERPSAPEGMC

SEQ ID NO: 496158 - protein, 10 aa, Influenza virus
ERPSIWTSSS

SEQ ID NO: 496159 - protein, 10 aa, Influenza virus
ERPTAVDTCY

SEQ ID NO: 496160 - protein, 10 aa, Influenza virus
ERQIGNVINW

SEQ ID NO: 496161 - protein, 10 aa, Influenza virus
ERQKINGVKL

SEQ ID NO: 496162 - protein, 10 aa, Influenza virus
ERQKISGVKL

SEQ ID NO: 496163 - protein, 10 aa, Influenza virus
ERQKVNGVKL

SEQ ID NO: 496164 - protein, 10 aa, Influenza virus
ERQRINGVKL

SEQ ID NO: 496165 - protein, 10 aa, Influenza virus
ERQTRGIFGA

SEQ ID NO: 496166 - protein, 10 aa, Influenza virus
ERQTRGLFGA

SEQ ID NO: 496167 - protein, 10 aa, Influenza virus
ERRIENLNKK

SEQ ID NO: 496168 - protein, 10 aa, Influenza virus
ERRIENLNRK

SEQ ID NO: 496169 - protein, 10 aa, Influenza virus
ERRIESLNKK

SEQ ID NO: 496170 - protein, 10 aa, Influenza virus
ERRINMLADR

SEQ ID NO: 496171 - protein, 10 aa, Influenza virus
ERRLENLNKK

SEQ ID NO: 496172 - protein, 10 aa, Influenza virus
ERRLENLNKR

SEQ ID NO: 496173 - protein, 10 aa, Influenza virus
ERRLENLSKR

SEQ ID NO: 496174 - protein, 10 aa, Influenza virus
ERRNKYLEEH

SEQ ID NO: 496175 - protein, 10 aa, Influenza virus
ERRNRYLEEH

SEQ ID NO: 496176 - protein, 10 aa, Influenza virus
ERRNSSDICY

SEQ ID NO: 496177 - protein, 10 aa, Influenza virus
ERRRKKRGLF

SEQ ID NO: 496178 - protein, 10 aa, Influenza virus
ERSKINEVKL

SEQ ID NO: 496179 - protein, 10 aa, Influenza virus
ERSKINGVIL

SEQ ID NO: 496180 - protein, 10 aa, Influenza virus
ERSKINGVKL

SEQ ID NO: 496181 - protein, 10 aa, Influenza virus
ERSKINGVRL

SEQ ID NO: 496182 - protein, 10 aa, Influenza virus
ERTHIHIFSF

SEQ ID NO: 496183 - protein, 10 aa, Influenza virus
ERTHNGKLCK

SEQ ID NO: 496184 - protein, 10 aa, Influenza virus
ERTIWTSGSS

SEQ ID NO: 496185 - protein, 10 aa, Influenza virus
ERTKEMEGIC

SEQ ID NO: 496186 - protein, 10 aa, Influenza virus
ERTLDFHDFN

SEQ ID NO: 496187 - protein, 10 aa, Influenza virus
ERTLDFHDSN

SEQ ID NO: 496188 - protein, 10 aa, Influenza virus
ERTLDFHDSS

SEQ ID NO: 496189 - protein, 10 aa, Influenza virus
ERTLDFHESN

SEQ ID NO: 496190 - protein, 10 aa, Influenza virus
ERTLDLHDAN

SEQ ID NO: 496191 - protein, 10 aa, Influenza virus
ERTLDLHDSN

SEQ ID NO: 496192 - protein, 10 aa, Influenza virus
ERTLDMHDAN

SEQ ID NO: 496193 - protein, 10 aa, Influenza virus
ERTLDMHDVN

SEQ ID NO: 496194 - protein, 10 aa, Influenza virus
ERTLDYHDSN

SEQ ID NO: 496195 - protein, 10 aa, Influenza virus
ERTLEFHDSN

SEQ ID NO: 496196 - protein, 10 aa, Influenza virus
ERTLYFHDSN

SEQ ID NO: 496197 - protein, 10 aa, Influenza virus
ERTNEKFHQI

SEQ ID NO: 496198 - protein, 10 aa, Influenza virus
ERTNEKYHQI

SEQ ID NO: 496199 - protein, 10 aa, Influenza virus
ERTNQQFELI

SEQ ID NO: 496200 - protein, 10 aa, Influenza virus
ERTSIWTSSS

SEQ ID NO: 496201 - protein, 10 aa, Influenza virus
ERTTFESNGG

SEQ ID NO: 496202 - protein, 10 aa, Influenza virus
ERVDTIIESN

SEQ ID NO: 496203 - protein, 10 aa, Influenza virus
ERVDTIMEKN

SEQ ID NO: 496204 - protein, 10 aa, Influenza virus
ERVKKQLREN

SEQ ID NO: 496205 - protein, 10 aa, Influenza virus
ERVKMFDFIK

SEQ ID NO: 496206 - protein, 10 aa, Influenza virus
ERVKMFDFSK

SEQ ID NO: 496207 - protein, 10 aa, Influenza virus
ERVKMFDFTK

SEQ ID NO: 496208 - protein, 10 aa, Influenza virus
ERVKRQLREN

SEQ ID NO: 496209 - protein, 10 aa, Influenza virus
ERVRHQLREN

SEQ ID NO: 496210 - protein, 10 aa, Influenza virus
ERVRKQLREN

SEQ ID NO: 496211 - protein, 10 aa, Influenza virus
ERVRKQLRQN

SEQ ID NO: 496212 - protein, 10 aa, Influenza virus
ERVRNGTYDH

SEQ ID NO: 496213 - protein, 10 aa, Influenza virus
ERVRRQLREN

SEQ ID NO: 496214 - protein, 10 aa, Influenza virus
ERYVEDTKID

SEQ ID NO: 496215 - protein, 10 aa, Influenza virus
ESADMSIGIT

SEQ ID NO: 496216 - protein, 10 aa, Influenza virus
ESADMSIGVT

SEQ ID NO: 496217 - protein, 10 aa, Influenza virus
ESAVLRGFLI

SEQ ID NO: 496218 - protein, 10 aa, Influenza virus
ESCEGECFYS

SEQ ID NO: 496219 - protein, 10 aa, Influenza virus
ESDEALKMTI

SEQ ID NO: 496220 - protein, 10 aa, Influenza virus
ESDGAFLAPR

SEQ ID NO: 496221 - protein, 10 aa, Influenza virus
ESECACINGS

SEQ ID NO: 496222 - protein, 10 aa, Influenza virus
ESECACVNGS

SEQ ID NO: 496223 - protein, 10 aa, Influenza virus
ESECICINGT

SEQ ID NO: 496224 - protein, 10 aa, Influenza virus
ESECVCHKGI

SEQ ID NO: 496225 - protein, 10 aa, Influenza virus
ESECVCHKGV

SEQ ID NO: 496226 - protein, 10 aa, Influenza virus
ESECVCHNGI

SEQ ID NO: 496227 - protein, 10 aa, Influenza virus
ESECVCHNGT

SEQ ID NO: 496228 - protein, 10 aa, Influenza virus
ESECVCHNGV

SEQ ID NO: 496229 - protein, 10 aa, Influenza virus
ESECVCHNST

SEQ ID NO: 496230 - protein, 10 aa, Influenza virus
ESECVCHSGI

SEQ ID NO: 496231 - protein, 10 aa, Influenza virus
ESECVCINGI

SEQ ID NO: 496232 - protein, 10 aa, Influenza virus
ESECVCINGS

SEQ ID NO: 496233 - protein, 10 aa, Influenza virus
ESECVCINGT

SEQ ID NO: 496234 - protein, 10 aa, Influenza virus
ESECVCISGT

SEQ ID NO: 496235 - protein, 10 aa, Influenza virus
ESECVCMNGS

SEQ ID NO: 496236 - protein, 10 aa, Influenza virus
ESECVCQDEF

SEQ ID NO: 496237 - protein, 10 aa, Influenza virus
ESECVCQNGV

SEQ ID NO: 496238 - protein, 10 aa, Influenza virus
ESECVCVNGS

SEQ ID NO: 496239 - protein, 10 aa, Influenza virus
ESECVRHNGT

SEQ ID NO: 496240 - protein, 10 aa, Influenza virus
ESEFNEIEHQ

SEQ ID NO: 496241 - protein, 10 aa, Influenza virus
ESEFNEIEYQ

SEQ ID NO: 496242 - protein, 10 aa, Influenza virus
ESEFSEIEHQ

SEQ ID NO: 496243 - protein, 10 aa, Influenza virus
ESEFSETEHQ

SEQ ID NO: 496244 - protein, 10 aa, Influenza virus
ESEMNKLYER

SEQ ID NO: 496245 - protein, 10 aa, Influenza virus
ESEQIIVTRE

SEQ ID NO: 496246 - protein, 10 aa, Influenza virus
ESEQIVVTRE

SEQ ID NO: 496247 - protein, 10 aa, Influenza virus
ESEQVIVTRE

SEQ ID NO: 496248 - protein, 10 aa, Influenza virus
ESGGIDKEPM

SEQ ID NO: 496249 - protein, 10 aa, Influenza virus
ESGGIDKESM

SEQ ID NO: 496250 - protein, 10 aa, Influenza virus
ESGGIDKIGT

SEQ ID NO: 496251 - protein, 10 aa, Influenza virus
ESGGIDKIST

SEQ ID NO: 496252 - protein, 10 aa, Influenza virus
ESGGIDKVST

SEQ ID NO: 496253 - protein, 10 aa, Influenza virus
ESGGISKIST

SEQ ID NO: 496254 - protein, 10 aa, Influenza virus
ESGGISKMST

SEQ ID NO: 496255 - protein, 10 aa, Influenza virus
ESGRLIDFLK

SEQ ID NO: 496256 - protein, 10 aa, Influenza virus
ESGRLMDFLK

SEQ ID NO: 496257 - protein, 10 aa, Influenza virus
ESHCRIIQNE

SEQ ID NO: 496258 - protein, 10 aa, Influenza virus
ESHGKIIQNE

SEQ ID NO: 496259 - protein, 10 aa, Influenza virus
ESHGRIIQNE

SEQ ID NO: 496260 - protein, 10 aa, Influenza virus
ESHGRTIQNE

SEQ ID NO: 496261 - protein, 10 aa, Influenza virus
ESIAWSATAC

SEQ ID NO: 496262 - protein, 10 aa, Influenza virus
ESIEECLIND

SEQ ID NO: 496263 - protein, 10 aa, Influenza virus
ESIESEFNEI

SEQ ID NO: 496264 - protein, 10 aa, Influenza virus
ESIESEFSEI

SEQ ID NO: 496265 - protein, 10 aa, Influenza virus
ESIESEFSET

SEQ ID NO: 496266 - protein, 10 aa, Influenza virus
ESIIEAESSV

SEQ ID NO: 496267 - protein, 10 aa, Influenza virus
ESIKNGTYDY

SEQ ID NO: 496268 - protein, 10 aa, Influenza virus
ESIRDNTYDH

SEQ ID NO: 496269 - protein, 10 aa, Influenza virus
ESIRNGTYDH

SEQ ID NO: 496270 - protein, 10 aa, Influenza virus
ESIRNGTYNH

SEQ ID NO: 496271 - protein, 10 aa, Influenza virus
ESIRNNTYDH

SEQ ID NO: 496272 - protein, 10 aa, Influenza virus
ESIRNNTYNH

SEQ ID NO: 496273 - protein, 10 aa, Influenza virus
ESKCFWKGGS

SEQ ID NO: 496274 - protein, 10 aa, Influenza virus
ESKCFWREGS

SEQ ID NO: 496275 - protein, 10 aa, Influenza virus
ESKCFWRGGS

SEQ ID NO: 496276 - protein, 10 aa, Influenza virus
ESKINRQEIE

SEQ ID NO: 496277 - protein, 10 aa, Influenza virus
ESKLKRNEIK

SEQ ID NO: 496278 - protein, 10 aa, Influenza virus
ESKLKRQEID

SEQ ID NO: 496279 - protein, 10 aa, Influenza virus
ESKLKRQEIE

SEQ ID NO: 496280 - protein, 10 aa, Influenza virus
ESKLKRQEIN

SEQ ID NO: 496281 - protein, 10 aa, Influenza virus
ESKLNRNEIK

SEQ ID NO: 496282 - protein, 10 aa, Influenza virus
ESKLNRQEIE

SEQ ID NO: 496283 - protein, 10 aa, Influenza virus
ESKLNRQEIG

SEQ ID NO: 496284 - protein, 10 aa, Influenza virus
ESKLNRSEIK

SEQ ID NO: 496285 - protein, 10 aa, Influenza virus
ESKLNRTEIK

SEQ ID NO: 496286 - protein, 10 aa, Influenza virus
ESLLLATGMK

SEQ ID NO: 496287 - protein, 10 aa, Influenza virus
ESLLNRLSIN

SEQ ID NO: 496288 - protein, 10 aa, Influenza virus
ESLMLATGMK

SEQ ID NO: 496289 - protein, 10 aa, Influenza virus
ESLNKKMEDG

SEQ ID NO: 496290 - protein, 10 aa, Influenza virus
ESLNNKVDDG

SEQ ID NO: 496291 - protein, 10 aa, Influenza virus
ESLQNRIQID

SEQ ID NO: 496292 - protein, 10 aa, Influenza virus
ESLRLAIGLR

SEQ ID NO: 496293 - protein, 10 aa, Influenza virus
ESLRLALGLR

SEQ ID NO: 496294 - protein, 10 aa, Influenza virus
ESLRLAVGLR

SEQ ID NO: 496295 - protein, 10 aa, Influenza virus
ESMGFRYSGI

SEQ ID NO: 496296 - protein, 10 aa, Influenza virus
ESMIEAESSI

SEQ ID NO: 496297 - protein, 10 aa, Influenza virus
ESMIEAESSV

SEQ ID NO: 496298 - protein, 10 aa, Influenza virus
ESMVEAESSV

SEQ ID NO: 496299 - protein, 10 aa, Influenza virus
ESNGAFIAPR

SEQ ID NO: 496300 - protein, 10 aa, Influenza virus
ESNGAFLAPG

SEQ ID NO: 496301 - protein, 10 aa, Influenza virus
ESNGAFLAPR

SEQ ID NO: 496302 - protein, 10 aa, Influenza virus
ESNGGFLAPR

SEQ ID NO: 496303 - protein, 10 aa, Influenza virus
ESNGGLIAPR

SEQ ID NO: 496304 - protein, 10 aa, Influenza virus
ESNGGLLAPK

SEQ ID NO: 496305 - protein, 10 aa, Influenza virus
ESNGGLLAPR

SEQ ID NO: 496306 - protein, 10 aa, Influenza virus
ESNGNFIAPE

SEQ ID NO: 496307 - protein, 10 aa, Influenza virus
ESNGNFITPE

SEQ ID NO: 496308 - protein, 10 aa, Influenza virus
ESNGNLIAPE

SEQ ID NO: 496309 - protein, 10 aa, Influenza virus
ESNGNLIAPW

SEQ ID NO: 496310 - protein, 10 aa, Influenza virus
ESNGNLVAPW

SEQ ID NO: 496311 - protein, 10 aa, Influenza virus
ESNGVFLAPR

SEQ ID NO: 496312 - protein, 10 aa, Influenza virus
ESNITVTSSV

SEQ ID NO: 496313 - protein, 10 aa, Influenza virus
ESNVTVTSSI

SEQ ID NO: 496314 - protein, 10 aa, Influenza virus
ESNVTVTSSV

SEQ ID NO: 496315 - protein, 10 aa, Influenza virus
ESQLKKQEIE

SEQ ID NO: 496316 - protein, 10 aa, Influenza virus
ESQLKRQEIE

SEQ ID NO: 496317 - protein, 10 aa, Influenza virus
ESRARIKTRL

SEQ ID NO: 496318 - protein, 10 aa, Influenza virus
ESRGLFGAIA

SEQ ID NO: 496319 - protein, 10 aa, Influenza virus
ESRINRQEIE

SEQ ID NO: 496320 - protein, 10 aa, Influenza virus
ESRKLLLIAQ

SEQ ID NO: 496321 - protein, 10 aa, Influenza virus
ESRKLLLITQ

SEQ ID NO: 496322 - protein, 10 aa, Influenza virus
ESRKLLLIVQ

SEQ ID NO: 496323 - protein, 10 aa, Influenza virus
ESRKLLLVVQ

SEQ ID NO: 496324 - protein, 10 aa, Influenza virus
ESRKMLLIVQ

SEQ ID NO: 496325 - protein, 10 aa, Influenza virus
ESRLNRNEIK

SEQ ID NO: 496326 - protein, 10 aa, Influenza virus
ESRLNRQEIE

SEQ ID NO: 496327 - protein, 10 aa, Influenza virus
ESRNPGNAEI

SEQ ID NO: 496328 - protein, 10 aa, Influenza virus
ESRSGFEMIW

SEQ ID NO: 496329 - protein, 10 aa, Influenza virus
ESRSGFEMVW

SEQ ID NO: 496330 - protein, 10 aa, Influenza virus
ESRSGYETFK

SEQ ID NO: 496331 - protein, 10 aa, Influenza virus
ESRSNIFNME

SEQ ID NO: 496332 - protein, 10 aa, Influenza virus
ESRSPGNAEI

SEQ ID NO: 496333 - protein, 10 aa, Influenza virus
ESSDVLVTRE

SEQ ID NO: 496334 - protein, 10 aa, Influenza virus
ESSFEQITFM

SEQ ID NO: 496335 - protein, 10 aa, Influenza virus
ESSFYAEMEW

SEQ ID NO: 496336 - protein, 10 aa, Influenza virus
ESSFYAEMKW

SEQ ID NO: 496337 - protein, 10 aa, Influenza virus
ESSGGLLAPR

SEQ ID NO: 496338 - protein, 10 aa, Influenza virus
ESSIGKVCRT

SEQ ID NO: 496339 - protein, 10 aa, Influenza virus
ESSIKEKDMT

SEQ ID NO: 496340 - protein, 10 aa, Influenza virus
ESSTYQNNFV

SEQ ID NO: 496341 - protein, 10 aa, Influenza virus
ESSVKEKDLT

SEQ ID NO: 496342 - protein, 10 aa, Influenza virus
ESSVKEKDMT

SEQ ID NO: 496343 - protein, 10 aa, Influenza virus
ESSVREKDMT

SEQ ID NO: 496344 - protein, 10 aa, Influenza virus
ESTGNFIAPE

SEQ ID NO: 496345 - protein, 10 aa, Influenza virus
ESTGNLIAPE

SEQ ID NO: 496346 - protein, 10 aa, Influenza virus
ESTGNLVAPE

SEQ ID NO: 496347 - protein, 10 aa, Influenza virus
ESTQAAIDQI

SEQ ID NO: 496348 - protein, 10 aa, Influenza virus
ESTQKAIDGI

SEQ ID NO: 496349 - protein, 10 aa, Influenza virus
ESTQKAIDGV

SEQ ID NO: 496350 - protein, 10 aa, Influenza virus
ESTQKAIDQI

SEQ ID NO: 496351 - protein, 10 aa, Influenza virus
ESTQKAIDRI

SEQ ID NO: 496352 - protein, 10 aa, Influenza virus
ESTQKAINGV

SEQ ID NO: 496353 - protein, 10 aa, Influenza virus
ESTQKAMDGV

SEQ ID NO: 496354 - protein, 10 aa, Influenza virus
ESTQRAIDGV

SEQ ID NO: 496355 - protein, 10 aa, Influenza virus
ESVAWSASAC

SEQ ID NO: 496356 - protein, 10 aa, Influenza virus
ESVAWSATAC

SEQ ID NO: 496357 - protein, 10 aa, Influenza virus
ESVGWSATAC

SEQ ID NO: 496358 - protein, 10 aa, Influenza virus
ESVKNGTYDY

SEQ ID NO: 496359 - protein, 10 aa, Influenza virus
ESVKNGTYNY

SEQ ID NO: 496360 - protein, 10 aa, Influenza virus
ESVLINTYQW

SEQ ID NO: 496361 - protein, 10 aa, Influenza virus
ESVLVNTYQW

SEQ ID NO: 496362 - protein, 10 aa, Influenza virus
ESVRNGTYDY

SEQ ID NO: 496363 - protein, 10 aa, Influenza virus
ESVRNGTYKY

SEQ ID NO: 496364 - protein, 10 aa, Influenza virus
ESVRNGTYNY

SEQ ID NO: 496365 - protein, 10 aa, Influenza virus
ESYGRIIQNE

SEQ ID NO: 496366 - protein, 10 aa, Influenza virus
ETCSALFVYS

SEQ ID NO: 496367 - protein, 10 aa, Influenza virus
ETEHQIGNVI

SEQ ID NO: 496368 - protein, 10 aa, Influenza virus
ETEQTKLYKN

SEQ ID NO: 496369 - protein, 10 aa, Influenza virus
ETFKVIGGWS

SEQ ID NO: 496370 - protein, 10 aa, Influenza virus
ETFKVIGGWT

SEQ ID NO: 496371 - protein, 10 aa, Influenza virus
ETFRVIDGWT

SEQ ID NO: 496372 - protein, 10 aa, Influenza virus
ETFRVIGGWA

SEQ ID NO: 496373 - protein, 10 aa, Influenza virus
ETFRVIGGWT

SEQ ID NO: 496374 - protein, 10 aa, Influenza virus
ETFRVIGGWV

SEQ ID NO: 496375 - protein, 10 aa, Influenza virus
ETFRVISGWT

SEQ ID NO: 496376 - protein, 10 aa, Influenza virus
ETFVNMTNVQ

SEQ ID NO: 496377 - protein, 10 aa, Influenza virus
ETFVNVTHVQ

SEQ ID NO: 496378 - protein, 10 aa, Influenza virus
ETFVNVTNVQ

SEQ ID NO: 496379 - protein, 10 aa, Influenza virus
ETGALQLNPI

SEQ ID NO: 496380 - protein, 10 aa, Influenza virus
ETGAPQLNPI

SEQ ID NO: 496381 - protein, 10 aa, Influenza virus
ETGAPQLNPV

SEQ ID NO: 496382 - protein, 10 aa, Influenza virus
ETGNGCFEFY

SEQ ID NO: 496383 - protein, 10 aa, Influenza virus
ETGVPVTSSV

SEQ ID NO: 496384 - protein, 10 aa, Influenza virus
ETGYICSKFH

SEQ ID NO: 496385 - protein, 10 aa, Influenza virus
ETGYVCGKFH

SEQ ID NO: 496386 - protein, 10 aa, Influenza virus
ETGYVCSKFH

SEQ ID NO: 496387 - protein, 10 aa, Influenza virus
ETIIETGYVC

SEQ ID NO: 496388 - protein, 10 aa, Influenza virus
ETIKNGTYDH

SEQ ID NO: 496389 - protein, 10 aa, Influenza virus
ETIKNGTYNH

SEQ ID NO: 496390 - protein, 10 aa, Influenza virus
ETIKNGTYNR

SEQ ID NO: 496391 - protein, 10 aa, Influenza virus
ETILETGYIC

SEQ ID NO: 496392 - protein, 10 aa, Influenza virus
ETILETGYVC

SEQ ID NO: 496393 - protein, 10 aa, Influenza virus
ETILETRYVC

SEQ ID NO: 496394 - protein, 10 aa, Influenza virus
ETIRNGTYDH

SEQ ID NO: 496395 - protein, 10 aa, Influenza virus
ETIRNGTYNH

SEQ ID NO: 496396 - protein, 10 aa, Influenza virus
ETIVETGYVC

SEQ ID NO: 496397 - protein, 10 aa, Influenza virus
ETKAPQLNPI

SEQ ID NO: 496398 - protein, 10 aa, Influenza virus
ETKCQSPLGA

SEQ ID NO: 496399 - protein, 10 aa, Influenza virus
ETKCQTPLGA

SEQ ID NO: 496400 - protein, 10 aa, Influenza virus
ETKGLFGAIA

SEQ ID NO: 496401 - protein, 10 aa, Influenza virus
ETKVWWTSNS

SEQ ID NO: 496402 - protein, 10 aa, Influenza virus
ETLKIRTNGN

SEQ ID NO: 496403 - protein, 10 aa, Influenza virus
ETLKVESNGN

SEQ ID NO: 496404 - protein, 10 aa, Influenza virus
ETLNIESNGN

SEQ ID NO: 496405 - protein, 10 aa, Influenza virus
ETLNVESNGN

SEQ ID NO: 496406 - protein, 10 aa, Influenza virus
ETNGNYGPIN

SEQ ID NO: 496407 - protein, 10 aa, Influenza virus
ETNHTDELCP

SEQ ID NO: 496408 - protein, 10 aa, Influenza virus
ETNHTGTYCS

SEQ ID NO: 496409 - protein, 10 aa, Influenza virus
ETNKFAAICT

SEQ ID NO: 496410 - protein, 10 aa, Influenza virus
ETNKFAAVCT

SEQ ID NO: 496411 - protein, 10 aa, Influenza virus
ETNKFASICT

SEQ ID NO: 496412 - protein, 10 aa, Influenza virus
ETNKLAAICT

SEQ ID NO: 496413 - protein, 10 aa, Influenza virus
ETQCQTPLGA

SEQ ID NO: 496414 - protein, 10 aa, Influenza virus
ETQTRGIFGA

SEQ ID NO: 496415 - protein, 10 aa, Influenza virus
ETRCQTPLGA

SEQ ID NO: 496416 - protein, 10 aa, Influenza virus
ETRGLFGAIA

SEQ ID NO: 496417 - protein, 10 aa, Influenza virus
ETRVWWTSNS

SEQ ID NO: 496418 - protein, 10 aa, Influenza virus
ETSHTGTYCS

SEQ ID NO: 496419 - protein, 10 aa, Influenza virus
ETTGRNCTIP

SEQ ID NO: 496420 - protein, 10 aa, Influenza virus
ETTGRNCTVP

SEQ ID NO: 496421 - protein, 10 aa, Influenza virus
ETTHTGTYCS

SEQ ID NO: 496422 - protein, 10 aa, Influenza virus
ETTVWWTSNS

SEQ ID NO: 496423 - protein, 10 aa, Influenza virus
ETVEITGIDK

SEQ ID NO: 496424 - protein, 10 aa, Influenza virus
ETVEITGINK

SEQ ID NO: 496425 - protein, 10 aa, Influenza virus
ETVNTLIEQN

SEQ ID NO: 496426 - protein, 10 aa, Influenza virus
ETVNTLSEQN

SEQ ID NO: 496427 - protein, 10 aa, Influenza virus
ETVNTLTEQN

SEQ ID NO: 496428 - protein, 10 aa, Influenza virus
ETYKILTIYS

SEQ ID NO: 496429 - protein, 10 aa, Influenza virus
ETYVLSIIPS

SEQ ID NO: 496430 - protein, 10 aa, Influenza virus
ETYVLSIVPS

SEQ ID NO: 496431 - protein, 10 aa, Influenza virus
ETYVLSVIPS

SEQ ID NO: 496432 - protein, 10 aa, Influenza virus
EVCFMYSDFH

SEQ ID NO: 496433 - protein, 10 aa, Influenza virus
EVCLKWDLMD

SEQ ID NO: 496434 - protein, 10 aa, Influenza virus
EVCLKWELMD

SEQ ID NO: 496435 - protein, 10 aa, Influenza virus
EVDNNGELRH

SEQ ID NO: 496436 - protein, 10 aa, Influenza virus
EVDQSLIIAA

SEQ ID NO: 496437 - protein, 10 aa, Influenza virus
EVEGRIQDLE

SEQ ID NO: 496438 - protein, 10 aa, Influenza virus
EVEKQIGNVI

SEQ ID NO: 496439 - protein, 10 aa, Influenza virus
EVEKQLGNVI

SEQ ID NO: 496440 - protein, 10 aa, Influenza virus
EVENEIRTFS

SEQ ID NO: 496441 - protein, 10 aa, Influenza virus
EVEQEIRAFS

SEQ ID NO: 496442 - protein, 10 aa, Influenza virus
EVEQEIRTFS

SEQ ID NO: 496443 - protein, 10 aa, Influenza virus
EVEQEMRTFS

SEQ ID NO: 496444 - protein, 10 aa, Influenza virus
EVEQQIGNVI

SEQ ID NO: 496445 - protein, 10 aa, Influenza virus
EVERQIGNVI

SEQ ID NO: 496446 - protein, 10 aa, Influenza virus
EVESEIRTFS

SEQ ID NO: 496447 - protein, 10 aa, Influenza virus
EVETYVLSII

SEQ ID NO: 496448 - protein, 10 aa, Influenza virus
EVETYVLSIV

SEQ ID NO: 496449 - protein, 10 aa, Influenza virus
EVETYVLSVI

SEQ ID NO: 496450 - protein, 10 aa, Influenza virus
EVEVVNATET

SEQ ID NO: 496451 - protein, 10 aa, Influenza virus
EVFVIREPCI

SEQ ID NO: 496452 - protein, 10 aa, Influenza virus
EVFVIREPFI

SEQ ID NO: 496453 - protein, 10 aa, Influenza virus
EVGAKILTSE

SEQ ID NO: 496454 - protein, 10 aa, Influenza virus
EVGARIITSE

SEQ ID NO: 496455 - protein, 10 aa, Influenza virus
EVGARILASE

SEQ ID NO: 496456 - protein, 10 aa, Influenza virus
EVGARILTSE

SEQ ID NO: 496457 - protein, 10 aa, Influenza virus
EVGNGCFEFY

SEQ ID NO: 496458 - protein, 10 aa, Influenza virus
EVGTRWMKII

SEQ ID NO: 496459 - protein, 10 aa, Influenza virus
EVGYLCAGIP

SEQ ID NO: 496460 - protein, 10 aa, Influenza virus
EVILWFSFGA

SEQ ID NO: 496461 - protein, 10 aa, Influenza virus
EVINATETVE

SEQ ID NO: 496462 - protein, 10 aa, Influenza virus
EVITAQELVE

SEQ ID NO: 496463 - protein, 10 aa, Influenza virus
EVKLEENTTY

SEQ ID NO: 496464 - protein, 10 aa, Influenza virus
EVKRRLSANA

SEQ ID NO: 496465 - protein, 10 aa, Influenza virus
EVKRRLSTNA

SEQ ID NO: 496466 - protein, 10 aa, Influenza virus
EVKYVWWTSN

SEQ ID NO: 496467 - protein, 10 aa, Influenza virus
EVLFQGGHIE

SEQ ID NO: 496468 - protein, 10 aa, Influenza virus
EVLHLTQGAC

SEQ ID NO: 496469 - protein, 10 aa, Influenza virus
EVLHLTQGTC

SEQ ID NO: 496470 - protein, 10 aa, Influenza virus
EVLNNKHWSG

SEQ ID NO: 496471 - protein, 10 aa, Influenza virus
EVLNNKNWSG

SEQ ID NO: 496472 - protein, 10 aa, Influenza virus
EVLNNMNWSG

SEQ ID NO: 496473 - protein, 10 aa, Influenza virus
EVLNNRNWSG

SEQ ID NO: 496474 - protein, 10 aa, Influenza virus
EVLTGNLQAL

SEQ ID NO: 496475 - protein, 10 aa, Influenza virus
EVLTGNLQTL

SEQ ID NO: 496476 - protein, 10 aa, Influenza virus
EVLWTSNSIV

SEQ ID NO: 496477 - protein, 10 aa, Influenza virus
EVNGPESVLV

SEQ ID NO: 496478 - protein, 10 aa, Influenza virus
EVNSWHIFSK

SEQ ID NO: 496479 - protein, 10 aa, Influenza virus
EVNSWHILSK

SEQ ID NO: 496480 - protein, 10 aa, Influenza virus
EVPGWSWDDG

SEQ ID NO: 496481 - protein, 10 aa, Influenza virus
EVPGWSWGDG

SEQ ID NO: 496482 - protein, 10 aa, Influenza virus
EVPSPYNSRF

SEQ ID NO: 496483 - protein, 10 aa, Influenza virus
EVRGDQMAHC

SEQ ID NO: 496484 - protein, 10 aa, Influenza virus
EVRHRLKITE

SEQ ID NO: 496485 - protein, 10 aa, Influenza virus
EVRRDQMAHC

SEQ ID NO: 496486 - protein, 10 aa, Influenza virus
EVRRIWRQAN

SEQ ID NO: 496487 - protein, 10 aa, Influenza virus
EVRRRLSANA

SEQ ID NO: 496488 - protein, 10 aa, Influenza virus
EVRRRLSTNA

SEQ ID NO: 496489 - protein, 10 aa, Influenza virus
EVRRRLSVNA

SEQ ID NO: 496490 - protein, 10 aa, Influenza virus
EVSFQGGHIE

SEQ ID NO: 496491 - protein, 10 aa, Influenza virus
EVSFQGRGVF

SEQ ID NO: 496492 - protein, 10 aa, Influenza virus
EVSFRGRGVF

SEQ ID NO: 496493 - protein, 10 aa, Influenza virus
EVSHCRATEY

SEQ ID NO: 496494 - protein, 10 aa, Influenza virus
EVSSWHILSK

SEQ ID NO: 496495 - protein, 10 aa, Influenza virus
EVSVIREPFI

SEQ ID NO: 496496 - protein, 10 aa, Influenza virus
EVSWTSNSIV

SEQ ID NO: 496497 - protein, 10 aa, Influenza virus
EVTNATELVQ

SEQ ID NO: 496498 - protein, 10 aa, Influenza virus
EVTNATETVE

SEQ ID NO: 496499 - protein, 10 aa, Influenza virus
EVVAAQELVE

SEQ ID NO: 496500 - protein, 10 aa, Influenza virus
EVVDATETVE

SEQ ID NO: 496501 - protein, 10 aa, Influenza virus
EVVFPNEVGA

SEQ ID NO: 496502 - protein, 10 aa, Influenza virus
EVVNATETVE

SEQ ID NO: 496503 - protein, 10 aa, Influenza virus
EVVSAKELVE

SEQ ID NO: 496504 - protein, 10 aa, Influenza virus
EVVTAQELVE

SEQ ID NO: 496505 - protein, 10 aa, Influenza virus
EVWIGRTKSL

SEQ ID NO: 496506 - protein, 10 aa, Influenza virus
EVWSYNADLL

SEQ ID NO: 496507 - protein, 10 aa, Influenza virus
EVWSYNAEFL

SEQ ID NO: 496508 - protein, 10 aa, Influenza virus
EVWSYNAELL

SEQ ID NO: 496509 - protein, 10 aa, Influenza virus
EVWWTSNSIV

SEQ ID NO: 496510 - protein, 10 aa, Influenza virus
EWGNGCFEFY

SEQ ID NO: 496511 - protein, 10 aa, Influenza virus
EWIKTRPILS

SEQ ID NO: 496512 - protein, 10 aa, Influenza virus
EWLKTRPILS

SEQ ID NO: 496513 - protein, 10 aa, Influenza virus
EWSGYSGSFV

SEQ ID NO: 496514 - protein, 10 aa, Influenza virus
EWSKRYELEI

SEQ ID NO: 496515 - protein, 10 aa, Influenza virus
EWSRRYELEI

SEQ ID NO: 496516 - protein, 10 aa, Influenza virus
EWSYIIEKEN

SEQ ID NO: 496517 - protein, 10 aa, Influenza virus
EWSYIMEKEN

SEQ ID NO: 496518 - protein, 10 aa, Influenza virus
EWSYIVEKAN

SEQ ID NO: 496519 - protein, 10 aa, Influenza virus
EWSYIVEKDK

SEQ ID NO: 496520 - protein, 10 aa, Influenza virus
EWSYIVEKDN

SEQ ID NO: 496521 - protein, 10 aa, Influenza virus
EWSYIVEKDS

SEQ ID NO: 496522 - protein, 10 aa, Influenza virus
EWSYIVEKEN

SEQ ID NO: 496523 - protein, 10 aa, Influenza virus
EWSYIVEKNN

SEQ ID NO: 496524 - protein, 10 aa, Influenza virus
EWSYIVEREN

SEQ ID NO: 496525 - protein, 10 aa, Influenza virus
EWSYIVERET

SEQ ID NO: 496526 - protein, 10 aa, Influenza virus
EWSYIVERPK

SEQ ID NO: 496527 - protein, 10 aa, Influenza virus
EWSYIVERTK

SEQ ID NO: 496528 - protein, 10 aa, Influenza virus
EWSYLIEDPA

SEQ ID NO: 496529 - protein, 10 aa, Influenza virus
EWSYLIEDPG

SEQ ID NO: 496530 - protein, 10 aa, Influenza virus
EWSYLIEDPN

SEQ ID NO: 496531 - protein, 10 aa, Influenza virus
EWSYLIEDPS

SEQ ID NO: 496532 - protein, 10 aa, Influenza virus
EWSYLIEDPT

SEQ ID NO: 496533 - protein, 10 aa, Influenza virus
EWTSNSLIAL

SEQ ID NO: 496534 - protein, 10 aa, Influenza virus
EYAEESKLKR

SEQ ID NO: 496535 - protein, 10 aa, Influenza virus
EYASKTRISE

SEQ ID NO: 496536 - protein, 10 aa, Influenza virus
EYDAVATTHS

SEQ ID NO: 496537 - protein, 10 aa, Influenza virus
EYEEEAKLEK

SEQ ID NO: 496538 - protein, 10 aa, Influenza virus
EYEEEAKLER

SEQ ID NO: 496539 - protein, 10 aa, Influenza virus
EYEEESKLKR

SEQ ID NO: 496540 - protein, 10 aa, Influenza virus
EYGFKISKRG

SEQ ID NO: 496541 - protein, 10 aa, Influenza virus
EYGFRISKRG

SEQ ID NO: 496542 - protein, 10 aa, Influenza virus
EYGHLITGKS

SEQ ID NO: 496543 - protein, 10 aa, Influenza virus
EYGHLTTGKS

SEQ ID NO: 496544 - protein, 10 aa, Influenza virus
EYGHLVTGKS

SEQ ID NO: 496545 - protein, 10 aa, Influenza virus
EYGKGRIFQS

SEQ ID NO: 496546 - protein, 10 aa, Influenza virus
EYGRGRIFQS

SEQ ID NO: 496547 - protein, 10 aa, Influenza virus
EYGYLITGKS

SEQ ID NO: 496548 - protein, 10 aa, Influenza virus
EYKDWILWIS

SEQ ID NO: 496549 - protein, 10 aa, Influenza virus
EYKNTGDSDI

SEQ ID NO: 496550 - protein, 10 aa, Influenza virus
EYKNTRDSDI

SEQ ID NO: 496551 - protein, 10 aa, Influenza virus
EYKNTRDSNI

SEQ ID NO: 496552 - protein, 10 aa, Influenza virus
EYNGKSLGIQ

SEQ ID NO: 496553 - protein, 10 aa, Influenza virus
EYNNTTGRDV

SEQ ID NO: 496554 - protein, 10 aa, Influenza virus
EYQIGNVINW

SEQ ID NO: 496555 - protein, 10 aa, Influenza virus
EYQSLRSILA

SEQ ID NO: 496556 - protein, 10 aa, Influenza virus
EYRQEALQNR

SEQ ID NO: 496557 - protein, 10 aa, Influenza virus
EYSIDSSYVC

SEQ ID NO: 496558 - protein, 10 aa, Influenza virus
EYTLDEESRA

SEQ ID NO: 496559 - protein, 10 aa, Influenza virus
EYYFVKEGKI

SEQ ID NO: 496560 - protein, 10 aa, Influenza virus
FADQELGDAP

SEQ ID NO: 496561 - protein, 10 aa, Influenza virus
FAGKNADLEA

SEQ ID NO: 496562 - protein, 10 aa, Influenza virus
FAGKNSDLEA

SEQ ID NO: 496563 - protein, 10 aa, Influenza virus
FAGKNTDLEA

SEQ ID NO: 496564 - protein, 10 aa, Influenza virus
FAGKNTDLEV

SEQ ID NO: 496565 - protein, 10 aa, Influenza virus
FAGWILGNPM

SEQ ID NO: 496566 - protein, 10 aa, Influenza virus
FAGWILGNPR

SEQ ID NO: 496567 - protein, 10 aa, Influenza virus
FAIASKDNGI

SEQ ID NO: 496568 - protein, 10 aa, Influenza virus
FAIFSKDNGI

SEQ ID NO: 496569 - protein, 10 aa, Influenza virus
FAIISKDNGI

SEQ ID NO: 496570 - protein, 10 aa, Influenza virus
FAIVSKDNGI

SEQ ID NO: 496571 - protein, 10 aa, Influenza virus
FAKDNSIRLS

SEQ ID NO: 496572 - protein, 10 aa, Influenza virus
FALAQGALLG

SEQ ID NO: 496573 - protein, 10 aa, Influenza virus
FALAQGALVG

SEQ ID NO: 496574 - protein, 10 aa, Influenza virus
FALAQGTLLG

SEQ ID NO: 496575 - protein, 10 aa, Influenza virus
FALAQGVLLG

SEQ ID NO: 496576 - protein, 10 aa, Influenza virus
FALGQGTPLN

SEQ ID NO: 496577 - protein, 10 aa, Influenza virus
FALGQGTTLD

SEQ ID NO: 496578 - protein, 10 aa, Influenza virus
FALGQGTTLE

SEQ ID NO: 496579 - protein, 10 aa, Influenza virus
FALGQGTTLK

SEQ ID NO: 496580 - protein, 10 aa, Influenza virus
FALGQGTTLN

SEQ ID NO: 496581 - protein, 10 aa, Influenza virus
FALGQGTTLS

SEQ ID NO: 496582 - protein, 10 aa, Influenza virus
FALGQGTTLY

SEQ ID NO: 496583 - protein, 10 aa, Influenza virus
FALSGMAIAL

SEQ ID NO: 496584 - protein, 10 aa, Influenza virus
FALSGVAIAL

SEQ ID NO: 496585 - protein, 10 aa, Influenza virus
FALSGVAITL

SEQ ID NO: 496586 - protein, 10 aa, Influenza virus
FALSGVAVAL

SEQ ID NO: 496587 - protein, 10 aa, Influenza virus
FALSQGTTLK

SEQ ID NO: 496588 - protein, 10 aa, Influenza virus
FALSQGTTLR

SEQ ID NO: 496589 - protein, 10 aa, Influenza virus
FANEESLRQI

SEQ ID NO: 496590 - protein, 10 aa, Influenza virus
FAPFAKDNSI

SEQ ID NO: 496591 - protein, 10 aa, Influenza virus
FAPFSKDNGI

SEQ ID NO: 496592 - protein, 10 aa, Influenza virus
FAPFSKDNSI

SEQ ID NO: 496593 - protein, 10 aa, Influenza virus
FAPFSKDNSV

SEQ ID NO: 496594 - protein, 10 aa, Influenza virus
FAPYSKDNGI

SEQ ID NO: 496595 - protein, 10 aa, Influenza virus
FASSGIAIAL

SEQ ID NO: 496596 - protein, 10 aa, Influenza virus
FASSGIAIVL

SEQ ID NO: 496597 - protein, 10 aa, Influenza virus
FAYDKICIGY

SEQ ID NO: 496598 - protein, 10 aa, Influenza virus
FCFTVMTDGP

SEQ ID NO: 496599 - protein, 10 aa, Influenza virus
FCGLDNEPGS

SEQ ID NO: 496600 - protein, 10 aa, Influenza virus
FCGLNNEPGS

SEQ ID NO: 496601 - protein, 10 aa, Influenza virus
FCGTSGTYGA

SEQ ID NO: 496602 - protein, 10 aa, Influenza virus
FCGTSGTYGS

SEQ ID NO: 496603 - protein, 10 aa, Influenza virus
FCGTSGTYGT

SEQ ID NO: 496604 - protein, 10 aa, Influenza virus
FCGVDSDTTG

SEQ ID NO: 496605 - protein, 10 aa, Influenza virus
FCGVDSDTTS

SEQ ID NO: 496606 - protein, 10 aa, Influenza virus
FCGVNSDTTG

SEQ ID NO: 496607 - protein, 10 aa, Influenza virus
FCGVNSDTTS

SEQ ID NO: 496608 - protein, 10 aa, Influenza virus
FCGVNSNTTG

SEQ ID NO: 496609 - protein, 10 aa, Influenza virus
FCGVSGEVPG

SEQ ID NO: 496610 - protein, 10 aa, Influenza virus
FCGVSSEVPE

SEQ ID NO: 496611 - protein, 10 aa, Influenza virus
FCGVSSEVPG

SEQ ID NO: 496612 - protein, 10 aa, Influenza virus
FCLKNGNMRC

SEQ ID NO: 496613 - protein, 10 aa, Influenza virus
FCLRNGNMRC

SEQ ID NO: 496614 - protein, 10 aa, Influenza virus
FCSIDGKAPI

SEQ ID NO: 496615 - protein, 10 aa, Influenza virus
FCSINGKAPI

SEQ ID NO: 496616 - protein, 10 aa, Influenza virus
FCSINGKEPI

SEQ ID NO: 496617 - protein, 10 aa, Influenza virus
FCSINGKQPI

SEQ ID NO: 496618 - protein, 10 aa, Influenza virus
FCSINGRAPI

SEQ ID NO: 496619 - protein, 10 aa, Influenza virus
FCYPGELDNN

SEQ ID NO: 496620 - protein, 10 aa, Influenza virus
FCYTLITDGP

SEQ ID NO: 496621 - protein, 10 aa, Influenza virus
FCYTLMTDGP

SEQ ID NO: 496622 - protein, 10 aa, Influenza virus
FCYTLVTDGP

SEQ ID NO: 496623 - protein, 10 aa, Influenza virus
FDERRNKYLE

SEQ ID NO: 496624 - protein, 10 aa, Influenza virus
FDERRNRYLE

SEQ ID NO: 496625 - protein, 10 aa, Influenza virus
FDEVKRRLSA

SEQ ID NO: 496626 - protein, 10 aa, Influenza virus
FDEVKRRLST

SEQ ID NO: 496627 - protein, 10 aa, Influenza virus
FDEVRRRLSA

SEQ ID NO: 496628 - protein, 10 aa, Influenza virus
FDEVRRRLST

SEQ ID NO: 496629 - protein, 10 aa, Influenza virus
FDEVRRRLSV

SEQ ID NO: 496630 - protein, 10 aa, Influenza virus
FDFIKWNVTY

SEQ ID NO: 496631 - protein, 10 aa, Influenza virus
FDFSKWNVTY

SEQ ID NO: 496632 - protein, 10 aa, Influenza virus
FDFTKWNVTH

SEQ ID NO: 496633 - protein, 10 aa, Influenza virus
FDFTKWNVTY

SEQ ID NO: 496634 - protein, 10 aa, Influenza virus
FDGGHIEECS

SEQ ID NO: 496635 - protein, 10 aa, Influenza virus
FDGKEWLHVC

SEQ ID NO: 496636 - protein, 10 aa, Influenza virus
FDGKEWMHIC

SEQ ID NO: 496637 - protein, 10 aa, Influenza virus
FDGKEWMHVC

SEQ ID NO: 496638 - protein, 10 aa, Influenza virus
FDGKEWMHVS

SEQ ID NO: 496639 - protein, 10 aa, Influenza virus
FDGREWMHVC

SEQ ID NO: 496640 - protein, 10 aa, Influenza virus
FDILHKCDNE

SEQ ID NO: 496641 - protein, 10 aa, Influenza virus
FDILHKCDNK

SEQ ID NO: 496642 - protein, 10 aa, Influenza virus
FDILHKCNNE

SEQ ID NO: 496643 - protein, 10 aa, Influenza virus
FDKLYIWGIH

SEQ ID NO: 496644 - protein, 10 aa, Influenza virus
FDKLYIWGVH

SEQ ID NO: 496645 - protein, 10 aa, Influenza virus
FDKLYVWGIH

SEQ ID NO: 496646 - protein, 10 aa, Influenza virus
FDKLYVWGVH

SEQ ID NO: 496647 - protein, 10 aa, Influenza virus
FDSLNITAAS

SEQ ID NO: 496648 - protein, 10 aa, Influenza virus
FDSNGNFIAP

SEQ ID NO: 496649 - protein, 10 aa, Influenza virus
FDVPDYQSLR

SEQ ID NO: 496650 - protein, 10 aa, Influenza virus
FDWTLNRNQP

SEQ ID NO: 496651 - protein, 10 aa, Influenza virus
FEANGNLIAP

SEQ ID NO: 496652 - protein, 10 aa, Influenza virus
FEATGNLIAP

SEQ ID NO: 496653 - protein, 10 aa, Influenza virus
FEATGNLLVP

SEQ ID NO: 496654 - protein, 10 aa, Influenza virus
FEATGNLVAP

SEQ ID NO: 496655 - protein, 10 aa, Influenza virus
FEATGNLVVP

SEQ ID NO: 496656 - protein, 10 aa, Influenza virus
FEAVAWSATA

SEQ ID NO: 496657 - protein, 10 aa, Influenza virus
FECITPNGSI

SEQ ID NO: 496658 - protein, 10 aa, Influenza virus
FECRTFFLTQ

SEQ ID NO: 496659 - protein, 10 aa, Influenza virus
FEECSCYPSG

SEQ ID NO: 496660 - protein, 10 aa, Influenza virus
FEECSCYPSR

SEQ ID NO: 496661 - protein, 10 aa, Influenza virus
FEFTSFFYRY

SEQ ID NO: 496662 - protein, 10 aa, Influenza virus
FEFWHKCDDE

SEQ ID NO: 496663 - protein, 10 aa, Influenza virus
FEFWHKCDND

SEQ ID NO: 496664 - protein, 10 aa, Influenza virus
FEFWHKCDNE

SEQ ID NO: 496665 - protein, 10 aa, Influenza virus
FEFWHKCNNE

SEQ ID NO: 496666 - protein, 10 aa, Influenza virus
FEFYHKCDDE

SEQ ID NO: 496667 - protein, 10 aa, Influenza virus
FEFYHKCDNE

SEQ ID NO: 496668 - protein, 10 aa, Influenza virus
FEFYHKCNDE

SEQ ID NO: 496669 - protein, 10 aa, Influenza virus
FEGGWTGMID

SEQ ID NO: 496670 - protein, 10 aa, Influenza virus
FEGWIGGNPA

SEQ ID NO: 496671 - protein, 10 aa, Influenza virus
FEGWIVGNPA

SEQ ID NO: 496672 - protein, 10 aa, Influenza virus
FEGWIVGNPS

SEQ ID NO: 496673 - protein, 10 aa, Influenza virus
FEIFHKCDDD

SEQ ID NO: 496674 - protein, 10 aa, Influenza virus
FEIFHKCDDH

SEQ ID NO: 496675 - protein, 10 aa, Influenza virus
FEIFHKCDDN

SEQ ID NO: 496676 - protein, 10 aa, Influenza virus
FEIFHKCDDQ

SEQ ID NO: 496677 - protein, 10 aa, Influenza virus
FEIFHKCDDR

SEQ ID NO: 496678 - protein, 10 aa, Influenza virus
FEIFHKCDNQ

SEQ ID NO: 496679 - protein, 10 aa, Influenza virus
FEIFHQCDND

SEQ ID NO: 496680 - protein, 10 aa, Influenza virus
FEIFHQCDNN

SEQ ID NO: 496681 - protein, 10 aa, Influenza virus
FEIFHRCDDQ

SEQ ID NO: 496682 - protein, 10 aa, Influenza virus
FEIIEGRDRA

SEQ ID NO: 496683 - protein, 10 aa, Influenza virus
FEIIEGRDRI

SEQ ID NO: 496684 - protein, 10 aa, Influenza virus
FEIIEGRDRN

SEQ ID NO: 496685 - protein, 10 aa, Influenza virus
FEIIEGRDRT

SEQ ID NO: 496686 - protein, 10 aa, Influenza virus
FEILLIEDGW

SEQ ID NO: 496687 - protein, 10 aa, Influenza virus
FEILLIEEGW

SEQ ID NO: 496688 - protein, 10 aa, Influenza virus
FEKEGYSLVG

SEQ ID NO: 496689 - protein, 10 aa, Influenza virus
FEKFFPSSSY

SEQ ID NO: 496690 - protein, 10 aa, Influenza virus
FEKIKILPRD

SEQ ID NO: 496691 - protein, 10 aa, Influenza virus
FEKVKILARN

SEQ ID NO: 496692 - protein, 10 aa, Influenza virus
FEKVKILPKD

SEQ ID NO: 496693 - protein, 10 aa, Influenza virus
FEKVKILPRD

SEQ ID NO: 496694 - protein, 10 aa, Influenza virus
FEKVRILPKD

SEQ ID NO: 496695 - protein, 10 aa, Influenza virus
FELIDNEFNE

SEQ ID NO: 496696 - protein, 10 aa, Influenza virus
FELIDNEFSE

SEQ ID NO: 496697 - protein, 10 aa, Influenza virus
FELIDNEFTE

SEQ ID NO: 496698 - protein, 10 aa, Influenza virus
FELINNEFNE

SEQ ID NO: 496699 - protein, 10 aa, Influenza virus
FELLHKCNDS

SEQ ID NO: 496700 - protein, 10 aa, Influenza virus
FELLHKCNNS

SEQ ID NO: 496701 - protein, 10 aa, Influenza virus
FELLHKCNNT

SEQ ID NO: 496702 - protein, 10 aa, Influenza virus
FEMIDNEFNE

SEQ ID NO: 496703 - protein, 10 aa, Influenza virus
FEMIWDANGW

SEQ ID NO: 496704 - protein, 10 aa, Influenza virus
FEMIWDPDGW

SEQ ID NO: 496705 - protein, 10 aa, Influenza virus
FEMIWDPNGW

SEQ ID NO: 496706 - protein, 10 aa, Influenza virus
FEMLKIHNAG

SEQ ID NO: 496707 - protein, 10 aa, Influenza virus
FEMLKIPNAE

SEQ ID NO: 496708 - protein, 10 aa, Influenza virus
FEMLKIPNAG

SEQ ID NO: 496709 - protein, 10 aa, Influenza virus
FEMLKVPNAE

SEQ ID NO: 496710 - protein, 10 aa, Influenza virus
FEMLKVPNAG

SEQ ID NO: 496711 - protein, 10 aa, Influenza virus
FEMLRIPNAG

SEQ ID NO: 496712 - protein, 10 aa, Influenza virus
FEMVWDANGW

SEQ ID NO: 496713 - protein, 10 aa, Influenza virus
FEMVWDPNGW

SEQ ID NO: 496714 - protein, 10 aa, Influenza virus
FEPFQSLIPK

SEQ ID NO: 496715 - protein, 10 aa, Influenza virus
FEPFQSLVPK

SEQ ID NO: 496716 - protein, 10 aa, Influenza virus
FEPFQSLVPR

SEQ ID NO: 496717 - protein, 10 aa, Influenza virus
FEPNGCIEGK

SEQ ID NO: 496718 - protein, 10 aa, Influenza virus
FEPNGCIESK

SEQ ID NO: 496719 - protein, 10 aa, Influenza virus
FEPNGSIEGK

SEQ ID NO: 496720 - protein, 10 aa, Influenza virus
FEPNGYIEGK

SEQ ID NO: 496721 - protein, 10 aa, Influenza virus
FEQIEGRIQD

SEQ ID NO: 496722 - protein, 10 aa, Influenza virus
FEQITFIQAL

SEQ ID NO: 496723 - protein, 10 aa, Influenza virus
FEQITFLQAL

SEQ ID NO: 496724 - protein, 10 aa, Influenza virus
FEQITFMQAL

SEQ ID NO: 496725 - protein, 10 aa, Influenza virus
FEQVEGRIQD

SEQ ID NO: 496726 - protein, 10 aa, Influenza virus
FEQVEGRIQY

SEQ ID NO: 496727 - protein, 10 aa, Influenza virus
FEQVEGRTQD

SEQ ID NO: 496728 - protein, 10 aa, Influenza virus
FEREGYSLVG

SEQ ID NO: 496729 - protein, 10 aa, Influenza virus
FERVKRQLRE

SEQ ID NO: 496730 - protein, 10 aa, Influenza virus
FERVRHQLRE

SEQ ID NO: 496731 - protein, 10 aa, Influenza virus
FERVRRQLRE

SEQ ID NO: 496732 - protein, 10 aa, Influenza virus
FESDGAFLAP

SEQ ID NO: 496733 - protein, 10 aa, Influenza virus
FESIAWSATA

SEQ ID NO: 496734 - protein, 10 aa, Influenza virus
FESIESEFNE

SEQ ID NO: 496735 - protein, 10 aa, Influenza virus
FESIESEFSE

SEQ ID NO: 496736 - protein, 10 aa, Influenza virus
FESNGAFIAP

SEQ ID NO: 496737 - protein, 10 aa, Influenza virus
FESNGAFLAP

SEQ ID NO: 496738 - protein, 10 aa, Influenza virus
FESNGALLAP

SEQ ID NO: 496739 - protein, 10 aa, Influenza virus
FESNGGFLAP

SEQ ID NO: 496740 - protein, 10 aa, Influenza virus
FESNGGLIAP

SEQ ID NO: 496741 - protein, 10 aa, Influenza virus
FESNGGLLAP

SEQ ID NO: 496742 - protein, 10 aa, Influenza virus
FESNGNFIAP

SEQ ID NO: 496743 - protein, 10 aa, Influenza virus
FESNGNFITP

SEQ ID NO: 496744 - protein, 10 aa, Influenza virus
FESNGNLIAP

SEQ ID NO: 496745 - protein, 10 aa, Influenza virus
FESSGGLLAP

SEQ ID NO: 496746 - protein, 10 aa, Influenza virus
FESTGNFIAP

SEQ ID NO: 496747 - protein, 10 aa, Influenza virus
FESTGNLIAP

SEQ ID NO: 496748 - protein, 10 aa, Influenza virus
FESTGNLVAP

SEQ ID NO: 496749 - protein, 10 aa, Influenza virus
FESVAWSASA

SEQ ID NO: 496750 - protein, 10 aa, Influenza virus
FESVAWSATA

SEQ ID NO: 496751 - protein, 10 aa, Influenza virus
FESVGWSATA

SEQ ID NO: 496752 - protein, 10 aa, Influenza virus
FEVLFIEDGW

SEQ ID NO: 496753 - protein, 10 aa, Influenza virus
FEVLLIEDGW

SEQ ID NO: 496754 - protein, 10 aa, Influenza virus
FFCLKNGNMR

SEQ ID NO: 496755 - protein, 10 aa, Influenza virus
FFCLRNGNMR

SEQ ID NO: 496756 - protein, 10 aa, Influenza virus
FFFCLKNGNM

SEQ ID NO: 496757 - protein, 10 aa, Influenza virus
FFGAIAGFIE

SEQ ID NO: 496758 - protein, 10 aa, Influenza virus
FFHKCNDSCM

SEQ ID NO: 496759 - protein, 10 aa, Influenza virus
FFITQGSLLN

SEQ ID NO: 496760 - protein, 10 aa, Influenza virus
FFLTHGALLN

SEQ ID NO: 496761 - protein, 10 aa, Influenza virus
FFLTHGSLLN

SEQ ID NO: 496762 - protein, 10 aa, Influenza virus
FFLTQGALLN

SEQ ID NO: 496763 - protein, 10 aa, Influenza virus
FFLTQGSLLN

SEQ ID NO: 496764 - protein, 10 aa, Influenza virus
FFNNTEPLCE

SEQ ID NO: 496765 - protein, 10 aa, Influenza virus
FFPDGPQIQY

SEQ ID NO: 496766 - protein, 10 aa, Influenza virus
FFPFHKDNAI

SEQ ID NO: 496767 - protein, 10 aa, Influenza virus
FFPFHKDNAL

SEQ ID NO: 496768 - protein, 10 aa, Influenza virus
FFPFHKDNAV

SEQ ID NO: 496769 - protein, 10 aa, Influenza virus
FFPFHKGNSA

SEQ ID NO: 496770 - protein, 10 aa, Influenza virus
FFPSSSYRRP

SEQ ID NO: 496771 - protein, 10 aa, Influenza virus
FFRNIVWLIK

SEQ ID NO: 496772 - protein, 10 aa, Influenza virus
FFRNVVWLIK

SEQ ID NO: 496773 - protein, 10 aa, Influenza virus
FFRNVVWLTK

SEQ ID NO: 496774 - protein, 10 aa, Influenza virus
FFRNVVWLVK

SEQ ID NO: 496775 - protein, 10 aa, Influenza virus
FFSRLNWLTK

SEQ ID NO: 496776 - protein, 10 aa, Influenza virus
FFWMCSNGSL

SEQ ID NO: 496777 - protein, 10 aa, Influenza virus
FFYRYGFVAN

SEQ ID NO: 496778 - protein, 10 aa, Influenza virus
FGAIAGFIEG

SEQ ID NO: 496779 - protein, 10 aa, Influenza virus
FGAIAGFIEN

SEQ ID NO: 496780 - protein, 10 aa, Influenza virus
FGAKAGFIEG

SEQ ID NO: 496781 - protein, 10 aa, Influenza virus
FGAKAGFIEN

SEQ ID NO: 496782 - protein, 10 aa, Influenza virus
FGASCFILLA

SEQ ID NO: 496783 - protein, 10 aa, Influenza virus
FGASCFLFLA

SEQ ID NO: 496784 - protein, 10 aa, Influenza virus
FGASCFLLIA

SEQ ID NO: 496785 - protein, 10 aa, Influenza virus
FGASCFLLLA

SEQ ID NO: 496786 - protein, 10 aa, Influenza virus
FGASCFVLLA

SEQ ID NO: 496787 - protein, 10 aa, Influenza virus
FGASCVMLLA

SEQ ID NO: 496788 - protein, 10 aa, Influenza virus
FGASSFVLLA

SEQ ID NO: 496789 - protein, 10 aa, Influenza virus
FGCQNGNIRC

SEQ ID NO: 496790 - protein, 10 aa, Influenza virus
FGCQNGNVRC

SEQ ID NO: 496791 - protein, 10 aa, Influenza virus
FGDNPRPADG

SEQ ID NO: 496792 - protein, 10 aa, Influenza virus
FGDNPRPDDG

SEQ ID NO: 496793 - protein, 10 aa, Influenza virus
FGDNPRPMDG

SEQ ID NO: 496794 - protein, 10 aa, Influenza virus
FGDNPRPMDS

SEQ ID NO: 496795 - protein, 10 aa, Influenza virus
FGDNPRPNDG

SEQ ID NO: 496796 - protein, 10 aa, Influenza virus
FGDNPRPSDG

SEQ ID NO: 496797 - protein, 10 aa, Influenza virus
FGDNPRPVDG

SEQ ID NO: 496798 - protein, 10 aa, Influenza virus
FGDNPRSVDG

SEQ ID NO: 496799 - protein, 10 aa, Influenza virus
FGDSPRPNDG

SEQ ID NO: 496800 - protein, 10 aa, Influenza virus
FGDTPRPNDG

SEQ ID NO: 496801 - protein, 10 aa, Influenza virus
FGEGEQIIVT

SEQ ID NO: 496802 - protein, 10 aa, Influenza virus
FGESEQIIVT

SEQ ID NO: 496803 - protein, 10 aa, Influenza virus
FGESEQIVVT

SEQ ID NO: 496804 - protein, 10 aa, Influenza virus
FGESEQVIVT

SEQ ID NO: 496805 - protein, 10 aa, Influenza virus
FGFGASCFLL

SEQ ID NO: 496806 - protein, 10 aa, Influenza virus
FGFRQGDDVW

SEQ ID NO: 496807 - protein, 10 aa, Influenza virus
FGFRQGNDVW

SEQ ID NO: 496808 - protein, 10 aa, Influenza virus
FGFRQGNNVW

SEQ ID NO: 496809 - protein, 10 aa, Influenza virus
FGFRQGNSVW

SEQ ID NO: 496810 - protein, 10 aa, Influenza virus
FGFRQGSDVW

SEQ ID NO: 496811 - protein, 10 aa, Influenza virus
FGFRQGTDVW

SEQ ID NO: 496812 - protein, 10 aa, Influenza virus
FGFRQGTSVW

SEQ ID NO: 496813 - protein, 10 aa, Influenza virus
FGGFTFKRTK

SEQ ID NO: 496814 - protein, 10 aa, Influenza virus
FGGFTFKRTN

SEQ ID NO: 496815 - protein, 10 aa, Influenza virus
FGGFTFKRTS

SEQ ID NO: 496816 - protein, 10 aa, Influenza virus
FGKDNAIRIG

SEQ ID NO: 496817 - protein, 10 aa, Influenza virus
FGKDNAVRIG

SEQ ID NO: 496818 - protein, 10 aa, Influenza virus
FGLICATCEQ

SEQ ID NO: 496819 - protein, 10 aa, Influenza virus
FGLIDNEFNE

SEQ ID NO: 496820 - protein, 10 aa, Influenza virus
FGLVCATCEQ

SEQ ID NO: 496821 - protein, 10 aa, Influenza virus
FGNLERRLEN

SEQ ID NO: 496822 - protein, 10 aa, Influenza virus
FGPVHFQNQV

SEQ ID NO: 496823 - protein, 10 aa, Influenza virus
FGPVHFRNQI

SEQ ID NO: 496824 - protein, 10 aa, Influenza virus
FGPVHFRNQV

SEQ ID NO: 496825 - protein, 10 aa, Influenza virus
FGPVHFRSQV

SEQ ID NO: 496826 - protein, 10 aa, Influenza virus
FGQVEGRIQD

SEQ ID NO: 496827 - protein, 10 aa, Influenza virus
FGRIDFHWLM

SEQ ID NO: 496828 - protein, 10 aa, Influenza virus
FGVSGINESA

SEQ ID NO: 496829 - protein, 10 aa, Influenza virus
FGVSGVNESA

SEQ ID NO: 496830 - protein, 10 aa, Influenza virus
FGYFGIFFVE

SEQ ID NO: 496831 - protein, 10 aa, Influenza virus
FGYLLKGESH

SEQ ID NO: 496832 - protein, 10 aa, Influenza virus
FGYLLKGESY

SEQ ID NO: 496833 - protein, 10 aa, Influenza virus
FGYLLRGESH

SEQ ID NO: 496834 - protein, 10 aa, Influenza virus
FHDSNVKNLY

SEQ ID NO: 496835 - protein, 10 aa, Influenza virus
FHDSNVKSLY

SEQ ID NO: 496836 - protein, 10 aa, Influenza virus
FHDSNVRNLY

SEQ ID NO: 496837 - protein, 10 aa, Influenza virus
FHFEECSCYP

SEQ ID NO: 496838 - protein, 10 aa, Influenza virus
FHHSNAEGTG

SEQ ID NO: 496839 - protein, 10 aa, Influenza virus
FHHSNSEGTG

SEQ ID NO: 496840 - protein, 10 aa, Influenza virus
FHKCDDDCMA

SEQ ID NO: 496841 - protein, 10 aa, Influenza virus
FHKCDDHCME

SEQ ID NO: 496842 - protein, 10 aa, Influenza virus
FHKCDDQCME

SEQ ID NO: 496843 - protein, 10 aa, Influenza virus
FHKCDNQCME

SEQ ID NO: 496844 - protein, 10 aa, Influenza virus
FHKCNDSCME

SEQ ID NO: 496845 - protein, 10 aa, Influenza virus
FHKDNAIRLG

SEQ ID NO: 496846 - protein, 10 aa, Influenza virus
FHKDNAIRPG

SEQ ID NO: 496847 - protein, 10 aa, Influenza virus
FHKDNALRLA

SEQ ID NO: 496848 - protein, 10 aa, Influenza virus
FHKDNAVRLG

SEQ ID NO: 496849 - protein, 10 aa, Influenza virus
FHKGIVIKEE

SEQ ID NO: 496850 - protein, 10 aa, Influenza virus
FHKGLIIKEE

SEQ ID NO: 496851 - protein, 10 aa, Influenza virus
FHKGLLIKEE

SEQ ID NO: 496852 - protein, 10 aa, Influenza virus
FHKGLVIKEE

SEQ ID NO: 496853 - protein, 10 aa, Influenza virus
FHKGLVVKEE

SEQ ID NO: 496854 - protein, 10 aa, Influenza virus
FHKGNSARLI

SEQ ID NO: 496855 - protein, 10 aa, Influenza virus
FHLGTKQVCA

SEQ ID NO: 496856 - protein, 10 aa, Influenza virus
FHLGTKQVCI

SEQ ID NO: 496857 - protein, 10 aa, Influenza virus
FHLGTKQVCM

SEQ ID NO: 496858 - protein, 10 aa, Influenza virus
FHLGTKQVCV

SEQ ID NO: 496859 - protein, 10 aa, Influenza virus
FHLGTRQVCI

SEQ ID NO: 496860 - protein, 10 aa, Influenza virus
FHLGTRQVCM

SEQ ID NO: 496861 - protein, 10 aa, Influenza virus
FHLGTRQVCV

SEQ ID NO: 496862 - protein, 10 aa, Influenza virus
FHNIHPLAIG

SEQ ID NO: 496863 - protein, 10 aa, Influenza virus
FHNIHPLTIG

SEQ ID NO: 496864 - protein, 10 aa, Influenza virus
FHNIHPLTMG

SEQ ID NO: 496865 - protein, 10 aa, Influenza virus
FHNVHPFTIG

SEQ ID NO: 496866 - protein, 10 aa, Influenza virus
FHNVHPLAIG

SEQ ID NO: 496867 - protein, 10 aa, Influenza virus
FHNVHPLTIG

SEQ ID NO: 496868 - protein, 10 aa, Influenza virus
FHQCDNNCIE

SEQ ID NO: 496869 - protein, 10 aa, Influenza virus
FHQIEKEFSE

SEQ ID NO: 496870 - protein, 10 aa, Influenza virus
FHRCDDQCME

SEQ ID NO: 496871 - protein, 10 aa, Influenza virus
FHRKRRVRDN

SEQ ID NO: 496872 - protein, 10 aa, Influenza virus
FHSDTPRPAD

SEQ ID NO: 496873 - protein, 10 aa, Influenza virus
FHSDTPRPDD

SEQ ID NO: 496874 - protein, 10 aa, Influenza virus
FHSDTPRPSD

SEQ ID NO: 496875 - protein, 10 aa, Influenza virus
FHSDTPRPTD

SEQ ID NO: 496876 - protein, 10 aa, Influenza virus
FHSDTPRPVD

SEQ ID NO: 496877 - protein, 10 aa, Influenza virus
FHWMLLDPGD

SEQ ID NO: 496878 - protein, 10 aa, Influenza virus
FHYEECSCYP

SEQ ID NO: 496879 - protein, 10 aa, Influenza virus
FIAEQFTWNG

SEQ ID NO: 496880 - protein, 10 aa, Influenza virus
FIAPDRASFF

SEQ ID NO: 496881 - protein, 10 aa, Influenza virus
FIAPDRASFL

SEQ ID NO: 496882 - protein, 10 aa, Influenza virus
FIAPDRATFL

SEQ ID NO: 496883 - protein, 10 aa, Influenza virus
FIAPDRVSFL

SEQ ID NO: 496884 - protein, 10 aa, Influenza virus
FIAPENAYKI

SEQ ID NO: 496885 - protein, 10 aa, Influenza virus
FIAPEYAFKI

SEQ ID NO: 496886 - protein, 10 aa, Influenza virus
FIAPEYAYIV

SEQ ID NO: 496887 - protein, 10 aa, Influenza virus
FIAPEYAYKI

SEQ ID NO: 496888 - protein, 10 aa, Influenza virus
FIAPEYAYKV

SEQ ID NO: 496889 - protein, 10 aa, Influenza virus
FIAPEYAYRI

SEQ ID NO: 496890 - protein, 10 aa, Influenza virus
FIAPNRASFF

SEQ ID NO: 496891 - protein, 10 aa, Influenza virus
FICIKDGNMR

SEQ ID NO: 496892 - protein, 10 aa, Influenza virus
FICIKNGNMQ

SEQ ID NO: 496893 - protein, 10 aa, Influenza virus
FICIKNGNMR

SEQ ID NO: 496894 - protein, 10 aa, Influenza virus
FICIKNGNVR

SEQ ID NO: 496895 - protein, 10 aa, Influenza virus
FICVGWSSTS

SEQ ID NO: 496896 - protein, 10 aa, Influenza virus
FICVGWSSTT

SEQ ID NO: 496897 - protein, 10 aa, Influenza virus
FICVKNGNHA

SEQ ID NO: 496898 - protein, 10 aa, Influenza virus
FICVKNGNMQ

SEQ ID NO: 496899 - protein, 10 aa, Influenza virus
FICVKNGNMR

SEQ ID NO: 496900 - protein, 10 aa, Influenza virus
FIDIWTYNAE

SEQ ID NO: 496901 - protein, 10 aa, Influenza virus
FIDVWTYNAE

SEQ ID NO: 496902 - protein, 10 aa, Influenza virus
FIEGGWCGMI

SEQ ID NO: 496903 - protein, 10 aa, Influenza virus
FIEGGWPGLI

SEQ ID NO: 496904 - protein, 10 aa, Influenza virus
FIEGGWPGLV

SEQ ID NO: 496905 - protein, 10 aa, Influenza virus
FIEGGWQGLV

SEQ ID NO: 496906 - protein, 10 aa, Influenza virus
FIEGGWQGMI

SEQ ID NO: 496907 - protein, 10 aa, Influenza virus
FIEGGWQGMV

SEQ ID NO: 496908 - protein, 10 aa, Influenza virus
FIEGGWSGLI

SEQ ID NO: 496909 - protein, 10 aa, Influenza virus
FIEGGWSGLV

SEQ ID NO: 496910 - protein, 10 aa, Influenza virus
FIEGGWSGMI

SEQ ID NO: 496911 - protein, 10 aa, Influenza virus
FIEGGWTGLI

SEQ ID NO: 496912 - protein, 10 aa, Influenza virus
FIEGGWTGMI

SEQ ID NO: 496913 - protein, 10 aa, Influenza virus
FIEGGWTGMV

SEQ ID NO: 496914 - protein, 10 aa, Influenza virus
FIEGRWPGLV

SEQ ID NO: 496915 - protein, 10 aa, Influenza virus
FIEIGVTRRE

SEQ ID NO: 496916 - protein, 10 aa, Influenza virus
FIENGWEGLI

SEQ ID NO: 496917 - protein, 10 aa, Influenza virus
FIENGWEGLV

SEQ ID NO: 496918 - protein, 10 aa, Influenza virus
FIENGWEGMI

SEQ ID NO: 496919 - protein, 10 aa, Influenza virus
FIENGWEGMM

SEQ ID NO: 496920 - protein, 10 aa, Influenza virus
FIENGWEGMV

SEQ ID NO: 496921 - protein, 10 aa, Influenza virus
FIENGWQGLI

SEQ ID NO: 496922 - protein, 10 aa, Influenza virus
FIERPTAVDT

SEQ ID NO: 496923 - protein, 10 aa, Influenza virus
FIEVEKQIGN

SEQ ID NO: 496924 - protein, 10 aa, Influenza virus
FIFGCQNGNI

SEQ ID NO: 496925 - protein, 10 aa, Influenza virus
FIFGCQNGNV

SEQ ID NO: 496926 - protein, 10 aa, Influenza virus
FIFILLTHWA

SEQ ID NO: 496927 - protein, 10 aa, Influenza virus
FIFLLLTHWA

SEQ ID NO: 496928 - protein, 10 aa, Influenza virus
FIFNGAFIAP

SEQ ID NO: 496929 - protein, 10 aa, Influenza virus
FIIKGRSHLR

SEQ ID NO: 496930 - protein, 10 aa, Influenza virus
FIIREPFISC

SEQ ID NO: 496931 - protein, 10 aa, Influenza virus
FIIREPFVSC

SEQ ID NO: 496932 - protein, 10 aa, Influenza virus
FIKDYRYTYR

SEQ ID NO: 496933 - protein, 10 aa, Influenza virus
FIKWNVTYTG

SEQ ID NO: 496934 - protein, 10 aa, Influenza virus
FILWACQNGN

SEQ ID NO: 496935 - protein, 10 aa, Influenza virus
FILWACQTGN

SEQ ID NO: 496936 - protein, 10 aa, Influenza virus
FILWACSSGN

SEQ ID NO: 496937 - protein, 10 aa, Influenza virus
FIMWACNSGN

SEQ ID NO: 496938 - protein, 10 aa, Influenza virus
FIMWACQKGN

SEQ ID NO: 496939 - protein, 10 aa, Influenza virus
FIMWACQRGN

SEQ ID NO: 496940 - protein, 10 aa, Influenza virus
FIMWACSNGN

SEQ ID NO: 496941 - protein, 10 aa, Influenza virus
FIMWACSNGS

SEQ ID NO: 496942 - protein, 10 aa, Influenza virus
FIMWACSSGN

SEQ ID NO: 496943 - protein, 10 aa, Influenza virus
FIMWTCNSGN

SEQ ID NO: 496944 - protein, 10 aa, Influenza virus
FIMWTCQKGN

SEQ ID NO: 496945 - protein, 10 aa, Influenza virus
FIQALQLLLE

SEQ ID NO: 496946 - protein, 10 aa, Influenza virus
FIQHPELTGL

SEQ ID NO: 496947 - protein, 10 aa, Influenza virus
FIQNALNGNG

SEQ ID NO: 496948 - protein, 10 aa, Influenza virus
FISCSHLECR

SEQ ID NO: 496949 - protein, 10 aa, Influenza virus
FISCSHMECR

SEQ ID NO: 496950 - protein, 10 aa, Influenza virus
FISCSHSECR

SEQ ID NO: 496951 - protein, 10 aa, Influenza virus
FISCSYLECR

SEQ ID NO: 496952 - protein, 10 aa, Influenza virus
FITPEYAYKI

SEQ ID NO: 496953 - protein, 10 aa, Influenza virus
FIVKGRSHLR

SEQ ID NO: 496954 - protein, 10 aa, Influenza virus
FIVWACQRGN

SEQ ID NO: 496955 - protein, 10 aa, Influenza virus
FIWAIHHPPT

SEQ ID NO: 496956 - protein, 10 aa, Influenza virus
FIYSGIRTNG

SEQ ID NO: 496957 - protein, 10 aa, Influenza virus
FKADLIIERR

SEQ ID NO: 496958 - protein, 10 aa, Influenza virus
FKGFFPFHKD

SEQ ID NO: 496959 - protein, 10 aa, Influenza virus
FKHQNAQGEG

SEQ ID NO: 496960 - protein, 10 aa, Influenza virus
FKISKRGGSG

SEQ ID NO: 496961 - protein, 10 aa, Influenza virus
FKISKRGNSG

SEQ ID NO: 496962 - protein, 10 aa, Influenza virus
FKISKRGSSG

SEQ ID NO: 496963 - protein, 10 aa, Influenza virus
FKISRRGNSG

SEQ ID NO: 496964 - protein, 10 aa, Influenza virus
FKLIDNEFTE

SEQ ID NO: 496965 - protein, 10 aa, Influenza virus
FKMNPNKKII

SEQ ID NO: 496966 - protein, 10 aa, Influenza virus
FKMNPNQKII

SEQ ID NO: 496967 - protein, 10 aa, Influenza virus
FKNTKGRDVL

SEQ ID NO: 496968 - protein, 10 aa, Influenza virus
FKPNGCIEGK

SEQ ID NO: 496969 - protein, 10 aa, Influenza virus
FKPNIGPRPF

SEQ ID NO: 496970 - protein, 10 aa, Influenza virus
FKPNIGPRPL

SEQ ID NO: 496971 - protein, 10 aa, Influenza virus
FKPPLPLCPF

SEQ ID NO: 496972 - protein, 10 aa, Influenza virus
FKPSLPLCPF

SEQ ID NO: 496973 - protein, 10 aa, Influenza virus
FKPSLPLCPV

SEQ ID NO: 496974 - protein, 10 aa, Influenza virus
FKQGNSVWAG

SEQ ID NO: 496975 - protein, 10 aa, Influenza virus
FKSPLPLCPF

SEQ ID NO: 496976 - protein, 10 aa, Influenza virus
FKSSLPLCPF

SEQ ID NO: 496977 - protein, 10 aa, Influenza virus
FKSTQAAINQ

SEQ ID NO: 496978 - protein, 10 aa, Influenza virus
FKSWKGNIMR

SEQ ID NO: 496979 - protein, 10 aa, Influenza virus
FKYGDGVWIG

SEQ ID NO: 496980 - protein, 10 aa, Influenza virus
FKYGNGAWIG

SEQ ID NO: 496981 - protein, 10 aa, Influenza virus
FKYGNGVWIG

SEQ ID NO: 496982 - protein, 10 aa, Influenza virus
FLAHALKLVV

SEQ ID NO: 496983 - protein, 10 aa, Influenza virus
FLAMITYITK

SEQ ID NO: 496984 - protein, 10 aa, Influenza virus
FLAMITYITR

SEQ ID NO: 496985 - protein, 10 aa, Influenza virus
FLAPRYGYII

SEQ ID NO: 496986 - protein, 10 aa, Influenza virus
FLARSALILR

SEQ ID NO: 496987 - protein, 10 aa, Influenza virus
FLCVGWSSTS

SEQ ID NO: 496988 - protein, 10 aa, Influenza virus
FLDIWTYNAE

SEQ ID NO: 496989 - protein, 10 aa, Influenza virus
FLDRLRRDQK

SEQ ID NO: 496990 - protein, 10 aa, Influenza virus
FLDVWTYNAE

SEQ ID NO: 496991 - protein, 10 aa, Influenza virus
FLDVWTYNTE

SEQ ID NO: 496992 - protein, 10 aa, Influenza virus
FLEIGVTRRE

SEQ ID NO: 496993 - protein, 10 aa, Influenza virus
FLFSSIKKYE

SEQ ID NO: 496994 - protein, 10 aa, Influenza virus
FLGQWDWPDG

SEQ ID NO: 496995 - protein, 10 aa, Influenza virus
FLGQWNWPDG

SEQ ID NO: 496996 - protein, 10 aa, Influenza virus
FLGVWTYNAE

SEQ ID NO: 496997 - protein, 10 aa, Influenza virus
FLHNGGLIAP

SEQ ID NO: 496998 - protein, 10 aa, Influenza virus
FLLMDALKLS

SEQ ID NO: 496999 - protein, 10 aa, Influenza virus
FLLMDSLKLS

SEQ ID NO: 497000 - protein, 10 aa, Influenza virus
FLNNTEPLCD

SEQ ID NO: 497001 - protein, 10 aa, Influenza virus
FLNNTEPLCE

SEQ ID NO: 497002 - protein, 10 aa, Influenza virus
FLNNTEPLCN

SEQ ID NO: 497003 - protein, 10 aa, Influenza virus
FLNVWTYNAE

SEQ ID NO: 497004 - protein, 10 aa, Influenza virus
FLPDLYDYKE

SEQ ID NO: 497005 - protein, 10 aa, Influenza virus
FLPVAGGTGS

SEQ ID NO: 497006 - protein, 10 aa, Influenza virus
FLPVAGGTSS

SEQ ID NO: 497007 - protein, 10 aa, Influenza virus
FLPVSGGTSS

SEQ ID NO: 497008 - protein, 10 aa, Influenza virus
FLPVTGGTSS

SEQ ID NO: 497009 - protein, 10 aa, Influenza virus
FLQALQLLLE

SEQ ID NO: 497010 - protein, 10 aa, Influenza virus
FLRSNAPSGI

SEQ ID NO: 497011 - protein, 10 aa, Influenza virus
FLRSNAPSGV

SEQ ID NO: 497012 - protein, 10 aa, Influenza virus
FLRVKDQQGN

SEQ ID NO: 497013 - protein, 10 aa, Influenza virus
FLRVRDQLGN

SEQ ID NO: 497014 - protein, 10 aa, Influenza virus
FLRVRDQMGN

SEQ ID NO: 497015 - protein, 10 aa, Influenza virus
FLRVRDQQGN

SEQ ID NO: 497016 - protein, 10 aa, Influenza virus
FLRVRDQRGN

SEQ ID NO: 497017 - protein, 10 aa, Influenza virus
FLSMEFSLTD

SEQ ID NO: 497018 - protein, 10 aa, Influenza virus
FLTHGALLND

SEQ ID NO: 497019 - protein, 10 aa, Influenza virus
FLTHGSLLND

SEQ ID NO: 497020 - protein, 10 aa, Influenza virus
FLTMITYITR

SEQ ID NO: 497021 - protein, 10 aa, Influenza virus
FLTQGALLND

SEQ ID NO: 497022 - protein, 10 aa, Influenza virus
FLTQGSLLND

SEQ ID NO: 497023 - protein, 10 aa, Influenza virus
FLTQGSLVND

SEQ ID NO: 497024 - protein, 10 aa, Influenza virus
FLTSSIVCPG

SEQ ID NO: 497025 - protein, 10 aa, Influenza virus
FLVALENQHT

SEQ ID NO: 497026 - protein, 10 aa, Influenza virus
FLVAVENQHT

SEQ ID NO: 497027 - protein, 10 aa, Influenza virus
FLVCVSLLQS

SEQ ID NO: 497028 - protein, 10 aa, Influenza virus
FLWCKIVTTV

SEQ ID NO: 497029 - protein, 10 aa, Influenza virus
FLWGIHHPPD

SEQ ID NO: 497030 - protein, 10 aa, Influenza virus
FLWGIHHPPN

SEQ ID NO: 497031 - protein, 10 aa, Influenza virus
FLWMCSNGSL

SEQ ID NO: 497032 - protein, 10 aa, Influenza virus
FLYIRTNGTS

SEQ ID NO: 497033 - protein, 10 aa, Influenza virus
FLYVRTNGTS

SEQ ID NO: 497034 - protein, 10 aa, Influenza virus
FMARSALILR

SEQ ID NO: 497035 - protein, 10 aa, Influenza virus
FMCVGWSSTT

SEQ ID NO: 497036 - protein, 10 aa, Influenza virus
FMCVKNGNLR

SEQ ID NO: 497037 - protein, 10 aa, Influenza virus
FMCVKNGNMR

SEQ ID NO: 497038 - protein, 10 aa, Influenza virus
FMDVWTYNAE

SEQ ID NO: 497039 - protein, 10 aa, Influenza virus
FMIIGGFIFG

SEQ ID NO: 497040 - protein, 10 aa, Influenza virus
FMLWACQNGN

SEQ ID NO: 497041 - protein, 10 aa, Influenza virus
FMQALQLLFE

SEQ ID NO: 497042 - protein, 10 aa, Influenza virus
FMQALQLLLE

SEQ ID NO: 497043 - protein, 10 aa, Influenza virus
FMWAIHHPPT

SEQ ID NO: 497044 - protein, 10 aa, Influenza virus
FMYSDFHFID

SEQ ID NO: 497045 - protein, 10 aa, Influenza virus
FMYSDFHFIN

SEQ ID NO: 497046 - protein, 10 aa, Influenza virus
FNCLYASPQL

SEQ ID NO: 497047 - protein, 10 aa, Influenza virus
FNDYEELKHL

SEQ ID NO: 497048 - protein, 10 aa, Influenza virus
FNEGHIEECS

SEQ ID NO: 497049 - protein, 10 aa, Influenza virus
FNEIEHQIGN

SEQ ID NO: 497050 - protein, 10 aa, Influenza virus
FNEIEQQIGN

SEQ ID NO: 497051 - protein, 10 aa, Influenza virus
FNEIEYQIGN

SEQ ID NO: 497052 - protein, 10 aa, Influenza virus
FNEVEKQIGN

SEQ ID NO: 497053 - protein, 10 aa, Influenza virus
FNEVEQQIGN

SEQ ID NO: 497054 - protein, 10 aa, Influenza virus
FNFFHKCNDS

SEQ ID NO: 497055 - protein, 10 aa, Influenza virus
FNFILLTHWA

SEQ ID NO: 497056 - protein, 10 aa, Influenza virus
FNFNGAFIAP

SEQ ID NO: 497057 - protein, 10 aa, Influenza virus
FNFNGAFVAP

SEQ ID NO: 497058 - protein, 10 aa, Influenza virus
FNGAFIAPDR

SEQ ID NO: 497059 - protein, 10 aa, Influenza virus
FNGAFIAPNR

SEQ ID NO: 497060 - protein, 10 aa, Influenza virus
FNGAFVAPDR

SEQ ID NO: 497061 - protein, 10 aa, Influenza virus
FNGGHIEECS

SEQ ID NO: 497062 - protein, 10 aa, Influenza virus
FNGSLQCRIC

SEQ ID NO: 497063 - protein, 10 aa, Influenza virus
FNKACELTDS

SEQ ID NO: 497064 - protein, 10 aa, Influenza virus
FNKLYIWGVH

SEQ ID NO: 497065 - protein, 10 aa, Influenza virus
FNLLHKCNDS

SEQ ID NO: 497066 - protein, 10 aa, Influenza virus
FNLLIGISNV

SEQ ID NO: 497067 - protein, 10 aa, Influenza virus
FNMERIKELR

SEQ ID NO: 497068 - protein, 10 aa, Influenza virus
FNMLSTVLGV

SEQ ID NO: 497069 - protein, 10 aa, Influenza virus
FNNIKGRDVL

SEQ ID NO: 497070 - protein, 10 aa, Influenza virus
FNNLEKRLEN

SEQ ID NO: 497071 - protein, 10 aa, Influenza virus
FNNLERRLEN

SEQ ID NO: 497072 - protein, 10 aa, Influenza virus
FNNLTKELCT

SEQ ID NO: 497073 - protein, 10 aa, Influenza virus
FNNLTKGLCT

SEQ ID NO: 497074 - protein, 10 aa, Influenza virus
FNNLTKRLCT

SEQ ID NO: 497075 - protein, 10 aa, Influenza virus
FNNLTRELCT

SEQ ID NO: 497076 - protein, 10 aa, Influenza virus
FNNLTRGLCT

SEQ ID NO: 497077 - protein, 10 aa, Influenza virus
FNNTEPLCEV

SEQ ID NO: 497078 - protein, 10 aa, Influenza virus
FNNTKERDVL

SEQ ID NO: 497079 - protein, 10 aa, Influenza virus
FNNTKGGDVL

SEQ ID NO: 497080 - protein, 10 aa, Influenza virus
FNNTKGRDVL

SEQ ID NO: 497081 - protein, 10 aa, Influenza virus
FNNYEELKHL

SEQ ID NO: 497082 - protein, 10 aa, Influenza virus
FNPCFYVELI

SEQ ID NO: 497083 - protein, 10 aa, Influenza virus
FNPMIAELAE

SEQ ID NO: 497084 - protein, 10 aa, Influenza virus
FNPMIIELAE

SEQ ID NO: 497085 - protein, 10 aa, Influenza virus
FNPMIVELAE

SEQ ID NO: 497086 - protein, 10 aa, Influenza virus
FNPMTVELAE

SEQ ID NO: 497087 - protein, 10 aa, Influenza virus
FNPMVVELAE

SEQ ID NO: 497088 - protein, 10 aa, Influenza virus
FNQVEKRINM

SEQ ID NO: 497089 - protein, 10 aa, Influenza virus
FNQVENRINM

SEQ ID NO: 497090 - protein, 10 aa, Influenza virus
FNQVEQRINM

SEQ ID NO: 497091 - protein, 10 aa, Influenza virus
FNSDLDYQIG

SEQ ID NO: 497092 - protein, 10 aa, Influenza virus
FNSDPDYQIG

SEQ ID NO: 497093 - protein, 10 aa, Influenza virus
FNSIGNLIAP

SEQ ID NO: 497094 - protein, 10 aa, Influenza virus
FNSIYASPQL

SEQ ID NO: 497095 - protein, 10 aa, Influenza virus
FNSLYASPQL

SEQ ID NO: 497096 - protein, 10 aa, Influenza virus
FNSLYASSQL

SEQ ID NO: 497097 - protein, 10 aa, Influenza virus
FNSLYSSPQL

SEQ ID NO: 497098 - protein, 10 aa, Influenza virus
FNSNLDYQIG

SEQ ID NO: 497099 - protein, 10 aa, Influenza virus
FNTIGNLIAP

SEQ ID NO: 497100 - protein, 10 aa, Influenza virus
FNTIGNLVAP

SEQ ID NO: 497101 - protein, 10 aa, Influenza virus
FPDGAKIQYF

SEQ ID NO: 497102 - protein, 10 aa, Influenza virus
FPDGAQIKYF

SEQ ID NO: 497103 - protein, 10 aa, Influenza virus
FPDGAQIQYF

SEQ ID NO: 497104 - protein, 10 aa, Influenza virus
FPDGPQIQYF

SEQ ID NO: 497105 - protein, 10 aa, Influenza virus
FPFHKDNAIR

SEQ ID NO: 497106 - protein, 10 aa, Influenza virus
FPFHKDNALR

SEQ ID NO: 497107 - protein, 10 aa, Influenza virus
FPFHKDNAVR

SEQ ID NO: 497108 - protein, 10 aa, Influenza virus
FPFHKGNSAR

SEQ ID NO: 497109 - protein, 10 aa, Influenza virus
FPGELDNNGE

SEQ ID NO: 497110 - protein, 10 aa, Influenza virus
FPGEVDNNGE

SEQ ID NO: 497111 - protein, 10 aa, Influenza virus
FPIGTAPILG

SEQ ID NO: 497112 - protein, 10 aa, Influenza virus
FPIGTAPVLG

SEQ ID NO: 497113 - protein, 10 aa, Influenza virus
FPIGVAPVLG

SEQ ID NO: 497114 - protein, 10 aa, Influenza virus
FPMGTAPVLG

SEQ ID NO: 497115 - protein, 10 aa, Influenza virus
FPNEVGAKIL

SEQ ID NO: 497116 - protein, 10 aa, Influenza virus
FPNEVGARII

SEQ ID NO: 497117 - protein, 10 aa, Influenza virus
FPNEVGARIL

SEQ ID NO: 497118 - protein, 10 aa, Influenza virus
FPNGAQIQYF

SEQ ID NO: 497119 - protein, 10 aa, Influenza virus
FPQLNQTYRN

SEQ ID NO: 497120 - protein, 10 aa, Influenza virus
FPQMTKSYKN

SEQ ID NO: 497121 - protein, 10 aa, Influenza virus
FPQMTKSYRN

SEQ ID NO: 497122 - protein, 10 aa, Influenza virus
FPQMTRSYKN

SEQ ID NO: 497123 - protein, 10 aa, Influenza virus
FPQTANTYRN

SEQ ID NO: 497124 - protein, 10 aa, Influenza virus
FPQTTKSYKN

SEQ ID NO: 497125 - protein, 10 aa, Influenza virus
FPQTTNTYRN

SEQ ID NO: 497126 - protein, 10 aa, Influenza virus
FPRTTNTYRN

SEQ ID NO: 497127 - protein, 10 aa, Influenza virus
FPSSSYRRPI

SEQ ID NO: 497128 - protein, 10 aa, Influenza virus
FPSSSYRRPV

SEQ ID NO: 497129 - protein, 10 aa, Influenza virus
FPSTGNHGSL

SEQ ID NO: 497130 - protein, 10 aa, Influenza virus
FPVGSGSFPD

SEQ ID NO: 497131 - protein, 10 aa, Influenza virus
FPVGTAPVLG

SEQ ID NO: 497132 - protein, 10 aa, Influenza virus
FPVQTDEYKN

SEQ ID NO: 497133 - protein, 10 aa, Influenza virus
FPYTGDPPYS

SEQ ID NO: 497134 - protein, 10 aa, Influenza virus
FQGFFPFHKD

SEQ ID NO: 497135 - protein, 10 aa, Influenza virus
FQGGHIEECS

SEQ ID NO: 497136 - protein, 10 aa, Influenza virus
FQGRGVFEFS

SEQ ID NO: 497137 - protein, 10 aa, Influenza virus
FQGRGVFELS

SEQ ID NO: 497138 - protein, 10 aa, Influenza virus
FQHQNAEGIG

SEQ ID NO: 497139 - protein, 10 aa, Influenza virus
FQHQNAEGTG

SEQ ID NO: 497140 - protein, 10 aa, Influenza virus
FQHQNEQGMG

SEQ ID NO: 497141 - protein, 10 aa, Influenza virus
FQHQNEQGTG

SEQ ID NO: 497142 - protein, 10 aa, Influenza virus
FQHQNEQGVG

SEQ ID NO: 497143 - protein, 10 aa, Influenza virus
FQHQNSEGTG

SEQ ID NO: 497144 - protein, 10 aa, Influenza virus
FQHRNDEGTG

SEQ ID NO: 497145 - protein, 10 aa, Influenza virus
FQHRNEEGTG

SEQ ID NO: 497146 - protein, 10 aa, Influenza virus
FQIQGIKLTQ

SEQ ID NO: 497147 - protein, 10 aa, Influenza virus
FQIQGVKLAQ

SEQ ID NO: 497148 - protein, 10 aa, Influenza virus
FQIQGVKLIQ

SEQ ID NO: 497149 - protein, 10 aa, Influenza virus
FQIQGVKLTQ

SEQ ID NO: 497150 - protein, 10 aa, Influenza virus
FQIQGVRLTQ

SEQ ID NO: 497151 - protein, 10 aa, Influenza virus
FQLFLVCVSL

SEQ ID NO: 497152 - protein, 10 aa, Influenza virus
FQLIPMISKC

SEQ ID NO: 497153 - protein, 10 aa, Influenza virus
FQLIPMISKS

SEQ ID NO: 497154 - protein, 10 aa, Influenza virus
FQNASRHHMG

SEQ ID NO: 497155 - protein, 10 aa, Influenza virus
FQNASRHYMG

SEQ ID NO: 497156 - protein, 10 aa, Influenza virus
FQNASRYYMG

SEQ ID NO: 497157 - protein, 10 aa, Influenza virus
FQNICKPYIG

SEQ ID NO: 497158 - protein, 10 aa, Influenza virus
FQNIDKNALG

SEQ ID NO: 497159 - protein, 10 aa, Influenza virus
FQNIDRNAIG

SEQ ID NO: 497160 - protein, 10 aa, Influenza virus
FQNIDRNALG

SEQ ID NO: 497161 - protein, 10 aa, Influenza virus
FQNIDSRAVG

SEQ ID NO: 497162 - protein, 10 aa, Influenza virus
FQNIDSWAVG

SEQ ID NO: 497163 - protein, 10 aa, Influenza virus
FQNIEKNALG

SEQ ID NO: 497164 - protein, 10 aa, Influenza virus
FQNIERNALG

SEQ ID NO: 497165 - protein, 10 aa, Influenza virus
FQNIHPATIG

SEQ ID NO: 497166 - protein, 10 aa, Influenza virus
FQNIHPITIG

SEQ ID NO: 497167 - protein, 10 aa, Influenza virus
FQNIHPVTIG

SEQ ID NO: 497168 - protein, 10 aa, Influenza virus
FQNISPVWIG

SEQ ID NO: 497169 - protein, 10 aa, Influenza virus
FQNLSPRTVG

SEQ ID NO: 497170 - protein, 10 aa, Influenza virus
FQNQVKIRRR

SEQ ID NO: 497171 - protein, 10 aa, Influenza virus
FQNTSKHYIG

SEQ ID NO: 497172 - protein, 10 aa, Influenza virus
FQNTSRHYIG

SEQ ID NO: 497173 - protein, 10 aa, Influenza virus
FQNTSRHYMG

SEQ ID NO: 497174 - protein, 10 aa, Influenza virus
FQNVHPITIG

SEQ ID NO: 497175 - protein, 10 aa, Influenza virus
FQNVHPVTIG

SEQ ID NO: 497176 - protein, 10 aa, Influenza virus
FQNVNKITYG

SEQ ID NO: 497177 - protein, 10 aa, Influenza virus
FQNVNKVTYG

SEQ ID NO: 497178 - protein, 10 aa, Influenza virus
FQNVNRITYG

SEQ ID NO: 497179 - protein, 10 aa, Influenza virus
FQNVSPIWIG

SEQ ID NO: 497180 - protein, 10 aa, Influenza virus
FQNVSPLWIG

SEQ ID NO: 497181 - protein, 10 aa, Influenza virus
FQNVSPLWVG

SEQ ID NO: 497182 - protein, 10 aa, Influenza virus
FQNVSPVWIG

SEQ ID NO: 497183 - protein, 10 aa, Influenza virus
FQNVSRIAIG

SEQ ID NO: 497184 - protein, 10 aa, Influenza virus
FQPCFYIELI

SEQ ID NO: 497185 - protein, 10 aa, Influenza virus
FQPCFYVELI

SEQ ID NO: 497186 - protein, 10 aa, Influenza virus
FQPCFYVELT

SEQ ID NO: 497187 - protein, 10 aa, Influenza virus
FQPNIGPRAL

SEQ ID NO: 497188 - protein, 10 aa, Influenza virus
FQPNIGPRPL

SEQ ID NO: 497189 - protein, 10 aa, Influenza virus
FQQMRDILGT

SEQ ID NO: 497190 - protein, 10 aa, Influenza virus
FQQMRDVLGT

SEQ ID NO: 497191 - protein, 10 aa, Influenza virus
FQRKRRIRDN

SEQ ID NO: 497192 - protein, 10 aa, Influenza virus
FQRKRRVRDN

SEQ ID NO: 497193 - protein, 10 aa, Influenza virus
FQRSKFLLMD

SEQ ID NO: 497194 - protein, 10 aa, Influenza virus
FQSCFYVELI

SEQ ID NO: 497195 - protein, 10 aa, Influenza virus
FQSGHIEECS

SEQ ID NO: 497196 - protein, 10 aa, Influenza virus
FQTAAQKAMM

SEQ ID NO: 497197 - protein, 10 aa, Influenza virus
FQTAAQRAMM

SEQ ID NO: 497198 - protein, 10 aa, Influenza virus
FQTAAQRAMV

SEQ ID NO: 497199 - protein, 10 aa, Influenza virus
FQVDCFIWHI

SEQ ID NO: 497200 - protein, 10 aa, Influenza virus
FQVDCFLWHI

SEQ ID NO: 497201 - protein, 10 aa, Influenza virus
FQVDCFLWHV

SEQ ID NO: 497202 - protein, 10 aa, Influenza virus
FQVDCFLWYV

SEQ ID NO: 497203 - protein, 10 aa, Influenza virus
FQVDCYLWHI

SEQ ID NO: 497204 - protein, 10 aa, Influenza virus
FQYLLFQDIL

SEQ ID NO: 497205 - protein, 10 aa, Influenza virus
FRALISWEMG

SEQ ID NO: 497206 - protein, 10 aa, Influenza virus
FRALISWGMG

SEQ ID NO: 497207 - protein, 10 aa, Influenza virus
FRALVSWEMG

SEQ ID NO: 497208 - protein, 10 aa, Influenza virus
FRAYVDGFEP

SEQ ID NO: 497209 - protein, 10 aa, Influenza virus
FRAYVDGFKP

SEQ ID NO: 497210 - protein, 10 aa, Influenza virus
FRDNLEPGTF

SEQ ID NO: 497211 - protein, 10 aa, Influenza virus
FRDYEELKHL

SEQ ID NO: 497212 - protein, 10 aa, Influenza virus
FREQKQEFKM

SEQ ID NO: 497213 - protein, 10 aa, Influenza virus
FRGFFPFHKD

SEQ ID NO: 497214 - protein, 10 aa, Influenza virus
FRGLISTHLG

SEQ ID NO: 497215 - protein, 10 aa, Influenza virus
FRGLISTPLG

SEQ ID NO: 497216 - protein, 10 aa, Influenza virus
FRGLISTQLG

SEQ ID NO: 497217 - protein, 10 aa, Influenza virus
FRGLLSTPLG

SEQ ID NO: 497218 - protein, 10 aa, Influenza virus
FRGLMSTPLG

SEQ ID NO: 497219 - protein, 10 aa, Influenza virus
FRGRGVFELS

SEQ ID NO: 497220 - protein, 10 aa, Influenza virus
FRHQKAQGEG

SEQ ID NO: 497221 - protein, 10 aa, Influenza virus
FRHQNAEGTG

SEQ ID NO: 497222 - protein, 10 aa, Influenza virus
FRHQNAQGEG

SEQ ID NO: 497223 - protein, 10 aa, Influenza virus
FRHQNAQGIG

SEQ ID NO: 497224 - protein, 10 aa, Influenza virus
FRHQNAQGQG

SEQ ID NO: 497225 - protein, 10 aa, Influenza virus
FRHQNAQGTG

SEQ ID NO: 497226 - protein, 10 aa, Influenza virus
FRHQNSEGTG

SEQ ID NO: 497227 - protein, 10 aa, Influenza virus
FRHQNSQGEG

SEQ ID NO: 497228 - protein, 10 aa, Influenza virus
FRISKRGSSG

SEQ ID NO: 497229 - protein, 10 aa, Influenza virus
FRNALSIAPI

SEQ ID NO: 497230 - protein, 10 aa, Influenza virus
FRNILSIAPI

SEQ ID NO: 497231 - protein, 10 aa, Influenza virus
FRNILSMAPI

SEQ ID NO: 497232 - protein, 10 aa, Influenza virus
FRNQIKIRRR

SEQ ID NO: 497233 - protein, 10 aa, Influenza virus
FRNQVKIRRR

SEQ ID NO: 497234 - protein, 10 aa, Influenza virus
FRNVLSIAPI

SEQ ID NO: 497235 - protein, 10 aa, Influenza virus
FRNVLSVAPI

SEQ ID NO: 497236 - protein, 10 aa, Influenza virus
FRNVVWLIKK

SEQ ID NO: 497237 - protein, 10 aa, Influenza virus
FRNVVWLTKK

SEQ ID NO: 497238 - protein, 10 aa, Influenza virus
FRNVVWLVKK

SEQ ID NO: 497239 - protein, 10 aa, Influenza virus
FRPNIGPRPL

SEQ ID NO: 497240 - protein, 10 aa, Influenza virus
FRQGNSVWAG

SEQ ID NO: 497241 - protein, 10 aa, Influenza virus
FRQGTSVWAG

SEQ ID NO: 497242 - protein, 10 aa, Influenza virus
FRQSERGEDT

SEQ ID NO: 497243 - protein, 10 aa, Influenza virus
FRQSERGEET

SEQ ID NO: 497244 - protein, 10 aa, Influenza virus
FRRPDSSWLF

SEQ ID NO: 497245 - protein, 10 aa, Influenza virus
FRTLMSCPIG

SEQ ID NO: 497246 - protein, 10 aa, Influenza virus
FRTLMSCPMG

SEQ ID NO: 497247 - protein, 10 aa, Influenza virus
FRTLMSCPVG

SEQ ID NO: 497248 - protein, 10 aa, Influenza virus
FRTYVDGFEP

SEQ ID NO: 497249 - protein, 10 aa, Influenza virus
FRTYVDGFKP

SEQ ID NO: 497250 - protein, 10 aa, Influenza virus
FRVYVDGFEP

SEQ ID NO: 497251 - protein, 10 aa, Influenza virus
FRYGDGVWIG

SEQ ID NO: 497252 - protein, 10 aa, Influenza virus
FRYGNGVWIG

SEQ ID NO: 497253 - protein, 10 aa, Influenza virus
FRYSGIKTDG

SEQ ID NO: 497254 - protein, 10 aa, Influenza virus
FRYSGIRTDG

SEQ ID NO: 497255 - protein, 10 aa, Influenza virus
FSAESRKLLL

SEQ ID NO: 497256 - protein, 10 aa, Influenza virus
FSAESRKMLL

SEQ ID NO: 497257 - protein, 10 aa, Influenza virus
FSARSALILR

SEQ ID NO: 497258 - protein, 10 aa, Influenza virus
FSDYEELKHL

SEQ ID NO: 497259 - protein, 10 aa, Influenza virus
FSEIEGRIQD

SEQ ID NO: 497260 - protein, 10 aa, Influenza virus
FSEIEHQIGN

SEQ ID NO: 497261 - protein, 10 aa, Influenza virus
FSEIEHQISN

SEQ ID NO: 497262 - protein, 10 aa, Influenza virus
FSEIEQQIGN

SEQ ID NO: 497263 - protein, 10 aa, Influenza virus
FSETEHQIGN

SEQ ID NO: 497264 - protein, 10 aa, Influenza virus
FSEVEGRIQD

SEQ ID NO: 497265 - protein, 10 aa, Influenza virus
FSFGASCFIL

SEQ ID NO: 497266 - protein, 10 aa, Influenza virus
FSFGASCFLF

SEQ ID NO: 497267 - protein, 10 aa, Influenza virus
FSFGASCFLL

SEQ ID NO: 497268 - protein, 10 aa, Influenza virus
FSFGASCFTL

SEQ ID NO: 497269 - protein, 10 aa, Influenza virus
FSFGASCFVL

SEQ ID NO: 497270 - protein, 10 aa, Influenza virus
FSFGASCLIL

SEQ ID NO: 497271 - protein, 10 aa, Influenza virus
FSFGASCVML

SEQ ID NO: 497272 - protein, 10 aa, Influenza virus
FSFGASSFVL

SEQ ID NO: 497273 - protein, 10 aa, Influenza virus
FSFGGFTFKR

SEQ ID NO: 497274 - protein, 10 aa, Influenza virus
FSFIGEEMAT

SEQ ID NO: 497275 - protein, 10 aa, Influenza virus
FSFKYGNGVW

SEQ ID NO: 497276 - protein, 10 aa, Influenza virus
FSFNGAFIAP

SEQ ID NO: 497277 - protein, 10 aa, Influenza virus
FSFNGAFVAP

SEQ ID NO: 497278 - protein, 10 aa, Influenza virus
FSFNGEEMAT

SEQ ID NO: 497279 - protein, 10 aa, Influenza virus
FSFQLINNKK

SEQ ID NO: 497280 - protein, 10 aa, Influenza virus
FSFRYGDGVW

SEQ ID NO: 497281 - protein, 10 aa, Influenza virus
FSFRYGNGVW

SEQ ID NO: 497282 - protein, 10 aa, Influenza virus
FSFTGEEMAS

SEQ ID NO: 497283 - protein, 10 aa, Influenza virus
FSFTGEEMAT

SEQ ID NO: 497284 - protein, 10 aa, Influenza virus
FSGGHIEECS

SEQ ID NO: 497285 - protein, 10 aa, Influenza virus
FSGIKSFSRT

SEQ ID NO: 497286 - protein, 10 aa, Influenza virus
FSGIRSFSRT

SEQ ID NO: 497287 - protein, 10 aa, Influenza virus
FSGMSANGDI

SEQ ID NO: 497288 - protein, 10 aa, Influenza virus
FSGSQKQEFK

SEQ ID NO: 497289 - protein, 10 aa, Influenza virus
FSGVNSFSRT

SEQ ID NO: 497290 - protein, 10 aa, Influenza virus
FSGYKDIILW

SEQ ID NO: 497291 - protein, 10 aa, Influenza virus
FSHNGGLIAP

SEQ ID NO: 497292 - protein, 10 aa, Influenza virus
FSHNGGLVAP

SEQ ID NO: 497293 - protein, 10 aa, Influenza virus
FSHNGGRIAP

SEQ ID NO: 497294 - protein, 10 aa, Influenza virus
FSHYNQITQT

SEQ ID NO: 497295 - protein, 10 aa, Influenza virus
FSHYNQMKQA

SEQ ID NO: 497296 - protein, 10 aa, Influenza virus
FSHYNQMTQA

SEQ ID NO: 497297 - protein, 10 aa, Influenza virus
FSHYNQVTQP

SEQ ID NO: 497298 - protein, 10 aa, Influenza virus
FSHYNQVTQT

SEQ ID NO: 497299 - protein, 10 aa, Influenza virus
FSIAASYKRI

SEQ ID NO: 497300 - protein, 10 aa, Influenza virus
FSILHKCNDS

SEQ ID NO: 497301 - protein, 10 aa, Influenza virus
FSIRGETTGR

SEQ ID NO: 497302 - protein, 10 aa, Influenza virus
FSIRWETTGR

SEQ ID NO: 497303 - protein, 10 aa, Influenza virus
FSISCFLLAA

SEQ ID NO: 497304 - protein, 10 aa, Influenza virus
FSISCFLLIA

SEQ ID NO: 497305 - protein, 10 aa, Influenza virus
FSISCFLLVA

SEQ ID NO: 497306 - protein, 10 aa, Influenza virus
FSKDNAIRIG

SEQ ID NO: 497307 - protein, 10 aa, Influenza virus
FSKDNGIRIG

SEQ ID NO: 497308 - protein, 10 aa, Influenza virus
FSKDNSIQLS

SEQ ID NO: 497309 - protein, 10 aa, Influenza virus
FSKDNSIRLA

SEQ ID NO: 497310 - protein, 10 aa, Influenza virus
FSKDNSIRLS

SEQ ID NO: 497311 - protein, 10 aa, Influenza virus
FSKDNSVRLS

SEQ ID NO: 497312 - protein, 10 aa, Influenza virus
FSKWNVTYTG

SEQ ID NO: 497313 - protein, 10 aa, Influenza virus
FSLGASCFLL

SEQ ID NO: 497314 - protein, 10 aa, Influenza virus
FSLLHKCNDS

SEQ ID NO: 497315 - protein, 10 aa, Influenza virus
FSMELPSFGV

SEQ ID NO: 497316 - protein, 10 aa, Influenza virus
FSMSCFVFVA

SEQ ID NO: 497317 - protein, 10 aa, Influenza virus
FSNAASYKRI

SEQ ID NO: 497318 - protein, 10 aa, Influenza virus
FSNKMARLGK

SEQ ID NO: 497319 - protein, 10 aa, Influenza virus
FSNKMARLGR

SEQ ID NO: 497320 - protein, 10 aa, Influenza virus
FSNKVARLGK

SEQ ID NO: 497321 - protein, 10 aa, Influenza virus
FSNLEKRLEN

SEQ ID NO: 497322 - protein, 10 aa, Influenza virus
FSNLERRLEN

SEQ ID NO: 497323 - protein, 10 aa, Influenza virus
FSPRSRSGFE

SEQ ID NO: 497324 - protein, 10 aa, Influenza virus
FSPSPGARPK

SEQ ID NO: 497325 - protein, 10 aa, Influenza virus
FSPSPGDRPK

SEQ ID NO: 497326 - protein, 10 aa, Influenza virus
FSQEDCMIKA

SEQ ID NO: 497327 - protein, 10 aa, Influenza virus
FSQEDCMMKA

SEQ ID NO: 497328 - protein, 10 aa, Influenza virus
FSQEDCMVKA

SEQ ID NO: 497329 - protein, 10 aa, Influenza virus
FSQEDRMIKA

SEQ ID NO: 497330 - protein, 10 aa, Influenza virus
FSQEECMIKA

SEQ ID NO: 497331 - protein, 10 aa, Influenza virus
FSQVEQRINM

SEQ ID NO: 497332 - protein, 10 aa, Influenza virus
FSQVERRINM

SEQ ID NO: 497333 - protein, 10 aa, Influenza virus
FSRLNWLTKA

SEQ ID NO: 497334 - protein, 10 aa, Influenza virus
FSRLNWLTKE

SEQ ID NO: 497335 - protein, 10 aa, Influenza virus
FSRTELINPN

SEQ ID NO: 497336 - protein, 10 aa, Influenza virus
FSRTELINPS

SEQ ID NO: 497337 - protein, 10 aa, Influenza virus
FSRTELIPPS

SEQ ID NO: 497338 - protein, 10 aa, Influenza virus
FSRTELISPN

SEQ ID NO: 497339 - protein, 10 aa, Influenza virus
FSRTELISPS

SEQ ID NO: 497340 - protein, 10 aa, Influenza virus
FSSAASYKRI

SEQ ID NO: 497341 - protein, 10 aa, Influenza virus
FSSAASYKRV

SEQ ID NO: 497342 - protein, 10 aa, Influenza virus
FSSIKKYERV

SEQ ID NO: 497343 - protein, 10 aa, Influenza virus
FSSIKRYERV

SEQ ID NO: 497344 - protein, 10 aa, Influenza virus
FSSLAVNVRG

SEQ ID NO: 497345 - protein, 10 aa, Influenza virus
FSSLTVNVRG

SEQ ID NO: 497346 - protein, 10 aa, Influenza virus
FSSLTVSVRG

SEQ ID NO: 497347 - protein, 10 aa, Influenza virus
FSSNGAFIAP

SEQ ID NO: 497348 - protein, 10 aa, Influenza virus
FSVGSGSFPD

SEQ ID NO: 497349 - protein, 10 aa, Influenza virus
FSVQRNLPFD

SEQ ID NO: 497350 - protein, 10 aa, Influenza virus
FSVQRNLPFE

SEQ ID NO: 497351 - protein, 10 aa, Influenza virus
FSVQRSLPFE

SEQ ID NO: 497352 - protein, 10 aa, Influenza virus
FSYKYDNGVW

SEQ ID NO: 497353 - protein, 10 aa, Influenza virus
FSYKYGNGVW

SEQ ID NO: 497354 - protein, 10 aa, Influenza virus
FSYRYGNGVW

SEQ ID NO: 497355 - protein, 10 aa, Influenza virus
FTAEISHCRA

SEQ ID NO: 497356 - protein, 10 aa, Influenza virus
FTAEVSHCRA

SEQ ID NO: 497357 - protein, 10 aa, Influenza virus
FTAEVSYCRA

SEQ ID NO: 497358 - protein, 10 aa, Influenza virus
FTDGSATGPA

SEQ ID NO: 497359 - protein, 10 aa, Influenza virus
FTEGHIEECS

SEQ ID NO: 497360 - protein, 10 aa, Influenza virus
FTEIGVTRRE

SEQ ID NO: 497361 - protein, 10 aa, Influenza virus
FTEVEGRIQD

SEQ ID NO: 497362 - protein, 10 aa, Influenza virus
FTEVEKQIGN

SEQ ID NO: 497363 - protein, 10 aa, Influenza virus
FTEVEQQIGN

SEQ ID NO: 497364 - protein, 10 aa, Influenza virus
FTFKRTKGFS

SEQ ID NO: 497365 - protein, 10 aa, Influenza virus
FTFKRTKGSS

SEQ ID NO: 497366 - protein, 10 aa, Influenza virus
FTFKRTNGSS

SEQ ID NO: 497367 - protein, 10 aa, Influenza virus
FTFKRTSGSS

SEQ ID NO: 497368 - protein, 10 aa, Influenza virus
FTFKRTSGTS

SEQ ID NO: 497369 - protein, 10 aa, Influenza virus
FTFNGAFIAP

SEQ ID NO: 497370 - protein, 10 aa, Influenza virus
FTGWILGNPM

SEQ ID NO: 497371 - protein, 10 aa, Influenza virus
FTIGECPKYV

SEQ ID NO: 497372 - protein, 10 aa, Influenza virus
FTITGDNTKW

SEQ ID NO: 497373 - protein, 10 aa, Influenza virus
FTKWNVTHTG

SEQ ID NO: 497374 - protein, 10 aa, Influenza virus
FTKWNVTYTG

SEQ ID NO: 497375 - protein, 10 aa, Influenza virus
FTLSGVAIAL

SEQ ID NO: 497376 - protein, 10 aa, Influenza virus
FTLTVPSERG

SEQ ID NO: 497377 - protein, 10 aa, Influenza virus
FTNEEALRQI

SEQ ID NO: 497378 - protein, 10 aa, Influenza virus
FTNEESLRQI

SEQ ID NO: 497379 - protein, 10 aa, Influenza virus
FTNEESLRQV

SEQ ID NO: 497380 - protein, 10 aa, Influenza virus
FTSFFYRYGF

SEQ ID NO: 497381 - protein, 10 aa, Influenza virus
FTTEVSHCRA

SEQ ID NO: 497382 - protein, 10 aa, Influenza virus
FTWAIHHPPT

SEQ ID NO: 497383 - protein, 10 aa, Influenza virus
FTWNGVKVDG

SEQ ID NO: 497384 - protein, 10 aa, Influenza virus
FTYNGIRTNG

SEQ ID NO: 497385 - protein, 10 aa, Influenza virus
FTYSGIRTDG

SEQ ID NO: 497386 - protein, 10 aa, Influenza virus
FTYSGIRTNG

SEQ ID NO: 497387 - protein, 10 aa, Influenza virus
FTYTGVRTDG

SEQ ID NO: 497388 - protein, 10 aa, Influenza virus
FTYTGVRTNG

SEQ ID NO: 497389 - protein, 10 aa, Influenza virus
FVACGPAECR

SEQ ID NO: 497390 - protein, 10 aa, Influenza virus
FVACGPSECR

SEQ ID NO: 497391 - protein, 10 aa, Influenza virus
FVACGPTECR

SEQ ID NO: 497392 - protein, 10 aa, Influenza virus
FVACSPSECR

SEQ ID NO: 497393 - protein, 10 aa, Influenza virus
FVALILGFVL

SEQ ID NO: 497394 - protein, 10 aa, Influenza virus
FVANFSMELP

SEQ ID NO: 497395 - protein, 10 aa, Influenza virus
FVAPDRVSFF

SEQ ID NO: 497396 - protein, 10 aa, Influenza virus
FVEIGVTRRE

SEQ ID NO: 497397 - protein, 10 aa, Influenza virus
FVENLEELRF

SEQ ID NO: 497398 - protein, 10 aa, Influenza virus
FVFSIAASYK

SEQ ID NO: 497399 - protein, 10 aa, Influenza virus
FVFSNAASYK

SEQ ID NO: 497400 - protein, 10 aa, Influenza virus
FVFSSAASYK

SEQ ID NO: 497401 - protein, 10 aa, Influenza virus
FVFTLTVPSE

SEQ ID NO: 497402 - protein, 10 aa, Influenza virus
FVFVALILGF

SEQ ID NO: 497403 - protein, 10 aa, Influenza virus
FVIREPCISC

SEQ ID NO: 497404 - protein, 10 aa, Influenza virus
FVIREPFISC

SEQ ID NO: 497405 - protein, 10 aa, Influenza virus
FVIREPFVAC

SEQ ID NO: 497406 - protein, 10 aa, Influenza virus
FVIREPFVSC

SEQ ID NO: 497407 - protein, 10 aa, Influenza virus
FVIVSKDNGI

SEQ ID NO: 497408 - protein, 10 aa, Influenza virus
FVLMENERTL

SEQ ID NO: 497409 - protein, 10 aa, Influenza virus
FVLWACQNGN

SEQ ID NO: 497410 - protein, 10 aa, Influenza virus
FVMREPFISC

SEQ ID NO: 497411 - protein, 10 aa, Influenza virus
FVMWACQKGN

SEQ ID NO: 497412 - protein, 10 aa, Influenza virus
FVNEEALRQI

SEQ ID NO: 497413 - protein, 10 aa, Influenza virus
FVNGEALRQI

SEQ ID NO: 497414 - protein, 10 aa, Influenza virus
FVNMTNVQNN

SEQ ID NO: 497415 - protein, 10 aa, Influenza virus
FVNRANQRLN

SEQ ID NO: 497416 - protein, 10 aa, Influenza virus
FVNVTHVQNN

SEQ ID NO: 497417 - protein, 10 aa, Influenza virus
FVNVTNVQND

SEQ ID NO: 497418 - protein, 10 aa, Influenza virus
FVNVTNVQNN

SEQ ID NO: 497419 - protein, 10 aa, Influenza virus
FVPVIGARPQ

SEQ ID NO: 497420 - protein, 10 aa, Influenza virus
FVPVMGARPQ

SEQ ID NO: 497421 - protein, 10 aa, Influenza virus
FVPVVGARPQ

SEQ ID NO: 497422 - protein, 10 aa, Influenza virus
FVPVVGDRPL

SEQ ID NO: 497423 - protein, 10 aa, Influenza virus
FVPVVRARPQ

SEQ ID NO: 497424 - protein, 10 aa, Influenza virus
FVQHPELTGL

SEQ ID NO: 497425 - protein, 10 aa, Influenza virus
FVQHPELTGM

SEQ ID NO: 497426 - protein, 10 aa, Influenza virus
FVQHPELTGV

SEQ ID NO: 497427 - protein, 10 aa, Influenza virus
FVQHPEMTGL

SEQ ID NO: 497428 - protein, 10 aa, Influenza virus
FVQNALNGNG

SEQ ID NO: 497429 - protein, 10 aa, Influenza virus
FVQNALSGNG

SEQ ID NO: 497430 - protein, 10 aa, Influenza virus
FVQSYFQLFL

SEQ ID NO: 497431 - protein, 10 aa, Influenza virus
FVRGQQGRMD

SEQ ID NO: 497432 - protein, 10 aa, Influenza virus
FVRQCFNPMI

SEQ ID NO: 497433 - protein, 10 aa, Influenza virus
FVRQCFNPMT

SEQ ID NO: 497434 - protein, 10 aa, Influenza virus
FVRQCFNPMV

SEQ ID NO: 497435 - protein, 10 aa, Influenza virus
FVRQCFSPMI

SEQ ID NO: 497436 - protein, 10 aa, Influenza virus
FVRTLFQQMR

SEQ ID NO: 497437 - protein, 10 aa, Influenza virus
FVSCGPSECR

SEQ ID NO: 497438 - protein, 10 aa, Influenza virus
FVSCSHLECR

SEQ ID NO: 497439 - protein, 10 aa, Influenza virus
FVSMEFSLTD

SEQ ID NO: 497440 - protein, 10 aa, Influenza virus
FVVREPFISC

SEQ ID NO: 497441 - protein, 10 aa, Influenza virus
FWIELIRGRP

SEQ ID NO: 497442 - protein, 10 aa, Influenza virus
FWKGGSIKTK

SEQ ID NO: 497443 - protein, 10 aa, Influenza virus
FWKGGSINTK

SEQ ID NO: 497444 - protein, 10 aa, Influenza virus
FWLEMIRGKP

SEQ ID NO: 497445 - protein, 10 aa, Influenza virus
FWLEMIRGRP

SEQ ID NO: 497446 - protein, 10 aa, Influenza virus
FWMCPNGSLQ

SEQ ID NO: 497447 - protein, 10 aa, Influenza virus
FWMCSGHSCR

SEQ ID NO: 497448 - protein, 10 aa, Influenza virus
FWMCSNGSLH

SEQ ID NO: 497449 - protein, 10 aa, Influenza virus
FWMCSNGSLQ

SEQ ID NO: 497450 - protein, 10 aa, Influenza virus
FWMCSNGSLR

SEQ ID NO: 497451 - protein, 10 aa, Influenza virus
FWRGDNGRRT

SEQ ID NO: 497452 - protein, 10 aa, Influenza virus
FWRGENGRKT

SEQ ID NO: 497453 - protein, 10 aa, Influenza virus
FWRGENGRRT

SEQ ID NO: 497454 - protein, 10 aa, Influenza virus
FWRGGSINTK

SEQ ID NO: 497455 - protein, 10 aa, Influenza virus
FWRGGSINTR

SEQ ID NO: 497456 - protein, 10 aa, Influenza virus
FWTSNSIVAL

SEQ ID NO: 497457 - protein, 10 aa, Influenza virus
FWVELIRGQP

SEQ ID NO: 497458 - protein, 10 aa, Influenza virus
FWVELIRGRP

SEQ ID NO: 497459 - protein, 10 aa, Influenza virus
FWVELVRGLP

SEQ ID NO: 497460 - protein, 10 aa, Influenza virus
FWVELVRGRP

SEQ ID NO: 497461 - protein, 10 aa, Influenza virus
FWVEMIRGEP

SEQ ID NO: 497462 - protein, 10 aa, Influenza virus
FWVEMIRGKP

SEQ ID NO: 497463 - protein, 10 aa, Influenza virus
FWVEMIRGQP

SEQ ID NO: 497464 - protein, 10 aa, Influenza virus
FWVEMIRGRP

SEQ ID NO: 497465 - protein, 10 aa, Influenza virus
FWVMTDGPAN

SEQ ID NO: 497466 - protein, 10 aa, Influenza virus
FYAELKWLIS

SEQ ID NO: 497467 - protein, 10 aa, Influenza virus
FYAELKWLVS

SEQ ID NO: 497468 - protein, 10 aa, Influenza virus
FYAEMEWLLS

SEQ ID NO: 497469 - protein, 10 aa, Influenza virus
FYAEMKWLLS

SEQ ID NO: 497470 - protein, 10 aa, Influenza virus
FYALSQGTTI

SEQ ID NO: 497471 - protein, 10 aa, Influenza virus
FYHKCDDECI

SEQ ID NO: 497472 - protein, 10 aa, Influenza virus
FYHKCDDECM

SEQ ID NO: 497473 - protein, 10 aa, Influenza virus
FYHKCDNECI

SEQ ID NO: 497474 - protein, 10 aa, Influenza virus
FYHKCDNECM

SEQ ID NO: 497475 - protein, 10 aa, Influenza virus
FYHKCDNGCI

SEQ ID NO: 497476 - protein, 10 aa, Influenza virus
FYHKCDNKCI

SEQ ID NO: 497477 - protein, 10 aa, Influenza virus
FYHKCNDECM

SEQ ID NO: 497478 - protein, 10 aa, Influenza virus
FYHKCNNECI

SEQ ID NO: 497479 - protein, 10 aa, Influenza virus
FYIELIRGKP

SEQ ID NO: 497480 - protein, 10 aa, Influenza virus
FYIELIRGRP

SEQ ID NO: 497481 - protein, 10 aa, Influenza virus
FYIQMCTELK

SEQ ID NO: 497482 - protein, 10 aa, Influenza virus
FYIQMCTELQ

SEQ ID NO: 497483 - protein, 10 aa, Influenza virus
FYKILKIKKG

SEQ ID NO: 497484 - protein, 10 aa, Influenza virus
FYKILKIRKG

SEQ ID NO: 497485 - protein, 10 aa, Influenza virus
FYRICKLVGI

SEQ ID NO: 497486 - protein, 10 aa, Influenza virus
FYRNLIWLVK

SEQ ID NO: 497487 - protein, 10 aa, Influenza virus
FYRNLIWLVN

SEQ ID NO: 497488 - protein, 10 aa, Influenza virus
FYRNLIWLVQ

SEQ ID NO: 497489 - protein, 10 aa, Influenza virus
FYRNLVWIVK

SEQ ID NO: 497490 - protein, 10 aa, Influenza virus
FYRNLVWLVK

SEQ ID NO: 497491 - protein, 10 aa, Influenza virus
FYRNMRWLTL

SEQ ID NO: 497492 - protein, 10 aa, Influenza virus
FYRNVVWLIK

SEQ ID NO: 497493 - protein, 10 aa, Influenza virus
FYRSINWLTK

SEQ ID NO: 497494 - protein, 10 aa, Influenza virus
FYRSIRWLTL

SEQ ID NO: 497495 - protein, 10 aa, Influenza virus
FYRSMKWLTL

SEQ ID NO: 497496 - protein, 10 aa, Influenza virus
FYRSMRWLTL

SEQ ID NO: 497497 - protein, 10 aa, Influenza virus
FYRTCKLLGI

SEQ ID NO: 497498 - protein, 10 aa, Influenza virus
FYRTCKLVGI

SEQ ID NO: 497499 - protein, 10 aa, Influenza virus
FYRYGFVANF

SEQ ID NO: 497500 - protein, 10 aa, Influenza virus
FYSEMKWLLS

SEQ ID NO: 497501 - protein, 10 aa, Influenza virus
FYSEMKWLSS

SEQ ID NO: 497502 - protein, 10 aa, Influenza virus
FYSGGTINSP

SEQ ID NO: 497503 - protein, 10 aa, Influenza virus
FYVELIRGKP

SEQ ID NO: 497504 - protein, 10 aa, Influenza virus
FYVELIRGMP

SEQ ID NO: 497505 - protein, 10 aa, Influenza virus
FYVELIRGRE

SEQ ID NO: 497506 - protein, 10 aa, Influenza virus
FYVELIRGRK

SEQ ID NO: 497507 - protein, 10 aa, Influenza virus
FYVELIRGRL

SEQ ID NO: 497508 - protein, 10 aa, Influenza virus
FYVELIRGRN

SEQ ID NO: 497509 - protein, 10 aa, Influenza virus
FYVELIRGRP

SEQ ID NO: 497510 - protein, 10 aa, Influenza virus
FYVELIRGRQ

SEQ ID NO: 497511 - protein, 10 aa, Influenza virus
FYVELIRGRR

SEQ ID NO: 497512 - protein, 10 aa, Influenza virus
FYVELIRGRS

SEQ ID NO: 497513 - protein, 10 aa, Influenza virus
FYVELVRGRP

SEQ ID NO: 497514 - protein, 10 aa, Influenza virus
FYVEMIRGRP

SEQ ID NO: 497515 - protein, 10 aa, Influenza virus
FYVQMCTELK

SEQ ID NO: 497516 - protein, 10 aa, Influenza virus
FYWTIVDPGD

SEQ ID NO: 497517 - protein, 10 aa, Influenza virus
FYWTIVEPED

SEQ ID NO: 497518 - protein, 10 aa, Influenza virus
FYWTIVEPGD

SEQ ID NO: 497519 - protein, 10 aa, Influenza virus
FYWTIVEPGN

SEQ ID NO: 497520 - protein, 10 aa, Influenza virus
FYYEECSCYP

SEQ ID NO: 497521 - protein, 10 aa, Influenza virus
GAAGAAIKGV

SEQ ID NO: 497522 - protein, 10 aa, Influenza virus
GAAGAAVKGI

SEQ ID NO: 497523 - protein, 10 aa, Influenza virus
GAAGAAVKGV

SEQ ID NO: 497524 - protein, 10 aa, Influenza virus
GAAIKGIGTM

SEQ ID NO: 497525 - protein, 10 aa, Influenza virus
GAAIKGVGTM

SEQ ID NO: 497526 - protein, 10 aa, Influenza virus
GAASLSPGMM

SEQ ID NO: 497527 - protein, 10 aa, Influenza virus
GAAVKGIGTM

SEQ ID NO: 497528 - protein, 10 aa, Influenza virus
GAAVKGVGTI

SEQ ID NO: 497529 - protein, 10 aa, Influenza virus
GAAVKGVGTM

SEQ ID NO: 497530 - protein, 10 aa, Influenza virus
GACWEQLYTP

SEQ ID NO: 497531 - protein, 10 aa, Influenza virus
GADDDAYAVI

SEQ ID NO: 497532 - protein, 10 aa, Influenza virus
GADDEAYAVI

SEQ ID NO: 497533 - protein, 10 aa, Influenza virus
GADGVKGFSY

SEQ ID NO: 497534 - protein, 10 aa, Influenza virus
GADIKSHAYI

SEQ ID NO: 497535 - protein, 10 aa, Influenza virus
GADINLHAYI

SEQ ID NO: 497536 - protein, 10 aa, Influenza virus
GADINLMPIY

SEQ ID NO: 497537 - protein, 10 aa, Influenza virus
GADNDAYAVI

SEQ ID NO: 497538 - protein, 10 aa, Influenza virus
GAFGPVHFRN

SEQ ID NO: 497539 - protein, 10 aa, Influenza virus
GAFIAPDRAG

SEQ ID NO: 497540 - protein, 10 aa, Influenza virus
GAFIAPDRAS

SEQ ID NO: 497541 - protein, 10 aa, Influenza virus
GAFIAPDRAT

SEQ ID NO: 497542 - protein, 10 aa, Influenza virus
GAFIAPDRVS

SEQ ID NO: 497543 - protein, 10 aa, Influenza virus
GAFIAPNRAS

SEQ ID NO: 497544 - protein, 10 aa, Influenza virus
GAFVAPDRVS

SEQ ID NO: 497545 - protein, 10 aa, Influenza virus
GAGALAEDPD

SEQ ID NO: 497546 - protein, 10 aa, Influenza virus
GAGNKLITVG

SEQ ID NO: 497547 - protein, 10 aa, Influenza virus
GAGSWPDGAN

SEQ ID NO: 497548 - protein, 10 aa, Influenza virus
GAGYAADKES

SEQ ID NO: 497549 - protein, 10 aa, Influenza virus
GAHILVTREP

SEQ ID NO: 497550 - protein, 10 aa, Influenza virus
GAIAGFIEGG

SEQ ID NO: 497551 - protein, 10 aa, Influenza virus
GAIAGFIEGR

SEQ ID NO: 497552 - protein, 10 aa, Influenza virus
GAIAGFIENG

SEQ ID NO: 497553 - protein, 10 aa, Influenza virus
GAIEECLIND

SEQ ID NO: 497554 - protein, 10 aa, Influenza virus
GAIGAIDSSM

SEQ ID NO: 497555 - protein, 10 aa, Influenza virus
GAILPFDIDK

SEQ ID NO: 497556 - protein, 10 aa, Influenza virus
GAILPFGIDK

SEQ ID NO: 497557 - protein, 10 aa, Influenza virus
GAINSSKPFQ

SEQ ID NO: 497558 - protein, 10 aa, Influenza virus
GAINSSKPLQ

SEQ ID NO: 497559 - protein, 10 aa, Influenza virus
GAINSSMPFH

SEQ ID NO: 497560 - protein, 10 aa, Influenza virus
GAINSSMPLH

SEQ ID NO: 497561 - protein, 10 aa, Influenza virus
GAINSSRPFQ

SEQ ID NO: 497562 - protein, 10 aa, Influenza virus
GAINTTLPFH

SEQ ID NO: 497563 - protein, 10 aa, Influenza virus
GAISFWMCSG

SEQ ID NO: 497564 - protein, 10 aa, Influenza virus
GAISFWMCSN

SEQ ID NO: 497565 - protein, 10 aa, Influenza virus
GAISSSMPFH

SEQ ID NO: 497566 - protein, 10 aa, Influenza virus
GAIWVTREPY

SEQ ID NO: 497567 - protein, 10 aa, Influenza virus
GAKAGFIEGG

SEQ ID NO: 497568 - protein, 10 aa, Influenza virus
GAKAGFIENG

SEQ ID NO: 497569 - protein, 10 aa, Influenza virus
GAKEIALSYS

SEQ ID NO: 497570 - protein, 10 aa, Influenza virus
GAKEISLSYS

SEQ ID NO: 497571 - protein, 10 aa, Influenza virus
GAKEVALGYS

SEQ ID NO: 497572 - protein, 10 aa, Influenza virus
GAKEVALSYS

SEQ ID NO: 497573 - protein, 10 aa, Influenza virus
GAKEVSLSYS

SEQ ID NO: 497574 - protein, 10 aa, Influenza virus
GAKILTSESQ

SEQ ID NO: 497575 - protein, 10 aa, Influenza virus
GAKVNTLTER

SEQ ID NO: 497576 - protein, 10 aa, Influenza virus
GALASCMGLI

SEQ ID NO: 497577 - protein, 10 aa, Influenza virus
GALGSPGCDH

SEQ ID NO: 497578 - protein, 10 aa, Influenza virus
GALGSPGCDR

SEQ ID NO: 497579 - protein, 10 aa, Influenza virus
GALLGTKHSN

SEQ ID NO: 497580 - protein, 10 aa, Influenza virus
GALLGTNHSN

SEQ ID NO: 497581 - protein, 10 aa, Influenza virus
GALLGTRHSN

SEQ ID NO: 497582 - protein, 10 aa, Influenza virus
GALLNDKHSN

SEQ ID NO: 497583 - protein, 10 aa, Influenza virus
GALLNDRHSN

SEQ ID NO: 497584 - protein, 10 aa, Influenza virus
GALLPFDIDK

SEQ ID NO: 497585 - protein, 10 aa, Influenza virus
GALLPFDIDR

SEQ ID NO: 497586 - protein, 10 aa, Influenza virus
GALNTTLPFH

SEQ ID NO: 497587 - protein, 10 aa, Influenza virus
GALQLNPIDG

SEQ ID NO: 497588 - protein, 10 aa, Influenza virus
GALRQKIMES

SEQ ID NO: 497589 - protein, 10 aa, Influenza virus
GALVGTKHSN

SEQ ID NO: 497590 - protein, 10 aa, Influenza virus
GANGVKGFSF

SEQ ID NO: 497591 - protein, 10 aa, Influenza virus
GANGVKGFSY

SEQ ID NO: 497592 - protein, 10 aa, Influenza virus
GANRPIIEID

SEQ ID NO: 497593 - protein, 10 aa, Influenza virus
GANRPIIEIN

SEQ ID NO: 497594 - protein, 10 aa, Influenza virus
GANRPIITIN

SEQ ID NO: 497595 - protein, 10 aa, Influenza virus
GANRPVIEID

SEQ ID NO: 497596 - protein, 10 aa, Influenza virus
GANRPVIEIN

SEQ ID NO: 497597 - protein, 10 aa, Influenza virus
GANRPVIIID

SEQ ID NO: 497598 - protein, 10 aa, Influenza virus
GANRPVIIIN

SEQ ID NO: 497599 - protein, 10 aa, Influenza virus
GANRPVIKID

SEQ ID NO: 497600 - protein, 10 aa, Influenza virus
GANRPVITID

SEQ ID NO: 497601 - protein, 10 aa, Influenza virus
GANRPVITIN

SEQ ID NO: 497602 - protein, 10 aa, Influenza virus
GAPACDLHLT

SEQ ID NO: 497603 - protein, 10 aa, Influenza virus
GAPGVKGFGF

SEQ ID NO: 497604 - protein, 10 aa, Influenza virus
GAPHGLCYPG

SEQ ID NO: 497605 - protein, 10 aa, Influenza virus
GAPLELRDCK

SEQ ID NO: 497606 - protein, 10 aa, Influenza virus
GAPLVLDDCS

SEQ ID NO: 497607 - protein, 10 aa, Influenza virus
GAPQLNPIDG

SEQ ID NO: 497608 - protein, 10 aa, Influenza virus
GAPQLNPVDG

SEQ ID NO: 497609 - protein, 10 aa, Influenza virus
GAPSCDLHLT

SEQ ID NO: 497610 - protein, 10 aa, Influenza virus
GAQHVEECSC

SEQ ID NO: 497611 - protein, 10 aa, Influenza virus
GAQSFYRSIN

SEQ ID NO: 497612 - protein, 10 aa, Influenza virus
GAQSLSISVG

SEQ ID NO: 497613 - protein, 10 aa, Influenza virus
GARIGEGQRS

SEQ ID NO: 497614 - protein, 10 aa, Influenza virus
GARIITSESQ

SEQ ID NO: 497615 - protein, 10 aa, Influenza virus
GARILASESQ

SEQ ID NO: 497616 - protein, 10 aa, Influenza virus
GARILTSESQ

SEQ ID NO: 497617 - protein, 10 aa, Influenza virus
GARPKVNGQA

SEQ ID NO: 497618 - protein, 10 aa, Influenza virus
GARPKVNGQS

SEQ ID NO: 497619 - protein, 10 aa, Influenza virus
GARPQVNGQF

SEQ ID NO: 497620 - protein, 10 aa, Influenza virus
GARPQVNGQS

SEQ ID NO: 497621 - protein, 10 aa, Influenza virus
GARRIDFHWL

SEQ ID NO: 497622 - protein, 10 aa, Influenza virus
GARRIDFNWL

SEQ ID NO: 497623 - protein, 10 aa, Influenza virus
GASCFIFLAI

SEQ ID NO: 497624 - protein, 10 aa, Influenza virus
GASCFILLAI

SEQ ID NO: 497625 - protein, 10 aa, Influenza virus
GASCFILLAV

SEQ ID NO: 497626 - protein, 10 aa, Influenza virus
GASCFLFLAI

SEQ ID NO: 497627 - protein, 10 aa, Influenza virus
GASCFLLIAI

SEQ ID NO: 497628 - protein, 10 aa, Influenza virus
GASCFLLLAI

SEQ ID NO: 497629 - protein, 10 aa, Influenza virus
GASCFLLLAV

SEQ ID NO: 497630 - protein, 10 aa, Influenza virus
GASCFTLLAI

SEQ ID NO: 497631 - protein, 10 aa, Influenza virus
GASCFVLLAA

SEQ ID NO: 497632 - protein, 10 aa, Influenza virus
GASCFVLLAD

SEQ ID NO: 497633 - protein, 10 aa, Influenza virus
GASCFVLLAI

SEQ ID NO: 497634 - protein, 10 aa, Influenza virus
GASCFVLLAV

SEQ ID NO: 497635 - protein, 10 aa, Influenza virus
GASCVMLLAI

SEQ ID NO: 497636 - protein, 10 aa, Influenza virus
GATINEEALR

SEQ ID NO: 497637 - protein, 10 aa, Influenza virus
GATSACKRTV

SEQ ID NO: 497638 - protein, 10 aa, Influenza virus
GATVNEEALR

SEQ ID NO: 497639 - protein, 10 aa, Influenza virus
GATVNEGALR

SEQ ID NO: 497640 - protein, 10 aa, Influenza virus
GAVAVLKYDG

SEQ ID NO: 497641 - protein, 10 aa, Influenza virus
GAVAVLKYKG

SEQ ID NO: 497642 - protein, 10 aa, Influenza virus
GAVAVLKYND

SEQ ID NO: 497643 - protein, 10 aa, Influenza virus
GAVAVLKYNG

SEQ ID NO: 497644 - protein, 10 aa, Influenza virus
GAVAVVKYNG

SEQ ID NO: 497645 - protein, 10 aa, Influenza virus
GAVNSSKPFQ

SEQ ID NO: 497646 - protein, 10 aa, Influenza virus
GAVNSSMPFH

SEQ ID NO: 497647 - protein, 10 aa, Influenza virus
GAVNTTLSTI

SEQ ID NO: 497648 - protein, 10 aa, Influenza virus
GAVSFWMCSN

SEQ ID NO: 497649 - protein, 10 aa, Influenza virus
GAWIGRTKST

SEQ ID NO: 497650 - protein, 10 aa, Influenza virus
GAYERMCNIL

SEQ ID NO: 497651 - protein, 10 aa, Influenza virus
GAYGVKGFSF

SEQ ID NO: 497652 - protein, 10 aa, Influenza virus
GAYKILTIYS

SEQ ID NO: 497653 - protein, 10 aa, Influenza virus
GAYNNTTGRD

SEQ ID NO: 497654 - protein, 10 aa, Influenza virus
GCDHSDNADK

SEQ ID NO: 497655 - protein, 10 aa, Influenza virus
GCDRLQDTTW

SEQ ID NO: 497656 - protein, 10 aa, Influenza virus
GCFDILHKCD

SEQ ID NO: 497657 - protein, 10 aa, Influenza virus
GCFDILHKCN

SEQ ID NO: 497658 - protein, 10 aa, Influenza virus
GCFDLYHKCD

SEQ ID NO: 497659 - protein, 10 aa, Influenza virus
GCFEFWHKCD

SEQ ID NO: 497660 - protein, 10 aa, Influenza virus
GCFEFWHKCN

SEQ ID NO: 497661 - protein, 10 aa, Influenza virus
GCFEFYHKCD

SEQ ID NO: 497662 - protein, 10 aa, Influenza virus
GCFEFYHKCN

SEQ ID NO: 497663 - protein, 10 aa, Influenza virus
GCFEFYHRCD

SEQ ID NO: 497664 - protein, 10 aa, Influenza virus
GCFEIFHKCD

SEQ ID NO: 497665 - protein, 10 aa, Influenza virus
GCFEIFHQCD

SEQ ID NO: 497666 - protein, 10 aa, Influenza virus
GCFEIFHRCD

SEQ ID NO: 497667 - protein, 10 aa, Influenza virus
GCFEILHKCD

SEQ ID NO: 497668 - protein, 10 aa, Influenza virus
GCFEILHKCN

SEQ ID NO: 497669 - protein, 10 aa, Influenza virus
GCFEILHRCD

SEQ ID NO: 497670 - protein, 10 aa, Influenza virus
GCFEILHRCN

SEQ ID NO: 497671 - protein, 10 aa, Influenza virus
GCFEIYHACD

SEQ ID NO: 497672 - protein, 10 aa, Influenza virus
GCFEIYHKCD

SEQ ID NO: 497673 - protein, 10 aa, Influenza virus
GCFEIYHNCD

SEQ ID NO: 497674 - protein, 10 aa, Influenza virus
GCFEIYHRCD

SEQ ID NO: 497675 - protein, 10 aa, Influenza virus
GCFEIYHTCD

SEQ ID NO: 497676 - protein, 10 aa, Influenza virus
GCFELFHKCD

SEQ ID NO: 497677 - protein, 10 aa, Influenza virus
GCFELLHKCN

SEQ ID NO: 497678 - protein, 10 aa, Influenza virus
GCFELYHECD

SEQ ID NO: 497679 - protein, 10 aa, Influenza virus
GCFELYHKCD

SEQ ID NO: 497680 - protein, 10 aa, Influenza virus
GCFELYHKCN

SEQ ID NO: 497681 - protein, 10 aa, Influenza virus
GCFELYHRCD

SEQ ID NO: 497682 - protein, 10 aa, Influenza virus
GCFKIYHKCD

SEQ ID NO: 497683 - protein, 10 aa, Influenza virus
GCFKIYHRCD

SEQ ID NO: 497684 - protein, 10 aa, Influenza virus
GCFNFFHKCN

SEQ ID NO: 497685 - protein, 10 aa, Influenza virus
GCFNLLHKCN

SEQ ID NO: 497686 - protein, 10 aa, Influenza virus
GCFPFYHKCD

SEQ ID NO: 497687 - protein, 10 aa, Influenza virus
GCFQPCFYIE

SEQ ID NO: 497688 - protein, 10 aa, Influenza virus
GCFQPCFYVE

SEQ ID NO: 497689 - protein, 10 aa, Influenza virus
GCFRIYHKCD

SEQ ID NO: 497690 - protein, 10 aa, Influenza virus
GCFSILHKCN

SEQ ID NO: 497691 - protein, 10 aa, Influenza virus
GCFSLLHKCN

SEQ ID NO: 497692 - protein, 10 aa, Influenza virus
GCFTFYHKCD

SEQ ID NO: 497693 - protein, 10 aa, Influenza virus
GCFTFYHKCN

SEQ ID NO: 497694 - protein, 10 aa, Influenza virus
GCFTIYHKCD

SEQ ID NO: 497695 - protein, 10 aa, Influenza virus
GCIEGKLSQM

SEQ ID NO: 497696 - protein, 10 aa, Influenza virus
GCIESKLSQM

SEQ ID NO: 497697 - protein, 10 aa, Influenza virus
GCINRCFYVE

SEQ ID NO: 497698 - protein, 10 aa, Influenza virus
GCITPNGSIP

SEQ ID NO: 497699 - protein, 10 aa, Influenza virus
GCKMYALHQG

SEQ ID NO: 497700 - protein, 10 aa, Influenza virus
GCLKIYHKCD

SEQ ID NO: 497701 - protein, 10 aa, Influenza virus
GCLVPCFWVE

SEQ ID NO: 497702 - protein, 10 aa, Influenza virus
GCQLNEGVMN

SEQ ID NO: 497703 - protein, 10 aa, Influenza virus
GCQNGNIRCT

SEQ ID NO: 497704 - protein, 10 aa, Influenza virus
GCQNGNVRCT

SEQ ID NO: 497705 - protein, 10 aa, Influenza virus
GCRDNWQGAN

SEQ ID NO: 497706 - protein, 10 aa, Influenza virus
GCRFYALSQG

SEQ ID NO: 497707 - protein, 10 aa, Influenza virus
GCRMFALSQG

SEQ ID NO: 497708 - protein, 10 aa, Influenza virus
GCRMYALHQG

SEQ ID NO: 497709 - protein, 10 aa, Influenza virus
GCRTFFLTQG

SEQ ID NO: 497710 - protein, 10 aa, Influenza virus
GCSFAGWILG

SEQ ID NO: 497711 - protein, 10 aa, Influenza virus
GCVILLNPFV

SEQ ID NO: 497712 - protein, 10 aa, Influenza virus
GCWSFALAQG

SEQ ID NO: 497713 - protein, 10 aa, Influenza virus
GDAPFIDRLR

SEQ ID NO: 497714 - protein, 10 aa, Influenza virus
GDAPFLDRIR

SEQ ID NO: 497715 - protein, 10 aa, Influenza virus
GDAPFLDRLR

SEQ ID NO: 497716 - protein, 10 aa, Influenza virus
GDCNFEGWIV

SEQ ID NO: 497717 - protein, 10 aa, Influenza virus
GDCNNPITGS

SEQ ID NO: 497718 - protein, 10 aa, Influenza virus
GDCPKYIKQG

SEQ ID NO: 497719 - protein, 10 aa, Influenza virus
GDCPKYIKSG

SEQ ID NO: 497720 - protein, 10 aa, Influenza virus
GDCPKYMNVK

SEQ ID NO: 497721 - protein, 10 aa, Influenza virus
GDCPKYVKQG

SEQ ID NO: 497722 - protein, 10 aa, Influenza virus
GDCPKYVNIK

SEQ ID NO: 497723 - protein, 10 aa, Influenza virus
GDCPKYVNVK

SEQ ID NO: 497724 - protein, 10 aa, Influenza virus
GDCPKYVNVR

SEQ ID NO: 497725 - protein, 10 aa, Influenza virus
GDCPRYVKQG

SEQ ID NO: 497726 - protein, 10 aa, Influenza virus
GDCRFEGWIV

SEQ ID NO: 497727 - protein, 10 aa, Influenza virus
GDCSFAGWIL

SEQ ID NO: 497728 - protein, 10 aa, Influenza virus
GDCSFAGWLL

SEQ ID NO: 497729 - protein, 10 aa, Influenza virus
GDCSFEGWIG

SEQ ID NO: 497730 - protein, 10 aa, Influenza virus
GDCSFEGWIV

SEQ ID NO: 497731 - protein, 10 aa, Influenza virus
GDCSFTGWIL

SEQ ID NO: 497732 - protein, 10 aa, Influenza virus
GDCSIAGWLL

SEQ ID NO: 497733 - protein, 10 aa, Influenza virus
GDCSITGWLL

SEQ ID NO: 497734 - protein, 10 aa, Influenza virus
GDCSNPITGS

SEQ ID NO: 497735 - protein, 10 aa, Influenza virus
GDCYRACFYV

SEQ ID NO: 497736 - protein, 10 aa, Influenza virus
GDCYWVMTDG

SEQ ID NO: 497737 - protein, 10 aa, Influenza virus
GDDENATASF

SEQ ID NO: 497738 - protein, 10 aa, Influenza virus
GDDKNATASF

SEQ ID NO: 497739 - protein, 10 aa, Influenza virus
GDDRNATASF

SEQ ID NO: 497740 - protein, 10 aa, Influenza virus
GDDRNATASL

SEQ ID NO: 497741 - protein, 10 aa, Influenza virus
GDDVLMGRTI

SEQ ID NO: 497742 - protein, 10 aa, Influenza virus
GDDVWLGRTV

SEQ ID NO: 497743 - protein, 10 aa, Influenza virus
GDDVWMGRTI

SEQ ID NO: 497744 - protein, 10 aa, Influenza virus
GDGCFEILHK

SEQ ID NO: 497745 - protein, 10 aa, Influenza virus
GDGCFEILHR

SEQ ID NO: 497746 - protein, 10 aa, Influenza virus
GDGCFNFFHK

SEQ ID NO: 497747 - protein, 10 aa, Influenza virus
GDGCFNLLHK

SEQ ID NO: 497748 - protein, 10 aa, Influenza virus
GDGCFSILHK

SEQ ID NO: 497749 - protein, 10 aa, Influenza virus
GDGCFSLLHK

SEQ ID NO: 497750 - protein, 10 aa, Influenza virus
GDGQRSWMKI

SEQ ID NO: 497751 - protein, 10 aa, Influenza virus
GDGQRSWMKL

SEQ ID NO: 497752 - protein, 10 aa, Influenza virus
GDGVWIGRTK

SEQ ID NO: 497753 - protein, 10 aa, Influenza virus
GDHGVKGWAF

SEQ ID NO: 497754 - protein, 10 aa, Influenza virus
GDHITFSHNG

SEQ ID NO: 497755 - protein, 10 aa, Influenza virus
GDIFVIREPF

SEQ ID NO: 497756 - protein, 10 aa, Influenza virus
GDIFVMREPF

SEQ ID NO: 497757 - protein, 10 aa, Influenza virus
GDIIFLWGIH

SEQ ID NO: 497758 - protein, 10 aa, Influenza virus
GDIIVFNTIG

SEQ ID NO: 497759 - protein, 10 aa, Influenza virus
GDILDGVTAS

SEQ ID NO: 497760 - protein, 10 aa, Influenza virus
GDILEGTTAS

SEQ ID NO: 497761 - protein, 10 aa, Influenza virus
GDILRTHESS

SEQ ID NO: 497762 - protein, 10 aa, Influenza virus
GDILRTQDSS

SEQ ID NO: 497763 - protein, 10 aa, Influenza virus
GDILRTQESS

SEQ ID NO: 497764 - protein, 10 aa, Influenza virus
GDIMRTQESS

SEQ ID NO: 497765 - protein, 10 aa, Influenza virus
GDIVLVMKRK

SEQ ID NO: 497766 - protein, 10 aa, Influenza virus
GDIWITREPY

SEQ ID NO: 497767 - protein, 10 aa, Influenza virus
GDIWVTRELY

SEQ ID NO: 497768 - protein, 10 aa, Influenza virus
GDIWVTREPY

SEQ ID NO: 497769 - protein, 10 aa, Influenza virus
GDIWVTRKPY

SEQ ID NO: 497770 - protein, 10 aa, Influenza virus
GDIWVTRVPY

SEQ ID NO: 497771 - protein, 10 aa, Influenza virus
GDKICLGHHA

SEQ ID NO: 497772 - protein, 10 aa, Influenza virus
GDLILFNTIG

SEQ ID NO: 497773 - protein, 10 aa, Influenza virus
GDLIVFNTIG

SEQ ID NO: 497774 - protein, 10 aa, Influenza virus
GDLNFVNRAN

SEQ ID NO: 497775 - protein, 10 aa, Influenza virus
GDNENATATV

SEQ ID NO: 497776 - protein, 10 aa, Influenza virus
GDNITFLHNG

SEQ ID NO: 497777 - protein, 10 aa, Influenza virus
GDNITFSDNG

SEQ ID NO: 497778 - protein, 10 aa, Influenza virus
GDNITFSHNG

SEQ ID NO: 497779 - protein, 10 aa, Influenza virus
GDNTKWNENQ

SEQ ID NO: 497780 - protein, 10 aa, Influenza virus
GDPNNMDKAV

SEQ ID NO: 497781 - protein, 10 aa, Influenza virus
GDPNNMDRAV

SEQ ID NO: 497782 - protein, 10 aa, Influenza virus
GDPPYSHGTG

SEQ ID NO: 497783 - protein, 10 aa, Influenza virus
GDPSNMDRAV

SEQ ID NO: 497784 - protein, 10 aa, Influenza virus
GDQICIGYHA

SEQ ID NO: 497785 - protein, 10 aa, Influenza virus
GDQICIGYHS

SEQ ID NO: 497786 - protein, 10 aa, Influenza virus
GDQICVGYHA

SEQ ID NO: 497787 - protein, 10 aa, Influenza virus
GDQICVGYHS

SEQ ID NO: 497788 - protein, 10 aa, Influenza virus
GDRICIGYHA

SEQ ID NO: 497789 - protein, 10 aa, Influenza virus
GDRPKVNGQA

SEQ ID NO: 497790 - protein, 10 aa, Influenza virus
GDRPLVNGQR

SEQ ID NO: 497791 - protein, 10 aa, Influenza virus
GDSEMLNLYE

SEQ ID NO: 497792 - protein, 10 aa, Influenza virus
GDSFYAELKW

SEQ ID NO: 497793 - protein, 10 aa, Influenza virus
GDSIIFNSIG

SEQ ID NO: 497794 - protein, 10 aa, Influenza virus
GDSITFSHNG

SEQ ID NO: 497795 - protein, 10 aa, Influenza virus
GDTPRNDDRF

SEQ ID NO: 497796 - protein, 10 aa, Influenza virus
GDTPRNDDRS

SEQ ID NO: 497797 - protein, 10 aa, Influenza virus
GDTPRNDDSS

SEQ ID NO: 497798 - protein, 10 aa, Influenza virus
GDTPRNEDGS

SEQ ID NO: 497799 - protein, 10 aa, Influenza virus
GDTPRNEDSS

SEQ ID NO: 497800 - protein, 10 aa, Influenza virus
GDTPRNGDSS

SEQ ID NO: 497801 - protein, 10 aa, Influenza virus
GDTPRSDDSS

SEQ ID NO: 497802 - protein, 10 aa, Influenza virus
GDTVTFTFNG

SEQ ID NO: 497803 - protein, 10 aa, Influenza virus
GDVFAIREPF

SEQ ID NO: 497804 - protein, 10 aa, Influenza virus
GDVFIIREPF

SEQ ID NO: 497805 - protein, 10 aa, Influenza virus
GDVFVIREPF

SEQ ID NO: 497806 - protein, 10 aa, Influenza virus
GDVFVMREPF

SEQ ID NO: 497807 - protein, 10 aa, Influenza virus
GDVFVTREPF

SEQ ID NO: 497808 - protein, 10 aa, Influenza virus
GDVFVVREPF

SEQ ID NO: 497809 - protein, 10 aa, Influenza virus
GDVLDGVTAS

SEQ ID NO: 497810 - protein, 10 aa, Influenza virus
GDVVLVMKRK

SEQ ID NO: 497811 - protein, 10 aa, Influenza virus
GDVYKILSIY

SEQ ID NO: 497812 - protein, 10 aa, Influenza virus
GDYARLYIWG

SEQ ID NO: 497813 - protein, 10 aa, Influenza virus
GDYNNTTGRD

SEQ ID NO: 497814 - protein, 10 aa, Influenza virus
GDYTRLYIWG

SEQ ID NO: 497815 - protein, 10 aa, Influenza virus
GEAMVSRARI

SEQ ID NO: 497816 - protein, 10 aa, Influenza virus
GEAPSPYNSK

SEQ ID NO: 497817 - protein, 10 aa, Influenza virus
GEAPSPYNSR

SEQ ID NO: 497818 - protein, 10 aa, Influenza virus
GECFNPITGS

SEQ ID NO: 497819 - protein, 10 aa, Influenza virus
GECFWVMTDG

SEQ ID NO: 497820 - protein, 10 aa, Influenza virus
GECFYSGGTI

SEQ ID NO: 497821 - protein, 10 aa, Influenza virus
GECPKYIKSD

SEQ ID NO: 497822 - protein, 10 aa, Influenza virus
GECPKYVKQG

SEQ ID NO: 497823 - protein, 10 aa, Influenza virus
GECPKYVKSD

SEQ ID NO: 497824 - protein, 10 aa, Influenza virus
GECPKYVKSE

SEQ ID NO: 497825 - protein, 10 aa, Influenza virus
GECPKYVKSN

SEQ ID NO: 497826 - protein, 10 aa, Influenza virus
GECPKYVKSS

SEQ ID NO: 497827 - protein, 10 aa, Influenza virus
GECPKYVKST

SEQ ID NO: 497828 - protein, 10 aa, Influenza virus
GECPKYVRSA

SEQ ID NO: 497829 - protein, 10 aa, Influenza virus
GECPKYVRSE

SEQ ID NO: 497830 - protein, 10 aa, Influenza virus
GECPKYVRST

SEQ ID NO: 497831 - protein, 10 aa, Influenza virus
GECPRYVKSE

SEQ ID NO: 497832 - protein, 10 aa, Influenza virus
GECYRACFYV

SEQ ID NO: 497833 - protein, 10 aa, Influenza virus
GECYWVMTDG

SEQ ID NO: 497834 - protein, 10 aa, Influenza virus
GEDSDILVTR

SEQ ID NO: 497835 - protein, 10 aa, Influenza virus
GEDSDVLVTR

SEQ ID NO: 497836 - protein, 10 aa, Influenza virus
GEDTIEERFE

SEQ ID NO: 497837 - protein, 10 aa, Influenza virus
GEETIEEKFE

SEQ ID NO: 497838 - protein, 10 aa, Influenza virus
GEETIEERFE

SEQ ID NO: 497839 - protein, 10 aa, Influenza virus
GEETVEERFE

SEQ ID NO: 497840 - protein, 10 aa, Influenza virus
GEFNQVEKRI

SEQ ID NO: 497841 - protein, 10 aa, Influenza virus
GEFNQVENRI

SEQ ID NO: 497842 - protein, 10 aa, Influenza virus
GEFNQVEQRI

SEQ ID NO: 497843 - protein, 10 aa, Influenza virus
GEFSQVEQRI

SEQ ID NO: 497844 - protein, 10 aa, Influenza virus
GEFSQVERRI

SEQ ID NO: 497845 - protein, 10 aa, Influenza virus
GEGEQIIVTR

SEQ ID NO: 497846 - protein, 10 aa, Influenza virus
GEGIAADYKS

SEQ ID NO: 497847 - protein, 10 aa, Influenza virus
GEGIPLHDAI

SEQ ID NO: 497848 - protein, 10 aa, Influenza virus
GEGIPLYDAI

SEQ ID NO: 497849 - protein, 10 aa, Influenza virus
GEGIPLYDAV

SEQ ID NO: 497850 - protein, 10 aa, Influenza virus
GEGQRSWMKI

SEQ ID NO: 497851 - protein, 10 aa, Influenza virus
GEGTAADYKS

SEQ ID NO: 497852 - protein, 10 aa, Influenza virus
GEHAKAIGNC

SEQ ID NO: 497853 - protein, 10 aa, Influenza virus
GEKANVLIGQ

SEQ ID NO: 497854 - protein, 10 aa, Influenza virus
GEKSDVLVTR

SEQ ID NO: 497855 - protein, 10 aa, Influenza virus
GELDNNGELR

SEQ ID NO: 497856 - protein, 10 aa, Influenza virus
GELNNNGELR

SEQ ID NO: 497857 - protein, 10 aa, Influenza virus
GELRHLFSGI

SEQ ID NO: 497858 - protein, 10 aa, Influenza virus
GELRHLFSGV

SEQ ID NO: 497859 - protein, 10 aa, Influenza virus
GENIAPEKVD

SEQ ID NO: 497860 - protein, 10 aa, Influenza virus
GENMAPEKID

SEQ ID NO: 497861 - protein, 10 aa, Influenza virus
GENMAPEKMD

SEQ ID NO: 497862 - protein, 10 aa, Influenza virus
GENMAPEKVD

SEQ ID NO: 497863 - protein, 10 aa, Influenza virus
GENSDVLVTR

SEQ ID NO: 497864 - protein, 10 aa, Influenza virus
GEPGVKGFGF

SEQ ID NO: 497865 - protein, 10 aa, Influenza virus
GEQIIVTREP

SEQ ID NO: 497866 - protein, 10 aa, Influenza virus
GERGLFGAIA

SEQ ID NO: 497867 - protein, 10 aa, Influenza virus
GERIMFESNG

SEQ ID NO: 497868 - protein, 10 aa, Influenza virus
GERITFESNG

SEQ ID NO: 497869 - protein, 10 aa, Influenza virus
GERITFESSG

SEQ ID NO: 497870 - protein, 10 aa, Influenza virus
GERTTFESNG

SEQ ID NO: 497871 - protein, 10 aa, Influenza virus
GESEQIIVTR

SEQ ID NO: 497872 - protein, 10 aa, Influenza virus
GESEQIVVTR

SEQ ID NO: 497873 - protein, 10 aa, Influenza virus
GESEQVIVTR

SEQ ID NO: 497874 - protein, 10 aa, Influenza virus
GESHCRIIQN

SEQ ID NO: 497875 - protein, 10 aa, Influenza virus
GESHGKIIQN

SEQ ID NO: 497876 - protein, 10 aa, Influenza virus
GESHGRIIQN

SEQ ID NO: 497877 - protein, 10 aa, Influenza virus
GESHGRTIQN

SEQ ID NO: 497878 - protein, 10 aa, Influenza virus
GESSDVLVTR

SEQ ID NO: 497879 - protein, 10 aa, Influenza virus
GESYGRIIQN

SEQ ID NO: 497880 - protein, 10 aa, Influenza virus
GETLKIRTNG

SEQ ID NO: 497881 - protein, 10 aa, Influenza virus
GETLKVESNG

SEQ ID NO: 497882 - protein, 10 aa, Influenza virus
GETLNIESNG

SEQ ID NO: 497883 - protein, 10 aa, Influenza virus
GETLNVESNG

SEQ ID NO: 497884 - protein, 10 aa, Influenza virus
GETTGRNCTI

SEQ ID NO: 497885 - protein, 10 aa, Influenza virus
GETTGRNCTV

SEQ ID NO: 497886 - protein, 10 aa, Influenza virus
GEVDNNGELR

SEQ ID NO: 497887 - protein, 10 aa, Influenza virus
GEVFVIREPF

SEQ ID NO: 497888 - protein, 10 aa, Influenza virus
GEVPGWSWDD

SEQ ID NO: 497889 - protein, 10 aa, Influenza virus
GEVPSPYNSR

SEQ ID NO: 497890 - protein, 10 aa, Influenza virus
GEVSVIREPF

SEQ ID NO: 497891 - protein, 10 aa, Influenza virus
GEYNNTTGRD

SEQ ID NO: 497892 - protein, 10 aa, Influenza virus
GFAFKQGNSV

SEQ ID NO: 497893 - protein, 10 aa, Influenza virus
GFAIFSKDNG

SEQ ID NO: 497894 - protein, 10 aa, Influenza virus
GFAIISKDNG

SEQ ID NO: 497895 - protein, 10 aa, Influenza virus
GFAIVSKDNG

SEQ ID NO: 497896 - protein, 10 aa, Influenza virus
GFAPFAKDNS

SEQ ID NO: 497897 - protein, 10 aa, Influenza virus
GFAPFSKDNG

SEQ ID NO: 497898 - protein, 10 aa, Influenza virus
GFAPFSKDNS

SEQ ID NO: 497899 - protein, 10 aa, Influenza virus
GFAPFTKDNS

SEQ ID NO: 497900 - protein, 10 aa, Influenza virus
GFAPLSKDNS

SEQ ID NO: 497901 - protein, 10 aa, Influenza virus
GFAVVSKDNG

SEQ ID NO: 497902 - protein, 10 aa, Influenza virus
GFCFTVMTDG

SEQ ID NO: 497903 - protein, 10 aa, Influenza virus
GFEILLIEDG

SEQ ID NO: 497904 - protein, 10 aa, Influenza virus
GFEILLIEEG

SEQ ID NO: 497905 - protein, 10 aa, Influenza virus
GFEMIWDANG

SEQ ID NO: 497906 - protein, 10 aa, Influenza virus
GFEMIWDPDG

SEQ ID NO: 497907 - protein, 10 aa, Influenza virus
GFEMIWDPNG

SEQ ID NO: 497908 - protein, 10 aa, Influenza virus
GFEMLKIHNA

SEQ ID NO: 497909 - protein, 10 aa, Influenza virus
GFEMLKIPNA

SEQ ID NO: 497910 - protein, 10 aa, Influenza virus
GFEMLKVPNA

SEQ ID NO: 497911 - protein, 10 aa, Influenza virus
GFEMLRIPNA

SEQ ID NO: 497912 - protein, 10 aa, Influenza virus
GFEMVWDANG

SEQ ID NO: 497913 - protein, 10 aa, Influenza virus
GFEMVWDPNG

SEQ ID NO: 497914 - protein, 10 aa, Influenza virus
GFEPNGCIEG

SEQ ID NO: 497915 - protein, 10 aa, Influenza virus
GFEPNGCIES

SEQ ID NO: 497916 - protein, 10 aa, Influenza virus
GFEPNGSIEG

SEQ ID NO: 497917 - protein, 10 aa, Influenza virus
GFEPNGYIEG

SEQ ID NO: 497918 - protein, 10 aa, Influenza virus
GFEVLLIEDG

SEQ ID NO: 497919 - protein, 10 aa, Influenza virus
GFEVLLIENG

SEQ ID NO: 497920 - protein, 10 aa, Influenza virus
GFFGAIAGFI

SEQ ID NO: 497921 - protein, 10 aa, Influenza virus
GFFPDGPQIQ

SEQ ID NO: 497922 - protein, 10 aa, Influenza virus
GFFPFHKDNA

SEQ ID NO: 497923 - protein, 10 aa, Influenza virus
GFGFRQGDDV

SEQ ID NO: 497924 - protein, 10 aa, Influenza virus
GFGFRQGNDV

SEQ ID NO: 497925 - protein, 10 aa, Influenza virus
GFGFRQGNSV

SEQ ID NO: 497926 - protein, 10 aa, Influenza virus
GFGFRQGSDV

SEQ ID NO: 497927 - protein, 10 aa, Influenza virus
GFGFRQGTDV

SEQ ID NO: 497928 - protein, 10 aa, Influenza virus
GFGFRQGTSV

SEQ ID NO: 497929 - protein, 10 aa, Influenza virus
GFHDSNVKNL

SEQ ID NO: 497930 - protein, 10 aa, Influenza virus
GFHFEECSCY

SEQ ID NO: 497931 - protein, 10 aa, Influenza virus
GFHHSNAEGT

SEQ ID NO: 497932 - protein, 10 aa, Influenza virus
GFHHSNSEGT

SEQ ID NO: 497933 - protein, 10 aa, Influenza virus
GFIDIWTYNA

SEQ ID NO: 497934 - protein, 10 aa, Influenza virus
GFIDVWTYNA

SEQ ID NO: 497935 - protein, 10 aa, Influenza virus
GFIEGGWCGM

SEQ ID NO: 497936 - protein, 10 aa, Influenza virus
GFIEGGWPGL

SEQ ID NO: 497937 - protein, 10 aa, Influenza virus
GFIEGGWQGL

SEQ ID NO: 497938 - protein, 10 aa, Influenza virus
GFIEGGWQGM

SEQ ID NO: 497939 - protein, 10 aa, Influenza virus
GFIEGGWSGL

SEQ ID NO: 497940 - protein, 10 aa, Influenza virus
GFIEGGWSGM

SEQ ID NO: 497941 - protein, 10 aa, Influenza virus
GFIEGGWTGL

SEQ ID NO: 497942 - protein, 10 aa, Influenza virus
GFIEGGWTGM

SEQ ID NO: 497943 - protein, 10 aa, Influenza virus
GFIEGRWPGL

SEQ ID NO: 497944 - protein, 10 aa, Influenza virus
GFIENGWEGL

SEQ ID NO: 497945 - protein, 10 aa, Influenza virus
GFIENGWEGM

SEQ ID NO: 497946 - protein, 10 aa, Influenza virus
GFIENGWQGL

SEQ ID NO: 497947 - protein, 10 aa, Influenza virus
GFIFGCQNGN

SEQ ID NO: 497948 - protein, 10 aa, Influenza virus
GFIIKGRSHL

SEQ ID NO: 497949 - protein, 10 aa, Influenza virus
GFIMWACQKG

SEQ ID NO: 497950 - protein, 10 aa, Influenza virus
GFIMWACQRG

SEQ ID NO: 497951 - protein, 10 aa, Influenza virus
GFIMWTCQKG

SEQ ID NO: 497952 - protein, 10 aa, Influenza virus
GFIVKGRSHL

SEQ ID NO: 497953 - protein, 10 aa, Influenza virus
GFIVWACQRG

SEQ ID NO: 497954 - protein, 10 aa, Influenza virus
GFIYSGIRTN

SEQ ID NO: 497955 - protein, 10 aa, Influenza virus
GFKHQNAQGE

SEQ ID NO: 497956 - protein, 10 aa, Influenza virus
GFKISKRGGS

SEQ ID NO: 497957 - protein, 10 aa, Influenza virus
GFKISKRGNS

SEQ ID NO: 497958 - protein, 10 aa, Influenza virus
GFKISKRGSS

SEQ ID NO: 497959 - protein, 10 aa, Influenza virus
GFKISRRGNS

SEQ ID NO: 497960 - protein, 10 aa, Influenza virus
GFKPNGCIEG

SEQ ID NO: 497961 - protein, 10 aa, Influenza virus
GFLAPRYGYI

SEQ ID NO: 497962 - protein, 10 aa, Influenza virus
GFLDIWTYNA

SEQ ID NO: 497963 - protein, 10 aa, Influenza virus
GFLDVWTYNA

SEQ ID NO: 497964 - protein, 10 aa, Influenza virus
GFLGVWTYNA

SEQ ID NO: 497965 - protein, 10 aa, Influenza virus
GFLIIGKEDR

SEQ ID NO: 497966 - protein, 10 aa, Influenza virus
GFLILGKEDK

SEQ ID NO: 497967 - protein, 10 aa, Influenza virus
GFLILGKEDR

SEQ ID NO: 497968 - protein, 10 aa, Influenza virus
GFLILGKENK

SEQ ID NO: 497969 - protein, 10 aa, Influenza virus
GFLILGREDK

SEQ ID NO: 497970 - protein, 10 aa, Influenza virus
GFLNVWTYNA

SEQ ID NO: 497971 - protein, 10 aa, Influenza virus
GFMDVWTYNA

SEQ ID NO: 497972 - protein, 10 aa, Influenza virus
GFQHQNAEGI

SEQ ID NO: 497973 - protein, 10 aa, Influenza virus
GFQHQNAEGT

SEQ ID NO: 497974 - protein, 10 aa, Influenza virus
GFQHQNEQGM

SEQ ID NO: 497975 - protein, 10 aa, Influenza virus
GFQHQNEQGT

SEQ ID NO: 497976 - protein, 10 aa, Influenza virus
GFQHQNEQGV

SEQ ID NO: 497977 - protein, 10 aa, Influenza virus
GFQHQNSEGT

SEQ ID NO: 497978 - protein, 10 aa, Influenza virus
GFQHRDEEGT

SEQ ID NO: 497979 - protein, 10 aa, Influenza virus
GFQHRNEEGT

SEQ ID NO: 497980 - protein, 10 aa, Influenza virus
GFRDVWTYNA

SEQ ID NO: 497981 - protein, 10 aa, Influenza virus
GFRHQKAQGE

SEQ ID NO: 497982 - protein, 10 aa, Influenza virus
GFRHQNAEGT

SEQ ID NO: 497983 - protein, 10 aa, Influenza virus
GFRHQNAQGE

SEQ ID NO: 497984 - protein, 10 aa, Influenza virus
GFRHQNAQGI

SEQ ID NO: 497985 - protein, 10 aa, Influenza virus
GFRHQNAQGQ

SEQ ID NO: 497986 - protein, 10 aa, Influenza virus
GFRHQNAQGT

SEQ ID NO: 497987 - protein, 10 aa, Influenza virus
GFRHQNSEGT

SEQ ID NO: 497988 - protein, 10 aa, Influenza virus
GFRHQNSQGE

SEQ ID NO: 497989 - protein, 10 aa, Influenza virus
GFRHQNTQGE

SEQ ID NO: 497990 - protein, 10 aa, Influenza virus
GFRISKRGSS

SEQ ID NO: 497991 - protein, 10 aa, Influenza virus
GFRQGNSVWA

SEQ ID NO: 497992 - protein, 10 aa, Influenza virus
GFRQGTSVWA

SEQ ID NO: 497993 - protein, 10 aa, Influenza virus
GFRYSGIKTD

SEQ ID NO: 497994 - protein, 10 aa, Influenza virus
GFRYSGIRTD

SEQ ID NO: 497995 - protein, 10 aa, Influenza virus
GFSAESRKLL

SEQ ID NO: 497996 - protein, 10 aa, Influenza virus
GFSAESRKML

SEQ ID NO: 497997 - protein, 10 aa, Influenza virus
GFSFKYGNGV

SEQ ID NO: 497998 - protein, 10 aa, Influenza virus
GFSFRYGDGV

SEQ ID NO: 497999 - protein, 10 aa, Influenza virus
GFSFRYGNGV

SEQ ID NO: 498000 - protein, 10 aa, Influenza virus
GFSYKYDNGV

SEQ ID NO: 498001 - protein, 10 aa, Influenza virus
GFSYKYGNGV

SEQ ID NO: 498002 - protein, 10 aa, Influenza virus
GFSYRYGNGV

SEQ ID NO: 498003 - protein, 10 aa, Influenza virus
GFTYNGIRTN

SEQ ID NO: 498004 - protein, 10 aa, Influenza virus
GFTYSEIRTN

SEQ ID NO: 498005 - protein, 10 aa, Influenza virus
GFTYSGIRTD

SEQ ID NO: 498006 - protein, 10 aa, Influenza virus
GFTYSGIRTN

SEQ ID NO: 498007 - protein, 10 aa, Influenza virus
GFTYTGVRTD

SEQ ID NO: 498008 - protein, 10 aa, Influenza virus
GFTYTGVRTN

SEQ ID NO: 498009 - protein, 10 aa, Influenza virus
GFVANFSMEL

SEQ ID NO: 498010 - protein, 10 aa, Influenza virus
GFVENLEELR

SEQ ID NO: 498011 - protein, 10 aa, Influenza virus
GFVFTLTVPS

SEQ ID NO: 498012 - protein, 10 aa, Influenza virus
GFVHFVEALA

SEQ ID NO: 498013 - protein, 10 aa, Influenza virus
GFVIVSKDNG

SEQ ID NO: 498014 - protein, 10 aa, Influenza virus
GFVLWACQNG

SEQ ID NO: 498015 - protein, 10 aa, Influenza virus
GFVMWACQKG

SEQ ID NO: 498016 - protein, 10 aa, Influenza virus
GFVPFSKDNS

SEQ ID NO: 498017 - protein, 10 aa, Influenza virus
GFVRQCFNPM

SEQ ID NO: 498018 - protein, 10 aa, Influenza virus
GFVRTLFQQM

SEQ ID NO: 498019 - protein, 10 aa, Influenza virus
GFVYFVEALA

SEQ ID NO: 498020 - protein, 10 aa, Influenza virus
GFVYFVEILA

SEQ ID NO: 498021 - protein, 10 aa, Influenza virus
GFVYFVETLA

SEQ ID NO: 498022 - protein, 10 aa, Influenza virus
GFWMCSNGSL

SEQ ID NO: 498023 - protein, 10 aa, Influenza virus
GGAIWVTREP

SEQ ID NO: 498024 - protein, 10 aa, Influenza virus
GGAQHVEECS

SEQ ID NO: 498025 - protein, 10 aa, Influenza virus
GGAVWVTREP

SEQ ID NO: 498026 - protein, 10 aa, Influenza virus
GGDIWATREP

SEQ ID NO: 498027 - protein, 10 aa, Influenza virus
GGDIWITREP

SEQ ID NO: 498028 - protein, 10 aa, Influenza virus
GGDIWVMREP

SEQ ID NO: 498029 - protein, 10 aa, Influenza virus
GGDIWVTREL

SEQ ID NO: 498030 - protein, 10 aa, Influenza virus
GGDIWVTREP

SEQ ID NO: 498031 - protein, 10 aa, Influenza virus
GGDIWVTRVP

SEQ ID NO: 498032 - protein, 10 aa, Influenza virus
GGDSFYAELK

SEQ ID NO: 498033 - protein, 10 aa, Influenza virus
GGFIFGCQNG

SEQ ID NO: 498034 - protein, 10 aa, Influenza virus
GGFLAPRYGY

SEQ ID NO: 498035 - protein, 10 aa, Influenza virus
GGFTFKRTKG

SEQ ID NO: 498036 - protein, 10 aa, Influenza virus
GGFTFKRTNG

SEQ ID NO: 498037 - protein, 10 aa, Influenza virus
GGFTFKRTSG

SEQ ID NO: 498038 - protein, 10 aa, Influenza virus
GGGDIWVTRE

SEQ ID NO: 498039 - protein, 10 aa, Influenza virus
GGGPDPGVKG

SEQ ID NO: 498040 - protein, 10 aa, Influenza virus
GGGYAADKES

SEQ ID NO: 498041 - protein, 10 aa, Influenza virus
GGHGVKGWAF

SEQ ID NO: 498042 - protein, 10 aa, Influenza virus
GGHIEECSCY

SEQ ID NO: 498043 - protein, 10 aa, Influenza virus
GGHIWVTREP

SEQ ID NO: 498044 - protein, 10 aa, Influenza virus
GGIDKEPMGF

SEQ ID NO: 498045 - protein, 10 aa, Influenza virus
GGIDKESMGF

SEQ ID NO: 498046 - protein, 10 aa, Influenza virus
GGIDTNKTFQ

SEQ ID NO: 498047 - protein, 10 aa, Influenza virus
GGIGKFYIQM

SEQ ID NO: 498048 - protein, 10 aa, Influenza virus
GGIGRFYIQM

SEQ ID NO: 498049 - protein, 10 aa, Influenza virus
GGIGRFYVQM

SEQ ID NO: 498050 - protein, 10 aa, Influenza virus
GGINTNKTFQ

SEQ ID NO: 498051 - protein, 10 aa, Influenza virus
GGINTNRTFQ

SEQ ID NO: 498052 - protein, 10 aa, Influenza virus
GGIPTDVVRS

SEQ ID NO: 498053 - protein, 10 aa, Influenza virus
GGLGVKGFGF

SEQ ID NO: 498054 - protein, 10 aa, Influenza virus
GGLIAPRYGY

SEQ ID NO: 498055 - protein, 10 aa, Influenza virus
GGLIAPSRVS

SEQ ID NO: 498056 - protein, 10 aa, Influenza virus
GGLIAPSRVT

SEQ ID NO: 498057 - protein, 10 aa, Influenza virus
GGLILGMQNG

SEQ ID NO: 498058 - protein, 10 aa, Influenza virus
GGLLAPKYGY

SEQ ID NO: 498059 - protein, 10 aa, Influenza virus
GGLLAPRYGY

SEQ ID NO: 498060 - protein, 10 aa, Influenza virus
GGLVAPSRVS

SEQ ID NO: 498061 - protein, 10 aa, Influenza virus
GGMPTDVVRS

SEQ ID NO: 498062 - protein, 10 aa, Influenza virus
GGNEKKAKLA

SEQ ID NO: 498063 - protein, 10 aa, Influenza virus
GGNIWITREP

SEQ ID NO: 498064 - protein, 10 aa, Influenza virus
GGNPDPGVKG

SEQ ID NO: 498065 - protein, 10 aa, Influenza virus
GGNSFYAELK

SEQ ID NO: 498066 - protein, 10 aa, Influenza virus
GGPDPGVKGF

SEQ ID NO: 498067 - protein, 10 aa, Influenza virus
GGPGVKGFGF

SEQ ID NO: 498068 - protein, 10 aa, Influenza virus
GGPNLYNIRN

SEQ ID NO: 498069 - protein, 10 aa, Influenza virus
GGQAFYRSIN

SEQ ID NO: 498070 - protein, 10 aa, Influenza virus
GGQSFYRSIN

SEQ ID NO: 498071 - protein, 10 aa, Influenza virus
GGRNSFFSRL

SEQ ID NO: 498072 - protein, 10 aa, Influenza virus
GGSGTDNYGV

SEQ ID NO: 498073 - protein, 10 aa, Influenza virus
GGSGTNNYGV

SEQ ID NO: 498074 - protein, 10 aa, Influenza virus
GGSIITELPF

SEQ ID NO: 498075 - protein, 10 aa, Influenza virus
GGSIKTKLPF

SEQ ID NO: 498076 - protein, 10 aa, Influenza virus
GGSINTKLPF

SEQ ID NO: 498077 - protein, 10 aa, Influenza virus
GGSINTRLPF

SEQ ID NO: 498078 - protein, 10 aa, Influenza virus
GGSPDPGVKG

SEQ ID NO: 498079 - protein, 10 aa, Influenza virus
GGTGSVYIEV

SEQ ID NO: 498080 - protein, 10 aa, Influenza virus
GGTIASSLPF

SEQ ID NO: 498081 - protein, 10 aa, Influenza virus
GGTIISNLPF

SEQ ID NO: 498082 - protein, 10 aa, Influenza virus
GGTIISSLPF

SEQ ID NO: 498083 - protein, 10 aa, Influenza virus
GGTINSPLPF

SEQ ID NO: 498084 - protein, 10 aa, Influenza virus
GGTINTKLPF

SEQ ID NO: 498085 - protein, 10 aa, Influenza virus
GGTITSNLPF

SEQ ID NO: 498086 - protein, 10 aa, Influenza virus
GGTITSPLPF

SEQ ID NO: 498087 - protein, 10 aa, Influenza virus
GGTIVSSLPF

SEQ ID NO: 498088 - protein, 10 aa, Influenza virus
GGTPDPGVKG

SEQ ID NO: 498089 - protein, 10 aa, Influenza virus
GGTSSIYIEV

SEQ ID NO: 498090 - protein, 10 aa, Influenza virus
GGTSSMYIEV

SEQ ID NO: 498091 - protein, 10 aa, Influenza virus
GGTSSVYIEV

SEQ ID NO: 498092 - protein, 10 aa, Influenza virus
GGTSSVYVEV

SEQ ID NO: 498093 - protein, 10 aa, Influenza virus
GGVESAVLRG

SEQ ID NO: 498094 - protein, 10 aa, Influenza virus
GGVNTNKTFQ

SEQ ID NO: 498095 - protein, 10 aa, Influenza virus
GGVPTDVIRS

SEQ ID NO: 498096 - protein, 10 aa, Influenza virus
GGVPTDVMRS

SEQ ID NO: 498097 - protein, 10 aa, Influenza virus
GGVPTDVVRS

SEQ ID NO: 498098 - protein, 10 aa, Influenza virus
GGWATANSKS

SEQ ID NO: 498099 - protein, 10 aa, Influenza virus
GGWCGMIDGW

SEQ ID NO: 498100 - protein, 10 aa, Influenza virus
GGWPGLINGW

SEQ ID NO: 498101 - protein, 10 aa, Influenza virus
GGWPGLVAGW

SEQ ID NO: 498102 - protein, 10 aa, Influenza virus
GGWQGLVDGW

SEQ ID NO: 498103 - protein, 10 aa, Influenza virus
GGWQGMIDGW

SEQ ID NO: 498104 - protein, 10 aa, Influenza virus
GGWQGMVDGW

SEQ ID NO: 498105 - protein, 10 aa, Influenza virus
GGWSGLIAGW

SEQ ID NO: 498106 - protein, 10 aa, Influenza virus
GGWSGLVAGW

SEQ ID NO: 498107 - protein, 10 aa, Influenza virus
GGWSGMIDGW

SEQ ID NO: 498108 - protein, 10 aa, Influenza virus
GGWTGLIDGW

SEQ ID NO: 498109 - protein, 10 aa, Influenza virus
GGWTGMIDGW

SEQ ID NO: 498110 - protein, 10 aa, Influenza virus
GGWTGMVDGW

SEQ ID NO: 498111 - protein, 10 aa, Influenza virus
GGWTGMVNGW

SEQ ID NO: 498112 - protein, 10 aa, Influenza virus
GGWTIANSKS

SEQ ID NO: 498113 - protein, 10 aa, Influenza virus
GGWTTANSKS

SEQ ID NO: 498114 - protein, 10 aa, Influenza virus
GGYKDIILWF

SEQ ID NO: 498115 - protein, 10 aa, Influenza virus
GGYKDVILWF

SEQ ID NO: 498116 - protein, 10 aa, Influenza virus
GGYPVIKKTY

SEQ ID NO: 498117 - protein, 10 aa, Influenza virus
GHDFEREGYS

SEQ ID NO: 498118 - protein, 10 aa, Influenza virus
GHFVNIELED

SEQ ID NO: 498119 - protein, 10 aa, Influenza virus
GHGVKGWAFD

SEQ ID NO: 498120 - protein, 10 aa, Influenza virus
GHHAIPNGTI

SEQ ID NO: 498121 - protein, 10 aa, Influenza virus
GHHANNSTEQ

SEQ ID NO: 498122 - protein, 10 aa, Influenza virus
GHHAVANGTI

SEQ ID NO: 498123 - protein, 10 aa, Influenza virus
GHHAVANGTK

SEQ ID NO: 498124 - protein, 10 aa, Influenza virus
GHHAVANGTR

SEQ ID NO: 498125 - protein, 10 aa, Influenza virus
GHHAVANGTV

SEQ ID NO: 498126 - protein, 10 aa, Influenza virus
GHHAVENGTS

SEQ ID NO: 498127 - protein, 10 aa, Influenza virus
GHHAVPNGTI

SEQ ID NO: 498128 - protein, 10 aa, Influenza virus
GHHAVPNGTK

SEQ ID NO: 498129 - protein, 10 aa, Influenza virus
GHHAVPNGTL

SEQ ID NO: 498130 - protein, 10 aa, Influenza virus
GHHAVPNGTV

SEQ ID NO: 498131 - protein, 10 aa, Influenza virus
GHHAVSNGTI

SEQ ID NO: 498132 - protein, 10 aa, Influenza virus
GHHAVSNGTK

SEQ ID NO: 498133 - protein, 10 aa, Influenza virus
GHHAVTNGTK

SEQ ID NO: 498134 - protein, 10 aa, Influenza virus
GHIEECSCYP

SEQ ID NO: 498135 - protein, 10 aa, Influenza virus
GHIFVIREPF

SEQ ID NO: 498136 - protein, 10 aa, Influenza virus
GHIWVTREPY

SEQ ID NO: 498137 - protein, 10 aa, Influenza virus
GHLITGKSHG

SEQ ID NO: 498138 - protein, 10 aa, Influenza virus
GHLTTGKSHG

SEQ ID NO: 498139 - protein, 10 aa, Influenza virus
GHLVTGKSHG

SEQ ID NO: 498140 - protein, 10 aa, Influenza virus
GHNQEYTSGR

SEQ ID NO: 498141 - protein, 10 aa, Influenza virus
GHVFVIREPF

SEQ ID NO: 498142 - protein, 10 aa, Influenza virus
GHWPDGSNIG

SEQ ID NO: 498143 - protein, 10 aa, Influenza virus
GHYKISKSTK

SEQ ID NO: 498144 - protein, 10 aa, Influenza virus
GIAADKASTQ

SEQ ID NO: 498145 - protein, 10 aa, Influenza virus
GIAADKESTQ

SEQ ID NO: 498146 - protein, 10 aa, Influenza virus
GIAADKTSTQ

SEQ ID NO: 498147 - protein, 10 aa, Influenza virus
GIAADKVSTQ

SEQ ID NO: 498148 - protein, 10 aa, Influenza virus
GIAADRDSTQ

SEQ ID NO: 498149 - protein, 10 aa, Influenza virus
GIAADRESTQ

SEQ ID NO: 498150 - protein, 10 aa, Influenza virus
GIAADRGSTQ

SEQ ID NO: 498151 - protein, 10 aa, Influenza virus
GIAADYKSTQ

SEQ ID NO: 498152 - protein, 10 aa, Influenza virus
GIAAEKESTQ

SEQ ID NO: 498153 - protein, 10 aa, Influenza virus
GIAIALGIIN

SEQ ID NO: 498154 - protein, 10 aa, Influenza virus
GIAIVLGIIN

SEQ ID NO: 498155 - protein, 10 aa, Influenza virus
GIANLGLNIG

SEQ ID NO: 498156 - protein, 10 aa, Influenza virus
GICAVATTHS

SEQ ID NO: 498157 - protein, 10 aa, Influenza virus
GICPVVFTDG

SEQ ID NO: 498158 - protein, 10 aa, Influenza virus
GICPVVMTDG

SEQ ID NO: 498159 - protein, 10 aa, Influenza virus
GICTVVMTDG

SEQ ID NO: 498160 - protein, 10 aa, Influenza virus
GICVVAVTDG

SEQ ID NO: 498161 - protein, 10 aa, Influenza virus
GICYPGSIEN

SEQ ID NO: 498162 - protein, 10 aa, Influenza virus
GICYPGSVEN

SEQ ID NO: 498163 - protein, 10 aa, Influenza virus
GIDKEPMGFR

SEQ ID NO: 498164 - protein, 10 aa, Influenza virus
GIDKESMGFR

SEQ ID NO: 498165 - protein, 10 aa, Influenza virus
GIDKICLGHH

SEQ ID NO: 498166 - protein, 10 aa, Influenza virus
GIDKVCTKGK

SEQ ID NO: 498167 - protein, 10 aa, Influenza virus
GIDTNKTFQN

SEQ ID NO: 498168 - protein, 10 aa, Influenza virus
GIEVVNATET

SEQ ID NO: 498169 - protein, 10 aa, Influenza virus
GIEYNGKSLG

SEQ ID NO: 498170 - protein, 10 aa, Influenza virus
GIFFWMCSNG

SEQ ID NO: 498171 - protein, 10 aa, Influenza virus
GIFGAIAGFI

SEQ ID NO: 498172 - protein, 10 aa, Influenza virus
GIFGPVHFRN

SEQ ID NO: 498173 - protein, 10 aa, Influenza virus
GIFLWMCSNG

SEQ ID NO: 498174 - protein, 10 aa, Influenza virus
GIGIAADRDS

SEQ ID NO: 498175 - protein, 10 aa, Influenza virus
GIGKFYIQMC

SEQ ID NO: 498176 - protein, 10 aa, Influenza virus
GIGNLIFNTV

SEQ ID NO: 498177 - protein, 10 aa, Influenza virus
GIGNLVFNTV

SEQ ID NO: 498178 - protein, 10 aa, Influenza virus
GIGQAADLKS

SEQ ID NO: 498179 - protein, 10 aa, Influenza virus
GIGQAADYKS

SEQ ID NO: 498180 - protein, 10 aa, Influenza virus
GIGRFYIQMC

SEQ ID NO: 498181 - protein, 10 aa, Influenza virus
GIGRFYVQMC

SEQ ID NO: 498182 - protein, 10 aa, Influenza virus
GIGRMTICIQ

SEQ ID NO: 498183 - protein, 10 aa, Influenza virus
GIGRMTICVQ

SEQ ID NO: 498184 - protein, 10 aa, Influenza virus
GIHHPDSETT

SEQ ID NO: 498185 - protein, 10 aa, Influenza virus
GIHHPDTEAT

SEQ ID NO: 498186 - protein, 10 aa, Influenza virus
GIHHPDTEAV

SEQ ID NO: 498187 - protein, 10 aa, Influenza virus
GIHHPDTEEV

SEQ ID NO: 498188 - protein, 10 aa, Influenza virus
GIHHPDTETT

SEQ ID NO: 498189 - protein, 10 aa, Influenza virus
GIHHPPDAKE

SEQ ID NO: 498190 - protein, 10 aa, Influenza virus
GIHHPPDETE

SEQ ID NO: 498191 - protein, 10 aa, Influenza virus
GIHHPPDTKE

SEQ ID NO: 498192 - protein, 10 aa, Influenza virus
GIHHPPNTKE

SEQ ID NO: 498193 - protein, 10 aa, Influenza virus
GIHHPSSAQE

SEQ ID NO: 498194 - protein, 10 aa, Influenza virus
GIHHPSSTKE

SEQ ID NO: 498195 - protein, 10 aa, Influenza virus
GIHHPSSTQE

SEQ ID NO: 498196 - protein, 10 aa, Influenza virus
GIILGNPKCD

SEQ ID NO: 498197 - protein, 10 aa, Influenza virus
GIINLLIGIS

SEQ ID NO: 498198 - protein, 10 aa, Influenza virus
GIITDTFKSW

SEQ ID NO: 498199 - protein, 10 aa, Influenza virus
GIITDTIKSW

SEQ ID NO: 498200 - protein, 10 aa, Influenza virus
GIITDTIRSW

SEQ ID NO: 498201 - protein, 10 aa, Influenza virus
GIITDTLKSW

SEQ ID NO: 498202 - protein, 10 aa, Influenza virus
GIITETIKSW

SEQ ID NO: 498203 - protein, 10 aa, Influenza virus
GIITGPPQCD

SEQ ID NO: 498204 - protein, 10 aa, Influenza virus
GIITGTIKSW

SEQ ID NO: 498205 - protein, 10 aa, Influenza virus
GIKGFAFLDG

SEQ ID NO: 498206 - protein, 10 aa, Influenza virus
GIKGFGFLNE

SEQ ID NO: 498207 - protein, 10 aa, Influenza virus
GIKGFSFKYG

SEQ ID NO: 498208 - protein, 10 aa, Influenza virus
GIKGFSFRYG

SEQ ID NO: 498209 - protein, 10 aa, Influenza virus
GIKLKSEDNV

SEQ ID NO: 498210 - protein, 10 aa, Influenza virus
GIKLKTEDNI

SEQ ID NO: 498211 - protein, 10 aa, Influenza virus
GIKLKTEDNV

SEQ ID NO: 498212 - protein, 10 aa, Influenza virus
GIKSFSRTEL

SEQ ID NO: 498213 - protein, 10 aa, Influenza virus
GIKSFSRTQL

SEQ ID NO: 498214 - protein, 10 aa, Influenza virus
GIKTDGATSA

SEQ ID NO: 498215 - protein, 10 aa, Influenza virus
GIKVDTLTEK

SEQ ID NO: 498216 - protein, 10 aa, Influenza virus
GILEDEQMYQ

SEQ ID NO: 498217 - protein, 10 aa, Influenza virus
GILGFVFTLT

SEQ ID NO: 498218 - protein, 10 aa, Influenza virus
GILGILTGPP

SEQ ID NO: 498219 - protein, 10 aa, Influenza virus
GILGTIIGPP

SEQ ID NO: 498220 - protein, 10 aa, Influenza virus
GILKRGETLK

SEQ ID NO: 498221 - protein, 10 aa, Influenza virus
GILTDTSRPG

SEQ ID NO: 498222 - protein, 10 aa, Influenza virus
GILTDTSRPS

SEQ ID NO: 498223 - protein, 10 aa, Influenza virus
GILTGPPQCD

SEQ ID NO: 498224 - protein, 10 aa, Influenza virus
GIMNTSKPFQ

SEQ ID NO: 498225 - protein, 10 aa, Influenza virus
GINDRNFWRG

SEQ ID NO: 498226 - protein, 10 aa, Influenza virus
GINESADMSI

SEQ ID NO: 498227 - protein, 10 aa, Influenza virus
GINKVCTKGK

SEQ ID NO: 498228 - protein, 10 aa, Influenza virus
GINMSKKKSY

SEQ ID NO: 498229 - protein, 10 aa, Influenza virus
GINTNKTFQN

SEQ ID NO: 498230 - protein, 10 aa, Influenza virus
GINTNRTFQN

SEQ ID NO: 498231 - protein, 10 aa, Influenza virus
GIPESMREEY

SEQ ID NO: 498232 - protein, 10 aa, Influenza virus
GIPFHLGTKQ

SEQ ID NO: 498233 - protein, 10 aa, Influenza virus
GIPLHDAIKC

SEQ ID NO: 498234 - protein, 10 aa, Influenza virus
GIPLYDAIKC

SEQ ID NO: 498235 - protein, 10 aa, Influenza virus
GIPLYDAVKC

SEQ ID NO: 498236 - protein, 10 aa, Influenza virus
GIPLYDAVRC

SEQ ID NO: 498237 - protein, 10 aa, Influenza virus
GIPPLELGDC

SEQ ID NO: 498238 - protein, 10 aa, Influenza virus
GIPPLELGNC

SEQ ID NO: 498239 - protein, 10 aa, Influenza virus
GIPPLELRDC

SEQ ID NO: 498240 - protein, 10 aa, Influenza virus
GIPPLVLGDC

SEQ ID NO: 498241 - protein, 10 aa, Influenza virus
GIPSDTPRGE

SEQ ID NO: 498242 - protein, 10 aa, Influenza virus
GIPTDTPRGE

SEQ ID NO: 498243 - protein, 10 aa, Influenza virus
GIPTDTPRIQ

SEQ ID NO: 498244 - protein, 10 aa, Influenza virus
GIPTDTPRVQ

SEQ ID NO: 498245 - protein, 10 aa, Influenza virus
GIPTDVIRSW

SEQ ID NO: 498246 - protein, 10 aa, Influenza virus
GIPTDVVRSW

SEQ ID NO: 498247 - protein, 10 aa, Influenza virus
GIQAGVDRFY

SEQ ID NO: 498248 - protein, 10 aa, Influenza virus
GIQAGVNRFY

SEQ ID NO: 498249 - protein, 10 aa, Influenza virus
GIQSDAQIDE

SEQ ID NO: 498250 - protein, 10 aa, Influenza virus
GIREWSYLIE

SEQ ID NO: 498251 - protein, 10 aa, Influenza virus
GIRIGSKGDV

SEQ ID NO: 498252 - protein, 10 aa, Influenza virus
GIRIGSKGHV

SEQ ID NO: 498253 - protein, 10 aa, Influenza virus
GIRIGSRGEV

SEQ ID NO: 498254 - protein, 10 aa, Influenza virus
GIRIGSRGHI

SEQ ID NO: 498255 - protein, 10 aa, Influenza virus
GIRIGSRGHV

SEQ ID NO: 498256 - protein, 10 aa, Influenza virus
GIRPGYNGQK

SEQ ID NO: 498257 - protein, 10 aa, Influenza virus
GIRSFSRTEL

SEQ ID NO: 498258 - protein, 10 aa, Influenza virus
GIRTDGATSA

SEQ ID NO: 498259 - protein, 10 aa, Influenza virus
GIRVGSRGHV

SEQ ID NO: 498260 - protein, 10 aa, Influenza virus
GISFWMCSNG

SEQ ID NO: 498261 - protein, 10 aa, Influenza virus
GISGADDDAY

SEQ ID NO: 498262 - protein, 10 aa, Influenza virus
GISGPDDGAV

SEQ ID NO: 498263 - protein, 10 aa, Influenza virus
GISGPDNEAV

SEQ ID NO: 498264 - protein, 10 aa, Influenza virus
GISGPDNGAV

SEQ ID NO: 498265 - protein, 10 aa, Influenza virus
GISGPDSGAV

SEQ ID NO: 498266 - protein, 10 aa, Influenza virus
GISIWMCSNG

SEQ ID NO: 498267 - protein, 10 aa, Influenza virus
GISLWMCSNG

SEQ ID NO: 498268 - protein, 10 aa, Influenza virus
GISNVGLNIS

SEQ ID NO: 498269 - protein, 10 aa, Influenza virus
GISNVGLNVS

SEQ ID NO: 498270 - protein, 10 aa, Influenza virus
GISPIHLGDC

SEQ ID NO: 498271 - protein, 10 aa, Influenza virus
GISPVHLGDC

SEQ ID NO: 498272 - protein, 10 aa, Influenza virus
GISSMGEAMV

SEQ ID NO: 498273 - protein, 10 aa, Influenza virus
GISSMMEAMV

SEQ ID NO: 498274 - protein, 10 aa, Influenza virus
GISSMVEAMI

SEQ ID NO: 498275 - protein, 10 aa, Influenza virus
GISSMVEAMM

SEQ ID NO: 498276 - protein, 10 aa, Influenza virus
GISSMVEAMV

SEQ ID NO: 498277 - protein, 10 aa, Influenza virus
GITGPDATAV

SEQ ID NO: 498278 - protein, 10 aa, Influenza virus
GITGPDSTAV

SEQ ID NO: 498279 - protein, 10 aa, Influenza virus
GITGPDTTAV

SEQ ID NO: 498280 - protein, 10 aa, Influenza virus
GITNKINSII

SEQ ID NO: 498281 - protein, 10 aa, Influenza virus
GITNKVNSII

SEQ ID NO: 498282 - protein, 10 aa, Influenza virus
GITNRVNSII

SEQ ID NO: 498283 - protein, 10 aa, Influenza virus
GITVIKNNMI

SEQ ID NO: 498284 - protein, 10 aa, Influenza virus
GIVADRDSTQ

SEQ ID NO: 498285 - protein, 10 aa, Influenza virus
GIVNTTLSTI

SEQ ID NO: 498286 - protein, 10 aa, Influenza virus
GIWIGRTKST

SEQ ID NO: 498287 - protein, 10 aa, Influenza virus
GIYKILTIYS

SEQ ID NO: 498288 - protein, 10 aa, Influenza virus
GIYQILAIYA

SEQ ID NO: 498289 - protein, 10 aa, Influenza virus
GIYQILAIYS

SEQ ID NO: 498290 - protein, 10 aa, Influenza virus
GIYQILSIYS

SEQ ID NO: 498291 - protein, 10 aa, Influenza virus
GKADTRILFI

SEQ ID NO: 498292 - protein, 10 aa, Influenza virus
GKADTRILFV

SEQ ID NO: 498293 - protein, 10 aa, Influenza virus
GKAPISLGDC

SEQ ID NO: 498294 - protein, 10 aa, Influenza virus
GKAPISLGGC

SEQ ID NO: 498295 - protein, 10 aa, Influenza virus
GKAWLHICVT

SEQ ID NO: 498296 - protein, 10 aa, Influenza virus
GKAWLHVCIT

SEQ ID NO: 498297 - protein, 10 aa, Influenza virus
GKAWLHVCVT

SEQ ID NO: 498298 - protein, 10 aa, Influenza virus
GKCNDPYPGN

SEQ ID NO: 498299 - protein, 10 aa, Influenza virus
GKCNEPYPGN

SEQ ID NO: 498300 - protein, 10 aa, Influenza virus
GKCNTKCQTS

SEQ ID NO: 498301 - protein, 10 aa, Influenza virus
GKCPKYIPSG

SEQ ID NO: 498302 - protein, 10 aa, Influenza virus
GKCPKYIPSN

SEQ ID NO: 498303 - protein, 10 aa, Influenza virus
GKCPKYIPSR

SEQ ID NO: 498304 - protein, 10 aa, Influenza virus
GKCPKYISSG

SEQ ID NO: 498305 - protein, 10 aa, Influenza virus
GKCPKYVKST

SEQ ID NO: 498306 - protein, 10 aa, Influenza virus
GKCPRYIPSG

SEQ ID NO: 498307 - protein, 10 aa, Influenza virus
GKCPRYVKQS

SEQ ID NO: 498308 - protein, 10 aa, Influenza virus
GKCSKYVKST

SEQ ID NO: 498309 - protein, 10 aa, Influenza virus
GKCYQFALGQ

SEQ ID NO: 498310 - protein, 10 aa, Influenza virus
GKDNAIRIGE

SEQ ID NO: 498311 - protein, 10 aa, Influenza virus
GKDNAVRIGE

SEQ ID NO: 498312 - protein, 10 aa, Influenza virus
GKDPKKTGGP

SEQ ID NO: 498313 - protein, 10 aa, Influenza virus
GKEDKRYGPA

SEQ ID NO: 498314 - protein, 10 aa, Influenza virus
GKEDRRYGPA

SEQ ID NO: 498315 - protein, 10 aa, Influenza virus
GKENKKYGPA

SEQ ID NO: 498316 - protein, 10 aa, Influenza virus
GKENKRYGPA

SEQ ID NO: 498317 - protein, 10 aa, Influenza virus
GKEPISLGDC

SEQ ID NO: 498318 - protein, 10 aa, Influenza virus
GKEWLHVCIT

SEQ ID NO: 498319 - protein, 10 aa, Influenza virus
GKEWMHICMT

SEQ ID NO: 498320 - protein, 10 aa, Influenza virus
GKEWMHVCIT

SEQ ID NO: 498321 - protein, 10 aa, Influenza virus
GKEWMHVCMA

SEQ ID NO: 498322 - protein, 10 aa, Influenza virus
GKEWMHVCMT

SEQ ID NO: 498323 - protein, 10 aa, Influenza virus
GKFEFIAEDF

SEQ ID NO: 498324 - protein, 10 aa, Influenza virus
GKFEFIAEEF

SEQ ID NO: 498325 - protein, 10 aa, Influenza virus
GKFEFIVEKF

SEQ ID NO: 498326 - protein, 10 aa, Influenza virus
GKFQTAAQKA

SEQ ID NO: 498327 - protein, 10 aa, Influenza virus
GKFQTAAQRA

SEQ ID NO: 498328 - protein, 10 aa, Influenza virus
GKFTNEEALR

SEQ ID NO: 498329 - protein, 10 aa, Influenza virus
GKFYIQMCTE

SEQ ID NO: 498330 - protein, 10 aa, Influenza virus
GKGCFDILHK

SEQ ID NO: 498331 - protein, 10 aa, Influenza virus
GKGCFDLYHK

SEQ ID NO: 498332 - protein, 10 aa, Influenza virus
GKGCFEIYHA

SEQ ID NO: 498333 - protein, 10 aa, Influenza virus
GKGCFEIYHK

SEQ ID NO: 498334 - protein, 10 aa, Influenza virus
GKGCFEIYHN

SEQ ID NO: 498335 - protein, 10 aa, Influenza virus
GKGCFEIYHT

SEQ ID NO: 498336 - protein, 10 aa, Influenza virus
GKGCFELYHE

SEQ ID NO: 498337 - protein, 10 aa, Influenza virus
GKGCFELYHK

SEQ ID NO: 498338 - protein, 10 aa, Influenza virus
GKGCFELYHR

SEQ ID NO: 498339 - protein, 10 aa, Influenza virus
GKGRIFQSHI

SEQ ID NO: 498340 - protein, 10 aa, Influenza virus
GKGRIFQSPI

SEQ ID NO: 498341 - protein, 10 aa, Influenza virus
GKGRIFQSRI

SEQ ID NO: 498342 - protein, 10 aa, Influenza virus
GKGRYGVKGF

SEQ ID NO: 498343 - protein, 10 aa, Influenza virus
GKHIVERILE

SEQ ID NO: 498344 - protein, 10 aa, Influenza virus
GKHSNGTIHD

SEQ ID NO: 498345 - protein, 10 aa, Influenza virus
GKIAHISPLS

SEQ ID NO: 498346 - protein, 10 aa, Influenza virus
GKIIHISPLS

SEQ ID NO: 498347 - protein, 10 aa, Influenza virus
GKIIQNEDIP

SEQ ID NO: 498348 - protein, 10 aa, Influenza virus
GKILRTQESE

SEQ ID NO: 498349 - protein, 10 aa, Influenza virus
GKISHISPLS

SEQ ID NO: 498350 - protein, 10 aa, Influenza virus
GKITNKVNNI

SEQ ID NO: 498351 - protein, 10 aa, Influenza virus
GKIVHISPLS

SEQ ID NO: 498352 - protein, 10 aa, Influenza virus
GKKAVDLGSC

SEQ ID NO: 498353 - protein, 10 aa, Influenza virus
GKKEEFSEIM

SEQ ID NO: 498354 - protein, 10 aa, Influenza virus
GKKEFSEIMK

SEQ ID NO: 498355 - protein, 10 aa, Influenza virus
GKKGKWLNQS

SEQ ID NO: 498356 - protein, 10 aa, Influenza virus
GKLCKLNGIP

SEQ ID NO: 498357 - protein, 10 aa, Influenza virus
GKLCRLRGIP

SEQ ID NO: 498358 - protein, 10 aa, Influenza virus
GKLCRLSGIP

SEQ ID NO: 498359 - protein, 10 aa, Influenza virus
GKLEFIAEEF

SEQ ID NO: 498360 - protein, 10 aa, Influenza virus
GKLKRRAIAT

SEQ ID NO: 498361 - protein, 10 aa, Influenza virus
GKLNRFIEKT

SEQ ID NO: 498362 - protein, 10 aa, Influenza virus
GKLNRIIEKT

SEQ ID NO: 498363 - protein, 10 aa, Influenza virus
GKLNRLIDKT

SEQ ID NO: 498364 - protein, 10 aa, Influenza virus
GKLNRLIDRT

SEQ ID NO: 498365 - protein, 10 aa, Influenza virus
GKLNRLIEKT

SEQ ID NO: 498366 - protein, 10 aa, Influenza virus
GKLNRLIERT

SEQ ID NO: 498367 - protein, 10 aa, Influenza virus
GKLNRLIGKT

SEQ ID NO: 498368 - protein, 10 aa, Influenza virus
GKLNRLISKT

SEQ ID NO: 498369 - protein, 10 aa, Influenza virus
GKMRDSIKSW

SEQ ID NO: 498370 - protein, 10 aa, Influenza virus
GKMTDSIKSW

SEQ ID NO: 498371 - protein, 10 aa, Influenza virus
GKNADLEALM

SEQ ID NO: 498372 - protein, 10 aa, Influenza virus
GKNSDLEALM

SEQ ID NO: 498373 - protein, 10 aa, Influenza virus
GKNSFYAELK

SEQ ID NO: 498374 - protein, 10 aa, Influenza virus
GKNSWSYIVE

SEQ ID NO: 498375 - protein, 10 aa, Influenza virus
GKNTDLEALM

SEQ ID NO: 498376 - protein, 10 aa, Influenza virus
GKNTDLEVLM

SEQ ID NO: 498377 - protein, 10 aa, Influenza virus
GKQAKGLFGA

SEQ ID NO: 498378 - protein, 10 aa, Influenza virus
GKQPISLGDC

SEQ ID NO: 498379 - protein, 10 aa, Influenza virus
GKRGKWVKSV

SEQ ID NO: 498380 - protein, 10 aa, Influenza virus
GKSGACKRAD

SEQ ID NO: 498381 - protein, 10 aa, Influenza virus
GKSGACKRAN

SEQ ID NO: 498382 - protein, 10 aa, Influenza virus
GKSHGRILKN

SEQ ID NO: 498383 - protein, 10 aa, Influenza virus
GKSHGRVLKN

SEQ ID NO: 498384 - protein, 10 aa, Influenza virus
GKSLGIQSDA

SEQ ID NO: 498385 - protein, 10 aa, Influenza virus
GKSSACKRAN

SEQ ID NO: 498386 - protein, 10 aa, Influenza virus
GKTKATKMEA

SEQ ID NO: 498387 - protein, 10 aa, Influenza virus
GKTKATKMKA

SEQ ID NO: 498388 - protein, 10 aa, Influenza virus
GKTNEKFHQI

SEQ ID NO: 498389 - protein, 10 aa, Influenza virus
GKTNQQFELI

SEQ ID NO: 498390 - protein, 10 aa, Influenza virus
GKTSWSYIVE

SEQ ID NO: 498391 - protein, 10 aa, Influenza virus
GKVCRALLAK

SEQ ID NO: 498392 - protein, 10 aa, Influenza virus
GKVCRTLLAK

SEQ ID NO: 498393 - protein, 10 aa, Influenza virus
GKVECICRDN

SEQ ID NO: 498394 - protein, 10 aa, Influenza virus
GKVECVCRDN

SEQ ID NO: 498395 - protein, 10 aa, Influenza virus
GKVVHISPLS

SEQ ID NO: 498396 - protein, 10 aa, Influenza virus
GKWDTLIERE

SEQ ID NO: 498397 - protein, 10 aa, Influenza virus
GKWREQLSQK

SEQ ID NO: 498398 - protein, 10 aa, Influenza virus
GLANLGLNIG

SEQ ID NO: 498399 - protein, 10 aa, Influenza virus
GLANLGLNVG

SEQ ID NO: 498400 - protein, 10 aa, Influenza virus
GLCTINSWHI

SEQ ID NO: 498401 - protein, 10 aa, Influenza virus
GLCYPGELDN

SEQ ID NO: 498402 - protein, 10 aa, Influenza virus
GLCYPGELNN

SEQ ID NO: 498403 - protein, 10 aa, Influenza virus
GLDIRTATRE

SEQ ID NO: 498404 - protein, 10 aa, Influenza virus
GLDKICLGHH

SEQ ID NO: 498405 - protein, 10 aa, Influenza virus
GLDNEPGSGK

SEQ ID NO: 498406 - protein, 10 aa, Influenza virus
GLDNEPGSGN

SEQ ID NO: 498407 - protein, 10 aa, Influenza virus
GLDRICLGHH

SEQ ID NO: 498408 - protein, 10 aa, Influenza virus
GLFFFCLKNG

SEQ ID NO: 498409 - protein, 10 aa, Influenza virus
GLFFWMCSNG

SEQ ID NO: 498410 - protein, 10 aa, Influenza virus
GLFGAIAGFI

SEQ ID NO: 498411 - protein, 10 aa, Influenza virus
GLFGAKAGFI

SEQ ID NO: 498412 - protein, 10 aa, Influenza virus
GLFLWMCSNG

SEQ ID NO: 498413 - protein, 10 aa, Influenza virus
GLGVKGFGFK

SEQ ID NO: 498414 - protein, 10 aa, Influenza virus
GLHDANVRNL

SEQ ID NO: 498415 - protein, 10 aa, Influenza virus
GLIAGWYGFQ

SEQ ID NO: 498416 - protein, 10 aa, Influenza virus
GLIAPDRVSK

SEQ ID NO: 498417 - protein, 10 aa, Influenza virus
GLIAPRYGYI

SEQ ID NO: 498418 - protein, 10 aa, Influenza virus
GLIAPSRVSK

SEQ ID NO: 498419 - protein, 10 aa, Influenza virus
GLIAPSRVTK

SEQ ID NO: 498420 - protein, 10 aa, Influenza virus
GLICATCEQI

SEQ ID NO: 498421 - protein, 10 aa, Influenza virus
GLIDGWYGFK

SEQ ID NO: 498422 - protein, 10 aa, Influenza virus
GLIDGWYGFR

SEQ ID NO: 498423 - protein, 10 aa, Influenza virus
GLIDGWYGYH

SEQ ID NO: 498424 - protein, 10 aa, Influenza virus
GLIDGWYGYK

SEQ ID NO: 498425 - protein, 10 aa, Influenza virus
GLIDGWYGYR

SEQ ID NO: 498426 - protein, 10 aa, Influenza virus
GLIFMCVKNG

SEQ ID NO: 498427 - protein, 10 aa, Influenza virus
GLILAFILWA

SEQ ID NO: 498428 - protein, 10 aa, Influenza virus
GLILAFIMWA

SEQ ID NO: 498429 - protein, 10 aa, Influenza virus
GLILAFIMWT

SEQ ID NO: 498430 - protein, 10 aa, Influenza virus
GLILGMQNGS

SEQ ID NO: 498431 - protein, 10 aa, Influenza virus
GLILGNPKCD

SEQ ID NO: 498432 - protein, 10 aa, Influenza virus
GLILSFIMWA

SEQ ID NO: 498433 - protein, 10 aa, Influenza virus
GLILSNPKCD

SEQ ID NO: 498434 - protein, 10 aa, Influenza virus
GLILTFIMWA

SEQ ID NO: 498435 - protein, 10 aa, Influenza virus
GLINGWYGFQ

SEQ ID NO: 498436 - protein, 10 aa, Influenza virus
GLINGWYGFR

SEQ ID NO: 498437 - protein, 10 aa, Influenza virus
GLISTPLGSP

SEQ ID NO: 498438 - protein, 10 aa, Influenza virus
GLISTPLGTP

SEQ ID NO: 498439 - protein, 10 aa, Influenza virus
GLITDTIKSW

SEQ ID NO: 498440 - protein, 10 aa, Influenza virus
GLIYGNPFCD

SEQ ID NO: 498441 - protein, 10 aa, Influenza virus
GLIYGNPSCD

SEQ ID NO: 498442 - protein, 10 aa, Influenza virus
GLIYGNPSCN

SEQ ID NO: 498443 - protein, 10 aa, Influenza virus
GLIYNRMGAV

SEQ ID NO: 498444 - protein, 10 aa, Influenza virus
GLIYNRMGTI

SEQ ID NO: 498445 - protein, 10 aa, Influenza virus
GLIYNRMGTV

SEQ ID NO: 498446 - protein, 10 aa, Influenza virus
GLKISSSFSF

SEQ ID NO: 498447 - protein, 10 aa, Influenza virus
GLLAPKYGYI

SEQ ID NO: 498448 - protein, 10 aa, Influenza virus
GLLAPRYGYI

SEQ ID NO: 498449 - protein, 10 aa, Influenza virus
GLLDVWTYNA

SEQ ID NO: 498450 - protein, 10 aa, Influenza virus
GLLEVGTRWM

SEQ ID NO: 498451 - protein, 10 aa, Influenza virus
GLLGAIAGFI

SEQ ID NO: 498452 - protein, 10 aa, Influenza virus
GLLGIITGPP

SEQ ID NO: 498453 - protein, 10 aa, Influenza virus
GLLGILIGPP

SEQ ID NO: 498454 - protein, 10 aa, Influenza virus
GLLGTITGPP

SEQ ID NO: 498455 - protein, 10 aa, Influenza virus
GLLGTLIGPP

SEQ ID NO: 498456 - protein, 10 aa, Influenza virus
GLLGTLTGPP

SEQ ID NO: 498457 - protein, 10 aa, Influenza virus
GLLGTVTGPP

SEQ ID NO: 498458 - protein, 10 aa, Influenza virus
GLLISDGGPN

SEQ ID NO: 498459 - protein, 10 aa, Influenza virus
GLLLQIISLC

SEQ ID NO: 498460 - protein, 10 aa, Influenza virus
GLLLQITSLC

SEQ ID NO: 498461 - protein, 10 aa, Influenza virus
GLLLWMCSNG

SEQ ID NO: 498462 - protein, 10 aa, Influenza virus
GLLVADGGPN

SEQ ID NO: 498463 - protein, 10 aa, Influenza virus
GLLVALENQH

SEQ ID NO: 498464 - protein, 10 aa, Influenza virus
GLLVSDGGPN

SEQ ID NO: 498465 - protein, 10 aa, Influenza virus
GLMSTPLGSP

SEQ ID NO: 498466 - protein, 10 aa, Influenza virus
GLNIGLHLKP

SEQ ID NO: 498467 - protein, 10 aa, Influenza virus
GLNIGLHLRP

SEQ ID NO: 498468 - protein, 10 aa, Influenza virus
GLNNEPGSGN

SEQ ID NO: 498469 - protein, 10 aa, Influenza virus
GLNVGLHLKP

SEQ ID NO: 498470 - protein, 10 aa, Influenza virus
GLPQSGRIVV

SEQ ID NO: 498471 - protein, 10 aa, Influenza virus
GLPSDTPRGE

SEQ ID NO: 498472 - protein, 10 aa, Influenza virus
GLPVGGNEKK

SEQ ID NO: 498473 - protein, 10 aa, Influenza virus
GLQRRRFIQN

SEQ ID NO: 498474 - protein, 10 aa, Influenza virus
GLQRRRFVQN

SEQ ID NO: 498475 - protein, 10 aa, Influenza virus
GLQSSDDFAL

SEQ ID NO: 498476 - protein, 10 aa, Influenza virus
GLREQKQEFK

SEQ ID NO: 498477 - protein, 10 aa, Influenza virus
GLRILIRGNS

SEQ ID NO: 498478 - protein, 10 aa, Influenza virus
GLRILVRGNS

SEQ ID NO: 498479 - protein, 10 aa, Influenza virus
GLRISSSFSF

SEQ ID NO: 498480 - protein, 10 aa, Influenza virus
GLRNIPSIQS

SEQ ID NO: 498481 - protein, 10 aa, Influenza virus
GLRNIPSVQS

SEQ ID NO: 498482 - protein, 10 aa, Influenza virus
GLRNTPSIDP

SEQ ID NO: 498483 - protein, 10 aa, Influenza virus
GLRNTPSIEP

SEQ ID NO: 498484 - protein, 10 aa, Influenza virus
GLRNTPSVEP

SEQ ID NO: 498485 - protein, 10 aa, Influenza virus
GLRNVPSIQS

SEQ ID NO: 498486 - protein, 10 aa, Influenza virus
GLSFWMCSNG

SEQ ID NO: 498487 - protein, 10 aa, Influenza virus
GLSLWMCFNG

SEQ ID NO: 498488 - protein, 10 aa, Influenza virus
GLSLWMCSNG

SEQ ID NO: 498489 - protein, 10 aa, Influenza virus
GLSMVKSDKI

SEQ ID NO: 498490 - protein, 10 aa, Influenza virus
GLSMVRSDKI

SEQ ID NO: 498491 - protein, 10 aa, Influenza virus
GLSPNVYQAR

SEQ ID NO: 498492 - protein, 10 aa, Influenza virus
GLSSRISFYW

SEQ ID NO: 498493 - protein, 10 aa, Influenza virus
GLTHIMIWHS

SEQ ID NO: 498494 - protein, 10 aa, Influenza virus
GLTHLMIWHS

SEQ ID NO: 498495 - protein, 10 aa, Influenza virus
GLTHMMIWHS

SEQ ID NO: 498496 - protein, 10 aa, Influenza virus
GLVAGWYGFQ

SEQ ID NO: 498497 - protein, 10 aa, Influenza virus
GLVCATCEQI

SEQ ID NO: 498498 - protein, 10 aa, Influenza virus
GLVDGWYGFR

SEQ ID NO: 498499 - protein, 10 aa, Influenza virus
GLVDGWYGYH

SEQ ID NO: 498500 - protein, 10 aa, Influenza virus
GLVFFCLKNG

SEQ ID NO: 498501 - protein, 10 aa, Influenza virus
GLVFFCLRNG

SEQ ID NO: 498502 - protein, 10 aa, Influenza virus
GLVFICIKNG

SEQ ID NO: 498503 - protein, 10 aa, Influenza virus
GLVFICMKNG

SEQ ID NO: 498504 - protein, 10 aa, Influenza virus
GLVFICVKNG

SEQ ID NO: 498505 - protein, 10 aa, Influenza virus
GLVFMCVKNG

SEQ ID NO: 498506 - protein, 10 aa, Influenza virus
GLVGDTPRND

SEQ ID NO: 498507 - protein, 10 aa, Influenza virus
GLVGDTPRNE

SEQ ID NO: 498508 - protein, 10 aa, Influenza virus
GLVGDTPRNG

SEQ ID NO: 498509 - protein, 10 aa, Influenza virus
GLVGDTPRNN

SEQ ID NO: 498510 - protein, 10 aa, Influenza virus
GLVGDTPRSD

SEQ ID NO: 498511 - protein, 10 aa, Influenza virus
GLVLGNPKCD

SEQ ID NO: 498512 - protein, 10 aa, Influenza virus
GLVNLGLNIG

SEQ ID NO: 498513 - protein, 10 aa, Influenza virus
GLVYGNPACD

SEQ ID NO: 498514 - protein, 10 aa, Influenza virus
GLVYGNPSCD

SEQ ID NO: 498515 - protein, 10 aa, Influenza virus
GLWAYNAELL

SEQ ID NO: 498516 - protein, 10 aa, Influenza virus
GLWDPFRQSE

SEQ ID NO: 498517 - protein, 10 aa, Influenza virus
GLWDSFRQSE

SEQ ID NO: 498518 - protein, 10 aa, Influenza virus
GLYDAIEECL

SEQ ID NO: 498519 - protein, 10 aa, Influenza virus
GLYEAIEECL

SEQ ID NO: 498520 - protein, 10 aa, Influenza virus
GLYESIEECL

SEQ ID NO: 498521 - protein, 10 aa, Influenza virus
GLYGAIEECL

SEQ ID NO: 498522 - protein, 10 aa, Influenza virus
GMAADKESTQ

SEQ ID NO: 498523 - protein, 10 aa, Influenza virus
GMAADQKSTQ

SEQ ID NO: 498524 - protein, 10 aa, Influenza virus
GMAADRDSTQ

SEQ ID NO: 498525 - protein, 10 aa, Influenza virus
GMALSVVSLL

SEQ ID NO: 498526 - protein, 10 aa, Influenza virus
GMCYPGFVEN

SEQ ID NO: 498527 - protein, 10 aa, Influenza virus
GMCYPGSIEN

SEQ ID NO: 498528 - protein, 10 aa, Influenza virus
GMCYPGSVEN

SEQ ID NO: 498529 - protein, 10 aa, Influenza virus
GMDPRMCSLM

SEQ ID NO: 498530 - protein, 10 aa, Influenza virus
GMELRRCLLQ

SEQ ID NO: 498531 - protein, 10 aa, Influenza virus
GMEMRRCLLQ

SEQ ID NO: 498532 - protein, 10 aa, Influenza virus
GMFNMLSTVL

SEQ ID NO: 498533 - protein, 10 aa, Influenza virus
GMGMAADKES

SEQ ID NO: 498534 - protein, 10 aa, Influenza virus
GMGQAADLKS

SEQ ID NO: 498535 - protein, 10 aa, Influenza virus
GMGQAPSPYN

SEQ ID NO: 498536 - protein, 10 aa, Influenza virus
GMIDGWYGFH

SEQ ID NO: 498537 - protein, 10 aa, Influenza virus
GMIDGWYGFR

SEQ ID NO: 498538 - protein, 10 aa, Influenza virus
GMIDGWYGYH

SEQ ID NO: 498539 - protein, 10 aa, Influenza virus
GMILSVVSLL

SEQ ID NO: 498540 - protein, 10 aa, Influenza virus
GMITDTIKSW

SEQ ID NO: 498541 - protein, 10 aa, Influenza virus
GMKNVPEIPK

SEQ ID NO: 498542 - protein, 10 aa, Influenza virus
GMKNVPEIPR

SEQ ID NO: 498543 - protein, 10 aa, Influenza virus
GMKNVPEKIH

SEQ ID NO: 498544 - protein, 10 aa, Influenza virus
GMKNVPEKIR

SEQ ID NO: 498545 - protein, 10 aa, Influenza virus
GMKNVPETPK

SEQ ID NO: 498546 - protein, 10 aa, Influenza virus
GMLGFVFTLT

SEQ ID NO: 498547 - protein, 10 aa, Influenza virus
GMMDGWYGFR

SEQ ID NO: 498548 - protein, 10 aa, Influenza virus
GMMMGMFNML

SEQ ID NO: 498549 - protein, 10 aa, Influenza virus
GMPESMREEY

SEQ ID NO: 498550 - protein, 10 aa, Influenza virus
GMPTDVVRSW

SEQ ID NO: 498551 - protein, 10 aa, Influenza virus
GMQIRGFVHF

SEQ ID NO: 498552 - protein, 10 aa, Influenza virus
GMQIRGFVYF

SEQ ID NO: 498553 - protein, 10 aa, Influenza virus
GMQNGSCRCM

SEQ ID NO: 498554 - protein, 10 aa, Influenza virus
GMQNGSYRCM

SEQ ID NO: 498555 - protein, 10 aa, Influenza virus
GMRILIRGNS

SEQ ID NO: 498556 - protein, 10 aa, Influenza virus
GMRILVRGNS

SEQ ID NO: 498557 - protein, 10 aa, Influenza virus
GMRNIPEKPK

SEQ ID NO: 498558 - protein, 10 aa, Influenza virus
GMRNIPEKQT

SEQ ID NO: 498559 - protein, 10 aa, Influenza virus
GMRNIPENPK

SEQ ID NO: 498560 - protein, 10 aa, Influenza virus
GMRNIPERQT

SEQ ID NO: 498561 - protein, 10 aa, Influenza virus
GMRNIPGKQA

SEQ ID NO: 498562 - protein, 10 aa, Influenza virus
GMRNVPEKPK

SEQ ID NO: 498563 - protein, 10 aa, Influenza virus
GMRNVPEKQT

SEQ ID NO: 498564 - protein, 10 aa, Influenza virus
GMRNVPENPK

SEQ ID NO: 498565 - protein, 10 aa, Influenza virus
GMRNVPERQT

SEQ ID NO: 498566 - protein, 10 aa, Influenza virus
GMRNVPETQT

SEQ ID NO: 498567 - protein, 10 aa, Influenza virus
GMRVLIRGNS

SEQ ID NO: 498568 - protein, 10 aa, Influenza virus
GMSANGDILM

SEQ ID NO: 498569 - protein, 10 aa, Influenza virus
GMTLSVVSLI

SEQ ID NO: 498570 - protein, 10 aa, Influenza virus
GMTLSVVSLL

SEQ ID NO: 498571 - protein, 10 aa, Influenza virus
GMVDGWYGFH

SEQ ID NO: 498572 - protein, 10 aa, Influenza virus
GMVDGWYGFR

SEQ ID NO: 498573 - protein, 10 aa, Influenza virus
GMVDGWYGYH

SEQ ID NO: 498574 - protein, 10 aa, Influenza virus
GMVNGWYGFR

SEQ ID NO: 498575 - protein, 10 aa, Influenza virus
GMWDTLIERD

SEQ ID NO: 498576 - protein, 10 aa, Influenza virus
GNAEIEDLIF

SEQ ID NO: 498577 - protein, 10 aa, Influenza virus
GNAEIEDLTF

SEQ ID NO: 498578 - protein, 10 aa, Influenza virus
GNAKDEGNGC

SEQ ID NO: 498579 - protein, 10 aa, Influenza virus
GNAQHIEECS

SEQ ID NO: 498580 - protein, 10 aa, Influenza virus
GNAQHVEECS

SEQ ID NO: 498581 - protein, 10 aa, Influenza virus
GNCDAKCQTP

SEQ ID NO: 498582 - protein, 10 aa, Influenza virus
GNCDTKCQTP

SEQ ID NO: 498583 - protein, 10 aa, Influenza virus
GNCNAKCQTP

SEQ ID NO: 498584 - protein, 10 aa, Influenza virus
GNCNTKCQTP

SEQ ID NO: 498585 - protein, 10 aa, Influenza virus
GNCPKYIKSG

SEQ ID NO: 498586 - protein, 10 aa, Influenza virus
GNCPKYVKQG

SEQ ID NO: 498587 - protein, 10 aa, Influenza virus
GNCYWVMTDG

SEQ ID NO: 498588 - protein, 10 aa, Influenza virus
GNDIWMGRTI

SEQ ID NO: 498589 - protein, 10 aa, Influenza virus
GNDLWMGRTI

SEQ ID NO: 498590 - protein, 10 aa, Influenza virus
GNDNWSGYSG

SEQ ID NO: 498591 - protein, 10 aa, Influenza virus
GNDVWLGRTV

SEQ ID NO: 498592 - protein, 10 aa, Influenza virus
GNDVWMGRTI

SEQ ID NO: 498593 - protein, 10 aa, Influenza virus
GNEKKAKLAN

SEQ ID NO: 498594 - protein, 10 aa, Influenza virus
GNFIAPENAY

SEQ ID NO: 498595 - protein, 10 aa, Influenza virus
GNFIAPEYAF

SEQ ID NO: 498596 - protein, 10 aa, Influenza virus
GNFIAPEYAY

SEQ ID NO: 498597 - protein, 10 aa, Influenza virus
GNFNDYEELK

SEQ ID NO: 498598 - protein, 10 aa, Influenza virus
GNGAWIGRTK

SEQ ID NO: 498599 - protein, 10 aa, Influenza virus
GNGCFDILHK

SEQ ID NO: 498600 - protein, 10 aa, Influenza virus
GNGCFEFWHK

SEQ ID NO: 498601 - protein, 10 aa, Influenza virus
GNGCFEFYHK

SEQ ID NO: 498602 - protein, 10 aa, Influenza virus
GNGCFEFYHR

SEQ ID NO: 498603 - protein, 10 aa, Influenza virus
GNGCFEIFHK

SEQ ID NO: 498604 - protein, 10 aa, Influenza virus
GNGCFEIFHQ

SEQ ID NO: 498605 - protein, 10 aa, Influenza virus
GNGCFEIFHR

SEQ ID NO: 498606 - protein, 10 aa, Influenza virus
GNGCFELLHK

SEQ ID NO: 498607 - protein, 10 aa, Influenza virus
GNGCFELYHK

SEQ ID NO: 498608 - protein, 10 aa, Influenza virus
GNGCFKIYHK

SEQ ID NO: 498609 - protein, 10 aa, Influenza virus
GNGCFTFYHK

SEQ ID NO: 498610 - protein, 10 aa, Influenza virus
GNGCFTFYHR

SEQ ID NO: 498611 - protein, 10 aa, Influenza virus
GNGCFTIYHK

SEQ ID NO: 498612 - protein, 10 aa, Influenza virus
GNGCLKIYHK

SEQ ID NO: 498613 - protein, 10 aa, Influenza virus
GNGDPNNMDK

SEQ ID NO: 498614 - protein, 10 aa, Influenza virus
GNGDPNNMDR

SEQ ID NO: 498615 - protein, 10 aa, Influenza virus
GNGSCRCTIC

SEQ ID NO: 498616 - protein, 10 aa, Influenza virus
GNGVWIGRTK

SEQ ID NO: 498617 - protein, 10 aa, Influenza virus
GNGVWMGRTK

SEQ ID NO: 498618 - protein, 10 aa, Influenza virus
GNHGSLVLSL

SEQ ID NO: 498619 - protein, 10 aa, Influenza virus
GNHGVKGWAF

SEQ ID NO: 498620 - protein, 10 aa, Influenza virus
GNIIFLWGIH

SEQ ID NO: 498621 - protein, 10 aa, Influenza virus
GNILLSPEEV

SEQ ID NO: 498622 - protein, 10 aa, Influenza virus
GNILRTQESE

SEQ ID NO: 498623 - protein, 10 aa, Influenza virus
GNILRTQESS

SEQ ID NO: 498624 - protein, 10 aa, Influenza virus
GNIMRTQESE

SEQ ID NO: 498625 - protein, 10 aa, Influenza virus
GNIWITREPY

SEQ ID NO: 498626 - protein, 10 aa, Influenza virus
GNIYKILSIY

SEQ ID NO: 498627 - protein, 10 aa, Influenza virus
GNKLITVGSS

SEQ ID NO: 498628 - protein, 10 aa, Influenza virus
GNLAFNAVIH

SEQ ID NO: 498629 - protein, 10 aa, Influenza virus
GNLAFNTVIH

SEQ ID NO: 498630 - protein, 10 aa, Influenza virus
GNLERRLENL

SEQ ID NO: 498631 - protein, 10 aa, Influenza virus
GNLIAPEFGY

SEQ ID NO: 498632 - protein, 10 aa, Influenza virus
GNLIAPEYGF

SEQ ID NO: 498633 - protein, 10 aa, Influenza virus
GNLIAPEYGH

SEQ ID NO: 498634 - protein, 10 aa, Influenza virus
GNLIAPEYGY

SEQ ID NO: 498635 - protein, 10 aa, Influenza virus
GNLIAPRGHY

SEQ ID NO: 498636 - protein, 10 aa, Influenza virus
GNLIAPRGYF

SEQ ID NO: 498637 - protein, 10 aa, Influenza virus
GNLIAPRGYY

SEQ ID NO: 498638 - protein, 10 aa, Influenza virus
GNLIAPWYAF

SEQ ID NO: 498639 - protein, 10 aa, Influenza virus
GNLIAPWYAY

SEQ ID NO: 498640 - protein, 10 aa, Influenza virus
GNLIFNAVIH

SEQ ID NO: 498641 - protein, 10 aa, Influenza virus
GNLIFNTVIH

SEQ ID NO: 498642 - protein, 10 aa, Influenza virus
GNLIVFNTIG

SEQ ID NO: 498643 - protein, 10 aa, Influenza virus
GNLNKKMEDG

SEQ ID NO: 498644 - protein, 10 aa, Influenza virus
GNLVAPEYGF

SEQ ID NO: 498645 - protein, 10 aa, Influenza virus
GNLVAPRGHY

SEQ ID NO: 498646 - protein, 10 aa, Influenza virus
GNLVAPRGYF

SEQ ID NO: 498647 - protein, 10 aa, Influenza virus
GNLVAPWYAY

SEQ ID NO: 498648 - protein, 10 aa, Influenza virus
GNLVFNTVIH

SEQ ID NO: 498649 - protein, 10 aa, Influenza virus
GNMRCTISLV

SEQ ID NO: 498650 - protein, 10 aa, Influenza virus
GNNBNGVKGF

SEQ ID NO: 498651 - protein, 10 aa, Influenza virus
GNNCIESIRN

SEQ ID NO: 498652 - protein, 10 aa, Influenza virus
GNNDNATATV

SEQ ID NO: 498653 - protein, 10 aa, Influenza virus
GNNENATATV

SEQ ID NO: 498654 - protein, 10 aa, Influenza virus
GNNKNATATV

SEQ ID NO: 498655 - protein, 10 aa, Influenza virus
GNNNKGVKGF

SEQ ID NO: 498656 - protein, 10 aa, Influenza virus
GNNNNATATV

SEQ ID NO: 498657 - protein, 10 aa, Influenza virus
GNNNNGVKGF

SEQ ID NO: 498658 - protein, 10 aa, Influenza virus
GNNQVFPQLN

SEQ ID NO: 498659 - protein, 10 aa, Influenza virus
GNPDPGVKGF

SEQ ID NO: 498660 - protein, 10 aa, Influenza virus
GNPECDRFLS

SEQ ID NO: 498661 - protein, 10 aa, Influenza virus
GNPECDRLLN

SEQ ID NO: 498662 - protein, 10 aa, Influenza virus
GNPECDRLLR

SEQ ID NO: 498663 - protein, 10 aa, Influenza virus
GNPECDRLLS

SEQ ID NO: 498664 - protein, 10 aa, Influenza virus
GNPECDRLLT

SEQ ID NO: 498665 - protein, 10 aa, Influenza virus
GNPGVKGWAF

SEQ ID NO: 498666 - protein, 10 aa, Influenza virus
GNPIICLGHH

SEQ ID NO: 498667 - protein, 10 aa, Influenza virus
GNPKCDIHLK

SEQ ID NO: 498668 - protein, 10 aa, Influenza virus
GNPKCDIHLR

SEQ ID NO: 498669 - protein, 10 aa, Influenza virus
GNPKCDLYLN

SEQ ID NO: 498670 - protein, 10 aa, Influenza virus
GNPKCDLYLS

SEQ ID NO: 498671 - protein, 10 aa, Influenza virus
GNPKCDPYLN

SEQ ID NO: 498672 - protein, 10 aa, Influenza virus
GNPKCDTHLK

SEQ ID NO: 498673 - protein, 10 aa, Influenza virus
GNPKCDVHLK

SEQ ID NO: 498674 - protein, 10 aa, Influenza virus
GNPMCDDLIG

SEQ ID NO: 498675 - protein, 10 aa, Influenza virus
GNPMCDELIG

SEQ ID NO: 498676 - protein, 10 aa, Influenza virus
GNPMCDNLIG

SEQ ID NO: 498677 - protein, 10 aa, Influenza virus
GNPMCDYLIG

SEQ ID NO: 498678 - protein, 10 aa, Influenza virus
GNPRCDDLIG

SEQ ID NO: 498679 - protein, 10 aa, Influenza virus
GNPSCASNIN

SEQ ID NO: 498680 - protein, 10 aa, Influenza virus
GNPSCATNIN

SEQ ID NO: 498681 - protein, 10 aa, Influenza virus
GNPVICLGHH

SEQ ID NO: 498682 - protein, 10 aa, Influenza virus
GNPVICMGHH

SEQ ID NO: 498683 - protein, 10 aa, Influenza virus
GNQGVKGWAF

SEQ ID NO: 498684 - protein, 10 aa, Influenza virus
GNQKTLDEHD

SEQ ID NO: 498685 - protein, 10 aa, Influenza virus
GNSARLIHHT

SEQ ID NO: 498686 - protein, 10 aa, Influenza virus
GNSFYAELKW

SEQ ID NO: 498687 - protein, 10 aa, Influenza virus
GNSGVKGWAF

SEQ ID NO: 498688 - protein, 10 aa, Influenza virus
GNSPAFNYNK

SEQ ID NO: 498689 - protein, 10 aa, Influenza virus
GNSPIFNYNK

SEQ ID NO: 498690 - protein, 10 aa, Influenza virus
GNSPVFNYNK

SEQ ID NO: 498691 - protein, 10 aa, Influenza virus
GNSPVFNYNR

SEQ ID NO: 498692 - protein, 10 aa, Influenza virus
GNSPVFNYSK

SEQ ID NO: 498693 - protein, 10 aa, Influenza virus
GNSVWAGRTI

SEQ ID NO: 498694 - protein, 10 aa, Influenza virus
GNSVWAGRTM

SEQ ID NO: 498695 - protein, 10 aa, Influenza virus
GNSVWAGRTV

SEQ ID NO: 498696 - protein, 10 aa, Influenza virus
GNTWLGRTIS

SEQ ID NO: 498697 - protein, 10 aa, Influenza virus
GNTYVNNTTV

SEQ ID NO: 498698 - protein, 10 aa, Influenza virus
GNVINWTKDS

SEQ ID NO: 498699 - protein, 10 aa, Influenza virus
GNVINWTQDA

SEQ ID NO: 498700 - protein, 10 aa, Influenza virus
GNVINWTRDA

SEQ ID NO: 498701 - protein, 10 aa, Influenza virus
GNVINWTRDS

SEQ ID NO: 498702 - protein, 10 aa, Influenza virus
GNVLDGVTAS

SEQ ID NO: 498703 - protein, 10 aa, Influenza virus
GNVLLSPEEV

SEQ ID NO: 498704 - protein, 10 aa, Influenza virus
GNVYKILSIC

SEQ ID NO: 498705 - protein, 10 aa, Influenza virus
GNVYKILSIY

SEQ ID NO: 498706 - protein, 10 aa, Influenza virus
GNWPDGSDIG

SEQ ID NO: 498707 - protein, 10 aa, Influenza virus
GNWPDGSNIG

SEQ ID NO: 498708 - protein, 10 aa, Influenza virus
GNYARLYIWG

SEQ ID NO: 498709 - protein, 10 aa, Influenza virus
GNYDSIRGEF

SEQ ID NO: 498710 - protein, 10 aa, Influenza virus
GNYGPINVTK

SEQ ID NO: 498711 - protein, 10 aa, Influenza virus
GNYKEICIAW

SEQ ID NO: 498712 - protein, 10 aa, Influenza virus
GNYKEICVAW

SEQ ID NO: 498713 - protein, 10 aa, Influenza virus
GNYKEMCAAW

SEQ ID NO: 498714 - protein, 10 aa, Influenza virus
GNYREICIAW

SEQ ID NO: 498715 - protein, 10 aa, Influenza virus
GNYREVCIAW

SEQ ID NO: 498716 - protein, 10 aa, Influenza virus
GPAANNADHR

SEQ ID NO: 498717 - protein, 10 aa, Influenza virus
GPAANSADHR

SEQ ID NO: 498718 - protein, 10 aa, Influenza virus
GPADNKADHR

SEQ ID NO: 498719 - protein, 10 aa, Influenza virus
GPADTRIYYF

SEQ ID NO: 498720 - protein, 10 aa, Influenza virus
GPADTRVYYF

SEQ ID NO: 498721 - protein, 10 aa, Influenza virus
GPAECRTFFL

SEQ ID NO: 498722 - protein, 10 aa, Influenza virus
GPAETRIYYF

SEQ ID NO: 498723 - protein, 10 aa, Influenza virus
GPAETRVYYF

SEQ ID NO: 498724 - protein, 10 aa, Influenza virus
GPALSINELG

SEQ ID NO: 498725 - protein, 10 aa, Influenza virus
GPALSINELS

SEQ ID NO: 498726 - protein, 10 aa, Influenza virus
GPALSISELS

SEQ ID NO: 498727 - protein, 10 aa, Influenza virus
GPANKQASYK

SEQ ID NO: 498728 - protein, 10 aa, Influenza virus
GPANNQASYK

SEQ ID NO: 498729 - protein, 10 aa, Influenza virus
GPANNQASYR

SEQ ID NO: 498730 - protein, 10 aa, Influenza virus
GPANSQASYK

SEQ ID NO: 498731 - protein, 10 aa, Influenza virus
GPANSQAYTK

SEQ ID NO: 498732 - protein, 10 aa, Influenza virus
GPASNQASYK

SEQ ID NO: 498733 - protein, 10 aa, Influenza virus
GPASSQAYTK

SEQ ID NO: 498734 - protein, 10 aa, Influenza virus
GPATAQMALQ

SEQ ID NO: 498735 - protein, 10 aa, Influenza virus
GPDATAVAVI

SEQ ID NO: 498736 - protein, 10 aa, Influenza virus
GPDATAVAVL

SEQ ID NO: 498737 - protein, 10 aa, Influenza virus
GPDDGAVAVL

SEQ ID NO: 498738 - protein, 10 aa, Influenza virus
GPDNEAVAVL

SEQ ID NO: 498739 - protein, 10 aa, Influenza virus
GPDNGAVAVL

SEQ ID NO: 498740 - protein, 10 aa, Influenza virus
GPDNGAVAVV

SEQ ID NO: 498741 - protein, 10 aa, Influenza virus
GPDPGVKGFA

SEQ ID NO: 498742 - protein, 10 aa, Influenza virus
GPDSGAVAVL

SEQ ID NO: 498743 - protein, 10 aa, Influenza virus
GPDSTAVAVI

SEQ ID NO: 498744 - protein, 10 aa, Influenza virus
GPDSVLVNTY

SEQ ID NO: 498745 - protein, 10 aa, Influenza virus
GPDTTAVAVL

SEQ ID NO: 498746 - protein, 10 aa, Influenza virus
GPESVLINTY

SEQ ID NO: 498747 - protein, 10 aa, Influenza virus
GPESVLVNTY

SEQ ID NO: 498748 - protein, 10 aa, Influenza virus
GPGSFPDGAQ

SEQ ID NO: 498749 - protein, 10 aa, Influenza virus
GPGVKGFGFK

SEQ ID NO: 498750 - protein, 10 aa, Influenza virus
GPGWLTIGIT

SEQ ID NO: 498751 - protein, 10 aa, Influenza virus
GPGWLTLGIT

SEQ ID NO: 498752 - protein, 10 aa, Influenza virus
GPILSFIMWA

SEQ ID NO: 498753 - protein, 10 aa, Influenza virus
GPINNGKGRY

SEQ ID NO: 498754 - protein, 10 aa, Influenza virus
GPINVTKENT

SEQ ID NO: 498755 - protein, 10 aa, Influenza virus
GPLKAEIAQK

SEQ ID NO: 498756 - protein, 10 aa, Influenza virus
GPLKAEIAQR

SEQ ID NO: 498757 - protein, 10 aa, Influenza virus
GPLLQITSLC

SEQ ID NO: 498758 - protein, 10 aa, Influenza virus
GPLSGSAQHI

SEQ ID NO: 498759 - protein, 10 aa, Influenza virus
GPNDNASAVV

SEQ ID NO: 498760 - protein, 10 aa, Influenza virus
GPNLYNIRNL

SEQ ID NO: 498761 - protein, 10 aa, Influenza virus
GPNNNASAIV

SEQ ID NO: 498762 - protein, 10 aa, Influenza virus
GPNNNASAVI

SEQ ID NO: 498763 - protein, 10 aa, Influenza virus
GPNNNASAVV

SEQ ID NO: 498764 - protein, 10 aa, Influenza virus
GPNNNASPVI

SEQ ID NO: 498765 - protein, 10 aa, Influenza virus
GPPHCDQFLE

SEQ ID NO: 498766 - protein, 10 aa, Influenza virus
GPPQCDKFLE

SEQ ID NO: 498767 - protein, 10 aa, Influenza virus
GPPQCDLFLE

SEQ ID NO: 498768 - protein, 10 aa, Influenza virus
GPPQCDLHLE

SEQ ID NO: 498769 - protein, 10 aa, Influenza virus
GPPQCDQFLE

SEQ ID NO: 498770 - protein, 10 aa, Influenza virus
GPPQCDRFLE

SEQ ID NO: 498771 - protein, 10 aa, Influenza virus
GPPQCDSHLK

SEQ ID NO: 498772 - protein, 10 aa, Influenza virus
GPRALVRGQQ

SEQ ID NO: 498773 - protein, 10 aa, Influenza virus
GPRPFVRGQQ

SEQ ID NO: 498774 - protein, 10 aa, Influenza virus
GPRPLIRGQQ

SEQ ID NO: 498775 - protein, 10 aa, Influenza virus
GPRPLVMGQQ

SEQ ID NO: 498776 - protein, 10 aa, Influenza virus
GPRPLVREQQ

SEQ ID NO: 498777 - protein, 10 aa, Influenza virus
GPRPLVRGQQ

SEQ ID NO: 498778 - protein, 10 aa, Influenza virus
GPSDAQAFYK

SEQ ID NO: 498779 - protein, 10 aa, Influenza virus
GPSECRTFFL

SEQ ID NO: 498780 - protein, 10 aa, Influenza virus
GPSFYAEMKW

SEQ ID NO: 498781 - protein, 10 aa, Influenza virus
GPSHSIHTGN

SEQ ID NO: 498782 - protein, 10 aa, Influenza virus
GPSNAQAFYK

SEQ ID NO: 498783 - protein, 10 aa, Influenza virus
GPTECRTFFL

SEQ ID NO: 498784 - protein, 10 aa, Influenza virus
GPVHFQNQVK

SEQ ID NO: 498785 - protein, 10 aa, Influenza virus
GPVHFRNQIK

SEQ ID NO: 498786 - protein, 10 aa, Influenza virus
GPVHFRNQVK

SEQ ID NO: 498787 - protein, 10 aa, Influenza virus
GPVHFRSQVK

SEQ ID NO: 498788 - protein, 10 aa, Influenza virus
GPWVRGQSGR

SEQ ID NO: 498789 - protein, 10 aa, Influenza virus
GQAADLKSTQ

SEQ ID NO: 498790 - protein, 10 aa, Influenza virus
GQAADYESTQ

SEQ ID NO: 498791 - protein, 10 aa, Influenza virus
GQAADYKSTQ

SEQ ID NO: 498792 - protein, 10 aa, Influenza virus
GQAFYKILKI

SEQ ID NO: 498793 - protein, 10 aa, Influenza virus
GQAFYRSINW

SEQ ID NO: 498794 - protein, 10 aa, Influenza virus
GQAGRIDFHW

SEQ ID NO: 498795 - protein, 10 aa, Influenza virus
GQAGRMTFYW

SEQ ID NO: 498796 - protein, 10 aa, Influenza virus
GQDCDLINGA

SEQ ID NO: 498797 - protein, 10 aa, Influenza virus
GQFGRIDFHW

SEQ ID NO: 498798 - protein, 10 aa, Influenza virus
GQFGRINFHW

SEQ ID NO: 498799 - protein, 10 aa, Influenza virus
GQFPVQTDEY

SEQ ID NO: 498800 - protein, 10 aa, Influenza virus
GQGDIVLVMK

SEQ ID NO: 498801 - protein, 10 aa, Influenza virus
GQGDVVLVMK

SEQ ID NO: 498802 - protein, 10 aa, Influenza virus
GQGSGYAADK

SEQ ID NO: 498803 - protein, 10 aa, Influenza virus
GQGSGYAADQ

SEQ ID NO: 498804 - protein, 10 aa, Influenza virus
GQGTAADYKS

SEQ ID NO: 498805 - protein, 10 aa, Influenza virus
GQGTTLDNEH

SEQ ID NO: 498806 - protein, 10 aa, Influenza virus
GQGTTLDNKH

SEQ ID NO: 498807 - protein, 10 aa, Influenza virus
GQGTTLENKH

SEQ ID NO: 498808 - protein, 10 aa, Influenza virus
GQGTTLNNKH

SEQ ID NO: 498809 - protein, 10 aa, Influenza virus
GQGTTLYNKH

SEQ ID NO: 498810 - protein, 10 aa, Influenza virus
GQHANGTIHD

SEQ ID NO: 498811 - protein, 10 aa, Influenza virus
GQKSWMKIYW

SEQ ID NO: 498812 - protein, 10 aa, Influenza virus
GQKSWTKIYW

SEQ ID NO: 498813 - protein, 10 aa, Influenza virus
GQLKLATGLK

SEQ ID NO: 498814 - protein, 10 aa, Influenza virus
GQLKLATGLR

SEQ ID NO: 498815 - protein, 10 aa, Influenza virus
GQNHGICAVA

SEQ ID NO: 498816 - protein, 10 aa, Influenza virus
GQPKEKAIWT

SEQ ID NO: 498817 - protein, 10 aa, Influenza virus
GQPKEKTIWT

SEQ ID NO: 498818 - protein, 10 aa, Influenza virus
GQPKERTIWT

SEQ ID NO: 498819 - protein, 10 aa, Influenza virus
GQQGRMDYYW

SEQ ID NO: 498820 - protein, 10 aa, Influenza virus
GQQGTMDYYW

SEQ ID NO: 498821 - protein, 10 aa, Influenza virus
GQQGWMDYYW

SEQ ID NO: 498822 - protein, 10 aa, Influenza virus
GQRGRIDFHW

SEQ ID NO: 498823 - protein, 10 aa, Influenza virus
GQRSWMKIYW

SEQ ID NO: 498824 - protein, 10 aa, Influenza virus
GQRSWMKLYW

SEQ ID NO: 498825 - protein, 10 aa, Influenza virus
GQSFYRSINW

SEQ ID NO: 498826 - protein, 10 aa, Influenza virus
GQSGRIDFHW

SEQ ID NO: 498827 - protein, 10 aa, Influenza virus
GQSGRIDFYW

SEQ ID NO: 498828 - protein, 10 aa, Influenza virus
GQSGRIEFHW

SEQ ID NO: 498829 - protein, 10 aa, Influenza virus
GQSGRINFHW

SEQ ID NO: 498830 - protein, 10 aa, Influenza virus
GQSGRISFYW

SEQ ID NO: 498831 - protein, 10 aa, Influenza virus
GQSGRIVFHW

SEQ ID NO: 498832 - protein, 10 aa, Influenza virus
GQSGRVSFYW

SEQ ID NO: 498833 - protein, 10 aa, Influenza virus
GQSPNVYQAK

SEQ ID NO: 498834 - protein, 10 aa, Influenza virus
GQSPNVYQAR

SEQ ID NO: 498835 - protein, 10 aa, Influenza virus
GQSPNVYQSR

SEQ ID NO: 498836 - protein, 10 aa, Influenza virus
GQTGRIDFHW

SEQ ID NO: 498837 - protein, 10 aa, Influenza virus
GQTIVLDTDW

SEQ ID NO: 498838 - protein, 10 aa, Influenza virus
GQTIVLNTDW

SEQ ID NO: 498839 - protein, 10 aa, Influenza virus
GQTIVLTTDW

SEQ ID NO: 498840 - protein, 10 aa, Influenza virus
GQTVKIKTNG

SEQ ID NO: 498841 - protein, 10 aa, Influenza virus
GQTVKIQTNG

SEQ ID NO: 498842 - protein, 10 aa, Influenza virus
GQTVKIQTSG

SEQ ID NO: 498843 - protein, 10 aa, Influenza virus
GQTVVLNTDW

SEQ ID NO: 498844 - protein, 10 aa, Influenza virus
GQVECVCRDN

SEQ ID NO: 498845 - protein, 10 aa, Influenza virus
GQVEGRIQDL

SEQ ID NO: 498846 - protein, 10 aa, Influenza virus
GQWDWPDGAK

SEQ ID NO: 498847 - protein, 10 aa, Influenza virus
GQWNWPDGAE

SEQ ID NO: 498848 - protein, 10 aa, Influenza virus
GQWNWPDGAK

SEQ ID NO: 498849 - protein, 10 aa, Influenza virus
GRADTKILFI

SEQ ID NO: 498850 - protein, 10 aa, Influenza virus
GRADTRILFI

SEQ ID NO: 498851 - protein, 10 aa, Influenza virus
GRAWLHVCVT

SEQ ID NO: 498852 - protein, 10 aa, Influenza virus
GRCPRYVKQS

SEQ ID NO: 498853 - protein, 10 aa, Influenza virus
GRDVLVIWGI

SEQ ID NO: 498854 - protein, 10 aa, Influenza virus
GRDVLVLWGI

SEQ ID NO: 498855 - protein, 10 aa, Influenza virus
GRDVLVMWGI

SEQ ID NO: 498856 - protein, 10 aa, Influenza virus
GRDVLVMWGL

SEQ ID NO: 498857 - protein, 10 aa, Influenza virus
GREDKRYGPA

SEQ ID NO: 498858 - protein, 10 aa, Influenza virus
GREWSYIVER

SEQ ID NO: 498859 - protein, 10 aa, Influenza virus
GRFEFIAEEF

SEQ ID NO: 498860 - protein, 10 aa, Influenza virus
GRFTNEEALR

SEQ ID NO: 498861 - protein, 10 aa, Influenza virus
GRFYIQMCTE

SEQ ID NO: 498862 - protein, 10 aa, Influenza virus
GRFYVQMCTE

SEQ ID NO: 498863 - protein, 10 aa, Influenza virus
GRGCFEIYHK

SEQ ID NO: 498864 - protein, 10 aa, Influenza virus
GRGIEVVNAT

SEQ ID NO: 498865 - protein, 10 aa, Influenza virus
GRGLFGAIAG

SEQ ID NO: 498866 - protein, 10 aa, Influenza virus
GRGLFGAKAG

SEQ ID NO: 498867 - protein, 10 aa, Influenza virus
GRGQAADLKS

SEQ ID NO: 498868 - protein, 10 aa, Influenza virus
GRGRIFQSRI

SEQ ID NO: 498869 - protein, 10 aa, Influenza virus
GRGSTLGLDI

SEQ ID NO: 498870 - protein, 10 aa, Influenza virus
GRGVFEFSDE

SEQ ID NO: 498871 - protein, 10 aa, Influenza virus
GRGVFELSDE

SEQ ID NO: 498872 - protein, 10 aa, Influenza virus
GRHANGTIHD

SEQ ID NO: 498873 - protein, 10 aa, Influenza virus
GRHANGTIND

SEQ ID NO: 498874 - protein, 10 aa, Influenza virus
GRHANGTMHD

SEQ ID NO: 498875 - protein, 10 aa, Influenza virus
GRHSNGTIHD

SEQ ID NO: 498876 - protein, 10 aa, Influenza virus
GRIDFHWLIL

SEQ ID NO: 498877 - protein, 10 aa, Influenza virus
GRIDFHWLLL

SEQ ID NO: 498878 - protein, 10 aa, Influenza virus
GRIDFHWLML

SEQ ID NO: 498879 - protein, 10 aa, Influenza virus
GRIDFHWLVL

SEQ ID NO: 498880 - protein, 10 aa, Influenza virus
GRIDFHWMLL

SEQ ID NO: 498881 - protein, 10 aa, Influenza virus
GRIFQSGIRM

SEQ ID NO: 498882 - protein, 10 aa, Influenza virus
GRIFQSGVRL

SEQ ID NO: 498883 - protein, 10 aa, Influenza virus
GRIFQSGVRM

SEQ ID NO: 498884 - protein, 10 aa, Influenza virus
GRIFQSGVRV

SEQ ID NO: 498885 - protein, 10 aa, Influenza virus
GRIFQSRIRM

SEQ ID NO: 498886 - protein, 10 aa, Influenza virus
GRIIQNEDIP

SEQ ID NO: 498887 - protein, 10 aa, Influenza virus
GRIQDLEKYI

SEQ ID NO: 498888 - protein, 10 aa, Influenza virus
GRIQDLEKYV

SEQ ID NO: 498889 - protein, 10 aa, Influenza virus
GRIQDLERYV

SEQ ID NO: 498890 - protein, 10 aa, Influenza virus
GRISFYWTIV

SEQ ID NO: 498891 - protein, 10 aa, Influenza virus
GRISIYWTLV

SEQ ID NO: 498892 - protein, 10 aa, Influenza virus
GRLCNPLNPF

SEQ ID NO: 498893 - protein, 10 aa, Influenza virus
GRLCNPMNPF

SEQ ID NO: 498894 - protein, 10 aa, Influenza virus
GRLIDFLKDV

SEQ ID NO: 498895 - protein, 10 aa, Influenza virus
GRLIQNSITI

SEQ ID NO: 498896 - protein, 10 aa, Influenza virus
GRLIQNSITV

SEQ ID NO: 498897 - protein, 10 aa, Influenza virus
GRLIQNSLTI

SEQ ID NO: 498898 - protein, 10 aa, Influenza virus
GRLIQNSMTI

SEQ ID NO: 498899 - protein, 10 aa, Influenza virus
GRLMDFLKDV

SEQ ID NO: 498900 - protein, 10 aa, Influenza virus
GRLTTTIKTW

SEQ ID NO: 498901 - protein, 10 aa, Influenza virus
GRLVQNSITI

SEQ ID NO: 498902 - protein, 10 aa, Influenza virus
GRLVRFRHQN

SEQ ID NO: 498903 - protein, 10 aa, Influenza virus
GRMDYYWAIL

SEQ ID NO: 498904 - protein, 10 aa, Influenza virus
GRMDYYWAVL

SEQ ID NO: 498905 - protein, 10 aa, Influenza virus
GRMDYYWGIL

SEQ ID NO: 498906 - protein, 10 aa, Influenza virus
GRMSDSIKSW

SEQ ID NO: 498907 - protein, 10 aa, Influenza virus
GRMTDSIKSW

SEQ ID NO: 498908 - protein, 10 aa, Influenza virus
GRMTFYWAIV

SEQ ID NO: 498909 - protein, 10 aa, Influenza virus
GRMTFYWKIV

SEQ ID NO: 498910 - protein, 10 aa, Influenza virus
GRMTFYWTII

SEQ ID NO: 498911 - protein, 10 aa, Influenza virus
GRMTFYWTIV

SEQ ID NO: 498912 - protein, 10 aa, Influenza virus
GRMTFYWTMV

SEQ ID NO: 498913 - protein, 10 aa, Influenza virus
GRMTICIQGN

SEQ ID NO: 498914 - protein, 10 aa, Influenza virus
GRMTICVQGK

SEQ ID NO: 498915 - protein, 10 aa, Influenza virus
GRMTICVQGN

SEQ ID NO: 498916 - protein, 10 aa, Influenza virus
GRNCTIPCFW

SEQ ID NO: 498917 - protein, 10 aa, Influenza virus
GRNCTVPCFW

SEQ ID NO: 498918 - protein, 10 aa, Influenza virus
GRNPGNAEIE

SEQ ID NO: 498919 - protein, 10 aa, Influenza virus
GRNSFFSRLN

SEQ ID NO: 498920 - protein, 10 aa, Influenza virus
GRNSFYAELK

SEQ ID NO: 498921 - protein, 10 aa, Influenza virus
GRPEEAKYVE

SEQ ID NO: 498922 - protein, 10 aa, Influenza virus
GRPEEAKYVW

SEQ ID NO: 498923 - protein, 10 aa, Influenza virus
GRPEEVKYVW

SEQ ID NO: 498924 - protein, 10 aa, Influenza virus
GRPITEINTW

SEQ ID NO: 498925 - protein, 10 aa, Influenza virus
GRPKEDEVWW

SEQ ID NO: 498926 - protein, 10 aa, Influenza virus
GRPKEDKVWW

SEQ ID NO: 498927 - protein, 10 aa, Influenza virus
GRPKEDRVWW

SEQ ID NO: 498928 - protein, 10 aa, Influenza virus
GRPKEEKVWW

SEQ ID NO: 498929 - protein, 10 aa, Influenza virus
GRPTTEINTW

SEQ ID NO: 498930 - protein, 10 aa, Influenza virus
GRQEKNPALR

SEQ ID NO: 498931 - protein, 10 aa, Influenza virus
GRQEKNPSLR

SEQ ID NO: 498932 - protein, 10 aa, Influenza virus
GRQTFDWTLN

SEQ ID NO: 498933 - protein, 10 aa, Influenza virus
GRQTYDWTLN

SEQ ID NO: 498934 - protein, 10 aa, Influenza virus
GRRKTNLYGF

SEQ ID NO: 498935 - protein, 10 aa, Influenza virus
GRRRTNLYGF

SEQ ID NO: 498936 - protein, 10 aa, Influenza virus
GRSHLRNDTD

SEQ ID NO: 498937 - protein, 10 aa, Influenza virus
GRTFSPRSRS

SEQ ID NO: 498938 - protein, 10 aa, Influenza virus
GRTINTASRS

SEQ ID NO: 498939 - protein, 10 aa, Influenza virus
GRTIQNEDIP

SEQ ID NO: 498940 - protein, 10 aa, Influenza virus
GRTISIASRS

SEQ ID NO: 498941 - protein, 10 aa, Influenza virus
GRTISKDLRS

SEQ ID NO: 498942 - protein, 10 aa, Influenza virus
GRTISKDSRS

SEQ ID NO: 498943 - protein, 10 aa, Influenza virus
GRTISKDTRS

SEQ ID NO: 498944 - protein, 10 aa, Influenza virus
GRTISMDSRS

SEQ ID NO: 498945 - protein, 10 aa, Influenza virus
GRTISPHSRS

SEQ ID NO: 498946 - protein, 10 aa, Influenza virus
GRTISPKLRS

SEQ ID NO: 498947 - protein, 10 aa, Influenza virus
GRTISPRLRS

SEQ ID NO: 498948 - protein, 10 aa, Influenza virus
GRTISPRSRN

SEQ ID NO: 498949 - protein, 10 aa, Influenza virus
GRTISPRSRS

SEQ ID NO: 498950 - protein, 10 aa, Influenza virus
GRTISRDSRS

SEQ ID NO: 498951 - protein, 10 aa, Influenza virus
GRTISTASRA

SEQ ID NO: 498952 - protein, 10 aa, Influenza virus
GRTISTASRS

SEQ ID NO: 498953 - protein, 10 aa, Influenza virus
GRTKSLESRR

SEQ ID NO: 498954 - protein, 10 aa, Influenza virus
GRTKSLESRS

SEQ ID NO: 498955 - protein, 10 aa, Influenza virus
GRTLDLHDAN

SEQ ID NO: 498956 - protein, 10 aa, Influenza virus
GRTLDMHDAN

SEQ ID NO: 498957 - protein, 10 aa, Influenza virus
GRTLGLHDAN

SEQ ID NO: 498958 - protein, 10 aa, Influenza virus
GRTNQQFELI

SEQ ID NO: 498959 - protein, 10 aa, Influenza virus
GRTSDMRAEI

SEQ ID NO: 498960 - protein, 10 aa, Influenza virus
GRTSDMRTEI

SEQ ID NO: 498961 - protein, 10 aa, Influenza virus
GRTSDMRTEV

SEQ ID NO: 498962 - protein, 10 aa, Influenza virus
GRTTSKDSRS

SEQ ID NO: 498963 - protein, 10 aa, Influenza virus
GRTTSTASRS

SEQ ID NO: 498964 - protein, 10 aa, Influenza virus
GRTVSINGRS

SEQ ID NO: 498965 - protein, 10 aa, Influenza virus
GRTVSISGRS

SEQ ID NO: 498966 - protein, 10 aa, Influenza virus
GRTVSNSGRS

SEQ ID NO: 498967 - protein, 10 aa, Influenza virus
GRTVSTSGRL

SEQ ID NO: 498968 - protein, 10 aa, Influenza virus
GRTVSTSGRS

SEQ ID NO: 498969 - protein, 10 aa, Influenza virus
GRVSFYWTIV

SEQ ID NO: 498970 - protein, 10 aa, Influenza virus
GRVTDSIKSW

SEQ ID NO: 498971 - protein, 10 aa, Influenza virus
GRVTVSTRSD

SEQ ID NO: 498972 - protein, 10 aa, Influenza virus
GRWPGLVAGW

SEQ ID NO: 498973 - protein, 10 aa, Influenza virus
GRYGVKGFSF

SEQ ID NO: 498974 - protein, 10 aa, Influenza virus
GRYSIADKIC

SEQ ID NO: 498975 - protein, 10 aa, Influenza virus
GRYSKADKIC

SEQ ID NO: 498976 - protein, 10 aa, Influenza virus
GRYSRADKIC

SEQ ID NO: 498977 - protein, 10 aa, Influenza virus
GSAEHIEECS

SEQ ID NO: 498978 - protein, 10 aa, Influenza virus
GSAKHIEECS

SEQ ID NO: 498979 - protein, 10 aa, Influenza virus
GSAKHVEECS

SEQ ID NO: 498980 - protein, 10 aa, Influenza virus
GSAMHIEECS

SEQ ID NO: 498981 - protein, 10 aa, Influenza virus
GSAQHIEECS

SEQ ID NO: 498982 - protein, 10 aa, Influenza virus
GSAQHVEECS

SEQ ID NO: 498983 - protein, 10 aa, Influenza virus
GSARHIEECS

SEQ ID NO: 498984 - protein, 10 aa, Influenza virus
GSARHIEEWS

SEQ ID NO: 498985 - protein, 10 aa, Influenza virus
GSARHVEECS

SEQ ID NO: 498986 - protein, 10 aa, Influenza virus
GSASGKADTR

SEQ ID NO: 498987 - protein, 10 aa, Influenza virus
GSASGQAYTK

SEQ ID NO: 498988 - protein, 10 aa, Influenza virus
GSASGRADTK

SEQ ID NO: 498989 - protein, 10 aa, Influenza virus
GSASGRADTR

SEQ ID NO: 498990 - protein, 10 aa, Influenza virus
GSASSQAHTK

SEQ ID NO: 498991 - protein, 10 aa, Influenza virus
GSASSQAYTK

SEQ ID NO: 498992 - protein, 10 aa, Influenza virus
GSATGPADTR

SEQ ID NO: 498993 - protein, 10 aa, Influenza virus
GSATGPAETR

SEQ ID NO: 498994 - protein, 10 aa, Influenza virus
GSCAVVMTDG

SEQ ID NO: 498995 - protein, 10 aa, Influenza virus
GSCFTIMTDG

SEQ ID NO: 498996 - protein, 10 aa, Influenza virus
GSCFTLMTDG

SEQ ID NO: 498997 - protein, 10 aa, Influenza virus
GSCFTVLTDG

SEQ ID NO: 498998 - protein, 10 aa, Influenza virus
GSCFTVMTDG

SEQ ID NO: 498999 - protein, 10 aa, Influenza virus
GSCGILGTII

SEQ ID NO: 499000 - protein, 10 aa, Influenza virus
GSCTSPCLTD

SEQ ID NO: 499001 - protein, 10 aa, Influenza virus
GSCTVVMTDG

SEQ ID NO: 499002 - protein, 10 aa, Influenza virus
GSDVWLGRTV

SEQ ID NO: 499003 - protein, 10 aa, Influenza virus
GSDVWMGRTI

SEQ ID NO: 499004 - protein, 10 aa, Influenza virus
GSEHTAYSQI

SEQ ID NO: 499005 - protein, 10 aa, Influenza virus
GSFIDYWAEG

SEQ ID NO: 499006 - protein, 10 aa, Influenza virus
GSFIDYWAKE

SEQ ID NO: 499007 - protein, 10 aa, Influenza virus
GSFIDYWAKG

SEQ ID NO: 499008 - protein, 10 aa, Influenza virus
GSFIQHPELT

SEQ ID NO: 499009 - protein, 10 aa, Influenza virus
GSFMDYWAEG

SEQ ID NO: 499010 - protein, 10 aa, Influenza virus
GSFNDYEELK

SEQ ID NO: 499011 - protein, 10 aa, Influenza virus
GSFNNYEELK

SEQ ID NO: 499012 - protein, 10 aa, Influenza virus
GSFPDGAKIQ

SEQ ID NO: 499013 - protein, 10 aa, Influenza virus
GSFPDGAQIK

SEQ ID NO: 499014 - protein, 10 aa, Influenza virus
GSFPDGAQIQ

SEQ ID NO: 499015 - protein, 10 aa, Influenza virus
GSFPNGAQIQ

SEQ ID NO: 499016 - protein, 10 aa, Influenza virus
GSFSIRGETT

SEQ ID NO: 499017 - protein, 10 aa, Influenza virus
GSFSIRWETT

SEQ ID NO: 499018 - protein, 10 aa, Influenza virus
GSFVDYWAEG

SEQ ID NO: 499019 - protein, 10 aa, Influenza virus
GSFVQHPELT

SEQ ID NO: 499020 - protein, 10 aa, Influenza virus
GSFVQHPEMT

SEQ ID NO: 499021 - protein, 10 aa, Influenza virus
GSFYRNMRWL

SEQ ID NO: 499022 - protein, 10 aa, Influenza virus
GSFYRSIRWL

SEQ ID NO: 499023 - protein, 10 aa, Influenza virus
GSFYRSMRWL

SEQ ID NO: 499024 - protein, 10 aa, Influenza virus
GSGFFPDGPQ

SEQ ID NO: 499025 - protein, 10 aa, Influenza virus
GSGHWPDGSN

SEQ ID NO: 499026 - protein, 10 aa, Influenza virus
GSGLRILIRG

SEQ ID NO: 499027 - protein, 10 aa, Influenza virus
GSGLRILVRG

SEQ ID NO: 499028 - protein, 10 aa, Influenza virus
GSGMRILIRG

SEQ ID NO: 499029 - protein, 10 aa, Influenza virus
GSGMRILVRG

SEQ ID NO: 499030 - protein, 10 aa, Influenza virus
GSGNWPDGSD

SEQ ID NO: 499031 - protein, 10 aa, Influenza virus
GSGNWPDGSN

SEQ ID NO: 499032 - protein, 10 aa, Influenza virus
GSGRIFQSGV

SEQ ID NO: 499033 - protein, 10 aa, Influenza virus
GSGSFPDGAK

SEQ ID NO: 499034 - protein, 10 aa, Influenza virus
GSGSFPDGAQ

SEQ ID NO: 499035 - protein, 10 aa, Influenza virus
GSGSFPDGAR

SEQ ID NO: 499036 - protein, 10 aa, Influenza virus
GSGSLPDGAQ

SEQ ID NO: 499037 - protein, 10 aa, Influenza virus
GSGSWPDGAD

SEQ ID NO: 499038 - protein, 10 aa, Influenza virus
GSGTDNYGVK

SEQ ID NO: 499039 - protein, 10 aa, Influenza virus
GSGTNNYGVK

SEQ ID NO: 499040 - protein, 10 aa, Influenza virus
GSGWLTLGIT

SEQ ID NO: 499041 - protein, 10 aa, Influenza virus
GSGYAADKAS

SEQ ID NO: 499042 - protein, 10 aa, Influenza virus
GSGYAADKES

SEQ ID NO: 499043 - protein, 10 aa, Influenza virus
GSGYAADKKS

SEQ ID NO: 499044 - protein, 10 aa, Influenza virus
GSGYAADLKS

SEQ ID NO: 499045 - protein, 10 aa, Influenza virus
GSGYAADQES

SEQ ID NO: 499046 - protein, 10 aa, Influenza virus
GSGYAADQKS

SEQ ID NO: 499047 - protein, 10 aa, Influenza virus
GSGYAADRES

SEQ ID NO: 499048 - protein, 10 aa, Influenza virus
GSGYAADRKS

SEQ ID NO: 499049 - protein, 10 aa, Influenza virus
GSGYGEDNES

SEQ ID NO: 499050 - protein, 10 aa, Influenza virus
GSHGVKGWAF

SEQ ID NO: 499051 - protein, 10 aa, Influenza virus
GSIAHKSCLP

SEQ ID NO: 499052 - protein, 10 aa, Influenza virus
GSIENLEELR

SEQ ID NO: 499053 - protein, 10 aa, Influenza virus
GSIENQEELK

SEQ ID NO: 499054 - protein, 10 aa, Influenza virus
GSIENQEELR

SEQ ID NO: 499055 - protein, 10 aa, Influenza virus
GSIGKVCRAL

SEQ ID NO: 499056 - protein, 10 aa, Influenza virus
GSIGKVCRTL

SEQ ID NO: 499057 - protein, 10 aa, Influenza virus
GSIISFCGVN

SEQ ID NO: 499058 - protein, 10 aa, Influenza virus
GSIITELPFQ

SEQ ID NO: 499059 - protein, 10 aa, Influenza virus
GSIKNQEELR

SEQ ID NO: 499060 - protein, 10 aa, Influenza virus
GSIKTKLPFQ

SEQ ID NO: 499061 - protein, 10 aa, Influenza virus
GSINTKLPFQ

SEQ ID NO: 499062 - protein, 10 aa, Influenza virus
GSINTRLPFQ

SEQ ID NO: 499063 - protein, 10 aa, Influenza virus
GSIPNDKPFQ

SEQ ID NO: 499064 - protein, 10 aa, Influenza virus
GSIPNEKPFQ

SEQ ID NO: 499065 - protein, 10 aa, Influenza virus
GSIPNGKPFQ

SEQ ID NO: 499066 - protein, 10 aa, Influenza virus
GSIPNNKPFQ

SEQ ID NO: 499067 - protein, 10 aa, Influenza virus
GSIQSDKPFQ

SEQ ID NO: 499068 - protein, 10 aa, Influenza virus
GSIRNETYDH

SEQ ID NO: 499069 - protein, 10 aa, Influenza virus
GSIRNGTYDH

SEQ ID NO: 499070 - protein, 10 aa, Influenza virus
GSIRNGTYNH

SEQ ID NO: 499071 - protein, 10 aa, Influenza virus
GSIRNNTYDH

SEQ ID NO: 499072 - protein, 10 aa, Influenza virus
GSISNDKPFQ

SEQ ID NO: 499073 - protein, 10 aa, Influenza virus
GSIYIEVLHL

SEQ ID NO: 499074 - protein, 10 aa, Influenza virus
GSKEQLGSWS

SEQ ID NO: 499075 - protein, 10 aa, Influenza virus
GSKERLGSWS

SEQ ID NO: 499076 - protein, 10 aa, Influenza virus
GSKGDIFVIR

SEQ ID NO: 499077 - protein, 10 aa, Influenza virus
GSKGDIFVMR

SEQ ID NO: 499078 - protein, 10 aa, Influenza virus
GSKGDVFVIR

SEQ ID NO: 499079 - protein, 10 aa, Influenza virus
GSKGDVFVMR

SEQ ID NO: 499080 - protein, 10 aa, Influenza virus
GSKGHVFVIR

SEQ ID NO: 499081 - protein, 10 aa, Influenza virus
GSKKRLGSWS

SEQ ID NO: 499082 - protein, 10 aa, Influenza virus
GSLEFIAEQF

SEQ ID NO: 499083 - protein, 10 aa, Influenza virus
GSLKLAIGLR

SEQ ID NO: 499084 - protein, 10 aa, Influenza virus
GSLKLAIGPR

SEQ ID NO: 499085 - protein, 10 aa, Influenza virus
GSLKLATGMR

SEQ ID NO: 499086 - protein, 10 aa, Influenza virus
GSLLLATGMR

SEQ ID NO: 499087 - protein, 10 aa, Influenza virus
GSLLNDKHFN

SEQ ID NO: 499088 - protein, 10 aa, Influenza virus
GSLLNDKHSN

SEQ ID NO: 499089 - protein, 10 aa, Influenza virus
GSLLNDKHSS

SEQ ID NO: 499090 - protein, 10 aa, Influenza virus
GSLLNDRHSN

SEQ ID NO: 499091 - protein, 10 aa, Influenza virus
GSLMLATGMR

SEQ ID NO: 499092 - protein, 10 aa, Influenza virus
GSLNDYEELK

SEQ ID NO: 499093 - protein, 10 aa, Influenza virus
GSLNFVSMEF

SEQ ID NO: 499094 - protein, 10 aa, Influenza virus
GSLRLATGMR

SEQ ID NO: 499095 - protein, 10 aa, Influenza virus
GSLSLAIMIA

SEQ ID NO: 499096 - protein, 10 aa, Influenza virus
GSLSLAIMMA

SEQ ID NO: 499097 - protein, 10 aa, Influenza virus
GSLSLAIMVA

SEQ ID NO: 499098 - protein, 10 aa, Influenza virus
GSMQCRICIG

SEQ ID NO: 499099 - protein, 10 aa, Influenza virus
GSNEQAAEAM

SEQ ID NO: 499100 - protein, 10 aa, Influenza virus
GSNNNGVKGF

SEQ ID NO: 499101 - protein, 10 aa, Influenza virus
GSNRPIIDIN

SEQ ID NO: 499102 - protein, 10 aa, Influenza virus
GSNRPIVDIN

SEQ ID NO: 499103 - protein, 10 aa, Influenza virus
GSNRPVIDIN

SEQ ID NO: 499104 - protein, 10 aa, Influenza virus
GSNRPVIDVN

SEQ ID NO: 499105 - protein, 10 aa, Influenza virus
GSNRPVIQID

SEQ ID NO: 499106 - protein, 10 aa, Influenza virus
GSNRPVIQIN

SEQ ID NO: 499107 - protein, 10 aa, Influenza virus
GSNRPVIRID

SEQ ID NO: 499108 - protein, 10 aa, Influenza virus
GSNRPVLDIS

SEQ ID NO: 499109 - protein, 10 aa, Influenza virus
GSNRPVVDIN

SEQ ID NO: 499110 - protein, 10 aa, Influenza virus
GSNRPVVDIR

SEQ ID NO: 499111 - protein, 10 aa, Influenza virus
GSNRPWIRFN

SEQ ID NO: 499112 - protein, 10 aa, Influenza virus
GSNRPWIRIN

SEQ ID NO: 499113 - protein, 10 aa, Influenza virus
GSNRPWISFN

SEQ ID NO: 499114 - protein, 10 aa, Influenza virus
GSNRPWLSFN

SEQ ID NO: 499115 - protein, 10 aa, Influenza virus
GSNRPWMRIN

SEQ ID NO: 499116 - protein, 10 aa, Influenza virus
GSNRPWMRIS

SEQ ID NO: 499117 - protein, 10 aa, Influenza virus
GSNRPWVRIN

SEQ ID NO: 499118 - protein, 10 aa, Influenza virus
GSNRPWVRMN

SEQ ID NO: 499119 - protein, 10 aa, Influenza virus
GSNRPWVSFD

SEQ ID NO: 499120 - protein, 10 aa, Influenza virus
GSNRPWVSFN

SEQ ID NO: 499121 - protein, 10 aa, Influenza virus
GSPDPGVKGF

SEQ ID NO: 499122 - protein, 10 aa, Influenza virus
GSPFPVGSGS

SEQ ID NO: 499123 - protein, 10 aa, Influenza virus
GSPGAPGVKG

SEQ ID NO: 499124 - protein, 10 aa, Influenza virus
GSPGCDRLQD

SEQ ID NO: 499125 - protein, 10 aa, Influenza virus
GSPGVKGWAF

SEQ ID NO: 499126 - protein, 10 aa, Influenza virus
GSPISVGSGS

SEQ ID NO: 499127 - protein, 10 aa, Influenza virus
GSPLELRDCK

SEQ ID NO: 499128 - protein, 10 aa, Influenza virus
GSPLVLDDCS

SEQ ID NO: 499129 - protein, 10 aa, Influenza virus
GSPPIVSNSD

SEQ ID NO: 499130 - protein, 10 aa, Influenza virus
GSPPIVSNSE

SEQ ID NO: 499131 - protein, 10 aa, Influenza virus
GSPPMVSNSD

SEQ ID NO: 499132 - protein, 10 aa, Influenza virus
GSPPVVSNSD

SEQ ID NO: 499133 - protein, 10 aa, Influenza virus
GSPSAPGVKG

SEQ ID NO: 499134 - protein, 10 aa, Influenza virus
GSPVPVGSGS

SEQ ID NO: 499135 - protein, 10 aa, Influenza virus
GSPVSVGSGS

SEQ ID NO: 499136 - protein, 10 aa, Influenza virus
GSQGVKGWAF

SEQ ID NO: 499137 - protein, 10 aa, Influenza virus
GSQKQEFKMN

SEQ ID NO: 499138 - protein, 10 aa, Influenza virus
GSRERLGSWS

SEQ ID NO: 499139 - protein, 10 aa, Influenza virus
GSRGEVFVIR

SEQ ID NO: 499140 - protein, 10 aa, Influenza virus
GSRGHIFVIR

SEQ ID NO: 499141 - protein, 10 aa, Influenza virus
GSRGHVFVIR

SEQ ID NO: 499142 - protein, 10 aa, Influenza virus
GSRPRVRNQS

SEQ ID NO: 499143 - protein, 10 aa, Influenza virus
GSSEQAAEAI

SEQ ID NO: 499144 - protein, 10 aa, Influenza virus
GSSEQAAEAM

SEQ ID NO: 499145 - protein, 10 aa, Influenza virus
GSSFYAELKW

SEQ ID NO: 499146 - protein, 10 aa, Influenza virus
GSSFYAEMKW

SEQ ID NO: 499147 - protein, 10 aa, Influenza virus
GSSIAFCGVD

SEQ ID NO: 499148 - protein, 10 aa, Influenza virus
GSSIAFCGVN

SEQ ID NO: 499149 - protein, 10 aa, Influenza virus
GSSISFCGVD

SEQ ID NO: 499150 - protein, 10 aa, Influenza virus
GSSISFCGVN

SEQ ID NO: 499151 - protein, 10 aa, Influenza virus
GSSISFCGVS

SEQ ID NO: 499152 - protein, 10 aa, Influenza virus
GSSKYQQSFS

SEQ ID NO: 499153 - protein, 10 aa, Influenza virus
GSSKYRQSFS

SEQ ID NO: 499154 - protein, 10 aa, Influenza virus
GSSPNAYQAK

SEQ ID NO: 499155 - protein, 10 aa, Influenza virus
GSSPNAYQAQ

SEQ ID NO: 499156 - protein, 10 aa, Influenza virus
GSSPNAYQAR

SEQ ID NO: 499157 - protein, 10 aa, Influenza virus
GSSSACLRGG

SEQ ID NO: 499158 - protein, 10 aa, Influenza virus
GSSSFYAEMK

SEQ ID NO: 499159 - protein, 10 aa, Influenza virus
GSSTYHNSFV

SEQ ID NO: 499160 - protein, 10 aa, Influenza virus
GSSTYQNNFV

SEQ ID NO: 499161 - protein, 10 aa, Influenza virus
GSSTYQNSFV

SEQ ID NO: 499162 - protein, 10 aa, Influenza virus
GSSTYQSNFV

SEQ ID NO: 499163 - protein, 10 aa, Influenza virus
GSSYVCSGLV

SEQ ID NO: 499164 - protein, 10 aa, Influenza virus
GSTLGLDIRT

SEQ ID NO: 499165 - protein, 10 aa, Influenza virus
GSTLPRRSGA

SEQ ID NO: 499166 - protein, 10 aa, Influenza virus
GSTQKAIDNM

SEQ ID NO: 499167 - protein, 10 aa, Influenza virus
GSTVNEEALR

SEQ ID NO: 499168 - protein, 10 aa, Influenza virus
GSVAHKSCLP

SEQ ID NO: 499169 - protein, 10 aa, Influenza virus
GSVENLEELR

SEQ ID NO: 499170 - protein, 10 aa, Influenza virus
GSVENQEELR

SEQ ID NO: 499171 - protein, 10 aa, Influenza virus
GSVYIEVLHL

SEQ ID NO: 499172 - protein, 10 aa, Influenza virus
GSWPDGADIN

SEQ ID NO: 499173 - protein, 10 aa, Influenza virus
GSWPDGANID

SEQ ID NO: 499174 - protein, 10 aa, Influenza virus
GSWPDGANIN

SEQ ID NO: 499175 - protein, 10 aa, Influenza virus
GSWPDGANIS

SEQ ID NO: 499176 - protein, 10 aa, Influenza virus
GSWPDGANTN

SEQ ID NO: 499177 - protein, 10 aa, Influenza virus
GSWSQNILRT

SEQ ID NO: 499178 - protein, 10 aa, Influenza virus
GSWSWHDGAE

SEQ ID NO: 499179 - protein, 10 aa, Influenza virus
GSYFFGDNAE

SEQ ID NO: 499180 - protein, 10 aa, Influenza virus
GSYFFGDNAK

SEQ ID NO: 499181 - protein, 10 aa, Influenza virus
GSYFFGDSAE

SEQ ID NO: 499182 - protein, 10 aa, Influenza virus
GSYNNTNGEQ

SEQ ID NO: 499183 - protein, 10 aa, Influenza virus
GSYNNTSGEQ

SEQ ID NO: 499184 - protein, 10 aa, Influenza virus
GSYNNTSGKQ

SEQ ID NO: 499185 - protein, 10 aa, Influenza virus
GSYVRLYLWG

SEQ ID NO: 499186 - protein, 10 aa, Influenza virus
GTAADLKSTQ

SEQ ID NO: 499187 - protein, 10 aa, Influenza virus
GTAADYKSTP

SEQ ID NO: 499188 - protein, 10 aa, Influenza virus
GTAADYKSTQ

SEQ ID NO: 499189 - protein, 10 aa, Influenza virus
GTAALSPGMM

SEQ ID NO: 499190 - protein, 10 aa, Influenza virus
GTAFRGLIST

SEQ ID NO: 499191 - protein, 10 aa, Influenza virus
GTAKHIEECS

SEQ ID NO: 499192 - protein, 10 aa, Influenza virus
GTAPILGNYK

SEQ ID NO: 499193 - protein, 10 aa, Influenza virus
GTAPVLGNYK

SEQ ID NO: 499194 - protein, 10 aa, Influenza virus
GTAPVLGNYR

SEQ ID NO: 499195 - protein, 10 aa, Influenza virus
GTAQHIEECS

SEQ ID NO: 499196 - protein, 10 aa, Influenza virus
GTASLSPGMM

SEQ ID NO: 499197 - protein, 10 aa, Influenza virus
GTCAVVMTDG

SEQ ID NO: 499198 - protein, 10 aa, Influenza virus
GTCGTGSWPD

SEQ ID NO: 499199 - protein, 10 aa, Influenza virus
GTCIVAVTDG

SEQ ID NO: 499200 - protein, 10 aa, Influenza virus
GTCTVVMTDG

SEQ ID NO: 499201 - protein, 10 aa, Influenza virus
GTCVAVMTDG

SEQ ID NO: 499202 - protein, 10 aa, Influenza virus
GTCVVAVTDG

SEQ ID NO: 499203 - protein, 10 aa, Influenza virus
GTCVVIMTDG

SEQ ID NO: 499204 - protein, 10 aa, Influenza virus
GTCVVTVTDG

SEQ ID NO: 499205 - protein, 10 aa, Influenza virus
GTCVVVMTDG

SEQ ID NO: 499206 - protein, 10 aa, Influenza virus
GTCWEQLYTP

SEQ ID NO: 499207 - protein, 10 aa, Influenza virus
GTCWEQMYTP

SEQ ID NO: 499208 - protein, 10 aa, Influenza virus
GTDNYGVKGF

SEQ ID NO: 499209 - protein, 10 aa, Influenza virus
GTFDTAQIIK

SEQ ID NO: 499210 - protein, 10 aa, Influenza virus
GTFDTIQIIK

SEQ ID NO: 499211 - protein, 10 aa, Influenza virus
GTFDTTQIIK

SEQ ID NO: 499212 - protein, 10 aa, Influenza virus
GTFDTVQIIK

SEQ ID NO: 499213 - protein, 10 aa, Influenza virus
GTFDTVQVIK

SEQ ID NO: 499214 - protein, 10 aa, Influenza virus
GTFEFTSFFY

SEQ ID NO: 499215 - protein, 10 aa, Influenza virus
GTFGPVHFQN

SEQ ID NO: 499216 - protein, 10 aa, Influenza virus
GTFGPVHFRN

SEQ ID NO: 499217 - protein, 10 aa, Influenza virus
GTFGPVHFRS

SEQ ID NO: 499218 - protein, 10 aa, Influenza virus
GTGCFEIFHK

SEQ ID NO: 499219 - protein, 10 aa, Influenza virus
GTGCFEIFHR

SEQ ID NO: 499220 - protein, 10 aa, Influenza virus
GTGCFEILHK

SEQ ID NO: 499221 - protein, 10 aa, Influenza virus
GTGCFELFHK

SEQ ID NO: 499222 - protein, 10 aa, Influenza virus
GTGIAADKAS

SEQ ID NO: 499223 - protein, 10 aa, Influenza virus
GTGIAADKES

SEQ ID NO: 499224 - protein, 10 aa, Influenza virus
GTGIAADKTS

SEQ ID NO: 499225 - protein, 10 aa, Influenza virus
GTGIAADKVS

SEQ ID NO: 499226 - protein, 10 aa, Influenza virus
GTGIAADRDS

SEQ ID NO: 499227 - protein, 10 aa, Influenza virus
GTGIAADRES

SEQ ID NO: 499228 - protein, 10 aa, Influenza virus
GTGIAADRGS

SEQ ID NO: 499229 - protein, 10 aa, Influenza virus
GTGIAAEKES

SEQ ID NO: 499230 - protein, 10 aa, Influenza virus
GTGIVADRDS

SEQ ID NO: 499231 - protein, 10 aa, Influenza virus
GTGMAADQKS

SEQ ID NO: 499232 - protein, 10 aa, Influenza virus
GTGMAADRDS

SEQ ID NO: 499233 - protein, 10 aa, Influenza virus
GTGMRILVRG

SEQ ID NO: 499234 - protein, 10 aa, Influenza virus
GTGNKLITVG

SEQ ID NO: 499235 - protein, 10 aa, Influenza virus
GTGQAADLKS

SEQ ID NO: 499236 - protein, 10 aa, Influenza virus
GTGQAADYES

SEQ ID NO: 499237 - protein, 10 aa, Influenza virus
GTGQAADYKS

SEQ ID NO: 499238 - protein, 10 aa, Influenza virus
GTGRIFQSGI

SEQ ID NO: 499239 - protein, 10 aa, Influenza virus
GTGRIFQSGV

SEQ ID NO: 499240 - protein, 10 aa, Influenza virus
GTGRIFQSRI

SEQ ID NO: 499241 - protein, 10 aa, Influenza virus
GTGSIYIEVL

SEQ ID NO: 499242 - protein, 10 aa, Influenza virus
GTGSVYIEVL

SEQ ID NO: 499243 - protein, 10 aa, Influenza virus
GTGSWADGAN

SEQ ID NO: 499244 - protein, 10 aa, Influenza virus
GTGSWPDGAD

SEQ ID NO: 499245 - protein, 10 aa, Influenza virus
GTGSWPDGAE

SEQ ID NO: 499246 - protein, 10 aa, Influenza virus
GTGSWPDGAN

SEQ ID NO: 499247 - protein, 10 aa, Influenza virus
GTGTAADLKS

SEQ ID NO: 499248 - protein, 10 aa, Influenza virus
GTGTGYTMDT

SEQ ID NO: 499249 - protein, 10 aa, Influenza virus
GTGYTMDTVN

SEQ ID NO: 499250 - protein, 10 aa, Influenza virus
GTGYTMDTVS

SEQ ID NO: 499251 - protein, 10 aa, Influenza virus
GTIAGFIEGG

SEQ ID NO: 499252 - protein, 10 aa, Influenza virus
GTIASSLPFQ

SEQ ID NO: 499253 - protein, 10 aa, Influenza virus
GTIHDRAAFR

SEQ ID NO: 499254 - protein, 10 aa, Influenza virus
GTIHDRSPFR

SEQ ID NO: 499255 - protein, 10 aa, Influenza virus
GTIHDRSPYR

SEQ ID NO: 499256 - protein, 10 aa, Influenza virus
GTIHDRSQFR

SEQ ID NO: 499257 - protein, 10 aa, Influenza virus
GTIHDRSQYR

SEQ ID NO: 499258 - protein, 10 aa, Influenza virus
GTIHDRTAFR

SEQ ID NO: 499259 - protein, 10 aa, Influenza virus
GTIHDRTTFR

SEQ ID NO: 499260 - protein, 10 aa, Influenza virus
GTIIGPPQCD

SEQ ID NO: 499261 - protein, 10 aa, Influenza virus
GTIISNLPFQ

SEQ ID NO: 499262 - protein, 10 aa, Influenza virus
GTIISSLPFQ

SEQ ID NO: 499263 - protein, 10 aa, Influenza virus
GTIKDRSPYR

SEQ ID NO: 499264 - protein, 10 aa, Influenza virus
GTINDRSPFR

SEQ ID NO: 499265 - protein, 10 aa, Influenza virus
GTINSPLPFQ

SEQ ID NO: 499266 - protein, 10 aa, Influenza virus
GTISPRSRSG

SEQ ID NO: 499267 - protein, 10 aa, Influenza virus
GTITGPPQCD

SEQ ID NO: 499268 - protein, 10 aa, Influenza virus
GTITSNLPFQ

SEQ ID NO: 499269 - protein, 10 aa, Influenza virus
GTITSPLPFQ

SEQ ID NO: 499270 - protein, 10 aa, Influenza virus
GTIVKTLTNE

SEQ ID NO: 499271 - protein, 10 aa, Influenza virus
GTIVKTLTSE

SEQ ID NO: 499272 - protein, 10 aa, Influenza virus
GTIVSSLPFQ

SEQ ID NO: 499273 - protein, 10 aa, Influenza virus
GTKGFGFLNE

SEQ ID NO: 499274 - protein, 10 aa, Influenza virus
GTKINTLTER

SEQ ID NO: 499275 - protein, 10 aa, Influenza virus
GTKQVCAAWS

SEQ ID NO: 499276 - protein, 10 aa, Influenza virus
GTKQVCIAWS

SEQ ID NO: 499277 - protein, 10 aa, Influenza virus
GTKQVCMAWS

SEQ ID NO: 499278 - protein, 10 aa, Influenza virus
GTKQVCVAWS

SEQ ID NO: 499279 - protein, 10 aa, Influenza virus
GTKRSHEQME

SEQ ID NO: 499280 - protein, 10 aa, Influenza virus
GTKRSYEQME

SEQ ID NO: 499281 - protein, 10 aa, Influenza virus
GTKVDTLTEK

SEQ ID NO: 499282 - protein, 10 aa, Influenza virus
GTKVNTLTEK

SEQ ID NO: 499283 - protein, 10 aa, Influenza virus
GTKVNTLTER

SEQ ID NO: 499284 - protein, 10 aa, Influenza virus
GTLIGPPQCD

SEQ ID NO: 499285 - protein, 10 aa, Influenza virus
GTMDYYWGIL

SEQ ID NO: 499286 - protein, 10 aa, Influenza virus
GTMHDRSPFR

SEQ ID NO: 499287 - protein, 10 aa, Influenza virus
GTMKDRSPYR

SEQ ID NO: 499288 - protein, 10 aa, Influenza virus
GTNGVKGFSF

SEQ ID NO: 499289 - protein, 10 aa, Influenza virus
GTNNYGVKGF

SEQ ID NO: 499290 - protein, 10 aa, Influenza virus
GTNRPILVIS

SEQ ID NO: 499291 - protein, 10 aa, Influenza virus
GTNRPVLIIS

SEQ ID NO: 499292 - protein, 10 aa, Influenza virus
GTNRPVLVIS

SEQ ID NO: 499293 - protein, 10 aa, Influenza virus
GTNRPVLVVS

SEQ ID NO: 499294 - protein, 10 aa, Influenza virus
GTPACDLHLT

SEQ ID NO: 499295 - protein, 10 aa, Influenza virus
GTPACDLYLT

SEQ ID NO: 499296 - protein, 10 aa, Influenza virus
GTPDPGVKGF

SEQ ID NO: 499297 - protein, 10 aa, Influenza virus
GTPLELRDCK

SEQ ID NO: 499298 - protein, 10 aa, Influenza virus
GTPPTVSNSD

SEQ ID NO: 499299 - protein, 10 aa, Influenza virus
GTPVCDPHLT

SEQ ID NO: 499300 - protein, 10 aa, Influenza virus
GTQGVKGWAF

SEQ ID NO: 499301 - protein, 10 aa, Influenza virus
GTQPLSISVG

SEQ ID NO: 499302 - protein, 10 aa, Influenza virus
GTQSLSISIG

SEQ ID NO: 499303 - protein, 10 aa, Influenza virus
GTQSLSISVE

SEQ ID NO: 499304 - protein, 10 aa, Influenza virus
GTQSLSISVG

SEQ ID NO: 499305 - protein, 10 aa, Influenza virus
GTREWSYLIE

SEQ ID NO: 499306 - protein, 10 aa, Influenza virus
GTRIGDGQRS

SEQ ID NO: 499307 - protein, 10 aa, Influenza virus
GTRPGYNGQK

SEQ ID NO: 499308 - protein, 10 aa, Influenza virus
GTRQVCIAWS

SEQ ID NO: 499309 - protein, 10 aa, Influenza virus
GTRQVCMAWS

SEQ ID NO: 499310 - protein, 10 aa, Influenza virus
GTRQVCVAWS

SEQ ID NO: 499311 - protein, 10 aa, Influenza virus
GTRRIDFHWL

SEQ ID NO: 499312 - protein, 10 aa, Influenza virus
GTRWMKIIRV

SEQ ID NO: 499313 - protein, 10 aa, Influenza virus
GTSGTYGAGS

SEQ ID NO: 499314 - protein, 10 aa, Influenza virus
GTSGTYGSGS

SEQ ID NO: 499315 - protein, 10 aa, Influenza virus
GTSGTYGTGS

SEQ ID NO: 499316 - protein, 10 aa, Influenza virus
GTSGTYGTGT

SEQ ID NO: 499317 - protein, 10 aa, Influenza virus
GTSIWTSSSS

SEQ ID NO: 499318 - protein, 10 aa, Influenza virus
GTSKACNALT

SEQ ID NO: 499319 - protein, 10 aa, Influenza virus
GTSKACNAST

SEQ ID NO: 499320 - protein, 10 aa, Influenza virus
GTSKACSAST

SEQ ID NO: 499321 - protein, 10 aa, Influenza virus
GTSKIKMKWG

SEQ ID NO: 499322 - protein, 10 aa, Influenza virus
GTSKVKMKWG

SEQ ID NO: 499323 - protein, 10 aa, Influenza virus
GTSSIYIEVL

SEQ ID NO: 499324 - protein, 10 aa, Influenza virus
GTSSVYIEVL

SEQ ID NO: 499325 - protein, 10 aa, Influenza virus
GTSSVYVEVL

SEQ ID NO: 499326 - protein, 10 aa, Influenza virus
GTSVKTLTDN

SEQ ID NO: 499327 - protein, 10 aa, Influenza virus
GTSVWAGRTI

SEQ ID NO: 499328 - protein, 10 aa, Influenza virus
GTSVWAGRTV

SEQ ID NO: 499329 - protein, 10 aa, Influenza virus
GTTASCQNRG

SEQ ID NO: 499330 - protein, 10 aa, Influenza virus
GTTGNPIICL

SEQ ID NO: 499331 - protein, 10 aa, Influenza virus
GTTHDRTAFR

SEQ ID NO: 499332 - protein, 10 aa, Influenza virus
GTTIRGKHSN

SEQ ID NO: 499333 - protein, 10 aa, Influenza virus
GTTIRGRHSN

SEQ ID NO: 499334 - protein, 10 aa, Influenza virus
GTTIRNKHSN

SEQ ID NO: 499335 - protein, 10 aa, Influenza virus
GTTIRNRHSN

SEQ ID NO: 499336 - protein, 10 aa, Influenza virus
GTTLDNEHSN

SEQ ID NO: 499337 - protein, 10 aa, Influenza virus
GTTLDNKHSN

SEQ ID NO: 499338 - protein, 10 aa, Influenza virus
GTTLENKHSN

SEQ ID NO: 499339 - protein, 10 aa, Influenza virus
GTTLKGRHAN

SEQ ID NO: 499340 - protein, 10 aa, Influenza virus
GTTLNNKHSN

SEQ ID NO: 499341 - protein, 10 aa, Influenza virus
GTTLRGQHAN

SEQ ID NO: 499342 - protein, 10 aa, Influenza virus
GTTLRGRHAN

SEQ ID NO: 499343 - protein, 10 aa, Influenza virus
GTTLYNKHSN

SEQ ID NO: 499344 - protein, 10 aa, Influenza virus
GTTVNEEALR

SEQ ID NO: 499345 - protein, 10 aa, Influenza virus
GTVKDRSPFR

SEQ ID NO: 499346 - protein, 10 aa, Influenza virus
GTVKDRSPYR

SEQ ID NO: 499347 - protein, 10 aa, Influenza virus
GTVSLSPGMM

SEQ ID NO: 499348 - protein, 10 aa, Influenza virus
GTVTGPPQCD

SEQ ID NO: 499349 - protein, 10 aa, Influenza virus
GTVVKTLTNE

SEQ ID NO: 499350 - protein, 10 aa, Influenza virus
GTWAVVMTDG

SEQ ID NO: 499351 - protein, 10 aa, Influenza virus
GTWDTLIERD

SEQ ID NO: 499352 - protein, 10 aa, Influenza virus
GTWDTLIERE

SEQ ID NO: 499353 - protein, 10 aa, Influenza virus
GTWDTLIERG

SEQ ID NO: 499354 - protein, 10 aa, Influenza virus
GTYCSLNGIS

SEQ ID NO: 499355 - protein, 10 aa, Influenza virus
GTYCSLNGVS

SEQ ID NO: 499356 - protein, 10 aa, Influenza virus
GTYDHKDFEE

SEQ ID NO: 499357 - protein, 10 aa, Influenza virus
GTYDHKDYEE

SEQ ID NO: 499358 - protein, 10 aa, Influenza virus
GTYDHKEFEE

SEQ ID NO: 499359 - protein, 10 aa, Influenza virus
GTYDHKEFEK

SEQ ID NO: 499360 - protein, 10 aa, Influenza virus
GTYDHKEYEE

SEQ ID NO: 499361 - protein, 10 aa, Influenza virus
GTYDHNIYRD

SEQ ID NO: 499362 - protein, 10 aa, Influenza virus
GTYDYPKYEE

SEQ ID NO: 499363 - protein, 10 aa, Influenza virus
GTYDYPKYEK

SEQ ID NO: 499364 - protein, 10 aa, Influenza virus
GTYDYPKYSE

SEQ ID NO: 499365 - protein, 10 aa, Influenza virus
GTYDYPKYSK

SEQ ID NO: 499366 - protein, 10 aa, Influenza virus
GTYDYSKYEE

SEQ ID NO: 499367 - protein, 10 aa, Influenza virus
GTYGAGSWPD

SEQ ID NO: 499368 - protein, 10 aa, Influenza virus
GTYGKGSWPD

SEQ ID NO: 499369 - protein, 10 aa, Influenza virus
GTYGSGSWPD

SEQ ID NO: 499370 - protein, 10 aa, Influenza virus
GTYGTGSWPD

SEQ ID NO: 499371 - protein, 10 aa, Influenza virus
GTYGTGTWPD

SEQ ID NO: 499372 - protein, 10 aa, Influenza virus
GTYKILTIYS

SEQ ID NO: 499373 - protein, 10 aa, Influenza virus
GTYNHEDYKE

SEQ ID NO: 499374 - protein, 10 aa, Influenza virus
GTYNHEDYRE

SEQ ID NO: 499375 - protein, 10 aa, Influenza virus
GTYNHKDYEE

SEQ ID NO: 499376 - protein, 10 aa, Influenza virus
GTYNHKEYEE

SEQ ID NO: 499377 - protein, 10 aa, Influenza virus
GTYNNTTGRD

SEQ ID NO: 499378 - protein, 10 aa, Influenza virus
GTYNRKEYEE

SEQ ID NO: 499379 - protein, 10 aa, Influenza virus
GTYNYPKYEE

SEQ ID NO: 499380 - protein, 10 aa, Influenza virus
GTYNYPKYSE

SEQ ID NO: 499381 - protein, 10 aa, Influenza virus
GTYQILSIYS

SEQ ID NO: 499382 - protein, 10 aa, Influenza virus
GTYYYPKYEE

SEQ ID NO: 499383 - protein, 10 aa, Influenza virus
GVAIALSILN

SEQ ID NO: 499384 - protein, 10 aa, Influenza virus
GVAIALSVLN

SEQ ID NO: 499385 - protein, 10 aa, Influenza virus
GVANLGLNIG

SEQ ID NO: 499386 - protein, 10 aa, Influenza virus
GVAPSPSNSR

SEQ ID NO: 499387 - protein, 10 aa, Influenza virus
GVAPSPYNSR

SEQ ID NO: 499388 - protein, 10 aa, Influenza virus
GVAPVLGNYK

SEQ ID NO: 499389 - protein, 10 aa, Influenza virus
GVCPVVFTDG

SEQ ID NO: 499390 - protein, 10 aa, Influenza virus
GVCPVVMTDG

SEQ ID NO: 499391 - protein, 10 aa, Influenza virus
GVCYPGSIEN

SEQ ID NO: 499392 - protein, 10 aa, Influenza virus
GVCYPGSIKN

SEQ ID NO: 499393 - protein, 10 aa, Influenza virus
GVDEYSNAEK

SEQ ID NO: 499394 - protein, 10 aa, Influenza virus
GVDEYSNAER

SEQ ID NO: 499395 - protein, 10 aa, Influenza virus
GVDEYSSAER

SEQ ID NO: 499396 - protein, 10 aa, Influenza virus
GVDEYSSTEK

SEQ ID NO: 499397 - protein, 10 aa, Influenza virus
GVDEYSSTER

SEQ ID NO: 499398 - protein, 10 aa, Influenza virus
GVDRFYRICK

SEQ ID NO: 499399 - protein, 10 aa, Influenza virus
GVDRFYRTCK

SEQ ID NO: 499400 - protein, 10 aa, Influenza virus
GVELSSMGVY

SEQ ID NO: 499401 - protein, 10 aa, Influenza virus
GVESAVLRGF

SEQ ID NO: 499402 - protein, 10 aa, Influenza virus
GVETMVILSA

SEQ ID NO: 499403 - protein, 10 aa, Influenza virus
GVEVVDATET

SEQ ID NO: 499404 - protein, 10 aa, Influenza virus
GVEVVNATET

SEQ ID NO: 499405 - protein, 10 aa, Influenza virus
GVEYNGKSLG

SEQ ID NO: 499406 - protein, 10 aa, Influenza virus
GVFEFSDERA

SEQ ID NO: 499407 - protein, 10 aa, Influenza virus
GVFELSDEKA

SEQ ID NO: 499408 - protein, 10 aa, Influenza virus
GVFELSDERA

SEQ ID NO: 499409 - protein, 10 aa, Influenza virus
GVGIAADKES

SEQ ID NO: 499410 - protein, 10 aa, Influenza virus
GVGMAADKES

SEQ ID NO: 499411 - protein, 10 aa, Influenza virus
GVGNLAFNTV

SEQ ID NO: 499412 - protein, 10 aa, Influenza virus
GVGNLIFNTV

SEQ ID NO: 499413 - protein, 10 aa, Influenza virus
GVGNLVFNTV

SEQ ID NO: 499414 - protein, 10 aa, Influenza virus
GVGRMTICIQ

SEQ ID NO: 499415 - protein, 10 aa, Influenza virus
GVGRMTICVQ

SEQ ID NO: 499416 - protein, 10 aa, Influenza virus
GVHHPSSDNE

SEQ ID NO: 499417 - protein, 10 aa, Influenza virus
GVHHPSTDAE

SEQ ID NO: 499418 - protein, 10 aa, Influenza virus
GVHHPSTDKE

SEQ ID NO: 499419 - protein, 10 aa, Influenza virus
GVHHPSTDTE

SEQ ID NO: 499420 - protein, 10 aa, Influenza virus
GVHHSSSLDE

SEQ ID NO: 499421 - protein, 10 aa, Influenza virus
GVILEENTTY

SEQ ID NO: 499422 - protein, 10 aa, Influenza virus
GVINTSKPFQ

SEQ ID NO: 499423 - protein, 10 aa, Influenza virus
GVIPLTTTPT

SEQ ID NO: 499424 - protein, 10 aa, Influenza virus
GVITDTIKSW

SEQ ID NO: 499425 - protein, 10 aa, Influenza virus
GVITDTLKSW

SEQ ID NO: 499426 - protein, 10 aa, Influenza virus
GVKGFAFKYG

SEQ ID NO: 499427 - protein, 10 aa, Influenza virus
GVKGFAFLDE

SEQ ID NO: 499428 - protein, 10 aa, Influenza virus
GVKGFAFLDG

SEQ ID NO: 499429 - protein, 10 aa, Influenza virus
GVKGFAFLDR

SEQ ID NO: 499430 - protein, 10 aa, Influenza virus
GVKGFAFLNG

SEQ ID NO: 499431 - protein, 10 aa, Influenza virus
GVKGFAYLDG

SEQ ID NO: 499432 - protein, 10 aa, Influenza virus
GVKGFGFKAG

SEQ ID NO: 499433 - protein, 10 aa, Influenza virus
GVKGFGFKKG

SEQ ID NO: 499434 - protein, 10 aa, Influenza virus
GVKGFGFKSG

SEQ ID NO: 499435 - protein, 10 aa, Influenza virus
GVKGFGFKTG

SEQ ID NO: 499436 - protein, 10 aa, Influenza virus
GVKGFGFKVG

SEQ ID NO: 499437 - protein, 10 aa, Influenza virus
GVKGFGFLDG

SEQ ID NO: 499438 - protein, 10 aa, Influenza virus
GVKGFGFLDN

SEQ ID NO: 499439 - protein, 10 aa, Influenza virus
GVKGFGFLDS

SEQ ID NO: 499440 - protein, 10 aa, Influenza virus
GVKGFGFLNG

SEQ ID NO: 499441 - protein, 10 aa, Influenza virus
GVKGFGFLSG

SEQ ID NO: 499442 - protein, 10 aa, Influenza virus
GVKGFGFRQG

SEQ ID NO: 499443 - protein, 10 aa, Influenza virus
GVKGFSFKYG

SEQ ID NO: 499444 - protein, 10 aa, Influenza virus
GVKGFSFRYG

SEQ ID NO: 499445 - protein, 10 aa, Influenza virus
GVKGFSYKYD

SEQ ID NO: 499446 - protein, 10 aa, Influenza virus
GVKGFSYKYG

SEQ ID NO: 499447 - protein, 10 aa, Influenza virus
GVKGFSYLDG

SEQ ID NO: 499448 - protein, 10 aa, Influenza virus
GVKGFSYLNG

SEQ ID NO: 499449 - protein, 10 aa, Influenza virus
GVKGFSYRYG

SEQ ID NO: 499450 - protein, 10 aa, Influenza virus
GVKGWAFDDG

SEQ ID NO: 499451 - protein, 10 aa, Influenza virus
GVKGWAFDNE

SEQ ID NO: 499452 - protein, 10 aa, Influenza virus
GVKGWAFDNG

SEQ ID NO: 499453 - protein, 10 aa, Influenza virus
GVKGWAFDSG

SEQ ID NO: 499454 - protein, 10 aa, Influenza virus
GVKGWAFDYG

SEQ ID NO: 499455 - protein, 10 aa, Influenza virus
GVKLAQGYKD

SEQ ID NO: 499456 - protein, 10 aa, Influenza virus
GVKLEENSTY

SEQ ID NO: 499457 - protein, 10 aa, Influenza virus
GVKLEENTSY

SEQ ID NO: 499458 - protein, 10 aa, Influenza virus
GVKLEENTTY

SEQ ID NO: 499459 - protein, 10 aa, Influenza virus
GVKLIQGYKD

SEQ ID NO: 499460 - protein, 10 aa, Influenza virus
GVKLSNMGIY

SEQ ID NO: 499461 - protein, 10 aa, Influenza virus
GVKLSNMGVY

SEQ ID NO: 499462 - protein, 10 aa, Influenza virus
GVKLSSMGIY

SEQ ID NO: 499463 - protein, 10 aa, Influenza virus
GVKLSSMGVY

SEQ ID NO: 499464 - protein, 10 aa, Influenza virus
GVKLTQGYKD

SEQ ID NO: 499465 - protein, 10 aa, Influenza virus
GVKMNPNQKI

SEQ ID NO: 499466 - protein, 10 aa, Influenza virus
GVKPLILKDC

SEQ ID NO: 499467 - protein, 10 aa, Influenza virus
GVKPLILRDC

SEQ ID NO: 499468 - protein, 10 aa, Influenza virus
GVKPLILRNC

SEQ ID NO: 499469 - protein, 10 aa, Influenza virus
GVKVDGSSSA

SEQ ID NO: 499470 - protein, 10 aa, Influenza virus
GVLEDEQMYQ

SEQ ID NO: 499471 - protein, 10 aa, Influenza virus
GVLLGTKHSN

SEQ ID NO: 499472 - protein, 10 aa, Influenza virus
GVLTDTSRPG

SEQ ID NO: 499473 - protein, 10 aa, Influenza virus
GVLTDTSRPK

SEQ ID NO: 499474 - protein, 10 aa, Influenza virus
GVLTDTSRPS

SEQ ID NO: 499475 - protein, 10 aa, Influenza virus
GVMNTSKPFQ

SEQ ID NO: 499476 - protein, 10 aa, Influenza virus
GVMNTSKPLQ

SEQ ID NO: 499477 - protein, 10 aa, Influenza virus
GVNDRNFWRG

SEQ ID NO: 499478 - protein, 10 aa, Influenza virus
GVNESADMSI

SEQ ID NO: 499479 - protein, 10 aa, Influenza virus
GVNRFYRTCK

SEQ ID NO: 499480 - protein, 10 aa, Influenza virus
GVNSFSRTEL

SEQ ID NO: 499481 - protein, 10 aa, Influenza virus
GVNTNKTFQN

SEQ ID NO: 499482 - protein, 10 aa, Influenza virus
GVPESMREEY

SEQ ID NO: 499483 - protein, 10 aa, Influenza virus
GVPFHLATKQ

SEQ ID NO: 499484 - protein, 10 aa, Influenza virus
GVPFHLGTKQ

SEQ ID NO: 499485 - protein, 10 aa, Influenza virus
GVPFHLGTRQ

SEQ ID NO: 499486 - protein, 10 aa, Influenza virus
GVPFYLGTKQ

SEQ ID NO: 499487 - protein, 10 aa, Influenza virus
GVPKSMREEY

SEQ ID NO: 499488 - protein, 10 aa, Influenza virus
GVPPLELGDC

SEQ ID NO: 499489 - protein, 10 aa, Influenza virus
GVPTDVIRSW

SEQ ID NO: 499490 - protein, 10 aa, Influenza virus
GVPTDVVRSW

SEQ ID NO: 499491 - protein, 10 aa, Influenza virus
GVPVTSSIDL

SEQ ID NO: 499492 - protein, 10 aa, Influenza virus
GVPVTSSVDL

SEQ ID NO: 499493 - protein, 10 aa, Influenza virus
GVQAGVDRFY

SEQ ID NO: 499494 - protein, 10 aa, Influenza virus
GVQDIIDNDN

SEQ ID NO: 499495 - protein, 10 aa, Influenza virus
GVQDIIDNNN

SEQ ID NO: 499496 - protein, 10 aa, Influenza virus
GVQMQRFRRP

SEQ ID NO: 499497 - protein, 10 aa, Influenza virus
GVRCICRDNW

SEQ ID NO: 499498 - protein, 10 aa, Influenza virus
GVREWSYLIE

SEQ ID NO: 499499 - protein, 10 aa, Influenza virus
GVRIGSKGDV

SEQ ID NO: 499500 - protein, 10 aa, Influenza virus
GVRLEENTTY

SEQ ID NO: 499501 - protein, 10 aa, Influenza virus
GVRLTQGYKD

SEQ ID NO: 499502 - protein, 10 aa, Influenza virus
GVRPGYNGQK

SEQ ID NO: 499503 - protein, 10 aa, Influenza virus
GVRPGYNGQR

SEQ ID NO: 499504 - protein, 10 aa, Influenza virus
GVRPLILKDC

SEQ ID NO: 499505 - protein, 10 aa, Influenza virus
GVRPLILRDC

SEQ ID NO: 499506 - protein, 10 aa, Influenza virus
GVRPRYNGQR

SEQ ID NO: 499507 - protein, 10 aa, Influenza virus
GVSFHLGTKQ

SEQ ID NO: 499508 - protein, 10 aa, Influenza virus
GVSGADDDAY

SEQ ID NO: 499509 - protein, 10 aa, Influenza virus
GVSGADNDAY

SEQ ID NO: 499510 - protein, 10 aa, Influenza virus
GVSGEVPGWS

SEQ ID NO: 499511 - protein, 10 aa, Influenza virus
GVSGINESAD

SEQ ID NO: 499512 - protein, 10 aa, Influenza virus
GVSGPDNGAV

SEQ ID NO: 499513 - protein, 10 aa, Influenza virus
GVSGTDDDAY

SEQ ID NO: 499514 - protein, 10 aa, Influenza virus
GVSGVNESAD

SEQ ID NO: 499515 - protein, 10 aa, Influenza virus
GVSILNLGQK

SEQ ID NO: 499516 - protein, 10 aa, Influenza virus
GVSILNLGQR

SEQ ID NO: 499517 - protein, 10 aa, Influenza virus
GVSPIHLGDC

SEQ ID NO: 499518 - protein, 10 aa, Influenza virus
GVSPVHLGDC

SEQ ID NO: 499519 - protein, 10 aa, Influenza virus
GVSSEAPGWS

SEQ ID NO: 499520 - protein, 10 aa, Influenza virus
GVSSEVPGCT

SEQ ID NO: 499521 - protein, 10 aa, Influenza virus
GVSSEVPGWS

SEQ ID NO: 499522 - protein, 10 aa, Influenza virus
GVSVLNLGQK

SEQ ID NO: 499523 - protein, 10 aa, Influenza virus
GVTASCLDKG

SEQ ID NO: 499524 - protein, 10 aa, Influenza virus
GVTASCLDRG

SEQ ID NO: 499525 - protein, 10 aa, Influenza virus
GVTASCRDNG

SEQ ID NO: 499526 - protein, 10 aa, Influenza virus
GVTLSVVSLL

SEQ ID NO: 499527 - protein, 10 aa, Influenza virus
GVTNKVNSII

SEQ ID NO: 499528 - protein, 10 aa, Influenza virus
GVTRREIHIY

SEQ ID NO: 499529 - protein, 10 aa, Influenza virus
GVTRREVHIY

SEQ ID NO: 499530 - protein, 10 aa, Influenza virus
GVTRREVHMY

SEQ ID NO: 499531 - protein, 10 aa, Influenza virus
GVTRREVHTY

SEQ ID NO: 499532 - protein, 10 aa, Influenza virus
GVTRREVHVY

SEQ ID NO: 499533 - protein, 10 aa, Influenza virus
GVTTHYVSQI

SEQ ID NO: 499534 - protein, 10 aa, Influenza virus
GVTVIKNNMI

SEQ ID NO: 499535 - protein, 10 aa, Influenza virus
GVTVIKNNMV

SEQ ID NO: 499536 - protein, 10 aa, Influenza virus
GVTVIRNNMI

SEQ ID NO: 499537 - protein, 10 aa, Influenza virus
GVVNTALSTI

SEQ ID NO: 499538 - protein, 10 aa, Influenza virus
GVVNTILSTK

SEQ ID NO: 499539 - protein, 10 aa, Influenza virus
GVVNTTLSTI

SEQ ID NO: 499540 - protein, 10 aa, Influenza virus
GVWIGRTKSA

SEQ ID NO: 499541 - protein, 10 aa, Influenza virus
GVWIGRTKSI

SEQ ID NO: 499542 - protein, 10 aa, Influenza virus
GVWIGRTKSL

SEQ ID NO: 499543 - protein, 10 aa, Influenza virus
GVWIGRTKSN

SEQ ID NO: 499544 - protein, 10 aa, Influenza virus
GVWIGRTKSP

SEQ ID NO: 499545 - protein, 10 aa, Influenza virus
GVWIGRTKST

SEQ ID NO: 499546 - protein, 10 aa, Influenza virus
GVWMGRTKSN

SEQ ID NO: 499547 - protein, 10 aa, Influenza virus
GVWTYNAELL

SEQ ID NO: 499548 - protein, 10 aa, Influenza virus
GVYINTALLN

SEQ ID NO: 499549 - protein, 10 aa, Influenza virus
GVYINTAMLN

SEQ ID NO: 499550 - protein, 10 aa, Influenza virus
GVYKALSIYS

SEQ ID NO: 499551 - protein, 10 aa, Influenza virus
GVYMNTALLN

SEQ ID NO: 499552 - protein, 10 aa, Influenza virus
GVYNNTTGRD

SEQ ID NO: 499553 - protein, 10 aa, Influenza virus
GVYQILAIYA

SEQ ID NO: 499554 - protein, 10 aa, Influenza virus
GVYQILAIYS

SEQ ID NO: 499555 - protein, 10 aa, Influenza virus
GVYQILSIYS

SEQ ID NO: 499556 - protein, 10 aa, Influenza virus
GVYQILVIYA

SEQ ID NO: 499557 - protein, 10 aa, Influenza virus
GVYVNTALLN

SEQ ID NO: 499558 - protein, 10 aa, Influenza virus
GWAIHTKDNS

SEQ ID NO: 499559 - protein, 10 aa, Influenza virus
GWAIYSKDNG

SEQ ID NO: 499560 - protein, 10 aa, Influenza virus
GWAIYSKDNS

SEQ ID NO: 499561 - protein, 10 aa, Influenza virus
GWAIYTKDNS

SEQ ID NO: 499562 - protein, 10 aa, Influenza virus
GWAPLSKDNG

SEQ ID NO: 499563 - protein, 10 aa, Influenza virus
GWATANSKSQ

SEQ ID NO: 499564 - protein, 10 aa, Influenza virus
GWCGMIDGWY

SEQ ID NO: 499565 - protein, 10 aa, Influenza virus
GWEGLIDGWY

SEQ ID NO: 499566 - protein, 10 aa, Influenza virus
GWEGLINGWY

SEQ ID NO: 499567 - protein, 10 aa, Influenza virus
GWEGLVDGWY

SEQ ID NO: 499568 - protein, 10 aa, Influenza virus
GWEGMIDGWY

SEQ ID NO: 499569 - protein, 10 aa, Influenza virus
GWEGMMDGWY

SEQ ID NO: 499570 - protein, 10 aa, Influenza virus
GWEGMVDGWY

SEQ ID NO: 499571 - protein, 10 aa, Influenza virus
GWEGMVNGWY

SEQ ID NO: 499572 - protein, 10 aa, Influenza virus
GWIDSPNHAK

SEQ ID NO: 499573 - protein, 10 aa, Influenza virus
GWILGNPKCD

SEQ ID NO: 499574 - protein, 10 aa, Influenza virus
GWILGNPMCD

SEQ ID NO: 499575 - protein, 10 aa, Influenza virus
GWILGNPQCD

SEQ ID NO: 499576 - protein, 10 aa, Influenza virus
GWILGNPRCD

SEQ ID NO: 499577 - protein, 10 aa, Influenza virus
GWILGNPRCG

SEQ ID NO: 499578 - protein, 10 aa, Influenza virus
GWINSPNHAK

SEQ ID NO: 499579 - protein, 10 aa, Influenza virus
GWINSPNHVK

SEQ ID NO: 499580 - protein, 10 aa, Influenza virus
GWINSPSQAK

SEQ ID NO: 499581 - protein, 10 aa, Influenza virus
GWITIGISGP

SEQ ID NO: 499582 - protein, 10 aa, Influenza virus
GWIVGNPSCA

SEQ ID NO: 499583 - protein, 10 aa, Influenza virus
GWLLGNPECD

SEQ ID NO: 499584 - protein, 10 aa, Influenza virus
GWLLGNPKCD

SEQ ID NO: 499585 - protein, 10 aa, Influenza virus
GWLLGNPLCD

SEQ ID NO: 499586 - protein, 10 aa, Influenza virus
GWLLGNPMCD

SEQ ID NO: 499587 - protein, 10 aa, Influenza virus
GWLTIGISGP

SEQ ID NO: 499588 - protein, 10 aa, Influenza virus
GWLTIGITGP

SEQ ID NO: 499589 - protein, 10 aa, Influenza virus
GWLTLGITGP

SEQ ID NO: 499590 - protein, 10 aa, Influenza virus
GWMDYYWGIL

SEQ ID NO: 499591 - protein, 10 aa, Influenza virus
GWPGLINGWY

SEQ ID NO: 499592 - protein, 10 aa, Influenza virus
GWPGLVAGWY

SEQ ID NO: 499593 - protein, 10 aa, Influenza virus
GWPWPDGALL

SEQ ID NO: 499594 - protein, 10 aa, Influenza virus
GWQGLIDGWY

SEQ ID NO: 499595 - protein, 10 aa, Influenza virus
GWQGLVDGWY

SEQ ID NO: 499596 - protein, 10 aa, Influenza virus
GWQGMIDGWY

SEQ ID NO: 499597 - protein, 10 aa, Influenza virus
GWQGMVDGWY

SEQ ID NO: 499598 - protein, 10 aa, Influenza virus
GWSATACHDG

SEQ ID NO: 499599 - protein, 10 aa, Influenza virus
GWSGLIAGWY

SEQ ID NO: 499600 - protein, 10 aa, Influenza virus
GWSGLVAGWY

SEQ ID NO: 499601 - protein, 10 aa, Influenza virus
GWSGMIDGWY

SEQ ID NO: 499602 - protein, 10 aa, Influenza virus
GWSSTSCHDG

SEQ ID NO: 499603 - protein, 10 aa, Influenza virus
GWSSTTCHDG

SEQ ID NO: 499604 - protein, 10 aa, Influenza virus
GWSWDDGAIL

SEQ ID NO: 499605 - protein, 10 aa, Influenza virus
GWSWGDGAIL

SEQ ID NO: 499606 - protein, 10 aa, Influenza virus
GWSWPDGALL

SEQ ID NO: 499607 - protein, 10 aa, Influenza virus
GWSYIVERPS

SEQ ID NO: 499608 - protein, 10 aa, Influenza virus
GWTGLIDGWY

SEQ ID NO: 499609 - protein, 10 aa, Influenza virus
GWTGMIDGWY

SEQ ID NO: 499610 - protein, 10 aa, Influenza virus
GWTGMVDGWY

SEQ ID NO: 499611 - protein, 10 aa, Influenza virus
GWTGMVNGWY

SEQ ID NO: 499612 - protein, 10 aa, Influenza virus
GWTIANSKSQ

SEQ ID NO: 499613 - protein, 10 aa, Influenza virus
GWTSNSIVVF

SEQ ID NO: 499614 - protein, 10 aa, Influenza virus
GWTTANSKSK

SEQ ID NO: 499615 - protein, 10 aa, Influenza virus
GWTTANSKSQ

SEQ ID NO: 499616 - protein, 10 aa, Influenza virus
GWVAVAKDNA

SEQ ID NO: 499617 - protein, 10 aa, Influenza virus
GWVSTDKDSN

SEQ ID NO: 499618 - protein, 10 aa, Influenza virus
GWVSTDKNSN

SEQ ID NO: 499619 - protein, 10 aa, Influenza virus
GWVSTDKSSN

SEQ ID NO: 499620 - protein, 10 aa, Influenza virus
GWVVIAKDNA

SEQ ID NO: 499621 - protein, 10 aa, Influenza virus
GWVVIAQDNA

SEQ ID NO: 499622 - protein, 10 aa, Influenza virus
GWVVIEKDNA

SEQ ID NO: 499623 - protein, 10 aa, Influenza virus
GWVVVAKDNA

SEQ ID NO: 499624 - protein, 10 aa, Influenza virus
GWYGFHHSNA

SEQ ID NO: 499625 - protein, 10 aa, Influenza virus
GWYGFHHSNE

SEQ ID NO: 499626 - protein, 10 aa, Influenza virus
GWYGFHHSNS

SEQ ID NO: 499627 - protein, 10 aa, Influenza virus
GWYGFKHQNA

SEQ ID NO: 499628 - protein, 10 aa, Influenza virus
GWYGFQHQNA

SEQ ID NO: 499629 - protein, 10 aa, Influenza virus
GWYGFQHQNE

SEQ ID NO: 499630 - protein, 10 aa, Influenza virus
GWYGFQHQNS

SEQ ID NO: 499631 - protein, 10 aa, Influenza virus
GWYGFQHRND

SEQ ID NO: 499632 - protein, 10 aa, Influenza virus
GWYGFQHRNE

SEQ ID NO: 499633 - protein, 10 aa, Influenza virus
GWYGFQHSNA

SEQ ID NO: 499634 - protein, 10 aa, Influenza virus
GWYGFQHSND

SEQ ID NO: 499635 - protein, 10 aa, Influenza virus
GWYGFQHSNE

SEQ ID NO: 499636 - protein, 10 aa, Influenza virus
GWYGFQHTND

SEQ ID NO: 499637 - protein, 10 aa, Influenza virus
GWYGFRHHNS

SEQ ID NO: 499638 - protein, 10 aa, Influenza virus
GWYGFRHLNS

SEQ ID NO: 499639 - protein, 10 aa, Influenza virus
GWYGFRHQKA

SEQ ID NO: 499640 - protein, 10 aa, Influenza virus
GWYGFRHQNA

SEQ ID NO: 499641 - protein, 10 aa, Influenza virus
GWYGFRHQNS

SEQ ID NO: 499642 - protein, 10 aa, Influenza virus
GWYGFRHQNT

SEQ ID NO: 499643 - protein, 10 aa, Influenza virus
GWYGFRYQNS

SEQ ID NO: 499644 - protein, 10 aa, Influenza virus
GWYGYHHENS

SEQ ID NO: 499645 - protein, 10 aa, Influenza virus
GWYGYHHNNE

SEQ ID NO: 499646 - protein, 10 aa, Influenza virus
GWYGYHHQNE

SEQ ID NO: 499647 - protein, 10 aa, Influenza virus
GWYGYHHQNG

SEQ ID NO: 499648 - protein, 10 aa, Influenza virus
GWYGYHHSKE

SEQ ID NO: 499649 - protein, 10 aa, Influenza virus
GWYGYHHSND

SEQ ID NO: 499650 - protein, 10 aa, Influenza virus
GWYGYHHSNE

SEQ ID NO: 499651 - protein, 10 aa, Influenza virus
GWYGYHHSNG

SEQ ID NO: 499652 - protein, 10 aa, Influenza virus
GWYGYKHQNA

SEQ ID NO: 499653 - protein, 10 aa, Influenza virus
GWYGYRHQNA

SEQ ID NO: 499654 - protein, 10 aa, Influenza virus
GYAADKASTQ

SEQ ID NO: 499655 - protein, 10 aa, Influenza virus
GYAADKESTQ

SEQ ID NO: 499656 - protein, 10 aa, Influenza virus
GYAADKKSTQ

SEQ ID NO: 499657 - protein, 10 aa, Influenza virus
GYAADLKSTQ

SEQ ID NO: 499658 - protein, 10 aa, Influenza virus
GYAADQESTQ

SEQ ID NO: 499659 - protein, 10 aa, Influenza virus
GYAADQKSTQ

SEQ ID NO: 499660 - protein, 10 aa, Influenza virus
GYAADRESTQ

SEQ ID NO: 499661 - protein, 10 aa, Influenza virus
GYAADRKSTQ

SEQ ID NO: 499662 - protein, 10 aa, Influenza virus
GYAEGQESPP

SEQ ID NO: 499663 - protein, 10 aa, Influenza virus
GYAQTDCVLE

SEQ ID NO: 499664 - protein, 10 aa, Influenza virus
GYCFTVMTDG

SEQ ID NO: 499665 - protein, 10 aa, Influenza virus
GYDFEKEGYS

SEQ ID NO: 499666 - protein, 10 aa, Influenza virus
GYDFEREGYS

SEQ ID NO: 499667 - protein, 10 aa, Influenza virus
GYEILKVPNA

SEQ ID NO: 499668 - protein, 10 aa, Influenza virus
GYEMLKVPDA

SEQ ID NO: 499669 - protein, 10 aa, Influenza virus
GYEMLKVPNA

SEQ ID NO: 499670 - protein, 10 aa, Influenza virus
GYETFKVIGG

SEQ ID NO: 499671 - protein, 10 aa, Influenza virus
GYETFRVIDG

SEQ ID NO: 499672 - protein, 10 aa, Influenza virus
GYETFRVIGG

SEQ ID NO: 499673 - protein, 10 aa, Influenza virus
GYETFRVISG

SEQ ID NO: 499674 - protein, 10 aa, Influenza virus
GYEVLKVPDA

SEQ ID NO: 499675 - protein, 10 aa, Influenza virus
GYEVLKVPNA

SEQ ID NO: 499676 - protein, 10 aa, Influenza virus
GYGVKGFGFR

SEQ ID NO: 499677 - protein, 10 aa, Influenza virus
GYHANNSKKQ

SEQ ID NO: 499678 - protein, 10 aa, Influenza virus
GYHANNSTDT

SEQ ID NO: 499679 - protein, 10 aa, Influenza virus
GYHANNSTEH

SEQ ID NO: 499680 - protein, 10 aa, Influenza virus
GYHANNSTEK

SEQ ID NO: 499681 - protein, 10 aa, Influenza virus
GYHANNSTEQ

SEQ ID NO: 499682 - protein, 10 aa, Influenza virus
GYHANNSTER

SEQ ID NO: 499683 - protein, 10 aa, Influenza virus
GYHANNSTET

SEQ ID NO: 499684 - protein, 10 aa, Influenza virus
GYHANNSTKQ

SEQ ID NO: 499685 - protein, 10 aa, Influenza virus
GYHANNSTTK

SEQ ID NO: 499686 - protein, 10 aa, Influenza virus
GYHANNSTTQ

SEQ ID NO: 499687 - protein, 10 aa, Influenza virus
GYHANNSTVQ

SEQ ID NO: 499688 - protein, 10 aa, Influenza virus
GYHFEECSCY

SEQ ID NO: 499689 - protein, 10 aa, Influenza virus
GYHHENSQGS

SEQ ID NO: 499690 - protein, 10 aa, Influenza virus
GYHHQNAQGS

SEQ ID NO: 499691 - protein, 10 aa, Influenza virus
GYHHQNEQGS

SEQ ID NO: 499692 - protein, 10 aa, Influenza virus
GYHHQNGQGS

SEQ ID NO: 499693 - protein, 10 aa, Influenza virus
GYHHSNDQGA

SEQ ID NO: 499694 - protein, 10 aa, Influenza virus
GYHHSNDQGS

SEQ ID NO: 499695 - protein, 10 aa, Influenza virus
GYHSNNSTEK

SEQ ID NO: 499696 - protein, 10 aa, Influenza virus
GYHSNNSTKK

SEQ ID NO: 499697 - protein, 10 aa, Influenza virus
GYICSGFFGD

SEQ ID NO: 499698 - protein, 10 aa, Influenza virus
GYICSGIFGD

SEQ ID NO: 499699 - protein, 10 aa, Influenza virus
GYICSGVFGD

SEQ ID NO: 499700 - protein, 10 aa, Influenza virus
GYICSKFHSD

SEQ ID NO: 499701 - protein, 10 aa, Influenza virus
GYIEGKLSQM

SEQ ID NO: 499702 - protein, 10 aa, Influenza virus
GYIIEEYGKG

SEQ ID NO: 499703 - protein, 10 aa, Influenza virus
GYIIEEYGRG

SEQ ID NO: 499704 - protein, 10 aa, Influenza virus
GYIIEKYGSG

SEQ ID NO: 499705 - protein, 10 aa, Influenza virus
GYIIEKYGTG

SEQ ID NO: 499706 - protein, 10 aa, Influenza virus
GYKDIILWFS

SEQ ID NO: 499707 - protein, 10 aa, Influenza virus
GYKDIILWIS

SEQ ID NO: 499708 - protein, 10 aa, Influenza virus
GYKDIILWVS

SEQ ID NO: 499709 - protein, 10 aa, Influenza virus
GYKDVIIWFS

SEQ ID NO: 499710 - protein, 10 aa, Influenza virus
GYKDVILWFS

SEQ ID NO: 499711 - protein, 10 aa, Influenza virus
GYKDWFLWIS

SEQ ID NO: 499712 - protein, 10 aa, Influenza virus
GYKDWILWIS

SEQ ID NO: 499713 - protein, 10 aa, Influenza virus
GYKDWVLWIS

SEQ ID NO: 499714 - protein, 10 aa, Influenza virus
GYKEVILWFS

SEQ ID NO: 499715 - protein, 10 aa, Influenza virus
GYKHQNAQGE

SEQ ID NO: 499716 - protein, 10 aa, Influenza virus
GYKMNIQILI

SEQ ID NO: 499717 - protein, 10 aa, Influenza virus
GYKMNNQILI

SEQ ID NO: 499718 - protein, 10 aa, Influenza virus
GYKMNTKILV

SEQ ID NO: 499719 - protein, 10 aa, Influenza virus
GYKMNTQILI

SEQ ID NO: 499720 - protein, 10 aa, Influenza virus
GYKMNTQILV

SEQ ID NO: 499721 - protein, 10 aa, Influenza virus
GYKMNTRILI

SEQ ID NO: 499722 - protein, 10 aa, Influenza virus
GYKNWILWIS

SEQ ID NO: 499723 - protein, 10 aa, Influenza virus
GYLCAGIPSD

SEQ ID NO: 499724 - protein, 10 aa, Influenza virus
GYLCAGIPTD

SEQ ID NO: 499725 - protein, 10 aa, Influenza virus
GYLCAGLPSD

SEQ ID NO: 499726 - protein, 10 aa, Influenza virus
GYLIRALTLN

SEQ ID NO: 499727 - protein, 10 aa, Influenza virus
GYLITGKSHG

SEQ ID NO: 499728 - protein, 10 aa, Influenza virus
GYLLKGESHC

SEQ ID NO: 499729 - protein, 10 aa, Influenza virus
GYLLKGESHG

SEQ ID NO: 499730 - protein, 10 aa, Influenza virus
GYLLKGESYG

SEQ ID NO: 499731 - protein, 10 aa, Influenza virus
GYLLLNKSLC

SEQ ID NO: 499732 - protein, 10 aa, Influenza virus
GYLLRGESHG

SEQ ID NO: 499733 - protein, 10 aa, Influenza virus
GYLSNNATDT

SEQ ID NO: 499734 - protein, 10 aa, Influenza virus
GYLSNNSSDT

SEQ ID NO: 499735 - protein, 10 aa, Influenza virus
GYLSNNSTDK

SEQ ID NO: 499736 - protein, 10 aa, Influenza virus
GYLSNNSTDT

SEQ ID NO: 499737 - protein, 10 aa, Influenza virus
GYLSNNSTEK

SEQ ID NO: 499738 - protein, 10 aa, Influenza virus
GYLSNNSTER

SEQ ID NO: 499739 - protein, 10 aa, Influenza virus
GYLSTNSSDK

SEQ ID NO: 499740 - protein, 10 aa, Influenza virus
GYLSTNSSEK

SEQ ID NO: 499741 - protein, 10 aa, Influenza virus
GYLSTNSSER

SEQ ID NO: 499742 - protein, 10 aa, Influenza virus
GYLSTNSTEK

SEQ ID NO: 499743 - protein, 10 aa, Influenza virus
GYMSNNSTEK

SEQ ID NO: 499744 - protein, 10 aa, Influenza virus
GYNFEKEGYS

SEQ ID NO: 499745 - protein, 10 aa, Influenza virus
GYNGQKSWMK

SEQ ID NO: 499746 - protein, 10 aa, Influenza virus
GYNGQKSWTK

SEQ ID NO: 499747 - protein, 10 aa, Influenza virus
GYNGQRSWMK

SEQ ID NO: 499748 - protein, 10 aa, Influenza virus
GYPGVKGWAF

SEQ ID NO: 499749 - protein, 10 aa, Influenza virus
GYQSLRSILA

SEQ ID NO: 499750 - protein, 10 aa, Influenza virus
GYQSNNSTDT

SEQ ID NO: 499751 - protein, 10 aa, Influenza virus
GYQSNNSTNT

SEQ ID NO: 499752 - protein, 10 aa, Influenza virus
GYQTNNSTDT

SEQ ID NO: 499753 - protein, 10 aa, Influenza virus
GYQTNNSTET

SEQ ID NO: 499754 - protein, 10 aa, Influenza virus
GYRHQNAQGE

SEQ ID NO: 499755 - protein, 10 aa, Influenza virus
GYSGAFIDYW

SEQ ID NO: 499756 - protein, 10 aa, Influenza virus
GYSGAFMDYW

SEQ ID NO: 499757 - protein, 10 aa, Influenza virus
GYSGAFTIPI

SEQ ID NO: 499758 - protein, 10 aa, Influenza virus
GYSGAFTIPT

SEQ ID NO: 499759 - protein, 10 aa, Influenza virus
GYSGAFTIPV

SEQ ID NO: 499760 - protein, 10 aa, Influenza virus
GYSGAFTVPI

SEQ ID NO: 499761 - protein, 10 aa, Influenza virus
GYSGAFVDYW

SEQ ID NO: 499762 - protein, 10 aa, Influenza virus
GYSGIFSVEG

SEQ ID NO: 499763 - protein, 10 aa, Influenza virus
GYSGIFSVEH

SEQ ID NO: 499764 - protein, 10 aa, Influenza virus
GYSGIFSVEN

SEQ ID NO: 499765 - protein, 10 aa, Influenza virus
GYSGIFSVES

SEQ ID NO: 499766 - protein, 10 aa, Influenza virus
GYSGSFIDYW

SEQ ID NO: 499767 - protein, 10 aa, Influenza virus
GYSGSFIQHP

SEQ ID NO: 499768 - protein, 10 aa, Influenza virus
GYSGSFMDYW

SEQ ID NO: 499769 - protein, 10 aa, Influenza virus
GYSGSFSIRG

SEQ ID NO: 499770 - protein, 10 aa, Influenza virus
GYSGSFSIRW

SEQ ID NO: 499771 - protein, 10 aa, Influenza virus
GYSGSFTIPT

SEQ ID NO: 499772 - protein, 10 aa, Influenza virus
GYSGSFTLPI

SEQ ID NO: 499773 - protein, 10 aa, Influenza virus
GYSGSFTLPV

SEQ ID NO: 499774 - protein, 10 aa, Influenza virus
GYSGSFVDYW

SEQ ID NO: 499775 - protein, 10 aa, Influenza virus
GYSGSFVQHP

SEQ ID NO: 499776 - protein, 10 aa, Influenza virus
GYSGVFSVEG

SEQ ID NO: 499777 - protein, 10 aa, Influenza virus
GYSLVGIDPF

SEQ ID NO: 499778 - protein, 10 aa, Influenza virus
GYSLVGVDPF

SEQ ID NO: 499779 - protein, 10 aa, Influenza virus
GYSTGALASC

SEQ ID NO: 499780 - protein, 10 aa, Influenza virus
GYTMDTVNRT

SEQ ID NO: 499781 - protein, 10 aa, Influenza virus
GYTMDTVSRT

SEQ ID NO: 499782 - protein, 10 aa, Influenza virus
GYVCGKFHSD

SEQ ID NO: 499783 - protein, 10 aa, Influenza virus
GYVCSGIFGD

SEQ ID NO: 499784 - protein, 10 aa, Influenza virus
GYVCSGLVGD

SEQ ID NO: 499785 - protein, 10 aa, Influenza virus
GYVCSGVFGD

SEQ ID NO: 499786 - protein, 10 aa, Influenza virus
GYVCSKFHSD

SEQ ID NO: 499787 - protein, 10 aa, Influenza virus
GYWAIRTRSG

SEQ ID NO: 499788 - protein, 10 aa, Influenza virus
HAKDILEKAH

SEQ ID NO: 499789 - protein, 10 aa, Influenza virus
HAKDILEKTH

SEQ ID NO: 499790 - protein, 10 aa, Influenza virus
HAKNILEKTH

SEQ ID NO: 499791 - protein, 10 aa, Influenza virus
HALKLVVAML

SEQ ID NO: 499792 - protein, 10 aa, Influenza virus
HALRELWQCY

SEQ ID NO: 499793 - protein, 10 aa, Influenza virus
HANGTIHDRS

SEQ ID NO: 499794 - protein, 10 aa, Influenza virus
HANGTINDRS

SEQ ID NO: 499795 - protein, 10 aa, Influenza virus
HANGTMHDRS

SEQ ID NO: 499796 - protein, 10 aa, Influenza virus
HANNSKKQID

SEQ ID NO: 499797 - protein, 10 aa, Influenza virus
HANNSTDTID

SEQ ID NO: 499798 - protein, 10 aa, Influenza virus
HANNSTDTVD

SEQ ID NO: 499799 - protein, 10 aa, Influenza virus
HANNSTEHVD

SEQ ID NO: 499800 - protein, 10 aa, Influenza virus
HANNSTEQVD

SEQ ID NO: 499801 - protein, 10 aa, Influenza virus
HANNSTERVD

SEQ ID NO: 499802 - protein, 10 aa, Influenza virus
HANNSTETVD

SEQ ID NO: 499803 - protein, 10 aa, Influenza virus
HANNSTKQID

SEQ ID NO: 499804 - protein, 10 aa, Influenza virus
HANNSTKQVD

SEQ ID NO: 499805 - protein, 10 aa, Influenza virus
HANNSTTKVD

SEQ ID NO: 499806 - protein, 10 aa, Influenza virus
HANNSTTQID

SEQ ID NO: 499807 - protein, 10 aa, Influenza virus
HANNSTTQVD

SEQ ID NO: 499808 - protein, 10 aa, Influenza virus
HANNSTTQVN

SEQ ID NO: 499809 - protein, 10 aa, Influenza virus
HANNSTVQVD

SEQ ID NO: 499810 - protein, 10 aa, Influenza virus
HAQDILEKTH

SEQ ID NO: 499811 - protein, 10 aa, Influenza virus
HAQNILEKTH

SEQ ID NO: 499812 - protein, 10 aa, Influenza virus
HAQYREEALL

SEQ ID NO: 499813 - protein, 10 aa, Influenza virus
HASNRPWISF

SEQ ID NO: 499814 - protein, 10 aa, Influenza virus
HASNRPWVSF

SEQ ID NO: 499815 - protein, 10 aa, Influenza virus
HAVANGTKVN

SEQ ID NO: 499816 - protein, 10 aa, Influenza virus
HAVENGTSVK

SEQ ID NO: 499817 - protein, 10 aa, Influenza virus
HAVPNGTIVK

SEQ ID NO: 499818 - protein, 10 aa, Influenza virus
HAVPNGTIVR

SEQ ID NO: 499819 - protein, 10 aa, Influenza virus
HAVPNGTKVN

SEQ ID NO: 499820 - protein, 10 aa, Influenza virus
HAVPNGTLVK

SEQ ID NO: 499821 - protein, 10 aa, Influenza virus
HAVPNGTMVK

SEQ ID NO: 499822 - protein, 10 aa, Influenza virus
HAVPNGTVVK

SEQ ID NO: 499823 - protein, 10 aa, Influenza virus
HAVSNGTKIN

SEQ ID NO: 499824 - protein, 10 aa, Influenza virus
HAVSNGTKVN

SEQ ID NO: 499825 - protein, 10 aa, Influenza virus
HCINRCFYVE

SEQ ID NO: 499826 - protein, 10 aa, Influenza virus
HCMESIRNNT

SEQ ID NO: 499827 - protein, 10 aa, Influenza virus
HCRATEYIMK

SEQ ID NO: 499828 - protein, 10 aa, Influenza virus
HCRATEYMMK

SEQ ID NO: 499829 - protein, 10 aa, Influenza virus
HCRIIQNEDI

SEQ ID NO: 499830 - protein, 10 aa, Influenza virus
HCSKYHWNLA

SEQ ID NO: 499831 - protein, 10 aa, Influenza virus
HCWSFALAQG

SEQ ID NO: 499832 - protein, 10 aa, Influenza virus
HCYPGATINE

SEQ ID NO: 499833 - protein, 10 aa, Influenza virus
HDANVKNLHD

SEQ ID NO: 499834 - protein, 10 aa, Influenza virus
HDANVKNLHE

SEQ ID NO: 499835 - protein, 10 aa, Influenza virus
HDANVRNLHD

SEQ ID NO: 499836 - protein, 10 aa, Influenza virus
HDANVRNLHE

SEQ ID NO: 499837 - protein, 10 aa, Influenza virus
HDFEREGYSL

SEQ ID NO: 499838 - protein, 10 aa, Influenza virus
HDGAEIIYFE

SEQ ID NO: 499839 - protein, 10 aa, Influenza virus
HDGAEIIYFK

SEQ ID NO: 499840 - protein, 10 aa, Influenza virus
HDGAEITYFK

SEQ ID NO: 499841 - protein, 10 aa, Influenza virus
HDGIARMTIC

SEQ ID NO: 499842 - protein, 10 aa, Influenza virus
HDGIGRMTIC

SEQ ID NO: 499843 - protein, 10 aa, Influenza virus
HDGKAWLHIC

SEQ ID NO: 499844 - protein, 10 aa, Influenza virus
HDGKAWLHVC

SEQ ID NO: 499845 - protein, 10 aa, Influenza virus
HDGKSWLHVC

SEQ ID NO: 499846 - protein, 10 aa, Influenza virus
HDGNAWLHVC

SEQ ID NO: 499847 - protein, 10 aa, Influenza virus
HDGRAWLHIC

SEQ ID NO: 499848 - protein, 10 aa, Influenza virus
HDGRAWLHVC

SEQ ID NO: 499849 - protein, 10 aa, Influenza virus
HDGVGRMTIC

SEQ ID NO: 499850 - protein, 10 aa, Influenza virus
HDGVNRMTIC

SEQ ID NO: 499851 - protein, 10 aa, Influenza virus
HDGVSRMTIC

SEQ ID NO: 499852 - protein, 10 aa, Influenza virus
HDRAAFRGLI

SEQ ID NO: 499853 - protein, 10 aa, Influenza virus
HDRICIGYQS

SEQ ID NO: 499854 - protein, 10 aa, Influenza virus
HDRIPHRTLL

SEQ ID NO: 499855 - protein, 10 aa, Influenza virus
HDRISHRTLL

SEQ ID NO: 499856 - protein, 10 aa, Influenza virus
HDRSPFRALI

SEQ ID NO: 499857 - protein, 10 aa, Influenza virus
HDRSPFRALV

SEQ ID NO: 499858 - protein, 10 aa, Influenza virus
HDRSPHRTLL

SEQ ID NO: 499859 - protein, 10 aa, Influenza virus
HDRSPYRALI

SEQ ID NO: 499860 - protein, 10 aa, Influenza virus
HDRSQFRALI

SEQ ID NO: 499861 - protein, 10 aa, Influenza virus
HDRSQYRALI

SEQ ID NO: 499862 - protein, 10 aa, Influenza virus
HDRSQYRALV

SEQ ID NO: 499863 - protein, 10 aa, Influenza virus
HDRSQYRSLI

SEQ ID NO: 499864 - protein, 10 aa, Influenza virus
HDRTAFRGLI

SEQ ID NO: 499865 - protein, 10 aa, Influenza virus
HDRTAFRGLM

SEQ ID NO: 499866 - protein, 10 aa, Influenza virus
HDRTPHRTLL

SEQ ID NO: 499867 - protein, 10 aa, Influenza virus
HDRTSHRTLL

SEQ ID NO: 499868 - protein, 10 aa, Influenza virus
HDRTTFRGLI

SEQ ID NO: 499869 - protein, 10 aa, Influenza virus
HDRTTFRGLL

SEQ ID NO: 499870 - protein, 10 aa, Influenza virus
HDSNVENLFD

SEQ ID NO: 499871 - protein, 10 aa, Influenza virus
HDSNVKNLFD

SEQ ID NO: 499872 - protein, 10 aa, Influenza virus
HDSNVKNLHE

SEQ ID NO: 499873 - protein, 10 aa, Influenza virus
HDSNVKNLYD

SEQ ID NO: 499874 - protein, 10 aa, Influenza virus
HDSNVKNLYE

SEQ ID NO: 499875 - protein, 10 aa, Influenza virus
HDSNVKNLYN

SEQ ID NO: 499876 - protein, 10 aa, Influenza virus
HDSNVKSLYD

SEQ ID NO: 499877 - protein, 10 aa, Influenza virus
HDSNVRNLHE

SEQ ID NO: 499878 - protein, 10 aa, Influenza virus
HDSNVRNLYD

SEQ ID NO: 499879 - protein, 10 aa, Influenza virus
HDSNVRSLHE

SEQ ID NO: 499880 - protein, 10 aa, Influenza virus
HECRTFFLTQ

SEQ ID NO: 499881 - protein, 10 aa, Influenza virus
HEDYKEESQL

SEQ ID NO: 499882 - protein, 10 aa, Influenza virus
HEDYREESQL

SEQ ID NO: 499883 - protein, 10 aa, Influenza virus
HEEVTNATET

SEQ ID NO: 499884 - protein, 10 aa, Influenza virus
HEFSNLEKRI

SEQ ID NO: 499885 - protein, 10 aa, Influenza virus
HEFSNLERRI

SEQ ID NO: 499886 - protein, 10 aa, Influenza virus
HEFSNLERRV

SEQ ID NO: 499887 - protein, 10 aa, Influenza virus
HEFSSLERRI

SEQ ID NO: 499888 - protein, 10 aa, Influenza virus
HEGEGIPLHD

SEQ ID NO: 499889 - protein, 10 aa, Influenza virus
HEGEGIPLYD

SEQ ID NO: 499890 - protein, 10 aa, Influenza virus
HENRMVIAST

SEQ ID NO: 499891 - protein, 10 aa, Influenza virus
HENRMVLAST

SEQ ID NO: 499892 - protein, 10 aa, Influenza virus
HENSQGSGYA

SEQ ID NO: 499893 - protein, 10 aa, Influenza virus
HEQMETGGER

SEQ ID NO: 499894 - protein, 10 aa, Influenza virus
HFEECSCYPS

SEQ ID NO: 499895 - protein, 10 aa, Influenza virus
HFEKIKILPR

SEQ ID NO: 499896 - protein, 10 aa, Influenza virus
HFEKVKILAR

SEQ ID NO: 499897 - protein, 10 aa, Influenza virus
HFEKVKILPK

SEQ ID NO: 499898 - protein, 10 aa, Influenza virus
HFEKVKILPR

SEQ ID NO: 499899 - protein, 10 aa, Influenza virus
HFEKVRILPK

SEQ ID NO: 499900 - protein, 10 aa, Influenza virus
HFESNGNFIA

SEQ ID NO: 499901 - protein, 10 aa, Influenza virus
HFHRKRRVRD

SEQ ID NO: 499902 - protein, 10 aa, Influenza virus
HFQNQVKIRR

SEQ ID NO: 499903 - protein, 10 aa, Influenza virus
HFQRKRRIRD

SEQ ID NO: 499904 - protein, 10 aa, Influenza virus
HFQRKRRVRD

SEQ ID NO: 499905 - protein, 10 aa, Influenza virus
HFRNQIKIRR

SEQ ID NO: 499906 - protein, 10 aa, Influenza virus
HFRNQVKIRR

SEQ ID NO: 499907 - protein, 10 aa, Influenza virus
HFRSQVKIRR

SEQ ID NO: 499908 - protein, 10 aa, Influenza virus
HGALLNDKHS

SEQ ID NO: 499909 - protein, 10 aa, Influenza virus
HGANRPWVSF

SEQ ID NO: 499910 - protein, 10 aa, Influenza virus
HGICAVATTH

SEQ ID NO: 499911 - protein, 10 aa, Influenza virus
HGKIIQNEDI

SEQ ID NO: 499912 - protein, 10 aa, Influenza virus
HGLCYPGELD

SEQ ID NO: 499913 - protein, 10 aa, Influenza virus
HGLCYPGELN

SEQ ID NO: 499914 - protein, 10 aa, Influenza virus
HGRIIQNEDI

SEQ ID NO: 499915 - protein, 10 aa, Influenza virus
HGRILKNDLP

SEQ ID NO: 499916 - protein, 10 aa, Influenza virus
HGRILKNNLP

SEQ ID NO: 499917 - protein, 10 aa, Influenza virus
HGRTIQNEDI

SEQ ID NO: 499918 - protein, 10 aa, Influenza virus
HGRVLKNNLP

SEQ ID NO: 499919 - protein, 10 aa, Influenza virus
HGSLLNDKHS

SEQ ID NO: 499920 - protein, 10 aa, Influenza virus
HGSLQCRICI

SEQ ID NO: 499921 - protein, 10 aa, Influenza virus
HGSLVLSLWM

SEQ ID NO: 499922 - protein, 10 aa, Influenza virus
HGSNRPWISF

SEQ ID NO: 499923 - protein, 10 aa, Influenza virus
HGSNRPWLSF

SEQ ID NO: 499924 - protein, 10 aa, Influenza virus
HGSNRPWVSF

SEQ ID NO: 499925 - protein, 10 aa, Influenza virus
HGTGTGYTMD

SEQ ID NO: 499926 - protein, 10 aa, Influenza virus
HGVKGWAFDD

SEQ ID NO: 499927 - protein, 10 aa, Influenza virus
HHANNSTEQV

SEQ ID NO: 499928 - protein, 10 aa, Influenza virus
HHAVANGTKV

SEQ ID NO: 499929 - protein, 10 aa, Influenza virus
HHAVANGTRV

SEQ ID NO: 499930 - protein, 10 aa, Influenza virus
HHAVENGTSV

SEQ ID NO: 499931 - protein, 10 aa, Influenza virus
HHAVPNGTIV

SEQ ID NO: 499932 - protein, 10 aa, Influenza virus
HHAVPNGTKV

SEQ ID NO: 499933 - protein, 10 aa, Influenza virus
HHAVPNGTLV

SEQ ID NO: 499934 - protein, 10 aa, Influenza virus
HHAVPNGTVV

SEQ ID NO: 499935 - protein, 10 aa, Influenza virus
HHAVSNGTKV

SEQ ID NO: 499936 - protein, 10 aa, Influenza virus
HHAVTNGTKV

SEQ ID NO: 499937 - protein, 10 aa, Influenza virus
HHENSQGSGY

SEQ ID NO: 499938 - protein, 10 aa, Influenza virus
HHMRKKRGLF

SEQ ID NO: 499939 - protein, 10 aa, Influenza virus
HHPPDAKEQT

SEQ ID NO: 499940 - protein, 10 aa, Influenza virus
HHPPDETEQT

SEQ ID NO: 499941 - protein, 10 aa, Influenza virus
HHPPDTKEQT

SEQ ID NO: 499942 - protein, 10 aa, Influenza virus
HHPPNTKEQT

SEQ ID NO: 499943 - protein, 10 aa, Influenza virus
HHPPTSAEQV

SEQ ID NO: 499944 - protein, 10 aa, Influenza virus
HHPPTSDEQI

SEQ ID NO: 499945 - protein, 10 aa, Influenza virus
HHPPTSDEQV

SEQ ID NO: 499946 - protein, 10 aa, Influenza virus
HHPPTSNEQV

SEQ ID NO: 499947 - protein, 10 aa, Influenza virus
HHPPTTDEQM

SEQ ID NO: 499948 - protein, 10 aa, Influenza virus
HHPSSAQEKN

SEQ ID NO: 499949 - protein, 10 aa, Influenza virus
HHPSSDNEQT

SEQ ID NO: 499950 - protein, 10 aa, Influenza virus
HHPSSTKEKN

SEQ ID NO: 499951 - protein, 10 aa, Influenza virus
HHPSSTQEKN

SEQ ID NO: 499952 - protein, 10 aa, Influenza virus
HHQNAQGSGY

SEQ ID NO: 499953 - protein, 10 aa, Influenza virus
HHQNEQGSGY

SEQ ID NO: 499954 - protein, 10 aa, Influenza virus
HHQNGQGSGY

SEQ ID NO: 499955 - protein, 10 aa, Influenza virus
HHRVYWIREG

SEQ ID NO: 499956 - protein, 10 aa, Influenza virus
HHSNAEGTGM

SEQ ID NO: 499957 - protein, 10 aa, Influenza virus
HHSNDQGAGY

SEQ ID NO: 499958 - protein, 10 aa, Influenza virus
HHSNDQGSGY

SEQ ID NO: 499959 - protein, 10 aa, Influenza virus
HHSNSEGTGM

SEQ ID NO: 499960 - protein, 10 aa, Influenza virus
HHSSSLDEQN

SEQ ID NO: 499961 - protein, 10 aa, Influenza virus
HIAILVTTVT

SEQ ID NO: 499962 - protein, 10 aa, Influenza virus
HICIGYHANN

SEQ ID NO: 499963 - protein, 10 aa, Influenza virus
HICVTGDDRN

SEQ ID NO: 499964 - protein, 10 aa, Influenza virus
HIEECPCYGH

SEQ ID NO: 499965 - protein, 10 aa, Influenza virus
HIEECSCYGA

SEQ ID NO: 499966 - protein, 10 aa, Influenza virus
HIEECSCYGE

SEQ ID NO: 499967 - protein, 10 aa, Influenza virus
HIEECSCYGH

SEQ ID NO: 499968 - protein, 10 aa, Influenza virus
HIEECSCYGK

SEQ ID NO: 499969 - protein, 10 aa, Influenza virus
HIEECSCYGS

SEQ ID NO: 499970 - protein, 10 aa, Influenza virus
HIEECSCYGV

SEQ ID NO: 499971 - protein, 10 aa, Influenza virus
HIEECSCYPN

SEQ ID NO: 499972 - protein, 10 aa, Influenza virus
HIEECSCYPQ

SEQ ID NO: 499973 - protein, 10 aa, Influenza virus
HIEECSCYPR

SEQ ID NO: 499974 - protein, 10 aa, Influenza virus
HIEECSCYSR

SEQ ID NO: 499975 - protein, 10 aa, Influenza virus
HIEEWSCYGH

SEQ ID NO: 499976 - protein, 10 aa, Influenza virus
HIEVTNATEL

SEQ ID NO: 499977 - protein, 10 aa, Influenza virus
HIFGKDNAIR

SEQ ID NO: 499978 - protein, 10 aa, Influenza virus
HIFGKDNAVR

SEQ ID NO: 499979 - protein, 10 aa, Influenza virus
HIFSFNGEEM

SEQ ID NO: 499980 - protein, 10 aa, Influenza virus
HIFSFTGEEM

SEQ ID NO: 499981 - protein, 10 aa, Influenza virus
HIFSKDNAIR

SEQ ID NO: 499982 - protein, 10 aa, Influenza virus
HIFVIREPFV

SEQ ID NO: 499983 - protein, 10 aa, Influenza virus
HIGPLSGSAQ

SEQ ID NO: 499984 - protein, 10 aa, Influenza virus
HIGVAPSPSN

SEQ ID NO: 499985 - protein, 10 aa, Influenza virus
HIHIFSFNGE

SEQ ID NO: 499986 - protein, 10 aa, Influenza virus
HIHIFSFTGE

SEQ ID NO: 499987 - protein, 10 aa, Influenza virus
HIIDLADSEM

SEQ ID NO: 499988 - protein, 10 aa, Influenza virus
HILSKDNAIR

SEQ ID NO: 499989 - protein, 10 aa, Influenza virus
HILSKDNAVR

SEQ ID NO: 499990 - protein, 10 aa, Influenza virus
HILVTREPYL

SEQ ID NO: 499991 - protein, 10 aa, Influenza virus
HIMIWHSNLN

SEQ ID NO: 499992 - protein, 10 aa, Influenza virus
HIPEAGLKWE

SEQ ID NO: 499993 - protein, 10 aa, Influenza virus
HIPEVCLKWD

SEQ ID NO: 499994 - protein, 10 aa, Influenza virus
HIPEVCLKWE

SEQ ID NO: 499995 - protein, 10 aa, Influenza virus
HIPEVCLKWG

SEQ ID NO: 499996 - protein, 10 aa, Influenza virus
HISPLAGSAQ

SEQ ID NO: 499997 - protein, 10 aa, Influenza virus
HISPLSGSAQ

SEQ ID NO: 499998 - protein, 10 aa, Influenza virus
HISVGTSTLN

SEQ ID NO: 499999 - protein, 10 aa, Influenza virus
HIVERILEEE

SEQ ID NO: 500000 - protein, 10 aa, Influenza virus
HIWVTREPYV

SEQ ID NO: 500001 - protein, 10 aa, Influenza virus
HIYGKDNAIR

SEQ ID NO: 500002 - protein, 10 aa, Influenza virus
HIYGKDNAVR

SEQ ID NO: 500003 - protein, 10 aa, Influenza virus
HKCDDDCMAS

SEQ ID NO: 500004 - protein, 10 aa, Influenza virus
HKCDDECMDS

SEQ ID NO: 500005 - protein, 10 aa, Influenza virus
HKCDDECMNS

SEQ ID NO: 500006 - protein, 10 aa, Influenza virus
HKCDDECMSS

SEQ ID NO: 500007 - protein, 10 aa, Influenza virus
HKCDDHCMES

SEQ ID NO: 500008 - protein, 10 aa, Influenza virus
HKCDDQCMES

SEQ ID NO: 500009 - protein, 10 aa, Influenza virus
HKCDNECMDS

SEQ ID NO: 500010 - protein, 10 aa, Influenza virus
HKCDNECMET

SEQ ID NO: 500011 - protein, 10 aa, Influenza virus
HKCDNKCMET

SEQ ID NO: 500012 - protein, 10 aa, Influenza virus
HKCDNQCMES

SEQ ID NO: 500013 - protein, 10 aa, Influenza virus
HKCNDECMNS

SEQ ID NO: 500014 - protein, 10 aa, Influenza virus
HKCNDSCMDT

SEQ ID NO: 500015 - protein, 10 aa, Influenza virus
HKCNDSCMEA

SEQ ID NO: 500016 - protein, 10 aa, Influenza virus
HKCNDSCMET

SEQ ID NO: 500017 - protein, 10 aa, Influenza virus
HKCNNECMET

SEQ ID NO: 500018 - protein, 10 aa, Influenza virus
HKCNNSCMET

SEQ ID NO: 500019 - protein, 10 aa, Influenza virus
HKCNNTCMET

SEQ ID NO: 500020 - protein, 10 aa, Influenza virus
HKDNAIRLGE

SEQ ID NO: 500021 - protein, 10 aa, Influenza virus
HKDNAIRPGE

SEQ ID NO: 500022 - protein, 10 aa, Influenza virus
HKDNALRLAE

SEQ ID NO: 500023 - protein, 10 aa, Influenza virus
HKDNAVRLGE

SEQ ID NO: 500024 - protein, 10 aa, Influenza virus
HKDYEEEAKL

SEQ ID NO: 500025 - protein, 10 aa, Influenza virus
HKEYEEEAKL

SEQ ID NO: 500026 - protein, 10 aa, Influenza virus
HKICIGYHAN

SEQ ID NO: 500027 - protein, 10 aa, Influenza virus
HKMESRGLFG

SEQ ID NO: 500028 - protein, 10 aa, Influenza virus
HKQLTHHMRK

SEQ ID NO: 500029 - protein, 10 aa, Influenza virus
HKSCLPACAY

SEQ ID NO: 500030 - protein, 10 aa, Influenza virus
HKSCLPACIY

SEQ ID NO: 500031 - protein, 10 aa, Influenza virus
HKSCLPACVY

SEQ ID NO: 500032 - protein, 10 aa, Influenza virus
HKSQLIWMAC

SEQ ID NO: 500033 - protein, 10 aa, Influenza virus
HKSQLVWMAC

SEQ ID NO: 500034 - protein, 10 aa, Influenza virus
HLAYCNTDLG

SEQ ID NO: 500035 - protein, 10 aa, Influenza virus
HLECRTFFLA

SEQ ID NO: 500036 - protein, 10 aa, Influenza virus
HLECRTFFLT

SEQ ID NO: 500037 - protein, 10 aa, Influenza virus
HLEECSCYMD

SEQ ID NO: 500038 - protein, 10 aa, Influenza virus
HLEECSCYTD

SEQ ID NO: 500039 - protein, 10 aa, Influenza virus
HLEECSCYVD

SEQ ID NO: 500040 - protein, 10 aa, Influenza virus
HLEFKADLII

SEQ ID NO: 500041 - protein, 10 aa, Influenza virus
HLEICFMYSD

SEQ ID NO: 500042 - protein, 10 aa, Influenza virus
HLEVCFMYSD

SEQ ID NO: 500043 - protein, 10 aa, Influenza virus
HLFSGIKSFS

SEQ ID NO: 500044 - protein, 10 aa, Influenza virus
HLFSGIRSFS

SEQ ID NO: 500045 - protein, 10 aa, Influenza virus
HLFSGVNSFS

SEQ ID NO: 500046 - protein, 10 aa, Influenza virus
HLGDCNFEGW

SEQ ID NO: 500047 - protein, 10 aa, Influenza virus
HLGDCRFEGW

SEQ ID NO: 500048 - protein, 10 aa, Influenza virus
HLGDCSFEGW

SEQ ID NO: 500049 - protein, 10 aa, Influenza virus
HLGTKQVCAA

SEQ ID NO: 500050 - protein, 10 aa, Influenza virus
HLGTKQVCIA

SEQ ID NO: 500051 - protein, 10 aa, Influenza virus
HLGTKQVCMA

SEQ ID NO: 500052 - protein, 10 aa, Influenza virus
HLGTKQVCVA

SEQ ID NO: 500053 - protein, 10 aa, Influenza virus
HLGTRQVCIA

SEQ ID NO: 500054 - protein, 10 aa, Influenza virus
HLGTRQVCMA

SEQ ID NO: 500055 - protein, 10 aa, Influenza virus
HLGTRQVCVA

SEQ ID NO: 500056 - protein, 10 aa, Influenza virus
HLIGKTNQQF

SEQ ID NO: 500057 - protein, 10 aa, Influenza virus
HLIIWGIHHP

SEQ ID NO: 500058 - protein, 10 aa, Influenza virus
HLIMWGIHHP

SEQ ID NO: 500059 - protein, 10 aa, Influenza virus
HLITGKSHGR

SEQ ID NO: 500060 - protein, 10 aa, Influenza virus
HLITWGIHHP

SEQ ID NO: 500061 - protein, 10 aa, Influenza virus
HLIVWGIHHP

SEQ ID NO: 500062 - protein, 10 aa, Influenza virus
HLKDQAWSYI

SEQ ID NO: 500063 - protein, 10 aa, Influenza virus
HLKDQDWSYI

SEQ ID NO: 500064 - protein, 10 aa, Influenza virus
HLKDQGWSYI

SEQ ID NO: 500065 - protein, 10 aa, Influenza virus
HLKDQSWSYI

SEQ ID NO: 500066 - protein, 10 aa, Influenza virus
HLKFKADLII

SEQ ID NO: 500067 - protein, 10 aa, Influenza virus
HLMIWHSNLN

SEQ ID NO: 500068 - protein, 10 aa, Influenza virus
HLRDQGWSYI

SEQ ID NO: 500069 - protein, 10 aa, Influenza virus
HLRNDTDVVN

SEQ ID NO: 500070 - protein, 10 aa, Influenza virus
HLSSVSSFER

SEQ ID NO: 500071 - protein, 10 aa, Influenza virus
HLTDSEMNKL

SEQ ID NO: 500072 - protein, 10 aa, Influenza virus
HLTGKWDTLI

SEQ ID NO: 500073 - protein, 10 aa, Influenza virus
HLTGMWDTLI

SEQ ID NO: 500074 - protein, 10 aa, Influenza virus
HLTGTWDTLI

SEQ ID NO: 500075 - protein, 10 aa, Influenza virus
HLTQGACWEQ

SEQ ID NO: 500076 - protein, 10 aa, Influenza virus
HLTQGTCWEQ

SEQ ID NO: 500077 - protein, 10 aa, Influenza virus
HLTTGKSHGR

SEQ ID NO: 500078 - protein, 10 aa, Influenza virus
HLVMWGIHHP

SEQ ID NO: 500079 - protein, 10 aa, Influenza virus
HLVTGKSHGR

SEQ ID NO: 500080 - protein, 10 aa, Influenza virus
HMAIIKKYTS

SEQ ID NO: 500081 - protein, 10 aa, Influenza virus
HMAIIKRYTS

SEQ ID NO: 500082 - protein, 10 aa, Influenza virus
HMECRTFFLT

SEQ ID NO: 500083 - protein, 10 aa, Influenza virus
HMEVCFMYSD

SEQ ID NO: 500084 - protein, 10 aa, Influenza virus
HMMIWHSNLN

SEQ ID NO: 500085 - protein, 10 aa, Influenza virus
HMRKKRGLFG

SEQ ID NO: 500086 - protein, 10 aa, Influenza virus
HNGGLIAPDR

SEQ ID NO: 500087 - protein, 10 aa, Influenza virus
HNGGLIAPNR

SEQ ID NO: 500088 - protein, 10 aa, Influenza virus
HNGGLIAPSR

SEQ ID NO: 500089 - protein, 10 aa, Influenza virus
HNGGLVAPSR

SEQ ID NO: 500090 - protein, 10 aa, Influenza virus
HNGGRIAPSR

SEQ ID NO: 500091 - protein, 10 aa, Influenza virus
HNGICPVAFT

SEQ ID NO: 500092 - protein, 10 aa, Influenza virus
HNGICPVVFT

SEQ ID NO: 500093 - protein, 10 aa, Influenza virus
HNGKLCKLNG

SEQ ID NO: 500094 - protein, 10 aa, Influenza virus
HNGKLCKLSG

SEQ ID NO: 500095 - protein, 10 aa, Influenza virus
HNGKLCRLNG

SEQ ID NO: 500096 - protein, 10 aa, Influenza virus
HNGKLCRLRG

SEQ ID NO: 500097 - protein, 10 aa, Influenza virus
HNGKLCRLSG

SEQ ID NO: 500098 - protein, 10 aa, Influenza virus
HNGTCAVVMT

SEQ ID NO: 500099 - protein, 10 aa, Influenza virus
HNGTCVVIMT

SEQ ID NO: 500100 - protein, 10 aa, Influenza virus
HNGTCVVVMT

SEQ ID NO: 500101 - protein, 10 aa, Influenza virus
HNGTWAVVMT

SEQ ID NO: 500102 - protein, 10 aa, Influenza virus
HNGVCPVVFT

SEQ ID NO: 500103 - protein, 10 aa, Influenza virus
HNIHPLAIGE

SEQ ID NO: 500104 - protein, 10 aa, Influenza virus
HNIHPLTIGE

SEQ ID NO: 500105 - protein, 10 aa, Influenza virus
HNIHPLTIGK

SEQ ID NO: 500106 - protein, 10 aa, Influenza virus
HNIHPLTMGE

SEQ ID NO: 500107 - protein, 10 aa, Influenza virus
HNITFSHNGG

SEQ ID NO: 500108 - protein, 10 aa, Influenza virus
HNIYRDEAIN

SEQ ID NO: 500109 - protein, 10 aa, Influenza virus
HNNEQGSGYA

SEQ ID NO: 500110 - protein, 10 aa, Influenza virus
HNQEYTSGRQ

SEQ ID NO: 500111 - protein, 10 aa, Influenza virus
HNSTCVVVMT

SEQ ID NO: 500112 - protein, 10 aa, Influenza virus
HNVHPLTIGE

SEQ ID NO: 500113 - protein, 10 aa, Influenza virus
HPATIGECPK

SEQ ID NO: 500114 - protein, 10 aa, Influenza virus
HPAYCNTDLG

SEQ ID NO: 500115 - protein, 10 aa, Influenza virus
HPELTGLDCI

SEQ ID NO: 500116 - protein, 10 aa, Influenza virus
HPELTGLDCM

SEQ ID NO: 500117 - protein, 10 aa, Influenza virus
HPELTGLNCI

SEQ ID NO: 500118 - protein, 10 aa, Influenza virus
HPELTGMDCI

SEQ ID NO: 500119 - protein, 10 aa, Influenza virus
HPELTGMNCI

SEQ ID NO: 500120 - protein, 10 aa, Influenza virus
HPFTIGECPK

SEQ ID NO: 500121 - protein, 10 aa, Influenza virus
HPFTIGECPR

SEQ ID NO: 500122 - protein, 10 aa, Influenza virus
HPGIFENSCI

SEQ ID NO: 500123 - protein, 10 aa, Influenza virus
HPGIFENSCL

SEQ ID NO: 500124 - protein, 10 aa, Influenza virus
HPGIFESSCL

SEQ ID NO: 500125 - protein, 10 aa, Influenza virus
HPGIFGNSCL

SEQ ID NO: 500126 - protein, 10 aa, Influenza virus
HPGLFENSCL

SEQ ID NO: 500127 - protein, 10 aa, Influenza virus
HPITIGECPK

SEQ ID NO: 500128 - protein, 10 aa, Influenza virus
HPLAIGECPK

SEQ ID NO: 500129 - protein, 10 aa, Influenza virus
HPLTIGECPK

SEQ ID NO: 500130 - protein, 10 aa, Influenza virus
HPLTIGKCPK

SEQ ID NO: 500131 - protein, 10 aa, Influenza virus
HPLTMGECPK

SEQ ID NO: 500132 - protein, 10 aa, Influenza virus
HPNAGKDPKK

SEQ ID NO: 500133 - protein, 10 aa, Influenza virus
HPRGLLEVGT

SEQ ID NO: 500134 - protein, 10 aa, Influenza virus
HPSAGKDPKK

SEQ ID NO: 500135 - protein, 10 aa, Influenza virus
HPSAGRDPKK

SEQ ID NO: 500136 - protein, 10 aa, Influenza virus
HPSSAQEKND

SEQ ID NO: 500137 - protein, 10 aa, Influenza virus
HPSSDNEQTD

SEQ ID NO: 500138 - protein, 10 aa, Influenza virus
HPSSTKEKND

SEQ ID NO: 500139 - protein, 10 aa, Influenza virus
HPSSTKEKNE

SEQ ID NO: 500140 - protein, 10 aa, Influenza virus
HPSSTQEKNA

SEQ ID NO: 500141 - protein, 10 aa, Influenza virus
HPSSTQEKND

SEQ ID NO: 500142 - protein, 10 aa, Influenza virus
HPSTGKDPKK

SEQ ID NO: 500143 - protein, 10 aa, Influenza virus
HPTLLFLKVP

SEQ ID NO: 500144 - protein, 10 aa, Influenza virus
HPVTIGECPK

SEQ ID NO: 500145 - protein, 10 aa, Influenza virus
HPVTIGKCPK

SEQ ID NO: 500146 - protein, 10 aa, Influenza virus
HQCDNNCIES

SEQ ID NO: 500147 - protein, 10 aa, Influenza virus
HQFELIDNEF

SEQ ID NO: 500148 - protein, 10 aa, Influenza virus
HQGTTIRNKH

SEQ ID NO: 500149 - protein, 10 aa, Influenza virus
HQGTTIRNRH

SEQ ID NO: 500150 - protein, 10 aa, Influenza virus
HQIEKEFEQV

SEQ ID NO: 500151 - protein, 10 aa, Influenza virus
HQIEKEFGQV

SEQ ID NO: 500152 - protein, 10 aa, Influenza virus
HQIEKEFSEI

SEQ ID NO: 500153 - protein, 10 aa, Influenza virus
HQIEKEFSEV

SEQ ID NO: 500154 - protein, 10 aa, Influenza virus
HQIEKEFTEV

SEQ ID NO: 500155 - protein, 10 aa, Influenza virus
HQIGNVINWT

SEQ ID NO: 500156 - protein, 10 aa, Influenza virus
HQILAIYSTV

SEQ ID NO: 500157 - protein, 10 aa, Influenza virus
HQLLRHFQKD

SEQ ID NO: 500158 - protein, 10 aa, Influenza virus
HQLLRHFQKN

SEQ ID NO: 500159 - protein, 10 aa, Influenza virus
HQLRDNAKEL

SEQ ID NO: 500160 - protein, 10 aa, Influenza virus
HQLRENAEDK

SEQ ID NO: 500161 - protein, 10 aa, Influenza virus
HQNAEGIGIA

SEQ ID NO: 500162 - protein, 10 aa, Influenza virus
HQNAEGTGIA

SEQ ID NO: 500163 - protein, 10 aa, Influenza virus
HQNAEGTGMA

SEQ ID NO: 500164 - protein, 10 aa, Influenza virus
HQNAEGTGTA

SEQ ID NO: 500165 - protein, 10 aa, Influenza virus
HQNAQGEGIA

SEQ ID NO: 500166 - protein, 10 aa, Influenza virus
HQNAQGEGTA

SEQ ID NO: 500167 - protein, 10 aa, Influenza virus
HQNAQGIGQA

SEQ ID NO: 500168 - protein, 10 aa, Influenza virus
HQNAQGQGTA

SEQ ID NO: 500169 - protein, 10 aa, Influenza virus
HQNAQGSGYA

SEQ ID NO: 500170 - protein, 10 aa, Influenza virus
HQNAQGTGQA

SEQ ID NO: 500171 - protein, 10 aa, Influenza virus
HQNAQGTGQV

SEQ ID NO: 500172 - protein, 10 aa, Influenza virus
HQNEQGMGMA

SEQ ID NO: 500173 - protein, 10 aa, Influenza virus
HQNEQGSGYA

SEQ ID NO: 500174 - protein, 10 aa, Influenza virus
HQNEQGTGIA

SEQ ID NO: 500175 - protein, 10 aa, Influenza virus
HQNEQGVGIA

SEQ ID NO: 500176 - protein, 10 aa, Influenza virus
HQNEQGVGMA

SEQ ID NO: 500177 - protein, 10 aa, Influenza virus
HQNGQGSGYA

SEQ ID NO: 500178 - protein, 10 aa, Influenza virus
HQNSEGTGIA

SEQ ID NO: 500179 - protein, 10 aa, Influenza virus
HQNSEGTGIV

SEQ ID NO: 500180 - protein, 10 aa, Influenza virus
HQNSEGTGTA

SEQ ID NO: 500181 - protein, 10 aa, Influenza virus
HQNSQGEGTA

SEQ ID NO: 500182 - protein, 10 aa, Influenza virus
HQNTQGEGTA

SEQ ID NO: 500183 - protein, 10 aa, Influenza virus
HQRSKFLLMD

SEQ ID NO: 500184 - protein, 10 aa, Influenza virus
HQSTNSTETV

SEQ ID NO: 500185 - protein, 10 aa, Influenza virus
HRCDDQCMES

SEQ ID NO: 500186 - protein, 10 aa, Influenza virus
HRDEEGTGIA

SEQ ID NO: 500187 - protein, 10 aa, Influenza virus
HRFEIIEGRD

SEQ ID NO: 500188 - protein, 10 aa, Influenza virus
HRIYWIREGK

SEQ ID NO: 500189 - protein, 10 aa, Influenza virus
HRIYWIREGR

SEQ ID NO: 500190 - protein, 10 aa, Influenza virus
HRIYWIRKGR

SEQ ID NO: 500191 - protein, 10 aa, Influenza virus
HRLCYPGELD

SEQ ID NO: 500192 - protein, 10 aa, Influenza virus
HRLKITENSF

SEQ ID NO: 500193 - protein, 10 aa, Influenza virus
HRNAIGDCPK

SEQ ID NO: 500194 - protein, 10 aa, Influenza virus
HRNDEGTGIA

SEQ ID NO: 500195 - protein, 10 aa, Influenza virus
HRNEEGTGIA

SEQ ID NO: 500196 - protein, 10 aa, Influenza virus
HRNTFGDCPK

SEQ ID NO: 500197 - protein, 10 aa, Influenza virus
HRNTIGDCPK

SEQ ID NO: 500198 - protein, 10 aa, Influenza virus
HRSTIGDCPK

SEQ ID NO: 500199 - protein, 10 aa, Influenza virus
HRTLLMNELG

SEQ ID NO: 500200 - protein, 10 aa, Influenza virus
HRTLLMSELG

SEQ ID NO: 500201 - protein, 10 aa, Influenza virus
HRVYWIREGK

SEQ ID NO: 500202 - protein, 10 aa, Influenza virus
HRVYWIREGR

SEQ ID NO: 500203 - protein, 10 aa, Influenza virus
HSAAFEDLRI

SEQ ID NO: 500204 - protein, 10 aa, Influenza virus
HSAAFEDLRL

SEQ ID NO: 500205 - protein, 10 aa, Influenza virus
HSAAFEDLRV

SEQ ID NO: 500206 - protein, 10 aa, Influenza virus
HSAYCNTDLG

SEQ ID NO: 500207 - protein, 10 aa, Influenza virus
HSCLQCRICI

SEQ ID NO: 500208 - protein, 10 aa, Influenza virus
HSDNADKICL

SEQ ID NO: 500209 - protein, 10 aa, Influenza virus
HSDTPRPADP

SEQ ID NO: 500210 - protein, 10 aa, Influenza virus
HSDTPRPDDP

SEQ ID NO: 500211 - protein, 10 aa, Influenza virus
HSDTPRPSDP

SEQ ID NO: 500212 - protein, 10 aa, Influenza virus
HSDTPRPTDP

SEQ ID NO: 500213 - protein, 10 aa, Influenza virus
HSDTPRPVDP

SEQ ID NO: 500214 - protein, 10 aa, Influenza virus
HSECRTFFLT

SEQ ID NO: 500215 - protein, 10 aa, Influenza virus
HSGICPVVFT

SEQ ID NO: 500216 - protein, 10 aa, Influenza virus
HSHYREEALL

SEQ ID NO: 500217 - protein, 10 aa, Influenza virus
HSKDNGIRIG

SEQ ID NO: 500218 - protein, 10 aa, Influenza virus
HSKDNNIRIG

SEQ ID NO: 500219 - protein, 10 aa, Influenza virus
HSKDNSIRIG

SEQ ID NO: 500220 - protein, 10 aa, Influenza virus
HSKEQGSGYA

SEQ ID NO: 500221 - protein, 10 aa, Influenza virus
HSMSDIEAMA

SEQ ID NO: 500222 - protein, 10 aa, Influenza virus
HSMSGFRSNL

SEQ ID NO: 500223 - protein, 10 aa, Influenza virus
HSNAEGTGMA

SEQ ID NO: 500224 - protein, 10 aa, Influenza virus
HSNDQGAGYA

SEQ ID NO: 500225 - protein, 10 aa, Influenza virus
HSNDQGSGYA

SEQ ID NO: 500226 - protein, 10 aa, Influenza virus
HSNDTIHDRT

SEQ ID NO: 500227 - protein, 10 aa, Influenza virus
HSNEQGSGYA

SEQ ID NO: 500228 - protein, 10 aa, Influenza virus
HSNETVKDRS

SEQ ID NO: 500229 - protein, 10 aa, Influenza virus
HSNGQGSGYA

SEQ ID NO: 500230 - protein, 10 aa, Influenza virus
HSNGTAKDRS

SEQ ID NO: 500231 - protein, 10 aa, Influenza virus
HSNGTIEDRT

SEQ ID NO: 500232 - protein, 10 aa, Influenza virus
HSNGTIHDRA

SEQ ID NO: 500233 - protein, 10 aa, Influenza virus
HSNGTIHDRI

SEQ ID NO: 500234 - protein, 10 aa, Influenza virus
HSNGTIHDRS

SEQ ID NO: 500235 - protein, 10 aa, Influenza virus
HSNGTIHDRT

SEQ ID NO: 500236 - protein, 10 aa, Influenza virus
HSNGTIKDRA

SEQ ID NO: 500237 - protein, 10 aa, Influenza virus
HSNGTIKDRS

SEQ ID NO: 500238 - protein, 10 aa, Influenza virus
HSNGTIKDRT

SEQ ID NO: 500239 - protein, 10 aa, Influenza virus
HSNGTINDRT

SEQ ID NO: 500240 - protein, 10 aa, Influenza virus
HSNGTMKDRS

SEQ ID NO: 500241 - protein, 10 aa, Influenza virus
HSNGTNKDRT

SEQ ID NO: 500242 - protein, 10 aa, Influenza virus
HSNGTTHDRI

SEQ ID NO: 500243 - protein, 10 aa, Influenza virus
HSNGTTHDRT

SEQ ID NO: 500244 - protein, 10 aa, Influenza virus
HSNGTVKBRS

SEQ ID NO: 500245 - protein, 10 aa, Influenza virus
HSNGTVKDRS

SEQ ID NO: 500246 - protein, 10 aa, Influenza virus
HSNGTVKDRT

SEQ ID NO: 500247 - protein, 10 aa, Influenza virus
HSNGTVKNRS

SEQ ID NO: 500248 - protein, 10 aa, Influenza virus
HSNGTVNDRS

SEQ ID NO: 500249 - protein, 10 aa, Influenza virus
HSNLNDATYQ

SEQ ID NO: 500250 - protein, 10 aa, Influenza virus
HSNLNDTTYQ

SEQ ID NO: 500251 - protein, 10 aa, Influenza virus
HSNNTVKDRS

SEQ ID NO: 500252 - protein, 10 aa, Influenza virus
HSNSEGTGMA

SEQ ID NO: 500253 - protein, 10 aa, Influenza virus
HSNSTTHDRT

SEQ ID NO: 500254 - protein, 10 aa, Influenza virus
HSQYREEALL

SEQ ID NO: 500255 - protein, 10 aa, Influenza virus
HSRGLFGAIA

SEQ ID NO: 500256 - protein, 10 aa, Influenza virus
HSRSGFEMLK

SEQ ID NO: 500257 - protein, 10 aa, Influenza virus
HSSGTVKDRS

SEQ ID NO: 500258 - protein, 10 aa, Influenza virus
HSSSLDEQNK

SEQ ID NO: 500259 - protein, 10 aa, Influenza virus
HSWIPKRNRS

SEQ ID NO: 500260 - protein, 10 aa, Influenza virus
HSWTPKRNRS

SEQ ID NO: 500261 - protein, 10 aa, Influenza virus
HSWVPILNTS

SEQ ID NO: 500262 - protein, 10 aa, Influenza virus
HSWVPKRNRS

SEQ ID NO: 500263 - protein, 10 aa, Influenza virus
HTAYSQITNG

SEQ ID NO: 500264 - protein, 10 aa, Influenza virus
HTDELCPSPL

SEQ ID NO: 500265 - protein, 10 aa, Influenza virus
HTEYRQEALQ

SEQ ID NO: 500266 - protein, 10 aa, Influenza virus
HTGNPVICLG

SEQ ID NO: 500267 - protein, 10 aa, Influenza virus
HTGSFCSIDG

SEQ ID NO: 500268 - protein, 10 aa, Influenza virus
HTGSFCSING

SEQ ID NO: 500269 - protein, 10 aa, Influenza virus
HTGSFCSLDG

SEQ ID NO: 500270 - protein, 10 aa, Influenza virus
HTGTFCSING

SEQ ID NO: 500271 - protein, 10 aa, Influenza virus
HTGTYCSLDG

SEQ ID NO: 500272 - protein, 10 aa, Influenza virus
HTGTYCSLGG

SEQ ID NO: 500273 - protein, 10 aa, Influenza virus
HTGTYCSLNG

SEQ ID NO: 500274 - protein, 10 aa, Influenza virus
HTGTYCSLSG

SEQ ID NO: 500275 - protein, 10 aa, Influenza virus
HTIDLADSEI

SEQ ID NO: 500276 - protein, 10 aa, Influenza virus
HTIDLADSEM

SEQ ID NO: 500277 - protein, 10 aa, Influenza virus
HTIDLAESEM

SEQ ID NO: 500278 - protein, 10 aa, Influenza virus
HTIDLTDAEM

SEQ ID NO: 500279 - protein, 10 aa, Influenza virus
HTIDLTDSEM

SEQ ID NO: 500280 - protein, 10 aa, Influenza virus
HTIDLTNSEM

SEQ ID NO: 500281 - protein, 10 aa, Influenza virus
HTIDMADSEM

SEQ ID NO: 500282 - protein, 10 aa, Influenza virus
HTIDMADSTM

SEQ ID NO: 500283 - protein, 10 aa, Influenza virus
HTIDMTDSEM

SEQ ID NO: 500284 - protein, 10 aa, Influenza virus
HTIDVADSEM

SEQ ID NO: 500285 - protein, 10 aa, Influenza virus
HTIDVTDSEM

SEQ ID NO: 500286 - protein, 10 aa, Influenza virus
HTIHLTDSEM

SEQ ID NO: 500287 - protein, 10 aa, Influenza virus
HTKCQTYAGA

SEQ ID NO: 500288 - protein, 10 aa, Influenza virus
HTKCQTYTGA

SEQ ID NO: 500289 - protein, 10 aa, Influenza virus
HTKVLYFHKG

SEQ ID NO: 500290 - protein, 10 aa, Influenza virus
HTQYREEALL

SEQ ID NO: 500291 - protein, 10 aa, Influenza virus
HTQYREESLL

SEQ ID NO: 500292 - protein, 10 aa, Influenza virus
HTRGLFGAIA

SEQ ID NO: 500293 - protein, 10 aa, Influenza virus
HTSQYICSPV

SEQ ID NO: 500294 - protein, 10 aa, Influenza virus
HTSQYLCTGI

SEQ ID NO: 500295 - protein, 10 aa, Influenza virus
HTSQYLCTGV

SEQ ID NO: 500296 - protein, 10 aa, Influenza virus
HTSRYVCTGI

SEQ ID NO: 500297 - protein, 10 aa, Influenza virus
HTTINNITNV

SEQ ID NO: 500298 - protein, 10 aa, Influenza virus
HVCITGDDRN

SEQ ID NO: 500299 - protein, 10 aa, Influenza virus
HVCVTGDDGN

SEQ ID NO: 500300 - protein, 10 aa, Influenza virus
HVCVTGDDKN

SEQ ID NO: 500301 - protein, 10 aa, Influenza virus
HVCVTGDDRN

SEQ ID NO: 500302 - protein, 10 aa, Influenza virus
HVDTIMEKNV

SEQ ID NO: 500303 - protein, 10 aa, Influenza virus
HVEECSCYGH

SEQ ID NO: 500304 - protein, 10 aa, Influenza virus
HVEECSCYPQ

SEQ ID NO: 500305 - protein, 10 aa, Influenza virus
HVEECSCYPR

SEQ ID NO: 500306 - protein, 10 aa, Influenza virus
HVEECSCYPS

SEQ ID NO: 500307 - protein, 10 aa, Influenza virus
HVEVVSAKEL

SEQ ID NO: 500308 - protein, 10 aa, Influenza virus
HVFIIREPFV

SEQ ID NO: 500309 - protein, 10 aa, Influenza virus
HVFVIREPFV

SEQ ID NO: 500310 - protein, 10 aa, Influenza virus
HVLVTREPYL

SEQ ID NO: 500311 - protein, 10 aa, Influenza virus
HVRKRFADQE

SEQ ID NO: 500312 - protein, 10 aa, Influenza virus
HVSPLSGSAQ

SEQ ID NO: 500313 - protein, 10 aa, Influenza virus
HWMLLDPGDT

SEQ ID NO: 500314 - protein, 10 aa, Influenza virus
HWNLALDIVD

SEQ ID NO: 500315 - protein, 10 aa, Influenza virus
HWPDGSNIGF

SEQ ID NO: 500316 - protein, 10 aa, Influenza virus
HYEECSCYPD

SEQ ID NO: 500317 - protein, 10 aa, Influenza virus
HYEECSCYPE

SEQ ID NO: 500318 - protein, 10 aa, Influenza virus
HYEECSCYPN

SEQ ID NO: 500319 - protein, 10 aa, Influenza virus
HYGGIPTDVI

SEQ ID NO: 500320 - protein, 10 aa, Influenza virus
HYGGIPTDVV

SEQ ID NO: 500321 - protein, 10 aa, Influenza virus
HYGGMPTDVV

SEQ ID NO: 500322 - protein, 10 aa, Influenza virus
HYGGVPTDVI

SEQ ID NO: 500323 - protein, 10 aa, Influenza virus
HYGGVPTDVV

SEQ ID NO: 500324 - protein, 10 aa, Influenza virus
HYIGKCPKYI

SEQ ID NO: 500325 - protein, 10 aa, Influenza virus
HYIGKCPRYI

SEQ ID NO: 500326 - protein, 10 aa, Influenza virus
HYKISKSTKS

SEQ ID NO: 500327 - protein, 10 aa, Influenza virus
HYPKIYKTYF

SEQ ID NO: 500328 - protein, 10 aa, Influenza virus
HYPKVYKPYF

SEQ ID NO: 500329 - protein, 10 aa, Influenza virus
HYPKVYKTYF

SEQ ID NO: 500330 - protein, 10 aa, Influenza virus
HYPKVYRTYF

SEQ ID NO: 500331 - protein, 10 aa, Influenza virus
HYREEALLNR

SEQ ID NO: 500332 - protein, 10 aa, Influenza virus
HYSKVYKTYF

SEQ ID NO: 500333 - protein, 10 aa, Influenza virus
HYVCSGLVGD

SEQ ID NO: 500334 - protein, 10 aa, Influenza virus
IAADKASTQK

SEQ ID NO: 500335 - protein, 10 aa, Influenza virus
IAADKESTQE

SEQ ID NO: 500336 - protein, 10 aa, Influenza virus
IAADKESTQK

SEQ ID NO: 500337 - protein, 10 aa, Influenza virus
IAADKESTQR

SEQ ID NO: 500338 - protein, 10 aa, Influenza virus
IAADKESTQT

SEQ ID NO: 500339 - protein, 10 aa, Influenza virus
IAADKTSTQK

SEQ ID NO: 500340 - protein, 10 aa, Influenza virus
IAADKVSTQK

SEQ ID NO: 500341 - protein, 10 aa, Influenza virus
IAADRESTQK

SEQ ID NO: 500342 - protein, 10 aa, Influenza virus
IAADYKSTQS

SEQ ID NO: 500343 - protein, 10 aa, Influenza virus
IAAEKESTQK

SEQ ID NO: 500344 - protein, 10 aa, Influenza virus
IAARNIVRRA

SEQ ID NO: 500345 - protein, 10 aa, Influenza virus
IAARSIVRRA

SEQ ID NO: 500346 - protein, 10 aa, Influenza virus
IAASYKRIRL

SEQ ID NO: 500347 - protein, 10 aa, Influenza virus
IADAQHRSHR

SEQ ID NO: 500348 - protein, 10 aa, Influenza virus
IADKICIGYL

SEQ ID NO: 500349 - protein, 10 aa, Influenza virus
IADRVDDAVT

SEQ ID NO: 500350 - protein, 10 aa, Influenza virus
IADSHHRSHR

SEQ ID NO: 500351 - protein, 10 aa, Influenza virus
IADSQHKSHR

SEQ ID NO: 500352 - protein, 10 aa, Influenza virus
IADSQHRSHR

SEQ ID NO: 500353 - protein, 10 aa, Influenza virus
IAEQFTWNGV

SEQ ID NO: 500354 - protein, 10 aa, Influenza virus
IAFCGTSGTY

SEQ ID NO: 500355 - protein, 10 aa, Influenza virus
IAFCGVDSDT

SEQ ID NO: 500356 - protein, 10 aa, Influenza virus
IAFCGVNSDT

SEQ ID NO: 500357 - protein, 10 aa, Influenza virus
IAFCGVNSNT

SEQ ID NO: 500358 - protein, 10 aa, Influenza virus
IAFLTSSIVC

SEQ ID NO: 500359 - protein, 10 aa, Influenza virus
IAFVLWACQN

SEQ ID NO: 500360 - protein, 10 aa, Influenza virus
IAGFAPFSKD

SEQ ID NO: 500361 - protein, 10 aa, Influenza virus
IAGFIEGGWC

SEQ ID NO: 500362 - protein, 10 aa, Influenza virus
IAGFIEGGWP

SEQ ID NO: 500363 - protein, 10 aa, Influenza virus
IAGFIEGGWQ

SEQ ID NO: 500364 - protein, 10 aa, Influenza virus
IAGFIEGGWS

SEQ ID NO: 500365 - protein, 10 aa, Influenza virus
IAGFIEGGWT

SEQ ID NO: 500366 - protein, 10 aa, Influenza virus
IAGFIEGRWP

SEQ ID NO: 500367 - protein, 10 aa, Influenza virus
IAGFIENGWE

SEQ ID NO: 500368 - protein, 10 aa, Influenza virus
IAGFIENGWQ

SEQ ID NO: 500369 - protein, 10 aa, Influenza virus
IAGFLENGWE

SEQ ID NO: 500370 - protein, 10 aa, Influenza virus
IAGGLILGMQ

SEQ ID NO: 500371 - protein, 10 aa, Influenza virus
IAGLFFWMCS

SEQ ID NO: 500372 - protein, 10 aa, Influenza virus
IAGLSFWMCS

SEQ ID NO: 500373 - protein, 10 aa, Influenza virus
IAGSSEQAAE

SEQ ID NO: 500374 - protein, 10 aa, Influenza virus
IAGWILGNPE

SEQ ID NO: 500375 - protein, 10 aa, Influenza virus
IAGWLLGNPE

SEQ ID NO: 500376 - protein, 10 aa, Influenza virus
IAGWLLGNPK

SEQ ID NO: 500377 - protein, 10 aa, Influenza virus
IAGWLLGNPM

SEQ ID NO: 500378 - protein, 10 aa, Influenza virus
IAGWYGFQHS

SEQ ID NO: 500379 - protein, 10 aa, Influenza virus
IAHISPLSGS

SEQ ID NO: 500380 - protein, 10 aa, Influenza virus
IAHKSCLPAC

SEQ ID NO: 500381 - protein, 10 aa, Influenza virus
IAIALGIINL

SEQ ID NO: 500382 - protein, 10 aa, Influenza virus
IAIGNCPKYV

SEQ ID NO: 500383 - protein, 10 aa, Influenza virus
IAIGSVSRTI

SEQ ID NO: 500384 - protein, 10 aa, Influenza virus
IAILAATVTL

SEQ ID NO: 500385 - protein, 10 aa, Influenza virus
IAILATTITL

SEQ ID NO: 500386 - protein, 10 aa, Influenza virus
IAILATTVTL

SEQ ID NO: 500387 - protein, 10 aa, Influenza virus
IAILVTTVTL

SEQ ID NO: 500388 - protein, 10 aa, Influenza virus
IAIRPKVNGQ

SEQ ID NO: 500389 - protein, 10 aa, Influenza virus
IAIVLGIINL

SEQ ID NO: 500390 - protein, 10 aa, Influenza virus
IAKDNAIRFG

SEQ ID NO: 500391 - protein, 10 aa, Influenza virus
IAKDNAVRFG

SEQ ID NO: 500392 - protein, 10 aa, Influenza virus
IAKGEKANVL

SEQ ID NO: 500393 - protein, 10 aa, Influenza virus
IALCGSPFPV

SEQ ID NO: 500394 - protein, 10 aa, Influenza virus
IALCGSPISV

SEQ ID NO: 500395 - protein, 10 aa, Influenza virus
IALFIGVGNL

SEQ ID NO: 500396 - protein, 10 aa, Influenza virus
IALGIINLLI

SEQ ID NO: 500397 - protein, 10 aa, Influenza virus
IALIIGVGNL

SEQ ID NO: 500398 - protein, 10 aa, Influenza virus
IALILVALAL

SEQ ID NO: 500399 - protein, 10 aa, Influenza virus
IALLIGIGNL

SEQ ID NO: 500400 - protein, 10 aa, Influenza virus
IALLIGVGNL

SEQ ID NO: 500401 - protein, 10 aa, Influenza virus
IALSILNLLI

SEQ ID NO: 500402 - protein, 10 aa, Influenza virus
IALSVLNLLI

SEQ ID NO: 500403 - protein, 10 aa, Influenza virus
IALSYSAGAL

SEQ ID NO: 500404 - protein, 10 aa, Influenza virus
IAMENQHTID

SEQ ID NO: 500405 - protein, 10 aa, Influenza virus
IAMGLIFMCV

SEQ ID NO: 500406 - protein, 10 aa, Influenza virus
IAPDRASFFK

SEQ ID NO: 500407 - protein, 10 aa, Influenza virus
IAPDRASFFR

SEQ ID NO: 500408 - protein, 10 aa, Influenza virus
IAPDRASFLR

SEQ ID NO: 500409 - protein, 10 aa, Influenza virus
IAPDRATFLR

SEQ ID NO: 500410 - protein, 10 aa, Influenza virus
IAPEFGYLLK

SEQ ID NO: 500411 - protein, 10 aa, Influenza virus
IAPEFGYLLR

SEQ ID NO: 500412 - protein, 10 aa, Influenza virus
IAPEYGFKIS

SEQ ID NO: 500413 - protein, 10 aa, Influenza virus
IAPEYGFRIS

SEQ ID NO: 500414 - protein, 10 aa, Influenza virus
IAPEYGHLIT

SEQ ID NO: 500415 - protein, 10 aa, Influenza virus
IAPEYGHLTT

SEQ ID NO: 500416 - protein, 10 aa, Influenza virus
IAPEYGHLVT

SEQ ID NO: 500417 - protein, 10 aa, Influenza virus
IAPEYGYLIT

SEQ ID NO: 500418 - protein, 10 aa, Influenza virus
IAPIMFSNKM

SEQ ID NO: 500419 - protein, 10 aa, Influenza virus
IAPLMMAYML

SEQ ID NO: 500420 - protein, 10 aa, Influenza virus
IAPLMVAYML

SEQ ID NO: 500421 - protein, 10 aa, Influenza virus
IAPNRASFFR

SEQ ID NO: 500422 - protein, 10 aa, Influenza virus
IAPRGHYKIS

SEQ ID NO: 500423 - protein, 10 aa, Influenza virus
IAPRYAFELV

SEQ ID NO: 500424 - protein, 10 aa, Influenza virus
IAPRYGYIIE

SEQ ID NO: 500425 - protein, 10 aa, Influenza virus
IAQDNAIRFG

SEQ ID NO: 500426 - protein, 10 aa, Influenza virus
IAQKLEDVFA

SEQ ID NO: 500427 - protein, 10 aa, Influenza virus
IAQRLEDVFA

SEQ ID NO: 500428 - protein, 10 aa, Influenza virus
IAQRLEGVFA

SEQ ID NO: 500429 - protein, 10 aa, Influenza virus
IAQRLENVFA

SEQ ID NO: 500430 - protein, 10 aa, Influenza virus
IAQRLESVFA

SEQ ID NO: 500431 - protein, 10 aa, Influenza virus
IASDILKRMS

SEQ ID NO: 500432 - protein, 10 aa, Influenza virus
IASDILTRMS

SEQ ID NO: 500433 - protein, 10 aa, Influenza virus
IASIRRNYFT

SEQ ID NO: 500434 - protein, 10 aa, Influenza virus
IASKDNGIRI

SEQ ID NO: 500435 - protein, 10 aa, Influenza virus
IASMRRDYFT

SEQ ID NO: 500436 - protein, 10 aa, Influenza virus
IASMRRNYFT

SEQ ID NO: 500437 - protein, 10 aa, Influenza virus
IASMRRSYFT

SEQ ID NO: 500438 - protein, 10 aa, Influenza virus
IASRSGYEIL

SEQ ID NO: 500439 - protein, 10 aa, Influenza virus
IASRSGYEML

SEQ ID NO: 500440 - protein, 10 aa, Influenza virus
IASSIVLVGL

SEQ ID NO: 500441 - protein, 10 aa, Influenza virus
IASSIVMVGL

SEQ ID NO: 500442 - protein, 10 aa, Influenza virus
IASSLILAAI

SEQ ID NO: 500443 - protein, 10 aa, Influenza virus
IASSLILAAL

SEQ ID NO: 500444 - protein, 10 aa, Influenza virus
IASSLPFQNI

SEQ ID NO: 500445 - protein, 10 aa, Influenza virus
IASSLVLAAI

SEQ ID NO: 500446 - protein, 10 aa, Influenza virus
IASSLVLAAL

SEQ ID NO: 500447 - protein, 10 aa, Influenza virus
IASSLVLAAS

SEQ ID NO: 500448 - protein, 10 aa, Influenza virus
IASSTVLVGL

SEQ ID NO: 500449 - protein, 10 aa, Influenza virus
IASSTVMVGL

SEQ ID NO: 500450 - protein, 10 aa, Influenza virus
IASSVVLVGL

SEQ ID NO: 500451 - protein, 10 aa, Influenza virus
IASSVVLVGP

SEQ ID NO: 500452 - protein, 10 aa, Influenza virus
IASTTAKAME

SEQ ID NO: 500453 - protein, 10 aa, Influenza virus
IASVPASRYL

SEQ ID NO: 500454 - protein, 10 aa, Influenza virus
IASWAGNILR

SEQ ID NO: 500455 - protein, 10 aa, Influenza virus
IATPGMQIRG

SEQ ID NO: 500456 - protein, 10 aa, Influenza virus
IATRPKVNGQ

SEQ ID NO: 500457 - protein, 10 aa, Influenza virus
IATRPQVNGQ

SEQ ID NO: 500458 - protein, 10 aa, Influenza virus
IATRPRVNGQ

SEQ ID NO: 500459 - protein, 10 aa, Influenza virus
IATRSKVNGQ

SEQ ID NO: 500460 - protein, 10 aa, Influenza virus
IAVFCGTSGT

SEQ ID NO: 500461 - protein, 10 aa, Influenza virus
IAWSRSSCHD

SEQ ID NO: 500462 - protein, 10 aa, Influenza virus
IAWSSASCHD

SEQ ID NO: 500463 - protein, 10 aa, Influenza virus
IAWSSSSCFD

SEQ ID NO: 500464 - protein, 10 aa, Influenza virus
IAWSSSSCHD

SEQ ID NO: 500465 - protein, 10 aa, Influenza virus
IAWSSSSCYD

SEQ ID NO: 500466 - protein, 10 aa, Influenza virus
IAYERMCNIL

SEQ ID NO: 500467 - protein, 10 aa, Influenza virus
ICATCEQIAD

SEQ ID NO: 500468 - protein, 10 aa, Influenza virus
ICAVATTHSW

SEQ ID NO: 500469 - protein, 10 aa, Influenza virus
ICAVVMTDGS

SEQ ID NO: 500470 - protein, 10 aa, Influenza virus
ICEKLEQSGL

SEQ ID NO: 500471 - protein, 10 aa, Influenza virus
ICFMYSDFHF

SEQ ID NO: 500472 - protein, 10 aa, Influenza virus
ICIAWSSSSC

SEQ ID NO: 500473 - protein, 10 aa, Influenza virus
ICIDFRDMRK

SEQ ID NO: 500474 - protein, 10 aa, Influenza virus
ICIGHHANNS

SEQ ID NO: 500475 - protein, 10 aa, Influenza virus
ICIGYHANNS

SEQ ID NO: 500476 - protein, 10 aa, Influenza virus
ICIGYHSNNS

SEQ ID NO: 500477 - protein, 10 aa, Influenza virus
ICIGYLSNNA

SEQ ID NO: 500478 - protein, 10 aa, Influenza virus
ICIGYLSNNS

SEQ ID NO: 500479 - protein, 10 aa, Influenza virus
ICIGYLSTNS

SEQ ID NO: 500480 - protein, 10 aa, Influenza virus
ICIGYMSNNS

SEQ ID NO: 500481 - protein, 10 aa, Influenza virus
ICIGYQSNNS

SEQ ID NO: 500482 - protein, 10 aa, Influenza virus
ICIGYQTNNS

SEQ ID NO: 500483 - protein, 10 aa, Influenza virus
ICIKNGNMQC

SEQ ID NO: 500484 - protein, 10 aa, Influenza virus
ICIKNGNMRC

SEQ ID NO: 500485 - protein, 10 aa, Influenza virus
ICIKNGNVRC

SEQ ID NO: 500486 - protein, 10 aa, Influenza virus
ICILDQNFRN

SEQ ID NO: 500487 - protein, 10 aa, Influenza virus
ICINGTCTVV

SEQ ID NO: 500488 - protein, 10 aa, Influenza virus
ICIQGNNDNA

SEQ ID NO: 500489 - protein, 10 aa, Influenza virus
ICISGPNNNA

SEQ ID NO: 500490 - protein, 10 aa, Influenza virus
ICKAAIGLRI

SEQ ID NO: 500491 - protein, 10 aa, Influenza virus
ICKAALGLRI

SEQ ID NO: 500492 - protein, 10 aa, Influenza virus
ICKAAMGLKI

SEQ ID NO: 500493 - protein, 10 aa, Influenza virus
ICKAAMGLRI

SEQ ID NO: 500494 - protein, 10 aa, Influenza virus
ICKAAMGMRI

SEQ ID NO: 500495 - protein, 10 aa, Influenza virus
ICKLVGINMS

SEQ ID NO: 500496 - protein, 10 aa, Influenza virus
ICKPYIGKCP

SEQ ID NO: 500497 - protein, 10 aa, Influenza virus
ICLGHHAIPN

SEQ ID NO: 500498 - protein, 10 aa, Influenza virus
ICLGHHAVAN

SEQ ID NO: 500499 - protein, 10 aa, Influenza virus
ICLGHHAVEN

SEQ ID NO: 500500 - protein, 10 aa, Influenza virus
ICLGHHAVPN

SEQ ID NO: 500501 - protein, 10 aa, Influenza virus
ICLGHHAVSN

SEQ ID NO: 500502 - protein, 10 aa, Influenza virus
ICLGHHAVTN

SEQ ID NO: 500503 - protein, 10 aa, Influenza virus
ICMSGPNDNA

SEQ ID NO: 500504 - protein, 10 aa, Influenza virus
ICMSGPNNNA

SEQ ID NO: 500505 - protein, 10 aa, Influenza virus
ICNSNAITRS

SEQ ID NO: 500506 - protein, 10 aa, Influenza virus
ICPVVFTDGS

SEQ ID NO: 500507 - protein, 10 aa, Influenza virus
ICPVVMTDGP

SEQ ID NO: 500508 - protein, 10 aa, Influenza virus
ICQMEKIVLL

SEQ ID NO: 500509 - protein, 10 aa, Influenza virus
ICRDNWKGAN

SEQ ID NO: 500510 - protein, 10 aa, Influenza virus
ICRDNWKGSN

SEQ ID NO: 500511 - protein, 10 aa, Influenza virus
ICRDNWQGAN

SEQ ID NO: 500512 - protein, 10 aa, Influenza virus
ICRDNWRGAN

SEQ ID NO: 500513 - protein, 10 aa, Influenza virus
ICRDNWTGTN

SEQ ID NO: 500514 - protein, 10 aa, Influenza virus
ICSCIASSLV

SEQ ID NO: 500515 - protein, 10 aa, Influenza virus
ICSGFFGDNP

SEQ ID NO: 500516 - protein, 10 aa, Influenza virus
ICSGIFGDNP

SEQ ID NO: 500517 - protein, 10 aa, Influenza virus
ICSGLVGDTP

SEQ ID NO: 500518 - protein, 10 aa, Influenza virus
ICSGVFGDNP

SEQ ID NO: 500519 - protein, 10 aa, Influenza virus
ICSGVFGDSP

SEQ ID NO: 500520 - protein, 10 aa, Influenza virus
ICSGVFGDTP

SEQ ID NO: 500521 - protein, 10 aa, Influenza virus
ICSGVLGDNP

SEQ ID NO: 500522 - protein, 10 aa, Influenza virus
ICSKFHSDTP

SEQ ID NO: 500523 - protein, 10 aa, Influenza virus
ICSPVLTDNP

SEQ ID NO: 500524 - protein, 10 aa, Influenza virus
ICTCRDNWQG

SEQ ID NO: 500525 - protein, 10 aa, Influenza virus
ICTGILTDTS

SEQ ID NO: 500526 - protein, 10 aa, Influenza virus
ICTGVLTDTS

SEQ ID NO: 500527 - protein, 10 aa, Influenza virus
ICTHLEICFM

SEQ ID NO: 500528 - protein, 10 aa, Influenza virus
ICTHLEVCFM

SEQ ID NO: 500529 - protein, 10 aa, Influenza virus
ICTHMEVCFM

SEQ ID NO: 500530 - protein, 10 aa, Influenza virus
ICTVVMTDGS

SEQ ID NO: 500531 - protein, 10 aa, Influenza virus
ICVAWSSSSC

SEQ ID NO: 500532 - protein, 10 aa, Influenza virus
ICVAWSSTSC

SEQ ID NO: 500533 - protein, 10 aa, Influenza virus
ICVCRDNWHG

SEQ ID NO: 500534 - protein, 10 aa, Influenza virus
ICVGWSSTSC

SEQ ID NO: 500535 - protein, 10 aa, Influenza virus
ICVGWSSTTC

SEQ ID NO: 500536 - protein, 10 aa, Influenza virus
ICVGYHANNS

SEQ ID NO: 500537 - protein, 10 aa, Influenza virus
ICVGYHSNNS

SEQ ID NO: 500538 - protein, 10 aa, Influenza virus
ICVGYLSTNS

SEQ ID NO: 500539 - protein, 10 aa, Influenza virus
ICVKNGNHAV

SEQ ID NO: 500540 - protein, 10 aa, Influenza virus
ICVKNGNMQC

SEQ ID NO: 500541 - protein, 10 aa, Influenza virus
ICVKNGNMRC

SEQ ID NO: 500542 - protein, 10 aa, Influenza virus
ICVQGNNDNA

SEQ ID NO: 500543 - protein, 10 aa, Influenza virus
ICVQGNNKNA

SEQ ID NO: 500544 - protein, 10 aa, Influenza virus
ICVQGNNNNA

SEQ ID NO: 500545 - protein, 10 aa, Influenza virus
ICVSGPNNNA

SEQ ID NO: 500546 - protein, 10 aa, Influenza virus
ICVTGDDRNA

SEQ ID NO: 500547 - protein, 10 aa, Influenza virus
ICVVAVTDGP

SEQ ID NO: 500548 - protein, 10 aa, Influenza virus
ICYPGKFTNE

SEQ ID NO: 500549 - protein, 10 aa, Influenza virus
ICYPGRFTNE

SEQ ID NO: 500550 - protein, 10 aa, Influenza virus
ICYPGSIENQ

SEQ ID NO: 500551 - protein, 10 aa, Influenza virus
ICYPGSVENQ

SEQ ID NO: 500552 - protein, 10 aa, Influenza virus
IDAGDGCFEI

SEQ ID NO: 500553 - protein, 10 aa, Influenza virus
IDAGNGCFDI

SEQ ID NO: 500554 - protein, 10 aa, Influenza virus
IDALLGDPHC

SEQ ID NO: 500555 - protein, 10 aa, Influenza virus
IDALLGDPQC

SEQ ID NO: 500556 - protein, 10 aa, Influenza virus
IDARIDFESG

SEQ ID NO: 500557 - protein, 10 aa, Influenza virus
IDARVDFESG

SEQ ID NO: 500558 - protein, 10 aa, Influenza virus
IDAVKLSSGY

SEQ ID NO: 500559 - protein, 10 aa, Influenza virus
IDDAVTDIWS

SEQ ID NO: 500560 - protein, 10 aa, Influenza virus
IDDAVTDVWS

SEQ ID NO: 500561 - protein, 10 aa, Influenza virus
IDDQIEDLWA

SEQ ID NO: 500562 - protein, 10 aa, Influenza virus
IDDQIEELWA

SEQ ID NO: 500563 - protein, 10 aa, Influenza virus
IDDQIEGLWA

SEQ ID NO: 500564 - protein, 10 aa, Influenza virus
IDDQIENLWA

SEQ ID NO: 500565 - protein, 10 aa, Influenza virus
IDDQIIDIWA

SEQ ID NO: 500566 - protein, 10 aa, Influenza virus
IDDQITDIWA

SEQ ID NO: 500567 - protein, 10 aa, Influenza virus
IDDQVTDIWA

SEQ ID NO: 500568 - protein, 10 aa, Influenza virus
IDECRTFFLT

SEQ ID NO: 500569 - protein, 10 aa, Influenza virus
IDEESRARIK

SEQ ID NO: 500570 - protein, 10 aa, Influenza virus
IDEGDGCFNF

SEQ ID NO: 500571 - protein, 10 aa, Influenza virus
IDEGDGCFNL

SEQ ID NO: 500572 - protein, 10 aa, Influenza virus
IDEGDGCFSI

SEQ ID NO: 500573 - protein, 10 aa, Influenza virus
IDEGDGCFSL

SEQ ID NO: 500574 - protein, 10 aa, Influenza virus
IDEGNGCFEL

SEQ ID NO: 500575 - protein, 10 aa, Influenza virus
IDEITTKINN

SEQ ID NO: 500576 - protein, 10 aa, Influenza virus
IDESCEGECF

SEQ ID NO: 500577 - protein, 10 aa, Influenza virus
IDFHWMLLDP

SEQ ID NO: 500578 - protein, 10 aa, Influenza virus
IDFRDMRKNT

SEQ ID NO: 500579 - protein, 10 aa, Influenza virus
IDGITNKINS

SEQ ID NO: 500580 - protein, 10 aa, Influenza virus
IDGITNKVNS

SEQ ID NO: 500581 - protein, 10 aa, Influenza virus
IDGKAPISLG

SEQ ID NO: 500582 - protein, 10 aa, Influenza virus
IDGTCTVVMT

SEQ ID NO: 500583 - protein, 10 aa, Influenza virus
IDGVTNKVNS

SEQ ID NO: 500584 - protein, 10 aa, Influenza virus
IDGWTTANSK

SEQ ID NO: 500585 - protein, 10 aa, Influenza virus
IDGWYGFHHS

SEQ ID NO: 500586 - protein, 10 aa, Influenza virus
IDGWYGFKHQ

SEQ ID NO: 500587 - protein, 10 aa, Influenza virus
IDGWYGFRHQ

SEQ ID NO: 500588 - protein, 10 aa, Influenza virus
IDGWYGYHHE

SEQ ID NO: 500589 - protein, 10 aa, Influenza virus
IDGWYGYHHQ

SEQ ID NO: 500590 - protein, 10 aa, Influenza virus
IDGWYGYHHS

SEQ ID NO: 500591 - protein, 10 aa, Influenza virus
IDGWYGYKHQ

SEQ ID NO: 500592 - protein, 10 aa, Influenza virus
IDGWYGYRHQ

SEQ ID NO: 500593 - protein, 10 aa, Influenza virus
IDIMQNKLNN

SEQ ID NO: 500594 - protein, 10 aa, Influenza virus
IDIWAYNAEL

SEQ ID NO: 500595 - protein, 10 aa, Influenza virus
IDIWTYNAEL

SEQ ID NO: 500596 - protein, 10 aa, Influenza virus
IDIYCICRDN

SEQ ID NO: 500597 - protein, 10 aa, Influenza virus
IDKEPMGFRY

SEQ ID NO: 500598 - protein, 10 aa, Influenza virus
IDKESMGFRY

SEQ ID NO: 500599 - protein, 10 aa, Influenza virus
IDKICLGHHA

SEQ ID NO: 500600 - protein, 10 aa, Influenza virus
IDKITNKINN

SEQ ID NO: 500601 - protein, 10 aa, Influenza virus
IDKITNKVNN

SEQ ID NO: 500602 - protein, 10 aa, Influenza virus
IDKMNGNYDS

SEQ ID NO: 500603 - protein, 10 aa, Influenza virus
IDKMNTQFEA

SEQ ID NO: 500604 - protein, 10 aa, Influenza virus
IDKMNTQFET

SEQ ID NO: 500605 - protein, 10 aa, Influenza virus
IDKMNTRFEA

SEQ ID NO: 500606 - protein, 10 aa, Influenza virus
IDKNALGDCP

SEQ ID NO: 500607 - protein, 10 aa, Influenza virus
IDKNALGECP

SEQ ID NO: 500608 - protein, 10 aa, Influenza virus
IDKTNQQFEL

SEQ ID NO: 500609 - protein, 10 aa, Influenza virus
IDKTNQQFEM

SEQ ID NO: 500610 - protein, 10 aa, Influenza virus
IDKVCTKGKK

SEQ ID NO: 500611 - protein, 10 aa, Influenza virus
IDLADSEMDK

SEQ ID NO: 500612 - protein, 10 aa, Influenza virus
IDLADSEMKK

SEQ ID NO: 500613 - protein, 10 aa, Influenza virus
IDLADSEMLN

SEQ ID NO: 500614 - protein, 10 aa, Influenza virus
IDLADSEMNK

SEQ ID NO: 500615 - protein, 10 aa, Influenza virus
IDLADSEMNN

SEQ ID NO: 500616 - protein, 10 aa, Influenza virus
IDLADSEMSK

SEQ ID NO: 500617 - protein, 10 aa, Influenza virus
IDLAESEMNK

SEQ ID NO: 500618 - protein, 10 aa, Influenza virus
IDLANSEMNK

SEQ ID NO: 500619 - protein, 10 aa, Influenza virus
IDLGQCGLLG

SEQ ID NO: 500620 - protein, 10 aa, Influenza virus
IDLTDSEMNK

SEQ ID NO: 500621 - protein, 10 aa, Influenza virus
IDLTDSEMSK

SEQ ID NO: 500622 - protein, 10 aa, Influenza virus
IDLVETNHTG

SEQ ID NO: 500623 - protein, 10 aa, Influenza virus
IDLWSYNADV

SEQ ID NO: 500624 - protein, 10 aa, Influenza virus
IDLWSYNAEL

SEQ ID NO: 500625 - protein, 10 aa, Influenza virus
IDLWSYNAGL

SEQ ID NO: 500626 - protein, 10 aa, Influenza virus
IDMADSEMLN

SEQ ID NO: 500627 - protein, 10 aa, Influenza virus
IDMADSTMLN

SEQ ID NO: 500628 - protein, 10 aa, Influenza virus
IDMTDSEMNK

SEQ ID NO: 500629 - protein, 10 aa, Influenza virus
IDNDNWSGYS

SEQ ID NO: 500630 - protein, 10 aa, Influenza virus
IDNEFTEVEQ

SEQ ID NO: 500631 - protein, 10 aa, Influenza virus
IDNGDGCFEI

SEQ ID NO: 500632 - protein, 10 aa, Influenza virus
IDNMQNKLNN

SEQ ID NO: 500633 - protein, 10 aa, Influenza virus
IDNMQNRLNN

SEQ ID NO: 500634 - protein, 10 aa, Influenza virus
IDNNNWSGYS

SEQ ID NO: 500635 - protein, 10 aa, Influenza virus
IDPKGLFGAI

SEQ ID NO: 500636 - protein, 10 aa, Influenza virus
IDPVELSSGY

SEQ ID NO: 500637 - protein, 10 aa, Influenza virus
IDPVKLSGGY

SEQ ID NO: 500638 - protein, 10 aa, Influenza virus
IDPVKLSSGY

SEQ ID NO: 500639 - protein, 10 aa, Influenza virus
IDQINGKLNR

SEQ ID NO: 500640 - protein, 10 aa, Influenza virus
IDQISGKLNR

SEQ ID NO: 500641 - protein, 10 aa, Influenza virus
IDQITGKLNH

SEQ ID NO: 500642 - protein, 10 aa, Influenza virus
IDQITGKLNR

SEQ ID NO: 500643 - protein, 10 aa, Influenza virus
IDQITGTLNR

SEQ ID NO: 500644 - protein, 10 aa, Influenza virus
IDQITTKINN

SEQ ID NO: 500645 - protein, 10 aa, Influenza virus
IDQSLIIAAR

SEQ ID NO: 500646 - protein, 10 aa, Influenza virus
IDQVKLSSGY

SEQ ID NO: 500647 - protein, 10 aa, Influenza virus
IDQVTGKLNR

SEQ ID NO: 500648 - protein, 10 aa, Influenza virus
IDRFLRVKDQ

SEQ ID NO: 500649 - protein, 10 aa, Influenza virus
IDRFLRVRDQ

SEQ ID NO: 500650 - protein, 10 aa, Influenza virus
IDRITTKINN

SEQ ID NO: 500651 - protein, 10 aa, Influenza virus
IDRNAIGDCP

SEQ ID NO: 500652 - protein, 10 aa, Influenza virus
IDRNALGDCP

SEQ ID NO: 500653 - protein, 10 aa, Influenza virus
IDRSFRPNIG

SEQ ID NO: 500654 - protein, 10 aa, Influenza virus
IDRTNHQFEL

SEQ ID NO: 500655 - protein, 10 aa, Influenza virus
IDSGYVCSGL

SEQ ID NO: 500656 - protein, 10 aa, Influenza virus
IDSIGSWSQN

SEQ ID NO: 500657 - protein, 10 aa, Influenza virus
IDSLLGDPHC

SEQ ID NO: 500658 - protein, 10 aa, Influenza virus
IDSNYVCSGL

SEQ ID NO: 500659 - protein, 10 aa, Influenza virus
IDSRAVGKCP

SEQ ID NO: 500660 - protein, 10 aa, Influenza virus
IDSSYICSGL

SEQ ID NO: 500661 - protein, 10 aa, Influenza virus
IDSSYLCSGL

SEQ ID NO: 500662 - protein, 10 aa, Influenza virus
IDSSYVCSGL

SEQ ID NO: 500663 - protein, 10 aa, Influenza virus
IDSTDSEMNK

SEQ ID NO: 500664 - protein, 10 aa, Influenza virus
IDSVKLSSGY

SEQ ID NO: 500665 - protein, 10 aa, Influenza virus
IDSWAVGRCP

SEQ ID NO: 500666 - protein, 10 aa, Influenza virus
IDTGDGCFEI

SEQ ID NO: 500667 - protein, 10 aa, Influenza virus
IDTGKGCFDI

SEQ ID NO: 500668 - protein, 10 aa, Influenza virus
IDTGNGCFDI

SEQ ID NO: 500669 - protein, 10 aa, Influenza virus
IDTILERNVT

SEQ ID NO: 500670 - protein, 10 aa, Influenza virus
IDTIMEKNVT

SEQ ID NO: 500671 - protein, 10 aa, Influenza virus
IDTLTETGVP

SEQ ID NO: 500672 - protein, 10 aa, Influenza virus
IDTNKTFQNI

SEQ ID NO: 500673 - protein, 10 aa, Influenza virus
IDVADSEMNK

SEQ ID NO: 500674 - protein, 10 aa, Influenza virus
IDVTDSEMDK

SEQ ID NO: 500675 - protein, 10 aa, Influenza virus
IDVTDSEMNK

SEQ ID NO: 500676 - protein, 10 aa, Influenza virus
IDVTDSEMNR

SEQ ID NO: 500677 - protein, 10 aa, Influenza virus
IDVWTYNAEL

SEQ ID NO: 500678 - protein, 10 aa, Influenza virus
IDVYCICRDN

SEQ ID NO: 500679 - protein, 10 aa, Influenza virus
IDVYCVCRDN

SEQ ID NO: 500680 - protein, 10 aa, Influenza virus
IEAESSIKEK

SEQ ID NO: 500681 - protein, 10 aa, Influenza virus
IEAESSVKEK

SEQ ID NO: 500682 - protein, 10 aa, Influenza virus
IEAESSVREK

SEQ ID NO: 500683 - protein, 10 aa, Influenza virus
IEAMASQGTK

SEQ ID NO: 500684 - protein, 10 aa, Influenza virus
IEAMATQGTK

SEQ ID NO: 500685 - protein, 10 aa, Influenza virus
IEARGLFGAI

SEQ ID NO: 500686 - protein, 10 aa, Influenza virus
IEAVIYGNPK

SEQ ID NO: 500687 - protein, 10 aa, Influenza virus
IECIGWSSTS

SEQ ID NO: 500688 - protein, 10 aa, Influenza virus
IECVCRDNWR

SEQ ID NO: 500689 - protein, 10 aa, Influenza virus
IECVGWSSTS

SEQ ID NO: 500690 - protein, 10 aa, Influenza virus
IEDLIFLARS

SEQ ID NO: 500691 - protein, 10 aa, Influenza virus
IEDLIFLTRS

SEQ ID NO: 500692 - protein, 10 aa, Influenza virus
IEDLIFMARS

SEQ ID NO: 500693 - protein, 10 aa, Influenza virus
IEDLIFSARS

SEQ ID NO: 500694 - protein, 10 aa, Influenza virus
IEDLTFLARS

SEQ ID NO: 500695 - protein, 10 aa, Influenza virus
IEDLWAYNAE

SEQ ID NO: 500696 - protein, 10 aa, Influenza virus
IEDPAAPHGL

SEQ ID NO: 500697 - protein, 10 aa, Influenza virus
IEDPDHEGEG

SEQ ID NO: 500698 - protein, 10 aa, Influenza virus
IEDPGAPHGL

SEQ ID NO: 500699 - protein, 10 aa, Influenza virus
IEDPNAPHKL

SEQ ID NO: 500700 - protein, 10 aa, Influenza virus
IEDPNAPNKF

SEQ ID NO: 500701 - protein, 10 aa, Influenza virus
IEDPNAPNKL

SEQ ID NO: 500702 - protein, 10 aa, Influenza virus
IEDPNHEGEG

SEQ ID NO: 500703 - protein, 10 aa, Influenza virus
IEDPSAPHGL

SEQ ID NO: 500704 - protein, 10 aa, Influenza virus
IEDPSAPHRL

SEQ ID NO: 500705 - protein, 10 aa, Influenza virus
IEDPSHEGEG

SEQ ID NO: 500706 - protein, 10 aa, Influenza virus
IEDPTAPHGL

SEQ ID NO: 500707 - protein, 10 aa, Influenza virus
IEDQITDIWA

SEQ ID NO: 500708 - protein, 10 aa, Influenza virus
IEECLINDPW

SEQ ID NO: 500709 - protein, 10 aa, Influenza virus
IEECSCYGHD

SEQ ID NO: 500710 - protein, 10 aa, Influenza virus
IEECSCYGHN

SEQ ID NO: 500711 - protein, 10 aa, Influenza virus
IEECSCYGHS

SEQ ID NO: 500712 - protein, 10 aa, Influenza virus
IEECSCYPND

SEQ ID NO: 500713 - protein, 10 aa, Influenza virus
IEECSCYPNE

SEQ ID NO: 500714 - protein, 10 aa, Influenza virus
IEECSCYPNL

SEQ ID NO: 500715 - protein, 10 aa, Influenza virus
IEECSCYPNM

SEQ ID NO: 500716 - protein, 10 aa, Influenza virus
IEECSCYPNS

SEQ ID NO: 500717 - protein, 10 aa, Influenza virus
IEECSCYPQY

SEQ ID NO: 500718 - protein, 10 aa, Influenza virus
IEECSCYPRY

SEQ ID NO: 500719 - protein, 10 aa, Influenza virus
IEEGSIGKVC

SEQ ID NO: 500720 - protein, 10 aa, Influenza virus
IEELRRQKSL

SEQ ID NO: 500721 - protein, 10 aa, Influenza virus
IEELRRQKWW

SEQ ID NO: 500722 - protein, 10 aa, Influenza virus
IEELWAYNAE

SEQ ID NO: 500723 - protein, 10 aa, Influenza virus
IEEWSCYGHS

SEQ ID NO: 500724 - protein, 10 aa, Influenza virus
IEEYGKGRIF

SEQ ID NO: 500725 - protein, 10 aa, Influenza virus
IEEYGRGRIF

SEQ ID NO: 500726 - protein, 10 aa, Influenza virus
IEFEPFQSLV

SEQ ID NO: 500727 - protein, 10 aa, Influenza virus
IEGGWCGMID

SEQ ID NO: 500728 - protein, 10 aa, Influenza virus
IEGGWPGLIN

SEQ ID NO: 500729 - protein, 10 aa, Influenza virus
IEGGWPGLVA

SEQ ID NO: 500730 - protein, 10 aa, Influenza virus
IEGGWQGLVD

SEQ ID NO: 500731 - protein, 10 aa, Influenza virus
IEGGWQGMID

SEQ ID NO: 500732 - protein, 10 aa, Influenza virus
IEGGWQGMVD

SEQ ID NO: 500733 - protein, 10 aa, Influenza virus
IEGGWSGLIA

SEQ ID NO: 500734 - protein, 10 aa, Influenza virus
IEGGWSGLVA

SEQ ID NO: 500735 - protein, 10 aa, Influenza virus
IEGGWSGLVD

SEQ ID NO: 500736 - protein, 10 aa, Influenza virus
IEGGWSGMID

SEQ ID NO: 500737 - protein, 10 aa, Influenza virus
IEGGWTGLID

SEQ ID NO: 500738 - protein, 10 aa, Influenza virus
IEGGWTGMID

SEQ ID NO: 500739 - protein, 10 aa, Influenza virus
IEGGWTGMVD

SEQ ID NO: 500740 - protein, 10 aa, Influenza virus
IEGGWTGMVN

SEQ ID NO: 500741 - protein, 10 aa, Influenza virus
IEGICYPGSI

SEQ ID NO: 500742 - protein, 10 aa, Influenza virus
IEGIKLKSED

SEQ ID NO: 500743 - protein, 10 aa, Influenza virus
IEGIKLKTED

SEQ ID NO: 500744 - protein, 10 aa, Influenza virus
IEGKLSQMSK

SEQ ID NO: 500745 - protein, 10 aa, Influenza virus
IEGKLSQMSR

SEQ ID NO: 500746 - protein, 10 aa, Influenza virus
IEGLWAYNAE

SEQ ID NO: 500747 - protein, 10 aa, Influenza virus
IEGRIQDLEK

SEQ ID NO: 500748 - protein, 10 aa, Influenza virus
IEGRWPGLVA

SEQ ID NO: 500749 - protein, 10 aa, Influenza virus
IEGWVVVAKD

SEQ ID NO: 500750 - protein, 10 aa, Influenza virus
IEHQIGNVIN

SEQ ID NO: 500751 - protein, 10 aa, Influenza virus
IEIITIGSIC

SEQ ID NO: 500752 - protein, 10 aa, Influenza virus
IEIWSYNAEF

SEQ ID NO: 500753 - protein, 10 aa, Influenza virus
IEKDNAVRFG

SEQ ID NO: 500754 - protein, 10 aa, Influenza virus
IEKEFEQVEG

SEQ ID NO: 500755 - protein, 10 aa, Influenza virus
IEKEFGQVEG

SEQ ID NO: 500756 - protein, 10 aa, Influenza virus
IEKEFSEIEG

SEQ ID NO: 500757 - protein, 10 aa, Influenza virus
IEKEFSEVEG

SEQ ID NO: 500758 - protein, 10 aa, Influenza virus
IEKIEKIRPL

SEQ ID NO: 500759 - protein, 10 aa, Influenza virus
IEKIRNGTYD

SEQ ID NO: 500760 - protein, 10 aa, Influenza virus
IEKITNKVNN

SEQ ID NO: 500761 - protein, 10 aa, Influenza virus
IEKMNGNYDS

SEQ ID NO: 500762 - protein, 10 aa, Influenza virus
IEKMNIQFTA

SEQ ID NO: 500763 - protein, 10 aa, Influenza virus
IEKMNIQFTS

SEQ ID NO: 500764 - protein, 10 aa, Influenza virus
IEKMNTQFTA

SEQ ID NO: 500765 - protein, 10 aa, Influenza virus
IEKMNTQFTV

SEQ ID NO: 500766 - protein, 10 aa, Influenza virus
IEKMVLSAFD

SEQ ID NO: 500767 - protein, 10 aa, Influenza virus
IEKNALGDCP

SEQ ID NO: 500768 - protein, 10 aa, Influenza virus
IEKQIGNVIN

SEQ ID NO: 500769 - protein, 10 aa, Influenza virus
IEKTNDKYHQ

SEQ ID NO: 500770 - protein, 10 aa, Influenza virus
IEKTNEKFHQ

SEQ ID NO: 500771 - protein, 10 aa, Influenza virus
IEKTNEKYHQ

SEQ ID NO: 500772 - protein, 10 aa, Influenza virus
IEKTNKQFEL

SEQ ID NO: 500773 - protein, 10 aa, Influenza virus
IEKTNQQFEL

SEQ ID NO: 500774 - protein, 10 aa, Influenza virus
IEKTNQQFKL

SEQ ID NO: 500775 - protein, 10 aa, Influenza virus
IEKTNTEFES

SEQ ID NO: 500776 - protein, 10 aa, Influenza virus
IEKTNTQFEL

SEQ ID NO: 500777 - protein, 10 aa, Influenza virus
IEKTSWSYIV

SEQ ID NO: 500778 - protein, 10 aa, Influenza virus
IEKVRNGTYD

SEQ ID NO: 500779 - protein, 10 aa, Influenza virus
IEKYGSGRIF

SEQ ID NO: 500780 - protein, 10 aa, Influenza virus
IEKYGTGRIF

SEQ ID NO: 500781 - protein, 10 aa, Influenza virus
IELAEKAMKE

SEQ ID NO: 500782 - protein, 10 aa, Influenza virus
IELIRGRPKE

SEQ ID NO: 500783 - protein, 10 aa, Influenza virus
IEMTDSEMLN

SEQ ID NO: 500784 - protein, 10 aa, Influenza virus
IENDRTLDLH

SEQ ID NO: 500785 - protein, 10 aa, Influenza virus
IENERTLDFH

SEQ ID NO: 500786 - protein, 10 aa, Influenza virus
IENGWEGLID

SEQ ID NO: 500787 - protein, 10 aa, Influenza virus
IENGWEGLIN

SEQ ID NO: 500788 - protein, 10 aa, Influenza virus
IENGWEGLVD

SEQ ID NO: 500789 - protein, 10 aa, Influenza virus
IENGWEGMID

SEQ ID NO: 500790 - protein, 10 aa, Influenza virus
IENGWEGMMD

SEQ ID NO: 500791 - protein, 10 aa, Influenza virus
IENGWEGMVD

SEQ ID NO: 500792 - protein, 10 aa, Influenza virus
IENGWEGMVE

SEQ ID NO: 500793 - protein, 10 aa, Influenza virus
IENGWEGMVN

SEQ ID NO: 500794 - protein, 10 aa, Influenza virus
IENGWQGLID

SEQ ID NO: 500795 - protein, 10 aa, Influenza virus
IENLEELRFV

SEQ ID NO: 500796 - protein, 10 aa, Influenza virus
IENLNKKIDD

SEQ ID NO: 500797 - protein, 10 aa, Influenza virus
IENLNKKMED

SEQ ID NO: 500798 - protein, 10 aa, Influenza virus
IENLNKKVDD

SEQ ID NO: 500799 - protein, 10 aa, Influenza virus
IENLNRKMED

SEQ ID NO: 500800 - protein, 10 aa, Influenza virus
IENLNRKVDD

SEQ ID NO: 500801 - protein, 10 aa, Influenza virus
IENLQAYQKR

SEQ ID NO: 500802 - protein, 10 aa, Influenza virus
IENLWAYNAE

SEQ ID NO: 500803 - protein, 10 aa, Influenza virus
IENNVTVTSS

SEQ ID NO: 500804 - protein, 10 aa, Influenza virus
IENPSHEGEG

SEQ ID NO: 500805 - protein, 10 aa, Influenza virus
IENQEELKSL

SEQ ID NO: 500806 - protein, 10 aa, Influenza virus
IENQEELRFL

SEQ ID NO: 500807 - protein, 10 aa, Influenza virus
IENQEELRSL

SEQ ID NO: 500808 - protein, 10 aa, Influenza virus
IENQHTIDLA

SEQ ID NO: 500809 - protein, 10 aa, Influenza virus
IENQKTLDEH

SEQ ID NO: 500810 - protein, 10 aa, Influenza virus
IENTYVNKTT

SEQ ID NO: 500811 - protein, 10 aa, Influenza virus
IENTYVNNTT

SEQ ID NO: 500812 - protein, 10 aa, Influenza virus
IEPKGLFGAI

SEQ ID NO: 500813 - protein, 10 aa, Influenza virus
IEPRGLFGAI

SEQ ID NO: 500814 - protein, 10 aa, Influenza virus
IEQNIPVTQV

SEQ ID NO: 500815 - protein, 10 aa, Influenza virus
IEQNVPVTQV

SEQ ID NO: 500816 - protein, 10 aa, Influenza virus
IEQQIGNVIN

SEQ ID NO: 500817 - protein, 10 aa, Influenza virus
IERMVLSAFD

SEQ ID NO: 500818 - protein, 10 aa, Influenza virus
IERNALGDCP

SEQ ID NO: 500819 - protein, 10 aa, Influenza virus
IERNALGNCP

SEQ ID NO: 500820 - protein, 10 aa, Influenza virus
IERPTAVDTC

SEQ ID NO: 500821 - protein, 10 aa, Influenza virus
IERRNSSDIC

SEQ ID NO: 500822 - protein, 10 aa, Influenza virus
IERTNEKFHQ

SEQ ID NO: 500823 - protein, 10 aa, Influenza virus
IERTNEKYHQ

SEQ ID NO: 500824 - protein, 10 aa, Influenza virus
IERTNQQFEL

SEQ ID NO: 500825 - protein, 10 aa, Influenza virus
IERVRNGTYD

SEQ ID NO: 500826 - protein, 10 aa, Influenza virus
IESEFNEIEH

SEQ ID NO: 500827 - protein, 10 aa, Influenza virus
IESEFNEIEY

SEQ ID NO: 500828 - protein, 10 aa, Influenza virus
IESEFSEIEH

SEQ ID NO: 500829 - protein, 10 aa, Influenza virus
IESEFSETEH

SEQ ID NO: 500830 - protein, 10 aa, Influenza virus
IESIIEAESS

SEQ ID NO: 500831 - protein, 10 aa, Influenza virus
IESIRNGTYD

SEQ ID NO: 500832 - protein, 10 aa, Influenza virus
IESIRNGTYN

SEQ ID NO: 500833 - protein, 10 aa, Influenza virus
IESKLSQMSK

SEQ ID NO: 500834 - protein, 10 aa, Influenza virus
IESLNKKMED

SEQ ID NO: 500835 - protein, 10 aa, Influenza virus
IESMIEAESS

SEQ ID NO: 500836 - protein, 10 aa, Influenza virus
IESMVEAESS

SEQ ID NO: 500837 - protein, 10 aa, Influenza virus
IESNGNLIAP

SEQ ID NO: 500838 - protein, 10 aa, Influenza virus
IESNVTVTNS

SEQ ID NO: 500839 - protein, 10 aa, Influenza virus
IESNVTVTSS

SEQ ID NO: 500840 - protein, 10 aa, Influenza virus
IESRGLFGAI

SEQ ID NO: 500841 - protein, 10 aa, Influenza virus
IETGYVCSKF

SEQ ID NO: 500842 - protein, 10 aa, Influenza virus
IETNHTGTYC

SEQ ID NO: 500843 - protein, 10 aa, Influenza virus
IETTHTGTYC

SEQ ID NO: 500844 - protein, 10 aa, Influenza virus
IEVLHLTQGA

SEQ ID NO: 500845 - protein, 10 aa, Influenza virus
IEVLHLTQGT

SEQ ID NO: 500846 - protein, 10 aa, Influenza virus
IEVTNATELV

SEQ ID NO: 500847 - protein, 10 aa, Influenza virus
IEVVAAQELV

SEQ ID NO: 500848 - protein, 10 aa, Influenza virus
IEVVNATETV

SEQ ID NO: 500849 - protein, 10 aa, Influenza virus
IEVVTAQELV

SEQ ID NO: 500850 - protein, 10 aa, Influenza virus
IEVWSYNAEF

SEQ ID NO: 500851 - protein, 10 aa, Influenza virus
IEYDAVATTH

SEQ ID NO: 500852 - protein, 10 aa, Influenza virus
IEYNGKSLGI

SEQ ID NO: 500853 - protein, 10 aa, Influenza virus
IEYQIGNVIN

SEQ ID NO: 500854 - protein, 10 aa, Influenza virus
IFESNGAFLA

SEQ ID NO: 500855 - protein, 10 aa, Influenza virus
IFFWMCSNGS

SEQ ID NO: 500856 - protein, 10 aa, Influenza virus
IFGAIAGFIE

SEQ ID NO: 500857 - protein, 10 aa, Influenza virus
IFGCQNGNIR

SEQ ID NO: 500858 - protein, 10 aa, Influenza virus
IFGCQNGNVR

SEQ ID NO: 500859 - protein, 10 aa, Influenza virus
IFGKDNAIRI

SEQ ID NO: 500860 - protein, 10 aa, Influenza virus
IFGKDNAVRI

SEQ ID NO: 500861 - protein, 10 aa, Influenza virus
IFGPVHFRNQ

SEQ ID NO: 500862 - protein, 10 aa, Influenza virus
IFHKCDDDCM

SEQ ID NO: 500863 - protein, 10 aa, Influenza virus
IFHKCDDHCM

SEQ ID NO: 500864 - protein, 10 aa, Influenza virus
IFHKCDDQCM

SEQ ID NO: 500865 - protein, 10 aa, Influenza virus
IFHKCDDRCM

SEQ ID NO: 500866 - protein, 10 aa, Influenza virus
IFHKCDNQCM

SEQ ID NO: 500867 - protein, 10 aa, Influenza virus
IFHQCDNDCM

SEQ ID NO: 500868 - protein, 10 aa, Influenza virus
IFHQCDNNCI

SEQ ID NO: 500869 - protein, 10 aa, Influenza virus
IFHRCDDQCM

SEQ ID NO: 500870 - protein, 10 aa, Influenza virus
IFIFILLTHW

SEQ ID NO: 500871 - protein, 10 aa, Influenza virus
IFIFLLLTHW

SEQ ID NO: 500872 - protein, 10 aa, Influenza virus
IFLAMITYIT

SEQ ID NO: 500873 - protein, 10 aa, Influenza virus
IFLARSALIL

SEQ ID NO: 500874 - protein, 10 aa, Influenza virus
IFLWCKIVTT

SEQ ID NO: 500875 - protein, 10 aa, Influenza virus
IFLWGIHHPP

SEQ ID NO: 500876 - protein, 10 aa, Influenza virus
IFLWMCSNGS

SEQ ID NO: 500877 - protein, 10 aa, Influenza virus
IFLYVRTNGT

SEQ ID NO: 500878 - protein, 10 aa, Influenza virus
IFMARSALIL

SEQ ID NO: 500879 - protein, 10 aa, Influenza virus
IFMCVKNGNL

SEQ ID NO: 500880 - protein, 10 aa, Influenza virus
IFMCVKNGNM

SEQ ID NO: 500881 - protein, 10 aa, Influenza virus
IFNFILLTHW

SEQ ID NO: 500882 - protein, 10 aa, Influenza virus
IFNGAFIAPD

SEQ ID NO: 500883 - protein, 10 aa, Influenza virus
IFNMERIKEL

SEQ ID NO: 500884 - protein, 10 aa, Influenza virus
IFNSIGNLIA

SEQ ID NO: 500885 - protein, 10 aa, Influenza virus
IFQPNIGPRP

SEQ ID NO: 500886 - protein, 10 aa, Influenza virus
IFRPNIGPRP

SEQ ID NO: 500887 - protein, 10 aa, Influenza virus
IFSARSALIL

SEQ ID NO: 500888 - protein, 10 aa, Influenza virus
IFSFNGEEMA

SEQ ID NO: 500889 - protein, 10 aa, Influenza virus
IFSFTGEEMA

SEQ ID NO: 500890 - protein, 10 aa, Influenza virus
IFSHNGGLIA

SEQ ID NO: 500891 - protein, 10 aa, Influenza virus
IFSKDNAIRI

SEQ ID NO: 500892 - protein, 10 aa, Influenza virus
IFSKDNGIRI

SEQ ID NO: 500893 - protein, 10 aa, Influenza virus
IFVIREPFIS

SEQ ID NO: 500894 - protein, 10 aa, Influenza virus
IFVIREPFVA

SEQ ID NO: 500895 - protein, 10 aa, Influenza virus
IFVIREPFVS

SEQ ID NO: 500896 - protein, 10 aa, Influenza virus
IFVMREPFIS

SEQ ID NO: 500897 - protein, 10 aa, Influenza virus
IGAIDSSMPF

SEQ ID NO: 500898 - protein, 10 aa, Influenza virus
IGAMASQGTK

SEQ ID NO: 500899 - protein, 10 aa, Influenza virus
IGAPQLNPID

SEQ ID NO: 500900 - protein, 10 aa, Influenza virus
IGARIGEGQR

SEQ ID NO: 500901 - protein, 10 aa, Influenza virus
IGARPQVNGQ

SEQ ID NO: 500902 - protein, 10 aa, Influenza virus
IGDCPKYIKS

SEQ ID NO: 500903 - protein, 10 aa, Influenza virus
IGDCPKYMNV

SEQ ID NO: 500904 - protein, 10 aa, Influenza virus
IGDCPKYVNI

SEQ ID NO: 500905 - protein, 10 aa, Influenza virus
IGDCPKYVNV

SEQ ID NO: 500906 - protein, 10 aa, Influenza virus
IGDGQRSWMK

SEQ ID NO: 500907 - protein, 10 aa, Influenza virus
IGEAPSPYNS

SEQ ID NO: 500908 - protein, 10 aa, Influenza virus
IGECPKYIKS

SEQ ID NO: 500909 - protein, 10 aa, Influenza virus
IGECPKYVKS

SEQ ID NO: 500910 - protein, 10 aa, Influenza virus
IGECPKYVRS

SEQ ID NO: 500911 - protein, 10 aa, Influenza virus
IGECPRYVKS

SEQ ID NO: 500912 - protein, 10 aa, Influenza virus
IGEDIAPIEH

SEQ ID NO: 500913 - protein, 10 aa, Influenza virus
IGEDIAPIEY

SEQ ID NO: 500914 - protein, 10 aa, Influenza virus
IGEDLAPIEY

SEQ ID NO: 500915 - protein, 10 aa, Influenza virus
IGEDSDILVT

SEQ ID NO: 500916 - protein, 10 aa, Influenza virus
IGEDSDVLVT

SEQ ID NO: 500917 - protein, 10 aa, Influenza virus
IGEDVAPIEH

SEQ ID NO: 500918 - protein, 10 aa, Influenza virus
IGEDVAPIEY

SEQ ID NO: 500919 - protein, 10 aa, Influenza virus
IGEGQRSWMK

SEQ ID NO: 500920 - protein, 10 aa, Influenza virus
IGEKSDVLVT

SEQ ID NO: 500921 - protein, 10 aa, Influenza virus
IGENSDVLVT

SEQ ID NO: 500922 - protein, 10 aa, Influenza virus
IGENSGVLVT

SEQ ID NO: 500923 - protein, 10 aa, Influenza virus
IGEVPSPYNS

SEQ ID NO: 500924 - protein, 10 aa, Influenza virus
IGEYPVVKGE

SEQ ID NO: 500925 - protein, 10 aa, Influenza virus
IGFHFEECSC

SEQ ID NO: 500926 - protein, 10 aa, Influenza virus
IGFWMCSNGS

SEQ ID NO: 500927 - protein, 10 aa, Influenza virus
IGGFIFGCQN

SEQ ID NO: 500928 - protein, 10 aa, Influenza virus
IGGSGTDNYG

SEQ ID NO: 500929 - protein, 10 aa, Influenza virus
IGGSGTNNYG

SEQ ID NO: 500930 - protein, 10 aa, Influenza virus
IGGWATANSK

SEQ ID NO: 500931 - protein, 10 aa, Influenza virus
IGGWTIANSK

SEQ ID NO: 500932 - protein, 10 aa, Influenza virus
IGGWTTANSK

SEQ ID NO: 500933 - protein, 10 aa, Influenza virus
IGHHANNSTE

SEQ ID NO: 500934 - protein, 10 aa, Influenza virus
IGIAADRDST

SEQ ID NO: 500935 - protein, 10 aa, Influenza virus
IGIGNLIFNT

SEQ ID NO: 500936 - protein, 10 aa, Influenza virus
IGIGNLVFNT

SEQ ID NO: 500937 - protein, 10 aa, Influenza virus
IGISGPDDGA

SEQ ID NO: 500938 - protein, 10 aa, Influenza virus
IGISGPDNEA

SEQ ID NO: 500939 - protein, 10 aa, Influenza virus
IGISGPDNGA

SEQ ID NO: 500940 - protein, 10 aa, Influenza virus
IGISGPDSGA

SEQ ID NO: 500941 - protein, 10 aa, Influenza virus
IGISNVGLNI

SEQ ID NO: 500942 - protein, 10 aa, Influenza virus
IGISNVGLNV

SEQ ID NO: 500943 - protein, 10 aa, Influenza virus
IGISSMVEAM

SEQ ID NO: 500944 - protein, 10 aa, Influenza virus
IGITGPDATA

SEQ ID NO: 500945 - protein, 10 aa, Influenza virus
IGITVIKNNM

SEQ ID NO: 500946 - protein, 10 aa, Influenza virus
IGKCNDPYPG

SEQ ID NO: 500947 - protein, 10 aa, Influenza virus
IGKCPKYIPS

SEQ ID NO: 500948 - protein, 10 aa, Influenza virus
IGKCPKYISS

SEQ ID NO: 500949 - protein, 10 aa, Influenza virus
IGKCPKYVKS

SEQ ID NO: 500950 - protein, 10 aa, Influenza virus
IGKCPRYIPS

SEQ ID NO: 500951 - protein, 10 aa, Influenza virus
IGKCPRYVKQ

SEQ ID NO: 500952 - protein, 10 aa, Influenza virus
IGKFYIQMCT

SEQ ID NO: 500953 - protein, 10 aa, Influenza virus
IGKITNKVNN

SEQ ID NO: 500954 - protein, 10 aa, Influenza virus
IGKMNTQFEA

SEQ ID NO: 500955 - protein, 10 aa, Influenza virus
IGKTNEKFHQ

SEQ ID NO: 500956 - protein, 10 aa, Influenza virus
IGKTNQQFEL

SEQ ID NO: 500957 - protein, 10 aa, Influenza virus
IGKTSWSYIV

SEQ ID NO: 500958 - protein, 10 aa, Influenza virus
IGKVCRTLLA

SEQ ID NO: 500959 - protein, 10 aa, Influenza virus
IGLLLQIISL

SEQ ID NO: 500960 - protein, 10 aa, Influenza virus
IGLLLQITSL

SEQ ID NO: 500961 - protein, 10 aa, Influenza virus
IGLREQKQEF

SEQ ID NO: 500962 - protein, 10 aa, Influenza virus
IGLRISSSFS

SEQ ID NO: 500963 - protein, 10 aa, Influenza virus
IGLRNTPSIE

SEQ ID NO: 500964 - protein, 10 aa, Influenza virus
IGLRNVPQAQ

SEQ ID NO: 500965 - protein, 10 aa, Influenza virus
IGLRNVPQIE

SEQ ID NO: 500966 - protein, 10 aa, Influenza virus
IGLRNVPQIQ

SEQ ID NO: 500967 - protein, 10 aa, Influenza virus
IGLRNVPQVQ

SEQ ID NO: 500968 - protein, 10 aa, Influenza virus
IGLSPNVYQA

SEQ ID NO: 500969 - protein, 10 aa, Influenza virus
IGNCPKYVKQ

SEQ ID NO: 500970 - protein, 10 aa, Influenza virus
IGNCPKYVNV

SEQ ID NO: 500971 - protein, 10 aa, Influenza virus
IGNGCFEFYH

SEQ ID NO: 500972 - protein, 10 aa, Influenza virus
IGNLAFNAVI

SEQ ID NO: 500973 - protein, 10 aa, Influenza virus
IGNLIAPRGH

SEQ ID NO: 500974 - protein, 10 aa, Influenza virus
IGNLIFNTVI

SEQ ID NO: 500975 - protein, 10 aa, Influenza virus
IGNLVAPRGH

SEQ ID NO: 500976 - protein, 10 aa, Influenza virus
IGNLVFNTVI

SEQ ID NO: 500977 - protein, 10 aa, Influenza virus
IGNVINWTKD

SEQ ID NO: 500978 - protein, 10 aa, Influenza virus
IGNVINWTQD

SEQ ID NO: 500979 - protein, 10 aa, Influenza virus
IGNVINWTRD

SEQ ID NO: 500980 - protein, 10 aa, Influenza virus
IGPLSGSAQH

SEQ ID NO: 500981 - protein, 10 aa, Influenza virus
IGPPHCDQFL

SEQ ID NO: 500982 - protein, 10 aa, Influenza virus
IGPPQCDKFL

SEQ ID NO: 500983 - protein, 10 aa, Influenza virus
IGPPQCDLFL

SEQ ID NO: 500984 - protein, 10 aa, Influenza virus
IGPPQCDLHL

SEQ ID NO: 500985 - protein, 10 aa, Influenza virus
IGPPQCDQFL

SEQ ID NO: 500986 - protein, 10 aa, Influenza virus
IGPPQCDRFL

SEQ ID NO: 500987 - protein, 10 aa, Influenza virus
IGPPQCDSHL

SEQ ID NO: 500988 - protein, 10 aa, Influenza virus
IGPRALVRGQ

SEQ ID NO: 500989 - protein, 10 aa, Influenza virus
IGPRNVPQAQ

SEQ ID NO: 500990 - protein, 10 aa, Influenza virus
IGPRNVPQVQ

SEQ ID NO: 500991 - protein, 10 aa, Influenza virus
IGPRPFVRGQ

SEQ ID NO: 500992 - protein, 10 aa, Influenza virus
IGPRPLIRGQ

SEQ ID NO: 500993 - protein, 10 aa, Influenza virus
IGPRPLVMGQ

SEQ ID NO: 500994 - protein, 10 aa, Influenza virus
IGPRPLVREQ

SEQ ID NO: 500995 - protein, 10 aa, Influenza virus
IGPRPLVRGQ

SEQ ID NO: 500996 - protein, 10 aa, Influenza virus
IGQAADLKST

SEQ ID NO: 500997 - protein, 10 aa, Influenza virus
IGQAADYKST

SEQ ID NO: 500998 - protein, 10 aa, Influenza virus
IGQGDIVLVM

SEQ ID NO: 500999 - protein, 10 aa, Influenza virus
IGQGDVVLVM

SEQ ID NO: 501000 - protein, 10 aa, Influenza virus
IGQSANVYQA

SEQ ID NO: 501001 - protein, 10 aa, Influenza virus
IGQSPNVYQA

SEQ ID NO: 501002 - protein, 10 aa, Influenza virus
IGQSPNVYQS

SEQ ID NO: 501003 - protein, 10 aa, Influenza virus
IGRFYIQMCT

SEQ ID NO: 501004 - protein, 10 aa, Influenza virus
IGRFYVQMCT

SEQ ID NO: 501005 - protein, 10 aa, Influenza virus
IGRMTICIQG

SEQ ID NO: 501006 - protein, 10 aa, Influenza virus
IGRMTICVQG

SEQ ID NO: 501007 - protein, 10 aa, Influenza virus
IGRTKSLESR

SEQ ID NO: 501008 - protein, 10 aa, Influenza virus
IGRTNQQFEL

SEQ ID NO: 501009 - protein, 10 aa, Influenza virus
IGSCASKCHT

SEQ ID NO: 501010 - protein, 10 aa, Influenza virus
IGSCESKCHT

SEQ ID NO: 501011 - protein, 10 aa, Influenza virus
IGSCISKCHT

SEQ ID NO: 501012 - protein, 10 aa, Influenza virus
IGSCTSPCLT

SEQ ID NO: 501013 - protein, 10 aa, Influenza virus
IGSCVSKCHT

SEQ ID NO: 501014 - protein, 10 aa, Influenza virus
IGSCVSRCHT

SEQ ID NO: 501015 - protein, 10 aa, Influenza virus
IGSGFFPDGP

SEQ ID NO: 501016 - protein, 10 aa, Influenza virus
IGSIRNETYD

SEQ ID NO: 501017 - protein, 10 aa, Influenza virus
IGSIRNGTYD

SEQ ID NO: 501018 - protein, 10 aa, Influenza virus
IGSIRNGTYN

SEQ ID NO: 501019 - protein, 10 aa, Influenza virus
IGSKGDIFVI

SEQ ID NO: 501020 - protein, 10 aa, Influenza virus
IGSKGDIFVM

SEQ ID NO: 501021 - protein, 10 aa, Influenza virus
IGSKGDVFVI

SEQ ID NO: 501022 - protein, 10 aa, Influenza virus
IGSKGDVFVM

SEQ ID NO: 501023 - protein, 10 aa, Influenza virus
IGSKGHVFVI

SEQ ID NO: 501024 - protein, 10 aa, Influenza virus
IGSRGEVFVI

SEQ ID NO: 501025 - protein, 10 aa, Influenza virus
IGSRGHIFVI

SEQ ID NO: 501026 - protein, 10 aa, Influenza virus
IGSRGHVFVI

SEQ ID NO: 501027 - protein, 10 aa, Influenza virus
IGSRPRVRNQ

SEQ ID NO: 501028 - protein, 10 aa, Influenza virus
IGSSTYQNNF

SEQ ID NO: 501029 - protein, 10 aa, Influenza virus
IGSSYVCSGL

SEQ ID NO: 501030 - protein, 10 aa, Influenza virus
IGSVSLIIAT

SEQ ID NO: 501031 - protein, 10 aa, Influenza virus
IGSVSLTIAA

SEQ ID NO: 501032 - protein, 10 aa, Influenza virus
IGSVSLTIAI

SEQ ID NO: 501033 - protein, 10 aa, Influenza virus
IGSVSLTIAT

SEQ ID NO: 501034 - protein, 10 aa, Influenza virus
IGSVSLTITT

SEQ ID NO: 501035 - protein, 10 aa, Influenza virus
IGSWSHNILR

SEQ ID NO: 501036 - protein, 10 aa, Influenza virus
IGSWSQNILR

SEQ ID NO: 501037 - protein, 10 aa, Influenza virus
IGTAPILGNY

SEQ ID NO: 501038 - protein, 10 aa, Influenza virus
IGTAPVLGNY

SEQ ID NO: 501039 - protein, 10 aa, Influenza virus
IGTRIGDGQR

SEQ ID NO: 501040 - protein, 10 aa, Influenza virus
IGTSTLNQRL

SEQ ID NO: 501041 - protein, 10 aa, Influenza virus
IGVAPSPSNS

SEQ ID NO: 501042 - protein, 10 aa, Influenza virus
IGVAPVLGNY

SEQ ID NO: 501043 - protein, 10 aa, Influenza virus
IGVAVIKNNM

SEQ ID NO: 501044 - protein, 10 aa, Influenza virus
IGVGNLAFNT

SEQ ID NO: 501045 - protein, 10 aa, Influenza virus
IGVGNLIFNT

SEQ ID NO: 501046 - protein, 10 aa, Influenza virus
IGVGNLVFNT

SEQ ID NO: 501047 - protein, 10 aa, Influenza virus
IGVSGPDNGA

SEQ ID NO: 501048 - protein, 10 aa, Influenza virus
IGVTRREIHI

SEQ ID NO: 501049 - protein, 10 aa, Influenza virus
IGVTRREVHI

SEQ ID NO: 501050 - protein, 10 aa, Influenza virus
IGVTRREVHM

SEQ ID NO: 501051 - protein, 10 aa, Influenza virus
IGVTRREVHT

SEQ ID NO: 501052 - protein, 10 aa, Influenza virus
IGVTRREVHV

SEQ ID NO: 501053 - protein, 10 aa, Influenza virus
IGVTVIKNNM

SEQ ID NO: 501054 - protein, 10 aa, Influenza virus
IGVTVIRNNM

SEQ ID NO: 501055 - protein, 10 aa, Influenza virus
IGWSSTSCHD

SEQ ID NO: 501056 - protein, 10 aa, Influenza virus
IGYHANNSKK

SEQ ID NO: 501057 - protein, 10 aa, Influenza virus
IGYHANNSTD

SEQ ID NO: 501058 - protein, 10 aa, Influenza virus
IGYHANNSTE

SEQ ID NO: 501059 - protein, 10 aa, Influenza virus
IGYHANNSTK

SEQ ID NO: 501060 - protein, 10 aa, Influenza virus
IGYHANNSTT

SEQ ID NO: 501061 - protein, 10 aa, Influenza virus
IGYHANNSTV

SEQ ID NO: 501062 - protein, 10 aa, Influenza virus
IGYHSNNSTE

SEQ ID NO: 501063 - protein, 10 aa, Influenza virus
IGYHSNNSTK

SEQ ID NO: 501064 - protein, 10 aa, Influenza virus
IGYICSGFFG

SEQ ID NO: 501065 - protein, 10 aa, Influenza virus
IGYICSGIFG

SEQ ID NO: 501066 - protein, 10 aa, Influenza virus
IGYICSGVFG

SEQ ID NO: 501067 - protein, 10 aa, Influenza virus
IGYICSGVLG

SEQ ID NO: 501068 - protein, 10 aa, Influenza virus
IGYLSNNATD

SEQ ID NO: 501069 - protein, 10 aa, Influenza virus
IGYLSNNSSD

SEQ ID NO: 501070 - protein, 10 aa, Influenza virus
IGYLSNNSTD

SEQ ID NO: 501071 - protein, 10 aa, Influenza virus
IGYLSNNSTE

SEQ ID NO: 501072 - protein, 10 aa, Influenza virus
IGYLSTNSSE

SEQ ID NO: 501073 - protein, 10 aa, Influenza virus
IGYMSNNSTE

SEQ ID NO: 501074 - protein, 10 aa, Influenza virus
IGYQSNNSTD

SEQ ID NO: 501075 - protein, 10 aa, Influenza virus
IGYQSNNSTN

SEQ ID NO: 501076 - protein, 10 aa, Influenza virus
IGYQTNNSTD

SEQ ID NO: 501077 - protein, 10 aa, Influenza virus
IGYQTNNSTE

SEQ ID NO: 501078 - protein, 10 aa, Influenza virus
IGYVCSGIFG

SEQ ID NO: 501079 - protein, 10 aa, Influenza virus
IGYVCSGVFG

SEQ ID NO: 501080 - protein, 10 aa, Influenza virus
IHDGTAFRGL

SEQ ID NO: 501081 - protein, 10 aa, Influenza virus
IHDRAAFRGL

SEQ ID NO: 501082 - protein, 10 aa, Influenza virus
IHDRIPHRTL

SEQ ID NO: 501083 - protein, 10 aa, Influenza virus
IHDRSPFRAL

SEQ ID NO: 501084 - protein, 10 aa, Influenza virus
IHDRSPHRTL

SEQ ID NO: 501085 - protein, 10 aa, Influenza virus
IHDRSPYRAL

SEQ ID NO: 501086 - protein, 10 aa, Influenza virus
IHDRSQFRAL

SEQ ID NO: 501087 - protein, 10 aa, Influenza virus
IHDRSQYRAL

SEQ ID NO: 501088 - protein, 10 aa, Influenza virus
IHDRSQYRSL

SEQ ID NO: 501089 - protein, 10 aa, Influenza virus
IHDRTAFRGL

SEQ ID NO: 501090 - protein, 10 aa, Influenza virus
IHDRTPHRTL

SEQ ID NO: 501091 - protein, 10 aa, Influenza virus
IHDRTTFRGL

SEQ ID NO: 501092 - protein, 10 aa, Influenza virus
IHECRTFFLT

SEQ ID NO: 501093 - protein, 10 aa, Influenza virus
IHFESNGNFI

SEQ ID NO: 501094 - protein, 10 aa, Influenza virus
IHHPDSETTA

SEQ ID NO: 501095 - protein, 10 aa, Influenza virus
IHHPDTEATA

SEQ ID NO: 501096 - protein, 10 aa, Influenza virus
IHHPDTEAVA

SEQ ID NO: 501097 - protein, 10 aa, Influenza virus
IHHPDTEEVA

SEQ ID NO: 501098 - protein, 10 aa, Influenza virus
IHHPDTETTA

SEQ ID NO: 501099 - protein, 10 aa, Influenza virus
IHHPPDAKEQ

SEQ ID NO: 501100 - protein, 10 aa, Influenza virus
IHHPPDETEQ

SEQ ID NO: 501101 - protein, 10 aa, Influenza virus
IHHPPDTKEQ

SEQ ID NO: 501102 - protein, 10 aa, Influenza virus
IHHPPNTKEQ

SEQ ID NO: 501103 - protein, 10 aa, Influenza virus
IHHPPTSAEQ

SEQ ID NO: 501104 - protein, 10 aa, Influenza virus
IHHPPTSDEQ

SEQ ID NO: 501105 - protein, 10 aa, Influenza virus
IHHPPTSNEQ

SEQ ID NO: 501106 - protein, 10 aa, Influenza virus
IHHPPTTDEQ

SEQ ID NO: 501107 - protein, 10 aa, Influenza virus
IHHPSSAQEK

SEQ ID NO: 501108 - protein, 10 aa, Influenza virus
IHHPSSTKEK

SEQ ID NO: 501109 - protein, 10 aa, Influenza virus
IHHPSSTQEK

SEQ ID NO: 501110 - protein, 10 aa, Influenza virus
IHIFSFNGEE

SEQ ID NO: 501111 - protein, 10 aa, Influenza virus
IHIFSFTGEE

SEQ ID NO: 501112 - protein, 10 aa, Influenza virus
IHISPLSGSA

SEQ ID NO: 501113 - protein, 10 aa, Influenza virus
IHKQLTHHMR

SEQ ID NO: 501114 - protein, 10 aa, Influenza virus
IHLGDCSFEG

SEQ ID NO: 501115 - protein, 10 aa, Influenza virus
IHLTDSEMNK

SEQ ID NO: 501116 - protein, 10 aa, Influenza virus
IHPLAIGECP

SEQ ID NO: 501117 - protein, 10 aa, Influenza virus
IHPLTIGECP

SEQ ID NO: 501118 - protein, 10 aa, Influenza virus
IHPLTIGKCP

SEQ ID NO: 501119 - protein, 10 aa, Influenza virus
IHPLTMGECP

SEQ ID NO: 501120 - protein, 10 aa, Influenza virus
IHQILAIYST

SEQ ID NO: 501121 - protein, 10 aa, Influenza virus
IHSRGLFGAI

SEQ ID NO: 501122 - protein, 10 aa, Influenza virus
IHTRGLFGAI

SEQ ID NO: 501123 - protein, 10 aa, Influenza virus
IHWTIVKPGD

SEQ ID NO: 501124 - protein, 10 aa, Influenza virus
IHYGGIPTDV

SEQ ID NO: 501125 - protein, 10 aa, Influenza virus
IHYGGMPTDV

SEQ ID NO: 501126 - protein, 10 aa, Influenza virus
IHYGGVPTDV

SEQ ID NO: 501127 - protein, 10 aa, Influenza virus
IIAARNIVRR

SEQ ID NO: 501128 - protein, 10 aa, Influenza virus
IIAARSIVRR

SEQ ID NO: 501129 - protein, 10 aa, Influenza virus
IIAFCGTSGT

SEQ ID NO: 501130 - protein, 10 aa, Influenza virus
IICIQGNNDN

SEQ ID NO: 501131 - protein, 10 aa, Influenza virus
IICLGHHAVE

SEQ ID NO: 501132 - protein, 10 aa, Influenza virus
IICTCRDNWQ

SEQ ID NO: 501133 - protein, 10 aa, Influenza virus
IICVCRDNWH

SEQ ID NO: 501134 - protein, 10 aa, Influenza virus
IIDIWAYNAE

SEQ ID NO: 501135 - protein, 10 aa, Influenza virus
IIDKMNGNYD

SEQ ID NO: 501136 - protein, 10 aa, Influenza virus
IIDKMNTQFE

SEQ ID NO: 501137 - protein, 10 aa, Influenza virus
IIDKMNTRFE

SEQ ID NO: 501138 - protein, 10 aa, Influenza virus
IIDLADSEMN

SEQ ID NO: 501139 - protein, 10 aa, Influenza virus
IIDNDNWSGY

SEQ ID NO: 501140 - protein, 10 aa, Influenza virus
IIDNNNWSGY

SEQ ID NO: 501141 - protein, 10 aa, Influenza virus
IIEAESSVKE

SEQ ID NO: 501142 - protein, 10 aa, Influenza virus
IIEEYGKGRI

SEQ ID NO: 501143 - protein, 10 aa, Influenza virus
IIEEYGRGRI

SEQ ID NO: 501144 - protein, 10 aa, Influenza virus
IIEKMNGNYD

SEQ ID NO: 501145 - protein, 10 aa, Influenza virus
IIEKMNTQFT

SEQ ID NO: 501146 - protein, 10 aa, Influenza virus
IIEKYGSGRI

SEQ ID NO: 501147 - protein, 10 aa, Influenza virus
IIEKYGTGRI

SEQ ID NO: 501148 - protein, 10 aa, Influenza virus
IIENNVTVTS

SEQ ID NO: 501149 - protein, 10 aa, Influenza virus
IIERRNSSDI

SEQ ID NO: 501150 - protein, 10 aa, Influenza virus
IIESNVTVTN

SEQ ID NO: 501151 - protein, 10 aa, Influenza virus
IIESNVTVTS

SEQ ID NO: 501152 - protein, 10 aa, Influenza virus
IIETGYVCSK

SEQ ID NO: 501153 - protein, 10 aa, Influenza virus
IIFLWGIHHP

SEQ ID NO: 501154 - protein, 10 aa, Influenza virus
IIFNMERIKE

SEQ ID NO: 501155 - protein, 10 aa, Influenza virus
IIFNSIGNLI

SEQ ID NO: 501156 - protein, 10 aa, Influenza virus
IIFSHNGGLI

SEQ ID NO: 501157 - protein, 10 aa, Influenza virus
IIGGFIFGCQ

SEQ ID NO: 501158 - protein, 10 aa, Influenza virus
IIGISNVGLN

SEQ ID NO: 501159 - protein, 10 aa, Influenza virus
IIGKMNTQFE

SEQ ID NO: 501160 - protein, 10 aa, Influenza virus
IIGPPQCDLH

SEQ ID NO: 501161 - protein, 10 aa, Influenza virus
IIGPPQCDSH

SEQ ID NO: 501162 - protein, 10 aa, Influenza virus
IIHISPLSGS

SEQ ID NO: 501163 - protein, 10 aa, Influenza virus
IIIAIGSVSR

SEQ ID NO: 501164 - protein, 10 aa, Influenza virus
IIIRMMENAR

SEQ ID NO: 501165 - protein, 10 aa, Influenza virus
IIIVVLLYTF

SEQ ID NO: 501166 - protein, 10 aa, Influenza virus
IIKGRSHLRN

SEQ ID NO: 501167 - protein, 10 aa, Influenza virus
IIKKYTSARQ

SEQ ID NO: 501168 - protein, 10 aa, Influenza virus
IIKKYTSGRQ

SEQ ID NO: 501169 - protein, 10 aa, Influenza virus
IIKLLPFAAA

SEQ ID NO: 501170 - protein, 10 aa, Influenza virus
IIKLLPFASA

SEQ ID NO: 501171 - protein, 10 aa, Influenza virus
IIKMLPFAAA

SEQ ID NO: 501172 - protein, 10 aa, Influenza virus
IIKTLTNEKE

SEQ ID NO: 501173 - protein, 10 aa, Influenza virus
IILGNPKCDL

SEQ ID NO: 501174 - protein, 10 aa, Influenza virus
IILWFSFGAS

SEQ ID NO: 501175 - protein, 10 aa, Influenza virus
IILWFSFSIS

SEQ ID NO: 501176 - protein, 10 aa, Influenza virus
IILWISFSIS

SEQ ID NO: 501177 - protein, 10 aa, Influenza virus
IILWISFSMS

SEQ ID NO: 501178 - protein, 10 aa, Influenza virus
IILWVSFSIS

SEQ ID NO: 501179 - protein, 10 aa, Influenza virus
IINGALGSPG

SEQ ID NO: 501180 - protein, 10 aa, Influenza virus
IINKMNTQFE

SEQ ID NO: 501181 - protein, 10 aa, Influenza virus
IINLLIGISN

SEQ ID NO: 501182 - protein, 10 aa, Influenza virus
IINNQNWSGY

SEQ ID NO: 501183 - protein, 10 aa, Influenza virus
IINNYHNETN

SEQ ID NO: 501184 - protein, 10 aa, Influenza virus
IINNYYNDTN

SEQ ID NO: 501185 - protein, 10 aa, Influenza virus
IINNYYNETN

SEQ ID NO: 501186 - protein, 10 aa, Influenza virus
IINNYYNKTN

SEQ ID NO: 501187 - protein, 10 aa, Influenza virus
IINSWHIYGK

SEQ ID NO: 501188 - protein, 10 aa, Influenza virus
IINWTRDSMT

SEQ ID NO: 501189 - protein, 10 aa, Influenza virus
IIPSGPLKAE

SEQ ID NO: 501190 - protein, 10 aa, Influenza virus
IIQNEDIPIE

SEQ ID NO: 501191 - protein, 10 aa, Influenza virus
IIQNEDIPIG

SEQ ID NO: 501192 - protein, 10 aa, Influenza virus
IIRALTLNTM

SEQ ID NO: 501193 - protein, 10 aa, Influenza virus
IIREPFVSCS

SEQ ID NO: 501194 - protein, 10 aa, Influenza virus
IIRESGGIDK

SEQ ID NO: 501195 - protein, 10 aa, Influenza virus
IIRVGCVILL

SEQ ID NO: 501196 - protein, 10 aa, Influenza virus
IISKDNGIRI

SEQ ID NO: 501197 - protein, 10 aa, Influenza virus
IISLCSIWFS

SEQ ID NO: 501198 - protein, 10 aa, Influenza virus
IISMCSSTEF

SEQ ID NO: 501199 - protein, 10 aa, Influenza virus
IISNLPFQNI

SEQ ID NO: 501200 - protein, 10 aa, Influenza virus
IISSLPFQNI

SEQ ID NO: 501201 - protein, 10 aa, Influenza virus
IITDTFKSWK

SEQ ID NO: 501202 - protein, 10 aa, Influenza virus
IITDTLKSWK

SEQ ID NO: 501203 - protein, 10 aa, Influenza virus
IITELPFQNL

SEQ ID NO: 501204 - protein, 10 aa, Influenza virus
IITHFQRKRR

SEQ ID NO: 501205 - protein, 10 aa, Influenza virus
IITIGSASLG

SEQ ID NO: 501206 - protein, 10 aa, Influenza virus
IITIGSICMV

SEQ ID NO: 501207 - protein, 10 aa, Influenza virus
IITIGSISLG

SEQ ID NO: 501208 - protein, 10 aa, Influenza virus
IITIGSMSLA

SEQ ID NO: 501209 - protein, 10 aa, Influenza virus
IITIGSVSLA

SEQ ID NO: 501210 - protein, 10 aa, Influenza virus
IITIGSVSLI

SEQ ID NO: 501211 - protein, 10 aa, Influenza virus
IITIGSVSLT

SEQ ID NO: 501212 - protein, 10 aa, Influenza virus
IITREPYVSC

SEQ ID NO: 501213 - protein, 10 aa, Influenza virus
IIVFCGTSGT

SEQ ID NO: 501214 - protein, 10 aa, Influenza virus
IIVFNTIGNL

SEQ ID NO: 501215 - protein, 10 aa, Influenza virus
IIVILVLGLS

SEQ ID NO: 501216 - protein, 10 aa, Influenza virus
IIVTREPYVS

SEQ ID NO: 501217 - protein, 10 aa, Influenza virus
IIWGIHHPSS

SEQ ID NO: 501218 - protein, 10 aa, Influenza virus
IIYSSSMMWE

SEQ ID NO: 501219 - protein, 10 aa, Influenza virus
IKAVRGDLNF

SEQ ID NO: 501220 - protein, 10 aa, Influenza virus
IKCICRDNWK

SEQ ID NO: 501221 - protein, 10 aa, Influenza virus
IKCICRDNWR

SEQ ID NO: 501222 - protein, 10 aa, Influenza virus
IKCVCRDNWK

SEQ ID NO: 501223 - protein, 10 aa, Influenza virus
IKDRSPYRTL

SEQ ID NO: 501224 - protein, 10 aa, Influenza virus
IKDYRYTYRC

SEQ ID NO: 501225 - protein, 10 aa, Influenza virus
IKGDYNNTTG

SEQ ID NO: 501226 - protein, 10 aa, Influenza virus
IKGFAPFSKD

SEQ ID NO: 501227 - protein, 10 aa, Influenza virus
IKGRSHLRND

SEQ ID NO: 501228 - protein, 10 aa, Influenza virus
IKGVELSSMG

SEQ ID NO: 501229 - protein, 10 aa, Influenza virus
IKGVKLSNMG

SEQ ID NO: 501230 - protein, 10 aa, Influenza virus
IKGVKLSSMG

SEQ ID NO: 501231 - protein, 10 aa, Influenza virus
IKGVYINTAL

SEQ ID NO: 501232 - protein, 10 aa, Influenza virus
IKGWAPLSKD

SEQ ID NO: 501233 - protein, 10 aa, Influenza virus
IKHENRMVLA

SEQ ID NO: 501234 - protein, 10 aa, Influenza virus
IKHLEECSCY

SEQ ID NO: 501235 - protein, 10 aa, Influenza virus
IKINPVTLTM

SEQ ID NO: 501236 - protein, 10 aa, Influenza virus
IKIRRRVDIN

SEQ ID NO: 501237 - protein, 10 aa, Influenza virus
IKKTNEKFHQ

SEQ ID NO: 501238 - protein, 10 aa, Influenza virus
IKKYERVKMF

SEQ ID NO: 501239 - protein, 10 aa, Influenza virus
IKKYTSARQE

SEQ ID NO: 501240 - protein, 10 aa, Influenza virus
IKKYTSGRQE

SEQ ID NO: 501241 - protein, 10 aa, Influenza virus
IKLKSEDNVY

SEQ ID NO: 501242 - protein, 10 aa, Influenza virus
IKLKTEDNIY

SEQ ID NO: 501243 - protein, 10 aa, Influenza virus
IKLKTEDNVY

SEQ ID NO: 501244 - protein, 10 aa, Influenza virus
IKLLPFAAAP

SEQ ID NO: 501245 - protein, 10 aa, Influenza virus
IKLLPFASAP

SEQ ID NO: 501246 - protein, 10 aa, Influenza virus
IKMKWGMELR

SEQ ID NO: 501247 - protein, 10 aa, Influenza virus
IKMKWGMEMR

SEQ ID NO: 501248 - protein, 10 aa, Influenza virus
IKMNPNQKII

SEQ ID NO: 501249 - protein, 10 aa, Influenza virus
IKMNPNQKIM

SEQ ID NO: 501250 - protein, 10 aa, Influenza virus
IKNGNMQCTI

SEQ ID NO: 501251 - protein, 10 aa, Influenza virus
IKNGNMRCTI

SEQ ID NO: 501252 - protein, 10 aa, Influenza virus
IKNGNVRCTI

SEQ ID NO: 501253 - protein, 10 aa, Influenza virus
IKNGTYDHKD

SEQ ID NO: 501254 - protein, 10 aa, Influenza virus
IKNGTYDHKE

SEQ ID NO: 501255 - protein, 10 aa, Influenza virus
IKNGTYDYPK

SEQ ID NO: 501256 - protein, 10 aa, Influenza virus
IKNGTYNHKD

SEQ ID NO: 501257 - protein, 10 aa, Influenza virus
IKNGTYNHKE

SEQ ID NO: 501258 - protein, 10 aa, Influenza virus
IKNGTYNRKE

SEQ ID NO: 501259 - protein, 10 aa, Influenza virus
IKNNMINNDL

SEQ ID NO: 501260 - protein, 10 aa, Influenza virus
IKNNMVNNDL

SEQ ID NO: 501261 - protein, 10 aa, Influenza virus
IKNQEELRSL

SEQ ID NO: 501262 - protein, 10 aa, Influenza virus
IKPCFWVELI

SEQ ID NO: 501263 - protein, 10 aa, Influenza virus
IKPWARNILR

SEQ ID NO: 501264 - protein, 10 aa, Influenza virus
IKQGSLKLAT

SEQ ID NO: 501265 - protein, 10 aa, Influenza virus
IKQNGKSGAC

SEQ ID NO: 501266 - protein, 10 aa, Influenza virus
IKQNTLKLAT

SEQ ID NO: 501267 - protein, 10 aa, Influenza virus
IKRGINDRNF

SEQ ID NO: 501268 - protein, 10 aa, Influenza virus
IKRGVNDRNF

SEQ ID NO: 501269 - protein, 10 aa, Influenza virus
IKRYERVKMF

SEQ ID NO: 501270 - protein, 10 aa, Influenza virus
IKSDQLKLAT

SEQ ID NO: 501271 - protein, 10 aa, Influenza virus
IKSFSRTELI

SEQ ID NO: 501272 - protein, 10 aa, Influenza virus
IKSFSRTQLI

SEQ ID NO: 501273 - protein, 10 aa, Influenza virus
IKSGQLKLAT

SEQ ID NO: 501274 - protein, 10 aa, Influenza virus
IKSWRKDILR

SEQ ID NO: 501275 - protein, 10 aa, Influenza virus
IKSWRRDILR

SEQ ID NO: 501276 - protein, 10 aa, Influenza virus
IKTDGATSAC

SEQ ID NO: 501277 - protein, 10 aa, Influenza virus
IKTKLPFQNL

SEQ ID NO: 501278 - protein, 10 aa, Influenza virus
IKTNGNLIAP

SEQ ID NO: 501279 - protein, 10 aa, Influenza virus
IKTRLFTIRQ

SEQ ID NO: 501280 - protein, 10 aa, Influenza virus
IKTRPILSPL

SEQ ID NO: 501281 - protein, 10 aa, Influenza virus
IKTWAGKILR

SEQ ID NO: 501282 - protein, 10 aa, Influenza virus
IKTWAGNILR

SEQ ID NO: 501283 - protein, 10 aa, Influenza virus
IKTWAKNILR

SEQ ID NO: 501284 - protein, 10 aa, Influenza virus
IKTWARNILR

SEQ ID NO: 501285 - protein, 10 aa, Influenza virus
IKWNVTYTGT

SEQ ID NO: 501286 - protein, 10 aa, Influenza virus
IKYNGIITDT

SEQ ID NO: 501287 - protein, 10 aa, Influenza virus
ILAATVTLHF

SEQ ID NO: 501288 - protein, 10 aa, Influenza virus
ILAFILWACS

SEQ ID NO: 501289 - protein, 10 aa, Influenza virus
ILAFIMWACS

SEQ ID NO: 501290 - protein, 10 aa, Influenza virus
ILAIYATVAG

SEQ ID NO: 501291 - protein, 10 aa, Influenza virus
ILAIYSTAAS

SEQ ID NO: 501292 - protein, 10 aa, Influenza virus
ILAIYSTISS

SEQ ID NO: 501293 - protein, 10 aa, Influenza virus
ILAIYSTVAS

SEQ ID NO: 501294 - protein, 10 aa, Influenza virus
ILAIYSTVSS

SEQ ID NO: 501295 - protein, 10 aa, Influenza virus
ILANNGKFEF

SEQ ID NO: 501296 - protein, 10 aa, Influenza virus
ILANNGRFEF

SEQ ID NO: 501297 - protein, 10 aa, Influenza virus
ILASSGSLEF

SEQ ID NO: 501298 - protein, 10 aa, Influenza virus
ILATTITLHF

SEQ ID NO: 501299 - protein, 10 aa, Influenza virus
ILATTVTLHF

SEQ ID NO: 501300 - protein, 10 aa, Influenza virus
ILDEHDSNVK

SEQ ID NO: 501301 - protein, 10 aa, Influenza virus
ILDFHDSNVK

SEQ ID NO: 501302 - protein, 10 aa, Influenza virus
ILDGVTASCR

SEQ ID NO: 501303 - protein, 10 aa, Influenza virus
ILDQNFRNIR

SEQ ID NO: 501304 - protein, 10 aa, Influenza virus
ILEDEQMYQK

SEQ ID NO: 501305 - protein, 10 aa, Influenza virus
ILEDEQMYQR

SEQ ID NO: 501306 - protein, 10 aa, Influenza virus
ILEDERMYQK

SEQ ID NO: 501307 - protein, 10 aa, Influenza virus
ILEEESDEAL

SEQ ID NO: 501308 - protein, 10 aa, Influenza virus
ILEENTTYKI

SEQ ID NO: 501309 - protein, 10 aa, Influenza virus
ILEGTTASCQ

SEQ ID NO: 501310 - protein, 10 aa, Influenza virus
ILEKAHNGKL

SEQ ID NO: 501311 - protein, 10 aa, Influenza virus
ILEKMHNGKL

SEQ ID NO: 501312 - protein, 10 aa, Influenza virus
ILEKNITVTH

SEQ ID NO: 501313 - protein, 10 aa, Influenza virus
ILEKNVTVTH

SEQ ID NO: 501314 - protein, 10 aa, Influenza virus
ILEKTHNGKL

SEQ ID NO: 501315 - protein, 10 aa, Influenza virus
ILEKTHNGRL

SEQ ID NO: 501316 - protein, 10 aa, Influenza virus
ILEKVHNGKL

SEQ ID NO: 501317 - protein, 10 aa, Influenza virus
ILEQNVTVTH

SEQ ID NO: 501318 - protein, 10 aa, Influenza virus
ILERNVTVTH

SEQ ID NO: 501319 - protein, 10 aa, Influenza virus
ILERTHNGKL

SEQ ID NO: 501320 - protein, 10 aa, Influenza virus
ILETGYICSK

SEQ ID NO: 501321 - protein, 10 aa, Influenza virus
ILETGYVCGK

SEQ ID NO: 501322 - protein, 10 aa, Influenza virus
ILETGYVCSK

SEQ ID NO: 501323 - protein, 10 aa, Influenza virus
ILFNTIGNLI

SEQ ID NO: 501324 - protein, 10 aa, Influenza virus
ILGFVFTLTV

SEQ ID NO: 501325 - protein, 10 aa, Influenza virus
ILGFVLWACQ

SEQ ID NO: 501326 - protein, 10 aa, Influenza virus
ILGILTGPPQ

SEQ ID NO: 501327 - protein, 10 aa, Influenza virus
ILGMQNGSCR

SEQ ID NO: 501328 - protein, 10 aa, Influenza virus
ILGMQNGSYR

SEQ ID NO: 501329 - protein, 10 aa, Influenza virus
ILGNGCFEFW

SEQ ID NO: 501330 - protein, 10 aa, Influenza virus
ILGNPKCDLY

SEQ ID NO: 501331 - protein, 10 aa, Influenza virus
ILGNPKCDPY

SEQ ID NO: 501332 - protein, 10 aa, Influenza virus
ILGNPMCDDL

SEQ ID NO: 501333 - protein, 10 aa, Influenza virus
ILGNPMCDEL

SEQ ID NO: 501334 - protein, 10 aa, Influenza virus
ILGNPMCDNL

SEQ ID NO: 501335 - protein, 10 aa, Influenza virus
ILGNPMCDYL

SEQ ID NO: 501336 - protein, 10 aa, Influenza virus
ILGNPRCDDL

SEQ ID NO: 501337 - protein, 10 aa, Influenza virus
ILGTIIGPPQ

SEQ ID NO: 501338 - protein, 10 aa, Influenza virus
ILHKCDNECM

SEQ ID NO: 501339 - protein, 10 aa, Influenza virus
ILHKCDNKCM

SEQ ID NO: 501340 - protein, 10 aa, Influenza virus
ILHKCNDSCM

SEQ ID NO: 501341 - protein, 10 aa, Influenza virus
ILHKCNNECM

SEQ ID NO: 501342 - protein, 10 aa, Influenza virus
ILIAGGLILG

SEQ ID NO: 501343 - protein, 10 aa, Influenza virus
ILITQESECV

SEQ ID NO: 501344 - protein, 10 aa, Influenza virus
ILKDCSIAGW

SEQ ID NO: 501345 - protein, 10 aa, Influenza virus
ILKDCSVAGW

SEQ ID NO: 501346 - protein, 10 aa, Influenza virus
ILKGKFQTAA

SEQ ID NO: 501347 - protein, 10 aa, Influenza virus
ILKHNPTEEQ

SEQ ID NO: 501348 - protein, 10 aa, Influenza virus
ILKIKKGKIM

SEQ ID NO: 501349 - protein, 10 aa, Influenza virus
ILKIKKGKIV

SEQ ID NO: 501350 - protein, 10 aa, Influenza virus
ILKIRKGKIM

SEQ ID NO: 501351 - protein, 10 aa, Influenza virus
ILKIRKGKIV

SEQ ID NO: 501352 - protein, 10 aa, Influenza virus
ILKPGQTVKI

SEQ ID NO: 501353 - protein, 10 aa, Influenza virus
ILKQNPTEEQ

SEQ ID NO: 501354 - protein, 10 aa, Influenza virus
ILKRGETLKI

SEQ ID NO: 501355 - protein, 10 aa, Influenza virus
ILLATGMRNV

SEQ ID NO: 501356 - protein, 10 aa, Influenza virus
ILLENERTLD

SEQ ID NO: 501357 - protein, 10 aa, Influenza virus
ILLNPFVSHK

SEQ ID NO: 501358 - protein, 10 aa, Influenza virus
ILLSPEEVSE

SEQ ID NO: 501359 - protein, 10 aa, Influenza virus
ILNLLIGISN

SEQ ID NO: 501360 - protein, 10 aa, Influenza virus
ILNNKNWSGY

SEQ ID NO: 501361 - protein, 10 aa, Influenza virus
ILNTSQRGIL

SEQ ID NO: 501362 - protein, 10 aa, Influenza virus
ILNTSQRGVL

SEQ ID NO: 501363 - protein, 10 aa, Influenza virus
ILPFDFDKIS

SEQ ID NO: 501364 - protein, 10 aa, Influenza virus
ILPFDIDKII

SEQ ID NO: 501365 - protein, 10 aa, Influenza virus
ILRDCSVAGW

SEQ ID NO: 501366 - protein, 10 aa, Influenza virus
ILRGAVAHKS

SEQ ID NO: 501367 - protein, 10 aa, Influenza virus
ILRGSIAHKS

SEQ ID NO: 501368 - protein, 10 aa, Influenza virus
ILRGSVAHKS

SEQ ID NO: 501369 - protein, 10 aa, Influenza virus
ILRQNPSEEQ

SEQ ID NO: 501370 - protein, 10 aa, Influenza virus
ILRQNPTEEQ

SEQ ID NO: 501371 - protein, 10 aa, Influenza virus
ILRTHESECV

SEQ ID NO: 501372 - protein, 10 aa, Influenza virus
ILRTQDSECV

SEQ ID NO: 501373 - protein, 10 aa, Influenza virus
ILRTQESECA

SEQ ID NO: 501374 - protein, 10 aa, Influenza virus
ILRTQESECI

SEQ ID NO: 501375 - protein, 10 aa, Influenza virus
ILRTQESECQ

SEQ ID NO: 501376 - protein, 10 aa, Influenza virus
ILRTQESECV

SEQ ID NO: 501377 - protein, 10 aa, Influenza virus
ILRTQESSCS

SEQ ID NO: 501378 - protein, 10 aa, Influenza virus
ILRTQESSCT

SEQ ID NO: 501379 - protein, 10 aa, Influenza virus
ILRTQESSCV

SEQ ID NO: 501380 - protein, 10 aa, Influenza virus
ILSIAPIMFS

SEQ ID NO: 501381 - protein, 10 aa, Influenza virus
ILSIYSCIAS

SEQ ID NO: 501382 - protein, 10 aa, Influenza virus
ILSIYSCVAS

SEQ ID NO: 501383 - protein, 10 aa, Influenza virus
ILSIYSSVAS

SEQ ID NO: 501384 - protein, 10 aa, Influenza virus
ILSIYSTAAS

SEQ ID NO: 501385 - protein, 10 aa, Influenza virus
ILSIYSTVAA

SEQ ID NO: 501386 - protein, 10 aa, Influenza virus
ILSIYSTVAS

SEQ ID NO: 501387 - protein, 10 aa, Influenza virus
ILSIYSTVTS

SEQ ID NO: 501388 - protein, 10 aa, Influenza virus
ILSIYSTVVS

SEQ ID NO: 501389 - protein, 10 aa, Influenza virus
ILSKDNAIRI

SEQ ID NO: 501390 - protein, 10 aa, Influenza virus
ILSLYSTVAS

SEQ ID NO: 501391 - protein, 10 aa, Influenza virus
ILSMAPIMFS

SEQ ID NO: 501392 - protein, 10 aa, Influenza virus
ILSNPKCDLY

SEQ ID NO: 501393 - protein, 10 aa, Influenza virus
ILSPLTKGIL

SEQ ID NO: 501394 - protein, 10 aa, Influenza virus
ILSPLTKGML

SEQ ID NO: 501395 - protein, 10 aa, Influenza virus
ILSTKALLIG

SEQ ID NO: 501396 - protein, 10 aa, Influenza virus
ILSVYSTVAS

SEQ ID NO: 501397 - protein, 10 aa, Influenza virus
ILTDSQTATK

SEQ ID NO: 501398 - protein, 10 aa, Influenza virus
ILTDTSRPGD

SEQ ID NO: 501399 - protein, 10 aa, Influenza virus
ILTDTSRPSD

SEQ ID NO: 501400 - protein, 10 aa, Influenza virus
ILTIYSTAAS

SEQ ID NO: 501401 - protein, 10 aa, Influenza virus
ILTIYSTVAS

SEQ ID NO: 501402 - protein, 10 aa, Influenza virus
ILTKITVDHM

SEQ ID NO: 501403 - protein, 10 aa, Influenza virus
ILTKTTVDHM

SEQ ID NO: 501404 - protein, 10 aa, Influenza virus
ILTRTTVDHM

SEQ ID NO: 501405 - protein, 10 aa, Influenza virus
ILVAGGLILG

SEQ ID NO: 501406 - protein, 10 aa, Influenza virus
ILVALALSHT

SEQ ID NO: 501407 - protein, 10 aa, Influenza virus
ILVALENQHT

SEQ ID NO: 501408 - protein, 10 aa, Influenza virus
ILVGSSTYQN

SEQ ID NO: 501409 - protein, 10 aa, Influenza virus
ILVLGLSMVK

SEQ ID NO: 501410 - protein, 10 aa, Influenza virus
ILVLGLSMVR

SEQ ID NO: 501411 - protein, 10 aa, Influenza virus
ILVSTNAYDR

SEQ ID NO: 501412 - protein, 10 aa, Influenza virus
ILVTREPYLS

SEQ ID NO: 501413 - protein, 10 aa, Influenza virus
ILVTREPYVS

SEQ ID NO: 501414 - protein, 10 aa, Influenza virus
ILVTTVTLHF

SEQ ID NO: 501415 - protein, 10 aa, Influenza virus
ILWACSSGNC

SEQ ID NO: 501416 - protein, 10 aa, Influenza virus
ILWFSFGASC

SEQ ID NO: 501417 - protein, 10 aa, Influenza virus
ILWFSFGASS

SEQ ID NO: 501418 - protein, 10 aa, Influenza virus
ILWFSLGASC

SEQ ID NO: 501419 - protein, 10 aa, Influenza virus
ILWISFAISC

SEQ ID NO: 501420 - protein, 10 aa, Influenza virus
ILWISFAMSC

SEQ ID NO: 501421 - protein, 10 aa, Influenza virus
ILWISFATSC

SEQ ID NO: 501422 - protein, 10 aa, Influenza virus
ILWISFSISC

SEQ ID NO: 501423 - protein, 10 aa, Influenza virus
ILWISFSMSC

SEQ ID NO: 501424 - protein, 10 aa, Influenza virus
ILWVSFSISC

SEQ ID NO: 501425 - protein, 10 aa, Influenza virus
ILYFWGVHHP

SEQ ID NO: 501426 - protein, 10 aa, Influenza virus
IMASQGTKRS

SEQ ID NO: 501427 - protein, 10 aa, Influenza virus
IMEKNITVTH

SEQ ID NO: 501428 - protein, 10 aa, Influenza virus
IMEKNVTVTH

SEQ ID NO: 501429 - protein, 10 aa, Influenza virus
IMERNVTVTH

SEQ ID NO: 501430 - protein, 10 aa, Influenza virus
IMESGGIDKI

SEQ ID NO: 501431 - protein, 10 aa, Influenza virus
IMESGGIDKV

SEQ ID NO: 501432 - protein, 10 aa, Influenza virus
IMESGGISKI

SEQ ID NO: 501433 - protein, 10 aa, Influenza virus
IMESGGISKM

SEQ ID NO: 501434 - protein, 10 aa, Influenza virus
IMEVVFPNEV

SEQ ID NO: 501435 - protein, 10 aa, Influenza virus
IMFSNKMAKL

SEQ ID NO: 501436 - protein, 10 aa, Influenza virus
IMFSNKMARL

SEQ ID NO: 501437 - protein, 10 aa, Influenza virus
IMFSNKVARL

SEQ ID NO: 501438 - protein, 10 aa, Influenza virus
IMGLFFFCLK

SEQ ID NO: 501439 - protein, 10 aa, Influenza virus
IMGLVFFCLK

SEQ ID NO: 501440 - protein, 10 aa, Influenza virus
IMGLVFFCLR

SEQ ID NO: 501441 - protein, 10 aa, Influenza virus
IMHDRTKIRQ

SEQ ID NO: 501442 - protein, 10 aa, Influenza virus
IMINPVKLSG

SEQ ID NO: 501443 - protein, 10 aa, Influenza virus
IMINPVKLSS

SEQ ID NO: 501444 - protein, 10 aa, Influenza virus
IMIWHSNLND

SEQ ID NO: 501445 - protein, 10 aa, Influenza virus
IMNTSKPFQN

SEQ ID NO: 501446 - protein, 10 aa, Influenza virus
IMQNKLNNVI

SEQ ID NO: 501447 - protein, 10 aa, Influenza virus
IMRTQESECA

SEQ ID NO: 501448 - protein, 10 aa, Influenza virus
IMRTQESECV

SEQ ID NO: 501449 - protein, 10 aa, Influenza virus
IMRTQESSCT

SEQ ID NO: 501450 - protein, 10 aa, Influenza virus
IMRTVIALSY

SEQ ID NO: 501451 - protein, 10 aa, Influenza virus
IMTDGPANSQ

SEQ ID NO: 501452 - protein, 10 aa, Influenza virus
IMTDGSANSQ

SEQ ID NO: 501453 - protein, 10 aa, Influenza virus
IMTDGSASSQ

SEQ ID NO: 501454 - protein, 10 aa, Influenza virus
IMTIGSVSLA

SEQ ID NO: 501455 - protein, 10 aa, Influenza virus
IMWACNSGNC

SEQ ID NO: 501456 - protein, 10 aa, Influenza virus
IMWACQKGNI

SEQ ID NO: 501457 - protein, 10 aa, Influenza virus
IMWACQRGNI

SEQ ID NO: 501458 - protein, 10 aa, Influenza virus
IMWACSNGNC

SEQ ID NO: 501459 - protein, 10 aa, Influenza virus
IMWACSNGSC

SEQ ID NO: 501460 - protein, 10 aa, Influenza virus
IMWACSSGNC

SEQ ID NO: 501461 - protein, 10 aa, Influenza virus
IMWGIHHPSS

SEQ ID NO: 501462 - protein, 10 aa, Influenza virus
IMWTCNSGNC

SEQ ID NO: 501463 - protein, 10 aa, Influenza virus
IMWTCQKGNI

SEQ ID NO: 501464 - protein, 10 aa, Influenza virus
INDKIDDQIE

SEQ ID NO: 501465 - protein, 10 aa, Influenza virus
INDKINDQIE

SEQ ID NO: 501466 - protein, 10 aa, Influenza virus
INDPWVLLNA

SEQ ID NO: 501467 - protein, 10 aa, Influenza virus
INDQIEDLWA

SEQ ID NO: 501468 - protein, 10 aa, Influenza virus
INDQITDIWA

SEQ ID NO: 501469 - protein, 10 aa, Influenza virus
INDRNFWRGD

SEQ ID NO: 501470 - protein, 10 aa, Influenza virus
INDRNFWRGE

SEQ ID NO: 501471 - protein, 10 aa, Influenza virus
INDRSPFRAL

SEQ ID NO: 501472 - protein, 10 aa, Influenza virus
INDRTAFRGL

SEQ ID NO: 501473 - protein, 10 aa, Influenza virus
INECRTFFLT

SEQ ID NO: 501474 - protein, 10 aa, Influenza virus
INEEALRQKI

SEQ ID NO: 501475 - protein, 10 aa, Influenza virus
INEGNGCFEL

SEQ ID NO: 501476 - protein, 10 aa, Influenza virus
INEITTKINN

SEQ ID NO: 501477 - protein, 10 aa, Influenza virus
INESADMSIG

SEQ ID NO: 501478 - protein, 10 aa, Influenza virus
INEVKLEENT

SEQ ID NO: 501479 - protein, 10 aa, Influenza virus
INFDSNGNFI

SEQ ID NO: 501480 - protein, 10 aa, Influenza virus
INFESNGNFI

SEQ ID NO: 501481 - protein, 10 aa, Influenza virus
INFESNGNLI

SEQ ID NO: 501482 - protein, 10 aa, Influenza virus
INFESTGNLI

SEQ ID NO: 501483 - protein, 10 aa, Influenza virus
INFESTGNLV

SEQ ID NO: 501484 - protein, 10 aa, Influenza virus
INFMPYISFA

SEQ ID NO: 501485 - protein, 10 aa, Influenza virus
INGALGSPGC

SEQ ID NO: 501486 - protein, 10 aa, Influenza virus
INGICTVVMT

SEQ ID NO: 501487 - protein, 10 aa, Influenza virus
INGKAPISLG

SEQ ID NO: 501488 - protein, 10 aa, Influenza virus
INGKEPISLG

SEQ ID NO: 501489 - protein, 10 aa, Influenza virus
INGKLNRLIE

SEQ ID NO: 501490 - protein, 10 aa, Influenza virus
INGKQPISLG

SEQ ID NO: 501491 - protein, 10 aa, Influenza virus
INGPDSVLVN

SEQ ID NO: 501492 - protein, 10 aa, Influenza virus
INGPESVLIN

SEQ ID NO: 501493 - protein, 10 aa, Influenza virus
INGPESVLVN

SEQ ID NO: 501494 - protein, 10 aa, Influenza virus
INGQAGRMTF

SEQ ID NO: 501495 - protein, 10 aa, Influenza virus
INGQSGRIDF

SEQ ID NO: 501496 - protein, 10 aa, Influenza virus
INGSCAVVMT

SEQ ID NO: 501497 - protein, 10 aa, Influenza virus
INGSCIVVMT

SEQ ID NO: 501498 - protein, 10 aa, Influenza virus
INGSCTVVMT

SEQ ID NO: 501499 - protein, 10 aa, Influenza virus
INGTCAVVMT

SEQ ID NO: 501500 - protein, 10 aa, Influenza virus
INGTCTVIMT

SEQ ID NO: 501501 - protein, 10 aa, Influenza virus
INGTCTVVMT

SEQ ID NO: 501502 - protein, 10 aa, Influenza virus
INGVILEENT

SEQ ID NO: 501503 - protein, 10 aa, Influenza virus
INGVKLEENS

SEQ ID NO: 501504 - protein, 10 aa, Influenza virus
INGVKLEENT

SEQ ID NO: 501505 - protein, 10 aa, Influenza virus
INGVRLEENT

SEQ ID NO: 501506 - protein, 10 aa, Influenza virus
INGVTNKVNS

SEQ ID NO: 501507 - protein, 10 aa, Influenza virus
INGWYGFQHQ

SEQ ID NO: 501508 - protein, 10 aa, Influenza virus
INGWYGFQHR

SEQ ID NO: 501509 - protein, 10 aa, Influenza virus
INGWYGFRHQ

SEQ ID NO: 501510 - protein, 10 aa, Influenza virus
INIAEYSIDS

SEQ ID NO: 501511 - protein, 10 aa, Influenza virus
INIMASQGTK

SEQ ID NO: 501512 - protein, 10 aa, Influenza virus
INIREWSYLI

SEQ ID NO: 501513 - protein, 10 aa, Influenza virus
INKITNKVNN

SEQ ID NO: 501514 - protein, 10 aa, Influenza virus
INKMNTQFEA

SEQ ID NO: 501515 - protein, 10 aa, Influenza virus
INKTGTFEFT

SEQ ID NO: 501516 - protein, 10 aa, Influenza virus
INKVCTKGKK

SEQ ID NO: 501517 - protein, 10 aa, Influenza virus
INLHAYISFR

SEQ ID NO: 501518 - protein, 10 aa, Influenza virus
INLLIGISNM

SEQ ID NO: 501519 - protein, 10 aa, Influenza virus
INLYASKNPY

SEQ ID NO: 501520 - protein, 10 aa, Influenza virus
INMADYSIDS

SEQ ID NO: 501521 - protein, 10 aa, Influenza virus
INMEDYSIDS

SEQ ID NO: 501522 - protein, 10 aa, Influenza virus
INMIADRVDD

SEQ ID NO: 501523 - protein, 10 aa, Influenza virus
INMINDKIDD

SEQ ID NO: 501524 - protein, 10 aa, Influenza virus
INMINDKIND

SEQ ID NO: 501525 - protein, 10 aa, Influenza virus
INMINSKIDD

SEQ ID NO: 501526 - protein, 10 aa, Influenza virus
INMINSKIED

SEQ ID NO: 501527 - protein, 10 aa, Influenza virus
INMINSKIND

SEQ ID NO: 501528 - protein, 10 aa, Influenza virus
INMINSQIDD

SEQ ID NO: 501529 - protein, 10 aa, Influenza virus
INMISDKIDD

SEQ ID NO: 501530 - protein, 10 aa, Influenza virus
INMLADRIDD

SEQ ID NO: 501531 - protein, 10 aa, Influenza virus
INMLADRVDD

SEQ ID NO: 501532 - protein, 10 aa, Influenza virus
INMLADWVDD

SEQ ID NO: 501533 - protein, 10 aa, Influenza virus
INMSKKKSYI

SEQ ID NO: 501534 - protein, 10 aa, Influenza virus
INMSKRKSYI

SEQ ID NO: 501535 - protein, 10 aa, Influenza virus
INNDLGPATA

SEQ ID NO: 501536 - protein, 10 aa, Influenza virus
INNETIIETG

SEQ ID NO: 501537 - protein, 10 aa, Influenza virus
INNETILETG

SEQ ID NO: 501538 - protein, 10 aa, Influenza virus
INNETILETR

SEQ ID NO: 501539 - protein, 10 aa, Influenza virus
INNETIVETG

SEQ ID NO: 501540 - protein, 10 aa, Influenza virus
INNGKGRYGV

SEQ ID NO: 501541 - protein, 10 aa, Influenza virus
INNIIDKMNG

SEQ ID NO: 501542 - protein, 10 aa, Influenza virus
INNIIEKMNG

SEQ ID NO: 501543 - protein, 10 aa, Influenza virus
INNIVDKMNR

SEQ ID NO: 501544 - protein, 10 aa, Influenza virus
INNQNWSGYS

SEQ ID NO: 501545 - protein, 10 aa, Influenza virus
INNRFQIQGI

SEQ ID NO: 501546 - protein, 10 aa, Influenza virus
INNRFQIQGV

SEQ ID NO: 501547 - protein, 10 aa, Influenza virus
INNRIKINPV

SEQ ID NO: 501548 - protein, 10 aa, Influenza virus
INPTLLFLKV

SEQ ID NO: 501549 - protein, 10 aa, Influenza virus
INPVELSSGY

SEQ ID NO: 501550 - protein, 10 aa, Influenza virus
INPVKLSGGY

SEQ ID NO: 501551 - protein, 10 aa, Influenza virus
INPVKLSSGY

SEQ ID NO: 501552 - protein, 10 aa, Influenza virus
INPVRLSSGY

SEQ ID NO: 501553 - protein, 10 aa, Influenza virus
INPVTLSSGY

SEQ ID NO: 501554 - protein, 10 aa, Influenza virus
INPVTLTMGY

SEQ ID NO: 501555 - protein, 10 aa, Influenza virus
INQINGKLNR

SEQ ID NO: 501556 - protein, 10 aa, Influenza virus
INQITGKLNR

SEQ ID NO: 501557 - protein, 10 aa, Influenza virus
INRCFYVELI

SEQ ID NO: 501558 - protein, 10 aa, Influenza virus
INRCFYVELV

SEQ ID NO: 501559 - protein, 10 aa, Influenza virus
INRIFQPNIG

SEQ ID NO: 501560 - protein, 10 aa, Influenza virus
INRIFRPNIG

SEQ ID NO: 501561 - protein, 10 aa, Influenza virus
INRITYGACP

SEQ ID NO: 501562 - protein, 10 aa, Influenza virus
INRNFKPNIG

SEQ ID NO: 501563 - protein, 10 aa, Influenza virus
INRNFQPNIG

SEQ ID NO: 501564 - protein, 10 aa, Influenza virus
INRQEIEGAR

SEQ ID NO: 501565 - protein, 10 aa, Influenza virus
INRQEIEGVK

SEQ ID NO: 501566 - protein, 10 aa, Influenza virus
INRQEIEGVR

SEQ ID NO: 501567 - protein, 10 aa, Influenza virus
INRSFKPNIG

SEQ ID NO: 501568 - protein, 10 aa, Influenza virus
INRSFQPNIG

SEQ ID NO: 501569 - protein, 10 aa, Influenza virus
INRSFRPNIG

SEQ ID NO: 501570 - protein, 10 aa, Influenza virus
INRTGTFEFT

SEQ ID NO: 501571 - protein, 10 aa, Influenza virus
INSIIDKMNT

SEQ ID NO: 501572 - protein, 10 aa, Influenza virus
INSPLPFQNI

SEQ ID NO: 501573 - protein, 10 aa, Influenza virus
INSRFQIQGV

SEQ ID NO: 501574 - protein, 10 aa, Influenza virus
INSSKPFQNA

SEQ ID NO: 501575 - protein, 10 aa, Influenza virus
INSSKPFQNT

SEQ ID NO: 501576 - protein, 10 aa, Influenza virus
INSSKPLQNA

SEQ ID NO: 501577 - protein, 10 aa, Influenza virus
INSSMPFHNI

SEQ ID NO: 501578 - protein, 10 aa, Influenza virus
INSSMPFHNV

SEQ ID NO: 501579 - protein, 10 aa, Influenza virus
INSSMPLHNI

SEQ ID NO: 501580 - protein, 10 aa, Influenza virus
INSSRPFQNA

SEQ ID NO: 501581 - protein, 10 aa, Influenza virus
INSSYVCSGL

SEQ ID NO: 501582 - protein, 10 aa, Influenza virus
INSVKLSSGY

SEQ ID NO: 501583 - protein, 10 aa, Influenza virus
INSWHIFGKD

SEQ ID NO: 501584 - protein, 10 aa, Influenza virus
INSWHIYGKD

SEQ ID NO: 501585 - protein, 10 aa, Influenza virus
INTALLNASC

SEQ ID NO: 501586 - protein, 10 aa, Influenza virus
INTAMLNASC

SEQ ID NO: 501587 - protein, 10 aa, Influenza virus
INTASRSGYE

SEQ ID NO: 501588 - protein, 10 aa, Influenza virus
INTINSKIDD

SEQ ID NO: 501589 - protein, 10 aa, Influenza virus
INTKLPFQNL

SEQ ID NO: 501590 - protein, 10 aa, Influenza virus
INTLTERGVE

SEQ ID NO: 501591 - protein, 10 aa, Influenza virus
INTNKTFQNI

SEQ ID NO: 501592 - protein, 10 aa, Influenza virus
INTNRTFQNI

SEQ ID NO: 501593 - protein, 10 aa, Influenza virus
INTRLPFQNL

SEQ ID NO: 501594 - protein, 10 aa, Influenza virus
INTSKPFQNT

SEQ ID NO: 501595 - protein, 10 aa, Influenza virus
INTTLPFHNI

SEQ ID NO: 501596 - protein, 10 aa, Influenza virus
INTTLPFHNV

SEQ ID NO: 501597 - protein, 10 aa, Influenza virus
INTWARNILR

SEQ ID NO: 501598 - protein, 10 aa, Influenza virus
INTYQWIIRN

SEQ ID NO: 501599 - protein, 10 aa, Influenza virus
INVINDKIDD

SEQ ID NO: 501600 - protein, 10 aa, Influenza virus
INVTKENTGS

SEQ ID NO: 501601 - protein, 10 aa, Influenza virus
INWLTKKEPD

SEQ ID NO: 501602 - protein, 10 aa, Influenza virus
INWLTKKKNP

SEQ ID NO: 501603 - protein, 10 aa, Influenza virus
INWLTKKKPD

SEQ ID NO: 501604 - protein, 10 aa, Influenza virus
INWTKDSITD

SEQ ID NO: 501605 - protein, 10 aa, Influenza virus
INWTQDAMTE

SEQ ID NO: 501606 - protein, 10 aa, Influenza virus
INWTRDAMTE

SEQ ID NO: 501607 - protein, 10 aa, Influenza virus
INWTRDSIIE

SEQ ID NO: 501608 - protein, 10 aa, Influenza virus
INWTRDSITE

SEQ ID NO: 501609 - protein, 10 aa, Influenza virus
INWTRDSLTE

SEQ ID NO: 501610 - protein, 10 aa, Influenza virus
INWTRDSMTE

SEQ ID NO: 501611 - protein, 10 aa, Influenza virus
INWTRDSVTE

SEQ ID NO: 501612 - protein, 10 aa, Influenza virus
INYYNETFVN

SEQ ID NO: 501613 - protein, 10 aa, Influenza virus
IPCFWVEMIR

SEQ ID NO: 501614 - protein, 10 aa, Influenza virus
IPEAGLKWEL

SEQ ID NO: 501615 - protein, 10 aa, Influenza virus
IPEVCLKWDL

SEQ ID NO: 501616 - protein, 10 aa, Influenza virus
IPEVCLKWEL

SEQ ID NO: 501617 - protein, 10 aa, Influenza virus
IPEVCLKWGL

SEQ ID NO: 501618 - protein, 10 aa, Influenza virus
IPEWSYIMEK

SEQ ID NO: 501619 - protein, 10 aa, Influenza virus
IPFHLGTKQV

SEQ ID NO: 501620 - protein, 10 aa, Influenza virus
IPGKQAKGLF

SEQ ID NO: 501621 - protein, 10 aa, Influenza virus
IPHRTLLMNE

SEQ ID NO: 501622 - protein, 10 aa, Influenza virus
IPHRTLLMSE

SEQ ID NO: 501623 - protein, 10 aa, Influenza virus
IPIGERGLFG

SEQ ID NO: 501624 - protein, 10 aa, Influenza virus
IPKRNRSILN

SEQ ID NO: 501625 - protein, 10 aa, Influenza virus
IPLTTTPTKS

SEQ ID NO: 501626 - protein, 10 aa, Influenza virus
IPMISKCKTK

SEQ ID NO: 501627 - protein, 10 aa, Influenza virus
IPMISKCRTK

SEQ ID NO: 501628 - protein, 10 aa, Influenza virus
IPMISKCRTR

SEQ ID NO: 501629 - protein, 10 aa, Influenza virus
IPMISNCRTK

SEQ ID NO: 501630 - protein, 10 aa, Influenza virus
IPNAETDPNS

SEQ ID NO: 501631 - protein, 10 aa, Influenza virus
IPNAETDPSS

SEQ ID NO: 501632 - protein, 10 aa, Influenza virus
IPNAGIDPNS

SEQ ID NO: 501633 - protein, 10 aa, Influenza virus
IPNAGTDPNS

SEQ ID NO: 501634 - protein, 10 aa, Influenza virus
IPPLELGDCS

SEQ ID NO: 501635 - protein, 10 aa, Influenza virus
IPPLELRDCS

SEQ ID NO: 501636 - protein, 10 aa, Influenza virus
IPPLVLGDCS

SEQ ID NO: 501637 - protein, 10 aa, Influenza virus
IPQIESRGLF

SEQ ID NO: 501638 - protein, 10 aa, Influenza virus
IPSDTPRGED

SEQ ID NO: 501639 - protein, 10 aa, Influenza virus
IPSGPLKAEI

SEQ ID NO: 501640 - protein, 10 aa, Influenza virus
IPSGSLKLAI

SEQ ID NO: 501641 - protein, 10 aa, Influenza virus
IPSIQSRGLF

SEQ ID NO: 501642 - protein, 10 aa, Influenza virus
IPSNSLKLAI

SEQ ID NO: 501643 - protein, 10 aa, Influenza virus
IPSRSLKLAI

SEQ ID NO: 501644 - protein, 10 aa, Influenza virus
IPSVQSRGLF

SEQ ID NO: 501645 - protein, 10 aa, Influenza virus
IPSWAGNILR

SEQ ID NO: 501646 - protein, 10 aa, Influenza virus
IPSWAGNVLR

SEQ ID NO: 501647 - protein, 10 aa, Influenza virus
IPSWEGNILR

SEQ ID NO: 501648 - protein, 10 aa, Influenza virus
IPTDTPRGED

SEQ ID NO: 501649 - protein, 10 aa, Influenza virus
IPTDTPRIQD

SEQ ID NO: 501650 - protein, 10 aa, Influenza virus
IPTDTPRVQD

SEQ ID NO: 501651 - protein, 10 aa, Influenza virus
IPVTQTMELV

SEQ ID NO: 501652 - protein, 10 aa, Influenza virus
IPVTQVEELV

SEQ ID NO: 501653 - protein, 10 aa, Influenza virus
IQAGVDRFYR

SEQ ID NO: 501654 - protein, 10 aa, Influenza virus
IQAGVNRFYR

SEQ ID NO: 501655 - protein, 10 aa, Influenza virus
IQALQLLLEV

SEQ ID NO: 501656 - protein, 10 aa, Influenza virus
IQDIWAYNAE

SEQ ID NO: 501657 - protein, 10 aa, Influenza virus
IQDLEKYVED

SEQ ID NO: 501658 - protein, 10 aa, Influenza virus
IQDLERYVED

SEQ ID NO: 501659 - protein, 10 aa, Influenza virus
IQDLWAYNAE

SEQ ID NO: 501660 - protein, 10 aa, Influenza virus
IQDVWAYNAE

SEQ ID NO: 501661 - protein, 10 aa, Influenza virus
IQFEAVGREF

SEQ ID NO: 501662 - protein, 10 aa, Influenza virus
IQFTAVGKEF

SEQ ID NO: 501663 - protein, 10 aa, Influenza virus
IQFTSVGKEF

SEQ ID NO: 501664 - protein, 10 aa, Influenza virus
IQGNNDNATA

SEQ ID NO: 501665 - protein, 10 aa, Influenza virus
IQGVKLAQGY

SEQ ID NO: 501666 - protein, 10 aa, Influenza virus
IQGVKLIQGY

SEQ ID NO: 501667 - protein, 10 aa, Influenza virus
IQGVKLTQGY

SEQ ID NO: 501668 - protein, 10 aa, Influenza virus
IQGVRLTQGY

SEQ ID NO: 501669 - protein, 10 aa, Influenza virus
IQGYKDIILW

SEQ ID NO: 501670 - protein, 10 aa, Influenza virus
IQHLEECSCY

SEQ ID NO: 501671 - protein, 10 aa, Influenza virus
IQHPELTGLN

SEQ ID NO: 501672 - protein, 10 aa, Influenza virus
IQIDPVKLSG

SEQ ID NO: 501673 - protein, 10 aa, Influenza virus
IQIDPVKLSS

SEQ ID NO: 501674 - protein, 10 aa, Influenza virus
IQIDQVKLSS

SEQ ID NO: 501675 - protein, 10 aa, Influenza virus
IQIDSVKLSS

SEQ ID NO: 501676 - protein, 10 aa, Influenza virus
IQIIKLLPFA

SEQ ID NO: 501677 - protein, 10 aa, Influenza virus
IQMCTELKLN

SEQ ID NO: 501678 - protein, 10 aa, Influenza virus
IQMCTELKLS

SEQ ID NO: 501679 - protein, 10 aa, Influenza virus
IQMCTELQLS

SEQ ID NO: 501680 - protein, 10 aa, Influenza virus
IQNALNGNGD

SEQ ID NO: 501681 - protein, 10 aa, Influenza virus
IQNEDIPIEN

SEQ ID NO: 501682 - protein, 10 aa, Influenza virus
IQNEDIPIGN

SEQ ID NO: 501683 - protein, 10 aa, Influenza virus
IQNEDIPIGS

SEQ ID NO: 501684 - protein, 10 aa, Influenza virus
IQNEFNKACE

SEQ ID NO: 501685 - protein, 10 aa, Influenza virus
IQNIWAYNAE

SEQ ID NO: 501686 - protein, 10 aa, Influenza virus
IQPGDNITFS

SEQ ID NO: 501687 - protein, 10 aa, Influenza virus
IQPTFSVQRN

SEQ ID NO: 501688 - protein, 10 aa, Influenza virus
IQQTRVDKLT

SEQ ID NO: 501689 - protein, 10 aa, Influenza virus
IQSDAQIDES

SEQ ID NO: 501690 - protein, 10 aa, Influenza virus
IQSDKPFQNV

SEQ ID NO: 501691 - protein, 10 aa, Influenza virus
IQSEFNKACE

SEQ ID NO: 501692 - protein, 10 aa, Influenza virus
IQSKGLFGAI

SEQ ID NO: 501693 - protein, 10 aa, Influenza virus
IQSRGLFGAI

SEQ ID NO: 501694 - protein, 10 aa, Influenza virus
IQTLVSNNDW

SEQ ID NO: 501695 - protein, 10 aa, Influenza virus
IQTNGNLIAP

SEQ ID NO: 501696 - protein, 10 aa, Influenza virus
IQTRGLFGAI

SEQ ID NO: 501697 - protein, 10 aa, Influenza virus
IQTSGNLIAP

SEQ ID NO: 501698 - protein, 10 aa, Influenza virus
IRALTLNTMT

SEQ ID NO: 501699 - protein, 10 aa, Influenza virus
IRCVCRDNWK

SEQ ID NO: 501700 - protein, 10 aa, Influenza virus
IREGLILEYY

SEQ ID NO: 501701 - protein, 10 aa, Influenza virus
IREPFISCSH

SEQ ID NO: 501702 - protein, 10 aa, Influenza virus
IREPFISCSI

SEQ ID NO: 501703 - protein, 10 aa, Influenza virus
IREPFISCSP

SEQ ID NO: 501704 - protein, 10 aa, Influenza virus
IREPFISCSQ

SEQ ID NO: 501705 - protein, 10 aa, Influenza virus
IREPFISCSV

SEQ ID NO: 501706 - protein, 10 aa, Influenza virus
IREPFVACGP

SEQ ID NO: 501707 - protein, 10 aa, Influenza virus
IREPFVACSP

SEQ ID NO: 501708 - protein, 10 aa, Influenza virus
IREPFVSCGP

SEQ ID NO: 501709 - protein, 10 aa, Influenza virus
IREPFVSCSH

SEQ ID NO: 501710 - protein, 10 aa, Influenza virus
IREPFVSCSI

SEQ ID NO: 501711 - protein, 10 aa, Influenza virus
IREPFVSCSP

SEQ ID NO: 501712 - protein, 10 aa, Influenza virus
IRESGGIDKE

SEQ ID NO: 501713 - protein, 10 aa, Influenza virus
IREWSYLIED

SEQ ID NO: 501714 - protein, 10 aa, Influenza virus
IRFGEGEQII

SEQ ID NO: 501715 - protein, 10 aa, Influenza virus
IRFGESEQII

SEQ ID NO: 501716 - protein, 10 aa, Influenza virus
IRFGESEQIV

SEQ ID NO: 501717 - protein, 10 aa, Influenza virus
IRFGESEQVI

SEQ ID NO: 501718 - protein, 10 aa, Influenza virus
IRFNSDLDYQ

SEQ ID NO: 501719 - protein, 10 aa, Influenza virus
IRFNSDLNYQ

SEQ ID NO: 501720 - protein, 10 aa, Influenza virus
IRFNSDPDYQ

SEQ ID NO: 501721 - protein, 10 aa, Influenza virus
IRFNSNLDYQ

SEQ ID NO: 501722 - protein, 10 aa, Influenza virus
IRFVNSDCSK

SEQ ID NO: 501723 - protein, 10 aa, Influenza virus
IRGEFNQVEK

SEQ ID NO: 501724 - protein, 10 aa, Influenza virus
IRGEFNQVEN

SEQ ID NO: 501725 - protein, 10 aa, Influenza virus
IRGEFNQVEQ

SEQ ID NO: 501726 - protein, 10 aa, Influenza virus
IRGEFSQVEQ

SEQ ID NO: 501727 - protein, 10 aa, Influenza virus
IRGEFSQVER

SEQ ID NO: 501728 - protein, 10 aa, Influenza virus
IRGETTGRNC

SEQ ID NO: 501729 - protein, 10 aa, Influenza virus
IRGFVHFVEA

SEQ ID NO: 501730 - protein, 10 aa, Influenza virus
IRGFVYFVEA

SEQ ID NO: 501731 - protein, 10 aa, Influenza virus
IRGFVYFVEI

SEQ ID NO: 501732 - protein, 10 aa, Influenza virus
IRGFVYFVET

SEQ ID NO: 501733 - protein, 10 aa, Influenza virus
IRGKHSNGTI

SEQ ID NO: 501734 - protein, 10 aa, Influenza virus
IRGNSPIFNY

SEQ ID NO: 501735 - protein, 10 aa, Influenza virus
IRGNSPVFNY

SEQ ID NO: 501736 - protein, 10 aa, Influenza virus
IRGQPKEKAI

SEQ ID NO: 501737 - protein, 10 aa, Influenza virus
IRGQPKEKTI

SEQ ID NO: 501738 - protein, 10 aa, Influenza virus
IRGQPKERTI

SEQ ID NO: 501739 - protein, 10 aa, Influenza virus
IRGQQGRMDY

SEQ ID NO: 501740 - protein, 10 aa, Influenza virus
IRGRHSNGTI

SEQ ID NO: 501741 - protein, 10 aa, Influenza virus
IRGRPEEAKY

SEQ ID NO: 501742 - protein, 10 aa, Influenza virus
IRGRPEEVKY

SEQ ID NO: 501743 - protein, 10 aa, Influenza virus
IRGRPKEDEV

SEQ ID NO: 501744 - protein, 10 aa, Influenza virus
IRGRPKEDKV

SEQ ID NO: 501745 - protein, 10 aa, Influenza virus
IRGRPKEDRV

SEQ ID NO: 501746 - protein, 10 aa, Influenza virus
IRGRPKEEKV

SEQ ID NO: 501747 - protein, 10 aa, Influenza virus
IRGVVYFVET

SEQ ID NO: 501748 - protein, 10 aa, Influenza virus
IRGWAPLSKD

SEQ ID NO: 501749 - protein, 10 aa, Influenza virus
IRHENRMVIA

SEQ ID NO: 501750 - protein, 10 aa, Influenza virus
IRHENRMVLA

SEQ ID NO: 501751 - protein, 10 aa, Influenza virus
IRHLEECSCY

SEQ ID NO: 501752 - protein, 10 aa, Influenza virus
IRIAWSSSSC

SEQ ID NO: 501753 - protein, 10 aa, Influenza virus
IRIGSKGDIF

SEQ ID NO: 501754 - protein, 10 aa, Influenza virus
IRIGSKGDVF

SEQ ID NO: 501755 - protein, 10 aa, Influenza virus
IRIGSKGHVF

SEQ ID NO: 501756 - protein, 10 aa, Influenza virus
IRIGSRGDVF

SEQ ID NO: 501757 - protein, 10 aa, Influenza virus
IRIGSRGEVF

SEQ ID NO: 501758 - protein, 10 aa, Influenza virus
IRIGSRGHIF

SEQ ID NO: 501759 - protein, 10 aa, Influenza virus
IRIGSRGHVF

SEQ ID NO: 501760 - protein, 10 aa, Influenza virus
IRINMINSKI

SEQ ID NO: 501761 - protein, 10 aa, Influenza virus
IRINNETILE

SEQ ID NO: 501762 - protein, 10 aa, Influenza virus
IRKGLILEYY

SEQ ID NO: 501763 - protein, 10 aa, Influenza virus
IRLAAGGAIW

SEQ ID NO: 501764 - protein, 10 aa, Influenza virus
IRLAAGGDIW

SEQ ID NO: 501765 - protein, 10 aa, Influenza virus
IRLFDYSGWN

SEQ ID NO: 501766 - protein, 10 aa, Influenza virus
IRLFDYSKWN

SEQ ID NO: 501767 - protein, 10 aa, Influenza virus
IRLFDYSRWN

SEQ ID NO: 501768 - protein, 10 aa, Influenza virus
IRLSADGDIW

SEQ ID NO: 501769 - protein, 10 aa, Influenza virus
IRLSAGGAIW

SEQ ID NO: 501770 - protein, 10 aa, Influenza virus
IRLSAGGAVW

SEQ ID NO: 501771 - protein, 10 aa, Influenza virus
IRLSAGGDIW

SEQ ID NO: 501772 - protein, 10 aa, Influenza virus
IRLSAGGHIW

SEQ ID NO: 501773 - protein, 10 aa, Influenza virus
IRLSAGGNIW

SEQ ID NO: 501774 - protein, 10 aa, Influenza virus
IRLSGGGDIW

SEQ ID NO: 501775 - protein, 10 aa, Influenza virus
IRMAINWGRI

SEQ ID NO: 501776 - protein, 10 aa, Influenza virus
IRMATNECRI

SEQ ID NO: 501777 - protein, 10 aa, Influenza virus
IRMIKRGIND

SEQ ID NO: 501778 - protein, 10 aa, Influenza virus
IRMIKRGVND

SEQ ID NO: 501779 - protein, 10 aa, Influenza virus
IRMVKRGIND

SEQ ID NO: 501780 - protein, 10 aa, Influenza virus
IRNGTYDHKE

SEQ ID NO: 501781 - protein, 10 aa, Influenza virus
IRNGTYDHNI

SEQ ID NO: 501782 - protein, 10 aa, Influenza virus
IRNGTYNHED

SEQ ID NO: 501783 - protein, 10 aa, Influenza virus
IRNKHSNGTI

SEQ ID NO: 501784 - protein, 10 aa, Influenza virus
IRNKHSNGTT

SEQ ID NO: 501785 - protein, 10 aa, Influenza virus
IRNKHSNSTT

SEQ ID NO: 501786 - protein, 10 aa, Influenza virus
IRNLHIPEAG

SEQ ID NO: 501787 - protein, 10 aa, Influenza virus
IRNLHIPEVC

SEQ ID NO: 501788 - protein, 10 aa, Influenza virus
IRNNMINNDL

SEQ ID NO: 501789 - protein, 10 aa, Influenza virus
IRNNSYDHSK

SEQ ID NO: 501790 - protein, 10 aa, Influenza virus
IRNNTYDHAQ

SEQ ID NO: 501791 - protein, 10 aa, Influenza virus
IRNNTYDHKK

SEQ ID NO: 501792 - protein, 10 aa, Influenza virus
IRNNTYDHSH

SEQ ID NO: 501793 - protein, 10 aa, Influenza virus
IRNNTYDHSK

SEQ ID NO: 501794 - protein, 10 aa, Influenza virus
IRNNTYDHSQ

SEQ ID NO: 501795 - protein, 10 aa, Influenza virus
IRNNTYDHSR

SEQ ID NO: 501796 - protein, 10 aa, Influenza virus
IRNNTYDHST

SEQ ID NO: 501797 - protein, 10 aa, Influenza virus
IRNNTYDHTK

SEQ ID NO: 501798 - protein, 10 aa, Influenza virus
IRNNTYDHTQ

SEQ ID NO: 501799 - protein, 10 aa, Influenza virus
IRNNTYNHTE

SEQ ID NO: 501800 - protein, 10 aa, Influenza virus
IRNNTYNHTQ

SEQ ID NO: 501801 - protein, 10 aa, Influenza virus
IRNRHSNGTI

SEQ ID NO: 501802 - protein, 10 aa, Influenza virus
IRPCFWVELI

SEQ ID NO: 501803 - protein, 10 aa, Influenza virus
IRPCFWVELV

SEQ ID NO: 501804 - protein, 10 aa, Influenza virus
IRPGYNGQKS

SEQ ID NO: 501805 - protein, 10 aa, Influenza virus
IRRRVDINPG

SEQ ID NO: 501806 - protein, 10 aa, Influenza virus
IRRRVDMNPG

SEQ ID NO: 501807 - protein, 10 aa, Influenza virus
IRRRVDTNPG

SEQ ID NO: 501808 - protein, 10 aa, Influenza virus
IRRRVDVNPG

SEQ ID NO: 501809 - protein, 10 aa, Influenza virus
IRSFSRTELI

SEQ ID NO: 501810 - protein, 10 aa, Influenza virus
IRSWRKQILR

SEQ ID NO: 501811 - protein, 10 aa, Influenza virus
IRTATREGKH

SEQ ID NO: 501812 - protein, 10 aa, Influenza virus
IRTDGATSAC

SEQ ID NO: 501813 - protein, 10 aa, Influenza virus
IRTFSFQLIL

SEQ ID NO: 501814 - protein, 10 aa, Influenza virus
IRTFSFQLIN

SEQ ID NO: 501815 - protein, 10 aa, Influenza virus
IRTKSGGNTN

SEQ ID NO: 501816 - protein, 10 aa, Influenza virus
IRTLTLNTMT

SEQ ID NO: 501817 - protein, 10 aa, Influenza virus
IRTNGNLIAP

SEQ ID NO: 501818 - protein, 10 aa, Influenza virus
IRTNGTSKIK

SEQ ID NO: 501819 - protein, 10 aa, Influenza virus
IRTRGLFGAI

SEQ ID NO: 501820 - protein, 10 aa, Influenza virus
IRTRSGGNNN

SEQ ID NO: 501821 - protein, 10 aa, Influenza virus
IRTRSGGNTN

SEQ ID NO: 501822 - protein, 10 aa, Influenza virus
IRTRSGGNTS

SEQ ID NO: 501823 - protein, 10 aa, Influenza virus
IRTWAKNILR

SEQ ID NO: 501824 - protein, 10 aa, Influenza virus
IRVGCVILLN

SEQ ID NO: 501825 - protein, 10 aa, Influenza virus
IRVGSRGHVF

SEQ ID NO: 501826 - protein, 10 aa, Influenza virus
IRVKRRPVAK

SEQ ID NO: 501827 - protein, 10 aa, Influenza virus
IRWETTGRNC

SEQ ID NO: 501828 - protein, 10 aa, Influenza virus
IRWLTLKSGQ

SEQ ID NO: 501829 - protein, 10 aa, Influenza virus
ISATGMALSV

SEQ ID NO: 501830 - protein, 10 aa, Influenza virus
ISATGMILSV

SEQ ID NO: 501831 - protein, 10 aa, Influenza virus
ISATGMTLSV

SEQ ID NO: 501832 - protein, 10 aa, Influenza virus
ISATGVTLSV

SEQ ID NO: 501833 - protein, 10 aa, Influenza virus
ISCFLLAALL

SEQ ID NO: 501834 - protein, 10 aa, Influenza virus
ISCFLLIALL

SEQ ID NO: 501835 - protein, 10 aa, Influenza virus
ISCFLLVALF

SEQ ID NO: 501836 - protein, 10 aa, Influenza virus
ISCFLLVALL

SEQ ID NO: 501837 - protein, 10 aa, Influenza virus
ISCLYKLSQF

SEQ ID NO: 501838 - protein, 10 aa, Influenza virus
ISCSHLECRT

SEQ ID NO: 501839 - protein, 10 aa, Influenza virus
ISCSHMECRT

SEQ ID NO: 501840 - protein, 10 aa, Influenza virus
ISCSHSECRT

SEQ ID NO: 501841 - protein, 10 aa, Influenza virus
ISCSIDECRT

SEQ ID NO: 501842 - protein, 10 aa, Influenza virus
ISCSIHECRT

SEQ ID NO: 501843 - protein, 10 aa, Influenza virus
ISCSINECRT

SEQ ID NO: 501844 - protein, 10 aa, Influenza virus
ISCSISECRT

SEQ ID NO: 501845 - protein, 10 aa, Influenza virus
ISCSVSECRT

SEQ ID NO: 501846 - protein, 10 aa, Influenza virus
ISCSYLECRT

SEQ ID NO: 501847 - protein, 10 aa, Influenza virus
ISDGGPNLYN

SEQ ID NO: 501848 - protein, 10 aa, Influenza virus
ISDKIDDQIE

SEQ ID NO: 501849 - protein, 10 aa, Influenza virus
ISECRTFFLT

SEQ ID NO: 501850 - protein, 10 aa, Influenza virus
ISFAISCFLL

SEQ ID NO: 501851 - protein, 10 aa, Influenza virus
ISFAMSCFLL

SEQ ID NO: 501852 - protein, 10 aa, Influenza virus
ISFATSCFLL

SEQ ID NO: 501853 - protein, 10 aa, Influenza virus
ISFESNGGLL

SEQ ID NO: 501854 - protein, 10 aa, Influenza virus
ISFESNGNFI

SEQ ID NO: 501855 - protein, 10 aa, Influenza virus
ISFESTGNLI

SEQ ID NO: 501856 - protein, 10 aa, Influenza virus
ISFESTGNLV

SEQ ID NO: 501857 - protein, 10 aa, Influenza virus
ISFQGGHIEE

SEQ ID NO: 501858 - protein, 10 aa, Influenza virus
ISFSISCFLF

SEQ ID NO: 501859 - protein, 10 aa, Influenza virus
ISFSISCFLL

SEQ ID NO: 501860 - protein, 10 aa, Influenza virus
ISFSMSCFVF

SEQ ID NO: 501861 - protein, 10 aa, Influenza virus
ISFTITGDNT

SEQ ID NO: 501862 - protein, 10 aa, Influenza virus
ISFWMCSGHS

SEQ ID NO: 501863 - protein, 10 aa, Influenza virus
ISFWMCSNGS

SEQ ID NO: 501864 - protein, 10 aa, Influenza virus
ISFYWTIVDP

SEQ ID NO: 501865 - protein, 10 aa, Influenza virus
ISFYWTIVEP

SEQ ID NO: 501866 - protein, 10 aa, Influenza virus
ISFYWTVVEP

SEQ ID NO: 501867 - protein, 10 aa, Influenza virus
ISGADDDAYA

SEQ ID NO: 501868 - protein, 10 aa, Influenza virus
ISGPDDGAVA

SEQ ID NO: 501869 - protein, 10 aa, Influenza virus
ISGPDNEAVA

SEQ ID NO: 501870 - protein, 10 aa, Influenza virus
ISGPDNGAVA

SEQ ID NO: 501871 - protein, 10 aa, Influenza virus
ISGPDSGAVA

SEQ ID NO: 501872 - protein, 10 aa, Influenza virus
ISGPNNNASA

SEQ ID NO: 501873 - protein, 10 aa, Influenza virus
ISGTCAVVMT

SEQ ID NO: 501874 - protein, 10 aa, Influenza virus
ISGVKLEENS

SEQ ID NO: 501875 - protein, 10 aa, Influenza virus
ISGWTTANSK

SEQ ID NO: 501876 - protein, 10 aa, Influenza virus
ISHCRATEYI

SEQ ID NO: 501877 - protein, 10 aa, Influenza virus
ISHISPLSGS

SEQ ID NO: 501878 - protein, 10 aa, Influenza virus
ISHRTLLMNE

SEQ ID NO: 501879 - protein, 10 aa, Influenza virus
ISIASRSGYE

SEQ ID NO: 501880 - protein, 10 aa, Influenza virus
ISIGSSTYQN

SEQ ID NO: 501881 - protein, 10 aa, Influenza virus
ISIGTSTLNQ

SEQ ID NO: 501882 - protein, 10 aa, Influenza virus
ISIVPNIGSR

SEQ ID NO: 501883 - protein, 10 aa, Influenza virus
ISIWMCSNGS

SEQ ID NO: 501884 - protein, 10 aa, Influenza virus
ISIYWTLVNP

SEQ ID NO: 501885 - protein, 10 aa, Influenza virus
ISKCKTKEGR

SEQ ID NO: 501886 - protein, 10 aa, Influenza virus
ISKCRTKEGR

SEQ ID NO: 501887 - protein, 10 aa, Influenza virus
ISKCRTREGR

SEQ ID NO: 501888 - protein, 10 aa, Influenza virus
ISKDLRSGYE

SEQ ID NO: 501889 - protein, 10 aa, Influenza virus
ISKDNGIRIG

SEQ ID NO: 501890 - protein, 10 aa, Influenza virus
ISKDSRSGYE

SEQ ID NO: 501891 - protein, 10 aa, Influenza virus
ISKDTRSGYE

SEQ ID NO: 501892 - protein, 10 aa, Influenza virus
ISKRGGSGIM

SEQ ID NO: 501893 - protein, 10 aa, Influenza virus
ISKRGNSGIM

SEQ ID NO: 501894 - protein, 10 aa, Influenza virus
ISKRGSSGIM

SEQ ID NO: 501895 - protein, 10 aa, Influenza virus
ISKRGSSGIV

SEQ ID NO: 501896 - protein, 10 aa, Influenza virus
ISKRGSSGVM

SEQ ID NO: 501897 - protein, 10 aa, Influenza virus
ISKSRATEYI

SEQ ID NO: 501898 - protein, 10 aa, Influenza virus
ISKSRTKEGR

SEQ ID NO: 501899 - protein, 10 aa, Influenza virus
ISKSTKSTVL

SEQ ID NO: 501900 - protein, 10 aa, Influenza virus
ISKTNQQFEL

SEQ ID NO: 501901 - protein, 10 aa, Influenza virus
ISLCSIWFSH

SEQ ID NO: 501902 - protein, 10 aa, Influenza virus
ISLGDCSFAG

SEQ ID NO: 501903 - protein, 10 aa, Influenza virus
ISLGGCSFAG

SEQ ID NO: 501904 - protein, 10 aa, Influenza virus
ISLVKTTLFL

SEQ ID NO: 501905 - protein, 10 aa, Influenza virus
ISLWMCSNGS

SEQ ID NO: 501906 - protein, 10 aa, Influenza virus
ISMCSSTEFL

SEQ ID NO: 501907 - protein, 10 aa, Influenza virus
ISMDSRSGYE

SEQ ID NO: 501908 - protein, 10 aa, Influenza virus
ISMEDYSIDS

SEQ ID NO: 501909 - protein, 10 aa, Influenza virus
ISMEDYSIGS

SEQ ID NO: 501910 - protein, 10 aa, Influenza virus
ISNEGSYFFG

SEQ ID NO: 501911 - protein, 10 aa, Influenza virus
ISNETILETG

SEQ ID NO: 501912 - protein, 10 aa, Influenza virus
ISNLPFQNIN

SEQ ID NO: 501913 - protein, 10 aa, Influenza virus
ISNQGSFYRN

SEQ ID NO: 501914 - protein, 10 aa, Influenza virus
ISNQGSFYRS

SEQ ID NO: 501915 - protein, 10 aa, Influenza virus
ISNRFQIQGV

SEQ ID NO: 501916 - protein, 10 aa, Influenza virus
ISNVGLNISL

SEQ ID NO: 501917 - protein, 10 aa, Influenza virus
ISNVGLNVSL

SEQ ID NO: 501918 - protein, 10 aa, Influenza virus
ISPHSRSGFE

SEQ ID NO: 501919 - protein, 10 aa, Influenza virus
ISPIHLGDCS

SEQ ID NO: 501920 - protein, 10 aa, Influenza virus
ISPKLRSGFE

SEQ ID NO: 501921 - protein, 10 aa, Influenza virus
ISPLAGSAQH

SEQ ID NO: 501922 - protein, 10 aa, Influenza virus
ISPLAVTWWN

SEQ ID NO: 501923 - protein, 10 aa, Influenza virus
ISPLMVAYML

SEQ ID NO: 501924 - protein, 10 aa, Influenza virus
ISPLSGSAQH

SEQ ID NO: 501925 - protein, 10 aa, Influenza virus
ISPRLRSGFE

SEQ ID NO: 501926 - protein, 10 aa, Influenza virus
ISPRSRNGFE

SEQ ID NO: 501927 - protein, 10 aa, Influenza virus
ISPRSRSGFE

SEQ ID NO: 501928 - protein, 10 aa, Influenza virus
ISPVHLGDCS

SEQ ID NO: 501929 - protein, 10 aa, Influenza virus
ISRARIDARI

SEQ ID NO: 501930 - protein, 10 aa, Influenza virus
ISRDSRSGYE

SEQ ID NO: 501931 - protein, 10 aa, Influenza virus
ISSGSLKLAI

SEQ ID NO: 501932 - protein, 10 aa, Influenza virus
ISSLPFQNIN

SEQ ID NO: 501933 - protein, 10 aa, Influenza virus
ISSMGEAMVS

SEQ ID NO: 501934 - protein, 10 aa, Influenza virus
ISSMMEAMVS

SEQ ID NO: 501935 - protein, 10 aa, Influenza virus
ISSMVEAMIS

SEQ ID NO: 501936 - protein, 10 aa, Influenza virus
ISSMVEAMMS

SEQ ID NO: 501937 - protein, 10 aa, Influenza virus
ISSMVEAMVS

SEQ ID NO: 501938 - protein, 10 aa, Influenza virus
ISSSFSFGGF

SEQ ID NO: 501939 - protein, 10 aa, Influenza virus
ISSSLVLMGL

SEQ ID NO: 501940 - protein, 10 aa, Influenza virus
ISTASRSGYE

SEQ ID NO: 501941 - protein, 10 aa, Influenza virus
ISTASRYGYE

SEQ ID NO: 501942 - protein, 10 aa, Influenza virus
ISTPLGSPPI

SEQ ID NO: 501943 - protein, 10 aa, Influenza virus
ISTPLGSPPM

SEQ ID NO: 501944 - protein, 10 aa, Influenza virus
ISTPLGSPPV

SEQ ID NO: 501945 - protein, 10 aa, Influenza virus
ISTPLGTPPT

SEQ ID NO: 501946 - protein, 10 aa, Influenza virus
ISTTFPYTGD

SEQ ID NO: 501947 - protein, 10 aa, Influenza virus
ISTTGMTLSV

SEQ ID NO: 501948 - protein, 10 aa, Influenza virus
ISVESSTYQN

SEQ ID NO: 501949 - protein, 10 aa, Influenza virus
ISVGSGSFPD

SEQ ID NO: 501950 - protein, 10 aa, Influenza virus
ISVGSSIYQN

SEQ ID NO: 501951 - protein, 10 aa, Influenza virus
ISVGSSTYQN

SEQ ID NO: 501952 - protein, 10 aa, Influenza virus
ISVGTSTLNL

SEQ ID NO: 501953 - protein, 10 aa, Influenza virus
ISVGTSTLNQ

SEQ ID NO: 501954 - protein, 10 aa, Influenza virus
ISWEMGLAPS

SEQ ID NO: 501955 - protein, 10 aa, Influenza virus
ISWEMGQAPS

SEQ ID NO: 501956 - protein, 10 aa, Influenza virus
ISWGMGQAPS

SEQ ID NO: 501957 - protein, 10 aa, Influenza virus
ISWPLSSPPT

SEQ ID NO: 501958 - protein, 10 aa, Influenza virus
ISWPQSSPPT

SEQ ID NO: 501959 - protein, 10 aa, Influenza virus
ITAASLNDDG

SEQ ID NO: 501960 - protein, 10 aa, Influenza virus
ITCTCRDNWQ

SEQ ID NO: 501961 - protein, 10 aa, Influenza virus
ITCVCRDNWH

SEQ ID NO: 501962 - protein, 10 aa, Influenza virus
ITCVCRDNWQ

SEQ ID NO: 501963 - protein, 10 aa, Influenza virus
ITDGPSDAQA

SEQ ID NO: 501964 - protein, 10 aa, Influenza virus
ITDGPSNAQA

SEQ ID NO: 501965 - protein, 10 aa, Influenza virus
ITDIWAYNAE

SEQ ID NO: 501966 - protein, 10 aa, Influenza virus
ITDIWTYQAE

SEQ ID NO: 501967 - protein, 10 aa, Influenza virus
ITDTFKSWKG

SEQ ID NO: 501968 - protein, 10 aa, Influenza virus
ITDTLKSWKG

SEQ ID NO: 501969 - protein, 10 aa, Influenza virus
ITDWSGYSGS

SEQ ID NO: 501970 - protein, 10 aa, Influenza virus
ITEINTWARN

SEQ ID NO: 501971 - protein, 10 aa, Influenza virus
ITEIVYLNHT

SEQ ID NO: 501972 - protein, 10 aa, Influenza virus
ITEIVYLNNT

SEQ ID NO: 501973 - protein, 10 aa, Influenza virus
ITEIVYLNST

SEQ ID NO: 501974 - protein, 10 aa, Influenza virus
ITEIYNETVR

SEQ ID NO: 501975 - protein, 10 aa, Influenza virus
ITELPFQNLS

SEQ ID NO: 501976 - protein, 10 aa, Influenza virus
ITENSFEQIT

SEQ ID NO: 501977 - protein, 10 aa, Influenza virus
ITEVWSYNAE

SEQ ID NO: 501978 - protein, 10 aa, Influenza virus
ITEWSGYSGS

SEQ ID NO: 501979 - protein, 10 aa, Influenza virus
ITFESNGGFL

SEQ ID NO: 501980 - protein, 10 aa, Influenza virus
ITFESNGGLL

SEQ ID NO: 501981 - protein, 10 aa, Influenza virus
ITFIQALQLL

SEQ ID NO: 501982 - protein, 10 aa, Influenza virus
ITFLHNGGLI

SEQ ID NO: 501983 - protein, 10 aa, Influenza virus
ITFLQALQLL

SEQ ID NO: 501984 - protein, 10 aa, Influenza virus
ITFMQALQLL

SEQ ID NO: 501985 - protein, 10 aa, Influenza virus
ITFSDNGGLI

SEQ ID NO: 501986 - protein, 10 aa, Influenza virus
ITFSFNGAFI

SEQ ID NO: 501987 - protein, 10 aa, Influenza virus
ITFSHNGGLI

SEQ ID NO: 501988 - protein, 10 aa, Influenza virus
ITFSHNGGLV

SEQ ID NO: 501989 - protein, 10 aa, Influenza virus
ITFSHNGGRI

SEQ ID NO: 501990 - protein, 10 aa, Influenza virus
ITGDDKNATA

SEQ ID NO: 501991 - protein, 10 aa, Influenza virus
ITGDDRNATA

SEQ ID NO: 501992 - protein, 10 aa, Influenza virus
ITGDNTKWNE

SEQ ID NO: 501993 - protein, 10 aa, Influenza virus
ITGFAPFSKD

SEQ ID NO: 501994 - protein, 10 aa, Influenza virus
ITGFASFSKD

SEQ ID NO: 501995 - protein, 10 aa, Influenza virus
ITGIDKVCTK

SEQ ID NO: 501996 - protein, 10 aa, Influenza virus
ITGINKVCTK

SEQ ID NO: 501997 - protein, 10 aa, Influenza virus
ITGKLNRFIE

SEQ ID NO: 501998 - protein, 10 aa, Influenza virus
ITGKLNRIIE

SEQ ID NO: 501999 - protein, 10 aa, Influenza virus
ITGKLNRLID

SEQ ID NO: 502000 - protein, 10 aa, Influenza virus
ITGKLNRLIE

SEQ ID NO: 502001 - protein, 10 aa, Influenza virus
ITGKLNRLIG

SEQ ID NO: 502002 - protein, 10 aa, Influenza virus
ITGKLNRLIS

SEQ ID NO: 502003 - protein, 10 aa, Influenza virus
ITGKSHGRIL

SEQ ID NO: 502004 - protein, 10 aa, Influenza virus
ITGKSHGRVL

SEQ ID NO: 502005 - protein, 10 aa, Influenza virus
ITGPDATAVA

SEQ ID NO: 502006 - protein, 10 aa, Influenza virus
ITGPDSTAVA

SEQ ID NO: 502007 - protein, 10 aa, Influenza virus
ITGPDTTAVA

SEQ ID NO: 502008 - protein, 10 aa, Influenza virus
ITGSPGAPGV

SEQ ID NO: 502009 - protein, 10 aa, Influenza virus
ITGSPSAPGV

SEQ ID NO: 502010 - protein, 10 aa, Influenza virus
ITGTLNRLID

SEQ ID NO: 502011 - protein, 10 aa, Influenza virus
ITHFQRKRRV

SEQ ID NO: 502012 - protein, 10 aa, Influenza virus
ITIGECPKYV

SEQ ID NO: 502013 - protein, 10 aa, Influenza virus
ITIGISGPDD

SEQ ID NO: 502014 - protein, 10 aa, Influenza virus
ITIGISGPDN

SEQ ID NO: 502015 - protein, 10 aa, Influenza virus
ITIGKCPKYV

SEQ ID NO: 502016 - protein, 10 aa, Influenza virus
ITIGKCSKYV

SEQ ID NO: 502017 - protein, 10 aa, Influenza virus
ITIGSISLTI

SEQ ID NO: 502018 - protein, 10 aa, Influenza virus
ITIGSVSLTI

SEQ ID NO: 502019 - protein, 10 aa, Influenza virus
ITKIVYLNST

SEQ ID NO: 502020 - protein, 10 aa, Influenza virus
ITLHFKQNEC

SEQ ID NO: 502021 - protein, 10 aa, Influenza virus
ITLKFAFNMM

SEQ ID NO: 502022 - protein, 10 aa, Influenza virus
ITNGTTGNPI

SEQ ID NO: 502023 - protein, 10 aa, Influenza virus
ITNKINNIVD

SEQ ID NO: 502024 - protein, 10 aa, Influenza virus
ITNKINSIID

SEQ ID NO: 502025 - protein, 10 aa, Influenza virus
ITNKVNNIVD

SEQ ID NO: 502026 - protein, 10 aa, Influenza virus
ITNKVNSIID

SEQ ID NO: 502027 - protein, 10 aa, Influenza virus
ITNPLIRHEN

SEQ ID NO: 502028 - protein, 10 aa, Influenza virus
ITNVQNNYTT

SEQ ID NO: 502029 - protein, 10 aa, Influenza virus
ITNWSGYSGS

SEQ ID NO: 502030 - protein, 10 aa, Influenza virus
ITPNGSIPND

SEQ ID NO: 502031 - protein, 10 aa, Influenza virus
ITPNGSIPNE

SEQ ID NO: 502032 - protein, 10 aa, Influenza virus
ITPNGSIPNG

SEQ ID NO: 502033 - protein, 10 aa, Influenza virus
ITPNGSIPNN

SEQ ID NO: 502034 - protein, 10 aa, Influenza virus
ITPNGSISND

SEQ ID NO: 502035 - protein, 10 aa, Influenza virus
ITQTLVSNDD

SEQ ID NO: 502036 - protein, 10 aa, Influenza virus
ITQTLVSNND

SEQ ID NO: 502037 - protein, 10 aa, Influenza virus
ITQTLVSNSD

SEQ ID NO: 502038 - protein, 10 aa, Influenza virus
ITREPYVSCD

SEQ ID NO: 502039 - protein, 10 aa, Influenza virus
ITRSGQNHGI

SEQ ID NO: 502040 - protein, 10 aa, Influenza virus
ITSLCSIWFS

SEQ ID NO: 502041 - protein, 10 aa, Influenza virus
ITSNLPFQNV

SEQ ID NO: 502042 - protein, 10 aa, Influenza virus
ITSPLPFQNI

SEQ ID NO: 502043 - protein, 10 aa, Influenza virus
ITTHFQRKRR

SEQ ID NO: 502044 - protein, 10 aa, Influenza virus
ITTKINNIID

SEQ ID NO: 502045 - protein, 10 aa, Influenza virus
ITTKINNIIE

SEQ ID NO: 502046 - protein, 10 aa, Influenza virus
ITVDHMAIIK

SEQ ID NO: 502047 - protein, 10 aa, Influenza virus
ITVGSSKYQQ

SEQ ID NO: 502048 - protein, 10 aa, Influenza virus
ITVGSSKYRQ

SEQ ID NO: 502049 - protein, 10 aa, Influenza virus
ITVIKNNMIN

SEQ ID NO: 502050 - protein, 10 aa, Influenza virus
ITVTHAKDIL

SEQ ID NO: 502051 - protein, 10 aa, Influenza virus
ITVTHAQDIL

SEQ ID NO: 502052 - protein, 10 aa, Influenza virus
ITVTHSVELL

SEQ ID NO: 502053 - protein, 10 aa, Influenza virus
ITVTHSVNLL

SEQ ID NO: 502054 - protein, 10 aa, Influenza virus
ITVTSSVELV

SEQ ID NO: 502055 - protein, 10 aa, Influenza virus
ITWGIHHPSS

SEQ ID NO: 502056 - protein, 10 aa, Influenza virus
ITYIWTYQAE

SEQ ID NO: 502057 - protein, 10 aa, Influenza virus
ITYNKTVINN

SEQ ID NO: 502058 - protein, 10 aa, Influenza virus
ITYNNTVINN

SEQ ID NO: 502059 - protein, 10 aa, Influenza virus
ITYNNTVVNN

SEQ ID NO: 502060 - protein, 10 aa, Influenza virus
ITYNSTVVNN

SEQ ID NO: 502061 - protein, 10 aa, Influenza virus
ITYSSPMMWE

SEQ ID NO: 502062 - protein, 10 aa, Influenza virus
ITYSSSLMWE

SEQ ID NO: 502063 - protein, 10 aa, Influenza virus
ITYSSSMMWE

SEQ ID NO: 502064 - protein, 10 aa, Influenza virus
IVAFCGTSGT

SEQ ID NO: 502065 - protein, 10 aa, Influenza virus
IVAIVFSQED

SEQ ID NO: 502066 - protein, 10 aa, Influenza virus
IVALCGSKEQ

SEQ ID NO: 502067 - protein, 10 aa, Influenza virus
IVALCGSKER

SEQ ID NO: 502068 - protein, 10 aa, Influenza virus
IVALCGSKKR

SEQ ID NO: 502069 - protein, 10 aa, Influenza virus
IVALCGSRER

SEQ ID NO: 502070 - protein, 10 aa, Influenza virus
IVAMVFSQED

SEQ ID NO: 502071 - protein, 10 aa, Influenza virus
IVAMVFSQEE

SEQ ID NO: 502072 - protein, 10 aa, Influenza virus
IVASSGTLEF

SEQ ID NO: 502073 - protein, 10 aa, Influenza virus
IVAVTDGPAA

SEQ ID NO: 502074 - protein, 10 aa, Influenza virus
IVDKMNREFE

SEQ ID NO: 502075 - protein, 10 aa, Influenza virus
IVDKMNREFG

SEQ ID NO: 502076 - protein, 10 aa, Influenza virus
IVDNKNWSGY

SEQ ID NO: 502077 - protein, 10 aa, Influenza virus
IVDNNNWFGY

SEQ ID NO: 502078 - protein, 10 aa, Influenza virus
IVDNNNWSGY

SEQ ID NO: 502079 - protein, 10 aa, Influenza virus
IVDNNSWSGY

SEQ ID NO: 502080 - protein, 10 aa, Influenza virus
IVDNQNWSGY

SEQ ID NO: 502081 - protein, 10 aa, Influenza virus
IVDNSNWSGY

SEQ ID NO: 502082 - protein, 10 aa, Influenza virus
IVEFCGTSGT

SEQ ID NO: 502083 - protein, 10 aa, Influenza virus
IVERILEEES

SEQ ID NO: 502084 - protein, 10 aa, Influenza virus
IVERPKEIEG

SEQ ID NO: 502085 - protein, 10 aa, Influenza virus
IVERPKEMEG

SEQ ID NO: 502086 - protein, 10 aa, Influenza virus
IVERPSAPEG

SEQ ID NO: 502087 - protein, 10 aa, Influenza virus
IVERTKEMEG

SEQ ID NO: 502088 - protein, 10 aa, Influenza virus
IVETGYVCSK

SEQ ID NO: 502089 - protein, 10 aa, Influenza virus
IVFCGTSGTY

SEQ ID NO: 502090 - protein, 10 aa, Influenza virus
IVFNTIGNLI

SEQ ID NO: 502091 - protein, 10 aa, Influenza virus
IVFNTIGNLV

SEQ ID NO: 502092 - protein, 10 aa, Influenza virus
IVFSQEDCMI

SEQ ID NO: 502093 - protein, 10 aa, Influenza virus
IVGLVFFCLK

SEQ ID NO: 502094 - protein, 10 aa, Influenza virus
IVGNDNWSGY

SEQ ID NO: 502095 - protein, 10 aa, Influenza virus
IVGNPSCASN

SEQ ID NO: 502096 - protein, 10 aa, Influenza virus
IVGNPSCATN

SEQ ID NO: 502097 - protein, 10 aa, Influenza virus
IVHISPLSGS

SEQ ID NO: 502098 - protein, 10 aa, Influenza virus
IVILVLGLSM

SEQ ID NO: 502099 - protein, 10 aa, Influenza virus
IVKGRSHLRN

SEQ ID NO: 502100 - protein, 10 aa, Influenza virus
IVKTLTNEKE

SEQ ID NO: 502101 - protein, 10 aa, Influenza virus
IVKTLTNEQE

SEQ ID NO: 502102 - protein, 10 aa, Influenza virus
IVKTLTNERE

SEQ ID NO: 502103 - protein, 10 aa, Influenza virus
IVKTLTSEKE

SEQ ID NO: 502104 - protein, 10 aa, Influenza virus
IVLGIINLLI

SEQ ID NO: 502105 - protein, 10 aa, Influenza virus
IVLLENQKTL

SEQ ID NO: 502106 - protein, 10 aa, Influenza virus
IVLNTDWSGY

SEQ ID NO: 502107 - protein, 10 aa, Influenza virus
IVLTTDWSGY

SEQ ID NO: 502108 - protein, 10 aa, Influenza virus
IVLVGLILAF

SEQ ID NO: 502109 - protein, 10 aa, Influenza virus
IVLVMKRKRD

SEQ ID NO: 502110 - protein, 10 aa, Influenza virus
IVMVGLILAF

SEQ ID NO: 502111 - protein, 10 aa, Influenza virus
IVNAALGSPG

SEQ ID NO: 502112 - protein, 10 aa, Influenza virus
IVNGALGSPG

SEQ ID NO: 502113 - protein, 10 aa, Influenza virus
IVNNNNWSGY

SEQ ID NO: 502114 - protein, 10 aa, Influenza virus
IVNNQDWSGY

SEQ ID NO: 502115 - protein, 10 aa, Influenza virus
IVNNQNWSGY

SEQ ID NO: 502116 - protein, 10 aa, Influenza virus
IVNSALGSPG

SEQ ID NO: 502117 - protein, 10 aa, Influenza virus
IVNTTLSTIA

SEQ ID NO: 502118 - protein, 10 aa, Influenza virus
IVPCFWLEMI

SEQ ID NO: 502119 - protein, 10 aa, Influenza virus
IVPNIGSRPR

SEQ ID NO: 502120 - protein, 10 aa, Influenza virus
IVPSGPLKAE

SEQ ID NO: 502121 - protein, 10 aa, Influenza virus
IVQITGKLNR

SEQ ID NO: 502122 - protein, 10 aa, Influenza virus
IVRRAAVSAD

SEQ ID NO: 502123 - protein, 10 aa, Influenza virus
IVRRAIVSAD

SEQ ID NO: 502124 - protein, 10 aa, Influenza virus
IVRRATVSAD

SEQ ID NO: 502125 - protein, 10 aa, Influenza virus
IVSADPLASL

SEQ ID NO: 502126 - protein, 10 aa, Influenza virus
IVSIDRFLRV

SEQ ID NO: 502127 - protein, 10 aa, Influenza virus
IVSKDNGIRI

SEQ ID NO: 502128 - protein, 10 aa, Influenza virus
IVSKDNGIRV

SEQ ID NO: 502129 - protein, 10 aa, Influenza virus
IVSLGAISFW

SEQ ID NO: 502130 - protein, 10 aa, Influenza virus
IVSMCSSTEF

SEQ ID NO: 502131 - protein, 10 aa, Influenza virus
IVSNDNWSGY

SEQ ID NO: 502132 - protein, 10 aa, Influenza virus
IVSPLAVTWW

SEQ ID NO: 502133 - protein, 10 aa, Influenza virus
IVSSLPFQNI

SEQ ID NO: 502134 - protein, 10 aa, Influenza virus
IVSSLPFQSI

SEQ ID NO: 502135 - protein, 10 aa, Influenza virus
IVSWSQNILR

SEQ ID NO: 502136 - protein, 10 aa, Influenza virus
IVTFCGLDBE

SEQ ID NO: 502137 - protein, 10 aa, Influenza virus
IVTFCGLDNE

SEQ ID NO: 502138 - protein, 10 aa, Influenza virus
IVTFCGLNNE

SEQ ID NO: 502139 - protein, 10 aa, Influenza virus
IVTHFQRKRR

SEQ ID NO: 502140 - protein, 10 aa, Influenza virus
IVTREPCVSC

SEQ ID NO: 502141 - protein, 10 aa, Influenza virus
IVTREPYISC

SEQ ID NO: 502142 - protein, 10 aa, Influenza virus
IVTREPYVSC

SEQ ID NO: 502143 - protein, 10 aa, Influenza virus
IVTTVGWSWP

SEQ ID NO: 502144 - protein, 10 aa, Influenza virus
IVVFCGASGT

SEQ ID NO: 502145 - protein, 10 aa, Influenza virus
IVVFCGTPGT

SEQ ID NO: 502146 - protein, 10 aa, Influenza virus
IVVFCGTSAT

SEQ ID NO: 502147 - protein, 10 aa, Influenza virus
IVVFCGTSGT

SEQ ID NO: 502148 - protein, 10 aa, Influenza virus
IVVFCGTSRT

SEQ ID NO: 502149 - protein, 10 aa, Influenza virus
IVVMTDGSAS

SEQ ID NO: 502150 - protein, 10 aa, Influenza virus
IVVTREPYVS

SEQ ID NO: 502151 - protein, 10 aa, Influenza virus
IVWACQRGNI

SEQ ID NO: 502152 - protein, 10 aa, Influenza virus
IVWGIHHPSS

SEQ ID NO: 502153 - protein, 10 aa, Influenza virus
IVWGVHHSSS

SEQ ID NO: 502154 - protein, 10 aa, Influenza virus
IWAIHHPPTS

SEQ ID NO: 502155 - protein, 10 aa, Influenza virus
IWASGSSISF

SEQ ID NO: 502156 - protein, 10 aa, Influenza virus
IWAYNAELIV

SEQ ID NO: 502157 - protein, 10 aa, Influenza virus
IWAYNAELLV

SEQ ID NO: 502158 - protein, 10 aa, Influenza virus
IWDANGWVST

SEQ ID NO: 502159 - protein, 10 aa, Influenza virus
IWDTLIERDN

SEQ ID NO: 502160 - protein, 10 aa, Influenza virus
IWFSHYNQIT

SEQ ID NO: 502161 - protein, 10 aa, Influenza virus
IWFSHYNQMK

SEQ ID NO: 502162 - protein, 10 aa, Influenza virus
IWFSHYNQMT

SEQ ID NO: 502163 - protein, 10 aa, Influenza virus
IWFSHYNQVT

SEQ ID NO: 502164 - protein, 10 aa, Influenza virus
IWGIHHPNDD

SEQ ID NO: 502165 - protein, 10 aa, Influenza virus
IWGIHHPNDE

SEQ ID NO: 502166 - protein, 10 aa, Influenza virus
IWGVHHPIDE

SEQ ID NO: 502167 - protein, 10 aa, Influenza virus
IWGVHHPKDE

SEQ ID NO: 502168 - protein, 10 aa, Influenza virus
IWGVHHPNDE

SEQ ID NO: 502169 - protein, 10 aa, Influenza virus
IWGVHHPSTD

SEQ ID NO: 502170 - protein, 10 aa, Influenza virus
IWHSNLNDAT

SEQ ID NO: 502171 - protein, 10 aa, Influenza virus
IWHSNLNDTT

SEQ ID NO: 502172 - protein, 10 aa, Influenza virus
IWITREPYVS

SEQ ID NO: 502173 - protein, 10 aa, Influenza virus
IWLWLVLREK

SEQ ID NO: 502174 - protein, 10 aa, Influenza virus
IWMACHSAAF

SEQ ID NO: 502175 - protein, 10 aa, Influenza virus
IWMCSNGSLQ

SEQ ID NO: 502176 - protein, 10 aa, Influenza virus
IWSYNAELLV

SEQ ID NO: 502177 - protein, 10 aa, Influenza virus
IWSYNAKLLV

SEQ ID NO: 502178 - protein, 10 aa, Influenza virus
IWSYNAQLLV

SEQ ID NO: 502179 - protein, 10 aa, Influenza virus
IWSYNARLLV

SEQ ID NO: 502180 - protein, 10 aa, Influenza virus
IWTSASSISF

SEQ ID NO: 502181 - protein, 10 aa, Influenza virus
IWTSGSIISF

SEQ ID NO: 502182 - protein, 10 aa, Influenza virus
IWTSGSSIAF

SEQ ID NO: 502183 - protein, 10 aa, Influenza virus
IWTSGSSISF

SEQ ID NO: 502184 - protein, 10 aa, Influenza virus
IWTSSSSIVM

SEQ ID NO: 502185 - protein, 10 aa, Influenza virus
IWTSSSSTVF

SEQ ID NO: 502186 - protein, 10 aa, Influenza virus
IWTSSSSVVM

SEQ ID NO: 502187 - protein, 10 aa, Influenza virus
IWTYNAELLI

SEQ ID NO: 502188 - protein, 10 aa, Influenza virus
IWTYNAELLV

SEQ ID NO: 502189 - protein, 10 aa, Influenza virus
IWTYQAELLV

SEQ ID NO: 502190 - protein, 10 aa, Influenza virus
IWTYQEELLV

SEQ ID NO: 502191 - protein, 10 aa, Influenza virus
IWVTRELYVS

SEQ ID NO: 502192 - protein, 10 aa, Influenza virus
IWVTREPYVS

SEQ ID NO: 502193 - protein, 10 aa, Influenza virus
IYATVAGSLS

SEQ ID NO: 502194 - protein, 10 aa, Influenza virus
IYCICRDNWK

SEQ ID NO: 502195 - protein, 10 aa, Influenza virus
IYCVCRDNWK

SEQ ID NO: 502196 - protein, 10 aa, Influenza virus
IYGKDNAIRI

SEQ ID NO: 502197 - protein, 10 aa, Influenza virus
IYGKDNAVRI

SEQ ID NO: 502198 - protein, 10 aa, Influenza virus
IYGNPKCDIH

SEQ ID NO: 502199 - protein, 10 aa, Influenza virus
IYGNPKCDTH

SEQ ID NO: 502200 - protein, 10 aa, Influenza virus
IYGNPKCDVH

SEQ ID NO: 502201 - protein, 10 aa, Influenza virus
IYIEVLHLTQ

SEQ ID NO: 502202 - protein, 10 aa, Influenza virus
IYKILSIYSC

SEQ ID NO: 502203 - protein, 10 aa, Influenza virus
IYKILSIYST

SEQ ID NO: 502204 - protein, 10 aa, Influenza virus
IYKILTIYST

SEQ ID NO: 502205 - protein, 10 aa, Influenza virus
IYQILAIYAT

SEQ ID NO: 502206 - protein, 10 aa, Influenza virus
IYQILAIYST

SEQ ID NO: 502207 - protein, 10 aa, Influenza virus
IYQILSIYST

SEQ ID NO: 502208 - protein, 10 aa, Influenza virus
IYRDEAINNR

SEQ ID NO: 502209 - protein, 10 aa, Influenza virus
IYSCIASSIV

SEQ ID NO: 502210 - protein, 10 aa, Influenza virus
IYSCIASSLI

SEQ ID NO: 502211 - protein, 10 aa, Influenza virus
IYSCIASSLV

SEQ ID NO: 502212 - protein, 10 aa, Influenza virus
IYSCIASSTV

SEQ ID NO: 502213 - protein, 10 aa, Influenza virus
IYSCIASSVV

SEQ ID NO: 502214 - protein, 10 aa, Influenza virus
IYSGIRTNGA

SEQ ID NO: 502215 - protein, 10 aa, Influenza virus
IYSSSMMWEI

SEQ ID NO: 502216 - protein, 10 aa, Influenza virus
IYSSVASSLV

SEQ ID NO: 502217 - protein, 10 aa, Influenza virus
IYSTAASSLV

SEQ ID NO: 502218 - protein, 10 aa, Influenza virus
IYSTISSSLV

SEQ ID NO: 502219 - protein, 10 aa, Influenza virus
IYSTVAASLC

SEQ ID NO: 502220 - protein, 10 aa, Influenza virus
IYSTVASSLV

SEQ ID NO: 502221 - protein, 10 aa, Influenza virus
IYSTVASSSV

SEQ ID NO: 502222 - protein, 10 aa, Influenza virus
IYSTVSSSLV

SEQ ID NO: 502223 - protein, 10 aa, Influenza virus
IYWHLMHPGE

SEQ ID NO: 502224 - protein, 10 aa, Influenza virus
IYWTIVKPGD

SEQ ID NO: 502225 - protein, 10 aa, Influenza virus
IYWTLVNPGD

SEQ ID NO: 502226 - protein, 10 aa, Influenza virus
IYWTVVKPGD

SEQ ID NO: 502227 - protein, 10 aa, Influenza virus
IYWWDGLQSS

SEQ ID NO: 502228 - protein, 10 aa, Influenza virus
KAAIGLRISS

SEQ ID NO: 502229 - protein, 10 aa, Influenza virus
KAALGLRISS

SEQ ID NO: 502230 - protein, 10 aa, Influenza virus
KAAMGLKISS

SEQ ID NO: 502231 - protein, 10 aa, Influenza virus
KAAMGLRISS

SEQ ID NO: 502232 - protein, 10 aa, Influenza virus
KAAMGMRISS

SEQ ID NO: 502233 - protein, 10 aa, Influenza virus
KAATQTLVSN

SEQ ID NO: 502234 - protein, 10 aa, Influenza virus
KACELTDSIW

SEQ ID NO: 502235 - protein, 10 aa, Influenza virus
KACELTDSSW

SEQ ID NO: 502236 - protein, 10 aa, Influenza virus
KACELTDSTW

SEQ ID NO: 502237 - protein, 10 aa, Influenza virus
KACELTDSVW

SEQ ID NO: 502238 - protein, 10 aa, Influenza virus
KACELTGSSW

SEQ ID NO: 502239 - protein, 10 aa, Influenza virus
KACNALTGGQ

SEQ ID NO: 502240 - protein, 10 aa, Influenza virus
KACNASTGAQ

SEQ ID NO: 502241 - protein, 10 aa, Influenza virus
KACNASTGGQ

SEQ ID NO: 502242 - protein, 10 aa, Influenza virus
KACSASTGGQ

SEQ ID NO: 502243 - protein, 10 aa, Influenza virus
KADEICIGYL

SEQ ID NO: 502244 - protein, 10 aa, Influenza virus
KADKICIGYL

SEQ ID NO: 502245 - protein, 10 aa, Influenza virus
KADLIIERRN

SEQ ID NO: 502246 - protein, 10 aa, Influenza virus
KADTILERNV

SEQ ID NO: 502247 - protein, 10 aa, Influenza virus
KAEIAQKLED

SEQ ID NO: 502248 - protein, 10 aa, Influenza virus
KAEIAQRLED

SEQ ID NO: 502249 - protein, 10 aa, Influenza virus
KAEIAQRLEG

SEQ ID NO: 502250 - protein, 10 aa, Influenza virus
KAEIAQRLEN

SEQ ID NO: 502251 - protein, 10 aa, Influenza virus
KAEIAQRLES

SEQ ID NO: 502252 - protein, 10 aa, Influenza virus
KAGFIEGGWP

SEQ ID NO: 502253 - protein, 10 aa, Influenza virus
KAGFIENGWE

SEQ ID NO: 502254 - protein, 10 aa, Influenza virus
KAGVKMNPNQ

SEQ ID NO: 502255 - protein, 10 aa, Influenza virus
KAHNGKLCRL

SEQ ID NO: 502256 - protein, 10 aa, Influenza virus
KAIDEITTKI

SEQ ID NO: 502257 - protein, 10 aa, Influenza virus
KAIDIMQNKL

SEQ ID NO: 502258 - protein, 10 aa, Influenza virus
KAIDNMQNKL

SEQ ID NO: 502259 - protein, 10 aa, Influenza virus
KAIDNMQNRL

SEQ ID NO: 502260 - protein, 10 aa, Influenza virus
KAIDQITTKI

SEQ ID NO: 502261 - protein, 10 aa, Influenza virus
KAIDRITTKI

SEQ ID NO: 502262 - protein, 10 aa, Influenza virus
KAINEITTKI

SEQ ID NO: 502263 - protein, 10 aa, Influenza virus
KAIWTSGSSI

SEQ ID NO: 502264 - protein, 10 aa, Influenza virus
KAKLANVVRK

SEQ ID NO: 502265 - protein, 10 aa, Influenza virus
KALNEITTKI

SEQ ID NO: 502266 - protein, 10 aa, Influenza virus
KALSIYSCIA

SEQ ID NO: 502267 - protein, 10 aa, Influenza virus
KAMEQMAGSS

SEQ ID NO: 502268 - protein, 10 aa, Influenza virus
KAMEQVAGSS

SEQ ID NO: 502269 - protein, 10 aa, Influenza virus
KAMMDQVRES

SEQ ID NO: 502270 - protein, 10 aa, Influenza virus
KANQVFPQLN

SEQ ID NO: 502271 - protein, 10 aa, Influenza virus
KANVLIGQGD

SEQ ID NO: 502272 - protein, 10 aa, Influenza virus
KAPISLGDCS

SEQ ID NO: 502273 - protein, 10 aa, Influenza virus
KAPQLNPIDG

SEQ ID NO: 502274 - protein, 10 aa, Influenza virus
KAQHIEECSC

SEQ ID NO: 502275 - protein, 10 aa, Influenza virus
KASKEPEVHE

SEQ ID NO: 502276 - protein, 10 aa, Influenza virus
KASLRLAVGL

SEQ ID NO: 502277 - protein, 10 aa, Influenza virus
KASTQKAIDE

SEQ ID NO: 502278 - protein, 10 aa, Influenza virus
KASTQKAINE

SEQ ID NO: 502279 - protein, 10 aa, Influenza virus
KATCVCRDNW

SEQ ID NO: 502280 - protein, 10 aa, Influenza virus
KATKMEAILV

SEQ ID NO: 502281 - protein, 10 aa, Influenza virus
KATKMKAIIV

SEQ ID NO: 502282 - protein, 10 aa, Influenza virus
KATKMKAILV

SEQ ID NO: 502283 - protein, 10 aa, Influenza virus
KATNGNYGPI

SEQ ID NO: 502284 - protein, 10 aa, Influenza virus
KAVDLGSCGI

SEQ ID NO: 502285 - protein, 10 aa, Influenza virus
KAVKLYKKLK

SEQ ID NO: 502286 - protein, 10 aa, Influenza virus
KAVKLYRKLK

SEQ ID NO: 502287 - protein, 10 aa, Influenza virus
KAVRGDLNFV

SEQ ID NO: 502288 - protein, 10 aa, Influenza virus
KAWLHICVTG

SEQ ID NO: 502289 - protein, 10 aa, Influenza virus
KAWLHVCITG

SEQ ID NO: 502290 - protein, 10 aa, Influenza virus
KAWLHVCVTG

SEQ ID NO: 502291 - protein, 10 aa, Influenza virus
KCCNLFEKFF

SEQ ID NO: 502292 - protein, 10 aa, Influenza virus
KCCSLFEKFF

SEQ ID NO: 502293 - protein, 10 aa, Influenza virus
KCCTLFEKFF

SEQ ID NO: 502294 - protein, 10 aa, Influenza virus
KCDDDCMASI

SEQ ID NO: 502295 - protein, 10 aa, Influenza virus
KCDDHCMESI

SEQ ID NO: 502296 - protein, 10 aa, Influenza virus
KCDDQCMESI

SEQ ID NO: 502297 - protein, 10 aa, Influenza virus
KCDLYLNGRE

SEQ ID NO: 502298 - protein, 10 aa, Influenza virus
KCDLYLSGRE

SEQ ID NO: 502299 - protein, 10 aa, Influenza virus
KCDNECMETI

SEQ ID NO: 502300 - protein, 10 aa, Influenza virus
KCDNKCMETI

SEQ ID NO: 502301 - protein, 10 aa, Influenza virus
KCDNQCMESI

SEQ ID NO: 502302 - protein, 10 aa, Influenza virus
KCDPYLNGRE

SEQ ID NO: 502303 - protein, 10 aa, Influenza virus
KCFNPCFYVE

SEQ ID NO: 502304 - protein, 10 aa, Influenza virus
KCFWKGGSIK

SEQ ID NO: 502305 - protein, 10 aa, Influenza virus
KCFWKGGSIN

SEQ ID NO: 502306 - protein, 10 aa, Influenza virus
KCFWKGGTIN

SEQ ID NO: 502307 - protein, 10 aa, Influenza virus
KCFWRGGSII

SEQ ID NO: 502308 - protein, 10 aa, Influenza virus
KCFWRGGSIN

SEQ ID NO: 502309 - protein, 10 aa, Influenza virus
KCICRDNWKG

SEQ ID NO: 502310 - protein, 10 aa, Influenza virus
KCICRDNWRG

SEQ ID NO: 502311 - protein, 10 aa, Influenza virus
KCIERVRNGT

SEQ ID NO: 502312 - protein, 10 aa, Influenza virus
KCIESIRNGT

SEQ ID NO: 502313 - protein, 10 aa, Influenza virus
KCITPNGSIP

SEQ ID NO: 502314 - protein, 10 aa, Influenza virus
KCKTKEGRRK

SEQ ID NO: 502315 - protein, 10 aa, Influenza virus
KCMESVRNGT

SEQ ID NO: 502316 - protein, 10 aa, Influenza virus
KCMETIKNGT

SEQ ID NO: 502317 - protein, 10 aa, Influenza virus
KCNDPYPGNN

SEQ ID NO: 502318 - protein, 10 aa, Influenza virus
KCNDSCMDTI

SEQ ID NO: 502319 - protein, 10 aa, Influenza virus
KCNDSCMEAI

SEQ ID NO: 502320 - protein, 10 aa, Influenza virus
KCNDSCMETI

SEQ ID NO: 502321 - protein, 10 aa, Influenza virus
KCNEPYPGNN

SEQ ID NO: 502322 - protein, 10 aa, Influenza virus
KCNNECMETI

SEQ ID NO: 502323 - protein, 10 aa, Influenza virus
KCNNSCMETI

SEQ ID NO: 502324 - protein, 10 aa, Influenza virus
KCNNTCMETI

SEQ ID NO: 502325 - protein, 10 aa, Influenza virus
KCNTKCQTSL

SEQ ID NO: 502326 - protein, 10 aa, Influenza virus
KCNTKCQTSM

SEQ ID NO: 502327 - protein, 10 aa, Influenza virus
KCNTKCQTSV

SEQ ID NO: 502328 - protein, 10 aa, Influenza virus
KCPKYIPSGS

SEQ ID NO: 502329 - protein, 10 aa, Influenza virus
KCPKYIPSNS

SEQ ID NO: 502330 - protein, 10 aa, Influenza virus
KCPKYIPSRS

SEQ ID NO: 502331 - protein, 10 aa, Influenza virus
KCPKYISSGS

SEQ ID NO: 502332 - protein, 10 aa, Influenza virus
KCPRYIPSGS

SEQ ID NO: 502333 - protein, 10 aa, Influenza virus
KCPRYVKQSS

SEQ ID NO: 502334 - protein, 10 aa, Influenza virus
KCQLNEGVMN

SEQ ID NO: 502335 - protein, 10 aa, Influenza virus
KCQSPLGAIN

SEQ ID NO: 502336 - protein, 10 aa, Influenza virus
KCQTPLGAIN

SEQ ID NO: 502337 - protein, 10 aa, Influenza virus
KCQTPLGALN

SEQ ID NO: 502338 - protein, 10 aa, Influenza virus
KCQTSVGGID

SEQ ID NO: 502339 - protein, 10 aa, Influenza virus
KCQTSVGGIN

SEQ ID NO: 502340 - protein, 10 aa, Influenza virus
KCQTYAGAIN

SEQ ID NO: 502341 - protein, 10 aa, Influenza virus
KCQTYAGAVN

SEQ ID NO: 502342 - protein, 10 aa, Influenza virus
KCQTYTGAIN

SEQ ID NO: 502343 - protein, 10 aa, Influenza virus
KCRTKEGRRK

SEQ ID NO: 502344 - protein, 10 aa, Influenza virus
KCRTKEGRRR

SEQ ID NO: 502345 - protein, 10 aa, Influenza virus
KCRTREGRRK

SEQ ID NO: 502346 - protein, 10 aa, Influenza virus
KCVCRDNWKG

SEQ ID NO: 502347 - protein, 10 aa, Influenza virus
KCYNPCFYVE

SEQ ID NO: 502348 - protein, 10 aa, Influenza virus
KCYQFALGQG

SEQ ID NO: 502349 - protein, 10 aa, Influenza virus
KDAERGKLKR

SEQ ID NO: 502350 - protein, 10 aa, Influenza virus
KDCSVAGWLL

SEQ ID NO: 502351 - protein, 10 aa, Influenza virus
KDEGNGCFTF

SEQ ID NO: 502352 - protein, 10 aa, Influenza virus
KDGDIIFLWG

SEQ ID NO: 502353 - protein, 10 aa, Influenza virus
KDIILWFSFG

SEQ ID NO: 502354 - protein, 10 aa, Influenza virus
KDIILWFSFS

SEQ ID NO: 502355 - protein, 10 aa, Influenza virus
KDIILWISFS

SEQ ID NO: 502356 - protein, 10 aa, Influenza virus
KDIILWVSFS

SEQ ID NO: 502357 - protein, 10 aa, Influenza virus
KDILEKAHNG

SEQ ID NO: 502358 - protein, 10 aa, Influenza virus
KDILEKTHNG

SEQ ID NO: 502359 - protein, 10 aa, Influenza virus
KDILRTQESE

SEQ ID NO: 502360 - protein, 10 aa, Influenza virus
KDKTPYRSLI

SEQ ID NO: 502361 - protein, 10 aa, Influenza virus
KDLDNCHPIG

SEQ ID NO: 502362 - protein, 10 aa, Influenza virus
KDLGNCHPIG

SEQ ID NO: 502363 - protein, 10 aa, Influenza virus
KDLGNCHPVG

SEQ ID NO: 502364 - protein, 10 aa, Influenza virus
KDLGNGCFEF

SEQ ID NO: 502365 - protein, 10 aa, Influenza virus
KDLGSCHPIG

SEQ ID NO: 502366 - protein, 10 aa, Influenza virus
KDLRSGYETF

SEQ ID NO: 502367 - protein, 10 aa, Influenza virus
KDNAIDEGDG

SEQ ID NO: 502368 - protein, 10 aa, Influenza virus
KDNAIRFGEG

SEQ ID NO: 502369 - protein, 10 aa, Influenza virus
KDNAIRFGES

SEQ ID NO: 502370 - protein, 10 aa, Influenza virus
KDNAIRIGED

SEQ ID NO: 502371 - protein, 10 aa, Influenza virus
KDNAIRIGEE

SEQ ID NO: 502372 - protein, 10 aa, Influenza virus
KDNAIRIGEG

SEQ ID NO: 502373 - protein, 10 aa, Influenza virus
KDNAIRIGEN

SEQ ID NO: 502374 - protein, 10 aa, Influenza virus
KDNAIRLGEN

SEQ ID NO: 502375 - protein, 10 aa, Influenza virus
KDNAIRLGET

SEQ ID NO: 502376 - protein, 10 aa, Influenza virus
KDNAIRPGEN

SEQ ID NO: 502377 - protein, 10 aa, Influenza virus
KDNAKDEGNG

SEQ ID NO: 502378 - protein, 10 aa, Influenza virus
KDNAKDLGNG

SEQ ID NO: 502379 - protein, 10 aa, Influenza virus
KDNAKELGNG

SEQ ID NO: 502380 - protein, 10 aa, Influenza virus
KDNALRLAEN

SEQ ID NO: 502381 - protein, 10 aa, Influenza virus
KDNANDLGNG

SEQ ID NO: 502382 - protein, 10 aa, Influenza virus
KDNARELGNG

SEQ ID NO: 502383 - protein, 10 aa, Influenza virus
KDNAVRFGES

SEQ ID NO: 502384 - protein, 10 aa, Influenza virus
KDNAVRIGED

SEQ ID NO: 502385 - protein, 10 aa, Influenza virus
KDNAVRIGEK

SEQ ID NO: 502386 - protein, 10 aa, Influenza virus
KDNAVRIGEN

SEQ ID NO: 502387 - protein, 10 aa, Influenza virus
KDNAVRLGEN

SEQ ID NO: 502388 - protein, 10 aa, Influenza virus
KDNGIRIGSK

SEQ ID NO: 502389 - protein, 10 aa, Influenza virus
KDNGIRIGSR

SEQ ID NO: 502390 - protein, 10 aa, Influenza virus
KDNGIRVGSR

SEQ ID NO: 502391 - protein, 10 aa, Influenza virus
KDNGVRIGSK

SEQ ID NO: 502392 - protein, 10 aa, Influenza virus
KDNLEPGTFD

SEQ ID NO: 502393 - protein, 10 aa, Influenza virus
KDNNIRIGSK

SEQ ID NO: 502394 - protein, 10 aa, Influenza virus
KDNPIRLSGG

SEQ ID NO: 502395 - protein, 10 aa, Influenza virus
KDNQVFPQLN

SEQ ID NO: 502396 - protein, 10 aa, Influenza virus
KDNSIQLSAG

SEQ ID NO: 502397 - protein, 10 aa, Influenza virus
KDNSIRIGSK

SEQ ID NO: 502398 - protein, 10 aa, Influenza virus
KDNSIRIGSR

SEQ ID NO: 502399 - protein, 10 aa, Influenza virus
KDNSIRLAAG

SEQ ID NO: 502400 - protein, 10 aa, Influenza virus
KDNSIRLSAD

SEQ ID NO: 502401 - protein, 10 aa, Influenza virus
KDNSIRLSAG

SEQ ID NO: 502402 - protein, 10 aa, Influenza virus
KDNSIRLSAS

SEQ ID NO: 502403 - protein, 10 aa, Influenza virus
KDNSVRIGSK

SEQ ID NO: 502404 - protein, 10 aa, Influenza virus
KDNSVRLSAG

SEQ ID NO: 502405 - protein, 10 aa, Influenza virus
KDNSVRLSAS

SEQ ID NO: 502406 - protein, 10 aa, Influenza virus
KDPKKTGGPI

SEQ ID NO: 502407 - protein, 10 aa, Influenza virus
KDQAWSYIVE

SEQ ID NO: 502408 - protein, 10 aa, Influenza virus
KDQDWSYIVE

SEQ ID NO: 502409 - protein, 10 aa, Influenza virus
KDQGWSYIVE

SEQ ID NO: 502410 - protein, 10 aa, Influenza virus
KDQSWSYIVE

SEQ ID NO: 502411 - protein, 10 aa, Influenza virus
KDRAPYRSLI

SEQ ID NO: 502412 - protein, 10 aa, Influenza virus
KDRSPFRALM

SEQ ID NO: 502413 - protein, 10 aa, Influenza virus
KDRSPFRTLM

SEQ ID NO: 502414 - protein, 10 aa, Influenza virus
KDRSPHRALM

SEQ ID NO: 502415 - protein, 10 aa, Influenza virus
KDRSPHRTLM

SEQ ID NO: 502416 - protein, 10 aa, Influenza virus
KDRSPQRTLM

SEQ ID NO: 502417 - protein, 10 aa, Influenza virus
KDRSPYRALM

SEQ ID NO: 502418 - protein, 10 aa, Influenza virus
KDRSPYRTLM

SEQ ID NO: 502419 - protein, 10 aa, Influenza virus
KDRTPYRSLI

SEQ ID NO: 502420 - protein, 10 aa, Influenza virus
KDRTSYRSLI

SEQ ID NO: 502421 - protein, 10 aa, Influenza virus
KDSITDIWTY

SEQ ID NO: 502422 - protein, 10 aa, Influenza virus
KDSNGVQDII

SEQ ID NO: 502423 - protein, 10 aa, Influenza virus
KDSRSGYETF

SEQ ID NO: 502424 - protein, 10 aa, Influenza virus
KDVIIWFSFG

SEQ ID NO: 502425 - protein, 10 aa, Influenza virus
KDVILWFSFG

SEQ ID NO: 502426 - protein, 10 aa, Influenza virus
KDVILWFSLG

SEQ ID NO: 502427 - protein, 10 aa, Influenza virus
KDWILWISFA

SEQ ID NO: 502428 - protein, 10 aa, Influenza virus
KDWVLWISFA

SEQ ID NO: 502429 - protein, 10 aa, Influenza virus
KDYEEEAKLE

SEQ ID NO: 502430 - protein, 10 aa, Influenza virus
KDYRYTYRCH

SEQ ID NO: 502431 - protein, 10 aa, Influenza virus
KEAMQNRIQI

SEQ ID NO: 502432 - protein, 10 aa, Influenza virus
KEAQDVIMEV

SEQ ID NO: 502433 - protein, 10 aa, Influenza virus
KECFNPCFYV

SEQ ID NO: 502434 - protein, 10 aa, Influenza virus
KEDEVWWTSN

SEQ ID NO: 502435 - protein, 10 aa, Influenza virus
KEDKRYGPAL

SEQ ID NO: 502436 - protein, 10 aa, Influenza virus
KEDKVWWTSN

SEQ ID NO: 502437 - protein, 10 aa, Influenza virus
KEDRRYGPAL

SEQ ID NO: 502438 - protein, 10 aa, Influenza virus
KEDRVWWTSN

SEQ ID NO: 502439 - protein, 10 aa, Influenza virus
KEEALKGSAR

SEQ ID NO: 502440 - protein, 10 aa, Influenza virus
KEEALQGSAR

SEQ ID NO: 502441 - protein, 10 aa, Influenza virus
KEECYRACFY

SEQ ID NO: 502442 - protein, 10 aa, Influenza virus
KEEKVWWTSN

SEQ ID NO: 502443 - protein, 10 aa, Influenza virus
KEEPLKGSAK

SEQ ID NO: 502444 - protein, 10 aa, Influenza virus
KEESQLKRQE

SEQ ID NO: 502445 - protein, 10 aa, Influenza virus
KEETLKGSAR

SEQ ID NO: 502446 - protein, 10 aa, Influenza virus
KEEVINATET

SEQ ID NO: 502447 - protein, 10 aa, Influenza virus
KEEVLKGSAR

SEQ ID NO: 502448 - protein, 10 aa, Influenza virus
KEEVTNATET

SEQ ID NO: 502449 - protein, 10 aa, Influenza virus
KEFEQVEGRI

SEQ ID NO: 502450 - protein, 10 aa, Influenza virus
KEFEQVEGRT

SEQ ID NO: 502451 - protein, 10 aa, Influenza virus
KEFGNLERRL

SEQ ID NO: 502452 - protein, 10 aa, Influenza virus
KEFGQVEGRI

SEQ ID NO: 502453 - protein, 10 aa, Influenza virus
KEFNNLEKRL

SEQ ID NO: 502454 - protein, 10 aa, Influenza virus
KEFNNLERRL

SEQ ID NO: 502455 - protein, 10 aa, Influenza virus
KEFSEIEGRI

SEQ ID NO: 502456 - protein, 10 aa, Influenza virus
KEFSEVEGRI

SEQ ID NO: 502457 - protein, 10 aa, Influenza virus
KEFSNLEKRL

SEQ ID NO: 502458 - protein, 10 aa, Influenza virus
KEFSNLERRL

SEQ ID NO: 502459 - protein, 10 aa, Influenza virus
KEFTEVEGRI

SEQ ID NO: 502460 - protein, 10 aa, Influenza virus
KEGRRKTNLY

SEQ ID NO: 502461 - protein, 10 aa, Influenza virus
KEGRRRTNLY

SEQ ID NO: 502462 - protein, 10 aa, Influenza virus
KEGSYFFGDN

SEQ ID NO: 502463 - protein, 10 aa, Influenza virus
KEGYSLVGID

SEQ ID NO: 502464 - protein, 10 aa, Influenza virus
KEGYSLVGVD

SEQ ID NO: 502465 - protein, 10 aa, Influenza virus
KEIEGICYPG

SEQ ID NO: 502466 - protein, 10 aa, Influenza virus
KEIGNGCFEF

SEQ ID NO: 502467 - protein, 10 aa, Influenza virus
KEKAIWTSGS

SEQ ID NO: 502468 - protein, 10 aa, Influenza virus
KEKDLTKEFF

SEQ ID NO: 502469 - protein, 10 aa, Influenza virus
KEKDMTKEFF

SEQ ID NO: 502470 - protein, 10 aa, Influenza virus
KEKDMTREFF

SEQ ID NO: 502471 - protein, 10 aa, Influenza virus
KEKEICSVVL

SEQ ID NO: 502472 - protein, 10 aa, Influenza virus
KEKENSYPKI

SEQ ID NO: 502473 - protein, 10 aa, Influenza virus
KEKENSYPMI

SEQ ID NO: 502474 - protein, 10 aa, Influenza virus
KEKNDLYGTQ

SEQ ID NO: 502475 - protein, 10 aa, Influenza virus
KEKNELYGTQ

SEQ ID NO: 502476 - protein, 10 aa, Influenza virus
KEKTIWTSGS

SEQ ID NO: 502477 - protein, 10 aa, Influenza virus
KEKVTNATET

SEQ ID NO: 502478 - protein, 10 aa, Influenza virus
KELGNGCFEF

SEQ ID NO: 502479 - protein, 10 aa, Influenza virus
KELVETNHTD

SEQ ID NO: 502480 - protein, 10 aa, Influenza virus
KEMEGICYPG

SEQ ID NO: 502481 - protein, 10 aa, Influenza virus
KEMEGVCYPG

SEQ ID NO: 502482 - protein, 10 aa, Influenza virus
KEMGNGCFEF

SEQ ID NO: 502483 - protein, 10 aa, Influenza virus
KENKKYGPAL

SEQ ID NO: 502484 - protein, 10 aa, Influenza virus
KENKRYGPAL

SEQ ID NO: 502485 - protein, 10 aa, Influenza virus
KENPAHKSQL

SEQ ID NO: 502486 - protein, 10 aa, Influenza virus
KENTGSYVRL

SEQ ID NO: 502487 - protein, 10 aa, Influenza virus
KEPALIVWGV

SEQ ID NO: 502488 - protein, 10 aa, Influenza virus
KEPDTYDFNE

SEQ ID NO: 502489 - protein, 10 aa, Influenza virus
KEPISLGDCS

SEQ ID NO: 502490 - protein, 10 aa, Influenza virus
KEPMGFRYSG

SEQ ID NO: 502491 - protein, 10 aa, Influenza virus
KEQGSGYAAD

SEQ ID NO: 502492 - protein, 10 aa, Influenza virus
KEQLGSWSWH

SEQ ID NO: 502493 - protein, 10 aa, Influenza virus
KEQLSSVSSF

SEQ ID NO: 502494 - protein, 10 aa, Influenza virus
KEQLSTVSSF

SEQ ID NO: 502495 - protein, 10 aa, Influenza virus
KEQTALYKNA

SEQ ID NO: 502496 - protein, 10 aa, Influenza virus
KEQTTLYKNA

SEQ ID NO: 502497 - protein, 10 aa, Influenza virus
KERLGSWSWH

SEQ ID NO: 502498 - protein, 10 aa, Influenza virus
KERTSIWTSS

SEQ ID NO: 502499 - protein, 10 aa, Influenza virus
KESKLNRNEI

SEQ ID NO: 502500 - protein, 10 aa, Influenza virus
KESLRLAIGL

SEQ ID NO: 502501 - protein, 10 aa, Influenza virus
KESLRLALGL

SEQ ID NO: 502502 - protein, 10 aa, Influenza virus
KESLRLAVGL

SEQ ID NO: 502503 - protein, 10 aa, Influenza virus
KESMGFRYSG

SEQ ID NO: 502504 - protein, 10 aa, Influenza virus
KESRSGYETF

SEQ ID NO: 502505 - protein, 10 aa, Influenza virus
KESTQKAIDQ

SEQ ID NO: 502506 - protein, 10 aa, Influenza virus
KESTQKAIDR

SEQ ID NO: 502507 - protein, 10 aa, Influenza virus
KETGNGCFEF

SEQ ID NO: 502508 - protein, 10 aa, Influenza virus
KETNGNYGPI

SEQ ID NO: 502509 - protein, 10 aa, Influenza virus
KETRVWWTSN

SEQ ID NO: 502510 - protein, 10 aa, Influenza virus
KETTVWWTSN

SEQ ID NO: 502511 - protein, 10 aa, Influenza virus
KEVGNGCFEF

SEQ ID NO: 502512 - protein, 10 aa, Influenza virus
KEVILWFSFG

SEQ ID NO: 502513 - protein, 10 aa, Influenza virus
KEWGNGCFEF

SEQ ID NO: 502514 - protein, 10 aa, Influenza virus
KEWMHICMTG

SEQ ID NO: 502515 - protein, 10 aa, Influenza virus
KEWMHVCITG

SEQ ID NO: 502516 - protein, 10 aa, Influenza virus
KEWMHVCMAG

SEQ ID NO: 502517 - protein, 10 aa, Influenza virus
KEWMHVCMTG

SEQ ID NO: 502518 - protein, 10 aa, Influenza virus
KEWMHVSMTG

SEQ ID NO: 502519 - protein, 10 aa, Influenza virus
KEWSKRYELE

SEQ ID NO: 502520 - protein, 10 aa, Influenza virus
KEWSRRYELE

SEQ ID NO: 502521 - protein, 10 aa, Influenza virus
KEYEEEAKLE

SEQ ID NO: 502522 - protein, 10 aa, Influenza virus
KFAAICTHLE

SEQ ID NO: 502523 - protein, 10 aa, Influenza virus
KFAAICTHME

SEQ ID NO: 502524 - protein, 10 aa, Influenza virus
KFASICTHLE

SEQ ID NO: 502525 - protein, 10 aa, Influenza virus
KFCYPGELDN

SEQ ID NO: 502526 - protein, 10 aa, Influenza virus
KFEAVAWSAT

SEQ ID NO: 502527 - protein, 10 aa, Influenza virus
KFESVAWSAS

SEQ ID NO: 502528 - protein, 10 aa, Influenza virus
KFESVAWSAT

SEQ ID NO: 502529 - protein, 10 aa, Influenza virus
KFFPSSSYRR

SEQ ID NO: 502530 - protein, 10 aa, Influenza virus
KFHQIEKEFS

SEQ ID NO: 502531 - protein, 10 aa, Influenza virus
KFHSDTPRPA

SEQ ID NO: 502532 - protein, 10 aa, Influenza virus
KFHSDTPRPD

SEQ ID NO: 502533 - protein, 10 aa, Influenza virus
KFHSDTPRPS

SEQ ID NO: 502534 - protein, 10 aa, Influenza virus
KFHSDTPRPT

SEQ ID NO: 502535 - protein, 10 aa, Influenza virus
KFHSDTPRPV

SEQ ID NO: 502536 - protein, 10 aa, Influenza virus
KFKADLIIER

SEQ ID NO: 502537 - protein, 10 aa, Influenza virus
KFLLMDALKL

SEQ ID NO: 502538 - protein, 10 aa, Influenza virus
KFLLMDSLKL

SEQ ID NO: 502539 - protein, 10 aa, Influenza virus
KFLNNTEPLC

SEQ ID NO: 502540 - protein, 10 aa, Influenza virus
KFLPDLYDYK

SEQ ID NO: 502541 - protein, 10 aa, Influenza virus
KFQTAAQKAM

SEQ ID NO: 502542 - protein, 10 aa, Influenza virus
KFQTAAQRAM

SEQ ID NO: 502543 - protein, 10 aa, Influenza virus
KFTNEEALRQ

SEQ ID NO: 502544 - protein, 10 aa, Influenza virus
KFYIQMCTEL

SEQ ID NO: 502545 - protein, 10 aa, Influenza virus
KGANRPIITI

SEQ ID NO: 502546 - protein, 10 aa, Influenza virus
KGANRPVIII

SEQ ID NO: 502547 - protein, 10 aa, Influenza virus
KGANRPVITI

SEQ ID NO: 502548 - protein, 10 aa, Influenza virus
KGCFDILHKC

SEQ ID NO: 502549 - protein, 10 aa, Influenza virus
KGCFDLYHKC

SEQ ID NO: 502550 - protein, 10 aa, Influenza virus
KGCFEIYHAC

SEQ ID NO: 502551 - protein, 10 aa, Influenza virus
KGCFEIYHKC

SEQ ID NO: 502552 - protein, 10 aa, Influenza virus
KGCFEIYHNC

SEQ ID NO: 502553 - protein, 10 aa, Influenza virus
KGCFEIYHTC

SEQ ID NO: 502554 - protein, 10 aa, Influenza virus
KGCFELYHKC

SEQ ID NO: 502555 - protein, 10 aa, Influenza virus
KGCFELYHRC

SEQ ID NO: 502556 - protein, 10 aa, Influenza virus
KGCINRCFYV

SEQ ID NO: 502557 - protein, 10 aa, Influenza virus
KGDCYRACFY

SEQ ID NO: 502558 - protein, 10 aa, Influenza virus
KGDIFVIREP

SEQ ID NO: 502559 - protein, 10 aa, Influenza virus
KGDIFVMREP

SEQ ID NO: 502560 - protein, 10 aa, Influenza virus
KGDKICLGHH

SEQ ID NO: 502561 - protein, 10 aa, Influenza virus
KGDQICIGYH

SEQ ID NO: 502562 - protein, 10 aa, Influenza virus
KGDRICIGYH

SEQ ID NO: 502563 - protein, 10 aa, Influenza virus
KGDVFVIREP

SEQ ID NO: 502564 - protein, 10 aa, Influenza virus
KGDVFVMREP

SEQ ID NO: 502565 - protein, 10 aa, Influenza virus
KGDYNNTTGR

SEQ ID NO: 502566 - protein, 10 aa, Influenza virus
KGECYRACFY

SEQ ID NO: 502567 - protein, 10 aa, Influenza virus
KGEKANVLIG

SEQ ID NO: 502568 - protein, 10 aa, Influenza virus
KGEYNNTTGR

SEQ ID NO: 502569 - protein, 10 aa, Influenza virus
KGFAFKQGNS

SEQ ID NO: 502570 - protein, 10 aa, Influenza virus
KGFAFKYGNG

SEQ ID NO: 502571 - protein, 10 aa, Influenza virus
KGFAPFSKDN

SEQ ID NO: 502572 - protein, 10 aa, Influenza virus
KGFFPFHKDN

SEQ ID NO: 502573 - protein, 10 aa, Influenza virus
KGFGFRQGDD

SEQ ID NO: 502574 - protein, 10 aa, Influenza virus
KGFGFRQGND

SEQ ID NO: 502575 - protein, 10 aa, Influenza virus
KGFGFRQGNS

SEQ ID NO: 502576 - protein, 10 aa, Influenza virus
KGFGFRQGTD

SEQ ID NO: 502577 - protein, 10 aa, Influenza virus
KGFGFRQGTS

SEQ ID NO: 502578 - protein, 10 aa, Influenza virus
KGFNSFYRNL

SEQ ID NO: 502579 - protein, 10 aa, Influenza virus
KGFSFKYGDG

SEQ ID NO: 502580 - protein, 10 aa, Influenza virus
KGFSFKYGNG

SEQ ID NO: 502581 - protein, 10 aa, Influenza virus
KGFSFRYGDG

SEQ ID NO: 502582 - protein, 10 aa, Influenza virus
KGFSFRYGNG

SEQ ID NO: 502583 - protein, 10 aa, Influenza virus
KGFSYKYDNG

SEQ ID NO: 502584 - protein, 10 aa, Influenza virus
KGFSYKYGNG

SEQ ID NO: 502585 - protein, 10 aa, Influenza virus
KGFSYRYGNG

SEQ ID NO: 502586 - protein, 10 aa, Influenza virus
KGGPGVKGFG

SEQ ID NO: 502587 - protein, 10 aa, Influenza virus
KGGSIKTKLP

SEQ ID NO: 502588 - protein, 10 aa, Influenza virus
KGGSINTKLP

SEQ ID NO: 502589 - protein, 10 aa, Influenza virus
KGHVFVIREP

SEQ ID NO: 502590 - protein, 10 aa, Influenza virus
KGIEVVNATE

SEQ ID NO: 502591 - protein, 10 aa, Influenza virus
KGILEDEQMY

SEQ ID NO: 502592 - protein, 10 aa, Influenza virus
KGILGFVFTL

SEQ ID NO: 502593 - protein, 10 aa, Influenza virus
KGKFQTAAQK

SEQ ID NO: 502594 - protein, 10 aa, Influenza virus
KGKFQTAAQR

SEQ ID NO: 502595 - protein, 10 aa, Influenza virus
KGKKAVDLGS

SEQ ID NO: 502596 - protein, 10 aa, Influenza virus
KGLCTINSWH

SEQ ID NO: 502597 - protein, 10 aa, Influenza virus
KGLFGAIAGF

SEQ ID NO: 502598 - protein, 10 aa, Influenza virus
KGLILGNPKC

SEQ ID NO: 502599 - protein, 10 aa, Influenza virus
KGLWDSFRQS

SEQ ID NO: 502600 - protein, 10 aa, Influenza virus
KGMLGFVFTL

SEQ ID NO: 502601 - protein, 10 aa, Influenza virus
KGNAKDEGNG

SEQ ID NO: 502602 - protein, 10 aa, Influenza virus
KGNGCFEIFH

SEQ ID NO: 502603 - protein, 10 aa, Influenza virus
KGNIKCNICI

SEQ ID NO: 502604 - protein, 10 aa, Influenza virus
KGNIMRTQES

SEQ ID NO: 502605 - protein, 10 aa, Influenza virus
KGNIRCDICI

SEQ ID NO: 502606 - protein, 10 aa, Influenza virus
KGNIRCNICI

SEQ ID NO: 502607 - protein, 10 aa, Influenza virus
KGNPGVKGWA

SEQ ID NO: 502608 - protein, 10 aa, Influenza virus
KGNQGVKGWA

SEQ ID NO: 502609 - protein, 10 aa, Influenza virus
KGRGLFGAIA

SEQ ID NO: 502610 - protein, 10 aa, Influenza virus
KGRHANGTIH

SEQ ID NO: 502611 - protein, 10 aa, Influenza virus
KGRIFQSHIR

SEQ ID NO: 502612 - protein, 10 aa, Influenza virus
KGRIFQSPIR

SEQ ID NO: 502613 - protein, 10 aa, Influenza virus
KGRIFQSRII

SEQ ID NO: 502614 - protein, 10 aa, Influenza virus
KGRIFQSRIR

SEQ ID NO: 502615 - protein, 10 aa, Influenza virus
KGRLCNPLNP

SEQ ID NO: 502616 - protein, 10 aa, Influenza virus
KGRSHLRNDT

SEQ ID NO: 502617 - protein, 10 aa, Influenza virus
KGRYGVKGFS

SEQ ID NO: 502618 - protein, 10 aa, Influenza virus
KGSAKHIEEC

SEQ ID NO: 502619 - protein, 10 aa, Influenza virus
KGSARHIEEC

SEQ ID NO: 502620 - protein, 10 aa, Influenza virus
KGSARHIEEW

SEQ ID NO: 502621 - protein, 10 aa, Influenza virus
KGSIQSDKPF

SEQ ID NO: 502622 - protein, 10 aa, Influenza virus
KGSNRPIIDI

SEQ ID NO: 502623 - protein, 10 aa, Influenza virus
KGSNRPIVDI

SEQ ID NO: 502624 - protein, 10 aa, Influenza virus
KGSNRPVIDI

SEQ ID NO: 502625 - protein, 10 aa, Influenza virus
KGSNRPVIDV

SEQ ID NO: 502626 - protein, 10 aa, Influenza virus
KGSNRPVVDI

SEQ ID NO: 502627 - protein, 10 aa, Influenza virus
KGSNRPWIRI

SEQ ID NO: 502628 - protein, 10 aa, Influenza virus
KGSNRPWMKI

SEQ ID NO: 502629 - protein, 10 aa, Influenza virus
KGSNRPWMRI

SEQ ID NO: 502630 - protein, 10 aa, Influenza virus
KGSNRPWVRI

SEQ ID NO: 502631 - protein, 10 aa, Influenza virus
KGSNRPWVRM

SEQ ID NO: 502632 - protein, 10 aa, Influenza virus
KGSWPDGANI

SEQ ID NO: 502633 - protein, 10 aa, Influenza virus
KGSYNNTNGE

SEQ ID NO: 502634 - protein, 10 aa, Influenza virus
KGSYNNTSGE

SEQ ID NO: 502635 - protein, 10 aa, Influenza virus
KGTNRPVLVI

SEQ ID NO: 502636 - protein, 10 aa, Influenza virus
KGTNSFYRNL

SEQ ID NO: 502637 - protein, 10 aa, Influenza virus
KGTYDYPKYQ

SEQ ID NO: 502638 - protein, 10 aa, Influenza virus
KGVELSSMGV

SEQ ID NO: 502639 - protein, 10 aa, Influenza virus
KGVEVVNATE

SEQ ID NO: 502640 - protein, 10 aa, Influenza virus
KGVKLSNMGI

SEQ ID NO: 502641 - protein, 10 aa, Influenza virus
KGVKLSNMGV

SEQ ID NO: 502642 - protein, 10 aa, Influenza virus
KGVKLSSMGI

SEQ ID NO: 502643 - protein, 10 aa, Influenza virus
KGVKLSSMGV

SEQ ID NO: 502644 - protein, 10 aa, Influenza virus
KGVYINTALL

SEQ ID NO: 502645 - protein, 10 aa, Influenza virus
KGVYINTAML

SEQ ID NO: 502646 - protein, 10 aa, Influenza virus
KGVYMNTALL

SEQ ID NO: 502647 - protein, 10 aa, Influenza virus
KGVYVNTALL

SEQ ID NO: 502648 - protein, 10 aa, Influenza virus
KGWAFDNGDD

SEQ ID NO: 502649 - protein, 10 aa, Influenza virus
KGWAFDNGND

SEQ ID NO: 502650 - protein, 10 aa, Influenza virus
KGWAFDSGDD

SEQ ID NO: 502651 - protein, 10 aa, Influenza virus
KGWAFDYGND

SEQ ID NO: 502652 - protein, 10 aa, Influenza virus
KGWAFDYGSD

SEQ ID NO: 502653 - protein, 10 aa, Influenza virus
KGWAPLSKDN

SEQ ID NO: 502654 - protein, 10 aa, Influenza virus
KGWILGNPRC

SEQ ID NO: 502655 - protein, 10 aa, Influenza virus
KGYGVKGFGF

SEQ ID NO: 502656 - protein, 10 aa, Influenza virus
KHDRIPHRTL

SEQ ID NO: 502657 - protein, 10 aa, Influenza virus
KHDSNVKNLF

SEQ ID NO: 502658 - protein, 10 aa, Influenza virus
KHENRMVLAS

SEQ ID NO: 502659 - protein, 10 aa, Influenza virus
KHIEECSCYG

SEQ ID NO: 502660 - protein, 10 aa, Influenza virus
KHIEECSSYG

SEQ ID NO: 502661 - protein, 10 aa, Influenza virus
KHIVERILEE

SEQ ID NO: 502662 - protein, 10 aa, Influenza virus
KHLAYCNTDL

SEQ ID NO: 502663 - protein, 10 aa, Influenza virus
KHLEECSCYV

SEQ ID NO: 502664 - protein, 10 aa, Influenza virus
KHNPTEEQAV

SEQ ID NO: 502665 - protein, 10 aa, Influenza virus
KHPAYCNTDL

SEQ ID NO: 502666 - protein, 10 aa, Influenza virus
KHQNAQGEGT

SEQ ID NO: 502667 - protein, 10 aa, Influenza virus
KHRFEIIEGR

SEQ ID NO: 502668 - protein, 10 aa, Influenza virus
KHSAYCNTDL

SEQ ID NO: 502669 - protein, 10 aa, Influenza virus
KHSNDTIHDR

SEQ ID NO: 502670 - protein, 10 aa, Influenza virus
KHSNDTVHDR

SEQ ID NO: 502671 - protein, 10 aa, Influenza virus
KHSNETVKDR

SEQ ID NO: 502672 - protein, 10 aa, Influenza virus
KHSNGTAKDR

SEQ ID NO: 502673 - protein, 10 aa, Influenza virus
KHSNGTIHDR

SEQ ID NO: 502674 - protein, 10 aa, Influenza virus
KHSNGTIKDR

SEQ ID NO: 502675 - protein, 10 aa, Influenza virus
KHSNGTKHDR

SEQ ID NO: 502676 - protein, 10 aa, Influenza virus
KHSNGTMKDR

SEQ ID NO: 502677 - protein, 10 aa, Influenza virus
KHSNGTTHDR

SEQ ID NO: 502678 - protein, 10 aa, Influenza virus
KHSNGTVKDR

SEQ ID NO: 502679 - protein, 10 aa, Influenza virus
KHSNGTVNDR

SEQ ID NO: 502680 - protein, 10 aa, Influenza virus
KHSNNTVKDR

SEQ ID NO: 502681 - protein, 10 aa, Influenza virus
KHSNNTVRDR

SEQ ID NO: 502682 - protein, 10 aa, Influenza virus
KHSNSTTHDR

SEQ ID NO: 502683 - protein, 10 aa, Influenza virus
KHSSGTVKDR

SEQ ID NO: 502684 - protein, 10 aa, Influenza virus
KHTSQYICSP

SEQ ID NO: 502685 - protein, 10 aa, Influenza virus
KHTSQYLCTG

SEQ ID NO: 502686 - protein, 10 aa, Influenza virus
KHWSGYSGSF

SEQ ID NO: 502687 - protein, 10 aa, Influenza virus
KHYIGKCPKY

SEQ ID NO: 502688 - protein, 10 aa, Influenza virus
KHYIGKCPRY

SEQ ID NO: 502689 - protein, 10 aa, Influenza virus
KIAHISPLSG

SEQ ID NO: 502690 - protein, 10 aa, Influenza virus
KICIGYHANN

SEQ ID NO: 502691 - protein, 10 aa, Influenza virus
KICIGYLSNN

SEQ ID NO: 502692 - protein, 10 aa, Influenza virus
KICIGYQTNN

SEQ ID NO: 502693 - protein, 10 aa, Influenza virus
KICLGHHAIP

SEQ ID NO: 502694 - protein, 10 aa, Influenza virus
KICLGHHAVA

SEQ ID NO: 502695 - protein, 10 aa, Influenza virus
KICLGHHAVP

SEQ ID NO: 502696 - protein, 10 aa, Influenza virus
KICLGHHAVS

SEQ ID NO: 502697 - protein, 10 aa, Influenza virus
KICLGHHAVT

SEQ ID NO: 502698 - protein, 10 aa, Influenza virus
KICVGYLSTN

SEQ ID NO: 502699 - protein, 10 aa, Influenza virus
KIDDQIEDLW

SEQ ID NO: 502700 - protein, 10 aa, Influenza virus
KIDDQIEELW

SEQ ID NO: 502701 - protein, 10 aa, Influenza virus
KIDDQIEGLW

SEQ ID NO: 502702 - protein, 10 aa, Influenza virus
KIDDQIENLW

SEQ ID NO: 502703 - protein, 10 aa, Influenza virus
KIDLWSYNAE

SEQ ID NO: 502704 - protein, 10 aa, Influenza virus
KIDLWSYNAG

SEQ ID NO: 502705 - protein, 10 aa, Influenza virus
KIDTILERNV

SEQ ID NO: 502706 - protein, 10 aa, Influenza virus
KIDTLTETGV

SEQ ID NO: 502707 - protein, 10 aa, Influenza virus
KIEAVIYGNP

SEQ ID NO: 502708 - protein, 10 aa, Influenza virus
KIEFEPFQSL

SEQ ID NO: 502709 - protein, 10 aa, Influenza virus
KIEKIEKIRP

SEQ ID NO: 502710 - protein, 10 aa, Influenza virus
KIHTRGLFGA

SEQ ID NO: 502711 - protein, 10 aa, Influenza virus
KIIHISPLSG

SEQ ID NO: 502712 - protein, 10 aa, Influenza virus
KIIQNEDIPI

SEQ ID NO: 502713 - protein, 10 aa, Influenza virus
KIIRVGCVIL

SEQ ID NO: 502714 - protein, 10 aa, Influenza virus
KIITIDSVSL

SEQ ID NO: 502715 - protein, 10 aa, Influenza virus
KIITIGSASL

SEQ ID NO: 502716 - protein, 10 aa, Influenza virus
KIITIGSISL

SEQ ID NO: 502717 - protein, 10 aa, Influenza virus
KIITIGSVSL

SEQ ID NO: 502718 - protein, 10 aa, Influenza virus
KIITMGSVSL

SEQ ID NO: 502719 - protein, 10 aa, Influenza virus
KIKHLEECSC

SEQ ID NO: 502720 - protein, 10 aa, Influenza virus
KIKMKWGMEL

SEQ ID NO: 502721 - protein, 10 aa, Influenza virus
KIKMKWGMEM

SEQ ID NO: 502722 - protein, 10 aa, Influenza virus
KIKTNGNLIA

SEQ ID NO: 502723 - protein, 10 aa, Influenza virus
KILDEHDSNV

SEQ ID NO: 502724 - protein, 10 aa, Influenza virus
KILKIKKGKI

SEQ ID NO: 502725 - protein, 10 aa, Influenza virus
KILKIKKGKL

SEQ ID NO: 502726 - protein, 10 aa, Influenza virus
KILKIRKGKI

SEQ ID NO: 502727 - protein, 10 aa, Influenza virus
KILRTHESEC

SEQ ID NO: 502728 - protein, 10 aa, Influenza virus
KILRTQESEC

SEQ ID NO: 502729 - protein, 10 aa, Influenza virus
KILRTQESSC

SEQ ID NO: 502730 - protein, 10 aa, Influenza virus
KILSIYSCIA

SEQ ID NO: 502731 - protein, 10 aa, Influenza virus
KILSIYSCVA

SEQ ID NO: 502732 - protein, 10 aa, Influenza virus
KILSIYSSVA

SEQ ID NO: 502733 - protein, 10 aa, Influenza virus
KILSIYSTVA

SEQ ID NO: 502734 - protein, 10 aa, Influenza virus
KILTIYSTAA

SEQ ID NO: 502735 - protein, 10 aa, Influenza virus
KILTIYSTVA

SEQ ID NO: 502736 - protein, 10 aa, Influenza virus
KIMESGGIDK

SEQ ID NO: 502737 - protein, 10 aa, Influenza virus
KIMESGGISK

SEQ ID NO: 502738 - protein, 10 aa, Influenza virus
KIMTIGSVSL

SEQ ID NO: 502739 - protein, 10 aa, Influenza virus
KINDQIEDLW

SEQ ID NO: 502740 - protein, 10 aa, Influenza virus
KINEVKLEEN

SEQ ID NO: 502741 - protein, 10 aa, Influenza virus
KINGVILEEN

SEQ ID NO: 502742 - protein, 10 aa, Influenza virus
KINGVKLEEN

SEQ ID NO: 502743 - protein, 10 aa, Influenza virus
KINGVRLEEN

SEQ ID NO: 502744 - protein, 10 aa, Influenza virus
KINNIIDKMN

SEQ ID NO: 502745 - protein, 10 aa, Influenza virus
KINNIIEKMN

SEQ ID NO: 502746 - protein, 10 aa, Influenza virus
KINNIVDKMN

SEQ ID NO: 502747 - protein, 10 aa, Influenza virus
KINPVTLTMG

SEQ ID NO: 502748 - protein, 10 aa, Influenza virus
KINSIIDKMN

SEQ ID NO: 502749 - protein, 10 aa, Influenza virus
KINTLTERGV

SEQ ID NO: 502750 - protein, 10 aa, Influenza virus
KIPNAETDPN

SEQ ID NO: 502751 - protein, 10 aa, Influenza virus
KIPNAETDPS

SEQ ID NO: 502752 - protein, 10 aa, Influenza virus
KIPNAGIDPN

SEQ ID NO: 502753 - protein, 10 aa, Influenza virus
KIPNAGTDPN

SEQ ID NO: 502754 - protein, 10 aa, Influenza virus
KIQHLEECSC

SEQ ID NO: 502755 - protein, 10 aa, Influenza virus
KIQTNGNLIA

SEQ ID NO: 502756 - protein, 10 aa, Influenza virus
KIQTSGNLIA

SEQ ID NO: 502757 - protein, 10 aa, Influenza virus
KIRHLEECSC

SEQ ID NO: 502758 - protein, 10 aa, Influenza virus
KIRNGTYDHK

SEQ ID NO: 502759 - protein, 10 aa, Influenza virus
KIRRRVDINP

SEQ ID NO: 502760 - protein, 10 aa, Influenza virus
KIRRRVDMNP

SEQ ID NO: 502761 - protein, 10 aa, Influenza virus
KIRRRVDTNP

SEQ ID NO: 502762 - protein, 10 aa, Influenza virus
KIRRRVDVNP

SEQ ID NO: 502763 - protein, 10 aa, Influenza virus
KIRTNGNLIA

SEQ ID NO: 502764 - protein, 10 aa, Influenza virus
KIRTRGLFGA

SEQ ID NO: 502765 - protein, 10 aa, Influenza virus
KIRVKRRPVA

SEQ ID NO: 502766 - protein, 10 aa, Influenza virus
KISGVKLEEN

SEQ ID NO: 502767 - protein, 10 aa, Influenza virus
KISHISPLSG

SEQ ID NO: 502768 - protein, 10 aa, Influenza virus
KISKRGGSGI

SEQ ID NO: 502769 - protein, 10 aa, Influenza virus
KISKRGNSGI

SEQ ID NO: 502770 - protein, 10 aa, Influenza virus
KISKRGSSGI

SEQ ID NO: 502771 - protein, 10 aa, Influenza virus
KISKRGSSGV

SEQ ID NO: 502772 - protein, 10 aa, Influenza virus
KISKSTKSTV

SEQ ID NO: 502773 - protein, 10 aa, Influenza virus
KISSSFSFGG

SEQ ID NO: 502774 - protein, 10 aa, Influenza virus
KITCVCRDNW

SEQ ID NO: 502775 - protein, 10 aa, Influenza virus
KITENSFEQI

SEQ ID NO: 502776 - protein, 10 aa, Influenza virus
KITFEATGNL

SEQ ID NO: 502777 - protein, 10 aa, Influenza virus
KITGFAPFSK

SEQ ID NO: 502778 - protein, 10 aa, Influenza virus
KITLKFAFNM

SEQ ID NO: 502779 - protein, 10 aa, Influenza virus
KITNKINNIV

SEQ ID NO: 502780 - protein, 10 aa, Influenza virus
KITNKVNNIV

SEQ ID NO: 502781 - protein, 10 aa, Influenza virus
KITVDHMAII

SEQ ID NO: 502782 - protein, 10 aa, Influenza virus
KIVHISPLSG

SEQ ID NO: 502783 - protein, 10 aa, Influenza virus
KIVTTVGWSW

SEQ ID NO: 502784 - protein, 10 aa, Influenza virus
KIYWHLMHPG

SEQ ID NO: 502785 - protein, 10 aa, Influenza virus
KKAKLANVVR

SEQ ID NO: 502786 - protein, 10 aa, Influenza virus
KKASLRLAVG

SEQ ID NO: 502787 - protein, 10 aa, Influenza virus
KKAVDLGSCG

SEQ ID NO: 502788 - protein, 10 aa, Influenza virus
KKCFNPCFYV

SEQ ID NO: 502789 - protein, 10 aa, Influenza virus
KKEPDTYDFN

SEQ ID NO: 502790 - protein, 10 aa, Influenza virus
KKESLRLAIG

SEQ ID NO: 502791 - protein, 10 aa, Influenza virus
KKESLRLALG

SEQ ID NO: 502792 - protein, 10 aa, Influenza virus
KKESLRLAVG

SEQ ID NO: 502793 - protein, 10 aa, Influenza virus
KKGTYDYPKY

SEQ ID NO: 502794 - protein, 10 aa, Influenza virus
KKHPAYCNTD

SEQ ID NO: 502795 - protein, 10 aa, Influenza virus
KKILRTQESS

SEQ ID NO: 502796 - protein, 10 aa, Influenza virus
KKINMINDKI

SEQ ID NO: 502797 - protein, 10 aa, Influenza virus
KKKKKKRGLF

SEQ ID NO: 502798 - protein, 10 aa, Influenza virus
KKKKKRGLFG

SEQ ID NO: 502799 - protein, 10 aa, Influenza virus
KKKKRGLFGA

SEQ ID NO: 502800 - protein, 10 aa, Influenza virus
KKKNPEAYNF

SEQ ID NO: 502801 - protein, 10 aa, Influenza virus
KKKPDIYDFN

SEQ ID NO: 502802 - protein, 10 aa, Influenza virus
KKKPDTYDFN

SEQ ID NO: 502803 - protein, 10 aa, Influenza virus
KKKRGLFGAI

SEQ ID NO: 502804 - protein, 10 aa, Influenza virus
KKKSYINKTG

SEQ ID NO: 502805 - protein, 10 aa, Influenza virus
KKKSYINRTG

SEQ ID NO: 502806 - protein, 10 aa, Influenza virus
KKLKREITFH

SEQ ID NO: 502807 - protein, 10 aa, Influenza virus
KKLKREMTFH

SEQ ID NO: 502808 - protein, 10 aa, Influenza virus
KKLTVTHSVN

SEQ ID NO: 502809 - protein, 10 aa, Influenza virus
KKMEDGFLDI

SEQ ID NO: 502810 - protein, 10 aa, Influenza virus
KKMEDGFLDV

SEQ ID NO: 502811 - protein, 10 aa, Influenza virus
KKMTITFLIL

SEQ ID NO: 502812 - protein, 10 aa, Influenza virus
KKNPEAYNFN

SEQ ID NO: 502813 - protein, 10 aa, Influenza virus
KKPDIYDFNE

SEQ ID NO: 502814 - protein, 10 aa, Influenza virus
KKPDTYDFNE

SEQ ID NO: 502815 - protein, 10 aa, Influenza virus
KKQEIEGIKL

SEQ ID NO: 502816 - protein, 10 aa, Influenza virus
KKQILRTQES

SEQ ID NO: 502817 - protein, 10 aa, Influenza virus
KKQLRENAED

SEQ ID NO: 502818 - protein, 10 aa, Influenza virus
KKQLRENAEE

SEQ ID NO: 502819 - protein, 10 aa, Influenza virus
KKRGLFGAIA

SEQ ID NO: 502820 - protein, 10 aa, Influenza virus
KKRKKRGLFG

SEQ ID NO: 502821 - protein, 10 aa, Influenza virus
KKRLGSWSWH

SEQ ID NO: 502822 - protein, 10 aa, Influenza virus
KKSYINKTGT

SEQ ID NO: 502823 - protein, 10 aa, Influenza virus
KKSYINRTGT

SEQ ID NO: 502824 - protein, 10 aa, Influenza virus
KKTGGPIYKK

SEQ ID NO: 502825 - protein, 10 aa, Influenza virus
KKTGGPIYKR

SEQ ID NO: 502826 - protein, 10 aa, Influenza virus
KKTGGPIYRR

SEQ ID NO: 502827 - protein, 10 aa, Influenza virus
KKTNEKFHQI

SEQ ID NO: 502828 - protein, 10 aa, Influenza virus
KKYERVKMFD

SEQ ID NO: 502829 - protein, 10 aa, Influenza virus
KKYGPALSIN

SEQ ID NO: 502830 - protein, 10 aa, Influenza virus
KKYTSARQEK

SEQ ID NO: 502831 - protein, 10 aa, Influenza virus
KKYTSGRQEK

SEQ ID NO: 502832 - protein, 10 aa, Influenza virus
KLAAICTHLE

SEQ ID NO: 502833 - protein, 10 aa, Influenza virus
KLAIGLRNVP

SEQ ID NO: 502834 - protein, 10 aa, Influenza virus
KLAIGPRNVP

SEQ ID NO: 502835 - protein, 10 aa, Influenza virus
KLANVVRKMM

SEQ ID NO: 502836 - protein, 10 aa, Influenza virus
KLAQGYKDII

SEQ ID NO: 502837 - protein, 10 aa, Influenza virus
KLASGLRNVP

SEQ ID NO: 502838 - protein, 10 aa, Influenza virus
KLATGLKNVP

SEQ ID NO: 502839 - protein, 10 aa, Influenza virus
KLATGLRNIP

SEQ ID NO: 502840 - protein, 10 aa, Influenza virus
KLATGLRNVP

SEQ ID NO: 502841 - protein, 10 aa, Influenza virus
KLATGMRNIP

SEQ ID NO: 502842 - protein, 10 aa, Influenza virus
KLATGMRNVP

SEQ ID NO: 502843 - protein, 10 aa, Influenza virus
KLATGPRNVP

SEQ ID NO: 502844 - protein, 10 aa, Influenza virus
KLCFPGELDN

SEQ ID NO: 502845 - protein, 10 aa, Influenza virus
KLCFPGEVDN

SEQ ID NO: 502846 - protein, 10 aa, Influenza virus
KLCKLNGIPP

SEQ ID NO: 502847 - protein, 10 aa, Influenza virus
KLCRLRGIPP

SEQ ID NO: 502848 - protein, 10 aa, Influenza virus
KLCRLSGIPP

SEQ ID NO: 502849 - protein, 10 aa, Influenza virus
KLCYPGELDN

SEQ ID NO: 502850 - protein, 10 aa, Influenza virus
KLCYPGEVDN

SEQ ID NO: 502851 - protein, 10 aa, Influenza virus
KLDINMADYS

SEQ ID NO: 502852 - protein, 10 aa, Influenza virus
KLEENSTYKI

SEQ ID NO: 502853 - protein, 10 aa, Influenza virus
KLEENTSYKI

SEQ ID NO: 502854 - protein, 10 aa, Influenza virus
KLEENTTYKI

SEQ ID NO: 502855 - protein, 10 aa, Influenza virus
KLEENTTYRI

SEQ ID NO: 502856 - protein, 10 aa, Influenza virus
KLEFEPFQSL

SEQ ID NO: 502857 - protein, 10 aa, Influenza virus
KLEKSRINGV

SEQ ID NO: 502858 - protein, 10 aa, Influenza virus
KLEQSGLPVG

SEQ ID NO: 502859 - protein, 10 aa, Influenza virus
KLERSKINEV

SEQ ID NO: 502860 - protein, 10 aa, Influenza virus
KLERSKINGV

SEQ ID NO: 502861 - protein, 10 aa, Influenza virus
KLFALSGVAI

SEQ ID NO: 502862 - protein, 10 aa, Influenza virus
KLFALSGVAV

SEQ ID NO: 502863 - protein, 10 aa, Influenza virus
KLFASSGIAI

SEQ ID NO: 502864 - protein, 10 aa, Influenza virus
KLFERVKRQL

SEQ ID NO: 502865 - protein, 10 aa, Influenza virus
KLFERVRHQL

SEQ ID NO: 502866 - protein, 10 aa, Influenza virus
KLFERVRRQL

SEQ ID NO: 502867 - protein, 10 aa, Influenza virus
KLFTLSGVAI

SEQ ID NO: 502868 - protein, 10 aa, Influenza virus
KLGQFPVQTD

SEQ ID NO: 502869 - protein, 10 aa, Influenza virus
KLGSPLVLDD

SEQ ID NO: 502870 - protein, 10 aa, Influenza virus
KLILATGLRN

SEQ ID NO: 502871 - protein, 10 aa, Influenza virus
KLIQGYKDII

SEQ ID NO: 502872 - protein, 10 aa, Influenza virus
KLITVGSSKY

SEQ ID NO: 502873 - protein, 10 aa, Influenza virus
KLKREITFHG

SEQ ID NO: 502874 - protein, 10 aa, Influenza virus
KLKREMTFHG

SEQ ID NO: 502875 - protein, 10 aa, Influenza virus
KLKRNEIKGV

SEQ ID NO: 502876 - protein, 10 aa, Influenza virus
KLKRQEIDGI

SEQ ID NO: 502877 - protein, 10 aa, Influenza virus
KLKRQEIEGI

SEQ ID NO: 502878 - protein, 10 aa, Influenza virus
KLKRQEINGI

SEQ ID NO: 502879 - protein, 10 aa, Influenza virus
KLKRRAIATP

SEQ ID NO: 502880 - protein, 10 aa, Influenza virus
KLKSEDNVYK

SEQ ID NO: 502881 - protein, 10 aa, Influenza virus
KLKTEDNIYK

SEQ ID NO: 502882 - protein, 10 aa, Influenza virus
KLKTEDNVYK

SEQ ID NO: 502883 - protein, 10 aa, Influenza virus
KLLGINMSKK

SEQ ID NO: 502884 - protein, 10 aa, Influenza virus
KLLKERGFFG

SEQ ID NO: 502885 - protein, 10 aa, Influenza virus
KLLPFAAAPP

SEQ ID NO: 502886 - protein, 10 aa, Influenza virus
KLLPFASAPP

SEQ ID NO: 502887 - protein, 10 aa, Influenza virus
KLLVLIENDR

SEQ ID NO: 502888 - protein, 10 aa, Influenza virus
KLLVLLENDK

SEQ ID NO: 502889 - protein, 10 aa, Influenza virus
KLLVLLENDR

SEQ ID NO: 502890 - protein, 10 aa, Influenza virus
KLLVLLENEK

SEQ ID NO: 502891 - protein, 10 aa, Influenza virus
KLLVLLENGR

SEQ ID NO: 502892 - protein, 10 aa, Influenza virus
KLNGIPPLEL

SEQ ID NO: 502893 - protein, 10 aa, Influenza virus
KLNNVIDKMN

SEQ ID NO: 502894 - protein, 10 aa, Influenza virus
KLNNVIDKMY

SEQ ID NO: 502895 - protein, 10 aa, Influenza virus
KLNRFIEKTN

SEQ ID NO: 502896 - protein, 10 aa, Influenza virus
KLNRIIEKTN

SEQ ID NO: 502897 - protein, 10 aa, Influenza virus
KLNRLIDKTN

SEQ ID NO: 502898 - protein, 10 aa, Influenza virus
KLNRLIDRTN

SEQ ID NO: 502899 - protein, 10 aa, Influenza virus
KLNRLIEKTN

SEQ ID NO: 502900 - protein, 10 aa, Influenza virus
KLNRLIERTN

SEQ ID NO: 502901 - protein, 10 aa, Influenza virus
KLNRLIGKTN

SEQ ID NO: 502902 - protein, 10 aa, Influenza virus
KLNRLISKTN

SEQ ID NO: 502903 - protein, 10 aa, Influenza virus
KLNRNEIKGV

SEQ ID NO: 502904 - protein, 10 aa, Influenza virus
KLPFQNLSPR

SEQ ID NO: 502905 - protein, 10 aa, Influenza virus
KLRLATGLRN

SEQ ID NO: 502906 - protein, 10 aa, Influenza virus
KLRMATGLRN

SEQ ID NO: 502907 - protein, 10 aa, Influenza virus
KLRMVTGLRN

SEQ ID NO: 502908 - protein, 10 aa, Influenza virus
KLRSGFEMLK

SEQ ID NO: 502909 - protein, 10 aa, Influenza virus
KLSGGYKDII

SEQ ID NO: 502910 - protein, 10 aa, Influenza virus
KLSGGYKDVI

SEQ ID NO: 502911 - protein, 10 aa, Influenza virus
KLSIEDPDHE

SEQ ID NO: 502912 - protein, 10 aa, Influenza virus
KLSIEDPNHE

SEQ ID NO: 502913 - protein, 10 aa, Influenza virus
KLSIEDPSHE

SEQ ID NO: 502914 - protein, 10 aa, Influenza virus
KLSIEEPSHE

SEQ ID NO: 502915 - protein, 10 aa, Influenza virus
KLSIENPSHE

SEQ ID NO: 502916 - protein, 10 aa, Influenza virus
KLSNMGIYQI

SEQ ID NO: 502917 - protein, 10 aa, Influenza virus
KLSNMGVYQI

SEQ ID NO: 502918 - protein, 10 aa, Influenza virus
KLSSGYKDII

SEQ ID NO: 502919 - protein, 10 aa, Influenza virus
KLSSGYKDVI

SEQ ID NO: 502920 - protein, 10 aa, Influenza virus
KLSSGYKEVI

SEQ ID NO: 502921 - protein, 10 aa, Influenza virus
KLSSMGIYQI

SEQ ID NO: 502922 - protein, 10 aa, Influenza virus
KLSSMGVYQI

SEQ ID NO: 502923 - protein, 10 aa, Influenza virus
KLTIIYSSSM

SEQ ID NO: 502924 - protein, 10 aa, Influenza virus
KLTITYSSPM

SEQ ID NO: 502925 - protein, 10 aa, Influenza virus
KLTITYSSSL

SEQ ID NO: 502926 - protein, 10 aa, Influenza virus
KLTITYSSSM

SEQ ID NO: 502927 - protein, 10 aa, Influenza virus
KLTQGRQTFD

SEQ ID NO: 502928 - protein, 10 aa, Influenza virus
KLTQGRQTYD

SEQ ID NO: 502929 - protein, 10 aa, Influenza virus
KLTQGYKDII

SEQ ID NO: 502930 - protein, 10 aa, Influenza virus
KLVDGQDCDL

SEQ ID NO: 502931 - protein, 10 aa, Influenza virus
KLVGINMSKK

SEQ ID NO: 502932 - protein, 10 aa, Influenza virus
KLVGINMSKR

SEQ ID NO: 502933 - protein, 10 aa, Influenza virus
KLVLATGLRN

SEQ ID NO: 502934 - protein, 10 aa, Influenza virus
KLVLATGPRN

SEQ ID NO: 502935 - protein, 10 aa, Influenza virus
KLYDRVRLQL

SEQ ID NO: 502936 - protein, 10 aa, Influenza virus
KLYEKVRRQL

SEQ ID NO: 502937 - protein, 10 aa, Influenza virus
KLYERVKKQL

SEQ ID NO: 502938 - protein, 10 aa, Influenza virus
KLYERVKRQL

SEQ ID NO: 502939 - protein, 10 aa, Influenza virus
KLYERVRKQL

SEQ ID NO: 502940 - protein, 10 aa, Influenza virus
KLYERVRRQL

SEQ ID NO: 502941 - protein, 10 aa, Influenza virus
KLYGAGNKLI

SEQ ID NO: 502942 - protein, 10 aa, Influenza virus
KLYGNGNKLI

SEQ ID NO: 502943 - protein, 10 aa, Influenza virus
KLYGNGNKLV

SEQ ID NO: 502944 - protein, 10 aa, Influenza virus
KLYGSGNKLI

SEQ ID NO: 502945 - protein, 10 aa, Influenza virus
KLYGSGNKLV

SEQ ID NO: 502946 - protein, 10 aa, Influenza virus
KLYGSGSKLI

SEQ ID NO: 502947 - protein, 10 aa, Influenza virus
KLYGTGNKLI

SEQ ID NO: 502948 - protein, 10 aa, Influenza virus
KLYIWGIHHP

SEQ ID NO: 502949 - protein, 10 aa, Influenza virus
KLYIWGVHHP

SEQ ID NO: 502950 - protein, 10 aa, Influenza virus
KLYKKLKREI

SEQ ID NO: 502951 - protein, 10 aa, Influenza virus
KLYKKLKREM

SEQ ID NO: 502952 - protein, 10 aa, Influenza virus
KLYKNTNTLS

SEQ ID NO: 502953 - protein, 10 aa, Influenza virus
KLYRKLKREI

SEQ ID NO: 502954 - protein, 10 aa, Influenza virus
KLYVNKNPYT

SEQ ID NO: 502955 - protein, 10 aa, Influenza virus
KLYVWGVHHP

SEQ ID NO: 502956 - protein, 10 aa, Influenza virus
KLYWHLMHPG

SEQ ID NO: 502957 - protein, 10 aa, Influenza virus
KLYWHLMRPG

SEQ ID NO: 502958 - protein, 10 aa, Influenza virus
KLYWHLMSPG

SEQ ID NO: 502959 - protein, 10 aa, Influenza virus
KMARLGKGYM

SEQ ID NO: 502960 - protein, 10 aa, Influenza virus
KMARLGRGYM

SEQ ID NO: 502961 - protein, 10 aa, Influenza virus
KMEAILVVLL

SEQ ID NO: 502962 - protein, 10 aa, Influenza virus
KMEDGFLDVW

SEQ ID NO: 502963 - protein, 10 aa, Influenza virus
KMEFEPFQSL

SEQ ID NO: 502964 - protein, 10 aa, Influenza virus
KMEKIVLLLA

SEQ ID NO: 502965 - protein, 10 aa, Influenza virus
KMESRGLFGA

SEQ ID NO: 502966 - protein, 10 aa, Influenza virus
KMFDFIKWNV

SEQ ID NO: 502967 - protein, 10 aa, Influenza virus
KMFDFSKWNV

SEQ ID NO: 502968 - protein, 10 aa, Influenza virus
KMFDFTKWNV

SEQ ID NO: 502969 - protein, 10 aa, Influenza virus
KMKAIIVVLL

SEQ ID NO: 502970 - protein, 10 aa, Influenza virus
KMKAILVVLL

SEQ ID NO: 502971 - protein, 10 aa, Influenza virus
KMKWGMELRR

SEQ ID NO: 502972 - protein, 10 aa, Influenza virus
KMKWGMEMRR

SEQ ID NO: 502973 - protein, 10 aa, Influenza virus
KMMTNSQDTE

SEQ ID NO: 502974 - protein, 10 aa, Influenza virus
KMMTSSQDTE

SEQ ID NO: 502975 - protein, 10 aa, Influenza virus
KMNGNYDSIR

SEQ ID NO: 502976 - protein, 10 aa, Influenza virus
KMNIQFEAVG

SEQ ID NO: 502977 - protein, 10 aa, Influenza virus
KMNIQFTAVG

SEQ ID NO: 502978 - protein, 10 aa, Influenza virus
KMNIQFTSVG

SEQ ID NO: 502979 - protein, 10 aa, Influenza virus
KMNIQFTSVS

SEQ ID NO: 502980 - protein, 10 aa, Influenza virus
KMNIQILILA

SEQ ID NO: 502981 - protein, 10 aa, Influenza virus
KMNNQILILA

SEQ ID NO: 502982 - protein, 10 aa, Influenza virus
KMNPNKKIIT

SEQ ID NO: 502983 - protein, 10 aa, Influenza virus
KMNPNQKIII

SEQ ID NO: 502984 - protein, 10 aa, Influenza virus
KMNPNQKIIT

SEQ ID NO: 502985 - protein, 10 aa, Influenza virus
KMNPNQKIMT

SEQ ID NO: 502986 - protein, 10 aa, Influenza virus
KMNREFEVMN

SEQ ID NO: 502987 - protein, 10 aa, Influenza virus
KMNREFEVVD

SEQ ID NO: 502988 - protein, 10 aa, Influenza virus
KMNREFEVVN

SEQ ID NO: 502989 - protein, 10 aa, Influenza virus
KMNREFGVVN

SEQ ID NO: 502990 - protein, 10 aa, Influenza virus
KMNTKILVLA

SEQ ID NO: 502991 - protein, 10 aa, Influenza virus
KMNTQFEAIG

SEQ ID NO: 502992 - protein, 10 aa, Influenza virus
KMNTQFEAVG

SEQ ID NO: 502993 - protein, 10 aa, Influenza virus
KMNTQFETVG

SEQ ID NO: 502994 - protein, 10 aa, Influenza virus
KMNTQFTAVG

SEQ ID NO: 502995 - protein, 10 aa, Influenza virus
KMNTQFTSVG

SEQ ID NO: 502996 - protein, 10 aa, Influenza virus
KMNTQILIFA

SEQ ID NO: 502997 - protein, 10 aa, Influenza virus
KMNTQILIFT

SEQ ID NO: 502998 - protein, 10 aa, Influenza virus
KMNTQILILA

SEQ ID NO: 502999 - protein, 10 aa, Influenza virus
KMNTQILVFA

SEQ ID NO: 503000 - protein, 10 aa, Influenza virus
KMNTRILILT

SEQ ID NO: 503001 - protein, 10 aa, Influenza virus
KMPASRYLTD

SEQ ID NO: 503002 - protein, 10 aa, Influenza virus
KMQFSSLTVN

SEQ ID NO: 503003 - protein, 10 aa, Influenza virus
KMQLRDNAKE

SEQ ID NO: 503004 - protein, 10 aa, Influenza virus
KMRDSIKSWR

SEQ ID NO: 503005 - protein, 10 aa, Influenza virus
KMSLLTEVET

SEQ ID NO: 503006 - protein, 10 aa, Influenza virus
KMTDSIKSWR

SEQ ID NO: 503007 - protein, 10 aa, Influenza virus
KMTIASDILK

SEQ ID NO: 503008 - protein, 10 aa, Influenza virus
KMTIASDILT

SEQ ID NO: 503009 - protein, 10 aa, Influenza virus
KMTITFLILL

SEQ ID NO: 503010 - protein, 10 aa, Influenza virus
KMVLSAFDER

SEQ ID NO: 503011 - protein, 10 aa, Influenza virus
KMYALHQGTT

SEQ ID NO: 503012 - protein, 10 aa, Influenza virus
KNADLEALME

SEQ ID NO: 503013 - protein, 10 aa, Influenza virus
KNALGDCPKY

SEQ ID NO: 503014 - protein, 10 aa, Influenza virus
KNALGECPKY

SEQ ID NO: 503015 - protein, 10 aa, Influenza virus
KNALYGTQSL

SEQ ID NO: 503016 - protein, 10 aa, Influenza virus
KNANTLSSVN

SEQ ID NO: 503017 - protein, 10 aa, Influenza virus
KNANTLSSVT

SEQ ID NO: 503018 - protein, 10 aa, Influenza virus
KNANTLTSVT

SEQ ID NO: 503019 - protein, 10 aa, Influenza virus
KNATATVYYD

SEQ ID NO: 503020 - protein, 10 aa, Influenza virus
KNCINRCFYV

SEQ ID NO: 503021 - protein, 10 aa, Influenza virus
KNCTLIDALL

SEQ ID NO: 503022 - protein, 10 aa, Influenza virus
KNDLYGTQPL

SEQ ID NO: 503023 - protein, 10 aa, Influenza virus
KNDLYGTQSL

SEQ ID NO: 503024 - protein, 10 aa, Influenza virus
KNELYGTQSL

SEQ ID NO: 503025 - protein, 10 aa, Influenza virus
KNGNHAVHYC

SEQ ID NO: 503026 - protein, 10 aa, Influenza virus
KNGNLRCTIC

SEQ ID NO: 503027 - protein, 10 aa, Influenza virus
KNGNMQCTIC

SEQ ID NO: 503028 - protein, 10 aa, Influenza virus
KNGNMRCTIC

SEQ ID NO: 503029 - protein, 10 aa, Influenza virus
KNGNMRCTIL

SEQ ID NO: 503030 - protein, 10 aa, Influenza virus
KNGNMRGTNW

SEQ ID NO: 503031 - protein, 10 aa, Influenza virus
KNGTYDHKDY

SEQ ID NO: 503032 - protein, 10 aa, Influenza virus
KNGTYDHKEY

SEQ ID NO: 503033 - protein, 10 aa, Influenza virus
KNGTYDYPKY

SEQ ID NO: 503034 - protein, 10 aa, Influenza virus
KNGTYKYPKY

SEQ ID NO: 503035 - protein, 10 aa, Influenza virus
KNGTYNHKDY

SEQ ID NO: 503036 - protein, 10 aa, Influenza virus
KNGTYNHKEY

SEQ ID NO: 503037 - protein, 10 aa, Influenza virus
KNGTYNRKEY

SEQ ID NO: 503038 - protein, 10 aa, Influenza virus
KNGTYNYPKY

SEQ ID NO: 503039 - protein, 10 aa, Influenza virus
KNGTYYYPKY

SEQ ID NO: 503040 - protein, 10 aa, Influenza virus
KNILEKTHNG

SEQ ID NO: 503041 - protein, 10 aa, Influenza virus
KNILRTQESE

SEQ ID NO: 503042 - protein, 10 aa, Influenza virus
KNITEIVYLN

SEQ ID NO: 503043 - protein, 10 aa, Influenza virus
KNITKIVYLN

SEQ ID NO: 503044 - protein, 10 aa, Influenza virus
KNITVTHAQD

SEQ ID NO: 503045 - protein, 10 aa, Influenza virus
KNITVTHSVE

SEQ ID NO: 503046 - protein, 10 aa, Influenza virus
KNITVTHSVN

SEQ ID NO: 503047 - protein, 10 aa, Influenza virus
KNLESRSGFE

SEQ ID NO: 503048 - protein, 10 aa, Influenza virus
KNLFDEVKRR

SEQ ID NO: 503049 - protein, 10 aa, Influenza virus
KNLFDEVRRR

SEQ ID NO: 503050 - protein, 10 aa, Influenza virus
KNLYDKVRLQ

SEQ ID NO: 503051 - protein, 10 aa, Influenza virus
KNLYDKVRMQ

SEQ ID NO: 503052 - protein, 10 aa, Influenza virus
KNLYDRVRLQ

SEQ ID NO: 503053 - protein, 10 aa, Influenza virus
KNLYEKVRLQ

SEQ ID NO: 503054 - protein, 10 aa, Influenza virus
KNLYEKVRMQ

SEQ ID NO: 503055 - protein, 10 aa, Influenza virus
KNLYNKVRMQ

SEQ ID NO: 503056 - protein, 10 aa, Influenza virus
KNNAIDEGDG

SEQ ID NO: 503057 - protein, 10 aa, Influenza virus
KNNAKDEGNG

SEQ ID NO: 503058 - protein, 10 aa, Influenza virus
KNNMINNDLG

SEQ ID NO: 503059 - protein, 10 aa, Influenza virus
KNNQVILCEP

SEQ ID NO: 503060 - protein, 10 aa, Influenza virus
KNNQVILCEQ

SEQ ID NO: 503061 - protein, 10 aa, Influenza virus
KNNQVILCGP

SEQ ID NO: 503062 - protein, 10 aa, Influenza virus
KNNTWVNQTY

SEQ ID NO: 503063 - protein, 10 aa, Influenza virus
KNNWSGYSGI

SEQ ID NO: 503064 - protein, 10 aa, Influenza virus
KNPALRMKWM

SEQ ID NO: 503065 - protein, 10 aa, Influenza virus
KNPAYCNTDL

SEQ ID NO: 503066 - protein, 10 aa, Influenza virus
KNPEAYNFNE

SEQ ID NO: 503067 - protein, 10 aa, Influenza virus
KNPSLRMKWM

SEQ ID NO: 503068 - protein, 10 aa, Influenza virus
KNPYTLVSTK

SEQ ID NO: 503069 - protein, 10 aa, Influenza virus
KNQEELRSLF

SEQ ID NO: 503070 - protein, 10 aa, Influenza virus
KNRSPYRALM

SEQ ID NO: 503071 - protein, 10 aa, Influenza virus
KNSDLEALME

SEQ ID NO: 503072 - protein, 10 aa, Influenza virus
KNSFYAELKW

SEQ ID NO: 503073 - protein, 10 aa, Influenza virus
KNSNGVQDII

SEQ ID NO: 503074 - protein, 10 aa, Influenza virus
KNSRSGYETF

SEQ ID NO: 503075 - protein, 10 aa, Influenza virus
KNTDLEALME

SEQ ID NO: 503076 - protein, 10 aa, Influenza virus
KNTDLEVLME

SEQ ID NO: 503077 - protein, 10 aa, Influenza virus
KNTNTLSSVT

SEQ ID NO: 503078 - protein, 10 aa, Influenza virus
KNTYVNNTTI

SEQ ID NO: 503079 - protein, 10 aa, Influenza virus
KNVPEKIHTR

SEQ ID NO: 503080 - protein, 10 aa, Influenza virus
KNVPEKIRTR

SEQ ID NO: 503081 - protein, 10 aa, Influenza virus
KNVPEKIRVK

SEQ ID NO: 503082 - protein, 10 aa, Influenza virus
KNVTVTHAKD

SEQ ID NO: 503083 - protein, 10 aa, Influenza virus
KNVTVTHAQD

SEQ ID NO: 503084 - protein, 10 aa, Influenza virus
KNVTVTHAQN

SEQ ID NO: 503085 - protein, 10 aa, Influenza virus
KNVTVTHAVN

SEQ ID NO: 503086 - protein, 10 aa, Influenza virus
KNVTVTHSIE

SEQ ID NO: 503087 - protein, 10 aa, Influenza virus
KNVTVTHSIN

SEQ ID NO: 503088 - protein, 10 aa, Influenza virus
KNVTVTHSVD

SEQ ID NO: 503089 - protein, 10 aa, Influenza virus
KNVTVTHSVE

SEQ ID NO: 503090 - protein, 10 aa, Influenza virus
KNVTVTHSVN

SEQ ID NO: 503091 - protein, 10 aa, Influenza virus
KNWILWISFA

SEQ ID NO: 503092 - protein, 10 aa, Influenza virus
KNWSGYSGAF

SEQ ID NO: 503093 - protein, 10 aa, Influenza virus
KNWSGYSGSF

SEQ ID NO: 503094 - protein, 10 aa, Influenza virus
KPCFWVELIR

SEQ ID NO: 503095 - protein, 10 aa, Influenza virus
KPDIYDFNEG

SEQ ID NO: 503096 - protein, 10 aa, Influenza virus
KPDTYDFNEG

SEQ ID NO: 503097 - protein, 10 aa, Influenza virus
KPFQNICKPY

SEQ ID NO: 503098 - protein, 10 aa, Influenza virus
KPFQNTSKHY

SEQ ID NO: 503099 - protein, 10 aa, Influenza virus
KPFQNTSRHY

SEQ ID NO: 503100 - protein, 10 aa, Influenza virus
KPFQNVNKIT

SEQ ID NO: 503101 - protein, 10 aa, Influenza virus
KPFQNVNKVT

SEQ ID NO: 503102 - protein, 10 aa, Influenza virus
KPFQNVNRIT

SEQ ID NO: 503103 - protein, 10 aa, Influenza virus
KPFQNVSRIA

SEQ ID NO: 503104 - protein, 10 aa, Influenza virus
KPGETLKVES

SEQ ID NO: 503105 - protein, 10 aa, Influenza virus
KPGETLNIES

SEQ ID NO: 503106 - protein, 10 aa, Influenza virus
KPGETLNVES

SEQ ID NO: 503107 - protein, 10 aa, Influenza virus
KPGQTLRIIS

SEQ ID NO: 503108 - protein, 10 aa, Influenza virus
KPGQTLRIRS

SEQ ID NO: 503109 - protein, 10 aa, Influenza virus
KPGQTLRVKS

SEQ ID NO: 503110 - protein, 10 aa, Influenza virus
KPGQTLRVRS

SEQ ID NO: 503111 - protein, 10 aa, Influenza virus
KPGQTVKIKT

SEQ ID NO: 503112 - protein, 10 aa, Influenza virus
KPGQTVKIQT

SEQ ID NO: 503113 - protein, 10 aa, Influenza virus
KPKFLPDLYD

SEQ ID NO: 503114 - protein, 10 aa, Influenza virus
KPKSLPDLYD

SEQ ID NO: 503115 - protein, 10 aa, Influenza virus
KPKYLPDLYD

SEQ ID NO: 503116 - protein, 10 aa, Influenza virus
KPLCAVNSWH

SEQ ID NO: 503117 - protein, 10 aa, Influenza virus
KPLCEVNSWH

SEQ ID NO: 503118 - protein, 10 aa, Influenza virus
KPLCEVSSWH

SEQ ID NO: 503119 - protein, 10 aa, Influenza virus
KPLILKDCSV

SEQ ID NO: 503120 - protein, 10 aa, Influenza virus
KPLILRDCSV

SEQ ID NO: 503121 - protein, 10 aa, Influenza virus
KPLQNTSKHY

SEQ ID NO: 503122 - protein, 10 aa, Influenza virus
KPNGCIEGKL

SEQ ID NO: 503123 - protein, 10 aa, Influenza virus
KPNIGPRPFV

SEQ ID NO: 503124 - protein, 10 aa, Influenza virus
KPNIGPRPLV

SEQ ID NO: 503125 - protein, 10 aa, Influenza virus
KPQCEITGFA

SEQ ID NO: 503126 - protein, 10 aa, Influenza virus
KPQCHITGFA

SEQ ID NO: 503127 - protein, 10 aa, Influenza virus
KPQCKITGFA

SEQ ID NO: 503128 - protein, 10 aa, Influenza virus
KPQCLITGFA

SEQ ID NO: 503129 - protein, 10 aa, Influenza virus
KPQCQIAGFA

SEQ ID NO: 503130 - protein, 10 aa, Influenza virus
KPQCQITGFA

SEQ ID NO: 503131 - protein, 10 aa, Influenza virus
KPQCQITGFV

SEQ ID NO: 503132 - protein, 10 aa, Influenza virus
KPQCQITGSA

SEQ ID NO: 503133 - protein, 10 aa, Influenza virus
KPQCQVTGFA

SEQ ID NO: 503134 - protein, 10 aa, Influenza virus
KPRFLPDLYD

SEQ ID NO: 503135 - protein, 10 aa, Influenza virus
KPRGLFGAIA

SEQ ID NO: 503136 - protein, 10 aa, Influenza virus
KPRPRRGLFG

SEQ ID NO: 503137 - protein, 10 aa, Influenza virus
KPRYLPDLYD

SEQ ID NO: 503138 - protein, 10 aa, Influenza virus
KPWARNILRT

SEQ ID NO: 503139 - protein, 10 aa, Influenza virus
KPYIGKCPKY

SEQ ID NO: 503140 - protein, 10 aa, Influenza virus
KQAKGLFGAI

SEQ ID NO: 503141 - protein, 10 aa, Influenza virus
KQASYKIFKS

SEQ ID NO: 503142 - protein, 10 aa, Influenza virus
KQDGKSSACK

SEQ ID NO: 503143 - protein, 10 aa, Influenza virus
KQEFKMNPNK

SEQ ID NO: 503144 - protein, 10 aa, Influenza virus
KQEFKMNPNQ

SEQ ID NO: 503145 - protein, 10 aa, Influenza virus
KQEIEGIKLK

SEQ ID NO: 503146 - protein, 10 aa, Influenza virus
KQEIKMNPNQ

SEQ ID NO: 503147 - protein, 10 aa, Influenza virus
KQESLLLATG

SEQ ID NO: 503148 - protein, 10 aa, Influenza virus
KQESLMLATG

SEQ ID NO: 503149 - protein, 10 aa, Influenza virus
KQETRVWWTS

SEQ ID NO: 503150 - protein, 10 aa, Influenza virus
KQFELIDNEF

SEQ ID NO: 503151 - protein, 10 aa, Influenza virus
KQGKTKATKM

SEQ ID NO: 503152 - protein, 10 aa, Influenza virus
KQGSLKLATG

SEQ ID NO: 503153 - protein, 10 aa, Influenza virus
KQGSLMLATG

SEQ ID NO: 503154 - protein, 10 aa, Influenza virus
KQGSLRLATG

SEQ ID NO: 503155 - protein, 10 aa, Influenza virus
KQIGNLINWT

SEQ ID NO: 503156 - protein, 10 aa, Influenza virus
KQIGNVINWT

SEQ ID NO: 503157 - protein, 10 aa, Influenza virus
KQILRTQESS

SEQ ID NO: 503158 - protein, 10 aa, Influenza virus
KQKSLLLATG

SEQ ID NO: 503159 - protein, 10 aa, Influenza virus
KQKTLKLATG

SEQ ID NO: 503160 - protein, 10 aa, Influenza virus
KQLGNVINWT

SEQ ID NO: 503161 - protein, 10 aa, Influenza virus
KQLRENAEDL

SEQ ID NO: 503162 - protein, 10 aa, Influenza virus
KQLRENAEDM

SEQ ID NO: 503163 - protein, 10 aa, Influenza virus
KQLRENAEED

SEQ ID NO: 503164 - protein, 10 aa, Influenza virus
KQLRENAEEM

SEQ ID NO: 503165 - protein, 10 aa, Influenza virus
KQLRQNAEED

SEQ ID NO: 503166 - protein, 10 aa, Influenza virus
KQLTHHMRKK

SEQ ID NO: 503167 - protein, 10 aa, Influenza virus
KQMTRGLFGA

SEQ ID NO: 503168 - protein, 10 aa, Influenza virus
KQNGKSGACK

SEQ ID NO: 503169 - protein, 10 aa, Influenza virus
KQNGKSSACK

SEQ ID NO: 503170 - protein, 10 aa, Influenza virus
KQNPTEEQAV

SEQ ID NO: 503171 - protein, 10 aa, Influenza virus
KQNTLKLATG

SEQ ID NO: 503172 - protein, 10 aa, Influenza virus
KQPISLGDCS

SEQ ID NO: 503173 - protein, 10 aa, Influenza virus
KQSSLPLALG

SEQ ID NO: 503174 - protein, 10 aa, Influenza virus
KQSTLKLATG

SEQ ID NO: 503175 - protein, 10 aa, Influenza virus
KQTKTMTITF

SEQ ID NO: 503176 - protein, 10 aa, Influenza virus
KQTRGIFGAI

SEQ ID NO: 503177 - protein, 10 aa, Influenza virus
KQTRGLFGAI

SEQ ID NO: 503178 - protein, 10 aa, Influenza virus
KQTSLLLATG

SEQ ID NO: 503179 - protein, 10 aa, Influenza virus
KQVCAAWSSS

SEQ ID NO: 503180 - protein, 10 aa, Influenza virus
KQVCIAWSSS

SEQ ID NO: 503181 - protein, 10 aa, Influenza virus
KQVCMAWSSS

SEQ ID NO: 503182 - protein, 10 aa, Influenza virus
KQVCVAWSSS

SEQ ID NO: 503183 - protein, 10 aa, Influenza virus
KQVDTIMEKN

SEQ ID NO: 503184 - protein, 10 aa, Influenza virus
KRCINRCFYV

SEQ ID NO: 503185 - protein, 10 aa, Influenza virus
KRDSSILTDS

SEQ ID NO: 503186 - protein, 10 aa, Influenza virus
KREITFHGAK

SEQ ID NO: 503187 - protein, 10 aa, Influenza virus
KREITFYGAK

SEQ ID NO: 503188 - protein, 10 aa, Influenza virus
KREMTFHGAK

SEQ ID NO: 503189 - protein, 10 aa, Influenza virus
KRFADQELGD

SEQ ID NO: 503190 - protein, 10 aa, Influenza virus
KRGETLKIRT

SEQ ID NO: 503191 - protein, 10 aa, Influenza virus
KRGGSGIMKT

SEQ ID NO: 503192 - protein, 10 aa, Influenza virus
KRGINDRNFW

SEQ ID NO: 503193 - protein, 10 aa, Influenza virus
KRGLFGAIAG

SEQ ID NO: 503194 - protein, 10 aa, Influenza virus
KRGNSGIMKT

SEQ ID NO: 503195 - protein, 10 aa, Influenza virus
KRGSSGIMKT

SEQ ID NO: 503196 - protein, 10 aa, Influenza virus
KRGSSGIVKT

SEQ ID NO: 503197 - protein, 10 aa, Influenza virus
KRGSSGVMKT

SEQ ID NO: 503198 - protein, 10 aa, Influenza virus
KRGVNDRNFW

SEQ ID NO: 503199 - protein, 10 aa, Influenza virus
KRIENLNKKM

SEQ ID NO: 503200 - protein, 10 aa, Influenza virus
KRIGSCTSPC

SEQ ID NO: 503201 - protein, 10 aa, Influenza virus
KRINMIADRV

SEQ ID NO: 503202 - protein, 10 aa, Influenza virus
KRINMINDKI

SEQ ID NO: 503203 - protein, 10 aa, Influenza virus
KRINMISDKI

SEQ ID NO: 503204 - protein, 10 aa, Influenza virus
KRINMLADRI

SEQ ID NO: 503205 - protein, 10 aa, Influenza virus
KRINMLADRV

SEQ ID NO: 503206 - protein, 10 aa, Influenza virus
KRINMLADWV

SEQ ID NO: 503207 - protein, 10 aa, Influenza virus
KRINVINDKI

SEQ ID NO: 503208 - protein, 10 aa, Influenza virus
KRIRLFDYSG

SEQ ID NO: 503209 - protein, 10 aa, Influenza virus
KRIRLFDYSK

SEQ ID NO: 503210 - protein, 10 aa, Influenza virus
KRIRLFDYSR

SEQ ID NO: 503211 - protein, 10 aa, Influenza virus
KRIRMAINLV

SEQ ID NO: 503212 - protein, 10 aa, Influenza virus
KRIRMAINQC

SEQ ID NO: 503213 - protein, 10 aa, Influenza virus
KRIRMAINWG

SEQ ID NO: 503214 - protein, 10 aa, Influenza virus
KRIRMAINYS

SEQ ID NO: 503215 - protein, 10 aa, Influenza virus
KRIRMATNEC

SEQ ID NO: 503216 - protein, 10 aa, Influenza virus
KRKKRGLFGA

SEQ ID NO: 503217 - protein, 10 aa, Influenza virus
KRKRDSSILT

SEQ ID NO: 503218 - protein, 10 aa, Influenza virus
KRKRGLFGAI

SEQ ID NO: 503219 - protein, 10 aa, Influenza virus
KRKRKTRGLF

SEQ ID NO: 503220 - protein, 10 aa, Influenza virus
KRKRNSSILT

SEQ ID NO: 503221 - protein, 10 aa, Influenza virus
KRKTRGLFGA

SEQ ID NO: 503222 - protein, 10 aa, Influenza virus
KRLAVLGKDA

SEQ ID NO: 503223 - protein, 10 aa, Influenza virus
KRLCTINSWH

SEQ ID NO: 503224 - protein, 10 aa, Influenza virus
KRLGSWSWHD

SEQ ID NO: 503225 - protein, 10 aa, Influenza virus
KRLLRENAEE

SEQ ID NO: 503226 - protein, 10 aa, Influenza virus
KRLTIIGKDA

SEQ ID NO: 503227 - protein, 10 aa, Influenza virus
KRLTILGKDA

SEQ ID NO: 503228 - protein, 10 aa, Influenza virus
KRLTTTIKTW

SEQ ID NO: 503229 - protein, 10 aa, Influenza virus
KRLTVLGKDA

SEQ ID NO: 503230 - protein, 10 aa, Influenza virus
KRLVLATGLR

SEQ ID NO: 503231 - protein, 10 aa, Influenza virus
KRMTRGLFGA

SEQ ID NO: 503232 - protein, 10 aa, Influenza virus
KRNEIKGVEL

SEQ ID NO: 503233 - protein, 10 aa, Influenza virus
KRNEIKGVKL

SEQ ID NO: 503234 - protein, 10 aa, Influenza virus
KRNITEIVYL

SEQ ID NO: 503235 - protein, 10 aa, Influenza virus
KRNRSILNTS

SEQ ID NO: 503236 - protein, 10 aa, Influenza virus
KRNSSILTDS

SEQ ID NO: 503237 - protein, 10 aa, Influenza virus
KRPVTEINTW

SEQ ID NO: 503238 - protein, 10 aa, Influenza virus
KRQEIDGIKL

SEQ ID NO: 503239 - protein, 10 aa, Influenza virus
KRQEIEGIKL

SEQ ID NO: 503240 - protein, 10 aa, Influenza virus
KRQEIEGIRL

SEQ ID NO: 503241 - protein, 10 aa, Influenza virus
KRQEINGIKL

SEQ ID NO: 503242 - protein, 10 aa, Influenza virus
KRQLRENAED

SEQ ID NO: 503243 - protein, 10 aa, Influenza virus
KRQLRENAEE

SEQ ID NO: 503244 - protein, 10 aa, Influenza virus
KRQLRENAEK

SEQ ID NO: 503245 - protein, 10 aa, Influenza virus
KRRAIATPGM

SEQ ID NO: 503246 - protein, 10 aa, Influenza virus
KRRKKRGLFG

SEQ ID NO: 503247 - protein, 10 aa, Influenza virus
KRRPVAKAGF

SEQ ID NO: 503248 - protein, 10 aa, Influenza virus
KRSHEQMETG

SEQ ID NO: 503249 - protein, 10 aa, Influenza virus
KRSYEQMETD

SEQ ID NO: 503250 - protein, 10 aa, Influenza virus
KRSYEQMETG

SEQ ID NO: 503251 - protein, 10 aa, Influenza virus
KRSYEQMETS

SEQ ID NO: 503252 - protein, 10 aa, Influenza virus
KRSYNNTSGE

SEQ ID NO: 503253 - protein, 10 aa, Influenza virus
KRTNMINDKI

SEQ ID NO: 503254 - protein, 10 aa, Influenza virus
KRTVSSFYSE

SEQ ID NO: 503255 - protein, 10 aa, Influenza virus
KRVRLFDYSR

SEQ ID NO: 503256 - protein, 10 aa, Influenza virus
KRYELEIGAR

SEQ ID NO: 503257 - protein, 10 aa, Influenza virus
KRYELEIGTR

SEQ ID NO: 503258 - protein, 10 aa, Influenza virus
KRYERVKMFD

SEQ ID NO: 503259 - protein, 10 aa, Influenza virus
KRYGPALSIN

SEQ ID NO: 503260 - protein, 10 aa, Influenza virus
KRYGPALSIS

SEQ ID NO: 503261 - protein, 10 aa, Influenza virus
KSCINRCFYV

SEQ ID NO: 503262 - protein, 10 aa, Influenza virus
KSCLPACAYG

SEQ ID NO: 503263 - protein, 10 aa, Influenza virus
KSCLPACIYG

SEQ ID NO: 503264 - protein, 10 aa, Influenza virus
KSCLPACVYG

SEQ ID NO: 503265 - protein, 10 aa, Influenza virus
KSCVNRCFYV

SEQ ID NO: 503266 - protein, 10 aa, Influenza virus
KSDKICIGYH

SEQ ID NO: 503267 - protein, 10 aa, Influenza virus
KSDKICLGHH

SEQ ID NO: 503268 - protein, 10 aa, Influenza virus
KSDKRIGSCT

SEQ ID NO: 503269 - protein, 10 aa, Influenza virus
KSDQLKLATG

SEQ ID NO: 503270 - protein, 10 aa, Influenza virus
KSDRICIGYH

SEQ ID NO: 503271 - protein, 10 aa, Influenza virus
KSDRLVLAIG

SEQ ID NO: 503272 - protein, 10 aa, Influenza virus
KSDRLVLATG

SEQ ID NO: 503273 - protein, 10 aa, Influenza virus
KSEDNVYKVL

SEQ ID NO: 503274 - protein, 10 aa, Influenza virus
KSEKLVLATG

SEQ ID NO: 503275 - protein, 10 aa, Influenza virus
KSEQFPVQTD

SEQ ID NO: 503276 - protein, 10 aa, Influenza virus
KSERLVLATG

SEQ ID NO: 503277 - protein, 10 aa, Influenza virus
KSFSRTELIA

SEQ ID NO: 503278 - protein, 10 aa, Influenza virus
KSFSRTQLIA

SEQ ID NO: 503279 - protein, 10 aa, Influenza virus
KSGQFPVQTD

SEQ ID NO: 503280 - protein, 10 aa, Influenza virus
KSGQLKLATG

SEQ ID NO: 503281 - protein, 10 aa, Influenza virus
KSHGRILKND

SEQ ID NO: 503282 - protein, 10 aa, Influenza virus
KSHGRILKNN

SEQ ID NO: 503283 - protein, 10 aa, Influenza virus
KSHGRVLKNN

SEQ ID NO: 503284 - protein, 10 aa, Influenza virus
KSITQTLVSN

SEQ ID NO: 503285 - protein, 10 aa, Influenza virus
KSKCFWRGGS

SEQ ID NO: 503286 - protein, 10 aa, Influenza virus
KSKLFTLSGV

SEQ ID NO: 503287 - protein, 10 aa, Influenza virus
KSLCEVNSWH

SEQ ID NO: 503288 - protein, 10 aa, Influenza virus
KSLCKIEGWV

SEQ ID NO: 503289 - protein, 10 aa, Influenza virus
KSLCKVEEWV

SEQ ID NO: 503290 - protein, 10 aa, Influenza virus
KSLCKVEGWV

SEQ ID NO: 503291 - protein, 10 aa, Influenza virus
KSLCNVEGWV

SEQ ID NO: 503292 - protein, 10 aa, Influenza virus
KSLCSVEGWV

SEQ ID NO: 503293 - protein, 10 aa, Influenza virus
KSLESRSGFE

SEQ ID NO: 503294 - protein, 10 aa, Influenza virus
KSLFSSIKKY

SEQ ID NO: 503295 - protein, 10 aa, Influenza virus
KSLGIQSDAQ

SEQ ID NO: 503296 - protein, 10 aa, Influenza virus
KSLIWLWLVL

SEQ ID NO: 503297 - protein, 10 aa, Influenza virus
KSLKLASGLR

SEQ ID NO: 503298 - protein, 10 aa, Influenza virus
KSLKLATGLR

SEQ ID NO: 503299 - protein, 10 aa, Influenza virus
KSLKLATGPR

SEQ ID NO: 503300 - protein, 10 aa, Influenza virus
KSLKLVTGLR

SEQ ID NO: 503301 - protein, 10 aa, Influenza virus
KSLLLATGMR

SEQ ID NO: 503302 - protein, 10 aa, Influenza virus
KSLMLATGMR

SEQ ID NO: 503303 - protein, 10 aa, Influenza virus
KSLPDLYDYK

SEQ ID NO: 503304 - protein, 10 aa, Influenza virus
KSLRGRGSTL

SEQ ID NO: 503305 - protein, 10 aa, Influenza virus
KSLYDKVRMQ

SEQ ID NO: 503306 - protein, 10 aa, Influenza virus
KSNAIDEGDG

SEQ ID NO: 503307 - protein, 10 aa, Influenza virus
KSQLIWMACH

SEQ ID NO: 503308 - protein, 10 aa, Influenza virus
KSQLVWMACH

SEQ ID NO: 503309 - protein, 10 aa, Influenza virus
KSQLVWMACN

SEQ ID NO: 503310 - protein, 10 aa, Influenza virus
KSRGYKMNIQ

SEQ ID NO: 503311 - protein, 10 aa, Influenza virus
KSRGYKMNNQ

SEQ ID NO: 503312 - protein, 10 aa, Influenza virus
KSRGYKMNTK

SEQ ID NO: 503313 - protein, 10 aa, Influenza virus
KSRGYKMNTQ

SEQ ID NO: 503314 - protein, 10 aa, Influenza virus
KSRGYKMNTR

SEQ ID NO: 503315 - protein, 10 aa, Influenza virus
KSRINGVKLE

SEQ ID NO: 503316 - protein, 10 aa, Influenza virus
KSRSIIFNME

SEQ ID NO: 503317 - protein, 10 aa, Influenza virus
KSRSNIFNME

SEQ ID NO: 503318 - protein, 10 aa, Influenza virus
KSRVDNHSMS

SEQ ID NO: 503319 - protein, 10 aa, Influenza virus
KSTKSTVLKS

SEQ ID NO: 503320 - protein, 10 aa, Influenza virus
KSTPSAIDQI

SEQ ID NO: 503321 - protein, 10 aa, Influenza virus
KSTQAAIDQI

SEQ ID NO: 503322 - protein, 10 aa, Influenza virus
KSTQAAIDQM

SEQ ID NO: 503323 - protein, 10 aa, Influenza virus
KSTQAAIDQV

SEQ ID NO: 503324 - protein, 10 aa, Influenza virus
KSTQAAINQI

SEQ ID NO: 503325 - protein, 10 aa, Influenza virus
KSTQAAVDQI

SEQ ID NO: 503326 - protein, 10 aa, Influenza virus
KSTQAAVNQI

SEQ ID NO: 503327 - protein, 10 aa, Influenza virus
KSTQEAIDKI

SEQ ID NO: 503328 - protein, 10 aa, Influenza virus
KSTQEAIEKI

SEQ ID NO: 503329 - protein, 10 aa, Influenza virus
KSTQEAIGKI

SEQ ID NO: 503330 - protein, 10 aa, Influenza virus
KSTQEAINKI

SEQ ID NO: 503331 - protein, 10 aa, Influenza virus
KSTQKTIDQV

SEQ ID NO: 503332 - protein, 10 aa, Influenza virus
KSTQSAIDQI

SEQ ID NO: 503333 - protein, 10 aa, Influenza virus
KSTQSAIDQV

SEQ ID NO: 503334 - protein, 10 aa, Influenza virus
KSTQSAINQI

SEQ ID NO: 503335 - protein, 10 aa, Influenza virus
KSTQSAVDQI

SEQ ID NO: 503336 - protein, 10 aa, Influenza virus
KSTQSAVNQI

SEQ ID NO: 503337 - protein, 10 aa, Influenza virus
KSTQTAIDQI

SEQ ID NO: 503338 - protein, 10 aa, Influenza virus
KSTVLKSDKR

SEQ ID NO: 503339 - protein, 10 aa, Influenza virus
KSVFNCLYAS

SEQ ID NO: 503340 - protein, 10 aa, Influenza virus
KSVFNNLYAS

SEQ ID NO: 503341 - protein, 10 aa, Influenza virus
KSVFNSIYAS

SEQ ID NO: 503342 - protein, 10 aa, Influenza virus
KSVFNSLYAS

SEQ ID NO: 503343 - protein, 10 aa, Influenza virus
KSVFNSLYSS

SEQ ID NO: 503344 - protein, 10 aa, Influenza virus
KSVTQTLVSN

SEQ ID NO: 503345 - protein, 10 aa, Influenza virus
KSWKGNIMRT

SEQ ID NO: 503346 - protein, 10 aa, Influenza virus
KSWRKDILRT

SEQ ID NO: 503347 - protein, 10 aa, Influenza virus
KSWRRDILRT

SEQ ID NO: 503348 - protein, 10 aa, Influenza virus
KSWSKPQCQI

SEQ ID NO: 503349 - protein, 10 aa, Influenza virus
KSYFANLKGT

SEQ ID NO: 503350 - protein, 10 aa, Influenza virus
KSYINKTGTF

SEQ ID NO: 503351 - protein, 10 aa, Influenza virus
KSYINRTGTF

SEQ ID NO: 503352 - protein, 10 aa, Influenza virus
KTAYELTDSS

SEQ ID NO: 503353 - protein, 10 aa, Influenza virus
KTDGATSACK

SEQ ID NO: 503354 - protein, 10 aa, Influenza virus
KTEDNIYKIL

SEQ ID NO: 503355 - protein, 10 aa, Influenza virus
KTEDNVYKIL

SEQ ID NO: 503356 - protein, 10 aa, Influenza virus
KTEDNVYKVL

SEQ ID NO: 503357 - protein, 10 aa, Influenza virus
KTFFLTQGAL

SEQ ID NO: 503358 - protein, 10 aa, Influenza virus
KTFQNIDKNA

SEQ ID NO: 503359 - protein, 10 aa, Influenza virus
KTFQNIDRNA

SEQ ID NO: 503360 - protein, 10 aa, Influenza virus
KTFQNIEKNA

SEQ ID NO: 503361 - protein, 10 aa, Influenza virus
KTFQNIERNA

SEQ ID NO: 503362 - protein, 10 aa, Influenza virus
KTFQNISPVW

SEQ ID NO: 503363 - protein, 10 aa, Influenza virus
KTFQNVSPIW

SEQ ID NO: 503364 - protein, 10 aa, Influenza virus
KTFQNVSPLW

SEQ ID NO: 503365 - protein, 10 aa, Influenza virus
KTFQNVSPVW

SEQ ID NO: 503366 - protein, 10 aa, Influenza virus
KTGTFEFTSF

SEQ ID NO: 503367 - protein, 10 aa, Influenza virus
KTGTYDYPKY

SEQ ID NO: 503368 - protein, 10 aa, Influenza virus
KTHNGKLCKL

SEQ ID NO: 503369 - protein, 10 aa, Influenza virus
KTHNGKLCRL

SEQ ID NO: 503370 - protein, 10 aa, Influenza virus
KTHNGRLCKL

SEQ ID NO: 503371 - protein, 10 aa, Influenza virus
KTIDQVTGKL

SEQ ID NO: 503372 - protein, 10 aa, Influenza virus
KTITIGSVSL

SEQ ID NO: 503373 - protein, 10 aa, Influenza virus
KTIWTSGSSI

SEQ ID NO: 503374 - protein, 10 aa, Influenza virus
KTKATKMEAI

SEQ ID NO: 503375 - protein, 10 aa, Influenza virus
KTKATKMKAI

SEQ ID NO: 503376 - protein, 10 aa, Influenza virus
KTKCQTYAGA

SEQ ID NO: 503377 - protein, 10 aa, Influenza virus
KTKKMTITFL

SEQ ID NO: 503378 - protein, 10 aa, Influenza virus
KTKLPFQNLS

SEQ ID NO: 503379 - protein, 10 aa, Influenza virus
KTLDEHDANV

SEQ ID NO: 503380 - protein, 10 aa, Influenza virus
KTLDEHDSNV

SEQ ID NO: 503381 - protein, 10 aa, Influenza virus
KTLDKHDSNV

SEQ ID NO: 503382 - protein, 10 aa, Influenza virus
KTLDLHDANV

SEQ ID NO: 503383 - protein, 10 aa, Influenza virus
KTLDLHDSNV

SEQ ID NO: 503384 - protein, 10 aa, Influenza virus
KTLDMHDANV

SEQ ID NO: 503385 - protein, 10 aa, Influenza virus
KTLKLATGMR

SEQ ID NO: 503386 - protein, 10 aa, Influenza virus
KTLNMHDANV

SEQ ID NO: 503387 - protein, 10 aa, Influenza virus
KTLTDNHVEV

SEQ ID NO: 503388 - protein, 10 aa, Influenza virus
KTLTNEHEEV

SEQ ID NO: 503389 - protein, 10 aa, Influenza virus
KTLTNEKEEV

SEQ ID NO: 503390 - protein, 10 aa, Influenza virus
KTLTNEKEKV

SEQ ID NO: 503391 - protein, 10 aa, Influenza virus
KTLTNEQEEV

SEQ ID NO: 503392 - protein, 10 aa, Influenza virus
KTLTSEKEEV

SEQ ID NO: 503393 - protein, 10 aa, Influenza virus
KTMTITFLIL

SEQ ID NO: 503394 - protein, 10 aa, Influenza virus
KTNDKYHQIE

SEQ ID NO: 503395 - protein, 10 aa, Influenza virus
KTNEKFHQIE

SEQ ID NO: 503396 - protein, 10 aa, Influenza virus
KTNEKYHQIE

SEQ ID NO: 503397 - protein, 10 aa, Influenza virus
KTNGNLIAPE

SEQ ID NO: 503398 - protein, 10 aa, Influenza virus
KTNKQFELID

SEQ ID NO: 503399 - protein, 10 aa, Influenza virus
KTNLYGFIIK

SEQ ID NO: 503400 - protein, 10 aa, Influenza virus
KTNLYGFIVK

SEQ ID NO: 503401 - protein, 10 aa, Influenza virus
KTNQQFELID

SEQ ID NO: 503402 - protein, 10 aa, Influenza virus
KTNQQFELIN

SEQ ID NO: 503403 - protein, 10 aa, Influenza virus
KTNQQFEMID

SEQ ID NO: 503404 - protein, 10 aa, Influenza virus
KTNQQFGLID

SEQ ID NO: 503405 - protein, 10 aa, Influenza virus
KTNQQFKLID

SEQ ID NO: 503406 - protein, 10 aa, Influenza virus
KTNTEFESIE

SEQ ID NO: 503407 - protein, 10 aa, Influenza virus
KTNTQFELID

SEQ ID NO: 503408 - protein, 10 aa, Influenza virus
KTPYRSLIRF

SEQ ID NO: 503409 - protein, 10 aa, Influenza virus
KTRFLPVAGG

SEQ ID NO: 503410 - protein, 10 aa, Influenza virus
KTRFLPVSGG

SEQ ID NO: 503411 - protein, 10 aa, Influenza virus
KTRFLPVTGG

SEQ ID NO: 503412 - protein, 10 aa, Influenza virus
KTRGLFGAIA

SEQ ID NO: 503413 - protein, 10 aa, Influenza virus
KTRLFTIRQE

SEQ ID NO: 503414 - protein, 10 aa, Influenza virus
KTRPILSPLT

SEQ ID NO: 503415 - protein, 10 aa, Influenza virus
KTSIWTSSSS

SEQ ID NO: 503416 - protein, 10 aa, Influenza virus
KTSTQKAINE

SEQ ID NO: 503417 - protein, 10 aa, Influenza virus
KTSWSYIVEK

SEQ ID NO: 503418 - protein, 10 aa, Influenza virus
KTSWSYIVER

SEQ ID NO: 503419 - protein, 10 aa, Influenza virus
KTTVDHMAII

SEQ ID NO: 503420 - protein, 10 aa, Influenza virus
KTVINNITTT

SEQ ID NO: 503421 - protein, 10 aa, Influenza virus
KTVVHLNSTT

SEQ ID NO: 503422 - protein, 10 aa, Influenza virus
KTWAGKILRT

SEQ ID NO: 503423 - protein, 10 aa, Influenza virus
KTWAGNILRT

SEQ ID NO: 503424 - protein, 10 aa, Influenza virus
KTWAKNILRT

SEQ ID NO: 503425 - protein, 10 aa, Influenza virus
KTWARNILRT

SEQ ID NO: 503426 - protein, 10 aa, Influenza virus
KTYNNTTGRD

SEQ ID NO: 503427 - protein, 10 aa, Influenza virus
KVARLGKGYM

SEQ ID NO: 503428 - protein, 10 aa, Influenza virus
KVATGRVTVS

SEQ ID NO: 503429 - protein, 10 aa, Influenza virus
KVCRALLAKS

SEQ ID NO: 503430 - protein, 10 aa, Influenza virus
KVCRTLLAKS

SEQ ID NO: 503431 - protein, 10 aa, Influenza virus
KVCTKGKKAV

SEQ ID NO: 503432 - protein, 10 aa, Influenza virus
KVDGSSSACL

SEQ ID NO: 503433 - protein, 10 aa, Influenza virus
KVDLWSYNAE

SEQ ID NO: 503434 - protein, 10 aa, Influenza virus
KVDTIIENNV

SEQ ID NO: 503435 - protein, 10 aa, Influenza virus
KVDTIIESNV

SEQ ID NO: 503436 - protein, 10 aa, Influenza virus
KVDTILERNV

SEQ ID NO: 503437 - protein, 10 aa, Influenza virus
KVDTLTEKGI

SEQ ID NO: 503438 - protein, 10 aa, Influenza virus
KVDTLTENGV

SEQ ID NO: 503439 - protein, 10 aa, Influenza virus
KVDTLTETGV

SEQ ID NO: 503440 - protein, 10 aa, Influenza virus
KVDTNLERNV

SEQ ID NO: 503441 - protein, 10 aa, Influenza virus
KVEAVIYGNP

SEQ ID NO: 503442 - protein, 10 aa, Influenza virus
KVECICRDNW

SEQ ID NO: 503443 - protein, 10 aa, Influenza virus
KVECIGWSST

SEQ ID NO: 503444 - protein, 10 aa, Influenza virus
KVECVCRDNW

SEQ ID NO: 503445 - protein, 10 aa, Influenza virus
KVEFEPFQSL

SEQ ID NO: 503446 - protein, 10 aa, Influenza virus
KVEGWVVVAK

SEQ ID NO: 503447 - protein, 10 aa, Influenza virus
KVESNGNLIA

SEQ ID NO: 503448 - protein, 10 aa, Influenza virus
KVGYLCAGIP

SEQ ID NO: 503449 - protein, 10 aa, Influenza virus
KVKMKWGMEM

SEQ ID NO: 503450 - protein, 10 aa, Influenza virus
KVLAIYSCIA

SEQ ID NO: 503451 - protein, 10 aa, Influenza virus
KVLSIYSCIA

SEQ ID NO: 503452 - protein, 10 aa, Influenza virus
KVNGQAGRID

SEQ ID NO: 503453 - protein, 10 aa, Influenza virus
KVNGVKLEEN

SEQ ID NO: 503454 - protein, 10 aa, Influenza virus
KVNNIVDKMN

SEQ ID NO: 503455 - protein, 10 aa, Influenza virus
KVNSIIDKMN

SEQ ID NO: 503456 - protein, 10 aa, Influenza virus
KVNSIIEKMN

SEQ ID NO: 503457 - protein, 10 aa, Influenza virus
KVNSIINKMN

SEQ ID NO: 503458 - protein, 10 aa, Influenza virus
KVNSVIEKMN

SEQ ID NO: 503459 - protein, 10 aa, Influenza virus
KVNSVVEKMN

SEQ ID NO: 503460 - protein, 10 aa, Influenza virus
KVNTIIENNV

SEQ ID NO: 503461 - protein, 10 aa, Influenza virus
KVNTIIESNV

SEQ ID NO: 503462 - protein, 10 aa, Influenza virus
KVNTLTEKGI

SEQ ID NO: 503463 - protein, 10 aa, Influenza virus
KVNTLTEKGV

SEQ ID NO: 503464 - protein, 10 aa, Influenza virus
KVNTLTEREV

SEQ ID NO: 503465 - protein, 10 aa, Influenza virus
KVNTLTERGI

SEQ ID NO: 503466 - protein, 10 aa, Influenza virus
KVNTLTERGV

SEQ ID NO: 503467 - protein, 10 aa, Influenza virus
KVPEWSYIVE

SEQ ID NO: 503468 - protein, 10 aa, Influenza virus
KVPNAGTDPN

SEQ ID NO: 503469 - protein, 10 aa, Influenza virus
KVPNALIDDR

SEQ ID NO: 503470 - protein, 10 aa, Influenza virus
KVPNALTDDK

SEQ ID NO: 503471 - protein, 10 aa, Influenza virus
KVPNALTDDR

SEQ ID NO: 503472 - protein, 10 aa, Influenza virus
KVPNALTDER

SEQ ID NO: 503473 - protein, 10 aa, Influenza virus
KVPNALTDNR

SEQ ID NO: 503474 - protein, 10 aa, Influenza virus
KVPVTQTMEL

SEQ ID NO: 503475 - protein, 10 aa, Influenza virus
KVQHLEECSC

SEQ ID NO: 503476 - protein, 10 aa, Influenza virus
KVRHQLRDNA

SEQ ID NO: 503477 - protein, 10 aa, Influenza virus
KVRLQLKDNA

SEQ ID NO: 503478 - protein, 10 aa, Influenza virus
KVRLQLRDNA

SEQ ID NO: 503479 - protein, 10 aa, Influenza virus
KVRMQLKDNA

SEQ ID NO: 503480 - protein, 10 aa, Influenza virus
KVRMQLRDNA

SEQ ID NO: 503481 - protein, 10 aa, Influenza virus
KVRMQLRDNV

SEQ ID NO: 503482 - protein, 10 aa, Influenza virus
KVRNGTYDHK

SEQ ID NO: 503483 - protein, 10 aa, Influenza virus
KVRRQLRENA

SEQ ID NO: 503484 - protein, 10 aa, Influenza virus
KVSCVCRDNW

SEQ ID NO: 503485 - protein, 10 aa, Influenza virus
KVSTQKAINE

SEQ ID NO: 503486 - protein, 10 aa, Influenza virus
KVSTQKALNE

SEQ ID NO: 503487 - protein, 10 aa, Influenza virus
KVTCICRDNW

SEQ ID NO: 503488 - protein, 10 aa, Influenza virus
KVTCVCRDNW

SEQ ID NO: 503489 - protein, 10 aa, Influenza virus
KVTHRENLLL

SEQ ID NO: 503490 - protein, 10 aa, Influenza virus
KVVHISPLSG

SEQ ID NO: 503491 - protein, 10 aa, Influenza virus
KVWWTSNSII

SEQ ID NO: 503492 - protein, 10 aa, Influenza virus
KVWWTSNSIV

SEQ ID NO: 503493 - protein, 10 aa, Influenza virus
KWALGENMAP

SEQ ID NO: 503494 - protein, 10 aa, Influenza virus
KWDTLIEREN

SEQ ID NO: 503495 - protein, 10 aa, Influenza virus
KWGDILDGVT

SEQ ID NO: 503496 - protein, 10 aa, Influenza virus
KWGDILEGTT

SEQ ID NO: 503497 - protein, 10 aa, Influenza virus
KWGDVLDGVT

SEQ ID NO: 503498 - protein, 10 aa, Influenza virus
KWGMELRRCL

SEQ ID NO: 503499 - protein, 10 aa, Influenza virus
KWGMEMRRCL

SEQ ID NO: 503500 - protein, 10 aa, Influenza virus
KWGNVLDGVT

SEQ ID NO: 503501 - protein, 10 aa, Influenza virus
KWLISKSKEQ

SEQ ID NO: 503502 - protein, 10 aa, Influenza virus
KWLLSSKANQ

SEQ ID NO: 503503 - protein, 10 aa, Influenza virus
KWLLSSKDNQ

SEQ ID NO: 503504 - protein, 10 aa, Influenza virus
KWLSSSGNNQ

SEQ ID NO: 503505 - protein, 10 aa, Influenza virus
KWLSSSMNNQ

SEQ ID NO: 503506 - protein, 10 aa, Influenza virus
KWLTLKSGQF

SEQ ID NO: 503507 - protein, 10 aa, Influenza virus
KWLVSKDKGR

SEQ ID NO: 503508 - protein, 10 aa, Influenza virus
KWLVSKNKGQ

SEQ ID NO: 503509 - protein, 10 aa, Influenza virus
KWLVSKSKGQ

SEQ ID NO: 503510 - protein, 10 aa, Influenza virus
KWLVSKTKGQ

SEQ ID NO: 503511 - protein, 10 aa, Influenza virus
KWMMAMKYPI

SEQ ID NO: 503512 - protein, 10 aa, Influenza virus
KWMMAMRYPI

SEQ ID NO: 503513 - protein, 10 aa, Influenza virus
KWNENQNPRI

SEQ ID NO: 503514 - protein, 10 aa, Influenza virus
KWNENQNPRM

SEQ ID NO: 503515 - protein, 10 aa, Influenza virus
KWNENQNPRV

SEQ ID NO: 503516 - protein, 10 aa, Influenza virus
KWNVTHTGTS

SEQ ID NO: 503517 - protein, 10 aa, Influenza virus
KWNVTYTGIS

SEQ ID NO: 503518 - protein, 10 aa, Influenza virus
KWNVTYTGTS

SEQ ID NO: 503519 - protein, 10 aa, Influenza virus
KWREQLSQKF

SEQ ID NO: 503520 - protein, 10 aa, Influenza virus
KWSGYSGSFI

SEQ ID NO: 503521 - protein, 10 aa, Influenza virus
KWTLGENMAP

SEQ ID NO: 503522 - protein, 10 aa, Influenza virus
KWVLGENMAP

SEQ ID NO: 503523 - protein, 10 aa, Influenza virus
KWWVWLWLVL

SEQ ID NO: 503524 - protein, 10 aa, Influenza virus
KYDGIITDTI

SEQ ID NO: 503525 - protein, 10 aa, Influenza virus
KYDNGVWIGR

SEQ ID NO: 503526 - protein, 10 aa, Influenza virus
KYEEESKLKR

SEQ ID NO: 503527 - protein, 10 aa, Influenza virus
KYEEESKLNK

SEQ ID NO: 503528 - protein, 10 aa, Influenza virus
KYEEESKLNR

SEQ ID NO: 503529 - protein, 10 aa, Influenza virus
KYEEESRLNR

SEQ ID NO: 503530 - protein, 10 aa, Influenza virus
KYERVKMFDF

SEQ ID NO: 503531 - protein, 10 aa, Influenza virus
KYGDGVWIGR

SEQ ID NO: 503532 - protein, 10 aa, Influenza virus
KYGNGAWIGR

SEQ ID NO: 503533 - protein, 10 aa, Influenza virus
KYGNGVWIGR

SEQ ID NO: 503534 - protein, 10 aa, Influenza virus
KYGNGVWMGR

SEQ ID NO: 503535 - protein, 10 aa, Influenza virus
KYGPALSINE

SEQ ID NO: 503536 - protein, 10 aa, Influenza virus
KYGSGRIFQS

SEQ ID NO: 503537 - protein, 10 aa, Influenza virus
KYGTGRIFQS

SEQ ID NO: 503538 - protein, 10 aa, Influenza virus
KYGYIIEEYG

SEQ ID NO: 503539 - protein, 10 aa, Influenza virus
KYHQIEKEFE

SEQ ID NO: 503540 - protein, 10 aa, Influenza virus
KYHQIEKEFG

SEQ ID NO: 503541 - protein, 10 aa, Influenza virus
KYHWNLALDI

SEQ ID NO: 503542 - protein, 10 aa, Influenza virus
KYIKQGSLKL

SEQ ID NO: 503543 - protein, 10 aa, Influenza virus
KYIKSDQLKL

SEQ ID NO: 503544 - protein, 10 aa, Influenza virus
KYIKSGQLKL

SEQ ID NO: 503545 - protein, 10 aa, Influenza virus
KYIPSGSLKL

SEQ ID NO: 503546 - protein, 10 aa, Influenza virus
KYIPSNSLKL

SEQ ID NO: 503547 - protein, 10 aa, Influenza virus
KYIPSRSLKL

SEQ ID NO: 503548 - protein, 10 aa, Influenza virus
KYISSGSLKL

SEQ ID NO: 503549 - protein, 10 aa, Influenza virus
KYKGIITDTI

SEQ ID NO: 503550 - protein, 10 aa, Influenza virus
KYKIFKNGKK

SEQ ID NO: 503551 - protein, 10 aa, Influenza virus
KYLEEHPNAG

SEQ ID NO: 503552 - protein, 10 aa, Influenza virus
KYLEEHPSAG

SEQ ID NO: 503553 - protein, 10 aa, Influenza virus
KYLEEHPSTG

SEQ ID NO: 503554 - protein, 10 aa, Influenza virus
KYLPDLYDYK

SEQ ID NO: 503555 - protein, 10 aa, Influenza virus
KYMNVKSLKL

SEQ ID NO: 503556 - protein, 10 aa, Influenza virus
KYNGIITDTF

SEQ ID NO: 503557 - protein, 10 aa, Influenza virus
KYNGIITDTI

SEQ ID NO: 503558 - protein, 10 aa, Influenza virus
KYNGIITDTL

SEQ ID NO: 503559 - protein, 10 aa, Influenza virus
KYNGLITDTI

SEQ ID NO: 503560 - protein, 10 aa, Influenza virus
KYNGMITDTI

SEQ ID NO: 503561 - protein, 10 aa, Influenza virus
KYNGVITDTL

SEQ ID NO: 503562 - protein, 10 aa, Influenza virus
KYQQSFSPSP

SEQ ID NO: 503563 - protein, 10 aa, Influenza virus
KYQQSFTPSP

SEQ ID NO: 503564 - protein, 10 aa, Influenza virus
KYREEAMQNR

SEQ ID NO: 503565 - protein, 10 aa, Influenza virus
KYRQSFSPSP

SEQ ID NO: 503566 - protein, 10 aa, Influenza virus
KYRTESLQNR

SEQ ID NO: 503567 - protein, 10 aa, Influenza virus
KYSRADKICI

SEQ ID NO: 503568 - protein, 10 aa, Influenza virus
KYTSARQEKN

SEQ ID NO: 503569 - protein, 10 aa, Influenza virus
KYTSGRQEKN

SEQ ID NO: 503570 - protein, 10 aa, Influenza virus
KYVEDTKIDL

SEQ ID NO: 503571 - protein, 10 aa, Influenza virus
KYVEDTKVDL

SEQ ID NO: 503572 - protein, 10 aa, Influenza virus
KYVEWTSNSL

SEQ ID NO: 503573 - protein, 10 aa, Influenza virus
KYVKQGSLKL

SEQ ID NO: 503574 - protein, 10 aa, Influenza virus
KYVKQGSLML

SEQ ID NO: 503575 - protein, 10 aa, Influenza virus
KYVKQGSLRL

SEQ ID NO: 503576 - protein, 10 aa, Influenza virus
KYVKSDRLVL

SEQ ID NO: 503577 - protein, 10 aa, Influenza virus
KYVKSEKLVL

SEQ ID NO: 503578 - protein, 10 aa, Influenza virus
KYVKSERLVL

SEQ ID NO: 503579 - protein, 10 aa, Influenza virus
KYVKSKRLVL

SEQ ID NO: 503580 - protein, 10 aa, Influenza virus
KYVNIKSLKL

SEQ ID NO: 503581 - protein, 10 aa, Influenza virus
KYVNVKSLKL

SEQ ID NO: 503582 - protein, 10 aa, Influenza virus
KYVNVRSLKL

SEQ ID NO: 503583 - protein, 10 aa, Influenza virus
KYVRSEKLVL

SEQ ID NO: 503584 - protein, 10 aa, Influenza virus
KYVWWASNSL

SEQ ID NO: 503585 - protein, 10 aa, Influenza virus
KYVWWTSNSL

SEQ ID NO: 503586 - protein, 10 aa, Influenza virus
KYWAIRTRSG

SEQ ID NO: 503587 - protein, 10 aa, Influenza virus
LAAGGAIWVT

SEQ ID NO: 503588 - protein, 10 aa, Influenza virus
LAAGGDIWVT

SEQ ID NO: 503589 - protein, 10 aa, Influenza virus
LAATVTLHFK

SEQ ID NO: 503590 - protein, 10 aa, Influenza virus
LADQSLPPNF

SEQ ID NO: 503591 - protein, 10 aa, Influenza virus
LADRIDDAVT

SEQ ID NO: 503592 - protein, 10 aa, Influenza virus
LADRVDDAVT

SEQ ID NO: 503593 - protein, 10 aa, Influenza virus
LADSEMDKLY

SEQ ID NO: 503594 - protein, 10 aa, Influenza virus
LADSEMKKLY

SEQ ID NO: 503595 - protein, 10 aa, Influenza virus
LADSEMLNLY

SEQ ID NO: 503596 - protein, 10 aa, Influenza virus
LADSEMNKLF

SEQ ID NO: 503597 - protein, 10 aa, Influenza virus
LADSEMNKLY

SEQ ID NO: 503598 - protein, 10 aa, Influenza virus
LADSEMNNLY

SEQ ID NO: 503599 - protein, 10 aa, Influenza virus
LADSEMSKLY

SEQ ID NO: 503600 - protein, 10 aa, Influenza virus
LADWVDDAVT

SEQ ID NO: 503601 - protein, 10 aa, Influenza virus
LAEKAMKEHG

SEQ ID NO: 503602 - protein, 10 aa, Influenza virus
LAEKAMKEYG

SEQ ID NO: 503603 - protein, 10 aa, Influenza virus
LAEKTMKEYG

SEQ ID NO: 503604 - protein, 10 aa, Influenza virus
LAERAMKEYG

SEQ ID NO: 503605 - protein, 10 aa, Influenza virus
LAESEMNKLY

SEQ ID NO: 503606 - protein, 10 aa, Influenza virus
LAFICIKNGN

SEQ ID NO: 503607 - protein, 10 aa, Influenza virus
LAFILWACQN

SEQ ID NO: 503608 - protein, 10 aa, Influenza virus
LAFILWACSS

SEQ ID NO: 503609 - protein, 10 aa, Influenza virus
LAFIMWACSN

SEQ ID NO: 503610 - protein, 10 aa, Influenza virus
LAFIMWACSS

SEQ ID NO: 503611 - protein, 10 aa, Influenza virus
LAFMLWACQN

SEQ ID NO: 503612 - protein, 10 aa, Influenza virus
LAFVLWACQN

SEQ ID NO: 503613 - protein, 10 aa, Influenza virus
LAGSAQHVEE

SEQ ID NO: 503614 - protein, 10 aa, Influenza virus
LAGTAKHIEE

SEQ ID NO: 503615 - protein, 10 aa, Influenza virus
LAHALKLVVA

SEQ ID NO: 503616 - protein, 10 aa, Influenza virus
LAIAMGLIFM

SEQ ID NO: 503617 - protein, 10 aa, Influenza virus
LAIGECPKYV

SEQ ID NO: 503618 - protein, 10 aa, Influenza virus
LAIGLRNTPS

SEQ ID NO: 503619 - protein, 10 aa, Influenza virus
LAIGLRNVPQ

SEQ ID NO: 503620 - protein, 10 aa, Influenza virus
LAIGPRNVPQ

SEQ ID NO: 503621 - protein, 10 aa, Influenza virus
LAIIIAGLSF

SEQ ID NO: 503622 - protein, 10 aa, Influenza virus
LAILIAGGLI

SEQ ID NO: 503623 - protein, 10 aa, Influenza virus
LAILVAGGLI

SEQ ID NO: 503624 - protein, 10 aa, Influenza virus
LAIMIAGLFF

SEQ ID NO: 503625 - protein, 10 aa, Influenza virus
LAIMIAGLSF

SEQ ID NO: 503626 - protein, 10 aa, Influenza virus
LAIMMAGLSF

SEQ ID NO: 503627 - protein, 10 aa, Influenza virus
LAIMVAGLSF

SEQ ID NO: 503628 - protein, 10 aa, Influenza virus
LAIYATVAGS

SEQ ID NO: 503629 - protein, 10 aa, Influenza virus
LAIYSCIASS

SEQ ID NO: 503630 - protein, 10 aa, Influenza virus
LAIYSTAASS

SEQ ID NO: 503631 - protein, 10 aa, Influenza virus
LAIYSTISSS

SEQ ID NO: 503632 - protein, 10 aa, Influenza virus
LAIYSTVASS

SEQ ID NO: 503633 - protein, 10 aa, Influenza virus
LAIYSTVSSS

SEQ ID NO: 503634 - protein, 10 aa, Influenza virus
LAKCNTKCQT

SEQ ID NO: 503635 - protein, 10 aa, Influenza virus
LAKGEKANVL

SEQ ID NO: 503636 - protein, 10 aa, Influenza virus
LAKSVFNCLY

SEQ ID NO: 503637 - protein, 10 aa, Influenza virus
LAKSVFNNLY

SEQ ID NO: 503638 - protein, 10 aa, Influenza virus
LAKSVFNSIY

SEQ ID NO: 503639 - protein, 10 aa, Influenza virus
LAKSVFNSLY

SEQ ID NO: 503640 - protein, 10 aa, Influenza virus
LALGLRNTPS

SEQ ID NO: 503641 - protein, 10 aa, Influenza virus
LALGMKNVPE

SEQ ID NO: 503642 - protein, 10 aa, Influenza virus
LALSHTAYSQ

SEQ ID NO: 503643 - protein, 10 aa, Influenza virus
LANNGKFEFI

SEQ ID NO: 503644 - protein, 10 aa, Influenza virus
LANNGRFEFI

SEQ ID NO: 503645 - protein, 10 aa, Influenza virus
LANQSLPPNF

SEQ ID NO: 503646 - protein, 10 aa, Influenza virus
LANTIEIFRS

SEQ ID NO: 503647 - protein, 10 aa, Influenza virus
LANTIEVFKS

SEQ ID NO: 503648 - protein, 10 aa, Influenza virus
LANTIEVFRL

SEQ ID NO: 503649 - protein, 10 aa, Influenza virus
LANTIEVFRS

SEQ ID NO: 503650 - protein, 10 aa, Influenza virus
LANVVRKMMT

SEQ ID NO: 503651 - protein, 10 aa, Influenza virus
LANYSLPPNF

SEQ ID NO: 503652 - protein, 10 aa, Influenza virus
LAPKYGYIIE

SEQ ID NO: 503653 - protein, 10 aa, Influenza virus
LAPRYAFEIV

SEQ ID NO: 503654 - protein, 10 aa, Influenza virus
LAPRYAFELV

SEQ ID NO: 503655 - protein, 10 aa, Influenza virus
LAPRYALELV

SEQ ID NO: 503656 - protein, 10 aa, Influenza virus
LAPRYGYIIE

SEQ ID NO: 503657 - protein, 10 aa, Influenza virus
LAPRYSFELV

SEQ ID NO: 503658 - protein, 10 aa, Influenza virus
LAQGALLGTK

SEQ ID NO: 503659 - protein, 10 aa, Influenza virus
LAQGALLGTN

SEQ ID NO: 503660 - protein, 10 aa, Influenza virus
LAQGALLGTR

SEQ ID NO: 503661 - protein, 10 aa, Influenza virus
LAQGALVGTK

SEQ ID NO: 503662 - protein, 10 aa, Influenza virus
LAQGVLLGTK

SEQ ID NO: 503663 - protein, 10 aa, Influenza virus
LAQGYKDIIL

SEQ ID NO: 503664 - protein, 10 aa, Influenza virus
LARCICEKLE

SEQ ID NO: 503665 - protein, 10 aa, Influenza virus
LARGEKANVL

SEQ ID NO: 503666 - protein, 10 aa, Influenza virus
LARNICEKLE

SEQ ID NO: 503667 - protein, 10 aa, Influenza virus
LARRICEKLE

SEQ ID NO: 503668 - protein, 10 aa, Influenza virus
LARSALILRG

SEQ ID NO: 503669 - protein, 10 aa, Influenza virus
LARSICEKLE

SEQ ID NO: 503670 - protein, 10 aa, Influenza virus
LASCMGLIYN

SEQ ID NO: 503671 - protein, 10 aa, Influenza virus
LASGLRNVPA

SEQ ID NO: 503672 - protein, 10 aa, Influenza virus
LASLLEMCHG

SEQ ID NO: 503673 - protein, 10 aa, Influenza virus
LASLLEMCHS

SEQ ID NO: 503674 - protein, 10 aa, Influenza virus
LASSGSLEFI

SEQ ID NO: 503675 - protein, 10 aa, Influenza virus
LASTNAHDRI

SEQ ID NO: 503676 - protein, 10 aa, Influenza virus
LASTNAYDRI

SEQ ID NO: 503677 - protein, 10 aa, Influenza virus
LASTTAKAME

SEQ ID NO: 503678 - protein, 10 aa, Influenza virus
LATGLKNVPA

SEQ ID NO: 503679 - protein, 10 aa, Influenza virus
LATGLRNAHK

SEQ ID NO: 503680 - protein, 10 aa, Influenza virus
LATGLRNIPA

SEQ ID NO: 503681 - protein, 10 aa, Influenza virus
LATGLRNIPQ

SEQ ID NO: 503682 - protein, 10 aa, Influenza virus
LATGLRNIPS

SEQ ID NO: 503683 - protein, 10 aa, Influenza virus
LATGLRNVPA

SEQ ID NO: 503684 - protein, 10 aa, Influenza virus
LATGLRNVPI

SEQ ID NO: 503685 - protein, 10 aa, Influenza virus
LATGLRNVPK

SEQ ID NO: 503686 - protein, 10 aa, Influenza virus
LATGLRNVPQ

SEQ ID NO: 503687 - protein, 10 aa, Influenza virus
LATGLRNVPS

SEQ ID NO: 503688 - protein, 10 aa, Influenza virus
LATGLRNVPT

SEQ ID NO: 503689 - protein, 10 aa, Influenza virus
LATGMKNVPE

SEQ ID NO: 503690 - protein, 10 aa, Influenza virus
LATGMRNIPE

SEQ ID NO: 503691 - protein, 10 aa, Influenza virus
LATGMRNIPG

SEQ ID NO: 503692 - protein, 10 aa, Influenza virus
LATGMRNVPE

SEQ ID NO: 503693 - protein, 10 aa, Influenza virus
LATGPRNVPA

SEQ ID NO: 503694 - protein, 10 aa, Influenza virus
LATGPRNVPQ

SEQ ID NO: 503695 - protein, 10 aa, Influenza virus
LATRGVQIAS

SEQ ID NO: 503696 - protein, 10 aa, Influenza virus
LATTITLHFK

SEQ ID NO: 503697 - protein, 10 aa, Influenza virus
LATTVTLHFK

SEQ ID NO: 503698 - protein, 10 aa, Influenza virus
LAVGLRNTPS

SEQ ID NO: 503699 - protein, 10 aa, Influenza virus
LAVLIAGGLI

SEQ ID NO: 503700 - protein, 10 aa, Influenza virus
LAVNVRGSGM

SEQ ID NO: 503701 - protein, 10 aa, Influenza virus
LAVTWWNRKG

SEQ ID NO: 503702 - protein, 10 aa, Influenza virus
LAVTWWNRNG

SEQ ID NO: 503703 - protein, 10 aa, Influenza virus
LAVTWWNRSG

SEQ ID NO: 503704 - protein, 10 aa, Influenza virus
LAYCNTDLGT

SEQ ID NO: 503705 - protein, 10 aa, Influenza virus
LAYDKICIGY

SEQ ID NO: 503706 - protein, 10 aa, Influenza virus
LCAGIPSDTP

SEQ ID NO: 503707 - protein, 10 aa, Influenza virus
LCAGIPTDTP

SEQ ID NO: 503708 - protein, 10 aa, Influenza virus
LCAGLPSDTP

SEQ ID NO: 503709 - protein, 10 aa, Influenza virus
LCAVNSWHIL

SEQ ID NO: 503710 - protein, 10 aa, Influenza virus
LCEVNSWHIF

SEQ ID NO: 503711 - protein, 10 aa, Influenza virus
LCEVNSWHIL

SEQ ID NO: 503712 - protein, 10 aa, Influenza virus
LCEVSSWHIL

SEQ ID NO: 503713 - protein, 10 aa, Influenza virus
LCFPGELDNN

SEQ ID NO: 503714 - protein, 10 aa, Influenza virus
LCFPGEVDNN

SEQ ID NO: 503715 - protein, 10 aa, Influenza virus
LCGSKEQLGS

SEQ ID NO: 503716 - protein, 10 aa, Influenza virus
LCGSKERLGS

SEQ ID NO: 503717 - protein, 10 aa, Influenza virus
LCGSKKRLGS

SEQ ID NO: 503718 - protein, 10 aa, Influenza virus
LCGSPFPVGS

SEQ ID NO: 503719 - protein, 10 aa, Influenza virus
LCGSPISVGS

SEQ ID NO: 503720 - protein, 10 aa, Influenza virus
LCGSPVPVGS

SEQ ID NO: 503721 - protein, 10 aa, Influenza virus
LCGSPVSVGS

SEQ ID NO: 503722 - protein, 10 aa, Influenza virus
LCGSRERLGS

SEQ ID NO: 503723 - protein, 10 aa, Influenza virus
LCIGYHANNS

SEQ ID NO: 503724 - protein, 10 aa, Influenza virus
LCKIEGWVVV

SEQ ID NO: 503725 - protein, 10 aa, Influenza virus
LCKLNGIPPL

SEQ ID NO: 503726 - protein, 10 aa, Influenza virus
LCKVEGWVVV

SEQ ID NO: 503727 - protein, 10 aa, Influenza virus
LCLAILIAGG

SEQ ID NO: 503728 - protein, 10 aa, Influenza virus
LCLAILVAGG

SEQ ID NO: 503729 - protein, 10 aa, Influenza virus
LCLAVLIAGG

SEQ ID NO: 503730 - protein, 10 aa, Influenza virus
LCLGHHAVAN

SEQ ID NO: 503731 - protein, 10 aa, Influenza virus
LCLGHHAVPN

SEQ ID NO: 503732 - protein, 10 aa, Influenza virus
LCLGHHAVQN

SEQ ID NO: 503733 - protein, 10 aa, Influenza virus
LCLGHHAVSN

SEQ ID NO: 503734 - protein, 10 aa, Influenza virus
LCNPLNPFVN

SEQ ID NO: 503735 - protein, 10 aa, Influenza virus
LCNPLNPFVS

SEQ ID NO: 503736 - protein, 10 aa, Influenza virus
LCNPLNPFVT

SEQ ID NO: 503737 - protein, 10 aa, Influenza virus
LCNPMNPFVS

SEQ ID NO: 503738 - protein, 10 aa, Influenza virus
LCNVEGWVVI

SEQ ID NO: 503739 - protein, 10 aa, Influenza virus
LCNVEGWVVV

SEQ ID NO: 503740 - protein, 10 aa, Influenza virus
LCPFKGFFPF

SEQ ID NO: 503741 - protein, 10 aa, Influenza virus
LCPFQGFFPF

SEQ ID NO: 503742 - protein, 10 aa, Influenza virus
LCPFRGFFPF

SEQ ID NO: 503743 - protein, 10 aa, Influenza virus
LCPIKGWAPL

SEQ ID NO: 503744 - protein, 10 aa, Influenza virus
LCPIRGWAPL

SEQ ID NO: 503745 - protein, 10 aa, Influenza virus
LCPKPLKLVD

SEQ ID NO: 503746 - protein, 10 aa, Influenza virus
LCPSPLKLID

SEQ ID NO: 503747 - protein, 10 aa, Influenza virus
LCPSPLKLVD

SEQ ID NO: 503748 - protein, 10 aa, Influenza virus
LCPSPLRLID

SEQ ID NO: 503749 - protein, 10 aa, Influenza virus
LCPSPLRLVD

SEQ ID NO: 503750 - protein, 10 aa, Influenza virus
LCPVKGWAPL

SEQ ID NO: 503751 - protein, 10 aa, Influenza virus
LCQVECVCRD

SEQ ID NO: 503752 - protein, 10 aa, Influenza virus
LCRLRGIPPL

SEQ ID NO: 503753 - protein, 10 aa, Influenza virus
LCRLSGIPPL

SEQ ID NO: 503754 - protein, 10 aa, Influenza virus
LCSGLVGDTP

SEQ ID NO: 503755 - protein, 10 aa, Influenza virus
LCSIWFSHYN

SEQ ID NO: 503756 - protein, 10 aa, Influenza virus
LCSKILTDTS

SEQ ID NO: 503757 - protein, 10 aa, Influenza virus
LCSKTLTDTS

SEQ ID NO: 503758 - protein, 10 aa, Influenza virus
LCSKVLTDTS

SEQ ID NO: 503759 - protein, 10 aa, Influenza virus
LCSRILTDTS

SEQ ID NO: 503760 - protein, 10 aa, Influenza virus
LCSRVLTDTS

SEQ ID NO: 503761 - protein, 10 aa, Influenza virus
LCSVEGWVVI

SEQ ID NO: 503762 - protein, 10 aa, Influenza virus
LCSVEYASKT

SEQ ID NO: 503763 - protein, 10 aa, Influenza virus
LCTGILTDTS

SEQ ID NO: 503764 - protein, 10 aa, Influenza virus
LCTGVLTDTS

SEQ ID NO: 503765 - protein, 10 aa, Influenza virus
LCTINSWHIF

SEQ ID NO: 503766 - protein, 10 aa, Influenza virus
LCTINSWHIH

SEQ ID NO: 503767 - protein, 10 aa, Influenza virus
LCTINSWHIY

SEQ ID NO: 503768 - protein, 10 aa, Influenza virus
LCVGWSSTSC

SEQ ID NO: 503769 - protein, 10 aa, Influenza virus
LCYPGELDNN

SEQ ID NO: 503770 - protein, 10 aa, Influenza virus
LCYPGELNNN

SEQ ID NO: 503771 - protein, 10 aa, Influenza virus
LCYPGEVDNN

SEQ ID NO: 503772 - protein, 10 aa, Influenza virus
LCYPGNFNDY

SEQ ID NO: 503773 - protein, 10 aa, Influenza virus
LCYPGSFNDY

SEQ ID NO: 503774 - protein, 10 aa, Influenza virus
LCYPGSFNNY

SEQ ID NO: 503775 - protein, 10 aa, Influenza virus
LCYPGSLNDY

SEQ ID NO: 503776 - protein, 10 aa, Influenza virus
LDDCSLEGII

SEQ ID NO: 503777 - protein, 10 aa, Influenza virus
LDDCSLEGLI

SEQ ID NO: 503778 - protein, 10 aa, Influenza virus
LDDCSLEGLV

SEQ ID NO: 503779 - protein, 10 aa, Influenza virus
LDDCSLKGLI

SEQ ID NO: 503780 - protein, 10 aa, Influenza virus
LDEESRARIK

SEQ ID NO: 503781 - protein, 10 aa, Influenza virus
LDEHDANVRN

SEQ ID NO: 503782 - protein, 10 aa, Influenza virus
LDEHDSNVEN

SEQ ID NO: 503783 - protein, 10 aa, Influenza virus
LDEHDSNVKN

SEQ ID NO: 503784 - protein, 10 aa, Influenza virus
LDEIGEDIAP

SEQ ID NO: 503785 - protein, 10 aa, Influenza virus
LDEIGEDLAP

SEQ ID NO: 503786 - protein, 10 aa, Influenza virus
LDEIGEDVAP

SEQ ID NO: 503787 - protein, 10 aa, Influenza virus
LDEQNKLYGA

SEQ ID NO: 503788 - protein, 10 aa, Influenza virus
LDEQNKLYGT

SEQ ID NO: 503789 - protein, 10 aa, Influenza virus
LDFHDSNVKN

SEQ ID NO: 503790 - protein, 10 aa, Influenza virus
LDFHDSNVKS

SEQ ID NO: 503791 - protein, 10 aa, Influenza virus
LDFHDSNVRN

SEQ ID NO: 503792 - protein, 10 aa, Influenza virus
LDFHDSSVKN

SEQ ID NO: 503793 - protein, 10 aa, Influenza virus
LDGKAPISLG

SEQ ID NO: 503794 - protein, 10 aa, Influenza virus
LDGVTASCLD

SEQ ID NO: 503795 - protein, 10 aa, Influenza virus
LDGVTASCRD

SEQ ID NO: 503796 - protein, 10 aa, Influenza virus
LDIRTATREG

SEQ ID NO: 503797 - protein, 10 aa, Influenza virus
LDIWTYNAEL

SEQ ID NO: 503798 - protein, 10 aa, Influenza virus
LDKHDSNVKN

SEQ ID NO: 503799 - protein, 10 aa, Influenza virus
LDKICLGHHA

SEQ ID NO: 503800 - protein, 10 aa, Influenza virus
LDLHDANVKN

SEQ ID NO: 503801 - protein, 10 aa, Influenza virus
LDLHDANVRN

SEQ ID NO: 503802 - protein, 10 aa, Influenza virus
LDLHDSNVKN

SEQ ID NO: 503803 - protein, 10 aa, Influenza virus
LDLHDSNVRN

SEQ ID NO: 503804 - protein, 10 aa, Influenza virus
LDLHDSNVRS

SEQ ID NO: 503805 - protein, 10 aa, Influenza virus
LDLHDSNVTN

SEQ ID NO: 503806 - protein, 10 aa, Influenza virus
LDLNMGQPFY

SEQ ID NO: 503807 - protein, 10 aa, Influenza virus
LDMHDANVKN

SEQ ID NO: 503808 - protein, 10 aa, Influenza virus
LDMHDANVRN

SEQ ID NO: 503809 - protein, 10 aa, Influenza virus
LDNEPGSGHW

SEQ ID NO: 503810 - protein, 10 aa, Influenza virus
LDNEPGSGNW

SEQ ID NO: 503811 - protein, 10 aa, Influenza virus
LDNKHSNDTI

SEQ ID NO: 503812 - protein, 10 aa, Influenza virus
LDNKHSNDTV

SEQ ID NO: 503813 - protein, 10 aa, Influenza virus
LDNKHSNGTI

SEQ ID NO: 503814 - protein, 10 aa, Influenza virus
LDNLQAYQKR

SEQ ID NO: 503815 - protein, 10 aa, Influenza virus
LDNNGELRHL

SEQ ID NO: 503816 - protein, 10 aa, Influenza virus
LDPGDTVTFT

SEQ ID NO: 503817 - protein, 10 aa, Influenza virus
LDQNFRNIRK

SEQ ID NO: 503818 - protein, 10 aa, Influenza virus
LDRICLGHHA

SEQ ID NO: 503819 - protein, 10 aa, Influenza virus
LDRLRRDQKS

SEQ ID NO: 503820 - protein, 10 aa, Influenza virus
LDTGDGCFEI

SEQ ID NO: 503821 - protein, 10 aa, Influenza virus
LDTINFESTG

SEQ ID NO: 503822 - protein, 10 aa, Influenza virus
LDVWTYNAEI

SEQ ID NO: 503823 - protein, 10 aa, Influenza virus
LDVWTYNAEL

SEQ ID NO: 503824 - protein, 10 aa, Influenza virus
LDVWTYNTEL

SEQ ID NO: 503825 - protein, 10 aa, Influenza virus
LDYHDSNVKN

SEQ ID NO: 503826 - protein, 10 aa, Influenza virus
LDYQIGYICS

SEQ ID NO: 503827 - protein, 10 aa, Influenza virus
LDYQIGYVCS

SEQ ID NO: 503828 - protein, 10 aa, Influenza virus
LEALMEWIKT

SEQ ID NO: 503829 - protein, 10 aa, Influenza virus
LEALMEWLKT

SEQ ID NO: 503830 - protein, 10 aa, Influenza virus
LEAMAFLEDS

SEQ ID NO: 503831 - protein, 10 aa, Influenza virus
LEAMAFLEES

SEQ ID NO: 503832 - protein, 10 aa, Influenza virus
LEAMAFLEKS

SEQ ID NO: 503833 - protein, 10 aa, Influenza virus
LEAMAFLENS

SEQ ID NO: 503834 - protein, 10 aa, Influenza virus
LEAMALLEES

SEQ ID NO: 503835 - protein, 10 aa, Influenza virus
LECKTFFLTQ

SEQ ID NO: 503836 - protein, 10 aa, Influenza virus
LECRTFFLTH

SEQ ID NO: 503837 - protein, 10 aa, Influenza virus
LECRTFFLTQ

SEQ ID NO: 503838 - protein, 10 aa, Influenza virus
LEDEQMYQKC

SEQ ID NO: 503839 - protein, 10 aa, Influenza virus
LEDEQMYQRC

SEQ ID NO: 503840 - protein, 10 aa, Influenza virus
LEECSCYMDI

SEQ ID NO: 503841 - protein, 10 aa, Influenza virus
LEECSCYVDI

SEQ ID NO: 503842 - protein, 10 aa, Influenza virus
LEECSCYVDT

SEQ ID NO: 503843 - protein, 10 aa, Influenza virus
LEECSCYVDV

SEQ ID NO: 503844 - protein, 10 aa, Influenza virus
LEEESDEALK

SEQ ID NO: 503845 - protein, 10 aa, Influenza virus
LEEHPNAGKD

SEQ ID NO: 503846 - protein, 10 aa, Influenza virus
LEEHPSAGKD

SEQ ID NO: 503847 - protein, 10 aa, Influenza virus
LEEHPSAGRD

SEQ ID NO: 503848 - protein, 10 aa, Influenza virus
LEEHPSTGKD

SEQ ID NO: 503849 - protein, 10 aa, Influenza virus
LEELRFVFSI

SEQ ID NO: 503850 - protein, 10 aa, Influenza virus
LEELRFVFSN

SEQ ID NO: 503851 - protein, 10 aa, Influenza virus
LEELRFVFSS

SEQ ID NO: 503852 - protein, 10 aa, Influenza virus
LEENPSAGKD

SEQ ID NO: 503853 - protein, 10 aa, Influenza virus
LEENSTYKIL

SEQ ID NO: 503854 - protein, 10 aa, Influenza virus
LEENTSYKIL

SEQ ID NO: 503855 - protein, 10 aa, Influenza virus
LEENTTYKIL

SEQ ID NO: 503856 - protein, 10 aa, Influenza virus
LEENTTYRIL

SEQ ID NO: 503857 - protein, 10 aa, Influenza virus
LEESHPGIFE

SEQ ID NO: 503858 - protein, 10 aa, Influenza virus
LEESHPGIFG

SEQ ID NO: 503859 - protein, 10 aa, Influenza virus
LEESHPGLFE

SEQ ID NO: 503860 - protein, 10 aa, Influenza virus
LEFEPFQSLV

SEQ ID NO: 503861 - protein, 10 aa, Influenza virus
LEFIAEQFTW

SEQ ID NO: 503862 - protein, 10 aa, Influenza virus
LEFKADLIIE

SEQ ID NO: 503863 - protein, 10 aa, Influenza virus
LEGFSAESRK

SEQ ID NO: 503864 - protein, 10 aa, Influenza virus
LEGIILGNPK

SEQ ID NO: 503865 - protein, 10 aa, Influenza virus
LEGLILGNPK

SEQ ID NO: 503866 - protein, 10 aa, Influenza virus
LEGLILSNPK

SEQ ID NO: 503867 - protein, 10 aa, Influenza virus
LEGLVLGNPK

SEQ ID NO: 503868 - protein, 10 aa, Influenza virus
LEGTTASCQN

SEQ ID NO: 503869 - protein, 10 aa, Influenza virus
LEHTSKYVCT

SEQ ID NO: 503870 - protein, 10 aa, Influenza virus
LEHTSRYICT

SEQ ID NO: 503871 - protein, 10 aa, Influenza virus
LEHTSRYVCT

SEQ ID NO: 503872 - protein, 10 aa, Influenza virus
LEICFMYSDF

SEQ ID NO: 503873 - protein, 10 aa, Influenza virus
LEIGARIGEG

SEQ ID NO: 503874 - protein, 10 aa, Influenza virus
LEIGTRIGDG

SEQ ID NO: 503875 - protein, 10 aa, Influenza virus
LEKAHNGKLC

SEQ ID NO: 503876 - protein, 10 aa, Influenza virus
LEKNITVTHS

SEQ ID NO: 503877 - protein, 10 aa, Influenza virus
LEKNVTVTHA

SEQ ID NO: 503878 - protein, 10 aa, Influenza virus
LEKNVTVTHS

SEQ ID NO: 503879 - protein, 10 aa, Influenza virus
LEKRIENLNK

SEQ ID NO: 503880 - protein, 10 aa, Influenza virus
LEKRLENLNK

SEQ ID NO: 503881 - protein, 10 aa, Influenza virus
LEKRLGNLNK

SEQ ID NO: 503882 - protein, 10 aa, Influenza virus
LEKSHPGIFE

SEQ ID NO: 503883 - protein, 10 aa, Influenza virus
LEKSRINGVK

SEQ ID NO: 503884 - protein, 10 aa, Influenza virus
LEKTHNGKLC

SEQ ID NO: 503885 - protein, 10 aa, Influenza virus
LEKTHNGRLC

SEQ ID NO: 503886 - protein, 10 aa, Influenza virus
LEKVHNGKLC

SEQ ID NO: 503887 - protein, 10 aa, Influenza virus
LEKYVEDTKI

SEQ ID NO: 503888 - protein, 10 aa, Influenza virus
LEKYVEDTKV

SEQ ID NO: 503889 - protein, 10 aa, Influenza virus
LELGDCSIAG

SEQ ID NO: 503890 - protein, 10 aa, Influenza virus
LELGDCSITG

SEQ ID NO: 503891 - protein, 10 aa, Influenza virus
LELIRMIKRG

SEQ ID NO: 503892 - protein, 10 aa, Influenza virus
LELRDCKIEA

SEQ ID NO: 503893 - protein, 10 aa, Influenza virus
LELRDCKVEA

SEQ ID NO: 503894 - protein, 10 aa, Influenza virus
LELRDCSIAG

SEQ ID NO: 503895 - protein, 10 aa, Influenza virus
LELRSGYWAI

SEQ ID NO: 503896 - protein, 10 aa, Influenza virus
LELRSKYWAI

SEQ ID NO: 503897 - protein, 10 aa, Influenza virus
LELRSRYWAI

SEQ ID NO: 503898 - protein, 10 aa, Influenza virus
LEMCHGTQIG

SEQ ID NO: 503899 - protein, 10 aa, Influenza virus
LEMCHSTQIG

SEQ ID NO: 503900 - protein, 10 aa, Influenza virus
LEMCHSTQVG

SEQ ID NO: 503901 - protein, 10 aa, Influenza virus
LEMCHSTRIG

SEQ ID NO: 503902 - protein, 10 aa, Influenza virus
LEMIRGKPEE

SEQ ID NO: 503903 - protein, 10 aa, Influenza virus
LEMIRGKPKE

SEQ ID NO: 503904 - protein, 10 aa, Influenza virus
LEMIRGRPEE

SEQ ID NO: 503905 - protein, 10 aa, Influenza virus
LENDKTLDLH

SEQ ID NO: 503906 - protein, 10 aa, Influenza virus
LENDKTLDMH

SEQ ID NO: 503907 - protein, 10 aa, Influenza virus
LENDKTLNMH

SEQ ID NO: 503908 - protein, 10 aa, Influenza virus
LENDRTLDLH

SEQ ID NO: 503909 - protein, 10 aa, Influenza virus
LENDVPVTSS

SEQ ID NO: 503910 - protein, 10 aa, Influenza virus
LENEKTLDLH

SEQ ID NO: 503911 - protein, 10 aa, Influenza virus
LENERTLDFH

SEQ ID NO: 503912 - protein, 10 aa, Influenza virus
LENERTLDLH

SEQ ID NO: 503913 - protein, 10 aa, Influenza virus
LENERTLDYH

SEQ ID NO: 503914 - protein, 10 aa, Influenza virus
LENGRTLDLH

SEQ ID NO: 503915 - protein, 10 aa, Influenza virus
LENGRTLGLH

SEQ ID NO: 503916 - protein, 10 aa, Influenza virus
LENGVPVTSS

SEQ ID NO: 503917 - protein, 10 aa, Influenza virus
LENGVPVTST

SEQ ID NO: 503918 - protein, 10 aa, Influenza virus
LENKHSNGTK

SEQ ID NO: 503919 - protein, 10 aa, Influenza virus
LENLDKKMED

SEQ ID NO: 503920 - protein, 10 aa, Influenza virus
LENLNKKMED

SEQ ID NO: 503921 - protein, 10 aa, Influenza virus
LENLNKKVED

SEQ ID NO: 503922 - protein, 10 aa, Influenza virus
LENLQAYQKR

SEQ ID NO: 503923 - protein, 10 aa, Influenza virus
LENLQTYQKR

SEQ ID NO: 503924 - protein, 10 aa, Influenza virus
LENLSKRMED

SEQ ID NO: 503925 - protein, 10 aa, Influenza virus
LENNVPVTSS

SEQ ID NO: 503926 - protein, 10 aa, Influenza virus
LENQHTIDLA

SEQ ID NO: 503927 - protein, 10 aa, Influenza virus
LENQHTIDLT

SEQ ID NO: 503928 - protein, 10 aa, Influenza virus
LENQHTIDMT

SEQ ID NO: 503929 - protein, 10 aa, Influenza virus
LENQHTIDVT

SEQ ID NO: 503930 - protein, 10 aa, Influenza virus
LENQHTIHLT

SEQ ID NO: 503931 - protein, 10 aa, Influenza virus
LENQKILDEH

SEQ ID NO: 503932 - protein, 10 aa, Influenza virus
LENQKPLDEH

SEQ ID NO: 503933 - protein, 10 aa, Influenza virus
LENQKTLDEH

SEQ ID NO: 503934 - protein, 10 aa, Influenza virus
LENQKTLDKH

SEQ ID NO: 503935 - protein, 10 aa, Influenza virus
LENQNTIDLT

SEQ ID NO: 503936 - protein, 10 aa, Influenza virus
LENSHPGIFE

SEQ ID NO: 503937 - protein, 10 aa, Influenza virus
LENYVEDTKI

SEQ ID NO: 503938 - protein, 10 aa, Influenza virus
LEPGTFDIEG

SEQ ID NO: 503939 - protein, 10 aa, Influenza virus
LEPGTFDIGG

SEQ ID NO: 503940 - protein, 10 aa, Influenza virus
LEPGTFDLEG

SEQ ID NO: 503941 - protein, 10 aa, Influenza virus
LEPGTFDLGG

SEQ ID NO: 503942 - protein, 10 aa, Influenza virus
LEQNVTVTHA

SEQ ID NO: 503943 - protein, 10 aa, Influenza virus
LEQSGLPVGG

SEQ ID NO: 503944 - protein, 10 aa, Influenza virus
LERELVRKTR

SEQ ID NO: 503945 - protein, 10 aa, Influenza virus
LERNVTVTHA

SEQ ID NO: 503946 - protein, 10 aa, Influenza virus
LERNVTVTHS

SEQ ID NO: 503947 - protein, 10 aa, Influenza virus
LERRIENLNK

SEQ ID NO: 503948 - protein, 10 aa, Influenza virus
LERRIENLNR

SEQ ID NO: 503949 - protein, 10 aa, Influenza virus
LERRIESLNK

SEQ ID NO: 503950 - protein, 10 aa, Influenza virus
LERRLENLNK

SEQ ID NO: 503951 - protein, 10 aa, Influenza virus
LERRLENLSK

SEQ ID NO: 503952 - protein, 10 aa, Influenza virus
LERSKINEVK

SEQ ID NO: 503953 - protein, 10 aa, Influenza virus
LERSKINGVI

SEQ ID NO: 503954 - protein, 10 aa, Influenza virus
LERSKINGVK

SEQ ID NO: 503955 - protein, 10 aa, Influenza virus
LERSKINGVR

SEQ ID NO: 503956 - protein, 10 aa, Influenza virus
LERTHNGKLC

SEQ ID NO: 503957 - protein, 10 aa, Influenza virus
LERYVEDTKI

SEQ ID NO: 503958 - protein, 10 aa, Influenza virus
LESDVPVTSS

SEQ ID NO: 503959 - protein, 10 aa, Influenza virus
LESRSGFEMI

SEQ ID NO: 503960 - protein, 10 aa, Influenza virus
LESRSGFEMV

SEQ ID NO: 503961 - protein, 10 aa, Influenza virus
LETGYICSKF

SEQ ID NO: 503962 - protein, 10 aa, Influenza virus
LETGYVCGKF

SEQ ID NO: 503963 - protein, 10 aa, Influenza virus
LETGYVCSKF

SEQ ID NO: 503964 - protein, 10 aa, Influenza virus
LEVCFMYSDF

SEQ ID NO: 503965 - protein, 10 aa, Influenza virus
LEVGTRWMKI

SEQ ID NO: 503966 - protein, 10 aa, Influenza virus
LFALSGMAIA

SEQ ID NO: 503967 - protein, 10 aa, Influenza virus
LFALSGVAIA

SEQ ID NO: 503968 - protein, 10 aa, Influenza virus
LFALSGVAIT

SEQ ID NO: 503969 - protein, 10 aa, Influenza virus
LFALSGVAVA

SEQ ID NO: 503970 - protein, 10 aa, Influenza virus
LFASSGIAIA

SEQ ID NO: 503971 - protein, 10 aa, Influenza virus
LFASSGIAIV

SEQ ID NO: 503972 - protein, 10 aa, Influenza virus
LFDEVKRRLS

SEQ ID NO: 503973 - protein, 10 aa, Influenza virus
LFDEVRRRLS

SEQ ID NO: 503974 - protein, 10 aa, Influenza virus
LFDYSGWNVT

SEQ ID NO: 503975 - protein, 10 aa, Influenza virus
LFDYSKWNVS

SEQ ID NO: 503976 - protein, 10 aa, Influenza virus
LFDYSKWNVT

SEQ ID NO: 503977 - protein, 10 aa, Influenza virus
LFDYSRWNVT

SEQ ID NO: 503978 - protein, 10 aa, Influenza virus
LFEKFFPSSS

SEQ ID NO: 503979 - protein, 10 aa, Influenza virus
LFERVKRQLR

SEQ ID NO: 503980 - protein, 10 aa, Influenza virus
LFERVRHQLR

SEQ ID NO: 503981 - protein, 10 aa, Influenza virus
LFERVRRQLR

SEQ ID NO: 503982 - protein, 10 aa, Influenza virus
LFFFCLKNGN

SEQ ID NO: 503983 - protein, 10 aa, Influenza virus
LFFWMCSNGS

SEQ ID NO: 503984 - protein, 10 aa, Influenza virus
LFGAIAGFIE

SEQ ID NO: 503985 - protein, 10 aa, Influenza virus
LFGAKAGFIE

SEQ ID NO: 503986 - protein, 10 aa, Influenza virus
LFHKCDDDCM

SEQ ID NO: 503987 - protein, 10 aa, Influenza virus
LFIKDYRYTY

SEQ ID NO: 503988 - protein, 10 aa, Influenza virus
LFLAFILWAC

SEQ ID NO: 503989 - protein, 10 aa, Influenza virus
LFLVCVSLLQ

SEQ ID NO: 503990 - protein, 10 aa, Influenza virus
LFLWMCSNGS

SEQ ID NO: 503991 - protein, 10 aa, Influenza virus
LFLYVRTNGT

SEQ ID NO: 503992 - protein, 10 aa, Influenza virus
LFMIIGGFIF

SEQ ID NO: 503993 - protein, 10 aa, Influenza virus
LFNTIGNLIA

SEQ ID NO: 503994 - protein, 10 aa, Influenza virus
LFQDILMRMS

SEQ ID NO: 503995 - protein, 10 aa, Influenza virus
LFQGGHIEEC

SEQ ID NO: 503996 - protein, 10 aa, Influenza virus
LFQQMRDILG

SEQ ID NO: 503997 - protein, 10 aa, Influenza virus
LFQQMRDVLG

SEQ ID NO: 503998 - protein, 10 aa, Influenza virus
LFSGIKSFSR

SEQ ID NO: 503999 - protein, 10 aa, Influenza virus
LFSGIRSFSR

SEQ ID NO: 504000 - protein, 10 aa, Influenza virus
LFSGVNSFSR

SEQ ID NO: 504001 - protein, 10 aa, Influenza virus
LFSSIKKYER

SEQ ID NO: 504002 - protein, 10 aa, Influenza virus
LFSSIKRYER

SEQ ID NO: 504003 - protein, 10 aa, Influenza virus
LFTIRQELAS

SEQ ID NO: 504004 - protein, 10 aa, Influenza virus
LFTIRQEMAG

SEQ ID NO: 504005 - protein, 10 aa, Influenza virus
LFTIRQEMAI

SEQ ID NO: 504006 - protein, 10 aa, Influenza virus
LFTIRQEMAN

SEQ ID NO: 504007 - protein, 10 aa, Influenza virus
LFTIRQEMAS

SEQ ID NO: 504008 - protein, 10 aa, Influenza virus
LFTLSGVAIA

SEQ ID NO: 504009 - protein, 10 aa, Influenza virus
LFVLMENERT

SEQ ID NO: 504010 - protein, 10 aa, Influenza virus
LFVQSYFQLF

SEQ ID NO: 504011 - protein, 10 aa, Influenza virus
LGAIAGFIEG

SEQ ID NO: 504012 - protein, 10 aa, Influenza virus
LGAINTTLPF

SEQ ID NO: 504013 - protein, 10 aa, Influenza virus
LGAISFWMCS

SEQ ID NO: 504014 - protein, 10 aa, Influenza virus
LGALNTTLPF

SEQ ID NO: 504015 - protein, 10 aa, Influenza virus
LGAPLELRDC

SEQ ID NO: 504016 - protein, 10 aa, Influenza virus
LGAPLVLDDC

SEQ ID NO: 504017 - protein, 10 aa, Influenza virus
LGAVSFWMCS

SEQ ID NO: 504018 - protein, 10 aa, Influenza virus
LGCKMYALHQ

SEQ ID NO: 504019 - protein, 10 aa, Influenza virus
LGCKTYALHQ

SEQ ID NO: 504020 - protein, 10 aa, Influenza virus
LGCRMYALHQ

SEQ ID NO: 504021 - protein, 10 aa, Influenza virus
LGDAPFLDRL

SEQ ID NO: 504022 - protein, 10 aa, Influenza virus
LGDCNFEGWI

SEQ ID NO: 504023 - protein, 10 aa, Influenza virus
LGDCPKYIKS

SEQ ID NO: 504024 - protein, 10 aa, Influenza virus
LGDCRFEGWI

SEQ ID NO: 504025 - protein, 10 aa, Influenza virus
LGDCSFAGWI

SEQ ID NO: 504026 - protein, 10 aa, Influenza virus
LGDCSFEGWI

SEQ ID NO: 504027 - protein, 10 aa, Influenza virus
LGDCSFTGWI

SEQ ID NO: 504028 - protein, 10 aa, Influenza virus
LGDCSIAGWL

SEQ ID NO: 504029 - protein, 10 aa, Influenza virus
LGDCSVAGWL

SEQ ID NO: 504030 - protein, 10 aa, Influenza virus
LGEAPSPYNS

SEQ ID NO: 504031 - protein, 10 aa, Influenza virus
LGECPKYIKS

SEQ ID NO: 504032 - protein, 10 aa, Influenza virus
LGENIAPEKV

SEQ ID NO: 504033 - protein, 10 aa, Influenza virus
LGENMAPEKI

SEQ ID NO: 504034 - protein, 10 aa, Influenza virus
LGENMAPEKM

SEQ ID NO: 504035 - protein, 10 aa, Influenza virus
LGENMAPEKV

SEQ ID NO: 504036 - protein, 10 aa, Influenza virus
LGFIMWACQK

SEQ ID NO: 504037 - protein, 10 aa, Influenza virus
LGFIMWACQR

SEQ ID NO: 504038 - protein, 10 aa, Influenza virus
LGFIMWTCQK

SEQ ID NO: 504039 - protein, 10 aa, Influenza virus
LGFIVWACQR

SEQ ID NO: 504040 - protein, 10 aa, Influenza virus
LGFVFTLTVP

SEQ ID NO: 504041 - protein, 10 aa, Influenza virus
LGFVLWACQN

SEQ ID NO: 504042 - protein, 10 aa, Influenza virus
LGFVMWACQK

SEQ ID NO: 504043 - protein, 10 aa, Influenza virus
LGGCSFAGWI

SEQ ID NO: 504044 - protein, 10 aa, Influenza virus
LGGTISPRSR

SEQ ID NO: 504045 - protein, 10 aa, Influenza virus
LGHHAIPNGT

SEQ ID NO: 504046 - protein, 10 aa, Influenza virus
LGHHAVANGT

SEQ ID NO: 504047 - protein, 10 aa, Influenza virus
LGHHAVENGT

SEQ ID NO: 504048 - protein, 10 aa, Influenza virus
LGHHAVPNGT

SEQ ID NO: 504049 - protein, 10 aa, Influenza virus
LGHHAVQNGT

SEQ ID NO: 504050 - protein, 10 aa, Influenza virus
LGHHAVSNGT

SEQ ID NO: 504051 - protein, 10 aa, Influenza virus
LGHHAVTNGT

SEQ ID NO: 504052 - protein, 10 aa, Influenza virus
LGIINLLIGI

SEQ ID NO: 504053 - protein, 10 aa, Influenza virus
LGIITGPPQC

SEQ ID NO: 504054 - protein, 10 aa, Influenza virus
LGILTGPPQC

SEQ ID NO: 504055 - protein, 10 aa, Influenza virus
LGINMSKKKS

SEQ ID NO: 504056 - protein, 10 aa, Influenza virus
LGIPFHLGTK

SEQ ID NO: 504057 - protein, 10 aa, Influenza virus
LGIQSDAQID

SEQ ID NO: 504058 - protein, 10 aa, Influenza virus
LGITGPDATA

SEQ ID NO: 504059 - protein, 10 aa, Influenza virus
LGITGPDSTA

SEQ ID NO: 504060 - protein, 10 aa, Influenza virus
LGITGPDTTA

SEQ ID NO: 504061 - protein, 10 aa, Influenza virus
LGKCPRYVKQ

SEQ ID NO: 504062 - protein, 10 aa, Influenza virus
LGKGYMFESK

SEQ ID NO: 504063 - protein, 10 aa, Influenza virus
LGKVECVCRD

SEQ ID NO: 504064 - protein, 10 aa, Influenza virus
LGLDIRTATR

SEQ ID NO: 504065 - protein, 10 aa, Influenza virus
LGLHDANVRN

SEQ ID NO: 504066 - protein, 10 aa, Influenza virus
LGLNIGLHLK

SEQ ID NO: 504067 - protein, 10 aa, Influenza virus
LGLNIGLHLR

SEQ ID NO: 504068 - protein, 10 aa, Influenza virus
LGLNVGLHLK

SEQ ID NO: 504069 - protein, 10 aa, Influenza virus
LGLRISSSFS

SEQ ID NO: 504070 - protein, 10 aa, Influenza virus
LGLRNTPSIE

SEQ ID NO: 504071 - protein, 10 aa, Influenza virus
LGLSMVKSDK

SEQ ID NO: 504072 - protein, 10 aa, Influenza virus
LGLSMVRSDK

SEQ ID NO: 504073 - protein, 10 aa, Influenza virus
LGLVCATCEQ

SEQ ID NO: 504074 - protein, 10 aa, Influenza virus
LGMKNVPEKI

SEQ ID NO: 504075 - protein, 10 aa, Influenza virus
LGMQNGSCRC

SEQ ID NO: 504076 - protein, 10 aa, Influenza virus
LGMQNGSYRC

SEQ ID NO: 504077 - protein, 10 aa, Influenza virus
LGNCPKYIKS

SEQ ID NO: 504078 - protein, 10 aa, Influenza virus
LGNCSIAGWL

SEQ ID NO: 504079 - protein, 10 aa, Influenza virus
LGNGCFEFWH

SEQ ID NO: 504080 - protein, 10 aa, Influenza virus
LGNGCFEFYH

SEQ ID NO: 504081 - protein, 10 aa, Influenza virus
LGNILLSPEE

SEQ ID NO: 504082 - protein, 10 aa, Influenza virus
LGNLNKKMED

SEQ ID NO: 504083 - protein, 10 aa, Influenza virus
LGNPECDILL

SEQ ID NO: 504084 - protein, 10 aa, Influenza virus
LGNPECDLFL

SEQ ID NO: 504085 - protein, 10 aa, Influenza virus
LGNPECDLLL

SEQ ID NO: 504086 - protein, 10 aa, Influenza virus
LGNPECDRLL

SEQ ID NO: 504087 - protein, 10 aa, Influenza virus
LGNPKCDLYL

SEQ ID NO: 504088 - protein, 10 aa, Influenza virus
LGNPKCDPYL

SEQ ID NO: 504089 - protein, 10 aa, Influenza virus
LGNPKCDRLL

SEQ ID NO: 504090 - protein, 10 aa, Influenza virus
LGNPMCDDLI

SEQ ID NO: 504091 - protein, 10 aa, Influenza virus
LGNPMCDELI

SEQ ID NO: 504092 - protein, 10 aa, Influenza virus
LGNPMCDNLI

SEQ ID NO: 504093 - protein, 10 aa, Influenza virus
LGNPMCDYLI

SEQ ID NO: 504094 - protein, 10 aa, Influenza virus
LGNPRCDDLI

SEQ ID NO: 504095 - protein, 10 aa, Influenza virus
LGNQKTLDEH

SEQ ID NO: 504096 - protein, 10 aa, Influenza virus
LGNVINWTRD

SEQ ID NO: 504097 - protein, 10 aa, Influenza virus
LGNYKEICIA

SEQ ID NO: 504098 - protein, 10 aa, Influenza virus
LGNYKEICVA

SEQ ID NO: 504099 - protein, 10 aa, Influenza virus
LGNYKEIRIA

SEQ ID NO: 504100 - protein, 10 aa, Influenza virus
LGNYKEMCAA

SEQ ID NO: 504101 - protein, 10 aa, Influenza virus
LGNYREICIA

SEQ ID NO: 504102 - protein, 10 aa, Influenza virus
LGPATAQMAL

SEQ ID NO: 504103 - protein, 10 aa, Influenza virus
LGQFPVQTDE

SEQ ID NO: 504104 - protein, 10 aa, Influenza virus
LGQGTTLDNE

SEQ ID NO: 504105 - protein, 10 aa, Influenza virus
LGQGTTLDNK

SEQ ID NO: 504106 - protein, 10 aa, Influenza virus
LGQGTTLENK

SEQ ID NO: 504107 - protein, 10 aa, Influenza virus
LGQGTTLNNK

SEQ ID NO: 504108 - protein, 10 aa, Influenza virus
LGQGTTLYNK

SEQ ID NO: 504109 - protein, 10 aa, Influenza virus
LGQVECVCRD

SEQ ID NO: 504110 - protein, 10 aa, Influenza virus
LGQWDWPDGA

SEQ ID NO: 504111 - protein, 10 aa, Influenza virus
LGQWNWPDGA

SEQ ID NO: 504112 - protein, 10 aa, Influenza virus
LGRGYMFESK

SEQ ID NO: 504113 - protein, 10 aa, Influenza virus
LGRTFSPRSR

SEQ ID NO: 504114 - protein, 10 aa, Influenza virus
LGRTINTASR

SEQ ID NO: 504115 - protein, 10 aa, Influenza virus
LGRTISIASR

SEQ ID NO: 504116 - protein, 10 aa, Influenza virus
LGRTISKDLR

SEQ ID NO: 504117 - protein, 10 aa, Influenza virus
LGRTISKDSR

SEQ ID NO: 504118 - protein, 10 aa, Influenza virus
LGRTISKDTR

SEQ ID NO: 504119 - protein, 10 aa, Influenza virus
LGRTISPKLR

SEQ ID NO: 504120 - protein, 10 aa, Influenza virus
LGRTISPRLR

SEQ ID NO: 504121 - protein, 10 aa, Influenza virus
LGRTISPRSR

SEQ ID NO: 504122 - protein, 10 aa, Influenza virus
LGRTISTASR

SEQ ID NO: 504123 - protein, 10 aa, Influenza virus
LGRTISTRSR

SEQ ID NO: 504124 - protein, 10 aa, Influenza virus
LGRTLNTASR

SEQ ID NO: 504125 - protein, 10 aa, Influenza virus
LGRTTSKDSR

SEQ ID NO: 504126 - protein, 10 aa, Influenza virus
LGRTVSINGR

SEQ ID NO: 504127 - protein, 10 aa, Influenza virus
LGRTVSISGR

SEQ ID NO: 504128 - protein, 10 aa, Influenza virus
LGRTVSNSGR

SEQ ID NO: 504129 - protein, 10 aa, Influenza virus
LGRTVSTSGR

SEQ ID NO: 504130 - protein, 10 aa, Influenza virus
LGSAQHVEEC

SEQ ID NO: 504131 - protein, 10 aa, Influenza virus
LGSCGILGTI

SEQ ID NO: 504132 - protein, 10 aa, Influenza virus
LGSPGCDRLQ

SEQ ID NO: 504133 - protein, 10 aa, Influenza virus
LGSPLELRDC

SEQ ID NO: 504134 - protein, 10 aa, Influenza virus
LGSPLVLDDC

SEQ ID NO: 504135 - protein, 10 aa, Influenza virus
LGSPPIVSNS

SEQ ID NO: 504136 - protein, 10 aa, Influenza virus
LGSPPMVSNS

SEQ ID NO: 504137 - protein, 10 aa, Influenza virus
LGSPPVVSNS

SEQ ID NO: 504138 - protein, 10 aa, Influenza virus
LGSSFYAEMK

SEQ ID NO: 504139 - protein, 10 aa, Influenza virus
LGSSPNAYQA

SEQ ID NO: 504140 - protein, 10 aa, Influenza virus
LGSSSNAYQA

SEQ ID NO: 504141 - protein, 10 aa, Influenza virus
LGSWSWHDGA

SEQ ID NO: 504142 - protein, 10 aa, Influenza virus
LGTIIGPPQC

SEQ ID NO: 504143 - protein, 10 aa, Influenza virus
LGTITGPPQC

SEQ ID NO: 504144 - protein, 10 aa, Influenza virus
LGTKQVCAAW

SEQ ID NO: 504145 - protein, 10 aa, Influenza virus
LGTKQVCIAW

SEQ ID NO: 504146 - protein, 10 aa, Influenza virus
LGTKQVCMAW

SEQ ID NO: 504147 - protein, 10 aa, Influenza virus
LGTKQVCVAW

SEQ ID NO: 504148 - protein, 10 aa, Influenza virus
LGTLIGPPQC

SEQ ID NO: 504149 - protein, 10 aa, Influenza virus
LGTPLELRDC

SEQ ID NO: 504150 - protein, 10 aa, Influenza virus
LGTPPTVSNS

SEQ ID NO: 504151 - protein, 10 aa, Influenza virus
LGTRQVCIAW

SEQ ID NO: 504152 - protein, 10 aa, Influenza virus
LGTRQVCMAW

SEQ ID NO: 504153 - protein, 10 aa, Influenza virus
LGTRQVCVAW

SEQ ID NO: 504154 - protein, 10 aa, Influenza virus
LGTVTGPPQC

SEQ ID NO: 504155 - protein, 10 aa, Influenza virus
LGVPFHLATK

SEQ ID NO: 504156 - protein, 10 aa, Influenza virus
LGVPFHLGTK

SEQ ID NO: 504157 - protein, 10 aa, Influenza virus
LGVPFHLGTR

SEQ ID NO: 504158 - protein, 10 aa, Influenza virus
LGVPFYLGTK

SEQ ID NO: 504159 - protein, 10 aa, Influenza virus
LGVPFYLGTR

SEQ ID NO: 504160 - protein, 10 aa, Influenza virus
LGVSFHLGTK

SEQ ID NO: 504161 - protein, 10 aa, Influenza virus
LGVSILNLGQ

SEQ ID NO: 504162 - protein, 10 aa, Influenza virus
LGVSVLNLGQ

SEQ ID NO: 504163 - protein, 10 aa, Influenza virus
LGVWTYNAEL

SEQ ID NO: 504164 - protein, 10 aa, Influenza virus
LGYGVKGFGF

SEQ ID NO: 504165 - protein, 10 aa, Influenza virus
LGYICSGVFG

SEQ ID NO: 504166 - protein, 10 aa, Influenza virus
LGYSTGALAS

SEQ ID NO: 504167 - protein, 10 aa, Influenza virus
LHAYISFRNL

SEQ ID NO: 504168 - protein, 10 aa, Influenza virus
LHDANVKNLH

SEQ ID NO: 504169 - protein, 10 aa, Influenza virus
LHDANVRNLH

SEQ ID NO: 504170 - protein, 10 aa, Influenza virus
LHDSNVKNLY

SEQ ID NO: 504171 - protein, 10 aa, Influenza virus
LHDSNVRNLH

SEQ ID NO: 504172 - protein, 10 aa, Influenza virus
LHDSNVRSLH

SEQ ID NO: 504173 - protein, 10 aa, Influenza virus
LHDSNVTNLH

SEQ ID NO: 504174 - protein, 10 aa, Influenza virus
LHERVRKQLR

SEQ ID NO: 504175 - protein, 10 aa, Influenza virus
LHICVTGDDR

SEQ ID NO: 504176 - protein, 10 aa, Influenza virus
LHIPEAGLKW

SEQ ID NO: 504177 - protein, 10 aa, Influenza virus
LHIPEVCLKW

SEQ ID NO: 504178 - protein, 10 aa, Influenza virus
LHKCDNECME

SEQ ID NO: 504179 - protein, 10 aa, Influenza virus
LHKCDNKCME

SEQ ID NO: 504180 - protein, 10 aa, Influenza virus
LHKCNDSCMD

SEQ ID NO: 504181 - protein, 10 aa, Influenza virus
LHKCNDSCME

SEQ ID NO: 504182 - protein, 10 aa, Influenza virus
LHKCNNECME

SEQ ID NO: 504183 - protein, 10 aa, Influenza virus
LHKCNNSCME

SEQ ID NO: 504184 - protein, 10 aa, Influenza virus
LHKCNNTCME

SEQ ID NO: 504185 - protein, 10 aa, Influenza virus
LHLEFKADLI

SEQ ID NO: 504186 - protein, 10 aa, Influenza virus
LHLTGKWDTL

SEQ ID NO: 504187 - protein, 10 aa, Influenza virus
LHLTGMWDTL

SEQ ID NO: 504188 - protein, 10 aa, Influenza virus
LHLTGTWDTL

SEQ ID NO: 504189 - protein, 10 aa, Influenza virus
LHLTQGACWE

SEQ ID NO: 504190 - protein, 10 aa, Influenza virus
LHLTQGTCWE

SEQ ID NO: 504191 - protein, 10 aa, Influenza virus
LHNIHPLTIG

SEQ ID NO: 504192 - protein, 10 aa, Influenza virus
LHQGTTIRNK

SEQ ID NO: 504193 - protein, 10 aa, Influenza virus
LHQGTTIRNR

SEQ ID NO: 504194 - protein, 10 aa, Influenza virus
LHVCITGDDR

SEQ ID NO: 504195 - protein, 10 aa, Influenza virus
LHVCVTGDDG

SEQ ID NO: 504196 - protein, 10 aa, Influenza virus
LHVCVTGDDK

SEQ ID NO: 504197 - protein, 10 aa, Influenza virus
LHVCVTGDDR

SEQ ID NO: 504198 - protein, 10 aa, Influenza virus
LIAFVLWACQ

SEQ ID NO: 504199 - protein, 10 aa, Influenza virus
LIAGGLILGM

SEQ ID NO: 504200 - protein, 10 aa, Influenza virus
LIAGWYGFQH

SEQ ID NO: 504201 - protein, 10 aa, Influenza virus
LIALCGSPFP

SEQ ID NO: 504202 - protein, 10 aa, Influenza virus
LIALCGSPFS

SEQ ID NO: 504203 - protein, 10 aa, Influenza virus
LIAMENQHTI

SEQ ID NO: 504204 - protein, 10 aa, Influenza virus
LIAPDRVSKL

SEQ ID NO: 504205 - protein, 10 aa, Influenza virus
LIAPEFGYLL

SEQ ID NO: 504206 - protein, 10 aa, Influenza virus
LIAPEYGFKI

SEQ ID NO: 504207 - protein, 10 aa, Influenza virus
LIAPEYGFRI

SEQ ID NO: 504208 - protein, 10 aa, Influenza virus
LIAPEYGHLI

SEQ ID NO: 504209 - protein, 10 aa, Influenza virus
LIAPEYGHLT

SEQ ID NO: 504210 - protein, 10 aa, Influenza virus
LIAPEYGHLV

SEQ ID NO: 504211 - protein, 10 aa, Influenza virus
LIAPEYGYLI

SEQ ID NO: 504212 - protein, 10 aa, Influenza virus
LIAPRGHYKI

SEQ ID NO: 504213 - protein, 10 aa, Influenza virus
LIAPRGHYKL

SEQ ID NO: 504214 - protein, 10 aa, Influenza virus
LIAPRGHYRL

SEQ ID NO: 504215 - protein, 10 aa, Influenza virus
LIAPRGYFKI

SEQ ID NO: 504216 - protein, 10 aa, Influenza virus
LIAPRGYFKM

SEQ ID NO: 504217 - protein, 10 aa, Influenza virus
LIAPRGYFKV

SEQ ID NO: 504218 - protein, 10 aa, Influenza virus
LIAPRGYFRI

SEQ ID NO: 504219 - protein, 10 aa, Influenza virus
LIAPRGYYKM

SEQ ID NO: 504220 - protein, 10 aa, Influenza virus
LIAPRYGYII

SEQ ID NO: 504221 - protein, 10 aa, Influenza virus
LIAPSRVSKL

SEQ ID NO: 504222 - protein, 10 aa, Influenza virus
LIAPSRVTKL

SEQ ID NO: 504223 - protein, 10 aa, Influenza virus
LIASSGTLEF

SEQ ID NO: 504224 - protein, 10 aa, Influenza virus
LICATCEQIA

SEQ ID NO: 504225 - protein, 10 aa, Influenza virus
LIDALLGDPH

SEQ ID NO: 504226 - protein, 10 aa, Influenza virus
LIDALLGDPQ

SEQ ID NO: 504227 - protein, 10 aa, Influenza virus
LIDGWYGFKH

SEQ ID NO: 504228 - protein, 10 aa, Influenza virus
LIDGWYGFRH

SEQ ID NO: 504229 - protein, 10 aa, Influenza virus
LIDGWYGYHH

SEQ ID NO: 504230 - protein, 10 aa, Influenza virus
LIDGWYGYKH

SEQ ID NO: 504231 - protein, 10 aa, Influenza virus
LIDGWYGYRH

SEQ ID NO: 504232 - protein, 10 aa, Influenza virus
LIDKTNQQFE

SEQ ID NO: 504233 - protein, 10 aa, Influenza virus
LIDNEFTEVE

SEQ ID NO: 504234 - protein, 10 aa, Influenza virus
LIDSIGSWSQ

SEQ ID NO: 504235 - protein, 10 aa, Influenza virus
LIDSLLGDPH

SEQ ID NO: 504236 - protein, 10 aa, Influenza virus
LIEDPAAPHG

SEQ ID NO: 504237 - protein, 10 aa, Influenza virus
LIEDPGAPHG

SEQ ID NO: 504238 - protein, 10 aa, Influenza virus
LIEDPNAPHK

SEQ ID NO: 504239 - protein, 10 aa, Influenza virus
LIEDPNAPNK

SEQ ID NO: 504240 - protein, 10 aa, Influenza virus
LIEDPSAPHG

SEQ ID NO: 504241 - protein, 10 aa, Influenza virus
LIEDPSAPHR

SEQ ID NO: 504242 - protein, 10 aa, Influenza virus
LIEDPTAPHG

SEQ ID NO: 504243 - protein, 10 aa, Influenza virus
LIEKTNDKYH

SEQ ID NO: 504244 - protein, 10 aa, Influenza virus
LIEKTNEKYH

SEQ ID NO: 504245 - protein, 10 aa, Influenza virus
LIEKTNKQFE

SEQ ID NO: 504246 - protein, 10 aa, Influenza virus
LIEKTNQQFE

SEQ ID NO: 504247 - protein, 10 aa, Influenza virus
LIEKTNTEFE

SEQ ID NO: 504248 - protein, 10 aa, Influenza virus
LIEKTNTQFE

SEQ ID NO: 504249 - protein, 10 aa, Influenza virus
LIENDRTLDL

SEQ ID NO: 504250 - protein, 10 aa, Influenza virus
LIENERTLDL

SEQ ID NO: 504251 - protein, 10 aa, Influenza virus
LIENLQAYQK

SEQ ID NO: 504252 - protein, 10 aa, Influenza virus
LIENQKTLDE

SEQ ID NO: 504253 - protein, 10 aa, Influenza virus
LIENTYVNNT

SEQ ID NO: 504254 - protein, 10 aa, Influenza virus
LIEQKVPVTQ

SEQ ID NO: 504255 - protein, 10 aa, Influenza virus
LIEQNIPVTQ

SEQ ID NO: 504256 - protein, 10 aa, Influenza virus
LIEQNVPVTQ

SEQ ID NO: 504257 - protein, 10 aa, Influenza virus
LIERTNEKYH

SEQ ID NO: 504258 - protein, 10 aa, Influenza virus
LIERTNQQFE

SEQ ID NO: 504259 - protein, 10 aa, Influenza virus
LIETNHTGTY

SEQ ID NO: 504260 - protein, 10 aa, Influenza virus
LIETTHTGTY

SEQ ID NO: 504261 - protein, 10 aa, Influenza virus
LIFLARSALI

SEQ ID NO: 504262 - protein, 10 aa, Influenza virus
LIFMARSALI

SEQ ID NO: 504263 - protein, 10 aa, Influenza virus
LIFMCVKNGN

SEQ ID NO: 504264 - protein, 10 aa, Influenza virus
LIFSARSALI

SEQ ID NO: 504265 - protein, 10 aa, Influenza virus
LIGISNIGLN

SEQ ID NO: 504266 - protein, 10 aa, Influenza virus
LIGISNMSLN

SEQ ID NO: 504267 - protein, 10 aa, Influenza virus
LIGISNVGLN

SEQ ID NO: 504268 - protein, 10 aa, Influenza virus
LIGISNVVLN

SEQ ID NO: 504269 - protein, 10 aa, Influenza virus
LIGKNSWSYI

SEQ ID NO: 504270 - protein, 10 aa, Influenza virus
LIGKTNQQFE

SEQ ID NO: 504271 - protein, 10 aa, Influenza virus
LIGKTSWSYI

SEQ ID NO: 504272 - protein, 10 aa, Influenza virus
LIGQGDIVLV

SEQ ID NO: 504273 - protein, 10 aa, Influenza virus
LIGQGDVVLV

SEQ ID NO: 504274 - protein, 10 aa, Influenza virus
LIGRTNQQFE

SEQ ID NO: 504275 - protein, 10 aa, Influenza virus
LIGVSNVGLN

SEQ ID NO: 504276 - protein, 10 aa, Influenza virus
LIIAARNIVR

SEQ ID NO: 504277 - protein, 10 aa, Influenza virus
LIIAARSIVR

SEQ ID NO: 504278 - protein, 10 aa, Influenza virus
LIIERKEGTD

SEQ ID NO: 504279 - protein, 10 aa, Influenza virus
LIIERREGAD

SEQ ID NO: 504280 - protein, 10 aa, Influenza virus
LIIERREGND

SEQ ID NO: 504281 - protein, 10 aa, Influenza virus
LIIERREGSD

SEQ ID NO: 504282 - protein, 10 aa, Influenza virus
LIIERREGTD

SEQ ID NO: 504283 - protein, 10 aa, Influenza virus
LIIERRNSSD

SEQ ID NO: 504284 - protein, 10 aa, Influenza virus
LIIGISGPDN

SEQ ID NO: 504285 - protein, 10 aa, Influenza virus
LIIGISNVGL

SEQ ID NO: 504286 - protein, 10 aa, Influenza virus
LIIWGIHHPS

SEQ ID NO: 504287 - protein, 10 aa, Influenza virus
LIKHENRMVL

SEQ ID NO: 504288 - protein, 10 aa, Influenza virus
LILAFILWAC

SEQ ID NO: 504289 - protein, 10 aa, Influenza virus
LILAFIMWAC

SEQ ID NO: 504290 - protein, 10 aa, Influenza virus
LILAFIMWTC

SEQ ID NO: 504291 - protein, 10 aa, Influenza virus
LILFNTIGNL

SEQ ID NO: 504292 - protein, 10 aa, Influenza virus
LILGFVLWAC

SEQ ID NO: 504293 - protein, 10 aa, Influenza virus
LILGMQNGSC

SEQ ID NO: 504294 - protein, 10 aa, Influenza virus
LILGMQNGSY

SEQ ID NO: 504295 - protein, 10 aa, Influenza virus
LILGNPKCDL

SEQ ID NO: 504296 - protein, 10 aa, Influenza virus
LILGNPKCDP

SEQ ID NO: 504297 - protein, 10 aa, Influenza virus
LILKDCSIAG

SEQ ID NO: 504298 - protein, 10 aa, Influenza virus
LILKDCSVAG

SEQ ID NO: 504299 - protein, 10 aa, Influenza virus
LILLENERTL

SEQ ID NO: 504300 - protein, 10 aa, Influenza virus
LILRDCSVAG

SEQ ID NO: 504301 - protein, 10 aa, Influenza virus
LILRGAVAHK

SEQ ID NO: 504302 - protein, 10 aa, Influenza virus
LILRGSIAHK

SEQ ID NO: 504303 - protein, 10 aa, Influenza virus
LILRGSVAHK

SEQ ID NO: 504304 - protein, 10 aa, Influenza virus
LILSFIMWAC

SEQ ID NO: 504305 - protein, 10 aa, Influenza virus
LILSNPKCDL

SEQ ID NO: 504306 - protein, 10 aa, Influenza virus
LILTFIMWAC

SEQ ID NO: 504307 - protein, 10 aa, Influenza virus
LILVALALSH

SEQ ID NO: 504308 - protein, 10 aa, Influenza virus
LIMRTVIALS

SEQ ID NO: 504309 - protein, 10 aa, Influenza virus
LIMWGIHHPS

SEQ ID NO: 504310 - protein, 10 aa, Influenza virus
LINDPWVLLN

SEQ ID NO: 504311 - protein, 10 aa, Influenza virus
LINGALGSPG

SEQ ID NO: 504312 - protein, 10 aa, Influenza virus
LINGWYGFQH

SEQ ID NO: 504313 - protein, 10 aa, Influenza virus
LINGWYGFRH

SEQ ID NO: 504314 - protein, 10 aa, Influenza virus
LINTYQWIIR

SEQ ID NO: 504315 - protein, 10 aa, Influenza virus
LIPMISKCKT

SEQ ID NO: 504316 - protein, 10 aa, Influenza virus
LIPMISKCRT

SEQ ID NO: 504317 - protein, 10 aa, Influenza virus
LIPMISKSRT

SEQ ID NO: 504318 - protein, 10 aa, Influenza virus
LIQFPIGTAP

SEQ ID NO: 504319 - protein, 10 aa, Influenza virus
LIQFPMGTAP

SEQ ID NO: 504320 - protein, 10 aa, Influenza virus
LIQGYKDIIL

SEQ ID NO: 504321 - protein, 10 aa, Influenza virus
LIRALTLNTM

SEQ ID NO: 504322 - protein, 10 aa, Influenza virus
LIRFPIGTAP

SEQ ID NO: 504323 - protein, 10 aa, Influenza virus
LIRFPIGVAP

SEQ ID NO: 504324 - protein, 10 aa, Influenza virus
LIRFPVGTAP

SEQ ID NO: 504325 - protein, 10 aa, Influenza virus
LIRGNSPIFN

SEQ ID NO: 504326 - protein, 10 aa, Influenza virus
LIRGNSPVFN

SEQ ID NO: 504327 - protein, 10 aa, Influenza virus
LIRGQQGRMD

SEQ ID NO: 504328 - protein, 10 aa, Influenza virus
LIRGRPEEAK

SEQ ID NO: 504329 - protein, 10 aa, Influenza virus
LIRGRPEEVK

SEQ ID NO: 504330 - protein, 10 aa, Influenza virus
LIRGRPKEDK

SEQ ID NO: 504331 - protein, 10 aa, Influenza virus
LIRGRPKEDR

SEQ ID NO: 504332 - protein, 10 aa, Influenza virus
LIRGRPKEEK

SEQ ID NO: 504333 - protein, 10 aa, Influenza virus
LIRHENRMVI

SEQ ID NO: 504334 - protein, 10 aa, Influenza virus
LIRHENRMVL

SEQ ID NO: 504335 - protein, 10 aa, Influenza virus
LIRMIKRGIN

SEQ ID NO: 504336 - protein, 10 aa, Influenza virus
LIRMIKRGVN

SEQ ID NO: 504337 - protein, 10 aa, Influenza virus
LIRMVKRGIN

SEQ ID NO: 504338 - protein, 10 aa, Influenza virus
LIRTLTLNTM

SEQ ID NO: 504339 - protein, 10 aa, Influenza virus
LISDGGPNLY

SEQ ID NO: 504340 - protein, 10 aa, Influenza virus
LISKTNQQFE

SEQ ID NO: 504341 - protein, 10 aa, Influenza virus
LISTPLGSPP

SEQ ID NO: 504342 - protein, 10 aa, Influenza virus
LISTPLGTPP

SEQ ID NO: 504343 - protein, 10 aa, Influenza virus
LISWEMGLAP

SEQ ID NO: 504344 - protein, 10 aa, Influenza virus
LISWEMGQAP

SEQ ID NO: 504345 - protein, 10 aa, Influenza virus
LISWGMGQAP

SEQ ID NO: 504346 - protein, 10 aa, Influenza virus
LISWPLSSPP

SEQ ID NO: 504347 - protein, 10 aa, Influenza virus
LISWPQSSPP

SEQ ID NO: 504348 - protein, 10 aa, Influenza virus
LITDGPSDAQ

SEQ ID NO: 504349 - protein, 10 aa, Influenza virus
LITDGPSNAQ

SEQ ID NO: 504350 - protein, 10 aa, Influenza virus
LITGKSHGRI

SEQ ID NO: 504351 - protein, 10 aa, Influenza virus
LITGKSHGRV

SEQ ID NO: 504352 - protein, 10 aa, Influenza virus
LITQESECVC

SEQ ID NO: 504353 - protein, 10 aa, Influenza virus
LITVGSSKYQ

SEQ ID NO: 504354 - protein, 10 aa, Influenza virus
LITVGSSKYR

SEQ ID NO: 504355 - protein, 10 aa, Influenza virus
LITWGIHHPS

SEQ ID NO: 504356 - protein, 10 aa, Influenza virus
LIVFNTIGNL

SEQ ID NO: 504357 - protein, 10 aa, Influenza virus
LIVLLENQKT

SEQ ID NO: 504358 - protein, 10 aa, Influenza virus
LIVSLGAISF

SEQ ID NO: 504359 - protein, 10 aa, Influenza virus
LIVWGIHHPS

SEQ ID NO: 504360 - protein, 10 aa, Influenza virus
LIVWGVHHSS

SEQ ID NO: 504361 - protein, 10 aa, Influenza virus
LIWLWLVLRE

SEQ ID NO: 504362 - protein, 10 aa, Influenza virus
LIWMACHSAA

SEQ ID NO: 504363 - protein, 10 aa, Influenza virus
LIYNRMGAVT

SEQ ID NO: 504364 - protein, 10 aa, Influenza virus
LIYNRMGTIT

SEQ ID NO: 504365 - protein, 10 aa, Influenza virus
LIYNRMGTVA

SEQ ID NO: 504366 - protein, 10 aa, Influenza virus
LIYNRMGTVT

SEQ ID NO: 504367 - protein, 10 aa, Influenza virus
LKAEIAQKLE

SEQ ID NO: 504368 - protein, 10 aa, Influenza virus
LKAEIAQRLE

SEQ ID NO: 504369 - protein, 10 aa, Influenza virus
LKDCSIAGWL

SEQ ID NO: 504370 - protein, 10 aa, Influenza virus
LKDCSVAGWL

SEQ ID NO: 504371 - protein, 10 aa, Influenza virus
LKDCSVSGWL

SEQ ID NO: 504372 - protein, 10 aa, Influenza virus
LKDEEKIPKT

SEQ ID NO: 504373 - protein, 10 aa, Influenza virus
LKDNAIDEGD

SEQ ID NO: 504374 - protein, 10 aa, Influenza virus
LKDNAKDEGN

SEQ ID NO: 504375 - protein, 10 aa, Influenza virus
LKDNAKDLGN

SEQ ID NO: 504376 - protein, 10 aa, Influenza virus
LKDNAKELGN

SEQ ID NO: 504377 - protein, 10 aa, Influenza virus
LKDNANDLGN

SEQ ID NO: 504378 - protein, 10 aa, Influenza virus
LKDNARELGN

SEQ ID NO: 504379 - protein, 10 aa, Influenza virus
LKDNLEPGTF

SEQ ID NO: 504380 - protein, 10 aa, Influenza virus
LKDQAWSYIV

SEQ ID NO: 504381 - protein, 10 aa, Influenza virus
LKDQDWSYIV

SEQ ID NO: 504382 - protein, 10 aa, Influenza virus
LKDQGWSYIV

SEQ ID NO: 504383 - protein, 10 aa, Influenza virus
LKDQSWSYIV

SEQ ID NO: 504384 - protein, 10 aa, Influenza virus
LKEQLSTVSS

SEQ ID NO: 504385 - protein, 10 aa, Influenza virus
LKFKADLIIE

SEQ ID NO: 504386 - protein, 10 aa, Influenza virus
LKGKFQTAAQ

SEQ ID NO: 504387 - protein, 10 aa, Influenza virus
LKGLILGNPK

SEQ ID NO: 504388 - protein, 10 aa, Influenza virus
LKGNAKDEGN

SEQ ID NO: 504389 - protein, 10 aa, Influenza virus
LKGRHANGTI

SEQ ID NO: 504390 - protein, 10 aa, Influenza virus
LKGSAKHIEE

SEQ ID NO: 504391 - protein, 10 aa, Influenza virus
LKGSARHIEE

SEQ ID NO: 504392 - protein, 10 aa, Influenza virus
LKHNPTEEQA

SEQ ID NO: 504393 - protein, 10 aa, Influenza virus
LKHRFEIIEG

SEQ ID NO: 504394 - protein, 10 aa, Influenza virus
LKIHNAGTDP

SEQ ID NO: 504395 - protein, 10 aa, Influenza virus
LKIPNAETDP

SEQ ID NO: 504396 - protein, 10 aa, Influenza virus
LKIPNAGIDP

SEQ ID NO: 504397 - protein, 10 aa, Influenza virus
LKIPNAGTDP

SEQ ID NO: 504398 - protein, 10 aa, Influenza virus
LKIRTNGNLI

SEQ ID NO: 504399 - protein, 10 aa, Influenza virus
LKISSSFSFG

SEQ ID NO: 504400 - protein, 10 aa, Influenza virus
LKITENSFEQ

SEQ ID NO: 504401 - protein, 10 aa, Influenza virus
LKKQEIEGIK

SEQ ID NO: 504402 - protein, 10 aa, Influenza virus
LKLAIGLRNV

SEQ ID NO: 504403 - protein, 10 aa, Influenza virus
LKLAIGPRNV

SEQ ID NO: 504404 - protein, 10 aa, Influenza virus
LKLASGLRNV

SEQ ID NO: 504405 - protein, 10 aa, Influenza virus
LKLATGLKNV

SEQ ID NO: 504406 - protein, 10 aa, Influenza virus
LKLATGLRNI

SEQ ID NO: 504407 - protein, 10 aa, Influenza virus
LKLATGLRNV

SEQ ID NO: 504408 - protein, 10 aa, Influenza virus
LKLATGMRNI

SEQ ID NO: 504409 - protein, 10 aa, Influenza virus
LKLATGMRNV

SEQ ID NO: 504410 - protein, 10 aa, Influenza virus
LKLATGPRNV

SEQ ID NO: 504411 - protein, 10 aa, Influenza virus
LKLGQFPVQT

SEQ ID NO: 504412 - protein, 10 aa, Influenza virus
LKLSIEDPDH

SEQ ID NO: 504413 - protein, 10 aa, Influenza virus
LKLSIEDPNH

SEQ ID NO: 504414 - protein, 10 aa, Influenza virus
LKLSIEDPSH

SEQ ID NO: 504415 - protein, 10 aa, Influenza virus
LKLSIEEPSH

SEQ ID NO: 504416 - protein, 10 aa, Influenza virus
LKLSIENPSH

SEQ ID NO: 504417 - protein, 10 aa, Influenza virus
LKLVDGQDCD

SEQ ID NO: 504418 - protein, 10 aa, Influenza virus
LKLVTGLRNV

SEQ ID NO: 504419 - protein, 10 aa, Influenza virus
LKMPASRYLT

SEQ ID NO: 504420 - protein, 10 aa, Influenza virus
LKMSLLTEVE

SEQ ID NO: 504421 - protein, 10 aa, Influenza virus
LKMTIASDIL

SEQ ID NO: 504422 - protein, 10 aa, Influenza virus
LKNGNMRCTI

SEQ ID NO: 504423 - protein, 10 aa, Influenza virus
LKNNAIDEGD

SEQ ID NO: 504424 - protein, 10 aa, Influenza virus
LKNNAKDEGN

SEQ ID NO: 504425 - protein, 10 aa, Influenza virus
LKPGETLKVE

SEQ ID NO: 504426 - protein, 10 aa, Influenza virus
LKPGETLNIE

SEQ ID NO: 504427 - protein, 10 aa, Influenza virus
LKPGETLNVE

SEQ ID NO: 504428 - protein, 10 aa, Influenza virus
LKPGQTLRII

SEQ ID NO: 504429 - protein, 10 aa, Influenza virus
LKPGQTLRIR

SEQ ID NO: 504430 - protein, 10 aa, Influenza virus
LKPGQTLRVK

SEQ ID NO: 504431 - protein, 10 aa, Influenza virus
LKPGQTLRVR

SEQ ID NO: 504432 - protein, 10 aa, Influenza virus
LKPGQTVKIK

SEQ ID NO: 504433 - protein, 10 aa, Influenza virus
LKPGQTVKIQ

SEQ ID NO: 504434 - protein, 10 aa, Influenza virus
LKPQCQITGF

SEQ ID NO: 504435 - protein, 10 aa, Influenza virus
LKQNPTEEQA

SEQ ID NO: 504436 - protein, 10 aa, Influenza virus
LKREITFHGA

SEQ ID NO: 504437 - protein, 10 aa, Influenza virus
LKREMTFHGA

SEQ ID NO: 504438 - protein, 10 aa, Influenza virus
LKRGETLKIR

SEQ ID NO: 504439 - protein, 10 aa, Influenza virus
LKRNEIKGVE

SEQ ID NO: 504440 - protein, 10 aa, Influenza virus
LKRNEIKGVK

SEQ ID NO: 504441 - protein, 10 aa, Influenza virus
LKRQEIDGIK

SEQ ID NO: 504442 - protein, 10 aa, Influenza virus
LKRQEIEGIK

SEQ ID NO: 504443 - protein, 10 aa, Influenza virus
LKRQEIEGIR

SEQ ID NO: 504444 - protein, 10 aa, Influenza virus
LKRQEINGIK

SEQ ID NO: 504445 - protein, 10 aa, Influenza virus
LKRRAIATPG

SEQ ID NO: 504446 - protein, 10 aa, Influenza virus
LKSDKRIGSC

SEQ ID NO: 504447 - protein, 10 aa, Influenza virus
LKSEDNVYKV

SEQ ID NO: 504448 - protein, 10 aa, Influenza virus
LKSEQFPVQT

SEQ ID NO: 504449 - protein, 10 aa, Influenza virus
LKSGQFPVQT

SEQ ID NO: 504450 - protein, 10 aa, Influenza virus
LKSLFSSIKK

SEQ ID NO: 504451 - protein, 10 aa, Influenza virus
LKSNAIDEGD

SEQ ID NO: 504452 - protein, 10 aa, Influenza virus
LKSTQAAIDK

SEQ ID NO: 504453 - protein, 10 aa, Influenza virus
LKSTQAAIDQ

SEQ ID NO: 504454 - protein, 10 aa, Influenza virus
LKSTQAAINQ

SEQ ID NO: 504455 - protein, 10 aa, Influenza virus
LKSTQAAITQ

SEQ ID NO: 504456 - protein, 10 aa, Influenza virus
LKSTQAAVNQ

SEQ ID NO: 504457 - protein, 10 aa, Influenza virus
LKSTQTAIDQ

SEQ ID NO: 504458 - protein, 10 aa, Influenza virus
LKSWKGNIMR

SEQ ID NO: 504459 - protein, 10 aa, Influenza virus
LKTEDNIYKI

SEQ ID NO: 504460 - protein, 10 aa, Influenza virus
LKTEDNVYKI

SEQ ID NO: 504461 - protein, 10 aa, Influenza virus
LKTEDNVYKV

SEQ ID NO: 504462 - protein, 10 aa, Influenza virus
LKTQEYECVC

SEQ ID NO: 504463 - protein, 10 aa, Influenza virus
LKTRPILSPL

SEQ ID NO: 504464 - protein, 10 aa, Influenza virus
LKVESNGNLI

SEQ ID NO: 504465 - protein, 10 aa, Influenza virus
LKVPNAEKDP

SEQ ID NO: 504466 - protein, 10 aa, Influenza virus
LKVPNAGTDP

SEQ ID NO: 504467 - protein, 10 aa, Influenza virus
LKVPNALIDD

SEQ ID NO: 504468 - protein, 10 aa, Influenza virus
LKVPNALTDD

SEQ ID NO: 504469 - protein, 10 aa, Influenza virus
LKVPNALTDN

SEQ ID NO: 504470 - protein, 10 aa, Influenza virus
LKWALGENMA

SEQ ID NO: 504471 - protein, 10 aa, Influenza virus
LKWLISKSKE

SEQ ID NO: 504472 - protein, 10 aa, Influenza virus
LKWLVSKDKG

SEQ ID NO: 504473 - protein, 10 aa, Influenza virus
LKWLVSKNKG

SEQ ID NO: 504474 - protein, 10 aa, Influenza virus
LKWLVSKSKG

SEQ ID NO: 504475 - protein, 10 aa, Influenza virus
LKWLVSKTKG

SEQ ID NO: 504476 - protein, 10 aa, Influenza virus
LKWTLGENMA

SEQ ID NO: 504477 - protein, 10 aa, Influenza virus
LKWVLGENMA

SEQ ID NO: 504478 - protein, 10 aa, Influenza virus
LKYKGIITGT

SEQ ID NO: 504479 - protein, 10 aa, Influenza virus
LKYNDIITDT

SEQ ID NO: 504480 - protein, 10 aa, Influenza virus
LKYNGIITDT

SEQ ID NO: 504481 - protein, 10 aa, Influenza virus
LKYNGIITET

SEQ ID NO: 504482 - protein, 10 aa, Influenza virus
LKYNGIITGT

SEQ ID NO: 504483 - protein, 10 aa, Influenza virus
LKYNGVITDT

SEQ ID NO: 504484 - protein, 10 aa, Influenza virus
LLAFILWACQ

SEQ ID NO: 504485 - protein, 10 aa, Influenza virus
LLAFMLWACQ

SEQ ID NO: 504486 - protein, 10 aa, Influenza virus
LLAFVLWACQ

SEQ ID NO: 504487 - protein, 10 aa, Influenza virus
LLAIAMGLGF

SEQ ID NO: 504488 - protein, 10 aa, Influenza virus
LLAIAMGLIF

SEQ ID NO: 504489 - protein, 10 aa, Influenza virus
LLAIAMGLVF

SEQ ID NO: 504490 - protein, 10 aa, Influenza virus
LLAIVMGLVF

SEQ ID NO: 504491 - protein, 10 aa, Influenza virus
  MOD_RES (4)..(4): Ile or Leu
LLAXVMGLVF

SEQ ID NO: 504492 - protein, 10 aa, Influenza virus
LLAKSVFNCL

SEQ ID NO: 504493 - protein, 10 aa, Influenza virus
LLAKSVFNNL

SEQ ID NO: 504494 - protein, 10 aa, Influenza virus
LLAKSVFNSL

SEQ ID NO: 504495 - protein, 10 aa, Influenza virus
LLAPKYGYII

SEQ ID NO: 504496 - protein, 10 aa, Influenza virus
LLAPRYGYII

SEQ ID NO: 504497 - protein, 10 aa, Influenza virus
LLASTNAHDR

SEQ ID NO: 504498 - protein, 10 aa, Influenza virus
LLASTNAYDR

SEQ ID NO: 504499 - protein, 10 aa, Influenza virus
LLATGMKNVP

SEQ ID NO: 504500 - protein, 10 aa, Influenza virus
LLATGMRNIP

SEQ ID NO: 504501 - protein, 10 aa, Influenza virus
LLATGMRNVP

SEQ ID NO: 504502 - protein, 10 aa, Influenza virus
LLAVVMGLVF

SEQ ID NO: 504503 - protein, 10 aa, Influenza virus
LLDNLQAYQK

SEQ ID NO: 504504 - protein, 10 aa, Influenza virus
LLDPGDTVTF

SEQ ID NO: 504505 - protein, 10 aa, Influenza virus
LLDVWTYNAE

SEQ ID NO: 504506 - protein, 10 aa, Influenza virus
LLEKNVTVTH

SEQ ID NO: 504507 - protein, 10 aa, Influenza virus
LLEMCHGTQI

SEQ ID NO: 504508 - protein, 10 aa, Influenza virus
LLEMCHSTQI

SEQ ID NO: 504509 - protein, 10 aa, Influenza virus
LLEMCHSTRI

SEQ ID NO: 504510 - protein, 10 aa, Influenza virus
LLENDKTLDL

SEQ ID NO: 504511 - protein, 10 aa, Influenza virus
LLENDKTLDM

SEQ ID NO: 504512 - protein, 10 aa, Influenza virus
LLENDKTLNM

SEQ ID NO: 504513 - protein, 10 aa, Influenza virus
LLENDRTLDL

SEQ ID NO: 504514 - protein, 10 aa, Influenza virus
LLENDVPVTS

SEQ ID NO: 504515 - protein, 10 aa, Influenza virus
LLENEKTLDL

SEQ ID NO: 504516 - protein, 10 aa, Influenza virus
LLENERTLDF

SEQ ID NO: 504517 - protein, 10 aa, Influenza virus
LLENERTLDL

SEQ ID NO: 504518 - protein, 10 aa, Influenza virus
LLENERTLDY

SEQ ID NO: 504519 - protein, 10 aa, Influenza virus
LLENGRTLDL

SEQ ID NO: 504520 - protein, 10 aa, Influenza virus
LLENGRTLGL

SEQ ID NO: 504521 - protein, 10 aa, Influenza virus
LLENGVPVTS

SEQ ID NO: 504522 - protein, 10 aa, Influenza virus
LLENLQAYQK

SEQ ID NO: 504523 - protein, 10 aa, Influenza virus
LLENLQTYQK

SEQ ID NO: 504524 - protein, 10 aa, Influenza virus
LLENNVPVTS

SEQ ID NO: 504525 - protein, 10 aa, Influenza virus
LLENQKILDE

SEQ ID NO: 504526 - protein, 10 aa, Influenza virus
LLENQKTLDD

SEQ ID NO: 504527 - protein, 10 aa, Influenza virus
LLENQKTLDE

SEQ ID NO: 504528 - protein, 10 aa, Influenza virus
LLENQKTLDK

SEQ ID NO: 504529 - protein, 10 aa, Influenza virus
LLESDVPVTS

SEQ ID NO: 504530 - protein, 10 aa, Influenza virus
LLEVGTRWMK

SEQ ID NO: 504531 - protein, 10 aa, Influenza virus
LLFMIIGGFI

SEQ ID NO: 504532 - protein, 10 aa, Influenza virus
LLFQDILMRM

SEQ ID NO: 504533 - protein, 10 aa, Influenza virus
LLGAIAGFIE

SEQ ID NO: 504534 - protein, 10 aa, Influenza virus
LLGIITGPPQ

SEQ ID NO: 504535 - protein, 10 aa, Influenza virus
LLGINMSKKK

SEQ ID NO: 504536 - protein, 10 aa, Influenza virus
LLGNPECDIL

SEQ ID NO: 504537 - protein, 10 aa, Influenza virus
LLGNPECDLF

SEQ ID NO: 504538 - protein, 10 aa, Influenza virus
LLGNPECDLL

SEQ ID NO: 504539 - protein, 10 aa, Influenza virus
LLGNPECDRL

SEQ ID NO: 504540 - protein, 10 aa, Influenza virus
LLGNPKCDRL

SEQ ID NO: 504541 - protein, 10 aa, Influenza virus
LLGNPLCDEF

SEQ ID NO: 504542 - protein, 10 aa, Influenza virus
LLGNPMCDEF

SEQ ID NO: 504543 - protein, 10 aa, Influenza virus
LLGNPMCDKF

SEQ ID NO: 504544 - protein, 10 aa, Influenza virus
LLGNPTCDEF

SEQ ID NO: 504545 - protein, 10 aa, Influenza virus
LLGNQKTLDE

SEQ ID NO: 504546 - protein, 10 aa, Influenza virus
LLGSAQHVEE

SEQ ID NO: 504547 - protein, 10 aa, Influenza virus
LLGSSPNAYQ

SEQ ID NO: 504548 - protein, 10 aa, Influenza virus
LLGTITGPPQ

SEQ ID NO: 504549 - protein, 10 aa, Influenza virus
LLGTKHSNGT

SEQ ID NO: 504550 - protein, 10 aa, Influenza virus
LLGTLIGPPQ

SEQ ID NO: 504551 - protein, 10 aa, Influenza virus
LLGTNHSNGT

SEQ ID NO: 504552 - protein, 10 aa, Influenza virus
LLGTRHSNGT

SEQ ID NO: 504553 - protein, 10 aa, Influenza virus
LLGTVTGPPQ

SEQ ID NO: 504554 - protein, 10 aa, Influenza virus
LLHKCNDSCM

SEQ ID NO: 504555 - protein, 10 aa, Influenza virus
LLHKCNNSCM

SEQ ID NO: 504556 - protein, 10 aa, Influenza virus
LLHKCNNTCM

SEQ ID NO: 504557 - protein, 10 aa, Influenza virus
LLIAFVLWAC

SEQ ID NO: 504558 - protein, 10 aa, Influenza virus
LLIAMENQHT

SEQ ID NO: 504559 - protein, 10 aa, Influenza virus
LLIGISNIGL

SEQ ID NO: 504560 - protein, 10 aa, Influenza virus
LLIGISNMSL

SEQ ID NO: 504561 - protein, 10 aa, Influenza virus
LLIGISNVGL

SEQ ID NO: 504562 - protein, 10 aa, Influenza virus
LLIGISNVVL

SEQ ID NO: 504563 - protein, 10 aa, Influenza virus
LLIGVSNVGL

SEQ ID NO: 504564 - protein, 10 aa, Influenza virus
LLILLENERT

SEQ ID NO: 504565 - protein, 10 aa, Influenza virus
LLISDGGPNL

SEQ ID NO: 504566 - protein, 10 aa, Influenza virus
LLKERGFFGA

SEQ ID NO: 504567 - protein, 10 aa, Influenza virus
LLKHRFEIIE

SEQ ID NO: 504568 - protein, 10 aa, Influenza virus
LLKIRKGKIV

SEQ ID NO: 504569 - protein, 10 aa, Influenza virus
LLLAFILWAC

SEQ ID NO: 504570 - protein, 10 aa, Influenza virus
LLLAFMLWAC

SEQ ID NO: 504571 - protein, 10 aa, Influenza virus
LLLAFVLWAC

SEQ ID NO: 504572 - protein, 10 aa, Influenza virus
LLLATGMKNV

SEQ ID NO: 504573 - protein, 10 aa, Influenza virus
LLLATGMRNI

SEQ ID NO: 504574 - protein, 10 aa, Influenza virus
LLLATGMRNV

SEQ ID NO: 504575 - protein, 10 aa, Influenza virus
LLLLQANLCR

SEQ ID NO: 504576 - protein, 10 aa, Influenza virus
LLLMIIGGFI

SEQ ID NO: 504577 - protein, 10 aa, Influenza virus
LLLNKSLCNV

SEQ ID NO: 504578 - protein, 10 aa, Influenza virus
LLLNKSLCSV

SEQ ID NO: 504579 - protein, 10 aa, Influenza virus
LLLQANLCRF

SEQ ID NO: 504580 - protein, 10 aa, Influenza virus
LLLQIISLCS

SEQ ID NO: 504581 - protein, 10 aa, Influenza virus
LLLQITSLCS

SEQ ID NO: 504582 - protein, 10 aa, Influenza virus
LLLWMCSNGS

SEQ ID NO: 504583 - protein, 10 aa, Influenza virus
LLMDALKLSI

SEQ ID NO: 504584 - protein, 10 aa, Influenza virus
LLMDSLKLSI

SEQ ID NO: 504585 - protein, 10 aa, Influenza virus
LLMIIGGFIF

SEQ ID NO: 504586 - protein, 10 aa, Influenza virus
LLMNELGIPF

SEQ ID NO: 504587 - protein, 10 aa, Influenza virus
LLMNELGVPF

SEQ ID NO: 504588 - protein, 10 aa, Influenza virus
LLMNELGVPL

SEQ ID NO: 504589 - protein, 10 aa, Influenza virus
LLMNELGVSF

SEQ ID NO: 504590 - protein, 10 aa, Influenza virus
LLMSELGVPF

SEQ ID NO: 504591 - protein, 10 aa, Influenza virus
LLMSTNAYDR

SEQ ID NO: 504592 - protein, 10 aa, Influenza virus
LLNASCAAMD

SEQ ID NO: 504593 - protein, 10 aa, Influenza virus
LLNASCAAME

SEQ ID NO: 504594 - protein, 10 aa, Influenza virus
LLNASWFNSF

SEQ ID NO: 504595 - protein, 10 aa, Influenza virus
LLNDKHSNET

SEQ ID NO: 504596 - protein, 10 aa, Influenza virus
LLNDKHSNGT

SEQ ID NO: 504597 - protein, 10 aa, Influenza virus
LLNDKHSNNT

SEQ ID NO: 504598 - protein, 10 aa, Influenza virus
LLNDKHSSGT

SEQ ID NO: 504599 - protein, 10 aa, Influenza virus
LLNDRHSNGT

SEQ ID NO: 504600 - protein, 10 aa, Influenza virus
LLNKSLCNVE

SEQ ID NO: 504601 - protein, 10 aa, Influenza virus
LLNKSLCSVE

SEQ ID NO: 504602 - protein, 10 aa, Influenza virus
LLNPFVSHKE

SEQ ID NO: 504603 - protein, 10 aa, Influenza virus
LLNRININPV

SEQ ID NO: 504604 - protein, 10 aa, Influenza virus
LLNRLNINPV

SEQ ID NO: 504605 - protein, 10 aa, Influenza virus
LLNRLNINSV

SEQ ID NO: 504606 - protein, 10 aa, Influenza virus
LLNRLSINPV

SEQ ID NO: 504607 - protein, 10 aa, Influenza virus
LLPDLYDYKE

SEQ ID NO: 504608 - protein, 10 aa, Influenza virus
LLPFAAAPPE

SEQ ID NO: 504609 - protein, 10 aa, Influenza virus
LLPFAAAPPK

SEQ ID NO: 504610 - protein, 10 aa, Influenza virus
LLPFAAAPPV

SEQ ID NO: 504611 - protein, 10 aa, Influenza virus
LLPFASAPPE

SEQ ID NO: 504612 - protein, 10 aa, Influenza virus
LLQANLCRFL

SEQ ID NO: 504613 - protein, 10 aa, Influenza virus
LLQIISLCSI

SEQ ID NO: 504614 - protein, 10 aa, Influenza virus
LLQITSLCSI

SEQ ID NO: 504615 - protein, 10 aa, Influenza virus
LLQSAILSLQ

SEQ ID NO: 504616 - protein, 10 aa, Influenza virus
LLQSLQQIES

SEQ ID NO: 504617 - protein, 10 aa, Influenza virus
LLRENAEEDG

SEQ ID NO: 504618 - protein, 10 aa, Influenza virus
LLRHFQKDAK

SEQ ID NO: 504619 - protein, 10 aa, Influenza virus
LLRHFQKDAR

SEQ ID NO: 504620 - protein, 10 aa, Influenza virus
LLRHFQKNAK

SEQ ID NO: 504621 - protein, 10 aa, Influenza virus
LLSLLEMCHS

SEQ ID NO: 504622 - protein, 10 aa, Influenza virus
LLSPEEVSET

SEQ ID NO: 504623 - protein, 10 aa, Influenza virus
LLSSKANQVF

SEQ ID NO: 504624 - protein, 10 aa, Influenza virus
LLSSKDNQVF

SEQ ID NO: 504625 - protein, 10 aa, Influenza virus
LLTEVETYVL

SEQ ID NO: 504626 - protein, 10 aa, Influenza virus
LLTFILWACQ

SEQ ID NO: 504627 - protein, 10 aa, Influenza virus
LLVADGGPNL

SEQ ID NO: 504628 - protein, 10 aa, Influenza virus
LLVAIENQHT

SEQ ID NO: 504629 - protein, 10 aa, Influenza virus
LLVALENQHT

SEQ ID NO: 504630 - protein, 10 aa, Influenza virus
LLVALENQNT

SEQ ID NO: 504631 - protein, 10 aa, Influenza virus
LLVAMENQHT

SEQ ID NO: 504632 - protein, 10 aa, Influenza virus
LLVLIENDRT

SEQ ID NO: 504633 - protein, 10 aa, Influenza virus
LLVLIENERT

SEQ ID NO: 504634 - protein, 10 aa, Influenza virus
LLVLIENQKT

SEQ ID NO: 504635 - protein, 10 aa, Influenza virus
LLVLLEDERT

SEQ ID NO: 504636 - protein, 10 aa, Influenza virus
LLVLLENDKT

SEQ ID NO: 504637 - protein, 10 aa, Influenza virus
LLVLLENDRT

SEQ ID NO: 504638 - protein, 10 aa, Influenza virus
LLVLLENEKT

SEQ ID NO: 504639 - protein, 10 aa, Influenza virus
LLVLLENERT

SEQ ID NO: 504640 - protein, 10 aa, Influenza virus
LLVLLENGRT

SEQ ID NO: 504641 - protein, 10 aa, Influenza virus
LLVLLENQKI

SEQ ID NO: 504642 - protein, 10 aa, Influenza virus
LLVLLENQKP

SEQ ID NO: 504643 - protein, 10 aa, Influenza virus
LLVLLENQKT

SEQ ID NO: 504644 - protein, 10 aa, Influenza virus
LLVLLGNQKT

SEQ ID NO: 504645 - protein, 10 aa, Influenza virus
LLVLMENEIT

SEQ ID NO: 504646 - protein, 10 aa, Influenza virus
LLVLMENEMT

SEQ ID NO: 504647 - protein, 10 aa, Influenza virus
LLVLMENERT

SEQ ID NO: 504648 - protein, 10 aa, Influenza virus
LLVLMETERT

SEQ ID NO: 504649 - protein, 10 aa, Influenza virus
LLVSDGGPNL

SEQ ID NO: 504650 - protein, 10 aa, Influenza virus
LLVSLGAIGF

SEQ ID NO: 504651 - protein, 10 aa, Influenza virus
LLVSLGAISF

SEQ ID NO: 504652 - protein, 10 aa, Influenza virus
LLVSLGAVSF

SEQ ID NO: 504653 - protein, 10 aa, Influenza virus
LLVSTNAYDR

SEQ ID NO: 504654 - protein, 10 aa, Influenza virus
LLVWLENEKT

SEQ ID NO: 504655 - protein, 10 aa, Influenza virus
LLWMCSNGSL

SEQ ID NO: 504656 - protein, 10 aa, Influenza virus
LMDALKLSIE

SEQ ID NO: 504657 - protein, 10 aa, Influenza virus
LMDALLGDPH

SEQ ID NO: 504658 - protein, 10 aa, Influenza virus
LMDSLKLSIE

SEQ ID NO: 504659 - protein, 10 aa, Influenza virus
LMENEITLDF

SEQ ID NO: 504660 - protein, 10 aa, Influenza virus
LMENEMTLDF

SEQ ID NO: 504661 - protein, 10 aa, Influenza virus
LMENERTLDF

SEQ ID NO: 504662 - protein, 10 aa, Influenza virus
LMENERTLDL

SEQ ID NO: 504663 - protein, 10 aa, Influenza virus
LMENERTLDY

SEQ ID NO: 504664 - protein, 10 aa, Influenza virus
LMENERTLEF

SEQ ID NO: 504665 - protein, 10 aa, Influenza virus
LMENERTLGF

SEQ ID NO: 504666 - protein, 10 aa, Influenza virus
LMENERTLYF

SEQ ID NO: 504667 - protein, 10 aa, Influenza virus
LMEQNVPVTQ

SEQ ID NO: 504668 - protein, 10 aa, Influenza virus
LMEWIKTRPI

SEQ ID NO: 504669 - protein, 10 aa, Influenza virus
LMEWLKTRPI

SEQ ID NO: 504670 - protein, 10 aa, Influenza virus
LMIIGGFIFG

SEQ ID NO: 504671 - protein, 10 aa, Influenza virus
LMIWHSNLND

SEQ ID NO: 504672 - protein, 10 aa, Influenza virus
LMLATGMKNV

SEQ ID NO: 504673 - protein, 10 aa, Influenza virus
LMLATGMRNI

SEQ ID NO: 504674 - protein, 10 aa, Influenza virus
LMLATGMRNV

SEQ ID NO: 504675 - protein, 10 aa, Influenza virus
LMLNKSLCKI

SEQ ID NO: 504676 - protein, 10 aa, Influenza virus
LMLNKSLCKV

SEQ ID NO: 504677 - protein, 10 aa, Influenza virus
LMLQSRTREI

SEQ ID NO: 504678 - protein, 10 aa, Influenza virus
LMLSKSLCKV

SEQ ID NO: 504679 - protein, 10 aa, Influenza virus
LMNELGIPFH

SEQ ID NO: 504680 - protein, 10 aa, Influenza virus
LMNELGVPFH

SEQ ID NO: 504681 - protein, 10 aa, Influenza virus
LMNELGVPFY

SEQ ID NO: 504682 - protein, 10 aa, Influenza virus
LMNELGVPLH

SEQ ID NO: 504683 - protein, 10 aa, Influenza virus
LMNELGVSFH

SEQ ID NO: 504684 - protein, 10 aa, Influenza virus
LMQGSTLPRR

SEQ ID NO: 504685 - protein, 10 aa, Influenza virus
LMSCHIGVAP

SEQ ID NO: 504686 - protein, 10 aa, Influenza virus
LMSCPIGEAP

SEQ ID NO: 504687 - protein, 10 aa, Influenza virus
LMSCPIGEVP

SEQ ID NO: 504688 - protein, 10 aa, Influenza virus
LMSCPIGVAP

SEQ ID NO: 504689 - protein, 10 aa, Influenza virus
LMSCPLGEAP

SEQ ID NO: 504690 - protein, 10 aa, Influenza virus
LMSCPMGVAP

SEQ ID NO: 504691 - protein, 10 aa, Influenza virus
LMSCPVGEAP

SEQ ID NO: 504692 - protein, 10 aa, Influenza virus
LMSCPVGVAP

SEQ ID NO: 504693 - protein, 10 aa, Influenza virus
LMSELGVPFH

SEQ ID NO: 504694 - protein, 10 aa, Influenza virus
LMSELGVPFN

SEQ ID NO: 504695 - protein, 10 aa, Influenza virus
LMSELGVPFY

SEQ ID NO: 504696 - protein, 10 aa, Influenza virus
LMSQSRTREI

SEQ ID NO: 504697 - protein, 10 aa, Influenza virus
LMSQSRTRGI

SEQ ID NO: 504698 - protein, 10 aa, Influenza virus
LMSTNAYDRI

SEQ ID NO: 504699 - protein, 10 aa, Influenza virus
LMSTPLGSPP

SEQ ID NO: 504700 - protein, 10 aa, Influenza virus
LMSVPLGSSP

SEQ ID NO: 504701 - protein, 10 aa, Influenza virus
LMSVPLGSSS

SEQ ID NO: 504702 - protein, 10 aa, Influenza virus
LMSVPMGSSP

SEQ ID NO: 504703 - protein, 10 aa, Influenza virus
LMTDGPSDAQ

SEQ ID NO: 504704 - protein, 10 aa, Influenza virus
LMVAYMLERE

SEQ ID NO: 504705 - protein, 10 aa, Influenza virus
LMWALGENMA

SEQ ID NO: 504706 - protein, 10 aa, Influenza virus
LMWEINGPES

SEQ ID NO: 504707 - protein, 10 aa, Influenza virus
LNASCAAMDD

SEQ ID NO: 504708 - protein, 10 aa, Influenza virus
LNASCAAMDE

SEQ ID NO: 504709 - protein, 10 aa, Influenza virus
LNASCAAMED

SEQ ID NO: 504710 - protein, 10 aa, Influenza virus
LNASWFNSFL

SEQ ID NO: 504711 - protein, 10 aa, Influenza virus
LNDATYQRTR

SEQ ID NO: 504712 - protein, 10 aa, Influenza virus
LNDKHSNETV

SEQ ID NO: 504713 - protein, 10 aa, Influenza virus
LNDKHSNGTA

SEQ ID NO: 504714 - protein, 10 aa, Influenza virus
LNDKHSNGTI

SEQ ID NO: 504715 - protein, 10 aa, Influenza virus
LNDKHSNGTV

SEQ ID NO: 504716 - protein, 10 aa, Influenza virus
LNDKHSNNTV

SEQ ID NO: 504717 - protein, 10 aa, Influenza virus
LNDRHSNGTI

SEQ ID NO: 504718 - protein, 10 aa, Influenza virus
LNDRHSNGTV

SEQ ID NO: 504719 - protein, 10 aa, Influenza virus
LNDTTYQRTR

SEQ ID NO: 504720 - protein, 10 aa, Influenza virus
LNDYEELKHL

SEQ ID NO: 504721 - protein, 10 aa, Influenza virus
LNEGIMNTSK

SEQ ID NO: 504722 - protein, 10 aa, Influenza virus
LNEGVINTSK

SEQ ID NO: 504723 - protein, 10 aa, Influenza virus
LNEGVMNTSK

SEQ ID NO: 504724 - protein, 10 aa, Influenza virus
LNEITTKINN

SEQ ID NO: 504725 - protein, 10 aa, Influenza virus
LNFVNRANQR

SEQ ID NO: 504726 - protein, 10 aa, Influenza virus
LNGIPPLELG

SEQ ID NO: 504727 - protein, 10 aa, Influenza virus
LNGISPIHLG

SEQ ID NO: 504728 - protein, 10 aa, Influenza virus
LNGISPVHLG

SEQ ID NO: 504729 - protein, 10 aa, Influenza virus
LNGNGDPNNM

SEQ ID NO: 504730 - protein, 10 aa, Influenza virus
LNGREWSYIV

SEQ ID NO: 504731 - protein, 10 aa, Influenza virus
LNGTAKHIEE

SEQ ID NO: 504732 - protein, 10 aa, Influenza virus
LNGVSPIHLG

SEQ ID NO: 504733 - protein, 10 aa, Influenza virus
LNGVSPVHLG

SEQ ID NO: 504734 - protein, 10 aa, Influenza virus
LNHLIGKTNQ

SEQ ID NO: 504735 - protein, 10 aa, Influenza virus
LNIESNGNLI

SEQ ID NO: 504736 - protein, 10 aa, Influenza virus
LNINPVKLSS

SEQ ID NO: 504737 - protein, 10 aa, Influenza virus
LNINPVTLSS

SEQ ID NO: 504738 - protein, 10 aa, Influenza virus
LNINSVKLSS

SEQ ID NO: 504739 - protein, 10 aa, Influenza virus
LNITAASLND

SEQ ID NO: 504740 - protein, 10 aa, Influenza virus
LNKKIDDGFL

SEQ ID NO: 504741 - protein, 10 aa, Influenza virus
LNKKMEDGFL

SEQ ID NO: 504742 - protein, 10 aa, Influenza virus
LNKKVDDGFI

SEQ ID NO: 504743 - protein, 10 aa, Influenza virus
LNKKVDDGFL

SEQ ID NO: 504744 - protein, 10 aa, Influenza virus
LNKKVDDGLL

SEQ ID NO: 504745 - protein, 10 aa, Influenza virus
LNKRLCKVEG

SEQ ID NO: 504746 - protein, 10 aa, Influenza virus
LNKSLCKIEG

SEQ ID NO: 504747 - protein, 10 aa, Influenza virus
LNKSLCKVEG

SEQ ID NO: 504748 - protein, 10 aa, Influenza virus
LNKSLCNVEG

SEQ ID NO: 504749 - protein, 10 aa, Influenza virus
LNKSLCSVEG

SEQ ID NO: 504750 - protein, 10 aa, Influenza virus
LNLIIGISNV

SEQ ID NO: 504751 - protein, 10 aa, Influenza virus
LNLLIGISNI

SEQ ID NO: 504752 - protein, 10 aa, Influenza virus
LNLLIGISNV

SEQ ID NO: 504753 - protein, 10 aa, Influenza virus
LNLLIGVSNV

SEQ ID NO: 504754 - protein, 10 aa, Influenza virus
LNLYDRVRKQ

SEQ ID NO: 504755 - protein, 10 aa, Influenza virus
LNLYERVRKQ

SEQ ID NO: 504756 - protein, 10 aa, Influenza virus
LNMGQPFYSH

SEQ ID NO: 504757 - protein, 10 aa, Influenza virus
LNMHDANVRN

SEQ ID NO: 504758 - protein, 10 aa, Influenza virus
LNNEIRWPPH

SEQ ID NO: 504759 - protein, 10 aa, Influenza virus
LNNEPGSGNW

SEQ ID NO: 504760 - protein, 10 aa, Influenza virus
LNNKHSNGTI

SEQ ID NO: 504761 - protein, 10 aa, Influenza virus
LNNKHWSGYS

SEQ ID NO: 504762 - protein, 10 aa, Influenza virus
LNNKNWSGYS

SEQ ID NO: 504763 - protein, 10 aa, Influenza virus
LNNMNWSGYS

SEQ ID NO: 504764 - protein, 10 aa, Influenza virus
LNNNGELRHL

SEQ ID NO: 504765 - protein, 10 aa, Influenza virus
LNNRNWSGYS

SEQ ID NO: 504766 - protein, 10 aa, Influenza virus
LNNTEPLCDV

SEQ ID NO: 504767 - protein, 10 aa, Influenza virus
LNNTEPLCEV

SEQ ID NO: 504768 - protein, 10 aa, Influenza virus
LNNTEPLCNV

SEQ ID NO: 504769 - protein, 10 aa, Influenza virus
LNNVIDKMNK

SEQ ID NO: 504770 - protein, 10 aa, Influenza virus
LNNVIDKMNN

SEQ ID NO: 504771 - protein, 10 aa, Influenza virus
LNNVIDKMYK

SEQ ID NO: 504772 - protein, 10 aa, Influenza virus
LNPIDGPLPD

SEQ ID NO: 504773 - protein, 10 aa, Influenza virus
LNPIDGPLPE

SEQ ID NO: 504774 - protein, 10 aa, Influenza virus
LNPIDGPLPK

SEQ ID NO: 504775 - protein, 10 aa, Influenza virus
LNPIDGPLPV

SEQ ID NO: 504776 - protein, 10 aa, Influenza virus
LNPMHQLLRH

SEQ ID NO: 504777 - protein, 10 aa, Influenza virus
LNQTYRNNRK

SEQ ID NO: 504778 - protein, 10 aa, Influenza virus
LNQTYRNTRK

SEQ ID NO: 504779 - protein, 10 aa, Influenza virus
LNRFIEKTNQ

SEQ ID NO: 504780 - protein, 10 aa, Influenza virus
LNRIIEKTNQ

SEQ ID NO: 504781 - protein, 10 aa, Influenza virus
LNRKMEDGFL

SEQ ID NO: 504782 - protein, 10 aa, Influenza virus
LNRKVDDGFL

SEQ ID NO: 504783 - protein, 10 aa, Influenza virus
LNRLIDKTNQ

SEQ ID NO: 504784 - protein, 10 aa, Influenza virus
LNRLIDRTNH

SEQ ID NO: 504785 - protein, 10 aa, Influenza virus
LNRLIEKTND

SEQ ID NO: 504786 - protein, 10 aa, Influenza virus
LNRLIEKTNE

SEQ ID NO: 504787 - protein, 10 aa, Influenza virus
LNRLIEKTNK

SEQ ID NO: 504788 - protein, 10 aa, Influenza virus
LNRLIEKTNQ

SEQ ID NO: 504789 - protein, 10 aa, Influenza virus
LNRLIEKTNT

SEQ ID NO: 504790 - protein, 10 aa, Influenza virus
LNRLIERTNE

SEQ ID NO: 504791 - protein, 10 aa, Influenza virus
LNRLIERTNQ

SEQ ID NO: 504792 - protein, 10 aa, Influenza virus
LNRLIGKTNQ

SEQ ID NO: 504793 - protein, 10 aa, Influenza virus
LNRLISKTNQ

SEQ ID NO: 504794 - protein, 10 aa, Influenza virus
LNRLNINPVK

SEQ ID NO: 504795 - protein, 10 aa, Influenza virus
LNRLNINPVR

SEQ ID NO: 504796 - protein, 10 aa, Influenza virus
LNRLNINPVT

SEQ ID NO: 504797 - protein, 10 aa, Influenza virus
LNRLNINSVK

SEQ ID NO: 504798 - protein, 10 aa, Influenza virus
LNRLSINPVK

SEQ ID NO: 504799 - protein, 10 aa, Influenza virus
LNRNEIKGIK

SEQ ID NO: 504800 - protein, 10 aa, Influenza virus
LNRNEIKGVK

SEQ ID NO: 504801 - protein, 10 aa, Influenza virus
LNRNQPAATA

SEQ ID NO: 504802 - protein, 10 aa, Influenza virus
LNRQEIEGVK

SEQ ID NO: 504803 - protein, 10 aa, Influenza virus
LNRQEIGGVK

SEQ ID NO: 504804 - protein, 10 aa, Influenza virus
LNSSCAAMDD

SEQ ID NO: 504805 - protein, 10 aa, Influenza virus
LNTDWSGYSG

SEQ ID NO: 504806 - protein, 10 aa, Influenza virus
LNTMHQLLRH

SEQ ID NO: 504807 - protein, 10 aa, Influenza virus
LNTMTKDAER

SEQ ID NO: 504808 - protein, 10 aa, Influenza virus
LNTSQRGILE

SEQ ID NO: 504809 - protein, 10 aa, Influenza virus
LNTSQRGVLE

SEQ ID NO: 504810 - protein, 10 aa, Influenza virus
LNTTLPFHNI

SEQ ID NO: 504811 - protein, 10 aa, Influenza virus
LNVESNGNLI

SEQ ID NO: 504812 - protein, 10 aa, Influenza virus
LNVESNGNLV

SEQ ID NO: 504813 - protein, 10 aa, Influenza virus
LNVWTYNAEL

SEQ ID NO: 504814 - protein, 10 aa, Influenza virus
LNWLTKATNG

SEQ ID NO: 504815 - protein, 10 aa, Influenza virus
LNWLTKETNG

SEQ ID NO: 504816 - protein, 10 aa, Influenza virus
LNWSGYSGSF

SEQ ID NO: 504817 - protein, 10 aa, Influenza virus
LPDGAQIQYF

SEQ ID NO: 504818 - protein, 10 aa, Influenza virus
LPDLYDYKED

SEQ ID NO: 504819 - protein, 10 aa, Influenza virus
LPDLYDYKEN

SEQ ID NO: 504820 - protein, 10 aa, Influenza virus
LPDLYDYKES

SEQ ID NO: 504821 - protein, 10 aa, Influenza virus
LPDLYDYKKN

SEQ ID NO: 504822 - protein, 10 aa, Influenza virus
LPFAAAPPEQ

SEQ ID NO: 504823 - protein, 10 aa, Influenza virus
LPFAAAPPKQ

SEQ ID NO: 504824 - protein, 10 aa, Influenza virus
LPFAAAPPVQ

SEQ ID NO: 504825 - protein, 10 aa, Influenza virus
LPFASAPPEQ

SEQ ID NO: 504826 - protein, 10 aa, Influenza virus
LPFDFDKISQ

SEQ ID NO: 504827 - protein, 10 aa, Influenza virus
LPFDIDKIIT

SEQ ID NO: 504828 - protein, 10 aa, Influenza virus
LPFHNIHPLA

SEQ ID NO: 504829 - protein, 10 aa, Influenza virus
LPFHNIHPLT

SEQ ID NO: 504830 - protein, 10 aa, Influenza virus
LPFHNVHPLT

SEQ ID NO: 504831 - protein, 10 aa, Influenza virus
LPFQNIDSRA

SEQ ID NO: 504832 - protein, 10 aa, Influenza virus
LPFQNIDSWA

SEQ ID NO: 504833 - protein, 10 aa, Influenza virus
LPFQNINPRT

SEQ ID NO: 504834 - protein, 10 aa, Influenza virus
LPFQNINSRA

SEQ ID NO: 504835 - protein, 10 aa, Influenza virus
LPFQNINSRT

SEQ ID NO: 504836 - protein, 10 aa, Influenza virus
LPFQNINSRV

SEQ ID NO: 504837 - protein, 10 aa, Influenza virus
LPFQNLSPRT

SEQ ID NO: 504838 - protein, 10 aa, Influenza virus
LPFQNVNSRA

SEQ ID NO: 504839 - protein, 10 aa, Influenza virus
LPLALGMKNV

SEQ ID NO: 504840 - protein, 10 aa, Influenza virus
LPLCPFKGFF

SEQ ID NO: 504841 - protein, 10 aa, Influenza virus
LPLCPFQGFF

SEQ ID NO: 504842 - protein, 10 aa, Influenza virus
LPLCPFRGFF

SEQ ID NO: 504843 - protein, 10 aa, Influenza virus
LPNDKHSNGT

SEQ ID NO: 504844 - protein, 10 aa, Influenza virus
LPQSGRIVVD

SEQ ID NO: 504845 - protein, 10 aa, Influenza virus
LPRRSGAAGA

SEQ ID NO: 504846 - protein, 10 aa, Influenza virus
LPSDTPRGED

SEQ ID NO: 504847 - protein, 10 aa, Influenza virus
LPSFGVSGIN

SEQ ID NO: 504848 - protein, 10 aa, Influenza virus
LPSFGVSGVN

SEQ ID NO: 504849 - protein, 10 aa, Influenza virus
LPTFDSLNIT

SEQ ID NO: 504850 - protein, 10 aa, Influenza virus
LPVGGNEKKA

SEQ ID NO: 504851 - protein, 10 aa, Influenza virus
LQALQLLLEV

SEQ ID NO: 504852 - protein, 10 aa, Influenza virus
LQANLCRFLE

SEQ ID NO: 504853 - protein, 10 aa, Influenza virus
LQAYQKRMGL

SEQ ID NO: 504854 - protein, 10 aa, Influenza virus
LQAYQKRMGV

SEQ ID NO: 504855 - protein, 10 aa, Influenza virus
LQCRICIDFR

SEQ ID NO: 504856 - protein, 10 aa, Influenza virus
LQCRICILDQ

SEQ ID NO: 504857 - protein, 10 aa, Influenza virus
LQCRICIRAD

SEQ ID NO: 504858 - protein, 10 aa, Influenza virus
LQDNAKDEGN

SEQ ID NO: 504859 - protein, 10 aa, Influenza virus
LQDTTWDVFI

SEQ ID NO: 504860 - protein, 10 aa, Influenza virus
LQGSARHIEE

SEQ ID NO: 504861 - protein, 10 aa, Influenza virus
LQGTKRSYEQ

SEQ ID NO: 504862 - protein, 10 aa, Influenza virus
LQIISLCSIW

SEQ ID NO: 504863 - protein, 10 aa, Influenza virus
LQITSLCSIW

SEQ ID NO: 504864 - protein, 10 aa, Influenza virus
LQLFIKDYRY

SEQ ID NO: 504865 - protein, 10 aa, Influenza virus
LQLKDNAKEL

SEQ ID NO: 504866 - protein, 10 aa, Influenza virus
LQLKDNAREL

SEQ ID NO: 504867 - protein, 10 aa, Influenza virus
LQLLFEVEQE

SEQ ID NO: 504868 - protein, 10 aa, Influenza virus
LQLLLEVENE

SEQ ID NO: 504869 - protein, 10 aa, Influenza virus
LQLLLEVEQE

SEQ ID NO: 504870 - protein, 10 aa, Influenza virus
LQLLLEVESE

SEQ ID NO: 504871 - protein, 10 aa, Influenza virus
LQLNPIDGPL

SEQ ID NO: 504872 - protein, 10 aa, Influenza virus
LQLRDNAKEL

SEQ ID NO: 504873 - protein, 10 aa, Influenza virus
LQLRDNAREL

SEQ ID NO: 504874 - protein, 10 aa, Influenza virus
LQNASRHYMG

SEQ ID NO: 504875 - protein, 10 aa, Influenza virus
LQNNAIDEGD

SEQ ID NO: 504876 - protein, 10 aa, Influenza virus
LQNRIMINPV

SEQ ID NO: 504877 - protein, 10 aa, Influenza virus
LQNRIQIDPV

SEQ ID NO: 504878 - protein, 10 aa, Influenza virus
LQNRIQIDQV

SEQ ID NO: 504879 - protein, 10 aa, Influenza virus
LQNRIQIDSV

SEQ ID NO: 504880 - protein, 10 aa, Influenza virus
LQNTSKHYIG

SEQ ID NO: 504881 - protein, 10 aa, Influenza virus
LQQIESIIEA

SEQ ID NO: 504882 - protein, 10 aa, Influenza virus
LQQIESMIEA

SEQ ID NO: 504883 - protein, 10 aa, Influenza virus
LQQIESMVEA

SEQ ID NO: 504884 - protein, 10 aa, Influenza virus
LQQVESMIEA

SEQ ID NO: 504885 - protein, 10 aa, Influenza virus
LQRRRFIQNA

SEQ ID NO: 504886 - protein, 10 aa, Influenza virus
LQRRRFVQNA

SEQ ID NO: 504887 - protein, 10 aa, Influenza virus
LQSLQQIESI

SEQ ID NO: 504888 - protein, 10 aa, Influenza virus
LQSLQQIESM

SEQ ID NO: 504889 - protein, 10 aa, Influenza virus
LQSRTREILT

SEQ ID NO: 504890 - protein, 10 aa, Influenza virus
LQSSDDFALI

SEQ ID NO: 504891 - protein, 10 aa, Influenza virus
LQTYQKRMGV

SEQ ID NO: 504892 - protein, 10 aa, Influenza virus
LRDCKIEAVI

SEQ ID NO: 504893 - protein, 10 aa, Influenza virus
LRDCKVEAVI

SEQ ID NO: 504894 - protein, 10 aa, Influenza virus
LRDCSIAGWL

SEQ ID NO: 504895 - protein, 10 aa, Influenza virus
LRDCSVAGWL

SEQ ID NO: 504896 - protein, 10 aa, Influenza virus
LRDNAKDEGN

SEQ ID NO: 504897 - protein, 10 aa, Influenza virus
LRDNAKDLGN

SEQ ID NO: 504898 - protein, 10 aa, Influenza virus
LRDNAKEIGN

SEQ ID NO: 504899 - protein, 10 aa, Influenza virus
LRDNAKELGN

SEQ ID NO: 504900 - protein, 10 aa, Influenza virus
LRDNAMILGN

SEQ ID NO: 504901 - protein, 10 aa, Influenza virus
LRDNANDLGN

SEQ ID NO: 504902 - protein, 10 aa, Influenza virus
LRDNLEPGTF

SEQ ID NO: 504903 - protein, 10 aa, Influenza virus
LRDNVKELGD

SEQ ID NO: 504904 - protein, 10 aa, Influenza virus
LRDNVKELGN

SEQ ID NO: 504905 - protein, 10 aa, Influenza virus
LRDQGWSYIV

SEQ ID NO: 504906 - protein, 10 aa, Influenza virus
LRDSLEPGTF

SEQ ID NO: 504907 - protein, 10 aa, Influenza virus
LREHLSSVSS

SEQ ID NO: 504908 - protein, 10 aa, Influenza virus
LRELWQCYYL

SEQ ID NO: 504909 - protein, 10 aa, Influenza virus
LRENAEDIGN

SEQ ID NO: 504910 - protein, 10 aa, Influenza virus
LRENAEDKGN

SEQ ID NO: 504911 - protein, 10 aa, Influenza virus
LRENAEDMGD

SEQ ID NO: 504912 - protein, 10 aa, Influenza virus
LRENAEDMGG

SEQ ID NO: 504913 - protein, 10 aa, Influenza virus
LRENAEDMGN

SEQ ID NO: 504914 - protein, 10 aa, Influenza virus
LRENAEDQGN

SEQ ID NO: 504915 - protein, 10 aa, Influenza virus
LRENAEDRGN

SEQ ID NO: 504916 - protein, 10 aa, Influenza virus
LRENAEEDCT

SEQ ID NO: 504917 - protein, 10 aa, Influenza virus
LRENAEEDGN

SEQ ID NO: 504918 - protein, 10 aa, Influenza virus
LRENAEEDGT

SEQ ID NO: 504919 - protein, 10 aa, Influenza virus
LRENAEEMGN

SEQ ID NO: 504920 - protein, 10 aa, Influenza virus
LREQKQEFKM

SEQ ID NO: 504921 - protein, 10 aa, Influenza virus
LREQLSSVSS

SEQ ID NO: 504922 - protein, 10 aa, Influenza virus
LREQLSTVSS

SEQ ID NO: 504923 - protein, 10 aa, Influenza virus
LRFLFSSIKK

SEQ ID NO: 504924 - protein, 10 aa, Influenza virus
LRFVFSIAAS

SEQ ID NO: 504925 - protein, 10 aa, Influenza virus
LRFVFSNAAS

SEQ ID NO: 504926 - protein, 10 aa, Influenza virus
LRFVFSSAAS

SEQ ID NO: 504927 - protein, 10 aa, Influenza virus
LRGFLIIGKE

SEQ ID NO: 504928 - protein, 10 aa, Influenza virus
LRGFLILGKE

SEQ ID NO: 504929 - protein, 10 aa, Influenza virus
LRGFLILGRE

SEQ ID NO: 504930 - protein, 10 aa, Influenza virus
LRGGRNSFFS

SEQ ID NO: 504931 - protein, 10 aa, Influenza virus
LRGIPPLELG

SEQ ID NO: 504932 - protein, 10 aa, Influenza virus
LRGQHANGTI

SEQ ID NO: 504933 - protein, 10 aa, Influenza virus
LRGRGSTLGL

SEQ ID NO: 504934 - protein, 10 aa, Influenza virus
LRGRHANGTI

SEQ ID NO: 504935 - protein, 10 aa, Influenza virus
LRGRHANGTM

SEQ ID NO: 504936 - protein, 10 aa, Influenza virus
LRGSARHIEE

SEQ ID NO: 504937 - protein, 10 aa, Influenza virus
LRGSIAHKSC

SEQ ID NO: 504938 - protein, 10 aa, Influenza virus
LRGSVAHKSC

SEQ ID NO: 504939 - protein, 10 aa, Influenza virus
LRHFQKDAKI

SEQ ID NO: 504940 - protein, 10 aa, Influenza virus
LRHFQKDAKM

SEQ ID NO: 504941 - protein, 10 aa, Influenza virus
LRHFQKDAKV

SEQ ID NO: 504942 - protein, 10 aa, Influenza virus
LRHFQKDARV

SEQ ID NO: 504943 - protein, 10 aa, Influenza virus
LRHFQKNAKV

SEQ ID NO: 504944 - protein, 10 aa, Influenza virus
LRHLFSGIKS

SEQ ID NO: 504945 - protein, 10 aa, Influenza virus
LRHLFSGIRS

SEQ ID NO: 504946 - protein, 10 aa, Influenza virus
LRHLFSGVNS

SEQ ID NO: 504947 - protein, 10 aa, Influenza virus
LRILIRGNSP

SEQ ID NO: 504948 - protein, 10 aa, Influenza virus
LRILVRGNSP

SEQ ID NO: 504949 - protein, 10 aa, Influenza virus
LRIPNAGIDP

SEQ ID NO: 504950 - protein, 10 aa, Influenza virus
LRISSSFSFG

SEQ ID NO: 504951 - protein, 10 aa, Influenza virus
LRKILRKSGG

SEQ ID NO: 504952 - protein, 10 aa, Influenza virus
LRLAIGLRNT

SEQ ID NO: 504953 - protein, 10 aa, Influenza virus
LRLALGLRNT

SEQ ID NO: 504954 - protein, 10 aa, Influenza virus
LRLATGLRNI

SEQ ID NO: 504955 - protein, 10 aa, Influenza virus
LRLATGLRNV

SEQ ID NO: 504956 - protein, 10 aa, Influenza virus
LRLATGMRNI

SEQ ID NO: 504957 - protein, 10 aa, Influenza virus
LRLAVGLRNT

SEQ ID NO: 504958 - protein, 10 aa, Influenza virus
LRMATGLRNI

SEQ ID NO: 504959 - protein, 10 aa, Influenza virus
LRMATGLRNV

SEQ ID NO: 504960 - protein, 10 aa, Influenza virus
LRMKWMMAMK

SEQ ID NO: 504961 - protein, 10 aa, Influenza virus
LRMKWMMAMR

SEQ ID NO: 504962 - protein, 10 aa, Influenza virus
LRMVTGLRNI

SEQ ID NO: 504963 - protein, 10 aa, Influenza virus
LRNDTDVVNF

SEQ ID NO: 504964 - protein, 10 aa, Influenza virus
LRNDTDVVNY

SEQ ID NO: 504965 - protein, 10 aa, Influenza virus
LRNGNMRCTI

SEQ ID NO: 504966 - protein, 10 aa, Influenza virus
LRNIPSIQSR

SEQ ID NO: 504967 - protein, 10 aa, Influenza virus
LRNIPSVQSR

SEQ ID NO: 504968 - protein, 10 aa, Influenza virus
LRNTPSIDPK

SEQ ID NO: 504969 - protein, 10 aa, Influenza virus
LRNTPSIEPK

SEQ ID NO: 504970 - protein, 10 aa, Influenza virus
LRNTPSIEPR

SEQ ID NO: 504971 - protein, 10 aa, Influenza virus
LRNTPSVEPK

SEQ ID NO: 504972 - protein, 10 aa, Influenza virus
LRNTPSVEPR

SEQ ID NO: 504973 - protein, 10 aa, Influenza virus
LRNVPSIQSR

SEQ ID NO: 504974 - protein, 10 aa, Influenza virus
LRPGETLNVE

SEQ ID NO: 504975 - protein, 10 aa, Influenza virus
LRPGQTLRVR

SEQ ID NO: 504976 - protein, 10 aa, Influenza virus
LRQIIRESGG

SEQ ID NO: 504977 - protein, 10 aa, Influenza virus
LRQILRESGG

SEQ ID NO: 504978 - protein, 10 aa, Influenza virus
LRQILRGSGG

SEQ ID NO: 504979 - protein, 10 aa, Influenza virus
LRQILRKSGG

SEQ ID NO: 504980 - protein, 10 aa, Influenza virus
LRQILRRSGG

SEQ ID NO: 504981 - protein, 10 aa, Influenza virus
LRQKIMESGG

SEQ ID NO: 504982 - protein, 10 aa, Influenza virus
LRQKVMESGG

SEQ ID NO: 504983 - protein, 10 aa, Influenza virus
LRQNAEEDGK

SEQ ID NO: 504984 - protein, 10 aa, Influenza virus
LRQNAEEDGR

SEQ ID NO: 504985 - protein, 10 aa, Influenza virus
LRQNPTEEQA

SEQ ID NO: 504986 - protein, 10 aa, Influenza virus
LRQVLRESGG

SEQ ID NO: 504987 - protein, 10 aa, Influenza virus
LRRCLLQSLQ

SEQ ID NO: 504988 - protein, 10 aa, Influenza virus
LRRDQKSLRG

SEQ ID NO: 504989 - protein, 10 aa, Influenza virus
LRRQKSLIWL

SEQ ID NO: 504990 - protein, 10 aa, Influenza virus
LRRQKWWVWL

SEQ ID NO: 504991 - protein, 10 aa, Influenza virus
LRSGFEMLKI

SEQ ID NO: 504992 - protein, 10 aa, Influenza virus
LRSGYEMLKV

SEQ ID NO: 504993 - protein, 10 aa, Influenza virus
LRSGYETFKV

SEQ ID NO: 504994 - protein, 10 aa, Influenza virus
LRSGYWAIRT

SEQ ID NO: 504995 - protein, 10 aa, Influenza virus
LRSILANNGK

SEQ ID NO: 504996 - protein, 10 aa, Influenza virus
LRSILANNGR

SEQ ID NO: 504997 - protein, 10 aa, Influenza virus
LRSILASSGS

SEQ ID NO: 504998 - protein, 10 aa, Influenza virus
LRSIVASSGT

SEQ ID NO: 504999 - protein, 10 aa, Influenza virus
LRSKYWAIRT

SEQ ID NO: 505000 - protein, 10 aa, Influenza virus
LRSLFSSIKK

SEQ ID NO: 505001 - protein, 10 aa, Influenza virus
LRSLFSSIKR

SEQ ID NO: 505002 - protein, 10 aa, Influenza virus
LRSLIASSGT

SEQ ID NO: 505003 - protein, 10 aa, Influenza virus
LRSLVASSGN

SEQ ID NO: 505004 - protein, 10 aa, Influenza virus
LRSLVASSGT

SEQ ID NO: 505005 - protein, 10 aa, Influenza virus
LRSNAPSGIE

SEQ ID NO: 505006 - protein, 10 aa, Influenza virus
LRSNAPSGVE

SEQ ID NO: 505007 - protein, 10 aa, Influenza virus
LRSRYWAIRT

SEQ ID NO: 505008 - protein, 10 aa, Influenza virus
LRTHESECVC

SEQ ID NO: 505009 - protein, 10 aa, Influenza virus
LRTQDSECVS

SEQ ID NO: 505010 - protein, 10 aa, Influenza virus
LRTQESDCVC

SEQ ID NO: 505011 - protein, 10 aa, Influenza virus
LRTQESECAC

SEQ ID NO: 505012 - protein, 10 aa, Influenza virus
LRTQESECIC

SEQ ID NO: 505013 - protein, 10 aa, Influenza virus
LRTQESECLC

SEQ ID NO: 505014 - protein, 10 aa, Influenza virus
LRTQESECQC

SEQ ID NO: 505015 - protein, 10 aa, Influenza virus
LRTQESECVC

SEQ ID NO: 505016 - protein, 10 aa, Influenza virus
LRTQESECVR

SEQ ID NO: 505017 - protein, 10 aa, Influenza virus
LRTQESSCTC

SEQ ID NO: 505018 - protein, 10 aa, Influenza virus
LRTQESSCVC

SEQ ID NO: 505019 - protein, 10 aa, Influenza virus
LRVPNALTDD

SEQ ID NO: 505020 - protein, 10 aa, Influenza virus
LRWALGENMA

SEQ ID NO: 505021 - protein, 10 aa, Influenza virus
LSADGDIWVT

SEQ ID NO: 505022 - protein, 10 aa, Influenza virus
LSAFDERRNK

SEQ ID NO: 505023 - protein, 10 aa, Influenza virus
LSAFDERRNR

SEQ ID NO: 505024 - protein, 10 aa, Influenza virus
LSAGGAIWVT

SEQ ID NO: 505025 - protein, 10 aa, Influenza virus
LSAGGDIWAT

SEQ ID NO: 505026 - protein, 10 aa, Influenza virus
LSAGGDIWIT

SEQ ID NO: 505027 - protein, 10 aa, Influenza virus
LSAGGDIWVM

SEQ ID NO: 505028 - protein, 10 aa, Influenza virus
LSAGGDIWVT

SEQ ID NO: 505029 - protein, 10 aa, Influenza virus
LSAGGHIWVT

SEQ ID NO: 505030 - protein, 10 aa, Influenza virus
LSAGGNIWIT

SEQ ID NO: 505031 - protein, 10 aa, Influenza virus
LSASGDIWIT

SEQ ID NO: 505032 - protein, 10 aa, Influenza virus
LSEQNVPVTQ

SEQ ID NO: 505033 - protein, 10 aa, Influenza virus
LSFQGRGVFE

SEQ ID NO: 505034 - protein, 10 aa, Influenza virus
LSFQVDCFLW

SEQ ID NO: 505035 - protein, 10 aa, Influenza virus
LSFTITGDNT

SEQ ID NO: 505036 - protein, 10 aa, Influenza virus
LSFTVTGDNT

SEQ ID NO: 505037 - protein, 10 aa, Influenza virus
LSFWMCSNGS

SEQ ID NO: 505038 - protein, 10 aa, Influenza virus
LSGGAQHVEE

SEQ ID NO: 505039 - protein, 10 aa, Influenza virus
LSGGGDIWVT

SEQ ID NO: 505040 - protein, 10 aa, Influenza virus
LSGGYKDIIL

SEQ ID NO: 505041 - protein, 10 aa, Influenza virus
LSGGYKDVIL

SEQ ID NO: 505042 - protein, 10 aa, Influenza virus
LSGIPPLELG

SEQ ID NO: 505043 - protein, 10 aa, Influenza virus
LSGNAQHVEE

SEQ ID NO: 505044 - protein, 10 aa, Influenza virus
LSGNGDPNNM

SEQ ID NO: 505045 - protein, 10 aa, Influenza virus
LSGREWSYIV

SEQ ID NO: 505046 - protein, 10 aa, Influenza virus
LSGSAQHIEE

SEQ ID NO: 505047 - protein, 10 aa, Influenza virus
LSGSAQHVEE

SEQ ID NO: 505048 - protein, 10 aa, Influenza virus
LSGVAIALSI

SEQ ID NO: 505049 - protein, 10 aa, Influenza virus
LSGVAIALSV

SEQ ID NO: 505050 - protein, 10 aa, Influenza virus
LSHTAYSQIT

SEQ ID NO: 505051 - protein, 10 aa, Influenza virus
LSIAPIMFSN

SEQ ID NO: 505052 - protein, 10 aa, Influenza virus
LSICSCIASS

SEQ ID NO: 505053 - protein, 10 aa, Influenza virus
LSIEDPDHEG

SEQ ID NO: 505054 - protein, 10 aa, Influenza virus
LSIEDPNHEG

SEQ ID NO: 505055 - protein, 10 aa, Influenza virus
LSIEDPSHEG

SEQ ID NO: 505056 - protein, 10 aa, Influenza virus
LSIEEPSHEG

SEQ ID NO: 505057 - protein, 10 aa, Influenza virus
LSIENPSHEG

SEQ ID NO: 505058 - protein, 10 aa, Influenza virus
LSIIALLIGI

SEQ ID NO: 505059 - protein, 10 aa, Influenza virus
LSIIPSGPLK

SEQ ID NO: 505060 - protein, 10 aa, Influenza virus
LSILNLLIGI

SEQ ID NO: 505061 - protein, 10 aa, Influenza virus
LSINPVKLSS

SEQ ID NO: 505062 - protein, 10 aa, Influenza virus
LSISIGSSTY

SEQ ID NO: 505063 - protein, 10 aa, Influenza virus
LSISVESSTY

SEQ ID NO: 505064 - protein, 10 aa, Influenza virus
LSISVGSSTY

SEQ ID NO: 505065 - protein, 10 aa, Influenza virus
LSIVPSGPLK

SEQ ID NO: 505066 - protein, 10 aa, Influenza virus
LSIYSCIASS

SEQ ID NO: 505067 - protein, 10 aa, Influenza virus
LSIYSSVASS

SEQ ID NO: 505068 - protein, 10 aa, Influenza virus
LSIYSTAASS

SEQ ID NO: 505069 - protein, 10 aa, Influenza virus
LSIYSTVAAS

SEQ ID NO: 505070 - protein, 10 aa, Influenza virus
LSIYSTVASS

SEQ ID NO: 505071 - protein, 10 aa, Influenza virus
LSIYSTVSSS

SEQ ID NO: 505072 - protein, 10 aa, Influenza virus
LSIYSTVTSS

SEQ ID NO: 505073 - protein, 10 aa, Influenza virus
LSIYSTVVSS

SEQ ID NO: 505074 - protein, 10 aa, Influenza virus
LSKDNAIRIG

SEQ ID NO: 505075 - protein, 10 aa, Influenza virus
LSKDNGIRIG

SEQ ID NO: 505076 - protein, 10 aa, Influenza virus
LSKSLCKVEG

SEQ ID NO: 505077 - protein, 10 aa, Influenza virus
LSLAIMIAGI

SEQ ID NO: 505078 - protein, 10 aa, Influenza virus
LSLAIMMAGI

SEQ ID NO: 505079 - protein, 10 aa, Influenza virus
LSLAIMVAGI

SEQ ID NO: 505080 - protein, 10 aa, Influenza virus
LSLCMCSNGS

SEQ ID NO: 505081 - protein, 10 aa, Influenza virus
LSLIMRTVIA

SEQ ID NO: 505082 - protein, 10 aa, Influenza virus
LSLLEMCHST

SEQ ID NO: 505083 - protein, 10 aa, Influenza virus
LSLWMCFNGS

SEQ ID NO: 505084 - protein, 10 aa, Influenza virus
LSLWMCSNGS

SEQ ID NO: 505085 - protein, 10 aa, Influenza virus
LSMAPIMFSN

SEQ ID NO: 505086 - protein, 10 aa, Influenza virus
LSMEFSLTDP

SEQ ID NO: 505087 - protein, 10 aa, Influenza virus
LSMVKSDKIC

SEQ ID NO: 505088 - protein, 10 aa, Influenza virus
LSMVRSDKIC

SEQ ID NO: 505089 - protein, 10 aa, Influenza virus
LSNMGIYQIL

SEQ ID NO: 505090 - protein, 10 aa, Influenza virus
LSNMGVYQIL

SEQ ID NO: 505091 - protein, 10 aa, Influenza virus
LSNNATDTVD

SEQ ID NO: 505092 - protein, 10 aa, Influenza virus
LSNNSSDTVD

SEQ ID NO: 505093 - protein, 10 aa, Influenza virus
LSNNSTDKID

SEQ ID NO: 505094 - protein, 10 aa, Influenza virus
LSNNSTDKVD

SEQ ID NO: 505095 - protein, 10 aa, Influenza virus
LSNNSTDKVN

SEQ ID NO: 505096 - protein, 10 aa, Influenza virus
LSNNSTDTVD

SEQ ID NO: 505097 - protein, 10 aa, Influenza virus
LSNNSTEKVD

SEQ ID NO: 505098 - protein, 10 aa, Influenza virus
LSNNSTERVD

SEQ ID NO: 505099 - protein, 10 aa, Influenza virus
LSNPKCDLYL

SEQ ID NO: 505100 - protein, 10 aa, Influenza virus
LSPEEVSEAQ

SEQ ID NO: 505101 - protein, 10 aa, Influenza virus
LSPEEVSETQ

SEQ ID NO: 505102 - protein, 10 aa, Influenza virus
LSPGMMMGMF

SEQ ID NO: 505103 - protein, 10 aa, Influenza virus
LSPLTKGILG

SEQ ID NO: 505104 - protein, 10 aa, Influenza virus
LSPLTKGMLG

SEQ ID NO: 505105 - protein, 10 aa, Influenza virus
LSPNVYQARF

SEQ ID NO: 505106 - protein, 10 aa, Influenza virus
LSPRTVGQCP

SEQ ID NO: 505107 - protein, 10 aa, Influenza virus
LSQGTTIRGK

SEQ ID NO: 505108 - protein, 10 aa, Influenza virus
LSQGTTIRGR

SEQ ID NO: 505109 - protein, 10 aa, Influenza virus
LSQGTTLKGR

SEQ ID NO: 505110 - protein, 10 aa, Influenza virus
LSQGTTLRGQ

SEQ ID NO: 505111 - protein, 10 aa, Influenza virus
LSQGTTLRGR

SEQ ID NO: 505112 - protein, 10 aa, Influenza virus
LSQKFEEIRW

SEQ ID NO: 505113 - protein, 10 aa, Influenza virus
LSRCRETRGL

SEQ ID NO: 505114 - protein, 10 aa, Influenza virus
LSRCRKTRGL

SEQ ID NO: 505115 - protein, 10 aa, Influenza virus
LSRTREILTK

SEQ ID NO: 505116 - protein, 10 aa, Influenza virus
LSSGYKDIIL

SEQ ID NO: 505117 - protein, 10 aa, Influenza virus
LSSGYKDVIL

SEQ ID NO: 505118 - protein, 10 aa, Influenza virus
LSSGYKEIIL

SEQ ID NO: 505119 - protein, 10 aa, Influenza virus
LSSGYKEVIL

SEQ ID NO: 505120 - protein, 10 aa, Influenza virus
LSSKANQVFP

SEQ ID NO: 505121 - protein, 10 aa, Influenza virus
LSSKDNQVFP

SEQ ID NO: 505122 - protein, 10 aa, Influenza virus
LSSMGIYQIL

SEQ ID NO: 505123 - protein, 10 aa, Influenza virus
LSSMGVYQIL

SEQ ID NO: 505124 - protein, 10 aa, Influenza virus
LSSPPTVYNN

SEQ ID NO: 505125 - protein, 10 aa, Influenza virus
LSSPPTVYNS

SEQ ID NO: 505126 - protein, 10 aa, Influenza virus
LSSPPTVYNT

SEQ ID NO: 505127 - protein, 10 aa, Influenza virus
LSSRISFYWT

SEQ ID NO: 505128 - protein, 10 aa, Influenza virus
LSSSGNNQVF

SEQ ID NO: 505129 - protein, 10 aa, Influenza virus
LSSSMNNQVF

SEQ ID NO: 505130 - protein, 10 aa, Influenza virus
LSSSYKDIIL

SEQ ID NO: 505131 - protein, 10 aa, Influenza virus
LSSVNTNTIN

SEQ ID NO: 505132 - protein, 10 aa, Influenza virus
LSSVSSFEKF

SEQ ID NO: 505133 - protein, 10 aa, Influenza virus
LSSVSSFERF

SEQ ID NO: 505134 - protein, 10 aa, Influenza virus
LSSVSSFKRF

SEQ ID NO: 505135 - protein, 10 aa, Influenza virus
LSSVTTNTIN

SEQ ID NO: 505136 - protein, 10 aa, Influenza virus
LSTIALFIGV

SEQ ID NO: 505137 - protein, 10 aa, Influenza virus
LSTIALIIGV

SEQ ID NO: 505138 - protein, 10 aa, Influenza virus
LSTIALLIGI

SEQ ID NO: 505139 - protein, 10 aa, Influenza virus
LSTIALLIGV

SEQ ID NO: 505140 - protein, 10 aa, Influenza virus
LSTNSSDKVD

SEQ ID NO: 505141 - protein, 10 aa, Influenza virus
LSTNSSEKVD

SEQ ID NO: 505142 - protein, 10 aa, Influenza virus
LSTNSSEKVN

SEQ ID NO: 505143 - protein, 10 aa, Influenza virus
LSTNSSERVD

SEQ ID NO: 505144 - protein, 10 aa, Influenza virus
LSTNSTEKVD

SEQ ID NO: 505145 - protein, 10 aa, Influenza virus
LSTRGIQIAS

SEQ ID NO: 505146 - protein, 10 aa, Influenza virus
LSTRGVQIAS

SEQ ID NO: 505147 - protein, 10 aa, Influenza virus
LSTRGVQVAS

SEQ ID NO: 505148 - protein, 10 aa, Influenza virus
LSTVLGVSIL

SEQ ID NO: 505149 - protein, 10 aa, Influenza virus
LSTVSSFERF

SEQ ID NO: 505150 - protein, 10 aa, Influenza virus
LSVAPIMFSN

SEQ ID NO: 505151 - protein, 10 aa, Influenza virus
LSVIPSGPLK

SEQ ID NO: 505152 - protein, 10 aa, Influenza virus
LSVLNLLIGI

SEQ ID NO: 505153 - protein, 10 aa, Influenza virus
LSVLNLLIGV

SEQ ID NO: 505154 - protein, 10 aa, Influenza virus
LSVYSTVASS

SEQ ID NO: 505155 - protein, 10 aa, Influenza virus
LSYKVGYLCA

SEQ ID NO: 505156 - protein, 10 aa, Influenza virus
LSYQVGYLCA

SEQ ID NO: 505157 - protein, 10 aa, Influenza virus
LSYRVGYLCA

SEQ ID NO: 505158 - protein, 10 aa, Influenza virus
LSYSAGALAS

SEQ ID NO: 505159 - protein, 10 aa, Influenza virus
LSYSTGALAS

SEQ ID NO: 505160 - protein, 10 aa, Influenza virus
LSYSVGYLCA

SEQ ID NO: 505161 - protein, 10 aa, Influenza virus
LSYTVGYLCA

SEQ ID NO: 505162 - protein, 10 aa, Influenza virus
LTDAEMNKLF

SEQ ID NO: 505163 - protein, 10 aa, Influenza virus
LTDKGSIQSD

SEQ ID NO: 505164 - protein, 10 aa, Influenza virus
LTDNHVEVVS

SEQ ID NO: 505165 - protein, 10 aa, Influenza virus
LTDNPRPNDP

SEQ ID NO: 505166 - protein, 10 aa, Influenza virus
LTDSEMNKLF

SEQ ID NO: 505167 - protein, 10 aa, Influenza virus
LTDSEMNKLY

SEQ ID NO: 505168 - protein, 10 aa, Influenza virus
LTDSEMSKLF

SEQ ID NO: 505169 - protein, 10 aa, Influenza virus
LTDSEMSKLY

SEQ ID NO: 505170 - protein, 10 aa, Influenza virus
LTDSQTATKR

SEQ ID NO: 505171 - protein, 10 aa, Influenza virus
LTDTSKPSDK

SEQ ID NO: 505172 - protein, 10 aa, Influenza virus
LTDTSRPGDK

SEQ ID NO: 505173 - protein, 10 aa, Influenza virus
LTDTSRPGDR

SEQ ID NO: 505174 - protein, 10 aa, Influenza virus
LTDTSRPKDK

SEQ ID NO: 505175 - protein, 10 aa, Influenza virus
LTDTSRPNDP

SEQ ID NO: 505176 - protein, 10 aa, Influenza virus
LTDTSRPSDK

SEQ ID NO: 505177 - protein, 10 aa, Influenza virus
LTDTSRPSDP

SEQ ID NO: 505178 - protein, 10 aa, Influenza virus
LTDTSRPSDR

SEQ ID NO: 505179 - protein, 10 aa, Influenza virus
LTDTSRPTDP

SEQ ID NO: 505180 - protein, 10 aa, Influenza virus
LTDWSGYSGS

SEQ ID NO: 505181 - protein, 10 aa, Influenza virus
LTEIWSYNAE

SEQ ID NO: 505182 - protein, 10 aa, Influenza virus
LTEKGIEVVN

SEQ ID NO: 505183 - protein, 10 aa, Influenza virus
LTEKGVEVVN

SEQ ID NO: 505184 - protein, 10 aa, Influenza virus
LTENGVPVTS

SEQ ID NO: 505185 - protein, 10 aa, Influenza virus
LTEQNVPVTQ

SEQ ID NO: 505186 - protein, 10 aa, Influenza virus
LTEREVEVVN

SEQ ID NO: 505187 - protein, 10 aa, Influenza virus
LTERGIEVVN

SEQ ID NO: 505188 - protein, 10 aa, Influenza virus
LTERGVEVVD

SEQ ID NO: 505189 - protein, 10 aa, Influenza virus
LTERGVEVVN

SEQ ID NO: 505190 - protein, 10 aa, Influenza virus
LTETGVPVTS

SEQ ID NO: 505191 - protein, 10 aa, Influenza virus
LTEVETYVLS

SEQ ID NO: 505192 - protein, 10 aa, Influenza virus
LTFILWACQN

SEQ ID NO: 505193 - protein, 10 aa, Influenza virus
LTFLARSALI

SEQ ID NO: 505194 - protein, 10 aa, Influenza virus
LTGGQSFYRS

SEQ ID NO: 505195 - protein, 10 aa, Influenza virus
LTGIWDTLIE

SEQ ID NO: 505196 - protein, 10 aa, Influenza virus
LTGKWDTLIE

SEQ ID NO: 505197 - protein, 10 aa, Influenza virus
LTGNLQALKI

SEQ ID NO: 505198 - protein, 10 aa, Influenza virus
LTGNLQTLKI

SEQ ID NO: 505199 - protein, 10 aa, Influenza virus
LTGNLQTLKL

SEQ ID NO: 505200 - protein, 10 aa, Influenza virus
LTGNLQTLKV

SEQ ID NO: 505201 - protein, 10 aa, Influenza virus
LTGNLQTLRI

SEQ ID NO: 505202 - protein, 10 aa, Influenza virus
LTGRGIEVVN

SEQ ID NO: 505203 - protein, 10 aa, Influenza virus
LTGTAKHIEE

SEQ ID NO: 505204 - protein, 10 aa, Influenza virus
LTGTWDTLIE

SEQ ID NO: 505205 - protein, 10 aa, Influenza virus
LTHALRELWQ

SEQ ID NO: 505206 - protein, 10 aa, Influenza virus
LTHGALLNDK

SEQ ID NO: 505207 - protein, 10 aa, Influenza virus
LTHGSLLNDK

SEQ ID NO: 505208 - protein, 10 aa, Influenza virus
LTHHMRKKRG

SEQ ID NO: 505209 - protein, 10 aa, Influenza virus
LTHIMIWHSN

SEQ ID NO: 505210 - protein, 10 aa, Influenza virus
LTHLMIWHSN

SEQ ID NO: 505211 - protein, 10 aa, Influenza virus
LTHMMIWHSN

SEQ ID NO: 505212 - protein, 10 aa, Influenza virus
LTIGECPKYI

SEQ ID NO: 505213 - protein, 10 aa, Influenza virus
LTIGECPKYV

SEQ ID NO: 505214 - protein, 10 aa, Influenza virus
LTIGECPRYV

SEQ ID NO: 505215 - protein, 10 aa, Influenza virus
LTIGISGPDD

SEQ ID NO: 505216 - protein, 10 aa, Influenza virus
LTIGISGPDN

SEQ ID NO: 505217 - protein, 10 aa, Influenza virus
LTIGISGPDS

SEQ ID NO: 505218 - protein, 10 aa, Influenza virus
LTIGITGPDA

SEQ ID NO: 505219 - protein, 10 aa, Influenza virus
LTIGKCPKYV

SEQ ID NO: 505220 - protein, 10 aa, Influenza virus
LTIGVSGPDN

SEQ ID NO: 505221 - protein, 10 aa, Influenza virus
LTIIYSSSMM

SEQ ID NO: 505222 - protein, 10 aa, Influenza virus
LTITYSSPMM

SEQ ID NO: 505223 - protein, 10 aa, Influenza virus
LTITYSSSLM

SEQ ID NO: 505224 - protein, 10 aa, Influenza virus
LTITYSSSMM

SEQ ID NO: 505225 - protein, 10 aa, Influenza virus
LTIYSTAASS

SEQ ID NO: 505226 - protein, 10 aa, Influenza virus
LTIYSTVASS

SEQ ID NO: 505227 - protein, 10 aa, Influenza virus
LTKATNGNYG

SEQ ID NO: 505228 - protein, 10 aa, Influenza virus
LTKETNGNYG

SEQ ID NO: 505229 - protein, 10 aa, Influenza virus
LTKGEKANVL

SEQ ID NO: 505230 - protein, 10 aa, Influenza virus
LTKGILGFVF

SEQ ID NO: 505231 - protein, 10 aa, Influenza virus
LTKGLCTINS

SEQ ID NO: 505232 - protein, 10 aa, Influenza virus
LTKGMLGFVF

SEQ ID NO: 505233 - protein, 10 aa, Influenza virus
LTKGVLGFVF

SEQ ID NO: 505234 - protein, 10 aa, Influenza virus
LTKITVDHMA

SEQ ID NO: 505235 - protein, 10 aa, Influenza virus
LTKKEPDTYD

SEQ ID NO: 505236 - protein, 10 aa, Influenza virus
LTKKKNPEAY

SEQ ID NO: 505237 - protein, 10 aa, Influenza virus
LTKKKPDIYD

SEQ ID NO: 505238 - protein, 10 aa, Influenza virus
LTKKKPDTYD

SEQ ID NO: 505239 - protein, 10 aa, Influenza virus
LTKRLCTINS

SEQ ID NO: 505240 - protein, 10 aa, Influenza virus
LTKTTVDHMA

SEQ ID NO: 505241 - protein, 10 aa, Influenza virus
LTLGITGPDA

SEQ ID NO: 505242 - protein, 10 aa, Influenza virus
LTLGITGPDS

SEQ ID NO: 505243 - protein, 10 aa, Influenza virus
LTLGITGPDT

SEQ ID NO: 505244 - protein, 10 aa, Influenza virus
LTLKLGQFPV

SEQ ID NO: 505245 - protein, 10 aa, Influenza virus
LTLKSEQFPV

SEQ ID NO: 505246 - protein, 10 aa, Influenza virus
LTLKSGQFPV

SEQ ID NO: 505247 - protein, 10 aa, Influenza virus
LTLNTMTKDA

SEQ ID NO: 505248 - protein, 10 aa, Influenza virus
LTMGECPKYV

SEQ ID NO: 505249 - protein, 10 aa, Influenza virus
LTMGYKDIIL

SEQ ID NO: 505250 - protein, 10 aa, Influenza virus
LTNSEMNKLY

SEQ ID NO: 505251 - protein, 10 aa, Influenza virus
LTQGACWEQL

SEQ ID NO: 505252 - protein, 10 aa, Influenza virus
LTQGALLNDK

SEQ ID NO: 505253 - protein, 10 aa, Influenza virus
LTQGALLNDR

SEQ ID NO: 505254 - protein, 10 aa, Influenza virus
LTQGRQTFDW

SEQ ID NO: 505255 - protein, 10 aa, Influenza virus
LTQGRQTYDW

SEQ ID NO: 505256 - protein, 10 aa, Influenza virus
LTQGSLLNDK

SEQ ID NO: 505257 - protein, 10 aa, Influenza virus
LTQGSLLNDR

SEQ ID NO: 505258 - protein, 10 aa, Influenza virus
LTQGSLPNDK

SEQ ID NO: 505259 - protein, 10 aa, Influenza virus
LTQGTCWEQL

SEQ ID NO: 505260 - protein, 10 aa, Influenza virus
LTQGTCWEQM

SEQ ID NO: 505261 - protein, 10 aa, Influenza virus
LTQGYKDIIL

SEQ ID NO: 505262 - protein, 10 aa, Influenza virus
LTRELCTINS

SEQ ID NO: 505263 - protein, 10 aa, Influenza virus
LTRGLCKINS

SEQ ID NO: 505264 - protein, 10 aa, Influenza virus
LTRGLCTINS

SEQ ID NO: 505265 - protein, 10 aa, Influenza virus
LTRTTVDHMA

SEQ ID NO: 505266 - protein, 10 aa, Influenza virus
LTSLPFQNIH

SEQ ID NO: 505267 - protein, 10 aa, Influenza virus
LTSVTTNTIN

SEQ ID NO: 505268 - protein, 10 aa, Influenza virus
LTTDWSGYSG

SEQ ID NO: 505269 - protein, 10 aa, Influenza virus
LTTGKSHGRI

SEQ ID NO: 505270 - protein, 10 aa, Influenza virus
LTTIGLLLQI

SEQ ID NO: 505271 - protein, 10 aa, Influenza virus
LTTIGPLLQI

SEQ ID NO: 505272 - protein, 10 aa, Influenza virus
LTTRGVQIAS

SEQ ID NO: 505273 - protein, 10 aa, Influenza virus
LTTTIKPWAR

SEQ ID NO: 505274 - protein, 10 aa, Influenza virus
LTTTIKTWAG

SEQ ID NO: 505275 - protein, 10 aa, Influenza virus
LTTTIKTWAK

SEQ ID NO: 505276 - protein, 10 aa, Influenza virus
LTTTIKTWAR

SEQ ID NO: 505277 - protein, 10 aa, Influenza virus
LTTTIRTWAK

SEQ ID NO: 505278 - protein, 10 aa, Influenza virus
LTTTPTKSYF

SEQ ID NO: 505279 - protein, 10 aa, Influenza virus
LTTTVKTWAG

SEQ ID NO: 505280 - protein, 10 aa, Influenza virus
LTTVGLLLQI

SEQ ID NO: 505281 - protein, 10 aa, Influenza virus
LTVEVPYVCT

SEQ ID NO: 505282 - protein, 10 aa, Influenza virus
LTVNVRGSGL

SEQ ID NO: 505283 - protein, 10 aa, Influenza virus
LTVNVRGSGM

SEQ ID NO: 505284 - protein, 10 aa, Influenza virus
LTVNVRGTGM

SEQ ID NO: 505285 - protein, 10 aa, Influenza virus
LTVPSERGLQ

SEQ ID NO: 505286 - protein, 10 aa, Influenza virus
LTVSVRGSGM

SEQ ID NO: 505287 - protein, 10 aa, Influenza virus
LVADGGPNLY

SEQ ID NO: 505288 - protein, 10 aa, Influenza virus
LVAGGLILGM

SEQ ID NO: 505289 - protein, 10 aa, Influenza virus
LVAGWYGFQH

SEQ ID NO: 505290 - protein, 10 aa, Influenza virus
LVAIENQHTI

SEQ ID NO: 505291 - protein, 10 aa, Influenza virus
LVALALSHTA

SEQ ID NO: 505292 - protein, 10 aa, Influenza virus
LVALCGSPIS

SEQ ID NO: 505293 - protein, 10 aa, Influenza virus
LVALCGSPVP

SEQ ID NO: 505294 - protein, 10 aa, Influenza virus
LVALCGSPVS

SEQ ID NO: 505295 - protein, 10 aa, Influenza virus
LVALENQHTI

SEQ ID NO: 505296 - protein, 10 aa, Influenza virus
LVALENQNTI

SEQ ID NO: 505297 - protein, 10 aa, Influenza virus
LVAMENQHTI

SEQ ID NO: 505298 - protein, 10 aa, Influenza virus
LVAPEYGFKI

SEQ ID NO: 505299 - protein, 10 aa, Influenza virus
LVAPRGHYKL

SEQ ID NO: 505300 - protein, 10 aa, Influenza virus
LVASSGNLEF

SEQ ID NO: 505301 - protein, 10 aa, Influenza virus
LVASSGTLEF

SEQ ID NO: 505302 - protein, 10 aa, Influenza virus
LVAVENQHTI

SEQ ID NO: 505303 - protein, 10 aa, Influenza virus
LVCATCEQIA

SEQ ID NO: 505304 - protein, 10 aa, Influenza virus
LVCVSLLQSA

SEQ ID NO: 505305 - protein, 10 aa, Influenza virus
LVDALLGDPH

SEQ ID NO: 505306 - protein, 10 aa, Influenza virus
LVDGQDCDLI

SEQ ID NO: 505307 - protein, 10 aa, Influenza virus
LVDGWYGFRH

SEQ ID NO: 505308 - protein, 10 aa, Influenza virus
LVDGWYGYHH

SEQ ID NO: 505309 - protein, 10 aa, Influenza virus
LVDSIGSWSQ

SEQ ID NO: 505310 - protein, 10 aa, Influenza virus
LVDSIVSWSQ

SEQ ID NO: 505311 - protein, 10 aa, Influenza virus
LVETNHTDEL

SEQ ID NO: 505312 - protein, 10 aa, Influenza virus
LVETNHTGTY

SEQ ID NO: 505313 - protein, 10 aa, Influenza virus
LVETSHTGTY

SEQ ID NO: 505314 - protein, 10 aa, Influenza virus
LVFFCLKNGN

SEQ ID NO: 505315 - protein, 10 aa, Influenza virus
LVFFCLRNGN

SEQ ID NO: 505316 - protein, 10 aa, Influenza virus
LVFICIKNGN

SEQ ID NO: 505317 - protein, 10 aa, Influenza virus
LVFICMKNGN

SEQ ID NO: 505318 - protein, 10 aa, Influenza virus
LVFICVKNGN

SEQ ID NO: 505319 - protein, 10 aa, Influenza virus
LVFMCVKNGN

SEQ ID NO: 505320 - protein, 10 aa, Influenza virus
LVFREQKQEF

SEQ ID NO: 505321 - protein, 10 aa, Influenza virus
LVGDTPRNDD

SEQ ID NO: 505322 - protein, 10 aa, Influenza virus
LVGDTPRNED

SEQ ID NO: 505323 - protein, 10 aa, Influenza virus
LVGDTPRNGD

SEQ ID NO: 505324 - protein, 10 aa, Influenza virus
LVGDTPRNND

SEQ ID NO: 505325 - protein, 10 aa, Influenza virus
LVGIDPFKLL

SEQ ID NO: 505326 - protein, 10 aa, Influenza virus
LVGIDPFRLL

SEQ ID NO: 505327 - protein, 10 aa, Influenza virus
LVGINMSKKK

SEQ ID NO: 505328 - protein, 10 aa, Influenza virus
LVGINMSKRK

SEQ ID NO: 505329 - protein, 10 aa, Influenza virus
LVGLILAFIL

SEQ ID NO: 505330 - protein, 10 aa, Influenza virus
LVGLILAFIM

SEQ ID NO: 505331 - protein, 10 aa, Influenza virus
LVGLILSFIM

SEQ ID NO: 505332 - protein, 10 aa, Influenza virus
LVGLILTFIM

SEQ ID NO: 505333 - protein, 10 aa, Influenza virus
LVGPILSFIM

SEQ ID NO: 505334 - protein, 10 aa, Influenza virus
LVGTKHSNGT

SEQ ID NO: 505335 - protein, 10 aa, Influenza virus
LVGVDPFKLL

SEQ ID NO: 505336 - protein, 10 aa, Influenza virus
LVGVDPFRLL

SEQ ID NO: 505337 - protein, 10 aa, Influenza virus
LVIAARNIVR

SEQ ID NO: 505338 - protein, 10 aa, Influenza virus
LVLAIGLRNV

SEQ ID NO: 505339 - protein, 10 aa, Influenza virus
LVLATGLRNI

SEQ ID NO: 505340 - protein, 10 aa, Influenza virus
LVLATGLRNV

SEQ ID NO: 505341 - protein, 10 aa, Influenza virus
LVLATGPRNV

SEQ ID NO: 505342 - protein, 10 aa, Influenza virus
LVLDDCSLEG

SEQ ID NO: 505343 - protein, 10 aa, Influenza virus
LVLDDCSLKG

SEQ ID NO: 505344 - protein, 10 aa, Influenza virus
LVLGDCSIAG

SEQ ID NO: 505345 - protein, 10 aa, Influenza virus
LVLGLSMVKS

SEQ ID NO: 505346 - protein, 10 aa, Influenza virus
LVLGLSMVRS

SEQ ID NO: 505347 - protein, 10 aa, Influenza virus
LVLGNPKCDL

SEQ ID NO: 505348 - protein, 10 aa, Influenza virus
LVLIENDRTL

SEQ ID NO: 505349 - protein, 10 aa, Influenza virus
LVLIENERTL

SEQ ID NO: 505350 - protein, 10 aa, Influenza virus
LVLIENQKTL

SEQ ID NO: 505351 - protein, 10 aa, Influenza virus
LVLLEDERTL

SEQ ID NO: 505352 - protein, 10 aa, Influenza virus
LVLLENDKTL

SEQ ID NO: 505353 - protein, 10 aa, Influenza virus
LVLLENDRTL

SEQ ID NO: 505354 - protein, 10 aa, Influenza virus
LVLLENEKTL

SEQ ID NO: 505355 - protein, 10 aa, Influenza virus
LVLLENERTL

SEQ ID NO: 505356 - protein, 10 aa, Influenza virus
LVLLENGRTL

SEQ ID NO: 505357 - protein, 10 aa, Influenza virus
LVLLENQKIL

SEQ ID NO: 505358 - protein, 10 aa, Influenza virus
LVLLENQKPL

SEQ ID NO: 505359 - protein, 10 aa, Influenza virus
LVLLENQKTL

SEQ ID NO: 505360 - protein, 10 aa, Influenza virus
LVLLFMIIGG

SEQ ID NO: 505361 - protein, 10 aa, Influenza virus
LVLLGNQKTL

SEQ ID NO: 505362 - protein, 10 aa, Influenza virus
LVLLLMIIGG

SEQ ID NO: 505363 - protein, 10 aa, Influenza virus
LVLMENEMTL

SEQ ID NO: 505364 - protein, 10 aa, Influenza virus
LVLMENERTL

SEQ ID NO: 505365 - protein, 10 aa, Influenza virus
LVLNKSLCKV

SEQ ID NO: 505366 - protein, 10 aa, Influenza virus
LVLWGIHHPD

SEQ ID NO: 505367 - protein, 10 aa, Influenza virus
LVMGQQGRMD

SEQ ID NO: 505368 - protein, 10 aa, Influenza virus
LVMKRKRDSS

SEQ ID NO: 505369 - protein, 10 aa, Influenza virus
LVMKRKRNSS

SEQ ID NO: 505370 - protein, 10 aa, Influenza virus
LVMWGIHHPS

SEQ ID NO: 505371 - protein, 10 aa, Influenza virus
LVNPGDSIIF

SEQ ID NO: 505372 - protein, 10 aa, Influenza virus
LVNTYQWIIK

SEQ ID NO: 505373 - protein, 10 aa, Influenza virus
LVNTYQWIIR

SEQ ID NO: 505374 - protein, 10 aa, Influenza virus
LVNTYQWVIR

SEQ ID NO: 505375 - protein, 10 aa, Influenza virus
LVPCEPIIIE

SEQ ID NO: 505376 - protein, 10 aa, Influenza virus
LVPCFWLEMI

SEQ ID NO: 505377 - protein, 10 aa, Influenza virus
LVPCFWVEMI

SEQ ID NO: 505378 - protein, 10 aa, Influenza virus
LVREQQGRMD

SEQ ID NO: 505379 - protein, 10 aa, Influenza virus
LVRGNSPAFN

SEQ ID NO: 505380 - protein, 10 aa, Influenza virus
LVRGNSPVFN

SEQ ID NO: 505381 - protein, 10 aa, Influenza virus
LVRGQQGRMD

SEQ ID NO: 505382 - protein, 10 aa, Influenza virus
LVRGQQGTMD

SEQ ID NO: 505383 - protein, 10 aa, Influenza virus
LVRGQQGWMD

SEQ ID NO: 505384 - protein, 10 aa, Influenza virus
LVRKTRFLPV

SEQ ID NO: 505385 - protein, 10 aa, Influenza virus
LVRMIKRGIN

SEQ ID NO: 505386 - protein, 10 aa, Influenza virus
LVRSGMDPRM

SEQ ID NO: 505387 - protein, 10 aa, Influenza virus
LVRTGMDPRM

SEQ ID NO: 505388 - protein, 10 aa, Influenza virus
LVSDGGPNLY

SEQ ID NO: 505389 - protein, 10 aa, Influenza virus
LVSLGAIGFW

SEQ ID NO: 505390 - protein, 10 aa, Influenza virus
LVSLGAISFW

SEQ ID NO: 505391 - protein, 10 aa, Influenza virus
LVSLGAVSFW

SEQ ID NO: 505392 - protein, 10 aa, Influenza virus
LVSNDDWSGY

SEQ ID NO: 505393 - protein, 10 aa, Influenza virus
LVSNNDWSGY

SEQ ID NO: 505394 - protein, 10 aa, Influenza virus
LVSNSDWSGY

SEQ ID NO: 505395 - protein, 10 aa, Influenza virus
LVSTKEWSKR

SEQ ID NO: 505396 - protein, 10 aa, Influenza virus
LVSTKEWSRR

SEQ ID NO: 505397 - protein, 10 aa, Influenza virus
LVSTNAYDRI

SEQ ID NO: 505398 - protein, 10 aa, Influenza virus
LVSWEMGQAP

SEQ ID NO: 505399 - protein, 10 aa, Influenza virus
LVSWPLSSPP

SEQ ID NO: 505400 - protein, 10 aa, Influenza virus
LVTDGPSDAQ

SEQ ID NO: 505401 - protein, 10 aa, Influenza virus
LVTGKSHGRI

SEQ ID NO: 505402 - protein, 10 aa, Influenza virus
LVTGLRNVPA

SEQ ID NO: 505403 - protein, 10 aa, Influenza virus
LVTREPYISC

SEQ ID NO: 505404 - protein, 10 aa, Influenza virus
LVTREPYLSC

SEQ ID NO: 505405 - protein, 10 aa, Influenza virus
LVTREPYVSC

SEQ ID NO: 505406 - protein, 10 aa, Influenza virus
LVTTVTLHFK

SEQ ID NO: 505407 - protein, 10 aa, Influenza virus
LVVPEYGFKI

SEQ ID NO: 505408 - protein, 10 aa, Influenza virus
LVVSLGAISF

SEQ ID NO: 505409 - protein, 10 aa, Influenza virus
LVWLENEKTL

SEQ ID NO: 505410 - protein, 10 aa, Influenza virus
LVWMACHSAA

SEQ ID NO: 505411 - protein, 10 aa, Influenza virus
LVWMACNSAA

SEQ ID NO: 505412 - protein, 10 aa, Influenza virus
LWACQNGNIR

SEQ ID NO: 505413 - protein, 10 aa, Influenza virus
LWACQNGNLR

SEQ ID NO: 505414 - protein, 10 aa, Influenza virus
LWACQNGNVR

SEQ ID NO: 505415 - protein, 10 aa, Influenza virus
LWACQTGNIR

SEQ ID NO: 505416 - protein, 10 aa, Influenza virus
LWACSSGNCR

SEQ ID NO: 505417 - protein, 10 aa, Influenza virus
LWAYNAELLV

SEQ ID NO: 505418 - protein, 10 aa, Influenza virus
LWCKIVTTVG

SEQ ID NO: 505419 - protein, 10 aa, Influenza virus
LWDPFRQSER

SEQ ID NO: 505420 - protein, 10 aa, Influenza virus
LWDSFRQSER

SEQ ID NO: 505421 - protein, 10 aa, Influenza virus
LWFSFGASCF

SEQ ID NO: 505422 - protein, 10 aa, Influenza virus
LWFSFGASCV

SEQ ID NO: 505423 - protein, 10 aa, Influenza virus
LWFSFGASSF

SEQ ID NO: 505424 - protein, 10 aa, Influenza virus
LWFSLGASCF

SEQ ID NO: 505425 - protein, 10 aa, Influenza virus
LWGIHHPDSE

SEQ ID NO: 505426 - protein, 10 aa, Influenza virus
LWGIHHPDTE

SEQ ID NO: 505427 - protein, 10 aa, Influenza virus
LWGIHHPPDA

SEQ ID NO: 505428 - protein, 10 aa, Influenza virus
LWGIHHPPDE

SEQ ID NO: 505429 - protein, 10 aa, Influenza virus
LWGIHHPPDT

SEQ ID NO: 505430 - protein, 10 aa, Influenza virus
LWGIHHPPNT

SEQ ID NO: 505431 - protein, 10 aa, Influenza virus
LWGVHHPSSD

SEQ ID NO: 505432 - protein, 10 aa, Influenza virus
LWHVRKRFAD

SEQ ID NO: 505433 - protein, 10 aa, Influenza virus
LWISFAISCF

SEQ ID NO: 505434 - protein, 10 aa, Influenza virus
LWISFAMSCF

SEQ ID NO: 505435 - protein, 10 aa, Influenza virus
LWISFATSCF

SEQ ID NO: 505436 - protein, 10 aa, Influenza virus
LWISFSISCF

SEQ ID NO: 505437 - protein, 10 aa, Influenza virus
LWISFSMSCF

SEQ ID NO: 505438 - protein, 10 aa, Influenza virus
LWLVLREKMP

SEQ ID NO: 505439 - protein, 10 aa, Influenza virus
LWMCFNGSLQ

SEQ ID NO: 505440 - protein, 10 aa, Influenza virus
LWMCSNGALQ

SEQ ID NO: 505441 - protein, 10 aa, Influenza virus
LWMCSNGSLQ

SEQ ID NO: 505442 - protein, 10 aa, Influenza virus
LWMCSNGSYN

SEQ ID NO: 505443 - protein, 10 aa, Influenza virus
LWSYNADVLV

SEQ ID NO: 505444 - protein, 10 aa, Influenza virus
LWSYNAELLI

SEQ ID NO: 505445 - protein, 10 aa, Influenza virus
LWSYNAELLV

SEQ ID NO: 505446 - protein, 10 aa, Influenza virus
LWSYNAGLLV

SEQ ID NO: 505447 - protein, 10 aa, Influenza virus
LWSYNAQLLV

SEQ ID NO: 505448 - protein, 10 aa, Influenza virus
LWTSNSIVAL

SEQ ID NO: 505449 - protein, 10 aa, Influenza virus
LWTSNSIVEF

SEQ ID NO: 505450 - protein, 10 aa, Influenza virus
LWTSNSIVVF

SEQ ID NO: 505451 - protein, 10 aa, Influenza virus
LWTSNSMVAL

SEQ ID NO: 505452 - protein, 10 aa, Influenza virus
LWTYNAELLI

SEQ ID NO: 505453 - protein, 10 aa, Influenza virus
LWVSFSISCF

SEQ ID NO: 505454 - protein, 10 aa, Influenza virus
LYASKNPYTL

SEQ ID NO: 505455 - protein, 10 aa, Influenza virus
LYASPQLEGF

SEQ ID NO: 505456 - protein, 10 aa, Influenza virus
LYASSQLEGF

SEQ ID NO: 505457 - protein, 10 aa, Influenza virus
LYDAIEECLI

SEQ ID NO: 505458 - protein, 10 aa, Influenza virus
LYDKVRLQLK

SEQ ID NO: 505459 - protein, 10 aa, Influenza virus
LYDKVRLQLR

SEQ ID NO: 505460 - protein, 10 aa, Influenza virus
LYDKVRMQLK

SEQ ID NO: 505461 - protein, 10 aa, Influenza virus
LYDKVRMQLR

SEQ ID NO: 505462 - protein, 10 aa, Influenza virus
LYDRVRKQLR

SEQ ID NO: 505463 - protein, 10 aa, Influenza virus
LYDRVRLQLR

SEQ ID NO: 505464 - protein, 10 aa, Influenza virus
LYDRVRMQLR

SEQ ID NO: 505465 - protein, 10 aa, Influenza virus
LYEAIEECLI

SEQ ID NO: 505466 - protein, 10 aa, Influenza virus
LYEKVRLQLR

SEQ ID NO: 505467 - protein, 10 aa, Influenza virus
LYEKVRMQLR

SEQ ID NO: 505468 - protein, 10 aa, Influenza virus
LYEKVRRQLR

SEQ ID NO: 505469 - protein, 10 aa, Influenza virus
LYENNPGRVT

SEQ ID NO: 505470 - protein, 10 aa, Influenza virus
LYERVKKQLR

SEQ ID NO: 505471 - protein, 10 aa, Influenza virus
LYERVKRQLR

SEQ ID NO: 505472 - protein, 10 aa, Influenza virus
LYERVRKQLR

SEQ ID NO: 505473 - protein, 10 aa, Influenza virus
LYERVRRQLR

SEQ ID NO: 505474 - protein, 10 aa, Influenza virus
LYESIEECLI

SEQ ID NO: 505475 - protein, 10 aa, Influenza virus
LYFHDSNVKN

SEQ ID NO: 505476 - protein, 10 aa, Influenza virus
LYGAGNKLIT

SEQ ID NO: 505477 - protein, 10 aa, Influenza virus
LYGAIEECLI

SEQ ID NO: 505478 - protein, 10 aa, Influenza virus
LYGAQSLSIS

SEQ ID NO: 505479 - protein, 10 aa, Influenza virus
LYGFIIKGRS

SEQ ID NO: 505480 - protein, 10 aa, Influenza virus
LYGFIVKGRS

SEQ ID NO: 505481 - protein, 10 aa, Influenza virus
LYGNGNKLIT

SEQ ID NO: 505482 - protein, 10 aa, Influenza virus
LYGSGAKLIT

SEQ ID NO: 505483 - protein, 10 aa, Influenza virus
LYGSGNKLIT

SEQ ID NO: 505484 - protein, 10 aa, Influenza virus
LYGSGNKLVT

SEQ ID NO: 505485 - protein, 10 aa, Influenza virus
LYGSGSKLIT

SEQ ID NO: 505486 - protein, 10 aa, Influenza virus
LYGTGNKLIT

SEQ ID NO: 505487 - protein, 10 aa, Influenza virus
LYGTQPLSIS

SEQ ID NO: 505488 - protein, 10 aa, Influenza virus
LYGTQSLSIS

SEQ ID NO: 505489 - protein, 10 aa, Influenza virus
LYIRTNGTSK

SEQ ID NO: 505490 - protein, 10 aa, Influenza virus
LYIWGVHHPS

SEQ ID NO: 505491 - protein, 10 aa, Influenza virus
LYKKLKREIT

SEQ ID NO: 505492 - protein, 10 aa, Influenza virus
LYKKLKREMT

SEQ ID NO: 505493 - protein, 10 aa, Influenza virus
LYKNANTLSS

SEQ ID NO: 505494 - protein, 10 aa, Influenza virus
LYKNANTLTS

SEQ ID NO: 505495 - protein, 10 aa, Influenza virus
LYKNNPGRVS

SEQ ID NO: 505496 - protein, 10 aa, Influenza virus
LYKNNPGRVT

SEQ ID NO: 505497 - protein, 10 aa, Influenza virus
LYKNSPGRVT

SEQ ID NO: 505498 - protein, 10 aa, Influenza virus
LYKNTNTLSS

SEQ ID NO: 505499 - protein, 10 aa, Influenza virus
LYKSNPGRVT

SEQ ID NO: 505500 - protein, 10 aa, Influenza virus
LYKVATGRVT

SEQ ID NO: 505501 - protein, 10 aa, Influenza virus
LYLNGREWSY

SEQ ID NO: 505502 - protein, 10 aa, Influenza virus
LYLSGREWSY

SEQ ID NO: 505503 - protein, 10 aa, Influenza virus
LYLTGTWDTL

SEQ ID NO: 505504 - protein, 10 aa, Influenza virus
LYLWGVHHPS

SEQ ID NO: 505505 - protein, 10 aa, Influenza virus
LYNIRNLHIP

SEQ ID NO: 505506 - protein, 10 aa, Influenza virus
LYNKIEFEPF

SEQ ID NO: 505507 - protein, 10 aa, Influenza virus
LYNKLEFEPF

SEQ ID NO: 505508 - protein, 10 aa, Influenza virus
LYNKMEFEPF

SEQ ID NO: 505509 - protein, 10 aa, Influenza virus
LYNKVEFEPF

SEQ ID NO: 505510 - protein, 10 aa, Influenza virus
LYNKVRMQLR

SEQ ID NO: 505511 - protein, 10 aa, Influenza virus
LYQEVGTYVS

SEQ ID NO: 505512 - protein, 10 aa, Influenza virus
LYQKVGTYVS

SEQ ID NO: 505513 - protein, 10 aa, Influenza virus
LYQNVETYVS

SEQ ID NO: 505514 - protein, 10 aa, Influenza virus
LYQNVGTYVS

SEQ ID NO: 505515 - protein, 10 aa, Influenza virus
LYRKLKREIT

SEQ ID NO: 505516 - protein, 10 aa, Influenza virus
LYSGFVRTLF

SEQ ID NO: 505517 - protein, 10 aa, Influenza virus
LYSSPQLEGF

SEQ ID NO: 505518 - protein, 10 aa, Influenza virus
LYVNKNPYTL

SEQ ID NO: 505519 - protein, 10 aa, Influenza virus
LYVRTNGTSK

SEQ ID NO: 505520 - protein, 10 aa, Influenza virus
LYWHLMHPGE

SEQ ID NO: 505521 - protein, 10 aa, Influenza virus
LYWHLMRPGE

SEQ ID NO: 505522 - protein, 10 aa, Influenza virus
LYWHLMSPGE

SEQ ID NO: 505523 - protein, 10 aa, Influenza virus
MAADKESTQK

SEQ ID NO: 505524 - protein, 10 aa, Influenza virus
MAADQKSTQE

SEQ ID NO: 505525 - protein, 10 aa, Influenza virus
MACHSAAFED

SEQ ID NO: 505526 - protein, 10 aa, Influenza virus
MACNSAAFED

SEQ ID NO: 505527 - protein, 10 aa, Influenza virus
MADSEMLNLY

SEQ ID NO: 505528 - protein, 10 aa, Influenza virus
MADSIKSWRK

SEQ ID NO: 505529 - protein, 10 aa, Influenza virus
MAFLEDSHPG

SEQ ID NO: 505530 - protein, 10 aa, Influenza virus
MAFLEESHPG

SEQ ID NO: 505531 - protein, 10 aa, Influenza virus
MAFLEKSHPG

SEQ ID NO: 505532 - protein, 10 aa, Influenza virus
MAFLENSHPG

SEQ ID NO: 505533 - protein, 10 aa, Influenza virus
MAGLSFWMCS

SEQ ID NO: 505534 - protein, 10 aa, Influenza virus
MAGSSEQAAE

SEQ ID NO: 505535 - protein, 10 aa, Influenza virus
MAIDNMQNKL

SEQ ID NO: 505536 - protein, 10 aa, Influenza virus
MAIIKKYTSA

SEQ ID NO: 505537 - protein, 10 aa, Influenza virus
MAIIKKYTSG

SEQ ID NO: 505538 - protein, 10 aa, Influenza virus
MAIIKRYTSG

SEQ ID NO: 505539 - protein, 10 aa, Influenza virus
MAKCNTKCQT

SEQ ID NO: 505540 - protein, 10 aa, Influenza virus
MALLEESHPG

SEQ ID NO: 505541 - protein, 10 aa, Influenza virus
MALQGTKRSY

SEQ ID NO: 505542 - protein, 10 aa, Influenza virus
MALQLFIKDY

SEQ ID NO: 505543 - protein, 10 aa, Influenza virus
MAMKYPITAD

SEQ ID NO: 505544 - protein, 10 aa, Influenza virus
MAMKYPITAE

SEQ ID NO: 505545 - protein, 10 aa, Influenza virus
MAMKYPITAN

SEQ ID NO: 505546 - protein, 10 aa, Influenza virus
MAMRYPITAD

SEQ ID NO: 505547 - protein, 10 aa, Influenza virus
MANIRNNTYD

SEQ ID NO: 505548 - protein, 10 aa, Influenza virus
MAPIMFSNKM

SEQ ID NO: 505549 - protein, 10 aa, Influenza virus
MARAVKLYKK

SEQ ID NO: 505550 - protein, 10 aa, Influenza virus
MARCNTKCQT

SEQ ID NO: 505551 - protein, 10 aa, Influenza virus
MARLGKGYMF

SEQ ID NO: 505552 - protein, 10 aa, Influenza virus
MARLGRGYMF

SEQ ID NO: 505553 - protein, 10 aa, Influenza virus
MARSALILRG

SEQ ID NO: 505554 - protein, 10 aa, Influenza virus
MASIRNNSYD

SEQ ID NO: 505555 - protein, 10 aa, Influenza virus
MASIRNNTYD

SEQ ID NO: 505556 - protein, 10 aa, Influenza virus
MASIRNNTYN

SEQ ID NO: 505557 - protein, 10 aa, Influenza virus
MASIRNSTYD

SEQ ID NO: 505558 - protein, 10 aa, Influenza virus
MASQGTKRPY

SEQ ID NO: 505559 - protein, 10 aa, Influenza virus
MASQGTKRSH

SEQ ID NO: 505560 - protein, 10 aa, Influenza virus
MASQGTKRSY

SEQ ID NO: 505561 - protein, 10 aa, Influenza virus
MATGLRNIPS

SEQ ID NO: 505562 - protein, 10 aa, Influenza virus
MATGLRNVPS

SEQ ID NO: 505563 - protein, 10 aa, Influenza virus
MATLCLGHHA

SEQ ID NO: 505564 - protein, 10 aa, Influenza virus
MAWSSSSCHD

SEQ ID NO: 505565 - protein, 10 aa, Influenza virus
MCAAWSSSSC

SEQ ID NO: 505566 - protein, 10 aa, Influenza virus
MCLNGSMQCR

SEQ ID NO: 505567 - protein, 10 aa, Influenza virus
MCNILKGKFQ

SEQ ID NO: 505568 - protein, 10 aa, Influenza virus
MCPNGSLQCK

SEQ ID NO: 505569 - protein, 10 aa, Influenza virus
MCSGHSCRIC

SEQ ID NO: 505570 - protein, 10 aa, Influenza virus
MCSGLVGDTP

SEQ ID NO: 505571 - protein, 10 aa, Influenza virus
MCSHGSLQCR

SEQ ID NO: 505572 - protein, 10 aa, Influenza virus
MCSLMQGSTL

SEQ ID NO: 505573 - protein, 10 aa, Influenza virus
MCSNGSLHGR

SEQ ID NO: 505574 - protein, 10 aa, Influenza virus
MCSNGSLQCK

SEQ ID NO: 505575 - protein, 10 aa, Influenza virus
MCSNGSLQCR

SEQ ID NO: 505576 - protein, 10 aa, Influenza virus
MCSNGSLQCT

SEQ ID NO: 505577 - protein, 10 aa, Influenza virus
MCSNGSLRCR

SEQ ID NO: 505578 - protein, 10 aa, Influenza virus
MCSNGSMQCK

SEQ ID NO: 505579 - protein, 10 aa, Influenza virus
MCSNGSMQCN

SEQ ID NO: 505580 - protein, 10 aa, Influenza virus
MCSNGSMQCR

SEQ ID NO: 505581 - protein, 10 aa, Influenza virus
MCSNSSMQCR

SEQ ID NO: 505582 - protein, 10 aa, Influenza virus
MCSSTEFLGQ

SEQ ID NO: 505583 - protein, 10 aa, Influenza virus
MCVCRDNWHA

SEQ ID NO: 505584 - protein, 10 aa, Influenza virus
MCVCRDNWHG

SEQ ID NO: 505585 - protein, 10 aa, Influenza virus
MCVGWSSTTC

SEQ ID NO: 505586 - protein, 10 aa, Influenza virus
MCVKNGNLRC

SEQ ID NO: 505587 - protein, 10 aa, Influenza virus
MCVKNGNMRC

SEQ ID NO: 505588 - protein, 10 aa, Influenza virus
MCYPGFVENL

SEQ ID NO: 505589 - protein, 10 aa, Influenza virus
MCYPGSIENL

SEQ ID NO: 505590 - protein, 10 aa, Influenza virus
MCYPGSVENL

SEQ ID NO: 505591 - protein, 10 aa, Influenza virus
MDAGNGCFDI

SEQ ID NO: 505592 - protein, 10 aa, Influenza virus
MDALKLSIED

SEQ ID NO: 505593 - protein, 10 aa, Influenza virus
MDALLGDPHC

SEQ ID NO: 505594 - protein, 10 aa, Influenza virus
MDDFQLIPMI

SEQ ID NO: 505595 - protein, 10 aa, Influenza virus
MDEFQLIPMI

SEQ ID NO: 505596 - protein, 10 aa, Influenza virus
MDGVTNKVNS

SEQ ID NO: 505597 - protein, 10 aa, Influenza virus
MDGWYGFRHQ

SEQ ID NO: 505598 - protein, 10 aa, Influenza virus
MDHTSQYLCT

SEQ ID NO: 505599 - protein, 10 aa, Influenza virus
MDKAVKLYKK

SEQ ID NO: 505600 - protein, 10 aa, Influenza virus
MDKAVKLYRK

SEQ ID NO: 505601 - protein, 10 aa, Influenza virus
MDKQTKTMTI

SEQ ID NO: 505602 - protein, 10 aa, Influenza virus
MDNKTKKMTI

SEQ ID NO: 505603 - protein, 10 aa, Influenza virus
MDNQTKKMTI

SEQ ID NO: 505604 - protein, 10 aa, Influenza virus
MDNQTKTMTI

SEQ ID NO: 505605 - protein, 10 aa, Influenza virus
MDPRMCSLMQ

SEQ ID NO: 505606 - protein, 10 aa, Influenza virus
MDQVREGRNP

SEQ ID NO: 505607 - protein, 10 aa, Influenza virus
MDQVRESRNP

SEQ ID NO: 505608 - protein, 10 aa, Influenza virus
MDRAVKLYKK

SEQ ID NO: 505609 - protein, 10 aa, Influenza virus
MDRAVKLYRK

SEQ ID NO: 505610 - protein, 10 aa, Influenza virus
MDSLKLSIED

SEQ ID NO: 505611 - protein, 10 aa, Influenza virus
MDSRSGYETF

SEQ ID NO: 505612 - protein, 10 aa, Influenza virus
MDTIRNGTYN

SEQ ID NO: 505613 - protein, 10 aa, Influenza virus
MDTVNRTHQY

SEQ ID NO: 505614 - protein, 10 aa, Influenza virus
MDTVSRTHQY

SEQ ID NO: 505615 - protein, 10 aa, Influenza virus
MDVNPTLLFL

SEQ ID NO: 505616 - protein, 10 aa, Influenza virus
MDVWTYNAEL

SEQ ID NO: 505617 - protein, 10 aa, Influenza virus
MDYYWAILKP

SEQ ID NO: 505618 - protein, 10 aa, Influenza virus
MDYYWAVLKP

SEQ ID NO: 505619 - protein, 10 aa, Influenza virus
MDYYWGILKR

SEQ ID NO: 505620 - protein, 10 aa, Influenza virus
MEAIRNGTYN

SEQ ID NO: 505621 - protein, 10 aa, Influenza virus
MEAMVSRARI

SEQ ID NO: 505622 - protein, 10 aa, Influenza virus
MECRTFFLTQ

SEQ ID NO: 505623 - protein, 10 aa, Influenza virus
MEDFQLIPMI

SEQ ID NO: 505624 - protein, 10 aa, Influenza virus
MEDFVRQCFN

SEQ ID NO: 505625 - protein, 10 aa, Influenza virus
MEDGFIDVWT

SEQ ID NO: 505626 - protein, 10 aa, Influenza virus
MEDGFLDVWT

SEQ ID NO: 505627 - protein, 10 aa, Influenza virus
MEDGFLGVWT

SEQ ID NO: 505628 - protein, 10 aa, Influenza virus
MEDGFRDVWT

SEQ ID NO: 505629 - protein, 10 aa, Influenza virus
MEEFVRQCFN

SEQ ID NO: 505630 - protein, 10 aa, Influenza virus
MEEGSIGKVC

SEQ ID NO: 505631 - protein, 10 aa, Influenza virus
MEEVTNATET

SEQ ID NO: 505632 - protein, 10 aa, Influenza virus
MEFEPFQSLI

SEQ ID NO: 505633 - protein, 10 aa, Influenza virus
MEFEPFQSLV

SEQ ID NO: 505634 - protein, 10 aa, Influenza virus
MEFSLTDPKL

SEQ ID NO: 505635 - protein, 10 aa, Influenza virus
MEFSLTDPRF

SEQ ID NO: 505636 - protein, 10 aa, Influenza virus
MEFSLTDPRL

SEQ ID NO: 505637 - protein, 10 aa, Influenza virus
MEGFVRQCFN

SEQ ID NO: 505638 - protein, 10 aa, Influenza virus
MEGICYPGSI

SEQ ID NO: 505639 - protein, 10 aa, Influenza virus
MEGICYPGSV

SEQ ID NO: 505640 - protein, 10 aa, Influenza virus
MEGVCYPGSI

SEQ ID NO: 505641 - protein, 10 aa, Influenza virus
MEHTSQYLCT

SEQ ID NO: 505642 - protein, 10 aa, Influenza virus
MEKNITVTHA

SEQ ID NO: 505643 - protein, 10 aa, Influenza virus
MEKNVAVTHA

SEQ ID NO: 505644 - protein, 10 aa, Influenza virus
MEKNVTVTHA

SEQ ID NO: 505645 - protein, 10 aa, Influenza virus
MEKNVTVTQA

SEQ ID NO: 505646 - protein, 10 aa, Influenza virus
MELIRMIKRG

SEQ ID NO: 505647 - protein, 10 aa, Influenza virus
MELIRMVKRG

SEQ ID NO: 505648 - protein, 10 aa, Influenza virus
MELPSFGVSG

SEQ ID NO: 505649 - protein, 10 aa, Influenza virus
MELRRCLLQS

SEQ ID NO: 505650 - protein, 10 aa, Influenza virus
MELVRMIKRG

SEQ ID NO: 505651 - protein, 10 aa, Influenza virus
MEMRRCLLQS

SEQ ID NO: 505652 - protein, 10 aa, Influenza virus
MENEMTLDFH

SEQ ID NO: 505653 - protein, 10 aa, Influenza virus
MENERILDFH

SEQ ID NO: 505654 - protein, 10 aa, Influenza virus
MENERTLDFH

SEQ ID NO: 505655 - protein, 10 aa, Influenza virus
MENERTLDLH

SEQ ID NO: 505656 - protein, 10 aa, Influenza virus
MENERTLDYH

SEQ ID NO: 505657 - protein, 10 aa, Influenza virus
MENERTLEFH

SEQ ID NO: 505658 - protein, 10 aa, Influenza virus
MENERTLYFH

SEQ ID NO: 505659 - protein, 10 aa, Influenza virus
MENFVRQCFN

SEQ ID NO: 505660 - protein, 10 aa, Influenza virus
MENLNKKVDD

SEQ ID NO: 505661 - protein, 10 aa, Influenza virus
MENQHTIDLA

SEQ ID NO: 505662 - protein, 10 aa, Influenza virus
MENQHTIDLT

SEQ ID NO: 505663 - protein, 10 aa, Influenza virus
MENQHTIDMA

SEQ ID NO: 505664 - protein, 10 aa, Influenza virus
MENQHTIEMT

SEQ ID NO: 505665 - protein, 10 aa, Influenza virus
MEQMAGSSEQ

SEQ ID NO: 505666 - protein, 10 aa, Influenza virus
MEQVAGSSEQ

SEQ ID NO: 505667 - protein, 10 aa, Influenza virus
MERIRNNTYD

SEQ ID NO: 505668 - protein, 10 aa, Influenza virus
MERNVTVTHA

SEQ ID NO: 505669 - protein, 10 aa, Influenza virus
MESGGIDKIG

SEQ ID NO: 505670 - protein, 10 aa, Influenza virus
MESGGIDKIS

SEQ ID NO: 505671 - protein, 10 aa, Influenza virus
MESGGIDKVS

SEQ ID NO: 505672 - protein, 10 aa, Influenza virus
MESGGISKIS

SEQ ID NO: 505673 - protein, 10 aa, Influenza virus
MESGGISKMS

SEQ ID NO: 505674 - protein, 10 aa, Influenza virus
MESIKNGTYD

SEQ ID NO: 505675 - protein, 10 aa, Influenza virus
MESIRDNTYD

SEQ ID NO: 505676 - protein, 10 aa, Influenza virus
MESIRNGTYD

SEQ ID NO: 505677 - protein, 10 aa, Influenza virus
MESIRNNTYD

SEQ ID NO: 505678 - protein, 10 aa, Influenza virus
MESIRNNTYN

SEQ ID NO: 505679 - protein, 10 aa, Influenza virus
MESRGLFGAI

SEQ ID NO: 505680 - protein, 10 aa, Influenza virus
MESVKNGTYD

SEQ ID NO: 505681 - protein, 10 aa, Influenza virus
MESVKNGTYN

SEQ ID NO: 505682 - protein, 10 aa, Influenza virus
MESVRNGTYD

SEQ ID NO: 505683 - protein, 10 aa, Influenza virus
METIKNGTYD

SEQ ID NO: 505684 - protein, 10 aa, Influenza virus
METIKNGTYN

SEQ ID NO: 505685 - protein, 10 aa, Influenza virus
METIRNGTYD

SEQ ID NO: 505686 - protein, 10 aa, Influenza virus
METIRNGTYN

SEQ ID NO: 505687 - protein, 10 aa, Influenza virus
MEVCFMYSDF

SEQ ID NO: 505688 - protein, 10 aa, Influenza virus
MEVVFPNEVG

SEQ ID NO: 505689 - protein, 10 aa, Influenza virus
MEWIKTRPIL

SEQ ID NO: 505690 - protein, 10 aa, Influenza virus
MEWLKTRPIL

SEQ ID NO: 505691 - protein, 10 aa, Influenza virus
MEYDAVATTH

SEQ ID NO: 505692 - protein, 10 aa, Influenza virus
MFALSQGTTL

SEQ ID NO: 505693 - protein, 10 aa, Influenza virus
MFDFIKWNVT

SEQ ID NO: 505694 - protein, 10 aa, Influenza virus
MFDFSKWNVT

SEQ ID NO: 505695 - protein, 10 aa, Influenza virus
MFDFTKWNVT

SEQ ID NO: 505696 - protein, 10 aa, Influenza virus
MFESNGGLIA

SEQ ID NO: 505697 - protein, 10 aa, Influenza virus
MFESNGGLLA

SEQ ID NO: 505698 - protein, 10 aa, Influenza virus
MFLAMITYIT

SEQ ID NO: 505699 - protein, 10 aa, Influenza virus
MFLYIRTNGT

SEQ ID NO: 505700 - protein, 10 aa, Influenza virus
MFLYVRTNGT

SEQ ID NO: 505701 - protein, 10 aa, Influenza virus
MFNMLSTVLG

SEQ ID NO: 505702 - protein, 10 aa, Influenza virus
MFSNKMARLG

SEQ ID NO: 505703 - protein, 10 aa, Influenza virus
MFSNKVARLG

SEQ ID NO: 505704 - protein, 10 aa, Influenza virus
MGARPQVNGQ

SEQ ID NO: 505705 - protein, 10 aa, Influenza virus
MGAYQILAIY

SEQ ID NO: 505706 - protein, 10 aa, Influenza virus
MGDFVRQCFN

SEQ ID NO: 505707 - protein, 10 aa, Influenza virus
MGDSEMLNLY

SEQ ID NO: 505708 - protein, 10 aa, Influenza virus
MGEAMVSRAR

SEQ ID NO: 505709 - protein, 10 aa, Influenza virus
MGECPEYVKK

SEQ ID NO: 505710 - protein, 10 aa, Influenza virus
MGECPKYAKK

SEQ ID NO: 505711 - protein, 10 aa, Influenza virus
MGECPKYVKK

SEQ ID NO: 505712 - protein, 10 aa, Influenza virus
MGECPKYVKS

SEQ ID NO: 505713 - protein, 10 aa, Influenza virus
MGECPKYVRK

SEQ ID NO: 505714 - protein, 10 aa, Influenza virus
MGECPNYVKK

SEQ ID NO: 505715 - protein, 10 aa, Influenza virus
MGFRYSGIKT

SEQ ID NO: 505716 - protein, 10 aa, Influenza virus
MGFRYSGIRT

SEQ ID NO: 505717 - protein, 10 aa, Influenza virus
MGFTYSGIRT

SEQ ID NO: 505718 - protein, 10 aa, Influenza virus
MGFTYTGVRT

SEQ ID NO: 505719 - protein, 10 aa, Influenza virus
MGIYQILAIY

SEQ ID NO: 505720 - protein, 10 aa, Influenza virus
MGKCNTKCQT

SEQ ID NO: 505721 - protein, 10 aa, Influenza virus
MGKVECVCRD

SEQ ID NO: 505722 - protein, 10 aa, Influenza virus
MGLFFFCLKN

SEQ ID NO: 505723 - protein, 10 aa, Influenza virus
MGLIFMCVKN

SEQ ID NO: 505724 - protein, 10 aa, Influenza virus
MGLIYNRMGA

SEQ ID NO: 505725 - protein, 10 aa, Influenza virus
MGLIYNRMGT

SEQ ID NO: 505726 - protein, 10 aa, Influenza virus
MGLKISSSFS

SEQ ID NO: 505727 - protein, 10 aa, Influenza virus
MGLRISSSFS

SEQ ID NO: 505728 - protein, 10 aa, Influenza virus
MGLTYNGIRT

SEQ ID NO: 505729 - protein, 10 aa, Influenza virus
MGLVFFCLKN

SEQ ID NO: 505730 - protein, 10 aa, Influenza virus
MGLVFFCLRN

SEQ ID NO: 505731 - protein, 10 aa, Influenza virus
MGLVFICIKN

SEQ ID NO: 505732 - protein, 10 aa, Influenza virus
MGLVFICMKN

SEQ ID NO: 505733 - protein, 10 aa, Influenza virus
MGLVFICVKN

SEQ ID NO: 505734 - protein, 10 aa, Influenza virus
MGLVFMCVKN

SEQ ID NO: 505735 - protein, 10 aa, Influenza virus
MGMAADKEST

SEQ ID NO: 505736 - protein, 10 aa, Influenza virus
MGMFNMLSTV

SEQ ID NO: 505737 - protein, 10 aa, Influenza virus
MGNGCFEFYH

SEQ ID NO: 505738 - protein, 10 aa, Influenza virus
MGNGCFKIYH

SEQ ID NO: 505739 - protein, 10 aa, Influenza virus
MGNGCFRIYH

SEQ ID NO: 505740 - protein, 10 aa, Influenza virus
MGNGCFTIYH

SEQ ID NO: 505741 - protein, 10 aa, Influenza virus
MGNGCLKIYH

SEQ ID NO: 505742 - protein, 10 aa, Influenza virus
MGQAADLKST

SEQ ID NO: 505743 - protein, 10 aa, Influenza virus
MGQQGRMDYY

SEQ ID NO: 505744 - protein, 10 aa, Influenza virus
MGRTISKDSR

SEQ ID NO: 505745 - protein, 10 aa, Influenza virus
MGRTISMDSR

SEQ ID NO: 505746 - protein, 10 aa, Influenza virus
MGRTISRDSR

SEQ ID NO: 505747 - protein, 10 aa, Influenza virus
MGSIRNNTYD

SEQ ID NO: 505748 - protein, 10 aa, Influenza virus
MGTAPVLGNY

SEQ ID NO: 505749 - protein, 10 aa, Influenza virus
MGVAPSPSNS

SEQ ID NO: 505750 - protein, 10 aa, Influenza virus
MGVDEYSNAE

SEQ ID NO: 505751 - protein, 10 aa, Influenza virus
MGVDEYSSAE

SEQ ID NO: 505752 - protein, 10 aa, Influenza virus
MGVDEYSSTE

SEQ ID NO: 505753 - protein, 10 aa, Influenza virus
MGVQMQRFRR

SEQ ID NO: 505754 - protein, 10 aa, Influenza virus
MGVYQILAIY

SEQ ID NO: 505755 - protein, 10 aa, Influenza virus
MGVYQILVIY

SEQ ID NO: 505756 - protein, 10 aa, Influenza virus
MGYICSGIFG

SEQ ID NO: 505757 - protein, 10 aa, Influenza virus
MGYICSGVFG

SEQ ID NO: 505758 - protein, 10 aa, Influenza virus
MGYKDIILWI

SEQ ID NO: 505759 - protein, 10 aa, Influenza virus
MHDANVKNLH

SEQ ID NO: 505760 - protein, 10 aa, Influenza virus
MHDANVRNLH

SEQ ID NO: 505761 - protein, 10 aa, Influenza virus
MHDRSPFRAL

SEQ ID NO: 505762 - protein, 10 aa, Influenza virus
MHDRTKIRQL

SEQ ID NO: 505763 - protein, 10 aa, Influenza virus
MHQLLRHFQK

SEQ ID NO: 505764 - protein, 10 aa, Influenza virus
MIADRVDDAV

SEQ ID NO: 505765 - protein, 10 aa, Influenza virus
MIALILVALA

SEQ ID NO: 505766 - protein, 10 aa, Influenza virus
MIDGWYGFHH

SEQ ID NO: 505767 - protein, 10 aa, Influenza virus
MIDGWYGFRH

SEQ ID NO: 505768 - protein, 10 aa, Influenza virus
MIDGWYGYHH

SEQ ID NO: 505769 - protein, 10 aa, Influenza virus
MIEAESSIKE

SEQ ID NO: 505770 - protein, 10 aa, Influenza virus
MIEAESSVKE

SEQ ID NO: 505771 - protein, 10 aa, Influenza virus
MIEAESSVRE

SEQ ID NO: 505772 - protein, 10 aa, Influenza virus
MIIGGFIFGC

SEQ ID NO: 505773 - protein, 10 aa, Influenza virus
MIKAVRGDLN

SEQ ID NO: 505774 - protein, 10 aa, Influenza virus
MIKRGINDRN

SEQ ID NO: 505775 - protein, 10 aa, Influenza virus
MIKRGVNDRN

SEQ ID NO: 505776 - protein, 10 aa, Influenza virus
MINDKIDDQI

SEQ ID NO: 505777 - protein, 10 aa, Influenza virus
MINDKINDQI

SEQ ID NO: 505778 - protein, 10 aa, Influenza virus
MINNDLGPAT

SEQ ID NO: 505779 - protein, 10 aa, Influenza virus
MINPVKLSGG

SEQ ID NO: 505780 - protein, 10 aa, Influenza virus
MINPVKLSSG

SEQ ID NO: 505781 - protein, 10 aa, Influenza virus
MIRGQPKEKA

SEQ ID NO: 505782 - protein, 10 aa, Influenza virus
MIRGQPKEKT

SEQ ID NO: 505783 - protein, 10 aa, Influenza virus
MIRGQPNERT

SEQ ID NO: 505784 - protein, 10 aa, Influenza virus
MISDKIDDQI

SEQ ID NO: 505785 - protein, 10 aa, Influenza virus
MISKCKTKEG

SEQ ID NO: 505786 - protein, 10 aa, Influenza virus
MISKCRTKEG

SEQ ID NO: 505787 - protein, 10 aa, Influenza virus
MISKCRTREG

SEQ ID NO: 505788 - protein, 10 aa, Influenza virus
MISKSRTKEG

SEQ ID NO: 505789 - protein, 10 aa, Influenza virus
MISPLAVTWW

SEQ ID NO: 505790 - protein, 10 aa, Influenza virus
MISRARIDAR

SEQ ID NO: 505791 - protein, 10 aa, Influenza virus
MITQRTIGKK

SEQ ID NO: 505792 - protein, 10 aa, Influenza virus
MIWDANGWVS

SEQ ID NO: 505793 - protein, 10 aa, Influenza virus
MIWHSNLNDA

SEQ ID NO: 505794 - protein, 10 aa, Influenza virus
MIWHSNLNDT

SEQ ID NO: 505795 - protein, 10 aa, Influenza virus
MKDRSPYRTL

SEQ ID NO: 505796 - protein, 10 aa, Influenza virus
MKGVYINTAL

SEQ ID NO: 505797 - protein, 10 aa, Influenza virus
MKGVYINTAM

SEQ ID NO: 505798 - protein, 10 aa, Influenza virus
MKGVYMNTAL

SEQ ID NO: 505799 - protein, 10 aa, Influenza virus
MKGVYVNTAL

SEQ ID NO: 505800 - protein, 10 aa, Influenza virus
MKHTSQYICS

SEQ ID NO: 505801 - protein, 10 aa, Influenza virus
MKHTSQYLCT

SEQ ID NO: 505802 - protein, 10 aa, Influenza virus
MKIIRVGCVI

SEQ ID NO: 505803 - protein, 10 aa, Influenza virus
MKIYWHLMHP

SEQ ID NO: 505804 - protein, 10 aa, Influenza virus
MKLYWHLMHP

SEQ ID NO: 505805 - protein, 10 aa, Influenza virus
MKLYWHLMRP

SEQ ID NO: 505806 - protein, 10 aa, Influenza virus
MKLYWHLMSP

SEQ ID NO: 505807 - protein, 10 aa, Influenza virus
MKNVPEKIHT

SEQ ID NO: 505808 - protein, 10 aa, Influenza virus
MKNVPEKIRT

SEQ ID NO: 505809 - protein, 10 aa, Influenza virus
MKNVPEKIRV

SEQ ID NO: 505810 - protein, 10 aa, Influenza virus
MKRKRDSSIL

SEQ ID NO: 505811 - protein, 10 aa, Influenza virus
MKRKRNSSIL

SEQ ID NO: 505812 - protein, 10 aa, Influenza virus
MKSRGYKMNT

SEQ ID NO: 505813 - protein, 10 aa, Influenza virus
MKTIIIVLSC

SEQ ID NO: 505814 - protein, 10 aa, Influenza virus
MKWGMELRRC

SEQ ID NO: 505815 - protein, 10 aa, Influenza virus
MKWGMEMRRC

SEQ ID NO: 505816 - protein, 10 aa, Influenza virus
MKWLLSNADN

SEQ ID NO: 505817 - protein, 10 aa, Influenza virus
MKWLLSNNDN

SEQ ID NO: 505818 - protein, 10 aa, Influenza virus
MKWLLSNSDN

SEQ ID NO: 505819 - protein, 10 aa, Influenza virus
MKWLLSNSNN

SEQ ID NO: 505820 - protein, 10 aa, Influenza virus
MKWLLSNTDN

SEQ ID NO: 505821 - protein, 10 aa, Influenza virus
MKWLLSSKAN

SEQ ID NO: 505822 - protein, 10 aa, Influenza virus
MKWLLSSKDN

SEQ ID NO: 505823 - protein, 10 aa, Influenza virus
MKWLLSSSDN

SEQ ID NO: 505824 - protein, 10 aa, Influenza virus
MKWLLSSTDN

SEQ ID NO: 505825 - protein, 10 aa, Influenza virus
MKWLSSSGNN

SEQ ID NO: 505826 - protein, 10 aa, Influenza virus
MKWLSSSMNN

SEQ ID NO: 505827 - protein, 10 aa, Influenza virus
MKWLTLKSGQ

SEQ ID NO: 505828 - protein, 10 aa, Influenza virus
MKWMMAMKYP

SEQ ID NO: 505829 - protein, 10 aa, Influenza virus
MKWMMAMRYP

SEQ ID NO: 505830 - protein, 10 aa, Influenza virus
MLADRIDDAV

SEQ ID NO: 505831 - protein, 10 aa, Influenza virus
MLADRVDDAV

SEQ ID NO: 505832 - protein, 10 aa, Influenza virus
MLADWVDDAV

SEQ ID NO: 505833 - protein, 10 aa, Influenza virus
MLATGMKNVP

SEQ ID NO: 505834 - protein, 10 aa, Influenza virus
MLATGMRNIP

SEQ ID NO: 505835 - protein, 10 aa, Influenza virus
MLATGMRNVP

SEQ ID NO: 505836 - protein, 10 aa, Influenza virus
MLCLGHHAVP

SEQ ID NO: 505837 - protein, 10 aa, Influenza virus
MLERELVRKT

SEQ ID NO: 505838 - protein, 10 aa, Influenza virus
MLFVQSYFQL

SEQ ID NO: 505839 - protein, 10 aa, Influenza virus
MLGFVFTLTV

SEQ ID NO: 505840 - protein, 10 aa, Influenza virus
MLKIHNAGTD

SEQ ID NO: 505841 - protein, 10 aa, Influenza virus
MLKIPNAETD

SEQ ID NO: 505842 - protein, 10 aa, Influenza virus
MLKIPNAGID

SEQ ID NO: 505843 - protein, 10 aa, Influenza virus
MLKIPNAGTD

SEQ ID NO: 505844 - protein, 10 aa, Influenza virus
MLKMSLLTEV

SEQ ID NO: 505845 - protein, 10 aa, Influenza virus
MLKVPNAGTD

SEQ ID NO: 505846 - protein, 10 aa, Influenza virus
MLKVPNALID

SEQ ID NO: 505847 - protein, 10 aa, Influenza virus
MLKVPNALTD

SEQ ID NO: 505848 - protein, 10 aa, Influenza virus
MLLAIAMGLI

SEQ ID NO: 505849 - protein, 10 aa, Influenza virus
MLLDPGDTVT

SEQ ID NO: 505850 - protein, 10 aa, Influenza virus
MLNASCAAMD

SEQ ID NO: 505851 - protein, 10 aa, Influenza virus
MLNKSLCKIE

SEQ ID NO: 505852 - protein, 10 aa, Influenza virus
MLNKSLCKVE

SEQ ID NO: 505853 - protein, 10 aa, Influenza virus
MLNLYDRVRK

SEQ ID NO: 505854 - protein, 10 aa, Influenza virus
MLNLYERVRK

SEQ ID NO: 505855 - protein, 10 aa, Influenza virus
MLQSRTREIL

SEQ ID NO: 505856 - protein, 10 aa, Influenza virus
MLRIPNAGID

SEQ ID NO: 505857 - protein, 10 aa, Influenza virus
MLSKSLCKVE

SEQ ID NO: 505858 - protein, 10 aa, Influenza virus
MLSLIMRTVI

SEQ ID NO: 505859 - protein, 10 aa, Influenza virus
MLSTVLGVSI

SEQ ID NO: 505860 - protein, 10 aa, Influenza virus
MLTGNLQTLK

SEQ ID NO: 505861 - protein, 10 aa, Influenza virus
MMAMKYPITA

SEQ ID NO: 505862 - protein, 10 aa, Influenza virus
MMAMRYPITA

SEQ ID NO: 505863 - protein, 10 aa, Influenza virus
MMAYMLEREL

SEQ ID NO: 505864 - protein, 10 aa, Influenza virus
MMDGWYGFRH

SEQ ID NO: 505865 - protein, 10 aa, Influenza virus
MMDQVREGRN

SEQ ID NO: 505866 - protein, 10 aa, Influenza virus
MMDQVRESRN

SEQ ID NO: 505867 - protein, 10 aa, Influenza virus
MMEAMVSRAR

SEQ ID NO: 505868 - protein, 10 aa, Influenza virus
MMGMFNMLST

SEQ ID NO: 505869 - protein, 10 aa, Influenza virus
MMIWHSNLND

SEQ ID NO: 505870 - protein, 10 aa, Influenza virus
MMKAVRGDLN

SEQ ID NO: 505871 - protein, 10 aa, Influenza virus
MMMGMFNMLS

SEQ ID NO: 505872 - protein, 10 aa, Influenza virus
MMSRARIDAR

SEQ ID NO: 505873 - protein, 10 aa, Influenza virus
MMTHTSQYIC

SEQ ID NO: 505874 - protein, 10 aa, Influenza virus
MMWEINGPDS

SEQ ID NO: 505875 - protein, 10 aa, Influenza virus
MMWEINGPES

SEQ ID NO: 505876 - protein, 10 aa, Influenza virus
MMWEVNGPES

SEQ ID NO: 505877 - protein, 10 aa, Influenza virus
MNELGIPFHL

SEQ ID NO: 505878 - protein, 10 aa, Influenza virus
MNELGVPFHL

SEQ ID NO: 505879 - protein, 10 aa, Influenza virus
MNELGVPFYL

SEQ ID NO: 505880 - protein, 10 aa, Influenza virus
MNELGVSFHL

SEQ ID NO: 505881 - protein, 10 aa, Influenza virus
MNGNYDSIRG

SEQ ID NO: 505882 - protein, 10 aa, Influenza virus
MNGQSGRIDF

SEQ ID NO: 505883 - protein, 10 aa, Influenza virus
MNIQFEAVGR

SEQ ID NO: 505884 - protein, 10 aa, Influenza virus
MNIQFTAVGK

SEQ ID NO: 505885 - protein, 10 aa, Influenza virus
MNIQFTSVGK

SEQ ID NO: 505886 - protein, 10 aa, Influenza virus
MNKLFERVRR

SEQ ID NO: 505887 - protein, 10 aa, Influenza virus
MNKLYEKVRR

SEQ ID NO: 505888 - protein, 10 aa, Influenza virus
MNKLYERVKR

SEQ ID NO: 505889 - protein, 10 aa, Influenza virus
MNKLYERVRK

SEQ ID NO: 505890 - protein, 10 aa, Influenza virus
MNKLYERVRR

SEQ ID NO: 505891 - protein, 10 aa, Influenza virus
MNLLIGISNV

SEQ ID NO: 505892 - protein, 10 aa, Influenza virus
MNNEGSYFFG

SEQ ID NO: 505893 - protein, 10 aa, Influenza virus
MNNETILETG

SEQ ID NO: 505894 - protein, 10 aa, Influenza virus
MNNQVFPQLN

SEQ ID NO: 505895 - protein, 10 aa, Influenza virus
MNPNQKIICI

SEQ ID NO: 505896 - protein, 10 aa, Influenza virus
MNPNQKIITI

SEQ ID NO: 505897 - protein, 10 aa, Influenza virus
MNPNQKILCA

SEQ ID NO: 505898 - protein, 10 aa, Influenza virus
MNPNQKILCT

SEQ ID NO: 505899 - protein, 10 aa, Influenza virus
MNPNQKILFA

SEQ ID NO: 505900 - protein, 10 aa, Influenza virus
MNPNQKIMCI

SEQ ID NO: 505901 - protein, 10 aa, Influenza virus
MNPNQKITCI

SEQ ID NO: 505902 - protein, 10 aa, Influenza virus
MNPNQKLFAL

SEQ ID NO: 505903 - protein, 10 aa, Influenza virus
MNPNQKLFAS

SEQ ID NO: 505904 - protein, 10 aa, Influenza virus
MNPNQKLFTL

SEQ ID NO: 505905 - protein, 10 aa, Influenza virus
MNPNQKTITI

SEQ ID NO: 505906 - protein, 10 aa, Influenza virus
MNPNQMIITI

SEQ ID NO: 505907 - protein, 10 aa, Influenza virus
MNPNQNLFTL

SEQ ID NO: 505908 - protein, 10 aa, Influenza virus
MNPNQRILCT

SEQ ID NO: 505909 - protein, 10 aa, Influenza virus
MNPNQSIITI

SEQ ID NO: 505910 - protein, 10 aa, Influenza virus
MNPSQKLFAL

SEQ ID NO: 505911 - protein, 10 aa, Influenza virus
MNREFEVMNH

SEQ ID NO: 505912 - protein, 10 aa, Influenza virus
MNREFEVVDH

SEQ ID NO: 505913 - protein, 10 aa, Influenza virus
MNREFEVVNH

SEQ ID NO: 505914 - protein, 10 aa, Influenza virus
MNREFGVVNH

SEQ ID NO: 505915 - protein, 10 aa, Influenza virus
MNTALLNASC

SEQ ID NO: 505916 - protein, 10 aa, Influenza virus
MNTQFEAIGR

SEQ ID NO: 505917 - protein, 10 aa, Influenza virus
MNTQFEAVGK

SEQ ID NO: 505918 - protein, 10 aa, Influenza virus
MNTQFEAVGR

SEQ ID NO: 505919 - protein, 10 aa, Influenza virus
MNTQFETVGK

SEQ ID NO: 505920 - protein, 10 aa, Influenza virus
MNTQFTAVGK

SEQ ID NO: 505921 - protein, 10 aa, Influenza virus
MNTQFTSVGK

SEQ ID NO: 505922 - protein, 10 aa, Influenza virus
MNTQFTVVGK

SEQ ID NO: 505923 - protein, 10 aa, Influenza virus
MNTQIIVILV

SEQ ID NO: 505924 - protein, 10 aa, Influenza virus
MNTSKPFQNI

SEQ ID NO: 505925 - protein, 10 aa, Influenza virus
MNTSKPFQNT

SEQ ID NO: 505926 - protein, 10 aa, Influenza virus
MNTSKPLQNT

SEQ ID NO: 505927 - protein, 10 aa, Influenza virus
MNWSGYSGSF

SEQ ID NO: 505928 - protein, 10 aa, Influenza virus
MPASRYLTDM

SEQ ID NO: 505929 - protein, 10 aa, Influenza virus
MPFHNIHPLT

SEQ ID NO: 505930 - protein, 10 aa, Influenza virus
MPFHNVHPLT

SEQ ID NO: 505931 - protein, 10 aa, Influenza virus
MPLHNIHPLT

SEQ ID NO: 505932 - protein, 10 aa, Influenza virus
MQALQLLFEV

SEQ ID NO: 505933 - protein, 10 aa, Influenza virus
MQALQLLLEV

SEQ ID NO: 505934 - protein, 10 aa, Influenza virus
MQFSSFTVNV

SEQ ID NO: 505935 - protein, 10 aa, Influenza virus
MQFSSLAVNV

SEQ ID NO: 505936 - protein, 10 aa, Influenza virus
MQFSSLTVNV

SEQ ID NO: 505937 - protein, 10 aa, Influenza virus
MQFSSLTVSV

SEQ ID NO: 505938 - protein, 10 aa, Influenza virus
MQGSTLPRRS

SEQ ID NO: 505939 - protein, 10 aa, Influenza virus
MQIRGFVHFV

SEQ ID NO: 505940 - protein, 10 aa, Influenza virus
MQIRGFVYFV

SEQ ID NO: 505941 - protein, 10 aa, Influenza virus
MQLKDNAKEV

SEQ ID NO: 505942 - protein, 10 aa, Influenza virus
MQLRDNAKEI

SEQ ID NO: 505943 - protein, 10 aa, Influenza virus
MQLRDNAKEL

SEQ ID NO: 505944 - protein, 10 aa, Influenza virus
MQLRDNAKET

SEQ ID NO: 505945 - protein, 10 aa, Influenza virus
MQLRDNVKEL

SEQ ID NO: 505946 - protein, 10 aa, Influenza virus
MQNGSCRCMF

SEQ ID NO: 505947 - protein, 10 aa, Influenza virus
MQNGSYRCMF

SEQ ID NO: 505948 - protein, 10 aa, Influenza virus
MQNKLNNVID

SEQ ID NO: 505949 - protein, 10 aa, Influenza virus
MQNRIQIDPV

SEQ ID NO: 505950 - protein, 10 aa, Influenza virus
MQNRLNNVID

SEQ ID NO: 505951 - protein, 10 aa, Influenza virus
MQRFRRPDSS

SEQ ID NO: 505952 - protein, 10 aa, Influenza virus
MRCTISLVKT

SEQ ID NO: 505953 - protein, 10 aa, Influenza virus
MRDILGTFDT

SEQ ID NO: 505954 - protein, 10 aa, Influenza virus
MRDSIKSWRN

SEQ ID NO: 505955 - protein, 10 aa, Influenza virus
MRDVIGTFDT

SEQ ID NO: 505956 - protein, 10 aa, Influenza virus
MRDVLGTFDT

SEQ ID NO: 505957 - protein, 10 aa, Influenza virus
MREPFISCSH

SEQ ID NO: 505958 - protein, 10 aa, Influenza virus
MRFTYSGIRT

SEQ ID NO: 505959 - protein, 10 aa, Influenza virus
MRILIRGNSP

SEQ ID NO: 505960 - protein, 10 aa, Influenza virus
MRILVRGNSP

SEQ ID NO: 505961 - protein, 10 aa, Influenza virus
MRINNETILE

SEQ ID NO: 505962 - protein, 10 aa, Influenza virus
MRISNETILE

SEQ ID NO: 505963 - protein, 10 aa, Influenza virus
MRIWRQANNG

SEQ ID NO: 505964 - protein, 10 aa, Influenza virus
MRKKRGLFGA

SEQ ID NO: 505965 - protein, 10 aa, Influenza virus
MRNIPEKQTR

SEQ ID NO: 505966 - protein, 10 aa, Influenza virus
MRNIPERQTR

SEQ ID NO: 505967 - protein, 10 aa, Influenza virus
MRNIPGKQAK

SEQ ID NO: 505968 - protein, 10 aa, Influenza virus
MRNVPEKQTR

SEQ ID NO: 505969 - protein, 10 aa, Influenza virus
MRNVPERQTR

SEQ ID NO: 505970 - protein, 10 aa, Influenza virus
MRNVPETQTR

SEQ ID NO: 505971 - protein, 10 aa, Influenza virus
MRPCFWVELI

SEQ ID NO: 505972 - protein, 10 aa, Influenza virus
MRPCFWVELV

SEQ ID NO: 505973 - protein, 10 aa, Influenza virus
MRRCLLQSLQ

SEQ ID NO: 505974 - protein, 10 aa, Influenza virus
MRTPIAFLTS

SEQ ID NO: 505975 - protein, 10 aa, Influenza virus
MRTQESECAC

SEQ ID NO: 505976 - protein, 10 aa, Influenza virus
MRTQESECVC

SEQ ID NO: 505977 - protein, 10 aa, Influenza virus
MRTQESSCTC

SEQ ID NO: 505978 - protein, 10 aa, Influenza virus
MRVLIRGNSP

SEQ ID NO: 505979 - protein, 10 aa, Influenza virus
MRWLTLKLGQ

SEQ ID NO: 505980 - protein, 10 aa, Influenza virus
MRWLTLKSEQ

SEQ ID NO: 505981 - protein, 10 aa, Influenza virus
MRWLTLKSGQ

SEQ ID NO: 505982 - protein, 10 aa, Influenza virus
MSCFVFVALI

SEQ ID NO: 505983 - protein, 10 aa, Influenza virus
MSCPIGEAPS

SEQ ID NO: 505984 - protein, 10 aa, Influenza virus
MSCPIGEVPS

SEQ ID NO: 505985 - protein, 10 aa, Influenza virus
MSCPIGVAPS

SEQ ID NO: 505986 - protein, 10 aa, Influenza virus
MSCPIGVVPS

SEQ ID NO: 505987 - protein, 10 aa, Influenza virus
MSCPLGEAPS

SEQ ID NO: 505988 - protein, 10 aa, Influenza virus
MSCPMGVAPS

SEQ ID NO: 505989 - protein, 10 aa, Influenza virus
MSCPVGEAPS

SEQ ID NO: 505990 - protein, 10 aa, Influenza virus
MSCPVGVAPS

SEQ ID NO: 505991 - protein, 10 aa, Influenza virus
MSDIEAMASQ

SEQ ID NO: 505992 - protein, 10 aa, Influenza virus
MSDIEAMATQ

SEQ ID NO: 505993 - protein, 10 aa, Influenza virus
MSDIEIMASQ

SEQ ID NO: 505994 - protein, 10 aa, Influenza virus
MSDINIMASQ

SEQ ID NO: 505995 - protein, 10 aa, Influenza virus
MSELGVPFHL

SEQ ID NO: 505996 - protein, 10 aa, Influenza virus
MSFQGRGVFE

SEQ ID NO: 505997 - protein, 10 aa, Influenza virus
MSGPNDNASA

SEQ ID NO: 505998 - protein, 10 aa, Influenza virus
MSGPNNNASA

SEQ ID NO: 505999 - protein, 10 aa, Influenza virus
MSGYSGIFSV

SEQ ID NO: 506000 - protein, 10 aa, Influenza virus
MSICISGPNN

SEQ ID NO: 506001 - protein, 10 aa, Influenza virus
MSICMSGPND

SEQ ID NO: 506002 - protein, 10 aa, Influenza virus
MSICMSGPNN

SEQ ID NO: 506003 - protein, 10 aa, Influenza virus
MSICVSGPNN

SEQ ID NO: 506004 - protein, 10 aa, Influenza virus
MSIGITVIKN

SEQ ID NO: 506005 - protein, 10 aa, Influenza virus
MSIGVAVIKN

SEQ ID NO: 506006 - protein, 10 aa, Influenza virus
MSIGVTVIKN

SEQ ID NO: 506007 - protein, 10 aa, Influenza virus
MSIGVTVIRN

SEQ ID NO: 506008 - protein, 10 aa, Influenza virus
MSKEGSYFFG

SEQ ID NO: 506009 - protein, 10 aa, Influenza virus
MSKKKSYINK

SEQ ID NO: 506010 - protein, 10 aa, Influenza virus
MSKKKSYINR

SEQ ID NO: 506011 - protein, 10 aa, Influenza virus
MSKRKSYINK

SEQ ID NO: 506012 - protein, 10 aa, Influenza virus
MSLLTEVETH

SEQ ID NO: 506013 - protein, 10 aa, Influenza virus
MSLLTEVETL

SEQ ID NO: 506014 - protein, 10 aa, Influenza virus
MSLLTEVETP

SEQ ID NO: 506015 - protein, 10 aa, Influenza virus
MSLLTEVETY

SEQ ID NO: 506016 - protein, 10 aa, Influenza virus
MSNEGSYFFG

SEQ ID NO: 506017 - protein, 10 aa, Influenza virus
MSNNSTEKVD

SEQ ID NO: 506018 - protein, 10 aa, Influenza virus
MSQLTEVETP

SEQ ID NO: 506019 - protein, 10 aa, Influenza virus
MSQSRTREIL

SEQ ID NO: 506020 - protein, 10 aa, Influenza virus
MSQSRTRGIL

SEQ ID NO: 506021 - protein, 10 aa, Influenza virus
MSRARIDARI

SEQ ID NO: 506022 - protein, 10 aa, Influenza virus
MSTNAYDRIC

SEQ ID NO: 506023 - protein, 10 aa, Influenza virus
MSTPLGTPPT

SEQ ID NO: 506024 - protein, 10 aa, Influenza virus
MSVCISGPNN

SEQ ID NO: 506025 - protein, 10 aa, Influenza virus
MSVCMSGPNN

SEQ ID NO: 506026 - protein, 10 aa, Influenza virus
MSVPLGSSPN

SEQ ID NO: 506027 - protein, 10 aa, Influenza virus
MSVPLGSSSN

SEQ ID NO: 506028 - protein, 10 aa, Influenza virus
MSVPMGSSPN

SEQ ID NO: 506029 - protein, 10 aa, Influenza virus
MTDGNASGKA

SEQ ID NO: 506030 - protein, 10 aa, Influenza virus
MTDGPANKQA

SEQ ID NO: 506031 - protein, 10 aa, Influenza virus
MTDGPANNQA

SEQ ID NO: 506032 - protein, 10 aa, Influenza virus
MTDGPANRQA

SEQ ID NO: 506033 - protein, 10 aa, Influenza virus
MTDGPANSQA

SEQ ID NO: 506034 - protein, 10 aa, Influenza virus
MTDGPASNQA

SEQ ID NO: 506035 - protein, 10 aa, Influenza virus
MTDGPASSQA

SEQ ID NO: 506036 - protein, 10 aa, Influenza virus
MTDGPSDAQA

SEQ ID NO: 506037 - protein, 10 aa, Influenza virus
MTDGSANSQA

SEQ ID NO: 506038 - protein, 10 aa, Influenza virus
MTDGSASGKA

SEQ ID NO: 506039 - protein, 10 aa, Influenza virus
MTDGSASGQA

SEQ ID NO: 506040 - protein, 10 aa, Influenza virus
MTDGSASGRA

SEQ ID NO: 506041 - protein, 10 aa, Influenza virus
MTDGSASRKA

SEQ ID NO: 506042 - protein, 10 aa, Influenza virus
MTDGSASSQA

SEQ ID NO: 506043 - protein, 10 aa, Influenza virus
MTDGSASSRA

SEQ ID NO: 506044 - protein, 10 aa, Influenza virus
MTDSEMLNLY

SEQ ID NO: 506045 - protein, 10 aa, Influenza virus
MTDSEMNKLF

SEQ ID NO: 506046 - protein, 10 aa, Influenza virus
MTDSIKSWRK

SEQ ID NO: 506047 - protein, 10 aa, Influenza virus
MTDSIKSWRR

SEQ ID NO: 506048 - protein, 10 aa, Influenza virus
MTEIWSYNAE

SEQ ID NO: 506049 - protein, 10 aa, Influenza virus
MTELGVPFHL

SEQ ID NO: 506050 - protein, 10 aa, Influenza virus
MTEVWSYNAE

SEQ ID NO: 506051 - protein, 10 aa, Influenza virus
MTHISKYLCS

SEQ ID NO: 506052 - protein, 10 aa, Influenza virus
MTHMSKYLCS

SEQ ID NO: 506053 - protein, 10 aa, Influenza virus
MTHSSKYLCS

SEQ ID NO: 506054 - protein, 10 aa, Influenza virus
MTHTSKYLCS

SEQ ID NO: 506055 - protein, 10 aa, Influenza virus
MTHTSQYICS

SEQ ID NO: 506056 - protein, 10 aa, Influenza virus
MTHTSRYLCS

SEQ ID NO: 506057 - protein, 10 aa, Influenza virus
MTIASDILKR

SEQ ID NO: 506058 - protein, 10 aa, Influenza virus
MTIASDILTR

SEQ ID NO: 506059 - protein, 10 aa, Influenza virus
MTICIQGNND

SEQ ID NO: 506060 - protein, 10 aa, Influenza virus
MTICVQGKND

SEQ ID NO: 506061 - protein, 10 aa, Influenza virus
MTICVQGNND

SEQ ID NO: 506062 - protein, 10 aa, Influenza virus
MTICVQGNNK

SEQ ID NO: 506063 - protein, 10 aa, Influenza virus
MTICVQGNNN

SEQ ID NO: 506064 - protein, 10 aa, Influenza virus
MTKDAERGKL

SEQ ID NO: 506065 - protein, 10 aa, Influenza virus
MTLDFHDSNV

SEQ ID NO: 506066 - protein, 10 aa, Influenza virus
MTRGLFGAIA

SEQ ID NO: 506067 - protein, 10 aa, Influenza virus
MVAYMLEREL

SEQ ID NO: 506068 - protein, 10 aa, Influenza virus
MVDGWYGFHH

SEQ ID NO: 506069 - protein, 10 aa, Influenza virus
MVDGWYGFRH

SEQ ID NO: 506070 - protein, 10 aa, Influenza virus
MVDGWYGFRY

SEQ ID NO: 506071 - protein, 10 aa, Influenza virus
MVDGWYGYHH

SEQ ID NO: 506072 - protein, 10 aa, Influenza virus
MVDQVRESRN

SEQ ID NO: 506073 - protein, 10 aa, Influenza virus
MVEAESSVKE

SEQ ID NO: 506074 - protein, 10 aa, Influenza virus
MVEAMISRAR

SEQ ID NO: 506075 - protein, 10 aa, Influenza virus
MVEAMMSRAR

SEQ ID NO: 506076 - protein, 10 aa, Influenza virus
MVEAMVSRAR

SEQ ID NO: 506077 - protein, 10 aa, Influenza virus
MVFSQEDCMI

SEQ ID NO: 506078 - protein, 10 aa, Influenza virus
MVFSQEDCMM

SEQ ID NO: 506079 - protein, 10 aa, Influenza virus
MVFSQEDCMV

SEQ ID NO: 506080 - protein, 10 aa, Influenza virus
MVFSQEECMI

SEQ ID NO: 506081 - protein, 10 aa, Influenza virus
MVGLILAFIM

SEQ ID NO: 506082 - protein, 10 aa, Influenza virus
MVHAMRTIGT

SEQ ID NO: 506083 - protein, 10 aa, Influenza virus
MVIASTTAKA

SEQ ID NO: 506084 - protein, 10 aa, Influenza virus
MVKAVRGDLN

SEQ ID NO: 506085 - protein, 10 aa, Influenza virus
MVKRGINDRN

SEQ ID NO: 506086 - protein, 10 aa, Influenza virus
MVKSDKICLG

SEQ ID NO: 506087 - protein, 10 aa, Influenza virus
MVLASTTAKA

SEQ ID NO: 506088 - protein, 10 aa, Influenza virus
MVLLQCRICI

SEQ ID NO: 506089 - protein, 10 aa, Influenza virus
MVLSAFDERR

SEQ ID NO: 506090 - protein, 10 aa, Influenza virus
MVNERTLDFH

SEQ ID NO: 506091 - protein, 10 aa, Influenza virus
MVNGWYGFRH

SEQ ID NO: 506092 - protein, 10 aa, Influenza virus
MVQAMRAIGT

SEQ ID NO: 506093 - protein, 10 aa, Influenza virus
MVQAMRAVGT

SEQ ID NO: 506094 - protein, 10 aa, Influenza virus
MVQAMRTIGT

SEQ ID NO: 506095 - protein, 10 aa, Influenza virus
MVQAMRTVGT

SEQ ID NO: 506096 - protein, 10 aa, Influenza virus
MVRSDKICLG

SEQ ID NO: 506097 - protein, 10 aa, Influenza virus
MVSPLAITWW

SEQ ID NO: 506098 - protein, 10 aa, Influenza virus
MVSPLAVTWW

SEQ ID NO: 506099 - protein, 10 aa, Influenza virus
MVSRARIDAR

SEQ ID NO: 506100 - protein, 10 aa, Influenza virus
MVTFCGLDNE

SEQ ID NO: 506101 - protein, 10 aa, Influenza virus
MVTGLRNIPS

SEQ ID NO: 506102 - protein, 10 aa, Influenza virus
MVTQRTIGKK

SEQ ID NO: 506103 - protein, 10 aa, Influenza virus
MVTQRTIGKR

SEQ ID NO: 506104 - protein, 10 aa, Influenza virus
MVTQRTMGKK

SEQ ID NO: 506105 - protein, 10 aa, Influenza virus
MVTQRTVGKK

SEQ ID NO: 506106 - protein, 10 aa, Influenza virus
MVVYAELLVA

SEQ ID NO: 506107 - protein, 10 aa, Influenza virus
MVWDANGWVS

SEQ ID NO: 506108 - protein, 10 aa, Influenza virus
MVWDANGWVT

SEQ ID NO: 506109 - protein, 10 aa, Influenza virus
MWACNSGNCR

SEQ ID NO: 506110 - protein, 10 aa, Influenza virus
MWACQKGNIK

SEQ ID NO: 506111 - protein, 10 aa, Influenza virus
MWACQKGNIR

SEQ ID NO: 506112 - protein, 10 aa, Influenza virus
MWACQRGNIR

SEQ ID NO: 506113 - protein, 10 aa, Influenza virus
MWACSNGNCR

SEQ ID NO: 506114 - protein, 10 aa, Influenza virus
MWACSNGSCR

SEQ ID NO: 506115 - protein, 10 aa, Influenza virus
MWACSSGNCR

SEQ ID NO: 506116 - protein, 10 aa, Influenza virus
MWAIHHPPTS

SEQ ID NO: 506117 - protein, 10 aa, Influenza virus
MWALGENMAP

SEQ ID NO: 506118 - protein, 10 aa, Influenza virus
MWEINGPDSV

SEQ ID NO: 506119 - protein, 10 aa, Influenza virus
MWEINGPESV

SEQ ID NO: 506120 - protein, 10 aa, Influenza virus
MWEVNGPESV

SEQ ID NO: 506121 - protein, 10 aa, Influenza virus
MWTCNSGNCR

SEQ ID NO: 506122 - protein, 10 aa, Influenza virus
MYALHQGTTI

SEQ ID NO: 506123 - protein, 10 aa, Influenza virus
MYQKCCNLFE

SEQ ID NO: 506124 - protein, 10 aa, Influenza virus
MYQKCCSLFE

SEQ ID NO: 506125 - protein, 10 aa, Influenza virus
MYQKCCTLFE

SEQ ID NO: 506126 - protein, 10 aa, Influenza virus
MYQRCCNLFE

SEQ ID NO: 506127 - protein, 10 aa, Influenza virus
MYSDFHFIDE

SEQ ID NO: 506128 - protein, 10 aa, Influenza virus
MYSDFHFINE

SEQ ID NO: 506129 - protein, 10 aa, Influenza virus
NAALGSPGCD

SEQ ID NO: 506130 - protein, 10 aa, Influenza virus
NAASYKRIRL

SEQ ID NO: 506131 - protein, 10 aa, Influenza virus
NADHRIYWIR

SEQ ID NO: 506132 - protein, 10 aa, Influenza virus
NADHRVYWIR

SEQ ID NO: 506133 - protein, 10 aa, Influenza virus
NADKICLGHH

SEQ ID NO: 506134 - protein, 10 aa, Influenza virus
NADLEALMEW

SEQ ID NO: 506135 - protein, 10 aa, Influenza virus
NADLLVAMEN

SEQ ID NO: 506136 - protein, 10 aa, Influenza virus
NADVLVALEN

SEQ ID NO: 506137 - protein, 10 aa, Influenza virus
NAEDIGNGCF

SEQ ID NO: 506138 - protein, 10 aa, Influenza virus
NAEDKGNGCF

SEQ ID NO: 506139 - protein, 10 aa, Influenza virus
NAEDMGDGCF

SEQ ID NO: 506140 - protein, 10 aa, Influenza virus
NAEDMGGGCF

SEQ ID NO: 506141 - protein, 10 aa, Influenza virus
NAEDMGNGCF

SEQ ID NO: 506142 - protein, 10 aa, Influenza virus
NAEDMGNGCL

SEQ ID NO: 506143 - protein, 10 aa, Influenza virus
NAEDQGNGCF

SEQ ID NO: 506144 - protein, 10 aa, Influenza virus
NAEDRGNGCF

SEQ ID NO: 506145 - protein, 10 aa, Influenza virus
NAEEDCTGCF

SEQ ID NO: 506146 - protein, 10 aa, Influenza virus
NAEEDGKGCF

SEQ ID NO: 506147 - protein, 10 aa, Influenza virus
NAEEDGNGCF

SEQ ID NO: 506148 - protein, 10 aa, Influenza virus
NAEEDGRGCF

SEQ ID NO: 506149 - protein, 10 aa, Influenza virus
NAEEDGTGCF

SEQ ID NO: 506150 - protein, 10 aa, Influenza virus
NAEEMGNGCF

SEQ ID NO: 506151 - protein, 10 aa, Influenza virus
NAEFFVLMEN

SEQ ID NO: 506152 - protein, 10 aa, Influenza virus
NAEFLVALEN

SEQ ID NO: 506153 - protein, 10 aa, Influenza virus
NAEFLVAVEN

SEQ ID NO: 506154 - protein, 10 aa, Influenza virus
NAEGIGIAAD

SEQ ID NO: 506155 - protein, 10 aa, Influenza virus
NAEGTGIAAD

SEQ ID NO: 506156 - protein, 10 aa, Influenza virus
NAEGTGMAAD

SEQ ID NO: 506157 - protein, 10 aa, Influenza virus
NAEGTGTAAD

SEQ ID NO: 506158 - protein, 10 aa, Influenza virus
NAEIEDLIFL

SEQ ID NO: 506159 - protein, 10 aa, Influenza virus
NAEIEDLIFM

SEQ ID NO: 506160 - protein, 10 aa, Influenza virus
NAEIEDLIFS

SEQ ID NO: 506161 - protein, 10 aa, Influenza virus
NAEIEDLTFL

SEQ ID NO: 506162 - protein, 10 aa, Influenza virus
NAEILVALEN

SEQ ID NO: 506163 - protein, 10 aa, Influenza virus
NAEILVLMEN

SEQ ID NO: 506164 - protein, 10 aa, Influenza virus
NAELFVLMEN

SEQ ID NO: 506165 - protein, 10 aa, Influenza virus
NAELIVLLEN

SEQ ID NO: 506166 - protein, 10 aa, Influenza virus
NAELLIALEN

SEQ ID NO: 506167 - protein, 10 aa, Influenza virus
NAELLIAMEN

SEQ ID NO: 506168 - protein, 10 aa, Influenza virus
NAELLILLEN

SEQ ID NO: 506169 - protein, 10 aa, Influenza virus
NAELLVALEN

SEQ ID NO: 506170 - protein, 10 aa, Influenza virus
NAELLVAMEN

SEQ ID NO: 506171 - protein, 10 aa, Influenza virus
NAELLVLIEN

SEQ ID NO: 506172 - protein, 10 aa, Influenza virus
NAELLVLLED

SEQ ID NO: 506173 - protein, 10 aa, Influenza virus
NAELLVLLEN

SEQ ID NO: 506174 - protein, 10 aa, Influenza virus
NAELLVLLGN

SEQ ID NO: 506175 - protein, 10 aa, Influenza virus
NAELLVLMEN

SEQ ID NO: 506176 - protein, 10 aa, Influenza virus
NAEVLVLMEN

SEQ ID NO: 506177 - protein, 10 aa, Influenza virus
NAGKDPKKTG

SEQ ID NO: 506178 - protein, 10 aa, Influenza virus
NAGLLVALEN

SEQ ID NO: 506179 - protein, 10 aa, Influenza virus
NAHDRICIGY

SEQ ID NO: 506180 - protein, 10 aa, Influenza virus
NAHILVTREP

SEQ ID NO: 506181 - protein, 10 aa, Influenza virus
NAHKMESRGL

SEQ ID NO: 506182 - protein, 10 aa, Influenza virus
NAIDAGDGCF

SEQ ID NO: 506183 - protein, 10 aa, Influenza virus
NAIDAGNGCF

SEQ ID NO: 506184 - protein, 10 aa, Influenza virus
NAIDEGDGCF

SEQ ID NO: 506185 - protein, 10 aa, Influenza virus
NAIDEGNGCF

SEQ ID NO: 506186 - protein, 10 aa, Influenza virus
NAIDNGDGCF
